United States Patent 11,369,692 (MATERIALS AND METHODS FOR TREATMENT OF DUCHENNE MUSCULAR DYSTROPHY) - sequence listing, part 31

SEQ ID NO: 1024506 - DNA, 22 bp, Artificial Sequence
  chemically synthesized
tacaagtaaataaataactata

SEQ ID NO: 1024507 - DNA, 22 bp, Artificial Sequence
  chemically synthesized
atacaagtaaataaataactat

SEQ ID NO: 1024508 - DNA, 22 bp, Artificial Sequence
  chemically synthesized
ctgaagtcatatagttatttat

SEQ ID NO: 1024509 - DNA, 22 bp, Artificial Sequence
  chemically synthesized
tgaagtcatatagttatttatt

SEQ ID NO: 1024510 - DNA, 22 bp, Artificial Sequence
  chemically synthesized
aagtcatatagttatttattta

SEQ ID NO: 1024511 - DNA, 22 bp, Artificial Sequence
  chemically synthesized
tttatttacttgtataaaccat

SEQ ID NO: 1024512 - DNA, 22 bp, Artificial Sequence
  chemically synthesized
atttacttgtataaaccatctt

SEQ ID NO: 1024513 - DNA, 22 bp, Artificial Sequence
  chemically synthesized
tttacttgtataaaccatctta

SEQ ID NO: 1024514 - DNA, 22 bp, Artificial Sequence
  chemically synthesized
acttgtataaaccatcttatca

SEQ ID NO: 1024515 - DNA, 22 bp, Artificial Sequence
  chemically synthesized
caaaaaagaatatgataagatg

SEQ ID NO: 1024516 - DNA, 22 bp, Artificial Sequence
  chemically synthesized
cttgtataaaccatcttatcat

SEQ ID NO: 1024517 - DNA, 22 bp, Artificial Sequence
  chemically synthesized
gtataaaccatcttatcatatt

SEQ ID NO: 1024518 - DNA, 22 bp, Artificial Sequence
  chemically synthesized
tataaaccatcttatcatattc

SEQ ID NO: 1024519 - DNA, 22 bp, Artificial Sequence
  chemically synthesized
atcatattcttttttggagctg

SEQ ID NO: 1024520 - DNA, 22 bp, Artificial Sequence
  chemically synthesized
tcatattcttttttggagctgt

SEQ ID NO: 1024521 - DNA, 22 bp, Artificial Sequence
  chemically synthesized
aaagatatgtaaacagctccaa

SEQ ID NO: 1024522 - DNA, 22 bp, Artificial Sequence
  chemically synthesized
ttttttggagctgtttacatat

SEQ ID NO: 1024523 - DNA, 22 bp, Artificial Sequence
  chemically synthesized
agagattaaaagatatgtaaac

SEQ ID NO: 1024524 - DNA, 22 bp, Artificial Sequence
  chemically synthesized
ttttggagctgtttacatatct

SEQ ID NO: 1024525 - DNA, 22 bp, Artificial Sequence
  chemically synthesized
tttggagctgtttacatatctt

SEQ ID NO: 1024526 - DNA, 22 bp, Artificial Sequence
  chemically synthesized
ttggagctgtttacatatcttt

SEQ ID NO: 1024527 - DNA, 22 bp, Artificial Sequence
  chemically synthesized
gttcagagattaaaagatatgt

SEQ ID NO: 1024528 - DNA, 22 bp, Artificial Sequence
  chemically synthesized
tggagctgtttacatatctttt

SEQ ID NO: 1024529 - DNA, 22 bp, Artificial Sequence
  chemically synthesized
agttcagagattaaaagatatg

SEQ ID NO: 1024530 - DNA, 22 bp, Artificial Sequence
  chemically synthesized
ggagctgtttacatatctttta

SEQ ID NO: 1024531 - DNA, 22 bp, Artificial Sequence
  chemically synthesized
gagctgtttacatatcttttaa

SEQ ID NO: 1024532 - DNA, 22 bp, Artificial Sequence
  chemically synthesized
ttagttcagagattaaaagata

SEQ ID NO: 1024533 - DNA, 22 bp, Artificial Sequence
  chemically synthesized
cttagttcagagattaaaagat

SEQ ID NO: 1024534 - DNA, 22 bp, Artificial Sequence
  chemically synthesized
atttcttagttcagagattaaa

SEQ ID NO: 1024535 - DNA, 22 bp, Artificial Sequence
  chemically synthesized
tttacatatcttttaatctctg

SEQ ID NO: 1024536 - DNA, 22 bp, Artificial Sequence
  chemically synthesized
aatttcttagttcagagattaa

SEQ ID NO: 1024537 - DNA, 22 bp, Artificial Sequence
  chemically synthesized
taatttcttagttcagagatta

SEQ ID NO: 1024538 - DNA, 22 bp, Artificial Sequence
  chemically synthesized
acatatcttttaatctctgaac

SEQ ID NO: 1024539 - DNA, 22 bp, Artificial Sequence
  chemically synthesized
catatcttttaatctctgaact

SEQ ID NO: 1024540 - DNA, 22 bp, Artificial Sequence
  chemically synthesized
ttaatctctgaactaagaaatt

SEQ ID NO: 1024541 - DNA, 22 bp, Artificial Sequence
  chemically synthesized
taatctctgaactaagaaatta

SEQ ID NO: 1024542 - DNA, 22 bp, Artificial Sequence
  chemically synthesized
aatctctgaactaagaaattaa

SEQ ID NO: 1024543 - DNA, 22 bp, Artificial Sequence
  chemically synthesized
tcaaatacaattttaatttctt

SEQ ID NO: 1024544 - DNA, 22 bp, Artificial Sequence
  chemically synthesized
atctctgaactaagaaattaaa

SEQ ID NO: 1024545 - DNA, 22 bp, Artificial Sequence
  chemically synthesized
ttgtcaaatacaattttaattt

SEQ ID NO: 1024546 - DNA, 22 bp, Artificial Sequence
  chemically synthesized
tgaactaagaaattaaaattgt

SEQ ID NO: 1024547 - DNA, 22 bp, Artificial Sequence
  chemically synthesized
attgttgtcaaatacaatttta

SEQ ID NO: 1024548 - DNA, 22 bp, Artificial Sequence
  chemically synthesized
aactaagaaattaaaattgtat

SEQ ID NO: 1024549 - DNA, 22 bp, Artificial Sequence
  chemically synthesized
agaaattaaaattgtatttgac

SEQ ID NO: 1024550 - DNA, 22 bp, Artificial Sequence
  chemically synthesized
agtcactaattgttgtcaaata

SEQ ID NO: 1024551 - DNA, 22 bp, Artificial Sequence
  chemically synthesized
gagtcactaattgttgtcaaat

SEQ ID NO: 1024552 - DNA, 22 bp, Artificial Sequence
  chemically synthesized
aaattgtatttgacaacaatta

SEQ ID NO: 1024553 - DNA, 22 bp, Artificial Sequence
  chemically synthesized
taatttgagtcactaattgttg

SEQ ID NO: 1024554 - DNA, 22 bp, Artificial Sequence
  chemically synthesized
attataatttgagtcactaatt

SEQ ID NO: 1024555 - DNA, 22 bp, Artificial Sequence
  chemically synthesized
tatttgacaacaattagtgact

SEQ ID NO: 1024556 - DNA, 22 bp, Artificial Sequence
  chemically synthesized
aattataatttgagtcactaat

SEQ ID NO: 1024557 - DNA, 22 bp, Artificial Sequence
  chemically synthesized
taattataatttgagtcactaa

SEQ ID NO: 1024558 - DNA, 22 bp, Artificial Sequence
  chemically synthesized
gacaacaattagtgactcaaat

SEQ ID NO: 1024559 - DNA, 22 bp, Artificial Sequence
  chemically synthesized
acaacaattagtgactcaaatt

SEQ ID NO: 1024560 - DNA, 22 bp, Artificial Sequence
  chemically synthesized
gtgactcaaattataattaaaa

SEQ ID NO: 1024561 - DNA, 22 bp, Artificial Sequence
  chemically synthesized
aaattataattaaaatatatgt

SEQ ID NO: 1024562 - DNA, 22 bp, Artificial Sequence
  chemically synthesized
tcgaggtgtgtaacaacatata

SEQ ID NO: 1024563 - DNA, 22 bp, Artificial Sequence
  chemically synthesized
gtcgaggtgtgtaacaacatat

SEQ ID NO: 1024564 - DNA, 22 bp, Artificial Sequence
  chemically synthesized
taattaaaatatatgttgttac

SEQ ID NO: 1024565 - DNA, 22 bp, Artificial Sequence
  chemically synthesized
cttgtcgaggtgtgtaacaaca

SEQ ID NO: 1024566 - DNA, 22 bp, Artificial Sequence
  chemically synthesized
gcttgtcgaggtgtgtaacaac

SEQ ID NO: 1024567 - DNA, 22 bp, Artificial Sequence
  chemically synthesized
aaatatatgttgttacacacct

SEQ ID NO: 1024568 - DNA, 22 bp, Artificial Sequence
  chemically synthesized
agtgcttgcttgtcgaggtgtg

SEQ ID NO: 1024569 - DNA, 22 bp, Artificial Sequence
  chemically synthesized
tgagtgcttgcttgtcgaggtg

SEQ ID NO: 1024570 - DNA, 22 bp, Artificial Sequence
  chemically synthesized
ctgagtgcttgcttgtcgaggt

SEQ ID NO: 1024571 - DNA, 22 bp, Artificial Sequence
  chemically synthesized
ttacacacctcgacaagcaagc

SEQ ID NO: 1024572 - DNA, 22 bp, Artificial Sequence
  chemically synthesized
cacacctcgacaagcaagcact

SEQ ID NO: 1024573 - DNA, 22 bp, Artificial Sequence
  chemically synthesized
gacaagcaagcactcagaaacc

SEQ ID NO: 1024574 - DNA, 22 bp, Artificial Sequence
  chemically synthesized
atagaaacagaatataaagtgg

SEQ ID NO: 1024575 - DNA, 22 bp, Artificial Sequence
  chemically synthesized
agaaacccactttatattctgt

SEQ ID NO: 1024576 - DNA, 22 bp, Artificial Sequence
  chemically synthesized
gtatcctaatagaaacagaata

SEQ ID NO: 1024577 - DNA, 22 bp, Artificial Sequence
  chemically synthesized
tatattctgtttctattaggat

SEQ ID NO: 1024578 - DNA, 22 bp, Artificial Sequence
  chemically synthesized
atattctgtttctattaggata

SEQ ID NO: 1024579 - DNA, 22 bp, Artificial Sequence
  chemically synthesized
tattctgtttctattaggatac

SEQ ID NO: 1024580 - DNA, 22 bp, Artificial Sequence
  chemically synthesized
tgtttctattaggatactaatt

SEQ ID NO: 1024581 - DNA, 22 bp, Artificial Sequence
  chemically synthesized
gaatagtgccataattagtatc

SEQ ID NO: 1024582 - DNA, 22 bp, Artificial Sequence
  chemically synthesized
ggaatagtgccataattagtat

SEQ ID NO: 1024583 - DNA, 22 bp, Artificial Sequence
  chemically synthesized
tttctattaggatactaattat

SEQ ID NO: 1024584 - DNA, 22 bp, Artificial Sequence
  chemically synthesized
tggaatagtgccataattagta

SEQ ID NO: 1024585 - DNA, 22 bp, Artificial Sequence
  chemically synthesized
ttggaatagtgccataattagt

SEQ ID NO: 1024586 - DNA, 22 bp, Artificial Sequence
  chemically synthesized
tttggaatagtgccataattag

SEQ ID NO: 1024587 - DNA, 22 bp, Artificial Sequence
  chemically synthesized
ctattaggatactaattatggc

SEQ ID NO: 1024588 - DNA, 22 bp, Artificial Sequence
  chemically synthesized
ttttggaatagtgccataatta

SEQ ID NO: 1024589 - DNA, 22 bp, Artificial Sequence
  chemically synthesized
tattaggatactaattatggca

SEQ ID NO: 1024590 - DNA, 22 bp, Artificial Sequence
  chemically synthesized
tttttggaatagtgccataatt

SEQ ID NO: 1024591 - DNA, 22 bp, Artificial Sequence
  chemically synthesized
ttttttggaatagtgccataat

SEQ ID NO: 1024592 - DNA, 22 bp, Artificial Sequence
  chemically synthesized
ttaggatactaattatggcact

SEQ ID NO: 1024593 - DNA, 22 bp, Artificial Sequence
  chemically synthesized
tttttttggaatagtgccataa

SEQ ID NO: 1024594 - DNA, 22 bp, Artificial Sequence
  chemically synthesized
ttttttttggaatagtgccata

SEQ ID NO: 1024595 - DNA, 22 bp, Artificial Sequence
  chemically synthesized
ggatactaattatggcactatt

SEQ ID NO: 1024596 - DNA, 22 bp, Artificial Sequence
  chemically synthesized
tttttttttttggaatagtgcc

SEQ ID NO: 1024597 - DNA, 22 bp, Artificial Sequence
  chemically synthesized
gtttttttttttggaatagtgc

SEQ ID NO: 1024598 - DNA, 22 bp, Artificial Sequence
  chemically synthesized
tgtttttttttttggaatagtg

SEQ ID NO: 1024599 - DNA, 22 bp, Artificial Sequence
  chemically synthesized
tttgtttttttttttggaatag

SEQ ID NO: 1024600 - DNA, 22 bp, Artificial Sequence
  chemically synthesized
ctttgtttttttttttggaata

SEQ ID NO: 1024601 - DNA, 22 bp, Artificial Sequence
  chemically synthesized
attatggcactattccaaaaaa

SEQ ID NO: 1024602 - DNA, 22 bp, Artificial Sequence
  chemically synthesized
tttctttgtttttttttttgga

SEQ ID NO: 1024603 - DNA, 22 bp, Artificial Sequence
  chemically synthesized
gtttctttgtttttttttttgg

SEQ ID NO: 1024604 - DNA, 22 bp, Artificial Sequence
  chemically synthesized
tgtttctttgtttttttttttg

SEQ ID NO: 1024605 - DNA, 22 bp, Artificial Sequence
  chemically synthesized
tggcactattccaaaaaaaaaa

SEQ ID NO: 1024606 - DNA, 22 bp, Artificial Sequence
  chemically synthesized
ctttgtttctttgttttttttt

SEQ ID NO: 1024607 - DNA, 22 bp, Artificial Sequence
  chemically synthesized
attactttgtttctttgttttt

SEQ ID NO: 1024608 - DNA, 22 bp, Artificial Sequence
  chemically synthesized
ttccaaaaaaaaaaacaaagaa

SEQ ID NO: 1024609 - DNA, 22 bp, Artificial Sequence
  chemically synthesized
caaaaaaaaaaacaaagaaaca

SEQ ID NO: 1024610 - DNA, 22 bp, Artificial Sequence
  chemically synthesized
caatgagttaattactttgttt

SEQ ID NO: 1024611 - DNA, 22 bp, Artificial Sequence
  chemically synthesized
gcaatgagttaattactttgtt

SEQ ID NO: 1024612 - DNA, 22 bp, Artificial Sequence
  chemically synthesized
tgtttgcaatgagttaattact

SEQ ID NO: 1024613 - DNA, 22 bp, Artificial Sequence
  chemically synthesized
atagtattgtgtttgcaatgag

SEQ ID NO: 1024614 - DNA, 22 bp, Artificial Sequence
  chemically synthesized
aaattaatagtattgtgtttgc

SEQ ID NO: 1024615 - DNA, 22 bp, Artificial Sequence
  chemically synthesized
actcattgcaaacacaatacta

SEQ ID NO: 1024616 - DNA, 22 bp, Artificial Sequence
  chemically synthesized
attgcaaacacaatactattaa

SEQ ID NO: 1024617 - DNA, 22 bp, Artificial Sequence
  chemically synthesized
caaacacaatactattaatttt

SEQ ID NO: 1024618 - DNA, 22 bp, Artificial Sequence
  chemically synthesized
agaaccaaggagttaaaattaa

SEQ ID NO: 1024619 - DNA, 22 bp, Artificial Sequence
  chemically synthesized
ttgagaaccaaggagttaaaat

SEQ ID NO: 1024620 - DNA, 22 bp, Artificial Sequence
  chemically synthesized
attgagaaccaaggagttaaaa

SEQ ID NO: 1024621 - DNA, 22 bp, Artificial Sequence
  chemically synthesized
tattgagaaccaaggagttaaa

SEQ ID NO: 1024622 - DNA, 22 bp, Artificial Sequence
  chemically synthesized
aaattttattgagaaccaagga

SEQ ID NO: 1024623 - DNA, 22 bp, Artificial Sequence
  chemically synthesized
ttaattttaactccttggttct

SEQ ID NO: 1024624 - DNA, 22 bp, Artificial Sequence
  chemically synthesized
attttaactccttggttctcaa

SEQ ID NO: 1024625 - DNA, 22 bp, Artificial Sequence
  chemically synthesized
gctcaaattttattgagaacca

SEQ ID NO: 1024626 - DNA, 22 bp, Artificial Sequence
  chemically synthesized
ctagctcaaattttattgagaa

SEQ ID NO: 1024627 - DNA, 22 bp, Artificial Sequence
  chemically synthesized
taactccttggttctcaataaa

SEQ ID NO: 1024628 - DNA, 22 bp, Artificial Sequence
  chemically synthesized
aactccttggttctcaataaaa

SEQ ID NO: 1024629 - DNA, 22 bp, Artificial Sequence
  chemically synthesized
actccttggttctcaataaaat

SEQ ID NO: 1024630 - DNA, 22 bp, Artificial Sequence
  chemically synthesized
cttggttctcaataaaatttga

SEQ ID NO: 1024631 - DNA, 22 bp, Artificial Sequence
  chemically synthesized
cgtggttactagctcaaatttt

SEQ ID NO: 1024632 - DNA, 22 bp, Artificial Sequence
  chemically synthesized
ggttctcaataaaatttgagct

SEQ ID NO: 1024633 - DNA, 22 bp, Artificial Sequence
  chemically synthesized
gttctcaataaaatttgagcta

SEQ ID NO: 1024634 - DNA, 22 bp, Artificial Sequence
  chemically synthesized
attacgtggttactagctcaaa

SEQ ID NO: 1024635 - DNA, 22 bp, Artificial Sequence
  chemically synthesized
tcaataaaatttgagctagtaa

SEQ ID NO: 1024636 - DNA, 22 bp, Artificial Sequence
  chemically synthesized
aataaaatttgagctagtaacc

SEQ ID NO: 1024637 - DNA, 22 bp, Artificial Sequence
  chemically synthesized
ataattaattacgtggttacta

SEQ ID NO: 1024638 - DNA, 22 bp, Artificial Sequence
  chemically synthesized
gagctagtaaccacgtaattaa

SEQ ID NO: 1024639 - DNA, 22 bp, Artificial Sequence
  chemically synthesized
agcaattaataattaattacgt

SEQ ID NO: 1024640 - DNA, 22 bp, Artificial Sequence
  chemically synthesized
agctagtaaccacgtaattaat

SEQ ID NO: 1024641 - DNA, 22 bp, Artificial Sequence
  chemically synthesized
gtaaccacgtaattaattatta

SEQ ID NO: 1024642 - DNA, 22 bp, Artificial Sequence
  chemically synthesized
gcatagtggagtgcactgagca

SEQ ID NO: 1024643 - DNA, 22 bp, Artificial Sequence
  chemically synthesized
ggcatagtggagtgcactgagc

SEQ ID NO: 1024644 - DNA, 22 bp, Artificial Sequence
  chemically synthesized
attattaattgctcagtgcact

SEQ ID NO: 1024645 - DNA, 22 bp, Artificial Sequence
  chemically synthesized
acttggcatagtggagtgcact

SEQ ID NO: 1024646 - DNA, 22 bp, Artificial Sequence
  chemically synthesized
ttaattgctcagtgcactccac

SEQ ID NO: 1024647 - DNA, 22 bp, Artificial Sequence
  chemically synthesized
attgctcagtgcactccactat

SEQ ID NO: 1024648 - DNA, 22 bp, Artificial Sequence
  chemically synthesized
ataattaacttggcatagtgga

SEQ ID NO: 1024649 - DNA, 22 bp, Artificial Sequence
  chemically synthesized
gataattaacttggcatagtgg

SEQ ID NO: 1024650 - DNA, 22 bp, Artificial Sequence
  chemically synthesized
ctcagtgcactccactatgcca

SEQ ID NO: 1024651 - DNA, 22 bp, Artificial Sequence
  chemically synthesized
ttgataattaacttggcatagt

SEQ ID NO: 1024652 - DNA, 22 bp, Artificial Sequence
  chemically synthesized
agtgcactccactatgccaagt

SEQ ID NO: 1024653 - DNA, 22 bp, Artificial Sequence
  chemically synthesized
ttcttgataattaacttggcat

SEQ ID NO: 1024654 - DNA, 22 bp, Artificial Sequence
  chemically synthesized
cactatgccaagttaattatca

SEQ ID NO: 1024655 - DNA, 22 bp, Artificial Sequence
  chemically synthesized
tgccaagttaattatcaagaat

SEQ ID NO: 1024656 - DNA, 22 bp, Artificial Sequence
  chemically synthesized
attatcaagaataacttggtgt

SEQ ID NO: 1024657 - DNA, 22 bp, Artificial Sequence
  chemically synthesized
ataataaaagtcacaccaagtt

SEQ ID NO: 1024658 - DNA, 22 bp, Artificial Sequence
  chemically synthesized
tcaagaataacttggtgtgact

SEQ ID NO: 1024659 - DNA, 22 bp, Artificial Sequence
  chemically synthesized
tccattcataataaaagtcaca

SEQ ID NO: 1024660 - DNA, 22 bp, Artificial Sequence
  chemically synthesized
taattatccattcataataaaa

SEQ ID NO: 1024661 - DNA, 22 bp, Artificial Sequence
  chemically synthesized
ggtgtgacttttattatgaatg

SEQ ID NO: 1024662 - DNA, 22 bp, Artificial Sequence
  chemically synthesized
gtgtgacttttattatgaatgg

SEQ ID NO: 1024663 - DNA, 22 bp, Artificial Sequence
  chemically synthesized
ttattatgaatggataattaca

SEQ ID NO: 1024664 - DNA, 22 bp, Artificial Sequence
  chemically synthesized
gaaaaacaaggttgtaattatc

SEQ ID NO: 1024665 - DNA, 22 bp, Artificial Sequence
  chemically synthesized
tattatgaatggataattacaa

SEQ ID NO: 1024666 - DNA, 22 bp, Artificial Sequence
  chemically synthesized
attatgaatggataattacaac

SEQ ID NO: 1024667 - DNA, 22 bp, Artificial Sequence
  chemically synthesized
tagaaaaacaaggttgtaatta

SEQ ID NO: 1024668 - DNA, 22 bp, Artificial Sequence
  chemically synthesized
ttatgaatggataattacaacc

SEQ ID NO: 1024669 - DNA, 22 bp, Artificial Sequence
  chemically synthesized
tgaatggataattacaaccttg

SEQ ID NO: 1024670 - DNA, 22 bp, Artificial Sequence
  chemically synthesized
ataattctagaaaaacaaggtt

SEQ ID NO: 1024671 - DNA, 22 bp, Artificial Sequence
  chemically synthesized
aaatcctgataattctagaaaa

SEQ ID NO: 1024672 - DNA, 22 bp, Artificial Sequence
  chemically synthesized
aaaatcctgataattctagaaa

SEQ ID NO: 1024673 - DNA, 22 bp, Artificial Sequence
  chemically synthesized
caaccttgtttttctagaatta

SEQ ID NO: 1024674 - DNA, 22 bp, Artificial Sequence
  chemically synthesized
atgtttaaaatcctgataattc

SEQ ID NO: 1024675 - DNA, 22 bp, Artificial Sequence
  chemically synthesized
catgtttaaaatcctgataatt

SEQ ID NO: 1024676 - DNA, 22 bp, Artificial Sequence
  chemically synthesized
tcatgtttaaaatcctgataat

SEQ ID NO: 1024677 - DNA, 22 bp, Artificial Sequence
  chemically synthesized
gtttttctagaattatcaggat

SEQ ID NO: 1024678 - DNA, 22 bp, Artificial Sequence
  chemically synthesized
tttttctagaattatcaggatt

SEQ ID NO: 1024679 - DNA, 22 bp, Artificial Sequence
  chemically synthesized
ttttcatgtttaaaatcctgat

SEQ ID NO: 1024680 - DNA, 22 bp, Artificial Sequence
  chemically synthesized
ttctagaattatcaggatttta

SEQ ID NO: 1024681 - DNA, 22 bp, Artificial Sequence
  chemically synthesized
tctagaattatcaggattttaa

SEQ ID NO: 1024682 - DNA, 22 bp, Artificial Sequence
  chemically synthesized
ttattttcatgtttaaaatcct

SEQ ID NO: 1024683 - DNA, 22 bp, Artificial Sequence
  chemically synthesized
ctagaattatcaggattttaaa

SEQ ID NO: 1024684 - DNA, 22 bp, Artificial Sequence
  chemically synthesized
tagaattatcaggattttaaac

SEQ ID NO: 1024685 - DNA, 22 bp, Artificial Sequence
  chemically synthesized
gaattatcaggattttaaacat

SEQ ID NO: 1024686 - DNA, 22 bp, Artificial Sequence
  chemically synthesized
attattattttcatgtttaaaa

SEQ ID NO: 1024687 - DNA, 22 bp, Artificial Sequence
  chemically synthesized
cattattattttcatgtttaaa

SEQ ID NO: 1024688 - DNA, 22 bp, Artificial Sequence
  chemically synthesized
ccttcattattattttcatgtt

SEQ ID NO: 1024689 - DNA, 22 bp, Artificial Sequence
  chemically synthesized
tcaggattttaaacatgaaaat

SEQ ID NO: 1024690 - DNA, 22 bp, Artificial Sequence
  chemically synthesized
accttcattattattttcatgt

SEQ ID NO: 1024691 - DNA, 22 bp, Artificial Sequence
  chemically synthesized
taccttcattattattttcatg

SEQ ID NO: 1024692 - DNA, 22 bp, Artificial Sequence
  chemically synthesized
tatctttaccttcattattatt

SEQ ID NO: 1024693 - DNA, 22 bp, Artificial Sequence
  chemically synthesized
taaacatgaaaataataatgaa

SEQ ID NO: 1024694 - DNA, 22 bp, Artificial Sequence
  chemically synthesized
aaacatgaaaataataatgaag

SEQ ID NO: 1024695 - DNA, 22 bp, Artificial Sequence
  chemically synthesized
aacatgaaaataataatgaagg

SEQ ID NO: 1024696 - DNA, 22 bp, Artificial Sequence
  chemically synthesized
agagcaatgcctatatctttac

SEQ ID NO: 1024697 - DNA, 22 bp, Artificial Sequence
  chemically synthesized
aagagcaatgcctatatcttta

SEQ ID NO: 1024698 - DNA, 22 bp, Artificial Sequence
  chemically synthesized
gcatatcagcatatttaagagc

SEQ ID NO: 1024699 - DNA, 22 bp, Artificial Sequence
  chemically synthesized
ataatgattagcatatcagcat

SEQ ID NO: 1024700 - DNA, 22 bp, Artificial Sequence
  chemically synthesized
cataatgattagcatatcagca

SEQ ID NO: 1024701 - DNA, 22 bp, Artificial Sequence
  chemically synthesized
ctcttaaatatgctgatatgct

SEQ ID NO: 1024702 - DNA, 22 bp, Artificial Sequence
  chemically synthesized
tttcataatgattagcatatca

SEQ ID NO: 1024703 - DNA, 22 bp, Artificial Sequence
  chemically synthesized
ttaaatatgctgatatgctaat

SEQ ID NO: 1024704 - DNA, 22 bp, Artificial Sequence
  chemically synthesized
ttatttcataatgattagcata

SEQ ID NO: 1024705 - DNA, 22 bp, Artificial Sequence
  chemically synthesized
aaatatgctgatatgctaatca

SEQ ID NO: 1024706 - DNA, 22 bp, Artificial Sequence
  chemically synthesized
aatatgctgatatgctaatcat

SEQ ID NO: 1024707 - DNA, 22 bp, Artificial Sequence
  chemically synthesized
atatgctaatcattatgaaata

SEQ ID NO: 1024708 - DNA, 22 bp, Artificial Sequence
  chemically synthesized
taaaaatgaacatcctattatt

SEQ ID NO: 1024709 - DNA, 22 bp, Artificial Sequence
  chemically synthesized
atcattatgaaataataggatg

SEQ ID NO: 1024710 - DNA, 22 bp, Artificial Sequence
  chemically synthesized
ttataaaaatgaacatcctatt

SEQ ID NO: 1024711 - DNA, 22 bp, Artificial Sequence
  chemically synthesized
tgaaataataggatgttcattt

SEQ ID NO: 1024712 - DNA, 22 bp, Artificial Sequence
  chemically synthesized
tataagaatgatactattataa

SEQ ID NO: 1024713 - DNA, 22 bp, Artificial Sequence
  chemically synthesized
gtccctatataagaatgatact

SEQ ID NO: 1024714 - DNA, 22 bp, Artificial Sequence
  chemically synthesized
atttttataatagtatcattct

SEQ ID NO: 1024715 - DNA, 22 bp, Artificial Sequence
  chemically synthesized
ggtccctatataagaatgatac

SEQ ID NO: 1024716 - DNA, 22 bp, Artificial Sequence
  chemically synthesized
ttataatagtatcattcttata

SEQ ID NO: 1024717 - DNA, 22 bp, Artificial Sequence
  chemically synthesized
tcttggtccctatataagaatg

SEQ ID NO: 1024718 - DNA, 22 bp, Artificial Sequence
  chemically synthesized
tataatagtatcattcttatat

SEQ ID NO: 1024719 - DNA, 22 bp, Artificial Sequence
  chemically synthesized
ataatagtatcattcttatata

SEQ ID NO: 1024720 - DNA, 22 bp, Artificial Sequence
  chemically synthesized
taatagtatcattcttatatag

SEQ ID NO: 1024721 - DNA, 22 bp, Artificial Sequence
  chemically synthesized
tcctgtcttggtccctatataa

SEQ ID NO: 1024722 - DNA, 22 bp, Artificial Sequence
  chemically synthesized
tatcctgtcttggtccctatat

SEQ ID NO: 1024723 - DNA, 22 bp, Artificial Sequence
  chemically synthesized
ctatcctgtcttggtccctata

SEQ ID NO: 1024724 - DNA, 22 bp, Artificial Sequence
  chemically synthesized
tctatcctgtcttggtccctat

SEQ ID NO: 1024725 - DNA, 22 bp, Artificial Sequence
  chemically synthesized
ttctatcctgtcttggtcccta

SEQ ID NO: 1024726 - DNA, 22 bp, Artificial Sequence
  chemically synthesized
ttatatagggaccaagacagga

SEQ ID NO: 1024727 - DNA, 22 bp, Artificial Sequence
  chemically synthesized
agtacttttctatcctgtcttg

SEQ ID NO: 1024728 - DNA, 22 bp, Artificial Sequence
  chemically synthesized
atatagggaccaagacaggata

SEQ ID NO: 1024729 - DNA, 22 bp, Artificial Sequence
  chemically synthesized
taagtacttttctatcctgtct

SEQ ID NO: 1024730 - DNA, 22 bp, Artificial Sequence
  chemically synthesized
tatagggaccaagacaggatag

SEQ ID NO: 1024731 - DNA, 22 bp, Artificial Sequence
  chemically synthesized
ctaagtacttttctatcctgtc

SEQ ID NO: 1024732 - DNA, 22 bp, Artificial Sequence
  chemically synthesized
tctaagtacttttctatcctgt

SEQ ID NO: 1024733 - DNA, 22 bp, Artificial Sequence
  chemically synthesized
gtactttctaagtacttttcta

SEQ ID NO: 1024734 - DNA, 22 bp, Artificial Sequence
  chemically synthesized
agtactttctaagtacttttct

SEQ ID NO: 1024735 - DNA, 22 bp, Artificial Sequence
  chemically synthesized
gcttagtactttctaagtactt

SEQ ID NO: 1024736 - DNA, 22 bp, Artificial Sequence
  chemically synthesized
agcttagtactttctaagtact

SEQ ID NO: 1024737 - DNA, 22 bp, Artificial Sequence
  chemically synthesized
tttagcttagtactttctaagt

SEQ ID NO: 1024738 - DNA, 22 bp, Artificial Sequence
  chemically synthesized
gtttagcttagtactttctaag

SEQ ID NO: 1024739 - DNA, 22 bp, Artificial Sequence
  chemically synthesized
tttgtttagcttagtactttct

SEQ ID NO: 1024740 - DNA, 22 bp, Artificial Sequence
  chemically synthesized
atttgtttagcttagtactttc

SEQ ID NO: 1024741 - DNA, 22 bp, Artificial Sequence
  chemically synthesized
acttatttgtttagcttagtac

SEQ ID NO: 1024742 - DNA, 22 bp, Artificial Sequence
  chemically synthesized
ttaacttatttgtttagcttag

SEQ ID NO: 1024743 - DNA, 22 bp, Artificial Sequence
  chemically synthesized
gttaacttatttgtttagctta

SEQ ID NO: 1024744 - DNA, 22 bp, Artificial Sequence
  chemically synthesized
tgttaacttatttgtttagctt

SEQ ID NO: 1024745 - DNA, 22 bp, Artificial Sequence
  chemically synthesized
agaaagtactaagctaaacaaa

SEQ ID NO: 1024746 - DNA, 22 bp, Artificial Sequence
  chemically synthesized
gaaagtactaagctaaacaaat

SEQ ID NO: 1024747 - DNA, 22 bp, Artificial Sequence
  chemically synthesized
atcctttgttaacttatttgtt

SEQ ID NO: 1024748 - DNA, 22 bp, Artificial Sequence
  chemically synthesized
agctaaacaaataagttaacaa

SEQ ID NO: 1024749 - DNA, 22 bp, Artificial Sequence
  chemically synthesized
aacaaataagttaacaaaggat

SEQ ID NO: 1024750 - DNA, 22 bp, Artificial Sequence
  chemically synthesized
tatataaaagattcatcctttg

SEQ ID NO: 1024751 - DNA, 22 bp, Artificial Sequence
  chemically synthesized
acaaaggatgaatcttttatat

SEQ ID NO: 1024752 - DNA, 22 bp, Artificial Sequence
  chemically synthesized
acgaatatatatcattatatat

SEQ ID NO: 1024753 - DNA, 22 bp, Artificial Sequence
  chemically synthesized
cacgaatatatatcattatata

SEQ ID NO: 1024754 - DNA, 22 bp, Artificial Sequence
  chemically synthesized
acttcacgaatatatatcatta

SEQ ID NO: 1024755 - DNA, 22 bp, Artificial Sequence
  chemically synthesized
cacttcacgaatatatatcatt

SEQ ID NO: 1024756 - DNA, 22 bp, Artificial Sequence
  chemically synthesized
tcacttcacgaatatatatcat

SEQ ID NO: 1024757 - DNA, 22 bp, Artificial Sequence
  chemically synthesized
ttatatataatgatatatattc

SEQ ID NO: 1024758 - DNA, 22 bp, Artificial Sequence
  chemically synthesized
tatatataatgatatatattcg

SEQ ID NO: 1024759 - DNA, 22 bp, Artificial Sequence
  chemically synthesized
atatataatgatatatattcgt

SEQ ID NO: 1024760 - DNA, 22 bp, Artificial Sequence
  chemically synthesized
gcctttcacttcacgaatatat

SEQ ID NO: 1024761 - DNA, 22 bp, Artificial Sequence
  chemically synthesized
tatataatgatatatattcgtg

SEQ ID NO: 1024762 - DNA, 22 bp, Artificial Sequence
  chemically synthesized
agaattggcctttcacttcacg

SEQ ID NO: 1024763 - DNA, 22 bp, Artificial Sequence
  chemically synthesized
actaagaattggcctttcactt

SEQ ID NO: 1024764 - DNA, 22 bp, Artificial Sequence
  chemically synthesized
atgtctaactaagaattggcct

SEQ ID NO: 1024765 - DNA, 22 bp, Artificial Sequence
  chemically synthesized
gtgaagtgaaaggccaattctt

SEQ ID NO: 1024766 - DNA, 22 bp, Artificial Sequence
  chemically synthesized
gaataaaactaatgtctaacta

SEQ ID NO: 1024767 - DNA, 22 bp, Artificial Sequence
  chemically synthesized
ggctggaataaaactaatgtct

SEQ ID NO: 1024768 - DNA, 22 bp, Artificial Sequence
  chemically synthesized
ctaggctggaataaaactaatg

SEQ ID NO: 1024769 - DNA, 22 bp, Artificial Sequence
  chemically synthesized
tcctaggctggaataaaactaa

SEQ ID NO: 1024770 - DNA, 22 bp, Artificial Sequence
  chemically synthesized
ttagttagacattagttttatt

SEQ ID NO: 1024771 - DNA, 22 bp, Artificial Sequence
  chemically synthesized
agttagacattagttttattcc

SEQ ID NO: 1024772 - DNA, 22 bp, Artificial Sequence
  chemically synthesized
gttagacattagttttattcca

SEQ ID NO: 1024773 - DNA, 22 bp, Artificial Sequence
  chemically synthesized
gacattagttttattccagcct

SEQ ID NO: 1024774 - DNA, 22 bp, Artificial Sequence
  chemically synthesized
gttttattccagcctaggagaa

SEQ ID NO: 1024775 - DNA, 22 bp, Artificial Sequence
  chemically synthesized
tattccagcctaggagaattct

SEQ ID NO: 1024776 - DNA, 22 bp, Artificial Sequence
  chemically synthesized
attccagcctaggagaattctc

SEQ ID NO: 1024777 - DNA, 22 bp, Artificial Sequence
  chemically synthesized
ttccagcctaggagaattctca

SEQ ID NO: 1024778 - DNA, 22 bp, Artificial Sequence
  chemically synthesized
cagcctaggagaattctcattc

SEQ ID NO: 1024779 - DNA, 22 bp, Artificial Sequence
  chemically synthesized
tggtagagcatgggaatgaatg

SEQ ID NO: 1024780 - DNA, 22 bp, Artificial Sequence
  chemically synthesized
atggtagagcatgggaatgaat

SEQ ID NO: 1024781 - DNA, 22 bp, Artificial Sequence
  chemically synthesized
ggagaattctcattcattccca

SEQ ID NO: 1024782 - DNA, 22 bp, Artificial Sequence
  chemically synthesized
ttatggtagagcatgggaatga

SEQ ID NO: 1024783 - DNA, 22 bp, Artificial Sequence
  chemically synthesized
taattcttatggtagagcatgg

SEQ ID NO: 1024784 - DNA, 22 bp, Artificial Sequence
  chemically synthesized
gtaattcttatggtagagcatg

SEQ ID NO: 1024785 - DNA, 22 bp, Artificial Sequence
  chemically synthesized
tcattcattcccatgctctacc

SEQ ID NO: 1024786 - DNA, 22 bp, Artificial Sequence
  chemically synthesized
attcattcccatgctctaccat

SEQ ID NO: 1024787 - DNA, 22 bp, Artificial Sequence
  chemically synthesized
attcccatgctctaccataaga

SEQ ID NO: 1024788 - DNA, 22 bp, Artificial Sequence
  chemically synthesized
gatatttgtaattcttatggta

SEQ ID NO: 1024789 - DNA, 22 bp, Artificial Sequence
  chemically synthesized
agatatttgtaattcttatggt

SEQ ID NO: 1024790 - DNA, 22 bp, Artificial Sequence
  chemically synthesized
ccatgctctaccataagaatta

SEQ ID NO: 1024791 - DNA, 22 bp, Artificial Sequence
  chemically synthesized
taccataagaattacaaatatc

SEQ ID NO: 1024792 - DNA, 22 bp, Artificial Sequence
  chemically synthesized
ccataagaattacaaatatcta

SEQ ID NO: 1024793 - DNA, 22 bp, Artificial Sequence
  chemically synthesized
tacatacatgtacttagatatt

SEQ ID NO: 1024794 - DNA, 22 bp, Artificial Sequence
  chemically synthesized
atacatacatgtacttagatat

SEQ ID NO: 1024795 - DNA, 22 bp, Artificial Sequence
  chemically synthesized
caaatatctaagtacatgtatg

SEQ ID NO: 1024796 - DNA, 22 bp, Artificial Sequence
  chemically synthesized
agcaaatgtttatacatacatg

SEQ ID NO: 1024797 - DNA, 22 bp, Artificial Sequence
  chemically synthesized
agtacatgtatgtataaacatt

SEQ ID NO: 1024798 - DNA, 22 bp, Artificial Sequence
  chemically synthesized
atgcataaccaaaataggttca

SEQ ID NO: 1024799 - DNA, 22 bp, Artificial Sequence
  chemically synthesized
aatgcataaccaaaataggttc

SEQ ID NO: 1024800 - DNA, 22 bp, Artificial Sequence
  chemically synthesized
tttaatgcataaccaaaatagg

SEQ ID NO: 1024801 - DNA, 22 bp, Artificial Sequence
  chemically synthesized
gctgaacctattttggttatgc

SEQ ID NO: 1024802 - DNA, 22 bp, Artificial Sequence
  chemically synthesized
ctgaacctattttggttatgca

SEQ ID NO: 1024803 - DNA, 22 bp, Artificial Sequence
  chemically synthesized
aagattatttaatgcataacca

SEQ ID NO: 1024804 - DNA, 22 bp, Artificial Sequence
  chemically synthesized
aaagattatttaatgcataacc

SEQ ID NO: 1024805 - DNA, 22 bp, Artificial Sequence
  chemically synthesized
aacctattttggttatgcatta

SEQ ID NO: 1024806 - DNA, 22 bp, Artificial Sequence
  chemically synthesized
acatttaaagattatttaatgc

SEQ ID NO: 1024807 - DNA, 22 bp, Artificial Sequence
  chemically synthesized
ttttggttatgcattaaataat

SEQ ID NO: 1024808 - DNA, 22 bp, Artificial Sequence
  chemically synthesized
tggttatgcattaaataatctt

SEQ ID NO: 1024809 - DNA, 22 bp, Artificial Sequence
  chemically synthesized
tgttcacatttaaagattattt

SEQ ID NO: 1024810 - DNA, 22 bp, Artificial Sequence
  chemically synthesized
ggttatgcattaaataatcttt

SEQ ID NO: 1024811 - DNA, 22 bp, Artificial Sequence
  chemically synthesized
gttatgcattaaataatcttta

SEQ ID NO: 1024812 - DNA, 22 bp, Artificial Sequence
  chemically synthesized
ttgtgttcacatttaaagatta

SEQ ID NO: 1024813 - DNA, 22 bp, Artificial Sequence
  chemically synthesized
tgcattaaataatctttaaatg

SEQ ID NO: 1024814 - DNA, 22 bp, Artificial Sequence
  chemically synthesized
ctgttgtgttcacatttaaaga

SEQ ID NO: 1024815 - DNA, 22 bp, Artificial Sequence
  chemically synthesized
actgttgtgttcacatttaaag

SEQ ID NO: 1024816 - DNA, 22 bp, Artificial Sequence
  chemically synthesized
tactgttgtgttcacatttaaa

SEQ ID NO: 1024817 - DNA, 22 bp, Artificial Sequence
  chemically synthesized
aataatctttaaatgtgaacac

SEQ ID NO: 1024818 - DNA, 22 bp, Artificial Sequence
  chemically synthesized
taaatgtgaacacaacagtaaa

SEQ ID NO: 1024819 - DNA, 22 bp, Artificial Sequence
  chemically synthesized
aaatgtgaacacaacagtaaaa

SEQ ID NO: 1024820 - DNA, 22 bp, Artificial Sequence
  chemically synthesized
aatgtgaacacaacagtaaaac

SEQ ID NO: 1024821 - DNA, 22 bp, Artificial Sequence
  chemically synthesized
atgaaaacaaaacatatgtttt

SEQ ID NO: 1024822 - DNA, 22 bp, Artificial Sequence
  chemically synthesized
aaataaaattgatgaaaacaaa

SEQ ID NO: 1024823 - DNA, 22 bp, Artificial Sequence
  chemically synthesized
agtaactgaaataaaattgatg

SEQ ID NO: 1024824 - DNA, 22 bp, Artificial Sequence
  chemically synthesized
actcagtaactgaaataaaatt

SEQ ID NO: 1024825 - DNA, 22 bp, Artificial Sequence
  chemically synthesized
tgttttcatcaattttatttca

SEQ ID NO: 1024826 - DNA, 22 bp, Artificial Sequence
  chemically synthesized
tgactcagtaactgaaataaaa

SEQ ID NO: 1024827 - DNA, 22 bp, Artificial Sequence
  chemically synthesized
gttttcatcaattttatttcag

SEQ ID NO: 1024828 - DNA, 22 bp, Artificial Sequence
  chemically synthesized
ttttcatcaattttatttcagt

SEQ ID NO: 1024829 - DNA, 22 bp, Artificial Sequence
  chemically synthesized
tcatcaattttatttcagttac

SEQ ID NO: 1024830 - DNA, 22 bp, Artificial Sequence
  chemically synthesized
catcaattttatttcagttact

SEQ ID NO: 1024831 - DNA, 22 bp, Artificial Sequence
  chemically synthesized
atcaattttatttcagttactg

SEQ ID NO: 1024832 - DNA, 22 bp, Artificial Sequence
  chemically synthesized
ggcagttctgactcagtaactg

SEQ ID NO: 1024833 - DNA, 22 bp, Artificial Sequence
  chemically synthesized
agttgggcagttctgactcagt

SEQ ID NO: 1024834 - DNA, 22 bp, Artificial Sequence
  chemically synthesized
tatttcagttactgagtcagaa

SEQ ID NO: 1024835 - DNA, 22 bp, Artificial Sequence
  chemically synthesized
atttcagttactgagtcagaac

SEQ ID NO: 1024836 - DNA, 22 bp, Artificial Sequence
  chemically synthesized
ttcagttgggcagttctgactc

SEQ ID NO: 1024837 - DNA, 22 bp, Artificial Sequence
  chemically synthesized
tttcagttactgagtcagaact

SEQ ID NO: 1024838 - DNA, 22 bp, Artificial Sequence
  chemically synthesized
attcagttgggcagttctgact

SEQ ID NO: 1024839 - DNA, 22 bp, Artificial Sequence
  chemically synthesized
tattcagttgggcagttctgac

SEQ ID NO: 1024840 - DNA, 22 bp, Artificial Sequence
  chemically synthesized
cagttactgagtcagaactgcc

SEQ ID NO: 1024841 - DNA, 22 bp, Artificial Sequence
  chemically synthesized
agttactgagtcagaactgccc

SEQ ID NO: 1024842 - DNA, 22 bp, Artificial Sequence
  chemically synthesized
ctgagtcagaactgcccaactg

SEQ ID NO: 1024843 - DNA, 22 bp, Artificial Sequence
  chemically synthesized
caaaactttattcagttgggca

SEQ ID NO: 1024844 - DNA, 22 bp, Artificial Sequence
  chemically synthesized
acaaaactttattcagttgggc

SEQ ID NO: 1024845 - DNA, 22 bp, Artificial Sequence
  chemically synthesized
agtcagaactgcccaactgaat

SEQ ID NO: 1024846 - DNA, 22 bp, Artificial Sequence
  chemically synthesized
tatgtttacaaaactttattca

SEQ ID NO: 1024847 - DNA, 22 bp, Artificial Sequence
  chemically synthesized
cccaactgaataaagttttgta

SEQ ID NO: 1024848 - DNA, 22 bp, Artificial Sequence
  chemically synthesized
taaagctatatgtttacaaaac

SEQ ID NO: 1024849 - DNA, 22 bp, Artificial Sequence
  chemically synthesized
aataaagttttgtaaacatata

SEQ ID NO: 1024850 - DNA, 22 bp, Artificial Sequence
  chemically synthesized
aggaactataaagctatatgtt

SEQ ID NO: 1024851 - DNA, 22 bp, Artificial Sequence
  chemically synthesized
aaggaactataaagctatatgt

SEQ ID NO: 1024852 - DNA, 22 bp, Artificial Sequence
  chemically synthesized
gatttaaggaactataaagcta

SEQ ID NO: 1024853 - DNA, 22 bp, Artificial Sequence
  chemically synthesized
agatttaaggaactataaagct

SEQ ID NO: 1024854 - DNA, 22 bp, Artificial Sequence
  chemically synthesized
tgtaaacatatagctttatagt

SEQ ID NO: 1024855 - DNA, 22 bp, Artificial Sequence
  chemically synthesized
gtaaacatatagctttatagtt

SEQ ID NO: 1024856 - DNA, 22 bp, Artificial Sequence
  chemically synthesized
taaacatatagctttatagttc

SEQ ID NO: 1024857 - DNA, 22 bp, Artificial Sequence
  chemically synthesized
gagtagatttagatttaaggaa

SEQ ID NO: 1024858 - DNA, 22 bp, Artificial Sequence
  chemically synthesized
tatagttccttaaatctaaatc

SEQ ID NO: 1024859 - DNA, 22 bp, Artificial Sequence
  chemically synthesized
aaaattagagtagatttagatt

SEQ ID NO: 1024860 - DNA, 22 bp, Artificial Sequence
  chemically synthesized
atagttccttaaatctaaatct

SEQ ID NO: 1024861 - DNA, 22 bp, Artificial Sequence
  chemically synthesized
gaaaattagagtagatttagat

SEQ ID NO: 1024862 - DNA, 22 bp, Artificial Sequence
  chemically synthesized
tagttccttaaatctaaatcta

SEQ ID NO: 1024863 - DNA, 22 bp, Artificial Sequence
  chemically synthesized
tgaaaattagagtagatttaga

SEQ ID NO: 1024864 - DNA, 22 bp, Artificial Sequence
  chemically synthesized
tgctttgaaaattagagtagat

SEQ ID NO: 1024865 - DNA, 22 bp, Artificial Sequence
  chemically synthesized
cttaaatctaaatctactctaa

SEQ ID NO: 1024866 - DNA, 22 bp, Artificial Sequence
  chemically synthesized
gtgctttgaaaattagagtaga

SEQ ID NO: 1024867 - DNA, 22 bp, Artificial Sequence
  chemically synthesized
tgtgctttgaaaattagagtag

SEQ ID NO: 1024868 - DNA, 22 bp, Artificial Sequence
  chemically synthesized
ttgtgctttgaaaattagagta

SEQ ID NO: 1024869 - DNA, 22 bp, Artificial Sequence
  chemically synthesized
aaatctaaatctactctaattt

SEQ ID NO: 1024870 - DNA, 22 bp, Artificial Sequence
  chemically synthesized
tttgtgctttgaaaattagagt

SEQ ID NO: 1024871 - DNA, 22 bp, Artificial Sequence
  chemically synthesized
aatctaaatctactctaatttt

SEQ ID NO: 1024872 - DNA, 22 bp, Artificial Sequence
  chemically synthesized
ttttgtgctttgaaaattagag

SEQ ID NO: 1024873 - DNA, 22 bp, Artificial Sequence
  chemically synthesized
tatttttttgtgctttgaaaat

SEQ ID NO: 1024874 - DNA, 22 bp, Artificial Sequence
  chemically synthesized
aatctactctaattttcaaagc

SEQ ID NO: 1024875 - DNA, 22 bp, Artificial Sequence
  chemically synthesized
gtatttttttgtgctttgaaaa

SEQ ID NO: 1024876 - DNA, 22 bp, Artificial Sequence
  chemically synthesized
tgtatttttttgtgctttgaaa

SEQ ID NO: 1024877 - DNA, 22 bp, Artificial Sequence
  chemically synthesized
ctctaattttcaaagcacaaaa

SEQ ID NO: 1024878 - DNA, 22 bp, Artificial Sequence
  chemically synthesized
taattttcaaagcacaaaaaaa

SEQ ID NO: 1024879 - DNA, 22 bp, Artificial Sequence
  chemically synthesized
ataagctttgtatttttttgtg

SEQ ID NO: 1024880 - DNA, 22 bp, Artificial Sequence
  chemically synthesized
gataagctttgtatttttttgt

SEQ ID NO: 1024881 - DNA, 22 bp, Artificial Sequence
  chemically synthesized
attttcaaagcacaaaaaaata

SEQ ID NO: 1024882 - DNA, 22 bp, Artificial Sequence
  chemically synthesized
tcaaagcacaaaaaaatacaaa

SEQ ID NO: 1024883 - DNA, 22 bp, Artificial Sequence
  chemically synthesized
caaagcacaaaaaaatacaaag

SEQ ID NO: 1024884 - DNA, 22 bp, Artificial Sequence
  chemically synthesized
aaagcacaaaaaaatacaaagc

SEQ ID NO: 1024885 - DNA, 22 bp, Artificial Sequence
  chemically synthesized
gtaggatatttgataagctttg

SEQ ID NO: 1024886 - DNA, 22 bp, Artificial Sequence
  chemically synthesized
agtaggatatttgataagcttt

SEQ ID NO: 1024887 - DNA, 22 bp, Artificial Sequence
  chemically synthesized
tagtaggatatttgataagctt

SEQ ID NO: 1024888 - DNA, 22 bp, Artificial Sequence
  chemically synthesized
aaaggaacattttagtaggata

SEQ ID NO: 1024889 - DNA, 22 bp, Artificial Sequence
  chemically synthesized
atcaaatatcctactaaaatgt

SEQ ID NO: 1024890 - DNA, 22 bp, Artificial Sequence
  chemically synthesized
tcaaatatcctactaaaatgtt

SEQ ID NO: 1024891 - DNA, 22 bp, Artificial Sequence
  chemically synthesized
ctaaaatgttcctttgaatcta

SEQ ID NO: 1024892 - DNA, 22 bp, Artificial Sequence
  chemically synthesized
aaatgttcctttgaatctatgg

SEQ ID NO: 1024893 - DNA, 22 bp, Artificial Sequence
  chemically synthesized
ctttgaatctatggtctcccat

SEQ ID NO: 1024894 - DNA, 22 bp, Artificial Sequence
  chemically synthesized
atcaccaaacaaatgggagacc

SEQ ID NO: 1024895 - DNA, 22 bp, Artificial Sequence
  chemically synthesized
gatcaccaaacaaatgggagac

SEQ ID NO: 1024896 - DNA, 22 bp, Artificial Sequence
  chemically synthesized
tgaatctatggtctcccatttg

SEQ ID NO: 1024897 - DNA, 22 bp, Artificial Sequence
  chemically synthesized
ttgatcaccaaacaaatgggag

SEQ ID NO: 1024898 - DNA, 22 bp, Artificial Sequence
  chemically synthesized
gaatctatggtctcccatttgt

SEQ ID NO: 1024899 - DNA, 22 bp, Artificial Sequence
  chemically synthesized
aatctatggtctcccatttgtt

SEQ ID NO: 1024900 - DNA, 22 bp, Artificial Sequence
  chemically synthesized
tggtctcccatttgtttggtga

SEQ ID NO: 1024901 - DNA, 22 bp, Artificial Sequence
  chemically synthesized
tgaacagtagctcttgatcacc

SEQ ID NO: 1024902 - DNA, 22 bp, Artificial Sequence
  chemically synthesized
ccatttgtttggtgatcaagag

SEQ ID NO: 1024903 - DNA, 22 bp, Artificial Sequence
  chemically synthesized
aaattatgaacagtagctcttg

SEQ ID NO: 1024904 - DNA, 22 bp, Artificial Sequence
  chemically synthesized
gaaattatgaacagtagctctt

SEQ ID NO: 1024905 - DNA, 22 bp, Artificial Sequence
  chemically synthesized
gtttggtgatcaagagctactg

SEQ ID NO: 1024906 - DNA, 22 bp, Artificial Sequence
  chemically synthesized
tgaaattatgaacagtagctct

SEQ ID NO: 1024907 - DNA, 22 bp, Artificial Sequence
  chemically synthesized
tttggtgatcaagagctactgt

SEQ ID NO: 1024908 - DNA, 22 bp, Artificial Sequence
  chemically synthesized
tttgaaattatgaacagtagct

SEQ ID NO: 1024909 - DNA, 22 bp, Artificial Sequence
  chemically synthesized
ggtgatcaagagctactgttca

SEQ ID NO: 1024910 - DNA, 22 bp, Artificial Sequence
  chemically synthesized
gtgatcaagagctactgttcat

SEQ ID NO: 1024911 - DNA, 22 bp, Artificial Sequence
  chemically synthesized
aagattctttgaaattatgaac

SEQ ID NO: 1024912 - DNA, 22 bp, Artificial Sequence
  chemically synthesized
caagattctttgaaattatgaa

SEQ ID NO: 1024913 - DNA, 22 bp, Artificial Sequence
  chemically synthesized
tttcaagattctttgaaattat

SEQ ID NO: 1024914 - DNA, 22 bp, Artificial Sequence
  chemically synthesized
ttatttcaagattctttgaaat

SEQ ID NO: 1024915 - DNA, 22 bp, Artificial Sequence
  chemically synthesized
gttatttcaagattctttgaaa

SEQ ID NO: 1024916 - DNA, 22 bp, Artificial Sequence
  chemically synthesized
tgttatttcaagattctttgaa

SEQ ID NO: 1024917 - DNA, 22 bp, Artificial Sequence
  chemically synthesized
ctgttcataatttcaaagaatc

SEQ ID NO: 1024918 - DNA, 22 bp, Artificial Sequence
  chemically synthesized
ttcataatttcaaagaatcttg

SEQ ID NO: 1024919 - DNA, 22 bp, Artificial Sequence
  chemically synthesized
cactttgttatttcaagattct

SEQ ID NO: 1024920 - DNA, 22 bp, Artificial Sequence
  chemically synthesized
ccactttgttatttcaagattc

SEQ ID NO: 1024921 - DNA, 22 bp, Artificial Sequence
  chemically synthesized
ataatttcaaagaatcttgaaa

SEQ ID NO: 1024922 - DNA, 22 bp, Artificial Sequence
  chemically synthesized
tccactttgttatttcaagatt

SEQ ID NO: 1024923 - DNA, 22 bp, Artificial Sequence
  chemically synthesized
ttccactttgttatttcaagat

SEQ ID NO: 1024924 - DNA, 22 bp, Artificial Sequence
  chemically synthesized
caaagaatcttgaaataacaaa

SEQ ID NO: 1024925 - DNA, 22 bp, Artificial Sequence
  chemically synthesized
aaagaatcttgaaataacaaag

SEQ ID NO: 1024926 - DNA, 22 bp, Artificial Sequence
  chemically synthesized
aagcacttttccactttgttat

SEQ ID NO: 1024927 - DNA, 22 bp, Artificial Sequence
  chemically synthesized
ctcaagcacttttccactttgt

SEQ ID NO: 1024928 - DNA, 22 bp, Artificial Sequence
  chemically synthesized
cctcaagcacttttccactttg

SEQ ID NO: 1024929 - DNA, 22 bp, Artificial Sequence
  chemically synthesized
ttcctcaagcacttttccactt

SEQ ID NO: 1024930 - DNA, 22 bp, Artificial Sequence
  chemically synthesized
gaaataacaaagtggaaaagtg

SEQ ID NO: 1024931 - DNA, 22 bp, Artificial Sequence
  chemically synthesized
aaataacaaagtggaaaagtgc

SEQ ID NO: 1024932 - DNA, 22 bp, Artificial Sequence
  chemically synthesized
gtctcttcctcaagcacttttc

SEQ ID NO: 1024933 - DNA, 22 bp, Artificial Sequence
  chemically synthesized
tcagtgtatcctggtctcttcc

SEQ ID NO: 1024934 - DNA, 22 bp, Artificial Sequence
  chemically synthesized
gtcagtgtatcctggtctcttc

SEQ ID NO: 1024935 - DNA, 22 bp, Artificial Sequence
  chemically synthesized
cttgtcagtgtatcctggtctc

SEQ ID NO: 1024936 - DNA, 22 bp, Artificial Sequence
  chemically synthesized
agctacttgtcagtgtatcctg

SEQ ID NO: 1024937 - DNA, 22 bp, Artificial Sequence
  chemically synthesized
gaggaagagaccaggatacact

SEQ ID NO: 1024938 - DNA, 22 bp, Artificial Sequence
  chemically synthesized
aggaagagaccaggatacactg

SEQ ID NO: 1024939 - DNA, 22 bp, Artificial Sequence
  chemically synthesized
tgagctacttgtcagtgtatcc

SEQ ID NO: 1024940 - DNA, 22 bp, Artificial Sequence
  chemically synthesized
gcactctgagctacttgtcagt

SEQ ID NO: 1024941 - DNA, 22 bp, Artificial Sequence
  chemically synthesized
ccattagcactctgagctactt

SEQ ID NO: 1024942 - DNA, 22 bp, Artificial Sequence
  chemically synthesized
gccattagcactctgagctact

SEQ ID NO: 1024943 - DNA, 22 bp, Artificial Sequence
  chemically synthesized
acccttgccattagcactctga

SEQ ID NO: 1024944 - DNA, 22 bp, Artificial Sequence
  chemically synthesized
tgacccttgccattagcactct

SEQ ID NO: 1024945 - DNA, 22 bp, Artificial Sequence
  chemically synthesized
acaagtagctcagagtgctaat

SEQ ID NO: 1024946 - DNA, 22 bp, Artificial Sequence
  chemically synthesized
tgattctgacccttgccattag

SEQ ID NO: 1024947 - DNA, 22 bp, Artificial Sequence
  chemically synthesized
agagtgctaatggcaagggtca

SEQ ID NO: 1024948 - DNA, 22 bp, Artificial Sequence
  chemically synthesized
atggcaagggtcagaatcatag

SEQ ID NO: 1024949 - DNA, 22 bp, Artificial Sequence
  chemically synthesized
ataagtaaaataggcataatac

SEQ ID NO: 1024950 - DNA, 22 bp, Artificial Sequence
  chemically synthesized
tcataagtaaaataggcataat

SEQ ID NO: 1024951 - DNA, 22 bp, Artificial Sequence
  chemically synthesized
ctcataagtaaaataggcataa

SEQ ID NO: 1024952 - DNA, 22 bp, Artificial Sequence
  chemically synthesized
tctcataagtaaaataggcata

SEQ ID NO: 1024953 - DNA, 22 bp, Artificial Sequence
  chemically synthesized
aattttctcataagtaaaatag

SEQ ID NO: 1024954 - DNA, 22 bp, Artificial Sequence
  chemically synthesized
tattatgcctattttacttatg

SEQ ID NO: 1024955 - DNA, 22 bp, Artificial Sequence
  chemically synthesized
aacctcaattttctcataagta

SEQ ID NO: 1024956 - DNA, 22 bp, Artificial Sequence
  chemically synthesized
tgcctattttacttatgagaaa

SEQ ID NO: 1024957 - DNA, 22 bp, Artificial Sequence
  chemically synthesized
gctgaacctcaattttctcata

SEQ ID NO: 1024958 - DNA, 22 bp, Artificial Sequence
  chemically synthesized
agctgaacctcaattttctcat

SEQ ID NO: 1024959 - DNA, 22 bp, Artificial Sequence
  chemically synthesized
tagctgaacctcaattttctca

SEQ ID NO: 1024960 - DNA, 22 bp, Artificial Sequence
  chemically synthesized
ttttacttatgagaaaattgag

SEQ ID NO: 1024961 - DNA, 22 bp, Artificial Sequence
  chemically synthesized
tacttatgagaaaattgaggtt

SEQ ID NO: 1024962 - DNA, 22 bp, Artificial Sequence
  chemically synthesized
acttatgagaaaattgaggttc

SEQ ID NO: 1024963 - DNA, 22 bp, Artificial Sequence
  chemically synthesized
cttatgagaaaattgaggttca

SEQ ID NO: 1024964 - DNA, 22 bp, Artificial Sequence
  chemically synthesized
gcaagttttagctgaacctcaa

SEQ ID NO: 1024965 - DNA, 22 bp, Artificial Sequence
  chemically synthesized
ggcaagttttagctgaacctca

SEQ ID NO: 1024966 - DNA, 22 bp, Artificial Sequence
  chemically synthesized
tggcaagttttagctgaacctc

SEQ ID NO: 1024967 - DNA, 22 bp, Artificial Sequence
  chemically synthesized
atgagaaaattgaggttcagct

SEQ ID NO: 1024968 - DNA, 22 bp, Artificial Sequence
  chemically synthesized
ttggcaagttttagctgaacct

SEQ ID NO: 1024969 - DNA, 22 bp, Artificial Sequence
  chemically synthesized
tgagaaaattgaggttcagcta

SEQ ID NO: 1024970 - DNA, 22 bp, Artificial Sequence
  chemically synthesized
tgtgaatttttggcaagtttta

SEQ ID NO: 1024971 - DNA, 22 bp, Artificial Sequence
  chemically synthesized
aggttcagctaaaacttgccaa

SEQ ID NO: 1024972 - DNA, 22 bp, Artificial Sequence
  chemically synthesized
attgtgtgaatttttggcaagt

SEQ ID NO: 1024973 - DNA, 22 bp, Artificial Sequence
  chemically synthesized
tgattgtgtgaatttttggcaa

SEQ ID NO: 1024974 - DNA, 22 bp, Artificial Sequence
  chemically synthesized
agctaaaacttgccaaaaattc

SEQ ID NO: 1024975 - DNA, 22 bp, Artificial Sequence
  chemically synthesized
aaacttgccaaaaattcacaca

SEQ ID NO: 1024976 - DNA, 22 bp, Artificial Sequence
  chemically synthesized
catcaatctctgattgtgtgaa

SEQ ID NO: 1024977 - DNA, 22 bp, Artificial Sequence
  chemically synthesized
gccaaaaattcacacaatcaga

SEQ ID NO: 1024978 - DNA, 22 bp, Artificial Sequence
  chemically synthesized
ccaaaaattcacacaatcagag

SEQ ID NO: 1024979 - DNA, 22 bp, Artificial Sequence
  chemically synthesized
aatcgtggctccatcaatctct

SEQ ID NO: 1024980 - DNA, 22 bp, Artificial Sequence
  chemically synthesized
gaatcgtggctccatcaatctc

SEQ ID NO: 1024981 - DNA, 22 bp, Artificial Sequence
  chemically synthesized
acacaatcagagattgatggag

SEQ ID NO: 1024982 - DNA, 22 bp, Artificial Sequence
  chemically synthesized
agtttgaatcgtggctccatca

SEQ ID NO: 1024983 - DNA, 22 bp, Artificial Sequence
  chemically synthesized
acctgagtttgaatcgtggctc

SEQ ID NO: 1024984 - DNA, 22 bp, Artificial Sequence
  chemically synthesized
gattgacctgagtttgaatcgt

SEQ ID NO: 1024985 - DNA, 22 bp, Artificial Sequence
  chemically synthesized
atggagccacgattcaaactca

SEQ ID NO: 1024986 - DNA, 22 bp, Artificial Sequence
  chemically synthesized
gaattagattgacctgagtttg

SEQ ID NO: 1024987 - DNA, 22 bp, Artificial Sequence
  chemically synthesized
ggaattagattgacctgagttt

SEQ ID NO: 1024988 - DNA, 22 bp, Artificial Sequence
  chemically synthesized
tggaattagattgacctgagtt

SEQ ID NO: 1024989 - DNA, 22 bp, Artificial Sequence
  chemically synthesized
gctttggaattagattgacctg

SEQ ID NO: 1024990 - DNA, 22 bp, Artificial Sequence
  chemically synthesized
ggctttggaattagattgacct

SEQ ID NO: 1024991 - DNA, 22 bp, Artificial Sequence
  chemically synthesized
aaactcaggtcaatctaattcc

SEQ ID NO: 1024992 - DNA, 22 bp, Artificial Sequence
  chemically synthesized
agagcttggctttggaattaga

SEQ ID NO: 1024993 - DNA, 22 bp, Artificial Sequence
  chemically synthesized
aggtcaatctaattccaaagcc

SEQ ID NO: 1024994 - DNA, 22 bp, Artificial Sequence
  chemically synthesized
agacacagttaagagcttggct

SEQ ID NO: 1024995 - DNA, 22 bp, Artificial Sequence
  chemically synthesized
attccaaagccaagctcttaac

SEQ ID NO: 1024996 - DNA, 22 bp, Artificial Sequence
  chemically synthesized
caaagccaagctcttaactgtg

SEQ ID NO: 1024997 - DNA, 22 bp, Artificial Sequence
  chemically synthesized
cagggataagtgagtctcagac

SEQ ID NO: 1024998 - DNA, 22 bp, Artificial Sequence
  chemically synthesized
ccagggataagtgagtctcaga

SEQ ID NO: 1024999 - DNA, 22 bp, Artificial Sequence
  chemically synthesized
tccagggataagtgagtctcag

SEQ ID NO: 1025000 - DNA, 22 bp, Artificial Sequence
  chemically synthesized
ttccagggataagtgagtctca

SEQ ID NO: 1025001 - DNA, 22 bp, Artificial Sequence
  chemically synthesized
ttaactgtgtctgagactcact

SEQ ID NO: 1025002 - DNA, 22 bp, Artificial Sequence
  chemically synthesized
aactgtgtctgagactcactta

SEQ ID NO: 1025003 - DNA, 22 bp, Artificial Sequence
  chemically synthesized
actgtgtctgagactcacttat

SEQ ID NO: 1025004 - DNA, 22 bp, Artificial Sequence
  chemically synthesized
tagcttttccagggataagtga

SEQ ID NO: 1025005 - DNA, 22 bp, Artificial Sequence
  chemically synthesized
gtagcttttccagggataagtg

SEQ ID NO: 1025006 - DNA, 22 bp, Artificial Sequence
  chemically synthesized
tgtctgagactcacttatccct

SEQ ID NO: 1025007 - DNA, 22 bp, Artificial Sequence
  chemically synthesized
agactcacttatccctggaaaa

SEQ ID NO: 1025008 - DNA, 22 bp, Artificial Sequence
  chemically synthesized
acttatccctggaaaagctaca

SEQ ID NO: 1025009 - DNA, 22 bp, Artificial Sequence
  chemically synthesized
atccctggaaaagctacaaatc

SEQ ID NO: 1025010 - DNA, 22 bp, Artificial Sequence
  chemically synthesized
tccctggaaaagctacaaatct

SEQ ID NO: 1025011 - DNA, 22 bp, Artificial Sequence
  chemically synthesized
acaggagaaagccagatttgta

SEQ ID NO: 1025012 - DNA, 22 bp, Artificial Sequence
  chemically synthesized
gaaaagctacaaatctggcttt

SEQ ID NO: 1025013 - DNA, 22 bp, Artificial Sequence
  chemically synthesized
tgtcgaatattgacaggagaaa

SEQ ID NO: 1025014 - DNA, 22 bp, Artificial Sequence
  chemically synthesized
gtgtcgaatattgacaggagaa

SEQ ID NO: 1025015 - DNA, 22 bp, Artificial Sequence
  chemically synthesized
caaatctggctttctcctgtca

SEQ ID NO: 1025016 - DNA, 22 bp, Artificial Sequence
  chemically synthesized
tgtgtcgaatattgacaggaga

SEQ ID NO: 1025017 - DNA, 22 bp, Artificial Sequence
  chemically synthesized
attttgtgtcgaatattgacag

SEQ ID NO: 1025018 - DNA, 22 bp, Artificial Sequence
  chemically synthesized
cattttgtgtcgaatattgaca

SEQ ID NO: 1025019 - DNA, 22 bp, Artificial Sequence
  chemically synthesized
gctttctcctgtcaatattcga

SEQ ID NO: 1025020 - DNA, 22 bp, Artificial Sequence
  chemically synthesized
ccttcattttgtgtcgaatatt

SEQ ID NO: 1025021 - DNA, 22 bp, Artificial Sequence
  chemically synthesized
tctcctgtcaatattcgacaca

SEQ ID NO: 1025022 - DNA, 22 bp, Artificial Sequence
  chemically synthesized
ctcctgtcaatattcgacacaa

SEQ ID NO: 1025023 - DNA, 22 bp, Artificial Sequence
  chemically synthesized
tcctgtcaatattcgacacaaa

SEQ ID NO: 1025024 - DNA, 22 bp, Artificial Sequence
  chemically synthesized
ctgtcaatattcgacacaaaat

SEQ ID NO: 1025025 - DNA, 22 bp, Artificial Sequence
  chemically synthesized
tcaatattcgacacaaaatgaa

SEQ ID NO: 1025026 - DNA, 22 bp, Artificial Sequence
  chemically synthesized
tataaaggttgccttcattttg

SEQ ID NO: 1025027 - DNA, 22 bp, Artificial Sequence
  chemically synthesized
gtataaaggttgccttcatttt

SEQ ID NO: 1025028 - DNA, 22 bp, Artificial Sequence
  chemically synthesized
gacacaaaatgaaggcaacctt

SEQ ID NO: 1025029 - DNA, 22 bp, Artificial Sequence
  chemically synthesized
tatacaagtggcttttatttct

SEQ ID NO: 1025030 - DNA, 22 bp, Artificial Sequence
  chemically synthesized
atacaagtggcttttatttctt

SEQ ID NO: 1025031 - DNA, 22 bp, Artificial Sequence
  chemically synthesized
tacaagtggcttttatttcttt

SEQ ID NO: 1025032 - DNA, 22 bp, Artificial Sequence
  chemically synthesized
aaccaaggacaagaatagaaag

SEQ ID NO: 1025033 - DNA, 22 bp, Artificial Sequence
  chemically synthesized
gaaccaaggacaagaatagaaa

SEQ ID NO: 1025034 - DNA, 22 bp, Artificial Sequence
  chemically synthesized
ttatttctttctattcttgtcc

SEQ ID NO: 1025035 - DNA, 22 bp, Artificial Sequence
  chemically synthesized
tatttctttctattcttgtcct

SEQ ID NO: 1025036 - DNA, 22 bp, Artificial Sequence
  chemically synthesized
atttctttctattcttgtcctt

SEQ ID NO: 1025037 - DNA, 22 bp, Artificial Sequence
  chemically synthesized
gatccttgaaccaaggacaaga

SEQ ID NO: 1025038 - DNA, 22 bp, Artificial Sequence
  chemically synthesized
tttctttctattcttgtccttg

SEQ ID NO: 1025039 - DNA, 22 bp, Artificial Sequence
  chemically synthesized
ctttctattcttgtccttggtt

SEQ ID NO: 1025040 - DNA, 22 bp, Artificial Sequence
  chemically synthesized
tttctattcttgtccttggttc

SEQ ID NO: 1025041 - DNA, 22 bp, Artificial Sequence
  chemically synthesized
tctattcttgtccttggttcaa

SEQ ID NO: 1025042 - DNA, 22 bp, Artificial Sequence
  chemically synthesized
agtgttcgatccttgaaccaag

SEQ ID NO: 1025043 - DNA, 22 bp, Artificial Sequence
  chemically synthesized
ctattcttgtccttggttcaag

SEQ ID NO: 1025044 - DNA, 22 bp, Artificial Sequence
  chemically synthesized
gagtgttcgatccttgaaccaa

SEQ ID NO: 1025045 - DNA, 22 bp, Artificial Sequence
  chemically synthesized
tattcttgtccttggttcaagg

SEQ ID NO: 1025046 - DNA, 22 bp, Artificial Sequence
  chemically synthesized
ttcttgtccttggttcaaggat

SEQ ID NO: 1025047 - DNA, 22 bp, Artificial Sequence
  chemically synthesized
cttgagtgttcgatccttgaac

SEQ ID NO: 1025048 - DNA, 22 bp, Artificial Sequence
  chemically synthesized
ttgtccttggttcaaggatcga

SEQ ID NO: 1025049 - DNA, 22 bp, Artificial Sequence
  chemically synthesized
gtccttggttcaaggatcgaac

SEQ ID NO: 1025050 - DNA, 22 bp, Artificial Sequence
  chemically synthesized
tccttggttcaaggatcgaaca

SEQ ID NO: 1025051 - DNA, 22 bp, Artificial Sequence
  chemically synthesized
ggtctccttgagtgttcgatcc

SEQ ID NO: 1025052 - DNA, 22 bp, Artificial Sequence
  chemically synthesized
aggtctccttgagtgttcgatc

SEQ ID NO: 1025053 - DNA, 22 bp, Artificial Sequence
  chemically synthesized
ggttcaaggatcgaacactcaa

SEQ ID NO: 1025054 - DNA, 22 bp, Artificial Sequence
  chemically synthesized
gttcaaggatcgaacactcaag

SEQ ID NO: 1025055 - DNA, 22 bp, Artificial Sequence
  chemically synthesized
aaggatcgaacactcaaggaga

SEQ ID NO: 1025056 - DNA, 22 bp, Artificial Sequence
  chemically synthesized
caaaatatttaggtctccttga

SEQ ID NO: 1025057 - DNA, 22 bp, Artificial Sequence
  chemically synthesized
ttccaaaatatttaggtctcct

SEQ ID NO: 1025058 - DNA, 22 bp, Artificial Sequence
  chemically synthesized
ctattccaaaatatttaggtct

SEQ ID NO: 1025059 - DNA, 22 bp, Artificial Sequence
  chemically synthesized
gctcctattccaaaatatttag

SEQ ID NO: 1025060 - DNA, 22 bp, Artificial Sequence
  chemically synthesized
aaggagacctaaatattttgga

SEQ ID NO: 1025061 - DNA, 22 bp, Artificial Sequence
  chemically synthesized
tcctggctcctattccaaaata

SEQ ID NO: 1025062 - DNA, 22 bp, Artificial Sequence
  chemically synthesized
aatattttggaataggagccag

SEQ ID NO: 1025063 - DNA, 22 bp, Artificial Sequence
  chemically synthesized
aggacaggttatcctggctcct

SEQ ID NO: 1025064 - DNA, 22 bp, Artificial Sequence
  chemically synthesized
tgaggacaggttatcctggctc

SEQ ID NO: 1025065 - DNA, 22 bp, Artificial Sequence
  chemically synthesized
tggaataggagccaggataacc

SEQ ID NO: 1025066 - DNA, 22 bp, Artificial Sequence
  chemically synthesized
ggaataggagccaggataacct

SEQ ID NO: 1025067 - DNA, 22 bp, Artificial Sequence
  chemically synthesized
gaataggagccaggataacctg

SEQ ID NO: 1025068 - DNA, 22 bp, Artificial Sequence
  chemically synthesized
ggtgatgcagccaaggaagcat

SEQ ID NO: 1025069 - DNA, 22 bp, Artificial Sequence
  chemically synthesized
tcctcagagatgcttccttggc

SEQ ID NO: 1025070 - DNA, 22 bp, Artificial Sequence
  chemically synthesized
tggctaggtgatgcagccaagg

SEQ ID NO: 1025071 - DNA, 22 bp, Artificial Sequence
  chemically synthesized
atggctaggtgatgcagccaag

SEQ ID NO: 1025072 - DNA, 22 bp, Artificial Sequence
  chemically synthesized
agagatgcttccttggctgcat

SEQ ID NO: 1025073 - DNA, 22 bp, Artificial Sequence
  chemically synthesized
ccttggctgcatcacctagcca

SEQ ID NO: 1025074 - DNA, 22 bp, Artificial Sequence
  chemically synthesized
cttggctgcatcacctagccat

SEQ ID NO: 1025075 - DNA, 22 bp, Artificial Sequence
  chemically synthesized
ggctgcatcacctagccataag

SEQ ID NO: 1025076 - DNA, 22 bp, Artificial Sequence
  chemically synthesized
gctgcatcacctagccataagt

SEQ ID NO: 1025077 - DNA, 22 bp, Artificial Sequence
  chemically synthesized
caaaaagggagtacttatggct

SEQ ID NO: 1025078 - DNA, 22 bp, Artificial Sequence
  chemically synthesized
ctgcaaaaagggagtacttatg

SEQ ID NO: 1025079 - DNA, 22 bp, Artificial Sequence
  chemically synthesized
catcacctagccataagtactc

SEQ ID NO: 1025080 - DNA, 22 bp, Artificial Sequence
  chemically synthesized
cctgcaaaaagggagtacttat

SEQ ID NO: 1025081 - DNA, 22 bp, Artificial Sequence
  chemically synthesized
tcctgcaaaaagggagtactta

SEQ ID NO: 1025082 - DNA, 22 bp, Artificial Sequence
  chemically synthesized
caagttttcctgcaaaaaggga

SEQ ID NO: 1025083 - DNA, 22 bp, Artificial Sequence
  chemically synthesized
gccataagtactccctttttgc

SEQ ID NO: 1025084 - DNA, 22 bp, Artificial Sequence
  chemically synthesized
gggttgcaagttttcctgcaaa

SEQ ID NO: 1025085 - DNA, 22 bp, Artificial Sequence
  chemically synthesized
tagggttgcaagttttcctgca

SEQ ID NO: 1025086 - DNA, 22 bp, Artificial Sequence
  chemically synthesized
cctttttgcaggaaaacttgca

SEQ ID NO: 1025087 - DNA, 22 bp, Artificial Sequence
  chemically synthesized
tttgcaggaaaacttgcaaccc

SEQ ID NO: 1025088 - DNA, 22 bp, Artificial Sequence
  chemically synthesized
ttgcaggaaaacttgcaaccct

SEQ ID NO: 1025089 - DNA, 22 bp, Artificial Sequence
  chemically synthesized
tgcaggaaaacttgcaacccta

SEQ ID NO: 1025090 - DNA, 22 bp, Artificial Sequence
  chemically synthesized
gcaggaaaacttgcaaccctag

SEQ ID NO: 1025091 - DNA, 22 bp, Artificial Sequence
  chemically synthesized
caggaaaacttgcaaccctaga

SEQ ID NO: 1025092 - DNA, 22 bp, Artificial Sequence
  chemically synthesized
gtatggtatggttctagggttg

SEQ ID NO: 1025093 - DNA, 22 bp, Artificial Sequence
  chemically synthesized
ggtatggtatggttctagggtt

SEQ ID NO: 1025094 - DNA, 22 bp, Artificial Sequence
  chemically synthesized
gcaaccctagaaccataccata

SEQ ID NO: 1025095 - DNA, 22 bp, Artificial Sequence
  chemically synthesized
caaccctagaaccataccatac

SEQ ID NO: 1025096 - DNA, 22 bp, Artificial Sequence
  chemically synthesized
gaaccataccataccaaacttc

SEQ ID NO: 1025097 - DNA, 22 bp, Artificial Sequence
  chemically synthesized
atcagaaaatgaaggaagtttg

SEQ ID NO: 1025098 - DNA, 22 bp, Artificial Sequence
  chemically synthesized
aatcagaaaatgaaggaagttt

SEQ ID NO: 1025099 - DNA, 22 bp, Artificial Sequence
  chemically synthesized
taatcagaaaatgaaggaagtt

SEQ ID NO: 1025100 - DNA, 22 bp, Artificial Sequence
  chemically synthesized
tgtacaaaatagttttaatcag

SEQ ID NO: 1025101 - DNA, 22 bp, Artificial Sequence
  chemically synthesized
ccttcattttctgattaaaact

SEQ ID NO: 1025102 - DNA, 22 bp, Artificial Sequence
  chemically synthesized
cttcattttctgattaaaacta

SEQ ID NO: 1025103 - DNA, 22 bp, Artificial Sequence
  chemically synthesized
cattttctgattaaaactattt

SEQ ID NO: 1025104 - DNA, 22 bp, Artificial Sequence
  chemically synthesized
attttctgattaaaactatttt

SEQ ID NO: 1025105 - DNA, 22 bp, Artificial Sequence
  chemically synthesized
tctgattaaaactattttgtac

SEQ ID NO: 1025106 - DNA, 22 bp, Artificial Sequence
  chemically synthesized
ctgattaaaactattttgtaca

SEQ ID NO: 1025107 - DNA, 22 bp, Artificial Sequence
  chemically synthesized
tgattaaaactattttgtacat

SEQ ID NO: 1025108 - DNA, 22 bp, Artificial Sequence
  chemically synthesized
attaaaactattttgtacataa

SEQ ID NO: 1025109 - DNA, 22 bp, Artificial Sequence
  chemically synthesized
aaactattttgtacataatgtc

SEQ ID NO: 1025110 - DNA, 22 bp, Artificial Sequence
  chemically synthesized
tgatgcaaaaaaagtgggacat

SEQ ID NO: 1025111 - DNA, 22 bp, Artificial Sequence
  chemically synthesized
ttttgtacataatgtcccactt

SEQ ID NO: 1025112 - DNA, 22 bp, Artificial Sequence
  chemically synthesized
gtgatgcaaaaaaagtgggaca

SEQ ID NO: 1025113 - DNA, 22 bp, Artificial Sequence
  chemically synthesized
tgtacataatgtcccacttttt

SEQ ID NO: 1025114 - DNA, 22 bp, Artificial Sequence
  chemically synthesized
gtacataatgtcccactttttt

SEQ ID NO: 1025115 - DNA, 22 bp, Artificial Sequence
  chemically synthesized
tacataatgtcccacttttttt

SEQ ID NO: 1025116 - DNA, 22 bp, Artificial Sequence
  chemically synthesized
aaggcgtttgtgatgcaaaaaa

SEQ ID NO: 1025117 - DNA, 22 bp, Artificial Sequence
  chemically synthesized
atggttcaaggcgtttgtgatg

SEQ ID NO: 1025118 - DNA, 22 bp, Artificial Sequence
  chemically synthesized
aatggttcaaggcgtttgtgat

SEQ ID NO: 1025119 - DNA, 22 bp, Artificial Sequence
  chemically synthesized
tttttgcatcacaaacgccttg

SEQ ID NO: 1025120 - DNA, 22 bp, Artificial Sequence
  chemically synthesized
ttttgcatcacaaacgccttga

SEQ ID NO: 1025121 - DNA, 22 bp, Artificial Sequence
  chemically synthesized
tttgcatcacaaacgccttgaa

SEQ ID NO: 1025122 - DNA, 22 bp, Artificial Sequence
  chemically synthesized
tgtacttaatggttcaaggcgt

SEQ ID NO: 1025123 - DNA, 22 bp, Artificial Sequence
  chemically synthesized
ttgcatcacaaacgccttgaac

SEQ ID NO: 1025124 - DNA, 22 bp, Artificial Sequence
  chemically synthesized
gtgtacttaatggttcaaggcg

SEQ ID NO: 1025125 - DNA, 22 bp, Artificial Sequence
  chemically synthesized
tgcatcacaaacgccttgaacc

SEQ ID NO: 1025126 - DNA, 22 bp, Artificial Sequence
  chemically synthesized
gcatcacaaacgccttgaacca

SEQ ID NO: 1025127 - DNA, 22 bp, Artificial Sequence
  chemically synthesized
catcacaaacgccttgaaccat

SEQ ID NO: 1025128 - DNA, 22 bp, Artificial Sequence
  chemically synthesized
ccaggaatatacttgtgtactt

SEQ ID NO: 1025129 - DNA, 22 bp, Artificial Sequence
  chemically synthesized
cccaggaatatacttgtgtact

SEQ ID NO: 1025130 - DNA, 22 bp, Artificial Sequence
  chemically synthesized
gaaccattaagtacacaagtat

SEQ ID NO: 1025131 - DNA, 22 bp, Artificial Sequence
  chemically synthesized
aaccattaagtacacaagtata

SEQ ID NO: 1025132 - DNA, 22 bp, Artificial Sequence
  chemically synthesized
atcttcccaggaatatacttgt

SEQ ID NO: 1025133 - DNA, 22 bp, Artificial Sequence
  chemically synthesized
attcatcttcccaggaatatac

SEQ ID NO: 1025134 - DNA, 22 bp, Artificial Sequence
  chemically synthesized
aattcatcttcccaggaatata

SEQ ID NO: 1025135 - DNA, 22 bp, Artificial Sequence
  chemically synthesized
agtacacaagtatattcctggg

SEQ ID NO: 1025136 - DNA, 22 bp, Artificial Sequence
  chemically synthesized
ctgggaagatgaattaaggtct

SEQ ID NO: 1025137 - DNA, 22 bp, Artificial Sequence
  chemically synthesized
agaacaagatgaagaccttaat

SEQ ID NO: 1025138 - DNA, 22 bp, Artificial Sequence
  chemically synthesized
taagaacaagatgaagacctta

SEQ ID NO: 1025139 - DNA, 22 bp, Artificial Sequence
  chemically synthesized
ggaagatgaattaaggtcttca

SEQ ID NO: 1025140 - DNA, 22 bp, Artificial Sequence
  chemically synthesized
ctaagaacaagatgaagacctt

SEQ ID NO: 1025141 - DNA, 22 bp, Artificial Sequence
  chemically synthesized
tctaagaacaagatgaagacct

SEQ ID NO: 1025142 - DNA, 22 bp, Artificial Sequence
  chemically synthesized
aggtcttcatcttgttcttaga

SEQ ID NO: 1025143 - DNA, 22 bp, Artificial Sequence
  chemically synthesized
catcttgttcttagaaagtatg

SEQ ID NO: 1025144 - DNA, 22 bp, Artificial Sequence
  chemically synthesized
atcttgttcttagaaagtatgt

SEQ ID NO: 1025145 - DNA, 22 bp, Artificial Sequence
  chemically synthesized
tcagaaaataaacacatacttt

SEQ ID NO: 1025146 - DNA, 22 bp, Artificial Sequence
  chemically synthesized
ctatcagaaaataaacacatac

SEQ ID NO: 1025147 - DNA, 22 bp, Artificial Sequence
  chemically synthesized
gttcttagaaagtatgtgttta

SEQ ID NO: 1025148 - DNA, 22 bp, Artificial Sequence
  chemically synthesized
ttcttagaaagtatgtgtttat

SEQ ID NO: 1025149 - DNA, 22 bp, Artificial Sequence
  chemically synthesized
tgctatcagaaaataaacacat

SEQ ID NO: 1025150 - DNA, 22 bp, Artificial Sequence
  chemically synthesized
ctgctatcagaaaataaacaca

SEQ ID NO: 1025151 - DNA, 22 bp, Artificial Sequence
  chemically synthesized
ttagaaagtatgtgtttatttt

SEQ ID NO: 1025152 - DNA, 22 bp, Artificial Sequence
  chemically synthesized
tttctgctatcagaaaataaac

SEQ ID NO: 1025153 - DNA, 22 bp, Artificial Sequence
  chemically synthesized
agaaagtatgtgtttattttct

SEQ ID NO: 1025154 - DNA, 22 bp, Artificial Sequence
  chemically synthesized
gaaagtatgtgtttattttctg

SEQ ID NO: 1025155 - DNA, 22 bp, Artificial Sequence
  chemically synthesized
ttatttctgctatcagaaaata

SEQ ID NO: 1025156 - DNA, 22 bp, Artificial Sequence
  chemically synthesized
taaagtattattatttctgcta

SEQ ID NO: 1025157 - DNA, 22 bp, Artificial Sequence
  chemically synthesized
attttctgatagcagaaataat

SEQ ID NO: 1025158 - DNA, 22 bp, Artificial Sequence
  chemically synthesized
ttttctgatagcagaaataata

SEQ ID NO: 1025159 - DNA, 22 bp, Artificial Sequence
  chemically synthesized
tctgatagcagaaataataata

SEQ ID NO: 1025160 - DNA, 22 bp, Artificial Sequence
  chemically synthesized
ctgatagcagaaataataatac

SEQ ID NO: 1025161 - DNA, 22 bp, Artificial Sequence
  chemically synthesized
taaaactataaagtattattat

SEQ ID NO: 1025162 - DNA, 22 bp, Artificial Sequence
  chemically synthesized
tgatagcagaaataataatact

SEQ ID NO: 1025163 - DNA, 22 bp, Artificial Sequence
  chemically synthesized
tataaaactataaagtattatt

SEQ ID NO: 1025164 - DNA, 22 bp, Artificial Sequence
  chemically synthesized
atagcagaaataataatacttt

SEQ ID NO: 1025165 - DNA, 22 bp, Artificial Sequence
  chemically synthesized
agaagattctataaaactataa

SEQ ID NO: 1025166 - DNA, 22 bp, Artificial Sequence
  chemically synthesized
cattgagaagattctataaaac

SEQ ID NO: 1025167 - DNA, 22 bp, Artificial Sequence
  chemically synthesized
tatagttttatagaatcttctc

SEQ ID NO: 1025168 - DNA, 22 bp, Artificial Sequence
  chemically synthesized
atagttttatagaatcttctca

SEQ ID NO: 1025169 - DNA, 22 bp, Artificial Sequence
  chemically synthesized
aaaatcctccattgagaagatt

SEQ ID NO: 1025170 - DNA, 22 bp, Artificial Sequence
  chemically synthesized
tagttttatagaatcttctcaa

SEQ ID NO: 1025171 - DNA, 22 bp, Artificial Sequence
  chemically synthesized
ctaaaaatcctccattgagaag

SEQ ID NO: 1025172 - DNA, 22 bp, Artificial Sequence
  chemically synthesized
tatagaatcttctcaatggagg

SEQ ID NO: 1025173 - DNA, 22 bp, Artificial Sequence
  chemically synthesized
atagaatcttctcaatggagga

SEQ ID NO: 1025174 - DNA, 22 bp, Artificial Sequence
  chemically synthesized
tagaatcttctcaatggaggat

SEQ ID NO: 1025175 - DNA, 22 bp, Artificial Sequence
  chemically synthesized
ctcaatggaggatttttaggag

SEQ ID NO: 1025176 - DNA, 22 bp, Artificial Sequence
  chemically synthesized
tcaatggaggatttttaggagc

SEQ ID NO: 1025177 - DNA, 22 bp, Artificial Sequence
  chemically synthesized
aatggaggatttttaggagctt

SEQ ID NO: 1025178 - DNA, 22 bp, Artificial Sequence
  chemically synthesized
cgcaatcagtaatatacatgtg

SEQ ID NO: 1025179 - DNA, 22 bp, Artificial Sequence
  chemically synthesized
ttaggagcttcacatgtatatt

SEQ ID NO: 1025180 - DNA, 22 bp, Artificial Sequence
  chemically synthesized
taggagcttcacatgtatatta

SEQ ID NO: 1025181 - DNA, 22 bp, Artificial Sequence
  chemically synthesized
aggagcttcacatgtatattac

SEQ ID NO: 1025182 - DNA, 22 bp, Artificial Sequence
  chemically synthesized
ggagcttcacatgtatattact

SEQ ID NO: 1025183 - DNA, 22 bp, Artificial Sequence
  chemically synthesized
cacatgtatattactgattgcg

SEQ ID NO: 1025184 - DNA, 22 bp, Artificial Sequence
  chemically synthesized
acatgtatattactgattgcgg

SEQ ID NO: 1025185 - DNA, 22 bp, Artificial Sequence
  chemically synthesized
agatatatgcaataaaaacact

SEQ ID NO: 1025186 - DNA, 22 bp, Artificial Sequence
  chemically synthesized
ctgattgcggagtgtttttatt

SEQ ID NO: 1025187 - DNA, 22 bp, Artificial Sequence
  chemically synthesized
attgcggagtgtttttattgca

SEQ ID NO: 1025188 - DNA, 22 bp, Artificial Sequence
  chemically synthesized
ccactgagatatatgcaataaa

SEQ ID NO: 1025189 - DNA, 22 bp, Artificial Sequence
  chemically synthesized
cggagtgtttttattgcatata

SEQ ID NO: 1025190 - DNA, 22 bp, Artificial Sequence
  chemically synthesized
caatactcccactgagatatat

SEQ ID NO: 1025191 - DNA, 22 bp, Artificial Sequence
  chemically synthesized
ccaatactcccactgagatata

SEQ ID NO: 1025192 - DNA, 22 bp, Artificial Sequence
  chemically synthesized
ttattgcatatatctcagtggg

SEQ ID NO: 1025193 - DNA, 22 bp, Artificial Sequence
  chemically synthesized
tattgcatatatctcagtggga

SEQ ID NO: 1025194 - DNA, 22 bp, Artificial Sequence
  chemically synthesized
attgcatatatctcagtgggag

SEQ ID NO: 1025195 - DNA, 22 bp, Artificial Sequence
  chemically synthesized
ttgcatatatctcagtgggagt

SEQ ID NO: 1025196 - DNA, 22 bp, Artificial Sequence
  chemically synthesized
catatatctcagtgggagtatt

SEQ ID NO: 1025197 - DNA, 22 bp, Artificial Sequence
  chemically synthesized
aaaaacccatttccaatactcc

SEQ ID NO: 1025198 - DNA, 22 bp, Artificial Sequence
  chemically synthesized
aatgttgaaaaacccatttcca

SEQ ID NO: 1025199 - DNA, 22 bp, Artificial Sequence
  chemically synthesized
agtgggagtattggaaatgggt

SEQ ID NO: 1025200 - DNA, 22 bp, Artificial Sequence
  chemically synthesized
aaatgttgaaaaacccatttcc

SEQ ID NO: 1025201 - DNA, 22 bp, Artificial Sequence
  chemically synthesized
gaaatgggtttttcaacattta

SEQ ID NO: 1025202 - DNA, 22 bp, Artificial Sequence
  chemically synthesized
aatggcatatatttaaatgttg

SEQ ID NO: 1025203 - DNA, 22 bp, Artificial Sequence
  chemically synthesized
aaatggcatatatttaaatgtt

SEQ ID NO: 1025204 - DNA, 22 bp, Artificial Sequence
  chemically synthesized
taaatggcatatatttaaatgt

SEQ ID NO: 1025205 - DNA, 22 bp, Artificial Sequence
  chemically synthesized
ttaaatggcatatatttaaatg

SEQ ID NO: 1025206 - DNA, 22 bp, Artificial Sequence
  chemically synthesized
tttaaatggcatatatttaaat

SEQ ID NO: 1025207 - DNA, 22 bp, Artificial Sequence
  chemically synthesized
ttcaacatttaaatatatgcca

SEQ ID NO: 1025208 - DNA, 22 bp, Artificial Sequence
  chemically synthesized
tcaacatttaaatatatgccat

SEQ ID NO: 1025209 - DNA, 22 bp, Artificial Sequence
  chemically synthesized
caacatttaaatatatgccatt

SEQ ID NO: 1025210 - DNA, 22 bp, Artificial Sequence
  chemically synthesized
aacatttaaatatatgccattt

SEQ ID NO: 1025211 - DNA, 22 bp, Artificial Sequence
  chemically synthesized
aaatatatgccatttaaaaaat

SEQ ID NO: 1025212 - DNA, 22 bp, Artificial Sequence
  chemically synthesized
aatatatgccatttaaaaaatc

SEQ ID NO: 1025213 - DNA, 22 bp, Artificial Sequence
  chemically synthesized
taagcagaagaggaagtgggat

SEQ ID NO: 1025214 - DNA, 22 bp, Artificial Sequence
  chemically synthesized
aaaaaatcccacttcctcttct

SEQ ID NO: 1025215 - DNA, 22 bp, Artificial Sequence
  chemically synthesized
aaaaatcccacttcctcttctg

SEQ ID NO: 1025216 - DNA, 22 bp, Artificial Sequence
  chemically synthesized
aagacagagaatagattgtaag

SEQ ID NO: 1025217 - DNA, 22 bp, Artificial Sequence
  chemically synthesized
gaagacagagaatagattgtaa

SEQ ID NO: 1025218 - DNA, 22 bp, Artificial Sequence
  chemically synthesized
tgaagacagagaatagattgta

SEQ ID NO: 1025219 - DNA, 22 bp, Artificial Sequence
  chemically synthesized
cctcttctgcttacaatctatt

SEQ ID NO: 1025220 - DNA, 22 bp, Artificial Sequence
  chemically synthesized
ctcttctgcttacaatctattc

SEQ ID NO: 1025221 - DNA, 22 bp, Artificial Sequence
  chemically synthesized
ttctgcttacaatctattctct

SEQ ID NO: 1025222 - DNA, 22 bp, Artificial Sequence
  chemically synthesized
tcactttgaagacagagaatag

SEQ ID NO: 1025223 - DNA, 22 bp, Artificial Sequence
  chemically synthesized
ctgcttacaatctattctctgt

SEQ ID NO: 1025224 - DNA, 22 bp, Artificial Sequence
  chemically synthesized
tgcttacaatctattctctgtc

SEQ ID NO: 1025225 - DNA, 22 bp, Artificial Sequence
  chemically synthesized
cttacaatctattctctgtctt

SEQ ID NO: 1025226 - DNA, 22 bp, Artificial Sequence
  chemically synthesized
acaatctattctctgtcttcaa

SEQ ID NO: 1025227 - DNA, 22 bp, Artificial Sequence
  chemically synthesized
caatctattctctgtcttcaaa

SEQ ID NO: 1025228 - DNA, 22 bp, Artificial Sequence
  chemically synthesized
agtgaatattatcactttgaag

SEQ ID NO: 1025229 - DNA, 22 bp, Artificial Sequence
  chemically synthesized
ttctctgtcttcaaagtgataa

SEQ ID NO: 1025230 - DNA, 22 bp, Artificial Sequence
  chemically synthesized
tctgtcttcaaagtgataatat

SEQ ID NO: 1025231 - DNA, 22 bp, Artificial Sequence
  chemically synthesized
tgtcttcaaagtgataatattc

SEQ ID NO: 1025232 - DNA, 22 bp, Artificial Sequence
  chemically synthesized
tcttcaaagtgataatattcac

SEQ ID NO: 1025233 - DNA, 22 bp, Artificial Sequence
  chemically synthesized
caaagtcgacattaagtgaata

SEQ ID NO: 1025234 - DNA, 22 bp, Artificial Sequence
  chemically synthesized
caaagtgataatattcacttaa

SEQ ID NO: 1025235 - DNA, 22 bp, Artificial Sequence
  chemically synthesized
ccaaagtcgacattaagtgaat

SEQ ID NO: 1025236 - DNA, 22 bp, Artificial Sequence
  chemically synthesized
aaagtgataatattcacttaat

SEQ ID NO: 1025237 - DNA, 22 bp, Artificial Sequence
  chemically synthesized
tgtgtttccaaagtcgacatta

SEQ ID NO: 1025238 - DNA, 22 bp, Artificial Sequence
  chemically synthesized
ttatgtgtttccaaagtcgaca

SEQ ID NO: 1025239 - DNA, 22 bp, Artificial Sequence
  chemically synthesized
attatgtgtttccaaagtcgac

SEQ ID NO: 1025240 - DNA, 22 bp, Artificial Sequence
  chemically synthesized
tattatgtgtttccaaagtcga

SEQ ID NO: 1025241 - DNA, 22 bp, Artificial Sequence
  chemically synthesized
ttattatgtgtttccaaagtcg

SEQ ID NO: 1025242 - DNA, 22 bp, Artificial Sequence
  chemically synthesized
acttaatgtcgactttggaaac

SEQ ID NO: 1025243 - DNA, 22 bp, Artificial Sequence
  chemically synthesized
ccatttttattatgtgtttcca

SEQ ID NO: 1025244 - DNA, 22 bp, Artificial Sequence
  chemically synthesized
aatgtcgactttggaaacacat

SEQ ID NO: 1025245 - DNA, 22 bp, Artificial Sequence
  chemically synthesized
accatttttattatgtgtttcc

SEQ ID NO: 1025246 - DNA, 22 bp, Artificial Sequence
  chemically synthesized
atgtcgactttggaaacacata

SEQ ID NO: 1025247 - DNA, 22 bp, Artificial Sequence
  chemically synthesized
tggaaacacataataaaaatgg

SEQ ID NO: 1025248 - DNA, 22 bp, Artificial Sequence
  chemically synthesized
ggaaacacataataaaaatggt

SEQ ID NO: 1025249 - DNA, 22 bp, Artificial Sequence
  chemically synthesized
gaaacacataataaaaatggta

SEQ ID NO: 1025250 - DNA, 22 bp, Artificial Sequence
  chemically synthesized
aaaagagagtgaggaaaatcca

SEQ ID NO: 1025251 - DNA, 22 bp, Artificial Sequence
  chemically synthesized
gctaaaaagagagtgaggaaaa

SEQ ID NO: 1025252 - DNA, 22 bp, Artificial Sequence
  chemically synthesized
ccacaatattagctaaaaagag

SEQ ID NO: 1025253 - DNA, 22 bp, Artificial Sequence
  chemically synthesized
gccacaatattagctaaaaaga

SEQ ID NO: 1025254 - DNA, 22 bp, Artificial Sequence
  chemically synthesized
tcctcactctctttttagctaa

SEQ ID NO: 1025255 - DNA, 22 bp, Artificial Sequence
  chemically synthesized
cctcactctctttttagctaat

SEQ ID NO: 1025256 - DNA, 22 bp, Artificial Sequence
  chemically synthesized
ctcactctctttttagctaata

SEQ ID NO: 1025257 - DNA, 22 bp, Artificial Sequence
  chemically synthesized
actctctttttagctaatattg

SEQ ID NO: 1025258 - DNA, 22 bp, Artificial Sequence
  chemically synthesized
tctttttagctaatattgtggc

SEQ ID NO: 1025259 - DNA, 22 bp, Artificial Sequence
  chemically synthesized
tttttagctaatattgtggcaa

SEQ ID NO: 1025260 - DNA, 22 bp, Artificial Sequence
  chemically synthesized
tttagctaatattgtggcaaat

SEQ ID NO: 1025261 - DNA, 22 bp, Artificial Sequence
  chemically synthesized
ttagctaatattgtggcaaatg

SEQ ID NO: 1025262 - DNA, 22 bp, Artificial Sequence
  chemically synthesized
tagctaatattgtggcaaatgt

SEQ ID NO: 1025263 - DNA, 22 bp, Artificial Sequence
  chemically synthesized
agctaatattgtggcaaatgtc

SEQ ID NO: 1025264 - DNA, 22 bp, Artificial Sequence
  chemically synthesized
caaagggaagaagacatttgcc

SEQ ID NO: 1025265 - DNA, 22 bp, Artificial Sequence
  chemically synthesized
gctaatattgtggcaaatgtct

SEQ ID NO: 1025266 - DNA, 22 bp, Artificial Sequence
  chemically synthesized
acaaagggaagaagacatttgc

SEQ ID NO: 1025267 - DNA, 22 bp, Artificial Sequence
  chemically synthesized
cttacaaagggaagaagacatt

SEQ ID NO: 1025268 - DNA, 22 bp, Artificial Sequence
  chemically synthesized
atattgtggcaaatgtcttctt

SEQ ID NO: 1025269 - DNA, 22 bp, Artificial Sequence
  chemically synthesized
tggcaaatgtcttcttcccttt

SEQ ID NO: 1025270 - DNA, 22 bp, Artificial Sequence
  chemically synthesized
cttccctttgtaagcaatattt

SEQ ID NO: 1025271 - DNA, 22 bp, Artificial Sequence
  chemically synthesized
ttccctttgtaagcaatatttt

SEQ ID NO: 1025272 - DNA, 22 bp, Artificial Sequence
  chemically synthesized
atagaaaagagagaaaatattg

SEQ ID NO: 1025273 - DNA, 22 bp, Artificial Sequence
  chemically synthesized
ccctttgtaagcaatattttct

SEQ ID NO: 1025274 - DNA, 22 bp, Artificial Sequence
  chemically synthesized
aatagaaaagagagaaaatatt

SEQ ID NO: 1025275 - DNA, 22 bp, Artificial Sequence
  chemically synthesized
cctttgtaagcaatattttctc

SEQ ID NO: 1025276 - DNA, 22 bp, Artificial Sequence
  chemically synthesized
tgtaagcaatattttctctctt

SEQ ID NO: 1025277 - DNA, 22 bp, Artificial Sequence
  chemically synthesized
gtaagcaatattttctctcttt

SEQ ID NO: 1025278 - DNA, 22 bp, Artificial Sequence
  chemically synthesized
taagcaatattttctctctttt

SEQ ID NO: 1025279 - DNA, 22 bp, Artificial Sequence
  chemically synthesized
ggcaaataaagcttaatagaaa

SEQ ID NO: 1025280 - DNA, 22 bp, Artificial Sequence
  chemically synthesized
tctctcttttctattaagcttt

SEQ ID NO: 1025281 - DNA, 22 bp, Artificial Sequence
  chemically synthesized
aactaggcaaataaagcttaat

SEQ ID NO: 1025282 - DNA, 22 bp, Artificial Sequence
  chemically synthesized
ctctcttttctattaagcttta

SEQ ID NO: 1025283 - DNA, 22 bp, Artificial Sequence
  chemically synthesized
tctcttttctattaagctttat

SEQ ID NO: 1025284 - DNA, 22 bp, Artificial Sequence
  chemically synthesized
ctaaactaggcaaataaagctt

SEQ ID NO: 1025285 - DNA, 22 bp, Artificial Sequence
  chemically synthesized
tcttttctattaagctttattt

SEQ ID NO: 1025286 - DNA, 22 bp, Artificial Sequence
  chemically synthesized
ttttctattaagctttatttgc

SEQ ID NO: 1025287 - DNA, 22 bp, Artificial Sequence
  chemically synthesized
ttctattaagctttatttgcct

SEQ ID NO: 1025288 - DNA, 22 bp, Artificial Sequence
  chemically synthesized
tctattaagctttatttgccta

SEQ ID NO: 1025289 - DNA, 22 bp, Artificial Sequence
  chemically synthesized
ctattaagctttatttgcctag

SEQ ID NO: 1025290 - DNA, 22 bp, Artificial Sequence
  chemically synthesized
tattaagctttatttgcctagt

SEQ ID NO: 1025291 - DNA, 22 bp, Artificial Sequence
  chemically synthesized
ttaagctttatttgcctagttt

SEQ ID NO: 1025292 - DNA, 22 bp, Artificial Sequence
  chemically synthesized
agctttatttgcctagtttagc

SEQ ID NO: 1025293 - DNA, 22 bp, Artificial Sequence
  chemically synthesized
tatttgcctagtttagcaggtt

SEQ ID NO: 1025294 - DNA, 22 bp, Artificial Sequence
  chemically synthesized
atttgcctagtttagcaggttt

SEQ ID NO: 1025295 - DNA, 22 bp, Artificial Sequence
  chemically synthesized
tttgcctagtttagcaggtttt

SEQ ID NO: 1025296 - DNA, 22 bp, Artificial Sequence
  chemically synthesized
gcctagtttagcaggttttatt

SEQ ID NO: 1025297 - DNA, 22 bp, Artificial Sequence
  chemically synthesized
cctagtttagcaggttttattt

SEQ ID NO: 1025298 - DNA, 22 bp, Artificial Sequence
  chemically synthesized
gtttagcaggttttatttttct

SEQ ID NO: 1025299 - DNA, 22 bp, Artificial Sequence
  chemically synthesized
agcaggttttatttttctcctg

SEQ ID NO: 1025300 - DNA, 22 bp, Artificial Sequence
  chemically synthesized
gcaggttttatttttctcctgc

SEQ ID NO: 1025301 - DNA, 22 bp, Artificial Sequence
  chemically synthesized
tatttttctcctgcttatcgta

SEQ ID NO: 1025302 - DNA, 22 bp, Artificial Sequence
  chemically synthesized
atttttctcctgcttatcgtat

SEQ ID NO: 1025303 - DNA, 22 bp, Artificial Sequence
  chemically synthesized
tttttctcctgcttatcgtatt

SEQ ID NO: 1025304 - DNA, 22 bp, Artificial Sequence
  chemically synthesized
ttctcctgcttatcgtattcct

SEQ ID NO: 1025305 - DNA, 22 bp, Artificial Sequence
  chemically synthesized
acccgcatggataggaatacga

SEQ ID NO: 1025306 - DNA, 22 bp, Artificial Sequence
  chemically synthesized
tctcctgcttatcgtattccta

SEQ ID NO: 1025307 - DNA, 22 bp, Artificial Sequence
  chemically synthesized
gacccgcatggataggaatacg

SEQ ID NO: 1025308 - DNA, 22 bp, Artificial Sequence
  chemically synthesized
ctcctgcttatcgtattcctat

SEQ ID NO: 1025309 - DNA, 22 bp, Artificial Sequence
  chemically synthesized
tgacccgcatggataggaatac

SEQ ID NO: 1025310 - DNA, 22 bp, Artificial Sequence
  chemically synthesized
tcctgcttatcgtattcctatc

SEQ ID NO: 1025311 - DNA, 22 bp, Artificial Sequence
  chemically synthesized
ttgacccgcatggataggaata

SEQ ID NO: 1025312 - DNA, 22 bp, Artificial Sequence
  chemically synthesized
ctgcttatcgtattcctatcca

SEQ ID NO: 1025313 - DNA, 22 bp, Artificial Sequence
  chemically synthesized
cttttgacccgcatggatagga

SEQ ID NO: 1025314 - DNA, 22 bp, Artificial Sequence
  chemically synthesized
ccttttgacccgcatggatagg

SEQ ID NO: 1025315 - DNA, 22 bp, Artificial Sequence
  chemically synthesized
cttatcgtattcctatccatgc

SEQ ID NO: 1025316 - DNA, 22 bp, Artificial Sequence
  chemically synthesized
atcgtattcctatccatgcggg

SEQ ID NO: 1025317 - DNA, 22 bp, Artificial Sequence
  chemically synthesized
atttccttttgacccgcatgga

SEQ ID NO: 1025318 - DNA, 22 bp, Artificial Sequence
  chemically synthesized
tcgtattcctatccatgcgggt

SEQ ID NO: 1025319 - DNA, 22 bp, Artificial Sequence
  chemically synthesized
attaatttccttttgacccgca

SEQ ID NO: 1025320 - DNA, 22 bp, Artificial Sequence
  chemically synthesized
ctatccatgcgggtcaaaagga

SEQ ID NO: 1025321 - DNA, 22 bp, Artificial Sequence
  chemically synthesized
tccatgcgggtcaaaaggaaat

SEQ ID NO: 1025322 - DNA, 22 bp, Artificial Sequence
  chemically synthesized
tgtcagaggaaacaagagctca

SEQ ID NO: 1025323 - DNA, 22 bp, Artificial Sequence
  chemically synthesized
gtgtcagaggaaacaagagctc

SEQ ID NO: 1025324 - DNA, 22 bp, Artificial Sequence
  chemically synthesized
tgtgtcagaggaaacaagagct

SEQ ID NO: 1025325 - DNA, 22 bp, Artificial Sequence
  chemically synthesized
atgagctcttgtttcctctgac

SEQ ID NO: 1025326 - DNA, 22 bp, Artificial Sequence
  chemically synthesized
ttgtttcctctgacacaaaaca

SEQ ID NO: 1025327 - DNA, 22 bp, Artificial Sequence
  chemically synthesized
gtttcctctgacacaaaacatt

SEQ ID NO: 1025328 - DNA, 22 bp, Artificial Sequence
  chemically synthesized
tgtaccaagaaaaatgttttgt

SEQ ID NO: 1025329 - DNA, 22 bp, Artificial Sequence
  chemically synthesized
tttcctctgacacaaaacattt

SEQ ID NO: 1025330 - DNA, 22 bp, Artificial Sequence
  chemically synthesized
cctctgacacaaaacatttttc

SEQ ID NO: 1025331 - DNA, 22 bp, Artificial Sequence
  chemically synthesized
ctctgacacaaaacatttttct

SEQ ID NO: 1025332 - DNA, 22 bp, Artificial Sequence
  chemically synthesized
tgacacaaaacatttttcttgg

SEQ ID NO: 1025333 - DNA, 22 bp, Artificial Sequence
  chemically synthesized
acacaaaacatttttcttggta

SEQ ID NO: 1025334 - DNA, 22 bp, Artificial Sequence
  chemically synthesized
gggaggcagaactgtgtaccaa

SEQ ID NO: 1025335 - DNA, 22 bp, Artificial Sequence
  chemically synthesized
ttcttggtacacagttctgcct

SEQ ID NO: 1025336 - DNA, 22 bp, Artificial Sequence
  chemically synthesized
tcttggtacacagttctgcctc

SEQ ID NO: 1025337 - DNA, 22 bp, Artificial Sequence
  chemically synthesized
cttggtacacagttctgcctcc

SEQ ID NO: 1025338 - DNA, 22 bp, Artificial Sequence
  chemically synthesized
ttggtacacagttctgcctccc

SEQ ID NO: 1025339 - DNA, 22 bp, Artificial Sequence
  chemically synthesized
ggtacacagttctgcctcccca

SEQ ID NO: 1025340 - DNA, 22 bp, Artificial Sequence
  chemically synthesized
gtacacagttctgcctccccag

SEQ ID NO: 1025341 - DNA, 22 bp, Artificial Sequence
  chemically synthesized
cgtcatgtccagagtgaaaaca

SEQ ID NO: 1025342 - DNA, 22 bp, Artificial Sequence
  chemically synthesized
tgcctccccagtgttttcactc

SEQ ID NO: 1025343 - DNA, 22 bp, Artificial Sequence
  chemically synthesized
ccgtcatgtccagagtgaaaac

SEQ ID NO: 1025344 - DNA, 22 bp, Artificial Sequence
  chemically synthesized
cctccccagtgttttcactctg

SEQ ID NO: 1025345 - DNA, 22 bp, Artificial Sequence
  chemically synthesized
tttccgtcatgtccagagtgaa

SEQ ID NO: 1025346 - DNA, 22 bp, Artificial Sequence
  chemically synthesized
cccagtgttttcactctggaca

SEQ ID NO: 1025347 - DNA, 22 bp, Artificial Sequence
  chemically synthesized
actgtttccgtcatgtccagag

SEQ ID NO: 1025348 - DNA, 22 bp, Artificial Sequence
  chemically synthesized
cactgtttccgtcatgtccaga

SEQ ID NO: 1025349 - DNA, 22 bp, Artificial Sequence
  chemically synthesized
tcactgtttccgtcatgtccag

SEQ ID NO: 1025350 - DNA, 22 bp, Artificial Sequence
  chemically synthesized
ttcactgtttccgtcatgtcca

SEQ ID NO: 1025351 - DNA, 22 bp, Artificial Sequence
  chemically synthesized
cttttcactgtttccgtcatgt

SEQ ID NO: 1025352 - DNA, 22 bp, Artificial Sequence
  chemically synthesized
tcactctggacatgacggaaac

SEQ ID NO: 1025353 - DNA, 22 bp, Artificial Sequence
  chemically synthesized
ttgcttttcactgtttccgtca

SEQ ID NO: 1025354 - DNA, 22 bp, Artificial Sequence
  chemically synthesized
cactctggacatgacggaaaca

SEQ ID NO: 1025355 - DNA, 22 bp, Artificial Sequence
  chemically synthesized
actctggacatgacggaaacag

SEQ ID NO: 1025356 - DNA, 22 bp, Artificial Sequence
  chemically synthesized
ctattgcttttcactgtttccg

SEQ ID NO: 1025357 - DNA, 22 bp, Artificial Sequence
  chemically synthesized
tggacatgacggaaacagtgaa

SEQ ID NO: 1025358 - DNA, 22 bp, Artificial Sequence
  chemically synthesized
gacatgacggaaacagtgaaaa

SEQ ID NO: 1025359 - DNA, 22 bp, Artificial Sequence
  chemically synthesized
ccatctcctattgcttttcact

SEQ ID NO: 1025360 - DNA, 22 bp, Artificial Sequence
  chemically synthesized
tcccatctcctattgcttttca

SEQ ID NO: 1025361 - DNA, 22 bp, Artificial Sequence
  chemically synthesized
ctcccatctcctattgcttttc

SEQ ID NO: 1025362 - DNA, 22 bp, Artificial Sequence
  chemically synthesized
cgaatgcaatgccttctcccat

SEQ ID NO: 1025363 - DNA, 22 bp, Artificial Sequence
  chemically synthesized
attgcgaatgcaatgccttctc

SEQ ID NO: 1025364 - DNA, 22 bp, Artificial Sequence
  chemically synthesized
accatatgttgattgcgaatgc

SEQ ID NO: 1025365 - DNA, 22 bp, Artificial Sequence
  chemically synthesized
gaagtggctgaccatatgttga

SEQ ID NO: 1025366 - DNA, 22 bp, Artificial Sequence
  chemically synthesized
cattcgcaatcaacatatggtc

SEQ ID NO: 1025367 - DNA, 22 bp, Artificial Sequence
  chemically synthesized
attggaagtggctgaccatatg

SEQ ID NO: 1025368 - DNA, 22 bp, Artificial Sequence
  chemically synthesized
gcaatcaacatatggtcagcca

SEQ ID NO: 1025369 - DNA, 22 bp, Artificial Sequence
  chemically synthesized
aaaactcattggaagtggctga

SEQ ID NO: 1025370 - DNA, 22 bp, Artificial Sequence
  chemically synthesized
atcagtgctgaaaactcattgg

SEQ ID NO: 1025371 - DNA, 22 bp, Artificial Sequence
  chemically synthesized
ccaatgagttttcagcactgat

SEQ ID NO: 1025372 - DNA, 22 bp, Artificial Sequence
  chemically synthesized
caatgagttttcagcactgatg

SEQ ID NO: 1025373 - DNA, 22 bp, Artificial Sequence
  chemically synthesized
agacagcagtgatagtgttcat

SEQ ID NO: 1025374 - DNA, 22 bp, Artificial Sequence
  chemically synthesized
aagacagcagtgatagtgttca

SEQ ID NO: 1025375 - DNA, 22 bp, Artificial Sequence
  chemically synthesized
tcagcactgatgaacactatca

SEQ ID NO: 1025376 - DNA, 22 bp, Artificial Sequence
  chemically synthesized
cagcactgatgaacactatcac

SEQ ID NO: 1025377 - DNA, 22 bp, Artificial Sequence
  chemically synthesized
agcactgatgaacactatcact

SEQ ID NO: 1025378 - DNA, 22 bp, Artificial Sequence
  chemically synthesized
atgaacactatcactgctgtct

SEQ ID NO: 1025379 - DNA, 22 bp, Artificial Sequence
  chemically synthesized
tcactgctgtcttaagcttatg

SEQ ID NO: 1025380 - DNA, 22 bp, Artificial Sequence
  chemically synthesized
ctgtcttaagcttatgctggtg

SEQ ID NO: 1025381 - DNA, 22 bp, Artificial Sequence
  chemically synthesized
tcttaagcttatgctggtgtcc

SEQ ID NO: 1025382 - DNA, 22 bp, Artificial Sequence
  chemically synthesized
aagcttatgctggtgtccatta

SEQ ID NO: 1025383 - DNA, 22 bp, Artificial Sequence
  chemically synthesized
agcttatgctggtgtccattac

SEQ ID NO: 1025384 - DNA, 22 bp, Artificial Sequence
  chemically synthesized
atgctggtgtccattactgtcc

SEQ ID NO: 1025385 - DNA, 22 bp, Artificial Sequence
  chemically synthesized
tgctggtgtccattactgtcca

SEQ ID NO: 1025386 - DNA, 22 bp, Artificial Sequence
  chemically synthesized
acaaagcagccagtggacagta

SEQ ID NO: 1025387 - DNA, 22 bp, Artificial Sequence
  chemically synthesized
cacaaagcagccagtggacagt

SEQ ID NO: 1025388 - DNA, 22 bp, Artificial Sequence
  chemically synthesized
gtgtccattactgtccactggc

SEQ ID NO: 1025389 - DNA, 22 bp, Artificial Sequence
  chemically synthesized
ctgtccactggctgctttgtga

SEQ ID NO: 1025390 - DNA, 22 bp, Artificial Sequence
  chemically synthesized
tccactggctgctttgtgaaac

SEQ ID NO: 1025391 - DNA, 22 bp, Artificial Sequence
  chemically synthesized
gctgctttgtgaaactacatct

SEQ ID NO: 1025392 - DNA, 22 bp, Artificial Sequence
  chemically synthesized
ctttgtgaaactacatctcctg

SEQ ID NO: 1025393 - DNA, 22 bp, Artificial Sequence
  chemically synthesized
tgtgaaactacatctcctggct

SEQ ID NO: 1025394 - DNA, 22 bp, Artificial Sequence
  chemically synthesized
gtgaaactacatctcctggctt

SEQ ID NO: 1025395 - DNA, 22 bp, Artificial Sequence
  chemically synthesized
tgaaactacatctcctggcttt

SEQ ID NO: 1025396 - DNA, 22 bp, Artificial Sequence
  chemically synthesized
catctcctggctttcttcatac

SEQ ID NO: 1025397 - DNA, 22 bp, Artificial Sequence
  chemically synthesized
ctggctttcttcatacctcgat

SEQ ID NO: 1025398 - DNA, 22 bp, Artificial Sequence
  chemically synthesized
gctttcttcatacctcgatggt

SEQ ID NO: 1025399 - DNA, 22 bp, Artificial Sequence
  chemically synthesized
aaaaggagcacaaaaaccatcg

SEQ ID NO: 1025400 - DNA, 22 bp, Artificial Sequence
  chemically synthesized
tcttcatacctcgatggttttt

SEQ ID NO: 1025401 - DNA, 22 bp, Artificial Sequence
  chemically synthesized
cttcatacctcgatggtttttg

SEQ ID NO: 1025402 - DNA, 22 bp, Artificial Sequence
  chemically synthesized
ttcatacctcgatggtttttgt

SEQ ID NO: 1025403 - DNA, 22 bp, Artificial Sequence
  chemically synthesized
catacctcgatggtttttgtgc

SEQ ID NO: 1025404 - DNA, 22 bp, Artificial Sequence
  chemically synthesized
atacctcgatggtttttgtgct

SEQ ID NO: 1025405 - DNA, 22 bp, Artificial Sequence
  chemically synthesized
gatggtttttgtgctccttttc

SEQ ID NO: 1025406 - DNA, 22 bp, Artificial Sequence
  chemically synthesized
ggtaaggaataaccctgaaaag

SEQ ID NO: 1025407 - DNA, 22 bp, Artificial Sequence
  chemically synthesized
ttgtgctccttttcagggttat

SEQ ID NO: 1025408 - DNA, 22 bp, Artificial Sequence
  chemically synthesized
tgtgctccttttcagggttatt

SEQ ID NO: 1025409 - DNA, 22 bp, Artificial Sequence
  chemically synthesized
gtgctccttttcagggttattc

SEQ ID NO: 1025410 - DNA, 22 bp, Artificial Sequence
  chemically synthesized
tgctccttttcagggttattcc

SEQ ID NO: 1025411 - DNA, 22 bp, Artificial Sequence
  chemically synthesized
gtgactgggtaaggaataaccc

SEQ ID NO: 1025412 - DNA, 22 bp, Artificial Sequence
  chemically synthesized
agtgactgggtaaggaataacc

SEQ ID NO: 1025413 - DNA, 22 bp, Artificial Sequence
  chemically synthesized
cttttcagggttattccttacc

SEQ ID NO: 1025414 - DNA, 22 bp, Artificial Sequence
  chemically synthesized
ttcagggttattccttacccag

SEQ ID NO: 1025415 - DNA, 22 bp, Artificial Sequence
  chemically synthesized
tcagggttattccttacccagt

SEQ ID NO: 1025416 - DNA, 22 bp, Artificial Sequence
  chemically synthesized
atgcatttagtgactgggtaag

SEQ ID NO: 1025417 - DNA, 22 bp, Artificial Sequence
  chemically synthesized
cagggttattccttacccagtc

SEQ ID NO: 1025418 - DNA, 22 bp, Artificial Sequence
  chemically synthesized
aatgcatttagtgactgggtaa

SEQ ID NO: 1025419 - DNA, 22 bp, Artificial Sequence
  chemically synthesized
agggttattccttacccagtca

SEQ ID NO: 1025420 - DNA, 22 bp, Artificial Sequence
  chemically synthesized
taatgcatttagtgactgggta

SEQ ID NO: 1025421 - DNA, 22 bp, Artificial Sequence
  chemically synthesized
ttaatgcatttagtgactgggt

SEQ ID NO: 1025422 - DNA, 22 bp, Artificial Sequence
  chemically synthesized
ttccttacccagtcactaaatg

SEQ ID NO: 1025423 - DNA, 22 bp, Artificial Sequence
  chemically synthesized
cttacccagtcactaaatgcat

SEQ ID NO: 1025424 - DNA, 22 bp, Artificial Sequence
  chemically synthesized
tgaggtacttttaatgcattta

SEQ ID NO: 1025425 - DNA, 22 bp, Artificial Sequence
  chemically synthesized
atgaggtacttttaatgcattt

SEQ ID NO: 1025426 - DNA, 22 bp, Artificial Sequence
  chemically synthesized
acccagtcactaaatgcattaa

SEQ ID NO: 1025427 - DNA, 22 bp, Artificial Sequence
  chemically synthesized
tatgaggtacttttaatgcatt

SEQ ID NO: 1025428 - DNA, 22 bp, Artificial Sequence
  chemically synthesized
cccagtcactaaatgcattaaa

SEQ ID NO: 1025429 - DNA, 22 bp, Artificial Sequence
  chemically synthesized
ttttatgaggtacttttaatgc

SEQ ID NO: 1025430 - DNA, 22 bp, Artificial Sequence
  chemically synthesized
aatgcattaaaagtacctcata

SEQ ID NO: 1025431 - DNA, 22 bp, Artificial Sequence
  chemically synthesized
aaagtacctcataaaacaggat

SEQ ID NO: 1025432 - DNA, 22 bp, Artificial Sequence
  chemically synthesized
caaaggacatgaagtcatcctg

SEQ ID NO: 1025433 - DNA, 22 bp, Artificial Sequence
  chemically synthesized
ataaaacaggatgacttcatgt

SEQ ID NO: 1025434 - DNA, 22 bp, Artificial Sequence
  chemically synthesized
atccatgtccctgcaaaggaca

SEQ ID NO: 1025435 - DNA, 22 bp, Artificial Sequence
  chemically synthesized
catccatgtccctgcaaaggac

SEQ ID NO: 1025436 - DNA, 22 bp, Artificial Sequence
  chemically synthesized
cagcttcatccatgtccctgca

SEQ ID NO: 1025437 - DNA, 22 bp, Artificial Sequence
  chemically synthesized
ccagcttcatccatgtccctgc

SEQ ID NO: 1025438 - DNA, 22 bp, Artificial Sequence
  chemically synthesized
catgtcctttgcagggacatgg

SEQ ID NO: 1025439 - DNA, 22 bp, Artificial Sequence
  chemically synthesized
atgtcctttgcagggacatgga

SEQ ID NO: 1025440 - DNA, 22 bp, Artificial Sequence
  chemically synthesized
tgcagggacatggatgaagctg

SEQ ID NO: 1025441 - DNA, 22 bp, Artificial Sequence
  chemically synthesized
gcagggacatggatgaagctgg

SEQ ID NO: 1025442 - DNA, 22 bp, Artificial Sequence
  chemically synthesized
cagggacatggatgaagctgga

SEQ ID NO: 1025443 - DNA, 22 bp, Artificial Sequence
  chemically synthesized
agaatgatggtttccagcttca

SEQ ID NO: 1025444 - DNA, 22 bp, Artificial Sequence
  chemically synthesized
ctaagaatgatggtttccagct

SEQ ID NO: 1025445 - DNA, 22 bp, Artificial Sequence
  chemically synthesized
gctaagaatgatggtttccagc

SEQ ID NO: 1025446 - DNA, 22 bp, Artificial Sequence
  chemically synthesized
gtttgctaagaatgatggtttc

SEQ ID NO: 1025447 - DNA, 22 bp, Artificial Sequence
  chemically synthesized
tgttagtttgctaagaatgatg

SEQ ID NO: 1025448 - DNA, 22 bp, Artificial Sequence
  chemically synthesized
ctgtgttagtttgctaagaatg

SEQ ID NO: 1025449 - DNA, 22 bp, Artificial Sequence
  chemically synthesized
ttcctgtgttagtttgctaaga

SEQ ID NO: 1025450 - DNA, 22 bp, Artificial Sequence
  chemically synthesized
gaaaccatcattcttagcaaac

SEQ ID NO: 1025451 - DNA, 22 bp, Artificial Sequence
  chemically synthesized
tgttcctgtgttagtttgctaa

SEQ ID NO: 1025452 - DNA, 22 bp, Artificial Sequence
  chemically synthesized
ctgttcctgtgttagtttgcta

SEQ ID NO: 1025453 - DNA, 22 bp, Artificial Sequence
  chemically synthesized
tctgttcctgtgttagtttgct

SEQ ID NO: 1025454 - DNA, 22 bp, Artificial Sequence
  chemically synthesized
attttctgttcctgtgttagtt

SEQ ID NO: 1025455 - DNA, 22 bp, Artificial Sequence
  chemically synthesized
cattttctgttcctgtgttagt

SEQ ID NO: 1025456 - DNA, 22 bp, Artificial Sequence
  chemically synthesized
ttagcaaactaacacaggaaca

SEQ ID NO: 1025457 - DNA, 22 bp, Artificial Sequence
  chemically synthesized
agcaaactaacacaggaacaga

SEQ ID NO: 1025458 - DNA, 22 bp, Artificial Sequence
  chemically synthesized
gcaaactaacacaggaacagaa

SEQ ID NO: 1025459 - DNA, 22 bp, Artificial Sequence
  chemically synthesized
acacaggaacagaaaatgaaac

SEQ ID NO: 1025460 - DNA, 22 bp, Artificial Sequence
  chemically synthesized
cgagtgagtccatgcagtgttt

SEQ ID NO: 1025461 - DNA, 22 bp, Artificial Sequence
  chemically synthesized
acgagtgagtccatgcagtgtt

SEQ ID NO: 1025462 - DNA, 22 bp, Artificial Sequence
  chemically synthesized
ccacttacgagtgagtccatgc

SEQ ID NO: 1025463 - DNA, 22 bp, Artificial Sequence
  chemically synthesized
cactcccacttacgagtgagtc

SEQ ID NO: 1025464 - DNA, 22 bp, Artificial Sequence
  chemically synthesized
ttccactcccacttacgagtga

SEQ ID NO: 1025465 - DNA, 22 bp, Artificial Sequence
  chemically synthesized
actgttccactcccacttacga

SEQ ID NO: 1025466 - DNA, 22 bp, Artificial Sequence
  chemically synthesized
catggactcactcgtaagtggg

SEQ ID NO: 1025467 - DNA, 22 bp, Artificial Sequence
  chemically synthesized
tcactgttccactcccacttac

SEQ ID NO: 1025468 - DNA, 22 bp, Artificial Sequence
  chemically synthesized
actcgtaagtgggagtggaaca

SEQ ID NO: 1025469 - DNA, 22 bp, Artificial Sequence
  chemically synthesized
gtaagtgggagtggaacagtga

SEQ ID NO: 1025470 - DNA, 22 bp, Artificial Sequence
  chemically synthesized
tgtccatgtgttctcactgttc

SEQ ID NO: 1025471 - DNA, 22 bp, Artificial Sequence
  chemically synthesized
cctgtgtccatgtgttctcact

SEQ ID NO: 1025472 - DNA, 22 bp, Artificial Sequence
  chemically synthesized
ccctccctgtgtccatgtgttc

SEQ ID NO: 1025473 - DNA, 22 bp, Artificial Sequence
  chemically synthesized
ttcccctccctgtgtccatgtg

SEQ ID NO: 1025474 - DNA, 22 bp, Artificial Sequence
  chemically synthesized
gccccccacccccaacaggcac

SEQ ID NO: 1025475 - DNA, 22 bp, Artificial Sequence
  chemically synthesized
ccctagccccccacccccaaca

SEQ ID NO: 1025476 - DNA, 22 bp, Artificial Sequence
  chemically synthesized
tccctaccctagccccccaccc

SEQ ID NO: 1025477 - DNA, 22 bp, Artificial Sequence
  chemically synthesized
gtgcctgttgggggtggggggc

SEQ ID NO: 1025478 - DNA, 22 bp, Artificial Sequence
  chemically synthesized
atgctatccctaccctagcccc

SEQ ID NO: 1025479 - DNA, 22 bp, Artificial Sequence
  chemically synthesized
ttgggggtggggggctagggta

SEQ ID NO: 1025480 - DNA, 22 bp, Artificial Sequence
  chemically synthesized
ctaatgctatccctaccctagc

SEQ ID NO: 1025481 - DNA, 22 bp, Artificial Sequence
  chemically synthesized
ggggtggggggctagggtaggg

SEQ ID NO: 1025482 - DNA, 22 bp, Artificial Sequence
  chemically synthesized
tcctaatgctatccctacccta

SEQ ID NO: 1025483 - DNA, 22 bp, Artificial Sequence
  chemically synthesized
ctcctaatgctatccctaccct

SEQ ID NO: 1025484 - DNA, 22 bp, Artificial Sequence
  chemically synthesized
ggtatttctcctaatgctatcc

SEQ ID NO: 1025485 - DNA, 22 bp, Artificial Sequence
  chemically synthesized
cattaggtatttctcctaatgc

SEQ ID NO: 1025486 - DNA, 22 bp, Artificial Sequence
  chemically synthesized
gggtagggatagcattaggaga

SEQ ID NO: 1025487 - DNA, 22 bp, Artificial Sequence
  chemically synthesized
ggagaaatacctaatgtagatg

SEQ ID NO: 1025488 - DNA, 22 bp, Artificial Sequence
  chemically synthesized
cacccatcaacccgtcatctac

SEQ ID NO: 1025489 - DNA, 22 bp, Artificial Sequence
  chemically synthesized
ctgcacccatcaacccgtcatc

SEQ ID NO: 1025490 - DNA, 22 bp, Artificial Sequence
  chemically synthesized
gctgcacccatcaacccgtcat

SEQ ID NO: 1025491 - DNA, 22 bp, Artificial Sequence
  chemically synthesized
atgtagatgacgggttgatggg

SEQ ID NO: 1025492 - DNA, 22 bp, Artificial Sequence
  chemically synthesized
tggtggtttgctgcacccatca

SEQ ID NO: 1025493 - DNA, 22 bp, Artificial Sequence
  chemically synthesized
atgggtgcagcaaaccaccata

SEQ ID NO: 1025494 - DNA, 22 bp, Artificial Sequence
  chemically synthesized
cataggtatacacgtgctatgg

SEQ ID NO: 1025495 - DNA, 22 bp, Artificial Sequence
  chemically synthesized
ttacataggtatacacgtgcta

SEQ ID NO: 1025496 - DNA, 22 bp, Artificial Sequence
  chemically synthesized
gttacataggtatacacgtgct

SEQ ID NO: 1025497 - DNA, 22 bp, Artificial Sequence
  chemically synthesized
ggatacaggtgcagaacgtgca

SEQ ID NO: 1025498 - DNA, 22 bp, Artificial Sequence
  chemically synthesized
tgtaacaaacctgcacgttctg

SEQ ID NO: 1025499 - DNA, 22 bp, Artificial Sequence
  chemically synthesized
tgggatacaggtgcagaacgtg

SEQ ID NO: 1025500 - DNA, 22 bp, Artificial Sequence
  chemically synthesized
cgttctgggatacaggtgcaga

SEQ ID NO: 1025501 - DNA, 22 bp, Artificial Sequence
  chemically synthesized
acgttctgggatacaggtgcag

SEQ ID NO: 1025502 - DNA, 22 bp, Artificial Sequence
  chemically synthesized
tacgttctgggatacaggtgca

SEQ ID NO: 1025503 - DNA, 22 bp, Artificial Sequence
  chemically synthesized
cacgttctgcacctgtatccca

SEQ ID NO: 1025504 - DNA, 22 bp, Artificial Sequence
  chemically synthesized
tactttacgttctgggatacag

SEQ ID NO: 1025505 - DNA, 22 bp, Artificial Sequence
  chemically synthesized
ttatactttacgttctgggata

SEQ ID NO: 1025506 - DNA, 22 bp, Artificial Sequence
  chemically synthesized
ttattatactttacgttctggg

SEQ ID NO: 1025507 - DNA, 22 bp, Artificial Sequence
  chemically synthesized
tgcacctgtatcccagaacgta

SEQ ID NO: 1025508 - DNA, 22 bp, Artificial Sequence
  chemically synthesized
cacctgtatcccagaacgtaaa

SEQ ID NO: 1025509 - DNA, 22 bp, Artificial Sequence
  chemically synthesized
attattattatactttacgttc

SEQ ID NO: 1025510 - DNA, 22 bp, Artificial Sequence
  chemically synthesized
aattattattatactttacgtt

SEQ ID NO: 1025511 - DNA, 22 bp, Artificial Sequence
  chemically synthesized
taattattattatactttacgt

SEQ ID NO: 1025512 - DNA, 22 bp, Artificial Sequence
  chemically synthesized
ttaattattattatactttacg

SEQ ID NO: 1025513 - DNA, 22 bp, Artificial Sequence
  chemically synthesized
tttaattattattatactttac

SEQ ID NO: 1025514 - DNA, 22 bp, Artificial Sequence
  chemically synthesized
tatcccagaacgtaaagtataa

SEQ ID NO: 1025515 - DNA, 22 bp, Artificial Sequence
  chemically synthesized
ttttaattattattatacttta

SEQ ID NO: 1025516 - DNA, 22 bp, Artificial Sequence
  chemically synthesized
tttttaattattattatacttt

SEQ ID NO: 1025517 - DNA, 22 bp, Artificial Sequence
  chemically synthesized
ttttttaattattattatactt

SEQ ID NO: 1025518 - DNA, 22 bp, Artificial Sequence
  chemically synthesized
tttttttaattattattatact

SEQ ID NO: 1025519 - DNA, 22 bp, Artificial Sequence
  chemically synthesized
ttttttttaattattattatac

SEQ ID NO: 1025520 - DNA, 22 bp, Artificial Sequence
  chemically synthesized
aggaacttttttttttaattat

SEQ ID NO: 1025521 - DNA, 22 bp, Artificial Sequence
  chemically synthesized
gaggaacttttttttttaatta

SEQ ID NO: 1025522 - DNA, 22 bp, Artificial Sequence
  chemically synthesized
tgaggaacttttttttttaatt

SEQ ID NO: 1025523 - DNA, 22 bp, Artificial Sequence
  chemically synthesized
atcaggacaaatctttgaggaa

SEQ ID NO: 1025524 - DNA, 22 bp, Artificial Sequence
  chemically synthesized
aaaaaaaaagttcctcaaagat

SEQ ID NO: 1025525 - DNA, 22 bp, Artificial Sequence
  chemically synthesized
taggtagaagattgatcaggac

SEQ ID NO: 1025526 - DNA, 22 bp, Artificial Sequence
  chemically synthesized
ctcaaagatttgtcctgatcaa

SEQ ID NO: 1025527 - DNA, 22 bp, Artificial Sequence
  chemically synthesized
aaagatttgtcctgatcaatct

SEQ ID NO: 1025528 - DNA, 22 bp, Artificial Sequence
  chemically synthesized
aagagagactgtaggtagaaga

SEQ ID NO: 1025529 - DNA, 22 bp, Artificial Sequence
  chemically synthesized
gtcctgatcaatcttctaccta

SEQ ID NO: 1025530 - DNA, 22 bp, Artificial Sequence
  chemically synthesized
tcctgatcaatcttctacctac

SEQ ID NO: 1025531 - DNA, 22 bp, Artificial Sequence
  chemically synthesized
atcaatcttctacctacagtct

SEQ ID NO: 1025532 - DNA, 22 bp, Artificial Sequence
  chemically synthesized
ctacctacagtctctctttagg

SEQ ID NO: 1025533 - DNA, 22 bp, Artificial Sequence
  chemically synthesized
tacctacagtctctctttaggt

SEQ ID NO: 1025534 - DNA, 22 bp, Artificial Sequence
  chemically synthesized
cctacagtctctctttaggtta

SEQ ID NO: 1025535 - DNA, 22 bp, Artificial Sequence
  chemically synthesized
tgtgagtgggtgcaataaccta

SEQ ID NO: 1025536 - DNA, 22 bp, Artificial Sequence
  chemically synthesized
cagtctctctttaggttattgc

SEQ ID NO: 1025537 - DNA, 22 bp, Artificial Sequence
  chemically synthesized
aagttatgtgagtgggtgcaat

SEQ ID NO: 1025538 - DNA, 22 bp, Artificial Sequence
  chemically synthesized
aaagttatgtgagtgggtgcaa

SEQ ID NO: 1025539 - DNA, 22 bp, Artificial Sequence
  chemically synthesized
tctttaggttattgcacccact

SEQ ID NO: 1025540 - DNA, 22 bp, Artificial Sequence
  chemically synthesized
tttaggttattgcacccactca

SEQ ID NO: 1025541 - DNA, 22 bp, Artificial Sequence
  chemically synthesized
taggttattgcacccactcaca

SEQ ID NO: 1025542 - DNA, 22 bp, Artificial Sequence
  chemically synthesized
aggttattgcacccactcacat

SEQ ID NO: 1025543 - DNA, 22 bp, Artificial Sequence
  chemically synthesized
ggttattgcacccactcacata

SEQ ID NO: 1025544 - DNA, 22 bp, Artificial Sequence
  chemically synthesized
ttgcacccactcacataacttt

SEQ ID NO: 1025545 - DNA, 22 bp, Artificial Sequence
  chemically synthesized
cacccactcacataactttaaa

SEQ ID NO: 1025546 - DNA, 22 bp, Artificial Sequence
  chemically synthesized
ggcatgtaaataatatttaaag

SEQ ID NO: 1025547 - DNA, 22 bp, Artificial Sequence
  chemically synthesized
acataactttaaatattattta

SEQ ID NO: 1025548 - DNA, 22 bp, Artificial Sequence
  chemically synthesized
taaatattatttacatgcctag

SEQ ID NO: 1025549 - DNA, 22 bp, Artificial Sequence
  chemically synthesized
aaatattatttacatgcctagg

SEQ ID NO: 1025550 - DNA, 22 bp, Artificial Sequence
  chemically synthesized
aatattatttacatgcctaggt

SEQ ID NO: 1025551 - DNA, 22 bp, Artificial Sequence
  chemically synthesized
tttacatgcctaggtatcccac

SEQ ID NO: 1025552 - DNA, 22 bp, Artificial Sequence
  chemically synthesized
acatgcctaggtatcccacgta

SEQ ID NO: 1025553 - DNA, 22 bp, Artificial Sequence
  chemically synthesized
catgcctaggtatcccacgtat

SEQ ID NO: 1025554 - DNA, 22 bp, Artificial Sequence
  chemically synthesized
tgaccaagatacatacgtggga

SEQ ID NO: 1025555 - DNA, 22 bp, Artificial Sequence
  chemically synthesized
ggtatcccacgtatgtatcttg

SEQ ID NO: 1025556 - DNA, 22 bp, Artificial Sequence
  chemically synthesized
catgaaacgtggatgaaatatc

SEQ ID NO: 1025557 - DNA, 22 bp, Artificial Sequence
  chemically synthesized
ggtcacagatatttcatccacg

SEQ ID NO: 1025558 - DNA, 22 bp, Artificial Sequence
  chemically synthesized
gtcacagatatttcatccacgt

SEQ ID NO: 1025559 - DNA, 22 bp, Artificial Sequence
  chemically synthesized
aaacatctacatgaaacgtgga

SEQ ID NO: 1025560 - DNA, 22 bp, Artificial Sequence
  chemically synthesized
catccacgtttcatgtagatgt

SEQ ID NO: 1025561 - DNA, 22 bp, Artificial Sequence
  chemically synthesized
atccacgtttcatgtagatgtt

SEQ ID NO: 1025562 - DNA, 22 bp, Artificial Sequence
  chemically synthesized
agatacatctgaaacatctaca

SEQ ID NO: 1025563 - DNA, 22 bp, Artificial Sequence
  chemically synthesized
gagatacatctgaaacatctac

SEQ ID NO: 1025564 - DNA, 22 bp, Artificial Sequence
  chemically synthesized
aatttgagatacatctgaaaca

SEQ ID NO: 1025565 - DNA, 22 bp, Artificial Sequence
  chemically synthesized
catgtagatgtttcagatgtat

SEQ ID NO: 1025566 - DNA, 22 bp, Artificial Sequence
  chemically synthesized
atgtagatgtttcagatgtatc

SEQ ID NO: 1025567 - DNA, 22 bp, Artificial Sequence
  chemically synthesized
tattcaatttgagatacatctg

SEQ ID NO: 1025568 - DNA, 22 bp, Artificial Sequence
  chemically synthesized
atattcaatttgagatacatct

SEQ ID NO: 1025569 - DNA, 22 bp, Artificial Sequence
  chemically synthesized
gatttatattcaatttgagata

SEQ ID NO: 1025570 - DNA, 22 bp, Artificial Sequence
  chemically synthesized
tagatttatattcaatttgaga

SEQ ID NO: 1025571 - DNA, 22 bp, Artificial Sequence
  chemically synthesized
ctagatttatattcaatttgag

SEQ ID NO: 1025572 - DNA, 22 bp, Artificial Sequence
  chemically synthesized
tctagatttatattcaatttga

SEQ ID NO: 1025573 - DNA, 22 bp, Artificial Sequence
  chemically synthesized
cagatgtatctcaaattgaata

SEQ ID NO: 1025574 - DNA, 22 bp, Artificial Sequence
  chemically synthesized
agatgtatctcaaattgaatat

SEQ ID NO: 1025575 - DNA, 22 bp, Artificial Sequence
  chemically synthesized
aaattgaatataaatctagaaa

SEQ ID NO: 1025576 - DNA, 22 bp, Artificial Sequence
  chemically synthesized
gaggtggagacctttctagatt

SEQ ID NO: 1025577 - DNA, 22 bp, Artificial Sequence
  chemically synthesized
ggaggtggagacctttctagat

SEQ ID NO: 1025578 - DNA, 22 bp, Artificial Sequence
  chemically synthesized
aatataaatctagaaaggtctc

SEQ ID NO: 1025579 - DNA, 22 bp, Artificial Sequence
  chemically synthesized
gaaaggtctccacctccaaatc

SEQ ID NO: 1025580 - DNA, 22 bp, Artificial Sequence
  chemically synthesized
gagaacagaaaagaaggggcag

SEQ ID NO: 1025581 - DNA, 22 bp, Artificial Sequence
  chemically synthesized
cacctccaaatctgccccttct

SEQ ID NO: 1025582 - DNA, 22 bp, Artificial Sequence
  chemically synthesized
agctggagaacagaaaagaagg

SEQ ID NO: 1025583 - DNA, 22 bp, Artificial Sequence
  chemically synthesized
caaatctgccccttcttttctg

SEQ ID NO: 1025584 - DNA, 22 bp, Artificial Sequence
  chemically synthesized
ccccttcttttctgttctccag

SEQ ID NO: 1025585 - DNA, 22 bp, Artificial Sequence
  chemically synthesized
gataatattgagctggagaaca

SEQ ID NO: 1025586 - DNA, 22 bp, Artificial Sequence
  chemically synthesized
cttttctgttctccagctcaat

SEQ ID NO: 1025587 - DNA, 22 bp, Artificial Sequence
  chemically synthesized
ttttctgttctccagctcaata

SEQ ID NO: 1025588 - DNA, 22 bp, Artificial Sequence
  chemically synthesized
ttctgttctccagctcaatatt

SEQ ID NO: 1025589 - DNA, 22 bp, Artificial Sequence
  chemically synthesized
agcatattagataatattgagc

SEQ ID NO: 1025590 - DNA, 22 bp, Artificial Sequence
  chemically synthesized
tctgttctccagctcaatatta

SEQ ID NO: 1025591 - DNA, 22 bp, Artificial Sequence
  chemically synthesized
ctgttctccagctcaatattat

SEQ ID NO: 1025592 - DNA, 22 bp, Artificial Sequence
  chemically synthesized
tgttctccagctcaatattatc

SEQ ID NO: 1025593 - DNA, 22 bp, Artificial Sequence
  chemically synthesized
ttctccagctcaatattatcta

SEQ ID NO: 1025594 - DNA, 22 bp, Artificial Sequence
  chemically synthesized
tccagctcaatattatctaata

SEQ ID NO: 1025595 - DNA, 22 bp, Artificial Sequence
  chemically synthesized
cagctcaatattatctaatatg

SEQ ID NO: 1025596 - DNA, 22 bp, Artificial Sequence
  chemically synthesized
aatattatctaatatgctcagg

SEQ ID NO: 1025597 - DNA, 22 bp, Artificial Sequence
  chemically synthesized
tctaatatgctcagggatcatc

SEQ ID NO: 1025598 - DNA, 22 bp, Artificial Sequence
  chemically synthesized
atatgctcagggatcatccctg

SEQ ID NO: 1025599 - DNA, 22 bp, Artificial Sequence
  chemically synthesized
aaagacagtgaagtgtcaggga

SEQ ID NO: 1025600 - DNA, 22 bp, Artificial Sequence
  chemically synthesized
agggatcatccctgacacttca

SEQ ID NO: 1025601 - DNA, 22 bp, Artificial Sequence
  chemically synthesized
aaagtggagttgaaagacagtg

SEQ ID NO: 1025602 - DNA, 22 bp, Artificial Sequence
  chemically synthesized
gaaagtggagttgaaagacagt

SEQ ID NO: 1025603 - DNA, 22 bp, Artificial Sequence
  chemically synthesized
acacttcactgtctttcaactc

SEQ ID NO: 1025604 - DNA, 22 bp, Artificial Sequence
  chemically synthesized
acagatttgaaagtggagttga

SEQ ID NO: 1025605 - DNA, 22 bp, Artificial Sequence
  chemically synthesized
gacagatttgaaagtggagttg

SEQ ID NO: 1025606 - DNA, 22 bp, Artificial Sequence
  chemically synthesized
tgacagatttgaaagtggagtt

SEQ ID NO: 1025607 - DNA, 22 bp, Artificial Sequence
  chemically synthesized
cactgtctttcaactccacttt

SEQ ID NO: 1025608 - DNA, 22 bp, Artificial Sequence
  chemically synthesized
ttgacagatttgaaagtggagt

SEQ ID NO: 1025609 - DNA, 22 bp, Artificial Sequence
  chemically synthesized
actgtctttcaactccactttc

SEQ ID NO: 1025610 - DNA, 22 bp, Artificial Sequence
  chemically synthesized
tctttcaactccactttcaaat

SEQ ID NO: 1025611 - DNA, 22 bp, Artificial Sequence
  chemically synthesized
tcaactccactttcaaatctgt

SEQ ID NO: 1025612 - DNA, 22 bp, Artificial Sequence
  chemically synthesized
caactccactttcaaatctgtc

SEQ ID NO: 1025613 - DNA, 22 bp, Artificial Sequence
  chemically synthesized
gtagcaacttttgacagatttg

SEQ ID NO: 1025614 - DNA, 22 bp, Artificial Sequence
  chemically synthesized
aactccactttcaaatctgtca

SEQ ID NO: 1025615 - DNA, 22 bp, Artificial Sequence
  chemically synthesized
ttagtagcaacttttgacagat

SEQ ID NO: 1025616 - DNA, 22 bp, Artificial Sequence
  chemically synthesized
cactttcaaatctgtcaaaagt

SEQ ID NO: 1025617 - DNA, 22 bp, Artificial Sequence
  chemically synthesized
tcaaatctgtcaaaagttgcta

SEQ ID NO: 1025618 - DNA, 22 bp, Artificial Sequence
  chemically synthesized
caaatctgtcaaaagttgctac

SEQ ID NO: 1025619 - DNA, 22 bp, Artificial Sequence
  chemically synthesized
atggagctattagtagcaactt

SEQ ID NO: 1025620 - DNA, 22 bp, Artificial Sequence
  chemically synthesized
aaatctgtcaaaagttgctact

SEQ ID NO: 1025621 - DNA, 22 bp, Artificial Sequence
  chemically synthesized
tgttaatggagctattagtagc

SEQ ID NO: 1025622 - DNA, 22 bp, Artificial Sequence
  chemically synthesized
atgttaatggagctattagtag

SEQ ID NO: 1025623 - DNA, 22 bp, Artificial Sequence
  chemically synthesized
tcaaaagttgctactaatagct

SEQ ID NO: 1025624 - DNA, 22 bp, Artificial Sequence
  chemically synthesized
atacttatgttaatggagctat

SEQ ID NO: 1025625 - DNA, 22 bp, Artificial Sequence
  chemically synthesized
gatacttatgttaatggagcta

SEQ ID NO: 1025626 - DNA, 22 bp, Artificial Sequence
  chemically synthesized
tgatacttatgttaatggagct

SEQ ID NO: 1025627 - DNA, 22 bp, Artificial Sequence
  chemically synthesized
ctactaatagctccattaacat

SEQ ID NO: 1025628 - DNA, 22 bp, Artificial Sequence
  chemically synthesized
ctaatagctccattaacataag

SEQ ID NO: 1025629 - DNA, 22 bp, Artificial Sequence
  chemically synthesized
atagctccattaacataagtat

SEQ ID NO: 1025630 - DNA, 22 bp, Artificial Sequence
  chemically synthesized
cattaacataagtatcaaagac

SEQ ID NO: 1025631 - DNA, 22 bp, Artificial Sequence
  chemically synthesized
acataagtatcaaagacatgtt

SEQ ID NO: 1025632 - DNA, 22 bp, Artificial Sequence
  chemically synthesized
agatggcaatggaagtggaaat

SEQ ID NO: 1025633 - DNA, 22 bp, Artificial Sequence
  chemically synthesized
gagatggcaatggaagtggaaa

SEQ ID NO: 1025634 - DNA, 22 bp, Artificial Sequence
  chemically synthesized
atttccacttccattgccatct

SEQ ID NO: 1025635 - DNA, 22 bp, Artificial Sequence
  chemically synthesized
tttccacttccattgccatctc

SEQ ID NO: 1025636 - DNA, 22 bp, Artificial Sequence
  chemically synthesized
ccacttccattgccatctcaag

SEQ ID NO: 1025637 - DNA, 22 bp, Artificial Sequence
  chemically synthesized
cacttccattgccatctcaagg

SEQ ID NO: 1025638 - DNA, 22 bp, Artificial Sequence
  chemically synthesized
ccattgccatctcaaggcttgg

SEQ ID NO: 1025639 - DNA, 22 bp, Artificial Sequence
  chemically synthesized
cattgccatctcaaggcttggt

SEQ ID NO: 1025640 - DNA, 22 bp, Artificial Sequence
  chemically synthesized
gaataccaaagcatagaccaag

SEQ ID NO: 1025641 - DNA, 22 bp, Artificial Sequence
  chemically synthesized
ccatctcaaggcttggtctatg

SEQ ID NO: 1025642 - DNA, 22 bp, Artificial Sequence
  chemically synthesized
agaataccaaagcatagaccaa

SEQ ID NO: 1025643 - DNA, 22 bp, Artificial Sequence
  chemically synthesized
aaggcttggtctatgctttggt

SEQ ID NO: 1025644 - DNA, 22 bp, Artificial Sequence
  chemically synthesized
ggtctatgctttggtattctaa

SEQ ID NO: 1025645 - DNA, 22 bp, Artificial Sequence
  chemically synthesized
gtctatgctttggtattctaag

SEQ ID NO: 1025646 - DNA, 22 bp, Artificial Sequence
  chemically synthesized
aaaacagaatggccacttagaa

SEQ ID NO: 1025647 - DNA, 22 bp, Artificial Sequence
  chemically synthesized
tgctttggtattctaagtggcc

SEQ ID NO: 1025648 - DNA, 22 bp, Artificial Sequence
  chemically synthesized
cctgaaaacagaatggccactt

SEQ ID NO: 1025649 - DNA, 22 bp, Artificial Sequence
  chemically synthesized
tggtattctaagtggccattct

SEQ ID NO: 1025650 - DNA, 22 bp, Artificial Sequence
  chemically synthesized
ggtattctaagtggccattctg

SEQ ID NO: 1025651 - DNA, 22 bp, Artificial Sequence
  chemically synthesized
gtattctaagtggccattctgt

SEQ ID NO: 1025652 - DNA, 22 bp, Artificial Sequence
  chemically synthesized
gggaacctccctgaaaacagaa

SEQ ID NO: 1025653 - DNA, 22 bp, Artificial Sequence
  chemically synthesized
agggaacctccctgaaaacaga

SEQ ID NO: 1025654 - DNA, 22 bp, Artificial Sequence
  chemically synthesized
taagtggccattctgttttcag

SEQ ID NO: 1025655 - DNA, 22 bp, Artificial Sequence
  chemically synthesized
tagggaacctccctgaaaacag

SEQ ID NO: 1025656 - DNA, 22 bp, Artificial Sequence
  chemically synthesized
agtggccattctgttttcaggg

SEQ ID NO: 1025657 - DNA, 22 bp, Artificial Sequence
  chemically synthesized
tgttttcagggaggttccctaa

SEQ ID NO: 1025658 - DNA, 22 bp, Artificial Sequence
  chemically synthesized
aaaacaatgtactttagggaac

SEQ ID NO: 1025659 - DNA, 22 bp, Artificial Sequence
  chemically synthesized
ttttcagggaggttccctaaag

SEQ ID NO: 1025660 - DNA, 22 bp, Artificial Sequence
  chemically synthesized
ctgaaaacaatgtactttaggg

SEQ ID NO: 1025661 - DNA, 22 bp, Artificial Sequence
  chemically synthesized
tcagggaggttccctaaagtac

SEQ ID NO: 1025662 - DNA, 22 bp, Artificial Sequence
  chemically synthesized
gctgaaaacaatgtactttagg

SEQ ID NO: 1025663 - DNA, 22 bp, Artificial Sequence
  chemically synthesized
cagggaggttccctaaagtaca

SEQ ID NO: 1025664 - DNA, 22 bp, Artificial Sequence
  chemically synthesized
tgctgaaaacaatgtactttag

SEQ ID NO: 1025665 - DNA, 22 bp, Artificial Sequence
  chemically synthesized
agggaggttccctaaagtacat

SEQ ID NO: 1025666 - DNA, 22 bp, Artificial Sequence
  chemically synthesized
ttgctgaaaacaatgtacttta

SEQ ID NO: 1025667 - DNA, 22 bp, Artificial Sequence
  chemically synthesized
tttttgctgaaaacaatgtact

SEQ ID NO: 1025668 - DNA, 22 bp, Artificial Sequence
  chemically synthesized
cctaaagtacattgttttcagc

SEQ ID NO: 1025669 - DNA, 22 bp, Artificial Sequence
  chemically synthesized
aagtacattgttttcagcaaaa

SEQ ID NO: 1025670 - DNA, 22 bp, Artificial Sequence
  chemically synthesized
ttttcagcaaaaacaatgatta

SEQ ID NO: 1025671 - DNA, 22 bp, Artificial Sequence
  chemically synthesized
tcagcaaaaacaatgattatgt

SEQ ID NO: 1025672 - DNA, 22 bp, Artificial Sequence
  chemically synthesized
cagcaaaaacaatgattatgtc

SEQ ID NO: 1025673 - DNA, 22 bp, Artificial Sequence
  chemically synthesized
agcaaaaacaatgattatgtca

SEQ ID NO: 1025674 - DNA, 22 bp, Artificial Sequence
  chemically synthesized
acccagcaaggtagtgacataa

SEQ ID NO: 1025675 - DNA, 22 bp, Artificial Sequence
  chemically synthesized
tgtcactaccttgctgggtgag

SEQ ID NO: 1025676 - DNA, 22 bp, Artificial Sequence
  chemically synthesized
cagatatgagccacctcaccca

SEQ ID NO: 1025677 - DNA, 22 bp, Artificial Sequence
  chemically synthesized
ccttgctgggtgaggtggctca

SEQ ID NO: 1025678 - DNA, 22 bp, Artificial Sequence
  chemically synthesized
gctgggtgaggtggctcatatc

SEQ ID NO: 1025679 - DNA, 22 bp, Artificial Sequence
  chemically synthesized
ctgggtgaggtggctcatatct

SEQ ID NO: 1025680 - DNA, 22 bp, Artificial Sequence
  chemically synthesized
ggtgaggtggctcatatctgta

SEQ ID NO: 1025681 - DNA, 22 bp, Artificial Sequence
  chemically synthesized
aaatggtgggattacagatatg

SEQ ID NO: 1025682 - DNA, 22 bp, Artificial Sequence
  chemically synthesized
aaaatggtgggattacagatat

SEQ ID NO: 1025683 - DNA, 22 bp, Artificial Sequence
  chemically synthesized
ttaaaatggtgggattacagat

SEQ ID NO: 1025684 - DNA, 22 bp, Artificial Sequence
  chemically synthesized
atcctcttaaaatggtgggatt

SEQ ID NO: 1025685 - DNA, 22 bp, Artificial Sequence
  chemically synthesized
atatctgtaatcccaccatttt

SEQ ID NO: 1025686 - DNA, 22 bp, Artificial Sequence
  chemically synthesized
ccgcctcatcctcttaaaatgg

SEQ ID NO: 1025687 - DNA, 22 bp, Artificial Sequence
  chemically synthesized
taatcccaccattttaagagga

SEQ ID NO: 1025688 - DNA, 22 bp, Artificial Sequence
  chemically synthesized
ggcccaagcaatcctcccgcct

SEQ ID NO: 1025689 - DNA, 22 bp, Artificial Sequence
  chemically synthesized
taagaggatgaggcgggaggat

SEQ ID NO: 1025690 - DNA, 22 bp, Artificial Sequence
  chemically synthesized
aagaggatgaggcgggaggatt

SEQ ID NO: 1025691 - DNA, 22 bp, Artificial Sequence
  chemically synthesized
ctgggcccaagcaatcctcccg

SEQ ID NO: 1025692 - DNA, 22 bp, Artificial Sequence
  chemically synthesized
agaggatgaggcgggaggattg

SEQ ID NO: 1025693 - DNA, 22 bp, Artificial Sequence
  chemically synthesized
gattactgggcccaagcaatcc

SEQ ID NO: 1025694 - DNA, 22 bp, Artificial Sequence
  chemically synthesized
ggattactgggcccaagcaatc

SEQ ID NO: 1025695 - DNA, 22 bp, Artificial Sequence
  chemically synthesized
atcttggattactgggcccaag

SEQ ID NO: 1025696 - DNA, 22 bp, Artificial Sequence
  chemically synthesized
aggctgatcttggattactggg

SEQ ID NO: 1025697 - DNA, 22 bp, Artificial Sequence
  chemically synthesized
taaggctgatcttggattactg

SEQ ID NO: 1025698 - DNA, 22 bp, Artificial Sequence
  chemically synthesized
ctaaggctgatcttggattact

SEQ ID NO: 1025699 - DNA, 22 bp, Artificial Sequence
  chemically synthesized
cttgggcccagtaatccaagat

SEQ ID NO: 1025700 - DNA, 22 bp, Artificial Sequence
  chemically synthesized
agtttctaaggctgatcttgga

SEQ ID NO: 1025701 - DNA, 22 bp, Artificial Sequence
  chemically synthesized
gggcccagtaatccaagatcag

SEQ ID NO: 1025702 - DNA, 22 bp, Artificial Sequence
  chemically synthesized
ggcccagtaatccaagatcagc

SEQ ID NO: 1025703 - DNA, 22 bp, Artificial Sequence
  chemically synthesized
taagtttctaaggctgatcttg

SEQ ID NO: 1025704 - DNA, 22 bp, Artificial Sequence
  chemically synthesized
ctaagtttctaaggctgatctt

SEQ ID NO: 1025705 - DNA, 22 bp, Artificial Sequence
  chemically synthesized
cgtttctaagtttctaaggctg

SEQ ID NO: 1025706 - DNA, 22 bp, Artificial Sequence
  chemically synthesized
ttacgtttctaagtttctaagg

SEQ ID NO: 1025707 - DNA, 22 bp, Artificial Sequence
  chemically synthesized
gttacgtttctaagtttctaag

SEQ ID NO: 1025708 - DNA, 22 bp, Artificial Sequence
  chemically synthesized
agaaacttagaaacgtaacaag

SEQ ID NO: 1025709 - DNA, 22 bp, Artificial Sequence
  chemically synthesized
aagagacagggtcttgttacgt

SEQ ID NO: 1025710 - DNA, 22 bp, Artificial Sequence
  chemically synthesized
gaaacttagaaacgtaacaaga

SEQ ID NO: 1025711 - DNA, 22 bp, Artificial Sequence
  chemically synthesized
gaagagacagggtcttgttacg

SEQ ID NO: 1025712 - DNA, 22 bp, Artificial Sequence
  chemically synthesized
tgaagagacagggtcttgttac

SEQ ID NO: 1025713 - DNA, 22 bp, Artificial Sequence
  chemically synthesized
ttttgaagagacagggtcttgt

SEQ ID NO: 1025714 - DNA, 22 bp, Artificial Sequence
  chemically synthesized
agaaacgtaacaagaccctgtc

SEQ ID NO: 1025715 - DNA, 22 bp, Artificial Sequence
  chemically synthesized
gaaacgtaacaagaccctgtct

SEQ ID NO: 1025716 - DNA, 22 bp, Artificial Sequence
  chemically synthesized
aacaattattttgaagagacag

SEQ ID NO: 1025717 - DNA, 22 bp, Artificial Sequence
  chemically synthesized
aaacaattattttgaagagaca

SEQ ID NO: 1025718 - DNA, 22 bp, Artificial Sequence
  chemically synthesized
taaacaattattttgaagagac

SEQ ID NO: 1025719 - DNA, 22 bp, Artificial Sequence
  chemically synthesized
actttaaacaattattttgaag

SEQ ID NO: 1025720 - DNA, 22 bp, Artificial Sequence
  chemically synthesized
gctaactttaaacaattatttt

SEQ ID NO: 1025721 - DNA, 22 bp, Artificial Sequence
  chemically synthesized
tctcttcaaaataattgtttaa

SEQ ID NO: 1025722 - DNA, 22 bp, Artificial Sequence
  chemically synthesized
tgcctggctaactttaaacaat

SEQ ID NO: 1025723 - DNA, 22 bp, Artificial Sequence
  chemically synthesized
ttcaaaataattgtttaaagtt

SEQ ID NO: 1025724 - DNA, 22 bp, Artificial Sequence
  chemically synthesized
caaaataattgtttaaagttag

SEQ ID NO: 1025725 - DNA, 22 bp, Artificial Sequence
  chemically synthesized
aaaataattgtttaaagttagc

SEQ ID NO: 1025726 - DNA, 22 bp, Artificial Sequence
  chemically synthesized
ccactatgcctggctaacttta

SEQ ID NO: 1025727 - DNA, 22 bp, Artificial Sequence
  chemically synthesized
gccactatgcctggctaacttt

SEQ ID NO: 1025728 - DNA, 22 bp, Artificial Sequence
  chemically synthesized
tttaaagttagccaggcatagt

SEQ ID NO: 1025729 - DNA, 22 bp, Artificial Sequence
  chemically synthesized
caggcatttgccactatgcctg

SEQ ID NO: 1025730 - DNA, 22 bp, Artificial Sequence
  chemically synthesized
aaagttagccaggcatagtggc

SEQ ID NO: 1025731 - DNA, 22 bp, Artificial Sequence
  chemically synthesized
ctacaggcatttgccactatgc

SEQ ID NO: 1025732 - DNA, 22 bp, Artificial Sequence
  chemically synthesized
aagttagccaggcatagtggca

SEQ ID NO: 1025733 - DNA, 22 bp, Artificial Sequence
  chemically synthesized
ggactactacaggcatttgcca

SEQ ID NO: 1025734 - DNA, 22 bp, Artificial Sequence
  chemically synthesized
gccaggcatagtggcaaatgcc

SEQ ID NO: 1025735 - DNA, 22 bp, Artificial Sequence
  chemically synthesized
ggtagctgggactactacaggc

SEQ ID NO: 1025736 - DNA, 22 bp, Artificial Sequence
  chemically synthesized
ctgggtagctgggactactaca

SEQ ID NO: 1025737 - DNA, 22 bp, Artificial Sequence
  chemically synthesized
cctgggtagctgggactactac

SEQ ID NO: 1025738 - DNA, 22 bp, Artificial Sequence
  chemically synthesized
agcttcctgggtagctgggact

SEQ ID NO: 1025739 - DNA, 22 bp, Artificial Sequence
  chemically synthesized
cctcagcttcctgggtagctgg

SEQ ID NO: 1025740 - DNA, 22 bp, Artificial Sequence
  chemically synthesized
ctacctcagcttcctgggtagc

SEQ ID NO: 1025741 - DNA, 22 bp, Artificial Sequence
  chemically synthesized
tagtagtcccagctacccagga

SEQ ID NO: 1025742 - DNA, 22 bp, Artificial Sequence
  chemically synthesized
ccatatcaccctcctacctcag

SEQ ID NO: 1025743 - DNA, 22 bp, Artificial Sequence
  chemically synthesized
cccaggaagctgaggtaggagg

SEQ ID NO: 1025744 - DNA, 22 bp, Artificial Sequence
  chemically synthesized
aagcaatcctcccatatcaccc

SEQ ID NO: 1025745 - DNA, 22 bp, Artificial Sequence
  chemically synthesized
aggtaggagggtgatatgggag

SEQ ID NO: 1025746 - DNA, 22 bp, Artificial Sequence
  chemically synthesized
ggctcaagcaatcctcccatat

SEQ ID NO: 1025747 - DNA, 22 bp, Artificial Sequence
  chemically synthesized
gggctcaagcaatcctcccata

SEQ ID NO: 1025748 - DNA, 22 bp, Artificial Sequence
  chemically synthesized
cttgggctcaagcaatcctccc

SEQ ID NO: 1025749 - DNA, 22 bp, Artificial Sequence
  chemically synthesized
aactccttgggctcaagcaatc

SEQ ID NO: 1025750 - DNA, 22 bp, Artificial Sequence
  chemically synthesized
gaactccttgggctcaagcaat

SEQ ID NO: 1025751 - DNA, 22 bp, Artificial Sequence
  chemically synthesized
cagccttgaactccttgggctc

SEQ ID NO: 1025752 - DNA, 22 bp, Artificial Sequence
  chemically synthesized
actgcagccttgaactccttgg

SEQ ID NO: 1025753 - DNA, 22 bp, Artificial Sequence
  chemically synthesized
cttgagcccaaggagttcaagg

SEQ ID NO: 1025754 - DNA, 22 bp, Artificial Sequence
  chemically synthesized
gagcccaaggagttcaaggctg

SEQ ID NO: 1025755 - DNA, 22 bp, Artificial Sequence
  chemically synthesized
agcccaaggagttcaaggctgc

SEQ ID NO: 1025756 - DNA, 22 bp, Artificial Sequence
  chemically synthesized
aaggctgcagtgagccgtgatc

SEQ ID NO: 1025757 - DNA, 22 bp, Artificial Sequence
  chemically synthesized
gagtgcagtgacatgatcacgg

SEQ ID NO: 1025758 - DNA, 22 bp, Artificial Sequence
  chemically synthesized
cagtgagccgtgatcatgtcac

SEQ ID NO: 1025759 - DNA, 22 bp, Artificial Sequence
  chemically synthesized
cccaggctggagtgcagtgaca

SEQ ID NO: 1025760 - DNA, 22 bp, Artificial Sequence
  chemically synthesized
ttgcccaggctggagtgcagtg

SEQ ID NO: 1025761 - DNA, 22 bp, Artificial Sequence
  chemically synthesized
tgttgcccaggctggagtgcag

SEQ ID NO: 1025762 - DNA, 22 bp, Artificial Sequence
  chemically synthesized
actctgttgcccaggctggagt

SEQ ID NO: 1025763 - DNA, 22 bp, Artificial Sequence
  chemically synthesized
cactccagcctgggcaacagag

SEQ ID NO: 1025764 - DNA, 22 bp, Artificial Sequence
  chemically synthesized
aagacacaatctcactctgttg

SEQ ID NO: 1025765 - DNA, 22 bp, Artificial Sequence
  chemically synthesized
caagacacaatctcactctgtt

SEQ ID NO: 1025766 - DNA, 22 bp, Artificial Sequence
  chemically synthesized
cagcctgggcaacagagtgaga

SEQ ID NO: 1025767 - DNA, 22 bp, Artificial Sequence
  chemically synthesized
tttcaagacacaatctcactct

SEQ ID NO: 1025768 - DNA, 22 bp, Artificial Sequence
  chemically synthesized
atttcaagacacaatctcactc

SEQ ID NO: 1025769 - DNA, 22 bp, Artificial Sequence
  chemically synthesized
tttatttcaagacacaatctca

SEQ ID NO: 1025770 - DNA, 22 bp, Artificial Sequence
  chemically synthesized
atttatttcaagacacaatctc

SEQ ID NO: 1025771 - DNA, 22 bp, Artificial Sequence
  chemically synthesized
ggcaacagagtgagattgtgtc

SEQ ID NO: 1025772 - DNA, 22 bp, Artificial Sequence
  chemically synthesized
tttatttatttcaagacacaat

SEQ ID NO: 1025773 - DNA, 22 bp, Artificial Sequence
  chemically synthesized
atttatttatttcaagacacaa

SEQ ID NO: 1025774 - DNA, 22 bp, Artificial Sequence
  chemically synthesized
cttatttatttatttcaagaca

SEQ ID NO: 1025775 - DNA, 22 bp, Artificial Sequence
  chemically synthesized
acttatttatttatttcaagac

SEQ ID NO: 1025776 - DNA, 22 bp, Artificial Sequence
  chemically synthesized
tacttatttatttatttcaaga

SEQ ID NO: 1025777 - DNA, 22 bp, Artificial Sequence
  chemically synthesized
ttttacttatttatttatttca

SEQ ID NO: 1025778 - DNA, 22 bp, Artificial Sequence
  chemically synthesized
gttttacttatttatttatttc

SEQ ID NO: 1025779 - DNA, 22 bp, Artificial Sequence
  chemically synthesized
tgttttacttatttatttattt

SEQ ID NO: 1025780 - DNA, 22 bp, Artificial Sequence
  chemically synthesized
tgtcttgaaataaataaataag

SEQ ID NO: 1025781 - DNA, 22 bp, Artificial Sequence
  chemically synthesized
aattttgttttacttatttatt

SEQ ID NO: 1025782 - DNA, 22 bp, Artificial Sequence
  chemically synthesized
aaattttgttttacttatttat

SEQ ID NO: 1025783 - DNA, 22 bp, Artificial Sequence
  chemically synthesized
ttaaattttgttttacttattt

SEQ ID NO: 1025784 - DNA, 22 bp, Artificial Sequence
  chemically synthesized
gaaataaataaataagtaaaac

SEQ ID NO: 1025785 - DNA, 22 bp, Artificial Sequence
  chemically synthesized
aaataaataaataagtaaaaca

SEQ ID NO: 1025786 - DNA, 22 bp, Artificial Sequence
  chemically synthesized
attcttaaattttgttttactt

SEQ ID NO: 1025787 - DNA, 22 bp, Artificial Sequence
  chemically synthesized
gattcttaaattttgttttact

SEQ ID NO: 1025788 - DNA, 22 bp, Artificial Sequence
  chemically synthesized
tgattcttaaattttgttttac

SEQ ID NO: 1025789 - DNA, 22 bp, Artificial Sequence
  chemically synthesized
ttgattcttaaattttgtttta

SEQ ID NO: 1025790 - DNA, 22 bp, Artificial Sequence
  chemically synthesized
tttgattcttaaattttgtttt

SEQ ID NO: 1025791 - DNA, 22 bp, Artificial Sequence
  chemically synthesized
ttttttgattcttaaattttgt

SEQ ID NO: 1025792 - DNA, 22 bp, Artificial Sequence
  chemically synthesized
attttttgattcttaaattttg

SEQ ID NO: 1025793 - DNA, 22 bp, Artificial Sequence
  chemically synthesized
caagtttattttttgattctta

SEQ ID NO: 1025794 - DNA, 22 bp, Artificial Sequence
  chemically synthesized
aagaatcaaaaaataaacttgt

SEQ ID NO: 1025795 - DNA, 22 bp, Artificial Sequence
  chemically synthesized
agaatcaaaaaataaacttgta

SEQ ID NO: 1025796 - DNA, 22 bp, Artificial Sequence
  chemically synthesized
agtgcaacggaaaaccattaca

SEQ ID NO: 1025797 - DNA, 22 bp, Artificial Sequence
  chemically synthesized
tctaagtgcaacggaaaaccat

SEQ ID NO: 1025798 - DNA, 22 bp, Artificial Sequence
  chemically synthesized
atctaagtgcaacggaaaacca

SEQ ID NO: 1025799 - DNA, 22 bp, Artificial Sequence
  chemically synthesized
tatctaagtgcaacggaaaacc

SEQ ID NO: 1025800 - DNA, 22 bp, Artificial Sequence
  chemically synthesized
gtaatggttttccgttgcactt

SEQ ID NO: 1025801 - DNA, 22 bp, Artificial Sequence
  chemically synthesized
taatggttttccgttgcactta

SEQ ID NO: 1025802 - DNA, 22 bp, Artificial Sequence
  chemically synthesized
tccgttgcacttagataaaatc

SEQ ID NO: 1025803 - DNA, 22 bp, Artificial Sequence
  chemically synthesized
ccgttgcacttagataaaatct

SEQ ID NO: 1025804 - DNA, 22 bp, Artificial Sequence
  chemically synthesized
cgttgcacttagataaaatcta

SEQ ID NO: 1025805 - DNA, 22 bp, Artificial Sequence
  chemically synthesized
cacttagataaaatctatactt

SEQ ID NO: 1025806 - DNA, 22 bp, Artificial Sequence
  chemically synthesized
taggccacaaaaataagtatag

SEQ ID NO: 1025807 - DNA, 22 bp, Artificial Sequence
  chemically synthesized
agataaaatctatacttatttt

SEQ ID NO: 1025808 - DNA, 22 bp, Artificial Sequence
  chemically synthesized
gataaaatctatacttattttt

SEQ ID NO: 1025809 - DNA, 22 bp, Artificial Sequence
  chemically synthesized
tacaagtcattgtaggccacaa

SEQ ID NO: 1025810 - DNA, 22 bp, Artificial Sequence
  chemically synthesized
tacttatttttgtggcctacaa

SEQ ID NO: 1025811 - DNA, 22 bp, Artificial Sequence
  chemically synthesized
cgttgtacaagtcattgtaggc

SEQ ID NO: 1025812 - DNA, 22 bp, Artificial Sequence
  chemically synthesized
acgttgtacaagtcattgtagg

SEQ ID NO: 1025813 - DNA, 22 bp, Artificial Sequence
  chemically synthesized
tacgttgtacaagtcattgtag

SEQ ID NO: 1025814 - DNA, 22 bp, Artificial Sequence
  chemically synthesized
atttttgtggcctacaatgact

SEQ ID NO: 1025815 - DNA, 22 bp, Artificial Sequence
  chemically synthesized
tttttgtggcctacaatgactt

SEQ ID NO: 1025816 - DNA, 22 bp, Artificial Sequence
  chemically synthesized
ttgtggcctacaatgacttgta

SEQ ID NO: 1025817 - DNA, 22 bp, Artificial Sequence
  chemically synthesized
tgtggcctacaatgacttgtac

SEQ ID NO: 1025818 - DNA, 22 bp, Artificial Sequence
  chemically synthesized
gtggcctacaatgacttgtaca

SEQ ID NO: 1025819 - DNA, 22 bp, Artificial Sequence
  chemically synthesized
tggcctacaatgacttgtacaa

SEQ ID NO: 1025820 - DNA, 22 bp, Artificial Sequence
  chemically synthesized
caatgacttgtacaacgtaaaa

SEQ ID NO: 1025821 - DNA, 22 bp, Artificial Sequence
  chemically synthesized
gtacaacgtaaaacttgccacg

SEQ ID NO: 1025822 - DNA, 22 bp, Artificial Sequence
  chemically synthesized
tacaacgtaaaacttgccacgc

SEQ ID NO: 1025823 - DNA, 22 bp, Artificial Sequence
  chemically synthesized
gccacgctctccctctctcacc

SEQ ID NO: 1025824 - DNA, 22 bp, Artificial Sequence
  chemically synthesized
tgtatggggtatggtgagagag

SEQ ID NO: 1025825 - DNA, 22 bp, Artificial Sequence
  chemically synthesized
ccacgctctccctctctcacca

SEQ ID NO: 1025826 - DNA, 22 bp, Artificial Sequence
  chemically synthesized
gtgtatggggtatggtgagaga

SEQ ID NO: 1025827 - DNA, 22 bp, Artificial Sequence
  chemically synthesized
tccctctctcaccataccccat

SEQ ID NO: 1025828 - DNA, 22 bp, Artificial Sequence
  chemically synthesized
cctctctcaccataccccatac

SEQ ID NO: 1025829 - DNA, 22 bp, Artificial Sequence
  chemically synthesized
aaagaaagcccttgtgtatggg

SEQ ID NO: 1025830 - DNA, 22 bp, Artificial Sequence
  chemically synthesized
tctcaccataccccatacacaa

SEQ ID NO: 1025831 - DNA, 22 bp, Artificial Sequence
  chemically synthesized
taaaagaaagcccttgtgtatg

SEQ ID NO: 1025832 - DNA, 22 bp, Artificial Sequence
  chemically synthesized
tcaccataccccatacacaagg

SEQ ID NO: 1025833 - DNA, 22 bp, Artificial Sequence
  chemically synthesized
accataccccatacacaagggc

SEQ ID NO: 1025834 - DNA, 22 bp, Artificial Sequence
  chemically synthesized
gaaattctaaaagaaagccctt

SEQ ID NO: 1025835 - DNA, 22 bp, Artificial Sequence
  chemically synthesized
gaatgttcgaaattctaaaaga

SEQ ID NO: 1025836 - DNA, 22 bp, Artificial Sequence
  chemically synthesized
ggaatgttcgaaattctaaaag

SEQ ID NO: 1025837 - DNA, 22 bp, Artificial Sequence
  chemically synthesized
tcttttagaatttcgaacattc

SEQ ID NO: 1025838 - DNA, 22 bp, Artificial Sequence
  chemically synthesized
gtagagatcttggaatgttcga

SEQ ID NO: 1025839 - DNA, 22 bp, Artificial Sequence
  chemically synthesized
cttttagaatttcgaacattcc

SEQ ID NO: 1025840 - DNA, 22 bp, Artificial Sequence
  chemically synthesized
ttttagaatttcgaacattcca

SEQ ID NO: 1025841 - DNA, 22 bp, Artificial Sequence
  chemically synthesized
ttagaatttcgaacattccaag

SEQ ID NO: 1025842 - DNA, 22 bp, Artificial Sequence
  chemically synthesized
tagaatttcgaacattccaaga

SEQ ID NO: 1025843 - DNA, 22 bp, Artificial Sequence
  chemically synthesized
agaatttcgaacattccaagat

SEQ ID NO: 1025844 - DNA, 22 bp, Artificial Sequence
  chemically synthesized
gaatttcgaacattccaagatc

SEQ ID NO: 1025845 - DNA, 22 bp, Artificial Sequence
  chemically synthesized
agatgttggtagagatcttgga

SEQ ID NO: 1025846 - DNA, 22 bp, Artificial Sequence
  chemically synthesized
gagatgttggtagagatcttgg

SEQ ID NO: 1025847 - DNA, 22 bp, Artificial Sequence
  chemically synthesized
cgaacattccaagatctctacc

SEQ ID NO: 1025848 - DNA, 22 bp, Artificial Sequence
  chemically synthesized
gaacattccaagatctctacca

SEQ ID NO: 1025849 - DNA, 22 bp, Artificial Sequence
  chemically synthesized
caagatctctaccaacatctca

SEQ ID NO: 1025850 - DNA, 22 bp, Artificial Sequence
  chemically synthesized
taccaacatctcaagactttgt

SEQ ID NO: 1025851 - DNA, 22 bp, Artificial Sequence
  chemically synthesized
ccaacatctcaagactttgttc

SEQ ID NO: 1025852 - DNA, 22 bp, Artificial Sequence
  chemically synthesized
aagactttgttcatgtgactcc

SEQ ID NO: 1025853 - DNA, 22 bp, Artificial Sequence
  chemically synthesized
agtaaagagtgtagggagtcac

SEQ ID NO: 1025854 - DNA, 22 bp, Artificial Sequence
  chemically synthesized
tgttcatgtgactccctacact

SEQ ID NO: 1025855 - DNA, 22 bp, Artificial Sequence
  chemically synthesized
gttcatgtgactccctacactc

SEQ ID NO: 1025856 - DNA, 22 bp, Artificial Sequence
  chemically synthesized
caactcagtaaagagtgtaggg

SEQ ID NO: 1025857 - DNA, 22 bp, Artificial Sequence
  chemically synthesized
ttcatgtgactccctacactct

SEQ ID NO: 1025858 - DNA, 22 bp, Artificial Sequence
  chemically synthesized
atgtgactccctacactcttta

SEQ ID NO: 1025859 - DNA, 22 bp, Artificial Sequence
  chemically synthesized
cctacactctttactgagttgc

SEQ ID NO: 1025860 - DNA, 22 bp, Artificial Sequence
  chemically synthesized
aagcagagacctgcaactcagt

SEQ ID NO: 1025861 - DNA, 22 bp, Artificial Sequence
  chemically synthesized
cactctttactgagttgcaggt

SEQ ID NO: 1025862 - DNA, 22 bp, Artificial Sequence
  chemically synthesized
tttactgagttgcaggtctctg

SEQ ID NO: 1025863 - DNA, 22 bp, Artificial Sequence
  chemically synthesized
tactgagttgcaggtctctgct

SEQ ID NO: 1025864 - DNA, 22 bp, Artificial Sequence
  chemically synthesized
actgagttgcaggtctctgctt

SEQ ID NO: 1025865 - DNA, 22 bp, Artificial Sequence
  chemically synthesized
ctgagttgcaggtctctgcttc

SEQ ID NO: 1025866 - DNA, 22 bp, Artificial Sequence
  chemically synthesized
tgaggaaaagtattgaagcaga

SEQ ID NO: 1025867 - DNA, 22 bp, Artificial Sequence
  chemically synthesized
agttgcaggtctctgcttcaat

SEQ ID NO: 1025868 - DNA, 22 bp, Artificial Sequence
  chemically synthesized
tctgtgaggaaaagtattgaag

SEQ ID NO: 1025869 - DNA, 22 bp, Artificial Sequence
  chemically synthesized
caggtctctgcttcaatacttt

SEQ ID NO: 1025870 - DNA, 22 bp, Artificial Sequence
  chemically synthesized
tgcttcaatacttttcctcaca

SEQ ID NO: 1025871 - DNA, 22 bp, Artificial Sequence
  chemically synthesized
agagtaattatctgtgaggaaa

SEQ ID NO: 1025872 - DNA, 22 bp, Artificial Sequence
  chemically synthesized
cttcaatacttttcctcacaga

SEQ ID NO: 1025873 - DNA, 22 bp, Artificial Sequence
  chemically synthesized
caatacttttcctcacagataa

SEQ ID NO: 1025874 - DNA, 22 bp, Artificial Sequence
  chemically synthesized
aatacttttcctcacagataat

SEQ ID NO: 1025875 - DNA, 22 bp, Artificial Sequence
  chemically synthesized
gagactgagagtaattatctgt

SEQ ID NO: 1025876 - DNA, 22 bp, Artificial Sequence
  chemically synthesized
ttcctcacagataattactctc

SEQ ID NO: 1025877 - DNA, 22 bp, Artificial Sequence
  chemically synthesized
tcctcacagataattactctca

SEQ ID NO: 1025878 - DNA, 22 bp, Artificial Sequence
  chemically synthesized
cagtctagagactgagagtaat

SEQ ID NO: 1025879 - DNA, 22 bp, Artificial Sequence
  chemically synthesized
cctcacagataattactctcag

SEQ ID NO: 1025880 - DNA, 22 bp, Artificial Sequence
  chemically synthesized
ctcacagataattactctcagt

SEQ ID NO: 1025881 - DNA, 22 bp, Artificial Sequence
  chemically synthesized
acagataattactctcagtctc

SEQ ID NO: 1025882 - DNA, 22 bp, Artificial Sequence
  chemically synthesized
ctctcagtctctagactgcagc

SEQ ID NO: 1025883 - DNA, 22 bp, Artificial Sequence
  chemically synthesized
acaaaaagaaatgctgcagtct

SEQ ID NO: 1025884 - DNA, 22 bp, Artificial Sequence
  chemically synthesized
taacaaaaagaaatgctgcagt

SEQ ID NO: 1025885 - DNA, 22 bp, Artificial Sequence
  chemically synthesized
tcagtctctagactgcagcatt

SEQ ID NO: 1025886 - DNA, 22 bp, Artificial Sequence
  chemically synthesized
agtctctagactgcagcatttc

SEQ ID NO: 1025887 - DNA, 22 bp, Artificial Sequence
  chemically synthesized
tagactgcagcatttctttttg

SEQ ID NO: 1025888 - DNA, 22 bp, Artificial Sequence
  chemically synthesized
tgagatattctaacaaaaagaa

SEQ ID NO: 1025889 - DNA, 22 bp, Artificial Sequence
  chemically synthesized
gactgcagcatttctttttgtt

SEQ ID NO: 1025890 - DNA, 22 bp, Artificial Sequence
  chemically synthesized
cagcatttctttttgttagaat

SEQ ID NO: 1025891 - DNA, 22 bp, Artificial Sequence
  chemically synthesized
ctttttgttagaatatctcata

SEQ ID NO: 1025892 - DNA, 22 bp, Artificial Sequence
  chemically synthesized
tttttgttagaatatctcatag

SEQ ID NO: 1025893 - DNA, 22 bp, Artificial Sequence
  chemically synthesized
tttgttagaatatctcatagct

SEQ ID NO: 1025894 - DNA, 22 bp, Artificial Sequence
  chemically synthesized
ttgttagaatatctcatagctc

SEQ ID NO: 1025895 - DNA, 22 bp, Artificial Sequence
  chemically synthesized
tgttagaatatctcatagctcc

SEQ ID NO: 1025896 - DNA, 22 bp, Artificial Sequence
  chemically synthesized
gttagaatatctcatagctcct

SEQ ID NO: 1025897 - DNA, 22 bp, Artificial Sequence
  chemically synthesized
ttagaatatctcatagctcctt

SEQ ID NO: 1025898 - DNA, 22 bp, Artificial Sequence
  chemically synthesized
tgaatgaaaagtataaggagct

SEQ ID NO: 1025899 - DNA, 22 bp, Artificial Sequence
  chemically synthesized
gaatatctcatagctccttata

SEQ ID NO: 1025900 - DNA, 22 bp, Artificial Sequence
  chemically synthesized
atagctccttatacttttcatt

SEQ ID NO: 1025901 - DNA, 22 bp, Artificial Sequence
  chemically synthesized
cttatacttttcattcatagca

SEQ ID NO: 1025902 - DNA, 22 bp, Artificial Sequence
  chemically synthesized
caagccgcagtaggtgctatga

SEQ ID NO: 1025903 - DNA, 22 bp, Artificial Sequence
  chemically synthesized
atacttttcattcatagcacct

SEQ ID NO: 1025904 - DNA, 22 bp, Artificial Sequence
  chemically synthesized
acaagccgcagtaggtgctatg

SEQ ID NO: 1025905 - DNA, 22 bp, Artificial Sequence
  chemically synthesized
tacttttcattcatagcaccta

SEQ ID NO: 1025906 - DNA, 22 bp, Artificial Sequence
  chemically synthesized
ttcattcatagcacctactgcg

SEQ ID NO: 1025907 - DNA, 22 bp, Artificial Sequence
  chemically synthesized
tcattcatagcacctactgcgg

SEQ ID NO: 1025908 - DNA, 22 bp, Artificial Sequence
  chemically synthesized
cattcatagcacctactgcggc

SEQ ID NO: 1025909 - DNA, 22 bp, Artificial Sequence
  chemically synthesized
attcatagcacctactgcggct

SEQ ID NO: 1025910 - DNA, 22 bp, Artificial Sequence
  chemically synthesized
atagcacctactgcggcttgta

SEQ ID NO: 1025911 - DNA, 22 bp, Artificial Sequence
  chemically synthesized
ctgcggcttgtaaatatacact

SEQ ID NO: 1025912 - DNA, 22 bp, Artificial Sequence
  chemically synthesized
cggcttgtaaatatacactcat

SEQ ID NO: 1025913 - DNA, 22 bp, Artificial Sequence
  chemically synthesized
aggcaataatcatatacatgag

SEQ ID NO: 1025914 - DNA, 22 bp, Artificial Sequence
  chemically synthesized
gtaaatatacactcatgtatat

SEQ ID NO: 1025915 - DNA, 22 bp, Artificial Sequence
  chemically synthesized
aaggcaataatcatatacatga

SEQ ID NO: 1025916 - DNA, 22 bp, Artificial Sequence
  chemically synthesized
taaatatacactcatgtatatg

SEQ ID NO: 1025917 - DNA, 22 bp, Artificial Sequence
  chemically synthesized
taaggcaataatcatatacatg

SEQ ID NO: 1025918 - DNA, 22 bp, Artificial Sequence
  chemically synthesized
atgtatatgattattgccttaa

SEQ ID NO: 1025919 - DNA, 22 bp, Artificial Sequence
  chemically synthesized
gtgggggaaaatgtattttaag

SEQ ID NO: 1025920 - DNA, 22 bp, Artificial Sequence
  chemically synthesized
agtgggggaaaatgtattttaa

SEQ ID NO: 1025921 - DNA, 22 bp, Artificial Sequence
  chemically synthesized
ttgccttaaaatacattttccc

SEQ ID NO: 1025922 - DNA, 22 bp, Artificial Sequence
  chemically synthesized
aatgtttagtgggggaaaatgt

SEQ ID NO: 1025923 - DNA, 22 bp, Artificial Sequence
  chemically synthesized
ccttaaaatacattttccccca

SEQ ID NO: 1025924 - DNA, 22 bp, Artificial Sequence
  chemically synthesized
gagctgaatgtttagtggggga

SEQ ID NO: 1025925 - DNA, 22 bp, Artificial Sequence
  chemically synthesized
aaaatacattttcccccactaa

SEQ ID NO: 1025926 - DNA, 22 bp, Artificial Sequence
  chemically synthesized
ggagctgaatgtttagtggggg

SEQ ID NO: 1025927 - DNA, 22 bp, Artificial Sequence
  chemically synthesized
aaatacattttcccccactaaa

SEQ ID NO: 1025928 - DNA, 22 bp, Artificial Sequence
  chemically synthesized
tggagctgaatgtttagtgggg

SEQ ID NO: 1025929 - DNA, 22 bp, Artificial Sequence
  chemically synthesized
ttggagctgaatgtttagtggg

SEQ ID NO: 1025930 - DNA, 22 bp, Artificial Sequence
  chemically synthesized
tttggagctgaatgtttagtgg

SEQ ID NO: 1025931 - DNA, 22 bp, Artificial Sequence
  chemically synthesized
cctttttggagctgaatgttta

SEQ ID NO: 1025932 - DNA, 22 bp, Artificial Sequence
  chemically synthesized
tgcctttttggagctgaatgtt

SEQ ID NO: 1025933 - DNA, 22 bp, Artificial Sequence
  chemically synthesized
ctgcctttttggagctgaatgt

SEQ ID NO: 1025934 - DNA, 22 bp, Artificial Sequence
  chemically synthesized
tcccccactaaacattcagctc

SEQ ID NO: 1025935 - DNA, 22 bp, Artificial Sequence
  chemically synthesized
cccccactaaacattcagctcc

SEQ ID NO: 1025936 - DNA, 22 bp, Artificial Sequence
  chemically synthesized
ccccactaaacattcagctcca

SEQ ID NO: 1025937 - DNA, 22 bp, Artificial Sequence
  chemically synthesized
tttctgcctttttggagctgaa

SEQ ID NO: 1025938 - DNA, 22 bp, Artificial Sequence
  chemically synthesized
aacattcagctccaaaaaggca

SEQ ID NO: 1025939 - DNA, 22 bp, Artificial Sequence
  chemically synthesized
agctccaaaaaggcagaaacaa

SEQ ID NO: 1025940 - DNA, 22 bp, Artificial Sequence
  chemically synthesized
acaaagaacacattgtttctgc

SEQ ID NO: 1025941 - DNA, 22 bp, Artificial Sequence
  chemically synthesized
caaaaaggcagaaacaatgtgt

SEQ ID NO: 1025942 - DNA, 22 bp, Artificial Sequence
  chemically synthesized
cagaaattaacaaagaacacat

SEQ ID NO: 1025943 - DNA, 22 bp, Artificial Sequence
  chemically synthesized
tacagaaattaacaaagaacac

SEQ ID NO: 1025944 - DNA, 22 bp, Artificial Sequence
  chemically synthesized
aaaaactctacagaaattaaca

SEQ ID NO: 1025945 - DNA, 22 bp, Artificial Sequence
  chemically synthesized
tctcaaaaactctacagaaatt

SEQ ID NO: 1025946 - DNA, 22 bp, Artificial Sequence
  chemically synthesized
tttgttaatttctgtagagttt

SEQ ID NO: 1025947 - DNA, 22 bp, Artificial Sequence
  chemically synthesized
atcctgtctcaaaaactctaca

SEQ ID NO: 1025948 - DNA, 22 bp, Artificial Sequence
  chemically synthesized
tgttaatttctgtagagttttt

SEQ ID NO: 1025949 - DNA, 22 bp, Artificial Sequence
  chemically synthesized
tgatcctgtctcaaaaactcta

SEQ ID NO: 1025950 - DNA, 22 bp, Artificial Sequence
  chemically synthesized
gttaatttctgtagagtttttg

SEQ ID NO: 1025951 - DNA, 22 bp, Artificial Sequence
  chemically synthesized
ttaatttctgtagagtttttga

SEQ ID NO: 1025952 - DNA, 22 bp, Artificial Sequence
  chemically synthesized
atttctgtagagtttttgagac

SEQ ID NO: 1025953 - DNA, 22 bp, Artificial Sequence
  chemically synthesized
ctgtagagtttttgagacagga

SEQ ID NO: 1025954 - DNA, 22 bp, Artificial Sequence
  chemically synthesized
tgtagagtttttgagacaggat

SEQ ID NO: 1025955 - DNA, 22 bp, Artificial Sequence
  chemically synthesized
tagagtttttgagacaggatca

SEQ ID NO: 1025956 - DNA, 22 bp, Artificial Sequence
  chemically synthesized
aacatatagtaattctgatcct

SEQ ID NO: 1025957 - DNA, 22 bp, Artificial Sequence
  chemically synthesized
ttcaacatatagtaattctgat

SEQ ID NO: 1025958 - DNA, 22 bp, Artificial Sequence
  chemically synthesized
attcaacatatagtaattctga

SEQ ID NO: 1025959 - DNA, 22 bp, Artificial Sequence
  chemically synthesized
ttgagacaggatcagaattact

SEQ ID NO: 1025960 - DNA, 22 bp, Artificial Sequence
  chemically synthesized
tgagacaggatcagaattacta

SEQ ID NO: 1025961 - DNA, 22 bp, Artificial Sequence
  chemically synthesized
gagacaggatcagaattactat

SEQ ID NO: 1025962 - DNA, 22 bp, Artificial Sequence
  chemically synthesized
agacaggatcagaattactata

SEQ ID NO: 1025963 - DNA, 22 bp, Artificial Sequence
  chemically synthesized
atttattcaacatatagtaatt

SEQ ID NO: 1025964 - DNA, 22 bp, Artificial Sequence
  chemically synthesized
tattcatttattcaacatatag

SEQ ID NO: 1025965 - DNA, 22 bp, Artificial Sequence
  chemically synthesized
tgtattcatttattcaacatat

SEQ ID NO: 1025966 - DNA, 22 bp, Artificial Sequence
  chemically synthesized
ctgtattcatttattcaacata

SEQ ID NO: 1025967 - DNA, 22 bp, Artificial Sequence
  chemically synthesized
tttctgtattcatttattcaac

SEQ ID NO: 1025968 - DNA, 22 bp, Artificial Sequence
  chemically synthesized
atttctgtattcatttattcaa

SEQ ID NO: 1025969 - DNA, 22 bp, Artificial Sequence
  chemically synthesized
tatttctgtattcatttattca

SEQ ID NO: 1025970 - DNA, 22 bp, Artificial Sequence
  chemically synthesized
ttatttctgtattcatttattc

SEQ ID NO: 1025971 - DNA, 22 bp, Artificial Sequence
  chemically synthesized
ctatatgttgaataaatgaata

SEQ ID NO: 1025972 - DNA, 22 bp, Artificial Sequence
  chemically synthesized
tttttatttctgtattcattta

SEQ ID NO: 1025973 - DNA, 22 bp, Artificial Sequence
  chemically synthesized
atttttatttctgtattcattt

SEQ ID NO: 1025974 - DNA, 22 bp, Artificial Sequence
  chemically synthesized
tatttttatttctgtattcatt

SEQ ID NO: 1025975 - DNA, 22 bp, Artificial Sequence
  chemically synthesized
tatgttgaataaatgaatacag

SEQ ID NO: 1025976 - DNA, 22 bp, Artificial Sequence
  chemically synthesized
aataaatgaatacagaaataaa

SEQ ID NO: 1025977 - DNA, 22 bp, Artificial Sequence
  chemically synthesized
tatatcagtgagcaaaggcatc

SEQ ID NO: 1025978 - DNA, 22 bp, Artificial Sequence
  chemically synthesized
tgatgcctttgctcactgatat

SEQ ID NO: 1025979 - DNA, 22 bp, Artificial Sequence
  chemically synthesized
tgctcactgatatatagtgcca

SEQ ID NO: 1025980 - DNA, 22 bp, Artificial Sequence
  chemically synthesized
gctcactgatatatagtgccat

SEQ ID NO: 1025981 - DNA, 22 bp, Artificial Sequence
  chemically synthesized
ctcactgatatatagtgccata

SEQ ID NO: 1025982 - DNA, 22 bp, Artificial Sequence
  chemically synthesized
tatatatatatatatggcacta

SEQ ID NO: 1025983 - DNA, 22 bp, Artificial Sequence
  chemically synthesized
atatatatatatatatggcact

SEQ ID NO: 1025984 - DNA, 22 bp, Artificial Sequence
  chemically synthesized
actgatatatagtgccatatat

SEQ ID NO: 1025985 - DNA, 22 bp, Artificial Sequence
  chemically synthesized
atatatagtgccatatatatat

SEQ ID NO: 1025986 - DNA, 22 bp, Artificial Sequence
  chemically synthesized
tatatgtttatatatatatata

SEQ ID NO: 1025987 - DNA, 22 bp, Artificial Sequence
  chemically synthesized
atatatgtttatatatatatat

SEQ ID NO: 1025988 - DNA, 22 bp, Artificial Sequence
  chemically synthesized
tttatatatgtttatatatata

SEQ ID NO: 1025989 - DNA, 22 bp, Artificial Sequence
  chemically synthesized
atttatatatgtttatatatat

SEQ ID NO: 1025990 - DNA, 22 bp, Artificial Sequence
  chemically synthesized
tatatttatttatatatgttta

SEQ ID NO: 1025991 - DNA, 22 bp, Artificial Sequence
  chemically synthesized
atatatttatttatatatgttt

SEQ ID NO: 1025992 - DNA, 22 bp, Artificial Sequence
  chemically synthesized
tatatacacatatttatatatt

SEQ ID NO: 1025993 - DNA, 22 bp, Artificial Sequence
  chemically synthesized
atatatacacatatttatatat

SEQ ID NO: 1025994 - DNA, 22 bp, Artificial Sequence
  chemically synthesized
tatatatttatatatacacata

SEQ ID NO: 1025995 - DNA, 22 bp, Artificial Sequence
  chemically synthesized
atatatatttatatatacacat

SEQ ID NO: 1025996 - DNA, 22 bp, Artificial Sequence
  chemically synthesized
tatttatatatatttatatata

SEQ ID NO: 1025997 - DNA, 22 bp, Artificial Sequence
  chemically synthesized
gtatttatatatatttatatat

SEQ ID NO: 1025998 - DNA, 22 bp, Artificial Sequence
  chemically synthesized
tatatttgtatttatatatatt

SEQ ID NO: 1025999 - DNA, 22 bp, Artificial Sequence
  chemically synthesized
atatatttgtatttatatatat

SEQ ID NO: 1026000 - DNA, 22 bp, Artificial Sequence
  chemically synthesized
tatatatatatttatatatttg

SEQ ID NO: 1026001 - DNA, 22 bp, Artificial Sequence
  chemically synthesized
atatatatatatttatatattt

SEQ ID NO: 1026002 - DNA, 22 bp, Artificial Sequence
  chemically synthesized
tatatttatatatatatattta

SEQ ID NO: 1026003 - DNA, 22 bp, Artificial Sequence
  chemically synthesized
atatatttatatatatatattt

SEQ ID NO: 1026004 - DNA, 22 bp, Artificial Sequence
  chemically synthesized
tatatatatttatatatttata

SEQ ID NO: 1026005 - DNA, 22 bp, Artificial Sequence
  chemically synthesized
atatatatatttatatatttat

SEQ ID NO: 1026006 - DNA, 22 bp, Artificial Sequence
  chemically synthesized
tatatatttatatatatattta

SEQ ID NO: 1026007 - DNA, 22 bp, Artificial Sequence
  chemically synthesized
atatatatttatatatatattt

SEQ ID NO: 1026008 - DNA, 22 bp, Artificial Sequence
  chemically synthesized
tatatttatatatatttatata

SEQ ID NO: 1026009 - DNA, 22 bp, Artificial Sequence
  chemically synthesized
atatatttatatatatttatat

SEQ ID NO: 1026010 - DNA, 22 bp, Artificial Sequence
  chemically synthesized
tatatatttatatatttatata

SEQ ID NO: 1026011 - DNA, 22 bp, Artificial Sequence
  chemically synthesized
atatatatttatatatttatat

SEQ ID NO: 1026012 - DNA, 22 bp, Artificial Sequence
  chemically synthesized
tatatttatatatatttatata

SEQ ID NO: 1026013 - DNA, 22 bp, Artificial Sequence
  chemically synthesized
atatatttatatatatttatat

SEQ ID NO: 1026014 - DNA, 22 bp, Artificial Sequence
  chemically synthesized
tatatatatttatatatttata

SEQ ID NO: 1026015 - DNA, 22 bp, Artificial Sequence
  chemically synthesized
atatatatatttatatatttat

SEQ ID NO: 1026016 - DNA, 22 bp, Artificial Sequence
  chemically synthesized
tatatatttatatatatattta

SEQ ID NO: 1026017 - DNA, 22 bp, Artificial Sequence
  chemically synthesized
atatatatttatatatatattt

SEQ ID NO: 1026018 - DNA, 22 bp, Artificial Sequence
  chemically synthesized
tatatttatatatatttatata

SEQ ID NO: 1026019 - DNA, 22 bp, Artificial Sequence
  chemically synthesized
atatatttatatatatttatat

SEQ ID NO: 1026020 - DNA, 22 bp, Artificial Sequence
  chemically synthesized
tatatatttatatatttatata

SEQ ID NO: 1026021 - DNA, 22 bp, Artificial Sequence
  chemically synthesized
atatatatttatatatttatat

SEQ ID NO: 1026022 - DNA, 22 bp, Artificial Sequence
  chemically synthesized
tatatatttatatatatttata

SEQ ID NO: 1026023 - DNA, 22 bp, Artificial Sequence
  chemically synthesized
atatatatttatatatatttat

SEQ ID NO: 1026024 - DNA, 22 bp, Artificial Sequence
  chemically synthesized
tatatatttatatatatttata

SEQ ID NO: 1026025 - DNA, 22 bp, Artificial Sequence
  chemically synthesized
atatatatttatatatatttat

SEQ ID NO: 1026026 - DNA, 22 bp, Artificial Sequence
  chemically synthesized
tatatatatttatatatattta

SEQ ID NO: 1026027 - DNA, 22 bp, Artificial Sequence
  chemically synthesized
atatatatatttatatatattt

SEQ ID NO: 1026028 - DNA, 22 bp, Artificial Sequence
  chemically synthesized
tatatatttatatatatattta

SEQ ID NO: 1026029 - DNA, 22 bp, Artificial Sequence
  chemically synthesized
atatatatttatatatatattt

SEQ ID NO: 1026030 - DNA, 22 bp, Artificial Sequence
  chemically synthesized
tatacttatatatatttatata

SEQ ID NO: 1026031 - DNA, 22 bp, Artificial Sequence
  chemically synthesized
atatacttatatatatttatat

SEQ ID NO: 1026032 - DNA, 22 bp, Artificial Sequence
  chemically synthesized
tatatatttatatacttatata

SEQ ID NO: 1026033 - DNA, 22 bp, Artificial Sequence
  chemically synthesized
atatatatttatatacttatat

SEQ ID NO: 1026034 - DNA, 22 bp, Artificial Sequence
  chemically synthesized
tatatatttatatatatttata

SEQ ID NO: 1026035 - DNA, 22 bp, Artificial Sequence
  chemically synthesized
atatatatttatatatatttat

SEQ ID NO: 1026036 - DNA, 22 bp, Artificial Sequence
  chemically synthesized
tatatttatatatatttatata

SEQ ID NO: 1026037 - DNA, 22 bp, Artificial Sequence
  chemically synthesized
atatatttatatatatttatat

SEQ ID NO: 1026038 - DNA, 22 bp, Artificial Sequence
  chemically synthesized
tatatatttatatatttatata

SEQ ID NO: 1026039 - DNA, 22 bp, Artificial Sequence
  chemically synthesized
atatatatttatatatttatat

SEQ ID NO: 1026040 - DNA, 22 bp, Artificial Sequence
  chemically synthesized
tatatttatatatatttatata

SEQ ID NO: 1026041 - DNA, 22 bp, Artificial Sequence
  chemically synthesized
atatatttatatatatttatat

SEQ ID NO: 1026042 - DNA, 22 bp, Artificial Sequence
  chemically synthesized
tatatttatatatttatatata

SEQ ID NO: 1026043 - DNA, 22 bp, Artificial Sequence
  chemically synthesized
atatatttatatatttatatat

SEQ ID NO: 1026044 - DNA, 22 bp, Artificial Sequence
  chemically synthesized
tatatatttatatatttatata

SEQ ID NO: 1026045 - DNA, 22 bp, Artificial Sequence
  chemically synthesized
ttatatatttatatatttatat

SEQ ID NO: 1026046 - DNA, 22 bp, Artificial Sequence
  chemically synthesized
tatatatttttatatatttata

SEQ ID NO: 1026047 - DNA, 22 bp, Artificial Sequence
  chemically synthesized
atatatatttttatatatttat

SEQ ID NO: 1026048 - DNA, 22 bp, Artificial Sequence
  chemically synthesized
tatatatttatatatattttta

SEQ ID NO: 1026049 - DNA, 22 bp, Artificial Sequence
  chemically synthesized
atatatatttatatatattttt

SEQ ID NO: 1026050 - DNA, 22 bp, Artificial Sequence
  chemically synthesized
tgtatatatttatatatattta

SEQ ID NO: 1026051 - DNA, 22 bp, Artificial Sequence
  chemically synthesized
atgtatatatttatatatattt

SEQ ID NO: 1026052 - DNA, 22 bp, Artificial Sequence
  chemically synthesized
tatatatttatgtatatattta

SEQ ID NO: 1026053 - DNA, 22 bp, Artificial Sequence
  chemically synthesized
tatatctatatatatttatgta

SEQ ID NO: 1026054 - DNA, 22 bp, Artificial Sequence
  chemically synthesized
atatatctatatatatttatgt

SEQ ID NO: 1026055 - DNA, 22 bp, Artificial Sequence
  chemically synthesized
tgtatatatatatttatatatc

SEQ ID NO: 1026056 - DNA, 22 bp, Artificial Sequence
  chemically synthesized
atgtatatatatatttatatat

SEQ ID NO: 1026057 - DNA, 22 bp, Artificial Sequence
  chemically synthesized
tatatatttatgtatatatata

SEQ ID NO: 1026058 - DNA, 22 bp, Artificial Sequence
  chemically synthesized
atatatatttatgtatatatat

SEQ ID NO: 1026059 - DNA, 22 bp, Artificial Sequence
  chemically synthesized
aatataaatatatatacacaca

SEQ ID NO: 1026060 - DNA, 22 bp, Artificial Sequence
  chemically synthesized
ccgttgaatataaatatatata

SEQ ID NO: 1026061 - DNA, 22 bp, Artificial Sequence
  chemically synthesized
accgttgaatataaatatatat

SEQ ID NO: 1026062 - DNA, 22 bp, Artificial Sequence
  chemically synthesized
gtgtgtgtatatatatttatat

SEQ ID NO: 1026063 - DNA, 22 bp, Artificial Sequence
  chemically synthesized
tgtgtgtatatatatttatatt

SEQ ID NO: 1026064 - DNA, 22 bp, Artificial Sequence
  chemically synthesized
taaaccatttaccgttgaatat

SEQ ID NO: 1026065 - DNA, 22 bp, Artificial Sequence
  chemically synthesized
ataaaccatttaccgttgaata

SEQ ID NO: 1026066 - DNA, 22 bp, Artificial Sequence
  chemically synthesized
tataaaccatttaccgttgaat

SEQ ID NO: 1026067 - DNA, 22 bp, Artificial Sequence
  chemically synthesized
atattcaacggtaaatggttta

SEQ ID NO: 1026068 - DNA, 22 bp, Artificial Sequence
  chemically synthesized
tattcaacggtaaatggtttat

SEQ ID NO: 1026069 - DNA, 22 bp, Artificial Sequence
  chemically synthesized
aacggtaaatggtttataaaac

SEQ ID NO: 1026070 - DNA, 22 bp, Artificial Sequence
  chemically synthesized
atcgatcgggaaagttttataa

SEQ ID NO: 1026071 - DNA, 22 bp, Artificial Sequence
  chemically synthesized
aatcgatcgggaaagttttata

SEQ ID NO: 1026072 - DNA, 22 bp, Artificial Sequence
  chemically synthesized
ataaaactttcccgatcgatta

SEQ ID NO: 1026073 - DNA, 22 bp, Artificial Sequence
  chemically synthesized
cataccaatacttaatcgatcg

SEQ ID NO: 1026074 - DNA, 22 bp, Artificial Sequence
  chemically synthesized
taaaactttcccgatcgattaa

SEQ ID NO: 1026075 - DNA, 22 bp, Artificial Sequence
  chemically synthesized
actccataccaatacttaatcg

SEQ ID NO: 1026076 - DNA, 22 bp, Artificial Sequence
  chemically synthesized
tgactccataccaatacttaat

SEQ ID NO: 1026077 - DNA, 22 bp, Artificial Sequence
  chemically synthesized
tctgactccataccaatactta

SEQ ID NO: 1026078 - DNA, 22 bp, Artificial Sequence
  chemically synthesized
tcccgatcgattaagtattggt

SEQ ID NO: 1026079 - DNA, 22 bp, Artificial Sequence
  chemically synthesized
ctctgactccataccaatactt

SEQ ID NO: 1026080 - DNA, 22 bp, Artificial Sequence
  chemically synthesized
cccgatcgattaagtattggta

SEQ ID NO: 1026081 - DNA, 22 bp, Artificial Sequence
  chemically synthesized
ccgatcgattaagtattggtat

SEQ ID NO: 1026082 - DNA, 22 bp, Artificial Sequence
  chemically synthesized
acttctctgactccataccaat

SEQ ID NO: 1026083 - DNA, 22 bp, Artificial Sequence
  chemically synthesized
cctcacttctctgactccatac

SEQ ID NO: 1026084 - DNA, 22 bp, Artificial Sequence
  chemically synthesized
ccctcacttctctgactccata

SEQ ID NO: 1026085 - DNA, 22 bp, Artificial Sequence
  chemically synthesized
tccctcacttctctgactccat

SEQ ID NO: 1026086 - DNA, 22 bp, Artificial Sequence
  chemically synthesized
agtattggtatggagtcagaga

SEQ ID NO: 1026087 - DNA, 22 bp, Artificial Sequence
  chemically synthesized
ttttccctcacttctctgactc

SEQ ID NO: 1026088 - DNA, 22 bp, Artificial Sequence
  chemically synthesized
gtatggagtcagagaagtgagg

SEQ ID NO: 1026089 - DNA, 22 bp, Artificial Sequence
  chemically synthesized
aaagatggtagataaaactgtt

SEQ ID NO: 1026090 - DNA, 22 bp, Artificial Sequence
  chemically synthesized
accatgatatctcaaagatggt

SEQ ID NO: 1026091 - DNA, 22 bp, Artificial Sequence
  chemically synthesized
aatctcaccatgatatctcaaa

SEQ ID NO: 1026092 - DNA, 22 bp, Artificial Sequence
  chemically synthesized
tatctaccatctttgagatatc

SEQ ID NO: 1026093 - DNA, 22 bp, Artificial Sequence
  chemically synthesized
aaatctcaccatgatatctcaa

SEQ ID NO: 1026094 - DNA, 22 bp, Artificial Sequence
  chemically synthesized
atctaccatctttgagatatca

SEQ ID NO: 1026095 - DNA, 22 bp, Artificial Sequence
  chemically synthesized
tctaccatctttgagatatcat

SEQ ID NO: 1026096 - DNA, 22 bp, Artificial Sequence
  chemically synthesized
ccatctttgagatatcatggtg

SEQ ID NO: 1026097 - DNA, 22 bp, Artificial Sequence
  chemically synthesized
tatccttaaatctcaccatgat

SEQ ID NO: 1026098 - DNA, 22 bp, Artificial Sequence
  chemically synthesized
tgtatccttaaatctcaccatg

SEQ ID NO: 1026099 - DNA, 22 bp, Artificial Sequence
  chemically synthesized
tgagatatcatggtgagattta

SEQ ID NO: 1026100 - DNA, 22 bp, Artificial Sequence
  chemically synthesized
gagatatcatggtgagatttaa

SEQ ID NO: 1026101 - DNA, 22 bp, Artificial Sequence
  chemically synthesized
atctctgtatccttaaatctca

SEQ ID NO: 1026102 - DNA, 22 bp, Artificial Sequence
  chemically synthesized
agatatcatggtgagatttaag

SEQ ID NO: 1026103 - DNA, 22 bp, Artificial Sequence
  chemically synthesized
aatctctgtatccttaaatctc

SEQ ID NO: 1026104 - DNA, 22 bp, Artificial Sequence
  chemically synthesized
gacaatatatttaatctctgta

SEQ ID NO: 1026105 - DNA, 22 bp, Artificial Sequence
  chemically synthesized
aaggatacagagattaaatata

SEQ ID NO: 1026106 - DNA, 22 bp, Artificial Sequence
  chemically synthesized
aggatacagagattaaatatat

SEQ ID NO: 1026107 - DNA, 22 bp, Artificial Sequence
  chemically synthesized
aagacctggacaatatatttaa

SEQ ID NO: 1026108 - DNA, 22 bp, Artificial Sequence
  chemically synthesized
aaagacctggacaatatattta

SEQ ID NO: 1026109 - DNA, 22 bp, Artificial Sequence
  chemically synthesized
ttaaagacctggacaatatatt

SEQ ID NO: 1026110 - DNA, 22 bp, Artificial Sequence
  chemically synthesized
tgaggttcttaaagacctggac

SEQ ID NO: 1026111 - DNA, 22 bp, Artificial Sequence
  chemically synthesized
aatatattgtccaggtctttaa

SEQ ID NO: 1026112 - DNA, 22 bp, Artificial Sequence
  chemically synthesized
tctatgaggttcttaaagacct

SEQ ID NO: 1026113 - DNA, 22 bp, Artificial Sequence
  chemically synthesized
tgtctatgaggttcttaaagac

SEQ ID NO: 1026114 - DNA, 22 bp, Artificial Sequence
  chemically synthesized
tccaggtctttaagaacctcat

SEQ ID NO: 1026115 - DNA, 22 bp, Artificial Sequence
  chemically synthesized
taagaacctcatagacagagtt

SEQ ID NO: 1026116 - DNA, 22 bp, Artificial Sequence
  chemically synthesized
gagtcacacataaactctgtct

SEQ ID NO: 1026117 - DNA, 22 bp, Artificial Sequence
  chemically synthesized
aagaacctcatagacagagttt

SEQ ID NO: 1026118 - DNA, 22 bp, Artificial Sequence
  chemically synthesized
agagtcacacataaactctgtc

SEQ ID NO: 1026119 - DNA, 22 bp, Artificial Sequence
  chemically synthesized
agaacctcatagacagagttta

SEQ ID NO: 1026120 - DNA, 22 bp, Artificial Sequence
  chemically synthesized
tagagtcacacataaactctgt

SEQ ID NO: 1026121 - DNA, 22 bp, Artificial Sequence
  chemically synthesized
ttagagtcacacataaactctg

SEQ ID NO: 1026122 - DNA, 22 bp, Artificial Sequence
  chemically synthesized
tttagagtcacacataaactct

SEQ ID NO: 1026123 - DNA, 22 bp, Artificial Sequence
  chemically synthesized
ttttttagagtcacacataaac

SEQ ID NO: 1026124 - DNA, 22 bp, Artificial Sequence
  chemically synthesized
atagacagagtttatgtgtgac

SEQ ID NO: 1026125 - DNA, 22 bp, Artificial Sequence
  chemically synthesized
atctattttttagagtcacaca

SEQ ID NO: 1026126 - DNA, 22 bp, Artificial Sequence
  chemically synthesized
catctattttttagagtcacac

SEQ ID NO: 1026127 - DNA, 22 bp, Artificial Sequence
  chemically synthesized
tcttcatctattttttagagtc

SEQ ID NO: 1026128 - DNA, 22 bp, Artificial Sequence
  chemically synthesized
atcttcatctattttttagagt

SEQ ID NO: 1026129 - DNA, 22 bp, Artificial Sequence
  chemically synthesized
ttatcttcatctattttttaga

SEQ ID NO: 1026130 - DNA, 22 bp, Artificial Sequence
  chemically synthesized
cttatcttcatctattttttag

SEQ ID NO: 1026131 - DNA, 22 bp, Artificial Sequence
  chemically synthesized
atgtgtgactctaaaaaataga

SEQ ID NO: 1026132 - DNA, 22 bp, Artificial Sequence
  chemically synthesized
tgtgtgactctaaaaaatagat

SEQ ID NO: 1026133 - DNA, 22 bp, Artificial Sequence
  chemically synthesized
tcttcttatcttcatctatttt

SEQ ID NO: 1026134 - DNA, 22 bp, Artificial Sequence
  chemically synthesized
atcttcttatcttcatctattt

SEQ ID NO: 1026135 - DNA, 22 bp, Artificial Sequence
  chemically synthesized
aatacttatcttcttatcttca

SEQ ID NO: 1026136 - DNA, 22 bp, Artificial Sequence
  chemically synthesized
taaaaaatagatgaagataaga

SEQ ID NO: 1026137 - DNA, 22 bp, Artificial Sequence
  chemically synthesized
aaatacttatcttcttatcttc

SEQ ID NO: 1026138 - DNA, 22 bp, Artificial Sequence
  chemically synthesized
aaaaatagatgaagataagaag

SEQ ID NO: 1026139 - DNA, 22 bp, Artificial Sequence
  chemically synthesized
atttaaatacttatcttcttat

SEQ ID NO: 1026140 - DNA, 22 bp, Artificial Sequence
  chemically synthesized
catttaaatacttatcttctta

SEQ ID NO: 1026141 - DNA, 22 bp, Artificial Sequence
  chemically synthesized
tcatttaaatacttatcttctt

SEQ ID NO: 1026142 - DNA, 22 bp, Artificial Sequence
  chemically synthesized
ttcatttaaatacttatcttct

SEQ ID NO: 1026143 - DNA, 22 bp, Artificial Sequence
  chemically synthesized
tttcatttaaatacttatcttc

SEQ ID NO: 1026144 - DNA, 22 bp, Artificial Sequence
  chemically synthesized
aattttttcatttaaatactta

SEQ ID NO: 1026145 - DNA, 22 bp, Artificial Sequence
  chemically synthesized
gccgcctcaattttttcattta

SEQ ID NO: 1026146 - DNA, 22 bp, Artificial Sequence
  chemically synthesized
ggccgcctcaattttttcattt

SEQ ID NO: 1026147 - DNA, 22 bp, Artificial Sequence
  chemically synthesized
cccaaacccttggccgcctcaa

SEQ ID NO: 1026148 - DNA, 22 bp, Artificial Sequence
  chemically synthesized
aaatgaaaaaattgaggcggcc

SEQ ID NO: 1026149 - DNA, 22 bp, Artificial Sequence
  chemically synthesized
aatgaaaaaattgaggcggcca

SEQ ID NO: 1026150 - DNA, 22 bp, Artificial Sequence
  chemically synthesized
aggcggccaagggtttggggag

SEQ ID NO: 1026151 - DNA, 22 bp, Artificial Sequence
  chemically synthesized
aagacagtcataagctccccaa

SEQ ID NO: 1026152 - DNA, 22 bp, Artificial Sequence
  chemically synthesized
ggggagcttatgactgtcttta

SEQ ID NO: 1026153 - DNA, 22 bp, Artificial Sequence
  chemically synthesized
gggagcttatgactgtctttaa

SEQ ID NO: 1026154 - DNA, 22 bp, Artificial Sequence
  chemically synthesized
gtgtcgatagggttaaagacag

SEQ ID NO: 1026155 - DNA, 22 bp, Artificial Sequence
  chemically synthesized
agtgtcgatagggttaaagaca

SEQ ID NO: 1026156 - DNA, 22 bp, Artificial Sequence
  chemically synthesized
ttagtgtcgatagggttaaaga

SEQ ID NO: 1026157 - DNA, 22 bp, Artificial Sequence
  chemically synthesized
tcttagtgtcgatagggttaaa

SEQ ID NO: 1026158 - DNA, 22 bp, Artificial Sequence
  chemically synthesized
atgactgtctttaaccctatcg

SEQ ID NO: 1026159 - DNA, 22 bp, Artificial Sequence
  chemically synthesized
ttctcttagtgtcgatagggtt

SEQ ID NO: 1026160 - DNA, 22 bp, Artificial Sequence
  chemically synthesized
tgactgtctttaaccctatcga

SEQ ID NO: 1026161 - DNA, 22 bp, Artificial Sequence
  chemically synthesized
tattctcttagtgtcgataggg

SEQ ID NO: 1026162 - DNA, 22 bp, Artificial Sequence
  chemically synthesized
ctattctcttagtgtcgatagg

SEQ ID NO: 1026163 - DNA, 22 bp, Artificial Sequence
  chemically synthesized
tctttaaccctatcgacactaa

SEQ ID NO: 1026164 - DNA, 22 bp, Artificial Sequence
  chemically synthesized
taaccctatcgacactaagaga

SEQ ID NO: 1026165 - DNA, 22 bp, Artificial Sequence
  chemically synthesized
aaccctatcgacactaagagaa

SEQ ID NO: 1026166 - DNA, 22 bp, Artificial Sequence
  chemically synthesized
accctatcgacactaagagaat

SEQ ID NO: 1026167 - DNA, 22 bp, Artificial Sequence
  chemically synthesized
gtaagcaacttctattctctta

SEQ ID NO: 1026168 - DNA, 22 bp, Artificial Sequence
  chemically synthesized
tcgacactaagagaatagaagt

SEQ ID NO: 1026169 - DNA, 22 bp, Artificial Sequence
  chemically synthesized
agtgaccagttagtaagcaact

SEQ ID NO: 1026170 - DNA, 22 bp, Artificial Sequence
  chemically synthesized
agagaatagaagttgcttacta

SEQ ID NO: 1026171 - DNA, 22 bp, Artificial Sequence
  chemically synthesized
agtcagctaagtgaccagttag

SEQ ID NO: 1026172 - DNA, 22 bp, Artificial Sequence
  chemically synthesized
cagtcagctaagtgaccagtta

SEQ ID NO: 1026173 - DNA, 22 bp, Artificial Sequence
  chemically synthesized
tttcagtcagctaagtgaccag

SEQ ID NO: 1026174 - DNA, 22 bp, Artificial Sequence
  chemically synthesized
cttactaactggtcacttagct

SEQ ID NO: 1026175 - DNA, 22 bp, Artificial Sequence
  chemically synthesized
actaactggtcacttagctgac

SEQ ID NO: 1026176 - DNA, 22 bp, Artificial Sequence
  chemically synthesized
ctaactggtcacttagctgact

SEQ ID NO: 1026177 - DNA, 22 bp, Artificial Sequence
  chemically synthesized
actggtcacttagctgactgaa

SEQ ID NO: 1026178 - DNA, 22 bp, Artificial Sequence
  chemically synthesized
gtcacttagctgactgaaacag

SEQ ID NO: 1026179 - DNA, 22 bp, Artificial Sequence
  chemically synthesized
caaagagagaagctgtttcagt

SEQ ID NO: 1026180 - DNA, 22 bp, Artificial Sequence
  chemically synthesized
ctacaaagagagaagctgtttc

SEQ ID NO: 1026181 - DNA, 22 bp, Artificial Sequence
  chemically synthesized
cctacaaagagagaagctgttt

SEQ ID NO: 1026182 - DNA, 22 bp, Artificial Sequence
  chemically synthesized
agctgactgaaacagcttctct

SEQ ID NO: 1026183 - DNA, 22 bp, Artificial Sequence
  chemically synthesized
gctgactgaaacagcttctctc

SEQ ID NO: 1026184 - DNA, 22 bp, Artificial Sequence
  chemically synthesized
aacttcctacaaagagagaagc

SEQ ID NO: 1026185 - DNA, 22 bp, Artificial Sequence
  chemically synthesized
aaacttcctacaaagagagaag

SEQ ID NO: 1026186 - DNA, 22 bp, Artificial Sequence
  chemically synthesized
actgaaacagcttctctctttg

SEQ ID NO: 1026187 - DNA, 22 bp, Artificial Sequence
  chemically synthesized
aaacagcttctctctttgtagg

SEQ ID NO: 1026188 - DNA, 22 bp, Artificial Sequence
  chemically synthesized
tggaacttaaacttcctacaaa

SEQ ID NO: 1026189 - DNA, 22 bp, Artificial Sequence
  chemically synthesized
ctctctttgtaggaagtttaag

SEQ ID NO: 1026190 - DNA, 22 bp, Artificial Sequence
  chemically synthesized
tctctttgtaggaagtttaagt

SEQ ID NO: 1026191 - DNA, 22 bp, Artificial Sequence
  chemically synthesized
tctttgtaggaagtttaagttc

SEQ ID NO: 1026192 - DNA, 22 bp, Artificial Sequence
  chemically synthesized
tttgtaggaagtttaagttcca

SEQ ID NO: 1026193 - DNA, 22 bp, Artificial Sequence
  chemically synthesized
tgtaggaagtttaagttccaca

SEQ ID NO: 1026194 - DNA, 22 bp, Artificial Sequence
  chemically synthesized
gcaccgagtaattgtggaactt

SEQ ID NO: 1026195 - DNA, 22 bp, Artificial Sequence
  chemically synthesized
gtaggaagtttaagttccacaa

SEQ ID NO: 1026196 - DNA, 22 bp, Artificial Sequence
  chemically synthesized
ggcaccgagtaattgtggaact

SEQ ID NO: 1026197 - DNA, 22 bp, Artificial Sequence
  chemically synthesized
taggaagtttaagttccacaat

SEQ ID NO: 1026198 - DNA, 22 bp, Artificial Sequence
  chemically synthesized
tggcaccgagtaattgtggaac

SEQ ID NO: 1026199 - DNA, 22 bp, Artificial Sequence
  chemically synthesized
ttggcaccgagtaattgtggaa

SEQ ID NO: 1026200 - DNA, 22 bp, Artificial Sequence
  chemically synthesized
tttggcaccgagtaattgtgga

SEQ ID NO: 1026201 - DNA, 22 bp, Artificial Sequence
  chemically synthesized
aagttccacaattactcggtgc

SEQ ID NO: 1026202 - DNA, 22 bp, Artificial Sequence
  chemically synthesized
agttccacaattactcggtgcc

SEQ ID NO: 1026203 - DNA, 22 bp, Artificial Sequence
  chemically synthesized
cacaattactcggtgccaaaaa

SEQ ID NO: 1026204 - DNA, 22 bp, Artificial Sequence
  chemically synthesized
aatagcacacagtattttttgg

SEQ ID NO: 1026205 - DNA, 22 bp, Artificial Sequence
  chemically synthesized
gaatagcacacagtattttttg

SEQ ID NO: 1026206 - DNA, 22 bp, Artificial Sequence
  chemically synthesized
ctcggtgccaaaaaatactgtg

SEQ ID NO: 1026207 - DNA, 22 bp, Artificial Sequence
  chemically synthesized
ggtgccaaaaaatactgtgtgc

SEQ ID NO: 1026208 - DNA, 22 bp, Artificial Sequence
  chemically synthesized
cagaaatttgaatagcacacag

SEQ ID NO: 1026209 - DNA, 22 bp, Artificial Sequence
  chemically synthesized
atcctccagaaatttgaatagc

SEQ ID NO: 1026210 - DNA, 22 bp, Artificial Sequence
  chemically synthesized
catcctccagaaatttgaatag

SEQ ID NO: 1026211 - DNA, 22 bp, Artificial Sequence
  chemically synthesized
tcatcctccagaaatttgaata

SEQ ID NO: 1026212 - DNA, 22 bp, Artificial Sequence
  chemically synthesized
ttcatcctccagaaatttgaat

SEQ ID NO: 1026213 - DNA, 22 bp, Artificial Sequence
  chemically synthesized
tgtgctattcaaatttctggag

SEQ ID NO: 1026214 - DNA, 22 bp, Artificial Sequence
  chemically synthesized
tgtagcttttcatcctccagaa

SEQ ID NO: 1026215 - DNA, 22 bp, Artificial Sequence
  chemically synthesized
ttcaaatttctggaggatgaaa

SEQ ID NO: 1026216 - DNA, 22 bp, Artificial Sequence
  chemically synthesized
aaatttctggaggatgaaaagc

SEQ ID NO: 1026217 - DNA, 22 bp, Artificial Sequence
  chemically synthesized
ccatatgccctatgtagctttt

SEQ ID NO: 1026218 - DNA, 22 bp, Artificial Sequence
  chemically synthesized
ctggaggatgaaaagctacata

SEQ ID NO: 1026219 - DNA, 22 bp, Artificial Sequence
  chemically synthesized
tgccatatgccctatgtagctt

SEQ ID NO: 1026220 - DNA, 22 bp, Artificial Sequence
  chemically synthesized
tggaggatgaaaagctacatag

SEQ ID NO: 1026221 - DNA, 22 bp, Artificial Sequence
  chemically synthesized
gaggatgaaaagctacataggg

SEQ ID NO: 1026222 - DNA, 22 bp, Artificial Sequence
  chemically synthesized
catcgttctgccatatgcccta

SEQ ID NO: 1026223 - DNA, 22 bp, Artificial Sequence
  chemically synthesized
acatcgttctgccatatgccct

SEQ ID NO: 1026224 - DNA, 22 bp, Artificial Sequence
  chemically synthesized
tacatcgttctgccatatgccc

SEQ ID NO: 1026225 - DNA, 22 bp, Artificial Sequence
  chemically synthesized
cactttacatcgttctgccata

SEQ ID NO: 1026226 - DNA, 22 bp, Artificial Sequence
  chemically synthesized
tgcactttacatcgttctgcca

SEQ ID NO: 1026227 - DNA, 22 bp, Artificial Sequence
  chemically synthesized
catagggcatatggcagaacga

SEQ ID NO: 1026228 - DNA, 22 bp, Artificial Sequence
  chemically synthesized
agcatattctgcactttacatc

SEQ ID NO: 1026229 - DNA, 22 bp, Artificial Sequence
  chemically synthesized
agctaagcatattctgcacttt

SEQ ID NO: 1026230 - DNA, 22 bp, Artificial Sequence
  chemically synthesized
cagctaagcatattctgcactt

SEQ ID NO: 1026231 - DNA, 22 bp, Artificial Sequence
  chemically synthesized
ggacaatcttcagctaagcata

SEQ ID NO: 1026232 - DNA, 22 bp, Artificial Sequence
  chemically synthesized
gggacaatcttcagctaagcat

SEQ ID NO: 1026233 - DNA, 22 bp, Artificial Sequence
  chemically synthesized
tgggacaatcttcagctaagca

SEQ ID NO: 1026234 - DNA, 22 bp, Artificial Sequence
  chemically synthesized
ccaagagctttgggacaatctt

SEQ ID NO: 1026235 - DNA, 22 bp, Artificial Sequence
  chemically synthesized
agctgaagattgtcccaaagct

SEQ ID NO: 1026236 - DNA, 22 bp, Artificial Sequence
  chemically synthesized
gctgaagattgtcccaaagctc

SEQ ID NO: 1026237 - DNA, 22 bp, Artificial Sequence
  chemically synthesized
aagattgtcccaaagctcttgg

SEQ ID NO: 1026238 - DNA, 22 bp, Artificial Sequence
  chemically synthesized
tcaccaaataaacatctcccaa

SEQ ID NO: 1026239 - DNA, 22 bp, Artificial Sequence
  chemically synthesized
tcccaaagctcttgggagatgt

SEQ ID NO: 1026240 - DNA, 22 bp, Artificial Sequence
  chemically synthesized
ttgggagatgtttatttggtga

SEQ ID NO: 1026241 - DNA, 22 bp, Artificial Sequence
  chemically synthesized
gggagatgtttatttggtgaca

SEQ ID NO: 1026242 - DNA, 22 bp, Artificial Sequence
  chemically synthesized
ggagatgtttatttggtgacaa

SEQ ID NO: 1026243 - DNA, 22 bp, Artificial Sequence
  chemically synthesized
acaatataaagtgaatgcgatt

SEQ ID NO: 1026244 - DNA, 22 bp, Artificial Sequence
  chemically synthesized
atttggtgacaatcgcattcac

SEQ ID NO: 1026245 - DNA, 22 bp, Artificial Sequence
  chemically synthesized
tttggtgacaatcgcattcact

SEQ ID NO: 1026246 - DNA, 22 bp, Artificial Sequence
  chemically synthesized
ggtgacaatcgcattcacttta

SEQ ID NO: 1026247 - DNA, 22 bp, Artificial Sequence
  chemically synthesized
gtgacaatcgcattcactttat

SEQ ID NO: 1026248 - DNA, 22 bp, Artificial Sequence
  chemically synthesized
acaaagggctgacaatataaag

SEQ ID NO: 1026249 - DNA, 22 bp, Artificial Sequence
  chemically synthesized
actttatattgtcagccctttg

SEQ ID NO: 1026250 - DNA, 22 bp, Artificial Sequence
  chemically synthesized
tatattgtcagccctttgttag

SEQ ID NO: 1026251 - DNA, 22 bp, Artificial Sequence
  chemically synthesized
atattgtcagccctttgttaga

SEQ ID NO: 1026252 - DNA, 22 bp, Artificial Sequence
  chemically synthesized
tattgtcagccctttgttagat

SEQ ID NO: 1026253 - DNA, 22 bp, Artificial Sequence
  chemically synthesized
atgagtaaggatgatctaacaa

SEQ ID NO: 1026254 - DNA, 22 bp, Artificial Sequence
  chemically synthesized
tcagccctttgttagatcatcc

SEQ ID NO: 1026255 - DNA, 22 bp, Artificial Sequence
  chemically synthesized
tgttagatcatccttactcatc

SEQ ID NO: 1026256 - DNA, 22 bp, Artificial Sequence
  chemically synthesized
gttagatcatccttactcatca

SEQ ID NO: 1026257 - DNA, 22 bp, Artificial Sequence
  chemically synthesized
ttagatcatccttactcatcag

SEQ ID NO: 1026258 - DNA, 22 bp, Artificial Sequence
  chemically synthesized
gatcatccttactcatcagggt

SEQ ID NO: 1026259 - DNA, 22 bp, Artificial Sequence
  chemically synthesized
aagcaaggatcagaccctgatg

SEQ ID NO: 1026260 - DNA, 22 bp, Artificial Sequence
  chemically synthesized
actcatcagggtctgatccttg

SEQ ID NO: 1026261 - DNA, 22 bp, Artificial Sequence
  chemically synthesized
ctcatcagggtctgatccttgc

SEQ ID NO: 1026262 - DNA, 22 bp, Artificial Sequence
  chemically synthesized
agtacaattaaagcaaggatca

SEQ ID NO: 1026263 - DNA, 22 bp, Artificial Sequence
  chemically synthesized
atcagggtctgatccttgcttt

SEQ ID NO: 1026264 - DNA, 22 bp, Artificial Sequence
  chemically synthesized
cctaagtacaattaaagcaagg

SEQ ID NO: 1026265 - DNA, 22 bp, Artificial Sequence
  chemically synthesized
atccttgctttaattgtactta

SEQ ID NO: 1026266 - DNA, 22 bp, Artificial Sequence
  chemically synthesized
gctttaattgtacttagggaat

SEQ ID NO: 1026267 - DNA, 22 bp, Artificial Sequence
  chemically synthesized
ctttaattgtacttagggaatt

SEQ ID NO: 1026268 - DNA, 22 bp, Artificial Sequence
  chemically synthesized
atatagagataaataattccct

SEQ ID NO: 1026269 - DNA, 22 bp, Artificial Sequence
  chemically synthesized
taattgtacttagggaattatt

SEQ ID NO: 1026270 - DNA, 22 bp, Artificial Sequence
  chemically synthesized
aattgtacttagggaattattt

SEQ ID NO: 1026271 - DNA, 22 bp, Artificial Sequence
  chemically synthesized
attgtacttagggaattattta

SEQ ID NO: 1026272 - DNA, 22 bp, Artificial Sequence
  chemically synthesized
gattgatatagagataaataat

SEQ ID NO: 1026273 - DNA, 22 bp, Artificial Sequence
  chemically synthesized
agattgatatagagataaataa

SEQ ID NO: 1026274 - DNA, 22 bp, Artificial Sequence
  chemically synthesized
tacttagggaattatttatctc

SEQ ID NO: 1026275 - DNA, 22 bp, Artificial Sequence
  chemically synthesized
tagattgatatagagataaata

SEQ ID NO: 1026276 - DNA, 22 bp, Artificial Sequence
  chemically synthesized
agggaattatttatctctatat

SEQ ID NO: 1026277 - DNA, 22 bp, Artificial Sequence
  chemically synthesized
gggaattatttatctctatatc

SEQ ID NO: 1026278 - DNA, 22 bp, Artificial Sequence
  chemically synthesized
aatcaattttagattgatatag

SEQ ID NO: 1026279 - DNA, 22 bp, Artificial Sequence
  chemically synthesized
tttatctctatatcaatctaaa

SEQ ID NO: 1026280 - DNA, 22 bp, Artificial Sequence
  chemically synthesized
atctctatatcaatctaaaatt

SEQ ID NO: 1026281 - DNA, 22 bp, Artificial Sequence
  chemically synthesized
tctctatatcaatctaaaattg

SEQ ID NO: 1026282 - DNA, 22 bp, Artificial Sequence
  chemically synthesized
tatatcaatctaaaattgattt

SEQ ID NO: 1026283 - DNA, 22 bp, Artificial Sequence
  chemically synthesized
tatcaatctaaaattgatttaa

SEQ ID NO: 1026284 - DNA, 22 bp, Artificial Sequence
  chemically synthesized
aaaaaaaaaaaaaaaagattaa

SEQ ID NO: 1026285 - DNA, 22 bp, Artificial Sequence
  chemically synthesized
aaattgatttaatctttttttt

SEQ ID NO: 1026286 - DNA, 22 bp, Artificial Sequence
  chemically synthesized
catctcaaaaaaaaaaaaaaaa

SEQ ID NO: 1026287 - DNA, 22 bp, Artificial Sequence
  chemically synthesized
atttaatctttttttttttttt

SEQ ID NO: 1026288 - DNA, 22 bp, Artificial Sequence
  chemically synthesized
aatcttttttttttttttttga

SEQ ID NO: 1026289 - DNA, 22 bp, Artificial Sequence
  chemically synthesized
atcttttttttttttttttgag

SEQ ID NO: 1026290 - DNA, 22 bp, Artificial Sequence
  chemically synthesized
ttttttttttttttgagatgta

SEQ ID NO: 1026291 - DNA, 22 bp, Artificial Sequence
  chemically synthesized
tttttttttttttgagatgtag

SEQ ID NO: 1026292 - DNA, 22 bp, Artificial Sequence
  chemically synthesized
ttttttttttttgagatgtagt

SEQ ID NO: 1026293 - DNA, 22 bp, Artificial Sequence
  chemically synthesized
tttttttttttgagatgtagtc

SEQ ID NO: 1026294 - DNA, 22 bp, Artificial Sequence
  chemically synthesized
ttttttttttgagatgtagtct

SEQ ID NO: 1026295 - DNA, 22 bp, Artificial Sequence
  chemically synthesized
ggtgacagagcgagactacatc

SEQ ID NO: 1026296 - DNA, 22 bp, Artificial Sequence
  chemically synthesized
tttttttttgagatgtagtctc

SEQ ID NO: 1026297 - DNA, 22 bp, Artificial Sequence
  chemically synthesized
ttttttttgagatgtagtctcg

SEQ ID NO: 1026298 - DNA, 22 bp, Artificial Sequence
  chemically synthesized
tttttttgagatgtagtctcgc

SEQ ID NO: 1026299 - DNA, 22 bp, Artificial Sequence
  chemically synthesized
ttttttgagatgtagtctcgct

SEQ ID NO: 1026300 - DNA, 22 bp, Artificial Sequence
  chemically synthesized
tttttgagatgtagtctcgctc

SEQ ID NO: 1026301 - DNA, 22 bp, Artificial Sequence
  chemically synthesized
ttttgagatgtagtctcgctct

SEQ ID NO: 1026302 - DNA, 22 bp, Artificial Sequence
  chemically synthesized
tttgagatgtagtctcgctctg

SEQ ID NO: 1026303 - DNA, 22 bp, Artificial Sequence
  chemically synthesized
cagcctgggtgacagagcgaga

SEQ ID NO: 1026304 - DNA, 22 bp, Artificial Sequence
  chemically synthesized
ttgagatgtagtctcgctctgt

SEQ ID NO: 1026305 - DNA, 22 bp, Artificial Sequence
  chemically synthesized
tgagatgtagtctcgctctgtc

SEQ ID NO: 1026306 - DNA, 22 bp, Artificial Sequence
  chemically synthesized
gagatgtagtctcgctctgtca

SEQ ID NO: 1026307 - DNA, 22 bp, Artificial Sequence
  chemically synthesized
agatgtagtctcgctctgtcac

SEQ ID NO: 1026308 - DNA, 22 bp, Artificial Sequence
  chemically synthesized
cactccagcctgggtgacagag

SEQ ID NO: 1026309 - DNA, 22 bp, Artificial Sequence
  chemically synthesized
gctctgtcacccaggctggagt

SEQ ID NO: 1026310 - DNA, 22 bp, Artificial Sequence
  chemically synthesized
tgtcacccaggctggagtgcag

SEQ ID NO: 1026311 - DNA, 22 bp, Artificial Sequence
  chemically synthesized
tcacccaggctggagtgcagtg

SEQ ID NO: 1026312 - DNA, 22 bp, Artificial Sequence
  chemically synthesized
cagtgagccaagatcacgccac

SEQ ID NO: 1026313 - DNA, 22 bp, Artificial Sequence
  chemically synthesized
gagtgcagtggcgtgatcttgg

SEQ ID NO: 1026314 - DNA, 22 bp, Artificial Sequence
  chemically synthesized
aacccagcaggcggaggttgca

SEQ ID NO: 1026315 - DNA, 22 bp, Artificial Sequence
  chemically synthesized
ctgaacccagcaggcggaggtt

SEQ ID NO: 1026316 - DNA, 22 bp, Artificial Sequence
  chemically synthesized
ggctcactgcaacctccgcctg

SEQ ID NO: 1026317 - DNA, 22 bp, Artificial Sequence
  chemically synthesized
gctcactgcaacctccgcctgc

SEQ ID NO: 1026318 - DNA, 22 bp, Artificial Sequence
  chemically synthesized
actgcaacctccgcctgctggg

SEQ ID NO: 1026319 - DNA, 22 bp, Artificial Sequence
  chemically synthesized
caacctccgcctgctgggttca

SEQ ID NO: 1026320 - DNA, 22 bp, Artificial Sequence
  chemically synthesized
aggcagaagaatctcctgaacc

SEQ ID NO: 1026321 - DNA, 22 bp, Artificial Sequence
  chemically synthesized
cgcctgctgggttcaggagatt

SEQ ID NO: 1026322 - DNA, 22 bp, Artificial Sequence
  chemically synthesized
ggaggctgaggcagaagaatct

SEQ ID NO: 1026323 - DNA, 22 bp, Artificial Sequence
  chemically synthesized
ctgggttcaggagattcttctg

SEQ ID NO: 1026324 - DNA, 22 bp, Artificial Sequence
  chemically synthesized
gggaggctgaggcagaagaatc

SEQ ID NO: 1026325 - DNA, 22 bp, Artificial Sequence
  chemically synthesized
ggttcaggagattcttctgcct

SEQ ID NO: 1026326 - DNA, 22 bp, Artificial Sequence
  chemically synthesized
cttgggaggctgaggcagaaga

SEQ ID NO: 1026327 - DNA, 22 bp, Artificial Sequence
  chemically synthesized
aggagattcttctgcctcagcc

SEQ ID NO: 1026328 - DNA, 22 bp, Artificial Sequence
  chemically synthesized
tagtcccagctacttgggaggc

SEQ ID NO: 1026329 - DNA, 22 bp, Artificial Sequence
  chemically synthesized
ttctgcctcagcctcccaagta

SEQ ID NO: 1026330 - DNA, 22 bp, Artificial Sequence
  chemically synthesized
ctgcctcagcctcccaagtagc

SEQ ID NO: 1026331 - DNA, 22 bp, Artificial Sequence
  chemically synthesized
tgcctcagcctcccaagtagct

SEQ ID NO: 1026332 - DNA, 22 bp, Artificial Sequence
  chemically synthesized
cctcagcctcccaagtagctgg

SEQ ID NO: 1026333 - DNA, 22 bp, Artificial Sequence
  chemically synthesized
agcctcccaagtagctgggact

SEQ ID NO: 1026334 - DNA, 22 bp, Artificial Sequence
  chemically synthesized
gtggtgcacgcctatagtccca

SEQ ID NO: 1026335 - DNA, 22 bp, Artificial Sequence
  chemically synthesized
ggtggtgcacgcctatagtccc

SEQ ID NO: 1026336 - DNA, 22 bp, Artificial Sequence
  chemically synthesized
ccaagtagctgggactataggc

SEQ ID NO: 1026337 - DNA, 22 bp, Artificial Sequence
  chemically synthesized
gccgggcttggtggtgcacgcc

SEQ ID NO: 1026338 - DNA, 22 bp, Artificial Sequence
  chemically synthesized
ggactataggcgtgcaccacca

SEQ ID NO: 1026339 - DNA, 22 bp, Artificial Sequence
  chemically synthesized
taggcgtgcaccaccaagcccg

SEQ ID NO: 1026340 - DNA, 22 bp, Artificial Sequence
  chemically synthesized
aaaatacaaaaattagccgggc

SEQ ID NO: 1026341 - DNA, 22 bp, Artificial Sequence
  chemically synthesized
ctaaaaatacaaaaattagccg

SEQ ID NO: 1026342 - DNA, 22 bp, Artificial Sequence
  chemically synthesized
tactaaaaatacaaaaattagc

SEQ ID NO: 1026343 - DNA, 22 bp, Artificial Sequence
  chemically synthesized
tctctactaaaaatacaaaaat

SEQ ID NO: 1026344 - DNA, 22 bp, Artificial Sequence
  chemically synthesized
atttttgtatttttagtagaga

SEQ ID NO: 1026345 - DNA, 22 bp, Artificial Sequence
  chemically synthesized
ttgtatttttagtagagacagg

SEQ ID NO: 1026346 - DNA, 22 bp, Artificial Sequence
  chemically synthesized
tgtatttttagtagagacaggg

SEQ ID NO: 1026347 - DNA, 22 bp, Artificial Sequence
  chemically synthesized
gtatttttagtagagacagggt

SEQ ID NO: 1026348 - DNA, 22 bp, Artificial Sequence
  chemically synthesized
tatttttagtagagacagggtt

SEQ ID NO: 1026349 - DNA, 22 bp, Artificial Sequence
  chemically synthesized
gccaatatggtgaaaccctgtc

SEQ ID NO: 1026350 - DNA, 22 bp, Artificial Sequence
  chemically synthesized
ttagtagagacagggtttcacc

SEQ ID NO: 1026351 - DNA, 22 bp, Artificial Sequence
  chemically synthesized
tagtagagacagggtttcacca

SEQ ID NO: 1026352 - DNA, 22 bp, Artificial Sequence
  chemically synthesized
agtagagacagggtttcaccat

SEQ ID NO: 1026353 - DNA, 22 bp, Artificial Sequence
  chemically synthesized
gtagagacagggtttcaccata

SEQ ID NO: 1026354 - DNA, 22 bp, Artificial Sequence
  chemically synthesized
gaaaacagcctagccaatatgg

SEQ ID NO: 1026355 - DNA, 22 bp, Artificial Sequence
  chemically synthesized
caccatattggctaggctgttt

SEQ ID NO: 1026356 - DNA, 22 bp, Artificial Sequence
  chemically synthesized
accatattggctaggctgtttt

SEQ ID NO: 1026357 - DNA, 22 bp, Artificial Sequence
  chemically synthesized
tgaggtcaggagttcgaaaaca

SEQ ID NO: 1026358 - DNA, 22 bp, Artificial Sequence
  chemically synthesized
gctaggctgttttcgaactcct

SEQ ID NO: 1026359 - DNA, 22 bp, Artificial Sequence
  chemically synthesized
ggctgttttcgaactcctgacc

SEQ ID NO: 1026360 - DNA, 22 bp, Artificial Sequence
  chemically synthesized
ttttcgaactcctgacctcata

SEQ ID NO: 1026361 - DNA, 22 bp, Artificial Sequence
  chemically synthesized
agacgggcagattatgaggtca

SEQ ID NO: 1026362 - DNA, 22 bp, Artificial Sequence
  chemically synthesized
tcgaactcctgacctcataatc

SEQ ID NO: 1026363 - DNA, 22 bp, Artificial Sequence
  chemically synthesized
cgaactcctgacctcataatct

SEQ ID NO: 1026364 - DNA, 22 bp, Artificial Sequence
  chemically synthesized
gaactcctgacctcataatctg

SEQ ID NO: 1026365 - DNA, 22 bp, Artificial Sequence
  chemically synthesized
ggaggctgagacgggcagatta

SEQ ID NO: 1026366 - DNA, 22 bp, Artificial Sequence
  chemically synthesized
gggaggctgagacgggcagatt

SEQ ID NO: 1026367 - DNA, 22 bp, Artificial Sequence
  chemically synthesized
tgggaggctgagacgggcagat

SEQ ID NO: 1026368 - DNA, 22 bp, Artificial Sequence
  chemically synthesized
ctgacctcataatctgcccgtc

SEQ ID NO: 1026369 - DNA, 22 bp, Artificial Sequence
  chemically synthesized
acctcataatctgcccgtctca

SEQ ID NO: 1026370 - DNA, 22 bp, Artificial Sequence
  chemically synthesized
ataatctgcccgtctcagcctc

SEQ ID NO: 1026371 - DNA, 22 bp, Artificial Sequence
  chemically synthesized
taatcgcagcactttgggaggc

SEQ ID NO: 1026372 - DNA, 22 bp, Artificial Sequence
  chemically synthesized
cccgtctcagcctcccaaagtg

SEQ ID NO: 1026373 - DNA, 22 bp, Artificial Sequence
  chemically synthesized
acgcctgtaatcgcagcacttt

SEQ ID NO: 1026374 - DNA, 22 bp, Artificial Sequence
  chemically synthesized
agcctcccaaagtgctgcgatt

SEQ ID NO: 1026375 - DNA, 22 bp, Artificial Sequence
  chemically synthesized
ccaaagtgctgcgattacaggc

SEQ ID NO: 1026376 - DNA, 22 bp, Artificial Sequence
  chemically synthesized
accaggcgtggtggctcacgcc

SEQ ID NO: 1026377 - DNA, 22 bp, Artificial Sequence
  chemically synthesized
cgattacaggcgtgagccacca

SEQ ID NO: 1026378 - DNA, 22 bp, Artificial Sequence
  chemically synthesized
caggcgtgagccaccacgcctg

SEQ ID NO: 1026379 - DNA, 22 bp, Artificial Sequence
  chemically synthesized
tgtaagacaaaatcaattgacc

SEQ ID NO: 1026380 - DNA, 22 bp, Artificial Sequence
  chemically synthesized
gtcaattgattttgtcttacac

SEQ ID NO: 1026381 - DNA, 22 bp, Artificial Sequence
  chemically synthesized
attttgtcttacacaattttct

SEQ ID NO: 1026382 - DNA, 22 bp, Artificial Sequence
  chemically synthesized
tgtcttacacaattttctcttc

SEQ ID NO: 1026383 - DNA, 22 bp, Artificial Sequence
  chemically synthesized
gtcttacacaattttctcttct

SEQ ID NO: 1026384 - DNA, 22 bp, Artificial Sequence
  chemically synthesized
tcttacacaattttctcttctg

SEQ ID NO: 1026385 - DNA, 22 bp, Artificial Sequence
  chemically synthesized
acacaattttctcttctgggca

SEQ ID NO: 1026386 - DNA, 22 bp, Artificial Sequence
  chemically synthesized
cacaattttctcttctgggcat

SEQ ID NO: 1026387 - DNA, 22 bp, Artificial Sequence
  chemically synthesized
tctcttctgggcatcactatcg

SEQ ID NO: 1026388 - DNA, 22 bp, Artificial Sequence
  chemically synthesized
ctcttctgggcatcactatcgt

SEQ ID NO: 1026389 - DNA, 22 bp, Artificial Sequence
  chemically synthesized
tcttctgggcatcactatcgtt

SEQ ID NO: 1026390 - DNA, 22 bp, Artificial Sequence
  chemically synthesized
ttctgggcatcactatcgttca

SEQ ID NO: 1026391 - DNA, 22 bp, Artificial Sequence
  chemically synthesized
ctgggcatcactatcgttcatc

SEQ ID NO: 1026392 - DNA, 22 bp, Artificial Sequence
  chemically synthesized
tgggcatcactatcgttcatcc

SEQ ID NO: 1026393 - DNA, 22 bp, Artificial Sequence
  chemically synthesized
ggcatcactatcgttcatcctc

SEQ ID NO: 1026394 - DNA, 22 bp, Artificial Sequence
  chemically synthesized
aacatagaggaaaaagaagatg

SEQ ID NO: 1026395 - DNA, 22 bp, Artificial Sequence
  chemically synthesized
tcgttcatcctcatcttctttt

SEQ ID NO: 1026396 - DNA, 22 bp, Artificial Sequence
  chemically synthesized
aaacatagaggaaaaagaagat

SEQ ID NO: 1026397 - DNA, 22 bp, Artificial Sequence
  chemically synthesized
taaacatagaggaaaaagaaga

SEQ ID NO: 1026398 - DNA, 22 bp, Artificial Sequence
  chemically synthesized
ttaaacatagaggaaaaagaag

SEQ ID NO: 1026399 - DNA, 22 bp, Artificial Sequence
  chemically synthesized
atcctcatcttctttttcctct

SEQ ID NO: 1026400 - DNA, 22 bp, Artificial Sequence
  chemically synthesized
atttttaaacatagaggaaaaa

SEQ ID NO: 1026401 - DNA, 22 bp, Artificial Sequence
  chemically synthesized
catttttaaacatagaggaaaa

SEQ ID NO: 1026402 - DNA, 22 bp, Artificial Sequence
  chemically synthesized
tcatttttaaacatagaggaaa

SEQ ID NO: 1026403 - DNA, 22 bp, Artificial Sequence
  chemically synthesized
atcttctttttcctctatgttt

SEQ ID NO: 1026404 - DNA, 22 bp, Artificial Sequence
  chemically synthesized
ctttttcctctatgtttaaaaa

SEQ ID NO: 1026405 - DNA, 22 bp, Artificial Sequence
  chemically synthesized
tttttcctctatgtttaaaaat

SEQ ID NO: 1026406 - DNA, 22 bp, Artificial Sequence
  chemically synthesized
cagaagagttttcatttttaaa

SEQ ID NO: 1026407 - DNA, 22 bp, Artificial Sequence
  chemically synthesized
tttcctctatgtttaaaaatga

SEQ ID NO: 1026408 - DNA, 22 bp, Artificial Sequence
  chemically synthesized
gcagaagagttttcatttttaa

SEQ ID NO: 1026409 - DNA, 22 bp, Artificial Sequence
  chemically synthesized
ttcctctatgtttaaaaatgaa

SEQ ID NO: 1026410 - DNA, 22 bp, Artificial Sequence
  chemically synthesized
tgcagaagagttttcattttta

SEQ ID NO: 1026411 - DNA, 22 bp, Artificial Sequence
  chemically synthesized
tcctctatgtttaaaaatgaaa

SEQ ID NO: 1026412 - DNA, 22 bp, Artificial Sequence
  chemically synthesized
ttgcagaagagttttcattttt

SEQ ID NO: 1026413 - DNA, 22 bp, Artificial Sequence
  chemically synthesized
cctctatgtttaaaaatgaaaa

SEQ ID NO: 1026414 - DNA, 22 bp, Artificial Sequence
  chemically synthesized
ctctatgtttaaaaatgaaaac

SEQ ID NO: 1026415 - DNA, 22 bp, Artificial Sequence
  chemically synthesized
ttttgcagaagagttttcattt

SEQ ID NO: 1026416 - DNA, 22 bp, Artificial Sequence
  chemically synthesized
tatgtttaaaaatgaaaactct

SEQ ID NO: 1026417 - DNA, 22 bp, Artificial Sequence
  chemically synthesized
tgtttaaaaatgaaaactcttc

SEQ ID NO: 1026418 - DNA, 22 bp, Artificial Sequence
  chemically synthesized
ataaactcttttgcagaagagt

SEQ ID NO: 1026419 - DNA, 22 bp, Artificial Sequence
  chemically synthesized
aataaactcttttgcagaagag

SEQ ID NO: 1026420 - DNA, 22 bp, Artificial Sequence
  chemically synthesized
aaaaatgaaaactcttctgcaa

SEQ ID NO: 1026421 - DNA, 22 bp, Artificial Sequence
  chemically synthesized
taataaactcttttgcagaaga

SEQ ID NO: 1026422 - DNA, 22 bp, Artificial Sequence
  chemically synthesized
aaaatgaaaactcttctgcaaa

SEQ ID NO: 1026423 - DNA, 22 bp, Artificial Sequence
  chemically synthesized
ttctgcaaaagagtttattaaa

SEQ ID NO: 1026424 - DNA, 22 bp, Artificial Sequence
  chemically synthesized
ctgcaaaagagtttattaaagc

SEQ ID NO: 1026425 - DNA, 22 bp, Artificial Sequence
  chemically synthesized
tgcaaaagagtttattaaagct

SEQ ID NO: 1026426 - DNA, 22 bp, Artificial Sequence
  chemically synthesized
caaaagagtttattaaagctta

SEQ ID NO: 1026427 - DNA, 22 bp, Artificial Sequence
  chemically synthesized
aaaaacaaacaaagaataaata

SEQ ID NO: 1026428 - DNA, 22 bp, Artificial Sequence
  chemically synthesized
attaaagcttatttattctttg

SEQ ID NO: 1026429 - DNA, 22 bp, Artificial Sequence
  chemically synthesized
ttaaagcttatttattctttgt

SEQ ID NO: 1026430 - DNA, 22 bp, Artificial Sequence
  chemically synthesized
tctcaaaaacaaacaaagaata

SEQ ID NO: 1026431 - DNA, 22 bp, Artificial Sequence
  chemically synthesized
tgtctcaaaaacaaacaaagaa

SEQ ID NO: 1026432 - DNA, 22 bp, Artificial Sequence
  chemically synthesized
aagcttatttattctttgtttg

SEQ ID NO: 1026433 - DNA, 22 bp, Artificial Sequence
  chemically synthesized
atttattctttgtttgtttttg

SEQ ID NO: 1026434 - DNA, 22 bp, Artificial Sequence
  chemically synthesized
tttattctttgtttgtttttga

SEQ ID NO: 1026435 - DNA, 22 bp, Artificial Sequence
  chemically synthesized
attctttgtttgtttttgagac

SEQ ID NO: 1026436 - DNA, 22 bp, Artificial Sequence
  chemically synthesized
ttctttgtttgtttttgagaca

SEQ ID NO: 1026437 - DNA, 22 bp, Artificial Sequence
  chemically synthesized
tttgtttgtttttgagacagag

SEQ ID NO: 1026438 - DNA, 22 bp, Artificial Sequence
  chemically synthesized
tgtttgtttttgagacagagtc

SEQ ID NO: 1026439 - DNA, 22 bp, Artificial Sequence
  chemically synthesized
gtttgtttttgagacagagtct

SEQ ID NO: 1026440 - DNA, 22 bp, Artificial Sequence
  chemically synthesized
ggcaacagagcaagactctgtc

SEQ ID NO: 1026441 - DNA, 22 bp, Artificial Sequence
  chemically synthesized
tttgtttttgagacagagtctt

SEQ ID NO: 1026442 - DNA, 22 bp, Artificial Sequence
  chemically synthesized
gtttttgagacagagtcttgct

SEQ ID NO: 1026443 - DNA, 22 bp, Artificial Sequence
  chemically synthesized
tttttgagacagagtcttgctc

SEQ ID NO: 1026444 - DNA, 22 bp, Artificial Sequence
  chemically synthesized
cagcctgggcaacagagcaaga

SEQ ID NO: 1026445 - DNA, 22 bp, Artificial Sequence
  chemically synthesized
ttgagacagagtcttgctctgt

SEQ ID NO: 1026446 - DNA, 22 bp, Artificial Sequence
  chemically synthesized
tgagacagagtcttgctctgtt

SEQ ID NO: 1026447 - DNA, 22 bp, Artificial Sequence
  chemically synthesized
gagacagagtcttgctctgttg

SEQ ID NO: 1026448 - DNA, 22 bp, Artificial Sequence
  chemically synthesized
agacagagtcttgctctgttgc

SEQ ID NO: 1026449 - DNA, 22 bp, Artificial Sequence
  chemically synthesized
ccctccagcctgggcaacagag

SEQ ID NO: 1026450 - DNA, 22 bp, Artificial Sequence
  chemically synthesized
gctctgttgcccaggctggagg

SEQ ID NO: 1026451 - DNA, 22 bp, Artificial Sequence
  chemically synthesized
ctctgttgcccaggctggaggg

SEQ ID NO: 1026452 - DNA, 22 bp, Artificial Sequence
  chemically synthesized
agatcatgccactgccctccag

SEQ ID NO: 1026453 - DNA, 22 bp, Artificial Sequence
  chemically synthesized
tgttgcccaggctggagggcag

SEQ ID NO: 1026454 - DNA, 22 bp, Artificial Sequence
  chemically synthesized
ttgcccaggctggagggcagtg

SEQ ID NO: 1026455 - DNA, 22 bp, Artificial Sequence
  chemically synthesized
cccaggctggagggcagtggca

SEQ ID NO: 1026456 - DNA, 22 bp, Artificial Sequence
  chemically synthesized
cagtgagctaagatcatgccac

SEQ ID NO: 1026457 - DNA, 22 bp, Artificial Sequence
  chemically synthesized
gagggcagtggcatgatcttag

SEQ ID NO: 1026458 - DNA, 22 bp, Artificial Sequence
  chemically synthesized
gaacccaggaggcggaggttgc

SEQ ID NO: 1026459 - DNA, 22 bp, Artificial Sequence
  chemically synthesized
agctcactgcaacctccgcctc

SEQ ID NO: 1026460 - DNA, 22 bp, Artificial Sequence
  chemically synthesized
gctcactgcaacctccgcctcc

SEQ ID NO: 1026461 - DNA, 22 bp, Artificial Sequence
  chemically synthesized
actgcaacctccgcctcctggg

SEQ ID NO: 1026462 - DNA, 22 bp, Artificial Sequence
  chemically synthesized
caacctccgcctcctgggttcc

SEQ ID NO: 1026463 - DNA, 22 bp, Artificial Sequence
  chemically synthesized
aggcaggagaatcactggaacc

SEQ ID NO: 1026464 - DNA, 22 bp, Artificial Sequence
  chemically synthesized
cgcctcctgggttccagtgatt

SEQ ID NO: 1026465 - DNA, 22 bp, Artificial Sequence
  chemically synthesized
ggaggctgaggcaggagaatca

SEQ ID NO: 1026466 - DNA, 22 bp, Artificial Sequence
  chemically synthesized
ctgggttccagtgattctcctg

SEQ ID NO: 1026467 - DNA, 22 bp, Artificial Sequence
  chemically synthesized
gggaggctgaggcaggagaatc

SEQ ID NO: 1026468 - DNA, 22 bp, Artificial Sequence
  chemically synthesized
ggttccagtgattctcctgcct

SEQ ID NO: 1026469 - DNA, 22 bp, Artificial Sequence
  chemically synthesized
cttgggaggctgaggcaggaga

SEQ ID NO: 1026470 - DNA, 22 bp, Artificial Sequence
  chemically synthesized
cagtgattctcctgcctcagcc

SEQ ID NO: 1026471 - DNA, 22 bp, Artificial Sequence
  chemically synthesized
taatcccagctacttgggaggc

SEQ ID NO: 1026472 - DNA, 22 bp, Artificial Sequence
  chemically synthesized
gtaatcccagctacttgggagg

SEQ ID NO: 1026473 - DNA, 22 bp, Artificial Sequence
  chemically synthesized
tcctgcctcagcctcccaagta

SEQ ID NO: 1026474 - DNA, 22 bp, Artificial Sequence
  chemically synthesized
ctgcctcagcctcccaagtagc

SEQ ID NO: 1026475 - DNA, 22 bp, Artificial Sequence
  chemically synthesized
cctcagcctcccaagtagctgg

SEQ ID NO: 1026476 - DNA, 22 bp, Artificial Sequence
  chemically synthesized
agcctcccaagtagctgggatt

SEQ ID NO: 1026477 - DNA, 22 bp, Artificial Sequence
  chemically synthesized
gcgcatgcttgtaatcccagct

SEQ ID NO: 1026478 - DNA, 22 bp, Artificial Sequence
  chemically synthesized
ccaagtagctgggattacaagc

SEQ ID NO: 1026479 - DNA, 22 bp, Artificial Sequence
  chemically synthesized
gccaggcgtgttggcgcatgct

SEQ ID NO: 1026480 - DNA, 22 bp, Artificial Sequence
  chemically synthesized
ggattacaagcatgcgccaaca

SEQ ID NO: 1026481 - DNA, 22 bp, Artificial Sequence
  chemically synthesized
caagcatgcgccaacacgcctg

SEQ ID NO: 1026482 - DNA, 22 bp, Artificial Sequence
  chemically synthesized
aaaatacaaaaattggccaggc

SEQ ID NO: 1026483 - DNA, 22 bp, Artificial Sequence
  chemically synthesized
ctaaaaatacaaaaattggcca

SEQ ID NO: 1026484 - DNA, 22 bp, Artificial Sequence
  chemically synthesized
tgctaaaaatacaaaaattggc

SEQ ID NO: 1026485 - DNA, 22 bp, Artificial Sequence
  chemically synthesized
gccaatttttgtatttttagca

SEQ ID NO: 1026486 - DNA, 22 bp, Artificial Sequence
  chemically synthesized
ttgtatttttagcagagatggg

SEQ ID NO: 1026487 - DNA, 22 bp, Artificial Sequence
  chemically synthesized
tgtatttttagcagagatgggg

SEQ ID NO: 1026488 - DNA, 22 bp, Artificial Sequence
  chemically synthesized
gtatttttagcagagatggggt

SEQ ID NO: 1026489 - DNA, 22 bp, Artificial Sequence
  chemically synthesized
tatttttagcagagatggggtt

SEQ ID NO: 1026490 - DNA, 22 bp, Artificial Sequence
  chemically synthesized
ttagcagagatggggtttcacc

SEQ ID NO: 1026491 - DNA, 22 bp, Artificial Sequence
  chemically synthesized
tagcagagatggggtttcacca

SEQ ID NO: 1026492 - DNA, 22 bp, Artificial Sequence
  chemically synthesized
agcagagatggggtttcaccat

SEQ ID NO: 1026493 - DNA, 22 bp, Artificial Sequence
  chemically synthesized
gcagagatggggtttcaccatg

SEQ ID NO: 1026494 - DNA, 22 bp, Artificial Sequence
  chemically synthesized
gagtccagcccagccaacatgg

SEQ ID NO: 1026495 - DNA, 22 bp, Artificial Sequence
  chemically synthesized
caccatgttggctgggctggac

SEQ ID NO: 1026496 - DNA, 22 bp, Artificial Sequence
  chemically synthesized
accatgttggctgggctggact

SEQ ID NO: 1026497 - DNA, 22 bp, Artificial Sequence
  chemically synthesized
aggccaggagttagagtccagc

SEQ ID NO: 1026498 - DNA, 22 bp, Artificial Sequence
  chemically synthesized
gaggccaggagttagagtccag

SEQ ID NO: 1026499 - DNA, 22 bp, Artificial Sequence
  chemically synthesized
gctgggctggactctaactcct

SEQ ID NO: 1026500 - DNA, 22 bp, Artificial Sequence
  chemically synthesized
ggctggactctaactcctggcc

SEQ ID NO: 1026501 - DNA, 22 bp, Artificial Sequence
  chemically synthesized
gactctaactcctggcctcaag

SEQ ID NO: 1026502 - DNA, 22 bp, Artificial Sequence
  chemically synthesized
taactcctggcctcaagtgatc

SEQ ID NO: 1026503 - DNA, 22 bp, Artificial Sequence
  chemically synthesized
actcctggcctcaagtgatctg

SEQ ID NO: 1026504 - DNA, 22 bp, Artificial Sequence
  chemically synthesized
agaggccgaggtgggcagatca

SEQ ID NO: 1026505 - DNA, 22 bp, Artificial Sequence
  chemically synthesized
ctggcctcaagtgatctgccca

SEQ ID NO: 1026506 - DNA, 22 bp, Artificial Sequence
  chemically synthesized
gagaggccgaggtgggcagatc

SEQ ID NO: 1026507 - DNA, 22 bp, Artificial Sequence
  chemically synthesized
gcctcaagtgatctgcccacct

SEQ ID NO: 1026508 - DNA, 22 bp, Artificial Sequence
  chemically synthesized
aagtgatctgcccacctcggcc

SEQ ID NO: 1026509 - DNA, 22 bp, Artificial Sequence
  chemically synthesized
taatcccagcaatttgagaggc

SEQ ID NO: 1026510 - DNA, 22 bp, Artificial Sequence
  chemically synthesized
cccacctcggcctctcaaattg

SEQ ID NO: 1026511 - DNA, 22 bp, Artificial Sequence
  chemically synthesized
gcctgtaatcccagcaatttga

SEQ ID NO: 1026512 - DNA, 22 bp, Artificial Sequence
  chemically synthesized
tcgcctgtaatcccagcaattt

SEQ ID NO: 1026513 - DNA, 22 bp, Artificial Sequence
  chemically synthesized
ggcctctcaaattgctgggatt

SEQ ID NO: 1026514 - DNA, 22 bp, Artificial Sequence
  chemically synthesized
tcaaattgctgggattacaggc

SEQ ID NO: 1026515 - DNA, 22 bp, Artificial Sequence
  chemically synthesized
aaattgctgggattacaggcga

SEQ ID NO: 1026516 - DNA, 22 bp, Artificial Sequence
  chemically synthesized
ctgggattacaggcgagagcca

SEQ ID NO: 1026517 - DNA, 22 bp, Artificial Sequence
  chemically synthesized
ggattacaggcgagagccacca

SEQ ID NO: 1026518 - DNA, 22 bp, Artificial Sequence
  chemically synthesized
caggcgagagccaccacacctg

SEQ ID NO: 1026519 - DNA, 22 bp, Artificial Sequence
  chemically synthesized
tataaaacaaaaaagaataggc

SEQ ID NO: 1026520 - DNA, 22 bp, Artificial Sequence
  chemically synthesized
atataaaacaaaaaagaatagg

SEQ ID NO: 1026521 - DNA, 22 bp, Artificial Sequence
  chemically synthesized
ttatataaaacaaaaaagaata

SEQ ID NO: 1026522 - DNA, 22 bp, Artificial Sequence
  chemically synthesized
cttatataaaacaaaaaagaat

SEQ ID NO: 1026523 - DNA, 22 bp, Artificial Sequence
  chemically synthesized
cacttcttatataaaacaaaaa

SEQ ID NO: 1026524 - DNA, 22 bp, Artificial Sequence
  chemically synthesized
gcctattcttttttgttttata

SEQ ID NO: 1026525 - DNA, 22 bp, Artificial Sequence
  chemically synthesized
tatgctacacttcttatataaa

SEQ ID NO: 1026526 - DNA, 22 bp, Artificial Sequence
  chemically synthesized
ttcttttttgttttatataaga

SEQ ID NO: 1026527 - DNA, 22 bp, Artificial Sequence
  chemically synthesized
ttatatgctacacttcttatat

SEQ ID NO: 1026528 - DNA, 22 bp, Artificial Sequence
  chemically synthesized
ttttttgttttatataagaagt

SEQ ID NO: 1026529 - DNA, 22 bp, Artificial Sequence
  chemically synthesized
ttttgttttatataagaagtgt

SEQ ID NO: 1026530 - DNA, 22 bp, Artificial Sequence
  chemically synthesized
tttgttttatataagaagtgta

SEQ ID NO: 1026531 - DNA, 22 bp, Artificial Sequence
  chemically synthesized
ttgttttatataagaagtgtag

SEQ ID NO: 1026532 - DNA, 22 bp, Artificial Sequence
  chemically synthesized
tgttttatataagaagtgtagc

SEQ ID NO: 1026533 - DNA, 22 bp, Artificial Sequence
  chemically synthesized
gttttatataagaagtgtagca

SEQ ID NO: 1026534 - DNA, 22 bp, Artificial Sequence
  chemically synthesized
ttttatataagaagtgtagcat

SEQ ID NO: 1026535 - DNA, 22 bp, Artificial Sequence
  chemically synthesized
tatataagaagtgtagcatata

SEQ ID NO: 1026536 - DNA, 22 bp, Artificial Sequence
  chemically synthesized
atataagaagtgtagcatataa

SEQ ID NO: 1026537 - DNA, 22 bp, Artificial Sequence
  chemically synthesized
tataagaagtgtagcatataat

SEQ ID NO: 1026538 - DNA, 22 bp, Artificial Sequence
  chemically synthesized
ccacaccaccacacattattat

SEQ ID NO: 1026539 - DNA, 22 bp, Artificial Sequence
  chemically synthesized
taccacaccaccacacattatt

SEQ ID NO: 1026540 - DNA, 22 bp, Artificial Sequence
  chemically synthesized
tctctaccacaccaccacacat

SEQ ID NO: 1026541 - DNA, 22 bp, Artificial Sequence
  chemically synthesized
atctctaccacaccaccacaca

SEQ ID NO: 1026542 - DNA, 22 bp, Artificial Sequence
  chemically synthesized
ttatctctaccacaccaccaca

SEQ ID NO: 1026543 - DNA, 22 bp, Artificial Sequence
  chemically synthesized
cttatctctaccacaccaccac

SEQ ID NO: 1026544 - DNA, 22 bp, Artificial Sequence
  chemically synthesized
aaaaaccacttcttatctctac

SEQ ID NO: 1026545 - DNA, 22 bp, Artificial Sequence
  chemically synthesized
caaaaaccacttcttatctcta

SEQ ID NO: 1026546 - DNA, 22 bp, Artificial Sequence
  chemically synthesized
tcaaaaaccacttcttatctct

SEQ ID NO: 1026547 - DNA, 22 bp, Artificial Sequence
  chemically synthesized
ttcaaaaaccacttcttatctc

SEQ ID NO: 1026548 - DNA, 22 bp, Artificial Sequence
  chemically synthesized
cttttcaaaaaccacttcttat

SEQ ID NO: 1026549 - DNA, 22 bp, Artificial Sequence
  chemically synthesized
ccttttcaaaaaccacttctta

SEQ ID NO: 1026550 - DNA, 22 bp, Artificial Sequence
  chemically synthesized
tccttttcaaaaaccacttctt

SEQ ID NO: 1026551 - DNA, 22 bp, Artificial Sequence
  chemically synthesized
ttgaaaaggaaaatgatcacat

SEQ ID NO: 1026552 - DNA, 22 bp, Artificial Sequence
  chemically synthesized
tgaaaaggaaaatgatcacata

SEQ ID NO: 1026553 - DNA, 22 bp, Artificial Sequence
  chemically synthesized
gaaaaggaaaatgatcacatat

SEQ ID NO: 1026554 - DNA, 22 bp, Artificial Sequence
  chemically synthesized
aaaaggaaaatgatcacatata

SEQ ID NO: 1026555 - DNA, 22 bp, Artificial Sequence
  chemically synthesized
gcaagtgaataatgtatatgtg

SEQ ID NO: 1026556 - DNA, 22 bp, Artificial Sequence
  chemically synthesized
ttcacttgctagttatgcttac

SEQ ID NO: 1026557 - DNA, 22 bp, Artificial Sequence
  chemically synthesized
acttgctagttatgcttactgg

SEQ ID NO: 1026558 - DNA, 22 bp, Artificial Sequence
  chemically synthesized
gccaagtagatacccagtaagc

SEQ ID NO: 1026559 - DNA, 22 bp, Artificial Sequence
  chemically synthesized
ggccaagtagatacccagtaag

SEQ ID NO: 1026560 - DNA, 22 bp, Artificial Sequence
  chemically synthesized
gctagttatgcttactgggtat

SEQ ID NO: 1026561 - DNA, 22 bp, Artificial Sequence
  chemically synthesized
ctagttatgcttactgggtatc

SEQ ID NO: 1026562 - DNA, 22 bp, Artificial Sequence
  chemically synthesized
tttggccaagtagatacccagt

SEQ ID NO: 1026563 - DNA, 22 bp, Artificial Sequence
  chemically synthesized
gttatgcttactgggtatctac

SEQ ID NO: 1026564 - DNA, 22 bp, Artificial Sequence
  chemically synthesized
attgtttggccaagtagatacc

SEQ ID NO: 1026565 - DNA, 22 bp, Artificial Sequence
  chemically synthesized
tgcttactgggtatctacttgg

SEQ ID NO: 1026566 - DNA, 22 bp, Artificial Sequence
  chemically synthesized
attcattgtttggccaagtaga

SEQ ID NO: 1026567 - DNA, 22 bp, Artificial Sequence
  chemically synthesized
gattcattgtttggccaagtag

SEQ ID NO: 1026568 - DNA, 22 bp, Artificial Sequence
  chemically synthesized
actgggtatctacttggccaaa

SEQ ID NO: 1026569 - DNA, 22 bp, Artificial Sequence
  chemically synthesized
cttgattcattgtttggccaag

SEQ ID NO: 1026570 - DNA, 22 bp, Artificial Sequence
  chemically synthesized
ctgggtatctacttggccaaac

SEQ ID NO: 1026571 - DNA, 22 bp, Artificial Sequence
  chemically synthesized
ggtatctacttggccaaacaat

SEQ ID NO: 1026572 - DNA, 22 bp, Artificial Sequence
  chemically synthesized
gttacttgattcattgtttggc

SEQ ID NO: 1026573 - DNA, 22 bp, Artificial Sequence
  chemically synthesized
cgttacttgattcattgtttgg

SEQ ID NO: 1026574 - DNA, 22 bp, Artificial Sequence
  chemically synthesized
tcgttacttgattcattgtttg

SEQ ID NO: 1026575 - DNA, 22 bp, Artificial Sequence
  chemically synthesized
cattttcgttacttgattcatt

SEQ ID NO: 1026576 - DNA, 22 bp, Artificial Sequence
  chemically synthesized
cttggccaaacaatgaatcaag

SEQ ID NO: 1026577 - DNA, 22 bp, Artificial Sequence
  chemically synthesized
ggccaaacaatgaatcaagtaa

SEQ ID NO: 1026578 - DNA, 22 bp, Artificial Sequence
  chemically synthesized
gccaaacaatgaatcaagtaac

SEQ ID NO: 1026579 - DNA, 22 bp, Artificial Sequence
  chemically synthesized
gaatgacagttacattttcgtt

SEQ ID NO: 1026580 - DNA, 22 bp, Artificial Sequence
  chemically synthesized
agaatgacagttacattttcgt

SEQ ID NO: 1026581 - DNA, 22 bp, Artificial Sequence
  chemically synthesized
tagaatgacagttacattttcg

SEQ ID NO: 1026582 - DNA, 22 bp, Artificial Sequence
  chemically synthesized
tttagaatgacagttacatttt

SEQ ID NO: 1026583 - DNA, 22 bp, Artificial Sequence
  chemically synthesized
ctttagaatgacagttacattt

SEQ ID NO: 1026584 - DNA, 22 bp, Artificial Sequence
  chemically synthesized
tgaacttctttagaatgacagt

SEQ ID NO: 1026585 - DNA, 22 bp, Artificial Sequence
  chemically synthesized
tcattctaaagaagttcacagt

SEQ ID NO: 1026586 - DNA, 22 bp, Artificial Sequence
  chemically synthesized
taaagaagttcacagtgtgtat

SEQ ID NO: 1026587 - DNA, 22 bp, Artificial Sequence
  chemically synthesized
aagaagttcacagtgtgtatgt

SEQ ID NO: 1026588 - DNA, 22 bp, Artificial Sequence
  chemically synthesized
tacatgtacaaacaacatacac

SEQ ID NO: 1026589 - DNA, 22 bp, Artificial Sequence
  chemically synthesized
tgtacatgtacaaacaacatac

SEQ ID NO: 1026590 - DNA, 22 bp, Artificial Sequence
  chemically synthesized
acagtgtgtatgttgtttgtac

SEQ ID NO: 1026591 - DNA, 22 bp, Artificial Sequence
  chemically synthesized
tgactctgtacatgtacaaaca

SEQ ID NO: 1026592 - DNA, 22 bp, Artificial Sequence
  chemically synthesized
tatgactctgtacatgtacaaa

SEQ ID NO: 1026593 - DNA, 22 bp, Artificial Sequence
  chemically synthesized
acctctatgactctgtacatgt

SEQ ID NO: 1026594 - DNA, 22 bp, Artificial Sequence
  chemically synthesized
tcacctctatgactctgtacat

SEQ ID NO: 1026595 - DNA, 22 bp, Artificial Sequence
  chemically synthesized
tctcacctctatgactctgtac

SEQ ID NO: 1026596 - DNA, 22 bp, Artificial Sequence
  chemically synthesized
tttgtacatgtacagagtcata

SEQ ID NO: 1026597 - DNA, 22 bp, Artificial Sequence
  chemically synthesized
gtacatgtacagagtcatagag

SEQ ID NO: 1026598 - DNA, 22 bp, Artificial Sequence
  chemically synthesized
catctctctcacctctatgact

SEQ ID NO: 1026599 - DNA, 22 bp, Artificial Sequence
  chemically synthesized
tacatgtacagagtcatagagg

SEQ ID NO: 1026600 - DNA, 22 bp, Artificial Sequence
  chemically synthesized
tccatctctctcacctctatga

SEQ ID NO: 1026601 - DNA, 22 bp, Artificial Sequence
  chemically synthesized
ctccatctctctcacctctatg

SEQ ID NO: 1026602 - DNA, 22 bp, Artificial Sequence
  chemically synthesized
tctccatctctctcacctctat

SEQ ID NO: 1026603 - DNA, 22 bp, Artificial Sequence
  chemically synthesized
ttctccatctctctcacctcta

SEQ ID NO: 1026604 - DNA, 22 bp, Artificial Sequence
  chemically synthesized
aatcacttttctccatctctct

SEQ ID NO: 1026605 - DNA, 22 bp, Artificial Sequence
  chemically synthesized
ttaaatcacttttctccatctc

SEQ ID NO: 1026606 - DNA, 22 bp, Artificial Sequence
  chemically synthesized
attaaatcacttttctccatct

SEQ ID NO: 1026607 - DNA, 22 bp, Artificial Sequence
  chemically synthesized
cttattaaatcacttttctcca

SEQ ID NO: 1026608 - DNA, 22 bp, Artificial Sequence
  chemically synthesized
acttattaaatcacttttctcc

SEQ ID NO: 1026609 - DNA, 22 bp, Artificial Sequence
  chemically synthesized
tgtacttacttattaaatcact

SEQ ID NO: 1026610 - DNA, 22 bp, Artificial Sequence
  chemically synthesized
gtgtacttacttattaaatcac

SEQ ID NO: 1026611 - DNA, 22 bp, Artificial Sequence
  chemically synthesized
tttgtgtacttacttattaaat

SEQ ID NO: 1026612 - DNA, 22 bp, Artificial Sequence
  chemically synthesized
ttatttgtgtacttacttatta

SEQ ID NO: 1026613 - DNA, 22 bp, Artificial Sequence
  chemically synthesized
gttatttgtgtacttacttatt

SEQ ID NO: 1026614 - DNA, 22 bp, Artificial Sequence
  chemically synthesized
tttgttatttgtgtacttactt

SEQ ID NO: 1026615 - DNA, 22 bp, Artificial Sequence
  chemically synthesized
aataagtaagtacacaaataac

SEQ ID NO: 1026616 - DNA, 22 bp, Artificial Sequence
  chemically synthesized
ataagtaagtacacaaataaca

SEQ ID NO: 1026617 - DNA, 22 bp, Artificial Sequence
  chemically synthesized
tgaatcatgttatttgttattt

SEQ ID NO: 1026618 - DNA, 22 bp, Artificial Sequence
  chemically synthesized
acattatgaatcatgttatttg

SEQ ID NO: 1026619 - DNA, 22 bp, Artificial Sequence
  chemically synthesized
cacattatgaatcatgttattt

SEQ ID NO: 1026620 - DNA, 22 bp, Artificial Sequence
  chemically synthesized
tggatataaacacccttcacat

SEQ ID NO: 1026621 - DNA, 22 bp, Artificial Sequence
  chemically synthesized
cattgtggatataaacaccctt

SEQ ID NO: 1026622 - DNA, 22 bp, Artificial Sequence
  chemically synthesized
ccattgtggatataaacaccct

SEQ ID NO: 1026623 - DNA, 22 bp, Artificial Sequence
  chemically synthesized
ataatgtgaagggtgtttatat

SEQ ID NO: 1026624 - DNA, 22 bp, Artificial Sequence
  chemically synthesized
catttccattgtggatataaac

SEQ ID NO: 1026625 - DNA, 22 bp, Artificial Sequence
  chemically synthesized
ccatttccattgtggatataaa

SEQ ID NO: 1026626 - DNA, 22 bp, Artificial Sequence
  chemically synthesized
accaatttccatttccattgtg

SEQ ID NO: 1026627 - DNA, 22 bp, Artificial Sequence
  chemically synthesized
gtactcaccaatttccatttcc

SEQ ID NO: 1026628 - DNA, 22 bp, Artificial Sequence
  chemically synthesized
atatccacaatggaaatggaaa

SEQ ID NO: 1026629 - DNA, 22 bp, Artificial Sequence
  chemically synthesized
tatccacaatggaaatggaaat

SEQ ID NO: 1026630 - DNA, 22 bp, Artificial Sequence
  chemically synthesized
ataaaaattggtactcaccaat

SEQ ID NO: 1026631 - DNA, 22 bp, Artificial Sequence
  chemically synthesized
gtgagtaccaatttttattaga

SEQ ID NO: 1026632 - DNA, 22 bp, Artificial Sequence
  chemically synthesized
catgtaatgcaatggtgggtaa

SEQ ID NO: 1026633 - DNA, 22 bp, Artificial Sequence
  chemically synthesized
ttattagatgttacccaccatt

SEQ ID NO: 1026634 - DNA, 22 bp, Artificial Sequence
  chemically synthesized
tattagatgttacccaccattg

SEQ ID NO: 1026635 - DNA, 22 bp, Artificial Sequence
  chemically synthesized
attagatgttacccaccattgc

SEQ ID NO: 1026636 - DNA, 22 bp, Artificial Sequence
  chemically synthesized
ttagatgttacccaccattgca

SEQ ID NO: 1026637 - DNA, 22 bp, Artificial Sequence
  chemically synthesized
gatgttacccaccattgcatta

SEQ ID NO: 1026638 - DNA, 22 bp, Artificial Sequence
  chemically synthesized
agatggaacaattgcatgtaat

SEQ ID NO: 1026639 - DNA, 22 bp, Artificial Sequence
  chemically synthesized
cccaccattgcattacatgcaa

SEQ ID NO: 1026640 - DNA, 22 bp, Artificial Sequence
  chemically synthesized
atatggttaagatggaacaatt

SEQ ID NO: 1026641 - DNA, 22 bp, Artificial Sequence
  chemically synthesized
cattacatgcaattgttccatc

SEQ ID NO: 1026642 - DNA, 22 bp, Artificial Sequence
  chemically synthesized
catgcaattgttccatcttaac

SEQ ID NO: 1026643 - DNA, 22 bp, Artificial Sequence
  chemically synthesized
gtgcagctgatatggttaagat

SEQ ID NO: 1026644 - DNA, 22 bp, Artificial Sequence
  chemically synthesized
agtgcagctgatatggttaaga

SEQ ID NO: 1026645 - DNA, 22 bp, Artificial Sequence
  chemically synthesized
ttccatcttaaccatatcagct

SEQ ID NO: 1026646 - DNA, 22 bp, Artificial Sequence
  chemically synthesized
catcttaaccatatcagctgca

SEQ ID NO: 1026647 - DNA, 22 bp, Artificial Sequence
  chemically synthesized
aaccatatcagctgcactaaac

SEQ ID NO: 1026648 - DNA, 22 bp, Artificial Sequence
  chemically synthesized
accatatcagctgcactaaaca

SEQ ID NO: 1026649 - DNA, 22 bp, Artificial Sequence
  chemically synthesized
gtgagcagtaatgagccatgtt

SEQ ID NO: 1026650 - DNA, 22 bp, Artificial Sequence
  chemically synthesized
ttagtgagcagtaatgagccat

SEQ ID NO: 1026651 - DNA, 22 bp, Artificial Sequence
  chemically synthesized
ctattagtgagcagtaatgagc

SEQ ID NO: 1026652 - DNA, 22 bp, Artificial Sequence
  chemically synthesized
cactaaacatggctcattactg

SEQ ID NO: 1026653 - DNA, 22 bp, Artificial Sequence
  chemically synthesized
tattcctattagtgagcagtaa

SEQ ID NO: 1026654 - DNA, 22 bp, Artificial Sequence
  chemically synthesized
aacatggctcattactgctcac

SEQ ID NO: 1026655 - DNA, 22 bp, Artificial Sequence
  chemically synthesized
attactgctcactaataggaat

SEQ ID NO: 1026656 - DNA, 22 bp, Artificial Sequence
  chemically synthesized
atataaatctgtattcctatta

SEQ ID NO: 1026657 - DNA, 22 bp, Artificial Sequence
  chemically synthesized
ctgatataaatctgtattccta

SEQ ID NO: 1026658 - DNA, 22 bp, Artificial Sequence
  chemically synthesized
ctgctcactaataggaatacag

SEQ ID NO: 1026659 - DNA, 22 bp, Artificial Sequence
  chemically synthesized
ctcactaataggaatacagatt

SEQ ID NO: 1026660 - DNA, 22 bp, Artificial Sequence
  chemically synthesized
actaataggaatacagatttat

SEQ ID NO: 1026661 - DNA, 22 bp, Artificial Sequence
  chemically synthesized
ataggaatacagatttatatca

SEQ ID NO: 1026662 - DNA, 22 bp, Artificial Sequence
  chemically synthesized
atatcagcaatttgggcacatg

SEQ ID NO: 1026663 - DNA, 22 bp, Artificial Sequence
  chemically synthesized
tatcagcaatttgggcacatgg

SEQ ID NO: 1026664 - DNA, 22 bp, Artificial Sequence
  chemically synthesized
aaaaagacaagcccatgtgccc

SEQ ID NO: 1026665 - DNA, 22 bp, Artificial Sequence
  chemically synthesized
ccacagttaaaaaagacaagcc

SEQ ID NO: 1026666 - DNA, 22 bp, Artificial Sequence
  chemically synthesized
cccacagttaaaaaagacaagc

SEQ ID NO: 1026667 - DNA, 22 bp, Artificial Sequence
  chemically synthesized
tcccacagttaaaaaagacaag

SEQ ID NO: 1026668 - DNA, 22 bp, Artificial Sequence
  chemically synthesized
gggcacatgggcttgtcttttt

SEQ ID NO: 1026669 - DNA, 22 bp, Artificial Sequence
  chemically synthesized
ggcacatgggcttgtctttttt

SEQ ID NO: 1026670 - DNA, 22 bp, Artificial Sequence
  chemically synthesized
tatattttcccacagttaaaaa

SEQ ID NO: 1026671 - DNA, 22 bp, Artificial Sequence
  chemically synthesized
gtatattttcccacagttaaaa

SEQ ID NO: 1026672 - DNA, 22 bp, Artificial Sequence
  chemically synthesized
tgtatattttcccacagttaaa

SEQ ID NO: 1026673 - DNA, 22 bp, Artificial Sequence
  chemically synthesized
gtcttttttaactgtgggaaaa

SEQ ID NO: 1026674 - DNA, 22 bp, Artificial Sequence
  chemically synthesized
tcttttttaactgtgggaaaat

SEQ ID NO: 1026675 - DNA, 22 bp, Artificial Sequence
  chemically synthesized
aaatattttgtatattttccca

SEQ ID NO: 1026676 - DNA, 22 bp, Artificial Sequence
  chemically synthesized
ttttaactgtgggaaaatatac

SEQ ID NO: 1026677 - DNA, 22 bp, Artificial Sequence
  chemically synthesized
tttaactgtgggaaaatataca

SEQ ID NO: 1026678 - DNA, 22 bp, Artificial Sequence
  chemically synthesized
ttaactgtgggaaaatatacaa

SEQ ID NO: 1026679 - DNA, 22 bp, Artificial Sequence
  chemically synthesized
taactgtgggaaaatatacaaa

SEQ ID NO: 1026680 - DNA, 22 bp, Artificial Sequence
  chemically synthesized
aactgtgggaaaatatacaaaa

SEQ ID NO: 1026681 - DNA, 22 bp, Artificial Sequence
  chemically synthesized
actgtgggaaaatatacaaaat

SEQ ID NO: 1026682 - DNA, 22 bp, Artificial Sequence
  chemically synthesized
caatggttgaaatattttgtat

SEQ ID NO: 1026683 - DNA, 22 bp, Artificial Sequence
  chemically synthesized
acaatggttgaaatattttgta

SEQ ID NO: 1026684 - DNA, 22 bp, Artificial Sequence
  chemically synthesized
tgggaaaatatacaaaatattt

SEQ ID NO: 1026685 - DNA, 22 bp, Artificial Sequence
  chemically synthesized
tatacacttacaatggttgaaa

SEQ ID NO: 1026686 - DNA, 22 bp, Artificial Sequence
  chemically synthesized
aactgtatacacttacaatggt

SEQ ID NO: 1026687 - DNA, 22 bp, Artificial Sequence
  chemically synthesized
atgccactgaactgtatacact

SEQ ID NO: 1026688 - DNA, 22 bp, Artificial Sequence
  chemically synthesized
caaccattgtaagtgtatacag

SEQ ID NO: 1026689 - DNA, 22 bp, Artificial Sequence
  chemically synthesized
aaccattgtaagtgtatacagt

SEQ ID NO: 1026690 - DNA, 22 bp, Artificial Sequence
  chemically synthesized
taagtgtatacagttcagtggc

SEQ ID NO: 1026691 - DNA, 22 bp, Artificial Sequence
  chemically synthesized
catatccatgtgaatgtatcta

SEQ ID NO: 1026692 - DNA, 22 bp, Artificial Sequence
  chemically synthesized
acatatccatgtgaatgtatct

SEQ ID NO: 1026693 - DNA, 22 bp, Artificial Sequence
  chemically synthesized
agtggcattagatacattcaca

SEQ ID NO: 1026694 - DNA, 22 bp, Artificial Sequence
  chemically synthesized
gatacattcacatggatatgta

SEQ ID NO: 1026695 - DNA, 22 bp, Artificial Sequence
  chemically synthesized
acatggatatgtaaacatcacc

SEQ ID NO: 1026696 - DNA, 22 bp, Artificial Sequence
  chemically synthesized
gagatagatggtggtgatgttt

SEQ ID NO: 1026697 - DNA, 22 bp, Artificial Sequence
  chemically synthesized
ggagatagatggtggtgatgtt

SEQ ID NO: 1026698 - DNA, 22 bp, Artificial Sequence
  chemically synthesized
tggagatagatggtggtgatgt

SEQ ID NO: 1026699 - DNA, 22 bp, Artificial Sequence
  chemically synthesized
gaaagatgaagagttttggaga

SEQ ID NO: 1026700 - DNA, 22 bp, Artificial Sequence
  chemically synthesized
agaaagatgaagagttttggag

SEQ ID NO: 1026701 - DNA, 22 bp, Artificial Sequence
  chemically synthesized
agtttagaaagatgaagagttt

SEQ ID NO: 1026702 - DNA, 22 bp, Artificial Sequence
  chemically synthesized
cagtttagaaagatgaagagtt

SEQ ID NO: 1026703 - DNA, 22 bp, Artificial Sequence
  chemically synthesized
tctccaaaactcttcatctttc

SEQ ID NO: 1026704 - DNA, 22 bp, Artificial Sequence
  chemically synthesized
caaaactcttcatctttctaaa

SEQ ID NO: 1026705 - DNA, 22 bp, Artificial Sequence
  chemically synthesized
gtatagagtttcagtttagaaa

SEQ ID NO: 1026706 - DNA, 22 bp, Artificial Sequence
  chemically synthesized
ttcatctttctaaactgaaact

SEQ ID NO: 1026707 - DNA, 22 bp, Artificial Sequence
  chemically synthesized
catctttctaaactgaaactct

SEQ ID NO: 1026708 - DNA, 22 bp, Artificial Sequence
  chemically synthesized
tgtcattggtatagagtttcag

SEQ ID NO: 1026709 - DNA, 22 bp, Artificial Sequence
  chemically synthesized
atctttctaaactgaaactcta

SEQ ID NO: 1026710 - DNA, 22 bp, Artificial Sequence
  chemically synthesized
gtgtcattggtatagagtttca

SEQ ID NO: 1026711 - DNA, 22 bp, Artificial Sequence
  chemically synthesized
ttgtgtcattggtatagagttt

SEQ ID NO: 1026712 - DNA, 22 bp, Artificial Sequence
  chemically synthesized
tctaaactgaaactctatacca

SEQ ID NO: 1026713 - DNA, 22 bp, Artificial Sequence
  chemically synthesized
ctaaactgaaactctataccaa

SEQ ID NO: 1026714 - DNA, 22 bp, Artificial Sequence
  chemically synthesized
taaactgaaactctataccaat

SEQ ID NO: 1026715 - DNA, 22 bp, Artificial Sequence
  chemically synthesized
aactgaaactctataccaatga

SEQ ID NO: 1026716 - DNA, 22 bp, Artificial Sequence
  chemically synthesized
aaactctataccaatgacacaa

SEQ ID NO: 1026717 - DNA, 22 bp, Artificial Sequence
  chemically synthesized
tataccaatgacacaagaactg

SEQ ID NO: 1026718 - DNA, 22 bp, Artificial Sequence
  chemically synthesized
taccaatgacacaagaactgct

SEQ ID NO: 1026719 - DNA, 22 bp, Artificial Sequence
  chemically synthesized
ccagggaccagggaggggtagg

SEQ ID NO: 1026720 - DNA, 22 bp, Artificial Sequence
  chemically synthesized
ctcatttcccctacccctccct

SEQ ID NO: 1026721 - DNA, 22 bp, Artificial Sequence
  chemically synthesized
atttcccctacccctccctggt

SEQ ID NO: 1026722 - DNA, 22 bp, Artificial Sequence
  chemically synthesized
catggttgccagggaccaggga

SEQ ID NO: 1026723 - DNA, 22 bp, Artificial Sequence
  chemically synthesized
cccctacccctccctggtccct

SEQ ID NO: 1026724 - DNA, 22 bp, Artificial Sequence
  chemically synthesized
ccctacccctccctggtccctg

SEQ ID NO: 1026725 - DNA, 22 bp, Artificial Sequence
  chemically synthesized
cccctccctggtccctggcaac

SEQ ID NO: 1026726 - DNA, 22 bp, Artificial Sequence
  chemically synthesized
gacaaatagttgcatggttgcc

SEQ ID NO: 1026727 - DNA, 22 bp, Artificial Sequence
  chemically synthesized
agacaaatagttgcatggttgc

SEQ ID NO: 1026728 - DNA, 22 bp, Artificial Sequence
  chemically synthesized
cctggtccctggcaaccatgca

SEQ ID NO: 1026729 - DNA, 22 bp, Artificial Sequence
  chemically synthesized
ttagacaaatagttgcatggtt

SEQ ID NO: 1026730 - DNA, 22 bp, Artificial Sequence
  chemically synthesized
gtccctggcaaccatgcaacta

SEQ ID NO: 1026731 - DNA, 22 bp, Artificial Sequence
  chemically synthesized
aattcttagacaaatagttgca

SEQ ID NO: 1026732 - DNA, 22 bp, Artificial Sequence
  chemically synthesized
gcaaccatgcaactatttgtct

SEQ ID NO: 1026733 - DNA, 22 bp, Artificial Sequence
  chemically synthesized
gagtagttaaattcttagacaa

SEQ ID NO: 1026734 - DNA, 22 bp, Artificial Sequence
  chemically synthesized
cacctagagtagttaaattctt

SEQ ID NO: 1026735 - DNA, 22 bp, Artificial Sequence
  chemically synthesized
tttgtctaagaatttaactact

SEQ ID NO: 1026736 - DNA, 22 bp, Artificial Sequence
  chemically synthesized
gtctaagaatttaactactcta

SEQ ID NO: 1026737 - DNA, 22 bp, Artificial Sequence
  chemically synthesized
tctaagaatttaactactctag

SEQ ID NO: 1026738 - DNA, 22 bp, Artificial Sequence
  chemically synthesized
gagatattccacctagagtagt

SEQ ID NO: 1026739 - DNA, 22 bp, Artificial Sequence
  chemically synthesized
ggagatattccacctagagtag

SEQ ID NO: 1026740 - DNA, 22 bp, Artificial Sequence
  chemically synthesized
tggagatattccacctagagta

SEQ ID NO: 1026741 - DNA, 22 bp, Artificial Sequence
  chemically synthesized
agaatttaactactctaggtgg

SEQ ID NO: 1026742 - DNA, 22 bp, Artificial Sequence
  chemically synthesized
aactactctaggtggaatatct

SEQ ID NO: 1026743 - DNA, 22 bp, Artificial Sequence
  chemically synthesized
actactctaggtggaatatctc

SEQ ID NO: 1026744 - DNA, 22 bp, Artificial Sequence
  chemically synthesized
ctctaggtggaatatctccaaa

SEQ ID NO: 1026745 - DNA, 22 bp, Artificial Sequence
  chemically synthesized
aaatagggatgaactttggaga

SEQ ID NO: 1026746 - DNA, 22 bp, Artificial Sequence
  chemically synthesized
taggtggaatatctccaaagtt

SEQ ID NO: 1026747 - DNA, 22 bp, Artificial Sequence
  chemically synthesized
ggtggaatatctccaaagttca

SEQ ID NO: 1026748 - DNA, 22 bp, Artificial Sequence
  chemically synthesized
tcacatcctaaaatagggatga

SEQ ID NO: 1026749 - DNA, 22 bp, Artificial Sequence
  chemically synthesized
tgtcacatcctaaaatagggat

SEQ ID NO: 1026750 - DNA, 22 bp, Artificial Sequence
  chemically synthesized
caaagttcatccctattttagg

SEQ ID NO: 1026751 - DNA, 22 bp, Artificial Sequence
  chemically synthesized
atccctattttaggatgtgaca

SEQ ID NO: 1026752 - DNA, 22 bp, Artificial Sequence
  chemically synthesized
aaaaggaatgaaattctgtcac

SEQ ID NO: 1026753 - DNA, 22 bp, Artificial Sequence
  chemically synthesized
aaaaaggaatgaaattctgtca

SEQ ID NO: 1026754 - DNA, 22 bp, Artificial Sequence
  chemically synthesized
taaaaaggaatgaaattctgtc

SEQ ID NO: 1026755 - DNA, 22 bp, Artificial Sequence
  chemically synthesized
ttttaggatgtgacagaatttc

SEQ ID NO: 1026756 - DNA, 22 bp, Artificial Sequence
  chemically synthesized
ctttaaaaaggaatgaaattct

SEQ ID NO: 1026757 - DNA, 22 bp, Artificial Sequence
  chemically synthesized
taggatgtgacagaatttcatt

SEQ ID NO: 1026758 - DNA, 22 bp, Artificial Sequence
  chemically synthesized
aggatgtgacagaatttcattc

SEQ ID NO: 1026759 - DNA, 22 bp, Artificial Sequence
  chemically synthesized
tgctttaaaaaggaatgaaatt

SEQ ID NO: 1026760 - DNA, 22 bp, Artificial Sequence
  chemically synthesized
ggatgtgacagaatttcattcc

SEQ ID NO: 1026761 - DNA, 22 bp, Artificial Sequence
  chemically synthesized
cattcctttttaaagcagaata

SEQ ID NO: 1026762 - DNA, 22 bp, Artificial Sequence
  chemically synthesized
attcctttttaaagcagaatac

SEQ ID NO: 1026763 - DNA, 22 bp, Artificial Sequence
  chemically synthesized
ctttttaaagcagaatactgtt

SEQ ID NO: 1026764 - DNA, 22 bp, Artificial Sequence
  chemically synthesized
tttaaagcagaatactgttctg

SEQ ID NO: 1026765 - DNA, 22 bp, Artificial Sequence
  chemically synthesized
ttaaagcagaatactgttctgc

SEQ ID NO: 1026766 - DNA, 22 bp, Artificial Sequence
  chemically synthesized
taaagcagaatactgttctgct

SEQ ID NO: 1026767 - DNA, 22 bp, Artificial Sequence
  chemically synthesized
aaagcagaatactgttctgctg

SEQ ID NO: 1026768 - DNA, 22 bp, Artificial Sequence
  chemically synthesized
aagcagaatactgttctgctgt

SEQ ID NO: 1026769 - DNA, 22 bp, Artificial Sequence
  chemically synthesized
ttctgctgtatggatacaccac

SEQ ID NO: 1026770 - DNA, 22 bp, Artificial Sequence
  chemically synthesized
tgctgtatggatacaccacgtt

SEQ ID NO: 1026771 - DNA, 22 bp, Artificial Sequence
  chemically synthesized
ctgtatggatacaccacgtttt

SEQ ID NO: 1026772 - DNA, 22 bp, Artificial Sequence
  chemically synthesized
tatggatacaccacgttttgtt

SEQ ID NO: 1026773 - DNA, 22 bp, Artificial Sequence
  chemically synthesized
accaagaatggagaaacaaaac

SEQ ID NO: 1026774 - DNA, 22 bp, Artificial Sequence
  chemically synthesized
tgtacactgaccaagaatggag

SEQ ID NO: 1026775 - DNA, 22 bp, Artificial Sequence
  chemically synthesized
tgtttctccattcttggtcagt

SEQ ID NO: 1026776 - DNA, 22 bp, Artificial Sequence
  chemically synthesized
gtttctccattcttggtcagtg

SEQ ID NO: 1026777 - DNA, 22 bp, Artificial Sequence
  chemically synthesized
tttctccattcttggtcagtgt

SEQ ID NO: 1026778 - DNA, 22 bp, Artificial Sequence
  chemically synthesized
ctccattcttggtcagtgtaca

SEQ ID NO: 1026779 - DNA, 22 bp, Artificial Sequence
  chemically synthesized
tccattcttggtcagtgtacac

SEQ ID NO: 1026780 - DNA, 22 bp, Artificial Sequence
  chemically synthesized
cattcttggtcagtgtacacag

SEQ ID NO: 1026781 - DNA, 22 bp, Artificial Sequence
  chemically synthesized
ttggtcagtgtacacagtgtac

SEQ ID NO: 1026782 - DNA, 22 bp, Artificial Sequence
  chemically synthesized
ggtcagtgtacacagtgtacat

SEQ ID NO: 1026783 - DNA, 22 bp, Artificial Sequence
  chemically synthesized
gtcagtgtacacagtgtacatt

SEQ ID NO: 1026784 - DNA, 22 bp, Artificial Sequence
  chemically synthesized
tagagaaaaggtagaaacaaat

SEQ ID NO: 1026785 - DNA, 22 bp, Artificial Sequence
  chemically synthesized
ctgtagagaaaaggtagaaaca

SEQ ID NO: 1026786 - DNA, 22 bp, Artificial Sequence
  chemically synthesized
actgtagagaaaaggtagaaac

SEQ ID NO: 1026787 - DNA, 22 bp, Artificial Sequence
  chemically synthesized
tactgtagagaaaaggtagaaa

SEQ ID NO: 1026788 - DNA, 22 bp, Artificial Sequence
  chemically synthesized
gtttctaccttttctctacagt

SEQ ID NO: 1026789 - DNA, 22 bp, Artificial Sequence
  chemically synthesized
tttctaccttttctctacagta

SEQ ID NO: 1026790 - DNA, 22 bp, Artificial Sequence
  chemically synthesized
atagcagcatattttactgtag

SEQ ID NO: 1026791 - DNA, 22 bp, Artificial Sequence
  chemically synthesized
ctaccttttctctacagtaaaa

SEQ ID NO: 1026792 - DNA, 22 bp, Artificial Sequence
  chemically synthesized
taccttttctctacagtaaaat

SEQ ID NO: 1026793 - DNA, 22 bp, Artificial Sequence
  chemically synthesized
ccttttctctacagtaaaatat

SEQ ID NO: 1026794 - DNA, 22 bp, Artificial Sequence
  chemically synthesized
ttctctacagtaaaatatgctg

SEQ ID NO: 1026795 - DNA, 22 bp, Artificial Sequence
  chemically synthesized
tctctacagtaaaatatgctgc

SEQ ID NO: 1026796 - DNA, 22 bp, Artificial Sequence
  chemically synthesized
ctctacagtaaaatatgctgct

SEQ ID NO: 1026797 - DNA, 22 bp, Artificial Sequence
  chemically synthesized
tctacagtaaaatatgctgcta

SEQ ID NO: 1026798 - DNA, 22 bp, Artificial Sequence
  chemically synthesized
tacagtaaaatatgctgctatg

SEQ ID NO: 1026799 - DNA, 22 bp, Artificial Sequence
  chemically synthesized
tacacccaagttcatagcagca

SEQ ID NO: 1026800 - DNA, 22 bp, Artificial Sequence
  chemically synthesized
gtacacccaagttcatagcagc

SEQ ID NO: 1026801 - DNA, 22 bp, Artificial Sequence
  chemically synthesized
cagtaaaatatgctgctatgaa

SEQ ID NO: 1026802 - DNA, 22 bp, Artificial Sequence
  chemically synthesized
acacagatatttgtacacccaa

SEQ ID NO: 1026803 - DNA, 22 bp, Artificial Sequence
  chemically synthesized
ctatgaacttgggtgtacaaat

SEQ ID NO: 1026804 - DNA, 22 bp, Artificial Sequence
  chemically synthesized
tgaacttgggtgtacaaatatc

SEQ ID NO: 1026805 - DNA, 22 bp, Artificial Sequence
  chemically synthesized
aaaacaggtattcacacagata

SEQ ID NO: 1026806 - DNA, 22 bp, Artificial Sequence
  chemically synthesized
gggtgtacaaatatctgtgtga

SEQ ID NO: 1026807 - DNA, 22 bp, Artificial Sequence
  chemically synthesized
ggtgtacaaatatctgtgtgaa

SEQ ID NO: 1026808 - DNA, 22 bp, Artificial Sequence
  chemically synthesized
tgtgaatacctgttttcaatta

SEQ ID NO: 1026809 - DNA, 22 bp, Artificial Sequence
  chemically synthesized
ggtatatacccaaaataattga

SEQ ID NO: 1026810 - DNA, 22 bp, Artificial Sequence
  chemically synthesized
tgggtatatacccaaaataatt

SEQ ID NO: 1026811 - DNA, 22 bp, Artificial Sequence
  chemically synthesized
ctgggtatatacccaaaataat

SEQ ID NO: 1026812 - DNA, 22 bp, Artificial Sequence
  chemically synthesized
cacttctgggtatatacccaaa

SEQ ID NO: 1026813 - DNA, 22 bp, Artificial Sequence
  chemically synthesized
ttttcaattattttgggtatat

SEQ ID NO: 1026814 - DNA, 22 bp, Artificial Sequence
  chemically synthesized
tcaattattttgggtatatacc

SEQ ID NO: 1026815 - DNA, 22 bp, Artificial Sequence
  chemically synthesized
caattattttgggtatataccc

SEQ ID NO: 1026816 - DNA, 22 bp, Artificial Sequence
  chemically synthesized
aattattttgggtatataccca

SEQ ID NO: 1026817 - DNA, 22 bp, Artificial Sequence
  chemically synthesized
ttttgggtatatacccagaagt

SEQ ID NO: 1026818 - DNA, 22 bp, Artificial Sequence
  chemically synthesized
tgggtatatacccagaagtgga

SEQ ID NO: 1026819 - DNA, 22 bp, Artificial Sequence
  chemically synthesized
gggtatatacccagaagtggaa

SEQ ID NO: 1026820 - DNA, 22 bp, Artificial Sequence
  chemically synthesized
ggtatatacccagaagtggaat

SEQ ID NO: 1026821 - DNA, 22 bp, Artificial Sequence
  chemically synthesized
tatgatccaataattccacttc

SEQ ID NO: 1026822 - DNA, 22 bp, Artificial Sequence
  chemically synthesized
ttatatgatccaataattccac

SEQ ID NO: 1026823 - DNA, 22 bp, Artificial Sequence
  chemically synthesized
acaaagaactattatatgatcc

SEQ ID NO: 1026824 - DNA, 22 bp, Artificial Sequence
  chemically synthesized
aacaaagaactattatatgatc

SEQ ID NO: 1026825 - DNA, 22 bp, Artificial Sequence
  chemically synthesized
ttggatcatataatagttcttt

SEQ ID NO: 1026826 - DNA, 22 bp, Artificial Sequence
  chemically synthesized
aaataaaatttaacaaagaact

SEQ ID NO: 1026827 - DNA, 22 bp, Artificial Sequence
  chemically synthesized
gatcatataatagttctttgtt

SEQ ID NO: 1026828 - DNA, 22 bp, Artificial Sequence
  chemically synthesized
aaaataaaatttaacaaagaac

SEQ ID NO: 1026829 - DNA, 22 bp, Artificial Sequence
  chemically synthesized
ttaaaataaaatttaacaaaga

SEQ ID NO: 1026830 - DNA, 22 bp, Artificial Sequence
  chemically synthesized
gttcttaaaataaaatttaaca

SEQ ID NO: 1026831 - DNA, 22 bp, Artificial Sequence
  chemically synthesized
caagactagttcttaaaataaa

SEQ ID NO: 1026832 - DNA, 22 bp, Artificial Sequence
  chemically synthesized
tttgttaaattttattttaaga

SEQ ID NO: 1026833 - DNA, 22 bp, Artificial Sequence
  chemically synthesized
tgttaaattttattttaagaac

SEQ ID NO: 1026834 - DNA, 22 bp, Artificial Sequence
  chemically synthesized
gttaaattttattttaagaact

SEQ ID NO: 1026835 - DNA, 22 bp, Artificial Sequence
  chemically synthesized
aactacaagactagttcttaaa

SEQ ID NO: 1026836 - DNA, 22 bp, Artificial Sequence
  chemically synthesized
ttaaattttattttaagaacta

SEQ ID NO: 1026837 - DNA, 22 bp, Artificial Sequence
  chemically synthesized
aaactacaagactagttcttaa

SEQ ID NO: 1026838 - DNA, 22 bp, Artificial Sequence
  chemically synthesized
taaactacaagactagttctta

SEQ ID NO: 1026839 - DNA, 22 bp, Artificial Sequence
  chemically synthesized
ttaaactacaagactagttctt

SEQ ID NO: 1026840 - DNA, 22 bp, Artificial Sequence
  chemically synthesized
aattttattttaagaactagtc

SEQ ID NO: 1026841 - DNA, 22 bp, Artificial Sequence
  chemically synthesized
tttttaaactacaagactagtt

SEQ ID NO: 1026842 - DNA, 22 bp, Artificial Sequence
  chemically synthesized
atttttaaactacaagactagt

SEQ ID NO: 1026843 - DNA, 22 bp, Artificial Sequence
  chemically synthesized
tatttttaaactacaagactag

SEQ ID NO: 1026844 - DNA, 22 bp, Artificial Sequence
  chemically synthesized
tattttaagaactagtcttgta

SEQ ID NO: 1026845 - DNA, 22 bp, Artificial Sequence
  chemically synthesized
attttaagaactagtcttgtag

SEQ ID NO: 1026846 - DNA, 22 bp, Artificial Sequence
  chemically synthesized
ttttaagaactagtcttgtagt

SEQ ID NO: 1026847 - DNA, 22 bp, Artificial Sequence
  chemically synthesized
taagaactagtcttgtagttta

SEQ ID NO: 1026848 - DNA, 22 bp, Artificial Sequence
  chemically synthesized
aagaactagtcttgtagtttaa

SEQ ID NO: 1026849 - DNA, 22 bp, Artificial Sequence
  chemically synthesized
agaactagtcttgtagtttaaa

SEQ ID NO: 1026850 - DNA, 22 bp, Artificial Sequence
  chemically synthesized
caataaaactttatttttaaac

SEQ ID NO: 1026851 - DNA, 22 bp, Artificial Sequence
  chemically synthesized
gtcttgtagtttaaaaataaag

SEQ ID NO: 1026852 - DNA, 22 bp, Artificial Sequence
  chemically synthesized
tattccaataaaactttatttt

SEQ ID NO: 1026853 - DNA, 22 bp, Artificial Sequence
  chemically synthesized
gtagtttaaaaataaagtttta

SEQ ID NO: 1026854 - DNA, 22 bp, Artificial Sequence
  chemically synthesized
tagtttaaaaataaagttttat

SEQ ID NO: 1026855 - DNA, 22 bp, Artificial Sequence
  chemically synthesized
aaaaataaagttttattggaat

SEQ ID NO: 1026856 - DNA, 22 bp, Artificial Sequence
  chemically synthesized
aaaataaagttttattggaata

SEQ ID NO: 1026857 - DNA, 22 bp, Artificial Sequence
  chemically synthesized
tattggaatataatcacactca

SEQ ID NO: 1026858 - DNA, 22 bp, Artificial Sequence
  chemically synthesized
attggaatataatcacactcat

SEQ ID NO: 1026859 - DNA, 22 bp, Artificial Sequence
  chemically synthesized
ttggaatataatcacactcatt

SEQ ID NO: 1026860 - DNA, 22 bp, Artificial Sequence
  chemically synthesized
gaatataatcacactcattcat

SEQ ID NO: 1026861 - DNA, 22 bp, Artificial Sequence
  chemically synthesized
caaaagcaaccatagacaatat

SEQ ID NO: 1026862 - DNA, 22 bp, Artificial Sequence
  chemically synthesized
gcaaaagcaaccatagacaata

SEQ ID NO: 1026863 - DNA, 22 bp, Artificial Sequence
  chemically synthesized
attcatttacatattgtctatg

SEQ ID NO: 1026864 - DNA, 22 bp, Artificial Sequence
  chemically synthesized
tgcaaaagcaaccatagacaat

SEQ ID NO: 1026865 - DNA, 22 bp, Artificial Sequence
  chemically synthesized
ttgcaaaagcaaccatagacaa

SEQ ID NO: 1026866 - DNA, 22 bp, Artificial Sequence
  chemically synthesized
tttgcaaaagcaaccatagaca

SEQ ID NO: 1026867 - DNA, 22 bp, Artificial Sequence
  chemically synthesized
ttttgcaaaagcaaccatagac

SEQ ID NO: 1026868 - DNA, 22 bp, Artificial Sequence
  chemically synthesized
atttacatattgtctatggttg

SEQ ID NO: 1026869 - DNA, 22 bp, Artificial Sequence
  chemically synthesized
tttttgcaaaagcaaccataga

SEQ ID NO: 1026870 - DNA, 22 bp, Artificial Sequence
  chemically synthesized
ttttttgcaaaagcaaccatag

SEQ ID NO: 1026871 - DNA, 22 bp, Artificial Sequence
  chemically synthesized
tttttttgcaaaagcaaccata

SEQ ID NO: 1026872 - DNA, 22 bp, Artificial Sequence
  chemically synthesized
ttttttttgcaaaagcaaccat

SEQ ID NO: 1026873 - DNA, 22 bp, Artificial Sequence
  chemically synthesized
acatattgtctatggttgcttt

SEQ ID NO: 1026874 - DNA, 22 bp, Artificial Sequence
  chemically synthesized
tttttttttgcaaaagcaacca

SEQ ID NO: 1026875 - DNA, 22 bp, Artificial Sequence
  chemically synthesized
catattgtctatggttgctttt

SEQ ID NO: 1026876 - DNA, 22 bp, Artificial Sequence
  chemically synthesized
ttttttttttgcaaaagcaacc

SEQ ID NO: 1026877 - DNA, 22 bp, Artificial Sequence
  chemically synthesized
tttttttttttgcaaaagcaac

SEQ ID NO: 1026878 - DNA, 22 bp, Artificial Sequence
  chemically synthesized
ttttttttttttgcaaaagcaa

SEQ ID NO: 1026879 - DNA, 22 bp, Artificial Sequence
  chemically synthesized
tctatggttgcttttgcaaaaa

SEQ ID NO: 1026880 - DNA, 22 bp, Artificial Sequence
  chemically synthesized
ccatttttttttttttttgcaa

SEQ ID NO: 1026881 - DNA, 22 bp, Artificial Sequence
  chemically synthesized
tgccatttttttttttttttgc

SEQ ID NO: 1026882 - DNA, 22 bp, Artificial Sequence
  chemically synthesized
tggttgcttttgcaaaaaaaaa

SEQ ID NO: 1026883 - DNA, 22 bp, Artificial Sequence
  chemically synthesized
aactctgccatttttttttttt

SEQ ID NO: 1026884 - DNA, 22 bp, Artificial Sequence
  chemically synthesized
cttttgcaaaaaaaaaaaaaaa

SEQ ID NO: 1026885 - DNA, 22 bp, Artificial Sequence
  chemically synthesized
ttaaactctgccattttttttt

SEQ ID NO: 1026886 - DNA, 22 bp, Artificial Sequence
  chemically synthesized
ttgcaaaaaaaaaaaaaaatgg

SEQ ID NO: 1026887 - DNA, 22 bp, Artificial Sequence
  chemically synthesized
tgcaaaaaaaaaaaaaaatggc

SEQ ID NO: 1026888 - DNA, 22 bp, Artificial Sequence
  chemically synthesized
gcaaaaaaaaaaaaaaatggca

SEQ ID NO: 1026889 - DNA, 22 bp, Artificial Sequence
  chemically synthesized
caaaaaaaaaaaaaaatggcag

SEQ ID NO: 1026890 - DNA, 22 bp, Artificial Sequence
  chemically synthesized
acaactattaaactctgccatt

SEQ ID NO: 1026891 - DNA, 22 bp, Artificial Sequence
  chemically synthesized
tctcacaactattaaactctgc

SEQ ID NO: 1026892 - DNA, 22 bp, Artificial Sequence
  chemically synthesized
cgggccatatggtctatctcac

SEQ ID NO: 1026893 - DNA, 22 bp, Artificial Sequence
  chemically synthesized
gcgggccatatggtctatctca

SEQ ID NO: 1026894 - DNA, 22 bp, Artificial Sequence
  chemically synthesized
tgcgggccatatggtctatctc

SEQ ID NO: 1026895 - DNA, 22 bp, Artificial Sequence
  chemically synthesized
aatagttgtgagatagaccata

SEQ ID NO: 1026896 - DNA, 22 bp, Artificial Sequence
  chemically synthesized
atagttgtgagatagaccatat

SEQ ID NO: 1026897 - DNA, 22 bp, Artificial Sequence
  chemically synthesized
taggctttgcgggccatatggt

SEQ ID NO: 1026898 - DNA, 22 bp, Artificial Sequence
  chemically synthesized
tgagatagaccatatggcccgc

SEQ ID NO: 1026899 - DNA, 22 bp, Artificial Sequence
  chemically synthesized
taaggaacaagatagtaaatat

SEQ ID NO: 1026900 - DNA, 22 bp, Artificial Sequence
  chemically synthesized
tgtaaggaacaagatagtaaat

SEQ ID NO: 1026901 - DNA, 22 bp, Artificial Sequence
  chemically synthesized
ttctgtaaggaacaagatagta

SEQ ID NO: 1026902 - DNA, 22 bp, Artificial Sequence
  chemically synthesized
attctgtaaggaacaagatagt

SEQ ID NO: 1026903 - DNA, 22 bp, Artificial Sequence
  chemically synthesized
taatatttactatcttgttcct

SEQ ID NO: 1026904 - DNA, 22 bp, Artificial Sequence
  chemically synthesized
gcaaacttattctgtaaggaac

SEQ ID NO: 1026905 - DNA, 22 bp, Artificial Sequence
  chemically synthesized
actatcttgttccttacagaat

SEQ ID NO: 1026906 - DNA, 22 bp, Artificial Sequence
  chemically synthesized
ctatcttgttccttacagaata

SEQ ID NO: 1026907 - DNA, 22 bp, Artificial Sequence
  chemically synthesized
tcttgttccttacagaataagt

SEQ ID NO: 1026908 - DNA, 22 bp, Artificial Sequence
  chemically synthesized
gttccttacagaataagtttgc

SEQ ID NO: 1026909 - DNA, 22 bp, Artificial Sequence
  chemically synthesized
ttccttacagaataagtttgct

SEQ ID NO: 1026910 - DNA, 22 bp, Artificial Sequence
  chemically synthesized
taagacagaagttagcaaactt

SEQ ID NO: 1026911 - DNA, 22 bp, Artificial Sequence
  chemically synthesized
gtaagacagaagttagcaaact

SEQ ID NO: 1026912 - DNA, 22 bp, Artificial Sequence
  chemically synthesized
cttacagaataagtttgctaac

SEQ ID NO: 1026913 - DNA, 22 bp, Artificial Sequence
  chemically synthesized
tgtaagacagaagttagcaaac

SEQ ID NO: 1026914 - DNA, 22 bp, Artificial Sequence
  chemically synthesized
acagaataagtttgctaacttc

SEQ ID NO: 1026915 - DNA, 22 bp, Artificial Sequence
  chemically synthesized
cagaataagtttgctaacttct

SEQ ID NO: 1026916 - DNA, 22 bp, Artificial Sequence
  chemically synthesized
caattttgtaagacagaagtta

SEQ ID NO: 1026917 - DNA, 22 bp, Artificial Sequence
  chemically synthesized
ctgcaattttgtaagacagaag

SEQ ID NO: 1026918 - DNA, 22 bp, Artificial Sequence
  chemically synthesized
ctactgcaattttgtaagacag

SEQ ID NO: 1026919 - DNA, 22 bp, Artificial Sequence
  chemically synthesized
gctaacttctgtcttacaaaat

SEQ ID NO: 1026920 - DNA, 22 bp, Artificial Sequence
  chemically synthesized
ctaacttctgtcttacaaaatt

SEQ ID NO: 1026921 - DNA, 22 bp, Artificial Sequence
  chemically synthesized
acttctgtcttacaaaattgca

SEQ ID NO: 1026922 - DNA, 22 bp, Artificial Sequence
  chemically synthesized
ctgtcttacaaaattgcagtag

SEQ ID NO: 1026923 - DNA, 22 bp, Artificial Sequence
  chemically synthesized
tgtcttacaaaattgcagtagc

SEQ ID NO: 1026924 - DNA, 22 bp, Artificial Sequence
  chemically synthesized
tcttacaaaattgcagtagcaa

SEQ ID NO: 1026925 - DNA, 22 bp, Artificial Sequence
  chemically synthesized
acaaaattgcagtagcaattcc

SEQ ID NO: 1026926 - DNA, 22 bp, Artificial Sequence
  chemically synthesized
atgtgaaaccaaggaattgcta

SEQ ID NO: 1026927 - DNA, 22 bp, Artificial Sequence
  chemically synthesized
caaaattgcagtagcaattcct

SEQ ID NO: 1026928 - DNA, 22 bp, Artificial Sequence
  chemically synthesized
catgtgaaaccaaggaattgct

SEQ ID NO: 1026929 - DNA, 22 bp, Artificial Sequence
  chemically synthesized
cagtagcaattccttggtttca

SEQ ID NO: 1026930 - DNA, 22 bp, Artificial Sequence
  chemically synthesized
aagacatatgtttcatgtgaaa

SEQ ID NO: 1026931 - DNA, 22 bp, Artificial Sequence
  chemically synthesized
gaagacatatgtttcatgtgaa

SEQ ID NO: 1026932 - DNA, 22 bp, Artificial Sequence
  chemically synthesized
tttgaagacatatgtttcatgt

SEQ ID NO: 1026933 - DNA, 22 bp, Artificial Sequence
  chemically synthesized
cttggtttcacatgaaacatat

SEQ ID NO: 1026934 - DNA, 22 bp, Artificial Sequence
  chemically synthesized
actgtttgaagacatatgtttc

SEQ ID NO: 1026935 - DNA, 22 bp, Artificial Sequence
  chemically synthesized
aactgtttgaagacatatgttt

SEQ ID NO: 1026936 - DNA, 22 bp, Artificial Sequence
  chemically synthesized
ggtttcacatgaaacatatgtc

SEQ ID NO: 1026937 - DNA, 22 bp, Artificial Sequence
  chemically synthesized
taactgtttgaagacatatgtt

SEQ ID NO: 1026938 - DNA, 22 bp, Artificial Sequence
  chemically synthesized
gtttcacatgaaacatatgtct

SEQ ID NO: 1026939 - DNA, 22 bp, Artificial Sequence
  chemically synthesized
ttaactgtttgaagacatatgt

SEQ ID NO: 1026940 - DNA, 22 bp, Artificial Sequence
  chemically synthesized
cacatgaaacatatgtcttcaa

SEQ ID NO: 1026941 - DNA, 22 bp, Artificial Sequence
  chemically synthesized
acatgaaacatatgtcttcaaa

SEQ ID NO: 1026942 - DNA, 22 bp, Artificial Sequence
  chemically synthesized
ccaacatgaaaggtcttttaac

SEQ ID NO: 1026943 - DNA, 22 bp, Artificial Sequence
  chemically synthesized
cccaacatgaaaggtcttttaa

SEQ ID NO: 1026944 - DNA, 22 bp, Artificial Sequence
  chemically synthesized
tttcccaacatgaaaggtcttt

SEQ ID NO: 1026945 - DNA, 22 bp, Artificial Sequence
  chemically synthesized
caaacagttaaaagacctttca

SEQ ID NO: 1026946 - DNA, 22 bp, Artificial Sequence
  chemically synthesized
tatttcccaacatgaaaggtct

SEQ ID NO: 1026947 - DNA, 22 bp, Artificial Sequence
  chemically synthesized
aaacagttaaaagacctttcat

SEQ ID NO: 1026948 - DNA, 22 bp, Artificial Sequence
  chemically synthesized
ctatttcccaacatgaaaggtc

SEQ ID NO: 1026949 - DNA, 22 bp, Artificial Sequence
  chemically synthesized
tttctatttcccaacatgaaag

SEQ ID NO: 1026950 - DNA, 22 bp, Artificial Sequence
  chemically synthesized
tcctgtttctatttcccaacat

SEQ ID NO: 1026951 - DNA, 22 bp, Artificial Sequence
  chemically synthesized
aaagacctttcatgttgggaaa

SEQ ID NO: 1026952 - DNA, 22 bp, Artificial Sequence
  chemically synthesized
tcatgttgggaaatagaaacag

SEQ ID NO: 1026953 - DNA, 22 bp, Artificial Sequence
  chemically synthesized
catgttgggaaatagaaacagg

SEQ ID NO: 1026954 - DNA, 22 bp, Artificial Sequence
  chemically synthesized
atgttgggaaatagaaacagga

SEQ ID NO: 1026955 - DNA, 22 bp, Artificial Sequence
  chemically synthesized
ggaaatagaaacaggataattt

SEQ ID NO: 1026956 - DNA, 22 bp, Artificial Sequence
  chemically synthesized
atatgtaggccgagaataaaat

SEQ ID NO: 1026957 - DNA, 22 bp, Artificial Sequence
  chemically synthesized
tcatatgtaggccgagaataaa

SEQ ID NO: 1026958 - DNA, 22 bp, Artificial Sequence
  chemically synthesized
ctcatatgtaggccgagaataa

SEQ ID NO: 1026959 - DNA, 22 bp, Artificial Sequence
  chemically synthesized
tctcatatgtaggccgagaata

SEQ ID NO: 1026960 - DNA, 22 bp, Artificial Sequence
  chemically synthesized
ttttctcatatgtaggccgaga

SEQ ID NO: 1026961 - DNA, 22 bp, Artificial Sequence
  chemically synthesized
gttttctcatatgtaggccgag

SEQ ID NO: 1026962 - DNA, 22 bp, Artificial Sequence
  chemically synthesized
cttgttttctcatatgtaggcc

SEQ ID NO: 1026963 - DNA, 22 bp, Artificial Sequence
  chemically synthesized
ccttgttttctcatatgtaggc

SEQ ID NO: 1026964 - DNA, 22 bp, Artificial Sequence
  chemically synthesized
tccttgttttctcatatgtagg

SEQ ID NO: 1026965 - DNA, 22 bp, Artificial Sequence
  chemically synthesized
tattctcggcctacatatgaga

SEQ ID NO: 1026966 - DNA, 22 bp, Artificial Sequence
  chemically synthesized
attctcggcctacatatgagaa

SEQ ID NO: 1026967 - DNA, 22 bp, Artificial Sequence
  chemically synthesized
ttctcggcctacatatgagaaa

SEQ ID NO: 1026968 - DNA, 22 bp, Artificial Sequence
  chemically synthesized
agcactttccttgttttctcat

SEQ ID NO: 1026969 - DNA, 22 bp, Artificial Sequence
  chemically synthesized
tcggcctacatatgagaaaaca

SEQ ID NO: 1026970 - DNA, 22 bp, Artificial Sequence
  chemically synthesized
ggcctacatatgagaaaacaag

SEQ ID NO: 1026971 - DNA, 22 bp, Artificial Sequence
  chemically synthesized
catatgagaaaacaaggaaagt

SEQ ID NO: 1026972 - DNA, 22 bp, Artificial Sequence
  chemically synthesized
catgtggcattcagcactttcc

SEQ ID NO: 1026973 - DNA, 22 bp, Artificial Sequence
  chemically synthesized
ccatgtggcattcagcactttc

SEQ ID NO: 1026974 - DNA, 22 bp, Artificial Sequence
  chemically synthesized
caacttccatgtggcattcagc

SEQ ID NO: 1026975 - DNA, 22 bp, Artificial Sequence
  chemically synthesized
agattgcaacttccatgtggca

SEQ ID NO: 1026976 - DNA, 22 bp, Artificial Sequence
  chemically synthesized
gagattgcaacttccatgtggc

SEQ ID NO: 1026977 - DNA, 22 bp, Artificial Sequence
  chemically synthesized
tgagattgcaacttccatgtgg

SEQ ID NO: 1026978 - DNA, 22 bp, Artificial Sequence
  chemically synthesized
ctttgagattgcaacttccatg

SEQ ID NO: 1026979 - DNA, 22 bp, Artificial Sequence
  chemically synthesized
cctttgagattgcaacttccat

SEQ ID NO: 1026980 - DNA, 22 bp, Artificial Sequence
  chemically synthesized
aatgccacatggaagttgcaat

SEQ ID NO: 1026981 - DNA, 22 bp, Artificial Sequence
  chemically synthesized
acttcctttgagattgcaactt

SEQ ID NO: 1026982 - DNA, 22 bp, Artificial Sequence
  chemically synthesized
gattaacttcctttgagattgc

SEQ ID NO: 1026983 - DNA, 22 bp, Artificial Sequence
  chemically synthesized
atattggattaacttcctttga

SEQ ID NO: 1026984 - DNA, 22 bp, Artificial Sequence
  chemically synthesized
caatctcaaaggaagttaatcc

SEQ ID NO: 1026985 - DNA, 22 bp, Artificial Sequence
  chemically synthesized
gatattaatattggattaactt

SEQ ID NO: 1026986 - DNA, 22 bp, Artificial Sequence
  chemically synthesized
aaaggaagttaatccaatatta

SEQ ID NO: 1026987 - DNA, 22 bp, Artificial Sequence
  chemically synthesized
caacaatgaggtctggatatta

SEQ ID NO: 1026988 - DNA, 22 bp, Artificial Sequence
  chemically synthesized
atccaatattaatatccagacc

SEQ ID NO: 1026989 - DNA, 22 bp, Artificial Sequence
  chemically synthesized
gctgcaacaatgaggtctggat

SEQ ID NO: 1026990 - DNA, 22 bp, Artificial Sequence
  chemically synthesized
agctgcaacaatgaggtctgga

SEQ ID NO: 1026991 - DNA, 22 bp, Artificial Sequence
  chemically synthesized
atatccagacctcattgttgca

SEQ ID NO: 1026992 - DNA, 22 bp, Artificial Sequence
  chemically synthesized
tgatgagatagatttagctgca

SEQ ID NO: 1026993 - DNA, 22 bp, Artificial Sequence
  chemically synthesized
gtgatgagatagatttagctgc

SEQ ID NO: 1026994 - DNA, 22 bp, Artificial Sequence
  chemically synthesized
attgttgcagctaaatctatct

SEQ ID NO: 1026995 - DNA, 22 bp, Artificial Sequence
  chemically synthesized
tgatttgtgatgagatagattt

SEQ ID NO: 1026996 - DNA, 22 bp, Artificial Sequence
  chemically synthesized
tgtgatttgtgatgagatagat

SEQ ID NO: 1026997 - DNA, 22 bp, Artificial Sequence
  chemically synthesized
ttgcagctaaatctatctcatc

SEQ ID NO: 1026998 - DNA, 22 bp, Artificial Sequence
  chemically synthesized
cagctaaatctatctcatcaca

SEQ ID NO: 1026999 - DNA, 22 bp, Artificial Sequence
  chemically synthesized
aatctatctcatcacaaatcac

SEQ ID NO: 1027000 - DNA, 22 bp, Artificial Sequence
  chemically synthesized
tctcatcacaaatcacagagtt

SEQ ID NO: 1027001 - DNA, 22 bp, Artificial Sequence
  chemically synthesized
atcacaaatcacagagttattt

SEQ ID NO: 1027002 - DNA, 22 bp, Artificial Sequence
  chemically synthesized
tatagcatataaagaagtaaaa

SEQ ID NO: 1027003 - DNA, 22 bp, Artificial Sequence
  chemically synthesized
tatatagcatataaagaagtaa

SEQ ID NO: 1027004 - DNA, 22 bp, Artificial Sequence
  chemically synthesized
ctatatagcatataaagaagta

SEQ ID NO: 1027005 - DNA, 22 bp, Artificial Sequence
  chemically synthesized
tctatatagcatataaagaagt

SEQ ID NO: 1027006 - DNA, 22 bp, Artificial Sequence
  chemically synthesized
agttttctatatagcatataaa

SEQ ID NO: 1027007 - DNA, 22 bp, Artificial Sequence
  chemically synthesized
ttttacttctttatatgctata

SEQ ID NO: 1027008 - DNA, 22 bp, Artificial Sequence
  chemically synthesized
tacttctttatatgctatatag

SEQ ID NO: 1027009 - DNA, 22 bp, Artificial Sequence
  chemically synthesized
acttctttatatgctatataga

SEQ ID NO: 1027010 - DNA, 22 bp, Artificial Sequence
  chemically synthesized
cttctttatatgctatatagaa

SEQ ID NO: 1027011 - DNA, 22 bp, Artificial Sequence
  chemically synthesized
ctttatatgctatatagaaaac

SEQ ID NO: 1027012 - DNA, 22 bp, Artificial Sequence
  chemically synthesized
tttatatgctatatagaaaact

SEQ ID NO: 1027013 - DNA, 22 bp, Artificial Sequence
  chemically synthesized
tatatgctatatagaaaactca

SEQ ID NO: 1027014 - DNA, 22 bp, Artificial Sequence
  chemically synthesized
atatgctatatagaaaactcag

SEQ ID NO: 1027015 - DNA, 22 bp, Artificial Sequence
  chemically synthesized
tatgctatatagaaaactcaga

SEQ ID NO: 1027016 - DNA, 22 bp, Artificial Sequence
  chemically synthesized
atatagggaaagtatatctgag

SEQ ID NO: 1027017 - DNA, 22 bp, Artificial Sequence
  chemically synthesized
tatagaaaactcagatatactt

SEQ ID NO: 1027018 - DNA, 22 bp, Artificial Sequence
  chemically synthesized
agatatactttccctatatcaa

SEQ ID NO: 1027019 - DNA, 22 bp, Artificial Sequence
  chemically synthesized
tccctatatcaatgcgatgttt

SEQ ID NO: 1027020 - DNA, 22 bp, Artificial Sequence
  chemically synthesized
ccctatatcaatgcgatgtttc

SEQ ID NO: 1027021 - DNA, 22 bp, Artificial Sequence
  chemically synthesized
cctatatcaatgcgatgtttca

SEQ ID NO: 1027022 - DNA, 22 bp, Artificial Sequence
  chemically synthesized
tatcaatgcgatgtttcatgct

SEQ ID NO: 1027023 - DNA, 22 bp, Artificial Sequence
  chemically synthesized
aataaaagaagaaagcatgaaa

SEQ ID NO: 1027024 - DNA, 22 bp, Artificial Sequence
  chemically synthesized
caataaaagaagaaagcatgaa

SEQ ID NO: 1027025 - DNA, 22 bp, Artificial Sequence
  chemically synthesized
ccaccccatcttcaataaaaga

SEQ ID NO: 1027026 - DNA, 22 bp, Artificial Sequence
  chemically synthesized
catgctttcttcttttattgaa

SEQ ID NO: 1027027 - DNA, 22 bp, Artificial Sequence
  chemically synthesized
atgctttcttcttttattgaag

SEQ ID NO: 1027028 - DNA, 22 bp, Artificial Sequence
  chemically synthesized
tcttcttttattgaagatgggg

SEQ ID NO: 1027029 - DNA, 22 bp, Artificial Sequence
  chemically synthesized
cttcttttattgaagatggggt

SEQ ID NO: 1027030 - DNA, 22 bp, Artificial Sequence
  chemically synthesized
ttcttttattgaagatggggtg

SEQ ID NO: 1027031 - DNA, 22 bp, Artificial Sequence
  chemically synthesized
atgcagtattcccaccccatct

SEQ ID NO: 1027032 - DNA, 22 bp, Artificial Sequence
  chemically synthesized
gatgcagtattcccaccccatc

SEQ ID NO: 1027033 - DNA, 22 bp, Artificial Sequence
  chemically synthesized
cttttattgaagatggggtggg

SEQ ID NO: 1027034 - DNA, 22 bp, Artificial Sequence
  chemically synthesized
ttttattgaagatggggtggga

SEQ ID NO: 1027035 - DNA, 22 bp, Artificial Sequence
  chemically synthesized
ttattgaagatggggtgggaat

SEQ ID NO: 1027036 - DNA, 22 bp, Artificial Sequence
  chemically synthesized
acttgatgcagtattcccaccc

SEQ ID NO: 1027037 - DNA, 22 bp, Artificial Sequence
  chemically synthesized
tattgaagatggggtgggaata

SEQ ID NO: 1027038 - DNA, 22 bp, Artificial Sequence
  chemically synthesized
attgaagatggggtgggaatac

SEQ ID NO: 1027039 - DNA, 22 bp, Artificial Sequence
  chemically synthesized
tcacttgatgcagtattcccac

SEQ ID NO: 1027040 - DNA, 22 bp, Artificial Sequence
  chemically synthesized
ttgaagatggggtgggaatact

SEQ ID NO: 1027041 - DNA, 22 bp, Artificial Sequence
  chemically synthesized
aagatggggtgggaatactgca

SEQ ID NO: 1027042 - DNA, 22 bp, Artificial Sequence
  chemically synthesized
aagtctctcacttgatgcagta

SEQ ID NO: 1027043 - DNA, 22 bp, Artificial Sequence
  chemically synthesized
ccagactcaagtctctcacttg

SEQ ID NO: 1027044 - DNA, 22 bp, Artificial Sequence
  chemically synthesized
tcccagactcaagtctctcact

SEQ ID NO: 1027045 - DNA, 22 bp, Artificial Sequence
  chemically synthesized
agcctctcccagactcaagtct

SEQ ID NO: 1027046 - DNA, 22 bp, Artificial Sequence
  chemically synthesized
catcaagtgagagacttgagtc

SEQ ID NO: 1027047 - DNA, 22 bp, Artificial Sequence
  chemically synthesized
tacaactcagcctctcccagac

SEQ ID NO: 1027048 - DNA, 22 bp, Artificial Sequence
  chemically synthesized
acagttatacaactcagcctct

SEQ ID NO: 1027049 - DNA, 22 bp, Artificial Sequence
  chemically synthesized
cacagttatacaactcagcctc

SEQ ID NO: 1027050 - DNA, 22 bp, Artificial Sequence
  chemically synthesized
gagtctgggagaggctgagttg

SEQ ID NO: 1027051 - DNA, 22 bp, Artificial Sequence
  chemically synthesized
agtctgggagaggctgagttgt

SEQ ID NO: 1027052 - DNA, 22 bp, Artificial Sequence
  chemically synthesized
ggagaggctgagttgtataact

SEQ ID NO: 1027053 - DNA, 22 bp, Artificial Sequence
  chemically synthesized
gaggacaaatgatttcacagtt

SEQ ID NO: 1027054 - DNA, 22 bp, Artificial Sequence
  chemically synthesized
ggaggacaaatgatttcacagt

SEQ ID NO: 1027055 - DNA, 22 bp, Artificial Sequence
  chemically synthesized
tggaggacaaatgatttcacag

SEQ ID NO: 1027056 - DNA, 22 bp, Artificial Sequence
  chemically synthesized
ttggaggacaaatgatttcaca

SEQ ID NO: 1027057 - DNA, 22 bp, Artificial Sequence
  chemically synthesized
agttgtataactgtgaaatcat

SEQ ID NO: 1027058 - DNA, 22 bp, Artificial Sequence
  chemically synthesized
tataactgtgaaatcatttgtc

SEQ ID NO: 1027059 - DNA, 22 bp, Artificial Sequence
  chemically synthesized
aatccaagcttttggaggacaa

SEQ ID NO: 1027060 - DNA, 22 bp, Artificial Sequence
  chemically synthesized
aaatccaagcttttggaggaca

SEQ ID NO: 1027061 - DNA, 22 bp, Artificial Sequence
  chemically synthesized
taaatccaagcttttggaggac

SEQ ID NO: 1027062 - DNA, 22 bp, Artificial Sequence
  chemically synthesized
tgaaatcatttgtcctccaaaa

SEQ ID NO: 1027063 - DNA, 22 bp, Artificial Sequence
  chemically synthesized
tattttaaatccaagcttttgg

SEQ ID NO: 1027064 - DNA, 22 bp, Artificial Sequence
  chemically synthesized
ttatattttaaatccaagcttt

SEQ ID NO: 1027065 - DNA, 22 bp, Artificial Sequence
  chemically synthesized
gtcctccaaaagcttggattta

SEQ ID NO: 1027066 - DNA, 22 bp, Artificial Sequence
  chemically synthesized
tcctccaaaagcttggatttaa

SEQ ID NO: 1027067 - DNA, 22 bp, Artificial Sequence
  chemically synthesized
caaaagcttggatttaaaatat

SEQ ID NO: 1027068 - DNA, 22 bp, Artificial Sequence
  chemically synthesized
ggatttaaaatataacagattc

SEQ ID NO: 1027069 - DNA, 22 bp, Artificial Sequence
  chemically synthesized
gatttaaaatataacagattca

SEQ ID NO: 1027070 - DNA, 22 bp, Artificial Sequence
  chemically synthesized
agtcatacatagtacgtgaatc

SEQ ID NO: 1027071 - DNA, 22 bp, Artificial Sequence
  chemically synthesized
aaaatataacagattcacgtac

SEQ ID NO: 1027072 - DNA, 22 bp, Artificial Sequence
  chemically synthesized
cagtcatacatagtacgtgaat

SEQ ID NO: 1027073 - DNA, 22 bp, Artificial Sequence
  chemically synthesized
aaatataacagattcacgtact

SEQ ID NO: 1027074 - DNA, 22 bp, Artificial Sequence
  chemically synthesized
tcagtcatacatagtacgtgaa

SEQ ID NO: 1027075 - DNA, 22 bp, Artificial Sequence
  chemically synthesized
acgtactatgtatgactgaaaa

SEQ ID NO: 1027076 - DNA, 22 bp, Artificial Sequence
  chemically synthesized
caggcaagtatgttttcagtca

SEQ ID NO: 1027077 - DNA, 22 bp, Artificial Sequence
  chemically synthesized
acattccaggcaagtatgtttt

SEQ ID NO: 1027078 - DNA, 22 bp, Artificial Sequence
  chemically synthesized
aacattccaggcaagtatgttt

SEQ ID NO: 1027079 - DNA, 22 bp, Artificial Sequence
  chemically synthesized
tgtatgactgaaaacatacttg

SEQ ID NO: 1027080 - DNA, 22 bp, Artificial Sequence
  chemically synthesized
taacattccaggcaagtatgtt

SEQ ID NO: 1027081 - DNA, 22 bp, Artificial Sequence
  chemically synthesized
atctttaacattccaggcaagt

SEQ ID NO: 1027082 - DNA, 22 bp, Artificial Sequence
  chemically synthesized
aaaacatacttgcctggaatgt

SEQ ID NO: 1027083 - DNA, 22 bp, Artificial Sequence
  chemically synthesized
ccctgatctttaacattccagg

SEQ ID NO: 1027084 - DNA, 22 bp, Artificial Sequence
  chemically synthesized
gcctggaatgttaaagatcagg

SEQ ID NO: 1027085 - DNA, 22 bp, Artificial Sequence
  chemically synthesized
cctggaatgttaaagatcaggg

SEQ ID NO: 1027086 - DNA, 22 bp, Artificial Sequence
  chemically synthesized
gaatgttaaagatcagggtaat

SEQ ID NO: 1027087 - DNA, 22 bp, Artificial Sequence
  chemically synthesized
acgagacagaaaattaccctga

SEQ ID NO: 1027088 - DNA, 22 bp, Artificial Sequence
  chemically synthesized
gattaacgagacagaaaattac

SEQ ID NO: 1027089 - DNA, 22 bp, Artificial Sequence
  chemically synthesized
aagatcagggtaattttctgtc

SEQ ID NO: 1027090 - DNA, 22 bp, Artificial Sequence
  chemically synthesized
tcaatattagattaacgagaca

SEQ ID NO: 1027091 - DNA, 22 bp, Artificial Sequence
  chemically synthesized
cactgtcaatattagattaacg

SEQ ID NO: 1027092 - DNA, 22 bp, Artificial Sequence
  chemically synthesized
tctgtctcgttaatctaatatt

SEQ ID NO: 1027093 - DNA, 22 bp, Artificial Sequence
  chemically synthesized
tactccactgtcaatattagat

SEQ ID NO: 1027094 - DNA, 22 bp, Artificial Sequence
  chemically synthesized
ctgtctcgttaatctaatattg

SEQ ID NO: 1027095 - DNA, 22 bp, Artificial Sequence
  chemically synthesized
atactccactgtcaatattaga

SEQ ID NO: 1027096 - DNA, 22 bp, Artificial Sequence
  chemically synthesized
tgtctcgttaatctaatattga

SEQ ID NO: 1027097 - DNA, 22 bp, Artificial Sequence
  chemically synthesized
tatactccactgtcaatattag

SEQ ID NO: 1027098 - DNA, 22 bp, Artificial Sequence
  chemically synthesized
ttatactccactgtcaatatta

SEQ ID NO: 1027099 - DNA, 22 bp, Artificial Sequence
  chemically synthesized
tctcgttaatctaatattgaca

SEQ ID NO: 1027100 - DNA, 22 bp, Artificial Sequence
  chemically synthesized
gttaatctaatattgacagtgg

SEQ ID NO: 1027101 - DNA, 22 bp, Artificial Sequence
  chemically synthesized
atctaatattgacagtggagta

SEQ ID NO: 1027102 - DNA, 22 bp, Artificial Sequence
  chemically synthesized
atattgacagtggagtataaaa

SEQ ID NO: 1027103 - DNA, 22 bp, Artificial Sequence
  chemically synthesized
acagtggagtataaaagtctct

SEQ ID NO: 1027104 - DNA, 22 bp, Artificial Sequence
  chemically synthesized
cacagtaatagtgagagacttt

SEQ ID NO: 1027105 - DNA, 22 bp, Artificial Sequence
  chemically synthesized
ctacacagtaatagtgagagac

SEQ ID NO: 1027106 - DNA, 22 bp, Artificial Sequence
  chemically synthesized
cactcctacacagtaatagtga

SEQ ID NO: 1027107 - DNA, 22 bp, Artificial Sequence
  chemically synthesized
acactcctacacagtaatagtg

SEQ ID NO: 1027108 - DNA, 22 bp, Artificial Sequence
  chemically synthesized
tcactattactgtgtaggagtg

SEQ ID NO: 1027109 - DNA, 22 bp, Artificial Sequence
  chemically synthesized
caaagagacttacactcctaca

SEQ ID NO: 1027110 - DNA, 22 bp, Artificial Sequence
  chemically synthesized
actattactgtgtaggagtgta

SEQ ID NO: 1027111 - DNA, 22 bp, Artificial Sequence
  chemically synthesized
ttactgtgtaggagtgtaagtc

SEQ ID NO: 1027112 - DNA, 22 bp, Artificial Sequence
  chemically synthesized
gagacctacaaagagacttaca

SEQ ID NO: 1027113 - DNA, 22 bp, Artificial Sequence
  chemically synthesized
ctgtgtaggagtgtaagtctct

SEQ ID NO: 1027114 - DNA, 22 bp, Artificial Sequence
  chemically synthesized
ctagagacctacaaagagactt

SEQ ID NO: 1027115 - DNA, 22 bp, Artificial Sequence
  chemically synthesized
tgtaggagtgtaagtctctttg

SEQ ID NO: 1027116 - DNA, 22 bp, Artificial Sequence
  chemically synthesized
gtaaagcaagttcctagagacc

SEQ ID NO: 1027117 - DNA, 22 bp, Artificial Sequence
  chemically synthesized
tttgtaggtctctaggaacttg

SEQ ID NO: 1027118 - DNA, 22 bp, Artificial Sequence
  chemically synthesized
tgtaggtctctaggaacttgct

SEQ ID NO: 1027119 - DNA, 22 bp, Artificial Sequence
  chemically synthesized
gtaggtctctaggaacttgctt

SEQ ID NO: 1027120 - DNA, 22 bp, Artificial Sequence
  chemically synthesized
taggtctctaggaacttgcttt

SEQ ID NO: 1027121 - DNA, 22 bp, Artificial Sequence
  chemically synthesized
taggaacttgctttacgaatct

SEQ ID NO: 1027122 - DNA, 22 bp, Artificial Sequence
  chemically synthesized
ggaacttgctttacgaatctgg

SEQ ID NO: 1027123 - DNA, 22 bp, Artificial Sequence
  chemically synthesized
gctttacgaatctgggtgctcc

SEQ ID NO: 1027124 - DNA, 22 bp, Artificial Sequence
  chemically synthesized
ctttacgaatctgggtgctcct

SEQ ID NO: 1027125 - DNA, 22 bp, Artificial Sequence
  chemically synthesized
tacgaatctgggtgctcctgta

SEQ ID NO: 1027126 - DNA, 22 bp, Artificial Sequence
  chemically synthesized
acgaatctgggtgctcctgtat

SEQ ID NO: 1027127 - DNA, 22 bp, Artificial Sequence
  chemically synthesized
cgaatctgggtgctcctgtatt

SEQ ID NO: 1027128 - DNA, 22 bp, Artificial Sequence
  chemically synthesized
aatatatatgcacccaatacag

SEQ ID NO: 1027129 - DNA, 22 bp, Artificial Sequence
  chemically synthesized
taaatatatatgcacccaatac

SEQ ID NO: 1027130 - DNA, 22 bp, Artificial Sequence
  chemically synthesized
ggtgctcctgtattgggtgcat

SEQ ID NO: 1027131 - DNA, 22 bp, Artificial Sequence
  chemically synthesized
ttctaaatatatatgcacccaa

SEQ ID NO: 1027132 - DNA, 22 bp, Artificial Sequence
  chemically synthesized
actattctaaatatatatgcac

SEQ ID NO: 1027133 - DNA, 22 bp, Artificial Sequence
  chemically synthesized
ctgtattgggtgcatatatatt

SEQ ID NO: 1027134 - DNA, 22 bp, Artificial Sequence
  chemically synthesized
tattgggtgcatatatatttag

SEQ ID NO: 1027135 - DNA, 22 bp, Artificial Sequence
  chemically synthesized
ggtgcatatatatttagaatag

SEQ ID NO: 1027136 - DNA, 22 bp, Artificial Sequence
  chemically synthesized
agaatagttagttcttcttgtt

SEQ ID NO: 1027137 - DNA, 22 bp, Artificial Sequence
  chemically synthesized
gaatagttagttcttcttgttg

SEQ ID NO: 1027138 - DNA, 22 bp, Artificial Sequence
  chemically synthesized
gttcttcttgttgcgttgctcc

SEQ ID NO: 1027139 - DNA, 22 bp, Artificial Sequence
  chemically synthesized
cataatggtaaagggagcaacg

SEQ ID NO: 1027140 - DNA, 22 bp, Artificial Sequence
  chemically synthesized
ttcttgttgcgttgctcccttt

SEQ ID NO: 1027141 - DNA, 22 bp, Artificial Sequence
  chemically synthesized
cttgttgcgttgctccctttac

SEQ ID NO: 1027142 - DNA, 22 bp, Artificial Sequence
  chemically synthesized
cattacataatggtaaagggag

SEQ ID NO: 1027143 - DNA, 22 bp, Artificial Sequence
  chemically synthesized
ttgttgcgttgctccctttacc

SEQ ID NO: 1027144 - DNA, 22 bp, Artificial Sequence
  chemically synthesized
gttgcgttgctccctttaccat

SEQ ID NO: 1027145 - DNA, 22 bp, Artificial Sequence
  chemically synthesized
ttgcgttgctccctttaccatt

SEQ ID NO: 1027146 - DNA, 22 bp, Artificial Sequence
  chemically synthesized
cgttgctccctttaccattatg

SEQ ID NO: 1027147 - DNA, 22 bp, Artificial Sequence
  chemically synthesized
ctccctttaccattatgtaatg

SEQ ID NO: 1027148 - DNA, 22 bp, Artificial Sequence
  chemically synthesized
cctttaccattatgtaatgtaa

SEQ ID NO: 1027149 - DNA, 22 bp, Artificial Sequence
  chemically synthesized
taccattatgtaatgtaatacc

SEQ ID NO: 1027150 - DNA, 22 bp, Artificial Sequence
  chemically synthesized
accattatgtaatgtaataccc

SEQ ID NO: 1027151 - DNA, 22 bp, Artificial Sequence
  chemically synthesized
ccattatgtaatgtaataccct

SEQ ID NO: 1027152 - DNA, 22 bp, Artificial Sequence
  chemically synthesized
tgtaatgtaatacccttctttg

SEQ ID NO: 1027153 - DNA, 22 bp, Artificial Sequence
  chemically synthesized
aaccaacaaagatcaagaaaga

SEQ ID NO: 1027154 - DNA, 22 bp, Artificial Sequence
  chemically synthesized
aaaccaacaaagatcaagaaag

SEQ ID NO: 1027155 - DNA, 22 bp, Artificial Sequence
  chemically synthesized
taaaccaacaaagatcaagaaa

SEQ ID NO: 1027156 - DNA, 22 bp, Artificial Sequence
  chemically synthesized
ctttgtctttcttgatctttgt

SEQ ID NO: 1027157 - DNA, 22 bp, Artificial Sequence
  chemically synthesized
tttgtctttcttgatctttgtt

SEQ ID NO: 1027158 - DNA, 22 bp, Artificial Sequence
  chemically synthesized
tgtctttcttgatctttgttgg

SEQ ID NO: 1027159 - DNA, 22 bp, Artificial Sequence
  chemically synthesized
gtctttcttgatctttgttggt

SEQ ID NO: 1027160 - DNA, 22 bp, Artificial Sequence
  chemically synthesized
tctttcttgatctttgttggtt

SEQ ID NO: 1027161 - DNA, 22 bp, Artificial Sequence
  chemically synthesized
ataaaacagactttaaaccaac

SEQ ID NO: 1027162 - DNA, 22 bp, Artificial Sequence
  chemically synthesized
tcttgatctttgttggtttaaa

SEQ ID NO: 1027163 - DNA, 22 bp, Artificial Sequence
  chemically synthesized
cttgatctttgttggtttaaag

SEQ ID NO: 1027164 - DNA, 22 bp, Artificial Sequence
  chemically synthesized
tgataaaacagactttaaacca

SEQ ID NO: 1027165 - DNA, 22 bp, Artificial Sequence
  chemically synthesized
ttgatctttgttggtttaaagt

SEQ ID NO: 1027166 - DNA, 22 bp, Artificial Sequence
  chemically synthesized
gatctttgttggtttaaagtct

SEQ ID NO: 1027167 - DNA, 22 bp, Artificial Sequence
  chemically synthesized
atctttgttggtttaaagtctg

SEQ ID NO: 1027168 - DNA, 22 bp, Artificial Sequence
  chemically synthesized
gtctctgataaaacagacttta

SEQ ID NO: 1027169 - DNA, 22 bp, Artificial Sequence
  chemically synthesized
tgttggtttaaagtctgtttta

SEQ ID NO: 1027170 - DNA, 22 bp, Artificial Sequence
  chemically synthesized
gttggtttaaagtctgttttat

SEQ ID NO: 1027171 - DNA, 22 bp, Artificial Sequence
  chemically synthesized
ttggtttaaagtctgttttatc

SEQ ID NO: 1027172 - DNA, 22 bp, Artificial Sequence
  chemically synthesized
caatcctagtctctgataaaac

SEQ ID NO: 1027173 - DNA, 22 bp, Artificial Sequence
  chemically synthesized
gtttaaagtctgttttatcaga

SEQ ID NO: 1027174 - DNA, 22 bp, Artificial Sequence
  chemically synthesized
aaagtctgttttatcagagact

SEQ ID NO: 1027175 - DNA, 22 bp, Artificial Sequence
  chemically synthesized
aagtctgttttatcagagacta

SEQ ID NO: 1027176 - DNA, 22 bp, Artificial Sequence
  chemically synthesized
ttttatcagagactaggattgt

SEQ ID NO: 1027177 - DNA, 22 bp, Artificial Sequence
  chemically synthesized
tatcagagactaggattgtaac

SEQ ID NO: 1027178 - DNA, 22 bp, Artificial Sequence
  chemically synthesized
atcagagactaggattgtaacc

SEQ ID NO: 1027179 - DNA, 22 bp, Artificial Sequence
  chemically synthesized
tcagagactaggattgtaaccc

SEQ ID NO: 1027180 - DNA, 22 bp, Artificial Sequence
  chemically synthesized
ggattgtaacccctgttttttt

SEQ ID NO: 1027181 - DNA, 22 bp, Artificial Sequence
  chemically synthesized
aaaaaaataaaaaaaaaaacag

SEQ ID NO: 1027182 - DNA, 22 bp, Artificial Sequence
  chemically synthesized
taacccctgtttttttttttat

SEQ ID NO: 1027183 - DNA, 22 bp, Artificial Sequence
  chemically synthesized
tttttttttttattttttttaa

SEQ ID NO: 1027184 - DNA, 22 bp, Artificial Sequence
  chemically synthesized
ttttttttattttttttaattt

SEQ ID NO: 1027185 - DNA, 22 bp, Artificial Sequence
  chemically synthesized
tttttttattttttttaatttt

SEQ ID NO: 1027186 - DNA, 22 bp, Artificial Sequence
  chemically synthesized
ttttttattttttttaattttt

SEQ ID NO: 1027187 - DNA, 22 bp, Artificial Sequence
  chemically synthesized
tttttattttttttaatttttt

SEQ ID NO: 1027188 - DNA, 22 bp, Artificial Sequence
  chemically synthesized
ttttattttttttaatttttta

SEQ ID NO: 1027189 - DNA, 22 bp, Artificial Sequence
  chemically synthesized
tttattttttttaattttttat

SEQ ID NO: 1027190 - DNA, 22 bp, Artificial Sequence
  chemically synthesized
ttattttttttaattttttatt

SEQ ID NO: 1027191 - DNA, 22 bp, Artificial Sequence
  chemically synthesized
tattttttttaattttttattt

SEQ ID NO: 1027192 - DNA, 22 bp, Artificial Sequence
  chemically synthesized
attttttttaattttttatttt

SEQ ID NO: 1027193 - DNA, 22 bp, Artificial Sequence
  chemically synthesized
ttttttttaattttttattttt

SEQ ID NO: 1027194 - DNA, 22 bp, Artificial Sequence
  chemically synthesized
tttttaattttttatttttttg

SEQ ID NO: 1027195 - DNA, 22 bp, Artificial Sequence
  chemically synthesized
ttttaattttttatttttttgc

SEQ ID NO: 1027196 - DNA, 22 bp, Artificial Sequence
  chemically synthesized
tttaattttttatttttttgct

SEQ ID NO: 1027197 - DNA, 22 bp, Artificial Sequence
  chemically synthesized
ttaattttttatttttttgctt

SEQ ID NO: 1027198 - DNA, 22 bp, Artificial Sequence
  chemically synthesized
caagcaaatggaaagcaaaaaa

SEQ ID NO: 1027199 - DNA, 22 bp, Artificial Sequence
  chemically synthesized
taattttttatttttttgcttt

SEQ ID NO: 1027200 - DNA, 22 bp, Artificial Sequence
  chemically synthesized
ccaagcaaatggaaagcaaaaa

SEQ ID NO: 1027201 - DNA, 22 bp, Artificial Sequence
  chemically synthesized
aattttttatttttttgctttc

SEQ ID NO: 1027202 - DNA, 22 bp, Artificial Sequence
  chemically synthesized
tccaagcaaatggaaagcaaaa

SEQ ID NO: 1027203 - DNA, 22 bp, Artificial Sequence
  chemically synthesized
attttttatttttttgctttcc

SEQ ID NO: 1027204 - DNA, 22 bp, Artificial Sequence
  chemically synthesized
tttatttttttgctttccattt

SEQ ID NO: 1027205 - DNA, 22 bp, Artificial Sequence
  chemically synthesized
ttatttttttgctttccatttg

SEQ ID NO: 1027206 - DNA, 22 bp, Artificial Sequence
  chemically synthesized
tatttttttgctttccatttgc

SEQ ID NO: 1027207 - DNA, 22 bp, Artificial Sequence
  chemically synthesized
atttttttgctttccatttgct

SEQ ID NO: 1027208 - DNA, 22 bp, Artificial Sequence
  chemically synthesized
tttttttgctttccatttgctt

SEQ ID NO: 1027209 - DNA, 22 bp, Artificial Sequence
  chemically synthesized
ttttgctttccatttgcttgga

SEQ ID NO: 1027210 - DNA, 22 bp, Artificial Sequence
  chemically synthesized
tttgctttccatttgcttggaa

SEQ ID NO: 1027211 - DNA, 22 bp, Artificial Sequence
  chemically synthesized
ttgctttccatttgcttggaaa

SEQ ID NO: 1027212 - DNA, 22 bp, Artificial Sequence
  chemically synthesized
tgctttccatttgcttggaaaa

SEQ ID NO: 1027213 - DNA, 22 bp, Artificial Sequence
  chemically synthesized
gctttccatttgcttggaaaat

SEQ ID NO: 1027214 - DNA, 22 bp, Artificial Sequence
  chemically synthesized
ctttccatttgcttggaaaata

SEQ ID NO: 1027215 - DNA, 22 bp, Artificial Sequence
  chemically synthesized
tccatttgcttggaaaatattc

SEQ ID NO: 1027216 - DNA, 22 bp, Artificial Sequence
  chemically synthesized
ccatttgcttggaaaatattcc

SEQ ID NO: 1027217 - DNA, 22 bp, Artificial Sequence
  chemically synthesized
catttgcttggaaaatattccg

SEQ ID NO: 1027218 - DNA, 22 bp, Artificial Sequence
  chemically synthesized
aaagcaaagggatggcggaata

SEQ ID NO: 1027219 - DNA, 22 bp, Artificial Sequence
  chemically synthesized
gcttggaaaatattccgccatc

SEQ ID NO: 1027220 - DNA, 22 bp, Artificial Sequence
  chemically synthesized
cttggaaaatattccgccatcc

SEQ ID NO: 1027221 - DNA, 22 bp, Artificial Sequence
  chemically synthesized
ggaaaatattccgccatccctt

SEQ ID NO: 1027222 - DNA, 22 bp, Artificial Sequence
  chemically synthesized
gaaaatattccgccatcccttt

SEQ ID NO: 1027223 - DNA, 22 bp, Artificial Sequence
  chemically synthesized
cgccatccctttgctttgagcc

SEQ ID NO: 1027224 - DNA, 22 bp, Artificial Sequence
  chemically synthesized
acatgcaaacacacacataggc

SEQ ID NO: 1027225 - DNA, 22 bp, Artificial Sequence
  chemically synthesized
tgctttgagcctatgtgtgtgt

SEQ ID NO: 1027226 - DNA, 22 bp, Artificial Sequence
  chemically synthesized
gctttgagcctatgtgtgtgtt

SEQ ID NO: 1027227 - DNA, 22 bp, Artificial Sequence
  chemically synthesized
ctttgagcctatgtgtgtgttt

SEQ ID NO: 1027228 - DNA, 22 bp, Artificial Sequence
  chemically synthesized
tgagcctatgtgtgtgtttgca

SEQ ID NO: 1027229 - DNA, 22 bp, Artificial Sequence
  chemically synthesized
gagcctatgtgtgtgtttgcat

SEQ ID NO: 1027230 - DNA, 22 bp, Artificial Sequence
  chemically synthesized
agcctatgtgtgtgtttgcatg

SEQ ID NO: 1027231 - DNA, 22 bp, Artificial Sequence
  chemically synthesized
aggagacccatctcacatgcaa

SEQ ID NO: 1027232 - DNA, 22 bp, Artificial Sequence
  chemically synthesized
tgtgtgtgtttgcatgtgagat

SEQ ID NO: 1027233 - DNA, 22 bp, Artificial Sequence
  chemically synthesized
gcatgtgagatgggtctcctga

SEQ ID NO: 1027234 - DNA, 22 bp, Artificial Sequence
  chemically synthesized
catgtgagatgggtctcctgaa

SEQ ID NO: 1027235 - DNA, 22 bp, Artificial Sequence
  chemically synthesized
ctgaatacaccacactgatggt

SEQ ID NO: 1027236 - DNA, 22 bp, Artificial Sequence
  chemically synthesized
gataaagagtcaggaccatcag

SEQ ID NO: 1027237 - DNA, 22 bp, Artificial Sequence
  chemically synthesized
aatacaccacactgatggtcct

SEQ ID NO: 1027238 - DNA, 22 bp, Artificial Sequence
  chemically synthesized
gcaaattggataaagagtcagg

SEQ ID NO: 1027239 - DNA, 22 bp, Artificial Sequence
  chemically synthesized
atggtcctgactctttatccaa

SEQ ID NO: 1027240 - DNA, 22 bp, Artificial Sequence
  chemically synthesized
aaagacacagactggcaaattg

SEQ ID NO: 1027241 - DNA, 22 bp, Artificial Sequence
  chemically synthesized
actctttatccaatttgccagt

SEQ ID NO: 1027242 - DNA, 22 bp, Artificial Sequence
  chemically synthesized
tttatccaatttgccagtctgt

SEQ ID NO: 1027243 - DNA, 22 bp, Artificial Sequence
  chemically synthesized
tatccaatttgccagtctgtgt

SEQ ID NO: 1027244 - DNA, 22 bp, Artificial Sequence
  chemically synthesized
atccaatttgccagtctgtgtc

SEQ ID NO: 1027245 - DNA, 22 bp, Artificial Sequence
  chemically synthesized
tccaatttgccagtctgtgtct

SEQ ID NO: 1027246 - DNA, 22 bp, Artificial Sequence
  chemically synthesized
aatgccccaattaaaagacaca

SEQ ID NO: 1027247 - DNA, 22 bp, Artificial Sequence
  chemically synthesized
gccagtctgtgtcttttaattg

SEQ ID NO: 1027248 - DNA, 22 bp, Artificial Sequence
  chemically synthesized
ccagtctgtgtcttttaattgg

SEQ ID NO: 1027249 - DNA, 22 bp, Artificial Sequence
  chemically synthesized
tgtcttttaattggggcattta

SEQ ID NO: 1027250 - DNA, 22 bp, Artificial Sequence
  chemically synthesized
aatgtaaatgggctaaatgccc

SEQ ID NO: 1027251 - DNA, 22 bp, Artificial Sequence
  chemically synthesized
aaatgtaaatgggctaaatgcc

SEQ ID NO: 1027252 - DNA, 22 bp, Artificial Sequence
  chemically synthesized
taaatgtaaatgggctaaatgc

SEQ ID NO: 1027253 - DNA, 22 bp, Artificial Sequence
  chemically synthesized
ttaattggggcatttagcccat

SEQ ID NO: 1027254 - DNA, 22 bp, Artificial Sequence
  chemically synthesized
taattggggcatttagcccatt

SEQ ID NO: 1027255 - DNA, 22 bp, Artificial Sequence
  chemically synthesized
actttaaatgtaaatgggctaa

SEQ ID NO: 1027256 - DNA, 22 bp, Artificial Sequence
  chemically synthesized
aattggggcatttagcccattt

SEQ ID NO: 1027257 - DNA, 22 bp, Artificial Sequence
  chemically synthesized
attggggcatttagcccattta

SEQ ID NO: 1027258 - DNA, 22 bp, Artificial Sequence
  chemically synthesized
gggcatttagcccatttacatt

SEQ ID NO: 1027259 - DNA, 22 bp, Artificial Sequence
  chemically synthesized
agcccatttacatttaaagtta

SEQ ID NO: 1027260 - DNA, 22 bp, Artificial Sequence
  chemically synthesized
gcccatttacatttaaagttaa

SEQ ID NO: 1027261 - DNA, 22 bp, Artificial Sequence
  chemically synthesized
acacatgacaatattaacttta

SEQ ID NO: 1027262 - DNA, 22 bp, Artificial Sequence
  chemically synthesized
acatttaaagttaatattgtca

SEQ ID NO: 1027263 - DNA, 22 bp, Artificial Sequence
  chemically synthesized
catttaaagttaatattgtcat

SEQ ID NO: 1027264 - DNA, 22 bp, Artificial Sequence
  chemically synthesized
aaagttaatattgtcatgtgtg

SEQ ID NO: 1027265 - DNA, 22 bp, Artificial Sequence
  chemically synthesized
caggatcacattcacacatgac

SEQ ID NO: 1027266 - DNA, 22 bp, Artificial Sequence
  chemically synthesized
aagttaatattgtcatgtgtga

SEQ ID NO: 1027267 - DNA, 22 bp, Artificial Sequence
  chemically synthesized
atattgtcatgtgtgaatgtga

SEQ ID NO: 1027268 - DNA, 22 bp, Artificial Sequence
  chemically synthesized
tcatgtgtgaatgtgatcctgt

SEQ ID NO: 1027269 - DNA, 22 bp, Artificial Sequence
  chemically synthesized
accaacatcataattacaggat

SEQ ID NO: 1027270 - DNA, 22 bp, Artificial Sequence
  chemically synthesized
acaggcaaaataactaaccaac

SEQ ID NO: 1027271 - DNA, 22 bp, Artificial Sequence
  chemically synthesized
taattatgatgttggttagtta

SEQ ID NO: 1027272 - DNA, 22 bp, Artificial Sequence
  chemically synthesized
aactaacaggcaaaataactaa

SEQ ID NO: 1027273 - DNA, 22 bp, Artificial Sequence
  chemically synthesized
tgatgttggttagttattttgc

SEQ ID NO: 1027274 - DNA, 22 bp, Artificial Sequence
  chemically synthesized
cctcaactaacaggcaaaataa

SEQ ID NO: 1027275 - DNA, 22 bp, Artificial Sequence
  chemically synthesized
gttagttattttgcctgttagt

SEQ ID NO: 1027276 - DNA, 22 bp, Artificial Sequence
  chemically synthesized
gttattttgcctgttagttgag

SEQ ID NO: 1027277 - DNA, 22 bp, Artificial Sequence
  chemically synthesized
tgaagaaactgcctcaactaac

SEQ ID NO: 1027278 - DNA, 22 bp, Artificial Sequence
  chemically synthesized
ttttgcctgttagttgaggcag

SEQ ID NO: 1027279 - DNA, 22 bp, Artificial Sequence
  chemically synthesized
tgcctgttagttgaggcagttt

SEQ ID NO: 1027280 - DNA, 22 bp, Artificial Sequence
  chemically synthesized
gcctgttagttgaggcagtttc

SEQ ID NO: 1027281 - DNA, 22 bp, Artificial Sequence
  chemically synthesized
cctgttagttgaggcagtttct

SEQ ID NO: 1027282 - DNA, 22 bp, Artificial Sequence
  chemically synthesized
ttagttgaggcagtttcttcat

SEQ ID NO: 1027283 - DNA, 22 bp, Artificial Sequence
  chemically synthesized
gttgaggcagtttcttcatagg

SEQ ID NO: 1027284 - DNA, 22 bp, Artificial Sequence
  chemically synthesized
taaagaccatcgaccctatgaa

SEQ ID NO: 1027285 - DNA, 22 bp, Artificial Sequence
  chemically synthesized
aggcagtttcttcatagggtcg

SEQ ID NO: 1027286 - DNA, 22 bp, Artificial Sequence
  chemically synthesized
cttcatagggtcgatggtcttt

SEQ ID NO: 1027287 - DNA, 22 bp, Artificial Sequence
  chemically synthesized
ttcatagggtcgatggtcttta

SEQ ID NO: 1027288 - DNA, 22 bp, Artificial Sequence
  chemically synthesized
catagggtcgatggtctttaca

SEQ ID NO: 1027289 - DNA, 22 bp, Artificial Sequence
  chemically synthesized
atagggtcgatggtctttacaa

SEQ ID NO: 1027290 - DNA, 22 bp, Artificial Sequence
  chemically synthesized
agagaaacataccaaattgtaa

SEQ ID NO: 1027291 - DNA, 22 bp, Artificial Sequence
  chemically synthesized
tacaatttggtatgtttctctc

SEQ ID NO: 1027292 - DNA, 22 bp, Artificial Sequence
  chemically synthesized
acaatttggtatgtttctctca

SEQ ID NO: 1027293 - DNA, 22 bp, Artificial Sequence
  chemically synthesized
caatttggtatgtttctctcag

SEQ ID NO: 1027294 - DNA, 22 bp, Artificial Sequence
  chemically synthesized
ggtatgtttctctcagtggctg

SEQ ID NO: 1027295 - DNA, 22 bp, Artificial Sequence
  chemically synthesized
gtatgtttctctcagtggctgg

SEQ ID NO: 1027296 - DNA, 22 bp, Artificial Sequence
  chemically synthesized
ctctcagtggctggtaccggtt

SEQ ID NO: 1027297 - DNA, 22 bp, Artificial Sequence
  chemically synthesized
tctcagtggctggtaccggttt

SEQ ID NO: 1027298 - DNA, 22 bp, Artificial Sequence
  chemically synthesized
tcagtggctggtaccggttttt

SEQ ID NO: 1027299 - DNA, 22 bp, Artificial Sequence
  chemically synthesized
aacatggaaaggaaaaaccggt

SEQ ID NO: 1027300 - DNA, 22 bp, Artificial Sequence
  chemically synthesized
agtggctggtaccggtttttcc

SEQ ID NO: 1027301 - DNA, 22 bp, Artificial Sequence
  chemically synthesized
gtaccggtttttcctttccatg

SEQ ID NO: 1027302 - DNA, 22 bp, Artificial Sequence
  chemically synthesized
aaggaatcactaaacatggaaa

SEQ ID NO: 1027303 - DNA, 22 bp, Artificial Sequence
  chemically synthesized
ctgaaggaatcactaaacatgg

SEQ ID NO: 1027304 - DNA, 22 bp, Artificial Sequence
  chemically synthesized
ttcctttccatgtttagtgatt

SEQ ID NO: 1027305 - DNA, 22 bp, Artificial Sequence
  chemically synthesized
tcctttccatgtttagtgattc

SEQ ID NO: 1027306 - DNA, 22 bp, Artificial Sequence
  chemically synthesized
cctttccatgtttagtgattcc

SEQ ID NO: 1027307 - DNA, 22 bp, Artificial Sequence
  chemically synthesized
ctttccatgtttagtgattcct

SEQ ID NO: 1027308 - DNA, 22 bp, Artificial Sequence
  chemically synthesized
caagagctcctgaaggaatcac

SEQ ID NO: 1027309 - DNA, 22 bp, Artificial Sequence
  chemically synthesized
acaagagctcctgaaggaatca

SEQ ID NO: 1027310 - DNA, 22 bp, Artificial Sequence
  chemically synthesized
tccatgtttagtgattccttca

SEQ ID NO: 1027311 - DNA, 22 bp, Artificial Sequence
  chemically synthesized
ccatgtttagtgattccttcag

SEQ ID NO: 1027312 - DNA, 22 bp, Artificial Sequence
  chemically synthesized
catgtttagtgattccttcagg

SEQ ID NO: 1027313 - DNA, 22 bp, Artificial Sequence
  chemically synthesized
gcttacaagagctcctgaagga

SEQ ID NO: 1027314 - DNA, 22 bp, Artificial Sequence
  chemically synthesized
agtgattccttcaggagctctt

SEQ ID NO: 1027315 - DNA, 22 bp, Artificial Sequence
  chemically synthesized
gtgattccttcaggagctcttg

SEQ ID NO: 1027316 - DNA, 22 bp, Artificial Sequence
  chemically synthesized
cttcaggagctcttgtaagcca

SEQ ID NO: 1027317 - DNA, 22 bp, Artificial Sequence
  chemically synthesized
tcaccaccaggcctggcttaca

SEQ ID NO: 1027318 - DNA, 22 bp, Artificial Sequence
  chemically synthesized
gtcaccaccaggcctggcttac

SEQ ID NO: 1027319 - DNA, 22 bp, Artificial Sequence
  chemically synthesized
caggagctcttgtaagccaggc

SEQ ID NO: 1027320 - DNA, 22 bp, Artificial Sequence
  chemically synthesized
tgtcaccaccaggcctggctta

SEQ ID NO: 1027321 - DNA, 22 bp, Artificial Sequence
  chemically synthesized
aggagctcttgtaagccaggcc

SEQ ID NO: 1027322 - DNA, 22 bp, Artificial Sequence
  chemically synthesized
agtgattttgtcaccaccaggc

SEQ ID NO: 1027323 - DNA, 22 bp, Artificial Sequence
  chemically synthesized
ttgtaagccaggcctggtggtg

SEQ ID NO: 1027324 - DNA, 22 bp, Artificial Sequence
  chemically synthesized
gtaagccaggcctggtggtgac

SEQ ID NO: 1027325 - DNA, 22 bp, Artificial Sequence
  chemically synthesized
taagccaggcctggtggtgaca

SEQ ID NO: 1027326 - DNA, 22 bp, Artificial Sequence
  chemically synthesized
gtggtgacaaaatcactcagca

SEQ ID NO: 1027327 - DNA, 22 bp, Artificial Sequence
  chemically synthesized
cagacaagcaaatgctgagtga

SEQ ID NO: 1027328 - DNA, 22 bp, Artificial Sequence
  chemically synthesized
acagacaagcaaatgctgagtg

SEQ ID NO: 1027329 - DNA, 22 bp, Artificial Sequence
  chemically synthesized
tacagacaagcaaatgctgagt

SEQ ID NO: 1027330 - DNA, 22 bp, Artificial Sequence
  chemically synthesized
agcatttgcttgtctgtaaagg

SEQ ID NO: 1027331 - DNA, 22 bp, Artificial Sequence
  chemically synthesized
gcttgtctgtaaaggattttat

SEQ ID NO: 1027332 - DNA, 22 bp, Artificial Sequence
  chemically synthesized
cttgtctgtaaaggattttatt

SEQ ID NO: 1027333 - DNA, 22 bp, Artificial Sequence
  chemically synthesized
ataagcaaaggagaaataaaat

SEQ ID NO: 1027334 - DNA, 22 bp, Artificial Sequence
  chemically synthesized
gtctgtaaaggattttatttct

SEQ ID NO: 1027335 - DNA, 22 bp, Artificial Sequence
  chemically synthesized
cataagcaaaggagaaataaaa

SEQ ID NO: 1027336 - DNA, 22 bp, Artificial Sequence
  chemically synthesized
tctgtaaaggattttatttctc

SEQ ID NO: 1027337 - DNA, 22 bp, Artificial Sequence
  chemically synthesized
taaaggattttatttctccttt

SEQ ID NO: 1027338 - DNA, 22 bp, Artificial Sequence
  chemically synthesized
agtttcataagcaaaggagaaa

SEQ ID NO: 1027339 - DNA, 22 bp, Artificial Sequence
  chemically synthesized
tatttctcctttgcttatgaaa

SEQ ID NO: 1027340 - DNA, 22 bp, Artificial Sequence
  chemically synthesized
atttctcctttgcttatgaaac

SEQ ID NO: 1027341 - DNA, 22 bp, Artificial Sequence
  chemically synthesized
tttctcctttgcttatgaaact

SEQ ID NO: 1027342 - DNA, 22 bp, Artificial Sequence
  chemically synthesized
ctcctttgcttatgaaacttag

SEQ ID NO: 1027343 - DNA, 22 bp, Artificial Sequence
  chemically synthesized
tcctttgcttatgaaacttagt

SEQ ID NO: 1027344 - DNA, 22 bp, Artificial Sequence
  chemically synthesized
atatccagccaaactaagtttc

SEQ ID NO: 1027345 - DNA, 22 bp, Artificial Sequence
  chemically synthesized
catatccagccaaactaagttt

SEQ ID NO: 1027346 - DNA, 22 bp, Artificial Sequence
  chemically synthesized
ctttgcttatgaaacttagttt

SEQ ID NO: 1027347 - DNA, 22 bp, Artificial Sequence
  chemically synthesized
tgcttatgaaacttagtttggc

SEQ ID NO: 1027348 - DNA, 22 bp, Artificial Sequence
  chemically synthesized
gcttatgaaacttagtttggct

SEQ ID NO: 1027349 - DNA, 22 bp, Artificial Sequence
  chemically synthesized
cttatgaaacttagtttggctg

SEQ ID NO: 1027350 - DNA, 22 bp, Artificial Sequence
  chemically synthesized
atgaaacttagtttggctggat

SEQ ID NO: 1027351 - DNA, 22 bp, Artificial Sequence
  chemically synthesized
tgaaacttagtttggctggata

SEQ ID NO: 1027352 - DNA, 22 bp, Artificial Sequence
  chemically synthesized
aacccagaatttcatatccagc

SEQ ID NO: 1027353 - DNA, 22 bp, Artificial Sequence
  chemically synthesized
caacccagaatttcatatccag

SEQ ID NO: 1027354 - DNA, 22 bp, Artificial Sequence
  chemically synthesized
tcaacccagaatttcatatcca

SEQ ID NO: 1027355 - DNA, 22 bp, Artificial Sequence
  chemically synthesized
agtttggctggatatgaaattc

SEQ ID NO: 1027356 - DNA, 22 bp, Artificial Sequence
  chemically synthesized
gtttggctggatatgaaattct

SEQ ID NO: 1027357 - DNA, 22 bp, Artificial Sequence
  chemically synthesized
ggctggatatgaaattctgggt

SEQ ID NO: 1027358 - DNA, 22 bp, Artificial Sequence
  chemically synthesized
gctggatatgaaattctgggtt

SEQ ID NO: 1027359 - DNA, 22 bp, Artificial Sequence
  chemically synthesized
aataagggaattttcaacccag

SEQ ID NO: 1027360 - DNA, 22 bp, Artificial Sequence
  chemically synthesized
gatatgaaattctgggttgaaa

SEQ ID NO: 1027361 - DNA, 22 bp, Artificial Sequence
  chemically synthesized
caataagggaattttcaaccca

SEQ ID NO: 1027362 - DNA, 22 bp, Artificial Sequence
  chemically synthesized
ttcaataagggaattttcaacc

SEQ ID NO: 1027363 - DNA, 22 bp, Artificial Sequence
  chemically synthesized
aacactcttcaataagggaatt

SEQ ID NO: 1027364 - DNA, 22 bp, Artificial Sequence
  chemically synthesized
tgggttgaaaattcccttattg

SEQ ID NO: 1027365 - DNA, 22 bp, Artificial Sequence
  chemically synthesized
ggttgaaaattcccttattgaa

SEQ ID NO: 1027366 - DNA, 22 bp, Artificial Sequence
  chemically synthesized
aaaattcccttattgaagagtg

SEQ ID NO: 1027367 - DNA, 22 bp, Artificial Sequence
  chemically synthesized
ccttattgaagagtgttgaata

SEQ ID NO: 1027368 - DNA, 22 bp, Artificial Sequence
  chemically synthesized
attgaagagtgttgaatattgg

SEQ ID NO: 1027369 - DNA, 22 bp, Artificial Sequence
  chemically synthesized
ttgaagagtgttgaatattggc

SEQ ID NO: 1027370 - DNA, 22 bp, Artificial Sequence
  chemically synthesized
gaagagagtgggtgccaatatt

SEQ ID NO: 1027371 - DNA, 22 bp, Artificial Sequence
  chemically synthesized
aagagtgttgaatattggcacc

SEQ ID NO: 1027372 - DNA, 22 bp, Artificial Sequence
  chemically synthesized
caagctagaagagagtgggtgc

SEQ ID NO: 1027373 - DNA, 22 bp, Artificial Sequence
  chemically synthesized
aatattggcacccactctcttc

SEQ ID NO: 1027374 - DNA, 22 bp, Artificial Sequence
  chemically synthesized
cagaaaccctacaagctagaag

SEQ ID NO: 1027375 - DNA, 22 bp, Artificial Sequence
  chemically synthesized
gcacccactctcttctagcttg

SEQ ID NO: 1027376 - DNA, 22 bp, Artificial Sequence
  chemically synthesized
tgcagaaaccctacaagctaga

SEQ ID NO: 1027377 - DNA, 22 bp, Artificial Sequence
  chemically synthesized
tcttctagcttgtagggtttct

SEQ ID NO: 1027378 - DNA, 22 bp, Artificial Sequence
  chemically synthesized
ttctagcttgtagggtttctgc

SEQ ID NO: 1027379 - DNA, 22 bp, Artificial Sequence
  chemically synthesized
ctagcttgtagggtttctgcag

SEQ ID NO: 1027380 - DNA, 22 bp, Artificial Sequence
  chemically synthesized
tagcttgtagggtttctgcaga

SEQ ID NO: 1027381 - DNA, 22 bp, Artificial Sequence
  chemically synthesized
acagtggatcactctgcagaaa

SEQ ID NO: 1027382 - DNA, 22 bp, Artificial Sequence
  chemically synthesized
gcttgtagggtttctgcagagt

SEQ ID NO: 1027383 - DNA, 22 bp, Artificial Sequence
  chemically synthesized
gtagggtttctgcagagtgatc

SEQ ID NO: 1027384 - DNA, 22 bp, Artificial Sequence
  chemically synthesized
tagggtttctgcagagtgatcc

SEQ ID NO: 1027385 - DNA, 22 bp, Artificial Sequence
  chemically synthesized
ctgcagagtgatccactgttag

SEQ ID NO: 1027386 - DNA, 22 bp, Artificial Sequence
  chemically synthesized
tgcagagtgatccactgttagt

SEQ ID NO: 1027387 - DNA, 22 bp, Artificial Sequence
  chemically synthesized
cagagtgatccactgttagtct

SEQ ID NO: 1027388 - DNA, 22 bp, Artificial Sequence
  chemically synthesized
cccacaaagggaagcccatcag

SEQ ID NO: 1027389 - DNA, 22 bp, Artificial Sequence
  chemically synthesized
ggttacccacaaagggaagccc

SEQ ID NO: 1027390 - DNA, 22 bp, Artificial Sequence
  chemically synthesized
ttagtctgatgggcttcccttt

SEQ ID NO: 1027391 - DNA, 22 bp, Artificial Sequence
  chemically synthesized
gtctgatgggcttccctttgtg

SEQ ID NO: 1027392 - DNA, 22 bp, Artificial Sequence
  chemically synthesized
atgggcttccctttgtgggtaa

SEQ ID NO: 1027393 - DNA, 22 bp, Artificial Sequence
  chemically synthesized
ccctttgtgggtaacccagcct

SEQ ID NO: 1027394 - DNA, 22 bp, Artificial Sequence
  chemically synthesized
cctttgtgggtaacccagcctt

SEQ ID NO: 1027395 - DNA, 22 bp, Artificial Sequence
  chemically synthesized
tgtgggtaacccagcctttctc

SEQ ID NO: 1027396 - DNA, 22 bp, Artificial Sequence
  chemically synthesized
ggggcagccagagagaaaggct

SEQ ID NO: 1027397 - DNA, 22 bp, Artificial Sequence
  chemically synthesized
gtgggtaacccagcctttctct

SEQ ID NO: 1027398 - DNA, 22 bp, Artificial Sequence
  chemically synthesized
tgggtaacccagcctttctctc

SEQ ID NO: 1027399 - DNA, 22 bp, Artificial Sequence
  chemically synthesized
gtaatgttaggggcagccagag

SEQ ID NO: 1027400 - DNA, 22 bp, Artificial Sequence
  chemically synthesized
ctcgtaatgttaggggcagcca

SEQ ID NO: 1027401 - DNA, 22 bp, Artificial Sequence
  chemically synthesized
tctctctggctgcccctaacat

SEQ ID NO: 1027402 - DNA, 22 bp, Artificial Sequence
  chemically synthesized
aagttgctcgtaatgttagggg

SEQ ID NO: 1027403 - DNA, 22 bp, Artificial Sequence
  chemically synthesized
ctctctggctgcccctaacatt

SEQ ID NO: 1027404 - DNA, 22 bp, Artificial Sequence
  chemically synthesized
tctctggctgcccctaacatta

SEQ ID NO: 1027405 - DNA, 22 bp, Artificial Sequence
  chemically synthesized
tctggctgcccctaacattacg

SEQ ID NO: 1027406 - DNA, 22 bp, Artificial Sequence
  chemically synthesized
gctgaagttgctcgtaatgtta

SEQ ID NO: 1027407 - DNA, 22 bp, Artificial Sequence
  chemically synthesized
ggctgaagttgctcgtaatgtt

SEQ ID NO: 1027408 - DNA, 22 bp, Artificial Sequence
  chemically synthesized
tggctgcccctaacattacgag

SEQ ID NO: 1027409 - DNA, 22 bp, Artificial Sequence
  chemically synthesized
gctgcccctaacattacgagca

SEQ ID NO: 1027410 - DNA, 22 bp, Artificial Sequence
  chemically synthesized
agacttggctgaagttgctcgt

SEQ ID NO: 1027411 - DNA, 22 bp, Artificial Sequence
  chemically synthesized
cccctaacattacgagcaactt

SEQ ID NO: 1027412 - DNA, 22 bp, Artificial Sequence
  chemically synthesized
tgagacttggctgaagttgctc

SEQ ID NO: 1027413 - DNA, 22 bp, Artificial Sequence
  chemically synthesized
acattacgagcaacttcagcca

SEQ ID NO: 1027414 - DNA, 22 bp, Artificial Sequence
  chemically synthesized
tattctgagacttggctgaagt

SEQ ID NO: 1027415 - DNA, 22 bp, Artificial Sequence
  chemically synthesized
gtattctgagacttggctgaag

SEQ ID NO: 1027416 - DNA, 22 bp, Artificial Sequence
  chemically synthesized
tgtattctgagacttggctgaa

SEQ ID NO: 1027417 - DNA, 22 bp, Artificial Sequence
  chemically synthesized
cgagcaacttcagccaagtctc

SEQ ID NO: 1027418 - DNA, 22 bp, Artificial Sequence
  chemically synthesized
attttgtattctgagacttggc

SEQ ID NO: 1027419 - DNA, 22 bp, Artificial Sequence
  chemically synthesized
gattttgtattctgagacttgg

SEQ ID NO: 1027420 - DNA, 22 bp, Artificial Sequence
  chemically synthesized
tgattttgtattctgagacttg

SEQ ID NO: 1027421 - DNA, 22 bp, Artificial Sequence
  chemically synthesized
actttgattttgtattctgaga

SEQ ID NO: 1027422 - DNA, 22 bp, Artificial Sequence
  chemically synthesized
cactttgattttgtattctgag

SEQ ID NO: 1027423 - DNA, 22 bp, Artificial Sequence
  chemically synthesized
tcactttgattttgtattctga

SEQ ID NO: 1027424 - DNA, 22 bp, Artificial Sequence
  chemically synthesized
ttcactttgattttgtattctg

SEQ ID NO: 1027425 - DNA, 22 bp, Artificial Sequence
  chemically synthesized
cagccaagtctcagaatacaaa

SEQ ID NO: 1027426 - DNA, 22 bp, Artificial Sequence
  chemically synthesized
agccaagtctcagaatacaaaa

SEQ ID NO: 1027427 - DNA, 22 bp, Artificial Sequence
  chemically synthesized
tgatcttttcactttgattttg

SEQ ID NO: 1027428 - DNA, 22 bp, Artificial Sequence
  chemically synthesized
gtgatcttttcactttgatttt

SEQ ID NO: 1027429 - DNA, 22 bp, Artificial Sequence
  chemically synthesized
agaatacaaaatcaaagtgaaa

SEQ ID NO: 1027430 - DNA, 22 bp, Artificial Sequence
  chemically synthesized
gtgtataggaatgcttgtgatc

SEQ ID NO: 1027431 - DNA, 22 bp, Artificial Sequence
  chemically synthesized
ggtgtataggaatgcttgtgat

SEQ ID NO: 1027432 - DNA, 22 bp, Artificial Sequence
  chemically synthesized
ttggtgtataggaatgcttgtg

SEQ ID NO: 1027433 - DNA, 22 bp, Artificial Sequence
  chemically synthesized
ttcttggtgtataggaatgctt

SEQ ID NO: 1027434 - DNA, 22 bp, Artificial Sequence
  chemically synthesized
tctattcttggtgtataggaat

SEQ ID NO: 1027435 - DNA, 22 bp, Artificial Sequence
  chemically synthesized
gtctattcttggtgtataggaa

SEQ ID NO: 1027436 - DNA, 22 bp, Artificial Sequence
  chemically synthesized
tttgtctattcttggtgtatag

SEQ ID NO: 1027437 - DNA, 22 bp, Artificial Sequence
  chemically synthesized
tgtttgtctattcttggtgtat

SEQ ID NO: 1027438 - DNA, 22 bp, Artificial Sequence
  chemically synthesized
tctgtttgtctattcttggtgt

SEQ ID NO: 1027439 - DNA, 22 bp, Artificial Sequence
  chemically synthesized
gctctctgtttgtctattcttg

SEQ ID NO: 1027440 - DNA, 22 bp, Artificial Sequence
  chemically synthesized
ggctctctgtttgtctattctt

SEQ ID NO: 1027441 - DNA, 22 bp, Artificial Sequence
  chemically synthesized
ctatacaccaagaatagacaaa

SEQ ID NO: 1027442 - DNA, 22 bp, Artificial Sequence
  chemically synthesized
tacaccaagaatagacaaacag

SEQ ID NO: 1027443 - DNA, 22 bp, Artificial Sequence
  chemically synthesized
acccacgatttggctctctgtt

SEQ ID NO: 1027444 - DNA, 22 bp, Artificial Sequence
  chemically synthesized
tgaataggagttcacccacgat

SEQ ID NO: 1027445 - DNA, 22 bp, Artificial Sequence
  chemically synthesized
tagcaattgtgaataggagttc

SEQ ID NO: 1027446 - DNA, 22 bp, Artificial Sequence
  chemically synthesized
gtagcaattgtgaataggagtt

SEQ ID NO: 1027447 - DNA, 22 bp, Artificial Sequence
  chemically synthesized
tgtagcaattgtgaataggagt

SEQ ID NO: 1027448 - DNA, 22 bp, Artificial Sequence
  chemically synthesized
tttgtagcaattgtgaatagga

SEQ ID NO: 1027449 - DNA, 22 bp, Artificial Sequence
  chemically synthesized
tctttgtagcaattgtgaatag

SEQ ID NO: 1027450 - DNA, 22 bp, Artificial Sequence
  chemically synthesized
ttctctttgtagcaattgtgaa

SEQ ID NO: 1027451 - DNA, 22 bp, Artificial Sequence
  chemically synthesized
attctctttgtagcaattgtga

SEQ ID NO: 1027452 - DNA, 22 bp, Artificial Sequence
  chemically synthesized
tattctctttgtagcaattgtg

SEQ ID NO: 1027453 - DNA, 22 bp, Artificial Sequence
  chemically synthesized
ctattcacaattgctacaaaga

SEQ ID NO: 1027454 - DNA, 22 bp, Artificial Sequence
  chemically synthesized
ggcactttattctctttgtagc

SEQ ID NO: 1027455 - DNA, 22 bp, Artificial Sequence
  chemically synthesized
ttcacaattgctacaaagagaa

SEQ ID NO: 1027456 - DNA, 22 bp, Artificial Sequence
  chemically synthesized
ctaggcactttattctctttgt

SEQ ID NO: 1027457 - DNA, 22 bp, Artificial Sequence
  chemically synthesized
acaattgctacaaagagaataa

SEQ ID NO: 1027458 - DNA, 22 bp, Artificial Sequence
  chemically synthesized
tattcctaggcactttattctc

SEQ ID NO: 1027459 - DNA, 22 bp, Artificial Sequence
  chemically synthesized
ctacaaagagaataaagtgcct

SEQ ID NO: 1027460 - DNA, 22 bp, Artificial Sequence
  chemically synthesized
taagttgtattcctaggcactt

SEQ ID NO: 1027461 - DNA, 22 bp, Artificial Sequence
  chemically synthesized
caaagagaataaagtgcctagg

SEQ ID NO: 1027462 - DNA, 22 bp, Artificial Sequence
  chemically synthesized
gtaagttgtattcctaggcact

SEQ ID NO: 1027463 - DNA, 22 bp, Artificial Sequence
  chemically synthesized
acatcccttgtaagttgtattc

SEQ ID NO: 1027464 - DNA, 22 bp, Artificial Sequence
  chemically synthesized
cacatcccttgtaagttgtatt

SEQ ID NO: 1027465 - DNA, 22 bp, Artificial Sequence
  chemically synthesized
ggaatacaacttacaagggatg

SEQ ID NO: 1027466 - DNA, 22 bp, Artificial Sequence
  chemically synthesized
aagaggtccttcacatcccttg

SEQ ID NO: 1027467 - DNA, 22 bp, Artificial Sequence
  chemically synthesized
gaagaggtccttcacatccctt

SEQ ID NO: 1027468 - DNA, 22 bp, Artificial Sequence
  chemically synthesized
cttgaagaggtccttcacatcc

SEQ ID NO: 1027469 - DNA, 22 bp, Artificial Sequence
  chemically synthesized
tccttgaagaggtccttcacat

SEQ ID NO: 1027470 - DNA, 22 bp, Artificial Sequence
  chemically synthesized
acaagggatgtgaaggacctct

SEQ ID NO: 1027471 - DNA, 22 bp, Artificial Sequence
  chemically synthesized
caagggatgtgaaggacctctt

SEQ ID NO: 1027472 - DNA, 22 bp, Artificial Sequence
  chemically synthesized
tagttctccttgaagaggtcct

SEQ ID NO: 1027473 - DNA, 22 bp, Artificial Sequence
  chemically synthesized
gtagttctccttgaagaggtcc

SEQ ID NO: 1027474 - DNA, 22 bp, Artificial Sequence
  chemically synthesized
aacagtggtttgtagttctcct

SEQ ID NO: 1027475 - DNA, 22 bp, Artificial Sequence
  chemically synthesized
gaacagtggtttgtagttctcc

SEQ ID NO: 1027476 - DNA, 22 bp, Artificial Sequence
  chemically synthesized
ttgaacagtggtttgtagttct

SEQ ID NO: 1027477 - DNA, 22 bp, Artificial Sequence
  chemically synthesized
cttgaacagtggtttgtagttc

SEQ ID NO: 1027478 - DNA, 22 bp, Artificial Sequence
  chemically synthesized
tcttgaacagtggtttgtagtt

SEQ ID NO: 1027479 - DNA, 22 bp, Artificial Sequence
  chemically synthesized
ttcaaggagaactacaaaccac

SEQ ID NO: 1027480 - DNA, 22 bp, Artificial Sequence
  chemically synthesized
caaggagaactacaaaccactg

SEQ ID NO: 1027481 - DNA, 22 bp, Artificial Sequence
  chemically synthesized
aaggagaactacaaaccactgt

SEQ ID NO: 1027482 - DNA, 22 bp, Artificial Sequence
  chemically synthesized
gtattttcttgaacagtggttt

SEQ ID NO: 1027483 - DNA, 22 bp, Artificial Sequence
  chemically synthesized
cgtattttcttgaacagtggtt

SEQ ID NO: 1027484 - DNA, 22 bp, Artificial Sequence
  chemically synthesized
tcgtattttcttgaacagtggt

SEQ ID NO: 1027485 - DNA, 22 bp, Artificial Sequence
  chemically synthesized
cgtcctttcgtattttcttgaa

SEQ ID NO: 1027486 - DNA, 22 bp, Artificial Sequence
  chemically synthesized
gcgtcctttcgtattttcttga

SEQ ID NO: 1027487 - DNA, 22 bp, Artificial Sequence
  chemically synthesized
caaaccactgttcaagaaaata

SEQ ID NO: 1027488 - DNA, 22 bp, Artificial Sequence
  chemically synthesized
tttgcgtcctttcgtattttct

SEQ ID NO: 1027489 - DNA, 22 bp, Artificial Sequence
  chemically synthesized
gtttgcgtcctttcgtattttc

SEQ ID NO: 1027490 - DNA, 22 bp, Artificial Sequence
  chemically synthesized
catttgtttgcgtcctttcgta

SEQ ID NO: 1027491 - DNA, 22 bp, Artificial Sequence
  chemically synthesized
ccatttgtttgcgtcctttcgt

SEQ ID NO: 1027492 - DNA, 22 bp, Artificial Sequence
  chemically synthesized
ttcaagaaaatacgaaaggacg

SEQ ID NO: 1027493 - DNA, 22 bp, Artificial Sequence
  chemically synthesized
tccatttgtttgcgtcctttcg

SEQ ID NO: 1027494 - DNA, 22 bp, Artificial Sequence
  chemically synthesized
ttccatttgtttgcgtcctttc

SEQ ID NO: 1027495 - DNA, 22 bp, Artificial Sequence
  chemically synthesized
tttccatttgtttgcgtccttt

SEQ ID NO: 1027496 - DNA, 22 bp, Artificial Sequence
  chemically synthesized
aagaaaatacgaaaggacgcaa

SEQ ID NO: 1027497 - DNA, 22 bp, Artificial Sequence
  chemically synthesized
accacgagcatgaaatgttttt

SEQ ID NO: 1027498 - DNA, 22 bp, Artificial Sequence
  chemically synthesized
ctaaccacgagcatgaaatgtt

SEQ ID NO: 1027499 - DNA, 22 bp, Artificial Sequence
  chemically synthesized
cctaaccacgagcatgaaatgt

SEQ ID NO: 1027500 - DNA, 22 bp, Artificial Sequence
  chemically synthesized
ttcctaaccacgagcatgaaat

SEQ ID NO: 1027501 - DNA, 22 bp, Artificial Sequence
  chemically synthesized
attcttcctaaccacgagcatg

SEQ ID NO: 1027502 - DNA, 22 bp, Artificial Sequence
  chemically synthesized
cactgattcttcctaaccacga

SEQ ID NO: 1027503 - DNA, 22 bp, Artificial Sequence
  chemically synthesized
actccactgattcttcctaacc

SEQ ID NO: 1027504 - DNA, 22 bp, Artificial Sequence
  chemically synthesized
cactccactgattcttcctaac

SEQ ID NO: 1027505 - DNA, 22 bp, Artificial Sequence
  chemically synthesized
tcactccactgattcttcctaa

SEQ ID NO: 1027506 - DNA, 22 bp, Artificial Sequence
  chemically synthesized
catgctcgtggttaggaagaat

SEQ ID NO: 1027507 - DNA, 22 bp, Artificial Sequence
  chemically synthesized
atgctcgtggttaggaagaatc

SEQ ID NO: 1027508 - DNA, 22 bp, Artificial Sequence
  chemically synthesized
gtggttaggaagaatcagtgga

SEQ ID NO: 1027509 - DNA, 22 bp, Artificial Sequence
  chemically synthesized
ggaagaatcagtggagtgaaaa

SEQ ID NO: 1027510 - DNA, 22 bp, Artificial Sequence
  chemically synthesized
gacagtatggccattttcactc

SEQ ID NO: 1027511 - DNA, 22 bp, Artificial Sequence
  chemically synthesized
ggacagtatggccattttcact

SEQ ID NO: 1027512 - DNA, 22 bp, Artificial Sequence
  chemically synthesized
atttggacagtatggccatttt

SEQ ID NO: 1027513 - DNA, 22 bp, Artificial Sequence
  chemically synthesized
taaattaatttggacagtatgg

SEQ ID NO: 1027514 - DNA, 22 bp, Artificial Sequence
  chemically synthesized
aatctgtaaattaatttggaca

SEQ ID NO: 1027515 - DNA, 22 bp, Artificial Sequence
  chemically synthesized
gggatagcattgaatctgtaaa

SEQ ID NO: 1027516 - DNA, 22 bp, Artificial Sequence
  chemically synthesized
tccaaattaatttacagattca

SEQ ID NO: 1027517 - DNA, 22 bp, Artificial Sequence
  chemically synthesized
ttggggatagcattgaatctgt

SEQ ID NO: 1027518 - DNA, 22 bp, Artificial Sequence
  chemically synthesized
atttacagattcaatgctatcc

SEQ ID NO: 1027519 - DNA, 22 bp, Artificial Sequence
  chemically synthesized
acagattcaatgctatccccaa

SEQ ID NO: 1027520 - DNA, 22 bp, Artificial Sequence
  chemically synthesized
cagattcaatgctatccccaac

SEQ ID NO: 1027521 - DNA, 22 bp, Artificial Sequence
  chemically synthesized
aatgctatccccaacaggctac

SEQ ID NO: 1027522 - DNA, 22 bp, Artificial Sequence
  chemically synthesized
taaagaaagtcagtggtagcct

SEQ ID NO: 1027523 - DNA, 22 bp, Artificial Sequence
  chemically synthesized
tgtaaagaaagtcagtggtagc

SEQ ID NO: 1027524 - DNA, 22 bp, Artificial Sequence
  chemically synthesized
tccccaacaggctaccactgac

SEQ ID NO: 1027525 - DNA, 22 bp, Artificial Sequence
  chemically synthesized
attctgtaaagaaagtcagtgg

SEQ ID NO: 1027526 - DNA, 22 bp, Artificial Sequence
  chemically synthesized
ctaattctgtaaagaaagtcag

SEQ ID NO: 1027527 - DNA, 22 bp, Artificial Sequence
  chemically synthesized
cctaattctgtaaagaaagtca

SEQ ID NO: 1027528 - DNA, 22 bp, Artificial Sequence
  chemically synthesized
tcctaattctgtaaagaaagtc

SEQ ID NO: 1027529 - DNA, 22 bp, Artificial Sequence
  chemically synthesized
ttcctaattctgtaaagaaagt

SEQ ID NO: 1027530 - DNA, 22 bp, Artificial Sequence
  chemically synthesized
ccactgactttctttacagaat

SEQ ID NO: 1027531 - DNA, 22 bp, Artificial Sequence
  chemically synthesized
actttctttacagaattaggaa

SEQ ID NO: 1027532 - DNA, 22 bp, Artificial Sequence
  chemically synthesized
tctttacagaattaggaaaaat

SEQ ID NO: 1027533 - DNA, 22 bp, Artificial Sequence
  chemically synthesized
aaatgtaaagtaatttttccta

SEQ ID NO: 1027534 - DNA, 22 bp, Artificial Sequence
  chemically synthesized
ctttacagaattaggaaaaatt

SEQ ID NO: 1027535 - DNA, 22 bp, Artificial Sequence
  chemically synthesized
tttacagaattaggaaaaatta

SEQ ID NO: 1027536 - DNA, 22 bp, Artificial Sequence
  chemically synthesized
tacagaattaggaaaaattact

SEQ ID NO: 1027537 - DNA, 22 bp, Artificial Sequence
  chemically synthesized
acagaattaggaaaaattactt

SEQ ID NO: 1027538 - DNA, 22 bp, Artificial Sequence
  chemically synthesized
cagaattaggaaaaattacttt

SEQ ID NO: 1027539 - DNA, 22 bp, Artificial Sequence
  chemically synthesized
catctgaaatgtaaagtaattt

SEQ ID NO: 1027540 - DNA, 22 bp, Artificial Sequence
  chemically synthesized
gttccatctgaaatgtaaagta

SEQ ID NO: 1027541 - DNA, 22 bp, Artificial Sequence
  chemically synthesized
ggttccatctgaaatgtaaagt

SEQ ID NO: 1027542 - DNA, 22 bp, Artificial Sequence
  chemically synthesized
tggttccatctgaaatgtaaag

SEQ ID NO: 1027543 - DNA, 22 bp, Artificial Sequence
  chemically synthesized
ttggttccatctgaaatgtaaa

SEQ ID NO: 1027544 - DNA, 22 bp, Artificial Sequence
  chemically synthesized
ggaaaaattactttacatttca

SEQ ID NO: 1027545 - DNA, 22 bp, Artificial Sequence
  chemically synthesized
tttggttccatctgaaatgtaa

SEQ ID NO: 1027546 - DNA, 22 bp, Artificial Sequence
  chemically synthesized
ttttggttccatctgaaatgta

SEQ ID NO: 1027547 - DNA, 22 bp, Artificial Sequence
  chemically synthesized
ttttttggttccatctgaaatg

SEQ ID NO: 1027548 - DNA, 22 bp, Artificial Sequence
  chemically synthesized
ctttacatttcagatggaacca

SEQ ID NO: 1027549 - DNA, 22 bp, Artificial Sequence
  chemically synthesized
tacaagctcttttttggttcca

SEQ ID NO: 1027550 - DNA, 22 bp, Artificial Sequence
  chemically synthesized
tacatttcagatggaaccaaaa

SEQ ID NO: 1027551 - DNA, 22 bp, Artificial Sequence
  chemically synthesized
acatttcagatggaaccaaaaa

SEQ ID NO: 1027552 - DNA, 22 bp, Artificial Sequence
  chemically synthesized
catttcagatggaaccaaaaaa

SEQ ID NO: 1027553 - DNA, 22 bp, Artificial Sequence
  chemically synthesized
gctatacaagctcttttttggt

SEQ ID NO: 1027554 - DNA, 22 bp, Artificial Sequence
  chemically synthesized
ggctatacaagctcttttttgg

SEQ ID NO: 1027555 - DNA, 22 bp, Artificial Sequence
  chemically synthesized
cagatggaaccaaaaaagagct

SEQ ID NO: 1027556 - DNA, 22 bp, Artificial Sequence
  chemically synthesized
agatggaaccaaaaaagagctt

SEQ ID NO: 1027557 - DNA, 22 bp, Artificial Sequence
  chemically synthesized
tcttggctatacaagctctttt

SEQ ID NO: 1027558 - DNA, 22 bp, Artificial Sequence
  chemically synthesized
ggattgtcttggctatacaagc

SEQ ID NO: 1027559 - DNA, 22 bp, Artificial Sequence
  chemically synthesized
aggattgtcttggctatacaag

SEQ ID NO: 1027560 - DNA, 22 bp, Artificial Sequence
  chemically synthesized
cttaggattgtcttggctatac

SEQ ID NO: 1027561 - DNA, 22 bp, Artificial Sequence
  chemically synthesized
acttaggattgtcttggctata

SEQ ID NO: 1027562 - DNA, 22 bp, Artificial Sequence
  chemically synthesized
tacttaggattgtcttggctat

SEQ ID NO: 1027563 - DNA, 22 bp, Artificial Sequence
  chemically synthesized
attttacttaggattgtcttgg

SEQ ID NO: 1027564 - DNA, 22 bp, Artificial Sequence
  chemically synthesized
ttcattttacttaggattgtct

SEQ ID NO: 1027565 - DNA, 22 bp, Artificial Sequence
  chemically synthesized
gttcattttacttaggattgtc

SEQ ID NO: 1027566 - DNA, 22 bp, Artificial Sequence
  chemically synthesized
tgttcattttacttaggattgt

SEQ ID NO: 1027567 - DNA, 22 bp, Artificial Sequence
  chemically synthesized
gtatagccaagacaatcctaag

SEQ ID NO: 1027568 - DNA, 22 bp, Artificial Sequence
  chemically synthesized
tatagccaagacaatcctaagt

SEQ ID NO: 1027569 - DNA, 22 bp, Artificial Sequence
  chemically synthesized
cagctttgttcattttacttag

SEQ ID NO: 1027570 - DNA, 22 bp, Artificial Sequence
  chemically synthesized
agtaaaatgaacaaagctggag

SEQ ID NO: 1027571 - DNA, 22 bp, Artificial Sequence
  chemically synthesized
aagtcaggtagcatgatgcctc

SEQ ID NO: 1027572 - DNA, 22 bp, Artificial Sequence
  chemically synthesized
gaagtcaggtagcatgatgcct

SEQ ID NO: 1027573 - DNA, 22 bp, Artificial Sequence
  chemically synthesized
gaggcatcatgctacctgactt

SEQ ID NO: 1027574 - DNA, 22 bp, Artificial Sequence
  chemically synthesized
tagtatagtttgaagtcaggta

SEQ ID NO: 1027575 - DNA, 22 bp, Artificial Sequence
  chemically synthesized
gtagtatagtttgaagtcaggt

SEQ ID NO: 1027576 - DNA, 22 bp, Artificial Sequence
  chemically synthesized
tagccttgtagtatagtttgaa

SEQ ID NO: 1027577 - DNA, 22 bp, Artificial Sequence
  chemically synthesized
ctgtagccttgtagtatagttt

SEQ ID NO: 1027578 - DNA, 22 bp, Artificial Sequence
  chemically synthesized
actgtagccttgtagtatagtt

SEQ ID NO: 1027579 - DNA, 22 bp, Artificial Sequence
  chemically synthesized
cctgacttcaaactatactaca

SEQ ID NO: 1027580 - DNA, 22 bp, Artificial Sequence
  chemically synthesized
cttactgtagccttgtagtata

SEQ ID NO: 1027581 - DNA, 22 bp, Artificial Sequence
  chemically synthesized
gcttactgtagccttgtagtat

SEQ ID NO: 1027582 - DNA, 22 bp, Artificial Sequence
  chemically synthesized
tgcttactgtagccttgtagta

SEQ ID NO: 1027583 - DNA, 22 bp, Artificial Sequence
  chemically synthesized
acttcaaactatactacaaggc

SEQ ID NO: 1027584 - DNA, 22 bp, Artificial Sequence
  chemically synthesized
ttttgcttactgtagccttgta

SEQ ID NO: 1027585 - DNA, 22 bp, Artificial Sequence
  chemically synthesized
caaactatactacaaggctaca

SEQ ID NO: 1027586 - DNA, 22 bp, Artificial Sequence
  chemically synthesized
aaactatactacaaggctacag

SEQ ID NO: 1027587 - DNA, 22 bp, Artificial Sequence
  chemically synthesized
tactacaaggctacagtaagca

SEQ ID NO: 1027588 - DNA, 22 bp, Artificial Sequence
  chemically synthesized
caaggctacagtaagcaaaaca

SEQ ID NO: 1027589 - DNA, 22 bp, Artificial Sequence
  chemically synthesized
ccagtaccagtctgttttgctt

SEQ ID NO: 1027590 - DNA, 22 bp, Artificial Sequence
  chemically synthesized
ctaccagtaccagtctgttttg

SEQ ID NO: 1027591 - DNA, 22 bp, Artificial Sequence
  chemically synthesized
gctaccagtaccagtctgtttt

SEQ ID NO: 1027592 - DNA, 22 bp, Artificial Sequence
  chemically synthesized
tgctaccagtaccagtctgttt

SEQ ID NO: 1027593 - DNA, 22 bp, Artificial Sequence
  chemically synthesized
cagtaagcaaaacagactggta

SEQ ID NO: 1027594 - DNA, 22 bp, Artificial Sequence
  chemically synthesized
ttttgctaccagtaccagtctg

SEQ ID NO: 1027595 - DNA, 22 bp, Artificial Sequence
  chemically synthesized
tatatctgttttgctaccagta

SEQ ID NO: 1027596 - DNA, 22 bp, Artificial Sequence
  chemically synthesized
gtctatatatctgttttgctac

SEQ ID NO: 1027597 - DNA, 22 bp, Artificial Sequence
  chemically synthesized
cattggtctatatatctgtttt

SEQ ID NO: 1027598 - DNA, 22 bp, Artificial Sequence
  chemically synthesized
gtactggtagcaaaacagatat

SEQ ID NO: 1027599 - DNA, 22 bp, Artificial Sequence
  chemically synthesized
ttccattggtctatatatctgt

SEQ ID NO: 1027600 - DNA, 22 bp, Artificial Sequence
  chemically synthesized
tgttccattggtctatatatct

SEQ ID NO: 1027601 - DNA, 22 bp, Artificial Sequence
  chemically synthesized
gtagcaaaacagatatatagac

SEQ ID NO: 1027602 - DNA, 22 bp, Artificial Sequence
  chemically synthesized
ttctgttccattggtctatata

SEQ ID NO: 1027603 - DNA, 22 bp, Artificial Sequence
  chemically synthesized
tgttctgttccattggtctata

SEQ ID NO: 1027604 - DNA, 22 bp, Artificial Sequence
  chemically synthesized
gcctctgttctgttccattggt

SEQ ID NO: 1027605 - DNA, 22 bp, Artificial Sequence
  chemically synthesized
tggcctctgttctgttccattg

SEQ ID NO: 1027606 - DNA, 22 bp, Artificial Sequence
  chemically synthesized
ctggcctctgttctgttccatt

SEQ ID NO: 1027607 - DNA, 22 bp, Artificial Sequence
  chemically synthesized
tctggcctctgttctgttccat

SEQ ID NO: 1027608 - DNA, 22 bp, Artificial Sequence
  chemically synthesized
ttctggcctctgttctgttcca

SEQ ID NO: 1027609 - DNA, 22 bp, Artificial Sequence
  chemically synthesized
tttttctggcctctgttctgtt

SEQ ID NO: 1027610 - DNA, 22 bp, Artificial Sequence
  chemically synthesized
tagatgtgtggcattatttttc

SEQ ID NO: 1027611 - DNA, 22 bp, Artificial Sequence
  chemically synthesized
tcaaagatcagatggttgtaga

SEQ ID NO: 1027612 - DNA, 22 bp, Artificial Sequence
  chemically synthesized
gtcaaagatcagatggttgtag

SEQ ID NO: 1027613 - DNA, 22 bp, Artificial Sequence
  chemically synthesized
tcaggtttgtcaaagatcagat

SEQ ID NO: 1027614 - DNA, 22 bp, Artificial Sequence
  chemically synthesized
gtcaggtttgtcaaagatcaga

SEQ ID NO: 1027615 - DNA, 22 bp, Artificial Sequence
  chemically synthesized
tgtcaggtttgtcaaagatcag

SEQ ID NO: 1027616 - DNA, 22 bp, Artificial Sequence
  chemically synthesized
ttgtcaggtttgtcaaagatca

SEQ ID NO: 1027617 - DNA, 22 bp, Artificial Sequence
  chemically synthesized
tttttgtcaggtttgtcaaaga

SEQ ID NO: 1027618 - DNA, 22 bp, Artificial Sequence
  chemically synthesized
caaccatctgatctttgacaaa

SEQ ID NO: 1027619 - DNA, 22 bp, Artificial Sequence
  chemically synthesized
gtttttgtcaggtttgtcaaag

SEQ ID NO: 1027620 - DNA, 22 bp, Artificial Sequence
  chemically synthesized
cttgtttttgtcaggtttgtca

SEQ ID NO: 1027621 - DNA, 22 bp, Artificial Sequence
  chemically synthesized
atctttgacaaacctgacaaaa

SEQ ID NO: 1027622 - DNA, 22 bp, Artificial Sequence
  chemically synthesized
cccgttgcttgtttttgtcagg

SEQ ID NO: 1027623 - DNA, 22 bp, Artificial Sequence
  chemically synthesized
ccccgttgcttgtttttgtcag

SEQ ID NO: 1027624 - DNA, 22 bp, Artificial Sequence
  chemically synthesized
tccccgttgcttgtttttgtca

SEQ ID NO: 1027625 - DNA, 22 bp, Artificial Sequence
  chemically synthesized
tgacaaacctgacaaaaacaag

SEQ ID NO: 1027626 - DNA, 22 bp, Artificial Sequence
  chemically synthesized
gacaaacctgacaaaaacaagc

SEQ ID NO: 1027627 - DNA, 22 bp, Artificial Sequence
  chemically synthesized
acaaacctgacaaaaacaagca

SEQ ID NO: 1027628 - DNA, 22 bp, Artificial Sequence
  chemically synthesized
acaaaaacaagcaacggggaaa

SEQ ID NO: 1027629 - DNA, 22 bp, Artificial Sequence
  chemically synthesized
aatagggaatcctttccccgtt

SEQ ID NO: 1027630 - DNA, 22 bp, Artificial Sequence
  chemically synthesized
ttaaatagggaatcctttcccc

SEQ ID NO: 1027631 - DNA, 22 bp, Artificial Sequence
  chemically synthesized
attaaatagggaatcctttccc

SEQ ID NO: 1027632 - DNA, 22 bp, Artificial Sequence
  chemically synthesized
ccaacaccatttattaaatagg

SEQ ID NO: 1027633 - DNA, 22 bp, Artificial Sequence
  chemically synthesized
cccaacaccatttattaaatag

SEQ ID NO: 1027634 - DNA, 22 bp, Artificial Sequence
  chemically synthesized
tcccaacaccatttattaaata

SEQ ID NO: 1027635 - DNA, 22 bp, Artificial Sequence
  chemically synthesized
gccagttttcccaacaccattt

SEQ ID NO: 1027636 - DNA, 22 bp, Artificial Sequence
  chemically synthesized
cctatttaataaatggtgttgg

SEQ ID NO: 1027637 - DNA, 22 bp, Artificial Sequence
  chemically synthesized
tttaataaatggtgttgggaaa

SEQ ID NO: 1027638 - DNA, 22 bp, Artificial Sequence
  chemically synthesized
aataaatggtgttgggaaaact

SEQ ID NO: 1027639 - DNA, 22 bp, Artificial Sequence
  chemically synthesized
ataaatggtgttgggaaaactg

SEQ ID NO: 1027640 - DNA, 22 bp, Artificial Sequence
  chemically synthesized
catatgactagccagttttccc

SEQ ID NO: 1027641 - DNA, 22 bp, Artificial Sequence
  chemically synthesized
tgcatatgactagccagttttc

SEQ ID NO: 1027642 - DNA, 22 bp, Artificial Sequence
  chemically synthesized
ctgcatatgactagccagtttt

SEQ ID NO: 1027643 - DNA, 22 bp, Artificial Sequence
  chemically synthesized
tctgcatatgactagccagttt

SEQ ID NO: 1027644 - DNA, 22 bp, Artificial Sequence
  chemically synthesized
cgttttctgcatatgactagcc

SEQ ID NO: 1027645 - DNA, 22 bp, Artificial Sequence
  chemically synthesized
ccgttttctgcatatgactagc

SEQ ID NO: 1027646 - DNA, 22 bp, Artificial Sequence
  chemically synthesized
ggaaaactggctagtcatatgc

SEQ ID NO: 1027647 - DNA, 22 bp, Artificial Sequence
  chemically synthesized
gctagtcatatgcagaaaacgg

SEQ ID NO: 1027648 - DNA, 22 bp, Artificial Sequence
  chemically synthesized
gtcatatgcagaaaacggaaac

SEQ ID NO: 1027649 - DNA, 22 bp, Artificial Sequence
  chemically synthesized
tataaggggtaaggaaggggtc

SEQ ID NO: 1027650 - DNA, 22 bp, Artificial Sequence
  chemically synthesized
gtataaggggtaaggaaggggt

SEQ ID NO: 1027651 - DNA, 22 bp, Artificial Sequence
  chemically synthesized
tgtataaggggtaaggaagggg

SEQ ID NO: 1027652 - DNA, 22 bp, Artificial Sequence
  chemically synthesized
ttgtataaggggtaaggaaggg

SEQ ID NO: 1027653 - DNA, 22 bp, Artificial Sequence
  chemically synthesized
atttttgtataaggggtaagga

SEQ ID NO: 1027654 - DNA, 22 bp, Artificial Sequence
  chemically synthesized
gaccccttccttaccccttata

SEQ ID NO: 1027655 - DNA, 22 bp, Artificial Sequence
  chemically synthesized
agttgatttttgtataaggggt

SEQ ID NO: 1027656 - DNA, 22 bp, Artificial Sequence
  chemically synthesized
gagttgatttttgtataagggg

SEQ ID NO: 1027657 - DNA, 22 bp, Artificial Sequence
  chemically synthesized
ccttaccccttatacaaaaatc

SEQ ID NO: 1027658 - DNA, 22 bp, Artificial Sequence
  chemically synthesized
cttaccccttatacaaaaatca

SEQ ID NO: 1027659 - DNA, 22 bp, Artificial Sequence
  chemically synthesized
atgcatcttgagttgatttttg

SEQ ID NO: 1027660 - DNA, 22 bp, Artificial Sequence
  chemically synthesized
aatgcatcttgagttgattttt

SEQ ID NO: 1027661 - DNA, 22 bp, Artificial Sequence
  chemically synthesized
accccttatacaaaaatcaact

SEQ ID NO: 1027662 - DNA, 22 bp, Artificial Sequence
  chemically synthesized
taatgcatcttgagttgatttt

SEQ ID NO: 1027663 - DNA, 22 bp, Artificial Sequence
  chemically synthesized
ccccttatacaaaaatcaactc

SEQ ID NO: 1027664 - DNA, 22 bp, Artificial Sequence
  chemically synthesized
agtctttaatgcatcttgagtt

SEQ ID NO: 1027665 - DNA, 22 bp, Artificial Sequence
  chemically synthesized
atacaaaaatcaactcaagatg

SEQ ID NO: 1027666 - DNA, 22 bp, Artificial Sequence
  chemically synthesized
aagtctttaatgcatcttgagt

SEQ ID NO: 1027667 - DNA, 22 bp, Artificial Sequence
  chemically synthesized
tacaaaaatcaactcaagatgc

SEQ ID NO: 1027668 - DNA, 22 bp, Artificial Sequence
  chemically synthesized
ggtttaagtctttaatgcatct

SEQ ID NO: 1027669 - DNA, 22 bp, Artificial Sequence
  chemically synthesized
aggtttaagtctttaatgcatc

SEQ ID NO: 1027670 - DNA, 22 bp, Artificial Sequence
  chemically synthesized
taggtttaagtctttaatgcat

SEQ ID NO: 1027671 - DNA, 22 bp, Artificial Sequence
  chemically synthesized
ggttttaggtttaagtctttaa

SEQ ID NO: 1027672 - DNA, 22 bp, Artificial Sequence
  chemically synthesized
cggttttaggtttaagtcttta

SEQ ID NO: 1027673 - DNA, 22 bp, Artificial Sequence
  chemically synthesized
tcggttttaggtttaagtcttt

SEQ ID NO: 1027674 - DNA, 22 bp, Artificial Sequence
  chemically synthesized
aagatgcattaaagacttaaac

SEQ ID NO: 1027675 - DNA, 22 bp, Artificial Sequence
  chemically synthesized
atggttttcggttttaggttta

SEQ ID NO: 1027676 - DNA, 22 bp, Artificial Sequence
  chemically synthesized
gatggttttcggttttaggttt

SEQ ID NO: 1027677 - DNA, 22 bp, Artificial Sequence
  chemically synthesized
tgatggttttcggttttaggtt

SEQ ID NO: 1027678 - DNA, 22 bp, Artificial Sequence
  chemically synthesized
aagacttaaacctaaaaccgaa

SEQ ID NO: 1027679 - DNA, 22 bp, Artificial Sequence
  chemically synthesized
gggttttgatggttttcggttt

SEQ ID NO: 1027680 - DNA, 22 bp, Artificial Sequence
  chemically synthesized
tagggttttgatggttttcggt

SEQ ID NO: 1027681 - DNA, 22 bp, Artificial Sequence
  chemically synthesized
ctagggttttgatggttttcgg

SEQ ID NO: 1027682 - DNA, 22 bp, Artificial Sequence
  chemically synthesized
aaacctaaaaccgaaaaccatc

SEQ ID NO: 1027683 - DNA, 22 bp, Artificial Sequence
  chemically synthesized
ttctagggttttgatggttttc

SEQ ID NO: 1027684 - DNA, 22 bp, Artificial Sequence
  chemically synthesized
aacctaaaaccgaaaaccatca

SEQ ID NO: 1027685 - DNA, 22 bp, Artificial Sequence
  chemically synthesized
cttctagggttttgatggtttt

SEQ ID NO: 1027686 - DNA, 22 bp, Artificial Sequence
  chemically synthesized
tcttctagggttttgatggttt

SEQ ID NO: 1027687 - DNA, 22 bp, Artificial Sequence
  chemically synthesized
aaaccgaaaaccatcaaaaccc

SEQ ID NO: 1027688 - DNA, 22 bp, Artificial Sequence
  chemically synthesized
ggttttcttctagggttttgat

SEQ ID NO: 1027689 - DNA, 22 bp, Artificial Sequence
  chemically synthesized
cctaggttttcttctagggttt

SEQ ID NO: 1027690 - DNA, 22 bp, Artificial Sequence
  chemically synthesized
aatggtattgcctaggttttct

SEQ ID NO: 1027691 - DNA, 22 bp, Artificial Sequence
  chemically synthesized
tgtcctgaatggtattgcctag

SEQ ID NO: 1027692 - DNA, 22 bp, Artificial Sequence
  chemically synthesized
gtgtcctgaatggtattgccta

SEQ ID NO: 1027693 - DNA, 22 bp, Artificial Sequence
  chemically synthesized
gaagaaaacctaggcaatacca

SEQ ID NO: 1027694 - DNA, 22 bp, Artificial Sequence
  chemically synthesized
cccgtacttgtgtcctgaatgg

SEQ ID NO: 1027695 - DNA, 22 bp, Artificial Sequence
  chemically synthesized
ccccgtacttgtgtcctgaatg

SEQ ID NO: 1027696 - DNA, 22 bp, Artificial Sequence
  chemically synthesized
tccccgtacttgtgtcctgaat

SEQ ID NO: 1027697 - DNA, 22 bp, Artificial Sequence
  chemically synthesized
ggcaataccattcaggacacaa

SEQ ID NO: 1027698 - DNA, 22 bp, Artificial Sequence
  chemically synthesized
gtcatgcagtctttccccgtac

SEQ ID NO: 1027699 - DNA, 22 bp, Artificial Sequence
  chemically synthesized
agtcatgcagtctttccccgta

SEQ ID NO: 1027700 - DNA, 22 bp, Artificial Sequence
  chemically synthesized
tagtcatgcagtctttccccgt

SEQ ID NO: 1027701 - DNA, 22 bp, Artificial Sequence
  chemically synthesized
aggacacaagtacggggaaaga

SEQ ID NO: 1027702 - DNA, 22 bp, Artificial Sequence
  chemically synthesized
gtgttttagtcatgcagtcttt

SEQ ID NO: 1027703 - DNA, 22 bp, Artificial Sequence
  chemically synthesized
ggtgttttagtcatgcagtctt

SEQ ID NO: 1027704 - DNA, 22 bp, Artificial Sequence
  chemically synthesized
tggtgttttagtcatgcagtct

SEQ ID NO: 1027705 - DNA, 22 bp, Artificial Sequence
  chemically synthesized
ttggtgttttagtcatgcagtc

SEQ ID NO: 1027706 - DNA, 22 bp, Artificial Sequence
  chemically synthesized
cttttggtgttttagtcatgca

SEQ ID NO: 1027707 - DNA, 22 bp, Artificial Sequence
  chemically synthesized
ttgcttttggtgttttagtcat

SEQ ID NO: 1027708 - DNA, 22 bp, Artificial Sequence
  chemically synthesized
ctgttgcttttggtgttttagt

SEQ ID NO: 1027709 - DNA, 22 bp, Artificial Sequence
  chemically synthesized
ttgctgttgcttttggtgtttt

SEQ ID NO: 1027710 - DNA, 22 bp, Artificial Sequence
  chemically synthesized
gttgctgttgcttttggtgttt

SEQ ID NO: 1027711 - DNA, 22 bp, Artificial Sequence
  chemically synthesized
tgttgctgttgcttttggtgtt

SEQ ID NO: 1027712 - DNA, 22 bp, Artificial Sequence
  chemically synthesized
ttgttgctgttgcttttggtgt

SEQ ID NO: 1027713 - DNA, 22 bp, Artificial Sequence
  chemically synthesized
catgactaaaacaccaaaagca

SEQ ID NO: 1027714 - DNA, 22 bp, Artificial Sequence
  chemically synthesized
gcttttgttgctgttgcttttg

SEQ ID NO: 1027715 - DNA, 22 bp, Artificial Sequence
  chemically synthesized
ggcttttgttgctgttgctttt

SEQ ID NO: 1027716 - DNA, 22 bp, Artificial Sequence
  chemically synthesized
tggcttttgttgctgttgcttt

SEQ ID NO: 1027717 - DNA, 22 bp, Artificial Sequence
  chemically synthesized
aaacaccaaaagcaacagcaac

SEQ ID NO: 1027718 - DNA, 22 bp, Artificial Sequence
  chemically synthesized
tcaattttggcttttgttgctg

SEQ ID NO: 1027719 - DNA, 22 bp, Artificial Sequence
  chemically synthesized
gtcaattttggcttttgttgct

SEQ ID NO: 1027720 - DNA, 22 bp, Artificial Sequence
  chemically synthesized
gatcccatttgtcaattttggc

SEQ ID NO: 1027721 - DNA, 22 bp, Artificial Sequence
  chemically synthesized
attagatcccatttgtcaattt

SEQ ID NO: 1027722 - DNA, 22 bp, Artificial Sequence
  chemically synthesized
cattagatcccatttgtcaatt

SEQ ID NO: 1027723 - DNA, 22 bp, Artificial Sequence
  chemically synthesized
gtttcattagatcccatttgtc

SEQ ID NO: 1027724 - DNA, 22 bp, Artificial Sequence
  chemically synthesized
agtttcattagatcccatttgt

SEQ ID NO: 1027725 - DNA, 22 bp, Artificial Sequence
  chemically synthesized
tagtttcattagatcccatttg

SEQ ID NO: 1027726 - DNA, 22 bp, Artificial Sequence
  chemically synthesized
tttagtttcattagatcccatt

SEQ ID NO: 1027727 - DNA, 22 bp, Artificial Sequence
  chemically synthesized
acaaatgggatctaatgaaact

SEQ ID NO: 1027728 - DNA, 22 bp, Artificial Sequence
  chemically synthesized
cagtgtagaagctctttagttt

SEQ ID NO: 1027729 - DNA, 22 bp, Artificial Sequence
  chemically synthesized
gcagtgtagaagctctttagtt

SEQ ID NO: 1027730 - DNA, 22 bp, Artificial Sequence
  chemically synthesized
tgcagtgtagaagctctttagt

SEQ ID NO: 1027731 - DNA, 22 bp, Artificial Sequence
  chemically synthesized
ttgcagtgtagaagctctttag

SEQ ID NO: 1027732 - DNA, 22 bp, Artificial Sequence
  chemically synthesized
ttttgcagtgtagaagctcttt

SEQ ID NO: 1027733 - DNA, 22 bp, Artificial Sequence
  chemically synthesized
cttttgcagtgtagaagctctt

SEQ ID NO: 1027734 - DNA, 22 bp, Artificial Sequence
  chemically synthesized
atgaaactaaagagcttctaca

SEQ ID NO: 1027735 - DNA, 22 bp, Artificial Sequence
  chemically synthesized
atgatagtttcttttgcagtgt

SEQ ID NO: 1027736 - DNA, 22 bp, Artificial Sequence
  chemically synthesized
aagagcttctacactgcaaaag

SEQ ID NO: 1027737 - DNA, 22 bp, Artificial Sequence
  chemically synthesized
tcatgatagtttcttttgcagt

SEQ ID NO: 1027738 - DNA, 22 bp, Artificial Sequence
  chemically synthesized
actctcatgatagtttcttttg

SEQ ID NO: 1027739 - DNA, 22 bp, Artificial Sequence
  chemically synthesized
ttcactctcatgatagtttctt

SEQ ID NO: 1027740 - DNA, 22 bp, Artificial Sequence
  chemically synthesized
ctacactgcaaaagaaactatc

SEQ ID NO: 1027741 - DNA, 22 bp, Artificial Sequence
  chemically synthesized
tacactgcaaaagaaactatca

SEQ ID NO: 1027742 - DNA, 22 bp, Artificial Sequence
  chemically synthesized
cactgcaaaagaaactatcatg

SEQ ID NO: 1027743 - DNA, 22 bp, Artificial Sequence
  chemically synthesized
cctgttcactctcatgatagtt

SEQ ID NO: 1027744 - DNA, 22 bp, Artificial Sequence
  chemically synthesized
gcctgttcactctcatgatagt

SEQ ID NO: 1027745 - DNA, 22 bp, Artificial Sequence
  chemically synthesized
caaaagaaactatcatgagagt

SEQ ID NO: 1027746 - DNA, 22 bp, Artificial Sequence
  chemically synthesized
tagtttgcctgttcactctcat

SEQ ID NO: 1027747 - DNA, 22 bp, Artificial Sequence
  chemically synthesized
ccaatctgtagtttgcctgttc

SEQ ID NO: 1027748 - DNA, 22 bp, Artificial Sequence
  chemically synthesized
tcatgagagtgaacaggcaaac

SEQ ID NO: 1027749 - DNA, 22 bp, Artificial Sequence
  chemically synthesized
tcccaatctgtagtttgcctgt

SEQ ID NO: 1027750 - DNA, 22 bp, Artificial Sequence
  chemically synthesized
ctcccaatctgtagtttgcctg

SEQ ID NO: 1027751 - DNA, 22 bp, Artificial Sequence
  chemically synthesized
tctcccaatctgtagtttgcct

SEQ ID NO: 1027752 - DNA, 22 bp, Artificial Sequence
  chemically synthesized
caaaaattttctcccaatctgt

SEQ ID NO: 1027753 - DNA, 22 bp, Artificial Sequence
  chemically synthesized
cagattgggagaaaatttttgc

SEQ ID NO: 1027754 - DNA, 22 bp, Artificial Sequence
  chemically synthesized
tcagatgtatagattgcaaaaa

SEQ ID NO: 1027755 - DNA, 22 bp, Artificial Sequence
  chemically synthesized
gtcagatgtatagattgcaaaa

SEQ ID NO: 1027756 - DNA, 22 bp, Artificial Sequence
  chemically synthesized
tgtcagatgtatagattgcaaa

SEQ ID NO: 1027757 - DNA, 22 bp, Artificial Sequence
  chemically synthesized
ggagaaaatttttgcaatctat

SEQ ID NO: 1027758 - DNA, 22 bp, Artificial Sequence
  chemically synthesized
gccctttgtcagatgtatagat

SEQ ID NO: 1027759 - DNA, 22 bp, Artificial Sequence
  chemically synthesized
ttgcaatctatacatctgacaa

SEQ ID NO: 1027760 - DNA, 22 bp, Artificial Sequence
  chemically synthesized
tgcaatctatacatctgacaaa

SEQ ID NO: 1027761 - DNA, 22 bp, Artificial Sequence
  chemically synthesized
gcaatctatacatctgacaaag

SEQ ID NO: 1027762 - DNA, 22 bp, Artificial Sequence
  chemically synthesized
cgggtattagccctttgtcaga

SEQ ID NO: 1027763 - DNA, 22 bp, Artificial Sequence
  chemically synthesized
caatctatacatctgacaaagg

SEQ ID NO: 1027764 - DNA, 22 bp, Artificial Sequence
  chemically synthesized
tagattccgggtattagccctt

SEQ ID NO: 1027765 - DNA, 22 bp, Artificial Sequence
  chemically synthesized
tacatctgacaaagggctaata

SEQ ID NO: 1027766 - DNA, 22 bp, Artificial Sequence
  chemically synthesized
atagattccgggtattagccct

SEQ ID NO: 1027767 - DNA, 22 bp, Artificial Sequence
  chemically synthesized
cttatagattccgggtattagc

SEQ ID NO: 1027768 - DNA, 22 bp, Artificial Sequence
  chemically synthesized
acaaagggctaatacccggaat

SEQ ID NO: 1027769 - DNA, 22 bp, Artificial Sequence
  chemically synthesized
agttccttatagattccgggta

SEQ ID NO: 1027770 - DNA, 22 bp, Artificial Sequence
  chemically synthesized
aagttccttatagattccgggt

SEQ ID NO: 1027771 - DNA, 22 bp, Artificial Sequence
  chemically synthesized
tttaagttccttatagattccg

SEQ ID NO: 1027772 - DNA, 22 bp, Artificial Sequence
  chemically synthesized
gtttaagttccttatagattcc

SEQ ID NO: 1027773 - DNA, 22 bp, Artificial Sequence
  chemically synthesized
atacccggaatctataaggaac

SEQ ID NO: 1027774 - DNA, 22 bp, Artificial Sequence
  chemically synthesized
taaatttgtttaagttccttat

SEQ ID NO: 1027775 - DNA, 22 bp, Artificial Sequence
  chemically synthesized
gtaaatttgtttaagttcctta

SEQ ID NO: 1027776 - DNA, 22 bp, Artificial Sequence
  chemically synthesized
ttgtaaatttgtttaagttcct

SEQ ID NO: 1027777 - DNA, 22 bp, Artificial Sequence
  chemically synthesized
cttgtaaatttgtttaagttcc

SEQ ID NO: 1027778 - DNA, 22 bp, Artificial Sequence
  chemically synthesized
tcttgtaaatttgtttaagttc

SEQ ID NO: 1027779 - DNA, 22 bp, Artificial Sequence
  chemically synthesized
ttcttgtaaatttgtttaagtt

SEQ ID NO: 1027780 - DNA, 22 bp, Artificial Sequence
  chemically synthesized
tttcttgtaaatttgtttaagt

SEQ ID NO: 1027781 - DNA, 22 bp, Artificial Sequence
  chemically synthesized
ttttcttgtaaatttgtttaag

SEQ ID NO: 1027782 - DNA, 22 bp, Artificial Sequence
  chemically synthesized
tttttcttgtaaatttgtttaa

SEQ ID NO: 1027783 - DNA, 22 bp, Artificial Sequence
  chemically synthesized
ttttttcttgtaaatttgttta

SEQ ID NO: 1027784 - DNA, 22 bp, Artificial Sequence
  chemically synthesized
tttttttcttgtaaatttgttt

SEQ ID NO: 1027785 - DNA, 22 bp, Artificial Sequence
  chemically synthesized
ttttttttcttgtaaatttgtt

SEQ ID NO: 1027786 - DNA, 22 bp, Artificial Sequence
  chemically synthesized
taaggaacttaaacaaatttac

SEQ ID NO: 1027787 - DNA, 22 bp, Artificial Sequence
  chemically synthesized
atgggtttttttttttcttgta

SEQ ID NO: 1027788 - DNA, 22 bp, Artificial Sequence
  chemically synthesized
tgatgggtttttttttttcttg

SEQ ID NO: 1027789 - DNA, 22 bp, Artificial Sequence
  chemically synthesized
aaacaaatttacaagaaaaaaa

SEQ ID NO: 1027790 - DNA, 22 bp, Artificial Sequence
  chemically synthesized
ctgatgggtttttttttttctt

SEQ ID NO: 1027791 - DNA, 22 bp, Artificial Sequence
  chemically synthesized
aacaaatttacaagaaaaaaaa

SEQ ID NO: 1027792 - DNA, 22 bp, Artificial Sequence
  chemically synthesized
tctgatgggtttttttttttct

SEQ ID NO: 1027793 - DNA, 22 bp, Artificial Sequence
  chemically synthesized
gcccactttctgatgggttttt

SEQ ID NO: 1027794 - DNA, 22 bp, Artificial Sequence
  chemically synthesized
acaagaaaaaaaaaaacccatc

SEQ ID NO: 1027795 - DNA, 22 bp, Artificial Sequence
  chemically synthesized
agcccactttctgatgggtttt

SEQ ID NO: 1027796 - DNA, 22 bp, Artificial Sequence
  chemically synthesized
caagaaaaaaaaaaacccatca

SEQ ID NO: 1027797 - DNA, 22 bp, Artificial Sequence
  chemically synthesized
atatccttagcccactttctga

SEQ ID NO: 1027798 - DNA, 22 bp, Artificial Sequence
  chemically synthesized
ttcatatccttagcccactttc

SEQ ID NO: 1027799 - DNA, 22 bp, Artificial Sequence
  chemically synthesized
agaagtgtctgttcatatcctt

SEQ ID NO: 1027800 - DNA, 22 bp, Artificial Sequence
  chemically synthesized
gagaagtgtctgttcatatcct

SEQ ID NO: 1027801 - DNA, 22 bp, Artificial Sequence
  chemically synthesized
tgagaagtgtctgttcatatcc

SEQ ID NO: 1027802 - DNA, 22 bp, Artificial Sequence
  chemically synthesized
ttttgagaagtgtctgttcata

SEQ ID NO: 1027803 - DNA, 22 bp, Artificial Sequence
  chemically synthesized
gttttgagaagtgtctgttcat

SEQ ID NO: 1027804 - DNA, 22 bp, Artificial Sequence
  chemically synthesized
aggatatgaacagacacttctc

SEQ ID NO: 1027805 - DNA, 22 bp, Artificial Sequence
  chemically synthesized
cataaatgtcttgttttgagaa

SEQ ID NO: 1027806 - DNA, 22 bp, Artificial Sequence
  chemically synthesized
gctgcataaatgtcttgttttg

SEQ ID NO: 1027807 - DNA, 22 bp, Artificial Sequence
  chemically synthesized
ctggctgcataaatgtcttgtt

SEQ ID NO: 1027808 - DNA, 22 bp, Artificial Sequence
  chemically synthesized
gctggctgcataaatgtcttgt

SEQ ID NO: 1027809 - DNA, 22 bp, Artificial Sequence
  chemically synthesized
ctcaaaacaagacatttatgca

SEQ ID NO: 1027810 - DNA, 22 bp, Artificial Sequence
  chemically synthesized
tcaaaacaagacatttatgcag

SEQ ID NO: 1027811 - DNA, 22 bp, Artificial Sequence
  chemically synthesized
atatgtttgctggctgcataaa

SEQ ID NO: 1027812 - DNA, 22 bp, Artificial Sequence
  chemically synthesized
aaaacaagacatttatgcagcc

SEQ ID NO: 1027813 - DNA, 22 bp, Artificial Sequence
  chemically synthesized
gatatgtttgctggctgcataa

SEQ ID NO: 1027814 - DNA, 22 bp, Artificial Sequence
  chemically synthesized
tgatatgtttgctggctgcata

SEQ ID NO: 1027815 - DNA, 22 bp, Artificial Sequence
  chemically synthesized
ttgatatgtttgctggctgcat

SEQ ID NO: 1027816 - DNA, 22 bp, Artificial Sequence
  chemically synthesized
tttgatatgtttgctggctgca

SEQ ID NO: 1027817 - DNA, 22 bp, Artificial Sequence
  chemically synthesized
ttttgatatgtttgctggctgc

SEQ ID NO: 1027818 - DNA, 22 bp, Artificial Sequence
  chemically synthesized
tttttgatatgtttgctggctg

SEQ ID NO: 1027819 - DNA, 22 bp, Artificial Sequence
  chemically synthesized
atgcagccagcaaacatatcaa

SEQ ID NO: 1027820 - DNA, 22 bp, Artificial Sequence
  chemically synthesized
tgcagccagcaaacatatcaaa

SEQ ID NO: 1027821 - DNA, 22 bp, Artificial Sequence
  chemically synthesized
atgaccagtgataatgagcttt

SEQ ID NO: 1027822 - DNA, 22 bp, Artificial Sequence
  chemically synthesized
taatgaccagtgataatgagct

SEQ ID NO: 1027823 - DNA, 22 bp, Artificial Sequence
  chemically synthesized
ctctaatgaccagtgataatga

SEQ ID NO: 1027824 - DNA, 22 bp, Artificial Sequence
  chemically synthesized
cattcctctaatgaccagtgat

SEQ ID NO: 1027825 - DNA, 22 bp, Artificial Sequence
  chemically synthesized
gcattcctctaatgaccagtga

SEQ ID NO: 1027826 - DNA, 22 bp, Artificial Sequence
  chemically synthesized
atttgcattcctctaatgacca

SEQ ID NO: 1027827 - DNA, 22 bp, Artificial Sequence
  chemically synthesized
gatttgcattcctctaatgacc

SEQ ID NO: 1027828 - DNA, 22 bp, Artificial Sequence
  chemically synthesized
tgatttgcattcctctaatgac

SEQ ID NO: 1027829 - DNA, 22 bp, Artificial Sequence
  chemically synthesized
attatcactggtcattagagga

SEQ ID NO: 1027830 - DNA, 22 bp, Artificial Sequence
  chemically synthesized
tcactggtcattagaggaatgc

SEQ ID NO: 1027831 - DNA, 22 bp, Artificial Sequence
  chemically synthesized
tggttttgatttgcattcctct

SEQ ID NO: 1027832 - DNA, 22 bp, Artificial Sequence
  chemically synthesized
attgtggttttgatttgcattc

SEQ ID NO: 1027833 - DNA, 22 bp, Artificial Sequence
  chemically synthesized
gtcattagaggaatgcaaatca

SEQ ID NO: 1027834 - DNA, 22 bp, Artificial Sequence
  chemically synthesized
gaggaatgcaaatcaaaaccac

SEQ ID NO: 1027835 - DNA, 22 bp, Artificial Sequence
  chemically synthesized
gtgtgagatggtatctcattgt

SEQ ID NO: 1027836 - DNA, 22 bp, Artificial Sequence
  chemically synthesized
actggtgtgagatggtatctca

SEQ ID NO: 1027837 - DNA, 22 bp, Artificial Sequence
  chemically synthesized
taactggtgtgagatggtatct

SEQ ID NO: 1027838 - DNA, 22 bp, Artificial Sequence
  chemically synthesized
gccattctaactggtgtgagat

SEQ ID NO: 1027839 - DNA, 22 bp, Artificial Sequence
  chemically synthesized
aatgttcgccattctaactggt

SEQ ID NO: 1027840 - DNA, 22 bp, Artificial Sequence
  chemically synthesized
gaatgttcgccattctaactgg

SEQ ID NO: 1027841 - DNA, 22 bp, Artificial Sequence
  chemically synthesized
tgaatgttcgccattctaactg

SEQ ID NO: 1027842 - DNA, 22 bp, Artificial Sequence
  chemically synthesized
ttgaatgttcgccattctaact

SEQ ID NO: 1027843 - DNA, 22 bp, Artificial Sequence
  chemically synthesized
acttttgaatgttcgccattct

SEQ ID NO: 1027844 - DNA, 22 bp, Artificial Sequence
  chemically synthesized
acaccagttagaatggcgaaca

SEQ ID NO: 1027845 - DNA, 22 bp, Artificial Sequence
  chemically synthesized
cctgacttttgaatgttcgcca

SEQ ID NO: 1027846 - DNA, 22 bp, Artificial Sequence
  chemically synthesized
ttgcctgacttttgaatgttcg

SEQ ID NO: 1027847 - DNA, 22 bp, Artificial Sequence
  chemically synthesized
ttgttgcctgacttttgaatgt

SEQ ID NO: 1027848 - DNA, 22 bp, Artificial Sequence
  chemically synthesized
gaatggcgaacattcaaaagtc

SEQ ID NO: 1027849 - DNA, 22 bp, Artificial Sequence
  chemically synthesized
cagcatctgttgttgcctgact

SEQ ID NO: 1027850 - DNA, 22 bp, Artificial Sequence
  chemically synthesized
tccagcatctgttgttgcctga

SEQ ID NO: 1027851 - DNA, 22 bp, Artificial Sequence
  chemically synthesized
aaaagtcaggcaacaacagatg

SEQ ID NO: 1027852 - DNA, 22 bp, Artificial Sequence
  chemically synthesized
cacatcctctccagcatctgtt

SEQ ID NO: 1027853 - DNA, 22 bp, Artificial Sequence
  chemically synthesized
tccacatcctctccagcatctg

SEQ ID NO: 1027854 - DNA, 22 bp, Artificial Sequence
  chemically synthesized
ctccacatcctctccagcatct

SEQ ID NO: 1027855 - DNA, 22 bp, Artificial Sequence
  chemically synthesized
tctccacatcctctccagcatc

SEQ ID NO: 1027856 - DNA, 22 bp, Artificial Sequence
  chemically synthesized
ttctccacatcctctccagcat

SEQ ID NO: 1027857 - DNA, 22 bp, Artificial Sequence
  chemically synthesized
tttctccacatcctctccagca

SEQ ID NO: 1027858 - DNA, 22 bp, Artificial Sequence
  chemically synthesized
ctttttctccacatcctctcca

SEQ ID NO: 1027859 - DNA, 22 bp, Artificial Sequence
  chemically synthesized
gagaggatgtggagaaaaagga

SEQ ID NO: 1027860 - DNA, 22 bp, Artificial Sequence
  chemically synthesized
cagtcccaccaacagtgtaaaa

SEQ ID NO: 1027861 - DNA, 22 bp, Artificial Sequence
  chemically synthesized
acagtcccaccaacagtgtaaa

SEQ ID NO: 1027862 - DNA, 22 bp, Artificial Sequence
  chemically synthesized
gtttacagtcccaccaacagtg

SEQ ID NO: 1027863 - DNA, 22 bp, Artificial Sequence
  chemically synthesized
aactagtttacagtcccaccaa

SEQ ID NO: 1027864 - DNA, 22 bp, Artificial Sequence
  chemically synthesized
ttacactgttggtgggactgta

SEQ ID NO: 1027865 - DNA, 22 bp, Artificial Sequence
  chemically synthesized
tacactgttggtgggactgtaa

SEQ ID NO: 1027866 - DNA, 22 bp, Artificial Sequence
  chemically synthesized
acactgttggtgggactgtaaa

SEQ ID NO: 1027867 - DNA, 22 bp, Artificial Sequence
  chemically synthesized
cactgttggtgggactgtaaac

SEQ ID NO: 1027868 - DNA, 22 bp, Artificial Sequence
  chemically synthesized
cacaatggttgaactagtttac

SEQ ID NO: 1027869 - DNA, 22 bp, Artificial Sequence
  chemically synthesized
ttggtgggactgtaaactagtt

SEQ ID NO: 1027870 - DNA, 22 bp, Artificial Sequence
  chemically synthesized
ccacaatggttgaactagttta

SEQ ID NO: 1027871 - DNA, 22 bp, Artificial Sequence
  chemically synthesized
gtgggactgtaaactagttcaa

SEQ ID NO: 1027872 - DNA, 22 bp, Artificial Sequence
  chemically synthesized
tcttccacaatggttgaactag

SEQ ID NO: 1027873 - DNA, 22 bp, Artificial Sequence
  chemically synthesized
taaactagttcaaccattgtgg

SEQ ID NO: 1027874 - DNA, 22 bp, Artificial Sequence
  chemically synthesized
gttcaaccattgtggaagacag

SEQ ID NO: 1027875 - DNA, 22 bp, Artificial Sequence
  chemically synthesized
aggaatcgccacactgtcttcc

SEQ ID NO: 1027876 - DNA, 22 bp, Artificial Sequence
  chemically synthesized
gaggaatcgccacactgtcttc

SEQ ID NO: 1027877 - DNA, 22 bp, Artificial Sequence
  chemically synthesized
aaccattgtggaagacagtgtg

SEQ ID NO: 1027878 - DNA, 22 bp, Artificial Sequence
  chemically synthesized
tatccttgaggaatcgccacac

SEQ ID NO: 1027879 - DNA, 22 bp, Artificial Sequence
  chemically synthesized
tgtatccttgaggaatcgccac

SEQ ID NO: 1027880 - DNA, 22 bp, Artificial Sequence
  chemically synthesized
tggaagacagtgtggcgattcc

SEQ ID NO: 1027881 - DNA, 22 bp, Artificial Sequence
  chemically synthesized
gttctgtatccttgaggaatcg

SEQ ID NO: 1027882 - DNA, 22 bp, Artificial Sequence
  chemically synthesized
tggttctgtatccttgaggaat

SEQ ID NO: 1027883 - DNA, 22 bp, Artificial Sequence
  chemically synthesized
ctggttctgtatccttgaggaa

SEQ ID NO: 1027884 - DNA, 22 bp, Artificial Sequence
  chemically synthesized
ctcaaggatacagaaccagaaa

SEQ ID NO: 1027885 - DNA, 22 bp, Artificial Sequence
  chemically synthesized
ggtcaaatggtatttctggttc

SEQ ID NO: 1027886 - DNA, 22 bp, Artificial Sequence
  chemically synthesized
aaggatacagaaccagaaatac

SEQ ID NO: 1027887 - DNA, 22 bp, Artificial Sequence
  chemically synthesized
ctgggtcaaatggtatttctgg

SEQ ID NO: 1027888 - DNA, 22 bp, Artificial Sequence
  chemically synthesized
ggtatatatgcagtaatgggat

SEQ ID NO: 1027889 - DNA, 22 bp, Artificial Sequence
  chemically synthesized
gggtatatatgcagtaatggga

SEQ ID NO: 1027890 - DNA, 22 bp, Artificial Sequence
  chemically synthesized
tgggtatatatgcagtaatggg

SEQ ID NO: 1027891 - DNA, 22 bp, Artificial Sequence
  chemically synthesized
gacccagcaatcccattactgc

SEQ ID NO: 1027892 - DNA, 22 bp, Artificial Sequence
  chemically synthesized
acccagcaatcccattactgca

SEQ ID NO: 1027893 - DNA, 22 bp, Artificial Sequence
  chemically synthesized
taatactttgggtatatatgca

SEQ ID NO: 1027894 - DNA, 22 bp, Artificial Sequence
  chemically synthesized
ataatactttgggtatatatgc

SEQ ID NO: 1027895 - DNA, 22 bp, Artificial Sequence
  chemically synthesized
ctgcatatatacccaaagtatt

SEQ ID NO: 1027896 - DNA, 22 bp, Artificial Sequence
  chemically synthesized
catatatacccaaagtattata

SEQ ID NO: 1027897 - DNA, 22 bp, Artificial Sequence
  chemically synthesized
taggagaatgatttataatact

SEQ ID NO: 1027898 - DNA, 22 bp, Artificial Sequence
  chemically synthesized
ataggagaatgatttataatac

SEQ ID NO: 1027899 - DNA, 22 bp, Artificial Sequence
  chemically synthesized
tataggagaatgatttataata

SEQ ID NO: 1027900 - DNA, 22 bp, Artificial Sequence
  chemically synthesized
taaatcattctcctataaagac

SEQ ID NO: 1027901 - DNA, 22 bp, Artificial Sequence
  chemically synthesized
tcctataaagacacatgcacac

SEQ ID NO: 1027902 - DNA, 22 bp, Artificial Sequence
  chemically synthesized
caataaacatacgtgtgcatgt

SEQ ID NO: 1027903 - DNA, 22 bp, Artificial Sequence
  chemically synthesized
ctataaagacacatgcacacgt

SEQ ID NO: 1027904 - DNA, 22 bp, Artificial Sequence
  chemically synthesized
taaagacacatgcacacgtatg

SEQ ID NO: 1027905 - DNA, 22 bp, Artificial Sequence
  chemically synthesized
taaatagtgctgcaataaacat

SEQ ID NO: 1027906 - DNA, 22 bp, Artificial Sequence
  chemically synthesized
ttgtaaatagtgctgcaataaa

SEQ ID NO: 1027907 - DNA, 22 bp, Artificial Sequence
  chemically synthesized
ctattgtaaatagtgctgcaat

SEQ ID NO: 1027908 - DNA, 22 bp, Artificial Sequence
  chemically synthesized
gctattgtaaatagtgctgcaa

SEQ ID NO: 1027909 - DNA, 22 bp, Artificial Sequence
  chemically synthesized
tgctattgtaaatagtgctgca

SEQ ID NO: 1027910 - DNA, 22 bp, Artificial Sequence
  chemically synthesized
caagtctttgctattgtaaata

SEQ ID NO: 1027911 - DNA, 22 bp, Artificial Sequence
  chemically synthesized
attgcagcactatttacaatag

SEQ ID NO: 1027912 - DNA, 22 bp, Artificial Sequence
  chemically synthesized
ttgcagcactatttacaatagc

SEQ ID NO: 1027913 - DNA, 22 bp, Artificial Sequence
  chemically synthesized
gttccaagtctttgctattgta

SEQ ID NO: 1027914 - DNA, 22 bp, Artificial Sequence
  chemically synthesized
cagcactatttacaatagcaaa

SEQ ID NO: 1027915 - DNA, 22 bp, Artificial Sequence
  chemically synthesized
ggttggttccaagtctttgcta

SEQ ID NO: 1027916 - DNA, 22 bp, Artificial Sequence
  chemically synthesized
gggttggttccaagtctttgct

SEQ ID NO: 1027917 - DNA, 22 bp, Artificial Sequence
  chemically synthesized
tttacaatagcaaagacttgga

SEQ ID NO: 1027918 - DNA, 22 bp, Artificial Sequence
  chemically synthesized
acaatagcaaagacttggaacc

SEQ ID NO: 1027919 - DNA, 22 bp, Artificial Sequence
  chemically synthesized
caatagcaaagacttggaacca

SEQ ID NO: 1027920 - DNA, 22 bp, Artificial Sequence
  chemically synthesized
atgggcatttgggttggttcca

SEQ ID NO: 1027921 - DNA, 22 bp, Artificial Sequence
  chemically synthesized
tcattgatgggcatttgggttg

SEQ ID NO: 1027922 - DNA, 22 bp, Artificial Sequence
  chemically synthesized
ggaaccaacccaaatgcccatc

SEQ ID NO: 1027923 - DNA, 22 bp, Artificial Sequence
  chemically synthesized
gaaccaacccaaatgcccatca

SEQ ID NO: 1027924 - DNA, 22 bp, Artificial Sequence
  chemically synthesized
tccagtctatcattgatgggca

SEQ ID NO: 1027925 - DNA, 22 bp, Artificial Sequence
  chemically synthesized
atccagtctatcattgatgggc

SEQ ID NO: 1027926 - DNA, 22 bp, Artificial Sequence
  chemically synthesized
tatccagtctatcattgatggg

SEQ ID NO: 1027927 - DNA, 22 bp, Artificial Sequence
  chemically synthesized
tttatccagtctatcattgatg

SEQ ID NO: 1027928 - DNA, 22 bp, Artificial Sequence
  chemically synthesized
ctttatccagtctatcattgat

SEQ ID NO: 1027929 - DNA, 22 bp, Artificial Sequence
  chemically synthesized
tctttatccagtctatcattga

SEQ ID NO: 1027930 - DNA, 22 bp, Artificial Sequence
  chemically synthesized
catggtgtatatgtgccaattt

SEQ ID NO: 1027931 - DNA, 22 bp, Artificial Sequence
  chemically synthesized
gataaagaaaattggcacatat

SEQ ID NO: 1027932 - DNA, 22 bp, Artificial Sequence
  chemically synthesized
catagtattccatggtgtatat

SEQ ID NO: 1027933 - DNA, 22 bp, Artificial Sequence
  chemically synthesized
tggctgcatagtattccatggt

SEQ ID NO: 1027934 - DNA, 22 bp, Artificial Sequence
  chemically synthesized
atggctgcatagtattccatgg

SEQ ID NO: 1027935 - DNA, 22 bp, Artificial Sequence
  chemically synthesized
gcacatatacaccatggaatac

SEQ ID NO: 1027936 - DNA, 22 bp, Artificial Sequence
  chemically synthesized
tatggctgcatagtattccatg

SEQ ID NO: 1027937 - DNA, 22 bp, Artificial Sequence
  chemically synthesized
ttatggctgcatagtattccat

SEQ ID NO: 1027938 - DNA, 22 bp, Artificial Sequence
  chemically synthesized
tttatggctgcatagtattcca

SEQ ID NO: 1027939 - DNA, 22 bp, Artificial Sequence
  chemically synthesized
ttttatggctgcatagtattcc

SEQ ID NO: 1027940 - DNA, 22 bp, Artificial Sequence
  chemically synthesized
ttttttatggctgcatagtatt

SEQ ID NO: 1027941 - DNA, 22 bp, Artificial Sequence
  chemically synthesized
attcttttttatggctgcatag

SEQ ID NO: 1027942 - DNA, 22 bp, Artificial Sequence
  chemically synthesized
tgcagccataaaaaagaatgag

SEQ ID NO: 1027943 - DNA, 22 bp, Artificial Sequence
  chemically synthesized
atccatgtccgtgcaaaggaca

SEQ ID NO: 1027944 - DNA, 22 bp, Artificial Sequence
  chemically synthesized
catccatgtccgtgcaaaggac

SEQ ID NO: 1027945 - DNA, 22 bp, Artificial Sequence
  chemically synthesized
cagcttcatccatgtccgtgca

SEQ ID NO: 1027946 - DNA, 22 bp, Artificial Sequence
  chemically synthesized
ccagcttcatccatgtccgtgc

SEQ ID NO: 1027947 - DNA, 22 bp, Artificial Sequence
  chemically synthesized
atgtcctttgcacggacatgga

SEQ ID NO: 1027948 - DNA, 22 bp, Artificial Sequence
  chemically synthesized
tgcacggacatggatgaagctg

SEQ ID NO: 1027949 - DNA, 22 bp, Artificial Sequence
  chemically synthesized
gcacggacatggatgaagctgg

SEQ ID NO: 1027950 - DNA, 22 bp, Artificial Sequence
  chemically synthesized
cacggacatggatgaagctgga

SEQ ID NO: 1027951 - DNA, 22 bp, Artificial Sequence
  chemically synthesized
agaatgatggtttccagcttca

SEQ ID NO: 1027952 - DNA, 22 bp, Artificial Sequence
  chemically synthesized
ctgagaatgatggtttccagct

SEQ ID NO: 1027953 - DNA, 22 bp, Artificial Sequence
  chemically synthesized
gctgagaatgatggtttccagc

SEQ ID NO: 1027954 - DNA, 22 bp, Artificial Sequence
  chemically synthesized
gtttgctgagaatgatggtttc

SEQ ID NO: 1027955 - DNA, 22 bp, Artificial Sequence
  chemically synthesized
tgttagtttgctgagaatgatg

SEQ ID NO: 1027956 - DNA, 22 bp, Artificial Sequence
  chemically synthesized
ctgtgttagtttgctgagaatg

SEQ ID NO: 1027957 - DNA, 22 bp, Artificial Sequence
  chemically synthesized
ttcctgtgttagtttgctgaga

SEQ ID NO: 1027958 - DNA, 22 bp, Artificial Sequence
  chemically synthesized
gaaaccatcattctcagcaaac

SEQ ID NO: 1027959 - DNA, 22 bp, Artificial Sequence
  chemically synthesized
tgttcctgtgttagtttgctga

SEQ ID NO: 1027960 - DNA, 22 bp, Artificial Sequence
  chemically synthesized
ctgttcctgtgttagtttgctg

SEQ ID NO: 1027961 - DNA, 22 bp, Artificial Sequence
  chemically synthesized
tctgttcctgtgttagtttgct

SEQ ID NO: 1027962 - DNA, 22 bp, Artificial Sequence
  chemically synthesized
gttttctgttcctgtgttagtt

SEQ ID NO: 1027963 - DNA, 22 bp, Artificial Sequence
  chemically synthesized
ggttttctgttcctgtgttagt

SEQ ID NO: 1027964 - DNA, 22 bp, Artificial Sequence
  chemically synthesized
tcagcaaactaacacaggaaca

SEQ ID NO: 1027965 - DNA, 22 bp, Artificial Sequence
  chemically synthesized
agcaaactaacacaggaacaga

SEQ ID NO: 1027966 - DNA, 22 bp, Artificial Sequence
  chemically synthesized
acacaggaacagaaaaccaaac

SEQ ID NO: 1027967 - DNA, 22 bp, Artificial Sequence
  chemically synthesized
tgggtgagaatatgtggtgttt

SEQ ID NO: 1027968 - DNA, 22 bp, Artificial Sequence
  chemically synthesized
atgggtgagaatatgtggtgtt

SEQ ID NO: 1027969 - DNA, 22 bp, Artificial Sequence
  chemically synthesized
ccacttatgggtgagaatatgt

SEQ ID NO: 1027970 - DNA, 22 bp, Artificial Sequence
  chemically synthesized
aactcccacttatgggtgagaa

SEQ ID NO: 1027971 - DNA, 22 bp, Artificial Sequence
  chemically synthesized
atcgttcaactcccacttatgg

SEQ ID NO: 1027972 - DNA, 22 bp, Artificial Sequence
  chemically synthesized
tcatcgttcaactcccacttat

SEQ ID NO: 1027973 - DNA, 22 bp, Artificial Sequence
  chemically synthesized
tcacccataagtgggagttgaa

SEQ ID NO: 1027974 - DNA, 22 bp, Artificial Sequence
  chemically synthesized
tgtgttctcatcgttcaactcc

SEQ ID NO: 1027975 - DNA, 22 bp, Artificial Sequence
  chemically synthesized
acccataagtgggagttgaacg

SEQ ID NO: 1027976 - DNA, 22 bp, Artificial Sequence
  chemically synthesized
tgtctatgtgttctcatcgttc

SEQ ID NO: 1027977 - DNA, 22 bp, Artificial Sequence
  chemically synthesized
cccgccctgtgtctatgtgttc

SEQ ID NO: 1027978 - DNA, 22 bp, Artificial Sequence
  chemically synthesized
aacgatgagaacacatagacac

SEQ ID NO: 1027979 - DNA, 22 bp, Artificial Sequence
  chemically synthesized
agaggccccggtgtgtgatgtt

SEQ ID NO: 1027980 - DNA, 22 bp, Artificial Sequence
  chemically synthesized
accccccatcccctgagaggcc

SEQ ID NO: 1027981 - DNA, 22 bp, Artificial Sequence
  chemically synthesized
ccctaaccccccatcccctgag

SEQ ID NO: 1027982 - DNA, 22 bp, Artificial Sequence
  chemically synthesized
tccctcccctaaccccccatcc

SEQ ID NO: 1027983 - DNA, 22 bp, Artificial Sequence
  chemically synthesized
atgctatccctcccctaacccc

SEQ ID NO: 1027984 - DNA, 22 bp, Artificial Sequence
  chemically synthesized
tcaggggatggggggttagggg

SEQ ID NO: 1027985 - DNA, 22 bp, Artificial Sequence
  chemically synthesized
aggggatggggggttaggggag

SEQ ID NO: 1027986 - DNA, 22 bp, Artificial Sequence
  chemically synthesized
ctaatgctatccctcccctaac

SEQ ID NO: 1027987 - DNA, 22 bp, Artificial Sequence
  chemically synthesized
tcctaatgctatccctccccta

SEQ ID NO: 1027988 - DNA, 22 bp, Artificial Sequence
  chemically synthesized
ctcctaatgctatccctcccct

SEQ ID NO: 1027989 - DNA, 22 bp, Artificial Sequence
  chemically synthesized
ggtatttctcctaatgctatcc

SEQ ID NO: 1027990 - DNA, 22 bp, Artificial Sequence
  chemically synthesized
cattaggtatttctcctaatgc

SEQ ID NO: 1027991 - DNA, 22 bp, Artificial Sequence
  chemically synthesized
ggggagggatagcattaggaga

SEQ ID NO: 1027992 - DNA, 22 bp, Artificial Sequence
  chemically synthesized
ggagaaatacctaatgtagatg

SEQ ID NO: 1027993 - DNA, 22 bp, Artificial Sequence
  chemically synthesized
cacacatcaacccatcatctac

SEQ ID NO: 1027994 - DNA, 22 bp, Artificial Sequence
  chemically synthesized
ctgcacacatcaacccatcatc

SEQ ID NO: 1027995 - DNA, 22 bp, Artificial Sequence
  chemically synthesized
gctgcacacatcaacccatcat

SEQ ID NO: 1027996 - DNA, 22 bp, Artificial Sequence
  chemically synthesized
atgtagatgatgggttgatgtg

SEQ ID NO: 1027997 - DNA, 22 bp, Artificial Sequence
  chemically synthesized
catggtggtttgctgcacacat

SEQ ID NO: 1027998 - DNA, 22 bp, Artificial Sequence
  chemically synthesized
atgtgtgcagcaaaccaccatg

SEQ ID NO: 1027999 - DNA, 22 bp, Artificial Sequence
  chemically synthesized
cataggtgtacacgttccatgg

SEQ ID NO: 1028000 - DNA, 22 bp, Artificial Sequence
  chemically synthesized
ttgcataggtgtacacgttcca

SEQ ID NO: 1028001 - DNA, 22 bp, Artificial Sequence
  chemically synthesized
gttgcataggtgtacacgttcc

SEQ ID NO: 1028002 - DNA, 22 bp, Artificial Sequence
  chemically synthesized
ggacacacgtgcagaacgggca

SEQ ID NO: 1028003 - DNA, 22 bp, Artificial Sequence
  chemically synthesized
tgcaacaaacctgcccgttctg

SEQ ID NO: 1028004 - DNA, 22 bp, Artificial Sequence
  chemically synthesized
tgggacacacgtgcagaacggg

SEQ ID NO: 1028005 - DNA, 22 bp, Artificial Sequence
  chemically synthesized
agttctgggacacacgtgcaga

SEQ ID NO: 1028006 - DNA, 22 bp, Artificial Sequence
  chemically synthesized
aagttctgggacacacgtgcag

SEQ ID NO: 1028007 - DNA, 22 bp, Artificial Sequence
  chemically synthesized
taagttctgggacacacgtgca

SEQ ID NO: 1028008 - DNA, 22 bp, Artificial Sequence
  chemically synthesized
cccgttctgcacgtgtgtccca

SEQ ID NO: 1028009 - DNA, 22 bp, Artificial Sequence
  chemically synthesized
tactttaagttctgggacacac

SEQ ID NO: 1028010 - DNA, 22 bp, Artificial Sequence
  chemically synthesized
ttatactttaagttctgggaca

SEQ ID NO: 1028011 - DNA, 22 bp, Artificial Sequence
  chemically synthesized
tgcacgtgtgtcccagaactta

SEQ ID NO: 1028012 - DNA, 22 bp, Artificial Sequence
  chemically synthesized
attattatactttaagttctgg

SEQ ID NO: 1028013 - DNA, 22 bp, Artificial Sequence
  chemically synthesized
cattattatactttaagttctg

SEQ ID NO: 1028014 - DNA, 22 bp, Artificial Sequence
  chemically synthesized
cacgtgtgtcccagaacttaaa

SEQ ID NO: 1028015 - DNA, 22 bp, Artificial Sequence
  chemically synthesized
tcattattatactttaagttct

SEQ ID NO: 1028016 - DNA, 22 bp, Artificial Sequence
  chemically synthesized
ttcattattatactttaagttc

SEQ ID NO: 1028017 - DNA, 22 bp, Artificial Sequence
  chemically synthesized
tttcattattatactttaagtt

SEQ ID NO: 1028018 - DNA, 22 bp, Artificial Sequence
  chemically synthesized
ttttcattattatactttaagt

SEQ ID NO: 1028019 - DNA, 22 bp, Artificial Sequence
  chemically synthesized
tttttcattattatactttaag

SEQ ID NO: 1028020 - DNA, 22 bp, Artificial Sequence
  chemically synthesized
atctttttttcattattatact

SEQ ID NO: 1028021 - DNA, 22 bp, Artificial Sequence
  chemically synthesized
ccctgatctttttttcattatt

SEQ ID NO: 1028022 - DNA, 22 bp, Artificial Sequence
  chemically synthesized
accctgatctttttttcattat

SEQ ID NO: 1028023 - DNA, 22 bp, Artificial Sequence
  chemically synthesized
taccctgatctttttttcatta

SEQ ID NO: 1028024 - DNA, 22 bp, Artificial Sequence
  chemically synthesized
aaagtataataatgaaaaaaag

SEQ ID NO: 1028025 - DNA, 22 bp, Artificial Sequence
  chemically synthesized
aagtataataatgaaaaaaaga

SEQ ID NO: 1028026 - DNA, 22 bp, Artificial Sequence
  chemically synthesized
aaaacaatgacaaaatatattt

SEQ ID NO: 1028027 - DNA, 22 bp, Artificial Sequence
  chemically synthesized
tgttcaaaacaatgacaaaata

SEQ ID NO: 1028028 - DNA, 22 bp, Artificial Sequence
  chemically synthesized
tggctatgttcaaaacaatgac

SEQ ID NO: 1028029 - DNA, 22 bp, Artificial Sequence
  chemically synthesized
cctatggctatgttcaaaacaa

SEQ ID NO: 1028030 - DNA, 22 bp, Artificial Sequence
  chemically synthesized
tgtcattgttttgaacatagcc

SEQ ID NO: 1028031 - DNA, 22 bp, Artificial Sequence
  chemically synthesized
gtcattgttttgaacatagcca

SEQ ID NO: 1028032 - DNA, 22 bp, Artificial Sequence
  chemically synthesized
tgatcctacctatggctatgtt

SEQ ID NO: 1028033 - DNA, 22 bp, Artificial Sequence
  chemically synthesized
tcattgttttgaacatagccat

SEQ ID NO: 1028034 - DNA, 22 bp, Artificial Sequence
  chemically synthesized
atgatcctacctatggctatgt

SEQ ID NO: 1028035 - DNA, 22 bp, Artificial Sequence
  chemically synthesized
tatgatcctacctatggctatg

SEQ ID NO: 1028036 - DNA, 22 bp, Artificial Sequence
  chemically synthesized
ttttatgatcctacctatggct

SEQ ID NO: 1028037 - DNA, 22 bp, Artificial Sequence
  chemically synthesized
ttttgaacatagccataggtag

SEQ ID NO: 1028038 - DNA, 22 bp, Artificial Sequence
  chemically synthesized
tgaacatagccataggtaggat

SEQ ID NO: 1028039 - DNA, 22 bp, Artificial Sequence
  chemically synthesized
tgctattttatgatcctaccta

SEQ ID NO: 1028040 - DNA, 22 bp, Artificial Sequence
  chemically synthesized
gaacatagccataggtaggatc

SEQ ID NO: 1028041 - DNA, 22 bp, Artificial Sequence
  chemically synthesized
aacatagccataggtaggatca

SEQ ID NO: 1028042 - DNA, 22 bp, Artificial Sequence
  chemically synthesized
agttgtgctattttatgatcct

SEQ ID NO: 1028043 - DNA, 22 bp, Artificial Sequence
  chemically synthesized
aagttgtgctattttatgatcc

SEQ ID NO: 1028044 - DNA, 22 bp, Artificial Sequence
  chemically synthesized
tttaagttgtgctattttatga

SEQ ID NO: 1028045 - DNA, 22 bp, Artificial Sequence
  chemically synthesized
tatttaagttgtgctattttat

SEQ ID NO: 1028046 - DNA, 22 bp, Artificial Sequence
  chemically synthesized
ctatttaagttgtgctatttta

SEQ ID NO: 1028047 - DNA, 22 bp, Artificial Sequence
  chemically synthesized
tctatttaagttgtgctatttt

SEQ ID NO: 1028048 - DNA, 22 bp, Artificial Sequence
  chemically synthesized
ttctatttaagttgtgctattt

SEQ ID NO: 1028049 - DNA, 22 bp, Artificial Sequence
  chemically synthesized
tttttctatttaagttgtgcta

SEQ ID NO: 1028050 - DNA, 22 bp, Artificial Sequence
  chemically synthesized
atttttctatttaagttgtgct

SEQ ID NO: 1028051 - DNA, 22 bp, Artificial Sequence
  chemically synthesized
aatcatttatttttctatttaa

SEQ ID NO: 1028052 - DNA, 22 bp, Artificial Sequence
  chemically synthesized
tgaatcatttatttttctattt

SEQ ID NO: 1028053 - DNA, 22 bp, Artificial Sequence
  chemically synthesized
attctgaatcatttatttttct

SEQ ID NO: 1028054 - DNA, 22 bp, Artificial Sequence
  chemically synthesized
agacctgattctgaatcattta

SEQ ID NO: 1028055 - DNA, 22 bp, Artificial Sequence
  chemically synthesized
aaatagaaaaataaatgattca

SEQ ID NO: 1028056 - DNA, 22 bp, Artificial Sequence
  chemically synthesized
aatagaaaaataaatgattcag

SEQ ID NO: 1028057 - DNA, 22 bp, Artificial Sequence
  chemically synthesized
tacctgagacctgattctgaat

SEQ ID NO: 1028058 - DNA, 22 bp, Artificial Sequence
  chemically synthesized
gtacctgagacctgattctgaa

SEQ ID NO: 1028059 - DNA, 22 bp, Artificial Sequence
  chemically synthesized
tttgtacctgagacctgattct

SEQ ID NO: 1028060 - DNA, 22 bp, Artificial Sequence
  chemically synthesized
gctgtttgtacctgagacctga

SEQ ID NO: 1028061 - DNA, 22 bp, Artificial Sequence
  chemically synthesized
ggctgtttgtacctgagacctg

SEQ ID NO: 1028062 - DNA, 22 bp, Artificial Sequence
  chemically synthesized
tggctgtttgtacctgagacct

SEQ ID NO: 1028063 - DNA, 22 bp, Artificial Sequence
  chemically synthesized
ttttggctgtttgtacctgaga

SEQ ID NO: 1028064 - DNA, 22 bp, Artificial Sequence
  chemically synthesized
agaatcaggtctcaggtacaaa

SEQ ID NO: 1028065 - DNA, 22 bp, Artificial Sequence
  chemically synthesized
aattattttggctgtttgtacc

SEQ ID NO: 1028066 - DNA, 22 bp, Artificial Sequence
  chemically synthesized
attgaattattttggctgtttg

SEQ ID NO: 1028067 - DNA, 22 bp, Artificial Sequence
  chemically synthesized
cattgaattattttggctgttt

SEQ ID NO: 1028068 - DNA, 22 bp, Artificial Sequence
  chemically synthesized
aggtacaaacagccaaaataat

SEQ ID NO: 1028069 - DNA, 22 bp, Artificial Sequence
  chemically synthesized
tagtatagagaaataatttcat

SEQ ID NO: 1028070 - DNA, 22 bp, Artificial Sequence
  chemically synthesized
gtagtatagagaaataatttca

SEQ ID NO: 1028071 - DNA, 22 bp, Artificial Sequence
  chemically synthesized
aatgaaattatttctctatact

SEQ ID NO: 1028072 - DNA, 22 bp, Artificial Sequence
  chemically synthesized
tttctctatactacaaattgtg

SEQ ID NO: 1028073 - DNA, 22 bp, Artificial Sequence
  chemically synthesized
ctctatactacaaattgtggac

SEQ ID NO: 1028074 - DNA, 22 bp, Artificial Sequence
  chemically synthesized
tctatactacaaattgtggact

SEQ ID NO: 1028075 - DNA, 22 bp, Artificial Sequence
  chemically synthesized
tatactacaaattgtggactca

SEQ ID NO: 1028076 - DNA, 22 bp, Artificial Sequence
  chemically synthesized
tactacaaattgtggactcaca

SEQ ID NO: 1028077 - DNA, 22 bp, Artificial Sequence
  chemically synthesized
caaattgtggactcacatggca

SEQ ID NO: 1028078 - DNA, 22 bp, Artificial Sequence
  chemically synthesized
tatcagatatgatgccatgtga

SEQ ID NO: 1028079 - DNA, 22 bp, Artificial Sequence
  chemically synthesized
atatcagatatgatgccatgtg

SEQ ID NO: 1028080 - DNA, 22 bp, Artificial Sequence
  chemically synthesized
tttatatcagatatgatgccat

SEQ ID NO: 1028081 - DNA, 22 bp, Artificial Sequence
  chemically synthesized
tggactcacatggcatcatatc

SEQ ID NO: 1028082 - DNA, 22 bp, Artificial Sequence
  chemically synthesized
ttatttatatcagatatgatgc

SEQ ID NO: 1028083 - DNA, 22 bp, Artificial Sequence
  chemically synthesized
acatggcatcatatctgatata

SEQ ID NO: 1028084 - DNA, 22 bp, Artificial Sequence
  chemically synthesized
aaataaactattatttatatca

SEQ ID NO: 1028085 - DNA, 22 bp, Artificial Sequence
  chemically synthesized
aaaataaactattatttatatc

SEQ ID NO: 1028086 - DNA, 22 bp, Artificial Sequence
  chemically synthesized
atttaaaataaactattattta

SEQ ID NO: 1028087 - DNA, 22 bp, Artificial Sequence
  chemically synthesized
tattcatttaaaataaactatt

SEQ ID NO: 1028088 - DNA, 22 bp, Artificial Sequence
  chemically synthesized
atataaataatagtttatttta

SEQ ID NO: 1028089 - DNA, 22 bp, Artificial Sequence
  chemically synthesized
tctatattcatttaaaataaac

SEQ ID NO: 1028090 - DNA, 22 bp, Artificial Sequence
  chemically synthesized
ctgtctatattcatttaaaata

SEQ ID NO: 1028091 - DNA, 22 bp, Artificial Sequence
  chemically synthesized
cagccactcctgtctatattca

SEQ ID NO: 1028092 - DNA, 22 bp, Artificial Sequence
  chemically synthesized
ccagccactcctgtctatattc

SEQ ID NO: 1028093 - DNA, 22 bp, Artificial Sequence
  chemically synthesized
attttaaatgaatatagacagg

SEQ ID NO: 1028094 - DNA, 22 bp, Artificial Sequence
  chemically synthesized
ttttaaatgaatatagacagga

SEQ ID NO: 1028095 - DNA, 22 bp, Artificial Sequence
  chemically synthesized
gtttccagccactcctgtctat

SEQ ID NO: 1028096 - DNA, 22 bp, Artificial Sequence
  chemically synthesized
agtttccagccactcctgtcta

SEQ ID NO: 1028097 - DNA, 22 bp, Artificial Sequence
  chemically synthesized
tagtttccagccactcctgtct

SEQ ID NO: 1028098 - DNA, 22 bp, Artificial Sequence
  chemically synthesized
taaatgaatatagacaggagtg

SEQ ID NO: 1028099 - DNA, 22 bp, Artificial Sequence
  chemically synthesized
ttagtttccagccactcctgtc

SEQ ID NO: 1028100 - DNA, 22 bp, Artificial Sequence
  chemically synthesized
aaatgaatatagacaggagtgg

SEQ ID NO: 1028101 - DNA, 22 bp, Artificial Sequence
  chemically synthesized
aatgaatatagacaggagtggc

SEQ ID NO: 1028102 - DNA, 22 bp, Artificial Sequence
  chemically synthesized
tggagaagaaatacatgctttt

SEQ ID NO: 1028103 - DNA, 22 bp, Artificial Sequence
  chemically synthesized
atggagaagaaatacatgcttt

SEQ ID NO: 1028104 - DNA, 22 bp, Artificial Sequence
  chemically synthesized
gaaactaaaagcatgtatttct

SEQ ID NO: 1028105 - DNA, 22 bp, Artificial Sequence
  chemically synthesized
atcttatggagaagaaatacat

SEQ ID NO: 1028106 - DNA, 22 bp, Artificial Sequence
  chemically synthesized
catcttatggagaagaaataca

SEQ ID NO: 1028107 - DNA, 22 bp, Artificial Sequence
  chemically synthesized
tcatcttatggagaagaaatac

SEQ ID NO: 1028108 - DNA, 22 bp, Artificial Sequence
  chemically synthesized
tttcatcttatggagaagaaat

SEQ ID NO: 1028109 - DNA, 22 bp, Artificial Sequence
  chemically synthesized
aaagcatgtatttcttctccat

SEQ ID NO: 1028110 - DNA, 22 bp, Artificial Sequence
  chemically synthesized
aatcctctttcatcttatggag

SEQ ID NO: 1028111 - DNA, 22 bp, Artificial Sequence
  chemically synthesized
cttctccataagatgaaagagg

SEQ ID NO: 1028112 - DNA, 22 bp, Artificial Sequence
  chemically synthesized
ttctccataagatgaaagagga

SEQ ID NO: 1028113 - DNA, 22 bp, Artificial Sequence
  chemically synthesized
agtgtatcctaaatcctctttc

SEQ ID NO: 1028114 - DNA, 22 bp, Artificial Sequence
  chemically synthesized
ctccataagatgaaagaggatt

SEQ ID NO: 1028115 - DNA, 22 bp, Artificial Sequence
  chemically synthesized
aagtgtatcctaaatcctcttt

SEQ ID NO: 1028116 - DNA, 22 bp, Artificial Sequence
  chemically synthesized
tccataagatgaaagaggattt

SEQ ID NO: 1028117 - DNA, 22 bp, Artificial Sequence
  chemically synthesized
cataagatgaaagaggatttag

SEQ ID NO: 1028118 - DNA, 22 bp, Artificial Sequence
  chemically synthesized
tcttaagtgtatcctaaatcct

SEQ ID NO: 1028119 - DNA, 22 bp, Artificial Sequence
  chemically synthesized
gtatgttatcttaagtgtatcc

SEQ ID NO: 1028120 - DNA, 22 bp, Artificial Sequence
  chemically synthesized
agtatgttatcttaagtgtatc

SEQ ID NO: 1028121 - DNA, 22 bp, Artificial Sequence
  chemically synthesized
aggatacacttaagataacata

SEQ ID NO: 1028122 - DNA, 22 bp, Artificial Sequence
  chemically synthesized
ggatacacttaagataacatac

SEQ ID NO: 1028123 - DNA, 22 bp, Artificial Sequence
  chemically synthesized
gcaaaacaagatttagtatgtt

SEQ ID NO: 1028124 - DNA, 22 bp, Artificial Sequence
  chemically synthesized
cactggcaaaacaagatttagt

SEQ ID NO: 1028125 - DNA, 22 bp, Artificial Sequence
  chemically synthesized
aagataacatactaaatcttgt

SEQ ID NO: 1028126 - DNA, 22 bp, Artificial Sequence
  chemically synthesized
agataacatactaaatcttgtt

SEQ ID NO: 1028127 - DNA, 22 bp, Artificial Sequence
  chemically synthesized
aatcttgttttgccagtgtagc

SEQ ID NO: 1028128 - DNA, 22 bp, Artificial Sequence
  chemically synthesized
aatgccaagcagaagctacact

SEQ ID NO: 1028129 - DNA, 22 bp, Artificial Sequence
  chemically synthesized
aaatgccaagcagaagctacac

SEQ ID NO: 1028130 - DNA, 22 bp, Artificial Sequence
  chemically synthesized
gttttgccagtgtagcttctgc

SEQ ID NO: 1028131 - DNA, 22 bp, Artificial Sequence
  chemically synthesized
ttttgccagtgtagcttctgct

SEQ ID NO: 1028132 - DNA, 22 bp, Artificial Sequence
  chemically synthesized
tgccagtgtagcttctgcttgg

SEQ ID NO: 1028133 - DNA, 22 bp, Artificial Sequence
  chemically synthesized
gccagtgtagcttctgcttggc

SEQ ID NO: 1028134 - DNA, 22 bp, Artificial Sequence
  chemically synthesized
ccagtgtagcttctgcttggca

SEQ ID NO: 1028135 - DNA, 22 bp, Artificial Sequence
  chemically synthesized
agtaacagatatttaaatgcca

SEQ ID NO: 1028136 - DNA, 22 bp, Artificial Sequence
  chemically synthesized
ttaagtaacagatatttaaatg

SEQ ID NO: 1028137 - DNA, 22 bp, Artificial Sequence
  chemically synthesized
tattaagtaacagatatttaaa

SEQ ID NO: 1028138 - DNA, 22 bp, Artificial Sequence
  chemically synthesized
ctattaagtaacagatatttaa

SEQ ID NO: 1028139 - DNA, 22 bp, Artificial Sequence
  chemically synthesized
ctgcttggcatttaaatatctg

SEQ ID NO: 1028140 - DNA, 22 bp, Artificial Sequence
  chemically synthesized
tgcttggcatttaaatatctgt

SEQ ID NO: 1028141 - DNA, 22 bp, Artificial Sequence
  chemically synthesized
cttggcatttaaatatctgtta

SEQ ID NO: 1028142 - DNA, 22 bp, Artificial Sequence
  chemically synthesized
ggcatttaaatatctgttactt

SEQ ID NO: 1028143 - DNA, 22 bp, Artificial Sequence
  chemically synthesized
aatgtttctattaagtaacaga

SEQ ID NO: 1028144 - DNA, 22 bp, Artificial Sequence
  chemically synthesized
gcatttaaatatctgttactta

SEQ ID NO: 1028145 - DNA, 22 bp, Artificial Sequence
  chemically synthesized
aaatatctgttacttaatagaa

SEQ ID NO: 1028146 - DNA, 22 bp, Artificial Sequence
  chemically synthesized
aatatctgttacttaatagaaa

SEQ ID NO: 1028147 - DNA, 22 bp, Artificial Sequence
  chemically synthesized
gggtccaaaattgaatgtttct

SEQ ID NO: 1028148 - DNA, 22 bp, Artificial Sequence
  chemically synthesized
agggtccaaaattgaatgtttc

SEQ ID NO: 1028149 - DNA, 22 bp, Artificial Sequence
  chemically synthesized
tagggtccaaaattgaatgttt

SEQ ID NO: 1028150 - DNA, 22 bp, Artificial Sequence
  chemically synthesized
ttacttaatagaaacattcaat

SEQ ID NO: 1028151 - DNA, 22 bp, Artificial Sequence
  chemically synthesized
cttaatagaaacattcaatttt

SEQ ID NO: 1028152 - DNA, 22 bp, Artificial Sequence
  chemically synthesized
aatagaaacattcaattttgga

SEQ ID NO: 1028153 - DNA, 22 bp, Artificial Sequence
  chemically synthesized
atagaaacattcaattttggac

SEQ ID NO: 1028154 - DNA, 22 bp, Artificial Sequence
  chemically synthesized
tgtgatattttagggtccaaaa

SEQ ID NO: 1028155 - DNA, 22 bp, Artificial Sequence
  chemically synthesized
aattttggaccctaaaatatca

SEQ ID NO: 1028156 - DNA, 22 bp, Artificial Sequence
  chemically synthesized
atgaataatattgtgtgatatt

SEQ ID NO: 1028157 - DNA, 22 bp, Artificial Sequence
  chemically synthesized
aatgaataatattgtgtgatat

SEQ ID NO: 1028158 - DNA, 22 bp, Artificial Sequence
  chemically synthesized
tggaccctaaaatatcacacaa

SEQ ID NO: 1028159 - DNA, 22 bp, Artificial Sequence
  chemically synthesized
taatgaataatattgtgtgata

SEQ ID NO: 1028160 - DNA, 22 bp, Artificial Sequence
  chemically synthesized
ggaccctaaaatatcacacaat

SEQ ID NO: 1028161 - DNA, 22 bp, Artificial Sequence
  chemically synthesized
gaccctaaaatatcacacaata

SEQ ID NO: 1028162 - DNA, 22 bp, Artificial Sequence
  chemically synthesized
aaatatcacacaatattattca

SEQ ID NO: 1028163 - DNA, 22 bp, Artificial Sequence
  chemically synthesized
agtaggtataattttaatgaat

SEQ ID NO: 1028164 - DNA, 22 bp, Artificial Sequence
  chemically synthesized
gagtaggtataattttaatgaa

SEQ ID NO: 1028165 - DNA, 22 bp, Artificial Sequence
  chemically synthesized
gacagatttgagtaggtataat

SEQ ID NO: 1028166 - DNA, 22 bp, Artificial Sequence
  chemically synthesized
ttcattaaaattatacctactc

SEQ ID NO: 1028167 - DNA, 22 bp, Artificial Sequence
  chemically synthesized
attaaaattatacctactcaaa

SEQ ID NO: 1028168 - DNA, 22 bp, Artificial Sequence
  chemically synthesized
aaattatacctactcaaatctg

SEQ ID NO: 1028169 - DNA, 22 bp, Artificial Sequence
  chemically synthesized
tatgatatggctagacagattt

SEQ ID NO: 1028170 - DNA, 22 bp, Artificial Sequence
  chemically synthesized
tacctactcaaatctgtctagc

SEQ ID NO: 1028171 - DNA, 22 bp, Artificial Sequence
  chemically synthesized
ctcaaatctgtctagccatatc

SEQ ID NO: 1028172 - DNA, 22 bp, Artificial Sequence
  chemically synthesized
aaatctgtctagccatatcata

SEQ ID NO: 1028173 - DNA, 22 bp, Artificial Sequence
  chemically synthesized
aaaatatcagtcgctatatgat

SEQ ID NO: 1028174 - DNA, 22 bp, Artificial Sequence
  chemically synthesized
tctagccatatcatatagcgac

SEQ ID NO: 1028175 - DNA, 22 bp, Artificial Sequence
  chemically synthesized
atctaaaaatatcagtcgctat

SEQ ID NO: 1028176 - DNA, 22 bp, Artificial Sequence
  chemically synthesized
gatctaaaaatatcagtcgcta

SEQ ID NO: 1028177 - DNA, 22 bp, Artificial Sequence
  chemically synthesized
gccatatcatatagcgactgat

SEQ ID NO: 1028178 - DNA, 22 bp, Artificial Sequence
  chemically synthesized
tgggtttgatctaaaaatatca

SEQ ID NO: 1028179 - DNA, 22 bp, Artificial Sequence
  chemically synthesized
gtgggtttgatctaaaaatatc

SEQ ID NO: 1028180 - DNA, 22 bp, Artificial Sequence
  chemically synthesized
acacttgtgggtttgatctaaa

SEQ ID NO: 1028181 - DNA, 22 bp, Artificial Sequence
  chemically synthesized
cacacttgtgggtttgatctaa

SEQ ID NO: 1028182 - DNA, 22 bp, Artificial Sequence
  chemically synthesized
atatttttagatcaaacccaca

SEQ ID NO: 1028183 - DNA, 22 bp, Artificial Sequence
  chemically synthesized
ttagatcaaacccacaagtgtg

SEQ ID NO: 1028184 - DNA, 22 bp, Artificial Sequence
  chemically synthesized
tagatcaaacccacaagtgtga

SEQ ID NO: 1028185 - DNA, 22 bp, Artificial Sequence
  chemically synthesized
agatcaaacccacaagtgtgaa

SEQ ID NO: 1028186 - DNA, 22 bp, Artificial Sequence
  chemically synthesized
gatcaaacccacaagtgtgaaa

SEQ ID NO: 1028187 - DNA, 22 bp, Artificial Sequence
  chemically synthesized
aaatgaaaaatatttcacactt

SEQ ID NO: 1028188 - DNA, 22 bp, Artificial Sequence
  chemically synthesized
aaaatgaaaaatatttcacact

SEQ ID NO: 1028189 - DNA, 22 bp, Artificial Sequence
  chemically synthesized
taaaatgaaaaatatttcacac

SEQ ID NO: 1028190 - DNA, 22 bp, Artificial Sequence
  chemically synthesized
aatgtaaaagagtctttaaaat

SEQ ID NO: 1028191 - DNA, 22 bp, Artificial Sequence
  chemically synthesized
ttcattttaaagactcttttac

SEQ ID NO: 1028192 - DNA, 22 bp, Artificial Sequence
  chemically synthesized
tcattttaaagactcttttaca

SEQ ID NO: 1028193 - DNA, 22 bp, Artificial Sequence
  chemically synthesized
cattttaaagactcttttacat

SEQ ID NO: 1028194 - DNA, 22 bp, Artificial Sequence
  chemically synthesized
attttaaagactcttttacatt

SEQ ID NO: 1028195 - DNA, 22 bp, Artificial Sequence
  chemically synthesized
taaagactcttttacatttaat

SEQ ID NO: 1028196 - DNA, 22 bp, Artificial Sequence
  chemically synthesized
gcatgaatacatattaaatgta

SEQ ID NO: 1028197 - DNA, 22 bp, Artificial Sequence
  chemically synthesized
aaagactcttttacatttaata

SEQ ID NO: 1028198 - DNA, 22 bp, Artificial Sequence
  chemically synthesized
aagactcttttacatttaatat

SEQ ID NO: 1028199 - DNA, 22 bp, Artificial Sequence
  chemically synthesized
aaaagttagcatgaatacatat

SEQ ID NO: 1028200 - DNA, 22 bp, Artificial Sequence
  chemically synthesized
ttttacatttaatatgtattca

SEQ ID NO: 1028201 - DNA, 22 bp, Artificial Sequence
  chemically synthesized
aaaaagttagcatgaatacata

SEQ ID NO: 1028202 - DNA, 22 bp, Artificial Sequence
  chemically synthesized
ttacatttaatatgtattcatg

SEQ ID NO: 1028203 - DNA, 22 bp, Artificial Sequence
  chemically synthesized
tacatttaatatgtattcatgc

SEQ ID NO: 1028204 - DNA, 22 bp, Artificial Sequence
  chemically synthesized
acatttaatatgtattcatgct

SEQ ID NO: 1028205 - DNA, 22 bp, Artificial Sequence
  chemically synthesized
catttaatatgtattcatgcta

SEQ ID NO: 1028206 - DNA, 22 bp, Artificial Sequence
  chemically synthesized
aatttaaaaagttagcatgaat

SEQ ID NO: 1028207 - DNA, 22 bp, Artificial Sequence
  chemically synthesized
aaatttaaaaagttagcatgaa

SEQ ID NO: 1028208 - DNA, 22 bp, Artificial Sequence
  chemically synthesized
taaatttaaaaagttagcatga

SEQ ID NO: 1028209 - DNA, 22 bp, Artificial Sequence
  chemically synthesized
aatatgtattcatgctaacttt

SEQ ID NO: 1028210 - DNA, 22 bp, Artificial Sequence
  chemically synthesized
atatgtattcatgctaactttt

SEQ ID NO: 1028211 - DNA, 22 bp, Artificial Sequence
  chemically synthesized
atagaaggtgctttaaatttaa

SEQ ID NO: 1028212 - DNA, 22 bp, Artificial Sequence
  chemically synthesized
atgctaactttttaaatttaaa

SEQ ID NO: 1028213 - DNA, 22 bp, Artificial Sequence
  chemically synthesized
catagaaggtgctttaaattta

SEQ ID NO: 1028214 - DNA, 22 bp, Artificial Sequence
  chemically synthesized
actttttaaatttaaagcacct

SEQ ID NO: 1028215 - DNA, 22 bp, Artificial Sequence
  chemically synthesized
tttaaatttaaagcaccttcta

SEQ ID NO: 1028216 - DNA, 22 bp, Artificial Sequence
  chemically synthesized
aaatacatttcatagaaggtgc

SEQ ID NO: 1028217 - DNA, 22 bp, Artificial Sequence
  chemically synthesized
ttaaatttaaagcaccttctat

SEQ ID NO: 1028218 - DNA, 22 bp, Artificial Sequence
  chemically synthesized
taaatttaaagcaccttctatg

SEQ ID NO: 1028219 - DNA, 22 bp, Artificial Sequence
  chemically synthesized
aaatttaaagcaccttctatga

SEQ ID NO: 1028220 - DNA, 22 bp, Artificial Sequence
  chemically synthesized
aatttaaagcaccttctatgaa

SEQ ID NO: 1028221 - DNA, 22 bp, Artificial Sequence
  chemically synthesized
tattaaaatacatttcatagaa

SEQ ID NO: 1028222 - DNA, 22 bp, Artificial Sequence
  chemically synthesized
gtattaaaatacatttcataga

SEQ ID NO: 1028223 - DNA, 22 bp, Artificial Sequence
  chemically synthesized
aaagcaccttctatgaaatgta

SEQ ID NO: 1028224 - DNA, 22 bp, Artificial Sequence
  chemically synthesized
aagcaccttctatgaaatgtat

SEQ ID NO: 1028225 - DNA, 22 bp, Artificial Sequence
  chemically synthesized
ctatgaaatgtattttaataca

SEQ ID NO: 1028226 - DNA, 22 bp, Artificial Sequence
  chemically synthesized
tatgaaatgtattttaatacaa

SEQ ID NO: 1028227 - DNA, 22 bp, Artificial Sequence
  chemically synthesized
tgaaatgtattttaatacaaat

SEQ ID NO: 1028228 - DNA, 22 bp, Artificial Sequence
  chemically synthesized
tacaatatagggtatttgtatt

SEQ ID NO: 1028229 - DNA, 22 bp, Artificial Sequence
  chemically synthesized
aagtaaattatacaatataggg

SEQ ID NO: 1028230 - DNA, 22 bp, Artificial Sequence
  chemically synthesized
taatacaaataccctatattgt

SEQ ID NO: 1028231 - DNA, 22 bp, Artificial Sequence
  chemically synthesized
aatacaaataccctatattgta

SEQ ID NO: 1028232 - DNA, 22 bp, Artificial Sequence
  chemically synthesized
atacaaataccctatattgtat

SEQ ID NO: 1028233 - DNA, 22 bp, Artificial Sequence
  chemically synthesized
caacgttgaagtaaattataca

SEQ ID NO: 1028234 - DNA, 22 bp, Artificial Sequence
  chemically synthesized
acaacgttgaagtaaattatac

SEQ ID NO: 1028235 - DNA, 22 bp, Artificial Sequence
  chemically synthesized
tattgtataatttacttcaacg

SEQ ID NO: 1028236 - DNA, 22 bp, Artificial Sequence
  chemically synthesized
tataatttacttcaacgttgta

SEQ ID NO: 1028237 - DNA, 22 bp, Artificial Sequence
  chemically synthesized
acttcaacgttgtaaattttcc

SEQ ID NO: 1028238 - DNA, 22 bp, Artificial Sequence
  chemically synthesized
cttcaacgttgtaaattttcca

SEQ ID NO: 1028239 - DNA, 22 bp, Artificial Sequence
  chemically synthesized
caacgttgtaaattttccacga

SEQ ID NO: 1028240 - DNA, 22 bp, Artificial Sequence
  chemically synthesized
aacgttgtaaattttccacgac

SEQ ID NO: 1028241 - DNA, 22 bp, Artificial Sequence
  chemically synthesized
tgaatgatacacatcgtcgtgg

SEQ ID NO: 1028242 - DNA, 22 bp, Artificial Sequence
  chemically synthesized
gtgaatgatacacatcgtcgtg

SEQ ID NO: 1028243 - DNA, 22 bp, Artificial Sequence
  chemically synthesized
taaattttccacgacgatgtgt

SEQ ID NO: 1028244 - DNA, 22 bp, Artificial Sequence
  chemically synthesized
tttgtgaatgatacacatcgtc

SEQ ID NO: 1028245 - DNA, 22 bp, Artificial Sequence
  chemically synthesized
atattatttgtgaatgatacac

SEQ ID NO: 1028246 - DNA, 22 bp, Artificial Sequence
  chemically synthesized
tccacgacgatgtgtatcattc

SEQ ID NO: 1028247 - DNA, 22 bp, Artificial Sequence
  chemically synthesized
catattatttgtgaatgataca

SEQ ID NO: 1028248 - DNA, 22 bp, Artificial Sequence
  chemically synthesized
ccacgacgatgtgtatcattca

SEQ ID NO: 1028249 - DNA, 22 bp, Artificial Sequence
  chemically synthesized
cacgacgatgtgtatcattcac

SEQ ID NO: 1028250 - DNA, 22 bp, Artificial Sequence
  chemically synthesized
tatttcatattatttgtgaatg

SEQ ID NO: 1028251 - DNA, 22 bp, Artificial Sequence
  chemically synthesized
atatttcatattatttgtgaat

SEQ ID NO: 1028252 - DNA, 22 bp, Artificial Sequence
  chemically synthesized
tatatttcatattatttgtgaa

SEQ ID NO: 1028253 - DNA, 22 bp, Artificial Sequence
  chemically synthesized
ttatatttcatattatttgtga

SEQ ID NO: 1028254 - DNA, 22 bp, Artificial Sequence
  chemically synthesized
agtgaatttttatatttcatat

SEQ ID NO: 1028255 - DNA, 22 bp, Artificial Sequence
  chemically synthesized
aagtgaatttttatatttcata

SEQ ID NO: 1028256 - DNA, 22 bp, Artificial Sequence
  chemically synthesized
acaaataatatgaaatataaaa

SEQ ID NO: 1028257 - DNA, 22 bp, Artificial Sequence
  chemically synthesized
tatatgtttaagtgaattttta

SEQ ID NO: 1028258 - DNA, 22 bp, Artificial Sequence
  chemically synthesized
atatatgtttaagtgaattttt

SEQ ID NO: 1028259 - DNA, 22 bp, Artificial Sequence
  chemically synthesized
tatatatgtttaagtgaatttt

SEQ ID NO: 1028260 - DNA, 22 bp, Artificial Sequence
  chemically synthesized
acttaaacatatataaaattat

SEQ ID NO: 1028261 - DNA, 22 bp, Artificial Sequence
  chemically synthesized
aaacatatataaaattattggt

SEQ ID NO: 1028262 - DNA, 22 bp, Artificial Sequence
  chemically synthesized
aacatatataaaattattggta

SEQ ID NO: 1028263 - DNA, 22 bp, Artificial Sequence
  chemically synthesized
gtacaaagtaaatataccaata

SEQ ID NO: 1028264 - DNA, 22 bp, Artificial Sequence
  chemically synthesized
agtacaaagtaaatataccaat

SEQ ID NO: 1028265 - DNA, 22 bp, Artificial Sequence
  chemically synthesized
catttagtacaaagtaaatata

SEQ ID NO: 1028266 - DNA, 22 bp, Artificial Sequence
  chemically synthesized
ttggtatatttactttgtacta

SEQ ID NO: 1028267 - DNA, 22 bp, Artificial Sequence
  chemically synthesized
gtatatttactttgtactaaat

SEQ ID NO: 1028268 - DNA, 22 bp, Artificial Sequence
  chemically synthesized
actttgtactaaatgtaatggg

SEQ ID NO: 1028269 - DNA, 22 bp, Artificial Sequence
  chemically synthesized
ctttgtactaaatgtaatggga

SEQ ID NO: 1028270 - DNA, 22 bp, Artificial Sequence
  chemically synthesized
tgtactaaatgtaatgggattt

SEQ ID NO: 1028271 - DNA, 22 bp, Artificial Sequence
  chemically synthesized
gtactaaatgtaatgggatttg

SEQ ID NO: 1028272 - DNA, 22 bp, Artificial Sequence
  chemically synthesized
atataataatatcaaatcccat

SEQ ID NO: 1028273 - DNA, 22 bp, Artificial Sequence
  chemically synthesized
tactaaatgtaatgggatttga

SEQ ID NO: 1028274 - DNA, 22 bp, Artificial Sequence
  chemically synthesized
aatataataatatcaaatccca

SEQ ID NO: 1028275 - DNA, 22 bp, Artificial Sequence
  chemically synthesized
aatgtaatgggatttgatatta

SEQ ID NO: 1028276 - DNA, 22 bp, Artificial Sequence
  chemically synthesized
atcatgaatataaatttaatat

SEQ ID NO: 1028277 - DNA, 22 bp, Artificial Sequence
  chemically synthesized
gatattattatattaaatttat

SEQ ID NO: 1028278 - DNA, 22 bp, Artificial Sequence
  chemically synthesized
atattattatattaaatttata

SEQ ID NO: 1028279 - DNA, 22 bp, Artificial Sequence
  chemically synthesized
tattcatcatgaatataaattt

SEQ ID NO: 1028280 - DNA, 22 bp, Artificial Sequence
  chemically synthesized
atattcatcatgaatataaatt

SEQ ID NO: 1028281 - DNA, 22 bp, Artificial Sequence
  chemically synthesized
cttatattcatcatgaatataa

SEQ ID NO: 1028282 - DNA, 22 bp, Artificial Sequence
  chemically synthesized
ttatattaaatttatattcatg

SEQ ID NO: 1028283 - DNA, 22 bp, Artificial Sequence
  chemically synthesized
acttatattcatcatgaatata

SEQ ID NO: 1028284 - DNA, 22 bp, Artificial Sequence
  chemically synthesized
tattaaatttatattcatgatg

SEQ ID NO: 1028285 - DNA, 22 bp, Artificial Sequence
  chemically synthesized
aatgtttacttatattcatcat

SEQ ID NO: 1028286 - DNA, 22 bp, Artificial Sequence
  chemically synthesized
aatttatattcatgatgaatat

SEQ ID NO: 1028287 - DNA, 22 bp, Artificial Sequence
  chemically synthesized
ctcaatgtttacttatattcat

SEQ ID NO: 1028288 - DNA, 22 bp, Artificial Sequence
  chemically synthesized
actcaatgtttacttatattca

SEQ ID NO: 1028289 - DNA, 22 bp, Artificial Sequence
  chemically synthesized
atattcatgatgaatataagta

SEQ ID NO: 1028290 - DNA, 22 bp, Artificial Sequence
  chemically synthesized
ttactcaatgtttacttatatt

SEQ ID NO: 1028291 - DNA, 22 bp, Artificial Sequence
  chemically synthesized
tattcatgatgaatataagtaa

SEQ ID NO: 1028292 - DNA, 22 bp, Artificial Sequence
  chemically synthesized
cttactcaatgtttacttatat

SEQ ID NO: 1028293 - DNA, 22 bp, Artificial Sequence
  chemically synthesized
atgatgaatataagtaaacatt

SEQ ID NO: 1028294 - DNA, 22 bp, Artificial Sequence
  chemically synthesized
aaacatttcttactcaatgttt

SEQ ID NO: 1028295 - DNA, 22 bp, Artificial Sequence
  chemically synthesized
aaaacatttcttactcaatgtt

SEQ ID NO: 1028296 - DNA, 22 bp, Artificial Sequence
  chemically synthesized
ttaaaacatttcttactcaatg

SEQ ID NO: 1028297 - DNA, 22 bp, Artificial Sequence
  chemically synthesized
cttaaaacatttcttactcaat

SEQ ID NO: 1028298 - DNA, 22 bp, Artificial Sequence
  chemically synthesized
agtaagaaatgttttaagaaat

SEQ ID NO: 1028299 - DNA, 22 bp, Artificial Sequence
  chemically synthesized
atgcagatagcaaatttcttaa

SEQ ID NO: 1028300 - DNA, 22 bp, Artificial Sequence
  chemically synthesized
aatagtcattcatgcagatagc

SEQ ID NO: 1028301 - DNA, 22 bp, Artificial Sequence
  chemically synthesized
taagaaatttgctatctgcatg

SEQ ID NO: 1028302 - DNA, 22 bp, Artificial Sequence
  chemically synthesized
aagaaatttgctatctgcatga

SEQ ID NO: 1028303 - DNA, 22 bp, Artificial Sequence
  chemically synthesized
agaaatttgctatctgcatgaa

SEQ ID NO: 1028304 - DNA, 22 bp, Artificial Sequence
  chemically synthesized
gctatctgcatgaatgactatt

SEQ ID NO: 1028305 - DNA, 22 bp, Artificial Sequence
  chemically synthesized
ctatctgcatgaatgactattc

SEQ ID NO: 1028306 - DNA, 22 bp, Artificial Sequence
  chemically synthesized
aataaaaatgtattgaatagtc

SEQ ID NO: 1028307 - DNA, 22 bp, Artificial Sequence
  chemically synthesized
tctgcatgaatgactattcaat

SEQ ID NO: 1028308 - DNA, 22 bp, Artificial Sequence
  chemically synthesized
catgaatgactattcaatacat

SEQ ID NO: 1028309 - DNA, 22 bp, Artificial Sequence
  chemically synthesized
gatggatgttcaataaaaatgt

SEQ ID NO: 1028310 - DNA, 22 bp, Artificial Sequence
  chemically synthesized
ttcaatacatttttattgaaca

SEQ ID NO: 1028311 - DNA, 22 bp, Artificial Sequence
  chemically synthesized
aatacatttttattgaacatcc

SEQ ID NO: 1028312 - DNA, 22 bp, Artificial Sequence
  chemically synthesized
atcgcaacgaactcgatggatg

SEQ ID NO: 1028313 - DNA, 22 bp, Artificial Sequence
  chemically synthesized
ttattgaacatccatcgagttc

SEQ ID NO: 1028314 - DNA, 22 bp, Artificial Sequence
  chemically synthesized
tattgaacatccatcgagttcg

SEQ ID NO: 1028315 - DNA, 22 bp, Artificial Sequence
  chemically synthesized
tattcatcgcaacgaactcgat

SEQ ID NO: 1028316 - DNA, 22 bp, Artificial Sequence
  chemically synthesized
attgaacatccatcgagttcgt

SEQ ID NO: 1028317 - DNA, 22 bp, Artificial Sequence
  chemically synthesized
ttgaacatccatcgagttcgtt

SEQ ID NO: 1028318 - DNA, 22 bp, Artificial Sequence
  chemically synthesized
aacatccatcgagttcgttgcg

SEQ ID NO: 1028319 - DNA, 22 bp, Artificial Sequence
  chemically synthesized
aaactgtattcatcgcaacgaa

SEQ ID NO: 1028320 - DNA, 22 bp, Artificial Sequence
  chemically synthesized
taaaactgtattcatcgcaacg

SEQ ID NO: 1028321 - DNA, 22 bp, Artificial Sequence
  chemically synthesized
ctaaaactgtattcatcgcaac

SEQ ID NO: 1028322 - DNA, 22 bp, Artificial Sequence
  chemically synthesized
tctaaaactgtattcatcgcaa

SEQ ID NO: 1028323 - DNA, 22 bp, Artificial Sequence
  chemically synthesized
ttctaaaactgtattcatcgca

SEQ ID NO: 1028324 - DNA, 22 bp, Artificial Sequence
  chemically synthesized
tttctaaaactgtattcatcgc

SEQ ID NO: 1028325 - DNA, 22 bp, Artificial Sequence
  chemically synthesized
gtattttttctaaaactgtatt

SEQ ID NO: 1028326 - DNA, 22 bp, Artificial Sequence
  chemically synthesized
gttgcgatgaatacagttttag

SEQ ID NO: 1028327 - DNA, 22 bp, Artificial Sequence
  chemically synthesized
cgatgaatacagttttagaaaa

SEQ ID NO: 1028328 - DNA, 22 bp, Artificial Sequence
  chemically synthesized
gaagccagagtattagtatttt

SEQ ID NO: 1028329 - DNA, 22 bp, Artificial Sequence
  chemically synthesized
cgaagccagagtattagtattt

SEQ ID NO: 1028330 - DNA, 22 bp, Artificial Sequence
  chemically synthesized
tagaaaaaatactaatactctg

SEQ ID NO: 1028331 - DNA, 22 bp, Artificial Sequence
  chemically synthesized
agaaaaaatactaatactctgg

SEQ ID NO: 1028332 - DNA, 22 bp, Artificial Sequence
  chemically synthesized
gaaaaaatactaatactctggc

SEQ ID NO: 1028333 - DNA, 22 bp, Artificial Sequence
  chemically synthesized
aatacatagcagtcttcgaagc

SEQ ID NO: 1028334 - DNA, 22 bp, Artificial Sequence
  chemically synthesized
caatacatagcagtcttcgaag

SEQ ID NO: 1028335 - DNA, 22 bp, Artificial Sequence
  chemically synthesized
atactctggcttcgaagactgc

SEQ ID NO: 1028336 - DNA, 22 bp, Artificial Sequence
  chemically synthesized
tagaccttcaatacatagcagt

SEQ ID NO: 1028337 - DNA, 22 bp, Artificial Sequence
  chemically synthesized
tggcttcgaagactgctatgta

SEQ ID NO: 1028338 - DNA, 22 bp, Artificial Sequence
  chemically synthesized
gcttcgaagactgctatgtatt

SEQ ID NO: 1028339 - DNA, 22 bp, Artificial Sequence
  chemically synthesized
cgaagactgctatgtattgaag

SEQ ID NO: 1028340 - DNA, 22 bp, Artificial Sequence
  chemically synthesized
gaagactgctatgtattgaagg

SEQ ID NO: 1028341 - DNA, 22 bp, Artificial Sequence
  chemically synthesized
aaagcattgtagaccttcaata

SEQ ID NO: 1028342 - DNA, 22 bp, Artificial Sequence
  chemically synthesized
ctatgtattgaaggtctacaat

SEQ ID NO: 1028343 - DNA, 22 bp, Artificial Sequence
  chemically synthesized
cagcattcaaagcattgtagac

SEQ ID NO: 1028344 - DNA, 22 bp, Artificial Sequence
  chemically synthesized
tgtattgaaggtctacaatgct

SEQ ID NO: 1028345 - DNA, 22 bp, Artificial Sequence
  chemically synthesized
ctacagcattcaaagcattgta

SEQ ID NO: 1028346 - DNA, 22 bp, Artificial Sequence
  chemically synthesized
cctacagcattcaaagcattgt

SEQ ID NO: 1028347 - DNA, 22 bp, Artificial Sequence
  chemically synthesized
tcttcctacagcattcaaagca

SEQ ID NO: 1028348 - DNA, 22 bp, Artificial Sequence
  chemically synthesized
aaggtctacaatgctttgaatg

SEQ ID NO: 1028349 - DNA, 22 bp, Artificial Sequence
  chemically synthesized
gtcttcctacagcattcaaagc

SEQ ID NO: 1028350 - DNA, 22 bp, Artificial Sequence
  chemically synthesized
tcttgtcttcctacagcattca

SEQ ID NO: 1028351 - DNA, 22 bp, Artificial Sequence
  chemically synthesized
atcttgtcttcctacagcattc

SEQ ID NO: 1028352 - DNA, 22 bp, Artificial Sequence
  chemically synthesized
caatgctttgaatgctgtagga

SEQ ID NO: 1028353 - DNA, 22 bp, Artificial Sequence
  chemically synthesized
atttatcttgtcttcctacagc

SEQ ID NO: 1028354 - DNA, 22 bp, Artificial Sequence
  chemically synthesized
tgaatgctgtaggaagacaaga

SEQ ID NO: 1028355 - DNA, 22 bp, Artificial Sequence
  chemically synthesized
gaatgctgtaggaagacaagat

SEQ ID NO: 1028356 - DNA, 22 bp, Artificial Sequence
  chemically synthesized
aatgctgtaggaagacaagata

SEQ ID NO: 1028357 - DNA, 22 bp, Artificial Sequence
  chemically synthesized
taggaagacaagataaattagg

SEQ ID NO: 1028358 - DNA, 22 bp, Artificial Sequence
  chemically synthesized
tgggacggtgatcaaaagtcct

SEQ ID NO: 1028359 - DNA, 22 bp, Artificial Sequence
  chemically synthesized
atgggacggtgatcaaaagtcc

SEQ ID NO: 1028360 - DNA, 22 bp, Artificial Sequence
  chemically synthesized
tatgggacggtgatcaaaagtc

SEQ ID NO: 1028361 - DNA, 22 bp, Artificial Sequence
  chemically synthesized
ttatgggacggtgatcaaaagt

SEQ ID NO: 1028362 - DNA, 22 bp, Artificial Sequence
  chemically synthesized
taagcttttatgggacggtgat

SEQ ID NO: 1028363 - DNA, 22 bp, Artificial Sequence
  chemically synthesized
ggacttttgatcaccgtcccat

SEQ ID NO: 1028364 - DNA, 22 bp, Artificial Sequence
  chemically synthesized
ttgatcaccgtcccataaaagc

SEQ ID NO: 1028365 - DNA, 22 bp, Artificial Sequence
  chemically synthesized
gacaaattataagcttttatgg

SEQ ID NO: 1028366 - DNA, 22 bp, Artificial Sequence
  chemically synthesized
tgatcaccgtcccataaaagct

SEQ ID NO: 1028367 - DNA, 22 bp, Artificial Sequence
  chemically synthesized
gatcaccgtcccataaaagctt

SEQ ID NO: 1028368 - DNA, 22 bp, Artificial Sequence
  chemically synthesized
atcaccgtcccataaaagctta

SEQ ID NO: 1028369 - DNA, 22 bp, Artificial Sequence
  chemically synthesized
ttagacaaattataagctttta

SEQ ID NO: 1028370 - DNA, 22 bp, Artificial Sequence
  chemically synthesized
attagacaaattataagctttt

SEQ ID NO: 1028371 - DNA, 22 bp, Artificial Sequence
  chemically synthesized
cttattagacaaattataagct

SEQ ID NO: 1028372 - DNA, 22 bp, Artificial Sequence
  chemically synthesized
ttccttattagacaaattataa

SEQ ID NO: 1028373 - DNA, 22 bp, Artificial Sequence
  chemically synthesized
gctattccttattagacaaatt

SEQ ID NO: 1028374 - DNA, 22 bp, Artificial Sequence
  chemically synthesized
ttggctattccttattagacaa

SEQ ID NO: 1028375 - DNA, 22 bp, Artificial Sequence
  chemically synthesized
ataatttgtctaataaggaata

SEQ ID NO: 1028376 - DNA, 22 bp, Artificial Sequence
  chemically synthesized
taatttgtctaataaggaatag

SEQ ID NO: 1028377 - DNA, 22 bp, Artificial Sequence
  chemically synthesized
taataattgttggctattcctt

SEQ ID NO: 1028378 - DNA, 22 bp, Artificial Sequence
  chemically synthesized
ttgtaataattgttggctattc

SEQ ID NO: 1028379 - DNA, 22 bp, Artificial Sequence
  chemically synthesized
gtctaataaggaatagccaaca

SEQ ID NO: 1028380 - DNA, 22 bp, Artificial Sequence
  chemically synthesized
tctaataaggaatagccaacaa

SEQ ID NO: 1028381 - DNA, 22 bp, Artificial Sequence
  chemically synthesized
ctattgtaataattgttggcta

SEQ ID NO: 1028382 - DNA, 22 bp, Artificial Sequence
  chemically synthesized
ataaggaatagccaacaattat

SEQ ID NO: 1028383 - DNA, 22 bp, Artificial Sequence
  chemically synthesized
tctcctattgtaataattgttg

SEQ ID NO: 1028384 - DNA, 22 bp, Artificial Sequence
  chemically synthesized
ctgtctcctattgtaataattg

SEQ ID NO: 1028385 - DNA, 22 bp, Artificial Sequence
  chemically synthesized
actgtctcctattgtaataatt

SEQ ID NO: 1028386 - DNA, 22 bp, Artificial Sequence
  chemically synthesized
tactgtctcctattgtaataat

SEQ ID NO: 1028387 - DNA, 22 bp, Artificial Sequence
  chemically synthesized
ttactgtctcctattgtaataa

SEQ ID NO: 1028388 - DNA, 22 bp, Artificial Sequence
  chemically synthesized
tttttactgtctcctattgtaa

SEQ ID NO: 1028389 - DNA, 22 bp, Artificial Sequence
  chemically synthesized
atttttactgtctcctattgta

SEQ ID NO: 1028390 - DNA, 22 bp, Artificial Sequence
  chemically synthesized
cttatttttactgtctcctatt

SEQ ID NO: 1028391 - DNA, 22 bp, Artificial Sequence
  chemically synthesized
tacttatttttactgtctccta

SEQ ID NO: 1028392 - DNA, 22 bp, Artificial Sequence
  chemically synthesized
cattctacttatttttactgtc

SEQ ID NO: 1028393 - DNA, 22 bp, Artificial Sequence
  chemically synthesized
ttacaataggagacagtaaaaa

SEQ ID NO: 1028394 - DNA, 22 bp, Artificial Sequence
  chemically synthesized
caataggagacagtaaaaataa

SEQ ID NO: 1028395 - DNA, 22 bp, Artificial Sequence
  chemically synthesized
gaacattgcattctacttattt

SEQ ID NO: 1028396 - DNA, 22 bp, Artificial Sequence
  chemically synthesized
aacatctggaacattgcattct

SEQ ID NO: 1028397 - DNA, 22 bp, Artificial Sequence
  chemically synthesized
tgaacatctggaacattgcatt

SEQ ID NO: 1028398 - DNA, 22 bp, Artificial Sequence
  chemically synthesized
ctctgaacatctggaacattgc

SEQ ID NO: 1028399 - DNA, 22 bp, Artificial Sequence
  chemically synthesized
caactcctctgaacatctggaa

SEQ ID NO: 1028400 - DNA, 22 bp, Artificial Sequence
  chemically synthesized
cagatgttcagaggagttggag

SEQ ID NO: 1028401 - DNA, 22 bp, Artificial Sequence
  chemically synthesized
agaggagttggagatcatctcc

SEQ ID NO: 1028402 - DNA, 22 bp, Artificial Sequence
  chemically synthesized
accaacccataaggagatgatc

SEQ ID NO: 1028403 - DNA, 22 bp, Artificial Sequence
  chemically synthesized
gaccaacccataaggagatgat

SEQ ID NO: 1028404 - DNA, 22 bp, Artificial Sequence
  chemically synthesized
ttgaccaacccataaggagatg

SEQ ID NO: 1028405 - DNA, 22 bp, Artificial Sequence
  chemically synthesized
tcttgaccaacccataaggaga

SEQ ID NO: 1028406 - DNA, 22 bp, Artificial Sequence
  chemically synthesized
gagatcatctccttatgggttg

SEQ ID NO: 1028407 - DNA, 22 bp, Artificial Sequence
  chemically synthesized
aggctctcttgaccaacccata

SEQ ID NO: 1028408 - DNA, 22 bp, Artificial Sequence
  chemically synthesized
cattaaggctctcttgaccaac

SEQ ID NO: 1028409 - DNA, 22 bp, Artificial Sequence
  chemically synthesized
ccattaaggctctcttgaccaa

SEQ ID NO: 1028410 - DNA, 22 bp, Artificial Sequence
  chemically synthesized
tccattaaggctctcttgacca

SEQ ID NO: 1028411 - DNA, 22 bp, Artificial Sequence
  chemically synthesized
cttatgggttggtcaagagagc

SEQ ID NO: 1028412 - DNA, 22 bp, Artificial Sequence
  chemically synthesized
cattttccattaaggctctctt

SEQ ID NO: 1028413 - DNA, 22 bp, Artificial Sequence
  chemically synthesized
atgggttggtcaagagagcctt

SEQ ID NO: 1028414 - DNA, 22 bp, Artificial Sequence
  chemically synthesized
tgggttggtcaagagagcctta

SEQ ID NO: 1028415 - DNA, 22 bp, Artificial Sequence
  chemically synthesized
agatgctacattttccattaag

SEQ ID NO: 1028416 - DNA, 22 bp, Artificial Sequence
  chemically synthesized
gtcaagagagccttaatggaaa

SEQ ID NO: 1028417 - DNA, 22 bp, Artificial Sequence
  chemically synthesized
ctcagatgctacattttccatt

SEQ ID NO: 1028418 - DNA, 22 bp, Artificial Sequence
  chemically synthesized
catgccctgctcagatgctaca

SEQ ID NO: 1028419 - DNA, 22 bp, Artificial Sequence
  chemically synthesized
ccatgccctgctcagatgctac

SEQ ID NO: 1028420 - DNA, 22 bp, Artificial Sequence
  chemically synthesized
aatggaaaatgtagcatctgag

SEQ ID NO: 1028421 - DNA, 22 bp, Artificial Sequence
  chemically synthesized
atggaaaatgtagcatctgagc

SEQ ID NO: 1028422 - DNA, 22 bp, Artificial Sequence
  chemically synthesized
aatgatccttccatgccctgct

SEQ ID NO: 1028423 - DNA, 22 bp, Artificial Sequence
  chemically synthesized
agcagggcatggaaggatcatt

SEQ ID NO: 1028424 - DNA, 22 bp, Artificial Sequence
  chemically synthesized
ggacagaggaatatccactaaa

SEQ ID NO: 1028425 - DNA, 22 bp, Artificial Sequence
  chemically synthesized
gggacagaggaatatccactaa

SEQ ID NO: 1028426 - DNA, 22 bp, Artificial Sequence
  chemically synthesized
tgggacagaggaatatccacta

SEQ ID NO: 1028427 - DNA, 22 bp, Artificial Sequence
  chemically synthesized
agtggatattcctctgtcccaa

SEQ ID NO: 1028428 - DNA, 22 bp, Artificial Sequence
  chemically synthesized
gtggatattcctctgtcccaaa

SEQ ID NO: 1028429 - DNA, 22 bp, Artificial Sequence
  chemically synthesized
gacagacaaaaaattttgggac

SEQ ID NO: 1028430 - DNA, 22 bp, Artificial Sequence
  chemically synthesized
ctctgtcccaaaattttttgtc

SEQ ID NO: 1028431 - DNA, 22 bp, Artificial Sequence
  chemically synthesized
tgtcccaaaattttttgtctgt

SEQ ID NO: 1028432 - DNA, 22 bp, Artificial Sequence
  chemically synthesized
tcccaaaattttttgtctgtcc

SEQ ID NO: 1028433 - DNA, 22 bp, Artificial Sequence
  chemically synthesized
accacagaagggatattggaca

SEQ ID NO: 1028434 - DNA, 22 bp, Artificial Sequence
  chemically synthesized
caccacagaagggatattggac

SEQ ID NO: 1028435 - DNA, 22 bp, Artificial Sequence
  chemically synthesized
ttcaccacagaagggatattgg

SEQ ID NO: 1028436 - DNA, 22 bp, Artificial Sequence
  chemically synthesized
cttcaccacagaagggatattg

SEQ ID NO: 1028437 - DNA, 22 bp, Artificial Sequence
  chemically synthesized
tcttcaccacagaagggatatt

SEQ ID NO: 1028438 - DNA, 22 bp, Artificial Sequence
  chemically synthesized
tttgtctgtccaatatcccttc

SEQ ID NO: 1028439 - DNA, 22 bp, Artificial Sequence
  chemically synthesized
ttgtctgtccaatatcccttct

SEQ ID NO: 1028440 - DNA, 22 bp, Artificial Sequence
  chemically synthesized
tgtctgtccaatatcccttctg

SEQ ID NO: 1028441 - DNA, 22 bp, Artificial Sequence
  chemically synthesized
gtctgtccaatatcccttctgt

SEQ ID NO: 1028442 - DNA, 22 bp, Artificial Sequence
  chemically synthesized
attttcttcaccacagaaggga

SEQ ID NO: 1028443 - DNA, 22 bp, Artificial Sequence
  chemically synthesized
tctgtccaatatcccttctgtg

SEQ ID NO: 1028444 - DNA, 22 bp, Artificial Sequence
  chemically synthesized
tccaatatcccttctgtggtga

SEQ ID NO: 1028445 - DNA, 22 bp, Artificial Sequence
  chemically synthesized
ctgtggtgaagaaaattagtac

SEQ ID NO: 1028446 - DNA, 22 bp, Artificial Sequence
  chemically synthesized
tgtggtgaagaaaattagtact

SEQ ID NO: 1028447 - DNA, 22 bp, Artificial Sequence
  chemically synthesized
tggtgaagaaaattagtactct

SEQ ID NO: 1028448 - DNA, 22 bp, Artificial Sequence
  chemically synthesized
gtactctttggatatcttggta

SEQ ID NO: 1028449 - DNA, 22 bp, Artificial Sequence
  chemically synthesized
tttggatatcttggtattgatt

SEQ ID NO: 1028450 - DNA, 22 bp, Artificial Sequence
  chemically synthesized
tggatatcttggtattgatttc

SEQ ID NO: 1028451 - DNA, 22 bp, Artificial Sequence
  chemically synthesized
ggatatcttggtattgatttca

SEQ ID NO: 1028452 - DNA, 22 bp, Artificial Sequence
  chemically synthesized
gatatcttggtattgatttcat

SEQ ID NO: 1028453 - DNA, 22 bp, Artificial Sequence
  chemically synthesized
ggtattgatttcattatgtttc

SEQ ID NO: 1028454 - DNA, 22 bp, Artificial Sequence
  chemically synthesized
aagggaacatgagaaacataat

SEQ ID NO: 1028455 - DNA, 22 bp, Artificial Sequence
  chemically synthesized
gtattgatttcattatgtttct

SEQ ID NO: 1028456 - DNA, 22 bp, Artificial Sequence
  chemically synthesized
atttcattatgtttctcatgtt

SEQ ID NO: 1028457 - DNA, 22 bp, Artificial Sequence
  chemically synthesized
acgaaacctcaagggaacatga

SEQ ID NO: 1028458 - DNA, 22 bp, Artificial Sequence
  chemically synthesized
cattatgtttctcatgttccct

SEQ ID NO: 1028459 - DNA, 22 bp, Artificial Sequence
  chemically synthesized
attatgtttctcatgttccctt

SEQ ID NO: 1028460 - DNA, 22 bp, Artificial Sequence
  chemically synthesized
cactcacgaaacctcaagggaa

SEQ ID NO: 1028461 - DNA, 22 bp, Artificial Sequence
  chemically synthesized
tgtttctcatgttcccttgagg

SEQ ID NO: 1028462 - DNA, 22 bp, Artificial Sequence
  chemically synthesized
ctcatgttcccttgaggtttcg

SEQ ID NO: 1028463 - DNA, 22 bp, Artificial Sequence
  chemically synthesized
tcatgttcccttgaggtttcgt

SEQ ID NO: 1028464 - DNA, 22 bp, Artificial Sequence
  chemically synthesized
atgttcccttgaggtttcgtga

SEQ ID NO: 1028465 - DNA, 22 bp, Artificial Sequence
  chemically synthesized
aatcacaattgcactcacgaaa

SEQ ID NO: 1028466 - DNA, 22 bp, Artificial Sequence
  chemically synthesized
ccttgaggtttcgtgagtgcaa

SEQ ID NO: 1028467 - DNA, 22 bp, Artificial Sequence
  chemically synthesized
gaggtttcgtgagtgcaattgt

SEQ ID NO: 1028468 - DNA, 22 bp, Artificial Sequence
  chemically synthesized
caggattcaatcacaattgcac

SEQ ID NO: 1028469 - DNA, 22 bp, Artificial Sequence
  chemically synthesized
aggtttcgtgagtgcaattgtg

SEQ ID NO: 1028470 - DNA, 22 bp, Artificial Sequence
  chemically synthesized
ccaggattcaatcacaattgca

SEQ ID NO: 1028471 - DNA, 22 bp, Artificial Sequence
  chemically synthesized
tccaggattcaatcacaattgc

SEQ ID NO: 1028472 - DNA, 22 bp, Artificial Sequence
  chemically synthesized
cgtgagtgcaattgtgattgaa

SEQ ID NO: 1028473 - DNA, 22 bp, Artificial Sequence
  chemically synthesized
gtgagtgcaattgtgattgaat

SEQ ID NO: 1028474 - DNA, 22 bp, Artificial Sequence
  chemically synthesized
ccactttccaggattcaatcac

SEQ ID NO: 1028475 - DNA, 22 bp, Artificial Sequence
  chemically synthesized
cccactttccaggattcaatca

SEQ ID NO: 1028476 - DNA, 22 bp, Artificial Sequence
  chemically synthesized
tcccactttccaggattcaatc

SEQ ID NO: 1028477 - DNA, 22 bp, Artificial Sequence
  chemically synthesized
cactttcccactttccaggatt

SEQ ID NO: 1028478 - DNA, 22 bp, Artificial Sequence
  chemically synthesized
ctacactttcccactttccagg

SEQ ID NO: 1028479 - DNA, 22 bp, Artificial Sequence
  chemically synthesized
cctacactttcccactttccag

SEQ ID NO: 1028480 - DNA, 22 bp, Artificial Sequence
  chemically synthesized
tgattgaatcctggaaagtggg

SEQ ID NO: 1028481 - DNA, 22 bp, Artificial Sequence
  chemically synthesized
aatcctggaaagtgggaaagtg

SEQ ID NO: 1028482 - DNA, 22 bp, Artificial Sequence
  chemically synthesized
gaaagtgggaaagtgtaggaag

SEQ ID NO: 1028483 - DNA, 22 bp, Artificial Sequence
  chemically synthesized
aggcaagaagtgatgcatcact

SEQ ID NO: 1028484 - DNA, 22 bp, Artificial Sequence
  chemically synthesized
tcaagtacctcaggcaagaagt

SEQ ID NO: 1028485 - DNA, 22 bp, Artificial Sequence
  chemically synthesized
actatcaagtacctcaggcaag

SEQ ID NO: 1028486 - DNA, 22 bp, Artificial Sequence
  chemically synthesized
acactaactatcaagtacctca

SEQ ID NO: 1028487 - DNA, 22 bp, Artificial Sequence
  chemically synthesized
cttgcctgaggtacttgatagt

SEQ ID NO: 1028488 - DNA, 22 bp, Artificial Sequence
  chemically synthesized
ttgcctgaggtacttgatagtt

SEQ ID NO: 1028489 - DNA, 22 bp, Artificial Sequence
  chemically synthesized
agaaattgacactaactatcaa

SEQ ID NO: 1028490 - DNA, 22 bp, Artificial Sequence
  chemically synthesized
gcctgaggtacttgatagttag

SEQ ID NO: 1028491 - DNA, 22 bp, Artificial Sequence
  chemically synthesized
cctgaggtacttgatagttagt

SEQ ID NO: 1028492 - DNA, 22 bp, Artificial Sequence
  chemically synthesized
aggtacttgatagttagtgtca

SEQ ID NO: 1028493 - DNA, 22 bp, Artificial Sequence
  chemically synthesized
gatagttagtgtcaatttctca

SEQ ID NO: 1028494 - DNA, 22 bp, Artificial Sequence
  chemically synthesized
acaaaggagagctgagaaattg

SEQ ID NO: 1028495 - DNA, 22 bp, Artificial Sequence
  chemically synthesized
atagttagtgtcaatttctcag

SEQ ID NO: 1028496 - DNA, 22 bp, Artificial Sequence
  chemically synthesized
gtgtcaatttctcagctctcct

SEQ ID NO: 1028497 - DNA, 22 bp, Artificial Sequence
  chemically synthesized
agaggtattgacaaaggagagc

SEQ ID NO: 1028498 - DNA, 22 bp, Artificial Sequence
  chemically synthesized
cagaggtattgacaaaggagag

SEQ ID NO: 1028499 - DNA, 22 bp, Artificial Sequence
  chemically synthesized
aaacttcagaggtattgacaaa

SEQ ID NO: 1028500 - DNA, 22 bp, Artificial Sequence
  chemically synthesized
ctcagctctcctttgtcaatac

SEQ ID NO: 1028501 - DNA, 22 bp, Artificial Sequence
  chemically synthesized
tcagctctcctttgtcaatacc

SEQ ID NO: 1028502 - DNA, 22 bp, Artificial Sequence
  chemically synthesized
agctctcctttgtcaatacctc

SEQ ID NO: 1028503 - DNA, 22 bp, Artificial Sequence
  chemically synthesized
tcctttgtcaatacctctgaag

SEQ ID NO: 1028504 - DNA, 22 bp, Artificial Sequence
  chemically synthesized
ctttgtcaatacctctgaagtt

SEQ ID NO: 1028505 - DNA, 22 bp, Artificial Sequence
  chemically synthesized
tgtcaatacctctgaagtttca

SEQ ID NO: 1028506 - DNA, 22 bp, Artificial Sequence
  chemically synthesized
ccatgtcaacattgaaacttca

SEQ ID NO: 1028507 - DNA, 22 bp, Artificial Sequence
  chemically synthesized
gtcaatacctctgaagtttcaa

SEQ ID NO: 1028508 - DNA, 22 bp, Artificial Sequence
  chemically synthesized
tcaatacctctgaagtttcaat

SEQ ID NO: 1028509 - DNA, 22 bp, Artificial Sequence
  chemically synthesized
tgccatgtcaacattgaaactt

SEQ ID NO: 1028510 - DNA, 22 bp, Artificial Sequence
  chemically synthesized
tggctctgccatgtcaacattg

SEQ ID NO: 1028511 - DNA, 22 bp, Artificial Sequence
  chemically synthesized
gtggctctgccatgtcaacatt

SEQ ID NO: 1028512 - DNA, 22 bp, Artificial Sequence
  chemically synthesized
tgaagtttcaatgttgacatgg

SEQ ID NO: 1028513 - DNA, 22 bp, Artificial Sequence
  chemically synthesized
aagtttcaatgttgacatggca

SEQ ID NO: 1028514 - DNA, 22 bp, Artificial Sequence
  chemically synthesized
atcttgtggctctgccatgtca

SEQ ID NO: 1028515 - DNA, 22 bp, Artificial Sequence
  chemically synthesized
catcttgtggctctgccatgtc

SEQ ID NO: 1028516 - DNA, 22 bp, Artificial Sequence
  chemically synthesized
tcatcttgtggctctgccatgt

SEQ ID NO: 1028517 - DNA, 22 bp, Artificial Sequence
  chemically synthesized
ctttcatcttgtggctctgcca

SEQ ID NO: 1028518 - DNA, 22 bp, Artificial Sequence
  chemically synthesized
caatgttgacatggcagagcca

SEQ ID NO: 1028519 - DNA, 22 bp, Artificial Sequence
  chemically synthesized
aatgttgacatggcagagccac

SEQ ID NO: 1028520 - DNA, 22 bp, Artificial Sequence
  chemically synthesized
aattgctttcatcttgtggctc

SEQ ID NO: 1028521 - DNA, 22 bp, Artificial Sequence
  chemically synthesized
acatggcagagccacaagatga

SEQ ID NO: 1028522 - DNA, 22 bp, Artificial Sequence
  chemically synthesized
agggacctaaattgctttcatc

SEQ ID NO: 1028523 - DNA, 22 bp, Artificial Sequence
  chemically synthesized
acagtgactcagggacctaaat

SEQ ID NO: 1028524 - DNA, 22 bp, Artificial Sequence
  chemically synthesized
cacagtgactcagggacctaaa

SEQ ID NO: 1028525 - DNA, 22 bp, Artificial Sequence
  chemically synthesized
cttcacagtgactcagggacct

SEQ ID NO: 1028526 - DNA, 22 bp, Artificial Sequence
  chemically synthesized
aggtccctgagtcactgtgaag

SEQ ID NO: 1028527 - DNA, 22 bp, Artificial Sequence
  chemically synthesized
ggtccctgagtcactgtgaagg

SEQ ID NO: 1028528 - DNA, 22 bp, Artificial Sequence
  chemically synthesized
atataaatcaggtagcattcct

SEQ ID NO: 1028529 - DNA, 22 bp, Artificial Sequence
  chemically synthesized
agtcactgtgaaggaatgctac

SEQ ID NO: 1028530 - DNA, 22 bp, Artificial Sequence
  chemically synthesized
tgaaggaatgctacctgattta

SEQ ID NO: 1028531 - DNA, 22 bp, Artificial Sequence
  chemically synthesized
atataaagtctgatataaatca

SEQ ID NO: 1028532 - DNA, 22 bp, Artificial Sequence
  chemically synthesized
ctcatataaagtctgatataaa

SEQ ID NO: 1028533 - DNA, 22 bp, Artificial Sequence
  chemically synthesized
ttgctcatataaagtctgatat

SEQ ID NO: 1028534 - DNA, 22 bp, Artificial Sequence
  chemically synthesized
attgctcatataaagtctgata

SEQ ID NO: 1028535 - DNA, 22 bp, Artificial Sequence
  chemically synthesized
cctgatttatatcagactttat

SEQ ID NO: 1028536 - DNA, 22 bp, Artificial Sequence
  chemically synthesized
tttattgctcatataaagtctg

SEQ ID NO: 1028537 - DNA, 22 bp, Artificial Sequence
  chemically synthesized
atttattgctcatataaagtct

SEQ ID NO: 1028538 - DNA, 22 bp, Artificial Sequence
  chemically synthesized
atttatatcagactttatatga

SEQ ID NO: 1028539 - DNA, 22 bp, Artificial Sequence
  chemically synthesized
atatcagactttatatgagcaa

SEQ ID NO: 1028540 - DNA, 22 bp, Artificial Sequence
  chemically synthesized
tatcagactttatatgagcaat

SEQ ID NO: 1028541 - DNA, 22 bp, Artificial Sequence
  chemically synthesized
atgaatgcttatttattgctca

SEQ ID NO: 1028542 - DNA, 22 bp, Artificial Sequence
  chemically synthesized
tatatgagcaataaataagcat

SEQ ID NO: 1028543 - DNA, 22 bp, Artificial Sequence
  chemically synthesized
atatgagcaataaataagcatt

SEQ ID NO: 1028544 - DNA, 22 bp, Artificial Sequence
  chemically synthesized
tatgagcaataaataagcattc

SEQ ID NO: 1028545 - DNA, 22 bp, Artificial Sequence
  chemically synthesized
aaatcaaagtggcctaatgaat

SEQ ID NO: 1028546 - DNA, 22 bp, Artificial Sequence
  chemically synthesized
accctgaaatcaaagtggccta

SEQ ID NO: 1028547 - DNA, 22 bp, Artificial Sequence
  chemically synthesized
attaggccactttgatttcagg

SEQ ID NO: 1028548 - DNA, 22 bp, Artificial Sequence
  chemically synthesized
ggccactttgatttcagggtta

SEQ ID NO: 1028549 - DNA, 22 bp, Artificial Sequence
  chemically synthesized
gatgccacaaaaaaactaaccc

SEQ ID NO: 1028550 - DNA, 22 bp, Artificial Sequence
  chemically synthesized
tgatttcagggttagttttttt

SEQ ID NO: 1028551 - DNA, 22 bp, Artificial Sequence
  chemically synthesized
gatttcagggttagtttttttg

SEQ ID NO: 1028552 - DNA, 22 bp, Artificial Sequence
  chemically synthesized
atttcagggttagtttttttgt

SEQ ID NO: 1028553 - DNA, 22 bp, Artificial Sequence
  chemically synthesized
atgttagatgccacaaaaaaac

SEQ ID NO: 1028554 - DNA, 22 bp, Artificial Sequence
  chemically synthesized
cagggttagtttttttgtggca

SEQ ID NO: 1028555 - DNA, 22 bp, Artificial Sequence
  chemically synthesized
agggttagtttttttgtggcat

SEQ ID NO: 1028556 - DNA, 22 bp, Artificial Sequence
  chemically synthesized
agaacaattaatgttagatgcc

SEQ ID NO: 1028557 - DNA, 22 bp, Artificial Sequence
  chemically synthesized
gtttttttgtggcatctaacat

SEQ ID NO: 1028558 - DNA, 22 bp, Artificial Sequence
  chemically synthesized
ttcagaacaattaatgttagat

SEQ ID NO: 1028559 - DNA, 22 bp, Artificial Sequence
  chemically synthesized
attcagaacaattaatgttaga

SEQ ID NO: 1028560 - DNA, 22 bp, Artificial Sequence
  chemically synthesized
ttttgtggcatctaacattaat

SEQ ID NO: 1028561 - DNA, 22 bp, Artificial Sequence
  chemically synthesized
tttgtggcatctaacattaatt

SEQ ID NO: 1028562 - DNA, 22 bp, Artificial Sequence
  chemically synthesized
ttgtggcatctaacattaattg

SEQ ID NO: 1028563 - DNA, 22 bp, Artificial Sequence
  chemically synthesized
tgtggcatctaacattaattgt

SEQ ID NO: 1028564 - DNA, 22 bp, Artificial Sequence
  chemically synthesized
gtggcatctaacattaattgtt

SEQ ID NO: 1028565 - DNA, 22 bp, Artificial Sequence
  chemically synthesized
tggcatctaacattaattgttc

SEQ ID NO: 1028566 - DNA, 22 bp, Artificial Sequence
  chemically synthesized
acattaattgttctgaataagt

SEQ ID NO: 1028567 - DNA, 22 bp, Artificial Sequence
  chemically synthesized
accaaagagtggagatacttat

SEQ ID NO: 1028568 - DNA, 22 bp, Artificial Sequence
  chemically synthesized
attgttctgaataagtatctcc

SEQ ID NO: 1028569 - DNA, 22 bp, Artificial Sequence
  chemically synthesized
ttctgaataagtatctccactc

SEQ ID NO: 1028570 - DNA, 22 bp, Artificial Sequence
  chemically synthesized
tgaataagtatctccactcttt

SEQ ID NO: 1028571 - DNA, 22 bp, Artificial Sequence
  chemically synthesized
aataagtatctccactctttgg

SEQ ID NO: 1028572 - DNA, 22 bp, Artificial Sequence
  chemically synthesized
cactctttggtgaatggtaccc

SEQ ID NO: 1028573 - DNA, 22 bp, Artificial Sequence
  chemically synthesized
atccaaggaaaagcagggtacc

SEQ ID NO: 1028574 - DNA, 22 bp, Artificial Sequence
  chemically synthesized
catccaaggaaaagcagggtac

SEQ ID NO: 1028575 - DNA, 22 bp, Artificial Sequence
  chemically synthesized
tttggtgaatggtaccctgctt

SEQ ID NO: 1028576 - DNA, 22 bp, Artificial Sequence
  chemically synthesized
tggtgaatggtaccctgctttt

SEQ ID NO: 1028577 - DNA, 22 bp, Artificial Sequence
  chemically synthesized
ggtgaatggtaccctgcttttc

SEQ ID NO: 1028578 - DNA, 22 bp, Artificial Sequence
  chemically synthesized
gtgaatggtaccctgcttttcc

SEQ ID NO: 1028579 - DNA, 22 bp, Artificial Sequence
  chemically synthesized
cttttccttggatgaaattact

SEQ ID NO: 1028580 - DNA, 22 bp, Artificial Sequence
  chemically synthesized
ttccttggatgaaattactctt

SEQ ID NO: 1028581 - DNA, 22 bp, Artificial Sequence
  chemically synthesized
tccttggatgaaattactcttc

SEQ ID NO: 1028582 - DNA, 22 bp, Artificial Sequence
  chemically synthesized
ccttggatgaaattactcttcc

SEQ ID NO: 1028583 - DNA, 22 bp, Artificial Sequence
  chemically synthesized
cttggatgaaattactcttccc

SEQ ID NO: 1028584 - DNA, 22 bp, Artificial Sequence
  chemically synthesized
ggatgaaattactcttccctca

SEQ ID NO: 1028585 - DNA, 22 bp, Artificial Sequence
  chemically synthesized
gatgaaattactcttccctcat

SEQ ID NO: 1028586 - DNA, 22 bp, Artificial Sequence
  chemically synthesized
agatcatgcagaatgagggaag

SEQ ID NO: 1028587 - DNA, 22 bp, Artificial Sequence
  chemically synthesized
ctcttccctcattctgcatgat

SEQ ID NO: 1028588 - DNA, 22 bp, Artificial Sequence
  chemically synthesized
taggtccccctaagatcatgca

SEQ ID NO: 1028589 - DNA, 22 bp, Artificial Sequence
  chemically synthesized
ttccctcattctgcatgatctt

SEQ ID NO: 1028590 - DNA, 22 bp, Artificial Sequence
  chemically synthesized
ccctcattctgcatgatcttag

SEQ ID NO: 1028591 - DNA, 22 bp, Artificial Sequence
  chemically synthesized
cctcattctgcatgatcttagg

SEQ ID NO: 1028592 - DNA, 22 bp, Artificial Sequence
  chemically synthesized
tgattataggtccccctaagat

SEQ ID NO: 1028593 - DNA, 22 bp, Artificial Sequence
  chemically synthesized
attctgcatgatcttaggggga

SEQ ID NO: 1028594 - DNA, 22 bp, Artificial Sequence
  chemically synthesized
tgcatgatcttagggggaccta

SEQ ID NO: 1028595 - DNA, 22 bp, Artificial Sequence
  chemically synthesized
catgatcttagggggacctata

SEQ ID NO: 1028596 - DNA, 22 bp, Artificial Sequence
  chemically synthesized
cagagcactatgattataggtc

SEQ ID NO: 1028597 - DNA, 22 bp, Artificial Sequence
  chemically synthesized
acagagcactatgattataggt

SEQ ID NO: 1028598 - DNA, 22 bp, Artificial Sequence
  chemically synthesized
agggggacctataatcatagtg

SEQ ID NO: 1028599 - DNA, 22 bp, Artificial Sequence
  chemically synthesized
gggggacctataatcatagtgc

SEQ ID NO: 1028600 - DNA, 22 bp, Artificial Sequence
  chemically synthesized
tagagtttacagagcactatga

SEQ ID NO: 1028601 - DNA, 22 bp, Artificial Sequence
  chemically synthesized
atagagtttacagagcactatg

SEQ ID NO: 1028602 - DNA, 22 bp, Artificial Sequence
  chemically synthesized
taatcatagtgctctgtaaact

SEQ ID NO: 1028603 - DNA, 22 bp, Artificial Sequence
  chemically synthesized
tcccaccagtttatagagttta

SEQ ID NO: 1028604 - DNA, 22 bp, Artificial Sequence
  chemically synthesized
gtcccaccagtttatagagttt

SEQ ID NO: 1028605 - DNA, 22 bp, Artificial Sequence
  chemically synthesized
ggaacttgtcccaccagtttat

SEQ ID NO: 1028606 - DNA, 22 bp, Artificial Sequence
  chemically synthesized
tgtaaactctataaactggtgg

SEQ ID NO: 1028607 - DNA, 22 bp, Artificial Sequence
  chemically synthesized
taaactctataaactggtggga

SEQ ID NO: 1028608 - DNA, 22 bp, Artificial Sequence
  chemically synthesized
gcataaattaggaacttgtccc

SEQ ID NO: 1028609 - DNA, 22 bp, Artificial Sequence
  chemically synthesized
tataaactggtgggacaagttc

SEQ ID NO: 1028610 - DNA, 22 bp, Artificial Sequence
  chemically synthesized
taaactggtgggacaagttcct

SEQ ID NO: 1028611 - DNA, 22 bp, Artificial Sequence
  chemically synthesized
gtgggacaagttcctaatttat

SEQ ID NO: 1028612 - DNA, 22 bp, Artificial Sequence
  chemically synthesized
aatgtaattggcataaattagg

SEQ ID NO: 1028613 - DNA, 22 bp, Artificial Sequence
  chemically synthesized
taaatgtaattggcataaatta

SEQ ID NO: 1028614 - DNA, 22 bp, Artificial Sequence
  chemically synthesized
ctaaatgtaattggcataaatt

SEQ ID NO: 1028615 - DNA, 22 bp, Artificial Sequence
  chemically synthesized
aaatttctaaatgtaattggca

SEQ ID NO: 1028616 - DNA, 22 bp, Artificial Sequence
  chemically synthesized
ctaatttatgccaattacattt

SEQ ID NO: 1028617 - DNA, 22 bp, Artificial Sequence
  chemically synthesized
gattcaaatttctaaatgtaat

SEQ ID NO: 1028618 - DNA, 22 bp, Artificial Sequence
  chemically synthesized
atttatgccaattacatttaga

SEQ ID NO: 1028619 - DNA, 22 bp, Artificial Sequence
  chemically synthesized
tagattcaaatttctaaatgta

SEQ ID NO: 1028620 - DNA, 22 bp, Artificial Sequence
  chemically synthesized
atgccaattacatttagaaatt

SEQ ID NO: 1028621 - DNA, 22 bp, Artificial Sequence
  chemically synthesized
tgccaattacatttagaaattt

SEQ ID NO: 1028622 - DNA, 22 bp, Artificial Sequence
  chemically synthesized
aattctagattcaaatttctaa

SEQ ID NO: 1028623 - DNA, 22 bp, Artificial Sequence
  chemically synthesized
tcaattctagattcaaatttct

SEQ ID NO: 1028624 - DNA, 22 bp, Artificial Sequence
  chemically synthesized
ctcaattctagattcaaatttc

SEQ ID NO: 1028625 - DNA, 22 bp, Artificial Sequence
  chemically synthesized
tctcaattctagattcaaattt

SEQ ID NO: 1028626 - DNA, 22 bp, Artificial Sequence
  chemically synthesized
cctttctcaattctagattcaa

SEQ ID NO: 1028627 - DNA, 22 bp, Artificial Sequence
  chemically synthesized
catttagaaatttgaatctaga

SEQ ID NO: 1028628 - DNA, 22 bp, Artificial Sequence
  chemically synthesized
tacctttctcaattctagattc

SEQ ID NO: 1028629 - DNA, 22 bp, Artificial Sequence
  chemically synthesized
agaaatttgaatctagaattga

SEQ ID NO: 1028630 - DNA, 22 bp, Artificial Sequence
  chemically synthesized
actctacctttctcaattctag

SEQ ID NO: 1028631 - DNA, 22 bp, Artificial Sequence
  chemically synthesized
gaaatttgaatctagaattgag

SEQ ID NO: 1028632 - DNA, 22 bp, Artificial Sequence
  chemically synthesized
tactgactctacctttctcaat

SEQ ID NO: 1028633 - DNA, 22 bp, Artificial Sequence
  chemically synthesized
gaatctagaattgagaaaggta

SEQ ID NO: 1028634 - DNA, 22 bp, Artificial Sequence
  chemically synthesized
aatctagaattgagaaaggtag

SEQ ID NO: 1028635 - DNA, 22 bp, Artificial Sequence
  chemically synthesized
aaattgtactgactctaccttt

SEQ ID NO: 1028636 - DNA, 22 bp, Artificial Sequence
  chemically synthesized
caaattgtactgactctacctt

SEQ ID NO: 1028637 - DNA, 22 bp, Artificial Sequence
  chemically synthesized
gaattgagaaaggtagagtcag

SEQ ID NO: 1028638 - DNA, 22 bp, Artificial Sequence
  chemically synthesized
agcttcaaattgtactgactct

SEQ ID NO: 1028639 - DNA, 22 bp, Artificial Sequence
  chemically synthesized
cagcttcaaattgtactgactc

SEQ ID NO: 1028640 - DNA, 22 bp, Artificial Sequence
  chemically synthesized
agaaaggtagagtcagtacaat

SEQ ID NO: 1028641 - DNA, 22 bp, Artificial Sequence
  chemically synthesized
aaatgcttcagcttcaaattgt

SEQ ID NO: 1028642 - DNA, 22 bp, Artificial Sequence
  chemically synthesized
tcattaaaatgcttcagcttca

SEQ ID NO: 1028643 - DNA, 22 bp, Artificial Sequence
  chemically synthesized
gatgctgtcattaaaatgcttc

SEQ ID NO: 1028644 - DNA, 22 bp, Artificial Sequence
  chemically synthesized
ggatgctgtcattaaaatgctt

SEQ ID NO: 1028645 - DNA, 22 bp, Artificial Sequence
  chemically synthesized
tggatgctgtcattaaaatgct

SEQ ID NO: 1028646 - DNA, 22 bp, Artificial Sequence
  chemically synthesized
ttggatgctgtcattaaaatgc

SEQ ID NO: 1028647 - DNA, 22 bp, Artificial Sequence
  chemically synthesized
tttggatgctgtcattaaaatg

SEQ ID NO: 1028648 - DNA, 22 bp, Artificial Sequence
  chemically synthesized
gaagctgaagcattttaatgac

SEQ ID NO: 1028649 - DNA, 22 bp, Artificial Sequence
  chemically synthesized
aagctgaagcattttaatgaca

SEQ ID NO: 1028650 - DNA, 22 bp, Artificial Sequence
  chemically synthesized
ctttttggatgctgtcattaaa

SEQ ID NO: 1028651 - DNA, 22 bp, Artificial Sequence
  chemically synthesized
aagcattttaatgacagcatcc

SEQ ID NO: 1028652 - DNA, 22 bp, Artificial Sequence
  chemically synthesized
cagggaagttactttttggatg

SEQ ID NO: 1028653 - DNA, 22 bp, Artificial Sequence
  chemically synthesized
taatgacagcatccaaaaagta

SEQ ID NO: 1028654 - DNA, 22 bp, Artificial Sequence
  chemically synthesized
aatgacagcatccaaaaagtaa

SEQ ID NO: 1028655 - DNA, 22 bp, Artificial Sequence
  chemically synthesized
atgacagcatccaaaaagtaac

SEQ ID NO: 1028656 - DNA, 22 bp, Artificial Sequence
  chemically synthesized
agagtcaggaactccagggaag

SEQ ID NO: 1028657 - DNA, 22 bp, Artificial Sequence
  chemically synthesized
ccctggagttcctgactctcag

SEQ ID NO: 1028658 - DNA, 22 bp, Artificial Sequence
  chemically synthesized
cctggagttcctgactctcagt

SEQ ID NO: 1028659 - DNA, 22 bp, Artificial Sequence
  chemically synthesized
gagttcctgactctcagtgctg

SEQ ID NO: 1028660 - DNA, 22 bp, Artificial Sequence
  chemically synthesized
tggcagagggagggcagcactg

SEQ ID NO: 1028661 - DNA, 22 bp, Artificial Sequence
  chemically synthesized
ctgactctcagtgctgccctcc

SEQ ID NO: 1028662 - DNA, 22 bp, Artificial Sequence
  chemically synthesized
actctcagtgctgccctccctc

SEQ ID NO: 1028663 - DNA, 22 bp, Artificial Sequence
  chemically synthesized
tcagtgctgccctccctctgcc

SEQ ID NO: 1028664 - DNA, 22 bp, Artificial Sequence
  chemically synthesized
agtgctgccctccctctgccac

SEQ ID NO: 1028665 - DNA, 22 bp, Artificial Sequence
  chemically synthesized
ccctccctctgccacagttgcc

SEQ ID NO: 1028666 - DNA, 22 bp, Artificial Sequence
  chemically synthesized
cctctgccacagttgccttctt

SEQ ID NO: 1028667 - DNA, 22 bp, Artificial Sequence
  chemically synthesized
gaaatgaaggaaaagaaggcaa

SEQ ID NO: 1028668 - DNA, 22 bp, Artificial Sequence
  chemically synthesized
ggaaatgaaggaaaagaaggca

SEQ ID NO: 1028669 - DNA, 22 bp, Artificial Sequence
  chemically synthesized
ttggaaatgaaggaaaagaagg

SEQ ID NO: 1028670 - DNA, 22 bp, Artificial Sequence
  chemically synthesized
tgccacagttgccttcttttcc

SEQ ID NO: 1028671 - DNA, 22 bp, Artificial Sequence
  chemically synthesized
ccacagttgccttcttttcctt

SEQ ID NO: 1028672 - DNA, 22 bp, Artificial Sequence
  chemically synthesized
ccttcttttccttcatttccaa

SEQ ID NO: 1028673 - DNA, 22 bp, Artificial Sequence
  chemically synthesized
cttttccttcatttccaagaac

SEQ ID NO: 1028674 - DNA, 22 bp, Artificial Sequence
  chemically synthesized
ttttccttcatttccaagaact

SEQ ID NO: 1028675 - DNA, 22 bp, Artificial Sequence
  chemically synthesized
ttccttcatttccaagaactat

SEQ ID NO: 1028676 - DNA, 22 bp, Artificial Sequence
  chemically synthesized
gagggataatgtatagttcttg

SEQ ID NO: 1028677 - DNA, 22 bp, Artificial Sequence
  chemically synthesized
tccttcatttccaagaactata

SEQ ID NO: 1028678 - DNA, 22 bp, Artificial Sequence
  chemically synthesized
ccttcatttccaagaactatac

SEQ ID NO: 1028679 - DNA, 22 bp, Artificial Sequence
  chemically synthesized
cttcatttccaagaactataca

SEQ ID NO: 1028680 - DNA, 22 bp, Artificial Sequence
  chemically synthesized
ctggagggataatgtatagttc

SEQ ID NO: 1028681 - DNA, 22 bp, Artificial Sequence
  chemically synthesized
actggagggataatgtatagtt

SEQ ID NO: 1028682 - DNA, 22 bp, Artificial Sequence
  chemically synthesized
catttccaagaactatacatta

SEQ ID NO: 1028683 - DNA, 22 bp, Artificial Sequence
  chemically synthesized
atttccaagaactatacattat

SEQ ID NO: 1028684 - DNA, 22 bp, Artificial Sequence
  chemically synthesized
ccaagaactatacattatccct

SEQ ID NO: 1028685 - DNA, 22 bp, Artificial Sequence
  chemically synthesized
caagaactatacattatccctc

SEQ ID NO: 1028686 - DNA, 22 bp, Artificial Sequence
  chemically synthesized
aagtgaaatgaaacttactgga

SEQ ID NO: 1028687 - DNA, 22 bp, Artificial Sequence
  chemically synthesized
tacattatccctccagtaagtt

SEQ ID NO: 1028688 - DNA, 22 bp, Artificial Sequence
  chemically synthesized
actgaagtgaaatgaaacttac

SEQ ID NO: 1028689 - DNA, 22 bp, Artificial Sequence
  chemically synthesized
aactgaagtgaaatgaaactta

SEQ ID NO: 1028690 - DNA, 22 bp, Artificial Sequence
  chemically synthesized
tccctccagtaagtttcatttc

SEQ ID NO: 1028691 - DNA, 22 bp, Artificial Sequence
  chemically synthesized
catttaactgaagtgaaatgaa

SEQ ID NO: 1028692 - DNA, 22 bp, Artificial Sequence
  chemically synthesized
cagtaagtttcatttcacttca

SEQ ID NO: 1028693 - DNA, 22 bp, Artificial Sequence
  chemically synthesized
catttcacttcagttaaatgga

SEQ ID NO: 1028694 - DNA, 22 bp, Artificial Sequence
  chemically synthesized
atttcacttcagttaaatggag

SEQ ID NO: 1028695 - DNA, 22 bp, Artificial Sequence
  chemically synthesized
cacttcagttaaatggagatgg

SEQ ID NO: 1028696 - DNA, 22 bp, Artificial Sequence
  chemically synthesized
acttcagttaaatggagatggc

SEQ ID NO: 1028697 - DNA, 22 bp, Artificial Sequence
  chemically synthesized
gaagaagcagaagccatctcca

SEQ ID NO: 1028698 - DNA, 22 bp, Artificial Sequence
  chemically synthesized
cagttaaatggagatggcttct

SEQ ID NO: 1028699 - DNA, 22 bp, Artificial Sequence
  chemically synthesized
attcgaagaagcagaagccatc

SEQ ID NO: 1028700 - DNA, 22 bp, Artificial Sequence
  chemically synthesized
agttaaatggagatggcttctg

SEQ ID NO: 1028701 - DNA, 22 bp, Artificial Sequence
  chemically synthesized
gattcgaagaagcagaagccat

SEQ ID NO: 1028702 - DNA, 22 bp, Artificial Sequence
  chemically synthesized
tgattcgaagaagcagaagcca

SEQ ID NO: 1028703 - DNA, 22 bp, Artificial Sequence
  chemically synthesized
aatggagatggcttctgcttct

SEQ ID NO: 1028704 - DNA, 22 bp, Artificial Sequence
  chemically synthesized
ggaagctttgattcgaagaagc

SEQ ID NO: 1028705 - DNA, 22 bp, Artificial Sequence
  chemically synthesized
taaacattaggaagctttgatt

SEQ ID NO: 1028706 - DNA, 22 bp, Artificial Sequence
  chemically synthesized
ctgcttcttcgaatcaaagctt

SEQ ID NO: 1028707 - DNA, 22 bp, Artificial Sequence
  chemically synthesized
tgcttcttcgaatcaaagcttc

SEQ ID NO: 1028708 - DNA, 22 bp, Artificial Sequence
  chemically synthesized
cttcttcgaatcaaagcttcct

SEQ ID NO: 1028709 - DNA, 22 bp, Artificial Sequence
  chemically synthesized
cttcgaatcaaagcttcctaat

SEQ ID NO: 1028710 - DNA, 22 bp, Artificial Sequence
  chemically synthesized
ttcgaatcaaagcttcctaatg

SEQ ID NO: 1028711 - DNA, 22 bp, Artificial Sequence
  chemically synthesized
accacctgtaaacattaggaag

SEQ ID NO: 1028712 - DNA, 22 bp, Artificial Sequence
  chemically synthesized
cgaatcaaagcttcctaatgtt

SEQ ID NO: 1028713 - DNA, 22 bp, Artificial Sequence
  chemically synthesized
gaatcaaagcttcctaatgttt

SEQ ID NO: 1028714 - DNA, 22 bp, Artificial Sequence
  chemically synthesized
cctaatgtttacaggtggtgag

SEQ ID NO: 1028715 - DNA, 22 bp, Artificial Sequence
  chemically synthesized
tatataaaagtcctcaccacct

SEQ ID NO: 1028716 - DNA, 22 bp, Artificial Sequence
  chemically synthesized
ctaatgtttacaggtggtgagg

SEQ ID NO: 1028717 - DNA, 22 bp, Artificial Sequence
  chemically synthesized
atatataaaagtcctcaccacc

SEQ ID NO: 1028718 - DNA, 22 bp, Artificial Sequence
  chemically synthesized
tatatataaaagtcctcaccac

SEQ ID NO: 1028719 - DNA, 22 bp, Artificial Sequence
  chemically synthesized
atgtttacaggtggtgaggact

SEQ ID NO: 1028720 - DNA, 22 bp, Artificial Sequence
  chemically synthesized
acaggtggtgaggacttttata

SEQ ID NO: 1028721 - DNA, 22 bp, Artificial Sequence
  chemically synthesized
caggtggtgaggacttttatat

SEQ ID NO: 1028722 - DNA, 22 bp, Artificial Sequence
  chemically synthesized
gagtgtaattttatatataaaa

SEQ ID NO: 1028723 - DNA, 22 bp, Artificial Sequence
  chemically synthesized
ggagtgtaattttatatataaa

SEQ ID NO: 1028724 - DNA, 22 bp, Artificial Sequence
  chemically synthesized
tggagtgtaattttatatataa

SEQ ID NO: 1028725 - DNA, 22 bp, Artificial Sequence
  chemically synthesized
tttggagtgtaattttatatat

SEQ ID NO: 1028726 - DNA, 22 bp, Artificial Sequence
  chemically synthesized
ctttggagtgtaattttatata

SEQ ID NO: 1028727 - DNA, 22 bp, Artificial Sequence
  chemically synthesized
catacttctttggagtgtaatt

SEQ ID NO: 1028728 - DNA, 22 bp, Artificial Sequence
  chemically synthesized
ttatatataaaattacactcca

SEQ ID NO: 1028729 - DNA, 22 bp, Artificial Sequence
  chemically synthesized
tatatataaaattacactccaa

SEQ ID NO: 1028730 - DNA, 22 bp, Artificial Sequence
  chemically synthesized
ttccatacttctttggagtgta

SEQ ID NO: 1028731 - DNA, 22 bp, Artificial Sequence
  chemically synthesized
atatataaaattacactccaaa

SEQ ID NO: 1028732 - DNA, 22 bp, Artificial Sequence
  chemically synthesized
attccatacttctttggagtgt

SEQ ID NO: 1028733 - DNA, 22 bp, Artificial Sequence
  chemically synthesized
tatataaaattacactccaaag

SEQ ID NO: 1028734 - DNA, 22 bp, Artificial Sequence
  chemically synthesized
aaatacccttattccatacttc

SEQ ID NO: 1028735 - DNA, 22 bp, Artificial Sequence
  chemically synthesized
taaaatacccttattccatact

SEQ ID NO: 1028736 - DNA, 22 bp, Artificial Sequence
  chemically synthesized
cactccaaagaagtatggaata

SEQ ID NO: 1028737 - DNA, 22 bp, Artificial Sequence
  chemically synthesized
tctaaaatacccttattccata

SEQ ID NO: 1028738 - DNA, 22 bp, Artificial Sequence
  chemically synthesized
ctctaaaatacccttattccat

SEQ ID NO: 1028739 - DNA, 22 bp, Artificial Sequence
  chemically synthesized
tctctaaaatacccttattcca

SEQ ID NO: 1028740 - DNA, 22 bp, Artificial Sequence
  chemically synthesized
caaagaagtatggaataagggt

SEQ ID NO: 1028741 - DNA, 22 bp, Artificial Sequence
  chemically synthesized
ttttctctaaaatacccttatt

SEQ ID NO: 1028742 - DNA, 22 bp, Artificial Sequence
  chemically synthesized
attttctctaaaatacccttat

SEQ ID NO: 1028743 - DNA, 22 bp, Artificial Sequence
  chemically synthesized
cagcaaaatgtacttattttct

SEQ ID NO: 1028744 - DNA, 22 bp, Artificial Sequence
  chemically synthesized
tacagcaaaatgtacttatttt

SEQ ID NO: 1028745 - DNA, 22 bp, Artificial Sequence
  chemically synthesized
tagagaaaataagtacattttg

SEQ ID NO: 1028746 - DNA, 22 bp, Artificial Sequence
  chemically synthesized
agagaaaataagtacattttgc

SEQ ID NO: 1028747 - DNA, 22 bp, Artificial Sequence
  chemically synthesized
tgcaactctacagcaaaatgta

SEQ ID NO: 1028748 - DNA, 22 bp, Artificial Sequence
  chemically synthesized
gagaaaataagtacattttgct

SEQ ID NO: 1028749 - DNA, 22 bp, Artificial Sequence
  chemically synthesized
tatgcaactctacagcaaaatg

SEQ ID NO: 1028750 - DNA, 22 bp, Artificial Sequence
  chemically synthesized
tatctctatgcaactctacagc

SEQ ID NO: 1028751 - DNA, 22 bp, Artificial Sequence
  chemically synthesized
gtatctctatgcaactctacag

SEQ ID NO: 1028752 - DNA, 22 bp, Artificial Sequence
  chemically synthesized
tcacttgtatctctatgcaact

SEQ ID NO: 1028753 - DNA, 22 bp, Artificial Sequence
  chemically synthesized
tgtcacttgtatctctatgcaa

SEQ ID NO: 1028754 - DNA, 22 bp, Artificial Sequence
  chemically synthesized
ctgtcacttgtatctctatgca

SEQ ID NO: 1028755 - DNA, 22 bp, Artificial Sequence
  chemically synthesized
tgctgtagagttgcatagagat

SEQ ID NO: 1028756 - DNA, 22 bp, Artificial Sequence
  chemically synthesized
gctgtagagttgcatagagata

SEQ ID NO: 1028757 - DNA, 22 bp, Artificial Sequence
  chemically synthesized
ctgtagagttgcatagagatac

SEQ ID NO: 1028758 - DNA, 22 bp, Artificial Sequence
  chemically synthesized
gcttctgtcacttgtatctcta

SEQ ID NO: 1028759 - DNA, 22 bp, Artificial Sequence
  chemically synthesized
agcttctgtcacttgtatctct

SEQ ID NO: 1028760 - DNA, 22 bp, Artificial Sequence
  chemically synthesized
tagagttgcatagagatacaag

SEQ ID NO: 1028761 - DNA, 22 bp, Artificial Sequence
  chemically synthesized
acttagcttctgtcacttgtat

SEQ ID NO: 1028762 - DNA, 22 bp, Artificial Sequence
  chemically synthesized
catagagatacaagtgacagaa

SEQ ID NO: 1028763 - DNA, 22 bp, Artificial Sequence
  chemically synthesized
taaaccctaacttagcttctgt

SEQ ID NO: 1028764 - DNA, 22 bp, Artificial Sequence
  chemically synthesized
ataaaccctaacttagcttctg

SEQ ID NO: 1028765 - DNA, 22 bp, Artificial Sequence
  chemically synthesized
gcacttataaaccctaacttag

SEQ ID NO: 1028766 - DNA, 22 bp, Artificial Sequence
  chemically synthesized
atagtctggcacttataaaccc

SEQ ID NO: 1028767 - DNA, 22 bp, Artificial Sequence
  chemically synthesized
agttagggtttataagtgccag

SEQ ID NO: 1028768 - DNA, 22 bp, Artificial Sequence
  chemically synthesized
gggtttataagtgccagactat

SEQ ID NO: 1028769 - DNA, 22 bp, Artificial Sequence
  chemically synthesized
acatccagaattcatagtctgg

SEQ ID NO: 1028770 - DNA, 22 bp, Artificial Sequence
  chemically synthesized
ataagtgccagactatgaattc

SEQ ID NO: 1028771 - DNA, 22 bp, Artificial Sequence
  chemically synthesized
taagtgccagactatgaattct

SEQ ID NO: 1028772 - DNA, 22 bp, Artificial Sequence
  chemically synthesized
ggccagaggctaacatccagaa

SEQ ID NO: 1028773 - DNA, 22 bp, Artificial Sequence
  chemically synthesized
ctaggccagaggctaacatcca

SEQ ID NO: 1028774 - DNA, 22 bp, Artificial Sequence
  chemically synthesized
tgaattctggatgttagcctct

SEQ ID NO: 1028775 - DNA, 22 bp, Artificial Sequence
  chemically synthesized
acctcctaggccagaggctaac

SEQ ID NO: 1028776 - DNA, 22 bp, Artificial Sequence
  chemically synthesized
taacctcctaggccagaggcta

SEQ ID NO: 1028777 - DNA, 22 bp, Artificial Sequence
  chemically synthesized
ctaacctcctaggccagaggct

SEQ ID NO: 1028778 - DNA, 22 bp, Artificial Sequence
  chemically synthesized
tctaacctcctaggccagaggc

SEQ ID NO: 1028779 - DNA, 22 bp, Artificial Sequence
  chemically synthesized
tggatgttagcctctggcctag

SEQ ID NO: 1028780 - DNA, 22 bp, Artificial Sequence
  chemically synthesized
attttctaacctcctaggccag

SEQ ID NO: 1028781 - DNA, 22 bp, Artificial Sequence
  chemically synthesized
gatgttagcctctggcctagga

SEQ ID NO: 1028782 - DNA, 22 bp, Artificial Sequence
  chemically synthesized
gattttctaacctcctaggcca

SEQ ID NO: 1028783 - DNA, 22 bp, Artificial Sequence
  chemically synthesized
gcctctggcctaggaggttaga

SEQ ID NO: 1028784 - DNA, 22 bp, Artificial Sequence
  chemically synthesized
aaggcatttgattttctaacct

SEQ ID NO: 1028785 - DNA, 22 bp, Artificial Sequence
  chemically synthesized
tggcctaggaggttagaaaatc

SEQ ID NO: 1028786 - DNA, 22 bp, Artificial Sequence
  chemically synthesized
gcctaggaggttagaaaatcaa

SEQ ID NO: 1028787 - DNA, 22 bp, Artificial Sequence
  chemically synthesized
ggaggttagaaaatcaaatgcc

SEQ ID NO: 1028788 - DNA, 22 bp, Artificial Sequence
  chemically synthesized
gaaaatcaaatgccttcagggg

SEQ ID NO: 1028789 - DNA, 22 bp, Artificial Sequence
  chemically synthesized
tgtgtcccacgtgtcccctgaa

SEQ ID NO: 1028790 - DNA, 22 bp, Artificial Sequence
  chemically synthesized
atgtgtcccacgtgtcccctga

SEQ ID NO: 1028791 - DNA, 22 bp, Artificial Sequence
  chemically synthesized
tatgtgtcccacgtgtcccctg

SEQ ID NO: 1028792 - DNA, 22 bp, Artificial Sequence
  chemically synthesized
caattttatgtgtcccacgtgt

SEQ ID NO: 1028793 - DNA, 22 bp, Artificial Sequence
  chemically synthesized
acaattttatgtgtcccacgtg

SEQ ID NO: 1028794 - DNA, 22 bp, Artificial Sequence
  chemically synthesized
tacaattttatgtgtcccacgt

SEQ ID NO: 1028795 - DNA, 22 bp, Artificial Sequence
  chemically synthesized
caggggacacgtgggacacata

SEQ ID NO: 1028796 - DNA, 22 bp, Artificial Sequence
  chemically synthesized
aggggacacgtgggacacataa

SEQ ID NO: 1028797 - DNA, 22 bp, Artificial Sequence
  chemically synthesized
aggctttacaattttatgtgtc

SEQ ID NO: 1028798 - DNA, 22 bp, Artificial Sequence
  chemically synthesized
taaggctttacaattttatgtg

SEQ ID NO: 1028799 - DNA, 22 bp, Artificial Sequence
  chemically synthesized
ctaaggctttacaattttatgt

SEQ ID NO: 1028800 - DNA, 22 bp, Artificial Sequence
  chemically synthesized
tctaaggctttacaattttatg

SEQ ID NO: 1028801 - DNA, 22 bp, Artificial Sequence
  chemically synthesized
tactttctaaggctttacaatt

SEQ ID NO: 1028802 - DNA, 22 bp, Artificial Sequence
  chemically synthesized
ctatactttctaaggctttaca

SEQ ID NO: 1028803 - DNA, 22 bp, Artificial Sequence
  chemically synthesized
ttgctatactttctaaggcttt

SEQ ID NO: 1028804 - DNA, 22 bp, Artificial Sequence
  chemically synthesized
attgctatactttctaaggctt

SEQ ID NO: 1028805 - DNA, 22 bp, Artificial Sequence
  chemically synthesized
gcacttattgctatactttcta

SEQ ID NO: 1028806 - DNA, 22 bp, Artificial Sequence
  chemically synthesized
agcacttattgctatactttct

SEQ ID NO: 1028807 - DNA, 22 bp, Artificial Sequence
  chemically synthesized
taaagccttagaaagtatagca

SEQ ID NO: 1028808 - DNA, 22 bp, Artificial Sequence
  chemically synthesized
agaaagtatagcaataagtgct

SEQ ID NO: 1028809 - DNA, 22 bp, Artificial Sequence
  chemically synthesized
gaaagtatagcaataagtgcta

SEQ ID NO: 1028810 - DNA, 22 bp, Artificial Sequence
  chemically synthesized
atcaacaccatcagtttagcac

SEQ ID NO: 1028811 - DNA, 22 bp, Artificial Sequence
  chemically synthesized
gactgatcaacaccatcagttt

SEQ ID NO: 1028812 - DNA, 22 bp, Artificial Sequence
  chemically synthesized
aactgatggtgttgatcagtcc

SEQ ID NO: 1028813 - DNA, 22 bp, Artificial Sequence
  chemically synthesized
atggtgttgatcagtccagtct

SEQ ID NO: 1028814 - DNA, 22 bp, Artificial Sequence
  chemically synthesized
atcagtccagtctctgcccggt

SEQ ID NO: 1028815 - DNA, 22 bp, Artificial Sequence
  chemically synthesized
aaaggcaatgaaaccgggcaga

SEQ ID NO: 1028816 - DNA, 22 bp, Artificial Sequence
  chemically synthesized
caaggaacattaaaaggcaatg

SEQ ID NO: 1028817 - DNA, 22 bp, Artificial Sequence
  chemically synthesized
tgcccggtttcattgcctttta

SEQ ID NO: 1028818 - DNA, 22 bp, Artificial Sequence
  chemically synthesized
cccggtttcattgccttttaat

SEQ ID NO: 1028819 - DNA, 22 bp, Artificial Sequence
  chemically synthesized
acctgcaaggaacattaaaagg

SEQ ID NO: 1028820 - DNA, 22 bp, Artificial Sequence
  chemically synthesized
gacctgcaaggaacattaaaag

SEQ ID NO: 1028821 - DNA, 22 bp, Artificial Sequence
  chemically synthesized
tttgacctgcaaggaacattaa

SEQ ID NO: 1028822 - DNA, 22 bp, Artificial Sequence
  chemically synthesized
gtttgacctgcaaggaacatta

SEQ ID NO: 1028823 - DNA, 22 bp, Artificial Sequence
  chemically synthesized
tgtttgacctgcaaggaacatt

SEQ ID NO: 1028824 - DNA, 22 bp, Artificial Sequence
  chemically synthesized
cattgccttttaatgttccttg

SEQ ID NO: 1028825 - DNA, 22 bp, Artificial Sequence
  chemically synthesized
attgccttttaatgttccttgc

SEQ ID NO: 1028826 - DNA, 22 bp, Artificial Sequence
  chemically synthesized
ctttgtttgacctgcaaggaac

SEQ ID NO: 1028827 - DNA, 22 bp, Artificial Sequence
  chemically synthesized
ccttttaatgttccttgcaggt

SEQ ID NO: 1028828 - DNA, 22 bp, Artificial Sequence
  chemically synthesized
gctgctttgtttgacctgcaag

SEQ ID NO: 1028829 - DNA, 22 bp, Artificial Sequence
  chemically synthesized
ggctgctttgtttgacctgcaa

SEQ ID NO: 1028830 - DNA, 22 bp, Artificial Sequence
  chemically synthesized
ttaatgttccttgcaggtcaaa

SEQ ID NO: 1028831 - DNA, 22 bp, Artificial Sequence
  chemically synthesized
taatgttccttgcaggtcaaac

SEQ ID NO: 1028832 - DNA, 22 bp, Artificial Sequence
  chemically synthesized
cttggctgctttgtttgacctg

SEQ ID NO: 1028833 - DNA, 22 bp, Artificial Sequence
  chemically synthesized
aatgttccttgcaggtcaaaca

SEQ ID NO: 1028834 - DNA, 22 bp, Artificial Sequence
  chemically synthesized
gcttggctgctttgtttgacct

SEQ ID NO: 1028835 - DNA, 22 bp, Artificial Sequence
  chemically synthesized
atgttccttgcaggtcaaacaa

SEQ ID NO: 1028836 - DNA, 22 bp, Artificial Sequence
  chemically synthesized
tgcttggctgctttgtttgacc

SEQ ID NO: 1028837 - DNA, 22 bp, Artificial Sequence
  chemically synthesized
cttgcaggtcaaacaaagcagc

SEQ ID NO: 1028838 - DNA, 22 bp, Artificial Sequence
  chemically synthesized
gcaggtcaaacaaagcagccaa

SEQ ID NO: 1028839 - DNA, 22 bp, Artificial Sequence
  chemically synthesized
caggtcaaacaaagcagccaag

SEQ ID NO: 1028840 - DNA, 22 bp, Artificial Sequence
  chemically synthesized
aaggatatgttttgcttggctg

SEQ ID NO: 1028841 - DNA, 22 bp, Artificial Sequence
  chemically synthesized
aaacgggtagccccaggagaaa

SEQ ID NO: 1028842 - DNA, 22 bp, Artificial Sequence
  chemically synthesized
caaacgggtagccccaggagaa

SEQ ID NO: 1028843 - DNA, 22 bp, Artificial Sequence
  chemically synthesized
cagctctcttttctcctggggc

SEQ ID NO: 1028844 - DNA, 22 bp, Artificial Sequence
  chemically synthesized
agctctcttttctcctggggct

SEQ ID NO: 1028845 - DNA, 22 bp, Artificial Sequence
  chemically synthesized
atttcaaacgggtagccccagg

SEQ ID NO: 1028846 - DNA, 22 bp, Artificial Sequence
  chemically synthesized
gatttcaaacgggtagccccag

SEQ ID NO: 1028847 - DNA, 22 bp, Artificial Sequence
  chemically synthesized
tgatttcaaacgggtagcccca

SEQ ID NO: 1028848 - DNA, 22 bp, Artificial Sequence
  chemically synthesized
tcttttctcctggggctacccg

SEQ ID NO: 1028849 - DNA, 22 bp, Artificial Sequence
  chemically synthesized
ttttctcctggggctacccgtt

SEQ ID NO: 1028850 - DNA, 22 bp, Artificial Sequence
  chemically synthesized
ttctcctggggctacccgtttg

SEQ ID NO: 1028851 - DNA, 22 bp, Artificial Sequence
  chemically synthesized
tctcctggggctacccgtttga

SEQ ID NO: 1028852 - DNA, 22 bp, Artificial Sequence
  chemically synthesized
atagctttgatttcaaacgggt

SEQ ID NO: 1028853 - DNA, 22 bp, Artificial Sequence
  chemically synthesized
ctcctggggctacccgtttgaa

SEQ ID NO: 1028854 - DNA, 22 bp, Artificial Sequence
  chemically synthesized
tcctggggctacccgtttgaaa

SEQ ID NO: 1028855 - DNA, 22 bp, Artificial Sequence
  chemically synthesized
ttgatagctttgatttcaaacg

SEQ ID NO: 1028856 - DNA, 22 bp, Artificial Sequence
  chemically synthesized
ctggggctacccgtttgaaatc

SEQ ID NO: 1028857 - DNA, 22 bp, Artificial Sequence
  chemically synthesized
tgttgatagctttgatttcaaa

SEQ ID NO: 1028858 - DNA, 22 bp, Artificial Sequence
  chemically synthesized
gggctacccgtttgaaatcaaa

SEQ ID NO: 1028859 - DNA, 22 bp, Artificial Sequence
  chemically synthesized
tctgttgatagctttgatttca

SEQ ID NO: 1028860 - DNA, 22 bp, Artificial Sequence
  chemically synthesized
ctctgttgatagctttgatttc

SEQ ID NO: 1028861 - DNA, 22 bp, Artificial Sequence
  chemically synthesized
cccgtttgaaatcaaagctatc

SEQ ID NO: 1028862 - DNA, 22 bp, Artificial Sequence
  chemically synthesized
agtgtttctctgttgatagctt

SEQ ID NO: 1028863 - DNA, 22 bp, Artificial Sequence
  chemically synthesized
cagtgtttctctgttgatagct

SEQ ID NO: 1028864 - DNA, 22 bp, Artificial Sequence
  chemically synthesized
gaaatcaaagctatcaacagag

SEQ ID NO: 1028865 - DNA, 22 bp, Artificial Sequence
  chemically synthesized
aaatcaaagctatcaacagaga

SEQ ID NO: 1028866 - DNA, 22 bp, Artificial Sequence
  chemically synthesized
ccagcacaggaaccttcagtgt

SEQ ID NO: 1028867 - DNA, 22 bp, Artificial Sequence
  chemically synthesized
tcaacagagaaacactgaaggt

SEQ ID NO: 1028868 - DNA, 22 bp, Artificial Sequence
  chemically synthesized
cccagcacaggaaccttcagtg

SEQ ID NO: 1028869 - DNA, 22 bp, Artificial Sequence
  chemically synthesized
acatttcccagcacaggaacct

SEQ ID NO: 1028870 - DNA, 22 bp, Artificial Sequence
  chemically synthesized
cacatttcccagcacaggaacc

SEQ ID NO: 1028871 - DNA, 22 bp, Artificial Sequence
  chemically synthesized
cttcacatttcccagcacagga

SEQ ID NO: 1028872 - DNA, 22 bp, Artificial Sequence
  chemically synthesized
ctgcttcacatttcccagcaca

SEQ ID NO: 1028873 - DNA, 22 bp, Artificial Sequence
  chemically synthesized
aaggttcctgtgctgggaaatg

SEQ ID NO: 1028874 - DNA, 22 bp, Artificial Sequence
  chemically synthesized
ctgtgctgggaaatgtgaagca

SEQ ID NO: 1028875 - DNA, 22 bp, Artificial Sequence
  chemically synthesized
aagcagcactcctgcttcacat

SEQ ID NO: 1028876 - DNA, 22 bp, Artificial Sequence
  chemically synthesized
tgaagcagcactcctgcttcac

SEQ ID NO: 1028877 - DNA, 22 bp, Artificial Sequence
  chemically synthesized
tgctgggaaatgtgaagcagga

SEQ ID NO: 1028878 - DNA, 22 bp, Artificial Sequence
  chemically synthesized
ctgaagcagcactcctgcttca

SEQ ID NO: 1028879 - DNA, 22 bp, Artificial Sequence
  chemically synthesized
tctgaagcagcactcctgcttc

SEQ ID NO: 1028880 - DNA, 22 bp, Artificial Sequence
  chemically synthesized
ggaaatgtgaagcaggagtgct

SEQ ID NO: 1028881 - DNA, 22 bp, Artificial Sequence
  chemically synthesized
acctttctgaagcagcactcct

SEQ ID NO: 1028882 - DNA, 22 bp, Artificial Sequence
  chemically synthesized
aaagagttaacctttctgaagc

SEQ ID NO: 1028883 - DNA, 22 bp, Artificial Sequence
  chemically synthesized
gaaagagttaacctttctgaag

SEQ ID NO: 1028884 - DNA, 22 bp, Artificial Sequence
  chemically synthesized
tgaaagagttaacctttctgaa

SEQ ID NO: 1028885 - DNA, 22 bp, Artificial Sequence
  chemically synthesized
ttgaaagagttaacctttctga

SEQ ID NO: 1028886 - DNA, 22 bp, Artificial Sequence
  chemically synthesized
ttttgaaagagttaacctttct

SEQ ID NO: 1028887 - DNA, 22 bp, Artificial Sequence
  chemically synthesized
cttttgaaagagttaacctttc

SEQ ID NO: 1028888 - DNA, 22 bp, Artificial Sequence
  chemically synthesized
tttcttttgaaagagttaacct

SEQ ID NO: 1028889 - DNA, 22 bp, Artificial Sequence
  chemically synthesized
cttcagaaaggttaactctttc

SEQ ID NO: 1028890 - DNA, 22 bp, Artificial Sequence
  chemically synthesized
cagaaaggttaactctttcaaa

SEQ ID NO: 1028891 - DNA, 22 bp, Artificial Sequence
  chemically synthesized
agaaaggttaactctttcaaaa

SEQ ID NO: 1028892 - DNA, 22 bp, Artificial Sequence
  chemically synthesized
cacccaaatcactgtttctttt

SEQ ID NO: 1028893 - DNA, 22 bp, Artificial Sequence
  chemically synthesized
tccacccaaatcactgtttctt

SEQ ID NO: 1028894 - DNA, 22 bp, Artificial Sequence
  chemically synthesized
actctttcaaaagaaacagtga

SEQ ID NO: 1028895 - DNA, 22 bp, Artificial Sequence
  chemically synthesized
tctccacccaaatcactgtttc

SEQ ID NO: 1028896 - DNA, 22 bp, Artificial Sequence
  chemically synthesized
tttcaaaagaaacagtgatttg

SEQ ID NO: 1028897 - DNA, 22 bp, Artificial Sequence
  chemically synthesized
tcaaaagaaacagtgatttggg

SEQ ID NO: 1028898 - DNA, 22 bp, Artificial Sequence
  chemically synthesized
caaaagaaacagtgatttgggt

SEQ ID NO: 1028899 - DNA, 22 bp, Artificial Sequence
  chemically synthesized
aaaagaaacagtgatttgggtg

SEQ ID NO: 1028900 - DNA, 22 bp, Artificial Sequence
  chemically synthesized
taagagatctctctccacccaa

SEQ ID NO: 1028901 - DNA, 22 bp, Artificial Sequence
  chemically synthesized
gtaagagatctctctccaccca

SEQ ID NO: 1028902 - DNA, 22 bp, Artificial Sequence
  chemically synthesized
gggtggagagagatctcttaca

SEQ ID NO: 1028903 - DNA, 22 bp, Artificial Sequence
  chemically synthesized
ggtggagagagatctcttacaa

SEQ ID NO: 1028904 - DNA, 22 bp, Artificial Sequence
  chemically synthesized
gacatcaatcgcaagtcagtag

SEQ ID NO: 1028905 - DNA, 22 bp, Artificial Sequence
  chemically synthesized
ttacaaggtatctactgacttg

SEQ ID NO: 1028906 - DNA, 22 bp, Artificial Sequence
  chemically synthesized
acaaggtatctactgacttgcg

SEQ ID NO: 1028907 - DNA, 22 bp, Artificial Sequence
  chemically synthesized
ctggacatcaatcgcaagtcag

SEQ ID NO: 1028908 - DNA, 22 bp, Artificial Sequence
  chemically synthesized
caaggtatctactgacttgcga

SEQ ID NO: 1028909 - DNA, 22 bp, Artificial Sequence
  chemically synthesized
tcctggacatcaatcgcaagtc

SEQ ID NO: 1028910 - DNA, 22 bp, Artificial Sequence
  chemically synthesized
attctcctggacatcaatcgca

SEQ ID NO: 1028911 - DNA, 22 bp, Artificial Sequence
  chemically synthesized
cattctcctggacatcaatcgc

SEQ ID NO: 1028912 - DNA, 22 bp, Artificial Sequence
  chemically synthesized
tcattctcctggacatcaatcg

SEQ ID NO: 1028913 - DNA, 22 bp, Artificial Sequence
  chemically synthesized
ttcattctcctggacatcaatc

SEQ ID NO: 1028914 - DNA, 22 bp, Artificial Sequence
  chemically synthesized
ctgacttgcgattgatgtccag

SEQ ID NO: 1028915 - DNA, 22 bp, Artificial Sequence
  chemically synthesized
ccttttcattctcctggacatc

SEQ ID NO: 1028916 - DNA, 22 bp, Artificial Sequence
  chemically synthesized
acttgcgattgatgtccaggag

SEQ ID NO: 1028917 - DNA, 22 bp, Artificial Sequence
  chemically synthesized
gcgattgatgtccaggagaatg

SEQ ID NO: 1028918 - DNA, 22 bp, Artificial Sequence
  chemically synthesized
cgattgatgtccaggagaatga

SEQ ID NO: 1028919 - DNA, 22 bp, Artificial Sequence
  chemically synthesized
atgccctcccttttcattctcc

SEQ ID NO: 1028920 - DNA, 22 bp, Artificial Sequence
  chemically synthesized
catgccctcccttttcattctc

SEQ ID NO: 1028921 - DNA, 22 bp, Artificial Sequence
  chemically synthesized
tcatgccctcccttttcattct

SEQ ID NO: 1028922 - DNA, 22 bp, Artificial Sequence
  chemically synthesized
atgtccaggagaatgaaaaggg

SEQ ID NO: 1028923 - DNA, 22 bp, Artificial Sequence
  chemically synthesized
tgttttcatgccctcccttttc

SEQ ID NO: 1028924 - DNA, 22 bp, Artificial Sequence
  chemically synthesized
atgttttcatgccctccctttt

SEQ ID NO: 1028925 - DNA, 22 bp, Artificial Sequence
  chemically synthesized
tatgttttcatgccctcccttt

SEQ ID NO: 1028926 - DNA, 22 bp, Artificial Sequence
  chemically synthesized
ttatgttttcatgccctccctt

SEQ ID NO: 1028927 - DNA, 22 bp, Artificial Sequence
  chemically synthesized
tttatgttttcatgccctccct

SEQ ID NO: 1028928 - DNA, 22 bp, Artificial Sequence
  chemically synthesized
tacactttttatgttttcatgc

SEQ ID NO: 1028929 - DNA, 22 bp, Artificial Sequence
  chemically synthesized
tgtacactttttatgttttcat

SEQ ID NO: 1028930 - DNA, 22 bp, Artificial Sequence
  chemically synthesized
gattctgtacactttttatgtt

SEQ ID NO: 1028931 - DNA, 22 bp, Artificial Sequence
  chemically synthesized
ctggattctgtacactttttat

SEQ ID NO: 1028932 - DNA, 22 bp, Artificial Sequence
  chemically synthesized
actggattctgtacacttttta

SEQ ID NO: 1028933 - DNA, 22 bp, Artificial Sequence
  chemically synthesized
ccatttactggattctgtacac

SEQ ID NO: 1028934 - DNA, 22 bp, Artificial Sequence
  chemically synthesized
gccatttactggattctgtaca

SEQ ID NO: 1028935 - DNA, 22 bp, Artificial Sequence
  chemically synthesized
tgccatttactggattctgtac

SEQ ID NO: 1028936 - DNA, 22 bp, Artificial Sequence
  chemically synthesized
aatattttgccatttactggat

SEQ ID NO: 1028937 - DNA, 22 bp, Artificial Sequence
  chemically synthesized
attgaatattttgccatttact

SEQ ID NO: 1028938 - DNA, 22 bp, Artificial Sequence
  chemically synthesized
aattgaatattttgccatttac

SEQ ID NO: 1028939 - DNA, 22 bp, Artificial Sequence
  chemically synthesized
taattgaatattttgccattta

SEQ ID NO: 1028940 - DNA, 22 bp, Artificial Sequence
  chemically synthesized
cactttaattgaatattttgcc

SEQ ID NO: 1028941 - DNA, 22 bp, Artificial Sequence
  chemically synthesized
cctgcactttaattgaatattt

SEQ ID NO: 1028942 - DNA, 22 bp, Artificial Sequence
  chemically synthesized
tacctccctgcactttaattga

SEQ ID NO: 1028943 - DNA, 22 bp, Artificial Sequence
  chemically synthesized
atacctccctgcactttaattg

SEQ ID NO: 1028944 - DNA, 22 bp, Artificial Sequence
  chemically synthesized
tatacctccctgcactttaatt

SEQ ID NO: 1028945 - DNA, 22 bp, Artificial Sequence
  chemically synthesized
tttatacctccctgcactttaa

SEQ ID NO: 1028946 - DNA, 22 bp, Artificial Sequence
  chemically synthesized
ctttatacctccctgcacttta

SEQ ID NO: 1028947 - DNA, 22 bp, Artificial Sequence
  chemically synthesized
tctttatacctccctgcacttt

SEQ ID NO: 1028948 - DNA, 22 bp, Artificial Sequence
  chemically synthesized
tcctttctttatacctccctgc

SEQ ID NO: 1028949 - DNA, 22 bp, Artificial Sequence
  chemically synthesized
aattaaagtgcagggaggtata

SEQ ID NO: 1028950 - DNA, 22 bp, Artificial Sequence
  chemically synthesized
aagtgcagggaggtataaagaa

SEQ ID NO: 1028951 - DNA, 22 bp, Artificial Sequence
  chemically synthesized
aaacatgtgttgtcctttcttt

SEQ ID NO: 1028952 - DNA, 22 bp, Artificial Sequence
  chemically synthesized
agattaaaacatgtgttgtcct

SEQ ID NO: 1028953 - DNA, 22 bp, Artificial Sequence
  chemically synthesized
taatgtcctcagattaaaacat

SEQ ID NO: 1028954 - DNA, 22 bp, Artificial Sequence
  chemically synthesized
ataatgtcctcagattaaaaca

SEQ ID NO: 1028955 - DNA, 22 bp, Artificial Sequence
  chemically synthesized
ttataatgtcctcagattaaaa

SEQ ID NO: 1028956 - DNA, 22 bp, Artificial Sequence
  chemically synthesized
cttataatgtcctcagattaaa

SEQ ID NO: 1028957 - DNA, 22 bp, Artificial Sequence
  chemically synthesized
tttcttataatgtcctcagatt

SEQ ID NO: 1028958 - DNA, 22 bp, Artificial Sequence
  chemically synthesized
taatctgaggacattataagaa

SEQ ID NO: 1028959 - DNA, 22 bp, Artificial Sequence
  chemically synthesized
aatctgaggacattataagaaa

SEQ ID NO: 1028960 - DNA, 22 bp, Artificial Sequence
  chemically synthesized
atctgaggacattataagaaat

SEQ ID NO: 1028961 - DNA, 22 bp, Artificial Sequence
  chemically synthesized
aggacattataagaaataatgg

SEQ ID NO: 1028962 - DNA, 22 bp, Artificial Sequence
  chemically synthesized
caagaacataccaccattattt

SEQ ID NO: 1028963 - DNA, 22 bp, Artificial Sequence
  chemically synthesized
aattccaagaacataccaccat

SEQ ID NO: 1028964 - DNA, 22 bp, Artificial Sequence
  chemically synthesized
tcaattccaagaacataccacc

SEQ ID NO: 1028965 - DNA, 22 bp, Artificial Sequence
  chemically synthesized
taagaaataatggtggtatgtt

SEQ ID NO: 1028966 - DNA, 22 bp, Artificial Sequence
  chemically synthesized
ctcaattccaagaacataccac

SEQ ID NO: 1028967 - DNA, 22 bp, Artificial Sequence
  chemically synthesized
ggcttctcaattccaagaacat

SEQ ID NO: 1028968 - DNA, 22 bp, Artificial Sequence
  chemically synthesized
gttaggcttctcaattccaaga

SEQ ID NO: 1028969 - DNA, 22 bp, Artificial Sequence
  chemically synthesized
agttaggcttctcaattccaag

SEQ ID NO: 1028970 - DNA, 22 bp, Artificial Sequence
  chemically synthesized
tgacttagttaggcttctcaat

SEQ ID NO: 1028971 - DNA, 22 bp, Artificial Sequence
  chemically synthesized
ttggaattgagaagcctaacta

SEQ ID NO: 1028972 - DNA, 22 bp, Artificial Sequence
  chemically synthesized
taacctgtgacttagttaggct

SEQ ID NO: 1028973 - DNA, 22 bp, Artificial Sequence
  chemically synthesized
ggaattgagaagcctaactaag

SEQ ID NO: 1028974 - DNA, 22 bp, Artificial Sequence
  chemically synthesized
gaattgagaagcctaactaagt

SEQ ID NO: 1028975 - DNA, 22 bp, Artificial Sequence
  chemically synthesized
ctataacctgtgacttagttag

SEQ ID NO: 1028976 - DNA, 22 bp, Artificial Sequence
  chemically synthesized
attcctataacctgtgacttag

SEQ ID NO: 1028977 - DNA, 22 bp, Artificial Sequence
  chemically synthesized
gattcctataacctgtgactta

SEQ ID NO: 1028978 - DNA, 22 bp, Artificial Sequence
  chemically synthesized
agaagcctaactaagtcacagg

SEQ ID NO: 1028979 - DNA, 22 bp, Artificial Sequence
  chemically synthesized
tgattcctataacctgtgactt

SEQ ID NO: 1028980 - DNA, 22 bp, Artificial Sequence
  chemically synthesized
actaagtcacaggttataggaa

SEQ ID NO: 1028981 - DNA, 22 bp, Artificial Sequence
  chemically synthesized
agtcacaggttataggaatcaa

SEQ ID NO: 1028982 - DNA, 22 bp, Artificial Sequence
  chemically synthesized
ccaagtcaatagcaccaccact

SEQ ID NO: 1028983 - DNA, 22 bp, Artificial Sequence
  chemically synthesized
accaagtcaatagcaccaccac

SEQ ID NO: 1028984 - DNA, 22 bp, Artificial Sequence
  chemically synthesized
taggaatcaaagtggtggtgct

SEQ ID NO: 1028985 - DNA, 22 bp, Artificial Sequence
  chemically synthesized
aatttaccaagtcaatagcacc

SEQ ID NO: 1028986 - DNA, 22 bp, Artificial Sequence
  chemically synthesized
aaatttaccaagtcaatagcac

SEQ ID NO: 1028987 - DNA, 22 bp, Artificial Sequence
  chemically synthesized
ttaaatttaccaagtcaatagc

SEQ ID NO: 1028988 - DNA, 22 bp, Artificial Sequence
  chemically synthesized
tcttaaatttaccaagtcaata

SEQ ID NO: 1028989 - DNA, 22 bp, Artificial Sequence
  chemically synthesized
taaagttctcttaaatttacca

SEQ ID NO: 1028990 - DNA, 22 bp, Artificial Sequence
  chemically synthesized
ataaagttctcttaaatttacc

SEQ ID NO: 1028991 - DNA, 22 bp, Artificial Sequence
  chemically synthesized
tataaagttctcttaaatttac

SEQ ID NO: 1028992 - DNA, 22 bp, Artificial Sequence
  chemically synthesized
ttgacttggtaaatttaagaga

SEQ ID NO: 1028993 - DNA, 22 bp, Artificial Sequence
  chemically synthesized
acttggtaaatttaagagaact

SEQ ID NO: 1028994 - DNA, 22 bp, Artificial Sequence
  chemically synthesized
acaaattttataaagttctctt

SEQ ID NO: 1028995 - DNA, 22 bp, Artificial Sequence
  chemically synthesized
ggtaaatttaagagaactttat

SEQ ID NO: 1028996 - DNA, 22 bp, Artificial Sequence
  chemically synthesized
gtaaatttaagagaactttata

SEQ ID NO: 1028997 - DNA, 22 bp, Artificial Sequence
  chemically synthesized
aagagaactttataaaatttgt

SEQ ID NO: 1028998 - DNA, 22 bp, Artificial Sequence
  chemically synthesized
agagaactttataaaatttgtg

SEQ ID NO: 1028999 - DNA, 22 bp, Artificial Sequence
  chemically synthesized
agataaagaaataacgaattca

SEQ ID NO: 1029000 - DNA, 22 bp, Artificial Sequence
  chemically synthesized
tataaaatttgtgaattcgtta

SEQ ID NO: 1029001 - DNA, 22 bp, Artificial Sequence
  chemically synthesized
aagataaagaaataacgaattc

SEQ ID NO: 1029002 - DNA, 22 bp, Artificial Sequence
  chemically synthesized
ataaaatttgtgaattcgttat

SEQ ID NO: 1029003 - DNA, 22 bp, Artificial Sequence
  chemically synthesized
taaaatttgtgaattcgttatt

SEQ ID NO: 1029004 - DNA, 22 bp, Artificial Sequence
  chemically synthesized
catttaagataaagaaataacg

SEQ ID NO: 1029005 - DNA, 22 bp, Artificial Sequence
  chemically synthesized
ttgcatttaagataaagaaata

SEQ ID NO: 1029006 - DNA, 22 bp, Artificial Sequence
  chemically synthesized
gtgaattcgttatttctttatc

SEQ ID NO: 1029007 - DNA, 22 bp, Artificial Sequence
  chemically synthesized
tgaattcgttatttctttatct

SEQ ID NO: 1029008 - DNA, 22 bp, Artificial Sequence
  chemically synthesized
gtgctattgcatttaagataaa

SEQ ID NO: 1029009 - DNA, 22 bp, Artificial Sequence
  chemically synthesized
gttatttctttatcttaaatgc

SEQ ID NO: 1029010 - DNA, 22 bp, Artificial Sequence
  chemically synthesized
tttctttatcttaaatgcaata

SEQ ID NO: 1029011 - DNA, 22 bp, Artificial Sequence
  chemically synthesized
aggcattagtgctattgcattt

SEQ ID NO: 1029012 - DNA, 22 bp, Artificial Sequence
  chemically synthesized
gaggcattagtgctattgcatt

SEQ ID NO: 1029013 - DNA, 22 bp, Artificial Sequence
  chemically synthesized
tgaggcattagtgctattgcat

SEQ ID NO: 1029014 - DNA, 22 bp, Artificial Sequence
  chemically synthesized
ctttatcttaaatgcaatagca

SEQ ID NO: 1029015 - DNA, 22 bp, Artificial Sequence
  chemically synthesized
ttgaggcattagtgctattgca

SEQ ID NO: 1029016 - DNA, 22 bp, Artificial Sequence
  chemically synthesized
tttatcttaaatgcaatagcac

SEQ ID NO: 1029017 - DNA, 22 bp, Artificial Sequence
  chemically synthesized
ttttgaggcattagtgctattg

SEQ ID NO: 1029018 - DNA, 22 bp, Artificial Sequence
  chemically synthesized
tatcttaaatgcaatagcacta

SEQ ID NO: 1029019 - DNA, 22 bp, Artificial Sequence
  chemically synthesized
atcttaaatgcaatagcactaa

SEQ ID NO: 1029020 - DNA, 22 bp, Artificial Sequence
  chemically synthesized
tcttaaatgcaatagcactaat

SEQ ID NO: 1029021 - DNA, 22 bp, Artificial Sequence
  chemically synthesized
ttcttttgaggcattagtgcta

SEQ ID NO: 1029022 - DNA, 22 bp, Artificial Sequence
  chemically synthesized
aaatgcaatagcactaatgcct

SEQ ID NO: 1029023 - DNA, 22 bp, Artificial Sequence
  chemically synthesized
aatgcaatagcactaatgcctc

SEQ ID NO: 1029024 - DNA, 22 bp, Artificial Sequence
  chemically synthesized
taggttgttcttttgaggcatt

SEQ ID NO: 1029025 - DNA, 22 bp, Artificial Sequence
  chemically synthesized
gtaggttgttcttttgaggcat

SEQ ID NO: 1029026 - DNA, 22 bp, Artificial Sequence
  chemically synthesized
atgcctcaaaagaacaacctac

SEQ ID NO: 1029027 - DNA, 22 bp, Artificial Sequence
  chemically synthesized
tgggtagacatttgtaggttgt

SEQ ID NO: 1029028 - DNA, 22 bp, Artificial Sequence
  chemically synthesized
tgtgggtagacatttgtaggtt

SEQ ID NO: 1029029 - DNA, 22 bp, Artificial Sequence
  chemically synthesized
ctgtgggtagacatttgtaggt

SEQ ID NO: 1029030 - DNA, 22 bp, Artificial Sequence
  chemically synthesized
aaaagaacaacctacaaatgtc

SEQ ID NO: 1029031 - DNA, 22 bp, Artificial Sequence
  chemically synthesized
tataacttctgtgggtagacat

SEQ ID NO: 1029032 - DNA, 22 bp, Artificial Sequence
  chemically synthesized
caaatgtctacccacagaagtt

SEQ ID NO: 1029033 - DNA, 22 bp, Artificial Sequence
  chemically synthesized
aaacaaaatagcctgtataact

SEQ ID NO: 1029034 - DNA, 22 bp, Artificial Sequence
  chemically synthesized
cccacagaagttatacaggcta

SEQ ID NO: 1029035 - DNA, 22 bp, Artificial Sequence
  chemically synthesized
attgaaacaaaatagcctgtat

SEQ ID NO: 1029036 - DNA, 22 bp, Artificial Sequence
  chemically synthesized
tacaggctattttgtttcaatg

SEQ ID NO: 1029037 - DNA, 22 bp, Artificial Sequence
  chemically synthesized
gggccagccattcattgaaaca

SEQ ID NO: 1029038 - DNA, 22 bp, Artificial Sequence
  chemically synthesized
tcgggccagccattcattgaaa

SEQ ID NO: 1029039 - DNA, 22 bp, Artificial Sequence
  chemically synthesized
ctcgggccagccattcattgaa

SEQ ID NO: 1029040 - DNA, 22 bp, Artificial Sequence
  chemically synthesized
tctcgggccagccattcattga

SEQ ID NO: 1029041 - DNA, 22 bp, Artificial Sequence
  chemically synthesized
ttttgtttcaatgaatggctgg

SEQ ID NO: 1029042 - DNA, 22 bp, Artificial Sequence
  chemically synthesized
tgtttcaatgaatggctggccc

SEQ ID NO: 1029043 - DNA, 22 bp, Artificial Sequence
  chemically synthesized
gtttcaatgaatggctggcccg

SEQ ID NO: 1029044 - DNA, 22 bp, Artificial Sequence
  chemically synthesized
tttcaatgaatggctggcccga

SEQ ID NO: 1029045 - DNA, 22 bp, Artificial Sequence
  chemically synthesized
caatgaatggctggcccgagaa

SEQ ID NO: 1029046 - DNA, 22 bp, Artificial Sequence
  chemically synthesized
agtgcaaccattttctcgggcc

SEQ ID NO: 1029047 - DNA, 22 bp, Artificial Sequence
  chemically synthesized
aatgaatggctggcccgagaaa

SEQ ID NO: 1029048 - DNA, 22 bp, Artificial Sequence
  chemically synthesized
gagtgcaaccattttctcgggc

SEQ ID NO: 1029049 - DNA, 22 bp, Artificial Sequence
  chemically synthesized
ttgagtgcaaccattttctcgg

SEQ ID NO: 1029050 - DNA, 22 bp, Artificial Sequence
  chemically synthesized
tcttgagtgcaaccattttctc

SEQ ID NO: 1029051 - DNA, 22 bp, Artificial Sequence
  chemically synthesized
tctcttgagtgcaaccattttc

SEQ ID NO: 1029052 - DNA, 22 bp, Artificial Sequence
  chemically synthesized
gcccgagaaaatggttgcactc

SEQ ID NO: 1029053 - DNA, 22 bp, Artificial Sequence
  chemically synthesized
caaaaacagtcgcaaacattct

SEQ ID NO: 1029054 - DNA, 22 bp, Artificial Sequence
  chemically synthesized
ccaaaaacagtcgcaaacattc

SEQ ID NO: 1029055 - DNA, 22 bp, Artificial Sequence
  chemically synthesized
cactcaagagagaatgtttgcg

SEQ ID NO: 1029056 - DNA, 22 bp, Artificial Sequence
  chemically synthesized
aagagagaatgtttgcgactgt

SEQ ID NO: 1029057 - DNA, 22 bp, Artificial Sequence
  chemically synthesized
gcgactgtttttggaaattctt

SEQ ID NO: 1029058 - DNA, 22 bp, Artificial Sequence
  chemically synthesized
cccaacccacagaagaatttcc

SEQ ID NO: 1029059 - DNA, 22 bp, Artificial Sequence
  chemically synthesized
cgactgtttttggaaattcttc

SEQ ID NO: 1029060 - DNA, 22 bp, Artificial Sequence
  chemically synthesized
ttacccaacccacagaagaatt

SEQ ID NO: 1029061 - DNA, 22 bp, Artificial Sequence
  chemically synthesized
tttttggaaattcttctgtggg

SEQ ID NO: 1029062 - DNA, 22 bp, Artificial Sequence
  chemically synthesized
ttggaaattcttctgtgggttg

SEQ ID NO: 1029063 - DNA, 22 bp, Artificial Sequence
  chemically synthesized
tggaaattcttctgtgggttgg

SEQ ID NO: 1029064 - DNA, 22 bp, Artificial Sequence
  chemically synthesized
ggaaattcttctgtgggttggg

SEQ ID NO: 1029065 - DNA, 22 bp, Artificial Sequence
  chemically synthesized
agtgtattattacccaacccac

SEQ ID NO: 1029066 - DNA, 22 bp, Artificial Sequence
  chemically synthesized
gaaattcttctgtgggttgggt

SEQ ID NO: 1029067 - DNA, 22 bp, Artificial Sequence
  chemically synthesized
gagtgtattattacccaaccca

SEQ ID NO: 1029068 - DNA, 22 bp, Artificial Sequence
  chemically synthesized
ttgagtgtattattacccaacc

SEQ ID NO: 1029069 - DNA, 22 bp, Artificial Sequence
  chemically synthesized
ttctgtgggttgggtaataata

SEQ ID NO: 1029070 - DNA, 22 bp, Artificial Sequence
  chemically synthesized
ctgtgggttgggtaataataca

SEQ ID NO: 1029071 - DNA, 22 bp, Artificial Sequence
  chemically synthesized
tgtgggttgggtaataatacac

SEQ ID NO: 1029072 - DNA, 22 bp, Artificial Sequence
  chemically synthesized
tgggttgggtaataatacactc

SEQ ID NO: 1029073 - DNA, 22 bp, Artificial Sequence
  chemically synthesized
ggtaataatacactcaagagac

SEQ ID NO: 1029074 - DNA, 22 bp, Artificial Sequence
  chemically synthesized
ccagaaaaatcacaaacatgtc

SEQ ID NO: 1029075 - DNA, 22 bp, Artificial Sequence
  chemically synthesized
cccagaaaaatcacaaacatgt

SEQ ID NO: 1029076 - DNA, 22 bp, Artificial Sequence
  chemically synthesized
aagagacatgtttgtgattttt

SEQ ID NO: 1029077 - DNA, 22 bp, Artificial Sequence
  chemically synthesized
cacgaaaaaatttcccagaaaa

SEQ ID NO: 1029078 - DNA, 22 bp, Artificial Sequence
  chemically synthesized
gtgatttttctgggaaattttt

SEQ ID NO: 1029079 - DNA, 22 bp, Artificial Sequence
  chemically synthesized
cccactccacgaaaaaatttcc

SEQ ID NO: 1029080 - DNA, 22 bp, Artificial Sequence
  chemically synthesized
tgatttttctgggaaatttttt

SEQ ID NO: 1029081 - DNA, 22 bp, Artificial Sequence
  chemically synthesized
ttacccactccacgaaaaaatt

SEQ ID NO: 1029082 - DNA, 22 bp, Artificial Sequence
  chemically synthesized
attacccactccacgaaaaaat

SEQ ID NO: 1029083 - DNA, 22 bp, Artificial Sequence
  chemically synthesized
ttctgggaaattttttcgtgga

SEQ ID NO: 1029084 - DNA, 22 bp, Artificial Sequence
  chemically synthesized
tttattacccactccacgaaaa

SEQ ID NO: 1029085 - DNA, 22 bp, Artificial Sequence
  chemically synthesized
tctgggaaattttttcgtggag

SEQ ID NO: 1029086 - DNA, 22 bp, Artificial Sequence
  chemically synthesized
ctgggaaattttttcgtggagt

SEQ ID NO: 1029087 - DNA, 22 bp, Artificial Sequence
  chemically synthesized
tatttattacccactccacgaa

SEQ ID NO: 1029088 - DNA, 22 bp, Artificial Sequence
  chemically synthesized
tgggaaattttttcgtggagtg

SEQ ID NO: 1029089 - DNA, 22 bp, Artificial Sequence
  chemically synthesized
ggaaattttttcgtggagtggg

SEQ ID NO: 1029090 - DNA, 22 bp, Artificial Sequence
  chemically synthesized
ctctatttattacccactccac

SEQ ID NO: 1029091 - DNA, 22 bp, Artificial Sequence
  chemically synthesized
tgctctatttattacccactcc

SEQ ID NO: 1029092 - DNA, 22 bp, Artificial Sequence
  chemically synthesized
tttcgtggagtgggtaataaat

SEQ ID NO: 1029093 - DNA, 22 bp, Artificial Sequence
  chemically synthesized
atattctgctctatttattacc

SEQ ID NO: 1029094 - DNA, 22 bp, Artificial Sequence
  chemically synthesized
ttcgtggagtgggtaataaata

SEQ ID NO: 1029095 - DNA, 22 bp, Artificial Sequence
  chemically synthesized
tcgtggagtgggtaataaatag

SEQ ID NO: 1029096 - DNA, 22 bp, Artificial Sequence
  chemically synthesized
cgtggagtgggtaataaataga

SEQ ID NO: 1029097 - DNA, 22 bp, Artificial Sequence
  chemically synthesized
gtggagtgggtaataaatagag

SEQ ID NO: 1029098 - DNA, 22 bp, Artificial Sequence
  chemically synthesized
acctaatattctgctctattta

SEQ ID NO: 1029099 - DNA, 22 bp, Artificial Sequence
  chemically synthesized
tcacctaatattctgctctatt

SEQ ID NO: 1029100 - DNA, 22 bp, Artificial Sequence
  chemically synthesized
ctcacctaatattctgctctat

SEQ ID NO: 1029101 - DNA, 22 bp, Artificial Sequence
  chemically synthesized
agtatttctcacctaatattct

SEQ ID NO: 1029102 - DNA, 22 bp, Artificial Sequence
  chemically synthesized
aaattgagtatttctcacctaa

SEQ ID NO: 1029103 - DNA, 22 bp, Artificial Sequence
  chemically synthesized
gtcctgaaattgagtatttctc

SEQ ID NO: 1029104 - DNA, 22 bp, Artificial Sequence
  chemically synthesized
ggtgagaaatactcaatttcag

SEQ ID NO: 1029105 - DNA, 22 bp, Artificial Sequence
  chemically synthesized
aaataactagtcctgaaattga

SEQ ID NO: 1029106 - DNA, 22 bp, Artificial Sequence
  chemically synthesized
aaaataactagtcctgaaattg

SEQ ID NO: 1029107 - DNA, 22 bp, Artificial Sequence
  chemically synthesized
caacagtttaaaataactagtc

SEQ ID NO: 1029108 - DNA, 22 bp, Artificial Sequence
  chemically synthesized
acaacagtttaaaataactagt

SEQ ID NO: 1029109 - DNA, 22 bp, Artificial Sequence
  chemically synthesized
aatttcaggactagttatttta

SEQ ID NO: 1029110 - DNA, 22 bp, Artificial Sequence
  chemically synthesized
taatttacaacagtttaaaata

SEQ ID NO: 1029111 - DNA, 22 bp, Artificial Sequence
  chemically synthesized
caggactagttattttaaactg

SEQ ID NO: 1029112 - DNA, 22 bp, Artificial Sequence
  chemically synthesized
aggactagttattttaaactgt

SEQ ID NO: 1029113 - DNA, 22 bp, Artificial Sequence
  chemically synthesized
atattataatttacaacagttt

SEQ ID NO: 1029114 - DNA, 22 bp, Artificial Sequence
  chemically synthesized
aatattataatttacaacagtt

SEQ ID NO: 1029115 - DNA, 22 bp, Artificial Sequence
  chemically synthesized
gttattttaaactgttgtaaat

SEQ ID NO: 1029116 - DNA, 22 bp, Artificial Sequence
  chemically synthesized
taatttaatattataatttaca

SEQ ID NO: 1029117 - DNA, 22 bp, Artificial Sequence
  chemically synthesized
ttttaaactgttgtaaattata

SEQ ID NO: 1029118 - DNA, 22 bp, Artificial Sequence
  chemically synthesized
ataatttaatattataatttac

SEQ ID NO: 1029119 - DNA, 22 bp, Artificial Sequence
  chemically synthesized
tataatttaatattataattta

SEQ ID NO: 1029120 - DNA, 22 bp, Artificial Sequence
  chemically synthesized
taaactgttgtaaattataata

SEQ ID NO: 1029121 - DNA, 22 bp, Artificial Sequence
  chemically synthesized
aaactgttgtaaattataatat

SEQ ID NO: 1029122 - DNA, 22 bp, Artificial Sequence
  chemically synthesized
aactgttgtaaattataatatt

SEQ ID NO: 1029123 - DNA, 22 bp, Artificial Sequence
  chemically synthesized
aattttataatttaatattata

SEQ ID NO: 1029124 - DNA, 22 bp, Artificial Sequence
  chemically synthesized
aaattttataatttaatattat

SEQ ID NO: 1029125 - DNA, 22 bp, Artificial Sequence
  chemically synthesized
ttgtaaattataatattaaatt

SEQ ID NO: 1029126 - DNA, 22 bp, Artificial Sequence
  chemically synthesized
taaattataatattaaattata

SEQ ID NO: 1029127 - DNA, 22 bp, Artificial Sequence
  chemically synthesized
acaatgtttaaattttataatt

SEQ ID NO: 1029128 - DNA, 22 bp, Artificial Sequence
  chemically synthesized
taatattaaattataaaattta

SEQ ID NO: 1029129 - DNA, 22 bp, Artificial Sequence
  chemically synthesized
aattataaaatttaaacattgt

SEQ ID NO: 1029130 - DNA, 22 bp, Artificial Sequence
  chemically synthesized
taaaatttaaacattgtgaata

SEQ ID NO: 1029131 - DNA, 22 bp, Artificial Sequence
  chemically synthesized
agtacagaaaaagaacatattc

SEQ ID NO: 1029132 - DNA, 22 bp, Artificial Sequence
  chemically synthesized
aaacattgtgaatatgttcttt

SEQ ID NO: 1029133 - DNA, 22 bp, Artificial Sequence
  chemically synthesized
aacattgtgaatatgttctttt

SEQ ID NO: 1029134 - DNA, 22 bp, Artificial Sequence
  chemically synthesized
atacctgagtacagaaaaagaa

SEQ ID NO: 1029135 - DNA, 22 bp, Artificial Sequence
  chemically synthesized
aatacctgagtacagaaaaaga

SEQ ID NO: 1029136 - DNA, 22 bp, Artificial Sequence
  chemically synthesized
tgaatatgttctttttctgtac

SEQ ID NO: 1029137 - DNA, 22 bp, Artificial Sequence
  chemically synthesized
atttaatacctgagtacagaaa

SEQ ID NO: 1029138 - DNA, 22 bp, Artificial Sequence
  chemically synthesized
gatttaatacctgagtacagaa

SEQ ID NO: 1029139 - DNA, 22 bp, Artificial Sequence
  chemically synthesized
tttttctgtactcaggtattaa

SEQ ID NO: 1029140 - DNA, 22 bp, Artificial Sequence
  chemically synthesized
tttctgtactcaggtattaaat

SEQ ID NO: 1029141 - DNA, 22 bp, Artificial Sequence
  chemically synthesized
ttctgtactcaggtattaaatc

SEQ ID NO: 1029142 - DNA, 22 bp, Artificial Sequence
  chemically synthesized
tctgtactcaggtattaaatca

SEQ ID NO: 1029143 - DNA, 22 bp, Artificial Sequence
  chemically synthesized
cccaaaaatatttgatttaata

SEQ ID NO: 1029144 - DNA, 22 bp, Artificial Sequence
  chemically synthesized
ctgtactcaggtattaaatcaa

SEQ ID NO: 1029145 - DNA, 22 bp, Artificial Sequence
  chemically synthesized
tgtactcaggtattaaatcaaa

SEQ ID NO: 1029146 - DNA, 22 bp, Artificial Sequence
  chemically synthesized
tactcaggtattaaatcaaata

SEQ ID NO: 1029147 - DNA, 22 bp, Artificial Sequence
  chemically synthesized
attacccaaaaatatttgattt

SEQ ID NO: 1029148 - DNA, 22 bp, Artificial Sequence
  chemically synthesized
aggtattaaatcaaatattttt

SEQ ID NO: 1029149 - DNA, 22 bp, Artificial Sequence
  chemically synthesized
cactaattacccaaaaatattt

SEQ ID NO: 1029150 - DNA, 22 bp, Artificial Sequence
  chemically synthesized
ccactaattacccaaaaatatt

SEQ ID NO: 1029151 - DNA, 22 bp, Artificial Sequence
  chemically synthesized
accttccactaattacccaaaa

SEQ ID NO: 1029152 - DNA, 22 bp, Artificial Sequence
  chemically synthesized
aatcaaatatttttgggtaatt

SEQ ID NO: 1029153 - DNA, 22 bp, Artificial Sequence
  chemically synthesized
taagctcaccttccactaatta

SEQ ID NO: 1029154 - DNA, 22 bp, Artificial Sequence
  chemically synthesized
ataagctcaccttccactaatt

SEQ ID NO: 1029155 - DNA, 22 bp, Artificial Sequence
  chemically synthesized
tataagctcaccttccactaat

SEQ ID NO: 1029156 - DNA, 22 bp, Artificial Sequence
  chemically synthesized
ttataagctcaccttccactaa

SEQ ID NO: 1029157 - DNA, 22 bp, Artificial Sequence
  chemically synthesized
tttataagctcaccttccacta

SEQ ID NO: 1029158 - DNA, 22 bp, Artificial Sequence
  chemically synthesized
ttgggtaattagtggaaggtga

SEQ ID NO: 1029159 - DNA, 22 bp, Artificial Sequence
  chemically synthesized
tgggtaattagtggaaggtgag

SEQ ID NO: 1029160 - DNA, 22 bp, Artificial Sequence
  chemically synthesized
gggtaattagtggaaggtgagc

SEQ ID NO: 1029161 - DNA, 22 bp, Artificial Sequence
  chemically synthesized
ggtaattagtggaaggtgagct

SEQ ID NO: 1029162 - DNA, 22 bp, Artificial Sequence
  chemically synthesized
tcaatctttttataagctcacc

SEQ ID NO: 1029163 - DNA, 22 bp, Artificial Sequence
  chemically synthesized
ctatcaatctttttataagctc

SEQ ID NO: 1029164 - DNA, 22 bp, Artificial Sequence
  chemically synthesized
gctatcaatctttttataagct

SEQ ID NO: 1029165 - DNA, 22 bp, Artificial Sequence
  chemically synthesized
gtggaaggtgagcttataaaaa

SEQ ID NO: 1029166 - DNA, 22 bp, Artificial Sequence
  chemically synthesized
tttgctatcaatctttttataa

SEQ ID NO: 1029167 - DNA, 22 bp, Artificial Sequence
  chemically synthesized
atttgctatcaatctttttata

SEQ ID NO: 1029168 - DNA, 22 bp, Artificial Sequence
  chemically synthesized
tatttgctatcaatctttttat

SEQ ID NO: 1029169 - DNA, 22 bp, Artificial Sequence
  chemically synthesized
ttttatttgctatcaatctttt

SEQ ID NO: 1029170 - DNA, 22 bp, Artificial Sequence
  chemically synthesized
ctgttttatttgctatcaatct

SEQ ID NO: 1029171 - DNA, 22 bp, Artificial Sequence
  chemically synthesized
ataaaaagattgatagcaaata

SEQ ID NO: 1029172 - DNA, 22 bp, Artificial Sequence
  chemically synthesized
taaaaagattgatagcaaataa

SEQ ID NO: 1029173 - DNA, 22 bp, Artificial Sequence
  chemically synthesized
aggcagttactgttttatttgc

SEQ ID NO: 1029174 - DNA, 22 bp, Artificial Sequence
  chemically synthesized
gagttgaggcagttactgtttt

SEQ ID NO: 1029175 - DNA, 22 bp, Artificial Sequence
  chemically synthesized
atagcaaataaaacagtaactg

SEQ ID NO: 1029176 - DNA, 22 bp, Artificial Sequence
  chemically synthesized
ggtatcaagtaaccctggagtt

SEQ ID NO: 1029177 - DNA, 22 bp, Artificial Sequence
  chemically synthesized
aggtatcaagtaaccctggagt

SEQ ID NO: 1029178 - DNA, 22 bp, Artificial Sequence
  chemically synthesized
gcccttaggtatcaagtaaccc

SEQ ID NO: 1029179 - DNA, 22 bp, Artificial Sequence
  chemically synthesized
cctcaactccagggttacttga

SEQ ID NO: 1029180 - DNA, 22 bp, Artificial Sequence
  chemically synthesized
aactccagggttacttgatacc

SEQ ID NO: 1029181 - DNA, 22 bp, Artificial Sequence
  chemically synthesized
gattagcccttaggtatcaagt

SEQ ID NO: 1029182 - DNA, 22 bp, Artificial Sequence
  chemically synthesized
ggattagcccttaggtatcaag

SEQ ID NO: 1029183 - DNA, 22 bp, Artificial Sequence
  chemically synthesized
cagggttacttgatacctaagg

SEQ ID NO: 1029184 - DNA, 22 bp, Artificial Sequence
  chemically synthesized
tcatgtttggattagcccttag

SEQ ID NO: 1029185 - DNA, 22 bp, Artificial Sequence
  chemically synthesized
cttgatacctaagggctaatcc

SEQ ID NO: 1029186 - DNA, 22 bp, Artificial Sequence
  chemically synthesized
gatacctaagggctaatccaaa

SEQ ID NO: 1029187 - DNA, 22 bp, Artificial Sequence
  chemically synthesized
atacctaagggctaatccaaac

SEQ ID NO: 1029188 - DNA, 22 bp, Artificial Sequence
  chemically synthesized
aagatactatcatgtttggatt

SEQ ID NO: 1029189 - DNA, 22 bp, Artificial Sequence
  chemically synthesized
aaagatactatcatgtttggat

SEQ ID NO: 1029190 - DNA, 22 bp, Artificial Sequence
  chemically synthesized
agggctaatccaaacatgatag

SEQ ID NO: 1029191 - DNA, 22 bp, Artificial Sequence
  chemically synthesized
tgtatttaaagatactatcatg

SEQ ID NO: 1029192 - DNA, 22 bp, Artificial Sequence
  chemically synthesized
atccaaacatgatagtatcttt

SEQ ID NO: 1029193 - DNA, 22 bp, Artificial Sequence
  chemically synthesized
cattatgtatttaaagatacta

SEQ ID NO: 1029194 - DNA, 22 bp, Artificial Sequence
  chemically synthesized
tgggtctacattatgtatttaa

SEQ ID NO: 1029195 - DNA, 22 bp, Artificial Sequence
  chemically synthesized
atgggtctacattatgtattta

SEQ ID NO: 1029196 - DNA, 22 bp, Artificial Sequence
  chemically synthesized
gtttatgggtctacattatgta

SEQ ID NO: 1029197 - DNA, 22 bp, Artificial Sequence
  chemically synthesized
taaatacataatgtagacccat

SEQ ID NO: 1029198 - DNA, 22 bp, Artificial Sequence
  chemically synthesized
cgatactagtttatgggtctac

SEQ ID NO: 1029199 - DNA, 22 bp, Artificial Sequence
  chemically synthesized
aaatacataatgtagacccata

SEQ ID NO: 1029200 - DNA, 22 bp, Artificial Sequence
  chemically synthesized
aatacataatgtagacccataa

SEQ ID NO: 1029201 - DNA, 22 bp, Artificial Sequence
  chemically synthesized
attccgatactagtttatgggt

SEQ ID NO: 1029202 - DNA, 22 bp, Artificial Sequence
  chemically synthesized
gattccgatactagtttatggg

SEQ ID NO: 1029203 - DNA, 22 bp, Artificial Sequence
  chemically synthesized
taatttgattccgatactagtt

SEQ ID NO: 1029204 - DNA, 22 bp, Artificial Sequence
  chemically synthesized
gtatcggaatcaaattacaatg

SEQ ID NO: 1029205 - DNA, 22 bp, Artificial Sequence
  chemically synthesized
agaaagtcaataaaaacattgt

SEQ ID NO: 1029206 - DNA, 22 bp, Artificial Sequence
  chemically synthesized
cacacattaagaaagtcaataa

SEQ ID NO: 1029207 - DNA, 22 bp, Artificial Sequence
  chemically synthesized
caatgtttttattgactttctt

SEQ ID NO: 1029208 - DNA, 22 bp, Artificial Sequence
  chemically synthesized
cgtgtgattacacacattaaga

SEQ ID NO: 1029209 - DNA, 22 bp, Artificial Sequence
  chemically synthesized
ttattgactttcttaatgtgtg

SEQ ID NO: 1029210 - DNA, 22 bp, Artificial Sequence
  chemically synthesized
tattgactttcttaatgtgtgt

SEQ ID NO: 1029211 - DNA, 22 bp, Artificial Sequence
  chemically synthesized
attgactttcttaatgtgtgta

SEQ ID NO: 1029212 - DNA, 22 bp, Artificial Sequence
  chemically synthesized
ttgactttcttaatgtgtgtaa

SEQ ID NO: 1029213 - DNA, 22 bp, Artificial Sequence
  chemically synthesized
actttcttaatgtgtgtaatca

SEQ ID NO: 1029214 - DNA, 22 bp, Artificial Sequence
  chemically synthesized
tcttaatgtgtgtaatcacacg

SEQ ID NO: 1029215 - DNA, 22 bp, Artificial Sequence
  chemically synthesized
cttaatgtgtgtaatcacacgg

SEQ ID NO: 1029216 - DNA, 22 bp, Artificial Sequence
  chemically synthesized
ttaatgtgtgtaatcacacgga

SEQ ID NO: 1029217 - DNA, 22 bp, Artificial Sequence
  chemically synthesized
aatgtgtgtaatcacacggaga

SEQ ID NO: 1029218 - DNA, 22 bp, Artificial Sequence
  chemically synthesized
tgaataatatgatctccgtgtg

SEQ ID NO: 1029219 - DNA, 22 bp, Artificial Sequence
  chemically synthesized
atgtgtgtaatcacacggagat

SEQ ID NO: 1029220 - DNA, 22 bp, Artificial Sequence
  chemically synthesized
gtgaataatatgatctccgtgt

SEQ ID NO: 1029221 - DNA, 22 bp, Artificial Sequence
  chemically synthesized
tgtgaataatatgatctccgtg

SEQ ID NO: 1029222 - DNA, 22 bp, Artificial Sequence
  chemically synthesized
attttgtgaataatatgatctc

SEQ ID NO: 1029223 - DNA, 22 bp, Artificial Sequence
  chemically synthesized
cattttgtgaataatatgatct

SEQ ID NO: 1029224 - DNA, 22 bp, Artificial Sequence
  chemically synthesized
tcattttgtgaataatatgatc

SEQ ID NO: 1029225 - DNA, 22 bp, Artificial Sequence
  chemically synthesized
actttcattttgtgaataatat

SEQ ID NO: 1029226 - DNA, 22 bp, Artificial Sequence
  chemically synthesized
ctaactttcattttgtgaataa

SEQ ID NO: 1029227 - DNA, 22 bp, Artificial Sequence
  chemically synthesized
acaaactactaactttcatttt

SEQ ID NO: 1029228 - DNA, 22 bp, Artificial Sequence
  chemically synthesized
actcacaaactactaactttca

SEQ ID NO: 1029229 - DNA, 22 bp, Artificial Sequence
  chemically synthesized
cactcacaaactactaactttc

SEQ ID NO: 1029230 - DNA, 22 bp, Artificial Sequence
  chemically synthesized
tcactcacaaactactaacttt

SEQ ID NO: 1029231 - DNA, 22 bp, Artificial Sequence
  chemically synthesized
ttcacaaaatgaaagttagtag

SEQ ID NO: 1029232 - DNA, 22 bp, Artificial Sequence
  chemically synthesized
tttcactcacaaactactaact

SEQ ID NO: 1029233 - DNA, 22 bp, Artificial Sequence
  chemically synthesized
ctttcactcacaaactactaac

SEQ ID NO: 1029234 - DNA, 22 bp, Artificial Sequence
  chemically synthesized
acaaaatgaaagttagtagttt

SEQ ID NO: 1029235 - DNA, 22 bp, Artificial Sequence
  chemically synthesized
ccttctttcactcacaaactac

SEQ ID NO: 1029236 - DNA, 22 bp, Artificial Sequence
  chemically synthesized
gtctgccttctttcactcacaa

SEQ ID NO: 1029237 - DNA, 22 bp, Artificial Sequence
  chemically synthesized
tggtctgccttctttcactcac

SEQ ID NO: 1029238 - DNA, 22 bp, Artificial Sequence
  chemically synthesized
ctggtctgccttctttcactca

SEQ ID NO: 1029239 - DNA, 22 bp, Artificial Sequence
  chemically synthesized
tttctggtctgccttctttcac

SEQ ID NO: 1029240 - DNA, 22 bp, Artificial Sequence
  chemically synthesized
gtagtttgtgagtgaaagaagg

SEQ ID NO: 1029241 - DNA, 22 bp, Artificial Sequence
  chemically synthesized
atttctggtctgccttctttca

SEQ ID NO: 1029242 - DNA, 22 bp, Artificial Sequence
  chemically synthesized
gtgagtgaaagaaggcagacca

SEQ ID NO: 1029243 - DNA, 22 bp, Artificial Sequence
  chemically synthesized
tgagtgaaagaaggcagaccag

SEQ ID NO: 1029244 - DNA, 22 bp, Artificial Sequence
  chemically synthesized
taaaagtagaatcatgaagtat

SEQ ID NO: 1029245 - DNA, 22 bp, Artificial Sequence
  chemically synthesized
ataaaagtagaatcatgaagta

SEQ ID NO: 1029246 - DNA, 22 bp, Artificial Sequence
  chemically synthesized
tataaaagtagaatcatgaagt

SEQ ID NO: 1029247 - DNA, 22 bp, Artificial Sequence
  chemically synthesized
tagaattttataaaagtagaat

SEQ ID NO: 1029248 - DNA, 22 bp, Artificial Sequence
  chemically synthesized
atagaattttataaaagtagaa

SEQ ID NO: 1029249 - DNA, 22 bp, Artificial Sequence
  chemically synthesized
tatagaattttataaaagtaga

SEQ ID NO: 1029250 - DNA, 22 bp, Artificial Sequence
  chemically synthesized
cgttttatagaattttataaaa

SEQ ID NO: 1029251 - DNA, 22 bp, Artificial Sequence
  chemically synthesized
catgattctacttttataaaat

SEQ ID NO: 1029252 - DNA, 22 bp, Artificial Sequence
  chemically synthesized
gcgttttatagaattttataaa

SEQ ID NO: 1029253 - DNA, 22 bp, Artificial Sequence
  chemically synthesized
atgattctacttttataaaatt

SEQ ID NO: 1029254 - DNA, 22 bp, Artificial Sequence
  chemically synthesized
tacttttataaaattctataaa

SEQ ID NO: 1029255 - DNA, 22 bp, Artificial Sequence
  chemically synthesized
cttttataaaattctataaaac

SEQ ID NO: 1029256 - DNA, 22 bp, Artificial Sequence
  chemically synthesized
tagataagtttgcgttttatag

SEQ ID NO: 1029257 - DNA, 22 bp, Artificial Sequence
  chemically synthesized
ttataaaattctataaaacgca

SEQ ID NO: 1029258 - DNA, 22 bp, Artificial Sequence
  chemically synthesized
tataaaattctataaaacgcaa

SEQ ID NO: 1029259 - DNA, 22 bp, Artificial Sequence
  chemically synthesized
ataaaattctataaaacgcaaa

SEQ ID NO: 1029260 - DNA, 22 bp, Artificial Sequence
  chemically synthesized
taaaattctataaaacgcaaac

SEQ ID NO: 1029261 - DNA, 22 bp, Artificial Sequence
  chemically synthesized
gcattatagataagtttgcgtt

SEQ ID NO: 1029262 - DNA, 22 bp, Artificial Sequence
  chemically synthesized
actggcattatagataagtttg

SEQ ID NO: 1029263 - DNA, 22 bp, Artificial Sequence
  chemically synthesized
tataaaacgcaaacttatctat

SEQ ID NO: 1029264 - DNA, 22 bp, Artificial Sequence
  chemically synthesized
taaaacgcaaacttatctataa

SEQ ID NO: 1029265 - DNA, 22 bp, Artificial Sequence
  chemically synthesized
atgctgactggcattatagata

SEQ ID NO: 1029266 - DNA, 22 bp, Artificial Sequence
  chemically synthesized
ccactgatgctgactggcatta

SEQ ID NO: 1029267 - DNA, 22 bp, Artificial Sequence
  chemically synthesized
atctataatgccagtcagcatc

SEQ ID NO: 1029268 - DNA, 22 bp, Artificial Sequence
  chemically synthesized
tctataatgccagtcagcatca

SEQ ID NO: 1029269 - DNA, 22 bp, Artificial Sequence
  chemically synthesized
ccaggttaccactgatgctgac

SEQ ID NO: 1029270 - DNA, 22 bp, Artificial Sequence
  chemically synthesized
taatgccagtcagcatcagtgg

SEQ ID NO: 1029271 - DNA, 22 bp, Artificial Sequence
  chemically synthesized
attcccaggttaccactgatgc

SEQ ID NO: 1029272 - DNA, 22 bp, Artificial Sequence
  chemically synthesized
gattcccaggttaccactgatg

SEQ ID NO: 1029273 - DNA, 22 bp, Artificial Sequence
  chemically synthesized
ccttgattcccaggttaccact

SEQ ID NO: 1029274 - DNA, 22 bp, Artificial Sequence
  chemically synthesized
cccctcccttgattcccaggtt

SEQ ID NO: 1029275 - DNA, 22 bp, Artificial Sequence
  chemically synthesized
ctgcccctcccttgattcccag

SEQ ID NO: 1029276 - DNA, 22 bp, Artificial Sequence
  chemically synthesized
tcctgcccctcccttgattccc

SEQ ID NO: 1029277 - DNA, 22 bp, Artificial Sequence
  chemically synthesized
tctcctgcccctcccttgattc

SEQ ID NO: 1029278 - DNA, 22 bp, Artificial Sequence
  chemically synthesized
ggaatcaagggaggggcaggag

SEQ ID NO: 1029279 - DNA, 22 bp, Artificial Sequence
  chemically synthesized
ggtaatcactctctcctgcccc

SEQ ID NO: 1029280 - DNA, 22 bp, Artificial Sequence
  chemically synthesized
cggtaatcactctctcctgccc

SEQ ID NO: 1029281 - DNA, 22 bp, Artificial Sequence
  chemically synthesized
tcggtaatcactctctcctgcc

SEQ ID NO: 1029282 - DNA, 22 bp, Artificial Sequence
  chemically synthesized
ttttcggtaatcactctctcct

SEQ ID NO: 1029283 - DNA, 22 bp, Artificial Sequence
  chemically synthesized
acaagtctgttttcggtaatca

SEQ ID NO: 1029284 - DNA, 22 bp, Artificial Sequence
  chemically synthesized
ccgaaaacagacttgtgaggat

SEQ ID NO: 1029285 - DNA, 22 bp, Artificial Sequence
  chemically synthesized
gtgaggatattggatatgttta

SEQ ID NO: 1029286 - DNA, 22 bp, Artificial Sequence
  chemically synthesized
tgaggatattggatatgtttat

SEQ ID NO: 1029287 - DNA, 22 bp, Artificial Sequence
  chemically synthesized
gcacagtcaagataataaacat

SEQ ID NO: 1029288 - DNA, 22 bp, Artificial Sequence
  chemically synthesized
ttagcacagtcaagataataaa

SEQ ID NO: 1029289 - DNA, 22 bp, Artificial Sequence
  chemically synthesized
gatatgtttattatcttgactg

SEQ ID NO: 1029290 - DNA, 22 bp, Artificial Sequence
  chemically synthesized
attatcttgactgtgctaatag

SEQ ID NO: 1029291 - DNA, 22 bp, Artificial Sequence
  chemically synthesized
ttatcttgactgtgctaatagt

SEQ ID NO: 1029292 - DNA, 22 bp, Artificial Sequence
  chemically synthesized
tcttgactgtgctaatagtttc

SEQ ID NO: 1029293 - DNA, 22 bp, Artificial Sequence
  chemically synthesized
gactgtgctaatagtttcactg

SEQ ID NO: 1029294 - DNA, 22 bp, Artificial Sequence
  chemically synthesized
actgtgctaatagtttcactgg

SEQ ID NO: 1029295 - DNA, 22 bp, Artificial Sequence
  chemically synthesized
acatatgcaaataccagtgaaa

SEQ ID NO: 1029296 - DNA, 22 bp, Artificial Sequence
  chemically synthesized
gacatatgcaaataccagtgaa

SEQ ID NO: 1029297 - DNA, 22 bp, Artificial Sequence
  chemically synthesized
tgacatatgcaaataccagtga

SEQ ID NO: 1029298 - DNA, 22 bp, Artificial Sequence
  chemically synthesized
tgctaatagtttcactggtatt

SEQ ID NO: 1029299 - DNA, 22 bp, Artificial Sequence
  chemically synthesized
atagtttcactggtatttgcat

SEQ ID NO: 1029300 - DNA, 22 bp, Artificial Sequence
  chemically synthesized
ataagttttgacatatgcaaat

SEQ ID NO: 1029301 - DNA, 22 bp, Artificial Sequence
  chemically synthesized
gataagttttgacatatgcaaa

SEQ ID NO: 1029302 - DNA, 22 bp, Artificial Sequence
  chemically synthesized
cactggtatttgcatatgtcaa

SEQ ID NO: 1029303 - DNA, 22 bp, Artificial Sequence
  chemically synthesized
actggtatttgcatatgtcaaa

SEQ ID NO: 1029304 - DNA, 22 bp, Artificial Sequence
  chemically synthesized
gtatttgcatatgtcaaaactt

SEQ ID NO: 1029305 - DNA, 22 bp, Artificial Sequence
  chemically synthesized
aatagtacaatttgataagttt

SEQ ID NO: 1029306 - DNA, 22 bp, Artificial Sequence
  chemically synthesized
aaatagtacaatttgataagtt

SEQ ID NO: 1029307 - DNA, 22 bp, Artificial Sequence
  chemically synthesized
gcatatgtcaaaacttatcaaa

SEQ ID NO: 1029308 - DNA, 22 bp, Artificial Sequence
  chemically synthesized
catatgtcaaaacttatcaaat

SEQ ID NO: 1029309 - DNA, 22 bp, Artificial Sequence
  chemically synthesized
cacatttaaatagtacaatttg

SEQ ID NO: 1029310 - DNA, 22 bp, Artificial Sequence
  chemically synthesized
atcaaattgtactatttaaatg

SEQ ID NO: 1029311 - DNA, 22 bp, Artificial Sequence
  chemically synthesized
tcaaattgtactatttaaatgt

SEQ ID NO: 1029312 - DNA, 22 bp, Artificial Sequence
  chemically synthesized
tactatttaaatgtgtagctta

SEQ ID NO: 1029313 - DNA, 22 bp, Artificial Sequence
  chemically synthesized
tttaaatgtgtagcttattgta

SEQ ID NO: 1029314 - DNA, 22 bp, Artificial Sequence
  chemically synthesized
tggtataaatgatatacaataa

SEQ ID NO: 1029315 - DNA, 22 bp, Artificial Sequence
  chemically synthesized
aaatgtgtagcttattgtatat

SEQ ID NO: 1029316 - DNA, 22 bp, Artificial Sequence
  chemically synthesized
aatgtgtagcttattgtatatc

SEQ ID NO: 1029317 - DNA, 22 bp, Artificial Sequence
  chemically synthesized
attgtggtataaatgatataca

SEQ ID NO: 1029318 - DNA, 22 bp, Artificial Sequence
  chemically synthesized
cattgtggtataaatgatatac

SEQ ID NO: 1029319 - DNA, 22 bp, Artificial Sequence
  chemically synthesized
attgtatatcatttataccaca

SEQ ID NO: 1029320 - DNA, 22 bp, Artificial Sequence
  chemically synthesized
ttgtatatcatttataccacaa

SEQ ID NO: 1029321 - DNA, 22 bp, Artificial Sequence
  chemically synthesized
gaaacaatttcattgtggtata

SEQ ID NO: 1029322 - DNA, 22 bp, Artificial Sequence
  chemically synthesized
ggaaacaatttcattgtggtat

SEQ ID NO: 1029323 - DNA, 22 bp, Artificial Sequence
  chemically synthesized
tggaaacaatttcattgtggta

SEQ ID NO: 1029324 - DNA, 22 bp, Artificial Sequence
  chemically synthesized
tatatcatttataccacaatga

SEQ ID NO: 1029325 - DNA, 22 bp, Artificial Sequence
  chemically synthesized
ttggaaacaatttcattgtggt

SEQ ID NO: 1029326 - DNA, 22 bp, Artificial Sequence
  chemically synthesized
tttggaaacaatttcattgtgg

SEQ ID NO: 1029327 - DNA, 22 bp, Artificial Sequence
  chemically synthesized
gtcctttttggaaacaatttca

SEQ ID NO: 1029328 - DNA, 22 bp, Artificial Sequence
  chemically synthesized
ataccacaatgaaattgtttcc

SEQ ID NO: 1029329 - DNA, 22 bp, Artificial Sequence
  chemically synthesized
taccacaatgaaattgtttcca

SEQ ID NO: 1029330 - DNA, 22 bp, Artificial Sequence
  chemically synthesized
gccaagctagtcctttttggaa

SEQ ID NO: 1029331 - DNA, 22 bp, Artificial Sequence
  chemically synthesized
tttccaaaaaggactagcttgg

SEQ ID NO: 1029332 - DNA, 22 bp, Artificial Sequence
  chemically synthesized
ggtagtgtattggccaagctag

SEQ ID NO: 1029333 - DNA, 22 bp, Artificial Sequence
  chemically synthesized
aggtagtgtattggccaagcta

SEQ ID NO: 1029334 - DNA, 22 bp, Artificial Sequence
  chemically synthesized
ccaaaaaggactagcttggcca

SEQ ID NO: 1029335 - DNA, 22 bp, Artificial Sequence
  chemically synthesized
caaaaaggactagcttggccaa

SEQ ID NO: 1029336 - DNA, 22 bp, Artificial Sequence
  chemically synthesized
gtaatgcatttaggtagtgtat

SEQ ID NO: 1029337 - DNA, 22 bp, Artificial Sequence
  chemically synthesized
gcttggccaatacactacctaa

SEQ ID NO: 1029338 - DNA, 22 bp, Artificial Sequence
  chemically synthesized
ggccaatacactacctaaatgc

SEQ ID NO: 1029339 - DNA, 22 bp, Artificial Sequence
  chemically synthesized
gccaatacactacctaaatgca

SEQ ID NO: 1029340 - DNA, 22 bp, Artificial Sequence
  chemically synthesized
tatacctagtaatgcatttagg

SEQ ID NO: 1029341 - DNA, 22 bp, Artificial Sequence
  chemically synthesized
gtatacctagtaatgcatttag

SEQ ID NO: 1029342 - DNA, 22 bp, Artificial Sequence
  chemically synthesized
agtaaaacttgtatacctagta

SEQ ID NO: 1029343 - DNA, 22 bp, Artificial Sequence
  chemically synthesized
cctaaatgcattactaggtata

SEQ ID NO: 1029344 - DNA, 22 bp, Artificial Sequence
  chemically synthesized
aagtaaaacttgtatacctagt

SEQ ID NO: 1029345 - DNA, 22 bp, Artificial Sequence
  chemically synthesized
taagtaaaacttgtatacctag

SEQ ID NO: 1029346 - DNA, 22 bp, Artificial Sequence
  chemically synthesized
ttaagtaaaacttgtataccta

SEQ ID NO: 1029347 - DNA, 22 bp, Artificial Sequence
  chemically synthesized
aatgcattactaggtatacaag

SEQ ID NO: 1029348 - DNA, 22 bp, Artificial Sequence
  chemically synthesized
tttttaagtaaaacttgtatac

SEQ ID NO: 1029349 - DNA, 22 bp, Artificial Sequence
  chemically synthesized
ctaggtatacaagttttactta

SEQ ID NO: 1029350 - DNA, 22 bp, Artificial Sequence
  chemically synthesized
ggtatacaagttttacttaaaa

SEQ ID NO: 1029351 - DNA, 22 bp, Artificial Sequence
  chemically synthesized
agacatatattgtttttaagta

SEQ ID NO: 1029352 - DNA, 22 bp, Artificial Sequence
  chemically synthesized
ttgagacatatattgtttttaa

SEQ ID NO: 1029353 - DNA, 22 bp, Artificial Sequence
  chemically synthesized
attgagacatatattgttttta

SEQ ID NO: 1029354 - DNA, 22 bp, Artificial Sequence
  chemically synthesized
tacttattgagacatatattgt

SEQ ID NO: 1029355 - DNA, 22 bp, Artificial Sequence
  chemically synthesized
atacttattgagacatatattg

SEQ ID NO: 1029356 - DNA, 22 bp, Artificial Sequence
  chemically synthesized
tatacttattgagacatatatt

SEQ ID NO: 1029357 - DNA, 22 bp, Artificial Sequence
  chemically synthesized
tacttaaaaacaatatatgtct

SEQ ID NO: 1029358 - DNA, 22 bp, Artificial Sequence
  chemically synthesized
acttaaaaacaatatatgtctc

SEQ ID NO: 1029359 - DNA, 22 bp, Artificial Sequence
  chemically synthesized
cttaaaaacaatatatgtctca

SEQ ID NO: 1029360 - DNA, 22 bp, Artificial Sequence
  chemically synthesized
aaaaacaatatatgtctcaata

SEQ ID NO: 1029361 - DNA, 22 bp, Artificial Sequence
  chemically synthesized
aaaacaatatatgtctcaataa

SEQ ID NO: 1029362 - DNA, 22 bp, Artificial Sequence
  chemically synthesized
cggtaatctttatacttattga

SEQ ID NO: 1029363 - DNA, 22 bp, Artificial Sequence
  chemically synthesized
gctacggtaatctttatactta

SEQ ID NO: 1029364 - DNA, 22 bp, Artificial Sequence
  chemically synthesized
aataagtataaagattaccgta

SEQ ID NO: 1029365 - DNA, 22 bp, Artificial Sequence
  chemically synthesized
ggtggcacaccacagtgttcgc

SEQ ID NO: 1029366 - DNA, 22 bp, Artificial Sequence
  chemically synthesized
ccgtagcgaacactgtggtgtg

SEQ ID NO: 1029367 - DNA, 22 bp, Artificial Sequence
  chemically synthesized
gtgaatctcggtggcacaccac

SEQ ID NO: 1029368 - DNA, 22 bp, Artificial Sequence
  chemically synthesized
taattggtgaatctcggtggca

SEQ ID NO: 1029369 - DNA, 22 bp, Artificial Sequence
  chemically synthesized
gtaattggtgaatctcggtggc

SEQ ID NO: 1029370 - DNA, 22 bp, Artificial Sequence
  chemically synthesized
atttgtaattggtgaatctcgg

SEQ ID NO: 1029371 - DNA, 22 bp, Artificial Sequence
  chemically synthesized
catttgtaattggtgaatctcg

SEQ ID NO: 1029372 - DNA, 22 bp, Artificial Sequence
  chemically synthesized
tggtgtgccaccgagattcacc

SEQ ID NO: 1029373 - DNA, 22 bp, Artificial Sequence
  chemically synthesized
ggagaatgaatgcttcatttgt

SEQ ID NO: 1029374 - DNA, 22 bp, Artificial Sequence
  chemically synthesized
accaattacaaatgaagcattc

SEQ ID NO: 1029375 - DNA, 22 bp, Artificial Sequence
  chemically synthesized
caaatgaagcattcattctccc

SEQ ID NO: 1029376 - DNA, 22 bp, Artificial Sequence
  chemically synthesized
gtagataacaatcccagcaact

SEQ ID NO: 1029377 - DNA, 22 bp, Artificial Sequence
  chemically synthesized
ttagtagataacaatcccagca

SEQ ID NO: 1029378 - DNA, 22 bp, Artificial Sequence
  chemically synthesized
attctcccagttgctgggattg

SEQ ID NO: 1029379 - DNA, 22 bp, Artificial Sequence
  chemically synthesized
tcccagttgctgggattgttat

SEQ ID NO: 1029380 - DNA, 22 bp, Artificial Sequence
  chemically synthesized
ccagttgctgggattgttatct

SEQ ID NO: 1029381 - DNA, 22 bp, Artificial Sequence
  chemically synthesized
ggtatgatctgttagtagataa

SEQ ID NO: 1029382 - DNA, 22 bp, Artificial Sequence
  chemically synthesized
aggtatgatctgttagtagata

SEQ ID NO: 1029383 - DNA, 22 bp, Artificial Sequence
  chemically synthesized
ctgggattgttatctactaaca

SEQ ID NO: 1029384 - DNA, 22 bp, Artificial Sequence
  chemically synthesized
ggattgttatctactaacagat

SEQ ID NO: 1029385 - DNA, 22 bp, Artificial Sequence
  chemically synthesized
gaagagcttaggtatgatctgt

SEQ ID NO: 1029386 - DNA, 22 bp, Artificial Sequence
  chemically synthesized
ggaagagcttaggtatgatctg

SEQ ID NO: 1029387 - DNA, 22 bp, Artificial Sequence
  chemically synthesized
ttatctactaacagatcatacc

SEQ ID NO: 1029388 - DNA, 22 bp, Artificial Sequence
  chemically synthesized
ttggaagagcttaggtatgatc

SEQ ID NO: 1029389 - DNA, 22 bp, Artificial Sequence
  chemically synthesized
cttggaagagcttaggtatgat

SEQ ID NO: 1029390 - DNA, 22 bp, Artificial Sequence
  chemically synthesized
tctactaacagatcatacctaa

SEQ ID NO: 1029391 - DNA, 22 bp, Artificial Sequence
  chemically synthesized
ctaacagatcatacctaagctc

SEQ ID NO: 1029392 - DNA, 22 bp, Artificial Sequence
  chemically synthesized
acagatcatacctaagctcttc

SEQ ID NO: 1029393 - DNA, 22 bp, Artificial Sequence
  chemically synthesized
agagaaatttcttggaagagct

SEQ ID NO: 1029394 - DNA, 22 bp, Artificial Sequence
  chemically synthesized
ctgagagaaatttcttggaaga

SEQ ID NO: 1029395 - DNA, 22 bp, Artificial Sequence
  chemically synthesized
tctgctgagagaaatttcttgg

SEQ ID NO: 1029396 - DNA, 22 bp, Artificial Sequence
  chemically synthesized
agctcttccaagaaatttctct

SEQ ID NO: 1029397 - DNA, 22 bp, Artificial Sequence
  chemically synthesized
ttccaagaaatttctctcagca

SEQ ID NO: 1029398 - DNA, 22 bp, Artificial Sequence
  chemically synthesized
ccaagaaatttctctcagcaga

SEQ ID NO: 1029399 - DNA, 22 bp, Artificial Sequence
  chemically synthesized
caagaaatttctctcagcagac

SEQ ID NO: 1029400 - DNA, 22 bp, Artificial Sequence
  chemically synthesized
gtcaaagaagtgcctgtctgct

SEQ ID NO: 1029401 - DNA, 22 bp, Artificial Sequence
  chemically synthesized
ggtcaaagaagtgcctgtctgc

SEQ ID NO: 1029402 - DNA, 22 bp, Artificial Sequence
  chemically synthesized
ctctcagcagacaggcacttct

SEQ ID NO: 1029403 - DNA, 22 bp, Artificial Sequence
  chemically synthesized
tctcagcagacaggcacttctt

SEQ ID NO: 1029404 - DNA, 22 bp, Artificial Sequence
  chemically synthesized
tcagcagacaggcacttctttg

SEQ ID NO: 1029405 - DNA, 22 bp, Artificial Sequence
  chemically synthesized
agcagacaggcacttctttgac

SEQ ID NO: 1029406 - DNA, 22 bp, Artificial Sequence
  chemically synthesized
cgggcaatatcatcttggtcaa

SEQ ID NO: 1029407 - DNA, 22 bp, Artificial Sequence
  chemically synthesized
ccgggcaatatcatcttggtca

SEQ ID NO: 1029408 - DNA, 22 bp, Artificial Sequence
  chemically synthesized
ccagcttccgggcaatatcatc

SEQ ID NO: 1029409 - DNA, 22 bp, Artificial Sequence
  chemically synthesized
ctttgaccaagatgatattgcc

SEQ ID NO: 1029410 - DNA, 22 bp, Artificial Sequence
  chemically synthesized
tttgaccaagatgatattgccc

SEQ ID NO: 1029411 - DNA, 22 bp, Artificial Sequence
  chemically synthesized
tgaccaagatgatattgcccgg

SEQ ID NO: 1029412 - DNA, 22 bp, Artificial Sequence
  chemically synthesized
gaccaagatgatattgcccgga

SEQ ID NO: 1029413 - DNA, 22 bp, Artificial Sequence
  chemically synthesized
accaagatgatattgcccggaa

SEQ ID NO: 1029414 - DNA, 22 bp, Artificial Sequence
  chemically synthesized
ccaactaccagcttccgggcaa

SEQ ID NO: 1029415 - DNA, 22 bp, Artificial Sequence
  chemically synthesized
gatgtgagcctcccaactacca

SEQ ID NO: 1029416 - DNA, 22 bp, Artificial Sequence
  chemically synthesized
cccggaagctggtagttgggag

SEQ ID NO: 1029417 - DNA, 22 bp, Artificial Sequence
  chemically synthesized
gtcattagatgtgagcctccca

SEQ ID NO: 1029418 - DNA, 22 bp, Artificial Sequence
  chemically synthesized
gtagttgggaggctcacatcta

SEQ ID NO: 1029419 - DNA, 22 bp, Artificial Sequence
  chemically synthesized
atccattagtcattagatgtga

SEQ ID NO: 1029420 - DNA, 22 bp, Artificial Sequence
  chemically synthesized
ggaggctcacatctaatgacta

SEQ ID NO: 1029421 - DNA, 22 bp, Artificial Sequence
  chemically synthesized
tatccctaatccattagtcatt

SEQ ID NO: 1029422 - DNA, 22 bp, Artificial Sequence
  chemically synthesized
acatctaatgactaatggatta

SEQ ID NO: 1029423 - DNA, 22 bp, Artificial Sequence
  chemically synthesized
atgactaatggattagggatac

SEQ ID NO: 1029424 - DNA, 22 bp, Artificial Sequence
  chemically synthesized
atggattagggatacaatggtc

SEQ ID NO: 1029425 - DNA, 22 bp, Artificial Sequence
  chemically synthesized
gggatacaatggtccaccttcc

SEQ ID NO: 1029426 - DNA, 22 bp, Artificial Sequence
  chemically synthesized
ccgtatgaagcaaggaaggtgg

SEQ ID NO: 1029427 - DNA, 22 bp, Artificial Sequence
  chemically synthesized
gagtattaccgtatgaagcaag

SEQ ID NO: 1029428 - DNA, 22 bp, Artificial Sequence
  chemically synthesized
agagtattaccgtatgaagcaa

SEQ ID NO: 1029429 - DNA, 22 bp, Artificial Sequence
  chemically synthesized
ccttgcttcatacggtaatact

SEQ ID NO: 1029430 - DNA, 22 bp, Artificial Sequence
  chemically synthesized
cttgcttcatacggtaatactc

SEQ ID NO: 1029431 - DNA, 22 bp, Artificial Sequence
  chemically synthesized
ggatgaccatttagagtattac

SEQ ID NO: 1029432 - DNA, 22 bp, Artificial Sequence
  chemically synthesized
gcttcatacggtaatactctaa

SEQ ID NO: 1029433 - DNA, 22 bp, Artificial Sequence
  chemically synthesized
cttcatacggtaatactctaaa

SEQ ID NO: 1029434 - DNA, 22 bp, Artificial Sequence
  chemically synthesized
catacggtaatactctaaatgg

SEQ ID NO: 1029435 - DNA, 22 bp, Artificial Sequence
  chemically synthesized
atacggtaatactctaaatggt

SEQ ID NO: 1029436 - DNA, 22 bp, Artificial Sequence
  chemically synthesized
gtcccatgtggggttgggatga

SEQ ID NO: 1029437 - DNA, 22 bp, Artificial Sequence
  chemically synthesized
tctggtcccatgtggggttggg

SEQ ID NO: 1029438 - DNA, 22 bp, Artificial Sequence
  chemically synthesized
taaatggtcatcccaaccccac

SEQ ID NO: 1029439 - DNA, 22 bp, Artificial Sequence
  chemically synthesized
atctggtcccatgtggggttgg

SEQ ID NO: 1029440 - DNA, 22 bp, Artificial Sequence
  chemically synthesized
aatggtcatcccaaccccacat

SEQ ID NO: 1029441 - DNA, 22 bp, Artificial Sequence
  chemically synthesized
aatgatgatgcagtgaaatgga

SEQ ID NO: 1029442 - DNA, 22 bp, Artificial Sequence
  chemically synthesized
ccatttcactgcatcatcattc

SEQ ID NO: 1029443 - DNA, 22 bp, Artificial Sequence
  chemically synthesized
catttcactgcatcatcattca

SEQ ID NO: 1029444 - DNA, 22 bp, Artificial Sequence
  chemically synthesized
aggagagagaggagttgaatga

SEQ ID NO: 1029445 - DNA, 22 bp, Artificial Sequence
  chemically synthesized
cactgcatcatcattcaactcc

SEQ ID NO: 1029446 - DNA, 22 bp, Artificial Sequence
  chemically synthesized
actgcatcatcattcaactcct

SEQ ID NO: 1029447 - DNA, 22 bp, Artificial Sequence
  chemically synthesized
catcatcattcaactcctctct

SEQ ID NO: 1029448 - DNA, 22 bp, Artificial Sequence
  chemically synthesized
aactcctctctctcctcaatcc

SEQ ID NO: 1029449 - DNA, 22 bp, Artificial Sequence
  chemically synthesized
ctctctctcctcaatcctgctg

SEQ ID NO: 1029450 - DNA, 22 bp, Artificial Sequence
  chemically synthesized
ggagggagtaaaggcagcagga

SEQ ID NO: 1029451 - DNA, 22 bp, Artificial Sequence
  chemically synthesized
tctctcctcaatcctgctgcct

SEQ ID NO: 1029452 - DNA, 22 bp, Artificial Sequence
  chemically synthesized
tctcctcaatcctgctgccttt

SEQ ID NO: 1029453 - DNA, 22 bp, Artificial Sequence
  chemically synthesized
tcctcaatcctgctgcctttac

SEQ ID NO: 1029454 - DNA, 22 bp, Artificial Sequence
  chemically synthesized
ctcaatcctgctgcctttactc

SEQ ID NO: 1029455 - DNA, 22 bp, Artificial Sequence
  chemically synthesized
aatcctgctgcctttactccct

SEQ ID NO: 1029456 - DNA, 22 bp, Artificial Sequence
  chemically synthesized
agaaaaatgcctgggagggagt

SEQ ID NO: 1029457 - DNA, 22 bp, Artificial Sequence
  chemically synthesized
aagaaaaatgcctgggagggag

SEQ ID NO: 1029458 - DNA, 22 bp, Artificial Sequence
  chemically synthesized
taagaaaaatgcctgggaggga

SEQ ID NO: 1029459 - DNA, 22 bp, Artificial Sequence
  chemically synthesized
ttaagaaaaatgcctgggaggg

SEQ ID NO: 1029460 - DNA, 22 bp, Artificial Sequence
  chemically synthesized
ctgcctttactccctcccaggc

SEQ ID NO: 1029461 - DNA, 22 bp, Artificial Sequence
  chemically synthesized
cctttactccctcccaggcatt

SEQ ID NO: 1029462 - DNA, 22 bp, Artificial Sequence
  chemically synthesized
tactccctcccaggcatttttc

SEQ ID NO: 1029463 - DNA, 22 bp, Artificial Sequence
  chemically synthesized
actccctcccaggcatttttct

SEQ ID NO: 1029464 - DNA, 22 bp, Artificial Sequence
  chemically synthesized
ctccctcccaggcatttttctt

SEQ ID NO: 1029465 - DNA, 22 bp, Artificial Sequence
  chemically synthesized
gtgagtgcttttaagaaaaatg

SEQ ID NO: 1029466 - DNA, 22 bp, Artificial Sequence
  chemically synthesized
agtgagtgcttttaagaaaaat

SEQ ID NO: 1029467 - DNA, 22 bp, Artificial Sequence
  chemically synthesized
cctcccaggcatttttcttaaa

SEQ ID NO: 1029468 - DNA, 22 bp, Artificial Sequence
  chemically synthesized
ttagtgagtgcttttaagaaaa

SEQ ID NO: 1029469 - DNA, 22 bp, Artificial Sequence
  chemically synthesized
cttagtgagtgcttttaagaaa

SEQ ID NO: 1029470 - DNA, 22 bp, Artificial Sequence
  chemically synthesized
ccaggcatttttcttaaaagca

SEQ ID NO: 1029471 - DNA, 22 bp, Artificial Sequence
  chemically synthesized
ttcttaaaagcactcactaaga

SEQ ID NO: 1029472 - DNA, 22 bp, Artificial Sequence
  chemically synthesized
tcttaaaagcactcactaagaa

SEQ ID NO: 1029473 - DNA, 22 bp, Artificial Sequence
  chemically synthesized
catgcagatggtttcttagtga

SEQ ID NO: 1029474 - DNA, 22 bp, Artificial Sequence
  chemically synthesized
cttaaaagcactcactaagaaa

SEQ ID NO: 1029475 - DNA, 22 bp, Artificial Sequence
  chemically synthesized
ccatgcagatggtttcttagtg

SEQ ID NO: 1029476 - DNA, 22 bp, Artificial Sequence
  chemically synthesized
ttaaaagcactcactaagaaac

SEQ ID NO: 1029477 - DNA, 22 bp, Artificial Sequence
  chemically synthesized
aaaagcactcactaagaaacca

SEQ ID NO: 1029478 - DNA, 22 bp, Artificial Sequence
  chemically synthesized
aaagcactcactaagaaaccat

SEQ ID NO: 1029479 - DNA, 22 bp, Artificial Sequence
  chemically synthesized
agacagagatttccatgcagat

SEQ ID NO: 1029480 - DNA, 22 bp, Artificial Sequence
  chemically synthesized
actaagaaaccatctgcatgga

SEQ ID NO: 1029481 - DNA, 22 bp, Artificial Sequence
  chemically synthesized
taagacagagatttccatgcag

SEQ ID NO: 1029482 - DNA, 22 bp, Artificial Sequence
  chemically synthesized
agaaaccatctgcatggaaatc

SEQ ID NO: 1029483 - DNA, 22 bp, Artificial Sequence
  chemically synthesized
agacatagactctaagacagag

SEQ ID NO: 1029484 - DNA, 22 bp, Artificial Sequence
  chemically synthesized
taagacatagactctaagacag

SEQ ID NO: 1029485 - DNA, 22 bp, Artificial Sequence
  chemically synthesized
catggaaatctctgtcttagag

SEQ ID NO: 1029486 - DNA, 22 bp, Artificial Sequence
  chemically synthesized
ctaagacatagactctaagaca

SEQ ID NO: 1029487 - DNA, 22 bp, Artificial Sequence
  chemically synthesized
tctaagacatagactctaagac

SEQ ID NO: 1029488 - DNA, 22 bp, Artificial Sequence
  chemically synthesized
gattttctaagacatagactct

SEQ ID NO: 1029489 - DNA, 22 bp, Artificial Sequence
  chemically synthesized
gattggattttctaagacatag

SEQ ID NO: 1029490 - DNA, 22 bp, Artificial Sequence
  chemically synthesized
tgtcttagagtctatgtcttag

SEQ ID NO: 1029491 - DNA, 22 bp, Artificial Sequence
  chemically synthesized
agattggattttctaagacata

SEQ ID NO: 1029492 - DNA, 22 bp, Artificial Sequence
  chemically synthesized
tcttagagtctatgtcttagaa

SEQ ID NO: 1029493 - DNA, 22 bp, Artificial Sequence
  chemically synthesized
tcttagattggattttctaaga

SEQ ID NO: 1029494 - DNA, 22 bp, Artificial Sequence
  chemically synthesized
agagtctatgtcttagaaaatc

SEQ ID NO: 1029495 - DNA, 22 bp, Artificial Sequence
  chemically synthesized
gagtctatgtcttagaaaatcc

SEQ ID NO: 1029496 - DNA, 22 bp, Artificial Sequence
  chemically synthesized
ttatcttagattggattttcta

SEQ ID NO: 1029497 - DNA, 22 bp, Artificial Sequence
  chemically synthesized
ggttgttatcttagattggatt

SEQ ID NO: 1029498 - DNA, 22 bp, Artificial Sequence
  chemically synthesized
tgtcttagaaaatccaatctaa

SEQ ID NO: 1029499 - DNA, 22 bp, Artificial Sequence
  chemically synthesized
agaaaatccaatctaagataac

SEQ ID NO: 1029500 - DNA, 22 bp, Artificial Sequence
  chemically synthesized
gaaaatccaatctaagataaca

SEQ ID NO: 1029501 - DNA, 22 bp, Artificial Sequence
  chemically synthesized
aacatattaggttgttatctta

SEQ ID NO: 1029502 - DNA, 22 bp, Artificial Sequence
  chemically synthesized
tcaacatattaggttgttatct

SEQ ID NO: 1029503 - DNA, 22 bp, Artificial Sequence
  chemically synthesized
ctcaacatattaggttgttatc

SEQ ID NO: 1029504 - DNA, 22 bp, Artificial Sequence
  chemically synthesized
acttctcaacatattaggttgt

SEQ ID NO: 1029505 - DNA, 22 bp, Artificial Sequence
  chemically synthesized
aacttctcaacatattaggttg

SEQ ID NO: 1029506 - DNA, 22 bp, Artificial Sequence
  chemically synthesized
taacttctcaacatattaggtt

SEQ ID NO: 1029507 - DNA, 22 bp, Artificial Sequence
  chemically synthesized
agataacaacctaatatgttga

SEQ ID NO: 1029508 - DNA, 22 bp, Artificial Sequence
  chemically synthesized
cattttaacttctcaacatatt

SEQ ID NO: 1029509 - DNA, 22 bp, Artificial Sequence
  chemically synthesized
tacattttaacttctcaacata

SEQ ID NO: 1029510 - DNA, 22 bp, Artificial Sequence
  chemically synthesized
ctacattttaacttctcaacat

SEQ ID NO: 1029511 - DNA, 22 bp, Artificial Sequence
  chemically synthesized
tctacattttaacttctcaaca

SEQ ID NO: 1029512 - DNA, 22 bp, Artificial Sequence
  chemically synthesized
ttttctacattttaacttctca

SEQ ID NO: 1029513 - DNA, 22 bp, Artificial Sequence
  chemically synthesized
tgttttctacattttaacttct

SEQ ID NO: 1029514 - DNA, 22 bp, Artificial Sequence
  chemically synthesized
ctgttttctacattttaacttc

SEQ ID NO: 1029515 - DNA, 22 bp, Artificial Sequence
  chemically synthesized
atatgttgagaagttaaaatgt

SEQ ID NO: 1029516 - DNA, 22 bp, Artificial Sequence
  chemically synthesized
agaagttaaaatgtagaaaaca

SEQ ID NO: 1029517 - DNA, 22 bp, Artificial Sequence
  chemically synthesized
agatatgtatttctgttttcta

SEQ ID NO: 1029518 - DNA, 22 bp, Artificial Sequence
  chemically synthesized
cagatatgtatttctgttttct

SEQ ID NO: 1029519 - DNA, 22 bp, Artificial Sequence
  chemically synthesized
cttcagatatgtatttctgttt

SEQ ID NO: 1029520 - DNA, 22 bp, Artificial Sequence
  chemically synthesized
aaatgtagaaaacagaaataca

SEQ ID NO: 1029521 - DNA, 22 bp, Artificial Sequence
  chemically synthesized
aatgattacttcagatatgtat

SEQ ID NO: 1029522 - DNA, 22 bp, Artificial Sequence
  chemically synthesized
aaatgattacttcagatatgta

SEQ ID NO: 1029523 - DNA, 22 bp, Artificial Sequence
  chemically synthesized
tttaaatgattacttcagatat

SEQ ID NO: 1029524 - DNA, 22 bp, Artificial Sequence
  chemically synthesized
ataatgttatttaaatgattac

SEQ ID NO: 1029525 - DNA, 22 bp, Artificial Sequence
  chemically synthesized
cataatgttatttaaatgatta

SEQ ID NO: 1029526 - DNA, 22 bp, Artificial Sequence
  chemically synthesized
tcataatgttatttaaatgatt

SEQ ID NO: 1029527 - DNA, 22 bp, Artificial Sequence
  chemically synthesized
aagtaatcatttaaataacatt

SEQ ID NO: 1029528 - DNA, 22 bp, Artificial Sequence
  chemically synthesized
atgtacattttcataatgttat

SEQ ID NO: 1029529 - DNA, 22 bp, Artificial Sequence
  chemically synthesized
taaatactgatgtacattttca

SEQ ID NO: 1029530 - DNA, 22 bp, Artificial Sequence
  chemically synthesized
aaataacattatgaaaatgtac

SEQ ID NO: 1029531 - DNA, 22 bp, Artificial Sequence
  chemically synthesized
ataaatactgatgtacattttc

SEQ ID NO: 1029532 - DNA, 22 bp, Artificial Sequence
  chemically synthesized
aataacattatgaaaatgtaca

SEQ ID NO: 1029533 - DNA, 22 bp, Artificial Sequence
  chemically synthesized
tttataaatactgatgtacatt

SEQ ID NO: 1029534 - DNA, 22 bp, Artificial Sequence
  chemically synthesized
tgaaaatgtacatcagtattta

SEQ ID NO: 1029535 - DNA, 22 bp, Artificial Sequence
  chemically synthesized
tatataatggctatttataaat

SEQ ID NO: 1029536 - DNA, 22 bp, Artificial Sequence
  chemically synthesized
tatcattgtatataatggctat

SEQ ID NO: 1029537 - DNA, 22 bp, Artificial Sequence
  chemically synthesized
ataaatagccattatatacaat

SEQ ID NO: 1029538 - DNA, 22 bp, Artificial Sequence
  chemically synthesized
taaatagccattatatacaatg

SEQ ID NO: 1029539 - DNA, 22 bp, Artificial Sequence
  chemically synthesized
aagaaatgataaacaaaattgt

SEQ ID NO: 1029540 - DNA, 22 bp, Artificial Sequence
  chemically synthesized
tatacaatgatacaattttgtt

SEQ ID NO: 1029541 - DNA, 22 bp, Artificial Sequence
  chemically synthesized
gcagtaagttgaagaaatgata

SEQ ID NO: 1029542 - DNA, 22 bp, Artificial Sequence
  chemically synthesized
aaatctagcagtaagttgaaga

SEQ ID NO: 1029543 - DNA, 22 bp, Artificial Sequence
  chemically synthesized
tgtttatcatttcttcaactta

SEQ ID NO: 1029544 - DNA, 22 bp, Artificial Sequence
  chemically synthesized
gtttatcatttcttcaacttac

SEQ ID NO: 1029545 - DNA, 22 bp, Artificial Sequence
  chemically synthesized
tttatcatttcttcaacttact

SEQ ID NO: 1029546 - DNA, 22 bp, Artificial Sequence
  chemically synthesized
cctgaaatctagcagtaagttg

SEQ ID NO: 1029547 - DNA, 22 bp, Artificial Sequence
  chemically synthesized
ccctgaaatctagcagtaagtt

SEQ ID NO: 1029548 - DNA, 22 bp, Artificial Sequence
  chemically synthesized
atcatttcttcaacttactgct

SEQ ID NO: 1029549 - DNA, 22 bp, Artificial Sequence
  chemically synthesized
tccctgaaatctagcagtaagt

SEQ ID NO: 1029550 - DNA, 22 bp, Artificial Sequence
  chemically synthesized
tcatttcttcaacttactgcta

SEQ ID NO: 1029551 - DNA, 22 bp, Artificial Sequence
  chemically synthesized
ttccctgaaatctagcagtaag

SEQ ID NO: 1029552 - DNA, 22 bp, Artificial Sequence
  chemically synthesized
tatttttccctgaaatctagca

SEQ ID NO: 1029553 - DNA, 22 bp, Artificial Sequence
  chemically synthesized
cttcaacttactgctagatttc

SEQ ID NO: 1029554 - DNA, 22 bp, Artificial Sequence
  chemically synthesized
ttcaacttactgctagatttca

SEQ ID NO: 1029555 - DNA, 22 bp, Artificial Sequence
  chemically synthesized
caacttactgctagatttcagg

SEQ ID NO: 1029556 - DNA, 22 bp, Artificial Sequence
  chemically synthesized
aacttactgctagatttcaggg

SEQ ID NO: 1029557 - DNA, 22 bp, Artificial Sequence
  chemically synthesized
tatcctgtatttttccctgaaa

SEQ ID NO: 1029558 - DNA, 22 bp, Artificial Sequence
  chemically synthesized
gtatcctgtatttttccctgaa

SEQ ID NO: 1029559 - DNA, 22 bp, Artificial Sequence
  chemically synthesized
actgctagatttcagggaaaaa

SEQ ID NO: 1029560 - DNA, 22 bp, Artificial Sequence
  chemically synthesized
ctgctagatttcagggaaaaat

SEQ ID NO: 1029561 - DNA, 22 bp, Artificial Sequence
  chemically synthesized
ctagatttcagggaaaaataca

SEQ ID NO: 1029562 - DNA, 22 bp, Artificial Sequence
  chemically synthesized
agtacttgtatcctgtattttt

SEQ ID NO: 1029563 - DNA, 22 bp, Artificial Sequence
  chemically synthesized
aagtacttgtatcctgtatttt

SEQ ID NO: 1029564 - DNA, 22 bp, Artificial Sequence
  chemically synthesized
gatttcagggaaaaatacagga

SEQ ID NO: 1029565 - DNA, 22 bp, Artificial Sequence
  chemically synthesized
taagtacttgtatcctgtattt

SEQ ID NO: 1029566 - DNA, 22 bp, Artificial Sequence
  chemically synthesized
tttaagtacttgtatcctgtat

SEQ ID NO: 1029567 - DNA, 22 bp, Artificial Sequence
  chemically synthesized
ctttaagtacttgtatcctgta

SEQ ID NO: 1029568 - DNA, 22 bp, Artificial Sequence
  chemically synthesized
tctttaagtacttgtatcctgt

SEQ ID NO: 1029569 - DNA, 22 bp, Artificial Sequence
  chemically synthesized
cagggaaaaatacaggatacaa

SEQ ID NO: 1029570 - DNA, 22 bp, Artificial Sequence
  chemically synthesized
agggaaaaatacaggatacaag

SEQ ID NO: 1029571 - DNA, 22 bp, Artificial Sequence
  chemically synthesized
agctttctttaagtacttgtat

SEQ ID NO: 1029572 - DNA, 22 bp, Artificial Sequence
  chemically synthesized
gagctttctttaagtacttgta

SEQ ID NO: 1029573 - DNA, 22 bp, Artificial Sequence
  chemically synthesized
ttgagctttctttaagtacttg

SEQ ID NO: 1029574 - DNA, 22 bp, Artificial Sequence
  chemically synthesized
cttgagctttctttaagtactt

SEQ ID NO: 1029575 - DNA, 22 bp, Artificial Sequence
  chemically synthesized
cttcttgagctttctttaagta

SEQ ID NO: 1029576 - DNA, 22 bp, Artificial Sequence
  chemically synthesized
aaagaaagctcaagaaggagat

SEQ ID NO: 1029577 - DNA, 22 bp, Artificial Sequence
  chemically synthesized
aagaaagctcaagaaggagata

SEQ ID NO: 1029578 - DNA, 22 bp, Artificial Sequence
  chemically synthesized
tgcaatcagccatatctccttc

SEQ ID NO: 1029579 - DNA, 22 bp, Artificial Sequence
  chemically synthesized
ttatgcaatcagccatatctcc

SEQ ID NO: 1029580 - DNA, 22 bp, Artificial Sequence
  chemically synthesized
tattatgcaatcagccatatct

SEQ ID NO: 1029581 - DNA, 22 bp, Artificial Sequence
  chemically synthesized
aagaaggagatatggctgattg

SEQ ID NO: 1029582 - DNA, 22 bp, Artificial Sequence
  chemically synthesized
caaaatattctattatgcaatc

SEQ ID NO: 1029583 - DNA, 22 bp, Artificial Sequence
  chemically synthesized
acagtctgcaaaatattctatt

SEQ ID NO: 1029584 - DNA, 22 bp, Artificial Sequence
  chemically synthesized
attgcataatagaatattttgc

SEQ ID NO: 1029585 - DNA, 22 bp, Artificial Sequence
  chemically synthesized
aatagttgacagtctgcaaaat

SEQ ID NO: 1029586 - DNA, 22 bp, Artificial Sequence
  chemically synthesized
cataatagaatattttgcagac

SEQ ID NO: 1029587 - DNA, 22 bp, Artificial Sequence
  chemically synthesized
tgcagactgtcaactattgagg

SEQ ID NO: 1029588 - DNA, 22 bp, Artificial Sequence
  chemically synthesized
gcagactgtcaactattgagga

SEQ ID NO: 1029589 - DNA, 22 bp, Artificial Sequence
  chemically synthesized
cagactgtcaactattgaggac

SEQ ID NO: 1029590 - DNA, 22 bp, Artificial Sequence
  chemically synthesized
caaacatgccagcgtcctcaat

SEQ ID NO: 1029591 - DNA, 22 bp, Artificial Sequence
  chemically synthesized
ccaaacatgccagcgtcctcaa

SEQ ID NO: 1029592 - DNA, 22 bp, Artificial Sequence
  chemically synthesized
ttccaaacatgccagcgtcctc

SEQ ID NO: 1029593 - DNA, 22 bp, Artificial Sequence
  chemically synthesized
tcaactattgaggacgctggca

SEQ ID NO: 1029594 - DNA, 22 bp, Artificial Sequence
  chemically synthesized
ttcttccaaacatgccagcgtc

SEQ ID NO: 1029595 - DNA, 22 bp, Artificial Sequence
  chemically synthesized
ttgaggacgctggcatgtttgg

SEQ ID NO: 1029596 - DNA, 22 bp, Artificial Sequence
  chemically synthesized
aggacgctggcatgtttggaag

SEQ ID NO: 1029597 - DNA, 22 bp, Artificial Sequence
  chemically synthesized
ataacagttattcttccaaaca

SEQ ID NO: 1029598 - DNA, 22 bp, Artificial Sequence
  chemically synthesized
aataacagttattcttccaaac

SEQ ID NO: 1029599 - DNA, 22 bp, Artificial Sequence
  chemically synthesized
aaatttaataacagttattctt

SEQ ID NO: 1029600 - DNA, 22 bp, Artificial Sequence
  chemically synthesized
gcatgtttggaagaataactgt

SEQ ID NO: 1029601 - DNA, 22 bp, Artificial Sequence
  chemically synthesized
taaaatttaataacagttattc

SEQ ID NO: 1029602 - DNA, 22 bp, Artificial Sequence
  chemically synthesized
tgttctaaaatttaataacagt

SEQ ID NO: 1029603 - DNA, 22 bp, Artificial Sequence
  chemically synthesized
atgttctaaaatttaataacag

SEQ ID NO: 1029604 - DNA, 22 bp, Artificial Sequence
  chemically synthesized
tatgttctaaaatttaataaca

SEQ ID NO: 1029605 - DNA, 22 bp, Artificial Sequence
  chemically synthesized
ggaagaataactgttattaaat

SEQ ID NO: 1029606 - DNA, 22 bp, Artificial Sequence
  chemically synthesized
gaagaataactgttattaaatt

SEQ ID NO: 1029607 - DNA, 22 bp, Artificial Sequence
  chemically synthesized
tacctttatgttctaaaattta

SEQ ID NO: 1029608 - DNA, 22 bp, Artificial Sequence
  chemically synthesized
ttattaaattttagaacataaa

SEQ ID NO: 1029609 - DNA, 22 bp, Artificial Sequence
  chemically synthesized
ttaaattttagaacataaaggt

SEQ ID NO: 1029610 - DNA, 22 bp, Artificial Sequence
  chemically synthesized
aattttagaacataaaggtaca

SEQ ID NO: 1029611 - DNA, 22 bp, Artificial Sequence
  chemically synthesized
ataacaatatgttgtaccttta

SEQ ID NO: 1029612 - DNA, 22 bp, Artificial Sequence
  chemically synthesized
tagaacataaaggtacaacata

SEQ ID NO: 1029613 - DNA, 22 bp, Artificial Sequence
  chemically synthesized
agaacataaaggtacaacatat

SEQ ID NO: 1029614 - DNA, 22 bp, Artificial Sequence
  chemically synthesized
agattgataacaatatgttgta

SEQ ID NO: 1029615 - DNA, 22 bp, Artificial Sequence
  chemically synthesized
gaacataaaggtacaacatatt

SEQ ID NO: 1029616 - DNA, 22 bp, Artificial Sequence
  chemically synthesized
ttaagattgataacaatatgtt

SEQ ID NO: 1029617 - DNA, 22 bp, Artificial Sequence
  chemically synthesized
attaagattgataacaatatgt

SEQ ID NO: 1029618 - DNA, 22 bp, Artificial Sequence
  chemically synthesized
aatggatttattaagattgata

SEQ ID NO: 1029619 - DNA, 22 bp, Artificial Sequence
  chemically synthesized
aaatgctgaatggatttattaa

SEQ ID NO: 1029620 - DNA, 22 bp, Artificial Sequence
  chemically synthesized
tgaaatgctgaatggatttatt

SEQ ID NO: 1029621 - DNA, 22 bp, Artificial Sequence
  chemically synthesized
ttatcaatcttaataaatccat

SEQ ID NO: 1029622 - DNA, 22 bp, Artificial Sequence
  chemically synthesized
ttctgaaatgctgaatggattt

SEQ ID NO: 1029623 - DNA, 22 bp, Artificial Sequence
  chemically synthesized
tcaatcttaataaatccattca

SEQ ID NO: 1029624 - DNA, 22 bp, Artificial Sequence
  chemically synthesized
atgttattctgaaatgctgaat

SEQ ID NO: 1029625 - DNA, 22 bp, Artificial Sequence
  chemically synthesized
catgttattctgaaatgctgaa

SEQ ID NO: 1029626 - DNA, 22 bp, Artificial Sequence
  chemically synthesized
tcatgttattctgaaatgctga

SEQ ID NO: 1029627 - DNA, 22 bp, Artificial Sequence
  chemically synthesized
aataaatccattcagcatttca

SEQ ID NO: 1029628 - DNA, 22 bp, Artificial Sequence
  chemically synthesized
ataaatccattcagcatttcag

SEQ ID NO: 1029629 - DNA, 22 bp, Artificial Sequence
  chemically synthesized
gcatattttcatgttattctga

SEQ ID NO: 1029630 - DNA, 22 bp, Artificial Sequence
  chemically synthesized
ttggcatattttcatgttattc

SEQ ID NO: 1029631 - DNA, 22 bp, Artificial Sequence
  chemically synthesized
tgttggcatattttcatgttat

SEQ ID NO: 1029632 - DNA, 22 bp, Artificial Sequence
  chemically synthesized
agcatttcagaataacatgaaa

SEQ ID NO: 1029633 - DNA, 22 bp, Artificial Sequence
  chemically synthesized
ctgttggcatattttcatgtta

SEQ ID NO: 1029634 - DNA, 22 bp, Artificial Sequence
  chemically synthesized
cagaataacatgaaaatatgcc

SEQ ID NO: 1029635 - DNA, 22 bp, Artificial Sequence
  chemically synthesized
agaataacatgaaaatatgcca

SEQ ID NO: 1029636 - DNA, 22 bp, Artificial Sequence
  chemically synthesized
atagtaacaatagtaaaatgga

SEQ ID NO: 1029637 - DNA, 22 bp, Artificial Sequence
  chemically synthesized
gatagtaacaatagtaaaatgg

SEQ ID NO: 1029638 - DNA, 22 bp, Artificial Sequence
  chemically synthesized
ttgatagtaacaatagtaaaat

SEQ ID NO: 1029639 - DNA, 22 bp, Artificial Sequence
  chemically synthesized
ccaagttcttgatagtaacaat

SEQ ID NO: 1029640 - DNA, 22 bp, Artificial Sequence
  chemically synthesized
gccaagttcttgatagtaacaa

SEQ ID NO: 1029641 - DNA, 22 bp, Artificial Sequence
  chemically synthesized
tgccaagttcttgatagtaaca

SEQ ID NO: 1029642 - DNA, 22 bp, Artificial Sequence
  chemically synthesized
cattttactattgttactatca

SEQ ID NO: 1029643 - DNA, 22 bp, Artificial Sequence
  chemically synthesized
tactattgttactatcaagaac

SEQ ID NO: 1029644 - DNA, 22 bp, Artificial Sequence
  chemically synthesized
actattgttactatcaagaact

SEQ ID NO: 1029645 - DNA, 22 bp, Artificial Sequence
  chemically synthesized
ctattgttactatcaagaactt

SEQ ID NO: 1029646 - DNA, 22 bp, Artificial Sequence
  chemically synthesized
ttgttactatcaagaacttggc

SEQ ID NO: 1029647 - DNA, 22 bp, Artificial Sequence
  chemically synthesized
ttactatcaagaacttggcaaa

SEQ ID NO: 1029648 - DNA, 22 bp, Artificial Sequence
  chemically synthesized
ctatcaagaacttggcaaaatt

SEQ ID NO: 1029649 - DNA, 22 bp, Artificial Sequence
  chemically synthesized
tcaagaacttggcaaaatttgg

SEQ ID NO: 1029650 - DNA, 22 bp, Artificial Sequence
  chemically synthesized
acaaagtaaaaaaccaaatttt

SEQ ID NO: 1029651 - DNA, 22 bp, Artificial Sequence
  chemically synthesized
atacattcacaaagtaaaaaac

SEQ ID NO: 1029652 - DNA, 22 bp, Artificial Sequence
  chemically synthesized
ggcaaaatttggttttttactt

SEQ ID NO: 1029653 - DNA, 22 bp, Artificial Sequence
  chemically synthesized
aatacattcacaaagtaaaaaa

SEQ ID NO: 1029654 - DNA, 22 bp, Artificial Sequence
  chemically synthesized
gcaaaatttggttttttacttt

SEQ ID NO: 1029655 - DNA, 22 bp, Artificial Sequence
  chemically synthesized
tatcatttaatacattcacaaa

SEQ ID NO: 1029656 - DNA, 22 bp, Artificial Sequence
  chemically synthesized
ggttttttactttgtgaatgta

SEQ ID NO: 1029657 - DNA, 22 bp, Artificial Sequence
  chemically synthesized
gttttttactttgtgaatgtat

SEQ ID NO: 1029658 - DNA, 22 bp, Artificial Sequence
  chemically synthesized
cctgtatcatttaatacattca

SEQ ID NO: 1029659 - DNA, 22 bp, Artificial Sequence
  chemically synthesized
tttactttgtgaatgtattaaa

SEQ ID NO: 1029660 - DNA, 22 bp, Artificial Sequence
  chemically synthesized
ttactttgtgaatgtattaaat

SEQ ID NO: 1029661 - DNA, 22 bp, Artificial Sequence
  chemically synthesized
tactttgtgaatgtattaaatg

SEQ ID NO: 1029662 - DNA, 22 bp, Artificial Sequence
  chemically synthesized
actttgtgaatgtattaaatga

SEQ ID NO: 1029663 - DNA, 22 bp, Artificial Sequence
  chemically synthesized
ctttgtgaatgtattaaatgat

SEQ ID NO: 1029664 - DNA, 22 bp, Artificial Sequence
  chemically synthesized
tgtgaatgtattaaatgataca

SEQ ID NO: 1029665 - DNA, 22 bp, Artificial Sequence
  chemically synthesized
gtgaatgtattaaatgatacag

SEQ ID NO: 1029666 - DNA, 22 bp, Artificial Sequence
  chemically synthesized
catatatgttacctgtatcatt

SEQ ID NO: 1029667 - DNA, 22 bp, Artificial Sequence
  chemically synthesized
tgaatgtattaaatgatacagg

SEQ ID NO: 1029668 - DNA, 22 bp, Artificial Sequence
  chemically synthesized
attccatatatgttacctgtat

SEQ ID NO: 1029669 - DNA, 22 bp, Artificial Sequence
  chemically synthesized
aatgatacaggtaacatatatg

SEQ ID NO: 1029670 - DNA, 22 bp, Artificial Sequence
  chemically synthesized
gcatatagttaattccatatat

SEQ ID NO: 1029671 - DNA, 22 bp, Artificial Sequence
  chemically synthesized
cagttagcatatagttaattcc

SEQ ID NO: 1029672 - DNA, 22 bp, Artificial Sequence
  chemically synthesized
ctacagttagcatatagttaat

SEQ ID NO: 1029673 - DNA, 22 bp, Artificial Sequence
  chemically synthesized
aaaagtgaaacctgctacagtt

SEQ ID NO: 1029674 - DNA, 22 bp, Artificial Sequence
  chemically synthesized
actatatgctaactgtagcagg

SEQ ID NO: 1029675 - DNA, 22 bp, Artificial Sequence
  chemically synthesized
ttgaaaagtgaaacctgctaca

SEQ ID NO: 1029676 - DNA, 22 bp, Artificial Sequence
  chemically synthesized
attgaaaagtgaaacctgctac

SEQ ID NO: 1029677 - DNA, 22 bp, Artificial Sequence
  chemically synthesized
tatgctaactgtagcaggtttc

SEQ ID NO: 1029678 - DNA, 22 bp, Artificial Sequence
  chemically synthesized
gtttattgaaaagtgaaacctg

SEQ ID NO: 1029679 - DNA, 22 bp, Artificial Sequence
  chemically synthesized
cgtttattgaaaagtgaaacct

SEQ ID NO: 1029680 - DNA, 22 bp, Artificial Sequence
  chemically synthesized
tttcgtttattgaaaagtgaaa

SEQ ID NO: 1029681 - DNA, 22 bp, Artificial Sequence
  chemically synthesized
actgtagcaggtttcacttttc

SEQ ID NO: 1029682 - DNA, 22 bp, Artificial Sequence
  chemically synthesized
tagcaggtttcacttttcaata

SEQ ID NO: 1029683 - DNA, 22 bp, Artificial Sequence
  chemically synthesized
tcacggctatttcgtttattga

SEQ ID NO: 1029684 - DNA, 22 bp, Artificial Sequence
  chemically synthesized
cacttttcaataaacgaaatag

SEQ ID NO: 1029685 - DNA, 22 bp, Artificial Sequence
  chemically synthesized
acttttcaataaacgaaatagc

SEQ ID NO: 1029686 - DNA, 22 bp, Artificial Sequence
  chemically synthesized
ttcaataaacgaaatagccgtg

SEQ ID NO: 1029687 - DNA, 22 bp, Artificial Sequence
  chemically synthesized
tcaataaacgaaatagccgtga

SEQ ID NO: 1029688 - DNA, 22 bp, Artificial Sequence
  chemically synthesized
aagacagaattgtcacggctat

SEQ ID NO: 1029689 - DNA, 22 bp, Artificial Sequence
  chemically synthesized
caataaacgaaatagccgtgac

SEQ ID NO: 1029690 - DNA, 22 bp, Artificial Sequence
  chemically synthesized
aataaacgaaatagccgtgaca

SEQ ID NO: 1029691 - DNA, 22 bp, Artificial Sequence
  chemically synthesized
atcctaaagacagaattgtcac

SEQ ID NO: 1029692 - DNA, 22 bp, Artificial Sequence
  chemically synthesized
catcctaaagacagaattgtca

SEQ ID NO: 1029693 - DNA, 22 bp, Artificial Sequence
  chemically synthesized
ttcatcctaaagacagaattgt

SEQ ID NO: 1029694 - DNA, 22 bp, Artificial Sequence
  chemically synthesized
tcttcatcctaaagacagaatt

SEQ ID NO: 1029695 - DNA, 22 bp, Artificial Sequence
  chemically synthesized
tctcttcatcctaaagacagaa

SEQ ID NO: 1029696 - DNA, 22 bp, Artificial Sequence
  chemically synthesized
atggaaaatgctctctcttcat

SEQ ID NO: 1029697 - DNA, 22 bp, Artificial Sequence
  chemically synthesized
catggaaaatgctctctcttca

SEQ ID NO: 1029698 - DNA, 22 bp, Artificial Sequence
  chemically synthesized
tgtctttaggatgaagagagag

SEQ ID NO: 1029699 - DNA, 22 bp, Artificial Sequence
  chemically synthesized
tcatggaaaatgctctctcttc

SEQ ID NO: 1029700 - DNA, 22 bp, Artificial Sequence
  chemically synthesized
tctttaggatgaagagagagca

SEQ ID NO: 1029701 - DNA, 22 bp, Artificial Sequence
  chemically synthesized
taggatgaagagagagcatttt

SEQ ID NO: 1029702 - DNA, 22 bp, Artificial Sequence
  chemically synthesized
agattttcatggaaaatgctct

SEQ ID NO: 1029703 - DNA, 22 bp, Artificial Sequence
  chemically synthesized
aggatgaagagagagcattttc

SEQ ID NO: 1029704 - DNA, 22 bp, Artificial Sequence
  chemically synthesized
ggatgaagagagagcattttcc

SEQ ID NO: 1029705 - DNA, 22 bp, Artificial Sequence
  chemically synthesized
gatagtgaaaatcaattcagat

SEQ ID NO: 1029706 - DNA, 22 bp, Artificial Sequence
  chemically synthesized
agatagtgaaaatcaattcaga

SEQ ID NO: 1029707 - DNA, 22 bp, Artificial Sequence
  chemically synthesized
tagatagtgaaaatcaattcag

SEQ ID NO: 1029708 - DNA, 22 bp, Artificial Sequence
  chemically synthesized
tccatgaaaatctgaattgatt

SEQ ID NO: 1029709 - DNA, 22 bp, Artificial Sequence
  chemically synthesized
ccatgaaaatctgaattgattt

SEQ ID NO: 1029710 - DNA, 22 bp, Artificial Sequence
  chemically synthesized
catgaaaatctgaattgatttt

SEQ ID NO: 1029711 - DNA, 22 bp, Artificial Sequence
  chemically synthesized
atgtctttagatagtgaaaatc

SEQ ID NO: 1029712 - DNA, 22 bp, Artificial Sequence
  chemically synthesized
catgtctttagatagtgaaaat

SEQ ID NO: 1029713 - DNA, 22 bp, Artificial Sequence
  chemically synthesized
aattgattttcactatctaaag

SEQ ID NO: 1029714 - DNA, 22 bp, Artificial Sequence
  chemically synthesized
attttcactatctaaagacatg

SEQ ID NO: 1029715 - DNA, 22 bp, Artificial Sequence
  chemically synthesized
gcatatgtgtttcatgtcttta

SEQ ID NO: 1029716 - DNA, 22 bp, Artificial Sequence
  chemically synthesized
tcactatctaaagacatgaaac

SEQ ID NO: 1029717 - DNA, 22 bp, Artificial Sequence
  chemically synthesized
cactatctaaagacatgaaaca

SEQ ID NO: 1029718 - DNA, 22 bp, Artificial Sequence
  chemically synthesized
actatctaaagacatgaaacac

SEQ ID NO: 1029719 - DNA, 22 bp, Artificial Sequence
  chemically synthesized
tctaaagacatgaaacacatat

SEQ ID NO: 1029720 - DNA, 22 bp, Artificial Sequence
  chemically synthesized
tcgtccagagctagcatatgtg

SEQ ID NO: 1029721 - DNA, 22 bp, Artificial Sequence
  chemically synthesized
aagacatgaaacacatatgcta

SEQ ID NO: 1029722 - DNA, 22 bp, Artificial Sequence
  chemically synthesized
gtcgtccagagctagcatatgt

SEQ ID NO: 1029723 - DNA, 22 bp, Artificial Sequence
  chemically synthesized
tgtcgtccagagctagcatatg

SEQ ID NO: 1029724 - DNA, 22 bp, Artificial Sequence
  chemically synthesized
ttgtcgtccagagctagcatat

SEQ ID NO: 1029725 - DNA, 22 bp, Artificial Sequence
  chemically synthesized
ttttgtcgtccagagctagcat

SEQ ID NO: 1029726 - DNA, 22 bp, Artificial Sequence
  chemically synthesized
cttttgtcgtccagagctagca

SEQ ID NO: 1029727 - DNA, 22 bp, Artificial Sequence
  chemically synthesized
atcttcttttgtcgtccagagc

SEQ ID NO: 1029728 - DNA, 22 bp, Artificial Sequence
  chemically synthesized
catcttcttttgtcgtccagag

SEQ ID NO: 1029729 - DNA, 22 bp, Artificial Sequence
  chemically synthesized
tcatcttcttttgtcgtccaga

SEQ ID NO: 1029730 - DNA, 22 bp, Artificial Sequence
  chemically synthesized
gctctggacgacaaaagaagat

SEQ ID NO: 1029731 - DNA, 22 bp, Artificial Sequence
  chemically synthesized
tagaggacattttcatcttctt

SEQ ID NO: 1029732 - DNA, 22 bp, Artificial Sequence
  chemically synthesized
tggacgacaaaagaagatgaaa

SEQ ID NO: 1029733 - DNA, 22 bp, Artificial Sequence
  chemically synthesized
ctatagaggacattttcatctt

SEQ ID NO: 1029734 - DNA, 22 bp, Artificial Sequence
  chemically synthesized
gacgacaaaagaagatgaaaat

SEQ ID NO: 1029735 - DNA, 22 bp, Artificial Sequence
  chemically synthesized
cctatagaggacattttcatct

SEQ ID NO: 1029736 - DNA, 22 bp, Artificial Sequence
  chemically synthesized
gatggccttcctatagaggaca

SEQ ID NO: 1029737 - DNA, 22 bp, Artificial Sequence
  chemically synthesized
aacatcctggatggccttccta

SEQ ID NO: 1029738 - DNA, 22 bp, Artificial Sequence
  chemically synthesized
ccattcaacatcctggatggcc

SEQ ID NO: 1029739 - DNA, 22 bp, Artificial Sequence
  chemically synthesized
accattcaacatcctggatggc

SEQ ID NO: 1029740 - DNA, 22 bp, Artificial Sequence
  chemically synthesized
ttaccattcaacatcctggatg

SEQ ID NO: 1029741 - DNA, 22 bp, Artificial Sequence
  chemically synthesized
tataggaaggccatccaggatg

SEQ ID NO: 1029742 - DNA, 22 bp, Artificial Sequence
  chemically synthesized
taggaaggccatccaggatgtt

SEQ ID NO: 1029743 - DNA, 22 bp, Artificial Sequence
  chemically synthesized
tctcttaccattcaacatcctg

SEQ ID NO: 1029744 - DNA, 22 bp, Artificial Sequence
  chemically synthesized
gatggaagttgtctcttaccat

SEQ ID NO: 1029745 - DNA, 22 bp, Artificial Sequence
  chemically synthesized
taattagatggaagttgtctct

SEQ ID NO: 1029746 - DNA, 22 bp, Artificial Sequence
  chemically synthesized
aatggtaagagacaacttccat

SEQ ID NO: 1029747 - DNA, 22 bp, Artificial Sequence
  chemically synthesized
atgtgtctataattagatggaa

SEQ ID NO: 1029748 - DNA, 22 bp, Artificial Sequence
  chemically synthesized
aatgtgtctataattagatgga

SEQ ID NO: 1029749 - DNA, 22 bp, Artificial Sequence
  chemically synthesized
taatgtgtctataattagatgg

SEQ ID NO: 1029750 - DNA, 22 bp, Artificial Sequence
  chemically synthesized
ccatctaattatagacacatta

SEQ ID NO: 1029751 - DNA, 22 bp, Artificial Sequence
  chemically synthesized
catctaattatagacacattaa

SEQ ID NO: 1029752 - DNA, 22 bp, Artificial Sequence
  chemically synthesized
acggaccatgttttaatgtgtc

SEQ ID NO: 1029753 - DNA, 22 bp, Artificial Sequence
  chemically synthesized
attatagacacattaaaacatg

SEQ ID NO: 1029754 - DNA, 22 bp, Artificial Sequence
  chemically synthesized
tagttaacggaccatgttttaa

SEQ ID NO: 1029755 - DNA, 22 bp, Artificial Sequence
  chemically synthesized
tagacacattaaaacatggtcc

SEQ ID NO: 1029756 - DNA, 22 bp, Artificial Sequence
  chemically synthesized
aaacatggtccgttaactacaa

SEQ ID NO: 1029757 - DNA, 22 bp, Artificial Sequence
  chemically synthesized
gtagaaagggaaaggataaggg

SEQ ID NO: 1029758 - DNA, 22 bp, Artificial Sequence
  chemically synthesized
actacaacccttatcctttccc

SEQ ID NO: 1029759 - DNA, 22 bp, Artificial Sequence
  chemically synthesized
caacccttatcctttccctttc

SEQ ID NO: 1029760 - DNA, 22 bp, Artificial Sequence
  chemically synthesized
atcctttccctttctaccaacc

SEQ ID NO: 1029761 - DNA, 22 bp, Artificial Sequence
  chemically synthesized
tcctttccctttctaccaaccc

SEQ ID NO: 1029762 - DNA, 22 bp, Artificial Sequence
  chemically synthesized
agggataaatgagggttggtag

SEQ ID NO: 1029763 - DNA, 22 bp, Artificial Sequence
  chemically synthesized
tccctttctaccaaccctcatt

SEQ ID NO: 1029764 - DNA, 22 bp, Artificial Sequence
  chemically synthesized
ccctttctaccaaccctcattt

SEQ ID NO: 1029765 - DNA, 22 bp, Artificial Sequence
  chemically synthesized
cctttctaccaaccctcattta

SEQ ID NO: 1029766 - DNA, 22 bp, Artificial Sequence
  chemically synthesized
tctaccaaccctcatttatccc

SEQ ID NO: 1029767 - DNA, 22 bp, Artificial Sequence
  chemically synthesized
ctaccaaccctcatttatccct

SEQ ID NO: 1029768 - DNA, 22 bp, Artificial Sequence
  chemically synthesized
taccaaccctcatttatccctc

SEQ ID NO: 1029769 - DNA, 22 bp, Artificial Sequence
  chemically synthesized
aaatcaatggctgagggataaa

SEQ ID NO: 1029770 - DNA, 22 bp, Artificial Sequence
  chemically synthesized
aaaatcaatggctgagggataa

SEQ ID NO: 1029771 - DNA, 22 bp, Artificial Sequence
  chemically synthesized
ccaaccctcatttatccctcag

SEQ ID NO: 1029772 - DNA, 22 bp, Artificial Sequence
  chemically synthesized
taaaatcaatggctgagggata

SEQ ID NO: 1029773 - DNA, 22 bp, Artificial Sequence
  chemically synthesized
ttaaaatcaatggctgagggat

SEQ ID NO: 1029774 - DNA, 22 bp, Artificial Sequence
  chemically synthesized
tttaaaatcaatggctgaggga

SEQ ID NO: 1029775 - DNA, 22 bp, Artificial Sequence
  chemically synthesized
atttatccctcagccattgatt

SEQ ID NO: 1029776 - DNA, 22 bp, Artificial Sequence
  chemically synthesized
atccctcagccattgattttaa

SEQ ID NO: 1029777 - DNA, 22 bp, Artificial Sequence
  chemically synthesized
tccctcagccattgattttaaa

SEQ ID NO: 1029778 - DNA, 22 bp, Artificial Sequence
  chemically synthesized
agccattgattttaaaaaatat

SEQ ID NO: 1029779 - DNA, 22 bp, Artificial Sequence
  chemically synthesized
ggtgtcaaatatataaaatatt

SEQ ID NO: 1029780 - DNA, 22 bp, Artificial Sequence
  chemically synthesized
gggtgtcaaatatataaaatat

SEQ ID NO: 1029781 - DNA, 22 bp, Artificial Sequence
  chemically synthesized
tgggtgtcaaatatataaaata

SEQ ID NO: 1029782 - DNA, 22 bp, Artificial Sequence
  chemically synthesized
attttaaaaaatattttatata

SEQ ID NO: 1029783 - DNA, 22 bp, Artificial Sequence
  chemically synthesized
ctttgggtgtcaaatatataaa

SEQ ID NO: 1029784 - DNA, 22 bp, Artificial Sequence
  chemically synthesized
cctttgggtgtcaaatatataa

SEQ ID NO: 1029785 - DNA, 22 bp, Artificial Sequence
  chemically synthesized
taaaaaatattttatatatttg

SEQ ID NO: 1029786 - DNA, 22 bp, Artificial Sequence
  chemically synthesized
tcctttgggtgtcaaatatata

SEQ ID NO: 1029787 - DNA, 22 bp, Artificial Sequence
  chemically synthesized
aaaaaatattttatatatttga

SEQ ID NO: 1029788 - DNA, 22 bp, Artificial Sequence
  chemically synthesized
ttcctttgggtgtcaaatatat

SEQ ID NO: 1029789 - DNA, 22 bp, Artificial Sequence
  chemically synthesized
aaaaatattttatatatttgac

SEQ ID NO: 1029790 - DNA, 22 bp, Artificial Sequence
  chemically synthesized
tttcctttgggtgtcaaatata

SEQ ID NO: 1029791 - DNA, 22 bp, Artificial Sequence
  chemically synthesized
cattttttcctttgggtgtcaa

SEQ ID NO: 1029792 - DNA, 22 bp, Artificial Sequence
  chemically synthesized
acattttttcctttgggtgtca

SEQ ID NO: 1029793 - DNA, 22 bp, Artificial Sequence
  chemically synthesized
tatatatttgacacccaaagga

SEQ ID NO: 1029794 - DNA, 22 bp, Artificial Sequence
  chemically synthesized
atttacattttttcctttgggt

SEQ ID NO: 1029795 - DNA, 22 bp, Artificial Sequence
  chemically synthesized
atatatttgacacccaaaggaa

SEQ ID NO: 1029796 - DNA, 22 bp, Artificial Sequence
  chemically synthesized
catttacattttttcctttggg

SEQ ID NO: 1029797 - DNA, 22 bp, Artificial Sequence
  chemically synthesized
tatatttgacacccaaaggaaa

SEQ ID NO: 1029798 - DNA, 22 bp, Artificial Sequence
  chemically synthesized
gacacccaaaggaaaaaatgta

SEQ ID NO: 1029799 - DNA, 22 bp, Artificial Sequence
  chemically synthesized
acacccaaaggaaaaaatgtaa

SEQ ID NO: 1029800 - DNA, 22 bp, Artificial Sequence
  chemically synthesized
gaagtgagtttcatttacattt

SEQ ID NO: 1029801 - DNA, 22 bp, Artificial Sequence
  chemically synthesized
ggaagtgagtttcatttacatt

SEQ ID NO: 1029802 - DNA, 22 bp, Artificial Sequence
  chemically synthesized
ttggaagtgagtttcatttaca

SEQ ID NO: 1029803 - DNA, 22 bp, Artificial Sequence
  chemically synthesized
agagcagtagtctcttggaagt

SEQ ID NO: 1029804 - DNA, 22 bp, Artificial Sequence
  chemically synthesized
ctgagagcagtagtctcttgga

SEQ ID NO: 1029805 - DNA, 22 bp, Artificial Sequence
  chemically synthesized
gctgagagcagtagtctcttgg

SEQ ID NO: 1029806 - DNA, 22 bp, Artificial Sequence
  chemically synthesized
gtttgctgagagcagtagtctc

SEQ ID NO: 1029807 - DNA, 22 bp, Artificial Sequence
  chemically synthesized
ggtttgctgagagcagtagtct

SEQ ID NO: 1029808 - DNA, 22 bp, Artificial Sequence
  chemically synthesized
tggtttgctgagagcagtagtc

SEQ ID NO: 1029809 - DNA, 22 bp, Artificial Sequence
  chemically synthesized
ttggtttgctgagagcagtagt

SEQ ID NO: 1029810 - DNA, 22 bp, Artificial Sequence
  chemically synthesized
acttccaagagactactgctct

SEQ ID NO: 1029811 - DNA, 22 bp, Artificial Sequence
  chemically synthesized
tttggtttgctgagagcagtag

SEQ ID NO: 1029812 - DNA, 22 bp, Artificial Sequence
  chemically synthesized
tttttggtttgctgagagcagt

SEQ ID NO: 1029813 - DNA, 22 bp, Artificial Sequence
  chemically synthesized
ccaagagactactgctctcagc

SEQ ID NO: 1029814 - DNA, 22 bp, Artificial Sequence
  chemically synthesized
tctttttggtttgctgagagca

SEQ ID NO: 1029815 - DNA, 22 bp, Artificial Sequence
  chemically synthesized
caagagactactgctctcagca

SEQ ID NO: 1029816 - DNA, 22 bp, Artificial Sequence
  chemically synthesized
ttctctttttggtttgctgaga

SEQ ID NO: 1029817 - DNA, 22 bp, Artificial Sequence
  chemically synthesized
attctctttttggtttgctgag

SEQ ID NO: 1029818 - DNA, 22 bp, Artificial Sequence
  chemically synthesized
tattctctttttggtttgctga

SEQ ID NO: 1029819 - DNA, 22 bp, Artificial Sequence
  chemically synthesized
ttattctctttttggtttgctg

SEQ ID NO: 1029820 - DNA, 22 bp, Artificial Sequence
  chemically synthesized
tttattctctttttggtttgct

SEQ ID NO: 1029821 - DNA, 22 bp, Artificial Sequence
  chemically synthesized
ttttttattctctttttggttt

SEQ ID NO: 1029822 - DNA, 22 bp, Artificial Sequence
  chemically synthesized
ctgctctcagcaaaccaaaaag

SEQ ID NO: 1029823 - DNA, 22 bp, Artificial Sequence
  chemically synthesized
gttttttattctctttttggtt

SEQ ID NO: 1029824 - DNA, 22 bp, Artificial Sequence
  chemically synthesized
ctctcagcaaaccaaaaagaga

SEQ ID NO: 1029825 - DNA, 22 bp, Artificial Sequence
  chemically synthesized
tcagcaaaccaaaaagagaata

SEQ ID NO: 1029826 - DNA, 22 bp, Artificial Sequence
  chemically synthesized
agcaaaccaaaaagagaataaa

SEQ ID NO: 1029827 - DNA, 22 bp, Artificial Sequence
  chemically synthesized
tagacatttgttttttattctc

SEQ ID NO: 1029828 - DNA, 22 bp, Artificial Sequence
  chemically synthesized
gtagacatttgttttttattct

SEQ ID NO: 1029829 - DNA, 22 bp, Artificial Sequence
  chemically synthesized
aagaaatttgtagacatttgtt

SEQ ID NO: 1029830 - DNA, 22 bp, Artificial Sequence
  chemically synthesized
cattgaagaaatttgtagacat

SEQ ID NO: 1029831 - DNA, 22 bp, Artificial Sequence
  chemically synthesized
tacattgaagaaatttgtagac

SEQ ID NO: 1029832 - DNA, 22 bp, Artificial Sequence
  chemically synthesized
ctacattgaagaaatttgtaga

SEQ ID NO: 1029833 - DNA, 22 bp, Artificial Sequence
  chemically synthesized
tctacattgaagaaatttgtag

SEQ ID NO: 1029834 - DNA, 22 bp, Artificial Sequence
  chemically synthesized
ttctacattgaagaaatttgta

SEQ ID NO: 1029835 - DNA, 22 bp, Artificial Sequence
  chemically synthesized
tttttctacattgaagaaattt

SEQ ID NO: 1029836 - DNA, 22 bp, Artificial Sequence
  chemically synthesized
tgaattgtttttctacattgaa

SEQ ID NO: 1029837 - DNA, 22 bp, Artificial Sequence
  chemically synthesized
caaatttcttcaatgtagaaaa

SEQ ID NO: 1029838 - DNA, 22 bp, Artificial Sequence
  chemically synthesized
agatctatgaattgtttttcta

SEQ ID NO: 1029839 - DNA, 22 bp, Artificial Sequence
  chemically synthesized
aagatctatgaattgtttttct

SEQ ID NO: 1029840 - DNA, 22 bp, Artificial Sequence
  chemically synthesized
taagatctatgaattgtttttc

SEQ ID NO: 1029841 - DNA, 22 bp, Artificial Sequence
  chemically synthesized
cttcaatgtagaaaaacaattc

SEQ ID NO: 1029842 - DNA, 22 bp, Artificial Sequence
  chemically synthesized
ttcaatgtagaaaaacaattca

SEQ ID NO: 1029843 - DNA, 22 bp, Artificial Sequence
  chemically synthesized
cctttaagatctatgaattgtt

SEQ ID NO: 1029844 - DNA, 22 bp, Artificial Sequence
  chemically synthesized
caatgtagaaaaacaattcata

SEQ ID NO: 1029845 - DNA, 22 bp, Artificial Sequence
  chemically synthesized
aatgtagaaaaacaattcatag

SEQ ID NO: 1029846 - DNA, 22 bp, Artificial Sequence
  chemically synthesized
tcactgcctttaagatctatga

SEQ ID NO: 1029847 - DNA, 22 bp, Artificial Sequence
  chemically synthesized
atagatcttaaaggcagtgata

SEQ ID NO: 1029848 - DNA, 22 bp, Artificial Sequence
  chemically synthesized
aaaggcagtgatagggtttggc

SEQ ID NO: 1029849 - DNA, 22 bp, Artificial Sequence
  chemically synthesized
ggtggggacacagccaaaccct

SEQ ID NO: 1029850 - DNA, 22 bp, Artificial Sequence
  chemically synthesized
aaggcagtgatagggtttggct

SEQ ID NO: 1029851 - DNA, 22 bp, Artificial Sequence
  chemically synthesized
gggtggggacacagccaaaccc

SEQ ID NO: 1029852 - DNA, 22 bp, Artificial Sequence
  chemically synthesized
aagacgggatttgggtggggac

SEQ ID NO: 1029853 - DNA, 22 bp, Artificial Sequence
  chemically synthesized
ggctgtgtccccacccaaatcc

SEQ ID NO: 1029854 - DNA, 22 bp, Artificial Sequence
  chemically synthesized
caattcaagacgggatttgggt

SEQ ID NO: 1029855 - DNA, 22 bp, Artificial Sequence
  chemically synthesized
gctgtgtccccacccaaatccc

SEQ ID NO: 1029856 - DNA, 22 bp, Artificial Sequence
  chemically synthesized
tgtccccacccaaatcccgtct

SEQ ID NO: 1029857 - DNA, 22 bp, Artificial Sequence
  chemically synthesized
tgggaactgcaattcaagacgg

SEQ ID NO: 1029858 - DNA, 22 bp, Artificial Sequence
  chemically synthesized
gggattatgggaactgcaattc

SEQ ID NO: 1029859 - DNA, 22 bp, Artificial Sequence
  chemically synthesized
gaattgcagttcccataatccc

SEQ ID NO: 1029860 - DNA, 22 bp, Artificial Sequence
  chemically synthesized
ccatgacatctggggattatgg

SEQ ID NO: 1029861 - DNA, 22 bp, Artificial Sequence
  chemically synthesized
aattgcagttcccataatcccc

SEQ ID NO: 1029862 - DNA, 22 bp, Artificial Sequence
  chemically synthesized
cagttcccataatccccagatg

SEQ ID NO: 1029863 - DNA, 22 bp, Artificial Sequence
  chemically synthesized
gatccctcccatgacatctggg

SEQ ID NO: 1029864 - DNA, 22 bp, Artificial Sequence
  chemically synthesized
ccataatccccagatgtcatgg

SEQ ID NO: 1029865 - DNA, 22 bp, Artificial Sequence
  chemically synthesized
ccactggatccctcccatgaca

SEQ ID NO: 1029866 - DNA, 22 bp, Artificial Sequence
  chemically synthesized
cctcccactggatccctcccat

SEQ ID NO: 1029867 - DNA, 22 bp, Artificial Sequence
  chemically synthesized
agttacctcccactggatccct

SEQ ID NO: 1029868 - DNA, 22 bp, Artificial Sequence
  chemically synthesized
aatcatggggggtggtcactcc

SEQ ID NO: 1029869 - DNA, 22 bp, Artificial Sequence
  chemically synthesized
tcataagaacagcagcacggga

SEQ ID NO: 1029870 - DNA, 22 bp, Artificial Sequence
  chemically synthesized
actatcataagaacagcagcac

SEQ ID NO: 1029871 - DNA, 22 bp, Artificial Sequence
  chemically synthesized
ccgtgctgctgttcttatgata

SEQ ID NO: 1029872 - DNA, 22 bp, Artificial Sequence
  chemically synthesized
atgagagctcactatcataaga

SEQ ID NO: 1029873 - DNA, 22 bp, Artificial Sequence
  chemically synthesized
tcatgagagctcactatcataa

SEQ ID NO: 1029874 - DNA, 22 bp, Artificial Sequence
  chemically synthesized
ctgttcttatgatagtgagctc

SEQ ID NO: 1029875 - DNA, 22 bp, Artificial Sequence
  chemically synthesized
ttcttatgatagtgagctctca

SEQ ID NO: 1029876 - DNA, 22 bp, Artificial Sequence
  chemically synthesized
ttatgatagtgagctctcatga

SEQ ID NO: 1029877 - DNA, 22 bp, Artificial Sequence
  chemically synthesized
atgatagtgagctctcatgaga

SEQ ID NO: 1029878 - DNA, 22 bp, Artificial Sequence
  chemically synthesized
tgatagtgagctctcatgagag

SEQ ID NO: 1029879 - DNA, 22 bp, Artificial Sequence
  chemically synthesized
tgaaaccatcagctctcatgag

SEQ ID NO: 1029880 - DNA, 22 bp, Artificial Sequence
  chemically synthesized
atgaaaccatcagctctcatga

SEQ ID NO: 1029881 - DNA, 22 bp, Artificial Sequence
  chemically synthesized
tcatgagagctgatggtttcat

SEQ ID NO: 1029882 - DNA, 22 bp, Artificial Sequence
  chemically synthesized
atgagagctgatggtttcataa

SEQ ID NO: 1029883 - DNA, 22 bp, Artificial Sequence
  chemically synthesized
atggtttcataaggggcttttc

SEQ ID NO: 1029884 - DNA, 22 bp, Artificial Sequence
  chemically synthesized
cataaggggcttttcctccttt

SEQ ID NO: 1029885 - DNA, 22 bp, Artificial Sequence
  chemically synthesized
ataaggggcttttcctcctttg

SEQ ID NO: 1029886 - DNA, 22 bp, Artificial Sequence
  chemically synthesized
ttcctcctttgctcggcacttc

SEQ ID NO: 1029887 - DNA, 22 bp, Artificial Sequence
  chemically synthesized
tcctcctttgctcggcacttct

SEQ ID NO: 1029888 - DNA, 22 bp, Artificial Sequence
  chemically synthesized
cctcctttgctcggcacttctc

SEQ ID NO: 1029889 - DNA, 22 bp, Artificial Sequence
  chemically synthesized
ctcctttgctcggcacttctcc

SEQ ID NO: 1029890 - DNA, 22 bp, Artificial Sequence
  chemically synthesized
ctttgctcggcacttctccttc

SEQ ID NO: 1029891 - DNA, 22 bp, Artificial Sequence
  chemically synthesized
tcacatgatggcaagaaggaga

SEQ ID NO: 1029892 - DNA, 22 bp, Artificial Sequence
  chemically synthesized
tgctcggcacttctccttcttg

SEQ ID NO: 1029893 - DNA, 22 bp, Artificial Sequence
  chemically synthesized
gtcacatgatggcaagaaggag

SEQ ID NO: 1029894 - DNA, 22 bp, Artificial Sequence
  chemically synthesized
gctcggcacttctccttcttgc

SEQ ID NO: 1029895 - DNA, 22 bp, Artificial Sequence
  chemically synthesized
tgtcacatgatggcaagaagga

SEQ ID NO: 1029896 - DNA, 22 bp, Artificial Sequence
  chemically synthesized
ctcggcacttctccttcttgcc

SEQ ID NO: 1029897 - DNA, 22 bp, Artificial Sequence
  chemically synthesized
ggcacttctccttcttgccatc

SEQ ID NO: 1029898 - DNA, 22 bp, Artificial Sequence
  chemically synthesized
ctccttcttgccatcatgtgac

SEQ ID NO: 1029899 - DNA, 22 bp, Artificial Sequence
  chemically synthesized
tccttcttgccatcatgtgaca

SEQ ID NO: 1029900 - DNA, 22 bp, Artificial Sequence
  chemically synthesized
cttcttgccatcatgtgacaaa

SEQ ID NO: 1029901 - DNA, 22 bp, Artificial Sequence
  chemically synthesized
cttgccatcatgtgacaaagga

SEQ ID NO: 1029902 - DNA, 22 bp, Artificial Sequence
  chemically synthesized
ttgccatcatgtgacaaaggat

SEQ ID NO: 1029903 - DNA, 22 bp, Artificial Sequence
  chemically synthesized
gccatcatgtgacaaaggatgt

SEQ ID NO: 1029904 - DNA, 22 bp, Artificial Sequence
  chemically synthesized
ccatcatgtgacaaaggatgtg

SEQ ID NO: 1029905 - DNA, 22 bp, Artificial Sequence
  chemically synthesized
tggaagcagaagcaaacacatc

SEQ ID NO: 1029906 - DNA, 22 bp, Artificial Sequence
  chemically synthesized
caatcactgtggaagcagaagc

SEQ ID NO: 1029907 - DNA, 22 bp, Artificial Sequence
  chemically synthesized
acaatcactgtggaagcagaag

SEQ ID NO: 1029908 - DNA, 22 bp, Artificial Sequence
  chemically synthesized
aggaaacttacaatcactgtgg

SEQ ID NO: 1029909 - DNA, 22 bp, Artificial Sequence
  chemically synthesized
gcttctgcttccacagtgattg

SEQ ID NO: 1029910 - DNA, 22 bp, Artificial Sequence
  chemically synthesized
cttctgcttccacagtgattgt

SEQ ID NO: 1029911 - DNA, 22 bp, Artificial Sequence
  chemically synthesized
ctgcttccacagtgattgtaag

SEQ ID NO: 1029912 - DNA, 22 bp, Artificial Sequence
  chemically synthesized
tgcttccacagtgattgtaagt

SEQ ID NO: 1029913 - DNA, 22 bp, Artificial Sequence
  chemically synthesized
cttccacagtgattgtaagttt

SEQ ID NO: 1029914 - DNA, 22 bp, Artificial Sequence
  chemically synthesized
gggaggcctcaggaaacttaca

SEQ ID NO: 1029915 - DNA, 22 bp, Artificial Sequence
  chemically synthesized
ccacagtgattgtaagtttcct

SEQ ID NO: 1029916 - DNA, 22 bp, Artificial Sequence
  chemically synthesized
cacagtgattgtaagtttcctg

SEQ ID NO: 1029917 - DNA, 22 bp, Artificial Sequence
  chemically synthesized
catggctggggaggcctcagga

SEQ ID NO: 1029918 - DNA, 22 bp, Artificial Sequence
  chemically synthesized
gcatggctggggaggcctcagg

SEQ ID NO: 1029919 - DNA, 22 bp, Artificial Sequence
  chemically synthesized
gtttgcatggctggggaggcct

SEQ ID NO: 1029920 - DNA, 22 bp, Artificial Sequence
  chemically synthesized
taagtttcctgaggcctcccca

SEQ ID NO: 1029921 - DNA, 22 bp, Artificial Sequence
  chemically synthesized
actggtttgcatggctggggag

SEQ ID NO: 1029922 - DNA, 22 bp, Artificial Sequence
  chemically synthesized
cctgaggcctccccagccatgc

SEQ ID NO: 1029923 - DNA, 22 bp, Artificial Sequence
  chemically synthesized
actcactggtttgcatggctgg

SEQ ID NO: 1029924 - DNA, 22 bp, Artificial Sequence
  chemically synthesized
ctgaggcctccccagccatgca

SEQ ID NO: 1029925 - DNA, 22 bp, Artificial Sequence
  chemically synthesized
aggcctccccagccatgcaaac

SEQ ID NO: 1029926 - DNA, 22 bp, Artificial Sequence
  chemically synthesized
attgactcactggtttgcatgg

SEQ ID NO: 1029927 - DNA, 22 bp, Artificial Sequence
  chemically synthesized
aattgactcactggtttgcatg

SEQ ID NO: 1029928 - DNA, 22 bp, Artificial Sequence
  chemically synthesized
cccagccatgcaaaccagtgag

SEQ ID NO: 1029929 - DNA, 22 bp, Artificial Sequence
  chemically synthesized
taaaggaacgaggtttaattga

SEQ ID NO: 1029930 - DNA, 22 bp, Artificial Sequence
  chemically synthesized
ataaaggaacgaggtttaattg

SEQ ID NO: 1029931 - DNA, 22 bp, Artificial Sequence
  chemically synthesized
ggtaatttataaaggaacgagg

SEQ ID NO: 1029932 - DNA, 22 bp, Artificial Sequence
  chemically synthesized
agactgggtaatttataaagga

SEQ ID NO: 1029933 - DNA, 22 bp, Artificial Sequence
  chemically synthesized
aacctcgttcctttataaatta

SEQ ID NO: 1029934 - DNA, 22 bp, Artificial Sequence
  chemically synthesized
cctgagactgggtaatttataa

SEQ ID NO: 1029935 - DNA, 22 bp, Artificial Sequence
  chemically synthesized
gttcctttataaattacccagt

SEQ ID NO: 1029936 - DNA, 22 bp, Artificial Sequence
  chemically synthesized
ctttataaattacccagtctca

SEQ ID NO: 1029937 - DNA, 22 bp, Artificial Sequence
  chemically synthesized
taaagaactacctgagactggg

SEQ ID NO: 1029938 - DNA, 22 bp, Artificial Sequence
  chemically synthesized
tataaattacccagtctcaggt

SEQ ID NO: 1029939 - DNA, 22 bp, Artificial Sequence
  chemically synthesized
ctataaagaactacctgagact

SEQ ID NO: 1029940 - DNA, 22 bp, Artificial Sequence
  chemically synthesized
ataaattacccagtctcaggta

SEQ ID NO: 1029941 - DNA, 22 bp, Artificial Sequence
  chemically synthesized
taaattacccagtctcaggtag

SEQ ID NO: 1029942 - DNA, 22 bp, Artificial Sequence
  chemically synthesized
atgctgctataaagaactacct

SEQ ID NO: 1029943 - DNA, 22 bp, Artificial Sequence
  chemically synthesized
tcatgctgctataaagaactac

SEQ ID NO: 1029944 - DNA, 22 bp, Artificial Sequence
  chemically synthesized
cccagtctcaggtagttcttta

SEQ ID NO: 1029945 - DNA, 22 bp, Artificial Sequence
  chemically synthesized
ttctcatgctgctataaagaac

SEQ ID NO: 1029946 - DNA, 22 bp, Artificial Sequence
  chemically synthesized
gtctgttctcatgctgctataa

SEQ ID NO: 1029947 - DNA, 22 bp, Artificial Sequence
  chemically synthesized
aggtagttctttatagcagcat

SEQ ID NO: 1029948 - DNA, 22 bp, Artificial Sequence
  chemically synthesized
tattagtctgttctcatgctgc

SEQ ID NO: 1029949 - DNA, 22 bp, Artificial Sequence
  chemically synthesized
ctgtattagtctgttctcatgc

SEQ ID NO: 1029950 - DNA, 22 bp, Artificial Sequence
  chemically synthesized
actgtattagtctgttctcatg

SEQ ID NO: 1029951 - DNA, 22 bp, Artificial Sequence
  chemically synthesized
tttatagcagcatgagaacaga

SEQ ID NO: 1029952 - DNA, 22 bp, Artificial Sequence
  chemically synthesized
tatagcagcatgagaacagact

SEQ ID NO: 1029953 - DNA, 22 bp, Artificial Sequence
  chemically synthesized
atagcagcatgagaacagacta

SEQ ID NO: 1029954 - DNA, 22 bp, Artificial Sequence
  chemically synthesized
tagcagcatgagaacagactaa

SEQ ID NO: 1029955 - DNA, 22 bp, Artificial Sequence
  chemically synthesized
tggtaccaatttactgtattag

SEQ ID NO: 1029956 - DNA, 22 bp, Artificial Sequence
  chemically synthesized
tgtggtaccaatttactgtatt

SEQ ID NO: 1029957 - DNA, 22 bp, Artificial Sequence
  chemically synthesized
tctgtggtaccaatttactgta

SEQ ID NO: 1029958 - DNA, 22 bp, Artificial Sequence
  chemically synthesized
atacagtaaattggtaccacag

SEQ ID NO: 1029959 - DNA, 22 bp, Artificial Sequence
  chemically synthesized
tagcagtatcccactctctgtg

SEQ ID NO: 1029960 - DNA, 22 bp, Artificial Sequence
  chemically synthesized
atagcagtatcccactctctgt

SEQ ID NO: 1029961 - DNA, 22 bp, Artificial Sequence
  chemically synthesized
tatagcagtatcccactctctg

SEQ ID NO: 1029962 - DNA, 22 bp, Artificial Sequence
  chemically synthesized
tttatagcagtatcccactctc

SEQ ID NO: 1029963 - DNA, 22 bp, Artificial Sequence
  chemically synthesized
ctttatagcagtatcccactct

SEQ ID NO: 1029964 - DNA, 22 bp, Artificial Sequence
  chemically synthesized
gtaccacagagagtgggatact

SEQ ID NO: 1029965 - DNA, 22 bp, Artificial Sequence
  chemically synthesized
ggtttctttatagcagtatccc

SEQ ID NO: 1029966 - DNA, 22 bp, Artificial Sequence
  chemically synthesized
gggtttctttatagcagtatcc

SEQ ID NO: 1029967 - DNA, 22 bp, Artificial Sequence
  chemically synthesized
tgggtttctttatagcagtatc

SEQ ID NO: 1029968 - DNA, 22 bp, Artificial Sequence
  chemically synthesized
ttgggtttctttatagcagtat

SEQ ID NO: 1029969 - DNA, 22 bp, Artificial Sequence
  chemically synthesized
cacatttttgggtttctttata

SEQ ID NO: 1029970 - DNA, 22 bp, Artificial Sequence
  chemically synthesized
ccacatttttgggtttctttat

SEQ ID NO: 1029971 - DNA, 22 bp, Artificial Sequence
  chemically synthesized
cttccacatttttgggtttctt

SEQ ID NO: 1029972 - DNA, 22 bp, Artificial Sequence
  chemically synthesized
ctataaagaaacccaaaaatgt

SEQ ID NO: 1029973 - DNA, 22 bp, Artificial Sequence
  chemically synthesized
caaagttgcttccacatttttg

SEQ ID NO: 1029974 - DNA, 22 bp, Artificial Sequence
  chemically synthesized
taaagaaacccaaaaatgtgga

SEQ ID NO: 1029975 - DNA, 22 bp, Artificial Sequence
  chemically synthesized
cccagttccaaagttgcttcca

SEQ ID NO: 1029976 - DNA, 22 bp, Artificial Sequence
  chemically synthesized
ttacccagttccaaagttgctt

SEQ ID NO: 1029977 - DNA, 22 bp, Artificial Sequence
  chemically synthesized
cctgttacccagttccaaagtt

SEQ ID NO: 1029978 - DNA, 22 bp, Artificial Sequence
  chemically synthesized
tgcctgttacccagttccaaag

SEQ ID NO: 1029979 - DNA, 22 bp, Artificial Sequence
  chemically synthesized
aacctctgcctgttacccagtt

SEQ ID NO: 1029980 - DNA, 22 bp, Artificial Sequence
  chemically synthesized
caacctctgcctgttacccagt

SEQ ID NO: 1029981 - DNA, 22 bp, Artificial Sequence
  chemically synthesized
tttcaacctctgcctgttaccc

SEQ ID NO: 1029982 - DNA, 22 bp, Artificial Sequence
  chemically synthesized
tggaactgggtaacaggcagag

SEQ ID NO: 1029983 - DNA, 22 bp, Artificial Sequence
  chemically synthesized
ggaactgggtaacaggcagagg

SEQ ID NO: 1029984 - DNA, 22 bp, Artificial Sequence
  chemically synthesized
gaactgggtaacaggcagaggt

SEQ ID NO: 1029985 - DNA, 22 bp, Artificial Sequence
  chemically synthesized
ccaactgtttcaacctctgcct

SEQ ID NO: 1029986 - DNA, 22 bp, Artificial Sequence
  chemically synthesized
ggtaacaggcagaggttgaaac

SEQ ID NO: 1029987 - DNA, 22 bp, Artificial Sequence
  chemically synthesized
agtcctcccaactgtttcaacc

SEQ ID NO: 1029988 - DNA, 22 bp, Artificial Sequence
  chemically synthesized
tgagtcctcccaactgtttcaa

SEQ ID NO: 1029989 - DNA, 22 bp, Artificial Sequence
  chemically synthesized
ctgagtcctcccaactgtttca

SEQ ID NO: 1029990 - DNA, 22 bp, Artificial Sequence
  chemically synthesized
ttctgagtcctcccaactgttt

SEQ ID NO: 1029991 - DNA, 22 bp, Artificial Sequence
  chemically synthesized
cttctgagtcctcccaactgtt

SEQ ID NO: 1029992 - DNA, 22 bp, Artificial Sequence
  chemically synthesized
tcttcttctgagtcctcccaac

SEQ ID NO: 1029993 - DNA, 22 bp, Artificial Sequence
  chemically synthesized
ctgtcttcttctgagtcctccc

SEQ ID NO: 1029994 - DNA, 22 bp, Artificial Sequence
  chemically synthesized
cctgtcttcttctgagtcctcc

SEQ ID NO: 1029995 - DNA, 22 bp, Artificial Sequence
  chemically synthesized
tcctgtcttcttctgagtcctc

SEQ ID NO: 1029996 - DNA, 22 bp, Artificial Sequence
  chemically synthesized
aaacagttgggaggactcagaa

SEQ ID NO: 1029997 - DNA, 22 bp, Artificial Sequence
  chemically synthesized
ccatactttcctgtcttcttct

SEQ ID NO: 1029998 - DNA, 22 bp, Artificial Sequence
  chemically synthesized
cccatactttcctgtcttcttc

SEQ ID NO: 1029999 - DNA, 22 bp, Artificial Sequence
  chemically synthesized
ggaggactcagaagaagacagg

SEQ ID NO: 1030000 - DNA, 22 bp, Artificial Sequence
  chemically synthesized
cagagtttcccatactttcctg

SEQ ID NO: 1030001 - DNA, 22 bp, Artificial Sequence
  chemically synthesized
agaagaagacaggaaagtatgg

SEQ ID NO: 1030002 - DNA, 22 bp, Artificial Sequence
  chemically synthesized
ggaagttccagagtttcccata

SEQ ID NO: 1030003 - DNA, 22 bp, Artificial Sequence
  chemically synthesized
taggaagttccagagtttccca

SEQ ID NO: 1030004 - DNA, 22 bp, Artificial Sequence
  chemically synthesized
tctaggaagttccagagtttcc

SEQ ID NO: 1030005 - DNA, 22 bp, Artificial Sequence
  chemically synthesized
caattctctaggaagttccaga

SEQ ID NO: 1030006 - DNA, 22 bp, Artificial Sequence
  chemically synthesized
acccctccaattctctaggaag

SEQ ID NO: 1030007 - DNA, 22 bp, Artificial Sequence
  chemically synthesized
tgacccctccaattctctagga

SEQ ID NO: 1030008 - DNA, 22 bp, Artificial Sequence
  chemically synthesized
ctgacccctccaattctctagg

SEQ ID NO: 1030009 - DNA, 22 bp, Artificial Sequence
  chemically synthesized
tggaacttcctagagaattgga

SEQ ID NO: 1030010 - DNA, 22 bp, Artificial Sequence
  chemically synthesized
tcttctgacccctccaattctc

SEQ ID NO: 1030011 - DNA, 22 bp, Artificial Sequence
  chemically synthesized
gaacttcctagagaattggagg

SEQ ID NO: 1030012 - DNA, 22 bp, Artificial Sequence
  chemically synthesized
ctgtcttctgacccctccaatt

SEQ ID NO: 1030013 - DNA, 22 bp, Artificial Sequence
  chemically synthesized
cctgtcttctgacccctccaat

SEQ ID NO: 1030014 - DNA, 22 bp, Artificial Sequence
  chemically synthesized
cctagagaattggaggggtcag

SEQ ID NO: 1030015 - DNA, 22 bp, Artificial Sequence
  chemically synthesized
ctagagaattggaggggtcaga

SEQ ID NO: 1030016 - DNA, 22 bp, Artificial Sequence
  chemically synthesized
gagaattggaggggtcagaaga

SEQ ID NO: 1030017 - DNA, 22 bp, Artificial Sequence
  chemically synthesized
ccacatcttcctgtcttctgac

SEQ ID NO: 1030018 - DNA, 22 bp, Artificial Sequence
  chemically synthesized
cccacatcttcctgtcttctga

SEQ ID NO: 1030019 - DNA, 22 bp, Artificial Sequence
  chemically synthesized
tcccacatcttcctgtcttctg

SEQ ID NO: 1030020 - DNA, 22 bp, Artificial Sequence
  chemically synthesized
gaggggtcagaagacaggaaga

SEQ ID NO: 1030021 - DNA, 22 bp, Artificial Sequence
  chemically synthesized
caaactttcccacatcttcctg

SEQ ID NO: 1030022 - DNA, 22 bp, Artificial Sequence
  chemically synthesized
ggaagttccaaactttcccaca

SEQ ID NO: 1030023 - DNA, 22 bp, Artificial Sequence
  chemically synthesized
taggaagttccaaactttccca

SEQ ID NO: 1030024 - DNA, 22 bp, Artificial Sequence
  chemically synthesized
aacaagtctctaggaagttcca

SEQ ID NO: 1030025 - DNA, 22 bp, Artificial Sequence
  chemically synthesized
ggaacttcctagagacttgttg

SEQ ID NO: 1030026 - DNA, 22 bp, Artificial Sequence
  chemically synthesized
gaacttcctagagacttgttga

SEQ ID NO: 1030027 - DNA, 22 bp, Artificial Sequence
  chemically synthesized
ggtcaaagccattcaacaagtc

SEQ ID NO: 1030028 - DNA, 22 bp, Artificial Sequence
  chemically synthesized
gggtcaaagccattcaacaagt

SEQ ID NO: 1030029 - DNA, 22 bp, Artificial Sequence
  chemically synthesized
cctagagacttgttgaatggct

SEQ ID NO: 1030030 - DNA, 22 bp, Artificial Sequence
  chemically synthesized
ctagagacttgttgaatggctt

SEQ ID NO: 1030031 - DNA, 22 bp, Artificial Sequence
  chemically synthesized
gagacttgttgaatggctttga

SEQ ID NO: 1030032 - DNA, 22 bp, Artificial Sequence
  chemically synthesized
tcagcatttgggtcaaagccat

SEQ ID NO: 1030033 - DNA, 22 bp, Artificial Sequence
  chemically synthesized
gttgaatggctttgacccaaat

SEQ ID NO: 1030034 - DNA, 22 bp, Artificial Sequence
  chemically synthesized
ttgaatggctttgacccaaatg

SEQ ID NO: 1030035 - DNA, 22 bp, Artificial Sequence
  chemically synthesized
aatggctttgacccaaatgctg

SEQ ID NO: 1030036 - DNA, 22 bp, Artificial Sequence
  chemically synthesized
tccatatcactatcagcatttg

SEQ ID NO: 1030037 - DNA, 22 bp, Artificial Sequence
  chemically synthesized
ttgtccatatcactatcagcat

SEQ ID NO: 1030038 - DNA, 22 bp, Artificial Sequence
  chemically synthesized
attgtccatatcactatcagca

SEQ ID NO: 1030039 - DNA, 22 bp, Artificial Sequence
  chemically synthesized
tattgtccatatcactatcagc

SEQ ID NO: 1030040 - DNA, 22 bp, Artificial Sequence
  chemically synthesized
tgacccaaatgctgatagtgat

SEQ ID NO: 1030041 - DNA, 22 bp, Artificial Sequence
  chemically synthesized
gacccaaatgctgatagtgata

SEQ ID NO: 1030042 - DNA, 22 bp, Artificial Sequence
  chemically synthesized
acccaaatgctgatagtgatat

SEQ ID NO: 1030043 - DNA, 22 bp, Artificial Sequence
  chemically synthesized
gactttattgtccatatcacta

SEQ ID NO: 1030044 - DNA, 22 bp, Artificial Sequence
  chemically synthesized
agtctggactttattgtccata

SEQ ID NO: 1030045 - DNA, 22 bp, Artificial Sequence
  chemically synthesized
atagtgatatggacaataaagt

SEQ ID NO: 1030046 - DNA, 22 bp, Artificial Sequence
  chemically synthesized
agaccacctcagtctggacttt

SEQ ID NO: 1030047 - DNA, 22 bp, Artificial Sequence
  chemically synthesized
tgagaccacctcagtctggact

SEQ ID NO: 1030048 - DNA, 22 bp, Artificial Sequence
  chemically synthesized
cctctgagaccacctcagtctg

SEQ ID NO: 1030049 - DNA, 22 bp, Artificial Sequence
  chemically synthesized
atctccctctgagaccacctca

SEQ ID NO: 1030050 - DNA, 22 bp, Artificial Sequence
  chemically synthesized
tcatctccctctgagaccacct

SEQ ID NO: 1030051 - DNA, 22 bp, Artificial Sequence
  chemically synthesized
ctcatctccctctgagaccacc

SEQ ID NO: 1030052 - DNA, 22 bp, Artificial Sequence
  chemically synthesized
aggtggtctcagagggagatga

SEQ ID NO: 1030053 - DNA, 22 bp, Artificial Sequence
  chemically synthesized
ccaagaagtttctcatctccct

SEQ ID NO: 1030054 - DNA, 22 bp, Artificial Sequence
  chemically synthesized
cagttaccaagaagtttctcat

SEQ ID NO: 1030055 - DNA, 22 bp, Artificial Sequence
  chemically synthesized
ctacagttaccaagaagtttct

SEQ ID NO: 1030056 - DNA, 22 bp, Artificial Sequence
  chemically synthesized
agagggagatgagaaacttctt

SEQ ID NO: 1030057 - DNA, 22 bp, Artificial Sequence
  chemically synthesized
actacagttaccaagaagtttc

SEQ ID NO: 1030058 - DNA, 22 bp, Artificial Sequence
  chemically synthesized
tactacagttaccaagaagttt

SEQ ID NO: 1030059 - DNA, 22 bp, Artificial Sequence
  chemically synthesized
cttggtaactgtagtaaaggtc

SEQ ID NO: 1030060 - DNA, 22 bp, Artificial Sequence
  chemically synthesized
ttggtaactgtagtaaaggtca

SEQ ID NO: 1030061 - DNA, 22 bp, Artificial Sequence
  chemically synthesized
ggtaactgtagtaaaggtcact

SEQ ID NO: 1030062 - DNA, 22 bp, Artificial Sequence
  chemically synthesized
aagcgtagcaaaagtgaccttt

SEQ ID NO: 1030063 - DNA, 22 bp, Artificial Sequence
  chemically synthesized
gtaactgtagtaaaggtcactt

SEQ ID NO: 1030064 - DNA, 22 bp, Artificial Sequence
  chemically synthesized
ctaaagcgtagcaaaagtgacc

SEQ ID NO: 1030065 - DNA, 22 bp, Artificial Sequence
  chemically synthesized
gctaaagcgtagcaaaagtgac

SEQ ID NO: 1030066 - DNA, 22 bp, Artificial Sequence
  chemically synthesized
tgctaaagcgtagcaaaagtga

SEQ ID NO: 1030067 - DNA, 22 bp, Artificial Sequence
  chemically synthesized
tttgctaaagcgtagcaaaagt

SEQ ID NO: 1030068 - DNA, 22 bp, Artificial Sequence
  chemically synthesized
tagtaaaggtcacttttgctac

SEQ ID NO: 1030069 - DNA, 22 bp, Artificial Sequence
  chemically synthesized
ttgctacgctttagcaaagaga

SEQ ID NO: 1030070 - DNA, 22 bp, Artificial Sequence
  chemically synthesized
tgctacgctttagcaaagagac

SEQ ID NO: 1030071 - DNA, 22 bp, Artificial Sequence
  chemically synthesized
gctacgctttagcaaagagact

SEQ ID NO: 1030072 - DNA, 22 bp, Artificial Sequence
  chemically synthesized
ctacgctttagcaaagagactg

SEQ ID NO: 1030073 - DNA, 22 bp, Artificial Sequence
  chemically synthesized
cgctttagcaaagagactggtg

SEQ ID NO: 1030074 - DNA, 22 bp, Artificial Sequence
  chemically synthesized
tagcaaagagactggtggcttt

SEQ ID NO: 1030075 - DNA, 22 bp, Artificial Sequence
  chemically synthesized
ggacaggggcaaaaagccacca

SEQ ID NO: 1030076 - DNA, 22 bp, Artificial Sequence
  chemically synthesized
agcaaagagactggtggctttt

SEQ ID NO: 1030077 - DNA, 22 bp, Artificial Sequence
  chemically synthesized
gcaaagagactggtggcttttt

SEQ ID NO: 1030078 - DNA, 22 bp, Artificial Sequence
  chemically synthesized
tcggacaggggcaaaaagccac

SEQ ID NO: 1030079 - DNA, 22 bp, Artificial Sequence
  chemically synthesized
cacagatctctcggacaggggc

SEQ ID NO: 1030080 - DNA, 22 bp, Artificial Sequence
  chemically synthesized
gtggctttttgcccctgtccga

SEQ ID NO: 1030081 - DNA, 22 bp, Artificial Sequence
  chemically synthesized
aaaattccacagatctctcgga

SEQ ID NO: 1030082 - DNA, 22 bp, Artificial Sequence
  chemically synthesized
tttgcccctgtccgagagatct

SEQ ID NO: 1030083 - DNA, 22 bp, Artificial Sequence
  chemically synthesized
ttgcccctgtccgagagatctg

SEQ ID NO: 1030084 - DNA, 22 bp, Artificial Sequence
  chemically synthesized
tgcccctgtccgagagatctgt

SEQ ID NO: 1030085 - DNA, 22 bp, Artificial Sequence
  chemically synthesized
gcccctgtccgagagatctgtg

SEQ ID NO: 1030086 - DNA, 22 bp, Artificial Sequence
  chemically synthesized
cccctgtccgagagatctgtgg

SEQ ID NO: 1030087 - DNA, 22 bp, Artificial Sequence
  chemically synthesized
atgttcaaaattccacagatct

SEQ ID NO: 1030088 - DNA, 22 bp, Artificial Sequence
  chemically synthesized
tcatgttcaaaattccacagat

SEQ ID NO: 1030089 - DNA, 22 bp, Artificial Sequence
  chemically synthesized
tctcatgttcaaaattccacag

SEQ ID NO: 1030090 - DNA, 22 bp, Artificial Sequence
  chemically synthesized
tccgagagatctgtggaatttt

SEQ ID NO: 1030091 - DNA, 22 bp, Artificial Sequence
  chemically synthesized
aatcatctctctcatgttcaaa

SEQ ID NO: 1030092 - DNA, 22 bp, Artificial Sequence
  chemically synthesized
tggaattttgaacatgagagag

SEQ ID NO: 1030093 - DNA, 22 bp, Artificial Sequence
  chemically synthesized
tgaacatgagagagatgattta

SEQ ID NO: 1030094 - DNA, 22 bp, Artificial Sequence
  chemically synthesized
caccagatgccctaaatcatct

SEQ ID NO: 1030095 - DNA, 22 bp, Artificial Sequence
  chemically synthesized
gaacatgagagagatgatttag

SEQ ID NO: 1030096 - DNA, 22 bp, Artificial Sequence
  chemically synthesized
ccaccagatgccctaaatcatc

SEQ ID NO: 1030097 - DNA, 22 bp, Artificial Sequence
  chemically synthesized
aacatgagagagatgatttagg

SEQ ID NO: 1030098 - DNA, 22 bp, Artificial Sequence
  chemically synthesized
cttccaccagatgccctaaatc

SEQ ID NO: 1030099 - DNA, 22 bp, Artificial Sequence
  chemically synthesized
gaaattccttccaccagatgcc

SEQ ID NO: 1030100 - DNA, 22 bp, Artificial Sequence
  chemically synthesized
agaaattccttccaccagatgc

SEQ ID NO: 1030101 - DNA, 22 bp, Artificial Sequence
  chemically synthesized
tttagaaattccttccaccaga

SEQ ID NO: 1030102 - DNA, 22 bp, Artificial Sequence
  chemically synthesized
ctgtttagaaattccttccacc

SEQ ID NO: 1030103 - DNA, 22 bp, Artificial Sequence
  chemically synthesized
gctgtttagaaattccttccac

SEQ ID NO: 1030104 - DNA, 22 bp, Artificial Sequence
  chemically synthesized
tgctgtttagaaattccttcca

SEQ ID NO: 1030105 - DNA, 22 bp, Artificial Sequence
  chemically synthesized
agggcatctggtggaaggaatt

SEQ ID NO: 1030106 - DNA, 22 bp, Artificial Sequence
  chemically synthesized
gggcatctggtggaaggaattt

SEQ ID NO: 1030107 - DNA, 22 bp, Artificial Sequence
  chemically synthesized
aacactttgctgtttagaaatt

SEQ ID NO: 1030108 - DNA, 22 bp, Artificial Sequence
  chemically synthesized
gaacactttgctgtttagaaat

SEQ ID NO: 1030109 - DNA, 22 bp, Artificial Sequence
  chemically synthesized
gtggaaggaatttctaaacagc

SEQ ID NO: 1030110 - DNA, 22 bp, Artificial Sequence
  chemically synthesized
ctaaacagcaaagtgttcaaga

SEQ ID NO: 1030111 - DNA, 22 bp, Artificial Sequence
  chemically synthesized
taaacagcaaagtgttcaagat

SEQ ID NO: 1030112 - DNA, 22 bp, Artificial Sequence
  chemically synthesized
aacagcaaagtgttcaagattt

SEQ ID NO: 1030113 - DNA, 22 bp, Artificial Sequence
  chemically synthesized
acagcacccaagtcaaatcttg

SEQ ID NO: 1030114 - DNA, 22 bp, Artificial Sequence
  chemically synthesized
aacagcacccaagtcaaatctt

SEQ ID NO: 1030115 - DNA, 22 bp, Artificial Sequence
  chemically synthesized
taacagcacccaagtcaaatct

SEQ ID NO: 1030116 - DNA, 22 bp, Artificial Sequence
  chemically synthesized
ttaacagcacccaagtcaaatc

SEQ ID NO: 1030117 - DNA, 22 bp, Artificial Sequence
  chemically synthesized
aatgcttttaacagcacccaag

SEQ ID NO: 1030118 - DNA, 22 bp, Artificial Sequence
  chemically synthesized
aagatttgacttgggtgctgtt

SEQ ID NO: 1030119 - DNA, 22 bp, Artificial Sequence
  chemically synthesized
gacttgggtgctgttaaaagca

SEQ ID NO: 1030120 - DNA, 22 bp, Artificial Sequence
  chemically synthesized
acttgggtgctgttaaaagcat

SEQ ID NO: 1030121 - DNA, 22 bp, Artificial Sequence
  chemically synthesized
gggtgctgttaaaagcattcag

SEQ ID NO: 1030122 - DNA, 22 bp, Artificial Sequence
  chemically synthesized
ggtgctgttaaaagcattcagt

SEQ ID NO: 1030123 - DNA, 22 bp, Artificial Sequence
  chemically synthesized
tggatacataaaactgaatgct

SEQ ID NO: 1030124 - DNA, 22 bp, Artificial Sequence
  chemically synthesized
gtggatacataaaactgaatgc

SEQ ID NO: 1030125 - DNA, 22 bp, Artificial Sequence
  chemically synthesized
tgtggatacataaaactgaatg

SEQ ID NO: 1030126 - DNA, 22 bp, Artificial Sequence
  chemically synthesized
ttaaaagcattcagttttatgt

SEQ ID NO: 1030127 - DNA, 22 bp, Artificial Sequence
  chemically synthesized
aaagcattcagttttatgtatc

SEQ ID NO: 1030128 - DNA, 22 bp, Artificial Sequence
  chemically synthesized
caaaccatatctttgtggatac

SEQ ID NO: 1030129 - DNA, 22 bp, Artificial Sequence
  chemically synthesized
agttttatgtatccacaaagat

SEQ ID NO: 1030130 - DNA, 22 bp, Artificial Sequence
  chemically synthesized
caattccaaaccatatctttgt

SEQ ID NO: 1030131 - DNA, 22 bp, Artificial Sequence
  chemically synthesized
ccaattccaaaccatatctttg

SEQ ID NO: 1030132 - DNA, 22 bp, Artificial Sequence
  chemically synthesized
tatgtatccacaaagatatggt

SEQ ID NO: 1030133 - DNA, 22 bp, Artificial Sequence
  chemically synthesized
atgtatccacaaagatatggtt

SEQ ID NO: 1030134 - DNA, 22 bp, Artificial Sequence
  chemically synthesized
tgtatccacaaagatatggttt

SEQ ID NO: 1030135 - DNA, 22 bp, Artificial Sequence
  chemically synthesized
aacataatttccaattccaaac

SEQ ID NO: 1030136 - DNA, 22 bp, Artificial Sequence
  chemically synthesized
aaacataatttccaattccaaa

SEQ ID NO: 1030137 - DNA, 22 bp, Artificial Sequence
  chemically synthesized
taaacataatttccaattccaa

SEQ ID NO: 1030138 - DNA, 22 bp, Artificial Sequence
  chemically synthesized
ttaaacataatttccaattcca

SEQ ID NO: 1030139 - DNA, 22 bp, Artificial Sequence
  chemically synthesized
ccttttaaacataatttccaat

SEQ ID NO: 1030140 - DNA, 22 bp, Artificial Sequence
  chemically synthesized
cccttttaaacataatttccaa

SEQ ID NO: 1030141 - DNA, 22 bp, Artificial Sequence
  chemically synthesized
cttcccttttaaacataatttc

SEQ ID NO: 1030142 - DNA, 22 bp, Artificial Sequence
  chemically synthesized
tgcttcccttttaaacataatt

SEQ ID NO: 1030143 - DNA, 22 bp, Artificial Sequence
  chemically synthesized
ggaattggaaattatgtttaaa

SEQ ID NO: 1030144 - DNA, 22 bp, Artificial Sequence
  chemically synthesized
gaattggaaattatgtttaaaa

SEQ ID NO: 1030145 - DNA, 22 bp, Artificial Sequence
  chemically synthesized
tgctctgcttcccttttaaaca

SEQ ID NO: 1030146 - DNA, 22 bp, Artificial Sequence
  chemically synthesized
atgctctgcttcccttttaaac

SEQ ID NO: 1030147 - DNA, 22 bp, Artificial Sequence
  chemically synthesized
tatgctctgcttcccttttaaa

SEQ ID NO: 1030148 - DNA, 22 bp, Artificial Sequence
  chemically synthesized
ttatgctctgcttcccttttaa

SEQ ID NO: 1030149 - DNA, 22 bp, Artificial Sequence
  chemically synthesized
gaaattatgtttaaaagggaag

SEQ ID NO: 1030150 - DNA, 22 bp, Artificial Sequence
  chemically synthesized
aacttttatgctctgcttccct

SEQ ID NO: 1030151 - DNA, 22 bp, Artificial Sequence
  chemically synthesized
tgaacttttatgctctgcttcc

SEQ ID NO: 1030152 - DNA, 22 bp, Artificial Sequence
  chemically synthesized
ctgaacttttatgctctgcttc

SEQ ID NO: 1030153 - DNA, 22 bp, Artificial Sequence
  chemically synthesized
tgtttaaaagggaagcagagca

SEQ ID NO: 1030154 - DNA, 22 bp, Artificial Sequence
  chemically synthesized
tctgaacttttatgctctgctt

SEQ ID NO: 1030155 - DNA, 22 bp, Artificial Sequence
  chemically synthesized
aaaagggaagcagagcataaaa

SEQ ID NO: 1030156 - DNA, 22 bp, Artificial Sequence
  chemically synthesized
aaagggaagcagagcataaaag

SEQ ID NO: 1030157 - DNA, 22 bp, Artificial Sequence
  chemically synthesized
caaattttctgaacttttatgc

SEQ ID NO: 1030158 - DNA, 22 bp, Artificial Sequence
  chemically synthesized
aggctgcaaattttctgaactt

SEQ ID NO: 1030159 - DNA, 22 bp, Artificial Sequence
  chemically synthesized
caggctgcaaattttctgaact

SEQ ID NO: 1030160 - DNA, 22 bp, Artificial Sequence
  chemically synthesized
catcttcaggctgcaaattttc

SEQ ID NO: 1030161 - DNA, 22 bp, Artificial Sequence
  chemically synthesized
ttgcatcttcaggctgcaaatt

SEQ ID NO: 1030162 - DNA, 22 bp, Artificial Sequence
  chemically synthesized
tattgcatcttcaggctgcaaa

SEQ ID NO: 1030163 - DNA, 22 bp, Artificial Sequence
  chemically synthesized
ctattgcatcttcaggctgcaa

SEQ ID NO: 1030164 - DNA, 22 bp, Artificial Sequence
  chemically synthesized
tctattgcatcttcaggctgca

SEQ ID NO: 1030165 - DNA, 22 bp, Artificial Sequence
  chemically synthesized
ttctattgcatcttcaggctgc

SEQ ID NO: 1030166 - DNA, 22 bp, Artificial Sequence
  chemically synthesized
ttttctattgcatcttcaggct

SEQ ID NO: 1030167 - DNA, 22 bp, Artificial Sequence
  chemically synthesized
agaaaatttgcagcctgaagat

SEQ ID NO: 1030168 - DNA, 22 bp, Artificial Sequence
  chemically synthesized
cttttctattgcatcttcaggc

SEQ ID NO: 1030169 - DNA, 22 bp, Artificial Sequence
  chemically synthesized
tcttttctattgcatcttcagg

SEQ ID NO: 1030170 - DNA, 22 bp, Artificial Sequence
  chemically synthesized
ttcttttctattgcatcttcag

SEQ ID NO: 1030171 - DNA, 22 bp, Artificial Sequence
  chemically synthesized
gcagcctgaagatgcaatagaa

SEQ ID NO: 1030172 - DNA, 22 bp, Artificial Sequence
  chemically synthesized
cagcctgaagatgcaatagaaa

SEQ ID NO: 1030173 - DNA, 22 bp, Artificial Sequence
  chemically synthesized
agaaaatgagtttttcttttct

SEQ ID NO: 1030174 - DNA, 22 bp, Artificial Sequence
  chemically synthesized
aagatgcaatagaaaagaaaaa

SEQ ID NO: 1030175 - DNA, 22 bp, Artificial Sequence
  chemically synthesized
ctcagaaaatgagtttttcttt

SEQ ID NO: 1030176 - DNA, 22 bp, Artificial Sequence
  chemically synthesized
tcctcagaaaatgagtttttct

SEQ ID NO: 1030177 - DNA, 22 bp, Artificial Sequence
  chemically synthesized
ctcctcagaaaatgagtttttc

SEQ ID NO: 1030178 - DNA, 22 bp, Artificial Sequence
  chemically synthesized
aatttctcctcagaaaatgagt

SEQ ID NO: 1030179 - DNA, 22 bp, Artificial Sequence
  chemically synthesized
tagtcagattgaatttctcctc

SEQ ID NO: 1030180 - DNA, 22 bp, Artificial Sequence
  chemically synthesized
tgtagtcagattgaatttctcc

SEQ ID NO: 1030181 - DNA, 22 bp, Artificial Sequence
  chemically synthesized
ctgtagtcagattgaatttctc

SEQ ID NO: 1030182 - DNA, 22 bp, Artificial Sequence
  chemically synthesized
attttctgaggagaaattcaat

SEQ ID NO: 1030183 - DNA, 22 bp, Artificial Sequence
  chemically synthesized
tctgaggagaaattcaatctga

SEQ ID NO: 1030184 - DNA, 22 bp, Artificial Sequence
  chemically synthesized
ctgaggagaaattcaatctgac

SEQ ID NO: 1030185 - DNA, 22 bp, Artificial Sequence
  chemically synthesized
tgaggagaaattcaatctgact

SEQ ID NO: 1030186 - DNA, 22 bp, Artificial Sequence
  chemically synthesized
aggagaaattcaatctgactac

SEQ ID NO: 1030187 - DNA, 22 bp, Artificial Sequence
  chemically synthesized
catatgcaaatttctgtagtca

SEQ ID NO: 1030188 - DNA, 22 bp, Artificial Sequence
  chemically synthesized
gttacatatgcaaatttctgta

SEQ ID NO: 1030189 - DNA, 22 bp, Artificial Sequence
  chemically synthesized
ctcgttacatatgcaaatttct

SEQ ID NO: 1030190 - DNA, 22 bp, Artificial Sequence
  chemically synthesized
aatctgactacagaaatttgca

SEQ ID NO: 1030191 - DNA, 22 bp, Artificial Sequence
  chemically synthesized
gctcctcgttacatatgcaaat

SEQ ID NO: 1030192 - DNA, 22 bp, Artificial Sequence
  chemically synthesized
ggctcctcgttacatatgcaaa

SEQ ID NO: 1030193 - DNA, 22 bp, Artificial Sequence
  chemically synthesized
actacagaaatttgcatatgta

SEQ ID NO: 1030194 - DNA, 22 bp, Artificial Sequence
  chemically synthesized
cagaaatttgcatatgtaacga

SEQ ID NO: 1030195 - DNA, 22 bp, Artificial Sequence
  chemically synthesized
acatttggctcctcgttacata

SEQ ID NO: 1030196 - DNA, 22 bp, Artificial Sequence
  chemically synthesized
gtgattaacatttggctcctcg

SEQ ID NO: 1030197 - DNA, 22 bp, Artificial Sequence
  chemically synthesized
ggtgattaacatttggctcctc

SEQ ID NO: 1030198 - DNA, 22 bp, Artificial Sequence
  chemically synthesized
gcatatgtaacgaggagccaaa

SEQ ID NO: 1030199 - DNA, 22 bp, Artificial Sequence
  chemically synthesized
catatgtaacgaggagccaaat

SEQ ID NO: 1030200 - DNA, 22 bp, Artificial Sequence
  chemically synthesized
ccttggtgattaacatttggct

SEQ ID NO: 1030201 - DNA, 22 bp, Artificial Sequence
  chemically synthesized
ccattgccttggtgattaacat

SEQ ID NO: 1030202 - DNA, 22 bp, Artificial Sequence
  chemically synthesized
cccattgccttggtgattaaca

SEQ ID NO: 1030203 - DNA, 22 bp, Artificial Sequence
  chemically synthesized
tcccattgccttggtgattaac

SEQ ID NO: 1030204 - DNA, 22 bp, Artificial Sequence
  chemically synthesized
gagacaattttcccattgcctt

SEQ ID NO: 1030205 - DNA, 22 bp, Artificial Sequence
  chemically synthesized
ctggagacaattttcccattgc

SEQ ID NO: 1030206 - DNA, 22 bp, Artificial Sequence
  chemically synthesized
cctggagacaattttcccattg

SEQ ID NO: 1030207 - DNA, 22 bp, Artificial Sequence
  chemically synthesized
atcaccaaggcaatgggaaaat

SEQ ID NO: 1030208 - DNA, 22 bp, Artificial Sequence
  chemically synthesized
gcatttcctggagacaattttc

SEQ ID NO: 1030209 - DNA, 22 bp, Artificial Sequence
  chemically synthesized
tggcatttcctggagacaattt

SEQ ID NO: 1030210 - DNA, 22 bp, Artificial Sequence
  chemically synthesized
ctggcatttcctggagacaatt

SEQ ID NO: 1030211 - DNA, 22 bp, Artificial Sequence
  chemically synthesized
ccatgaaaacttctggcatttc

SEQ ID NO: 1030212 - DNA, 22 bp, Artificial Sequence
  chemically synthesized
tctccaggaaatgccagaagtt

SEQ ID NO: 1030213 - DNA, 22 bp, Artificial Sequence
  chemically synthesized
caggaaatgccagaagttttca

SEQ ID NO: 1030214 - DNA, 22 bp, Artificial Sequence
  chemically synthesized
tgatgggaggggctgccatgaa

SEQ ID NO: 1030215 - DNA, 22 bp, Artificial Sequence
  chemically synthesized
gtcctatgatgggaggggctgc

SEQ ID NO: 1030216 - DNA, 22 bp, Artificial Sequence
  chemically synthesized
tggtcctatgatgggaggggct

SEQ ID NO: 1030217 - DNA, 22 bp, Artificial Sequence
  chemically synthesized
tcatggcagcccctcccatcat

SEQ ID NO: 1030218 - DNA, 22 bp, Artificial Sequence
  chemically synthesized
catggcagcccctcccatcata

SEQ ID NO: 1030219 - DNA, 22 bp, Artificial Sequence
  chemically synthesized
ggcctctggtcctatgatggga

SEQ ID NO: 1030220 - DNA, 22 bp, Artificial Sequence
  chemically synthesized
atggcagcccctcccatcatag

SEQ ID NO: 1030221 - DNA, 22 bp, Artificial Sequence
  chemically synthesized
ctaggcctctggtcctatgatg

SEQ ID NO: 1030222 - DNA, 22 bp, Artificial Sequence
  chemically synthesized
cctaggcctctggtcctatgat

SEQ ID NO: 1030223 - DNA, 22 bp, Artificial Sequence
  chemically synthesized
ccttcctaggcctctggtccta

SEQ ID NO: 1030224 - DNA, 22 bp, Artificial Sequence
  chemically synthesized
gccttcctaggcctctggtcct

SEQ ID NO: 1030225 - DNA, 22 bp, Artificial Sequence
  chemically synthesized
tgccttcctaggcctctggtcc

SEQ ID NO: 1030226 - DNA, 22 bp, Artificial Sequence
  chemically synthesized
ccatcataggaccagaggccta

SEQ ID NO: 1030227 - DNA, 22 bp, Artificial Sequence
  chemically synthesized
ggcccggcccaggaaaccattt

SEQ ID NO: 1030228 - DNA, 22 bp, Artificial Sequence
  chemically synthesized
tgggcccggcccaggaaaccat

SEQ ID NO: 1030229 - DNA, 22 bp, Artificial Sequence
  chemically synthesized
ggaaggcaaaatggtttcctgg

SEQ ID NO: 1030230 - DNA, 22 bp, Artificial Sequence
  chemically synthesized
cacatagcaggggggctctggg

SEQ ID NO: 1030231 - DNA, 22 bp, Artificial Sequence
  chemically synthesized
cctgggccgggcccagagcccc

SEQ ID NO: 1030232 - DNA, 22 bp, Artificial Sequence
  chemically synthesized
ctgggccgggcccagagccccc

SEQ ID NO: 1030233 - DNA, 22 bp, Artificial Sequence
  chemically synthesized
ggccgggcccagagcccccctg

SEQ ID NO: 1030234 - DNA, 22 bp, Artificial Sequence
  chemically synthesized
ggctgcacatagcaggggggct

SEQ ID NO: 1030235 - DNA, 22 bp, Artificial Sequence
  chemically synthesized
gtccctaggctgcacatagcag

SEQ ID NO: 1030236 - DNA, 22 bp, Artificial Sequence
  chemically synthesized
ctatgtgcagcctagggactag

SEQ ID NO: 1030237 - DNA, 22 bp, Artificial Sequence
  chemically synthesized
ggatgcagggcacctagtccct

SEQ ID NO: 1030238 - DNA, 22 bp, Artificial Sequence
  chemically synthesized
tgtgcagcctagggactaggtg

SEQ ID NO: 1030239 - DNA, 22 bp, Artificial Sequence
  chemically synthesized
gagtggctgggatgcagggcac

SEQ ID NO: 1030240 - DNA, 22 bp, Artificial Sequence
  chemically synthesized
gggactaggtgccctgcatccc

SEQ ID NO: 1030241 - DNA, 22 bp, Artificial Sequence
  chemically synthesized
gccatggctggagtggctggga

SEQ ID NO: 1030242 - DNA, 22 bp, Artificial Sequence
  chemically synthesized
ggtgccctgcatcccagccact

SEQ ID NO: 1030243 - DNA, 22 bp, Artificial Sequence
  chemically synthesized
agccatggctggagtggctggg

SEQ ID NO: 1030244 - DNA, 22 bp, Artificial Sequence
  chemically synthesized
tagccatggctggagtggctgg

SEQ ID NO: 1030245 - DNA, 22 bp, Artificial Sequence
  chemically synthesized
ttagccatggctggagtggctg

SEQ ID NO: 1030246 - DNA, 22 bp, Artificial Sequence
  chemically synthesized
cttttagccatggctggagtgg

SEQ ID NO: 1030247 - DNA, 22 bp, Artificial Sequence
  chemically synthesized
catcccagccactccagccatg

SEQ ID NO: 1030248 - DNA, 22 bp, Artificial Sequence
  chemically synthesized
gctccttttagccatggctgga

SEQ ID NO: 1030249 - DNA, 22 bp, Artificial Sequence
  chemically synthesized
ggctccttttagccatggctgg

SEQ ID NO: 1030250 - DNA, 22 bp, Artificial Sequence
  chemically synthesized
tcttggctccttttagccatgg

SEQ ID NO: 1030251 - DNA, 22 bp, Artificial Sequence
  chemically synthesized
tatcttggctccttttagccat

SEQ ID NO: 1030252 - DNA, 22 bp, Artificial Sequence
  chemically synthesized
agctctatcttggctcctttta

SEQ ID NO: 1030253 - DNA, 22 bp, Artificial Sequence
  chemically synthesized
cagccatggctaaaaggagcca

SEQ ID NO: 1030254 - DNA, 22 bp, Artificial Sequence
  chemically synthesized
tagccatgggctgagctctatc

SEQ ID NO: 1030255 - DNA, 22 bp, Artificial Sequence
  chemically synthesized
aaaggagccaagatagagctca

SEQ ID NO: 1030256 - DNA, 22 bp, Artificial Sequence
  chemically synthesized
tgtagccatgggctgagctcta

SEQ ID NO: 1030257 - DNA, 22 bp, Artificial Sequence
  chemically synthesized
caccctctgtagccatgggctg

SEQ ID NO: 1030258 - DNA, 22 bp, Artificial Sequence
  chemically synthesized
gcaccctctgtagccatgggct

SEQ ID NO: 1030259 - DNA, 22 bp, Artificial Sequence
  chemically synthesized
gggcttgcaccctctgtagcca

SEQ ID NO: 1030260 - DNA, 22 bp, Artificial Sequence
  chemically synthesized
ggggcttgcaccctctgtagcc

SEQ ID NO: 1030261 - DNA, 22 bp, Artificial Sequence
  chemically synthesized
agcccatggctacagagggtgc

SEQ ID NO: 1030262 - DNA, 22 bp, Artificial Sequence
  chemically synthesized
ccaaatcttggggcttgcaccc

SEQ ID NO: 1030263 - DNA, 22 bp, Artificial Sequence
  chemically synthesized
cagagggtgcaagccccaagat

SEQ ID NO: 1030264 - DNA, 22 bp, Artificial Sequence
  chemically synthesized
aacaccacatggaagctgccaa

SEQ ID NO: 1030265 - DNA, 22 bp, Artificial Sequence
  chemically synthesized
ggcagcttccatgtggtgttga

SEQ ID NO: 1030266 - DNA, 22 bp, Artificial Sequence
  chemically synthesized
gcagcttccatgtggtgttgag

SEQ ID NO: 1030267 - DNA, 22 bp, Artificial Sequence
  chemically synthesized
tgtacccacaggctcaacacca

SEQ ID NO: 1030268 - DNA, 22 bp, Artificial Sequence
  chemically synthesized
tgtgtacccacaggctcaacac

SEQ ID NO: 1030269 - DNA, 22 bp, Artificial Sequence
  chemically synthesized
ctgtgtacccacaggctcaaca

SEQ ID NO: 1030270 - DNA, 22 bp, Artificial Sequence
  chemically synthesized
ccatgtggtgttgagcctgtgg

SEQ ID NO: 1030271 - DNA, 22 bp, Artificial Sequence
  chemically synthesized
acttctgtgtacccacaggctc

SEQ ID NO: 1030272 - DNA, 22 bp, Artificial Sequence
  chemically synthesized
catgtggtgttgagcctgtggg

SEQ ID NO: 1030273 - DNA, 22 bp, Artificial Sequence
  chemically synthesized
gacttctgtgtacccacaggct

SEQ ID NO: 1030274 - DNA, 22 bp, Artificial Sequence
  chemically synthesized
ttgacttctgtgtacccacagg

SEQ ID NO: 1030275 - DNA, 22 bp, Artificial Sequence
  chemically synthesized
agttcttgacttctgtgtaccc

SEQ ID NO: 1030276 - DNA, 22 bp, Artificial Sequence
  chemically synthesized
agcctgtgggtacacagaagtc

SEQ ID NO: 1030277 - DNA, 22 bp, Artificial Sequence
  chemically synthesized
ccaaagctcagttcttgacttc

SEQ ID NO: 1030278 - DNA, 22 bp, Artificial Sequence
  chemically synthesized
tgggtacacagaagtcaagaac

SEQ ID NO: 1030279 - DNA, 22 bp, Artificial Sequence
  chemically synthesized
ggtagaagttcccaaagctcag

SEQ ID NO: 1030280 - DNA, 22 bp, Artificial Sequence
  chemically synthesized
aaatctaggtagaagttcccaa

SEQ ID NO: 1030281 - DNA, 22 bp, Artificial Sequence
  chemically synthesized
tgaaatctaggtagaagttccc

SEQ ID NO: 1030282 - DNA, 22 bp, Artificial Sequence
  chemically synthesized
agctttgggaacttctacctag

SEQ ID NO: 1030283 - DNA, 22 bp, Artificial Sequence
  chemically synthesized
tgggaacttctacctagatttc

SEQ ID NO: 1030284 - DNA, 22 bp, Artificial Sequence
  chemically synthesized
catatatcctctgaaatctagg

SEQ ID NO: 1030285 - DNA, 22 bp, Artificial Sequence
  chemically synthesized
gggaacttctacctagatttca

SEQ ID NO: 1030286 - DNA, 22 bp, Artificial Sequence
  chemically synthesized
ccatatatcctctgaaatctag

SEQ ID NO: 1030287 - DNA, 22 bp, Artificial Sequence
  chemically synthesized
ggaacttctacctagatttcag

SEQ ID NO: 1030288 - DNA, 22 bp, Artificial Sequence
  chemically synthesized
gacatttccatatatcctctga

SEQ ID NO: 1030289 - DNA, 22 bp, Artificial Sequence
  chemically synthesized
ctacctagatttcagaggatat

SEQ ID NO: 1030290 - DNA, 22 bp, Artificial Sequence
  chemically synthesized
tacctagatttcagaggatata

SEQ ID NO: 1030291 - DNA, 22 bp, Artificial Sequence
  chemically synthesized
cctagatttcagaggatatatg

SEQ ID NO: 1030292 - DNA, 22 bp, Artificial Sequence
  chemically synthesized
gatttcagaggatatatggaaa

SEQ ID NO: 1030293 - DNA, 22 bp, Artificial Sequence
  chemically synthesized
gatatctagacatttccatata

SEQ ID NO: 1030294 - DNA, 22 bp, Artificial Sequence
  chemically synthesized
cctggatatctagacatttcca

SEQ ID NO: 1030295 - DNA, 22 bp, Artificial Sequence
  chemically synthesized
cagaggatatatggaaatgtct

SEQ ID NO: 1030296 - DNA, 22 bp, Artificial Sequence
  chemically synthesized
agaggatatatggaaatgtcta

SEQ ID NO: 1030297 - DNA, 22 bp, Artificial Sequence
  chemically synthesized
tgcctggatatctagacatttc

SEQ ID NO: 1030298 - DNA, 22 bp, Artificial Sequence
  chemically synthesized
ctgcctggatatctagacattt

SEQ ID NO: 1030299 - DNA, 22 bp, Artificial Sequence
  chemically synthesized
cagcaaacttctgcctggatat

SEQ ID NO: 1030300 - DNA, 22 bp, Artificial Sequence
  chemically synthesized
tgcagcaaacttctgcctggat

SEQ ID NO: 1030301 - DNA, 22 bp, Artificial Sequence
  chemically synthesized
gatatccaggcagaagtttgct

SEQ ID NO: 1030302 - DNA, 22 bp, Artificial Sequence
  chemically synthesized
agggccccatctctgcagcaaa

SEQ ID NO: 1030303 - DNA, 22 bp, Artificial Sequence
  chemically synthesized
tgagggccccatctctgcagca

SEQ ID NO: 1030304 - DNA, 22 bp, Artificial Sequence
  chemically synthesized
tctgagggccccatctctgcag

SEQ ID NO: 1030305 - DNA, 22 bp, Artificial Sequence
  chemically synthesized
tctctgagggccccatctctgc

SEQ ID NO: 1030306 - DNA, 22 bp, Artificial Sequence
  chemically synthesized
gctgcagagatggggccctcag

SEQ ID NO: 1030307 - DNA, 22 bp, Artificial Sequence
  chemically synthesized
ctgcagagatggggccctcaga

SEQ ID NO: 1030308 - DNA, 22 bp, Artificial Sequence
  chemically synthesized
gtagaggttctctctgagggcc

SEQ ID NO: 1030309 - DNA, 22 bp, Artificial Sequence
  chemically synthesized
cagagatggggccctcagagag

SEQ ID NO: 1030310 - DNA, 22 bp, Artificial Sequence
  chemically synthesized
acctagtagaggttctctctga

SEQ ID NO: 1030311 - DNA, 22 bp, Artificial Sequence
  chemically synthesized
cactgacctagtagaggttctc

SEQ ID NO: 1030312 - DNA, 22 bp, Artificial Sequence
  chemically synthesized
tgcactgacctagtagaggttc

SEQ ID NO: 1030313 - DNA, 22 bp, Artificial Sequence
  chemically synthesized
ctgcactgacctagtagaggtt

SEQ ID NO: 1030314 - DNA, 22 bp, Artificial Sequence
  chemically synthesized
ttctgcactgacctagtagagg

SEQ ID NO: 1030315 - DNA, 22 bp, Artificial Sequence
  chemically synthesized
tcttctgcactgacctagtaga

SEQ ID NO: 1030316 - DNA, 22 bp, Artificial Sequence
  chemically synthesized
ctcttctgcactgacctagtag

SEQ ID NO: 1030317 - DNA, 22 bp, Artificial Sequence
  chemically synthesized
agagagaacctctactaggtca

SEQ ID NO: 1030318 - DNA, 22 bp, Artificial Sequence
  chemically synthesized
tactaggtcagtgcagaagaga

SEQ ID NO: 1030319 - DNA, 22 bp, Artificial Sequence
  chemically synthesized
caaccccacatttctcttctgc

SEQ ID NO: 1030320 - DNA, 22 bp, Artificial Sequence
  chemically synthesized
ctaggtcagtgcagaagagaaa

SEQ ID NO: 1030321 - DNA, 22 bp, Artificial Sequence
  chemically synthesized
ggtcagtgcagaagagaaatgt

SEQ ID NO: 1030322 - DNA, 22 bp, Artificial Sequence
  chemically synthesized
tgtgggggctccaaccccacat

SEQ ID NO: 1030323 - DNA, 22 bp, Artificial Sequence
  chemically synthesized
tatgtgggggctccaaccccac

SEQ ID NO: 1030324 - DNA, 22 bp, Artificial Sequence
  chemically synthesized
gagcccccacatagagtcccca

SEQ ID NO: 1030325 - DNA, 22 bp, Artificial Sequence
  chemically synthesized
ggcagtgccccagtggggactc

SEQ ID NO: 1030326 - DNA, 22 bp, Artificial Sequence
  chemically synthesized
ctaggcagtgccccagtgggga

SEQ ID NO: 1030327 - DNA, 22 bp, Artificial Sequence
  chemically synthesized
tactaggcagtgccccagtggg

SEQ ID NO: 1030328 - DNA, 22 bp, Artificial Sequence
  chemically synthesized
acagctctactaggcagtgccc

SEQ ID NO: 1030329 - DNA, 22 bp, Artificial Sequence
  chemically synthesized
tcacagctctactaggcagtgc

SEQ ID NO: 1030330 - DNA, 22 bp, Artificial Sequence
  chemically synthesized
ctcacagctctactaggcagtg

SEQ ID NO: 1030331 - DNA, 22 bp, Artificial Sequence
  chemically synthesized
ttctcacagctctactaggcag

SEQ ID NO: 1030332 - DNA, 22 bp, Artificial Sequence
  chemically synthesized
gggcactgcctagtagagctgt

SEQ ID NO: 1030333 - DNA, 22 bp, Artificial Sequence
  chemically synthesized
cctagtagagctgtgagaagag

SEQ ID NO: 1030334 - DNA, 22 bp, Artificial Sequence
  chemically synthesized
gtagagctgtgagaagagggct

SEQ ID NO: 1030335 - DNA, 22 bp, Artificial Sequence
  chemically synthesized
catgcacacggtggatcaagcc

SEQ ID NO: 1030336 - DNA, 22 bp, Artificial Sequence
  chemically synthesized
tgagaagagggcttgatccacc

SEQ ID NO: 1030337 - DNA, 22 bp, Artificial Sequence
  chemically synthesized
ttccatgcacacggtggatcaa

SEQ ID NO: 1030338 - DNA, 22 bp, Artificial Sequence
  chemically synthesized
tggctgttccatgcacacggtg

SEQ ID NO: 1030339 - DNA, 22 bp, Artificial Sequence
  chemically synthesized
gatccaccgtgtgcatggaaca

SEQ ID NO: 1030340 - DNA, 22 bp, Artificial Sequence
  chemically synthesized
agtgtctgtggctgttccatgc

SEQ ID NO: 1030341 - DNA, 22 bp, Artificial Sequence
  chemically synthesized
atccaccgtgtgcatggaacag

SEQ ID NO: 1030342 - DNA, 22 bp, Artificial Sequence
  chemically synthesized
gcattgagtgtctgtggctgtt

SEQ ID NO: 1030343 - DNA, 22 bp, Artificial Sequence
  chemically synthesized
acaggctagcattgagtgtctg

SEQ ID NO: 1030344 - DNA, 22 bp, Artificial Sequence
  chemically synthesized
cacaggctagcattgagtgtct

SEQ ID NO: 1030345 - DNA, 22 bp, Artificial Sequence
  chemically synthesized
tcacaggctagcattgagtgtc

SEQ ID NO: 1030346 - DNA, 22 bp, Artificial Sequence
  chemically synthesized
ctttcacaggctagcattgagt

SEQ ID NO: 1030347 - DNA, 22 bp, Artificial Sequence
  chemically synthesized
gctgctttcacaggctagcatt

SEQ ID NO: 1030348 - DNA, 22 bp, Artificial Sequence
  chemically synthesized
ctggctgctttcacaggctagc

SEQ ID NO: 1030349 - DNA, 22 bp, Artificial Sequence
  chemically synthesized
cctggctgctttcacaggctag

SEQ ID NO: 1030350 - DNA, 22 bp, Artificial Sequence
  chemically synthesized
aatgctagcctgtgaaagcagc

SEQ ID NO: 1030351 - DNA, 22 bp, Artificial Sequence
  chemically synthesized
gcctgtgaaagcagccaggaag

SEQ ID NO: 1030352 - DNA, 22 bp, Artificial Sequence
  chemically synthesized
cagggtacagcccccttcctgg

SEQ ID NO: 1030353 - DNA, 22 bp, Artificial Sequence
  chemically synthesized
tgaaagcagccaggaagggggc

SEQ ID NO: 1030354 - DNA, 22 bp, Artificial Sequence
  chemically synthesized
gcgttgcagggtacagccccct

SEQ ID NO: 1030355 - DNA, 22 bp, Artificial Sequence
  chemically synthesized
ggcgttgcagggtacagccccc

SEQ ID NO: 1030356 - DNA, 22 bp, Artificial Sequence
  chemically synthesized
tggcgttgcagggtacagcccc

SEQ ID NO: 1030357 - DNA, 22 bp, Artificial Sequence
  chemically synthesized
ctttggcgttgcagggtacagc

SEQ ID NO: 1030358 - DNA, 22 bp, Artificial Sequence
  chemically synthesized
cactcctttggcgttgcagggt

SEQ ID NO: 1030359 - DNA, 22 bp, Artificial Sequence
  chemically synthesized
ggtagctccactcctttggcgt

SEQ ID NO: 1030360 - DNA, 22 bp, Artificial Sequence
  chemically synthesized
gggtagctccactcctttggcg

SEQ ID NO: 1030361 - DNA, 22 bp, Artificial Sequence
  chemically synthesized
taccctgcaacgccaaaggagt

SEQ ID NO: 1030362 - DNA, 22 bp, Artificial Sequence
  chemically synthesized
caacgccaaaggagtggagcta

SEQ ID NO: 1030363 - DNA, 22 bp, Artificial Sequence
  chemically synthesized
ccacagccttgggtagctccac

SEQ ID NO: 1030364 - DNA, 22 bp, Artificial Sequence
  chemically synthesized
atgcaaggtgggctcccacagc

SEQ ID NO: 1030365 - DNA, 22 bp, Artificial Sequence
  chemically synthesized
cccaaggctgtgggagcccacc

SEQ ID NO: 1030366 - DNA, 22 bp, Artificial Sequence
  chemically synthesized
tgggagcccaccttgcatcagc

SEQ ID NO: 1030367 - DNA, 22 bp, Artificial Sequence
  chemically synthesized
acatccaggtcacgctgatgca

SEQ ID NO: 1030368 - DNA, 22 bp, Artificial Sequence
  chemically synthesized
tgtctcacatccaggtcacgct

SEQ ID NO: 1030369 - DNA, 22 bp, Artificial Sequence
  chemically synthesized
tgtgtctcacatccaggtcacg

SEQ ID NO: 1030370 - DNA, 22 bp, Artificial Sequence
  chemically synthesized
actctgtgtctcacatccaggt

SEQ ID NO: 1030371 - DNA, 22 bp, Artificial Sequence
  chemically synthesized
gcatcagcgtgacctggatgtg

SEQ ID NO: 1030372 - DNA, 22 bp, Artificial Sequence
  chemically synthesized
gactctgtgtctcacatccagg

SEQ ID NO: 1030373 - DNA, 22 bp, Artificial Sequence
  chemically synthesized
catcagcgtgacctggatgtga

SEQ ID NO: 1030374 - DNA, 22 bp, Artificial Sequence
  chemically synthesized
tgactctgtgtctcacatccag

SEQ ID NO: 1030375 - DNA, 22 bp, Artificial Sequence
  chemically synthesized
ctttgactctgtgtctcacatc

SEQ ID NO: 1030376 - DNA, 22 bp, Artificial Sequence
  chemically synthesized
gatgtgagacacagagtcaaag

SEQ ID NO: 1030377 - DNA, 22 bp, Artificial Sequence
  chemically synthesized
caagataatctcctttgactct

SEQ ID NO: 1030378 - DNA, 22 bp, Artificial Sequence
  chemically synthesized
aagctccaagataatctccttt

SEQ ID NO: 1030379 - DNA, 22 bp, Artificial Sequence
  chemically synthesized
aaagctccaagataatctcctt

SEQ ID NO: 1030380 - DNA, 22 bp, Artificial Sequence
  chemically synthesized
aatcttaaagctccaagataat

SEQ ID NO: 1030381 - DNA, 22 bp, Artificial Sequence
  chemically synthesized
tcttggagctttaagatttaat

SEQ ID NO: 1030382 - DNA, 22 bp, Artificial Sequence
  chemically synthesized
ggagctttaagatttaattact

SEQ ID NO: 1030383 - DNA, 22 bp, Artificial Sequence
  chemically synthesized
gagctttaagatttaattactg

SEQ ID NO: 1030384 - DNA, 22 bp, Artificial Sequence
  chemically synthesized
taagatttaattactgcctcat

SEQ ID NO: 1030385 - DNA, 22 bp, Artificial Sequence
  chemically synthesized
aagatttaattactgcctcatt

SEQ ID NO: 1030386 - DNA, 22 bp, Artificial Sequence
  chemically synthesized
agatttaattactgcctcattg

SEQ ID NO: 1030387 - DNA, 22 bp, Artificial Sequence
  chemically synthesized
catgcatgtcaaatccaatgag

SEQ ID NO: 1030388 - DNA, 22 bp, Artificial Sequence
  chemically synthesized
aattactgcctcattggatttg

SEQ ID NO: 1030389 - DNA, 22 bp, Artificial Sequence
  chemically synthesized
attactgcctcattggatttga

SEQ ID NO: 1030390 - DNA, 22 bp, Artificial Sequence
  chemically synthesized
caggctccatgcatgtcaaatc

SEQ ID NO: 1030391 - DNA, 22 bp, Artificial Sequence
  chemically synthesized
ctgcctcattggatttgacatg

SEQ ID NO: 1030392 - DNA, 22 bp, Artificial Sequence
  chemically synthesized
cctcattggatttgacatgcat

SEQ ID NO: 1030393 - DNA, 22 bp, Artificial Sequence
  chemically synthesized
attggatttgacatgcatggag

SEQ ID NO: 1030394 - DNA, 22 bp, Artificial Sequence
  chemically synthesized
gatttgacatgcatggagcctg

SEQ ID NO: 1030395 - DNA, 22 bp, Artificial Sequence
  chemically synthesized
gacatgcatggagcctggagcc

SEQ ID NO: 1030396 - DNA, 22 bp, Artificial Sequence
  chemically synthesized
acatgcatggagcctggagccc

SEQ ID NO: 1030397 - DNA, 22 bp, Artificial Sequence
  chemically synthesized
gcccaaacaaaggggctccagg

SEQ ID NO: 1030398 - DNA, 22 bp, Artificial Sequence
  chemically synthesized
gagcccctttgtttgggccaat

SEQ ID NO: 1030399 - DNA, 22 bp, Artificial Sequence
  chemically synthesized
cagatgggagaaattggcccaa

SEQ ID NO: 1030400 - DNA, 22 bp, Artificial Sequence
  chemically synthesized
tgtttgggccaatttctcccat

SEQ ID NO: 1030401 - DNA, 22 bp, Artificial Sequence
  chemically synthesized
gtttgggccaatttctcccatc

SEQ ID NO: 1030402 - DNA, 22 bp, Artificial Sequence
  chemically synthesized
tttgggccaatttctcccatct

SEQ ID NO: 1030403 - DNA, 22 bp, Artificial Sequence
  chemically synthesized
aatacacccattccagatggga

SEQ ID NO: 1030404 - DNA, 22 bp, Artificial Sequence
  chemically synthesized
gggccaatttctcccatctgga

SEQ ID NO: 1030405 - DNA, 22 bp, Artificial Sequence
  chemically synthesized
ggccaatttctcccatctggaa

SEQ ID NO: 1030406 - DNA, 22 bp, Artificial Sequence
  chemically synthesized
gttaaatacacccattccagat

SEQ ID NO: 1030407 - DNA, 22 bp, Artificial Sequence
  chemically synthesized
ctcccatctggaatgggtgtat

SEQ ID NO: 1030408 - DNA, 22 bp, Artificial Sequence
  chemically synthesized
tcccatctggaatgggtgtatt

SEQ ID NO: 1030409 - DNA, 22 bp, Artificial Sequence
  chemically synthesized
ccatctggaatgggtgtattta

SEQ ID NO: 1030410 - DNA, 22 bp, Artificial Sequence
  chemically synthesized
gaatgggtgtatttaaccaatg

SEQ ID NO: 1030411 - DNA, 22 bp, Artificial Sequence
  chemically synthesized
ggtacaatggaggtaccagcat

SEQ ID NO: 1030412 - DNA, 22 bp, Artificial Sequence
  chemically synthesized
taggtacaatggaggtaccagc

SEQ ID NO: 1030413 - DNA, 22 bp, Artificial Sequence
  chemically synthesized
ctaggtacaatggaggtaccag

SEQ ID NO: 1030414 - DNA, 22 bp, Artificial Sequence
  chemically synthesized
tctaggtacaatggaggtacca

SEQ ID NO: 1030415 - DNA, 22 bp, Artificial Sequence
  chemically synthesized
aaccaatgctggtacctccatt

SEQ ID NO: 1030416 - DNA, 22 bp, Artificial Sequence
  chemically synthesized
ctttctaggtacaatggaggta

SEQ ID NO: 1030417 - DNA, 22 bp, Artificial Sequence
  chemically synthesized
accaatgctggtacctccattg

SEQ ID NO: 1030418 - DNA, 22 bp, Artificial Sequence
  chemically synthesized
gttactttctaggtacaatgga

SEQ ID NO: 1030419 - DNA, 22 bp, Artificial Sequence
  chemically synthesized
gtacctccattgtacctagaaa

SEQ ID NO: 1030420 - DNA, 22 bp, Artificial Sequence
  chemically synthesized
cattgtacctagaaagtaacta

SEQ ID NO: 1030421 - DNA, 22 bp, Artificial Sequence
  chemically synthesized
tacctagaaagtaactaacttg

SEQ ID NO: 1030422 - DNA, 22 bp, Artificial Sequence
  chemically synthesized
gaaagtaactaacttgcttttg

SEQ ID NO: 1030423 - DNA, 22 bp, Artificial Sequence
  chemically synthesized
ggagccataaaatcaaaagcaa

SEQ ID NO: 1030424 - DNA, 22 bp, Artificial Sequence
  chemically synthesized
cctaggagccataaaatcaaaa

SEQ ID NO: 1030425 - DNA, 22 bp, Artificial Sequence
  chemically synthesized
tgcctaggagccataaaatcaa

SEQ ID NO: 1030426 - DNA, 22 bp, Artificial Sequence
  chemically synthesized
ctgcctaggagccataaaatca

SEQ ID NO: 1030427 - DNA, 22 bp, Artificial Sequence
  chemically synthesized
acttgcttttgattttatggct

SEQ ID NO: 1030428 - DNA, 22 bp, Artificial Sequence
  chemically synthesized
gcttttgattttatggctccta

SEQ ID NO: 1030429 - DNA, 22 bp, Artificial Sequence
  chemically synthesized
cttttgattttatggctcctag

SEQ ID NO: 1030430 - DNA, 22 bp, Artificial Sequence
  chemically synthesized
ttgattttatggctcctaggca

SEQ ID NO: 1030431 - DNA, 22 bp, Artificial Sequence
  chemically synthesized
tgattttatggctcctaggcag

SEQ ID NO: 1030432 - DNA, 22 bp, Artificial Sequence
  chemically synthesized
gattttatggctcctaggcaga

SEQ ID NO: 1030433 - DNA, 22 bp, Artificial Sequence
  chemically synthesized
attttatggctcctaggcagaa

SEQ ID NO: 1030434 - DNA, 22 bp, Artificial Sequence
  chemically synthesized
tatggctcctaggcagaagtga

SEQ ID NO: 1030435 - DNA, 22 bp, Artificial Sequence
  chemically synthesized
agacaaggcaagtcacttctgc

SEQ ID NO: 1030436 - DNA, 22 bp, Artificial Sequence
  chemically synthesized
atggctcctaggcagaagtgac

SEQ ID NO: 1030437 - DNA, 22 bp, Artificial Sequence
  chemically synthesized
tggctcctaggcagaagtgact

SEQ ID NO: 1030438 - DNA, 22 bp, Artificial Sequence
  chemically synthesized
atctgagacaaggcaagtcact

SEQ ID NO: 1030439 - DNA, 22 bp, Artificial Sequence
  chemically synthesized
ctaggcagaagtgacttgcctt

SEQ ID NO: 1030440 - DNA, 22 bp, Artificial Sequence
  chemically synthesized
ggcagaagtgacttgccttgtc

SEQ ID NO: 1030441 - DNA, 22 bp, Artificial Sequence
  chemically synthesized
gccttgtctcagatgagacttt

SEQ ID NO: 1030442 - DNA, 22 bp, Artificial Sequence
  chemically synthesized
ccttgtctcagatgagactttg

SEQ ID NO: 1030443 - DNA, 22 bp, Artificial Sequence
  chemically synthesized
gtctcagatgagactttggact

SEQ ID NO: 1030444 - DNA, 22 bp, Artificial Sequence
  chemically synthesized
tctcagatgagactttggactt

SEQ ID NO: 1030445 - DNA, 22 bp, Artificial Sequence
  chemically synthesized
acccaggagtccaagtccaaag

SEQ ID NO: 1030446 - DNA, 22 bp, Artificial Sequence
  chemically synthesized
agatgagactttggacttggac

SEQ ID NO: 1030447 - DNA, 22 bp, Artificial Sequence
  chemically synthesized
gcattaacccaggagtccaagt

SEQ ID NO: 1030448 - DNA, 22 bp, Artificial Sequence
  chemically synthesized
tagcattaacccaggagtccaa

SEQ ID NO: 1030449 - DNA, 22 bp, Artificial Sequence
  chemically synthesized
actctagcattaacccaggagt

SEQ ID NO: 1030450 - DNA, 22 bp, Artificial Sequence
  chemically synthesized
tggacttggactcctgggttaa

SEQ ID NO: 1030451 - DNA, 22 bp, Artificial Sequence
  chemically synthesized
ggacttggactcctgggttaat

SEQ ID NO: 1030452 - DNA, 22 bp, Artificial Sequence
  chemically synthesized
actcactctagcattaacccag

SEQ ID NO: 1030453 - DNA, 22 bp, Artificial Sequence
  chemically synthesized
gacttggactcctgggttaatg

SEQ ID NO: 1030454 - DNA, 22 bp, Artificial Sequence
  chemically synthesized
aactcactctagcattaaccca

SEQ ID NO: 1030455 - DNA, 22 bp, Artificial Sequence
  chemically synthesized
ggactcctgggttaatgctaga

SEQ ID NO: 1030456 - DNA, 22 bp, Artificial Sequence
  chemically synthesized
gactcctgggttaatgctagag

SEQ ID NO: 1030457 - DNA, 22 bp, Artificial Sequence
  chemically synthesized
aaagtcttaactcactctagca

SEQ ID NO: 1030458 - DNA, 22 bp, Artificial Sequence
  chemically synthesized
ctgggttaatgctagagtgagt

SEQ ID NO: 1030459 - DNA, 22 bp, Artificial Sequence
  chemically synthesized
ggttaatgctagagtgagttaa

SEQ ID NO: 1030460 - DNA, 22 bp, Artificial Sequence
  chemically synthesized
atgctagagtgagttaagactt

SEQ ID NO: 1030461 - DNA, 22 bp, Artificial Sequence
  chemically synthesized
ccaacagtcactcaaagtctta

SEQ ID NO: 1030462 - DNA, 22 bp, Artificial Sequence
  chemically synthesized
cccaacagtcactcaaagtctt

SEQ ID NO: 1030463 - DNA, 22 bp, Artificial Sequence
  chemically synthesized
gagtgagttaagactttgagtg

SEQ ID NO: 1030464 - DNA, 22 bp, Artificial Sequence
  chemically synthesized
agactttgagtgactgttggga

SEQ ID NO: 1030465 - DNA, 22 bp, Artificial Sequence
  chemically synthesized
aaaacacaataatgccttccca

SEQ ID NO: 1030466 - DNA, 22 bp, Artificial Sequence
  chemically synthesized
tgagtgactgttgggaaggcat

SEQ ID NO: 1030467 - DNA, 22 bp, Artificial Sequence
  chemically synthesized
caaaacacaataatgccttccc

SEQ ID NO: 1030468 - DNA, 22 bp, Artificial Sequence
  chemically synthesized
gagtgactgttgggaaggcatt

SEQ ID NO: 1030469 - DNA, 22 bp, Artificial Sequence
  chemically synthesized
agtgactgttgggaaggcatta

SEQ ID NO: 1030470 - DNA, 22 bp, Artificial Sequence
  chemically synthesized
acatttcaaaacacaataatgc

SEQ ID NO: 1030471 - DNA, 22 bp, Artificial Sequence
  chemically synthesized
cacatttcaaaacacaataatg

SEQ ID NO: 1030472 - DNA, 22 bp, Artificial Sequence
  chemically synthesized
ttgggaaggcattattgtgttt

SEQ ID NO: 1030473 - DNA, 22 bp, Artificial Sequence
  chemically synthesized
ggaaggcattattgtgttttga

SEQ ID NO: 1030474 - DNA, 22 bp, Artificial Sequence
  chemically synthesized
ccaaatggcacgtcttcacatt

SEQ ID NO: 1030475 - DNA, 22 bp, Artificial Sequence
  chemically synthesized
ttgtgttttgaaatgtgaagac

SEQ ID NO: 1030476 - DNA, 22 bp, Artificial Sequence
  chemically synthesized
tgttttgaaatgtgaagacgtg

SEQ ID NO: 1030477 - DNA, 22 bp, Artificial Sequence
  chemically synthesized
gcccctcccaaatggcacgtct

SEQ ID NO: 1030478 - DNA, 22 bp, Artificial Sequence
  chemically synthesized
tgaaatgtgaagacgtgccatt

SEQ ID NO: 1030479 - DNA, 22 bp, Artificial Sequence
  chemically synthesized
gaaatgtgaagacgtgccattt

SEQ ID NO: 1030480 - DNA, 22 bp, Artificial Sequence
  chemically synthesized
aaatgtgaagacgtgccatttg

SEQ ID NO: 1030481 - DNA, 22 bp, Artificial Sequence
  chemically synthesized
atccctggcccctcccaaatgg

SEQ ID NO: 1030482 - DNA, 22 bp, Artificial Sequence
  chemically synthesized
catccctggcccctcccaaatg

SEQ ID NO: 1030483 - DNA, 22 bp, Artificial Sequence
  chemically synthesized
gggaggggccagggatgaaatg

SEQ ID NO: 1030484 - DNA, 22 bp, Artificial Sequence
  chemically synthesized
ggaggggccagggatgaaatga

SEQ ID NO: 1030485 - DNA, 22 bp, Artificial Sequence
  chemically synthesized
ggtggggacatagccaaaccat

SEQ ID NO: 1030486 - DNA, 22 bp, Artificial Sequence
  chemically synthesized
gggtggggacatagccaaacca

SEQ ID NO: 1030487 - DNA, 22 bp, Artificial Sequence
  chemically synthesized
agaatgagatttgggtggggac

SEQ ID NO: 1030488 - DNA, 22 bp, Artificial Sequence
  chemically synthesized
ggctatgtccccacccaaatct

SEQ ID NO: 1030489 - DNA, 22 bp, Artificial Sequence
  chemically synthesized
caattcagaatgagatttgggt

SEQ ID NO: 1030490 - DNA, 22 bp, Artificial Sequence
  chemically synthesized
gctatgtccccacccaaatctc

SEQ ID NO: 1030491 - DNA, 22 bp, Artificial Sequence
  chemically synthesized
tgtccccacccaaatctcattc

SEQ ID NO: 1030492 - DNA, 22 bp, Artificial Sequence
  chemically synthesized
caggaactacaattcagaatga

SEQ ID NO: 1030493 - DNA, 22 bp, Artificial Sequence
  chemically synthesized
attctgaattgtagttcctgta

SEQ ID NO: 1030494 - DNA, 22 bp, Artificial Sequence
  chemically synthesized
tgaattgtagttcctgtaatcc

SEQ ID NO: 1030495 - DNA, 22 bp, Artificial Sequence
  chemically synthesized
acatgacacatggggattacag

SEQ ID NO: 1030496 - DNA, 22 bp, Artificial Sequence
  chemically synthesized
aattgtagttcctgtaatcccc

SEQ ID NO: 1030497 - DNA, 22 bp, Artificial Sequence
  chemically synthesized
tagttcctgtaatccccatgtg

SEQ ID NO: 1030498 - DNA, 22 bp, Artificial Sequence
  chemically synthesized
ggtccctcacatgacacatggg

SEQ ID NO: 1030499 - DNA, 22 bp, Artificial Sequence
  chemically synthesized
ctgtaatccccatgtgtcatgt

SEQ ID NO: 1030500 - DNA, 22 bp, Artificial Sequence
  chemically synthesized
caactgggtccctcacatgaca

SEQ ID NO: 1030501 - DNA, 22 bp, Artificial Sequence
  chemically synthesized
taatccccatgtgtcatgtgag

SEQ ID NO: 1030502 - DNA, 22 bp, Artificial Sequence
  chemically synthesized
cctccaactgggtccctcacat

SEQ ID NO: 1030503 - DNA, 22 bp, Artificial Sequence
  chemically synthesized
aattacctccaactgggtccct

SEQ ID NO: 1030504 - DNA, 22 bp, Artificial Sequence
  chemically synthesized
taattcaattacctccaactgg

SEQ ID NO: 1030505 - DNA, 22 bp, Artificial Sequence
  chemically synthesized
gaggtaattgaattacaggggc

SEQ ID NO: 1030506 - DNA, 22 bp, Artificial Sequence
  chemically synthesized
aattacaggggcggttatcccc

SEQ ID NO: 1030507 - DNA, 22 bp, Artificial Sequence
  chemically synthesized
caggggcggttatccccatggt

SEQ ID NO: 1030508 - DNA, 22 bp, Artificial Sequence
  chemically synthesized
tcacaagaacagcaccatgggg

SEQ ID NO: 1030509 - DNA, 22 bp, Artificial Sequence
  chemically synthesized
actatcacaagaacagcaccat

SEQ ID NO: 1030510 - DNA, 22 bp, Artificial Sequence
  chemically synthesized
tccccatggtgctgttcttgtg

SEQ ID NO: 1030511 - DNA, 22 bp, Artificial Sequence
  chemically synthesized
atgagaactcactatcacaaga

SEQ ID NO: 1030512 - DNA, 22 bp, Artificial Sequence
  chemically synthesized
gatctcatgagaactcactatc

SEQ ID NO: 1030513 - DNA, 22 bp, Artificial Sequence
  chemically synthesized
ttcttgtgatagtgagttctca

SEQ ID NO: 1030514 - DNA, 22 bp, Artificial Sequence
  chemically synthesized
ttgtgatagtgagttctcatga

SEQ ID NO: 1030515 - DNA, 22 bp, Artificial Sequence
  chemically synthesized
gtgatagtgagttctcatgaga

SEQ ID NO: 1030516 - DNA, 22 bp, Artificial Sequence
  chemically synthesized
tgatagtgagttctcatgagat

SEQ ID NO: 1030517 - DNA, 22 bp, Artificial Sequence
  chemically synthesized
taaaaccattggatctcatgag

SEQ ID NO: 1030518 - DNA, 22 bp, Artificial Sequence
  chemically synthesized
ataaaaccattggatctcatga

SEQ ID NO: 1030519 - DNA, 22 bp, Artificial Sequence
  chemically synthesized
tcatgagatccaatggttttat

SEQ ID NO: 1030520 - DNA, 22 bp, Artificial Sequence
  chemically synthesized
atgagatccaatggttttataa

SEQ ID NO: 1030521 - DNA, 22 bp, Artificial Sequence
  chemically synthesized
agcaaagggggaaaagcccctt

SEQ ID NO: 1030522 - DNA, 22 bp, Artificial Sequence
  chemically synthesized
tataaggggcttttcccccttt

SEQ ID NO: 1030523 - DNA, 22 bp, Artificial Sequence
  chemically synthesized
ataaggggcttttccccctttg

SEQ ID NO: 1030524 - DNA, 22 bp, Artificial Sequence
  chemically synthesized
taaggggcttttccccctttgc

SEQ ID NO: 1030525 - DNA, 22 bp, Artificial Sequence
  chemically synthesized
ttccccctttgctcagcacttc

SEQ ID NO: 1030526 - DNA, 22 bp, Artificial Sequence
  chemically synthesized
tccccctttgctcagcacttct

SEQ ID NO: 1030527 - DNA, 22 bp, Artificial Sequence
  chemically synthesized
ccccctttgctcagcacttctc

SEQ ID NO: 1030528 - DNA, 22 bp, Artificial Sequence
  chemically synthesized
cccctttgctcagcacttctcc

SEQ ID NO: 1030529 - DNA, 22 bp, Artificial Sequence
  chemically synthesized
atatggtggcagaaaggagaag

SEQ ID NO: 1030530 - DNA, 22 bp, Artificial Sequence
  chemically synthesized
catatggtggcagaaaggagaa

SEQ ID NO: 1030531 - DNA, 22 bp, Artificial Sequence
  chemically synthesized
tgctcagcacttctcctttctg

SEQ ID NO: 1030532 - DNA, 22 bp, Artificial Sequence
  chemically synthesized
ttcatatggtggcagaaaggag

SEQ ID NO: 1030533 - DNA, 22 bp, Artificial Sequence
  chemically synthesized
gctcagcacttctcctttctgc

SEQ ID NO: 1030534 - DNA, 22 bp, Artificial Sequence
  chemically synthesized
cttcatatggtggcagaaagga

SEQ ID NO: 1030535 - DNA, 22 bp, Artificial Sequence
  chemically synthesized
ctcagcacttctcctttctgcc

SEQ ID NO: 1030536 - DNA, 22 bp, Artificial Sequence
  chemically synthesized
agcacttctcctttctgccacc

SEQ ID NO: 1030537 - DNA, 22 bp, Artificial Sequence
  chemically synthesized
ctcctttctgccaccatatgaa

SEQ ID NO: 1030538 - DNA, 22 bp, Artificial Sequence
  chemically synthesized
tcctttctgccaccatatgaag

SEQ ID NO: 1030539 - DNA, 22 bp, Artificial Sequence
  chemically synthesized
ctttctgccaccatatgaagaa

SEQ ID NO: 1030540 - DNA, 22 bp, Artificial Sequence
  chemically synthesized
tctgccaccatatgaagaagga

SEQ ID NO: 1030541 - DNA, 22 bp, Artificial Sequence
  chemically synthesized
ctgccaccatatgaagaaggat

SEQ ID NO: 1030542 - DNA, 22 bp, Artificial Sequence
  chemically synthesized
tgccaccatatgaagaaggatg

SEQ ID NO: 1030543 - DNA, 22 bp, Artificial Sequence
  chemically synthesized
ccaccatatgaagaaggatgtg

SEQ ID NO: 1030544 - DNA, 22 bp, Artificial Sequence
  chemically synthesized
caaccatgccagaaggggaagc

SEQ ID NO: 1030545 - DNA, 22 bp, Artificial Sequence
  chemically synthesized
acaaccatgccagaaggggaag

SEQ ID NO: 1030546 - DNA, 22 bp, Artificial Sequence
  chemically synthesized
agggaaaacttacaaccatgcc

SEQ ID NO: 1030547 - DNA, 22 bp, Artificial Sequence
  chemically synthesized
cttccccttctggcatggttgt

SEQ ID NO: 1030548 - DNA, 22 bp, Artificial Sequence
  chemically synthesized
ccccttctggcatggttgtaag

SEQ ID NO: 1030549 - DNA, 22 bp, Artificial Sequence
  chemically synthesized
cccttctggcatggttgtaagt

SEQ ID NO: 1030550 - DNA, 22 bp, Artificial Sequence
  chemically synthesized
ctggcatggttgtaagttttcc

SEQ ID NO: 1030551 - DNA, 22 bp, Artificial Sequence
  chemically synthesized
gggaggcctcagggaaaactta

SEQ ID NO: 1030552 - DNA, 22 bp, Artificial Sequence
  chemically synthesized
tggcatggttgtaagttttccc

SEQ ID NO: 1030553 - DNA, 22 bp, Artificial Sequence
  chemically synthesized
gcatggttgtaagttttccctg

SEQ ID NO: 1030554 - DNA, 22 bp, Artificial Sequence
  chemically synthesized
cacatggctggggaggcctcag

SEQ ID NO: 1030555 - DNA, 22 bp, Artificial Sequence
  chemically synthesized
taagttttccctgaggcctccc

SEQ ID NO: 1030556 - DNA, 22 bp, Artificial Sequence
  chemically synthesized
acagttccacatggctggggag

SEQ ID NO: 1030557 - DNA, 22 bp, Artificial Sequence
  chemically synthesized
tccctgaggcctccccagccat

SEQ ID NO: 1030558 - DNA, 22 bp, Artificial Sequence
  chemically synthesized
ccctgaggcctccccagccatg

SEQ ID NO: 1030559 - DNA, 22 bp, Artificial Sequence
  chemically synthesized
cctgaggcctccccagccatgt

SEQ ID NO: 1030560 - DNA, 22 bp, Artificial Sequence
  chemically synthesized
actcacagttccacatggctgg

SEQ ID NO: 1030561 - DNA, 22 bp, Artificial Sequence
  chemically synthesized
aggcctccccagccatgtggaa

SEQ ID NO: 1030562 - DNA, 22 bp, Artificial Sequence
  chemically synthesized
attgactcacagttccacatgg

SEQ ID NO: 1030563 - DNA, 22 bp, Artificial Sequence
  chemically synthesized
aattgactcacagttccacatg

SEQ ID NO: 1030564 - DNA, 22 bp, Artificial Sequence
  chemically synthesized
cccagccatgtggaactgtgag

SEQ ID NO: 1030565 - DNA, 22 bp, Artificial Sequence
  chemically synthesized
taaaggacagaggtttaattga

SEQ ID NO: 1030566 - DNA, 22 bp, Artificial Sequence
  chemically synthesized
ataaaggacagaggtttaattg

SEQ ID NO: 1030567 - DNA, 22 bp, Artificial Sequence
  chemically synthesized
tgagtcaattaaacctctgtcc

SEQ ID NO: 1030568 - DNA, 22 bp, Artificial Sequence
  chemically synthesized
aataatttataaaggacagagg

SEQ ID NO: 1030569 - DNA, 22 bp, Artificial Sequence
  chemically synthesized
aacctctgtcctttataaatta

SEQ ID NO: 1030570 - DNA, 22 bp, Artificial Sequence
  chemically synthesized
cccaagactgaataatttataa

SEQ ID NO: 1030571 - DNA, 22 bp, Artificial Sequence
  chemically synthesized
tgtcctttataaattattcagt

SEQ ID NO: 1030572 - DNA, 22 bp, Artificial Sequence
  chemically synthesized
tcctttataaattattcagtct

SEQ ID NO: 1030573 - DNA, 22 bp, Artificial Sequence
  chemically synthesized
aagaactgcccaagactgaata

SEQ ID NO: 1030574 - DNA, 22 bp, Artificial Sequence
  chemically synthesized
taaagaactgcccaagactgaa

SEQ ID NO: 1030575 - DNA, 22 bp, Artificial Sequence
  chemically synthesized
tataaattattcagtcttgggc

SEQ ID NO: 1030576 - DNA, 22 bp, Artificial Sequence
  chemically synthesized
ctctaaagaactgcccaagact

SEQ ID NO: 1030577 - DNA, 22 bp, Artificial Sequence
  chemically synthesized
ataaattattcagtcttgggca

SEQ ID NO: 1030578 - DNA, 22 bp, Artificial Sequence
  chemically synthesized
taaattattcagtcttgggcag

SEQ ID NO: 1030579 - DNA, 22 bp, Artificial Sequence
  chemically synthesized
atgctgctctaaagaactgccc

SEQ ID NO: 1030580 - DNA, 22 bp, Artificial Sequence
  chemically synthesized
tcatgctgctctaaagaactgc

SEQ ID NO: 1030581 - DNA, 22 bp, Artificial Sequence
  chemically synthesized
ttcagtcttgggcagttcttta

SEQ ID NO: 1030582 - DNA, 22 bp, Artificial Sequence
  chemically synthesized
ttctcatgctgctctaaagaac

SEQ ID NO: 1030583 - DNA, 22 bp, Artificial Sequence
  chemically synthesized
agtcttgggcagttctttagag

SEQ ID NO: 1030584 - DNA, 22 bp, Artificial Sequence
  chemically synthesized
gtctgttctcatgctgctctaa

SEQ ID NO: 1030585 - DNA, 22 bp, Artificial Sequence
  chemically synthesized
gggcagttctttagagcagcat

SEQ ID NO: 1030586 - DNA, 22 bp, Artificial Sequence
  chemically synthesized
ggcagttctttagagcagcatg

SEQ ID NO: 1030587 - DNA, 22 bp, Artificial Sequence
  chemically synthesized
tattagtctgttctcatgctgc

SEQ ID NO: 1030588 - DNA, 22 bp, Artificial Sequence
  chemically synthesized
tttagagcagcatgagaacaga

SEQ ID NO: 1030589 - DNA, 22 bp, Artificial Sequence
  chemically synthesized
tagagcagcatgagaacagact

SEQ ID NO: 1030590 - DNA, 22 bp, Artificial Sequence
  chemically synthesized
agagcagcatgagaacagacta

SEQ ID NO: 1030591 - DNA, 22 bp, Artificial Sequence
  chemically synthesized
gagcagcatgagaacagactaa

SEQ ID NO: 1030592 - DNA, 22 bp, Artificial Sequence
  chemically synthesized
atcatacagtctgtattagtct

SEQ ID NO: 1030593 - DNA, 22 bp, Artificial Sequence
  chemically synthesized
atacagactgtatgatcaatat

SEQ ID NO: 1030594 - DNA, 22 bp, Artificial Sequence
  chemically synthesized
agaaagtaaaatatattgatca

SEQ ID NO: 1030595 - DNA, 22 bp, Artificial Sequence
  chemically synthesized
tatgatcaatatattttacttt

SEQ ID NO: 1030596 - DNA, 22 bp, Artificial Sequence
  chemically synthesized
ataagtaaactcagaaagtaaa

SEQ ID NO: 1030597 - DNA, 22 bp, Artificial Sequence
  chemically synthesized
gcattaataagtaaactcagaa

SEQ ID NO: 1030598 - DNA, 22 bp, Artificial Sequence
  chemically synthesized
agcattaataagtaaactcaga

SEQ ID NO: 1030599 - DNA, 22 bp, Artificial Sequence
  chemically synthesized
tactttctgagtttacttatta

SEQ ID NO: 1030600 - DNA, 22 bp, Artificial Sequence
  chemically synthesized
actttctgagtttacttattaa

SEQ ID NO: 1030601 - DNA, 22 bp, Artificial Sequence
  chemically synthesized
ctttctgagtttacttattaat

SEQ ID NO: 1030602 - DNA, 22 bp, Artificial Sequence
  chemically synthesized
tctgagtttacttattaatgct

SEQ ID NO: 1030603 - DNA, 22 bp, Artificial Sequence
  chemically synthesized
ctgagtttacttattaatgcta

SEQ ID NO: 1030604 - DNA, 22 bp, Artificial Sequence
  chemically synthesized
tgagtttacttattaatgctaa

SEQ ID NO: 1030605 - DNA, 22 bp, Artificial Sequence
  chemically synthesized
agtttacttattaatgctaaac

SEQ ID NO: 1030606 - DNA, 22 bp, Artificial Sequence
  chemically synthesized
acttattaatgctaaactgtat

SEQ ID NO: 1030607 - DNA, 22 bp, Artificial Sequence
  chemically synthesized
cttattaatgctaaactgtatt

SEQ ID NO: 1030608 - DNA, 22 bp, Artificial Sequence
  chemically synthesized
attaatgctaaactgtattttt

SEQ ID NO: 1030609 - DNA, 22 bp, Artificial Sequence
  chemically synthesized
ttaatgctaaactgtattttta

SEQ ID NO: 1030610 - DNA, 22 bp, Artificial Sequence
  chemically synthesized
aaaagtaaaaaggtaaaaatac

SEQ ID NO: 1030611 - DNA, 22 bp, Artificial Sequence
  chemically synthesized
atgctaaactgtatttttacct

SEQ ID NO: 1030612 - DNA, 22 bp, Artificial Sequence
  chemically synthesized
aactgtatttttacctttttac

SEQ ID NO: 1030613 - DNA, 22 bp, Artificial Sequence
  chemically synthesized
tatttttacctttttacttttg

SEQ ID NO: 1030614 - DNA, 22 bp, Artificial Sequence
  chemically synthesized
atatgacaatggcgttcaaaag

SEQ ID NO: 1030615 - DNA, 22 bp, Artificial Sequence
  chemically synthesized
ttacctttttacttttgaacgc

SEQ ID NO: 1030616 - DNA, 22 bp, Artificial Sequence
  chemically synthesized
tacctttttacttttgaacgcc

SEQ ID NO: 1030617 - DNA, 22 bp, Artificial Sequence
  chemically synthesized
acctttttacttttgaacgcca

SEQ ID NO: 1030618 - DNA, 22 bp, Artificial Sequence
  chemically synthesized
ttaatatgacaatggcgttcaa

SEQ ID NO: 1030619 - DNA, 22 bp, Artificial Sequence
  chemically synthesized
cctttttacttttgaacgccat

SEQ ID NO: 1030620 - DNA, 22 bp, Artificial Sequence
  chemically synthesized
attaatatgacaatggcgttca

SEQ ID NO: 1030621 - DNA, 22 bp, Artificial Sequence
  chemically synthesized
ttattaatatgacaatggcgtt

SEQ ID NO: 1030622 - DNA, 22 bp, Artificial Sequence
  chemically synthesized
tttacttttgaacgccattgtc

SEQ ID NO: 1030623 - DNA, 22 bp, Artificial Sequence
  chemically synthesized
tcttattaatatgacaatggcg

SEQ ID NO: 1030624 - DNA, 22 bp, Artificial Sequence
  chemically synthesized
ttacttttgaacgccattgtca

SEQ ID NO: 1030625 - DNA, 22 bp, Artificial Sequence
  chemically synthesized
tacttttgaacgccattgtcat

SEQ ID NO: 1030626 - DNA, 22 bp, Artificial Sequence
  chemically synthesized
acttttgaacgccattgtcata

SEQ ID NO: 1030627 - DNA, 22 bp, Artificial Sequence
  chemically synthesized
cttttgaacgccattgtcatat

SEQ ID NO: 1030628 - DNA, 22 bp, Artificial Sequence
  chemically synthesized
ttgaacgccattgtcatattaa

SEQ ID NO: 1030629 - DNA, 22 bp, Artificial Sequence
  chemically synthesized
tgaacgccattgtcatattaat

SEQ ID NO: 1030630 - DNA, 22 bp, Artificial Sequence
  chemically synthesized
gaacgccattgtcatattaata

SEQ ID NO: 1030631 - DNA, 22 bp, Artificial Sequence
  chemically synthesized
aacgccattgtcatattaataa

SEQ ID NO: 1030632 - DNA, 22 bp, Artificial Sequence
  chemically synthesized
gtcaaaaaaattctcttattaa

SEQ ID NO: 1030633 - DNA, 22 bp, Artificial Sequence
  chemically synthesized
ggtcaaaaaaattctcttatta

SEQ ID NO: 1030634 - DNA, 22 bp, Artificial Sequence
  chemically synthesized
tggtcaaaaaaattctcttatt

SEQ ID NO: 1030635 - DNA, 22 bp, Artificial Sequence
  chemically synthesized
tcatattaataagagaattttt

SEQ ID NO: 1030636 - DNA, 22 bp, Artificial Sequence
  chemically synthesized
aaatgctttggtcaaaaaaatt

SEQ ID NO: 1030637 - DNA, 22 bp, Artificial Sequence
  chemically synthesized
aaaatgctttggtcaaaaaaat

SEQ ID NO: 1030638 - DNA, 22 bp, Artificial Sequence
  chemically synthesized
ataagagaatttttttgaccaa

SEQ ID NO: 1030639 - DNA, 22 bp, Artificial Sequence
  chemically synthesized
ttttgaccaaagcattttaagt

SEQ ID NO: 1030640 - DNA, 22 bp, Artificial Sequence
  chemically synthesized
caagtgtacagaacttaaaatg

SEQ ID NO: 1030641 - DNA, 22 bp, Artificial Sequence
  chemically synthesized
tttgaccaaagcattttaagtt

SEQ ID NO: 1030642 - DNA, 22 bp, Artificial Sequence
  chemically synthesized
ttgaccaaagcattttaagttc

SEQ ID NO: 1030643 - DNA, 22 bp, Artificial Sequence
  chemically synthesized
tgaccaaagcattttaagttct

SEQ ID NO: 1030644 - DNA, 22 bp, Artificial Sequence
  chemically synthesized
gaccaaagcattttaagttctg

SEQ ID NO: 1030645 - DNA, 22 bp, Artificial Sequence
  chemically synthesized
accaaagcattttaagttctgt

SEQ ID NO: 1030646 - DNA, 22 bp, Artificial Sequence
  chemically synthesized
tagatcaaatactgcaagtgta

SEQ ID NO: 1030647 - DNA, 22 bp, Artificial Sequence
  chemically synthesized
taagttctgtacacttgcagta

SEQ ID NO: 1030648 - DNA, 22 bp, Artificial Sequence
  chemically synthesized
aagttctgtacacttgcagtat

SEQ ID NO: 1030649 - DNA, 22 bp, Artificial Sequence
  chemically synthesized
agttctgtacacttgcagtatt

SEQ ID NO: 1030650 - DNA, 22 bp, Artificial Sequence
  chemically synthesized
tgtacacttgcagtatttgatc

SEQ ID NO: 1030651 - DNA, 22 bp, Artificial Sequence
  chemically synthesized
tacacttgcagtatttgatcta

SEQ ID NO: 1030652 - DNA, 22 bp, Artificial Sequence
  chemically synthesized
gcagtatttgatctacagattt

SEQ ID NO: 1030653 - DNA, 22 bp, Artificial Sequence
  chemically synthesized
tccatgatgtgtaaatctgtag

SEQ ID NO: 1030654 - DNA, 22 bp, Artificial Sequence
  chemically synthesized
cagtatttgatctacagattta

SEQ ID NO: 1030655 - DNA, 22 bp, Artificial Sequence
  chemically synthesized
tgtccatgatgtgtaaatctgt

SEQ ID NO: 1030656 - DNA, 22 bp, Artificial Sequence
  chemically synthesized
ctgtccatgatgtgtaaatctg

SEQ ID NO: 1030657 - DNA, 22 bp, Artificial Sequence
  chemically synthesized
gatctacagatttacacatcat

SEQ ID NO: 1030658 - DNA, 22 bp, Artificial Sequence
  chemically synthesized
atctacagatttacacatcatg

SEQ ID NO: 1030659 - DNA, 22 bp, Artificial Sequence
  chemically synthesized
ataacatttctgtccatgatgt

SEQ ID NO: 1030660 - DNA, 22 bp, Artificial Sequence
  chemically synthesized
cataacatttctgtccatgatg

SEQ ID NO: 1030661 - DNA, 22 bp, Artificial Sequence
  chemically synthesized
tcataacatttctgtccatgat

SEQ ID NO: 1030662 - DNA, 22 bp, Artificial Sequence
  chemically synthesized
cagatttacacatcatggacag

SEQ ID NO: 1030663 - DNA, 22 bp, Artificial Sequence
  chemically synthesized
acacatcatggacagaaatgtt

SEQ ID NO: 1030664 - DNA, 22 bp, Artificial Sequence
  chemically synthesized
cacatcatggacagaaatgtta

SEQ ID NO: 1030665 - DNA, 22 bp, Artificial Sequence
  chemically synthesized
taaatgattttcataacatttc

SEQ ID NO: 1030666 - DNA, 22 bp, Artificial Sequence
  chemically synthesized
tgtaaatgattttcataacatt

SEQ ID NO: 1030667 - DNA, 22 bp, Artificial Sequence
  chemically synthesized
aataattctgtaaatgattttc

SEQ ID NO: 1030668 - DNA, 22 bp, Artificial Sequence
  chemically synthesized
cattaaataattctgtaaatga

SEQ ID NO: 1030669 - DNA, 22 bp, Artificial Sequence
  chemically synthesized
ccattaaataattctgtaaatg

SEQ ID NO: 1030670 - DNA, 22 bp, Artificial Sequence
  chemically synthesized
tccattaaataattctgtaaat

SEQ ID NO: 1030671 - DNA, 22 bp, Artificial Sequence
  chemically synthesized
tgaaaatcatttacagaattat

SEQ ID NO: 1030672 - DNA, 22 bp, Artificial Sequence
  chemically synthesized
aatatgaaacgttttccattaa

SEQ ID NO: 1030673 - DNA, 22 bp, Artificial Sequence
  chemically synthesized
acagaattatttaatggaaaac

SEQ ID NO: 1030674 - DNA, 22 bp, Artificial Sequence
  chemically synthesized
cagaattatttaatggaaaacg

SEQ ID NO: 1030675 - DNA, 22 bp, Artificial Sequence
  chemically synthesized
tttaatggaaaacgtttcatat

SEQ ID NO: 1030676 - DNA, 22 bp, Artificial Sequence
  chemically synthesized
aatggaaaacgtttcatattta

SEQ ID NO: 1030677 - DNA, 22 bp, Artificial Sequence
  chemically synthesized
atggaaaacgtttcatatttaa

SEQ ID NO: 1030678 - DNA, 22 bp, Artificial Sequence
  chemically synthesized
catgtacaacatatgaaaatat

SEQ ID NO: 1030679 - DNA, 22 bp, Artificial Sequence
  chemically synthesized
acatgtacaacatatgaaaata

SEQ ID NO: 1030680 - DNA, 22 bp, Artificial Sequence
  chemically synthesized
catatttaatatattttcatat

SEQ ID NO: 1030681 - DNA, 22 bp, Artificial Sequence
  chemically synthesized
atatttaatatattttcatatg

SEQ ID NO: 1030682 - DNA, 22 bp, Artificial Sequence
  chemically synthesized
ttacatgtacaacatatgaaaa

SEQ ID NO: 1030683 - DNA, 22 bp, Artificial Sequence
  chemically synthesized
cttacatgtacaacatatgaaa

SEQ ID NO: 1030684 - DNA, 22 bp, Artificial Sequence
  chemically synthesized
aatatattttcatatgttgtac

SEQ ID NO: 1030685 - DNA, 22 bp, Artificial Sequence
  chemically synthesized
atatattttcatatgttgtaca

SEQ ID NO: 1030686 - DNA, 22 bp, Artificial Sequence
  chemically synthesized
tcatatgttgtacatgtaagaa

SEQ ID NO: 1030687 - DNA, 22 bp, Artificial Sequence
  chemically synthesized
catatgttgtacatgtaagaaa

SEQ ID NO: 1030688 - DNA, 22 bp, Artificial Sequence
  chemically synthesized
atatgttgtacatgtaagaaat

SEQ ID NO: 1030689 - DNA, 22 bp, Artificial Sequence
  chemically synthesized
tcaatggccataaaatcagatt

SEQ ID NO: 1030690 - DNA, 22 bp, Artificial Sequence
  chemically synthesized
tacatgtaagaaatctgatttt

SEQ ID NO: 1030691 - DNA, 22 bp, Artificial Sequence
  chemically synthesized
atcaatggccataaaatcagat

SEQ ID NO: 1030692 - DNA, 22 bp, Artificial Sequence
  chemically synthesized
ttatcaatggccataaaatcag

SEQ ID NO: 1030693 - DNA, 22 bp, Artificial Sequence
  chemically synthesized
tcgctcttatcaatggccataa

SEQ ID NO: 1030694 - DNA, 22 bp, Artificial Sequence
  chemically synthesized
ccattatcgctcttatcaatgg

SEQ ID NO: 1030695 - DNA, 22 bp, Artificial Sequence
  chemically synthesized
attttatggccattgataagag

SEQ ID NO: 1030696 - DNA, 22 bp, Artificial Sequence
  chemically synthesized
tatggccattgataagagcgat

SEQ ID NO: 1030697 - DNA, 22 bp, Artificial Sequence
  chemically synthesized
atggccattgataagagcgata

SEQ ID NO: 1030698 - DNA, 22 bp, Artificial Sequence
  chemically synthesized
tggccattgataagagcgataa

SEQ ID NO: 1030699 - DNA, 22 bp, Artificial Sequence
  chemically synthesized
tatgaaggctgccattatcgct

SEQ ID NO: 1030700 - DNA, 22 bp, Artificial Sequence
  chemically synthesized
atatgaaggctgccattatcgc

SEQ ID NO: 1030701 - DNA, 22 bp, Artificial Sequence
  chemically synthesized
ataagagcgataatggcagcct

SEQ ID NO: 1030702 - DNA, 22 bp, Artificial Sequence
  chemically synthesized
catataagatacatttctgtct

SEQ ID NO: 1030703 - DNA, 22 bp, Artificial Sequence
  chemically synthesized
atataagatacatttctgtctt

SEQ ID NO: 1030704 - DNA, 22 bp, Artificial Sequence
  chemically synthesized
caggtataatcaaaaataaaaa

SEQ ID NO: 1030705 - DNA, 22 bp, Artificial Sequence
  chemically synthesized
gcaggtataatcaaaaataaaa

SEQ ID NO: 1030706 - DNA, 22 bp, Artificial Sequence
  chemically synthesized
ttgcaggtataatcaaaaataa

SEQ ID NO: 1030707 - DNA, 22 bp, Artificial Sequence
  chemically synthesized
cttgcaggtataatcaaaaata

SEQ ID NO: 1030708 - DNA, 22 bp, Artificial Sequence
  chemically synthesized
ctgtctttttatttttgattat

SEQ ID NO: 1030709 - DNA, 22 bp, Artificial Sequence
  chemically synthesized
tgtctttttatttttgattata

SEQ ID NO: 1030710 - DNA, 22 bp, Artificial Sequence
  chemically synthesized
tctttttatttttgattatacc

SEQ ID NO: 1030711 - DNA, 22 bp, Artificial Sequence
  chemically synthesized
tttatttttgattatacctgca

SEQ ID NO: 1030712 - DNA, 22 bp, Artificial Sequence
  chemically synthesized
ttatttttgattatacctgcaa

SEQ ID NO: 1030713 - DNA, 22 bp, Artificial Sequence
  chemically synthesized
tatttttgattatacctgcaag

SEQ ID NO: 1030714 - DNA, 22 bp, Artificial Sequence
  chemically synthesized
atttttgattatacctgcaaga

SEQ ID NO: 1030715 - DNA, 22 bp, Artificial Sequence
  chemically synthesized
tttttgattatacctgcaagaa

SEQ ID NO: 1030716 - DNA, 22 bp, Artificial Sequence
  chemically synthesized
ttgattatacctgcaagaagac

SEQ ID NO: 1030717 - DNA, 22 bp, Artificial Sequence
  chemically synthesized
tgattatacctgcaagaagaca

SEQ ID NO: 1030718 - DNA, 22 bp, Artificial Sequence
  chemically synthesized
cataggaccatgtgtcttcttg

SEQ ID NO: 1030719 - DNA, 22 bp, Artificial Sequence
  chemically synthesized
gattatacctgcaagaagacac

SEQ ID NO: 1030720 - DNA, 22 bp, Artificial Sequence
  chemically synthesized
attatacctgcaagaagacaca

SEQ ID NO: 1030721 - DNA, 22 bp, Artificial Sequence
  chemically synthesized
gctgcataggaccatgtgtctt

SEQ ID NO: 1030722 - DNA, 22 bp, Artificial Sequence
  chemically synthesized
tacctgcaagaagacacatggt

SEQ ID NO: 1030723 - DNA, 22 bp, Artificial Sequence
  chemically synthesized
ttggctgcataggaccatgtgt

SEQ ID NO: 1030724 - DNA, 22 bp, Artificial Sequence
  chemically synthesized
attggctgcataggaccatgtg

SEQ ID NO: 1030725 - DNA, 22 bp, Artificial Sequence
  chemically synthesized
tttattggctgcataggaccat

SEQ ID NO: 1030726 - DNA, 22 bp, Artificial Sequence
  chemically synthesized
caagaagacacatggtcctatg

SEQ ID NO: 1030727 - DNA, 22 bp, Artificial Sequence
  chemically synthesized
tacaactatttattggctgcat

SEQ ID NO: 1030728 - DNA, 22 bp, Artificial Sequence
  chemically synthesized
ttatacaactatttattggctg

SEQ ID NO: 1030729 - DNA, 22 bp, Artificial Sequence
  chemically synthesized
ttattatacaactatttattgg

SEQ ID NO: 1030730 - DNA, 22 bp, Artificial Sequence
  chemically synthesized
attattatacaactatttattg

SEQ ID NO: 1030731 - DNA, 22 bp, Artificial Sequence
  chemically synthesized
tattattatacaactatttatt

SEQ ID NO: 1030732 - DNA, 22 bp, Artificial Sequence
  chemically synthesized
tgcagccaataaatagttgtat

SEQ ID NO: 1030733 - DNA, 22 bp, Artificial Sequence
  chemically synthesized
tcataactttattattatacaa

SEQ ID NO: 1030734 - DNA, 22 bp, Artificial Sequence
  chemically synthesized
ttatcataactttattattata

SEQ ID NO: 1030735 - DNA, 22 bp, Artificial Sequence
  chemically synthesized
attatcataactttattattat

SEQ ID NO: 1030736 - DNA, 22 bp, Artificial Sequence
  chemically synthesized
tataataataaagttatgataa

SEQ ID NO: 1030737 - DNA, 22 bp, Artificial Sequence
  chemically synthesized
tgataataaatgtttatacctt

SEQ ID NO: 1030738 - DNA, 22 bp, Artificial Sequence
  chemically synthesized
gtggtgtatgtaaaacatgaaa

SEQ ID NO: 1030739 - DNA, 22 bp, Artificial Sequence
  chemically synthesized
ggtggtgtatgtaaaacatgaa

SEQ ID NO: 1030740 - DNA, 22 bp, Artificial Sequence
  chemically synthesized
catttggtggtgtatgtaaaac

SEQ ID NO: 1030741 - DNA, 22 bp, Artificial Sequence
  chemically synthesized
atacctttcatgttttacatac

SEQ ID NO: 1030742 - DNA, 22 bp, Artificial Sequence
  chemically synthesized
gcatttggtggtgtatgtaaaa

SEQ ID NO: 1030743 - DNA, 22 bp, Artificial Sequence
  chemically synthesized
tacctttcatgttttacataca

SEQ ID NO: 1030744 - DNA, 22 bp, Artificial Sequence
  chemically synthesized
tgcatttggtggtgtatgtaaa

SEQ ID NO: 1030745 - DNA, 22 bp, Artificial Sequence
  chemically synthesized
ctttgcatttggtggtgtatgt

SEQ ID NO: 1030746 - DNA, 22 bp, Artificial Sequence
  chemically synthesized
tcatgttttacatacaccacca

SEQ ID NO: 1030747 - DNA, 22 bp, Artificial Sequence
  chemically synthesized
catgttttacatacaccaccaa

SEQ ID NO: 1030748 - DNA, 22 bp, Artificial Sequence
  chemically synthesized
atgttttacatacaccaccaaa

SEQ ID NO: 1030749 - DNA, 22 bp, Artificial Sequence
  chemically synthesized
atagttcctttgcatttggtgg

SEQ ID NO: 1030750 - DNA, 22 bp, Artificial Sequence
  chemically synthesized
catagttcctttgcatttggtg

SEQ ID NO: 1030751 - DNA, 22 bp, Artificial Sequence
  chemically synthesized
tacatacaccaccaaatgcaaa

SEQ ID NO: 1030752 - DNA, 22 bp, Artificial Sequence
  chemically synthesized
cttcatagttcctttgcatttg

SEQ ID NO: 1030753 - DNA, 22 bp, Artificial Sequence
  chemically synthesized
acatacaccaccaaatgcaaag

SEQ ID NO: 1030754 - DNA, 22 bp, Artificial Sequence
  chemically synthesized
catacaccaccaaatgcaaagg

SEQ ID NO: 1030755 - DNA, 22 bp, Artificial Sequence
  chemically synthesized
agtgcaaactgcttcatagttc

SEQ ID NO: 1030756 - DNA, 22 bp, Artificial Sequence
  chemically synthesized
gtctcagtgcaaactgcttcat

SEQ ID NO: 1030757 - DNA, 22 bp, Artificial Sequence
  chemically synthesized
actggtctcagtgcaaactgct

SEQ ID NO: 1030758 - DNA, 22 bp, Artificial Sequence
  chemically synthesized
aactggtctcagtgcaaactgc

SEQ ID NO: 1030759 - DNA, 22 bp, Artificial Sequence
  chemically synthesized
taactggtctcagtgcaaactg

SEQ ID NO: 1030760 - DNA, 22 bp, Artificial Sequence
  chemically synthesized
ggttttaactggtctcagtgca

SEQ ID NO: 1030761 - DNA, 22 bp, Artificial Sequence
  chemically synthesized
aggttttaactggtctcagtgc

SEQ ID NO: 1030762 - DNA, 22 bp, Artificial Sequence
  chemically synthesized
tgaagcagtttgcactgagacc

SEQ ID NO: 1030763 - DNA, 22 bp, Artificial Sequence
  chemically synthesized
gcactgagaccagttaaaacct

SEQ ID NO: 1030764 - DNA, 22 bp, Artificial Sequence
  chemically synthesized
cactgagaccagttaaaaccta

SEQ ID NO: 1030765 - DNA, 22 bp, Artificial Sequence
  chemically synthesized
aaggggagaatttaggttttaa

SEQ ID NO: 1030766 - DNA, 22 bp, Artificial Sequence
  chemically synthesized
agaccagttaaaacctaaattc

SEQ ID NO: 1030767 - DNA, 22 bp, Artificial Sequence
  chemically synthesized
aaacctaaattctcccctttag

SEQ ID NO: 1030768 - DNA, 22 bp, Artificial Sequence
  chemically synthesized
aattctcccctttagctatgcg

SEQ ID NO: 1030769 - DNA, 22 bp, Artificial Sequence
  chemically synthesized
tcccctttagctatgcggtgat

SEQ ID NO: 1030770 - DNA, 22 bp, Artificial Sequence
  chemically synthesized
ccctttagctatgcggtgatct

SEQ ID NO: 1030771 - DNA, 22 bp, Artificial Sequence
  chemically synthesized
tatgtagcaggaaatagatcac

SEQ ID NO: 1030772 - DNA, 22 bp, Artificial Sequence
  chemically synthesized
gtatgtagcaggaaatagatca

SEQ ID NO: 1030773 - DNA, 22 bp, Artificial Sequence
  chemically synthesized
tagctatgcggtgatctatttc

SEQ ID NO: 1030774 - DNA, 22 bp, Artificial Sequence
  chemically synthesized
tgtatgtagcaggaaatagatc

SEQ ID NO: 1030775 - DNA, 22 bp, Artificial Sequence
  chemically synthesized
agctatgcggtgatctatttcc

SEQ ID NO: 1030776 - DNA, 22 bp, Artificial Sequence
  chemically synthesized
gctatgcggtgatctatttcct

SEQ ID NO: 1030777 - DNA, 22 bp, Artificial Sequence
  chemically synthesized
tgcggtgatctatttcctgcta

SEQ ID NO: 1030778 - DNA, 22 bp, Artificial Sequence
  chemically synthesized
aggattttgtatgtagcaggaa

SEQ ID NO: 1030779 - DNA, 22 bp, Artificial Sequence
  chemically synthesized
caggattttgtatgtagcagga

SEQ ID NO: 1030780 - DNA, 22 bp, Artificial Sequence
  chemically synthesized
tcaggattttgtatgtagcagg

SEQ ID NO: 1030781 - DNA, 22 bp, Artificial Sequence
  chemically synthesized
ttcaggattttgtatgtagcag

SEQ ID NO: 1030782 - DNA, 22 bp, Artificial Sequence
  chemically synthesized
tttcaggattttgtatgtagca

SEQ ID NO: 1030783 - DNA, 22 bp, Artificial Sequence
  chemically synthesized
tttcctgctacatacaaaatcc

SEQ ID NO: 1030784 - DNA, 22 bp, Artificial Sequence
  chemically synthesized
cctgctacatacaaaatcctga

SEQ ID NO: 1030785 - DNA, 22 bp, Artificial Sequence
  chemically synthesized
ctgctacatacaaaatcctgaa

SEQ ID NO: 1030786 - DNA, 22 bp, Artificial Sequence
  chemically synthesized
cagccccattttttcaggattt

SEQ ID NO: 1030787 - DNA, 22 bp, Artificial Sequence
  chemically synthesized
ccagccccattttttcaggatt

SEQ ID NO: 1030788 - DNA, 22 bp, Artificial Sequence
  chemically synthesized
ctacatacaaaatcctgaaaaa

SEQ ID NO: 1030789 - DNA, 22 bp, Artificial Sequence
  chemically synthesized
cttccagccccattttttcagg

SEQ ID NO: 1030790 - DNA, 22 bp, Artificial Sequence
  chemically synthesized
catacaaaatcctgaaaaaatg

SEQ ID NO: 1030791 - DNA, 22 bp, Artificial Sequence
  chemically synthesized
gaattacttccagccccatttt

SEQ ID NO: 1030792 - DNA, 22 bp, Artificial Sequence
  chemically synthesized
aaagcactggaattacttccag

SEQ ID NO: 1030793 - DNA, 22 bp, Artificial Sequence
  chemically synthesized
aaaaaatggggctggaagtaat

SEQ ID NO: 1030794 - DNA, 22 bp, Artificial Sequence
  chemically synthesized
aaaagcactggaattacttcca

SEQ ID NO: 1030795 - DNA, 22 bp, Artificial Sequence
  chemically synthesized
ggtttaaaagcactggaattac

SEQ ID NO: 1030796 - DNA, 22 bp, Artificial Sequence
  chemically synthesized
tagattgggtttaaaagcactg

SEQ ID NO: 1030797 - DNA, 22 bp, Artificial Sequence
  chemically synthesized
gaagtaattccagtgcttttaa

SEQ ID NO: 1030798 - DNA, 22 bp, Artificial Sequence
  chemically synthesized
aattgtagattgggtttaaaag

SEQ ID NO: 1030799 - DNA, 22 bp, Artificial Sequence
  chemically synthesized
cagtgcttttaaacccaatcta

SEQ ID NO: 1030800 - DNA, 22 bp, Artificial Sequence
  chemically synthesized
ttaaacccaatctacaatttaa

SEQ ID NO: 1030801 - DNA, 22 bp, Artificial Sequence
  chemically synthesized
taaacccaatctacaatttaat

SEQ ID NO: 1030802 - DNA, 22 bp, Artificial Sequence
  chemically synthesized
aaacccaatctacaatttaatt

SEQ ID NO: 1030803 - DNA, 22 bp, Artificial Sequence
  chemically synthesized
aacccaatctacaatttaattt

SEQ ID NO: 1030804 - DNA, 22 bp, Artificial Sequence
  chemically synthesized
aaaggtcacaaaggaaattaaa

SEQ ID NO: 1030805 - DNA, 22 bp, Artificial Sequence
  chemically synthesized
caaaggtcacaaaggaaattaa

SEQ ID NO: 1030806 - DNA, 22 bp, Artificial Sequence
  chemically synthesized
caatttaatttcctttgtgacc

SEQ ID NO: 1030807 - DNA, 22 bp, Artificial Sequence
  chemically synthesized
aatttcctttgtgacctttgaa

SEQ ID NO: 1030808 - DNA, 22 bp, Artificial Sequence
  chemically synthesized
taacagtgatgtttcaaaggtc

SEQ ID NO: 1030809 - DNA, 22 bp, Artificial Sequence
  chemically synthesized
atttcctttgtgacctttgaaa

SEQ ID NO: 1030810 - DNA, 22 bp, Artificial Sequence
  chemically synthesized
tataacagtgatgtttcaaagg

SEQ ID NO: 1030811 - DNA, 22 bp, Artificial Sequence
  chemically synthesized
ctataacagtgatgtttcaaag

SEQ ID NO: 1030812 - DNA, 22 bp, Artificial Sequence
  chemically synthesized
cctttgtgacctttgaaacatc

SEQ ID NO: 1030813 - DNA, 22 bp, Artificial Sequence
  chemically synthesized
ctttgtgacctttgaaacatca

SEQ ID NO: 1030814 - DNA, 22 bp, Artificial Sequence
  chemically synthesized
tgtgacctttgaaacatcactg

SEQ ID NO: 1030815 - DNA, 22 bp, Artificial Sequence
  chemically synthesized
gtgacctttgaaacatcactgt

SEQ ID NO: 1030816 - DNA, 22 bp, Artificial Sequence
  chemically synthesized
tgacctttgaaacatcactgtt

SEQ ID NO: 1030817 - DNA, 22 bp, Artificial Sequence
  chemically synthesized
tgaaacatcactgttatagaag

SEQ ID NO: 1030818 - DNA, 22 bp, Artificial Sequence
  chemically synthesized
ggaatggtggaacttctataac

SEQ ID NO: 1030819 - DNA, 22 bp, Artificial Sequence
  chemically synthesized
gaaacatcactgttatagaagt

SEQ ID NO: 1030820 - DNA, 22 bp, Artificial Sequence
  chemically synthesized
aaacatcactgttatagaagtt

SEQ ID NO: 1030821 - DNA, 22 bp, Artificial Sequence
  chemically synthesized
gggcattaggaatggtggaact

SEQ ID NO: 1030822 - DNA, 22 bp, Artificial Sequence
  chemically synthesized
ttatagaagttccaccattcct

SEQ ID NO: 1030823 - DNA, 22 bp, Artificial Sequence
  chemically synthesized
tagaagttccaccattcctaat

SEQ ID NO: 1030824 - DNA, 22 bp, Artificial Sequence
  chemically synthesized
caccattcctaatgccccagat

SEQ ID NO: 1030825 - DNA, 22 bp, Artificial Sequence
  chemically synthesized
ctaatgccccagatttgccact

SEQ ID NO: 1030826 - DNA, 22 bp, Artificial Sequence
  chemically synthesized
ataaggaaacaacagtggcaaa

SEQ ID NO: 1030827 - DNA, 22 bp, Artificial Sequence
  chemically synthesized
aataaggaaacaacagtggcaa

SEQ ID NO: 1030828 - DNA, 22 bp, Artificial Sequence
  chemically synthesized
atgccccagatttgccactgtt

SEQ ID NO: 1030829 - DNA, 22 bp, Artificial Sequence
  chemically synthesized
ttaataaggaaacaacagtggc

SEQ ID NO: 1030830 - DNA, 22 bp, Artificial Sequence
  chemically synthesized
cttaataaggaaacaacagtgg

SEQ ID NO: 1030831 - DNA, 22 bp, Artificial Sequence
  chemically synthesized
cttcttaataaggaaacaacag

SEQ ID NO: 1030832 - DNA, 22 bp, Artificial Sequence
  chemically synthesized
gcttcttaataaggaaacaaca

SEQ ID NO: 1030833 - DNA, 22 bp, Artificial Sequence
  chemically synthesized
tgcttcttaataaggaaacaac

SEQ ID NO: 1030834 - DNA, 22 bp, Artificial Sequence
  chemically synthesized
ttttgcttcttaataaggaaac

SEQ ID NO: 1030835 - DNA, 22 bp, Artificial Sequence
  chemically synthesized
gttttgcttcttaataaggaaa

SEQ ID NO: 1030836 - DNA, 22 bp, Artificial Sequence
  chemically synthesized
tgttttgcttcttaataaggaa

SEQ ID NO: 1030837 - DNA, 22 bp, Artificial Sequence
  chemically synthesized
gccactgttgtttccttattaa

SEQ ID NO: 1030838 - DNA, 22 bp, Artificial Sequence
  chemically synthesized
ccactgttgtttccttattaag

SEQ ID NO: 1030839 - DNA, 22 bp, Artificial Sequence
  chemically synthesized
ctttgttttgcttcttaataag

SEQ ID NO: 1030840 - DNA, 22 bp, Artificial Sequence
  chemically synthesized
actttgttttgcttcttaataa

SEQ ID NO: 1030841 - DNA, 22 bp, Artificial Sequence
  chemically synthesized
tactttgttttgcttcttaata

SEQ ID NO: 1030842 - DNA, 22 bp, Artificial Sequence
  chemically synthesized
ttgtttccttattaagaagcaa

SEQ ID NO: 1030843 - DNA, 22 bp, Artificial Sequence
  chemically synthesized
ttttactttgttttgcttctta

SEQ ID NO: 1030844 - DNA, 22 bp, Artificial Sequence
  chemically synthesized
gttttactttgttttgcttctt

SEQ ID NO: 1030845 - DNA, 22 bp, Artificial Sequence
  chemically synthesized
tgttttactttgttttgcttct

SEQ ID NO: 1030846 - DNA, 22 bp, Artificial Sequence
  chemically synthesized
tttccttattaagaagcaaaac

SEQ ID NO: 1030847 - DNA, 22 bp, Artificial Sequence
  chemically synthesized
ttgttttactttgttttgcttc

SEQ ID NO: 1030848 - DNA, 22 bp, Artificial Sequence
  chemically synthesized
ccttattaagaagcaaaacaaa

SEQ ID NO: 1030849 - DNA, 22 bp, Artificial Sequence
  chemically synthesized
cttattaagaagcaaaacaaag

SEQ ID NO: 1030850 - DNA, 22 bp, Artificial Sequence
  chemically synthesized
attaagaagcaaaacaaagtaa

SEQ ID NO: 1030851 - DNA, 22 bp, Artificial Sequence
  chemically synthesized
ttaagaagcaaaacaaagtaaa

SEQ ID NO: 1030852 - DNA, 22 bp, Artificial Sequence
  chemically synthesized
agaagcaaaacaaagtaaaaca

SEQ ID NO: 1030853 - DNA, 22 bp, Artificial Sequence
  chemically synthesized
tgtgaaggtttttgttttactt

SEQ ID NO: 1030854 - DNA, 22 bp, Artificial Sequence
  chemically synthesized
aaaattatgtgaaggtttttgt

SEQ ID NO: 1030855 - DNA, 22 bp, Artificial Sequence
  chemically synthesized
agaagaaagagaactcaaaatt

SEQ ID NO: 1030856 - DNA, 22 bp, Artificial Sequence
  chemically synthesized
ctgagaagaaagagaactcaaa

SEQ ID NO: 1030857 - DNA, 22 bp, Artificial Sequence
  chemically synthesized
actgagaagaaagagaactcaa

SEQ ID NO: 1030858 - DNA, 22 bp, Artificial Sequence
  chemically synthesized
cacataattttgagttctcttt

SEQ ID NO: 1030859 - DNA, 22 bp, Artificial Sequence
  chemically synthesized
acataattttgagttctctttc

SEQ ID NO: 1030860 - DNA, 22 bp, Artificial Sequence
  chemically synthesized
ccttactgagaagaaagagaac

SEQ ID NO: 1030861 - DNA, 22 bp, Artificial Sequence
  chemically synthesized
cccttactgagaagaaagagaa

SEQ ID NO: 1030862 - DNA, 22 bp, Artificial Sequence
  chemically synthesized
tgagttctctttcttctcagta

SEQ ID NO: 1030863 - DNA, 22 bp, Artificial Sequence
  chemically synthesized
gagttctctttcttctcagtaa

SEQ ID NO: 1030864 - DNA, 22 bp, Artificial Sequence
  chemically synthesized
agttctctttcttctcagtaag

SEQ ID NO: 1030865 - DNA, 22 bp, Artificial Sequence
  chemically synthesized
agtgaaaatccttcccttactg

SEQ ID NO: 1030866 - DNA, 22 bp, Artificial Sequence
  chemically synthesized
tctttcttctcagtaagggaag

SEQ ID NO: 1030867 - DNA, 22 bp, Artificial Sequence
  chemically synthesized
tttcttctcagtaagggaagga

SEQ ID NO: 1030868 - DNA, 22 bp, Artificial Sequence
  chemically synthesized
tcttctcagtaagggaaggatt

SEQ ID NO: 1030869 - DNA, 22 bp, Artificial Sequence
  chemically synthesized
cttctcagtaagggaaggattt

SEQ ID NO: 1030870 - DNA, 22 bp, Artificial Sequence
  chemically synthesized
ttctcagtaagggaaggatttt

SEQ ID NO: 1030871 - DNA, 22 bp, Artificial Sequence
  chemically synthesized
ctcagtaagggaaggattttca

SEQ ID NO: 1030872 - DNA, 22 bp, Artificial Sequence
  chemically synthesized
tcagtaagggaaggattttcac

SEQ ID NO: 1030873 - DNA, 22 bp, Artificial Sequence
  chemically synthesized
agtaagggaaggattttcactt

SEQ ID NO: 1030874 - DNA, 22 bp, Artificial Sequence
  chemically synthesized
tcacttaacttcacttatctca

SEQ ID NO: 1030875 - DNA, 22 bp, Artificial Sequence
  chemically synthesized
cacttaacttcacttatctcat

SEQ ID NO: 1030876 - DNA, 22 bp, Artificial Sequence
  chemically synthesized
acttaacttcacttatctcatt

SEQ ID NO: 1030877 - DNA, 22 bp, Artificial Sequence
  chemically synthesized
aagaacacagaaaaatgagata

SEQ ID NO: 1030878 - DNA, 22 bp, Artificial Sequence
  chemically synthesized
aacttcacttatctcatttttc

SEQ ID NO: 1030879 - DNA, 22 bp, Artificial Sequence
  chemically synthesized
acttcacttatctcatttttct

SEQ ID NO: 1030880 - DNA, 22 bp, Artificial Sequence
  chemically synthesized
aggttgaagaacacagaaaaat

SEQ ID NO: 1030881 - DNA, 22 bp, Artificial Sequence
  chemically synthesized
aaggttgaagaacacagaaaaa

SEQ ID NO: 1030882 - DNA, 22 bp, Artificial Sequence
  chemically synthesized
cacttatctcatttttctgtgt

SEQ ID NO: 1030883 - DNA, 22 bp, Artificial Sequence
  chemically synthesized
acttatctcatttttctgtgtt

SEQ ID NO: 1030884 - DNA, 22 bp, Artificial Sequence
  chemically synthesized
atctcatttttctgtgttcttc

SEQ ID NO: 1030885 - DNA, 22 bp, Artificial Sequence
  chemically synthesized
tctcatttttctgtgttcttca

SEQ ID NO: 1030886 - DNA, 22 bp, Artificial Sequence
  chemically synthesized
gatgtagtttaaggttgaagaa

SEQ ID NO: 1030887 - DNA, 22 bp, Artificial Sequence
  chemically synthesized
atttttctgtgttcttcaacct

SEQ ID NO: 1030888 - DNA, 22 bp, Artificial Sequence
  chemically synthesized
ttctgtgttcttcaaccttaaa

SEQ ID NO: 1030889 - DNA, 22 bp, Artificial Sequence
  chemically synthesized
tctgtgttcttcaaccttaaac

SEQ ID NO: 1030890 - DNA, 22 bp, Artificial Sequence
  chemically synthesized
ctgtgttcttcaaccttaaact

SEQ ID NO: 1030891 - DNA, 22 bp, Artificial Sequence
  chemically synthesized
tgtgttcttcaaccttaaacta

SEQ ID NO: 1030892 - DNA, 22 bp, Artificial Sequence
  chemically synthesized
tgttcttcaaccttaaactaca

SEQ ID NO: 1030893 - DNA, 22 bp, Artificial Sequence
  chemically synthesized
ttcaaccttaaactacatccag

SEQ ID NO: 1030894 - DNA, 22 bp, Artificial Sequence
  chemically synthesized
caaccttaaactacatccagcc

SEQ ID NO: 1030895 - DNA, 22 bp, Artificial Sequence
  chemically synthesized
aaccttaaactacatccagcct

SEQ ID NO: 1030896 - DNA, 22 bp, Artificial Sequence
  chemically synthesized
agagagacatgaacaaggctgg

SEQ ID NO: 1030897 - DNA, 22 bp, Artificial Sequence
  chemically synthesized
aagagagacatgaacaaggctg

SEQ ID NO: 1030898 - DNA, 22 bp, Artificial Sequence
  chemically synthesized
aaactacatccagccttgttca

SEQ ID NO: 1030899 - DNA, 22 bp, Artificial Sequence
  chemically synthesized
aactacatccagccttgttcat

SEQ ID NO: 1030900 - DNA, 22 bp, Artificial Sequence
  chemically synthesized
catccagccttgttcatgtctc

SEQ ID NO: 1030901 - DNA, 22 bp, Artificial Sequence
  chemically synthesized
gttcatgtctctcttaaacttt

SEQ ID NO: 1030902 - DNA, 22 bp, Artificial Sequence
  chemically synthesized
ttcatgtctctcttaaactttc

SEQ ID NO: 1030903 - DNA, 22 bp, Artificial Sequence
  chemically synthesized
aaatgtataaagaagaaagttt

SEQ ID NO: 1030904 - DNA, 22 bp, Artificial Sequence
  chemically synthesized
atgtctctcttaaactttcttc

SEQ ID NO: 1030905 - DNA, 22 bp, Artificial Sequence
  chemically synthesized
gaaatgtataaagaagaaagtt

SEQ ID NO: 1030906 - DNA, 22 bp, Artificial Sequence
  chemically synthesized
tgaaatgtataaagaagaaagt

SEQ ID NO: 1030907 - DNA, 22 bp, Artificial Sequence
  chemically synthesized
ttgaaatgtataaagaagaaag

SEQ ID NO: 1030908 - DNA, 22 bp, Artificial Sequence
  chemically synthesized
tcttaaactttcttctttatac

SEQ ID NO: 1030909 - DNA, 22 bp, Artificial Sequence
  chemically synthesized
ttaaactttcttctttatacat

SEQ ID NO: 1030910 - DNA, 22 bp, Artificial Sequence
  chemically synthesized
aaactttcttctttatacattt

SEQ ID NO: 1030911 - DNA, 22 bp, Artificial Sequence
  chemically synthesized
aactttcttctttatacatttc

SEQ ID NO: 1030912 - DNA, 22 bp, Artificial Sequence
  chemically synthesized
tcttctttatacatttcaaaag

SEQ ID NO: 1030913 - DNA, 22 bp, Artificial Sequence
  chemically synthesized
cttctttatacatttcaaaagc

SEQ ID NO: 1030914 - DNA, 22 bp, Artificial Sequence
  chemically synthesized
ttctttatacatttcaaaagct

SEQ ID NO: 1030915 - DNA, 22 bp, Artificial Sequence
  chemically synthesized
ctttatacatttcaaaagcttt

SEQ ID NO: 1030916 - DNA, 22 bp, Artificial Sequence
  chemically synthesized
tttatacatttcaaaagctttg

SEQ ID NO: 1030917 - DNA, 22 bp, Artificial Sequence
  chemically synthesized
tatacatttcaaaagctttgct

SEQ ID NO: 1030918 - DNA, 22 bp, Artificial Sequence
  chemically synthesized
atacatttcaaaagctttgctc

SEQ ID NO: 1030919 - DNA, 22 bp, Artificial Sequence
  chemically synthesized
tacatttcaaaagctttgctct

SEQ ID NO: 1030920 - DNA, 22 bp, Artificial Sequence
  chemically synthesized
gatgacagaaaaagagcaaagc

SEQ ID NO: 1030921 - DNA, 22 bp, Artificial Sequence
  chemically synthesized
caaaagctttgctctttttctg

SEQ ID NO: 1030922 - DNA, 22 bp, Artificial Sequence
  chemically synthesized
aaaagctttgctctttttctgt

SEQ ID NO: 1030923 - DNA, 22 bp, Artificial Sequence
  chemically synthesized
gcccaattagatgacagaaaaa

SEQ ID NO: 1030924 - DNA, 22 bp, Artificial Sequence
  chemically synthesized
tgctctttttctgtcatctaat

SEQ ID NO: 1030925 - DNA, 22 bp, Artificial Sequence
  chemically synthesized
gctctttttctgtcatctaatt

SEQ ID NO: 1030926 - DNA, 22 bp, Artificial Sequence
  chemically synthesized
ctctttttctgtcatctaattg

SEQ ID NO: 1030927 - DNA, 22 bp, Artificial Sequence
  chemically synthesized
tttttctgtcatctaattgggc

SEQ ID NO: 1030928 - DNA, 22 bp, Artificial Sequence
  chemically synthesized
tttctgtcatctaattgggcta

SEQ ID NO: 1030929 - DNA, 22 bp, Artificial Sequence
  chemically synthesized
ttctgtcatctaattgggctag

SEQ ID NO: 1030930 - DNA, 22 bp, Artificial Sequence
  chemically synthesized
tctgtcatctaattgggctaga

SEQ ID NO: 1030931 - DNA, 22 bp, Artificial Sequence
  chemically synthesized
ctgtcatctaattgggctagat

SEQ ID NO: 1030932 - DNA, 22 bp, Artificial Sequence
  chemically synthesized
tgtcatctaattgggctagatc

SEQ ID NO: 1030933 - DNA, 22 bp, Artificial Sequence
  chemically synthesized
tcatctaattgggctagatctc

SEQ ID NO: 1030934 - DNA, 22 bp, Artificial Sequence
  chemically synthesized
attgggctagatctctattcat

SEQ ID NO: 1030935 - DNA, 22 bp, Artificial Sequence
  chemically synthesized
ggctagatctctattcatatta

SEQ ID NO: 1030936 - DNA, 22 bp, Artificial Sequence
  chemically synthesized
taacataaagagtaatatgaat

SEQ ID NO: 1030937 - DNA, 22 bp, Artificial Sequence
  chemically synthesized
gatctctattcatattactctt

SEQ ID NO: 1030938 - DNA, 22 bp, Artificial Sequence
  chemically synthesized
ataggttgtaacataaagagta

SEQ ID NO: 1030939 - DNA, 22 bp, Artificial Sequence
  chemically synthesized
tattcatattactctttatgtt

SEQ ID NO: 1030940 - DNA, 22 bp, Artificial Sequence
  chemically synthesized
gttaataggttgtaacataaag

SEQ ID NO: 1030941 - DNA, 22 bp, Artificial Sequence
  chemically synthesized
ttcatattactctttatgttac

SEQ ID NO: 1030942 - DNA, 22 bp, Artificial Sequence
  chemically synthesized
ggttaataggttgtaacataaa

SEQ ID NO: 1030943 - DNA, 22 bp, Artificial Sequence
  chemically synthesized
tggttaataggttgtaacataa

SEQ ID NO: 1030944 - DNA, 22 bp, Artificial Sequence
  chemically synthesized
atattactctttatgttacaac

SEQ ID NO: 1030945 - DNA, 22 bp, Artificial Sequence
  chemically synthesized
ctctttatgttacaacctatta

SEQ ID NO: 1030946 - DNA, 22 bp, Artificial Sequence
  chemically synthesized
tttatgttacaacctattaacc

SEQ ID NO: 1030947 - DNA, 22 bp, Artificial Sequence
  chemically synthesized
tatgttacaacctattaaccaa

SEQ ID NO: 1030948 - DNA, 22 bp, Artificial Sequence
  chemically synthesized
atgttacaacctattaaccaaa

SEQ ID NO: 1030949 - DNA, 22 bp, Artificial Sequence
  chemically synthesized
tgttacaacctattaaccaaaa

SEQ ID NO: 1030950 - DNA, 22 bp, Artificial Sequence
  chemically synthesized
ccacatgaaaatattttggtta

SEQ ID NO: 1030951 - DNA, 22 bp, Artificial Sequence
  chemically synthesized
gccacatgaaaatattttggtt

SEQ ID NO: 1030952 - DNA, 22 bp, Artificial Sequence
  chemically synthesized
tgccacatgaaaatattttggt

SEQ ID NO: 1030953 - DNA, 22 bp, Artificial Sequence
  chemically synthesized
caacctattaaccaaaatattt

SEQ ID NO: 1030954 - DNA, 22 bp, Artificial Sequence
  chemically synthesized
tttgccacatgaaaatattttg

SEQ ID NO: 1030955 - DNA, 22 bp, Artificial Sequence
  chemically synthesized
ttaaccaaaatattttcatgtg

SEQ ID NO: 1030956 - DNA, 22 bp, Artificial Sequence
  chemically synthesized
accaaaatattttcatgtggca

SEQ ID NO: 1030957 - DNA, 22 bp, Artificial Sequence
  chemically synthesized
atgatcagaattctttgccaca

SEQ ID NO: 1030958 - DNA, 22 bp, Artificial Sequence
  chemically synthesized
cctcatgatcagaattctttgc

SEQ ID NO: 1030959 - DNA, 22 bp, Artificial Sequence
  chemically synthesized
gcctcatgatcagaattctttg

SEQ ID NO: 1030960 - DNA, 22 bp, Artificial Sequence
  chemically synthesized
tgcctcatgatcagaattcttt

SEQ ID NO: 1030961 - DNA, 22 bp, Artificial Sequence
  chemically synthesized
tcatgtggcaaagaattctgat

SEQ ID NO: 1030962 - DNA, 22 bp, Artificial Sequence
  chemically synthesized
catgtggcaaagaattctgatc

SEQ ID NO: 1030963 - DNA, 22 bp, Artificial Sequence
  chemically synthesized
attttgcctcatgatcagaatt

SEQ ID NO: 1030964 - DNA, 22 bp, Artificial Sequence
  chemically synthesized
atgtggcaaagaattctgatca

SEQ ID NO: 1030965 - DNA, 22 bp, Artificial Sequence
  chemically synthesized
gttcattttgcctcatgatcag

SEQ ID NO: 1030966 - DNA, 22 bp, Artificial Sequence
  chemically synthesized
attagttcattttgcctcatga

SEQ ID NO: 1030967 - DNA, 22 bp, Artificial Sequence
  chemically synthesized
tcattagttcattttgcctcat

SEQ ID NO: 1030968 - DNA, 22 bp, Artificial Sequence
  chemically synthesized
ctcattagttcattttgcctca

SEQ ID NO: 1030969 - DNA, 22 bp, Artificial Sequence
  chemically synthesized
tctcattagttcattttgcctc

SEQ ID NO: 1030970 - DNA, 22 bp, Artificial Sequence
  chemically synthesized
ttctcattagttcattttgcct

SEQ ID NO: 1030971 - DNA, 22 bp, Artificial Sequence
  chemically synthesized
tgatcatgaggcaaaatgaact

SEQ ID NO: 1030972 - DNA, 22 bp, Artificial Sequence
  chemically synthesized
atcatgaggcaaaatgaactaa

SEQ ID NO: 1030973 - DNA, 22 bp, Artificial Sequence
  chemically synthesized
gaaatgaagacaaatttttctc

SEQ ID NO: 1030974 - DNA, 22 bp, Artificial Sequence
  chemically synthesized
actagaaatgaagacaaatttt

SEQ ID NO: 1030975 - DNA, 22 bp, Artificial Sequence
  chemically synthesized
cactagaaatgaagacaaattt

SEQ ID NO: 1030976 - DNA, 22 bp, Artificial Sequence
  chemically synthesized
tcactagaaatgaagacaaatt

SEQ ID NO: 1030977 - DNA, 22 bp, Artificial Sequence
  chemically synthesized
atgagaaaaatttgtcttcatt

SEQ ID NO: 1030978 - DNA, 22 bp, Artificial Sequence
  chemically synthesized
gttttcactagaaatgaagaca

SEQ ID NO: 1030979 - DNA, 22 bp, Artificial Sequence
  chemically synthesized
gtcttcatttctagtgaaaact

SEQ ID NO: 1030980 - DNA, 22 bp, Artificial Sequence
  chemically synthesized
tcttcatttctagtgaaaacta

SEQ ID NO: 1030981 - DNA, 22 bp, Artificial Sequence
  chemically synthesized
catttctagtgaaaactaattt

SEQ ID NO: 1030982 - DNA, 22 bp, Artificial Sequence
  chemically synthesized
atttctagtgaaaactaattta

SEQ ID NO: 1030983 - DNA, 22 bp, Artificial Sequence
  chemically synthesized
gagaaagcaagaataaattagt

SEQ ID NO: 1030984 - DNA, 22 bp, Artificial Sequence
  chemically synthesized
ctagtgaaaactaatttattct

SEQ ID NO: 1030985 - DNA, 22 bp, Artificial Sequence
  chemically synthesized
tagtgaaaactaatttattctt

SEQ ID NO: 1030986 - DNA, 22 bp, Artificial Sequence
  chemically synthesized
gtgaaaactaatttattcttgc

SEQ ID NO: 1030987 - DNA, 22 bp, Artificial Sequence
  chemically synthesized
aaatatccctagagaaagcaag

SEQ ID NO: 1030988 - DNA, 22 bp, Artificial Sequence
  chemically synthesized
gaaatatccctagagaaagcaa

SEQ ID NO: 1030989 - DNA, 22 bp, Artificial Sequence
  chemically synthesized
ttgaaatatccctagagaaagc

SEQ ID NO: 1030990 - DNA, 22 bp, Artificial Sequence
  chemically synthesized
atttattcttgctttctctagg

SEQ ID NO: 1030991 - DNA, 22 bp, Artificial Sequence
  chemically synthesized
attcttgctttctctagggata

SEQ ID NO: 1030992 - DNA, 22 bp, Artificial Sequence
  chemically synthesized
ttcttgctttctctagggatat

SEQ ID NO: 1030993 - DNA, 22 bp, Artificial Sequence
  chemically synthesized
ttgctttctctagggatatttc

SEQ ID NO: 1030994 - DNA, 22 bp, Artificial Sequence
  chemically synthesized
gctttctctagggatatttcaa

SEQ ID NO: 1030995 - DNA, 22 bp, Artificial Sequence
  chemically synthesized
ctttctctagggatatttcaag

SEQ ID NO: 1030996 - DNA, 22 bp, Artificial Sequence
  chemically synthesized
tctctagggatatttcaagaat

SEQ ID NO: 1030997 - DNA, 22 bp, Artificial Sequence
  chemically synthesized
ctctagggatatttcaagaatt

SEQ ID NO: 1030998 - DNA, 22 bp, Artificial Sequence
  chemically synthesized
tctagggatatttcaagaattg

SEQ ID NO: 1030999 - DNA, 22 bp, Artificial Sequence
  chemically synthesized
tagggatatttcaagaattgta

SEQ ID NO: 1031000 - DNA, 22 bp, Artificial Sequence
  chemically synthesized
aaagaccaaaagtacaattctt

SEQ ID NO: 1031001 - DNA, 22 bp, Artificial Sequence
  chemically synthesized
gggatatttcaagaattgtact

SEQ ID NO: 1031002 - DNA, 22 bp, Artificial Sequence
  chemically synthesized
aaagtcctaaaagaccaaaagt

SEQ ID NO: 1031003 - DNA, 22 bp, Artificial Sequence
  chemically synthesized
caaagtcctaaaagaccaaaag

SEQ ID NO: 1031004 - DNA, 22 bp, Artificial Sequence
  chemically synthesized
caagaattgtacttttggtctt

SEQ ID NO: 1031005 - DNA, 22 bp, Artificial Sequence
  chemically synthesized
tcaaagtcctaaaagaccaaaa

SEQ ID NO: 1031006 - DNA, 22 bp, Artificial Sequence
  chemically synthesized
aagaattgtacttttggtcttt

SEQ ID NO: 1031007 - DNA, 22 bp, Artificial Sequence
  chemically synthesized
caacattttcaaagtcctaaaa

SEQ ID NO: 1031008 - DNA, 22 bp, Artificial Sequence
  chemically synthesized
tacttttggtcttttaggactt

SEQ ID NO: 1031009 - DNA, 22 bp, Artificial Sequence
  chemically synthesized
ttggtcttttaggactttgaaa

SEQ ID NO: 1031010 - DNA, 22 bp, Artificial Sequence
  chemically synthesized
tggtcttttaggactttgaaaa

SEQ ID NO: 1031011 - DNA, 22 bp, Artificial Sequence
  chemically synthesized
ccaattccaacattttcaaagt

SEQ ID NO: 1031012 - DNA, 22 bp, Artificial Sequence
  chemically synthesized
ggtcttttaggactttgaaaat

SEQ ID NO: 1031013 - DNA, 22 bp, Artificial Sequence
  chemically synthesized
gtcttttaggactttgaaaatg

SEQ ID NO: 1031014 - DNA, 22 bp, Artificial Sequence
  chemically synthesized
actaccaattccaacattttca

SEQ ID NO: 1031015 - DNA, 22 bp, Artificial Sequence
  chemically synthesized
ttaggactttgaaaatgttgga

SEQ ID NO: 1031016 - DNA, 22 bp, Artificial Sequence
  chemically synthesized
taggactttgaaaatgttggaa

SEQ ID NO: 1031017 - DNA, 22 bp, Artificial Sequence
  chemically synthesized
aggactttgaaaatgttggaat

SEQ ID NO: 1031018 - DNA, 22 bp, Artificial Sequence
  chemically synthesized
ggactttgaaaatgttggaatt

SEQ ID NO: 1031019 - DNA, 22 bp, Artificial Sequence
  chemically synthesized
gaaattcactaccaattccaac

SEQ ID NO: 1031020 - DNA, 22 bp, Artificial Sequence
  chemically synthesized
gttagaaattcactaccaattc

SEQ ID NO: 1031021 - DNA, 22 bp, Artificial Sequence
  chemically synthesized
tgaaaatgttggaattggtagt

SEQ ID NO: 1031022 - DNA, 22 bp, Artificial Sequence
  chemically synthesized
ggttagaaattcactaccaatt

SEQ ID NO: 1031023 - DNA, 22 bp, Artificial Sequence
  chemically synthesized
gaaaatgttggaattggtagtg

SEQ ID NO: 1031024 - DNA, 22 bp, Artificial Sequence
  chemically synthesized
tggttagaaattcactaccaat

SEQ ID NO: 1031025 - DNA, 22 bp, Artificial Sequence
  chemically synthesized
aaaatgttggaattggtagtga

SEQ ID NO: 1031026 - DNA, 22 bp, Artificial Sequence
  chemically synthesized
gaattggtagtgaatttctaac

SEQ ID NO: 1031027 - DNA, 22 bp, Artificial Sequence
  chemically synthesized
tgcacagttttggttagaaatt

SEQ ID NO: 1031028 - DNA, 22 bp, Artificial Sequence
  chemically synthesized
atgcacagttttggttagaaat

SEQ ID NO: 1031029 - DNA, 22 bp, Artificial Sequence
  chemically synthesized
tatgcacagttttggttagaaa

SEQ ID NO: 1031030 - DNA, 22 bp, Artificial Sequence
  chemically synthesized
gtagtgaatttctaaccaaaac

SEQ ID NO: 1031031 - DNA, 22 bp, Artificial Sequence
  chemically synthesized
actttatgcacagttttggtta

SEQ ID NO: 1031032 - DNA, 22 bp, Artificial Sequence
  chemically synthesized
aagcagctgactttatgcacag

SEQ ID NO: 1031033 - DNA, 22 bp, Artificial Sequence
  chemically synthesized
gaagcagctgactttatgcaca

SEQ ID NO: 1031034 - DNA, 22 bp, Artificial Sequence
  chemically synthesized
ctaaccaaaactgtgcataaag

SEQ ID NO: 1031035 - DNA, 22 bp, Artificial Sequence
  chemically synthesized
tgaagcagctgactttatgcac

SEQ ID NO: 1031036 - DNA, 22 bp, Artificial Sequence
  chemically synthesized
taaccaaaactgtgcataaagt

SEQ ID NO: 1031037 - DNA, 22 bp, Artificial Sequence
  chemically synthesized
accaaaactgtgcataaagtca

SEQ ID NO: 1031038 - DNA, 22 bp, Artificial Sequence
  chemically synthesized
ctttgaagcagctgactttatg

SEQ ID NO: 1031039 - DNA, 22 bp, Artificial Sequence
  chemically synthesized
gctttgaagcagctgactttat

SEQ ID NO: 1031040 - DNA, 22 bp, Artificial Sequence
  chemically synthesized
tgacttgctttgaagcagctga

SEQ ID NO: 1031041 - DNA, 22 bp, Artificial Sequence
  chemically synthesized
tatgacttgctttgaagcagct

SEQ ID NO: 1031042 - DNA, 22 bp, Artificial Sequence
  chemically synthesized
tgcataaagtcagctgcttcaa

SEQ ID NO: 1031043 - DNA, 22 bp, Artificial Sequence
  chemically synthesized
ctatgacttgctttgaagcagc

SEQ ID NO: 1031044 - DNA, 22 bp, Artificial Sequence
  chemically synthesized
gaggcttctatgacttgctttg

SEQ ID NO: 1031045 - DNA, 22 bp, Artificial Sequence
  chemically synthesized
ctggaggcttctatgacttgct

SEQ ID NO: 1031046 - DNA, 22 bp, Artificial Sequence
  chemically synthesized
cttcaaagcaagtcatagaagc

SEQ ID NO: 1031047 - DNA, 22 bp, Artificial Sequence
  chemically synthesized
caaagcaagtcatagaagcctc

SEQ ID NO: 1031048 - DNA, 22 bp, Artificial Sequence
  chemically synthesized
aaagcaagtcatagaagcctcc

SEQ ID NO: 1031049 - DNA, 22 bp, Artificial Sequence
  chemically synthesized
gtcacagaattgctggaggctt

SEQ ID NO: 1031050 - DNA, 22 bp, Artificial Sequence
  chemically synthesized
ggtcacagaattgctggaggct

SEQ ID NO: 1031051 - DNA, 22 bp, Artificial Sequence
  chemically synthesized
tggtcacagaattgctggaggc

SEQ ID NO: 1031052 - DNA, 22 bp, Artificial Sequence
  chemically synthesized
tttggtcacagaattgctggag

SEQ ID NO: 1031053 - DNA, 22 bp, Artificial Sequence
  chemically synthesized
ctttggtcacagaattgctgga

SEQ ID NO: 1031054 - DNA, 22 bp, Artificial Sequence
  chemically synthesized
tctttggtcacagaattgctgg

SEQ ID NO: 1031055 - DNA, 22 bp, Artificial Sequence
  chemically synthesized
ttctttggtcacagaattgctg

SEQ ID NO: 1031056 - DNA, 22 bp, Artificial Sequence
  chemically synthesized
cttttctttggtcacagaattg

SEQ ID NO: 1031057 - DNA, 22 bp, Artificial Sequence
  chemically synthesized
gggttacttttctttggtcaca

SEQ ID NO: 1031058 - DNA, 22 bp, Artificial Sequence
  chemically synthesized
cagcaattctgtgaccaaagaa

SEQ ID NO: 1031059 - DNA, 22 bp, Artificial Sequence
  chemically synthesized
atattagggttacttttctttg

SEQ ID NO: 1031060 - DNA, 22 bp, Artificial Sequence
  chemically synthesized
tgtgaccaaagaaaagtaaccc

SEQ ID NO: 1031061 - DNA, 22 bp, Artificial Sequence
  chemically synthesized
tgaccaaagaaaagtaacccta

SEQ ID NO: 1031062 - DNA, 22 bp, Artificial Sequence
  chemically synthesized
aagtcaaaggaaaggttaatat

SEQ ID NO: 1031063 - DNA, 22 bp, Artificial Sequence
  chemically synthesized
aaagtcaaaggaaaggttaata

SEQ ID NO: 1031064 - DNA, 22 bp, Artificial Sequence
  chemically synthesized
taaagtcaaaggaaaggttaat

SEQ ID NO: 1031065 - DNA, 22 bp, Artificial Sequence
  chemically synthesized
tctttaaagtcaaaggaaaggt

SEQ ID NO: 1031066 - DNA, 22 bp, Artificial Sequence
  chemically synthesized
ttgtctttaaagtcaaaggaaa

SEQ ID NO: 1031067 - DNA, 22 bp, Artificial Sequence
  chemically synthesized
atattaacctttcctttgactt

SEQ ID NO: 1031068 - DNA, 22 bp, Artificial Sequence
  chemically synthesized
aaattattgtctttaaagtcaa

SEQ ID NO: 1031069 - DNA, 22 bp, Artificial Sequence
  chemically synthesized
acctttcctttgactttaaaga

SEQ ID NO: 1031070 - DNA, 22 bp, Artificial Sequence
  chemically synthesized
ttcaaattattgtctttaaagt

SEQ ID NO: 1031071 - DNA, 22 bp, Artificial Sequence
  chemically synthesized
tcctttgactttaaagacaata

SEQ ID NO: 1031072 - DNA, 22 bp, Artificial Sequence
  chemically synthesized
cctttgactttaaagacaataa

SEQ ID NO: 1031073 - DNA, 22 bp, Artificial Sequence
  chemically synthesized
ctttgactttaaagacaataat

SEQ ID NO: 1031074 - DNA, 22 bp, Artificial Sequence
  chemically synthesized
gaaattattcaaattattgtct

SEQ ID NO: 1031075 - DNA, 22 bp, Artificial Sequence
  chemically synthesized
tgactttaaagacaataatttg

SEQ ID NO: 1031076 - DNA, 22 bp, Artificial Sequence
  chemically synthesized
ctggaaattattcaaattattg

SEQ ID NO: 1031077 - DNA, 22 bp, Artificial Sequence
  chemically synthesized
gactttaaagacaataatttga

SEQ ID NO: 1031078 - DNA, 22 bp, Artificial Sequence
  chemically synthesized
actttaaagacaataatttgaa

SEQ ID NO: 1031079 - DNA, 22 bp, Artificial Sequence
  chemically synthesized
taaagacaataatttgaataat

SEQ ID NO: 1031080 - DNA, 22 bp, Artificial Sequence
  chemically synthesized
aaagacaataatttgaataatt

SEQ ID NO: 1031081 - DNA, 22 bp, Artificial Sequence
  chemically synthesized
aagtctcctggaaattattcaa

SEQ ID NO: 1031082 - DNA, 22 bp, Artificial Sequence
  chemically synthesized
aagacaataatttgaataattt

SEQ ID NO: 1031083 - DNA, 22 bp, Artificial Sequence
  chemically synthesized
caagtctcctggaaattattca

SEQ ID NO: 1031084 - DNA, 22 bp, Artificial Sequence
  chemically synthesized
tcaagtctcctggaaattattc

SEQ ID NO: 1031085 - DNA, 22 bp, Artificial Sequence
  chemically synthesized
ttcaagtctcctggaaattatt

SEQ ID NO: 1031086 - DNA, 22 bp, Artificial Sequence
  chemically synthesized
tttcaagtctcctggaaattat

SEQ ID NO: 1031087 - DNA, 22 bp, Artificial Sequence
  chemically synthesized
gaataatttccaggagacttga

SEQ ID NO: 1031088 - DNA, 22 bp, Artificial Sequence
  chemically synthesized
aataatttccaggagacttgaa

SEQ ID NO: 1031089 - DNA, 22 bp, Artificial Sequence
  chemically synthesized
tgtgaagattttttcaagtctc

SEQ ID NO: 1031090 - DNA, 22 bp, Artificial Sequence
  chemically synthesized
gtgtgaagattttttcaagtct

SEQ ID NO: 1031091 - DNA, 22 bp, Artificial Sequence
  chemically synthesized
tgtgtgaagattttttcaagtc

SEQ ID NO: 1031092 - DNA, 22 bp, Artificial Sequence
  chemically synthesized
ttgtgtgaagattttttcaagt

SEQ ID NO: 1031093 - DNA, 22 bp, Artificial Sequence
  chemically synthesized
tttttgtgtgaagattttttca

SEQ ID NO: 1031094 - DNA, 22 bp, Artificial Sequence
  chemically synthesized
atttttgtgtgaagattttttc

SEQ ID NO: 1031095 - DNA, 22 bp, Artificial Sequence
  chemically synthesized
ccaggagacttgaaaaaatctt

SEQ ID NO: 1031096 - DNA, 22 bp, Artificial Sequence
  chemically synthesized
tatttttgtgtgaagatttttt

SEQ ID NO: 1031097 - DNA, 22 bp, Artificial Sequence
  chemically synthesized
caggagacttgaaaaaatcttc

SEQ ID NO: 1031098 - DNA, 22 bp, Artificial Sequence
  chemically synthesized
acaaaactttatttttgtgtga

SEQ ID NO: 1031099 - DNA, 22 bp, Artificial Sequence
  chemically synthesized
aacaaaactttatttttgtgtg

SEQ ID NO: 1031100 - DNA, 22 bp, Artificial Sequence
  chemically synthesized
gaaaaaatcttcacacaaaaat

SEQ ID NO: 1031101 - DNA, 22 bp, Artificial Sequence
  chemically synthesized
aaaaaatcttcacacaaaaata

SEQ ID NO: 1031102 - DNA, 22 bp, Artificial Sequence
  chemically synthesized
atttaacaaaactttatttttg

SEQ ID NO: 1031103 - DNA, 22 bp, Artificial Sequence
  chemically synthesized
cacacaaaaataaagttttgtt

SEQ ID NO: 1031104 - DNA, 22 bp, Artificial Sequence
  chemically synthesized
acacaaaaataaagttttgtta

SEQ ID NO: 1031105 - DNA, 22 bp, Artificial Sequence
  chemically synthesized
aaagtattgatttaacaaaact

SEQ ID NO: 1031106 - DNA, 22 bp, Artificial Sequence
  chemically synthesized
tcaaagtattgatttaacaaaa

SEQ ID NO: 1031107 - DNA, 22 bp, Artificial Sequence
  chemically synthesized
ctcaaagtattgatttaacaaa

SEQ ID NO: 1031108 - DNA, 22 bp, Artificial Sequence
  chemically synthesized
ggggtatttctcaaagtattga

SEQ ID NO: 1031109 - DNA, 22 bp, Artificial Sequence
  chemically synthesized
gggggtatttctcaaagtattg

SEQ ID NO: 1031110 - DNA, 22 bp, Artificial Sequence
  chemically synthesized
tgttaaatcaatactttgagaa

SEQ ID NO: 1031111 - DNA, 22 bp, Artificial Sequence
  chemically synthesized
gttaaatcaatactttgagaaa

SEQ ID NO: 1031112 - DNA, 22 bp, Artificial Sequence
  chemically synthesized
ttaaatcaatactttgagaaat

SEQ ID NO: 1031113 - DNA, 22 bp, Artificial Sequence
  chemically synthesized
aatcaatactttgagaaatacc

SEQ ID NO: 1031114 - DNA, 22 bp, Artificial Sequence
  chemically synthesized
tgagaaatacccccaaattatt

SEQ ID NO: 1031115 - DNA, 22 bp, Artificial Sequence
  chemically synthesized
gagaaatacccccaaattattt

SEQ ID NO: 1031116 - DNA, 22 bp, Artificial Sequence
  chemically synthesized
tcaccaatatagaaataatttg

SEQ ID NO: 1031117 - DNA, 22 bp, Artificial Sequence
  chemically synthesized
agaaatacccccaaattatttc

SEQ ID NO: 1031118 - DNA, 22 bp, Artificial Sequence
  chemically synthesized
ctatcaccaatatagaaataat

SEQ ID NO: 1031119 - DNA, 22 bp, Artificial Sequence
  chemically synthesized
actatcaccaatatagaaataa

SEQ ID NO: 1031120 - DNA, 22 bp, Artificial Sequence
  chemically synthesized
tactatcaccaatatagaaata

SEQ ID NO: 1031121 - DNA, 22 bp, Artificial Sequence
  chemically synthesized
ttactatcaccaatatagaaat

SEQ ID NO: 1031122 - DNA, 22 bp, Artificial Sequence
  chemically synthesized
tcttttactatcaccaatatag

SEQ ID NO: 1031123 - DNA, 22 bp, Artificial Sequence
  chemically synthesized
gtcttttactatcaccaatata

SEQ ID NO: 1031124 - DNA, 22 bp, Artificial Sequence
  chemically synthesized
aatttgtcttttactatcacca

SEQ ID NO: 1031125 - DNA, 22 bp, Artificial Sequence
  chemically synthesized
gaatttgtcttttactatcacc

SEQ ID NO: 1031126 - DNA, 22 bp, Artificial Sequence
  chemically synthesized
tttctatattggtgatagtaaa

SEQ ID NO: 1031127 - DNA, 22 bp, Artificial Sequence
  chemically synthesized
ctatattggtgatagtaaaaga

SEQ ID NO: 1031128 - DNA, 22 bp, Artificial Sequence
  chemically synthesized
tatattggtgatagtaaaagac

SEQ ID NO: 1031129 - DNA, 22 bp, Artificial Sequence
  chemically synthesized
tattggtgatagtaaaagacaa

SEQ ID NO: 1031130 - DNA, 22 bp, Artificial Sequence
  chemically synthesized
gtgatagtaaaagacaaattca

SEQ ID NO: 1031131 - DNA, 22 bp, Artificial Sequence
  chemically synthesized
aacgacataaaatacttgaatt

SEQ ID NO: 1031132 - DNA, 22 bp, Artificial Sequence
  chemically synthesized
gaacgacataaaatacttgaat

SEQ ID NO: 1031133 - DNA, 22 bp, Artificial Sequence
  chemically synthesized
ttgaacgacataaaatacttga

SEQ ID NO: 1031134 - DNA, 22 bp, Artificial Sequence
  chemically synthesized
cttgaacgacataaaatacttg

SEQ ID NO: 1031135 - DNA, 22 bp, Artificial Sequence
  chemically synthesized
aagtattttatgtcgttcaaga

SEQ ID NO: 1031136 - DNA, 22 bp, Artificial Sequence
  chemically synthesized
cacaagccaatttcttgaacga

SEQ ID NO: 1031137 - DNA, 22 bp, Artificial Sequence
  chemically synthesized
tatgtcgttcaagaaattggct

SEQ ID NO: 1031138 - DNA, 22 bp, Artificial Sequence
  chemically synthesized
atgtcgttcaagaaattggctt

SEQ ID NO: 1031139 - DNA, 22 bp, Artificial Sequence
  chemically synthesized
tgtcgttcaagaaattggcttg

SEQ ID NO: 1031140 - DNA, 22 bp, Artificial Sequence
  chemically synthesized
aagaaattggcttgtgtaggat

SEQ ID NO: 1031141 - DNA, 22 bp, Artificial Sequence
  chemically synthesized
aaggtcacgtgcacaatcctac

SEQ ID NO: 1031142 - DNA, 22 bp, Artificial Sequence
  chemically synthesized
gcttgtgtaggattgtgcacgt

SEQ ID NO: 1031143 - DNA, 22 bp, Artificial Sequence
  chemically synthesized
gtgtaggattgtgcacgtgacc

SEQ ID NO: 1031144 - DNA, 22 bp, Artificial Sequence
  chemically synthesized
tgtaggattgtgcacgtgacct

SEQ ID NO: 1031145 - DNA, 22 bp, Artificial Sequence
  chemically synthesized
gaagtggaaattaaaggtcacg

SEQ ID NO: 1031146 - DNA, 22 bp, Artificial Sequence
  chemically synthesized
tgcacgtgacctttaatttcca

SEQ ID NO: 1031147 - DNA, 22 bp, Artificial Sequence
  chemically synthesized
gtgacaaaattagaagtggaaa

SEQ ID NO: 1031148 - DNA, 22 bp, Artificial Sequence
  chemically synthesized
taatttccacttctaattttgt

SEQ ID NO: 1031149 - DNA, 22 bp, Artificial Sequence
  chemically synthesized
aatttccacttctaattttgtc

SEQ ID NO: 1031150 - DNA, 22 bp, Artificial Sequence
  chemically synthesized
ataacagttagtgacaaaatta

SEQ ID NO: 1031151 - DNA, 22 bp, Artificial Sequence
  chemically synthesized
atttccacttctaattttgtca

SEQ ID NO: 1031152 - DNA, 22 bp, Artificial Sequence
  chemically synthesized
ccacttctaattttgtcactaa

SEQ ID NO: 1031153 - DNA, 22 bp, Artificial Sequence
  chemically synthesized
cacttctaattttgtcactaac

SEQ ID NO: 1031154 - DNA, 22 bp, Artificial Sequence
  chemically synthesized
agtgtgattcataacagttagt

SEQ ID NO: 1031155 - DNA, 22 bp, Artificial Sequence
  chemically synthesized
ctaattttgtcactaactgtta

SEQ ID NO: 1031156 - DNA, 22 bp, Artificial Sequence
  chemically synthesized
aagtgtgattcataacagttag

SEQ ID NO: 1031157 - DNA, 22 bp, Artificial Sequence
  chemically synthesized
taattttgtcactaactgttat

SEQ ID NO: 1031158 - DNA, 22 bp, Artificial Sequence
  chemically synthesized
taagtgtgattcataacagtta

SEQ ID NO: 1031159 - DNA, 22 bp, Artificial Sequence
  chemically synthesized
ttaagtgtgattcataacagtt

SEQ ID NO: 1031160 - DNA, 22 bp, Artificial Sequence
  chemically synthesized
attttgtcactaactgttatga

SEQ ID NO: 1031161 - DNA, 22 bp, Artificial Sequence
  chemically synthesized
tttaagtgtgattcataacagt

SEQ ID NO: 1031162 - DNA, 22 bp, Artificial Sequence
  chemically synthesized
ttttttaagtgtgattcataac

SEQ ID NO: 1031163 - DNA, 22 bp, Artificial Sequence
  chemically synthesized
tgtcactaactgttatgaatca

SEQ ID NO: 1031164 - DNA, 22 bp, Artificial Sequence
  chemically synthesized
gttttttaagtgtgattcataa

SEQ ID NO: 1031165 - DNA, 22 bp, Artificial Sequence
  chemically synthesized
gtcactaactgttatgaatcac

SEQ ID NO: 1031166 - DNA, 22 bp, Artificial Sequence
  chemically synthesized
tcactaactgttatgaatcaca

SEQ ID NO: 1031167 - DNA, 22 bp, Artificial Sequence
  chemically synthesized
actgttatgaatcacacttaaa

SEQ ID NO: 1031168 - DNA, 22 bp, Artificial Sequence
  chemically synthesized
ttatgaatcacacttaaaaaac

SEQ ID NO: 1031169 - DNA, 22 bp, Artificial Sequence
  chemically synthesized
tgaatcacacttaaaaaacaaa

SEQ ID NO: 1031170 - DNA, 22 bp, Artificial Sequence
  chemically synthesized
aaaagatcatagccatggtttg

SEQ ID NO: 1031171 - DNA, 22 bp, Artificial Sequence
  chemically synthesized
aaaaagatcatagccatggttt

SEQ ID NO: 1031172 - DNA, 22 bp, Artificial Sequence
  chemically synthesized
taaaaagatcatagccatggtt

SEQ ID NO: 1031173 - DNA, 22 bp, Artificial Sequence
  chemically synthesized
aaaaaacaaaccatggctatga

SEQ ID NO: 1031174 - DNA, 22 bp, Artificial Sequence
  chemically synthesized
aaaaacaaaccatggctatgat

SEQ ID NO: 1031175 - DNA, 22 bp, Artificial Sequence
  chemically synthesized
cagctttaaaaagatcatagcc

SEQ ID NO: 1031176 - DNA, 22 bp, Artificial Sequence
  chemically synthesized
acagctttaaaaagatcatagc

SEQ ID NO: 1031177 - DNA, 22 bp, Artificial Sequence
  chemically synthesized
tacagctttaaaaagatcatag

SEQ ID NO: 1031178 - DNA, 22 bp, Artificial Sequence
  chemically synthesized
ctttacagctttaaaaagatca

SEQ ID NO: 1031179 - DNA, 22 bp, Artificial Sequence
  chemically synthesized
gctttacagctttaaaaagatc

SEQ ID NO: 1031180 - DNA, 22 bp, Artificial Sequence
  chemically synthesized
agtcttgctttacagctttaaa

SEQ ID NO: 1031181 - DNA, 22 bp, Artificial Sequence
  chemically synthesized
ttgagtcttgctttacagcttt

SEQ ID NO: 1031182 - DNA, 22 bp, Artificial Sequence
  chemically synthesized
tgatctttttaaagctgtaaag

SEQ ID NO: 1031183 - DNA, 22 bp, Artificial Sequence
  chemically synthesized
tgaattattgagtcttgcttta

SEQ ID NO: 1031184 - DNA, 22 bp, Artificial Sequence
  chemically synthesized
tttaaagctgtaaagcaagact

SEQ ID NO: 1031185 - DNA, 22 bp, Artificial Sequence
  chemically synthesized
tgtgaattattgagtcttgctt

SEQ ID NO: 1031186 - DNA, 22 bp, Artificial Sequence
  chemically synthesized
ttaaagctgtaaagcaagactc

SEQ ID NO: 1031187 - DNA, 22 bp, Artificial Sequence
  chemically synthesized
taaagctgtaaagcaagactca

SEQ ID NO: 1031188 - DNA, 22 bp, Artificial Sequence
  chemically synthesized
aaagctgtaaagcaagactcaa

SEQ ID NO: 1031189 - DNA, 22 bp, Artificial Sequence
  chemically synthesized
aagctgtaaagcaagactcaat

SEQ ID NO: 1031190 - DNA, 22 bp, Artificial Sequence
  chemically synthesized
gctctgtgaattattgagtctt

SEQ ID NO: 1031191 - DNA, 22 bp, Artificial Sequence
  chemically synthesized
gttagctctgtgaattattgag

SEQ ID NO: 1031192 - DNA, 22 bp, Artificial Sequence
  chemically synthesized
ggttagctctgtgaattattga

SEQ ID NO: 1031193 - DNA, 22 bp, Artificial Sequence
  chemically synthesized
taaagcaagactcaataattca

SEQ ID NO: 1031194 - DNA, 22 bp, Artificial Sequence
  chemically synthesized
tggttagctctgtgaattattg

SEQ ID NO: 1031195 - DNA, 22 bp, Artificial Sequence
  chemically synthesized
acctttggttagctctgtgaat

SEQ ID NO: 1031196 - DNA, 22 bp, Artificial Sequence
  chemically synthesized
tgtactcacctttggttagctc

SEQ ID NO: 1031197 - DNA, 22 bp, Artificial Sequence
  chemically synthesized
aataattcacagagctaaccaa

SEQ ID NO: 1031198 - DNA, 22 bp, Artificial Sequence
  chemically synthesized
ctatgtactcacctttggttag

SEQ ID NO: 1031199 - DNA, 22 bp, Artificial Sequence
  chemically synthesized
acagagctaaccaaaggtgagt

SEQ ID NO: 1031200 - DNA, 22 bp, Artificial Sequence
  chemically synthesized
atattcctatgtactcaccttt

SEQ ID NO: 1031201 - DNA, 22 bp, Artificial Sequence
  chemically synthesized
gatattcctatgtactcacctt

SEQ ID NO: 1031202 - DNA, 22 bp, Artificial Sequence
  chemically synthesized
tgatattcctatgtactcacct

SEQ ID NO: 1031203 - DNA, 22 bp, Artificial Sequence
  chemically synthesized
accaaaggtgagtacataggaa

SEQ ID NO: 1031204 - DNA, 22 bp, Artificial Sequence
  chemically synthesized
atgtatacctttgatattccta

SEQ ID NO: 1031205 - DNA, 22 bp, Artificial Sequence
  chemically synthesized
ctaatgtatacctttgatattc

SEQ ID NO: 1031206 - DNA, 22 bp, Artificial Sequence
  chemically synthesized
gctaatgtatacctttgatatt

SEQ ID NO: 1031207 - DNA, 22 bp, Artificial Sequence
  chemically synthesized
tgctaatgtatacctttgatat

SEQ ID NO: 1031208 - DNA, 22 bp, Artificial Sequence
  chemically synthesized
ttgctaatgtatacctttgata

SEQ ID NO: 1031209 - DNA, 22 bp, Artificial Sequence
  chemically synthesized
atcttttgctaatgtatacctt

SEQ ID NO: 1031210 - DNA, 22 bp, Artificial Sequence
  chemically synthesized
aatcttttgctaatgtatacct

SEQ ID NO: 1031211 - DNA, 22 bp, Artificial Sequence
  chemically synthesized
tttaatcttttgctaatgtata

SEQ ID NO: 1031212 - DNA, 22 bp, Artificial Sequence
  chemically synthesized
gtttaatcttttgctaatgtat

SEQ ID NO: 1031213 - DNA, 22 bp, Artificial Sequence
  chemically synthesized
cttgtttaatcttttgctaatg

SEQ ID NO: 1031214 - DNA, 22 bp, Artificial Sequence
  chemically synthesized
acttgtttaatcttttgctaat

SEQ ID NO: 1031215 - DNA, 22 bp, Artificial Sequence
  chemically synthesized
acttacttgtttaatcttttgc

SEQ ID NO: 1031216 - DNA, 22 bp, Artificial Sequence
  chemically synthesized
ttgacttacttgtttaatcttt

SEQ ID NO: 1031217 - DNA, 22 bp, Artificial Sequence
  chemically synthesized
attgacttacttgtttaatctt

SEQ ID NO: 1031218 - DNA, 22 bp, Artificial Sequence
  chemically synthesized
cttattgacttacttgtttaat

SEQ ID NO: 1031219 - DNA, 22 bp, Artificial Sequence
  chemically synthesized
ccttattgacttacttgtttaa

SEQ ID NO: 1031220 - DNA, 22 bp, Artificial Sequence
  chemically synthesized
ttccttattgacttacttgttt

SEQ ID NO: 1031221 - DNA, 22 bp, Artificial Sequence
  chemically synthesized
cttccttattgacttacttgtt

SEQ ID NO: 1031222 - DNA, 22 bp, Artificial Sequence
  chemically synthesized
gcaaaagattaaacaagtaagt

SEQ ID NO: 1031223 - DNA, 22 bp, Artificial Sequence
  chemically synthesized
tttcttccttattgacttactt

SEQ ID NO: 1031224 - DNA, 22 bp, Artificial Sequence
  chemically synthesized
tatttcttccttattgacttac

SEQ ID NO: 1031225 - DNA, 22 bp, Artificial Sequence
  chemically synthesized
ctatttcttccttattgactta

SEQ ID NO: 1031226 - DNA, 22 bp, Artificial Sequence
  chemically synthesized
tctatttcttccttattgactt

SEQ ID NO: 1031227 - DNA, 22 bp, Artificial Sequence
  chemically synthesized
aacaagtaagtcaataaggaag

SEQ ID NO: 1031228 - DNA, 22 bp, Artificial Sequence
  chemically synthesized
tgtctttctatttcttccttat

SEQ ID NO: 1031229 - DNA, 22 bp, Artificial Sequence
  chemically synthesized
tgtggctgtgtctttctatttc

SEQ ID NO: 1031230 - DNA, 22 bp, Artificial Sequence
  chemically synthesized
gtgtggctgtgtctttctattt

SEQ ID NO: 1031231 - DNA, 22 bp, Artificial Sequence
  chemically synthesized
aggcttgtgtggctgtgtcttt

SEQ ID NO: 1031232 - DNA, 22 bp, Artificial Sequence
  chemically synthesized
tgaggcttgtgtggctgtgtct

SEQ ID NO: 1031233 - DNA, 22 bp, Artificial Sequence
  chemically synthesized
tattctgaggcttgtgtggctg

SEQ ID NO: 1031234 - DNA, 22 bp, Artificial Sequence
  chemically synthesized
gtattctgaggcttgtgtggct

SEQ ID NO: 1031235 - DNA, 22 bp, Artificial Sequence
  chemically synthesized
tgtattctgaggcttgtgtggc

SEQ ID NO: 1031236 - DNA, 22 bp, Artificial Sequence
  chemically synthesized
ttgtattctgaggcttgtgtgg

SEQ ID NO: 1031237 - DNA, 22 bp, Artificial Sequence
  chemically synthesized
accatcagcttttgtattctga

SEQ ID NO: 1031238 - DNA, 22 bp, Artificial Sequence
  chemically synthesized
attcaccatcagcttttgtatt

SEQ ID NO: 1031239 - DNA, 22 bp, Artificial Sequence
  chemically synthesized
gatcctgattcaccatcagctt

SEQ ID NO: 1031240 - DNA, 22 bp, Artificial Sequence
  chemically synthesized
tggatcctgattcaccatcagc

SEQ ID NO: 1031241 - DNA, 22 bp, Artificial Sequence
  chemically synthesized
agaatacaaaagctgatggtga

SEQ ID NO: 1031242 - DNA, 22 bp, Artificial Sequence
  chemically synthesized
ctctggatcctgattcaccatc

SEQ ID NO: 1031243 - DNA, 22 bp, Artificial Sequence
  chemically synthesized
cattcctctggatcctgattca

SEQ ID NO: 1031244 - DNA, 22 bp, Artificial Sequence
  chemically synthesized
ctgcattcctctggatcctgat

SEQ ID NO: 1031245 - DNA, 22 bp, Artificial Sequence
  chemically synthesized
actcctgcattcctctggatcc

SEQ ID NO: 1031246 - DNA, 22 bp, Artificial Sequence
  chemically synthesized
atggtgaatcaggatccagagg

SEQ ID NO: 1031247 - DNA, 22 bp, Artificial Sequence
  chemically synthesized
tgactcctgcattcctctggat

SEQ ID NO: 1031248 - DNA, 22 bp, Artificial Sequence
  chemically synthesized
ctgactcctgcattcctctgga

SEQ ID NO: 1031249 - DNA, 22 bp, Artificial Sequence
  chemically synthesized
tctgactcctgcattcctctgg

SEQ ID NO: 1031250 - DNA, 22 bp, Artificial Sequence
  chemically synthesized
ttctgactcctgcattcctctg

SEQ ID NO: 1031251 - DNA, 22 bp, Artificial Sequence
  chemically synthesized
cttttctgactcctgcattcct

SEQ ID NO: 1031252 - DNA, 22 bp, Artificial Sequence
  chemically synthesized
tgttacttttctgactcctgca

SEQ ID NO: 1031253 - DNA, 22 bp, Artificial Sequence
  chemically synthesized
gtgttacttttctgactcctgc

SEQ ID NO: 1031254 - DNA, 22 bp, Artificial Sequence
  chemically synthesized
cgtatttgtgttacttttctga

SEQ ID NO: 1031255 - DNA, 22 bp, Artificial Sequence
  chemically synthesized
tgcgtatttgtgttacttttct

SEQ ID NO: 1031256 - DNA, 22 bp, Artificial Sequence
  chemically synthesized
ctgcgtatttgtgttacttttc

SEQ ID NO: 1031257 - DNA, 22 bp, Artificial Sequence
  chemically synthesized
ttctgcgtatttgtgttacttt

SEQ ID NO: 1031258 - DNA, 22 bp, Artificial Sequence
  chemically synthesized
gtcactcttctgcgtatttgtg

SEQ ID NO: 1031259 - DNA, 22 bp, Artificial Sequence
  chemically synthesized
tccagctggtcactcttctgcg

SEQ ID NO: 1031260 - DNA, 22 bp, Artificial Sequence
  chemically synthesized
cctatccagctggtcactcttc

SEQ ID NO: 1031261 - DNA, 22 bp, Artificial Sequence
  chemically synthesized
ccctatccagctggtcactctt

SEQ ID NO: 1031262 - DNA, 22 bp, Artificial Sequence
  chemically synthesized
cacttccctatccagctggtca

SEQ ID NO: 1031263 - DNA, 22 bp, Artificial Sequence
  chemically synthesized
gcaagggccactgcacttccct

SEQ ID NO: 1031264 - DNA, 22 bp, Artificial Sequence
  chemically synthesized
ccctagcaagggccactgcact

SEQ ID NO: 1031265 - DNA, 22 bp, Artificial Sequence
  chemically synthesized
ttaccctagcaagggccactgc

SEQ ID NO: 1031266 - DNA, 22 bp, Artificial Sequence
  chemically synthesized
gatagggaagtgcagtggccct

SEQ ID NO: 1031267 - DNA, 22 bp, Artificial Sequence
  chemically synthesized
gctagggtaataatgcccctcc

SEQ ID NO: 1031268 - DNA, 22 bp, Artificial Sequence
  chemically synthesized
tggcaatgtgagggaggggcat

SEQ ID NO: 1031269 - DNA, 22 bp, Artificial Sequence
  chemically synthesized
ctagggtaataatgcccctccc

SEQ ID NO: 1031270 - DNA, 22 bp, Artificial Sequence
  chemically synthesized
gggtaataatgcccctccctca

SEQ ID NO: 1031271 - DNA, 22 bp, Artificial Sequence
  chemically synthesized
gatctgtggcaatgtgagggag

SEQ ID NO: 1031272 - DNA, 22 bp, Artificial Sequence
  chemically synthesized
cacctggatctgtggcaatgtg

SEQ ID NO: 1031273 - DNA, 22 bp, Artificial Sequence
  chemically synthesized
cctcacattgccacagatccag

SEQ ID NO: 1031274 - DNA, 22 bp, Artificial Sequence
  chemically synthesized
acattgccacagatccaggtgg

SEQ ID NO: 1031275 - DNA, 22 bp, Artificial Sequence
  chemically synthesized
ccacagatccaggtggagctca

SEQ ID NO: 1031276 - DNA, 22 bp, Artificial Sequence
  chemically synthesized
gagtgtccaggcccaagataat

SEQ ID NO: 1031277 - DNA, 22 bp, Artificial Sequence
  chemically synthesized
acccattatcttgggcctggac

SEQ ID NO: 1031278 - DNA, 22 bp, Artificial Sequence
  chemically synthesized
tcttgggcctggacactccagg

SEQ ID NO: 1031279 - DNA, 22 bp, Artificial Sequence
  chemically synthesized
gggcctggacactccagggtac

SEQ ID NO: 1031280 - DNA, 22 bp, Artificial Sequence
  chemically synthesized
ggcctggacactccagggtact

SEQ ID NO: 1031281 - DNA, 22 bp, Artificial Sequence
  chemically synthesized
taggacatcaaccagagtaccc

SEQ ID NO: 1031282 - DNA, 22 bp, Artificial Sequence
  chemically synthesized
gacactccagggtactctggtt

SEQ ID NO: 1031283 - DNA, 22 bp, Artificial Sequence
  chemically synthesized
cggctgtaggacatcaaccaga

SEQ ID NO: 1031284 - DNA, 22 bp, Artificial Sequence
  chemically synthesized
ccggctgtaggacatcaaccag

SEQ ID NO: 1031285 - DNA, 22 bp, Artificial Sequence
  chemically synthesized
cagggtactctggttgatgtcc

SEQ ID NO: 1031286 - DNA, 22 bp, Artificial Sequence
  chemically synthesized
tggttgatgtcctacagccgga

SEQ ID NO: 1031287 - DNA, 22 bp, Artificial Sequence
  chemically synthesized
agacatgcagtttccggctgta

SEQ ID NO: 1031288 - DNA, 22 bp, Artificial Sequence
  chemically synthesized
gttgatgtcctacagccggaaa

SEQ ID NO: 1031289 - DNA, 22 bp, Artificial Sequence
  chemically synthesized
ggctaagacatgcagtttccgg

SEQ ID NO: 1031290 - DNA, 22 bp, Artificial Sequence
  chemically synthesized
atgtcctacagccggaaactgc

SEQ ID NO: 1031291 - DNA, 22 bp, Artificial Sequence
  chemically synthesized
aggctaagacatgcagtttccg

SEQ ID NO: 1031292 - DNA, 22 bp, Artificial Sequence
  chemically synthesized
taggctaagacatgcagtttcc

SEQ ID NO: 1031293 - DNA, 22 bp, Artificial Sequence
  chemically synthesized
cagccggaaactgcatgtctta

SEQ ID NO: 1031294 - DNA, 22 bp, Artificial Sequence
  chemically synthesized
cgtcaaagatagactttaggct

SEQ ID NO: 1031295 - DNA, 22 bp, Artificial Sequence
  chemically synthesized
tgcgtcaaagatagactttagg

SEQ ID NO: 1031296 - DNA, 22 bp, Artificial Sequence
  chemically synthesized
ctgcgtcaaagatagactttag

SEQ ID NO: 1031297 - DNA, 22 bp, Artificial Sequence
  chemically synthesized
catgtcttagcctaaagtctat

SEQ ID NO: 1031298 - DNA, 22 bp, Artificial Sequence
  chemically synthesized
tctgcgtcaaagatagacttta

SEQ ID NO: 1031299 - DNA, 22 bp, Artificial Sequence
  chemically synthesized
ttctgcgtcaaagatagacttt

SEQ ID NO: 1031300 - DNA, 22 bp, Artificial Sequence
  chemically synthesized
tttctgcgtcaaagatagactt

SEQ ID NO: 1031301 - DNA, 22 bp, Artificial Sequence
  chemically synthesized
ctttttctgcgtcaaagataga

SEQ ID NO: 1031302 - DNA, 22 bp, Artificial Sequence
  chemically synthesized
agcctaaagtctatctttgacg

SEQ ID NO: 1031303 - DNA, 22 bp, Artificial Sequence
  chemically synthesized
gcctaaagtctatctttgacgc

SEQ ID NO: 1031304 - DNA, 22 bp, Artificial Sequence
  chemically synthesized
tagctactttttctgcgtcaaa

SEQ ID NO: 1031305 - DNA, 22 bp, Artificial Sequence
  chemically synthesized
aagtctatctttgacgcagaaa

SEQ ID NO: 1031306 - DNA, 22 bp, Artificial Sequence
  chemically synthesized
tctttgacgcagaaaaagtagc

SEQ ID NO: 1031307 - DNA, 22 bp, Artificial Sequence
  chemically synthesized
catgtggttgtagctacttttt

SEQ ID NO: 1031308 - DNA, 22 bp, Artificial Sequence
  chemically synthesized
gcatgtggttgtagctactttt

SEQ ID NO: 1031309 - DNA, 22 bp, Artificial Sequence
  chemically synthesized
tgcatgtggttgtagctacttt

SEQ ID NO: 1031310 - DNA, 22 bp, Artificial Sequence
  chemically synthesized
ttgcatgtggttgtagctactt

SEQ ID NO: 1031311 - DNA, 22 bp, Artificial Sequence
  chemically synthesized
tgacgcagaaaaagtagctaca

SEQ ID NO: 1031312 - DNA, 22 bp, Artificial Sequence
  chemically synthesized
gacgcagaaaaagtagctacaa

SEQ ID NO: 1031313 - DNA, 22 bp, Artificial Sequence
  chemically synthesized
acgcagaaaaagtagctacaac

SEQ ID NO: 1031314 - DNA, 22 bp, Artificial Sequence
  chemically synthesized
tttttgcatgtggttgtagcta

SEQ ID NO: 1031315 - DNA, 22 bp, Artificial Sequence
  chemically synthesized
caacctgtttttgcatgtggtt

SEQ ID NO: 1031316 - DNA, 22 bp, Artificial Sequence
  chemically synthesized
ccaacctgtttttgcatgtggt

SEQ ID NO: 1031317 - DNA, 22 bp, Artificial Sequence
  chemically synthesized
cttccaacctgtttttgcatgt

SEQ ID NO: 1031318 - DNA, 22 bp, Artificial Sequence
  chemically synthesized
caactacttccaacctgttttt

SEQ ID NO: 1031319 - DNA, 22 bp, Artificial Sequence
  chemically synthesized
caaccacatgcaaaaacaggtt

SEQ ID NO: 1031320 - DNA, 22 bp, Artificial Sequence
  chemically synthesized
gcaactacttccaacctgtttt

SEQ ID NO: 1031321 - DNA, 22 bp, Artificial Sequence
  chemically synthesized
ttgcaactacttccaacctgtt

SEQ ID NO: 1031322 - DNA, 22 bp, Artificial Sequence
  chemically synthesized
ctcttgcaactacttccaacct

SEQ ID NO: 1031323 - DNA, 22 bp, Artificial Sequence
  chemically synthesized
cctcttgcaactacttccaacc

SEQ ID NO: 1031324 - DNA, 22 bp, Artificial Sequence
  chemically synthesized
atttcctcttgcaactacttcc

SEQ ID NO: 1031325 - DNA, 22 bp, Artificial Sequence
  chemically synthesized
gaagtagttgcaagaggaaatt

SEQ ID NO: 1031326 - DNA, 22 bp, Artificial Sequence
  chemically synthesized
agggtgtcagggtattaatttc

SEQ ID NO: 1031327 - DNA, 22 bp, Artificial Sequence
  chemically synthesized
caagaggaaattaataccctga

SEQ ID NO: 1031328 - DNA, 22 bp, Artificial Sequence
  chemically synthesized
aagggccgctcagggtgtcagg

SEQ ID NO: 1031329 - DNA, 22 bp, Artificial Sequence
  chemically synthesized
aaagggccgctcagggtgtcag

SEQ ID NO: 1031330 - DNA, 22 bp, Artificial Sequence
  chemically synthesized
taaagggccgctcagggtgtca

SEQ ID NO: 1031331 - DNA, 22 bp, Artificial Sequence
  chemically synthesized
ttaaagggccgctcagggtgtc

SEQ ID NO: 1031332 - DNA, 22 bp, Artificial Sequence
  chemically synthesized
ataccctgacaccctgagcggc

SEQ ID NO: 1031333 - DNA, 22 bp, Artificial Sequence
  chemically synthesized
gtcacttttaaagggccgctca

SEQ ID NO: 1031334 - DNA, 22 bp, Artificial Sequence
  chemically synthesized
ttagtcacttttaaagggccgc

SEQ ID NO: 1031335 - DNA, 22 bp, Artificial Sequence
  chemically synthesized
gttagtcacttttaaagggccg

SEQ ID NO: 1031336 - DNA, 22 bp, Artificial Sequence
  chemically synthesized
acaccctgagcggccctttaaa

SEQ ID NO: 1031337 - DNA, 22 bp, Artificial Sequence
  chemically synthesized
ttgttagtcacttttaaagggc

SEQ ID NO: 1031338 - DNA, 22 bp, Artificial Sequence
  chemically synthesized
aactcttgttagtcacttttaa

SEQ ID NO: 1031339 - DNA, 22 bp, Artificial Sequence
  chemically synthesized
caactcttgttagtcactttta

SEQ ID NO: 1031340 - DNA, 22 bp, Artificial Sequence
  chemically synthesized
agcggccctttaaaagtgacta

SEQ ID NO: 1031341 - DNA, 22 bp, Artificial Sequence
  chemically synthesized
tatttcaactcttgttagtcac

SEQ ID NO: 1031342 - DNA, 22 bp, Artificial Sequence
  chemically synthesized
atatttcaactcttgttagtca

SEQ ID NO: 1031343 - DNA, 22 bp, Artificial Sequence
  chemically synthesized
taaaagtgactaacaagagttg

SEQ ID NO: 1031344 - DNA, 22 bp, Artificial Sequence
  chemically synthesized
aaaagtgactaacaagagttga

SEQ ID NO: 1031345 - DNA, 22 bp, Artificial Sequence
  chemically synthesized
aaagtgactaacaagagttgaa

SEQ ID NO: 1031346 - DNA, 22 bp, Artificial Sequence
  chemically synthesized
aggtgtttatatttcaactctt

SEQ ID NO: 1031347 - DNA, 22 bp, Artificial Sequence
  chemically synthesized
acaagagttgaaatataaacac

SEQ ID NO: 1031348 - DNA, 22 bp, Artificial Sequence
  chemically synthesized
gacaaggtgcaggagctgaggt

SEQ ID NO: 1031349 - DNA, 22 bp, Artificial Sequence
  chemically synthesized
agacaaggtgcaggagctgagg

SEQ ID NO: 1031350 - DNA, 22 bp, Artificial Sequence
  chemically synthesized
aaatataaacacctcagctcct

SEQ ID NO: 1031351 - DNA, 22 bp, Artificial Sequence
  chemically synthesized
tcttagacaaggtgcaggagct

SEQ ID NO: 1031352 - DNA, 22 bp, Artificial Sequence
  chemically synthesized
agagttatcttagacaaggtgc

SEQ ID NO: 1031353 - DNA, 22 bp, Artificial Sequence
  chemically synthesized
tctcagagttatcttagacaag

SEQ ID NO: 1031354 - DNA, 22 bp, Artificial Sequence
  chemically synthesized
agctcctgcaccttgtctaaga

SEQ ID NO: 1031355 - DNA, 22 bp, Artificial Sequence
  chemically synthesized
gtctcagagttatcttagacaa

SEQ ID NO: 1031356 - DNA, 22 bp, Artificial Sequence
  chemically synthesized
ctgcaccttgtctaagataact

SEQ ID NO: 1031357 - DNA, 22 bp, Artificial Sequence
  chemically synthesized
caccttgtctaagataactctg

SEQ ID NO: 1031358 - DNA, 22 bp, Artificial Sequence
  chemically synthesized
gtctaagataactctgagacaa

SEQ ID NO: 1031359 - DNA, 22 bp, Artificial Sequence
  chemically synthesized
tctaagataactctgagacaag

SEQ ID NO: 1031360 - DNA, 22 bp, Artificial Sequence
  chemically synthesized
ggaaggcataaaacacttgtct

SEQ ID NO: 1031361 - DNA, 22 bp, Artificial Sequence
  chemically synthesized
agataactctgagacaagtgtt

SEQ ID NO: 1031362 - DNA, 22 bp, Artificial Sequence
  chemically synthesized
tgagacaagtgttttatgcctt

SEQ ID NO: 1031363 - DNA, 22 bp, Artificial Sequence
  chemically synthesized
gagaaagtctgggaaggcataa

SEQ ID NO: 1031364 - DNA, 22 bp, Artificial Sequence
  chemically synthesized
agacaagtgttttatgccttcc

SEQ ID NO: 1031365 - DNA, 22 bp, Artificial Sequence
  chemically synthesized
cctggagaaagtctgggaaggc

SEQ ID NO: 1031366 - DNA, 22 bp, Artificial Sequence
  chemically synthesized
attccctggagaaagtctggga

SEQ ID NO: 1031367 - DNA, 22 bp, Artificial Sequence
  chemically synthesized
aattccctggagaaagtctggg

SEQ ID NO: 1031368 - DNA, 22 bp, Artificial Sequence
  chemically synthesized
tatgccttcccagactttctcc

SEQ ID NO: 1031369 - DNA, 22 bp, Artificial Sequence
  chemically synthesized
atgccttcccagactttctcca

SEQ ID NO: 1031370 - DNA, 22 bp, Artificial Sequence
  chemically synthesized
tgccttcccagactttctccag

SEQ ID NO: 1031371 - DNA, 22 bp, Artificial Sequence
  chemically synthesized
gggcttaattccctggagaaag

SEQ ID NO: 1031372 - DNA, 22 bp, Artificial Sequence
  chemically synthesized
cccagactttctccagggaatt

SEQ ID NO: 1031373 - DNA, 22 bp, Artificial Sequence
  chemically synthesized
ccagactttctccagggaatta

SEQ ID NO: 1031374 - DNA, 22 bp, Artificial Sequence
  chemically synthesized
tgagaactagggcttaattccc

SEQ ID NO: 1031375 - DNA, 22 bp, Artificial Sequence
  chemically synthesized
tctccagggaattaagccctag

SEQ ID NO: 1031376 - DNA, 22 bp, Artificial Sequence
  chemically synthesized
ctccagggaattaagccctagt

SEQ ID NO: 1031377 - DNA, 22 bp, Artificial Sequence
  chemically synthesized
tccagggaattaagccctagtt

SEQ ID NO: 1031378 - DNA, 22 bp, Artificial Sequence
  chemically synthesized
cagggaattaagccctagttct

SEQ ID NO: 1031379 - DNA, 22 bp, Artificial Sequence
  chemically synthesized
tcaagccaaacaccactgtgag

SEQ ID NO: 1031380 - DNA, 22 bp, Artificial Sequence
  chemically synthesized
agccctagttctcacagtggtg

SEQ ID NO: 1031381 - DNA, 22 bp, Artificial Sequence
  chemically synthesized
gttctcacagtggtgtttggct

SEQ ID NO: 1031382 - DNA, 22 bp, Artificial Sequence
  chemically synthesized
tcacagtggtgtttggcttgat

SEQ ID NO: 1031383 - DNA, 22 bp, Artificial Sequence
  chemically synthesized
taaagagtatgttatcaagcca

SEQ ID NO: 1031384 - DNA, 22 bp, Artificial Sequence
  chemically synthesized
acagtggtgtttggcttgataa

SEQ ID NO: 1031385 - DNA, 22 bp, Artificial Sequence
  chemically synthesized
ggcttgataacatactctttac

SEQ ID NO: 1031386 - DNA, 22 bp, Artificial Sequence
  chemically synthesized
gcttgataacatactctttaca

SEQ ID NO: 1031387 - DNA, 22 bp, Artificial Sequence
  chemically synthesized
agagaaagcaacctgtaaagag

SEQ ID NO: 1031388 - DNA, 22 bp, Artificial Sequence
  chemically synthesized
gataacatactctttacaggtt

SEQ ID NO: 1031389 - DNA, 22 bp, Artificial Sequence
  chemically synthesized
ataacatactctttacaggttg

SEQ ID NO: 1031390 - DNA, 22 bp, Artificial Sequence
  chemically synthesized
tgagaaagttaagagaaagcaa

SEQ ID NO: 1031391 - DNA, 22 bp, Artificial Sequence
  chemically synthesized
tttacaggttgctttctcttaa

SEQ ID NO: 1031392 - DNA, 22 bp, Artificial Sequence
  chemically synthesized
tacaggttgctttctcttaact

SEQ ID NO: 1031393 - DNA, 22 bp, Artificial Sequence
  chemically synthesized
gagttgtgagaaagttaagaga

SEQ ID NO: 1031394 - DNA, 22 bp, Artificial Sequence
  chemically synthesized
acaggttgctttctcttaactt

SEQ ID NO: 1031395 - DNA, 22 bp, Artificial Sequence
  chemically synthesized
caggttgctttctcttaacttt

SEQ ID NO: 1031396 - DNA, 22 bp, Artificial Sequence
  chemically synthesized
ctttctcttaactttctcacaa

SEQ ID NO: 1031397 - DNA, 22 bp, Artificial Sequence
  chemically synthesized
tctcttaactttctcacaactc

SEQ ID NO: 1031398 - DNA, 22 bp, Artificial Sequence
  chemically synthesized
ctcttaactttctcacaactcc

SEQ ID NO: 1031399 - DNA, 22 bp, Artificial Sequence
  chemically synthesized
tggtaggatgttggagttgtga

SEQ ID NO: 1031400 - DNA, 22 bp, Artificial Sequence
  chemically synthesized
tcttaactttctcacaactcca

SEQ ID NO: 1031401 - DNA, 22 bp, Artificial Sequence
  chemically synthesized
ttaactttctcacaactccaac

SEQ ID NO: 1031402 - DNA, 22 bp, Artificial Sequence
  chemically synthesized
aactttctcacaactccaacat

SEQ ID NO: 1031403 - DNA, 22 bp, Artificial Sequence
  chemically synthesized
actttctcacaactccaacatc

SEQ ID NO: 1031404 - DNA, 22 bp, Artificial Sequence
  chemically synthesized
ggaagctgtggtaggatgttgg

SEQ ID NO: 1031405 - DNA, 22 bp, Artificial Sequence
  chemically synthesized
tctcacaactccaacatcctac

SEQ ID NO: 1031406 - DNA, 22 bp, Artificial Sequence
  chemically synthesized
taggaagctgtggtaggatgtt

SEQ ID NO: 1031407 - DNA, 22 bp, Artificial Sequence
  chemically synthesized
ctcacaactccaacatcctacc

SEQ ID NO: 1031408 - DNA, 22 bp, Artificial Sequence
  chemically synthesized
tcacaactccaacatcctacca

SEQ ID NO: 1031409 - DNA, 22 bp, Artificial Sequence
  chemically synthesized
acaactccaacatcctaccaca

SEQ ID NO: 1031410 - DNA, 22 bp, Artificial Sequence
  chemically synthesized
caacatcctaccacagcttcct

SEQ ID NO: 1031411 - DNA, 22 bp, Artificial Sequence
  chemically synthesized
ggcagtgattctaggaagctgt

SEQ ID NO: 1031412 - DNA, 22 bp, Artificial Sequence
  chemically synthesized
gggcagtgattctaggaagctg

SEQ ID NO: 1031413 - DNA, 22 bp, Artificial Sequence
  chemically synthesized
tgggcagtgattctaggaagct

SEQ ID NO: 1031414 - DNA, 22 bp, Artificial Sequence
  chemically synthesized
tttgggcagtgattctaggaag

SEQ ID NO: 1031415 - DNA, 22 bp, Artificial Sequence
  chemically synthesized
ctttgggcagtgattctaggaa

SEQ ID NO: 1031416 - DNA, 22 bp, Artificial Sequence
  chemically synthesized
ccacagcttcctagaatcactg

SEQ ID NO: 1031417 - DNA, 22 bp, Artificial Sequence
  chemically synthesized
aaatagtttctttgggcagtga

SEQ ID NO: 1031418 - DNA, 22 bp, Artificial Sequence
  chemically synthesized
cctagaatcactgcccaaagaa

SEQ ID NO: 1031419 - DNA, 22 bp, Artificial Sequence
  chemically synthesized
ctagaatcactgcccaaagaaa

SEQ ID NO: 1031420 - DNA, 22 bp, Artificial Sequence
  chemically synthesized
gaatcactgcccaaagaaacta

SEQ ID NO: 1031421 - DNA, 22 bp, Artificial Sequence
  chemically synthesized
cccaaagaaactatttgaactc

SEQ ID NO: 1031422 - DNA, 22 bp, Artificial Sequence
  chemically synthesized
agacaaggatgtgagttcaaat

SEQ ID NO: 1031423 - DNA, 22 bp, Artificial Sequence
  chemically synthesized
tttgaactcacatccttgtctc

SEQ ID NO: 1031424 - DNA, 22 bp, Artificial Sequence
  chemically synthesized
cataagcaaatcctgagacaag

SEQ ID NO: 1031425 - DNA, 22 bp, Artificial Sequence
  chemically synthesized
gaactcacatccttgtctcagg

SEQ ID NO: 1031426 - DNA, 22 bp, Artificial Sequence
  chemically synthesized
acataagcaaatcctgagacaa

SEQ ID NO: 1031427 - DNA, 22 bp, Artificial Sequence
  chemically synthesized
aactcacatccttgtctcagga

SEQ ID NO: 1031428 - DNA, 22 bp, Artificial Sequence
  chemically synthesized
ttacataagcaaatcctgagac

SEQ ID NO: 1031429 - DNA, 22 bp, Artificial Sequence
  chemically synthesized
acatccttgtctcaggatttgc

SEQ ID NO: 1031430 - DNA, 22 bp, Artificial Sequence
  chemically synthesized
ggttcttacataagcaaatcct

SEQ ID NO: 1031431 - DNA, 22 bp, Artificial Sequence
  chemically synthesized
gggttcttacataagcaaatcc

SEQ ID NO: 1031432 - DNA, 22 bp, Artificial Sequence
  chemically synthesized
agtttgggttcttacataagca

SEQ ID NO: 1031433 - DNA, 22 bp, Artificial Sequence
  chemically synthesized
gtctcaggatttgcttatgtaa

SEQ ID NO: 1031434 - DNA, 22 bp, Artificial Sequence
  chemically synthesized
tctcaggatttgcttatgtaag

SEQ ID NO: 1031435 - DNA, 22 bp, Artificial Sequence
  chemically synthesized
aggatttgcttatgtaagaacc

SEQ ID NO: 1031436 - DNA, 22 bp, Artificial Sequence
  chemically synthesized
tgagtgtctcagtttgggttct

SEQ ID NO: 1031437 - DNA, 22 bp, Artificial Sequence
  chemically synthesized
gcttatgtaagaacccaaactg

SEQ ID NO: 1031438 - DNA, 22 bp, Artificial Sequence
  chemically synthesized
cttatgtaagaacccaaactga

SEQ ID NO: 1031439 - DNA, 22 bp, Artificial Sequence
  chemically synthesized
cattatgagtgtctcagtttgg

SEQ ID NO: 1031440 - DNA, 22 bp, Artificial Sequence
  chemically synthesized
gcattatgagtgtctcagtttg

SEQ ID NO: 1031441 - DNA, 22 bp, Artificial Sequence
  chemically synthesized
atgtaagaacccaaactgagac

SEQ ID NO: 1031442 - DNA, 22 bp, Artificial Sequence
  chemically synthesized
tgtaagaacccaaactgagaca

SEQ ID NO: 1031443 - DNA, 22 bp, Artificial Sequence
  chemically synthesized
ttgcattatgagtgtctcagtt

SEQ ID NO: 1031444 - DNA, 22 bp, Artificial Sequence
  chemically synthesized
ataatataaattcttgcattat

SEQ ID NO: 1031445 - DNA, 22 bp, Artificial Sequence
  chemically synthesized
agacactcataatgcaagaatt

SEQ ID NO: 1031446 - DNA, 22 bp, Artificial Sequence
  chemically synthesized
gtattaataatataaattcttg

SEQ ID NO: 1031447 - DNA, 22 bp, Artificial Sequence
  chemically synthesized
tggtattaataatataaattct

SEQ ID NO: 1031448 - DNA, 22 bp, Artificial Sequence
  chemically synthesized
ataatgcaagaatttatattat

SEQ ID NO: 1031449 - DNA, 22 bp, Artificial Sequence
  chemically synthesized
attctggtattaataatataaa

SEQ ID NO: 1031450 - DNA, 22 bp, Artificial Sequence
  chemically synthesized
aggattgattctggtattaata

SEQ ID NO: 1031451 - DNA, 22 bp, Artificial Sequence
  chemically synthesized
aaggattgattctggtattaat

SEQ ID NO: 1031452 - DNA, 22 bp, Artificial Sequence
  chemically synthesized
atattattaataccagaatcaa

SEQ ID NO: 1031453 - DNA, 22 bp, Artificial Sequence
  chemically synthesized
tattattaataccagaatcaat

SEQ ID NO: 1031454 - DNA, 22 bp, Artificial Sequence
  chemically synthesized
gccatgcttaaggattgattct

SEQ ID NO: 1031455 - DNA, 22 bp, Artificial Sequence
  chemically synthesized
ttaataccagaatcaatcctta

SEQ ID NO: 1031456 - DNA, 22 bp, Artificial Sequence
  chemically synthesized
ataccagaatcaatccttaagc

SEQ ID NO: 1031457 - DNA, 22 bp, Artificial Sequence
  chemically synthesized
tgtagagtgtcaaactagccat

SEQ ID NO: 1031458 - DNA, 22 bp, Artificial Sequence
  chemically synthesized
tatgtagagtgtcaaactagcc

SEQ ID NO: 1031459 - DNA, 22 bp, Artificial Sequence
  chemically synthesized
cctctatgtagagtgtcaaact

SEQ ID NO: 1031460 - DNA, 22 bp, Artificial Sequence
  chemically synthesized
acctctatgtagagtgtcaaac

SEQ ID NO: 1031461 - DNA, 22 bp, Artificial Sequence
  chemically synthesized
aagcatggctagtttgacactc

SEQ ID NO: 1031462 - DNA, 22 bp, Artificial Sequence
  chemically synthesized
agcatggctagtttgacactct

SEQ ID NO: 1031463 - DNA, 22 bp, Artificial Sequence
  chemically synthesized
cttacctctatgtagagtgtca

SEQ ID NO: 1031464 - DNA, 22 bp, Artificial Sequence
  chemically synthesized
ccttacctctatgtagagtgtc

SEQ ID NO: 1031465 - DNA, 22 bp, Artificial Sequence
  chemically synthesized
tccttacctctatgtagagtgt

SEQ ID NO: 1031466 - DNA, 22 bp, Artificial Sequence
  chemically synthesized
ttccttacctctatgtagagtg

SEQ ID NO: 1031467 - DNA, 22 bp, Artificial Sequence
  chemically synthesized
gtttgacactctacatagaggt

SEQ ID NO: 1031468 - DNA, 22 bp, Artificial Sequence
  chemically synthesized
agtgcttttccttacctctatg

SEQ ID NO: 1031469 - DNA, 22 bp, Artificial Sequence
  chemically synthesized
gacactctacatagaggtaagg

SEQ ID NO: 1031470 - DNA, 22 bp, Artificial Sequence
  chemically synthesized
acactctacatagaggtaagga

SEQ ID NO: 1031471 - DNA, 22 bp, Artificial Sequence
  chemically synthesized
cagttaagtgcttttccttacc

SEQ ID NO: 1031472 - DNA, 22 bp, Artificial Sequence
  chemically synthesized
ctccagttaagtgcttttcctt

SEQ ID NO: 1031473 - DNA, 22 bp, Artificial Sequence
  chemically synthesized
tacatagaggtaaggaaaagca

SEQ ID NO: 1031474 - DNA, 22 bp, Artificial Sequence
  chemically synthesized
tgctccagttaagtgcttttcc

SEQ ID NO: 1031475 - DNA, 22 bp, Artificial Sequence
  chemically synthesized
catagaggtaaggaaaagcact

SEQ ID NO: 1031476 - DNA, 22 bp, Artificial Sequence
  chemically synthesized
ctgctccagttaagtgcttttc

SEQ ID NO: 1031477 - DNA, 22 bp, Artificial Sequence
  chemically synthesized
tctgctccagttaagtgctttt

SEQ ID NO: 1031478 - DNA, 22 bp, Artificial Sequence
  chemically synthesized
aaaagaatgagtgaattttctg

SEQ ID NO: 1031479 - DNA, 22 bp, Artificial Sequence
  chemically synthesized
caaaagaatgagtgaattttct

SEQ ID NO: 1031480 - DNA, 22 bp, Artificial Sequence
  chemically synthesized
tcaaaagaatgagtgaattttc

SEQ ID NO: 1031481 - DNA, 22 bp, Artificial Sequence
  chemically synthesized
ttcaaaagaatgagtgaatttt

SEQ ID NO: 1031482 - DNA, 22 bp, Artificial Sequence
  chemically synthesized
aactggagcagaaaattcactc

SEQ ID NO: 1031483 - DNA, 22 bp, Artificial Sequence
  chemically synthesized
actggagcagaaaattcactca

SEQ ID NO: 1031484 - DNA, 22 bp, Artificial Sequence
  chemically synthesized
atttttcaaaagaatgagtgaa

SEQ ID NO: 1031485 - DNA, 22 bp, Artificial Sequence
  chemically synthesized
gagcagaaaattcactcattct

SEQ ID NO: 1031486 - DNA, 22 bp, Artificial Sequence
  chemically synthesized
ttcatttttcaaaagaatgagt

SEQ ID NO: 1031487 - DNA, 22 bp, Artificial Sequence
  chemically synthesized
attcatttttcaaaagaatgag

SEQ ID NO: 1031488 - DNA, 22 bp, Artificial Sequence
  chemically synthesized
actcattcttttgaaaaatgaa

SEQ ID NO: 1031489 - DNA, 22 bp, Artificial Sequence
  chemically synthesized
attcttttgaaaaatgaataag

SEQ ID NO: 1031490 - DNA, 22 bp, Artificial Sequence
  chemically synthesized
caaaaaagagtaccttattcat

SEQ ID NO: 1031491 - DNA, 22 bp, Artificial Sequence
  chemically synthesized
ttttgaaaaatgaataaggtac

SEQ ID NO: 1031492 - DNA, 22 bp, Artificial Sequence
  chemically synthesized
ttacaaaaaagagtaccttatt

SEQ ID NO: 1031493 - DNA, 22 bp, Artificial Sequence
  chemically synthesized
ttgaaaaatgaataaggtactc

SEQ ID NO: 1031494 - DNA, 22 bp, Artificial Sequence
  chemically synthesized
tattacaaaaaagagtacctta

SEQ ID NO: 1031495 - DNA, 22 bp, Artificial Sequence
  chemically synthesized
tgaaaaatgaataaggtactct

SEQ ID NO: 1031496 - DNA, 22 bp, Artificial Sequence
  chemically synthesized
gaaaaatgaataaggtactctt

SEQ ID NO: 1031497 - DNA, 22 bp, Artificial Sequence
  chemically synthesized
tctattacaaaaaagagtacct

SEQ ID NO: 1031498 - DNA, 22 bp, Artificial Sequence
  chemically synthesized
aaaaatgaataaggtactcttt

SEQ ID NO: 1031499 - DNA, 22 bp, Artificial Sequence
  chemically synthesized
actctctattacaaaaaagagt

SEQ ID NO: 1031500 - DNA, 22 bp, Artificial Sequence
  chemically synthesized
cactcactctctattacaaaaa

SEQ ID NO: 1031501 - DNA, 22 bp, Artificial Sequence
  chemically synthesized
tatcccattacactcactctct

SEQ ID NO: 1031502 - DNA, 22 bp, Artificial Sequence
  chemically synthesized
ttttttgtaatagagagtgagt

SEQ ID NO: 1031503 - DNA, 22 bp, Artificial Sequence
  chemically synthesized
ttttgtaatagagagtgagtgt

SEQ ID NO: 1031504 - DNA, 22 bp, Artificial Sequence
  chemically synthesized
tttgtaatagagagtgagtgta

SEQ ID NO: 1031505 - DNA, 22 bp, Artificial Sequence
  chemically synthesized
ttgtaatagagagtgagtgtaa

SEQ ID NO: 1031506 - DNA, 22 bp, Artificial Sequence
  chemically synthesized
tgtaatagagagtgagtgtaat

SEQ ID NO: 1031507 - DNA, 22 bp, Artificial Sequence
  chemically synthesized
gtaatagagagtgagtgtaatg

SEQ ID NO: 1031508 - DNA, 22 bp, Artificial Sequence
  chemically synthesized
taatagagagtgagtgtaatgg

SEQ ID NO: 1031509 - DNA, 22 bp, Artificial Sequence
  chemically synthesized
ggtatgtctgtatcccattaca

SEQ ID NO: 1031510 - DNA, 22 bp, Artificial Sequence
  chemically synthesized
ttaggtatgtctgtatcccatt

SEQ ID NO: 1031511 - DNA, 22 bp, Artificial Sequence
  chemically synthesized
ctattaggtatgtctgtatccc

SEQ ID NO: 1031512 - DNA, 22 bp, Artificial Sequence
  chemically synthesized
taacactactattaggtatgtc

SEQ ID NO: 1031513 - DNA, 22 bp, Artificial Sequence
  chemically synthesized
ctgtaacactactattaggtat

SEQ ID NO: 1031514 - DNA, 22 bp, Artificial Sequence
  chemically synthesized
tctactgtaacactactattag

SEQ ID NO: 1031515 - DNA, 22 bp, Artificial Sequence
  chemically synthesized
gctatctactgtaacactacta

SEQ ID NO: 1031516 - DNA, 22 bp, Artificial Sequence
  chemically synthesized
actagctatctactgtaacact

SEQ ID NO: 1031517 - DNA, 22 bp, Artificial Sequence
  chemically synthesized
atagtagtgttacagtagatag

SEQ ID NO: 1031518 - DNA, 22 bp, Artificial Sequence
  chemically synthesized
atatctgactagctatctactg

SEQ ID NO: 1031519 - DNA, 22 bp, Artificial Sequence
  chemically synthesized
ctcatatctgactagctatcta

SEQ ID NO: 1031520 - DNA, 22 bp, Artificial Sequence
  chemically synthesized
ccctgctcatatctgactagct

SEQ ID NO: 1031521 - DNA, 22 bp, Artificial Sequence
  chemically synthesized
ctaccctgctcatatctgacta

SEQ ID NO: 1031522 - DNA, 22 bp, Artificial Sequence
  chemically synthesized
cagtagatagctagtcagatat

SEQ ID NO: 1031523 - DNA, 22 bp, Artificial Sequence
  chemically synthesized
gtcagatatgagcagggtagga

SEQ ID NO: 1031524 - DNA, 22 bp, Artificial Sequence
  chemically synthesized
gggtggcgggggtggggggtct

SEQ ID NO: 1031525 - DNA, 22 bp, Artificial Sequence
  chemically synthesized
gttggggtggcgggggtggggg

SEQ ID NO: 1031526 - DNA, 22 bp, Artificial Sequence
  chemically synthesized
ctggttggggtggcgggggtgg

SEQ ID NO: 1031527 - DNA, 22 bp, Artificial Sequence
  chemically synthesized
acattcctggttggggtggcgg

SEQ ID NO: 1031528 - DNA, 22 bp, Artificial Sequence
  chemically synthesized
cctgacattcctggttggggtg

SEQ ID NO: 1031529 - DNA, 22 bp, Artificial Sequence
  chemically synthesized
atggttgcctgacattcctggt

SEQ ID NO: 1031530 - DNA, 22 bp, Artificial Sequence
  chemically synthesized
gatggttgcctgacattcctgg

SEQ ID NO: 1031531 - DNA, 22 bp, Artificial Sequence
  chemically synthesized
accatcacttgatggttgcctg

SEQ ID NO: 1031532 - DNA, 22 bp, Artificial Sequence
  chemically synthesized
actgaccatcacttgatggttg

SEQ ID NO: 1031533 - DNA, 22 bp, Artificial Sequence
  chemically synthesized
ataaccacctgactgaccatca

SEQ ID NO: 1031534 - DNA, 22 bp, Artificial Sequence
  chemically synthesized
aataaccacctgactgaccatc

SEQ ID NO: 1031535 - DNA, 22 bp, Artificial Sequence
  chemically synthesized
aagacacagtttaataaccacc

SEQ ID NO: 1031536 - DNA, 22 bp, Artificial Sequence
  chemically synthesized
aaagacacagtttaataaccac

SEQ ID NO: 1031537 - DNA, 22 bp, Artificial Sequence
  chemically synthesized
taaagacacagtttaataacca

SEQ ID NO: 1031538 - DNA, 22 bp, Artificial Sequence
  chemically synthesized
ttttaaagacacagtttaataa

SEQ ID NO: 1031539 - DNA, 22 bp, Artificial Sequence
  chemically synthesized
ttattttaaagacacagtttaa

SEQ ID NO: 1031540 - DNA, 22 bp, Artificial Sequence
  chemically synthesized
tgaccaattattattttaaaga

SEQ ID NO: 1031541 - DNA, 22 bp, Artificial Sequence
  chemically synthesized
ttaaactgtgtctttaaaataa

SEQ ID NO: 1031542 - DNA, 22 bp, Artificial Sequence
  chemically synthesized
gctgtgaccaattattatttta

SEQ ID NO: 1031543 - DNA, 22 bp, Artificial Sequence
  chemically synthesized
aactgtgtctttaaaataataa

SEQ ID NO: 1031544 - DNA, 22 bp, Artificial Sequence
  chemically synthesized
tgtctttaaaataataattggt

SEQ ID NO: 1031545 - DNA, 22 bp, Artificial Sequence
  chemically synthesized
gtattggctgtgaccaattatt

SEQ ID NO: 1031546 - DNA, 22 bp, Artificial Sequence
  chemically synthesized
cctggtattggctgtgaccaat

SEQ ID NO: 1031547 - DNA, 22 bp, Artificial Sequence
  chemically synthesized
ccctggtattggctgtgaccaa

SEQ ID NO: 1031548 - DNA, 22 bp, Artificial Sequence
  chemically synthesized
taaaataataattggtcacagc

SEQ ID NO: 1031549 - DNA, 22 bp, Artificial Sequence
  chemically synthesized
tccctggtattggctgtgacca

SEQ ID NO: 1031550 - DNA, 22 bp, Artificial Sequence
  chemically synthesized
aaaataataattggtcacagcc

SEQ ID NO: 1031551 - DNA, 22 bp, Artificial Sequence
  chemically synthesized
aaataataattggtcacagcca

SEQ ID NO: 1031552 - DNA, 22 bp, Artificial Sequence
  chemically synthesized
cctttccctggtattggctgtg

SEQ ID NO: 1031553 - DNA, 22 bp, Artificial Sequence
  chemically synthesized
ggagactgcctttccctggtat

SEQ ID NO: 1031554 - DNA, 22 bp, Artificial Sequence
  chemically synthesized
gtcacagccaataccagggaaa

SEQ ID NO: 1031555 - DNA, 22 bp, Artificial Sequence
  chemically synthesized
ttgggagactgcctttccctgg

SEQ ID NO: 1031556 - DNA, 22 bp, Artificial Sequence
  chemically synthesized
tctattgggagactgcctttcc

SEQ ID NO: 1031557 - DNA, 22 bp, Artificial Sequence
  chemically synthesized
atctattgggagactgcctttc

SEQ ID NO: 1031558 - DNA, 22 bp, Artificial Sequence
  chemically synthesized
tatctattgggagactgccttt

SEQ ID NO: 1031559 - DNA, 22 bp, Artificial Sequence
  chemically synthesized
ttatctattgggagactgcctt

SEQ ID NO: 1031560 - DNA, 22 bp, Artificial Sequence
  chemically synthesized
aggtgtttttatctattgggag

SEQ ID NO: 1031561 - DNA, 22 bp, Artificial Sequence
  chemically synthesized
caggtgtttttatctattggga

SEQ ID NO: 1031562 - DNA, 22 bp, Artificial Sequence
  chemically synthesized
atcaccaatttcaggtgttttt

SEQ ID NO: 1031563 - DNA, 22 bp, Artificial Sequence
  chemically synthesized
ccaatagataaaaacacctgaa

SEQ ID NO: 1031564 - DNA, 22 bp, Artificial Sequence
  chemically synthesized
ctgatcaccaatttcaggtgtt

SEQ ID NO: 1031565 - DNA, 22 bp, Artificial Sequence
  chemically synthesized
tcgggaagctgctgatcaccaa

SEQ ID NO: 1031566 - DNA, 22 bp, Artificial Sequence
  chemically synthesized
atcgggaagctgctgatcacca

SEQ ID NO: 1031567 - DNA, 22 bp, Artificial Sequence
  chemically synthesized
cgatcttatcgggaagctgctg

SEQ ID NO: 1031568 - DNA, 22 bp, Artificial Sequence
  chemically synthesized
aaattggtgatcagcagcttcc

SEQ ID NO: 1031569 - DNA, 22 bp, Artificial Sequence
  chemically synthesized
ctgcgatcttatcgggaagctg

SEQ ID NO: 1031570 - DNA, 22 bp, Artificial Sequence
  chemically synthesized
gtgatcagcagcttcccgataa

SEQ ID NO: 1031571 - DNA, 22 bp, Artificial Sequence
  chemically synthesized
cccaactcctgcgatcttatcg

SEQ ID NO: 1031572 - DNA, 22 bp, Artificial Sequence
  chemically synthesized
gcccaactcctgcgatcttatc

SEQ ID NO: 1031573 - DNA, 22 bp, Artificial Sequence
  chemically synthesized
cccgataagatcgcaggagttg

SEQ ID NO: 1031574 - DNA, 22 bp, Artificial Sequence
  chemically synthesized
ccgataagatcgcaggagttgg

SEQ ID NO: 1031575 - DNA, 22 bp, Artificial Sequence
  chemically synthesized
gtgcgcacgcgggagcccattt

SEQ ID NO: 1031576 - DNA, 22 bp, Artificial Sequence
  chemically synthesized
agtgcgcacgcgggagcccatt

SEQ ID NO: 1031577 - DNA, 22 bp, Artificial Sequence
  chemically synthesized
ttagtgcgcacgcgggagccca

SEQ ID NO: 1031578 - DNA, 22 bp, Artificial Sequence
  chemically synthesized
cctcttagtgcgcacgcgggag

SEQ ID NO: 1031579 - DNA, 22 bp, Artificial Sequence
  chemically synthesized
gcctcttagtgcgcacgcggga

SEQ ID NO: 1031580 - DNA, 22 bp, Artificial Sequence
  chemically synthesized
ggcaaatgggctcccgcgtgcg

SEQ ID NO: 1031581 - DNA, 22 bp, Artificial Sequence
  chemically synthesized
tgcctcttagtgcgcacgcggg

SEQ ID NO: 1031582 - DNA, 22 bp, Artificial Sequence
  chemically synthesized
tgacattttgcctcttagtgcg

SEQ ID NO: 1031583 - DNA, 22 bp, Artificial Sequence
  chemically synthesized
ccgcgtgcgcactaagaggcaa

SEQ ID NO: 1031584 - DNA, 22 bp, Artificial Sequence
  chemically synthesized
cactatgacattttgcctctta

SEQ ID NO: 1031585 - DNA, 22 bp, Artificial Sequence
  chemically synthesized
agaggcaaaatgtcatagtgta

SEQ ID NO: 1031586 - DNA, 22 bp, Artificial Sequence
  chemically synthesized
cagaggaaggtcgtataccagt

SEQ ID NO: 1031587 - DNA, 22 bp, Artificial Sequence
  chemically synthesized
ccagaggaaggtcgtataccag

SEQ ID NO: 1031588 - DNA, 22 bp, Artificial Sequence
  chemically synthesized
ccagtcaagtgtttccagagga

SEQ ID NO: 1031589 - DNA, 22 bp, Artificial Sequence
  chemically synthesized
gtatacgaccttcctctggaaa

SEQ ID NO: 1031590 - DNA, 22 bp, Artificial Sequence
  chemically synthesized
accagtcaagtgtttccagagg

SEQ ID NO: 1031591 - DNA, 22 bp, Artificial Sequence
  chemically synthesized
ccttaccagtcaagtgtttcca

SEQ ID NO: 1031592 - DNA, 22 bp, Artificial Sequence
  chemically synthesized
cctctggaaacacttgactggt

SEQ ID NO: 1031593 - DNA, 22 bp, Artificial Sequence
  chemically synthesized
ctctggaaacacttgactggta

SEQ ID NO: 1031594 - DNA, 22 bp, Artificial Sequence
  chemically synthesized
aagaggtgttcccttaccagtc

SEQ ID NO: 1031595 - DNA, 22 bp, Artificial Sequence
  chemically synthesized
tggaaacacttgactggtaagg

SEQ ID NO: 1031596 - DNA, 22 bp, Artificial Sequence
  chemically synthesized
gaaacacttgactggtaaggga

SEQ ID NO: 1031597 - DNA, 22 bp, Artificial Sequence
  chemically synthesized
tattcaagaggtgttcccttac

SEQ ID NO: 1031598 - DNA, 22 bp, Artificial Sequence
  chemically synthesized
gagttgtattcaagaggtgttc

SEQ ID NO: 1031599 - DNA, 22 bp, Artificial Sequence
  chemically synthesized
gactggtaagggaacacctctt

SEQ ID NO: 1031600 - DNA, 22 bp, Artificial Sequence
  chemically synthesized
actggtaagggaacacctcttg

SEQ ID NO: 1031601 - DNA, 22 bp, Artificial Sequence
  chemically synthesized
ctggagttgtattcaagaggtg

SEQ ID NO: 1031602 - DNA, 22 bp, Artificial Sequence
  chemically synthesized
actggagttgtattcaagaggt

SEQ ID NO: 1031603 - DNA, 22 bp, Artificial Sequence
  chemically synthesized
gtaagggaacacctcttgaata

SEQ ID NO: 1031604 - DNA, 22 bp, Artificial Sequence
  chemically synthesized
ttgaatacaactccagtaaata

SEQ ID NO: 1031605 - DNA, 22 bp, Artificial Sequence
  chemically synthesized
gaatacaactccagtaaataca

SEQ ID NO: 1031606 - DNA, 22 bp, Artificial Sequence
  chemically synthesized
aatacaactccagtaaatacac

SEQ ID NO: 1031607 - DNA, 22 bp, Artificial Sequence
  chemically synthesized
ggaggggagcatgcacggtgta

SEQ ID NO: 1031608 - DNA, 22 bp, Artificial Sequence
  chemically synthesized
gggaggggagcatgcacggtgt

SEQ ID NO: 1031609 - DNA, 22 bp, Artificial Sequence
  chemically synthesized
cagtaaatacaccgtgcatgct

SEQ ID NO: 1031610 - DNA, 22 bp, Artificial Sequence
  chemically synthesized
acacttgggaggggagcatgca

SEQ ID NO: 1031611 - DNA, 22 bp, Artificial Sequence
  chemically synthesized
ctgacacttgggaggggagcat

SEQ ID NO: 1031612 - DNA, 22 bp, Artificial Sequence
  chemically synthesized
catgcacagtggtctgctgaca

SEQ ID NO: 1031613 - DNA, 22 bp, Artificial Sequence
  chemically synthesized
ccctcccaagtgtcagcagacc

SEQ ID NO: 1031614 - DNA, 22 bp, Artificial Sequence
  chemically synthesized
tctgcatgcacagtggtctgct

SEQ ID NO: 1031615 - DNA, 22 bp, Artificial Sequence
  chemically synthesized
ccaagtgtcagcagaccactgt

SEQ ID NO: 1031616 - DNA, 22 bp, Artificial Sequence
  chemically synthesized
gggtagggggctatctgcatgc

SEQ ID NO: 1031617 - DNA, 22 bp, Artificial Sequence
  chemically synthesized
ggggtagggggctatctgcatg

SEQ ID NO: 1031618 - DNA, 22 bp, Artificial Sequence
  chemically synthesized
ccttggggtagggggctatctg

SEQ ID NO: 1031619 - DNA, 22 bp, Artificial Sequence
  chemically synthesized
cccttggggtagggggctatct

SEQ ID NO: 1031620 - DNA, 22 bp, Artificial Sequence
  chemically synthesized
ttcccttggggtagggggctat

SEQ ID NO: 1031621 - DNA, 22 bp, Artificial Sequence
  chemically synthesized
tgcatgcagatagccccctacc

SEQ ID NO: 1031622 - DNA, 22 bp, Artificial Sequence
  chemically synthesized
cccaattcttcccttggggtag

SEQ ID NO: 1031623 - DNA, 22 bp, Artificial Sequence
  chemically synthesized
tccccaattcttcccttggggt

SEQ ID NO: 1031624 - DNA, 22 bp, Artificial Sequence
  chemically synthesized
ctccccaattcttcccttgggg

SEQ ID NO: 1031625 - DNA, 22 bp, Artificial Sequence
  chemically synthesized
tataccttctccccaattcttc

SEQ ID NO: 1031626 - DNA, 22 bp, Artificial Sequence
  chemically synthesized
atataccttctccccaattctt

SEQ ID NO: 1031627 - DNA, 22 bp, Artificial Sequence
  chemically synthesized
ccccaagggaagaattggggag

SEQ ID NO: 1031628 - DNA, 22 bp, Artificial Sequence
  chemically synthesized
catggtcttatataccttctcc

SEQ ID NO: 1031629 - DNA, 22 bp, Artificial Sequence
  chemically synthesized
ccatggtcttatataccttctc

SEQ ID NO: 1031630 - DNA, 22 bp, Artificial Sequence
  chemically synthesized
gcatacttccatggtcttatat

SEQ ID NO: 1031631 - DNA, 22 bp, Artificial Sequence
  chemically synthesized
ggcatacttccatggtcttata

SEQ ID NO: 1031632 - DNA, 22 bp, Artificial Sequence
  chemically synthesized
gggagaaggtatataagaccat

SEQ ID NO: 1031633 - DNA, 22 bp, Artificial Sequence
  chemically synthesized
tggcatacttccatggtcttat

SEQ ID NO: 1031634 - DNA, 22 bp, Artificial Sequence
  chemically synthesized
tattttggcatacttccatggt

SEQ ID NO: 1031635 - DNA, 22 bp, Artificial Sequence
  chemically synthesized
gtattttggcatacttccatgg

SEQ ID NO: 1031636 - DNA, 22 bp, Artificial Sequence
  chemically synthesized
tgtattttggcatacttccatg

SEQ ID NO: 1031637 - DNA, 22 bp, Artificial Sequence
  chemically synthesized
tggttttgtattttggcatact

SEQ ID NO: 1031638 - DNA, 22 bp, Artificial Sequence
  chemically synthesized
atggttttgtattttggcatac

SEQ ID NO: 1031639 - DNA, 22 bp, Artificial Sequence
  chemically synthesized
atttatggttttgtattttggc

SEQ ID NO: 1031640 - DNA, 22 bp, Artificial Sequence
  chemically synthesized
gatttatggttttgtattttgg

SEQ ID NO: 1031641 - DNA, 22 bp, Artificial Sequence
  chemically synthesized
tgatttatggttttgtattttg

SEQ ID NO: 1031642 - DNA, 22 bp, Artificial Sequence
  chemically synthesized
aactttgatttatggttttgta

SEQ ID NO: 1031643 - DNA, 22 bp, Artificial Sequence
  chemically synthesized
gaactttgatttatggttttgt

SEQ ID NO: 1031644 - DNA, 22 bp, Artificial Sequence
  chemically synthesized
tttgaactttgatttatggttt

SEQ ID NO: 1031645 - DNA, 22 bp, Artificial Sequence
  chemically synthesized
agtgtcctgtttgaactttgat

SEQ ID NO: 1031646 - DNA, 22 bp, Artificial Sequence
  chemically synthesized
agatattaagtgtcctgtttga

SEQ ID NO: 1031647 - DNA, 22 bp, Artificial Sequence
  chemically synthesized
gagatattaagtgtcctgtttg

SEQ ID NO: 1031648 - DNA, 22 bp, Artificial Sequence
  chemically synthesized
aaacaggacacttaatatctca

SEQ ID NO: 1031649 - DNA, 22 bp, Artificial Sequence
  chemically synthesized
gaagggggccaagtgggcgact

SEQ ID NO: 1031650 - DNA, 22 bp, Artificial Sequence
  chemically synthesized
aatatctcaagtcgcccacttg

SEQ ID NO: 1031651 - DNA, 22 bp, Artificial Sequence
  chemically synthesized
atatctcaagtcgcccacttgg

SEQ ID NO: 1031652 - DNA, 22 bp, Artificial Sequence
  chemically synthesized
aagtcgcccacttggccccctt

SEQ ID NO: 1031653 - DNA, 22 bp, Artificial Sequence
  chemically synthesized
ggcccccttccagatgtacttt

SEQ ID NO: 1031654 - DNA, 22 bp, Artificial Sequence
  chemically synthesized
gcccccttccagatgtacttta

SEQ ID NO: 1031655 - DNA, 22 bp, Artificial Sequence
  chemically synthesized
gagcagaaatgaaaggaaataa

SEQ ID NO: 1031656 - DNA, 22 bp, Artificial Sequence
  chemically synthesized
ccagatgtactttatttccttt

SEQ ID NO: 1031657 - DNA, 22 bp, Artificial Sequence
  chemically synthesized
agagcagaaatgaaaggaaata

SEQ ID NO: 1031658 - DNA, 22 bp, Artificial Sequence
  chemically synthesized
cagatgtactttatttcctttc

SEQ ID NO: 1031659 - DNA, 22 bp, Artificial Sequence
  chemically synthesized
tagagcagaaatgaaaggaaat

SEQ ID NO: 1031660 - DNA, 22 bp, Artificial Sequence
  chemically synthesized
aaaactttagagcagaaatgaa

SEQ ID NO: 1031661 - DNA, 22 bp, Artificial Sequence
  chemically synthesized
aaaaactttagagcagaaatga

SEQ ID NO: 1031662 - DNA, 22 bp, Artificial Sequence
  chemically synthesized
tatttcctttcatttctgctct

SEQ ID NO: 1031663 - DNA, 22 bp, Artificial Sequence
  chemically synthesized
tttaaaaactttagagcagaaa

SEQ ID NO: 1031664 - DNA, 22 bp, Artificial Sequence
  chemically synthesized
atttcctttcatttctgctcta

SEQ ID NO: 1031665 - DNA, 22 bp, Artificial Sequence
  chemically synthesized
atttaaaaactttagagcagaa

SEQ ID NO: 1031666 - DNA, 22 bp, Artificial Sequence
  chemically synthesized
tttcctttcatttctgctctaa

SEQ ID NO: 1031667 - DNA, 22 bp, Artificial Sequence
  chemically synthesized
cctttcatttctgctctaaagt

SEQ ID NO: 1031668 - DNA, 22 bp, Artificial Sequence
  chemically synthesized
ctttcatttctgctctaaagtt

SEQ ID NO: 1031669 - DNA, 22 bp, Artificial Sequence
  chemically synthesized
tcatttctgctctaaagttttt

SEQ ID NO: 1031670 - DNA, 22 bp, Artificial Sequence
  chemically synthesized
catttctgctctaaagttttta

SEQ ID NO: 1031671 - DNA, 22 bp, Artificial Sequence
  chemically synthesized
atttctgctctaaagtttttaa

SEQ ID NO: 1031672 - DNA, 22 bp, Artificial Sequence
  chemically synthesized
ctgctctaaagtttttaaataa

SEQ ID NO: 1031673 - DNA, 22 bp, Artificial Sequence
  chemically synthesized
tgctctaaagtttttaaataaa

SEQ ID NO: 1031674 - DNA, 22 bp, Artificial Sequence
  chemically synthesized
ctctaaagtttttaaataaact

SEQ ID NO: 1031675 - DNA, 22 bp, Artificial Sequence
  chemically synthesized
gagcaggaatgaaagtttattt

SEQ ID NO: 1031676 - DNA, 22 bp, Artificial Sequence
  chemically synthesized
taaagtttttaaataaactttc

SEQ ID NO: 1031677 - DNA, 22 bp, Artificial Sequence
  chemically synthesized
aagtttttaaataaactttcat

SEQ ID NO: 1031678 - DNA, 22 bp, Artificial Sequence
  chemically synthesized
ttaaataaactttcattcctgc

SEQ ID NO: 1031679 - DNA, 22 bp, Artificial Sequence
  chemically synthesized
taaataaactttcattcctgct

SEQ ID NO: 1031680 - DNA, 22 bp, Artificial Sequence
  chemically synthesized
aaataaactttcattcctgctc

SEQ ID NO: 1031681 - DNA, 22 bp, Artificial Sequence
  chemically synthesized
aggcaagtgttagagcaggaat

SEQ ID NO: 1031682 - DNA, 22 bp, Artificial Sequence
  chemically synthesized
aataaactttcattcctgctct

SEQ ID NO: 1031683 - DNA, 22 bp, Artificial Sequence
  chemically synthesized
tcattcctgctctaacacttgc

SEQ ID NO: 1031684 - DNA, 22 bp, Artificial Sequence
  chemically synthesized
cattcctgctctaacacttgcc

SEQ ID NO: 1031685 - DNA, 22 bp, Artificial Sequence
  chemically synthesized
attcctgctctaacacttgcct

SEQ ID NO: 1031686 - DNA, 22 bp, Artificial Sequence
  chemically synthesized
ctgctctaacacttgcctcagt

SEQ ID NO: 1031687 - DNA, 22 bp, Artificial Sequence
  chemically synthesized
ctctaacacttgcctcagtctc

SEQ ID NO: 1031688 - DNA, 22 bp, Artificial Sequence
  chemically synthesized
taacacttgcctcagtctcttc

SEQ ID NO: 1031689 - DNA, 22 bp, Artificial Sequence
  chemically synthesized
acacttgcctcagtctcttctt

SEQ ID NO: 1031690 - DNA, 22 bp, Artificial Sequence
  chemically synthesized
gcctcagtctcttcttctgcct

SEQ ID NO: 1031691 - DNA, 22 bp, Artificial Sequence
  chemically synthesized
cctcagtctcttcttctgcctt

SEQ ID NO: 1031692 - DNA, 22 bp, Artificial Sequence
  chemically synthesized
gaccaaggaggcataaggcaga

SEQ ID NO: 1031693 - DNA, 22 bp, Artificial Sequence
  chemically synthesized
agtctcttcttctgccttatgc

SEQ ID NO: 1031694 - DNA, 22 bp, Artificial Sequence
  chemically synthesized
ttcttctgccttatgcctcctt

SEQ ID NO: 1031695 - DNA, 22 bp, Artificial Sequence
  chemically synthesized
cttctgccttatgcctccttgg

SEQ ID NO: 1031696 - DNA, 22 bp, Artificial Sequence
  chemically synthesized
ttctgccttatgcctccttggt

SEQ ID NO: 1031697 - DNA, 22 bp, Artificial Sequence
  chemically synthesized
ctgccttatgcctccttggtcg

SEQ ID NO: 1031698 - DNA, 22 bp, Artificial Sequence
  chemically synthesized
tgccttatgcctccttggtcga

SEQ ID NO: 1031699 - DNA, 22 bp, Artificial Sequence
  chemically synthesized
agaagaaagaattcgaccaagg

SEQ ID NO: 1031700 - DNA, 22 bp, Artificial Sequence
  chemically synthesized
ccttatgcctccttggtcgaat

SEQ ID NO: 1031701 - DNA, 22 bp, Artificial Sequence
  chemically synthesized
ctcagaagaaagaattcgacca

SEQ ID NO: 1031702 - DNA, 22 bp, Artificial Sequence
  chemically synthesized
atgcctccttggtcgaattctt

SEQ ID NO: 1031703 - DNA, 22 bp, Artificial Sequence
  chemically synthesized
tgcctccttggtcgaattcttt

SEQ ID NO: 1031704 - DNA, 22 bp, Artificial Sequence
  chemically synthesized
atgcctcctcagaagaaagaat

SEQ ID NO: 1031705 - DNA, 22 bp, Artificial Sequence
  chemically synthesized
cttggtcgaattctttcttctg

SEQ ID NO: 1031706 - DNA, 22 bp, Artificial Sequence
  chemically synthesized
attcatgcctcctcagaagaaa

SEQ ID NO: 1031707 - DNA, 22 bp, Artificial Sequence
  chemically synthesized
aattcatgcctcctcagaagaa

SEQ ID NO: 1031708 - DNA, 22 bp, Artificial Sequence
  chemically synthesized
ggtcgaattctttcttctgagg

SEQ ID NO: 1031709 - DNA, 22 bp, Artificial Sequence
  chemically synthesized
gtcgaattctttcttctgagga

SEQ ID NO: 1031710 - DNA, 22 bp, Artificial Sequence
  chemically synthesized
agcaaccttaattcatgcctcc

SEQ ID NO: 1031711 - DNA, 22 bp, Artificial Sequence
  chemically synthesized
cagcaaccttaattcatgcctc

SEQ ID NO: 1031712 - DNA, 22 bp, Artificial Sequence
  chemically synthesized
tttcttctgaggaggcatgaat

SEQ ID NO: 1031713 - DNA, 22 bp, Artificial Sequence
  chemically synthesized
tcttctgaggaggcatgaatta

SEQ ID NO: 1031714 - DNA, 22 bp, Artificial Sequence
  chemically synthesized
cttctgaggaggcatgaattaa

SEQ ID NO: 1031715 - DNA, 22 bp, Artificial Sequence
  chemically synthesized
ttctgaggaggcatgaattaag

SEQ ID NO: 1031716 - DNA, 22 bp, Artificial Sequence
  chemically synthesized
ctgaggaggcatgaattaaggt

SEQ ID NO: 1031717 - DNA, 22 bp, Artificial Sequence
  chemically synthesized
tgaggaggcatgaattaaggtt

SEQ ID NO: 1031718 - DNA, 22 bp, Artificial Sequence
  chemically synthesized
aggaggcatgaattaaggttgc

SEQ ID NO: 1031719 - DNA, 22 bp, Artificial Sequence
  chemically synthesized
gcagtgaatccatacgggtctt

SEQ ID NO: 1031720 - DNA, 22 bp, Artificial Sequence
  chemically synthesized
aggttgctgaagacccgtatgg

SEQ ID NO: 1031721 - DNA, 22 bp, Artificial Sequence
  chemically synthesized
ctggcagtgaatccatacgggt

SEQ ID NO: 1031722 - DNA, 22 bp, Artificial Sequence
  chemically synthesized
ttactggcagtgaatccatacg

SEQ ID NO: 1031723 - DNA, 22 bp, Artificial Sequence
  chemically synthesized
ctgaagacccgtatggattcac

SEQ ID NO: 1031724 - DNA, 22 bp, Artificial Sequence
  chemically synthesized
ctgttactggcagtgaatccat

SEQ ID NO: 1031725 - DNA, 22 bp, Artificial Sequence
  chemically synthesized
aagacccgtatggattcactgc

SEQ ID NO: 1031726 - DNA, 22 bp, Artificial Sequence
  chemically synthesized
ctcctgttactggcagtgaatc

SEQ ID NO: 1031727 - DNA, 22 bp, Artificial Sequence
  chemically synthesized
tcctcctgttactggcagtgaa

SEQ ID NO: 1031728 - DNA, 22 bp, Artificial Sequence
  chemically synthesized
tctcctcctgttactggcagtg

SEQ ID NO: 1031729 - DNA, 22 bp, Artificial Sequence
  chemically synthesized
tctctcctcctgttactggcag

SEQ ID NO: 1031730 - DNA, 22 bp, Artificial Sequence
  chemically synthesized
aataactctctctcctcctgtt

SEQ ID NO: 1031731 - DNA, 22 bp, Artificial Sequence
  chemically synthesized
actgccagtaacaggaggagag

SEQ ID NO: 1031732 - DNA, 22 bp, Artificial Sequence
  chemically synthesized
gttgaataactctctctcctcc

SEQ ID NO: 1031733 - DNA, 22 bp, Artificial Sequence
  chemically synthesized
ccagtaacaggaggagagagag

SEQ ID NO: 1031734 - DNA, 22 bp, Artificial Sequence
  chemically synthesized
tatagtcggtatataataattc

SEQ ID NO: 1031735 - DNA, 22 bp, Artificial Sequence
  chemically synthesized
ctatatagtcggtatataataa

SEQ ID NO: 1031736 - DNA, 22 bp, Artificial Sequence
  chemically synthesized
actatatagtcggtatataata

SEQ ID NO: 1031737 - DNA, 22 bp, Artificial Sequence
  chemically synthesized
ttcaacgaattattatataccg

SEQ ID NO: 1031738 - DNA, 22 bp, Artificial Sequence
  chemically synthesized
aacgaattattatataccgact

SEQ ID NO: 1031739 - DNA, 22 bp, Artificial Sequence
  chemically synthesized
ttatataccgactatatagtaa

SEQ ID NO: 1031740 - DNA, 22 bp, Artificial Sequence
  chemically synthesized
tataccgactatatagtaagtg

SEQ ID NO: 1031741 - DNA, 22 bp, Artificial Sequence
  chemically synthesized
tatagtaagtgaccttactcat

SEQ ID NO: 1031742 - DNA, 22 bp, Artificial Sequence
  chemically synthesized
tgatggtgagccggaatgagta

SEQ ID NO: 1031743 - DNA, 22 bp, Artificial Sequence
  chemically synthesized
atattgtgatggtgagccggaa

SEQ ID NO: 1031744 - DNA, 22 bp, Artificial Sequence
  chemically synthesized
atactcatattgtgatggtgag

SEQ ID NO: 1031745 - DNA, 22 bp, Artificial Sequence
  chemically synthesized
actcattccggctcaccatcac

SEQ ID NO: 1031746 - DNA, 22 bp, Artificial Sequence
  chemically synthesized
ctcattccggctcaccatcaca

SEQ ID NO: 1031747 - DNA, 22 bp, Artificial Sequence
  chemically synthesized
attccggctcaccatcacaata

SEQ ID NO: 1031748 - DNA, 22 bp, Artificial Sequence
  chemically synthesized
aaccctaatactcatattgtga

SEQ ID NO: 1031749 - DNA, 22 bp, Artificial Sequence
  chemically synthesized
gaaccctaatactcatattgtg

SEQ ID NO: 1031750 - DNA, 22 bp, Artificial Sequence
  chemically synthesized
cggctcaccatcacaatatgag

SEQ ID NO: 1031751 - DNA, 22 bp, Artificial Sequence
  chemically synthesized
tgaaccctaatactcatattgt

SEQ ID NO: 1031752 - DNA, 22 bp, Artificial Sequence
  chemically synthesized
tcctttgaaccctaatactcat

SEQ ID NO: 1031753 - DNA, 22 bp, Artificial Sequence
  chemically synthesized
accatcacaatatgagtattag

SEQ ID NO: 1031754 - DNA, 22 bp, Artificial Sequence
  chemically synthesized
gtcctttgaaccctaatactca

SEQ ID NO: 1031755 - DNA, 22 bp, Artificial Sequence
  chemically synthesized
ataaaagcttgtcctttgaacc

SEQ ID NO: 1031756 - DNA, 22 bp, Artificial Sequence
  chemically synthesized
cataaaagcttgtcctttgaac

SEQ ID NO: 1031757 - DNA, 22 bp, Artificial Sequence
  chemically synthesized
catttcataaaagcttgtcctt

SEQ ID NO: 1031758 - DNA, 22 bp, Artificial Sequence
  chemically synthesized
acatttcataaaagcttgtcct

SEQ ID NO: 1031759 - DNA, 22 bp, Artificial Sequence
  chemically synthesized
gggttcaaaggacaagctttta

SEQ ID NO: 1031760 - DNA, 22 bp, Artificial Sequence
  chemically synthesized
agagatttacatttcataaaag

SEQ ID NO: 1031761 - DNA, 22 bp, Artificial Sequence
  chemically synthesized
aaaggacaagcttttatgaaat

SEQ ID NO: 1031762 - DNA, 22 bp, Artificial Sequence
  chemically synthesized
tattaagagatttacatttcat

SEQ ID NO: 1031763 - DNA, 22 bp, Artificial Sequence
  chemically synthesized
atattaagagatttacatttca

SEQ ID NO: 1031764 - DNA, 22 bp, Artificial Sequence
  chemically synthesized
tatattaagagatttacatttc

SEQ ID NO: 1031765 - DNA, 22 bp, Artificial Sequence
  chemically synthesized
tttatattaagagatttacatt

SEQ ID NO: 1031766 - DNA, 22 bp, Artificial Sequence
  chemically synthesized
attctttatattaagagattta

SEQ ID NO: 1031767 - DNA, 22 bp, Artificial Sequence
  chemically synthesized
aattctttatattaagagattt

SEQ ID NO: 1031768 - DNA, 22 bp, Artificial Sequence
  chemically synthesized
ttatgaaatgtaaatctcttaa

SEQ ID NO: 1031769 - DNA, 22 bp, Artificial Sequence
  chemically synthesized
taattctttatattaagagatt

SEQ ID NO: 1031770 - DNA, 22 bp, Artificial Sequence
  chemically synthesized
tatgaaatgtaaatctcttaat

SEQ ID NO: 1031771 - DNA, 22 bp, Artificial Sequence
  chemically synthesized
atgaaatgtaaatctcttaata

SEQ ID NO: 1031772 - DNA, 22 bp, Artificial Sequence
  chemically synthesized
tgaaatgtaaatctcttaatat

SEQ ID NO: 1031773 - DNA, 22 bp, Artificial Sequence
  chemically synthesized
ttttaattctttatattaagag

SEQ ID NO: 1031774 - DNA, 22 bp, Artificial Sequence
  chemically synthesized
gatattattttaattctttata

SEQ ID NO: 1031775 - DNA, 22 bp, Artificial Sequence
  chemically synthesized
ggatattattttaattctttat

SEQ ID NO: 1031776 - DNA, 22 bp, Artificial Sequence
  chemically synthesized
atacttggatattattttaatt

SEQ ID NO: 1031777 - DNA, 22 bp, Artificial Sequence
  chemically synthesized
ttaatataaagaattaaaataa

SEQ ID NO: 1031778 - DNA, 22 bp, Artificial Sequence
  chemically synthesized
aatataaagaattaaaataata

SEQ ID NO: 1031779 - DNA, 22 bp, Artificial Sequence
  chemically synthesized
atataaagaattaaaataatat

SEQ ID NO: 1031780 - DNA, 22 bp, Artificial Sequence
  chemically synthesized
gaatctaatacttggatattat

SEQ ID NO: 1031781 - DNA, 22 bp, Artificial Sequence
  chemically synthesized
agaatctaatacttggatatta

SEQ ID NO: 1031782 - DNA, 22 bp, Artificial Sequence
  chemically synthesized
tttagaatctaatacttggata

SEQ ID NO: 1031783 - DNA, 22 bp, Artificial Sequence
  chemically synthesized
atttagaatctaatacttggat

SEQ ID NO: 1031784 - DNA, 22 bp, Artificial Sequence
  chemically synthesized
aaataatatccaagtattagat

SEQ ID NO: 1031785 - DNA, 22 bp, Artificial Sequence
  chemically synthesized
aaagtatttatttagaatctaa

SEQ ID NO: 1031786 - DNA, 22 bp, Artificial Sequence
  chemically synthesized
aaaagtatttatttagaatcta

SEQ ID NO: 1031787 - DNA, 22 bp, Artificial Sequence
  chemically synthesized
taaaagtatttatttagaatct

SEQ ID NO: 1031788 - DNA, 22 bp, Artificial Sequence
  chemically synthesized
gttttaaaagtatttatttaga

SEQ ID NO: 1031789 - DNA, 22 bp, Artificial Sequence
  chemically synthesized
gattctaaataaatacttttaa

SEQ ID NO: 1031790 - DNA, 22 bp, Artificial Sequence
  chemically synthesized
taataactagttttaaaagtat

SEQ ID NO: 1031791 - DNA, 22 bp, Artificial Sequence
  chemically synthesized
gtaataactagttttaaaagta

SEQ ID NO: 1031792 - DNA, 22 bp, Artificial Sequence
  chemically synthesized
taaataaatacttttaaaacta

SEQ ID NO: 1031793 - DNA, 22 bp, Artificial Sequence
  chemically synthesized
aataaatacttttaaaactagt

SEQ ID NO: 1031794 - DNA, 22 bp, Artificial Sequence
  chemically synthesized
gatacagtcttgtaataactag

SEQ ID NO: 1031795 - DNA, 22 bp, Artificial Sequence
  chemically synthesized
ttaaaactagttattacaagac

SEQ ID NO: 1031796 - DNA, 22 bp, Artificial Sequence
  chemically synthesized
tgattagatacagtcttgtaat

SEQ ID NO: 1031797 - DNA, 22 bp, Artificial Sequence
  chemically synthesized
taaaactagttattacaagact

SEQ ID NO: 1031798 - DNA, 22 bp, Artificial Sequence
  chemically synthesized
gtgattagatacagtcttgtaa

SEQ ID NO: 1031799 - DNA, 22 bp, Artificial Sequence
  chemically synthesized
aaaactagttattacaagactg

SEQ ID NO: 1031800 - DNA, 22 bp, Artificial Sequence
  chemically synthesized
aaactagttattacaagactgt

SEQ ID NO: 1031801 - DNA, 22 bp, Artificial Sequence
  chemically synthesized
tttgtgattagatacagtcttg

SEQ ID NO: 1031802 - DNA, 22 bp, Artificial Sequence
  chemically synthesized
gttattacaagactgtatctaa

SEQ ID NO: 1031803 - DNA, 22 bp, Artificial Sequence
  chemically synthesized
ttacaagactgtatctaatcac

SEQ ID NO: 1031804 - DNA, 22 bp, Artificial Sequence
  chemically synthesized
caagactgtatctaatcacaaa

SEQ ID NO: 1031805 - DNA, 22 bp, Artificial Sequence
  chemically synthesized
tatctaatcacaaacaggtttt

SEQ ID NO: 1031806 - DNA, 22 bp, Artificial Sequence
  chemically synthesized
atcacaaacaggtttttatttt

SEQ ID NO: 1031807 - DNA, 22 bp, Artificial Sequence
  chemically synthesized
agatagtgagaaaaacaaaaca

SEQ ID NO: 1031808 - DNA, 22 bp, Artificial Sequence
  chemically synthesized
gagatagtgagaaaaacaaaac

SEQ ID NO: 1031809 - DNA, 22 bp, Artificial Sequence
  chemically synthesized
ttattttgttttgtttttctca

SEQ ID NO: 1031810 - DNA, 22 bp, Artificial Sequence
  chemically synthesized
tattttgttttgtttttctcac

SEQ ID NO: 1031811 - DNA, 22 bp, Artificial Sequence
  chemically synthesized
attttgttttgtttttctcact

SEQ ID NO: 1031812 - DNA, 22 bp, Artificial Sequence
  chemically synthesized
ttttgttttgtttttctcacta

SEQ ID NO: 1031813 - DNA, 22 bp, Artificial Sequence
  chemically synthesized
agcagcttgagatagtgagaaa

SEQ ID NO: 1031814 - DNA, 22 bp, Artificial Sequence
  chemically synthesized
cagcagcttgagatagtgagaa

SEQ ID NO: 1031815 - DNA, 22 bp, Artificial Sequence
  chemically synthesized
tgttttgtttttctcactatct

SEQ ID NO: 1031816 - DNA, 22 bp, Artificial Sequence
  chemically synthesized
gttttgtttttctcactatctc

SEQ ID NO: 1031817 - DNA, 22 bp, Artificial Sequence
  chemically synthesized
tttcagcagcttgagatagtga

SEQ ID NO: 1031818 - DNA, 22 bp, Artificial Sequence
  chemically synthesized
ttttgtttttctcactatctca

SEQ ID NO: 1031819 - DNA, 22 bp, Artificial Sequence
  chemically synthesized
gtttcagcagcttgagatagtg

SEQ ID NO: 1031820 - DNA, 22 bp, Artificial Sequence
  chemically synthesized
tgtttttctcactatctcaagc

SEQ ID NO: 1031821 - DNA, 22 bp, Artificial Sequence
  chemically synthesized
gtttttctcactatctcaagct

SEQ ID NO: 1031822 - DNA, 22 bp, Artificial Sequence
  chemically synthesized
tttttctcactatctcaagctg

SEQ ID NO: 1031823 - DNA, 22 bp, Artificial Sequence
  chemically synthesized
aatttgtttcagcagcttgaga

SEQ ID NO: 1031824 - DNA, 22 bp, Artificial Sequence
  chemically synthesized
ttctcactatctcaagctgctg

SEQ ID NO: 1031825 - DNA, 22 bp, Artificial Sequence
  chemically synthesized
tctcactatctcaagctgctga

SEQ ID NO: 1031826 - DNA, 22 bp, Artificial Sequence
  chemically synthesized
ctcactatctcaagctgctgaa

SEQ ID NO: 1031827 - DNA, 22 bp, Artificial Sequence
  chemically synthesized
cattaaatttgtttcagcagct

SEQ ID NO: 1031828 - DNA, 22 bp, Artificial Sequence
  chemically synthesized
tcactatctcaagctgctgaaa

SEQ ID NO: 1031829 - DNA, 22 bp, Artificial Sequence
  chemically synthesized
actatctcaagctgctgaaaca

SEQ ID NO: 1031830 - DNA, 22 bp, Artificial Sequence
  chemically synthesized
tctcaagctgctgaaacaaatt

SEQ ID NO: 1031831 - DNA, 22 bp, Artificial Sequence
  chemically synthesized
aagctgctgaaacaaatttaat

SEQ ID NO: 1031832 - DNA, 22 bp, Artificial Sequence
  chemically synthesized
ctgaaacaaatttaatggagtc

SEQ ID NO: 1031833 - DNA, 22 bp, Artificial Sequence
  chemically synthesized
agtgatgagggaaggactccat

SEQ ID NO: 1031834 - DNA, 22 bp, Artificial Sequence
  chemically synthesized
aaacaaatttaatggagtcctt

SEQ ID NO: 1031835 - DNA, 22 bp, Artificial Sequence
  chemically synthesized
cagaattcagtgatgagggaag

SEQ ID NO: 1031836 - DNA, 22 bp, Artificial Sequence
  chemically synthesized
aatggagtccttccctcatcac

SEQ ID NO: 1031837 - DNA, 22 bp, Artificial Sequence
  chemically synthesized
atggagtccttccctcatcact

SEQ ID NO: 1031838 - DNA, 22 bp, Artificial Sequence
  chemically synthesized
aaagaaaaatctacagaattca

SEQ ID NO: 1031839 - DNA, 22 bp, Artificial Sequence
  chemically synthesized
ccctcatcactgaattctgtag

SEQ ID NO: 1031840 - DNA, 22 bp, Artificial Sequence
  chemically synthesized
cctcatcactgaattctgtaga

SEQ ID NO: 1031841 - DNA, 22 bp, Artificial Sequence
  chemically synthesized
caactgaaagaaaaatctacag

SEQ ID NO: 1031842 - DNA, 22 bp, Artificial Sequence
  chemically synthesized
atcactgaattctgtagatttt

SEQ ID NO: 1031843 - DNA, 22 bp, Artificial Sequence
  chemically synthesized
acaactgaaagaaaaatctaca

SEQ ID NO: 1031844 - DNA, 22 bp, Artificial Sequence
  chemically synthesized
ttacaactgaaagaaaaatcta

SEQ ID NO: 1031845 - DNA, 22 bp, Artificial Sequence
  chemically synthesized
cttacaactgaaagaaaaatct

SEQ ID NO: 1031846 - DNA, 22 bp, Artificial Sequence
  chemically synthesized
tcttacaactgaaagaaaaatc

SEQ ID NO: 1031847 - DNA, 22 bp, Artificial Sequence
  chemically synthesized
aattctgtagatttttctttca

SEQ ID NO: 1031848 - DNA, 22 bp, Artificial Sequence
  chemically synthesized
ttttcttacaactgaaagaaaa

SEQ ID NO: 1031849 - DNA, 22 bp, Artificial Sequence
  chemically synthesized
tgtagatttttctttcagttgt

SEQ ID NO: 1031850 - DNA, 22 bp, Artificial Sequence
  chemically synthesized
tagatttttctttcagttgtaa

SEQ ID NO: 1031851 - DNA, 22 bp, Artificial Sequence
  chemically synthesized
ttctttcagttgtaagaaaata

SEQ ID NO: 1031852 - DNA, 22 bp, Artificial Sequence
  chemically synthesized
tctttcagttgtaagaaaataa

SEQ ID NO: 1031853 - DNA, 22 bp, Artificial Sequence
  chemically synthesized
aaaaggaaagcattattttctt

SEQ ID NO: 1031854 - DNA, 22 bp, Artificial Sequence
  chemically synthesized
ctttcagttgtaagaaaataat

SEQ ID NO: 1031855 - DNA, 22 bp, Artificial Sequence
  chemically synthesized
caaaaggaaagcattattttct

SEQ ID NO: 1031856 - DNA, 22 bp, Artificial Sequence
  chemically synthesized
tttcagttgtaagaaaataatg

SEQ ID NO: 1031857 - DNA, 22 bp, Artificial Sequence
  chemically synthesized
tcagttgtaagaaaataatgct

SEQ ID NO: 1031858 - DNA, 22 bp, Artificial Sequence
  chemically synthesized
cagttgtaagaaaataatgctt

SEQ ID NO: 1031859 - DNA, 22 bp, Artificial Sequence
  chemically synthesized
agttgtaagaaaataatgcttt

SEQ ID NO: 1031860 - DNA, 22 bp, Artificial Sequence
  chemically synthesized
taagaaaataatgctttccttt

SEQ ID NO: 1031861 - DNA, 22 bp, Artificial Sequence
  chemically synthesized
atccaagccaacatcttcaaaa

SEQ ID NO: 1031862 - DNA, 22 bp, Artificial Sequence
  chemically synthesized
taatccaagccaacatcttcaa

SEQ ID NO: 1031863 - DNA, 22 bp, Artificial Sequence
  chemically synthesized
ctaatccaagccaacatcttca

SEQ ID NO: 1031864 - DNA, 22 bp, Artificial Sequence
  chemically synthesized
tctaatccaagccaacatcttc

SEQ ID NO: 1031865 - DNA, 22 bp, Artificial Sequence
  chemically synthesized
ttctaatccaagccaacatctt

SEQ ID NO: 1031866 - DNA, 22 bp, Artificial Sequence
  chemically synthesized
tccttttgaagatgttggcttg

SEQ ID NO: 1031867 - DNA, 22 bp, Artificial Sequence
  chemically synthesized
ccttttgaagatgttggcttgg

SEQ ID NO: 1031868 - DNA, 22 bp, Artificial Sequence
  chemically synthesized
cttttgaagatgttggcttgga

SEQ ID NO: 1031869 - DNA, 22 bp, Artificial Sequence
  chemically synthesized
ttgaagatgttggcttggatta

SEQ ID NO: 1031870 - DNA, 22 bp, Artificial Sequence
  chemically synthesized
tgaagatgttggcttggattag

SEQ ID NO: 1031871 - DNA, 22 bp, Artificial Sequence
  chemically synthesized
gaagatgttggcttggattaga

SEQ ID NO: 1031872 - DNA, 22 bp, Artificial Sequence
  chemically synthesized
aagatgttggcttggattagaa

SEQ ID NO: 1031873 - DNA, 22 bp, Artificial Sequence
  chemically synthesized
ataataaagcatttttctaatc

SEQ ID NO: 1031874 - DNA, 22 bp, Artificial Sequence
  chemically synthesized
gcttggattagaaaaatgcttt

SEQ ID NO: 1031875 - DNA, 22 bp, Artificial Sequence
  chemically synthesized
caatactcataataaagcattt

SEQ ID NO: 1031876 - DNA, 22 bp, Artificial Sequence
  chemically synthesized
gcaatactcataataaagcatt

SEQ ID NO: 1031877 - DNA, 22 bp, Artificial Sequence
  chemically synthesized
tgcaatactcataataaagcat

SEQ ID NO: 1031878 - DNA, 22 bp, Artificial Sequence
  chemically synthesized
ggattagaaaaatgctttatta

SEQ ID NO: 1031879 - DNA, 22 bp, Artificial Sequence
  chemically synthesized
gattagaaaaatgctttattat

SEQ ID NO: 1031880 - DNA, 22 bp, Artificial Sequence
  chemically synthesized
gaaaaatgctttattatgagta

SEQ ID NO: 1031881 - DNA, 22 bp, Artificial Sequence
  chemically synthesized
tggtaaataagtagctttgcaa

SEQ ID NO: 1031882 - DNA, 22 bp, Artificial Sequence
  chemically synthesized
tattatgagtattgcaaagcta

SEQ ID NO: 1031883 - DNA, 22 bp, Artificial Sequence
  chemically synthesized
attatgagtattgcaaagctac

SEQ ID NO: 1031884 - DNA, 22 bp, Artificial Sequence
  chemically synthesized
ttatgagtattgcaaagctact

SEQ ID NO: 1031885 - DNA, 22 bp, Artificial Sequence
  chemically synthesized
gctgtggtaaataagtagcttt

SEQ ID NO: 1031886 - DNA, 22 bp, Artificial Sequence
  chemically synthesized
tgagtattgcaaagctacttat

SEQ ID NO: 1031887 - DNA, 22 bp, Artificial Sequence
  chemically synthesized
tctagctgtggtaaataagtag

SEQ ID NO: 1031888 - DNA, 22 bp, Artificial Sequence
  chemically synthesized
tgtctagctgtggtaaataagt

SEQ ID NO: 1031889 - DNA, 22 bp, Artificial Sequence
  chemically synthesized
caaagctacttatttaccacag

SEQ ID NO: 1031890 - DNA, 22 bp, Artificial Sequence
  chemically synthesized
cttatttaccacagctagacag

SEQ ID NO: 1031891 - DNA, 22 bp, Artificial Sequence
  chemically synthesized
atttaccacagctagacagaga

SEQ ID NO: 1031892 - DNA, 22 bp, Artificial Sequence
  chemically synthesized
tttaccacagctagacagagac

SEQ ID NO: 1031893 - DNA, 22 bp, Artificial Sequence
  chemically synthesized
accacagctagacagagactct

SEQ ID NO: 1031894 - DNA, 22 bp, Artificial Sequence
  chemically synthesized
ccacagctagacagagactctt

SEQ ID NO: 1031895 - DNA, 22 bp, Artificial Sequence
  chemically synthesized
catgacaaagtaagaaagagtc

SEQ ID NO: 1031896 - DNA, 22 bp, Artificial Sequence
  chemically synthesized
gacagagactctttcttacttt

SEQ ID NO: 1031897 - DNA, 22 bp, Artificial Sequence
  chemically synthesized
aaaacaagcagctgcatgacaa

SEQ ID NO: 1031898 - DNA, 22 bp, Artificial Sequence
  chemically synthesized
aaaaacaagcagctgcatgaca

SEQ ID NO: 1031899 - DNA, 22 bp, Artificial Sequence
  chemically synthesized
tttcttactttgtcatgcagct

SEQ ID NO: 1031900 - DNA, 22 bp, Artificial Sequence
  chemically synthesized
tttaaaaacaagcagctgcatg

SEQ ID NO: 1031901 - DNA, 22 bp, Artificial Sequence
  chemically synthesized
tcttactttgtcatgcagctgc

SEQ ID NO: 1031902 - DNA, 22 bp, Artificial Sequence
  chemically synthesized
gtttaaaaacaagcagctgcat

SEQ ID NO: 1031903 - DNA, 22 bp, Artificial Sequence
  chemically synthesized
cttactttgtcatgcagctgct

SEQ ID NO: 1031904 - DNA, 22 bp, Artificial Sequence
  chemically synthesized
ttactttgtcatgcagctgctt

SEQ ID NO: 1031905 - DNA, 22 bp, Artificial Sequence
  chemically synthesized
actttgtcatgcagctgcttgt

SEQ ID NO: 1031906 - DNA, 22 bp, Artificial Sequence
  chemically synthesized
ctttgtcatgcagctgcttgtt

SEQ ID NO: 1031907 - DNA, 22 bp, Artificial Sequence
  chemically synthesized
tgtcatgcagctgcttgttttt

SEQ ID NO: 1031908 - DNA, 22 bp, Artificial Sequence
  chemically synthesized
gtcatgcagctgcttgttttta

SEQ ID NO: 1031909 - DNA, 22 bp, Artificial Sequence
  chemically synthesized
gcaaaatttgtttaaaaacaag

SEQ ID NO: 1031910 - DNA, 22 bp, Artificial Sequence
  chemically synthesized
tcatgcagctgcttgtttttaa

SEQ ID NO: 1031911 - DNA, 22 bp, Artificial Sequence
  chemically synthesized
ggcaaaatttgtttaaaaacaa

SEQ ID NO: 1031912 - DNA, 22 bp, Artificial Sequence
  chemically synthesized
ttggcaaaatttgtttaaaaac

SEQ ID NO: 1031913 - DNA, 22 bp, Artificial Sequence
  chemically synthesized
tgtctcttggcaaaatttgttt

SEQ ID NO: 1031914 - DNA, 22 bp, Artificial Sequence
  chemically synthesized
atgtctcttggcaaaatttgtt

SEQ ID NO: 1031915 - DNA, 22 bp, Artificial Sequence
  chemically synthesized
cttgtttttaaacaaattttgc

SEQ ID NO: 1031916 - DNA, 22 bp, Artificial Sequence
  chemically synthesized
gtttatgtctcttggcaaaatt

SEQ ID NO: 1031917 - DNA, 22 bp, Artificial Sequence
  chemically synthesized
gtttttaaacaaattttgccaa

SEQ ID NO: 1031918 - DNA, 22 bp, Artificial Sequence
  chemically synthesized
tttttaaacaaattttgccaag

SEQ ID NO: 1031919 - DNA, 22 bp, Artificial Sequence
  chemically synthesized
ttaaacaaattttgccaagaga

SEQ ID NO: 1031920 - DNA, 22 bp, Artificial Sequence
  chemically synthesized
taaacaaattttgccaagagac

SEQ ID NO: 1031921 - DNA, 22 bp, Artificial Sequence
  chemically synthesized
aaacaaattttgccaagagaca

SEQ ID NO: 1031922 - DNA, 22 bp, Artificial Sequence
  chemically synthesized
aacaaattttgccaagagacat

SEQ ID NO: 1031923 - DNA, 22 bp, Artificial Sequence
  chemically synthesized
aagaagaccatctggtttatgt

SEQ ID NO: 1031924 - DNA, 22 bp, Artificial Sequence
  chemically synthesized
gaagaagaccatctggtttatg

SEQ ID NO: 1031925 - DNA, 22 bp, Artificial Sequence
  chemically synthesized
tgccaagagacataaaccagat

SEQ ID NO: 1031926 - DNA, 22 bp, Artificial Sequence
  chemically synthesized
gccaagagacataaaccagatg

SEQ ID NO: 1031927 - DNA, 22 bp, Artificial Sequence
  chemically synthesized
ccaagagacataaaccagatgg

SEQ ID NO: 1031928 - DNA, 22 bp, Artificial Sequence
  chemically synthesized
acaggatacccttgaagaagac

SEQ ID NO: 1031929 - DNA, 22 bp, Artificial Sequence
  chemically synthesized
tcacagctcacaggataccctt

SEQ ID NO: 1031930 - DNA, 22 bp, Artificial Sequence
  chemically synthesized
actatcacagctcacaggatac

SEQ ID NO: 1031931 - DNA, 22 bp, Artificial Sequence
  chemically synthesized
cttcaagggtatcctgtgagct

SEQ ID NO: 1031932 - DNA, 22 bp, Artificial Sequence
  chemically synthesized
ttcaagggtatcctgtgagctg

SEQ ID NO: 1031933 - DNA, 22 bp, Artificial Sequence
  chemically synthesized
caagggtatcctgtgagctgtg

SEQ ID NO: 1031934 - DNA, 22 bp, Artificial Sequence
  chemically synthesized
aagggtatcctgtgagctgtga

SEQ ID NO: 1031935 - DNA, 22 bp, Artificial Sequence
  chemically synthesized
ccataagctgactatcacagct

SEQ ID NO: 1031936 - DNA, 22 bp, Artificial Sequence
  chemically synthesized
aaaactaccataagctgactat

SEQ ID NO: 1031937 - DNA, 22 bp, Artificial Sequence
  chemically synthesized
tgagctgtgatagtcagcttat

SEQ ID NO: 1031938 - DNA, 22 bp, Artificial Sequence
  chemically synthesized
ctcaaaactaccataagctgac

SEQ ID NO: 1031939 - DNA, 22 bp, Artificial Sequence
  chemically synthesized
ctgctcaaaactaccataagct

SEQ ID NO: 1031940 - DNA, 22 bp, Artificial Sequence
  chemically synthesized
tgatagtcagcttatggtagtt

SEQ ID NO: 1031941 - DNA, 22 bp, Artificial Sequence
  chemically synthesized
tctgctgctcaaaactaccata

SEQ ID NO: 1031942 - DNA, 22 bp, Artificial Sequence
  chemically synthesized
catacccagctgtctgctgctc

SEQ ID NO: 1031943 - DNA, 22 bp, Artificial Sequence
  chemically synthesized
atggtagttttgagcagcagac

SEQ ID NO: 1031944 - DNA, 22 bp, Artificial Sequence
  chemically synthesized
ccatacccagctgtctgctgct

SEQ ID NO: 1031945 - DNA, 22 bp, Artificial Sequence
  chemically synthesized
tggtagttttgagcagcagaca

SEQ ID NO: 1031946 - DNA, 22 bp, Artificial Sequence
  chemically synthesized
tccatacccagctgtctgctgc

SEQ ID NO: 1031947 - DNA, 22 bp, Artificial Sequence
  chemically synthesized
tgagcagcagacagctgggtat

SEQ ID NO: 1031948 - DNA, 22 bp, Artificial Sequence
  chemically synthesized
gagcagcagacagctgggtatg

SEQ ID NO: 1031949 - DNA, 22 bp, Artificial Sequence
  chemically synthesized
agcagcagacagctgggtatgg

SEQ ID NO: 1031950 - DNA, 22 bp, Artificial Sequence
  chemically synthesized
caaatagcatcatgactttcca

SEQ ID NO: 1031951 - DNA, 22 bp, Artificial Sequence
  chemically synthesized
ccaaatagcatcatgactttcc

SEQ ID NO: 1031952 - DNA, 22 bp, Artificial Sequence
  chemically synthesized
gatttccaaatagcatcatgac

SEQ ID NO: 1031953 - DNA, 22 bp, Artificial Sequence
  chemically synthesized
ggtatggaaagtcatgatgcta

SEQ ID NO: 1031954 - DNA, 22 bp, Artificial Sequence
  chemically synthesized
gtagttggatttccaaatagca

SEQ ID NO: 1031955 - DNA, 22 bp, Artificial Sequence
  chemically synthesized
ggtagttggatttccaaatagc

SEQ ID NO: 1031956 - DNA, 22 bp, Artificial Sequence
  chemically synthesized
agcacacttggtagttggattt

SEQ ID NO: 1031957 - DNA, 22 bp, Artificial Sequence
  chemically synthesized
cagcacacttggtagttggatt

SEQ ID NO: 1031958 - DNA, 22 bp, Artificial Sequence
  chemically synthesized
tgcttcagcacacttggtagtt

SEQ ID NO: 1031959 - DNA, 22 bp, Artificial Sequence
  chemically synthesized
tttggaaatccaactaccaagt

SEQ ID NO: 1031960 - DNA, 22 bp, Artificial Sequence
  chemically synthesized
gtgcttcagcacacttggtagt

SEQ ID NO: 1031961 - DNA, 22 bp, Artificial Sequence
  chemically synthesized
ggaaatccaactaccaagtgtg

SEQ ID NO: 1031962 - DNA, 22 bp, Artificial Sequence
  chemically synthesized
cttgtgcttcagcacacttggt

SEQ ID NO: 1031963 - DNA, 22 bp, Artificial Sequence
  chemically synthesized
gaaatccaactaccaagtgtgc

SEQ ID NO: 1031964 - DNA, 22 bp, Artificial Sequence
  chemically synthesized
agaatctccttgtgcttcagca

SEQ ID NO: 1031965 - DNA, 22 bp, Artificial Sequence
  chemically synthesized
gagaatctccttgtgcttcagc

SEQ ID NO: 1031966 - DNA, 22 bp, Artificial Sequence
  chemically synthesized
ccaagtgtgctgaagcacaagg

SEQ ID NO: 1031967 - DNA, 22 bp, Artificial Sequence
  chemically synthesized
acttgagaatctccttgtgctt

SEQ ID NO: 1031968 - DNA, 22 bp, Artificial Sequence
  chemically synthesized
ctgacttgagaatctccttgtg

SEQ ID NO: 1031969 - DNA, 22 bp, Artificial Sequence
  chemically synthesized
actgacttgagaatctccttgt

SEQ ID NO: 1031970 - DNA, 22 bp, Artificial Sequence
  chemically synthesized
tttactgacttgagaatctcct

SEQ ID NO: 1031971 - DNA, 22 bp, Artificial Sequence
  chemically synthesized
ttatttactgacttgagaatct

SEQ ID NO: 1031972 - DNA, 22 bp, Artificial Sequence
  chemically synthesized
attatttactgacttgagaatc

SEQ ID NO: 1031973 - DNA, 22 bp, Artificial Sequence
  chemically synthesized
aagcacaaggagattctcaagt

SEQ ID NO: 1031974 - DNA, 22 bp, Artificial Sequence
  chemically synthesized
tattatttactgacttgagaat

SEQ ID NO: 1031975 - DNA, 22 bp, Artificial Sequence
  chemically synthesized
agtcacaattttattatttact

SEQ ID NO: 1031976 - DNA, 22 bp, Artificial Sequence
  chemically synthesized
aagtcacaattttattatttac

SEQ ID NO: 1031977 - DNA, 22 bp, Artificial Sequence
  chemically synthesized
taagtcacaattttattattta

SEQ ID NO: 1031978 - DNA, 22 bp, Artificial Sequence
  chemically synthesized
tcaagtcagtaaataataaaat

SEQ ID NO: 1031979 - DNA, 22 bp, Artificial Sequence
  chemically synthesized
aagtcagtaaataataaaattg

SEQ ID NO: 1031980 - DNA, 22 bp, Artificial Sequence
  chemically synthesized
aaacaaactttaagtcacaatt

SEQ ID NO: 1031981 - DNA, 22 bp, Artificial Sequence
  chemically synthesized
taaaaatagaatactgaaacaa

SEQ ID NO: 1031982 - DNA, 22 bp, Artificial Sequence
  chemically synthesized
tgacttaaagtttgtttcagta

SEQ ID NO: 1031983 - DNA, 22 bp, Artificial Sequence
  chemically synthesized
aaagtttgtttcagtattctat

SEQ ID NO: 1031984 - DNA, 22 bp, Artificial Sequence
  chemically synthesized
aagtttgtttcagtattctatt

SEQ ID NO: 1031985 - DNA, 22 bp, Artificial Sequence
  chemically synthesized
atgccccctgtaaaaatagaat

SEQ ID NO: 1031986 - DNA, 22 bp, Artificial Sequence
  chemically synthesized
gtttcagtattctatttttaca

SEQ ID NO: 1031987 - DNA, 22 bp, Artificial Sequence
  chemically synthesized
tttcagtattctatttttacag

SEQ ID NO: 1031988 - DNA, 22 bp, Artificial Sequence
  chemically synthesized
cagtattctatttttacagggg

SEQ ID NO: 1031989 - DNA, 22 bp, Artificial Sequence
  chemically synthesized
agtattctatttttacaggggg

SEQ ID NO: 1031990 - DNA, 22 bp, Artificial Sequence
  chemically synthesized
taaagcataaagttaatgcccc

SEQ ID NO: 1031991 - DNA, 22 bp, Artificial Sequence
  chemically synthesized
tatttttacagggggcattaac

SEQ ID NO: 1031992 - DNA, 22 bp, Artificial Sequence
  chemically synthesized
tttttacagggggcattaactt

SEQ ID NO: 1031993 - DNA, 22 bp, Artificial Sequence
  chemically synthesized
ttacagggggcattaactttat

SEQ ID NO: 1031994 - DNA, 22 bp, Artificial Sequence
  chemically synthesized
tacagggggcattaactttatg

SEQ ID NO: 1031995 - DNA, 22 bp, Artificial Sequence
  chemically synthesized
acagggggcattaactttatgc

SEQ ID NO: 1031996 - DNA, 22 bp, Artificial Sequence
  chemically synthesized
cagggggcattaactttatgct

SEQ ID NO: 1031997 - DNA, 22 bp, Artificial Sequence
  chemically synthesized
cccagaaaagtaatattataaa

SEQ ID NO: 1031998 - DNA, 22 bp, Artificial Sequence
  chemically synthesized
acccagaaaagtaatattataa

SEQ ID NO: 1031999 - DNA, 22 bp, Artificial Sequence
  chemically synthesized
tacccagaaaagtaatattata

SEQ ID NO: 1032000 - DNA, 22 bp, Artificial Sequence
  chemically synthesized
actttatgctttataatattac

SEQ ID NO: 1032001 - DNA, 22 bp, Artificial Sequence
  chemically synthesized
ttttacccagaaaagtaatatt

SEQ ID NO: 1032002 - DNA, 22 bp, Artificial Sequence
  chemically synthesized
attttacccagaaaagtaatat

SEQ ID NO: 1032003 - DNA, 22 bp, Artificial Sequence
  chemically synthesized
tatgctttataatattactttt

SEQ ID NO: 1032004 - DNA, 22 bp, Artificial Sequence
  chemically synthesized
tattttacccagaaaagtaata

SEQ ID NO: 1032005 - DNA, 22 bp, Artificial Sequence
  chemically synthesized
atgctttataatattacttttc

SEQ ID NO: 1032006 - DNA, 22 bp, Artificial Sequence
  chemically synthesized
ttattttacccagaaaagtaat

SEQ ID NO: 1032007 - DNA, 22 bp, Artificial Sequence
  chemically synthesized
tgctttataatattacttttct

SEQ ID NO: 1032008 - DNA, 22 bp, Artificial Sequence
  chemically synthesized
tataatattacttttctgggta

SEQ ID NO: 1032009 - DNA, 22 bp, Artificial Sequence
  chemically synthesized
ataatattacttttctgggtaa

SEQ ID NO: 1032010 - DNA, 22 bp, Artificial Sequence
  chemically synthesized
taatattacttttctgggtaaa

SEQ ID NO: 1032011 - DNA, 22 bp, Artificial Sequence
  chemically synthesized
gggtacttttattttacccaga

SEQ ID NO: 1032012 - DNA, 22 bp, Artificial Sequence
  chemically synthesized
cttttctgggtaaaataaaagt

SEQ ID NO: 1032013 - DNA, 22 bp, Artificial Sequence
  chemically synthesized
aatgtgttggggtacttttatt

SEQ ID NO: 1032014 - DNA, 22 bp, Artificial Sequence
  chemically synthesized
ttctgggtaaaataaaagtacc

SEQ ID NO: 1032015 - DNA, 22 bp, Artificial Sequence
  chemically synthesized
tctgggtaaaataaaagtaccc

SEQ ID NO: 1032016 - DNA, 22 bp, Artificial Sequence
  chemically synthesized
ctgggtaaaataaaagtacccc

SEQ ID NO: 1032017 - DNA, 22 bp, Artificial Sequence
  chemically synthesized
attcaatgtgttggggtacttt

SEQ ID NO: 1032018 - DNA, 22 bp, Artificial Sequence
  chemically synthesized
tgggtaaaataaaagtacccca

SEQ ID NO: 1032019 - DNA, 22 bp, Artificial Sequence
  chemically synthesized
taattcaatgtgttggggtact

SEQ ID NO: 1032020 - DNA, 22 bp, Artificial Sequence
  chemically synthesized
ggtaaaataaaagtaccccaac

SEQ ID NO: 1032021 - DNA, 22 bp, Artificial Sequence
  chemically synthesized
ctaattcaatgtgttggggtac

SEQ ID NO: 1032022 - DNA, 22 bp, Artificial Sequence
  chemically synthesized
tctaattcaatgtgttggggta

SEQ ID NO: 1032023 - DNA, 22 bp, Artificial Sequence
  chemically synthesized
tttctaattcaatgtgttgggg

SEQ ID NO: 1032024 - DNA, 22 bp, Artificial Sequence
  chemically synthesized
ctttctaattcaatgtgttggg

SEQ ID NO: 1032025 - DNA, 22 bp, Artificial Sequence
  chemically synthesized
tctttctaattcaatgtgttgg

SEQ ID NO: 1032026 - DNA, 22 bp, Artificial Sequence
  chemically synthesized
acaagttttctttctaattcaa

SEQ ID NO: 1032027 - DNA, 22 bp, Artificial Sequence
  chemically synthesized
cacaagttttctttctaattca

SEQ ID NO: 1032028 - DNA, 22 bp, Artificial Sequence
  chemically synthesized
tcacaagttttctttctaattc

SEQ ID NO: 1032029 - DNA, 22 bp, Artificial Sequence
  chemically synthesized
ttcacaagttttctttctaatt

SEQ ID NO: 1032030 - DNA, 22 bp, Artificial Sequence
  chemically synthesized
tttcacaagttttctttctaat

SEQ ID NO: 1032031 - DNA, 22 bp, Artificial Sequence
  chemically synthesized
aatccattttttcacaagtttt

SEQ ID NO: 1032032 - DNA, 22 bp, Artificial Sequence
  chemically synthesized
aattagaaagaaaacttgtgaa

SEQ ID NO: 1032033 - DNA, 22 bp, Artificial Sequence
  chemically synthesized
tgaatccattttttcacaagtt

SEQ ID NO: 1032034 - DNA, 22 bp, Artificial Sequence
  chemically synthesized
gaaagaaaacttgtgaaaaaat

SEQ ID NO: 1032035 - DNA, 22 bp, Artificial Sequence
  chemically synthesized
gaaaggtattctgaatccattt

SEQ ID NO: 1032036 - DNA, 22 bp, Artificial Sequence
  chemically synthesized
ggaaaggtattctgaatccatt

SEQ ID NO: 1032037 - DNA, 22 bp, Artificial Sequence
  chemically synthesized
gtgaaaaaatggattcagaata

SEQ ID NO: 1032038 - DNA, 22 bp, Artificial Sequence
  chemically synthesized
tgaaaaaatggattcagaatac

SEQ ID NO: 1032039 - DNA, 22 bp, Artificial Sequence
  chemically synthesized
atcccacttggaaaggtattct

SEQ ID NO: 1032040 - DNA, 22 bp, Artificial Sequence
  chemically synthesized
ttgatcccacttggaaaggtat

SEQ ID NO: 1032041 - DNA, 22 bp, Artificial Sequence
  chemically synthesized
gttgatcccacttggaaaggta

SEQ ID NO: 1032042 - DNA, 22 bp, Artificial Sequence
  chemically synthesized
caatttgttgatcccacttgga

SEQ ID NO: 1032043 - DNA, 22 bp, Artificial Sequence
  chemically synthesized
acaatttgttgatcccacttgg

SEQ ID NO: 1032044 - DNA, 22 bp, Artificial Sequence
  chemically synthesized
agaatacctttccaagtgggat

SEQ ID NO: 1032045 - DNA, 22 bp, Artificial Sequence
  chemically synthesized
tccaagtgggatcaacaaattg

SEQ ID NO: 1032046 - DNA, 22 bp, Artificial Sequence
  chemically synthesized
ccaagtgggatcaacaaattgt

SEQ ID NO: 1032047 - DNA, 22 bp, Artificial Sequence
  chemically synthesized
caagtgggatcaacaaattgta

SEQ ID NO: 1032048 - DNA, 22 bp, Artificial Sequence
  chemically synthesized
gaaagcccaacttacaatttgt

SEQ ID NO: 1032049 - DNA, 22 bp, Artificial Sequence
  chemically synthesized
ttagaaagcccaacttacaatt

SEQ ID NO: 1032050 - DNA, 22 bp, Artificial Sequence
  chemically synthesized
tgttagaaagcccaacttacaa

SEQ ID NO: 1032051 - DNA, 22 bp, Artificial Sequence
  chemically synthesized
taagttgggctttctaacagag

SEQ ID NO: 1032052 - DNA, 22 bp, Artificial Sequence
  chemically synthesized
ataaaacacagacaactctgtt

SEQ ID NO: 1032053 - DNA, 22 bp, Artificial Sequence
  chemically synthesized
gataaaacacagacaactctgt

SEQ ID NO: 1032054 - DNA, 22 bp, Artificial Sequence
  chemically synthesized
tgataaaacacagacaactctg

SEQ ID NO: 1032055 - DNA, 22 bp, Artificial Sequence
  chemically synthesized
ttgataaaacacagacaactct

SEQ ID NO: 1032056 - DNA, 22 bp, Artificial Sequence
  chemically synthesized
ggctttctaacagagttgtctg

SEQ ID NO: 1032057 - DNA, 22 bp, Artificial Sequence
  chemically synthesized
tctaacagagttgtctgtgttt

SEQ ID NO: 1032058 - DNA, 22 bp, Artificial Sequence
  chemically synthesized
ctaacagagttgtctgtgtttt

SEQ ID NO: 1032059 - DNA, 22 bp, Artificial Sequence
  chemically synthesized
aacatttttgataaaacacaga

SEQ ID NO: 1032060 - DNA, 22 bp, Artificial Sequence
  chemically synthesized
taacagagttgtctgtgtttta

SEQ ID NO: 1032061 - DNA, 22 bp, Artificial Sequence
  chemically synthesized
acagagttgtctgtgttttatc

SEQ ID NO: 1032062 - DNA, 22 bp, Artificial Sequence
  chemically synthesized
attaaacatttttgataaaaca

SEQ ID NO: 1032063 - DNA, 22 bp, Artificial Sequence
  chemically synthesized
tctgtgttttatcaaaaatgtt

SEQ ID NO: 1032064 - DNA, 22 bp, Artificial Sequence
  chemically synthesized
cagtattaattaaacatttttg

SEQ ID NO: 1032065 - DNA, 22 bp, Artificial Sequence
  chemically synthesized
ttacagtattaattaaacattt

SEQ ID NO: 1032066 - DNA, 22 bp, Artificial Sequence
  chemically synthesized
tgttttatcaaaaatgtttaat

SEQ ID NO: 1032067 - DNA, 22 bp, Artificial Sequence
  chemically synthesized
attacagtattaattaaacatt

SEQ ID NO: 1032068 - DNA, 22 bp, Artificial Sequence
  chemically synthesized
tattacagtattaattaaacat

SEQ ID NO: 1032069 - DNA, 22 bp, Artificial Sequence
  chemically synthesized
tatcaaaaatgtttaattaata

SEQ ID NO: 1032070 - DNA, 22 bp, Artificial Sequence
  chemically synthesized
atcaaaaatgtttaattaatac

SEQ ID NO: 1032071 - DNA, 22 bp, Artificial Sequence
  chemically synthesized
tcaaaaatgtttaattaatact

SEQ ID NO: 1032072 - DNA, 22 bp, Artificial Sequence
  chemically synthesized
gtagaattttattacagtatta

SEQ ID NO: 1032073 - DNA, 22 bp, Artificial Sequence
  chemically synthesized
tagtagaattttattacagtat

SEQ ID NO: 1032074 - DNA, 22 bp, Artificial Sequence
  chemically synthesized
aattaatactgtaataaaattc

SEQ ID NO: 1032075 - DNA, 22 bp, Artificial Sequence
  chemically synthesized
attaatactgtaataaaattct

SEQ ID NO: 1032076 - DNA, 22 bp, Artificial Sequence
  chemically synthesized
atactgtaataaaattctacta

SEQ ID NO: 1032077 - DNA, 22 bp, Artificial Sequence
  chemically synthesized
aaataccacaccattctagtag

SEQ ID NO: 1032078 - DNA, 22 bp, Artificial Sequence
  chemically synthesized
gaaataccacaccattctagta

SEQ ID NO: 1032079 - DNA, 22 bp, Artificial Sequence
  chemically synthesized
taataaaattctactagaatgg

SEQ ID NO: 1032080 - DNA, 22 bp, Artificial Sequence
  chemically synthesized
caacttgaaataccacaccatt

SEQ ID NO: 1032081 - DNA, 22 bp, Artificial Sequence
  chemically synthesized
gcaacttgaaataccacaccat

SEQ ID NO: 1032082 - DNA, 22 bp, Artificial Sequence
  chemically synthesized
tactagaatggtgtggtatttc

SEQ ID NO: 1032083 - DNA, 22 bp, Artificial Sequence
  chemically synthesized
agacttgcaacttgaaatacca

SEQ ID NO: 1032084 - DNA, 22 bp, Artificial Sequence
  chemically synthesized
ctagaatggtgtggtatttcaa

SEQ ID NO: 1032085 - DNA, 22 bp, Artificial Sequence
  chemically synthesized
gaatggtgtggtatttcaagtt

SEQ ID NO: 1032086 - DNA, 22 bp, Artificial Sequence
  chemically synthesized
caaaacagaactgagacttgca

SEQ ID NO: 1032087 - DNA, 22 bp, Artificial Sequence
  chemically synthesized
ctacaaaacagaactgagactt

SEQ ID NO: 1032088 - DNA, 22 bp, Artificial Sequence
  chemically synthesized
caagttgcaagtctcagttctg

SEQ ID NO: 1032089 - DNA, 22 bp, Artificial Sequence
  chemically synthesized
aagttgcaagtctcagttctgt

SEQ ID NO: 1032090 - DNA, 22 bp, Artificial Sequence
  chemically synthesized
caagtctcagttctgttttgta

SEQ ID NO: 1032091 - DNA, 22 bp, Artificial Sequence
  chemically synthesized
agttctgttttgtagtagtgtt

SEQ ID NO: 1032092 - DNA, 22 bp, Artificial Sequence
  chemically synthesized
aagagtgtgggtgtataacact

SEQ ID NO: 1032093 - DNA, 22 bp, Artificial Sequence
  chemically synthesized
tgttttgtagtagtgttataca

SEQ ID NO: 1032094 - DNA, 22 bp, Artificial Sequence
  chemically synthesized
caagagtgtgggtgtataacac

SEQ ID NO: 1032095 - DNA, 22 bp, Artificial Sequence
  chemically synthesized
ttttgtagtagtgttatacacc

SEQ ID NO: 1032096 - DNA, 22 bp, Artificial Sequence
  chemically synthesized
tgtagtagtgttatacacccac

SEQ ID NO: 1032097 - DNA, 22 bp, Artificial Sequence
  chemically synthesized
gtagtagtgttatacacccaca

SEQ ID NO: 1032098 - DNA, 22 bp, Artificial Sequence
  chemically synthesized
tagtagtgttatacacccacac

SEQ ID NO: 1032099 - DNA, 22 bp, Artificial Sequence
  chemically synthesized
gtgaacccatttcaagagtgtg

SEQ ID NO: 1032100 - DNA, 22 bp, Artificial Sequence
  chemically synthesized
tacacccacactcttgaaatgg

SEQ ID NO: 1032101 - DNA, 22 bp, Artificial Sequence
  chemically synthesized
gcagttagtgaacccatttcaa

SEQ ID NO: 1032102 - DNA, 22 bp, Artificial Sequence
  chemically synthesized
ggcagttagtgaacccatttca

SEQ ID NO: 1032103 - DNA, 22 bp, Artificial Sequence
  chemically synthesized
ttgaaatgggttcactaactgc

SEQ ID NO: 1032104 - DNA, 22 bp, Artificial Sequence
  chemically synthesized
gaaatgggttcactaactgcca

SEQ ID NO: 1032105 - DNA, 22 bp, Artificial Sequence
  chemically synthesized
aaatgggttcactaactgccaa

SEQ ID NO: 1032106 - DNA, 22 bp, Artificial Sequence
  chemically synthesized
actaactgccaagtgtatttct

SEQ ID NO: 1032107 - DNA, 22 bp, Artificial Sequence
  chemically synthesized
actgccaagtgtatttctctat

SEQ ID NO: 1032108 - DNA, 22 bp, Artificial Sequence
  chemically synthesized
ccaagtgtatttctctatccct

SEQ ID NO: 1032109 - DNA, 22 bp, Artificial Sequence
  chemically synthesized
ctctatccctgatctttggata

SEQ ID NO: 1032110 - DNA, 22 bp, Artificial Sequence
  chemically synthesized
tctatccctgatctttggatat

SEQ ID NO: 1032111 - DNA, 22 bp, Artificial Sequence
  chemically synthesized
tatccctgatctttggatatgc

SEQ ID NO: 1032112 - DNA, 22 bp, Artificial Sequence
  chemically synthesized
tccctgatctttggatatgcca

SEQ ID NO: 1032113 - DNA, 22 bp, Artificial Sequence
  chemically synthesized
tcaaagcaagtcacgtggcata

SEQ ID NO: 1032114 - DNA, 22 bp, Artificial Sequence
  chemically synthesized
atctttggatatgccacgtgac

SEQ ID NO: 1032115 - DNA, 22 bp, Artificial Sequence
  chemically synthesized
tggatatgccacgtgacttgct

SEQ ID NO: 1032116 - DNA, 22 bp, Artificial Sequence
  chemically synthesized
ggatatgccacgtgacttgctt

SEQ ID NO: 1032117 - DNA, 22 bp, Artificial Sequence
  chemically synthesized
gatatgccacgtgacttgcttt

SEQ ID NO: 1032118 - DNA, 22 bp, Artificial Sequence
  chemically synthesized
catccatagtcaattgtcaaag

SEQ ID NO: 1032119 - DNA, 22 bp, Artificial Sequence
  chemically synthesized
ccatccatagtcaattgtcaaa

SEQ ID NO: 1032120 - DNA, 22 bp, Artificial Sequence
  chemically synthesized
ttccatccatagtcaattgtca

SEQ ID NO: 1032121 - DNA, 22 bp, Artificial Sequence
  chemically synthesized
tcttccatccatagtcaattgt

SEQ ID NO: 1032122 - DNA, 22 bp, Artificial Sequence
  chemically synthesized
tctcttccatccatagtcaatt

SEQ ID NO: 1032123 - DNA, 22 bp, Artificial Sequence
  chemically synthesized
gctttgacaattgactatggat

SEQ ID NO: 1032124 - DNA, 22 bp, Artificial Sequence
  chemically synthesized
ctttgacaattgactatggatg

SEQ ID NO: 1032125 - DNA, 22 bp, Artificial Sequence
  chemically synthesized
gcgttctctcttccatccatag

SEQ ID NO: 1032126 - DNA, 22 bp, Artificial Sequence
  chemically synthesized
tgacaattgactatggatggaa

SEQ ID NO: 1032127 - DNA, 22 bp, Artificial Sequence
  chemically synthesized
gacaattgactatggatggaag

SEQ ID NO: 1032128 - DNA, 22 bp, Artificial Sequence
  chemically synthesized
acaattgactatggatggaaga

SEQ ID NO: 1032129 - DNA, 22 bp, Artificial Sequence
  chemically synthesized
taactagcgttctctcttccat

SEQ ID NO: 1032130 - DNA, 22 bp, Artificial Sequence
  chemically synthesized
ataactagcgttctctcttcca

SEQ ID NO: 1032131 - DNA, 22 bp, Artificial Sequence
  chemically synthesized
actatggatggaagagagaacg

SEQ ID NO: 1032132 - DNA, 22 bp, Artificial Sequence
  chemically synthesized
tggatggaagagagaacgctag

SEQ ID NO: 1032133 - DNA, 22 bp, Artificial Sequence
  chemically synthesized
agacccagatttataactagcg

SEQ ID NO: 1032134 - DNA, 22 bp, Artificial Sequence
  chemically synthesized
aagacccagatttataactagc

SEQ ID NO: 1032135 - DNA, 22 bp, Artificial Sequence
  chemically synthesized
ttaagacccagatttataacta

SEQ ID NO: 1032136 - DNA, 22 bp, Artificial Sequence
  chemically synthesized
gttataaatctgggtcttaaga

SEQ ID NO: 1032137 - DNA, 22 bp, Artificial Sequence
  chemically synthesized
taaatctgggtcttaagaacca

SEQ ID NO: 1032138 - DNA, 22 bp, Artificial Sequence
  chemically synthesized
ggtcttaagaaccatcatgtgt

SEQ ID NO: 1032139 - DNA, 22 bp, Artificial Sequence
  chemically synthesized
agaagggtaagcagaaacacat

SEQ ID NO: 1032140 - DNA, 22 bp, Artificial Sequence
  chemically synthesized
aagaaccatcatgtgtttctgc

SEQ ID NO: 1032141 - DNA, 22 bp, Artificial Sequence
  chemically synthesized
agaaccatcatgtgtttctgct

SEQ ID NO: 1032142 - DNA, 22 bp, Artificial Sequence
  chemically synthesized
aagatctcagaagggtaagcag

SEQ ID NO: 1032143 - DNA, 22 bp, Artificial Sequence
  chemically synthesized
taaagatctcagaagggtaagc

SEQ ID NO: 1032144 - DNA, 22 bp, Artificial Sequence
  chemically synthesized
agttctaaagatctcagaaggg

SEQ ID NO: 1032145 - DNA, 22 bp, Artificial Sequence
  chemically synthesized
ctgcttacccttctgagatctt

SEQ ID NO: 1032146 - DNA, 22 bp, Artificial Sequence
  chemically synthesized
tgcttacccttctgagatcttt

SEQ ID NO: 1032147 - DNA, 22 bp, Artificial Sequence
  chemically synthesized
cttacccttctgagatctttag

SEQ ID NO: 1032148 - DNA, 22 bp, Artificial Sequence
  chemically synthesized
catggctgagttctaaagatct

SEQ ID NO: 1032149 - DNA, 22 bp, Artificial Sequence
  chemically synthesized
acccttctgagatctttagaac

SEQ ID NO: 1032150 - DNA, 22 bp, Artificial Sequence
  chemically synthesized
ctccatggctgagttctaaaga

SEQ ID NO: 1032151 - DNA, 22 bp, Artificial Sequence
  chemically synthesized
cccttctgagatctttagaact

SEQ ID NO: 1032152 - DNA, 22 bp, Artificial Sequence
  chemically synthesized
ctgagatctttagaactcagcc

SEQ ID NO: 1032153 - DNA, 22 bp, Artificial Sequence
  chemically synthesized
tgagatctttagaactcagcca

SEQ ID NO: 1032154 - DNA, 22 bp, Artificial Sequence
  chemically synthesized
agatctttagaactcagccatg

SEQ ID NO: 1032155 - DNA, 22 bp, Artificial Sequence
  chemically synthesized
gggcacattcctccatggctga

SEQ ID NO: 1032156 - DNA, 22 bp, Artificial Sequence
  chemically synthesized
ggggcacattcctccatggctg

SEQ ID NO: 1032157 - DNA, 22 bp, Artificial Sequence
  chemically synthesized
tagaactcagccatggaggaat

SEQ ID NO: 1032158 - DNA, 22 bp, Artificial Sequence
  chemically synthesized
agaactcagccatggaggaatg

SEQ ID NO: 1032159 - DNA, 22 bp, Artificial Sequence
  chemically synthesized
gaactcagccatggaggaatgt

SEQ ID NO: 1032160 - DNA, 22 bp, Artificial Sequence
  chemically synthesized
agccatggaggaatgtgcccca

SEQ ID NO: 1032161 - DNA, 22 bp, Artificial Sequence
  chemically synthesized
gaatggcagtagatatttgggg

SEQ ID NO: 1032162 - DNA, 22 bp, Artificial Sequence
  chemically synthesized
aagctggaatggcagtagatat

SEQ ID NO: 1032163 - DNA, 22 bp, Artificial Sequence
  chemically synthesized
gggctcaagctggaatggcagt

SEQ ID NO: 1032164 - DNA, 22 bp, Artificial Sequence
  chemically synthesized
tggggctcaagctggaatggca

SEQ ID NO: 1032165 - DNA, 22 bp, Artificial Sequence
  chemically synthesized
attctggggctcaagctggaat

SEQ ID NO: 1032166 - DNA, 22 bp, Artificial Sequence
  chemically synthesized
ctgccattccagcttgagcccc

SEQ ID NO: 1032167 - DNA, 22 bp, Artificial Sequence
  chemically synthesized
tgtgtctcattctggggctcaa

SEQ ID NO: 1032168 - DNA, 22 bp, Artificial Sequence
  chemically synthesized
ccattccagcttgagccccaga

SEQ ID NO: 1032169 - DNA, 22 bp, Artificial Sequence
  chemically synthesized
atctatgtgtctcattctgggg

SEQ ID NO: 1032170 - DNA, 22 bp, Artificial Sequence
  chemically synthesized
cagcttgagccccagaatgaga

SEQ ID NO: 1032171 - DNA, 22 bp, Artificial Sequence
  chemically synthesized
gagccccagaatgagacacata

SEQ ID NO: 1032172 - DNA, 22 bp, Artificial Sequence
  chemically synthesized
agccccagaatgagacacatag

SEQ ID NO: 1032173 - DNA, 22 bp, Artificial Sequence
  chemically synthesized
accaaacatgtctgatctatgt

SEQ ID NO: 1032174 - DNA, 22 bp, Artificial Sequence
  chemically synthesized
taggttgaccaaacatgtctga

SEQ ID NO: 1032175 - DNA, 22 bp, Artificial Sequence
  chemically synthesized
actgtaggttgaccaaacatgt

SEQ ID NO: 1032176 - DNA, 22 bp, Artificial Sequence
  chemically synthesized
agaatctgactgtaggttgacc

SEQ ID NO: 1032177 - DNA, 22 bp, Artificial Sequence
  chemically synthesized
attcagaatctgactgtaggtt

SEQ ID NO: 1032178 - DNA, 22 bp, Artificial Sequence
  chemically synthesized
tgattcagaatctgactgtagg

SEQ ID NO: 1032179 - DNA, 22 bp, Artificial Sequence
  chemically synthesized
ggtcaacctacagtcagattct

SEQ ID NO: 1032180 - DNA, 22 bp, Artificial Sequence
  chemically synthesized
gtcaacctacagtcagattctg

SEQ ID NO: 1032181 - DNA, 22 bp, Artificial Sequence
  chemically synthesized
agtaatctctgattcagaatct

SEQ ID NO: 1032182 - DNA, 22 bp, Artificial Sequence
  chemically synthesized
gagtaatctctgattcagaatc

SEQ ID NO: 1032183 - DNA, 22 bp, Artificial Sequence
  chemically synthesized
tgagtaatctctgattcagaat

SEQ ID NO: 1032184 - DNA, 22 bp, Artificial Sequence
  chemically synthesized
ctttgagtaatctctgattcag

SEQ ID NO: 1032185 - DNA, 22 bp, Artificial Sequence
  chemically synthesized
cagtcagattctgaatcagaga

SEQ ID NO: 1032186 - DNA, 22 bp, Artificial Sequence
  chemically synthesized
acaggcctactttgagtaatct

SEQ ID NO: 1032187 - DNA, 22 bp, Artificial Sequence
  chemically synthesized
tgaatcagagattactcaaagt

SEQ ID NO: 1032188 - DNA, 22 bp, Artificial Sequence
  chemically synthesized
aatcagagattactcaaagtag

SEQ ID NO: 1032189 - DNA, 22 bp, Artificial Sequence
  chemically synthesized
atattcacaggcctactttgag

SEQ ID NO: 1032190 - DNA, 22 bp, Artificial Sequence
  chemically synthesized
tcctcatattcacaggcctact

SEQ ID NO: 1032191 - DNA, 22 bp, Artificial Sequence
  chemically synthesized
atcctcatattcacaggcctac

SEQ ID NO: 1032192 - DNA, 22 bp, Artificial Sequence
  chemically synthesized
ctcaaagtaggcctgtgaatat

SEQ ID NO: 1032193 - DNA, 22 bp, Artificial Sequence
  chemically synthesized
aaagtaggcctgtgaatatgag

SEQ ID NO: 1032194 - DNA, 22 bp, Artificial Sequence
  chemically synthesized
tgaatatgaggataagtgctta

SEQ ID NO: 1032195 - DNA, 22 bp, Artificial Sequence
  chemically synthesized
tgtgacaagcataccccaaaag

SEQ ID NO: 1032196 - DNA, 22 bp, Artificial Sequence
  chemically synthesized
attgttcttttggggtatgctt

SEQ ID NO: 1032197 - DNA, 22 bp, Artificial Sequence
  chemically synthesized
ttgttcttttggggtatgcttg

SEQ ID NO: 1032198 - DNA, 22 bp, Artificial Sequence
  chemically synthesized
ttcttttggggtatgcttgtca

SEQ ID NO: 1032199 - DNA, 22 bp, Artificial Sequence
  chemically synthesized
ttttggggtatgcttgtcacac

SEQ ID NO: 1032200 - DNA, 22 bp, Artificial Sequence
  chemically synthesized
ttggggtatgcttgtcacacag

SEQ ID NO: 1032201 - DNA, 22 bp, Artificial Sequence
  chemically synthesized
tggggtatgcttgtcacacagc

SEQ ID NO: 1032202 - DNA, 22 bp, Artificial Sequence
  chemically synthesized
ggggtatgcttgtcacacagca

SEQ ID NO: 1032203 - DNA, 22 bp, Artificial Sequence
  chemically synthesized
caaccacaataatgctgtgtga

SEQ ID NO: 1032204 - DNA, 22 bp, Artificial Sequence
  chemically synthesized
gggtatgcttgtcacacagcat

SEQ ID NO: 1032205 - DNA, 22 bp, Artificial Sequence
  chemically synthesized
gtcagctacaaccacaataatg

SEQ ID NO: 1032206 - DNA, 22 bp, Artificial Sequence
  chemically synthesized
gtcacacagcattattgtggtt

SEQ ID NO: 1032207 - DNA, 22 bp, Artificial Sequence
  chemically synthesized
tcacacagcattattgtggttg

SEQ ID NO: 1032208 - DNA, 22 bp, Artificial Sequence
  chemically synthesized
ttgtggttgtagctgactaata

SEQ ID NO: 1032209 - DNA, 22 bp, Artificial Sequence
  chemically synthesized
tggttgtagctgactaatattg

SEQ ID NO: 1032210 - DNA, 22 bp, Artificial Sequence
  chemically synthesized
accaaagtcaatcaatattagt

SEQ ID NO: 1032211 - DNA, 22 bp, Artificial Sequence
  chemically synthesized
tagctgactaatattgattgac

SEQ ID NO: 1032212 - DNA, 22 bp, Artificial Sequence
  chemically synthesized
ggccctcaccaaagtcaatcaa

SEQ ID NO: 1032213 - DNA, 22 bp, Artificial Sequence
  chemically synthesized
ttgggccctcaccaaagtcaat

SEQ ID NO: 1032214 - DNA, 22 bp, Artificial Sequence
  chemically synthesized
attgggccctcaccaaagtcaa

SEQ ID NO: 1032215 - DNA, 22 bp, Artificial Sequence
  chemically synthesized
actaatattgattgactttggt

SEQ ID NO: 1032216 - DNA, 22 bp, Artificial Sequence
  chemically synthesized
tttattgggccctcaccaaagt

SEQ ID NO: 1032217 - DNA, 22 bp, Artificial Sequence
  chemically synthesized
atattgattgactttggtgagg

SEQ ID NO: 1032218 - DNA, 22 bp, Artificial Sequence
  chemically synthesized
attgactttggtgagggcccaa

SEQ ID NO: 1032219 - DNA, 22 bp, Artificial Sequence
  chemically synthesized
actttggtgagggcccaataaa

SEQ ID NO: 1032220 - DNA, 22 bp, Artificial Sequence
  chemically synthesized
tggtgagggcccaataaacagc

SEQ ID NO: 1032221 - DNA, 22 bp, Artificial Sequence
  chemically synthesized
ggtgagggcccaataaacagct

SEQ ID NO: 1032222 - DNA, 22 bp, Artificial Sequence
  chemically synthesized
gtgagggcccaataaacagcta

SEQ ID NO: 1032223 - DNA, 22 bp, Artificial Sequence
  chemically synthesized
agtaatgtaggagtgacccaag

SEQ ID NO: 1032224 - DNA, 22 bp, Artificial Sequence
  chemically synthesized
tcagtaatgtaggagtgaccca

SEQ ID NO: 1032225 - DNA, 22 bp, Artificial Sequence
  chemically synthesized
tctctcagtaatgtaggagtga

SEQ ID NO: 1032226 - DNA, 22 bp, Artificial Sequence
  chemically synthesized
ccttgggtcactcctacattac

SEQ ID NO: 1032227 - DNA, 22 bp, Artificial Sequence
  chemically synthesized
ccctatctctcagtaatgtagg

SEQ ID NO: 1032228 - DNA, 22 bp, Artificial Sequence
  chemically synthesized
cccctatctctcagtaatgtag

SEQ ID NO: 1032229 - DNA, 22 bp, Artificial Sequence
  chemically synthesized
tcccctatctctcagtaatgta

SEQ ID NO: 1032230 - DNA, 22 bp, Artificial Sequence
  chemically synthesized
gggtcactcctacattactgag

SEQ ID NO: 1032231 - DNA, 22 bp, Artificial Sequence
  chemically synthesized
tttcccctatctctcagtaatg

SEQ ID NO: 1032232 - DNA, 22 bp, Artificial Sequence
  chemically synthesized
ggtcactcctacattactgaga

SEQ ID NO: 1032233 - DNA, 22 bp, Artificial Sequence
  chemically synthesized
ctttcccctatctctcagtaat

SEQ ID NO: 1032234 - DNA, 22 bp, Artificial Sequence
  chemically synthesized
tctttcccctatctctcagtaa

SEQ ID NO: 1032235 - DNA, 22 bp, Artificial Sequence
  chemically synthesized
attttctttcccctatctctca

SEQ ID NO: 1032236 - DNA, 22 bp, Artificial Sequence
  chemically synthesized
ctacattactgagagatagggg

SEQ ID NO: 1032237 - DNA, 22 bp, Artificial Sequence
  chemically synthesized
tctcattttctttcccctatct

SEQ ID NO: 1032238 - DNA, 22 bp, Artificial Sequence
  chemically synthesized
atctcattttctttcccctatc

SEQ ID NO: 1032239 - DNA, 22 bp, Artificial Sequence
  chemically synthesized
cattactgagagataggggaaa

SEQ ID NO: 1032240 - DNA, 22 bp, Artificial Sequence
  chemically synthesized
tatctcattttctttcccctat

SEQ ID NO: 1032241 - DNA, 22 bp, Artificial Sequence
  chemically synthesized
ttatctcattttctttccccta

SEQ ID NO: 1032242 - DNA, 22 bp, Artificial Sequence
  chemically synthesized
tttttatctcattttctttccc

SEQ ID NO: 1032243 - DNA, 22 bp, Artificial Sequence
  chemically synthesized
ctgagagataggggaaagaaaa

SEQ ID NO: 1032244 - DNA, 22 bp, Artificial Sequence
  chemically synthesized
atttttatctcattttctttcc

SEQ ID NO: 1032245 - DNA, 22 bp, Artificial Sequence
  chemically synthesized
tatttttatctcattttctttc

SEQ ID NO: 1032246 - DNA, 22 bp, Artificial Sequence
  chemically synthesized
ttatttttatctcattttcttt

SEQ ID NO: 1032247 - DNA, 22 bp, Artificial Sequence
  chemically synthesized
agagataggggaaagaaaatga

SEQ ID NO: 1032248 - DNA, 22 bp, Artificial Sequence
  chemically synthesized
acttttatttttatctcatttt

SEQ ID NO: 1032249 - DNA, 22 bp, Artificial Sequence
  chemically synthesized
ataaggacgtagatgctaactt

SEQ ID NO: 1032250 - DNA, 22 bp, Artificial Sequence
  chemically synthesized
gcatctacgtccttatcaggat

SEQ ID NO: 1032251 - DNA, 22 bp, Artificial Sequence
  chemically synthesized
cataaaatagtagcatcctgat

SEQ ID NO: 1032252 - DNA, 22 bp, Artificial Sequence
  chemically synthesized
ccataaaatagtagcatcctga

SEQ ID NO: 1032253 - DNA, 22 bp, Artificial Sequence
  chemically synthesized
cgtccttatcaggatgctacta

SEQ ID NO: 1032254 - DNA, 22 bp, Artificial Sequence
  chemically synthesized
ggtaccttccataaaatagtag

SEQ ID NO: 1032255 - DNA, 22 bp, Artificial Sequence
  chemically synthesized
gggtaccttccataaaatagta

SEQ ID NO: 1032256 - DNA, 22 bp, Artificial Sequence
  chemically synthesized
tgggtaccttccataaaatagt

SEQ ID NO: 1032257 - DNA, 22 bp, Artificial Sequence
  chemically synthesized
atcaggatgctactattttatg

SEQ ID NO: 1032258 - DNA, 22 bp, Artificial Sequence
  chemically synthesized
tcaggatgctactattttatgg

SEQ ID NO: 1032259 - DNA, 22 bp, Artificial Sequence
  chemically synthesized
tttgggtaccttccataaaata

SEQ ID NO: 1032260 - DNA, 22 bp, Artificial Sequence
  chemically synthesized
ctttgggtaccttccataaaat

SEQ ID NO: 1032261 - DNA, 22 bp, Artificial Sequence
  chemically synthesized
gaatttctttgggtaccttcca

SEQ ID NO: 1032262 - DNA, 22 bp, Artificial Sequence
  chemically synthesized
tggaatttctttgggtaccttc

SEQ ID NO: 1032263 - DNA, 22 bp, Artificial Sequence
  chemically synthesized
ctattttatggaaggtacccaa

SEQ ID NO: 1032264 - DNA, 22 bp, Artificial Sequence
  chemically synthesized
ttttatggaaggtacccaaaga

SEQ ID NO: 1032265 - DNA, 22 bp, Artificial Sequence
  chemically synthesized
tatggaaggtacccaaagaaat

SEQ ID NO: 1032266 - DNA, 22 bp, Artificial Sequence
  chemically synthesized
atggaaggtacccaaagaaatt

SEQ ID NO: 1032267 - DNA, 22 bp, Artificial Sequence
  chemically synthesized
tggaaggtacccaaagaaattc

SEQ ID NO: 1032268 - DNA, 22 bp, Artificial Sequence
  chemically synthesized
gaatcatcagagatataattct

SEQ ID NO: 1032269 - DNA, 22 bp, Artificial Sequence
  chemically synthesized
ggaatcatcagagatataattc

SEQ ID NO: 1032270 - DNA, 22 bp, Artificial Sequence
  chemically synthesized
tggaatcatcagagatataatt

SEQ ID NO: 1032271 - DNA, 22 bp, Artificial Sequence
  chemically synthesized
cagaattatatctctgatgatt

SEQ ID NO: 1032272 - DNA, 22 bp, Artificial Sequence
  chemically synthesized
aaggaattttggaatcatcaga

SEQ ID NO: 1032273 - DNA, 22 bp, Artificial Sequence
  chemically synthesized
gaaggaattttggaatcatcag

SEQ ID NO: 1032274 - DNA, 22 bp, Artificial Sequence
  chemically synthesized
tgaaggaattttggaatcatca

SEQ ID NO: 1032275 - DNA, 22 bp, Artificial Sequence
  chemically synthesized
ttttgaaggaattttggaatca

SEQ ID NO: 1032276 - DNA, 22 bp, Artificial Sequence
  chemically synthesized
gttttgaaggaattttggaatc

SEQ ID NO: 1032277 - DNA, 22 bp, Artificial Sequence
  chemically synthesized
tgttttgaaggaattttggaat

SEQ ID NO: 1032278 - DNA, 22 bp, Artificial Sequence
  chemically synthesized
tatctctgatgattccaaaatt

SEQ ID NO: 1032279 - DNA, 22 bp, Artificial Sequence
  chemically synthesized
tgatgattccaaaattccttca

SEQ ID NO: 1032280 - DNA, 22 bp, Artificial Sequence
  chemically synthesized
tgtcctttgttttgaaggaatt

SEQ ID NO: 1032281 - DNA, 22 bp, Artificial Sequence
  chemically synthesized
atgattccaaaattccttcaaa

SEQ ID NO: 1032282 - DNA, 22 bp, Artificial Sequence
  chemically synthesized
caaaattccttcaaaacaaagg

SEQ ID NO: 1032283 - DNA, 22 bp, Artificial Sequence
  chemically synthesized
cttcaaaacaaaggacacagac

SEQ ID NO: 1032284 - DNA, 22 bp, Artificial Sequence
  chemically synthesized
caaaacaaaggacacagactgg

SEQ ID NO: 1032285 - DNA, 22 bp, Artificial Sequence
  chemically synthesized
aaaacaaaggacacagactgga

SEQ ID NO: 1032286 - DNA, 22 bp, Artificial Sequence
  chemically synthesized
aaaaccaaggatggtccagtct

SEQ ID NO: 1032287 - DNA, 22 bp, Artificial Sequence
  chemically synthesized
gaaaaccaaggatggtccagtc

SEQ ID NO: 1032288 - DNA, 22 bp, Artificial Sequence
  chemically synthesized
tagcatagtacttgaaaaccaa

SEQ ID NO: 1032289 - DNA, 22 bp, Artificial Sequence
  chemically synthesized
gaccatccttggttttcaagta

SEQ ID NO: 1032290 - DNA, 22 bp, Artificial Sequence
  chemically synthesized
aaaattatagcatagtacttga

SEQ ID NO: 1032291 - DNA, 22 bp, Artificial Sequence
  chemically synthesized
ggttttcaagtactatgctata

SEQ ID NO: 1032292 - DNA, 22 bp, Artificial Sequence
  chemically synthesized
gttttcaagtactatgctataa

SEQ ID NO: 1032293 - DNA, 22 bp, Artificial Sequence
  chemically synthesized
taatattcaaaattatagcata

SEQ ID NO: 1032294 - DNA, 22 bp, Artificial Sequence
  chemically synthesized
tgtaatattcaaaattatagca

SEQ ID NO: 1032295 - DNA, 22 bp, Artificial Sequence
  chemically synthesized
ctgtaatattcaaaattatagc

SEQ ID NO: 1032296 - DNA, 22 bp, Artificial Sequence
  chemically synthesized
tcaagtactatgctataatttt

SEQ ID NO: 1032297 - DNA, 22 bp, Artificial Sequence
  chemically synthesized
tctgtaatattcaaaattatag

SEQ ID NO: 1032298 - DNA, 22 bp, Artificial Sequence
  chemically synthesized
caagtactatgctataattttg

SEQ ID NO: 1032299 - DNA, 22 bp, Artificial Sequence
  chemically synthesized
aagtactatgctataattttga

SEQ ID NO: 1032300 - DNA, 22 bp, Artificial Sequence
  chemically synthesized
tctttctgtaatattcaaaatt

SEQ ID NO: 1032301 - DNA, 22 bp, Artificial Sequence
  chemically synthesized
gtctttctgtaatattcaaaat

SEQ ID NO: 1032302 - DNA, 22 bp, Artificial Sequence
  chemically synthesized
acttgtctttctgtaatattca

SEQ ID NO: 1032303 - DNA, 22 bp, Artificial Sequence
  chemically synthesized
tgctataattttgaatattaca

SEQ ID NO: 1032304 - DNA, 22 bp, Artificial Sequence
  chemically synthesized
cacttgtctttctgtaatattc

SEQ ID NO: 1032305 - DNA, 22 bp, Artificial Sequence
  chemically synthesized
tcacttgtctttctgtaatatt

SEQ ID NO: 1032306 - DNA, 22 bp, Artificial Sequence
  chemically synthesized
tttcacttgtctttctgtaata

SEQ ID NO: 1032307 - DNA, 22 bp, Artificial Sequence
  chemically synthesized
taattttgaatattacagaaag

SEQ ID NO: 1032308 - DNA, 22 bp, Artificial Sequence
  chemically synthesized
agttctttcacttgtctttctg

SEQ ID NO: 1032309 - DNA, 22 bp, Artificial Sequence
  chemically synthesized
cagttctttcacttgtctttct

SEQ ID NO: 1032310 - DNA, 22 bp, Artificial Sequence
  chemically synthesized
tgaatattacagaaagacaagt

SEQ ID NO: 1032311 - DNA, 22 bp, Artificial Sequence
  chemically synthesized
ttcagttctttcacttgtcttt

SEQ ID NO: 1032312 - DNA, 22 bp, Artificial Sequence
  chemically synthesized
gaatattacagaaagacaagtg

SEQ ID NO: 1032313 - DNA, 22 bp, Artificial Sequence
  chemically synthesized
cttcagttctttcacttgtctt

SEQ ID NO: 1032314 - DNA, 22 bp, Artificial Sequence
  chemically synthesized
aatattacagaaagacaagtga

SEQ ID NO: 1032315 - DNA, 22 bp, Artificial Sequence
  chemically synthesized
ttcttcagttctttcacttgtc

SEQ ID NO: 1032316 - DNA, 22 bp, Artificial Sequence
  chemically synthesized
cttcttcagttctttcacttgt

SEQ ID NO: 1032317 - DNA, 22 bp, Artificial Sequence
  chemically synthesized
gtttcttcttcagttctttcac

SEQ ID NO: 1032318 - DNA, 22 bp, Artificial Sequence
  chemically synthesized
cagaaagacaagtgaaagaact

SEQ ID NO: 1032319 - DNA, 22 bp, Artificial Sequence
  chemically synthesized
agtttcttcttcagttctttca

SEQ ID NO: 1032320 - DNA, 22 bp, Artificial Sequence
  chemically synthesized
tagtttcttcttcagttctttc

SEQ ID NO: 1032321 - DNA, 22 bp, Artificial Sequence
  chemically synthesized
ttagtttcttcttcagttcttt

SEQ ID NO: 1032322 - DNA, 22 bp, Artificial Sequence
  chemically synthesized
tttagtttcttcttcagttctt

SEQ ID NO: 1032323 - DNA, 22 bp, Artificial Sequence
  chemically synthesized
ttttagtttcttcttcagttct

SEQ ID NO: 1032324 - DNA, 22 bp, Artificial Sequence
  chemically synthesized
aaatgcttttttagtttcttct

SEQ ID NO: 1032325 - DNA, 22 bp, Artificial Sequence
  chemically synthesized
gaaatgcttttttagtttcttc

SEQ ID NO: 1032326 - DNA, 22 bp, Artificial Sequence
  chemically synthesized
tcttgaaatgcttttttagttt

SEQ ID NO: 1032327 - DNA, 22 bp, Artificial Sequence
  chemically synthesized
gtcttgaaatgcttttttagtt

SEQ ID NO: 1032328 - DNA, 22 bp, Artificial Sequence
  chemically synthesized
tttgtcttgaaatgctttttta

SEQ ID NO: 1032329 - DNA, 22 bp, Artificial Sequence
  chemically synthesized
aagaagaaactaaaaaagcatt

SEQ ID NO: 1032330 - DNA, 22 bp, Artificial Sequence
  chemically synthesized
tctgtttgtcttgaaatgcttt

SEQ ID NO: 1032331 - DNA, 22 bp, Artificial Sequence
  chemically synthesized
gtctgtttgtcttgaaatgctt

SEQ ID NO: 1032332 - DNA, 22 bp, Artificial Sequence
  chemically synthesized
tgtctgtttgtcttgaaatgct

SEQ ID NO: 1032333 - DNA, 22 bp, Artificial Sequence
  chemically synthesized
aaaaagcatttcaagacaaaca

SEQ ID NO: 1032334 - DNA, 22 bp, Artificial Sequence
  chemically synthesized
ataaaaaggcaaattttgtctg

SEQ ID NO: 1032335 - DNA, 22 bp, Artificial Sequence
  chemically synthesized
caagacaaacagacaaaatttg

SEQ ID NO: 1032336 - DNA, 22 bp, Artificial Sequence
  chemically synthesized
ttcataaaaaggcaaattttgt

SEQ ID NO: 1032337 - DNA, 22 bp, Artificial Sequence
  chemically synthesized
aagacaaacagacaaaatttgc

SEQ ID NO: 1032338 - DNA, 22 bp, Artificial Sequence
  chemically synthesized
gttcataaaaaggcaaattttg

SEQ ID NO: 1032339 - DNA, 22 bp, Artificial Sequence
  chemically synthesized
tgttcataaaaaggcaaatttt

SEQ ID NO: 1032340 - DNA, 22 bp, Artificial Sequence
  chemically synthesized
tctttgttcataaaaaggcaaa

SEQ ID NO: 1032341 - DNA, 22 bp, Artificial Sequence
  chemically synthesized
aactatctttgttcataaaaag

SEQ ID NO: 1032342 - DNA, 22 bp, Artificial Sequence
  chemically synthesized
aaactatctttgttcataaaaa

SEQ ID NO: 1032343 - DNA, 22 bp, Artificial Sequence
  chemically synthesized
gcctttttatgaacaaagatag

SEQ ID NO: 1032344 - DNA, 22 bp, Artificial Sequence
  chemically synthesized
aataaatttaaactatctttgt

SEQ ID NO: 1032345 - DNA, 22 bp, Artificial Sequence
  chemically synthesized
cctttttatgaacaaagatagt

SEQ ID NO: 1032346 - DNA, 22 bp, Artificial Sequence
  chemically synthesized
gaataaatttaaactatctttg

SEQ ID NO: 1032347 - DNA, 22 bp, Artificial Sequence
  chemically synthesized
tttatgaacaaagatagtttaa

SEQ ID NO: 1032348 - DNA, 22 bp, Artificial Sequence
  chemically synthesized
ttatgaacaaagatagtttaaa

SEQ ID NO: 1032349 - DNA, 22 bp, Artificial Sequence
  chemically synthesized
tatgaacaaagatagtttaaat

SEQ ID NO: 1032350 - DNA, 22 bp, Artificial Sequence
  chemically synthesized
atgaacaaagatagtttaaatt

SEQ ID NO: 1032351 - DNA, 22 bp, Artificial Sequence
  chemically synthesized
tatgtttgaataaatttaaact

SEQ ID NO: 1032352 - DNA, 22 bp, Artificial Sequence
  chemically synthesized
tgaacaaagatagtttaaattt

SEQ ID NO: 1032353 - DNA, 22 bp, Artificial Sequence
  chemically synthesized
atatgtttgaataaatttaaac

SEQ ID NO: 1032354 - DNA, 22 bp, Artificial Sequence
  chemically synthesized
agtaatttatatgtttgaataa

SEQ ID NO: 1032355 - DNA, 22 bp, Artificial Sequence
  chemically synthesized
gagtaatttatatgtttgaata

SEQ ID NO: 1032356 - DNA, 22 bp, Artificial Sequence
  chemically synthesized
tgagtaatttatatgtttgaat

SEQ ID NO: 1032357 - DNA, 22 bp, Artificial Sequence
  chemically synthesized
gcctttgagtaatttatatgtt

SEQ ID NO: 1032358 - DNA, 22 bp, Artificial Sequence
  chemically synthesized
aaatttattcaaacatataaat

SEQ ID NO: 1032359 - DNA, 22 bp, Artificial Sequence
  chemically synthesized
agcctttgagtaatttatatgt

SEQ ID NO: 1032360 - DNA, 22 bp, Artificial Sequence
  chemically synthesized
aatttattcaaacatataaatt

SEQ ID NO: 1032361 - DNA, 22 bp, Artificial Sequence
  chemically synthesized
ttagcctttgagtaatttatat

SEQ ID NO: 1032362 - DNA, 22 bp, Artificial Sequence
  chemically synthesized
attcaaacatataaattactca

SEQ ID NO: 1032363 - DNA, 22 bp, Artificial Sequence
  chemically synthesized
ttcaaacatataaattactcaa

SEQ ID NO: 1032364 - DNA, 22 bp, Artificial Sequence
  chemically synthesized
aaaattcttagcctttgagtaa

SEQ ID NO: 1032365 - DNA, 22 bp, Artificial Sequence
  chemically synthesized
aaacatataaattactcaaagg

SEQ ID NO: 1032366 - DNA, 22 bp, Artificial Sequence
  chemically synthesized
gaaaattcttagcctttgagta

SEQ ID NO: 1032367 - DNA, 22 bp, Artificial Sequence
  chemically synthesized
gatgcacatttgaaaattctta

SEQ ID NO: 1032368 - DNA, 22 bp, Artificial Sequence
  chemically synthesized
agatgcacatttgaaaattctt

SEQ ID NO: 1032369 - DNA, 22 bp, Artificial Sequence
  chemically synthesized
ctcaaaggctaagaattttcaa

SEQ ID NO: 1032370 - DNA, 22 bp, Artificial Sequence
  chemically synthesized
aaaggctaagaattttcaaatg

SEQ ID NO: 1032371 - DNA, 22 bp, Artificial Sequence
  chemically synthesized
agaattttcaaatgtgcatcta

SEQ ID NO: 1032372 - DNA, 22 bp, Artificial Sequence
  chemically synthesized
taggaaatgacaatttagatgc

SEQ ID NO: 1032373 - DNA, 22 bp, Artificial Sequence
  chemically synthesized
gtaggaaatgacaatttagatg

SEQ ID NO: 1032374 - DNA, 22 bp, Artificial Sequence
  chemically synthesized
tcaaatgtgcatctaaattgtc

SEQ ID NO: 1032375 - DNA, 22 bp, Artificial Sequence
  chemically synthesized
caaatgtgcatctaaattgtca

SEQ ID NO: 1032376 - DNA, 22 bp, Artificial Sequence
  chemically synthesized
aaatgtgcatctaaattgtcat

SEQ ID NO: 1032377 - DNA, 22 bp, Artificial Sequence
  chemically synthesized
gatacttgtaggaaatgacaat

SEQ ID NO: 1032378 - DNA, 22 bp, Artificial Sequence
  chemically synthesized
gtatggctagatacttgtagga

SEQ ID NO: 1032379 - DNA, 22 bp, Artificial Sequence
  chemically synthesized
aattgtcatttcctacaagtat

SEQ ID NO: 1032380 - DNA, 22 bp, Artificial Sequence
  chemically synthesized
ctagtatggctagatacttgta

SEQ ID NO: 1032381 - DNA, 22 bp, Artificial Sequence
  chemically synthesized
cctagtatggctagatacttgt

SEQ ID NO: 1032382 - DNA, 22 bp, Artificial Sequence
  chemically synthesized
tcatttcctacaagtatctagc

SEQ ID NO: 1032383 - DNA, 22 bp, Artificial Sequence
  chemically synthesized
tagtttcctagtatggctagat

SEQ ID NO: 1032384 - DNA, 22 bp, Artificial Sequence
  chemically synthesized
gtagtttcctagtatggctaga

SEQ ID NO: 1032385 - DNA, 22 bp, Artificial Sequence
  chemically synthesized
tgtagtttcctagtatggctag

SEQ ID NO: 1032386 - DNA, 22 bp, Artificial Sequence
  chemically synthesized
cctacaagtatctagccatact

SEQ ID NO: 1032387 - DNA, 22 bp, Artificial Sequence
  chemically synthesized
ctacaagtatctagccatacta

SEQ ID NO: 1032388 - DNA, 22 bp, Artificial Sequence
  chemically synthesized
tttgtagtttcctagtatggct

SEQ ID NO: 1032389 - DNA, 22 bp, Artificial Sequence
  chemically synthesized
caagtatctagccatactagga

SEQ ID NO: 1032390 - DNA, 22 bp, Artificial Sequence
  chemically synthesized
aaatattctttgtagtttccta

SEQ ID NO: 1032391 - DNA, 22 bp, Artificial Sequence
  chemically synthesized
aaaatattctttgtagtttcct

SEQ ID NO: 1032392 - DNA, 22 bp, Artificial Sequence
  chemically synthesized
taaaatattctttgtagtttcc

SEQ ID NO: 1032393 - DNA, 22 bp, Artificial Sequence
  chemically synthesized
gccatactaggaaactacaaag

SEQ ID NO: 1032394 - DNA, 22 bp, Artificial Sequence
  chemically synthesized
ggaaactacaaagaatatttta

SEQ ID NO: 1032395 - DNA, 22 bp, Artificial Sequence
  chemically synthesized
aaatacaagttttaaaatattc

SEQ ID NO: 1032396 - DNA, 22 bp, Artificial Sequence
  chemically synthesized
cctgaaatacaagttttaaaat

SEQ ID NO: 1032397 - DNA, 22 bp, Artificial Sequence
  chemically synthesized
tgcctgaaatacaagttttaaa

SEQ ID NO: 1032398 - DNA, 22 bp, Artificial Sequence
  chemically synthesized
ctgcctgaaatacaagttttaa

SEQ ID NO: 1032399 - DNA, 22 bp, Artificial Sequence
  chemically synthesized
caaagaatattttaaaacttgt

SEQ ID NO: 1032400 - DNA, 22 bp, Artificial Sequence
  chemically synthesized
agagatttctgcctgaaataca

SEQ ID NO: 1032401 - DNA, 22 bp, Artificial Sequence
  chemically synthesized
gagagatttctgcctgaaatac

SEQ ID NO: 1032402 - DNA, 22 bp, Artificial Sequence
  chemically synthesized
tgagagatttctgcctgaaata

SEQ ID NO: 1032403 - DNA, 22 bp, Artificial Sequence
  chemically synthesized
ttgagagatttctgcctgaaat

SEQ ID NO: 1032404 - DNA, 22 bp, Artificial Sequence
  chemically synthesized
tttgagagatttctgcctgaaa

SEQ ID NO: 1032405 - DNA, 22 bp, Artificial Sequence
  chemically synthesized
taaaacttgtatttcaggcaga

SEQ ID NO: 1032406 - DNA, 22 bp, Artificial Sequence
  chemically synthesized
aaaacttgtatttcaggcagaa

SEQ ID NO: 1032407 - DNA, 22 bp, Artificial Sequence
  chemically synthesized
aaacttgtatttcaggcagaaa

SEQ ID NO: 1032408 - DNA, 22 bp, Artificial Sequence
  chemically synthesized
gtatttcaggcagaaatctctc

SEQ ID NO: 1032409 - DNA, 22 bp, Artificial Sequence
  chemically synthesized
tatttcaggcagaaatctctca

SEQ ID NO: 1032410 - DNA, 22 bp, Artificial Sequence
  chemically synthesized
caggcagaaatctctcaaaaaa

SEQ ID NO: 1032411 - DNA, 22 bp, Artificial Sequence
  chemically synthesized
aggcagaaatctctcaaaaaac

SEQ ID NO: 1032412 - DNA, 22 bp, Artificial Sequence
  chemically synthesized
caagccacagatgtggtttttt

SEQ ID NO: 1032413 - DNA, 22 bp, Artificial Sequence
  chemically synthesized
cccattacaagccacagatgtg

SEQ ID NO: 1032414 - DNA, 22 bp, Artificial Sequence
  chemically synthesized
tcaaaaaaccacatctgtggct

SEQ ID NO: 1032415 - DNA, 22 bp, Artificial Sequence
  chemically synthesized
aaaaaaccacatctgtggcttg

SEQ ID NO: 1032416 - DNA, 22 bp, Artificial Sequence
  chemically synthesized
aagggaaaactgcccattacaa

SEQ ID NO: 1032417 - DNA, 22 bp, Artificial Sequence
  chemically synthesized
tcaagggaaaactgcccattac

SEQ ID NO: 1032418 - DNA, 22 bp, Artificial Sequence
  chemically synthesized
tggcttgtaatgggcagttttc

SEQ ID NO: 1032419 - DNA, 22 bp, Artificial Sequence
  chemically synthesized
gtaatgggcagttttcccttga

SEQ ID NO: 1032420 - DNA, 22 bp, Artificial Sequence
  chemically synthesized
taatgggcagttttcccttgag

SEQ ID NO: 1032421 - DNA, 22 bp, Artificial Sequence
  chemically synthesized
aaaatatcagtgttctcaaggg

SEQ ID NO: 1032422 - DNA, 22 bp, Artificial Sequence
  chemically synthesized
gaaaatatcagtgttctcaagg

SEQ ID NO: 1032423 - DNA, 22 bp, Artificial Sequence
  chemically synthesized
ttgaaaatatcagtgttctcaa

SEQ ID NO: 1032424 - DNA, 22 bp, Artificial Sequence
  chemically synthesized
ctcttgaaaatatcagtgttct

SEQ ID NO: 1032425 - DNA, 22 bp, Artificial Sequence
  chemically synthesized
tcccttgagaacactgatattt

SEQ ID NO: 1032426 - DNA, 22 bp, Artificial Sequence
  chemically synthesized
cccttgagaacactgatatttt

SEQ ID NO: 1032427 - DNA, 22 bp, Artificial Sequence
  chemically synthesized
aaattcctcttgaaaatatcag

SEQ ID NO: 1032428 - DNA, 22 bp, Artificial Sequence
  chemically synthesized
ccttgagaacactgatattttc

SEQ ID NO: 1032429 - DNA, 22 bp, Artificial Sequence
  chemically synthesized
gagaacactgatattttcaaga

SEQ ID NO: 1032430 - DNA, 22 bp, Artificial Sequence
  chemically synthesized
agaacactgatattttcaagag

SEQ ID NO: 1032431 - DNA, 22 bp, Artificial Sequence
  chemically synthesized
atattttcaagaggaatttgag

SEQ ID NO: 1032432 - DNA, 22 bp, Artificial Sequence
  chemically synthesized
tccgtggatagtctcaaattcc

SEQ ID NO: 1032433 - DNA, 22 bp, Artificial Sequence
  chemically synthesized
atccgtggatagtctcaaattc

SEQ ID NO: 1032434 - DNA, 22 bp, Artificial Sequence
  chemically synthesized
gtttatccgtggatagtctcaa

SEQ ID NO: 1032435 - DNA, 22 bp, Artificial Sequence
  chemically synthesized
tcaagaggaatttgagactatc

SEQ ID NO: 1032436 - DNA, 22 bp, Artificial Sequence
  chemically synthesized
agtttatccgtggatagtctca

SEQ ID NO: 1032437 - DNA, 22 bp, Artificial Sequence
  chemically synthesized
caagaggaatttgagactatcc

SEQ ID NO: 1032438 - DNA, 22 bp, Artificial Sequence
  chemically synthesized
tagtttatccgtggatagtctc

SEQ ID NO: 1032439 - DNA, 22 bp, Artificial Sequence
  chemically synthesized
aagaggaatttgagactatcca

SEQ ID NO: 1032440 - DNA, 22 bp, Artificial Sequence
  chemically synthesized
gttttagtttatccgtggatag

SEQ ID NO: 1032441 - DNA, 22 bp, Artificial Sequence
  chemically synthesized
atattagttttagtttatccgt

SEQ ID NO: 1032442 - DNA, 22 bp, Artificial Sequence
  chemically synthesized
catattagttttagtttatccg

SEQ ID NO: 1032443 - DNA, 22 bp, Artificial Sequence
  chemically synthesized
gagactatccacggataaacta

SEQ ID NO: 1032444 - DNA, 22 bp, Artificial Sequence
  chemically synthesized
tcatattagttttagtttatcc

SEQ ID NO: 1032445 - DNA, 22 bp, Artificial Sequence
  chemically synthesized
agactatccacggataaactaa

SEQ ID NO: 1032446 - DNA, 22 bp, Artificial Sequence
  chemically synthesized
ttttcatattagttttagttta

SEQ ID NO: 1032447 - DNA, 22 bp, Artificial Sequence
  chemically synthesized
tccacggataaactaaaactaa

SEQ ID NO: 1032448 - DNA, 22 bp, Artificial Sequence
  chemically synthesized
acaagaattattttcatattag

SEQ ID NO: 1032449 - DNA, 22 bp, Artificial Sequence
  chemically synthesized
cacaagaattattttcatatta

SEQ ID NO: 1032450 - DNA, 22 bp, Artificial Sequence
  chemically synthesized
tcacaagaattattttcatatt

SEQ ID NO: 1032451 - DNA, 22 bp, Artificial Sequence
  chemically synthesized
aaactaatatgaaaataattct

SEQ ID NO: 1032452 - DNA, 22 bp, Artificial Sequence
  chemically synthesized
taaggcaattttcacaagaatt

SEQ ID NO: 1032453 - DNA, 22 bp, Artificial Sequence
  chemically synthesized
atatgaaaataattcttgtgaa

SEQ ID NO: 1032454 - DNA, 22 bp, Artificial Sequence
  chemically synthesized
cctgtaaggcaattttcacaag

SEQ ID NO: 1032455 - DNA, 22 bp, Artificial Sequence
  chemically synthesized
gcctgtaaggcaattttcacaa

SEQ ID NO: 1032456 - DNA, 22 bp, Artificial Sequence
  chemically synthesized
ttgcctgtaaggcaattttcac

SEQ ID NO: 1032457 - DNA, 22 bp, Artificial Sequence
  chemically synthesized
caaattcttgcctgtaaggcaa

SEQ ID NO: 1032458 - DNA, 22 bp, Artificial Sequence
  chemically synthesized
ttgtgaaaattgccttacaggc

SEQ ID NO: 1032459 - DNA, 22 bp, Artificial Sequence
  chemically synthesized
gtgaaaattgccttacaggcaa

SEQ ID NO: 1032460 - DNA, 22 bp, Artificial Sequence
  chemically synthesized
tgaaaattgccttacaggcaag

SEQ ID NO: 1032461 - DNA, 22 bp, Artificial Sequence
  chemically synthesized
tgaaagttgcaaattcttgcct

SEQ ID NO: 1032462 - DNA, 22 bp, Artificial Sequence
  chemically synthesized
ccctatgaaagttgcaaattct

SEQ ID NO: 1032463 - DNA, 22 bp, Artificial Sequence
  chemically synthesized
ccttacaggcaagaatttgcaa

SEQ ID NO: 1032464 - DNA, 22 bp, Artificial Sequence
  chemically synthesized
accctatgaaagttgcaaattc

SEQ ID NO: 1032465 - DNA, 22 bp, Artificial Sequence
  chemically synthesized
tttaccctatgaaagttgcaaa

SEQ ID NO: 1032466 - DNA, 22 bp, Artificial Sequence
  chemically synthesized
acaggcaagaatttgcaacttt

SEQ ID NO: 1032467 - DNA, 22 bp, Artificial Sequence
  chemically synthesized
caggcaagaatttgcaactttc

SEQ ID NO: 1032468 - DNA, 22 bp, Artificial Sequence
  chemically synthesized
aaaatctgtttaccctatgaaa

SEQ ID NO: 1032469 - DNA, 22 bp, Artificial Sequence
  chemically synthesized
aaaaatctgtttaccctatgaa

SEQ ID NO: 1032470 - DNA, 22 bp, Artificial Sequence
  chemically synthesized
taaaaatctgtttaccctatga

SEQ ID NO: 1032471 - DNA, 22 bp, Artificial Sequence
  chemically synthesized
gcaactttcatagggtaaacag

SEQ ID NO: 1032472 - DNA, 22 bp, Artificial Sequence
  chemically synthesized
caactttcatagggtaaacaga

SEQ ID NO: 1032473 - DNA, 22 bp, Artificial Sequence
  chemically synthesized
acgctttaaaaatctgtttacc

SEQ ID NO: 1032474 - DNA, 22 bp, Artificial Sequence
  chemically synthesized
taacgctttaaaaatctgttta

SEQ ID NO: 1032475 - DNA, 22 bp, Artificial Sequence
  chemically synthesized
tcatagggtaaacagattttta

SEQ ID NO: 1032476 - DNA, 22 bp, Artificial Sequence
  chemically synthesized
catagggtaaacagatttttaa

SEQ ID NO: 1032477 - DNA, 22 bp, Artificial Sequence
  chemically synthesized
atagggtaaacagatttttaaa

SEQ ID NO: 1032478 - DNA, 22 bp, Artificial Sequence
  chemically synthesized
tgaaattctaacgctttaaaaa

SEQ ID NO: 1032479 - DNA, 22 bp, Artificial Sequence
  chemically synthesized
tcacaattatgaaattctaacg

SEQ ID NO: 1032480 - DNA, 22 bp, Artificial Sequence
  chemically synthesized
gtcacaattatgaaattctaac

SEQ ID NO: 1032481 - DNA, 22 bp, Artificial Sequence
  chemically synthesized
ttaaagcgttagaatttcataa

SEQ ID NO: 1032482 - DNA, 22 bp, Artificial Sequence
  chemically synthesized
taaagcgttagaatttcataat

SEQ ID NO: 1032483 - DNA, 22 bp, Artificial Sequence
  chemically synthesized
aaagcgttagaatttcataatt

SEQ ID NO: 1032484 - DNA, 22 bp, Artificial Sequence
  chemically synthesized
aagcgttagaatttcataattg

SEQ ID NO: 1032485 - DNA, 22 bp, Artificial Sequence
  chemically synthesized
ggaggatgtttgtcacaattat

SEQ ID NO: 1032486 - DNA, 22 bp, Artificial Sequence
  chemically synthesized
taggaggatgtttgtcacaatt

SEQ ID NO: 1032487 - DNA, 22 bp, Artificial Sequence
  chemically synthesized
gaatttcataattgtgacaaac

SEQ ID NO: 1032488 - DNA, 22 bp, Artificial Sequence
  chemically synthesized
ttctaggaggatgtttgtcaca

SEQ ID NO: 1032489 - DNA, 22 bp, Artificial Sequence
  chemically synthesized
tattctaggaggatgtttgtca

SEQ ID NO: 1032490 - DNA, 22 bp, Artificial Sequence
  chemically synthesized
ctattctaggaggatgtttgtc

SEQ ID NO: 1032491 - DNA, 22 bp, Artificial Sequence
  chemically synthesized
cataattgtgacaaacatcctc

SEQ ID NO: 1032492 - DNA, 22 bp, Artificial Sequence
  chemically synthesized
ataattgtgacaaacatcctcc

SEQ ID NO: 1032493 - DNA, 22 bp, Artificial Sequence
  chemically synthesized
accttctattctaggaggatgt

SEQ ID NO: 1032494 - DNA, 22 bp, Artificial Sequence
  chemically synthesized
caccttctattctaggaggatg

SEQ ID NO: 1032495 - DNA, 22 bp, Artificial Sequence
  chemically synthesized
tttcaccttctattctaggagg

SEQ ID NO: 1032496 - DNA, 22 bp, Artificial Sequence
  chemically synthesized
gtttcaccttctattctaggag

SEQ ID NO: 1032497 - DNA, 22 bp, Artificial Sequence
  chemically synthesized
tgacaaacatcctcctagaata

SEQ ID NO: 1032498 - DNA, 22 bp, Artificial Sequence
  chemically synthesized
cttgtttcaccttctattctag

SEQ ID NO: 1032499 - DNA, 22 bp, Artificial Sequence
  chemically synthesized
gcttgtttcaccttctattcta

SEQ ID NO: 1032500 - DNA, 22 bp, Artificial Sequence
  chemically synthesized
cttgcttgtttcaccttctatt

SEQ ID NO: 1032501 - DNA, 22 bp, Artificial Sequence
  chemically synthesized
acttgcttgtttcaccttctat

SEQ ID NO: 1032502 - DNA, 22 bp, Artificial Sequence
  chemically synthesized
cttacttgcttgtttcaccttc

SEQ ID NO: 1032503 - DNA, 22 bp, Artificial Sequence
  chemically synthesized
ctagaatagaaggtgaaacaag

SEQ ID NO: 1032504 - DNA, 22 bp, Artificial Sequence
  chemically synthesized
tctgcttacttgcttgtttcac

SEQ ID NO: 1032505 - DNA, 22 bp, Artificial Sequence
  chemically synthesized
gtctgcttacttgcttgtttca

SEQ ID NO: 1032506 - DNA, 22 bp, Artificial Sequence
  chemically synthesized
gaatagaaggtgaaacaagcaa

SEQ ID NO: 1032507 - DNA, 22 bp, Artificial Sequence
  chemically synthesized
cttgtctgcttacttgcttgtt

SEQ ID NO: 1032508 - DNA, 22 bp, Artificial Sequence
  chemically synthesized
gcttgtctgcttacttgcttgt

SEQ ID NO: 1032509 - DNA, 22 bp, Artificial Sequence
  chemically synthesized
cttgcttgtctgcttacttgct

SEQ ID NO: 1032510 - DNA, 22 bp, Artificial Sequence
  chemically synthesized
gcttgcttgtctgcttacttgc

SEQ ID NO: 1032511 - DNA, 22 bp, Artificial Sequence
  chemically synthesized
cttgcttgcttgtctgcttact

SEQ ID NO: 1032512 - DNA, 22 bp, Artificial Sequence
  chemically synthesized
gcttgcttgcttgtctgcttac

SEQ ID NO: 1032513 - DNA, 22 bp, Artificial Sequence
  chemically synthesized
gtgaaaggtttgcttgcttgct

SEQ ID NO: 1032514 - DNA, 22 bp, Artificial Sequence
  chemically synthesized
tggtgaaaggtttgcttgcttg

SEQ ID NO: 1032515 - DNA, 22 bp, Artificial Sequence
  chemically synthesized
aagtcagtataacattctggtg

SEQ ID NO: 1032516 - DNA, 22 bp, Artificial Sequence
  chemically synthesized
gtcactaaagtcagtataacat

SEQ ID NO: 1032517 - DNA, 22 bp, Artificial Sequence
  chemically synthesized
tcaccagaatgttatactgact

SEQ ID NO: 1032518 - DNA, 22 bp, Artificial Sequence
  chemically synthesized
caccagaatgttatactgactt

SEQ ID NO: 1032519 - DNA, 22 bp, Artificial Sequence
  chemically synthesized
accagaatgttatactgacttt

SEQ ID NO: 1032520 - DNA, 22 bp, Artificial Sequence
  chemically synthesized
tactgactttagtgactaatgg

SEQ ID NO: 1032521 - DNA, 22 bp, Artificial Sequence
  chemically synthesized
atagagaaaaatatatccatta

SEQ ID NO: 1032522 - DNA, 22 bp, Artificial Sequence
  chemically synthesized
actttagtgactaatggatata

SEQ ID NO: 1032523 - DNA, 22 bp, Artificial Sequence
  chemically synthesized
tcatagagaaaaatatatccat

SEQ ID NO: 1032524 - DNA, 22 bp, Artificial Sequence
  chemically synthesized
tagtgactaatggatatatttt

SEQ ID NO: 1032525 - DNA, 22 bp, Artificial Sequence
  chemically synthesized
agtgactaatggatatattttt

SEQ ID NO: 1032526 - DNA, 22 bp, Artificial Sequence
  chemically synthesized
gtgactaatggatatatttttc

SEQ ID NO: 1032527 - DNA, 22 bp, Artificial Sequence
  chemically synthesized
atggatatatttttctctatga

SEQ ID NO: 1032528 - DNA, 22 bp, Artificial Sequence
  chemically synthesized
gagatacatgaacagtctctca

SEQ ID NO: 1032529 - DNA, 22 bp, Artificial Sequence
  chemically synthesized
ttctctatgagagactgttcat

SEQ ID NO: 1032530 - DNA, 22 bp, Artificial Sequence
  chemically synthesized
tctctatgagagactgttcatg

SEQ ID NO: 1032531 - DNA, 22 bp, Artificial Sequence
  chemically synthesized
ctctatgagagactgttcatgt

SEQ ID NO: 1032532 - DNA, 22 bp, Artificial Sequence
  chemically synthesized
tctatgagagactgttcatgta

SEQ ID NO: 1032533 - DNA, 22 bp, Artificial Sequence
  chemically synthesized
gggaattggagatacatgaaca

SEQ ID NO: 1032534 - DNA, 22 bp, Artificial Sequence
  chemically synthesized
tatgagagactgttcatgtatc

SEQ ID NO: 1032535 - DNA, 22 bp, Artificial Sequence
  chemically synthesized
tgagagactgttcatgtatctc

SEQ ID NO: 1032536 - DNA, 22 bp, Artificial Sequence
  chemically synthesized
attagggaattggagatacatg

SEQ ID NO: 1032537 - DNA, 22 bp, Artificial Sequence
  chemically synthesized
taattagggaattggagataca

SEQ ID NO: 1032538 - DNA, 22 bp, Artificial Sequence
  chemically synthesized
ctaattagggaattggagatac

SEQ ID NO: 1032539 - DNA, 22 bp, Artificial Sequence
  chemically synthesized
tctaattagggaattggagata

SEQ ID NO: 1032540 - DNA, 22 bp, Artificial Sequence
  chemically synthesized
ttctaattagggaattggagat

SEQ ID NO: 1032541 - DNA, 22 bp, Artificial Sequence
  chemically synthesized
ttcatgtatctccaattcccta

SEQ ID NO: 1032542 - DNA, 22 bp, Artificial Sequence
  chemically synthesized
atgtatctccaattccctaatt

SEQ ID NO: 1032543 - DNA, 22 bp, Artificial Sequence
  chemically synthesized
gatatatgtttttctaattagg

SEQ ID NO: 1032544 - DNA, 22 bp, Artificial Sequence
  chemically synthesized
caattccctaattagaaaaaca

SEQ ID NO: 1032545 - DNA, 22 bp, Artificial Sequence
  chemically synthesized
agacctggatatatgtttttct

SEQ ID NO: 1032546 - DNA, 22 bp, Artificial Sequence
  chemically synthesized
cctaattagaaaaacatatatc

SEQ ID NO: 1032547 - DNA, 22 bp, Artificial Sequence
  chemically synthesized
attagaaaaacatatatccagg

SEQ ID NO: 1032548 - DNA, 22 bp, Artificial Sequence
  chemically synthesized
gaaaaacatatatccaggtctt

SEQ ID NO: 1032549 - DNA, 22 bp, Artificial Sequence
  chemically synthesized
ggtgtggatacagcaatatata

SEQ ID NO: 1032550 - DNA, 22 bp, Artificial Sequence
  chemically synthesized
aggtgtggatacagcaatatat

SEQ ID NO: 1032551 - DNA, 22 bp, Artificial Sequence
  chemically synthesized
taggtgtggatacagcaatata

SEQ ID NO: 1032552 - DNA, 22 bp, Artificial Sequence
  chemically synthesized
agattattttatatattgctgt

SEQ ID NO: 1032553 - DNA, 22 bp, Artificial Sequence
  chemically synthesized
ttaggtgtggatacagcaatat

SEQ ID NO: 1032554 - DNA, 22 bp, Artificial Sequence
  chemically synthesized
gattattttatatattgctgta

SEQ ID NO: 1032555 - DNA, 22 bp, Artificial Sequence
  chemically synthesized
ttttatatattgctgtatccac

SEQ ID NO: 1032556 - DNA, 22 bp, Artificial Sequence
  chemically synthesized
tatatattgctgtatccacacc

SEQ ID NO: 1032557 - DNA, 22 bp, Artificial Sequence
  chemically synthesized
atatattgctgtatccacacct

SEQ ID NO: 1032558 - DNA, 22 bp, Artificial Sequence
  chemically synthesized
tatattgctgtatccacaccta

SEQ ID NO: 1032559 - DNA, 22 bp, Artificial Sequence
  chemically synthesized
aggtcaaatcatgacttttagg

SEQ ID NO: 1032560 - DNA, 22 bp, Artificial Sequence
  chemically synthesized
ctgtatccacacctaaaagtca

SEQ ID NO: 1032561 - DNA, 22 bp, Artificial Sequence
  chemically synthesized
tatccacacctaaaagtcatga

SEQ ID NO: 1032562 - DNA, 22 bp, Artificial Sequence
  chemically synthesized
tactaaggtcaaatcatgactt

SEQ ID NO: 1032563 - DNA, 22 bp, Artificial Sequence
  chemically synthesized
gctatactaaggtcaaatcatg

SEQ ID NO: 1032564 - DNA, 22 bp, Artificial Sequence
  chemically synthesized
cgctatactaaggtcaaatcat

SEQ ID NO: 1032565 - DNA, 22 bp, Artificial Sequence
  chemically synthesized
atttcgctatactaaggtcaaa

SEQ ID NO: 1032566 - DNA, 22 bp, Artificial Sequence
  chemically synthesized
catttcgctatactaaggtcaa

SEQ ID NO: 1032567 - DNA, 22 bp, Artificial Sequence
  chemically synthesized
aaagtcatgatttgaccttagt

SEQ ID NO: 1032568 - DNA, 22 bp, Artificial Sequence
  chemically synthesized
tcatttcgctatactaaggtca

SEQ ID NO: 1032569 - DNA, 22 bp, Artificial Sequence
  chemically synthesized
ctttcatttcgctatactaagg

SEQ ID NO: 1032570 - DNA, 22 bp, Artificial Sequence
  chemically synthesized
cctttcatttcgctatactaag

SEQ ID NO: 1032571 - DNA, 22 bp, Artificial Sequence
  chemically synthesized
tatttcctttcatttcgctata

SEQ ID NO: 1032572 - DNA, 22 bp, Artificial Sequence
  chemically synthesized
atatttcctttcatttcgctat

SEQ ID NO: 1032573 - DNA, 22 bp, Artificial Sequence
  chemically synthesized
gaccttagtatagcgaaatgaa

SEQ ID NO: 1032574 - DNA, 22 bp, Artificial Sequence
  chemically synthesized
cttatatttcctttcatttcgc

SEQ ID NO: 1032575 - DNA, 22 bp, Artificial Sequence
  chemically synthesized
accttagtatagcgaaatgaaa

SEQ ID NO: 1032576 - DNA, 22 bp, Artificial Sequence
  chemically synthesized
ccttatatttcctttcatttcg

SEQ ID NO: 1032577 - DNA, 22 bp, Artificial Sequence
  chemically synthesized
agtatagcgaaatgaaaggaaa

SEQ ID NO: 1032578 - DNA, 22 bp, Artificial Sequence
  chemically synthesized
gtatagcgaaatgaaaggaaat

SEQ ID NO: 1032579 - DNA, 22 bp, Artificial Sequence
  chemically synthesized
atgcagggtaaatttccttata

SEQ ID NO: 1032580 - DNA, 22 bp, Artificial Sequence
  chemically synthesized
ttaatgcagggtaaatttcctt

SEQ ID NO: 1032581 - DNA, 22 bp, Artificial Sequence
  chemically synthesized
aataaattattaatgcagggta

SEQ ID NO: 1032582 - DNA, 22 bp, Artificial Sequence
  chemically synthesized
accctgcattaataatttattg

SEQ ID NO: 1032583 - DNA, 22 bp, Artificial Sequence
  chemically synthesized
ccctgcattaataatttattga

SEQ ID NO: 1032584 - DNA, 22 bp, Artificial Sequence
  chemically synthesized
catcatagtgtattcaataaat

SEQ ID NO: 1032585 - DNA, 22 bp, Artificial Sequence
  chemically synthesized
ccatcatagtgtattcaataaa

SEQ ID NO: 1032586 - DNA, 22 bp, Artificial Sequence
  chemically synthesized
cattaataatttattgaataca

SEQ ID NO: 1032587 - DNA, 22 bp, Artificial Sequence
  chemically synthesized
catttccatcatagtgtattca

SEQ ID NO: 1032588 - DNA, 22 bp, Artificial Sequence
  chemically synthesized
ataatttattgaatacactatg

SEQ ID NO: 1032589 - DNA, 22 bp, Artificial Sequence
  chemically synthesized
attgaatacactatgatggaaa

SEQ ID NO: 1032590 - DNA, 22 bp, Artificial Sequence
  chemically synthesized
acagaatctccatttccatcat

SEQ ID NO: 1032591 - DNA, 22 bp, Artificial Sequence
  chemically synthesized
ttgaatacactatgatggaaat

SEQ ID NO: 1032592 - DNA, 22 bp, Artificial Sequence
  chemically synthesized
aatacactatgatggaaatgga

SEQ ID NO: 1032593 - DNA, 22 bp, Artificial Sequence
  chemically synthesized
gttaacagaatctccatttcca

SEQ ID NO: 1032594 - DNA, 22 bp, Artificial Sequence
  chemically synthesized
ggttaacagaatctccatttcc

SEQ ID NO: 1032595 - DNA, 22 bp, Artificial Sequence
  chemically synthesized
tggttaacagaatctccatttc

SEQ ID NO: 1032596 - DNA, 22 bp, Artificial Sequence
  chemically synthesized
tttggttaacagaatctccatt

SEQ ID NO: 1032597 - DNA, 22 bp, Artificial Sequence
  chemically synthesized
tgatggaaatggagattctgtt

SEQ ID NO: 1032598 - DNA, 22 bp, Artificial Sequence
  chemically synthesized
agaaactctttggttaacagaa

SEQ ID NO: 1032599 - DNA, 22 bp, Artificial Sequence
  chemically synthesized
gagaaactctttggttaacaga

SEQ ID NO: 1032600 - DNA, 22 bp, Artificial Sequence
  chemically synthesized
ttgagaaactctttggttaaca

SEQ ID NO: 1032601 - DNA, 22 bp, Artificial Sequence
  chemically synthesized
cttgagaaactctttggttaac

SEQ ID NO: 1032602 - DNA, 22 bp, Artificial Sequence
  chemically synthesized
tgttaaccaaagagtttctcaa

SEQ ID NO: 1032603 - DNA, 22 bp, Artificial Sequence
  chemically synthesized
ttaaccaaagagtttctcaaga

SEQ ID NO: 1032604 - DNA, 22 bp, Artificial Sequence
  chemically synthesized
gaatgaataagtttcttgagaa

SEQ ID NO: 1032605 - DNA, 22 bp, Artificial Sequence
  chemically synthesized
accaaagagtttctcaagaaac

SEQ ID NO: 1032606 - DNA, 22 bp, Artificial Sequence
  chemically synthesized
tagaatgaataagtttcttgag

SEQ ID NO: 1032607 - DNA, 22 bp, Artificial Sequence
  chemically synthesized
taatattctagaatgaataagt

SEQ ID NO: 1032608 - DNA, 22 bp, Artificial Sequence
  chemically synthesized
ctcaagaaacttattcattcta

SEQ ID NO: 1032609 - DNA, 22 bp, Artificial Sequence
  chemically synthesized
tcaagaaacttattcattctag

SEQ ID NO: 1032610 - DNA, 22 bp, Artificial Sequence
  chemically synthesized
aagaaacttattcattctagaa

SEQ ID NO: 1032611 - DNA, 22 bp, Artificial Sequence
  chemically synthesized
aaaagctgtaatattctagaat

SEQ ID NO: 1032612 - DNA, 22 bp, Artificial Sequence
  chemically synthesized
actcaaaagctgtaatattcta

SEQ ID NO: 1032613 - DNA, 22 bp, Artificial Sequence
  chemically synthesized
tcactcaaaagctgtaatattc

SEQ ID NO: 1032614 - DNA, 22 bp, Artificial Sequence
  chemically synthesized
ctcactcaaaagctgtaatatt

SEQ ID NO: 1032615 - DNA, 22 bp, Artificial Sequence
  chemically synthesized
attcattctagaatattacagc

SEQ ID NO: 1032616 - DNA, 22 bp, Artificial Sequence
  chemically synthesized
ttcattctagaatattacagct

SEQ ID NO: 1032617 - DNA, 22 bp, Artificial Sequence
  chemically synthesized
attctagaatattacagctttt

SEQ ID NO: 1032618 - DNA, 22 bp, Artificial Sequence
  chemically synthesized
tagaatattacagcttttgagt

SEQ ID NO: 1032619 - DNA, 22 bp, Artificial Sequence
  chemically synthesized
gaatattacagcttttgagtga

SEQ ID NO: 1032620 - DNA, 22 bp, Artificial Sequence
  chemically synthesized
aatgtatataataagcttctca

SEQ ID NO: 1032621 - DNA, 22 bp, Artificial Sequence
  chemically synthesized
cagcttttgagtgagaagctta

SEQ ID NO: 1032622 - DNA, 22 bp, Artificial Sequence
  chemically synthesized
aaatgtatataataagcttctc

SEQ ID NO: 1032623 - DNA, 22 bp, Artificial Sequence
  chemically synthesized
ttgagtgagaagcttattatat

SEQ ID NO: 1032624 - DNA, 22 bp, Artificial Sequence
  chemically synthesized
tgagtgagaagcttattatata

SEQ ID NO: 1032625 - DNA, 22 bp, Artificial Sequence
  chemically synthesized
gagtgagaagcttattatatac

SEQ ID NO: 1032626 - DNA, 22 bp, Artificial Sequence
  chemically synthesized
agtgagaagcttattatataca

SEQ ID NO: 1032627 - DNA, 22 bp, Artificial Sequence
  chemically synthesized
atgagcccttaaatgtatataa

SEQ ID NO: 1032628 - DNA, 22 bp, Artificial Sequence
  chemically synthesized
ttgatgagcccttaaatgtata

SEQ ID NO: 1032629 - DNA, 22 bp, Artificial Sequence
  chemically synthesized
attgatgagcccttaaatgtat

SEQ ID NO: 1032630 - DNA, 22 bp, Artificial Sequence
  chemically synthesized
tattgatgagcccttaaatgta

SEQ ID NO: 1032631 - DNA, 22 bp, Artificial Sequence
  chemically synthesized
attatatacatttaagggctca

SEQ ID NO: 1032632 - DNA, 22 bp, Artificial Sequence
  chemically synthesized
atattttattgatgagccctta

SEQ ID NO: 1032633 - DNA, 22 bp, Artificial Sequence
  chemically synthesized
ttatatacatttaagggctcat

SEQ ID NO: 1032634 - DNA, 22 bp, Artificial Sequence
  chemically synthesized
tatacatttaagggctcatcaa

SEQ ID NO: 1032635 - DNA, 22 bp, Artificial Sequence
  chemically synthesized
aatacatgttaatattttattg

SEQ ID NO: 1032636 - DNA, 22 bp, Artificial Sequence
  chemically synthesized
aagggctcatcaataaaatatt

SEQ ID NO: 1032637 - DNA, 22 bp, Artificial Sequence
  chemically synthesized
agggctcatcaataaaatatta

SEQ ID NO: 1032638 - DNA, 22 bp, Artificial Sequence
  chemically synthesized
gatgttcaatacatgttaatat

SEQ ID NO: 1032639 - DNA, 22 bp, Artificial Sequence
  chemically synthesized
atcaataaaatattaacatgta

SEQ ID NO: 1032640 - DNA, 22 bp, Artificial Sequence
  chemically synthesized
atgttagatgttcaatacatgt

SEQ ID NO: 1032641 - DNA, 22 bp, Artificial Sequence
  chemically synthesized
catgttagatgttcaatacatg

SEQ ID NO: 1032642 - DNA, 22 bp, Artificial Sequence
  chemically synthesized
acatgtattgaacatctaacat

SEQ ID NO: 1032643 - DNA, 22 bp, Artificial Sequence
  chemically synthesized
agtggaatgcagtatggtttca

SEQ ID NO: 1032644 - DNA, 22 bp, Artificial Sequence
  chemically synthesized
aacatctaacatgaaaccatac

SEQ ID NO: 1032645 - DNA, 22 bp, Artificial Sequence
  chemically synthesized
acatgaaaccatactgcattcc

SEQ ID NO: 1032646 - DNA, 22 bp, Artificial Sequence
  chemically synthesized
tcacccctaagtggaatgcagt

SEQ ID NO: 1032647 - DNA, 22 bp, Artificial Sequence
  chemically synthesized
gtcacccctaagtggaatgcag

SEQ ID NO: 1032648 - DNA, 22 bp, Artificial Sequence
  chemically synthesized
tgtcacccctaagtggaatgca

SEQ ID NO: 1032649 - DNA, 22 bp, Artificial Sequence
  chemically synthesized
ttgtcacccctaagtggaatgc

SEQ ID NO: 1032650 - DNA, 22 bp, Artificial Sequence
  chemically synthesized
tataccttttgtcacccctaag

SEQ ID NO: 1032651 - DNA, 22 bp, Artificial Sequence
  chemically synthesized
cattccacttaggggtgacaaa

SEQ ID NO: 1032652 - DNA, 22 bp, Artificial Sequence
  chemically synthesized
tactatataccttttgtcaccc

SEQ ID NO: 1032653 - DNA, 22 bp, Artificial Sequence
  chemically synthesized
cacttaggggtgacaaaaggta

SEQ ID NO: 1032654 - DNA, 22 bp, Artificial Sequence
  chemically synthesized
aggggtgacaaaaggtatatag

SEQ ID NO: 1032655 - DNA, 22 bp, Artificial Sequence
  chemically synthesized
ggggtgacaaaaggtatatagt

SEQ ID NO: 1032656 - DNA, 22 bp, Artificial Sequence
  chemically synthesized
cagggaagaggctgtactatat

SEQ ID NO: 1032657 - DNA, 22 bp, Artificial Sequence
  chemically synthesized
ctacagggaagaggctgtacta

SEQ ID NO: 1032658 - DNA, 22 bp, Artificial Sequence
  chemically synthesized
cctacagggaagaggctgtact

SEQ ID NO: 1032659 - DNA, 22 bp, Artificial Sequence
  chemically synthesized
tcctacagggaagaggctgtac

SEQ ID NO: 1032660 - DNA, 22 bp, Artificial Sequence
  chemically synthesized
ttcctacagggaagaggctgta

SEQ ID NO: 1032661 - DNA, 22 bp, Artificial Sequence
  chemically synthesized
tttcctacagggaagaggctgt

SEQ ID NO: 1032662 - DNA, 22 bp, Artificial Sequence
  chemically synthesized
agtggagtactttttcctacag

SEQ ID NO: 1032663 - DNA, 22 bp, Artificial Sequence
  chemically synthesized
ccattcagtggagtactttttc

SEQ ID NO: 1032664 - DNA, 22 bp, Artificial Sequence
  chemically synthesized
ttccctgtaggaaaaagtactc

SEQ ID NO: 1032665 - DNA, 22 bp, Artificial Sequence
  chemically synthesized
ccctgtaggaaaaagtactcca

SEQ ID NO: 1032666 - DNA, 22 bp, Artificial Sequence
  chemically synthesized
cctgtaggaaaaagtactccac

SEQ ID NO: 1032667 - DNA, 22 bp, Artificial Sequence
  chemically synthesized
taggaaaaagtactccactgaa

SEQ ID NO: 1032668 - DNA, 22 bp, Artificial Sequence
  chemically synthesized
caacatgttaccattcagtgga

SEQ ID NO: 1032669 - DNA, 22 bp, Artificial Sequence
  chemically synthesized
gcaacatgttaccattcagtgg

SEQ ID NO: 1032670 - DNA, 22 bp, Artificial Sequence
  chemically synthesized
tttgcaacatgttaccattcag

SEQ ID NO: 1032671 - DNA, 22 bp, Artificial Sequence
  chemically synthesized
catagctgtttgcaacatgtta

SEQ ID NO: 1032672 - DNA, 22 bp, Artificial Sequence
  chemically synthesized
acatagctgtttgcaacatgtt

SEQ ID NO: 1032673 - DNA, 22 bp, Artificial Sequence
  chemically synthesized
cactgaatggtaacatgttgca

SEQ ID NO: 1032674 - DNA, 22 bp, Artificial Sequence
  chemically synthesized
aatggtaacatgttgcaaacag

SEQ ID NO: 1032675 - DNA, 22 bp, Artificial Sequence
  chemically synthesized
tatgtcttacatagctgtttgc

SEQ ID NO: 1032676 - DNA, 22 bp, Artificial Sequence
  chemically synthesized
atatgtcttacatagctgtttg

SEQ ID NO: 1032677 - DNA, 22 bp, Artificial Sequence
  chemically synthesized
tcatgagtttatatgtcttaca

SEQ ID NO: 1032678 - DNA, 22 bp, Artificial Sequence
  chemically synthesized
caaacagctatgtaagacatat

SEQ ID NO: 1032679 - DNA, 22 bp, Artificial Sequence
  chemically synthesized
ttatcatgagtttatatgtctt

SEQ ID NO: 1032680 - DNA, 22 bp, Artificial Sequence
  chemically synthesized
caggttattatcatgagtttat

SEQ ID NO: 1032681 - DNA, 22 bp, Artificial Sequence
  chemically synthesized
acaggttattatcatgagttta

SEQ ID NO: 1032682 - DNA, 22 bp, Artificial Sequence
  chemically synthesized
tgtaagacatataaactcatga

SEQ ID NO: 1032683 - DNA, 22 bp, Artificial Sequence
  chemically synthesized
tcttacaggttattatcatgag

SEQ ID NO: 1032684 - DNA, 22 bp, Artificial Sequence
  chemically synthesized
atcttacaggttattatcatga

SEQ ID NO: 1032685 - DNA, 22 bp, Artificial Sequence
  chemically synthesized
tttatcttacaggttattatca

SEQ ID NO: 1032686 - DNA, 22 bp, Artificial Sequence
  chemically synthesized
cctatttatcttacaggttatt

SEQ ID NO: 1032687 - DNA, 22 bp, Artificial Sequence
  chemically synthesized
acctatttatcttacaggttat

SEQ ID NO: 1032688 - DNA, 22 bp, Artificial Sequence
  chemically synthesized
tttacctatttatcttacaggt

SEQ ID NO: 1032689 - DNA, 22 bp, Artificial Sequence
  chemically synthesized
tgtttacctatttatcttacag

SEQ ID NO: 1032690 - DNA, 22 bp, Artificial Sequence
  chemically synthesized
atgataataacctgtaagataa

SEQ ID NO: 1032691 - DNA, 22 bp, Artificial Sequence
  chemically synthesized
tctgtttacctatttatcttac

SEQ ID NO: 1032692 - DNA, 22 bp, Artificial Sequence
  chemically synthesized
atagaactctctgtttacctat

SEQ ID NO: 1032693 - DNA, 22 bp, Artificial Sequence
  chemically synthesized
taagataaataggtaaacagag

SEQ ID NO: 1032694 - DNA, 22 bp, Artificial Sequence
  chemically synthesized
gattcatagaactctctgttta

SEQ ID NO: 1032695 - DNA, 22 bp, Artificial Sequence
  chemically synthesized
tctggattcatagaactctctg

SEQ ID NO: 1032696 - DNA, 22 bp, Artificial Sequence
  chemically synthesized
cattgtctggattcatagaact

SEQ ID NO: 1032697 - DNA, 22 bp, Artificial Sequence
  chemically synthesized
ttccattgtctggattcataga

SEQ ID NO: 1032698 - DNA, 22 bp, Artificial Sequence
  chemically synthesized
atcaattattccattgtctgga

SEQ ID NO: 1032699 - DNA, 22 bp, Artificial Sequence
  chemically synthesized
gatcaattattccattgtctgg

SEQ ID NO: 1032700 - DNA, 22 bp, Artificial Sequence
  chemically synthesized
ttgatcaattattccattgtct

SEQ ID NO: 1032701 - DNA, 22 bp, Artificial Sequence
  chemically synthesized
tatgaatccagacaatggaata

SEQ ID NO: 1032702 - DNA, 22 bp, Artificial Sequence
  chemically synthesized
ttcttgatcaattattccattg

SEQ ID NO: 1032703 - DNA, 22 bp, Artificial Sequence
  chemically synthesized
tgaatccagacaatggaataat

SEQ ID NO: 1032704 - DNA, 22 bp, Artificial Sequence
  chemically synthesized
tgttcttgatcaattattccat

SEQ ID NO: 1032705 - DNA, 22 bp, Artificial Sequence
  chemically synthesized
tctgttcttgatcaattattcc

SEQ ID NO: 1032706 - DNA, 22 bp, Artificial Sequence
  chemically synthesized
ctctgttcttgatcaattattc

SEQ ID NO: 1032707 - DNA, 22 bp, Artificial Sequence
  chemically synthesized
gaatccttctctgttcttgatc

SEQ ID NO: 1032708 - DNA, 22 bp, Artificial Sequence
  chemically synthesized
ggaatccttctctgttcttgat

SEQ ID NO: 1032709 - DNA, 22 bp, Artificial Sequence
  chemically synthesized
ttggaatccttctctgttcttg

SEQ ID NO: 1032710 - DNA, 22 bp, Artificial Sequence
  chemically synthesized
atcaagaacagagaaggattcc

SEQ ID NO: 1032711 - DNA, 22 bp, Artificial Sequence
  chemically synthesized
agtgcaaataccacctcttgga

SEQ ID NO: 1032712 - DNA, 22 bp, Artificial Sequence
  chemically synthesized
agcattcagtgcaaataccacc

SEQ ID NO: 1032713 - DNA, 22 bp, Artificial Sequence
  chemically synthesized
caagaggtggtatttgcactga

SEQ ID NO: 1032714 - DNA, 22 bp, Artificial Sequence
  chemically synthesized
cacaccattcagcattcagtgc

SEQ ID NO: 1032715 - DNA, 22 bp, Artificial Sequence
  chemically synthesized
ctacacaccattcagcattcag

SEQ ID NO: 1032716 - DNA, 22 bp, Artificial Sequence
  chemically synthesized
gcaaattcctacacaccattca

SEQ ID NO: 1032717 - DNA, 22 bp, Artificial Sequence
  chemically synthesized
gcactgaatgctgaatggtgtg

SEQ ID NO: 1032718 - DNA, 22 bp, Artificial Sequence
  chemically synthesized
agcaaattcctacacaccattc

SEQ ID NO: 1032719 - DNA, 22 bp, Artificial Sequence
  chemically synthesized
cactgaatgctgaatggtgtgt

SEQ ID NO: 1032720 - DNA, 22 bp, Artificial Sequence
  chemically synthesized
cttagcaaattcctacacacca

SEQ ID NO: 1032721 - DNA, 22 bp, Artificial Sequence
  chemically synthesized
aatgctgaatggtgtgtaggaa

SEQ ID NO: 1032722 - DNA, 22 bp, Artificial Sequence
  chemically synthesized
ctccttagcaaattcctacaca

SEQ ID NO: 1032723 - DNA, 22 bp, Artificial Sequence
  chemically synthesized
gctccttagcaaattcctacac

SEQ ID NO: 1032724 - DNA, 22 bp, Artificial Sequence
  chemically synthesized
acttgctccttagcaaattcct

SEQ ID NO: 1032725 - DNA, 22 bp, Artificial Sequence
  chemically synthesized
aatggtgtgtaggaatttgcta

SEQ ID NO: 1032726 - DNA, 22 bp, Artificial Sequence
  chemically synthesized
aggagtcctgacttgctcctta

SEQ ID NO: 1032727 - DNA, 22 bp, Artificial Sequence
  chemically synthesized
gaggagtcctgacttgctcctt

SEQ ID NO: 1032728 - DNA, 22 bp, Artificial Sequence
  chemically synthesized
atgtgcttgaggagtcctgact

SEQ ID NO: 1032729 - DNA, 22 bp, Artificial Sequence
  chemically synthesized
gctaaggagcaagtcaggactc

SEQ ID NO: 1032730 - DNA, 22 bp, Artificial Sequence
  chemically synthesized
ctaaggagcaagtcaggactcc

SEQ ID NO: 1032731 - DNA, 22 bp, Artificial Sequence
  chemically synthesized
tgatgtgcttgaggagtcctga

SEQ ID NO: 1032732 - DNA, 22 bp, Artificial Sequence
  chemically synthesized
ctgatgtgcttgaggagtcctg

SEQ ID NO: 1032733 - DNA, 22 bp, Artificial Sequence
  chemically synthesized
tctgatgtgcttgaggagtcct

SEQ ID NO: 1032734 - DNA, 22 bp, Artificial Sequence
  chemically synthesized
aggagcaagtcaggactcctca

SEQ ID NO: 1032735 - DNA, 22 bp, Artificial Sequence
  chemically synthesized
ctcaagcacatcagaaaatcct

SEQ ID NO: 1032736 - DNA, 22 bp, Artificial Sequence
  chemically synthesized
aagcacatcagaaaatccttta

SEQ ID NO: 1032737 - DNA, 22 bp, Artificial Sequence
  chemically synthesized
gcaaagccaagtggtaaaggat

SEQ ID NO: 1032738 - DNA, 22 bp, Artificial Sequence
  chemically synthesized
agcaaagccaagtggtaaagga

SEQ ID NO: 1032739 - DNA, 22 bp, Artificial Sequence
  chemically synthesized
caagatgcttagcaaagccaag

SEQ ID NO: 1032740 - DNA, 22 bp, Artificial Sequence
  chemically synthesized
attacaagatgcttagcaaagc

SEQ ID NO: 1032741 - DNA, 22 bp, Artificial Sequence
  chemically synthesized
taccacttggctttgctaagca

SEQ ID NO: 1032742 - DNA, 22 bp, Artificial Sequence
  chemically synthesized
accacttggctttgctaagcat

SEQ ID NO: 1032743 - DNA, 22 bp, Artificial Sequence
  chemically synthesized
ccacttggctttgctaagcatc

SEQ ID NO: 1032744 - DNA, 22 bp, Artificial Sequence
  chemically synthesized
taattcattacaagatgcttag

SEQ ID NO: 1032745 - DNA, 22 bp, Artificial Sequence
  chemically synthesized
ggctttgctaagcatcttgtaa

SEQ ID NO: 1032746 - DNA, 22 bp, Artificial Sequence
  chemically synthesized
gctttgctaagcatcttgtaat

SEQ ID NO: 1032747 - DNA, 22 bp, Artificial Sequence
  chemically synthesized
tgctaagcatcttgtaatgaat

SEQ ID NO: 1032748 - DNA, 22 bp, Artificial Sequence
  chemically synthesized
gctaagcatcttgtaatgaatt

SEQ ID NO: 1032749 - DNA, 22 bp, Artificial Sequence
  chemically synthesized
ctaagcatcttgtaatgaatta

SEQ ID NO: 1032750 - DNA, 22 bp, Artificial Sequence
  chemically synthesized
agcatcttgtaatgaattacaa

SEQ ID NO: 1032751 - DNA, 22 bp, Artificial Sequence
  chemically synthesized
gtaatgaattacaatccatttc

SEQ ID NO: 1032752 - DNA, 22 bp, Artificial Sequence
  chemically synthesized
taatgaattacaatccatttct

SEQ ID NO: 1032753 - DNA, 22 bp, Artificial Sequence
  chemically synthesized
gagatcagtagcagaaatggat

SEQ ID NO: 1032754 - DNA, 22 bp, Artificial Sequence
  chemically synthesized
tgttcgagatcagtagcagaaa

SEQ ID NO: 1032755 - DNA, 22 bp, Artificial Sequence
  chemically synthesized
atgttcgagatcagtagcagaa

SEQ ID NO: 1032756 - DNA, 22 bp, Artificial Sequence
  chemically synthesized
tatgttcgagatcagtagcaga

SEQ ID NO: 1032757 - DNA, 22 bp, Artificial Sequence
  chemically synthesized
caatccatttctgctactgatc

SEQ ID NO: 1032758 - DNA, 22 bp, Artificial Sequence
  chemically synthesized
ctgctactgatctcgaacataa

SEQ ID NO: 1032759 - DNA, 22 bp, Artificial Sequence
  chemically synthesized
aaggtgatatctttatgttcga

SEQ ID NO: 1032760 - DNA, 22 bp, Artificial Sequence
  chemically synthesized
tgctactgatctcgaacataaa

SEQ ID NO: 1032761 - DNA, 22 bp, Artificial Sequence
  chemically synthesized
gaaggtgatatctttatgttcg

SEQ ID NO: 1032762 - DNA, 22 bp, Artificial Sequence
  chemically synthesized
tgaaggtgatatctttatgttc

SEQ ID NO: 1032763 - DNA, 22 bp, Artificial Sequence
  chemically synthesized
ctactgatctcgaacataaaga

SEQ ID NO: 1032764 - DNA, 22 bp, Artificial Sequence
  chemically synthesized
ttgaaggtgatatctttatgtt

SEQ ID NO: 1032765 - DNA, 22 bp, Artificial Sequence
  chemically synthesized
ctgatctcgaacataaagatat

SEQ ID NO: 1032766 - DNA, 22 bp, Artificial Sequence
  chemically synthesized
aatttttgaaggtgatatcttt

SEQ ID NO: 1032767 - DNA, 22 bp, Artificial Sequence
  chemically synthesized
atctcgaacataaagatatcac

SEQ ID NO: 1032768 - DNA, 22 bp, Artificial Sequence
  chemically synthesized
aaatttttgaaggtgatatctt

SEQ ID NO: 1032769 - DNA, 22 bp, Artificial Sequence
  chemically synthesized
gaacataaagatatcaccttca

SEQ ID NO: 1032770 - DNA, 22 bp, Artificial Sequence
  chemically synthesized
aaaagatgtttaaatttttgaa

SEQ ID NO: 1032771 - DNA, 22 bp, Artificial Sequence
  chemically synthesized
aaaaagatgtttaaatttttga

SEQ ID NO: 1032772 - DNA, 22 bp, Artificial Sequence
  chemically synthesized
taaaaagatgtttaaatttttg

SEQ ID NO: 1032773 - DNA, 22 bp, Artificial Sequence
  chemically synthesized
caaaaatttaaacatcttttta

SEQ ID NO: 1032774 - DNA, 22 bp, Artificial Sequence
  chemically synthesized
aaaaatttaaacatctttttaa

SEQ ID NO: 1032775 - DNA, 22 bp, Artificial Sequence
  chemically synthesized
aaacatctttttaaagtacttt

SEQ ID NO: 1032776 - DNA, 22 bp, Artificial Sequence
  chemically synthesized
atatacaagaccaaagtacttt

SEQ ID NO: 1032777 - DNA, 22 bp, Artificial Sequence
  chemically synthesized
aacatctttttaaagtactttg

SEQ ID NO: 1032778 - DNA, 22 bp, Artificial Sequence
  chemically synthesized
aagtctcatatacaagaccaaa

SEQ ID NO: 1032779 - DNA, 22 bp, Artificial Sequence
  chemically synthesized
aaagtctcatatacaagaccaa

SEQ ID NO: 1032780 - DNA, 22 bp, Artificial Sequence
  chemically synthesized
tttaaagtactttggtcttgta

SEQ ID NO: 1032781 - DNA, 22 bp, Artificial Sequence
  chemically synthesized
taaagtctcatatacaagacca

SEQ ID NO: 1032782 - DNA, 22 bp, Artificial Sequence
  chemically synthesized
ttaaagtactttggtcttgtat

SEQ ID NO: 1032783 - DNA, 22 bp, Artificial Sequence
  chemically synthesized
ttaaagtctcatatacaagacc

SEQ ID NO: 1032784 - DNA, 22 bp, Artificial Sequence
  chemically synthesized
taaagtactttggtcttgtata

SEQ ID NO: 1032785 - DNA, 22 bp, Artificial Sequence
  chemically synthesized
tttaaagtctcatatacaagac

SEQ ID NO: 1032786 - DNA, 22 bp, Artificial Sequence
  chemically synthesized
aaagtactttggtcttgtatat

SEQ ID NO: 1032787 - DNA, 22 bp, Artificial Sequence
  chemically synthesized
aagtactttggtcttgtatatg

SEQ ID NO: 1032788 - DNA, 22 bp, Artificial Sequence
  chemically synthesized
tggtcttgtatatgagacttta

SEQ ID NO: 1032789 - DNA, 22 bp, Artificial Sequence
  chemically synthesized
ggtcttgtatatgagactttaa

SEQ ID NO: 1032790 - DNA, 22 bp, Artificial Sequence
  chemically synthesized
gtcttgtatatgagactttaaa

SEQ ID NO: 1032791 - DNA, 22 bp, Artificial Sequence
  chemically synthesized
gtatatgagactttaaaaagtc

SEQ ID NO: 1032792 - DNA, 22 bp, Artificial Sequence
  chemically synthesized
tatatgagactttaaaaagtca

SEQ ID NO: 1032793 - DNA, 22 bp, Artificial Sequence
  chemically synthesized
taaaaagtcattatacgtattt

SEQ ID NO: 1032794 - DNA, 22 bp, Artificial Sequence
  chemically synthesized
aaaaagtcattatacgtatttg

SEQ ID NO: 1032795 - DNA, 22 bp, Artificial Sequence
  chemically synthesized
aaaagtcattatacgtatttgt

SEQ ID NO: 1032796 - DNA, 22 bp, Artificial Sequence
  chemically synthesized
tagacatcagtagaaacaacac

SEQ ID NO: 1032797 - DNA, 22 bp, Artificial Sequence
  chemically synthesized
tacgtatttgtgttgtttctac

SEQ ID NO: 1032798 - DNA, 22 bp, Artificial Sequence
  chemically synthesized
cagatctatagacatcagtaga

SEQ ID NO: 1032799 - DNA, 22 bp, Artificial Sequence
  chemically synthesized
ccagatctatagacatcagtag

SEQ ID NO: 1032800 - DNA, 22 bp, Artificial Sequence
  chemically synthesized
gtgttgtttctactgatgtcta

SEQ ID NO: 1032801 - DNA, 22 bp, Artificial Sequence
  chemically synthesized
cttccagatctatagacatcag

SEQ ID NO: 1032802 - DNA, 22 bp, Artificial Sequence
  chemically synthesized
tgttgtttctactgatgtctat

SEQ ID NO: 1032803 - DNA, 22 bp, Artificial Sequence
  chemically synthesized
ccttccagatctatagacatca

SEQ ID NO: 1032804 - DNA, 22 bp, Artificial Sequence
  chemically synthesized
ttccttccagatctatagacat

SEQ ID NO: 1032805 - DNA, 22 bp, Artificial Sequence
  chemically synthesized
tttctactgatgtctatagatc

SEQ ID NO: 1032806 - DNA, 22 bp, Artificial Sequence
  chemically synthesized
tgttcttccttccagatctata

SEQ ID NO: 1032807 - DNA, 22 bp, Artificial Sequence
  chemically synthesized
ctactgatgtctatagatctgg

SEQ ID NO: 1032808 - DNA, 22 bp, Artificial Sequence
  chemically synthesized
tactgatgtctatagatctgga

SEQ ID NO: 1032809 - DNA, 22 bp, Artificial Sequence
  chemically synthesized
ctgatgtctatagatctggaag

SEQ ID NO: 1032810 - DNA, 22 bp, Artificial Sequence
  chemically synthesized
atgtctatagatctggaaggaa

SEQ ID NO: 1032811 - DNA, 22 bp, Artificial Sequence
  chemically synthesized
aaggattatgttcttccttcca

SEQ ID NO: 1032812 - DNA, 22 bp, Artificial Sequence
  chemically synthesized
tgctcaaggattatgttcttcc

SEQ ID NO: 1032813 - DNA, 22 bp, Artificial Sequence
  chemically synthesized
tagatctggaaggaagaacata

SEQ ID NO: 1032814 - DNA, 22 bp, Artificial Sequence
  chemically synthesized
atgctcaaggattatgttcttc

SEQ ID NO: 1032815 - DNA, 22 bp, Artificial Sequence
  chemically synthesized
ttatgctcaaggattatgttct

SEQ ID NO: 1032816 - DNA, 22 bp, Artificial Sequence
  chemically synthesized
cttatgctcaaggattatgttc

SEQ ID NO: 1032817 - DNA, 22 bp, Artificial Sequence
  chemically synthesized
gaaggaagaacataatccttga

SEQ ID NO: 1032818 - DNA, 22 bp, Artificial Sequence
  chemically synthesized
acataggatttcttatgctcaa

SEQ ID NO: 1032819 - DNA, 22 bp, Artificial Sequence
  chemically synthesized
cacataggatttcttatgctca

SEQ ID NO: 1032820 - DNA, 22 bp, Artificial Sequence
  chemically synthesized
catggcatttcacataggattt

SEQ ID NO: 1032821 - DNA, 22 bp, Artificial Sequence
  chemically synthesized
gagcataagaaatcctatgtga

SEQ ID NO: 1032822 - DNA, 22 bp, Artificial Sequence
  chemically synthesized
agcataagaaatcctatgtgaa

SEQ ID NO: 1032823 - DNA, 22 bp, Artificial Sequence
  chemically synthesized
cctccatggcatttcacatagg

SEQ ID NO: 1032824 - DNA, 22 bp, Artificial Sequence
  chemically synthesized
catagcctgcctccatggcatt

SEQ ID NO: 1032825 - DNA, 22 bp, Artificial Sequence
  chemically synthesized
cactacatagcctgcctccatg

SEQ ID NO: 1032826 - DNA, 22 bp, Artificial Sequence
  chemically synthesized
ccactacatagcctgcctccat

SEQ ID NO: 1032827 - DNA, 22 bp, Artificial Sequence
  chemically synthesized
tgtgaaatgccatggaggcagg

SEQ ID NO: 1032828 - DNA, 22 bp, Artificial Sequence
  chemically synthesized
tccactacatagcctgcctcca

SEQ ID NO: 1032829 - DNA, 22 bp, Artificial Sequence
  chemically synthesized
ttccactacatagcctgcctcc

SEQ ID NO: 1032830 - DNA, 22 bp, Artificial Sequence
  chemically synthesized
ttttccactacatagcctgcct

SEQ ID NO: 1032831 - DNA, 22 bp, Artificial Sequence
  chemically synthesized
tgaattcttttccactacatag

SEQ ID NO: 1032832 - DNA, 22 bp, Artificial Sequence
  chemically synthesized
tgtagtggaaaagaattcataa

SEQ ID NO: 1032833 - DNA, 22 bp, Artificial Sequence
  chemically synthesized
tatcgtgaccccagttatgaat

SEQ ID NO: 1032834 - DNA, 22 bp, Artificial Sequence
  chemically synthesized
ataactggggtcacgatataga

SEQ ID NO: 1032835 - DNA, 22 bp, Artificial Sequence
  chemically synthesized
gggtcacgatatagactctggc

SEQ ID NO: 1032836 - DNA, 22 bp, Artificial Sequence
  chemically synthesized
acacatgaagtatgtgccagag

SEQ ID NO: 1032837 - DNA, 22 bp, Artificial Sequence
  chemically synthesized
agctcacacatgaagtatgtgc

SEQ ID NO: 1032838 - DNA, 22 bp, Artificial Sequence
  chemically synthesized
aagctcacacatgaagtatgtg

SEQ ID NO: 1032839 - DNA, 22 bp, Artificial Sequence
  chemically synthesized
tcttaagctcacacatgaagta

SEQ ID NO: 1032840 - DNA, 22 bp, Artificial Sequence
  chemically synthesized
tggcacatacttcatgtgtgag

SEQ ID NO: 1032841 - DNA, 22 bp, Artificial Sequence
  chemically synthesized
gcacatacttcatgtgtgagct

SEQ ID NO: 1032842 - DNA, 22 bp, Artificial Sequence
  chemically synthesized
gaataaataattgtcttaagct

SEQ ID NO: 1032843 - DNA, 22 bp, Artificial Sequence
  chemically synthesized
agaataaataattgtcttaagc

SEQ ID NO: 1032844 - DNA, 22 bp, Artificial Sequence
  chemically synthesized
tagaataaataattgtcttaag

SEQ ID NO: 1032845 - DNA, 22 bp, Artificial Sequence
  chemically synthesized
catgtgtgagcttaagacaatt

SEQ ID NO: 1032846 - DNA, 22 bp, Artificial Sequence
  chemically synthesized
atgtgtgagcttaagacaatta

SEQ ID NO: 1032847 - DNA, 22 bp, Artificial Sequence
  chemically synthesized
agttttagaataaataattgtc

SEQ ID NO: 1032848 - DNA, 22 bp, Artificial Sequence
  chemically synthesized
gagttttagaataaataattgt

SEQ ID NO: 1032849 - DNA, 22 bp, Artificial Sequence
  chemically synthesized
tgagttttagaataaataattg

SEQ ID NO: 1032850 - DNA, 22 bp, Artificial Sequence
  chemically synthesized
aagacaattatttattctaaaa

SEQ ID NO: 1032851 - DNA, 22 bp, Artificial Sequence
  chemically synthesized
agacaattatttattctaaaac

SEQ ID NO: 1032852 - DNA, 22 bp, Artificial Sequence
  chemically synthesized
gagacgaataattttgagtttt

SEQ ID NO: 1032853 - DNA, 22 bp, Artificial Sequence
  chemically synthesized
agagacgaataattttgagttt

SEQ ID NO: 1032854 - DNA, 22 bp, Artificial Sequence
  chemically synthesized
tagagacgaataattttgagtt

SEQ ID NO: 1032855 - DNA, 22 bp, Artificial Sequence
  chemically synthesized
tttattctaaaactcaaaatta

SEQ ID NO: 1032856 - DNA, 22 bp, Artificial Sequence
  chemically synthesized
attttagagacgaataattttg

SEQ ID NO: 1032857 - DNA, 22 bp, Artificial Sequence
  chemically synthesized
attctaaaactcaaaattattc

SEQ ID NO: 1032858 - DNA, 22 bp, Artificial Sequence
  chemically synthesized
aattttagagacgaataatttt

SEQ ID NO: 1032859 - DNA, 22 bp, Artificial Sequence
  chemically synthesized
ttctaaaactcaaaattattcg

SEQ ID NO: 1032860 - DNA, 22 bp, Artificial Sequence
  chemically synthesized
taaaactcaaaattattcgtct

SEQ ID NO: 1032861 - DNA, 22 bp, Artificial Sequence
  chemically synthesized
aaactcaaaattattcgtctct

SEQ ID NO: 1032862 - DNA, 22 bp, Artificial Sequence
  chemically synthesized
aagagaaccttaattttagaga

SEQ ID NO: 1032863 - DNA, 22 bp, Artificial Sequence
  chemically synthesized
aaaattattcgtctctaaaatt

SEQ ID NO: 1032864 - DNA, 22 bp, Artificial Sequence
  chemically synthesized
tcaagagaaccttaattttaga

SEQ ID NO: 1032865 - DNA, 22 bp, Artificial Sequence
  chemically synthesized
attctcaagagaaccttaattt

SEQ ID NO: 1032866 - DNA, 22 bp, Artificial Sequence
  chemically synthesized
cattctcaagagaaccttaatt

SEQ ID NO: 1032867 - DNA, 22 bp, Artificial Sequence
  chemically synthesized
ttcgtctctaaaattaaggttc

SEQ ID NO: 1032868 - DNA, 22 bp, Artificial Sequence
  chemically synthesized
gtctctaaaattaaggttctct

SEQ ID NO: 1032869 - DNA, 22 bp, Artificial Sequence
  chemically synthesized
taaaattaaggttctcttgaga

SEQ ID NO: 1032870 - DNA, 22 bp, Artificial Sequence
  chemically synthesized
aaattaaggttctcttgagaat

SEQ ID NO: 1032871 - DNA, 22 bp, Artificial Sequence
  chemically synthesized
catatatcatttcattctcaag

SEQ ID NO: 1032872 - DNA, 22 bp, Artificial Sequence
  chemically synthesized
acatatatcatttcattctcaa

SEQ ID NO: 1032873 - DNA, 22 bp, Artificial Sequence
  chemically synthesized
aggttctcttgagaatgaaatg

SEQ ID NO: 1032874 - DNA, 22 bp, Artificial Sequence
  chemically synthesized
agagccttacatatatcatttc

SEQ ID NO: 1032875 - DNA, 22 bp, Artificial Sequence
  chemically synthesized
tcttgagaatgaaatgatatat

SEQ ID NO: 1032876 - DNA, 22 bp, Artificial Sequence
  chemically synthesized
ttgagaatgaaatgatatatgt

SEQ ID NO: 1032877 - DNA, 22 bp, Artificial Sequence
  chemically synthesized
gagaatgaaatgatatatgtaa

SEQ ID NO: 1032878 - DNA, 22 bp, Artificial Sequence
  chemically synthesized
agaatgaaatgatatatgtaag

SEQ ID NO: 1032879 - DNA, 22 bp, Artificial Sequence
  chemically synthesized
tgtgccaggcatgggttcagag

SEQ ID NO: 1032880 - DNA, 22 bp, Artificial Sequence
  chemically synthesized
ggcacacctatgtgccaggcat

SEQ ID NO: 1032881 - DNA, 22 bp, Artificial Sequence
  chemically synthesized
aggcacacctatgtgccaggca

SEQ ID NO: 1032882 - DNA, 22 bp, Artificial Sequence
  chemically synthesized
taggcacacctatgtgccaggc

SEQ ID NO: 1032883 - DNA, 22 bp, Artificial Sequence
  chemically synthesized
ttaggcacacctatgtgccagg

SEQ ID NO: 1032884 - DNA, 22 bp, Artificial Sequence
  chemically synthesized
tgaacccatgcctggcacatag

SEQ ID NO: 1032885 - DNA, 22 bp, Artificial Sequence
  chemically synthesized
tttttaggcacacctatgtgcc

SEQ ID NO: 1032886 - DNA, 22 bp, Artificial Sequence
  chemically synthesized
aacccatgcctggcacataggt

SEQ ID NO: 1032887 - DNA, 22 bp, Artificial Sequence
  chemically synthesized
atttttaggcacacctatgtgc

SEQ ID NO: 1032888 - DNA, 22 bp, Artificial Sequence
  chemically synthesized
gcacataggtgtgcctaaaaat

SEQ ID NO: 1032889 - DNA, 22 bp, Artificial Sequence
  chemically synthesized
cataagataaaagagcttattt

SEQ ID NO: 1032890 - DNA, 22 bp, Artificial Sequence
  chemically synthesized
gcataagataaaagagcttatt

SEQ ID NO: 1032891 - DNA, 22 bp, Artificial Sequence
  chemically synthesized
aaaataagctcttttatcttat

SEQ ID NO: 1032892 - DNA, 22 bp, Artificial Sequence
  chemically synthesized
gacacgtaggatggaccttgca

SEQ ID NO: 1032893 - DNA, 22 bp, Artificial Sequence
  chemically synthesized
ttttatcttatgcaaggtccat

SEQ ID NO: 1032894 - DNA, 22 bp, Artificial Sequence
  chemically synthesized
tggacacgtaggatggaccttg

SEQ ID NO: 1032895 - DNA, 22 bp, Artificial Sequence
  chemically synthesized
ctggacacgtaggatggacctt

SEQ ID NO: 1032896 - DNA, 22 bp, Artificial Sequence
  chemically synthesized
ttatcttatgcaaggtccatcc

SEQ ID NO: 1032897 - DNA, 22 bp, Artificial Sequence
  chemically synthesized
tctggacacgtaggatggacct

SEQ ID NO: 1032898 - DNA, 22 bp, Artificial Sequence
  chemically synthesized
tatcttatgcaaggtccatcct

SEQ ID NO: 1032899 - DNA, 22 bp, Artificial Sequence
  chemically synthesized
ttctggacacgtaggatggacc

SEQ ID NO: 1032900 - DNA, 22 bp, Artificial Sequence
  chemically synthesized
atcttatgcaaggtccatccta

SEQ ID NO: 1032901 - DNA, 22 bp, Artificial Sequence
  chemically synthesized
tttctggacacgtaggatggac

SEQ ID NO: 1032902 - DNA, 22 bp, Artificial Sequence
  chemically synthesized
tcttatgcaaggtccatcctac

SEQ ID NO: 1032903 - DNA, 22 bp, Artificial Sequence
  chemically synthesized
ctttttctggacacgtaggatg

SEQ ID NO: 1032904 - DNA, 22 bp, Artificial Sequence
  chemically synthesized
atgcaaggtccatcctacgtgt

SEQ ID NO: 1032905 - DNA, 22 bp, Artificial Sequence
  chemically synthesized
tgcaaggtccatcctacgtgtc

SEQ ID NO: 1032906 - DNA, 22 bp, Artificial Sequence
  chemically synthesized
aagacattactttttctggaca

SEQ ID NO: 1032907 - DNA, 22 bp, Artificial Sequence
  chemically synthesized
caagacattactttttctggac

SEQ ID NO: 1032908 - DNA, 22 bp, Artificial Sequence
  chemically synthesized
aaatttcaagacattacttttt

SEQ ID NO: 1032909 - DNA, 22 bp, Artificial Sequence
  chemically synthesized
cgtgtccagaaaaagtaatgtc

SEQ ID NO: 1032910 - DNA, 22 bp, Artificial Sequence
  chemically synthesized
tgacaatgtactgaaatttcaa

SEQ ID NO: 1032911 - DNA, 22 bp, Artificial Sequence
  chemically synthesized
atattatgacaatgtactgaaa

SEQ ID NO: 1032912 - DNA, 22 bp, Artificial Sequence
  chemically synthesized
aagctgatattatgacaatgta

SEQ ID NO: 1032913 - DNA, 22 bp, Artificial Sequence
  chemically synthesized
aaagctgatattatgacaatgt

SEQ ID NO: 1032914 - DNA, 22 bp, Artificial Sequence
  chemically synthesized
gaaatttcagtacattgtcata

SEQ ID NO: 1032915 - DNA, 22 bp, Artificial Sequence
  chemically synthesized
aaatttcagtacattgtcataa

SEQ ID NO: 1032916 - DNA, 22 bp, Artificial Sequence
  chemically synthesized
agtttaaagctgatattatgac

SEQ ID NO: 1032917 - DNA, 22 bp, Artificial Sequence
  chemically synthesized
cagtacattgtcataatatcag

SEQ ID NO: 1032918 - DNA, 22 bp, Artificial Sequence
  chemically synthesized
agtacattgtcataatatcagc

SEQ ID NO: 1032919 - DNA, 22 bp, Artificial Sequence
  chemically synthesized
tcataatatcagctttaaactt

SEQ ID NO: 1032920 - DNA, 22 bp, Artificial Sequence
  chemically synthesized
taaaacaaggacctaagtttaa

SEQ ID NO: 1032921 - DNA, 22 bp, Artificial Sequence
  chemically synthesized
accactataaaacaaggaccta

SEQ ID NO: 1032922 - DNA, 22 bp, Artificial Sequence
  chemically synthesized
actaaccactataaaacaagga

SEQ ID NO: 1032923 - DNA, 22 bp, Artificial Sequence
  chemically synthesized
taaacttaggtccttgttttat

SEQ ID NO: 1032924 - DNA, 22 bp, Artificial Sequence
  chemically synthesized
aaacttaggtccttgttttata

SEQ ID NO: 1032925 - DNA, 22 bp, Artificial Sequence
  chemically synthesized
aacttaggtccttgttttatag

SEQ ID NO: 1032926 - DNA, 22 bp, Artificial Sequence
  chemically synthesized
actgactaaccactataaaaca

SEQ ID NO: 1032927 - DNA, 22 bp, Artificial Sequence
  chemically synthesized
attcactgactaaccactataa

SEQ ID NO: 1032928 - DNA, 22 bp, Artificial Sequence
  chemically synthesized
aggtccttgttttatagtggtt

SEQ ID NO: 1032929 - DNA, 22 bp, Artificial Sequence
  chemically synthesized
ggtccttgttttatagtggtta

SEQ ID NO: 1032930 - DNA, 22 bp, Artificial Sequence
  chemically synthesized
ctaattcactgactaaccacta

SEQ ID NO: 1032931 - DNA, 22 bp, Artificial Sequence
  chemically synthesized
actaattcactgactaaccact

SEQ ID NO: 1032932 - DNA, 22 bp, Artificial Sequence
  chemically synthesized
cttactaattcactgactaacc

SEQ ID NO: 1032933 - DNA, 22 bp, Artificial Sequence
  chemically synthesized
gcttactaattcactgactaac

SEQ ID NO: 1032934 - DNA, 22 bp, Artificial Sequence
  chemically synthesized
gttttatagtggttagtcagtg

SEQ ID NO: 1032935 - DNA, 22 bp, Artificial Sequence
  chemically synthesized
tgcttactaattcactgactaa

SEQ ID NO: 1032936 - DNA, 22 bp, Artificial Sequence
  chemically synthesized
ttttatagtggttagtcagtga

SEQ ID NO: 1032937 - DNA, 22 bp, Artificial Sequence
  chemically synthesized
tatagtggttagtcagtgaatt

SEQ ID NO: 1032938 - DNA, 22 bp, Artificial Sequence
  chemically synthesized
atagtggttagtcagtgaatta

SEQ ID NO: 1032939 - DNA, 22 bp, Artificial Sequence
  chemically synthesized
tagtggttagtcagtgaattag

SEQ ID NO: 1032940 - DNA, 22 bp, Artificial Sequence
  chemically synthesized
gcaagttttgcttactaattca

SEQ ID NO: 1032941 - DNA, 22 bp, Artificial Sequence
  chemically synthesized
attagcaagttttgcttactaa

SEQ ID NO: 1032942 - DNA, 22 bp, Artificial Sequence
  chemically synthesized
aattagcaagttttgcttacta

SEQ ID NO: 1032943 - DNA, 22 bp, Artificial Sequence
  chemically synthesized
gtcagtgaattagtaagcaaaa

SEQ ID NO: 1032944 - DNA, 22 bp, Artificial Sequence
  chemically synthesized
aatttaattagcaagttttgct

SEQ ID NO: 1032945 - DNA, 22 bp, Artificial Sequence
  chemically synthesized
cctaaatttaattagcaagttt

SEQ ID NO: 1032946 - DNA, 22 bp, Artificial Sequence
  chemically synthesized
gtaagcaaaacttgctaattaa

SEQ ID NO: 1032947 - DNA, 22 bp, Artificial Sequence
  chemically synthesized
tataagttacctaaatttaatt

SEQ ID NO: 1032948 - DNA, 22 bp, Artificial Sequence
  chemically synthesized
agttatataagttacctaaatt

SEQ ID NO: 1032949 - DNA, 22 bp, Artificial Sequence
  chemically synthesized
gctaattaaatttaggtaactt

SEQ ID NO: 1032950 - DNA, 22 bp, Artificial Sequence
  chemically synthesized
ctaattaaatttaggtaactta

SEQ ID NO: 1032951 - DNA, 22 bp, Artificial Sequence
  chemically synthesized
gatcctaagttatataagttac

SEQ ID NO: 1032952 - DNA, 22 bp, Artificial Sequence
  chemically synthesized
attaaatttaggtaacttatat

SEQ ID NO: 1032953 - DNA, 22 bp, Artificial Sequence
  chemically synthesized
aatttaggtaacttatataact

SEQ ID NO: 1032954 - DNA, 22 bp, Artificial Sequence
  chemically synthesized
aagttggatcctaagttatata

SEQ ID NO: 1032955 - DNA, 22 bp, Artificial Sequence
  chemically synthesized
ctaaagttggatcctaagttat

SEQ ID NO: 1032956 - DNA, 22 bp, Artificial Sequence
  chemically synthesized
aggtaacttatataacttagga

SEQ ID NO: 1032957 - DNA, 22 bp, Artificial Sequence
  chemically synthesized
actaaagttggatcctaagtta

SEQ ID NO: 1032958 - DNA, 22 bp, Artificial Sequence
  chemically synthesized
ggtaacttatataacttaggat

SEQ ID NO: 1032959 - DNA, 22 bp, Artificial Sequence
  chemically synthesized
tactaaagttggatcctaagtt

SEQ ID NO: 1032960 - DNA, 22 bp, Artificial Sequence
  chemically synthesized
aattttactaaagttggatcct

SEQ ID NO: 1032961 - DNA, 22 bp, Artificial Sequence
  chemically synthesized
atataacttaggatccaacttt

SEQ ID NO: 1032962 - DNA, 22 bp, Artificial Sequence
  chemically synthesized
ctaaattttactaaagttggat

SEQ ID NO: 1032963 - DNA, 22 bp, Artificial Sequence
  chemically synthesized
tataacttaggatccaacttta

SEQ ID NO: 1032964 - DNA, 22 bp, Artificial Sequence
  chemically synthesized
cctaaattttactaaagttgga

SEQ ID NO: 1032965 - DNA, 22 bp, Artificial Sequence
  chemically synthesized
tcctaaattttactaaagttgg

SEQ ID NO: 1032966 - DNA, 22 bp, Artificial Sequence
  chemically synthesized
atgctttcctaaattttactaa

SEQ ID NO: 1032967 - DNA, 22 bp, Artificial Sequence
  chemically synthesized
aggatccaactttagtaaaatt

SEQ ID NO: 1032968 - DNA, 22 bp, Artificial Sequence
  chemically synthesized
ggatccaactttagtaaaattt

SEQ ID NO: 1032969 - DNA, 22 bp, Artificial Sequence
  chemically synthesized
gagggctaatgctttcctaaat

SEQ ID NO: 1032970 - DNA, 22 bp, Artificial Sequence
  chemically synthesized
agagggctaatgctttcctaaa

SEQ ID NO: 1032971 - DNA, 22 bp, Artificial Sequence
  chemically synthesized
cttagagggctaatgctttcct

SEQ ID NO: 1032972 - DNA, 22 bp, Artificial Sequence
  chemically synthesized
tagtaaaatttaggaaagcatt

SEQ ID NO: 1032973 - DNA, 22 bp, Artificial Sequence
  chemically synthesized
agtaaaatttaggaaagcatta

SEQ ID NO: 1032974 - DNA, 22 bp, Artificial Sequence
  chemically synthesized
gtaaaatttaggaaagcattag

SEQ ID NO: 1032975 - DNA, 22 bp, Artificial Sequence
  chemically synthesized
ctacttagagggctaatgcttt

SEQ ID NO: 1032976 - DNA, 22 bp, Artificial Sequence
  chemically synthesized
aggaaagcattagccctctaag

SEQ ID NO: 1032977 - DNA, 22 bp, Artificial Sequence
  chemically synthesized
ggaaagcattagccctctaagt

SEQ ID NO: 1032978 - DNA, 22 bp, Artificial Sequence
  chemically synthesized
tcatagcgctcctacttagagg

SEQ ID NO: 1032979 - DNA, 22 bp, Artificial Sequence
  chemically synthesized
gttgtcatagcgctcctactta

SEQ ID NO: 1032980 - DNA, 22 bp, Artificial Sequence
  chemically synthesized
ggttgtcatagcgctcctactt

SEQ ID NO: 1032981 - DNA, 22 bp, Artificial Sequence
  chemically synthesized
gccctctaagtaggagcgctat

SEQ ID NO: 1032982 - DNA, 22 bp, Artificial Sequence
  chemically synthesized
taagtaggagcgctatgacaac

SEQ ID NO: 1032983 - DNA, 22 bp, Artificial Sequence
  chemically synthesized
agtaggagcgctatgacaacca

SEQ ID NO: 1032984 - DNA, 22 bp, Artificial Sequence
  chemically synthesized
ggaaatgtgagaaatggagaat

SEQ ID NO: 1032985 - DNA, 22 bp, Artificial Sequence
  chemically synthesized
aggaaatgtgagaaatggagaa

SEQ ID NO: 1032986 - DNA, 22 bp, Artificial Sequence
  chemically synthesized
tgacaaccaaattctccatttc

SEQ ID NO: 1032987 - DNA, 22 bp, Artificial Sequence
  chemically synthesized
cttaggaaatgtgagaaatgga

SEQ ID NO: 1032988 - DNA, 22 bp, Artificial Sequence
  chemically synthesized
ctgcttaggaaatgtgagaaat

SEQ ID NO: 1032989 - DNA, 22 bp, Artificial Sequence
  chemically synthesized
agctactgcttaggaaatgtga

SEQ ID NO: 1032990 - DNA, 22 bp, Artificial Sequence
  chemically synthesized
aagctactgcttaggaaatgtg

SEQ ID NO: 1032991 - DNA, 22 bp, Artificial Sequence
  chemically synthesized
tccatttctcacatttcctaag

SEQ ID NO: 1032992 - DNA, 22 bp, Artificial Sequence
  chemically synthesized
catttctcacatttcctaagca

SEQ ID NO: 1032993 - DNA, 22 bp, Artificial Sequence
  chemically synthesized
gatttaagctactgcttaggaa

SEQ ID NO: 1032994 - DNA, 22 bp, Artificial Sequence
  chemically synthesized
agatttaagctactgcttagga

SEQ ID NO: 1032995 - DNA, 22 bp, Artificial Sequence
  chemically synthesized
ctcacatttcctaagcagtagc

SEQ ID NO: 1032996 - DNA, 22 bp, Artificial Sequence
  chemically synthesized
acttagatttaagctactgctt

SEQ ID NO: 1032997 - DNA, 22 bp, Artificial Sequence
  chemically synthesized
tcacatttcctaagcagtagct

SEQ ID NO: 1032998 - DNA, 22 bp, Artificial Sequence
  chemically synthesized
acatttcctaagcagtagctta

SEQ ID NO: 1032999 - DNA, 22 bp, Artificial Sequence
  chemically synthesized
tctgacttagatttaagctact

SEQ ID NO: 1033000 - DNA, 22 bp, Artificial Sequence
  chemically synthesized
gtctgacttagatttaagctac

SEQ ID NO: 1033001 - DNA, 22 bp, Artificial Sequence
  chemically synthesized
tgtctgacttagatttaagcta

SEQ ID NO: 1033002 - DNA, 22 bp, Artificial Sequence
  chemically synthesized
ttgtctgacttagatttaagct

SEQ ID NO: 1033003 - DNA, 22 bp, Artificial Sequence
  chemically synthesized
cctaagcagtagcttaaatcta

SEQ ID NO: 1033004 - DNA, 22 bp, Artificial Sequence
  chemically synthesized
ctaagcagtagcttaaatctaa

SEQ ID NO: 1033005 - DNA, 22 bp, Artificial Sequence
  chemically synthesized
agcagtagcttaaatctaagtc

SEQ ID NO: 1033006 - DNA, 22 bp, Artificial Sequence
  chemically synthesized
atcaacttttgtctgacttaga

SEQ ID NO: 1033007 - DNA, 22 bp, Artificial Sequence
  chemically synthesized
attcatcaacttttgtctgact

SEQ ID NO: 1033008 - DNA, 22 bp, Artificial Sequence
  chemically synthesized
tcattcatcaacttttgtctga

SEQ ID NO: 1033009 - DNA, 22 bp, Artificial Sequence
  chemically synthesized
ctcattcatcaacttttgtctg

SEQ ID NO: 1033010 - DNA, 22 bp, Artificial Sequence
  chemically synthesized
aaatctaagtcagacaaaagtt

SEQ ID NO: 1033011 - DNA, 22 bp, Artificial Sequence
  chemically synthesized
aatctaagtcagacaaaagttg

SEQ ID NO: 1033012 - DNA, 22 bp, Artificial Sequence
  chemically synthesized
agtcagacaaaagttgatgaat

SEQ ID NO: 1033013 - DNA, 22 bp, Artificial Sequence
  chemically synthesized
aaagtaatttctcattcatcaa

SEQ ID NO: 1033014 - DNA, 22 bp, Artificial Sequence
  chemically synthesized
tcaaagtaatttctcattcatc

SEQ ID NO: 1033015 - DNA, 22 bp, Artificial Sequence
  chemically synthesized
catattctcaaagtaatttctc

SEQ ID NO: 1033016 - DNA, 22 bp, Artificial Sequence
  chemically synthesized
tccatattctcaaagtaatttc

SEQ ID NO: 1033017 - DNA, 22 bp, Artificial Sequence
  chemically synthesized
ctccatattctcaaagtaattt

SEQ ID NO: 1033018 - DNA, 22 bp, Artificial Sequence
  chemically synthesized
atgaatgagaaattactttgag

SEQ ID NO: 1033019 - DNA, 22 bp, Artificial Sequence
  chemically synthesized
tttctccatattctcaaagtaa

SEQ ID NO: 1033020 - DNA, 22 bp, Artificial Sequence
  chemically synthesized
tgtttctccatattctcaaagt

SEQ ID NO: 1033021 - DNA, 22 bp, Artificial Sequence
  chemically synthesized
ctgtttctccatattctcaaag

SEQ ID NO: 1033022 - DNA, 22 bp, Artificial Sequence
  chemically synthesized
ttctgtttctccatattctcaa

SEQ ID NO: 1033023 - DNA, 22 bp, Artificial Sequence
  chemically synthesized
ctcttctgtttctccatattct

SEQ ID NO: 1033024 - DNA, 22 bp, Artificial Sequence
  chemically synthesized
ctttgagaatatggagaaacag

SEQ ID NO: 1033025 - DNA, 22 bp, Artificial Sequence
  chemically synthesized
ggtacctactcttctgtttctc

SEQ ID NO: 1033026 - DNA, 22 bp, Artificial Sequence
  chemically synthesized
tgagaatatggagaaacagaag

SEQ ID NO: 1033027 - DNA, 22 bp, Artificial Sequence
  chemically synthesized
gagaatatggagaaacagaaga

SEQ ID NO: 1033028 - DNA, 22 bp, Artificial Sequence
  chemically synthesized
agaatatggagaaacagaagag

SEQ ID NO: 1033029 - DNA, 22 bp, Artificial Sequence
  chemically synthesized
cctaggtacctactcttctgtt

SEQ ID NO: 1033030 - DNA, 22 bp, Artificial Sequence
  chemically synthesized
ccctaggtacctactcttctgt

SEQ ID NO: 1033031 - DNA, 22 bp, Artificial Sequence
  chemically synthesized
atcatttccctaggtacctact

SEQ ID NO: 1033032 - DNA, 22 bp, Artificial Sequence
  chemically synthesized
catcatttccctaggtacctac

SEQ ID NO: 1033033 - DNA, 22 bp, Artificial Sequence
  chemically synthesized
tcatcatttccctaggtaccta

SEQ ID NO: 1033034 - DNA, 22 bp, Artificial Sequence
  chemically synthesized
ccaatataagagtagaagtttt

SEQ ID NO: 1033035 - DNA, 22 bp, Artificial Sequence
  chemically synthesized
gggaaatgatgaaaacttctac

SEQ ID NO: 1033036 - DNA, 22 bp, Artificial Sequence
  chemically synthesized
tgccaatataagagtagaagtt

SEQ ID NO: 1033037 - DNA, 22 bp, Artificial Sequence
  chemically synthesized
aattctgccaatataagagtag

SEQ ID NO: 1033038 - DNA, 22 bp, Artificial Sequence
  chemically synthesized
ctaaattctgccaatataagag

SEQ ID NO: 1033039 - DNA, 22 bp, Artificial Sequence
  chemically synthesized
actaaattctgccaatataaga

SEQ ID NO: 1033040 - DNA, 22 bp, Artificial Sequence
  chemically synthesized
gcttactaaattctgccaatat

SEQ ID NO: 1033041 - DNA, 22 bp, Artificial Sequence
  chemically synthesized
tggcttactaaattctgccaat

SEQ ID NO: 1033042 - DNA, 22 bp, Artificial Sequence
  chemically synthesized
ctactcttatattggcagaatt

SEQ ID NO: 1033043 - DNA, 22 bp, Artificial Sequence
  chemically synthesized
tactcttatattggcagaattt

SEQ ID NO: 1033044 - DNA, 22 bp, Artificial Sequence
  chemically synthesized
ctctggcttactaaattctgcc

SEQ ID NO: 1033045 - DNA, 22 bp, Artificial Sequence
  chemically synthesized
actctggcttactaaattctgc

SEQ ID NO: 1033046 - DNA, 22 bp, Artificial Sequence
  chemically synthesized
ctcttatattggcagaatttag

SEQ ID NO: 1033047 - DNA, 22 bp, Artificial Sequence
  chemically synthesized
ttatattggcagaatttagtaa

SEQ ID NO: 1033048 - DNA, 22 bp, Artificial Sequence
  chemically synthesized
atattggcagaatttagtaagc

SEQ ID NO: 1033049 - DNA, 22 bp, Artificial Sequence
  chemically synthesized
tattggcagaatttagtaagcc

SEQ ID NO: 1033050 - DNA, 22 bp, Artificial Sequence
  chemically synthesized
gcagaatttagtaagccagagt

SEQ ID NO: 1033051 - DNA, 22 bp, Artificial Sequence
  chemically synthesized
agcccgcatcttactctggctt

SEQ ID NO: 1033052 - DNA, 22 bp, Artificial Sequence
  chemically synthesized
attcagcccgcatcttactctg

SEQ ID NO: 1033053 - DNA, 22 bp, Artificial Sequence
  chemically synthesized
tgattcagcccgcatcttactc

SEQ ID NO: 1033054 - DNA, 22 bp, Artificial Sequence
  chemically synthesized
agtaagccagagtaagatgcgg

SEQ ID NO: 1033055 - DNA, 22 bp, Artificial Sequence
  chemically synthesized
gtaagccagagtaagatgcggg

SEQ ID NO: 1033056 - DNA, 22 bp, Artificial Sequence
  chemically synthesized
tgaactctgattcagcccgcat

SEQ ID NO: 1033057 - DNA, 22 bp, Artificial Sequence
  chemically synthesized
atgaactctgattcagcccgca

SEQ ID NO: 1033058 - DNA, 22 bp, Artificial Sequence
  chemically synthesized
tatgaactctgattcagcccgc

SEQ ID NO: 1033059 - DNA, 22 bp, Artificial Sequence
  chemically synthesized
attttatgaactctgattcagc

SEQ ID NO: 1033060 - DNA, 22 bp, Artificial Sequence
  chemically synthesized
ctaattttatgaactctgattc

SEQ ID NO: 1033061 - DNA, 22 bp, Artificial Sequence
  chemically synthesized
cctaattttatgaactctgatt

SEQ ID NO: 1033062 - DNA, 22 bp, Artificial Sequence
  chemically synthesized
tcctaattttatgaactctgat

SEQ ID NO: 1033063 - DNA, 22 bp, Artificial Sequence
  chemically synthesized
tttcctaattttatgaactctg

SEQ ID NO: 1033064 - DNA, 22 bp, Artificial Sequence
  chemically synthesized
ctttcctaattttatgaactct

SEQ ID NO: 1033065 - DNA, 22 bp, Artificial Sequence
  chemically synthesized
tctttcctaattttatgaactc

SEQ ID NO: 1033066 - DNA, 22 bp, Artificial Sequence
  chemically synthesized
ttctttcctaattttatgaact

SEQ ID NO: 1033067 - DNA, 22 bp, Artificial Sequence
  chemically synthesized
tttctttcctaattttatgaac

SEQ ID NO: 1033068 - DNA, 22 bp, Artificial Sequence
  chemically synthesized
ttttctttcctaattttatgaa

SEQ ID NO: 1033069 - DNA, 22 bp, Artificial Sequence
  chemically synthesized
tttttctttcctaattttatga

SEQ ID NO: 1033070 - DNA, 22 bp, Artificial Sequence
  chemically synthesized
ttttttctttcctaattttatg

SEQ ID NO: 1033071 - DNA, 22 bp, Artificial Sequence
  chemically synthesized
tttttttctttcctaattttat

SEQ ID NO: 1033072 - DNA, 22 bp, Artificial Sequence
  chemically synthesized
aatcagagttcataaaattagg

SEQ ID NO: 1033073 - DNA, 22 bp, Artificial Sequence
  chemically synthesized
cctttttttttctttcctaatt

SEQ ID NO: 1033074 - DNA, 22 bp, Artificial Sequence
  chemically synthesized
ccctttttttttctttcctaat

SEQ ID NO: 1033075 - DNA, 22 bp, Artificial Sequence
  chemically synthesized
acccttccctttttttttcttt

SEQ ID NO: 1033076 - DNA, 22 bp, Artificial Sequence
  chemically synthesized
ataaaattaggaaagaaaaaaa

SEQ ID NO: 1033077 - DNA, 22 bp, Artificial Sequence
  chemically synthesized
gttaacccttcccttttttttt

SEQ ID NO: 1033078 - DNA, 22 bp, Artificial Sequence
  chemically synthesized
agttaacccttccctttttttt

SEQ ID NO: 1033079 - DNA, 22 bp, Artificial Sequence
  chemically synthesized
tagttaacccttcccttttttt

SEQ ID NO: 1033080 - DNA, 22 bp, Artificial Sequence
  chemically synthesized
ggaaagaaaaaaaaagggaagg

SEQ ID NO: 1033081 - DNA, 22 bp, Artificial Sequence
  chemically synthesized
tctttagttaacccttcccttt

SEQ ID NO: 1033082 - DNA, 22 bp, Artificial Sequence
  chemically synthesized
gtctttagttaacccttccctt

SEQ ID NO: 1033083 - DNA, 22 bp, Artificial Sequence
  chemically synthesized
tgtctttagttaacccttccct

SEQ ID NO: 1033084 - DNA, 22 bp, Artificial Sequence
  chemically synthesized
actaaagacaaagttgcccttt

SEQ ID NO: 1033085 - DNA, 22 bp, Artificial Sequence
  chemically synthesized
agaagagtgtaaaaagggcaac

SEQ ID NO: 1033086 - DNA, 22 bp, Artificial Sequence
  chemically synthesized
aagacaaagttgccctttttac

SEQ ID NO: 1033087 - DNA, 22 bp, Artificial Sequence
  chemically synthesized
aggagccctaagaagagtgtaa

SEQ ID NO: 1033088 - DNA, 22 bp, Artificial Sequence
  chemically synthesized
aaggagccctaagaagagtgta

SEQ ID NO: 1033089 - DNA, 22 bp, Artificial Sequence
  chemically synthesized
tttaaggagccctaagaagagt

SEQ ID NO: 1033090 - DNA, 22 bp, Artificial Sequence
  chemically synthesized
atttaaggagccctaagaagag

SEQ ID NO: 1033091 - DNA, 22 bp, Artificial Sequence
  chemically synthesized
ccctttttacactcttcttagg

SEQ ID NO: 1033092 - DNA, 22 bp, Artificial Sequence
  chemically synthesized
tatttaaggagccctaagaaga

SEQ ID NO: 1033093 - DNA, 22 bp, Artificial Sequence
  chemically synthesized
ttttatttaaggagccctaaga

SEQ ID NO: 1033094 - DNA, 22 bp, Artificial Sequence
  chemically synthesized
gttttatttaaggagccctaag

SEQ ID NO: 1033095 - DNA, 22 bp, Artificial Sequence
  chemically synthesized
tttacactcttcttagggctcc

SEQ ID NO: 1033096 - DNA, 22 bp, Artificial Sequence
  chemically synthesized
tgttttatttaaggagccctaa

SEQ ID NO: 1033097 - DNA, 22 bp, Artificial Sequence
  chemically synthesized
ttacactcttcttagggctcct

SEQ ID NO: 1033098 - DNA, 22 bp, Artificial Sequence
  chemically synthesized
tacactcttcttagggctcctt

SEQ ID NO: 1033099 - DNA, 22 bp, Artificial Sequence
  chemically synthesized
acactcttcttagggctcctta

SEQ ID NO: 1033100 - DNA, 22 bp, Artificial Sequence
  chemically synthesized
ttttgttttatttaaggagccc

SEQ ID NO: 1033101 - DNA, 22 bp, Artificial Sequence
  chemically synthesized
cactcttcttagggctccttaa

SEQ ID NO: 1033102 - DNA, 22 bp, Artificial Sequence
  chemically synthesized
gttttgttttatttaaggagcc

SEQ ID NO: 1033103 - DNA, 22 bp, Artificial Sequence
  chemically synthesized
tgttttgttttatttaaggagc

SEQ ID NO: 1033104 - DNA, 22 bp, Artificial Sequence
  chemically synthesized
ttttgttttgttttatttaagg

SEQ ID NO: 1033105 - DNA, 22 bp, Artificial Sequence
  chemically synthesized
ttcttagggctccttaaataaa

SEQ ID NO: 1033106 - DNA, 22 bp, Artificial Sequence
  chemically synthesized
gttttgttttgttttatttaag

SEQ ID NO: 1033107 - DNA, 22 bp, Artificial Sequence
  chemically synthesized
tgttttgttttgttttatttaa

SEQ ID NO: 1033108 - DNA, 22 bp, Artificial Sequence
  chemically synthesized
cttagggctccttaaataaaac

SEQ ID NO: 1033109 - DNA, 22 bp, Artificial Sequence
  chemically synthesized
ttagggctccttaaataaaaca

SEQ ID NO: 1033110 - DNA, 22 bp, Artificial Sequence
  chemically synthesized
ttttgttttgttttgttttatt

SEQ ID NO: 1033111 - DNA, 22 bp, Artificial Sequence
  chemically synthesized
agggctccttaaataaaacaaa

SEQ ID NO: 1033112 - DNA, 22 bp, Artificial Sequence
  chemically synthesized
gttttgttttgttttgttttat

SEQ ID NO: 1033113 - DNA, 22 bp, Artificial Sequence
  chemically synthesized
gggctccttaaataaaacaaaa

SEQ ID NO: 1033114 - DNA, 22 bp, Artificial Sequence
  chemically synthesized
tgttttgttttgttttgtttta

SEQ ID NO: 1033115 - DNA, 22 bp, Artificial Sequence
  chemically synthesized
ttttgttttgttttgttttgtt

SEQ ID NO: 1033116 - DNA, 22 bp, Artificial Sequence
  chemically synthesized
cttaaataaaacaaaacaaaac

SEQ ID NO: 1033117 - DNA, 22 bp, Artificial Sequence
  chemically synthesized
ctgttttgttttgttttgtttt

SEQ ID NO: 1033118 - DNA, 22 bp, Artificial Sequence
  chemically synthesized
aaataaaacaaaacaaaacaaa

SEQ ID NO: 1033119 - DNA, 22 bp, Artificial Sequence
  chemically synthesized
aataaaacaaaacaaaacaaaa

SEQ ID NO: 1033120 - DNA, 22 bp, Artificial Sequence
  chemically synthesized
cacccggctcctgttttgtttt

SEQ ID NO: 1033121 - DNA, 22 bp, Artificial Sequence
  chemically synthesized
cagaggcacaccactgcacccg

SEQ ID NO: 1033122 - DNA, 22 bp, Artificial Sequence
  chemically synthesized
agaagatgggattacagaggca

SEQ ID NO: 1033123 - DNA, 22 bp, Artificial Sequence
  chemically synthesized
tgagaagatgggattacagagg

SEQ ID NO: 1033124 - DNA, 22 bp, Artificial Sequence
  chemically synthesized
ctgagaagatgggattacagag

SEQ ID NO: 1033125 - DNA, 22 bp, Artificial Sequence
  chemically synthesized
agccttctgagaagatgggatt

SEQ ID NO: 1033126 - DNA, 22 bp, Artificial Sequence
  chemically synthesized
ccacctcagccttctgagaaga

SEQ ID NO: 1033127 - DNA, 22 bp, Artificial Sequence
  chemically synthesized
tgtaatcccatcttctcagaag

SEQ ID NO: 1033128 - DNA, 22 bp, Artificial Sequence
  chemically synthesized
taatcccatcttctcagaaggc

SEQ ID NO: 1033129 - DNA, 22 bp, Artificial Sequence
  chemically synthesized
gatgaagtaatcctcccacctc

SEQ ID NO: 1033130 - DNA, 22 bp, Artificial Sequence
  chemically synthesized
ctcagaaggctgaggtgggagg

SEQ ID NO: 1033131 - DNA, 22 bp, Artificial Sequence
  chemically synthesized
tcagaaggctgaggtgggagga

SEQ ID NO: 1033132 - DNA, 22 bp, Artificial Sequence
  chemically synthesized
agaaggctgaggtgggaggatt

SEQ ID NO: 1033133 - DNA, 22 bp, Artificial Sequence
  chemically synthesized
cctggatgaagtaatcctccca

SEQ ID NO: 1033134 - DNA, 22 bp, Artificial Sequence
  chemically synthesized
aaactccctggatgaagtaatc

SEQ ID NO: 1033135 - DNA, 22 bp, Artificial Sequence
  chemically synthesized
aggtgggaggattacttcatcc

SEQ ID NO: 1033136 - DNA, 22 bp, Artificial Sequence
  chemically synthesized
gtctcaaactccctggatgaag

SEQ ID NO: 1033137 - DNA, 22 bp, Artificial Sequence
  chemically synthesized
gggctggtctcaaactccctgg

SEQ ID NO: 1033138 - DNA, 22 bp, Artificial Sequence
  chemically synthesized
ctggggctggtctcaaactccc

SEQ ID NO: 1033139 - DNA, 22 bp, Artificial Sequence
  chemically synthesized
cttcatccagggagtttgagac

SEQ ID NO: 1033140 - DNA, 22 bp, Artificial Sequence
  chemically synthesized
catccagggagtttgagaccag

SEQ ID NO: 1033141 - DNA, 22 bp, Artificial Sequence
  chemically synthesized
atccagggagtttgagaccagc

SEQ ID NO: 1033142 - DNA, 22 bp, Artificial Sequence
  chemically synthesized
agtgagagtgttgctggggctg

SEQ ID NO: 1033143 - DNA, 22 bp, Artificial Sequence
  chemically synthesized
gagtgagagtgttgctggggct

SEQ ID NO: 1033144 - DNA, 22 bp, Artificial Sequence
  chemically synthesized
tgagtgagagtgttgctggggc

SEQ ID NO: 1033145 - DNA, 22 bp, Artificial Sequence
  chemically synthesized
ttgagtgagagtgttgctgggg

SEQ ID NO: 1033146 - DNA, 22 bp, Artificial Sequence
  chemically synthesized
tttgagtgagagtgttgctggg

SEQ ID NO: 1033147 - DNA, 22 bp, Artificial Sequence
  chemically synthesized
ttttgagtgagagtgttgctgg

SEQ ID NO: 1033148 - DNA, 22 bp, Artificial Sequence
  chemically synthesized
tttttgagtgagagtgttgctg

SEQ ID NO: 1033149 - DNA, 22 bp, Artificial Sequence
  chemically synthesized
gagaccagccccagcaacactc

SEQ ID NO: 1033150 - DNA, 22 bp, Artificial Sequence
  chemically synthesized
ttttttgagtgagagtgttgct

SEQ ID NO: 1033151 - DNA, 22 bp, Artificial Sequence
  chemically synthesized
agaccagccccagcaacactct

SEQ ID NO: 1033152 - DNA, 22 bp, Artificial Sequence
  chemically synthesized
tttttttttgagtgagagtgtt

SEQ ID NO: 1033153 - DNA, 22 bp, Artificial Sequence
  chemically synthesized
atttttttttgagtgagagtgt

SEQ ID NO: 1033154 - DNA, 22 bp, Artificial Sequence
  chemically synthesized
tttatttttttttgagtgagag

SEQ ID NO: 1033155 - DNA, 22 bp, Artificial Sequence
  chemically synthesized
atttatttttttttgagtgaga

SEQ ID NO: 1033156 - DNA, 22 bp, Artificial Sequence
  chemically synthesized
cttatttatttttttttgagtg

SEQ ID NO: 1033157 - DNA, 22 bp, Artificial Sequence
  chemically synthesized
acttatttatttttttttgagt

SEQ ID NO: 1033158 - DNA, 22 bp, Artificial Sequence
  chemically synthesized
tacttatttatttttttttgag

SEQ ID NO: 1033159 - DNA, 22 bp, Artificial Sequence
  chemically synthesized
ttacttatttatttttttttga

SEQ ID NO: 1033160 - DNA, 22 bp, Artificial Sequence
  chemically synthesized
ttttacttatttattttttttt

SEQ ID NO: 1033161 - DNA, 22 bp, Artificial Sequence
  chemically synthesized
cttttacttatttatttttttt

SEQ ID NO: 1033162 - DNA, 22 bp, Artificial Sequence
  chemically synthesized
tcttttacttatttattttttt

SEQ ID NO: 1033163 - DNA, 22 bp, Artificial Sequence
  chemically synthesized
ttcttttacttatttatttttt

SEQ ID NO: 1033164 - DNA, 22 bp, Artificial Sequence
  chemically synthesized
tcactcaaaaaaaaataaataa

SEQ ID NO: 1033165 - DNA, 22 bp, Artificial Sequence
  chemically synthesized
tttttcttttacttatttattt

SEQ ID NO: 1033166 - DNA, 22 bp, Artificial Sequence
  chemically synthesized
actcaaaaaaaaataaataagt

SEQ ID NO: 1033167 - DNA, 22 bp, Artificial Sequence
  chemically synthesized
aaaaaaaaataaataagtaaaa

SEQ ID NO: 1033168 - DNA, 22 bp, Artificial Sequence
  chemically synthesized
aaaagagcgttatttttctttt

SEQ ID NO: 1033169 - DNA, 22 bp, Artificial Sequence
  chemically synthesized
aaaaagagcgttatttttcttt

SEQ ID NO: 1033170 - DNA, 22 bp, Artificial Sequence
  chemically synthesized
aacatgtatatttaaaaagagc

SEQ ID NO: 1033171 - DNA, 22 bp, Artificial Sequence
  chemically synthesized
caacatgtatatttaaaaagag

SEQ ID NO: 1033172 - DNA, 22 bp, Artificial Sequence
  chemically synthesized
acagtcttcaacatgtatattt

SEQ ID NO: 1033173 - DNA, 22 bp, Artificial Sequence
  chemically synthesized
tttttaaatatacatgttgaag

SEQ ID NO: 1033174 - DNA, 22 bp, Artificial Sequence
  chemically synthesized
tttaaatatacatgttgaagac

SEQ ID NO: 1033175 - DNA, 22 bp, Artificial Sequence
  chemically synthesized
ttaaatatacatgttgaagact

SEQ ID NO: 1033176 - DNA, 22 bp, Artificial Sequence
  chemically synthesized
taaatatacatgttgaagactg

SEQ ID NO: 1033177 - DNA, 22 bp, Artificial Sequence
  chemically synthesized
gaagagaactaacagtcttcaa

SEQ ID NO: 1033178 - DNA, 22 bp, Artificial Sequence
  chemically synthesized
aaatatacatgttgaagactgt

SEQ ID NO: 1033179 - DNA, 22 bp, Artificial Sequence
  chemically synthesized
aatatacatgttgaagactgtt

SEQ ID NO: 1033180 - DNA, 22 bp, Artificial Sequence
  chemically synthesized
aagactgttagttctcttccaa

SEQ ID NO: 1033181 - DNA, 22 bp, Artificial Sequence
  chemically synthesized
ttagttctcttccaatattctt

SEQ ID NO: 1033182 - DNA, 22 bp, Artificial Sequence
  chemically synthesized
gttctcttccaatattcttttt

SEQ ID NO: 1033183 - DNA, 22 bp, Artificial Sequence
  chemically synthesized
agtcatgaaaaaaaaaaaaaga

SEQ ID NO: 1033184 - DNA, 22 bp, Artificial Sequence
  chemically synthesized
tcttccaatattcttttttttt

SEQ ID NO: 1033185 - DNA, 22 bp, Artificial Sequence
  chemically synthesized
ttccaatattcttttttttttt

SEQ ID NO: 1033186 - DNA, 22 bp, Artificial Sequence
  chemically synthesized
ttcagtcatgaaaaaaaaaaaa

SEQ ID NO: 1033187 - DNA, 22 bp, Artificial Sequence
  chemically synthesized
ccaatattcttttttttttttt

SEQ ID NO: 1033188 - DNA, 22 bp, Artificial Sequence
  chemically synthesized
caatattctttttttttttttc

SEQ ID NO: 1033189 - DNA, 22 bp, Artificial Sequence
  chemically synthesized
aaaactgttcagtcatgaaaaa

SEQ ID NO: 1033190 - DNA, 22 bp, Artificial Sequence
  chemically synthesized
ctaaaaactgttcagtcatgaa

SEQ ID NO: 1033191 - DNA, 22 bp, Artificial Sequence
  chemically synthesized
tttttttttttttcatgactga

SEQ ID NO: 1033192 - DNA, 22 bp, Artificial Sequence
  chemically synthesized
tgctaaaaactgttcagtcatg

SEQ ID NO: 1033193 - DNA, 22 bp, Artificial Sequence
  chemically synthesized
tttttttttttcatgactgaac

SEQ ID NO: 1033194 - DNA, 22 bp, Artificial Sequence
  chemically synthesized
ttttttttttcatgactgaaca

SEQ ID NO: 1033195 - DNA, 22 bp, Artificial Sequence
  chemically synthesized
tttttttttcatgactgaacag

SEQ ID NO: 1033196 - DNA, 22 bp, Artificial Sequence
  chemically synthesized
ttttttttcatgactgaacagt

SEQ ID NO: 1033197 - DNA, 22 bp, Artificial Sequence
  chemically synthesized
tttttttcatgactgaacagtt

SEQ ID NO: 1033198 - DNA, 22 bp, Artificial Sequence
  chemically synthesized
ttttttcatgactgaacagttt

SEQ ID NO: 1033199 - DNA, 22 bp, Artificial Sequence
  chemically synthesized
tttttcatgactgaacagtttt

SEQ ID NO: 1033200 - DNA, 22 bp, Artificial Sequence
  chemically synthesized
ttttcatgactgaacagttttt

SEQ ID NO: 1033201 - DNA, 22 bp, Artificial Sequence
  chemically synthesized
tttcatgactgaacagttttta

SEQ ID NO: 1033202 - DNA, 22 bp, Artificial Sequence
  chemically synthesized
ttcatgactgaacagtttttag

SEQ ID NO: 1033203 - DNA, 22 bp, Artificial Sequence
  chemically synthesized
acatgtgctctgctaaaaactg

SEQ ID NO: 1033204 - DNA, 22 bp, Artificial Sequence
  chemically synthesized
tcatgactgaacagtttttagc

SEQ ID NO: 1033205 - DNA, 22 bp, Artificial Sequence
  chemically synthesized
cacatgtgctctgctaaaaact

SEQ ID NO: 1033206 - DNA, 22 bp, Artificial Sequence
  chemically synthesized
catgactgaacagtttttagca

SEQ ID NO: 1033207 - DNA, 22 bp, Artificial Sequence
  chemically synthesized
atgactgaacagtttttagcag

SEQ ID NO: 1033208 - DNA, 22 bp, Artificial Sequence
  chemically synthesized
tttcacatgtgctctgctaaaa

SEQ ID NO: 1033209 - DNA, 22 bp, Artificial Sequence
  chemically synthesized
atttcacatgtgctctgctaaa

SEQ ID NO: 1033210 - DNA, 22 bp, Artificial Sequence
  chemically synthesized
aacagtttttagcagagcacat

SEQ ID NO: 1033211 - DNA, 22 bp, Artificial Sequence
  chemically synthesized
ggaaatgtgtttatttcacatg

SEQ ID NO: 1033212 - DNA, 22 bp, Artificial Sequence
  chemically synthesized
ttagcagagcacatgtgaaata

SEQ ID NO: 1033213 - DNA, 22 bp, Artificial Sequence
  chemically synthesized
tagcagagcacatgtgaaataa

SEQ ID NO: 1033214 - DNA, 22 bp, Artificial Sequence
  chemically synthesized
agcagagcacatgtgaaataaa

SEQ ID NO: 1033215 - DNA, 22 bp, Artificial Sequence
  chemically synthesized
gcagagcacatgtgaaataaac

SEQ ID NO: 1033216 - DNA, 22 bp, Artificial Sequence
  chemically synthesized
caagtggggctgggaaatgtgt

SEQ ID NO: 1033217 - DNA, 22 bp, Artificial Sequence
  chemically synthesized
agctgcaagtggggctgggaaa

SEQ ID NO: 1033218 - DNA, 22 bp, Artificial Sequence
  chemically synthesized
cccagccccacttgcagcttag

SEQ ID NO: 1033219 - DNA, 22 bp, Artificial Sequence
  chemically synthesized
ccagccccacttgcagcttaga

SEQ ID NO: 1033220 - DNA, 22 bp, Artificial Sequence
  chemically synthesized
tcacatggccacatctaagctg

SEQ ID NO: 1033221 - DNA, 22 bp, Artificial Sequence
  chemically synthesized
gcagcttagatgtggccatgtg

SEQ ID NO: 1033222 - DNA, 22 bp, Artificial Sequence
  chemically synthesized
cagcttagatgtggccatgtga

SEQ ID NO: 1033223 - DNA, 22 bp, Artificial Sequence
  chemically synthesized
gccagatgtctgtcacatggcc

SEQ ID NO: 1033224 - DNA, 22 bp, Artificial Sequence
  chemically synthesized
attggccagatgtctgtcacat

SEQ ID NO: 1033225 - DNA, 22 bp, Artificial Sequence
  chemically synthesized
cattggccagatgtctgtcaca

SEQ ID NO: 1033226 - DNA, 22 bp, Artificial Sequence
  chemically synthesized
agatgtggccatgtgacagaca

SEQ ID NO: 1033227 - DNA, 22 bp, Artificial Sequence
  chemically synthesized
gatgtggccatgtgacagacat

SEQ ID NO: 1033228 - DNA, 22 bp, Artificial Sequence
  chemically synthesized
cgcttcattggccagatgtctg

SEQ ID NO: 1033229 - DNA, 22 bp, Artificial Sequence
  chemically synthesized
acgcttcattggccagatgtct

SEQ ID NO: 1033230 - DNA, 22 bp, Artificial Sequence
  chemically synthesized
cacttacgcttcattggccaga

SEQ ID NO: 1033231 - DNA, 22 bp, Artificial Sequence
  chemically synthesized
ccacttacgcttcattggccag

SEQ ID NO: 1033232 - DNA, 22 bp, Artificial Sequence
  chemically synthesized
tatttccacttacgcttcattg

SEQ ID NO: 1033233 - DNA, 22 bp, Artificial Sequence
  chemically synthesized
ccatgttatatttccacttacg

SEQ ID NO: 1033234 - DNA, 22 bp, Artificial Sequence
  chemically synthesized
gccaatgaagcgtaagtggaaa

SEQ ID NO: 1033235 - DNA, 22 bp, Artificial Sequence
  chemically synthesized
gtgggagctgccatgttatatt

SEQ ID NO: 1033236 - DNA, 22 bp, Artificial Sequence
  chemically synthesized
cgtgggagctgccatgttatat

SEQ ID NO: 1033237 - DNA, 22 bp, Artificial Sequence
  chemically synthesized
gggaagtttcgtgggagctgcc

SEQ ID NO: 1033238 - DNA, 22 bp, Artificial Sequence
  chemically synthesized
agggaagtttcgtgggagctgc

SEQ ID NO: 1033239 - DNA, 22 bp, Artificial Sequence
  chemically synthesized
tagggaagtttcgtgggagctg

SEQ ID NO: 1033240 - DNA, 22 bp, Artificial Sequence
  chemically synthesized
ttagggaagtttcgtgggagct

SEQ ID NO: 1033241 - DNA, 22 bp, Artificial Sequence
  chemically synthesized
tcttttagggaagtttcgtggg

SEQ ID NO: 1033242 - DNA, 22 bp, Artificial Sequence
  chemically synthesized
ccacgaaacttccctaaaagac

SEQ ID NO: 1033243 - DNA, 22 bp, Artificial Sequence
  chemically synthesized
ccctaaaagacaattggtatgc

SEQ ID NO: 1033244 - DNA, 22 bp, Artificial Sequence
  chemically synthesized
cctaaaagacaattggtatgca

SEQ ID NO: 1033245 - DNA, 22 bp, Artificial Sequence
  chemically synthesized
aaagacaattggtatgcaccct

SEQ ID NO: 1033246 - DNA, 22 bp, Artificial Sequence
  chemically synthesized
gtatgcaccctttgacccttct

SEQ ID NO: 1033247 - DNA, 22 bp, Artificial Sequence
  chemically synthesized
tgacccttcttctggccttctt

SEQ ID NO: 1033248 - DNA, 22 bp, Artificial Sequence
  chemically synthesized
caagaaggatgtaagaaggcca

SEQ ID NO: 1033249 - DNA, 22 bp, Artificial Sequence
  chemically synthesized
gacccttcttctggccttctta

SEQ ID NO: 1033250 - DNA, 22 bp, Artificial Sequence
  chemically synthesized
acccttcttctggccttcttac

SEQ ID NO: 1033251 - DNA, 22 bp, Artificial Sequence
  chemically synthesized
cttctggccttcttacatcctt

SEQ ID NO: 1033252 - DNA, 22 bp, Artificial Sequence
  chemically synthesized
ttctggccttcttacatccttc

SEQ ID NO: 1033253 - DNA, 22 bp, Artificial Sequence
  chemically synthesized
ctggccttcttacatccttctt

SEQ ID NO: 1033254 - DNA, 22 bp, Artificial Sequence
  chemically synthesized
tggccttcttacatccttcttg

SEQ ID NO: 1033255 - DNA, 22 bp, Artificial Sequence
  chemically synthesized
gccttcttacatccttcttgga

SEQ ID NO: 1033256 - DNA, 22 bp, Artificial Sequence
  chemically synthesized
atgacatccacattccaagaag

SEQ ID NO: 1033257 - DNA, 22 bp, Artificial Sequence
  chemically synthesized
tcatgacatccacattccaaga

SEQ ID NO: 1033258 - DNA, 22 bp, Artificial Sequence
  chemically synthesized
cttacatccttcttggaatgtg

SEQ ID NO: 1033259 - DNA, 22 bp, Artificial Sequence
  chemically synthesized
ttacatccttcttggaatgtgg

SEQ ID NO: 1033260 - DNA, 22 bp, Artificial Sequence
  chemically synthesized
acatccttcttggaatgtggat

SEQ ID NO: 1033261 - DNA, 22 bp, Artificial Sequence
  chemically synthesized
catccttcttggaatgtggatg

SEQ ID NO: 1033262 - DNA, 22 bp, Artificial Sequence
  chemically synthesized
cttggaatgtggatgtcatgag

SEQ ID NO: 1033263 - DNA, 22 bp, Artificial Sequence
  chemically synthesized
caagatggagctctcatgacat

SEQ ID NO: 1033264 - DNA, 22 bp, Artificial Sequence
  chemically synthesized
ttggaatgtggatgtcatgaga

SEQ ID NO: 1033265 - DNA, 22 bp, Artificial Sequence
  chemically synthesized
ggaatgtggatgtcatgagagc

SEQ ID NO: 1033266 - DNA, 22 bp, Artificial Sequence
  chemically synthesized
gaatgtggatgtcatgagagct

SEQ ID NO: 1033267 - DNA, 22 bp, Artificial Sequence
  chemically synthesized
atccacatgttgcaagatggag

SEQ ID NO: 1033268 - DNA, 22 bp, Artificial Sequence
  chemically synthesized
catccacatgttgcaagatgga

SEQ ID NO: 1033269 - DNA, 22 bp, Artificial Sequence
  chemically synthesized
gtggaatttcatccacatgttg

SEQ ID NO: 1033270 - DNA, 22 bp, Artificial Sequence
  chemically synthesized
ggtggaatttcatccacatgtt

SEQ ID NO: 1033271 - DNA, 22 bp, Artificial Sequence
  chemically synthesized
cttggtggaatttcatccacat

SEQ ID NO: 1033272 - DNA, 22 bp, Artificial Sequence
  chemically synthesized
catcttgcaacatgtggatgaa

SEQ ID NO: 1033273 - DNA, 22 bp, Artificial Sequence
  chemically synthesized
acttggtggaatttcatccaca

SEQ ID NO: 1033274 - DNA, 22 bp, Artificial Sequence
  chemically synthesized
tacttggtggaatttcatccac

SEQ ID NO: 1033275 - DNA, 22 bp, Artificial Sequence
  chemically synthesized
tctttacttggtggaatttcat

SEQ ID NO: 1033276 - DNA, 22 bp, Artificial Sequence
  chemically synthesized
gcaacatgtggatgaaattcca

SEQ ID NO: 1033277 - DNA, 22 bp, Artificial Sequence
  chemically synthesized
caacatgtggatgaaattccac

SEQ ID NO: 1033278 - DNA, 22 bp, Artificial Sequence
  chemically synthesized
agtgagttatctttacttggtg

SEQ ID NO: 1033279 - DNA, 22 bp, Artificial Sequence
  chemically synthesized
ctgagtgagttatctttacttg

SEQ ID NO: 1033280 - DNA, 22 bp, Artificial Sequence
  chemically synthesized
tactgagtgagttatctttact

SEQ ID NO: 1033281 - DNA, 22 bp, Artificial Sequence
  chemically synthesized
ctactgagtgagttatctttac

SEQ ID NO: 1033282 - DNA, 22 bp, Artificial Sequence
  chemically synthesized
tctactgagtgagttatcttta

SEQ ID NO: 1033283 - DNA, 22 bp, Artificial Sequence
  chemically synthesized
ttttctactgagtgagttatct

SEQ ID NO: 1033284 - DNA, 22 bp, Artificial Sequence
  chemically synthesized
caccaagtaaagataactcact

SEQ ID NO: 1033285 - DNA, 22 bp, Artificial Sequence
  chemically synthesized
tgttttctactgagtgagttat

SEQ ID NO: 1033286 - DNA, 22 bp, Artificial Sequence
  chemically synthesized
ctgttttctactgagtgagtta

SEQ ID NO: 1033287 - DNA, 22 bp, Artificial Sequence
  chemically synthesized
atttctgttttctactgagtga

SEQ ID NO: 1033288 - DNA, 22 bp, Artificial Sequence
  chemically synthesized
gccccgctcatttctgttttct

SEQ ID NO: 1033289 - DNA, 22 bp, Artificial Sequence
  chemically synthesized
actcagtagaaaacagaaatga

SEQ ID NO: 1033290 - DNA, 22 bp, Artificial Sequence
  chemically synthesized
agtagaaaacagaaatgagcgg

SEQ ID NO: 1033291 - DNA, 22 bp, Artificial Sequence
  chemically synthesized
cagccaaggcagatatgttggc

SEQ ID NO: 1033292 - DNA, 22 bp, Artificial Sequence
  chemically synthesized
gcagccaaggcagatatgttgg

SEQ ID NO: 1033293 - DNA, 22 bp, Artificial Sequence
  chemically synthesized
gaagtttgcagccaaggcagat

SEQ ID NO: 1033294 - DNA, 22 bp, Artificial Sequence
  chemically synthesized
aaaaaccctggaagtttgcagc

SEQ ID NO: 1033295 - DNA, 22 bp, Artificial Sequence
  chemically synthesized
ctgaaaaaccctggaagtttgc

SEQ ID NO: 1033296 - DNA, 22 bp, Artificial Sequence
  chemically synthesized
tcctgaaaaaccctggaagttt

SEQ ID NO: 1033297 - DNA, 22 bp, Artificial Sequence
  chemically synthesized
ctcctgaaaaaccctggaagtt

SEQ ID NO: 1033298 - DNA, 22 bp, Artificial Sequence
  chemically synthesized
ccttggctgcaaacttccaggg

SEQ ID NO: 1033299 - DNA, 22 bp, Artificial Sequence
  chemically synthesized
tctcctgaaaaaccctggaagt

SEQ ID NO: 1033300 - DNA, 22 bp, Artificial Sequence
  chemically synthesized
tttctcctgaaaaaccctggaa

SEQ ID NO: 1033301 - DNA, 22 bp, Artificial Sequence
  chemically synthesized
ctttctcctgaaaaaccctgga

SEQ ID NO: 1033302 - DNA, 22 bp, Artificial Sequence
  chemically synthesized
ggctgcaaacttccagggtttt

SEQ ID NO: 1033303 - DNA, 22 bp, Artificial Sequence
  chemically synthesized
gctgcaaacttccagggttttt

SEQ ID NO: 1033304 - DNA, 22 bp, Artificial Sequence
  chemically synthesized
tttctttctcctgaaaaaccct

SEQ ID NO: 1033305 - DNA, 22 bp, Artificial Sequence
  chemically synthesized
caaacttccagggtttttcagg

SEQ ID NO: 1033306 - DNA, 22 bp, Artificial Sequence
  chemically synthesized
ccagggtttttcaggagaaaga

SEQ ID NO: 1033307 - DNA, 22 bp, Artificial Sequence
  chemically synthesized
cagggtttttcaggagaaagaa

SEQ ID NO: 1033308 - DNA, 22 bp, Artificial Sequence
  chemically synthesized
aataaaagagaagcctatttct

SEQ ID NO: 1033309 - DNA, 22 bp, Artificial Sequence
  chemically synthesized
aaataaaagagaagcctatttc

SEQ ID NO: 1033310 - DNA, 22 bp, Artificial Sequence
  chemically synthesized
ttcaggagaaagaaataggctt

SEQ ID NO: 1033311 - DNA, 22 bp, Artificial Sequence
  chemically synthesized
tcaggagaaagaaataggcttc

SEQ ID NO: 1033312 - DNA, 22 bp, Artificial Sequence
  chemically synthesized
caggagaaagaaataggcttct

SEQ ID NO: 1033313 - DNA, 22 bp, Artificial Sequence
  chemically synthesized
aggagaaagaaataggcttctc

SEQ ID NO: 1033314 - DNA, 22 bp, Artificial Sequence
  chemically synthesized
aaggtagaaatgacttaaataa

SEQ ID NO: 1033315 - DNA, 22 bp, Artificial Sequence
  chemically synthesized
ctcttttatttaagtcatttct

SEQ ID NO: 1033316 - DNA, 22 bp, Artificial Sequence
  chemically synthesized
tcttttatttaagtcatttcta

SEQ ID NO: 1033317 - DNA, 22 bp, Artificial Sequence
  chemically synthesized
cagaagctcaaggtagaaatga

SEQ ID NO: 1033318 - DNA, 22 bp, Artificial Sequence
  chemically synthesized
ttttatttaagtcatttctacc

SEQ ID NO: 1033319 - DNA, 22 bp, Artificial Sequence
  chemically synthesized
ttatttaagtcatttctacctt

SEQ ID NO: 1033320 - DNA, 22 bp, Artificial Sequence
  chemically synthesized
tatttaagtcatttctaccttg

SEQ ID NO: 1033321 - DNA, 22 bp, Artificial Sequence
  chemically synthesized
atttaagtcatttctaccttga

SEQ ID NO: 1033322 - DNA, 22 bp, Artificial Sequence
  chemically synthesized
tttaagtcatttctaccttgag

SEQ ID NO: 1033323 - DNA, 22 bp, Artificial Sequence
  chemically synthesized
agtgttacagaagctcaaggta

SEQ ID NO: 1033324 - DNA, 22 bp, Artificial Sequence
  chemically synthesized
aagtcatttctaccttgagctt

SEQ ID NO: 1033325 - DNA, 22 bp, Artificial Sequence
  chemically synthesized
agtcatttctaccttgagcttc

SEQ ID NO: 1033326 - DNA, 22 bp, Artificial Sequence
  chemically synthesized
gctaagtgttacagaagctcaa

SEQ ID NO: 1033327 - DNA, 22 bp, Artificial Sequence
  chemically synthesized
ggctaagtgttacagaagctca

SEQ ID NO: 1033328 - DNA, 22 bp, Artificial Sequence
  chemically synthesized
tggctaagtgttacagaagctc

SEQ ID NO: 1033329 - DNA, 22 bp, Artificial Sequence
  chemically synthesized
ctttggctaagtgttacagaag

SEQ ID NO: 1033330 - DNA, 22 bp, Artificial Sequence
  chemically synthesized
gctttggctaagtgttacagaa

SEQ ID NO: 1033331 - DNA, 22 bp, Artificial Sequence
  chemically synthesized
ctaccttgagcttctgtaacac

SEQ ID NO: 1033332 - DNA, 22 bp, Artificial Sequence
  chemically synthesized
taccttgagcttctgtaacact

SEQ ID NO: 1033333 - DNA, 22 bp, Artificial Sequence
  chemically synthesized
ccttgagcttctgtaacactta

SEQ ID NO: 1033334 - DNA, 22 bp, Artificial Sequence
  chemically synthesized
taatttgctttggctaagtgtt

SEQ ID NO: 1033335 - DNA, 22 bp, Artificial Sequence
  chemically synthesized
gagcttctgtaacacttagcca

SEQ ID NO: 1033336 - DNA, 22 bp, Artificial Sequence
  chemically synthesized
agcttctgtaacacttagccaa

SEQ ID NO: 1033337 - DNA, 22 bp, Artificial Sequence
  chemically synthesized
tcaattataatttgctttggct

SEQ ID NO: 1033338 - DNA, 22 bp, Artificial Sequence
  chemically synthesized
ctgtaacacttagccaaagcaa

SEQ ID NO: 1033339 - DNA, 22 bp, Artificial Sequence
  chemically synthesized
atcaattataatttgctttggc

SEQ ID NO: 1033340 - DNA, 22 bp, Artificial Sequence
  chemically synthesized
tgtaacacttagccaaagcaaa

SEQ ID NO: 1033341 - DNA, 22 bp, Artificial Sequence
  chemically synthesized
tatcaattataatttgctttgg

SEQ ID NO: 1033342 - DNA, 22 bp, Artificial Sequence
  chemically synthesized
taacacttagccaaagcaaatt

SEQ ID NO: 1033343 - DNA, 22 bp, Artificial Sequence
  chemically synthesized
ttttatcaattataatttgctt

SEQ ID NO: 1033344 - DNA, 22 bp, Artificial Sequence
  chemically synthesized
attttatcaattataatttgct

SEQ ID NO: 1033345 - DNA, 22 bp, Artificial Sequence
  chemically synthesized
tattttatcaattataatttgc

SEQ ID NO: 1033346 - DNA, 22 bp, Artificial Sequence
  chemically synthesized
tttattttatcaattataattt

SEQ ID NO: 1033347 - DNA, 22 bp, Artificial Sequence
  chemically synthesized
tctttattttatcaattataat

SEQ ID NO: 1033348 - DNA, 22 bp, Artificial Sequence
  chemically synthesized
agccaaagcaaattataattga

SEQ ID NO: 1033349 - DNA, 22 bp, Artificial Sequence
  chemically synthesized
gccaaagcaaattataattgat

SEQ ID NO: 1033350 - DNA, 22 bp, Artificial Sequence
  chemically synthesized
ccagaaactctctttattttat

SEQ ID NO: 1033351 - DNA, 22 bp, Artificial Sequence
  chemically synthesized
cccagaaactctctttatttta

SEQ ID NO: 1033352 - DNA, 22 bp, Artificial Sequence
  chemically synthesized
tcccagaaactctctttatttt

SEQ ID NO: 1033353 - DNA, 22 bp, Artificial Sequence
  chemically synthesized
ttcccagaaactctctttattt

SEQ ID NO: 1033354 - DNA, 22 bp, Artificial Sequence
  chemically synthesized
taattgataaaataaagagagt

SEQ ID NO: 1033355 - DNA, 22 bp, Artificial Sequence
  chemically synthesized
ataaaataaagagagtttctgg

SEQ ID NO: 1033356 - DNA, 22 bp, Artificial Sequence
  chemically synthesized
aatgtacttttcccagaaactc

SEQ ID NO: 1033357 - DNA, 22 bp, Artificial Sequence
  chemically synthesized
tgctaaatgtacttttcccaga

SEQ ID NO: 1033358 - DNA, 22 bp, Artificial Sequence
  chemically synthesized
ctgggaaaagtacatttagcac

SEQ ID NO: 1033359 - DNA, 22 bp, Artificial Sequence
  chemically synthesized
taaaataaaactgtgctaaatg

SEQ ID NO: 1033360 - DNA, 22 bp, Artificial Sequence
  chemically synthesized
tgggaaaagtacatttagcaca

SEQ ID NO: 1033361 - DNA, 22 bp, Artificial Sequence
  chemically synthesized
ggaaaagtacatttagcacagt

SEQ ID NO: 1033362 - DNA, 22 bp, Artificial Sequence
  chemically synthesized
ctgtaaaataaaactgtgctaa

SEQ ID NO: 1033363 - DNA, 22 bp, Artificial Sequence
  chemically synthesized
aaagacattactgtaaaataaa

SEQ ID NO: 1033364 - DNA, 22 bp, Artificial Sequence
  chemically synthesized
aaaagacattactgtaaaataa

SEQ ID NO: 1033365 - DNA, 22 bp, Artificial Sequence
  chemically synthesized
taaaagacattactgtaaaata

SEQ ID NO: 1033366 - DNA, 22 bp, Artificial Sequence
  chemically synthesized
agcacagttttattttacagta

SEQ ID NO: 1033367 - DNA, 22 bp, Artificial Sequence
  chemically synthesized
gcacagttttattttacagtaa

SEQ ID NO: 1033368 - DNA, 22 bp, Artificial Sequence
  chemically synthesized
tattttacagtaatgtctttta

SEQ ID NO: 1033369 - DNA, 22 bp, Artificial Sequence
  chemically synthesized
attttacagtaatgtcttttaa

SEQ ID NO: 1033370 - DNA, 22 bp, Artificial Sequence
  chemically synthesized
ttttacagtaatgtcttttaaa

SEQ ID NO: 1033371 - DNA, 22 bp, Artificial Sequence
  chemically synthesized
gaatagatgagttttaaaagac

SEQ ID NO: 1033372 - DNA, 22 bp, Artificial Sequence
  chemically synthesized
tacagtaatgtcttttaaaact

SEQ ID NO: 1033373 - DNA, 22 bp, Artificial Sequence
  chemically synthesized
acagtaatgtcttttaaaactc

SEQ ID NO: 1033374 - DNA, 22 bp, Artificial Sequence
  chemically synthesized
cctggaatagatgagttttaaa

SEQ ID NO: 1033375 - DNA, 22 bp, Artificial Sequence
  chemically synthesized
cagtaatgtcttttaaaactca

SEQ ID NO: 1033376 - DNA, 22 bp, Artificial Sequence
  chemically synthesized
tacctggaatagatgagtttta

SEQ ID NO: 1033377 - DNA, 22 bp, Artificial Sequence
  chemically synthesized
tctacctggaatagatgagttt

SEQ ID NO: 1033378 - DNA, 22 bp, Artificial Sequence
  chemically synthesized
ctctacctggaatagatgagtt

SEQ ID NO: 1033379 - DNA, 22 bp, Artificial Sequence
  chemically synthesized
tctctacctggaatagatgagt

SEQ ID NO: 1033380 - DNA, 22 bp, Artificial Sequence
  chemically synthesized
ttctctacctggaatagatgag

SEQ ID NO: 1033381 - DNA, 22 bp, Artificial Sequence
  chemically synthesized
tttctctacctggaatagatga

SEQ ID NO: 1033382 - DNA, 22 bp, Artificial Sequence
  chemically synthesized
ttaaaactcatctattccaggt

SEQ ID NO: 1033383 - DNA, 22 bp, Artificial Sequence
  chemically synthesized
taaaactcatctattccaggta

SEQ ID NO: 1033384 - DNA, 22 bp, Artificial Sequence
  chemically synthesized
aaaactcatctattccaggtag

SEQ ID NO: 1033385 - DNA, 22 bp, Artificial Sequence
  chemically synthesized
aaactcatctattccaggtaga

SEQ ID NO: 1033386 - DNA, 22 bp, Artificial Sequence
  chemically synthesized
aatatgcattttttctctacct

SEQ ID NO: 1033387 - DNA, 22 bp, Artificial Sequence
  chemically synthesized
taaatatgcattttttctctac

SEQ ID NO: 1033388 - DNA, 22 bp, Artificial Sequence
  chemically synthesized
atctattccaggtagagaaaaa

SEQ ID NO: 1033389 - DNA, 22 bp, Artificial Sequence
  chemically synthesized
tctaaatatgcattttttctct

SEQ ID NO: 1033390 - DNA, 22 bp, Artificial Sequence
  chemically synthesized
ctctaaatatgcattttttctc

SEQ ID NO: 1033391 - DNA, 22 bp, Artificial Sequence
  chemically synthesized
ttccaggtagagaaaaaatgca

SEQ ID NO: 1033392 - DNA, 22 bp, Artificial Sequence
  chemically synthesized
ccttctctaaatatgcattttt

SEQ ID NO: 1033393 - DNA, 22 bp, Artificial Sequence
  chemically synthesized
cccttctctaaatatgcatttt

SEQ ID NO: 1033394 - DNA, 22 bp, Artificial Sequence
  chemically synthesized
caggtagagaaaaaatgcatat

SEQ ID NO: 1033395 - DNA, 22 bp, Artificial Sequence
  chemically synthesized
acaaatttcccttctctaaata

SEQ ID NO: 1033396 - DNA, 22 bp, Artificial Sequence
  chemically synthesized
cacaaatttcccttctctaaat

SEQ ID NO: 1033397 - DNA, 22 bp, Artificial Sequence
  chemically synthesized
tcatttcacaaatttcccttct

SEQ ID NO: 1033398 - DNA, 22 bp, Artificial Sequence
  chemically synthesized
gtcatttcacaaatttcccttc

SEQ ID NO: 1033399 - DNA, 22 bp, Artificial Sequence
  chemically synthesized
tgtcatttcacaaatttccctt

SEQ ID NO: 1033400 - DNA, 22 bp, Artificial Sequence
  chemically synthesized
gttttgtcatttcacaaatttc

SEQ ID NO: 1033401 - DNA, 22 bp, Artificial Sequence
  chemically synthesized
ggttttgtcatttcacaaattt

SEQ ID NO: 1033402 - DNA, 22 bp, Artificial Sequence
  chemically synthesized
ttggttttgtcatttcacaaat

SEQ ID NO: 1033403 - DNA, 22 bp, Artificial Sequence
  chemically synthesized
agagaagggaaatttgtgaaat

SEQ ID NO: 1033404 - DNA, 22 bp, Artificial Sequence
  chemically synthesized
cttggttttgtcatttcacaaa

SEQ ID NO: 1033405 - DNA, 22 bp, Artificial Sequence
  chemically synthesized
gagaagggaaatttgtgaaatg

SEQ ID NO: 1033406 - DNA, 22 bp, Artificial Sequence
  chemically synthesized
tgtatttcttggttttgtcatt

SEQ ID NO: 1033407 - DNA, 22 bp, Artificial Sequence
  chemically synthesized
attgtgtatttcttggttttgt

SEQ ID NO: 1033408 - DNA, 22 bp, Artificial Sequence
  chemically synthesized
ttcattgtgtatttcttggttt

SEQ ID NO: 1033409 - DNA, 22 bp, Artificial Sequence
  chemically synthesized
gtgaaatgacaaaaccaagaaa

SEQ ID NO: 1033410 - DNA, 22 bp, Artificial Sequence
  chemically synthesized
attcattgtgtatttcttggtt

SEQ ID NO: 1033411 - DNA, 22 bp, Artificial Sequence
  chemically synthesized
tgaaatgacaaaaccaagaaat

SEQ ID NO: 1033412 - DNA, 22 bp, Artificial Sequence
  chemically synthesized
tattcattgtgtatttcttggt

SEQ ID NO: 1033413 - DNA, 22 bp, Artificial Sequence
  chemically synthesized
actttattcattgtgtatttct

SEQ ID NO: 1033414 - DNA, 22 bp, Artificial Sequence
  chemically synthesized
gactttattcattgtgtatttc

SEQ ID NO: 1033415 - DNA, 22 bp, Artificial Sequence
  chemically synthesized
atatttgactttattcattgtg

SEQ ID NO: 1033416 - DNA, 22 bp, Artificial Sequence
  chemically synthesized
atattaatatttgactttattc

SEQ ID NO: 1033417 - DNA, 22 bp, Artificial Sequence
  chemically synthesized
gaggctgatattaatatttgac

SEQ ID NO: 1033418 - DNA, 22 bp, Artificial Sequence
  chemically synthesized
ggaggctgatattaatatttga

SEQ ID NO: 1033419 - DNA, 22 bp, Artificial Sequence
  chemically synthesized
tggaggctgatattaatatttg

SEQ ID NO: 1033420 - DNA, 22 bp, Artificial Sequence
  chemically synthesized
attttggaggctgatattaata

SEQ ID NO: 1033421 - DNA, 22 bp, Artificial Sequence
  chemically synthesized
gcctcattttggaggctgatat

SEQ ID NO: 1033422 - DNA, 22 bp, Artificial Sequence
  chemically synthesized
atatcagcctccaaaatgaggc

SEQ ID NO: 1033423 - DNA, 22 bp, Artificial Sequence
  chemically synthesized
tgtccataggactagcctcatt

SEQ ID NO: 1033424 - DNA, 22 bp, Artificial Sequence
  chemically synthesized
gtgtccataggactagcctcat

SEQ ID NO: 1033425 - DNA, 22 bp, Artificial Sequence
  chemically synthesized
tgtgtccataggactagcctca

SEQ ID NO: 1033426 - DNA, 22 bp, Artificial Sequence
  chemically synthesized
caaaatgaggctagtcctatgg

SEQ ID NO: 1033427 - DNA, 22 bp, Artificial Sequence
  chemically synthesized
atacagaaagaaattttgtgtc

SEQ ID NO: 1033428 - DNA, 22 bp, Artificial Sequence
  chemically synthesized
taatacagaaagaaattttgtg

SEQ ID NO: 1033429 - DNA, 22 bp, Artificial Sequence
  chemically synthesized
gtcctatggacacaaaatttct

SEQ ID NO: 1033430 - DNA, 22 bp, Artificial Sequence
  chemically synthesized
tggacacaaaatttctttctgt

SEQ ID NO: 1033431 - DNA, 22 bp, Artificial Sequence
  chemically synthesized
tcaaaggaaaaagactctaata

SEQ ID NO: 1033432 - DNA, 22 bp, Artificial Sequence
  chemically synthesized
ttgtcaaaggaaaaagactcta

SEQ ID NO: 1033433 - DNA, 22 bp, Artificial Sequence
  chemically synthesized
ctttctgtattagagtcttttt

SEQ ID NO: 1033434 - DNA, 22 bp, Artificial Sequence
  chemically synthesized
tttctgtattagagtctttttc

SEQ ID NO: 1033435 - DNA, 22 bp, Artificial Sequence
  chemically synthesized
ttattgtcaaaggaaaaagact

SEQ ID NO: 1033436 - DNA, 22 bp, Artificial Sequence
  chemically synthesized
attattgtcaaaggaaaaagac

SEQ ID NO: 1033437 - DNA, 22 bp, Artificial Sequence
  chemically synthesized
tctgtattagagtctttttcct

SEQ ID NO: 1033438 - DNA, 22 bp, Artificial Sequence
  chemically synthesized
tattattgtcaaaggaaaaaga

SEQ ID NO: 1033439 - DNA, 22 bp, Artificial Sequence
  chemically synthesized
ctgtattagagtctttttcctt

SEQ ID NO: 1033440 - DNA, 22 bp, Artificial Sequence
  chemically synthesized
ttattattgtcaaaggaaaaag

SEQ ID NO: 1033441 - DNA, 22 bp, Artificial Sequence
  chemically synthesized
tgtattagagtctttttccttt

SEQ ID NO: 1033442 - DNA, 22 bp, Artificial Sequence
  chemically synthesized
tattagagtctttttcctttga

SEQ ID NO: 1033443 - DNA, 22 bp, Artificial Sequence
  chemically synthesized
gagtctttttcctttgacaata

SEQ ID NO: 1033444 - DNA, 22 bp, Artificial Sequence
  chemically synthesized
aataaacatttttattattgtc

SEQ ID NO: 1033445 - DNA, 22 bp, Artificial Sequence
  chemically synthesized
tttcctttgacaataataaaaa

SEQ ID NO: 1033446 - DNA, 22 bp, Artificial Sequence
  chemically synthesized
tctaaataaacatttttattat

SEQ ID NO: 1033447 - DNA, 22 bp, Artificial Sequence
  chemically synthesized
ttcctttgacaataataaaaat

SEQ ID NO: 1033448 - DNA, 22 bp, Artificial Sequence
  chemically synthesized
tcctttgacaataataaaaatg

SEQ ID NO: 1033449 - DNA, 22 bp, Artificial Sequence
  chemically synthesized
cctttgacaataataaaaatgt

SEQ ID NO: 1033450 - DNA, 22 bp, Artificial Sequence
  chemically synthesized
ttatctaaataaacatttttat

SEQ ID NO: 1033451 - DNA, 22 bp, Artificial Sequence
  chemically synthesized
ctttgacaataataaaaatgtt

SEQ ID NO: 1033452 - DNA, 22 bp, Artificial Sequence
  chemically synthesized
gttatctaaataaacattttta

SEQ ID NO: 1033453 - DNA, 22 bp, Artificial Sequence
  chemically synthesized
tgacaataataaaaatgtttat

SEQ ID NO: 1033454 - DNA, 22 bp, Artificial Sequence
  chemically synthesized
cttgttatctaaataaacattt

SEQ ID NO: 1033455 - DNA, 22 bp, Artificial Sequence
  chemically synthesized
gacaataataaaaatgtttatt

SEQ ID NO: 1033456 - DNA, 22 bp, Artificial Sequence
  chemically synthesized
acaataataaaaatgtttattt

SEQ ID NO: 1033457 - DNA, 22 bp, Artificial Sequence
  chemically synthesized
cctgcttgttatctaaataaac

SEQ ID NO: 1033458 - DNA, 22 bp, Artificial Sequence
  chemically synthesized
gcctgcttgttatctaaataaa

SEQ ID NO: 1033459 - DNA, 22 bp, Artificial Sequence
  chemically synthesized
tatttgcctgcttgttatctaa

SEQ ID NO: 1033460 - DNA, 22 bp, Artificial Sequence
  chemically synthesized
atttagataacaagcaggcaaa

SEQ ID NO: 1033461 - DNA, 22 bp, Artificial Sequence
  chemically synthesized
tttagataacaagcaggcaaat

SEQ ID NO: 1033462 - DNA, 22 bp, Artificial Sequence
  chemically synthesized
agataacaagcaggcaaataca

SEQ ID NO: 1033463 - DNA, 22 bp, Artificial Sequence
  chemically synthesized
gataacaagcaggcaaatacag

SEQ ID NO: 1033464 - DNA, 22 bp, Artificial Sequence
  chemically synthesized
agtatatgaggggactgtattt

SEQ ID NO: 1033465 - DNA, 22 bp, Artificial Sequence
  chemically synthesized
cagtatatgaggggactgtatt

SEQ ID NO: 1033466 - DNA, 22 bp, Artificial Sequence
  chemically synthesized
ttcagtatatgaggggactgta

SEQ ID NO: 1033467 - DNA, 22 bp, Artificial Sequence
  chemically synthesized
ttcttcagtatatgaggggact

SEQ ID NO: 1033468 - DNA, 22 bp, Artificial Sequence
  chemically synthesized
gttcttcagtatatgaggggac

SEQ ID NO: 1033469 - DNA, 22 bp, Artificial Sequence
  chemically synthesized
ttgttcttcagtatatgagggg

SEQ ID NO: 1033470 - DNA, 22 bp, Artificial Sequence
  chemically synthesized
accatagatgattcttgttctt

SEQ ID NO: 1033471 - DNA, 22 bp, Artificial Sequence
  chemically synthesized
atatactgaagaacaagaatca

SEQ ID NO: 1033472 - DNA, 22 bp, Artificial Sequence
  chemically synthesized
atcctcaccatagatgattctt

SEQ ID NO: 1033473 - DNA, 22 bp, Artificial Sequence
  chemically synthesized
catcctcaccatagatgattct

SEQ ID NO: 1033474 - DNA, 22 bp, Artificial Sequence
  chemically synthesized
tcatcctcaccatagatgattc

SEQ ID NO: 1033475 - DNA, 22 bp, Artificial Sequence
  chemically synthesized
aagaacaagaatcatctatggt

SEQ ID NO: 1033476 - DNA, 22 bp, Artificial Sequence
  chemically synthesized
tatacaagcattttcatcctca

SEQ ID NO: 1033477 - DNA, 22 bp, Artificial Sequence
  chemically synthesized
tggtgaggatgaaaatgcttgt

SEQ ID NO: 1033478 - DNA, 22 bp, Artificial Sequence
  chemically synthesized
ccaggatagttgtatacaagca

SEQ ID NO: 1033479 - DNA, 22 bp, Artificial Sequence
  chemically synthesized
cccaggatagttgtatacaagc

SEQ ID NO: 1033480 - DNA, 22 bp, Artificial Sequence
  chemically synthesized
tttcccaggatagttgtataca

SEQ ID NO: 1033481 - DNA, 22 bp, Artificial Sequence
  chemically synthesized
gtttcccaggatagttgtatac

SEQ ID NO: 1033482 - DNA, 22 bp, Artificial Sequence
  chemically synthesized
tgtttcccaggatagttgtata

SEQ ID NO: 1033483 - DNA, 22 bp, Artificial Sequence
  chemically synthesized
ttgtttcccaggatagttgtat

SEQ ID NO: 1033484 - DNA, 22 bp, Artificial Sequence
  chemically synthesized
aacatttttgtttcccaggata

SEQ ID NO: 1033485 - DNA, 22 bp, Artificial Sequence
  chemically synthesized
gtatacaactatcctgggaaac

SEQ ID NO: 1033486 - DNA, 22 bp, Artificial Sequence
  chemically synthesized
tatacaactatcctgggaaaca

SEQ ID NO: 1033487 - DNA, 22 bp, Artificial Sequence
  chemically synthesized
aaagtaattgaacatttttgtt

SEQ ID NO: 1033488 - DNA, 22 bp, Artificial Sequence
  chemically synthesized
tcaaagtaattgaacatttttg

SEQ ID NO: 1033489 - DNA, 22 bp, Artificial Sequence
  chemically synthesized
ctcaaagtaattgaacattttt

SEQ ID NO: 1033490 - DNA, 22 bp, Artificial Sequence
  chemically synthesized
tcctgggaaacaaaaatgttca

SEQ ID NO: 1033491 - DNA, 22 bp, Artificial Sequence
  chemically synthesized
tctcaaagtaattgaacatttt

SEQ ID NO: 1033492 - DNA, 22 bp, Artificial Sequence
  chemically synthesized
ttctcaaagtaattgaacattt

SEQ ID NO: 1033493 - DNA, 22 bp, Artificial Sequence
  chemically synthesized
tttctcaaagtaattgaacatt

SEQ ID NO: 1033494 - DNA, 22 bp, Artificial Sequence
  chemically synthesized
ggaaacaaaaatgttcaattac

SEQ ID NO: 1033495 - DNA, 22 bp, Artificial Sequence
  chemically synthesized
aattactttgagaaaaagactg

SEQ ID NO: 1033496 - DNA, 22 bp, Artificial Sequence
  chemically synthesized
ctttgagaaaaagactggggat

SEQ ID NO: 1033497 - DNA, 22 bp, Artificial Sequence
  chemically synthesized
gccatagatcaatatccccagt

SEQ ID NO: 1033498 - DNA, 22 bp, Artificial Sequence
  chemically synthesized
tgagaaaaagactggggatatt

SEQ ID NO: 1033499 - DNA, 22 bp, Artificial Sequence
  chemically synthesized
gagaaaaagactggggatattg

SEQ ID NO: 1033500 - DNA, 22 bp, Artificial Sequence
  chemically synthesized
agaaaaagactggggatattga

SEQ ID NO: 1033501 - DNA, 22 bp, Artificial Sequence
  chemically synthesized
agagttagccatagatcaatat

SEQ ID NO: 1033502 - DNA, 22 bp, Artificial Sequence
  chemically synthesized
gggatattgatctatggctaac

SEQ ID NO: 1033503 - DNA, 22 bp, Artificial Sequence
  chemically synthesized
acataatctcagagttagccat

SEQ ID NO: 1033504 - DNA, 22 bp, Artificial Sequence
  chemically synthesized
atctatggctaactctgagatt

SEQ ID NO: 1033505 - DNA, 22 bp, Artificial Sequence
  chemically synthesized
gatataaaattcacataatctc

SEQ ID NO: 1033506 - DNA, 22 bp, Artificial Sequence
  chemically synthesized
tggctaactctgagattatgtg

SEQ ID NO: 1033507 - DNA, 22 bp, Artificial Sequence
  chemically synthesized
actagatataaaattcacataa

SEQ ID NO: 1033508 - DNA, 22 bp, Artificial Sequence
  chemically synthesized
actctgagattatgtgaatttt

SEQ ID NO: 1033509 - DNA, 22 bp, Artificial Sequence
  chemically synthesized
tgagattatgtgaattttatat

SEQ ID NO: 1033510 - DNA, 22 bp, Artificial Sequence
  chemically synthesized
agattatgtgaattttatatct

SEQ ID NO: 1033511 - DNA, 22 bp, Artificial Sequence
  chemically synthesized
agataagaaattgactagatat

SEQ ID NO: 1033512 - DNA, 22 bp, Artificial Sequence
  chemically synthesized
cagataagaaattgactagata

SEQ ID NO: 1033513 - DNA, 22 bp, Artificial Sequence
  chemically synthesized
tgtgaattttatatctagtcaa

SEQ ID NO: 1033514 - DNA, 22 bp, Artificial Sequence
  chemically synthesized
ttcagataagaaattgactaga

SEQ ID NO: 1033515 - DNA, 22 bp, Artificial Sequence
  chemically synthesized
cttcagataagaaattgactag

SEQ ID NO: 1033516 - DNA, 22 bp, Artificial Sequence
  chemically synthesized
tcttcagataagaaattgacta

SEQ ID NO: 1033517 - DNA, 22 bp, Artificial Sequence
  chemically synthesized
tatatctagtcaatttcttatc

SEQ ID NO: 1033518 - DNA, 22 bp, Artificial Sequence
  chemically synthesized
aaactttcttcagataagaaat

SEQ ID NO: 1033519 - DNA, 22 bp, Artificial Sequence
  chemically synthesized
atatctagtcaatttcttatct

SEQ ID NO: 1033520 - DNA, 22 bp, Artificial Sequence
  chemically synthesized
aaaactttcttcagataagaaa

SEQ ID NO: 1033521 - DNA, 22 bp, Artificial Sequence
  chemically synthesized
tatctagtcaatttcttatctg

SEQ ID NO: 1033522 - DNA, 22 bp, Artificial Sequence
  chemically synthesized
gtttaaaactttcttcagataa

SEQ ID NO: 1033523 - DNA, 22 bp, Artificial Sequence
  chemically synthesized
gtcaatttcttatctgaagaaa

SEQ ID NO: 1033524 - DNA, 22 bp, Artificial Sequence
  chemically synthesized
gaggttagtttaaaactttctt

SEQ ID NO: 1033525 - DNA, 22 bp, Artificial Sequence
  chemically synthesized
agaggttagtttaaaactttct

SEQ ID NO: 1033526 - DNA, 22 bp, Artificial Sequence
  chemically synthesized
cttatctgaagaaagttttaaa

SEQ ID NO: 1033527 - DNA, 22 bp, Artificial Sequence
  chemically synthesized
ttatctgaagaaagttttaaac

SEQ ID NO: 1033528 - DNA, 22 bp, Artificial Sequence
  chemically synthesized
acttagaggttagtttaaaact

SEQ ID NO: 1033529 - DNA, 22 bp, Artificial Sequence
  chemically synthesized
atctgaagaaagttttaaacta

SEQ ID NO: 1033530 - DNA, 22 bp, Artificial Sequence
  chemically synthesized
tctgaagaaagttttaaactaa

SEQ ID NO: 1033531 - DNA, 22 bp, Artificial Sequence
  chemically synthesized
aagaaagttttaaactaacctc

SEQ ID NO: 1033532 - DNA, 22 bp, Artificial Sequence
  chemically synthesized
acagttcacttagaggttagtt

SEQ ID NO: 1033533 - DNA, 22 bp, Artificial Sequence
  chemically synthesized
cacagttcacttagaggttagt

SEQ ID NO: 1033534 - DNA, 22 bp, Artificial Sequence
  chemically synthesized
taaatcttcacagttcacttag

SEQ ID NO: 1033535 - DNA, 22 bp, Artificial Sequence
  chemically synthesized
taaactaacctctaagtgaact

SEQ ID NO: 1033536 - DNA, 22 bp, Artificial Sequence
  chemically synthesized
ataaatcttcacagttcactta

SEQ ID NO: 1033537 - DNA, 22 bp, Artificial Sequence
  chemically synthesized
aaactaacctctaagtgaactg

SEQ ID NO: 1033538 - DNA, 22 bp, Artificial Sequence
  chemically synthesized
aactaacctctaagtgaactgt

SEQ ID NO: 1033539 - DNA, 22 bp, Artificial Sequence
  chemically synthesized
ttataaatcttcacagttcact

SEQ ID NO: 1033540 - DNA, 22 bp, Artificial Sequence
  chemically synthesized
acctctaagtgaactgtgaaga

SEQ ID NO: 1033541 - DNA, 22 bp, Artificial Sequence
  chemically synthesized
agattcttataaatcttcacag

SEQ ID NO: 1033542 - DNA, 22 bp, Artificial Sequence
  chemically synthesized
cagattcttataaatcttcaca

SEQ ID NO: 1033543 - DNA, 22 bp, Artificial Sequence
  chemically synthesized
tcagattcttataaatcttcac

SEQ ID NO: 1033544 - DNA, 22 bp, Artificial Sequence
  chemically synthesized
taagtgaactgtgaagatttat

SEQ ID NO: 1033545 - DNA, 22 bp, Artificial Sequence
  chemically synthesized
agtgaactgtgaagatttataa

SEQ ID NO: 1033546 - DNA, 22 bp, Artificial Sequence
  chemically synthesized
aacattttcagattcttataaa

SEQ ID NO: 1033547 - DNA, 22 bp, Artificial Sequence
  chemically synthesized
caacattttcagattcttataa

SEQ ID NO: 1033548 - DNA, 22 bp, Artificial Sequence
  chemically synthesized
tgaagatttataagaatctgaa

SEQ ID NO: 1033549 - DNA, 22 bp, Artificial Sequence
  chemically synthesized
tatcttcaacattttcagattc

SEQ ID NO: 1033550 - DNA, 22 bp, Artificial Sequence
  chemically synthesized
atatcttcaacattttcagatt

SEQ ID NO: 1033551 - DNA, 22 bp, Artificial Sequence
  chemically synthesized
ccttatatcttcaacattttca

SEQ ID NO: 1033552 - DNA, 22 bp, Artificial Sequence
  chemically synthesized
gccttatatcttcaacattttc

SEQ ID NO: 1033553 - DNA, 22 bp, Artificial Sequence
  chemically synthesized
ataagaatctgaaaatgttgaa

SEQ ID NO: 1033554 - DNA, 22 bp, Artificial Sequence
  chemically synthesized
taagaatctgaaaatgttgaag

SEQ ID NO: 1033555 - DNA, 22 bp, Artificial Sequence
  chemically synthesized
aaaatgttgaagatataaggca

SEQ ID NO: 1033556 - DNA, 22 bp, Artificial Sequence
  chemically synthesized
atccaggatcatttgccttata

SEQ ID NO: 1033557 - DNA, 22 bp, Artificial Sequence
  chemically synthesized
catccaggatcatttgccttat

SEQ ID NO: 1033558 - DNA, 22 bp, Artificial Sequence
  chemically synthesized
aagatataaggcaaatgatcct

SEQ ID NO: 1033559 - DNA, 22 bp, Artificial Sequence
  chemically synthesized
tgatcaccgcttcatccaggat

SEQ ID NO: 1033560 - DNA, 22 bp, Artificial Sequence
  chemically synthesized
atgatcaccgcttcatccagga

SEQ ID NO: 1033561 - DNA, 22 bp, Artificial Sequence
  chemically synthesized
tatgatcaccgcttcatccagg

SEQ ID NO: 1033562 - DNA, 22 bp, Artificial Sequence
  chemically synthesized
ttatgatcaccgcttcatccag

SEQ ID NO: 1033563 - DNA, 22 bp, Artificial Sequence
  chemically synthesized
tttatgatcaccgcttcatcca

SEQ ID NO: 1033564 - DNA, 22 bp, Artificial Sequence
  chemically synthesized
ctttttatgatcaccgcttcat

SEQ ID NO: 1033565 - DNA, 22 bp, Artificial Sequence
  chemically synthesized
gctttttatgatcaccgcttca

SEQ ID NO: 1033566 - DNA, 22 bp, Artificial Sequence
  chemically synthesized
gatgaagcggtgatcataaaaa

SEQ ID NO: 1033567 - DNA, 22 bp, Artificial Sequence
  chemically synthesized
cagagtgatttgctttttatga

SEQ ID NO: 1033568 - DNA, 22 bp, Artificial Sequence
  chemically synthesized
agagttgcagagtgatttgctt

SEQ ID NO: 1033569 - DNA, 22 bp, Artificial Sequence
  chemically synthesized
aagagttgcagagtgatttgct

SEQ ID NO: 1033570 - DNA, 22 bp, Artificial Sequence
  chemically synthesized
aaagcacttaagagttgcagag

SEQ ID NO: 1033571 - DNA, 22 bp, Artificial Sequence
  chemically synthesized
tagttcaaagcacttaagagtt

SEQ ID NO: 1033572 - DNA, 22 bp, Artificial Sequence
  chemically synthesized
atagttcaaagcacttaagagt

SEQ ID NO: 1033573 - DNA, 22 bp, Artificial Sequence
  chemically synthesized
tttatagttcaaagcacttaag

SEQ ID NO: 1033574 - DNA, 22 bp, Artificial Sequence
  chemically synthesized
ctatttatagttcaaagcactt

SEQ ID NO: 1033575 - DNA, 22 bp, Artificial Sequence
  chemically synthesized
tgcaactcttaagtgctttgaa

SEQ ID NO: 1033576 - DNA, 22 bp, Artificial Sequence
  chemically synthesized
caactcttaagtgctttgaact

SEQ ID NO: 1033577 - DNA, 22 bp, Artificial Sequence
  chemically synthesized
catattcctatttatagttcaa

SEQ ID NO: 1033578 - DNA, 22 bp, Artificial Sequence
  chemically synthesized
tgcatattcctatttatagttc

SEQ ID NO: 1033579 - DNA, 22 bp, Artificial Sequence
  chemically synthesized
ttaagtgctttgaactataaat

SEQ ID NO: 1033580 - DNA, 22 bp, Artificial Sequence
  chemically synthesized
ctgcatattcctatttatagtt

SEQ ID NO: 1033581 - DNA, 22 bp, Artificial Sequence
  chemically synthesized
aagtgctttgaactataaatag

SEQ ID NO: 1033582 - DNA, 22 bp, Artificial Sequence
  chemically synthesized
agtgctttgaactataaatagg

SEQ ID NO: 1033583 - DNA, 22 bp, Artificial Sequence
  chemically synthesized
tcttctgcatattcctatttat

SEQ ID NO: 1033584 - DNA, 22 bp, Artificial Sequence
  chemically synthesized
atcttctgcatattcctattta

SEQ ID NO: 1033585 - DNA, 22 bp, Artificial Sequence
  chemically synthesized
tgaactataaataggaatatgc

SEQ ID NO: 1033586 - DNA, 22 bp, Artificial Sequence
  chemically synthesized
gaactataaataggaatatgca

SEQ ID NO: 1033587 - DNA, 22 bp, Artificial Sequence
  chemically synthesized
aactataaataggaatatgcag

SEQ ID NO: 1033588 - DNA, 22 bp, Artificial Sequence
  chemically synthesized
cccatcagcttatcttctgcat

SEQ ID NO: 1033589 - DNA, 22 bp, Artificial Sequence
  chemically synthesized
taaataggaatatgcagaagat

SEQ ID NO: 1033590 - DNA, 22 bp, Artificial Sequence
  chemically synthesized
tgcccatcagcttatcttctgc

SEQ ID NO: 1033591 - DNA, 22 bp, Artificial Sequence
  chemically synthesized
ctgcccatcagcttatcttctg

SEQ ID NO: 1033592 - DNA, 22 bp, Artificial Sequence
  chemically synthesized
tttctgcccatcagcttatctt

SEQ ID NO: 1033593 - DNA, 22 bp, Artificial Sequence
  chemically synthesized
gtttctgcccatcagcttatct

SEQ ID NO: 1033594 - DNA, 22 bp, Artificial Sequence
  chemically synthesized
aatagaagtttgtttctgccca

SEQ ID NO: 1033595 - DNA, 22 bp, Artificial Sequence
  chemically synthesized
aaatgcattaaatagaagtttg

SEQ ID NO: 1033596 - DNA, 22 bp, Artificial Sequence
  chemically synthesized
atgggcagaaacaaacttctat

SEQ ID NO: 1033597 - DNA, 22 bp, Artificial Sequence
  chemically synthesized
gaaatgcattaaatagaagttt

SEQ ID NO: 1033598 - DNA, 22 bp, Artificial Sequence
  chemically synthesized
tgaaatgcattaaatagaagtt

SEQ ID NO: 1033599 - DNA, 22 bp, Artificial Sequence
  chemically synthesized
ttgaaatgcattaaatagaagt

SEQ ID NO: 1033600 - DNA, 22 bp, Artificial Sequence
  chemically synthesized
tttgaaatgcattaaatagaag

SEQ ID NO: 1033601 - DNA, 22 bp, Artificial Sequence
  chemically synthesized
agtgaaagagctttttgaaatg

SEQ ID NO: 1033602 - DNA, 22 bp, Artificial Sequence
  chemically synthesized
ctatttaatgcatttcaaaaag

SEQ ID NO: 1033603 - DNA, 22 bp, Artificial Sequence
  chemically synthesized
tatttaatgcatttcaaaaagc

SEQ ID NO: 1033604 - DNA, 22 bp, Artificial Sequence
  chemically synthesized
ttaagtgaaagagctttttgaa

SEQ ID NO: 1033605 - DNA, 22 bp, Artificial Sequence
  chemically synthesized
attaagtgaaagagctttttga

SEQ ID NO: 1033606 - DNA, 22 bp, Artificial Sequence
  chemically synthesized
tttaatgcatttcaaaaagctc

SEQ ID NO: 1033607 - DNA, 22 bp, Artificial Sequence
  chemically synthesized
aatgcatttcaaaaagctcttt

SEQ ID NO: 1033608 - DNA, 22 bp, Artificial Sequence
  chemically synthesized
atgcatttcaaaaagctctttc

SEQ ID NO: 1033609 - DNA, 22 bp, Artificial Sequence
  chemically synthesized
tatttattaagtgaaagagctt

SEQ ID NO: 1033610 - DNA, 22 bp, Artificial Sequence
  chemically synthesized
ttgtatttattaagtgaaagag

SEQ ID NO: 1033611 - DNA, 22 bp, Artificial Sequence
  chemically synthesized
gttgtatttattaagtgaaaga

SEQ ID NO: 1033612 - DNA, 22 bp, Artificial Sequence
  chemically synthesized
caaaaagctctttcacttaata

SEQ ID NO: 1033613 - DNA, 22 bp, Artificial Sequence
  chemically synthesized
aaaaagctctttcacttaataa

SEQ ID NO: 1033614 - DNA, 22 bp, Artificial Sequence
  chemically synthesized
aagaagaaaatttgttgtattt

SEQ ID NO: 1033615 - DNA, 22 bp, Artificial Sequence
  chemically synthesized
tttcacttaataaatacaacaa

SEQ ID NO: 1033616 - DNA, 22 bp, Artificial Sequence
  chemically synthesized
aaagaagaaaatttgttgtatt

SEQ ID NO: 1033617 - DNA, 22 bp, Artificial Sequence
  chemically synthesized
tcacttaataaatacaacaaat

SEQ ID NO: 1033618 - DNA, 22 bp, Artificial Sequence
  chemically synthesized
cacttaataaatacaacaaatt

SEQ ID NO: 1033619 - DNA, 22 bp, Artificial Sequence
  chemically synthesized
acttaataaatacaacaaattt

SEQ ID NO: 1033620 - DNA, 22 bp, Artificial Sequence
  chemically synthesized
aataaatacaacaaattttctt

SEQ ID NO: 1033621 - DNA, 22 bp, Artificial Sequence
  chemically synthesized
ataaatacaacaaattttcttc

SEQ ID NO: 1033622 - DNA, 22 bp, Artificial Sequence
  chemically synthesized
agagcaggtggtgaaagaattt

SEQ ID NO: 1033623 - DNA, 22 bp, Artificial Sequence
  chemically synthesized
ttaagagcaggtggtgaaagaa

SEQ ID NO: 1033624 - DNA, 22 bp, Artificial Sequence
  chemically synthesized
tcttctttaaattctttcacca

SEQ ID NO: 1033625 - DNA, 22 bp, Artificial Sequence
  chemically synthesized
cttctttaaattctttcaccac

SEQ ID NO: 1033626 - DNA, 22 bp, Artificial Sequence
  chemically synthesized
ttctttaaattctttcaccacc

SEQ ID NO: 1033627 - DNA, 22 bp, Artificial Sequence
  chemically synthesized
gttgttaagagcaggtggtgaa

SEQ ID NO: 1033628 - DNA, 22 bp, Artificial Sequence
  chemically synthesized
ctttaaattctttcaccacctg

SEQ ID NO: 1033629 - DNA, 22 bp, Artificial Sequence
  chemically synthesized
agttgttaagagcaggtggtga

SEQ ID NO: 1033630 - DNA, 22 bp, Artificial Sequence
  chemically synthesized
tttaaattctttcaccacctgc

SEQ ID NO: 1033631 - DNA, 22 bp, Artificial Sequence
  chemically synthesized
ttagttgttaagagcaggtggt

SEQ ID NO: 1033632 - DNA, 22 bp, Artificial Sequence
  chemically synthesized
taaattctttcaccacctgctc

SEQ ID NO: 1033633 - DNA, 22 bp, Artificial Sequence
  chemically synthesized
aaattctttcaccacctgctct

SEQ ID NO: 1033634 - DNA, 22 bp, Artificial Sequence
  chemically synthesized
aattctttcaccacctgctctt

SEQ ID NO: 1033635 - DNA, 22 bp, Artificial Sequence
  chemically synthesized
aattcttagttgttaagagcag

SEQ ID NO: 1033636 - DNA, 22 bp, Artificial Sequence
  chemically synthesized
tgaattcttagttgttaagagc

SEQ ID NO: 1033637 - DNA, 22 bp, Artificial Sequence
  chemically synthesized
tttcaccacctgctcttaacaa

SEQ ID NO: 1033638 - DNA, 22 bp, Artificial Sequence
  chemically synthesized
ctgaattcttagttgttaagag

SEQ ID NO: 1033639 - DNA, 22 bp, Artificial Sequence
  chemically synthesized
tcaccacctgctcttaacaact

SEQ ID NO: 1033640 - DNA, 22 bp, Artificial Sequence
  chemically synthesized
ttctgaattcttagttgttaag

SEQ ID NO: 1033641 - DNA, 22 bp, Artificial Sequence
  chemically synthesized
caccacctgctcttaacaacta

SEQ ID NO: 1033642 - DNA, 22 bp, Artificial Sequence
  chemically synthesized
cttctgaattcttagttgttaa

SEQ ID NO: 1033643 - DNA, 22 bp, Artificial Sequence
  chemically synthesized
accacctgctcttaacaactaa

SEQ ID NO: 1033644 - DNA, 22 bp, Artificial Sequence
  chemically synthesized
ctcttaacaactaagaattcag

SEQ ID NO: 1033645 - DNA, 22 bp, Artificial Sequence
  chemically synthesized
aatataatttcttctgaattct

SEQ ID NO: 1033646 - DNA, 22 bp, Artificial Sequence
  chemically synthesized
aaatataatttcttctgaattc

SEQ ID NO: 1033647 - DNA, 22 bp, Artificial Sequence
  chemically synthesized
ttaacaactaagaattcagaag

SEQ ID NO: 1033648 - DNA, 22 bp, Artificial Sequence
  chemically synthesized
taaatataatttcttctgaatt

SEQ ID NO: 1033649 - DNA, 22 bp, Artificial Sequence
  chemically synthesized
aacaactaagaattcagaagaa

SEQ ID NO: 1033650 - DNA, 22 bp, Artificial Sequence
  chemically synthesized
acaactaagaattcagaagaaa

SEQ ID NO: 1033651 - DNA, 22 bp, Artificial Sequence
  chemically synthesized
gttttaaatataatttcttctg

SEQ ID NO: 1033652 - DNA, 22 bp, Artificial Sequence
  chemically synthesized
agttttaaatataatttcttct

SEQ ID NO: 1033653 - DNA, 22 bp, Artificial Sequence
  chemically synthesized
tttagttttaaatataatttct

SEQ ID NO: 1033654 - DNA, 22 bp, Artificial Sequence
  chemically synthesized
gtttagttttaaatataatttc

SEQ ID NO: 1033655 - DNA, 22 bp, Artificial Sequence
  chemically synthesized
agaattcagaagaaattatatt

SEQ ID NO: 1033656 - DNA, 22 bp, Artificial Sequence
  chemically synthesized
cttgtttagttttaaatataat

SEQ ID NO: 1033657 - DNA, 22 bp, Artificial Sequence
  chemically synthesized
ccttgtttagttttaaatataa

SEQ ID NO: 1033658 - DNA, 22 bp, Artificial Sequence
  chemically synthesized
agaagaaattatatttaaaact

SEQ ID NO: 1033659 - DNA, 22 bp, Artificial Sequence
  chemically synthesized
catttccttgtttagttttaaa

SEQ ID NO: 1033660 - DNA, 22 bp, Artificial Sequence
  chemically synthesized
acatttccttgtttagttttaa

SEQ ID NO: 1033661 - DNA, 22 bp, Artificial Sequence
  chemically synthesized
atttacatttccttgtttagtt

SEQ ID NO: 1033662 - DNA, 22 bp, Artificial Sequence
  chemically synthesized
catttacatttccttgtttagt

SEQ ID NO: 1033663 - DNA, 22 bp, Artificial Sequence
  chemically synthesized
tatttaaaactaaacaaggaaa

SEQ ID NO: 1033664 - DNA, 22 bp, Artificial Sequence
  chemically synthesized
gccttcatttacatttccttgt

SEQ ID NO: 1033665 - DNA, 22 bp, Artificial Sequence
  chemically synthesized
aaaactaaacaaggaaatgtaa

SEQ ID NO: 1033666 - DNA, 22 bp, Artificial Sequence
  chemically synthesized
aaactaaacaaggaaatgtaaa

SEQ ID NO: 1033667 - DNA, 22 bp, Artificial Sequence
  chemically synthesized
aactagccttcatttacatttc

SEQ ID NO: 1033668 - DNA, 22 bp, Artificial Sequence
  chemically synthesized
aacaaggaaatgtaaatgaagg

SEQ ID NO: 1033669 - DNA, 22 bp, Artificial Sequence
  chemically synthesized
gatatctaaactagccttcatt

SEQ ID NO: 1033670 - DNA, 22 bp, Artificial Sequence
  chemically synthesized
aattagatatctaaactagcct

SEQ ID NO: 1033671 - DNA, 22 bp, Artificial Sequence
  chemically synthesized
taccgtctaaattagatatcta

SEQ ID NO: 1033672 - DNA, 22 bp, Artificial Sequence
  chemically synthesized
gtttagatatctaatttagacg

SEQ ID NO: 1033673 - DNA, 22 bp, Artificial Sequence
  chemically synthesized
agcacactataccgtctaaatt

SEQ ID NO: 1033674 - DNA, 22 bp, Artificial Sequence
  chemically synthesized
agatatctaatttagacggtat

SEQ ID NO: 1033675 - DNA, 22 bp, Artificial Sequence
  chemically synthesized
gatatctaatttagacggtata

SEQ ID NO: 1033676 - DNA, 22 bp, Artificial Sequence
  chemically synthesized
atttagacggtatagtgtgctg

SEQ ID NO: 1033677 - DNA, 22 bp, Artificial Sequence
  chemically synthesized
agacggtatagtgtgctgaatg

SEQ ID NO: 1033678 - DNA, 22 bp, Artificial Sequence
  chemically synthesized
aaaaacatgaaccattcagcac

SEQ ID NO: 1033679 - DNA, 22 bp, Artificial Sequence
  chemically synthesized
gacggtatagtgtgctgaatgg

SEQ ID NO: 1033680 - DNA, 22 bp, Artificial Sequence
  chemically synthesized
aaaaaacatgaaccattcagca

SEQ ID NO: 1033681 - DNA, 22 bp, Artificial Sequence
  chemically synthesized
taaaaaacatgaaccattcagc

SEQ ID NO: 1033682 - DNA, 22 bp, Artificial Sequence
  chemically synthesized
tttaaaaaacatgaaccattca

SEQ ID NO: 1033683 - DNA, 22 bp, Artificial Sequence
  chemically synthesized
aaactctttaaaaaacatgaac

SEQ ID NO: 1033684 - DNA, 22 bp, Artificial Sequence
  chemically synthesized
ttgaaactctttaaaaaacatg

SEQ ID NO: 1033685 - DNA, 22 bp, Artificial Sequence
  chemically synthesized
attgaaactctttaaaaaacat

SEQ ID NO: 1033686 - DNA, 22 bp, Artificial Sequence
  chemically synthesized
aatggttcatgttttttaaaga

SEQ ID NO: 1033687 - DNA, 22 bp, Artificial Sequence
  chemically synthesized
tgacttattgaaactctttaaa

SEQ ID NO: 1033688 - DNA, 22 bp, Artificial Sequence
  chemically synthesized
ttgtgacttattgaaactcttt

SEQ ID NO: 1033689 - DNA, 22 bp, Artificial Sequence
  chemically synthesized
attgtgacttattgaaactctt

SEQ ID NO: 1033690 - DNA, 22 bp, Artificial Sequence
  chemically synthesized
atgttttttaaagagtttcaat

SEQ ID NO: 1033691 - DNA, 22 bp, Artificial Sequence
  chemically synthesized
tcttattgtgacttattgaaac

SEQ ID NO: 1033692 - DNA, 22 bp, Artificial Sequence
  chemically synthesized
atcttattgtgacttattgaaa

SEQ ID NO: 1033693 - DNA, 22 bp, Artificial Sequence
  chemically synthesized
ttatcttattgtgacttattga

SEQ ID NO: 1033694 - DNA, 22 bp, Artificial Sequence
  chemically synthesized
tttaaagagtttcaataagtca

SEQ ID NO: 1033695 - DNA, 22 bp, Artificial Sequence
  chemically synthesized
ttaaagagtttcaataagtcac

SEQ ID NO: 1033696 - DNA, 22 bp, Artificial Sequence
  chemically synthesized
taaagagtttcaataagtcaca

SEQ ID NO: 1033697 - DNA, 22 bp, Artificial Sequence
  chemically synthesized
aaagagtttcaataagtcacaa

SEQ ID NO: 1033698 - DNA, 22 bp, Artificial Sequence
  chemically synthesized
aagagtttcaataagtcacaat

SEQ ID NO: 1033699 - DNA, 22 bp, Artificial Sequence
  chemically synthesized
caataagtcacaataagataag

SEQ ID NO: 1033700 - DNA, 22 bp, Artificial Sequence
  chemically synthesized
aataagtcacaataagataaga

SEQ ID NO: 1033701 - DNA, 22 bp, Artificial Sequence
  chemically synthesized
tcaatgaataatattcttatct

SEQ ID NO: 1033702 - DNA, 22 bp, Artificial Sequence
  chemically synthesized
caacaaaccaattatcaatgaa

SEQ ID NO: 1033703 - DNA, 22 bp, Artificial Sequence
  chemically synthesized
acaacaaaccaattatcaatga

SEQ ID NO: 1033704 - DNA, 22 bp, Artificial Sequence
  chemically synthesized
cttacaacaaaccaattatcaa

SEQ ID NO: 1033705 - DNA, 22 bp, Artificial Sequence
  chemically synthesized
ttcattgataattggtttgttg

SEQ ID NO: 1033706 - DNA, 22 bp, Artificial Sequence
  chemically synthesized
attgataattggtttgttgtaa

SEQ ID NO: 1033707 - DNA, 22 bp, Artificial Sequence
  chemically synthesized
tcaaagcgtctccttacaacaa

SEQ ID NO: 1033708 - DNA, 22 bp, Artificial Sequence
  chemically synthesized
ataattggtttgttgtaaggag

SEQ ID NO: 1033709 - DNA, 22 bp, Artificial Sequence
  chemically synthesized
gactatcaaagcgtctccttac

SEQ ID NO: 1033710 - DNA, 22 bp, Artificial Sequence
  chemically synthesized
gtttgttgtaaggagacgcttt

SEQ ID NO: 1033711 - DNA, 22 bp, Artificial Sequence
  chemically synthesized
gttgtaaggagacgctttgata

SEQ ID NO: 1033712 - DNA, 22 bp, Artificial Sequence
  chemically synthesized
ttgtaaggagacgctttgatag

SEQ ID NO: 1033713 - DNA, 22 bp, Artificial Sequence
  chemically synthesized
atgtatattggactatcaaagc

SEQ ID NO: 1033714 - DNA, 22 bp, Artificial Sequence
  chemically synthesized
aatgtatattggactatcaaag

SEQ ID NO: 1033715 - DNA, 22 bp, Artificial Sequence
  chemically synthesized
taaggagacgctttgatagtcc

SEQ ID NO: 1033716 - DNA, 22 bp, Artificial Sequence
  chemically synthesized
tgatagtccaatatacattaaa

SEQ ID NO: 1033717 - DNA, 22 bp, Artificial Sequence
  chemically synthesized
gatagtccaatatacattaaat

SEQ ID NO: 1033718 - DNA, 22 bp, Artificial Sequence
  chemically synthesized
gtgtcatgaggtatttaatgta

SEQ ID NO: 1033719 - DNA, 22 bp, Artificial Sequence
  chemically synthesized
atagtccaatatacattaaata

SEQ ID NO: 1033720 - DNA, 22 bp, Artificial Sequence
  chemically synthesized
accccatatagttggtgtcatg

SEQ ID NO: 1033721 - DNA, 22 bp, Artificial Sequence
  chemically synthesized
aatacctcatgacaccaactat

SEQ ID NO: 1033722 - DNA, 22 bp, Artificial Sequence
  chemically synthesized
caaaagattaaccccatatagt

SEQ ID NO: 1033723 - DNA, 22 bp, Artificial Sequence
  chemically synthesized
atgacaccaactatatggggtt

SEQ ID NO: 1033724 - DNA, 22 bp, Artificial Sequence
  chemically synthesized
aactgcaaaagattaaccccat

SEQ ID NO: 1033725 - DNA, 22 bp, Artificial Sequence
  chemically synthesized
aaactgcaaaagattaacccca

SEQ ID NO: 1033726 - DNA, 22 bp, Artificial Sequence
  chemically synthesized
taaactgcaaaagattaacccc

SEQ ID NO: 1033727 - DNA, 22 bp, Artificial Sequence
  chemically synthesized
tatggggttaatcttttgcagt

SEQ ID NO: 1033728 - DNA, 22 bp, Artificial Sequence
  chemically synthesized
ccagaggcaaagctttaaactg

SEQ ID NO: 1033729 - DNA, 22 bp, Artificial Sequence
  chemically synthesized
ctaccagaggcaaagctttaaa

SEQ ID NO: 1033730 - DNA, 22 bp, Artificial Sequence
  chemically synthesized
atcttttgcagtttaaagcttt

SEQ ID NO: 1033731 - DNA, 22 bp, Artificial Sequence
  chemically synthesized
actaccagaggcaaagctttaa

SEQ ID NO: 1033732 - DNA, 22 bp, Artificial Sequence
  chemically synthesized
tactaccagaggcaaagcttta

SEQ ID NO: 1033733 - DNA, 22 bp, Artificial Sequence
  chemically synthesized
ttgcagtttaaagctttgcctc

SEQ ID NO: 1033734 - DNA, 22 bp, Artificial Sequence
  chemically synthesized
tgcagtttaaagctttgcctct

SEQ ID NO: 1033735 - DNA, 22 bp, Artificial Sequence
  chemically synthesized
gcagtttaaagctttgcctctg

SEQ ID NO: 1033736 - DNA, 22 bp, Artificial Sequence
  chemically synthesized
cagtttaaagctttgcctctgg

SEQ ID NO: 1033737 - DNA, 22 bp, Artificial Sequence
  chemically synthesized
catggaagttttactaccagag

SEQ ID NO: 1033738 - DNA, 22 bp, Artificial Sequence
  chemically synthesized
aaagctttgcctctggtagtaa

SEQ ID NO: 1033739 - DNA, 22 bp, Artificial Sequence
  chemically synthesized
aagctttgcctctggtagtaaa

SEQ ID NO: 1033740 - DNA, 22 bp, Artificial Sequence
  chemically synthesized
tgcctctggtagtaaaacttcc

SEQ ID NO: 1033741 - DNA, 22 bp, Artificial Sequence
  chemically synthesized
gcctctggtagtaaaacttcca

SEQ ID NO: 1033742 - DNA, 22 bp, Artificial Sequence
  chemically synthesized
atgccaattacatggaagtttt

SEQ ID NO: 1033743 - DNA, 22 bp, Artificial Sequence
  chemically synthesized
cctctggtagtaaaacttccat

SEQ ID NO: 1033744 - DNA, 22 bp, Artificial Sequence
  chemically synthesized
ttgatgccaattacatggaagt

SEQ ID NO: 1033745 - DNA, 22 bp, Artificial Sequence
  chemically synthesized
tggtagtaaaacttccatgtaa

SEQ ID NO: 1033746 - DNA, 22 bp, Artificial Sequence
  chemically synthesized
gtagtaaaacttccatgtaatt

SEQ ID NO: 1033747 - DNA, 22 bp, Artificial Sequence
  chemically synthesized
actattgatgccaattacatgg

SEQ ID NO: 1033748 - DNA, 22 bp, Artificial Sequence
  chemically synthesized
gactattgatgccaattacatg

SEQ ID NO: 1033749 - DNA, 22 bp, Artificial Sequence
  chemically synthesized
tgtgatttgactattgatgcca

SEQ ID NO: 1033750 - DNA, 22 bp, Artificial Sequence
  chemically synthesized
ccatgtaattggcatcaatagt

SEQ ID NO: 1033751 - DNA, 22 bp, Artificial Sequence
  chemically synthesized
catgtaattggcatcaatagtc

SEQ ID NO: 1033752 - DNA, 22 bp, Artificial Sequence
  chemically synthesized
gcatcaatagtcaaatcacaca

SEQ ID NO: 1033753 - DNA, 22 bp, Artificial Sequence
  chemically synthesized
cacccagcaacccaaaatgaat

SEQ ID NO: 1033754 - DNA, 22 bp, Artificial Sequence
  chemically synthesized
ccacccagcaacccaaaatgaa

SEQ ID NO: 1033755 - DNA, 22 bp, Artificial Sequence
  chemically synthesized
tttccacccagcaacccaaaat

SEQ ID NO: 1033756 - DNA, 22 bp, Artificial Sequence
  chemically synthesized
gtttccacccagcaacccaaaa

SEQ ID NO: 1033757 - DNA, 22 bp, Artificial Sequence
  chemically synthesized
tgtttccacccagcaacccaaa

SEQ ID NO: 1033758 - DNA, 22 bp, Artificial Sequence
  chemically synthesized
attttgggttgctgggtggaaa

SEQ ID NO: 1033759 - DNA, 22 bp, Artificial Sequence
  chemically synthesized
tgggttgctgggtggaaacaaa

SEQ ID NO: 1033760 - DNA, 22 bp, Artificial Sequence
  chemically synthesized
gggttgctgggtggaaacaaaa

SEQ ID NO: 1033761 - DNA, 22 bp, Artificial Sequence
  chemically synthesized
ggttgctgggtggaaacaaaat

SEQ ID NO: 1033762 - DNA, 22 bp, Artificial Sequence
  chemically synthesized
ctgggtggaaacaaaatctcct

SEQ ID NO: 1033763 - DNA, 22 bp, Artificial Sequence
  chemically synthesized
tgagccaaatagaggagatttt

SEQ ID NO: 1033764 - DNA, 22 bp, Artificial Sequence
  chemically synthesized
ggtggaaacaaaatctcctcta

SEQ ID NO: 1033765 - DNA, 22 bp, Artificial Sequence
  chemically synthesized
agagagtgattgtgagccaaat

SEQ ID NO: 1033766 - DNA, 22 bp, Artificial Sequence
  chemically synthesized
ctctatttggctcacaatcact

SEQ ID NO: 1033767 - DNA, 22 bp, Artificial Sequence
  chemically synthesized
cacaccactgagagagtgattg

SEQ ID NO: 1033768 - DNA, 22 bp, Artificial Sequence
  chemically synthesized
tatttggctcacaatcactctc

SEQ ID NO: 1033769 - DNA, 22 bp, Artificial Sequence
  chemically synthesized
gcacaccactgagagagtgatt

SEQ ID NO: 1033770 - DNA, 22 bp, Artificial Sequence
  chemically synthesized
tgcacaccactgagagagtgat

SEQ ID NO: 1033771 - DNA, 22 bp, Artificial Sequence
  chemically synthesized
tttggctcacaatcactctctc

SEQ ID NO: 1033772 - DNA, 22 bp, Artificial Sequence
  chemically synthesized
ggctcacaatcactctctcagt

SEQ ID NO: 1033773 - DNA, 22 bp, Artificial Sequence
  chemically synthesized
gctcacaatcactctctcagtg

SEQ ID NO: 1033774 - DNA, 22 bp, Artificial Sequence
  chemically synthesized
cattttgcacaccactgagaga

SEQ ID NO: 1033775 - DNA, 22 bp, Artificial Sequence
  chemically synthesized
acaatcactctctcagtggtgt

SEQ ID NO: 1033776 - DNA, 22 bp, Artificial Sequence
  chemically synthesized
gccagtcattgcattttgcaca

SEQ ID NO: 1033777 - DNA, 22 bp, Artificial Sequence
  chemically synthesized
tctcagtggtgtgcaaaatgca

SEQ ID NO: 1033778 - DNA, 22 bp, Artificial Sequence
  chemically synthesized
actggccagtcattgcattttg

SEQ ID NO: 1033779 - DNA, 22 bp, Artificial Sequence
  chemically synthesized
tcagtggtgtgcaaaatgcaat

SEQ ID NO: 1033780 - DNA, 22 bp, Artificial Sequence
  chemically synthesized
agtggtgtgcaaaatgcaatga

SEQ ID NO: 1033781 - DNA, 22 bp, Artificial Sequence
  chemically synthesized
taaatatcattcactggccagt

SEQ ID NO: 1033782 - DNA, 22 bp, Artificial Sequence
  chemically synthesized
ttgtaaatatcattcactggcc

SEQ ID NO: 1033783 - DNA, 22 bp, Artificial Sequence
  chemically synthesized
gctattgtaaatatcattcact

SEQ ID NO: 1033784 - DNA, 22 bp, Artificial Sequence
  chemically synthesized
gccagtgaatgatatttacaat

SEQ ID NO: 1033785 - DNA, 22 bp, Artificial Sequence
  chemically synthesized
agataatccctagctattgtaa

SEQ ID NO: 1033786 - DNA, 22 bp, Artificial Sequence
  chemically synthesized
tataatctaagataatccctag

SEQ ID NO: 1033787 - DNA, 22 bp, Artificial Sequence
  chemically synthesized
acaatagctagggattatctta

SEQ ID NO: 1033788 - DNA, 22 bp, Artificial Sequence
  chemically synthesized
caatagctagggattatcttag

SEQ ID NO: 1033789 - DNA, 22 bp, Artificial Sequence
  chemically synthesized
aaggctgtataatctaagataa

SEQ ID NO: 1033790 - DNA, 22 bp, Artificial Sequence
  chemically synthesized
ctgaaggctgtataatctaaga

SEQ ID NO: 1033791 - DNA, 22 bp, Artificial Sequence
  chemically synthesized
tgctgaaggctgtataatctaa

SEQ ID NO: 1033792 - DNA, 22 bp, Artificial Sequence
  chemically synthesized
ctgctgaaggctgtataatcta

SEQ ID NO: 1033793 - DNA, 22 bp, Artificial Sequence
  chemically synthesized
gggattatcttagattatacag

SEQ ID NO: 1033794 - DNA, 22 bp, Artificial Sequence
  chemically synthesized
tgtttctgctgaaggctgtata

SEQ ID NO: 1033795 - DNA, 22 bp, Artificial Sequence
  chemically synthesized
atgtttctgctgaaggctgtat

SEQ ID NO: 1033796 - DNA, 22 bp, Artificial Sequence
  chemically synthesized
tcttagattatacagccttcag

SEQ ID NO: 1033797 - DNA, 22 bp, Artificial Sequence
  chemically synthesized
agattatacagccttcagcaga

SEQ ID NO: 1033798 - DNA, 22 bp, Artificial Sequence
  chemically synthesized
gattatacagccttcagcagaa

SEQ ID NO: 1033799 - DNA, 22 bp, Artificial Sequence
  chemically synthesized
aagtgtttatgtttctgctgaa

SEQ ID NO: 1033800 - DNA, 22 bp, Artificial Sequence
  chemically synthesized
ttcaagtgtttatgtttctgct

SEQ ID NO: 1033801 - DNA, 22 bp, Artificial Sequence
  chemically synthesized
tacagccttcagcagaaacata

SEQ ID NO: 1033802 - DNA, 22 bp, Artificial Sequence
  chemically synthesized
tgttcaagtgtttatgtttctg

SEQ ID NO: 1033803 - DNA, 22 bp, Artificial Sequence
  chemically synthesized
ctctgttcaagtgtttatgttt

SEQ ID NO: 1033804 - DNA, 22 bp, Artificial Sequence
  chemically synthesized
cagcagaaacataaacacttga

SEQ ID NO: 1033805 - DNA, 22 bp, Artificial Sequence
  chemically synthesized
acactgctctgttcaagtgttt

SEQ ID NO: 1033806 - DNA, 22 bp, Artificial Sequence
  chemically synthesized
agcagaaacataaacacttgaa

SEQ ID NO: 1033807 - DNA, 22 bp, Artificial Sequence
  chemically synthesized
cacactgctctgttcaagtgtt

SEQ ID NO: 1033808 - DNA, 22 bp, Artificial Sequence
  chemically synthesized
tttcacactgctctgttcaagt

SEQ ID NO: 1033809 - DNA, 22 bp, Artificial Sequence
  chemically synthesized
tatttcacactgctctgttcaa

SEQ ID NO: 1033810 - DNA, 22 bp, Artificial Sequence
  chemically synthesized
ctatttcacactgctctgttca

SEQ ID NO: 1033811 - DNA, 22 bp, Artificial Sequence
  chemically synthesized
tcttctatttcacactgctctg

SEQ ID NO: 1033812 - DNA, 22 bp, Artificial Sequence
  chemically synthesized
gaacagagcagtgtgaaataga

SEQ ID NO: 1033813 - DNA, 22 bp, Artificial Sequence
  chemically synthesized
aacagagcagtgtgaaatagaa

SEQ ID NO: 1033814 - DNA, 22 bp, Artificial Sequence
  chemically synthesized
ccacacactatcttctatttca

SEQ ID NO: 1033815 - DNA, 22 bp, Artificial Sequence
  chemically synthesized
ctcccacacactatcttctatt

SEQ ID NO: 1033816 - DNA, 22 bp, Artificial Sequence
  chemically synthesized
cctcctcccacacactatcttc

SEQ ID NO: 1033817 - DNA, 22 bp, Artificial Sequence
  chemically synthesized
gcctcctcccacacactatctt

SEQ ID NO: 1033818 - DNA, 22 bp, Artificial Sequence
  chemically synthesized
gagcttgcctcctcccacacac

SEQ ID NO: 1033819 - DNA, 22 bp, Artificial Sequence
  chemically synthesized
agattagagcttgcctcctccc

SEQ ID NO: 1033820 - DNA, 22 bp, Artificial Sequence
  chemically synthesized
cagattagagcttgcctcctcc

SEQ ID NO: 1033821 - DNA, 22 bp, Artificial Sequence
  chemically synthesized
tatatttcagattagagcttgc

SEQ ID NO: 1033822 - DNA, 22 bp, Artificial Sequence
  chemically synthesized
gtatatttcagattagagcttg

SEQ ID NO: 1033823 - DNA, 22 bp, Artificial Sequence
  chemically synthesized
ttgtatatttcagattagagct

SEQ ID NO: 1033824 - DNA, 22 bp, Artificial Sequence
  chemically synthesized
cttgtatatttcagattagagc

SEQ ID NO: 1033825 - DNA, 22 bp, Artificial Sequence
  chemically synthesized
ttcttgtatatttcagattaga

SEQ ID NO: 1033826 - DNA, 22 bp, Artificial Sequence
  chemically synthesized
cttcttgtatatttcagattag

SEQ ID NO: 1033827 - DNA, 22 bp, Artificial Sequence
  chemically synthesized
taatctgaaatatacaagaaga

SEQ ID NO: 1033828 - DNA, 22 bp, Artificial Sequence
  chemically synthesized
ccatatgtaagtttcttcttgt

SEQ ID NO: 1033829 - DNA, 22 bp, Artificial Sequence
  chemically synthesized
atctgaaatatacaagaagaaa

SEQ ID NO: 1033830 - DNA, 22 bp, Artificial Sequence
  chemically synthesized
gccatatgtaagtttcttcttg

SEQ ID NO: 1033831 - DNA, 22 bp, Artificial Sequence
  chemically synthesized
tgccatatgtaagtttcttctt

SEQ ID NO: 1033832 - DNA, 22 bp, Artificial Sequence
  chemically synthesized
ttgccatatgtaagtttcttct

SEQ ID NO: 1033833 - DNA, 22 bp, Artificial Sequence
  chemically synthesized
tttgccatatgtaagtttcttc

SEQ ID NO: 1033834 - DNA, 22 bp, Artificial Sequence
  chemically synthesized
ttttgccatatgtaagtttctt

SEQ ID NO: 1033835 - DNA, 22 bp, Artificial Sequence
  chemically synthesized
aaatatacaagaagaaacttac

SEQ ID NO: 1033836 - DNA, 22 bp, Artificial Sequence
  chemically synthesized
tcttttttgccatatgtaagtt

SEQ ID NO: 1033837 - DNA, 22 bp, Artificial Sequence
  chemically synthesized
tatactgtcttttttgccatat

SEQ ID NO: 1033838 - DNA, 22 bp, Artificial Sequence
  chemically synthesized
tatatactgtcttttttgccat

SEQ ID NO: 1033839 - DNA, 22 bp, Artificial Sequence
  chemically synthesized
acatatggcaaaaaagacagta

SEQ ID NO: 1033840 - DNA, 22 bp, Artificial Sequence
  chemically synthesized
catatggcaaaaaagacagtat

SEQ ID NO: 1033841 - DNA, 22 bp, Artificial Sequence
  chemically synthesized
catcaagcgtagcctctatata

SEQ ID NO: 1033842 - DNA, 22 bp, Artificial Sequence
  chemically synthesized
cctccatcaagcgtagcctcta

SEQ ID NO: 1033843 - DNA, 22 bp, Artificial Sequence
  chemically synthesized
taatctccctccatcaagcgta

SEQ ID NO: 1033844 - DNA, 22 bp, Artificial Sequence
  chemically synthesized
ttataatctccctccatcaagc

SEQ ID NO: 1033845 - DNA, 22 bp, Artificial Sequence
  chemically synthesized
attataatctccctccatcaag

SEQ ID NO: 1033846 - DNA, 22 bp, Artificial Sequence
  chemically synthesized
tcatttattataatctccctcc

SEQ ID NO: 1033847 - DNA, 22 bp, Artificial Sequence
  chemically synthesized
cgcttgatggagggagattata

SEQ ID NO: 1033848 - DNA, 22 bp, Artificial Sequence
  chemically synthesized
atctgtcatttattataatctc

SEQ ID NO: 1033849 - DNA, 22 bp, Artificial Sequence
  chemically synthesized
gatggagggagattataataaa

SEQ ID NO: 1033850 - DNA, 22 bp, Artificial Sequence
  chemically synthesized
attaatctgtcatttattataa

SEQ ID NO: 1033851 - DNA, 22 bp, Artificial Sequence
  chemically synthesized
atggagggagattataataaat

SEQ ID NO: 1033852 - DNA, 22 bp, Artificial Sequence
  chemically synthesized
taataaatgacagattaatgag

SEQ ID NO: 1033853 - DNA, 22 bp, Artificial Sequence
  chemically synthesized
gagaaaaacaagtctcattaat

SEQ ID NO: 1033854 - DNA, 22 bp, Artificial Sequence
  chemically synthesized
cgagaaaaacaagtctcattaa

SEQ ID NO: 1033855 - DNA, 22 bp, Artificial Sequence
  chemically synthesized
atgagacttgtttttctcgaag

SEQ ID NO: 1033856 - DNA, 22 bp, Artificial Sequence
  chemically synthesized
gtttttctcgaagtttatgatg

SEQ ID NO: 1033857 - DNA, 22 bp, Artificial Sequence
  chemically synthesized
tttttctcgaagtttatgatgg

SEQ ID NO: 1033858 - DNA, 22 bp, Artificial Sequence
  chemically synthesized
ttctcgaagtttatgatggttt

SEQ ID NO: 1033859 - DNA, 22 bp, Artificial Sequence
  chemically synthesized
tctcgaagtttatgatggttta

SEQ ID NO: 1033860 - DNA, 22 bp, Artificial Sequence
  chemically synthesized
ctcgaagtttatgatggtttat

SEQ ID NO: 1033861 - DNA, 22 bp, Artificial Sequence
  chemically synthesized
tcgaagtttatgatggtttatt

SEQ ID NO: 1033862 - DNA, 22 bp, Artificial Sequence
  chemically synthesized
gaagtttatgatggtttatttc

SEQ ID NO: 1033863 - DNA, 22 bp, Artificial Sequence
  chemically synthesized
gcatgtatgccagaaataaacc

SEQ ID NO: 1033864 - DNA, 22 bp, Artificial Sequence
  chemically synthesized
ggcatgtatgccagaaataaac

SEQ ID NO: 1033865 - DNA, 22 bp, Artificial Sequence
  chemically synthesized
atgatggtttatttctggcata

SEQ ID NO: 1033866 - DNA, 22 bp, Artificial Sequence
  chemically synthesized
tgatggtttatttctggcatac

SEQ ID NO: 1033867 - DNA, 22 bp, Artificial Sequence
  chemically synthesized
atagcatcaacttggcatgtat

SEQ ID NO: 1033868 - DNA, 22 bp, Artificial Sequence
  chemically synthesized
gatagcatcaacttggcatgta

SEQ ID NO: 1033869 - DNA, 22 bp, Artificial Sequence
  chemically synthesized
atttctggcatacatgccaagt

SEQ ID NO: 1033870 - DNA, 22 bp, Artificial Sequence
  chemically synthesized
tttctggcatacatgccaagtt

SEQ ID NO: 1033871 - DNA, 22 bp, Artificial Sequence
  chemically synthesized
ctggcatacatgccaagttgat

SEQ ID NO: 1033872 - DNA, 22 bp, Artificial Sequence
  chemically synthesized
taatttgatagcatcaacttgg

SEQ ID NO: 1033873 - DNA, 22 bp, Artificial Sequence
  chemically synthesized
tggcatacatgccaagttgatg

SEQ ID NO: 1033874 - DNA, 22 bp, Artificial Sequence
  chemically synthesized
gcatacatgccaagttgatgct

SEQ ID NO: 1033875 - DNA, 22 bp, Artificial Sequence
  chemically synthesized
atgctatcaaattatagtgttc

SEQ ID NO: 1033876 - DNA, 22 bp, Artificial Sequence
  chemically synthesized
atgataataatggtaatgaaca

SEQ ID NO: 1033877 - DNA, 22 bp, Artificial Sequence
  chemically synthesized
tcaaattatagtgttcattacc

SEQ ID NO: 1033878 - DNA, 22 bp, Artificial Sequence
  chemically synthesized
gatgataataatggtaatgaac

SEQ ID NO: 1033879 - DNA, 22 bp, Artificial Sequence
  chemically synthesized
tagtgttcattaccattattat

SEQ ID NO: 1033880 - DNA, 22 bp, Artificial Sequence
  chemically synthesized
attaccattattatcatcaagt

SEQ ID NO: 1033881 - DNA, 22 bp, Artificial Sequence
  chemically synthesized
gtaatcaatacgacttgatgat

SEQ ID NO: 1033882 - DNA, 22 bp, Artificial Sequence
  chemically synthesized
ccattattatcatcaagtcgta

SEQ ID NO: 1033883 - DNA, 22 bp, Artificial Sequence
  chemically synthesized
ttatcatcaagtcgtattgatt

SEQ ID NO: 1033884 - DNA, 22 bp, Artificial Sequence
  chemically synthesized
tcatcaagtcgtattgattacc

SEQ ID NO: 1033885 - DNA, 22 bp, Artificial Sequence
  chemically synthesized
attaccaatgtgcactctactg

SEQ ID NO: 1033886 - DNA, 22 bp, Artificial Sequence
  chemically synthesized
tatatataatgcccagtagagt

SEQ ID NO: 1033887 - DNA, 22 bp, Artificial Sequence
  chemically synthesized
gtatatataatgcccagtagag

SEQ ID NO: 1033888 - DNA, 22 bp, Artificial Sequence
  chemically synthesized
ccaatgtgcactctactgggca

SEQ ID NO: 1033889 - DNA, 22 bp, Artificial Sequence
  chemically synthesized
cttgtatatataatgcccagta

SEQ ID NO: 1033890 - DNA, 22 bp, Artificial Sequence
  chemically synthesized
gcttgtatatataatgcccagt

SEQ ID NO: 1033891 - DNA, 22 bp, Artificial Sequence
  chemically synthesized
tgcttgtatatataatgcccag

SEQ ID NO: 1033892 - DNA, 22 bp, Artificial Sequence
  chemically synthesized
aattttgcttgtatatataatg

SEQ ID NO: 1033893 - DNA, 22 bp, Artificial Sequence
  chemically synthesized
tactgggcattatatatacaag

SEQ ID NO: 1033894 - DNA, 22 bp, Artificial Sequence
  chemically synthesized
ctgggcattatatatacaagca

SEQ ID NO: 1033895 - DNA, 22 bp, Artificial Sequence
  chemically synthesized
ggcattatatatacaagcaaaa

SEQ ID NO: 1033896 - DNA, 22 bp, Artificial Sequence
  chemically synthesized
tatatacaagcaaaattcaggt

SEQ ID NO: 1033897 - DNA, 22 bp, Artificial Sequence
  chemically synthesized
aatgtcagaaaccacctgaatt

SEQ ID NO: 1033898 - DNA, 22 bp, Artificial Sequence
  chemically synthesized
ttgaatgtcagaaaccacctga

SEQ ID NO: 1033899 - DNA, 22 bp, Artificial Sequence
  chemically synthesized
gttgttgaatgtcagaaaccac

SEQ ID NO: 1033900 - DNA, 22 bp, Artificial Sequence
  chemically synthesized
ttggttgttgaatgtcagaaac

SEQ ID NO: 1033901 - DNA, 22 bp, Artificial Sequence
  chemically synthesized
attggttgttgaatgtcagaaa

SEQ ID NO: 1033902 - DNA, 22 bp, Artificial Sequence
  chemically synthesized
tattggttgttgaatgtcagaa

SEQ ID NO: 1033903 - DNA, 22 bp, Artificial Sequence
  chemically synthesized
ttttattggttgttgaatgtca

SEQ ID NO: 1033904 - DNA, 22 bp, Artificial Sequence
  chemically synthesized
attttattggttgttgaatgtc

SEQ ID NO: 1033905 - DNA, 22 bp, Artificial Sequence
  chemically synthesized
aggtggtttctgacattcaaca

SEQ ID NO: 1033906 - DNA, 22 bp, Artificial Sequence
  chemically synthesized
atttattttattggttgttgaa

SEQ ID NO: 1033907 - DNA, 22 bp, Artificial Sequence
  chemically synthesized
gtctgatttattttattggttg

SEQ ID NO: 1033908 - DNA, 22 bp, Artificial Sequence
  chemically synthesized
ctgacattcaacaaccaataaa

SEQ ID NO: 1033909 - DNA, 22 bp, Artificial Sequence
  chemically synthesized
ggtctgatttattttattggtt

SEQ ID NO: 1033910 - DNA, 22 bp, Artificial Sequence
  chemically synthesized
tgacattcaacaaccaataaaa

SEQ ID NO: 1033911 - DNA, 22 bp, Artificial Sequence
  chemically synthesized
tggtctgatttattttattggt

SEQ ID NO: 1033912 - DNA, 22 bp, Artificial Sequence
  chemically synthesized
acattcaacaaccaataaaata

SEQ ID NO: 1033913 - DNA, 22 bp, Artificial Sequence
  chemically synthesized
caatctttggtctgatttattt

SEQ ID NO: 1033914 - DNA, 22 bp, Artificial Sequence
  chemically synthesized
aacaaccaataaaataaatcag

SEQ ID NO: 1033915 - DNA, 22 bp, Artificial Sequence
  chemically synthesized
catatgtctacaatctttggtc

SEQ ID NO: 1033916 - DNA, 22 bp, Artificial Sequence
  chemically synthesized
ctacatatgtctacaatctttg

SEQ ID NO: 1033917 - DNA, 22 bp, Artificial Sequence
  chemically synthesized
tcctacatatgtctacaatctt

SEQ ID NO: 1033918 - DNA, 22 bp, Artificial Sequence
  chemically synthesized
tacgctctcctacatatgtcta

SEQ ID NO: 1033919 - DNA, 22 bp, Artificial Sequence
  chemically synthesized
tgcactatacgctctcctacat

SEQ ID NO: 1033920 - DNA, 22 bp, Artificial Sequence
  chemically synthesized
gtgcactatacgctctcctaca

SEQ ID NO: 1033921 - DNA, 22 bp, Artificial Sequence
  chemically synthesized
tagacatatgtaggagagcgta

SEQ ID NO: 1033922 - DNA, 22 bp, Artificial Sequence
  chemically synthesized
agtatcttgtgcactatacgct

SEQ ID NO: 1033923 - DNA, 22 bp, Artificial Sequence
  chemically synthesized
gagtatcttgtgcactatacgc

SEQ ID NO: 1033924 - DNA, 22 bp, Artificial Sequence
  chemically synthesized
catttgagtatcttgtgcacta

SEQ ID NO: 1033925 - DNA, 22 bp, Artificial Sequence
  chemically synthesized
tccatttgagtatcttgtgcac

SEQ ID NO: 1033926 - DNA, 22 bp, Artificial Sequence
  chemically synthesized
ctccatttgagtatcttgtgca

SEQ ID NO: 1033927 - DNA, 22 bp, Artificial Sequence
  chemically synthesized
tctccatttgagtatcttgtgc

SEQ ID NO: 1033928 - DNA, 22 bp, Artificial Sequence
  chemically synthesized
ttctccatttgagtatcttgtg

SEQ ID NO: 1033929 - DNA, 22 bp, Artificial Sequence
  chemically synthesized
agtttttctccatttgagtatc

SEQ ID NO: 1033930 - DNA, 22 bp, Artificial Sequence
  chemically synthesized
aagtttttctccatttgagtat

SEQ ID NO: 1033931 - DNA, 22 bp, Artificial Sequence
  chemically synthesized
taagtttttctccatttgagta

SEQ ID NO: 1033932 - DNA, 22 bp, Artificial Sequence
  chemically synthesized
acctttaagtttttctccattt

SEQ ID NO: 1033933 - DNA, 22 bp, Artificial Sequence
  chemically synthesized
aacctttaagtttttctccatt

SEQ ID NO: 1033934 - DNA, 22 bp, Artificial Sequence
  chemically synthesized
taacctttaagtttttctccat

SEQ ID NO: 1033935 - DNA, 22 bp, Artificial Sequence
  chemically synthesized
ttaacctttaagtttttctcca

SEQ ID NO: 1033936 - DNA, 22 bp, Artificial Sequence
  chemically synthesized
tttttaacctttaagtttttct

SEQ ID NO: 1033937 - DNA, 22 bp, Artificial Sequence
  chemically synthesized
atttttaacctttaagtttttc

SEQ ID NO: 1033938 - DNA, 22 bp, Artificial Sequence
  chemically synthesized
aaatggagaaaaacttaaaggt

SEQ ID NO: 1033939 - DNA, 22 bp, Artificial Sequence
  chemically synthesized
aaaatttatttttaacctttaa

SEQ ID NO: 1033940 - DNA, 22 bp, Artificial Sequence
  chemically synthesized
aaaaatttatttttaaccttta

SEQ ID NO: 1033941 - DNA, 22 bp, Artificial Sequence
  chemically synthesized
aaagtatttaaaaatttatttt

SEQ ID NO: 1033942 - DNA, 22 bp, Artificial Sequence
  chemically synthesized
aaaggttaaaaataaattttta

SEQ ID NO: 1033943 - DNA, 22 bp, Artificial Sequence
  chemically synthesized
aaggttaaaaataaatttttaa

SEQ ID NO: 1033944 - DNA, 22 bp, Artificial Sequence
  chemically synthesized
aacactgaaagtatttaaaaat

SEQ ID NO: 1033945 - DNA, 22 bp, Artificial Sequence
  chemically synthesized
aaaataaatttttaaatacttt

SEQ ID NO: 1033946 - DNA, 22 bp, Artificial Sequence
  chemically synthesized
acctaaacactgaaagtattta

SEQ ID NO: 1033947 - DNA, 22 bp, Artificial Sequence
  chemically synthesized
ccagttcacctaaacactgaaa

SEQ ID NO: 1033948 - DNA, 22 bp, Artificial Sequence
  chemically synthesized
accagttcacctaaacactgaa

SEQ ID NO: 1033949 - DNA, 22 bp, Artificial Sequence
  chemically synthesized
ttaaatactttcagtgtttagg

SEQ ID NO: 1033950 - DNA, 22 bp, Artificial Sequence
  chemically synthesized
taaatactttcagtgtttaggt

SEQ ID NO: 1033951 - DNA, 22 bp, Artificial Sequence
  chemically synthesized
aaatactttcagtgtttaggtg

SEQ ID NO: 1033952 - DNA, 22 bp, Artificial Sequence
  chemically synthesized
aatactttcagtgtttaggtga

SEQ ID NO: 1033953 - DNA, 22 bp, Artificial Sequence
  chemically synthesized
tcagtgtttaggtgaactggta

SEQ ID NO: 1033954 - DNA, 22 bp, Artificial Sequence
  chemically synthesized
cagtgtttaggtgaactggtaa

SEQ ID NO: 1033955 - DNA, 22 bp, Artificial Sequence
  chemically synthesized
agtgtttaggtgaactggtaag

SEQ ID NO: 1033956 - DNA, 22 bp, Artificial Sequence
  chemically synthesized
acacaccaaaacacttaccagt

SEQ ID NO: 1033957 - DNA, 22 bp, Artificial Sequence
  chemically synthesized
aggtgaactggtaagtgttttg

SEQ ID NO: 1033958 - DNA, 22 bp, Artificial Sequence
  chemically synthesized
ggtgaactggtaagtgttttgg

SEQ ID NO: 1033959 - DNA, 22 bp, Artificial Sequence
  chemically synthesized
taaactgacacaccaaaacact

SEQ ID NO: 1033960 - DNA, 22 bp, Artificial Sequence
  chemically synthesized
ataaactgacacaccaaaacac

SEQ ID NO: 1033961 - DNA, 22 bp, Artificial Sequence
  chemically synthesized
ttataaactgacacaccaaaac

SEQ ID NO: 1033962 - DNA, 22 bp, Artificial Sequence
  chemically synthesized
gtaagtgttttggtgtgtcagt

SEQ ID NO: 1033963 - DNA, 22 bp, Artificial Sequence
  chemically synthesized
tggtgtgtcagtttataagaac

SEQ ID NO: 1033964 - DNA, 22 bp, Artificial Sequence
  chemically synthesized
ggtgtgtcagtttataagaaca

SEQ ID NO: 1033965 - DNA, 22 bp, Artificial Sequence
  chemically synthesized
gtgtgtcagtttataagaacat

SEQ ID NO: 1033966 - DNA, 22 bp, Artificial Sequence
  chemically synthesized
gatatagcaagcaatgttctta

SEQ ID NO: 1033967 - DNA, 22 bp, Artificial Sequence
  chemically synthesized
agatatagcaagcaatgttctt

SEQ ID NO: 1033968 - DNA, 22 bp, Artificial Sequence
  chemically synthesized
ccttagatatagcaagcaatgt

SEQ ID NO: 1033969 - DNA, 22 bp, Artificial Sequence
  chemically synthesized
ataagaacattgcttgctatat

SEQ ID NO: 1033970 - DNA, 22 bp, Artificial Sequence
  chemically synthesized
taagaacattgcttgctatatc

SEQ ID NO: 1033971 - DNA, 22 bp, Artificial Sequence
  chemically synthesized
cttgctatatctaagggaacta

SEQ ID NO: 1033972 - DNA, 22 bp, Artificial Sequence
  chemically synthesized
gctatatctaagggaactactt

SEQ ID NO: 1033973 - DNA, 22 bp, Artificial Sequence
  chemically synthesized
ctatatctaagggaactactta

SEQ ID NO: 1033974 - DNA, 22 bp, Artificial Sequence
  chemically synthesized
agaaaataatgaataagtagtt

SEQ ID NO: 1033975 - DNA, 22 bp, Artificial Sequence
  chemically synthesized
aagaaaataatgaataagtagt

SEQ ID NO: 1033976 - DNA, 22 bp, Artificial Sequence
  chemically synthesized
tatctaagggaactacttattc

SEQ ID NO: 1033977 - DNA, 22 bp, Artificial Sequence
  chemically synthesized
taagaaaataatgaataagtag

SEQ ID NO: 1033978 - DNA, 22 bp, Artificial Sequence
  chemically synthesized
ttaagaaaataatgaataagta

SEQ ID NO: 1033979 - DNA, 22 bp, Artificial Sequence
  chemically synthesized
atttttaagaaaataatgaata

SEQ ID NO: 1033980 - DNA, 22 bp, Artificial Sequence
  chemically synthesized
agggaactacttattcattatt

SEQ ID NO: 1033981 - DNA, 22 bp, Artificial Sequence
  chemically synthesized
cttattcattattttcttaaaa

SEQ ID NO: 1033982 - DNA, 22 bp, Artificial Sequence
  chemically synthesized
gatagaattcatttttaagaaa

SEQ ID NO: 1033983 - DNA, 22 bp, Artificial Sequence
  chemically synthesized
attcattattttcttaaaaatg

SEQ ID NO: 1033984 - DNA, 22 bp, Artificial Sequence
  chemically synthesized
ttcattattttcttaaaaatga

SEQ ID NO: 1033985 - DNA, 22 bp, Artificial Sequence
  chemically synthesized
gttggatagaattcatttttaa

SEQ ID NO: 1033986 - DNA, 22 bp, Artificial Sequence
  chemically synthesized
attattttcttaaaaatgaatt

SEQ ID NO: 1033987 - DNA, 22 bp, Artificial Sequence
  chemically synthesized
ttttcttaaaaatgaattctat

SEQ ID NO: 1033988 - DNA, 22 bp, Artificial Sequence
  chemically synthesized
agtaactagttggatagaattc

SEQ ID NO: 1033989 - DNA, 22 bp, Artificial Sequence
  chemically synthesized
tcttaaaaatgaattctatcca

SEQ ID NO: 1033990 - DNA, 22 bp, Artificial Sequence
  chemically synthesized
cttaaaaatgaattctatccaa

SEQ ID NO: 1033991 - DNA, 22 bp, Artificial Sequence
  chemically synthesized
ctaagtaactagttggatagaa

SEQ ID NO: 1033992 - DNA, 22 bp, Artificial Sequence
  chemically synthesized
ttaaaaatgaattctatccaac

SEQ ID NO: 1033993 - DNA, 22 bp, Artificial Sequence
  chemically synthesized
actaagtaactagttggataga

SEQ ID NO: 1033994 - DNA, 22 bp, Artificial Sequence
  chemically synthesized
aaaaatgaattctatccaacta

SEQ ID NO: 1033995 - DNA, 22 bp, Artificial Sequence
  chemically synthesized
aaaatgaattctatccaactag

SEQ ID NO: 1033996 - DNA, 22 bp, Artificial Sequence
  chemically synthesized
aaaatcatgatttactaagtaa

SEQ ID NO: 1033997 - DNA, 22 bp, Artificial Sequence
  chemically synthesized
tatccaactagttacttagtaa

SEQ ID NO: 1033998 - DNA, 22 bp, Artificial Sequence
  chemically synthesized
gaaaatcatgatttactaagta

SEQ ID NO: 1033999 - DNA, 22 bp, Artificial Sequence
  chemically synthesized
tgaaaatcatgatttactaagt

SEQ ID NO: 1034000 - DNA, 22 bp, Artificial Sequence
  chemically synthesized
tccaactagttacttagtaaat

SEQ ID NO: 1034001 - DNA, 22 bp, Artificial Sequence
  chemically synthesized
tttgaaaatcatgatttactaa

SEQ ID NO: 1034002 - DNA, 22 bp, Artificial Sequence
  chemically synthesized
ctttgaaaatcatgatttacta

SEQ ID NO: 1034003 - DNA, 22 bp, Artificial Sequence
  chemically synthesized
gttacttagtaaatcatgattt

SEQ ID NO: 1034004 - DNA, 22 bp, Artificial Sequence
  chemically synthesized
aagatcttctttgaaaatcatg

SEQ ID NO: 1034005 - DNA, 22 bp, Artificial Sequence
  chemically synthesized
cttagtaaatcatgattttcaa

SEQ ID NO: 1034006 - DNA, 22 bp, Artificial Sequence
  chemically synthesized
agtaaatcatgattttcaaaga

SEQ ID NO: 1034007 - DNA, 22 bp, Artificial Sequence
  chemically synthesized
ccctcaagatcttctttgaaaa

SEQ ID NO: 1034008 - DNA, 22 bp, Artificial Sequence
  chemically synthesized
gtaaatcatgattttcaaagaa

SEQ ID NO: 1034009 - DNA, 22 bp, Artificial Sequence
  chemically synthesized
accctcaagatcttctttgaaa

SEQ ID NO: 1034010 - DNA, 22 bp, Artificial Sequence
  chemically synthesized
taccctcaagatcttctttgaa

SEQ ID NO: 1034011 - DNA, 22 bp, Artificial Sequence
  chemically synthesized
ttaccctcaagatcttctttga

SEQ ID NO: 1034012 - DNA, 22 bp, Artificial Sequence
  chemically synthesized
gtttttaccctcaagatcttct

SEQ ID NO: 1034013 - DNA, 22 bp, Artificial Sequence
  chemically synthesized
tggtttttaccctcaagatctt

SEQ ID NO: 1034014 - DNA, 22 bp, Artificial Sequence
  chemically synthesized
ttctggtttttaccctcaagat

SEQ ID NO: 1034015 - DNA, 22 bp, Artificial Sequence
  chemically synthesized
tgttctggtttttaccctcaag

SEQ ID NO: 1034016 - DNA, 22 bp, Artificial Sequence
  chemically synthesized
tcaaagaagatcttgagggtaa

SEQ ID NO: 1034017 - DNA, 22 bp, Artificial Sequence
  chemically synthesized
caaagaagatcttgagggtaaa

SEQ ID NO: 1034018 - DNA, 22 bp, Artificial Sequence
  chemically synthesized
aaagaagatcttgagggtaaaa

SEQ ID NO: 1034019 - DNA, 22 bp, Artificial Sequence
  chemically synthesized
tggggaaatgttctgttctggt

SEQ ID NO: 1034020 - DNA, 22 bp, Artificial Sequence
  chemically synthesized
atggggaaatgttctgttctgg

SEQ ID NO: 1034021 - DNA, 22 bp, Artificial Sequence
  chemically synthesized
gagggtaaaaaccagaacagaa

SEQ ID NO: 1034022 - DNA, 22 bp, Artificial Sequence
  chemically synthesized
agggtaaaaaccagaacagaac

SEQ ID NO: 1034023 - DNA, 22 bp, Artificial Sequence
  chemically synthesized
aaaccatggtttatggggaaat

SEQ ID NO: 1034024 - DNA, 22 bp, Artificial Sequence
  chemically synthesized
ttgaaaccatggtttatgggga

SEQ ID NO: 1034025 - DNA, 22 bp, Artificial Sequence
  chemically synthesized
aattgttgaaaccatggtttat

SEQ ID NO: 1034026 - DNA, 22 bp, Artificial Sequence
  chemically synthesized
gaattgttgaaaccatggttta

SEQ ID NO: 1034027 - DNA, 22 bp, Artificial Sequence
  chemically synthesized
tgaattgttgaaaccatggttt

SEQ ID NO: 1034028 - DNA, 22 bp, Artificial Sequence
  chemically synthesized
ttgaattgttgaaaccatggtt

SEQ ID NO: 1034029 - DNA, 22 bp, Artificial Sequence
  chemically synthesized
tttgaattgttgaaaccatggt

SEQ ID NO: 1034030 - DNA, 22 bp, Artificial Sequence
  chemically synthesized
ttttgaattgttgaaaccatgg

SEQ ID NO: 1034031 - DNA, 22 bp, Artificial Sequence
  chemically synthesized
ccccataaaccatggtttcaac

SEQ ID NO: 1034032 - DNA, 22 bp, Artificial Sequence
  chemically synthesized
cccataaaccatggtttcaaca

SEQ ID NO: 1034033 - DNA, 22 bp, Artificial Sequence
  chemically synthesized
acttttttgaattgttgaaacc

SEQ ID NO: 1034034 - DNA, 22 bp, Artificial Sequence
  chemically synthesized
cgtctcacttttttgaattgtt

SEQ ID NO: 1034035 - DNA, 22 bp, Artificial Sequence
  chemically synthesized
caccactccgtctcactttttt

SEQ ID NO: 1034036 - DNA, 22 bp, Artificial Sequence
  chemically synthesized
gcaccactccgtctcacttttt

SEQ ID NO: 1034037 - DNA, 22 bp, Artificial Sequence
  chemically synthesized
caacaattcaaaaaagtgagac

SEQ ID NO: 1034038 - DNA, 22 bp, Artificial Sequence
  chemically synthesized
aacaattcaaaaaagtgagacg

SEQ ID NO: 1034039 - DNA, 22 bp, Artificial Sequence
  chemically synthesized
acatcttgcaccactccgtctc

SEQ ID NO: 1034040 - DNA, 22 bp, Artificial Sequence
  chemically synthesized
tgacatcttgcaccactccgtc

SEQ ID NO: 1034041 - DNA, 22 bp, Artificial Sequence
  chemically synthesized
aaaaaagtgagacggagtggtg

SEQ ID NO: 1034042 - DNA, 22 bp, Artificial Sequence
  chemically synthesized
ttctgacatcttgcaccactcc

SEQ ID NO: 1034043 - DNA, 22 bp, Artificial Sequence
  chemically synthesized
tattctgacatcttgcaccact

SEQ ID NO: 1034044 - DNA, 22 bp, Artificial Sequence
  chemically synthesized
ctattctgacatcttgcaccac

SEQ ID NO: 1034045 - DNA, 22 bp, Artificial Sequence
  chemically synthesized
tataggcttctattctgacatc

SEQ ID NO: 1034046 - DNA, 22 bp, Artificial Sequence
  chemically synthesized
gttatataggcttctattctga

SEQ ID NO: 1034047 - DNA, 22 bp, Artificial Sequence
  chemically synthesized
agtgagggagattagttatata

SEQ ID NO: 1034048 - DNA, 22 bp, Artificial Sequence
  chemically synthesized
cagtgagggagattagttatat

SEQ ID NO: 1034049 - DNA, 22 bp, Artificial Sequence
  chemically synthesized
atgtttcagtgagggagattag

SEQ ID NO: 1034050 - DNA, 22 bp, Artificial Sequence
  chemically synthesized
gatgtttcagtgagggagatta

SEQ ID NO: 1034051 - DNA, 22 bp, Artificial Sequence
  chemically synthesized
tataactaatctccctcactga

SEQ ID NO: 1034052 - DNA, 22 bp, Artificial Sequence
  chemically synthesized
caatttgatgtttcagtgaggg

SEQ ID NO: 1034053 - DNA, 22 bp, Artificial Sequence
  chemically synthesized
ttacaatttgatgtttcagtga

SEQ ID NO: 1034054 - DNA, 22 bp, Artificial Sequence
  chemically synthesized
atctccctcactgaaacatcaa

SEQ ID NO: 1034055 - DNA, 22 bp, Artificial Sequence
  chemically synthesized
atagttgttacaatttgatgtt

SEQ ID NO: 1034056 - DNA, 22 bp, Artificial Sequence
  chemically synthesized
cctcactgaaacatcaaattgt

SEQ ID NO: 1034057 - DNA, 22 bp, Artificial Sequence
  chemically synthesized
ctcatagttgttacaatttgat

SEQ ID NO: 1034058 - DNA, 22 bp, Artificial Sequence
  chemically synthesized
actgaaacatcaaattgtaaca

SEQ ID NO: 1034059 - DNA, 22 bp, Artificial Sequence
  chemically synthesized
tctgctcatagttgttacaatt

SEQ ID NO: 1034060 - DNA, 22 bp, Artificial Sequence
  chemically synthesized
tgtctgctcatagttgttacaa

SEQ ID NO: 1034061 - DNA, 22 bp, Artificial Sequence
  chemically synthesized
ctgtctgctcatagttgttaca

SEQ ID NO: 1034062 - DNA, 22 bp, Artificial Sequence
  chemically synthesized
aaacatcaaattgtaacaacta

SEQ ID NO: 1034063 - DNA, 22 bp, Artificial Sequence
  chemically synthesized
tctgtctgctcatagttgttac

SEQ ID NO: 1034064 - DNA, 22 bp, Artificial Sequence
  chemically synthesized
ttctgtctgctcatagttgtta

SEQ ID NO: 1034065 - DNA, 22 bp, Artificial Sequence
  chemically synthesized
taacaactatgagcagacagaa

SEQ ID NO: 1034066 - DNA, 22 bp, Artificial Sequence
  chemically synthesized
gtgacagtgcttttctgtctgc

SEQ ID NO: 1034067 - DNA, 22 bp, Artificial Sequence
  chemically synthesized
tggtgacagtgcttttctgtct

SEQ ID NO: 1034068 - DNA, 22 bp, Artificial Sequence
  chemically synthesized
gttctggtgacagtgcttttct

SEQ ID NO: 1034069 - DNA, 22 bp, Artificial Sequence
  chemically synthesized
ggttctggtgacagtgcttttc

SEQ ID NO: 1034070 - DNA, 22 bp, Artificial Sequence
  chemically synthesized
tggttctggtgacagtgctttt

SEQ ID NO: 1034071 - DNA, 22 bp, Artificial Sequence
  chemically synthesized
tgagcagacagaaaagcactgt

SEQ ID NO: 1034072 - DNA, 22 bp, Artificial Sequence
  chemically synthesized
ttggttctggtgacagtgcttt

SEQ ID NO: 1034073 - DNA, 22 bp, Artificial Sequence
  chemically synthesized
gtttttggttctggtgacagtg

SEQ ID NO: 1034074 - DNA, 22 bp, Artificial Sequence
  chemically synthesized
cgtacctggtttttggttctgg

SEQ ID NO: 1034075 - DNA, 22 bp, Artificial Sequence
  chemically synthesized
tcaccagaaccaaaaaccaggt

SEQ ID NO: 1034076 - DNA, 22 bp, Artificial Sequence
  chemically synthesized
aaaccaggtaccatgattccgt

SEQ ID NO: 1034077 - DNA, 22 bp, Artificial Sequence
  chemically synthesized
gcaagatgaagttaaaaccagg

SEQ ID NO: 1034078 - DNA, 22 bp, Artificial Sequence
  chemically synthesized
agcaagatgaagttaaaaccag

SEQ ID NO: 1034079 - DNA, 22 bp, Artificial Sequence
  chemically synthesized
tagcaagatgaagttaaaacca

SEQ ID NO: 1034080 - DNA, 22 bp, Artificial Sequence
  chemically synthesized
ttagcaagatgaagttaaaacc

SEQ ID NO: 1034081 - DNA, 22 bp, Artificial Sequence
  chemically synthesized
ttttagcaagatgaagttaaaa

SEQ ID NO: 1034082 - DNA, 22 bp, Artificial Sequence
  chemically synthesized
aatgcctcttttagcaagatga

SEQ ID NO: 1034083 - DNA, 22 bp, Artificial Sequence
  chemically synthesized
gttttaacttcatcttgctaaa

SEQ ID NO: 1034084 - DNA, 22 bp, Artificial Sequence
  chemically synthesized
ctcaatgcctcttttagcaaga

SEQ ID NO: 1034085 - DNA, 22 bp, Artificial Sequence
  chemically synthesized
cctcaatgcctcttttagcaag

SEQ ID NO: 1034086 - DNA, 22 bp, Artificial Sequence
  chemically synthesized
tcctcaatgcctcttttagcaa

SEQ ID NO: 1034087 - DNA, 22 bp, Artificial Sequence
  chemically synthesized
taacttcatcttgctaaaagag

SEQ ID NO: 1034088 - DNA, 22 bp, Artificial Sequence
  chemically synthesized
aacttcatcttgctaaaagagg

SEQ ID NO: 1034089 - DNA, 22 bp, Artificial Sequence
  chemically synthesized
acttcatcttgctaaaagaggc

SEQ ID NO: 1034090 - DNA, 22 bp, Artificial Sequence
  chemically synthesized
cctttcctcaatgcctctttta

SEQ ID NO: 1034091 - DNA, 22 bp, Artificial Sequence
  chemically synthesized
ctgcctttcctcaatgcctctt

SEQ ID NO: 1034092 - DNA, 22 bp, Artificial Sequence
  chemically synthesized
catcttgctaaaagaggcattg

SEQ ID NO: 1034093 - DNA, 22 bp, Artificial Sequence
  chemically synthesized
atcttgctaaaagaggcattga

SEQ ID NO: 1034094 - DNA, 22 bp, Artificial Sequence
  chemically synthesized
tgtctcctgcctttcctcaatg

SEQ ID NO: 1034095 - DNA, 22 bp, Artificial Sequence
  chemically synthesized
gctaaaagaggcattgaggaaa

SEQ ID NO: 1034096 - DNA, 22 bp, Artificial Sequence
  chemically synthesized
ctaaaagaggcattgaggaaag

SEQ ID NO: 1034097 - DNA, 22 bp, Artificial Sequence
  chemically synthesized
aaagaggcattgaggaaaggca

SEQ ID NO: 1034098 - DNA, 22 bp, Artificial Sequence
  chemically synthesized
aagactgtgtctcctgcctttc

SEQ ID NO: 1034099 - DNA, 22 bp, Artificial Sequence
  chemically synthesized
gtgattcaagactgtgtctcct

SEQ ID NO: 1034100 - DNA, 22 bp, Artificial Sequence
  chemically synthesized
aggaaaggcaggagacacagtc

SEQ ID NO: 1034101 - DNA, 22 bp, Artificial Sequence
  chemically synthesized
ggaaggtgtggtgttggtgatt

SEQ ID NO: 1034102 - DNA, 22 bp, Artificial Sequence
  chemically synthesized
ggtgattgggaaggtgtggtgt

SEQ ID NO: 1034103 - DNA, 22 bp, Artificial Sequence
  chemically synthesized
gaatcaccaacaccacaccttc

SEQ ID NO: 1034104 - DNA, 22 bp, Artificial Sequence
  chemically synthesized
aatcaccaacaccacaccttcc

SEQ ID NO: 1034105 - DNA, 22 bp, Artificial Sequence
  chemically synthesized
cacgtccagtgctgggtgattg

SEQ ID NO: 1034106 - DNA, 22 bp, Artificial Sequence
  chemically synthesized
cactgcacgtccagtgctgggt

SEQ ID NO: 1034107 - DNA, 22 bp, Artificial Sequence
  chemically synthesized
tgcactgcacgtccagtgctgg

SEQ ID NO: 1034108 - DNA, 22 bp, Artificial Sequence
  chemically synthesized
tctgcactgcacgtccagtgct

SEQ ID NO: 1034109 - DNA, 22 bp, Artificial Sequence
  chemically synthesized
cccaatcacccagcactggacg

SEQ ID NO: 1034110 - DNA, 22 bp, Artificial Sequence
  chemically synthesized
ccaatcacccagcactggacgt

SEQ ID NO: 1034111 - DNA, 22 bp, Artificial Sequence
  chemically synthesized
cctctctgcactgcacgtccag

SEQ ID NO: 1034112 - DNA, 22 bp, Artificial Sequence
  chemically synthesized
gacgtgcagtgcagagagggaa

SEQ ID NO: 1034113 - DNA, 22 bp, Artificial Sequence
  chemically synthesized
caaaagtgcaaagattccctct

SEQ ID NO: 1034114 - DNA, 22 bp, Artificial Sequence
  chemically synthesized
ccaaaagtgcaaagattccctc

SEQ ID NO: 1034115 - DNA, 22 bp, Artificial Sequence
  chemically synthesized
tcccttccaaaagtgcaaagat

SEQ ID NO: 1034116 - DNA, 22 bp, Artificial Sequence
  chemically synthesized
tactgtcccttccaaaagtgca

SEQ ID NO: 1034117 - DNA, 22 bp, Artificial Sequence
  chemically synthesized
tgcacttttggaagggacagta

SEQ ID NO: 1034118 - DNA, 22 bp, Artificial Sequence
  chemically synthesized
gcacttttggaagggacagtac

SEQ ID NO: 1034119 - DNA, 22 bp, Artificial Sequence
  chemically synthesized
cacttttggaagggacagtaca

SEQ ID NO: 1034120 - DNA, 22 bp, Artificial Sequence
  chemically synthesized
ttggaagggacagtacagctac

SEQ ID NO: 1034121 - DNA, 22 bp, Artificial Sequence
  chemically synthesized
tggaagggacagtacagctact

SEQ ID NO: 1034122 - DNA, 22 bp, Artificial Sequence
  chemically synthesized
ggaagggacagtacagctactg

SEQ ID NO: 1034123 - DNA, 22 bp, Artificial Sequence
  chemically synthesized
gaagggacagtacagctactgg

SEQ ID NO: 1034124 - DNA, 22 bp, Artificial Sequence
  chemically synthesized
aatgtaaagtcccccagtagct

SEQ ID NO: 1034125 - DNA, 22 bp, Artificial Sequence
  chemically synthesized
gttcaatgtaaagtcccccagt

SEQ ID NO: 1034126 - DNA, 22 bp, Artificial Sequence
  chemically synthesized
ctgggggactttacattgaact

SEQ ID NO: 1034127 - DNA, 22 bp, Artificial Sequence
  chemically synthesized
ggggactttacattgaactaac

SEQ ID NO: 1034128 - DNA, 22 bp, Artificial Sequence
  chemically synthesized
tgacagcacagcagttagttca

SEQ ID NO: 1034129 - DNA, 22 bp, Artificial Sequence
  chemically synthesized
ctgtgacagcacagcagttagt

SEQ ID NO: 1034130 - DNA, 22 bp, Artificial Sequence
  chemically synthesized
tactgtgacagcacagcagtta

SEQ ID NO: 1034131 - DNA, 22 bp, Artificial Sequence
  chemically synthesized
tacattgaactaactgctgtgc

SEQ ID NO: 1034132 - DNA, 22 bp, Artificial Sequence
  chemically synthesized
tctactgtgacagcacagcagt

SEQ ID NO: 1034133 - DNA, 22 bp, Artificial Sequence
  chemically synthesized
acattgaactaactgctgtgct

SEQ ID NO: 1034134 - DNA, 22 bp, Artificial Sequence
  chemically synthesized
ctctactgtgacagcacagcag

SEQ ID NO: 1034135 - DNA, 22 bp, Artificial Sequence
  chemically synthesized
cattgaactaactgctgtgctg

SEQ ID NO: 1034136 - DNA, 22 bp, Artificial Sequence
  chemically synthesized
tctctactgtgacagcacagca

SEQ ID NO: 1034137 - DNA, 22 bp, Artificial Sequence
  chemically synthesized
ttctctactgtgacagcacagc

SEQ ID NO: 1034138 - DNA, 22 bp, Artificial Sequence
  chemically synthesized
tttctctactgtgacagcacag

SEQ ID NO: 1034139 - DNA, 22 bp, Artificial Sequence
  chemically synthesized
ttttctctactgtgacagcaca

SEQ ID NO: 1034140 - DNA, 22 bp, Artificial Sequence
  chemically synthesized
aactaactgctgtgctgtcaca

SEQ ID NO: 1034141 - DNA, 22 bp, Artificial Sequence
  chemically synthesized
actgctgtgctgtcacagtaga

SEQ ID NO: 1034142 - DNA, 22 bp, Artificial Sequence
  chemically synthesized
ctgtgctgtcacagtagagaaa

SEQ ID NO: 1034143 - DNA, 22 bp, Artificial Sequence
  chemically synthesized
tgctgtcacagtagagaaaaaa

SEQ ID NO: 1034144 - DNA, 22 bp, Artificial Sequence
  chemically synthesized
aggccagcatggcttttttctc

SEQ ID NO: 1034145 - DNA, 22 bp, Artificial Sequence
  chemically synthesized
tcacagtagagaaaaaagccat

SEQ ID NO: 1034146 - DNA, 22 bp, Artificial Sequence
  chemically synthesized
actgaggccagcatggcttttt

SEQ ID NO: 1034147 - DNA, 22 bp, Artificial Sequence
  chemically synthesized
cgtgcacaggcactgactgagg

SEQ ID NO: 1034148 - DNA, 22 bp, Artificial Sequence
  chemically synthesized
cctccgtgcacaggcactgact

SEQ ID NO: 1034149 - DNA, 22 bp, Artificial Sequence
  chemically synthesized
gcctcagtcagtgcctgtgcac

SEQ ID NO: 1034150 - DNA, 22 bp, Artificial Sequence
  chemically synthesized
aaatattccctccgtgcacagg

SEQ ID NO: 1034151 - DNA, 22 bp, Artificial Sequence
  chemically synthesized
agtcagtgcctgtgcacggagg

SEQ ID NO: 1034152 - DNA, 22 bp, Artificial Sequence
  chemically synthesized
gttcaaatattccctccgtgca

SEQ ID NO: 1034153 - DNA, 22 bp, Artificial Sequence
  chemically synthesized
gggctagttcaaatattccctc

SEQ ID NO: 1034154 - DNA, 22 bp, Artificial Sequence
  chemically synthesized
gctggggctagttcaaatattc

SEQ ID NO: 1034155 - DNA, 22 bp, Artificial Sequence
  chemically synthesized
tgcacggagggaatatttgaac

SEQ ID NO: 1034156 - DNA, 22 bp, Artificial Sequence
  chemically synthesized
tggctggggctagttcaaatat

SEQ ID NO: 1034157 - DNA, 22 bp, Artificial Sequence
  chemically synthesized
ctggctggggctagttcaaata

SEQ ID NO: 1034158 - DNA, 22 bp, Artificial Sequence
  chemically synthesized
ccttctggctggggctagttca

SEQ ID NO: 1034159 - DNA, 22 bp, Artificial Sequence
  chemically synthesized
gaactagccccagccagaaggg

SEQ ID NO: 1034160 - DNA, 22 bp, Artificial Sequence
  chemically synthesized
ggatgggcgattcccttctggc

SEQ ID NO: 1034161 - DNA, 22 bp, Artificial Sequence
  chemically synthesized
aactagccccagccagaaggga

SEQ ID NO: 1034162 - DNA, 22 bp, Artificial Sequence
  chemically synthesized
ctgggatgggcgattcccttct

SEQ ID NO: 1034163 - DNA, 22 bp, Artificial Sequence
  chemically synthesized
gccccagccagaagggaatcgc

SEQ ID NO: 1034164 - DNA, 22 bp, Artificial Sequence
  chemically synthesized
actgctgggatgggcgattccc

SEQ ID NO: 1034165 - DNA, 22 bp, Artificial Sequence
  chemically synthesized
tgactgctgggatgggcgattc

SEQ ID NO: 1034166 - DNA, 22 bp, Artificial Sequence
  chemically synthesized
agttctgactgctgggatgggc

SEQ ID NO: 1034167 - DNA, 22 bp, Artificial Sequence
  chemically synthesized
gagttctgactgctgggatggg

SEQ ID NO: 1034168 - DNA, 22 bp, Artificial Sequence
  chemically synthesized
ccaagaaacttgagttctgact

SEQ ID NO: 1034169 - DNA, 22 bp, Artificial Sequence
  chemically synthesized
gccaagaaacttgagttctgac

SEQ ID NO: 1034170 - DNA, 22 bp, Artificial Sequence
  chemically synthesized
gcccacaatggtgaggcttgcc

SEQ ID NO: 1034171 - DNA, 22 bp, Artificial Sequence
  chemically synthesized
ggcccacaatggtgaggcttgc

SEQ ID NO: 1034172 - DNA, 22 bp, Artificial Sequence
  chemically synthesized
tggcccacaatggtgaggcttg

SEQ ID NO: 1034173 - DNA, 22 bp, Artificial Sequence
  chemically synthesized
aagtttcttggcaagcctcacc

SEQ ID NO: 1034174 - DNA, 22 bp, Artificial Sequence
  chemically synthesized
cttggcaagcctcaccattgtg

SEQ ID NO: 1034175 - DNA, 22 bp, Artificial Sequence
  chemically synthesized
ttggcaagcctcaccattgtgg

SEQ ID NO: 1034176 - DNA, 22 bp, Artificial Sequence
  chemically synthesized
ggcaagcctcaccattgtgggc

SEQ ID NO: 1034177 - DNA, 22 bp, Artificial Sequence
  chemically synthesized
cagagcactttggcccacaatg

SEQ ID NO: 1034178 - DNA, 22 bp, Artificial Sequence
  chemically synthesized
gcaagcctcaccattgtgggcc

SEQ ID NO: 1034179 - DNA, 22 bp, Artificial Sequence
  chemically synthesized
ggactccagagcactttggccc

SEQ ID NO: 1034180 - DNA, 22 bp, Artificial Sequence
  chemically synthesized
accattgtgggccaaagtgctc

SEQ ID NO: 1034181 - DNA, 22 bp, Artificial Sequence
  chemically synthesized
cctgggactccagagcactttg

SEQ ID NO: 1034182 - DNA, 22 bp, Artificial Sequence
  chemically synthesized
acctgggactccagagcacttt

SEQ ID NO: 1034183 - DNA, 22 bp, Artificial Sequence
  chemically synthesized
tgggccaaagtgctctggagtc

SEQ ID NO: 1034184 - DNA, 22 bp, Artificial Sequence
  chemically synthesized
aggtttacctgggactccagag

SEQ ID NO: 1034185 - DNA, 22 bp, Artificial Sequence
  chemically synthesized
tcaggtttacctgggactccag

SEQ ID NO: 1034186 - DNA, 22 bp, Artificial Sequence
  chemically synthesized
cctctcaggtttacctgggact

SEQ ID NO: 1034187 - DNA, 22 bp, Artificial Sequence
  chemically synthesized
tggagtcccaggtaaacctgag

SEQ ID NO: 1034188 - DNA, 22 bp, Artificial Sequence
  chemically synthesized
gagtcccaggtaaacctgagag

SEQ ID NO: 1034189 - DNA, 22 bp, Artificial Sequence
  chemically synthesized
gtgtgtcccagactgcctctca

SEQ ID NO: 1034190 - DNA, 22 bp, Artificial Sequence
  chemically synthesized
cagttcgtgtgtcccagactgc

SEQ ID NO: 1034191 - DNA, 22 bp, Artificial Sequence
  chemically synthesized
ggaattgcagttcgtgtgtccc

SEQ ID NO: 1034192 - DNA, 22 bp, Artificial Sequence
  chemically synthesized
agaggcagtctgggacacacga

SEQ ID NO: 1034193 - DNA, 22 bp, Artificial Sequence
  chemically synthesized
tctaggaattgcagttcgtgtg

SEQ ID NO: 1034194 - DNA, 22 bp, Artificial Sequence
  chemically synthesized
gaagttatctaggaattgcagt

SEQ ID NO: 1034195 - DNA, 22 bp, Artificial Sequence
  chemically synthesized
ggacacacgaactgcaattcct

SEQ ID NO: 1034196 - DNA, 22 bp, Artificial Sequence
  chemically synthesized
tgactagaagttatctaggaat

SEQ ID NO: 1034197 - DNA, 22 bp, Artificial Sequence
  chemically synthesized
caattcctagataacttctagt

SEQ ID NO: 1034198 - DNA, 22 bp, Artificial Sequence
  chemically synthesized
gcccaggctatgactagaagtt

SEQ ID NO: 1034199 - DNA, 22 bp, Artificial Sequence
  chemically synthesized
agcccaggctatgactagaagt

SEQ ID NO: 1034200 - DNA, 22 bp, Artificial Sequence
  chemically synthesized
ttagcccaggctatgactagaa

SEQ ID NO: 1034201 - DNA, 22 bp, Artificial Sequence
  chemically synthesized
ctagataacttctagtcatagc

SEQ ID NO: 1034202 - DNA, 22 bp, Artificial Sequence
  chemically synthesized
gctcttagcccaggctatgact

SEQ ID NO: 1034203 - DNA, 22 bp, Artificial Sequence
  chemically synthesized
gataacttctagtcatagcctg

SEQ ID NO: 1034204 - DNA, 22 bp, Artificial Sequence
  chemically synthesized
tagctcttagcccaggctatga

SEQ ID NO: 1034205 - DNA, 22 bp, Artificial Sequence
  chemically synthesized
gtcctctagctcttagcccagg

SEQ ID NO: 1034206 - DNA, 22 bp, Artificial Sequence
  chemically synthesized
ctagtcatagcctgggctaaga

SEQ ID NO: 1034207 - DNA, 22 bp, Artificial Sequence
  chemically synthesized
tagtcatagcctgggctaagag

SEQ ID NO: 1034208 - DNA, 22 bp, Artificial Sequence
  chemically synthesized
gtcatagcctgggctaagagct

SEQ ID NO: 1034209 - DNA, 22 bp, Artificial Sequence
  chemically synthesized
ggctaagagctagaggactagg

SEQ ID NO: 1034210 - DNA, 22 bp, Artificial Sequence
  chemically synthesized
ggtcacatgccaccctagtcct

SEQ ID NO: 1034211 - DNA, 22 bp, Artificial Sequence
  chemically synthesized
agagctagaggactagggtggc

SEQ ID NO: 1034212 - DNA, 22 bp, Artificial Sequence
  chemically synthesized
cctaggtcacatgccaccctag

SEQ ID NO: 1034213 - DNA, 22 bp, Artificial Sequence
  chemically synthesized
gaggactagggtggcatgtgac

SEQ ID NO: 1034214 - DNA, 22 bp, Artificial Sequence
  chemically synthesized
gtgtctccctaggtcacatgcc

SEQ ID NO: 1034215 - DNA, 22 bp, Artificial Sequence
  chemically synthesized
gggtggcatgtgacctagggag

SEQ ID NO: 1034216 - DNA, 22 bp, Artificial Sequence
  chemically synthesized
gccatgccagctggtgtctccc

SEQ ID NO: 1034217 - DNA, 22 bp, Artificial Sequence
  chemically synthesized
agccatgccagctggtgtctcc

SEQ ID NO: 1034218 - DNA, 22 bp, Artificial Sequence
  chemically synthesized
ccttagccatgccagctggtgt

SEQ ID NO: 1034219 - DNA, 22 bp, Artificial Sequence
  chemically synthesized
gggagacaccagctggcatggc

SEQ ID NO: 1034220 - DNA, 22 bp, Artificial Sequence
  chemically synthesized
gcatggctaagggagtgcttgc

SEQ ID NO: 1034221 - DNA, 22 bp, Artificial Sequence
  chemically synthesized
aggtgggggaggaatggtgcaa

SEQ ID NO: 1034222 - DNA, 22 bp, Artificial Sequence
  chemically synthesized
gaggtgggggaggaatggtgca

SEQ ID NO: 1034223 - DNA, 22 bp, Artificial Sequence
  chemically synthesized
agggagtgcttgcaccattcct

SEQ ID NO: 1034224 - DNA, 22 bp, Artificial Sequence
  chemically synthesized
cttgaggtgggggaggaatggt

SEQ ID NO: 1034225 - DNA, 22 bp, Artificial Sequence
  chemically synthesized
cactgcttgaggtgggggagga

SEQ ID NO: 1034226 - DNA, 22 bp, Artificial Sequence
  chemically synthesized
gcaccattcctcccccacctca

SEQ ID NO: 1034227 - DNA, 22 bp, Artificial Sequence
  chemically synthesized
caccattcctcccccacctcaa

SEQ ID NO: 1034228 - DNA, 22 bp, Artificial Sequence
  chemically synthesized
tgggctgcactgcttgaggtgg

SEQ ID NO: 1034229 - DNA, 22 bp, Artificial Sequence
  chemically synthesized
ctgtgggctgcactgcttgagg

SEQ ID NO: 1034230 - DNA, 22 bp, Artificial Sequence
  chemically synthesized
ttactgtgggctgcactgcttg

SEQ ID NO: 1034231 - DNA, 22 bp, Artificial Sequence
  chemically synthesized
ctcccccacctcaagcagtgca

SEQ ID NO: 1034232 - DNA, 22 bp, Artificial Sequence
  chemically synthesized
gttactgtgggctgcactgctt

SEQ ID NO: 1034233 - DNA, 22 bp, Artificial Sequence
  chemically synthesized
tgttactgtgggctgcactgct

SEQ ID NO: 1034234 - DNA, 22 bp, Artificial Sequence
  chemically synthesized
ttgttactgtgggctgcactgc

SEQ ID NO: 1034235 - DNA, 22 bp, Artificial Sequence
  chemically synthesized
ccccacctcaagcagtgcagcc

SEQ ID NO: 1034236 - DNA, 22 bp, Artificial Sequence
  chemically synthesized
aagcagtgcagcccacagtaac

SEQ ID NO: 1034237 - DNA, 22 bp, Artificial Sequence
  chemically synthesized
agcaaaagtaaggagtcacttt

SEQ ID NO: 1034238 - DNA, 22 bp, Artificial Sequence
  chemically synthesized
aagcaaaagtaaggagtcactt

SEQ ID NO: 1034239 - DNA, 22 bp, Artificial Sequence
  chemically synthesized
cttaagcaaaagtaaggagtca

SEQ ID NO: 1034240 - DNA, 22 bp, Artificial Sequence
  chemically synthesized
tccttaagcaaaagtaaggagt

SEQ ID NO: 1034241 - DNA, 22 bp, Artificial Sequence
  chemically synthesized
ctctccttaagcaaaagtaagg

SEQ ID NO: 1034242 - DNA, 22 bp, Artificial Sequence
  chemically synthesized
tcctctccttaagcaaaagtaa

SEQ ID NO: 1034243 - DNA, 22 bp, Artificial Sequence
  chemically synthesized
actctcctctccttaagcaaaa

SEQ ID NO: 1034244 - DNA, 22 bp, Artificial Sequence
  chemically synthesized
cactctcctctccttaagcaaa

SEQ ID NO: 1034245 - DNA, 22 bp, Artificial Sequence
  chemically synthesized
tcactctcctctccttaagcaa

SEQ ID NO: 1034246 - DNA, 22 bp, Artificial Sequence
  chemically synthesized
ttcactctcctctccttaagca

SEQ ID NO: 1034247 - DNA, 22 bp, Artificial Sequence
  chemically synthesized
cttttcactctcctctccttaa

SEQ ID NO: 1034248 - DNA, 22 bp, Artificial Sequence
  chemically synthesized
cttacttttgcttaaggagagg

SEQ ID NO: 1034249 - DNA, 22 bp, Artificial Sequence
  chemically synthesized
acttttcactctcctctcctta

SEQ ID NO: 1034250 - DNA, 22 bp, Artificial Sequence
  chemically synthesized
tacttttcactctcctctcctt

SEQ ID NO: 1034251 - DNA, 22 bp, Artificial Sequence
  chemically synthesized
acttttgcttaaggagaggaga

SEQ ID NO: 1034252 - DNA, 22 bp, Artificial Sequence
  chemically synthesized
tttacttttcactctcctctcc

SEQ ID NO: 1034253 - DNA, 22 bp, Artificial Sequence
  chemically synthesized
cttttgcttaaggagaggagag

SEQ ID NO: 1034254 - DNA, 22 bp, Artificial Sequence
  chemically synthesized
ttgcttaaggagaggagagtga

SEQ ID NO: 1034255 - DNA, 22 bp, Artificial Sequence
  chemically synthesized
tgcttaaggagaggagagtgaa

SEQ ID NO: 1034256 - DNA, 22 bp, Artificial Sequence
  chemically synthesized
gcttaaggagaggagagtgaaa

SEQ ID NO: 1034257 - DNA, 22 bp, Artificial Sequence
  chemically synthesized
cttaaggagaggagagtgaaaa

SEQ ID NO: 1034258 - DNA, 22 bp, Artificial Sequence
  chemically synthesized
aaggagaggagagtgaaaagta

SEQ ID NO: 1034259 - DNA, 22 bp, Artificial Sequence
  chemically synthesized
aggagaggagagtgaaaagtaa

SEQ ID NO: 1034260 - DNA, 22 bp, Artificial Sequence
  chemically synthesized
gtatccaagatgcaagacagaa

SEQ ID NO: 1034261 - DNA, 22 bp, Artificial Sequence
  chemically synthesized
agctggtatccaagatgcaaga

SEQ ID NO: 1034262 - DNA, 22 bp, Artificial Sequence
  chemically synthesized
tgactaagctggtatccaagat

SEQ ID NO: 1034263 - DNA, 22 bp, Artificial Sequence
  chemically synthesized
ctgtgactaagctggtatccaa

SEQ ID NO: 1034264 - DNA, 22 bp, Artificial Sequence
  chemically synthesized
tgtcttgcatcttggataccag

SEQ ID NO: 1034265 - DNA, 22 bp, Artificial Sequence
  chemically synthesized
tcttgcatcttggataccagct

SEQ ID NO: 1034266 - DNA, 22 bp, Artificial Sequence
  chemically synthesized
tcctactgtgactaagctggta

SEQ ID NO: 1034267 - DNA, 22 bp, Artificial Sequence
  chemically synthesized
gcatcttggataccagcttagt

SEQ ID NO: 1034268 - DNA, 22 bp, Artificial Sequence
  chemically synthesized
catcttggataccagcttagtc

SEQ ID NO: 1034269 - DNA, 22 bp, Artificial Sequence
  chemically synthesized
ggataccagcttagtcacagta

SEQ ID NO: 1034270 - DNA, 22 bp, Artificial Sequence
  chemically synthesized
gataccagcttagtcacagtag

SEQ ID NO: 1034271 - DNA, 22 bp, Artificial Sequence
  chemically synthesized
tccagtgccctatcctactgtg

SEQ ID NO: 1034272 - DNA, 22 bp, Artificial Sequence
  chemically synthesized
agtcacagtaggatagggcact

SEQ ID NO: 1034273 - DNA, 22 bp, Artificial Sequence
  chemically synthesized
acaacactgtccagtgccctat

SEQ ID NO: 1034274 - DNA, 22 bp, Artificial Sequence
  chemically synthesized
gtcacagtaggatagggcactg

SEQ ID NO: 1034275 - DNA, 22 bp, Artificial Sequence
  chemically synthesized
gaaatgggtcctcacaacactg

SEQ ID NO: 1034276 - DNA, 22 bp, Artificial Sequence
  chemically synthesized
agcctagaaatgggtcctcaca

SEQ ID NO: 1034277 - DNA, 22 bp, Artificial Sequence
  chemically synthesized
gacagtgttgtgaggacccatt

SEQ ID NO: 1034278 - DNA, 22 bp, Artificial Sequence
  chemically synthesized
tccaggagctgagcctagaaat

SEQ ID NO: 1034279 - DNA, 22 bp, Artificial Sequence
  chemically synthesized
tgaggacccatttctaggctca

SEQ ID NO: 1034280 - DNA, 22 bp, Artificial Sequence
  chemically synthesized
gagagtgttgtccaggagctga

SEQ ID NO: 1034281 - DNA, 22 bp, Artificial Sequence
  chemically synthesized
attggagagtgttgtccaggag

SEQ ID NO: 1034282 - DNA, 22 bp, Artificial Sequence
  chemically synthesized
gattggagagtgttgtccagga

SEQ ID NO: 1034283 - DNA, 22 bp, Artificial Sequence
  chemically synthesized
ctaggctcagctcctggacaac

SEQ ID NO: 1034284 - DNA, 22 bp, Artificial Sequence
  chemically synthesized
taggctcagctcctggacaaca

SEQ ID NO: 1034285 - DNA, 22 bp, Artificial Sequence
  chemically synthesized
ttgattggagagtgttgtccag

SEQ ID NO: 1034286 - DNA, 22 bp, Artificial Sequence
  chemically synthesized
ggctcagctcctggacaacact

SEQ ID NO: 1034287 - DNA, 22 bp, Artificial Sequence
  chemically synthesized
tcttgattggagagtgttgtcc

SEQ ID NO: 1034288 - DNA, 22 bp, Artificial Sequence
  chemically synthesized
agctcctggacaacactctcca

SEQ ID NO: 1034289 - DNA, 22 bp, Artificial Sequence
  chemically synthesized
tatctctcttgattggagagtg

SEQ ID NO: 1034290 - DNA, 22 bp, Artificial Sequence
  chemically synthesized
ctggacaacactctccaatcaa

SEQ ID NO: 1034291 - DNA, 22 bp, Artificial Sequence
  chemically synthesized
gacaacactctccaatcaagag

SEQ ID NO: 1034292 - DNA, 22 bp, Artificial Sequence
  chemically synthesized
gtcgagacactgtatctctctt

SEQ ID NO: 1034293 - DNA, 22 bp, Artificial Sequence
  chemically synthesized
tccaatcaagagagatacagtg

SEQ ID NO: 1034294 - DNA, 22 bp, Artificial Sequence
  chemically synthesized
caatcaagagagatacagtgtc

SEQ ID NO: 1034295 - DNA, 22 bp, Artificial Sequence
  chemically synthesized
caggcgtgagccaccatgcctg

SEQ ID NO: 1034296 - DNA, 22 bp, Artificial Sequence
  chemically synthesized
ggattacaggcgtgagccacca

SEQ ID NO: 1034297 - DNA, 22 bp, Artificial Sequence
  chemically synthesized
gaccaggcatggtggctcacgc

SEQ ID NO: 1034298 - DNA, 22 bp, Artificial Sequence
  chemically synthesized
ccaaagtgctaggattacaggc

SEQ ID NO: 1034299 - DNA, 22 bp, Artificial Sequence
  chemically synthesized
ggcctcccaaagtgctaggatt

SEQ ID NO: 1034300 - DNA, 22 bp, Artificial Sequence
  chemically synthesized
cggcctcccaaagtgctaggat

SEQ ID NO: 1034301 - DNA, 22 bp, Artificial Sequence
  chemically synthesized
acgcctgtaatcctagcacttt

SEQ ID NO: 1034302 - DNA, 22 bp, Artificial Sequence
  chemically synthesized
cttcggcctcccaaagtgctag

SEQ ID NO: 1034303 - DNA, 22 bp, Artificial Sequence
  chemically synthesized
taatcctagcactttgggaggc

SEQ ID NO: 1034304 - DNA, 22 bp, Artificial Sequence
  chemically synthesized
aagtgatccacctacttcggcc

SEQ ID NO: 1034305 - DNA, 22 bp, Artificial Sequence
  chemically synthesized
gcactttgggaggccgaagtag

SEQ ID NO: 1034306 - DNA, 22 bp, Artificial Sequence
  chemically synthesized
acctcaagtgatccacctactt

SEQ ID NO: 1034307 - DNA, 22 bp, Artificial Sequence
  chemically synthesized
tgggaggccgaagtaggtggat

SEQ ID NO: 1034308 - DNA, 22 bp, Artificial Sequence
  chemically synthesized
gggaggccgaagtaggtggatc

SEQ ID NO: 1034309 - DNA, 22 bp, Artificial Sequence
  chemically synthesized
ctgacctcaagtgatccaccta

SEQ ID NO: 1034310 - DNA, 22 bp, Artificial Sequence
  chemically synthesized
ggaggccgaagtaggtggatca

SEQ ID NO: 1034311 - DNA, 22 bp, Artificial Sequence
  chemically synthesized
gaactcctgacctcaagtgatc

SEQ ID NO: 1034312 - DNA, 22 bp, Artificial Sequence
  chemically synthesized
gtctcgaactcctgacctcaag

SEQ ID NO: 1034313 - DNA, 22 bp, Artificial Sequence
  chemically synthesized
gccaggctggtctcgaactcct

SEQ ID NO: 1034314 - DNA, 22 bp, Artificial Sequence
  chemically synthesized
gaggtcaggagttcgagaccag

SEQ ID NO: 1034315 - DNA, 22 bp, Artificial Sequence
  chemically synthesized
aggtcaggagttcgagaccagc

SEQ ID NO: 1034316 - DNA, 22 bp, Artificial Sequence
  chemically synthesized
atgatgttggccaggctggtct

SEQ ID NO: 1034317 - DNA, 22 bp, Artificial Sequence
  chemically synthesized
catgatgttggccaggctggtc

SEQ ID NO: 1034318 - DNA, 22 bp, Artificial Sequence
  chemically synthesized
gggtttcatgatgttggccagg

SEQ ID NO: 1034319 - DNA, 22 bp, Artificial Sequence
  chemically synthesized
gagaccagcctggccaacatca

SEQ ID NO: 1034320 - DNA, 22 bp, Artificial Sequence
  chemically synthesized
gtagagttggggtttcatgatg

SEQ ID NO: 1034321 - DNA, 22 bp, Artificial Sequence
  chemically synthesized
agtagagttggggtttcatgat

SEQ ID NO: 1034322 - DNA, 22 bp, Artificial Sequence
  chemically synthesized
tagtagagttggggtttcatga

SEQ ID NO: 1034323 - DNA, 22 bp, Artificial Sequence
  chemically synthesized
ttagtagagttggggtttcatg

SEQ ID NO: 1034324 - DNA, 22 bp, Artificial Sequence
  chemically synthesized
gccaacatcatgaaaccccaac

SEQ ID NO: 1034325 - DNA, 22 bp, Artificial Sequence
  chemically synthesized
tatttttagtagagttggggtt

SEQ ID NO: 1034326 - DNA, 22 bp, Artificial Sequence
  chemically synthesized
gtatttttagtagagttggggt

SEQ ID NO: 1034327 - DNA, 22 bp, Artificial Sequence
  chemically synthesized
tgtatttttagtagagttgggg

SEQ ID NO: 1034328 - DNA, 22 bp, Artificial Sequence
  chemically synthesized
ttgtatttttagtagagttggg

SEQ ID NO: 1034329 - DNA, 22 bp, Artificial Sequence
  chemically synthesized
atttttgtatttttagtagagt

SEQ ID NO: 1034330 - DNA, 22 bp, Artificial Sequence
  chemically synthesized
tactaaaaatacaaaaattagc

SEQ ID NO: 1034331 - DNA, 22 bp, Artificial Sequence
  chemically synthesized
ctaaaaatacaaaaattagcca

SEQ ID NO: 1034332 - DNA, 22 bp, Artificial Sequence
  chemically synthesized
aaaatacaaaaattagccacgc

SEQ ID NO: 1034333 - DNA, 22 bp, Artificial Sequence
  chemically synthesized
cagtcacccacaatcacgcgtg

SEQ ID NO: 1034334 - DNA, 22 bp, Artificial Sequence
  chemically synthesized
agattacagtcacccacaatca

SEQ ID NO: 1034335 - DNA, 22 bp, Artificial Sequence
  chemically synthesized
gccacgcgtgattgtgggtgac

SEQ ID NO: 1034336 - DNA, 22 bp, Artificial Sequence
  chemically synthesized
gccccccaagaggctgagatta

SEQ ID NO: 1034337 - DNA, 22 bp, Artificial Sequence
  chemically synthesized
agccccccaagaggctgagatt

SEQ ID NO: 1034338 - DNA, 22 bp, Artificial Sequence
  chemically synthesized
tgggtgactgtaatctcagcct

SEQ ID NO: 1034339 - DNA, 22 bp, Artificial Sequence
  chemically synthesized
tgccttagccccccaagaggct

SEQ ID NO: 1034340 - DNA, 22 bp, Artificial Sequence
  chemically synthesized
gtgccttagccccccaagaggc

SEQ ID NO: 1034341 - DNA, 22 bp, Artificial Sequence
  chemically synthesized
ttgtgccttagccccccaagag

SEQ ID NO: 1034342 - DNA, 22 bp, Artificial Sequence
  chemically synthesized
taatctcagcctcttggggggc

SEQ ID NO: 1034343 - DNA, 22 bp, Artificial Sequence
  chemically synthesized
agcctcttggggggctaaggca

SEQ ID NO: 1034344 - DNA, 22 bp, Artificial Sequence
  chemically synthesized
aagagattcttgtgccttagcc

SEQ ID NO: 1034345 - DNA, 22 bp, Artificial Sequence
  chemically synthesized
ggttcaagagattcttgtgcct

SEQ ID NO: 1034346 - DNA, 22 bp, Artificial Sequence
  chemically synthesized
ttggggggctaaggcacaagaa

SEQ ID NO: 1034347 - DNA, 22 bp, Artificial Sequence
  chemically synthesized
ggggggctaaggcacaagaatc

SEQ ID NO: 1034348 - DNA, 22 bp, Artificial Sequence
  chemically synthesized
ctgggttcaagagattcttgtg

SEQ ID NO: 1034349 - DNA, 22 bp, Artificial Sequence
  chemically synthesized
gggggctaaggcacaagaatct

SEQ ID NO: 1034350 - DNA, 22 bp, Artificial Sequence
  chemically synthesized
cgcctcctgggttcaagagatt

SEQ ID NO: 1034351 - DNA, 22 bp, Artificial Sequence
  chemically synthesized
aggcacaagaatctcttgaacc

SEQ ID NO: 1034352 - DNA, 22 bp, Artificial Sequence
  chemically synthesized
caacctccgcctcctgggttca

SEQ ID NO: 1034353 - DNA, 22 bp, Artificial Sequence
  chemically synthesized
gctgcaacctccgcctcctggg

SEQ ID NO: 1034354 - DNA, 22 bp, Artificial Sequence
  chemically synthesized
agttcgctgcaacctccgcctc

SEQ ID NO: 1034355 - DNA, 22 bp, Artificial Sequence
  chemically synthesized
ttgaacccaggaggcggaggtt

SEQ ID NO: 1034356 - DNA, 22 bp, Artificial Sequence
  chemically synthesized
gaacccaggaggcggaggttgc

SEQ ID NO: 1034357 - DNA, 22 bp, Artificial Sequence
  chemically synthesized
aacccaggaggcggaggttgca

SEQ ID NO: 1034358 - DNA, 22 bp, Artificial Sequence
  chemically synthesized
tgacaggatctcagttcgctgc

SEQ ID NO: 1034359 - DNA, 22 bp, Artificial Sequence
  chemically synthesized
gagtgctgtgacaggatctcag

SEQ ID NO: 1034360 - DNA, 22 bp, Artificial Sequence
  chemically synthesized
cagcgaactgagatcctgtcac

SEQ ID NO: 1034361 - DNA, 22 bp, Artificial Sequence
  chemically synthesized
cccaggctggagtgctgtgaca

SEQ ID NO: 1034362 - DNA, 22 bp, Artificial Sequence
  chemically synthesized
ttgcccaggctggagtgctgtg

SEQ ID NO: 1034363 - DNA, 22 bp, Artificial Sequence
  chemically synthesized
tgttgcccaggctggagtgctg

SEQ ID NO: 1034364 - DNA, 22 bp, Artificial Sequence
  chemically synthesized
agatcctgtcacagcactccag

SEQ ID NO: 1034365 - DNA, 22 bp, Artificial Sequence
  chemically synthesized
actctgttgcccaggctggagt

SEQ ID NO: 1034366 - DNA, 22 bp, Artificial Sequence
  chemically synthesized
tcacagcactccagcctgggca

SEQ ID NO: 1034367 - DNA, 22 bp, Artificial Sequence
  chemically synthesized
agacagcatctcactctgttgc

SEQ ID NO: 1034368 - DNA, 22 bp, Artificial Sequence
  chemically synthesized
gagacagcatctcactctgttg

SEQ ID NO: 1034369 - DNA, 22 bp, Artificial Sequence
  chemically synthesized
ttgagacagcatctcactctgt

SEQ ID NO: 1034370 - DNA, 22 bp, Artificial Sequence
  chemically synthesized
cagcctgggcaacagagtgaga

SEQ ID NO: 1034371 - DNA, 22 bp, Artificial Sequence
  chemically synthesized
cttgagacagcatctcactctg

SEQ ID NO: 1034372 - DNA, 22 bp, Artificial Sequence
  chemically synthesized
tcttgagacagcatctcactct

SEQ ID NO: 1034373 - DNA, 22 bp, Artificial Sequence
  chemically synthesized
tttcttgagacagcatctcact

SEQ ID NO: 1034374 - DNA, 22 bp, Artificial Sequence
  chemically synthesized
ctttcttgagacagcatctcac

SEQ ID NO: 1034375 - DNA, 22 bp, Artificial Sequence
  chemically synthesized
tctttcttgagacagcatctca

SEQ ID NO: 1034376 - DNA, 22 bp, Artificial Sequence
  chemically synthesized
ttctttcttgagacagcatctc

SEQ ID NO: 1034377 - DNA, 22 bp, Artificial Sequence
  chemically synthesized
ggcaacagagtgagatgctgtc

SEQ ID NO: 1034378 - DNA, 22 bp, Artificial Sequence
  chemically synthesized
ttttctttcttgagacagcatc

SEQ ID NO: 1034379 - DNA, 22 bp, Artificial Sequence
  chemically synthesized
cttttctttcttgagacagcat

SEQ ID NO: 1034380 - DNA, 22 bp, Artificial Sequence
  chemically synthesized
tcttttctttcttgagacagca

SEQ ID NO: 1034381 - DNA, 22 bp, Artificial Sequence
  chemically synthesized
ttcttttctttcttgagacagc

SEQ ID NO: 1034382 - DNA, 22 bp, Artificial Sequence
  chemically synthesized
ttttcttttctttcttgagaca

SEQ ID NO: 1034383 - DNA, 22 bp, Artificial Sequence
  chemically synthesized
cttttcttttctttcttgagac

SEQ ID NO: 1034384 - DNA, 22 bp, Artificial Sequence
  chemically synthesized
tcttttcttttctttcttgaga

SEQ ID NO: 1034385 - DNA, 22 bp, Artificial Sequence
  chemically synthesized
tttcttttcttttctttcttga

SEQ ID NO: 1034386 - DNA, 22 bp, Artificial Sequence
  chemically synthesized
ctttcttttcttttctttcttg

SEQ ID NO: 1034387 - DNA, 22 bp, Artificial Sequence
  chemically synthesized
tctttcttttcttttctttctt

SEQ ID NO: 1034388 - DNA, 22 bp, Artificial Sequence
  chemically synthesized
tctttctttcttttcttttctt

SEQ ID NO: 1034389 - DNA, 22 bp, Artificial Sequence
  chemically synthesized
tatctttctttcttttcttttc

SEQ ID NO: 1034390 - DNA, 22 bp, Artificial Sequence
  chemically synthesized
ctatctttctttcttttctttt

SEQ ID NO: 1034391 - DNA, 22 bp, Artificial Sequence
  chemically synthesized
tctcaagaaagaaaagaaaaga

SEQ ID NO: 1034392 - DNA, 22 bp, Artificial Sequence
  chemically synthesized
tctatctttctttcttttcttt

SEQ ID NO: 1034393 - DNA, 22 bp, Artificial Sequence
  chemically synthesized
ttctatctttctttcttttctt

SEQ ID NO: 1034394 - DNA, 22 bp, Artificial Sequence
  chemically synthesized
tttctatctttctttcttttct

SEQ ID NO: 1034395 - DNA, 22 bp, Artificial Sequence
  chemically synthesized
ttttctatctttctttcttttc

SEQ ID NO: 1034396 - DNA, 22 bp, Artificial Sequence
  chemically synthesized
aagaaagaaaagaaaagaaaga

SEQ ID NO: 1034397 - DNA, 22 bp, Artificial Sequence
  chemically synthesized
tttttctatctttctttctttt

SEQ ID NO: 1034398 - DNA, 22 bp, Artificial Sequence
  chemically synthesized
ttttttctatctttctttcttt

SEQ ID NO: 1034399 - DNA, 22 bp, Artificial Sequence
  chemically synthesized
ttttttttctatctttctttct

SEQ ID NO: 1034400 - DNA, 22 bp, Artificial Sequence
  chemically synthesized
tcttttttttctatctttcttt

SEQ ID NO: 1034401 - DNA, 22 bp, Artificial Sequence
  chemically synthesized
tctcttttttttctatctttct

SEQ ID NO: 1034402 - DNA, 22 bp, Artificial Sequence
  chemically synthesized
tctctcttttttttctatcttt

SEQ ID NO: 1034403 - DNA, 22 bp, Artificial Sequence
  chemically synthesized
ctctctcttttttttctatctt

SEQ ID NO: 1034404 - DNA, 22 bp, Artificial Sequence
  chemically synthesized
ttctctctcttttttttctatc

SEQ ID NO: 1034405 - DNA, 22 bp, Artificial Sequence
  chemically synthesized
cttctctctcttttttttctat

SEQ ID NO: 1034406 - DNA, 22 bp, Artificial Sequence
  chemically synthesized
tcttctctctcttttttttcta

SEQ ID NO: 1034407 - DNA, 22 bp, Artificial Sequence
  chemically synthesized
ttcttctctctcttttttttct

SEQ ID NO: 1034408 - DNA, 22 bp, Artificial Sequence
  chemically synthesized
ttttcttctctctctttttttt

SEQ ID NO: 1034409 - DNA, 22 bp, Artificial Sequence
  chemically synthesized
cttttcttctctctcttttttt

SEQ ID NO: 1034410 - DNA, 22 bp, Artificial Sequence
  chemically synthesized
tcttttcttctctctctttttt

SEQ ID NO: 1034411 - DNA, 22 bp, Artificial Sequence
  chemically synthesized
ttcttttcttctctctcttttt

SEQ ID NO: 1034412 - DNA, 22 bp, Artificial Sequence
  chemically synthesized
ttttcttttcttctctctcttt

SEQ ID NO: 1034413 - DNA, 22 bp, Artificial Sequence
  chemically synthesized
cttttcttttcttctctctctt

SEQ ID NO: 1034414 - DNA, 22 bp, Artificial Sequence
  chemically synthesized
tcttttcttttcttctctctct

SEQ ID NO: 1034415 - DNA, 22 bp, Artificial Sequence
  chemically synthesized
ttcttttcttttcttctctctc

SEQ ID NO: 1034416 - DNA, 22 bp, Artificial Sequence
  chemically synthesized
tttttcttttcttttcttctct

SEQ ID NO: 1034417 - DNA, 22 bp, Artificial Sequence
  chemically synthesized
tatctatttttcttttcttttc

SEQ ID NO: 1034418 - DNA, 22 bp, Artificial Sequence
  chemically synthesized
agacactgtatctatttttctt

SEQ ID NO: 1034419 - DNA, 22 bp, Artificial Sequence
  chemically synthesized
atccattcagacactgtatcta

SEQ ID NO: 1034420 - DNA, 22 bp, Artificial Sequence
  chemically synthesized
catccattcagacactgtatct

SEQ ID NO: 1034421 - DNA, 22 bp, Artificial Sequence
  chemically synthesized
tcatccattcagacactgtatc

SEQ ID NO: 1034422 - DNA, 22 bp, Artificial Sequence
  chemically synthesized
ttcatccattcagacactgtat

SEQ ID NO: 1034423 - DNA, 22 bp, Artificial Sequence
  chemically synthesized
tttcatccattcagacactgta

SEQ ID NO: 1034424 - DNA, 22 bp, Artificial Sequence
  chemically synthesized
ttttttcatccattcagacact

SEQ ID NO: 1034425 - DNA, 22 bp, Artificial Sequence
  chemically synthesized
attttttcatccattcagacac

SEQ ID NO: 1034426 - DNA, 22 bp, Artificial Sequence
  chemically synthesized
ggtcttattttttcatccattc

SEQ ID NO: 1034427 - DNA, 22 bp, Artificial Sequence
  chemically synthesized
aatggatgaaaaaataagaccc

SEQ ID NO: 1034428 - DNA, 22 bp, Artificial Sequence
  chemically synthesized
aggtcaacacaaaattgggtct

SEQ ID NO: 1034429 - DNA, 22 bp, Artificial Sequence
  chemically synthesized
gaggtcaacacaaaattgggtc

SEQ ID NO: 1034430 - DNA, 22 bp, Artificial Sequence
  chemically synthesized
ttgaggtcaacacaaaattggg

SEQ ID NO: 1034431 - DNA, 22 bp, Artificial Sequence
  chemically synthesized
cttgaggtcaacacaaaattgg

SEQ ID NO: 1034432 - DNA, 22 bp, Artificial Sequence
  chemically synthesized
taggtgaagagtgcttcttgag

SEQ ID NO: 1034433 - DNA, 22 bp, Artificial Sequence
  chemically synthesized
ataggtgaagagtgcttcttga

SEQ ID NO: 1034434 - DNA, 22 bp, Artificial Sequence
  chemically synthesized
tataggtgaagagtgcttcttg

SEQ ID NO: 1034435 - DNA, 22 bp, Artificial Sequence
  chemically synthesized
tgtgttgacctcaagaagcact

SEQ ID NO: 1034436 - DNA, 22 bp, Artificial Sequence
  chemically synthesized
gtgttgacctcaagaagcactc

SEQ ID NO: 1034437 - DNA, 22 bp, Artificial Sequence
  chemically synthesized
tgttgacctcaagaagcactct

SEQ ID NO: 1034438 - DNA, 22 bp, Artificial Sequence
  chemically synthesized
acctcaagaagcactcttcacc

SEQ ID NO: 1034439 - DNA, 22 bp, Artificial Sequence
  chemically synthesized
tgtgtagctttataggtgaaga

SEQ ID NO: 1034440 - DNA, 22 bp, Artificial Sequence
  chemically synthesized
aagaagcactcttcacctataa

SEQ ID NO: 1034441 - DNA, 22 bp, Artificial Sequence
  chemically synthesized
cagtctgtgtgtagctttatag

SEQ ID NO: 1034442 - DNA, 22 bp, Artificial Sequence
  chemically synthesized
ccagtctgtgtgtagctttata

SEQ ID NO: 1034443 - DNA, 22 bp, Artificial Sequence
  chemically synthesized
tttccagtctgtgtgtagcttt

SEQ ID NO: 1034444 - DNA, 22 bp, Artificial Sequence
  chemically synthesized
atttccagtctgtgtgtagctt

SEQ ID NO: 1034445 - DNA, 22 bp, Artificial Sequence
  chemically synthesized
tatttccagtctgtgtgtagct

SEQ ID NO: 1034446 - DNA, 22 bp, Artificial Sequence
  chemically synthesized
ttcacctataaagctacacaca

SEQ ID NO: 1034447 - DNA, 22 bp, Artificial Sequence
  chemically synthesized
cacctataaagctacacacaga

SEQ ID NO: 1034448 - DNA, 22 bp, Artificial Sequence
  chemically synthesized
acctataaagctacacacagac

SEQ ID NO: 1034449 - DNA, 22 bp, Artificial Sequence
  chemically synthesized
catccctttatttccagtctgt

SEQ ID NO: 1034450 - DNA, 22 bp, Artificial Sequence
  chemically synthesized
taaagctacacacagactggaa

SEQ ID NO: 1034451 - DNA, 22 bp, Artificial Sequence
  chemically synthesized
ccatccctttatttccagtctg

SEQ ID NO: 1034452 - DNA, 22 bp, Artificial Sequence
  chemically synthesized
tccatccctttatttccagtct

SEQ ID NO: 1034453 - DNA, 22 bp, Artificial Sequence
  chemically synthesized
ttccatccctttatttccagtc

SEQ ID NO: 1034454 - DNA, 22 bp, Artificial Sequence
  chemically synthesized
tttccatccctttatttccagt

SEQ ID NO: 1034455 - DNA, 22 bp, Artificial Sequence
  chemically synthesized
cacacagactggaaataaaggg

SEQ ID NO: 1034456 - DNA, 22 bp, Artificial Sequence
  chemically synthesized
gcatggaatatctttttccatc

SEQ ID NO: 1034457 - DNA, 22 bp, Artificial Sequence
  chemically synthesized
gaaataaagggatggaaaaaga

SEQ ID NO: 1034458 - DNA, 22 bp, Artificial Sequence
  chemically synthesized
cattggcatggaatatcttttt

SEQ ID NO: 1034459 - DNA, 22 bp, Artificial Sequence
  chemically synthesized
ccattggcatggaatatctttt

SEQ ID NO: 1034460 - DNA, 22 bp, Artificial Sequence
  chemically synthesized
ggtttccattggcatggaatat

SEQ ID NO: 1034461 - DNA, 22 bp, Artificial Sequence
  chemically synthesized
gggtttccattggcatggaata

SEQ ID NO: 1034462 - DNA, 22 bp, Artificial Sequence
  chemically synthesized
tgtttgggtttccattggcatg

SEQ ID NO: 1034463 - DNA, 22 bp, Artificial Sequence
  chemically synthesized
gtccagctatgtttgggtttcc

SEQ ID NO: 1034464 - DNA, 22 bp, Artificial Sequence
  chemically synthesized
catgccaatggaaacccaaaca

SEQ ID NO: 1034465 - DNA, 22 bp, Artificial Sequence
  chemically synthesized
atataagtagagctagtccagc

SEQ ID NO: 1034466 - DNA, 22 bp, Artificial Sequence
  chemically synthesized
gtctgatataagtagagctagt

SEQ ID NO: 1034467 - DNA, 22 bp, Artificial Sequence
  chemically synthesized
ggtctgatataagtagagctag

SEQ ID NO: 1034468 - DNA, 22 bp, Artificial Sequence
  chemically synthesized
gactagctctacttatatcaga

SEQ ID NO: 1034469 - DNA, 22 bp, Artificial Sequence
  chemically synthesized
atatcgatttggtctgatataa

SEQ ID NO: 1034470 - DNA, 22 bp, Artificial Sequence
  chemically synthesized
gctctacttatatcagaccaaa

SEQ ID NO: 1034471 - DNA, 22 bp, Artificial Sequence
  chemically synthesized
tcctgatatcgatttggtctga

SEQ ID NO: 1034472 - DNA, 22 bp, Artificial Sequence
  chemically synthesized
gtcctgatatcgatttggtctg

SEQ ID NO: 1034473 - DNA, 22 bp, Artificial Sequence
  chemically synthesized
tgtcctgatatcgatttggtct

SEQ ID NO: 1034474 - DNA, 22 bp, Artificial Sequence
  chemically synthesized
ttgtcctgatatcgatttggtc

SEQ ID NO: 1034475 - DNA, 22 bp, Artificial Sequence
  chemically synthesized
tacttatatcagaccaaatcga

SEQ ID NO: 1034476 - DNA, 22 bp, Artificial Sequence
  chemically synthesized
cttatatcagaccaaatcgata

SEQ ID NO: 1034477 - DNA, 22 bp, Artificial Sequence
  chemically synthesized
atatcagaccaaatcgatatca

SEQ ID NO: 1034478 - DNA, 22 bp, Artificial Sequence
  chemically synthesized
cagtttttgtcctgatatcgat

SEQ ID NO: 1034479 - DNA, 22 bp, Artificial Sequence
  chemically synthesized
tatcagaccaaatcgatatcag

SEQ ID NO: 1034480 - DNA, 22 bp, Artificial Sequence
  chemically synthesized
acagtttttgtcctgatatcga

SEQ ID NO: 1034481 - DNA, 22 bp, Artificial Sequence
  chemically synthesized
ttacagtttttgtcctgatatc

SEQ ID NO: 1034482 - DNA, 22 bp, Artificial Sequence
  chemically synthesized
cttacagtttttgtcctgatat

SEQ ID NO: 1034483 - DNA, 22 bp, Artificial Sequence
  chemically synthesized
ttcttacagtttttgtcctgat

SEQ ID NO: 1034484 - DNA, 22 bp, Artificial Sequence
  chemically synthesized
tctcttcttacagtttttgtcc

SEQ ID NO: 1034485 - DNA, 22 bp, Artificial Sequence
  chemically synthesized
gtctcttcttacagtttttgtc

SEQ ID NO: 1034486 - DNA, 22 bp, Artificial Sequence
  chemically synthesized
tgtctcttcttacagtttttgt

SEQ ID NO: 1034487 - DNA, 22 bp, Artificial Sequence
  chemically synthesized
tttgtctcttcttacagttttt

SEQ ID NO: 1034488 - DNA, 22 bp, Artificial Sequence
  chemically synthesized
ctttgtctcttcttacagtttt

SEQ ID NO: 1034489 - DNA, 22 bp, Artificial Sequence
  chemically synthesized
tataatgaccttctttgtctct

SEQ ID NO: 1034490 - DNA, 22 bp, Artificial Sequence
  chemically synthesized
tcattatataatgaccttcttt

SEQ ID NO: 1034491 - DNA, 22 bp, Artificial Sequence
  chemically synthesized
taagaagagacaaagaaggtca

SEQ ID NO: 1034492 - DNA, 22 bp, Artificial Sequence
  chemically synthesized
gtcattatataatgaccttctt

SEQ ID NO: 1034493 - DNA, 22 bp, Artificial Sequence
  chemically synthesized
tgtcattatataatgaccttct

SEQ ID NO: 1034494 - DNA, 22 bp, Artificial Sequence
  chemically synthesized
ttgtcattatataatgaccttc

SEQ ID NO: 1034495 - DNA, 22 bp, Artificial Sequence
  chemically synthesized
acccttttgtcattatataatg

SEQ ID NO: 1034496 - DNA, 22 bp, Artificial Sequence
  chemically synthesized
aattgacccttttgtcattata

SEQ ID NO: 1034497 - DNA, 22 bp, Artificial Sequence
  chemically synthesized
ctgaattgacccttttgtcatt

SEQ ID NO: 1034498 - DNA, 22 bp, Artificial Sequence
  chemically synthesized
ttgctgaattgacccttttgtc

SEQ ID NO: 1034499 - DNA, 22 bp, Artificial Sequence
  chemically synthesized
tataatgacaaaagggtcaatt

SEQ ID NO: 1034500 - DNA, 22 bp, Artificial Sequence
  chemically synthesized
tatcctgttgctgaattgaccc

SEQ ID NO: 1034501 - DNA, 22 bp, Artificial Sequence
  chemically synthesized
ttatatcctgttgctgaattga

SEQ ID NO: 1034502 - DNA, 22 bp, Artificial Sequence
  chemically synthesized
agtgcatatataattgttatat

SEQ ID NO: 1034503 - DNA, 22 bp, Artificial Sequence
  chemically synthesized
agcaacaggatataacaattat

SEQ ID NO: 1034504 - DNA, 22 bp, Artificial Sequence
  chemically synthesized
cagtgttgagtgcatatataat

SEQ ID NO: 1034505 - DNA, 22 bp, Artificial Sequence
  chemically synthesized
tatatatatactccagtgttga

SEQ ID NO: 1034506 - DNA, 22 bp, Artificial Sequence
  chemically synthesized
atatatatatactccagtgttg

SEQ ID NO: 1034507 - DNA, 22 bp, Artificial Sequence
  chemically synthesized
tatatatatatactccagtgtt

SEQ ID NO: 1034508 - DNA, 22 bp, Artificial Sequence
  chemically synthesized
tatatgcactcaacactggagt

SEQ ID NO: 1034509 - DNA, 22 bp, Artificial Sequence
  chemically synthesized
ctttatatatatatactccagt

SEQ ID NO: 1034510 - DNA, 22 bp, Artificial Sequence
  chemically synthesized
gctttatatatatatactccag

SEQ ID NO: 1034511 - DNA, 22 bp, Artificial Sequence
  chemically synthesized
aacactggagtatatatatata

SEQ ID NO: 1034512 - DNA, 22 bp, Artificial Sequence
  chemically synthesized
tatatatatttgctttatatat

SEQ ID NO: 1034513 - DNA, 22 bp, Artificial Sequence
  chemically synthesized
gagtatatatatataaagcaaa

SEQ ID NO: 1034514 - DNA, 22 bp, Artificial Sequence
  chemically synthesized
cagtgttgtatatatatttgct

SEQ ID NO: 1034515 - DNA, 22 bp, Artificial Sequence
  chemically synthesized
tactccagtgttgtatatatat

SEQ ID NO: 1034516 - DNA, 22 bp, Artificial Sequence
  chemically synthesized
tatatctgtactccagtgttgt

SEQ ID NO: 1034517 - DNA, 22 bp, Artificial Sequence
  chemically synthesized
atatatctgtactccagtgttg

SEQ ID NO: 1034518 - DNA, 22 bp, Artificial Sequence
  chemically synthesized
tatatatctgtactccagtgtt

SEQ ID NO: 1034519 - DNA, 22 bp, Artificial Sequence
  chemically synthesized
ctttatatatctgtactccagt

SEQ ID NO: 1034520 - DNA, 22 bp, Artificial Sequence
  chemically synthesized
gctttatatatctgtactccag

SEQ ID NO: 1034521 - DNA, 22 bp, Artificial Sequence
  chemically synthesized
gaataatatttgctttatatat

SEQ ID NO: 1034522 - DNA, 22 bp, Artificial Sequence
  chemically synthesized
gagtacagatatataaagcaaa

SEQ ID NO: 1034523 - DNA, 22 bp, Artificial Sequence
  chemically synthesized
agctcgaataatatttgcttta

SEQ ID NO: 1034524 - DNA, 22 bp, Artificial Sequence
  chemically synthesized
ctgagctcgaataatatttgct

SEQ ID NO: 1034525 - DNA, 22 bp, Artificial Sequence
  chemically synthesized
tcctgagctcgaataatatttg

SEQ ID NO: 1034526 - DNA, 22 bp, Artificial Sequence
  chemically synthesized
tctcctgagctcgaataatatt

SEQ ID NO: 1034527 - DNA, 22 bp, Artificial Sequence
  chemically synthesized
tctctcctgagctcgaataata

SEQ ID NO: 1034528 - DNA, 22 bp, Artificial Sequence
  chemically synthesized
ctctctcctgagctcgaataat

SEQ ID NO: 1034529 - DNA, 22 bp, Artificial Sequence
  chemically synthesized
tctctctcctgagctcgaataa

SEQ ID NO: 1034530 - DNA, 22 bp, Artificial Sequence
  chemically synthesized
aggtctttctctctcctgagct

SEQ ID NO: 1034531 - DNA, 22 bp, Artificial Sequence
  chemically synthesized
tattgaggtctttctctctcct

SEQ ID NO: 1034532 - DNA, 22 bp, Artificial Sequence
  chemically synthesized
ttcgagctcaggagagagaaag

SEQ ID NO: 1034533 - DNA, 22 bp, Artificial Sequence
  chemically synthesized
ttgtattgaggtctttctctct

SEQ ID NO: 1034534 - DNA, 22 bp, Artificial Sequence
  chemically synthesized
gagctcaggagagagaaagacc

SEQ ID NO: 1034535 - DNA, 22 bp, Artificial Sequence
  chemically synthesized
ttattgtattgaggtctttctc

SEQ ID NO: 1034536 - DNA, 22 bp, Artificial Sequence
  chemically synthesized
ctgttattgtattgaggtcttt

SEQ ID NO: 1034537 - DNA, 22 bp, Artificial Sequence
  chemically synthesized
aggagagagaaagacctcaata

SEQ ID NO: 1034538 - DNA, 22 bp, Artificial Sequence
  chemically synthesized
ctgctgttattgtattgaggtc

SEQ ID NO: 1034539 - DNA, 22 bp, Artificial Sequence
  chemically synthesized
aaggctcctgctgttattgtat

SEQ ID NO: 1034540 - DNA, 22 bp, Artificial Sequence
  chemically synthesized
ttgaaggctcctgctgttattg

SEQ ID NO: 1034541 - DNA, 22 bp, Artificial Sequence
  chemically synthesized
aatacaataacagcaggagcct

SEQ ID NO: 1034542 - DNA, 22 bp, Artificial Sequence
  chemically synthesized
aaagtggggttgttgaaggctc

SEQ ID NO: 1034543 - DNA, 22 bp, Artificial Sequence
  chemically synthesized
cccaatgttgaaagtggggttg

SEQ ID NO: 1034544 - DNA, 22 bp, Artificial Sequence
  chemically synthesized
caacaaccccactttcaacatt

SEQ ID NO: 1034545 - DNA, 22 bp, Artificial Sequence
  chemically synthesized
ggagatctgcccaatgttgaaa

SEQ ID NO: 1034546 - DNA, 22 bp, Artificial Sequence
  chemically synthesized
aacaaccccactttcaacattg

SEQ ID NO: 1034547 - DNA, 22 bp, Artificial Sequence
  chemically synthesized
tctgggagatctgcccaatgtt

SEQ ID NO: 1034548 - DNA, 22 bp, Artificial Sequence
  chemically synthesized
tgtctgggagatctgcccaatg

SEQ ID NO: 1034549 - DNA, 22 bp, Artificial Sequence
  chemically synthesized
ctgtctgggagatctgcccaat

SEQ ID NO: 1034550 - DNA, 22 bp, Artificial Sequence
  chemically synthesized
agcttctgtctgggagatctgc

SEQ ID NO: 1034551 - DNA, 22 bp, Artificial Sequence
  chemically synthesized
tcaacattgggcagatctccca

SEQ ID NO: 1034552 - DNA, 22 bp, Artificial Sequence
  chemically synthesized
caacattgggcagatctcccag

SEQ ID NO: 1034553 - DNA, 22 bp, Artificial Sequence
  chemically synthesized
aacattgggcagatctcccaga

SEQ ID NO: 1034554 - DNA, 22 bp, Artificial Sequence
  chemically synthesized
gttgagcttctgtctgggagat

SEQ ID NO: 1034555 - DNA, 22 bp, Artificial Sequence
  chemically synthesized
ggttgagcttctgtctgggaga

SEQ ID NO: 1034556 - DNA, 22 bp, Artificial Sequence
  chemically synthesized
tggttgagcttctgtctgggag

SEQ ID NO: 1034557 - DNA, 22 bp, Artificial Sequence
  chemically synthesized
ctttggttgagcttctgtctgg

SEQ ID NO: 1034558 - DNA, 22 bp, Artificial Sequence
  chemically synthesized
ggcagatctcccagacagaagc

SEQ ID NO: 1034559 - DNA, 22 bp, Artificial Sequence
  chemically synthesized
ctactttggttgagcttctgtc

SEQ ID NO: 1034560 - DNA, 22 bp, Artificial Sequence
  chemically synthesized
ccagacagaagctcaaccaaag

SEQ ID NO: 1034561 - DNA, 22 bp, Artificial Sequence
  chemically synthesized
agtccaatgttactactttggt

SEQ ID NO: 1034562 - DNA, 22 bp, Artificial Sequence
  chemically synthesized
aaccaaagtagtaacattggac

SEQ ID NO: 1034563 - DNA, 22 bp, Artificial Sequence
  chemically synthesized
tagtgcagattaagtccaatgt

SEQ ID NO: 1034564 - DNA, 22 bp, Artificial Sequence
  chemically synthesized
tatagtgcagattaagtccaat

SEQ ID NO: 1034565 - DNA, 22 bp, Artificial Sequence
  chemically synthesized
ttctatagtgcagattaagtcc

SEQ ID NO: 1034566 - DNA, 22 bp, Artificial Sequence
  chemically synthesized
attctatagtgcagattaagtc

SEQ ID NO: 1034567 - DNA, 22 bp, Artificial Sequence
  chemically synthesized
gatccatttattctatagtgca

SEQ ID NO: 1034568 - DNA, 22 bp, Artificial Sequence
  chemically synthesized
gacttaatctgcactatagaat

SEQ ID NO: 1034569 - DNA, 22 bp, Artificial Sequence
  chemically synthesized
aatctgcactatagaataaatg

SEQ ID NO: 1034570 - DNA, 22 bp, Artificial Sequence
  chemically synthesized
atctgcactatagaataaatgg

SEQ ID NO: 1034571 - DNA, 22 bp, Artificial Sequence
  chemically synthesized
taaatattagatccatttattc

SEQ ID NO: 1034572 - DNA, 22 bp, Artificial Sequence
  chemically synthesized
cactatagaataaatggatcta

SEQ ID NO: 1034573 - DNA, 22 bp, Artificial Sequence
  chemically synthesized
aatgtcctgtaaatattagatc

SEQ ID NO: 1034574 - DNA, 22 bp, Artificial Sequence
  chemically synthesized
tagaataaatggatctaatatt

SEQ ID NO: 1034575 - DNA, 22 bp, Artificial Sequence
  chemically synthesized
aattaaatgtcctgtaaatatt

SEQ ID NO: 1034576 - DNA, 22 bp, Artificial Sequence
  chemically synthesized
attgaattaaatgtcctgtaaa

SEQ ID NO: 1034577 - DNA, 22 bp, Artificial Sequence
  chemically synthesized
cactcattgaattaaatgtcct

SEQ ID NO: 1034578 - DNA, 22 bp, Artificial Sequence
  chemically synthesized
tacactcattgaattaaatgtc

SEQ ID NO: 1034579 - DNA, 22 bp, Artificial Sequence
  chemically synthesized
atatttacaggacatttaattc

SEQ ID NO: 1034580 - DNA, 22 bp, Artificial Sequence
  chemically synthesized
acaggacatttaattcaatgag

SEQ ID NO: 1034581 - DNA, 22 bp, Artificial Sequence
  chemically synthesized
caggacatttaattcaatgagt

SEQ ID NO: 1034582 - DNA, 22 bp, Artificial Sequence
  chemically synthesized
aattcaatgagtgtagaataca

SEQ ID NO: 1034583 - DNA, 22 bp, Artificial Sequence
  chemically synthesized
agaagaagaatgtgtattctac

SEQ ID NO: 1034584 - DNA, 22 bp, Artificial Sequence
  chemically synthesized
attcaatgagtgtagaatacac

SEQ ID NO: 1034585 - DNA, 22 bp, Artificial Sequence
  chemically synthesized
aatgagtgtagaatacacattc

SEQ ID NO: 1034586 - DNA, 22 bp, Artificial Sequence
  chemically synthesized
tgtgctgagaagaagaatgtgt

SEQ ID NO: 1034587 - DNA, 22 bp, Artificial Sequence
  chemically synthesized
ataataatctgtgtgctgagaa

SEQ ID NO: 1034588 - DNA, 22 bp, Artificial Sequence
  chemically synthesized
gataataatctgtgtgctgaga

SEQ ID NO: 1034589 - DNA, 22 bp, Artificial Sequence
  chemically synthesized
tgataataatctgtgtgctgag

SEQ ID NO: 1034590 - DNA, 22 bp, Artificial Sequence
  chemically synthesized
tctttgataataatctgtgtgc

SEQ ID NO: 1034591 - DNA, 22 bp, Artificial Sequence
  chemically synthesized
ttcttctcagcacacagattat

SEQ ID NO: 1034592 - DNA, 22 bp, Artificial Sequence
  chemically synthesized
cttctcagcacacagattatta

SEQ ID NO: 1034593 - DNA, 22 bp, Artificial Sequence
  chemically synthesized
ttctcagcacacagattattat

SEQ ID NO: 1034594 - DNA, 22 bp, Artificial Sequence
  chemically synthesized
ctcagcacacagattattatca

SEQ ID NO: 1034595 - DNA, 22 bp, Artificial Sequence
  chemically synthesized
tcagcacacagattattatcaa

SEQ ID NO: 1034596 - DNA, 22 bp, Artificial Sequence
  chemically synthesized
tgtggtctatctttgataataa

SEQ ID NO: 1034597 - DNA, 22 bp, Artificial Sequence
  chemically synthesized
agcacacagattattatcaaag

SEQ ID NO: 1034598 - DNA, 22 bp, Artificial Sequence
  chemically synthesized
ctgtgtggtctatctttgataa

SEQ ID NO: 1034599 - DNA, 22 bp, Artificial Sequence
  chemically synthesized
tgacctactgtgtggtctatct

SEQ ID NO: 1034600 - DNA, 22 bp, Artificial Sequence
  chemically synthesized
gtgacctactgtgtggtctatc

SEQ ID NO: 1034601 - DNA, 22 bp, Artificial Sequence
  chemically synthesized
tgtgacctactgtgtggtctat

SEQ ID NO: 1034602 - DNA, 22 bp, Artificial Sequence
  chemically synthesized
ttgtgacctactgtgtggtcta

SEQ ID NO: 1034603 - DNA, 22 bp, Artificial Sequence
  chemically synthesized
ttatcaaagatagaccacacag

SEQ ID NO: 1034604 - DNA, 22 bp, Artificial Sequence
  chemically synthesized
cttttgtgacctactgtgtggt

SEQ ID NO: 1034605 - DNA, 22 bp, Artificial Sequence
  chemically synthesized
tcaaagatagaccacacagtag

SEQ ID NO: 1034606 - DNA, 22 bp, Artificial Sequence
  chemically synthesized
agactgcttttgtgacctactg

SEQ ID NO: 1034607 - DNA, 22 bp, Artificial Sequence
  chemically synthesized
aagactgcttttgtgacctact

SEQ ID NO: 1034608 - DNA, 22 bp, Artificial Sequence
  chemically synthesized
taagactgcttttgtgacctac

SEQ ID NO: 1034609 - DNA, 22 bp, Artificial Sequence
  chemically synthesized
ttaagactgcttttgtgaccta

SEQ ID NO: 1034610 - DNA, 22 bp, Artificial Sequence
  chemically synthesized
aatttttaagactgcttttgtg

SEQ ID NO: 1034611 - DNA, 22 bp, Artificial Sequence
  chemically synthesized
ctgaatttttaagactgctttt

SEQ ID NO: 1034612 - DNA, 22 bp, Artificial Sequence
  chemically synthesized
ttactgaatttttaagactgct

SEQ ID NO: 1034613 - DNA, 22 bp, Artificial Sequence
  chemically synthesized
attgttactgaatttttaagac

SEQ ID NO: 1034614 - DNA, 22 bp, Artificial Sequence
  chemically synthesized
cattgttactgaatttttaaga

SEQ ID NO: 1034615 - DNA, 22 bp, Artificial Sequence
  chemically synthesized
tttcattgttactgaattttta

SEQ ID NO: 1034616 - DNA, 22 bp, Artificial Sequence
  chemically synthesized
atattatttcattgttactgaa

SEQ ID NO: 1034617 - DNA, 22 bp, Artificial Sequence
  chemically synthesized
gatattatttcattgttactga

SEQ ID NO: 1034618 - DNA, 22 bp, Artificial Sequence
  chemically synthesized
aaaaattcagtaacaatgaaat

SEQ ID NO: 1034619 - DNA, 22 bp, Artificial Sequence
  chemically synthesized
aaaattcagtaacaatgaaata

SEQ ID NO: 1034620 - DNA, 22 bp, Artificial Sequence
  chemically synthesized
agtaacaatgaaataatatcaa

SEQ ID NO: 1034621 - DNA, 22 bp, Artificial Sequence
  chemically synthesized
tggtcagagaagatgcttgata

SEQ ID NO: 1034622 - DNA, 22 bp, Artificial Sequence
  chemically synthesized
cattgtggtcagagaagatgct

SEQ ID NO: 1034623 - DNA, 22 bp, Artificial Sequence
  chemically synthesized
attccattgtggtcagagaaga

SEQ ID NO: 1034624 - DNA, 22 bp, Artificial Sequence
  chemically synthesized
gtctcattccattgtggtcaga

SEQ ID NO: 1034625 - DNA, 22 bp, Artificial Sequence
  chemically synthesized
tagtctcattccattgtggtca

SEQ ID NO: 1034626 - DNA, 22 bp, Artificial Sequence
  chemically synthesized
ctagtctcattccattgtggtc

SEQ ID NO: 1034627 - DNA, 22 bp, Artificial Sequence
  chemically synthesized
atttctagtctcattccattgt

SEQ ID NO: 1034628 - DNA, 22 bp, Artificial Sequence
  chemically synthesized
ttgatttctagtctcattccat

SEQ ID NO: 1034629 - DNA, 22 bp, Artificial Sequence
  chemically synthesized
ctctgaccacaatggaatgaga

SEQ ID NO: 1034630 - DNA, 22 bp, Artificial Sequence
  chemically synthesized
tctgaccacaatggaatgagac

SEQ ID NO: 1034631 - DNA, 22 bp, Artificial Sequence
  chemically synthesized
tgaccacaatggaatgagacta

SEQ ID NO: 1034632 - DNA, 22 bp, Artificial Sequence
  chemically synthesized
attgttgatttctagtctcatt

SEQ ID NO: 1034633 - DNA, 22 bp, Artificial Sequence
  chemically synthesized
accacaatggaatgagactaga

SEQ ID NO: 1034634 - DNA, 22 bp, Artificial Sequence
  chemically synthesized
ctcattgttgatttctagtctc

SEQ ID NO: 1034635 - DNA, 22 bp, Artificial Sequence
  chemically synthesized
caaaattcctcattgttgattt

SEQ ID NO: 1034636 - DNA, 22 bp, Artificial Sequence
  chemically synthesized
ccaaaattcctcattgttgatt

SEQ ID NO: 1034637 - DNA, 22 bp, Artificial Sequence
  chemically synthesized
tatagcttccaaaattcctcat

SEQ ID NO: 1034638 - DNA, 22 bp, Artificial Sequence
  chemically synthesized
gtatagcttccaaaattcctca

SEQ ID NO: 1034639 - DNA, 22 bp, Artificial Sequence
  chemically synthesized
gaaatcaacaatgaggaatttt

SEQ ID NO: 1034640 - DNA, 22 bp, Artificial Sequence
  chemically synthesized
catgtgtttgtatagcttccaa

SEQ ID NO: 1034641 - DNA, 22 bp, Artificial Sequence
  chemically synthesized
ccatgtgtttgtatagcttcca

SEQ ID NO: 1034642 - DNA, 22 bp, Artificial Sequence
  chemically synthesized
acttccatgtgtttgtatagct

SEQ ID NO: 1034643 - DNA, 22 bp, Artificial Sequence
  chemically synthesized
aacttccatgtgtttgtatagc

SEQ ID NO: 1034644 - DNA, 22 bp, Artificial Sequence
  chemically synthesized
tttaacttccatgtgtttgtat

SEQ ID NO: 1034645 - DNA, 22 bp, Artificial Sequence
  chemically synthesized
tggaagctatacaaacacatgg

SEQ ID NO: 1034646 - DNA, 22 bp, Artificial Sequence
  chemically synthesized
ggaagctatacaaacacatgga

SEQ ID NO: 1034647 - DNA, 22 bp, Artificial Sequence
  chemically synthesized
gaagctatacaaacacatggaa

SEQ ID NO: 1034648 - DNA, 22 bp, Artificial Sequence
  chemically synthesized
gtagcatattgtttaacttcca

SEQ ID NO: 1034649 - DNA, 22 bp, Artificial Sequence
  chemically synthesized
agtagcatattgtttaacttcc

SEQ ID NO: 1034650 - DNA, 22 bp, Artificial Sequence
  chemically synthesized
tacaaacacatggaagttaaac

SEQ ID NO: 1034651 - DNA, 22 bp, Artificial Sequence
  chemically synthesized
atagacccagtggtcatttagt

SEQ ID NO: 1034652 - DNA, 22 bp, Artificial Sequence
  chemically synthesized
aacaatatgctactaaatgacc

SEQ ID NO: 1034653 - DNA, 22 bp, Artificial Sequence
  chemically synthesized
catagacccagtggtcatttag

SEQ ID NO: 1034654 - DNA, 22 bp, Artificial Sequence
  chemically synthesized
ttcatagacccagtggtcattt

SEQ ID NO: 1034655 - DNA, 22 bp, Artificial Sequence
  chemically synthesized
cttcatagacccagtggtcatt

SEQ ID NO: 1034656 - DNA, 22 bp, Artificial Sequence
  chemically synthesized
atttcttcatagacccagtggt

SEQ ID NO: 1034657 - DNA, 22 bp, Artificial Sequence
  chemically synthesized
aatttcttcatagacccagtgg

SEQ ID NO: 1034658 - DNA, 22 bp, Artificial Sequence
  chemically synthesized
ttaatttcttcatagacccagt

SEQ ID NO: 1034659 - DNA, 22 bp, Artificial Sequence
  chemically synthesized
cttaatttcttcatagacccag

SEQ ID NO: 1034660 - DNA, 22 bp, Artificial Sequence
  chemically synthesized
ctaaatgaccactgggtctatg

SEQ ID NO: 1034661 - DNA, 22 bp, Artificial Sequence
  chemically synthesized
cttcttaatttcttcatagacc

SEQ ID NO: 1034662 - DNA, 22 bp, Artificial Sequence
  chemically synthesized
aatgaccactgggtctatgaag

SEQ ID NO: 1034663 - DNA, 22 bp, Artificial Sequence
  chemically synthesized
ccttcttaatttcttcatagac

SEQ ID NO: 1034664 - DNA, 22 bp, Artificial Sequence
  chemically synthesized
aatttccttcttaatttcttca

SEQ ID NO: 1034665 - DNA, 22 bp, Artificial Sequence
  chemically synthesized
caatttccttcttaatttcttc

SEQ ID NO: 1034666 - DNA, 22 bp, Artificial Sequence
  chemically synthesized
tcaatttccttcttaatttctt

SEQ ID NO: 1034667 - DNA, 22 bp, Artificial Sequence
  chemically synthesized
ttcaatttccttcttaatttct

SEQ ID NO: 1034668 - DNA, 22 bp, Artificial Sequence
  chemically synthesized
ggtctatgaagaaattaagaag

SEQ ID NO: 1034669 - DNA, 22 bp, Artificial Sequence
  chemically synthesized
tgaagaaattaagaaggaaatt

SEQ ID NO: 1034670 - DNA, 22 bp, Artificial Sequence
  chemically synthesized
aagacatttttcaatttccttc

SEQ ID NO: 1034671 - DNA, 22 bp, Artificial Sequence
  chemically synthesized
gaagacatttttcaatttcctt

SEQ ID NO: 1034672 - DNA, 22 bp, Artificial Sequence
  chemically synthesized
tgaagacatttttcaatttcct

SEQ ID NO: 1034673 - DNA, 22 bp, Artificial Sequence
  chemically synthesized
ttgaagacatttttcaatttcc

SEQ ID NO: 1034674 - DNA, 22 bp, Artificial Sequence
  chemically synthesized
tttgaagacatttttcaatttc

SEQ ID NO: 1034675 - DNA, 22 bp, Artificial Sequence
  chemically synthesized
attttttgaagacatttttcaa

SEQ ID NO: 1034676 - DNA, 22 bp, Artificial Sequence
  chemically synthesized
cattttttgaagacatttttca

SEQ ID NO: 1034677 - DNA, 22 bp, Artificial Sequence
  chemically synthesized
tcattttttgaagacatttttc

SEQ ID NO: 1034678 - DNA, 22 bp, Artificial Sequence
  chemically synthesized
agaaggaaattgaaaaatgtct

SEQ ID NO: 1034679 - DNA, 22 bp, Artificial Sequence
  chemically synthesized
tttcattttttgaagacatttt

SEQ ID NO: 1034680 - DNA, 22 bp, Artificial Sequence
  chemically synthesized
ctttcattttttgaagacattt

SEQ ID NO: 1034681 - DNA, 22 bp, Artificial Sequence
  chemically synthesized
tctttcattttttgaagacatt

SEQ ID NO: 1034682 - DNA, 22 bp, Artificial Sequence
  chemically synthesized
ttctttcattttttgaagacat

SEQ ID NO: 1034683 - DNA, 22 bp, Artificial Sequence
  chemically synthesized
aaaaatgtcttcaaaaaatgaa

SEQ ID NO: 1034684 - DNA, 22 bp, Artificial Sequence
  chemically synthesized
gtatgtggtttttctttcattt

SEQ ID NO: 1034685 - DNA, 22 bp, Artificial Sequence
  chemically synthesized
ggtatgtggtttttctttcatt

SEQ ID NO: 1034686 - DNA, 22 bp, Artificial Sequence
  chemically synthesized
tggtatgtggtttttctttcat

SEQ ID NO: 1034687 - DNA, 22 bp, Artificial Sequence
  chemically synthesized
caaaaaatgaaagaaaaaccac

SEQ ID NO: 1034688 - DNA, 22 bp, Artificial Sequence
  chemically synthesized
aaaaaatgaaagaaaaaccaca

SEQ ID NO: 1034689 - DNA, 22 bp, Artificial Sequence
  chemically synthesized
tatcccataggttttggtatgt

SEQ ID NO: 1034690 - DNA, 22 bp, Artificial Sequence
  chemically synthesized
ctgtatcccataggttttggta

SEQ ID NO: 1034691 - DNA, 22 bp, Artificial Sequence
  chemically synthesized
gctgtatcccataggttttggt

SEQ ID NO: 1034692 - DNA, 22 bp, Artificial Sequence
  chemically synthesized
tgctgtatcccataggttttgg

SEQ ID NO: 1034693 - DNA, 22 bp, Artificial Sequence
  chemically synthesized
gttttgctgtatcccataggtt

SEQ ID NO: 1034694 - DNA, 22 bp, Artificial Sequence
  chemically synthesized
gtactagttttgctgtatccca

SEQ ID NO: 1034695 - DNA, 22 bp, Artificial Sequence
  chemically synthesized
agtactagttttgctgtatccc

SEQ ID NO: 1034696 - DNA, 22 bp, Artificial Sequence
  chemically synthesized
ttagtactagttttgctgtatc

SEQ ID NO: 1034697 - DNA, 22 bp, Artificial Sequence
  chemically synthesized
tcttagtactagttttgctgta

SEQ ID NO: 1034698 - DNA, 22 bp, Artificial Sequence
  chemically synthesized
tctcttagtactagttttgctg

SEQ ID NO: 1034699 - DNA, 22 bp, Artificial Sequence
  chemically synthesized
ctctcttagtactagttttgct

SEQ ID NO: 1034700 - DNA, 22 bp, Artificial Sequence
  chemically synthesized
tgggatacagcaaaactagtac

SEQ ID NO: 1034701 - DNA, 22 bp, Artificial Sequence
  chemically synthesized
taaatttctctcttagtactag

SEQ ID NO: 1034702 - DNA, 22 bp, Artificial Sequence
  chemically synthesized
cagctgtaaatttctctcttag

SEQ ID NO: 1034703 - DNA, 22 bp, Artificial Sequence
  chemically synthesized
gtactaagagagaaatttacag

SEQ ID NO: 1034704 - DNA, 22 bp, Artificial Sequence
  chemically synthesized
atagaagcacctacagctgtaa

SEQ ID NO: 1034705 - DNA, 22 bp, Artificial Sequence
  chemically synthesized
gatagaagcacctacagctgta

SEQ ID NO: 1034706 - DNA, 22 bp, Artificial Sequence
  chemically synthesized
agagagaaatttacagctgtag

SEQ ID NO: 1034707 - DNA, 22 bp, Artificial Sequence
  chemically synthesized
tgatagaagcacctacagctgt

SEQ ID NO: 1034708 - DNA, 22 bp, Artificial Sequence
  chemically synthesized
ttgatagaagcacctacagctg

SEQ ID NO: 1034709 - DNA, 22 bp, Artificial Sequence
  chemically synthesized
tttgatagaagcacctacagct

SEQ ID NO: 1034710 - DNA, 22 bp, Artificial Sequence
  chemically synthesized
ttttgatagaagcacctacagc

SEQ ID NO: 1034711 - DNA, 22 bp, Artificial Sequence
  chemically synthesized
ttttttgatagaagcacctaca

SEQ ID NO: 1034712 - DNA, 22 bp, Artificial Sequence
  chemically synthesized
cttttttgatagaagcacctac

SEQ ID NO: 1034713 - DNA, 22 bp, Artificial Sequence
  chemically synthesized
tcttttttgatagaagcaccta

SEQ ID NO: 1034714 - DNA, 22 bp, Artificial Sequence
  chemically synthesized
ttcttttttgatagaagcacct

SEQ ID NO: 1034715 - DNA, 22 bp, Artificial Sequence
  chemically synthesized
tttcttttttgatagaagcacc

SEQ ID NO: 1034716 - DNA, 22 bp, Artificial Sequence
  chemically synthesized
ttttcttttttgatagaagcac

SEQ ID NO: 1034717 - DNA, 22 bp, Artificial Sequence
  chemically synthesized
acagctgtaggtgcttctatca

SEQ ID NO: 1034718 - DNA, 22 bp, Artificial Sequence
  chemically synthesized
cagctgtaggtgcttctatcaa

SEQ ID NO: 1034719 - DNA, 22 bp, Artificial Sequence
  chemically synthesized
aagtttttttcttttttgatag

SEQ ID NO: 1034720 - DNA, 22 bp, Artificial Sequence
  chemically synthesized
gaagtttttttcttttttgata

SEQ ID NO: 1034721 - DNA, 22 bp, Artificial Sequence
  chemically synthesized
taggtgcttctatcaaaaaaga

SEQ ID NO: 1034722 - DNA, 22 bp, Artificial Sequence
  chemically synthesized
tttgaagtttttttcttttttg

SEQ ID NO: 1034723 - DNA, 22 bp, Artificial Sequence
  chemically synthesized
atttgaagtttttttctttttt

SEQ ID NO: 1034724 - DNA, 22 bp, Artificial Sequence
  chemically synthesized
ctatcaaaaaagaaaaaaactt

SEQ ID NO: 1034725 - DNA, 22 bp, Artificial Sequence
  chemically synthesized
tatcaaaaaagaaaaaaacttc

SEQ ID NO: 1034726 - DNA, 22 bp, Artificial Sequence
  chemically synthesized
ggtgatttatttgaagtttttt

SEQ ID NO: 1034727 - DNA, 22 bp, Artificial Sequence
  chemically synthesized
tcaaaaaagaaaaaaacttcaa

SEQ ID NO: 1034728 - DNA, 22 bp, Artificial Sequence
  chemically synthesized
ttaggtgatttatttgaagttt

SEQ ID NO: 1034729 - DNA, 22 bp, Artificial Sequence
  chemically synthesized
cattgttaggtgatttatttga

SEQ ID NO: 1034730 - DNA, 22 bp, Artificial Sequence
  chemically synthesized
agttgcattgttaggtgattta

SEQ ID NO: 1034731 - DNA, 22 bp, Artificial Sequence
  chemically synthesized
aagttgcattgttaggtgattt

SEQ ID NO: 1034732 - DNA, 22 bp, Artificial Sequence
  chemically synthesized
taagttgcattgttaggtgatt

SEQ ID NO: 1034733 - DNA, 22 bp, Artificial Sequence
  chemically synthesized
caaataaatcacctaacaatgc

SEQ ID NO: 1034734 - DNA, 22 bp, Artificial Sequence
  chemically synthesized
ggtctttaagttgcattgttag

SEQ ID NO: 1034735 - DNA, 22 bp, Artificial Sequence
  chemically synthesized
aaataaatcacctaacaatgca

SEQ ID NO: 1034736 - DNA, 22 bp, Artificial Sequence
  chemically synthesized
tctaggtctttaagttgcattg

SEQ ID NO: 1034737 - DNA, 22 bp, Artificial Sequence
  chemically synthesized
gtctaggtctttaagttgcatt

SEQ ID NO: 1034738 - DNA, 22 bp, Artificial Sequence
  chemically synthesized
cttgtctaggtctttaagttgc

SEQ ID NO: 1034739 - DNA, 22 bp, Artificial Sequence
  chemically synthesized
ctgcttgtctaggtctttaagt

SEQ ID NO: 1034740 - DNA, 22 bp, Artificial Sequence
  chemically synthesized
ctcctgcttgtctaggtcttta

SEQ ID NO: 1034741 - DNA, 22 bp, Artificial Sequence
  chemically synthesized
acaatgcaacttaaagacctag

SEQ ID NO: 1034742 - DNA, 22 bp, Artificial Sequence
  chemically synthesized
gctcctgcttgtctaggtcttt

SEQ ID NO: 1034743 - DNA, 22 bp, Artificial Sequence
  chemically synthesized
gatttgctcctgcttgtctagg

SEQ ID NO: 1034744 - DNA, 22 bp, Artificial Sequence
  chemically synthesized
ggttcgatttgctcctgcttgt

SEQ ID NO: 1034745 - DNA, 22 bp, Artificial Sequence
  chemically synthesized
gggttcgatttgctcctgcttg

SEQ ID NO: 1034746 - DNA, 22 bp, Artificial Sequence
  chemically synthesized
aaagacctagacaagcaggagc

SEQ ID NO: 1034747 - DNA, 22 bp, Artificial Sequence
  chemically synthesized
tgggttcgatttgctcctgctt

SEQ ID NO: 1034748 - DNA, 22 bp, Artificial Sequence
  chemically synthesized
aagacctagacaagcaggagca

SEQ ID NO: 1034749 - DNA, 22 bp, Artificial Sequence
  chemically synthesized
attttgggttcgatttgctcct

SEQ ID NO: 1034750 - DNA, 22 bp, Artificial Sequence
  chemically synthesized
gacaagcaggagcaaatcgaac

SEQ ID NO: 1034751 - DNA, 22 bp, Artificial Sequence
  chemically synthesized
cactaattttgggttcgatttg

SEQ ID NO: 1034752 - DNA, 22 bp, Artificial Sequence
  chemically synthesized
ccactaattttgggttcgattt

SEQ ID NO: 1034753 - DNA, 22 bp, Artificial Sequence
  chemically synthesized
ttccactaattttgggttcgat

SEQ ID NO: 1034754 - DNA, 22 bp, Artificial Sequence
  chemically synthesized
cttccactaattttgggttcga

SEQ ID NO: 1034755 - DNA, 22 bp, Artificial Sequence
  chemically synthesized
tcttccactaattttgggttcg

SEQ ID NO: 1034756 - DNA, 22 bp, Artificial Sequence
  chemically synthesized
tttcttccactaattttgggtt

SEQ ID NO: 1034757 - DNA, 22 bp, Artificial Sequence
  chemically synthesized
ctttcttccactaattttgggt

SEQ ID NO: 1034758 - DNA, 22 bp, Artificial Sequence
  chemically synthesized
tttctttcttccactaattttg

SEQ ID NO: 1034759 - DNA, 22 bp, Artificial Sequence
  chemically synthesized
ttatttctttcttccactaatt

SEQ ID NO: 1034760 - DNA, 22 bp, Artificial Sequence
  chemically synthesized
attatttctttcttccactaat

SEQ ID NO: 1034761 - DNA, 22 bp, Artificial Sequence
  chemically synthesized
tattatttctttcttccactaa

SEQ ID NO: 1034762 - DNA, 22 bp, Artificial Sequence
  chemically synthesized
atctttattatttctttcttcc

SEQ ID NO: 1034763 - DNA, 22 bp, Artificial Sequence
  chemically synthesized
tgatctttattatttctttctt

SEQ ID NO: 1034764 - DNA, 22 bp, Artificial Sequence
  chemically synthesized
ctctgatctttattatttcttt

SEQ ID NO: 1034765 - DNA, 22 bp, Artificial Sequence
  chemically synthesized
tgctctgatctttattatttct

SEQ ID NO: 1034766 - DNA, 22 bp, Artificial Sequence
  chemically synthesized
ctgctctgatctttattatttc

SEQ ID NO: 1034767 - DNA, 22 bp, Artificial Sequence
  chemically synthesized
gtggaagaaagaaataataaag

SEQ ID NO: 1034768 - DNA, 22 bp, Artificial Sequence
  chemically synthesized
tttctgctctgatctttattat

SEQ ID NO: 1034769 - DNA, 22 bp, Artificial Sequence
  chemically synthesized
atttctgctctgatctttatta

SEQ ID NO: 1034770 - DNA, 22 bp, Artificial Sequence
  chemically synthesized
caaagtcatttatttctgctct

SEQ ID NO: 1034771 - DNA, 22 bp, Artificial Sequence
  chemically synthesized
ttacaaagtcatttatttctgc

SEQ ID NO: 1034772 - DNA, 22 bp, Artificial Sequence
  chemically synthesized
attacaaagtcatttatttctg

SEQ ID NO: 1034773 - DNA, 22 bp, Artificial Sequence
  chemically synthesized
tattacaaagtcatttatttct

SEQ ID NO: 1034774 - DNA, 22 bp, Artificial Sequence
  chemically synthesized
tttattacaaagtcatttattt

SEQ ID NO: 1034775 - DNA, 22 bp, Artificial Sequence
  chemically synthesized
ctttattacaaagtcatttatt

SEQ ID NO: 1034776 - DNA, 22 bp, Artificial Sequence
  chemically synthesized
tctttattacaaagtcatttat

SEQ ID NO: 1034777 - DNA, 22 bp, Artificial Sequence
  chemically synthesized
tatgttttctttattacaaagt

SEQ ID NO: 1034778 - DNA, 22 bp, Artificial Sequence
  chemically synthesized
gtatgttttctttattacaaag

SEQ ID NO: 1034779 - DNA, 22 bp, Artificial Sequence
  chemically synthesized
tgtatgttttctttattacaaa

SEQ ID NO: 1034780 - DNA, 22 bp, Artificial Sequence
  chemically synthesized
ttgtatgttttctttattacaa

SEQ ID NO: 1034781 - DNA, 22 bp, Artificial Sequence
  chemically synthesized
tttgtatgttttctttattaca

SEQ ID NO: 1034782 - DNA, 22 bp, Artificial Sequence
  chemically synthesized
actttttgtatgttttctttat

SEQ ID NO: 1034783 - DNA, 22 bp, Artificial Sequence
  chemically synthesized
ttgactttttgtatgttttctt

SEQ ID NO: 1034784 - DNA, 22 bp, Artificial Sequence
  chemically synthesized
gttgactttttgtatgttttct

SEQ ID NO: 1034785 - DNA, 22 bp, Artificial Sequence
  chemically synthesized
tgttgactttttgtatgttttc

SEQ ID NO: 1034786 - DNA, 22 bp, Artificial Sequence
  chemically synthesized
tgtaataaagaaaacatacaaa

SEQ ID NO: 1034787 - DNA, 22 bp, Artificial Sequence
  chemically synthesized
gtaataaagaaaacatacaaaa

SEQ ID NO: 1034788 - DNA, 22 bp, Artificial Sequence
  chemically synthesized
gttttgttgactttttgtatgt

SEQ ID NO: 1034789 - DNA, 22 bp, Artificial Sequence
  chemically synthesized
taataaagaaaacatacaaaaa

SEQ ID NO: 1034790 - DNA, 22 bp, Artificial Sequence
  chemically synthesized
cgttttgttgactttttgtatg

SEQ ID NO: 1034791 - DNA, 22 bp, Artificial Sequence
  chemically synthesized
tcgttttgttgactttttgtat

SEQ ID NO: 1034792 - DNA, 22 bp, Artificial Sequence
  chemically synthesized
ttcgttttgttgactttttgta

SEQ ID NO: 1034793 - DNA, 22 bp, Artificial Sequence
  chemically synthesized
aataaaccaacttttcgttttg

SEQ ID NO: 1034794 - DNA, 22 bp, Artificial Sequence
  chemically synthesized
caataaaccaacttttcgtttt

SEQ ID NO: 1034795 - DNA, 22 bp, Artificial Sequence
  chemically synthesized
tcaataaaccaacttttcgttt

SEQ ID NO: 1034796 - DNA, 22 bp, Artificial Sequence
  chemically synthesized
ttcaataaaccaacttttcgtt

SEQ ID NO: 1034797 - DNA, 22 bp, Artificial Sequence
  chemically synthesized
ccttttcaataaaccaactttt

SEQ ID NO: 1034798 - DNA, 22 bp, Artificial Sequence
  chemically synthesized
accttttcaataaaccaacttt

SEQ ID NO: 1034799 - DNA, 22 bp, Artificial Sequence
  chemically synthesized
tttaccttttcaataaaccaac

SEQ ID NO: 1034800 - DNA, 22 bp, Artificial Sequence
  chemically synthesized
gtttaccttttcaataaaccaa

SEQ ID NO: 1034801 - DNA, 22 bp, Artificial Sequence
  chemically synthesized
tgtttaccttttcaataaacca

SEQ ID NO: 1034802 - DNA, 22 bp, Artificial Sequence
  chemically synthesized
tcaattttgtttaccttttcaa

SEQ ID NO: 1034803 - DNA, 22 bp, Artificial Sequence
  chemically synthesized
gtcaattttgtttaccttttca

SEQ ID NO: 1034804 - DNA, 22 bp, Artificial Sequence
  chemically synthesized
gtttattgaaaaggtaaacaaa

SEQ ID NO: 1034805 - DNA, 22 bp, Artificial Sequence
  chemically synthesized
aagatttgtcaattttgtttac

SEQ ID NO: 1034806 - DNA, 22 bp, Artificial Sequence
  chemically synthesized
attgaaaaggtaaacaaaattg

SEQ ID NO: 1034807 - DNA, 22 bp, Artificial Sequence
  chemically synthesized
ttgaaaaggtaaacaaaattga

SEQ ID NO: 1034808 - DNA, 22 bp, Artificial Sequence
  chemically synthesized
gctcaagatttgtcaattttgt

SEQ ID NO: 1034809 - DNA, 22 bp, Artificial Sequence
  chemically synthesized
aaaaggtaaacaaaattgacaa

SEQ ID NO: 1034810 - DNA, 22 bp, Artificial Sequence
  chemically synthesized
gtctggctcaagatttgtcaat

SEQ ID NO: 1034811 - DNA, 22 bp, Artificial Sequence
  chemically synthesized
attagtctggctcaagatttgt

SEQ ID NO: 1034812 - DNA, 22 bp, Artificial Sequence
  chemically synthesized
cattagtctggctcaagatttg

SEQ ID NO: 1034813 - DNA, 22 bp, Artificial Sequence
  chemically synthesized
ttcattagtctggctcaagatt

SEQ ID NO: 1034814 - DNA, 22 bp, Artificial Sequence
  chemically synthesized
cttcattagtctggctcaagat

SEQ ID NO: 1034815 - DNA, 22 bp, Artificial Sequence
  chemically synthesized
tcttcattagtctggctcaaga

SEQ ID NO: 1034816 - DNA, 22 bp, Artificial Sequence
  chemically synthesized
ttcttcattagtctggctcaag

SEQ ID NO: 1034817 - DNA, 22 bp, Artificial Sequence
  chemically synthesized
tttcttcattagtctggctcaa

SEQ ID NO: 1034818 - DNA, 22 bp, Artificial Sequence
  chemically synthesized
ttttcttcattagtctggctca

SEQ ID NO: 1034819 - DNA, 22 bp, Artificial Sequence
  chemically synthesized
acaaatcttgagccagactaat

SEQ ID NO: 1034820 - DNA, 22 bp, Artificial Sequence
  chemically synthesized
ccttttttcttcattagtctgg

SEQ ID NO: 1034821 - DNA, 22 bp, Artificial Sequence
  chemically synthesized
tcccttttttcttcattagtct

SEQ ID NO: 1034822 - DNA, 22 bp, Artificial Sequence
  chemically synthesized
ctcccttttttcttcattagtc

SEQ ID NO: 1034823 - DNA, 22 bp, Artificial Sequence
  chemically synthesized
gagccagactaatgaagaaaaa

SEQ ID NO: 1034824 - DNA, 22 bp, Artificial Sequence
  chemically synthesized
ggtcttctcccttttttcttca

SEQ ID NO: 1034825 - DNA, 22 bp, Artificial Sequence
  chemically synthesized
agccagactaatgaagaaaaaa

SEQ ID NO: 1034826 - DNA, 22 bp, Artificial Sequence
  chemically synthesized
gggtcttctcccttttttcttc

SEQ ID NO: 1034827 - DNA, 22 bp, Artificial Sequence
  chemically synthesized
tttgggtcttctcccttttttc

SEQ ID NO: 1034828 - DNA, 22 bp, Artificial Sequence
  chemically synthesized
atttgggtcttctccctttttt

SEQ ID NO: 1034829 - DNA, 22 bp, Artificial Sequence
  chemically synthesized
cttatttgggtcttctcccttt

SEQ ID NO: 1034830 - DNA, 22 bp, Artificial Sequence
  chemically synthesized
acttatttgggtcttctccctt

SEQ ID NO: 1034831 - DNA, 22 bp, Artificial Sequence
  chemically synthesized
tacttatttgggtcttctccct

SEQ ID NO: 1034832 - DNA, 22 bp, Artificial Sequence
  chemically synthesized
atgaagaaaaaagggagaagac

SEQ ID NO: 1034833 - DNA, 22 bp, Artificial Sequence
  chemically synthesized
attttacttatttgggtcttct

SEQ ID NO: 1034834 - DNA, 22 bp, Artificial Sequence
  chemically synthesized
tgattttacttatttgggtctt

SEQ ID NO: 1034835 - DNA, 22 bp, Artificial Sequence
  chemically synthesized
ctgattttacttatttgggtct

SEQ ID NO: 1034836 - DNA, 22 bp, Artificial Sequence
  chemically synthesized
atttctgattttacttatttgg

SEQ ID NO: 1034837 - DNA, 22 bp, Artificial Sequence
  chemically synthesized
tcatttctgattttacttattt

SEQ ID NO: 1034838 - DNA, 22 bp, Artificial Sequence
  chemically synthesized
ctcatttctgattttacttatt

SEQ ID NO: 1034839 - DNA, 22 bp, Artificial Sequence
  chemically synthesized
tctcatttctgattttacttat

SEQ ID NO: 1034840 - DNA, 22 bp, Artificial Sequence
  chemically synthesized
ctttctcatttctgattttact

SEQ ID NO: 1034841 - DNA, 22 bp, Artificial Sequence
  chemically synthesized
taatatctcctttctcatttct

SEQ ID NO: 1034842 - DNA, 22 bp, Artificial Sequence
  chemically synthesized
attgtaatatctcctttctcat

SEQ ID NO: 1034843 - DNA, 22 bp, Artificial Sequence
  chemically synthesized
gtattaattgtaatatctcctt

SEQ ID NO: 1034844 - DNA, 22 bp, Artificial Sequence
  chemically synthesized
tctggtattaattgtaatatct

SEQ ID NO: 1034845 - DNA, 22 bp, Artificial Sequence
  chemically synthesized
atctggtattaattgtaatatc

SEQ ID NO: 1034846 - DNA, 22 bp, Artificial Sequence
  chemically synthesized
aatttatctggtattaattgta

SEQ ID NO: 1034847 - DNA, 22 bp, Artificial Sequence
  chemically synthesized
gaatttatctggtattaattgt

SEQ ID NO: 1034848 - DNA, 22 bp, Artificial Sequence
  chemically synthesized
tgaatttatctggtattaattg

SEQ ID NO: 1034849 - DNA, 22 bp, Artificial Sequence
  chemically synthesized
atgagcctttgaatttatctgg

SEQ ID NO: 1034850 - DNA, 22 bp, Artificial Sequence
  chemically synthesized
caattaataccagataaattca

SEQ ID NO: 1034851 - DNA, 22 bp, Artificial Sequence
  chemically synthesized
ataccagataaattcaaaggct

SEQ ID NO: 1034852 - DNA, 22 bp, Artificial Sequence
  chemically synthesized
atagtagccactaatgagcctt

SEQ ID NO: 1034853 - DNA, 22 bp, Artificial Sequence
  chemically synthesized
ctcatagtagccactaatgagc

SEQ ID NO: 1034854 - DNA, 22 bp, Artificial Sequence
  chemically synthesized
aaaggctcattagtggctacta

SEQ ID NO: 1034855 - DNA, 22 bp, Artificial Sequence
  chemically synthesized
gcatatagttgctcatagtagc

SEQ ID NO: 1034856 - DNA, 22 bp, Artificial Sequence
  chemically synthesized
ttggcatatagttgctcatagt

SEQ ID NO: 1034857 - DNA, 22 bp, Artificial Sequence
  chemically synthesized
gttggcatatagttgctcatag

SEQ ID NO: 1034858 - DNA, 22 bp, Artificial Sequence
  chemically synthesized
attagtggctactatgagcaac

SEQ ID NO: 1034859 - DNA, 22 bp, Artificial Sequence
  chemically synthesized
gtggctactatgagcaactata

SEQ ID NO: 1034860 - DNA, 22 bp, Artificial Sequence
  chemically synthesized
aatttgttggcatatagttgct

SEQ ID NO: 1034861 - DNA, 22 bp, Artificial Sequence
  chemically synthesized
caatttgttggcatatagttgc

SEQ ID NO: 1034862 - DNA, 22 bp, Artificial Sequence
  chemically synthesized
tcaatttgttggcatatagttg

SEQ ID NO: 1034863 - DNA, 22 bp, Artificial Sequence
  chemically synthesized
ttcaatttgttggcatatagtt

SEQ ID NO: 1034864 - DNA, 22 bp, Artificial Sequence
  chemically synthesized
ctatgagcaactatatgccaac

SEQ ID NO: 1034865 - DNA, 22 bp, Artificial Sequence
  chemically synthesized
gatttttcaatttgttggcata

SEQ ID NO: 1034866 - DNA, 22 bp, Artificial Sequence
  chemically synthesized
tgagcaactatatgccaacaaa

SEQ ID NO: 1034867 - DNA, 22 bp, Artificial Sequence
  chemically synthesized
tagatttttcaatttgttggca

SEQ ID NO: 1034868 - DNA, 22 bp, Artificial Sequence
  chemically synthesized
cctctagatttttcaatttgtt

SEQ ID NO: 1034869 - DNA, 22 bp, Artificial Sequence
  chemically synthesized
tatgccaacaaattgaaaaatc

SEQ ID NO: 1034870 - DNA, 22 bp, Artificial Sequence
  chemically synthesized
tccattacctctagatttttca

SEQ ID NO: 1034871 - DNA, 22 bp, Artificial Sequence
  chemically synthesized
atccattacctctagatttttc

SEQ ID NO: 1034872 - DNA, 22 bp, Artificial Sequence
  chemically synthesized
ggaatttatccattacctctag

SEQ ID NO: 1034873 - DNA, 22 bp, Artificial Sequence
  chemically synthesized
aaaaatctagaggtaatggata

SEQ ID NO: 1034874 - DNA, 22 bp, Artificial Sequence
  chemically synthesized
tatgtgtctaggaatttatcca

SEQ ID NO: 1034875 - DNA, 22 bp, Artificial Sequence
  chemically synthesized
gaggtaatggataaattcctag

SEQ ID NO: 1034876 - DNA, 22 bp, Artificial Sequence
  chemically synthesized
gtaggttgtatgtgtctaggaa

SEQ ID NO: 1034877 - DNA, 22 bp, Artificial Sequence
  chemically synthesized
ggtaggttgtatgtgtctagga

SEQ ID NO: 1034878 - DNA, 22 bp, Artificial Sequence
  chemically synthesized
atcttggtaggttgtatgtgtc

SEQ ID NO: 1034879 - DNA, 22 bp, Artificial Sequence
  chemically synthesized
aatcttggtaggttgtatgtgt

SEQ ID NO: 1034880 - DNA, 22 bp, Artificial Sequence
  chemically synthesized
tggtttaatcttggtaggttgt

SEQ ID NO: 1034881 - DNA, 22 bp, Artificial Sequence
  chemically synthesized
atggtttaatcttggtaggttg

SEQ ID NO: 1034882 - DNA, 22 bp, Artificial Sequence
  chemically synthesized
ctagacacatacaacctaccaa

SEQ ID NO: 1034883 - DNA, 22 bp, Artificial Sequence
  chemically synthesized
tatggtttaatcttggtaggtt

SEQ ID NO: 1034884 - DNA, 22 bp, Artificial Sequence
  chemically synthesized
tttatggtttaatcttggtagg

SEQ ID NO: 1034885 - DNA, 22 bp, Artificial Sequence
  chemically synthesized
gacacatacaacctaccaagat

SEQ ID NO: 1034886 - DNA, 22 bp, Artificial Sequence
  chemically synthesized
ctttatggtttaatcttggtag

SEQ ID NO: 1034887 - DNA, 22 bp, Artificial Sequence
  chemically synthesized
gatttctttatggtttaatctt

SEQ ID NO: 1034888 - DNA, 22 bp, Artificial Sequence
  chemically synthesized
ggatttctttatggtttaatct

SEQ ID NO: 1034889 - DNA, 22 bp, Artificial Sequence
  chemically synthesized
tggatttctttatggtttaatc

SEQ ID NO: 1034890 - DNA, 22 bp, Artificial Sequence
  chemically synthesized
aggttttggatttctttatggt

SEQ ID NO: 1034891 - DNA, 22 bp, Artificial Sequence
  chemically synthesized
ccaagattaaaccataaagaaa

SEQ ID NO: 1034892 - DNA, 22 bp, Artificial Sequence
  chemically synthesized
gtccgttcaggttttggatttc

SEQ ID NO: 1034893 - DNA, 22 bp, Artificial Sequence
  chemically synthesized
aaccataaagaaatccaaaacc

SEQ ID NO: 1034894 - DNA, 22 bp, Artificial Sequence
  chemically synthesized
ctggtccgttcaggttttggat

SEQ ID NO: 1034895 - DNA, 22 bp, Artificial Sequence
  chemically synthesized
gttactggtccgttcaggtttt

SEQ ID NO: 1034896 - DNA, 22 bp, Artificial Sequence
  chemically synthesized
ctcgttactggtccgttcaggt

SEQ ID NO: 1034897 - DNA, 22 bp, Artificial Sequence
  chemically synthesized
tgttactcgttactggtccgtt

SEQ ID NO: 1034898 - DNA, 22 bp, Artificial Sequence
  chemically synthesized
agttgtgttactcgttactggt

SEQ ID NO: 1034899 - DNA, 22 bp, Artificial Sequence
  chemically synthesized
cagttgtgttactcgttactgg

SEQ ID NO: 1034900 - DNA, 22 bp, Artificial Sequence
  chemically synthesized
aacggaccagtaacgagtaaca

SEQ ID NO: 1034901 - DNA, 22 bp, Artificial Sequence
  chemically synthesized
aggcttcagttgtgttactcgt

SEQ ID NO: 1034902 - DNA, 22 bp, Artificial Sequence
  chemically synthesized
ctaaggcttcagttgtgttact

SEQ ID NO: 1034903 - DNA, 22 bp, Artificial Sequence
  chemically synthesized
actaaggcttcagttgtgttac

SEQ ID NO: 1034904 - DNA, 22 bp, Artificial Sequence
  chemically synthesized
ggagagtttactaaggcttcag

SEQ ID NO: 1034905 - DNA, 22 bp, Artificial Sequence
  chemically synthesized
ctgggagagtttactaaggctt

SEQ ID NO: 1034906 - DNA, 22 bp, Artificial Sequence
  chemically synthesized
actgggagagtttactaaggct

SEQ ID NO: 1034907 - DNA, 22 bp, Artificial Sequence
  chemically synthesized
tactgggagagtttactaaggc

SEQ ID NO: 1034908 - DNA, 22 bp, Artificial Sequence
  chemically synthesized
tttactgggagagtttactaag

SEQ ID NO: 1034909 - DNA, 22 bp, Artificial Sequence
  chemically synthesized
ctttactgggagagtttactaa

SEQ ID NO: 1034910 - DNA, 22 bp, Artificial Sequence
  chemically synthesized
tctttactgggagagtttacta

SEQ ID NO: 1034911 - DNA, 22 bp, Artificial Sequence
  chemically synthesized
ttctttactgggagagtttact

SEQ ID NO: 1034912 - DNA, 22 bp, Artificial Sequence
  chemically synthesized
aagccttagtaaactctcccag

SEQ ID NO: 1034913 - DNA, 22 bp, Artificial Sequence
  chemically synthesized
agtaaactctcccagtaaagaa

SEQ ID NO: 1034914 - DNA, 22 bp, Artificial Sequence
  chemically synthesized
gtaaactctcccagtaaagaaa

SEQ ID NO: 1034915 - DNA, 22 bp, Artificial Sequence
  chemically synthesized
tcccagtaaagaaaagcttggg

SEQ ID NO: 1034916 - DNA, 22 bp, Artificial Sequence
  chemically synthesized
ccagtaaagaaaagcttgggac

SEQ ID NO: 1034917 - DNA, 22 bp, Artificial Sequence
  chemically synthesized
agcagtgcagccatcgggtccc

SEQ ID NO: 1034918 - DNA, 22 bp, Artificial Sequence
  chemically synthesized
gggacccgatggctgcactgct

SEQ ID NO: 1034919 - DNA, 22 bp, Artificial Sequence
  chemically synthesized
ggacccgatggctgcactgctg

SEQ ID NO: 1034920 - DNA, 22 bp, Artificial Sequence
  chemically synthesized
tcacatggtagagttcagcagt

SEQ ID NO: 1034921 - DNA, 22 bp, Artificial Sequence
  chemically synthesized
atcacatggtagagttcagcag

SEQ ID NO: 1034922 - DNA, 22 bp, Artificial Sequence
  chemically synthesized
cactgctgaactctaccatgtg

SEQ ID NO: 1034923 - DNA, 22 bp, Artificial Sequence
  chemically synthesized
catcaatatttatcacatggta

SEQ ID NO: 1034924 - DNA, 22 bp, Artificial Sequence
  chemically synthesized
gcatcaatatttatcacatggt

SEQ ID NO: 1034925 - DNA, 22 bp, Artificial Sequence
  chemically synthesized
tgcatcaatatttatcacatgg

SEQ ID NO: 1034926 - DNA, 22 bp, Artificial Sequence
  chemically synthesized
ctgaactctaccatgtgataaa

SEQ ID NO: 1034927 - DNA, 22 bp, Artificial Sequence
  chemically synthesized
aactctaccatgtgataaatat

SEQ ID NO: 1034928 - DNA, 22 bp, Artificial Sequence
  chemically synthesized
catcaattttgcatcaatattt

SEQ ID NO: 1034929 - DNA, 22 bp, Artificial Sequence
  chemically synthesized
taccatgtgataaatattgatg

SEQ ID NO: 1034930 - DNA, 22 bp, Artificial Sequence
  chemically synthesized
gcatcaattttgcatcaatatt

SEQ ID NO: 1034931 - DNA, 22 bp, Artificial Sequence
  chemically synthesized
tgcatcaattttgcatcaatat

SEQ ID NO: 1034932 - DNA, 22 bp, Artificial Sequence
  chemically synthesized
ccatgtgataaatattgatgca

SEQ ID NO: 1034933 - DNA, 22 bp, Artificial Sequence
  chemically synthesized
ttgcatcaattttgcatcaata

SEQ ID NO: 1034934 - DNA, 22 bp, Artificial Sequence
  chemically synthesized
tttgcatcaattttgcatcaat

SEQ ID NO: 1034935 - DNA, 22 bp, Artificial Sequence
  chemically synthesized
catcaatattttttgcatcaat

SEQ ID NO: 1034936 - DNA, 22 bp, Artificial Sequence
  chemically synthesized
gcatcaatattttttgcatcaa

SEQ ID NO: 1034937 - DNA, 22 bp, Artificial Sequence
  chemically synthesized
tgcatcaatattttttgcatca

SEQ ID NO: 1034938 - DNA, 22 bp, Artificial Sequence
  chemically synthesized
atgcaaaattgatgcaaaaaat

SEQ ID NO: 1034939 - DNA, 22 bp, Artificial Sequence
  chemically synthesized
catcaattttgcatcaatattt

SEQ ID NO: 1034940 - DNA, 22 bp, Artificial Sequence
  chemically synthesized
tgcatcaattttgcatcaatat

SEQ ID NO: 1034941 - DNA, 22 bp, Artificial Sequence
  chemically synthesized
atgcaaaaaatattgatgcaaa

SEQ ID NO: 1034942 - DNA, 22 bp, Artificial Sequence
  chemically synthesized
actctgcatcaattttgcatca

SEQ ID NO: 1034943 - DNA, 22 bp, Artificial Sequence
  chemically synthesized
ttcactctgcatcaattttgca

SEQ ID NO: 1034944 - DNA, 22 bp, Artificial Sequence
  chemically synthesized
cctgttcactctgcatcaattt

SEQ ID NO: 1034945 - DNA, 22 bp, Artificial Sequence
  chemically synthesized
atgcaaaattgatgcagagtga

SEQ ID NO: 1034946 - DNA, 22 bp, Artificial Sequence
  chemically synthesized
taggttgcctgttcactctgca

SEQ ID NO: 1034947 - DNA, 22 bp, Artificial Sequence
  chemically synthesized
gtaggttgcctgttcactctgc

SEQ ID NO: 1034948 - DNA, 22 bp, Artificial Sequence
  chemically synthesized
tgtaggttgcctgttcactctg

SEQ ID NO: 1034949 - DNA, 22 bp, Artificial Sequence
  chemically synthesized
ccattttgtaggttgcctgttc

SEQ ID NO: 1034950 - DNA, 22 bp, Artificial Sequence
  chemically synthesized
tcccattttgtaggttgcctgt

SEQ ID NO: 1034951 - DNA, 22 bp, Artificial Sequence
  chemically synthesized
atgcagagtgaacaggcaacct

SEQ ID NO: 1034952 - DNA, 22 bp, Artificial Sequence
  chemically synthesized
ctcccattttgtaggttgcctg

SEQ ID NO: 1034953 - DNA, 22 bp, Artificial Sequence
  chemically synthesized
tctcccattttgtaggttgcct

SEQ ID NO: 1034954 - DNA, 22 bp, Artificial Sequence
  chemically synthesized
cgaaaattttctcccattttgt

SEQ ID NO: 1034955 - DNA, 22 bp, Artificial Sequence
  chemically synthesized
caaaatgggagaaaattttcgc

SEQ ID NO: 1034956 - DNA, 22 bp, Artificial Sequence
  chemically synthesized
tcagatgagtaggttgcgaaaa

SEQ ID NO: 1034957 - DNA, 22 bp, Artificial Sequence
  chemically synthesized
gtcagatgagtaggttgcgaaa

SEQ ID NO: 1034958 - DNA, 22 bp, Artificial Sequence
  chemically synthesized
tgtcagatgagtaggttgcgaa

SEQ ID NO: 1034959 - DNA, 22 bp, Artificial Sequence
  chemically synthesized
gccctttgtcagatgagtaggt

SEQ ID NO: 1034960 - DNA, 22 bp, Artificial Sequence
  chemically synthesized
tcgcaacctactcatctgacaa

SEQ ID NO: 1034961 - DNA, 22 bp, Artificial Sequence
  chemically synthesized
gatattagccctttgtcagatg

SEQ ID NO: 1034962 - DNA, 22 bp, Artificial Sequence
  chemically synthesized
cgcaacctactcatctgacaaa

SEQ ID NO: 1034963 - DNA, 22 bp, Artificial Sequence
  chemically synthesized
gcaacctactcatctgacaaag

SEQ ID NO: 1034964 - DNA, 22 bp, Artificial Sequence
  chemically synthesized
tggatattagccctttgtcaga

SEQ ID NO: 1034965 - DNA, 22 bp, Artificial Sequence
  chemically synthesized
tagattctggatattagccctt

SEQ ID NO: 1034966 - DNA, 22 bp, Artificial Sequence
  chemically synthesized
ctcatctgacaaagggctaata

SEQ ID NO: 1034967 - DNA, 22 bp, Artificial Sequence
  chemically synthesized
atctgacaaagggctaatatcc

SEQ ID NO: 1034968 - DNA, 22 bp, Artificial Sequence
  chemically synthesized
attgtagattctggatattagc

SEQ ID NO: 1034969 - DNA, 22 bp, Artificial Sequence
  chemically synthesized
acaaagggctaatatccagaat

SEQ ID NO: 1034970 - DNA, 22 bp, Artificial Sequence
  chemically synthesized
agttcattgtagattctggata

SEQ ID NO: 1034971 - DNA, 22 bp, Artificial Sequence
  chemically synthesized
gagttcattgtagattctggat

SEQ ID NO: 1034972 - DNA, 22 bp, Artificial Sequence
  chemically synthesized
tttgagttcattgtagattctg

SEQ ID NO: 1034973 - DNA, 22 bp, Artificial Sequence
  chemically synthesized
gtttgagttcattgtagattct

SEQ ID NO: 1034974 - DNA, 22 bp, Artificial Sequence
  chemically synthesized
atatccagaatctacaatgaac

SEQ ID NO: 1034975 - DNA, 22 bp, Artificial Sequence
  chemically synthesized
tacgtttgtttgagttcattgt

SEQ ID NO: 1034976 - DNA, 22 bp, Artificial Sequence
  chemically synthesized
gtacgtttgtttgagttcattg

SEQ ID NO: 1034977 - DNA, 22 bp, Artificial Sequence
  chemically synthesized
ttgtacgtttgtttgagttcat

SEQ ID NO: 1034978 - DNA, 22 bp, Artificial Sequence
  chemically synthesized
cttgtacgtttgtttgagttca

SEQ ID NO: 1034979 - DNA, 22 bp, Artificial Sequence
  chemically synthesized
tcttgtacgtttgtttgagttc

SEQ ID NO: 1034980 - DNA, 22 bp, Artificial Sequence
  chemically synthesized
ttcttgtacgtttgtttgagtt

SEQ ID NO: 1034981 - DNA, 22 bp, Artificial Sequence
  chemically synthesized
tttcttgtacgtttgtttgagt

SEQ ID NO: 1034982 - DNA, 22 bp, Artificial Sequence
  chemically synthesized
ttttcttgtacgtttgtttgag

SEQ ID NO: 1034983 - DNA, 22 bp, Artificial Sequence
  chemically synthesized
tttttttcttgtacgtttgttt

SEQ ID NO: 1034984 - DNA, 22 bp, Artificial Sequence
  chemically synthesized
gtttttttcttgtacgtttgtt

SEQ ID NO: 1034985 - DNA, 22 bp, Artificial Sequence
  chemically synthesized
caatgaactcaaacaaacgtac

SEQ ID NO: 1034986 - DNA, 22 bp, Artificial Sequence
  chemically synthesized
tttgtttttttcttgtacgttt

SEQ ID NO: 1034987 - DNA, 22 bp, Artificial Sequence
  chemically synthesized
aaacaaacgtacaagaaaaaaa

SEQ ID NO: 1034988 - DNA, 22 bp, Artificial Sequence
  chemically synthesized
atggggttgtttgtttttttct

SEQ ID NO: 1034989 - DNA, 22 bp, Artificial Sequence
  chemically synthesized
gatggggttgtttgtttttttc

SEQ ID NO: 1034990 - DNA, 22 bp, Artificial Sequence
  chemically synthesized
tgatggggttgtttgttttttt

SEQ ID NO: 1034991 - DNA, 22 bp, Artificial Sequence
  chemically synthesized
ttgatggggttgtttgtttttt

SEQ ID NO: 1034992 - DNA, 22 bp, Artificial Sequence
  chemically synthesized
tttgatggggttgtttgttttt

SEQ ID NO: 1034993 - DNA, 22 bp, Artificial Sequence
  chemically synthesized
acccactttttgatggggttgt

SEQ ID NO: 1034994 - DNA, 22 bp, Artificial Sequence
  chemically synthesized
cacccactttttgatggggttg

SEQ ID NO: 1034995 - DNA, 22 bp, Artificial Sequence
  chemically synthesized
atgtccttcacccactttttga

SEQ ID NO: 1034996 - DNA, 22 bp, Artificial Sequence
  chemically synthesized
ttcatgtccttcacccactttt

SEQ ID NO: 1034997 - DNA, 22 bp, Artificial Sequence
  chemically synthesized
agaagtgtctgttcatgtcctt

SEQ ID NO: 1034998 - DNA, 22 bp, Artificial Sequence
  chemically synthesized
gagaagtgtctgttcatgtcct

SEQ ID NO: 1034999 - DNA, 22 bp, Artificial Sequence
  chemically synthesized
tgagaagtgtctgttcatgtcc

SEQ ID NO: 1035000 - DNA, 22 bp, Artificial Sequence
  chemically synthesized
ttgagaagtgtctgttcatgtc

SEQ ID NO: 1035001 - DNA, 22 bp, Artificial Sequence
  chemically synthesized
ttttgagaagtgtctgttcatg

SEQ ID NO: 1035002 - DNA, 22 bp, Artificial Sequence
  chemically synthesized
cttttgagaagtgtctgttcat

SEQ ID NO: 1035003 - DNA, 22 bp, Artificial Sequence
  chemically synthesized
cataaatgtcttcttttgagaa

SEQ ID NO: 1035004 - DNA, 22 bp, Artificial Sequence
  chemically synthesized
gctgcataaatgtcttcttttg

SEQ ID NO: 1035005 - DNA, 22 bp, Artificial Sequence
  chemically synthesized
ggctgcataaatgtcttctttt

SEQ ID NO: 1035006 - DNA, 22 bp, Artificial Sequence
  chemically synthesized
tggctgcataaatgtcttcttt

SEQ ID NO: 1035007 - DNA, 22 bp, Artificial Sequence
  chemically synthesized
ttggctgcataaatgtcttctt

SEQ ID NO: 1035008 - DNA, 22 bp, Artificial Sequence
  chemically synthesized
tttggctgcataaatgtcttct

SEQ ID NO: 1035009 - DNA, 22 bp, Artificial Sequence
  chemically synthesized
ctcaaaagaagacatttatgca

SEQ ID NO: 1035010 - DNA, 22 bp, Artificial Sequence
  chemically synthesized
tcaaaagaagacatttatgcag

SEQ ID NO: 1035011 - DNA, 22 bp, Artificial Sequence
  chemically synthesized
atgtgttttttggctgcataaa

SEQ ID NO: 1035012 - DNA, 22 bp, Artificial Sequence
  chemically synthesized
aaaagaagacatttatgcagcc

SEQ ID NO: 1035013 - DNA, 22 bp, Artificial Sequence
  chemically synthesized
catgtgttttttggctgcataa

SEQ ID NO: 1035014 - DNA, 22 bp, Artificial Sequence
  chemically synthesized
tcatgtgttttttggctgcata

SEQ ID NO: 1035015 - DNA, 22 bp, Artificial Sequence
  chemically synthesized
ttcatgtgttttttggctgcat

SEQ ID NO: 1035016 - DNA, 22 bp, Artificial Sequence
  chemically synthesized
tttcatgtgttttttggctgca

SEQ ID NO: 1035017 - DNA, 22 bp, Artificial Sequence
  chemically synthesized
atgcagccaaaaaacacatgaa

SEQ ID NO: 1035018 - DNA, 22 bp, Artificial Sequence
  chemically synthesized
tgcagccaaaaaacacatgaaa

SEQ ID NO: 1035019 - DNA, 22 bp, Artificial Sequence
  chemically synthesized
atggccagtgatggtgagcatt

SEQ ID NO: 1035020 - DNA, 22 bp, Artificial Sequence
  chemically synthesized
tgatggccagtgatggtgagca

SEQ ID NO: 1035021 - DNA, 22 bp, Artificial Sequence
  chemically synthesized
tctgatggccagtgatggtgag

SEQ ID NO: 1035022 - DNA, 22 bp, Artificial Sequence
  chemically synthesized
cagttctctgatggccagtgat

SEQ ID NO: 1035023 - DNA, 22 bp, Artificial Sequence
  chemically synthesized
gcagttctctgatggccagtga

SEQ ID NO: 1035024 - DNA, 22 bp, Artificial Sequence
  chemically synthesized
atttgcagttctctgatggcca

SEQ ID NO: 1035025 - DNA, 22 bp, Artificial Sequence
  chemically synthesized
gatttgcagttctctgatggcc

SEQ ID NO: 1035026 - DNA, 22 bp, Artificial Sequence
  chemically synthesized
tgatttgcagttctctgatggc

SEQ ID NO: 1035027 - DNA, 22 bp, Artificial Sequence
  chemically synthesized
accatcactggccatcagagaa

SEQ ID NO: 1035028 - DNA, 22 bp, Artificial Sequence
  chemically synthesized
atccattttgatttgcagttct

SEQ ID NO: 1035029 - DNA, 22 bp, Artificial Sequence
  chemically synthesized
gccatcagagaactgcaaatca

SEQ ID NO: 1035030 - DNA, 22 bp, Artificial Sequence
  chemically synthesized
gtcgttaatccattttgatttg

SEQ ID NO: 1035031 - DNA, 22 bp, Artificial Sequence
  chemically synthesized
agtcgttaatccattttgattt

SEQ ID NO: 1035032 - DNA, 22 bp, Artificial Sequence
  chemically synthesized
tagtcgttaatccattttgatt

SEQ ID NO: 1035033 - DNA, 22 bp, Artificial Sequence
  chemically synthesized
gattttagtcgttaatccattt

SEQ ID NO: 1035034 - DNA, 22 bp, Artificial Sequence
  chemically synthesized
agattttagtcgttaatccatt

SEQ ID NO: 1035035 - DNA, 22 bp, Artificial Sequence
  chemically synthesized
caaatcaaaatggattaacgac

SEQ ID NO: 1035036 - DNA, 22 bp, Artificial Sequence
  chemically synthesized
aggtcttagattttagtcgtta

SEQ ID NO: 1035037 - DNA, 22 bp, Artificial Sequence
  chemically synthesized
gaggtcttagattttagtcgtt

SEQ ID NO: 1035038 - DNA, 22 bp, Artificial Sequence
  chemically synthesized
gtttgaggtcttagattttagt

SEQ ID NO: 1035039 - DNA, 22 bp, Artificial Sequence
  chemically synthesized
agtttgaggtcttagattttag

SEQ ID NO: 1035040 - DNA, 22 bp, Artificial Sequence
  chemically synthesized
ttagtttgaggtcttagatttt

SEQ ID NO: 1035041 - DNA, 22 bp, Artificial Sequence
  chemically synthesized
cttagtttgaggtcttagattt

SEQ ID NO: 1035042 - DNA, 22 bp, Artificial Sequence
  chemically synthesized
acgactaaaatctaagacctca

SEQ ID NO: 1035043 - DNA, 22 bp, Artificial Sequence
  chemically synthesized
tagtagtttcttagtttgaggt

SEQ ID NO: 1035044 - DNA, 22 bp, Artificial Sequence
  chemically synthesized
gtagtagtttcttagtttgagg

SEQ ID NO: 1035045 - DNA, 22 bp, Artificial Sequence
  chemically synthesized
aaatctaagacctcaaactaag

SEQ ID NO: 1035046 - DNA, 22 bp, Artificial Sequence
  chemically synthesized
cttgtagtagtttcttagtttg

SEQ ID NO: 1035047 - DNA, 22 bp, Artificial Sequence
  chemically synthesized
ccttgtagtagtttcttagttt

SEQ ID NO: 1035048 - DNA, 22 bp, Artificial Sequence
  chemically synthesized
agacctcaaactaagaaactac

SEQ ID NO: 1035049 - DNA, 22 bp, Artificial Sequence
  chemically synthesized
caatgtttccttgtagtagttt

SEQ ID NO: 1035050 - DNA, 22 bp, Artificial Sequence
  chemically synthesized
tccaatgtttccttgtagtagt

SEQ ID NO: 1035051 - DNA, 22 bp, Artificial Sequence
  chemically synthesized
ctccaatgtttccttgtagtag

SEQ ID NO: 1035052 - DNA, 22 bp, Artificial Sequence
  chemically synthesized
aaactaagaaactactacaagg

SEQ ID NO: 1035053 - DNA, 22 bp, Artificial Sequence
  chemically synthesized
agaaactactacaaggaaacat

SEQ ID NO: 1035054 - DNA, 22 bp, Artificial Sequence
  chemically synthesized
gagagtttctccaatgtttcct

SEQ ID NO: 1035055 - DNA, 22 bp, Artificial Sequence
  chemically synthesized
ctacaaggaaacattggagaaa

SEQ ID NO: 1035056 - DNA, 22 bp, Artificial Sequence
  chemically synthesized
caaggaaacattggagaaactc

SEQ ID NO: 1035057 - DNA, 22 bp, Artificial Sequence
  chemically synthesized
cccagacagatatcctggagag

SEQ ID NO: 1035058 - DNA, 22 bp, Artificial Sequence
  chemically synthesized
acccagacagatatcctggaga

SEQ ID NO: 1035059 - DNA, 22 bp, Artificial Sequence
  chemically synthesized
tacccagacagatatcctggag

SEQ ID NO: 1035060 - DNA, 22 bp, Artificial Sequence
  chemically synthesized
ttttacccagacagatatcctg

SEQ ID NO: 1035061 - DNA, 22 bp, Artificial Sequence
  chemically synthesized
gagaaactctccaggatatctg

SEQ ID NO: 1035062 - DNA, 22 bp, Artificial Sequence
  chemically synthesized
gttttacccagacagatatcct

SEQ ID NO: 1035063 - DNA, 22 bp, Artificial Sequence
  chemically synthesized
aagatttgttttacccagacag

SEQ ID NO: 1035064 - DNA, 22 bp, Artificial Sequence
  chemically synthesized
tccaggatatctgtctgggtaa

SEQ ID NO: 1035065 - DNA, 22 bp, Artificial Sequence
  chemically synthesized
ctcaagatttgttttacccaga

SEQ ID NO: 1035066 - DNA, 22 bp, Artificial Sequence
  chemically synthesized
caggatatctgtctgggtaaaa

SEQ ID NO: 1035067 - DNA, 22 bp, Artificial Sequence
  chemically synthesized
taggatattactcaagatttgt

SEQ ID NO: 1035068 - DNA, 22 bp, Artificial Sequence
  chemically synthesized
ataggatattactcaagatttg

SEQ ID NO: 1035069 - DNA, 22 bp, Artificial Sequence
  chemically synthesized
tctgggtaaaacaaatcttgag

SEQ ID NO: 1035070 - DNA, 22 bp, Artificial Sequence
  chemically synthesized
ggtaaaacaaatcttgagtaat

SEQ ID NO: 1035071 - DNA, 22 bp, Artificial Sequence
  chemically synthesized
tgcttataggatattactcaag

SEQ ID NO: 1035072 - DNA, 22 bp, Artificial Sequence
  chemically synthesized
cctgtgcttataggatattact

SEQ ID NO: 1035073 - DNA, 22 bp, Artificial Sequence
  chemically synthesized
ttgcctgtgcttataggatatt

SEQ ID NO: 1035074 - DNA, 22 bp, Artificial Sequence
  chemically synthesized
gttgcctgtgcttataggatat

SEQ ID NO: 1035075 - DNA, 22 bp, Artificial Sequence
  chemically synthesized
tgttgcctgtgcttataggata

SEQ ID NO: 1035076 - DNA, 22 bp, Artificial Sequence
  chemically synthesized
ttgttgcctgtgcttataggat

SEQ ID NO: 1035077 - DNA, 22 bp, Artificial Sequence
  chemically synthesized
cttttgttgcctgtgcttatag

SEQ ID NO: 1035078 - DNA, 22 bp, Artificial Sequence
  chemically synthesized
gcttttgttgcctgtgcttata

SEQ ID NO: 1035079 - DNA, 22 bp, Artificial Sequence
  chemically synthesized
gagtaatatcctataagcacag

SEQ ID NO: 1035080 - DNA, 22 bp, Artificial Sequence
  chemically synthesized
tgcttttgttgcctgtgcttat

SEQ ID NO: 1035081 - DNA, 22 bp, Artificial Sequence
  chemically synthesized
agtaatatcctataagcacagg

SEQ ID NO: 1035082 - DNA, 22 bp, Artificial Sequence
  chemically synthesized
ttgcttttgttgcctgtgctta

SEQ ID NO: 1035083 - DNA, 22 bp, Artificial Sequence
  chemically synthesized
tttttgcttttgttgcctgtgc

SEQ ID NO: 1035084 - DNA, 22 bp, Artificial Sequence
  chemically synthesized
tctatttttgcttttgttgcct

SEQ ID NO: 1035085 - DNA, 22 bp, Artificial Sequence
  chemically synthesized
gtctatttttgcttttgttgcc

SEQ ID NO: 1035086 - DNA, 22 bp, Artificial Sequence
  chemically synthesized
taagcacaggcaacaaaagcaa

SEQ ID NO: 1035087 - DNA, 22 bp, Artificial Sequence
  chemically synthesized
atgtgatccatttgtctatttt

SEQ ID NO: 1035088 - DNA, 22 bp, Artificial Sequence
  chemically synthesized
gatgtgatccatttgtctattt

SEQ ID NO: 1035089 - DNA, 22 bp, Artificial Sequence
  chemically synthesized
acttgatgtgatccatttgtct

SEQ ID NO: 1035090 - DNA, 22 bp, Artificial Sequence
  chemically synthesized
aacttgatgtgatccatttgtc

SEQ ID NO: 1035091 - DNA, 22 bp, Artificial Sequence
  chemically synthesized
taacttgatgtgatccatttgt

SEQ ID NO: 1035092 - DNA, 22 bp, Artificial Sequence
  chemically synthesized
ttaacttgatgtgatccatttg

SEQ ID NO: 1035093 - DNA, 22 bp, Artificial Sequence
  chemically synthesized
tttaacttgatgtgatccattt

SEQ ID NO: 1035094 - DNA, 22 bp, Artificial Sequence
  chemically synthesized
cggaggagctttttaacttgat

SEQ ID NO: 1035095 - DNA, 22 bp, Artificial Sequence
  chemically synthesized
actgcggaggagctttttaact

SEQ ID NO: 1035096 - DNA, 22 bp, Artificial Sequence
  chemically synthesized
cactgcggaggagctttttaac

SEQ ID NO: 1035097 - DNA, 22 bp, Artificial Sequence
  chemically synthesized
tttcactgcggaggagcttttt

SEQ ID NO: 1035098 - DNA, 22 bp, Artificial Sequence
  chemically synthesized
attgtttcactgcggaggagct

SEQ ID NO: 1035099 - DNA, 22 bp, Artificial Sequence
  chemically synthesized
ttgattgtttcactgcggagga

SEQ ID NO: 1035100 - DNA, 22 bp, Artificial Sequence
  chemically synthesized
attgattgtttcactgcggagg

SEQ ID NO: 1035101 - DNA, 22 bp, Artificial Sequence
  chemically synthesized
tattgattgtttcactgcggag

SEQ ID NO: 1035102 - DNA, 22 bp, Artificial Sequence
  chemically synthesized
aaaagctcctccgcagtgaaac

SEQ ID NO: 1035103 - DNA, 22 bp, Artificial Sequence
  chemically synthesized
actttattgattgtttcactgc

SEQ ID NO: 1035104 - DNA, 22 bp, Artificial Sequence
  chemically synthesized
cactttattgattgtttcactg

SEQ ID NO: 1035105 - DNA, 22 bp, Artificial Sequence
  chemically synthesized
ttcactttattgattgtttcac

SEQ ID NO: 1035106 - DNA, 22 bp, Artificial Sequence
  chemically synthesized
tctcttcactttattgattgtt

SEQ ID NO: 1035107 - DNA, 22 bp, Artificial Sequence
  chemically synthesized
ctccgcagtgaaacaatcaata

SEQ ID NO: 1035108 - DNA, 22 bp, Artificial Sequence
  chemically synthesized
cgcagtgaaacaatcaataaag

SEQ ID NO: 1035109 - DNA, 22 bp, Artificial Sequence
  chemically synthesized
gttgtctcttcactttattgat

SEQ ID NO: 1035110 - DNA, 22 bp, Artificial Sequence
  chemically synthesized
ttggttgtctcttcactttatt

SEQ ID NO: 1035111 - DNA, 22 bp, Artificial Sequence
  chemically synthesized
tgttggttgtctcttcacttta

SEQ ID NO: 1035112 - DNA, 22 bp, Artificial Sequence
  chemically synthesized
ctgttggttgtctcttcacttt

SEQ ID NO: 1035113 - DNA, 22 bp, Artificial Sequence
  chemically synthesized
tctgttggttgtctcttcactt

SEQ ID NO: 1035114 - DNA, 22 bp, Artificial Sequence
  chemically synthesized
cctttctgttggttgtctcttc

SEQ ID NO: 1035115 - DNA, 22 bp, Artificial Sequence
  chemically synthesized
tccctttctgttggttgtctct

SEQ ID NO: 1035116 - DNA, 22 bp, Artificial Sequence
  chemically synthesized
ctccctttctgttggttgtctc

SEQ ID NO: 1035117 - DNA, 22 bp, Artificial Sequence
  chemically synthesized
tctccctttctgttggttgtct

SEQ ID NO: 1035118 - DNA, 22 bp, Artificial Sequence
  chemically synthesized
caaatattttctccctttctgt

SEQ ID NO: 1035119 - DNA, 22 bp, Artificial Sequence
  chemically synthesized
gcaaatattttctccctttctg

SEQ ID NO: 1035120 - DNA, 22 bp, Artificial Sequence
  chemically synthesized
tgagatgggtaatttgcaaata

SEQ ID NO: 1035121 - DNA, 22 bp, Artificial Sequence
  chemically synthesized
gtgagatgggtaatttgcaaat

SEQ ID NO: 1035122 - DNA, 22 bp, Artificial Sequence
  chemically synthesized
atcccttgtgagatgggtaatt

SEQ ID NO: 1035123 - DNA, 22 bp, Artificial Sequence
  chemically synthesized
ttaatcccttgtgagatgggta

SEQ ID NO: 1035124 - DNA, 22 bp, Artificial Sequence
  chemically synthesized
gttattaatcccttgtgagatg

SEQ ID NO: 1035125 - DNA, 22 bp, Artificial Sequence
  chemically synthesized
gcaaattacccatctcacaagg

SEQ ID NO: 1035126 - DNA, 22 bp, Artificial Sequence
  chemically synthesized
tggttattaatcccttgtgaga

SEQ ID NO: 1035127 - DNA, 22 bp, Artificial Sequence
  chemically synthesized
caaattacccatctcacaaggg

SEQ ID NO: 1035128 - DNA, 22 bp, Artificial Sequence
  chemically synthesized
tatattctggttattaatccct

SEQ ID NO: 1035129 - DNA, 22 bp, Artificial Sequence
  chemically synthesized
cccatctcacaagggattaata

SEQ ID NO: 1035130 - DNA, 22 bp, Artificial Sequence
  chemically synthesized
atatattctggttattaatccc

SEQ ID NO: 1035131 - DNA, 22 bp, Artificial Sequence
  chemically synthesized
cttatatattctggttattaat

SEQ ID NO: 1035132 - DNA, 22 bp, Artificial Sequence
  chemically synthesized
actccttatatattctggttat

SEQ ID NO: 1035133 - DNA, 22 bp, Artificial Sequence
  chemically synthesized
acaagggattaataaccagaat

SEQ ID NO: 1035134 - DNA, 22 bp, Artificial Sequence
  chemically synthesized
aactccttatatattctggtta

SEQ ID NO: 1035135 - DNA, 22 bp, Artificial Sequence
  chemically synthesized
taactccttatatattctggtt

SEQ ID NO: 1035136 - DNA, 22 bp, Artificial Sequence
  chemically synthesized
ttttaactccttatatattctg

SEQ ID NO: 1035137 - DNA, 22 bp, Artificial Sequence
  chemically synthesized
ataaccagaatatataaggagt

SEQ ID NO: 1035138 - DNA, 22 bp, Artificial Sequence
  chemically synthesized
tagagttgttttaactccttat

SEQ ID NO: 1035139 - DNA, 22 bp, Artificial Sequence
  chemically synthesized
ctatagagttgttttaactcct

SEQ ID NO: 1035140 - DNA, 22 bp, Artificial Sequence
  chemically synthesized
cctatagagttgttttaactcc

SEQ ID NO: 1035141 - DNA, 22 bp, Artificial Sequence
  chemically synthesized
tcctatagagttgttttaactc

SEQ ID NO: 1035142 - DNA, 22 bp, Artificial Sequence
  chemically synthesized
ttcctatagagttgttttaact

SEQ ID NO: 1035143 - DNA, 22 bp, Artificial Sequence
  chemically synthesized
tttcctatagagttgttttaac

SEQ ID NO: 1035144 - DNA, 22 bp, Artificial Sequence
  chemically synthesized
gactttttcctatagagttgtt

SEQ ID NO: 1035145 - DNA, 22 bp, Artificial Sequence
  chemically synthesized
ttagactttttcctatagagtt

SEQ ID NO: 1035146 - DNA, 22 bp, Artificial Sequence
  chemically synthesized
attattagactttttcctatag

SEQ ID NO: 1035147 - DNA, 22 bp, Artificial Sequence
  chemically synthesized
aaacaactctataggaaaaagt

SEQ ID NO: 1035148 - DNA, 22 bp, Artificial Sequence
  chemically synthesized
atctaattattagactttttcc

SEQ ID NO: 1035149 - DNA, 22 bp, Artificial Sequence
  chemically synthesized
tgatctaattattagacttttt

SEQ ID NO: 1035150 - DNA, 22 bp, Artificial Sequence
  chemically synthesized
ctgatctaattattagactttt

SEQ ID NO: 1035151 - DNA, 22 bp, Artificial Sequence
  chemically synthesized
tctgatctaattattagacttt

SEQ ID NO: 1035152 - DNA, 22 bp, Artificial Sequence
  chemically synthesized
ttttctgatctaattattagac

SEQ ID NO: 1035153 - DNA, 22 bp, Artificial Sequence
  chemically synthesized
tataggaaaaagtctaataatt

SEQ ID NO: 1035154 - DNA, 22 bp, Artificial Sequence
  chemically synthesized
taggaaaaagtctaataattag

SEQ ID NO: 1035155 - DNA, 22 bp, Artificial Sequence
  chemically synthesized
tctattttctgatctaattatt

SEQ ID NO: 1035156 - DNA, 22 bp, Artificial Sequence
  chemically synthesized
gtctattttctgatctaattat

SEQ ID NO: 1035157 - DNA, 22 bp, Artificial Sequence
  chemically synthesized
tgtctattttctgatctaatta

SEQ ID NO: 1035158 - DNA, 22 bp, Artificial Sequence
  chemically synthesized
ttgtctattttctgatctaatt

SEQ ID NO: 1035159 - DNA, 22 bp, Artificial Sequence
  chemically synthesized
gaatcttttgtctattttctga

SEQ ID NO: 1035160 - DNA, 22 bp, Artificial Sequence
  chemically synthesized
ataattagatcagaaaatagac

SEQ ID NO: 1035161 - DNA, 22 bp, Artificial Sequence
  chemically synthesized
ttcgaatcttttgtctattttc

SEQ ID NO: 1035162 - DNA, 22 bp, Artificial Sequence
  chemically synthesized
gatcagaaaatagacaaaagat

SEQ ID NO: 1035163 - DNA, 22 bp, Artificial Sequence
  chemically synthesized
agaaatgcctattcgaatcttt

SEQ ID NO: 1035164 - DNA, 22 bp, Artificial Sequence
  chemically synthesized
gagaaatgcctattcgaatctt

SEQ ID NO: 1035165 - DNA, 22 bp, Artificial Sequence
  chemically synthesized
tgagaaatgcctattcgaatct

SEQ ID NO: 1035166 - DNA, 22 bp, Artificial Sequence
  chemically synthesized
ttgagaaatgcctattcgaatc

SEQ ID NO: 1035167 - DNA, 22 bp, Artificial Sequence
  chemically synthesized
ttttgagaaatgcctattcgaa

SEQ ID NO: 1035168 - DNA, 22 bp, Artificial Sequence
  chemically synthesized
cttttgagaaatgcctattcga

SEQ ID NO: 1035169 - DNA, 22 bp, Artificial Sequence
  chemically synthesized
tatgtcttcttttgagaaatgc

SEQ ID NO: 1035170 - DNA, 22 bp, Artificial Sequence
  chemically synthesized
gtatgtcttcttttgagaaatg

SEQ ID NO: 1035171 - DNA, 22 bp, Artificial Sequence
  chemically synthesized
gaataggcatttctcaaaagaa

SEQ ID NO: 1035172 - DNA, 22 bp, Artificial Sequence
  chemically synthesized
ccatttgtatgtcttcttttga

SEQ ID NO: 1035173 - DNA, 22 bp, Artificial Sequence
  chemically synthesized
gccatttgtatgtcttcttttg

SEQ ID NO: 1035174 - DNA, 22 bp, Artificial Sequence
  chemically synthesized
tttgccatttgtatgtcttctt

SEQ ID NO: 1035175 - DNA, 22 bp, Artificial Sequence
  chemically synthesized
ctcaaaagaagacatacaaatg

SEQ ID NO: 1035176 - DNA, 22 bp, Artificial Sequence
  chemically synthesized
tcaaaagaagacatacaaatgg

SEQ ID NO: 1035177 - DNA, 22 bp, Artificial Sequence
  chemically synthesized
atacacctgtttgccatttgta

SEQ ID NO: 1035178 - DNA, 22 bp, Artificial Sequence
  chemically synthesized
aaaagaagacatacaaatggca

SEQ ID NO: 1035179 - DNA, 22 bp, Artificial Sequence
  chemically synthesized
gatacacctgtttgccatttgt

SEQ ID NO: 1035180 - DNA, 22 bp, Artificial Sequence
  chemically synthesized
tgatacacctgtttgccatttg

SEQ ID NO: 1035181 - DNA, 22 bp, Artificial Sequence
  chemically synthesized
agcatattttgatacacctgtt

SEQ ID NO: 1035182 - DNA, 22 bp, Artificial Sequence
  chemically synthesized
gtgatgctgagcatattttgat

SEQ ID NO: 1035183 - DNA, 22 bp, Artificial Sequence
  chemically synthesized
tgatgattagtgatgctgagca

SEQ ID NO: 1035184 - DNA, 22 bp, Artificial Sequence
  chemically synthesized
tgtgatgattagtgatgctgag

SEQ ID NO: 1035185 - DNA, 22 bp, Artificial Sequence
  chemically synthesized
ctgtgatgattagtgatgctga

SEQ ID NO: 1035186 - DNA, 22 bp, Artificial Sequence
  chemically synthesized
tatttctgtgatgattagtgat

SEQ ID NO: 1035187 - DNA, 22 bp, Artificial Sequence
  chemically synthesized
gtatttctgtgatgattagtga

SEQ ID NO: 1035188 - DNA, 22 bp, Artificial Sequence
  chemically synthesized
tgtatttctgtgatgattagtg

SEQ ID NO: 1035189 - DNA, 22 bp, Artificial Sequence
  chemically synthesized
ctttgtatttctgtgatgatta

SEQ ID NO: 1035190 - DNA, 22 bp, Artificial Sequence
  chemically synthesized
gctttgtatttctgtgatgatt

SEQ ID NO: 1035191 - DNA, 22 bp, Artificial Sequence
  chemically synthesized
tgctttgtatttctgtgatgat

SEQ ID NO: 1035192 - DNA, 22 bp, Artificial Sequence
  chemically synthesized
agcatcactaatcatcacagaa

SEQ ID NO: 1035193 - DNA, 22 bp, Artificial Sequence
  chemically synthesized
tagttttgctttgtatttctgt

SEQ ID NO: 1035194 - DNA, 22 bp, Artificial Sequence
  chemically synthesized
atcatcacagaaatacaaagca

SEQ ID NO: 1035195 - DNA, 22 bp, Artificial Sequence
  chemically synthesized
gggtgagagaatatcccattgt

SEQ ID NO: 1035196 - DNA, 22 bp, Artificial Sequence
  chemically synthesized
attggggtgagagaatatccca

SEQ ID NO: 1035197 - DNA, 22 bp, Artificial Sequence
  chemically synthesized
aattggggtgagagaatatccc

SEQ ID NO: 1035198 - DNA, 22 bp, Artificial Sequence
  chemically synthesized
taattggggtgagagaatatcc

SEQ ID NO: 1035199 - DNA, 22 bp, Artificial Sequence
  chemically synthesized
caatgggatattctctcacccc

SEQ ID NO: 1035200 - DNA, 22 bp, Artificial Sequence
  chemically synthesized
gatatgtcgttttaattggggt

SEQ ID NO: 1035201 - DNA, 22 bp, Artificial Sequence
  chemically synthesized
ggatatgtcgttttaattgggg

SEQ ID NO: 1035202 - DNA, 22 bp, Artificial Sequence
  chemically synthesized
tggatatgtcgttttaattggg

SEQ ID NO: 1035203 - DNA, 22 bp, Artificial Sequence
  chemically synthesized
ttggatatgtcgttttaattgg

SEQ ID NO: 1035204 - DNA, 22 bp, Artificial Sequence
  chemically synthesized
tcttttggatatgtcgttttaa

SEQ ID NO: 1035205 - DNA, 22 bp, Artificial Sequence
  chemically synthesized
tctcaccccaattaaaacgaca

SEQ ID NO: 1035206 - DNA, 22 bp, Artificial Sequence
  chemically synthesized
tcaccccaattaaaacgacata

SEQ ID NO: 1035207 - DNA, 22 bp, Artificial Sequence
  chemically synthesized
cctgtcttttggatatgtcgtt

SEQ ID NO: 1035208 - DNA, 22 bp, Artificial Sequence
  chemically synthesized
accccaattaaaacgacatatc

SEQ ID NO: 1035209 - DNA, 22 bp, Artificial Sequence
  chemically synthesized
taattgcctgtcttttggatat

SEQ ID NO: 1035210 - DNA, 22 bp, Artificial Sequence
  chemically synthesized
gtaattgcctgtcttttggata

SEQ ID NO: 1035211 - DNA, 22 bp, Artificial Sequence
  chemically synthesized
aaacgacatatccaaaagacag

SEQ ID NO: 1035212 - DNA, 22 bp, Artificial Sequence
  chemically synthesized
cagcatttgtaattgcctgtct

SEQ ID NO: 1035213 - DNA, 22 bp, Artificial Sequence
  chemically synthesized
tccagcatttgtaattgcctgt

SEQ ID NO: 1035214 - DNA, 22 bp, Artificial Sequence
  chemically synthesized
tctccagcatttgtaattgcct

SEQ ID NO: 1035215 - DNA, 22 bp, Artificial Sequence
  chemically synthesized
acactctctccagcatttgtaa

SEQ ID NO: 1035216 - DNA, 22 bp, Artificial Sequence
  chemically synthesized
cacactctctccagcatttgta

SEQ ID NO: 1035217 - DNA, 22 bp, Artificial Sequence
  chemically synthesized
ttcacactctctccagcatttg

SEQ ID NO: 1035218 - DNA, 22 bp, Artificial Sequence
  chemically synthesized
cttcacactctctccagcattt

SEQ ID NO: 1035219 - DNA, 22 bp, Artificial Sequence
  chemically synthesized
tcttcacactctctccagcatt

SEQ ID NO: 1035220 - DNA, 22 bp, Artificial Sequence
  chemically synthesized
ttcttcacactctctccagcat

SEQ ID NO: 1035221 - DNA, 22 bp, Artificial Sequence
  chemically synthesized
caaatgctggagagagtgtgaa

SEQ ID NO: 1035222 - DNA, 22 bp, Artificial Sequence
  chemically synthesized
gagagagtgtgaagaaaagggg

SEQ ID NO: 1035223 - DNA, 22 bp, Artificial Sequence
  chemically synthesized
ccaacagtgtacaggagtcccc

SEQ ID NO: 1035224 - DNA, 22 bp, Artificial Sequence
  chemically synthesized
ctgccaacagtgtacaggagtc

SEQ ID NO: 1035225 - DNA, 22 bp, Artificial Sequence
  chemically synthesized
cattcctgccaacagtgtacag

SEQ ID NO: 1035226 - DNA, 22 bp, Artificial Sequence
  chemically synthesized
acattcctgccaacagtgtaca

SEQ ID NO: 1035227 - DNA, 22 bp, Artificial Sequence
  chemically synthesized
atttacattcctgccaacagtg

SEQ ID NO: 1035228 - DNA, 22 bp, Artificial Sequence
  chemically synthesized
tactaatttacattcctgccaa

SEQ ID NO: 1035229 - DNA, 22 bp, Artificial Sequence
  chemically synthesized
ctgtacactgttggcaggaatg

SEQ ID NO: 1035230 - DNA, 22 bp, Artificial Sequence
  chemically synthesized
gttgtactaatttacattcctg

SEQ ID NO: 1035231 - DNA, 22 bp, Artificial Sequence
  chemically synthesized
tacactgttggcaggaatgtaa

SEQ ID NO: 1035232 - DNA, 22 bp, Artificial Sequence
  chemically synthesized
ggttgtactaatttacattcct

SEQ ID NO: 1035233 - DNA, 22 bp, Artificial Sequence
  chemically synthesized
tggttgtactaatttacattcc

SEQ ID NO: 1035234 - DNA, 22 bp, Artificial Sequence
  chemically synthesized
cattttggttgtactaatttac

SEQ ID NO: 1035235 - DNA, 22 bp, Artificial Sequence
  chemically synthesized
ttggcaggaatgtaaattagta

SEQ ID NO: 1035236 - DNA, 22 bp, Artificial Sequence
  chemically synthesized
tccattttggttgtactaattt

SEQ ID NO: 1035237 - DNA, 22 bp, Artificial Sequence
  chemically synthesized
gcaggaatgtaaattagtacaa

SEQ ID NO: 1035238 - DNA, 22 bp, Artificial Sequence
  chemically synthesized
ttctccattttggttgtactaa

SEQ ID NO: 1035239 - DNA, 22 bp, Artificial Sequence
  chemically synthesized
caaactattctccattttggtt

SEQ ID NO: 1035240 - DNA, 22 bp, Artificial Sequence
  chemically synthesized
gtacaaccaaaatggagaatag

SEQ ID NO: 1035241 - DNA, 22 bp, Artificial Sequence
  chemically synthesized
aggaacctccaaactattctcc

SEQ ID NO: 1035242 - DNA, 22 bp, Artificial Sequence
  chemically synthesized
tgaggaacctccaaactattct

SEQ ID NO: 1035243 - DNA, 22 bp, Artificial Sequence
  chemically synthesized
ctgaggaacctccaaactattc

SEQ ID NO: 1035244 - DNA, 22 bp, Artificial Sequence
  chemically synthesized
gtttctgaggaacctccaaact

SEQ ID NO: 1035245 - DNA, 22 bp, Artificial Sequence
  chemically synthesized
agtttctgaggaacctccaaac

SEQ ID NO: 1035246 - DNA, 22 bp, Artificial Sequence
  chemically synthesized
tagtttctgaggaacctccaaa

SEQ ID NO: 1035247 - DNA, 22 bp, Artificial Sequence
  chemically synthesized
ttagtttctgaggaacctccaa

SEQ ID NO: 1035248 - DNA, 22 bp, Artificial Sequence
  chemically synthesized
tttttagtttctgaggaacctc

SEQ ID NO: 1035249 - DNA, 22 bp, Artificial Sequence
  chemically synthesized
ggaggttcctcagaaactaaaa

SEQ ID NO: 1035250 - DNA, 22 bp, Artificial Sequence
  chemically synthesized
gaggttcctcagaaactaaaaa

SEQ ID NO: 1035251 - DNA, 22 bp, Artificial Sequence
  chemically synthesized
gatcatatggtagccctgtttt

SEQ ID NO: 1035252 - DNA, 22 bp, Artificial Sequence
  chemically synthesized
ctcagaaactaaaaacagggct

SEQ ID NO: 1035253 - DNA, 22 bp, Artificial Sequence
  chemically synthesized
ctggatcatatggtagccctgt

SEQ ID NO: 1035254 - DNA, 22 bp, Artificial Sequence
  chemically synthesized
agaaactaaaaacagggctacc

SEQ ID NO: 1035255 - DNA, 22 bp, Artificial Sequence
  chemically synthesized
aaaacagggctaccatatgatc

SEQ ID NO: 1035256 - DNA, 22 bp, Artificial Sequence
  chemically synthesized
ccatatgatccagcaatcccac

SEQ ID NO: 1035257 - DNA, 22 bp, Artificial Sequence
  chemically synthesized
ggatatatacccagcagtggga

SEQ ID NO: 1035258 - DNA, 22 bp, Artificial Sequence
  chemically synthesized
gggatatatacccagcagtggg

SEQ ID NO: 1035259 - DNA, 22 bp, Artificial Sequence
  chemically synthesized
tgggatatatacccagcagtgg

SEQ ID NO: 1035260 - DNA, 22 bp, Artificial Sequence
  chemically synthesized
tttgggatatatacccagcagt

SEQ ID NO: 1035261 - DNA, 22 bp, Artificial Sequence
  chemically synthesized
ctttgggatatatacccagcag

SEQ ID NO: 1035262 - DNA, 22 bp, Artificial Sequence
  chemically synthesized
tctttgggatatatacccagca

SEQ ID NO: 1035263 - DNA, 22 bp, Artificial Sequence
  chemically synthesized
ctttctttgggatatataccca

SEQ ID NO: 1035264 - DNA, 22 bp, Artificial Sequence
  chemically synthesized
gctttctttgggatatataccc

SEQ ID NO: 1035265 - DNA, 22 bp, Artificial Sequence
  chemically synthesized
atttgctttctttgggatatat

SEQ ID NO: 1035266 - DNA, 22 bp, Artificial Sequence
  chemically synthesized
ctgggtatatatcccaaagaaa

SEQ ID NO: 1035267 - DNA, 22 bp, Artificial Sequence
  chemically synthesized
atatactgatttgctttctttg

SEQ ID NO: 1035268 - DNA, 22 bp, Artificial Sequence
  chemically synthesized
ggtatatatcccaaagaaagca

SEQ ID NO: 1035269 - DNA, 22 bp, Artificial Sequence
  chemically synthesized
gatatactgatttgctttcttt

SEQ ID NO: 1035270 - DNA, 22 bp, Artificial Sequence
  chemically synthesized
tgatatactgatttgctttctt

SEQ ID NO: 1035271 - DNA, 22 bp, Artificial Sequence
  chemically synthesized
tttgatatactgatttgctttc

SEQ ID NO: 1035272 - DNA, 22 bp, Artificial Sequence
  chemically synthesized
aacaaacgtgggagtacagata

SEQ ID NO: 1035273 - DNA, 22 bp, Artificial Sequence
  chemically synthesized
caacaaacgtgggagtacagat

SEQ ID NO: 1035274 - DNA, 22 bp, Artificial Sequence
  chemically synthesized
tgaacagtgcttcaacaaacgt

SEQ ID NO: 1035275 - DNA, 22 bp, Artificial Sequence
  chemically synthesized
ttatgaacagtgcttcaacaaa

SEQ ID NO: 1035276 - DNA, 22 bp, Artificial Sequence
  chemically synthesized
tactcccacgtttgttgaagca

SEQ ID NO: 1035277 - DNA, 22 bp, Artificial Sequence
  chemically synthesized
gctattatgaacagtgcttcaa

SEQ ID NO: 1035278 - DNA, 22 bp, Artificial Sequence
  chemically synthesized
ggctattatgaacagtgcttca

SEQ ID NO: 1035279 - DNA, 22 bp, Artificial Sequence
  chemically synthesized
ccacgtttgttgaagcactgtt

SEQ ID NO: 1035280 - DNA, 22 bp, Artificial Sequence
  chemically synthesized
caaatcttggctattatgaaca

SEQ ID NO: 1035281 - DNA, 22 bp, Artificial Sequence
  chemically synthesized
ccaaatcttggctattatgaac

SEQ ID NO: 1035282 - DNA, 22 bp, Artificial Sequence
  chemically synthesized
gttgaagcactgttcataatag

SEQ ID NO: 1035283 - DNA, 22 bp, Artificial Sequence
  chemically synthesized
ttgaagcactgttcataatagc

SEQ ID NO: 1035284 - DNA, 22 bp, Artificial Sequence
  chemically synthesized
cttccaaatcttggctattatg

SEQ ID NO: 1035285 - DNA, 22 bp, Artificial Sequence
  chemically synthesized
aagcactgttcataatagccaa

SEQ ID NO: 1035286 - DNA, 22 bp, Artificial Sequence
  chemically synthesized
aggttgcttccaaatcttggct

SEQ ID NO: 1035287 - DNA, 22 bp, Artificial Sequence
  chemically synthesized
ttcataatagccaagatttgga

SEQ ID NO: 1035288 - DNA, 22 bp, Artificial Sequence
  chemically synthesized
ataatagccaagatttggaagc

SEQ ID NO: 1035289 - DNA, 22 bp, Artificial Sequence
  chemically synthesized
atggacgctcaggttgcttcca

SEQ ID NO: 1035290 - DNA, 22 bp, Artificial Sequence
  chemically synthesized
gatggacgctcaggttgcttcc

SEQ ID NO: 1035291 - DNA, 22 bp, Artificial Sequence
  chemically synthesized
ttgatggacgctcaggttgctt

SEQ ID NO: 1035292 - DNA, 22 bp, Artificial Sequence
  chemically synthesized
atctcttgatggacgctcaggt

SEQ ID NO: 1035293 - DNA, 22 bp, Artificial Sequence
  chemically synthesized
ggaagcaacctgagcgtccatc

SEQ ID NO: 1035294 - DNA, 22 bp, Artificial Sequence
  chemically synthesized
gaagcaacctgagcgtccatca

SEQ ID NO: 1035295 - DNA, 22 bp, Artificial Sequence
  chemically synthesized
tccattcatctcttgatggacg

SEQ ID NO: 1035296 - DNA, 22 bp, Artificial Sequence
  chemically synthesized
gtccattcatctcttgatggac

SEQ ID NO: 1035297 - DNA, 22 bp, Artificial Sequence
  chemically synthesized
tgtccattcatctcttgatgga

SEQ ID NO: 1035298 - DNA, 22 bp, Artificial Sequence
  chemically synthesized
tttgtccattcatctcttgatg

SEQ ID NO: 1035299 - DNA, 22 bp, Artificial Sequence
  chemically synthesized
ctttgtccattcatctcttgat

SEQ ID NO: 1035300 - DNA, 22 bp, Artificial Sequence
  chemically synthesized
tctttgtccattcatctcttga

SEQ ID NO: 1035301 - DNA, 22 bp, Artificial Sequence
  chemically synthesized
agcgtccatcaagagatgaatg

SEQ ID NO: 1035302 - DNA, 22 bp, Artificial Sequence
  chemically synthesized
cgtatatgtatcacattttctt

SEQ ID NO: 1035303 - DNA, 22 bp, Artificial Sequence
  chemically synthesized
ttacgtatatgtatcacatttt

SEQ ID NO: 1035304 - DNA, 22 bp, Artificial Sequence
  chemically synthesized
tattacgtatatgtatcacatt

SEQ ID NO: 1035305 - DNA, 22 bp, Artificial Sequence
  chemically synthesized
aatagtactctattacgtatat

SEQ ID NO: 1035306 - DNA, 22 bp, Artificial Sequence
  chemically synthesized
tggctgaatagtactctattac

SEQ ID NO: 1035307 - DNA, 22 bp, Artificial Sequence
  chemically synthesized
atggctgaatagtactctatta

SEQ ID NO: 1035308 - DNA, 22 bp, Artificial Sequence
  chemically synthesized
tatggctgaatagtactctatt

SEQ ID NO: 1035309 - DNA, 22 bp, Artificial Sequence
  chemically synthesized
ttatggctgaatagtactctat

SEQ ID NO: 1035310 - DNA, 22 bp, Artificial Sequence
  chemically synthesized
tttatggctgaatagtactcta

SEQ ID NO: 1035311 - DNA, 22 bp, Artificial Sequence
  chemically synthesized
tttttatggctgaatagtactc

SEQ ID NO: 1035312 - DNA, 22 bp, Artificial Sequence
  chemically synthesized
attctttttatggctgaatagt

SEQ ID NO: 1035313 - DNA, 22 bp, Artificial Sequence
  chemically synthesized
ttcagccataaaaagaatgaga

SEQ ID NO: 1035314 - DNA, 22 bp, Artificial Sequence
  chemically synthesized
caaatgaaaggatctcattctt

SEQ ID NO: 1035315 - DNA, 22 bp, Artificial Sequence
  chemically synthesized
agccataaaaagaatgagatcc

SEQ ID NO: 1035316 - DNA, 22 bp, Artificial Sequence
  chemically synthesized
catccatgatgttgcaaatgaa

SEQ ID NO: 1035317 - DNA, 22 bp, Artificial Sequence
  chemically synthesized
cagttccatccatgatgttgca

SEQ ID NO: 1035318 - DNA, 22 bp, Artificial Sequence
  chemically synthesized
tcatttgcaacatcatggatgg

SEQ ID NO: 1035319 - DNA, 22 bp, Artificial Sequence
  chemically synthesized
catttgcaacatcatggatgga

SEQ ID NO: 1035320 - DNA, 22 bp, Artificial Sequence
  chemically synthesized
atttgcaacatcatggatggaa

SEQ ID NO: 1035321 - DNA, 22 bp, Artificial Sequence
  chemically synthesized
gcaacatcatggatggaactgg

SEQ ID NO: 1035322 - DNA, 22 bp, Artificial Sequence
  chemically synthesized
acacaatgacctccagttccat

SEQ ID NO: 1035323 - DNA, 22 bp, Artificial Sequence
  chemically synthesized
caacatcatggatggaactgga

SEQ ID NO: 1035324 - DNA, 22 bp, Artificial Sequence
  chemically synthesized
aacacaatgacctccagttcca

SEQ ID NO: 1035325 - DNA, 22 bp, Artificial Sequence
  chemically synthesized
atttaacacaatgacctccagt

SEQ ID NO: 1035326 - DNA, 22 bp, Artificial Sequence
  chemically synthesized
catttaacacaatgacctccag

SEQ ID NO: 1035327 - DNA, 22 bp, Artificial Sequence
  chemically synthesized
tttcatttaacacaatgacctc

SEQ ID NO: 1035328 - DNA, 22 bp, Artificial Sequence
  chemically synthesized
atttcatttaacacaatgacct

SEQ ID NO: 1035329 - DNA, 22 bp, Artificial Sequence
  chemically synthesized
gcttatttcatttaacacaatg

SEQ ID NO: 1035330 - DNA, 22 bp, Artificial Sequence
  chemically synthesized
tgcctggcttatttcatttaac

SEQ ID NO: 1035331 - DNA, 22 bp, Artificial Sequence
  chemically synthesized
gaggtcattgtgttaaatgaaa

SEQ ID NO: 1035332 - DNA, 22 bp, Artificial Sequence
  chemically synthesized
tgtgcctggcttatttcattta

SEQ ID NO: 1035333 - DNA, 22 bp, Artificial Sequence
  chemically synthesized
ctgtgcctggcttatttcattt

SEQ ID NO: 1035334 - DNA, 22 bp, Artificial Sequence
  chemically synthesized
tctgtgcctggcttatttcatt

SEQ ID NO: 1035335 - DNA, 22 bp, Artificial Sequence
  chemically synthesized
tctttctgtgcctggcttattt

SEQ ID NO: 1035336 - DNA, 22 bp, Artificial Sequence
  chemically synthesized
gtctttctgtgcctggcttatt

SEQ ID NO: 1035337 - DNA, 22 bp, Artificial Sequence
  chemically synthesized
tgttaaatgaaataagccaggc

SEQ ID NO: 1035338 - DNA, 22 bp, Artificial Sequence
  chemically synthesized
aatgaaataagccaggcacaga

SEQ ID NO: 1035339 - DNA, 22 bp, Artificial Sequence
  chemically synthesized
ccacaaataaatgagaacgtgt

SEQ ID NO: 1035340 - DNA, 22 bp, Artificial Sequence
  chemically synthesized
cctgccacaaataaatgagaac

SEQ ID NO: 1035341 - DNA, 22 bp, Artificial Sequence
  chemically synthesized
acctgccacaaataaatgagaa

SEQ ID NO: 1035342 - DNA, 22 bp, Artificial Sequence
  chemically synthesized
tacctgccacaaataaatgaga

SEQ ID NO: 1035343 - DNA, 22 bp, Artificial Sequence
  chemically synthesized
ttacctgccacaaataaatgag

SEQ ID NO: 1035344 - DNA, 22 bp, Artificial Sequence
  chemically synthesized
atttttacctgccacaaataaa

SEQ ID NO: 1035345 - DNA, 22 bp, Artificial Sequence
  chemically synthesized
gatttttacctgccacaaataa

SEQ ID NO: 1035346 - DNA, 22 bp, Artificial Sequence
  chemically synthesized
tgatttttacctgccacaaata

SEQ ID NO: 1035347 - DNA, 22 bp, Artificial Sequence
  chemically synthesized
ttttgatttttacctgccacaa

SEQ ID NO: 1035348 - DNA, 22 bp, Artificial Sequence
  chemically synthesized
tcatttatttgtggcaggtaaa

SEQ ID NO: 1035349 - DNA, 22 bp, Artificial Sequence
  chemically synthesized
agttgttttgatttttacctgc

SEQ ID NO: 1035350 - DNA, 22 bp, Artificial Sequence
  chemically synthesized
atttatttgtggcaggtaaaaa

SEQ ID NO: 1035351 - DNA, 22 bp, Artificial Sequence
  chemically synthesized
atttgtggcaggtaaaaatcaa

SEQ ID NO: 1035352 - DNA, 22 bp, Artificial Sequence
  chemically synthesized
tttgtggcaggtaaaaatcaaa

SEQ ID NO: 1035353 - DNA, 22 bp, Artificial Sequence
  chemically synthesized
gtggcaggtaaaaatcaaaaca

SEQ ID NO: 1035354 - DNA, 22 bp, Artificial Sequence
  chemically synthesized
caagtgttcagttgttttgatt

SEQ ID NO: 1035355 - DNA, 22 bp, Artificial Sequence
  chemically synthesized
tggcaggtaaaaatcaaaacaa

SEQ ID NO: 1035356 - DNA, 22 bp, Artificial Sequence
  chemically synthesized
tctccaagtgttcagttgtttt

SEQ ID NO: 1035357 - DNA, 22 bp, Artificial Sequence
  chemically synthesized
tatctccaagtgttcagttgtt

SEQ ID NO: 1035358 - DNA, 22 bp, Artificial Sequence
  chemically synthesized
caccctctatctccaagtgttc

SEQ ID NO: 1035359 - DNA, 22 bp, Artificial Sequence
  chemically synthesized
ccaccctctatctccaagtgtt

SEQ ID NO: 1035360 - DNA, 22 bp, Artificial Sequence
  chemically synthesized
aacacttggagatagagggtgg

SEQ ID NO: 1035361 - DNA, 22 bp, Artificial Sequence
  chemically synthesized
gtaaccatccttccaccctcta

SEQ ID NO: 1035362 - DNA, 22 bp, Artificial Sequence
  chemically synthesized
tggtaaccatccttccaccctc

SEQ ID NO: 1035363 - DNA, 22 bp, Artificial Sequence
  chemically synthesized
ggagatagagggtggaaggatg

SEQ ID NO: 1035364 - DNA, 22 bp, Artificial Sequence
  chemically synthesized
gagatagagggtggaaggatgg

SEQ ID NO: 1035365 - DNA, 22 bp, Artificial Sequence
  chemically synthesized
acagcctctggtaaccatcctt

SEQ ID NO: 1035366 - DNA, 22 bp, Artificial Sequence
  chemically synthesized
cacagcctctggtaaccatcct

SEQ ID NO: 1035367 - DNA, 22 bp, Artificial Sequence
  chemically synthesized
cccttcacagcctctggtaacc

SEQ ID NO: 1035368 - DNA, 22 bp, Artificial Sequence
  chemically synthesized
aacccccccactacccttcaca

SEQ ID NO: 1035369 - DNA, 22 bp, Artificial Sequence
  chemically synthesized
ccagaggctgtgaagggtagtg

SEQ ID NO: 1035370 - DNA, 22 bp, Artificial Sequence
  chemically synthesized
cccctcaacccccccactaccc

SEQ ID NO: 1035371 - DNA, 22 bp, Artificial Sequence
  chemically synthesized
aacctccccctcaaccccccca

SEQ ID NO: 1035372 - DNA, 22 bp, Artificial Sequence
  chemically synthesized
caacctccccctcaaccccccc

SEQ ID NO: 1035373 - DNA, 22 bp, Artificial Sequence
  chemically synthesized
tgaagggtagtgggggggttga

SEQ ID NO: 1035374 - DNA, 22 bp, Artificial Sequence
  chemically synthesized
taccaagtaaccatttcaacct

SEQ ID NO: 1035375 - DNA, 22 bp, Artificial Sequence
  chemically synthesized
gtaccaagtaaccatttcaacc

SEQ ID NO: 1035376 - DNA, 22 bp, Artificial Sequence
  chemically synthesized
tgtaccaagtaaccatttcaac

SEQ ID NO: 1035377 - DNA, 22 bp, Artificial Sequence
  chemically synthesized
ttgtaccaagtaaccatttcaa

SEQ ID NO: 1035378 - DNA, 22 bp, Artificial Sequence
  chemically synthesized
tttgtaccaagtaaccatttca

SEQ ID NO: 1035379 - DNA, 22 bp, Artificial Sequence
  chemically synthesized
agggggaggttgaaatggttac

SEQ ID NO: 1035380 - DNA, 22 bp, Artificial Sequence
  chemically synthesized
ttttttgtaccaagtaaccatt

SEQ ID NO: 1035381 - DNA, 22 bp, Artificial Sequence
  chemically synthesized
actattttttgtaccaagtaac

SEQ ID NO: 1035382 - DNA, 22 bp, Artificial Sequence
  chemically synthesized
taactattttttgtaccaagta

SEQ ID NO: 1035383 - DNA, 22 bp, Artificial Sequence
  chemically synthesized
ctaactattttttgtaccaagt

SEQ ID NO: 1035384 - DNA, 22 bp, Artificial Sequence
  chemically synthesized
tctaactattttttgtaccaag

SEQ ID NO: 1035385 - DNA, 22 bp, Artificial Sequence
  chemically synthesized
tttctaactattttttgtacca

SEQ ID NO: 1035386 - DNA, 22 bp, Artificial Sequence
  chemically synthesized
aaatggttacttggtacaaaaa

SEQ ID NO: 1035387 - DNA, 22 bp, Artificial Sequence
  chemically synthesized
attctttctaactattttttgt

SEQ ID NO: 1035388 - DNA, 22 bp, Artificial Sequence
  chemically synthesized
cttggtacaaaaaatagttaga

SEQ ID NO: 1035389 - DNA, 22 bp, Artificial Sequence
  chemically synthesized
ggtacaaaaaatagttagaaag

SEQ ID NO: 1035390 - DNA, 22 bp, Artificial Sequence
  chemically synthesized
gtacaaaaaatagttagaaaga

SEQ ID NO: 1035391 - DNA, 22 bp, Artificial Sequence
  chemically synthesized
gcaaatagtaggtggtgttcat

SEQ ID NO: 1035392 - DNA, 22 bp, Artificial Sequence
  chemically synthesized
tgctagcaaatagtaggtggtg

SEQ ID NO: 1035393 - DNA, 22 bp, Artificial Sequence
  chemically synthesized
gaaagaatgaacaccacctact

SEQ ID NO: 1035394 - DNA, 22 bp, Artificial Sequence
  chemically synthesized
ttgtgctagcaaatagtaggtg

SEQ ID NO: 1035395 - DNA, 22 bp, Artificial Sequence
  chemically synthesized
tagtcaccctgttgtgctagca

SEQ ID NO: 1035396 - DNA, 22 bp, Artificial Sequence
  chemically synthesized
actatagtcaccctgttgtgct

SEQ ID NO: 1035397 - DNA, 22 bp, Artificial Sequence
  chemically synthesized
gactatagtcaccctgttgtgc

SEQ ID NO: 1035398 - DNA, 22 bp, Artificial Sequence
  chemically synthesized
tgactatagtcaccctgttgtg

SEQ ID NO: 1035399 - DNA, 22 bp, Artificial Sequence
  chemically synthesized
ctatttgctagcacaacagggt

SEQ ID NO: 1035400 - DNA, 22 bp, Artificial Sequence
  chemically synthesized
ttttgactatagtcaccctgtt

SEQ ID NO: 1035401 - DNA, 22 bp, Artificial Sequence
  chemically synthesized
tttgctagcacaacagggtgac

SEQ ID NO: 1035402 - DNA, 22 bp, Artificial Sequence
  chemically synthesized
gctagcacaacagggtgactat

SEQ ID NO: 1035403 - DNA, 22 bp, Artificial Sequence
  chemically synthesized
ctagcacaacagggtgactata

SEQ ID NO: 1035404 - DNA, 22 bp, Artificial Sequence
  chemically synthesized
aattgttttgactatagtcacc

SEQ ID NO: 1035405 - DNA, 22 bp, Artificial Sequence
  chemically synthesized
gcacaacagggtgactatagtc

SEQ ID NO: 1035406 - DNA, 22 bp, Artificial Sequence
  chemically synthesized
aaaatgtacaattaaattgttt

SEQ ID NO: 1035407 - DNA, 22 bp, Artificial Sequence
  chemically synthesized
aaaaatgtacaattaaattgtt

SEQ ID NO: 1035408 - DNA, 22 bp, Artificial Sequence
  chemically synthesized
tttaaaaatgtacaattaaatt

SEQ ID NO: 1035409 - DNA, 22 bp, Artificial Sequence
  chemically synthesized
tagtcaaaacaatttaattgta

SEQ ID NO: 1035410 - DNA, 22 bp, Artificial Sequence
  chemically synthesized
attgtttaaaaatgtacaatta

SEQ ID NO: 1035411 - DNA, 22 bp, Artificial Sequence
  chemically synthesized
aattgtttaaaaatgtacaatt

SEQ ID NO: 1035412 - DNA, 22 bp, Artificial Sequence
  chemically synthesized
taattgtttaaaaatgtacaat

SEQ ID NO: 1035413 - DNA, 22 bp, Artificial Sequence
  chemically synthesized
ttaattgtttaaaaatgtacaa

SEQ ID NO: 1035414 - DNA, 22 bp, Artificial Sequence
  chemically synthesized
tttaattgtttaaaaatgtaca

SEQ ID NO: 1035415 - DNA, 22 bp, Artificial Sequence
  chemically synthesized
ttttaattgtttaaaaatgtac

SEQ ID NO: 1035416 - DNA, 22 bp, Artificial Sequence
  chemically synthesized
tatttttttaattgtttaaaaa

SEQ ID NO: 1035417 - DNA, 22 bp, Artificial Sequence
  chemically synthesized
aattgtacatttttaaacaatt

SEQ ID NO: 1035418 - DNA, 22 bp, Artificial Sequence
  chemically synthesized
attgtacatttttaaacaatta

SEQ ID NO: 1035419 - DNA, 22 bp, Artificial Sequence
  chemically synthesized
tacatttttaaacaattaaaaa

SEQ ID NO: 1035420 - DNA, 22 bp, Artificial Sequence
  chemically synthesized
ttaaacaattaaaaaaatacaa

SEQ ID NO: 1035421 - DNA, 22 bp, Artificial Sequence
  chemically synthesized
caaacagtaaaattgtattttt

SEQ ID NO: 1035422 - DNA, 22 bp, Artificial Sequence
  chemically synthesized
taaacaattaaaaaaatacaat

SEQ ID NO: 1035423 - DNA, 22 bp, Artificial Sequence
  chemically synthesized
acaaacagtaaaattgtatttt

SEQ ID NO: 1035424 - DNA, 22 bp, Artificial Sequence
  chemically synthesized
aaacaattaaaaaaatacaatt

SEQ ID NO: 1035425 - DNA, 22 bp, Artificial Sequence
  chemically synthesized
tacaaacagtaaaattgtattt

SEQ ID NO: 1035426 - DNA, 22 bp, Artificial Sequence
  chemically synthesized
aacaattaaaaaaatacaattt

SEQ ID NO: 1035427 - DNA, 22 bp, Artificial Sequence
  chemically synthesized
ttttacaaacagtaaaattgta

SEQ ID NO: 1035428 - DNA, 22 bp, Artificial Sequence
  chemically synthesized
gttttacaaacagtaaaattgt

SEQ ID NO: 1035429 - DNA, 22 bp, Artificial Sequence
  chemically synthesized
tgttttacaaacagtaaaattg

SEQ ID NO: 1035430 - DNA, 22 bp, Artificial Sequence
  chemically synthesized
tttgttttacaaacagtaaaat

SEQ ID NO: 1035431 - DNA, 22 bp, Artificial Sequence
  chemically synthesized
aaaaaatacaattttactgttt

SEQ ID NO: 1035432 - DNA, 22 bp, Artificial Sequence
  chemically synthesized
ttctttgttttacaaacagtaa

SEQ ID NO: 1035433 - DNA, 22 bp, Artificial Sequence
  chemically synthesized
aagcaattattctttgttttac

SEQ ID NO: 1035434 - DNA, 22 bp, Artificial Sequence
  chemically synthesized
tactgtttgtaaaacaaagaat

SEQ ID NO: 1035435 - DNA, 22 bp, Artificial Sequence
  chemically synthesized
actgtttgtaaaacaaagaata

SEQ ID NO: 1035436 - DNA, 22 bp, Artificial Sequence
  chemically synthesized
ctgtttgtaaaacaaagaataa

SEQ ID NO: 1035437 - DNA, 22 bp, Artificial Sequence
  chemically synthesized
atcccctcaagcaattattctt

SEQ ID NO: 1035438 - DNA, 22 bp, Artificial Sequence
  chemically synthesized
tttgtaaaacaaagaataattg

SEQ ID NO: 1035439 - DNA, 22 bp, Artificial Sequence
  chemically synthesized
gtaaaacaaagaataattgctt

SEQ ID NO: 1035440 - DNA, 22 bp, Artificial Sequence
  chemically synthesized
taaaacaaagaataattgcttg

SEQ ID NO: 1035441 - DNA, 22 bp, Artificial Sequence
  chemically synthesized
cttgaggggatgaacatcccat

SEQ ID NO: 1035442 - DNA, 22 bp, Artificial Sequence
  chemically synthesized
gaggggatgaacatcccatttt

SEQ ID NO: 1035443 - DNA, 22 bp, Artificial Sequence
  chemically synthesized
aggggatgaacatcccattttc

SEQ ID NO: 1035444 - DNA, 22 bp, Artificial Sequence
  chemically synthesized
atataggcatgcaagtatcatg

SEQ ID NO: 1035445 - DNA, 22 bp, Artificial Sequence
  chemically synthesized
gatataggcatgcaagtatcat

SEQ ID NO: 1035446 - DNA, 22 bp, Artificial Sequence
  chemically synthesized
tgatataggcatgcaagtatca

SEQ ID NO: 1035447 - DNA, 22 bp, Artificial Sequence
  chemically synthesized
tccatgatacttgcatgcctat

SEQ ID NO: 1035448 - DNA, 22 bp, Artificial Sequence
  chemically synthesized
ccatgatacttgcatgcctata

SEQ ID NO: 1035449 - DNA, 22 bp, Artificial Sequence
  chemically synthesized
catgatacttgcatgcctatat

SEQ ID NO: 1035450 - DNA, 22 bp, Artificial Sequence
  chemically synthesized
gcatgcctatatcaaaacatct

SEQ ID NO: 1035451 - DNA, 22 bp, Artificial Sequence
  chemically synthesized
catgcctatatcaaaacatctc

SEQ ID NO: 1035452 - DNA, 22 bp, Artificial Sequence
  chemically synthesized
tatcaaaacatctcatgtaccc

SEQ ID NO: 1035453 - DNA, 22 bp, Artificial Sequence
  chemically synthesized
atgtaccccatatatatatatg

SEQ ID NO: 1035454 - DNA, 22 bp, Artificial Sequence
  chemically synthesized
cacatatatatgtgtatatatg

SEQ ID NO: 1035455 - DNA, 22 bp, Artificial Sequence
  chemically synthesized
tgtatatacacacatacatagt

SEQ ID NO: 1035456 - DNA, 22 bp, Artificial Sequence
  chemically synthesized
ctatgtatatacacacatacat

SEQ ID NO: 1035457 - DNA, 22 bp, Artificial Sequence
  chemically synthesized
actatgtatatacacacataca

SEQ ID NO: 1035458 - DNA, 22 bp, Artificial Sequence
  chemically synthesized
tgtatgtgtgtatatacatagt

SEQ ID NO: 1035459 - DNA, 22 bp, Artificial Sequence
  chemically synthesized
tatataaatagatttactatgt

SEQ ID NO: 1035460 - DNA, 22 bp, Artificial Sequence
  chemically synthesized
tatataaacatatactatatat

SEQ ID NO: 1035461 - DNA, 22 bp, Artificial Sequence
  chemically synthesized
tttatatatagtatatgtttat

SEQ ID NO: 1035462 - DNA, 22 bp, Artificial Sequence
  chemically synthesized
atatatagtatatgtttatata

SEQ ID NO: 1035463 - DNA, 22 bp, Artificial Sequence
  chemically synthesized
tatatagtatatgtttatatat

SEQ ID NO: 1035464 - DNA, 22 bp, Artificial Sequence
  chemically synthesized
atatatagtatatatttatata

SEQ ID NO: 1035465 - DNA, 22 bp, Artificial Sequence
  chemically synthesized
tatatagtatatatttatatat

SEQ ID NO: 1035466 - DNA, 22 bp, Artificial Sequence
  chemically synthesized
tatatataaacacacatatata

SEQ ID NO: 1035467 - DNA, 22 bp, Artificial Sequence
  chemically synthesized
atatatgtgtgtttatatatac

SEQ ID NO: 1035468 - DNA, 22 bp, Artificial Sequence
  chemically synthesized
tatatgtgtgtttatatataca

SEQ ID NO: 1035469 - DNA, 22 bp, Artificial Sequence
  chemically synthesized
tatatatatatatatatactgt

SEQ ID NO: 1035470 - DNA, 22 bp, Artificial Sequence
  chemically synthesized
atatatacagtatatatatata

SEQ ID NO: 1035471 - DNA, 22 bp, Artificial Sequence
  chemically synthesized
tatatacagtatatatatatat

SEQ ID NO: 1035472 - DNA, 22 bp, Artificial Sequence
  chemically synthesized
tgggtacatagtgtgtatatat

SEQ ID NO: 1035473 - DNA, 22 bp, Artificial Sequence
  chemically synthesized
gtgggtacatagtgtgtatata

SEQ ID NO: 1035474 - DNA, 22 bp, Artificial Sequence
  chemically synthesized
acgtttgtgggtacatagtgtg

SEQ ID NO: 1035475 - DNA, 22 bp, Artificial Sequence
  chemically synthesized
aacgtttgtgggtacatagtgt

SEQ ID NO: 1035476 - DNA, 22 bp, Artificial Sequence
  chemically synthesized
taacgtttgtgggtacatagtg

SEQ ID NO: 1035477 - DNA, 22 bp, Artificial Sequence
  chemically synthesized
ttaacgtttgtgggtacatagt

SEQ ID NO: 1035478 - DNA, 22 bp, Artificial Sequence
  chemically synthesized
tttttaacgtttgtgggtacat

SEQ ID NO: 1035479 - DNA, 22 bp, Artificial Sequence
  chemically synthesized
aatgttatttttaacgtttgtg

SEQ ID NO: 1035480 - DNA, 22 bp, Artificial Sequence
  chemically synthesized
aaatgttatttttaacgtttgt

SEQ ID NO: 1035481 - DNA, 22 bp, Artificial Sequence
  chemically synthesized
taaatgttatttttaacgtttg

SEQ ID NO: 1035482 - DNA, 22 bp, Artificial Sequence
  chemically synthesized
tgtacccacaaacgttaaaaat

SEQ ID NO: 1035483 - DNA, 22 bp, Artificial Sequence
  chemically synthesized
tctttaaatgttatttttaacg

SEQ ID NO: 1035484 - DNA, 22 bp, Artificial Sequence
  chemically synthesized
atctttaaatgttatttttaac

SEQ ID NO: 1035485 - DNA, 22 bp, Artificial Sequence
  chemically synthesized
tatctttaaatgttatttttaa

SEQ ID NO: 1035486 - DNA, 22 bp, Artificial Sequence
  chemically synthesized
ttatctttaaatgttattttta

SEQ ID NO: 1035487 - DNA, 22 bp, Artificial Sequence
  chemically synthesized
tttatctttaaatgttattttt

SEQ ID NO: 1035488 - DNA, 22 bp, Artificial Sequence
  chemically synthesized
aaaattttttatctttaaatgt

SEQ ID NO: 1035489 - DNA, 22 bp, Artificial Sequence
  chemically synthesized
caaaattttttatctttaaatg

SEQ ID NO: 1035490 - DNA, 22 bp, Artificial Sequence
  chemically synthesized
tcaaaattttttatctttaaat

SEQ ID NO: 1035491 - DNA, 22 bp, Artificial Sequence
  chemically synthesized
ttcaaaattttttatctttaaa

SEQ ID NO: 1035492 - DNA, 22 bp, Artificial Sequence
  chemically synthesized
aaaataacatttaaagataaaa

SEQ ID NO: 1035493 - DNA, 22 bp, Artificial Sequence
  chemically synthesized
cacttttcaaaattttttatct

SEQ ID NO: 1035494 - DNA, 22 bp, Artificial Sequence
  chemically synthesized
tgttccacttttcaaaattttt

SEQ ID NO: 1035495 - DNA, 22 bp, Artificial Sequence
  chemically synthesized
atgttccacttttcaaaatttt

SEQ ID NO: 1035496 - DNA, 22 bp, Artificial Sequence
  chemically synthesized
tttatgttccacttttcaaaat

SEQ ID NO: 1035497 - DNA, 22 bp, Artificial Sequence
  chemically synthesized
aaagataaaaaattttgaaaag

SEQ ID NO: 1035498 - DNA, 22 bp, Artificial Sequence
  chemically synthesized
aagataaaaaattttgaaaagt

SEQ ID NO: 1035499 - DNA, 22 bp, Artificial Sequence
  chemically synthesized
tatttatgttccacttttcaaa

SEQ ID NO: 1035500 - DNA, 22 bp, Artificial Sequence
  chemically synthesized
ctatttatgttccacttttcaa

SEQ ID NO: 1035501 - DNA, 22 bp, Artificial Sequence
  chemically synthesized
tgaaaagtggaacataaataga

SEQ ID NO: 1035502 - DNA, 22 bp, Artificial Sequence
  chemically synthesized
gaaaagtggaacataaatagaa

SEQ ID NO: 1035503 - DNA, 22 bp, Artificial Sequence
  chemically synthesized
aaaagtggaacataaatagaaa

SEQ ID NO: 1035504 - DNA, 22 bp, Artificial Sequence
  chemically synthesized
gtacttctctgtctgtctactg

SEQ ID NO: 1035505 - DNA, 22 bp, Artificial Sequence
  chemically synthesized
tacttctctgtctgtctactgt

SEQ ID NO: 1035506 - DNA, 22 bp, Artificial Sequence
  chemically synthesized
ctctgtctgtctactgtatctt

SEQ ID NO: 1035507 - DNA, 22 bp, Artificial Sequence
  chemically synthesized
tctgtctgtctactgtatcttc

SEQ ID NO: 1035508 - DNA, 22 bp, Artificial Sequence
  chemically synthesized
tgtctgtctactgtatcttctt

SEQ ID NO: 1035509 - DNA, 22 bp, Artificial Sequence
  chemically synthesized
tctgtctactgtatcttcttct

SEQ ID NO: 1035510 - DNA, 22 bp, Artificial Sequence
  chemically synthesized
tctactgtatcttcttctgcat

SEQ ID NO: 1035511 - DNA, 22 bp, Artificial Sequence
  chemically synthesized
agtcatggggacaatgcagaag

SEQ ID NO: 1035512 - DNA, 22 bp, Artificial Sequence
  chemically synthesized
ctgtatcttcttctgcattgtc

SEQ ID NO: 1035513 - DNA, 22 bp, Artificial Sequence
  chemically synthesized
tatcttcttctgcattgtcccc

SEQ ID NO: 1035514 - DNA, 22 bp, Artificial Sequence
  chemically synthesized
cttctgcattgtccccatgact

SEQ ID NO: 1035515 - DNA, 22 bp, Artificial Sequence
  chemically synthesized
ttctgcattgtccccatgactg

SEQ ID NO: 1035516 - DNA, 22 bp, Artificial Sequence
  chemically synthesized
ctgcattgtccccatgactgaa

SEQ ID NO: 1035517 - DNA, 22 bp, Artificial Sequence
  chemically synthesized
tgcattgtccccatgactgaat

SEQ ID NO: 1035518 - DNA, 22 bp, Artificial Sequence
  chemically synthesized
cattgtccccatgactgaatcc

SEQ ID NO: 1035519 - DNA, 22 bp, Artificial Sequence
  chemically synthesized
tccccatgactgaatccacggg

SEQ ID NO: 1035520 - DNA, 22 bp, Artificial Sequence
  chemically synthesized
gaagaaaggaatcccgtggatt

SEQ ID NO: 1035521 - DNA, 22 bp, Artificial Sequence
  chemically synthesized
actggaagaaaggaatcccgtg

SEQ ID NO: 1035522 - DNA, 22 bp, Artificial Sequence
  chemically synthesized
ctgactggaagaaaggaatccc

SEQ ID NO: 1035523 - DNA, 22 bp, Artificial Sequence
  chemically synthesized
actgactggaagaaaggaatcc

SEQ ID NO: 1035524 - DNA, 22 bp, Artificial Sequence
  chemically synthesized
tactgactggaagaaaggaatc

SEQ ID NO: 1035525 - DNA, 22 bp, Artificial Sequence
  chemically synthesized
aatccacgggattcctttcttc

SEQ ID NO: 1035526 - DNA, 22 bp, Artificial Sequence
  chemically synthesized
ttttactgactggaagaaagga

SEQ ID NO: 1035527 - DNA, 22 bp, Artificial Sequence
  chemically synthesized
catggccactgttttactgact

SEQ ID NO: 1035528 - DNA, 22 bp, Artificial Sequence
  chemically synthesized
ctttcttccagtcagtaaaaca

SEQ ID NO: 1035529 - DNA, 22 bp, Artificial Sequence
  chemically synthesized
ttccatggccactgttttactg

SEQ ID NO: 1035530 - DNA, 22 bp, Artificial Sequence
  chemically synthesized
tcttccagtcagtaaaacagtg

SEQ ID NO: 1035531 - DNA, 22 bp, Artificial Sequence
  chemically synthesized
cttccagtcagtaaaacagtgg

SEQ ID NO: 1035532 - DNA, 22 bp, Artificial Sequence
  chemically synthesized
ttccagtcagtaaaacagtggc

SEQ ID NO: 1035533 - DNA, 22 bp, Artificial Sequence
  chemically synthesized
ccagtcagtaaaacagtggcca

SEQ ID NO: 1035534 - DNA, 22 bp, Artificial Sequence
  chemically synthesized
cagtcagtaaaacagtggccat

SEQ ID NO: 1035535 - DNA, 22 bp, Artificial Sequence
  chemically synthesized
atatcctattccatggccactg

SEQ ID NO: 1035536 - DNA, 22 bp, Artificial Sequence
  chemically synthesized
ttcatatcctattccatggcca

SEQ ID NO: 1035537 - DNA, 22 bp, Artificial Sequence
  chemically synthesized
agaaagttgttcatatcctatt

SEQ ID NO: 1035538 - DNA, 22 bp, Artificial Sequence
  chemically synthesized
aagaaagttgttcatatcctat

SEQ ID NO: 1035539 - DNA, 22 bp, Artificial Sequence
  chemically synthesized
aacttaagaaagttgttcatat

SEQ ID NO: 1035540 - DNA, 22 bp, Artificial Sequence
  chemically synthesized
tcttaagttcaggacttgcttg

SEQ ID NO: 1035541 - DNA, 22 bp, Artificial Sequence
  chemically synthesized
cttaagttcaggacttgcttgt

SEQ ID NO: 1035542 - DNA, 22 bp, Artificial Sequence
  chemically synthesized
ttaagttcaggacttgcttgtt

SEQ ID NO: 1035543 - DNA, 22 bp, Artificial Sequence
  chemically synthesized
aagttcaggacttgcttgtttt

SEQ ID NO: 1035544 - DNA, 22 bp, Artificial Sequence
  chemically synthesized
agttcaggacttgcttgttttt

SEQ ID NO: 1035545 - DNA, 22 bp, Artificial Sequence
  chemically synthesized
ggaagtaaggggtaaaaaacaa

SEQ ID NO: 1035546 - DNA, 22 bp, Artificial Sequence
  chemically synthesized
aggacttgcttgttttttaccc

SEQ ID NO: 1035547 - DNA, 22 bp, Artificial Sequence
  chemically synthesized
gtagaattaggaagtaaggggt

SEQ ID NO: 1035548 - DNA, 22 bp, Artificial Sequence
  chemically synthesized
gcttgttttttaccccttactt

SEQ ID NO: 1035549 - DNA, 22 bp, Artificial Sequence
  chemically synthesized
ggtagaattaggaagtaagggg

SEQ ID NO: 1035550 - DNA, 22 bp, Artificial Sequence
  chemically synthesized
cttgttttttaccccttacttc

SEQ ID NO: 1035551 - DNA, 22 bp, Artificial Sequence
  chemically synthesized
gttttttaccccttacttccta

SEQ ID NO: 1035552 - DNA, 22 bp, Artificial Sequence
  chemically synthesized
ttttttaccccttacttcctaa

SEQ ID NO: 1035553 - DNA, 22 bp, Artificial Sequence
  chemically synthesized
agcttggtagaattaggaagta

SEQ ID NO: 1035554 - DNA, 22 bp, Artificial Sequence
  chemically synthesized
tgagcttggtagaattaggaag

SEQ ID NO: 1035555 - DNA, 22 bp, Artificial Sequence
  chemically synthesized
tttaccccttacttcctaattc

SEQ ID NO: 1035556 - DNA, 22 bp, Artificial Sequence
  chemically synthesized
ctgagcttggtagaattaggaa

SEQ ID NO: 1035557 - DNA, 22 bp, Artificial Sequence
  chemically synthesized
ttaccccttacttcctaattct

SEQ ID NO: 1035558 - DNA, 22 bp, Artificial Sequence
  chemically synthesized
taccccttacttcctaattcta

SEQ ID NO: 1035559 - DNA, 22 bp, Artificial Sequence
  chemically synthesized
accccttacttcctaattctac

SEQ ID NO: 1035560 - DNA, 22 bp, Artificial Sequence
  chemically synthesized
ccccttacttcctaattctacc

SEQ ID NO: 1035561 - DNA, 22 bp, Artificial Sequence
  chemically synthesized
gtttctgagcttggtagaatta

SEQ ID NO: 1035562 - DNA, 22 bp, Artificial Sequence
  chemically synthesized
ttggtttctgagcttggtagaa

SEQ ID NO: 1035563 - DNA, 22 bp, Artificial Sequence
  chemically synthesized
acttcctaattctaccaagctc

SEQ ID NO: 1035564 - DNA, 22 bp, Artificial Sequence
  chemically synthesized
ctgttggtttctgagcttggta

SEQ ID NO: 1035565 - DNA, 22 bp, Artificial Sequence
  chemically synthesized
cttcctaattctaccaagctca

SEQ ID NO: 1035566 - DNA, 22 bp, Artificial Sequence
  chemically synthesized
actgttggtttctgagcttggt

SEQ ID NO: 1035567 - DNA, 22 bp, Artificial Sequence
  chemically synthesized
cctaattctaccaagctcagaa

SEQ ID NO: 1035568 - DNA, 22 bp, Artificial Sequence
  chemically synthesized
ctaattctaccaagctcagaaa

SEQ ID NO: 1035569 - DNA, 22 bp, Artificial Sequence
  chemically synthesized
attctaccaagctcagaaacca

SEQ ID NO: 1035570 - DNA, 22 bp, Artificial Sequence
  chemically synthesized
taccaagctcagaaaccaacag

SEQ ID NO: 1035571 - DNA, 22 bp, Artificial Sequence
  chemically synthesized
ccaagctcagaaaccaacagta

SEQ ID NO: 1035572 - DNA, 22 bp, Artificial Sequence
  chemically synthesized
agaaaccaacagtaagtatttt

SEQ ID NO: 1035573 - DNA, 22 bp, Artificial Sequence
  chemically synthesized
cacaacccaggtataggtatat

SEQ ID NO: 1035574 - DNA, 22 bp, Artificial Sequence
  chemically synthesized
tgtattggcacatatacctata

SEQ ID NO: 1035575 - DNA, 22 bp, Artificial Sequence
  chemically synthesized
gtattggcacatatacctatac

SEQ ID NO: 1035576 - DNA, 22 bp, Artificial Sequence
  chemically synthesized
tattggcacatatacctatacc

SEQ ID NO: 1035577 - DNA, 22 bp, Artificial Sequence
  chemically synthesized
attccacaacccaggtataggt

SEQ ID NO: 1035578 - DNA, 22 bp, Artificial Sequence
  chemically synthesized
cattccacaacccaggtatagg

SEQ ID NO: 1035579 - DNA, 22 bp, Artificial Sequence
  chemically synthesized
gcacatatacctatacctgggt

SEQ ID NO: 1035580 - DNA, 22 bp, Artificial Sequence
  chemically synthesized
gatcttcattccacaacccagg

SEQ ID NO: 1035581 - DNA, 22 bp, Artificial Sequence
  chemically synthesized
tacctgggttgtggaatgaaga

SEQ ID NO: 1035582 - DNA, 22 bp, Artificial Sequence
  chemically synthesized
tgcaagactggatcttcattcc

SEQ ID NO: 1035583 - DNA, 22 bp, Artificial Sequence
  chemically synthesized
atgcaagactggatcttcattc

SEQ ID NO: 1035584 - DNA, 22 bp, Artificial Sequence
  chemically synthesized
tatgcaagactggatcttcatt

SEQ ID NO: 1035585 - DNA, 22 bp, Artificial Sequence
  chemically synthesized
ttatgcaagactggatcttcat

SEQ ID NO: 1035586 - DNA, 22 bp, Artificial Sequence
  chemically synthesized
ggttgtggaatgaagatccagt

SEQ ID NO: 1035587 - DNA, 22 bp, Artificial Sequence
  chemically synthesized
aagatttttatgcaagactgga

SEQ ID NO: 1035588 - DNA, 22 bp, Artificial Sequence
  chemically synthesized
tggaatgaagatccagtcttgc

SEQ ID NO: 1035589 - DNA, 22 bp, Artificial Sequence
  chemically synthesized
gaagatttttatgcaagactgg

SEQ ID NO: 1035590 - DNA, 22 bp, Artificial Sequence
  chemically synthesized
ccatatttgaagatttttatgc

SEQ ID NO: 1035591 - DNA, 22 bp, Artificial Sequence
  chemically synthesized
taccatatttgaagatttttat

SEQ ID NO: 1035592 - DNA, 22 bp, Artificial Sequence
  chemically synthesized
atctctaccatatttgaagatt

SEQ ID NO: 1035593 - DNA, 22 bp, Artificial Sequence
  chemically synthesized
gcataaaaatcttcaaatatgg

SEQ ID NO: 1035594 - DNA, 22 bp, Artificial Sequence
  chemically synthesized
cataaaaatcttcaaatatggt

SEQ ID NO: 1035595 - DNA, 22 bp, Artificial Sequence
  chemically synthesized
gaattaatctctaccatatttg

SEQ ID NO: 1035596 - DNA, 22 bp, Artificial Sequence
  chemically synthesized
agaattaatctctaccatattt

SEQ ID NO: 1035597 - DNA, 22 bp, Artificial Sequence
  chemically synthesized
cagtcttagaattaatctctac

SEQ ID NO: 1035598 - DNA, 22 bp, Artificial Sequence
  chemically synthesized
caaatatggtagagattaattc

SEQ ID NO: 1035599 - DNA, 22 bp, Artificial Sequence
  chemically synthesized
aaatatggtagagattaattct

SEQ ID NO: 1035600 - DNA, 22 bp, Artificial Sequence
  chemically synthesized
tcattgcagtcttagaattaat

SEQ ID NO: 1035601 - DNA, 22 bp, Artificial Sequence
  chemically synthesized
acgaaggattatcattgcagtc

SEQ ID NO: 1035602 - DNA, 22 bp, Artificial Sequence
  chemically synthesized
attctaagactgcaatgataat

SEQ ID NO: 1035603 - DNA, 22 bp, Artificial Sequence
  chemically synthesized
acaactcacgaaggattatcat

SEQ ID NO: 1035604 - DNA, 22 bp, Artificial Sequence
  chemically synthesized
taagactgcaatgataatcctt

SEQ ID NO: 1035605 - DNA, 22 bp, Artificial Sequence
  chemically synthesized
agactgcaatgataatccttcg

SEQ ID NO: 1035606 - DNA, 22 bp, Artificial Sequence
  chemically synthesized
caatgataatccttcgtgagtt

SEQ ID NO: 1035607 - DNA, 22 bp, Artificial Sequence
  chemically synthesized
cgtgagttgtcagcatcctgta

SEQ ID NO: 1035608 - DNA, 22 bp, Artificial Sequence
  chemically synthesized
gtgagttgtcagcatcctgtat

SEQ ID NO: 1035609 - DNA, 22 bp, Artificial Sequence
  chemically synthesized
tcagcatcctgtatgtgcttat

SEQ ID NO: 1035610 - DNA, 22 bp, Artificial Sequence
  chemically synthesized
ggaagatacatgataagcacat

SEQ ID NO: 1035611 - DNA, 22 bp, Artificial Sequence
  chemically synthesized
tatgtgcttatcatgtatcttc

SEQ ID NO: 1035612 - DNA, 22 bp, Artificial Sequence
  chemically synthesized
atcatgtatcttcccaactaca

SEQ ID NO: 1035613 - DNA, 22 bp, Artificial Sequence
  chemically synthesized
tcatgtatcttcccaactacat

SEQ ID NO: 1035614 - DNA, 22 bp, Artificial Sequence
  chemically synthesized
tcacaatgccatatgtagttgg

SEQ ID NO: 1035615 - DNA, 22 bp, Artificial Sequence
  chemically synthesized
gtcacaatgccatatgtagttg

SEQ ID NO: 1035616 - DNA, 22 bp, Artificial Sequence
  chemically synthesized
tttgtcacaatgccatatgtag

SEQ ID NO: 1035617 - DNA, 22 bp, Artificial Sequence
  chemically synthesized
tatttgtcacaatgccatatgt

SEQ ID NO: 1035618 - DNA, 22 bp, Artificial Sequence
  chemically synthesized
ctatttgtcacaatgccatatg

SEQ ID NO: 1035619 - DNA, 22 bp, Artificial Sequence
  chemically synthesized
ttctatttgtcacaatgccata

SEQ ID NO: 1035620 - DNA, 22 bp, Artificial Sequence
  chemically synthesized
cccaactacatatggcattgtg

SEQ ID NO: 1035621 - DNA, 22 bp, Artificial Sequence
  chemically synthesized
ccaactacatatggcattgtga

SEQ ID NO: 1035622 - DNA, 22 bp, Artificial Sequence
  chemically synthesized
gcagcctcttctatttgtcaca

SEQ ID NO: 1035623 - DNA, 22 bp, Artificial Sequence
  chemically synthesized
catatggcattgtgacaaatag

SEQ ID NO: 1035624 - DNA, 22 bp, Artificial Sequence
  chemically synthesized
tagcagcattagcagcctcttc

SEQ ID NO: 1035625 - DNA, 22 bp, Artificial Sequence
  chemically synthesized
tgacaaatagaagaggctgcta

SEQ ID NO: 1035626 - DNA, 22 bp, Artificial Sequence
  chemically synthesized
agctatagcagcattagcagcc

SEQ ID NO: 1035627 - DNA, 22 bp, Artificial Sequence
  chemically synthesized
aatgagacattcagctatagca

SEQ ID NO: 1035628 - DNA, 22 bp, Artificial Sequence
  chemically synthesized
ctaaatgagacattcagctata

SEQ ID NO: 1035629 - DNA, 22 bp, Artificial Sequence
  chemically synthesized
ctaatgctgctatagctgaatg

SEQ ID NO: 1035630 - DNA, 22 bp, Artificial Sequence
  chemically synthesized
ttcctaaatgagacattcagct

SEQ ID NO: 1035631 - DNA, 22 bp, Artificial Sequence
  chemically synthesized
gttcctaaatgagacattcagc

SEQ ID NO: 1035632 - DNA, 22 bp, Artificial Sequence
  chemically synthesized
atgctgctatagctgaatgtct

SEQ ID NO: 1035633 - DNA, 22 bp, Artificial Sequence
  chemically synthesized
tttgttcctaaatgagacattc

SEQ ID NO: 1035634 - DNA, 22 bp, Artificial Sequence
  chemically synthesized
ctatagctgaatgtctcattta

SEQ ID NO: 1035635 - DNA, 22 bp, Artificial Sequence
  chemically synthesized
tagctgaatgtctcatttagga

SEQ ID NO: 1035636 - DNA, 22 bp, Artificial Sequence
  chemically synthesized
cagaattgtttgttcctaaatg

SEQ ID NO: 1035637 - DNA, 22 bp, Artificial Sequence
  chemically synthesized
ccagaattgtttgttcctaaat

SEQ ID NO: 1035638 - DNA, 22 bp, Artificial Sequence
  chemically synthesized
tccagaattgtttgttcctaaa

SEQ ID NO: 1035639 - DNA, 22 bp, Artificial Sequence
  chemically synthesized
ttccagaattgtttgttcctaa

SEQ ID NO: 1035640 - DNA, 22 bp, Artificial Sequence
  chemically synthesized
aatgtctcatttaggaacaaac

SEQ ID NO: 1035641 - DNA, 22 bp, Artificial Sequence
  chemically synthesized
ggagcttttccagaattgtttg

SEQ ID NO: 1035642 - DNA, 22 bp, Artificial Sequence
  chemically synthesized
atttaggaacaaacaattctgg

SEQ ID NO: 1035643 - DNA, 22 bp, Artificial Sequence
  chemically synthesized
aggaacaaacaattctggaaaa

SEQ ID NO: 1035644 - DNA, 22 bp, Artificial Sequence
  chemically synthesized
ggaacaaacaattctggaaaag

SEQ ID NO: 1035645 - DNA, 22 bp, Artificial Sequence
  chemically synthesized
gagggacagatgcataatctgg

SEQ ID NO: 1035646 - DNA, 22 bp, Artificial Sequence
  chemically synthesized
tggaaaagctcccagattatgc

SEQ ID NO: 1035647 - DNA, 22 bp, Artificial Sequence
  chemically synthesized
gaaaagctcccagattatgcat

SEQ ID NO: 1035648 - DNA, 22 bp, Artificial Sequence
  chemically synthesized
ccagattatgcatctgtccctc

SEQ ID NO: 1035649 - DNA, 22 bp, Artificial Sequence
  chemically synthesized
aagtggaagctagagggacaga

SEQ ID NO: 1035650 - DNA, 22 bp, Artificial Sequence
  chemically synthesized
aaagtggaagctagagggacag

SEQ ID NO: 1035651 - DNA, 22 bp, Artificial Sequence
  chemically synthesized
taaagtggaagctagagggaca

SEQ ID NO: 1035652 - DNA, 22 bp, Artificial Sequence
  chemically synthesized
ttaaagtggaagctagagggac

SEQ ID NO: 1035653 - DNA, 22 bp, Artificial Sequence
  chemically synthesized
tcttttaaagtggaagctagag

SEQ ID NO: 1035654 - DNA, 22 bp, Artificial Sequence
  chemically synthesized
tgcatctgtccctctagcttcc

SEQ ID NO: 1035655 - DNA, 22 bp, Artificial Sequence
  chemically synthesized
atcttttaaagtggaagctaga

SEQ ID NO: 1035656 - DNA, 22 bp, Artificial Sequence
  chemically synthesized
tatcttttaaagtggaagctag

SEQ ID NO: 1035657 - DNA, 22 bp, Artificial Sequence
  chemically synthesized
tccctctagcttccactttaaa

SEQ ID NO: 1035658 - DNA, 22 bp, Artificial Sequence
  chemically synthesized
tagaattttatcttttaaagtg

SEQ ID NO: 1035659 - DNA, 22 bp, Artificial Sequence
  chemically synthesized
tagcttccactttaaaagataa

SEQ ID NO: 1035660 - DNA, 22 bp, Artificial Sequence
  chemically synthesized
tcactatagaattttatctttt

SEQ ID NO: 1035661 - DNA, 22 bp, Artificial Sequence
  chemically synthesized
gcttccactttaaaagataaaa

SEQ ID NO: 1035662 - DNA, 22 bp, Artificial Sequence
  chemically synthesized
ccactttaaaagataaaattct

SEQ ID NO: 1035663 - DNA, 22 bp, Artificial Sequence
  chemically synthesized
cactttaaaagataaaattcta

SEQ ID NO: 1035664 - DNA, 22 bp, Artificial Sequence
  chemically synthesized
acgttatcactatagaatttta

SEQ ID NO: 1035665 - DNA, 22 bp, Artificial Sequence
  chemically synthesized
taaaagataaaattctatagtg

SEQ ID NO: 1035666 - DNA, 22 bp, Artificial Sequence
  chemically synthesized
aaaagataaaattctatagtga

SEQ ID NO: 1035667 - DNA, 22 bp, Artificial Sequence
  chemically synthesized
atcctcacgttatcactataga

SEQ ID NO: 1035668 - DNA, 22 bp, Artificial Sequence
  chemically synthesized
aaagataaaattctatagtgat

SEQ ID NO: 1035669 - DNA, 22 bp, Artificial Sequence
  chemically synthesized
tatagtgataacgtgaggatta

SEQ ID NO: 1035670 - DNA, 22 bp, Artificial Sequence
  chemically synthesized
tagtgataacgtgaggattagt

SEQ ID NO: 1035671 - DNA, 22 bp, Artificial Sequence
  chemically synthesized
cccatataaggaaagaatagta

SEQ ID NO: 1035672 - DNA, 22 bp, Artificial Sequence
  chemically synthesized
acattacccatataaggaaaga

SEQ ID NO: 1035673 - DNA, 22 bp, Artificial Sequence
  chemically synthesized
gtatactattctttccttatat

SEQ ID NO: 1035674 - DNA, 22 bp, Artificial Sequence
  chemically synthesized
ttctttccttatatgggtaatg

SEQ ID NO: 1035675 - DNA, 22 bp, Artificial Sequence
  chemically synthesized
tttccttatatgggtaatgtga

SEQ ID NO: 1035676 - DNA, 22 bp, Artificial Sequence
  chemically synthesized
tccttatatgggtaatgtgagg

SEQ ID NO: 1035677 - DNA, 22 bp, Artificial Sequence
  chemically synthesized
ccttatatgggtaatgtgaggt

SEQ ID NO: 1035678 - DNA, 22 bp, Artificial Sequence
  chemically synthesized
cttatatgggtaatgtgaggtt

SEQ ID NO: 1035679 - DNA, 22 bp, Artificial Sequence
  chemically synthesized
atatgggtaatgtgaggttatt

SEQ ID NO: 1035680 - DNA, 22 bp, Artificial Sequence
  chemically synthesized
tatgggtaatgtgaggttattt

SEQ ID NO: 1035681 - DNA, 22 bp, Artificial Sequence
  chemically synthesized
atgtcaaggtaaggaaataacc

SEQ ID NO: 1035682 - DNA, 22 bp, Artificial Sequence
  chemically synthesized
catgtcaaggtaaggaaataac

SEQ ID NO: 1035683 - DNA, 22 bp, Artificial Sequence
  chemically synthesized
tcatgtcaaggtaaggaaataa

SEQ ID NO: 1035684 - DNA, 22 bp, Artificial Sequence
  chemically synthesized
tttcatgtcaaggtaaggaaat

SEQ ID NO: 1035685 - DNA, 22 bp, Artificial Sequence
  chemically synthesized
ctttcatgtcaaggtaaggaaa

SEQ ID NO: 1035686 - DNA, 22 bp, Artificial Sequence
  chemically synthesized
tctttcatgtcaaggtaaggaa

SEQ ID NO: 1035687 - DNA, 22 bp, Artificial Sequence
  chemically synthesized
tttccttaccttgacatgaaag

SEQ ID NO: 1035688 - DNA, 22 bp, Artificial Sequence
  chemically synthesized
aataaataattttctttcatgt

SEQ ID NO: 1035689 - DNA, 22 bp, Artificial Sequence
  chemically synthesized
ccttaccttgacatgaaagaaa

SEQ ID NO: 1035690 - DNA, 22 bp, Artificial Sequence
  chemically synthesized
cttaccttgacatgaaagaaaa

SEQ ID NO: 1035691 - DNA, 22 bp, Artificial Sequence
  chemically synthesized
accttgacatgaaagaaaatta

SEQ ID NO: 1035692 - DNA, 22 bp, Artificial Sequence
  chemically synthesized
ccttgacatgaaagaaaattat

SEQ ID NO: 1035693 - DNA, 22 bp, Artificial Sequence
  chemically synthesized
agacattcaataaataattttc

SEQ ID NO: 1035694 - DNA, 22 bp, Artificial Sequence
  chemically synthesized
gacatgaaagaaaattatttat

SEQ ID NO: 1035695 - DNA, 22 bp, Artificial Sequence
  chemically synthesized
ctgagacattcaataaataatt

SEQ ID NO: 1035696 - DNA, 22 bp, Artificial Sequence
  chemically synthesized
acatgaaagaaaattatttatt

SEQ ID NO: 1035697 - DNA, 22 bp, Artificial Sequence
  chemically synthesized
tactgagacattcaataaataa

SEQ ID NO: 1035698 - DNA, 22 bp, Artificial Sequence
  chemically synthesized
ctactgagacattcaataaata

SEQ ID NO: 1035699 - DNA, 22 bp, Artificial Sequence
  chemically synthesized
tctactgagacattcaataaat

SEQ ID NO: 1035700 - DNA, 22 bp, Artificial Sequence
  chemically synthesized
taatctttctactgagacattc

SEQ ID NO: 1035701 - DNA, 22 bp, Artificial Sequence
  chemically synthesized
agttgtaatctttctactgaga

SEQ ID NO: 1035702 - DNA, 22 bp, Artificial Sequence
  chemically synthesized
tttattgaatgtctcagtagaa

SEQ ID NO: 1035703 - DNA, 22 bp, Artificial Sequence
  chemically synthesized
attgaatgtctcagtagaaaga

SEQ ID NO: 1035704 - DNA, 22 bp, Artificial Sequence
  chemically synthesized
tctcagttgtaatctttctact

SEQ ID NO: 1035705 - DNA, 22 bp, Artificial Sequence
  chemically synthesized
ttgaatgtctcagtagaaagat

SEQ ID NO: 1035706 - DNA, 22 bp, Artificial Sequence
  chemically synthesized
ctatctcagttgtaatctttct

SEQ ID NO: 1035707 - DNA, 22 bp, Artificial Sequence
  chemically synthesized
aatgtctcagtagaaagattac

SEQ ID NO: 1035708 - DNA, 22 bp, Artificial Sequence
  chemically synthesized
gctatctcagttgtaatctttc

SEQ ID NO: 1035709 - DNA, 22 bp, Artificial Sequence
  chemically synthesized
agtagaaagattacaactgaga

SEQ ID NO: 1035710 - DNA, 22 bp, Artificial Sequence
  chemically synthesized
ataagaatttgctatctcagtt

SEQ ID NO: 1035711 - DNA, 22 bp, Artificial Sequence
  chemically synthesized
tgataagaatttgctatctcag

SEQ ID NO: 1035712 - DNA, 22 bp, Artificial Sequence
  chemically synthesized
ctgataagaatttgctatctca

SEQ ID NO: 1035713 - DNA, 22 bp, Artificial Sequence
  chemically synthesized
caactgagatagcaaattctta

SEQ ID NO: 1035714 - DNA, 22 bp, Artificial Sequence
  chemically synthesized
atgtgagtttctgataagaatt

SEQ ID NO: 1035715 - DNA, 22 bp, Artificial Sequence
  chemically synthesized
ctaatgtgagtttctgataaga

SEQ ID NO: 1035716 - DNA, 22 bp, Artificial Sequence
  chemically synthesized
agatagcaaattcttatcagaa

SEQ ID NO: 1035717 - DNA, 22 bp, Artificial Sequence
  chemically synthesized
caagcccattcctaatgtgagt

SEQ ID NO: 1035718 - DNA, 22 bp, Artificial Sequence
  chemically synthesized
tgcaagcccattcctaatgtga

SEQ ID NO: 1035719 - DNA, 22 bp, Artificial Sequence
  chemically synthesized
ttatcagaaactcacattagga

SEQ ID NO: 1035720 - DNA, 22 bp, Artificial Sequence
  chemically synthesized
atcagaaactcacattaggaat

SEQ ID NO: 1035721 - DNA, 22 bp, Artificial Sequence
  chemically synthesized
tcagaaactcacattaggaatg

SEQ ID NO: 1035722 - DNA, 22 bp, Artificial Sequence
  chemically synthesized
acattaggaatgggcttgcaga

SEQ ID NO: 1035723 - DNA, 22 bp, Artificial Sequence
  chemically synthesized
ggaatgggcttgcagaattgca

SEQ ID NO: 1035724 - DNA, 22 bp, Artificial Sequence
  chemically synthesized
agacagtagggaatgagcatgc

SEQ ID NO: 1035725 - DNA, 22 bp, Artificial Sequence
  chemically synthesized
gcagaattgcatgctcattccc

SEQ ID NO: 1035726 - DNA, 22 bp, Artificial Sequence
  chemically synthesized
cagaattgcatgctcattccct

SEQ ID NO: 1035727 - DNA, 22 bp, Artificial Sequence
  chemically synthesized
tattcagacagtagggaatgag

SEQ ID NO: 1035728 - DNA, 22 bp, Artificial Sequence
  chemically synthesized
tgtattcagacagtagggaatg

SEQ ID NO: 1035729 - DNA, 22 bp, Artificial Sequence
  chemically synthesized
catgctcattccctactgtctg

SEQ ID NO: 1035730 - DNA, 22 bp, Artificial Sequence
  chemically synthesized
atcgtctctgtattcagacagt

SEQ ID NO: 1035731 - DNA, 22 bp, Artificial Sequence
  chemically synthesized
attccctactgtctgaatacag

SEQ ID NO: 1035732 - DNA, 22 bp, Artificial Sequence
  chemically synthesized
cctactgtctgaatacagagac

SEQ ID NO: 1035733 - DNA, 22 bp, Artificial Sequence
  chemically synthesized
ctgtctgaatacagagacgatt

SEQ ID NO: 1035734 - DNA, 22 bp, Artificial Sequence
  chemically synthesized
tctgaatacagagacgattagg

SEQ ID NO: 1035735 - DNA, 22 bp, Artificial Sequence
  chemically synthesized
gaagagaaagtccctaatcgtc

SEQ ID NO: 1035736 - DNA, 22 bp, Artificial Sequence
  chemically synthesized
aatacagagacgattagggact

SEQ ID NO: 1035737 - DNA, 22 bp, Artificial Sequence
  chemically synthesized
gggactttctcttcgaatctga

SEQ ID NO: 1035738 - DNA, 22 bp, Artificial Sequence
  chemically synthesized
tctcttcgaatctgatttattt

SEQ ID NO: 1035739 - DNA, 22 bp, Artificial Sequence
  chemically synthesized
ctcttcgaatctgatttatttg

SEQ ID NO: 1035740 - DNA, 22 bp, Artificial Sequence
  chemically synthesized
tcttcgaatctgatttatttgg

SEQ ID NO: 1035741 - DNA, 22 bp, Artificial Sequence
  chemically synthesized
ttcgaatctgatttatttggtt

SEQ ID NO: 1035742 - DNA, 22 bp, Artificial Sequence
  chemically synthesized
cgaatctgatttatttggtttc

SEQ ID NO: 1035743 - DNA, 22 bp, Artificial Sequence
  chemically synthesized
gaatctgatttatttggtttct

SEQ ID NO: 1035744 - DNA, 22 bp, Artificial Sequence
  chemically synthesized
atttatttggtttctactcctg

SEQ ID NO: 1035745 - DNA, 22 bp, Artificial Sequence
  chemically synthesized
atttggtttctactcctgtttt

SEQ ID NO: 1035746 - DNA, 22 bp, Artificial Sequence
  chemically synthesized
tttggtttctactcctgttttc

SEQ ID NO: 1035747 - DNA, 22 bp, Artificial Sequence
  chemically synthesized
ggtttctactcctgttttctct

SEQ ID NO: 1035748 - DNA, 22 bp, Artificial Sequence
  chemically synthesized
gtttctactcctgttttctctc

SEQ ID NO: 1035749 - DNA, 22 bp, Artificial Sequence
  chemically synthesized
ctactcctgttttctctccttt

SEQ ID NO: 1035750 - DNA, 22 bp, Artificial Sequence
  chemically synthesized
tactcctgttttctctcctttc

SEQ ID NO: 1035751 - DNA, 22 bp, Artificial Sequence
  chemically synthesized
ctcctgttttctctcctttcgt

SEQ ID NO: 1035752 - DNA, 22 bp, Artificial Sequence
  chemically synthesized
ctgttttctctcctttcgtttc

SEQ ID NO: 1035753 - DNA, 22 bp, Artificial Sequence
  chemically synthesized
ttttctctcctttcgtttcttt

SEQ ID NO: 1035754 - DNA, 22 bp, Artificial Sequence
  chemically synthesized
tctctcctttcgtttctttcat

SEQ ID NO: 1035755 - DNA, 22 bp, Artificial Sequence
  chemically synthesized
ctctcctttcgtttctttcatt

SEQ ID NO: 1035756 - DNA, 22 bp, Artificial Sequence
  chemically synthesized
tctcctttcgtttctttcattt

SEQ ID NO: 1035757 - DNA, 22 bp, Artificial Sequence
  chemically synthesized
tcctttcgtttctttcattttc

SEQ ID NO: 1035758 - DNA, 22 bp, Artificial Sequence
  chemically synthesized
ctttcgtttctttcattttctc

SEQ ID NO: 1035759 - DNA, 22 bp, Artificial Sequence
  chemically synthesized
catgaagaaaaatgagaaaatg

SEQ ID NO: 1035760 - DNA, 22 bp, Artificial Sequence
  chemically synthesized
tcgtttctttcattttctcatt

SEQ ID NO: 1035761 - DNA, 22 bp, Artificial Sequence
  chemically synthesized
cgtttctttcattttctcattt

SEQ ID NO: 1035762 - DNA, 22 bp, Artificial Sequence
  chemically synthesized
gtttctttcattttctcatttt

SEQ ID NO: 1035763 - DNA, 22 bp, Artificial Sequence
  chemically synthesized
tgctacatgaagaaaaatgaga

SEQ ID NO: 1035764 - DNA, 22 bp, Artificial Sequence
  chemically synthesized
gtgctacatgaagaaaaatgag

SEQ ID NO: 1035765 - DNA, 22 bp, Artificial Sequence
  chemically synthesized
ctttcattttctcatttttctt

SEQ ID NO: 1035766 - DNA, 22 bp, Artificial Sequence
  chemically synthesized
tttcattttctcatttttcttc

SEQ ID NO: 1035767 - DNA, 22 bp, Artificial Sequence
  chemically synthesized
tcattttctcatttttcttcat

SEQ ID NO: 1035768 - DNA, 22 bp, Artificial Sequence
  chemically synthesized
cattttctcatttttcttcatg

SEQ ID NO: 1035769 - DNA, 22 bp, Artificial Sequence
  chemically synthesized
ccatttgtgctacatgaagaaa

SEQ ID NO: 1035770 - DNA, 22 bp, Artificial Sequence
  chemically synthesized
attttctcatttttcttcatgt

SEQ ID NO: 1035771 - DNA, 22 bp, Artificial Sequence
  chemically synthesized
gctgccatttgtgctacatgaa

SEQ ID NO: 1035772 - DNA, 22 bp, Artificial Sequence
  chemically synthesized
tctcatttttcttcatgtagca

SEQ ID NO: 1035773 - DNA, 22 bp, Artificial Sequence
  chemically synthesized
ctcatttttcttcatgtagcac

SEQ ID NO: 1035774 - DNA, 22 bp, Artificial Sequence
  chemically synthesized
tggctgccatttgtgctacatg

SEQ ID NO: 1035775 - DNA, 22 bp, Artificial Sequence
  chemically synthesized
tcatttttcttcatgtagcaca

SEQ ID NO: 1035776 - DNA, 22 bp, Artificial Sequence
  chemically synthesized
atttttcttcatgtagcacaaa

SEQ ID NO: 1035777 - DNA, 22 bp, Artificial Sequence
  chemically synthesized
ttcttcatgtagcacaaatggc

SEQ ID NO: 1035778 - DNA, 22 bp, Artificial Sequence
  chemically synthesized
tcttcatgtagcacaaatggca

SEQ ID NO: 1035779 - DNA, 22 bp, Artificial Sequence
  chemically synthesized
acaggctctggctgccatttgt

SEQ ID NO: 1035780 - DNA, 22 bp, Artificial Sequence
  chemically synthesized
cttcatgtagcacaaatggcag

SEQ ID NO: 1035781 - DNA, 22 bp, Artificial Sequence
  chemically synthesized
ttcatgtagcacaaatggcagc

SEQ ID NO: 1035782 - DNA, 22 bp, Artificial Sequence
  chemically synthesized
catgtagcacaaatggcagcca

SEQ ID NO: 1035783 - DNA, 22 bp, Artificial Sequence
  chemically synthesized
atgtagcacaaatggcagccag

SEQ ID NO: 1035784 - DNA, 22 bp, Artificial Sequence
  chemically synthesized
aagcactcacaggctctggctg

SEQ ID NO: 1035785 - DNA, 22 bp, Artificial Sequence
  chemically synthesized
cagcattaaagcactcacaggc

SEQ ID NO: 1035786 - DNA, 22 bp, Artificial Sequence
  chemically synthesized
atagcagtaagcctgcagcatt

SEQ ID NO: 1035787 - DNA, 22 bp, Artificial Sequence
  chemically synthesized
tgagtgctttaatgctgcaggc

SEQ ID NO: 1035788 - DNA, 22 bp, Artificial Sequence
  chemically synthesized
tcatagcagtaagcctgcagca

SEQ ID NO: 1035789 - DNA, 22 bp, Artificial Sequence
  chemically synthesized
agttctcatagcagtaagcctg

SEQ ID NO: 1035790 - DNA, 22 bp, Artificial Sequence
  chemically synthesized
ttcagttctcatagcagtaagc

SEQ ID NO: 1035791 - DNA, 22 bp, Artificial Sequence
  chemically synthesized
taatgctgcaggcttactgcta

SEQ ID NO: 1035792 - DNA, 22 bp, Artificial Sequence
  chemically synthesized
aatgctgcaggcttactgctat

SEQ ID NO: 1035793 - DNA, 22 bp, Artificial Sequence
  chemically synthesized
atgctgcaggcttactgctatg

SEQ ID NO: 1035794 - DNA, 22 bp, Artificial Sequence
  chemically synthesized
cattgttcagttctcatagcag

SEQ ID NO: 1035795 - DNA, 22 bp, Artificial Sequence
  chemically synthesized
tccattgttcagttctcatagc

SEQ ID NO: 1035796 - DNA, 22 bp, Artificial Sequence
  chemically synthesized
ctccattgttcagttctcatag

SEQ ID NO: 1035797 - DNA, 22 bp, Artificial Sequence
  chemically synthesized
caggcttactgctatgagaact

SEQ ID NO: 1035798 - DNA, 22 bp, Artificial Sequence
  chemically synthesized
actgctatgagaactgaacaat

SEQ ID NO: 1035799 - DNA, 22 bp, Artificial Sequence
  chemically synthesized
ctgctatgagaactgaacaatg

SEQ ID NO: 1035800 - DNA, 22 bp, Artificial Sequence
  chemically synthesized
cccagggatttctccattgttc

SEQ ID NO: 1035801 - DNA, 22 bp, Artificial Sequence
  chemically synthesized
ctatgagaactgaacaatggag

SEQ ID NO: 1035802 - DNA, 22 bp, Artificial Sequence
  chemically synthesized
ccccagggatttctccattgtt

SEQ ID NO: 1035803 - DNA, 22 bp, Artificial Sequence
  chemically synthesized
tgagaactgaacaatggagaaa

SEQ ID NO: 1035804 - DNA, 22 bp, Artificial Sequence
  chemically synthesized
cttccccagggatttctccatt

SEQ ID NO: 1035805 - DNA, 22 bp, Artificial Sequence
  chemically synthesized
gaagctgcttccccagggattt

SEQ ID NO: 1035806 - DNA, 22 bp, Artificial Sequence
  chemically synthesized
aacaatggagaaatccctgggg

SEQ ID NO: 1035807 - DNA, 22 bp, Artificial Sequence
  chemically synthesized
agggtgggacagttggaagctg

SEQ ID NO: 1035808 - DNA, 22 bp, Artificial Sequence
  chemically synthesized
gggaagcagcttccaactgtcc

SEQ ID NO: 1035809 - DNA, 22 bp, Artificial Sequence
  chemically synthesized
ggatgctgagggtgggacagtt

SEQ ID NO: 1035810 - DNA, 22 bp, Artificial Sequence
  chemically synthesized
ccaactgtcccaccctcagcat

SEQ ID NO: 1035811 - DNA, 22 bp, Artificial Sequence
  chemically synthesized
caactgtcccaccctcagcatc

SEQ ID NO: 1035812 - DNA, 22 bp, Artificial Sequence
  chemically synthesized
cacaggtcattaggatgctgag

SEQ ID NO: 1035813 - DNA, 22 bp, Artificial Sequence
  chemically synthesized
tcccaccctcagcatcctaatg

SEQ ID NO: 1035814 - DNA, 22 bp, Artificial Sequence
  chemically synthesized
gaaccacagttccacaggtcat

SEQ ID NO: 1035815 - DNA, 22 bp, Artificial Sequence
  chemically synthesized
tggaaccacagttccacaggtc

SEQ ID NO: 1035816 - DNA, 22 bp, Artificial Sequence
  chemically synthesized
agcatcctaatgacctgtggaa

SEQ ID NO: 1035817 - DNA, 22 bp, Artificial Sequence
  chemically synthesized
atgacctgtggaactgtggttc

SEQ ID NO: 1035818 - DNA, 22 bp, Artificial Sequence
  chemically synthesized
tcaccaccattctggaaccaca

SEQ ID NO: 1035819 - DNA, 22 bp, Artificial Sequence
  chemically synthesized
atcaccaccattctggaaccac

SEQ ID NO: 1035820 - DNA, 22 bp, Artificial Sequence
  chemically synthesized
tggaactgtggttccagaatgg

SEQ ID NO: 1035821 - DNA, 22 bp, Artificial Sequence
  chemically synthesized
caaatttatcaccaccattctg

SEQ ID NO: 1035822 - DNA, 22 bp, Artificial Sequence
  chemically synthesized
ccaaatttatcaccaccattct

SEQ ID NO: 1035823 - DNA, 22 bp, Artificial Sequence
  chemically synthesized
tccaaatttatcaccaccattc

SEQ ID NO: 1035824 - DNA, 22 bp, Artificial Sequence
  chemically synthesized
tggttccagaatggtggtgata

SEQ ID NO: 1035825 - DNA, 22 bp, Artificial Sequence
  chemically synthesized
cagaatggtggtgataaatttg

SEQ ID NO: 1035826 - DNA, 22 bp, Artificial Sequence
  chemically synthesized
gagaaagtattttccaaattta

SEQ ID NO: 1035827 - DNA, 22 bp, Artificial Sequence
  chemically synthesized
agagaaagtattttccaaattt

SEQ ID NO: 1035828 - DNA, 22 bp, Artificial Sequence
  chemically synthesized
tagagaaagtattttccaaatt

SEQ ID NO: 1035829 - DNA, 22 bp, Artificial Sequence
  chemically synthesized
ctttagagaaagtattttccaa

SEQ ID NO: 1035830 - DNA, 22 bp, Artificial Sequence
  chemically synthesized
ctgctttagagaaagtattttc

SEQ ID NO: 1035831 - DNA, 22 bp, Artificial Sequence
  chemically synthesized
ggaaaatactttctctaaagca

SEQ ID NO: 1035832 - DNA, 22 bp, Artificial Sequence
  chemically synthesized
gaaaatactttctctaaagcag

SEQ ID NO: 1035833 - DNA, 22 bp, Artificial Sequence
  chemically synthesized
tctctaaagcagtagtgcccac

SEQ ID NO: 1035834 - DNA, 22 bp, Artificial Sequence
  chemically synthesized
tcagataaatatgtgggcacta

SEQ ID NO: 1035835 - DNA, 22 bp, Artificial Sequence
  chemically synthesized
ctctaaagcagtagtgcccaca

SEQ ID NO: 1035836 - DNA, 22 bp, Artificial Sequence
  chemically synthesized
tctaaagcagtagtgcccacat

SEQ ID NO: 1035837 - DNA, 22 bp, Artificial Sequence
  chemically synthesized
taaagcagtagtgcccacatat

SEQ ID NO: 1035838 - DNA, 22 bp, Artificial Sequence
  chemically synthesized
aagcagtagtgcccacatattt

SEQ ID NO: 1035839 - DNA, 22 bp, Artificial Sequence
  chemically synthesized
cccagtacagcctgtcagataa

SEQ ID NO: 1035840 - DNA, 22 bp, Artificial Sequence
  chemically synthesized
taattgcccagtacagcctgtc

SEQ ID NO: 1035841 - DNA, 22 bp, Artificial Sequence
  chemically synthesized
ataattgcccagtacagcctgt

SEQ ID NO: 1035842 - DNA, 22 bp, Artificial Sequence
  chemically synthesized
tataattgcccagtacagcctg

SEQ ID NO: 1035843 - DNA, 22 bp, Artificial Sequence
  chemically synthesized
atctgacaggctgtactgggca

SEQ ID NO: 1035844 - DNA, 22 bp, Artificial Sequence
  chemically synthesized
tctgacaggctgtactgggcaa

SEQ ID NO: 1035845 - DNA, 22 bp, Artificial Sequence
  chemically synthesized
aacattttataattgcccagta

SEQ ID NO: 1035846 - DNA, 22 bp, Artificial Sequence
  chemically synthesized
acaggctgtactgggcaattat

SEQ ID NO: 1035847 - DNA, 22 bp, Artificial Sequence
  chemically synthesized
tactgggcaattataaaatgtt

SEQ ID NO: 1035848 - DNA, 22 bp, Artificial Sequence
  chemically synthesized
accatggacccctgaacatttt

SEQ ID NO: 1035849 - DNA, 22 bp, Artificial Sequence
  chemically synthesized
caccatggacccctgaacattt

SEQ ID NO: 1035850 - DNA, 22 bp, Artificial Sequence
  chemically synthesized
ggcaattataaaatgttcaggg

SEQ ID NO: 1035851 - DNA, 22 bp, Artificial Sequence
  chemically synthesized
gcatttcaccatggacccctga

SEQ ID NO: 1035852 - DNA, 22 bp, Artificial Sequence
  chemically synthesized
ggcatttcaccatggacccctg

SEQ ID NO: 1035853 - DNA, 22 bp, Artificial Sequence
  chemically synthesized
tggcatttcaccatggacccct

SEQ ID NO: 1035854 - DNA, 22 bp, Artificial Sequence
  chemically synthesized
ttggcatttcaccatggacccc

SEQ ID NO: 1035855 - DNA, 22 bp, Artificial Sequence
  chemically synthesized
taaaatgttcaggggtccatgg

SEQ ID NO: 1035856 - DNA, 22 bp, Artificial Sequence
  chemically synthesized
tttttggcatttcaccatggac

SEQ ID NO: 1035857 - DNA, 22 bp, Artificial Sequence
  chemically synthesized
tatttttggcatttcaccatgg

SEQ ID NO: 1035858 - DNA, 22 bp, Artificial Sequence
  chemically synthesized
ttctatttttggcatttcacca

SEQ ID NO: 1035859 - DNA, 22 bp, Artificial Sequence
  chemically synthesized
aggggtccatggtgaaatgcca

SEQ ID NO: 1035860 - DNA, 22 bp, Artificial Sequence
  chemically synthesized
ggaaaagcataccgcattgttc

SEQ ID NO: 1035861 - DNA, 22 bp, Artificial Sequence
  chemically synthesized
aggaaaagcataccgcattgtt

SEQ ID NO: 1035862 - DNA, 22 bp, Artificial Sequence
  chemically synthesized
taggaaaagcataccgcattgt

SEQ ID NO: 1035863 - DNA, 22 bp, Artificial Sequence
  chemically synthesized
ataaagaaggtgtagctttagg

SEQ ID NO: 1035864 - DNA, 22 bp, Artificial Sequence
  chemically synthesized
aataaagaaggtgtagctttag

SEQ ID NO: 1035865 - DNA, 22 bp, Artificial Sequence
  chemically synthesized
taataaagaaggtgtagcttta

SEQ ID NO: 1035866 - DNA, 22 bp, Artificial Sequence
  chemically synthesized
ttttaataaagaaggtgtagct

SEQ ID NO: 1035867 - DNA, 22 bp, Artificial Sequence
  chemically synthesized
ttcctaaagctacaccttcttt

SEQ ID NO: 1035868 - DNA, 22 bp, Artificial Sequence
  chemically synthesized
tcctaaagctacaccttcttta

SEQ ID NO: 1035869 - DNA, 22 bp, Artificial Sequence
  chemically synthesized
cctaaagctacaccttctttat

SEQ ID NO: 1035870 - DNA, 22 bp, Artificial Sequence
  chemically synthesized
ctaaagctacaccttctttatt

SEQ ID NO: 1035871 - DNA, 22 bp, Artificial Sequence
  chemically synthesized
aagctacaccttctttattaaa

SEQ ID NO: 1035872 - DNA, 22 bp, Artificial Sequence
  chemically synthesized
caccttctttattaaaacaatt

SEQ ID NO: 1035873 - DNA, 22 bp, Artificial Sequence
  chemically synthesized
ctttattaaaacaattatgatt

SEQ ID NO: 1035874 - DNA, 22 bp, Artificial Sequence
  chemically synthesized
tttattaaaacaattatgattt

SEQ ID NO: 1035875 - DNA, 22 bp, Artificial Sequence
  chemically synthesized
tattaaaacaattatgatttat

SEQ ID NO: 1035876 - DNA, 22 bp, Artificial Sequence
  chemically synthesized
attaaaacaattatgatttatg

SEQ ID NO: 1035877 - DNA, 22 bp, Artificial Sequence
  chemically synthesized
ttaaaacaattatgatttatgt

SEQ ID NO: 1035878 - DNA, 22 bp, Artificial Sequence
  chemically synthesized
agtacaggagggacataaatca

SEQ ID NO: 1035879 - DNA, 22 bp, Artificial Sequence
  chemically synthesized
aagtacaggagggacataaatc

SEQ ID NO: 1035880 - DNA, 22 bp, Artificial Sequence
  chemically synthesized
taagtacaggagggacataaat

SEQ ID NO: 1035881 - DNA, 22 bp, Artificial Sequence
  chemically synthesized
aaacaattatgatttatgtccc

SEQ ID NO: 1035882 - DNA, 22 bp, Artificial Sequence
  chemically synthesized
tgatttatgtccctcctgtact

SEQ ID NO: 1035883 - DNA, 22 bp, Artificial Sequence
  chemically synthesized
atgtccctcctgtacttaaagt

SEQ ID NO: 1035884 - DNA, 22 bp, Artificial Sequence
  chemically synthesized
tgtccctcctgtacttaaagta

SEQ ID NO: 1035885 - DNA, 22 bp, Artificial Sequence
  chemically synthesized
aaaataataaatatgtacttta

SEQ ID NO: 1035886 - DNA, 22 bp, Artificial Sequence
  chemically synthesized
aaaaataataaatatgtacttt

SEQ ID NO: 1035887 - DNA, 22 bp, Artificial Sequence
  chemically synthesized
taaaaataataaatatgtactt

SEQ ID NO: 1035888 - DNA, 22 bp, Artificial Sequence
  chemically synthesized
ctgtacttaaagtacatattta

SEQ ID NO: 1035889 - DNA, 22 bp, Artificial Sequence
  chemically synthesized
cattttaaaaataataaatatg

SEQ ID NO: 1035890 - DNA, 22 bp, Artificial Sequence
  chemically synthesized
tacttaaagtacatatttatta

SEQ ID NO: 1035891 - DNA, 22 bp, Artificial Sequence
  chemically synthesized
acattttaaaaataataaatat

SEQ ID NO: 1035892 - DNA, 22 bp, Artificial Sequence
  chemically synthesized
aaagtacatatttattattttt

SEQ ID NO: 1035893 - DNA, 22 bp, Artificial Sequence
  chemically synthesized
tacttacattttaaaaataata

SEQ ID NO: 1035894 - DNA, 22 bp, Artificial Sequence
  chemically synthesized
aagtacatatttattattttta

SEQ ID NO: 1035895 - DNA, 22 bp, Artificial Sequence
  chemically synthesized
atacttacattttaaaaataat

SEQ ID NO: 1035896 - DNA, 22 bp, Artificial Sequence
  chemically synthesized
aaatttatacttacattttaaa

SEQ ID NO: 1035897 - DNA, 22 bp, Artificial Sequence
  chemically synthesized
aactaaaatttatacttacatt

SEQ ID NO: 1035898 - DNA, 22 bp, Artificial Sequence
  chemically synthesized
attatttttaaaatgtaagtat

SEQ ID NO: 1035899 - DNA, 22 bp, Artificial Sequence
  chemically synthesized
ttatttttaaaatgtaagtata

SEQ ID NO: 1035900 - DNA, 22 bp, Artificial Sequence
  chemically synthesized
tttttaaaatgtaagtataaat

SEQ ID NO: 1035901 - DNA, 22 bp, Artificial Sequence
  chemically synthesized
gactgaactaaaatttatactt

SEQ ID NO: 1035902 - DNA, 22 bp, Artificial Sequence
  chemically synthesized
ttaaaatgtaagtataaatttt

SEQ ID NO: 1035903 - DNA, 22 bp, Artificial Sequence
  chemically synthesized
taaaatgtaagtataaatttta

SEQ ID NO: 1035904 - DNA, 22 bp, Artificial Sequence
  chemically synthesized
aaaatgtaagtataaattttag

SEQ ID NO: 1035905 - DNA, 22 bp, Artificial Sequence
  chemically synthesized
aaatgtaagtataaattttagt

SEQ ID NO: 1035906 - DNA, 22 bp, Artificial Sequence
  chemically synthesized
tgtgaatgctggactgaactaa

SEQ ID NO: 1035907 - DNA, 22 bp, Artificial Sequence
  chemically synthesized
tgtgtgaatgctggactgaact

SEQ ID NO: 1035908 - DNA, 22 bp, Artificial Sequence
  chemically synthesized
ctgtgtgaatgctggactgaac

SEQ ID NO: 1035909 - DNA, 22 bp, Artificial Sequence
  chemically synthesized
tagttcagtccagcattcacac

SEQ ID NO: 1035910 - DNA, 22 bp, Artificial Sequence
  chemically synthesized
agttcagtccagcattcacaca

SEQ ID NO: 1035911 - DNA, 22 bp, Artificial Sequence
  chemically synthesized
gttcagtccagcattcacacag

SEQ ID NO: 1035912 - DNA, 22 bp, Artificial Sequence
  chemically synthesized
agtccagcattcacacagaaat

SEQ ID NO: 1035913 - DNA, 22 bp, Artificial Sequence
  chemically synthesized
tgatgtgtacacatttctgtgt

SEQ ID NO: 1035914 - DNA, 22 bp, Artificial Sequence
  chemically synthesized
gtgatgtgtacacatttctgtg

SEQ ID NO: 1035915 - DNA, 22 bp, Artificial Sequence
  chemically synthesized
acacagaaatgtgtacacatca

SEQ ID NO: 1035916 - DNA, 22 bp, Artificial Sequence
  chemically synthesized
tggaaccatacacttgtgatgt

SEQ ID NO: 1035917 - DNA, 22 bp, Artificial Sequence
  chemically synthesized
atggaaccatacacttgtgatg

SEQ ID NO: 1035918 - DNA, 22 bp, Artificial Sequence
  chemically synthesized
gggaagtttatggaaccataca

SEQ ID NO: 1035919 - DNA, 22 bp, Artificial Sequence
  chemically synthesized
agggaagtttatggaaccatac

SEQ ID NO: 1035920 - DNA, 22 bp, Artificial Sequence
  chemically synthesized
tagggaagtttatggaaccata

SEQ ID NO: 1035921 - DNA, 22 bp, Artificial Sequence
  chemically synthesized
ctttagggaagtttatggaacc

SEQ ID NO: 1035922 - DNA, 22 bp, Artificial Sequence
  chemically synthesized
cctttagggaagtttatggaac

SEQ ID NO: 1035923 - DNA, 22 bp, Artificial Sequence
  chemically synthesized
atgtgtttcctttagggaagtt

SEQ ID NO: 1035924 - DNA, 22 bp, Artificial Sequence
  chemically synthesized
cattgatgtgtttcctttaggg

SEQ ID NO: 1035925 - DNA, 22 bp, Artificial Sequence
  chemically synthesized
gcattgatgtgtttcctttagg

SEQ ID NO: 1035926 - DNA, 22 bp, Artificial Sequence
  chemically synthesized
cataaacttccctaaaggaaac

SEQ ID NO: 1035927 - DNA, 22 bp, Artificial Sequence
  chemically synthesized
cttgcattgatgtgtttccttt

SEQ ID NO: 1035928 - DNA, 22 bp, Artificial Sequence
  chemically synthesized
ccctaaaggaaacacatcaatg

SEQ ID NO: 1035929 - DNA, 22 bp, Artificial Sequence
  chemically synthesized
cctaaaggaaacacatcaatgc

SEQ ID NO: 1035930 - DNA, 22 bp, Artificial Sequence
  chemically synthesized
atgtggatgctgcttgcattga

SEQ ID NO: 1035931 - DNA, 22 bp, Artificial Sequence
  chemically synthesized
aaggaaacacatcaatgcaagc

SEQ ID NO: 1035932 - DNA, 22 bp, Artificial Sequence
  chemically synthesized
gatgtggatgctgcttgcattg

SEQ ID NO: 1035933 - DNA, 22 bp, Artificial Sequence
  chemically synthesized
ttgatgtggatgctgcttgcat

SEQ ID NO: 1035934 - DNA, 22 bp, Artificial Sequence
  chemically synthesized
cttgatgtggatgctgcttgca

SEQ ID NO: 1035935 - DNA, 22 bp, Artificial Sequence
  chemically synthesized
tttcttgatgtggatgctgctt

SEQ ID NO: 1035936 - DNA, 22 bp, Artificial Sequence
  chemically synthesized
gtttcttgatgtggatgctgct

SEQ ID NO: 1035937 - DNA, 22 bp, Artificial Sequence
  chemically synthesized
tgtttcttgatgtggatgctgc

SEQ ID NO: 1035938 - DNA, 22 bp, Artificial Sequence
  chemically synthesized
ggtaatgttttgtttcttgatg

SEQ ID NO: 1035939 - DNA, 22 bp, Artificial Sequence
  chemically synthesized
gggactgggtaatgttttgttt

SEQ ID NO: 1035940 - DNA, 22 bp, Artificial Sequence
  chemically synthesized
tagggactgggtaatgttttgt

SEQ ID NO: 1035941 - DNA, 22 bp, Artificial Sequence
  chemically synthesized
ctagggactgggtaatgttttg

SEQ ID NO: 1035942 - DNA, 22 bp, Artificial Sequence
  chemically synthesized
aagcaggcttctagggactggg

SEQ ID NO: 1035943 - DNA, 22 bp, Artificial Sequence
  chemically synthesized
acaagggctgaagcaggcttct

SEQ ID NO: 1035944 - DNA, 22 bp, Artificial Sequence
  chemically synthesized
cccagtccctagaagcctgctt

SEQ ID NO: 1035945 - DNA, 22 bp, Artificial Sequence
  chemically synthesized
tgattaacaagggctgaagcag

SEQ ID NO: 1035946 - DNA, 22 bp, Artificial Sequence
  chemically synthesized
gaagcctgcttcagcccttgtt

SEQ ID NO: 1035947 - DNA, 22 bp, Artificial Sequence
  chemically synthesized
tgagttgtgattaacaagggct

SEQ ID NO: 1035948 - DNA, 22 bp, Artificial Sequence
  chemically synthesized
gtgagttgtgattaacaagggc

SEQ ID NO: 1035949 - DNA, 22 bp, Artificial Sequence
  chemically synthesized
tgtgagttgtgattaacaaggg

SEQ ID NO: 1035950 - DNA, 22 bp, Artificial Sequence
  chemically synthesized
cctttgtgagttgtgattaaca

SEQ ID NO: 1035951 - DNA, 22 bp, Artificial Sequence
  chemically synthesized
cttcagcccttgttaatcacaa

SEQ ID NO: 1035952 - DNA, 22 bp, Artificial Sequence
  chemically synthesized
cagcccttgttaatcacaactc

SEQ ID NO: 1035953 - DNA, 22 bp, Artificial Sequence
  chemically synthesized
agcccttgttaatcacaactca

SEQ ID NO: 1035954 - DNA, 22 bp, Artificial Sequence
  chemically synthesized
gttaatcacaactcacaaaggt

SEQ ID NO: 1035955 - DNA, 22 bp, Artificial Sequence
  chemically synthesized
ttaatcacaactcacaaaggta

SEQ ID NO: 1035956 - DNA, 22 bp, Artificial Sequence
  chemically synthesized
atcacaactcacaaaggtaact

SEQ ID NO: 1035957 - DNA, 22 bp, Artificial Sequence
  chemically synthesized
gaggtcagataggagttacctt

SEQ ID NO: 1035958 - DNA, 22 bp, Artificial Sequence
  chemically synthesized
agaggtcagataggagttacct

SEQ ID NO: 1035959 - DNA, 22 bp, Artificial Sequence
  chemically synthesized
gagtttagaggtcagataggag

SEQ ID NO: 1035960 - DNA, 22 bp, Artificial Sequence
  chemically synthesized
ggagtttagaggtcagatagga

SEQ ID NO: 1035961 - DNA, 22 bp, Artificial Sequence
  chemically synthesized
acaaaggtaactcctatctgac

SEQ ID NO: 1035962 - DNA, 22 bp, Artificial Sequence
  chemically synthesized
tggagtttagaggtcagatagg

SEQ ID NO: 1035963 - DNA, 22 bp, Artificial Sequence
  chemically synthesized
ggcactttggagtttagaggtc

SEQ ID NO: 1035964 - DNA, 22 bp, Artificial Sequence
  chemically synthesized
ctatctgacctctaaactccaa

SEQ ID NO: 1035965 - DNA, 22 bp, Artificial Sequence
  chemically synthesized
aaaaattaggcactttggagtt

SEQ ID NO: 1035966 - DNA, 22 bp, Artificial Sequence
  chemically synthesized
tctgacctctaaactccaaagt

SEQ ID NO: 1035967 - DNA, 22 bp, Artificial Sequence
  chemically synthesized
acctctaaactccaaagtgcct

SEQ ID NO: 1035968 - DNA, 22 bp, Artificial Sequence
  chemically synthesized
taaactccaaagtgcctaattt

SEQ ID NO: 1035969 - DNA, 22 bp, Artificial Sequence
  chemically synthesized
tatgaaactaaaaaattaggca

SEQ ID NO: 1035970 - DNA, 22 bp, Artificial Sequence
  chemically synthesized
aactccaaagtgcctaattttt

SEQ ID NO: 1035971 - DNA, 22 bp, Artificial Sequence
  chemically synthesized
ttatatgaaactaaaaaattag

SEQ ID NO: 1035972 - DNA, 22 bp, Artificial Sequence
  chemically synthesized
caaagtgcctaattttttagtt

SEQ ID NO: 1035973 - DNA, 22 bp, Artificial Sequence
  chemically synthesized
tatgaatctattatatgaaact

SEQ ID NO: 1035974 - DNA, 22 bp, Artificial Sequence
  chemically synthesized
ctgtatgaatctattatatgaa

SEQ ID NO: 1035975 - DNA, 22 bp, Artificial Sequence
  chemically synthesized
actgtatgaatctattatatga

SEQ ID NO: 1035976 - DNA, 22 bp, Artificial Sequence
  chemically synthesized
attttttagtttcatataatag

SEQ ID NO: 1035977 - DNA, 22 bp, Artificial Sequence
  chemically synthesized
tttagtttcatataatagattc

SEQ ID NO: 1035978 - DNA, 22 bp, Artificial Sequence
  chemically synthesized
ttagtttcatataatagattca

SEQ ID NO: 1035979 - DNA, 22 bp, Artificial Sequence
  chemically synthesized
tagtttcatataatagattcat

SEQ ID NO: 1035980 - DNA, 22 bp, Artificial Sequence
  chemically synthesized
agtttcatataatagattcata

SEQ ID NO: 1035981 - DNA, 22 bp, Artificial Sequence
  chemically synthesized
gtttcatataatagattcatac

SEQ ID NO: 1035982 - DNA, 22 bp, Artificial Sequence
  chemically synthesized
catataatagattcatacagta

SEQ ID NO: 1035983 - DNA, 22 bp, Artificial Sequence
  chemically synthesized
atataatagattcatacagtaa

SEQ ID NO: 1035984 - DNA, 22 bp, Artificial Sequence
  chemically synthesized
atacagtaagtgttctcttatt

SEQ ID NO: 1035985 - DNA, 22 bp, Artificial Sequence
  chemically synthesized
tataaagtaagtcagaaataag

SEQ ID NO: 1035986 - DNA, 22 bp, Artificial Sequence
  chemically synthesized
tcttatttctgacttactttat

SEQ ID NO: 1035987 - DNA, 22 bp, Artificial Sequence
  chemically synthesized
ttatttctgacttactttatac

SEQ ID NO: 1035988 - DNA, 22 bp, Artificial Sequence
  chemically synthesized
atttctgacttactttatacaa

SEQ ID NO: 1035989 - DNA, 22 bp, Artificial Sequence
  chemically synthesized
tttctgacttactttatacaac

SEQ ID NO: 1035990 - DNA, 22 bp, Artificial Sequence
  chemically synthesized
ctgacttactttatacaacact

SEQ ID NO: 1035991 - DNA, 22 bp, Artificial Sequence
  chemically synthesized
tgacttactttatacaacactg

SEQ ID NO: 1035992 - DNA, 22 bp, Artificial Sequence
  chemically synthesized
acttactttatacaacactgtg

SEQ ID NO: 1035993 - DNA, 22 bp, Artificial Sequence
  chemically synthesized
actttatacaacactgtgttca

SEQ ID NO: 1035994 - DNA, 22 bp, Artificial Sequence
  chemically synthesized
aaaaataaaatatgaacacagt

SEQ ID NO: 1035995 - DNA, 22 bp, Artificial Sequence
  chemically synthesized
ctttatacaacactgtgttcat

SEQ ID NO: 1035996 - DNA, 22 bp, Artificial Sequence
  chemically synthesized
tatacaacactgtgttcatatt

SEQ ID NO: 1035997 - DNA, 22 bp, Artificial Sequence
  chemically synthesized
atacaacactgtgttcatattt

SEQ ID NO: 1035998 - DNA, 22 bp, Artificial Sequence
  chemically synthesized
tacaacactgtgttcatatttt

SEQ ID NO: 1035999 - DNA, 22 bp, Artificial Sequence
  chemically synthesized
tgttcatattttatttttcaac

SEQ ID NO: 1036000 - DNA, 22 bp, Artificial Sequence
  chemically synthesized
ataaaataaaggaaatgttgaa

SEQ ID NO: 1036001 - DNA, 22 bp, Artificial Sequence
  chemically synthesized
atattttatttttcaacatttc

SEQ ID NO: 1036002 - DNA, 22 bp, Artificial Sequence
  chemically synthesized
cataaaataaaggaaatgttga

SEQ ID NO: 1036003 - DNA, 22 bp, Artificial Sequence
  chemically synthesized
tatttttcaacatttcctttat

SEQ ID NO: 1036004 - DNA, 22 bp, Artificial Sequence
  chemically synthesized
atttttcaacatttcctttatt

SEQ ID NO: 1036005 - DNA, 22 bp, Artificial Sequence
  chemically synthesized
tttttcaacatttcctttattt

SEQ ID NO: 1036006 - DNA, 22 bp, Artificial Sequence
  chemically synthesized
ataatatttcataaaataaagg

SEQ ID NO: 1036007 - DNA, 22 bp, Artificial Sequence
  chemically synthesized
ttcaacatttcctttattttat

SEQ ID NO: 1036008 - DNA, 22 bp, Artificial Sequence
  chemically synthesized
tcaacatttcctttattttatg

SEQ ID NO: 1036009 - DNA, 22 bp, Artificial Sequence
  chemically synthesized
ttaataatatttcataaaataa

SEQ ID NO: 1036010 - DNA, 22 bp, Artificial Sequence
  chemically synthesized
caacatttcctttattttatga

SEQ ID NO: 1036011 - DNA, 22 bp, Artificial Sequence
  chemically synthesized
attaataatatttcataaaata

SEQ ID NO: 1036012 - DNA, 22 bp, Artificial Sequence
  chemically synthesized
aacatttcctttattttatgaa

SEQ ID NO: 1036013 - DNA, 22 bp, Artificial Sequence
  chemically synthesized
ttattaataatatttcataaaa

SEQ ID NO: 1036014 - DNA, 22 bp, Artificial Sequence
  chemically synthesized
cctttattttatgaaatattat

SEQ ID NO: 1036015 - DNA, 22 bp, Artificial Sequence
  chemically synthesized
ctttattttatgaaatattatt

SEQ ID NO: 1036016 - DNA, 22 bp, Artificial Sequence
  chemically synthesized
tattttatgaaatattattaat

SEQ ID NO: 1036017 - DNA, 22 bp, Artificial Sequence
  chemically synthesized
attttatgaaatattattaata

SEQ ID NO: 1036018 - DNA, 22 bp, Artificial Sequence
  chemically synthesized
atcaaatgttcttattaataat

SEQ ID NO: 1036019 - DNA, 22 bp, Artificial Sequence
  chemically synthesized
ttttatgaaatattattaataa

SEQ ID NO: 1036020 - DNA, 22 bp, Artificial Sequence
  chemically synthesized
tatgaaatattattaataagaa

SEQ ID NO: 1036021 - DNA, 22 bp, Artificial Sequence
  chemically synthesized
attaatcaaatgttcttattaa

SEQ ID NO: 1036022 - DNA, 22 bp, Artificial Sequence
  chemically synthesized
atgaaatattattaataagaac

SEQ ID NO: 1036023 - DNA, 22 bp, Artificial Sequence
  chemically synthesized
aattaatcaaatgttcttatta

SEQ ID NO: 1036024 - DNA, 22 bp, Artificial Sequence
  chemically synthesized
tgaaatattattaataagaaca

SEQ ID NO: 1036025 - DNA, 22 bp, Artificial Sequence
  chemically synthesized
ttaataagaacatttgattaat

SEQ ID NO: 1036026 - DNA, 22 bp, Artificial Sequence
  chemically synthesized
ataagaacatttgattaattaa

SEQ ID NO: 1036027 - DNA, 22 bp, Artificial Sequence
  chemically synthesized
gagaaagaagtataagggcatt

SEQ ID NO: 1036028 - DNA, 22 bp, Artificial Sequence
  chemically synthesized
gattaattaaatgcccttatac

SEQ ID NO: 1036029 - DNA, 22 bp, Artificial Sequence
  chemically synthesized
attaattaaatgcccttatact

SEQ ID NO: 1036030 - DNA, 22 bp, Artificial Sequence
  chemically synthesized
attaaatgcccttatacttctt

SEQ ID NO: 1036031 - DNA, 22 bp, Artificial Sequence
  chemically synthesized
aaaaaattagagaaagaagtat

SEQ ID NO: 1036032 - DNA, 22 bp, Artificial Sequence
  chemically synthesized
taaaaaaattagagaaagaagt

SEQ ID NO: 1036033 - DNA, 22 bp, Artificial Sequence
  chemically synthesized
aatgcccttatacttctttctc

SEQ ID NO: 1036034 - DNA, 22 bp, Artificial Sequence
  chemically synthesized
atacttctttctctaatttttt

SEQ ID NO: 1036035 - DNA, 22 bp, Artificial Sequence
  chemically synthesized
tacttctttctctaattttttt

SEQ ID NO: 1036036 - DNA, 22 bp, Artificial Sequence
  chemically synthesized
ctttctctaatttttttagagg

SEQ ID NO: 1036037 - DNA, 22 bp, Artificial Sequence
  chemically synthesized
tttctctaatttttttagaggt

SEQ ID NO: 1036038 - DNA, 22 bp, Artificial Sequence
  chemically synthesized
tctctaatttttttagaggttt

SEQ ID NO: 1036039 - DNA, 22 bp, Artificial Sequence
  chemically synthesized
tagcaaaaaaagaaacctctaa

SEQ ID NO: 1036040 - DNA, 22 bp, Artificial Sequence
  chemically synthesized
ctctaatttttttagaggtttc

SEQ ID NO: 1036041 - DNA, 22 bp, Artificial Sequence
  chemically synthesized
tctaatttttttagaggtttct

SEQ ID NO: 1036042 - DNA, 22 bp, Artificial Sequence
  chemically synthesized
tatagcaaaaaaagaaacctct

SEQ ID NO: 1036043 - DNA, 22 bp, Artificial Sequence
  chemically synthesized
ctatagcaaaaaaagaaacctc

SEQ ID NO: 1036044 - DNA, 22 bp, Artificial Sequence
  chemically synthesized
taatttttttagaggtttcttt

SEQ ID NO: 1036045 - DNA, 22 bp, Artificial Sequence
  chemically synthesized
atttttttagaggtttcttttt

SEQ ID NO: 1036046 - DNA, 22 bp, Artificial Sequence
  chemically synthesized
catttctatagcaaaaaaagaa

SEQ ID NO: 1036047 - DNA, 22 bp, Artificial Sequence
  chemically synthesized
ttttagaggtttctttttttgc

SEQ ID NO: 1036048 - DNA, 22 bp, Artificial Sequence
  chemically synthesized
tttagaggtttctttttttgct

SEQ ID NO: 1036049 - DNA, 22 bp, Artificial Sequence
  chemically synthesized
ttacatttctatagcaaaaaaa

SEQ ID NO: 1036050 - DNA, 22 bp, Artificial Sequence
  chemically synthesized
ttagaggtttctttttttgcta

SEQ ID NO: 1036051 - DNA, 22 bp, Artificial Sequence
  chemically synthesized
tagaggtttctttttttgctat

SEQ ID NO: 1036052 - DNA, 22 bp, Artificial Sequence
  chemically synthesized
agaggtttctttttttgctata

SEQ ID NO: 1036053 - DNA, 22 bp, Artificial Sequence
  chemically synthesized
gaggtttctttttttgctatag

SEQ ID NO: 1036054 - DNA, 22 bp, Artificial Sequence
  chemically synthesized
tattattacatttctatagcaa

SEQ ID NO: 1036055 - DNA, 22 bp, Artificial Sequence
  chemically synthesized
tatattattacatttctatagc

SEQ ID NO: 1036056 - DNA, 22 bp, Artificial Sequence
  chemically synthesized
ctatattattacatttctatag

SEQ ID NO: 1036057 - DNA, 22 bp, Artificial Sequence
  chemically synthesized
ctttttttgctatagaaatgta

SEQ ID NO: 1036058 - DNA, 22 bp, Artificial Sequence
  chemically synthesized
tttctatattattacatttcta

SEQ ID NO: 1036059 - DNA, 22 bp, Artificial Sequence
  chemically synthesized
tttttttgctatagaaatgtaa

SEQ ID NO: 1036060 - DNA, 22 bp, Artificial Sequence
  chemically synthesized
atttctatattattacatttct

SEQ ID NO: 1036061 - DNA, 22 bp, Artificial Sequence
  chemically synthesized
tttttgctatagaaatgtaata

SEQ ID NO: 1036062 - DNA, 22 bp, Artificial Sequence
  chemically synthesized
ttttgctatagaaatgtaataa

SEQ ID NO: 1036063 - DNA, 22 bp, Artificial Sequence
  chemically synthesized
tttgctatagaaatgtaataat

SEQ ID NO: 1036064 - DNA, 22 bp, Artificial Sequence
  chemically synthesized
ttgctatagaaatgtaataata

SEQ ID NO: 1036065 - DNA, 22 bp, Artificial Sequence
  chemically synthesized
tgctatagaaatgtaataatat

SEQ ID NO: 1036066 - DNA, 22 bp, Artificial Sequence
  chemically synthesized
gctatagaaatgtaataatata

SEQ ID NO: 1036067 - DNA, 22 bp, Artificial Sequence
  chemically synthesized
ctatagaaatgtaataatatag

SEQ ID NO: 1036068 - DNA, 22 bp, Artificial Sequence
  chemically synthesized
agagtatttatttctatattat

SEQ ID NO: 1036069 - DNA, 22 bp, Artificial Sequence
  chemically synthesized
tagaaatgtaataatatagaaa

SEQ ID NO: 1036070 - DNA, 22 bp, Artificial Sequence
  chemically synthesized
gatatgatgtaaaatagacatg

SEQ ID NO: 1036071 - DNA, 22 bp, Artificial Sequence
  chemically synthesized
agatatgatgtaaaatagacat

SEQ ID NO: 1036072 - DNA, 22 bp, Artificial Sequence
  chemically synthesized
tagatatgatgtaaaatagaca

SEQ ID NO: 1036073 - DNA, 22 bp, Artificial Sequence
  chemically synthesized
ttagtctcatgtctattttaca

SEQ ID NO: 1036074 - DNA, 22 bp, Artificial Sequence
  chemically synthesized
agtctcatgtctattttacatc

SEQ ID NO: 1036075 - DNA, 22 bp, Artificial Sequence
  chemically synthesized
agctttagatatgatgtaaaat

SEQ ID NO: 1036076 - DNA, 22 bp, Artificial Sequence
  chemically synthesized
gtctcatgtctattttacatca

SEQ ID NO: 1036077 - DNA, 22 bp, Artificial Sequence
  chemically synthesized
tgagctttagatatgatgtaaa

SEQ ID NO: 1036078 - DNA, 22 bp, Artificial Sequence
  chemically synthesized
atgtctattttacatcatatct

SEQ ID NO: 1036079 - DNA, 22 bp, Artificial Sequence
  chemically synthesized
aagatggttctgagctttagat

SEQ ID NO: 1036080 - DNA, 22 bp, Artificial Sequence
  chemically synthesized
ttttacatcatatctaaagctc

SEQ ID NO: 1036081 - DNA, 22 bp, Artificial Sequence
  chemically synthesized
tacatcatatctaaagctcaga

SEQ ID NO: 1036082 - DNA, 22 bp, Artificial Sequence
  chemically synthesized
acatcatatctaaagctcagaa

SEQ ID NO: 1036083 - DNA, 22 bp, Artificial Sequence
  chemically synthesized
aattcaagatggttctgagctt

SEQ ID NO: 1036084 - DNA, 22 bp, Artificial Sequence
  chemically synthesized
catcatatctaaagctcagaac

SEQ ID NO: 1036085 - DNA, 22 bp, Artificial Sequence
  chemically synthesized
aagctcagaaccatcttgaatt

SEQ ID NO: 1036086 - DNA, 22 bp, Artificial Sequence
  chemically synthesized
agaaccatcttgaatttaacta

SEQ ID NO: 1036087 - DNA, 22 bp, Artificial Sequence
  chemically synthesized
cccacccatataagtagttaaa

SEQ ID NO: 1036088 - DNA, 22 bp, Artificial Sequence
  chemically synthesized
acccacccatataagtagttaa

SEQ ID NO: 1036089 - DNA, 22 bp, Artificial Sequence
  chemically synthesized
acttacccacccatataagtag

SEQ ID NO: 1036090 - DNA, 22 bp, Artificial Sequence
  chemically synthesized
gaatttaactacttatatgggt

SEQ ID NO: 1036091 - DNA, 22 bp, Artificial Sequence
  chemically synthesized
aatttaactacttatatgggtg

SEQ ID NO: 1036092 - DNA, 22 bp, Artificial Sequence
  chemically synthesized
ggttgacttacccacccatata

SEQ ID NO: 1036093 - DNA, 22 bp, Artificial Sequence
  chemically synthesized
aactacttatatgggtgggtaa

SEQ ID NO: 1036094 - DNA, 22 bp, Artificial Sequence
  chemically synthesized
actacttatatgggtgggtaag

SEQ ID NO: 1036095 - DNA, 22 bp, Artificial Sequence
  chemically synthesized
cttatatgggtgggtaagtcaa

SEQ ID NO: 1036096 - DNA, 22 bp, Artificial Sequence
  chemically synthesized
atatgggtgggtaagtcaaccc

SEQ ID NO: 1036097 - DNA, 22 bp, Artificial Sequence
  chemically synthesized
gtcagatatgttgggttgactt

SEQ ID NO: 1036098 - DNA, 22 bp, Artificial Sequence
  chemically synthesized
tatgggtgggtaagtcaaccca

SEQ ID NO: 1036099 - DNA, 22 bp, Artificial Sequence
  chemically synthesized
agtcagatatgttgggttgact

SEQ ID NO: 1036100 - DNA, 22 bp, Artificial Sequence
  chemically synthesized
cttagtcagatatgttgggttg

SEQ ID NO: 1036101 - DNA, 22 bp, Artificial Sequence
  chemically synthesized
tacttagtcagatatgttgggt

SEQ ID NO: 1036102 - DNA, 22 bp, Artificial Sequence
  chemically synthesized
gaattctacttagtcagatatg

SEQ ID NO: 1036103 - DNA, 22 bp, Artificial Sequence
  chemically synthesized
ggaattctacttagtcagatat

SEQ ID NO: 1036104 - DNA, 22 bp, Artificial Sequence
  chemically synthesized
ttggaattctacttagtcagat

SEQ ID NO: 1036105 - DNA, 22 bp, Artificial Sequence
  chemically synthesized
cttggaattctacttagtcaga

SEQ ID NO: 1036106 - DNA, 22 bp, Artificial Sequence
  chemically synthesized
cttcttggaattctacttagtc

SEQ ID NO: 1036107 - DNA, 22 bp, Artificial Sequence
  chemically synthesized
ccttcttggaattctacttagt

SEQ ID NO: 1036108 - DNA, 22 bp, Artificial Sequence
  chemically synthesized
actaagtagaattccaagaagg

SEQ ID NO: 1036109 - DNA, 22 bp, Artificial Sequence
  chemically synthesized
aaatcagtatttccttcttgga

SEQ ID NO: 1036110 - DNA, 22 bp, Artificial Sequence
  chemically synthesized
aaaatcagtatttccttcttgg

SEQ ID NO: 1036111 - DNA, 22 bp, Artificial Sequence
  chemically synthesized
taaaatcagtatttccttcttg

SEQ ID NO: 1036112 - DNA, 22 bp, Artificial Sequence
  chemically synthesized
agtagaattccaagaaggaaat

SEQ ID NO: 1036113 - DNA, 22 bp, Artificial Sequence
  chemically synthesized
caagaaggaaatactgatttta

SEQ ID NO: 1036114 - DNA, 22 bp, Artificial Sequence
  chemically synthesized
tcaaacatcaagaaagtaatgt

SEQ ID NO: 1036115 - DNA, 22 bp, Artificial Sequence
  chemically synthesized
attttaaaacattactttcttg

SEQ ID NO: 1036116 - DNA, 22 bp, Artificial Sequence
  chemically synthesized
taaaacattactttcttgatgt

SEQ ID NO: 1036117 - DNA, 22 bp, Artificial Sequence
  chemically synthesized
aaaacattactttcttgatgtt

SEQ ID NO: 1036118 - DNA, 22 bp, Artificial Sequence
  chemically synthesized
aaacattactttcttgatgttt

SEQ ID NO: 1036119 - DNA, 22 bp, Artificial Sequence
  chemically synthesized
ctttcttgatgtttgacaggga

SEQ ID NO: 1036120 - DNA, 22 bp, Artificial Sequence
  chemically synthesized
tgtaacaacaaggtccctgtca

SEQ ID NO: 1036121 - DNA, 22 bp, Artificial Sequence
  chemically synthesized
tcttgatgtttgacagggacct

SEQ ID NO: 1036122 - DNA, 22 bp, Artificial Sequence
  chemically synthesized
cttgatgtttgacagggacctt

SEQ ID NO: 1036123 - DNA, 22 bp, Artificial Sequence
  chemically synthesized
ttgtgtaacaacaaggtccctg

SEQ ID NO: 1036124 - DNA, 22 bp, Artificial Sequence
  chemically synthesized
ttgatgtttgacagggaccttg

SEQ ID NO: 1036125 - DNA, 22 bp, Artificial Sequence
  chemically synthesized
gatgtttgacagggaccttgtt

SEQ ID NO: 1036126 - DNA, 22 bp, Artificial Sequence
  chemically synthesized
atgtttgacagggaccttgttg

SEQ ID NO: 1036127 - DNA, 22 bp, Artificial Sequence
  chemically synthesized
gacagggaccttgttgttacac

SEQ ID NO: 1036128 - DNA, 22 bp, Artificial Sequence
  chemically synthesized
acagggaccttgttgttacaca

SEQ ID NO: 1036129 - DNA, 22 bp, Artificial Sequence
  chemically synthesized
tacagccataagatggcattat

SEQ ID NO: 1036130 - DNA, 22 bp, Artificial Sequence
  chemically synthesized
gttgttacacaataatgccatc

SEQ ID NO: 1036131 - DNA, 22 bp, Artificial Sequence
  chemically synthesized
ttgttacacaataatgccatct

SEQ ID NO: 1036132 - DNA, 22 bp, Artificial Sequence
  chemically synthesized
ctgtacagccataagatggcat

SEQ ID NO: 1036133 - DNA, 22 bp, Artificial Sequence
  chemically synthesized
ttacacaataatgccatcttat

SEQ ID NO: 1036134 - DNA, 22 bp, Artificial Sequence
  chemically synthesized
cacaataatgccatcttatggc

SEQ ID NO: 1036135 - DNA, 22 bp, Artificial Sequence
  chemically synthesized
caaattgctgtacagccataag

SEQ ID NO: 1036136 - DNA, 22 bp, Artificial Sequence
  chemically synthesized
gactacaaattgctgtacagcc

SEQ ID NO: 1036137 - DNA, 22 bp, Artificial Sequence
  chemically synthesized
tagactacaaattgctgtacag

SEQ ID NO: 1036138 - DNA, 22 bp, Artificial Sequence
  chemically synthesized
ctagactacaaattgctgtaca

SEQ ID NO: 1036139 - DNA, 22 bp, Artificial Sequence
  chemically synthesized
atggctgtacagcaatttgtag

SEQ ID NO: 1036140 - DNA, 22 bp, Artificial Sequence
  chemically synthesized
tggctgtacagcaatttgtagt

SEQ ID NO: 1036141 - DNA, 22 bp, Artificial Sequence
  chemically synthesized
tacagcaatttgtagtctagaa

SEQ ID NO: 1036142 - DNA, 22 bp, Artificial Sequence
  chemically synthesized
tcatcaaaatgaaggcagtttc

SEQ ID NO: 1036143 - DNA, 22 bp, Artificial Sequence
  chemically synthesized
gtagtctagaaactgccttcat

SEQ ID NO: 1036144 - DNA, 22 bp, Artificial Sequence
  chemically synthesized
tagtctagaaactgccttcatt

SEQ ID NO: 1036145 - DNA, 22 bp, Artificial Sequence
  chemically synthesized
aaatgctatcatcaaaatgaag

SEQ ID NO: 1036146 - DNA, 22 bp, Artificial Sequence
  chemically synthesized
gaaactgccttcattttgatga

SEQ ID NO: 1036147 - DNA, 22 bp, Artificial Sequence
  chemically synthesized
ccttcattttgatgatagcatt

SEQ ID NO: 1036148 - DNA, 22 bp, Artificial Sequence
  chemically synthesized
cattttgatgatagcatttgaa

SEQ ID NO: 1036149 - DNA, 22 bp, Artificial Sequence
  chemically synthesized
attttgatgatagcatttgaac

SEQ ID NO: 1036150 - DNA, 22 bp, Artificial Sequence
  chemically synthesized
agagggtagaacagttcaaatg

SEQ ID NO: 1036151 - DNA, 22 bp, Artificial Sequence
  chemically synthesized
tgatgatagcatttgaactgtt

SEQ ID NO: 1036152 - DNA, 22 bp, Artificial Sequence
  chemically synthesized
gatgatagcatttgaactgttc

SEQ ID NO: 1036153 - DNA, 22 bp, Artificial Sequence
  chemically synthesized
atgatagcatttgaactgttct

SEQ ID NO: 1036154 - DNA, 22 bp, Artificial Sequence
  chemically synthesized
ccaaagactaagagggtagaac

SEQ ID NO: 1036155 - DNA, 22 bp, Artificial Sequence
  chemically synthesized
cccaaagactaagagggtagaa

SEQ ID NO: 1036156 - DNA, 22 bp, Artificial Sequence
  chemically synthesized
gaactgttctaccctcttagtc

SEQ ID NO: 1036157 - DNA, 22 bp, Artificial Sequence
  chemically synthesized
aactgttctaccctcttagtct

SEQ ID NO: 1036158 - DNA, 22 bp, Artificial Sequence
  chemically synthesized
gaaaatgacttcccaaagacta

SEQ ID NO: 1036159 - DNA, 22 bp, Artificial Sequence
  chemically synthesized
ttctaccctcttagtctttggg

SEQ ID NO: 1036160 - DNA, 22 bp, Artificial Sequence
  chemically synthesized
agaaaatgacttcccaaagact

SEQ ID NO: 1036161 - DNA, 22 bp, Artificial Sequence
  chemically synthesized
tagaaaatgacttcccaaagac

SEQ ID NO: 1036162 - DNA, 22 bp, Artificial Sequence
  chemically synthesized
ttagaaaatgacttcccaaaga

SEQ ID NO: 1036163 - DNA, 22 bp, Artificial Sequence
  chemically synthesized
taccctcttagtctttgggaag

SEQ ID NO: 1036164 - DNA, 22 bp, Artificial Sequence
  chemically synthesized
ccctcttagtctttgggaagtc

SEQ ID NO: 1036165 - DNA, 22 bp, Artificial Sequence
  chemically synthesized
ccacttttagaaaatgacttcc

SEQ ID NO: 1036166 - DNA, 22 bp, Artificial Sequence
  chemically synthesized
cccacttttagaaaatgacttc

SEQ ID NO: 1036167 - DNA, 22 bp, Artificial Sequence
  chemically synthesized
ttagtctttgggaagtcatttt

SEQ ID NO: 1036168 - DNA, 22 bp, Artificial Sequence
  chemically synthesized
agtctttgggaagtcattttct

SEQ ID NO: 1036169 - DNA, 22 bp, Artificial Sequence
  chemically synthesized
gtctttgggaagtcattttcta

SEQ ID NO: 1036170 - DNA, 22 bp, Artificial Sequence
  chemically synthesized
tgggaagtcattttctaaaagt

SEQ ID NO: 1036171 - DNA, 22 bp, Artificial Sequence
  chemically synthesized
gggaagtcattttctaaaagtg

SEQ ID NO: 1036172 - DNA, 22 bp, Artificial Sequence
  chemically synthesized
gtgagtgtttcccacttttaga

SEQ ID NO: 1036173 - DNA, 22 bp, Artificial Sequence
  chemically synthesized
ggaagtcattttctaaaagtgg

SEQ ID NO: 1036174 - DNA, 22 bp, Artificial Sequence
  chemically synthesized
taagccattagtgagtgtttcc

SEQ ID NO: 1036175 - DNA, 22 bp, Artificial Sequence
  chemically synthesized
tctaaaagtgggaaacactcac

SEQ ID NO: 1036176 - DNA, 22 bp, Artificial Sequence
  chemically synthesized
ctaaaagtgggaaacactcact

SEQ ID NO: 1036177 - DNA, 22 bp, Artificial Sequence
  chemically synthesized
taaaagtgggaaacactcacta

SEQ ID NO: 1036178 - DNA, 22 bp, Artificial Sequence
  chemically synthesized
tcctgtaagccattagtgagtg

SEQ ID NO: 1036179 - DNA, 22 bp, Artificial Sequence
  chemically synthesized
aaagtgggaaacactcactaat

SEQ ID NO: 1036180 - DNA, 22 bp, Artificial Sequence
  chemically synthesized
ctatcctgtaagccattagtga

SEQ ID NO: 1036181 - DNA, 22 bp, Artificial Sequence
  chemically synthesized
actatcctgtaagccattagtg

SEQ ID NO: 1036182 - DNA, 22 bp, Artificial Sequence
  chemically synthesized
tactatcctgtaagccattagt

SEQ ID NO: 1036183 - DNA, 22 bp, Artificial Sequence
  chemically synthesized
ataccatctttactatcctgta

SEQ ID NO: 1036184 - DNA, 22 bp, Artificial Sequence
  chemically synthesized
actaatggcttacaggatagta

SEQ ID NO: 1036185 - DNA, 22 bp, Artificial Sequence
  chemically synthesized
tgataccatctttactatcctg

SEQ ID NO: 1036186 - DNA, 22 bp, Artificial Sequence
  chemically synthesized
ctgataccatctttactatcct

SEQ ID NO: 1036187 - DNA, 22 bp, Artificial Sequence
  chemically synthesized
tctgataccatctttactatcc

SEQ ID NO: 1036188 - DNA, 22 bp, Artificial Sequence
  chemically synthesized
atggcttacaggatagtaaaga

SEQ ID NO: 1036189 - DNA, 22 bp, Artificial Sequence
  chemically synthesized
tttctgataccatctttactat

SEQ ID NO: 1036190 - DNA, 22 bp, Artificial Sequence
  chemically synthesized
ctttctgataccatctttacta

SEQ ID NO: 1036191 - DNA, 22 bp, Artificial Sequence
  chemically synthesized
gtttctttctgataccatcttt

SEQ ID NO: 1036192 - DNA, 22 bp, Artificial Sequence
  chemically synthesized
acaggatagtaaagatggtatc

SEQ ID NO: 1036193 - DNA, 22 bp, Artificial Sequence
  chemically synthesized
caggatagtaaagatggtatca

SEQ ID NO: 1036194 - DNA, 22 bp, Artificial Sequence
  chemically synthesized
tcgttagtttctttctgatacc

SEQ ID NO: 1036195 - DNA, 22 bp, Artificial Sequence
  chemically synthesized
ttgtcgttagtttctttctgat

SEQ ID NO: 1036196 - DNA, 22 bp, Artificial Sequence
  chemically synthesized
tattgtcgttagtttctttctg

SEQ ID NO: 1036197 - DNA, 22 bp, Artificial Sequence
  chemically synthesized
tactctattgtcgttagtttct

SEQ ID NO: 1036198 - DNA, 22 bp, Artificial Sequence
  chemically synthesized
aatgtcagatgttatactctat

SEQ ID NO: 1036199 - DNA, 22 bp, Artificial Sequence
  chemically synthesized
ctaaatgtcagatgttatactc

SEQ ID NO: 1036200 - DNA, 22 bp, Artificial Sequence
  chemically synthesized
acgacaatagagtataacatct

SEQ ID NO: 1036201 - DNA, 22 bp, Artificial Sequence
  chemically synthesized
agaagggcctactaaatgtcag

SEQ ID NO: 1036202 - DNA, 22 bp, Artificial Sequence
  chemically synthesized
aagaagggcctactaaatgtca

SEQ ID NO: 1036203 - DNA, 22 bp, Artificial Sequence
  chemically synthesized
aatgaacacttaagaagggcct

SEQ ID NO: 1036204 - DNA, 22 bp, Artificial Sequence
  chemically synthesized
caatgaacacttaagaagggcc

SEQ ID NO: 1036205 - DNA, 22 bp, Artificial Sequence
  chemically synthesized
tcaatgaacacttaagaagggc

SEQ ID NO: 1036206 - DNA, 22 bp, Artificial Sequence
  chemically synthesized
acatttagtaggcccttcttaa

SEQ ID NO: 1036207 - DNA, 22 bp, Artificial Sequence
  chemically synthesized
tttcaatgaacacttaagaagg

SEQ ID NO: 1036208 - DNA, 22 bp, Artificial Sequence
  chemically synthesized
ctttcaatgaacacttaagaag

SEQ ID NO: 1036209 - DNA, 22 bp, Artificial Sequence
  chemically synthesized
ttctttcaatgaacacttaaga

SEQ ID NO: 1036210 - DNA, 22 bp, Artificial Sequence
  chemically synthesized
cttctttcaatgaacacttaag

SEQ ID NO: 1036211 - DNA, 22 bp, Artificial Sequence
  chemically synthesized
agtaggcccttcttaagtgttc

SEQ ID NO: 1036212 - DNA, 22 bp, Artificial Sequence
  chemically synthesized
tcttctttcaatgaacacttaa

SEQ ID NO: 1036213 - DNA, 22 bp, Artificial Sequence
  chemically synthesized
gtaggcccttcttaagtgttca

SEQ ID NO: 1036214 - DNA, 22 bp, Artificial Sequence
  chemically synthesized
ttcttctttcaatgaacactta

SEQ ID NO: 1036215 - DNA, 22 bp, Artificial Sequence
  chemically synthesized
ttttcttctttcaatgaacact

SEQ ID NO: 1036216 - DNA, 22 bp, Artificial Sequence
  chemically synthesized
cttaagtgttcattgaaagaag

SEQ ID NO: 1036217 - DNA, 22 bp, Artificial Sequence
  chemically synthesized
ttaagtgttcattgaaagaaga

SEQ ID NO: 1036218 - DNA, 22 bp, Artificial Sequence
  chemically synthesized
aagtgttcattgaaagaagaaa

SEQ ID NO: 1036219 - DNA, 22 bp, Artificial Sequence
  chemically synthesized
agtgttcattgaaagaagaaaa

SEQ ID NO: 1036220 - DNA, 22 bp, Artificial Sequence
  chemically synthesized
gagaaacaaagctcttttcttc

SEQ ID NO: 1036221 - DNA, 22 bp, Artificial Sequence
  chemically synthesized
attgaaagaagaaaagagcttt

SEQ ID NO: 1036222 - DNA, 22 bp, Artificial Sequence
  chemically synthesized
ggattagagaaacaaagctctt

SEQ ID NO: 1036223 - DNA, 22 bp, Artificial Sequence
  chemically synthesized
aaagaagaaaagagctttgttt

SEQ ID NO: 1036224 - DNA, 22 bp, Artificial Sequence
  chemically synthesized
tctgggattagagaaacaaagc

SEQ ID NO: 1036225 - DNA, 22 bp, Artificial Sequence
  chemically synthesized
cataagatctatctgggattag

SEQ ID NO: 1036226 - DNA, 22 bp, Artificial Sequence
  chemically synthesized
acataagatctatctgggatta

SEQ ID NO: 1036227 - DNA, 22 bp, Artificial Sequence
  chemically synthesized
tgtttctctaatcccagataga

SEQ ID NO: 1036228 - DNA, 22 bp, Artificial Sequence
  chemically synthesized
gtttctctaatcccagatagat

SEQ ID NO: 1036229 - DNA, 22 bp, Artificial Sequence
  chemically synthesized
tttctctaatcccagatagatc

SEQ ID NO: 1036230 - DNA, 22 bp, Artificial Sequence
  chemically synthesized
ctctaatcccagatagatctta

SEQ ID NO: 1036231 - DNA, 22 bp, Artificial Sequence
  chemically synthesized
tctaatcccagatagatcttat

SEQ ID NO: 1036232 - DNA, 22 bp, Artificial Sequence
  chemically synthesized
taatcccagatagatcttatgt

SEQ ID NO: 1036233 - DNA, 22 bp, Artificial Sequence
  chemically synthesized
atcccagatagatcttatgtaa

SEQ ID NO: 1036234 - DNA, 22 bp, Artificial Sequence
  chemically synthesized
taggaaacatgtaaaaacaaag

SEQ ID NO: 1036235 - DNA, 22 bp, Artificial Sequence
  chemically synthesized
atgtaaattctttgtttttaca

SEQ ID NO: 1036236 - DNA, 22 bp, Artificial Sequence
  chemically synthesized
tgtaaattctttgtttttacat

SEQ ID NO: 1036237 - DNA, 22 bp, Artificial Sequence
  chemically synthesized
tttgtttttacatgtttcctat

SEQ ID NO: 1036238 - DNA, 22 bp, Artificial Sequence
  chemically synthesized
taaaatatacctataggaaaca

SEQ ID NO: 1036239 - DNA, 22 bp, Artificial Sequence
  chemically synthesized
ataaaatatacctataggaaac

SEQ ID NO: 1036240 - DNA, 22 bp, Artificial Sequence
  chemically synthesized
tgtttttacatgtttcctatag

SEQ ID NO: 1036241 - DNA, 22 bp, Artificial Sequence
  chemically synthesized
gtttttacatgtttcctatagg

SEQ ID NO: 1036242 - DNA, 22 bp, Artificial Sequence
  chemically synthesized
tttttacatgtttcctataggt

SEQ ID NO: 1036243 - DNA, 22 bp, Artificial Sequence
  chemically synthesized
cttataaaatatacctatagga

SEQ ID NO: 1036244 - DNA, 22 bp, Artificial Sequence
  chemically synthesized
ttacatgtttcctataggtata

SEQ ID NO: 1036245 - DNA, 22 bp, Artificial Sequence
  chemically synthesized
tacatgtttcctataggtatat

SEQ ID NO: 1036246 - DNA, 22 bp, Artificial Sequence
  chemically synthesized
actgcttataaaatatacctat

SEQ ID NO: 1036247 - DNA, 22 bp, Artificial Sequence
  chemically synthesized
acatgtttcctataggtatatt

SEQ ID NO: 1036248 - DNA, 22 bp, Artificial Sequence
  chemically synthesized
catgtttcctataggtatattt

SEQ ID NO: 1036249 - DNA, 22 bp, Artificial Sequence
  chemically synthesized
cctataggtatattttataagc

SEQ ID NO: 1036250 - DNA, 22 bp, Artificial Sequence
  chemically synthesized
ctataggtatattttataagca

SEQ ID NO: 1036251 - DNA, 22 bp, Artificial Sequence
  chemically synthesized
taggtatattttataagcagtt

SEQ ID NO: 1036252 - DNA, 22 bp, Artificial Sequence
  chemically synthesized
gggtgggtaactaactgcttat

SEQ ID NO: 1036253 - DNA, 22 bp, Artificial Sequence
  chemically synthesized
cgggtgggtaactaactgctta

SEQ ID NO: 1036254 - DNA, 22 bp, Artificial Sequence
  chemically synthesized
tcgggtgggtaactaactgctt

SEQ ID NO: 1036255 - DNA, 22 bp, Artificial Sequence
  chemically synthesized
attttcgggtgggtaactaact

SEQ ID NO: 1036256 - DNA, 22 bp, Artificial Sequence
  chemically synthesized
attgattttcgggtgggtaact

SEQ ID NO: 1036257 - DNA, 22 bp, Artificial Sequence
  chemically synthesized
tataagcagttagttacccacc

SEQ ID NO: 1036258 - DNA, 22 bp, Artificial Sequence
  chemically synthesized
cattgattttcgggtgggtaac

SEQ ID NO: 1036259 - DNA, 22 bp, Artificial Sequence
  chemically synthesized
ataagcagttagttacccaccc

SEQ ID NO: 1036260 - DNA, 22 bp, Artificial Sequence
  chemically synthesized
tcattgattttcgggtgggtaa

SEQ ID NO: 1036261 - DNA, 22 bp, Artificial Sequence
  chemically synthesized
taagcagttagttacccacccg

SEQ ID NO: 1036262 - DNA, 22 bp, Artificial Sequence
  chemically synthesized
agttttcattgattttcgggtg

SEQ ID NO: 1036263 - DNA, 22 bp, Artificial Sequence
  chemically synthesized
aattcagttttcattgattttc

SEQ ID NO: 1036264 - DNA, 22 bp, Artificial Sequence
  chemically synthesized
gttacccacccgaaaatcaatg

SEQ ID NO: 1036265 - DNA, 22 bp, Artificial Sequence
  chemically synthesized
ctaaattcagttttcattgatt

SEQ ID NO: 1036266 - DNA, 22 bp, Artificial Sequence
  chemically synthesized
cccacccgaaaatcaatgaaaa

SEQ ID NO: 1036267 - DNA, 22 bp, Artificial Sequence
  chemically synthesized
ctgctaaattcagttttcattg

SEQ ID NO: 1036268 - DNA, 22 bp, Artificial Sequence
  chemically synthesized
atattactgctaaattcagttt

SEQ ID NO: 1036269 - DNA, 22 bp, Artificial Sequence
  chemically synthesized
ggaaattaatattactgctaaa

SEQ ID NO: 1036270 - DNA, 22 bp, Artificial Sequence
  chemically synthesized
gggaaattaatattactgctaa

SEQ ID NO: 1036271 - DNA, 22 bp, Artificial Sequence
  chemically synthesized
tgggaaattaatattactgcta

SEQ ID NO: 1036272 - DNA, 22 bp, Artificial Sequence
  chemically synthesized
ttgggaaattaatattactgct

SEQ ID NO: 1036273 - DNA, 22 bp, Artificial Sequence
  chemically synthesized
tttgggaaattaatattactgc

SEQ ID NO: 1036274 - DNA, 22 bp, Artificial Sequence
  chemically synthesized
actttttgggaaattaatatta

SEQ ID NO: 1036275 - DNA, 22 bp, Artificial Sequence
  chemically synthesized
aatttagcagtaatattaattt

SEQ ID NO: 1036276 - DNA, 22 bp, Artificial Sequence
  chemically synthesized
gttaactttttgggaaattaat

SEQ ID NO: 1036277 - DNA, 22 bp, Artificial Sequence
  chemically synthesized
agcagtaatattaatttcccaa

SEQ ID NO: 1036278 - DNA, 22 bp, Artificial Sequence
  chemically synthesized
ctagttaactttttgggaaatt

SEQ ID NO: 1036279 - DNA, 22 bp, Artificial Sequence
  chemically synthesized
gcagtaatattaatttcccaaa

SEQ ID NO: 1036280 - DNA, 22 bp, Artificial Sequence
  chemically synthesized
tatgtaagattactagttaact

SEQ ID NO: 1036281 - DNA, 22 bp, Artificial Sequence
  chemically synthesized
atttcccaaaaagttaactagt

SEQ ID NO: 1036282 - DNA, 22 bp, Artificial Sequence
  chemically synthesized
cccaaaaagttaactagtaatc

SEQ ID NO: 1036283 - DNA, 22 bp, Artificial Sequence
  chemically synthesized
ccaaaaagttaactagtaatct

SEQ ID NO: 1036284 - DNA, 22 bp, Artificial Sequence
  chemically synthesized
actagtaatcttacatataggc

SEQ ID NO: 1036285 - DNA, 22 bp, Artificial Sequence
  chemically synthesized
gtaatcttacatataggcatat

SEQ ID NO: 1036286 - DNA, 22 bp, Artificial Sequence
  chemically synthesized
acatataggcatatctatccat

SEQ ID NO: 1036287 - DNA, 22 bp, Artificial Sequence
  chemically synthesized
catataggcatatctatccata

SEQ ID NO: 1036288 - DNA, 22 bp, Artificial Sequence
  chemically synthesized
tccatacgttcatggtgcttgt

SEQ ID NO: 1036289 - DNA, 22 bp, Artificial Sequence
  chemically synthesized
atggtgcttgtggatttactgt

SEQ ID NO: 1036290 - DNA, 22 bp, Artificial Sequence
  chemically synthesized
acagtcaacacagtcaacagta

SEQ ID NO: 1036291 - DNA, 22 bp, Artificial Sequence
  chemically synthesized
actaacagtcaacacagtcaac

SEQ ID NO: 1036292 - DNA, 22 bp, Artificial Sequence
  chemically synthesized
gtggatttactgttgactgtgt

SEQ ID NO: 1036293 - DNA, 22 bp, Artificial Sequence
  chemically synthesized
tggatttactgttgactgtgtt

SEQ ID NO: 1036294 - DNA, 22 bp, Artificial Sequence
  chemically synthesized
ttcactaacagtcaacacagtc

SEQ ID NO: 1036295 - DNA, 22 bp, Artificial Sequence
  chemically synthesized
attgttcactaacagtcaacac

SEQ ID NO: 1036296 - DNA, 22 bp, Artificial Sequence
  chemically synthesized
actgttgactgtgttgactgtt

SEQ ID NO: 1036297 - DNA, 22 bp, Artificial Sequence
  chemically synthesized
tgattgttcactaacagtcaac

SEQ ID NO: 1036298 - DNA, 22 bp, Artificial Sequence
  chemically synthesized
ctgttgactgtgttgactgtta

SEQ ID NO: 1036299 - DNA, 22 bp, Artificial Sequence
  chemically synthesized
ttgactgtgttgactgttagtg

SEQ ID NO: 1036300 - DNA, 22 bp, Artificial Sequence
  chemically synthesized
actgtgttgactgttagtgaac

SEQ ID NO: 1036301 - DNA, 22 bp, Artificial Sequence
  chemically synthesized
acggacattctgattgttcact

SEQ ID NO: 1036302 - DNA, 22 bp, Artificial Sequence
  chemically synthesized
tgttgactgttagtgaacaatc

SEQ ID NO: 1036303 - DNA, 22 bp, Artificial Sequence
  chemically synthesized
cacggacattctgattgttcac

SEQ ID NO: 1036304 - DNA, 22 bp, Artificial Sequence
  chemically synthesized
tcacggacattctgattgttca

SEQ ID NO: 1036305 - DNA, 22 bp, Artificial Sequence
  chemically synthesized
ttttcacggacattctgattgt

SEQ ID NO: 1036306 - DNA, 22 bp, Artificial Sequence
  chemically synthesized
actgttagtgaacaatcagaat

SEQ ID NO: 1036307 - DNA, 22 bp, Artificial Sequence
  chemically synthesized
attttcacggacattctgattg

SEQ ID NO: 1036308 - DNA, 22 bp, Artificial Sequence
  chemically synthesized
ttagtgaacaatcagaatgtcc

SEQ ID NO: 1036309 - DNA, 22 bp, Artificial Sequence
  chemically synthesized
gtgaacaatcagaatgtccgtg

SEQ ID NO: 1036310 - DNA, 22 bp, Artificial Sequence
  chemically synthesized
aaagccttattttcacggacat

SEQ ID NO: 1036311 - DNA, 22 bp, Artificial Sequence
  chemically synthesized
cacatcatcaaagtattaaaag

SEQ ID NO: 1036312 - DNA, 22 bp, Artificial Sequence
  chemically synthesized
aacaagttacacatcatcaaag

SEQ ID NO: 1036313 - DNA, 22 bp, Artificial Sequence
  chemically synthesized
ttaatactttgatgatgtgtaa

SEQ ID NO: 1036314 - DNA, 22 bp, Artificial Sequence
  chemically synthesized
taatactttgatgatgtgtaac

SEQ ID NO: 1036315 - DNA, 22 bp, Artificial Sequence
  chemically synthesized
aatactttgatgatgtgtaact

SEQ ID NO: 1036316 - DNA, 22 bp, Artificial Sequence
  chemically synthesized
atactttgatgatgtgtaactt

SEQ ID NO: 1036317 - DNA, 22 bp, Artificial Sequence
  chemically synthesized
aacatgtatctcaacaagttac

SEQ ID NO: 1036318 - DNA, 22 bp, Artificial Sequence
  chemically synthesized
caacatgtatctcaacaagtta

SEQ ID NO: 1036319 - DNA, 22 bp, Artificial Sequence
  chemically synthesized
tgatgatgtgtaacttgttgag

SEQ ID NO: 1036320 - DNA, 22 bp, Artificial Sequence
  chemically synthesized
gatgatgtgtaacttgttgaga

SEQ ID NO: 1036321 - DNA, 22 bp, Artificial Sequence
  chemically synthesized
atgatgtgtaacttgttgagat

SEQ ID NO: 1036322 - DNA, 22 bp, Artificial Sequence
  chemically synthesized
agcaaatagaatttcaacatgt

SEQ ID NO: 1036323 - DNA, 22 bp, Artificial Sequence
  chemically synthesized
cagcaaatagaatttcaacatg

SEQ ID NO: 1036324 - DNA, 22 bp, Artificial Sequence
  chemically synthesized
tcagcaaatagaatttcaacat

SEQ ID NO: 1036325 - DNA, 22 bp, Artificial Sequence
  chemically synthesized
gttgagatacatgttgaaattc

SEQ ID NO: 1036326 - DNA, 22 bp, Artificial Sequence
  chemically synthesized
ttgagatacatgttgaaattct

SEQ ID NO: 1036327 - DNA, 22 bp, Artificial Sequence
  chemically synthesized
tctttcagcaaatagaatttca

SEQ ID NO: 1036328 - DNA, 22 bp, Artificial Sequence
  chemically synthesized
agatacatgttgaaattctatt

SEQ ID NO: 1036329 - DNA, 22 bp, Artificial Sequence
  chemically synthesized
catacattgtctttcagcaaat

SEQ ID NO: 1036330 - DNA, 22 bp, Artificial Sequence
  chemically synthesized
ccatacattgtctttcagcaaa

SEQ ID NO: 1036331 - DNA, 22 bp, Artificial Sequence
  chemically synthesized
cttccatacattgtctttcagc

SEQ ID NO: 1036332 - DNA, 22 bp, Artificial Sequence
  chemically synthesized
aaattctatttgctgaaagaca

SEQ ID NO: 1036333 - DNA, 22 bp, Artificial Sequence
  chemically synthesized
tatttgctgaaagacaatgtat

SEQ ID NO: 1036334 - DNA, 22 bp, Artificial Sequence
  chemically synthesized
tttgctgaaagacaatgtatgg

SEQ ID NO: 1036335 - DNA, 22 bp, Artificial Sequence
  chemically synthesized
acatacctgcttccatacattg

SEQ ID NO: 1036336 - DNA, 22 bp, Artificial Sequence
  chemically synthesized
gctgaaagacaatgtatggaag

SEQ ID NO: 1036337 - DNA, 22 bp, Artificial Sequence
  chemically synthesized
ctgaaagacaatgtatggaagc

SEQ ID NO: 1036338 - DNA, 22 bp, Artificial Sequence
  chemically synthesized
tctaacatacctgcttccatac

SEQ ID NO: 1036339 - DNA, 22 bp, Artificial Sequence
  chemically synthesized
aaagacaatgtatggaagcagg

SEQ ID NO: 1036340 - DNA, 22 bp, Artificial Sequence
  chemically synthesized
attatctaacatacctgcttcc

SEQ ID NO: 1036341 - DNA, 22 bp, Artificial Sequence
  chemically synthesized
attcattatctaacatacctgc

SEQ ID NO: 1036342 - DNA, 22 bp, Artificial Sequence
  chemically synthesized
ctcattcattatctaacatacc

SEQ ID NO: 1036343 - DNA, 22 bp, Artificial Sequence
  chemically synthesized
tgactgctcattcattatctaa

SEQ ID NO: 1036344 - DNA, 22 bp, Artificial Sequence
  chemically synthesized
atgactgctcattcattatcta

SEQ ID NO: 1036345 - DNA, 22 bp, Artificial Sequence
  chemically synthesized
atttatgactgctcattcatta

SEQ ID NO: 1036346 - DNA, 22 bp, Artificial Sequence
  chemically synthesized
gataatgaatgagcagtcataa

SEQ ID NO: 1036347 - DNA, 22 bp, Artificial Sequence
  chemically synthesized
aaaagccagactaatttatgac

SEQ ID NO: 1036348 - DNA, 22 bp, Artificial Sequence
  chemically synthesized
aaaaagccagactaatttatga

SEQ ID NO: 1036349 - DNA, 22 bp, Artificial Sequence
  chemically synthesized
gatgagaacaggaagatattta

SEQ ID NO: 1036350 - DNA, 22 bp, Artificial Sequence
  chemically synthesized
gtctggctttttaaatatcttc

SEQ ID NO: 1036351 - DNA, 22 bp, Artificial Sequence
  chemically synthesized
agatgagaacaggaagatattt

SEQ ID NO: 1036352 - DNA, 22 bp, Artificial Sequence
  chemically synthesized
tagatgagaacaggaagatatt

SEQ ID NO: 1036353 - DNA, 22 bp, Artificial Sequence
  chemically synthesized
gctttttaaatatcttcctgtt

SEQ ID NO: 1036354 - DNA, 22 bp, Artificial Sequence
  chemically synthesized
cgctttagatgagaacaggaag

SEQ ID NO: 1036355 - DNA, 22 bp, Artificial Sequence
  chemically synthesized
tttaaatatcttcctgttctca

SEQ ID NO: 1036356 - DNA, 22 bp, Artificial Sequence
  chemically synthesized
ttaaatatcttcctgttctcat

SEQ ID NO: 1036357 - DNA, 22 bp, Artificial Sequence
  chemically synthesized
taaatatcttcctgttctcatc

SEQ ID NO: 1036358 - DNA, 22 bp, Artificial Sequence
  chemically synthesized
aaatatcttcctgttctcatct

SEQ ID NO: 1036359 - DNA, 22 bp, Artificial Sequence
  chemically synthesized
aatatcttcctgttctcatcta

SEQ ID NO: 1036360 - DNA, 22 bp, Artificial Sequence
  chemically synthesized
cctgttctcatctaaagcgtaa

SEQ ID NO: 1036361 - DNA, 22 bp, Artificial Sequence
  chemically synthesized
ctgttctcatctaaagcgtaat

SEQ ID NO: 1036362 - DNA, 22 bp, Artificial Sequence
  chemically synthesized
ttctcatctaaagcgtaatgtc

SEQ ID NO: 1036363 - DNA, 22 bp, Artificial Sequence
  chemically synthesized
tcatctaaagcgtaatgtctgt

SEQ ID NO: 1036364 - DNA, 22 bp, Artificial Sequence
  chemically synthesized
atctaaagcgtaatgtctgttt

SEQ ID NO: 1036365 - DNA, 22 bp, Artificial Sequence
  chemically synthesized
aatgtcataaggtaaaacagac

SEQ ID NO: 1036366 - DNA, 22 bp, Artificial Sequence
  chemically synthesized
aagcgtaatgtctgttttacct

SEQ ID NO: 1036367 - DNA, 22 bp, Artificial Sequence
  chemically synthesized
ttaaatgtcataaggtaaaaca

SEQ ID NO: 1036368 - DNA, 22 bp, Artificial Sequence
  chemically synthesized
tattaaatgtcataaggtaaaa

SEQ ID NO: 1036369 - DNA, 22 bp, Artificial Sequence
  chemically synthesized
agtcatctctattaaatgtcat

SEQ ID NO: 1036370 - DNA, 22 bp, Artificial Sequence
  chemically synthesized
ttttaccttatgacatttaata

SEQ ID NO: 1036371 - DNA, 22 bp, Artificial Sequence
  chemically synthesized
gttcagtcatctctattaaatg

SEQ ID NO: 1036372 - DNA, 22 bp, Artificial Sequence
  chemically synthesized
taccttatgacatttaatagag

SEQ ID NO: 1036373 - DNA, 22 bp, Artificial Sequence
  chemically synthesized
tcgttcagtcatctctattaaa

SEQ ID NO: 1036374 - DNA, 22 bp, Artificial Sequence
  chemically synthesized
accttatgacatttaatagaga

SEQ ID NO: 1036375 - DNA, 22 bp, Artificial Sequence
  chemically synthesized
ctcgttcagtcatctctattaa

SEQ ID NO: 1036376 - DNA, 22 bp, Artificial Sequence
  chemically synthesized
ccttatgacatttaatagagat

SEQ ID NO: 1036377 - DNA, 22 bp, Artificial Sequence
  chemically synthesized
atgacatttaatagagatgact

SEQ ID NO: 1036378 - DNA, 22 bp, Artificial Sequence
  chemically synthesized
tgacatttaatagagatgactg

SEQ ID NO: 1036379 - DNA, 22 bp, Artificial Sequence
  chemically synthesized
cgtatttctcgttcagtcatct

SEQ ID NO: 1036380 - DNA, 22 bp, Artificial Sequence
  chemically synthesized
aatagagatgactgaacgagaa

SEQ ID NO: 1036381 - DNA, 22 bp, Artificial Sequence
  chemically synthesized
atagagatgactgaacgagaaa

SEQ ID NO: 1036382 - DNA, 22 bp, Artificial Sequence
  chemically synthesized
aatagtacatctgcgtatttct

SEQ ID NO: 1036383 - DNA, 22 bp, Artificial Sequence
  chemically synthesized
aacgagaaatacgcagatgtac

SEQ ID NO: 1036384 - DNA, 22 bp, Artificial Sequence
  chemically synthesized
agcacatactaaatagtacatc

SEQ ID NO: 1036385 - DNA, 22 bp, Artificial Sequence
  chemically synthesized
cctaagcacatactaaatagta

SEQ ID NO: 1036386 - DNA, 22 bp, Artificial Sequence
  chemically synthesized
gcctaagcacatactaaatagt

SEQ ID NO: 1036387 - DNA, 22 bp, Artificial Sequence
  chemically synthesized
tgtgacttgcctaagcacatac

SEQ ID NO: 1036388 - DNA, 22 bp, Artificial Sequence
  chemically synthesized
tttagtatgtgcttaggcaagt

SEQ ID NO: 1036389 - DNA, 22 bp, Artificial Sequence
  chemically synthesized
aaagatgttatgtgacttgcct

SEQ ID NO: 1036390 - DNA, 22 bp, Artificial Sequence
  chemically synthesized
agtatgtgcttaggcaagtcac

SEQ ID NO: 1036391 - DNA, 22 bp, Artificial Sequence
  chemically synthesized
caaagatgttatgtgacttgcc

SEQ ID NO: 1036392 - DNA, 22 bp, Artificial Sequence
  chemically synthesized
gtatgtgcttaggcaagtcaca

SEQ ID NO: 1036393 - DNA, 22 bp, Artificial Sequence
  chemically synthesized
tatttcaaagatgttatgtgac

SEQ ID NO: 1036394 - DNA, 22 bp, Artificial Sequence
  chemically synthesized
aggcaagtcacataacatcttt

SEQ ID NO: 1036395 - DNA, 22 bp, Artificial Sequence
  chemically synthesized
ggcaagtcacataacatctttg

SEQ ID NO: 1036396 - DNA, 22 bp, Artificial Sequence
  chemically synthesized
taagggagaaaactatatttca

SEQ ID NO: 1036397 - DNA, 22 bp, Artificial Sequence
  chemically synthesized
ataagggagaaaactatatttc

SEQ ID NO: 1036398 - DNA, 22 bp, Artificial Sequence
  chemically synthesized
tataagggagaaaactatattt

SEQ ID NO: 1036399 - DNA, 22 bp, Artificial Sequence
  chemically synthesized
ttttataagggagaaaactata

SEQ ID NO: 1036400 - DNA, 22 bp, Artificial Sequence
  chemically synthesized
attattttataagggagaaaac

SEQ ID NO: 1036401 - DNA, 22 bp, Artificial Sequence
  chemically synthesized
cattattttataagggagaaaa

SEQ ID NO: 1036402 - DNA, 22 bp, Artificial Sequence
  chemically synthesized
tgaaatatagttttctccctta

SEQ ID NO: 1036403 - DNA, 22 bp, Artificial Sequence
  chemically synthesized
gaaatatagttttctcccttat

SEQ ID NO: 1036404 - DNA, 22 bp, Artificial Sequence
  chemically synthesized
cttcattattttataagggaga

SEQ ID NO: 1036405 - DNA, 22 bp, Artificial Sequence
  chemically synthesized
aaatatagttttctcccttata

SEQ ID NO: 1036406 - DNA, 22 bp, Artificial Sequence
  chemically synthesized
ccctgcttcattattttataag

SEQ ID NO: 1036407 - DNA, 22 bp, Artificial Sequence
  chemically synthesized
gccctgcttcattattttataa

SEQ ID NO: 1036408 - DNA, 22 bp, Artificial Sequence
  chemically synthesized
tgccctgcttcattattttata

SEQ ID NO: 1036409 - DNA, 22 bp, Artificial Sequence
  chemically synthesized
tctcccttataaaataatgaag

SEQ ID NO: 1036410 - DNA, 22 bp, Artificial Sequence
  chemically synthesized
ctcccttataaaataatgaagc

SEQ ID NO: 1036411 - DNA, 22 bp, Artificial Sequence
  chemically synthesized
tcccttataaaataatgaagca

SEQ ID NO: 1036412 - DNA, 22 bp, Artificial Sequence
  chemically synthesized
gtggttttgccctgcttcatta

SEQ ID NO: 1036413 - DNA, 22 bp, Artificial Sequence
  chemically synthesized
agtggttttgccctgcttcatt

SEQ ID NO: 1036414 - DNA, 22 bp, Artificial Sequence
  chemically synthesized
ccttataaaataatgaagcagg

SEQ ID NO: 1036415 - DNA, 22 bp, Artificial Sequence
  chemically synthesized
ataaaataatgaagcagggcaa

SEQ ID NO: 1036416 - DNA, 22 bp, Artificial Sequence
  chemically synthesized
taaaataatgaagcagggcaaa

SEQ ID NO: 1036417 - DNA, 22 bp, Artificial Sequence
  chemically synthesized
gaaaatgccttagtggttttgc

SEQ ID NO: 1036418 - DNA, 22 bp, Artificial Sequence
  chemically synthesized
cagctagaaaatgccttagtgg

SEQ ID NO: 1036419 - DNA, 22 bp, Artificial Sequence
  chemically synthesized
acagctagaaaatgccttagtg

SEQ ID NO: 1036420 - DNA, 22 bp, Artificial Sequence
  chemically synthesized
tacagctagaaaatgccttagt

SEQ ID NO: 1036421 - DNA, 22 bp, Artificial Sequence
  chemically synthesized
ttttacagctagaaaatgcctt

SEQ ID NO: 1036422 - DNA, 22 bp, Artificial Sequence
  chemically synthesized
taacaggattgttttacagcta

SEQ ID NO: 1036423 - DNA, 22 bp, Artificial Sequence
  chemically synthesized
ataacaggattgttttacagct

SEQ ID NO: 1036424 - DNA, 22 bp, Artificial Sequence
  chemically synthesized
aggcattttctagctgtaaaac

SEQ ID NO: 1036425 - DNA, 22 bp, Artificial Sequence
  chemically synthesized
ataatttataacaggattgttt

SEQ ID NO: 1036426 - DNA, 22 bp, Artificial Sequence
  chemically synthesized
tctagctgtaaaacaatcctgt

SEQ ID NO: 1036427 - DNA, 22 bp, Artificial Sequence
  chemically synthesized
ctagctgtaaaacaatcctgtt

SEQ ID NO: 1036428 - DNA, 22 bp, Artificial Sequence
  chemically synthesized
tagctgtaaaacaatcctgtta

SEQ ID NO: 1036429 - DNA, 22 bp, Artificial Sequence
  chemically synthesized
gctgtaaaacaatcctgttata

SEQ ID NO: 1036430 - DNA, 22 bp, Artificial Sequence
  chemically synthesized
taaaacaatcctgttataaatt

SEQ ID NO: 1036431 - DNA, 22 bp, Artificial Sequence
  chemically synthesized
gagatagttaataatttataac

SEQ ID NO: 1036432 - DNA, 22 bp, Artificial Sequence
  chemically synthesized
ttagagatagttaataatttat

SEQ ID NO: 1036433 - DNA, 22 bp, Artificial Sequence
  chemically synthesized
aaattattagagatagttaata

SEQ ID NO: 1036434 - DNA, 22 bp, Artificial Sequence
  chemically synthesized
ttataaattattaactatctct

SEQ ID NO: 1036435 - DNA, 22 bp, Artificial Sequence
  chemically synthesized
taaattattaactatctctaat

SEQ ID NO: 1036436 - DNA, 22 bp, Artificial Sequence
  chemically synthesized
aaccataattcaaattattaga

SEQ ID NO: 1036437 - DNA, 22 bp, Artificial Sequence
  chemically synthesized
ttaactatctctaataatttga

SEQ ID NO: 1036438 - DNA, 22 bp, Artificial Sequence
  chemically synthesized
ctgaaccataattcaaattatt

SEQ ID NO: 1036439 - DNA, 22 bp, Artificial Sequence
  chemically synthesized
gctgaaccataattcaaattat

SEQ ID NO: 1036440 - DNA, 22 bp, Artificial Sequence
  chemically synthesized
actatctctaataatttgaatt

SEQ ID NO: 1036441 - DNA, 22 bp, Artificial Sequence
  chemically synthesized
tctctaataatttgaattatgg

SEQ ID NO: 1036442 - DNA, 22 bp, Artificial Sequence
  chemically synthesized
atatttgctgaaccataattca

SEQ ID NO: 1036443 - DNA, 22 bp, Artificial Sequence
  chemically synthesized
taataatttgaattatggttca

SEQ ID NO: 1036444 - DNA, 22 bp, Artificial Sequence
  chemically synthesized
ataatttgaattatggttcagc

SEQ ID NO: 1036445 - DNA, 22 bp, Artificial Sequence
  chemically synthesized
gaattatggttcagcaaatatt

SEQ ID NO: 1036446 - DNA, 22 bp, Artificial Sequence
  chemically synthesized
aattatggttcagcaaatatta

SEQ ID NO: 1036447 - DNA, 22 bp, Artificial Sequence
  chemically synthesized
tggttcagcaaatattaacatc

SEQ ID NO: 1036448 - DNA, 22 bp, Artificial Sequence
  chemically synthesized
cagtggaaggggggagagatgt

SEQ ID NO: 1036449 - DNA, 22 bp, Artificial Sequence
  chemically synthesized
agcaaatattaacatctctccc

SEQ ID NO: 1036450 - DNA, 22 bp, Artificial Sequence
  chemically synthesized
ctacagtggaaggggggagaga

SEQ ID NO: 1036451 - DNA, 22 bp, Artificial Sequence
  chemically synthesized
cctacagtggaaggggggagag

SEQ ID NO: 1036452 - DNA, 22 bp, Artificial Sequence
  chemically synthesized
ttcctacagtggaaggggggag

SEQ ID NO: 1036453 - DNA, 22 bp, Artificial Sequence
  chemically synthesized
acatctctccccccttccactg

SEQ ID NO: 1036454 - DNA, 22 bp, Artificial Sequence
  chemically synthesized
tccccccttccactgtaggaag

SEQ ID NO: 1036455 - DNA, 22 bp, Artificial Sequence
  chemically synthesized
cccccttccactgtaggaagag

SEQ ID NO: 1036456 - DNA, 22 bp, Artificial Sequence
  chemically synthesized
ccactgtaggaagagtctactt

SEQ ID NO: 1036457 - DNA, 22 bp, Artificial Sequence
  chemically synthesized
cactgtaggaagagtctacttt

SEQ ID NO: 1036458 - DNA, 22 bp, Artificial Sequence
  chemically synthesized
acatcaatagaatgagaaagta

SEQ ID NO: 1036459 - DNA, 22 bp, Artificial Sequence
  chemically synthesized
taggaagagtctactttctcat

SEQ ID NO: 1036460 - DNA, 22 bp, Artificial Sequence
  chemically synthesized
ccaaatctgacatcaatagaat

SEQ ID NO: 1036461 - DNA, 22 bp, Artificial Sequence
  chemically synthesized
ctttctcattctattgatgtca

SEQ ID NO: 1036462 - DNA, 22 bp, Artificial Sequence
  chemically synthesized
cgttgccaaatctgacatcaat

SEQ ID NO: 1036463 - DNA, 22 bp, Artificial Sequence
  chemically synthesized
tctcattctattgatgtcagat

SEQ ID NO: 1036464 - DNA, 22 bp, Artificial Sequence
  chemically synthesized
ctcattctattgatgtcagatt

SEQ ID NO: 1036465 - DNA, 22 bp, Artificial Sequence
  chemically synthesized
tcattctattgatgtcagattt

SEQ ID NO: 1036466 - DNA, 22 bp, Artificial Sequence
  chemically synthesized
attctattgatgtcagatttgg

SEQ ID NO: 1036467 - DNA, 22 bp, Artificial Sequence
  chemically synthesized
tattgatgtcagatttggcaac

SEQ ID NO: 1036468 - DNA, 22 bp, Artificial Sequence
  chemically synthesized
ttgatgtcagatttggcaacgt

SEQ ID NO: 1036469 - DNA, 22 bp, Artificial Sequence
  chemically synthesized
gccaaagcaaattacgttgcca

SEQ ID NO: 1036470 - DNA, 22 bp, Artificial Sequence
  chemically synthesized
atgtcagatttggcaacgtaat

SEQ ID NO: 1036471 - DNA, 22 bp, Artificial Sequence
  chemically synthesized
attggccaaagcaaattacgtt

SEQ ID NO: 1036472 - DNA, 22 bp, Artificial Sequence
  chemically synthesized
gattggccaaagcaaattacgt

SEQ ID NO: 1036473 - DNA, 22 bp, Artificial Sequence
  chemically synthesized
acatttgattggccaaagcaaa

SEQ ID NO: 1036474 - DNA, 22 bp, Artificial Sequence
  chemically synthesized
ggcaacgtaatttgctttggcc

SEQ ID NO: 1036475 - DNA, 22 bp, Artificial Sequence
  chemically synthesized
gcaacgtaatttgctttggcca

SEQ ID NO: 1036476 - DNA, 22 bp, Artificial Sequence
  chemically synthesized
actgacatttgattggccaaag

SEQ ID NO: 1036477 - DNA, 22 bp, Artificial Sequence
  chemically synthesized
tgaagttcactgacatttgatt

SEQ ID NO: 1036478 - DNA, 22 bp, Artificial Sequence
  chemically synthesized
gctttggccaatcaaatgtcag

SEQ ID NO: 1036479 - DNA, 22 bp, Artificial Sequence
  chemically synthesized
ctgtgaagttcactgacatttg

SEQ ID NO: 1036480 - DNA, 22 bp, Artificial Sequence
  chemically synthesized
ctttggccaatcaaatgtcagt

SEQ ID NO: 1036481 - DNA, 22 bp, Artificial Sequence
  chemically synthesized
ctcctgtgaagttcactgacat

SEQ ID NO: 1036482 - DNA, 22 bp, Artificial Sequence
  chemically synthesized
tggccaatcaaatgtcagtgaa

SEQ ID NO: 1036483 - DNA, 22 bp, Artificial Sequence
  chemically synthesized
ggccaatcaaatgtcagtgaac

SEQ ID NO: 1036484 - DNA, 22 bp, Artificial Sequence
  chemically synthesized
tgctcctgtgaagttcactgac

SEQ ID NO: 1036485 - DNA, 22 bp, Artificial Sequence
  chemically synthesized
gccaatcaaatgtcagtgaact

SEQ ID NO: 1036486 - DNA, 22 bp, Artificial Sequence
  chemically synthesized
atggcctctgctcctgtgaagt

SEQ ID NO: 1036487 - DNA, 22 bp, Artificial Sequence
  chemically synthesized
ccaagaacactcatggcctctg

SEQ ID NO: 1036488 - DNA, 22 bp, Artificial Sequence
  chemically synthesized
cacaggagcagaggccatgagt

SEQ ID NO: 1036489 - DNA, 22 bp, Artificial Sequence
  chemically synthesized
acaggagcagaggccatgagtg

SEQ ID NO: 1036490 - DNA, 22 bp, Artificial Sequence
  chemically synthesized
aacctcccaagaacactcatgg

SEQ ID NO: 1036491 - DNA, 22 bp, Artificial Sequence
  chemically synthesized
ttgggaggtttaggtttatact

SEQ ID NO: 1036492 - DNA, 22 bp, Artificial Sequence
  chemically synthesized
gggaggtttaggtttatacttt

SEQ ID NO: 1036493 - DNA, 22 bp, Artificial Sequence
  chemically synthesized
ggaggtttaggtttatactttg

SEQ ID NO: 1036494 - DNA, 22 bp, Artificial Sequence
  chemically synthesized
atgaccagtcaccaaagtataa

SEQ ID NO: 1036495 - DNA, 22 bp, Artificial Sequence
  chemically synthesized
catgaccagtcaccaaagtata

SEQ ID NO: 1036496 - DNA, 22 bp, Artificial Sequence
  chemically synthesized
tcatgaccagtcaccaaagtat

SEQ ID NO: 1036497 - DNA, 22 bp, Artificial Sequence
  chemically synthesized
aggtttatactttggtgactgg

SEQ ID NO: 1036498 - DNA, 22 bp, Artificial Sequence
  chemically synthesized
ggtttatactttggtgactggt

SEQ ID NO: 1036499 - DNA, 22 bp, Artificial Sequence
  chemically synthesized
atactttggtgactggtcatga

SEQ ID NO: 1036500 - DNA, 22 bp, Artificial Sequence
  chemically synthesized
tactttggtgactggtcatgaa

SEQ ID NO: 1036501 - DNA, 22 bp, Artificial Sequence
  chemically synthesized
tggtgactggtcatgaaaacat

SEQ ID NO: 1036502 - DNA, 22 bp, Artificial Sequence
  chemically synthesized
ggtgactggtcatgaaaacatg

SEQ ID NO: 1036503 - DNA, 22 bp, Artificial Sequence
  chemically synthesized
gtgactggtcatgaaaacatgt

SEQ ID NO: 1036504 - DNA, 22 bp, Artificial Sequence
  chemically synthesized
agatgaagggtcagtgacatgt

SEQ ID NO: 1036505 - DNA, 22 bp, Artificial Sequence
  chemically synthesized
gtcatgaaaacatgtcactgac

SEQ ID NO: 1036506 - DNA, 22 bp, Artificial Sequence
  chemically synthesized
gacctaagatgaagggtcagtg

SEQ ID NO: 1036507 - DNA, 22 bp, Artificial Sequence
  chemically synthesized
tggacctaagatgaagggtcag

SEQ ID NO: 1036508 - DNA, 22 bp, Artificial Sequence
  chemically synthesized
ctctggacctaagatgaagggt

SEQ ID NO: 1036509 - DNA, 22 bp, Artificial Sequence
  chemically synthesized
gctctggacctaagatgaaggg

SEQ ID NO: 1036510 - DNA, 22 bp, Artificial Sequence
  chemically synthesized
tgctctggacctaagatgaagg

SEQ ID NO: 1036511 - DNA, 22 bp, Artificial Sequence
  chemically synthesized
acccttcatcttaggtccagag

SEQ ID NO: 1036512 - DNA, 22 bp, Artificial Sequence
  chemically synthesized
tatatgtctttgctctggacct

SEQ ID NO: 1036513 - DNA, 22 bp, Artificial Sequence
  chemically synthesized
ctatatatgtctttgctctgga

SEQ ID NO: 1036514 - DNA, 22 bp, Artificial Sequence
  chemically synthesized
catcttaggtccagagcaaaga

SEQ ID NO: 1036515 - DNA, 22 bp, Artificial Sequence
  chemically synthesized
atcttaggtccagagcaaagac

SEQ ID NO: 1036516 - DNA, 22 bp, Artificial Sequence
  chemically synthesized
aggtctgctatatatgtctttg

SEQ ID NO: 1036517 - DNA, 22 bp, Artificial Sequence
  chemically synthesized
aggtccagagcaaagacatata

SEQ ID NO: 1036518 - DNA, 22 bp, Artificial Sequence
  chemically synthesized
ggtccagagcaaagacatatat

SEQ ID NO: 1036519 - DNA, 22 bp, Artificial Sequence
  chemically synthesized
gattaaggtctgctatatatgt

SEQ ID NO: 1036520 - DNA, 22 bp, Artificial Sequence
  chemically synthesized
catgatgcatgttggattaagg

SEQ ID NO: 1036521 - DNA, 22 bp, Artificial Sequence
  chemically synthesized
ggttccatgatgcatgttggat

SEQ ID NO: 1036522 - DNA, 22 bp, Artificial Sequence
  chemically synthesized
gtagagctaggttccatgatgc

SEQ ID NO: 1036523 - DNA, 22 bp, Artificial Sequence
  chemically synthesized
aatccaacatgcatcatggaac

SEQ ID NO: 1036524 - DNA, 22 bp, Artificial Sequence
  chemically synthesized
atccaacatgcatcatggaacc

SEQ ID NO: 1036525 - DNA, 22 bp, Artificial Sequence
  chemically synthesized
aagatgtgggttagtagagcta

SEQ ID NO: 1036526 - DNA, 22 bp, Artificial Sequence
  chemically synthesized
caagatgtgggttagtagagct

SEQ ID NO: 1036527 - DNA, 22 bp, Artificial Sequence
  chemically synthesized
cttcaagatgtgggttagtaga

SEQ ID NO: 1036528 - DNA, 22 bp, Artificial Sequence
  chemically synthesized
tgcttcaagatgtgggttagta

SEQ ID NO: 1036529 - DNA, 22 bp, Artificial Sequence
  chemically synthesized
gctctactaacccacatcttga

SEQ ID NO: 1036530 - DNA, 22 bp, Artificial Sequence
  chemically synthesized
tactaacccacatcttgaagca

SEQ ID NO: 1036531 - DNA, 22 bp, Artificial Sequence
  chemically synthesized
gccgggaagctctgcttcaaga

SEQ ID NO: 1036532 - DNA, 22 bp, Artificial Sequence
  chemically synthesized
ggccgggaagctctgcttcaag

SEQ ID NO: 1036533 - DNA, 22 bp, Artificial Sequence
  chemically synthesized
ctaacccacatcttgaagcaga

SEQ ID NO: 1036534 - DNA, 22 bp, Artificial Sequence
  chemically synthesized
acccacatcttgaagcagagct

SEQ ID NO: 1036535 - DNA, 22 bp, Artificial Sequence
  chemically synthesized
ggcttggccgggaagctctgct

SEQ ID NO: 1036536 - DNA, 22 bp, Artificial Sequence
  chemically synthesized
agctgggcttggccgggaagct

SEQ ID NO: 1036537 - DNA, 22 bp, Artificial Sequence
  chemically synthesized
actcagctgggcttggccggga

SEQ ID NO: 1036538 - DNA, 22 bp, Artificial Sequence
  chemically synthesized
gaagcagagcttcccggccaag

SEQ ID NO: 1036539 - DNA, 22 bp, Artificial Sequence
  chemically synthesized
aagcagagcttcccggccaagc

SEQ ID NO: 1036540 - DNA, 22 bp, Artificial Sequence
  chemically synthesized
actgactcagctgggcttggcc

SEQ ID NO: 1036541 - DNA, 22 bp, Artificial Sequence
  chemically synthesized
gactgactcagctgggcttggc

SEQ ID NO: 1036542 - DNA, 22 bp, Artificial Sequence
  chemically synthesized
taccttgactgactcagctggg

SEQ ID NO: 1036543 - DNA, 22 bp, Artificial Sequence
  chemically synthesized
gtaccttgactgactcagctgg

SEQ ID NO: 1036544 - DNA, 22 bp, Artificial Sequence
  chemically synthesized
cccggccaagcccagctgagtc

SEQ ID NO: 1036545 - DNA, 22 bp, Artificial Sequence
  chemically synthesized
ccggccaagcccagctgagtca

SEQ ID NO: 1036546 - DNA, 22 bp, Artificial Sequence
  chemically synthesized
cttgtaccttgactgactcagc

SEQ ID NO: 1036547 - DNA, 22 bp, Artificial Sequence
  chemically synthesized
ggttacttgtaccttgactgac

SEQ ID NO: 1036548 - DNA, 22 bp, Artificial Sequence
  chemically synthesized
aggttacttgtaccttgactga

SEQ ID NO: 1036549 - DNA, 22 bp, Artificial Sequence
  chemically synthesized
tttaggttacttgtaccttgac

SEQ ID NO: 1036550 - DNA, 22 bp, Artificial Sequence
  chemically synthesized
gctgtttaggttacttgtacct

SEQ ID NO: 1036551 - DNA, 22 bp, Artificial Sequence
  chemically synthesized
tggctgtttaggttacttgtac

SEQ ID NO: 1036552 - DNA, 22 bp, Artificial Sequence
  chemically synthesized
agtcagtcaaggtacaagtaac

SEQ ID NO: 1036553 - DNA, 22 bp, Artificial Sequence
  chemically synthesized
ctggctgtttaggttacttgta

SEQ ID NO: 1036554 - DNA, 22 bp, Artificial Sequence
  chemically synthesized
aaaacaacaggcatttctggct

SEQ ID NO: 1036555 - DNA, 22 bp, Artificial Sequence
  chemically synthesized
actgaaaacaacaggcatttct

SEQ ID NO: 1036556 - DNA, 22 bp, Artificial Sequence
  chemically synthesized
ctgactgaaaacaacaggcatt

SEQ ID NO: 1036557 - DNA, 22 bp, Artificial Sequence
  chemically synthesized
gctgactgaaaacaacaggcat

SEQ ID NO: 1036558 - DNA, 22 bp, Artificial Sequence
  chemically synthesized
aacagccagaaatgcctgttgt

SEQ ID NO: 1036559 - DNA, 22 bp, Artificial Sequence
  chemically synthesized
gaacttgctgactgaaaacaac

SEQ ID NO: 1036560 - DNA, 22 bp, Artificial Sequence
  chemically synthesized
ttgttttcagtcagcaagttct

SEQ ID NO: 1036561 - DNA, 22 bp, Artificial Sequence
  chemically synthesized
ttttcagtcagcaagttctagg

SEQ ID NO: 1036562 - DNA, 22 bp, Artificial Sequence
  chemically synthesized
tgacacaaatcaccctagaact

SEQ ID NO: 1036563 - DNA, 22 bp, Artificial Sequence
  chemically synthesized
tcagtcagcaagttctagggtg

SEQ ID NO: 1036564 - DNA, 22 bp, Artificial Sequence
  chemically synthesized
cagtcagcaagttctagggtga

SEQ ID NO: 1036565 - DNA, 22 bp, Artificial Sequence
  chemically synthesized
agtcagcaagttctagggtgat

SEQ ID NO: 1036566 - DNA, 22 bp, Artificial Sequence
  chemically synthesized
tagggtgatttgtgtcacagca

SEQ ID NO: 1036567 - DNA, 22 bp, Artificial Sequence
  chemically synthesized
tgaccgcaataatgctgtgaca

SEQ ID NO: 1036568 - DNA, 22 bp, Artificial Sequence
  chemically synthesized
gggtgatttgtgtcacagcatt

SEQ ID NO: 1036569 - DNA, 22 bp, Artificial Sequence
  chemically synthesized
gctatgaccgcaataatgctgt

SEQ ID NO: 1036570 - DNA, 22 bp, Artificial Sequence
  chemically synthesized
gtgtcacagcattattgcggtc

SEQ ID NO: 1036571 - DNA, 22 bp, Artificial Sequence
  chemically synthesized
tgtcacagcattattgcggtca

SEQ ID NO: 1036572 - DNA, 22 bp, Artificial Sequence
  chemically synthesized
ttgcggtcatagctaatactac

SEQ ID NO: 1036573 - DNA, 22 bp, Artificial Sequence
  chemically synthesized
cggtcatagctaatactaccat

SEQ ID NO: 1036574 - DNA, 22 bp, Artificial Sequence
  chemically synthesized
aatggtacatgtatggtagtat

SEQ ID NO: 1036575 - DNA, 22 bp, Artificial Sequence
  chemically synthesized
aaatggtacatgtatggtagta

SEQ ID NO: 1036576 - DNA, 22 bp, Artificial Sequence
  chemically synthesized
ttaaatggtacatgtatggtag

SEQ ID NO: 1036577 - DNA, 22 bp, Artificial Sequence
  chemically synthesized
cttaaatggtacatgtatggta

SEQ ID NO: 1036578 - DNA, 22 bp, Artificial Sequence
  chemically synthesized
tcttaaatggtacatgtatggt

SEQ ID NO: 1036579 - DNA, 22 bp, Artificial Sequence
  chemically synthesized
ttcttaaatggtacatgtatgg

SEQ ID NO: 1036580 - DNA, 22 bp, Artificial Sequence
  chemically synthesized
atactaccatacatgtaccatt

SEQ ID NO: 1036581 - DNA, 22 bp, Artificial Sequence
  chemically synthesized
gtatttttcttaaatggtacat

SEQ ID NO: 1036582 - DNA, 22 bp, Artificial Sequence
  chemically synthesized
tattggtatttttcttaaatgg

SEQ ID NO: 1036583 - DNA, 22 bp, Artificial Sequence
  chemically synthesized
ccatacatgtaccatttaagaa

SEQ ID NO: 1036584 - DNA, 22 bp, Artificial Sequence
  chemically synthesized
gtaagaagggctatattggtat

SEQ ID NO: 1036585 - DNA, 22 bp, Artificial Sequence
  chemically synthesized
aagaaaaataccaatatagccc

SEQ ID NO: 1036586 - DNA, 22 bp, Artificial Sequence
  chemically synthesized
agctagtaagaagggctatatt

SEQ ID NO: 1036587 - DNA, 22 bp, Artificial Sequence
  chemically synthesized
agaaaaataccaatatagccct

SEQ ID NO: 1036588 - DNA, 22 bp, Artificial Sequence
  chemically synthesized
gagctagtaagaagggctatat

SEQ ID NO: 1036589 - DNA, 22 bp, Artificial Sequence
  chemically synthesized
aatcaaaataaatttgagctag

SEQ ID NO: 1036590 - DNA, 22 bp, Artificial Sequence
  chemically synthesized
ggttaaatcaaaataaatttga

SEQ ID NO: 1036591 - DNA, 22 bp, Artificial Sequence
  chemically synthesized
gggttaaatcaaaataaatttg

SEQ ID NO: 1036592 - DNA, 22 bp, Artificial Sequence
  chemically synthesized
cttactagctcaaatttatttt

SEQ ID NO: 1036593 - DNA, 22 bp, Artificial Sequence
  chemically synthesized
ttactagctcaaatttattttg

SEQ ID NO: 1036594 - DNA, 22 bp, Artificial Sequence
  chemically synthesized
actagctcaaatttattttgat

SEQ ID NO: 1036595 - DNA, 22 bp, Artificial Sequence
  chemically synthesized
ctagctcaaatttattttgatt

SEQ ID NO: 1036596 - DNA, 22 bp, Artificial Sequence
  chemically synthesized
gctcaaatttattttgatttaa

SEQ ID NO: 1036597 - DNA, 22 bp, Artificial Sequence
  chemically synthesized
gtaagccaatttgggttaaatc

SEQ ID NO: 1036598 - DNA, 22 bp, Artificial Sequence
  chemically synthesized
aaatttattttgatttaaccca

SEQ ID NO: 1036599 - DNA, 22 bp, Artificial Sequence
  chemically synthesized
agtaagccaatttgggttaaat

SEQ ID NO: 1036600 - DNA, 22 bp, Artificial Sequence
  chemically synthesized
tagtaagccaatttgggttaaa

SEQ ID NO: 1036601 - DNA, 22 bp, Artificial Sequence
  chemically synthesized
ttagtaagccaatttgggttaa

SEQ ID NO: 1036602 - DNA, 22 bp, Artificial Sequence
  chemically synthesized
tttagtaagccaatttgggtta

SEQ ID NO: 1036603 - DNA, 22 bp, Artificial Sequence
  chemically synthesized
attttgatttaacccaaattgg

SEQ ID NO: 1036604 - DNA, 22 bp, Artificial Sequence
  chemically synthesized
ttttgatttaacccaaattggc

SEQ ID NO: 1036605 - DNA, 22 bp, Artificial Sequence
  chemically synthesized
agttttttagtaagccaatttg

SEQ ID NO: 1036606 - DNA, 22 bp, Artificial Sequence
  chemically synthesized
tgatttaacccaaattggctta

SEQ ID NO: 1036607 - DNA, 22 bp, Artificial Sequence
  chemically synthesized
gatttaacccaaattggcttac

SEQ ID NO: 1036608 - DNA, 22 bp, Artificial Sequence
  chemically synthesized
ctgagttttttagtaagccaat

SEQ ID NO: 1036609 - DNA, 22 bp, Artificial Sequence
  chemically synthesized
atttaacccaaattggcttact

SEQ ID NO: 1036610 - DNA, 22 bp, Artificial Sequence
  chemically synthesized
aacccaaattggcttactaaaa

SEQ ID NO: 1036611 - DNA, 22 bp, Artificial Sequence
  chemically synthesized
acccaaattggcttactaaaaa

SEQ ID NO: 1036612 - DNA, 22 bp, Artificial Sequence
  chemically synthesized
aacaaaaatctgctgagttttt

SEQ ID NO: 1036613 - DNA, 22 bp, Artificial Sequence
  chemically synthesized
tcaacaaaaatctgctgagttt

SEQ ID NO: 1036614 - DNA, 22 bp, Artificial Sequence
  chemically synthesized
gcttactaaaaaactcagcaga

SEQ ID NO: 1036615 - DNA, 22 bp, Artificial Sequence
  chemically synthesized
actaaaaaactcagcagatttt

SEQ ID NO: 1036616 - DNA, 22 bp, Artificial Sequence
  chemically synthesized
ctaaaaaactcagcagattttt

SEQ ID NO: 1036617 - DNA, 22 bp, Artificial Sequence
  chemically synthesized
aaaaactcagcagatttttgtt

SEQ ID NO: 1036618 - DNA, 22 bp, Artificial Sequence
  chemically synthesized
atgtggtgttctcaacaaaaat

SEQ ID NO: 1036619 - DNA, 22 bp, Artificial Sequence
  chemically synthesized
catgtggtgttctcaacaaaaa

SEQ ID NO: 1036620 - DNA, 22 bp, Artificial Sequence
  chemically synthesized
agcagatttttgttgagaacac

SEQ ID NO: 1036621 - DNA, 22 bp, Artificial Sequence
  chemically synthesized
agtacagccttcatgtggtgtt

SEQ ID NO: 1036622 - DNA, 22 bp, Artificial Sequence
  chemically synthesized
ttgttgagaacaccacatgaag

SEQ ID NO: 1036623 - DNA, 22 bp, Artificial Sequence
  chemically synthesized
tgttgagaacaccacatgaagg

SEQ ID NO: 1036624 - DNA, 22 bp, Artificial Sequence
  chemically synthesized
gttgagaacaccacatgaaggc

SEQ ID NO: 1036625 - DNA, 22 bp, Artificial Sequence
  chemically synthesized
ttgagaacaccacatgaaggct

SEQ ID NO: 1036626 - DNA, 22 bp, Artificial Sequence
  chemically synthesized
agaacaccacatgaaggctgta

SEQ ID NO: 1036627 - DNA, 22 bp, Artificial Sequence
  chemically synthesized
aatacacaaatgttcagtacag

SEQ ID NO: 1036628 - DNA, 22 bp, Artificial Sequence
  chemically synthesized
ctgaatacacaaatgttcagta

SEQ ID NO: 1036629 - DNA, 22 bp, Artificial Sequence
  chemically synthesized
tgcattcctgaatacacaaatg

SEQ ID NO: 1036630 - DNA, 22 bp, Artificial Sequence
  chemically synthesized
tactgaacatttgtgtattcag

SEQ ID NO: 1036631 - DNA, 22 bp, Artificial Sequence
  chemically synthesized
gaagctatgcattcctgaatac

SEQ ID NO: 1036632 - DNA, 22 bp, Artificial Sequence
  chemically synthesized
agaagctatgcattcctgaata

SEQ ID NO: 1036633 - DNA, 22 bp, Artificial Sequence
  chemically synthesized
aacatttgtgtattcaggaatg

SEQ ID NO: 1036634 - DNA, 22 bp, Artificial Sequence
  chemically synthesized
gtgtattcaggaatgcatagct

SEQ ID NO: 1036635 - DNA, 22 bp, Artificial Sequence
  chemically synthesized
gagagatttagaagctatgcat

SEQ ID NO: 1036636 - DNA, 22 bp, Artificial Sequence
  chemically synthesized
tgtattcaggaatgcatagctt

SEQ ID NO: 1036637 - DNA, 22 bp, Artificial Sequence
  chemically synthesized
ggagagatttagaagctatgca

SEQ ID NO: 1036638 - DNA, 22 bp, Artificial Sequence
  chemically synthesized
aggaatgcatagcttctaaatc

SEQ ID NO: 1036639 - DNA, 22 bp, Artificial Sequence
  chemically synthesized
aatccttggagagatttagaag

SEQ ID NO: 1036640 - DNA, 22 bp, Artificial Sequence
  chemically synthesized
gaatccttggagagatttagaa

SEQ ID NO: 1036641 - DNA, 22 bp, Artificial Sequence
  chemically synthesized
ttgaatccttggagagatttag

SEQ ID NO: 1036642 - DNA, 22 bp, Artificial Sequence
  chemically synthesized
ctaaatctctccaaggattcaa

SEQ ID NO: 1036643 - DNA, 22 bp, Artificial Sequence
  chemically synthesized
taaatctctccaaggattcaag

SEQ ID NO: 1036644 - DNA, 22 bp, Artificial Sequence
  chemically synthesized
aatctctccaaggattcaagaa

SEQ ID NO: 1036645 - DNA, 22 bp, Artificial Sequence
  chemically synthesized
tccaaggattcaagaatctacc

SEQ ID NO: 1036646 - DNA, 22 bp, Artificial Sequence
  chemically synthesized
agtcccatacaatggtagattc

SEQ ID NO: 1036647 - DNA, 22 bp, Artificial Sequence
  chemically synthesized
caaggattcaagaatctaccat

SEQ ID NO: 1036648 - DNA, 22 bp, Artificial Sequence
  chemically synthesized
ctaagtcccatacaatggtaga

SEQ ID NO: 1036649 - DNA, 22 bp, Artificial Sequence
  chemically synthesized
aagaatctaccattgtatggga

SEQ ID NO: 1036650 - DNA, 22 bp, Artificial Sequence
  chemically synthesized
gtgtcctactaagtcccataca

SEQ ID NO: 1036651 - DNA, 22 bp, Artificial Sequence
  chemically synthesized
ccattgtatgggacttagtagg

SEQ ID NO: 1036652 - DNA, 22 bp, Artificial Sequence
  chemically synthesized
tatgggacttagtaggacacga

SEQ ID NO: 1036653 - DNA, 22 bp, Artificial Sequence
  chemically synthesized
tagtggcagtcaacacctcgtg

SEQ ID NO: 1036654 - DNA, 22 bp, Artificial Sequence
  chemically synthesized
attgtagtggcagtcaacacct

SEQ ID NO: 1036655 - DNA, 22 bp, Artificial Sequence
  chemically synthesized
agtaggacacgaggtgttgact

SEQ ID NO: 1036656 - DNA, 22 bp, Artificial Sequence
  chemically synthesized
cattgtagtggcagtcaacacc

SEQ ID NO: 1036657 - DNA, 22 bp, Artificial Sequence
  chemically synthesized
gtaggacacgaggtgttgactg

SEQ ID NO: 1036658 - DNA, 22 bp, Artificial Sequence
  chemically synthesized
ttcattgtagtggcagtcaaca

SEQ ID NO: 1036659 - DNA, 22 bp, Artificial Sequence
  chemically synthesized
ttcttcattgtagtggcagtca

SEQ ID NO: 1036660 - DNA, 22 bp, Artificial Sequence
  chemically synthesized
gttcttcattgtagtggcagtc

SEQ ID NO: 1036661 - DNA, 22 bp, Artificial Sequence
  chemically synthesized
aatttgttcttcattgtagtgg

SEQ ID NO: 1036662 - DNA, 22 bp, Artificial Sequence
  chemically synthesized
actgccactacaatgaagaaca

SEQ ID NO: 1036663 - DNA, 22 bp, Artificial Sequence
  chemically synthesized
ccactacaatgaagaacaaatt

SEQ ID NO: 1036664 - DNA, 22 bp, Artificial Sequence
  chemically synthesized
caatgaagaacaaattcagcta

SEQ ID NO: 1036665 - DNA, 22 bp, Artificial Sequence
  chemically synthesized
ccagagatcagggaaaataaat

SEQ ID NO: 1036666 - DNA, 22 bp, Artificial Sequence
  chemically synthesized
ttgccagagatcagggaaaata

SEQ ID NO: 1036667 - DNA, 22 bp, Artificial Sequence
  chemically synthesized
attgccagagatcagggaaaat

SEQ ID NO: 1036668 - DNA, 22 bp, Artificial Sequence
  chemically synthesized
ttattgccagagatcagggaaa

SEQ ID NO: 1036669 - DNA, 22 bp, Artificial Sequence
  chemically synthesized
agctatttattttccctgatct

SEQ ID NO: 1036670 - DNA, 22 bp, Artificial Sequence
  chemically synthesized
ggttcttattgccagagatcag

SEQ ID NO: 1036671 - DNA, 22 bp, Artificial Sequence
  chemically synthesized
tttattttccctgatctctggc

SEQ ID NO: 1036672 - DNA, 22 bp, Artificial Sequence
  chemically synthesized
attttccctgatctctggcaat

SEQ ID NO: 1036673 - DNA, 22 bp, Artificial Sequence
  chemically synthesized
ttttccctgatctctggcaata

SEQ ID NO: 1036674 - DNA, 22 bp, Artificial Sequence
  chemically synthesized
tccctgatctctggcaataaga

SEQ ID NO: 1036675 - DNA, 22 bp, Artificial Sequence
  chemically synthesized
ccctgatctctggcaataagaa

SEQ ID NO: 1036676 - DNA, 22 bp, Artificial Sequence
  chemically synthesized
cctgatctctggcaataagaac

SEQ ID NO: 1036677 - DNA, 22 bp, Artificial Sequence
  chemically synthesized
ggccacagaactaggttcttat

SEQ ID NO: 1036678 - DNA, 22 bp, Artificial Sequence
  chemically synthesized
aggccacagaactaggttctta

SEQ ID NO: 1036679 - DNA, 22 bp, Artificial Sequence
  chemically synthesized
atctctggcaataagaacctag

SEQ ID NO: 1036680 - DNA, 22 bp, Artificial Sequence
  chemically synthesized
tggcaataagaacctagttctg

SEQ ID NO: 1036681 - DNA, 22 bp, Artificial Sequence
  chemically synthesized
gcaataagaacctagttctgtg

SEQ ID NO: 1036682 - DNA, 22 bp, Artificial Sequence
  chemically synthesized
caatacaggtttaggccacaga

SEQ ID NO: 1036683 - DNA, 22 bp, Artificial Sequence
  chemically synthesized
ttacaatacaggtttaggccac

SEQ ID NO: 1036684 - DNA, 22 bp, Artificial Sequence
  chemically synthesized
ctgttacaatacaggtttaggc

SEQ ID NO: 1036685 - DNA, 22 bp, Artificial Sequence
  chemically synthesized
gttctgtggcctaaacctgtat

SEQ ID NO: 1036686 - DNA, 22 bp, Artificial Sequence
  chemically synthesized
atgactgctgttacaatacagg

SEQ ID NO: 1036687 - DNA, 22 bp, Artificial Sequence
  chemically synthesized
tgtggcctaaacctgtattgta

SEQ ID NO: 1036688 - DNA, 22 bp, Artificial Sequence
  chemically synthesized
tggcctaaacctgtattgtaac

SEQ ID NO: 1036689 - DNA, 22 bp, Artificial Sequence
  chemically synthesized
aacctgtattgtaacagcagtc

SEQ ID NO: 1036690 - DNA, 22 bp, Artificial Sequence
  chemically synthesized
atgggccatagattgatgactg

SEQ ID NO: 1036691 - DNA, 22 bp, Artificial Sequence
  chemically synthesized
tattgtaacagcagtcatcaat

SEQ ID NO: 1036692 - DNA, 22 bp, Artificial Sequence
  chemically synthesized
ctgatgggccatagattgatga

SEQ ID NO: 1036693 - DNA, 22 bp, Artificial Sequence
  chemically synthesized
taacagcagtcatcaatctatg

SEQ ID NO: 1036694 - DNA, 22 bp, Artificial Sequence
  chemically synthesized
gaattgctgatgggccatagat

SEQ ID NO: 1036695 - DNA, 22 bp, Artificial Sequence
  chemically synthesized
tggcccatcagcaattccagcc

SEQ ID NO: 1036696 - DNA, 22 bp, Artificial Sequence
  chemically synthesized
ccaaggcagatggcaggctgga

SEQ ID NO: 1036697 - DNA, 22 bp, Artificial Sequence
  chemically synthesized
accaaggcagatggcaggctgg

SEQ ID NO: 1036698 - DNA, 22 bp, Artificial Sequence
  chemically synthesized
tttaccaaggcagatggcaggc

SEQ ID NO: 1036699 - DNA, 22 bp, Artificial Sequence
  chemically synthesized
atttaccaaggcagatggcagg

SEQ ID NO: 1036700 - DNA, 22 bp, Artificial Sequence
  chemically synthesized
tatttaccaaggcagatggcag

SEQ ID NO: 1036701 - DNA, 22 bp, Artificial Sequence
  chemically synthesized
cagcctgccatctgccttggta

SEQ ID NO: 1036702 - DNA, 22 bp, Artificial Sequence
  chemically synthesized
aataaaactttatttaccaagg

SEQ ID NO: 1036703 - DNA, 22 bp, Artificial Sequence
  chemically synthesized
aaataaaactttatttaccaag

SEQ ID NO: 1036704 - DNA, 22 bp, Artificial Sequence
  chemically synthesized
ccatctgccttggtaaataaag

SEQ ID NO: 1036705 - DNA, 22 bp, Artificial Sequence
  chemically synthesized
tgtttaaataaaactttattta

SEQ ID NO: 1036706 - DNA, 22 bp, Artificial Sequence
  chemically synthesized
ccttggtaaataaagttttatt

SEQ ID NO: 1036707 - DNA, 22 bp, Artificial Sequence
  chemically synthesized
ggtaaataaagttttatttaaa

SEQ ID NO: 1036708 - DNA, 22 bp, Artificial Sequence
  chemically synthesized
gtaaataaagttttatttaaac

SEQ ID NO: 1036709 - DNA, 22 bp, Artificial Sequence
  chemically synthesized
tatttaaacacaacatgtccat

SEQ ID NO: 1036710 - DNA, 22 bp, Artificial Sequence
  chemically synthesized
atttaaacacaacatgtccatc

SEQ ID NO: 1036711 - DNA, 22 bp, Artificial Sequence
  chemically synthesized
tttaaacacaacatgtccatcc

SEQ ID NO: 1036712 - DNA, 22 bp, Artificial Sequence
  chemically synthesized
aaacacaacatgtccatccatt

SEQ ID NO: 1036713 - DNA, 22 bp, Artificial Sequence
  chemically synthesized
aacacaacatgtccatccattt

SEQ ID NO: 1036714 - DNA, 22 bp, Artificial Sequence
  chemically synthesized
gggtgaaaaaaaccatgtataa

SEQ ID NO: 1036715 - DNA, 22 bp, Artificial Sequence
  chemically synthesized
agggtgaaaaaaaccatgtata

SEQ ID NO: 1036716 - DNA, 22 bp, Artificial Sequence
  chemically synthesized
tagggtgaaaaaaaccatgtat

SEQ ID NO: 1036717 - DNA, 22 bp, Artificial Sequence
  chemically synthesized
ttttagggtgaaaaaaaccatg

SEQ ID NO: 1036718 - DNA, 22 bp, Artificial Sequence
  chemically synthesized
atatattatacatggttttttt

SEQ ID NO: 1036719 - DNA, 22 bp, Artificial Sequence
  chemically synthesized
tatattatacatggtttttttc

SEQ ID NO: 1036720 - DNA, 22 bp, Artificial Sequence
  chemically synthesized
ctgttttagggtgaaaaaaacc

SEQ ID NO: 1036721 - DNA, 22 bp, Artificial Sequence
  chemically synthesized
tgctgttttagggtgaaaaaaa

SEQ ID NO: 1036722 - DNA, 22 bp, Artificial Sequence
  chemically synthesized
tacatggtttttttcaccctaa

SEQ ID NO: 1036723 - DNA, 22 bp, Artificial Sequence
  chemically synthesized
aactctgctgttttagggtgaa

SEQ ID NO: 1036724 - DNA, 22 bp, Artificial Sequence
  chemically synthesized
ctcaactctgctgttttagggt

SEQ ID NO: 1036725 - DNA, 22 bp, Artificial Sequence
  chemically synthesized
ttttcaccctaaaacagcagag

SEQ ID NO: 1036726 - DNA, 22 bp, Artificial Sequence
  chemically synthesized
tttcaccctaaaacagcagagt

SEQ ID NO: 1036727 - DNA, 22 bp, Artificial Sequence
  chemically synthesized
ttcaccctaaaacagcagagtt

SEQ ID NO: 1036728 - DNA, 22 bp, Artificial Sequence
  chemically synthesized
tcacaactactcaactctgctg

SEQ ID NO: 1036729 - DNA, 22 bp, Artificial Sequence
  chemically synthesized
tcaccctaaaacagcagagttg

SEQ ID NO: 1036730 - DNA, 22 bp, Artificial Sequence
  chemically synthesized
caccctaaaacagcagagttga

SEQ ID NO: 1036731 - DNA, 22 bp, Artificial Sequence
  chemically synthesized
tgtcacaactactcaactctgc

SEQ ID NO: 1036732 - DNA, 22 bp, Artificial Sequence
  chemically synthesized
accctaaaacagcagagttgag

SEQ ID NO: 1036733 - DNA, 22 bp, Artificial Sequence
  chemically synthesized
aaacagcagagttgagtagttg

SEQ ID NO: 1036734 - DNA, 22 bp, Artificial Sequence
  chemically synthesized
caggtcatgtagtctctgtcac

SEQ ID NO: 1036735 - DNA, 22 bp, Artificial Sequence
  chemically synthesized
agtagttgtgacagagactaca

SEQ ID NO: 1036736 - DNA, 22 bp, Artificial Sequence
  chemically synthesized
tccctgcaggtcatgtagtctc

SEQ ID NO: 1036737 - DNA, 22 bp, Artificial Sequence
  chemically synthesized
gtccctgcaggtcatgtagtct

SEQ ID NO: 1036738 - DNA, 22 bp, Artificial Sequence
  chemically synthesized
tgtccctgcaggtcatgtagtc

SEQ ID NO: 1036739 - DNA, 22 bp, Artificial Sequence
  chemically synthesized
ttgtccctgcaggtcatgtagt

SEQ ID NO: 1036740 - DNA, 22 bp, Artificial Sequence
  chemically synthesized
tgacagagactacatgacctgc

SEQ ID NO: 1036741 - DNA, 22 bp, Artificial Sequence
  chemically synthesized
gtcgatatttttgtccctgcag

SEQ ID NO: 1036742 - DNA, 22 bp, Artificial Sequence
  chemically synthesized
catgacctgcagggacaaaaat

SEQ ID NO: 1036743 - DNA, 22 bp, Artificial Sequence
  chemically synthesized
taaaggggcagttagtcgatat

SEQ ID NO: 1036744 - DNA, 22 bp, Artificial Sequence
  chemically synthesized
cagggacaaaaatatcgactaa

SEQ ID NO: 1036745 - DNA, 22 bp, Artificial Sequence
  chemically synthesized
tgtaaaggggcagttagtcgat

SEQ ID NO: 1036746 - DNA, 22 bp, Artificial Sequence
  chemically synthesized
ctgtaaaggggcagttagtcga

SEQ ID NO: 1036747 - DNA, 22 bp, Artificial Sequence
  chemically synthesized
tctgtaaaggggcagttagtcg

SEQ ID NO: 1036748 - DNA, 22 bp, Artificial Sequence
  chemically synthesized
ttctgtaaaggggcagttagtc

SEQ ID NO: 1036749 - DNA, 22 bp, Artificial Sequence
  chemically synthesized
tttctgtaaaggggcagttagt

SEQ ID NO: 1036750 - DNA, 22 bp, Artificial Sequence
  chemically synthesized
ttttctgtaaaggggcagttag

SEQ ID NO: 1036751 - DNA, 22 bp, Artificial Sequence
  chemically synthesized
actgcccctttacagaaaaaaa

SEQ ID NO: 1036752 - DNA, 22 bp, Artificial Sequence
  chemically synthesized
cccctttacagaaaaaaatatc

SEQ ID NO: 1036753 - DNA, 22 bp, Artificial Sequence
  chemically synthesized
atagtcagaggatggatatttt

SEQ ID NO: 1036754 - DNA, 22 bp, Artificial Sequence
  chemically synthesized
tacagaaaaaaatatccatcct

SEQ ID NO: 1036755 - DNA, 22 bp, Artificial Sequence
  chemically synthesized
acagaaaaaaatatccatcctc

SEQ ID NO: 1036756 - DNA, 22 bp, Artificial Sequence
  chemically synthesized
cagaaaaaaatatccatcctct

SEQ ID NO: 1036757 - DNA, 22 bp, Artificial Sequence
  chemically synthesized
gcagaagcatctgatagtcaga

SEQ ID NO: 1036758 - DNA, 22 bp, Artificial Sequence
  chemically synthesized
tggcagaagcatctgatagtca

SEQ ID NO: 1036759 - DNA, 22 bp, Artificial Sequence
  chemically synthesized
gggtctctggcagaagcatctg

SEQ ID NO: 1036760 - DNA, 22 bp, Artificial Sequence
  chemically synthesized
tgactatcagatgcttctgcca

SEQ ID NO: 1036761 - DNA, 22 bp, Artificial Sequence
  chemically synthesized
caactagggtctctggcagaag

SEQ ID NO: 1036762 - DNA, 22 bp, Artificial Sequence
  chemically synthesized
actatcagatgcttctgccaga

SEQ ID NO: 1036763 - DNA, 22 bp, Artificial Sequence
  chemically synthesized
tacaactagggtctctggcaga

SEQ ID NO: 1036764 - DNA, 22 bp, Artificial Sequence
  chemically synthesized
tcagatgcttctgccagagacc

SEQ ID NO: 1036765 - DNA, 22 bp, Artificial Sequence
  chemically synthesized
attctacaactagggtctctgg

SEQ ID NO: 1036766 - DNA, 22 bp, Artificial Sequence
  chemically synthesized
ctgccagagaccctagttgtag

SEQ ID NO: 1036767 - DNA, 22 bp, Artificial Sequence
  chemically synthesized
tgccagagaccctagttgtaga

SEQ ID NO: 1036768 - DNA, 22 bp, Artificial Sequence
  chemically synthesized
tgtgtcgctcattctacaacta

SEQ ID NO: 1036769 - DNA, 22 bp, Artificial Sequence
  chemically synthesized
ccagagaccctagttgtagaat

SEQ ID NO: 1036770 - DNA, 22 bp, Artificial Sequence
  chemically synthesized
ctgtgtgtcgctcattctacaa

SEQ ID NO: 1036771 - DNA, 22 bp, Artificial Sequence
  chemically synthesized
gctgtgtgtcgctcattctaca

SEQ ID NO: 1036772 - DNA, 22 bp, Artificial Sequence
  chemically synthesized
ttgctgtgtgtcgctcattcta

SEQ ID NO: 1036773 - DNA, 22 bp, Artificial Sequence
  chemically synthesized
ttcttgctgtgtgtcgctcatt

SEQ ID NO: 1036774 - DNA, 22 bp, Artificial Sequence
  chemically synthesized
attcttgctgtgtgtcgctcat

SEQ ID NO: 1036775 - DNA, 22 bp, Artificial Sequence
  chemically synthesized
tttattcttgctgtgtgtcgct

SEQ ID NO: 1036776 - DNA, 22 bp, Artificial Sequence
  chemically synthesized
gttgtagaatgagcgacacaca

SEQ ID NO: 1036777 - DNA, 22 bp, Artificial Sequence
  chemically synthesized
tagaatgagcgacacacagcaa

SEQ ID NO: 1036778 - DNA, 22 bp, Artificial Sequence
  chemically synthesized
aattatttattcttgctgtgtg

SEQ ID NO: 1036779 - DNA, 22 bp, Artificial Sequence
  chemically synthesized
caaaaaaaaagtatctaaatta

SEQ ID NO: 1036780 - DNA, 22 bp, Artificial Sequence
  chemically synthesized
tcgtcactgcaaaaaaaaagta

SEQ ID NO: 1036781 - DNA, 22 bp, Artificial Sequence
  chemically synthesized
ctatcgtcactgcaaaaaaaaa

SEQ ID NO: 1036782 - DNA, 22 bp, Artificial Sequence
  chemically synthesized
gctatcgtcactgcaaaaaaaa

SEQ ID NO: 1036783 - DNA, 22 bp, Artificial Sequence
  chemically synthesized
cttgctatcgtcactgcaaaaa

SEQ ID NO: 1036784 - DNA, 22 bp, Artificial Sequence
  chemically synthesized
agatactttttttttgcagtga

SEQ ID NO: 1036785 - DNA, 22 bp, Artificial Sequence
  chemically synthesized
gatactttttttttgcagtgac

SEQ ID NO: 1036786 - DNA, 22 bp, Artificial Sequence
  chemically synthesized
gacattgcttgctatcgtcact

SEQ ID NO: 1036787 - DNA, 22 bp, Artificial Sequence
  chemically synthesized
tttttttgcagtgacgatagca

SEQ ID NO: 1036788 - DNA, 22 bp, Artificial Sequence
  chemically synthesized
ttttttgcagtgacgatagcaa

SEQ ID NO: 1036789 - DNA, 22 bp, Artificial Sequence
  chemically synthesized
tttttgcagtgacgatagcaag

SEQ ID NO: 1036790 - DNA, 22 bp, Artificial Sequence
  chemically synthesized
cactggacattgcttgctatcg

SEQ ID NO: 1036791 - DNA, 22 bp, Artificial Sequence
  chemically synthesized
ttttgcagtgacgatagcaagc

SEQ ID NO: 1036792 - DNA, 22 bp, Artificial Sequence
  chemically synthesized
tttgcagtgacgatagcaagca

SEQ ID NO: 1036793 - DNA, 22 bp, Artificial Sequence
  chemically synthesized
ttgcagtgacgatagcaagcaa

SEQ ID NO: 1036794 - DNA, 22 bp, Artificial Sequence
  chemically synthesized
tgcagtgacgatagcaagcaat

SEQ ID NO: 1036795 - DNA, 22 bp, Artificial Sequence
  chemically synthesized
gcagtgacgatagcaagcaatg

SEQ ID NO: 1036796 - DNA, 22 bp, Artificial Sequence
  chemically synthesized
cagtgacgatagcaagcaatgt

SEQ ID NO: 1036797 - DNA, 22 bp, Artificial Sequence
  chemically synthesized
ccaggagcaccattgcactgga

SEQ ID NO: 1036798 - DNA, 22 bp, Artificial Sequence
  chemically synthesized
accaggagcaccattgcactgg

SEQ ID NO: 1036799 - DNA, 22 bp, Artificial Sequence
  chemically synthesized
taccaggagcaccattgcactg

SEQ ID NO: 1036800 - DNA, 22 bp, Artificial Sequence
  chemically synthesized
ctttaccaggagcaccattgca

SEQ ID NO: 1036801 - DNA, 22 bp, Artificial Sequence
  chemically synthesized
tcatgccagagtccattgcttt

SEQ ID NO: 1036802 - DNA, 22 bp, Artificial Sequence
  chemically synthesized
ctgtcatgccagagtccattgc

SEQ ID NO: 1036803 - DNA, 22 bp, Artificial Sequence
  chemically synthesized
gctgtcatgccagagtccattg

SEQ ID NO: 1036804 - DNA, 22 bp, Artificial Sequence
  chemically synthesized
tgctgtcatgccagagtccatt

SEQ ID NO: 1036805 - DNA, 22 bp, Artificial Sequence
  chemically synthesized
ctggtaaagcaatggactctgg

SEQ ID NO: 1036806 - DNA, 22 bp, Artificial Sequence
  chemically synthesized
ttttgctgtcatgccagagtcc

SEQ ID NO: 1036807 - DNA, 22 bp, Artificial Sequence
  chemically synthesized
gtaaagcaatggactctggcat

SEQ ID NO: 1036808 - DNA, 22 bp, Artificial Sequence
  chemically synthesized
aattattttgctgtcatgccag

SEQ ID NO: 1036809 - DNA, 22 bp, Artificial Sequence
  chemically synthesized
tggcatgacagcaaaataattc

SEQ ID NO: 1036810 - DNA, 22 bp, Artificial Sequence
  chemically synthesized
tgaggtaaatctgaattatttt

SEQ ID NO: 1036811 - DNA, 22 bp, Artificial Sequence
  chemically synthesized
gcatgacagcaaaataattcag

SEQ ID NO: 1036812 - DNA, 22 bp, Artificial Sequence
  chemically synthesized
tcaagctatgaggtaaatctga

SEQ ID NO: 1036813 - DNA, 22 bp, Artificial Sequence
  chemically synthesized
ctatcaagctatgaggtaaatc

SEQ ID NO: 1036814 - DNA, 22 bp, Artificial Sequence
  chemically synthesized
agatttacctcatagcttgata

SEQ ID NO: 1036815 - DNA, 22 bp, Artificial Sequence
  chemically synthesized
acctcatagcttgatagtagat

SEQ ID NO: 1036816 - DNA, 22 bp, Artificial Sequence
  chemically synthesized
cctcatagcttgatagtagata

SEQ ID NO: 1036817 - DNA, 22 bp, Artificial Sequence
  chemically synthesized
ggcatccagaatatatctacta

SEQ ID NO: 1036818 - DNA, 22 bp, Artificial Sequence
  chemically synthesized
atagcttgatagtagatatatt

SEQ ID NO: 1036819 - DNA, 22 bp, Artificial Sequence
  chemically synthesized
gatagtagatatattctggatg

SEQ ID NO: 1036820 - DNA, 22 bp, Artificial Sequence
  chemically synthesized
atagtagatatattctggatgc

SEQ ID NO: 1036821 - DNA, 22 bp, Artificial Sequence
  chemically synthesized
taaaggaagagcaggctaggca

SEQ ID NO: 1036822 - DNA, 22 bp, Artificial Sequence
  chemically synthesized
tggatgcctagcctgctcttcc

SEQ ID NO: 1036823 - DNA, 22 bp, Artificial Sequence
  chemically synthesized
gatgcctagcctgctcttcctt

SEQ ID NO: 1036824 - DNA, 22 bp, Artificial Sequence
  chemically synthesized
acaatgggcagaaactataaag

SEQ ID NO: 1036825 - DNA, 22 bp, Artificial Sequence
  chemically synthesized
gcctgctcttcctttatagttt

SEQ ID NO: 1036826 - DNA, 22 bp, Artificial Sequence
  chemically synthesized
aacaatgggcagaaactataaa

SEQ ID NO: 1036827 - DNA, 22 bp, Artificial Sequence
  chemically synthesized
ctcttcctttatagtttctgcc

SEQ ID NO: 1036828 - DNA, 22 bp, Artificial Sequence
  chemically synthesized
ggtttaacaatgggcagaaact

SEQ ID NO: 1036829 - DNA, 22 bp, Artificial Sequence
  chemically synthesized
ttcctttatagtttctgcccat

SEQ ID NO: 1036830 - DNA, 22 bp, Artificial Sequence
  chemically synthesized
cctttatagtttctgcccattg

SEQ ID NO: 1036831 - DNA, 22 bp, Artificial Sequence
  chemically synthesized
ctttatagtttctgcccattgt

SEQ ID NO: 1036832 - DNA, 22 bp, Artificial Sequence
  chemically synthesized
agagctaggtttaacaatgggc

SEQ ID NO: 1036833 - DNA, 22 bp, Artificial Sequence
  chemically synthesized
tatagtttctgcccattgttaa

SEQ ID NO: 1036834 - DNA, 22 bp, Artificial Sequence
  chemically synthesized
atagtttctgcccattgttaaa

SEQ ID NO: 1036835 - DNA, 22 bp, Artificial Sequence
  chemically synthesized
tagtttctgcccattgttaaac

SEQ ID NO: 1036836 - DNA, 22 bp, Artificial Sequence
  chemically synthesized
ctgcccattgttaaacctagct

SEQ ID NO: 1036837 - DNA, 22 bp, Artificial Sequence
  chemically synthesized
tgcccattgttaaacctagctc

SEQ ID NO: 1036838 - DNA, 22 bp, Artificial Sequence
  chemically synthesized
cccattgttaaacctagctctc

SEQ ID NO: 1036839 - DNA, 22 bp, Artificial Sequence
  chemically synthesized
ttaaacctagctctcaggcttt

SEQ ID NO: 1036840 - DNA, 22 bp, Artificial Sequence
  chemically synthesized
atggaatcaataggaaagcctg

SEQ ID NO: 1036841 - DNA, 22 bp, Artificial Sequence
  chemically synthesized
aacctagctctcaggctttcct

SEQ ID NO: 1036842 - DNA, 22 bp, Artificial Sequence
  chemically synthesized
gctctcaggctttcctattgat

SEQ ID NO: 1036843 - DNA, 22 bp, Artificial Sequence
  chemically synthesized
tcaggctttcctattgattcca

SEQ ID NO: 1036844 - DNA, 22 bp, Artificial Sequence
  chemically synthesized
aggctttcctattgattccatg

SEQ ID NO: 1036845 - DNA, 22 bp, Artificial Sequence
  chemically synthesized
tcctattgattccatgaggtat

SEQ ID NO: 1036846 - DNA, 22 bp, Artificial Sequence
  chemically synthesized
gaaggatatcagatacctcatg

SEQ ID NO: 1036847 - DNA, 22 bp, Artificial Sequence
  chemically synthesized
cctattgattccatgaggtatc

SEQ ID NO: 1036848 - DNA, 22 bp, Artificial Sequence
  chemically synthesized
ctattgattccatgaggtatct

SEQ ID NO: 1036849 - DNA, 22 bp, Artificial Sequence
  chemically synthesized
ctagaaggatatcagatacctc

SEQ ID NO: 1036850 - DNA, 22 bp, Artificial Sequence
  chemically synthesized
ttgattccatgaggtatctgat

SEQ ID NO: 1036851 - DNA, 22 bp, Artificial Sequence
  chemically synthesized
attccatgaggtatctgatatc

SEQ ID NO: 1036852 - DNA, 22 bp, Artificial Sequence
  chemically synthesized
catgaggtatctgatatccttc

SEQ ID NO: 1036853 - DNA, 22 bp, Artificial Sequence
  chemically synthesized
tataaattactagaaggatatc

SEQ ID NO: 1036854 - DNA, 22 bp, Artificial Sequence
  chemically synthesized
ggtagaattatataaattacta

SEQ ID NO: 1036855 - DNA, 22 bp, Artificial Sequence
  chemically synthesized
aggtagaattatataaattact

SEQ ID NO: 1036856 - DNA, 22 bp, Artificial Sequence
  chemically synthesized
taggtagaattatataaattac

SEQ ID NO: 1036857 - DNA, 22 bp, Artificial Sequence
  chemically synthesized
atatccttctagtaatttatat

SEQ ID NO: 1036858 - DNA, 22 bp, Artificial Sequence
  chemically synthesized
ctttaggtagaattatataaat

SEQ ID NO: 1036859 - DNA, 22 bp, Artificial Sequence
  chemically synthesized
gttactttaggtagaattatat

SEQ ID NO: 1036860 - DNA, 22 bp, Artificial Sequence
  chemically synthesized
ctagtaatttatataattctac

SEQ ID NO: 1036861 - DNA, 22 bp, Artificial Sequence
  chemically synthesized
tagttactttaggtagaattat

SEQ ID NO: 1036862 - DNA, 22 bp, Artificial Sequence
  chemically synthesized
tagtaatttatataattctacc

SEQ ID NO: 1036863 - DNA, 22 bp, Artificial Sequence
  chemically synthesized
gtaatttatataattctaccta

SEQ ID NO: 1036864 - DNA, 22 bp, Artificial Sequence
  chemically synthesized
atataattctacctaaagtaac

SEQ ID NO: 1036865 - DNA, 22 bp, Artificial Sequence
  chemically synthesized
tataattctacctaaagtaact

SEQ ID NO: 1036866 - DNA, 22 bp, Artificial Sequence
  chemically synthesized
acagaaagtgactctagttact

SEQ ID NO: 1036867 - DNA, 22 bp, Artificial Sequence
  chemically synthesized
tacctaaagtaactagagtcac

SEQ ID NO: 1036868 - DNA, 22 bp, Artificial Sequence
  chemically synthesized
caactaacagaaagtgactcta

SEQ ID NO: 1036869 - DNA, 22 bp, Artificial Sequence
  chemically synthesized
cctaaagtaactagagtcactt

SEQ ID NO: 1036870 - DNA, 22 bp, Artificial Sequence
  chemically synthesized
aagtaactagagtcactttctg

SEQ ID NO: 1036871 - DNA, 22 bp, Artificial Sequence
  chemically synthesized
agttacaactaacagaaagtga

SEQ ID NO: 1036872 - DNA, 22 bp, Artificial Sequence
  chemically synthesized
tgagttacaactaacagaaagt

SEQ ID NO: 1036873 - DNA, 22 bp, Artificial Sequence
  chemically synthesized
gagtcactttctgttagttgta

SEQ ID NO: 1036874 - DNA, 22 bp, Artificial Sequence
  chemically synthesized
aaggttctgagttacaactaac

SEQ ID NO: 1036875 - DNA, 22 bp, Artificial Sequence
  chemically synthesized
tctgttagttgtaactcagaac

SEQ ID NO: 1036876 - DNA, 22 bp, Artificial Sequence
  chemically synthesized
ctgttagttgtaactcagaacc

SEQ ID NO: 1036877 - DNA, 22 bp, Artificial Sequence
  chemically synthesized
tagaccattcaaggttctgagt

SEQ ID NO: 1036878 - DNA, 22 bp, Artificial Sequence
  chemically synthesized
tgttagttgtaactcagaacct

SEQ ID NO: 1036879 - DNA, 22 bp, Artificial Sequence
  chemically synthesized
ttagttgtaactcagaaccttg

SEQ ID NO: 1036880 - DNA, 22 bp, Artificial Sequence
  chemically synthesized
gttgtaactcagaaccttgaat

SEQ ID NO: 1036881 - DNA, 22 bp, Artificial Sequence
  chemically synthesized
taactcagaaccttgaatggtc

SEQ ID NO: 1036882 - DNA, 22 bp, Artificial Sequence
  chemically synthesized
agaaccttgaatggtctataga

SEQ ID NO: 1036883 - DNA, 22 bp, Artificial Sequence
  chemically synthesized
gaatggtctatagaccttgact

SEQ ID NO: 1036884 - DNA, 22 bp, Artificial Sequence
  chemically synthesized
aatggtctatagaccttgactt

SEQ ID NO: 1036885 - DNA, 22 bp, Artificial Sequence
  chemically synthesized
agaatggggaataagtcaaggt

SEQ ID NO: 1036886 - DNA, 22 bp, Artificial Sequence
  chemically synthesized
ctaagaatggggaataagtcaa

SEQ ID NO: 1036887 - DNA, 22 bp, Artificial Sequence
  chemically synthesized
actaagaatggggaataagtca

SEQ ID NO: 1036888 - DNA, 22 bp, Artificial Sequence
  chemically synthesized
tcttactaagaatggggaataa

SEQ ID NO: 1036889 - DNA, 22 bp, Artificial Sequence
  chemically synthesized
tagaccttgacttattccccat

SEQ ID NO: 1036890 - DNA, 22 bp, Artificial Sequence
  chemically synthesized
gacttattccccattcttagta

SEQ ID NO: 1036891 - DNA, 22 bp, Artificial Sequence
  chemically synthesized
acttattccccattcttagtaa

SEQ ID NO: 1036892 - DNA, 22 bp, Artificial Sequence
  chemically synthesized
attccccattcttagtaagata

SEQ ID NO: 1036893 - DNA, 22 bp, Artificial Sequence
  chemically synthesized
ttccccattcttagtaagatag

SEQ ID NO: 1036894 - DNA, 22 bp, Artificial Sequence
  chemically synthesized
cccattcttagtaagatagctt

SEQ ID NO: 1036895 - DNA, 22 bp, Artificial Sequence
  chemically synthesized
gggaatggaatgaagctatctt

SEQ ID NO: 1036896 - DNA, 22 bp, Artificial Sequence
  chemically synthesized
ttagtaagatagcttcattcca

SEQ ID NO: 1036897 - DNA, 22 bp, Artificial Sequence
  chemically synthesized
agtaagatagcttcattccatt

SEQ ID NO: 1036898 - DNA, 22 bp, Artificial Sequence
  chemically synthesized
gtaagatagcttcattccattc

SEQ ID NO: 1036899 - DNA, 22 bp, Artificial Sequence
  chemically synthesized
cattccattccccagggatctt

SEQ ID NO: 1036900 - DNA, 22 bp, Artificial Sequence
  chemically synthesized
attccattccccagggatcttg

SEQ ID NO: 1036901 - DNA, 22 bp, Artificial Sequence
  chemically synthesized
cattccccagggatcttgttct

SEQ ID NO: 1036902 - DNA, 22 bp, Artificial Sequence
  chemically synthesized
tacaagagggcaagaacaagat

SEQ ID NO: 1036903 - DNA, 22 bp, Artificial Sequence
  chemically synthesized
cccagggatcttgttcttgccc

SEQ ID NO: 1036904 - DNA, 22 bp, Artificial Sequence
  chemically synthesized
gagctgtacaagagggcaagaa

SEQ ID NO: 1036905 - DNA, 22 bp, Artificial Sequence
  chemically synthesized
atagactggagctgtacaagag

SEQ ID NO: 1036906 - DNA, 22 bp, Artificial Sequence
  chemically synthesized
gttcttgccctcttgtacagct

SEQ ID NO: 1036907 - DNA, 22 bp, Artificial Sequence
  chemically synthesized
ttcttgccctcttgtacagctc

SEQ ID NO: 1036908 - DNA, 22 bp, Artificial Sequence
  chemically synthesized
ttgccctcttgtacagctccag

SEQ ID NO: 1036909 - DNA, 22 bp, Artificial Sequence
  chemically synthesized
gccctcttgtacagctccagtc

SEQ ID NO: 1036910 - DNA, 22 bp, Artificial Sequence
  chemically synthesized
ccctcttgtacagctccagtct

SEQ ID NO: 1036911 - DNA, 22 bp, Artificial Sequence
  chemically synthesized
ttgtacagctccagtctatcaa

SEQ ID NO: 1036912 - DNA, 22 bp, Artificial Sequence
  chemically synthesized
gtacagctccagtctatcaacc

SEQ ID NO: 1036913 - DNA, 22 bp, Artificial Sequence
  chemically synthesized
tacagctccagtctatcaaccc

SEQ ID NO: 1036914 - DNA, 22 bp, Artificial Sequence
  chemically synthesized
cagtctatcaacccttatttta

SEQ ID NO: 1036915 - DNA, 22 bp, Artificial Sequence
  chemically synthesized
tcaacccttattttactggctg

SEQ ID NO: 1036916 - DNA, 22 bp, Artificial Sequence
  chemically synthesized
gagagaaaaggcacaaccagcc

SEQ ID NO: 1036917 - DNA, 22 bp, Artificial Sequence
  chemically synthesized
ggagagaaaaggcacaaccagc

SEQ ID NO: 1036918 - DNA, 22 bp, Artificial Sequence
  chemically synthesized
attttactggctggttgtgcct

SEQ ID NO: 1036919 - DNA, 22 bp, Artificial Sequence
  chemically synthesized
ttttactggctggttgtgcctt

SEQ ID NO: 1036920 - DNA, 22 bp, Artificial Sequence
  chemically synthesized
tactggctggttgtgccttttc

SEQ ID NO: 1036921 - DNA, 22 bp, Artificial Sequence
  chemically synthesized
actggctggttgtgccttttct

SEQ ID NO: 1036922 - DNA, 22 bp, Artificial Sequence
  chemically synthesized
acagtcttggagagaaaaggca

SEQ ID NO: 1036923 - DNA, 22 bp, Artificial Sequence
  chemically synthesized
ctggctggttgtgccttttctc

SEQ ID NO: 1036924 - DNA, 22 bp, Artificial Sequence
  chemically synthesized
cacagtcttggagagaaaaggc

SEQ ID NO: 1036925 - DNA, 22 bp, Artificial Sequence
  chemically synthesized
gctggttgtgccttttctctcc

SEQ ID NO: 1036926 - DNA, 22 bp, Artificial Sequence
  chemically synthesized
gttgtgccttttctctccaaga

SEQ ID NO: 1036927 - DNA, 22 bp, Artificial Sequence
  chemically synthesized
aagagcttcacagtcttggaga

SEQ ID NO: 1036928 - DNA, 22 bp, Artificial Sequence
  chemically synthesized
gaagagcttcacagtcttggag

SEQ ID NO: 1036929 - DNA, 22 bp, Artificial Sequence
  chemically synthesized
tgaagagcttcacagtcttgga

SEQ ID NO: 1036930 - DNA, 22 bp, Artificial Sequence
  chemically synthesized
tgccttttctctccaagactgt

SEQ ID NO: 1036931 - DNA, 22 bp, Artificial Sequence
  chemically synthesized
ctttgaagagcttcacagtctt

SEQ ID NO: 1036932 - DNA, 22 bp, Artificial Sequence
  chemically synthesized
ttctctccaagactgtgaagct

SEQ ID NO: 1036933 - DNA, 22 bp, Artificial Sequence
  chemically synthesized
tctctccaagactgtgaagctc

SEQ ID NO: 1036934 - DNA, 22 bp, Artificial Sequence
  chemically synthesized
ctctccaagactgtgaagctct

SEQ ID NO: 1036935 - DNA, 22 bp, Artificial Sequence
  chemically synthesized
tctccaagactgtgaagctctt

SEQ ID NO: 1036936 - DNA, 22 bp, Artificial Sequence
  chemically synthesized
agtccctgctttgaagagcttc

SEQ ID NO: 1036937 - DNA, 22 bp, Artificial Sequence
  chemically synthesized
tccaagactgtgaagctcttca

SEQ ID NO: 1036938 - DNA, 22 bp, Artificial Sequence
  chemically synthesized
caagactgtgaagctcttcaaa

SEQ ID NO: 1036939 - DNA, 22 bp, Artificial Sequence
  chemically synthesized
gactcagtccctgctttgaaga

SEQ ID NO: 1036940 - DNA, 22 bp, Artificial Sequence
  chemically synthesized
tgaagctcttcaaagcagggac

SEQ ID NO: 1036941 - DNA, 22 bp, Artificial Sequence
  chemically synthesized
ttcaaagcagggactgagtcta

SEQ ID NO: 1036942 - DNA, 22 bp, Artificial Sequence
  chemically synthesized
cagagagaagaattagactcag

SEQ ID NO: 1036943 - DNA, 22 bp, Artificial Sequence
  chemically synthesized
caaagcagggactgagtctaat

SEQ ID NO: 1036944 - DNA, 22 bp, Artificial Sequence
  chemically synthesized
aaagcagggactgagtctaatt

SEQ ID NO: 1036945 - DNA, 22 bp, Artificial Sequence
  chemically synthesized
agaactacagagagaagaatta

SEQ ID NO: 1036946 - DNA, 22 bp, Artificial Sequence
  chemically synthesized
cctgagaactacagagagaaga

SEQ ID NO: 1036947 - DNA, 22 bp, Artificial Sequence
  chemically synthesized
ccctgagaactacagagagaag

SEQ ID NO: 1036948 - DNA, 22 bp, Artificial Sequence
  chemically synthesized
agtctaattcttctctctgtag

SEQ ID NO: 1036949 - DNA, 22 bp, Artificial Sequence
  chemically synthesized
aaatttccctgagaactacaga

SEQ ID NO: 1036950 - DNA, 22 bp, Artificial Sequence
  chemically synthesized
caaatttccctgagaactacag

SEQ ID NO: 1036951 - DNA, 22 bp, Artificial Sequence
  chemically synthesized
tcaaatttccctgagaactaca

SEQ ID NO: 1036952 - DNA, 22 bp, Artificial Sequence
  chemically synthesized
attcttctctctgtagttctca

SEQ ID NO: 1036953 - DNA, 22 bp, Artificial Sequence
  chemically synthesized
ttctctctgtagttctcaggga

SEQ ID NO: 1036954 - DNA, 22 bp, Artificial Sequence
  chemically synthesized
ctctctgtagttctcagggaaa

SEQ ID NO: 1036955 - DNA, 22 bp, Artificial Sequence
  chemically synthesized
catgctttcaaatttccctgag

SEQ ID NO: 1036956 - DNA, 22 bp, Artificial Sequence
  chemically synthesized
tctctgtagttctcagggaaat

SEQ ID NO: 1036957 - DNA, 22 bp, Artificial Sequence
  chemically synthesized
acatgctttcaaatttccctga

SEQ ID NO: 1036958 - DNA, 22 bp, Artificial Sequence
  chemically synthesized
tctgtagttctcagggaaattt

SEQ ID NO: 1036959 - DNA, 22 bp, Artificial Sequence
  chemically synthesized
ttacatgctttcaaatttccct

SEQ ID NO: 1036960 - DNA, 22 bp, Artificial Sequence
  chemically synthesized
tgtagttctcagggaaatttga

SEQ ID NO: 1036961 - DNA, 22 bp, Artificial Sequence
  chemically synthesized
tagttctcagggaaatttgaaa

SEQ ID NO: 1036962 - DNA, 22 bp, Artificial Sequence
  chemically synthesized
attcttacatgctttcaaattt

SEQ ID NO: 1036963 - DNA, 22 bp, Artificial Sequence
  chemically synthesized
attcattcttacatgctttcaa

SEQ ID NO: 1036964 - DNA, 22 bp, Artificial Sequence
  chemically synthesized
tcagggaaatttgaaagcatgt

SEQ ID NO: 1036965 - DNA, 22 bp, Artificial Sequence
  chemically synthesized
ttaattcattcttacatgcttt

SEQ ID NO: 1036966 - DNA, 22 bp, Artificial Sequence
  chemically synthesized
agggaaatttgaaagcatgtaa

SEQ ID NO: 1036967 - DNA, 22 bp, Artificial Sequence
  chemically synthesized
gaaagcatgtaagaatgaatta

SEQ ID NO: 1036968 - DNA, 22 bp, Artificial Sequence
  chemically synthesized
aaagcatgtaagaatgaattaa

SEQ ID NO: 1036969 - DNA, 22 bp, Artificial Sequence
  chemically synthesized
atagtcatgatatctgttaatt

SEQ ID NO: 1036970 - DNA, 22 bp, Artificial Sequence
  chemically synthesized
tgatagtcatgatatctgttaa

SEQ ID NO: 1036971 - DNA, 22 bp, Artificial Sequence
  chemically synthesized
tggttctgatagtcatgatatc

SEQ ID NO: 1036972 - DNA, 22 bp, Artificial Sequence
  chemically synthesized
atggttctgatagtcatgatat

SEQ ID NO: 1036973 - DNA, 22 bp, Artificial Sequence
  chemically synthesized
acagatatcatgactatcagaa

SEQ ID NO: 1036974 - DNA, 22 bp, Artificial Sequence
  chemically synthesized
atgatgaaaatggtgatcttat

SEQ ID NO: 1036975 - DNA, 22 bp, Artificial Sequence
  chemically synthesized
gatgatgaaaatggtgatctta

SEQ ID NO: 1036976 - DNA, 22 bp, Artificial Sequence
  chemically synthesized
tgatgatgaaaatggtgatctt

SEQ ID NO: 1036977 - DNA, 22 bp, Artificial Sequence
  chemically synthesized
tcagaaccataagatcaccatt

SEQ ID NO: 1036978 - DNA, 22 bp, Artificial Sequence
  chemically synthesized
gcaattttgatgatgaaaatgg

SEQ ID NO: 1036979 - DNA, 22 bp, Artificial Sequence
  chemically synthesized
aggttggcaattttgatgatga

SEQ ID NO: 1036980 - DNA, 22 bp, Artificial Sequence
  chemically synthesized
agttaaggttggcaattttgat

SEQ ID NO: 1036981 - DNA, 22 bp, Artificial Sequence
  chemically synthesized
tcatcatcaaaattgccaacct

SEQ ID NO: 1036982 - DNA, 22 bp, Artificial Sequence
  chemically synthesized
catcatcaaaattgccaacctt

SEQ ID NO: 1036983 - DNA, 22 bp, Artificial Sequence
  chemically synthesized
atcatcaaaattgccaacctta

SEQ ID NO: 1036984 - DNA, 22 bp, Artificial Sequence
  chemically synthesized
aacacgataatggctcagttaa

SEQ ID NO: 1036985 - DNA, 22 bp, Artificial Sequence
  chemically synthesized
aaacacgataatggctcagtta

SEQ ID NO: 1036986 - DNA, 22 bp, Artificial Sequence
  chemically synthesized
cttaaacacgataatggctcag

SEQ ID NO: 1036987 - DNA, 22 bp, Artificial Sequence
  chemically synthesized
ccaaccttaactgagccattat

SEQ ID NO: 1036988 - DNA, 22 bp, Artificial Sequence
  chemically synthesized
gtgggttgcttaaacacgataa

SEQ ID NO: 1036989 - DNA, 22 bp, Artificial Sequence
  chemically synthesized
agtgggttgcttaaacacgata

SEQ ID NO: 1036990 - DNA, 22 bp, Artificial Sequence
  chemically synthesized
aactgagccattatcgtgttta

SEQ ID NO: 1036991 - DNA, 22 bp, Artificial Sequence
  chemically synthesized
actgagccattatcgtgtttaa

SEQ ID NO: 1036992 - DNA, 22 bp, Artificial Sequence
  chemically synthesized
agccattatcgtgtttaagcaa

SEQ ID NO: 1036993 - DNA, 22 bp, Artificial Sequence
  chemically synthesized
tcgtgtttaagcaacccactaa

SEQ ID NO: 1036994 - DNA, 22 bp, Artificial Sequence
  chemically synthesized
aagcaacccactaagctcccca

SEQ ID NO: 1036995 - DNA, 22 bp, Artificial Sequence
  chemically synthesized
acacaatatatgtggggagctt

SEQ ID NO: 1036996 - DNA, 22 bp, Artificial Sequence
  chemically synthesized
agcaacccactaagctccccac

SEQ ID NO: 1036997 - DNA, 22 bp, Artificial Sequence
  chemically synthesized
tctgacacaatatatgtgggga

SEQ ID NO: 1036998 - DNA, 22 bp, Artificial Sequence
  chemically synthesized
agctccccacatatattgtgtc

SEQ ID NO: 1036999 - DNA, 22 bp, Artificial Sequence
  chemically synthesized
tgaggattatctgacacaatat

SEQ ID NO: 1037000 - DNA, 22 bp, Artificial Sequence
  chemically synthesized
ttatgaggattatctgacacaa

SEQ ID NO: 1037001 - DNA, 22 bp, Artificial Sequence
  chemically synthesized
cccacatatattgtgtcagata

SEQ ID NO: 1037002 - DNA, 22 bp, Artificial Sequence
  chemically synthesized
tgtcacagggttgttatgagga

SEQ ID NO: 1037003 - DNA, 22 bp, Artificial Sequence
  chemically synthesized
tgtcagataatcctcataacaa

SEQ ID NO: 1037004 - DNA, 22 bp, Artificial Sequence
  chemically synthesized
ataacaaccctgtgacatagac

SEQ ID NO: 1037005 - DNA, 22 bp, Artificial Sequence
  chemically synthesized
tgacatagacactattcttatc

SEQ ID NO: 1037006 - DNA, 22 bp, Artificial Sequence
  chemically synthesized
atgtataaaataggataagaat

SEQ ID NO: 1037007 - DNA, 22 bp, Artificial Sequence
  chemically synthesized
tgatgtataaaataggataaga

SEQ ID NO: 1037008 - DNA, 22 bp, Artificial Sequence
  chemically synthesized
ctgatgtataaaataggataag

SEQ ID NO: 1037009 - DNA, 22 bp, Artificial Sequence
  chemically synthesized
catacatttctgatgtataaaa

SEQ ID NO: 1037010 - DNA, 22 bp, Artificial Sequence
  chemically synthesized
ttcttatcctattttatacatc

SEQ ID NO: 1037011 - DNA, 22 bp, Artificial Sequence
  chemically synthesized
ctccatacatttctgatgtata

SEQ ID NO: 1037012 - DNA, 22 bp, Artificial Sequence
  chemically synthesized
ttatcctattttatacatcaga

SEQ ID NO: 1037013 - DNA, 22 bp, Artificial Sequence
  chemically synthesized
tgctccatacatttctgatgta

SEQ ID NO: 1037014 - DNA, 22 bp, Artificial Sequence
  chemically synthesized
atcctattttatacatcagaaa

SEQ ID NO: 1037015 - DNA, 22 bp, Artificial Sequence
  chemically synthesized
ctgctccatacatttctgatgt

SEQ ID NO: 1037016 - DNA, 22 bp, Artificial Sequence
  chemically synthesized
tcctattttatacatcagaaat

SEQ ID NO: 1037017 - DNA, 22 bp, Artificial Sequence
  chemically synthesized
ttttatacatcagaaatgtatg

SEQ ID NO: 1037018 - DNA, 22 bp, Artificial Sequence
  chemically synthesized
aatcttctgctccatacatttc

SEQ ID NO: 1037019 - DNA, 22 bp, Artificial Sequence
  chemically synthesized
aaatcttctgctccatacattt

SEQ ID NO: 1037020 - DNA, 22 bp, Artificial Sequence
  chemically synthesized
tatacatcagaaatgtatggag

SEQ ID NO: 1037021 - DNA, 22 bp, Artificial Sequence
  chemically synthesized
ttaaatcttctgctccatacat

SEQ ID NO: 1037022 - DNA, 22 bp, Artificial Sequence
  chemically synthesized
atacatcagaaatgtatggagc

SEQ ID NO: 1037023 - DNA, 22 bp, Artificial Sequence
  chemically synthesized
tacatcagaaatgtatggagca

SEQ ID NO: 1037024 - DNA, 22 bp, Artificial Sequence
  chemically synthesized
agcaagtctcttaaatcttctg

SEQ ID NO: 1037025 - DNA, 22 bp, Artificial Sequence
  chemically synthesized
gagcaagtctcttaaatcttct

SEQ ID NO: 1037026 - DNA, 22 bp, Artificial Sequence
  chemically synthesized
tgtgcccttgagcaagtctctt

SEQ ID NO: 1037027 - DNA, 22 bp, Artificial Sequence
  chemically synthesized
tctatgtgcccttgagcaagtc

SEQ ID NO: 1037028 - DNA, 22 bp, Artificial Sequence
  chemically synthesized
ctatctatgtgcccttgagcaa

SEQ ID NO: 1037029 - DNA, 22 bp, Artificial Sequence
  chemically synthesized
tgctatctatgtgcccttgagc

SEQ ID NO: 1037030 - DNA, 22 bp, Artificial Sequence
  chemically synthesized
ctgctatctatgtgcccttgag

SEQ ID NO: 1037031 - DNA, 22 bp, Artificial Sequence
  chemically synthesized
tctgctatctatgtgcccttga

SEQ ID NO: 1037032 - DNA, 22 bp, Artificial Sequence
  chemically synthesized
aagagacttgctcaagggcaca

SEQ ID NO: 1037033 - DNA, 22 bp, Artificial Sequence
  chemically synthesized
agagacttgctcaagggcacat

SEQ ID NO: 1037034 - DNA, 22 bp, Artificial Sequence
  chemically synthesized
gcctttctgctatctatgtgcc

SEQ ID NO: 1037035 - DNA, 22 bp, Artificial Sequence
  chemically synthesized
tggcctttctgctatctatgtg

SEQ ID NO: 1037036 - DNA, 22 bp, Artificial Sequence
  chemically synthesized
gctcaagggcacatagatagca

SEQ ID NO: 1037037 - DNA, 22 bp, Artificial Sequence
  chemically synthesized
ctcaagggcacatagatagcag

SEQ ID NO: 1037038 - DNA, 22 bp, Artificial Sequence
  chemically synthesized
gaattctggcctttctgctatc

SEQ ID NO: 1037039 - DNA, 22 bp, Artificial Sequence
  chemically synthesized
aagggcacatagatagcagaaa

SEQ ID NO: 1037040 - DNA, 22 bp, Artificial Sequence
  chemically synthesized
ggaattctggcctttctgctat

SEQ ID NO: 1037041 - DNA, 22 bp, Artificial Sequence
  chemically synthesized
tggaattctggcctttctgcta

SEQ ID NO: 1037042 - DNA, 22 bp, Artificial Sequence
  chemically synthesized
caacccgttttggaattctggc

SEQ ID NO: 1037043 - DNA, 22 bp, Artificial Sequence
  chemically synthesized
gagttccaacccgttttggaat

SEQ ID NO: 1037044 - DNA, 22 bp, Artificial Sequence
  chemically synthesized
tagagttccaacccgttttgga

SEQ ID NO: 1037045 - DNA, 22 bp, Artificial Sequence
  chemically synthesized
taagcacaggctctagagttcc

SEQ ID NO: 1037046 - DNA, 22 bp, Artificial Sequence
  chemically synthesized
caaaacgggttggaactctaga

SEQ ID NO: 1037047 - DNA, 22 bp, Artificial Sequence
  chemically synthesized
ataagcacaggctctagagttc

SEQ ID NO: 1037048 - DNA, 22 bp, Artificial Sequence
  chemically synthesized
cttataagcacaggctctagag

SEQ ID NO: 1037049 - DNA, 22 bp, Artificial Sequence
  chemically synthesized
agtaattgcttataagcacagg

SEQ ID NO: 1037050 - DNA, 22 bp, Artificial Sequence
  chemically synthesized
gaactctagagcctgtgcttat

SEQ ID NO: 1037051 - DNA, 22 bp, Artificial Sequence
  chemically synthesized
aagtaattgcttataagcacag

SEQ ID NO: 1037052 - DNA, 22 bp, Artificial Sequence
  chemically synthesized
taagtaattgcttataagcaca

SEQ ID NO: 1037053 - DNA, 22 bp, Artificial Sequence
  chemically synthesized
ttttaagtaattgcttataagc

SEQ ID NO: 1037054 - DNA, 22 bp, Artificial Sequence
  chemically synthesized
tagagcctgtgcttataagcaa

SEQ ID NO: 1037055 - DNA, 22 bp, Artificial Sequence
  chemically synthesized
gagcctgtgcttataagcaatt

SEQ ID NO: 1037056 - DNA, 22 bp, Artificial Sequence
  chemically synthesized
tgcttataagcaattacttaaa

SEQ ID NO: 1037057 - DNA, 22 bp, Artificial Sequence
  chemically synthesized
agatacaaactgttttaagtaa

SEQ ID NO: 1037058 - DNA, 22 bp, Artificial Sequence
  chemically synthesized
ataagcaattacttaaaacagt

SEQ ID NO: 1037059 - DNA, 22 bp, Artificial Sequence
  chemically synthesized
taagcaattacttaaaacagtt

SEQ ID NO: 1037060 - DNA, 22 bp, Artificial Sequence
  chemically synthesized
gtacaatctcagatacaaactg

SEQ ID NO: 1037061 - DNA, 22 bp, Artificial Sequence
  chemically synthesized
agtacaatctcagatacaaact

SEQ ID NO: 1037062 - DNA, 22 bp, Artificial Sequence
  chemically synthesized
tagtacaatctcagatacaaac

SEQ ID NO: 1037063 - DNA, 22 bp, Artificial Sequence
  chemically synthesized
ttagtacaatctcagatacaaa

SEQ ID NO: 1037064 - DNA, 22 bp, Artificial Sequence
  chemically synthesized
cttaaaacagtttgtatctgag

SEQ ID NO: 1037065 - DNA, 22 bp, Artificial Sequence
  chemically synthesized
aaaacagtttgtatctgagatt

SEQ ID NO: 1037066 - DNA, 22 bp, Artificial Sequence
  chemically synthesized
aaacagtttgtatctgagattg

SEQ ID NO: 1037067 - DNA, 22 bp, Artificial Sequence
  chemically synthesized
tgacttttagtacaatctcaga

SEQ ID NO: 1037068 - DNA, 22 bp, Artificial Sequence
  chemically synthesized
ctatgacttttagtacaatctc

SEQ ID NO: 1037069 - DNA, 22 bp, Artificial Sequence
  chemically synthesized
cctatgacttttagtacaatct

SEQ ID NO: 1037070 - DNA, 22 bp, Artificial Sequence
  chemically synthesized
gtatctgagattgtactaaaag

SEQ ID NO: 1037071 - DNA, 22 bp, Artificial Sequence
  chemically synthesized
aatttcctatgacttttagtac

SEQ ID NO: 1037072 - DNA, 22 bp, Artificial Sequence
  chemically synthesized
tatctgagattgtactaaaagt

SEQ ID NO: 1037073 - DNA, 22 bp, Artificial Sequence
  chemically synthesized
ttaaatttcctatgacttttag

SEQ ID NO: 1037074 - DNA, 22 bp, Artificial Sequence
  chemically synthesized
agattgtactaaaagtcatagg

SEQ ID NO: 1037075 - DNA, 22 bp, Artificial Sequence
  chemically synthesized
tactaaaagtcataggaaattt

SEQ ID NO: 1037076 - DNA, 22 bp, Artificial Sequence
  chemically synthesized
gtcaggagctgttaaatttcct

SEQ ID NO: 1037077 - DNA, 22 bp, Artificial Sequence
  chemically synthesized
aaagtcataggaaatttaacag

SEQ ID NO: 1037078 - DNA, 22 bp, Artificial Sequence
  chemically synthesized
taggaattggtcaggagctgtt

SEQ ID NO: 1037079 - DNA, 22 bp, Artificial Sequence
  chemically synthesized
tataggaattggtcaggagctg

SEQ ID NO: 1037080 - DNA, 22 bp, Artificial Sequence
  chemically synthesized
acattctataggaattggtcag

SEQ ID NO: 1037081 - DNA, 22 bp, Artificial Sequence
  chemically synthesized
aacagctcctgaccaattccta

SEQ ID NO: 1037082 - DNA, 22 bp, Artificial Sequence
  chemically synthesized
acagctcctgaccaattcctat

SEQ ID NO: 1037083 - DNA, 22 bp, Artificial Sequence
  chemically synthesized
cattgacattctataggaattg

SEQ ID NO: 1037084 - DNA, 22 bp, Artificial Sequence
  chemically synthesized
ccattgacattctataggaatt

SEQ ID NO: 1037085 - DNA, 22 bp, Artificial Sequence
  chemically synthesized
tacttccattgacattctatag

SEQ ID NO: 1037086 - DNA, 22 bp, Artificial Sequence
  chemically synthesized
ctgaccaattcctatagaatgt

SEQ ID NO: 1037087 - DNA, 22 bp, Artificial Sequence
  chemically synthesized
accaattcctatagaatgtcaa

SEQ ID NO: 1037088 - DNA, 22 bp, Artificial Sequence
  chemically synthesized
aaattgtacttccattgacatt

SEQ ID NO: 1037089 - DNA, 22 bp, Artificial Sequence
  chemically synthesized
ctatagaatgtcaatggaagta

SEQ ID NO: 1037090 - DNA, 22 bp, Artificial Sequence
  chemically synthesized
tagaatgtcaatggaagtacaa

SEQ ID NO: 1037091 - DNA, 22 bp, Artificial Sequence
  chemically synthesized
tccagaggttgaaattgtactt

SEQ ID NO: 1037092 - DNA, 22 bp, Artificial Sequence
  chemically synthesized
atccagaggttgaaattgtact

SEQ ID NO: 1037093 - DNA, 22 bp, Artificial Sequence
  chemically synthesized
tccttatccagaggttgaaatt

SEQ ID NO: 1037094 - DNA, 22 bp, Artificial Sequence
  chemically synthesized
caacctctggataaggacaggg

SEQ ID NO: 1037095 - DNA, 22 bp, Artificial Sequence
  chemically synthesized
aacctctggataaggacagggt

SEQ ID NO: 1037096 - DNA, 22 bp, Artificial Sequence
  chemically synthesized
gccccaatagatccaccctgtc

SEQ ID NO: 1037097 - DNA, 22 bp, Artificial Sequence
  chemically synthesized
tagccccaatagatccaccctg

SEQ ID NO: 1037098 - DNA, 22 bp, Artificial Sequence
  chemically synthesized
tggataaggacagggtggatct

SEQ ID NO: 1037099 - DNA, 22 bp, Artificial Sequence
  chemically synthesized
tctagccccaatagatccaccc

SEQ ID NO: 1037100 - DNA, 22 bp, Artificial Sequence
  chemically synthesized
ctctagccccaatagatccacc

SEQ ID NO: 1037101 - DNA, 22 bp, Artificial Sequence
  chemically synthesized
gataaggacagggtggatctat

SEQ ID NO: 1037102 - DNA, 22 bp, Artificial Sequence
  chemically synthesized
acaaaggatagagtttctctag

SEQ ID NO: 1037103 - DNA, 22 bp, Artificial Sequence
  chemically synthesized
gacaaaggatagagtttctcta

SEQ ID NO: 1037104 - DNA, 22 bp, Artificial Sequence
  chemically synthesized
tgacaaaggatagagtttctct

SEQ ID NO: 1037105 - DNA, 22 bp, Artificial Sequence
  chemically synthesized
ttggggctagagaaactctatc

SEQ ID NO: 1037106 - DNA, 22 bp, Artificial Sequence
  chemically synthesized
gttttgacaaaggatagagttt

SEQ ID NO: 1037107 - DNA, 22 bp, Artificial Sequence
  chemically synthesized
tggttttgacaaaggatagagt

SEQ ID NO: 1037108 - DNA, 22 bp, Artificial Sequence
  chemically synthesized
gggctagagaaactctatcctt

SEQ ID NO: 1037109 - DNA, 22 bp, Artificial Sequence
  chemically synthesized
ctggttttgacaaaggatagag

SEQ ID NO: 1037110 - DNA, 22 bp, Artificial Sequence
  chemically synthesized
tctggttttgacaaaggataga

SEQ ID NO: 1037111 - DNA, 22 bp, Artificial Sequence
  chemically synthesized
ttctggttttgacaaaggatag

SEQ ID NO: 1037112 - DNA, 22 bp, Artificial Sequence
  chemically synthesized
gagaaactctatcctttgtcaa

SEQ ID NO: 1037113 - DNA, 22 bp, Artificial Sequence
  chemically synthesized
aggacttttctggttttgacaa

SEQ ID NO: 1037114 - DNA, 22 bp, Artificial Sequence
  chemically synthesized
tgaggacttttctggttttgac

SEQ ID NO: 1037115 - DNA, 22 bp, Artificial Sequence
  chemically synthesized
tatcctttgtcaaaaccagaaa

SEQ ID NO: 1037116 - DNA, 22 bp, Artificial Sequence
  chemically synthesized
tcctttgtcaaaaccagaaaag

SEQ ID NO: 1037117 - DNA, 22 bp, Artificial Sequence
  chemically synthesized
accccaactctgaggacttttc

SEQ ID NO: 1037118 - DNA, 22 bp, Artificial Sequence
  chemically synthesized
tgtcaaaaccagaaaagtcctc

SEQ ID NO: 1037119 - DNA, 22 bp, Artificial Sequence
  chemically synthesized
gtcaaaaccagaaaagtcctca

SEQ ID NO: 1037120 - DNA, 22 bp, Artificial Sequence
  chemically synthesized
tcaaaaccagaaaagtcctcag

SEQ ID NO: 1037121 - DNA, 22 bp, Artificial Sequence
  chemically synthesized
aaatctcaccccaactctgagg

SEQ ID NO: 1037122 - DNA, 22 bp, Artificial Sequence
  chemically synthesized
agagttggggtgagatttcagc

SEQ ID NO: 1037123 - DNA, 22 bp, Artificial Sequence
  chemically synthesized
cacagagagggtcgctgaaatc

SEQ ID NO: 1037124 - DNA, 22 bp, Artificial Sequence
  chemically synthesized
gggtgagatttcagcgaccctc

SEQ ID NO: 1037125 - DNA, 22 bp, Artificial Sequence
  chemically synthesized
acgccattccacagagagggtc

SEQ ID NO: 1037126 - DNA, 22 bp, Artificial Sequence
  chemically synthesized
cagcgaccctctctgtggaatg

SEQ ID NO: 1037127 - DNA, 22 bp, Artificial Sequence
  chemically synthesized
agcgaccctctctgtggaatgg

SEQ ID NO: 1037128 - DNA, 22 bp, Artificial Sequence
  chemically synthesized
aacagaaacactaacgccattc

SEQ ID NO: 1037129 - DNA, 22 bp, Artificial Sequence
  chemically synthesized
aaacagaaacactaacgccatt

SEQ ID NO: 1037130 - DNA, 22 bp, Artificial Sequence
  chemically synthesized
tctgtggaatggcgttagtgtt

SEQ ID NO: 1037131 - DNA, 22 bp, Artificial Sequence
  chemically synthesized
gacttaaacagaaacactaacg

SEQ ID NO: 1037132 - DNA, 22 bp, Artificial Sequence
  chemically synthesized
agacttaaacagaaacactaac

SEQ ID NO: 1037133 - DNA, 22 bp, Artificial Sequence
  chemically synthesized
tgtggaatggcgttagtgtttc

SEQ ID NO: 1037134 - DNA, 22 bp, Artificial Sequence
  chemically synthesized
tggaatggcgttagtgtttctg

SEQ ID NO: 1037135 - DNA, 22 bp, Artificial Sequence
  chemically synthesized
accttagacttaaacagaaaca

SEQ ID NO: 1037136 - DNA, 22 bp, Artificial Sequence
  chemically synthesized
caccttagacttaaacagaaac

SEQ ID NO: 1037137 - DNA, 22 bp, Artificial Sequence
  chemically synthesized
ccttcaccttagacttaaacag

SEQ ID NO: 1037138 - DNA, 22 bp, Artificial Sequence
  chemically synthesized
accttcaccttagacttaaaca

SEQ ID NO: 1037139 - DNA, 22 bp, Artificial Sequence
  chemically synthesized
gtgtttctgtttaagtctaagg

SEQ ID NO: 1037140 - DNA, 22 bp, Artificial Sequence
  chemically synthesized
agtttaccttcaccttagactt

SEQ ID NO: 1037141 - DNA, 22 bp, Artificial Sequence
  chemically synthesized
cagtttaccttcaccttagact

SEQ ID NO: 1037142 - DNA, 22 bp, Artificial Sequence
  chemically synthesized
tcagtttaccttcaccttagac

SEQ ID NO: 1037143 - DNA, 22 bp, Artificial Sequence
  chemically synthesized
ctgtttaagtctaaggtgaagg

SEQ ID NO: 1037144 - DNA, 22 bp, Artificial Sequence
  chemically synthesized
cctttcagtttaccttcacctt

SEQ ID NO: 1037145 - DNA, 22 bp, Artificial Sequence
  chemically synthesized
tgtttaagtctaaggtgaaggt

SEQ ID NO: 1037146 - DNA, 22 bp, Artificial Sequence
  chemically synthesized
ccctttcagtttaccttcacct

SEQ ID NO: 1037147 - DNA, 22 bp, Artificial Sequence
  chemically synthesized
tttaagtctaaggtgaaggtaa

SEQ ID NO: 1037148 - DNA, 22 bp, Artificial Sequence
  chemically synthesized
aagtctaaggtgaaggtaaact

SEQ ID NO: 1037149 - DNA, 22 bp, Artificial Sequence
  chemically synthesized
agtctaaggtgaaggtaaactg

SEQ ID NO: 1037150 - DNA, 22 bp, Artificial Sequence
  chemically synthesized
aggtgaaggtaaactgaaaggg

SEQ ID NO: 1037151 - DNA, 22 bp, Artificial Sequence
  chemically synthesized
ggtcatatggacatttcccttt

SEQ ID NO: 1037152 - DNA, 22 bp, Artificial Sequence
  chemically synthesized
actgggtcatatggacatttcc

SEQ ID NO: 1037153 - DNA, 22 bp, Artificial Sequence
  chemically synthesized
tcactgggtcatatggacattt

SEQ ID NO: 1037154 - DNA, 22 bp, Artificial Sequence
  chemically synthesized
ctcactgggtcatatggacatt

SEQ ID NO: 1037155 - DNA, 22 bp, Artificial Sequence
  chemically synthesized
ccttctcactgggtcatatgga

SEQ ID NO: 1037156 - DNA, 22 bp, Artificial Sequence
  chemically synthesized
aaagggaaatgtccatatgacc

SEQ ID NO: 1037157 - DNA, 22 bp, Artificial Sequence
  chemically synthesized
gcaaatgatccaggtattccct

SEQ ID NO: 1037158 - DNA, 22 bp, Artificial Sequence
  chemically synthesized
ggcaaatgatccaggtattccc

SEQ ID NO: 1037159 - DNA, 22 bp, Artificial Sequence
  chemically synthesized
tggcaaatgatccaggtattcc

SEQ ID NO: 1037160 - DNA, 22 bp, Artificial Sequence
  chemically synthesized
ttggcaaatgatccaggtattc

SEQ ID NO: 1037161 - DNA, 22 bp, Artificial Sequence
  chemically synthesized
atgagtaatttttggcaaatga

SEQ ID NO: 1037162 - DNA, 22 bp, Artificial Sequence
  chemically synthesized
ctcatgagtaatttttggcaaa

SEQ ID NO: 1037163 - DNA, 22 bp, Artificial Sequence
  chemically synthesized
actcatgagtaatttttggcaa

SEQ ID NO: 1037164 - DNA, 22 bp, Artificial Sequence
  chemically synthesized
tactcatgagtaatttttggca

SEQ ID NO: 1037165 - DNA, 22 bp, Artificial Sequence
  chemically synthesized
gatcatttgccaaaaattactc

SEQ ID NO: 1037166 - DNA, 22 bp, Artificial Sequence
  chemically synthesized
cgctttactcatgagtaatttt

SEQ ID NO: 1037167 - DNA, 22 bp, Artificial Sequence
  chemically synthesized
ctccgctttactcatgagtaat

SEQ ID NO: 1037168 - DNA, 22 bp, Artificial Sequence
  chemically synthesized
tcctccgctttactcatgagta

SEQ ID NO: 1037169 - DNA, 22 bp, Artificial Sequence
  chemically synthesized
ctcctccgctttactcatgagt

SEQ ID NO: 1037170 - DNA, 22 bp, Artificial Sequence
  chemically synthesized
gccaaaaattactcatgagtaa

SEQ ID NO: 1037171 - DNA, 22 bp, Artificial Sequence
  chemically synthesized
ccaaaaattactcatgagtaaa

SEQ ID NO: 1037172 - DNA, 22 bp, Artificial Sequence
  chemically synthesized
aggtttctcctccgctttactc

SEQ ID NO: 1037173 - DNA, 22 bp, Artificial Sequence
  chemically synthesized
gaggtttctcctccgctttact

SEQ ID NO: 1037174 - DNA, 22 bp, Artificial Sequence
  chemically synthesized
tgaggtttctcctccgctttac

SEQ ID NO: 1037175 - DNA, 22 bp, Artificial Sequence
  chemically synthesized
ttgaggtttctcctccgcttta

SEQ ID NO: 1037176 - DNA, 22 bp, Artificial Sequence
  chemically synthesized
tttgaggtttctcctccgcttt

SEQ ID NO: 1037177 - DNA, 22 bp, Artificial Sequence
  chemically synthesized
ctcatgagtaaagcggaggaga

SEQ ID NO: 1037178 - DNA, 22 bp, Artificial Sequence
  chemically synthesized
ctttttgaggtttctcctccgc

SEQ ID NO: 1037179 - DNA, 22 bp, Artificial Sequence
  chemically synthesized
tgctttttgaggtttctcctcc

SEQ ID NO: 1037180 - DNA, 22 bp, Artificial Sequence
  chemically synthesized
atgagtaaagcggaggagaaac

SEQ ID NO: 1037181 - DNA, 22 bp, Artificial Sequence
  chemically synthesized
ctgctttttgaggtttctcctc

SEQ ID NO: 1037182 - DNA, 22 bp, Artificial Sequence
  chemically synthesized
tctgctttttgaggtttctcct

SEQ ID NO: 1037183 - DNA, 22 bp, Artificial Sequence
  chemically synthesized
aagtagaaataacgctttctgc

SEQ ID NO: 1037184 - DNA, 22 bp, Artificial Sequence
  chemically synthesized
cactaaagtagaaataacgctt

SEQ ID NO: 1037185 - DNA, 22 bp, Artificial Sequence
  chemically synthesized
gcactaaagtagaaataacgct

SEQ ID NO: 1037186 - DNA, 22 bp, Artificial Sequence
  chemically synthesized
aaaaagcagaaagcgttatttc

SEQ ID NO: 1037187 - DNA, 22 bp, Artificial Sequence
  chemically synthesized
tgcactaaagtagaaataacgc

SEQ ID NO: 1037188 - DNA, 22 bp, Artificial Sequence
  chemically synthesized
ccagttttgcactaaagtagaa

SEQ ID NO: 1037189 - DNA, 22 bp, Artificial Sequence
  chemically synthesized
tatacacctaccagttttgcac

SEQ ID NO: 1037190 - DNA, 22 bp, Artificial Sequence
  chemically synthesized
tttctactttagtgcaaaactg

SEQ ID NO: 1037191 - DNA, 22 bp, Artificial Sequence
  chemically synthesized
tatatacacctaccagttttgc

SEQ ID NO: 1037192 - DNA, 22 bp, Artificial Sequence
  chemically synthesized
ctatatacacctaccagttttg

SEQ ID NO: 1037193 - DNA, 22 bp, Artificial Sequence
  chemically synthesized
ctactttagtgcaaaactggta

SEQ ID NO: 1037194 - DNA, 22 bp, Artificial Sequence
  chemically synthesized
tactttagtgcaaaactggtag

SEQ ID NO: 1037195 - DNA, 22 bp, Artificial Sequence
  chemically synthesized
ctttagtgcaaaactggtaggt

SEQ ID NO: 1037196 - DNA, 22 bp, Artificial Sequence
  chemically synthesized
tgcttctatatacacctaccag

SEQ ID NO: 1037197 - DNA, 22 bp, Artificial Sequence
  chemically synthesized
tagtgcaaaactggtaggtgta

SEQ ID NO: 1037198 - DNA, 22 bp, Artificial Sequence
  chemically synthesized
agtgcaaaactggtaggtgtat

SEQ ID NO: 1037199 - DNA, 22 bp, Artificial Sequence
  chemically synthesized
ctgtgcttctatatacacctac

SEQ ID NO: 1037200 - DNA, 22 bp, Artificial Sequence
  chemically synthesized
gtgcaaaactggtaggtgtata

SEQ ID NO: 1037201 - DNA, 22 bp, Artificial Sequence
  chemically synthesized
gtaggtgtatatagaagcacag

SEQ ID NO: 1037202 - DNA, 22 bp, Artificial Sequence
  chemically synthesized
gatagccagtgattactgtgct

SEQ ID NO: 1037203 - DNA, 22 bp, Artificial Sequence
  chemically synthesized
ggatagccagtgattactgtgc

SEQ ID NO: 1037204 - DNA, 22 bp, Artificial Sequence
  chemically synthesized
ttggatagccagtgattactgt

SEQ ID NO: 1037205 - DNA, 22 bp, Artificial Sequence
  chemically synthesized
cttggatagccagtgattactg

SEQ ID NO: 1037206 - DNA, 22 bp, Artificial Sequence
  chemically synthesized
aggtttcttggatagccagtga

SEQ ID NO: 1037207 - DNA, 22 bp, Artificial Sequence
  chemically synthesized
aggaccgttgaggtttcttgga

SEQ ID NO: 1037208 - DNA, 22 bp, Artificial Sequence
  chemically synthesized
gctatccaagaaacctcaacgg

SEQ ID NO: 1037209 - DNA, 22 bp, Artificial Sequence
  chemically synthesized
tccaagaaacctcaacggtcct

SEQ ID NO: 1037210 - DNA, 22 bp, Artificial Sequence
  chemically synthesized
ggccacccacaccatcccctaa

SEQ ID NO: 1037211 - DNA, 22 bp, Artificial Sequence
  chemically synthesized
taggccacccacaccatcccct

SEQ ID NO: 1037212 - DNA, 22 bp, Artificial Sequence
  chemically synthesized
aacggtccttaggggatggtgt

SEQ ID NO: 1037213 - DNA, 22 bp, Artificial Sequence
  chemically synthesized
caagcattctaggccacccaca

SEQ ID NO: 1037214 - DNA, 22 bp, Artificial Sequence
  chemically synthesized
tccaagcattctaggccaccca

SEQ ID NO: 1037215 - DNA, 22 bp, Artificial Sequence
  chemically synthesized
aggggatggtgtgggtggccta

SEQ ID NO: 1037216 - DNA, 22 bp, Artificial Sequence
  chemically synthesized
ctccaagcattctaggccaccc

SEQ ID NO: 1037217 - DNA, 22 bp, Artificial Sequence
  chemically synthesized
ggggatggtgtgggtggcctag

SEQ ID NO: 1037218 - DNA, 22 bp, Artificial Sequence
  chemically synthesized
tctccaagcattctaggccacc

SEQ ID NO: 1037219 - DNA, 22 bp, Artificial Sequence
  chemically synthesized
tagtcagtgttttctccaagca

SEQ ID NO: 1037220 - DNA, 22 bp, Artificial Sequence
  chemically synthesized
atagtcagtgttttctccaagc

SEQ ID NO: 1037221 - DNA, 22 bp, Artificial Sequence
  chemically synthesized
ttatagtcagtgttttctccaa

SEQ ID NO: 1037222 - DNA, 22 bp, Artificial Sequence
  chemically synthesized
cttatagtcagtgttttctcca

SEQ ID NO: 1037223 - DNA, 22 bp, Artificial Sequence
  chemically synthesized
tcttcttatagtcagtgttttc

SEQ ID NO: 1037224 - DNA, 22 bp, Artificial Sequence
  chemically synthesized
gaatgcttggagaaaacactga

SEQ ID NO: 1037225 - DNA, 22 bp, Artificial Sequence
  chemically synthesized
gtcttcttatagtcagtgtttt

SEQ ID NO: 1037226 - DNA, 22 bp, Artificial Sequence
  chemically synthesized
gtttgtcttcttatagtcagtg

SEQ ID NO: 1037227 - DNA, 22 bp, Artificial Sequence
  chemically synthesized
tggtttgtcttcttatagtcag

SEQ ID NO: 1037228 - DNA, 22 bp, Artificial Sequence
  chemically synthesized
ggagaaaacactgactataaga

SEQ ID NO: 1037229 - DNA, 22 bp, Artificial Sequence
  chemically synthesized
gagaaaacactgactataagaa

SEQ ID NO: 1037230 - DNA, 22 bp, Artificial Sequence
  chemically synthesized
cccctctggtttgtcttcttat

SEQ ID NO: 1037231 - DNA, 22 bp, Artificial Sequence
  chemically synthesized
ccccctctggtttgtcttctta

SEQ ID NO: 1037232 - DNA, 22 bp, Artificial Sequence
  chemically synthesized
ttccccctctggtttgtcttct

SEQ ID NO: 1037233 - DNA, 22 bp, Artificial Sequence
  chemically synthesized
actataagaagacaaaccagag

SEQ ID NO: 1037234 - DNA, 22 bp, Artificial Sequence
  chemically synthesized
ggaagttcttccccctctggtt

SEQ ID NO: 1037235 - DNA, 22 bp, Artificial Sequence
  chemically synthesized
gggaagttcttccccctctggt

SEQ ID NO: 1037236 - DNA, 22 bp, Artificial Sequence
  chemically synthesized
taagaagacaaaccagaggggg

SEQ ID NO: 1037237 - DNA, 22 bp, Artificial Sequence
  chemically synthesized
ttgggaagttcttccccctctg

SEQ ID NO: 1037238 - DNA, 22 bp, Artificial Sequence
  chemically synthesized
cactcttgggaagttcttcccc

SEQ ID NO: 1037239 - DNA, 22 bp, Artificial Sequence
  chemically synthesized
attccactcttgggaagttctt

SEQ ID NO: 1037240 - DNA, 22 bp, Artificial Sequence
  chemically synthesized
ggatgttcattccactcttggg

SEQ ID NO: 1037241 - DNA, 22 bp, Artificial Sequence
  chemically synthesized
gggatgttcattccactcttgg

SEQ ID NO: 1037242 - DNA, 22 bp, Artificial Sequence
  chemically synthesized
tgggatgttcattccactcttg

SEQ ID NO: 1037243 - DNA, 22 bp, Artificial Sequence
  chemically synthesized
ttgggatgttcattccactctt

SEQ ID NO: 1037244 - DNA, 22 bp, Artificial Sequence
  chemically synthesized
ccatcttttgggatgttcattc

SEQ ID NO: 1037245 - DNA, 22 bp, Artificial Sequence
  chemically synthesized
cccaagagtggaatgaacatcc

SEQ ID NO: 1037246 - DNA, 22 bp, Artificial Sequence
  chemically synthesized
ccaagagtggaatgaacatccc

SEQ ID NO: 1037247 - DNA, 22 bp, Artificial Sequence
  chemically synthesized
attaccatcttttgggatgttc

SEQ ID NO: 1037248 - DNA, 22 bp, Artificial Sequence
  chemically synthesized
cattaccatcttttgggatgtt

SEQ ID NO: 1037249 - DNA, 22 bp, Artificial Sequence
  chemically synthesized
caatgatgtcagtttcattacc

SEQ ID NO: 1037250 - DNA, 22 bp, Artificial Sequence
  chemically synthesized
ctccaatgatgtcagtttcatt

SEQ ID NO: 1037251 - DNA, 22 bp, Artificial Sequence
  chemically synthesized
cgggctactccaatgatgtcag

SEQ ID NO: 1037252 - DNA, 22 bp, Artificial Sequence
  chemically synthesized
tgcgggctactccaatgatgtc

SEQ ID NO: 1037253 - DNA, 22 bp, Artificial Sequence
  chemically synthesized
tgaggctctgcgggctactcca

SEQ ID NO: 1037254 - DNA, 22 bp, Artificial Sequence
  chemically synthesized
acatcattggagtagcccgcag

SEQ ID NO: 1037255 - DNA, 22 bp, Artificial Sequence
  chemically synthesized
agacattatgaggctctgcggg

SEQ ID NO: 1037256 - DNA, 22 bp, Artificial Sequence
  chemically synthesized
gagtagcccgcagagcctcata

SEQ ID NO: 1037257 - DNA, 22 bp, Artificial Sequence
  chemically synthesized
acattgagacattatgaggctc

SEQ ID NO: 1037258 - DNA, 22 bp, Artificial Sequence
  chemically synthesized
cacattgagacattatgaggct

SEQ ID NO: 1037259 - DNA, 22 bp, Artificial Sequence
  chemically synthesized
ccagcatttcacattgagacat

SEQ ID NO: 1037260 - DNA, 22 bp, Artificial Sequence
  chemically synthesized
tcccagcatttcacattgagac

SEQ ID NO: 1037261 - DNA, 22 bp, Artificial Sequence
  chemically synthesized
ctcccagcatttcacattgaga

SEQ ID NO: 1037262 - DNA, 22 bp, Artificial Sequence
  chemically synthesized
tctcccagcatttcacattgag

SEQ ID NO: 1037263 - DNA, 22 bp, Artificial Sequence
  chemically synthesized
ataatgtctcaatgtgaaatgc

SEQ ID NO: 1037264 - DNA, 22 bp, Artificial Sequence
  chemically synthesized
aatgtgaaatgctgggagaaag

SEQ ID NO: 1037265 - DNA, 22 bp, Artificial Sequence
  chemically synthesized
tatcgccaccatggtgtacttt

SEQ ID NO: 1037266 - DNA, 22 bp, Artificial Sequence
  chemically synthesized
atatcgccaccatggtgtactt

SEQ ID NO: 1037267 - DNA, 22 bp, Artificial Sequence
  chemically synthesized
ggagaaagtacaccatggtggc

SEQ ID NO: 1037268 - DNA, 22 bp, Artificial Sequence
  chemically synthesized
aataaacttatatcgccaccat

SEQ ID NO: 1037269 - DNA, 22 bp, Artificial Sequence
  chemically synthesized
gaataaacttatatcgccacca

SEQ ID NO: 1037270 - DNA, 22 bp, Artificial Sequence
  chemically synthesized
acaaaaatatttgaataaactt

SEQ ID NO: 1037271 - DNA, 22 bp, Artificial Sequence
  chemically synthesized
aaataaattaacaaaaatattt

SEQ ID NO: 1037272 - DNA, 22 bp, Artificial Sequence
  chemically synthesized
taaaataaattaacaaaaatat

SEQ ID NO: 1037273 - DNA, 22 bp, Artificial Sequence
  chemically synthesized
tctaaaataaattaacaaaaat

SEQ ID NO: 1037274 - DNA, 22 bp, Artificial Sequence
  chemically synthesized
tctctaaaataaattaacaaaa

SEQ ID NO: 1037275 - DNA, 22 bp, Artificial Sequence
  chemically synthesized
attcaaatatttttgttaattt

SEQ ID NO: 1037276 - DNA, 22 bp, Artificial Sequence
  chemically synthesized
ttcaaatatttttgttaattta

SEQ ID NO: 1037277 - DNA, 22 bp, Artificial Sequence
  chemically synthesized
aaatatttttgttaatttattt

SEQ ID NO: 1037278 - DNA, 22 bp, Artificial Sequence
  chemically synthesized
agtaacagactctctctaaaat

SEQ ID NO: 1037279 - DNA, 22 bp, Artificial Sequence
  chemically synthesized
ttgttaatttattttagagaga

SEQ ID NO: 1037280 - DNA, 22 bp, Artificial Sequence
  chemically synthesized
tgttaatttattttagagagag

SEQ ID NO: 1037281 - DNA, 22 bp, Artificial Sequence
  chemically synthesized
gttaatttattttagagagagt

SEQ ID NO: 1037282 - DNA, 22 bp, Artificial Sequence
  chemically synthesized
ttaatttattttagagagagtc

SEQ ID NO: 1037283 - DNA, 22 bp, Artificial Sequence
  chemically synthesized
cagcctgagtaacagactctct

SEQ ID NO: 1037284 - DNA, 22 bp, Artificial Sequence
  chemically synthesized
atttattttagagagagtctgt

SEQ ID NO: 1037285 - DNA, 22 bp, Artificial Sequence
  chemically synthesized
attttagagagagtctgttact

SEQ ID NO: 1037286 - DNA, 22 bp, Artificial Sequence
  chemically synthesized
tactacagcctgagtaacagac

SEQ ID NO: 1037287 - DNA, 22 bp, Artificial Sequence
  chemically synthesized
ttttagagagagtctgttactc

SEQ ID NO: 1037288 - DNA, 22 bp, Artificial Sequence
  chemically synthesized
tagagagagtctgttactcagg

SEQ ID NO: 1037289 - DNA, 22 bp, Artificial Sequence
  chemically synthesized
agagagagtctgttactcaggc

SEQ ID NO: 1037290 - DNA, 22 bp, Artificial Sequence
  chemically synthesized
gagagagtctgttactcaggct

SEQ ID NO: 1037291 - DNA, 22 bp, Artificial Sequence
  chemically synthesized
tgccactgtactacagcctgag

SEQ ID NO: 1037292 - DNA, 22 bp, Artificial Sequence
  chemically synthesized
ttactcaggctgtagtacagtg

SEQ ID NO: 1037293 - DNA, 22 bp, Artificial Sequence
  chemically synthesized
ctcaggctgtagtacagtggca

SEQ ID NO: 1037294 - DNA, 22 bp, Artificial Sequence
  chemically synthesized
aggctgtagtacagtggcacaa

SEQ ID NO: 1037295 - DNA, 22 bp, Artificial Sequence
  chemically synthesized
ccacgagccatgattgtgccac

SEQ ID NO: 1037296 - DNA, 22 bp, Artificial Sequence
  chemically synthesized
tagtacagtggcacaatcatgg

SEQ ID NO: 1037297 - DNA, 22 bp, Artificial Sequence
  chemically synthesized
aaggctgccacgagccatgatt

SEQ ID NO: 1037298 - DNA, 22 bp, Artificial Sequence
  chemically synthesized
agcccaggaattcaaggctgcc

SEQ ID NO: 1037299 - DNA, 22 bp, Artificial Sequence
  chemically synthesized
gagcccaggaattcaaggctgc

SEQ ID NO: 1037300 - DNA, 22 bp, Artificial Sequence
  chemically synthesized
gtggcagccttgaattcctggg

SEQ ID NO: 1037301 - DNA, 22 bp, Artificial Sequence
  chemically synthesized
aggcaggagggtcacttgagcc

SEQ ID NO: 1037302 - DNA, 22 bp, Artificial Sequence
  chemically synthesized
gaattcctgggctcaagtgacc

SEQ ID NO: 1037303 - DNA, 22 bp, Artificial Sequence
  chemically synthesized
aattcctgggctcaagtgaccc

SEQ ID NO: 1037304 - DNA, 22 bp, Artificial Sequence
  chemically synthesized
ggaggctgaggcaggagggtca

SEQ ID NO: 1037305 - DNA, 22 bp, Artificial Sequence
  chemically synthesized
ctgggctcaagtgaccctcctg

SEQ ID NO: 1037306 - DNA, 22 bp, Artificial Sequence
  chemically synthesized
gggaggctgaggcaggagggtc

SEQ ID NO: 1037307 - DNA, 22 bp, Artificial Sequence
  chemically synthesized
tgggaggctgaggcaggagggt

SEQ ID NO: 1037308 - DNA, 22 bp, Artificial Sequence
  chemically synthesized
ggctcaagtgaccctcctgcct

SEQ ID NO: 1037309 - DNA, 22 bp, Artificial Sequence
  chemically synthesized
tgctttgggaggctgaggcagg

SEQ ID NO: 1037310 - DNA, 22 bp, Artificial Sequence
  chemically synthesized
aagtgaccctcctgcctcagcc

SEQ ID NO: 1037311 - DNA, 22 bp, Artificial Sequence
  chemically synthesized
taatccctgtgctttgggaggc

SEQ ID NO: 1037312 - DNA, 22 bp, Artificial Sequence
  chemically synthesized
ctgcctcagcctcccaaagcac

SEQ ID NO: 1037313 - DNA, 22 bp, Artificial Sequence
  chemically synthesized
cctcagcctcccaaagcacagg

SEQ ID NO: 1037314 - DNA, 22 bp, Artificial Sequence
  chemically synthesized
atgcctgtaatccctgtgcttt

SEQ ID NO: 1037315 - DNA, 22 bp, Artificial Sequence
  chemically synthesized
agcctcccaaagcacagggatt

SEQ ID NO: 1037316 - DNA, 22 bp, Artificial Sequence
  chemically synthesized
ccaaagcacagggattacaggc

SEQ ID NO: 1037317 - DNA, 22 bp, Artificial Sequence
  chemically synthesized
taaaatggtggctcatgcctgt

SEQ ID NO: 1037318 - DNA, 22 bp, Artificial Sequence
  chemically synthesized
ataaaatggtggctcatgcctg

SEQ ID NO: 1037319 - DNA, 22 bp, Artificial Sequence
  chemically synthesized
aacttataaaatggtggctcat

SEQ ID NO: 1037320 - DNA, 22 bp, Artificial Sequence
  chemically synthesized
aaacttataaaatggtggctca

SEQ ID NO: 1037321 - DNA, 22 bp, Artificial Sequence
  chemically synthesized
caggcatgagccaccattttat

SEQ ID NO: 1037322 - DNA, 22 bp, Artificial Sequence
  chemically synthesized
caaatacaaacttaaacttata

SEQ ID NO: 1037323 - DNA, 22 bp, Artificial Sequence
  chemically synthesized
tgtatatgctacaaatacaaac

SEQ ID NO: 1037324 - DNA, 22 bp, Artificial Sequence
  chemically synthesized
tataagtttaagtttgtatttg

SEQ ID NO: 1037325 - DNA, 22 bp, Artificial Sequence
  chemically synthesized
ataagtttaagtttgtatttgt

SEQ ID NO: 1037326 - DNA, 22 bp, Artificial Sequence
  chemically synthesized
tgtgtatatgctacaaatacaa

SEQ ID NO: 1037327 - DNA, 22 bp, Artificial Sequence
  chemically synthesized
taagtttaagtttgtatttgta

SEQ ID NO: 1037328 - DNA, 22 bp, Artificial Sequence
  chemically synthesized
aagtttgtatttgtagcatata

SEQ ID NO: 1037329 - DNA, 22 bp, Artificial Sequence
  chemically synthesized
agccactctgtgtatatgctac

SEQ ID NO: 1037330 - DNA, 22 bp, Artificial Sequence
  chemically synthesized
agtttgtatttgtagcatatac

SEQ ID NO: 1037331 - DNA, 22 bp, Artificial Sequence
  chemically synthesized
gtatttgtagcatatacacaga

SEQ ID NO: 1037332 - DNA, 22 bp, Artificial Sequence
  chemically synthesized
tatttgtagcatatacacagag

SEQ ID NO: 1037333 - DNA, 22 bp, Artificial Sequence
  chemically synthesized
gtagcatatacacagagtggct

SEQ ID NO: 1037334 - DNA, 22 bp, Artificial Sequence
  chemically synthesized
tagcatatacacagagtggctg

SEQ ID NO: 1037335 - DNA, 22 bp, Artificial Sequence
  chemically synthesized
ataaaggcaaagaaactcagcc

SEQ ID NO: 1037336 - DNA, 22 bp, Artificial Sequence
  chemically synthesized
gataaaggcaaagaaactcagc

SEQ ID NO: 1037337 - DNA, 22 bp, Artificial Sequence
  chemically synthesized
agtttctttgcctttatcaagc

SEQ ID NO: 1037338 - DNA, 22 bp, Artificial Sequence
  chemically synthesized
ctttgcctttatcaagcctggc

SEQ ID NO: 1037339 - DNA, 22 bp, Artificial Sequence
  chemically synthesized
tttgcctttatcaagcctggct

SEQ ID NO: 1037340 - DNA, 22 bp, Artificial Sequence
  chemically synthesized
tgcctttatcaagcctggcttt

SEQ ID NO: 1037341 - DNA, 22 bp, Artificial Sequence
  chemically synthesized
gcctttatcaagcctggctttg

SEQ ID NO: 1037342 - DNA, 22 bp, Artificial Sequence
  chemically synthesized
cctttatcaagcctggctttgg

SEQ ID NO: 1037343 - DNA, 22 bp, Artificial Sequence
  chemically synthesized
gtcccacagtatccaaagccag

SEQ ID NO: 1037344 - DNA, 22 bp, Artificial Sequence
  chemically synthesized
tatcaagcctggctttggatac

SEQ ID NO: 1037345 - DNA, 22 bp, Artificial Sequence
  chemically synthesized
atcaagcctggctttggatact

SEQ ID NO: 1037346 - DNA, 22 bp, Artificial Sequence
  chemically synthesized
tcaagcctggctttggatactg

SEQ ID NO: 1037347 - DNA, 22 bp, Artificial Sequence
  chemically synthesized
aaaatagctggtcccacagtat

SEQ ID NO: 1037348 - DNA, 22 bp, Artificial Sequence
  chemically synthesized
gaaaatagctggtcccacagta

SEQ ID NO: 1037349 - DNA, 22 bp, Artificial Sequence
  chemically synthesized
cttgaaaatagctggtcccaca

SEQ ID NO: 1037350 - DNA, 22 bp, Artificial Sequence
  chemically synthesized
gctttggatactgtgggaccag

SEQ ID NO: 1037351 - DNA, 22 bp, Artificial Sequence
  chemically synthesized
ccttgaaaatagctggtcccac

SEQ ID NO: 1037352 - DNA, 22 bp, Artificial Sequence
  chemically synthesized
tggatactgtgggaccagctat

SEQ ID NO: 1037353 - DNA, 22 bp, Artificial Sequence
  chemically synthesized
ggatactgtgggaccagctatt

SEQ ID NO: 1037354 - DNA, 22 bp, Artificial Sequence
  chemically synthesized
aacttccttgaaaatagctggt

SEQ ID NO: 1037355 - DNA, 22 bp, Artificial Sequence
  chemically synthesized
gatactgtgggaccagctattt

SEQ ID NO: 1037356 - DNA, 22 bp, Artificial Sequence
  chemically synthesized
tctcaacttccttgaaaatagc

SEQ ID NO: 1037357 - DNA, 22 bp, Artificial Sequence
  chemically synthesized
atctcaacttccttgaaaatag

SEQ ID NO: 1037358 - DNA, 22 bp, Artificial Sequence
  chemically synthesized
tgggaccagctattttcaagga

SEQ ID NO: 1037359 - DNA, 22 bp, Artificial Sequence
  chemically synthesized
ttttcaaggaagttgagataaa

SEQ ID NO: 1037360 - DNA, 22 bp, Artificial Sequence
  chemically synthesized
tcaaggaagttgagataaatct

SEQ ID NO: 1037361 - DNA, 22 bp, Artificial Sequence
  chemically synthesized
caaggaagttgagataaatctg

SEQ ID NO: 1037362 - DNA, 22 bp, Artificial Sequence
  chemically synthesized
aaggaagttgagataaatctgt

SEQ ID NO: 1037363 - DNA, 22 bp, Artificial Sequence
  chemically synthesized
agataaatctgtttttttgttt

SEQ ID NO: 1037364 - DNA, 22 bp, Artificial Sequence
  chemically synthesized
aaacaaaacaaaacaaaacaaa

SEQ ID NO: 1037365 - DNA, 22 bp, Artificial Sequence
  chemically synthesized
cgtctcaaacaaaacaaaacaa

SEQ ID NO: 1037366 - DNA, 22 bp, Artificial Sequence
  chemically synthesized
tttttttgttttgttttgtttt

SEQ ID NO: 1037367 - DNA, 22 bp, Artificial Sequence
  chemically synthesized
ttttgttttgttttgttttgtt

SEQ ID NO: 1037368 - DNA, 22 bp, Artificial Sequence
  chemically synthesized
tttgttttgttttgttttgttt

SEQ ID NO: 1037369 - DNA, 22 bp, Artificial Sequence
  chemically synthesized
ttgttttgttttgttttgtttg

SEQ ID NO: 1037370 - DNA, 22 bp, Artificial Sequence
  chemically synthesized
tgttttgttttgttttgtttga

SEQ ID NO: 1037371 - DNA, 22 bp, Artificial Sequence
  chemically synthesized
gttttgttttgttttgtttgag

SEQ ID NO: 1037372 - DNA, 22 bp, Artificial Sequence
  chemically synthesized
ttttgttttgttttgtttgaga

SEQ ID NO: 1037373 - DNA, 22 bp, Artificial Sequence
  chemically synthesized
tgttttgttttgtttgagacgg

SEQ ID NO: 1037374 - DNA, 22 bp, Artificial Sequence
  chemically synthesized
gttttgttttgtttgagacgga

SEQ ID NO: 1037375 - DNA, 22 bp, Artificial Sequence
  chemically synthesized
ttttgttttgtttgagacggag

SEQ ID NO: 1037376 - DNA, 22 bp, Artificial Sequence
  chemically synthesized
tgttttgtttgagacggagcct

SEQ ID NO: 1037377 - DNA, 22 bp, Artificial Sequence
  chemically synthesized
ggtgacagagcaaggctccgtc

SEQ ID NO: 1037378 - DNA, 22 bp, Artificial Sequence
  chemically synthesized
gttttgtttgagacggagcctt

SEQ ID NO: 1037379 - DNA, 22 bp, Artificial Sequence
  chemically synthesized
ttttgtttgagacggagccttg

SEQ ID NO: 1037380 - DNA, 22 bp, Artificial Sequence
  chemically synthesized
tgtttgagacggagccttgctc

SEQ ID NO: 1037381 - DNA, 22 bp, Artificial Sequence
  chemically synthesized
gtttgagacggagccttgctct

SEQ ID NO: 1037382 - DNA, 22 bp, Artificial Sequence
  chemically synthesized
tttgagacggagccttgctctg

SEQ ID NO: 1037383 - DNA, 22 bp, Artificial Sequence
  chemically synthesized
cagcctgggtgacagagcaagg

SEQ ID NO: 1037384 - DNA, 22 bp, Artificial Sequence
  chemically synthesized
gagacggagccttgctctgtca

SEQ ID NO: 1037385 - DNA, 22 bp, Artificial Sequence
  chemically synthesized
agacggagccttgctctgtcac

SEQ ID NO: 1037386 - DNA, 22 bp, Artificial Sequence
  chemically synthesized
cattccagcctgggtgacagag

SEQ ID NO: 1037387 - DNA, 22 bp, Artificial Sequence
  chemically synthesized
gctctgtcacccaggctggaat

SEQ ID NO: 1037388 - DNA, 22 bp, Artificial Sequence
  chemically synthesized
ctctgtcacccaggctggaatg

SEQ ID NO: 1037389 - DNA, 22 bp, Artificial Sequence
  chemically synthesized
tgtcacccaggctggaatgcag

SEQ ID NO: 1037390 - DNA, 22 bp, Artificial Sequence
  chemically synthesized
tcacccaggctggaatgcagtg

SEQ ID NO: 1037391 - DNA, 22 bp, Artificial Sequence
  chemically synthesized
cagtgagcccaaatccaccact

SEQ ID NO: 1037392 - DNA, 22 bp, Artificial Sequence
  chemically synthesized
gaatgcagtggtggatttgggc

SEQ ID NO: 1037393 - DNA, 22 bp, Artificial Sequence
  chemically synthesized
aacccaggaggcagaggctgca

SEQ ID NO: 1037394 - DNA, 22 bp, Artificial Sequence
  chemically synthesized
gaacccaggaggcagaggctgc

SEQ ID NO: 1037395 - DNA, 22 bp, Artificial Sequence
  chemically synthesized
gggctcactgcagcctctgcct

SEQ ID NO: 1037396 - DNA, 22 bp, Artificial Sequence
  chemically synthesized
ggctcactgcagcctctgcctc

SEQ ID NO: 1037397 - DNA, 22 bp, Artificial Sequence
  chemically synthesized
actgcagcctctgcctcctggg

SEQ ID NO: 1037398 - DNA, 22 bp, Artificial Sequence
  chemically synthesized
cagcctctgcctcctgggttca

SEQ ID NO: 1037399 - DNA, 22 bp, Artificial Sequence
  chemically synthesized
aggcaggagaatcccttgaacc

SEQ ID NO: 1037400 - DNA, 22 bp, Artificial Sequence
  chemically synthesized
tgcctcctgggttcaagggatt

SEQ ID NO: 1037401 - DNA, 22 bp, Artificial Sequence
  chemically synthesized
cctcctgggttcaagggattct

SEQ ID NO: 1037402 - DNA, 22 bp, Artificial Sequence
  chemically synthesized
ctgggttcaagggattctcctg

SEQ ID NO: 1037403 - DNA, 22 bp, Artificial Sequence
  chemically synthesized
gggaggctgaggcaggagaatc

SEQ ID NO: 1037404 - DNA, 22 bp, Artificial Sequence
  chemically synthesized
ggttcaagggattctcctgcct

SEQ ID NO: 1037405 - DNA, 22 bp, Artificial Sequence
  chemically synthesized
ctcgggaggctgaggcaggaga

SEQ ID NO: 1037406 - DNA, 22 bp, Artificial Sequence
  chemically synthesized
aagggattctcctgcctcagcc

SEQ ID NO: 1037407 - DNA, 22 bp, Artificial Sequence
  chemically synthesized
tagtcccagctactcgggaggc

SEQ ID NO: 1037408 - DNA, 22 bp, Artificial Sequence
  chemically synthesized
gtagtcccagctactcgggagg

SEQ ID NO: 1037409 - DNA, 22 bp, Artificial Sequence
  chemically synthesized
tcctgcctcagcctcccgagta

SEQ ID NO: 1037410 - DNA, 22 bp, Artificial Sequence
  chemically synthesized
ctgcctcagcctcccgagtagc

SEQ ID NO: 1037411 - DNA, 22 bp, Artificial Sequence
  chemically synthesized
cctcagcctcccgagtagctgg

SEQ ID NO: 1037412 - DNA, 22 bp, Artificial Sequence
  chemically synthesized
agcctcccgagtagctgggact

SEQ ID NO: 1037413 - DNA, 22 bp, Artificial Sequence
  chemically synthesized
ccgagtagctgggactacaagc

SEQ ID NO: 1037414 - DNA, 22 bp, Artificial Sequence
  chemically synthesized
tgcgtggtggcatgcgcttgta

SEQ ID NO: 1037415 - DNA, 22 bp, Artificial Sequence
  chemically synthesized
ggactacaagcgcatgccacca

SEQ ID NO: 1037416 - DNA, 22 bp, Artificial Sequence
  chemically synthesized
caagcgcatgccaccacgcaca

SEQ ID NO: 1037417 - DNA, 22 bp, Artificial Sequence
  chemically synthesized
aaaatacaaaaatgacctgtgc

SEQ ID NO: 1037418 - DNA, 22 bp, Artificial Sequence
  chemically synthesized
cattaaaaatacaaaaatgacc

SEQ ID NO: 1037419 - DNA, 22 bp, Artificial Sequence
  chemically synthesized
tctccattaaaaatacaaaaat

SEQ ID NO: 1037420 - DNA, 22 bp, Artificial Sequence
  chemically synthesized
gtctccattaaaaatacaaaaa

SEQ ID NO: 1037421 - DNA, 22 bp, Artificial Sequence
  chemically synthesized
ttgtatttttaatggagacaag

SEQ ID NO: 1037422 - DNA, 22 bp, Artificial Sequence
  chemically synthesized
tgtatttttaatggagacaagg

SEQ ID NO: 1037423 - DNA, 22 bp, Artificial Sequence
  chemically synthesized
gtatttttaatggagacaaggt

SEQ ID NO: 1037424 - DNA, 22 bp, Artificial Sequence
  chemically synthesized
tatttttaatggagacaaggtt

SEQ ID NO: 1037425 - DNA, 22 bp, Artificial Sequence
  chemically synthesized
gccaacatggtgaaaccttgtc

SEQ ID NO: 1037426 - DNA, 22 bp, Artificial Sequence
  chemically synthesized
ttaatggagacaaggtttcacc

SEQ ID NO: 1037427 - DNA, 22 bp, Artificial Sequence
  chemically synthesized
taatggagacaaggtttcacca

SEQ ID NO: 1037428 - DNA, 22 bp, Artificial Sequence
  chemically synthesized
aatggagacaaggtttcaccat

SEQ ID NO: 1037429 - DNA, 22 bp, Artificial Sequence
  chemically synthesized
atggagacaaggtttcaccatg

SEQ ID NO: 1037430 - DNA, 22 bp, Artificial Sequence
  chemically synthesized
caccatgttggccaggctggtc

SEQ ID NO: 1037431 - DNA, 22 bp, Artificial Sequence
  chemically synthesized
accatgttggccaggctggtct

SEQ ID NO: 1037432 - DNA, 22 bp, Artificial Sequence
  chemically synthesized
aggtcaggagtccgagaccagc

SEQ ID NO: 1037433 - DNA, 22 bp, Artificial Sequence
  chemically synthesized
gaggtcaggagtccgagaccag

SEQ ID NO: 1037434 - DNA, 22 bp, Artificial Sequence
  chemically synthesized
gccaggctggtctcggactcct

SEQ ID NO: 1037435 - DNA, 22 bp, Artificial Sequence
  chemically synthesized
gtctcggactcctgacctcaaa

SEQ ID NO: 1037436 - DNA, 22 bp, Artificial Sequence
  chemically synthesized
ggactcctgacctcaaatgatg

SEQ ID NO: 1037437 - DNA, 22 bp, Artificial Sequence
  chemically synthesized
ggagtccaaggcgggcacatca

SEQ ID NO: 1037438 - DNA, 22 bp, Artificial Sequence
  chemically synthesized
ctgacctcaaatgatgtgcccg

SEQ ID NO: 1037439 - DNA, 22 bp, Artificial Sequence
  chemically synthesized
gggagtccaaggcgggcacatc

SEQ ID NO: 1037440 - DNA, 22 bp, Artificial Sequence
  chemically synthesized
tgggagtccaaggcgggcacat

SEQ ID NO: 1037441 - DNA, 22 bp, Artificial Sequence
  chemically synthesized
acctcaaatgatgtgcccgcct

SEQ ID NO: 1037442 - DNA, 22 bp, Artificial Sequence
  chemically synthesized
aaatgatgtgcccgccttggac

SEQ ID NO: 1037443 - DNA, 22 bp, Artificial Sequence
  chemically synthesized
taatcccagcactttgggagtc

SEQ ID NO: 1037444 - DNA, 22 bp, Artificial Sequence
  chemically synthesized
atgtctgtaatcccagcacttt

SEQ ID NO: 1037445 - DNA, 22 bp, Artificial Sequence
  chemically synthesized
ggactcccaaagtgctgggatt

SEQ ID NO: 1037446 - DNA, 22 bp, Artificial Sequence
  chemically synthesized
gactcccaaagtgctgggatta

SEQ ID NO: 1037447 - DNA, 22 bp, Artificial Sequence
  chemically synthesized
ccaaagtgctgggattacagac

SEQ ID NO: 1037448 - DNA, 22 bp, Artificial Sequence
  chemically synthesized
cagggcaggtgcggtggctcat

SEQ ID NO: 1037449 - DNA, 22 bp, Artificial Sequence
  chemically synthesized
ggattacagacatgagccaccg

SEQ ID NO: 1037450 - DNA, 22 bp, Artificial Sequence
  chemically synthesized
ccagggcaggtgcggtggctca

SEQ ID NO: 1037451 - DNA, 22 bp, Artificial Sequence
  chemically synthesized
cagacatgagccaccgcacctg

SEQ ID NO: 1037452 - DNA, 22 bp, Artificial Sequence
  chemically synthesized
caccttccagggcaggtgcggt

SEQ ID NO: 1037453 - DNA, 22 bp, Artificial Sequence
  chemically synthesized
actgcaccttccagggcaggtg

SEQ ID NO: 1037454 - DNA, 22 bp, Artificial Sequence
  chemically synthesized
tctcactgcaccttccagggca

SEQ ID NO: 1037455 - DNA, 22 bp, Artificial Sequence
  chemically synthesized
atctcactgcaccttccagggc

SEQ ID NO: 1037456 - DNA, 22 bp, Artificial Sequence
  chemically synthesized
ccagatttatctcactgcacct

SEQ ID NO: 1037457 - DNA, 22 bp, Artificial Sequence
  chemically synthesized
ccctggaaggtgcagtgagata

SEQ ID NO: 1037458 - DNA, 22 bp, Artificial Sequence
  chemically synthesized
gatagtctaccagatttatctc

SEQ ID NO: 1037459 - DNA, 22 bp, Artificial Sequence
  chemically synthesized
gaaggtgcagtgagataaatct

SEQ ID NO: 1037460 - DNA, 22 bp, Artificial Sequence
  chemically synthesized
ggatagtctaccagatttatct

SEQ ID NO: 1037461 - DNA, 22 bp, Artificial Sequence
  chemically synthesized
tggatagtctaccagatttatc

SEQ ID NO: 1037462 - DNA, 22 bp, Artificial Sequence
  chemically synthesized
ccctttggatagtctaccagat

SEQ ID NO: 1037463 - DNA, 22 bp, Artificial Sequence
  chemically synthesized
cccctttggatagtctaccaga

SEQ ID NO: 1037464 - DNA, 22 bp, Artificial Sequence
  chemically synthesized
agaatatttcccctttggatag

SEQ ID NO: 1037465 - DNA, 22 bp, Artificial Sequence
  chemically synthesized
gtagactatccaaaggggaaat

SEQ ID NO: 1037466 - DNA, 22 bp, Artificial Sequence
  chemically synthesized
cgaaacctgagaatatttcccc

SEQ ID NO: 1037467 - DNA, 22 bp, Artificial Sequence
  chemically synthesized
tccgaaacctgagaatatttcc

SEQ ID NO: 1037468 - DNA, 22 bp, Artificial Sequence
  chemically synthesized
ctctccgaaacctgagaatatt

SEQ ID NO: 1037469 - DNA, 22 bp, Artificial Sequence
  chemically synthesized
tccaaaggggaaatattctcag

SEQ ID NO: 1037470 - DNA, 22 bp, Artificial Sequence
  chemically synthesized
aagcctcctctccgaaacctga

SEQ ID NO: 1037471 - DNA, 22 bp, Artificial Sequence
  chemically synthesized
gactcaagcctcctctccgaaa

SEQ ID NO: 1037472 - DNA, 22 bp, Artificial Sequence
  chemically synthesized
tcaggtttcggagaggaggctt

SEQ ID NO: 1037473 - DNA, 22 bp, Artificial Sequence
  chemically synthesized
aggtttcggagaggaggcttga

SEQ ID NO: 1037474 - DNA, 22 bp, Artificial Sequence
  chemically synthesized
aatgtgtctggactcaagcctc

SEQ ID NO: 1037475 - DNA, 22 bp, Artificial Sequence
  chemically synthesized
cggagaggaggcttgagtccag

SEQ ID NO: 1037476 - DNA, 22 bp, Artificial Sequence
  chemically synthesized
ggagaggaggcttgagtccaga

SEQ ID NO: 1037477 - DNA, 22 bp, Artificial Sequence
  chemically synthesized
agcacaaagtgggtgttcaatg

SEQ ID NO: 1037478 - DNA, 22 bp, Artificial Sequence
  chemically synthesized
gagtccagacacattgaacacc

SEQ ID NO: 1037479 - DNA, 22 bp, Artificial Sequence
  chemically synthesized
agtccagacacattgaacaccc

SEQ ID NO: 1037480 - DNA, 22 bp, Artificial Sequence
  chemically synthesized
atatagtgctgagcacaaagtg

SEQ ID NO: 1037481 - DNA, 22 bp, Artificial Sequence
  chemically synthesized
aacacccactttgtgctcagca

SEQ ID NO: 1037482 - DNA, 22 bp, Artificial Sequence
  chemically synthesized
aggactgatatagtgctgagca

SEQ ID NO: 1037483 - DNA, 22 bp, Artificial Sequence
  chemically synthesized
tatgctcaggactgatatagtg

SEQ ID NO: 1037484 - DNA, 22 bp, Artificial Sequence
  chemically synthesized
tgtgctcagcactatatcagtc

SEQ ID NO: 1037485 - DNA, 22 bp, Artificial Sequence
  chemically synthesized
gtgctcagcactatatcagtcc

SEQ ID NO: 1037486 - DNA, 22 bp, Artificial Sequence
  chemically synthesized
tgctcagcactatatcagtcct

SEQ ID NO: 1037487 - DNA, 22 bp, Artificial Sequence
  chemically synthesized
tgttatatgctcaggactgata

SEQ ID NO: 1037488 - DNA, 22 bp, Artificial Sequence
  chemically synthesized
gtgttatatgctcaggactgat

SEQ ID NO: 1037489 - DNA, 22 bp, Artificial Sequence
  chemically synthesized
tttgtgttatatgctcaggact

SEQ ID NO: 1037490 - DNA, 22 bp, Artificial Sequence
  chemically synthesized
agcactatatcagtcctgagca

SEQ ID NO: 1037491 - DNA, 22 bp, Artificial Sequence
  chemically synthesized
atttgtgttatatgctcaggac

SEQ ID NO: 1037492 - DNA, 22 bp, Artificial Sequence
  chemically synthesized
tatttgtgttatatgctcagga

SEQ ID NO: 1037493 - DNA, 22 bp, Artificial Sequence
  chemically synthesized
tgttttatttgtgttatatgct

SEQ ID NO: 1037494 - DNA, 22 bp, Artificial Sequence
  chemically synthesized
tatcagtcctgagcatataaca

SEQ ID NO: 1037495 - DNA, 22 bp, Artificial Sequence
  chemically synthesized
agcatataacacaaataaaaca

SEQ ID NO: 1037496 - DNA, 22 bp, Artificial Sequence
  chemically synthesized
tagaaaagggctatgttttatt

SEQ ID NO: 1037497 - DNA, 22 bp, Artificial Sequence
  chemically synthesized
atagaaaagggctatgttttat

SEQ ID NO: 1037498 - DNA, 22 bp, Artificial Sequence
  chemically synthesized
cttatagaaaagggctatgttt

SEQ ID NO: 1037499 - DNA, 22 bp, Artificial Sequence
  chemically synthesized
ccacacaagctccttatagaaa

SEQ ID NO: 1037500 - DNA, 22 bp, Artificial Sequence
  chemically synthesized
cctcccacacaagctccttata

SEQ ID NO: 1037501 - DNA, 22 bp, Artificial Sequence
  chemically synthesized
tgcctcccacacaagctcctta

SEQ ID NO: 1037502 - DNA, 22 bp, Artificial Sequence
  chemically synthesized
ctgcctcccacacaagctcctt

SEQ ID NO: 1037503 - DNA, 22 bp, Artificial Sequence
  chemically synthesized
tctgcctcccacacaagctcct

SEQ ID NO: 1037504 - DNA, 22 bp, Artificial Sequence
  chemically synthesized
ttctgcctcccacacaagctcc

SEQ ID NO: 1037505 - DNA, 22 bp, Artificial Sequence
  chemically synthesized
cttttctgcctcccacacaagc

SEQ ID NO: 1037506 - DNA, 22 bp, Artificial Sequence
  chemically synthesized
ttctataaggagcttgtgtggg

SEQ ID NO: 1037507 - DNA, 22 bp, Artificial Sequence
  chemically synthesized
acttttctgcctcccacacaag

SEQ ID NO: 1037508 - DNA, 22 bp, Artificial Sequence
  chemically synthesized
tctataaggagcttgtgtggga

SEQ ID NO: 1037509 - DNA, 22 bp, Artificial Sequence
  chemically synthesized
ctataaggagcttgtgtgggag

SEQ ID NO: 1037510 - DNA, 22 bp, Artificial Sequence
  chemically synthesized
tataaggagcttgtgtgggagg

SEQ ID NO: 1037511 - DNA, 22 bp, Artificial Sequence
  chemically synthesized
tttacttttctgcctcccacac

SEQ ID NO: 1037512 - DNA, 22 bp, Artificial Sequence
  chemically synthesized
gtttacttttctgcctcccaca

SEQ ID NO: 1037513 - DNA, 22 bp, Artificial Sequence
  chemically synthesized
taaggagcttgtgtgggaggca

SEQ ID NO: 1037514 - DNA, 22 bp, Artificial Sequence
  chemically synthesized
gtgtgggaggcagaaaagtaaa

SEQ ID NO: 1037515 - DNA, 22 bp, Artificial Sequence
  chemically synthesized
tgtgggaggcagaaaagtaaac

SEQ ID NO: 1037516 - DNA, 22 bp, Artificial Sequence
  chemically synthesized
acacatagtaatcaatttgttt

SEQ ID NO: 1037517 - DNA, 22 bp, Artificial Sequence
  chemically synthesized
aaacctaacacatagtaatcaa

SEQ ID NO: 1037518 - DNA, 22 bp, Artificial Sequence
  chemically synthesized
ctaaaacctaacacatagtaat

SEQ ID NO: 1037519 - DNA, 22 bp, Artificial Sequence
  chemically synthesized
ctcctaaaacctaacacatagt

SEQ ID NO: 1037520 - DNA, 22 bp, Artificial Sequence
  chemically synthesized
attactatgtgttaggttttag

SEQ ID NO: 1037521 - DNA, 22 bp, Artificial Sequence
  chemically synthesized
atgtgcctgctcctaaaaccta

SEQ ID NO: 1037522 - DNA, 22 bp, Artificial Sequence
  chemically synthesized
ctatgtgttaggttttaggagc

SEQ ID NO: 1037523 - DNA, 22 bp, Artificial Sequence
  chemically synthesized
tgtgttaggttttaggagcagg

SEQ ID NO: 1037524 - DNA, 22 bp, Artificial Sequence
  chemically synthesized
ggttttaggagcaggcacatca

SEQ ID NO: 1037525 - DNA, 22 bp, Artificial Sequence
  chemically synthesized
taggagcaggcacatcagatca

SEQ ID NO: 1037526 - DNA, 22 bp, Artificial Sequence
  chemically synthesized
aggagcaggcacatcagatcat

SEQ ID NO: 1037527 - DNA, 22 bp, Artificial Sequence
  chemically synthesized
ggagcaggcacatcagatcata

SEQ ID NO: 1037528 - DNA, 22 bp, Artificial Sequence
  chemically synthesized
ccgtgtagaatatatgatctga

SEQ ID NO: 1037529 - DNA, 22 bp, Artificial Sequence
  chemically synthesized
gtggctaccgtgtagaatatat

SEQ ID NO: 1037530 - DNA, 22 bp, Artificial Sequence
  chemically synthesized
ggtggctaccgtgtagaatata

SEQ ID NO: 1037531 - DNA, 22 bp, Artificial Sequence
  chemically synthesized
cagacttggtggctaccgtgta

SEQ ID NO: 1037532 - DNA, 22 bp, Artificial Sequence
  chemically synthesized
ccagacttggtggctaccgtgt

SEQ ID NO: 1037533 - DNA, 22 bp, Artificial Sequence
  chemically synthesized
tccagacttggtggctaccgtg

SEQ ID NO: 1037534 - DNA, 22 bp, Artificial Sequence
  chemically synthesized
taaattttccagacttggtggc

SEQ ID NO: 1037535 - DNA, 22 bp, Artificial Sequence
  chemically synthesized
gtaaattttccagacttggtgg

SEQ ID NO: 1037536 - DNA, 22 bp, Artificial Sequence
  chemically synthesized
tacacggtagccaccaagtctg

SEQ ID NO: 1037537 - DNA, 22 bp, Artificial Sequence
  chemically synthesized
cacggtagccaccaagtctgga

SEQ ID NO: 1037538 - DNA, 22 bp, Artificial Sequence
  chemically synthesized
tgcatttgtaaattttccagac

SEQ ID NO: 1037539 - DNA, 22 bp, Artificial Sequence
  chemically synthesized
atgcatttgtaaattttccaga

SEQ ID NO: 1037540 - DNA, 22 bp, Artificial Sequence
  chemically synthesized
gaaaatttacaaatgcataaat

SEQ ID NO: 1037541 - DNA, 22 bp, Artificial Sequence
  chemically synthesized
atatcaataaatcatttatgca

SEQ ID NO: 1037542 - DNA, 22 bp, Artificial Sequence
  chemically synthesized
aatatcaataaatcatttatgc

SEQ ID NO: 1037543 - DNA, 22 bp, Artificial Sequence
  chemically synthesized
acaaatgcataaatgatttatt

SEQ ID NO: 1037544 - DNA, 22 bp, Artificial Sequence
  chemically synthesized
caaatgcataaatgatttattg

SEQ ID NO: 1037545 - DNA, 22 bp, Artificial Sequence
  chemically synthesized
atgtaatttaatatcaataaat

SEQ ID NO: 1037546 - DNA, 22 bp, Artificial Sequence
  chemically synthesized
aatgtaatttaatatcaataaa

SEQ ID NO: 1037547 - DNA, 22 bp, Artificial Sequence
  chemically synthesized
atcatttaatgtaatttaatat

SEQ ID NO: 1037548 - DNA, 22 bp, Artificial Sequence
  chemically synthesized
catcatttaatgtaatttaata

SEQ ID NO: 1037549 - DNA, 22 bp, Artificial Sequence
  chemically synthesized
tttcatcatttaatgtaattta

SEQ ID NO: 1037550 - DNA, 22 bp, Artificial Sequence
  chemically synthesized
attgatattaaattacattaaa

SEQ ID NO: 1037551 - DNA, 22 bp, Artificial Sequence
  chemically synthesized
ttgatattaaattacattaaat

SEQ ID NO: 1037552 - DNA, 22 bp, Artificial Sequence
  chemically synthesized
gatattgtttcatcatttaatg

SEQ ID NO: 1037553 - DNA, 22 bp, Artificial Sequence
  chemically synthesized
atattaaattacattaaatgat

SEQ ID NO: 1037554 - DNA, 22 bp, Artificial Sequence
  chemically synthesized
ggatattgtttcatcatttaat

SEQ ID NO: 1037555 - DNA, 22 bp, Artificial Sequence
  chemically synthesized
aattacattaaatgatgaaaca

SEQ ID NO: 1037556 - DNA, 22 bp, Artificial Sequence
  chemically synthesized
gaaacttggatattgtttcatc

SEQ ID NO: 1037557 - DNA, 22 bp, Artificial Sequence
  chemically synthesized
cattaaatgatgaaacaatatc

SEQ ID NO: 1037558 - DNA, 22 bp, Artificial Sequence
  chemically synthesized
acatctggaaacttggatattg

SEQ ID NO: 1037559 - DNA, 22 bp, Artificial Sequence
  chemically synthesized
aatgatgaaacaatatccaagt

SEQ ID NO: 1037560 - DNA, 22 bp, Artificial Sequence
  chemically synthesized
ctaacatctggaaacttggata

SEQ ID NO: 1037561 - DNA, 22 bp, Artificial Sequence
  chemically synthesized
gtcgctcctaacatctggaaac

SEQ ID NO: 1037562 - DNA, 22 bp, Artificial Sequence
  chemically synthesized
ttagtcgctcctaacatctgga

SEQ ID NO: 1037563 - DNA, 22 bp, Artificial Sequence
  chemically synthesized
aaactattagtcgctcctaaca

SEQ ID NO: 1037564 - DNA, 22 bp, Artificial Sequence
  chemically synthesized
ccagatgttaggagcgactaat

SEQ ID NO: 1037565 - DNA, 22 bp, Artificial Sequence
  chemically synthesized
cagatgttaggagcgactaata

SEQ ID NO: 1037566 - DNA, 22 bp, Artificial Sequence
  chemically synthesized
gaaatcctaaaactattagtcg

SEQ ID NO: 1037567 - DNA, 22 bp, Artificial Sequence
  chemically synthesized
tagaaatcctaaaactattagt

SEQ ID NO: 1037568 - DNA, 22 bp, Artificial Sequence
  chemically synthesized
ctagaaatcctaaaactattag

SEQ ID NO: 1037569 - DNA, 22 bp, Artificial Sequence
  chemically synthesized
tctagaaatcctaaaactatta

SEQ ID NO: 1037570 - DNA, 22 bp, Artificial Sequence
  chemically synthesized
ttctagaaatcctaaaactatt

SEQ ID NO: 1037571 - DNA, 22 bp, Artificial Sequence
  chemically synthesized
tttctagaaatcctaaaactat

SEQ ID NO: 1037572 - DNA, 22 bp, Artificial Sequence
  chemically synthesized
ggagcgactaatagttttagga

SEQ ID NO: 1037573 - DNA, 22 bp, Artificial Sequence
  chemically synthesized
tctttttctagaaatcctaaaa

SEQ ID NO: 1037574 - DNA, 22 bp, Artificial Sequence
  chemically synthesized
atagttttaggatttctagaaa

SEQ ID NO: 1037575 - DNA, 22 bp, Artificial Sequence
  chemically synthesized
agatgttgtctttttctagaaa

SEQ ID NO: 1037576 - DNA, 22 bp, Artificial Sequence
  chemically synthesized
cagatgttgtctttttctagaa

SEQ ID NO: 1037577 - DNA, 22 bp, Artificial Sequence
  chemically synthesized
acttcagatgttgtctttttct

SEQ ID NO: 1037578 - DNA, 22 bp, Artificial Sequence
  chemically synthesized
taggatttctagaaaaagacaa

SEQ ID NO: 1037579 - DNA, 22 bp, Artificial Sequence
  chemically synthesized
aggatttctagaaaaagacaac

SEQ ID NO: 1037580 - DNA, 22 bp, Artificial Sequence
  chemically synthesized
ggatttctagaaaaagacaaca

SEQ ID NO: 1037581 - DNA, 22 bp, Artificial Sequence
  chemically synthesized
aggtctcacttcagatgttgtc

SEQ ID NO: 1037582 - DNA, 22 bp, Artificial Sequence
  chemically synthesized
caggtctcacttcagatgttgt

SEQ ID NO: 1037583 - DNA, 22 bp, Artificial Sequence
  chemically synthesized
ctagaaaaagacaacatctgaa

SEQ ID NO: 1037584 - DNA, 22 bp, Artificial Sequence
  chemically synthesized
ttcaggtctcacttcagatgtt

SEQ ID NO: 1037585 - DNA, 22 bp, Artificial Sequence
  chemically synthesized
tagaaaaagacaacatctgaag

SEQ ID NO: 1037586 - DNA, 22 bp, Artificial Sequence
  chemically synthesized
gaaaaagacaacatctgaagtg

SEQ ID NO: 1037587 - DNA, 22 bp, Artificial Sequence
  chemically synthesized
ttcttcaggtctcacttcagat

SEQ ID NO: 1037588 - DNA, 22 bp, Artificial Sequence
  chemically synthesized
cctgttcttcaggtctcacttc

SEQ ID NO: 1037589 - DNA, 22 bp, Artificial Sequence
  chemically synthesized
acctgcctgttcttcaggtctc

SEQ ID NO: 1037590 - DNA, 22 bp, Artificial Sequence
  chemically synthesized
tgacctgcctgttcttcaggtc

SEQ ID NO: 1037591 - DNA, 22 bp, Artificial Sequence
  chemically synthesized
cctctgacctgcctgttcttca

SEQ ID NO: 1037592 - DNA, 22 bp, Artificial Sequence
  chemically synthesized
aagtgagacctgaagaacaggc

SEQ ID NO: 1037593 - DNA, 22 bp, Artificial Sequence
  chemically synthesized
tactccctctgacctgcctgtt

SEQ ID NO: 1037594 - DNA, 22 bp, Artificial Sequence
  chemically synthesized
gtactccctctgacctgcctgt

SEQ ID NO: 1037595 - DNA, 22 bp, Artificial Sequence
  chemically synthesized
tgtactccctctgacctgcctg

SEQ ID NO: 1037596 - DNA, 22 bp, Artificial Sequence
  chemically synthesized
aagaacaggcaggtcagaggga

SEQ ID NO: 1037597 - DNA, 22 bp, Artificial Sequence
  chemically synthesized
cagatgcccaagtgttttgtac

SEQ ID NO: 1037598 - DNA, 22 bp, Artificial Sequence
  chemically synthesized
gcagatgcccaagtgttttgta

SEQ ID NO: 1037599 - DNA, 22 bp, Artificial Sequence
  chemically synthesized
aatcaatttgcagatgcccaag

SEQ ID NO: 1037600 - DNA, 22 bp, Artificial Sequence
  chemically synthesized
gcgatattaaatcaatttgcag

SEQ ID NO: 1037601 - DNA, 22 bp, Artificial Sequence
  chemically synthesized
tagcgatattaaatcaatttgc

SEQ ID NO: 1037602 - DNA, 22 bp, Artificial Sequence
  chemically synthesized
gggcatctgcaaattgatttaa

SEQ ID NO: 1037603 - DNA, 22 bp, Artificial Sequence
  chemically synthesized
ggcatctgcaaattgatttaat

SEQ ID NO: 1037604 - DNA, 22 bp, Artificial Sequence
  chemically synthesized
tgttctagcgatattaaatcaa

SEQ ID NO: 1037605 - DNA, 22 bp, Artificial Sequence
  chemically synthesized
caattatgttctagcgatatta

SEQ ID NO: 1037606 - DNA, 22 bp, Artificial Sequence
  chemically synthesized
caaattgatttaatatcgctag

SEQ ID NO: 1037607 - DNA, 22 bp, Artificial Sequence
  chemically synthesized
atttaatatcgctagaacataa

SEQ ID NO: 1037608 - DNA, 22 bp, Artificial Sequence
  chemically synthesized
aatatcgctagaacataattgg

SEQ ID NO: 1037609 - DNA, 22 bp, Artificial Sequence
  chemically synthesized
tagcaagcccctccaattatgt

SEQ ID NO: 1037610 - DNA, 22 bp, Artificial Sequence
  chemically synthesized
atatcgctagaacataattgga

SEQ ID NO: 1037611 - DNA, 22 bp, Artificial Sequence
  chemically synthesized
ccctatagcaagcccctccaat

SEQ ID NO: 1037612 - DNA, 22 bp, Artificial Sequence
  chemically synthesized
gaacataattggaggggcttgc

SEQ ID NO: 1037613 - DNA, 22 bp, Artificial Sequence
  chemically synthesized
gtgcctgccctatagcaagccc

SEQ ID NO: 1037614 - DNA, 22 bp, Artificial Sequence
  chemically synthesized
cgtgcctgccctatagcaagcc

SEQ ID NO: 1037615 - DNA, 22 bp, Artificial Sequence
  chemically synthesized
ttcgtgcctgccctatagcaag

SEQ ID NO: 1037616 - DNA, 22 bp, Artificial Sequence
  chemically synthesized
cttcgtgcctgccctatagcaa

SEQ ID NO: 1037617 - DNA, 22 bp, Artificial Sequence
  chemically synthesized
tttcttcgtgcctgccctatag

SEQ ID NO: 1037618 - DNA, 22 bp, Artificial Sequence
  chemically synthesized
atttcttcgtgcctgccctata

SEQ ID NO: 1037619 - DNA, 22 bp, Artificial Sequence
  chemically synthesized
gaggggcttgctatagggcagg

SEQ ID NO: 1037620 - DNA, 22 bp, Artificial Sequence
  chemically synthesized
cttatttcttcgtgcctgccct

SEQ ID NO: 1037621 - DNA, 22 bp, Artificial Sequence
  chemically synthesized
actgcttatttcttcgtgcctg

SEQ ID NO: 1037622 - DNA, 22 bp, Artificial Sequence
  chemically synthesized
gctatagggcaggcacgaagaa

SEQ ID NO: 1037623 - DNA, 22 bp, Artificial Sequence
  chemically synthesized
ctatagggcaggcacgaagaaa

SEQ ID NO: 1037624 - DNA, 22 bp, Artificial Sequence
  chemically synthesized
tagggcaggcacgaagaaataa

SEQ ID NO: 1037625 - DNA, 22 bp, Artificial Sequence
  chemically synthesized
gtcagcctcactgcttatttct

SEQ ID NO: 1037626 - DNA, 22 bp, Artificial Sequence
  chemically synthesized
tctggtcagcctcactgcttat

SEQ ID NO: 1037627 - DNA, 22 bp, Artificial Sequence
  chemically synthesized
tgcaaaattatctggtcagcct

SEQ ID NO: 1037628 - DNA, 22 bp, Artificial Sequence
  chemically synthesized
attgtgcaaaattatctggtca

SEQ ID NO: 1037629 - DNA, 22 bp, Artificial Sequence
  chemically synthesized
aattgtgcaaaattatctggtc

SEQ ID NO: 1037630 - DNA, 22 bp, Artificial Sequence
  chemically synthesized
cttaattgtgcaaaattatctg

SEQ ID NO: 1037631 - DNA, 22 bp, Artificial Sequence
  chemically synthesized
actccttaattgtgcaaaatta

SEQ ID NO: 1037632 - DNA, 22 bp, Artificial Sequence
  chemically synthesized
accagataattttgcacaatta

SEQ ID NO: 1037633 - DNA, 22 bp, Artificial Sequence
  chemically synthesized
agaatgaaaccctgactcctta

SEQ ID NO: 1037634 - DNA, 22 bp, Artificial Sequence
  chemically synthesized
gagaatgaaaccctgactcctt

SEQ ID NO: 1037635 - DNA, 22 bp, Artificial Sequence
  chemically synthesized
tgcacaattaaggagtcagggt

SEQ ID NO: 1037636 - DNA, 22 bp, Artificial Sequence
  chemically synthesized
gcacaattaaggagtcagggtt

SEQ ID NO: 1037637 - DNA, 22 bp, Artificial Sequence
  chemically synthesized
ccttgagaatgaaaccctgact

SEQ ID NO: 1037638 - DNA, 22 bp, Artificial Sequence
  chemically synthesized
cacaattaaggagtcagggttt

SEQ ID NO: 1037639 - DNA, 22 bp, Artificial Sequence
  chemically synthesized
attcccttgagaatgaaaccct

SEQ ID NO: 1037640 - DNA, 22 bp, Artificial Sequence
  chemically synthesized
aggagtcagggtttcattctca

SEQ ID NO: 1037641 - DNA, 22 bp, Artificial Sequence
  chemically synthesized
taatctcattcccttgagaatg

SEQ ID NO: 1037642 - DNA, 22 bp, Artificial Sequence
  chemically synthesized
gtactataatctcattcccttg

SEQ ID NO: 1037643 - DNA, 22 bp, Artificial Sequence
  chemically synthesized
ggtactataatctcattccctt

SEQ ID NO: 1037644 - DNA, 22 bp, Artificial Sequence
  chemically synthesized
tggtactataatctcattccct

SEQ ID NO: 1037645 - DNA, 22 bp, Artificial Sequence
  chemically synthesized
cattctcaagggaatgagatta

SEQ ID NO: 1037646 - DNA, 22 bp, Artificial Sequence
  chemically synthesized
attctcaagggaatgagattat

SEQ ID NO: 1037647 - DNA, 22 bp, Artificial Sequence
  chemically synthesized
tcaagggaatgagattatagta

SEQ ID NO: 1037648 - DNA, 22 bp, Artificial Sequence
  chemically synthesized
aagggaatgagattatagtacc

SEQ ID NO: 1037649 - DNA, 22 bp, Artificial Sequence
  chemically synthesized
aagtgtaagagctttggtacta

SEQ ID NO: 1037650 - DNA, 22 bp, Artificial Sequence
  chemically synthesized
taaagtgtaagagctttggtac

SEQ ID NO: 1037651 - DNA, 22 bp, Artificial Sequence
  chemically synthesized
ctaaagtgtaagagctttggta

SEQ ID NO: 1037652 - DNA, 22 bp, Artificial Sequence
  chemically synthesized
tctaaagtgtaagagctttggt

SEQ ID NO: 1037653 - DNA, 22 bp, Artificial Sequence
  chemically synthesized
ttctaaagtgtaagagctttgg

SEQ ID NO: 1037654 - DNA, 22 bp, Artificial Sequence
  chemically synthesized
tagtaccaaagctcttacactt

SEQ ID NO: 1037655 - DNA, 22 bp, Artificial Sequence
  chemically synthesized
agtggccgtcatttttctaaag

SEQ ID NO: 1037656 - DNA, 22 bp, Artificial Sequence
  chemically synthesized
cagtggccgtcatttttctaaa

SEQ ID NO: 1037657 - DNA, 22 bp, Artificial Sequence
  chemically synthesized
tcagtggccgtcatttttctaa

SEQ ID NO: 1037658 - DNA, 22 bp, Artificial Sequence
  chemically synthesized
ttacactttagaaaaatgacgg

SEQ ID NO: 1037659 - DNA, 22 bp, Artificial Sequence
  chemically synthesized
acactttagaaaaatgacggcc

SEQ ID NO: 1037660 - DNA, 22 bp, Artificial Sequence
  chemically synthesized
cactttagaaaaatgacggcca

SEQ ID NO: 1037661 - DNA, 22 bp, Artificial Sequence
  chemically synthesized
aacgatctttcagtggccgtca

SEQ ID NO: 1037662 - DNA, 22 bp, Artificial Sequence
  chemically synthesized
tcaacgatctttcagtggccgt

SEQ ID NO: 1037663 - DNA, 22 bp, Artificial Sequence
  chemically synthesized
tagaaaaatgacggccactgaa

SEQ ID NO: 1037664 - DNA, 22 bp, Artificial Sequence
  chemically synthesized
agaaaaatgacggccactgaaa

SEQ ID NO: 1037665 - DNA, 22 bp, Artificial Sequence
  chemically synthesized
ttctcaacgatctttcagtggc

SEQ ID NO: 1037666 - DNA, 22 bp, Artificial Sequence
  chemically synthesized
gaaaaatgacggccactgaaag

SEQ ID NO: 1037667 - DNA, 22 bp, Artificial Sequence
  chemically synthesized
gttctcaacgatctttcagtgg

SEQ ID NO: 1037668 - DNA, 22 bp, Artificial Sequence
  chemically synthesized
tgttctcaacgatctttcagtg

SEQ ID NO: 1037669 - DNA, 22 bp, Artificial Sequence
  chemically synthesized
cactttgttctcaacgatcttt

SEQ ID NO: 1037670 - DNA, 22 bp, Artificial Sequence
  chemically synthesized
tctccactttgttctcaacgat

SEQ ID NO: 1037671 - DNA, 22 bp, Artificial Sequence
  chemically synthesized
aaagatcgttgagaacaaagtg

SEQ ID NO: 1037672 - DNA, 22 bp, Artificial Sequence
  chemically synthesized
aagtgattatctccactttgtt

SEQ ID NO: 1037673 - DNA, 22 bp, Artificial Sequence
  chemically synthesized
tctcaagtgattatctccactt

SEQ ID NO: 1037674 - DNA, 22 bp, Artificial Sequence
  chemically synthesized
agttgtctcaagtgattatctc

SEQ ID NO: 1037675 - DNA, 22 bp, Artificial Sequence
  chemically synthesized
agaacaaagtggagataatcac

SEQ ID NO: 1037676 - DNA, 22 bp, Artificial Sequence
  chemically synthesized
atctcagttgtctcaagtgatt

SEQ ID NO: 1037677 - DNA, 22 bp, Artificial Sequence
  chemically synthesized
gcattaatctcagttgtctcaa

SEQ ID NO: 1037678 - DNA, 22 bp, Artificial Sequence
  chemically synthesized
tagcattaatctcagttgtctc

SEQ ID NO: 1037679 - DNA, 22 bp, Artificial Sequence
  chemically synthesized
ctagcattaatctcagttgtct

SEQ ID NO: 1037680 - DNA, 22 bp, Artificial Sequence
  chemically synthesized
gagacaactgagattaatgcta

SEQ ID NO: 1037681 - DNA, 22 bp, Artificial Sequence
  chemically synthesized
aagagagatttctagcattaat

SEQ ID NO: 1037682 - DNA, 22 bp, Artificial Sequence
  chemically synthesized
agacaactgagattaatgctag

SEQ ID NO: 1037683 - DNA, 22 bp, Artificial Sequence
  chemically synthesized
agattaatgctagaaatctctc

SEQ ID NO: 1037684 - DNA, 22 bp, Artificial Sequence
  chemically synthesized
catcaggcacctaaagagagat

SEQ ID NO: 1037685 - DNA, 22 bp, Artificial Sequence
  chemically synthesized
atgctagaaatctctctttagg

SEQ ID NO: 1037686 - DNA, 22 bp, Artificial Sequence
  chemically synthesized
ctacatcaggcacctaaagaga

SEQ ID NO: 1037687 - DNA, 22 bp, Artificial Sequence
  chemically synthesized
actacatcaggcacctaaagag

SEQ ID NO: 1037688 - DNA, 22 bp, Artificial Sequence
  chemically synthesized
gtttactacatcaggcacctaa

SEQ ID NO: 1037689 - DNA, 22 bp, Artificial Sequence
  chemically synthesized
gaaatctctctttaggtgcctg

SEQ ID NO: 1037690 - DNA, 22 bp, Artificial Sequence
  chemically synthesized
ggtttactacatcaggcaccta

SEQ ID NO: 1037691 - DNA, 22 bp, Artificial Sequence
  chemically synthesized
ttggtttactacatcaggcacc

SEQ ID NO: 1037692 - DNA, 22 bp, Artificial Sequence
  chemically synthesized
gttcttggtttactacatcagg

SEQ ID NO: 1037693 - DNA, 22 bp, Artificial Sequence
  chemically synthesized
agttcttggtttactacatcag

SEQ ID NO: 1037694 - DNA, 22 bp, Artificial Sequence
  chemically synthesized
tctttaggtgcctgatgtagta

SEQ ID NO: 1037695 - DNA, 22 bp, Artificial Sequence
  chemically synthesized
tagttcttggtttactacatca

SEQ ID NO: 1037696 - DNA, 22 bp, Artificial Sequence
  chemically synthesized
tttaggtgcctgatgtagtaaa

SEQ ID NO: 1037697 - DNA, 22 bp, Artificial Sequence
  chemically synthesized
ttttagttcttggtttactaca

SEQ ID NO: 1037698 - DNA, 22 bp, Artificial Sequence
  chemically synthesized
taggtgcctgatgtagtaaacc

SEQ ID NO: 1037699 - DNA, 22 bp, Artificial Sequence
  chemically synthesized
aggtgcctgatgtagtaaacca

SEQ ID NO: 1037700 - DNA, 22 bp, Artificial Sequence
  chemically synthesized
ggtgcctgatgtagtaaaccaa

SEQ ID NO: 1037701 - DNA, 22 bp, Artificial Sequence
  chemically synthesized
ctattttagttcttggtttact

SEQ ID NO: 1037702 - DNA, 22 bp, Artificial Sequence
  chemically synthesized
ctcctattttagttcttggttt

SEQ ID NO: 1037703 - DNA, 22 bp, Artificial Sequence
  chemically synthesized
actcctattttagttcttggtt

SEQ ID NO: 1037704 - DNA, 22 bp, Artificial Sequence
  chemically synthesized
tactcctattttagttcttggt

SEQ ID NO: 1037705 - DNA, 22 bp, Artificial Sequence
  chemically synthesized
atgtagtaaaccaagaactaaa

SEQ ID NO: 1037706 - DNA, 22 bp, Artificial Sequence
  chemically synthesized
accatctttactcctattttag

SEQ ID NO: 1037707 - DNA, 22 bp, Artificial Sequence
  chemically synthesized
taaccatctttactcctatttt

SEQ ID NO: 1037708 - DNA, 22 bp, Artificial Sequence
  chemically synthesized
ctaaccatctttactcctattt

SEQ ID NO: 1037709 - DNA, 22 bp, Artificial Sequence
  chemically synthesized
tccatttctaaccatctttact

SEQ ID NO: 1037710 - DNA, 22 bp, Artificial Sequence
  chemically synthesized
aaataggagtaaagatggttag

SEQ ID NO: 1037711 - DNA, 22 bp, Artificial Sequence
  chemically synthesized
catctgtccatttctaaccatc

SEQ ID NO: 1037712 - DNA, 22 bp, Artificial Sequence
  chemically synthesized
acatctgtccatttctaaccat

SEQ ID NO: 1037713 - DNA, 22 bp, Artificial Sequence
  chemically synthesized
ttacatctgtccatttctaacc

SEQ ID NO: 1037714 - DNA, 22 bp, Artificial Sequence
  chemically synthesized
catggtatctcttacatctgtc

SEQ ID NO: 1037715 - DNA, 22 bp, Artificial Sequence
  chemically synthesized
gaaatggacagatgtaagagat

SEQ ID NO: 1037716 - DNA, 22 bp, Artificial Sequence
  chemically synthesized
tagggaacctccatggtatctc

SEQ ID NO: 1037717 - DNA, 22 bp, Artificial Sequence
  chemically synthesized
ataattatagggaacctccatg

SEQ ID NO: 1037718 - DNA, 22 bp, Artificial Sequence
  chemically synthesized
gtctaataattatagggaacct

SEQ ID NO: 1037719 - DNA, 22 bp, Artificial Sequence
  chemically synthesized
cctataattattagacgaatga

SEQ ID NO: 1037720 - DNA, 22 bp, Artificial Sequence
  chemically synthesized
agaggaaatcaaatcattcgtc

SEQ ID NO: 1037721 - DNA, 22 bp, Artificial Sequence
  chemically synthesized
tcagaggaaatcaaatcattcg

SEQ ID NO: 1037722 - DNA, 22 bp, Artificial Sequence
  chemically synthesized
taattattagacgaatgatttg

SEQ ID NO: 1037723 - DNA, 22 bp, Artificial Sequence
  chemically synthesized
ttctcagaggaaatcaaatcat

SEQ ID NO: 1037724 - DNA, 22 bp, Artificial Sequence
  chemically synthesized
ttagacgaatgatttgatttcc

SEQ ID NO: 1037725 - DNA, 22 bp, Artificial Sequence
  chemically synthesized
attattctcagaggaaatcaaa

SEQ ID NO: 1037726 - DNA, 22 bp, Artificial Sequence
  chemically synthesized
aattattctcagaggaaatcaa

SEQ ID NO: 1037727 - DNA, 22 bp, Artificial Sequence
  chemically synthesized
gacgaatgatttgatttcctct

SEQ ID NO: 1037728 - DNA, 22 bp, Artificial Sequence
  chemically synthesized
ttaattattctcagaggaaatc

SEQ ID NO: 1037729 - DNA, 22 bp, Artificial Sequence
  chemically synthesized
cttaattattctcagaggaaat

SEQ ID NO: 1037730 - DNA, 22 bp, Artificial Sequence
  chemically synthesized
gatttcctctgagaataattaa

SEQ ID NO: 1037731 - DNA, 22 bp, Artificial Sequence
  chemically synthesized
aaggtaggcttcttaattattc

SEQ ID NO: 1037732 - DNA, 22 bp, Artificial Sequence
  chemically synthesized
atttcctctgagaataattaag

SEQ ID NO: 1037733 - DNA, 22 bp, Artificial Sequence
  chemically synthesized
cctctgagaataattaagaagc

SEQ ID NO: 1037734 - DNA, 22 bp, Artificial Sequence
  chemically synthesized
tcctcaaggtaggcttcttaat

SEQ ID NO: 1037735 - DNA, 22 bp, Artificial Sequence
  chemically synthesized
ctctgagaataattaagaagcc

SEQ ID NO: 1037736 - DNA, 22 bp, Artificial Sequence
  chemically synthesized
atcctcaaggtaggcttcttaa

SEQ ID NO: 1037737 - DNA, 22 bp, Artificial Sequence
  chemically synthesized
tatcctcaaggtaggcttctta

SEQ ID NO: 1037738 - DNA, 22 bp, Artificial Sequence
  chemically synthesized
tgagaataattaagaagcctac

SEQ ID NO: 1037739 - DNA, 22 bp, Artificial Sequence
  chemically synthesized
agaataattaagaagcctacct

SEQ ID NO: 1037740 - DNA, 22 bp, Artificial Sequence
  chemically synthesized
agaagtctttatcctcaaggta

SEQ ID NO: 1037741 - DNA, 22 bp, Artificial Sequence
  chemically synthesized
cagaagtctttatcctcaaggt

SEQ ID NO: 1037742 - DNA, 22 bp, Artificial Sequence
  chemically synthesized
agaagcctaccttgaggataaa

SEQ ID NO: 1037743 - DNA, 22 bp, Artificial Sequence
  chemically synthesized
atttcagaagtctttatcctca

SEQ ID NO: 1037744 - DNA, 22 bp, Artificial Sequence
  chemically synthesized
ccttgaggataaagacttctga

SEQ ID NO: 1037745 - DNA, 22 bp, Artificial Sequence
  chemically synthesized
aagtgattcatttcagaagtct

SEQ ID NO: 1037746 - DNA, 22 bp, Artificial Sequence
  chemically synthesized
aaagtgattcatttcagaagtc

SEQ ID NO: 1037747 - DNA, 22 bp, Artificial Sequence
  chemically synthesized
gaggataaagacttctgaaatg

SEQ ID NO: 1037748 - DNA, 22 bp, Artificial Sequence
  chemically synthesized
aggataaagacttctgaaatga

SEQ ID NO: 1037749 - DNA, 22 bp, Artificial Sequence
  chemically synthesized
acagcttaaagtgattcatttc

SEQ ID NO: 1037750 - DNA, 22 bp, Artificial Sequence
  chemically synthesized
taacagcttaaagtgattcatt

SEQ ID NO: 1037751 - DNA, 22 bp, Artificial Sequence
  chemically synthesized
tctaacagcttaaagtgattca

SEQ ID NO: 1037752 - DNA, 22 bp, Artificial Sequence
  chemically synthesized
ctgaaatgaatcactttaagct

SEQ ID NO: 1037753 - DNA, 22 bp, Artificial Sequence
  chemically synthesized
tgaaatgaatcactttaagctg

SEQ ID NO: 1037754 - DNA, 22 bp, Artificial Sequence
  chemically synthesized
aaatgaatcactttaagctgtt

SEQ ID NO: 1037755 - DNA, 22 bp, Artificial Sequence
  chemically synthesized
aaagtaataaagttctctaaca

SEQ ID NO: 1037756 - DNA, 22 bp, Artificial Sequence
  chemically synthesized
gattaaaagtaataaagttctc

SEQ ID NO: 1037757 - DNA, 22 bp, Artificial Sequence
  chemically synthesized
agattaaaagtaataaagttct

SEQ ID NO: 1037758 - DNA, 22 bp, Artificial Sequence
  chemically synthesized
taagctgttagagaactttatt

SEQ ID NO: 1037759 - DNA, 22 bp, Artificial Sequence
  chemically synthesized
tagattaaaagtaataaagttc

SEQ ID NO: 1037760 - DNA, 22 bp, Artificial Sequence
  chemically synthesized
aagctgttagagaactttatta

SEQ ID NO: 1037761 - DNA, 22 bp, Artificial Sequence
  chemically synthesized
ttagattaaaagtaataaagtt

SEQ ID NO: 1037762 - DNA, 22 bp, Artificial Sequence
  chemically synthesized
agctgttagagaactttattac

SEQ ID NO: 1037763 - DNA, 22 bp, Artificial Sequence
  chemically synthesized
catttttagattaaaagtaata

SEQ ID NO: 1037764 - DNA, 22 bp, Artificial Sequence
  chemically synthesized
ttagagaactttattactttta

SEQ ID NO: 1037765 - DNA, 22 bp, Artificial Sequence
  chemically synthesized
acatttttagattaaaagtaat

SEQ ID NO: 1037766 - DNA, 22 bp, Artificial Sequence
  chemically synthesized
tacatttttagattaaaagtaa

SEQ ID NO: 1037767 - DNA, 22 bp, Artificial Sequence
  chemically synthesized
ttacatttttagattaaaagta

SEQ ID NO: 1037768 - DNA, 22 bp, Artificial Sequence
  chemically synthesized
gagaactttattacttttaatc

SEQ ID NO: 1037769 - DNA, 22 bp, Artificial Sequence
  chemically synthesized
ttttacatttttagattaaaag

SEQ ID NO: 1037770 - DNA, 22 bp, Artificial Sequence
  chemically synthesized
cttttacatttttagattaaaa

SEQ ID NO: 1037771 - DNA, 22 bp, Artificial Sequence
  chemically synthesized
tcttttacatttttagattaaa

SEQ ID NO: 1037772 - DNA, 22 bp, Artificial Sequence
  chemically synthesized
tttcttttacatttttagatta

SEQ ID NO: 1037773 - DNA, 22 bp, Artificial Sequence
  chemically synthesized
tattacttttaatctaaaaatg

SEQ ID NO: 1037774 - DNA, 22 bp, Artificial Sequence
  chemically synthesized
ctctttcttttacatttttaga

SEQ ID NO: 1037775 - DNA, 22 bp, Artificial Sequence
  chemically synthesized
attacttttaatctaaaaatgt

SEQ ID NO: 1037776 - DNA, 22 bp, Artificial Sequence
  chemically synthesized
ttacttttaatctaaaaatgta

SEQ ID NO: 1037777 - DNA, 22 bp, Artificial Sequence
  chemically synthesized
cttttaatctaaaaatgtaaaa

SEQ ID NO: 1037778 - DNA, 22 bp, Artificial Sequence
  chemically synthesized
ttaatctaaaaatgtaaaagaa

SEQ ID NO: 1037779 - DNA, 22 bp, Artificial Sequence
  chemically synthesized
taatctaaaaatgtaaaagaaa

SEQ ID NO: 1037780 - DNA, 22 bp, Artificial Sequence
  chemically synthesized
aatctaaaaatgtaaaagaaag

SEQ ID NO: 1037781 - DNA, 22 bp, Artificial Sequence
  chemically synthesized
atctaaaaatgtaaaagaaaga

SEQ ID NO: 1037782 - DNA, 22 bp, Artificial Sequence
  chemically synthesized
aaaatgtaaaagaaagagtaat

SEQ ID NO: 1037783 - DNA, 22 bp, Artificial Sequence
  chemically synthesized
acatcacaagaagtggattact

SEQ ID NO: 1037784 - DNA, 22 bp, Artificial Sequence
  chemically synthesized
cacatcacaagaagtggattac

SEQ ID NO: 1037785 - DNA, 22 bp, Artificial Sequence
  chemically synthesized
gcttcacatcacaagaagtgga

SEQ ID NO: 1037786 - DNA, 22 bp, Artificial Sequence
  chemically synthesized
agcttcacatcacaagaagtgg

SEQ ID NO: 1037787 - DNA, 22 bp, Artificial Sequence
  chemically synthesized
tttagcttcacatcacaagaag

SEQ ID NO: 1037788 - DNA, 22 bp, Artificial Sequence
  chemically synthesized
cattatttagcttcacatcaca

SEQ ID NO: 1037789 - DNA, 22 bp, Artificial Sequence
  chemically synthesized
aattacattatttagcttcaca

SEQ ID NO: 1037790 - DNA, 22 bp, Artificial Sequence
  chemically synthesized
cttgtgatgtgaagctaaataa

SEQ ID NO: 1037791 - DNA, 22 bp, Artificial Sequence
  chemically synthesized
ttgtgatgtgaagctaaataat

SEQ ID NO: 1037792 - DNA, 22 bp, Artificial Sequence
  chemically synthesized
gtgatgtgaagctaaataatgt

SEQ ID NO: 1037793 - DNA, 22 bp, Artificial Sequence
  chemically synthesized
tgatgtgaagctaaataatgta

SEQ ID NO: 1037794 - DNA, 22 bp, Artificial Sequence
  chemically synthesized
gggggtggcagaaattcaatta

SEQ ID NO: 1037795 - DNA, 22 bp, Artificial Sequence
  chemically synthesized
attggggggtggcagaaattca

SEQ ID NO: 1037796 - DNA, 22 bp, Artificial Sequence
  chemically synthesized
aataatgtaattgaatttctgc

SEQ ID NO: 1037797 - DNA, 22 bp, Artificial Sequence
  chemically synthesized
aattggggggtggcagaaattc

SEQ ID NO: 1037798 - DNA, 22 bp, Artificial Sequence
  chemically synthesized
acttaattggggggtggcagaa

SEQ ID NO: 1037799 - DNA, 22 bp, Artificial Sequence
  chemically synthesized
ttgacttaattggggggtggca

SEQ ID NO: 1037800 - DNA, 22 bp, Artificial Sequence
  chemically synthesized
gctgttgacttaattggggggt

SEQ ID NO: 1037801 - DNA, 22 bp, Artificial Sequence
  chemically synthesized
agctgttgacttaattgggggg

SEQ ID NO: 1037802 - DNA, 22 bp, Artificial Sequence
  chemically synthesized
aatttctgccaccccccaatta

SEQ ID NO: 1037803 - DNA, 22 bp, Artificial Sequence
  chemically synthesized
ctgccaccccccaattaagtca

SEQ ID NO: 1037804 - DNA, 22 bp, Artificial Sequence
  chemically synthesized
tgccaccccccaattaagtcaa

SEQ ID NO: 1037805 - DNA, 22 bp, Artificial Sequence
  chemically synthesized
aaatatttagctgttgacttaa

SEQ ID NO: 1037806 - DNA, 22 bp, Artificial Sequence
  chemically synthesized
ccaccccccaattaagtcaaca

SEQ ID NO: 1037807 - DNA, 22 bp, Artificial Sequence
  chemically synthesized
attgaaatatttagctgttgac

SEQ ID NO: 1037808 - DNA, 22 bp, Artificial Sequence
  chemically synthesized
aattgaaatatttagctgttga

SEQ ID NO: 1037809 - DNA, 22 bp, Artificial Sequence
  chemically synthesized
tcttaattgaaatatttagctg

SEQ ID NO: 1037810 - DNA, 22 bp, Artificial Sequence
  chemically synthesized
atcttaattgaaatatttagct

SEQ ID NO: 1037811 - DNA, 22 bp, Artificial Sequence
  chemically synthesized
tatcttaattgaaatatttagc

SEQ ID NO: 1037812 - DNA, 22 bp, Artificial Sequence
  chemically synthesized
ttatcttaattgaaatatttag

SEQ ID NO: 1037813 - DNA, 22 bp, Artificial Sequence
  chemically synthesized
tttatcttaattgaaatattta

SEQ ID NO: 1037814 - DNA, 22 bp, Artificial Sequence
  chemically synthesized
agtcaacagctaaatatttcaa

SEQ ID NO: 1037815 - DNA, 22 bp, Artificial Sequence
  chemically synthesized
tttttatcttaattgaaatatt

SEQ ID NO: 1037816 - DNA, 22 bp, Artificial Sequence
  chemically synthesized
ctttttatcttaattgaaatat

SEQ ID NO: 1037817 - DNA, 22 bp, Artificial Sequence
  chemically synthesized
aatatttcaattaagataaaaa

SEQ ID NO: 1037818 - DNA, 22 bp, Artificial Sequence
  chemically synthesized
aaatcatgtttctttttatctt

SEQ ID NO: 1037819 - DNA, 22 bp, Artificial Sequence
  chemically synthesized
aaaatcatgtttctttttatct

SEQ ID NO: 1037820 - DNA, 22 bp, Artificial Sequence
  chemically synthesized
atttaaaatcatgtttcttttt

SEQ ID NO: 1037821 - DNA, 22 bp, Artificial Sequence
  chemically synthesized
caattaagataaaaagaaacat

SEQ ID NO: 1037822 - DNA, 22 bp, Artificial Sequence
  chemically synthesized
aattaagataaaaagaaacatg

SEQ ID NO: 1037823 - DNA, 22 bp, Artificial Sequence
  chemically synthesized
agttgatttaaaatcatgtttc

SEQ ID NO: 1037824 - DNA, 22 bp, Artificial Sequence
  chemically synthesized
agataaaaagaaacatgatttt

SEQ ID NO: 1037825 - DNA, 22 bp, Artificial Sequence
  chemically synthesized
ttaagttgatttaaaatcatgt

SEQ ID NO: 1037826 - DNA, 22 bp, Artificial Sequence
  chemically synthesized
gttaagttgatttaaaatcatg

SEQ ID NO: 1037827 - DNA, 22 bp, Artificial Sequence
  chemically synthesized
ccatggggaatttgttaagttg

SEQ ID NO: 1037828 - DNA, 22 bp, Artificial Sequence
  chemically synthesized
gccatggggaatttgttaagtt

SEQ ID NO: 1037829 - DNA, 22 bp, Artificial Sequence
  chemically synthesized
tgccatggggaatttgttaagt

SEQ ID NO: 1037830 - DNA, 22 bp, Artificial Sequence
  chemically synthesized
ttgccatggggaatttgttaag

SEQ ID NO: 1037831 - DNA, 22 bp, Artificial Sequence
  chemically synthesized
tttgccatggggaatttgttaa

SEQ ID NO: 1037832 - DNA, 22 bp, Artificial Sequence
  chemically synthesized
ttttgccatggggaatttgtta

SEQ ID NO: 1037833 - DNA, 22 bp, Artificial Sequence
  chemically synthesized
tttttgccatggggaatttgtt

SEQ ID NO: 1037834 - DNA, 22 bp, Artificial Sequence
  chemically synthesized
taaatcaacttaacaaattccc

SEQ ID NO: 1037835 - DNA, 22 bp, Artificial Sequence
  chemically synthesized
ttttttgccatggggaatttgt

SEQ ID NO: 1037836 - DNA, 22 bp, Artificial Sequence
  chemically synthesized
aaatcaacttaacaaattcccc

SEQ ID NO: 1037837 - DNA, 22 bp, Artificial Sequence
  chemically synthesized
aatcaacttaacaaattcccca

SEQ ID NO: 1037838 - DNA, 22 bp, Artificial Sequence
  chemically synthesized
ccccacatttttttttgccatg

SEQ ID NO: 1037839 - DNA, 22 bp, Artificial Sequence
  chemically synthesized
aacaaattccccatggcaaaaa

SEQ ID NO: 1037840 - DNA, 22 bp, Artificial Sequence
  chemically synthesized
acaaattccccatggcaaaaaa

SEQ ID NO: 1037841 - DNA, 22 bp, Artificial Sequence
  chemically synthesized
ccctcccccacatttttttttg

SEQ ID NO: 1037842 - DNA, 22 bp, Artificial Sequence
  chemically synthesized
cccatggcaaaaaaaaatgtgg

SEQ ID NO: 1037843 - DNA, 22 bp, Artificial Sequence
  chemically synthesized
cattaccctcccccacattttt

SEQ ID NO: 1037844 - DNA, 22 bp, Artificial Sequence
  chemically synthesized
gcattaccctcccccacatttt

SEQ ID NO: 1037845 - DNA, 22 bp, Artificial Sequence
  chemically synthesized
tgcattaccctcccccacattt

SEQ ID NO: 1037846 - DNA, 22 bp, Artificial Sequence
  chemically synthesized
cactttgcattaccctccccca

SEQ ID NO: 1037847 - DNA, 22 bp, Artificial Sequence
  chemically synthesized
acactttgcattaccctccccc

SEQ ID NO: 1037848 - DNA, 22 bp, Artificial Sequence
  chemically synthesized
tacactttgcattaccctcccc

SEQ ID NO: 1037849 - DNA, 22 bp, Artificial Sequence
  chemically synthesized
gagggtgacactttacactttg

SEQ ID NO: 1037850 - DNA, 22 bp, Artificial Sequence
  chemically synthesized
ggagggtgacactttacacttt

SEQ ID NO: 1037851 - DNA, 22 bp, Artificial Sequence
  chemically synthesized
tggagggtgacactttacactt

SEQ ID NO: 1037852 - DNA, 22 bp, Artificial Sequence
  chemically synthesized
tattttggagggtgacacttta

SEQ ID NO: 1037853 - DNA, 22 bp, Artificial Sequence
  chemically synthesized
atattttggagggtgacacttt

SEQ ID NO: 1037854 - DNA, 22 bp, Artificial Sequence
  chemically synthesized
tttatattttggagggtgacac

SEQ ID NO: 1037855 - DNA, 22 bp, Artificial Sequence
  chemically synthesized
atttatattttggagggtgaca

SEQ ID NO: 1037856 - DNA, 22 bp, Artificial Sequence
  chemically synthesized
atttatttatattttggagggt

SEQ ID NO: 1037857 - DNA, 22 bp, Artificial Sequence
  chemically synthesized
catttatttatattttggaggg

SEQ ID NO: 1037858 - DNA, 22 bp, Artificial Sequence
  chemically synthesized
tcatttatttatattttggagg

SEQ ID NO: 1037859 - DNA, 22 bp, Artificial Sequence
  chemically synthesized
attttcatttatttatattttg

SEQ ID NO: 1037860 - DNA, 22 bp, Artificial Sequence
  chemically synthesized
caaaatataaataaatgaaaat

SEQ ID NO: 1037861 - DNA, 22 bp, Artificial Sequence
  chemically synthesized
tcaataaaaaaattgattttca

SEQ ID NO: 1037862 - DNA, 22 bp, Artificial Sequence
  chemically synthesized
cctatcaataaaaaaattgatt

SEQ ID NO: 1037863 - DNA, 22 bp, Artificial Sequence
  chemically synthesized
aaatactacctatcaataaaaa

SEQ ID NO: 1037864 - DNA, 22 bp, Artificial Sequence
  chemically synthesized
aaaatactacctatcaataaaa

SEQ ID NO: 1037865 - DNA, 22 bp, Artificial Sequence
  chemically synthesized
acatgtttaaaatactacctat

SEQ ID NO: 1037866 - DNA, 22 bp, Artificial Sequence
  chemically synthesized
ttttattgataggtagtatttt

SEQ ID NO: 1037867 - DNA, 22 bp, Artificial Sequence
  chemically synthesized
tttattgataggtagtatttta

SEQ ID NO: 1037868 - DNA, 22 bp, Artificial Sequence
  chemically synthesized
gattaacatgtttaaaatacta

SEQ ID NO: 1037869 - DNA, 22 bp, Artificial Sequence
  chemically synthesized
ttattgataggtagtattttaa

SEQ ID NO: 1037870 - DNA, 22 bp, Artificial Sequence
  chemically synthesized
agattaacatgtttaaaatact

SEQ ID NO: 1037871 - DNA, 22 bp, Artificial Sequence
  chemically synthesized
tattgataggtagtattttaaa

SEQ ID NO: 1037872 - DNA, 22 bp, Artificial Sequence
  chemically synthesized
attgataggtagtattttaaac

SEQ ID NO: 1037873 - DNA, 22 bp, Artificial Sequence
  chemically synthesized
ttgataggtagtattttaaaca

SEQ ID NO: 1037874 - DNA, 22 bp, Artificial Sequence
  chemically synthesized
ataggtagtattttaaacatgt

SEQ ID NO: 1037875 - DNA, 22 bp, Artificial Sequence
  chemically synthesized
atacttagattaacatgtttaa

SEQ ID NO: 1037876 - DNA, 22 bp, Artificial Sequence
  chemically synthesized
gatacttagattaacatgttta

SEQ ID NO: 1037877 - DNA, 22 bp, Artificial Sequence
  chemically synthesized
taggagtttgatacttagatta

SEQ ID NO: 1037878 - DNA, 22 bp, Artificial Sequence
  chemically synthesized
ataggagtttgatacttagatt

SEQ ID NO: 1037879 - DNA, 22 bp, Artificial Sequence
  chemically synthesized
taaacatgttaatctaagtatc

SEQ ID NO: 1037880 - DNA, 22 bp, Artificial Sequence
  chemically synthesized
aaacatgttaatctaagtatca

SEQ ID NO: 1037881 - DNA, 22 bp, Artificial Sequence
  chemically synthesized
aacatgttaatctaagtatcaa

SEQ ID NO: 1037882 - DNA, 22 bp, Artificial Sequence
  chemically synthesized
caaatttataggagtttgatac

SEQ ID NO: 1037883 - DNA, 22 bp, Artificial Sequence
  chemically synthesized
atctaagtatcaaactcctata

SEQ ID NO: 1037884 - DNA, 22 bp, Artificial Sequence
  chemically synthesized
tatctacaaatttataggagtt

SEQ ID NO: 1037885 - DNA, 22 bp, Artificial Sequence
  chemically synthesized
agtatcaaactcctataaattt

SEQ ID NO: 1037886 - DNA, 22 bp, Artificial Sequence
  chemically synthesized
gtcaaatctgtatctacaaatt

SEQ ID NO: 1037887 - DNA, 22 bp, Artificial Sequence
  chemically synthesized
agtcaaatctgtatctacaaat

SEQ ID NO: 1037888 - DNA, 22 bp, Artificial Sequence
  chemically synthesized
tagtcaaatctgtatctacaaa

SEQ ID NO: 1037889 - DNA, 22 bp, Artificial Sequence
  chemically synthesized
tctttagtcaaatctgtatcta

SEQ ID NO: 1037890 - DNA, 22 bp, Artificial Sequence
  chemically synthesized
ctataaatttgtagatacagat

SEQ ID NO: 1037891 - DNA, 22 bp, Artificial Sequence
  chemically synthesized
atctttagtcaaatctgtatct

SEQ ID NO: 1037892 - DNA, 22 bp, Artificial Sequence
  chemically synthesized
taaatttgtagatacagatttg

SEQ ID NO: 1037893 - DNA, 22 bp, Artificial Sequence
  chemically synthesized
gtagatacagatttgactaaag

SEQ ID NO: 1037894 - DNA, 22 bp, Artificial Sequence
  chemically synthesized
tagatacagatttgactaaaga

SEQ ID NO: 1037895 - DNA, 22 bp, Artificial Sequence
  chemically synthesized
gatataacatatttatctttag

SEQ ID NO: 1037896 - DNA, 22 bp, Artificial Sequence
  chemically synthesized
ttcgatataacatatttatctt

SEQ ID NO: 1037897 - DNA, 22 bp, Artificial Sequence
  chemically synthesized
gactaaagataaatatgttata

SEQ ID NO: 1037898 - DNA, 22 bp, Artificial Sequence
  chemically synthesized
actaaagataaatatgttatat

SEQ ID NO: 1037899 - DNA, 22 bp, Artificial Sequence
  chemically synthesized
taaacagttgttcgatataaca

SEQ ID NO: 1037900 - DNA, 22 bp, Artificial Sequence
  chemically synthesized
aagataaatatgttatatcgaa

SEQ ID NO: 1037901 - DNA, 22 bp, Artificial Sequence
  chemically synthesized
aggtgctataaacagttgttcg

SEQ ID NO: 1037902 - DNA, 22 bp, Artificial Sequence
  chemically synthesized
gggcattgaggtgctataaaca

SEQ ID NO: 1037903 - DNA, 22 bp, Artificial Sequence
  chemically synthesized
tatcgaacaactgtttatagca

SEQ ID NO: 1037904 - DNA, 22 bp, Artificial Sequence
  chemically synthesized
tttatagcacctcaatgcccca

SEQ ID NO: 1037905 - DNA, 22 bp, Artificial Sequence
  chemically synthesized
atagcacctcaatgccccaatc

SEQ ID NO: 1037906 - DNA, 22 bp, Artificial Sequence
  chemically synthesized
tagcacctcaatgccccaatct

SEQ ID NO: 1037907 - DNA, 22 bp, Artificial Sequence
  chemically synthesized
aggtaatcgtaaatcagattgg

SEQ ID NO: 1037908 - DNA, 22 bp, Artificial Sequence
  chemically synthesized
caggtaatcgtaaatcagattg

SEQ ID NO: 1037909 - DNA, 22 bp, Artificial Sequence
  chemically synthesized
aatgccccaatctgatttacga

SEQ ID NO: 1037910 - DNA, 22 bp, Artificial Sequence
  chemically synthesized
aaatttcaggtaatcgtaaatc

SEQ ID NO: 1037911 - DNA, 22 bp, Artificial Sequence
  chemically synthesized
taaaatttcaggtaatcgtaaa

SEQ ID NO: 1037912 - DNA, 22 bp, Artificial Sequence
  chemically synthesized
ctaaaatttcaggtaatcgtaa

SEQ ID NO: 1037913 - DNA, 22 bp, Artificial Sequence
  chemically synthesized
tatcttctaaaatttcaggtaa

SEQ ID NO: 1037914 - DNA, 22 bp, Artificial Sequence
  chemically synthesized
atttacgattacctgaaatttt

SEQ ID NO: 1037915 - DNA, 22 bp, Artificial Sequence
  chemically synthesized
acgattacctgaaattttagaa

SEQ ID NO: 1037916 - DNA, 22 bp, Artificial Sequence
  chemically synthesized
aagcattatatcttctaaaatt

SEQ ID NO: 1037917 - DNA, 22 bp, Artificial Sequence
  chemically synthesized
cgattacctgaaattttagaag

SEQ ID NO: 1037918 - DNA, 22 bp, Artificial Sequence
  chemically synthesized
tgttgaagcattatatcttcta

SEQ ID NO: 1037919 - DNA, 22 bp, Artificial Sequence
  chemically synthesized
cctgaaattttagaagatataa

SEQ ID NO: 1037920 - DNA, 22 bp, Artificial Sequence
  chemically synthesized
aaattttagaagatataatgct

SEQ ID NO: 1037921 - DNA, 22 bp, Artificial Sequence
  chemically synthesized
gcgttatgttgaagcattatat

SEQ ID NO: 1037922 - DNA, 22 bp, Artificial Sequence
  chemically synthesized
agcgttatgttgaagcattata

SEQ ID NO: 1037923 - DNA, 22 bp, Artificial Sequence
  chemically synthesized
tagaagatataatgcttcaaca

SEQ ID NO: 1037924 - DNA, 22 bp, Artificial Sequence
  chemically synthesized
aatttagcgttatgttgaagca

SEQ ID NO: 1037925 - DNA, 22 bp, Artificial Sequence
  chemically synthesized
agaagatataatgcttcaacat

SEQ ID NO: 1037926 - DNA, 22 bp, Artificial Sequence
  chemically synthesized
gaagatataatgcttcaacata

SEQ ID NO: 1037927 - DNA, 22 bp, Artificial Sequence
  chemically synthesized
agtattaaatttagcgttatgt

SEQ ID NO: 1037928 - DNA, 22 bp, Artificial Sequence
  chemically synthesized
ttcagtattaaatttagcgtta

SEQ ID NO: 1037929 - DNA, 22 bp, Artificial Sequence
  chemically synthesized
caacataacgctaaatttaata

SEQ ID NO: 1037930 - DNA, 22 bp, Artificial Sequence
  chemically synthesized
aacataacgctaaatttaatac

SEQ ID NO: 1037931 - DNA, 22 bp, Artificial Sequence
  chemically synthesized
tagaaattattcagtattaaat

SEQ ID NO: 1037932 - DNA, 22 bp, Artificial Sequence
  chemically synthesized
aactgtagaaattattcagtat

SEQ ID NO: 1037933 - DNA, 22 bp, Artificial Sequence
  chemically synthesized
aatttaatactgaataatttct

SEQ ID NO: 1037934 - DNA, 22 bp, Artificial Sequence
  chemically synthesized
aatactgaataatttctacagt

SEQ ID NO: 1037935 - DNA, 22 bp, Artificial Sequence
  chemically synthesized
atactgaataatttctacagtt

SEQ ID NO: 1037936 - DNA, 22 bp, Artificial Sequence
  chemically synthesized
agacaaatgagctgaactgtag

SEQ ID NO: 1037937 - DNA, 22 bp, Artificial Sequence
  chemically synthesized
aataatttctacagttcagctc

SEQ ID NO: 1037938 - DNA, 22 bp, Artificial Sequence
  chemically synthesized
ctacagttcagctcatttgtct

SEQ ID NO: 1037939 - DNA, 22 bp, Artificial Sequence
  chemically synthesized
tacagttcagctcatttgtctg

SEQ ID NO: 1037940 - DNA, 22 bp, Artificial Sequence
  chemically synthesized
cagttcagctcatttgtctgaa

SEQ ID NO: 1037941 - DNA, 22 bp, Artificial Sequence
  chemically synthesized
agctcatttgtctgaattgttc

SEQ ID NO: 1037942 - DNA, 22 bp, Artificial Sequence
  chemically synthesized
atttgtctgaattgttcatcat

SEQ ID NO: 1037943 - DNA, 22 bp, Artificial Sequence
  chemically synthesized
gtctgaattgttcatcattatt

SEQ ID NO: 1037944 - DNA, 22 bp, Artificial Sequence
  chemically synthesized
tctgaattgttcatcattattt

SEQ ID NO: 1037945 - DNA, 22 bp, Artificial Sequence
  chemically synthesized
aattgttcatcattatttgttc

SEQ ID NO: 1037946 - DNA, 22 bp, Artificial Sequence
  chemically synthesized
ttcatcattatttgttctcatt

SEQ ID NO: 1037947 - DNA, 22 bp, Artificial Sequence
  chemically synthesized
atcattatttgttctcatttta

SEQ ID NO: 1037948 - DNA, 22 bp, Artificial Sequence
  chemically synthesized
aaaaatggtaagtaaaatgaga

SEQ ID NO: 1037949 - DNA, 22 bp, Artificial Sequence
  chemically synthesized
attgaaaaatggtaagtaaaat

SEQ ID NO: 1037950 - DNA, 22 bp, Artificial Sequence
  chemically synthesized
tcattgaaaaatggtaagtaaa

SEQ ID NO: 1037951 - DNA, 22 bp, Artificial Sequence
  chemically synthesized
tttgttctcattttacttacca

SEQ ID NO: 1037952 - DNA, 22 bp, Artificial Sequence
  chemically synthesized
gttctcattttacttaccattt

SEQ ID NO: 1037953 - DNA, 22 bp, Artificial Sequence
  chemically synthesized
ttctcattttacttaccatttt

SEQ ID NO: 1037954 - DNA, 22 bp, Artificial Sequence
  chemically synthesized
tcattttacttaccatttttca

SEQ ID NO: 1037955 - DNA, 22 bp, Artificial Sequence
  chemically synthesized
attttacttaccatttttcaat

SEQ ID NO: 1037956 - DNA, 22 bp, Artificial Sequence
  chemically synthesized
tacttaccatttttcaatgaga

SEQ ID NO: 1037957 - DNA, 22 bp, Artificial Sequence
  chemically synthesized
acttaccatttttcaatgagag

SEQ ID NO: 1037958 - DNA, 22 bp, Artificial Sequence
  chemically synthesized
cttaccatttttcaatgagagt

SEQ ID NO: 1037959 - DNA, 22 bp, Artificial Sequence
  chemically synthesized
accatttttcaatgagagtgat

SEQ ID NO: 1037960 - DNA, 22 bp, Artificial Sequence
  chemically synthesized
ccatttttcaatgagagtgata

SEQ ID NO: 1037961 - DNA, 22 bp, Artificial Sequence
  chemically synthesized
ttcaatgagagtgatacttctt

SEQ ID NO: 1037962 - DNA, 22 bp, Artificial Sequence
  chemically synthesized
tcaatgagagtgatacttcttt

SEQ ID NO: 1037963 - DNA, 22 bp, Artificial Sequence
  chemically synthesized
caatgagagtgatacttctttt

SEQ ID NO: 1037964 - DNA, 22 bp, Artificial Sequence
  chemically synthesized
aatgagagtgatacttcttttt

SEQ ID NO: 1037965 - DNA, 22 bp, Artificial Sequence
  chemically synthesized
catggaaaaaagacagggaaaa

SEQ ID NO: 1037966 - DNA, 22 bp, Artificial Sequence
  chemically synthesized
agtaccctccatggaaaaaaga

SEQ ID NO: 1037967 - DNA, 22 bp, Artificial Sequence
  chemically synthesized
ctttttccctgtcttttttcca

SEQ ID NO: 1037968 - DNA, 22 bp, Artificial Sequence
  chemically synthesized
cagtaccctccatggaaaaaag

SEQ ID NO: 1037969 - DNA, 22 bp, Artificial Sequence
  chemically synthesized
tttttccctgtcttttttccat

SEQ ID NO: 1037970 - DNA, 22 bp, Artificial Sequence
  chemically synthesized
tttccctgtcttttttccatgg

SEQ ID NO: 1037971 - DNA, 22 bp, Artificial Sequence
  chemically synthesized
tttcagtaccctccatggaaaa

SEQ ID NO: 1037972 - DNA, 22 bp, Artificial Sequence
  chemically synthesized
ttccctgtcttttttccatgga

SEQ ID NO: 1037973 - DNA, 22 bp, Artificial Sequence
  chemically synthesized
atttcagtaccctccatggaaa

SEQ ID NO: 1037974 - DNA, 22 bp, Artificial Sequence
  chemically synthesized
tccctgtcttttttccatggag

SEQ ID NO: 1037975 - DNA, 22 bp, Artificial Sequence
  chemically synthesized
ccctgtcttttttccatggagg

SEQ ID NO: 1037976 - DNA, 22 bp, Artificial Sequence
  chemically synthesized
cctgtcttttttccatggaggg

SEQ ID NO: 1037977 - DNA, 22 bp, Artificial Sequence
  chemically synthesized
tcttttttccatggagggtact

SEQ ID NO: 1037978 - DNA, 22 bp, Artificial Sequence
  chemically synthesized
tagaatttatttcagtaccctc

SEQ ID NO: 1037979 - DNA, 22 bp, Artificial Sequence
  chemically synthesized
ttttccatggagggtactgaaa

SEQ ID NO: 1037980 - DNA, 22 bp, Artificial Sequence
  chemically synthesized
tttccatggagggtactgaaat

SEQ ID NO: 1037981 - DNA, 22 bp, Artificial Sequence
  chemically synthesized
ttccatggagggtactgaaata

SEQ ID NO: 1037982 - DNA, 22 bp, Artificial Sequence
  chemically synthesized
tccatggagggtactgaaataa

SEQ ID NO: 1037983 - DNA, 22 bp, Artificial Sequence
  chemically synthesized
ccatggagggtactgaaataaa

SEQ ID NO: 1037984 - DNA, 22 bp, Artificial Sequence
  chemically synthesized
catggagggtactgaaataaat

SEQ ID NO: 1037985 - DNA, 22 bp, Artificial Sequence
  chemically synthesized
agggaactgtagaatttatttc

SEQ ID NO: 1037986 - DNA, 22 bp, Artificial Sequence
  chemically synthesized
cagggaactgtagaatttattt

SEQ ID NO: 1037987 - DNA, 22 bp, Artificial Sequence
  chemically synthesized
tcagggaactgtagaatttatt

SEQ ID NO: 1037988 - DNA, 22 bp, Artificial Sequence
  chemically synthesized
ttttcagggaactgtagaattt

SEQ ID NO: 1037989 - DNA, 22 bp, Artificial Sequence
  chemically synthesized
gttttcagggaactgtagaatt

SEQ ID NO: 1037990 - DNA, 22 bp, Artificial Sequence
  chemically synthesized
aaataaattctacagttccctg

SEQ ID NO: 1037991 - DNA, 22 bp, Artificial Sequence
  chemically synthesized
cagaaatgatttgttttcaggg

SEQ ID NO: 1037992 - DNA, 22 bp, Artificial Sequence
  chemically synthesized
gcagaaatgatttgttttcagg

SEQ ID NO: 1037993 - DNA, 22 bp, Artificial Sequence
  chemically synthesized
tacagttccctgaaaacaaatc

SEQ ID NO: 1037994 - DNA, 22 bp, Artificial Sequence
  chemically synthesized
cagttccctgaaaacaaatcat

SEQ ID NO: 1037995 - DNA, 22 bp, Artificial Sequence
  chemically synthesized
atacttgcagaaatgatttgtt

SEQ ID NO: 1037996 - DNA, 22 bp, Artificial Sequence
  chemically synthesized
gatacttgcagaaatgatttgt

SEQ ID NO: 1037997 - DNA, 22 bp, Artificial Sequence
  chemically synthesized
ttgatacttgcagaaatgattt

SEQ ID NO: 1037998 - DNA, 22 bp, Artificial Sequence
  chemically synthesized
cttgatacttgcagaaatgatt

SEQ ID NO: 1037999 - DNA, 22 bp, Artificial Sequence
  chemically synthesized
tcttgatacttgcagaaatgat

SEQ ID NO: 1038000 - DNA, 22 bp, Artificial Sequence
  chemically synthesized
cctgaaaacaaatcatttctgc

SEQ ID NO: 1038001 - DNA, 22 bp, Artificial Sequence
  chemically synthesized
ttcttgatacttgcagaaatga

SEQ ID NO: 1038002 - DNA, 22 bp, Artificial Sequence
  chemically synthesized
aaaacaaatcatttctgcaagt

SEQ ID NO: 1038003 - DNA, 22 bp, Artificial Sequence
  chemically synthesized
ctgcaagtatcaagaaaaatat

SEQ ID NO: 1038004 - DNA, 22 bp, Artificial Sequence
  chemically synthesized
tgcaagtatcaagaaaaatata

SEQ ID NO: 1038005 - DNA, 22 bp, Artificial Sequence
  chemically synthesized
caagtatcaagaaaaatatatg

SEQ ID NO: 1038006 - DNA, 22 bp, Artificial Sequence
  chemically synthesized
acaaaatgtacaaggaccgaca

SEQ ID NO: 1038007 - DNA, 22 bp, Artificial Sequence
  chemically synthesized
cctacccttgtcggtccttgta

SEQ ID NO: 1038008 - DNA, 22 bp, Artificial Sequence
  chemically synthesized
cccttgtcggtccttgtacatt

SEQ ID NO: 1038009 - DNA, 22 bp, Artificial Sequence
  chemically synthesized
gtcggtccttgtacattttgtt

SEQ ID NO: 1038010 - DNA, 22 bp, Artificial Sequence
  chemically synthesized
tcggtccttgtacattttgtta

SEQ ID NO: 1038011 - DNA, 22 bp, Artificial Sequence
  chemically synthesized
caatgggaaaaagttaacaaaa

SEQ ID NO: 1038012 - DNA, 22 bp, Artificial Sequence
  chemically synthesized
ccaatgggaaaaagttaacaaa

SEQ ID NO: 1038013 - DNA, 22 bp, Artificial Sequence
  chemically synthesized
atttccaatgggaaaaagttaa

SEQ ID NO: 1038014 - DNA, 22 bp, Artificial Sequence
  chemically synthesized
gatttccaatgggaaaaagtta

SEQ ID NO: 1038015 - DNA, 22 bp, Artificial Sequence
  chemically synthesized
gtacattttgttaactttttcc

SEQ ID NO: 1038016 - DNA, 22 bp, Artificial Sequence
  chemically synthesized
tacattttgttaactttttccc

SEQ ID NO: 1038017 - DNA, 22 bp, Artificial Sequence
  chemically synthesized
ccagcttgatttccaatgggaa

SEQ ID NO: 1038018 - DNA, 22 bp, Artificial Sequence
  chemically synthesized
tgttaactttttcccattggaa

SEQ ID NO: 1038019 - DNA, 22 bp, Artificial Sequence
  chemically synthesized
tcccagcttgatttccaatggg

SEQ ID NO: 1038020 - DNA, 22 bp, Artificial Sequence
  chemically synthesized
gttaactttttcccattggaaa

SEQ ID NO: 1038021 - DNA, 22 bp, Artificial Sequence
  chemically synthesized
ttaactttttcccattggaaat

SEQ ID NO: 1038022 - DNA, 22 bp, Artificial Sequence
  chemically synthesized
tctcccagcttgatttccaatg

SEQ ID NO: 1038023 - DNA, 22 bp, Artificial Sequence
  chemically synthesized
actttttcccattggaaatcaa

SEQ ID NO: 1038024 - DNA, 22 bp, Artificial Sequence
  chemically synthesized
tttcccattggaaatcaagctg

SEQ ID NO: 1038025 - DNA, 22 bp, Artificial Sequence
  chemically synthesized
ttcccattggaaatcaagctgg

SEQ ID NO: 1038026 - DNA, 22 bp, Artificial Sequence
  chemically synthesized
tcccattggaaatcaagctggg

SEQ ID NO: 1038027 - DNA, 22 bp, Artificial Sequence
  chemically synthesized
cccattggaaatcaagctggga

SEQ ID NO: 1038028 - DNA, 22 bp, Artificial Sequence
  chemically synthesized
caggaagctctctcccagcttg

SEQ ID NO: 1038029 - DNA, 22 bp, Artificial Sequence
  chemically synthesized
ccattggaaatcaagctgggag

SEQ ID NO: 1038030 - DNA, 22 bp, Artificial Sequence
  chemically synthesized
gaaatcaagctgggagagagct

SEQ ID NO: 1038031 - DNA, 22 bp, Artificial Sequence
  chemically synthesized
tggaaagggtgaagctacagga

SEQ ID NO: 1038032 - DNA, 22 bp, Artificial Sequence
  chemically synthesized
ggagagagcttcctgtagcttc

SEQ ID NO: 1038033 - DNA, 22 bp, Artificial Sequence
  chemically synthesized
cctgtagcttcaccctttccac

SEQ ID NO: 1038034 - DNA, 22 bp, Artificial Sequence
  chemically synthesized
ctgtagcttcaccctttccaca

SEQ ID NO: 1038035 - DNA, 22 bp, Artificial Sequence
  chemically synthesized
caaagtgcaacgcctgtggaaa

SEQ ID NO: 1038036 - DNA, 22 bp, Artificial Sequence
  chemically synthesized
tagcttcaccctttccacaggc

SEQ ID NO: 1038037 - DNA, 22 bp, Artificial Sequence
  chemically synthesized
caccctttccacaggcgttgca

SEQ ID NO: 1038038 - DNA, 22 bp, Artificial Sequence
  chemically synthesized
accctttccacaggcgttgcac

SEQ ID NO: 1038039 - DNA, 22 bp, Artificial Sequence
  chemically synthesized
tccacaggcgttgcactttgca

SEQ ID NO: 1038040 - DNA, 22 bp, Artificial Sequence
  chemically synthesized
ccacaggcgttgcactttgcaa

SEQ ID NO: 1038041 - DNA, 22 bp, Artificial Sequence
  chemically synthesized
cacaggcgttgcactttgcaat

SEQ ID NO: 1038042 - DNA, 22 bp, Artificial Sequence
  chemically synthesized
atagcaagaagacagcagcatt

SEQ ID NO: 1038043 - DNA, 22 bp, Artificial Sequence
  chemically synthesized
ttcatagcaagaagacagcagc

SEQ ID NO: 1038044 - DNA, 22 bp, Artificial Sequence
  chemically synthesized
cactttgcaatgctgctgtctt

SEQ ID NO: 1038045 - DNA, 22 bp, Artificial Sequence
  chemically synthesized
tgcaatgctgctgtcttcttgc

SEQ ID NO: 1038046 - DNA, 22 bp, Artificial Sequence
  chemically synthesized
acattattcatagcaagaagac

SEQ ID NO: 1038047 - DNA, 22 bp, Artificial Sequence
  chemically synthesized
gcaatgctgctgtcttcttgct

SEQ ID NO: 1038048 - DNA, 22 bp, Artificial Sequence
  chemically synthesized
caatgctgctgtcttcttgcta

SEQ ID NO: 1038049 - DNA, 22 bp, Artificial Sequence
  chemically synthesized
ctgtcttcttgctatgaataat

SEQ ID NO: 1038050 - DNA, 22 bp, Artificial Sequence
  chemically synthesized
aggtcggattgacattattcat

SEQ ID NO: 1038051 - DNA, 22 bp, Artificial Sequence
  chemically synthesized
tcttcttgctatgaataatgtc

SEQ ID NO: 1038052 - DNA, 22 bp, Artificial Sequence
  chemically synthesized
cttgctatgaataatgtcaatc

SEQ ID NO: 1038053 - DNA, 22 bp, Artificial Sequence
  chemically synthesized
ttgctatgaataatgtcaatcc

SEQ ID NO: 1038054 - DNA, 22 bp, Artificial Sequence
  chemically synthesized
gctatgaataatgtcaatccga

SEQ ID NO: 1038055 - DNA, 22 bp, Artificial Sequence
  chemically synthesized
ctatgaataatgtcaatccgac

SEQ ID NO: 1038056 - DNA, 22 bp, Artificial Sequence
  chemically synthesized
caacaaagctcaggtcggattg

SEQ ID NO: 1038057 - DNA, 22 bp, Artificial Sequence
  chemically synthesized
tgaataatgtcaatccgacctg

SEQ ID NO: 1038058 - DNA, 22 bp, Artificial Sequence
  chemically synthesized
cagaatataaaagatagtctac

SEQ ID NO: 1038059 - DNA, 22 bp, Artificial Sequence
  chemically synthesized
agctttgttgtagactatcttt

SEQ ID NO: 1038060 - DNA, 22 bp, Artificial Sequence
  chemically synthesized
tattacagaatataaaagatag

SEQ ID NO: 1038061 - DNA, 22 bp, Artificial Sequence
  chemically synthesized
atattacagaatataaaagata

SEQ ID NO: 1038062 - DNA, 22 bp, Artificial Sequence
  chemically synthesized
tatattacagaatataaaagat

SEQ ID NO: 1038063 - DNA, 22 bp, Artificial Sequence
  chemically synthesized
tgttgtagactatcttttatat

SEQ ID NO: 1038064 - DNA, 22 bp, Artificial Sequence
  chemically synthesized
ttatattacagaatataaaaga

SEQ ID NO: 1038065 - DNA, 22 bp, Artificial Sequence
  chemically synthesized
gttgtagactatcttttatatt

SEQ ID NO: 1038066 - DNA, 22 bp, Artificial Sequence
  chemically synthesized
ttgtagactatcttttatattc

SEQ ID NO: 1038067 - DNA, 22 bp, Artificial Sequence
  chemically synthesized
tagactatcttttatattctgt

SEQ ID NO: 1038068 - DNA, 22 bp, Artificial Sequence
  chemically synthesized
aaatttttatattacagaatat

SEQ ID NO: 1038069 - DNA, 22 bp, Artificial Sequence
  chemically synthesized
aaaatttttatattacagaata

SEQ ID NO: 1038070 - DNA, 22 bp, Artificial Sequence
  chemically synthesized
taaaatttttatattacagaat

SEQ ID NO: 1038071 - DNA, 22 bp, Artificial Sequence
  chemically synthesized
ttttaaaatttttatattacag

SEQ ID NO: 1038072 - DNA, 22 bp, Artificial Sequence
  chemically synthesized
tcttttatattctgtaatataa

SEQ ID NO: 1038073 - DNA, 22 bp, Artificial Sequence
  chemically synthesized
ctgttttaaaatttttatatta

SEQ ID NO: 1038074 - DNA, 22 bp, Artificial Sequence
  chemically synthesized
actgttttaaaatttttatatt

SEQ ID NO: 1038075 - DNA, 22 bp, Artificial Sequence
  chemically synthesized
ttatattctgtaatataaaaat

SEQ ID NO: 1038076 - DNA, 22 bp, Artificial Sequence
  chemically synthesized
tactgttttaaaatttttatat

SEQ ID NO: 1038077 - DNA, 22 bp, Artificial Sequence
  chemically synthesized
tatattctgtaatataaaaatt

SEQ ID NO: 1038078 - DNA, 22 bp, Artificial Sequence
  chemically synthesized
ttactgttttaaaatttttata

SEQ ID NO: 1038079 - DNA, 22 bp, Artificial Sequence
  chemically synthesized
atattctgtaatataaaaattt

SEQ ID NO: 1038080 - DNA, 22 bp, Artificial Sequence
  chemically synthesized
tttactgttttaaaatttttat

SEQ ID NO: 1038081 - DNA, 22 bp, Artificial Sequence
  chemically synthesized
tattctgtaatataaaaatttt

SEQ ID NO: 1038082 - DNA, 22 bp, Artificial Sequence
  chemically synthesized
ttttactgttttaaaattttta

SEQ ID NO: 1038083 - DNA, 22 bp, Artificial Sequence
  chemically synthesized
atttttttactgttttaaaatt

SEQ ID NO: 1038084 - DNA, 22 bp, Artificial Sequence
  chemically synthesized
tgtaatataaaaattttaaaac

SEQ ID NO: 1038085 - DNA, 22 bp, Artificial Sequence
  chemically synthesized
taatataaaaattttaaaacag

SEQ ID NO: 1038086 - DNA, 22 bp, Artificial Sequence
  chemically synthesized
attcatttttttactgttttaa

SEQ ID NO: 1038087 - DNA, 22 bp, Artificial Sequence
  chemically synthesized
tagacagctaattcattttttt

SEQ ID NO: 1038088 - DNA, 22 bp, Artificial Sequence
  chemically synthesized
tatagacagctaattcattttt

SEQ ID NO: 1038089 - DNA, 22 bp, Artificial Sequence
  chemically synthesized
taaaacagtaaaaaaatgaatt

SEQ ID NO: 1038090 - DNA, 22 bp, Artificial Sequence
  chemically synthesized
ctatagacagctaattcatttt

SEQ ID NO: 1038091 - DNA, 22 bp, Artificial Sequence
  chemically synthesized
aaaacagtaaaaaaatgaatta

SEQ ID NO: 1038092 - DNA, 22 bp, Artificial Sequence
  chemically synthesized
tctatagacagctaattcattt

SEQ ID NO: 1038093 - DNA, 22 bp, Artificial Sequence
  chemically synthesized
aaacagtaaaaaaatgaattag

SEQ ID NO: 1038094 - DNA, 22 bp, Artificial Sequence
  chemically synthesized
tttctatagacagctaattcat

SEQ ID NO: 1038095 - DNA, 22 bp, Artificial Sequence
  chemically synthesized
tctttctatagacagctaattc

SEQ ID NO: 1038096 - DNA, 22 bp, Artificial Sequence
  chemically synthesized
ctctttctatagacagctaatt

SEQ ID NO: 1038097 - DNA, 22 bp, Artificial Sequence
  chemically synthesized
tctctttctatagacagctaat

SEQ ID NO: 1038098 - DNA, 22 bp, Artificial Sequence
  chemically synthesized
ttctctttctatagacagctaa

SEQ ID NO: 1038099 - DNA, 22 bp, Artificial Sequence
  chemically synthesized
gctgtctatagaaagagaaaaa

SEQ ID NO: 1038100 - DNA, 22 bp, Artificial Sequence
  chemically synthesized
tatatatatatatatttttctc

SEQ ID NO: 1038101 - DNA, 22 bp, Artificial Sequence
  chemically synthesized
gtatatatatatatatttttct

SEQ ID NO: 1038102 - DNA, 22 bp, Artificial Sequence
  chemically synthesized
tctatagaaagagaaaaatata

SEQ ID NO: 1038103 - DNA, 22 bp, Artificial Sequence
  chemically synthesized
tagaaagagaaaaatatatata

SEQ ID NO: 1038104 - DNA, 22 bp, Artificial Sequence
  chemically synthesized
ggatttgtatatatatatatat

SEQ ID NO: 1038105 - DNA, 22 bp, Artificial Sequence
  chemically synthesized
gggatttgtatatatatatata

SEQ ID NO: 1038106 - DNA, 22 bp, Artificial Sequence
  chemically synthesized
tgggatttgtatatatatatat

SEQ ID NO: 1038107 - DNA, 22 bp, Artificial Sequence
  chemically synthesized
cctttgggatttgtatatatat

SEQ ID NO: 1038108 - DNA, 22 bp, Artificial Sequence
  chemically synthesized
ctacctttgggatttgtatata

SEQ ID NO: 1038109 - DNA, 22 bp, Artificial Sequence
  chemically synthesized
gctacctttgggatttgtatat

SEQ ID NO: 1038110 - DNA, 22 bp, Artificial Sequence
  chemically synthesized
caacaccatttgctacctttgg

SEQ ID NO: 1038111 - DNA, 22 bp, Artificial Sequence
  chemically synthesized
agaattgcaacaccatttgcta

SEQ ID NO: 1038112 - DNA, 22 bp, Artificial Sequence
  chemically synthesized
aaaagtcaataattaagaattg

SEQ ID NO: 1038113 - DNA, 22 bp, Artificial Sequence
  chemically synthesized
aaaaagtcaataattaagaatt

SEQ ID NO: 1038114 - DNA, 22 bp, Artificial Sequence
  chemically synthesized
taaaaagtcaataattaagaat

SEQ ID NO: 1038115 - DNA, 22 bp, Artificial Sequence
  chemically synthesized
actttaaaaagtcaataattaa

SEQ ID NO: 1038116 - DNA, 22 bp, Artificial Sequence
  chemically synthesized
ttaactttaaaaagtcaataat

SEQ ID NO: 1038117 - DNA, 22 bp, Artificial Sequence
  chemically synthesized
caattcttaattattgactttt

SEQ ID NO: 1038118 - DNA, 22 bp, Artificial Sequence
  chemically synthesized
atggttattaactttaaaaagt

SEQ ID NO: 1038119 - DNA, 22 bp, Artificial Sequence
  chemically synthesized
catggttattaactttaaaaag

SEQ ID NO: 1038120 - DNA, 22 bp, Artificial Sequence
  chemically synthesized
ttaattattgactttttaaagt

SEQ ID NO: 1038121 - DNA, 22 bp, Artificial Sequence
  chemically synthesized
aattattgactttttaaagtta

SEQ ID NO: 1038122 - DNA, 22 bp, Artificial Sequence
  chemically synthesized
attattgactttttaaagttaa

SEQ ID NO: 1038123 - DNA, 22 bp, Artificial Sequence
  chemically synthesized
gacttcatggttattaacttta

SEQ ID NO: 1038124 - DNA, 22 bp, Artificial Sequence
  chemically synthesized
ttgactttttaaagttaataac

SEQ ID NO: 1038125 - DNA, 22 bp, Artificial Sequence
  chemically synthesized
actttttaaagttaataaccat

SEQ ID NO: 1038126 - DNA, 22 bp, Artificial Sequence
  chemically synthesized
tttaaagttaataaccatgaag

SEQ ID NO: 1038127 - DNA, 22 bp, Artificial Sequence
  chemically synthesized
ttaaagttaataaccatgaagt

SEQ ID NO: 1038128 - DNA, 22 bp, Artificial Sequence
  chemically synthesized
taaagttaataaccatgaagtc

SEQ ID NO: 1038129 - DNA, 22 bp, Artificial Sequence
  chemically synthesized
aaagttaataaccatgaagtcc

SEQ ID NO: 1038130 - DNA, 22 bp, Artificial Sequence
  chemically synthesized
aagttaataaccatgaagtcca

SEQ ID NO: 1038131 - DNA, 22 bp, Artificial Sequence
  chemically synthesized
aacatgtcaaagtcactggact

SEQ ID NO: 1038132 - DNA, 22 bp, Artificial Sequence
  chemically synthesized
gaacatgtcaaagtcactggac

SEQ ID NO: 1038133 - DNA, 22 bp, Artificial Sequence
  chemically synthesized
ataaccatgaagtccagtgact

SEQ ID NO: 1038134 - DNA, 22 bp, Artificial Sequence
  chemically synthesized
aatttgaacatgtcaaagtcac

SEQ ID NO: 1038135 - DNA, 22 bp, Artificial Sequence
  chemically synthesized
ttgaatttgaacatgtcaaagt

SEQ ID NO: 1038136 - DNA, 22 bp, Artificial Sequence
  chemically synthesized
cctattgaatttgaacatgtca

SEQ ID NO: 1038137 - DNA, 22 bp, Artificial Sequence
  chemically synthesized
acctattgaatttgaacatgtc

SEQ ID NO: 1038138 - DNA, 22 bp, Artificial Sequence
  chemically synthesized
tgatttacctattgaatttgaa

SEQ ID NO: 1038139 - DNA, 22 bp, Artificial Sequence
  chemically synthesized
tgacatgttcaaattcaatagg

SEQ ID NO: 1038140 - DNA, 22 bp, Artificial Sequence
  chemically synthesized
gacatgttcaaattcaataggt

SEQ ID NO: 1038141 - DNA, 22 bp, Artificial Sequence
  chemically synthesized
acatgttcaaattcaataggta

SEQ ID NO: 1038142 - DNA, 22 bp, Artificial Sequence
  chemically synthesized
aggatgaggtctgtgatttacc

SEQ ID NO: 1038143 - DNA, 22 bp, Artificial Sequence
  chemically synthesized
aaattcaataggtaaatcacag

SEQ ID NO: 1038144 - DNA, 22 bp, Artificial Sequence
  chemically synthesized
tcaggatgaggtctgtgattta

SEQ ID NO: 1038145 - DNA, 22 bp, Artificial Sequence
  chemically synthesized
tctcaggatgaggtctgtgatt

SEQ ID NO: 1038146 - DNA, 22 bp, Artificial Sequence
  chemically synthesized
aataggtaaatcacagacctca

SEQ ID NO: 1038147 - DNA, 22 bp, Artificial Sequence
  chemically synthesized
agatgtagggagcgatccactc

SEQ ID NO: 1038148 - DNA, 22 bp, Artificial Sequence
  chemically synthesized
aagatgtagggagcgatccact

SEQ ID NO: 1038149 - DNA, 22 bp, Artificial Sequence
  chemically synthesized
taagatgtagggagcgatccac

SEQ ID NO: 1038150 - DNA, 22 bp, Artificial Sequence
  chemically synthesized
atcctgagagagtggatcgctc

SEQ ID NO: 1038151 - DNA, 22 bp, Artificial Sequence
  chemically synthesized
agagagtggatcgctccctaca

SEQ ID NO: 1038152 - DNA, 22 bp, Artificial Sequence
  chemically synthesized
cctacatcttaaaactgccttc

SEQ ID NO: 1038153 - DNA, 22 bp, Artificial Sequence
  chemically synthesized
catcttaaaactgccttcattt

SEQ ID NO: 1038154 - DNA, 22 bp, Artificial Sequence
  chemically synthesized
aaaactgccttcatttggcttc

SEQ ID NO: 1038155 - DNA, 22 bp, Artificial Sequence
  chemically synthesized
aaactgccttcatttggcttct

SEQ ID NO: 1038156 - DNA, 22 bp, Artificial Sequence
  chemically synthesized
ccttcatttggcttctgtatcc

SEQ ID NO: 1038157 - DNA, 22 bp, Artificial Sequence
  chemically synthesized
catttggcttctgtatcctgac

SEQ ID NO: 1038158 - DNA, 22 bp, Artificial Sequence
  chemically synthesized
atttggcttctgtatcctgacc

SEQ ID NO: 1038159 - DNA, 22 bp, Artificial Sequence
  chemically synthesized
ggcttctgtatcctgacctctt

SEQ ID NO: 1038160 - DNA, 22 bp, Artificial Sequence
  chemically synthesized
gcttctgtatcctgacctcttc

SEQ ID NO: 1038161 - DNA, 22 bp, Artificial Sequence
  chemically synthesized
ctgtatcctgacctcttctgct

SEQ ID NO: 1038162 - DNA, 22 bp, Artificial Sequence
  chemically synthesized
tgtatcctgacctcttctgctt

SEQ ID NO: 1038163 - DNA, 22 bp, Artificial Sequence
  chemically synthesized
tatcctgacctcttctgctttc

SEQ ID NO: 1038164 - DNA, 22 bp, Artificial Sequence
  chemically synthesized
acctcttctgctttcctttgct

SEQ ID NO: 1038165 - DNA, 22 bp, Artificial Sequence
  chemically synthesized
ttctgctttcctttgctggatc

SEQ ID NO: 1038166 - DNA, 22 bp, Artificial Sequence
  chemically synthesized
ctgctttcctttgctggatcct

SEQ ID NO: 1038167 - DNA, 22 bp, Artificial Sequence
  chemically synthesized
tgctttcctttgctggatcctt

SEQ ID NO: 1038168 - DNA, 22 bp, Artificial Sequence
  chemically synthesized
agatcaggatgagaaggatcca

SEQ ID NO: 1038169 - DNA, 22 bp, Artificial Sequence
  chemically synthesized
ctttcctttgctggatccttct

SEQ ID NO: 1038170 - DNA, 22 bp, Artificial Sequence
  chemically synthesized
tcctttgctggatccttctcat

SEQ ID NO: 1038171 - DNA, 22 bp, Artificial Sequence
  chemically synthesized
cctttgctggatccttctcatc

SEQ ID NO: 1038172 - DNA, 22 bp, Artificial Sequence
  chemically synthesized
ctttgctggatccttctcatcc

SEQ ID NO: 1038173 - DNA, 22 bp, Artificial Sequence
  chemically synthesized
atattaagatcaggatgagaag

SEQ ID NO: 1038174 - DNA, 22 bp, Artificial Sequence
  chemically synthesized
taatattaagatcaggatgaga

SEQ ID NO: 1038175 - DNA, 22 bp, Artificial Sequence
  chemically synthesized
tgctggatccttctcatcctga

SEQ ID NO: 1038176 - DNA, 22 bp, Artificial Sequence
  chemically synthesized
gctggatccttctcatcctgat

SEQ ID NO: 1038177 - DNA, 22 bp, Artificial Sequence
  chemically synthesized
ctggatccttctcatcctgatc

SEQ ID NO: 1038178 - DNA, 22 bp, Artificial Sequence
  chemically synthesized
gatccttctcatcctgatctta

SEQ ID NO: 1038179 - DNA, 22 bp, Artificial Sequence
  chemically synthesized
ctcatcctgatcttaatattag

SEQ ID NO: 1038180 - DNA, 22 bp, Artificial Sequence
  chemically synthesized
agtcagagcactctaatattaa

SEQ ID NO: 1038181 - DNA, 22 bp, Artificial Sequence
  chemically synthesized
tcatcctgatcttaatattaga

SEQ ID NO: 1038182 - DNA, 22 bp, Artificial Sequence
  chemically synthesized
atcctgatcttaatattagagt

SEQ ID NO: 1038183 - DNA, 22 bp, Artificial Sequence
  chemically synthesized
atcttaatattagagtgctctg

SEQ ID NO: 1038184 - DNA, 22 bp, Artificial Sequence
  chemically synthesized
aatattagagtgctctgactca

SEQ ID NO: 1038185 - DNA, 22 bp, Artificial Sequence
  chemically synthesized
atattagagtgctctgactcag

SEQ ID NO: 1038186 - DNA, 22 bp, Artificial Sequence
  chemically synthesized
gagtgctctgactcagtatttg

SEQ ID NO: 1038187 - DNA, 22 bp, Artificial Sequence
  chemically synthesized
tgactcagtatttgcacttctt

SEQ ID NO: 1038188 - DNA, 22 bp, Artificial Sequence
  chemically synthesized
actcagtatttgcacttctttt

SEQ ID NO: 1038189 - DNA, 22 bp, Artificial Sequence
  chemically synthesized
tggacagagaagaaaagaagtg

SEQ ID NO: 1038190 - DNA, 22 bp, Artificial Sequence
  chemically synthesized
agtatttgcacttcttttcttc

SEQ ID NO: 1038191 - DNA, 22 bp, Artificial Sequence
  chemically synthesized
gcacttcttttcttctctgtcc

SEQ ID NO: 1038192 - DNA, 22 bp, Artificial Sequence
  chemically synthesized
cacttcttttcttctctgtcca

SEQ ID NO: 1038193 - DNA, 22 bp, Artificial Sequence
  chemically synthesized
cttttcttctctgtccataatc

SEQ ID NO: 1038194 - DNA, 22 bp, Artificial Sequence
  chemically synthesized
ttttcttctctgtccataatcc

SEQ ID NO: 1038195 - DNA, 22 bp, Artificial Sequence
  chemically synthesized
ttcttctctgtccataatccat

SEQ ID NO: 1038196 - DNA, 22 bp, Artificial Sequence
  chemically synthesized
tcttctctgtccataatccatc

SEQ ID NO: 1038197 - DNA, 22 bp, Artificial Sequence
  chemically synthesized
cttctctgtccataatccatcc

SEQ ID NO: 1038198 - DNA, 22 bp, Artificial Sequence
  chemically synthesized
tgagaacaaatgggatggatta

SEQ ID NO: 1038199 - DNA, 22 bp, Artificial Sequence
  chemically synthesized
ttctctgtccataatccatccc

SEQ ID NO: 1038200 - DNA, 22 bp, Artificial Sequence
  chemically synthesized
ctctgtccataatccatcccat

SEQ ID NO: 1038201 - DNA, 22 bp, Artificial Sequence
  chemically synthesized
tctgtccataatccatcccatt

SEQ ID NO: 1038202 - DNA, 22 bp, Artificial Sequence
  chemically synthesized
tgtccataatccatcccatttg

SEQ ID NO: 1038203 - DNA, 22 bp, Artificial Sequence
  chemically synthesized
aaattatgagaacaaatgggat

SEQ ID NO: 1038204 - DNA, 22 bp, Artificial Sequence
  chemically synthesized
aaaattatgagaacaaatggga

SEQ ID NO: 1038205 - DNA, 22 bp, Artificial Sequence
  chemically synthesized
tccataatccatcccatttgtt

SEQ ID NO: 1038206 - DNA, 22 bp, Artificial Sequence
  chemically synthesized
tataagatatttaaaattatga

SEQ ID NO: 1038207 - DNA, 22 bp, Artificial Sequence
  chemically synthesized
atataagatatttaaaattatg

SEQ ID NO: 1038208 - DNA, 22 bp, Artificial Sequence
  chemically synthesized
tcttatataagatatttaaaat

SEQ ID NO: 1038209 - DNA, 22 bp, Artificial Sequence
  chemically synthesized
gttctcataattttaaatatct

SEQ ID NO: 1038210 - DNA, 22 bp, Artificial Sequence
  chemically synthesized
ttctcataattttaaatatctt

SEQ ID NO: 1038211 - DNA, 22 bp, Artificial Sequence
  chemically synthesized
tcataattttaaatatcttata

SEQ ID NO: 1038212 - DNA, 22 bp, Artificial Sequence
  chemically synthesized
ataattttaaatatcttatata

SEQ ID NO: 1038213 - DNA, 22 bp, Artificial Sequence
  chemically synthesized
ggtgtcattgtcttatataaga

SEQ ID NO: 1038214 - DNA, 22 bp, Artificial Sequence
  chemically synthesized
gggtgtcattgtcttatataag

SEQ ID NO: 1038215 - DNA, 22 bp, Artificial Sequence
  chemically synthesized
taaatatcttatataagacaat

SEQ ID NO: 1038216 - DNA, 22 bp, Artificial Sequence
  chemically synthesized
aaatatcttatataagacaatg

SEQ ID NO: 1038217 - DNA, 22 bp, Artificial Sequence
  chemically synthesized
aatatcttatataagacaatga

SEQ ID NO: 1038218 - DNA, 22 bp, Artificial Sequence
  chemically synthesized
agatacacatttgggtgtcatt

SEQ ID NO: 1038219 - DNA, 22 bp, Artificial Sequence
  chemically synthesized
gagatacacatttgggtgtcat

SEQ ID NO: 1038220 - DNA, 22 bp, Artificial Sequence
  chemically synthesized
atataagacaatgacacccaaa

SEQ ID NO: 1038221 - DNA, 22 bp, Artificial Sequence
  chemically synthesized
tataagacaatgacacccaaat

SEQ ID NO: 1038222 - DNA, 22 bp, Artificial Sequence
  chemically synthesized
ggaggagatgtccgggcttgag

SEQ ID NO: 1038223 - DNA, 22 bp, Artificial Sequence
  chemically synthesized
gagttcggaggagatgtccggg

SEQ ID NO: 1038224 - DNA, 22 bp, Artificial Sequence
  chemically synthesized
gactggagttcggaggagatgt

SEQ ID NO: 1038225 - DNA, 22 bp, Artificial Sequence
  chemically synthesized
ttagactggagttcggaggaga

SEQ ID NO: 1038226 - DNA, 22 bp, Artificial Sequence
  chemically synthesized
aagcccggacatctcctccgaa

SEQ ID NO: 1038227 - DNA, 22 bp, Artificial Sequence
  chemically synthesized
gttagactggagttcggaggag

SEQ ID NO: 1038228 - DNA, 22 bp, Artificial Sequence
  chemically synthesized
gcatttgttagactggagttcg

SEQ ID NO: 1038229 - DNA, 22 bp, Artificial Sequence
  chemically synthesized
agaaattagcatttgttagact

SEQ ID NO: 1038230 - DNA, 22 bp, Artificial Sequence
  chemically synthesized
ctccgaactccagtctaacaaa

SEQ ID NO: 1038231 - DNA, 22 bp, Artificial Sequence
  chemically synthesized
cgaactccagtctaacaaatgc

SEQ ID NO: 1038232 - DNA, 22 bp, Artificial Sequence
  chemically synthesized
caagtgttgagaaattagcatt

SEQ ID NO: 1038233 - DNA, 22 bp, Artificial Sequence
  chemically synthesized
cagtctaacaaatgctaatttc

SEQ ID NO: 1038234 - DNA, 22 bp, Artificial Sequence
  chemically synthesized
acaaatgctaatttctcaacac

SEQ ID NO: 1038235 - DNA, 22 bp, Artificial Sequence
  chemically synthesized
gtgagacctccaagtgttgaga

SEQ ID NO: 1038236 - DNA, 22 bp, Artificial Sequence
  chemically synthesized
aaagtctcgtgagacctccaag

SEQ ID NO: 1038237 - DNA, 22 bp, Artificial Sequence
  chemically synthesized
atttctcaacacttggaggtct

SEQ ID NO: 1038238 - DNA, 22 bp, Artificial Sequence
  chemically synthesized
gaaagtctcgtgagacctccaa

SEQ ID NO: 1038239 - DNA, 22 bp, Artificial Sequence
  chemically synthesized
ctcaacacttggaggtctcacg

SEQ ID NO: 1038240 - DNA, 22 bp, Artificial Sequence
  chemically synthesized
tcaacacttggaggtctcacga

SEQ ID NO: 1038241 - DNA, 22 bp, Artificial Sequence
  chemically synthesized
agtttgaaagtctcgtgagacc

SEQ ID NO: 1038242 - DNA, 22 bp, Artificial Sequence
  chemically synthesized
aacacttggaggtctcacgaga

SEQ ID NO: 1038243 - DNA, 22 bp, Artificial Sequence
  chemically synthesized
ggaggtctcacgagactttcaa

SEQ ID NO: 1038244 - DNA, 22 bp, Artificial Sequence
  chemically synthesized
gaggtctcacgagactttcaaa

SEQ ID NO: 1038245 - DNA, 22 bp, Artificial Sequence
  chemically synthesized
cgtcatattaagtttgaaagtc

SEQ ID NO: 1038246 - DNA, 22 bp, Artificial Sequence
  chemically synthesized
gcgtcatattaagtttgaaagt

SEQ ID NO: 1038247 - DNA, 22 bp, Artificial Sequence
  chemically synthesized
tttgcgtcatattaagtttgaa

SEQ ID NO: 1038248 - DNA, 22 bp, Artificial Sequence
  chemically synthesized
gtttgcgtcatattaagtttga

SEQ ID NO: 1038249 - DNA, 22 bp, Artificial Sequence
  chemically synthesized
tgtttgcgtcatattaagtttg

SEQ ID NO: 1038250 - DNA, 22 bp, Artificial Sequence
  chemically synthesized
acgagactttcaaacttaatat

SEQ ID NO: 1038251 - DNA, 22 bp, Artificial Sequence
  chemically synthesized
agaattttgtttgcgtcatatt

SEQ ID NO: 1038252 - DNA, 22 bp, Artificial Sequence
  chemically synthesized
tcaaacttaatatgacgcaaac

SEQ ID NO: 1038253 - DNA, 22 bp, Artificial Sequence
  chemically synthesized
caaacttaatatgacgcaaaca

SEQ ID NO: 1038254 - DNA, 22 bp, Artificial Sequence
  chemically synthesized
aaacttaatatgacgcaaacaa

SEQ ID NO: 1038255 - DNA, 22 bp, Artificial Sequence
  chemically synthesized
aatatgacgcaaacaaaattct

SEQ ID NO: 1038256 - DNA, 22 bp, Artificial Sequence
  chemically synthesized
atatgacgcaaacaaaattctg

SEQ ID NO: 1038257 - DNA, 22 bp, Artificial Sequence
  chemically synthesized
ggaaatgcagttcagaattttg

SEQ ID NO: 1038258 - DNA, 22 bp, Artificial Sequence
  chemically synthesized
tgggatgagaaggattaggaaa

SEQ ID NO: 1038259 - DNA, 22 bp, Artificial Sequence
  chemically synthesized
tgaactgcatttcctaatcctt

SEQ ID NO: 1038260 - DNA, 22 bp, Artificial Sequence
  chemically synthesized
aactgcatttcctaatccttct

SEQ ID NO: 1038261 - DNA, 22 bp, Artificial Sequence
  chemically synthesized
catttcctaatccttctcatcc

SEQ ID NO: 1038262 - DNA, 22 bp, Artificial Sequence
  chemically synthesized
cctaatccttctcatcccatag

SEQ ID NO: 1038263 - DNA, 22 bp, Artificial Sequence
  chemically synthesized
aaatgagggaatctatgggatg

SEQ ID NO: 1038264 - DNA, 22 bp, Artificial Sequence
  chemically synthesized
ctaatccttctcatcccataga

SEQ ID NO: 1038265 - DNA, 22 bp, Artificial Sequence
  chemically synthesized
ctgaaatgagggaatctatggg

SEQ ID NO: 1038266 - DNA, 22 bp, Artificial Sequence
  chemically synthesized
atccttctcatcccatagattc

SEQ ID NO: 1038267 - DNA, 22 bp, Artificial Sequence
  chemically synthesized
actgaaatgagggaatctatgg

SEQ ID NO: 1038268 - DNA, 22 bp, Artificial Sequence
  chemically synthesized
ctcatcccatagattccctcat

SEQ ID NO: 1038269 - DNA, 22 bp, Artificial Sequence
  chemically synthesized
ccatttactgaaatgagggaat

SEQ ID NO: 1038270 - DNA, 22 bp, Artificial Sequence
  chemically synthesized
tcatcccatagattccctcatt

SEQ ID NO: 1038271 - DNA, 22 bp, Artificial Sequence
  chemically synthesized
atcccatagattccctcatttc

SEQ ID NO: 1038272 - DNA, 22 bp, Artificial Sequence
  chemically synthesized
aaatcagtaattgccatttact

SEQ ID NO: 1038273 - DNA, 22 bp, Artificial Sequence
  chemically synthesized
cctcatttcagtaaatggcaat

SEQ ID NO: 1038274 - DNA, 22 bp, Artificial Sequence
  chemically synthesized
aattgaaatcagtaattgccat

SEQ ID NO: 1038275 - DNA, 22 bp, Artificial Sequence
  chemically synthesized
atttcagtaaatggcaattact

SEQ ID NO: 1038276 - DNA, 22 bp, Artificial Sequence
  chemically synthesized
cagtaaatggcaattactgatt

SEQ ID NO: 1038277 - DNA, 22 bp, Artificial Sequence
  chemically synthesized
taattcaattgaaatcagtaat

SEQ ID NO: 1038278 - DNA, 22 bp, Artificial Sequence
  chemically synthesized
agtaaatggcaattactgattt

SEQ ID NO: 1038279 - DNA, 22 bp, Artificial Sequence
  chemically synthesized
ctataattcaattgaaatcagt

SEQ ID NO: 1038280 - DNA, 22 bp, Artificial Sequence
  chemically synthesized
aattactataattcaattgaaa

SEQ ID NO: 1038281 - DNA, 22 bp, Artificial Sequence
  chemically synthesized
attgaattactataattcaatt

SEQ ID NO: 1038282 - DNA, 22 bp, Artificial Sequence
  chemically synthesized
ttaattgaattactataattca

SEQ ID NO: 1038283 - DNA, 22 bp, Artificial Sequence
  chemically synthesized
ctgatttcaattgaattatagt

SEQ ID NO: 1038284 - DNA, 22 bp, Artificial Sequence
  chemically synthesized
atttcaattgaattatagtaat

SEQ ID NO: 1038285 - DNA, 22 bp, Artificial Sequence
  chemically synthesized
caattgaattatagtaattcaa

SEQ ID NO: 1038286 - DNA, 22 bp, Artificial Sequence
  chemically synthesized
agtaattgttaattgaattact

SEQ ID NO: 1038287 - DNA, 22 bp, Artificial Sequence
  chemically synthesized
aattgaattatagtaattcaat

SEQ ID NO: 1038288 - DNA, 22 bp, Artificial Sequence
  chemically synthesized
aattatagtaattcaattaaca

SEQ ID NO: 1038289 - DNA, 22 bp, Artificial Sequence
  chemically synthesized
tcaatctgagtaattgttaatt

SEQ ID NO: 1038290 - DNA, 22 bp, Artificial Sequence
  chemically synthesized
tagtaattcaattaacaattac

SEQ ID NO: 1038291 - DNA, 22 bp, Artificial Sequence
  chemically synthesized
caaagttgtcaatctgagtaat

SEQ ID NO: 1038292 - DNA, 22 bp, Artificial Sequence
  chemically synthesized
aattaacaattactcagattga

SEQ ID NO: 1038293 - DNA, 22 bp, Artificial Sequence
  chemically synthesized
acaattactcagattgacaact

SEQ ID NO: 1038294 - DNA, 22 bp, Artificial Sequence
  chemically synthesized
aggatggctccaaagttgtcaa

SEQ ID NO: 1038295 - DNA, 22 bp, Artificial Sequence
  chemically synthesized
ctcagattgacaactttggagc

SEQ ID NO: 1038296 - DNA, 22 bp, Artificial Sequence
  chemically synthesized
agattgacaactttggagccat

SEQ ID NO: 1038297 - DNA, 22 bp, Artificial Sequence
  chemically synthesized
aaaaaattaaggatggctccaa

SEQ ID NO: 1038298 - DNA, 22 bp, Artificial Sequence
  chemically synthesized
acaactttggagccatccttaa

SEQ ID NO: 1038299 - DNA, 22 bp, Artificial Sequence
  chemically synthesized
gagactgaaaaaattaaggatg

SEQ ID NO: 1038300 - DNA, 22 bp, Artificial Sequence
  chemically synthesized
tggagccatccttaattttttc

SEQ ID NO: 1038301 - DNA, 22 bp, Artificial Sequence
  chemically synthesized
ggagccatccttaattttttca

SEQ ID NO: 1038302 - DNA, 22 bp, Artificial Sequence
  chemically synthesized
aatactggagactgaaaaaatt

SEQ ID NO: 1038303 - DNA, 22 bp, Artificial Sequence
  chemically synthesized
gagccatccttaattttttcag

SEQ ID NO: 1038304 - DNA, 22 bp, Artificial Sequence
  chemically synthesized
gaatactggagactgaaaaaat

SEQ ID NO: 1038305 - DNA, 22 bp, Artificial Sequence
  chemically synthesized
aattttttcagtctccagtatt

SEQ ID NO: 1038306 - DNA, 22 bp, Artificial Sequence
  chemically synthesized
cccaataatttgaatactggag

SEQ ID NO: 1038307 - DNA, 22 bp, Artificial Sequence
  chemically synthesized
attttttcagtctccagtattc

SEQ ID NO: 1038308 - DNA, 22 bp, Artificial Sequence
  chemically synthesized
gcccaataatttgaatactgga

SEQ ID NO: 1038309 - DNA, 22 bp, Artificial Sequence
  chemically synthesized
tttcagtctccagtattcaaat

SEQ ID NO: 1038310 - DNA, 22 bp, Artificial Sequence
  chemically synthesized
ttcagtctccagtattcaaatt

SEQ ID NO: 1038311 - DNA, 22 bp, Artificial Sequence
  chemically synthesized
tcagtctccagtattcaaatta

SEQ ID NO: 1038312 - DNA, 22 bp, Artificial Sequence
  chemically synthesized
cagtctccagtattcaaattat

SEQ ID NO: 1038313 - DNA, 22 bp, Artificial Sequence
  chemically synthesized
agtctccagtattcaaattatt

SEQ ID NO: 1038314 - DNA, 22 bp, Artificial Sequence
  chemically synthesized
cagtattcaaattattgggcaa

SEQ ID NO: 1038315 - DNA, 22 bp, Artificial Sequence
  chemically synthesized
aaagtcaagccaaaacatttgc

SEQ ID NO: 1038316 - DNA, 22 bp, Artificial Sequence
  chemically synthesized
aaattattgggcaaatgttttg

SEQ ID NO: 1038317 - DNA, 22 bp, Artificial Sequence
  chemically synthesized
ttgggcaaatgttttggcttga

SEQ ID NO: 1038318 - DNA, 22 bp, Artificial Sequence
  chemically synthesized
ggcaaatgttttggcttgactt

SEQ ID NO: 1038319 - DNA, 22 bp, Artificial Sequence
  chemically synthesized
catatgtcctgaaagtcaagcc

SEQ ID NO: 1038320 - DNA, 22 bp, Artificial Sequence
  chemically synthesized
tgcatatgtcctgaaagtcaag

SEQ ID NO: 1038321 - DNA, 22 bp, Artificial Sequence
  chemically synthesized
tggcttgactttcaggacatat

SEQ ID NO: 1038322 - DNA, 22 bp, Artificial Sequence
  chemically synthesized
ggcttgactttcaggacatatg

SEQ ID NO: 1038323 - DNA, 22 bp, Artificial Sequence
  chemically synthesized
gcttgactttcaggacatatgc

SEQ ID NO: 1038324 - DNA, 22 bp, Artificial Sequence
  chemically synthesized
gactttcaggacatatgcagaa

SEQ ID NO: 1038325 - DNA, 22 bp, Artificial Sequence
  chemically synthesized
actttcaggacatatgcagaat

SEQ ID NO: 1038326 - DNA, 22 bp, Artificial Sequence
  chemically synthesized
tcaggacatatgcagaatttga

SEQ ID NO: 1038327 - DNA, 22 bp, Artificial Sequence
  chemically synthesized
caggacatatgcagaatttgac

SEQ ID NO: 1038328 - DNA, 22 bp, Artificial Sequence
  chemically synthesized
aggacatatgcagaatttgact

SEQ ID NO: 1038329 - DNA, 22 bp, Artificial Sequence
  chemically synthesized
tagcaagaaaggtagtgagaag

SEQ ID NO: 1038330 - DNA, 22 bp, Artificial Sequence
  chemically synthesized
gactgcttctcactacctttct

SEQ ID NO: 1038331 - DNA, 22 bp, Artificial Sequence
  chemically synthesized
actgcttctcactacctttctt

SEQ ID NO: 1038332 - DNA, 22 bp, Artificial Sequence
  chemically synthesized
tcagatctgtagcaagaaaggt

SEQ ID NO: 1038333 - DNA, 22 bp, Artificial Sequence
  chemically synthesized
tatcagatctgtagcaagaaag

SEQ ID NO: 1038334 - DNA, 22 bp, Artificial Sequence
  chemically synthesized
cttctcactacctttcttgcta

SEQ ID NO: 1038335 - DNA, 22 bp, Artificial Sequence
  chemically synthesized
ctatcagatctgtagcaagaaa

SEQ ID NO: 1038336 - DNA, 22 bp, Artificial Sequence
  chemically synthesized
ctcactacctttcttgctacag

SEQ ID NO: 1038337 - DNA, 22 bp, Artificial Sequence
  chemically synthesized
tcactacctttcttgctacaga

SEQ ID NO: 1038338 - DNA, 22 bp, Artificial Sequence
  chemically synthesized
actacctttcttgctacagatc

SEQ ID NO: 1038339 - DNA, 22 bp, Artificial Sequence
  chemically synthesized
cctttcttgctacagatctgat

SEQ ID NO: 1038340 - DNA, 22 bp, Artificial Sequence
  chemically synthesized
tcttgctacagatctgatagaa

SEQ ID NO: 1038341 - DNA, 22 bp, Artificial Sequence
  chemically synthesized
cttgctacagatctgatagaag

SEQ ID NO: 1038342 - DNA, 22 bp, Artificial Sequence
  chemically synthesized
ttgctacagatctgatagaagc

SEQ ID NO: 1038343 - DNA, 22 bp, Artificial Sequence
  chemically synthesized
gctacagatctgatagaagcta

SEQ ID NO: 1038344 - DNA, 22 bp, Artificial Sequence
  chemically synthesized
ctacagatctgatagaagctat

SEQ ID NO: 1038345 - DNA, 22 bp, Artificial Sequence
  chemically synthesized
cagatctgatagaagctattat

SEQ ID NO: 1038346 - DNA, 22 bp, Artificial Sequence
  chemically synthesized
taacccagatgagagacaataa

SEQ ID NO: 1038347 - DNA, 22 bp, Artificial Sequence
  chemically synthesized
atagaagctattattgtctctc

SEQ ID NO: 1038348 - DNA, 22 bp, Artificial Sequence
  chemically synthesized
tataacccagatgagagacaat

SEQ ID NO: 1038349 - DNA, 22 bp, Artificial Sequence
  chemically synthesized
ttattgtctctcatctgggtta

SEQ ID NO: 1038350 - DNA, 22 bp, Artificial Sequence
  chemically synthesized
gataggtagttctataacccag

SEQ ID NO: 1038351 - DNA, 22 bp, Artificial Sequence
  chemically synthesized
ttgtctctcatctgggttatag

SEQ ID NO: 1038352 - DNA, 22 bp, Artificial Sequence
  chemically synthesized
agataggtagttctataaccca

SEQ ID NO: 1038353 - DNA, 22 bp, Artificial Sequence
  chemically synthesized
tctctcatctgggttatagaac

SEQ ID NO: 1038354 - DNA, 22 bp, Artificial Sequence
  chemically synthesized
tcatctgggttatagaactacc

SEQ ID NO: 1038355 - DNA, 22 bp, Artificial Sequence
  chemically synthesized
atctgggttatagaactaccta

SEQ ID NO: 1038356 - DNA, 22 bp, Artificial Sequence
  chemically synthesized
ggttatagaactacctatctaa

SEQ ID NO: 1038357 - DNA, 22 bp, Artificial Sequence
  chemically synthesized
tagaactacctatctaaatggt

SEQ ID NO: 1038358 - DNA, 22 bp, Artificial Sequence
  chemically synthesized
cctatctaaatggtcctcttgc

SEQ ID NO: 1038359 - DNA, 22 bp, Artificial Sequence
  chemically synthesized
tctaaatggtcctcttgcttcc

SEQ ID NO: 1038360 - DNA, 22 bp, Artificial Sequence
  chemically synthesized
aatggtcctcttgcttccgctc

SEQ ID NO: 1038361 - DNA, 22 bp, Artificial Sequence
  chemically synthesized
tccagtaggggggaaagagcgg

SEQ ID NO: 1038362 - DNA, 22 bp, Artificial Sequence
  chemically synthesized
ttgcttccgctctttcccccct

SEQ ID NO: 1038363 - DNA, 22 bp, Artificial Sequence
  chemically synthesized
gcttccgctctttcccccctac

SEQ ID NO: 1038364 - DNA, 22 bp, Artificial Sequence
  chemically synthesized
cttccgctctttcccccctact

SEQ ID NO: 1038365 - DNA, 22 bp, Artificial Sequence
  chemically synthesized
ccgctctttcccccctactgga

SEQ ID NO: 1038366 - DNA, 22 bp, Artificial Sequence
  chemically synthesized
tgtggagaattatccagtaggg

SEQ ID NO: 1038367 - DNA, 22 bp, Artificial Sequence
  chemically synthesized
cgctctttcccccctactggat

SEQ ID NO: 1038368 - DNA, 22 bp, Artificial Sequence
  chemically synthesized
gtgtggagaattatccagtagg

SEQ ID NO: 1038369 - DNA, 22 bp, Artificial Sequence
  chemically synthesized
ttgtgtggagaattatccagta

SEQ ID NO: 1038370 - DNA, 22 bp, Artificial Sequence
  chemically synthesized
tttcccccctactggataattc

SEQ ID NO: 1038371 - DNA, 22 bp, Artificial Sequence
  chemically synthesized
tcccccctactggataattctc

SEQ ID NO: 1038372 - DNA, 22 bp, Artificial Sequence
  chemically synthesized
ggctcttgtgtggagaattatc

SEQ ID NO: 1038373 - DNA, 22 bp, Artificial Sequence
  chemically synthesized
cccccctactggataattctcc

SEQ ID NO: 1038374 - DNA, 22 bp, Artificial Sequence
  chemically synthesized
cggctcttgtgtggagaattat

SEQ ID NO: 1038375 - DNA, 22 bp, Artificial Sequence
  chemically synthesized
ccccctactggataattctcca

SEQ ID NO: 1038376 - DNA, 22 bp, Artificial Sequence
  chemically synthesized
tcggctcttgtgtggagaatta

SEQ ID NO: 1038377 - DNA, 22 bp, Artificial Sequence
  chemically synthesized
ttcggctcttgtgtggagaatt

SEQ ID NO: 1038378 - DNA, 22 bp, Artificial Sequence
  chemically synthesized
ctggataattctccacacaaga

SEQ ID NO: 1038379 - DNA, 22 bp, Artificial Sequence
  chemically synthesized
gataattctccacacaagagcc

SEQ ID NO: 1038380 - DNA, 22 bp, Artificial Sequence
  chemically synthesized
aaagaatcttttcggctcttgt

SEQ ID NO: 1038381 - DNA, 22 bp, Artificial Sequence
  chemically synthesized
aaaagaatcttttcggctcttg

SEQ ID NO: 1038382 - DNA, 22 bp, Artificial Sequence
  chemically synthesized
taaaagaatcttttcggctctt

SEQ ID NO: 1038383 - DNA, 22 bp, Artificial Sequence
  chemically synthesized
tccacacaagagccgaaaagat

SEQ ID NO: 1038384 - DNA, 22 bp, Artificial Sequence
  chemically synthesized
tgttttaaaagaatcttttcgg

SEQ ID NO: 1038385 - DNA, 22 bp, Artificial Sequence
  chemically synthesized
cacacaagagccgaaaagattc

SEQ ID NO: 1038386 - DNA, 22 bp, Artificial Sequence
  chemically synthesized
ttttaaaacataattgggatca

SEQ ID NO: 1038387 - DNA, 22 bp, Artificial Sequence
  chemically synthesized
ttaaaacataattgggatcata

SEQ ID NO: 1038388 - DNA, 22 bp, Artificial Sequence
  chemically synthesized
taaaacataattgggatcatat

SEQ ID NO: 1038389 - DNA, 22 bp, Artificial Sequence
  chemically synthesized
agcagaggagtgatatgatccc

SEQ ID NO: 1038390 - DNA, 22 bp, Artificial Sequence
  chemically synthesized
aaaacataattgggatcatatc

SEQ ID NO: 1038391 - DNA, 22 bp, Artificial Sequence
  chemically synthesized
gagcagaggagtgatatgatcc

SEQ ID NO: 1038392 - DNA, 22 bp, Artificial Sequence
  chemically synthesized
aaacataattgggatcatatca

SEQ ID NO: 1038393 - DNA, 22 bp, Artificial Sequence
  chemically synthesized
tgagcagaggagtgatatgatc

SEQ ID NO: 1038394 - DNA, 22 bp, Artificial Sequence
  chemically synthesized
ggatcatatcactcctctgctc

SEQ ID NO: 1038395 - DNA, 22 bp, Artificial Sequence
  chemically synthesized
tgatgaagagccaccagaagat

SEQ ID NO: 1038396 - DNA, 22 bp, Artificial Sequence
  chemically synthesized
ctctgctcaaaatcttctggtg

SEQ ID NO: 1038397 - DNA, 22 bp, Artificial Sequence
  chemically synthesized
tgtgatgaagagccaccagaag

SEQ ID NO: 1038398 - DNA, 22 bp, Artificial Sequence
  chemically synthesized
tgctcaaaatcttctggtggct

SEQ ID NO: 1038399 - DNA, 22 bp, Artificial Sequence
  chemically synthesized
ctcaaaatcttctggtggctct

SEQ ID NO: 1038400 - DNA, 22 bp, Artificial Sequence
  chemically synthesized
aactctgtgatgaagagccacc

SEQ ID NO: 1038401 - DNA, 22 bp, Artificial Sequence
  chemically synthesized
aaaatcttctggtggctcttca

SEQ ID NO: 1038402 - DNA, 22 bp, Artificial Sequence
  chemically synthesized
tgattgaactctgtgatgaaga

SEQ ID NO: 1038403 - DNA, 22 bp, Artificial Sequence
  chemically synthesized
ctggtggctcttcatcacagag

SEQ ID NO: 1038404 - DNA, 22 bp, Artificial Sequence
  chemically synthesized
gctgtgattgaactctgtgatg

SEQ ID NO: 1038405 - DNA, 22 bp, Artificial Sequence
  chemically synthesized
tggtggctcttcatcacagagt

SEQ ID NO: 1038406 - DNA, 22 bp, Artificial Sequence
  chemically synthesized
gtggctcttcatcacagagttc

SEQ ID NO: 1038407 - DNA, 22 bp, Artificial Sequence
  chemically synthesized
aaattggctgtgattgaactct

SEQ ID NO: 1038408 - DNA, 22 bp, Artificial Sequence
  chemically synthesized
gaaattggctgtgattgaactc

SEQ ID NO: 1038409 - DNA, 22 bp, Artificial Sequence
  chemically synthesized
tgaaattggctgtgattgaact

SEQ ID NO: 1038410 - DNA, 22 bp, Artificial Sequence
  chemically synthesized
ttgaaattggctgtgattgaac

SEQ ID NO: 1038411 - DNA, 22 bp, Artificial Sequence
  chemically synthesized
ttcatcacagagttcaatcaca

SEQ ID NO: 1038412 - DNA, 22 bp, Artificial Sequence
  chemically synthesized
catcacagagttcaatcacagc

SEQ ID NO: 1038413 - DNA, 22 bp, Artificial Sequence
  chemically synthesized
atcacagagttcaatcacagcc

SEQ ID NO: 1038414 - DNA, 22 bp, Artificial Sequence
  chemically synthesized
atgtaggcttttgaaattggct

SEQ ID NO: 1038415 - DNA, 22 bp, Artificial Sequence
  chemically synthesized
catgtaggcttttgaaattggc

SEQ ID NO: 1038416 - DNA, 22 bp, Artificial Sequence
  chemically synthesized
tcatgtaggcttttgaaattgg

SEQ ID NO: 1038417 - DNA, 22 bp, Artificial Sequence
  chemically synthesized
ttcatgtaggcttttgaaattg

SEQ ID NO: 1038418 - DNA, 22 bp, Artificial Sequence
  chemically synthesized
aatcacagccaatttcaaaagc

SEQ ID NO: 1038419 - DNA, 22 bp, Artificial Sequence
  chemically synthesized
tttttcatgtaggcttttgaaa

SEQ ID NO: 1038420 - DNA, 22 bp, Artificial Sequence
  chemically synthesized
caagaataattatttttcatgt

SEQ ID NO: 1038421 - DNA, 22 bp, Artificial Sequence
  chemically synthesized
caaaagcctacatgaaaaataa

SEQ ID NO: 1038422 - DNA, 22 bp, Artificial Sequence
  chemically synthesized
aaaagcctacatgaaaaataat

SEQ ID NO: 1038423 - DNA, 22 bp, Artificial Sequence
  chemically synthesized
tataaagtgttgcaagaataat

SEQ ID NO: 1038424 - DNA, 22 bp, Artificial Sequence
  chemically synthesized
catgaaaaataattattcttgc

SEQ ID NO: 1038425 - DNA, 22 bp, Artificial Sequence
  chemically synthesized
gtataaagtgttgcaagaataa

SEQ ID NO: 1038426 - DNA, 22 bp, Artificial Sequence
  chemically synthesized
tttgtataaagtgttgcaagaa

SEQ ID NO: 1038427 - DNA, 22 bp, Artificial Sequence
  chemically synthesized
attatttgtataaagtgttgca

SEQ ID NO: 1038428 - DNA, 22 bp, Artificial Sequence
  chemically synthesized
gcctgattatttgtataaagtg

SEQ ID NO: 1038429 - DNA, 22 bp, Artificial Sequence
  chemically synthesized
ggcctgattatttgtataaagt

SEQ ID NO: 1038430 - DNA, 22 bp, Artificial Sequence
  chemically synthesized
ttcttgcaacactttatacaaa

SEQ ID NO: 1038431 - DNA, 22 bp, Artificial Sequence
  chemically synthesized
ttgcaacactttatacaaataa

SEQ ID NO: 1038432 - DNA, 22 bp, Artificial Sequence
  chemically synthesized
tacttggcctgattatttgtat

SEQ ID NO: 1038433 - DNA, 22 bp, Artificial Sequence
  chemically synthesized
gcaacactttatacaaataatc

SEQ ID NO: 1038434 - DNA, 22 bp, Artificial Sequence
  chemically synthesized
caacactttatacaaataatca

SEQ ID NO: 1038435 - DNA, 22 bp, Artificial Sequence
  chemically synthesized
ttatacttggcctgattatttg

SEQ ID NO: 1038436 - DNA, 22 bp, Artificial Sequence
  chemically synthesized
attatacttggcctgattattt

SEQ ID NO: 1038437 - DNA, 22 bp, Artificial Sequence
  chemically synthesized
tattatacttggcctgattatt

SEQ ID NO: 1038438 - DNA, 22 bp, Artificial Sequence
  chemically synthesized
ctttattatacttggcctgatt

SEQ ID NO: 1038439 - DNA, 22 bp, Artificial Sequence
  chemically synthesized
gctttattatacttggcctgat

SEQ ID NO: 1038440 - DNA, 22 bp, Artificial Sequence
  chemically synthesized
tatacaaataatcaggccaagt

SEQ ID NO: 1038441 - DNA, 22 bp, Artificial Sequence
  chemically synthesized
atacaaataatcaggccaagta

SEQ ID NO: 1038442 - DNA, 22 bp, Artificial Sequence
  chemically synthesized
tacaaataatcaggccaagtat

SEQ ID NO: 1038443 - DNA, 22 bp, Artificial Sequence
  chemically synthesized
atttgctttattatacttggcc

SEQ ID NO: 1038444 - DNA, 22 bp, Artificial Sequence
  chemically synthesized
aagatggatcatcataggactg

SEQ ID NO: 1038445 - DNA, 22 bp, Artificial Sequence
  chemically synthesized
ctaaagatggatcatcatagga

SEQ ID NO: 1038446 - DNA, 22 bp, Artificial Sequence
  chemically synthesized
actaaagatggatcatcatagg

SEQ ID NO: 1038447 - DNA, 22 bp, Artificial Sequence
  chemically synthesized
tactaaagatggatcatcatag

SEQ ID NO: 1038448 - DNA, 22 bp, Artificial Sequence
  chemically synthesized
ttactaaagatggatcatcata

SEQ ID NO: 1038449 - DNA, 22 bp, Artificial Sequence
  chemically synthesized
ccatttttactaaagatggatc

SEQ ID NO: 1038450 - DNA, 22 bp, Artificial Sequence
  chemically synthesized
cagtctcccatttttactaaag

SEQ ID NO: 1038451 - DNA, 22 bp, Artificial Sequence
  chemically synthesized
tgatgatccatctttagtaaaa

SEQ ID NO: 1038452 - DNA, 22 bp, Artificial Sequence
  chemically synthesized
tccagtctcccatttttactaa

SEQ ID NO: 1038453 - DNA, 22 bp, Artificial Sequence
  chemically synthesized
tctccagtctcccatttttact

SEQ ID NO: 1038454 - DNA, 22 bp, Artificial Sequence
  chemically synthesized
tctctccagtctcccattttta

SEQ ID NO: 1038455 - DNA, 22 bp, Artificial Sequence
  chemically synthesized
ctctctccagtctcccattttt

SEQ ID NO: 1038456 - DNA, 22 bp, Artificial Sequence
  chemically synthesized
tctctctccagtctcccatttt

SEQ ID NO: 1038457 - DNA, 22 bp, Artificial Sequence
  chemically synthesized
ttctctctccagtctcccattt

SEQ ID NO: 1038458 - DNA, 22 bp, Artificial Sequence
  chemically synthesized
tttctctctccagtctcccatt

SEQ ID NO: 1038459 - DNA, 22 bp, Artificial Sequence
  chemically synthesized
ttttctctctccagtctcccat

SEQ ID NO: 1038460 - DNA, 22 bp, Artificial Sequence
  chemically synthesized
tagtaaaaatgggagactggag

SEQ ID NO: 1038461 - DNA, 22 bp, Artificial Sequence
  chemically synthesized
agtaaaaatgggagactggaga

SEQ ID NO: 1038462 - DNA, 22 bp, Artificial Sequence
  chemically synthesized
gtaaaaatgggagactggagag

SEQ ID NO: 1038463 - DNA, 22 bp, Artificial Sequence
  chemically synthesized
aaacataatttttttctctctc

SEQ ID NO: 1038464 - DNA, 22 bp, Artificial Sequence
  chemically synthesized
aaaacataatttttttctctct

SEQ ID NO: 1038465 - DNA, 22 bp, Artificial Sequence
  chemically synthesized
ttaaaacataatttttttctct

SEQ ID NO: 1038466 - DNA, 22 bp, Artificial Sequence
  chemically synthesized
gagagagaaaaaaattatgttt

SEQ ID NO: 1038467 - DNA, 22 bp, Artificial Sequence
  chemically synthesized
ataacaggtgtaccatagttct

SEQ ID NO: 1038468 - DNA, 22 bp, Artificial Sequence
  chemically synthesized
tgttttaagaactatggtacac

SEQ ID NO: 1038469 - DNA, 22 bp, Artificial Sequence
  chemically synthesized
acgagactaataacaggtgtac

SEQ ID NO: 1038470 - DNA, 22 bp, Artificial Sequence
  chemically synthesized
taagaactatggtacacctgtt

SEQ ID NO: 1038471 - DNA, 22 bp, Artificial Sequence
  chemically synthesized
aagaactatggtacacctgtta

SEQ ID NO: 1038472 - DNA, 22 bp, Artificial Sequence
  chemically synthesized
agaactatggtacacctgttat

SEQ ID NO: 1038473 - DNA, 22 bp, Artificial Sequence
  chemically synthesized
tggtacacctgttattagtctc

SEQ ID NO: 1038474 - DNA, 22 bp, Artificial Sequence
  chemically synthesized
aaaaacagctgacgagactaat

SEQ ID NO: 1038475 - DNA, 22 bp, Artificial Sequence
  chemically synthesized
ttattagtctcgtcagctgttt

SEQ ID NO: 1038476 - DNA, 22 bp, Artificial Sequence
  chemically synthesized
ttagtctcgtcagctgtttttg

SEQ ID NO: 1038477 - DNA, 22 bp, Artificial Sequence
  chemically synthesized
caggaaaaaactcaaaaacagc

SEQ ID NO: 1038478 - DNA, 22 bp, Artificial Sequence
  chemically synthesized
gtctcgtcagctgtttttgagt

SEQ ID NO: 1038479 - DNA, 22 bp, Artificial Sequence
  chemically synthesized
tattgcaggaaaaaactcaaaa

SEQ ID NO: 1038480 - DNA, 22 bp, Artificial Sequence
  chemically synthesized
gtcagctgtttttgagtttttt

SEQ ID NO: 1038481 - DNA, 22 bp, Artificial Sequence
  chemically synthesized
tttttgagttttttcctgcaat

SEQ ID NO: 1038482 - DNA, 22 bp, Artificial Sequence
  chemically synthesized
ttgagttttttcctgcaatata

SEQ ID NO: 1038483 - DNA, 22 bp, Artificial Sequence
  chemically synthesized
tgagttttttcctgcaatatag

SEQ ID NO: 1038484 - DNA, 22 bp, Artificial Sequence
  chemically synthesized
gagttttttcctgcaatataga

SEQ ID NO: 1038485 - DNA, 22 bp, Artificial Sequence
  chemically synthesized
agttttttcctgcaatatagac

SEQ ID NO: 1038486 - DNA, 22 bp, Artificial Sequence
  chemically synthesized
tttcctgcaatatagactgatc

SEQ ID NO: 1038487 - DNA, 22 bp, Artificial Sequence
  chemically synthesized
ttcctgcaatatagactgatcc

SEQ ID NO: 1038488 - DNA, 22 bp, Artificial Sequence
  chemically synthesized
tcctgcaatatagactgatcct

SEQ ID NO: 1038489 - DNA, 22 bp, Artificial Sequence
  chemically synthesized
acaggaataagcaggatcagtc

SEQ ID NO: 1038490 - DNA, 22 bp, Artificial Sequence
  chemically synthesized
cctgcaatatagactgatcctg

SEQ ID NO: 1038491 - DNA, 22 bp, Artificial Sequence
  chemically synthesized
ctgcaatatagactgatcctgc

SEQ ID NO: 1038492 - DNA, 22 bp, Artificial Sequence
  chemically synthesized
caatatagactgatcctgctta

SEQ ID NO: 1038493 - DNA, 22 bp, Artificial Sequence
  chemically synthesized
gcaggttcacaggaataagcag

SEQ ID NO: 1038494 - DNA, 22 bp, Artificial Sequence
  chemically synthesized
atcctgcttattcctgtgaacc

SEQ ID NO: 1038495 - DNA, 22 bp, Artificial Sequence
  chemically synthesized
cttattcctgtgaacctgccag

SEQ ID NO: 1038496 - DNA, 22 bp, Artificial Sequence
  chemically synthesized
attcctgtgaacctgccagtga

SEQ ID NO: 1038497 - DNA, 22 bp, Artificial Sequence
  chemically synthesized
ttcctgtgaacctgccagtgat

SEQ ID NO: 1038498 - DNA, 22 bp, Artificial Sequence
  chemically synthesized
aggtgcagtcagagatcactgg

SEQ ID NO: 1038499 - DNA, 22 bp, Artificial Sequence
  chemically synthesized
ctgtgaacctgccagtgatctc

SEQ ID NO: 1038500 - DNA, 22 bp, Artificial Sequence
  chemically synthesized
tgaggtgcagtcagagatcact

SEQ ID NO: 1038501 - DNA, 22 bp, Artificial Sequence
  chemically synthesized
ctgaggtgcagtcagagatcac

SEQ ID NO: 1038502 - DNA, 22 bp, Artificial Sequence
  chemically synthesized
tgaacctgccagtgatctctga

SEQ ID NO: 1038503 - DNA, 22 bp, Artificial Sequence
  chemically synthesized
ttctgaggtgcagtcagagatc

SEQ ID NO: 1038504 - DNA, 22 bp, Artificial Sequence
  chemically synthesized
cttctgaggtgcagtcagagat

SEQ ID NO: 1038505 - DNA, 22 bp, Artificial Sequence
  chemically synthesized
tttcttctgaggtgcagtcaga

SEQ ID NO: 1038506 - DNA, 22 bp, Artificial Sequence
  chemically synthesized
gtttcttctgaggtgcagtcag

SEQ ID NO: 1038507 - DNA, 22 bp, Artificial Sequence
  chemically synthesized
ccagtgatctctgactgcacct

SEQ ID NO: 1038508 - DNA, 22 bp, Artificial Sequence
  chemically synthesized
ttgtttcttctgaggtgcagtc

SEQ ID NO: 1038509 - DNA, 22 bp, Artificial Sequence
  chemically synthesized
cttgtttcttctgaggtgcagt

SEQ ID NO: 1038510 - DNA, 22 bp, Artificial Sequence
  chemically synthesized
cccatccttcttgtttcttctg

SEQ ID NO: 1038511 - DNA, 22 bp, Artificial Sequence
  chemically synthesized
tgactgcacctcagaagaaaca

SEQ ID NO: 1038512 - DNA, 22 bp, Artificial Sequence
  chemically synthesized
actgcacctcagaagaaacaag

SEQ ID NO: 1038513 - DNA, 22 bp, Artificial Sequence
  chemically synthesized
tattacccatccttcttgtttc

SEQ ID NO: 1038514 - DNA, 22 bp, Artificial Sequence
  chemically synthesized
atattacccatccttcttgttt

SEQ ID NO: 1038515 - DNA, 22 bp, Artificial Sequence
  chemically synthesized
cacctcagaagaaacaagaagg

SEQ ID NO: 1038516 - DNA, 22 bp, Artificial Sequence
  chemically synthesized
tatattacccatccttcttgtt

SEQ ID NO: 1038517 - DNA, 22 bp, Artificial Sequence
  chemically synthesized
ttatattacccatccttcttgt

SEQ ID NO: 1038518 - DNA, 22 bp, Artificial Sequence
  chemically synthesized
agaagaaacaagaaggatgggt

SEQ ID NO: 1038519 - DNA, 22 bp, Artificial Sequence
  chemically synthesized
atccaggtttttatattaccca

SEQ ID NO: 1038520 - DNA, 22 bp, Artificial Sequence
  chemically synthesized
gaatactgatccaggtttttat

SEQ ID NO: 1038521 - DNA, 22 bp, Artificial Sequence
  chemically synthesized
caatacatgcccagaattagaa

SEQ ID NO: 1038522 - DNA, 22 bp, Artificial Sequence
  chemically synthesized
gatcagtattctaattctgggc

SEQ ID NO: 1038523 - DNA, 22 bp, Artificial Sequence
  chemically synthesized
attccaatacatgcccagaatt

SEQ ID NO: 1038524 - DNA, 22 bp, Artificial Sequence
  chemically synthesized
gctgattccaatacatgcccag

SEQ ID NO: 1038525 - DNA, 22 bp, Artificial Sequence
  chemically synthesized
ctagctgattccaatacatgcc

SEQ ID NO: 1038526 - DNA, 22 bp, Artificial Sequence
  chemically synthesized
taattctgggcatgtattggaa

SEQ ID NO: 1038527 - DNA, 22 bp, Artificial Sequence
  chemically synthesized
attctgggcatgtattggaatc

SEQ ID NO: 1038528 - DNA, 22 bp, Artificial Sequence
  chemically synthesized
tgggcatgtattggaatcagct

SEQ ID NO: 1038529 - DNA, 22 bp, Artificial Sequence
  chemically synthesized
ggcatgtattggaatcagctag

SEQ ID NO: 1038530 - DNA, 22 bp, Artificial Sequence
  chemically synthesized
gaaccaaagtgatgtggggctg

SEQ ID NO: 1038531 - DNA, 22 bp, Artificial Sequence
  chemically synthesized
gaatcagctagcagccccacat

SEQ ID NO: 1038532 - DNA, 22 bp, Artificial Sequence
  chemically synthesized
ttggaaccaaagtgatgtgggg

SEQ ID NO: 1038533 - DNA, 22 bp, Artificial Sequence
  chemically synthesized
gcagccccacatcactttggtt

SEQ ID NO: 1038534 - DNA, 22 bp, Artificial Sequence
  chemically synthesized
ggcagctgttggaaccaaagtg

SEQ ID NO: 1038535 - DNA, 22 bp, Artificial Sequence
  chemically synthesized
cgtgaactgggcagctgttgga

SEQ ID NO: 1038536 - DNA, 22 bp, Artificial Sequence
  chemically synthesized
ccgtgaactgggcagctgttgg

SEQ ID NO: 1038537 - DNA, 22 bp, Artificial Sequence
  chemically synthesized
tccgtgaactgggcagctgttg

SEQ ID NO: 1038538 - DNA, 22 bp, Artificial Sequence
  chemically synthesized
tggttccaacagctgcccagtt

SEQ ID NO: 1038539 - DNA, 22 bp, Artificial Sequence
  chemically synthesized
ggttccaacagctgcccagttc

SEQ ID NO: 1038540 - DNA, 22 bp, Artificial Sequence
  chemically synthesized
gttccaacagctgcccagttca

SEQ ID NO: 1038541 - DNA, 22 bp, Artificial Sequence
  chemically synthesized
gaaggctttccgtgaactgggc

SEQ ID NO: 1038542 - DNA, 22 bp, Artificial Sequence
  chemically synthesized
caacagctgcccagttcacgga

SEQ ID NO: 1038543 - DNA, 22 bp, Artificial Sequence
  chemically synthesized
aattagaaggctttccgtgaac

SEQ ID NO: 1038544 - DNA, 22 bp, Artificial Sequence
  chemically synthesized
cccagttcacggaaagccttct

SEQ ID NO: 1038545 - DNA, 22 bp, Artificial Sequence
  chemically synthesized
tcccaagtaaactaaattagaa

SEQ ID NO: 1038546 - DNA, 22 bp, Artificial Sequence
  chemically synthesized
acggaaagccttctaatttagt

SEQ ID NO: 1038547 - DNA, 22 bp, Artificial Sequence
  chemically synthesized
ctaatttagtttacttgggata

SEQ ID NO: 1038548 - DNA, 22 bp, Artificial Sequence
  chemically synthesized
taatttagtttacttgggataa

SEQ ID NO: 1038549 - DNA, 22 bp, Artificial Sequence
  chemically synthesized
atttagtttacttgggataatt

SEQ ID NO: 1038550 - DNA, 22 bp, Artificial Sequence
  chemically synthesized
agtttacttgggataattttac

SEQ ID NO: 1038551 - DNA, 22 bp, Artificial Sequence
  chemically synthesized
gtttacttgggataattttact

SEQ ID NO: 1038552 - DNA, 22 bp, Artificial Sequence
  chemically synthesized
acttgggataattttacttatt

SEQ ID NO: 1038553 - DNA, 22 bp, Artificial Sequence
  chemically synthesized
cttgggataattttacttattg

SEQ ID NO: 1038554 - DNA, 22 bp, Artificial Sequence
  chemically synthesized
gggataattttacttattgtgt

SEQ ID NO: 1038555 - DNA, 22 bp, Artificial Sequence
  chemically synthesized
cacaacagtaaaacacaataag

SEQ ID NO: 1038556 - DNA, 22 bp, Artificial Sequence
  chemically synthesized
ggataattttacttattgtgtt

SEQ ID NO: 1038557 - DNA, 22 bp, Artificial Sequence
  chemically synthesized
tacttattgtgttttactgttg

SEQ ID NO: 1038558 - DNA, 22 bp, Artificial Sequence
  chemically synthesized
acttattgtgttttactgttgt

SEQ ID NO: 1038559 - DNA, 22 bp, Artificial Sequence
  chemically synthesized
cttattgtgttttactgttgtg

SEQ ID NO: 1038560 - DNA, 22 bp, Artificial Sequence
  chemically synthesized
attgtgttttactgttgtggaa

SEQ ID NO: 1038561 - DNA, 22 bp, Artificial Sequence
  chemically synthesized
ttgtgttttactgttgtggaat

SEQ ID NO: 1038562 - DNA, 22 bp, Artificial Sequence
  chemically synthesized
tgttttactgttgtggaatata

SEQ ID NO: 1038563 - DNA, 22 bp, Artificial Sequence
  chemically synthesized
tactgttgtggaatatatttgc

SEQ ID NO: 1038564 - DNA, 22 bp, Artificial Sequence
  chemically synthesized
actgttgtggaatatatttgct

SEQ ID NO: 1038565 - DNA, 22 bp, Artificial Sequence
  chemically synthesized
ctgttgtggaatatatttgctg

SEQ ID NO: 1038566 - DNA, 22 bp, Artificial Sequence
  chemically synthesized
tacaaaaagtaaaacagcaaat

SEQ ID NO: 1038567 - DNA, 22 bp, Artificial Sequence
  chemically synthesized
ttgtggaatatatttgctgttt

SEQ ID NO: 1038568 - DNA, 22 bp, Artificial Sequence
  chemically synthesized
ctatacaaaaagtaaaacagca

SEQ ID NO: 1038569 - DNA, 22 bp, Artificial Sequence
  chemically synthesized
tggaatatatttgctgttttac

SEQ ID NO: 1038570 - DNA, 22 bp, Artificial Sequence
  chemically synthesized
cattcctatacaaaaagtaaaa

SEQ ID NO: 1038571 - DNA, 22 bp, Artificial Sequence
  chemically synthesized
tgcattcctatacaaaaagtaa

SEQ ID NO: 1038572 - DNA, 22 bp, Artificial Sequence
  chemically synthesized
ttctgcattcctatacaaaaag

SEQ ID NO: 1038573 - DNA, 22 bp, Artificial Sequence
  chemically synthesized
attctgcattcctatacaaaaa

SEQ ID NO: 1038574 - DNA, 22 bp, Artificial Sequence
  chemically synthesized
gctgttttactttttgtatagg

SEQ ID NO: 1038575 - DNA, 22 bp, Artificial Sequence
  chemically synthesized
ctgttttactttttgtatagga

SEQ ID NO: 1038576 - DNA, 22 bp, Artificial Sequence
  chemically synthesized
ttttactttttgtataggaatg

SEQ ID NO: 1038577 - DNA, 22 bp, Artificial Sequence
  chemically synthesized
tactttttgtataggaatgcag

SEQ ID NO: 1038578 - DNA, 22 bp, Artificial Sequence
  chemically synthesized
agtaagcttattctgcattcct

SEQ ID NO: 1038579 - DNA, 22 bp, Artificial Sequence
  chemically synthesized
actttttgtataggaatgcaga

SEQ ID NO: 1038580 - DNA, 22 bp, Artificial Sequence
  chemically synthesized
ctttttgtataggaatgcagaa

SEQ ID NO: 1038581 - DNA, 22 bp, Artificial Sequence
  chemically synthesized
tttgtataggaatgcagaataa

SEQ ID NO: 1038582 - DNA, 22 bp, Artificial Sequence
  chemically synthesized
ttgtataggaatgcagaataag

SEQ ID NO: 1038583 - DNA, 22 bp, Artificial Sequence
  chemically synthesized
tgtataggaatgcagaataagc

SEQ ID NO: 1038584 - DNA, 22 bp, Artificial Sequence
  chemically synthesized
gtataggaatgcagaataagct

SEQ ID NO: 1038585 - DNA, 22 bp, Artificial Sequence
  chemically synthesized
tataggaatgcagaataagctt

SEQ ID NO: 1038586 - DNA, 22 bp, Artificial Sequence
  chemically synthesized
agaaaacattgagtaagcttat

SEQ ID NO: 1038587 - DNA, 22 bp, Artificial Sequence
  chemically synthesized
aatctaagaaaacattgagtaa

SEQ ID NO: 1038588 - DNA, 22 bp, Artificial Sequence
  chemically synthesized
caatctaagaaaacattgagta

SEQ ID NO: 1038589 - DNA, 22 bp, Artificial Sequence
  chemically synthesized
tcaatctaagaaaacattgagt

SEQ ID NO: 1038590 - DNA, 22 bp, Artificial Sequence
  chemically synthesized
gtaagttttcaatctaagaaaa

SEQ ID NO: 1038591 - DNA, 22 bp, Artificial Sequence
  chemically synthesized
actcaatgttttcttagattga

SEQ ID NO: 1038592 - DNA, 22 bp, Artificial Sequence
  chemically synthesized
ctcaatgttttcttagattgaa

SEQ ID NO: 1038593 - DNA, 22 bp, Artificial Sequence
  chemically synthesized
aatgttttcttagattgaaaac

SEQ ID NO: 1038594 - DNA, 22 bp, Artificial Sequence
  chemically synthesized
gaagattagtaagttttcaatc

SEQ ID NO: 1038595 - DNA, 22 bp, Artificial Sequence
  chemically synthesized
tcttagattgaaaacttactaa

SEQ ID NO: 1038596 - DNA, 22 bp, Artificial Sequence
  chemically synthesized
cttagattgaaaacttactaat

SEQ ID NO: 1038597 - DNA, 22 bp, Artificial Sequence
  chemically synthesized
ttagattgaaaacttactaatc

SEQ ID NO: 1038598 - DNA, 22 bp, Artificial Sequence
  chemically synthesized
agattgaaaacttactaatctt

SEQ ID NO: 1038599 - DNA, 22 bp, Artificial Sequence
  chemically synthesized
gattgaaaacttactaatcttc

SEQ ID NO: 1038600 - DNA, 22 bp, Artificial Sequence
  chemically synthesized
aaaacttactaatcttccagat

SEQ ID NO: 1038601 - DNA, 22 bp, Artificial Sequence
  chemically synthesized
ataaatggtgatatctggaaga

SEQ ID NO: 1038602 - DNA, 22 bp, Artificial Sequence
  chemically synthesized
actaatcttccagatatcacca

SEQ ID NO: 1038603 - DNA, 22 bp, Artificial Sequence
  chemically synthesized
ataactgataaatggtgatatc

SEQ ID NO: 1038604 - DNA, 22 bp, Artificial Sequence
  chemically synthesized
ctaatcttccagatatcaccat

SEQ ID NO: 1038605 - DNA, 22 bp, Artificial Sequence
  chemically synthesized
atcttccagatatcaccattta

SEQ ID NO: 1038606 - DNA, 22 bp, Artificial Sequence
  chemically synthesized
ccagatatcaccatttatcagt

SEQ ID NO: 1038607 - DNA, 22 bp, Artificial Sequence
  chemically synthesized
cagatatcaccatttatcagtt

SEQ ID NO: 1038608 - DNA, 22 bp, Artificial Sequence
  chemically synthesized
gtgagggccattcataactgat

SEQ ID NO: 1038609 - DNA, 22 bp, Artificial Sequence
  chemically synthesized
ggtgagggccattcataactga

SEQ ID NO: 1038610 - DNA, 22 bp, Artificial Sequence
  chemically synthesized
atcagttatgaatggccctcac

SEQ ID NO: 1038611 - DNA, 22 bp, Artificial Sequence
  chemically synthesized
tcagttatgaatggccctcacc

SEQ ID NO: 1038612 - DNA, 22 bp, Artificial Sequence
  chemically synthesized
tgaatggccctcaccaagctga

SEQ ID NO: 1038613 - DNA, 22 bp, Artificial Sequence
  chemically synthesized
agtcagcaagcatcagcttggt

SEQ ID NO: 1038614 - DNA, 22 bp, Artificial Sequence
  chemically synthesized
accaagctgatgcttgctgact

SEQ ID NO: 1038615 - DNA, 22 bp, Artificial Sequence
  chemically synthesized
agggtagagaggagctcagtca

SEQ ID NO: 1038616 - DNA, 22 bp, Artificial Sequence
  chemically synthesized
atgcttgctgactgagctcctc

SEQ ID NO: 1038617 - DNA, 22 bp, Artificial Sequence
  chemically synthesized
tattcagggtagagaggagctc

SEQ ID NO: 1038618 - DNA, 22 bp, Artificial Sequence
  chemically synthesized
gtattcagggtagagaggagct

SEQ ID NO: 1038619 - DNA, 22 bp, Artificial Sequence
  chemically synthesized
ttgtattcagggtagagaggag

SEQ ID NO: 1038620 - DNA, 22 bp, Artificial Sequence
  chemically synthesized
gctgactgagctcctctctacc

SEQ ID NO: 1038621 - DNA, 22 bp, Artificial Sequence
  chemically synthesized
ctgactgagctcctctctaccc

SEQ ID NO: 1038622 - DNA, 22 bp, Artificial Sequence
  chemically synthesized
actgagctcctctctaccctga

SEQ ID NO: 1038623 - DNA, 22 bp, Artificial Sequence
  chemically synthesized
gggtctcttgtattcagggtag

SEQ ID NO: 1038624 - DNA, 22 bp, Artificial Sequence
  chemically synthesized
agctcctctctaccctgaatac

SEQ ID NO: 1038625 - DNA, 22 bp, Artificial Sequence
  chemically synthesized
ttagggtctcttgtattcaggg

SEQ ID NO: 1038626 - DNA, 22 bp, Artificial Sequence
  chemically synthesized
actattagggtctcttgtattc

SEQ ID NO: 1038627 - DNA, 22 bp, Artificial Sequence
  chemically synthesized
ctctctaccctgaatacaagag

SEQ ID NO: 1038628 - DNA, 22 bp, Artificial Sequence
  chemically synthesized
tctaccctgaatacaagagacc

SEQ ID NO: 1038629 - DNA, 22 bp, Artificial Sequence
  chemically synthesized
cctaactattagggtctcttgt

SEQ ID NO: 1038630 - DNA, 22 bp, Artificial Sequence
  chemically synthesized
taccctgaatacaagagaccct

SEQ ID NO: 1038631 - DNA, 22 bp, Artificial Sequence
  chemically synthesized
tgcctaactattagggtctctt

SEQ ID NO: 1038632 - DNA, 22 bp, Artificial Sequence
  chemically synthesized
ctgcctaactattagggtctct

SEQ ID NO: 1038633 - DNA, 22 bp, Artificial Sequence
  chemically synthesized
ccctgaatacaagagaccctaa

SEQ ID NO: 1038634 - DNA, 22 bp, Artificial Sequence
  chemically synthesized
aatacaagagaccctaatagtt

SEQ ID NO: 1038635 - DNA, 22 bp, Artificial Sequence
  chemically synthesized
aatatgggtgatgatatttctg

SEQ ID NO: 1038636 - DNA, 22 bp, Artificial Sequence
  chemically synthesized
atagttaggcagaaatatcatc

SEQ ID NO: 1038637 - DNA, 22 bp, Artificial Sequence
  chemically synthesized
aggctgaatatgggtgatgata

SEQ ID NO: 1038638 - DNA, 22 bp, Artificial Sequence
  chemically synthesized
caggctgaatatgggtgatgat

SEQ ID NO: 1038639 - DNA, 22 bp, Artificial Sequence
  chemically synthesized
ttcaggctgaatatgggtgatg

SEQ ID NO: 1038640 - DNA, 22 bp, Artificial Sequence
  chemically synthesized
ggcagaaatatcatcacccata

SEQ ID NO: 1038641 - DNA, 22 bp, Artificial Sequence
  chemically synthesized
cttcaggctgaatatgggtgat

SEQ ID NO: 1038642 - DNA, 22 bp, Artificial Sequence
  chemically synthesized
taacttcttcaggctgaatatg

SEQ ID NO: 1038643 - DNA, 22 bp, Artificial Sequence
  chemically synthesized
tgtaacttcttcaggctgaata

SEQ ID NO: 1038644 - DNA, 22 bp, Artificial Sequence
  chemically synthesized
ctgtaacttcttcaggctgaat

SEQ ID NO: 1038645 - DNA, 22 bp, Artificial Sequence
  chemically synthesized
agcctgaagaagttacagaaga

SEQ ID NO: 1038646 - DNA, 22 bp, Artificial Sequence
  chemically synthesized
aagaagttacagaagatgtatt

SEQ ID NO: 1038647 - DNA, 22 bp, Artificial Sequence
  chemically synthesized
agtagtagaagggtaatacatc

SEQ ID NO: 1038648 - DNA, 22 bp, Artificial Sequence
  chemically synthesized
ggattaagtagtagaagggtaa

SEQ ID NO: 1038649 - DNA, 22 bp, Artificial Sequence
  chemically synthesized
cagaagatgtattacccttcta

SEQ ID NO: 1038650 - DNA, 22 bp, Artificial Sequence
  chemically synthesized
aggattaagtagtagaagggta

SEQ ID NO: 1038651 - DNA, 22 bp, Artificial Sequence
  chemically synthesized
cccttaggattaagtagtagaa

SEQ ID NO: 1038652 - DNA, 22 bp, Artificial Sequence
  chemically synthesized
cccttctactacttaatcctaa

SEQ ID NO: 1038653 - DNA, 22 bp, Artificial Sequence
  chemically synthesized
ctactacttaatcctaagggta

SEQ ID NO: 1038654 - DNA, 22 bp, Artificial Sequence
  chemically synthesized
tactacttaatcctaagggtaa

SEQ ID NO: 1038655 - DNA, 22 bp, Artificial Sequence
  chemically synthesized
agggtagtagagttacccttag

SEQ ID NO: 1038656 - DNA, 22 bp, Artificial Sequence
  chemically synthesized
ctacttaatcctaagggtaact

SEQ ID NO: 1038657 - DNA, 22 bp, Artificial Sequence
  chemically synthesized
cttaatcctaagggtaactcta

SEQ ID NO: 1038658 - DNA, 22 bp, Artificial Sequence
  chemically synthesized
atcctaagggtagtagagttac

SEQ ID NO: 1038659 - DNA, 22 bp, Artificial Sequence
  chemically synthesized
aatcctaagggtagtagagtta

SEQ ID NO: 1038660 - DNA, 22 bp, Artificial Sequence
  chemically synthesized
aatcctaagggtaactctacta

SEQ ID NO: 1038661 - DNA, 22 bp, Artificial Sequence
  chemically synthesized
atcctaagggtaactctactac

SEQ ID NO: 1038662 - DNA, 22 bp, Artificial Sequence
  chemically synthesized
agggtaactctactacccttag

SEQ ID NO: 1038663 - DNA, 22 bp, Artificial Sequence
  chemically synthesized
caagggaacccttaatcctaag

SEQ ID NO: 1038664 - DNA, 22 bp, Artificial Sequence
  chemically synthesized
acaagggaacccttaatcctaa

SEQ ID NO: 1038665 - DNA, 22 bp, Artificial Sequence
  chemically synthesized
tacaagggaacccttaatccta

SEQ ID NO: 1038666 - DNA, 22 bp, Artificial Sequence
  chemically synthesized
ttacaagggaacccttaatcct

SEQ ID NO: 1038667 - DNA, 22 bp, Artificial Sequence
  chemically synthesized
tactacccttaggattaagggt

SEQ ID NO: 1038668 - DNA, 22 bp, Artificial Sequence
  chemically synthesized
ttttacaagggaacccttaatc

SEQ ID NO: 1038669 - DNA, 22 bp, Artificial Sequence
  chemically synthesized
cttttacaagggaacccttaat

SEQ ID NO: 1038670 - DNA, 22 bp, Artificial Sequence
  chemically synthesized
ctacccttaggattaagggttc

SEQ ID NO: 1038671 - DNA, 22 bp, Artificial Sequence
  chemically synthesized
tcttttacaagggaacccttaa

SEQ ID NO: 1038672 - DNA, 22 bp, Artificial Sequence
  chemically synthesized
tttcttttacaagggaaccctt

SEQ ID NO: 1038673 - DNA, 22 bp, Artificial Sequence
  chemically synthesized
cccttaggattaagggttccct

SEQ ID NO: 1038674 - DNA, 22 bp, Artificial Sequence
  chemically synthesized
ccctctttcttttacaagggaa

SEQ ID NO: 1038675 - DNA, 22 bp, Artificial Sequence
  chemically synthesized
aggattaagggttcccttgtaa

SEQ ID NO: 1038676 - DNA, 22 bp, Artificial Sequence
  chemically synthesized
cccctctttcttttacaaggga

SEQ ID NO: 1038677 - DNA, 22 bp, Artificial Sequence
  chemically synthesized
ggattaagggttcccttgtaaa

SEQ ID NO: 1038678 - DNA, 22 bp, Artificial Sequence
  chemically synthesized
agggttcccttgtaaaagaaag

SEQ ID NO: 1038679 - DNA, 22 bp, Artificial Sequence
  chemically synthesized
acatatttcccctctttctttt

SEQ ID NO: 1038680 - DNA, 22 bp, Artificial Sequence
  chemically synthesized
tgacatatttcccctctttctt

SEQ ID NO: 1038681 - DNA, 22 bp, Artificial Sequence
  chemically synthesized
ccttgtaaaagaaagaggggaa

SEQ ID NO: 1038682 - DNA, 22 bp, Artificial Sequence
  chemically synthesized
gtaaaagaaagaggggaaatat

SEQ ID NO: 1038683 - DNA, 22 bp, Artificial Sequence
  chemically synthesized
taaaagaaagaggggaaatatg

SEQ ID NO: 1038684 - DNA, 22 bp, Artificial Sequence
  chemically synthesized
gaacgcctctgacatatttccc

SEQ ID NO: 1038685 - DNA, 22 bp, Artificial Sequence
  chemically synthesized
gttcgaacgcctctgacatatt

SEQ ID NO: 1038686 - DNA, 22 bp, Artificial Sequence
  chemically synthesized
tagttcgaacgcctctgacata

SEQ ID NO: 1038687 - DNA, 22 bp, Artificial Sequence
  chemically synthesized
ttctagttcgaacgcctctgac

SEQ ID NO: 1038688 - DNA, 22 bp, Artificial Sequence
  chemically synthesized
aagatggagttgttctagttcg

SEQ ID NO: 1038689 - DNA, 22 bp, Artificial Sequence
  chemically synthesized
ttcaagatggagttgttctagt

SEQ ID NO: 1038690 - DNA, 22 bp, Artificial Sequence
  chemically synthesized
gaactagaacaactccatcttg

SEQ ID NO: 1038691 - DNA, 22 bp, Artificial Sequence
  chemically synthesized
cccagcccctattcaagatgga

SEQ ID NO: 1038692 - DNA, 22 bp, Artificial Sequence
  chemically synthesized
acccagcccctattcaagatgg

SEQ ID NO: 1038693 - DNA, 22 bp, Artificial Sequence
  chemically synthesized
tacccagcccctattcaagatg

SEQ ID NO: 1038694 - DNA, 22 bp, Artificial Sequence
  chemically synthesized
gaacaactccatcttgaatagg

SEQ ID NO: 1038695 - DNA, 22 bp, Artificial Sequence
  chemically synthesized
ttttacccagcccctattcaag

SEQ ID NO: 1038696 - DNA, 22 bp, Artificial Sequence
  chemically synthesized
attttacccagcccctattcaa

SEQ ID NO: 1038697 - DNA, 22 bp, Artificial Sequence
  chemically synthesized
agccttattttacccagcccct

SEQ ID NO: 1038698 - DNA, 22 bp, Artificial Sequence
  chemically synthesized
catcttgaataggggctgggta

SEQ ID NO: 1038699 - DNA, 22 bp, Artificial Sequence
  chemically synthesized
gaataggggctgggtaaaataa

SEQ ID NO: 1038700 - DNA, 22 bp, Artificial Sequence
  chemically synthesized
aataggggctgggtaaaataag

SEQ ID NO: 1038701 - DNA, 22 bp, Artificial Sequence
  chemically synthesized
ggtaaaataaggctgagaccta

SEQ ID NO: 1038702 - DNA, 22 bp, Artificial Sequence
  chemically synthesized
ggaatgcagcccagtaggtctc

SEQ ID NO: 1038703 - DNA, 22 bp, Artificial Sequence
  chemically synthesized
ctgggaatgcagcccagtaggt

SEQ ID NO: 1038704 - DNA, 22 bp, Artificial Sequence
  chemically synthesized
agacctactgggctgcattccc

SEQ ID NO: 1038705 - DNA, 22 bp, Artificial Sequence
  chemically synthesized
agaatgcccaacctcctgggaa

SEQ ID NO: 1038706 - DNA, 22 bp, Artificial Sequence
  chemically synthesized
ctgggctgcattcccaggaggt

SEQ ID NO: 1038707 - DNA, 22 bp, Artificial Sequence
  chemically synthesized
ggctgcattcccaggaggttgg

SEQ ID NO: 1038708 - DNA, 22 bp, Artificial Sequence
  chemically synthesized
tgactaagaatgcccaacctcc

SEQ ID NO: 1038709 - DNA, 22 bp, Artificial Sequence
  chemically synthesized
cattcccaggaggttgggcatt

SEQ ID NO: 1038710 - DNA, 22 bp, Artificial Sequence
  chemically synthesized
atcctgtgactaagaatgccca

SEQ ID NO: 1038711 - DNA, 22 bp, Artificial Sequence
  chemically synthesized
ccaggaggttgggcattcttag

SEQ ID NO: 1038712 - DNA, 22 bp, Artificial Sequence
  chemically synthesized
tctcatcctgtgactaagaatg

SEQ ID NO: 1038713 - DNA, 22 bp, Artificial Sequence
  chemically synthesized
atctcatcctgtgactaagaat

SEQ ID NO: 1038714 - DNA, 22 bp, Artificial Sequence
  chemically synthesized
ttatctcatcctgtgactaaga

SEQ ID NO: 1038715 - DNA, 22 bp, Artificial Sequence
  chemically synthesized
gcctcttatctcatcctgtgac

SEQ ID NO: 1038716 - DNA, 22 bp, Artificial Sequence
  chemically synthesized
ggcattcttagtcacaggatga

SEQ ID NO: 1038717 - DNA, 22 bp, Artificial Sequence
  chemically synthesized
tggcctcttatctcatcctgtg

SEQ ID NO: 1038718 - DNA, 22 bp, Artificial Sequence
  chemically synthesized
ttctggcctcttatctcatcct

SEQ ID NO: 1038719 - DNA, 22 bp, Artificial Sequence
  chemically synthesized
gttctggcctcttatctcatcc

SEQ ID NO: 1038720 - DNA, 22 bp, Artificial Sequence
  chemically synthesized
ttagtcacaggatgagataaga

SEQ ID NO: 1038721 - DNA, 22 bp, Artificial Sequence
  chemically synthesized
agtcacaggatgagataagagg

SEQ ID NO: 1038722 - DNA, 22 bp, Artificial Sequence
  chemically synthesized
gtcacaggatgagataagaggc

SEQ ID NO: 1038723 - DNA, 22 bp, Artificial Sequence
  chemically synthesized
tgacccgtatcttgttctggcc

SEQ ID NO: 1038724 - DNA, 22 bp, Artificial Sequence
  chemically synthesized
gtgacccgtatcttgttctggc

SEQ ID NO: 1038725 - DNA, 22 bp, Artificial Sequence
  chemically synthesized
tgtgacccgtatcttgttctgg

SEQ ID NO: 1038726 - DNA, 22 bp, Artificial Sequence
  chemically synthesized
tcagcaaggtctttgtgacccg

SEQ ID NO: 1038727 - DNA, 22 bp, Artificial Sequence
  chemically synthesized
atcagcaaggtctttgtgaccc

SEQ ID NO: 1038728 - DNA, 22 bp, Artificial Sequence
  chemically synthesized
tatcagcaaggtctttgtgacc

SEQ ID NO: 1038729 - DNA, 22 bp, Artificial Sequence
  chemically synthesized
ctttatcagcaaggtctttgtg

SEQ ID NO: 1038730 - DNA, 22 bp, Artificial Sequence
  chemically synthesized
cagcaacctgctttatcagcaa

SEQ ID NO: 1038731 - DNA, 22 bp, Artificial Sequence
  chemically synthesized
acagcaacctgctttatcagca

SEQ ID NO: 1038732 - DNA, 22 bp, Artificial Sequence
  chemically synthesized
tttacagcaacctgctttatca

SEQ ID NO: 1038733 - DNA, 22 bp, Artificial Sequence
  chemically synthesized
atttacagcaacctgctttatc

SEQ ID NO: 1038734 - DNA, 22 bp, Artificial Sequence
  chemically synthesized
gcttatttacagcaacctgctt

SEQ ID NO: 1038735 - DNA, 22 bp, Artificial Sequence
  chemically synthesized
actagcttatttacagcaacct

SEQ ID NO: 1038736 - DNA, 22 bp, Artificial Sequence
  chemically synthesized
gctgataaagcaggttgctgta

SEQ ID NO: 1038737 - DNA, 22 bp, Artificial Sequence
  chemically synthesized
gactagcttatttacagcaacc

SEQ ID NO: 1038738 - DNA, 22 bp, Artificial Sequence
  chemically synthesized
ctgataaagcaggttgctgtaa

SEQ ID NO: 1038739 - DNA, 22 bp, Artificial Sequence
  chemically synthesized
tgactagcttatttacagcaac

SEQ ID NO: 1038740 - DNA, 22 bp, Artificial Sequence
  chemically synthesized
ataaagcaggttgctgtaaata

SEQ ID NO: 1038741 - DNA, 22 bp, Artificial Sequence
  chemically synthesized
gtgggttttgactagcttattt

SEQ ID NO: 1038742 - DNA, 22 bp, Artificial Sequence
  chemically synthesized
ggtgggttttgactagcttatt

SEQ ID NO: 1038743 - DNA, 22 bp, Artificial Sequence
  chemically synthesized
tggtgggttttgactagcttat

SEQ ID NO: 1038744 - DNA, 22 bp, Artificial Sequence
  chemically synthesized
gttttggtgggttttgactagc

SEQ ID NO: 1038745 - DNA, 22 bp, Artificial Sequence
  chemically synthesized
ggttttggtgggttttgactag

SEQ ID NO: 1038746 - DNA, 22 bp, Artificial Sequence
  chemically synthesized
ctgtaaataagctagtcaaaac

SEQ ID NO: 1038747 - DNA, 22 bp, Artificial Sequence
  chemically synthesized
taaataagctagtcaaaaccca

SEQ ID NO: 1038748 - DNA, 22 bp, Artificial Sequence
  chemically synthesized
accagcttggttttggtgggtt

SEQ ID NO: 1038749 - DNA, 22 bp, Artificial Sequence
  chemically synthesized
caccagcttggttttggtgggt

SEQ ID NO: 1038750 - DNA, 22 bp, Artificial Sequence
  chemically synthesized
tcaccagcttggttttggtggg

SEQ ID NO: 1038751 - DNA, 22 bp, Artificial Sequence
  chemically synthesized
ttcaccagcttggttttggtgg

SEQ ID NO: 1038752 - DNA, 22 bp, Artificial Sequence
  chemically synthesized
tttcaccagcttggttttggtg

SEQ ID NO: 1038753 - DNA, 22 bp, Artificial Sequence
  chemically synthesized
ttttcaccagcttggttttggt

SEQ ID NO: 1038754 - DNA, 22 bp, Artificial Sequence
  chemically synthesized
gtcaaaacccaccaaaaccaag

SEQ ID NO: 1038755 - DNA, 22 bp, Artificial Sequence
  chemically synthesized
gtgaaaaaagtgacctctggtc

SEQ ID NO: 1038756 - DNA, 22 bp, Artificial Sequence
  chemically synthesized
gtgtataatgagcagtgagaag

SEQ ID NO: 1038757 - DNA, 22 bp, Artificial Sequence
  chemically synthesized
taattagtgtataatgagcagt

SEQ ID NO: 1038758 - DNA, 22 bp, Artificial Sequence
  chemically synthesized
tggtccttctcactgctcatta

SEQ ID NO: 1038759 - DNA, 22 bp, Artificial Sequence
  chemically synthesized
gtccttctcactgctcattata

SEQ ID NO: 1038760 - DNA, 22 bp, Artificial Sequence
  chemically synthesized
atgcattataattagtgtataa

SEQ ID NO: 1038761 - DNA, 22 bp, Artificial Sequence
  chemically synthesized
ctcactgctcattatacactaa

SEQ ID NO: 1038762 - DNA, 22 bp, Artificial Sequence
  chemically synthesized
tcactgctcattatacactaat

SEQ ID NO: 1038763 - DNA, 22 bp, Artificial Sequence
  chemically synthesized
ctaatgcattataattagtgta

SEQ ID NO: 1038764 - DNA, 22 bp, Artificial Sequence
  chemically synthesized
actgctcattatacactaatta

SEQ ID NO: 1038765 - DNA, 22 bp, Artificial Sequence
  chemically synthesized
ctcattatacactaattataat

SEQ ID NO: 1038766 - DNA, 22 bp, Artificial Sequence
  chemically synthesized
gcctgctaatgcattataatta

SEQ ID NO: 1038767 - DNA, 22 bp, Artificial Sequence
  chemically synthesized
agcctgctaatgcattataatt

SEQ ID NO: 1038768 - DNA, 22 bp, Artificial Sequence
  chemically synthesized
tagcctgctaatgcattataat

SEQ ID NO: 1038769 - DNA, 22 bp, Artificial Sequence
  chemically synthesized
attatacactaattataatgca

SEQ ID NO: 1038770 - DNA, 22 bp, Artificial Sequence
  chemically synthesized
ttagcctgctaatgcattataa

SEQ ID NO: 1038771 - DNA, 22 bp, Artificial Sequence
  chemically synthesized
tacactaattataatgcattag

SEQ ID NO: 1038772 - DNA, 22 bp, Artificial Sequence
  chemically synthesized
ggagtgtcttttagcctgctaa

SEQ ID NO: 1038773 - DNA, 22 bp, Artificial Sequence
  chemically synthesized
attataatgcattagcaggcta

SEQ ID NO: 1038774 - DNA, 22 bp, Artificial Sequence
  chemically synthesized
ctaggagtgtcttttagcctgc

SEQ ID NO: 1038775 - DNA, 22 bp, Artificial Sequence
  chemically synthesized
taatgcattagcaggctaaaag

SEQ ID NO: 1038776 - DNA, 22 bp, Artificial Sequence
  chemically synthesized
tcatggcactgctaggagtgtc

SEQ ID NO: 1038777 - DNA, 22 bp, Artificial Sequence
  chemically synthesized
gcaggctaaaagacactcctag

SEQ ID NO: 1038778 - DNA, 22 bp, Artificial Sequence
  chemically synthesized
taacctgtcatggcactgctag

SEQ ID NO: 1038779 - DNA, 22 bp, Artificial Sequence
  chemically synthesized
gtaacctgtcatggcactgcta

SEQ ID NO: 1038780 - DNA, 22 bp, Artificial Sequence
  chemically synthesized
aaagacactcctagcagtgcca

SEQ ID NO: 1038781 - DNA, 22 bp, Artificial Sequence
  chemically synthesized
ccatgcatttgtaacctgtcat

SEQ ID NO: 1038782 - DNA, 22 bp, Artificial Sequence
  chemically synthesized
ctagcagtgccatgacaggtta

SEQ ID NO: 1038783 - DNA, 22 bp, Artificial Sequence
  chemically synthesized
gcagtgccatgacaggttacaa

SEQ ID NO: 1038784 - DNA, 22 bp, Artificial Sequence
  chemically synthesized
acattgccatgcatttgtaacc

SEQ ID NO: 1038785 - DNA, 22 bp, Artificial Sequence
  chemically synthesized
gacattgccatgcatttgtaac

SEQ ID NO: 1038786 - DNA, 22 bp, Artificial Sequence
  chemically synthesized
ttgacattgccatgcatttgta

SEQ ID NO: 1038787 - DNA, 22 bp, Artificial Sequence
  chemically synthesized
cttgacattgccatgcatttgt

SEQ ID NO: 1038788 - DNA, 22 bp, Artificial Sequence
  chemically synthesized
ggtaacttcttgacattgccat

SEQ ID NO: 1038789 - DNA, 22 bp, Artificial Sequence
  chemically synthesized
caaatgcatggcaatgtcaaga

SEQ ID NO: 1038790 - DNA, 22 bp, Artificial Sequence
  chemically synthesized
gaccatattgggtaacttcttg

SEQ ID NO: 1038791 - DNA, 22 bp, Artificial Sequence
  chemically synthesized
agaccatattgggtaacttctt

SEQ ID NO: 1038792 - DNA, 22 bp, Artificial Sequence
  chemically synthesized
tagaccatattgggtaacttct

SEQ ID NO: 1038793 - DNA, 22 bp, Artificial Sequence
  chemically synthesized
ccattttagaccatattgggta

SEQ ID NO: 1038794 - DNA, 22 bp, Artificial Sequence
  chemically synthesized
tcccattttagaccatattggg

SEQ ID NO: 1038795 - DNA, 22 bp, Artificial Sequence
  chemically synthesized
ctcccattttagaccatattgg

SEQ ID NO: 1038796 - DNA, 22 bp, Artificial Sequence
  chemically synthesized
agggtttctcccattttagacc

SEQ ID NO: 1038797 - DNA, 22 bp, Artificial Sequence
  chemically synthesized
cccaatatggtctaaaatggga

SEQ ID NO: 1038798 - DNA, 22 bp, Artificial Sequence
  chemically synthesized
gaactgagggtttctcccattt

SEQ ID NO: 1038799 - DNA, 22 bp, Artificial Sequence
  chemically synthesized
ctagaactgagggtttctccca

SEQ ID NO: 1038800 - DNA, 22 bp, Artificial Sequence
  chemically synthesized
aaatgggagaaaccctcagttc

SEQ ID NO: 1038801 - DNA, 22 bp, Artificial Sequence
  chemically synthesized
ggaaaaggagtcagcaattcct

SEQ ID NO: 1038802 - DNA, 22 bp, Artificial Sequence
  chemically synthesized
tgggaaaaggagtcagcaattc

SEQ ID NO: 1038803 - DNA, 22 bp, Artificial Sequence
  chemically synthesized
ctgggaaaaggagtcagcaatt

SEQ ID NO: 1038804 - DNA, 22 bp, Artificial Sequence
  chemically synthesized
tctgggaaaaggagtcagcaat

SEQ ID NO: 1038805 - DNA, 22 bp, Artificial Sequence
  chemically synthesized
agttctaggaattgctgactcc

SEQ ID NO: 1038806 - DNA, 22 bp, Artificial Sequence
  chemically synthesized
taggaattgctgactccttttc

SEQ ID NO: 1038807 - DNA, 22 bp, Artificial Sequence
  chemically synthesized
atgagttttctgggaaaaggag

SEQ ID NO: 1038808 - DNA, 22 bp, Artificial Sequence
  chemically synthesized
ggaattgctgactccttttccc

SEQ ID NO: 1038809 - DNA, 22 bp, Artificial Sequence
  chemically synthesized
ttcatgagttttctgggaaaag

SEQ ID NO: 1038810 - DNA, 22 bp, Artificial Sequence
  chemically synthesized
ctgactccttttcccagaaaac

SEQ ID NO: 1038811 - DNA, 22 bp, Artificial Sequence
  chemically synthesized
actccttttcccagaaaactca

SEQ ID NO: 1038812 - DNA, 22 bp, Artificial Sequence
  chemically synthesized
cttttcccagaaaactcatgaa

SEQ ID NO: 1038813 - DNA, 22 bp, Artificial Sequence
  chemically synthesized
ttcccagaaaactcatgaataa

SEQ ID NO: 1038814 - DNA, 22 bp, Artificial Sequence
  chemically synthesized
tcccagaaaactcatgaataat

SEQ ID NO: 1038815 - DNA, 22 bp, Artificial Sequence
  chemically synthesized
aacaaggggtggattattcatg

SEQ ID NO: 1038816 - DNA, 22 bp, Artificial Sequence
  chemically synthesized
cccagaaaactcatgaataatc

SEQ ID NO: 1038817 - DNA, 22 bp, Artificial Sequence
  chemically synthesized
ccagaaaactcatgaataatcc

SEQ ID NO: 1038818 - DNA, 22 bp, Artificial Sequence
  chemically synthesized
tatgctaaacaaggggtggatt

SEQ ID NO: 1038819 - DNA, 22 bp, Artificial Sequence
  chemically synthesized
attatatgctaaacaaggggtg

SEQ ID NO: 1038820 - DNA, 22 bp, Artificial Sequence
  chemically synthesized
gattatatgctaaacaaggggt

SEQ ID NO: 1038821 - DNA, 22 bp, Artificial Sequence
  chemically synthesized
atgaataatccaccccttgttt

SEQ ID NO: 1038822 - DNA, 22 bp, Artificial Sequence
  chemically synthesized
ttgattatatgctaaacaaggg

SEQ ID NO: 1038823 - DNA, 22 bp, Artificial Sequence
  chemically synthesized
cttgattatatgctaaacaagg

SEQ ID NO: 1038824 - DNA, 22 bp, Artificial Sequence
  chemically synthesized
tttcttgattatatgctaaaca

SEQ ID NO: 1038825 - DNA, 22 bp, Artificial Sequence
  chemically synthesized
tagttatttcttgattatatgc

SEQ ID NO: 1038826 - DNA, 22 bp, Artificial Sequence
  chemically synthesized
gtagttatttcttgattatatg

SEQ ID NO: 1038827 - DNA, 22 bp, Artificial Sequence
  chemically synthesized
gtttagcatataatcaagaaat

SEQ ID NO: 1038828 - DNA, 22 bp, Artificial Sequence
  chemically synthesized
tttagcatataatcaagaaata

SEQ ID NO: 1038829 - DNA, 22 bp, Artificial Sequence
  chemically synthesized
aggatacttgtagttatttctt

SEQ ID NO: 1038830 - DNA, 22 bp, Artificial Sequence
  chemically synthesized
agcatataatcaagaaataact

SEQ ID NO: 1038831 - DNA, 22 bp, Artificial Sequence
  chemically synthesized
gcatataatcaagaaataacta

SEQ ID NO: 1038832 - DNA, 22 bp, Artificial Sequence
  chemically synthesized
actcaggatacttgtagttatt

SEQ ID NO: 1038833 - DNA, 22 bp, Artificial Sequence
  chemically synthesized
gactcaggatacttgtagttat

SEQ ID NO: 1038834 - DNA, 22 bp, Artificial Sequence
  chemically synthesized
cttgactcaggatacttgtagt

SEQ ID NO: 1038835 - DNA, 22 bp, Artificial Sequence
  chemically synthesized
caagtatcctgagtcaagcagc

SEQ ID NO: 1038836 - DNA, 22 bp, Artificial Sequence
  chemically synthesized
cgtaggcagtgcagtggcatgg

SEQ ID NO: 1038837 - DNA, 22 bp, Artificial Sequence
  chemically synthesized
agtcaagcagcccatgccactg

SEQ ID NO: 1038838 - DNA, 22 bp, Artificial Sequence
  chemically synthesized
cactgcctacggagtggccatt

SEQ ID NO: 1038839 - DNA, 22 bp, Artificial Sequence
  chemically synthesized
cctacggagtggccattcttta

SEQ ID NO: 1038840 - DNA, 22 bp, Artificial Sequence
  chemically synthesized
agaaagtaaaggaataaagaat

SEQ ID NO: 1038841 - DNA, 22 bp, Artificial Sequence
  chemically synthesized
cggagtggccattctttattcc

SEQ ID NO: 1038842 - DNA, 22 bp, Artificial Sequence
  chemically synthesized
ttaagaaagtaaaggaataaag

SEQ ID NO: 1038843 - DNA, 22 bp, Artificial Sequence
  chemically synthesized
attaagaaagtaaaggaataaa

SEQ ID NO: 1038844 - DNA, 22 bp, Artificial Sequence
  chemically synthesized
tttattcctttactttcttaat

SEQ ID NO: 1038845 - DNA, 22 bp, Artificial Sequence
  chemically synthesized
tattcctttactttcttaataa

SEQ ID NO: 1038846 - DNA, 22 bp, Artificial Sequence
  chemically synthesized
attcctttactttcttaataaa

SEQ ID NO: 1038847 - DNA, 22 bp, Artificial Sequence
  chemically synthesized
ttcctttactttcttaataaac

SEQ ID NO: 1038848 - DNA, 22 bp, Artificial Sequence
  chemically synthesized
ctttactttcttaataaacttg

SEQ ID NO: 1038849 - DNA, 22 bp, Artificial Sequence
  chemically synthesized
aaaaaagtaaaagcaagtttat

SEQ ID NO: 1038850 - DNA, 22 bp, Artificial Sequence
  chemically synthesized
aaaaaaagtaaaagcaagttta

SEQ ID NO: 1038851 - DNA, 22 bp, Artificial Sequence
  chemically synthesized
tactttcttaataaacttgctt

SEQ ID NO: 1038852 - DNA, 22 bp, Artificial Sequence
  chemically synthesized
taaaaaaagtaaaagcaagttt

SEQ ID NO: 1038853 - DNA, 22 bp, Artificial Sequence
  chemically synthesized
actttcttaataaacttgcttt

SEQ ID NO: 1038854 - DNA, 22 bp, Artificial Sequence
  chemically synthesized
ttaaaaaaagtaaaagcaagtt

SEQ ID NO: 1038855 - DNA, 22 bp, Artificial Sequence
  chemically synthesized
ctttcttaataaacttgctttt

SEQ ID NO: 1038856 - DNA, 22 bp, Artificial Sequence
  chemically synthesized
tttaaaaaaagtaaaagcaagt

SEQ ID NO: 1038857 - DNA, 22 bp, Artificial Sequence
  chemically synthesized
ttttaaaaaaagtaaaagcaag

SEQ ID NO: 1038858 - DNA, 22 bp, Artificial Sequence
  chemically synthesized
tcttaataaacttgcttttact

SEQ ID NO: 1038859 - DNA, 22 bp, Artificial Sequence
  chemically synthesized
cttaataaacttgcttttactt

SEQ ID NO: 1038860 - DNA, 22 bp, Artificial Sequence
  chemically synthesized
ttaataaacttgcttttacttt

SEQ ID NO: 1038861 - DNA, 22 bp, Artificial Sequence
  chemically synthesized
tgcttttttaaaaaaagtaaaa

SEQ ID NO: 1038862 - DNA, 22 bp, Artificial Sequence
  chemically synthesized
aataaacttgcttttacttttt

SEQ ID NO: 1038863 - DNA, 22 bp, Artificial Sequence
  chemically synthesized
ataaacttgcttttactttttt

SEQ ID NO: 1038864 - DNA, 22 bp, Artificial Sequence
  chemically synthesized
gcttttactttttttaaaaaag

SEQ ID NO: 1038865 - DNA, 22 bp, Artificial Sequence
  chemically synthesized
cttttactttttttaaaaaagc

SEQ ID NO: 1038866 - DNA, 22 bp, Artificial Sequence
  chemically synthesized
ttactttttttaaaaaagcata

SEQ ID NO: 1038867 - DNA, 22 bp, Artificial Sequence
  chemically synthesized
tactttttttaaaaaagcataa

SEQ ID NO: 1038868 - DNA, 22 bp, Artificial Sequence
  chemically synthesized
actttttttaaaaaagcataat

SEQ ID NO: 1038869 - DNA, 22 bp, Artificial Sequence
  chemically synthesized
ctttttttaaaaaagcataatc

SEQ ID NO: 1038870 - DNA, 22 bp, Artificial Sequence
  chemically synthesized
taggtcatagtgaagattatgc

SEQ ID NO: 1038871 - DNA, 22 bp, Artificial Sequence
  chemically synthesized
tttttaaaaaagcataatcttc

SEQ ID NO: 1038872 - DNA, 22 bp, Artificial Sequence
  chemically synthesized
ataggtcatagtgaagattatg

SEQ ID NO: 1038873 - DNA, 22 bp, Artificial Sequence
  chemically synthesized
ttttaaaaaagcataatcttca

SEQ ID NO: 1038874 - DNA, 22 bp, Artificial Sequence
  chemically synthesized
tttaaaaaagcataatcttcac

SEQ ID NO: 1038875 - DNA, 22 bp, Artificial Sequence
  chemically synthesized
ttaaaaaagcataatcttcact

SEQ ID NO: 1038876 - DNA, 22 bp, Artificial Sequence
  chemically synthesized
taaaaaagcataatcttcacta

SEQ ID NO: 1038877 - DNA, 22 bp, Artificial Sequence
  chemically synthesized
aaaaaagcataatcttcactat

SEQ ID NO: 1038878 - DNA, 22 bp, Artificial Sequence
  chemically synthesized
aaaaagcataatcttcactatg

SEQ ID NO: 1038879 - DNA, 22 bp, Artificial Sequence
  chemically synthesized
cactatgacctataaatctcta

SEQ ID NO: 1038880 - DNA, 22 bp, Artificial Sequence
  chemically synthesized
actatgacctataaatctctac

SEQ ID NO: 1038881 - DNA, 22 bp, Artificial Sequence
  chemically synthesized
tgacctataaatctctacatga

SEQ ID NO: 1038882 - DNA, 22 bp, Artificial Sequence
  chemically synthesized
taaatctctacatgacttggtt

SEQ ID NO: 1038883 - DNA, 22 bp, Artificial Sequence
  chemically synthesized
gaatggtaggtagtatacaacc

SEQ ID NO: 1038884 - DNA, 22 bp, Artificial Sequence
  chemically synthesized
ggaatggtaggtagtatacaac

SEQ ID NO: 1038885 - DNA, 22 bp, Artificial Sequence
  chemically synthesized
tacatgacttggttgtatacta

SEQ ID NO: 1038886 - DNA, 22 bp, Artificial Sequence
  chemically synthesized
catgacttggttgtatactacc

SEQ ID NO: 1038887 - DNA, 22 bp, Artificial Sequence
  chemically synthesized
ggttgtatactacctaccattc

SEQ ID NO: 1038888 - DNA, 22 bp, Artificial Sequence
  chemically synthesized
gttgtatactacctaccattcc

SEQ ID NO: 1038889 - DNA, 22 bp, Artificial Sequence
  chemically synthesized
ggaagagatgagcttggaatgg

SEQ ID NO: 1038890 - DNA, 22 bp, Artificial Sequence
  chemically synthesized
tatactacctaccattccaagc

SEQ ID NO: 1038891 - DNA, 22 bp, Artificial Sequence
  chemically synthesized
cctaccattccaagctcatctc

SEQ ID NO: 1038892 - DNA, 22 bp, Artificial Sequence
  chemically synthesized
tgaagagactgggaagagatga

SEQ ID NO: 1038893 - DNA, 22 bp, Artificial Sequence
  chemically synthesized
ccattccaagctcatctcttcc

SEQ ID NO: 1038894 - DNA, 22 bp, Artificial Sequence
  chemically synthesized
caagctcatctcttcccagtct

SEQ ID NO: 1038895 - DNA, 22 bp, Artificial Sequence
  chemically synthesized
tggactatgaagagactgggaa

SEQ ID NO: 1038896 - DNA, 22 bp, Artificial Sequence
  chemically synthesized
atctcttcccagtctcttcata

SEQ ID NO: 1038897 - DNA, 22 bp, Artificial Sequence
  chemically synthesized
ttcccagtctcttcatagtcca

SEQ ID NO: 1038898 - DNA, 22 bp, Artificial Sequence
  chemically synthesized
cccagtctcttcatagtccaca

SEQ ID NO: 1038899 - DNA, 22 bp, Artificial Sequence
  chemically synthesized
ccagtctcttcatagtccacaa

SEQ ID NO: 1038900 - DNA, 22 bp, Artificial Sequence
  chemically synthesized
atgagggtgaagtgttgtggac

SEQ ID NO: 1038901 - DNA, 22 bp, Artificial Sequence
  chemically synthesized
ttcatagtccacaacacttcac

SEQ ID NO: 1038902 - DNA, 22 bp, Artificial Sequence
  chemically synthesized
catagtccacaacacttcaccc

SEQ ID NO: 1038903 - DNA, 22 bp, Artificial Sequence
  chemically synthesized
atagtccacaacacttcaccct

SEQ ID NO: 1038904 - DNA, 22 bp, Artificial Sequence
  chemically synthesized
aagtaatgcaataaacctaatg

SEQ ID NO: 1038905 - DNA, 22 bp, Artificial Sequence
  chemically synthesized
tactcaagtaatgcaataaacc

SEQ ID NO: 1038906 - DNA, 22 bp, Artificial Sequence
  chemically synthesized
caccctcattaggtttattgca

SEQ ID NO: 1038907 - DNA, 22 bp, Artificial Sequence
  chemically synthesized
accctcattaggtttattgcat

SEQ ID NO: 1038908 - DNA, 22 bp, Artificial Sequence
  chemically synthesized
ttatactcaagtaatgcaataa

SEQ ID NO: 1038909 - DNA, 22 bp, Artificial Sequence
  chemically synthesized
attaggtttattgcattacttg

SEQ ID NO: 1038910 - DNA, 22 bp, Artificial Sequence
  chemically synthesized
ggtttattgcattacttgagta

SEQ ID NO: 1038911 - DNA, 22 bp, Artificial Sequence
  chemically synthesized
attgcattacttgagtataaca

SEQ ID NO: 1038912 - DNA, 22 bp, Artificial Sequence
  chemically synthesized
ttgcattacttgagtataacaa

SEQ ID NO: 1038913 - DNA, 22 bp, Artificial Sequence
  chemically synthesized
aagcaagaatgtagttgttata

SEQ ID NO: 1038914 - DNA, 22 bp, Artificial Sequence
  chemically synthesized
cattacttgagtataacaacta

SEQ ID NO: 1038915 - DNA, 22 bp, Artificial Sequence
  chemically synthesized
gaagcaagaatgtagttgttat

SEQ ID NO: 1038916 - DNA, 22 bp, Artificial Sequence
  chemically synthesized
cttgagtataacaactacattc

SEQ ID NO: 1038917 - DNA, 22 bp, Artificial Sequence
  chemically synthesized
gagtataacaactacattcttg

SEQ ID NO: 1038918 - DNA, 22 bp, Artificial Sequence
  chemically synthesized
agtataacaactacattcttgc

SEQ ID NO: 1038919 - DNA, 22 bp, Artificial Sequence
  chemically synthesized
cattcttgcttcaagatttctg

SEQ ID NO: 1038920 - DNA, 22 bp, Artificial Sequence
  chemically synthesized
ttgcttcaagatttctgccctt

SEQ ID NO: 1038921 - DNA, 22 bp, Artificial Sequence
  chemically synthesized
gcttcaagatttctgcccttgc

SEQ ID NO: 1038922 - DNA, 22 bp, Artificial Sequence
  chemically synthesized
gcaggtagaacagcaagggcag

SEQ ID NO: 1038923 - DNA, 22 bp, Artificial Sequence
  chemically synthesized
cttcaagatttctgcccttgct

SEQ ID NO: 1038924 - DNA, 22 bp, Artificial Sequence
  chemically synthesized
ggcaggtagaacagcaagggca

SEQ ID NO: 1038925 - DNA, 22 bp, Artificial Sequence
  chemically synthesized
tggcaggtagaacagcaagggc

SEQ ID NO: 1038926 - DNA, 22 bp, Artificial Sequence
  chemically synthesized
ttggcaggtagaacagcaaggg

SEQ ID NO: 1038927 - DNA, 22 bp, Artificial Sequence
  chemically synthesized
caagatttctgcccttgctgtt

SEQ ID NO: 1038928 - DNA, 22 bp, Artificial Sequence
  chemically synthesized
aagatttctgcccttgctgttc

SEQ ID NO: 1038929 - DNA, 22 bp, Artificial Sequence
  chemically synthesized
tttttggcaggtagaacagcaa

SEQ ID NO: 1038930 - DNA, 22 bp, Artificial Sequence
  chemically synthesized
ctgcccttgctgttctacctgc

SEQ ID NO: 1038931 - DNA, 22 bp, Artificial Sequence
  chemically synthesized
tgcccttgctgttctacctgcc

SEQ ID NO: 1038932 - DNA, 22 bp, Artificial Sequence
  chemically synthesized
cccttgctgttctacctgccaa

SEQ ID NO: 1038933 - DNA, 22 bp, Artificial Sequence
  chemically synthesized
ggaaaactatttttggcaggta

SEQ ID NO: 1038934 - DNA, 22 bp, Artificial Sequence
  chemically synthesized
gctgttctacctgccaaaaata

SEQ ID NO: 1038935 - DNA, 22 bp, Artificial Sequence
  chemically synthesized
ctgttctacctgccaaaaatag

SEQ ID NO: 1038936 - DNA, 22 bp, Artificial Sequence
  chemically synthesized
ttctacctgccaaaaatagttt

SEQ ID NO: 1038937 - DNA, 22 bp, Artificial Sequence
  chemically synthesized
tacctgccaaaaatagttttcc

SEQ ID NO: 1038938 - DNA, 22 bp, Artificial Sequence
  chemically synthesized
cctgccaaaaatagttttccta

SEQ ID NO: 1038939 - DNA, 22 bp, Artificial Sequence
  chemically synthesized
atagaaatgtgggttaggaaaa

SEQ ID NO: 1038940 - DNA, 22 bp, Artificial Sequence
  chemically synthesized
ccaaaaatagttttcctaaccc

SEQ ID NO: 1038941 - DNA, 22 bp, Artificial Sequence
  chemically synthesized
tcctaacccacatttctatcag

SEQ ID NO: 1038942 - DNA, 22 bp, Artificial Sequence
  chemically synthesized
cctaacccacatttctatcagt

SEQ ID NO: 1038943 - DNA, 22 bp, Artificial Sequence
  chemically synthesized
ctaacccacatttctatcagtg

SEQ ID NO: 1038944 - DNA, 22 bp, Artificial Sequence
  chemically synthesized
acccacatttctatcagtggtt

SEQ ID NO: 1038945 - DNA, 22 bp, Artificial Sequence
  chemically synthesized
acgtgagaaagaagtaagggaa

SEQ ID NO: 1038946 - DNA, 22 bp, Artificial Sequence
  chemically synthesized
aacgtgagaaagaagtaaggga

SEQ ID NO: 1038947 - DNA, 22 bp, Artificial Sequence
  chemically synthesized
ctatcagtggttcccttacttc

SEQ ID NO: 1038948 - DNA, 22 bp, Artificial Sequence
  chemically synthesized
taacgtgagaaagaagtaaggg

SEQ ID NO: 1038949 - DNA, 22 bp, Artificial Sequence
  chemically synthesized
tatcagtggttcccttacttct

SEQ ID NO: 1038950 - DNA, 22 bp, Artificial Sequence
  chemically synthesized
tcagtggttcccttacttcttt

SEQ ID NO: 1038951 - DNA, 22 bp, Artificial Sequence
  chemically synthesized
ccttacttctttctcacgttaa

SEQ ID NO: 1038952 - DNA, 22 bp, Artificial Sequence
  chemically synthesized
acttctttctcacgttaaaggg

SEQ ID NO: 1038953 - DNA, 22 bp, Artificial Sequence
  chemically synthesized
cttctttctcacgttaaagggg

SEQ ID NO: 1038954 - DNA, 22 bp, Artificial Sequence
  chemically synthesized
ctttctcacgttaaaggggcct

SEQ ID NO: 1038955 - DNA, 22 bp, Artificial Sequence
  chemically synthesized
tttctcacgttaaaggggcctt

SEQ ID NO: 1038956 - DNA, 22 bp, Artificial Sequence
  chemically synthesized
tctcacgttaaaggggccttct

SEQ ID NO: 1038957 - DNA, 22 bp, Artificial Sequence
  chemically synthesized
ctcacgttaaaggggccttctc

SEQ ID NO: 1038958 - DNA, 22 bp, Artificial Sequence
  chemically synthesized
tcacgttaaaggggccttctct

SEQ ID NO: 1038959 - DNA, 22 bp, Artificial Sequence
  chemically synthesized
aaatagagtagtagagaaggcc

SEQ ID NO: 1038960 - DNA, 22 bp, Artificial Sequence
  chemically synthesized
aaaatagagtagtagagaaggc

SEQ ID NO: 1038961 - DNA, 22 bp, Artificial Sequence
  chemically synthesized
acgttaaaggggccttctctac

SEQ ID NO: 1038962 - DNA, 22 bp, Artificial Sequence
  chemically synthesized
tttaaaatagagtagtagagaa

SEQ ID NO: 1038963 - DNA, 22 bp, Artificial Sequence
  chemically synthesized
aaggggccttctctactactct

SEQ ID NO: 1038964 - DNA, 22 bp, Artificial Sequence
  chemically synthesized
gtgctatttaaaatagagtagt

SEQ ID NO: 1038965 - DNA, 22 bp, Artificial Sequence
  chemically synthesized
ctggtgctatttaaaatagagt

SEQ ID NO: 1038966 - DNA, 22 bp, Artificial Sequence
  chemically synthesized
ctctactactctattttaaata

SEQ ID NO: 1038967 - DNA, 22 bp, Artificial Sequence
  chemically synthesized
tctactactctattttaaatag

SEQ ID NO: 1038968 - DNA, 22 bp, Artificial Sequence
  chemically synthesized
tactactctattttaaatagca

SEQ ID NO: 1038969 - DNA, 22 bp, Artificial Sequence
  chemically synthesized
ctactctattttaaatagcacc

SEQ ID NO: 1038970 - DNA, 22 bp, Artificial Sequence
  chemically synthesized
ctctattttaaatagcaccagc

SEQ ID NO: 1038971 - DNA, 22 bp, Artificial Sequence
  chemically synthesized
tattttaaatagcaccagcaat

SEQ ID NO: 1038972 - DNA, 22 bp, Artificial Sequence
  chemically synthesized
ttttaaatagcaccagcaatca

SEQ ID NO: 1038973 - DNA, 22 bp, Artificial Sequence
  chemically synthesized
taaatagcaccagcaatcactc

SEQ ID NO: 1038974 - DNA, 22 bp, Artificial Sequence
  chemically synthesized
aaatagcaccagcaatcactct

SEQ ID NO: 1038975 - DNA, 22 bp, Artificial Sequence
  chemically synthesized
aatagcaccagcaatcactctt

SEQ ID NO: 1038976 - DNA, 22 bp, Artificial Sequence
  chemically synthesized
taaagaaaagggaagagtaatg

SEQ ID NO: 1038977 - DNA, 22 bp, Artificial Sequence
  chemically synthesized
tttattcctggcattactcttc

SEQ ID NO: 1038978 - DNA, 22 bp, Artificial Sequence
  chemically synthesized
tattcctggcattactcttccc

SEQ ID NO: 1038979 - DNA, 22 bp, Artificial Sequence
  chemically synthesized
attcctggcattactcttccct

SEQ ID NO: 1038980 - DNA, 22 bp, Artificial Sequence
  chemically synthesized
ttcctggcattactcttccctt

SEQ ID NO: 1038981 - DNA, 22 bp, Artificial Sequence
  chemically synthesized
ctggcattactcttcccttttc

SEQ ID NO: 1038982 - DNA, 22 bp, Artificial Sequence
  chemically synthesized
gcattactcttcccttttcttt

SEQ ID NO: 1038983 - DNA, 22 bp, Artificial Sequence
  chemically synthesized
gtaataagtactataaagaaaa

SEQ ID NO: 1038984 - DNA, 22 bp, Artificial Sequence
  chemically synthesized
ctcttcccttttctttatagta

SEQ ID NO: 1038985 - DNA, 22 bp, Artificial Sequence
  chemically synthesized
atgttagtaataagtactataa

SEQ ID NO: 1038986 - DNA, 22 bp, Artificial Sequence
  chemically synthesized
ttcccttttctttatagtactt

SEQ ID NO: 1038987 - DNA, 22 bp, Artificial Sequence
  chemically synthesized
aatgttagtaataagtactata

SEQ ID NO: 1038988 - DNA, 22 bp, Artificial Sequence
  chemically synthesized
taatgttagtaataagtactat

SEQ ID NO: 1038989 - DNA, 22 bp, Artificial Sequence
  chemically synthesized
cccttttctttatagtacttat

SEQ ID NO: 1038990 - DNA, 22 bp, Artificial Sequence
  chemically synthesized
ccttttctttatagtacttatt

SEQ ID NO: 1038991 - DNA, 22 bp, Artificial Sequence
  chemically synthesized
ttctttatagtacttattacta

SEQ ID NO: 1038992 - DNA, 22 bp, Artificial Sequence
  chemically synthesized
tctttatagtacttattactaa

SEQ ID NO: 1038993 - DNA, 22 bp, Artificial Sequence
  chemically synthesized
ctttatagtacttattactaac

SEQ ID NO: 1038994 - DNA, 22 bp, Artificial Sequence
  chemically synthesized
tttatagtacttattactaaca

SEQ ID NO: 1038995 - DNA, 22 bp, Artificial Sequence
  chemically synthesized
atatatattttaatgttagtaa

SEQ ID NO: 1038996 - DNA, 22 bp, Artificial Sequence
  chemically synthesized
tatagtacttattactaacatt

SEQ ID NO: 1038997 - DNA, 22 bp, Artificial Sequence
  chemically synthesized
gatatatattttaatgttagta

SEQ ID NO: 1038998 - DNA, 22 bp, Artificial Sequence
  chemically synthesized
atagtacttattactaacatta

SEQ ID NO: 1038999 - DNA, 22 bp, Artificial Sequence
  chemically synthesized
tagtacttattactaacattaa

SEQ ID NO: 1039000 - DNA, 22 bp, Artificial Sequence
  chemically synthesized
cttgatatatattttaatgtta

SEQ ID NO: 1039001 - DNA, 22 bp, Artificial Sequence
  chemically synthesized
attactaacattaaaatatata

SEQ ID NO: 1039002 - DNA, 22 bp, Artificial Sequence
  chemically synthesized
ttactaacattaaaatatatat

SEQ ID NO: 1039003 - DNA, 22 bp, Artificial Sequence
  chemically synthesized
ctaacattaaaatatatatcaa

SEQ ID NO: 1039004 - DNA, 22 bp, Artificial Sequence
  chemically synthesized
acattaaaatatatatcaagta

SEQ ID NO: 1039005 - DNA, 22 bp, Artificial Sequence
  chemically synthesized
gtggtatataccggctacttga

SEQ ID NO: 1039006 - DNA, 22 bp, Artificial Sequence
  chemically synthesized
aaatatatatcaagtagccggt

SEQ ID NO: 1039007 - DNA, 22 bp, Artificial Sequence
  chemically synthesized
aaattagtggtatataccggct

SEQ ID NO: 1039008 - DNA, 22 bp, Artificial Sequence
  chemically synthesized
caaattagtggtatataccggc

SEQ ID NO: 1039009 - DNA, 22 bp, Artificial Sequence
  chemically synthesized
tagtcatagatttcaaattagt

SEQ ID NO: 1039010 - DNA, 22 bp, Artificial Sequence
  chemically synthesized
atttgaaatctatgactacagg

SEQ ID NO: 1039011 - DNA, 22 bp, Artificial Sequence
  chemically synthesized
gaaatctatgactacagggatg

SEQ ID NO: 1039012 - DNA, 22 bp, Artificial Sequence
  chemically synthesized
aaatctatgactacagggatgt

SEQ ID NO: 1039013 - DNA, 22 bp, Artificial Sequence
  chemically synthesized
gaagcccaacagataacaacat

SEQ ID NO: 1039014 - DNA, 22 bp, Artificial Sequence
  chemically synthesized
tgactacagggatgttgttatc

SEQ ID NO: 1039015 - DNA, 22 bp, Artificial Sequence
  chemically synthesized
ggaagcccaacagataacaaca

SEQ ID NO: 1039016 - DNA, 22 bp, Artificial Sequence
  chemically synthesized
tggaagcccaacagataacaac

SEQ ID NO: 1039017 - DNA, 22 bp, Artificial Sequence
  chemically synthesized
cagggatgttgttatctgttgg

SEQ ID NO: 1039018 - DNA, 22 bp, Artificial Sequence
  chemically synthesized
agctttggaagcccaacagata

SEQ ID NO: 1039019 - DNA, 22 bp, Artificial Sequence
  chemically synthesized
gagctttggaagcccaacagat

SEQ ID NO: 1039020 - DNA, 22 bp, Artificial Sequence
  chemically synthesized
ttatctgttgggcttccaaagc

SEQ ID NO: 1039021 - DNA, 22 bp, Artificial Sequence
  chemically synthesized
tctgttgggcttccaaagctca

SEQ ID NO: 1039022 - DNA, 22 bp, Artificial Sequence
  chemically synthesized
ttgggcttccaaagctcaaacc

SEQ ID NO: 1039023 - DNA, 22 bp, Artificial Sequence
  chemically synthesized
ggcttccaaagctcaaacctgt

SEQ ID NO: 1039024 - DNA, 22 bp, Artificial Sequence
  chemically synthesized
tcatgtgccaagcacaggtttg

SEQ ID NO: 1039025 - DNA, 22 bp, Artificial Sequence
  chemically synthesized
ccaaagctcaaacctgtgcttg

SEQ ID NO: 1039026 - DNA, 22 bp, Artificial Sequence
  chemically synthesized
caaagctcaaacctgtgcttgg

SEQ ID NO: 1039027 - DNA, 22 bp, Artificial Sequence
  chemically synthesized
ccatctatcatgtgccaagcac

SEQ ID NO: 1039028 - DNA, 22 bp, Artificial Sequence
  chemically synthesized
gccatctatcatgtgccaagca

SEQ ID NO: 1039029 - DNA, 22 bp, Artificial Sequence
  chemically synthesized
tgccatctatcatgtgccaagc

SEQ ID NO: 1039030 - DNA, 22 bp, Artificial Sequence
  chemically synthesized
ttgccatctatcatgtgccaag

SEQ ID NO: 1039031 - DNA, 22 bp, Artificial Sequence
  chemically synthesized
aaacctgtgcttggcacatgat

SEQ ID NO: 1039032 - DNA, 22 bp, Artificial Sequence
  chemically synthesized
tgcttggcacatgatagatggc

SEQ ID NO: 1039033 - DNA, 22 bp, Artificial Sequence
  chemically synthesized
aacaaaaaagcttttgccatct

SEQ ID NO: 1039034 - DNA, 22 bp, Artificial Sequence
  chemically synthesized
ggcacatgatagatggcaaaag

SEQ ID NO: 1039035 - DNA, 22 bp, Artificial Sequence
  chemically synthesized
gcacatgatagatggcaaaagc

SEQ ID NO: 1039036 - DNA, 22 bp, Artificial Sequence
  chemically synthesized
ttcaacaaaaaagcttttgcca

SEQ ID NO: 1039037 - DNA, 22 bp, Artificial Sequence
  chemically synthesized
attcaacaaaaaagcttttgcc

SEQ ID NO: 1039038 - DNA, 22 bp, Artificial Sequence
  chemically synthesized
atttattcaacaaaaaagcttt

SEQ ID NO: 1039039 - DNA, 22 bp, Artificial Sequence
  chemically synthesized
ttcatttattcaacaaaaaagc

SEQ ID NO: 1039040 - DNA, 22 bp, Artificial Sequence
  chemically synthesized
tgggaccatctattcatttatt

SEQ ID NO: 1039041 - DNA, 22 bp, Artificial Sequence
  chemically synthesized
atgggaccatctattcatttat

SEQ ID NO: 1039042 - DNA, 22 bp, Artificial Sequence
  chemically synthesized
ttttgttgaataaatgaataga

SEQ ID NO: 1039043 - DNA, 22 bp, Artificial Sequence
  chemically synthesized
tttgttgaataaatgaatagat

SEQ ID NO: 1039044 - DNA, 22 bp, Artificial Sequence
  chemically synthesized
ttgttgaataaatgaatagatg

SEQ ID NO: 1039045 - DNA, 22 bp, Artificial Sequence
  chemically synthesized
aatttatgggaccatctattca

SEQ ID NO: 1039046 - DNA, 22 bp, Artificial Sequence
  chemically synthesized
tgttgaataaatgaatagatgg

SEQ ID NO: 1039047 - DNA, 22 bp, Artificial Sequence
  chemically synthesized
gttgaataaatgaatagatggt

SEQ ID NO: 1039048 - DNA, 22 bp, Artificial Sequence
  chemically synthesized
ttgaataaatgaatagatggtc

SEQ ID NO: 1039049 - DNA, 22 bp, Artificial Sequence
  chemically synthesized
aataaatgaatagatggtccca

SEQ ID NO: 1039050 - DNA, 22 bp, Artificial Sequence
  chemically synthesized
tggattaaatttatgggaccat

SEQ ID NO: 1039051 - DNA, 22 bp, Artificial Sequence
  chemically synthesized
aatagaatataaacaaaacatt

SEQ ID NO: 1039052 - DNA, 22 bp, Artificial Sequence
  chemically synthesized
aatccataatgttttgtttata

SEQ ID NO: 1039053 - DNA, 22 bp, Artificial Sequence
  chemically synthesized
cgttaaatagaatataaacaaa

SEQ ID NO: 1039054 - DNA, 22 bp, Artificial Sequence
  chemically synthesized
atccataatgttttgtttatat

SEQ ID NO: 1039055 - DNA, 22 bp, Artificial Sequence
  chemically synthesized
ccgttaaatagaatataaacaa

SEQ ID NO: 1039056 - DNA, 22 bp, Artificial Sequence
  chemically synthesized
tccgttaaatagaatataaaca

SEQ ID NO: 1039057 - DNA, 22 bp, Artificial Sequence
  chemically synthesized
ttccgttaaatagaatataaac

SEQ ID NO: 1039058 - DNA, 22 bp, Artificial Sequence
  chemically synthesized
tgatttttccgttaaatagaat

SEQ ID NO: 1039059 - DNA, 22 bp, Artificial Sequence
  chemically synthesized
gtgatttttccgttaaatagaa

SEQ ID NO: 1039060 - DNA, 22 bp, Artificial Sequence
  chemically synthesized
tgtttatattctatttaacgga

SEQ ID NO: 1039061 - DNA, 22 bp, Artificial Sequence
  chemically synthesized
gtttatattctatttaacggaa

SEQ ID NO: 1039062 - DNA, 22 bp, Artificial Sequence
  chemically synthesized
tttatattctatttaacggaaa

SEQ ID NO: 1039063 - DNA, 22 bp, Artificial Sequence
  chemically synthesized
tggtttgtgatttttccgttaa

SEQ ID NO: 1039064 - DNA, 22 bp, Artificial Sequence
  chemically synthesized
gtggtttgtgatttttccgtta

SEQ ID NO: 1039065 - DNA, 22 bp, Artificial Sequence
  chemically synthesized
atattctatttaacggaaaaat

SEQ ID NO: 1039066 - DNA, 22 bp, Artificial Sequence
  chemically synthesized
tattctatttaacggaaaaatc

SEQ ID NO: 1039067 - DNA, 22 bp, Artificial Sequence
  chemically synthesized
tatttaacggaaaaatcacaaa

SEQ ID NO: 1039068 - DNA, 22 bp, Artificial Sequence
  chemically synthesized
tttaacggaaaaatcacaaacc

SEQ ID NO: 1039069 - DNA, 22 bp, Artificial Sequence
  chemically synthesized
aacggaaaaatcacaaaccaca

SEQ ID NO: 1039070 - DNA, 22 bp, Artificial Sequence
  chemically synthesized
acggaaaaatcacaaaccacaa

SEQ ID NO: 1039071 - DNA, 22 bp, Artificial Sequence
  chemically synthesized
ccgtataacccatttgtggttt

SEQ ID NO: 1039072 - DNA, 22 bp, Artificial Sequence
  chemically synthesized
cccgtataacccatttgtggtt

SEQ ID NO: 1039073 - DNA, 22 bp, Artificial Sequence
  chemically synthesized
ttcccgtataacccatttgtgg

SEQ ID NO: 1039074 - DNA, 22 bp, Artificial Sequence
  chemically synthesized
cttcccgtataacccatttgtg

SEQ ID NO: 1039075 - DNA, 22 bp, Artificial Sequence
  chemically synthesized
tcttcccgtataacccatttgt

SEQ ID NO: 1039076 - DNA, 22 bp, Artificial Sequence
  chemically synthesized
tttcttcccgtataacccattt

SEQ ID NO: 1039077 - DNA, 22 bp, Artificial Sequence
  chemically synthesized
ctttcttcccgtataacccatt

SEQ ID NO: 1039078 - DNA, 22 bp, Artificial Sequence
  chemically synthesized
tctttcttcccgtataacccat

SEQ ID NO: 1039079 - DNA, 22 bp, Artificial Sequence
  chemically synthesized
ttctttcttcccgtataaccca

SEQ ID NO: 1039080 - DNA, 22 bp, Artificial Sequence
  chemically synthesized
gatttttctttcttcccgtata

SEQ ID NO: 1039081 - DNA, 22 bp, Artificial Sequence
  chemically synthesized
agatttttctttcttcccgtat

SEQ ID NO: 1039082 - DNA, 22 bp, Artificial Sequence
  chemically synthesized
tacgggaagaaagaaaaatcta

SEQ ID NO: 1039083 - DNA, 22 bp, Artificial Sequence
  chemically synthesized
agaataaatatgtttagatttt

SEQ ID NO: 1039084 - DNA, 22 bp, Artificial Sequence
  chemically synthesized
ttgagaataaatatgtttagat

SEQ ID NO: 1039085 - DNA, 22 bp, Artificial Sequence
  chemically synthesized
attgagaataaatatgtttaga

SEQ ID NO: 1039086 - DNA, 22 bp, Artificial Sequence
  chemically synthesized
gcaaatttattgagaataaata

SEQ ID NO: 1039087 - DNA, 22 bp, Artificial Sequence
  chemically synthesized
agcaaatttattgagaataaat

SEQ ID NO: 1039088 - DNA, 22 bp, Artificial Sequence
  chemically synthesized
tagcaaatttattgagaataaa

SEQ ID NO: 1039089 - DNA, 22 bp, Artificial Sequence
  chemically synthesized
ttagcaaatttattgagaataa

SEQ ID NO: 1039090 - DNA, 22 bp, Artificial Sequence
  chemically synthesized
aacatatttattctcaataaat

SEQ ID NO: 1039091 - DNA, 22 bp, Artificial Sequence
  chemically synthesized
attctcaataaatttgctaaaa

SEQ ID NO: 1039092 - DNA, 22 bp, Artificial Sequence
  chemically synthesized
ttctcaataaatttgctaaaaa

SEQ ID NO: 1039093 - DNA, 22 bp, Artificial Sequence
  chemically synthesized
tcaataaatttgctaaaaacta

SEQ ID NO: 1039094 - DNA, 22 bp, Artificial Sequence
  chemically synthesized
aataaatttgctaaaaactaca

SEQ ID NO: 1039095 - DNA, 22 bp, Artificial Sequence
  chemically synthesized
ggaagaatagccagaatgtagt

SEQ ID NO: 1039096 - DNA, 22 bp, Artificial Sequence
  chemically synthesized
gctaaaaactacattctggcta

SEQ ID NO: 1039097 - DNA, 22 bp, Artificial Sequence
  chemically synthesized
ctaaaaactacattctggctat

SEQ ID NO: 1039098 - DNA, 22 bp, Artificial Sequence
  chemically synthesized
gtactaggaagaatagccagaa

SEQ ID NO: 1039099 - DNA, 22 bp, Artificial Sequence
  chemically synthesized
aaaactacattctggctattct

SEQ ID NO: 1039100 - DNA, 22 bp, Artificial Sequence
  chemically synthesized
cattctggctattcttcctagt

SEQ ID NO: 1039101 - DNA, 22 bp, Artificial Sequence
  chemically synthesized
tggctattcttcctagtacgaa

SEQ ID NO: 1039102 - DNA, 22 bp, Artificial Sequence
  chemically synthesized
gctattcttcctagtacgaatt

SEQ ID NO: 1039103 - DNA, 22 bp, Artificial Sequence
  chemically synthesized
ttcttcctagtacgaattttgt

SEQ ID NO: 1039104 - DNA, 22 bp, Artificial Sequence
  chemically synthesized
gatgatcaaaataacaaaattc

SEQ ID NO: 1039105 - DNA, 22 bp, Artificial Sequence
  chemically synthesized
agatgatcaaaataacaaaatt

SEQ ID NO: 1039106 - DNA, 22 bp, Artificial Sequence
  chemically synthesized
ttcctagtacgaattttgttat

SEQ ID NO: 1039107 - DNA, 22 bp, Artificial Sequence
  chemically synthesized
cctagtacgaattttgttattt

SEQ ID NO: 1039108 - DNA, 22 bp, Artificial Sequence
  chemically synthesized
ctagtacgaattttgttatttt

SEQ ID NO: 1039109 - DNA, 22 bp, Artificial Sequence
  chemically synthesized
gtacgaattttgttattttgat

SEQ ID NO: 1039110 - DNA, 22 bp, Artificial Sequence
  chemically synthesized
tgtataatttagatgatcaaaa

SEQ ID NO: 1039111 - DNA, 22 bp, Artificial Sequence
  chemically synthesized
atgtataatttagatgatcaaa

SEQ ID NO: 1039112 - DNA, 22 bp, Artificial Sequence
  chemically synthesized
tgttattttgatcatctaaatt

SEQ ID NO: 1039113 - DNA, 22 bp, Artificial Sequence
  chemically synthesized
gttattttgatcatctaaatta

SEQ ID NO: 1039114 - DNA, 22 bp, Artificial Sequence
  chemically synthesized
ttattttgatcatctaaattat

SEQ ID NO: 1039115 - DNA, 22 bp, Artificial Sequence
  chemically synthesized
agtggaccttatgtataattta

SEQ ID NO: 1039116 - DNA, 22 bp, Artificial Sequence
  chemically synthesized
ttttgatcatctaaattataca

SEQ ID NO: 1039117 - DNA, 22 bp, Artificial Sequence
  chemically synthesized
ctcagtggaccttatgtataat

SEQ ID NO: 1039118 - DNA, 22 bp, Artificial Sequence
  chemically synthesized
tgatcatctaaattatacataa

SEQ ID NO: 1039119 - DNA, 22 bp, Artificial Sequence
  chemically synthesized
gctcagtggaccttatgtataa

SEQ ID NO: 1039120 - DNA, 22 bp, Artificial Sequence
  chemically synthesized
gatcatctaaattatacataag

SEQ ID NO: 1039121 - DNA, 22 bp, Artificial Sequence
  chemically synthesized
tgctcagtggaccttatgtata

SEQ ID NO: 1039122 - DNA, 22 bp, Artificial Sequence
  chemically synthesized
atcatctaaattatacataagg

SEQ ID NO: 1039123 - DNA, 22 bp, Artificial Sequence
  chemically synthesized
aattatacataaggtccactga

SEQ ID NO: 1039124 - DNA, 22 bp, Artificial Sequence
  chemically synthesized
aataaattttgctcagtggacc

SEQ ID NO: 1039125 - DNA, 22 bp, Artificial Sequence
  chemically synthesized
tacataaggtccactgagcaaa

SEQ ID NO: 1039126 - DNA, 22 bp, Artificial Sequence
  chemically synthesized
cacatgggaagaactcaataaa

SEQ ID NO: 1039127 - DNA, 22 bp, Artificial Sequence
  chemically synthesized
acacatgggaagaactcaataa

SEQ ID NO: 1039128 - DNA, 22 bp, Artificial Sequence
  chemically synthesized
cttacacatgggaagaactcaa

SEQ ID NO: 1039129 - DNA, 22 bp, Artificial Sequence
  chemically synthesized
agcaaaatttattgagttcttc

SEQ ID NO: 1039130 - DNA, 22 bp, Artificial Sequence
  chemically synthesized
ctccttacacatgggaagaact

SEQ ID NO: 1039131 - DNA, 22 bp, Artificial Sequence
  chemically synthesized
tattgctccttacacatgggaa

SEQ ID NO: 1039132 - DNA, 22 bp, Artificial Sequence
  chemically synthesized
attgagttcttcccatgtgtaa

SEQ ID NO: 1039133 - DNA, 22 bp, Artificial Sequence
  chemically synthesized
ctatattgctccttacacatgg

SEQ ID NO: 1039134 - DNA, 22 bp, Artificial Sequence
  chemically synthesized
ttgagttcttcccatgtgtaag

SEQ ID NO: 1039135 - DNA, 22 bp, Artificial Sequence
  chemically synthesized
tgctatattgctccttacacat

SEQ ID NO: 1039136 - DNA, 22 bp, Artificial Sequence
  chemically synthesized
ctgctatattgctccttacaca

SEQ ID NO: 1039137 - DNA, 22 bp, Artificial Sequence
  chemically synthesized
agttcttcccatgtgtaaggag

SEQ ID NO: 1039138 - DNA, 22 bp, Artificial Sequence
  chemically synthesized
tttctgctatattgctccttac

SEQ ID NO: 1039139 - DNA, 22 bp, Artificial Sequence
  chemically synthesized
gtttctgctatattgctcctta

SEQ ID NO: 1039140 - DNA, 22 bp, Artificial Sequence
  chemically synthesized
tgtttctgctatattgctcctt

SEQ ID NO: 1039141 - DNA, 22 bp, Artificial Sequence
  chemically synthesized
ttcccatgtgtaaggagcaata

SEQ ID NO: 1039142 - DNA, 22 bp, Artificial Sequence
  chemically synthesized
cccatgtgtaaggagcaatata

SEQ ID NO: 1039143 - DNA, 22 bp, Artificial Sequence
  chemically synthesized
ccatgtgtaaggagcaatatag

SEQ ID NO: 1039144 - DNA, 22 bp, Artificial Sequence
  chemically synthesized
acccacctttgtttctgctata

SEQ ID NO: 1039145 - DNA, 22 bp, Artificial Sequence
  chemically synthesized
cacccacctttgtttctgctat

SEQ ID NO: 1039146 - DNA, 22 bp, Artificial Sequence
  chemically synthesized
tgtttcacccacctttgtttct

SEQ ID NO: 1039147 - DNA, 22 bp, Artificial Sequence
  chemically synthesized
aactgtgtttcacccacctttg

SEQ ID NO: 1039148 - DNA, 22 bp, Artificial Sequence
  chemically synthesized
aaggcaaactaaactgtgtttc

SEQ ID NO: 1039149 - DNA, 22 bp, Artificial Sequence
  chemically synthesized
aaaggcaaactaaactgtgttt

SEQ ID NO: 1039150 - DNA, 22 bp, Artificial Sequence
  chemically synthesized
ttaaaggcaaactaaactgtgt

SEQ ID NO: 1039151 - DNA, 22 bp, Artificial Sequence
  chemically synthesized
cttaaaggcaaactaaactgtg

SEQ ID NO: 1039152 - DNA, 22 bp, Artificial Sequence
  chemically synthesized
aaacttcttaaaggcaaactaa

SEQ ID NO: 1039153 - DNA, 22 bp, Artificial Sequence
  chemically synthesized
aaaacttcttaaaggcaaacta

SEQ ID NO: 1039154 - DNA, 22 bp, Artificial Sequence
  chemically synthesized
cttaaaacttcttaaaggcaaa

SEQ ID NO: 1039155 - DNA, 22 bp, Artificial Sequence
  chemically synthesized
agtttgcctttaagaagtttta

SEQ ID NO: 1039156 - DNA, 22 bp, Artificial Sequence
  chemically synthesized
gtttgcctttaagaagttttaa

SEQ ID NO: 1039157 - DNA, 22 bp, Artificial Sequence
  chemically synthesized
caataaaacctacttaaaactt

SEQ ID NO: 1039158 - DNA, 22 bp, Artificial Sequence
  chemically synthesized
gcctttaagaagttttaagtag

SEQ ID NO: 1039159 - DNA, 22 bp, Artificial Sequence
  chemically synthesized
ctacaataaaacctacttaaaa

SEQ ID NO: 1039160 - DNA, 22 bp, Artificial Sequence
  chemically synthesized
cctttaagaagttttaagtagg

SEQ ID NO: 1039161 - DNA, 22 bp, Artificial Sequence
  chemically synthesized
ctactacaataaaacctactta

SEQ ID NO: 1039162 - DNA, 22 bp, Artificial Sequence
  chemically synthesized
actactacaataaaacctactt

SEQ ID NO: 1039163 - DNA, 22 bp, Artificial Sequence
  chemically synthesized
taagaagttttaagtaggtttt

SEQ ID NO: 1039164 - DNA, 22 bp, Artificial Sequence
  chemically synthesized
aagaagttttaagtaggtttta

SEQ ID NO: 1039165 - DNA, 22 bp, Artificial Sequence
  chemically synthesized
ttactactacaataaaacctac

SEQ ID NO: 1039166 - DNA, 22 bp, Artificial Sequence
  chemically synthesized
agaagttttaagtaggttttat

SEQ ID NO: 1039167 - DNA, 22 bp, Artificial Sequence
  chemically synthesized
cttactactacaataaaaccta

SEQ ID NO: 1039168 - DNA, 22 bp, Artificial Sequence
  chemically synthesized
tcttactactacaataaaacct

SEQ ID NO: 1039169 - DNA, 22 bp, Artificial Sequence
  chemically synthesized
taagtaggttttattgtagtag

SEQ ID NO: 1039170 - DNA, 22 bp, Artificial Sequence
  chemically synthesized
aagtaggttttattgtagtagt

SEQ ID NO: 1039171 - DNA, 22 bp, Artificial Sequence
  chemically synthesized
agtaggttttattgtagtagta

SEQ ID NO: 1039172 - DNA, 22 bp, Artificial Sequence
  chemically synthesized
aaaccatatcctttcttactac

SEQ ID NO: 1039173 - DNA, 22 bp, Artificial Sequence
  chemically synthesized
caaaccatatcctttcttacta

SEQ ID NO: 1039174 - DNA, 22 bp, Artificial Sequence
  chemically synthesized
ttcaaaccatatcctttcttac

SEQ ID NO: 1039175 - DNA, 22 bp, Artificial Sequence
  chemically synthesized
tattgtagtagtaagaaaggat

SEQ ID NO: 1039176 - DNA, 22 bp, Artificial Sequence
  chemically synthesized
attgtagtagtaagaaaggata

SEQ ID NO: 1039177 - DNA, 22 bp, Artificial Sequence
  chemically synthesized
ttgtagtagtaagaaaggatat

SEQ ID NO: 1039178 - DNA, 22 bp, Artificial Sequence
  chemically synthesized
aattcttcaaaccatatccttt

SEQ ID NO: 1039179 - DNA, 22 bp, Artificial Sequence
  chemically synthesized
caattcttcaaaccatatcctt

SEQ ID NO: 1039180 - DNA, 22 bp, Artificial Sequence
  chemically synthesized
tagtagtaagaaaggatatggt

SEQ ID NO: 1039181 - DNA, 22 bp, Artificial Sequence
  chemically synthesized
ttcaattcttcaaaccatatcc

SEQ ID NO: 1039182 - DNA, 22 bp, Artificial Sequence
  chemically synthesized
cttcaattcttcaaaccatatc

SEQ ID NO: 1039183 - DNA, 22 bp, Artificial Sequence
  chemically synthesized
tcttcaattcttcaaaccatat

SEQ ID NO: 1039184 - DNA, 22 bp, Artificial Sequence
  chemically synthesized
ttcttcaattcttcaaaccata

SEQ ID NO: 1039185 - DNA, 22 bp, Artificial Sequence
  chemically synthesized
tttcttcaattcttcaaaccat

SEQ ID NO: 1039186 - DNA, 22 bp, Artificial Sequence
  chemically synthesized
ttttcttcaattcttcaaacca

SEQ ID NO: 1039187 - DNA, 22 bp, Artificial Sequence
  chemically synthesized
gatttttttcttcaattcttca

SEQ ID NO: 1039188 - DNA, 22 bp, Artificial Sequence
  chemically synthesized
ggatttttttcttcaattcttc

SEQ ID NO: 1039189 - DNA, 22 bp, Artificial Sequence
  chemically synthesized
tacttggatttttttcttcaat

SEQ ID NO: 1039190 - DNA, 22 bp, Artificial Sequence
  chemically synthesized
tatacttggatttttttcttca

SEQ ID NO: 1039191 - DNA, 22 bp, Artificial Sequence
  chemically synthesized
ctatacttggatttttttcttc

SEQ ID NO: 1039192 - DNA, 22 bp, Artificial Sequence
  chemically synthesized
gaagaattgaagaaaaaaatcc

SEQ ID NO: 1039193 - DNA, 22 bp, Artificial Sequence
  chemically synthesized
aagaattgaagaaaaaaatcca

SEQ ID NO: 1039194 - DNA, 22 bp, Artificial Sequence
  chemically synthesized
aggcttctatacttggattttt

SEQ ID NO: 1039195 - DNA, 22 bp, Artificial Sequence
  chemically synthesized
aagaaaaaaatccaagtataga

SEQ ID NO: 1039196 - DNA, 22 bp, Artificial Sequence
  chemically synthesized
atccagctaaggcttctatact

SEQ ID NO: 1039197 - DNA, 22 bp, Artificial Sequence
  chemically synthesized
tcatccagctaaggcttctata

SEQ ID NO: 1039198 - DNA, 22 bp, Artificial Sequence
  chemically synthesized
ctcatccagctaaggcttctat

SEQ ID NO: 1039199 - DNA, 22 bp, Artificial Sequence
  chemically synthesized
ttctcatccagctaaggcttct

SEQ ID NO: 1039200 - DNA, 22 bp, Artificial Sequence
  chemically synthesized
cttctcatccagctaaggcttc

SEQ ID NO: 1039201 - DNA, 22 bp, Artificial Sequence
  chemically synthesized
cttcttctcatccagctaaggc

SEQ ID NO: 1039202 - DNA, 22 bp, Artificial Sequence
  chemically synthesized
ccttcttctcatccagctaagg

SEQ ID NO: 1039203 - DNA, 22 bp, Artificial Sequence
  chemically synthesized
ttccttcttctcatccagctaa

SEQ ID NO: 1039204 - DNA, 22 bp, Artificial Sequence
  chemically synthesized
cttccttcttctcatccagcta

SEQ ID NO: 1039205 - DNA, 22 bp, Artificial Sequence
  chemically synthesized
atttcttccttcttctcatcca

SEQ ID NO: 1039206 - DNA, 22 bp, Artificial Sequence
  chemically synthesized
gaacactcatttcttccttctt

SEQ ID NO: 1039207 - DNA, 22 bp, Artificial Sequence
  chemically synthesized
agctggatgagaagaaggaaga

SEQ ID NO: 1039208 - DNA, 22 bp, Artificial Sequence
  chemically synthesized
ggaacactcatttcttccttct

SEQ ID NO: 1039209 - DNA, 22 bp, Artificial Sequence
  chemically synthesized
gctggatgagaagaaggaagaa

SEQ ID NO: 1039210 - DNA, 22 bp, Artificial Sequence
  chemically synthesized
gatgagaagaaggaagaaatga

SEQ ID NO: 1039211 - DNA, 22 bp, Artificial Sequence
  chemically synthesized
gtaccacttggaacactcattt

SEQ ID NO: 1039212 - DNA, 22 bp, Artificial Sequence
  chemically synthesized
ggtaccacttggaacactcatt

SEQ ID NO: 1039213 - DNA, 22 bp, Artificial Sequence
  chemically synthesized
gaaaatgtttggtaccacttgg

SEQ ID NO: 1039214 - DNA, 22 bp, Artificial Sequence
  chemically synthesized
tagaaaatgtttggtaccactt

SEQ ID NO: 1039215 - DNA, 22 bp, Artificial Sequence
  chemically synthesized
ctagaaaatgtttggtaccact

SEQ ID NO: 1039216 - DNA, 22 bp, Artificial Sequence
  chemically synthesized
acttctagaaaatgtttggtac

SEQ ID NO: 1039217 - DNA, 22 bp, Artificial Sequence
  chemically synthesized
taacttctagaaaatgtttggt

SEQ ID NO: 1039218 - DNA, 22 bp, Artificial Sequence
  chemically synthesized
tctaacttctagaaaatgtttg

SEQ ID NO: 1039219 - DNA, 22 bp, Artificial Sequence
  chemically synthesized
ctctaacttctagaaaatgttt

SEQ ID NO: 1039220 - DNA, 22 bp, Artificial Sequence
  chemically synthesized
caagtggtaccaaacattttct

SEQ ID NO: 1039221 - DNA, 22 bp, Artificial Sequence
  chemically synthesized
tctctaacttctagaaaatgtt

SEQ ID NO: 1039222 - DNA, 22 bp, Artificial Sequence
  chemically synthesized
tctagaagttagagaaaacatg

SEQ ID NO: 1039223 - DNA, 22 bp, Artificial Sequence
  chemically synthesized
ctagaagttagagaaaacatgt

SEQ ID NO: 1039224 - DNA, 22 bp, Artificial Sequence
  chemically synthesized
tagaagttagagaaaacatgta

SEQ ID NO: 1039225 - DNA, 22 bp, Artificial Sequence
  chemically synthesized
gaagttagagaaaacatgtatc

SEQ ID NO: 1039226 - DNA, 22 bp, Artificial Sequence
  chemically synthesized
tgaccaaatatatgatacatgt

SEQ ID NO: 1039227 - DNA, 22 bp, Artificial Sequence
  chemically synthesized
gagaaaacatgtatcatatatt

SEQ ID NO: 1039228 - DNA, 22 bp, Artificial Sequence
  chemically synthesized
agcctatgaccaaatatatgat

SEQ ID NO: 1039229 - DNA, 22 bp, Artificial Sequence
  chemically synthesized
ctgagcctatgaccaaatatat

SEQ ID NO: 1039230 - DNA, 22 bp, Artificial Sequence
  chemically synthesized
cctgagcctatgaccaaatata

SEQ ID NO: 1039231 - DNA, 22 bp, Artificial Sequence
  chemically synthesized
tcctgagcctatgaccaaatat

SEQ ID NO: 1039232 - DNA, 22 bp, Artificial Sequence
  chemically synthesized
tttcctgagcctatgaccaaat

SEQ ID NO: 1039233 - DNA, 22 bp, Artificial Sequence
  chemically synthesized
gtgaattctttcctgagcctat

SEQ ID NO: 1039234 - DNA, 22 bp, Artificial Sequence
  chemically synthesized
cgtgaattctttcctgagccta

SEQ ID NO: 1039235 - DNA, 22 bp, Artificial Sequence
  chemically synthesized
ttcgtgaattctttcctgagcc

SEQ ID NO: 1039236 - DNA, 22 bp, Artificial Sequence
  chemically synthesized
cttcgtgaattctttcctgagc

SEQ ID NO: 1039237 - DNA, 22 bp, Artificial Sequence
  chemically synthesized
ggtcataggctcaggaaagaat

SEQ ID NO: 1039238 - DNA, 22 bp, Artificial Sequence
  chemically synthesized
gtcataggctcaggaaagaatt

SEQ ID NO: 1039239 - DNA, 22 bp, Artificial Sequence
  chemically synthesized
caccttcttcgtgaattctttc

SEQ ID NO: 1039240 - DNA, 22 bp, Artificial Sequence
  chemically synthesized
gcaccttcttcgtgaattcttt

SEQ ID NO: 1039241 - DNA, 22 bp, Artificial Sequence
  chemically synthesized
caatttgcaccttcttcgtgaa

SEQ ID NO: 1039242 - DNA, 22 bp, Artificial Sequence
  chemically synthesized
aggaaagaattcacgaagaagg

SEQ ID NO: 1039243 - DNA, 22 bp, Artificial Sequence
  chemically synthesized
ctgcaatttgcaccttcttcgt

SEQ ID NO: 1039244 - DNA, 22 bp, Artificial Sequence
  chemically synthesized
agatatgtctactgcaatttgc

SEQ ID NO: 1039245 - DNA, 22 bp, Artificial Sequence
  chemically synthesized
acgaagaaggtgcaaattgcag

SEQ ID NO: 1039246 - DNA, 22 bp, Artificial Sequence
  chemically synthesized
ctcagatatgtctactgcaatt

SEQ ID NO: 1039247 - DNA, 22 bp, Artificial Sequence
  chemically synthesized
ctactcagatatgtctactgca

SEQ ID NO: 1039248 - DNA, 22 bp, Artificial Sequence
  chemically synthesized
tactactcagatatgtctactg

SEQ ID NO: 1039249 - DNA, 22 bp, Artificial Sequence
  chemically synthesized
ctactactcagatatgtctact

SEQ ID NO: 1039250 - DNA, 22 bp, Artificial Sequence
  chemically synthesized
ccacttctactactcagatatg

SEQ ID NO: 1039251 - DNA, 22 bp, Artificial Sequence
  chemically synthesized
cccacttctactactcagatat

SEQ ID NO: 1039252 - DNA, 22 bp, Artificial Sequence
  chemically synthesized
ttcccacttctactactcagat

SEQ ID NO: 1039253 - DNA, 22 bp, Artificial Sequence
  chemically synthesized
cagtagacatatctgagtagta

SEQ ID NO: 1039254 - DNA, 22 bp, Artificial Sequence
  chemically synthesized
atgttcttcccacttctactac

SEQ ID NO: 1039255 - DNA, 22 bp, Artificial Sequence
  chemically synthesized
taatgttcttcccacttctact

SEQ ID NO: 1039256 - DNA, 22 bp, Artificial Sequence
  chemically synthesized
gctctaatgttcttcccacttc

SEQ ID NO: 1039257 - DNA, 22 bp, Artificial Sequence
  chemically synthesized
ctagctctaatgttcttcccac

SEQ ID NO: 1039258 - DNA, 22 bp, Artificial Sequence
  chemically synthesized
agtagtagaagtgggaagaaca

SEQ ID NO: 1039259 - DNA, 22 bp, Artificial Sequence
  chemically synthesized
cctactagctctaatgttcttc

SEQ ID NO: 1039260 - DNA, 22 bp, Artificial Sequence
  chemically synthesized
cgtgtgtgttacctactagctc

SEQ ID NO: 1039261 - DNA, 22 bp, Artificial Sequence
  chemically synthesized
gcgtgtgtgttacctactagct

SEQ ID NO: 1039262 - DNA, 22 bp, Artificial Sequence
  chemically synthesized
tgcgtgtgtgttacctactagc

SEQ ID NO: 1039263 - DNA, 22 bp, Artificial Sequence
  chemically synthesized
gctttgcgtgtgtgttacctac

SEQ ID NO: 1039264 - DNA, 22 bp, Artificial Sequence
  chemically synthesized
cctagctttgcgtgtgtgttac

SEQ ID NO: 1039265 - DNA, 22 bp, Artificial Sequence
  chemically synthesized
gagctagtaggtaacacacacg

SEQ ID NO: 1039266 - DNA, 22 bp, Artificial Sequence
  chemically synthesized
ttacctagctttgcgtgtgtgt

SEQ ID NO: 1039267 - DNA, 22 bp, Artificial Sequence
  chemically synthesized
gttacctagctttgcgtgtgtg

SEQ ID NO: 1039268 - DNA, 22 bp, Artificial Sequence
  chemically synthesized
gtaggtaacacacacgcaaagc

SEQ ID NO: 1039269 - DNA, 22 bp, Artificial Sequence
  chemically synthesized
cgcttgttacctagctttgcgt

SEQ ID NO: 1039270 - DNA, 22 bp, Artificial Sequence
  chemically synthesized
aaaaggcagccaaatatgactg

SEQ ID NO: 1039271 - DNA, 22 bp, Artificial Sequence
  chemically synthesized
ggtaacaagcgcagtcatattt

SEQ ID NO: 1039272 - DNA, 22 bp, Artificial Sequence
  chemically synthesized
ctgaaaaggcagccaaatatga

SEQ ID NO: 1039273 - DNA, 22 bp, Artificial Sequence
  chemically synthesized
tgttactgaaaaggcagccaaa

SEQ ID NO: 1039274 - DNA, 22 bp, Artificial Sequence
  chemically synthesized
tatgttactgaaaaggcagcca

SEQ ID NO: 1039275 - DNA, 22 bp, Artificial Sequence
  chemically synthesized
ctatgttactgaaaaggcagcc

SEQ ID NO: 1039276 - DNA, 22 bp, Artificial Sequence
  chemically synthesized
agcttctatgttactgaaaagg

SEQ ID NO: 1039277 - DNA, 22 bp, Artificial Sequence
  chemically synthesized
ccctaagcttctatgttactga

SEQ ID NO: 1039278 - DNA, 22 bp, Artificial Sequence
  chemically synthesized
cccctaagcttctatgttactg

SEQ ID NO: 1039279 - DNA, 22 bp, Artificial Sequence
  chemically synthesized
ggctgccttttcagtaacatag

SEQ ID NO: 1039280 - DNA, 22 bp, Artificial Sequence
  chemically synthesized
gctgccttttcagtaacataga

SEQ ID NO: 1039281 - DNA, 22 bp, Artificial Sequence
  chemically synthesized
ccttttcagtaacatagaagct

SEQ ID NO: 1039282 - DNA, 22 bp, Artificial Sequence
  chemically synthesized
ttcagtaacatagaagcttagg

SEQ ID NO: 1039283 - DNA, 22 bp, Artificial Sequence
  chemically synthesized
tcagtaacatagaagcttaggg

SEQ ID NO: 1039284 - DNA, 22 bp, Artificial Sequence
  chemically synthesized
cagtaacatagaagcttagggg

SEQ ID NO: 1039285 - DNA, 22 bp, Artificial Sequence
  chemically synthesized
atgccccatcttcccctaagct

SEQ ID NO: 1039286 - DNA, 22 bp, Artificial Sequence
  chemically synthesized
agtaacatagaagcttagggga

SEQ ID NO: 1039287 - DNA, 22 bp, Artificial Sequence
  chemically synthesized
catgccccatcttcccctaagc

SEQ ID NO: 1039288 - DNA, 22 bp, Artificial Sequence
  chemically synthesized
tttcatgccccatcttccccta

SEQ ID NO: 1039289 - DNA, 22 bp, Artificial Sequence
  chemically synthesized
tgtttcatgccccatcttcccc

SEQ ID NO: 1039290 - DNA, 22 bp, Artificial Sequence
  chemically synthesized
agcctctgtttcatgccccatc

SEQ ID NO: 1039291 - DNA, 22 bp, Artificial Sequence
  chemically synthesized
aggggaagatggggcatgaaac

SEQ ID NO: 1039292 - DNA, 22 bp, Artificial Sequence
  chemically synthesized
ggggaagatggggcatgaaaca

SEQ ID NO: 1039293 - DNA, 22 bp, Artificial Sequence
  chemically synthesized
aacatcctcagcctctgtttca

SEQ ID NO: 1039294 - DNA, 22 bp, Artificial Sequence
  chemically synthesized
ttgaacatcctcagcctctgtt

SEQ ID NO: 1039295 - DNA, 22 bp, Artificial Sequence
  chemically synthesized
aaagcacattattgaacatcct

SEQ ID NO: 1039296 - DNA, 22 bp, Artificial Sequence
  chemically synthesized
agattcaaagcacattattgaa

SEQ ID NO: 1039297 - DNA, 22 bp, Artificial Sequence
  chemically synthesized
ttgagattcaaagcacattatt

SEQ ID NO: 1039298 - DNA, 22 bp, Artificial Sequence
  chemically synthesized
tgttgagattcaaagcacatta

SEQ ID NO: 1039299 - DNA, 22 bp, Artificial Sequence
  chemically synthesized
aggatgttcaataatgtgcttt

SEQ ID NO: 1039300 - DNA, 22 bp, Artificial Sequence
  chemically synthesized
ctgttgagattcaaagcacatt

SEQ ID NO: 1039301 - DNA, 22 bp, Artificial Sequence
  chemically synthesized
tctgttgagattcaaagcacat

SEQ ID NO: 1039302 - DNA, 22 bp, Artificial Sequence
  chemically synthesized
aataatgtgctttgaatctcaa

SEQ ID NO: 1039303 - DNA, 22 bp, Artificial Sequence
  chemically synthesized
aagtacaggcagaattttctgt

SEQ ID NO: 1039304 - DNA, 22 bp, Artificial Sequence
  chemically synthesized
tgaatctcaacagaaaattctg

SEQ ID NO: 1039305 - DNA, 22 bp, Artificial Sequence
  chemically synthesized
ctgaagtacaggcagaattttc

SEQ ID NO: 1039306 - DNA, 22 bp, Artificial Sequence
  chemically synthesized
gaatctcaacagaaaattctgc

SEQ ID NO: 1039307 - DNA, 22 bp, Artificial Sequence
  chemically synthesized
aatctcaacagaaaattctgcc

SEQ ID NO: 1039308 - DNA, 22 bp, Artificial Sequence
  chemically synthesized
gctactgaagtacaggcagaat

SEQ ID NO: 1039309 - DNA, 22 bp, Artificial Sequence
  chemically synthesized
aacagaaaattctgcctgtact

SEQ ID NO: 1039310 - DNA, 22 bp, Artificial Sequence
  chemically synthesized
cccattagctactgaagtacag

SEQ ID NO: 1039311 - DNA, 22 bp, Artificial Sequence
  chemically synthesized
tgcctgtacttcagtagctaat

SEQ ID NO: 1039312 - DNA, 22 bp, Artificial Sequence
  chemically synthesized
cctgtacttcagtagctaatgg

SEQ ID NO: 1039313 - DNA, 22 bp, Artificial Sequence
  chemically synthesized
aaaatcatagttccccattagc

SEQ ID NO: 1039314 - DNA, 22 bp, Artificial Sequence
  chemically synthesized
aaaaatcatagttccccattag

SEQ ID NO: 1039315 - DNA, 22 bp, Artificial Sequence
  chemically synthesized
tacttcagtagctaatggggaa

SEQ ID NO: 1039316 - DNA, 22 bp, Artificial Sequence
  chemically synthesized
taaaaatcatagttccccatta

SEQ ID NO: 1039317 - DNA, 22 bp, Artificial Sequence
  chemically synthesized
ttaaaaatcatagttccccatt

SEQ ID NO: 1039318 - DNA, 22 bp, Artificial Sequence
  chemically synthesized
tttaaaaatcatagttccccat

SEQ ID NO: 1039319 - DNA, 22 bp, Artificial Sequence
  chemically synthesized
cagtagctaatggggaactatg

SEQ ID NO: 1039320 - DNA, 22 bp, Artificial Sequence
  chemically synthesized
agtagctaatggggaactatga

SEQ ID NO: 1039321 - DNA, 22 bp, Artificial Sequence
  chemically synthesized
atggggaactatgatttttaaa

SEQ ID NO: 1039322 - DNA, 22 bp, Artificial Sequence
  chemically synthesized
cataatgataactttttaaaaa

SEQ ID NO: 1039323 - DNA, 22 bp, Artificial Sequence
  chemically synthesized
acataatgataactttttaaaa

SEQ ID NO: 1039324 - DNA, 22 bp, Artificial Sequence
  chemically synthesized
aaatcttacataatgataactt

SEQ ID NO: 1039325 - DNA, 22 bp, Artificial Sequence
  chemically synthesized
tgatttttaaaaagttatcatt

SEQ ID NO: 1039326 - DNA, 22 bp, Artificial Sequence
  chemically synthesized
gaaatcttacataatgataact

SEQ ID NO: 1039327 - DNA, 22 bp, Artificial Sequence
  chemically synthesized
ttaaaaagttatcattatgtaa

SEQ ID NO: 1039328 - DNA, 22 bp, Artificial Sequence
  chemically synthesized
taaaaagttatcattatgtaag

SEQ ID NO: 1039329 - DNA, 22 bp, Artificial Sequence
  chemically synthesized
aaaaagttatcattatgtaaga

SEQ ID NO: 1039330 - DNA, 22 bp, Artificial Sequence
  chemically synthesized
aaaagttatcattatgtaagat

SEQ ID NO: 1039331 - DNA, 22 bp, Artificial Sequence
  chemically synthesized
aaatatatttgaaatcttacat

SEQ ID NO: 1039332 - DNA, 22 bp, Artificial Sequence
  chemically synthesized
caaatatatttgaaatcttaca

SEQ ID NO: 1039333 - DNA, 22 bp, Artificial Sequence
  chemically synthesized
tcaaatatatttgaaatcttac

SEQ ID NO: 1039334 - DNA, 22 bp, Artificial Sequence
  chemically synthesized
ctttcaaatatatttgaaatct

SEQ ID NO: 1039335 - DNA, 22 bp, Artificial Sequence
  chemically synthesized
tcattatgtaagatttcaaata

SEQ ID NO: 1039336 - DNA, 22 bp, Artificial Sequence
  chemically synthesized
ctactttcaaatatatttgaaa

SEQ ID NO: 1039337 - DNA, 22 bp, Artificial Sequence
  chemically synthesized
cctactttcaaatatatttgaa

SEQ ID NO: 1039338 - DNA, 22 bp, Artificial Sequence
  chemically synthesized
tcctactttcaaatatatttga

SEQ ID NO: 1039339 - DNA, 22 bp, Artificial Sequence
  chemically synthesized
tgtaagatttcaaatatatttg

SEQ ID NO: 1039340 - DNA, 22 bp, Artificial Sequence
  chemically synthesized
ttttcctactttcaaatatatt

SEQ ID NO: 1039341 - DNA, 22 bp, Artificial Sequence
  chemically synthesized
tattattttcctactttcaaat

SEQ ID NO: 1039342 - DNA, 22 bp, Artificial Sequence
  chemically synthesized
gtattattttcctactttcaaa

SEQ ID NO: 1039343 - DNA, 22 bp, Artificial Sequence
  chemically synthesized
tttgtattattttcctactttc

SEQ ID NO: 1039344 - DNA, 22 bp, Artificial Sequence
  chemically synthesized
caaatatatttgaaagtaggaa

SEQ ID NO: 1039345 - DNA, 22 bp, Artificial Sequence
  chemically synthesized
aaatatatttgaaagtaggaaa

SEQ ID NO: 1039346 - DNA, 22 bp, Artificial Sequence
  chemically synthesized
tgggagctatttgtattatttt

SEQ ID NO: 1039347 - DNA, 22 bp, Artificial Sequence
  chemically synthesized
gaaagtaggaaaataatacaaa

SEQ ID NO: 1039348 - DNA, 22 bp, Artificial Sequence
  chemically synthesized
aaagtaggaaaataatacaaat

SEQ ID NO: 1039349 - DNA, 22 bp, Artificial Sequence
  chemically synthesized
tagggttatgggagctatttgt

SEQ ID NO: 1039350 - DNA, 22 bp, Artificial Sequence
  chemically synthesized
gattatagggttatgggagcta

SEQ ID NO: 1039351 - DNA, 22 bp, Artificial Sequence
  chemically synthesized
gcactggattatagggttatgg

SEQ ID NO: 1039352 - DNA, 22 bp, Artificial Sequence
  chemically synthesized
ccataaccctataatccagtgc

SEQ ID NO: 1039353 - DNA, 22 bp, Artificial Sequence
  chemically synthesized
tccatggagtcataacagttgg

SEQ ID NO: 1039354 - DNA, 22 bp, Artificial Sequence
  chemically synthesized
taatccagtgccaactgttatg

SEQ ID NO: 1039355 - DNA, 22 bp, Artificial Sequence
  chemically synthesized
ttatgactccatggacaatcca

SEQ ID NO: 1039356 - DNA, 22 bp, Artificial Sequence
  chemically synthesized
aagaggtgagtgggtggattgt

SEQ ID NO: 1039357 - DNA, 22 bp, Artificial Sequence
  chemically synthesized
tgactccatggacaatccaccc

SEQ ID NO: 1039358 - DNA, 22 bp, Artificial Sequence
  chemically synthesized
gttgaagaggtgagtgggtgga

SEQ ID NO: 1039359 - DNA, 22 bp, Artificial Sequence
  chemically synthesized
catggacaatccacccactcac

SEQ ID NO: 1039360 - DNA, 22 bp, Artificial Sequence
  chemically synthesized
agaataatctagttgaagaggt

SEQ ID NO: 1039361 - DNA, 22 bp, Artificial Sequence
  chemically synthesized
cagaataatctagttgaagagg

SEQ ID NO: 1039362 - DNA, 22 bp, Artificial Sequence
  chemically synthesized
tttcagaataatctagttgaag

SEQ ID NO: 1039363 - DNA, 22 bp, Artificial Sequence
  chemically synthesized
gtttcagaataatctagttgaa

SEQ ID NO: 1039364 - DNA, 22 bp, Artificial Sequence
  chemically synthesized
acctcttcaactagattattct

SEQ ID NO: 1039365 - DNA, 22 bp, Artificial Sequence
  chemically synthesized
ttcaactagattattctgaaac

SEQ ID NO: 1039366 - DNA, 22 bp, Artificial Sequence
  chemically synthesized
caactagattattctgaaacaa

SEQ ID NO: 1039367 - DNA, 22 bp, Artificial Sequence
  chemically synthesized
aactagattattctgaaacaaa

SEQ ID NO: 1039368 - DNA, 22 bp, Artificial Sequence
  chemically synthesized
gattattctgaaacaaactgat

SEQ ID NO: 1039369 - DNA, 22 bp, Artificial Sequence
  chemically synthesized
tggagaaaataatatatcagtt

SEQ ID NO: 1039370 - DNA, 22 bp, Artificial Sequence
  chemically synthesized
atggagaaaataatatatcagt

SEQ ID NO: 1039371 - DNA, 22 bp, Artificial Sequence
  chemically synthesized
ttctgaaacaaactgatatatt

SEQ ID NO: 1039372 - DNA, 22 bp, Artificial Sequence
  chemically synthesized
tgaaacaaactgatatattatt

SEQ ID NO: 1039373 - DNA, 22 bp, Artificial Sequence
  chemically synthesized
aaacaaactgatatattatttt

SEQ ID NO: 1039374 - DNA, 22 bp, Artificial Sequence
  chemically synthesized
aagtatttatggagaaaataat

SEQ ID NO: 1039375 - DNA, 22 bp, Artificial Sequence
  chemically synthesized
atatattattttctccataaat

SEQ ID NO: 1039376 - DNA, 22 bp, Artificial Sequence
  chemically synthesized
ttttctccataaatacttcagc

SEQ ID NO: 1039377 - DNA, 22 bp, Artificial Sequence
  chemically synthesized
agcaagagaaaaatgctgaagt

SEQ ID NO: 1039378 - DNA, 22 bp, Artificial Sequence
  chemically synthesized
tctccataaatacttcagcatt

SEQ ID NO: 1039379 - DNA, 22 bp, Artificial Sequence
  chemically synthesized
cagcaagagaaaaatgctgaag

SEQ ID NO: 1039380 - DNA, 22 bp, Artificial Sequence
  chemically synthesized
ctccataaatacttcagcattt

SEQ ID NO: 1039381 - DNA, 22 bp, Artificial Sequence
  chemically synthesized
tccataaatacttcagcatttt

SEQ ID NO: 1039382 - DNA, 22 bp, Artificial Sequence
  chemically synthesized
cataaatacttcagcatttttc

SEQ ID NO: 1039383 - DNA, 22 bp, Artificial Sequence
  chemically synthesized
atgagagaatatttcagcaaga

SEQ ID NO: 1039384 - DNA, 22 bp, Artificial Sequence
  chemically synthesized
cagcatttttctcttgctgaaa

SEQ ID NO: 1039385 - DNA, 22 bp, Artificial Sequence
  chemically synthesized
agcatttttctcttgctgaaat

SEQ ID NO: 1039386 - DNA, 22 bp, Artificial Sequence
  chemically synthesized
tcatgagagaatatttcagcaa

SEQ ID NO: 1039387 - DNA, 22 bp, Artificial Sequence
  chemically synthesized
ttctcttgctgaaatattctct

SEQ ID NO: 1039388 - DNA, 22 bp, Artificial Sequence
  chemically synthesized
tctcttgctgaaatattctctc

SEQ ID NO: 1039389 - DNA, 22 bp, Artificial Sequence
  chemically synthesized
ctcttgctgaaatattctctca

SEQ ID NO: 1039390 - DNA, 22 bp, Artificial Sequence
  chemically synthesized
tcttgctgaaatattctctcat

SEQ ID NO: 1039391 - DNA, 22 bp, Artificial Sequence
  chemically synthesized
ttgctgaaatattctctcatga

SEQ ID NO: 1039392 - DNA, 22 bp, Artificial Sequence
  chemically synthesized
cgaaaaaagttctcatgagaga

SEQ ID NO: 1039393 - DNA, 22 bp, Artificial Sequence
  chemically synthesized
ccgaaaaaagttctcatgagag

SEQ ID NO: 1039394 - DNA, 22 bp, Artificial Sequence
  chemically synthesized
gctgaaatattctctcatgaga

SEQ ID NO: 1039395 - DNA, 22 bp, Artificial Sequence
  chemically synthesized
tccgaaaaaagttctcatgaga

SEQ ID NO: 1039396 - DNA, 22 bp, Artificial Sequence
  chemically synthesized
ctgaaatattctctcatgagaa

SEQ ID NO: 1039397 - DNA, 22 bp, Artificial Sequence
  chemically synthesized
aaatattctctcatgagaactt

SEQ ID NO: 1039398 - DNA, 22 bp, Artificial Sequence
  chemically synthesized
tatatgtactttccgaaaaaag

SEQ ID NO: 1039399 - DNA, 22 bp, Artificial Sequence
  chemically synthesized
tctcatgagaacttttttcgga

SEQ ID NO: 1039400 - DNA, 22 bp, Artificial Sequence
  chemically synthesized
tcatgagaacttttttcggaaa

SEQ ID NO: 1039401 - DNA, 22 bp, Artificial Sequence
  chemically synthesized
atgagaacttttttcggaaagt

SEQ ID NO: 1039402 - DNA, 22 bp, Artificial Sequence
  chemically synthesized
atggtattatatatgtactttc

SEQ ID NO: 1039403 - DNA, 22 bp, Artificial Sequence
  chemically synthesized
ttttcggaaagtacatatataa

SEQ ID NO: 1039404 - DNA, 22 bp, Artificial Sequence
  chemically synthesized
tttcggaaagtacatatataat

SEQ ID NO: 1039405 - DNA, 22 bp, Artificial Sequence
  chemically synthesized
ttcggaaagtacatatataata

SEQ ID NO: 1039406 - DNA, 22 bp, Artificial Sequence
  chemically synthesized
tcggaaagtacatatataatac

SEQ ID NO: 1039407 - DNA, 22 bp, Artificial Sequence
  chemically synthesized
cggaaagtacatatataatacc

SEQ ID NO: 1039408 - DNA, 22 bp, Artificial Sequence
  chemically synthesized
ggaaagtacatatataatacca

SEQ ID NO: 1039409 - DNA, 22 bp, Artificial Sequence
  chemically synthesized
taggtgtgttaatggtattata

SEQ ID NO: 1039410 - DNA, 22 bp, Artificial Sequence
  chemically synthesized
agactgtaggtgtgttaatggt

SEQ ID NO: 1039411 - DNA, 22 bp, Artificial Sequence
  chemically synthesized
ttaagactgtaggtgtgttaat

SEQ ID NO: 1039412 - DNA, 22 bp, Artificial Sequence
  chemically synthesized
gttaagactgtaggtgtgttaa

SEQ ID NO: 1039413 - DNA, 22 bp, Artificial Sequence
  chemically synthesized
tgttaagactgtaggtgtgtta

SEQ ID NO: 1039414 - DNA, 22 bp, Artificial Sequence
  chemically synthesized
ttgttaagactgtaggtgtgtt

SEQ ID NO: 1039415 - DNA, 22 bp, Artificial Sequence
  chemically synthesized
atgaacttttgttaagactgta

SEQ ID NO: 1039416 - DNA, 22 bp, Artificial Sequence
  chemically synthesized
acacacctacagtcttaacaaa

SEQ ID NO: 1039417 - DNA, 22 bp, Artificial Sequence
  chemically synthesized
aattaatgaacttttgttaaga

SEQ ID NO: 1039418 - DNA, 22 bp, Artificial Sequence
  chemically synthesized
attcaattaatgaacttttgtt

SEQ ID NO: 1039419 - DNA, 22 bp, Artificial Sequence
  chemically synthesized
gattcaattaatgaacttttgt

SEQ ID NO: 1039420 - DNA, 22 bp, Artificial Sequence
  chemically synthesized
cagtcttaacaaaagttcatta

SEQ ID NO: 1039421 - DNA, 22 bp, Artificial Sequence
  chemically synthesized
gatacttgattcaattaatgaa

SEQ ID NO: 1039422 - DNA, 22 bp, Artificial Sequence
  chemically synthesized
aacaaaagttcattaattgaat

SEQ ID NO: 1039423 - DNA, 22 bp, Artificial Sequence
  chemically synthesized
acaaaagttcattaattgaatc

SEQ ID NO: 1039424 - DNA, 22 bp, Artificial Sequence
  chemically synthesized
attaattgaatcaagtatctag

SEQ ID NO: 1039425 - DNA, 22 bp, Artificial Sequence
  chemically synthesized
aaatgtgaatagcaactagata

SEQ ID NO: 1039426 - DNA, 22 bp, Artificial Sequence
  chemically synthesized
attgaatcaagtatctagttgc

SEQ ID NO: 1039427 - DNA, 22 bp, Artificial Sequence
  chemically synthesized
aatcaagtatctagttgctatt

SEQ ID NO: 1039428 - DNA, 22 bp, Artificial Sequence
  chemically synthesized
agctcaaatgtgaatagcaact

SEQ ID NO: 1039429 - DNA, 22 bp, Artificial Sequence
  chemically synthesized
cagctcaaatgtgaatagcaac

SEQ ID NO: 1039430 - DNA, 22 bp, Artificial Sequence
  chemically synthesized
ccacttcagctcaaatgtgaat

SEQ ID NO: 1039431 - DNA, 22 bp, Artificial Sequence
  chemically synthesized
cccacttcagctcaaatgtgaa

SEQ ID NO: 1039432 - DNA, 22 bp, Artificial Sequence
  chemically synthesized
cttcccacttcagctcaaatgt

SEQ ID NO: 1039433 - DNA, 22 bp, Artificial Sequence
  chemically synthesized
ccttcccacttcagctcaaatg

SEQ ID NO: 1039434 - DNA, 22 bp, Artificial Sequence
  chemically synthesized
gttgctattcacatttgagctg

SEQ ID NO: 1039435 - DNA, 22 bp, Artificial Sequence
  chemically synthesized
ctattcacatttgagctgaagt

SEQ ID NO: 1039436 - DNA, 22 bp, Artificial Sequence
  chemically synthesized
aacttccttcccacttcagctc

SEQ ID NO: 1039437 - DNA, 22 bp, Artificial Sequence
  chemically synthesized
ttcacatttgagctgaagtggg

SEQ ID NO: 1039438 - DNA, 22 bp, Artificial Sequence
  chemically synthesized
ctaaacttccttcccacttcag

SEQ ID NO: 1039439 - DNA, 22 bp, Artificial Sequence
  chemically synthesized
cctaaacttccttcccacttca

SEQ ID NO: 1039440 - DNA, 22 bp, Artificial Sequence
  chemically synthesized
tcctaaacttccttcccacttc

SEQ ID NO: 1039441 - DNA, 22 bp, Artificial Sequence
  chemically synthesized
acatttgagctgaagtgggaag

SEQ ID NO: 1039442 - DNA, 22 bp, Artificial Sequence
  chemically synthesized
ttttcctaaacttccttcccac

SEQ ID NO: 1039443 - DNA, 22 bp, Artificial Sequence
  chemically synthesized
gagctgaagtgggaaggaagtt

SEQ ID NO: 1039444 - DNA, 22 bp, Artificial Sequence
  chemically synthesized
agctgaagtgggaaggaagttt

SEQ ID NO: 1039445 - DNA, 22 bp, Artificial Sequence
  chemically synthesized
agctgttttcctaaacttcctt

SEQ ID NO: 1039446 - DNA, 22 bp, Artificial Sequence
  chemically synthesized
ctgagctgttttcctaaacttc

SEQ ID NO: 1039447 - DNA, 22 bp, Artificial Sequence
  chemically synthesized
aagtgggaaggaagtttaggaa

SEQ ID NO: 1039448 - DNA, 22 bp, Artificial Sequence
  chemically synthesized
tgctgagctgttttcctaaact

SEQ ID NO: 1039449 - DNA, 22 bp, Artificial Sequence
  chemically synthesized
aattctgctgagctgttttcct

SEQ ID NO: 1039450 - DNA, 22 bp, Artificial Sequence
  chemically synthesized
aggaaaacagctcagcagaatt

SEQ ID NO: 1039451 - DNA, 22 bp, Artificial Sequence
  chemically synthesized
ggaaaacagctcagcagaattc

SEQ ID NO: 1039452 - DNA, 22 bp, Artificial Sequence
  chemically synthesized
acccaacacacagtcactgaat

SEQ ID NO: 1039453 - DNA, 22 bp, Artificial Sequence
  chemically synthesized
cacccaacacacagtcactgaa

SEQ ID NO: 1039454 - DNA, 22 bp, Artificial Sequence
  chemically synthesized
ttcacccaacacacagtcactg

SEQ ID NO: 1039455 - DNA, 22 bp, Artificial Sequence
  chemically synthesized
cttcacccaacacacagtcact

SEQ ID NO: 1039456 - DNA, 22 bp, Artificial Sequence
  chemically synthesized
agcagaattcagtgactgtgtg

SEQ ID NO: 1039457 - DNA, 22 bp, Artificial Sequence
  chemically synthesized
ttcttcacccaacacacagtca

SEQ ID NO: 1039458 - DNA, 22 bp, Artificial Sequence
  chemically synthesized
ctcttcttcacccaacacacag

SEQ ID NO: 1039459 - DNA, 22 bp, Artificial Sequence
  chemically synthesized
cctcttcttcacccaacacaca

SEQ ID NO: 1039460 - DNA, 22 bp, Artificial Sequence
  chemically synthesized
ttcctcttcttcacccaacaca

SEQ ID NO: 1039461 - DNA, 22 bp, Artificial Sequence
  chemically synthesized
agtgactgtgtgttgggtgaag

SEQ ID NO: 1039462 - DNA, 22 bp, Artificial Sequence
  chemically synthesized
aagttcttcctcttcttcaccc

SEQ ID NO: 1039463 - DNA, 22 bp, Artificial Sequence
  chemically synthesized
attcaagttcttcctcttcttc

SEQ ID NO: 1039464 - DNA, 22 bp, Artificial Sequence
  chemically synthesized
tgtgttgggtgaagaagaggaa

SEQ ID NO: 1039465 - DNA, 22 bp, Artificial Sequence
  chemically synthesized
agactcattcaagttcttcctc

SEQ ID NO: 1039466 - DNA, 22 bp, Artificial Sequence
  chemically synthesized
ggtgaagaagaggaagaacttg

SEQ ID NO: 1039467 - DNA, 22 bp, Artificial Sequence
  chemically synthesized
gaatgagtcttaggtatctggc

SEQ ID NO: 1039468 - DNA, 22 bp, Artificial Sequence
  chemically synthesized
aatgagtcttaggtatctggcc

SEQ ID NO: 1039469 - DNA, 22 bp, Artificial Sequence
  chemically synthesized
aggtatctggcctgggcatcca

SEQ ID NO: 1039470 - DNA, 22 bp, Artificial Sequence
  chemically synthesized
ggtatctggcctgggcatccac

SEQ ID NO: 1039471 - DNA, 22 bp, Artificial Sequence
  chemically synthesized
gcctgggcatccacatgatttg

SEQ ID NO: 1039472 - DNA, 22 bp, Artificial Sequence
  chemically synthesized
cccaatgacaccacaaatcatg

SEQ ID NO: 1039473 - DNA, 22 bp, Artificial Sequence
  chemically synthesized
ttacccaatgacaccacaaatc

SEQ ID NO: 1039474 - DNA, 22 bp, Artificial Sequence
  chemically synthesized
ggcatccacatgatttgtggtg

SEQ ID NO: 1039475 - DNA, 22 bp, Artificial Sequence
  chemically synthesized
aaatcctgttacccaatgacac

SEQ ID NO: 1039476 - DNA, 22 bp, Artificial Sequence
  chemically synthesized
tctgaaatcctgttacccaatg

SEQ ID NO: 1039477 - DNA, 22 bp, Artificial Sequence
  chemically synthesized
gtggtgtcattgggtaacagga

SEQ ID NO: 1039478 - DNA, 22 bp, Artificial Sequence
  chemically synthesized
atctgtctgaaatcctgttacc

SEQ ID NO: 1039479 - DNA, 22 bp, Artificial Sequence
  chemically synthesized
tggtgtcattgggtaacaggat

SEQ ID NO: 1039480 - DNA, 22 bp, Artificial Sequence
  chemically synthesized
catctgtctgaaatcctgttac

SEQ ID NO: 1039481 - DNA, 22 bp, Artificial Sequence
  chemically synthesized
ttcatctgtctgaaatcctgtt

SEQ ID NO: 1039482 - DNA, 22 bp, Artificial Sequence
  chemically synthesized
ggtaacaggatttcagacagat

SEQ ID NO: 1039483 - DNA, 22 bp, Artificial Sequence
  chemically synthesized
cagacagatgaagaggttccat

SEQ ID NO: 1039484 - DNA, 22 bp, Artificial Sequence
  chemically synthesized
agacagatgaagaggttccatg

SEQ ID NO: 1039485 - DNA, 22 bp, Artificial Sequence
  chemically synthesized
tgcacacatacacaagcatgta

SEQ ID NO: 1039486 - DNA, 22 bp, Artificial Sequence
  chemically synthesized
atgcacacatacacaagcatgt

SEQ ID NO: 1039487 - DNA, 22 bp, Artificial Sequence
  chemically synthesized
catggttacatgcttgtgtatg

SEQ ID NO: 1039488 - DNA, 22 bp, Artificial Sequence
  chemically synthesized
atcacttatgcacacatacaca

SEQ ID NO: 1039489 - DNA, 22 bp, Artificial Sequence
  chemically synthesized
aactgatcacttatgcacacat

SEQ ID NO: 1039490 - DNA, 22 bp, Artificial Sequence
  chemically synthesized
catgcttgtgtatgtgtgcata

SEQ ID NO: 1039491 - DNA, 22 bp, Artificial Sequence
  chemically synthesized
gtgtatgtgtgcataagtgatc

SEQ ID NO: 1039492 - DNA, 22 bp, Artificial Sequence
  chemically synthesized
tgtatgtgtgcataagtgatca

SEQ ID NO: 1039493 - DNA, 22 bp, Artificial Sequence
  chemically synthesized
agaatgaccatgtccaaaattg

SEQ ID NO: 1039494 - DNA, 22 bp, Artificial Sequence
  chemically synthesized
cagaatgaccatgtccaaaatt

SEQ ID NO: 1039495 - DNA, 22 bp, Artificial Sequence
  chemically synthesized
tcagaatgaccatgtccaaaat

SEQ ID NO: 1039496 - DNA, 22 bp, Artificial Sequence
  chemically synthesized
ttcagaatgaccatgtccaaaa

SEQ ID NO: 1039497 - DNA, 22 bp, Artificial Sequence
  chemically synthesized
aaaggcttttcagaatgaccat

SEQ ID NO: 1039498 - DNA, 22 bp, Artificial Sequence
  chemically synthesized
aattttggacatggtcattctg

SEQ ID NO: 1039499 - DNA, 22 bp, Artificial Sequence
  chemically synthesized
tggacatggtcattctgaaaag

SEQ ID NO: 1039500 - DNA, 22 bp, Artificial Sequence
  chemically synthesized
atgcctcaaaggcttttcagaa

SEQ ID NO: 1039501 - DNA, 22 bp, Artificial Sequence
  chemically synthesized
ggacatggtcattctgaaaagc

SEQ ID NO: 1039502 - DNA, 22 bp, Artificial Sequence
  chemically synthesized
gatgcctcaaaggcttttcaga

SEQ ID NO: 1039503 - DNA, 22 bp, Artificial Sequence
  chemically synthesized
gacatggtcattctgaaaagcc

SEQ ID NO: 1039504 - DNA, 22 bp, Artificial Sequence
  chemically synthesized
cagtttgatgcctcaaaggctt

SEQ ID NO: 1039505 - DNA, 22 bp, Artificial Sequence
  chemically synthesized
tgaaaagcctttgaggcatcaa

SEQ ID NO: 1039506 - DNA, 22 bp, Artificial Sequence
  chemically synthesized
gaacatctacagtttgatgcct

SEQ ID NO: 1039507 - DNA, 22 bp, Artificial Sequence
  chemically synthesized
aaaagcctttgaggcatcaaac

SEQ ID NO: 1039508 - DNA, 22 bp, Artificial Sequence
  chemically synthesized
tggaacatctacagtttgatgc

SEQ ID NO: 1039509 - DNA, 22 bp, Artificial Sequence
  chemically synthesized
cctctggaacatctacagtttg

SEQ ID NO: 1039510 - DNA, 22 bp, Artificial Sequence
  chemically synthesized
tgaggcatcaaactgtagatgt

SEQ ID NO: 1039511 - DNA, 22 bp, Artificial Sequence
  chemically synthesized
gaggcatcaaactgtagatgtt

SEQ ID NO: 1039512 - DNA, 22 bp, Artificial Sequence
  chemically synthesized
aactgcctctggaacatctaca

SEQ ID NO: 1039513 - DNA, 22 bp, Artificial Sequence
  chemically synthesized
aggcatcaaactgtagatgttc

SEQ ID NO: 1039514 - DNA, 22 bp, Artificial Sequence
  chemically synthesized
caactgcctctggaacatctac

SEQ ID NO: 1039515 - DNA, 22 bp, Artificial Sequence
  chemically synthesized
atttcaactgcctctggaacat

SEQ ID NO: 1039516 - DNA, 22 bp, Artificial Sequence
  chemically synthesized
aaaatctgatttcaactgcctc

SEQ ID NO: 1039517 - DNA, 22 bp, Artificial Sequence
  chemically synthesized
tagatgttccagaggcagttga

SEQ ID NO: 1039518 - DNA, 22 bp, Artificial Sequence
  chemically synthesized
tcaaaatctgatttcaactgcc

SEQ ID NO: 1039519 - DNA, 22 bp, Artificial Sequence
  chemically synthesized
ctcaaaatctgatttcaactgc

SEQ ID NO: 1039520 - DNA, 22 bp, Artificial Sequence
  chemically synthesized
ttctcaaaatctgatttcaact

SEQ ID NO: 1039521 - DNA, 22 bp, Artificial Sequence
  chemically synthesized
ctcttctcaaaatctgatttca

SEQ ID NO: 1039522 - DNA, 22 bp, Artificial Sequence
  chemically synthesized
cagaggcagttgaaatcagatt

SEQ ID NO: 1039523 - DNA, 22 bp, Artificial Sequence
  chemically synthesized
ctcctcttctcaaaatctgatt

SEQ ID NO: 1039524 - DNA, 22 bp, Artificial Sequence
  chemically synthesized
actcctcttctcaaaatctgat

SEQ ID NO: 1039525 - DNA, 22 bp, Artificial Sequence
  chemically synthesized
ccatcttactcctcttctcaaa

SEQ ID NO: 1039526 - DNA, 22 bp, Artificial Sequence
  chemically synthesized
aaatcagattttgagaagagga

SEQ ID NO: 1039527 - DNA, 22 bp, Artificial Sequence
  chemically synthesized
agcaatccctgccatcttactc

SEQ ID NO: 1039528 - DNA, 22 bp, Artificial Sequence
  chemically synthesized
tgagaagaggagtaagatggca

SEQ ID NO: 1039529 - DNA, 22 bp, Artificial Sequence
  chemically synthesized
gagaagaggagtaagatggcag

SEQ ID NO: 1039530 - DNA, 22 bp, Artificial Sequence
  chemically synthesized
agaagaggagtaagatggcagg

SEQ ID NO: 1039531 - DNA, 22 bp, Artificial Sequence
  chemically synthesized
ctgagccatacatattttcaca

SEQ ID NO: 1039532 - DNA, 22 bp, Artificial Sequence
  chemically synthesized
agccatacatattttcacattt

SEQ ID NO: 1039533 - DNA, 22 bp, Artificial Sequence
  chemically synthesized
gtccatgtatccaaatgtgaaa

SEQ ID NO: 1039534 - DNA, 22 bp, Artificial Sequence
  chemically synthesized
agaaagcctagtccatgtatcc

SEQ ID NO: 1039535 - DNA, 22 bp, Artificial Sequence
  chemically synthesized
ctcagaaagcctagtccatgta

SEQ ID NO: 1039536 - DNA, 22 bp, Artificial Sequence
  chemically synthesized
tcacatttggatacatggacta

SEQ ID NO: 1039537 - DNA, 22 bp, Artificial Sequence
  chemically synthesized
gctcagaaagcctagtccatgt

SEQ ID NO: 1039538 - DNA, 22 bp, Artificial Sequence
  chemically synthesized
cacatttggatacatggactag

SEQ ID NO: 1039539 - DNA, 22 bp, Artificial Sequence
  chemically synthesized
tgctcagaaagcctagtccatg

SEQ ID NO: 1039540 - DNA, 22 bp, Artificial Sequence
  chemically synthesized
acatttggatacatggactagg

SEQ ID NO: 1039541 - DNA, 22 bp, Artificial Sequence
  chemically synthesized
tttgctcagaaagcctagtcca

SEQ ID NO: 1039542 - DNA, 22 bp, Artificial Sequence
  chemically synthesized
ggatacatggactaggctttct

SEQ ID NO: 1039543 - DNA, 22 bp, Artificial Sequence
  chemically synthesized
gatacatggactaggctttctg

SEQ ID NO: 1039544 - DNA, 22 bp, Artificial Sequence
  chemically synthesized
caactctttgctcagaaagcct

SEQ ID NO: 1039545 - DNA, 22 bp, Artificial Sequence
  chemically synthesized
ctacaactctttgctcagaaag

SEQ ID NO: 1039546 - DNA, 22 bp, Artificial Sequence
  chemically synthesized
agacagttactacaactctttg

SEQ ID NO: 1039547 - DNA, 22 bp, Artificial Sequence
  chemically synthesized
ggctttctgagcaaagagttgt

SEQ ID NO: 1039548 - DNA, 22 bp, Artificial Sequence
  chemically synthesized
aagacagttactacaactcttt

SEQ ID NO: 1039549 - DNA, 22 bp, Artificial Sequence
  chemically synthesized
taagacagttactacaactctt

SEQ ID NO: 1039550 - DNA, 22 bp, Artificial Sequence
  chemically synthesized
tctgagcaaagagttgtagtaa

SEQ ID NO: 1039551 - DNA, 22 bp, Artificial Sequence
  chemically synthesized
ctgagcaaagagttgtagtaac

SEQ ID NO: 1039552 - DNA, 22 bp, Artificial Sequence
  chemically synthesized
tgagcaaagagttgtagtaact

SEQ ID NO: 1039553 - DNA, 22 bp, Artificial Sequence
  chemically synthesized
agcaaagagttgtagtaactgt

SEQ ID NO: 1039554 - DNA, 22 bp, Artificial Sequence
  chemically synthesized
agtcaccctttaagacagttac

SEQ ID NO: 1039555 - DNA, 22 bp, Artificial Sequence
  chemically synthesized
ccattcagtcaccctttaagac

SEQ ID NO: 1039556 - DNA, 22 bp, Artificial Sequence
  chemically synthesized
gccattcagtcaccctttaaga

SEQ ID NO: 1039557 - DNA, 22 bp, Artificial Sequence
  chemically synthesized
tagtaactgtcttaaagggtga

SEQ ID NO: 1039558 - DNA, 22 bp, Artificial Sequence
  chemically synthesized
tcttaaagggtgactgaatggc

SEQ ID NO: 1039559 - DNA, 22 bp, Artificial Sequence
  chemically synthesized
caaggtacgcttgccattcagt

SEQ ID NO: 1039560 - DNA, 22 bp, Artificial Sequence
  chemically synthesized
aaagggtgactgaatggcaagc

SEQ ID NO: 1039561 - DNA, 22 bp, Artificial Sequence
  chemically synthesized
aagggtgactgaatggcaagcg

SEQ ID NO: 1039562 - DNA, 22 bp, Artificial Sequence
  chemically synthesized
aactccaaggtacgcttgccat

SEQ ID NO: 1039563 - DNA, 22 bp, Artificial Sequence
  chemically synthesized
aatggcaagcgtaccttggagt

SEQ ID NO: 1039564 - DNA, 22 bp, Artificial Sequence
  chemically synthesized
cagagcaatgcactaaactcca

SEQ ID NO: 1039565 - DNA, 22 bp, Artificial Sequence
  chemically synthesized
tccagagcaatgcactaaactc

SEQ ID NO: 1039566 - DNA, 22 bp, Artificial Sequence
  chemically synthesized
aatctctccagagcaatgcact

SEQ ID NO: 1039567 - DNA, 22 bp, Artificial Sequence
  chemically synthesized
aaatctctccagagcaatgcac

SEQ ID NO: 1039568 - DNA, 22 bp, Artificial Sequence
  chemically synthesized
taaatctctccagagcaatgca

SEQ ID NO: 1039569 - DNA, 22 bp, Artificial Sequence
  chemically synthesized
ttaaatctctccagagcaatgc

SEQ ID NO: 1039570 - DNA, 22 bp, Artificial Sequence
  chemically synthesized
ggagtttagtgcattgctctgg

SEQ ID NO: 1039571 - DNA, 22 bp, Artificial Sequence
  chemically synthesized
gagtttagtgcattgctctgga

SEQ ID NO: 1039572 - DNA, 22 bp, Artificial Sequence
  chemically synthesized
agtgcattgctctggagagatt

SEQ ID NO: 1039573 - DNA, 22 bp, Artificial Sequence
  chemically synthesized
gtgcattgctctggagagattt

SEQ ID NO: 1039574 - DNA, 22 bp, Artificial Sequence
  chemically synthesized
gagataaaagtttttaaatctc

SEQ ID NO: 1039575 - DNA, 22 bp, Artificial Sequence
  chemically synthesized
ggagataaaagtttttaaatct

SEQ ID NO: 1039576 - DNA, 22 bp, Artificial Sequence
  chemically synthesized
ttggagataaaagtttttaaat

SEQ ID NO: 1039577 - DNA, 22 bp, Artificial Sequence
  chemically synthesized
ctctggagagatttaaaaactt

SEQ ID NO: 1039578 - DNA, 22 bp, Artificial Sequence
  chemically synthesized
tggagagatttaaaaactttta

SEQ ID NO: 1039579 - DNA, 22 bp, Artificial Sequence
  chemically synthesized
gagagatttaaaaacttttatc

SEQ ID NO: 1039580 - DNA, 22 bp, Artificial Sequence
  chemically synthesized
aaaaacttttatctccaagagc

SEQ ID NO: 1039581 - DNA, 22 bp, Artificial Sequence
  chemically synthesized
aaaacttttatctccaagagcc

SEQ ID NO: 1039582 - DNA, 22 bp, Artificial Sequence
  chemically synthesized
aaatgtaatcaaagggctcttg

SEQ ID NO: 1039583 - DNA, 22 bp, Artificial Sequence
  chemically synthesized
ttatctccaagagccctttgat

SEQ ID NO: 1039584 - DNA, 22 bp, Artificial Sequence
  chemically synthesized
tatctccaagagccctttgatt

SEQ ID NO: 1039585 - DNA, 22 bp, Artificial Sequence
  chemically synthesized
atctccaagagccctttgatta

SEQ ID NO: 1039586 - DNA, 22 bp, Artificial Sequence
  chemically synthesized
tctccaagagccctttgattac

SEQ ID NO: 1039587 - DNA, 22 bp, Artificial Sequence
  chemically synthesized
caagagccctttgattacattt

SEQ ID NO: 1039588 - DNA, 22 bp, Artificial Sequence
  chemically synthesized
gaatataagttgaaatgtaatc

SEQ ID NO: 1039589 - DNA, 22 bp, Artificial Sequence
  chemically synthesized
ggaatataagttgaaatgtaat

SEQ ID NO: 1039590 - DNA, 22 bp, Artificial Sequence
  chemically synthesized
tggaatataagttgaaatgtaa

SEQ ID NO: 1039591 - DNA, 22 bp, Artificial Sequence
  chemically synthesized
ttggaatataagttgaaatgta

SEQ ID NO: 1039592 - DNA, 22 bp, Artificial Sequence
  chemically synthesized
tttttggaatataagttgaaat

SEQ ID NO: 1039593 - DNA, 22 bp, Artificial Sequence
  chemically synthesized
ttatttttggaatataagttga

SEQ ID NO: 1039594 - DNA, 22 bp, Artificial Sequence
  chemically synthesized
tgattacatttcaacttatatt

SEQ ID NO: 1039595 - DNA, 22 bp, Artificial Sequence
  chemically synthesized
gattacatttcaacttatattc

SEQ ID NO: 1039596 - DNA, 22 bp, Artificial Sequence
  chemically synthesized
attacatttcaacttatattcc

SEQ ID NO: 1039597 - DNA, 22 bp, Artificial Sequence
  chemically synthesized
ggtctattatttttggaatata

SEQ ID NO: 1039598 - DNA, 22 bp, Artificial Sequence
  chemically synthesized
catttcaacttatattccaaaa

SEQ ID NO: 1039599 - DNA, 22 bp, Artificial Sequence
  chemically synthesized
caacttatattccaaaaataat

SEQ ID NO: 1039600 - DNA, 22 bp, Artificial Sequence
  chemically synthesized
aacttatattccaaaaataata

SEQ ID NO: 1039601 - DNA, 22 bp, Artificial Sequence
  chemically synthesized
atattccaaaaataatagacct

SEQ ID NO: 1039602 - DNA, 22 bp, Artificial Sequence
  chemically synthesized
tattccaaaaataatagaccta

SEQ ID NO: 1039603 - DNA, 22 bp, Artificial Sequence
  chemically synthesized
taaaccaatgatctaggtctat

SEQ ID NO: 1039604 - DNA, 22 bp, Artificial Sequence
  chemically synthesized
caaaaataatagacctagatca

SEQ ID NO: 1039605 - DNA, 22 bp, Artificial Sequence
  chemically synthesized
ggctataaaccaatgatctagg

SEQ ID NO: 1039606 - DNA, 22 bp, Artificial Sequence
  chemically synthesized
tgggctataaaccaatgatcta

SEQ ID NO: 1039607 - DNA, 22 bp, Artificial Sequence
  chemically synthesized
ctctgggctataaaccaatgat

SEQ ID NO: 1039608 - DNA, 22 bp, Artificial Sequence
  chemically synthesized
gctctgggctataaaccaatga

SEQ ID NO: 1039609 - DNA, 22 bp, Artificial Sequence
  chemically synthesized
tgctctgggctataaaccaatg

SEQ ID NO: 1039610 - DNA, 22 bp, Artificial Sequence
  chemically synthesized
gatcattggtttatagcccaga

SEQ ID NO: 1039611 - DNA, 22 bp, Artificial Sequence
  chemically synthesized
gtttatagcccagagcaaagtc

SEQ ID NO: 1039612 - DNA, 22 bp, Artificial Sequence
  chemically synthesized
atagcccagagcaaagtctctg

SEQ ID NO: 1039613 - DNA, 22 bp, Artificial Sequence
  chemically synthesized
tagcccagagcaaagtctctgt

SEQ ID NO: 1039614 - DNA, 22 bp, Artificial Sequence
  chemically synthesized
tgtcttcctgtatgtctgtctc

SEQ ID NO: 1039615 - DNA, 22 bp, Artificial Sequence
  chemically synthesized
tcttcctgtatgtctgtctctc

SEQ ID NO: 1039616 - DNA, 22 bp, Artificial Sequence
  chemically synthesized
cctgtatgtctgtctctctcac

SEQ ID NO: 1039617 - DNA, 22 bp, Artificial Sequence
  chemically synthesized
ctgtatgtctgtctctctcact

SEQ ID NO: 1039618 - DNA, 22 bp, Artificial Sequence
  chemically synthesized
tatgtctgtctctctcactttc

SEQ ID NO: 1039619 - DNA, 22 bp, Artificial Sequence
  chemically synthesized
atgtatcaggaggagagaaagt

SEQ ID NO: 1039620 - DNA, 22 bp, Artificial Sequence
  chemically synthesized
tctctctcactttctctcctcc

SEQ ID NO: 1039621 - DNA, 22 bp, Artificial Sequence
  chemically synthesized
tctcactttctctcctcctgat

SEQ ID NO: 1039622 - DNA, 22 bp, Artificial Sequence
  chemically synthesized
tcactttctctcctcctgatac

SEQ ID NO: 1039623 - DNA, 22 bp, Artificial Sequence
  chemically synthesized
actttctctcctcctgatacat

SEQ ID NO: 1039624 - DNA, 22 bp, Artificial Sequence
  chemically synthesized
tatagagcacctgatgtatcag

SEQ ID NO: 1039625 - DNA, 22 bp, Artificial Sequence
  chemically synthesized
tctctcctcctgatacatcagg

SEQ ID NO: 1039626 - DNA, 22 bp, Artificial Sequence
  chemically synthesized
ctctcctcctgatacatcaggt

SEQ ID NO: 1039627 - DNA, 22 bp, Artificial Sequence
  chemically synthesized
tctcctcctgatacatcaggtg

SEQ ID NO: 1039628 - DNA, 22 bp, Artificial Sequence
  chemically synthesized
tcctcctgatacatcaggtgct

SEQ ID NO: 1039629 - DNA, 22 bp, Artificial Sequence
  chemically synthesized
gagattatatagagcacctgat

SEQ ID NO: 1039630 - DNA, 22 bp, Artificial Sequence
  chemically synthesized
ggagattatatagagcacctga

SEQ ID NO: 1039631 - DNA, 22 bp, Artificial Sequence
  chemically synthesized
ctcctgatacatcaggtgctct

SEQ ID NO: 1039632 - DNA, 22 bp, Artificial Sequence
  chemically synthesized
ctgatacatcaggtgctctata

SEQ ID NO: 1039633 - DNA, 22 bp, Artificial Sequence
  chemically synthesized
atacatcaggtgctctatataa

SEQ ID NO: 1039634 - DNA, 22 bp, Artificial Sequence
  chemically synthesized
tggatcttggagattatataga

SEQ ID NO: 1039635 - DNA, 22 bp, Artificial Sequence
  chemically synthesized
tatataatctccaagatccaca

SEQ ID NO: 1039636 - DNA, 22 bp, Artificial Sequence
  chemically synthesized
tataatctccaagatccacaat

SEQ ID NO: 1039637 - DNA, 22 bp, Artificial Sequence
  chemically synthesized
caagatccacaattctgggatt

SEQ ID NO: 1039638 - DNA, 22 bp, Artificial Sequence
  chemically synthesized
tagtacaggagagaaatcccag

SEQ ID NO: 1039639 - DNA, 22 bp, Artificial Sequence
  chemically synthesized
tgggatttctctcctgtactac

SEQ ID NO: 1039640 - DNA, 22 bp, Artificial Sequence
  chemically synthesized
ggatttctctcctgtactacaa

SEQ ID NO: 1039641 - DNA, 22 bp, Artificial Sequence
  chemically synthesized
tgagtgcaggggttgtagtaca

SEQ ID NO: 1039642 - DNA, 22 bp, Artificial Sequence
  chemically synthesized
tctgtgagtgcaggggttgtag

SEQ ID NO: 1039643 - DNA, 22 bp, Artificial Sequence
  chemically synthesized
atctgtgagtgcaggggttgta

SEQ ID NO: 1039644 - DNA, 22 bp, Artificial Sequence
  chemically synthesized
ctctcctgtactacaacccctg

SEQ ID NO: 1039645 - DNA, 22 bp, Artificial Sequence
  chemically synthesized
tctcctgtactacaacccctgc

SEQ ID NO: 1039646 - DNA, 22 bp, Artificial Sequence
  chemically synthesized
tcctgtactacaacccctgcac

SEQ ID NO: 1039647 - DNA, 22 bp, Artificial Sequence
  chemically synthesized
ctgtactacaacccctgcactc

SEQ ID NO: 1039648 - DNA, 22 bp, Artificial Sequence
  chemically synthesized
tactacaacccctgcactcaca

SEQ ID NO: 1039649 - DNA, 22 bp, Artificial Sequence
  chemically synthesized
caacccctgcactcacagataa

SEQ ID NO: 1039650 - DNA, 22 bp, Artificial Sequence
  chemically synthesized
agggcaagatgtttatctgtga

SEQ ID NO: 1039651 - DNA, 22 bp, Artificial Sequence
  chemically synthesized
cactcacagataaacatcttgc

SEQ ID NO: 1039652 - DNA, 22 bp, Artificial Sequence
  chemically synthesized
aaaagcatctcagggcaagatg

SEQ ID NO: 1039653 - DNA, 22 bp, Artificial Sequence
  chemically synthesized
acagataaacatcttgccctga

SEQ ID NO: 1039654 - DNA, 22 bp, Artificial Sequence
  chemically synthesized
ctcaaaagcatctcagggcaag

SEQ ID NO: 1039655 - DNA, 22 bp, Artificial Sequence
  chemically synthesized
attactcaaaagcatctcaggg

SEQ ID NO: 1039656 - DNA, 22 bp, Artificial Sequence
  chemically synthesized
gccctgagatgcttttgagtaa

SEQ ID NO: 1039657 - DNA, 22 bp, Artificial Sequence
  chemically synthesized
ccctgagatgcttttgagtaat

SEQ ID NO: 1039658 - DNA, 22 bp, Artificial Sequence
  chemically synthesized
agatgcttttgagtaattaatg

SEQ ID NO: 1039659 - DNA, 22 bp, Artificial Sequence
  chemically synthesized
gatgagagaatacatcattaat

SEQ ID NO: 1039660 - DNA, 22 bp, Artificial Sequence
  chemically synthesized
tggatgagagaatacatcatta

SEQ ID NO: 1039661 - DNA, 22 bp, Artificial Sequence
  chemically synthesized
ttgagtaattaatgatgtattc

SEQ ID NO: 1039662 - DNA, 22 bp, Artificial Sequence
  chemically synthesized
tgagtaattaatgatgtattct

SEQ ID NO: 1039663 - DNA, 22 bp, Artificial Sequence
  chemically synthesized
gagtaattaatgatgtattctc

SEQ ID NO: 1039664 - DNA, 22 bp, Artificial Sequence
  chemically synthesized
agtaattaatgatgtattctct

SEQ ID NO: 1039665 - DNA, 22 bp, Artificial Sequence
  chemically synthesized
atgatgtattctctcatccaga

SEQ ID NO: 1039666 - DNA, 22 bp, Artificial Sequence
  chemically synthesized
gtcaggaaacataagatctctg

SEQ ID NO: 1039667 - DNA, 22 bp, Artificial Sequence
  chemically synthesized
tctagtcaggaaacataagatc

SEQ ID NO: 1039668 - DNA, 22 bp, Artificial Sequence
  chemically synthesized
tctcatccagagatcttatgtt

SEQ ID NO: 1039669 - DNA, 22 bp, Artificial Sequence
  chemically synthesized
atctagtcaggaaacataagat

SEQ ID NO: 1039670 - DNA, 22 bp, Artificial Sequence
  chemically synthesized
tcatccagagatcttatgtttc

SEQ ID NO: 1039671 - DNA, 22 bp, Artificial Sequence
  chemically synthesized
atccagagatcttatgtttcct

SEQ ID NO: 1039672 - DNA, 22 bp, Artificial Sequence
  chemically synthesized
tatttatctagtcaggaaacat

SEQ ID NO: 1039673 - DNA, 22 bp, Artificial Sequence
  chemically synthesized
atatttatctagtcaggaaaca

SEQ ID NO: 1039674 - DNA, 22 bp, Artificial Sequence
  chemically synthesized
aaatttatatttatctagtcag

SEQ ID NO: 1039675 - DNA, 22 bp, Artificial Sequence
  chemically synthesized
ttaaaatttatatttatctagt

SEQ ID NO: 1039676 - DNA, 22 bp, Artificial Sequence
  chemically synthesized
gttaaaatttatatttatctag

SEQ ID NO: 1039677 - DNA, 22 bp, Artificial Sequence
  chemically synthesized
atgtttcctgactagataaata

SEQ ID NO: 1039678 - DNA, 22 bp, Artificial Sequence
  chemically synthesized
tgtttcctgactagataaatat

SEQ ID NO: 1039679 - DNA, 22 bp, Artificial Sequence
  chemically synthesized
atatttgttaaaatttatattt

SEQ ID NO: 1039680 - DNA, 22 bp, Artificial Sequence
  chemically synthesized
cctgactagataaatataaatt

SEQ ID NO: 1039681 - DNA, 22 bp, Artificial Sequence
  chemically synthesized
ctgactagataaatataaattt

SEQ ID NO: 1039682 - DNA, 22 bp, Artificial Sequence
  chemically synthesized
ttgatatttgttaaaatttata

SEQ ID NO: 1039683 - DNA, 22 bp, Artificial Sequence
  chemically synthesized
gttgatatttgttaaaatttat

SEQ ID NO: 1039684 - DNA, 22 bp, Artificial Sequence
  chemically synthesized
actagataaatataaattttaa

SEQ ID NO: 1039685 - DNA, 22 bp, Artificial Sequence
  chemically synthesized
tgttgatatttgttaaaattta

SEQ ID NO: 1039686 - DNA, 22 bp, Artificial Sequence
  chemically synthesized
gataaatataaattttaacaaa

SEQ ID NO: 1039687 - DNA, 22 bp, Artificial Sequence
  chemically synthesized
cctttgttgatatttgttaaaa

SEQ ID NO: 1039688 - DNA, 22 bp, Artificial Sequence
  chemically synthesized
taacaaatatcaacaaagggaa

SEQ ID NO: 1039689 - DNA, 22 bp, Artificial Sequence
  chemically synthesized
aacaaatatcaacaaagggaat

SEQ ID NO: 1039690 - DNA, 22 bp, Artificial Sequence
  chemically synthesized
acaaatatcaacaaagggaata

SEQ ID NO: 1039691 - DNA, 22 bp, Artificial Sequence
  chemically synthesized
aaaaaaaaaaaaaaaagaatat

SEQ ID NO: 1039692 - DNA, 22 bp, Artificial Sequence
  chemically synthesized
catctcaaaaaaaaaaaaaaaa

SEQ ID NO: 1039693 - DNA, 22 bp, Artificial Sequence
  chemically synthesized
gactccatctcaaaaaaaaaaa

SEQ ID NO: 1039694 - DNA, 22 bp, Artificial Sequence
  chemically synthesized
ttttttttttttttttgagatg

SEQ ID NO: 1039695 - DNA, 22 bp, Artificial Sequence
  chemically synthesized
ttttttttttttttgagatgga

SEQ ID NO: 1039696 - DNA, 22 bp, Artificial Sequence
  chemically synthesized
tttttttttttttgagatggag

SEQ ID NO: 1039697 - DNA, 22 bp, Artificial Sequence
  chemically synthesized
ttttttttttttgagatggagt

SEQ ID NO: 1039698 - DNA, 22 bp, Artificial Sequence
  chemically synthesized
tttttttttttgagatggagtc

SEQ ID NO: 1039699 - DNA, 22 bp, Artificial Sequence
  chemically synthesized
ttttttttttgagatggagtct

SEQ ID NO: 1039700 - DNA, 22 bp, Artificial Sequence
  chemically synthesized
ggtgacagagctagactccatc

SEQ ID NO: 1039701 - DNA, 22 bp, Artificial Sequence
  chemically synthesized
tttttttttgagatggagtcta

SEQ ID NO: 1039702 - DNA, 22 bp, Artificial Sequence
  chemically synthesized
ttttttttgagatggagtctag

SEQ ID NO: 1039703 - DNA, 22 bp, Artificial Sequence
  chemically synthesized
tttttttgagatggagtctagc

SEQ ID NO: 1039704 - DNA, 22 bp, Artificial Sequence
  chemically synthesized
ttttttgagatggagtctagct

SEQ ID NO: 1039705 - DNA, 22 bp, Artificial Sequence
  chemically synthesized
tttttgagatggagtctagctc

SEQ ID NO: 1039706 - DNA, 22 bp, Artificial Sequence
  chemically synthesized
ttttgagatggagtctagctct

SEQ ID NO: 1039707 - DNA, 22 bp, Artificial Sequence
  chemically synthesized
tttgagatggagtctagctctg

SEQ ID NO: 1039708 - DNA, 22 bp, Artificial Sequence
  chemically synthesized
cagcctgggtgacagagctaga

SEQ ID NO: 1039709 - DNA, 22 bp, Artificial Sequence
  chemically synthesized
ttgagatggagtctagctctgt

SEQ ID NO: 1039710 - DNA, 22 bp, Artificial Sequence
  chemically synthesized
tgagatggagtctagctctgtc

SEQ ID NO: 1039711 - DNA, 22 bp, Artificial Sequence
  chemically synthesized
gagatggagtctagctctgtca

SEQ ID NO: 1039712 - DNA, 22 bp, Artificial Sequence
  chemically synthesized
agatggagtctagctctgtcac

SEQ ID NO: 1039713 - DNA, 22 bp, Artificial Sequence
  chemically synthesized
cactccagcctgggtgacagag

SEQ ID NO: 1039714 - DNA, 22 bp, Artificial Sequence
  chemically synthesized
gctctgtcacccaggctggagt

SEQ ID NO: 1039715 - DNA, 22 bp, Artificial Sequence
  chemically synthesized
gatcagaccactgcactccagc

SEQ ID NO: 1039716 - DNA, 22 bp, Artificial Sequence
  chemically synthesized
tgtcacccaggctggagtgcag

SEQ ID NO: 1039717 - DNA, 22 bp, Artificial Sequence
  chemically synthesized
tcacccaggctggagtgcagtg

SEQ ID NO: 1039718 - DNA, 22 bp, Artificial Sequence
  chemically synthesized
cagtgagcctagatcagaccac

SEQ ID NO: 1039719 - DNA, 22 bp, Artificial Sequence
  chemically synthesized
gcagtgagcctagatcagacca

SEQ ID NO: 1039720 - DNA, 22 bp, Artificial Sequence
  chemically synthesized
gagtgcagtggtctgatctagg

SEQ ID NO: 1039721 - DNA, 22 bp, Artificial Sequence
  chemically synthesized
atctaggctcactgcaagctcc

SEQ ID NO: 1039722 - DNA, 22 bp, Artificial Sequence
  chemically synthesized
ggctcactgcaagctccgcctc

SEQ ID NO: 1039723 - DNA, 22 bp, Artificial Sequence
  chemically synthesized
actgcaagctccgcctcccggg

SEQ ID NO: 1039724 - DNA, 22 bp, Artificial Sequence
  chemically synthesized
caagctccgcctcccgggttta

SEQ ID NO: 1039725 - DNA, 22 bp, Artificial Sequence
  chemically synthesized
cgcctcccgggtttacttacac

SEQ ID NO: 1039726 - DNA, 22 bp, Artificial Sequence
  chemically synthesized
aggcaagagaatggtgtaagta

SEQ ID NO: 1039727 - DNA, 22 bp, Artificial Sequence
  chemically synthesized
ccgggtttacttacaccattct

SEQ ID NO: 1039728 - DNA, 22 bp, Artificial Sequence
  chemically synthesized
gggaggaggctgaggcaagaga

SEQ ID NO: 1039729 - DNA, 22 bp, Artificial Sequence
  chemically synthesized
acttacaccattctcttgcctc

SEQ ID NO: 1039730 - DNA, 22 bp, Artificial Sequence
  chemically synthesized
cttacaccattctcttgcctca

SEQ ID NO: 1039731 - DNA, 22 bp, Artificial Sequence
  chemically synthesized
ctcgggaggaggctgaggcaag

SEQ ID NO: 1039732 - DNA, 22 bp, Artificial Sequence
  chemically synthesized
acaccattctcttgcctcagcc

SEQ ID NO: 1039733 - DNA, 22 bp, Artificial Sequence
  chemically synthesized
caccattctcttgcctcagcct

SEQ ID NO: 1039734 - DNA, 22 bp, Artificial Sequence
  chemically synthesized
tcttgcctcagcctcctcccga

SEQ ID NO: 1039735 - DNA, 22 bp, Artificial Sequence
  chemically synthesized
tagtcccagctactcgggagga

SEQ ID NO: 1039736 - DNA, 22 bp, Artificial Sequence
  chemically synthesized
ttgcctcagcctcctcccgagt

SEQ ID NO: 1039737 - DNA, 22 bp, Artificial Sequence
  chemically synthesized
gcctcagcctcctcccgagtag

SEQ ID NO: 1039738 - DNA, 22 bp, Artificial Sequence
  chemically synthesized
cctcagcctcctcccgagtagc

SEQ ID NO: 1039739 - DNA, 22 bp, Artificial Sequence
  chemically synthesized
agcctcctcccgagtagctggg

SEQ ID NO: 1039740 - DNA, 22 bp, Artificial Sequence
  chemically synthesized
ctcccgagtagctgggactata

SEQ ID NO: 1039741 - DNA, 22 bp, Artificial Sequence
  chemically synthesized
ccgagtagctgggactataggc

SEQ ID NO: 1039742 - DNA, 22 bp, Artificial Sequence
  chemically synthesized
gccaggcgtggtggtgggcgcc

SEQ ID NO: 1039743 - DNA, 22 bp, Artificial Sequence
  chemically synthesized
ggactataggcgcccaccacca

SEQ ID NO: 1039744 - DNA, 22 bp, Artificial Sequence
  chemically synthesized
taggcgcccaccaccacgcctg

SEQ ID NO: 1039745 - DNA, 22 bp, Artificial Sequence
  chemically synthesized
aagatacaaaaaattagccagg

SEQ ID NO: 1039746 - DNA, 22 bp, Artificial Sequence
  chemically synthesized
ctaaagatacaaaaaattagcc

SEQ ID NO: 1039747 - DNA, 22 bp, Artificial Sequence
  chemically synthesized
tactaaagatacaaaaaattag

SEQ ID NO: 1039748 - DNA, 22 bp, Artificial Sequence
  chemically synthesized
gctaattttttgtatctttagt

SEQ ID NO: 1039749 - DNA, 22 bp, Artificial Sequence
  chemically synthesized
attttttgtatctttagtagag

SEQ ID NO: 1039750 - DNA, 22 bp, Artificial Sequence
  chemically synthesized
tttgtatctttagtagagacgg

SEQ ID NO: 1039751 - DNA, 22 bp, Artificial Sequence
  chemically synthesized
ttgtatctttagtagagacggg

SEQ ID NO: 1039752 - DNA, 22 bp, Artificial Sequence
  chemically synthesized
acacggtgaaaccccgtctcta

SEQ ID NO: 1039753 - DNA, 22 bp, Artificial Sequence
  chemically synthesized
tgtatctttagtagagacgggg

SEQ ID NO: 1039754 - DNA, 22 bp, Artificial Sequence
  chemically synthesized
gtatctttagtagagacggggt

SEQ ID NO: 1039755 - DNA, 22 bp, Artificial Sequence
  chemically synthesized
tatctttagtagagacggggtt

SEQ ID NO: 1039756 - DNA, 22 bp, Artificial Sequence
  chemically synthesized
gctaacacggtgaaaccccgtc

SEQ ID NO: 1039757 - DNA, 22 bp, Artificial Sequence
  chemically synthesized
tagtagagacggggtttcaccg

SEQ ID NO: 1039758 - DNA, 22 bp, Artificial Sequence
  chemically synthesized
agtagagacggggtttcaccgt

SEQ ID NO: 1039759 - DNA, 22 bp, Artificial Sequence
  chemically synthesized
gtagagacggggtttcaccgtg

SEQ ID NO: 1039760 - DNA, 22 bp, Artificial Sequence
  chemically synthesized
caccgtgttagccaggatggtc

SEQ ID NO: 1039761 - DNA, 22 bp, Artificial Sequence
  chemically synthesized
accgtgttagccaggatggtct

SEQ ID NO: 1039762 - DNA, 22 bp, Artificial Sequence
  chemically synthesized
gccaggatggtctcgatctcct

SEQ ID NO: 1039763 - DNA, 22 bp, Artificial Sequence
  chemically synthesized
aggcgggtggatcacgaggtca

SEQ ID NO: 1039764 - DNA, 22 bp, Artificial Sequence
  chemically synthesized
gatctcctgacctcgtgatcca

SEQ ID NO: 1039765 - DNA, 22 bp, Artificial Sequence
  chemically synthesized
ggaggctgaggcgggtggatca

SEQ ID NO: 1039766 - DNA, 22 bp, Artificial Sequence
  chemically synthesized
gggaggctgaggcgggtggatc

SEQ ID NO: 1039767 - DNA, 22 bp, Artificial Sequence
  chemically synthesized
tgggaggctgaggcgggtggat

SEQ ID NO: 1039768 - DNA, 22 bp, Artificial Sequence
  chemically synthesized
ctgacctcgtgatccacccgcc

SEQ ID NO: 1039769 - DNA, 22 bp, Artificial Sequence
  chemically synthesized
ttttgggaggctgaggcgggtg

SEQ ID NO: 1039770 - DNA, 22 bp, Artificial Sequence
  chemically synthesized
acctcgtgatccacccgcctca

SEQ ID NO: 1039771 - DNA, 22 bp, Artificial Sequence
  chemically synthesized
gttttgggaggctgaggcgggt

SEQ ID NO: 1039772 - DNA, 22 bp, Artificial Sequence
  chemically synthesized
tgttttgggaggctgaggcggg

SEQ ID NO: 1039773 - DNA, 22 bp, Artificial Sequence
  chemically synthesized
gtgatccacccgcctcagcctc

SEQ ID NO: 1039774 - DNA, 22 bp, Artificial Sequence
  chemically synthesized
cctttgttttgggaggctgagg

SEQ ID NO: 1039775 - DNA, 22 bp, Artificial Sequence
  chemically synthesized
agcctcccaaaacaaagggaat

SEQ ID NO: 1039776 - DNA, 22 bp, Artificial Sequence
  chemically synthesized
aaaataggcaagaatattccct

SEQ ID NO: 1039777 - DNA, 22 bp, Artificial Sequence
  chemically synthesized
ccaaaacaaagggaatattctt

SEQ ID NO: 1039778 - DNA, 22 bp, Artificial Sequence
  chemically synthesized
actgaaaataggcaagaatatt

SEQ ID NO: 1039779 - DNA, 22 bp, Artificial Sequence
  chemically synthesized
gactgaaaataggcaagaatat

SEQ ID NO: 1039780 - DNA, 22 bp, Artificial Sequence
  chemically synthesized
tgactgaaaataggcaagaata

SEQ ID NO: 1039781 - DNA, 22 bp, Artificial Sequence
  chemically synthesized
ccaattttgactgaaaataggc

SEQ ID NO: 1039782 - DNA, 22 bp, Artificial Sequence
  chemically synthesized
cccaattttgactgaaaatagg

SEQ ID NO: 1039783 - DNA, 22 bp, Artificial Sequence
  chemically synthesized
aaatgcttcccaattttgactg

SEQ ID NO: 1039784 - DNA, 22 bp, Artificial Sequence
  chemically synthesized
ttgcctattttcagtcaaaatt

SEQ ID NO: 1039785 - DNA, 22 bp, Artificial Sequence
  chemically synthesized
gcctattttcagtcaaaattgg

SEQ ID NO: 1039786 - DNA, 22 bp, Artificial Sequence
  chemically synthesized
cctattttcagtcaaaattggg

SEQ ID NO: 1039787 - DNA, 22 bp, Artificial Sequence
  chemically synthesized
ttttcagtcaaaattgggaagc

SEQ ID NO: 1039788 - DNA, 22 bp, Artificial Sequence
  chemically synthesized
caaatgattaaaatgcttccca

SEQ ID NO: 1039789 - DNA, 22 bp, Artificial Sequence
  chemically synthesized
tcagtcaaaattgggaagcatt

SEQ ID NO: 1039790 - DNA, 22 bp, Artificial Sequence
  chemically synthesized
acaaatgattaaaatgcttccc

SEQ ID NO: 1039791 - DNA, 22 bp, Artificial Sequence
  chemically synthesized
cagtcaaaattgggaagcattt

SEQ ID NO: 1039792 - DNA, 22 bp, Artificial Sequence
  chemically synthesized
agtcaaaattgggaagcatttt

SEQ ID NO: 1039793 - DNA, 22 bp, Artificial Sequence
  chemically synthesized
caacttacaaatgattaaaatg

SEQ ID NO: 1039794 - DNA, 22 bp, Artificial Sequence
  chemically synthesized
ggaagcattttaatcatttgta

SEQ ID NO: 1039795 - DNA, 22 bp, Artificial Sequence
  chemically synthesized
acacagtctccaacttacaaat

SEQ ID NO: 1039796 - DNA, 22 bp, Artificial Sequence
  chemically synthesized
tctaacacagtctccaacttac

SEQ ID NO: 1039797 - DNA, 22 bp, Artificial Sequence
  chemically synthesized
taatcatttgtaagttggagac

SEQ ID NO: 1039798 - DNA, 22 bp, Artificial Sequence
  chemically synthesized
aatcatttgtaagttggagact

SEQ ID NO: 1039799 - DNA, 22 bp, Artificial Sequence
  chemically synthesized
cctatctaacacagtctccaac

SEQ ID NO: 1039800 - DNA, 22 bp, Artificial Sequence
  chemically synthesized
atcatttgtaagttggagactg

SEQ ID NO: 1039801 - DNA, 22 bp, Artificial Sequence
  chemically synthesized
gtaagttggagactgtgttaga

SEQ ID NO: 1039802 - DNA, 22 bp, Artificial Sequence
  chemically synthesized
taagttggagactgtgttagat

SEQ ID NO: 1039803 - DNA, 22 bp, Artificial Sequence
  chemically synthesized
gagactgtgttagatagggagt

SEQ ID NO: 1039804 - DNA, 22 bp, Artificial Sequence
  chemically synthesized
tacgatcagcagcagtcactcc

SEQ ID NO: 1039805 - DNA, 22 bp, Artificial Sequence
  chemically synthesized
tgttagatagggagtgactgct

SEQ ID NO: 1039806 - DNA, 22 bp, Artificial Sequence
  chemically synthesized
gatagggagtgactgctgctga

SEQ ID NO: 1039807 - DNA, 22 bp, Artificial Sequence
  chemically synthesized
gaaagctgtacgatcagcagca

SEQ ID NO: 1039808 - DNA, 22 bp, Artificial Sequence
  chemically synthesized
ctgctgatcgtacagctttcca

SEQ ID NO: 1039809 - DNA, 22 bp, Artificial Sequence
  chemically synthesized
agagcccgtcatctggaaagct

SEQ ID NO: 1039810 - DNA, 22 bp, Artificial Sequence
  chemically synthesized
cagagcccgtcatctggaaagc

SEQ ID NO: 1039811 - DNA, 22 bp, Artificial Sequence
  chemically synthesized
ctgatcgtacagctttccagat

SEQ ID NO: 1039812 - DNA, 22 bp, Artificial Sequence
  chemically synthesized
ttcagagcccgtcatctggaaa

SEQ ID NO: 1039813 - DNA, 22 bp, Artificial Sequence
  chemically synthesized
cttcagagcccgtcatctggaa

SEQ ID NO: 1039814 - DNA, 22 bp, Artificial Sequence
  chemically synthesized
atcgtacagctttccagatgac

SEQ ID NO: 1039815 - DNA, 22 bp, Artificial Sequence
  chemically synthesized
tcttcagagcccgtcatctgga

SEQ ID NO: 1039816 - DNA, 22 bp, Artificial Sequence
  chemically synthesized
tgaagttttcttcagagcccgt

SEQ ID NO: 1039817 - DNA, 22 bp, Artificial Sequence
  chemically synthesized
tccagatgacgggctctgaaga

SEQ ID NO: 1039818 - DNA, 22 bp, Artificial Sequence
  chemically synthesized
attgtgaagttttcttcagagc

SEQ ID NO: 1039819 - DNA, 22 bp, Artificial Sequence
  chemically synthesized
ccagatgacgggctctgaagaa

SEQ ID NO: 1039820 - DNA, 22 bp, Artificial Sequence
  chemically synthesized
cagatgacgggctctgaagaaa

SEQ ID NO: 1039821 - DNA, 22 bp, Artificial Sequence
  chemically synthesized
tgattgtgaagttttcttcaga

SEQ ID NO: 1039822 - DNA, 22 bp, Artificial Sequence
  chemically synthesized
tctgattgtgaagttttcttca

SEQ ID NO: 1039823 - DNA, 22 bp, Artificial Sequence
  chemically synthesized
cctctctgattgtgaagttttc

SEQ ID NO: 1039824 - DNA, 22 bp, Artificial Sequence
  chemically synthesized
ccctctctgattgtgaagtttt

SEQ ID NO: 1039825 - DNA, 22 bp, Artificial Sequence
  chemically synthesized
tttccctctctgattgtgaagt

SEQ ID NO: 1039826 - DNA, 22 bp, Artificial Sequence
  chemically synthesized
ctgtttccctctctgattgtga

SEQ ID NO: 1039827 - DNA, 22 bp, Artificial Sequence
  chemically synthesized
tgaagaaaacttcacaatcaga

SEQ ID NO: 1039828 - DNA, 22 bp, Artificial Sequence
  chemically synthesized
cctgtttccctctctgattgtg

SEQ ID NO: 1039829 - DNA, 22 bp, Artificial Sequence
  chemically synthesized
tcctgtttccctctctgattgt

SEQ ID NO: 1039830 - DNA, 22 bp, Artificial Sequence
  chemically synthesized
aagaaaacttcacaatcagaga

SEQ ID NO: 1039831 - DNA, 22 bp, Artificial Sequence
  chemically synthesized
tttcctgtttccctctctgatt

SEQ ID NO: 1039832 - DNA, 22 bp, Artificial Sequence
  chemically synthesized
ctttcctgtttccctctctgat

SEQ ID NO: 1039833 - DNA, 22 bp, Artificial Sequence
  chemically synthesized
acttctttcctgtttccctctc

SEQ ID NO: 1039834 - DNA, 22 bp, Artificial Sequence
  chemically synthesized
ttaacttctttcctgtttccct

SEQ ID NO: 1039835 - DNA, 22 bp, Artificial Sequence
  chemically synthesized
cacaatcagagagggaaacagg

SEQ ID NO: 1039836 - DNA, 22 bp, Artificial Sequence
  chemically synthesized
acaatcagagagggaaacagga

SEQ ID NO: 1039837 - DNA, 22 bp, Artificial Sequence
  chemically synthesized
ttgttaacttctttcctgtttc

SEQ ID NO: 1039838 - DNA, 22 bp, Artificial Sequence
  chemically synthesized
attgttaacttctttcctgttt

SEQ ID NO: 1039839 - DNA, 22 bp, Artificial Sequence
  chemically synthesized
tattgttaacttctttcctgtt

SEQ ID NO: 1039840 - DNA, 22 bp, Artificial Sequence
  chemically synthesized
agttttattgttaacttctttc

SEQ ID NO: 1039841 - DNA, 22 bp, Artificial Sequence
  chemically synthesized
taagttttattgttaacttctt

SEQ ID NO: 1039842 - DNA, 22 bp, Artificial Sequence
  chemically synthesized
gaataaggcagaaaatcctcta

SEQ ID NO: 1039843 - DNA, 22 bp, Artificial Sequence
  chemically synthesized
acaataaaacttagaggatttt

SEQ ID NO: 1039844 - DNA, 22 bp, Artificial Sequence
  chemically synthesized
agaataaggcagaaaatcctct

SEQ ID NO: 1039845 - DNA, 22 bp, Artificial Sequence
  chemically synthesized
agaggattttctgccttattct

SEQ ID NO: 1039846 - DNA, 22 bp, Artificial Sequence
  chemically synthesized
gaggattttctgccttattcta

SEQ ID NO: 1039847 - DNA, 22 bp, Artificial Sequence
  chemically synthesized
tctgccttattctaagatttca

SEQ ID NO: 1039848 - DNA, 22 bp, Artificial Sequence
  chemically synthesized
ctgccttattctaagatttcac

SEQ ID NO: 1039849 - DNA, 22 bp, Artificial Sequence
  chemically synthesized
tgccttattctaagatttcacg

SEQ ID NO: 1039850 - DNA, 22 bp, Artificial Sequence
  chemically synthesized
gtggaccacaaacgtgaaatct

SEQ ID NO: 1039851 - DNA, 22 bp, Artificial Sequence
  chemically synthesized
ccttattctaagatttcacgtt

SEQ ID NO: 1039852 - DNA, 22 bp, Artificial Sequence
  chemically synthesized
attctaagatttcacgtttgtg

SEQ ID NO: 1039853 - DNA, 22 bp, Artificial Sequence
  chemically synthesized
ttctaagatttcacgtttgtgg

SEQ ID NO: 1039854 - DNA, 22 bp, Artificial Sequence
  chemically synthesized
taagatttcacgtttgtggtcc

SEQ ID NO: 1039855 - DNA, 22 bp, Artificial Sequence
  chemically synthesized
agatttcacgtttgtggtccac

SEQ ID NO: 1039856 - DNA, 22 bp, Artificial Sequence
  chemically synthesized
aaggcaagtcctcgtggaccac

SEQ ID NO: 1039857 - DNA, 22 bp, Artificial Sequence
  chemically synthesized
ctcaaggcaagtcctcgtggac

SEQ ID NO: 1039858 - DNA, 22 bp, Artificial Sequence
  chemically synthesized
gctcaaggcaagtcctcgtgga

SEQ ID NO: 1039859 - DNA, 22 bp, Artificial Sequence
  chemically synthesized
cacgtttgtggtccacgaggac

SEQ ID NO: 1039860 - DNA, 22 bp, Artificial Sequence
  chemically synthesized
acgtttgtggtccacgaggact

SEQ ID NO: 1039861 - DNA, 22 bp, Artificial Sequence
  chemically synthesized
ttgctcaaggcaagtcctcgtg

SEQ ID NO: 1039862 - DNA, 22 bp, Artificial Sequence
  chemically synthesized
gttcttgctcaaggcaagtcct

SEQ ID NO: 1039863 - DNA, 22 bp, Artificial Sequence
  chemically synthesized
agttcttgctcaaggcaagtcc

SEQ ID NO: 1039864 - DNA, 22 bp, Artificial Sequence
  chemically synthesized
gtggtccacgaggacttgcctt

SEQ ID NO: 1039865 - DNA, 22 bp, Artificial Sequence
  chemically synthesized
tggtccacgaggacttgccttg

SEQ ID NO: 1039866 - DNA, 22 bp, Artificial Sequence
  chemically synthesized
agcttagttcttgctcaaggca

SEQ ID NO: 1039867 - DNA, 22 bp, Artificial Sequence
  chemically synthesized
cagcttagttcttgctcaaggc

SEQ ID NO: 1039868 - DNA, 22 bp, Artificial Sequence
  chemically synthesized
ttcagcttagttcttgctcaag

SEQ ID NO: 1039869 - DNA, 22 bp, Artificial Sequence
  chemically synthesized
cctcttcagcttagttcttgct

SEQ ID NO: 1039870 - DNA, 22 bp, Artificial Sequence
  chemically synthesized
acctgcctcttcagcttagttc

SEQ ID NO: 1039871 - DNA, 22 bp, Artificial Sequence
  chemically synthesized
gccttgagcaagaactaagctg

SEQ ID NO: 1039872 - DNA, 22 bp, Artificial Sequence
  chemically synthesized
ccttgagcaagaactaagctga

SEQ ID NO: 1039873 - DNA, 22 bp, Artificial Sequence
  chemically synthesized
gagcaagaactaagctgaagag

SEQ ID NO: 1039874 - DNA, 22 bp, Artificial Sequence
  chemically synthesized
agcaagaactaagctgaagagg

SEQ ID NO: 1039875 - DNA, 22 bp, Artificial Sequence
  chemically synthesized
tagtctcacctgcctcttcagc

SEQ ID NO: 1039876 - DNA, 22 bp, Artificial Sequence
  chemically synthesized
tctgtagtctcacctgcctctt

SEQ ID NO: 1039877 - DNA, 22 bp, Artificial Sequence
  chemically synthesized
acattatctgtagtctcacctg

SEQ ID NO: 1039878 - DNA, 22 bp, Artificial Sequence
  chemically synthesized
agctgaagaggcaggtgagact

SEQ ID NO: 1039879 - DNA, 22 bp, Artificial Sequence
  chemically synthesized
aagaggcaggtgagactacaga

SEQ ID NO: 1039880 - DNA, 22 bp, Artificial Sequence
  chemically synthesized
caactgacattatctgtagtct

SEQ ID NO: 1039881 - DNA, 22 bp, Artificial Sequence
  chemically synthesized
acaactgacattatctgtagtc

SEQ ID NO: 1039882 - DNA, 22 bp, Artificial Sequence
  chemically synthesized
tacaactgacattatctgtagt

SEQ ID NO: 1039883 - DNA, 22 bp, Artificial Sequence
  chemically synthesized
ttacaactgacattatctgtag

SEQ ID NO: 1039884 - DNA, 22 bp, Artificial Sequence
  chemically synthesized
ccttttacaactgacattatct

SEQ ID NO: 1039885 - DNA, 22 bp, Artificial Sequence
  chemically synthesized
accttttacaactgacattatc

SEQ ID NO: 1039886 - DNA, 22 bp, Artificial Sequence
  chemically synthesized
taccttttacaactgacattat

SEQ ID NO: 1039887 - DNA, 22 bp, Artificial Sequence
  chemically synthesized
ttaccttttacaactgacatta

SEQ ID NO: 1039888 - DNA, 22 bp, Artificial Sequence
  chemically synthesized
acttttaccttttacaactgac

SEQ ID NO: 1039889 - DNA, 22 bp, Artificial Sequence
  chemically synthesized
cagataatgtcagttgtaaaag

SEQ ID NO: 1039890 - DNA, 22 bp, Artificial Sequence
  chemically synthesized
taagcattgacttttacctttt

SEQ ID NO: 1039891 - DNA, 22 bp, Artificial Sequence
  chemically synthesized
ccattgtaagcattgactttta

SEQ ID NO: 1039892 - DNA, 22 bp, Artificial Sequence
  chemically synthesized
taaaaggtaaaagtcaatgctt

SEQ ID NO: 1039893 - DNA, 22 bp, Artificial Sequence
  chemically synthesized
taaggttcccattgtaagcatt

SEQ ID NO: 1039894 - DNA, 22 bp, Artificial Sequence
  chemically synthesized
ataaggttcccattgtaagcat

SEQ ID NO: 1039895 - DNA, 22 bp, Artificial Sequence
  chemically synthesized
tataaggttcccattgtaagca

SEQ ID NO: 1039896 - DNA, 22 bp, Artificial Sequence
  chemically synthesized
ttataaggttcccattgtaagc

SEQ ID NO: 1039897 - DNA, 22 bp, Artificial Sequence
  chemically synthesized
tttataaggttcccattgtaag

SEQ ID NO: 1039898 - DNA, 22 bp, Artificial Sequence
  chemically synthesized
ctttttataaggttcccattgt

SEQ ID NO: 1039899 - DNA, 22 bp, Artificial Sequence
  chemically synthesized
acaatgggaaccttataaaaag

SEQ ID NO: 1039900 - DNA, 22 bp, Artificial Sequence
  chemically synthesized
caatgggaaccttataaaaagc

SEQ ID NO: 1039901 - DNA, 22 bp, Artificial Sequence
  chemically synthesized
ataaaaagcaactgtgttctcg

SEQ ID NO: 1039902 - DNA, 22 bp, Artificial Sequence
  chemically synthesized
ataaataagacacgagaacaca

SEQ ID NO: 1039903 - DNA, 22 bp, Artificial Sequence
  chemically synthesized
taaaaagcaactgtgttctcgt

SEQ ID NO: 1039904 - DNA, 22 bp, Artificial Sequence
  chemically synthesized
agctgataaataagacacgaga

SEQ ID NO: 1039905 - DNA, 22 bp, Artificial Sequence
  chemically synthesized
ctgagctgataaataagacacg

SEQ ID NO: 1039906 - DNA, 22 bp, Artificial Sequence
  chemically synthesized
ttgctgagctgataaataagac

SEQ ID NO: 1039907 - DNA, 22 bp, Artificial Sequence
  chemically synthesized
tgttctcgtgtcttatttatca

SEQ ID NO: 1039908 - DNA, 22 bp, Artificial Sequence
  chemically synthesized
tcctgttgctgagctgataaat

SEQ ID NO: 1039909 - DNA, 22 bp, Artificial Sequence
  chemically synthesized
atcctgttgctgagctgataaa

SEQ ID NO: 1039910 - DNA, 22 bp, Artificial Sequence
  chemically synthesized
tcgtgtcttatttatcagctca

SEQ ID NO: 1039911 - DNA, 22 bp, Artificial Sequence
  chemically synthesized
gtgtcttatttatcagctcagc

SEQ ID NO: 1039912 - DNA, 22 bp, Artificial Sequence
  chemically synthesized
tatcttatcctgttgctgagct

SEQ ID NO: 1039913 - DNA, 22 bp, Artificial Sequence
  chemically synthesized
atttatcagctcagcaacagga

SEQ ID NO: 1039914 - DNA, 22 bp, Artificial Sequence
  chemically synthesized
tttatcagctcagcaacaggat

SEQ ID NO: 1039915 - DNA, 22 bp, Artificial Sequence
  chemically synthesized
atcagctcagcaacaggataag

SEQ ID NO: 1039916 - DNA, 22 bp, Artificial Sequence
  chemically synthesized
tcagctcagcaacaggataaga

SEQ ID NO: 1039917 - DNA, 22 bp, Artificial Sequence
  chemically synthesized
agcaacaggataagatacaatg

SEQ ID NO: 1039918 - DNA, 22 bp, Artificial Sequence
  chemically synthesized
acatcacccataaccattgtat

SEQ ID NO: 1039919 - DNA, 22 bp, Artificial Sequence
  chemically synthesized
actcacatcacccataaccatt

SEQ ID NO: 1039920 - DNA, 22 bp, Artificial Sequence
  chemically synthesized
aaattcactcacatcacccata

SEQ ID NO: 1039921 - DNA, 22 bp, Artificial Sequence
  chemically synthesized
tgaaattcactcacatcaccca

SEQ ID NO: 1039922 - DNA, 22 bp, Artificial Sequence
  chemically synthesized
tctgaaattcactcacatcacc

SEQ ID NO: 1039923 - DNA, 22 bp, Artificial Sequence
  chemically synthesized
ctctgaaattcactcacatcac

SEQ ID NO: 1039924 - DNA, 22 bp, Artificial Sequence
  chemically synthesized
tctctgaaattcactcacatca

SEQ ID NO: 1039925 - DNA, 22 bp, Artificial Sequence
  chemically synthesized
tttctctgaaattcactcacat

SEQ ID NO: 1039926 - DNA, 22 bp, Artificial Sequence
  chemically synthesized
ctttctctgaaattcactcaca

SEQ ID NO: 1039927 - DNA, 22 bp, Artificial Sequence
  chemically synthesized
tgggtgatgtgagtgaatttca

SEQ ID NO: 1039928 - DNA, 22 bp, Artificial Sequence
  chemically synthesized
aaaacaccttctttctctgaaa

SEQ ID NO: 1039929 - DNA, 22 bp, Artificial Sequence
  chemically synthesized
aaaaacaccttctttctctgaa

SEQ ID NO: 1039930 - DNA, 22 bp, Artificial Sequence
  chemically synthesized
taaaaacaccttctttctctga

SEQ ID NO: 1039931 - DNA, 22 bp, Artificial Sequence
  chemically synthesized
ttttaaaaacaccttctttctc

SEQ ID NO: 1039932 - DNA, 22 bp, Artificial Sequence
  chemically synthesized
attttaaaaacaccttctttct

SEQ ID NO: 1039933 - DNA, 22 bp, Artificial Sequence
  chemically synthesized
tattttaaaaacaccttctttc

SEQ ID NO: 1039934 - DNA, 22 bp, Artificial Sequence
  chemically synthesized
aaattttattttaaaaacacct

SEQ ID NO: 1039935 - DNA, 22 bp, Artificial Sequence
  chemically synthesized
gaaattttattttaaaaacacc

SEQ ID NO: 1039936 - DNA, 22 bp, Artificial Sequence
  chemically synthesized
cagagaaagaaggtgtttttaa

SEQ ID NO: 1039937 - DNA, 22 bp, Artificial Sequence
  chemically synthesized
agagaaagaaggtgtttttaaa

SEQ ID NO: 1039938 - DNA, 22 bp, Artificial Sequence
  chemically synthesized
gaagagaatgccttgaaatttt

SEQ ID NO: 1039939 - DNA, 22 bp, Artificial Sequence
  chemically synthesized
ttaaaataaaatttcaaggcat

SEQ ID NO: 1039940 - DNA, 22 bp, Artificial Sequence
  chemically synthesized
taaaataaaatttcaaggcatt

SEQ ID NO: 1039941 - DNA, 22 bp, Artificial Sequence
  chemically synthesized
aaaataaaatttcaaggcattc

SEQ ID NO: 1039942 - DNA, 22 bp, Artificial Sequence
  chemically synthesized
aaataaaatttcaaggcattct

SEQ ID NO: 1039943 - DNA, 22 bp, Artificial Sequence
  chemically synthesized
caaggcattctcttccagtcta

SEQ ID NO: 1039944 - DNA, 22 bp, Artificial Sequence
  chemically synthesized
aaggcattctcttccagtctat

SEQ ID NO: 1039945 - DNA, 22 bp, Artificial Sequence
  chemically synthesized
catcacaaggtgtacatagact

SEQ ID NO: 1039946 - DNA, 22 bp, Artificial Sequence
  chemically synthesized
ccatcacaaggtgtacatagac

SEQ ID NO: 1039947 - DNA, 22 bp, Artificial Sequence
  chemically synthesized
tccatcacaaggtgtacataga

SEQ ID NO: 1039948 - DNA, 22 bp, Artificial Sequence
  chemically synthesized
tcttccagtctatgtacacctt

SEQ ID NO: 1039949 - DNA, 22 bp, Artificial Sequence
  chemically synthesized
ttccagtctatgtacaccttgt

SEQ ID NO: 1039950 - DNA, 22 bp, Artificial Sequence
  chemically synthesized
ccagtctatgtacaccttgtga

SEQ ID NO: 1039951 - DNA, 22 bp, Artificial Sequence
  chemically synthesized
cagtctatgtacaccttgtgat

SEQ ID NO: 1039952 - DNA, 22 bp, Artificial Sequence
  chemically synthesized
tgtacaccttgtgatggaaagc

SEQ ID NO: 1039953 - DNA, 22 bp, Artificial Sequence
  chemically synthesized
gtgatggaaagctttcattatt

SEQ ID NO: 1039954 - DNA, 22 bp, Artificial Sequence
  chemically synthesized
tgatggaaagctttcattattt

SEQ ID NO: 1039955 - DNA, 22 bp, Artificial Sequence
  chemically synthesized
aggtgcgaaacaaaagaaataa

SEQ ID NO: 1039956 - DNA, 22 bp, Artificial Sequence
  chemically synthesized
aattgaggtgcgaaacaaaaga

SEQ ID NO: 1039957 - DNA, 22 bp, Artificial Sequence
  chemically synthesized
tcattatttcttttgtttcgca

SEQ ID NO: 1039958 - DNA, 22 bp, Artificial Sequence
  chemically synthesized
cattatttcttttgtttcgcac

SEQ ID NO: 1039959 - DNA, 22 bp, Artificial Sequence
  chemically synthesized
attatttcttttgtttcgcacc

SEQ ID NO: 1039960 - DNA, 22 bp, Artificial Sequence
  chemically synthesized
tttcttttgtttcgcacctcaa

SEQ ID NO: 1039961 - DNA, 22 bp, Artificial Sequence
  chemically synthesized
cacagagttaaattgaggtgcg

SEQ ID NO: 1039962 - DNA, 22 bp, Artificial Sequence
  chemically synthesized
ccacagagttaaattgaggtgc

SEQ ID NO: 1039963 - DNA, 22 bp, Artificial Sequence
  chemically synthesized
tccacagagttaaattgaggtg

SEQ ID NO: 1039964 - DNA, 22 bp, Artificial Sequence
  chemically synthesized
cttttgtttcgcacctcaattt

SEQ ID NO: 1039965 - DNA, 22 bp, Artificial Sequence
  chemically synthesized
ttccacagagttaaattgaggt

SEQ ID NO: 1039966 - DNA, 22 bp, Artificial Sequence
  chemically synthesized
ttttgtttcgcacctcaattta

SEQ ID NO: 1039967 - DNA, 22 bp, Artificial Sequence
  chemically synthesized
tttccacagagttaaattgagg

SEQ ID NO: 1039968 - DNA, 22 bp, Artificial Sequence
  chemically synthesized
ttgtttcgcacctcaatttaac

SEQ ID NO: 1039969 - DNA, 22 bp, Artificial Sequence
  chemically synthesized
tgtttcgcacctcaatttaact

SEQ ID NO: 1039970 - DNA, 22 bp, Artificial Sequence
  chemically synthesized
gtttcgcacctcaatttaactc

SEQ ID NO: 1039971 - DNA, 22 bp, Artificial Sequence
  chemically synthesized
tttcgcacctcaatttaactct

SEQ ID NO: 1039972 - DNA, 22 bp, Artificial Sequence
  chemically synthesized
cgcacctcaatttaactctgtg

SEQ ID NO: 1039973 - DNA, 22 bp, Artificial Sequence
  chemically synthesized
gcacctcaatttaactctgtgg

SEQ ID NO: 1039974 - DNA, 22 bp, Artificial Sequence
  chemically synthesized
tcagataagtactttttccaca

SEQ ID NO: 1039975 - DNA, 22 bp, Artificial Sequence
  chemically synthesized
aatttaactctgtggaaaaagt

SEQ ID NO: 1039976 - DNA, 22 bp, Artificial Sequence
  chemically synthesized
acctgtcagataagtacttttt

SEQ ID NO: 1039977 - DNA, 22 bp, Artificial Sequence
  chemically synthesized
aactctgtggaaaaagtactta

SEQ ID NO: 1039978 - DNA, 22 bp, Artificial Sequence
  chemically synthesized
actctgtggaaaaagtacttat

SEQ ID NO: 1039979 - DNA, 22 bp, Artificial Sequence
  chemically synthesized
tgtggaaaaagtacttatctga

SEQ ID NO: 1039980 - DNA, 22 bp, Artificial Sequence
  chemically synthesized
tggaaaaagtacttatctgaca

SEQ ID NO: 1039981 - DNA, 22 bp, Artificial Sequence
  chemically synthesized
tatggtaatacctgacctgtca

SEQ ID NO: 1039982 - DNA, 22 bp, Artificial Sequence
  chemically synthesized
gtatggtaatacctgacctgtc

SEQ ID NO: 1039983 - DNA, 22 bp, Artificial Sequence
  chemically synthesized
tgtatggtaatacctgacctgt

SEQ ID NO: 1039984 - DNA, 22 bp, Artificial Sequence
  chemically synthesized
ttgtatggtaatacctgacctg

SEQ ID NO: 1039985 - DNA, 22 bp, Artificial Sequence
  chemically synthesized
ttttgtatggtaatacctgacc

SEQ ID NO: 1039986 - DNA, 22 bp, Artificial Sequence
  chemically synthesized
cttttgtatggtaatacctgac

SEQ ID NO: 1039987 - DNA, 22 bp, Artificial Sequence
  chemically synthesized
tcttttgtatggtaatacctga

SEQ ID NO: 1039988 - DNA, 22 bp, Artificial Sequence
  chemically synthesized
atctgacaggtcaggtattacc

SEQ ID NO: 1039989 - DNA, 22 bp, Artificial Sequence
  chemically synthesized
tttcttttgtatggtaatacct

SEQ ID NO: 1039990 - DNA, 22 bp, Artificial Sequence
  chemically synthesized
tctgacaggtcaggtattacca

SEQ ID NO: 1039991 - DNA, 22 bp, Artificial Sequence
  chemically synthesized
ttctttcttttgtatggtaata

SEQ ID NO: 1039992 - DNA, 22 bp, Artificial Sequence
  chemically synthesized
gttctttcttttgtatggtaat

SEQ ID NO: 1039993 - DNA, 22 bp, Artificial Sequence
  chemically synthesized
acaggtcaggtattaccataca

SEQ ID NO: 1039994 - DNA, 22 bp, Artificial Sequence
  chemically synthesized
gcttgttctttcttttgtatgg

SEQ ID NO: 1039995 - DNA, 22 bp, Artificial Sequence
  chemically synthesized
tgttggcttgttctttcttttg

SEQ ID NO: 1039996 - DNA, 22 bp, Artificial Sequence
  chemically synthesized
tgtgttggcttgttctttcttt

SEQ ID NO: 1039997 - DNA, 22 bp, Artificial Sequence
  chemically synthesized
ctgtgttggcttgttctttctt

SEQ ID NO: 1039998 - DNA, 22 bp, Artificial Sequence
  chemically synthesized
tttctgtgttggcttgttcttt

SEQ ID NO: 1039999 - DNA, 22 bp, Artificial Sequence
  chemically synthesized
ccatacaaaagaaagaacaagc

SEQ ID NO: 1040000 - DNA, 22 bp, Artificial Sequence
  chemically synthesized
agattgtttctgtgttggcttg

SEQ ID NO: 1040001 - DNA, 22 bp, Artificial Sequence
  chemically synthesized
tcagattgtttctgtgttggct

SEQ ID NO: 1040002 - DNA, 22 bp, Artificial Sequence
  chemically synthesized
cagataagtaaattctcagatt

SEQ ID NO: 1040003 - DNA, 22 bp, Artificial Sequence
  chemically synthesized
ctccagataagtaaattctcag

SEQ ID NO: 1040004 - DNA, 22 bp, Artificial Sequence
  chemically synthesized
cattcctccagataagtaaatt

SEQ ID NO: 1040005 - DNA, 22 bp, Artificial Sequence
  chemically synthesized
acctgcattcctccagataagt

SEQ ID NO: 1040006 - DNA, 22 bp, Artificial Sequence
  chemically synthesized
aacctgcattcctccagataag

SEQ ID NO: 1040007 - DNA, 22 bp, Artificial Sequence
  chemically synthesized
taacctgcattcctccagataa

SEQ ID NO: 1040008 - DNA, 22 bp, Artificial Sequence
  chemically synthesized
agaatttacttatctggaggaa

SEQ ID NO: 1040009 - DNA, 22 bp, Artificial Sequence
  chemically synthesized
acttatctggaggaatgcaggt

SEQ ID NO: 1040010 - DNA, 22 bp, Artificial Sequence
  chemically synthesized
cttatctggaggaatgcaggtt

SEQ ID NO: 1040011 - DNA, 22 bp, Artificial Sequence
  chemically synthesized
aaagacagttttaacctgcatt

SEQ ID NO: 1040012 - DNA, 22 bp, Artificial Sequence
  chemically synthesized
atctggaggaatgcaggttaaa

SEQ ID NO: 1040013 - DNA, 22 bp, Artificial Sequence
  chemically synthesized
ctaaaagacagttttaacctgc

SEQ ID NO: 1040014 - DNA, 22 bp, Artificial Sequence
  chemically synthesized
tctggaggaatgcaggttaaaa

SEQ ID NO: 1040015 - DNA, 22 bp, Artificial Sequence
  chemically synthesized
gaggaatgcaggttaaaactgt

SEQ ID NO: 1040016 - DNA, 22 bp, Artificial Sequence
  chemically synthesized
tgtgaaattgctaaaagacagt

SEQ ID NO: 1040017 - DNA, 22 bp, Artificial Sequence
  chemically synthesized
tatgtgaaattgctaaaagaca

SEQ ID NO: 1040018 - DNA, 22 bp, Artificial Sequence
  chemically synthesized
tctatgtgaaattgctaaaaga

SEQ ID NO: 1040019 - DNA, 22 bp, Artificial Sequence
  chemically synthesized
aaactgtcttttagcaatttca

SEQ ID NO: 1040020 - DNA, 22 bp, Artificial Sequence
  chemically synthesized
tcaattctctatgtgaaattgc

SEQ ID NO: 1040021 - DNA, 22 bp, Artificial Sequence
  chemically synthesized
tcttttagcaatttcacataga

SEQ ID NO: 1040022 - DNA, 22 bp, Artificial Sequence
  chemically synthesized
ttagcaatttcacatagagaat

SEQ ID NO: 1040023 - DNA, 22 bp, Artificial Sequence
  chemically synthesized
caatgactatcaattctctatg

SEQ ID NO: 1040024 - DNA, 22 bp, Artificial Sequence
  chemically synthesized
tagcaatttcacatagagaatt

SEQ ID NO: 1040025 - DNA, 22 bp, Artificial Sequence
  chemically synthesized
agcaatttcacatagagaattg

SEQ ID NO: 1040026 - DNA, 22 bp, Artificial Sequence
  chemically synthesized
gcaatttcacatagagaattga

SEQ ID NO: 1040027 - DNA, 22 bp, Artificial Sequence
  chemically synthesized
cacatagagaattgatagtcat

SEQ ID NO: 1040028 - DNA, 22 bp, Artificial Sequence
  chemically synthesized
acatagagaattgatagtcatt

SEQ ID NO: 1040029 - DNA, 22 bp, Artificial Sequence
  chemically synthesized
aacatcacacacattccaatga

SEQ ID NO: 1040030 - DNA, 22 bp, Artificial Sequence
  chemically synthesized
ttcaacatcacacacattccaa

SEQ ID NO: 1040031 - DNA, 22 bp, Artificial Sequence
  chemically synthesized
attcaacatcacacacattcca

SEQ ID NO: 1040032 - DNA, 22 bp, Artificial Sequence
  chemically synthesized
atagtcattggaatgtgtgtga

SEQ ID NO: 1040033 - DNA, 22 bp, Artificial Sequence
  chemically synthesized
gtcttattcaacatcacacaca

SEQ ID NO: 1040034 - DNA, 22 bp, Artificial Sequence
  chemically synthesized
gaatgtgtgtgatgttgaataa

SEQ ID NO: 1040035 - DNA, 22 bp, Artificial Sequence
  chemically synthesized
accatccctagtcttattcaac

SEQ ID NO: 1040036 - DNA, 22 bp, Artificial Sequence
  chemically synthesized
agcaatctgaccatccctagtc

SEQ ID NO: 1040037 - DNA, 22 bp, Artificial Sequence
  chemically synthesized
ctgagcaatctgaccatcccta

SEQ ID NO: 1040038 - DNA, 22 bp, Artificial Sequence
  chemically synthesized
cctgagcaatctgaccatccct

SEQ ID NO: 1040039 - DNA, 22 bp, Artificial Sequence
  chemically synthesized
tcctgagcaatctgaccatccc

SEQ ID NO: 1040040 - DNA, 22 bp, Artificial Sequence
  chemically synthesized
aataagactagggatggtcaga

SEQ ID NO: 1040041 - DNA, 22 bp, Artificial Sequence
  chemically synthesized
aacacctttcctgagcaatctg

SEQ ID NO: 1040042 - DNA, 22 bp, Artificial Sequence
  chemically synthesized
gggatggtcagattgctcagga

SEQ ID NO: 1040043 - DNA, 22 bp, Artificial Sequence
  chemically synthesized
accctaaacacctttcctgagc

SEQ ID NO: 1040044 - DNA, 22 bp, Artificial Sequence
  chemically synthesized
caccctaaacacctttcctgag

SEQ ID NO: 1040045 - DNA, 22 bp, Artificial Sequence
  chemically synthesized
tcaccctaaacacctttcctga

SEQ ID NO: 1040046 - DNA, 22 bp, Artificial Sequence
  chemically synthesized
ttcaccctaaacacctttcctg

SEQ ID NO: 1040047 - DNA, 22 bp, Artificial Sequence
  chemically synthesized
ttttcaccctaaacacctttcc

SEQ ID NO: 1040048 - DNA, 22 bp, Artificial Sequence
  chemically synthesized
actcttttcaccctaaacacct

SEQ ID NO: 1040049 - DNA, 22 bp, Artificial Sequence
  chemically synthesized
tcactcttttcaccctaaacac

SEQ ID NO: 1040050 - DNA, 22 bp, Artificial Sequence
  chemically synthesized
ctcactcttttcaccctaaaca

SEQ ID NO: 1040051 - DNA, 22 bp, Artificial Sequence
  chemically synthesized
ctcaggaaaggtgtttagggtg

SEQ ID NO: 1040052 - DNA, 22 bp, Artificial Sequence
  chemically synthesized
ttctcactcttttcaccctaaa

SEQ ID NO: 1040053 - DNA, 22 bp, Artificial Sequence
  chemically synthesized
cttctcactcttttcaccctaa

SEQ ID NO: 1040054 - DNA, 22 bp, Artificial Sequence
  chemically synthesized
aggaaaggtgtttagggtgaaa

SEQ ID NO: 1040055 - DNA, 22 bp, Artificial Sequence
  chemically synthesized
tcttctcactcttttcacccta

SEQ ID NO: 1040056 - DNA, 22 bp, Artificial Sequence
  chemically synthesized
cctttcttctcactcttttcac

SEQ ID NO: 1040057 - DNA, 22 bp, Artificial Sequence
  chemically synthesized
tgctacctttcttctcactctt

SEQ ID NO: 1040058 - DNA, 22 bp, Artificial Sequence
  chemically synthesized
atgctacctttcttctcactct

SEQ ID NO: 1040059 - DNA, 22 bp, Artificial Sequence
  chemically synthesized
tatgctacctttcttctcactc

SEQ ID NO: 1040060 - DNA, 22 bp, Artificial Sequence
  chemically synthesized
agggtgaaaagagtgagaagaa

SEQ ID NO: 1040061 - DNA, 22 bp, Artificial Sequence
  chemically synthesized
gggtgaaaagagtgagaagaaa

SEQ ID NO: 1040062 - DNA, 22 bp, Artificial Sequence
  chemically synthesized
atctttatgctacctttcttct

SEQ ID NO: 1040063 - DNA, 22 bp, Artificial Sequence
  chemically synthesized
cacataggttcatctttatgct

SEQ ID NO: 1040064 - DNA, 22 bp, Artificial Sequence
  chemically synthesized
ccacataggttcatctttatgc

SEQ ID NO: 1040065 - DNA, 22 bp, Artificial Sequence
  chemically synthesized
tccacataggttcatctttatg

SEQ ID NO: 1040066 - DNA, 22 bp, Artificial Sequence
  chemically synthesized
cccatgctttccacataggttc

SEQ ID NO: 1040067 - DNA, 22 bp, Artificial Sequence
  chemically synthesized
tgcccatgctttccacataggt

SEQ ID NO: 1040068 - DNA, 22 bp, Artificial Sequence
  chemically synthesized
ctctgcccatgctttccacata

SEQ ID NO: 1040069 - DNA, 22 bp, Artificial Sequence
  chemically synthesized
cctctgcccatgctttccacat

SEQ ID NO: 1040070 - DNA, 22 bp, Artificial Sequence
  chemically synthesized
cttcctctgcccatgctttcca

SEQ ID NO: 1040071 - DNA, 22 bp, Artificial Sequence
  chemically synthesized
atctccttcctctgcccatgct

SEQ ID NO: 1040072 - DNA, 22 bp, Artificial Sequence
  chemically synthesized
tgtggaaagcatgggcagagga

SEQ ID NO: 1040073 - DNA, 22 bp, Artificial Sequence
  chemically synthesized
gggatactcatctccttcctct

SEQ ID NO: 1040074 - DNA, 22 bp, Artificial Sequence
  chemically synthesized
agggatactcatctccttcctc

SEQ ID NO: 1040075 - DNA, 22 bp, Artificial Sequence
  chemically synthesized
tagggatactcatctccttcct

SEQ ID NO: 1040076 - DNA, 22 bp, Artificial Sequence
  chemically synthesized
tttagggatactcatctccttc

SEQ ID NO: 1040077 - DNA, 22 bp, Artificial Sequence
  chemically synthesized
ttctttagggatactcatctcc

SEQ ID NO: 1040078 - DNA, 22 bp, Artificial Sequence
  chemically synthesized
ttattctttagggatactcatc

SEQ ID NO: 1040079 - DNA, 22 bp, Artificial Sequence
  chemically synthesized
atgactattattctttagggat

SEQ ID NO: 1040080 - DNA, 22 bp, Artificial Sequence
  chemically synthesized
ggtctgatgactattattcttt

SEQ ID NO: 1040081 - DNA, 22 bp, Artificial Sequence
  chemically synthesized
ctgggtctgatgactattattc

SEQ ID NO: 1040082 - DNA, 22 bp, Artificial Sequence
  chemically synthesized
cctgggtctgatgactattatt

SEQ ID NO: 1040083 - DNA, 22 bp, Artificial Sequence
  chemically synthesized
ttcctgggtctgatgactatta

SEQ ID NO: 1040084 - DNA, 22 bp, Artificial Sequence
  chemically synthesized
tcttcctgggtctgatgactat

SEQ ID NO: 1040085 - DNA, 22 bp, Artificial Sequence
  chemically synthesized
gttctcttcctgggtctgatga

SEQ ID NO: 1040086 - DNA, 22 bp, Artificial Sequence
  chemically synthesized
aagaataatagtcatcagaccc

SEQ ID NO: 1040087 - DNA, 22 bp, Artificial Sequence
  chemically synthesized
tggttctcttcctgggtctgat

SEQ ID NO: 1040088 - DNA, 22 bp, Artificial Sequence
  chemically synthesized
ctggttctcttcctgggtctga

SEQ ID NO: 1040089 - DNA, 22 bp, Artificial Sequence
  chemically synthesized
cttctggttctcttcctgggtc

SEQ ID NO: 1040090 - DNA, 22 bp, Artificial Sequence
  chemically synthesized
cctccttctggttctcttcctg

SEQ ID NO: 1040091 - DNA, 22 bp, Artificial Sequence
  chemically synthesized
cctccctccttctggttctctt

SEQ ID NO: 1040092 - DNA, 22 bp, Artificial Sequence
  chemically synthesized
acaactccctccctccttctgg

SEQ ID NO: 1040093 - DNA, 22 bp, Artificial Sequence
  chemically synthesized
ttgacaactccctccctccttc

SEQ ID NO: 1040094 - DNA, 22 bp, Artificial Sequence
  chemically synthesized
gttgacaactccctccctcctt

SEQ ID NO: 1040095 - DNA, 22 bp, Artificial Sequence
  chemically synthesized
acttgttgacaactccctccct

SEQ ID NO: 1040096 - DNA, 22 bp, Artificial Sequence
  chemically synthesized
catctgacttgttgacaactcc

SEQ ID NO: 1040097 - DNA, 22 bp, Artificial Sequence
  chemically synthesized
gctgcatctgacttgttgacaa

SEQ ID NO: 1040098 - DNA, 22 bp, Artificial Sequence
  chemically synthesized
gtcctggctgcatctgacttgt

SEQ ID NO: 1040099 - DNA, 22 bp, Artificial Sequence
  chemically synthesized
ctggtcctggctgcatctgact

SEQ ID NO: 1040100 - DNA, 22 bp, Artificial Sequence
  chemically synthesized
cctcctggtcctggctgcatct

SEQ ID NO: 1040101 - DNA, 22 bp, Artificial Sequence
  chemically synthesized
ccctcctggtcctggctgcatc

SEQ ID NO: 1040102 - DNA, 22 bp, Artificial Sequence
  chemically synthesized
tcaacaagtcagatgcagccag

SEQ ID NO: 1040103 - DNA, 22 bp, Artificial Sequence
  chemically synthesized
tccctcctggtcctggctgcat

SEQ ID NO: 1040104 - DNA, 22 bp, Artificial Sequence
  chemically synthesized
ttccctcctggtcctggctgca

SEQ ID NO: 1040105 - DNA, 22 bp, Artificial Sequence
  chemically synthesized
acttttccctcctggtcctggc

SEQ ID NO: 1040106 - DNA, 22 bp, Artificial Sequence
  chemically synthesized
cccgagctgacttttccctcct

SEQ ID NO: 1040107 - DNA, 22 bp, Artificial Sequence
  chemically synthesized
aattgcccgagctgacttttcc

SEQ ID NO: 1040108 - DNA, 22 bp, Artificial Sequence
  chemically synthesized
ctaaattgcccgagctgacttt

SEQ ID NO: 1040109 - DNA, 22 bp, Artificial Sequence
  chemically synthesized
gataagatcaccaatgacctcc

SEQ ID NO: 1040110 - DNA, 22 bp, Artificial Sequence
  chemically synthesized
gggcaatttaggaggtcattgg

SEQ ID NO: 1040111 - DNA, 22 bp, Artificial Sequence
  chemically synthesized
tcgataagatcaccaatgacct

SEQ ID NO: 1040112 - DNA, 22 bp, Artificial Sequence
  chemically synthesized
ctctcgataagatcaccaatga

SEQ ID NO: 1040113 - DNA, 22 bp, Artificial Sequence
  chemically synthesized
ttgctctcgataagatcaccaa

SEQ ID NO: 1040114 - DNA, 22 bp, Artificial Sequence
  chemically synthesized
aggaggtcattggtgatcttat

SEQ ID NO: 1040115 - DNA, 22 bp, Artificial Sequence
  chemically synthesized
ttgttgctctcgataagatcac

SEQ ID NO: 1040116 - DNA, 22 bp, Artificial Sequence
  chemically synthesized
ggaggtcattggtgatcttatc

SEQ ID NO: 1040117 - DNA, 22 bp, Artificial Sequence
  chemically synthesized
caacatgctgttgttgctctcg

SEQ ID NO: 1040118 - DNA, 22 bp, Artificial Sequence
  chemically synthesized
ccaacatgctgttgttgctctc

SEQ ID NO: 1040119 - DNA, 22 bp, Artificial Sequence
  chemically synthesized
gtgatcttatcgagagcaacaa

SEQ ID NO: 1040120 - DNA, 22 bp, Artificial Sequence
  chemically synthesized
cacttccaacatgctgttgttg

SEQ ID NO: 1040121 - DNA, 22 bp, Artificial Sequence
  chemically synthesized
ccacttccaacatgctgttgtt

SEQ ID NO: 1040122 - DNA, 22 bp, Artificial Sequence
  chemically synthesized
tccacttccaacatgctgttgt

SEQ ID NO: 1040123 - DNA, 22 bp, Artificial Sequence
  chemically synthesized
atcgagagcaacaacagcatgt

SEQ ID NO: 1040124 - DNA, 22 bp, Artificial Sequence
  chemically synthesized
tcgagagcaacaacagcatgtt

SEQ ID NO: 1040125 - DNA, 22 bp, Artificial Sequence
  chemically synthesized
tgttttccacttccaacatgct

SEQ ID NO: 1040126 - DNA, 22 bp, Artificial Sequence
  chemically synthesized
atgttttccacttccaacatgc

SEQ ID NO: 1040127 - DNA, 22 bp, Artificial Sequence
  chemically synthesized
catttatgttttccacttccaa

SEQ ID NO: 1040128 - DNA, 22 bp, Artificial Sequence
  chemically synthesized
cctacatttatgttttccactt

SEQ ID NO: 1040129 - DNA, 22 bp, Artificial Sequence
  chemically synthesized
gtctgcctacatttatgttttc

SEQ ID NO: 1040130 - DNA, 22 bp, Artificial Sequence
  chemically synthesized
gaagtggaaaacataaatgtag

SEQ ID NO: 1040131 - DNA, 22 bp, Artificial Sequence
  chemically synthesized
tagtgaaagatgatgacagcaa

SEQ ID NO: 1040132 - DNA, 22 bp, Artificial Sequence
  chemically synthesized
atagtgaaagatgatgacagca

SEQ ID NO: 1040133 - DNA, 22 bp, Artificial Sequence
  chemically synthesized
tatagtgaaagatgatgacagc

SEQ ID NO: 1040134 - DNA, 22 bp, Artificial Sequence
  chemically synthesized
ttttatagtgaaagatgatgac

SEQ ID NO: 1040135 - DNA, 22 bp, Artificial Sequence
  chemically synthesized
tattttatagtgaaagatgatg

SEQ ID NO: 1040136 - DNA, 22 bp, Artificial Sequence
  chemically synthesized
tcttttgctgtcatcatctttc

SEQ ID NO: 1040137 - DNA, 22 bp, Artificial Sequence
  chemically synthesized
ctattttatagtgaaagatgat

SEQ ID NO: 1040138 - DNA, 22 bp, Artificial Sequence
  chemically synthesized
tctattttatagtgaaagatga

SEQ ID NO: 1040139 - DNA, 22 bp, Artificial Sequence
  chemically synthesized
ttgctgtcatcatctttcacta

SEQ ID NO: 1040140 - DNA, 22 bp, Artificial Sequence
  chemically synthesized
ttttctattttatagtgaaaga

SEQ ID NO: 1040141 - DNA, 22 bp, Artificial Sequence
  chemically synthesized
tgctgtcatcatctttcactat

SEQ ID NO: 1040142 - DNA, 22 bp, Artificial Sequence
  chemically synthesized
gctgtcatcatctttcactata

SEQ ID NO: 1040143 - DNA, 22 bp, Artificial Sequence
  chemically synthesized
ctgtcatcatctttcactataa

SEQ ID NO: 1040144 - DNA, 22 bp, Artificial Sequence
  chemically synthesized
tcatcatctttcactataaaat

SEQ ID NO: 1040145 - DNA, 22 bp, Artificial Sequence
  chemically synthesized
tcactataaaatagaaaatagc

SEQ ID NO: 1040146 - DNA, 22 bp, Artificial Sequence
  chemically synthesized
cactataaaatagaaaatagct

SEQ ID NO: 1040147 - DNA, 22 bp, Artificial Sequence
  chemically synthesized
actataaaatagaaaatagctt

SEQ ID NO: 1040148 - DNA, 22 bp, Artificial Sequence
  chemically synthesized
caatgtcgtacaaagctatttt

SEQ ID NO: 1040149 - DNA, 22 bp, Artificial Sequence
  chemically synthesized
taaaatagaaaatagctttgta

SEQ ID NO: 1040150 - DNA, 22 bp, Artificial Sequence
  chemically synthesized
atgtcaaatacagcatactgca

SEQ ID NO: 1040151 - DNA, 22 bp, Artificial Sequence
  chemically synthesized
tgtacgacattgcagtatgctg

SEQ ID NO: 1040152 - DNA, 22 bp, Artificial Sequence
  chemically synthesized
tgatgtcaaatacagcatactg

SEQ ID NO: 1040153 - DNA, 22 bp, Artificial Sequence
  chemically synthesized
gtacgacattgcagtatgctgt

SEQ ID NO: 1040154 - DNA, 22 bp, Artificial Sequence
  chemically synthesized
tacgacattgcagtatgctgta

SEQ ID NO: 1040155 - DNA, 22 bp, Artificial Sequence
  chemically synthesized
cagtatgctgtatttgacatca

SEQ ID NO: 1040156 - DNA, 22 bp, Artificial Sequence
  chemically synthesized
aataagcaagcctctgatgtca

SEQ ID NO: 1040157 - DNA, 22 bp, Artificial Sequence
  chemically synthesized
caataagcaagcctctgatgtc

SEQ ID NO: 1040158 - DNA, 22 bp, Artificial Sequence
  chemically synthesized
ttcaataagcaagcctctgatg

SEQ ID NO: 1040159 - DNA, 22 bp, Artificial Sequence
  chemically synthesized
cttcaataagcaagcctctgat

SEQ ID NO: 1040160 - DNA, 22 bp, Artificial Sequence
  chemically synthesized
tcttcaataagcaagcctctga

SEQ ID NO: 1040161 - DNA, 22 bp, Artificial Sequence
  chemically synthesized
ttcttcaataagcaagcctctg

SEQ ID NO: 1040162 - DNA, 22 bp, Artificial Sequence
  chemically synthesized
tatttgacatcagaggcttgct

SEQ ID NO: 1040163 - DNA, 22 bp, Artificial Sequence
  chemically synthesized
gacatcagaggcttgcttattg

SEQ ID NO: 1040164 - DNA, 22 bp, Artificial Sequence
  chemically synthesized
acatcagaggcttgcttattga

SEQ ID NO: 1040165 - DNA, 22 bp, Artificial Sequence
  chemically synthesized
tcaatatgaaacttttcttcaa

SEQ ID NO: 1040166 - DNA, 22 bp, Artificial Sequence
  chemically synthesized
atcaatatgaaacttttcttca

SEQ ID NO: 1040167 - DNA, 22 bp, Artificial Sequence
  chemically synthesized
tatcaatatgaaacttttcttc

SEQ ID NO: 1040168 - DNA, 22 bp, Artificial Sequence
  chemically synthesized
ttatcaatatgaaacttttctt

SEQ ID NO: 1040169 - DNA, 22 bp, Artificial Sequence
  chemically synthesized
tttttatcaatatgaaactttt

SEQ ID NO: 1040170 - DNA, 22 bp, Artificial Sequence
  chemically synthesized
gcttattgaagaaaagtttcat

SEQ ID NO: 1040171 - DNA, 22 bp, Artificial Sequence
  chemically synthesized
gtttttatcaatatgaaacttt

SEQ ID NO: 1040172 - DNA, 22 bp, Artificial Sequence
  chemically synthesized
cttattgaagaaaagtttcata

SEQ ID NO: 1040173 - DNA, 22 bp, Artificial Sequence
  chemically synthesized
tgtttttatcaatatgaaactt

SEQ ID NO: 1040174 - DNA, 22 bp, Artificial Sequence
  chemically synthesized
attgaagaaaagtttcatattg

SEQ ID NO: 1040175 - DNA, 22 bp, Artificial Sequence
  chemically synthesized
ttgaagaaaagtttcatattga

SEQ ID NO: 1040176 - DNA, 22 bp, Artificial Sequence
  chemically synthesized
aagaaaagtttcatattgataa

SEQ ID NO: 1040177 - DNA, 22 bp, Artificial Sequence
  chemically synthesized
tgagttttgtttttatcaatat

SEQ ID NO: 1040178 - DNA, 22 bp, Artificial Sequence
  chemically synthesized
ttatgagttttgtttttatcaa

SEQ ID NO: 1040179 - DNA, 22 bp, Artificial Sequence
  chemically synthesized
attatgagttttgtttttatca

SEQ ID NO: 1040180 - DNA, 22 bp, Artificial Sequence
  chemically synthesized
tattatgagttttgtttttatc

SEQ ID NO: 1040181 - DNA, 22 bp, Artificial Sequence
  chemically synthesized
ttttattatgagttttgttttt

SEQ ID NO: 1040182 - DNA, 22 bp, Artificial Sequence
  chemically synthesized
tgttttattatgagttttgttt

SEQ ID NO: 1040183 - DNA, 22 bp, Artificial Sequence
  chemically synthesized
catattgataaaaacaaaactc

SEQ ID NO: 1040184 - DNA, 22 bp, Artificial Sequence
  chemically synthesized
ctgttttattatgagttttgtt

SEQ ID NO: 1040185 - DNA, 22 bp, Artificial Sequence
  chemically synthesized
atattgataaaaacaaaactca

SEQ ID NO: 1040186 - DNA, 22 bp, Artificial Sequence
  chemically synthesized
ataaaaacaaaactcataataa

SEQ ID NO: 1040187 - DNA, 22 bp, Artificial Sequence
  chemically synthesized
ataataaaacagaaactgttgg

SEQ ID NO: 1040188 - DNA, 22 bp, Artificial Sequence
  chemically synthesized
ttggatactatgctcactgcct

SEQ ID NO: 1040189 - DNA, 22 bp, Artificial Sequence
  chemically synthesized
gatactatgctcactgcctggg

SEQ ID NO: 1040190 - DNA, 22 bp, Artificial Sequence
  chemically synthesized
tgctcactgcctgggtgatggg

SEQ ID NO: 1040191 - DNA, 22 bp, Artificial Sequence
  chemically synthesized
ggatatgaatgaccccatcacc

SEQ ID NO: 1040192 - DNA, 22 bp, Artificial Sequence
  chemically synthesized
gggatatgaatgaccccatcac

SEQ ID NO: 1040193 - DNA, 22 bp, Artificial Sequence
  chemically synthesized
actgcctgggtgatggggtcat

SEQ ID NO: 1040194 - DNA, 22 bp, Artificial Sequence
  chemically synthesized
agatttgggatatgaatgaccc

SEQ ID NO: 1040195 - DNA, 22 bp, Artificial Sequence
  chemically synthesized
cctgggtgatggggtcattcat

SEQ ID NO: 1040196 - DNA, 22 bp, Artificial Sequence
  chemically synthesized
ggtgatggggtcattcatatcc

SEQ ID NO: 1040197 - DNA, 22 bp, Artificial Sequence
  chemically synthesized
atgctgagatttgggatatgaa

SEQ ID NO: 1040198 - DNA, 22 bp, Artificial Sequence
  chemically synthesized
gatgctgagatttgggatatga

SEQ ID NO: 1040199 - DNA, 22 bp, Artificial Sequence
  chemically synthesized
tttgatgctgagatttgggata

SEQ ID NO: 1040200 - DNA, 22 bp, Artificial Sequence
  chemically synthesized
atatcccaaatctcagcatcaa

SEQ ID NO: 1040201 - DNA, 22 bp, Artificial Sequence
  chemically synthesized
catggatatattgtttgatgct

SEQ ID NO: 1040202 - DNA, 22 bp, Artificial Sequence
  chemically synthesized
ttacatggatatattgtttgat

SEQ ID NO: 1040203 - DNA, 22 bp, Artificial Sequence
  chemically synthesized
gttacatggatatattgtttga

SEQ ID NO: 1040204 - DNA, 22 bp, Artificial Sequence
  chemically synthesized
agcatcaaacaatatatccatg

SEQ ID NO: 1040205 - DNA, 22 bp, Artificial Sequence
  chemically synthesized
aggaatacatgtgcaggtttgt

SEQ ID NO: 1040206 - DNA, 22 bp, Artificial Sequence
  chemically synthesized
gattcaggaatacatgtgcagg

SEQ ID NO: 1040207 - DNA, 22 bp, Artificial Sequence
  chemically synthesized
agattcaggaatacatgtgcag

SEQ ID NO: 1040208 - DNA, 22 bp, Artificial Sequence
  chemically synthesized
tagattcaggaatacatgtgca

SEQ ID NO: 1040209 - DNA, 22 bp, Artificial Sequence
  chemically synthesized
aagtgtattttagattcaggaa

SEQ ID NO: 1040210 - DNA, 22 bp, Artificial Sequence
  chemically synthesized
caagtgtattttagattcagga

SEQ ID NO: 1040211 - DNA, 22 bp, Artificial Sequence
  chemically synthesized
cacatgtattcctgaatctaaa

SEQ ID NO: 1040212 - DNA, 22 bp, Artificial Sequence
  chemically synthesized
taatttcaagtgtattttagat

SEQ ID NO: 1040213 - DNA, 22 bp, Artificial Sequence
  chemically synthesized
ttataatttcaagtgtatttta

SEQ ID NO: 1040214 - DNA, 22 bp, Artificial Sequence
  chemically synthesized
attataatttcaagtgtatttt

SEQ ID NO: 1040215 - DNA, 22 bp, Artificial Sequence
  chemically synthesized
tattataatttcaagtgtattt

SEQ ID NO: 1040216 - DNA, 22 bp, Artificial Sequence
  chemically synthesized
ttattataatttcaagtgtatt

SEQ ID NO: 1040217 - DNA, 22 bp, Artificial Sequence
  chemically synthesized
ctgaatctaaaatacacttgaa

SEQ ID NO: 1040218 - DNA, 22 bp, Artificial Sequence
  chemically synthesized
ttttattataatttcaagtgta

SEQ ID NO: 1040219 - DNA, 22 bp, Artificial Sequence
  chemically synthesized
aatctaaaatacacttgaaatt

SEQ ID NO: 1040220 - DNA, 22 bp, Artificial Sequence
  chemically synthesized
tatctcttttattataatttca

SEQ ID NO: 1040221 - DNA, 22 bp, Artificial Sequence
  chemically synthesized
aaatacacttgaaattataata

SEQ ID NO: 1040222 - DNA, 22 bp, Artificial Sequence
  chemically synthesized
catccattgtatctcttttatt

SEQ ID NO: 1040223 - DNA, 22 bp, Artificial Sequence
  chemically synthesized
gaaattataataaaagagatac

SEQ ID NO: 1040224 - DNA, 22 bp, Artificial Sequence
  chemically synthesized
aaattataataaaagagataca

SEQ ID NO: 1040225 - DNA, 22 bp, Artificial Sequence
  chemically synthesized
taataaaagagatacaatggat

SEQ ID NO: 1040226 - DNA, 22 bp, Artificial Sequence
  chemically synthesized
ataacaggtattacatccattg

SEQ ID NO: 1040227 - DNA, 22 bp, Artificial Sequence
  chemically synthesized
gggcattaataacaggtattac

SEQ ID NO: 1040228 - DNA, 22 bp, Artificial Sequence
  chemically synthesized
agggcattaataacaggtatta

SEQ ID NO: 1040229 - DNA, 22 bp, Artificial Sequence
  chemically synthesized
tagggcattaataacaggtatt

SEQ ID NO: 1040230 - DNA, 22 bp, Artificial Sequence
  chemically synthesized
ttagggcattaataacaggtat

SEQ ID NO: 1040231 - DNA, 22 bp, Artificial Sequence
  chemically synthesized
aatggcttttagggcattaata

SEQ ID NO: 1040232 - DNA, 22 bp, Artificial Sequence
  chemically synthesized
agttcaatggcttttagggcat

SEQ ID NO: 1040233 - DNA, 22 bp, Artificial Sequence
  chemically synthesized
gagttcaatggcttttagggca

SEQ ID NO: 1040234 - DNA, 22 bp, Artificial Sequence
  chemically synthesized
ttattaatgccctaaaagccat

SEQ ID NO: 1040235 - DNA, 22 bp, Artificial Sequence
  chemically synthesized
ttaatgccctaaaagccattga

SEQ ID NO: 1040236 - DNA, 22 bp, Artificial Sequence
  chemically synthesized
atgccctaaaagccattgaact

SEQ ID NO: 1040237 - DNA, 22 bp, Artificial Sequence
  chemically synthesized
gagatacgcttgagttcaatgg

SEQ ID NO: 1040238 - DNA, 22 bp, Artificial Sequence
  chemically synthesized
aaagccattgaactcaagcgta

SEQ ID NO: 1040239 - DNA, 22 bp, Artificial Sequence
  chemically synthesized
aactcaagcgtatctctagtat

SEQ ID NO: 1040240 - DNA, 22 bp, Artificial Sequence
  chemically synthesized
aagcgtatctctagtattattt

SEQ ID NO: 1040241 - DNA, 22 bp, Artificial Sequence
  chemically synthesized
ccaggtaaataaaagtaaagaa

SEQ ID NO: 1040242 - DNA, 22 bp, Artificial Sequence
  chemically synthesized
taccaggtaaataaaagtaaag

SEQ ID NO: 1040243 - DNA, 22 bp, Artificial Sequence
  chemically synthesized
tagtattatttctttactttta

SEQ ID NO: 1040244 - DNA, 22 bp, Artificial Sequence
  chemically synthesized
gtattatttctttacttttatt

SEQ ID NO: 1040245 - DNA, 22 bp, Artificial Sequence
  chemically synthesized
tttctttacttttatttacctg

SEQ ID NO: 1040246 - DNA, 22 bp, Artificial Sequence
  chemically synthesized
ctttacttttatttacctggta

SEQ ID NO: 1040247 - DNA, 22 bp, Artificial Sequence
  chemically synthesized
tttacttttatttacctggtag

SEQ ID NO: 1040248 - DNA, 22 bp, Artificial Sequence
  chemically synthesized
tacttttatttacctggtagaa

SEQ ID NO: 1040249 - DNA, 22 bp, Artificial Sequence
  chemically synthesized
acttttatttacctggtagaat

SEQ ID NO: 1040250 - DNA, 22 bp, Artificial Sequence
  chemically synthesized
cttttatttacctggtagaatt

SEQ ID NO: 1040251 - DNA, 22 bp, Artificial Sequence
  chemically synthesized
ttatttacctggtagaatttta

SEQ ID NO: 1040252 - DNA, 22 bp, Artificial Sequence
  chemically synthesized
tatttacctggtagaattttac

SEQ ID NO: 1040253 - DNA, 22 bp, Artificial Sequence
  chemically synthesized
atttacctggtagaattttact

SEQ ID NO: 1040254 - DNA, 22 bp, Artificial Sequence
  chemically synthesized
tttacctggtagaattttacta

SEQ ID NO: 1040255 - DNA, 22 bp, Artificial Sequence
  chemically synthesized
acctggtagaattttactacca

SEQ ID NO: 1040256 - DNA, 22 bp, Artificial Sequence
  chemically synthesized
cctggtagaattttactaccat

SEQ ID NO: 1040257 - DNA, 22 bp, Artificial Sequence
  chemically synthesized
gagccatcagaagatggtagta

SEQ ID NO: 1040258 - DNA, 22 bp, Artificial Sequence
  chemically synthesized
ggagccatcagaagatggtagt

SEQ ID NO: 1040259 - DNA, 22 bp, Artificial Sequence
  chemically synthesized
gtagaattttactaccatcttc

SEQ ID NO: 1040260 - DNA, 22 bp, Artificial Sequence
  chemically synthesized
caggcttggagccatcagaaga

SEQ ID NO: 1040261 - DNA, 22 bp, Artificial Sequence
  chemically synthesized
tactaccatcttctgatggctc

SEQ ID NO: 1040262 - DNA, 22 bp, Artificial Sequence
  chemically synthesized
actaccatcttctgatggctcc

SEQ ID NO: 1040263 - DNA, 22 bp, Artificial Sequence
  chemically synthesized
ctaccatcttctgatggctcca

SEQ ID NO: 1040264 - DNA, 22 bp, Artificial Sequence
  chemically synthesized
ccatcttctgatggctccaagc

SEQ ID NO: 1040265 - DNA, 22 bp, Artificial Sequence
  chemically synthesized
cacccaagactccaggcttgga

SEQ ID NO: 1040266 - DNA, 22 bp, Artificial Sequence
  chemically synthesized
ctgatggctccaagcctggagt

SEQ ID NO: 1040267 - DNA, 22 bp, Artificial Sequence
  chemically synthesized
tgatggctccaagcctggagtc

SEQ ID NO: 1040268 - DNA, 22 bp, Artificial Sequence
  chemically synthesized
atggctccaagcctggagtctt

SEQ ID NO: 1040269 - DNA, 22 bp, Artificial Sequence
  chemically synthesized
aacattccacccaagactccag

SEQ ID NO: 1040270 - DNA, 22 bp, Artificial Sequence
  chemically synthesized
caagcctggagtcttgggtgga

SEQ ID NO: 1040271 - DNA, 22 bp, Artificial Sequence
  chemically synthesized
gcggagtagccctaaacattcc

SEQ ID NO: 1040272 - DNA, 22 bp, Artificial Sequence
  chemically synthesized
gagtcttgggtggaatgtttag

SEQ ID NO: 1040273 - DNA, 22 bp, Artificial Sequence
  chemically synthesized
gggtggaatgtttagggctact

SEQ ID NO: 1040274 - DNA, 22 bp, Artificial Sequence
  chemically synthesized
ggtggaatgtttagggctactc

SEQ ID NO: 1040275 - DNA, 22 bp, Artificial Sequence
  chemically synthesized
atcaggctagcggagtagccct

SEQ ID NO: 1040276 - DNA, 22 bp, Artificial Sequence
  chemically synthesized
acctaatcaggctagcggagta

SEQ ID NO: 1040277 - DNA, 22 bp, Artificial Sequence
  chemically synthesized
agggctactccgctagcctgat

SEQ ID NO: 1040278 - DNA, 22 bp, Artificial Sequence
  chemically synthesized
gtacctgacctaatcaggctag

SEQ ID NO: 1040279 - DNA, 22 bp, Artificial Sequence
  chemically synthesized
gggctactccgctagcctgatt

SEQ ID NO: 1040280 - DNA, 22 bp, Artificial Sequence
  chemically synthesized
tggtacctgacctaatcaggct

SEQ ID NO: 1040281 - DNA, 22 bp, Artificial Sequence
  chemically synthesized
ctggtacctgacctaatcaggc

SEQ ID NO: 1040282 - DNA, 22 bp, Artificial Sequence
  chemically synthesized
ctccgctagcctgattaggtca

SEQ ID NO: 1040283 - DNA, 22 bp, Artificial Sequence
  chemically synthesized
cgctagcctgattaggtcaggt

SEQ ID NO: 1040284 - DNA, 22 bp, Artificial Sequence
  chemically synthesized
gtgcacgtttctggtacctgac

SEQ ID NO: 1040285 - DNA, 22 bp, Artificial Sequence
  chemically synthesized
gcctgattaggtcaggtaccag

SEQ ID NO: 1040286 - DNA, 22 bp, Artificial Sequence
  chemically synthesized
attaggtcaggtaccagaaacg

SEQ ID NO: 1040287 - DNA, 22 bp, Artificial Sequence
  chemically synthesized
ggtcaggtaccagaaacgtgca

SEQ ID NO: 1040288 - DNA, 22 bp, Artificial Sequence
  chemically synthesized
acagaagcagccaagaagatat

SEQ ID NO: 1040289 - DNA, 22 bp, Artificial Sequence
  chemically synthesized
cccaggtcaggcaagttaacag

SEQ ID NO: 1040290 - DNA, 22 bp, Artificial Sequence
  chemically synthesized
cttggctgcttctgttaacttg

SEQ ID NO: 1040291 - DNA, 22 bp, Artificial Sequence
  chemically synthesized
ttggctgcttctgttaacttgc

SEQ ID NO: 1040292 - DNA, 22 bp, Artificial Sequence
  chemically synthesized
ggctgcttctgttaacttgcct

SEQ ID NO: 1040293 - DNA, 22 bp, Artificial Sequence
  chemically synthesized
gctgcttctgttaacttgcctg

SEQ ID NO: 1040294 - DNA, 22 bp, Artificial Sequence
  chemically synthesized
cttctgttaacttgcctgacct

SEQ ID NO: 1040295 - DNA, 22 bp, Artificial Sequence
  chemically synthesized
ctgttaacttgcctgacctggg

SEQ ID NO: 1040296 - DNA, 22 bp, Artificial Sequence
  chemically synthesized
tgttaacttgcctgacctgggc

SEQ ID NO: 1040297 - DNA, 22 bp, Artificial Sequence
  chemically synthesized
tgaaatcaggctgcccaggtca

SEQ ID NO: 1040298 - DNA, 22 bp, Artificial Sequence
  chemically synthesized
gtgaaatcaggctgcccaggtc

SEQ ID NO: 1040299 - DNA, 22 bp, Artificial Sequence
  chemically synthesized
ttaacttgcctgacctgggcag

SEQ ID NO: 1040300 - DNA, 22 bp, Artificial Sequence
  chemically synthesized
acttgcctgacctgggcagcct

SEQ ID NO: 1040301 - DNA, 22 bp, Artificial Sequence
  chemically synthesized
gcctgacctgggcagcctgatt

SEQ ID NO: 1040302 - DNA, 22 bp, Artificial Sequence
  chemically synthesized
cctgacctgggcagcctgattt

SEQ ID NO: 1040303 - DNA, 22 bp, Artificial Sequence
  chemically synthesized
aatcaagtacttgtgaaatcag

SEQ ID NO: 1040304 - DNA, 22 bp, Artificial Sequence
  chemically synthesized
acctgggcagcctgatttcaca

SEQ ID NO: 1040305 - DNA, 22 bp, Artificial Sequence
  chemically synthesized
ggcagcctgatttcacaagtac

SEQ ID NO: 1040306 - DNA, 22 bp, Artificial Sequence
  chemically synthesized
agagttgaatcaagtacttgtg

SEQ ID NO: 1040307 - DNA, 22 bp, Artificial Sequence
  chemically synthesized
atttcacaagtacttgattcaa

SEQ ID NO: 1040308 - DNA, 22 bp, Artificial Sequence
  chemically synthesized
aaagaattcagagttgaatcaa

SEQ ID NO: 1040309 - DNA, 22 bp, Artificial Sequence
  chemically synthesized
aaaagaattcagagttgaatca

SEQ ID NO: 1040310 - DNA, 22 bp, Artificial Sequence
  chemically synthesized
cacaagtacttgattcaactct

SEQ ID NO: 1040311 - DNA, 22 bp, Artificial Sequence
  chemically synthesized
acaagtacttgattcaactctg

SEQ ID NO: 1040312 - DNA, 22 bp, Artificial Sequence
  chemically synthesized
gattcaactctgaattctttta

SEQ ID NO: 1040313 - DNA, 22 bp, Artificial Sequence
  chemically synthesized
attcaactctgaattcttttaa

SEQ ID NO: 1040314 - DNA, 22 bp, Artificial Sequence
  chemically synthesized
aactctgaattcttttaagtca

SEQ ID NO: 1040315 - DNA, 22 bp, Artificial Sequence
  chemically synthesized
tgaattcttttaagtcactgtc

SEQ ID NO: 1040316 - DNA, 22 bp, Artificial Sequence
  chemically synthesized
aattcttttaagtcactgtctc

SEQ ID NO: 1040317 - DNA, 22 bp, Artificial Sequence
  chemically synthesized
ttttaagtcactgtctccatca

SEQ ID NO: 1040318 - DNA, 22 bp, Artificial Sequence
  chemically synthesized
ttaagtcactgtctccatcatt

SEQ ID NO: 1040319 - DNA, 22 bp, Artificial Sequence
  chemically synthesized
taagtcactgtctccatcattc

SEQ ID NO: 1040320 - DNA, 22 bp, Artificial Sequence
  chemically synthesized
gcagccaagcaagaatgatgga

SEQ ID NO: 1040321 - DNA, 22 bp, Artificial Sequence
  chemically synthesized
aagtcactgtctccatcattct

SEQ ID NO: 1040322 - DNA, 22 bp, Artificial Sequence
  chemically synthesized
agtcactgtctccatcattctt

SEQ ID NO: 1040323 - DNA, 22 bp, Artificial Sequence
  chemically synthesized
gactggcagccaagcaagaatg

SEQ ID NO: 1040324 - DNA, 22 bp, Artificial Sequence
  chemically synthesized
tctccatcattcttgcttggct

SEQ ID NO: 1040325 - DNA, 22 bp, Artificial Sequence
  chemically synthesized
ccattggactggcagccaagca

SEQ ID NO: 1040326 - DNA, 22 bp, Artificial Sequence
  chemically synthesized
gccattggactggcagccaagc

SEQ ID NO: 1040327 - DNA, 22 bp, Artificial Sequence
  chemically synthesized
tgccattggactggcagccaag

SEQ ID NO: 1040328 - DNA, 22 bp, Artificial Sequence
  chemically synthesized
catcattcttgcttggctgcca

SEQ ID NO: 1040329 - DNA, 22 bp, Artificial Sequence
  chemically synthesized
tgtatctttgccattggactgg

SEQ ID NO: 1040330 - DNA, 22 bp, Artificial Sequence
  chemically synthesized
ttgcttggctgccagtccaatg

SEQ ID NO: 1040331 - DNA, 22 bp, Artificial Sequence
  chemically synthesized
gcttggctgccagtccaatggc

SEQ ID NO: 1040332 - DNA, 22 bp, Artificial Sequence
  chemically synthesized
cttggctgccagtccaatggca

SEQ ID NO: 1040333 - DNA, 22 bp, Artificial Sequence
  chemically synthesized
ggctgccagtccaatggcaaag

SEQ ID NO: 1040334 - DNA, 22 bp, Artificial Sequence
  chemically synthesized
gctgccagtccaatggcaaaga

SEQ ID NO: 1040335 - DNA, 22 bp, Artificial Sequence
  chemically synthesized
gcagagttatgtatctttgcca

SEQ ID NO: 1040336 - DNA, 22 bp, Artificial Sequence
  chemically synthesized
ggcagagttatgtatctttgcc

SEQ ID NO: 1040337 - DNA, 22 bp, Artificial Sequence
  chemically synthesized
ccagtccaatggcaaagataca

SEQ ID NO: 1040338 - DNA, 22 bp, Artificial Sequence
  chemically synthesized
gtatcaggtggaggacttggca

SEQ ID NO: 1040339 - DNA, 22 bp, Artificial Sequence
  chemically synthesized
ggtatcaggtggaggacttggc

SEQ ID NO: 1040340 - DNA, 22 bp, Artificial Sequence
  chemically synthesized
gagtcttggtatcaggtggagg

SEQ ID NO: 1040341 - DNA, 22 bp, Artificial Sequence
  chemically synthesized
tgccaagtcctccacctgatac

SEQ ID NO: 1040342 - DNA, 22 bp, Artificial Sequence
  chemically synthesized
agctggagtcttggtatcaggt

SEQ ID NO: 1040343 - DNA, 22 bp, Artificial Sequence
  chemically synthesized
ccaagtcctccacctgatacca

SEQ ID NO: 1040344 - DNA, 22 bp, Artificial Sequence
  chemically synthesized
attcagctggagtcttggtatc

SEQ ID NO: 1040345 - DNA, 22 bp, Artificial Sequence
  chemically synthesized
cattcagctggagtcttggtat

SEQ ID NO: 1040346 - DNA, 22 bp, Artificial Sequence
  chemically synthesized
tcattcagctggagtcttggta

SEQ ID NO: 1040347 - DNA, 22 bp, Artificial Sequence
  chemically synthesized
cacctgataccaagactccagc

SEQ ID NO: 1040348 - DNA, 22 bp, Artificial Sequence
  chemically synthesized
ataccaagactccagctgaatg

SEQ ID NO: 1040349 - DNA, 22 bp, Artificial Sequence
  chemically synthesized
agtaatcagcctttcattcagc

SEQ ID NO: 1040350 - DNA, 22 bp, Artificial Sequence
  chemically synthesized
aagtaatcagcctttcattcag

SEQ ID NO: 1040351 - DNA, 22 bp, Artificial Sequence
  chemically synthesized
cagctgaatgaaaggctgatta

SEQ ID NO: 1040352 - DNA, 22 bp, Artificial Sequence
  chemically synthesized
cccaatgtgaatttaagtaatc

SEQ ID NO: 1040353 - DNA, 22 bp, Artificial Sequence
  chemically synthesized
aatgaaaggctgattacttaaa

SEQ ID NO: 1040354 - DNA, 22 bp, Artificial Sequence
  chemically synthesized
gttgcccaatgtgaatttaagt

SEQ ID NO: 1040355 - DNA, 22 bp, Artificial Sequence
  chemically synthesized
attacttaaattcacattgggc

SEQ ID NO: 1040356 - DNA, 22 bp, Artificial Sequence
  chemically synthesized
cttaaattcacattgggcaacc

SEQ ID NO: 1040357 - DNA, 22 bp, Artificial Sequence
  chemically synthesized
acaaatgtgattggttgcccaa

SEQ ID NO: 1040358 - DNA, 22 bp, Artificial Sequence
  chemically synthesized
aaattcacattgggcaaccaat

SEQ ID NO: 1040359 - DNA, 22 bp, Artificial Sequence
  chemically synthesized
aattcacattgggcaaccaatc

SEQ ID NO: 1040360 - DNA, 22 bp, Artificial Sequence
  chemically synthesized
tgtactaacaaatgtgattggt

SEQ ID NO: 1040361 - DNA, 22 bp, Artificial Sequence
  chemically synthesized
acattgggcaaccaatcacatt

SEQ ID NO: 1040362 - DNA, 22 bp, Artificial Sequence
  chemically synthesized
ctatgtactaacaaatgtgatt

SEQ ID NO: 1040363 - DNA, 22 bp, Artificial Sequence
  chemically synthesized
ggcaaccaatcacatttgttag

SEQ ID NO: 1040364 - DNA, 22 bp, Artificial Sequence
  chemically synthesized
ggcctgctatgtactaacaaat

SEQ ID NO: 1040365 - DNA, 22 bp, Artificial Sequence
  chemically synthesized
gggcctgctatgtactaacaaa

SEQ ID NO: 1040366 - DNA, 22 bp, Artificial Sequence
  chemically synthesized
aagggtttgggcctgctatgta

SEQ ID NO: 1040367 - DNA, 22 bp, Artificial Sequence
  chemically synthesized
aaagggtttgggcctgctatgt

SEQ ID NO: 1040368 - DNA, 22 bp, Artificial Sequence
  chemically synthesized
gttagtacatagcaggcccaaa

SEQ ID NO: 1040369 - DNA, 22 bp, Artificial Sequence
  chemically synthesized
ttagtacatagcaggcccaaac

SEQ ID NO: 1040370 - DNA, 22 bp, Artificial Sequence
  chemically synthesized
tgcatttaaagggtttgggcct

SEQ ID NO: 1040371 - DNA, 22 bp, Artificial Sequence
  chemically synthesized
gtacatagcaggcccaaaccct

SEQ ID NO: 1040372 - DNA, 22 bp, Artificial Sequence
  chemically synthesized
cagctatgcatttaaagggttt

SEQ ID NO: 1040373 - DNA, 22 bp, Artificial Sequence
  chemically synthesized
acagctatgcatttaaagggtt

SEQ ID NO: 1040374 - DNA, 22 bp, Artificial Sequence
  chemically synthesized
catgggtgcttacagctatgca

SEQ ID NO: 1040375 - DNA, 22 bp, Artificial Sequence
  chemically synthesized
tccatgggtgcttacagctatg

SEQ ID NO: 1040376 - DNA, 22 bp, Artificial Sequence
  chemically synthesized
ctccatgggtgcttacagctat

SEQ ID NO: 1040377 - DNA, 22 bp, Artificial Sequence
  chemically synthesized
tctccatgggtgcttacagcta

SEQ ID NO: 1040378 - DNA, 22 bp, Artificial Sequence
  chemically synthesized
ttctccatgggtgcttacagct

SEQ ID NO: 1040379 - DNA, 22 bp, Artificial Sequence
  chemically synthesized
taaatgcatagctgtaagcacc

SEQ ID NO: 1040380 - DNA, 22 bp, Artificial Sequence
  chemically synthesized
aaatgcatagctgtaagcaccc

SEQ ID NO: 1040381 - DNA, 22 bp, Artificial Sequence
  chemically synthesized
aatgcatagctgtaagcaccca

SEQ ID NO: 1040382 - DNA, 22 bp, Artificial Sequence
  chemically synthesized
aatgtttttctccatgggtgct

SEQ ID NO: 1040383 - DNA, 22 bp, Artificial Sequence
  chemically synthesized
gaatgtttttctccatgggtgc

SEQ ID NO: 1040384 - DNA, 22 bp, Artificial Sequence
  chemically synthesized
ccttgaatgtttttctccatgg

SEQ ID NO: 1040385 - DNA, 22 bp, Artificial Sequence
  chemically synthesized
cccttgaatgtttttctccatg

SEQ ID NO: 1040386 - DNA, 22 bp, Artificial Sequence
  chemically synthesized
ttcccttgaatgtttttctcca

SEQ ID NO: 1040387 - DNA, 22 bp, Artificial Sequence
  chemically synthesized
taagcacccatggagaaaaaca

SEQ ID NO: 1040388 - DNA, 22 bp, Artificial Sequence
  chemically synthesized
tctcttcccttgaatgtttttc

SEQ ID NO: 1040389 - DNA, 22 bp, Artificial Sequence
  chemically synthesized
atctcttcccttgaatgttttt

SEQ ID NO: 1040390 - DNA, 22 bp, Artificial Sequence
  chemically synthesized
tatctcttcccttgaatgtttt

SEQ ID NO: 1040391 - DNA, 22 bp, Artificial Sequence
  chemically synthesized
atggggaagatcctttatctct

SEQ ID NO: 1040392 - DNA, 22 bp, Artificial Sequence
  chemically synthesized
aagggaagagataaaggatctt

SEQ ID NO: 1040393 - DNA, 22 bp, Artificial Sequence
  chemically synthesized
tatgctgatggggaagatcctt

SEQ ID NO: 1040394 - DNA, 22 bp, Artificial Sequence
  chemically synthesized
atatgctgatggggaagatcct

SEQ ID NO: 1040395 - DNA, 22 bp, Artificial Sequence
  chemically synthesized
tatatgctgatggggaagatcc

SEQ ID NO: 1040396 - DNA, 22 bp, Artificial Sequence
  chemically synthesized
ttatatgctgatggggaagatc

SEQ ID NO: 1040397 - DNA, 22 bp, Artificial Sequence
  chemically synthesized
gataacttttatatgctgatgg

SEQ ID NO: 1040398 - DNA, 22 bp, Artificial Sequence
  chemically synthesized
ccccatcagcatataaaagtta

SEQ ID NO: 1040399 - DNA, 22 bp, Artificial Sequence
  chemically synthesized
cccatcagcatataaaagttat

SEQ ID NO: 1040400 - DNA, 22 bp, Artificial Sequence
  chemically synthesized
tccagttatggctttgatatgg

SEQ ID NO: 1040401 - DNA, 22 bp, Artificial Sequence
  chemically synthesized
tggctttgatatggtatgcgtg

SEQ ID NO: 1040402 - DNA, 22 bp, Artificial Sequence
  chemically synthesized
tgatatggtatgcgtgtgtttg

SEQ ID NO: 1040403 - DNA, 22 bp, Artificial Sequence
  chemically synthesized
gatatggtatgcgtgtgtttgt

SEQ ID NO: 1040404 - DNA, 22 bp, Artificial Sequence
  chemically synthesized
atatggtatgcgtgtgtttgtg

SEQ ID NO: 1040405 - DNA, 22 bp, Artificial Sequence
  chemically synthesized
agagagtatacatacacacaca

SEQ ID NO: 1040406 - DNA, 22 bp, Artificial Sequence
  chemically synthesized
gtgcgtatgtgtgtgtatgtat

SEQ ID NO: 1040407 - DNA, 22 bp, Artificial Sequence
  chemically synthesized
tgcgtatgtgtgtgtatgtata

SEQ ID NO: 1040408 - DNA, 22 bp, Artificial Sequence
  chemically synthesized
aaatcctcagagagtatacata

SEQ ID NO: 1040409 - DNA, 22 bp, Artificial Sequence
  chemically synthesized
caagctcaaatcctcagagagt

SEQ ID NO: 1040410 - DNA, 22 bp, Artificial Sequence
  chemically synthesized
gcaagctcaaatcctcagagag

SEQ ID NO: 1040411 - DNA, 22 bp, Artificial Sequence
  chemically synthesized
tgcaagctcaaatcctcagaga

SEQ ID NO: 1040412 - DNA, 22 bp, Artificial Sequence
  chemically synthesized
tctgaggatttgagcttgcaaa

SEQ ID NO: 1040413 - DNA, 22 bp, Artificial Sequence
  chemically synthesized
aaatcaggaagctttgcaagct

SEQ ID NO: 1040414 - DNA, 22 bp, Artificial Sequence
  chemically synthesized
tgaggatttgagcttgcaaagc

SEQ ID NO: 1040415 - DNA, 22 bp, Artificial Sequence
  chemically synthesized
aggatttgagcttgcaaagctt

SEQ ID NO: 1040416 - DNA, 22 bp, Artificial Sequence
  chemically synthesized
agattaaaatcaggaagctttg

SEQ ID NO: 1040417 - DNA, 22 bp, Artificial Sequence
  chemically synthesized
gagcttgcaaagcttcctgatt

SEQ ID NO: 1040418 - DNA, 22 bp, Artificial Sequence
  chemically synthesized
agcttgcaaagcttcctgattt

SEQ ID NO: 1040419 - DNA, 22 bp, Artificial Sequence
  chemically synthesized
gcaaagcttcctgattttaatc

SEQ ID NO: 1040420 - DNA, 22 bp, Artificial Sequence
  chemically synthesized
cccagagactcagattaaaatc

SEQ ID NO: 1040421 - DNA, 22 bp, Artificial Sequence
  chemically synthesized
caaagcttcctgattttaatct

SEQ ID NO: 1040422 - DNA, 22 bp, Artificial Sequence
  chemically synthesized
gtagctccccagagactcagat

SEQ ID NO: 1040423 - DNA, 22 bp, Artificial Sequence
  chemically synthesized
cctgattttaatctgagtctct

SEQ ID NO: 1040424 - DNA, 22 bp, Artificial Sequence
  chemically synthesized
ctgattttaatctgagtctctg

SEQ ID NO: 1040425 - DNA, 22 bp, Artificial Sequence
  chemically synthesized
attttaatctgagtctctgggg

SEQ ID NO: 1040426 - DNA, 22 bp, Artificial Sequence
  chemically synthesized
taatctgagtctctggggagct

SEQ ID NO: 1040427 - DNA, 22 bp, Artificial Sequence
  chemically synthesized
caaagaattggtagctccccag

SEQ ID NO: 1040428 - DNA, 22 bp, Artificial Sequence
  chemically synthesized
aatctgagtctctggggagcta

SEQ ID NO: 1040429 - DNA, 22 bp, Artificial Sequence
  chemically synthesized
atctgagtctctggggagctac

SEQ ID NO: 1040430 - DNA, 22 bp, Artificial Sequence
  chemically synthesized
agtctctggggagctaccaatt

SEQ ID NO: 1040431 - DNA, 22 bp, Artificial Sequence
  chemically synthesized
cagcattccaaagaattggtag

SEQ ID NO: 1040432 - DNA, 22 bp, Artificial Sequence
  chemically synthesized
tggggagctaccaattctttgg

SEQ ID NO: 1040433 - DNA, 22 bp, Artificial Sequence
  chemically synthesized
gggagctaccaattctttggaa

SEQ ID NO: 1040434 - DNA, 22 bp, Artificial Sequence
  chemically synthesized
agcaatgctacagcattccaaa

SEQ ID NO: 1040435 - DNA, 22 bp, Artificial Sequence
  chemically synthesized
ccaattctttggaatgctgtag

SEQ ID NO: 1040436 - DNA, 22 bp, Artificial Sequence
  chemically synthesized
atgctgagcaatgctacagcat

SEQ ID NO: 1040437 - DNA, 22 bp, Artificial Sequence
  chemically synthesized
gatgctgagcaatgctacagca

SEQ ID NO: 1040438 - DNA, 22 bp, Artificial Sequence
  chemically synthesized
tttggaatgctgtagcattgct

SEQ ID NO: 1040439 - DNA, 22 bp, Artificial Sequence
  chemically synthesized
tggaatgctgtagcattgctca

SEQ ID NO: 1040440 - DNA, 22 bp, Artificial Sequence
  chemically synthesized
ataacttgatgctgagcaatgc

SEQ ID NO: 1040441 - DNA, 22 bp, Artificial Sequence
  chemically synthesized
ggaatgctgtagcattgctcag

SEQ ID NO: 1040442 - DNA, 22 bp, Artificial Sequence
  chemically synthesized
gaatgctgtagcattgctcagc

SEQ ID NO: 1040443 - DNA, 22 bp, Artificial Sequence
  chemically synthesized
aaaccgttcataacttgatgct

SEQ ID NO: 1040444 - DNA, 22 bp, Artificial Sequence
  chemically synthesized
tagcattgctcagcatcaagtt

SEQ ID NO: 1040445 - DNA, 22 bp, Artificial Sequence
  chemically synthesized
ctaaaaccgttcataacttgat

SEQ ID NO: 1040446 - DNA, 22 bp, Artificial Sequence
  chemically synthesized
ctcagcatcaagttatgaacgg

SEQ ID NO: 1040447 - DNA, 22 bp, Artificial Sequence
  chemically synthesized
agcatcaagttatgaacggttt

SEQ ID NO: 1040448 - DNA, 22 bp, Artificial Sequence
  chemically synthesized
tacagcattgctaaaaccgttc

SEQ ID NO: 1040449 - DNA, 22 bp, Artificial Sequence
  chemically synthesized
tgaacggttttagcaatgctgt

SEQ ID NO: 1040450 - DNA, 22 bp, Artificial Sequence
  chemically synthesized
gtaacatgctgtacagcattgc

SEQ ID NO: 1040451 - DNA, 22 bp, Artificial Sequence
  chemically synthesized
ccgcgttagtaacatgctgtac

SEQ ID NO: 1040452 - DNA, 22 bp, Artificial Sequence
  chemically synthesized
cccgcgttagtaacatgctgta

SEQ ID NO: 1040453 - DNA, 22 bp, Artificial Sequence
  chemically synthesized
tagcaatgctgtacagcatgtt

SEQ ID NO: 1040454 - DNA, 22 bp, Artificial Sequence
  chemically synthesized
tcccgcgttagtaacatgctgt

SEQ ID NO: 1040455 - DNA, 22 bp, Artificial Sequence
  chemically synthesized
agcaatgctgtacagcatgtta

SEQ ID NO: 1040456 - DNA, 22 bp, Artificial Sequence
  chemically synthesized
gcaatgctgtacagcatgttac

SEQ ID NO: 1040457 - DNA, 22 bp, Artificial Sequence
  chemically synthesized
tacagcatgttactaacgcggg

SEQ ID NO: 1040458 - DNA, 22 bp, Artificial Sequence
  chemically synthesized
agatagaaagttttcccgcgtt

SEQ ID NO: 1040459 - DNA, 22 bp, Artificial Sequence
  chemically synthesized
aagatagaaagttttcccgcgt

SEQ ID NO: 1040460 - DNA, 22 bp, Artificial Sequence
  chemically synthesized
taagatagaaagttttcccgcg

SEQ ID NO: 1040461 - DNA, 22 bp, Artificial Sequence
  chemically synthesized
ctttaagatagaaagttttccc

SEQ ID NO: 1040462 - DNA, 22 bp, Artificial Sequence
  chemically synthesized
tcctttaagatagaaagttttc

SEQ ID NO: 1040463 - DNA, 22 bp, Artificial Sequence
  chemically synthesized
ctcctttaagatagaaagtttt

SEQ ID NO: 1040464 - DNA, 22 bp, Artificial Sequence
  chemically synthesized
tctcctttaagatagaaagttt

SEQ ID NO: 1040465 - DNA, 22 bp, Artificial Sequence
  chemically synthesized
ctaacgcgggaaaactttctat

SEQ ID NO: 1040466 - DNA, 22 bp, Artificial Sequence
  chemically synthesized
ttctcctttaagatagaaagtt

SEQ ID NO: 1040467 - DNA, 22 bp, Artificial Sequence
  chemically synthesized
acgcgggaaaactttctatctt

SEQ ID NO: 1040468 - DNA, 22 bp, Artificial Sequence
  chemically synthesized
cttttctcctttaagatagaaa

SEQ ID NO: 1040469 - DNA, 22 bp, Artificial Sequence
  chemically synthesized
gcttttctcctttaagatagaa

SEQ ID NO: 1040470 - DNA, 22 bp, Artificial Sequence
  chemically synthesized
tgcttttctcctttaagataga

SEQ ID NO: 1040471 - DNA, 22 bp, Artificial Sequence
  chemically synthesized
ttgcttttctcctttaagatag

SEQ ID NO: 1040472 - DNA, 22 bp, Artificial Sequence
  chemically synthesized
tttgcttttctcctttaagata

SEQ ID NO: 1040473 - DNA, 22 bp, Artificial Sequence
  chemically synthesized
ctttttgcttttctcctttaag

SEQ ID NO: 1040474 - DNA, 22 bp, Artificial Sequence
  chemically synthesized
gctttttgcttttctcctttaa

SEQ ID NO: 1040475 - DNA, 22 bp, Artificial Sequence
  chemically synthesized
tgctttttgcttttctccttta

SEQ ID NO: 1040476 - DNA, 22 bp, Artificial Sequence
  chemically synthesized
ttgctttttgcttttctccttt

SEQ ID NO: 1040477 - DNA, 22 bp, Artificial Sequence
  chemically synthesized
tctatcttaaaggagaaaagca

SEQ ID NO: 1040478 - DNA, 22 bp, Artificial Sequence
  chemically synthesized
ctatcttaaaggagaaaagcaa

SEQ ID NO: 1040479 - DNA, 22 bp, Artificial Sequence
  chemically synthesized
tatcttaaaggagaaaagcaaa

SEQ ID NO: 1040480 - DNA, 22 bp, Artificial Sequence
  chemically synthesized
tcttaaaggagaaaagcaaaaa

SEQ ID NO: 1040481 - DNA, 22 bp, Artificial Sequence
  chemically synthesized
ccccagtttttgctttttgctt

SEQ ID NO: 1040482 - DNA, 22 bp, Artificial Sequence
  chemically synthesized
aaaggagaaaagcaaaaagcaa

SEQ ID NO: 1040483 - DNA, 22 bp, Artificial Sequence
  chemically synthesized
aaggagaaaagcaaaaagcaaa

SEQ ID NO: 1040484 - DNA, 22 bp, Artificial Sequence
  chemically synthesized
gatatccagggagtgtgacatc

SEQ ID NO: 1040485 - DNA, 22 bp, Artificial Sequence
  chemically synthesized
gggcaggggatgtcacactccc

SEQ ID NO: 1040486 - DNA, 22 bp, Artificial Sequence
  chemically synthesized
tctagatatccagggagtgtga

SEQ ID NO: 1040487 - DNA, 22 bp, Artificial Sequence
  chemically synthesized
ttatctagatatccagggagtg

SEQ ID NO: 1040488 - DNA, 22 bp, Artificial Sequence
  chemically synthesized
cctggatatctagataatagct

SEQ ID NO: 1040489 - DNA, 22 bp, Artificial Sequence
  chemically synthesized
agaatgcaccaaggagctatta

SEQ ID NO: 1040490 - DNA, 22 bp, Artificial Sequence
  chemically synthesized
gatatctagataatagctcctt

SEQ ID NO: 1040491 - DNA, 22 bp, Artificial Sequence
  chemically synthesized
tgagaatgcaccaaggagctat

SEQ ID NO: 1040492 - DNA, 22 bp, Artificial Sequence
  chemically synthesized
tctgagaatgcaccaaggagct

SEQ ID NO: 1040493 - DNA, 22 bp, Artificial Sequence
  chemically synthesized
gataatagctccttggtgcatt

SEQ ID NO: 1040494 - DNA, 22 bp, Artificial Sequence
  chemically synthesized
acagcattctctgagaatgcac

SEQ ID NO: 1040495 - DNA, 22 bp, Artificial Sequence
  chemically synthesized
gacagcattctctgagaatgca

SEQ ID NO: 1040496 - DNA, 22 bp, Artificial Sequence
  chemically synthesized
tgacagcattctctgagaatgc

SEQ ID NO: 1040497 - DNA, 22 bp, Artificial Sequence
  chemically synthesized
cttggtgcattctcagagaatg

SEQ ID NO: 1040498 - DNA, 22 bp, Artificial Sequence
  chemically synthesized
ggtgcattctcagagaatgctg

SEQ ID NO: 1040499 - DNA, 22 bp, Artificial Sequence
  chemically synthesized
gtgcattctcagagaatgctgt

SEQ ID NO: 1040500 - DNA, 22 bp, Artificial Sequence
  chemically synthesized
cagccaattttgacagcattct

SEQ ID NO: 1040501 - DNA, 22 bp, Artificial Sequence
  chemically synthesized
gactccagccaattttgacagc

SEQ ID NO: 1040502 - DNA, 22 bp, Artificial Sequence
  chemically synthesized
tcagagaatgctgtcaaaattg

SEQ ID NO: 1040503 - DNA, 22 bp, Artificial Sequence
  chemically synthesized
ctggactccagccaattttgac

SEQ ID NO: 1040504 - DNA, 22 bp, Artificial Sequence
  chemically synthesized
cctggactccagccaattttga

SEQ ID NO: 1040505 - DNA, 22 bp, Artificial Sequence
  chemically synthesized
agagaatgctgtcaaaattggc

SEQ ID NO: 1040506 - DNA, 22 bp, Artificial Sequence
  chemically synthesized
tcaaaattggctggagtccagg

SEQ ID NO: 1040507 - DNA, 22 bp, Artificial Sequence
  chemically synthesized
aaaaggatgtatttcctggact

SEQ ID NO: 1040508 - DNA, 22 bp, Artificial Sequence
  chemically synthesized
aaaaaggatgtatttcctggac

SEQ ID NO: 1040509 - DNA, 22 bp, Artificial Sequence
  chemically synthesized
taaaaaggatgtatttcctgga

SEQ ID NO: 1040510 - DNA, 22 bp, Artificial Sequence
  chemically synthesized
gctggagtccaggaaatacatc

SEQ ID NO: 1040511 - DNA, 22 bp, Artificial Sequence
  chemically synthesized
gagtccaggaaatacatccttt

SEQ ID NO: 1040512 - DNA, 22 bp, Artificial Sequence
  chemically synthesized
aggacacgaatatgtgcaggga

SEQ ID NO: 1040513 - DNA, 22 bp, Artificial Sequence
  chemically synthesized
gaggacacgaatatgtgcaggg

SEQ ID NO: 1040514 - DNA, 22 bp, Artificial Sequence
  chemically synthesized
tttaaagtccctgcacatattc

SEQ ID NO: 1040515 - DNA, 22 bp, Artificial Sequence
  chemically synthesized
ttaaagtccctgcacatattcg

SEQ ID NO: 1040516 - DNA, 22 bp, Artificial Sequence
  chemically synthesized
taaagtccctgcacatattcgt

SEQ ID NO: 1040517 - DNA, 22 bp, Artificial Sequence
  chemically synthesized
aaagtccctgcacatattcgtg

SEQ ID NO: 1040518 - DNA, 22 bp, Artificial Sequence
  chemically synthesized
aagtccctgcacatattcgtgt

SEQ ID NO: 1040519 - DNA, 22 bp, Artificial Sequence
  chemically synthesized
tgtgcagtgccttgaggacacg

SEQ ID NO: 1040520 - DNA, 22 bp, Artificial Sequence
  chemically synthesized
tgtgtgcagtgccttgaggaca

SEQ ID NO: 1040521 - DNA, 22 bp, Artificial Sequence
  chemically synthesized
ctgtgtgcagtgccttgaggac

SEQ ID NO: 1040522 - DNA, 22 bp, Artificial Sequence
  chemically synthesized
cacatattcgtgtcctcaaggc

SEQ ID NO: 1040523 - DNA, 22 bp, Artificial Sequence
  chemically synthesized
tctgtgtgcagtgccttgagga

SEQ ID NO: 1040524 - DNA, 22 bp, Artificial Sequence
  chemically synthesized
ttctgtgtgcagtgccttgagg

SEQ ID NO: 1040525 - DNA, 22 bp, Artificial Sequence
  chemically synthesized
gtgtcctcaaggcactgcacac

SEQ ID NO: 1040526 - DNA, 22 bp, Artificial Sequence
  chemically synthesized
gtgcacataccatttttctgtg

SEQ ID NO: 1040527 - DNA, 22 bp, Artificial Sequence
  chemically synthesized
aaggcactgcacacagaaaaat

SEQ ID NO: 1040528 - DNA, 22 bp, Artificial Sequence
  chemically synthesized
ggtgcacataccatttttctgt

SEQ ID NO: 1040529 - DNA, 22 bp, Artificial Sequence
  chemically synthesized
tggtgcacataccatttttctg

SEQ ID NO: 1040530 - DNA, 22 bp, Artificial Sequence
  chemically synthesized
tttggtgcacataccatttttc

SEQ ID NO: 1040531 - DNA, 22 bp, Artificial Sequence
  chemically synthesized
ctttggtgcacataccattttt

SEQ ID NO: 1040532 - DNA, 22 bp, Artificial Sequence
  chemically synthesized
tctttggtgcacataccatttt

SEQ ID NO: 1040533 - DNA, 22 bp, Artificial Sequence
  chemically synthesized
cacacagaaaaatggtatgtgc

SEQ ID NO: 1040534 - DNA, 22 bp, Artificial Sequence
  chemically synthesized
cagcattttctttggtgcacat

SEQ ID NO: 1040535 - DNA, 22 bp, Artificial Sequence
  chemically synthesized
tggaaagtgctacagcattttc

SEQ ID NO: 1040536 - DNA, 22 bp, Artificial Sequence
  chemically synthesized
aactatggaaagtgctacagca

SEQ ID NO: 1040537 - DNA, 22 bp, Artificial Sequence
  chemically synthesized
aaactatggaaagtgctacagc

SEQ ID NO: 1040538 - DNA, 22 bp, Artificial Sequence
  chemically synthesized
taaactatggaaagtgctacag

SEQ ID NO: 1040539 - DNA, 22 bp, Artificial Sequence
  chemically synthesized
actttaaactatggaaagtgct

SEQ ID NO: 1040540 - DNA, 22 bp, Artificial Sequence
  chemically synthesized
tgactttaaactatggaaagtg

SEQ ID NO: 1040541 - DNA, 22 bp, Artificial Sequence
  chemically synthesized
atctctgactttaaactatgga

SEQ ID NO: 1040542 - DNA, 22 bp, Artificial Sequence
  chemically synthesized
tagcactttccatagtttaaag

SEQ ID NO: 1040543 - DNA, 22 bp, Artificial Sequence
  chemically synthesized
tcagagatctcatctctgactt

SEQ ID NO: 1040544 - DNA, 22 bp, Artificial Sequence
  chemically synthesized
tccatagtttaaagtcagagat

SEQ ID NO: 1040545 - DNA, 22 bp, Artificial Sequence
  chemically synthesized
ccatagtttaaagtcagagatg

SEQ ID NO: 1040546 - DNA, 22 bp, Artificial Sequence
  chemically synthesized
catagtttaaagtcagagatga

SEQ ID NO: 1040547 - DNA, 22 bp, Artificial Sequence
  chemically synthesized
aaagtcagagatgagatctctg

SEQ ID NO: 1040548 - DNA, 22 bp, Artificial Sequence
  chemically synthesized
aagtcagagatgagatctctga

SEQ ID NO: 1040549 - DNA, 22 bp, Artificial Sequence
  chemically synthesized
aaatagtaaaatactatcagag

SEQ ID NO: 1040550 - DNA, 22 bp, Artificial Sequence
  chemically synthesized
gacaaactaaaatagtaaaata

SEQ ID NO: 1040551 - DNA, 22 bp, Artificial Sequence
  chemically synthesized
tagacaaactaaaatagtaaaa

SEQ ID NO: 1040552 - DNA, 22 bp, Artificial Sequence
  chemically synthesized
ctagacaaactaaaatagtaaa

SEQ ID NO: 1040553 - DNA, 22 bp, Artificial Sequence
  chemically synthesized
tgatagtattttactattttag

SEQ ID NO: 1040554 - DNA, 22 bp, Artificial Sequence
  chemically synthesized
tttctagacaaactaaaatagt

SEQ ID NO: 1040555 - DNA, 22 bp, Artificial Sequence
  chemically synthesized
atttctagacaaactaaaatag

SEQ ID NO: 1040556 - DNA, 22 bp, Artificial Sequence
  chemically synthesized
atagtattttactattttagtt

SEQ ID NO: 1040557 - DNA, 22 bp, Artificial Sequence
  chemically synthesized
tactattttagtttgtctagaa

SEQ ID NO: 1040558 - DNA, 22 bp, Artificial Sequence
  chemically synthesized
actattttagtttgtctagaaa

SEQ ID NO: 1040559 - DNA, 22 bp, Artificial Sequence
  chemically synthesized
ctattttagtttgtctagaaat

SEQ ID NO: 1040560 - DNA, 22 bp, Artificial Sequence
  chemically synthesized
taaagatcacttatttctagac

SEQ ID NO: 1040561 - DNA, 22 bp, Artificial Sequence
  chemically synthesized
ttttagtttgtctagaaataag

SEQ ID NO: 1040562 - DNA, 22 bp, Artificial Sequence
  chemically synthesized
tagtttgtctagaaataagtga

SEQ ID NO: 1040563 - DNA, 22 bp, Artificial Sequence
  chemically synthesized
agtttgtctagaaataagtgat

SEQ ID NO: 1040564 - DNA, 22 bp, Artificial Sequence
  chemically synthesized
gtttgtctagaaataagtgatc

SEQ ID NO: 1040565 - DNA, 22 bp, Artificial Sequence
  chemically synthesized
gtctagaaataagtgatcttta

SEQ ID NO: 1040566 - DNA, 22 bp, Artificial Sequence
  chemically synthesized
tctagaaataagtgatctttat

SEQ ID NO: 1040567 - DNA, 22 bp, Artificial Sequence
  chemically synthesized
gagggtcagaaactataaagat

SEQ ID NO: 1040568 - DNA, 22 bp, Artificial Sequence
  chemically synthesized
agagggtcagaaactataaaga

SEQ ID NO: 1040569 - DNA, 22 bp, Artificial Sequence
  chemically synthesized
gaaataagtgatctttatagtt

SEQ ID NO: 1040570 - DNA, 22 bp, Artificial Sequence
  chemically synthesized
tagagggtcagaaactataaag

SEQ ID NO: 1040571 - DNA, 22 bp, Artificial Sequence
  chemically synthesized
ttagagggtcagaaactataaa

SEQ ID NO: 1040572 - DNA, 22 bp, Artificial Sequence
  chemically synthesized
tttagagggtcagaaactataa

SEQ ID NO: 1040573 - DNA, 22 bp, Artificial Sequence
  chemically synthesized
ctttttagagggtcagaaacta

SEQ ID NO: 1040574 - DNA, 22 bp, Artificial Sequence
  chemically synthesized
cctttttagagggtcagaaact

SEQ ID NO: 1040575 - DNA, 22 bp, Artificial Sequence
  chemically synthesized
tggcttcctttttagagggtca

SEQ ID NO: 1040576 - DNA, 22 bp, Artificial Sequence
  chemically synthesized
tatagtttctgaccctctaaaa

SEQ ID NO: 1040577 - DNA, 22 bp, Artificial Sequence
  chemically synthesized
atagtttctgaccctctaaaaa

SEQ ID NO: 1040578 - DNA, 22 bp, Artificial Sequence
  chemically synthesized
tagtttctgaccctctaaaaag

SEQ ID NO: 1040579 - DNA, 22 bp, Artificial Sequence
  chemically synthesized
caagggactatggcttcctttt

SEQ ID NO: 1040580 - DNA, 22 bp, Artificial Sequence
  chemically synthesized
ctgaccctctaaaaaggaagcc

SEQ ID NO: 1040581 - DNA, 22 bp, Artificial Sequence
  chemically synthesized
tgaccctctaaaaaggaagcca

SEQ ID NO: 1040582 - DNA, 22 bp, Artificial Sequence
  chemically synthesized
accctctaaaaaggaagccata

SEQ ID NO: 1040583 - DNA, 22 bp, Artificial Sequence
  chemically synthesized
taaaaaggaagccatagtccct

SEQ ID NO: 1040584 - DNA, 22 bp, Artificial Sequence
  chemically synthesized
aaaaggaagccatagtcccttg

SEQ ID NO: 1040585 - DNA, 22 bp, Artificial Sequence
  chemically synthesized
tatcgccatagcaactacaagg

SEQ ID NO: 1040586 - DNA, 22 bp, Artificial Sequence
  chemically synthesized
atatcgccatagcaactacaag

SEQ ID NO: 1040587 - DNA, 22 bp, Artificial Sequence
  chemically synthesized
gggatgtttatatcgccatagc

SEQ ID NO: 1040588 - DNA, 22 bp, Artificial Sequence
  chemically synthesized
tagggatgtttatatcgccata

SEQ ID NO: 1040589 - DNA, 22 bp, Artificial Sequence
  chemically synthesized
gtagttgctatggcgatataaa

SEQ ID NO: 1040590 - DNA, 22 bp, Artificial Sequence
  chemically synthesized
tagttgctatggcgatataaac

SEQ ID NO: 1040591 - DNA, 22 bp, Artificial Sequence
  chemically synthesized
tagtgattctagggatgtttat

SEQ ID NO: 1040592 - DNA, 22 bp, Artificial Sequence
  chemically synthesized
ctatggcgatataaacatccct

SEQ ID NO: 1040593 - DNA, 22 bp, Artificial Sequence
  chemically synthesized
tatagtgattctagggatgttt

SEQ ID NO: 1040594 - DNA, 22 bp, Artificial Sequence
  chemically synthesized
tggcgatataaacatccctaga

SEQ ID NO: 1040595 - DNA, 22 bp, Artificial Sequence
  chemically synthesized
tattctatagtgattctaggga

SEQ ID NO: 1040596 - DNA, 22 bp, Artificial Sequence
  chemically synthesized
gaatcactatagaatatagcat

SEQ ID NO: 1040597 - DNA, 22 bp, Artificial Sequence
  chemically synthesized
agggagagaaatagaaatgcta

SEQ ID NO: 1040598 - DNA, 22 bp, Artificial Sequence
  chemically synthesized
ttcagggagagaaatagaaatg

SEQ ID NO: 1040599 - DNA, 22 bp, Artificial Sequence
  chemically synthesized
tagaatatagcatttctatttc

SEQ ID NO: 1040600 - DNA, 22 bp, Artificial Sequence
  chemically synthesized
ctatttctctccctgaatagtt

SEQ ID NO: 1040601 - DNA, 22 bp, Artificial Sequence
  chemically synthesized
tatttctctccctgaatagttc

SEQ ID NO: 1040602 - DNA, 22 bp, Artificial Sequence
  chemically synthesized
agataagataaggaactattca

SEQ ID NO: 1040603 - DNA, 22 bp, Artificial Sequence
  chemically synthesized
cagataagataaggaactattc

SEQ ID NO: 1040604 - DNA, 22 bp, Artificial Sequence
  chemically synthesized
tttctctccctgaatagttcct

SEQ ID NO: 1040605 - DNA, 22 bp, Artificial Sequence
  chemically synthesized
tcagataagataaggaactatt

SEQ ID NO: 1040606 - DNA, 22 bp, Artificial Sequence
  chemically synthesized
ctctccctgaatagttccttat

SEQ ID NO: 1040607 - DNA, 22 bp, Artificial Sequence
  chemically synthesized
tctccctgaatagttccttatc

SEQ ID NO: 1040608 - DNA, 22 bp, Artificial Sequence
  chemically synthesized
tccctgaatagttccttatctt

SEQ ID NO: 1040609 - DNA, 22 bp, Artificial Sequence
  chemically synthesized
cctgaatagttccttatcttat

SEQ ID NO: 1040610 - DNA, 22 bp, Artificial Sequence
  chemically synthesized
acatcatattttcagataagat

SEQ ID NO: 1040611 - DNA, 22 bp, Artificial Sequence
  chemically synthesized
aatagttccttatcttatctga

SEQ ID NO: 1040612 - DNA, 22 bp, Artificial Sequence
  chemically synthesized
gacatcatattttcagataaga

SEQ ID NO: 1040613 - DNA, 22 bp, Artificial Sequence
  chemically synthesized
tgacatcatattttcagataag

SEQ ID NO: 1040614 - DNA, 22 bp, Artificial Sequence
  chemically synthesized
tcattttgacatcatattttca

SEQ ID NO: 1040615 - DNA, 22 bp, Artificial Sequence
  chemically synthesized
cttatcttatctgaaaatatga

SEQ ID NO: 1040616 - DNA, 22 bp, Artificial Sequence
  chemically synthesized
atcattttgacatcatattttc

SEQ ID NO: 1040617 - DNA, 22 bp, Artificial Sequence
  chemically synthesized
tatcattttgacatcatatttt

SEQ ID NO: 1040618 - DNA, 22 bp, Artificial Sequence
  chemically synthesized
atcttatctgaaaatatgatgt

SEQ ID NO: 1040619 - DNA, 22 bp, Artificial Sequence
  chemically synthesized
tcttatctgaaaatatgatgtc

SEQ ID NO: 1040620 - DNA, 22 bp, Artificial Sequence
  chemically synthesized
gtactttatcattttgacatca

SEQ ID NO: 1040621 - DNA, 22 bp, Artificial Sequence
  chemically synthesized
atctgaaaatatgatgtcaaaa

SEQ ID NO: 1040622 - DNA, 22 bp, Artificial Sequence
  chemically synthesized
tctgaaaatatgatgtcaaaat

SEQ ID NO: 1040623 - DNA, 22 bp, Artificial Sequence
  chemically synthesized
aaaatatgatgtcaaaatgata

SEQ ID NO: 1040624 - DNA, 22 bp, Artificial Sequence
  chemically synthesized
aaaagttggtactttatcattt

SEQ ID NO: 1040625 - DNA, 22 bp, Artificial Sequence
  chemically synthesized
actaaaaagttggtactttatc

SEQ ID NO: 1040626 - DNA, 22 bp, Artificial Sequence
  chemically synthesized
gactaaaaagttggtactttat

SEQ ID NO: 1040627 - DNA, 22 bp, Artificial Sequence
  chemically synthesized
agaagggatttgactaaaaagt

SEQ ID NO: 1040628 - DNA, 22 bp, Artificial Sequence
  chemically synthesized
tttagtcaaatcccttcttaat

SEQ ID NO: 1040629 - DNA, 22 bp, Artificial Sequence
  chemically synthesized
ttagtcaaatcccttcttaatt

SEQ ID NO: 1040630 - DNA, 22 bp, Artificial Sequence
  chemically synthesized
tagtcaaatcccttcttaattt

SEQ ID NO: 1040631 - DNA, 22 bp, Artificial Sequence
  chemically synthesized
agtcaaatcccttcttaatttt

SEQ ID NO: 1040632 - DNA, 22 bp, Artificial Sequence
  chemically synthesized
gtcaaatcccttcttaattttg

SEQ ID NO: 1040633 - DNA, 22 bp, Artificial Sequence
  chemically synthesized
ataggggcatgtcaaaattaag

SEQ ID NO: 1040634 - DNA, 22 bp, Artificial Sequence
  chemically synthesized
cttaattttgacatgcccctat

SEQ ID NO: 1040635 - DNA, 22 bp, Artificial Sequence
  chemically synthesized
ttaattttgacatgcccctatg

SEQ ID NO: 1040636 - DNA, 22 bp, Artificial Sequence
  chemically synthesized
aattttgacatgcccctatgaa

SEQ ID NO: 1040637 - DNA, 22 bp, Artificial Sequence
  chemically synthesized
attttgacatgcccctatgaat

SEQ ID NO: 1040638 - DNA, 22 bp, Artificial Sequence
  chemically synthesized
tgacatgcccctatgaattgac

SEQ ID NO: 1040639 - DNA, 22 bp, Artificial Sequence
  chemically synthesized
gacatgcccctatgaattgacc

SEQ ID NO: 1040640 - DNA, 22 bp, Artificial Sequence
  chemically synthesized
acatgcccctatgaattgacca

SEQ ID NO: 1040641 - DNA, 22 bp, Artificial Sequence
  chemically synthesized
agcggaatagtgaagtggtcaa

SEQ ID NO: 1040642 - DNA, 22 bp, Artificial Sequence
  chemically synthesized
cagcggaatagtgaagtggtca

SEQ ID NO: 1040643 - DNA, 22 bp, Artificial Sequence
  chemically synthesized
tgaattgaccacttcactattc

SEQ ID NO: 1040644 - DNA, 22 bp, Artificial Sequence
  chemically synthesized
cagaatttcagcggaatagtga

SEQ ID NO: 1040645 - DNA, 22 bp, Artificial Sequence
  chemically synthesized
acagaatttcagcggaatagtg

SEQ ID NO: 1040646 - DNA, 22 bp, Artificial Sequence
  chemically synthesized
accacttcactattccgctgaa

SEQ ID NO: 1040647 - DNA, 22 bp, Artificial Sequence
  chemically synthesized
cactattccgctgaaattctgt

SEQ ID NO: 1040648 - DNA, 22 bp, Artificial Sequence
  chemically synthesized
actattccgctgaaattctgta

SEQ ID NO: 1040649 - DNA, 22 bp, Artificial Sequence
  chemically synthesized
ttccgctgaaattctgtaagat

SEQ ID NO: 1040650 - DNA, 22 bp, Artificial Sequence
  chemically synthesized
cgctgaaattctgtaagatgtt

SEQ ID NO: 1040651 - DNA, 22 bp, Artificial Sequence
  chemically synthesized
aaattctgtaagatgtttattt

SEQ ID NO: 1040652 - DNA, 22 bp, Artificial Sequence
  chemically synthesized
cagaaagagtggccaaaaataa

SEQ ID NO: 1040653 - DNA, 22 bp, Artificial Sequence
  chemically synthesized
gcagaaagagtggccaaaaata

SEQ ID NO: 1040654 - DNA, 22 bp, Artificial Sequence
  chemically synthesized
tgtaagatgtttatttttggcc

SEQ ID NO: 1040655 - DNA, 22 bp, Artificial Sequence
  chemically synthesized
tgcagaaagagtggccaaaaat

SEQ ID NO: 1040656 - DNA, 22 bp, Artificial Sequence
  chemically synthesized
ttgcagaaagagtggccaaaaa

SEQ ID NO: 1040657 - DNA, 22 bp, Artificial Sequence
  chemically synthesized
taagatgtttatttttggccac

SEQ ID NO: 1040658 - DNA, 22 bp, Artificial Sequence
  chemically synthesized
cttttgcagaaagagtggccaa

SEQ ID NO: 1040659 - DNA, 22 bp, Artificial Sequence
  chemically synthesized
ccttttgcagaaagagtggcca

SEQ ID NO: 1040660 - DNA, 22 bp, Artificial Sequence
  chemically synthesized
gaatttccttttgcagaaagag

SEQ ID NO: 1040661 - DNA, 22 bp, Artificial Sequence
  chemically synthesized
atttttggccactctttctgca

SEQ ID NO: 1040662 - DNA, 22 bp, Artificial Sequence
  chemically synthesized
agaatttccttttgcagaaaga

SEQ ID NO: 1040663 - DNA, 22 bp, Artificial Sequence
  chemically synthesized
tttttggccactctttctgcaa

SEQ ID NO: 1040664 - DNA, 22 bp, Artificial Sequence
  chemically synthesized
ttggccactctttctgcaaaag

SEQ ID NO: 1040665 - DNA, 22 bp, Artificial Sequence
  chemically synthesized
tggccactctttctgcaaaagg

SEQ ID NO: 1040666 - DNA, 22 bp, Artificial Sequence
  chemically synthesized
ggccactctttctgcaaaagga

SEQ ID NO: 1040667 - DNA, 22 bp, Artificial Sequence
  chemically synthesized
gccactctttctgcaaaaggaa

SEQ ID NO: 1040668 - DNA, 22 bp, Artificial Sequence
  chemically synthesized
tatgtatatttagaatttcctt

SEQ ID NO: 1040669 - DNA, 22 bp, Artificial Sequence
  chemically synthesized
gtatgtatatttagaatttcct

SEQ ID NO: 1040670 - DNA, 22 bp, Artificial Sequence
  chemically synthesized
tttctgcaaaaggaaattctaa

SEQ ID NO: 1040671 - DNA, 22 bp, Artificial Sequence
  chemically synthesized
tctgcaaaaggaaattctaaat

SEQ ID NO: 1040672 - DNA, 22 bp, Artificial Sequence
  chemically synthesized
ctgcaaaaggaaattctaaata

SEQ ID NO: 1040673 - DNA, 22 bp, Artificial Sequence
  chemically synthesized
catttgtatgtatatttagaat

SEQ ID NO: 1040674 - DNA, 22 bp, Artificial Sequence
  chemically synthesized
tgcaaaaggaaattctaaatat

SEQ ID NO: 1040675 - DNA, 22 bp, Artificial Sequence
  chemically synthesized
caaaaggaaattctaaatatac

SEQ ID NO: 1040676 - DNA, 22 bp, Artificial Sequence
  chemically synthesized
aaattccatttgtatgtatatt

SEQ ID NO: 1040677 - DNA, 22 bp, Artificial Sequence
  chemically synthesized
agaaattaaaattccatttgta

SEQ ID NO: 1040678 - DNA, 22 bp, Artificial Sequence
  chemically synthesized
cagaaattaaaattccatttgt

SEQ ID NO: 1040679 - DNA, 22 bp, Artificial Sequence
  chemically synthesized
taaatatacatacaaatggaat

SEQ ID NO: 1040680 - DNA, 22 bp, Artificial Sequence
  chemically synthesized
tcagaaattaaaattccatttg

SEQ ID NO: 1040681 - DNA, 22 bp, Artificial Sequence
  chemically synthesized
aatatacatacaaatggaattt

SEQ ID NO: 1040682 - DNA, 22 bp, Artificial Sequence
  chemically synthesized
gtgtacagatgcctttcagaaa

SEQ ID NO: 1040683 - DNA, 22 bp, Artificial Sequence
  chemically synthesized
taatttctgaaaggcatctgta

SEQ ID NO: 1040684 - DNA, 22 bp, Artificial Sequence
  chemically synthesized
tataaattcgtgtacagatgcc

SEQ ID NO: 1040685 - DNA, 22 bp, Artificial Sequence
  chemically synthesized
aatttctgaaaggcatctgtac

SEQ ID NO: 1040686 - DNA, 22 bp, Artificial Sequence
  chemically synthesized
atttctgaaaggcatctgtaca

SEQ ID NO: 1040687 - DNA, 22 bp, Artificial Sequence
  chemically synthesized
ctgaaaggcatctgtacacgaa

SEQ ID NO: 1040688 - DNA, 22 bp, Artificial Sequence
  chemically synthesized
gagttgtataaattcgtgtaca

SEQ ID NO: 1040689 - DNA, 22 bp, Artificial Sequence
  chemically synthesized
tgaaaggcatctgtacacgaat

SEQ ID NO: 1040690 - DNA, 22 bp, Artificial Sequence
  chemically synthesized
aaaggcatctgtacacgaattt

SEQ ID NO: 1040691 - DNA, 22 bp, Artificial Sequence
  chemically synthesized
aggactcgagttgtataaattc

SEQ ID NO: 1040692 - DNA, 22 bp, Artificial Sequence
  chemically synthesized
tacacgaatttatacaactcga

SEQ ID NO: 1040693 - DNA, 22 bp, Artificial Sequence
  chemically synthesized
aaatattaaggactcgagttgt

SEQ ID NO: 1040694 - DNA, 22 bp, Artificial Sequence
  chemically synthesized
aaaatattaaggactcgagttg

SEQ ID NO: 1040695 - DNA, 22 bp, Artificial Sequence
  chemically synthesized
taaaatattaaggactcgagtt

SEQ ID NO: 1040696 - DNA, 22 bp, Artificial Sequence
  chemically synthesized
ttttaaaatattaaggactcga

SEQ ID NO: 1040697 - DNA, 22 bp, Artificial Sequence
  chemically synthesized
atacaactcgagtccttaatat

SEQ ID NO: 1040698 - DNA, 22 bp, Artificial Sequence
  chemically synthesized
tacaactcgagtccttaatatt

SEQ ID NO: 1040699 - DNA, 22 bp, Artificial Sequence
  chemically synthesized
gagtccttaatattttaaaata

SEQ ID NO: 1040700 - DNA, 22 bp, Artificial Sequence
  chemically synthesized
aatattttaaaataggatattt

SEQ ID NO: 1040701 - DNA, 22 bp, Artificial Sequence
  chemically synthesized
atattttaaaataggatatttg

SEQ ID NO: 1040702 - DNA, 22 bp, Artificial Sequence
  chemically synthesized
tgaatcagagatgcaaatatcc

SEQ ID NO: 1040703 - DNA, 22 bp, Artificial Sequence
  chemically synthesized
taaaataggatatttgcatctc

SEQ ID NO: 1040704 - DNA, 22 bp, Artificial Sequence
  chemically synthesized
aaaataggatatttgcatctct

SEQ ID NO: 1040705 - DNA, 22 bp, Artificial Sequence
  chemically synthesized
aaataggatatttgcatctctg

SEQ ID NO: 1040706 - DNA, 22 bp, Artificial Sequence
  chemically synthesized
gagactgtgaatcagagatgca

SEQ ID NO: 1040707 - DNA, 22 bp, Artificial Sequence
  chemically synthesized
ttggagactgtgaatcagagat

SEQ ID NO: 1040708 - DNA, 22 bp, Artificial Sequence
  chemically synthesized
attggagactgtgaatcagaga

SEQ ID NO: 1040709 - DNA, 22 bp, Artificial Sequence
  chemically synthesized
acttattggagactgtgaatca

SEQ ID NO: 1040710 - DNA, 22 bp, Artificial Sequence
  chemically synthesized
aacttattggagactgtgaatc

SEQ ID NO: 1040711 - DNA, 22 bp, Artificial Sequence
  chemically synthesized
taacttattggagactgtgaat

SEQ ID NO: 1040712 - DNA, 22 bp, Artificial Sequence
  chemically synthesized
tttaacttattggagactgtga

SEQ ID NO: 1040713 - DNA, 22 bp, Artificial Sequence
  chemically synthesized
gcatctctgattcacagtctcc

SEQ ID NO: 1040714 - DNA, 22 bp, Artificial Sequence
  chemically synthesized
ctttaacttattggagactgtg

SEQ ID NO: 1040715 - DNA, 22 bp, Artificial Sequence
  chemically synthesized
catctctgattcacagtctcca

SEQ ID NO: 1040716 - DNA, 22 bp, Artificial Sequence
  chemically synthesized
tgattcacagtctccaataagt

SEQ ID NO: 1040717 - DNA, 22 bp, Artificial Sequence
  chemically synthesized
attcacagtctccaataagtta

SEQ ID NO: 1040718 - DNA, 22 bp, Artificial Sequence
  chemically synthesized
acagtctccaataagttaaaga

SEQ ID NO: 1040719 - DNA, 22 bp, Artificial Sequence
  chemically synthesized
caataagttaaagaagaccctg

SEQ ID NO: 1040720 - DNA, 22 bp, Artificial Sequence
  chemically synthesized
acagtgcataatcagggtcttc

SEQ ID NO: 1040721 - DNA, 22 bp, Artificial Sequence
  chemically synthesized
ttcacagtgcataatcagggtc

SEQ ID NO: 1040722 - DNA, 22 bp, Artificial Sequence
  chemically synthesized
tattcacagtgcataatcaggg

SEQ ID NO: 1040723 - DNA, 22 bp, Artificial Sequence
  chemically synthesized
tctattcacagtgcataatcag

SEQ ID NO: 1040724 - DNA, 22 bp, Artificial Sequence
  chemically synthesized
ctctattcacagtgcataatca

SEQ ID NO: 1040725 - DNA, 22 bp, Artificial Sequence
  chemically synthesized
tctctattcacagtgcataatc

SEQ ID NO: 1040726 - DNA, 22 bp, Artificial Sequence
  chemically synthesized
aagaagaccctgattatgcact

SEQ ID NO: 1040727 - DNA, 22 bp, Artificial Sequence
  chemically synthesized
ttctctattcacagtgcataat

SEQ ID NO: 1040728 - DNA, 22 bp, Artificial Sequence
  chemically synthesized
atttttctctattcacagtgca

SEQ ID NO: 1040729 - DNA, 22 bp, Artificial Sequence
  chemically synthesized
tctaatttttctctattcacag

SEQ ID NO: 1040730 - DNA, 22 bp, Artificial Sequence
  chemically synthesized
attatgcactgtgaatagagaa

SEQ ID NO: 1040731 - DNA, 22 bp, Artificial Sequence
  chemically synthesized
tgctatctaatttttctctatt

SEQ ID NO: 1040732 - DNA, 22 bp, Artificial Sequence
  chemically synthesized
tgcactgtgaatagagaaaaat

SEQ ID NO: 1040733 - DNA, 22 bp, Artificial Sequence
  chemically synthesized
ctgtgctatctaatttttctct

SEQ ID NO: 1040734 - DNA, 22 bp, Artificial Sequence
  chemically synthesized
tgaatagagaaaaattagatag

SEQ ID NO: 1040735 - DNA, 22 bp, Artificial Sequence
  chemically synthesized
taaaagttactgtgctatctaa

SEQ ID NO: 1040736 - DNA, 22 bp, Artificial Sequence
  chemically synthesized
ccggttgtaaaagttactgtgc

SEQ ID NO: 1040737 - DNA, 22 bp, Artificial Sequence
  chemically synthesized
atctgccggttgtaaaagttac

SEQ ID NO: 1040738 - DNA, 22 bp, Artificial Sequence
  chemically synthesized
catctgccggttgtaaaagtta

SEQ ID NO: 1040739 - DNA, 22 bp, Artificial Sequence
  chemically synthesized
gatagcacagtaacttttacaa

SEQ ID NO: 1040740 - DNA, 22 bp, Artificial Sequence
  chemically synthesized
gatttcatctgccggttgtaaa

SEQ ID NO: 1040741 - DNA, 22 bp, Artificial Sequence
  chemically synthesized
ggtatctggatttcatctgccg

SEQ ID NO: 1040742 - DNA, 22 bp, Artificial Sequence
  chemically synthesized
aggtatctggatttcatctgcc

SEQ ID NO: 1040743 - DNA, 22 bp, Artificial Sequence
  chemically synthesized
taggtatctggatttcatctgc

SEQ ID NO: 1040744 - DNA, 22 bp, Artificial Sequence
  chemically synthesized
ttacaaccggcagatgaaatcc

SEQ ID NO: 1040745 - DNA, 22 bp, Artificial Sequence
  chemically synthesized
ctttaggtatctggatttcatc

SEQ ID NO: 1040746 - DNA, 22 bp, Artificial Sequence
  chemically synthesized
tacaaccggcagatgaaatcca

SEQ ID NO: 1040747 - DNA, 22 bp, Artificial Sequence
  chemically synthesized
actttaggtatctggatttcat

SEQ ID NO: 1040748 - DNA, 22 bp, Artificial Sequence
  chemically synthesized
acaaccggcagatgaaatccag

SEQ ID NO: 1040749 - DNA, 22 bp, Artificial Sequence
  chemically synthesized
caaccggcagatgaaatccaga

SEQ ID NO: 1040750 - DNA, 22 bp, Artificial Sequence
  chemically synthesized
cttactttaggtatctggattt

SEQ ID NO: 1040751 - DNA, 22 bp, Artificial Sequence
  chemically synthesized
ccttactttaggtatctggatt

SEQ ID NO: 1040752 - DNA, 22 bp, Artificial Sequence
  chemically synthesized
tccttactttaggtatctggat

SEQ ID NO: 1040753 - DNA, 22 bp, Artificial Sequence
  chemically synthesized
ttccttactttaggtatctgga

SEQ ID NO: 1040754 - DNA, 22 bp, Artificial Sequence
  chemically synthesized
cttttccttactttaggtatct

SEQ ID NO: 1040755 - DNA, 22 bp, Artificial Sequence
  chemically synthesized
tgcttttccttactttaggtat

SEQ ID NO: 1040756 - DNA, 22 bp, Artificial Sequence
  chemically synthesized
ctgcttttccttactttaggta

SEQ ID NO: 1040757 - DNA, 22 bp, Artificial Sequence
  chemically synthesized
tagatttctgcttttccttact

SEQ ID NO: 1040758 - DNA, 22 bp, Artificial Sequence
  chemically synthesized
atagatttctgcttttccttac

SEQ ID NO: 1040759 - DNA, 22 bp, Artificial Sequence
  chemically synthesized
aagtaaggaaaagcagaaatct

SEQ ID NO: 1040760 - DNA, 22 bp, Artificial Sequence
  chemically synthesized
aagccacatggcttatagattt

SEQ ID NO: 1040761 - DNA, 22 bp, Artificial Sequence
  chemically synthesized
aaacagataaatgaattgaagc

SEQ ID NO: 1040762 - DNA, 22 bp, Artificial Sequence
  chemically synthesized
taagccatgtggcttcaattca

SEQ ID NO: 1040763 - DNA, 22 bp, Artificial Sequence
  chemically synthesized
caaacagataaatgaattgaag

SEQ ID NO: 1040764 - DNA, 22 bp, Artificial Sequence
  chemically synthesized
tcaaacagataaatgaattgaa

SEQ ID NO: 1040765 - DNA, 22 bp, Artificial Sequence
  chemically synthesized
ttcaaacagataaatgaattga

SEQ ID NO: 1040766 - DNA, 22 bp, Artificial Sequence
  chemically synthesized
aacaataagcttttcaaacaga

SEQ ID NO: 1040767 - DNA, 22 bp, Artificial Sequence
  chemically synthesized
caattcatttatctgtttgaaa

SEQ ID NO: 1040768 - DNA, 22 bp, Artificial Sequence
  chemically synthesized
aaacaataagcttttcaaacag

SEQ ID NO: 1040769 - DNA, 22 bp, Artificial Sequence
  chemically synthesized
aattcatttatctgtttgaaaa

SEQ ID NO: 1040770 - DNA, 22 bp, Artificial Sequence
  chemically synthesized
tttaaacaataagcttttcaaa

SEQ ID NO: 1040771 - DNA, 22 bp, Artificial Sequence
  chemically synthesized
atttaaacaataagcttttcaa

SEQ ID NO: 1040772 - DNA, 22 bp, Artificial Sequence
  chemically synthesized
atttatctgtttgaaaagctta

SEQ ID NO: 1040773 - DNA, 22 bp, Artificial Sequence
  chemically synthesized
atctgtttgaaaagcttattgt

SEQ ID NO: 1040774 - DNA, 22 bp, Artificial Sequence
  chemically synthesized
tctgtttgaaaagcttattgtt

SEQ ID NO: 1040775 - DNA, 22 bp, Artificial Sequence
  chemically synthesized
tttgaaaagcttattgtttaaa

SEQ ID NO: 1040776 - DNA, 22 bp, Artificial Sequence
  chemically synthesized
tcaataaacacttatttaaaca

SEQ ID NO: 1040777 - DNA, 22 bp, Artificial Sequence
  chemically synthesized
gaaaagcttattgtttaaataa

SEQ ID NO: 1040778 - DNA, 22 bp, Artificial Sequence
  chemically synthesized
aaaagcttattgtttaaataag

SEQ ID NO: 1040779 - DNA, 22 bp, Artificial Sequence
  chemically synthesized
tattatcaataaacacttattt

SEQ ID NO: 1040780 - DNA, 22 bp, Artificial Sequence
  chemically synthesized
attgtttaaataagtgtttatt

SEQ ID NO: 1040781 - DNA, 22 bp, Artificial Sequence
  chemically synthesized
ttgtttaaataagtgtttattg

SEQ ID NO: 1040782 - DNA, 22 bp, Artificial Sequence
  chemically synthesized
tgtctgtattatcaataaacac

SEQ ID NO: 1040783 - DNA, 22 bp, Artificial Sequence
  chemically synthesized
tttaaataagtgtttattgata

SEQ ID NO: 1040784 - DNA, 22 bp, Artificial Sequence
  chemically synthesized
aaataagtgtttattgataata

SEQ ID NO: 1040785 - DNA, 22 bp, Artificial Sequence
  chemically synthesized
atattatgtctgtattatcaat

SEQ ID NO: 1040786 - DNA, 22 bp, Artificial Sequence
  chemically synthesized
aataagtgtttattgataatac

SEQ ID NO: 1040787 - DNA, 22 bp, Artificial Sequence
  chemically synthesized
aggctgatattatgtctgtatt

SEQ ID NO: 1040788 - DNA, 22 bp, Artificial Sequence
  chemically synthesized
gaggctgatattatgtctgtat

SEQ ID NO: 1040789 - DNA, 22 bp, Artificial Sequence
  chemically synthesized
attgataatacagacataatat

SEQ ID NO: 1040790 - DNA, 22 bp, Artificial Sequence
  chemically synthesized
ttgataatacagacataatatc

SEQ ID NO: 1040791 - DNA, 22 bp, Artificial Sequence
  chemically synthesized
acatttgaggctgatattatgt

SEQ ID NO: 1040792 - DNA, 22 bp, Artificial Sequence
  chemically synthesized
ataatacagacataatatcagc

SEQ ID NO: 1040793 - DNA, 22 bp, Artificial Sequence
  chemically synthesized
atatctcacatttgaggctgat

SEQ ID NO: 1040794 - DNA, 22 bp, Artificial Sequence
  chemically synthesized
catatctcacatttgaggctga

SEQ ID NO: 1040795 - DNA, 22 bp, Artificial Sequence
  chemically synthesized
tcatatctcacatttgaggctg

SEQ ID NO: 1040796 - DNA, 22 bp, Artificial Sequence
  chemically synthesized
ttttcatatctcacatttgagg

SEQ ID NO: 1040797 - DNA, 22 bp, Artificial Sequence
  chemically synthesized
attttcatatctcacatttgag

SEQ ID NO: 1040798 - DNA, 22 bp, Artificial Sequence
  chemically synthesized
tattttcatatctcacatttga

SEQ ID NO: 1040799 - DNA, 22 bp, Artificial Sequence
  chemically synthesized
aagtctttattttcatatctca

SEQ ID NO: 1040800 - DNA, 22 bp, Artificial Sequence
  chemically synthesized
aaagtctttattttcatatctc

SEQ ID NO: 1040801 - DNA, 22 bp, Artificial Sequence
  chemically synthesized
taaagtctttattttcatatct

SEQ ID NO: 1040802 - DNA, 22 bp, Artificial Sequence
  chemically synthesized
aaatgtgagatatgaaaataaa

SEQ ID NO: 1040803 - DNA, 22 bp, Artificial Sequence
  chemically synthesized
acattttaaagtctttattttc

SEQ ID NO: 1040804 - DNA, 22 bp, Artificial Sequence
  chemically synthesized
agggagagactcacattttaaa

SEQ ID NO: 1040805 - DNA, 22 bp, Artificial Sequence
  chemically synthesized
aagggagagactcacattttaa

SEQ ID NO: 1040806 - DNA, 22 bp, Artificial Sequence
  chemically synthesized
ttaagggagagactcacatttt

SEQ ID NO: 1040807 - DNA, 22 bp, Artificial Sequence
  chemically synthesized
cttaagggagagactcacattt

SEQ ID NO: 1040808 - DNA, 22 bp, Artificial Sequence
  chemically synthesized
tcttcttaagggagagactcac

SEQ ID NO: 1040809 - DNA, 22 bp, Artificial Sequence
  chemically synthesized
taaaatgtgagtctctccctta

SEQ ID NO: 1040810 - DNA, 22 bp, Artificial Sequence
  chemically synthesized
aaaatgtgagtctctcccttaa

SEQ ID NO: 1040811 - DNA, 22 bp, Artificial Sequence
  chemically synthesized
aaatgtgagtctctcccttaag

SEQ ID NO: 1040812 - DNA, 22 bp, Artificial Sequence
  chemically synthesized
aaaaccaattatcttcttaagg

SEQ ID NO: 1040813 - DNA, 22 bp, Artificial Sequence
  chemically synthesized
aaaaaccaattatcttcttaag

SEQ ID NO: 1040814 - DNA, 22 bp, Artificial Sequence
  chemically synthesized
taaaaaccaattatcttcttaa

SEQ ID NO: 1040815 - DNA, 22 bp, Artificial Sequence
  chemically synthesized
ctttaaaaaccaattatcttct

SEQ ID NO: 1040816 - DNA, 22 bp, Artificial Sequence
  chemically synthesized
tcccttaagaagataattggtt

SEQ ID NO: 1040817 - DNA, 22 bp, Artificial Sequence
  chemically synthesized
ccttaagaagataattggtttt

SEQ ID NO: 1040818 - DNA, 22 bp, Artificial Sequence
  chemically synthesized
tatgtgtctcctttaaaaacca

SEQ ID NO: 1040819 - DNA, 22 bp, Artificial Sequence
  chemically synthesized
aagaagataattggtttttaaa

SEQ ID NO: 1040820 - DNA, 22 bp, Artificial Sequence
  chemically synthesized
agaagataattggtttttaaag

SEQ ID NO: 1040821 - DNA, 22 bp, Artificial Sequence
  chemically synthesized
tgtatgtgtctcctttaaaaac

SEQ ID NO: 1040822 - DNA, 22 bp, Artificial Sequence
  chemically synthesized
ctgtatgtgtctcctttaaaaa

SEQ ID NO: 1040823 - DNA, 22 bp, Artificial Sequence
  chemically synthesized
tttctgtatgtgtctcctttaa

SEQ ID NO: 1040824 - DNA, 22 bp, Artificial Sequence
  chemically synthesized
aaattatttctgtatgtgtctc

SEQ ID NO: 1040825 - DNA, 22 bp, Artificial Sequence
  chemically synthesized
gtttttaaaggagacacataca

SEQ ID NO: 1040826 - DNA, 22 bp, Artificial Sequence
  chemically synthesized
tgttcaaattatttctgtatgt

SEQ ID NO: 1040827 - DNA, 22 bp, Artificial Sequence
  chemically synthesized
ttaaaggagacacatacagaaa

SEQ ID NO: 1040828 - DNA, 22 bp, Artificial Sequence
  chemically synthesized
atgttcaaattatttctgtatg

SEQ ID NO: 1040829 - DNA, 22 bp, Artificial Sequence
  chemically synthesized
taaaggagacacatacagaaat

SEQ ID NO: 1040830 - DNA, 22 bp, Artificial Sequence
  chemically synthesized
tatgttcaaattatttctgtat

SEQ ID NO: 1040831 - DNA, 22 bp, Artificial Sequence
  chemically synthesized
aaaggagacacatacagaaata

SEQ ID NO: 1040832 - DNA, 22 bp, Artificial Sequence
  chemically synthesized
ttatgttcaaattatttctgta

SEQ ID NO: 1040833 - DNA, 22 bp, Artificial Sequence
  chemically synthesized
aaggagacacatacagaaataa

SEQ ID NO: 1040834 - DNA, 22 bp, Artificial Sequence
  chemically synthesized
aataaacaaagcatttttatgt

SEQ ID NO: 1040835 - DNA, 22 bp, Artificial Sequence
  chemically synthesized
gaataaacaaagcatttttatg

SEQ ID NO: 1040836 - DNA, 22 bp, Artificial Sequence
  chemically synthesized
gaacataaaaatgctttgttta

SEQ ID NO: 1040837 - DNA, 22 bp, Artificial Sequence
  chemically synthesized
aacataaaaatgctttgtttat

SEQ ID NO: 1040838 - DNA, 22 bp, Artificial Sequence
  chemically synthesized
cacaacacttgaataaacaaag

SEQ ID NO: 1040839 - DNA, 22 bp, Artificial Sequence
  chemically synthesized
aagacacatactccacaacact

SEQ ID NO: 1040840 - DNA, 22 bp, Artificial Sequence
  chemically synthesized
tgtttattcaagtgttgtggag

SEQ ID NO: 1040841 - DNA, 22 bp, Artificial Sequence
  chemically synthesized
gtttattcaagtgttgtggagt

SEQ ID NO: 1040842 - DNA, 22 bp, Artificial Sequence
  chemically synthesized
ttaaagacacatactccacaac

SEQ ID NO: 1040843 - DNA, 22 bp, Artificial Sequence
  chemically synthesized
tttattcaagtgttgtggagta

SEQ ID NO: 1040844 - DNA, 22 bp, Artificial Sequence
  chemically synthesized
attcaagtgttgtggagtatgt

SEQ ID NO: 1040845 - DNA, 22 bp, Artificial Sequence
  chemically synthesized
ttcaagtgttgtggagtatgtg

SEQ ID NO: 1040846 - DNA, 22 bp, Artificial Sequence
  chemically synthesized
tcctgttaaagacacatactcc

SEQ ID NO: 1040847 - DNA, 22 bp, Artificial Sequence
  chemically synthesized
atcctgttaaagacacatactc

SEQ ID NO: 1040848 - DNA, 22 bp, Artificial Sequence
  chemically synthesized
tatcctgttaaagacacatact

SEQ ID NO: 1040849 - DNA, 22 bp, Artificial Sequence
  chemically synthesized
aagtgttgtggagtatgtgtct

SEQ ID NO: 1040850 - DNA, 22 bp, Artificial Sequence
  chemically synthesized
ttatcctgttaaagacacatac

SEQ ID NO: 1040851 - DNA, 22 bp, Artificial Sequence
  chemically synthesized
cttttatcctgttaaagacaca

SEQ ID NO: 1040852 - DNA, 22 bp, Artificial Sequence
  chemically synthesized
tccttttatcctgttaaagaca

SEQ ID NO: 1040853 - DNA, 22 bp, Artificial Sequence
  chemically synthesized
ctccttttatcctgttaaagac

SEQ ID NO: 1040854 - DNA, 22 bp, Artificial Sequence
  chemically synthesized
tggagtatgtgtctttaacagg

SEQ ID NO: 1040855 - DNA, 22 bp, Artificial Sequence
  chemically synthesized
gcttctccttttatcctgttaa

SEQ ID NO: 1040856 - DNA, 22 bp, Artificial Sequence
  chemically synthesized
tggcttctccttttatcctgtt

SEQ ID NO: 1040857 - DNA, 22 bp, Artificial Sequence
  chemically synthesized
tctggcttctccttttatcctg

SEQ ID NO: 1040858 - DNA, 22 bp, Artificial Sequence
  chemically synthesized
tattctctggcttctcctttta

SEQ ID NO: 1040859 - DNA, 22 bp, Artificial Sequence
  chemically synthesized
tgtattctctggcttctccttt

SEQ ID NO: 1040860 - DNA, 22 bp, Artificial Sequence
  chemically synthesized
ctgtattctctggcttctcctt

SEQ ID NO: 1040861 - DNA, 22 bp, Artificial Sequence
  chemically synthesized
taacaggataaaaggagaagcc

SEQ ID NO: 1040862 - DNA, 22 bp, Artificial Sequence
  chemically synthesized
tctgtattctctggcttctcct

SEQ ID NO: 1040863 - DNA, 22 bp, Artificial Sequence
  chemically synthesized
aacaggataaaaggagaagcca

SEQ ID NO: 1040864 - DNA, 22 bp, Artificial Sequence
  chemically synthesized
acaggataaaaggagaagccag

SEQ ID NO: 1040865 - DNA, 22 bp, Artificial Sequence
  chemically synthesized
gataaattttctgtattctctg

SEQ ID NO: 1040866 - DNA, 22 bp, Artificial Sequence
  chemically synthesized
ctagataaattttctgtattct

SEQ ID NO: 1040867 - DNA, 22 bp, Artificial Sequence
  chemically synthesized
cctagataaattttctgtattc

SEQ ID NO: 1040868 - DNA, 22 bp, Artificial Sequence
  chemically synthesized
tttcctagataaattttctgta

SEQ ID NO: 1040869 - DNA, 22 bp, Artificial Sequence
  chemically synthesized
gtttcctagataaattttctgt

SEQ ID NO: 1040870 - DNA, 22 bp, Artificial Sequence
  chemically synthesized
tttgtttcctagataaattttc

SEQ ID NO: 1040871 - DNA, 22 bp, Artificial Sequence
  chemically synthesized
gtttgtttcctagataaatttt

SEQ ID NO: 1040872 - DNA, 22 bp, Artificial Sequence
  chemically synthesized
gcaaataggtcccttgtttgtt

SEQ ID NO: 1040873 - DNA, 22 bp, Artificial Sequence
  chemically synthesized
atctaggaaacaaacaagggac

SEQ ID NO: 1040874 - DNA, 22 bp, Artificial Sequence
  chemically synthesized
gttggcaaataggtcccttgtt

SEQ ID NO: 1040875 - DNA, 22 bp, Artificial Sequence
  chemically synthesized
tctaggaaacaaacaagggacc

SEQ ID NO: 1040876 - DNA, 22 bp, Artificial Sequence
  chemically synthesized
attagttggcaaataggtccct

SEQ ID NO: 1040877 - DNA, 22 bp, Artificial Sequence
  chemically synthesized
ggaaacaaacaagggacctatt

SEQ ID NO: 1040878 - DNA, 22 bp, Artificial Sequence
  chemically synthesized
aactgattagttggcaaatagg

SEQ ID NO: 1040879 - DNA, 22 bp, Artificial Sequence
  chemically synthesized
aaactgattagttggcaaatag

SEQ ID NO: 1040880 - DNA, 22 bp, Artificial Sequence
  chemically synthesized
tcttaaactgattagttggcaa

SEQ ID NO: 1040881 - DNA, 22 bp, Artificial Sequence
  chemically synthesized
atcttaaactgattagttggca

SEQ ID NO: 1040882 - DNA, 22 bp, Artificial Sequence
  chemically synthesized
tatcttaaactgattagttggc

SEQ ID NO: 1040883 - DNA, 22 bp, Artificial Sequence
  chemically synthesized
atacctttatcttaaactgatt

SEQ ID NO: 1040884 - DNA, 22 bp, Artificial Sequence
  chemically synthesized
catacctttatcttaaactgat

SEQ ID NO: 1040885 - DNA, 22 bp, Artificial Sequence
  chemically synthesized
tttgccaactaatcagtttaag

SEQ ID NO: 1040886 - DNA, 22 bp, Artificial Sequence
  chemically synthesized
cttcatacctttatcttaaact

SEQ ID NO: 1040887 - DNA, 22 bp, Artificial Sequence
  chemically synthesized
gccaactaatcagtttaagata

SEQ ID NO: 1040888 - DNA, 22 bp, Artificial Sequence
  chemically synthesized
ccaactaatcagtttaagataa

SEQ ID NO: 1040889 - DNA, 22 bp, Artificial Sequence
  chemically synthesized
agggttgcttcatacctttatc

SEQ ID NO: 1040890 - DNA, 22 bp, Artificial Sequence
  chemically synthesized
atcagtttaagataaaggtatg

SEQ ID NO: 1040891 - DNA, 22 bp, Artificial Sequence
  chemically synthesized
aagataaaggtatgaagcaacc

SEQ ID NO: 1040892 - DNA, 22 bp, Artificial Sequence
  chemically synthesized
agataaaggtatgaagcaaccc

SEQ ID NO: 1040893 - DNA, 22 bp, Artificial Sequence
  chemically synthesized
tgataaagaatggagcatagtt

SEQ ID NO: 1040894 - DNA, 22 bp, Artificial Sequence
  chemically synthesized
atgataaagaatggagcatagt

SEQ ID NO: 1040895 - DNA, 22 bp, Artificial Sequence
  chemically synthesized
tcccttatgataaagaatggag

SEQ ID NO: 1040896 - DNA, 22 bp, Artificial Sequence
  chemically synthesized
aactatgctccattctttatca

SEQ ID NO: 1040897 - DNA, 22 bp, Artificial Sequence
  chemically synthesized
actatgctccattctttatcat

SEQ ID NO: 1040898 - DNA, 22 bp, Artificial Sequence
  chemically synthesized
tgctccattctttatcataagg

SEQ ID NO: 1040899 - DNA, 22 bp, Artificial Sequence
  chemically synthesized
cattctttatcataagggatag

SEQ ID NO: 1040900 - DNA, 22 bp, Artificial Sequence
  chemically synthesized
aacagtagaagtctatccctta

SEQ ID NO: 1040901 - DNA, 22 bp, Artificial Sequence
  chemically synthesized
tttatcataagggatagacttc

SEQ ID NO: 1040902 - DNA, 22 bp, Artificial Sequence
  chemically synthesized
tatcataagggatagacttcta

SEQ ID NO: 1040903 - DNA, 22 bp, Artificial Sequence
  chemically synthesized
atcataagggatagacttctac

SEQ ID NO: 1040904 - DNA, 22 bp, Artificial Sequence
  chemically synthesized
tcataagggatagacttctact

SEQ ID NO: 1040905 - DNA, 22 bp, Artificial Sequence
  chemically synthesized
aatggaagaaaaactaaacagt

SEQ ID NO: 1040906 - DNA, 22 bp, Artificial Sequence
  chemically synthesized
cattaaatggaagaaaaactaa

SEQ ID NO: 1040907 - DNA, 22 bp, Artificial Sequence
  chemically synthesized
acattaaatggaagaaaaacta

SEQ ID NO: 1040908 - DNA, 22 bp, Artificial Sequence
  chemically synthesized
tacattaaatggaagaaaaact

SEQ ID NO: 1040909 - DNA, 22 bp, Artificial Sequence
  chemically synthesized
ctactgtttagtttttcttcca

SEQ ID NO: 1040910 - DNA, 22 bp, Artificial Sequence
  chemically synthesized
tactgtttagtttttcttccat

SEQ ID NO: 1040911 - DNA, 22 bp, Artificial Sequence
  chemically synthesized
ctgtttagtttttcttccattt

SEQ ID NO: 1040912 - DNA, 22 bp, Artificial Sequence
  chemically synthesized
tcactttacattaaatggaaga

SEQ ID NO: 1040913 - DNA, 22 bp, Artificial Sequence
  chemically synthesized
tttagtttttcttccatttaat

SEQ ID NO: 1040914 - DNA, 22 bp, Artificial Sequence
  chemically synthesized
agtttttcttccatttaatgta

SEQ ID NO: 1040915 - DNA, 22 bp, Artificial Sequence
  chemically synthesized
gtttttcttccatttaatgtaa

SEQ ID NO: 1040916 - DNA, 22 bp, Artificial Sequence
  chemically synthesized
ttcttccatttaatgtaaagtg

SEQ ID NO: 1040917 - DNA, 22 bp, Artificial Sequence
  chemically synthesized
tcttccatttaatgtaaagtga

SEQ ID NO: 1040918 - DNA, 22 bp, Artificial Sequence
  chemically synthesized
cttccatttaatgtaaagtgac

SEQ ID NO: 1040919 - DNA, 22 bp, Artificial Sequence
  chemically synthesized
ttccatttaatgtaaagtgaca

SEQ ID NO: 1040920 - DNA, 22 bp, Artificial Sequence
  chemically synthesized
ccatttaatgtaaagtgacaac

SEQ ID NO: 1040921 - DNA, 22 bp, Artificial Sequence
  chemically synthesized
catttaatgtaaagtgacaact

SEQ ID NO: 1040922 - DNA, 22 bp, Artificial Sequence
  chemically synthesized
acagcaagggagtagttgtcac

SEQ ID NO: 1040923 - DNA, 22 bp, Artificial Sequence
  chemically synthesized
gacagcaagggagtagttgtca

SEQ ID NO: 1040924 - DNA, 22 bp, Artificial Sequence
  chemically synthesized
tgacagcaagggagtagttgtc

SEQ ID NO: 1040925 - DNA, 22 bp, Artificial Sequence
  chemically synthesized
aatgtaaagtgacaactactcc

SEQ ID NO: 1040926 - DNA, 22 bp, Artificial Sequence
  chemically synthesized
atgtaaagtgacaactactccc

SEQ ID NO: 1040927 - DNA, 22 bp, Artificial Sequence
  chemically synthesized
caatgaaaatctttgacagcaa

SEQ ID NO: 1040928 - DNA, 22 bp, Artificial Sequence
  chemically synthesized
tgcaatgaaaatctttgacagc

SEQ ID NO: 1040929 - DNA, 22 bp, Artificial Sequence
  chemically synthesized
ctcccttgctgtcaaagatttt

SEQ ID NO: 1040930 - DNA, 22 bp, Artificial Sequence
  chemically synthesized
ccttgctgtcaaagattttcat

SEQ ID NO: 1040931 - DNA, 22 bp, Artificial Sequence
  chemically synthesized
gctgtcaaagattttcattgca

SEQ ID NO: 1040932 - DNA, 22 bp, Artificial Sequence
  chemically synthesized
ctgtcaaagattttcattgcag

SEQ ID NO: 1040933 - DNA, 22 bp, Artificial Sequence
  chemically synthesized
tcaaagattttcattgcagagc

SEQ ID NO: 1040934 - DNA, 22 bp, Artificial Sequence
  chemically synthesized
gatggtaaaggcaggctctgca

SEQ ID NO: 1040935 - DNA, 22 bp, Artificial Sequence
  chemically synthesized
agatggtaaaggcaggctctgc

SEQ ID NO: 1040936 - DNA, 22 bp, Artificial Sequence
  chemically synthesized
ccatttagatggtaaaggcagg

SEQ ID NO: 1040937 - DNA, 22 bp, Artificial Sequence
  chemically synthesized
tcattgcagagcctgcctttac

SEQ ID NO: 1040938 - DNA, 22 bp, Artificial Sequence
  chemically synthesized
accatttagatggtaaaggcag

SEQ ID NO: 1040939 - DNA, 22 bp, Artificial Sequence
  chemically synthesized
cattgcagagcctgcctttacc

SEQ ID NO: 1040940 - DNA, 22 bp, Artificial Sequence
  chemically synthesized
attgcagagcctgcctttacca

SEQ ID NO: 1040941 - DNA, 22 bp, Artificial Sequence
  chemically synthesized
cagagcctgcctttaccatcta

SEQ ID NO: 1040942 - DNA, 22 bp, Artificial Sequence
  chemically synthesized
tacacataagtttaccatttag

SEQ ID NO: 1040943 - DNA, 22 bp, Artificial Sequence
  chemically synthesized
atacacataagtttaccattta

SEQ ID NO: 1040944 - DNA, 22 bp, Artificial Sequence
  chemically synthesized
cctttaccatctaaatggtaaa

SEQ ID NO: 1040945 - DNA, 22 bp, Artificial Sequence
  chemically synthesized
taccatctaaatggtaaactta

SEQ ID NO: 1040946 - DNA, 22 bp, Artificial Sequence
  chemically synthesized
accatctaaatggtaaacttat

SEQ ID NO: 1040947 - DNA, 22 bp, Artificial Sequence
  chemically synthesized
acatttatacacataagtttac

SEQ ID NO: 1040948 - DNA, 22 bp, Artificial Sequence
  chemically synthesized
ccatctaaatggtaaacttatg

SEQ ID NO: 1040949 - DNA, 22 bp, Artificial Sequence
  chemically synthesized
gacatttatacacataagttta

SEQ ID NO: 1040950 - DNA, 22 bp, Artificial Sequence
  chemically synthesized
tgacatttatacacataagttt

SEQ ID NO: 1040951 - DNA, 22 bp, Artificial Sequence
  chemically synthesized
ctttgacatttatacacataag

SEQ ID NO: 1040952 - DNA, 22 bp, Artificial Sequence
  chemically synthesized
aatggtaaacttatgtgtataa

SEQ ID NO: 1040953 - DNA, 22 bp, Artificial Sequence
  chemically synthesized
caatatctactttgacatttat

SEQ ID NO: 1040954 - DNA, 22 bp, Artificial Sequence
  chemically synthesized
tgcaatatctactttgacattt

SEQ ID NO: 1040955 - DNA, 22 bp, Artificial Sequence
  chemically synthesized
atgtgtataaatgtcaaagtag

SEQ ID NO: 1040956 - DNA, 22 bp, Artificial Sequence
  chemically synthesized
tgtgtataaatgtcaaagtaga

SEQ ID NO: 1040957 - DNA, 22 bp, Artificial Sequence
  chemically synthesized
aggttctgcaatatctactttg

SEQ ID NO: 1040958 - DNA, 22 bp, Artificial Sequence
  chemically synthesized
caggttctgcaatatctacttt

SEQ ID NO: 1040959 - DNA, 22 bp, Artificial Sequence
  chemically synthesized
ttcaggttctgcaatatctact

SEQ ID NO: 1040960 - DNA, 22 bp, Artificial Sequence
  chemically synthesized
tcttcaggttctgcaatatcta

SEQ ID NO: 1040961 - DNA, 22 bp, Artificial Sequence
  chemically synthesized
gttctcttcaggttctgcaata

SEQ ID NO: 1040962 - DNA, 22 bp, Artificial Sequence
  chemically synthesized
tagttctcttcaggttctgcaa

SEQ ID NO: 1040963 - DNA, 22 bp, Artificial Sequence
  chemically synthesized
ctctagttctcttcaggttctg

SEQ ID NO: 1040964 - DNA, 22 bp, Artificial Sequence
  chemically synthesized
ccctactctagttctcttcagg

SEQ ID NO: 1040965 - DNA, 22 bp, Artificial Sequence
  chemically synthesized
tcccctactctagttctcttca

SEQ ID NO: 1040966 - DNA, 22 bp, Artificial Sequence
  chemically synthesized
ctctcccctactctagttctct

SEQ ID NO: 1040967 - DNA, 22 bp, Artificial Sequence
  chemically synthesized
cagaacctgaagagaactagag

SEQ ID NO: 1040968 - DNA, 22 bp, Artificial Sequence
  chemically synthesized
tcagatattactctcccctact

SEQ ID NO: 1040969 - DNA, 22 bp, Artificial Sequence
  chemically synthesized
aagagaactagagtaggggaga

SEQ ID NO: 1040970 - DNA, 22 bp, Artificial Sequence
  chemically synthesized
gtcagatattactctcccctac

SEQ ID NO: 1040971 - DNA, 22 bp, Artificial Sequence
  chemically synthesized
aatttgtcagatattactctcc

SEQ ID NO: 1040972 - DNA, 22 bp, Artificial Sequence
  chemically synthesized
gagtaggggagagtaatatctg

SEQ ID NO: 1040973 - DNA, 22 bp, Artificial Sequence
  chemically synthesized
acagtaagttcaatttgtcaga

SEQ ID NO: 1040974 - DNA, 22 bp, Artificial Sequence
  chemically synthesized
atcaaaagtgattaacagtaag

SEQ ID NO: 1040975 - DNA, 22 bp, Artificial Sequence
  chemically synthesized
catcaaaagtgattaacagtaa

SEQ ID NO: 1040976 - DNA, 22 bp, Artificial Sequence
  chemically synthesized
acaaattgaacttactgttaat

SEQ ID NO: 1040977 - DNA, 22 bp, Artificial Sequence
  chemically synthesized
tcatcaaaagtgattaacagta

SEQ ID NO: 1040978 - DNA, 22 bp, Artificial Sequence
  chemically synthesized
ctttcatcaaaagtgattaaca

SEQ ID NO: 1040979 - DNA, 22 bp, Artificial Sequence
  chemically synthesized
actttcatcaaaagtgattaac

SEQ ID NO: 1040980 - DNA, 22 bp, Artificial Sequence
  chemically synthesized
aacttactgttaatcacttttg

SEQ ID NO: 1040981 - DNA, 22 bp, Artificial Sequence
  chemically synthesized
agtttactttcatcaaaagtga

SEQ ID NO: 1040982 - DNA, 22 bp, Artificial Sequence
  chemically synthesized
aagtttactttcatcaaaagtg

SEQ ID NO: 1040983 - DNA, 22 bp, Artificial Sequence
  chemically synthesized
taagtttactttcatcaaaagt

SEQ ID NO: 1040984 - DNA, 22 bp, Artificial Sequence
  chemically synthesized
actgttaatcacttttgatgaa

SEQ ID NO: 1040985 - DNA, 22 bp, Artificial Sequence
  chemically synthesized
ctgttaatcacttttgatgaaa

SEQ ID NO: 1040986 - DNA, 22 bp, Artificial Sequence
  chemically synthesized
ttttaagtttactttcatcaaa

SEQ ID NO: 1040987 - DNA, 22 bp, Artificial Sequence
  chemically synthesized
ttaatcacttttgatgaaagta

SEQ ID NO: 1040988 - DNA, 22 bp, Artificial Sequence
  chemically synthesized
atcacttttgatgaaagtaaac

SEQ ID NO: 1040989 - DNA, 22 bp, Artificial Sequence
  chemically synthesized
agtaaattattttaagtttact

SEQ ID NO: 1040990 - DNA, 22 bp, Artificial Sequence
  chemically synthesized
cagtaaattattttaagtttac

SEQ ID NO: 1040991 - DNA, 22 bp, Artificial Sequence
  chemically synthesized
ttgatgaaagtaaacttaaaat

SEQ ID NO: 1040992 - DNA, 22 bp, Artificial Sequence
  chemically synthesized
tgatgaaagtaaacttaaaata

SEQ ID NO: 1040993 - DNA, 22 bp, Artificial Sequence
  chemically synthesized
gatgaaagtaaacttaaaataa

SEQ ID NO: 1040994 - DNA, 22 bp, Artificial Sequence
  chemically synthesized
atgaaagtaaacttaaaataat

SEQ ID NO: 1040995 - DNA, 22 bp, Artificial Sequence
  chemically synthesized
aaacttcagtaaattattttaa

SEQ ID NO: 1040996 - DNA, 22 bp, Artificial Sequence
  chemically synthesized
aaaacttcagtaaattatttta

SEQ ID NO: 1040997 - DNA, 22 bp, Artificial Sequence
  chemically synthesized
aaaataatttactgaagtttta

SEQ ID NO: 1040998 - DNA, 22 bp, Artificial Sequence
  chemically synthesized
aaataatttactgaagttttaa

SEQ ID NO: 1040999 - DNA, 22 bp, Artificial Sequence
  chemically synthesized
taggtacaaaaatatatttaaa

SEQ ID NO: 1041000 - DNA, 22 bp, Artificial Sequence
  chemically synthesized
ctataggtacaaaaatatattt

SEQ ID NO: 1041001 - DNA, 22 bp, Artificial Sequence
  chemically synthesized
actgaagttttaaatatatttt

SEQ ID NO: 1041002 - DNA, 22 bp, Artificial Sequence
  chemically synthesized
gctataggtacaaaaatatatt

SEQ ID NO: 1041003 - DNA, 22 bp, Artificial Sequence
  chemically synthesized
ctgaagttttaaatatattttt

SEQ ID NO: 1041004 - DNA, 22 bp, Artificial Sequence
  chemically synthesized
tgctataggtacaaaaatatat

SEQ ID NO: 1041005 - DNA, 22 bp, Artificial Sequence
  chemically synthesized
aagttttaaatatatttttgta

SEQ ID NO: 1041006 - DNA, 22 bp, Artificial Sequence
  chemically synthesized
taaatatatttttgtacctata

SEQ ID NO: 1041007 - DNA, 22 bp, Artificial Sequence
  chemically synthesized
aaatatatttttgtacctatag

SEQ ID NO: 1041008 - DNA, 22 bp, Artificial Sequence
  chemically synthesized
aatatatttttgtacctatagc

SEQ ID NO: 1041009 - DNA, 22 bp, Artificial Sequence
  chemically synthesized
gggaagcaacgagctttgctat

SEQ ID NO: 1041010 - DNA, 22 bp, Artificial Sequence
  chemically synthesized
ttgtacctatagcaaagctcgt

SEQ ID NO: 1041011 - DNA, 22 bp, Artificial Sequence
  chemically synthesized
tgtacctatagcaaagctcgtt

SEQ ID NO: 1041012 - DNA, 22 bp, Artificial Sequence
  chemically synthesized
gtacctatagcaaagctcgttg

SEQ ID NO: 1041013 - DNA, 22 bp, Artificial Sequence
  chemically synthesized
tacctatagcaaagctcgttgc

SEQ ID NO: 1041014 - DNA, 22 bp, Artificial Sequence
  chemically synthesized
acagtattcgggaagcaacgag

SEQ ID NO: 1041015 - DNA, 22 bp, Artificial Sequence
  chemically synthesized
cacagtattcgggaagcaacga

SEQ ID NO: 1041016 - DNA, 22 bp, Artificial Sequence
  chemically synthesized
tcacagtattcgggaagcaacg

SEQ ID NO: 1041017 - DNA, 22 bp, Artificial Sequence
  chemically synthesized
ttcacagtattcgggaagcaac

SEQ ID NO: 1041018 - DNA, 22 bp, Artificial Sequence
  chemically synthesized
tagcaaagctcgttgcttcccg

SEQ ID NO: 1041019 - DNA, 22 bp, Artificial Sequence
  chemically synthesized
gcacttttcacagtattcggga

SEQ ID NO: 1041020 - DNA, 22 bp, Artificial Sequence
  chemically synthesized
ggcacttttcacagtattcggg

SEQ ID NO: 1041021 - DNA, 22 bp, Artificial Sequence
  chemically synthesized
tggcacttttcacagtattcgg

SEQ ID NO: 1041022 - DNA, 22 bp, Artificial Sequence
  chemically synthesized
gttgcttcccgaatactgtgaa

SEQ ID NO: 1041023 - DNA, 22 bp, Artificial Sequence
  chemically synthesized
cttcccgaatactgtgaaaagt

SEQ ID NO: 1041024 - DNA, 22 bp, Artificial Sequence
  chemically synthesized
cccgaatactgtgaaaagtgcc

SEQ ID NO: 1041025 - DNA, 22 bp, Artificial Sequence
  chemically synthesized
ccgaatactgtgaaaagtgcca

SEQ ID NO: 1041026 - DNA, 22 bp, Artificial Sequence
  chemically synthesized
aataatagaactttggcacttt

SEQ ID NO: 1041027 - DNA, 22 bp, Artificial Sequence
  chemically synthesized
aaataatagaactttggcactt

SEQ ID NO: 1041028 - DNA, 22 bp, Artificial Sequence
  chemically synthesized
taaataatagaactttggcact

SEQ ID NO: 1041029 - DNA, 22 bp, Artificial Sequence
  chemically synthesized
ttttaaataatagaactttggc

SEQ ID NO: 1041030 - DNA, 22 bp, Artificial Sequence
  chemically synthesized
ctattttaaataatagaacttt

SEQ ID NO: 1041031 - DNA, 22 bp, Artificial Sequence
  chemically synthesized
tgaaaagtgccaaagttctatt

SEQ ID NO: 1041032 - DNA, 22 bp, Artificial Sequence
  chemically synthesized
tattatttaaaatagcagccgg

SEQ ID NO: 1041033 - DNA, 22 bp, Artificial Sequence
  chemically synthesized
ttatttaaaatagcagccgggc

SEQ ID NO: 1041034 - DNA, 22 bp, Artificial Sequence
  chemically synthesized
tttaaaatagcagccgggcgcg

SEQ ID NO: 1041035 - DNA, 22 bp, Artificial Sequence
  chemically synthesized
caggcgtgagccaccgcgcccg

SEQ ID NO: 1041036 - DNA, 22 bp, Artificial Sequence
  chemically synthesized
aaaatagcagccgggcgcggtg

SEQ ID NO: 1041037 - DNA, 22 bp, Artificial Sequence
  chemically synthesized
aaatagcagccgggcgcggtgg

SEQ ID NO: 1041038 - DNA, 22 bp, Artificial Sequence
  chemically synthesized
ggattacaggcgtgagccaccg

SEQ ID NO: 1041039 - DNA, 22 bp, Artificial Sequence
  chemically synthesized
ccaaagtgctgggattacaggc

SEQ ID NO: 1041040 - DNA, 22 bp, Artificial Sequence
  chemically synthesized
ggcctcccaaagtgctgggatt

SEQ ID NO: 1041041 - DNA, 22 bp, Artificial Sequence
  chemically synthesized
acgcctgtaatcccagcacttt

SEQ ID NO: 1041042 - DNA, 22 bp, Artificial Sequence
  chemically synthesized
cctcggcctcccaaagtgctgg

SEQ ID NO: 1041043 - DNA, 22 bp, Artificial Sequence
  chemically synthesized
taatcccagcactttgggaggc

SEQ ID NO: 1041044 - DNA, 22 bp, Artificial Sequence
  chemically synthesized
aagtgatccacctacctcggcc

SEQ ID NO: 1041045 - DNA, 22 bp, Artificial Sequence
  chemically synthesized
tcctaaagtgatccacctacct

SEQ ID NO: 1041046 - DNA, 22 bp, Artificial Sequence
  chemically synthesized
tgggaggccgaggtaggtggat

SEQ ID NO: 1041047 - DNA, 22 bp, Artificial Sequence
  chemically synthesized
gggaggccgaggtaggtggatc

SEQ ID NO: 1041048 - DNA, 22 bp, Artificial Sequence
  chemically synthesized
ctgtcctaaagtgatccaccta

SEQ ID NO: 1041049 - DNA, 22 bp, Artificial Sequence
  chemically synthesized
ggaggccgaggtaggtggatca

SEQ ID NO: 1041050 - DNA, 22 bp, Artificial Sequence
  chemically synthesized
gaactcctgtcctaaagtgatc

SEQ ID NO: 1041051 - DNA, 22 bp, Artificial Sequence
  chemically synthesized
gtctcgaactcctgtcctaaag

SEQ ID NO: 1041052 - DNA, 22 bp, Artificial Sequence
  chemically synthesized
gtcaggctggtctcgaactcct

SEQ ID NO: 1041053 - DNA, 22 bp, Artificial Sequence
  chemically synthesized
taggacaggagttcgagaccag

SEQ ID NO: 1041054 - DNA, 22 bp, Artificial Sequence
  chemically synthesized
aggacaggagttcgagaccagc

SEQ ID NO: 1041055 - DNA, 22 bp, Artificial Sequence
  chemically synthesized
ggacaggagttcgagaccagcc

SEQ ID NO: 1041056 - DNA, 22 bp, Artificial Sequence
  chemically synthesized
acatgttggtcaggctggtctc

SEQ ID NO: 1041057 - DNA, 22 bp, Artificial Sequence
  chemically synthesized
cacatgttggtcaggctggtct

SEQ ID NO: 1041058 - DNA, 22 bp, Artificial Sequence
  chemically synthesized
gagaccagcctgaccaacatgt

SEQ ID NO: 1041059 - DNA, 22 bp, Artificial Sequence
  chemically synthesized
gtagagacagggtttcacatgt

SEQ ID NO: 1041060 - DNA, 22 bp, Artificial Sequence
  chemically synthesized
agtagagacagggtttcacatg

SEQ ID NO: 1041061 - DNA, 22 bp, Artificial Sequence
  chemically synthesized
tagtagagacagggtttcacat

SEQ ID NO: 1041062 - DNA, 22 bp, Artificial Sequence
  chemically synthesized
ttagtagagacagggtttcaca

SEQ ID NO: 1041063 - DNA, 22 bp, Artificial Sequence
  chemically synthesized
accaacatgtgaaaccctgtct

SEQ ID NO: 1041064 - DNA, 22 bp, Artificial Sequence
  chemically synthesized
tatttttagtagagacagggtt

SEQ ID NO: 1041065 - DNA, 22 bp, Artificial Sequence
  chemically synthesized
gtatttttagtagagacagggt

SEQ ID NO: 1041066 - DNA, 22 bp, Artificial Sequence
  chemically synthesized
gtgaatgtttgtatttttagta

SEQ ID NO: 1041067 - DNA, 22 bp, Artificial Sequence
  chemically synthesized
tctctactaaaaatacaaacat

SEQ ID NO: 1041068 - DNA, 22 bp, Artificial Sequence
  chemically synthesized
tactaaaaatacaaacattcac

SEQ ID NO: 1041069 - DNA, 22 bp, Artificial Sequence
  chemically synthesized
ctaaaaatacaaacattcacca

SEQ ID NO: 1041070 - DNA, 22 bp, Artificial Sequence
  chemically synthesized
aaaatacaaacattcaccaggt

SEQ ID NO: 1041071 - DNA, 22 bp, Artificial Sequence
  chemically synthesized
caggcgcccaccgccacacctg

SEQ ID NO: 1041072 - DNA, 22 bp, Artificial Sequence
  chemically synthesized
ggattacaggcgcccaccgcca

SEQ ID NO: 1041073 - DNA, 22 bp, Artificial Sequence
  chemically synthesized
accaggtgtggcggtgggcgcc

SEQ ID NO: 1041074 - DNA, 22 bp, Artificial Sequence
  chemically synthesized
ccaagtagctgggattacaggc

SEQ ID NO: 1041075 - DNA, 22 bp, Artificial Sequence
  chemically synthesized
gcctcccaagtagctgggatta

SEQ ID NO: 1041076 - DNA, 22 bp, Artificial Sequence
  chemically synthesized
agcctcccaagtagctgggatt

SEQ ID NO: 1041077 - DNA, 22 bp, Artificial Sequence
  chemically synthesized
ccttagcctcccaagtagctgg

SEQ ID NO: 1041078 - DNA, 22 bp, Artificial Sequence
  chemically synthesized
ctaccttagcctcccaagtagc

SEQ ID NO: 1041079 - DNA, 22 bp, Artificial Sequence
  chemically synthesized
tcctaccttagcctcccaagta

SEQ ID NO: 1041080 - DNA, 22 bp, Artificial Sequence
  chemically synthesized
taatcccagctacttgggaggc

SEQ ID NO: 1041081 - DNA, 22 bp, Artificial Sequence
  chemically synthesized
cttgggaggctaaggtaggaga

SEQ ID NO: 1041082 - DNA, 22 bp, Artificial Sequence
  chemically synthesized
gggtcaagtgattctcctacct

SEQ ID NO: 1041083 - DNA, 22 bp, Artificial Sequence
  chemically synthesized
gggaggctaaggtaggagaatc

SEQ ID NO: 1041084 - DNA, 22 bp, Artificial Sequence
  chemically synthesized
ctggggtcaagtgattctccta

SEQ ID NO: 1041085 - DNA, 22 bp, Artificial Sequence
  chemically synthesized
ggaggctaaggtaggagaatca

SEQ ID NO: 1041086 - DNA, 22 bp, Artificial Sequence
  chemically synthesized
cctggggtcaagtgattctcct

SEQ ID NO: 1041087 - DNA, 22 bp, Artificial Sequence
  chemically synthesized
cgcttcctggggtcaagtgatt

SEQ ID NO: 1041088 - DNA, 22 bp, Artificial Sequence
  chemically synthesized
aggtaggagaatcacttgaccc

SEQ ID NO: 1041089 - DNA, 22 bp, Artificial Sequence
  chemically synthesized
caacctccgcttcctggggtca

SEQ ID NO: 1041090 - DNA, 22 bp, Artificial Sequence
  chemically synthesized
actgcaacctccgcttcctggg

SEQ ID NO: 1041091 - DNA, 22 bp, Artificial Sequence
  chemically synthesized
ggctcactgcaacctccgcttc

SEQ ID NO: 1041092 - DNA, 22 bp, Artificial Sequence
  chemically synthesized
gaccccaggaagcggaggttgc

SEQ ID NO: 1041093 - DNA, 22 bp, Artificial Sequence
  chemically synthesized
accccaggaagcggaggttgca

SEQ ID NO: 1041094 - DNA, 22 bp, Artificial Sequence
  chemically synthesized
gagtgcggtggcacagtctcgg

SEQ ID NO: 1041095 - DNA, 22 bp, Artificial Sequence
  chemically synthesized
cagtgagccgagactgtgccac

SEQ ID NO: 1041096 - DNA, 22 bp, Artificial Sequence
  chemically synthesized
cccaggctggagtgcggtggca

SEQ ID NO: 1041097 - DNA, 22 bp, Artificial Sequence
  chemically synthesized
ttgcccaggctggagtgcggtg

SEQ ID NO: 1041098 - DNA, 22 bp, Artificial Sequence
  chemically synthesized
gttgcccaggctggagtgcggt

SEQ ID NO: 1041099 - DNA, 22 bp, Artificial Sequence
  chemically synthesized
ttgttgcccaggctggagtgcg

SEQ ID NO: 1041100 - DNA, 22 bp, Artificial Sequence
  chemically synthesized
actcttgttgcccaggctggag

SEQ ID NO: 1041101 - DNA, 22 bp, Artificial Sequence
  chemically synthesized
cactcttgttgcccaggctgga

SEQ ID NO: 1041102 - DNA, 22 bp, Artificial Sequence
  chemically synthesized
tgccaccgcactccagcctggg

SEQ ID NO: 1041103 - DNA, 22 bp, Artificial Sequence
  chemically synthesized
agacagagtttcactcttgttg

SEQ ID NO: 1041104 - DNA, 22 bp, Artificial Sequence
  chemically synthesized
cagcctgggcaacaagagtgaa

SEQ ID NO: 1041105 - DNA, 22 bp, Artificial Sequence
  chemically synthesized
ttgagacagagtttcactcttg

SEQ ID NO: 1041106 - DNA, 22 bp, Artificial Sequence
  chemically synthesized
attgagacagagtttcactctt

SEQ ID NO: 1041107 - DNA, 22 bp, Artificial Sequence
  chemically synthesized
tttattgagacagagtttcact

SEQ ID NO: 1041108 - DNA, 22 bp, Artificial Sequence
  chemically synthesized
ggcaacaagagtgaaactctgt

SEQ ID NO: 1041109 - DNA, 22 bp, Artificial Sequence
  chemically synthesized
attgtttattgagacagagttt

SEQ ID NO: 1041110 - DNA, 22 bp, Artificial Sequence
  chemically synthesized
aattgtttattgagacagagtt

SEQ ID NO: 1041111 - DNA, 22 bp, Artificial Sequence
  chemically synthesized
tttaattgtttattgagacaga

SEQ ID NO: 1041112 - DNA, 22 bp, Artificial Sequence
  chemically synthesized
gtttaattgtttattgagacag

SEQ ID NO: 1041113 - DNA, 22 bp, Artificial Sequence
  chemically synthesized
tttgtttaattgtttattgaga

SEQ ID NO: 1041114 - DNA, 22 bp, Artificial Sequence
  chemically synthesized
gtttgtttaattgtttattgag

SEQ ID NO: 1041115 - DNA, 22 bp, Artificial Sequence
  chemically synthesized
tttgtttgtttaattgtttatt

SEQ ID NO: 1041116 - DNA, 22 bp, Artificial Sequence
  chemically synthesized
gtttgtttgtttaattgtttat

SEQ ID NO: 1041117 - DNA, 22 bp, Artificial Sequence
  chemically synthesized
tgtctcaataaacaattaaaca

SEQ ID NO: 1041118 - DNA, 22 bp, Artificial Sequence
  chemically synthesized
tctcaataaacaattaaacaaa

SEQ ID NO: 1041119 - DNA, 22 bp, Artificial Sequence
  chemically synthesized
aataaacaattaaacaaacaaa

SEQ ID NO: 1041120 - DNA, 22 bp, Artificial Sequence
  chemically synthesized
aacaaacaaacaaacatcactt

SEQ ID NO: 1041121 - DNA, 22 bp, Artificial Sequence
  chemically synthesized
aatgaccacagagacgggacag

SEQ ID NO: 1041122 - DNA, 22 bp, Artificial Sequence
  chemically synthesized
aattgaatgaccacagagacgg

SEQ ID NO: 1041123 - DNA, 22 bp, Artificial Sequence
  chemically synthesized
cctctgtcccgtctctgtggtc

SEQ ID NO: 1041124 - DNA, 22 bp, Artificial Sequence
  chemically synthesized
ctctgtcccgtctctgtggtca

SEQ ID NO: 1041125 - DNA, 22 bp, Artificial Sequence
  chemically synthesized
tgtcccgtctctgtggtcattc

SEQ ID NO: 1041126 - DNA, 22 bp, Artificial Sequence
  chemically synthesized
tcccgtctctgtggtcattcaa

SEQ ID NO: 1041127 - DNA, 22 bp, Artificial Sequence
  chemically synthesized
aagatgaagaaatggctgaatt

SEQ ID NO: 1041128 - DNA, 22 bp, Artificial Sequence
  chemically synthesized
tgtggtcattcaattcagccat

SEQ ID NO: 1041129 - DNA, 22 bp, Artificial Sequence
  chemically synthesized
tggtcattcaattcagccattt

SEQ ID NO: 1041130 - DNA, 22 bp, Artificial Sequence
  chemically synthesized
gatgttgaagatgaagaaatgg

SEQ ID NO: 1041131 - DNA, 22 bp, Artificial Sequence
  chemically synthesized
aattcagccatttcttcatctt

SEQ ID NO: 1041132 - DNA, 22 bp, Artificial Sequence
  chemically synthesized
gtaattggatgttgaagatgaa

SEQ ID NO: 1041133 - DNA, 22 bp, Artificial Sequence
  chemically synthesized
agtaattggatgttgaagatga

SEQ ID NO: 1041134 - DNA, 22 bp, Artificial Sequence
  chemically synthesized
agccatttcttcatcttcaaca

SEQ ID NO: 1041135 - DNA, 22 bp, Artificial Sequence
  chemically synthesized
tttagtaattggatgttgaaga

SEQ ID NO: 1041136 - DNA, 22 bp, Artificial Sequence
  chemically synthesized
atttagtaattggatgttgaag

SEQ ID NO: 1041137 - DNA, 22 bp, Artificial Sequence
  chemically synthesized
cttcatcttcaacatccaatta

SEQ ID NO: 1041138 - DNA, 22 bp, Artificial Sequence
  chemically synthesized
ttcatcttcaacatccaattac

SEQ ID NO: 1041139 - DNA, 22 bp, Artificial Sequence
  chemically synthesized
catcttcaacatccaattacta

SEQ ID NO: 1041140 - DNA, 22 bp, Artificial Sequence
  chemically synthesized
atcttcaacatccaattactaa

SEQ ID NO: 1041141 - DNA, 22 bp, Artificial Sequence
  chemically synthesized
tagacatccttatttagtaatt

SEQ ID NO: 1041142 - DNA, 22 bp, Artificial Sequence
  chemically synthesized
caacatccaattactaaataag

SEQ ID NO: 1041143 - DNA, 22 bp, Artificial Sequence
  chemically synthesized
aacatccaattactaaataagg

SEQ ID NO: 1041144 - DNA, 22 bp, Artificial Sequence
  chemically synthesized
taaattatagacatccttattt

SEQ ID NO: 1041145 - DNA, 22 bp, Artificial Sequence
  chemically synthesized
gtaaattatagacatccttatt

SEQ ID NO: 1041146 - DNA, 22 bp, Artificial Sequence
  chemically synthesized
ctaaataaggatgtctataatt

SEQ ID NO: 1041147 - DNA, 22 bp, Artificial Sequence
  chemically synthesized
aataaggatgtctataatttac

SEQ ID NO: 1041148 - DNA, 22 bp, Artificial Sequence
  chemically synthesized
taatttacaagtgtctttgctc

SEQ ID NO: 1041149 - DNA, 22 bp, Artificial Sequence
  chemically synthesized
ggtatgaaataagggagcaaag

SEQ ID NO: 1041150 - DNA, 22 bp, Artificial Sequence
  chemically synthesized
taggtatgaaataagggagcaa

SEQ ID NO: 1041151 - DNA, 22 bp, Artificial Sequence
  chemically synthesized
ctaggtatgaaataagggagca

SEQ ID NO: 1041152 - DNA, 22 bp, Artificial Sequence
  chemically synthesized
acaagtgtctttgctcccttat

SEQ ID NO: 1041153 - DNA, 22 bp, Artificial Sequence
  chemically synthesized
caagtgtctttgctcccttatt

SEQ ID NO: 1041154 - DNA, 22 bp, Artificial Sequence
  chemically synthesized
tttctaggtatgaaataaggga

SEQ ID NO: 1041155 - DNA, 22 bp, Artificial Sequence
  chemically synthesized
atttctaggtatgaaataaggg

SEQ ID NO: 1041156 - DNA, 22 bp, Artificial Sequence
  chemically synthesized
tgctcccttatttcatacctag

SEQ ID NO: 1041157 - DNA, 22 bp, Artificial Sequence
  chemically synthesized
gctcccttatttcatacctaga

SEQ ID NO: 1041158 - DNA, 22 bp, Artificial Sequence
  chemically synthesized
ctcccttatttcatacctagaa

SEQ ID NO: 1041159 - DNA, 22 bp, Artificial Sequence
  chemically synthesized
ccttatttcatacctagaaata

SEQ ID NO: 1041160 - DNA, 22 bp, Artificial Sequence
  chemically synthesized
atttcatacctagaaataagct

SEQ ID NO: 1041161 - DNA, 22 bp, Artificial Sequence
  chemically synthesized
tttcatacctagaaataagctc

SEQ ID NO: 1041162 - DNA, 22 bp, Artificial Sequence
  chemically synthesized
tgaaggtatatgtgagcttatt

SEQ ID NO: 1041163 - DNA, 22 bp, Artificial Sequence
  chemically synthesized
gtgaaggtatatgtgagcttat

SEQ ID NO: 1041164 - DNA, 22 bp, Artificial Sequence
  chemically synthesized
catacctagaaataagctcaca

SEQ ID NO: 1041165 - DNA, 22 bp, Artificial Sequence
  chemically synthesized
atacctagaaataagctcacat

SEQ ID NO: 1041166 - DNA, 22 bp, Artificial Sequence
  chemically synthesized
tagatttgtgaaggtatatgtg

SEQ ID NO: 1041167 - DNA, 22 bp, Artificial Sequence
  chemically synthesized
gaaataagctcacatatacctt

SEQ ID NO: 1041168 - DNA, 22 bp, Artificial Sequence
  chemically synthesized
gaaagagttgtagatttgtgaa

SEQ ID NO: 1041169 - DNA, 22 bp, Artificial Sequence
  chemically synthesized
ggaaagagttgtagatttgtga

SEQ ID NO: 1041170 - DNA, 22 bp, Artificial Sequence
  chemically synthesized
acatataccttcacaaatctac

SEQ ID NO: 1041171 - DNA, 22 bp, Artificial Sequence
  chemically synthesized
aaatcttggaaagagttgtaga

SEQ ID NO: 1041172 - DNA, 22 bp, Artificial Sequence
  chemically synthesized
aaaatcttggaaagagttgtag

SEQ ID NO: 1041173 - DNA, 22 bp, Artificial Sequence
  chemically synthesized
tttaaaatcttggaaagagttg

SEQ ID NO: 1041174 - DNA, 22 bp, Artificial Sequence
  chemically synthesized
cacaaatctacaactctttcca

SEQ ID NO: 1041175 - DNA, 22 bp, Artificial Sequence
  chemically synthesized
acaaatctacaactctttccaa

SEQ ID NO: 1041176 - DNA, 22 bp, Artificial Sequence
  chemically synthesized
caactctttccaagattttaaa

SEQ ID NO: 1041177 - DNA, 22 bp, Artificial Sequence
  chemically synthesized
tttccaagattttaaataatat

SEQ ID NO: 1041178 - DNA, 22 bp, Artificial Sequence
  chemically synthesized
tccaagattttaaataatatgt

SEQ ID NO: 1041179 - DNA, 22 bp, Artificial Sequence
  chemically synthesized
ccaagattttaaataatatgtc

SEQ ID NO: 1041180 - DNA, 22 bp, Artificial Sequence
  chemically synthesized
caagattttaaataatatgtcc

SEQ ID NO: 1041181 - DNA, 22 bp, Artificial Sequence
  chemically synthesized
tatatacatcccacagtggaca

SEQ ID NO: 1041182 - DNA, 22 bp, Artificial Sequence
  chemically synthesized
gtatatacatcccacagtggac

SEQ ID NO: 1041183 - DNA, 22 bp, Artificial Sequence
  chemically synthesized
taaataatatgtccactgtggg

SEQ ID NO: 1041184 - DNA, 22 bp, Artificial Sequence
  chemically synthesized
aaataatatgtccactgtggga

SEQ ID NO: 1041185 - DNA, 22 bp, Artificial Sequence
  chemically synthesized
aataatatgtccactgtgggat

SEQ ID NO: 1041186 - DNA, 22 bp, Artificial Sequence
  chemically synthesized
atgtttgtatatacatcccaca

SEQ ID NO: 1041187 - DNA, 22 bp, Artificial Sequence
  chemically synthesized
gccaattaatgtttgtatatac

SEQ ID NO: 1041188 - DNA, 22 bp, Artificial Sequence
  chemically synthesized
tgggatgtatatacaaacatta

SEQ ID NO: 1041189 - DNA, 22 bp, Artificial Sequence
  chemically synthesized
aacagaagacaaattagccaat

SEQ ID NO: 1041190 - DNA, 22 bp, Artificial Sequence
  chemically synthesized
ttaaacagaagacaaattagcc

SEQ ID NO: 1041191 - DNA, 22 bp, Artificial Sequence
  chemically synthesized
attggctaatttgtcttctgtt

SEQ ID NO: 1041192 - DNA, 22 bp, Artificial Sequence
  chemically synthesized
aggaaaaactgttaaacagaag

SEQ ID NO: 1041193 - DNA, 22 bp, Artificial Sequence
  chemically synthesized
gctaatttgtcttctgtttaac

SEQ ID NO: 1041194 - DNA, 22 bp, Artificial Sequence
  chemically synthesized
ctgaggaaaaactgttaaacag

SEQ ID NO: 1041195 - DNA, 22 bp, Artificial Sequence
  chemically synthesized
atttgtcttctgtttaacagtt

SEQ ID NO: 1041196 - DNA, 22 bp, Artificial Sequence
  chemically synthesized
ttactgaggaaaaactgttaaa

SEQ ID NO: 1041197 - DNA, 22 bp, Artificial Sequence
  chemically synthesized
attactgaggaaaaactgttaa

SEQ ID NO: 1041198 - DNA, 22 bp, Artificial Sequence
  chemically synthesized
tattactgaggaaaaactgtta

SEQ ID NO: 1041199 - DNA, 22 bp, Artificial Sequence
  chemically synthesized
gtcttctgtttaacagtttttc

SEQ ID NO: 1041200 - DNA, 22 bp, Artificial Sequence
  chemically synthesized
tcttctgtttaacagtttttcc

SEQ ID NO: 1041201 - DNA, 22 bp, Artificial Sequence
  chemically synthesized
ctgtttaacagtttttcctcag

SEQ ID NO: 1041202 - DNA, 22 bp, Artificial Sequence
  chemically synthesized
tgtttaacagtttttcctcagt

SEQ ID NO: 1041203 - DNA, 22 bp, Artificial Sequence
  chemically synthesized
tttaacagtttttcctcagtaa

SEQ ID NO: 1041204 - DNA, 22 bp, Artificial Sequence
  chemically synthesized
atgtaaaattttattactgagg

SEQ ID NO: 1041205 - DNA, 22 bp, Artificial Sequence
  chemically synthesized
aacagtttttcctcagtaataa

SEQ ID NO: 1041206 - DNA, 22 bp, Artificial Sequence
  chemically synthesized
tgatgtaaaattttattactga

SEQ ID NO: 1041207 - DNA, 22 bp, Artificial Sequence
  chemically synthesized
acagtttttcctcagtaataaa

SEQ ID NO: 1041208 - DNA, 22 bp, Artificial Sequence
  chemically synthesized
ctgatgtaaaattttattactg

SEQ ID NO: 1041209 - DNA, 22 bp, Artificial Sequence
  chemically synthesized
ttcctcagtaataaaattttac

SEQ ID NO: 1041210 - DNA, 22 bp, Artificial Sequence
  chemically synthesized
acaacttctgatgtaaaatttt

SEQ ID NO: 1041211 - DNA, 22 bp, Artificial Sequence
  chemically synthesized
tcctcagtaataaaattttaca

SEQ ID NO: 1041212 - DNA, 22 bp, Artificial Sequence
  chemically synthesized
cctcagtaataaaattttacat

SEQ ID NO: 1041213 - DNA, 22 bp, Artificial Sequence
  chemically synthesized
ctcagtaataaaattttacatc

SEQ ID NO: 1041214 - DNA, 22 bp, Artificial Sequence
  chemically synthesized
agtaataaaattttacatcaga

SEQ ID NO: 1041215 - DNA, 22 bp, Artificial Sequence
  chemically synthesized
agagaacactcacaacttctga

SEQ ID NO: 1041216 - DNA, 22 bp, Artificial Sequence
  chemically synthesized
actgagagaacactcacaactt

SEQ ID NO: 1041217 - DNA, 22 bp, Artificial Sequence
  chemically synthesized
gactgagagaacactcacaact

SEQ ID NO: 1041218 - DNA, 22 bp, Artificial Sequence
  chemically synthesized
tgactgagagaacactcacaac

SEQ ID NO: 1041219 - DNA, 22 bp, Artificial Sequence
  chemically synthesized
ttgactgagagaacactcacaa

SEQ ID NO: 1041220 - DNA, 22 bp, Artificial Sequence
  chemically synthesized
tacatcagaagttgtgagtgtt

SEQ ID NO: 1041221 - DNA, 22 bp, Artificial Sequence
  chemically synthesized
acatcagaagttgtgagtgttc

SEQ ID NO: 1041222 - DNA, 22 bp, Artificial Sequence
  chemically synthesized
catcagaagttgtgagtgttct

SEQ ID NO: 1041223 - DNA, 22 bp, Artificial Sequence
  chemically synthesized
aaatttttgactgagagaacac

SEQ ID NO: 1041224 - DNA, 22 bp, Artificial Sequence
  chemically synthesized
attgaaatttttgactgagaga

SEQ ID NO: 1041225 - DNA, 22 bp, Artificial Sequence
  chemically synthesized
taattgaaatttttgactgaga

SEQ ID NO: 1041226 - DNA, 22 bp, Artificial Sequence
  chemically synthesized
ctaattgaaatttttgactgag

SEQ ID NO: 1041227 - DNA, 22 bp, Artificial Sequence
  chemically synthesized
tctaattgaaatttttgactga

SEQ ID NO: 1041228 - DNA, 22 bp, Artificial Sequence
  chemically synthesized
tgagtgttctctcagtcaaaaa

SEQ ID NO: 1041229 - DNA, 22 bp, Artificial Sequence
  chemically synthesized
ttctaattgaaatttttgactg

SEQ ID NO: 1041230 - DNA, 22 bp, Artificial Sequence
  chemically synthesized
tttctaattgaaatttttgact

SEQ ID NO: 1041231 - DNA, 22 bp, Artificial Sequence
  chemically synthesized
ttttctaattgaaatttttgac

SEQ ID NO: 1041232 - DNA, 22 bp, Artificial Sequence
  chemically synthesized
tctcagtcaaaaatttcaatta

SEQ ID NO: 1041233 - DNA, 22 bp, Artificial Sequence
  chemically synthesized
aagacttttttctaattgaaat

SEQ ID NO: 1041234 - DNA, 22 bp, Artificial Sequence
  chemically synthesized
gaagacttttttctaattgaaa

SEQ ID NO: 1041235 - DNA, 22 bp, Artificial Sequence
  chemically synthesized
tcagtcaaaaatttcaattaga

SEQ ID NO: 1041236 - DNA, 22 bp, Artificial Sequence
  chemically synthesized
agtcaaaaatttcaattagaaa

SEQ ID NO: 1041237 - DNA, 22 bp, Artificial Sequence
  chemically synthesized
atttgaagacttttttctaatt

SEQ ID NO: 1041238 - DNA, 22 bp, Artificial Sequence
  chemically synthesized
catttgaagacttttttctaat

SEQ ID NO: 1041239 - DNA, 22 bp, Artificial Sequence
  chemically synthesized
tttcatttgaagacttttttct

SEQ ID NO: 1041240 - DNA, 22 bp, Artificial Sequence
  chemically synthesized
atttcatttgaagacttttttc

SEQ ID NO: 1041241 - DNA, 22 bp, Artificial Sequence
  chemically synthesized
tatttcatttgaagactttttt

SEQ ID NO: 1041242 - DNA, 22 bp, Artificial Sequence
  chemically synthesized
caattagaaaaaagtcttcaaa

SEQ ID NO: 1041243 - DNA, 22 bp, Artificial Sequence
  chemically synthesized
aattagaaaaaagtcttcaaat

SEQ ID NO: 1041244 - DNA, 22 bp, Artificial Sequence
  chemically synthesized
aaattttatttcatttgaagac

SEQ ID NO: 1041245 - DNA, 22 bp, Artificial Sequence
  chemically synthesized
gaaattttatttcatttgaaga

SEQ ID NO: 1041246 - DNA, 22 bp, Artificial Sequence
  chemically synthesized
gaaaaaagtcttcaaatgaaat

SEQ ID NO: 1041247 - DNA, 22 bp, Artificial Sequence
  chemically synthesized
tacatttgaaattttatttcat

SEQ ID NO: 1041248 - DNA, 22 bp, Artificial Sequence
  chemically synthesized
atacatttgaaattttatttca

SEQ ID NO: 1041249 - DNA, 22 bp, Artificial Sequence
  chemically synthesized
tatacatttgaaattttatttc

SEQ ID NO: 1041250 - DNA, 22 bp, Artificial Sequence
  chemically synthesized
ttatacatttgaaattttattt

SEQ ID NO: 1041251 - DNA, 22 bp, Artificial Sequence
  chemically synthesized
tgcttttatacatttgaaattt

SEQ ID NO: 1041252 - DNA, 22 bp, Artificial Sequence
  chemically synthesized
caaatgaaataaaatttcaaat

SEQ ID NO: 1041253 - DNA, 22 bp, Artificial Sequence
  chemically synthesized
atgcttttatacatttgaaatt

SEQ ID NO: 1041254 - DNA, 22 bp, Artificial Sequence
  chemically synthesized
aaatgaaataaaatttcaaatg

SEQ ID NO: 1041255 - DNA, 22 bp, Artificial Sequence
  chemically synthesized
acttatgcttttatacatttga

SEQ ID NO: 1041256 - DNA, 22 bp, Artificial Sequence
  chemically synthesized
aacttatgcttttatacatttg

SEQ ID NO: 1041257 - DNA, 22 bp, Artificial Sequence
  chemically synthesized
taacttatgcttttatacattt

SEQ ID NO: 1041258 - DNA, 22 bp, Artificial Sequence
  chemically synthesized
tattttaacttatgcttttata

SEQ ID NO: 1041259 - DNA, 22 bp, Artificial Sequence
  chemically synthesized
atattttaacttatgcttttat

SEQ ID NO: 1041260 - DNA, 22 bp, Artificial Sequence
  chemically synthesized
tcttatattttaacttatgctt

SEQ ID NO: 1041261 - DNA, 22 bp, Artificial Sequence
  chemically synthesized
caaatgtataaaagcataagtt

SEQ ID NO: 1041262 - DNA, 22 bp, Artificial Sequence
  chemically synthesized
aaatgtataaaagcataagtta

SEQ ID NO: 1041263 - DNA, 22 bp, Artificial Sequence
  chemically synthesized
atattatcttatattttaactt

SEQ ID NO: 1041264 - DNA, 22 bp, Artificial Sequence
  chemically synthesized
catattatcttatattttaact

SEQ ID NO: 1041265 - DNA, 22 bp, Artificial Sequence
  chemically synthesized
aaacaacaatttcatattatct

SEQ ID NO: 1041266 - DNA, 22 bp, Artificial Sequence
  chemically synthesized
aaatataagataatatgaaatt

SEQ ID NO: 1041267 - DNA, 22 bp, Artificial Sequence
  chemically synthesized
aggggaaaatgccctgaaacaa

SEQ ID NO: 1041268 - DNA, 22 bp, Artificial Sequence
  chemically synthesized
caggggaaaatgccctgaaaca

SEQ ID NO: 1041269 - DNA, 22 bp, Artificial Sequence
  chemically synthesized
tcaggggaaaatgccctgaaac

SEQ ID NO: 1041270 - DNA, 22 bp, Artificial Sequence
  chemically synthesized
aagtcattttcaggggaaaatg

SEQ ID NO: 1041271 - DNA, 22 bp, Artificial Sequence
  chemically synthesized
ttgtttcagggcattttcccct

SEQ ID NO: 1041272 - DNA, 22 bp, Artificial Sequence
  chemically synthesized
tttcagggcattttcccctgaa

SEQ ID NO: 1041273 - DNA, 22 bp, Artificial Sequence
  chemically synthesized
cagggcattttcccctgaaaat

SEQ ID NO: 1041274 - DNA, 22 bp, Artificial Sequence
  chemically synthesized
agggcattttcccctgaaaatg

SEQ ID NO: 1041275 - DNA, 22 bp, Artificial Sequence
  chemically synthesized
tcccctgaaaatgacttcagta

SEQ ID NO: 1041276 - DNA, 22 bp, Artificial Sequence
  chemically synthesized
cccctgaaaatgacttcagtat

SEQ ID NO: 1041277 - DNA, 22 bp, Artificial Sequence
  chemically synthesized
ccctgaaaatgacttcagtatt

SEQ ID NO: 1041278 - DNA, 22 bp, Artificial Sequence
  chemically synthesized
aaaatgacttcagtatttcgat

SEQ ID NO: 1041279 - DNA, 22 bp, Artificial Sequence
  chemically synthesized
aaaccagaatatcatcgaaata

SEQ ID NO: 1041280 - DNA, 22 bp, Artificial Sequence
  chemically synthesized
caaaccagaatatcatcgaaat

SEQ ID NO: 1041281 - DNA, 22 bp, Artificial Sequence
  chemically synthesized
cagtatttcgatgatattctgg

SEQ ID NO: 1041282 - DNA, 22 bp, Artificial Sequence
  chemically synthesized
agtatttcgatgatattctggt

SEQ ID NO: 1041283 - DNA, 22 bp, Artificial Sequence
  chemically synthesized
aatatatttcaaaccagaatat

SEQ ID NO: 1041284 - DNA, 22 bp, Artificial Sequence
  chemically synthesized
cgatgatattctggtttgaaat

SEQ ID NO: 1041285 - DNA, 22 bp, Artificial Sequence
  chemically synthesized
gatgatattctggtttgaaata

SEQ ID NO: 1041286 - DNA, 22 bp, Artificial Sequence
  chemically synthesized
aaaaataaagttcaatatattt

SEQ ID NO: 1041287 - DNA, 22 bp, Artificial Sequence
  chemically synthesized
aaaaaataaagttcaatatatt

SEQ ID NO: 1041288 - DNA, 22 bp, Artificial Sequence
  chemically synthesized
taaaaaataaagttcaatatat

SEQ ID NO: 1041289 - DNA, 22 bp, Artificial Sequence
  chemically synthesized
ttaaaaaataaagttcaatata

SEQ ID NO: 1041290 - DNA, 22 bp, Artificial Sequence
  chemically synthesized
tggtttgaaatatattgaactt

SEQ ID NO: 1041291 - DNA, 22 bp, Artificial Sequence
  chemically synthesized
ttttaaaaaataaagttcaata

SEQ ID NO: 1041292 - DNA, 22 bp, Artificial Sequence
  chemically synthesized
cttttaaaaaataaagttcaat

SEQ ID NO: 1041293 - DNA, 22 bp, Artificial Sequence
  chemically synthesized
gtttgaaatatattgaacttta

SEQ ID NO: 1041294 - DNA, 22 bp, Artificial Sequence
  chemically synthesized
gaaatatattgaactttatttt

SEQ ID NO: 1041295 - DNA, 22 bp, Artificial Sequence
  chemically synthesized
aaatatattgaactttattttt

SEQ ID NO: 1041296 - DNA, 22 bp, Artificial Sequence
  chemically synthesized
tcacttcttttaaaaaataaag

SEQ ID NO: 1041297 - DNA, 22 bp, Artificial Sequence
  chemically synthesized
atcacttcttttaaaaaataaa

SEQ ID NO: 1041298 - DNA, 22 bp, Artificial Sequence
  chemically synthesized
tatcacttcttttaaaaaataa

SEQ ID NO: 1041299 - DNA, 22 bp, Artificial Sequence
  chemically synthesized
aactttattttttaaaagaagt

SEQ ID NO: 1041300 - DNA, 22 bp, Artificial Sequence
  chemically synthesized
gaaagcaattttatcacttctt

SEQ ID NO: 1041301 - DNA, 22 bp, Artificial Sequence
  chemically synthesized
tattttttaaaagaagtgataa

SEQ ID NO: 1041302 - DNA, 22 bp, Artificial Sequence
  chemically synthesized
attttttaaaagaagtgataaa

SEQ ID NO: 1041303 - DNA, 22 bp, Artificial Sequence
  chemically synthesized
ttttttaaaagaagtgataaaa

SEQ ID NO: 1041304 - DNA, 22 bp, Artificial Sequence
  chemically synthesized
tttaaaagaagtgataaaattg

SEQ ID NO: 1041305 - DNA, 22 bp, Artificial Sequence
  chemically synthesized
ttaaaagaagtgataaaattgc

SEQ ID NO: 1041306 - DNA, 22 bp, Artificial Sequence
  chemically synthesized
taaaagaagtgataaaattgct

SEQ ID NO: 1041307 - DNA, 22 bp, Artificial Sequence
  chemically synthesized
aaaagaagtgataaaattgctt

SEQ ID NO: 1041308 - DNA, 22 bp, Artificial Sequence
  chemically synthesized
aaagaagtgataaaattgcttt

SEQ ID NO: 1041309 - DNA, 22 bp, Artificial Sequence
  chemically synthesized
agaaaccattagaaagcaattt

SEQ ID NO: 1041310 - DNA, 22 bp, Artificial Sequence
  chemically synthesized
agagaaatgaaaactgagaaac

SEQ ID NO: 1041311 - DNA, 22 bp, Artificial Sequence
  chemically synthesized
cagagaaatgaaaactgagaaa

SEQ ID NO: 1041312 - DNA, 22 bp, Artificial Sequence
  chemically synthesized
ctttctaatggtttctcagttt

SEQ ID NO: 1041313 - DNA, 22 bp, Artificial Sequence
  chemically synthesized
tctaatggtttctcagttttca

SEQ ID NO: 1041314 - DNA, 22 bp, Artificial Sequence
  chemically synthesized
ctaatggtttctcagttttcat

SEQ ID NO: 1041315 - DNA, 22 bp, Artificial Sequence
  chemically synthesized
taatggtttctcagttttcatt

SEQ ID NO: 1041316 - DNA, 22 bp, Artificial Sequence
  chemically synthesized
gtccttcagagaaatgaaaact

SEQ ID NO: 1041317 - DNA, 22 bp, Artificial Sequence
  chemically synthesized
atggtttctcagttttcatttc

SEQ ID NO: 1041318 - DNA, 22 bp, Artificial Sequence
  chemically synthesized
atgttagtccttcagagaaatg

SEQ ID NO: 1041319 - DNA, 22 bp, Artificial Sequence
  chemically synthesized
ctcagttttcatttctctgaag

SEQ ID NO: 1041320 - DNA, 22 bp, Artificial Sequence
  chemically synthesized
ctaatgttagtccttcagagaa

SEQ ID NO: 1041321 - DNA, 22 bp, Artificial Sequence
  chemically synthesized
tcagttttcatttctctgaagg

SEQ ID NO: 1041322 - DNA, 22 bp, Artificial Sequence
  chemically synthesized
agttttcatttctctgaaggac

SEQ ID NO: 1041323 - DNA, 22 bp, Artificial Sequence
  chemically synthesized
tctgctaatgttagtccttcag

SEQ ID NO: 1041324 - DNA, 22 bp, Artificial Sequence
  chemically synthesized
tcatttctctgaaggactaaca

SEQ ID NO: 1041325 - DNA, 22 bp, Artificial Sequence
  chemically synthesized
catttctctgaaggactaacat

SEQ ID NO: 1041326 - DNA, 22 bp, Artificial Sequence
  chemically synthesized
atttctctgaaggactaacatt

SEQ ID NO: 1041327 - DNA, 22 bp, Artificial Sequence
  chemically synthesized
cagctgtctgctaatgttagtc

SEQ ID NO: 1041328 - DNA, 22 bp, Artificial Sequence
  chemically synthesized
ccagctgtctgctaatgttagt

SEQ ID NO: 1041329 - DNA, 22 bp, Artificial Sequence
  chemically synthesized
ctctgaaggactaacattagca

SEQ ID NO: 1041330 - DNA, 22 bp, Artificial Sequence
  chemically synthesized
tctgaaggactaacattagcag

SEQ ID NO: 1041331 - DNA, 22 bp, Artificial Sequence
  chemically synthesized
tgaaggactaacattagcagac

SEQ ID NO: 1041332 - DNA, 22 bp, Artificial Sequence
  chemically synthesized
aaggactaacattagcagacag

SEQ ID NO: 1041333 - DNA, 22 bp, Artificial Sequence
  chemically synthesized
taagtgcttccagctgtctgct

SEQ ID NO: 1041334 - DNA, 22 bp, Artificial Sequence
  chemically synthesized
acattagcagacagctggaagc

SEQ ID NO: 1041335 - DNA, 22 bp, Artificial Sequence
  chemically synthesized
gcagacagctggaagcacttat

SEQ ID NO: 1041336 - DNA, 22 bp, Artificial Sequence
  chemically synthesized
aaaatgtgaattataagtgctt

SEQ ID NO: 1041337 - DNA, 22 bp, Artificial Sequence
  chemically synthesized
gaagcacttataattcacattt

SEQ ID NO: 1041338 - DNA, 22 bp, Artificial Sequence
  chemically synthesized
aggaaataaatatggttaaaaa

SEQ ID NO: 1041339 - DNA, 22 bp, Artificial Sequence
  chemically synthesized
caggaaataaatatggttaaaa

SEQ ID NO: 1041340 - DNA, 22 bp, Artificial Sequence
  chemically synthesized
ataattcacatttttaaccata

SEQ ID NO: 1041341 - DNA, 22 bp, Artificial Sequence
  chemically synthesized
taattcacatttttaaccatat

SEQ ID NO: 1041342 - DNA, 22 bp, Artificial Sequence
  chemically synthesized
cttcaggaaataaatatggtta

SEQ ID NO: 1041343 - DNA, 22 bp, Artificial Sequence
  chemically synthesized
ccttcaggaaataaatatggtt

SEQ ID NO: 1041344 - DNA, 22 bp, Artificial Sequence
  chemically synthesized
acatttttaaccatatttattt

SEQ ID NO: 1041345 - DNA, 22 bp, Artificial Sequence
  chemically synthesized
ttaaccatatttatttcctgaa

SEQ ID NO: 1041346 - DNA, 22 bp, Artificial Sequence
  chemically synthesized
taaccatatttatttcctgaag

SEQ ID NO: 1041347 - DNA, 22 bp, Artificial Sequence
  chemically synthesized
aaccatatttatttcctgaagg

SEQ ID NO: 1041348 - DNA, 22 bp, Artificial Sequence
  chemically synthesized
accatatttatttcctgaagga

SEQ ID NO: 1041349 - DNA, 22 bp, Artificial Sequence
  chemically synthesized
agtgagtgaataggaatttcct

SEQ ID NO: 1041350 - DNA, 22 bp, Artificial Sequence
  chemically synthesized
atttcctgaaggaaattcctat

SEQ ID NO: 1041351 - DNA, 22 bp, Artificial Sequence
  chemically synthesized
ctaagtgagtgaataggaattt

SEQ ID NO: 1041352 - DNA, 22 bp, Artificial Sequence
  chemically synthesized
tttcctgaaggaaattcctatt

SEQ ID NO: 1041353 - DNA, 22 bp, Artificial Sequence
  chemically synthesized
ttactaagtgagtgaataggaa

SEQ ID NO: 1041354 - DNA, 22 bp, Artificial Sequence
  chemically synthesized
cctgaaggaaattcctattcac

SEQ ID NO: 1041355 - DNA, 22 bp, Artificial Sequence
  chemically synthesized
ctgaaggaaattcctattcact

SEQ ID NO: 1041356 - DNA, 22 bp, Artificial Sequence
  chemically synthesized
aaggaaattcctattcactcac

SEQ ID NO: 1041357 - DNA, 22 bp, Artificial Sequence
  chemically synthesized
ctattcactcacttagtaatag

SEQ ID NO: 1041358 - DNA, 22 bp, Artificial Sequence
  chemically synthesized
ttcactcacttagtaatagctt

SEQ ID NO: 1041359 - DNA, 22 bp, Artificial Sequence
  chemically synthesized
actcacttagtaatagcttccc

SEQ ID NO: 1041360 - DNA, 22 bp, Artificial Sequence
  chemically synthesized
acttagtaatagcttccccatt

SEQ ID NO: 1041361 - DNA, 22 bp, Artificial Sequence
  chemically synthesized
agtaatagcttccccatttcat

SEQ ID NO: 1041362 - DNA, 22 bp, Artificial Sequence
  chemically synthesized
gtaatagcttccccatttcatc

SEQ ID NO: 1041363 - DNA, 22 bp, Artificial Sequence
  chemically synthesized
ccaaggagggaaagatgaaatg

SEQ ID NO: 1041364 - DNA, 22 bp, Artificial Sequence
  chemically synthesized
aatcctgccaaggagggaaaga

SEQ ID NO: 1041365 - DNA, 22 bp, Artificial Sequence
  chemically synthesized
ccccatttcatctttccctcct

SEQ ID NO: 1041366 - DNA, 22 bp, Artificial Sequence
  chemically synthesized
cccatttcatctttccctcctt

SEQ ID NO: 1041367 - DNA, 22 bp, Artificial Sequence
  chemically synthesized
tactgaatcctgccaaggaggg

SEQ ID NO: 1041368 - DNA, 22 bp, Artificial Sequence
  chemically synthesized
actgtactgaatcctgccaagg

SEQ ID NO: 1041369 - DNA, 22 bp, Artificial Sequence
  chemically synthesized
catctttccctccttggcagga

SEQ ID NO: 1041370 - DNA, 22 bp, Artificial Sequence
  chemically synthesized
atctttccctccttggcaggat

SEQ ID NO: 1041371 - DNA, 22 bp, Artificial Sequence
  chemically synthesized
tgcctaactgtactgaatcctg

SEQ ID NO: 1041372 - DNA, 22 bp, Artificial Sequence
  chemically synthesized
tccctccttggcaggattcagt

SEQ ID NO: 1041373 - DNA, 22 bp, Artificial Sequence
  chemically synthesized
ccctccttggcaggattcagta

SEQ ID NO: 1041374 - DNA, 22 bp, Artificial Sequence
  chemically synthesized
cctccttggcaggattcagtac

SEQ ID NO: 1041375 - DNA, 22 bp, Artificial Sequence
  chemically synthesized
cttggcaggattcagtacagtt

SEQ ID NO: 1041376 - DNA, 22 bp, Artificial Sequence
  chemically synthesized
ggcaggattcagtacagttagg

SEQ ID NO: 1041377 - DNA, 22 bp, Artificial Sequence
  chemically synthesized
gcaggattcagtacagttaggc

SEQ ID NO: 1041378 - DNA, 22 bp, Artificial Sequence
  chemically synthesized
tatgatgaaaactgtgcctaac

SEQ ID NO: 1041379 - DNA, 22 bp, Artificial Sequence
  chemically synthesized
agtacagttaggcacagttttc

SEQ ID NO: 1041380 - DNA, 22 bp, Artificial Sequence
  chemically synthesized
ggtctgtatgatgaaaactgtg

SEQ ID NO: 1041381 - DNA, 22 bp, Artificial Sequence
  chemically synthesized
gtgtggctaggtctgtatgatg

SEQ ID NO: 1041382 - DNA, 22 bp, Artificial Sequence
  chemically synthesized
ggcacagttttcatcatacaga

SEQ ID NO: 1041383 - DNA, 22 bp, Artificial Sequence
  chemically synthesized
aaactagtgtggctaggtctgt

SEQ ID NO: 1041384 - DNA, 22 bp, Artificial Sequence
  chemically synthesized
gttaaaactagtgtggctaggt

SEQ ID NO: 1041385 - DNA, 22 bp, Artificial Sequence
  chemically synthesized
tcatcatacagacctagccaca

SEQ ID NO: 1041386 - DNA, 22 bp, Artificial Sequence
  chemically synthesized
catcatacagacctagccacac

SEQ ID NO: 1041387 - DNA, 22 bp, Artificial Sequence
  chemically synthesized
atcatacagacctagccacact

SEQ ID NO: 1041388 - DNA, 22 bp, Artificial Sequence
  chemically synthesized
ctagttaaaactagtgtggcta

SEQ ID NO: 1041389 - DNA, 22 bp, Artificial Sequence
  chemically synthesized
gaagatagtattactagttaaa

SEQ ID NO: 1041390 - DNA, 22 bp, Artificial Sequence
  chemically synthesized
gccacactagttttaactagta

SEQ ID NO: 1041391 - DNA, 22 bp, Artificial Sequence
  chemically synthesized
gttttaactagtaatactatct

SEQ ID NO: 1041392 - DNA, 22 bp, Artificial Sequence
  chemically synthesized
taactagtaatactatcttcta

SEQ ID NO: 1041393 - DNA, 22 bp, Artificial Sequence
  chemically synthesized
aactagtaatactatcttctag

SEQ ID NO: 1041394 - DNA, 22 bp, Artificial Sequence
  chemically synthesized
actagtaatactatcttctagg

SEQ ID NO: 1041395 - DNA, 22 bp, Artificial Sequence
  chemically synthesized
gtaatactatcttctaggtttc

SEQ ID NO: 1041396 - DNA, 22 bp, Artificial Sequence
  chemically synthesized
tcagacacagagagagaaacct

SEQ ID NO: 1041397 - DNA, 22 bp, Artificial Sequence
  chemically synthesized
tcttctaggtttctctctctgt

SEQ ID NO: 1041398 - DNA, 22 bp, Artificial Sequence
  chemically synthesized
ctaggtttctctctctgtgtct

SEQ ID NO: 1041399 - DNA, 22 bp, Artificial Sequence
  chemically synthesized
taggtttctctctctgtgtctg

SEQ ID NO: 1041400 - DNA, 22 bp, Artificial Sequence
  chemically synthesized
ggtttctctctctgtgtctgac

SEQ ID NO: 1041401 - DNA, 22 bp, Artificial Sequence
  chemically synthesized
ctctctctgtgtctgacagcta

SEQ ID NO: 1041402 - DNA, 22 bp, Artificial Sequence
  chemically synthesized
tctctctgtgtctgacagctac

SEQ ID NO: 1041403 - DNA, 22 bp, Artificial Sequence
  chemically synthesized
tctctgtgtctgacagctacat

SEQ ID NO: 1041404 - DNA, 22 bp, Artificial Sequence
  chemically synthesized
tctgtgtctgacagctacatcg

SEQ ID NO: 1041405 - DNA, 22 bp, Artificial Sequence
  chemically synthesized
tgtgtctgacagctacatcgct

SEQ ID NO: 1041406 - DNA, 22 bp, Artificial Sequence
  chemically synthesized
atgaatgaatacagcgatgtag

SEQ ID NO: 1041407 - DNA, 22 bp, Artificial Sequence
  chemically synthesized
tgtctgacagctacatcgctgt

SEQ ID NO: 1041408 - DNA, 22 bp, Artificial Sequence
  chemically synthesized
agttaatgaatgaatacagcga

SEQ ID NO: 1041409 - DNA, 22 bp, Artificial Sequence
  chemically synthesized
gagttaatgaatgaatacagcg

SEQ ID NO: 1041410 - DNA, 22 bp, Artificial Sequence
  chemically synthesized
acagctacatcgctgtattcat

SEQ ID NO: 1041411 - DNA, 22 bp, Artificial Sequence
  chemically synthesized
ttgagttaatgaatgaatacag

SEQ ID NO: 1041412 - DNA, 22 bp, Artificial Sequence
  chemically synthesized
cttgagttaatgaatgaataca

SEQ ID NO: 1041413 - DNA, 22 bp, Artificial Sequence
  chemically synthesized
catcgctgtattcattcattaa

SEQ ID NO: 1041414 - DNA, 22 bp, Artificial Sequence
  chemically synthesized
aacaaatatttcttgagttaat

SEQ ID NO: 1041415 - DNA, 22 bp, Artificial Sequence
  chemically synthesized
caacaaatatttcttgagttaa

SEQ ID NO: 1041416 - DNA, 22 bp, Artificial Sequence
  chemically synthesized
tcaacaaatatttcttgagtta

SEQ ID NO: 1041417 - DNA, 22 bp, Artificial Sequence
  chemically synthesized
tattcattcattaactcaagaa

SEQ ID NO: 1041418 - DNA, 22 bp, Artificial Sequence
  chemically synthesized
ttcaacaaatatttcttgagtt

SEQ ID NO: 1041419 - DNA, 22 bp, Artificial Sequence
  chemically synthesized
tttcaacaaatatttcttgagt

SEQ ID NO: 1041420 - DNA, 22 bp, Artificial Sequence
  chemically synthesized
attcattaactcaagaaatatt

SEQ ID NO: 1041421 - DNA, 22 bp, Artificial Sequence
  chemically synthesized
attaactcaagaaatatttgtt

SEQ ID NO: 1041422 - DNA, 22 bp, Artificial Sequence
  chemically synthesized
atggtaggttttttcaacaaat

SEQ ID NO: 1041423 - DNA, 22 bp, Artificial Sequence
  chemically synthesized
actcaagaaatatttgttgaaa

SEQ ID NO: 1041424 - DNA, 22 bp, Artificial Sequence
  chemically synthesized
tctcatggtaggttttttcaac

SEQ ID NO: 1041425 - DNA, 22 bp, Artificial Sequence
  chemically synthesized
aagaaatatttgttgaaaaaac

SEQ ID NO: 1041426 - DNA, 22 bp, Artificial Sequence
  chemically synthesized
gttgaaaaaacctaccatgaga

SEQ ID NO: 1041427 - DNA, 22 bp, Artificial Sequence
  chemically synthesized
ttgaaaaaacctaccatgagac

SEQ ID NO: 1041428 - DNA, 22 bp, Artificial Sequence
  chemically synthesized
aaaaaacctaccatgagacagt

SEQ ID NO: 1041429 - DNA, 22 bp, Artificial Sequence
  chemically synthesized
ccatgagacagtcatattttat

SEQ ID NO: 1041430 - DNA, 22 bp, Artificial Sequence
  chemically synthesized
tatttatttatttatttattta

SEQ ID NO: 1041431 - DNA, 22 bp, Artificial Sequence
  chemically synthesized
atttatttatttatttatttat

SEQ ID NO: 1041432 - DNA, 22 bp, Artificial Sequence
  chemically synthesized
tttatttatttatttatttatt

SEQ ID NO: 1041433 - DNA, 22 bp, Artificial Sequence
  chemically synthesized
atttatttatttatttatttat

SEQ ID NO: 1041434 - DNA, 22 bp, Artificial Sequence
  chemically synthesized
tttatttatttatttatttatt

SEQ ID NO: 1041435 - DNA, 22 bp, Artificial Sequence
  chemically synthesized
atttatttatttatttatttat

SEQ ID NO: 1041436 - DNA, 22 bp, Artificial Sequence
  chemically synthesized
tttatttatttatttatttatt

SEQ ID NO: 1041437 - DNA, 22 bp, Artificial Sequence
  chemically synthesized
atttatttatttatttatttat

SEQ ID NO: 1041438 - DNA, 22 bp, Artificial Sequence
  chemically synthesized
tttatttatttatttatttatt

SEQ ID NO: 1041439 - DNA, 22 bp, Artificial Sequence
  chemically synthesized
atttatttatttatttattatt

SEQ ID NO: 1041440 - DNA, 22 bp, Artificial Sequence
  chemically synthesized
tttatttatttatttattattt

SEQ ID NO: 1041441 - DNA, 22 bp, Artificial Sequence
  chemically synthesized
caaaataaataaataaataata

SEQ ID NO: 1041442 - DNA, 22 bp, Artificial Sequence
  chemically synthesized
atttatttatttattatttatt

SEQ ID NO: 1041443 - DNA, 22 bp, Artificial Sequence
  chemically synthesized
tttatttatttattatttattt

SEQ ID NO: 1041444 - DNA, 22 bp, Artificial Sequence
  chemically synthesized
tctccaaaataaataaataaat

SEQ ID NO: 1041445 - DNA, 22 bp, Artificial Sequence
  chemically synthesized
atttatttattatttatttatt

SEQ ID NO: 1041446 - DNA, 22 bp, Artificial Sequence
  chemically synthesized
tttatttattatttatttattt

SEQ ID NO: 1041447 - DNA, 22 bp, Artificial Sequence
  chemically synthesized
tgtctccaaaataaataaataa

SEQ ID NO: 1041448 - DNA, 22 bp, Artificial Sequence
  chemically synthesized
atttattatttatttatttatt

SEQ ID NO: 1041449 - DNA, 22 bp, Artificial Sequence
  chemically synthesized
tttattatttatttatttattt

SEQ ID NO: 1041450 - DNA, 22 bp, Artificial Sequence
  chemically synthesized
attatttatttatttattttgg

SEQ ID NO: 1041451 - DNA, 22 bp, Artificial Sequence
  chemically synthesized
ttatttatttatttattttgga

SEQ ID NO: 1041452 - DNA, 22 bp, Artificial Sequence
  chemically synthesized
tttatttatttattttggagac

SEQ ID NO: 1041453 - DNA, 22 bp, Artificial Sequence
  chemically synthesized
atttatttattttggagacaga

SEQ ID NO: 1041454 - DNA, 22 bp, Artificial Sequence
  chemically synthesized
tttatttattttggagacagag

SEQ ID NO: 1041455 - DNA, 22 bp, Artificial Sequence
  chemically synthesized
atttattttggagacagagtct

SEQ ID NO: 1041456 - DNA, 22 bp, Artificial Sequence
  chemically synthesized
ggtgacagagtgagactctgtc

SEQ ID NO: 1041457 - DNA, 22 bp, Artificial Sequence
  chemically synthesized
tttattttggagacagagtctc

SEQ ID NO: 1041458 - DNA, 22 bp, Artificial Sequence
  chemically synthesized
attttggagacagagtctcact

SEQ ID NO: 1041459 - DNA, 22 bp, Artificial Sequence
  chemically synthesized
ttttggagacagagtctcactc

SEQ ID NO: 1041460 - DNA, 22 bp, Artificial Sequence
  chemically synthesized
cagcctgggtgacagagtgaga

SEQ ID NO: 1041461 - DNA, 22 bp, Artificial Sequence
  chemically synthesized
tggagacagagtctcactctgt

SEQ ID NO: 1041462 - DNA, 22 bp, Artificial Sequence
  chemically synthesized
ggagacagagtctcactctgtc

SEQ ID NO: 1041463 - DNA, 22 bp, Artificial Sequence
  chemically synthesized
gagacagagtctcactctgtca

SEQ ID NO: 1041464 - DNA, 22 bp, Artificial Sequence
  chemically synthesized
cattccagcctgggtgacagag

SEQ ID NO: 1041465 - DNA, 22 bp, Artificial Sequence
  chemically synthesized
cgccactgcattccagcctggg

SEQ ID NO: 1041466 - DNA, 22 bp, Artificial Sequence
  chemically synthesized
actctgtcacccaggctggaat

SEQ ID NO: 1041467 - DNA, 22 bp, Artificial Sequence
  chemically synthesized
tgtcacccaggctggaatgcag

SEQ ID NO: 1041468 - DNA, 22 bp, Artificial Sequence
  chemically synthesized
tcacccaggctggaatgcagtg

SEQ ID NO: 1041469 - DNA, 22 bp, Artificial Sequence
  chemically synthesized
cagtgaacagagattgcgccac

SEQ ID NO: 1041470 - DNA, 22 bp, Artificial Sequence
  chemically synthesized
gaatgcagtggcgcaatctctg

SEQ ID NO: 1041471 - DNA, 22 bp, Artificial Sequence
  chemically synthesized
ggaggtggaggttgcagtgaac

SEQ ID NO: 1041472 - DNA, 22 bp, Artificial Sequence
  chemically synthesized
aacctgggaggtggaggttgca

SEQ ID NO: 1041473 - DNA, 22 bp, Artificial Sequence
  chemically synthesized
gaacctgggaggtggaggttgc

SEQ ID NO: 1041474 - DNA, 22 bp, Artificial Sequence
  chemically synthesized
cttgaacctgggaggtggaggt

SEQ ID NO: 1041475 - DNA, 22 bp, Artificial Sequence
  chemically synthesized
tgttcactgcaacctccacctc

SEQ ID NO: 1041476 - DNA, 22 bp, Artificial Sequence
  chemically synthesized
ttcactgcaacctccacctccc

SEQ ID NO: 1041477 - DNA, 22 bp, Artificial Sequence
  chemically synthesized
actgcaacctccacctcccagg

SEQ ID NO: 1041478 - DNA, 22 bp, Artificial Sequence
  chemically synthesized
caacctccacctcccaggttca

SEQ ID NO: 1041479 - DNA, 22 bp, Artificial Sequence
  chemically synthesized
aggcaggagaattgcttgaacc

SEQ ID NO: 1041480 - DNA, 22 bp, Artificial Sequence
  chemically synthesized
cacctcccaggttcaagcaatt

SEQ ID NO: 1041481 - DNA, 22 bp, Artificial Sequence
  chemically synthesized
ccaggttcaagcaattctcctg

SEQ ID NO: 1041482 - DNA, 22 bp, Artificial Sequence
  chemically synthesized
gggaggctgaggcaggagaatt

SEQ ID NO: 1041483 - DNA, 22 bp, Artificial Sequence
  chemically synthesized
ctcgggaggctgaggcaggaga

SEQ ID NO: 1041484 - DNA, 22 bp, Artificial Sequence
  chemically synthesized
aagcaattctcctgcctcagcc

SEQ ID NO: 1041485 - DNA, 22 bp, Artificial Sequence
  chemically synthesized
taatcccagctactcgggaggc

SEQ ID NO: 1041486 - DNA, 22 bp, Artificial Sequence
  chemically synthesized
tcctgcctcagcctcccgagta

SEQ ID NO: 1041487 - DNA, 22 bp, Artificial Sequence
  chemically synthesized
ctgcctcagcctcccgagtagc

SEQ ID NO: 1041488 - DNA, 22 bp, Artificial Sequence
  chemically synthesized
cctcagcctcccgagtagctgg

SEQ ID NO: 1041489 - DNA, 22 bp, Artificial Sequence
  chemically synthesized
agcctcccgagtagctgggatt

SEQ ID NO: 1041490 - DNA, 22 bp, Artificial Sequence
  chemically synthesized
ccgagtagctgggattacaggc

SEQ ID NO: 1041491 - DNA, 22 bp, Artificial Sequence
  chemically synthesized
gccgggcatggtggcgggcgcc

SEQ ID NO: 1041492 - DNA, 22 bp, Artificial Sequence
  chemically synthesized
ggattacaggcgcccgccacca

SEQ ID NO: 1041493 - DNA, 22 bp, Artificial Sequence
  chemically synthesized
caggcgcccgccaccatgcccg

SEQ ID NO: 1041494 - DNA, 22 bp, Artificial Sequence
  chemically synthesized
aaaatacaaaaaattagccggg

SEQ ID NO: 1041495 - DNA, 22 bp, Artificial Sequence
  chemically synthesized
ctaaaaatacaaaaaattagcc

SEQ ID NO: 1041496 - DNA, 22 bp, Artificial Sequence
  chemically synthesized
tactaaaaatacaaaaaattag

SEQ ID NO: 1041497 - DNA, 22 bp, Artificial Sequence
  chemically synthesized
attttttgtatttttagtagag

SEQ ID NO: 1041498 - DNA, 22 bp, Artificial Sequence
  chemically synthesized
tttgtatttttagtagagatcg

SEQ ID NO: 1041499 - DNA, 22 bp, Artificial Sequence
  chemically synthesized
ttgtatttttagtagagatcgg

SEQ ID NO: 1041500 - DNA, 22 bp, Artificial Sequence
  chemically synthesized
tgtatttttagtagagatcggg

SEQ ID NO: 1041501 - DNA, 22 bp, Artificial Sequence
  chemically synthesized
gtatttttagtagagatcgggt

SEQ ID NO: 1041502 - DNA, 22 bp, Artificial Sequence
  chemically synthesized
tatttttagtagagatcgggtt

SEQ ID NO: 1041503 - DNA, 22 bp, Artificial Sequence
  chemically synthesized
gccaacgtaatggaacccgatc

SEQ ID NO: 1041504 - DNA, 22 bp, Artificial Sequence
  chemically synthesized
ttagtagagatcgggttccatt

SEQ ID NO: 1041505 - DNA, 22 bp, Artificial Sequence
  chemically synthesized
tagtagagatcgggttccatta

SEQ ID NO: 1041506 - DNA, 22 bp, Artificial Sequence
  chemically synthesized
agtagagatcgggttccattac

SEQ ID NO: 1041507 - DNA, 22 bp, Artificial Sequence
  chemically synthesized
gtagagatcgggttccattacg

SEQ ID NO: 1041508 - DNA, 22 bp, Artificial Sequence
  chemically synthesized
aataccagcctggccaacgtaa

SEQ ID NO: 1041509 - DNA, 22 bp, Artificial Sequence
  chemically synthesized
cattacgttggccaggctggta

SEQ ID NO: 1041510 - DNA, 22 bp, Artificial Sequence
  chemically synthesized
cgttggccaggctggtattgaa

SEQ ID NO: 1041511 - DNA, 22 bp, Artificial Sequence
  chemically synthesized
gccaggctggtattgaactcct

SEQ ID NO: 1041512 - DNA, 22 bp, Artificial Sequence
  chemically synthesized
gtattgaactcctgaccctgtg

SEQ ID NO: 1041513 - DNA, 22 bp, Artificial Sequence
  chemically synthesized
aactcctgaccctgtggtcacc

SEQ ID NO: 1041514 - DNA, 22 bp, Artificial Sequence
  chemically synthesized
ggaggccaaggcgggtgaccac

SEQ ID NO: 1041515 - DNA, 22 bp, Artificial Sequence
  chemically synthesized
gggaggccaaggcgggtgacca

SEQ ID NO: 1041516 - DNA, 22 bp, Artificial Sequence
  chemically synthesized
tgggaggccaaggcgggtgacc

SEQ ID NO: 1041517 - DNA, 22 bp, Artificial Sequence
  chemically synthesized
ctgaccctgtggtcacccgcct

SEQ ID NO: 1041518 - DNA, 22 bp, Artificial Sequence
  chemically synthesized
accctgtggtcacccgccttgg

SEQ ID NO: 1041519 - DNA, 22 bp, Artificial Sequence
  chemically synthesized
tggtcacccgccttggcctccc

SEQ ID NO: 1041520 - DNA, 22 bp, Artificial Sequence
  chemically synthesized
taatcccagcactttgggaggc

SEQ ID NO: 1041521 - DNA, 22 bp, Artificial Sequence
  chemically synthesized
acgcctgtaatcccagcacttt

SEQ ID NO: 1041522 - DNA, 22 bp, Artificial Sequence
  chemically synthesized
ggcctcccaaagtgctgggatt

SEQ ID NO: 1041523 - DNA, 22 bp, Artificial Sequence
  chemically synthesized
gcctcccaaagtgctgggatta

SEQ ID NO: 1041524 - DNA, 22 bp, Artificial Sequence
  chemically synthesized
ccaaagtgctgggattacaggc

SEQ ID NO: 1041525 - DNA, 22 bp, Artificial Sequence
  chemically synthesized
ggcgcggtggctcacgcctgta

SEQ ID NO: 1041526 - DNA, 22 bp, Artificial Sequence
  chemically synthesized
aggctgggcgcggtggctcacg

SEQ ID NO: 1041527 - DNA, 22 bp, Artificial Sequence
  chemically synthesized
ggattacaggcgtgagccaccg

SEQ ID NO: 1041528 - DNA, 22 bp, Artificial Sequence
  chemically synthesized
tctcaggctgggcgcggtggct

SEQ ID NO: 1041529 - DNA, 22 bp, Artificial Sequence
  chemically synthesized
caggcgtgagccaccgcgccca

SEQ ID NO: 1041530 - DNA, 22 bp, Artificial Sequence
  chemically synthesized
gtatatacccaagatataatat

SEQ ID NO: 1041531 - DNA, 22 bp, Artificial Sequence
  chemically synthesized
agacagtcatatattatatctt

SEQ ID NO: 1041532 - DNA, 22 bp, Artificial Sequence
  chemically synthesized
gatcactagtatatacccaaga

SEQ ID NO: 1041533 - DNA, 22 bp, Artificial Sequence
  chemically synthesized
tggatcactagtatatacccaa

SEQ ID NO: 1041534 - DNA, 22 bp, Artificial Sequence
  chemically synthesized
ctggatcactagtatataccca

SEQ ID NO: 1041535 - DNA, 22 bp, Artificial Sequence
  chemically synthesized
tctggatcactagtatataccc

SEQ ID NO: 1041536 - DNA, 22 bp, Artificial Sequence
  chemically synthesized
ctttctggatcactagtatata

SEQ ID NO: 1041537 - DNA, 22 bp, Artificial Sequence
  chemically synthesized
gctttctggatcactagtatat

SEQ ID NO: 1041538 - DNA, 22 bp, Artificial Sequence
  chemically synthesized
tgctttctggatcactagtata

SEQ ID NO: 1041539 - DNA, 22 bp, Artificial Sequence
  chemically synthesized
tatcttgggtatatactagtga

SEQ ID NO: 1041540 - DNA, 22 bp, Artificial Sequence
  chemically synthesized
ttgctttctggatcactagtat

SEQ ID NO: 1041541 - DNA, 22 bp, Artificial Sequence
  chemically synthesized
gggtatatactagtgatccaga

SEQ ID NO: 1041542 - DNA, 22 bp, Artificial Sequence
  chemically synthesized
ggtatatactagtgatccagaa

SEQ ID NO: 1041543 - DNA, 22 bp, Artificial Sequence
  chemically synthesized
cagagagcggggcttttgcttt

SEQ ID NO: 1041544 - DNA, 22 bp, Artificial Sequence
  chemically synthesized
gtgatccagaaagcaaaagccc

SEQ ID NO: 1041545 - DNA, 22 bp, Artificial Sequence
  chemically synthesized
tagaaggtgagattccagagag

SEQ ID NO: 1041546 - DNA, 22 bp, Artificial Sequence
  chemically synthesized
ctgtagaaggtgagattccaga

SEQ ID NO: 1041547 - DNA, 22 bp, Artificial Sequence
  chemically synthesized
tcctgtagaaggtgagattcca

SEQ ID NO: 1041548 - DNA, 22 bp, Artificial Sequence
  chemically synthesized
ttctcctgtagaaggtgagatt

SEQ ID NO: 1041549 - DNA, 22 bp, Artificial Sequence
  chemically synthesized
attctcctgtagaaggtgagat

SEQ ID NO: 1041550 - DNA, 22 bp, Artificial Sequence
  chemically synthesized
tattctcctgtagaaggtgaga

SEQ ID NO: 1041551 - DNA, 22 bp, Artificial Sequence
  chemically synthesized
ctttattctcctgtagaaggtg

SEQ ID NO: 1041552 - DNA, 22 bp, Artificial Sequence
  chemically synthesized
actttattctcctgtagaaggt

SEQ ID NO: 1041553 - DNA, 22 bp, Artificial Sequence
  chemically synthesized
tctggaatctcaccttctacag

SEQ ID NO: 1041554 - DNA, 22 bp, Artificial Sequence
  chemically synthesized
tggaatctcaccttctacagga

SEQ ID NO: 1041555 - DNA, 22 bp, Artificial Sequence
  chemically synthesized
tttactttattctcctgtagaa

SEQ ID NO: 1041556 - DNA, 22 bp, Artificial Sequence
  chemically synthesized
gtttactttattctcctgtaga

SEQ ID NO: 1041557 - DNA, 22 bp, Artificial Sequence
  chemically synthesized
gaatctcaccttctacaggaga

SEQ ID NO: 1041558 - DNA, 22 bp, Artificial Sequence
  chemically synthesized
tttgtttactttattctcctgt

SEQ ID NO: 1041559 - DNA, 22 bp, Artificial Sequence
  chemically synthesized
tatttgtttactttattctcct

SEQ ID NO: 1041560 - DNA, 22 bp, Artificial Sequence
  chemically synthesized
tctatttgtttactttattctc

SEQ ID NO: 1041561 - DNA, 22 bp, Artificial Sequence
  chemically synthesized
accttctacaggagaataaagt

SEQ ID NO: 1041562 - DNA, 22 bp, Artificial Sequence
  chemically synthesized
ctctatttgtttactttattct

SEQ ID NO: 1041563 - DNA, 22 bp, Artificial Sequence
  chemically synthesized
ctacaggagaataaagtaaaca

SEQ ID NO: 1041564 - DNA, 22 bp, Artificial Sequence
  chemically synthesized
tacaggagaataaagtaaacaa

SEQ ID NO: 1041565 - DNA, 22 bp, Artificial Sequence
  chemically synthesized
gtcatttctctatttgtttact

SEQ ID NO: 1041566 - DNA, 22 bp, Artificial Sequence
  chemically synthesized
caggagaataaagtaaacaaat

SEQ ID NO: 1041567 - DNA, 22 bp, Artificial Sequence
  chemically synthesized
agtcatttctctatttgtttac

SEQ ID NO: 1041568 - DNA, 22 bp, Artificial Sequence
  chemically synthesized
agtatatagtttagtcatttct

SEQ ID NO: 1041569 - DNA, 22 bp, Artificial Sequence
  chemically synthesized
actgagtatatagtttagtcat

SEQ ID NO: 1041570 - DNA, 22 bp, Artificial Sequence
  chemically synthesized
tctaactgagtatatagtttag

SEQ ID NO: 1041571 - DNA, 22 bp, Artificial Sequence
  chemically synthesized
accactatctaactgagtatat

SEQ ID NO: 1041572 - DNA, 22 bp, Artificial Sequence
  chemically synthesized
aaccactatctaactgagtata

SEQ ID NO: 1041573 - DNA, 22 bp, Artificial Sequence
  chemically synthesized
aactatatactcagttagatag

SEQ ID NO: 1041574 - DNA, 22 bp, Artificial Sequence
  chemically synthesized
agcacttaaccactatctaact

SEQ ID NO: 1041575 - DNA, 22 bp, Artificial Sequence
  chemically synthesized
ctcagcacttaaccactatcta

SEQ ID NO: 1041576 - DNA, 22 bp, Artificial Sequence
  chemically synthesized
tatactcagttagatagtggtt

SEQ ID NO: 1041577 - DNA, 22 bp, Artificial Sequence
  chemically synthesized
ctcctcagcacttaaccactat

SEQ ID NO: 1041578 - DNA, 22 bp, Artificial Sequence
  chemically synthesized
gctcctcagcacttaaccacta

SEQ ID NO: 1041579 - DNA, 22 bp, Artificial Sequence
  chemically synthesized
tgctcctcagcacttaaccact

SEQ ID NO: 1041580 - DNA, 22 bp, Artificial Sequence
  chemically synthesized
agttagatagtggttaagtgct

SEQ ID NO: 1041581 - DNA, 22 bp, Artificial Sequence
  chemically synthesized
gttttgctcctcagcacttaac

SEQ ID NO: 1041582 - DNA, 22 bp, Artificial Sequence
  chemically synthesized
agttttgctcctcagcacttaa

SEQ ID NO: 1041583 - DNA, 22 bp, Artificial Sequence
  chemically synthesized
tagttttgctcctcagcactta

SEQ ID NO: 1041584 - DNA, 22 bp, Artificial Sequence
  chemically synthesized
gatagtggttaagtgctgagga

SEQ ID NO: 1041585 - DNA, 22 bp, Artificial Sequence
  chemically synthesized
ctttagttttgctcctcagcac

SEQ ID NO: 1041586 - DNA, 22 bp, Artificial Sequence
  chemically synthesized
cctgctttagttttgctcctca

SEQ ID NO: 1041587 - DNA, 22 bp, Artificial Sequence
  chemically synthesized
ccctgctttagttttgctcctc

SEQ ID NO: 1041588 - DNA, 22 bp, Artificial Sequence
  chemically synthesized
cttccctgctttagttttgctc

SEQ ID NO: 1041589 - DNA, 22 bp, Artificial Sequence
  chemically synthesized
ccttccctgctttagttttgct

SEQ ID NO: 1041590 - DNA, 22 bp, Artificial Sequence
  chemically synthesized
agtgctgaggagcaaaactaaa

SEQ ID NO: 1041591 - DNA, 22 bp, Artificial Sequence
  chemically synthesized
ttccttccctgctttagttttg

SEQ ID NO: 1041592 - DNA, 22 bp, Artificial Sequence
  chemically synthesized
cttccttccctgctttagtttt

SEQ ID NO: 1041593 - DNA, 22 bp, Artificial Sequence
  chemically synthesized
atttcttccttccctgctttag

SEQ ID NO: 1041594 - DNA, 22 bp, Artificial Sequence
  chemically synthesized
catttcttccttccctgcttta

SEQ ID NO: 1041595 - DNA, 22 bp, Artificial Sequence
  chemically synthesized
aggagcaaaactaaagcaggga

SEQ ID NO: 1041596 - DNA, 22 bp, Artificial Sequence
  chemically synthesized
tccttcatttcttccttccctg

SEQ ID NO: 1041597 - DNA, 22 bp, Artificial Sequence
  chemically synthesized
atccttcatttcttccttccct

SEQ ID NO: 1041598 - DNA, 22 bp, Artificial Sequence
  chemically synthesized
tatccttcatttcttccttccc

SEQ ID NO: 1041599 - DNA, 22 bp, Artificial Sequence
  chemically synthesized
aagcagggaaggaagaaatgaa

SEQ ID NO: 1041600 - DNA, 22 bp, Artificial Sequence
  chemically synthesized
acccccactttatccttcattt

SEQ ID NO: 1041601 - DNA, 22 bp, Artificial Sequence
  chemically synthesized
tgacccccactttatccttcat

SEQ ID NO: 1041602 - DNA, 22 bp, Artificial Sequence
  chemically synthesized
aaattctgacccccactttatc

SEQ ID NO: 1041603 - DNA, 22 bp, Artificial Sequence
  chemically synthesized
cctaaaattctgacccccactt

SEQ ID NO: 1041604 - DNA, 22 bp, Artificial Sequence
  chemically synthesized
acctaaaattctgacccccact

SEQ ID NO: 1041605 - DNA, 22 bp, Artificial Sequence
  chemically synthesized
ttacctaaaattctgaccccca

SEQ ID NO: 1041606 - DNA, 22 bp, Artificial Sequence
  chemically synthesized
cccgacccctcttacctaaaat

SEQ ID NO: 1041607 - DNA, 22 bp, Artificial Sequence
  chemically synthesized
ccccgacccctcttacctaaaa

SEQ ID NO: 1041608 - DNA, 22 bp, Artificial Sequence
  chemically synthesized
gtaaggtcttccccgacccctc

SEQ ID NO: 1041609 - DNA, 22 bp, Artificial Sequence
  chemically synthesized
ctggtaaggtcttccccgaccc

SEQ ID NO: 1041610 - DNA, 22 bp, Artificial Sequence
  chemically synthesized
cctggtaaggtcttccccgacc

SEQ ID NO: 1041611 - DNA, 22 bp, Artificial Sequence
  chemically synthesized
taggtaagaggggtcggggaag

SEQ ID NO: 1041612 - DNA, 22 bp, Artificial Sequence
  chemically synthesized
aggtaagaggggtcggggaaga

SEQ ID NO: 1041613 - DNA, 22 bp, Artificial Sequence
  chemically synthesized
ggtaagaggggtcggggaagac

SEQ ID NO: 1041614 - DNA, 22 bp, Artificial Sequence
  chemically synthesized
ccttcctggtaaggtcttcccc

SEQ ID NO: 1041615 - DNA, 22 bp, Artificial Sequence
  chemically synthesized
aaaactgccttcctggtaaggt

SEQ ID NO: 1041616 - DNA, 22 bp, Artificial Sequence
  chemically synthesized
aaaaactgccttcctggtaagg

SEQ ID NO: 1041617 - DNA, 22 bp, Artificial Sequence
  chemically synthesized
cttaaaaactgccttcctggta

SEQ ID NO: 1041618 - DNA, 22 bp, Artificial Sequence
  chemically synthesized
acttaaaaactgccttcctggt

SEQ ID NO: 1041619 - DNA, 22 bp, Artificial Sequence
  chemically synthesized
tacttaaaaactgccttcctgg

SEQ ID NO: 1041620 - DNA, 22 bp, Artificial Sequence
  chemically synthesized
agatctttacttaaaaactgcc

SEQ ID NO: 1041621 - DNA, 22 bp, Artificial Sequence
  chemically synthesized
cagatctttacttaaaaactgc

SEQ ID NO: 1041622 - DNA, 22 bp, Artificial Sequence
  chemically synthesized
accaggaaggcagtttttaagt

SEQ ID NO: 1041623 - DNA, 22 bp, Artificial Sequence
  chemically synthesized
cttcagatctttacttaaaaac

SEQ ID NO: 1041624 - DNA, 22 bp, Artificial Sequence
  chemically synthesized
ccaggaaggcagtttttaagta

SEQ ID NO: 1041625 - DNA, 22 bp, Artificial Sequence
  chemically synthesized
ccttcagatctttacttaaaaa

SEQ ID NO: 1041626 - DNA, 22 bp, Artificial Sequence
  chemically synthesized
catttccttcagatctttactt

SEQ ID NO: 1041627 - DNA, 22 bp, Artificial Sequence
  chemically synthesized
tgcatttccttcagatctttac

SEQ ID NO: 1041628 - DNA, 22 bp, Artificial Sequence
  chemically synthesized
ctgcatttccttcagatcttta

SEQ ID NO: 1041629 - DNA, 22 bp, Artificial Sequence
  chemically synthesized
atttctgcatttccttcagatc

SEQ ID NO: 1041630 - DNA, 22 bp, Artificial Sequence
  chemically synthesized
ttaagtaaagatctgaaggaaa

SEQ ID NO: 1041631 - DNA, 22 bp, Artificial Sequence
  chemically synthesized
taagtaaagatctgaaggaaat

SEQ ID NO: 1041632 - DNA, 22 bp, Artificial Sequence
  chemically synthesized
aagtaaagatctgaaggaaatg

SEQ ID NO: 1041633 - DNA, 22 bp, Artificial Sequence
  chemically synthesized
agtaaagatctgaaggaaatgc

SEQ ID NO: 1041634 - DNA, 22 bp, Artificial Sequence
  chemically synthesized
aatggttaatttctgcatttcc

SEQ ID NO: 1041635 - DNA, 22 bp, Artificial Sequence
  chemically synthesized
caatggttaatttctgcatttc

SEQ ID NO: 1041636 - DNA, 22 bp, Artificial Sequence
  chemically synthesized
tcaatggttaatttctgcattt

SEQ ID NO: 1041637 - DNA, 22 bp, Artificial Sequence
  chemically synthesized
tttcaatggttaatttctgcat

SEQ ID NO: 1041638 - DNA, 22 bp, Artificial Sequence
  chemically synthesized
ctttcaatggttaatttctgca

SEQ ID NO: 1041639 - DNA, 22 bp, Artificial Sequence
  chemically synthesized
tctttcaatggttaatttctgc

SEQ ID NO: 1041640 - DNA, 22 bp, Artificial Sequence
  chemically synthesized
ttctttcaatggttaatttctg

SEQ ID NO: 1041641 - DNA, 22 bp, Artificial Sequence
  chemically synthesized
aaggaaatgcagaaattaacca

SEQ ID NO: 1041642 - DNA, 22 bp, Artificial Sequence
  chemically synthesized
atgatttttctttcaatggtta

SEQ ID NO: 1041643 - DNA, 22 bp, Artificial Sequence
  chemically synthesized
tcatgatttttctttcaatggt

SEQ ID NO: 1041644 - DNA, 22 bp, Artificial Sequence
  chemically synthesized
ttctcatgatttttctttcaat

SEQ ID NO: 1041645 - DNA, 22 bp, Artificial Sequence
  chemically synthesized
gaatattattctcatgattttt

SEQ ID NO: 1041646 - DNA, 22 bp, Artificial Sequence
  chemically synthesized
accattgaaagaaaaatcatga

SEQ ID NO: 1041647 - DNA, 22 bp, Artificial Sequence
  chemically synthesized
tctggaatattattctcatgat

SEQ ID NO: 1041648 - DNA, 22 bp, Artificial Sequence
  chemically synthesized
aaagaaaaatcatgagaataat

SEQ ID NO: 1041649 - DNA, 22 bp, Artificial Sequence
  chemically synthesized
cctgtctggaatattattctca

SEQ ID NO: 1041650 - DNA, 22 bp, Artificial Sequence
  chemically synthesized
acctgtctggaatattattctc

SEQ ID NO: 1041651 - DNA, 22 bp, Artificial Sequence
  chemically synthesized
tacctgtctggaatattattct

SEQ ID NO: 1041652 - DNA, 22 bp, Artificial Sequence
  chemically synthesized
ctttacctgtctggaatattat

SEQ ID NO: 1041653 - DNA, 22 bp, Artificial Sequence
  chemically synthesized
gctttacctgtctggaatatta

SEQ ID NO: 1041654 - DNA, 22 bp, Artificial Sequence
  chemically synthesized
tacttgctttacctgtctggaa

SEQ ID NO: 1041655 - DNA, 22 bp, Artificial Sequence
  chemically synthesized
atacttgctttacctgtctgga

SEQ ID NO: 1041656 - DNA, 22 bp, Artificial Sequence
  chemically synthesized
cagacaggtaaagcaagtataa

SEQ ID NO: 1041657 - DNA, 22 bp, Artificial Sequence
  chemically synthesized
cagtgtcagggcccttatactt

SEQ ID NO: 1041658 - DNA, 22 bp, Artificial Sequence
  chemically synthesized
caggcacattccagtgtcaggg

SEQ ID NO: 1041659 - DNA, 22 bp, Artificial Sequence
  chemically synthesized
ctccaggcacattccagtgtca

SEQ ID NO: 1041660 - DNA, 22 bp, Artificial Sequence
  chemically synthesized
gccactcctccaggcacattcc

SEQ ID NO: 1041661 - DNA, 22 bp, Artificial Sequence
  chemically synthesized
ggccactcctccaggcacattc

SEQ ID NO: 1041662 - DNA, 22 bp, Artificial Sequence
  chemically synthesized
cttggccactcctccaggcaca

SEQ ID NO: 1041663 - DNA, 22 bp, Artificial Sequence
  chemically synthesized
acactggaatgtgcctggagga

SEQ ID NO: 1041664 - DNA, 22 bp, Artificial Sequence
  chemically synthesized
catgttccttggccactcctcc

SEQ ID NO: 1041665 - DNA, 22 bp, Artificial Sequence
  chemically synthesized
gaatgtgcctggaggagtggcc

SEQ ID NO: 1041666 - DNA, 22 bp, Artificial Sequence
  chemically synthesized
ctccatgttccttggccactcc

SEQ ID NO: 1041667 - DNA, 22 bp, Artificial Sequence
  chemically synthesized
cctccatgttccttggccactc

SEQ ID NO: 1041668 - DNA, 22 bp, Artificial Sequence
  chemically synthesized
gaggagtggccaaggaacatgg

SEQ ID NO: 1041669 - DNA, 22 bp, Artificial Sequence
  chemically synthesized
cagccataatcacttcctccat

SEQ ID NO: 1041670 - DNA, 22 bp, Artificial Sequence
  chemically synthesized
atacactccagccataatcact

SEQ ID NO: 1041671 - DNA, 22 bp, Artificial Sequence
  chemically synthesized
gctcatacactccagccataat

SEQ ID NO: 1041672 - DNA, 22 bp, Artificial Sequence
  chemically synthesized
gtagtcgctagctcatacactc

SEQ ID NO: 1041673 - DNA, 22 bp, Artificial Sequence
  chemically synthesized
tggtagtcgctagctcatacac

SEQ ID NO: 1041674 - DNA, 22 bp, Artificial Sequence
  chemically synthesized
tctggtagtcgctagctcatac

SEQ ID NO: 1041675 - DNA, 22 bp, Artificial Sequence
  chemically synthesized
ctctggtagtcgctagctcata

SEQ ID NO: 1041676 - DNA, 22 bp, Artificial Sequence
  chemically synthesized
tggctggagtgtatgagctagc

SEQ ID NO: 1041677 - DNA, 22 bp, Artificial Sequence
  chemically synthesized
atatttctctggtagtcgctag

SEQ ID NO: 1041678 - DNA, 22 bp, Artificial Sequence
  chemically synthesized
gagtgtatgagctagcgactac

SEQ ID NO: 1041679 - DNA, 22 bp, Artificial Sequence
  chemically synthesized
tgatatttctctggtagtcgct

SEQ ID NO: 1041680 - DNA, 22 bp, Artificial Sequence
  chemically synthesized
tctgatatttctctggtagtcg

SEQ ID NO: 1041681 - DNA, 22 bp, Artificial Sequence
  chemically synthesized
gcgactaccagagaaatatcag

SEQ ID NO: 1041682 - DNA, 22 bp, Artificial Sequence
  chemically synthesized
cccaccccattctctgatattt

SEQ ID NO: 1041683 - DNA, 22 bp, Artificial Sequence
  chemically synthesized
ccagagaaatatcagagaatgg

SEQ ID NO: 1041684 - DNA, 22 bp, Artificial Sequence
  chemically synthesized
atgggttacccaccccattctc

SEQ ID NO: 1041685 - DNA, 22 bp, Artificial Sequence
  chemically synthesized
catgggttacccaccccattct

SEQ ID NO: 1041686 - DNA, 22 bp, Artificial Sequence
  chemically synthesized
ataagtaccttcatgggttacc

SEQ ID NO: 1041687 - DNA, 22 bp, Artificial Sequence
  chemically synthesized
tgttcataagtaccttcatggg

SEQ ID NO: 1041688 - DNA, 22 bp, Artificial Sequence
  chemically synthesized
atgttcataagtaccttcatgg

SEQ ID NO: 1041689 - DNA, 22 bp, Artificial Sequence
  chemically synthesized
aaagtaaacagggaagtcctta

SEQ ID NO: 1041690 - DNA, 22 bp, Artificial Sequence
  chemically synthesized
atgaacataaggacttccctgt

SEQ ID NO: 1041691 - DNA, 22 bp, Artificial Sequence
  chemically synthesized
tgaacataaggacttccctgtt

SEQ ID NO: 1041692 - DNA, 22 bp, Artificial Sequence
  chemically synthesized
cccatccccctcaaagtaaaca

SEQ ID NO: 1041693 - DNA, 22 bp, Artificial Sequence
  chemically synthesized
ccctgtttactttgagggggat

SEQ ID NO: 1041694 - DNA, 22 bp, Artificial Sequence
  chemically synthesized
cctgtttactttgagggggatg

SEQ ID NO: 1041695 - DNA, 22 bp, Artificial Sequence
  chemically synthesized
tttactttgagggggatgggga

SEQ ID NO: 1041696 - DNA, 22 bp, Artificial Sequence
  chemically synthesized
aaaacccccaatgctccccatc

SEQ ID NO: 1041697 - DNA, 22 bp, Artificial Sequence
  chemically synthesized
actttgagggggatggggagca

SEQ ID NO: 1041698 - DNA, 22 bp, Artificial Sequence
  chemically synthesized
ctttgagggggatggggagcat

SEQ ID NO: 1041699 - DNA, 22 bp, Artificial Sequence
  chemically synthesized
ttcaaaacccccaatgctcccc

SEQ ID NO: 1041700 - DNA, 22 bp, Artificial Sequence
  chemically synthesized
tgagggggatggggagcattgg

SEQ ID NO: 1041701 - DNA, 22 bp, Artificial Sequence
  chemically synthesized
tgttcaaaacccccaatgctcc

SEQ ID NO: 1041702 - DNA, 22 bp, Artificial Sequence
  chemically synthesized
gagggggatggggagcattggg

SEQ ID NO: 1041703 - DNA, 22 bp, Artificial Sequence
  chemically synthesized
ctgttcaaaacccccaatgctc

SEQ ID NO: 1041704 - DNA, 22 bp, Artificial Sequence
  chemically synthesized
agggggatggggagcattgggg

SEQ ID NO: 1041705 - DNA, 22 bp, Artificial Sequence
  chemically synthesized
cttctgttcaaaacccccaatg

SEQ ID NO: 1041706 - DNA, 22 bp, Artificial Sequence
  chemically synthesized
tgcttctgttcaaaacccccaa

SEQ ID NO: 1041707 - DNA, 22 bp, Artificial Sequence
  chemically synthesized
ctgcttctgttcaaaaccccca

SEQ ID NO: 1041708 - DNA, 22 bp, Artificial Sequence
  chemically synthesized
tctgcttctgttcaaaaccccc

SEQ ID NO: 1041709 - DNA, 22 bp, Artificial Sequence
  chemically synthesized
tatccccctttctgcttctgtt

SEQ ID NO: 1041710 - DNA, 22 bp, Artificial Sequence
  chemically synthesized
ggggttttgaacagaagcagaa

SEQ ID NO: 1041711 - DNA, 22 bp, Artificial Sequence
  chemically synthesized
tgaacagaagcagaaaggggga

SEQ ID NO: 1041712 - DNA, 22 bp, Artificial Sequence
  chemically synthesized
gaacagaagcagaaagggggat

SEQ ID NO: 1041713 - DNA, 22 bp, Artificial Sequence
  chemically synthesized
aacagaagcagaaagggggata

SEQ ID NO: 1041714 - DNA, 22 bp, Artificial Sequence
  chemically synthesized
aatggaaagtcagattatatcc

SEQ ID NO: 1041715 - DNA, 22 bp, Artificial Sequence
  chemically synthesized
aaatggaaagtcagattatatc

SEQ ID NO: 1041716 - DNA, 22 bp, Artificial Sequence
  chemically synthesized
tttaaatggaaagtcagattat

SEQ ID NO: 1041717 - DNA, 22 bp, Artificial Sequence
  chemically synthesized
gccagagatacctatttaaatg

SEQ ID NO: 1041718 - DNA, 22 bp, Artificial Sequence
  chemically synthesized
actttccatttaaataggtatc

SEQ ID NO: 1041719 - DNA, 22 bp, Artificial Sequence
  chemically synthesized
tccatttaaataggtatctctg

SEQ ID NO: 1041720 - DNA, 22 bp, Artificial Sequence
  chemically synthesized
ccatttaaataggtatctctgg

SEQ ID NO: 1041721 - DNA, 22 bp, Artificial Sequence
  chemically synthesized
tcaatatactagccagagatac

SEQ ID NO: 1041722 - DNA, 22 bp, Artificial Sequence
  chemically synthesized
catttaaataggtatctctggc

SEQ ID NO: 1041723 - DNA, 22 bp, Artificial Sequence
  chemically synthesized
ctgtcaatatactagccagaga

SEQ ID NO: 1041724 - DNA, 22 bp, Artificial Sequence
  chemically synthesized
tactgtcaatatactagccaga

SEQ ID NO: 1041725 - DNA, 22 bp, Artificial Sequence
  chemically synthesized
aaataggtatctctggctagta

SEQ ID NO: 1041726 - DNA, 22 bp, Artificial Sequence
  chemically synthesized
aataggtatctctggctagtat

SEQ ID NO: 1041727 - DNA, 22 bp, Artificial Sequence
  chemically synthesized
tagactctactgtcaatatact

SEQ ID NO: 1041728 - DNA, 22 bp, Artificial Sequence
  chemically synthesized
ccctgtagactctactgtcaat

SEQ ID NO: 1041729 - DNA, 22 bp, Artificial Sequence
  chemically synthesized
tggctagtatattgacagtaga

SEQ ID NO: 1041730 - DNA, 22 bp, Artificial Sequence
  chemically synthesized
tcccctgtagactctactgtca

SEQ ID NO: 1041731 - DNA, 22 bp, Artificial Sequence
  chemically synthesized
ctcccctgtagactctactgtc

SEQ ID NO: 1041732 - DNA, 22 bp, Artificial Sequence
  chemically synthesized
gctagtatattgacagtagagt

SEQ ID NO: 1041733 - DNA, 22 bp, Artificial Sequence
  chemically synthesized
ccttctcccctgtagactctac

SEQ ID NO: 1041734 - DNA, 22 bp, Artificial Sequence
  chemically synthesized
gtatattgacagtagagtctac

SEQ ID NO: 1041735 - DNA, 22 bp, Artificial Sequence
  chemically synthesized
attgccttctcccctgtagact

SEQ ID NO: 1041736 - DNA, 22 bp, Artificial Sequence
  chemically synthesized
acagtagagtctacaggggaga

SEQ ID NO: 1041737 - DNA, 22 bp, Artificial Sequence
  chemically synthesized
cccctcattgccttctcccctg

SEQ ID NO: 1041738 - DNA, 22 bp, Artificial Sequence
  chemically synthesized
ccccctcattgccttctcccct

SEQ ID NO: 1041739 - DNA, 22 bp, Artificial Sequence
  chemically synthesized
acaagtttccccctcattgcct

SEQ ID NO: 1041740 - DNA, 22 bp, Artificial Sequence
  chemically synthesized
caggggagaaggcaatgagggg

SEQ ID NO: 1041741 - DNA, 22 bp, Artificial Sequence
  chemically synthesized
ttaacaagtttccccctcattg

SEQ ID NO: 1041742 - DNA, 22 bp, Artificial Sequence
  chemically synthesized
tctattaacaagtttccccctc

SEQ ID NO: 1041743 - DNA, 22 bp, Artificial Sequence
  chemically synthesized
cagttgtctattaacaagtttc

SEQ ID NO: 1041744 - DNA, 22 bp, Artificial Sequence
  chemically synthesized
cagcatggatgattgcagttgt

SEQ ID NO: 1041745 - DNA, 22 bp, Artificial Sequence
  chemically synthesized
gttaatagacaactgcaatcat

SEQ ID NO: 1041746 - DNA, 22 bp, Artificial Sequence
  chemically synthesized
ttaatagacaactgcaatcatc

SEQ ID NO: 1041747 - DNA, 22 bp, Artificial Sequence
  chemically synthesized
atagacaactgcaatcatccat

SEQ ID NO: 1041748 - DNA, 22 bp, Artificial Sequence
  chemically synthesized
caatcatccatgctggagatga

SEQ ID NO: 1041749 - DNA, 22 bp, Artificial Sequence
  chemically synthesized
atccaaagcaccatcatctcca

SEQ ID NO: 1041750 - DNA, 22 bp, Artificial Sequence
  chemically synthesized
tgatccaaagcaccatcatctc

SEQ ID NO: 1041751 - DNA, 22 bp, Artificial Sequence
  chemically synthesized
cactctgatccaaagcaccatc

SEQ ID NO: 1041752 - DNA, 22 bp, Artificial Sequence
  chemically synthesized
cctccactctgatccaaagcac

SEQ ID NO: 1041753 - DNA, 22 bp, Artificial Sequence
  chemically synthesized
gagatgatggtgctttggatca

SEQ ID NO: 1041754 - DNA, 22 bp, Artificial Sequence
  chemically synthesized
aaccctgcctccactctgatcc

SEQ ID NO: 1041755 - DNA, 22 bp, Artificial Sequence
  chemically synthesized
tggatcagagtggaggcagggt

SEQ ID NO: 1041756 - DNA, 22 bp, Artificial Sequence
  chemically synthesized
ggatcagagtggaggcagggtt

SEQ ID NO: 1041757 - DNA, 22 bp, Artificial Sequence
  chemically synthesized
gatcagagtggaggcagggttg

SEQ ID NO: 1041758 - DNA, 22 bp, Artificial Sequence
  chemically synthesized
caatgtatccggaattcaaccc

SEQ ID NO: 1041759 - DNA, 22 bp, Artificial Sequence
  chemically synthesized
acaatgtatccggaattcaacc

SEQ ID NO: 1041760 - DNA, 22 bp, Artificial Sequence
  chemically synthesized
tacaatgtatccggaattcaac

SEQ ID NO: 1041761 - DNA, 22 bp, Artificial Sequence
  chemically synthesized
cctttacaatgtatccggaatt

SEQ ID NO: 1041762 - DNA, 22 bp, Artificial Sequence
  chemically synthesized
tgcctttacaatgtatccggaa

SEQ ID NO: 1041763 - DNA, 22 bp, Artificial Sequence
  chemically synthesized
aggattctgcctttacaatgta

SEQ ID NO: 1041764 - DNA, 22 bp, Artificial Sequence
  chemically synthesized
aattccggatacattgtaaagg

SEQ ID NO: 1041765 - DNA, 22 bp, Artificial Sequence
  chemically synthesized
cggatacattgtaaaggcagaa

SEQ ID NO: 1041766 - DNA, 22 bp, Artificial Sequence
  chemically synthesized
gccaccaaatcctaaggattct

SEQ ID NO: 1041767 - DNA, 22 bp, Artificial Sequence
  chemically synthesized
taaaggcagaatccttaggatt

SEQ ID NO: 1041768 - DNA, 22 bp, Artificial Sequence
  chemically synthesized
ccaacacacatgtaattggcca

SEQ ID NO: 1041769 - DNA, 22 bp, Artificial Sequence
  chemically synthesized
taccaacacacatgtaattggc

SEQ ID NO: 1041770 - DNA, 22 bp, Artificial Sequence
  chemically synthesized
aggatttggtggccaattacat

SEQ ID NO: 1041771 - DNA, 22 bp, Artificial Sequence
  chemically synthesized
ggatttggtggccaattacatg

SEQ ID NO: 1041772 - DNA, 22 bp, Artificial Sequence
  chemically synthesized
tctaccaacacacatgtaattg

SEQ ID NO: 1041773 - DNA, 22 bp, Artificial Sequence
  chemically synthesized
ctctaccaacacacatgtaatt

SEQ ID NO: 1041774 - DNA, 22 bp, Artificial Sequence
  chemically synthesized
tctctaccaacacacatgtaat

SEQ ID NO: 1041775 - DNA, 22 bp, Artificial Sequence
  chemically synthesized
ggtggccaattacatgtgtgtt

SEQ ID NO: 1041776 - DNA, 22 bp, Artificial Sequence
  chemically synthesized
gtggccaattacatgtgtgttg

SEQ ID NO: 1041777 - DNA, 22 bp, Artificial Sequence
  chemically synthesized
aggcctttctctaccaacacac

SEQ ID NO: 1041778 - DNA, 22 bp, Artificial Sequence
  chemically synthesized
aaggcctttctctaccaacaca

SEQ ID NO: 1041779 - DNA, 22 bp, Artificial Sequence
  chemically synthesized
tccttaaggcctttctctacca

SEQ ID NO: 1041780 - DNA, 22 bp, Artificial Sequence
  chemically synthesized
catgtgtgttggtagagaaagg

SEQ ID NO: 1041781 - DNA, 22 bp, Artificial Sequence
  chemically synthesized
atgttatccttaaggcctttct

SEQ ID NO: 1041782 - DNA, 22 bp, Artificial Sequence
  chemically synthesized
catgttatccttaaggcctttc

SEQ ID NO: 1041783 - DNA, 22 bp, Artificial Sequence
  chemically synthesized
ttcatgttatccttaaggcctt

SEQ ID NO: 1041784 - DNA, 22 bp, Artificial Sequence
  chemically synthesized
gtagagaaaggccttaaggata

SEQ ID NO: 1041785 - DNA, 22 bp, Artificial Sequence
  chemically synthesized
tgccaaaattcttcatgttatc

SEQ ID NO: 1041786 - DNA, 22 bp, Artificial Sequence
  chemically synthesized
tctgtgccaaaattcttcatgt

SEQ ID NO: 1041787 - DNA, 22 bp, Artificial Sequence
  chemically synthesized
gtctgtgccaaaattcttcatg

SEQ ID NO: 1041788 - DNA, 22 bp, Artificial Sequence
  chemically synthesized
aaggataacatgaagaattttg

SEQ ID NO: 1041789 - DNA, 22 bp, Artificial Sequence
  chemically synthesized
aggataacatgaagaattttgg

SEQ ID NO: 1041790 - DNA, 22 bp, Artificial Sequence
  chemically synthesized
cacttgtctgtgccaaaattct

SEQ ID NO: 1041791 - DNA, 22 bp, Artificial Sequence
  chemically synthesized
ttccacttgtctgtgccaaaat

SEQ ID NO: 1041792 - DNA, 22 bp, Artificial Sequence
  chemically synthesized
cattattccacttgtctgtgcc

SEQ ID NO: 1041793 - DNA, 22 bp, Artificial Sequence
  chemically synthesized
atggcaactccattattccact

SEQ ID NO: 1041794 - DNA, 22 bp, Artificial Sequence
  chemically synthesized
tggcacagacaagtggaataat

SEQ ID NO: 1041795 - DNA, 22 bp, Artificial Sequence
  chemically synthesized
ggcacagacaagtggaataatg

SEQ ID NO: 1041796 - DNA, 22 bp, Artificial Sequence
  chemically synthesized
gcacagacaagtggaataatgg

SEQ ID NO: 1041797 - DNA, 22 bp, Artificial Sequence
  chemically synthesized
tagttaatggcaactccattat

SEQ ID NO: 1041798 - DNA, 22 bp, Artificial Sequence
  chemically synthesized
cactatagttaatggcaactcc

SEQ ID NO: 1041799 - DNA, 22 bp, Artificial Sequence
  chemically synthesized
tacactatagttaatggcaact

SEQ ID NO: 1041800 - DNA, 22 bp, Artificial Sequence
  chemically synthesized
ctacactatagttaatggcaac

SEQ ID NO: 1041801 - DNA, 22 bp, Artificial Sequence
  chemically synthesized
tctacactatagttaatggcaa

SEQ ID NO: 1041802 - DNA, 22 bp, Artificial Sequence
  chemically synthesized
cagttttctacactatagttaa

SEQ ID NO: 1041803 - DNA, 22 bp, Artificial Sequence
  chemically synthesized
ctgcagttttctacactatagt

SEQ ID NO: 1041804 - DNA, 22 bp, Artificial Sequence
  chemically synthesized
tcctcctgcagttttctacact

SEQ ID NO: 1041805 - DNA, 22 bp, Artificial Sequence
  chemically synthesized
ccattaactatagtgtagaaaa

SEQ ID NO: 1041806 - DNA, 22 bp, Artificial Sequence
  chemically synthesized
atcctcctgcagttttctacac

SEQ ID NO: 1041807 - DNA, 22 bp, Artificial Sequence
  chemically synthesized
accttatcctcctgcagttttc

SEQ ID NO: 1041808 - DNA, 22 bp, Artificial Sequence
  chemically synthesized
actatagtgtagaaaactgcag

SEQ ID NO: 1041809 - DNA, 22 bp, Artificial Sequence
  chemically synthesized
tagtgtagaaaactgcaggagg

SEQ ID NO: 1041810 - DNA, 22 bp, Artificial Sequence
  chemically synthesized
caccctaaccttatcctcctgc

SEQ ID NO: 1041811 - DNA, 22 bp, Artificial Sequence
  chemically synthesized
acaccctaaccttatcctcctg

SEQ ID NO: 1041812 - DNA, 22 bp, Artificial Sequence
  chemically synthesized
aaatcttacaccctaaccttat

SEQ ID NO: 1041813 - DNA, 22 bp, Artificial Sequence
  chemically synthesized
caggaggataaggttagggtgt

SEQ ID NO: 1041814 - DNA, 22 bp, Artificial Sequence
  chemically synthesized
gcatgttaaaatcttacaccct

SEQ ID NO: 1041815 - DNA, 22 bp, Artificial Sequence
  chemically synthesized
agcatgttaaaatcttacaccc

SEQ ID NO: 1041816 - DNA, 22 bp, Artificial Sequence
  chemically synthesized
aatttagcatgttaaaatctta

SEQ ID NO: 1041817 - DNA, 22 bp, Artificial Sequence
  chemically synthesized
aaatttagcatgttaaaatctt

SEQ ID NO: 1041818 - DNA, 22 bp, Artificial Sequence
  chemically synthesized
gggtgtaagattttaacatgct

SEQ ID NO: 1041819 - DNA, 22 bp, Artificial Sequence
  chemically synthesized
taacatgctaaatttaagatgt

SEQ ID NO: 1041820 - DNA, 22 bp, Artificial Sequence
  chemically synthesized
gaagtataataaacatcttaaa

SEQ ID NO: 1041821 - DNA, 22 bp, Artificial Sequence
  chemically synthesized
aacatgctaaatttaagatgtt

SEQ ID NO: 1041822 - DNA, 22 bp, Artificial Sequence
  chemically synthesized
agaagtataataaacatcttaa

SEQ ID NO: 1041823 - DNA, 22 bp, Artificial Sequence
  chemically synthesized
acatgctaaatttaagatgttt

SEQ ID NO: 1041824 - DNA, 22 bp, Artificial Sequence
  chemically synthesized
acttagaagtataataaacatc

SEQ ID NO: 1041825 - DNA, 22 bp, Artificial Sequence
  chemically synthesized
aatttaagatgtttattatact

SEQ ID NO: 1041826 - DNA, 22 bp, Artificial Sequence
  chemically synthesized
tatattcacttagaagtataat

SEQ ID NO: 1041827 - DNA, 22 bp, Artificial Sequence
  chemically synthesized
atatattcacttagaagtataa

SEQ ID NO: 1041828 - DNA, 22 bp, Artificial Sequence
  chemically synthesized
tatatattcacttagaagtata

SEQ ID NO: 1041829 - DNA, 22 bp, Artificial Sequence
  chemically synthesized
aagatgtttattatacttctaa

SEQ ID NO: 1041830 - DNA, 22 bp, Artificial Sequence
  chemically synthesized
ttatatattcacttagaagtat

SEQ ID NO: 1041831 - DNA, 22 bp, Artificial Sequence
  chemically synthesized
agatgtttattatacttctaag

SEQ ID NO: 1041832 - DNA, 22 bp, Artificial Sequence
  chemically synthesized
attatacttctaagtgaatata

SEQ ID NO: 1041833 - DNA, 22 bp, Artificial Sequence
  chemically synthesized
ttatacttctaagtgaatatat

SEQ ID NO: 1041834 - DNA, 22 bp, Artificial Sequence
  chemically synthesized
tacttctaagtgaatatataaa

SEQ ID NO: 1041835 - DNA, 22 bp, Artificial Sequence
  chemically synthesized
ctaagtgaatatataaaaggca

SEQ ID NO: 1041836 - DNA, 22 bp, Artificial Sequence
  chemically synthesized
taagtgaatatataaaaggcat

SEQ ID NO: 1041837 - DNA, 22 bp, Artificial Sequence
  chemically synthesized
agtgaatatataaaaggcatat

SEQ ID NO: 1041838 - DNA, 22 bp, Artificial Sequence
  chemically synthesized
aatcatgacatatatatatatg

SEQ ID NO: 1041839 - DNA, 22 bp, Artificial Sequence
  chemically synthesized
ctgaatcatgacatatatatat

SEQ ID NO: 1041840 - DNA, 22 bp, Artificial Sequence
  chemically synthesized
tcctgaatcatgacatatatat

SEQ ID NO: 1041841 - DNA, 22 bp, Artificial Sequence
  chemically synthesized
ctctcctgaatcatgacatata

SEQ ID NO: 1041842 - DNA, 22 bp, Artificial Sequence
  chemically synthesized
gtcaagattcctctcctgaatc

SEQ ID NO: 1041843 - DNA, 22 bp, Artificial Sequence
  chemically synthesized
tagtcaagattcctctcctgaa

SEQ ID NO: 1041844 - DNA, 22 bp, Artificial Sequence
  chemically synthesized
tatctctagtcaagattcctct

SEQ ID NO: 1041845 - DNA, 22 bp, Artificial Sequence
  chemically synthesized
atatctctagtcaagattcctc

SEQ ID NO: 1041846 - DNA, 22 bp, Artificial Sequence
  chemically synthesized
aaatttatatctctagtcaaga

SEQ ID NO: 1041847 - DNA, 22 bp, Artificial Sequence
  chemically synthesized
aggagaggaatcttgactagag

SEQ ID NO: 1041848 - DNA, 22 bp, Artificial Sequence
  chemically synthesized
tcaaatttatatctctagtcaa

SEQ ID NO: 1041849 - DNA, 22 bp, Artificial Sequence
  chemically synthesized
gtgactctcaaatttatatctc

SEQ ID NO: 1041850 - DNA, 22 bp, Artificial Sequence
  chemically synthesized
cccctagtgactctcaaattta

SEQ ID NO: 1041851 - DNA, 22 bp, Artificial Sequence
  chemically synthesized
gactagagatataaatttgaga

SEQ ID NO: 1041852 - DNA, 22 bp, Artificial Sequence
  chemically synthesized
actagagatataaatttgagag

SEQ ID NO: 1041853 - DNA, 22 bp, Artificial Sequence
  chemically synthesized
gagatataaatttgagagtcac

SEQ ID NO: 1041854 - DNA, 22 bp, Artificial Sequence
  chemically synthesized
aaaattacccctagtgactctc

SEQ ID NO: 1041855 - DNA, 22 bp, Artificial Sequence
  chemically synthesized
gaagagattaaaaattacccct

SEQ ID NO: 1041856 - DNA, 22 bp, Artificial Sequence
  chemically synthesized
ggaagagattaaaaattacccc

SEQ ID NO: 1041857 - DNA, 22 bp, Artificial Sequence
  chemically synthesized
gagagtcactaggggtaatttt

SEQ ID NO: 1041858 - DNA, 22 bp, Artificial Sequence
  chemically synthesized
agagtcactaggggtaattttt

SEQ ID NO: 1041859 - DNA, 22 bp, Artificial Sequence
  chemically synthesized
agcaagtttggaagagattaaa

SEQ ID NO: 1041860 - DNA, 22 bp, Artificial Sequence
  chemically synthesized
tgagcaagtttggaagagatta

SEQ ID NO: 1041861 - DNA, 22 bp, Artificial Sequence
  chemically synthesized
ggggtaatttttaatctcttcc

SEQ ID NO: 1041862 - DNA, 22 bp, Artificial Sequence
  chemically synthesized
ctgagcaagtttggaagagatt

SEQ ID NO: 1041863 - DNA, 22 bp, Artificial Sequence
  chemically synthesized
tctgagcaagtttggaagagat

SEQ ID NO: 1041864 - DNA, 22 bp, Artificial Sequence
  chemically synthesized
ttaatctcttccaaacttgctc

SEQ ID NO: 1041865 - DNA, 22 bp, Artificial Sequence
  chemically synthesized
taatctcttccaaacttgctca

SEQ ID NO: 1041866 - DNA, 22 bp, Artificial Sequence
  chemically synthesized
aatctcttccaaacttgctcag

SEQ ID NO: 1041867 - DNA, 22 bp, Artificial Sequence
  chemically synthesized
atctcttccaaacttgctcaga

SEQ ID NO: 1041868 - DNA, 22 bp, Artificial Sequence
  chemically synthesized
ttccaaacttgctcagaaaata

SEQ ID NO: 1041869 - DNA, 22 bp, Artificial Sequence
  chemically synthesized
ccaaacttgctcagaaaatact

SEQ ID NO: 1041870 - DNA, 22 bp, Artificial Sequence
  chemically synthesized
caaacttgctcagaaaatactg

SEQ ID NO: 1041871 - DNA, 22 bp, Artificial Sequence
  chemically synthesized
gctcagaaaatactgatgtttt

SEQ ID NO: 1041872 - DNA, 22 bp, Artificial Sequence
  chemically synthesized
ctcagaaaatactgatgttttg

SEQ ID NO: 1041873 - DNA, 22 bp, Artificial Sequence
  chemically synthesized
gaaagggaatatagcaaaacat

SEQ ID NO: 1041874 - DNA, 22 bp, Artificial Sequence
  chemically synthesized
agaaaatactgatgttttgcta

SEQ ID NO: 1041875 - DNA, 22 bp, Artificial Sequence
  chemically synthesized
atgttttgctatattccctttc

SEQ ID NO: 1041876 - DNA, 22 bp, Artificial Sequence
  chemically synthesized
gaagaaaagaggtctggaaagg

SEQ ID NO: 1041877 - DNA, 22 bp, Artificial Sequence
  chemically synthesized
ggaagaaaagaggtctggaaag

SEQ ID NO: 1041878 - DNA, 22 bp, Artificial Sequence
  chemically synthesized
tgctatattccctttccagacc

SEQ ID NO: 1041879 - DNA, 22 bp, Artificial Sequence
  chemically synthesized
gctatattccctttccagacct

SEQ ID NO: 1041880 - DNA, 22 bp, Artificial Sequence
  chemically synthesized
ctatattccctttccagacctc

SEQ ID NO: 1041881 - DNA, 22 bp, Artificial Sequence
  chemically synthesized
ggtttggaagaaaagaggtctg

SEQ ID NO: 1041882 - DNA, 22 bp, Artificial Sequence
  chemically synthesized
tattccctttccagacctcttt

SEQ ID NO: 1041883 - DNA, 22 bp, Artificial Sequence
  chemically synthesized
cctttccagacctcttttcttc

SEQ ID NO: 1041884 - DNA, 22 bp, Artificial Sequence
  chemically synthesized
cagggttgggtttggaagaaaa

SEQ ID NO: 1041885 - DNA, 22 bp, Artificial Sequence
  chemically synthesized
tccagacctcttttcttccaaa

SEQ ID NO: 1041886 - DNA, 22 bp, Artificial Sequence
  chemically synthesized
ccagacctcttttcttccaaac

SEQ ID NO: 1041887 - DNA, 22 bp, Artificial Sequence
  chemically synthesized
cagacctcttttcttccaaacc

SEQ ID NO: 1041888 - DNA, 22 bp, Artificial Sequence
  chemically synthesized
tctacagggttgggtttggaag

SEQ ID NO: 1041889 - DNA, 22 bp, Artificial Sequence
  chemically synthesized
agattgtctacagggttgggtt

SEQ ID NO: 1041890 - DNA, 22 bp, Artificial Sequence
  chemically synthesized
ttttcttccaaacccaaccctg

SEQ ID NO: 1041891 - DNA, 22 bp, Artificial Sequence
  chemically synthesized
ttcttccaaacccaaccctgta

SEQ ID NO: 1041892 - DNA, 22 bp, Artificial Sequence
  chemically synthesized
tcttccaaacccaaccctgtag

SEQ ID NO: 1041893 - DNA, 22 bp, Artificial Sequence
  chemically synthesized
cttccaaacccaaccctgtaga

SEQ ID NO: 1041894 - DNA, 22 bp, Artificial Sequence
  chemically synthesized
ttccaaacccaaccctgtagac

SEQ ID NO: 1041895 - DNA, 22 bp, Artificial Sequence
  chemically synthesized
ccaaacccaaccctgtagacaa

SEQ ID NO: 1041896 - DNA, 22 bp, Artificial Sequence
  chemically synthesized
caaacccaaccctgtagacaat

SEQ ID NO: 1041897 - DNA, 22 bp, Artificial Sequence
  chemically synthesized
agtgatagaaatggctaagatt

SEQ ID NO: 1041898 - DNA, 22 bp, Artificial Sequence
  chemically synthesized
aagtgatagaaatggctaagat

SEQ ID NO: 1041899 - DNA, 22 bp, Artificial Sequence
  chemically synthesized
atttaagtgatagaaatggcta

SEQ ID NO: 1041900 - DNA, 22 bp, Artificial Sequence
  chemically synthesized
gatttaagtgatagaaatggct

SEQ ID NO: 1041901 - DNA, 22 bp, Artificial Sequence
  chemically synthesized
tagacaatcttagccatttcta

SEQ ID NO: 1041902 - DNA, 22 bp, Artificial Sequence
  chemically synthesized
tgtcaaagtttgatttaagtga

SEQ ID NO: 1041903 - DNA, 22 bp, Artificial Sequence
  chemically synthesized
agccatttctatcacttaaatc

SEQ ID NO: 1041904 - DNA, 22 bp, Artificial Sequence
  chemically synthesized
gtgtcaaagtttgatttaagtg

SEQ ID NO: 1041905 - DNA, 22 bp, Artificial Sequence
  chemically synthesized
gccatttctatcacttaaatca

SEQ ID NO: 1041906 - DNA, 22 bp, Artificial Sequence
  chemically synthesized
tgtgtcaaagtttgatttaagt

SEQ ID NO: 1041907 - DNA, 22 bp, Artificial Sequence
  chemically synthesized
ctttgtgtcaaagtttgattta

SEQ ID NO: 1041908 - DNA, 22 bp, Artificial Sequence
  chemically synthesized
ctatcacttaaatcaaactttg

SEQ ID NO: 1041909 - DNA, 22 bp, Artificial Sequence
  chemically synthesized
tatcacttaaatcaaactttga

SEQ ID NO: 1041910 - DNA, 22 bp, Artificial Sequence
  chemically synthesized
tcacttaaatcaaactttgaca

SEQ ID NO: 1041911 - DNA, 22 bp, Artificial Sequence
  chemically synthesized
aataaaattcctttgtgtcaaa

SEQ ID NO: 1041912 - DNA, 22 bp, Artificial Sequence
  chemically synthesized
aaatcaaactttgacacaaagg

SEQ ID NO: 1041913 - DNA, 22 bp, Artificial Sequence
  chemically synthesized
aatcaaactttgacacaaagga

SEQ ID NO: 1041914 - DNA, 22 bp, Artificial Sequence
  chemically synthesized
ccctaaataaaattcctttgtg

SEQ ID NO: 1041915 - DNA, 22 bp, Artificial Sequence
  chemically synthesized
ccacctcccctaaataaaattc

SEQ ID NO: 1041916 - DNA, 22 bp, Artificial Sequence
  chemically synthesized
cccacctcccctaaataaaatt

SEQ ID NO: 1041917 - DNA, 22 bp, Artificial Sequence
  chemically synthesized
tgacacaaaggaattttattta

SEQ ID NO: 1041918 - DNA, 22 bp, Artificial Sequence
  chemically synthesized
tcccacctcccctaaataaaat

SEQ ID NO: 1041919 - DNA, 22 bp, Artificial Sequence
  chemically synthesized
gacacaaaggaattttatttag

SEQ ID NO: 1041920 - DNA, 22 bp, Artificial Sequence
  chemically synthesized
acacaaaggaattttatttagg

SEQ ID NO: 1041921 - DNA, 22 bp, Artificial Sequence
  chemically synthesized
tcccctttcccacctcccctaa

SEQ ID NO: 1041922 - DNA, 22 bp, Artificial Sequence
  chemically synthesized
atcccctttcccacctccccta

SEQ ID NO: 1041923 - DNA, 22 bp, Artificial Sequence
  chemically synthesized
ttatcccctttcccacctcccc

SEQ ID NO: 1041924 - DNA, 22 bp, Artificial Sequence
  chemically synthesized
cttatcccctttcccacctccc

SEQ ID NO: 1041925 - DNA, 22 bp, Artificial Sequence
  chemically synthesized
tcttatcccctttcccacctcc

SEQ ID NO: 1041926 - DNA, 22 bp, Artificial Sequence
  chemically synthesized
ttcttatcccctttcccacctc

SEQ ID NO: 1041927 - DNA, 22 bp, Artificial Sequence
  chemically synthesized
tatttaggggaggtgggaaagg

SEQ ID NO: 1041928 - DNA, 22 bp, Artificial Sequence
  chemically synthesized
atttaggggaggtgggaaaggg

SEQ ID NO: 1041929 - DNA, 22 bp, Artificial Sequence
  chemically synthesized
tttaggggaggtgggaaagggg

SEQ ID NO: 1041930 - DNA, 22 bp, Artificial Sequence
  chemically synthesized
acatttttcttatcccctttcc

SEQ ID NO: 1041931 - DNA, 22 bp, Artificial Sequence
  chemically synthesized
gacatttttcttatcccctttc

SEQ ID NO: 1041932 - DNA, 22 bp, Artificial Sequence
  chemically synthesized
aggggaggtgggaaaggggata

SEQ ID NO: 1041933 - DNA, 22 bp, Artificial Sequence
  chemically synthesized
ggggaggtgggaaaggggataa

SEQ ID NO: 1041934 - DNA, 22 bp, Artificial Sequence
  chemically synthesized
ccaacttgacatttttcttatc

SEQ ID NO: 1041935 - DNA, 22 bp, Artificial Sequence
  chemically synthesized
tgctcccaacttgacatttttc

SEQ ID NO: 1041936 - DNA, 22 bp, Artificial Sequence
  chemically synthesized
ggccccagcagcagtgaatcta

SEQ ID NO: 1041937 - DNA, 22 bp, Artificial Sequence
  chemically synthesized
ttgggccccagcagcagtgaat

SEQ ID NO: 1041938 - DNA, 22 bp, Artificial Sequence
  chemically synthesized
tgttgggccccagcagcagtga

SEQ ID NO: 1041939 - DNA, 22 bp, Artificial Sequence
  chemically synthesized
ggagcatagattcactgctgct

SEQ ID NO: 1041940 - DNA, 22 bp, Artificial Sequence
  chemically synthesized
tctgttgggccccagcagcagt

SEQ ID NO: 1041941 - DNA, 22 bp, Artificial Sequence
  chemically synthesized
ctctgttgggccccagcagcag

SEQ ID NO: 1041942 - DNA, 22 bp, Artificial Sequence
  chemically synthesized
ggtgccttctctgttgggcccc

SEQ ID NO: 1041943 - DNA, 22 bp, Artificial Sequence
  chemically synthesized
actgctgctggggcccaacaga

SEQ ID NO: 1041944 - DNA, 22 bp, Artificial Sequence
  chemically synthesized
ctgggtgccttctctgttgggc

SEQ ID NO: 1041945 - DNA, 22 bp, Artificial Sequence
  chemically synthesized
ctgctgggtgccttctctgttg

SEQ ID NO: 1041946 - DNA, 22 bp, Artificial Sequence
  chemically synthesized
ctgctggggcccaacagagaag

SEQ ID NO: 1041947 - DNA, 22 bp, Artificial Sequence
  chemically synthesized
ctcctgctgggtgccttctctg

SEQ ID NO: 1041948 - DNA, 22 bp, Artificial Sequence
  chemically synthesized
ctggggcccaacagagaaggca

SEQ ID NO: 1041949 - DNA, 22 bp, Artificial Sequence
  chemically synthesized
gggcccaacagagaaggcaccc

SEQ ID NO: 1041950 - DNA, 22 bp, Artificial Sequence
  chemically synthesized
cctcctcctgctgggtgccttc

SEQ ID NO: 1041951 - DNA, 22 bp, Artificial Sequence
  chemically synthesized
actccctcctcctgctgggtgc

SEQ ID NO: 1041952 - DNA, 22 bp, Artificial Sequence
  chemically synthesized
agcagaatcaaccatcaaaggg

SEQ ID NO: 1041953 - DNA, 22 bp, Artificial Sequence
  chemically synthesized
aagcagaatcaaccatcaaagg

SEQ ID NO: 1041954 - DNA, 22 bp, Artificial Sequence
  chemically synthesized
gccctttgatggttgattctgc

SEQ ID NO: 1041955 - DNA, 22 bp, Artificial Sequence
  chemically synthesized
atgtagccttaagcagaatcaa

SEQ ID NO: 1041956 - DNA, 22 bp, Artificial Sequence
  chemically synthesized
gatgtagccttaagcagaatca

SEQ ID NO: 1041957 - DNA, 22 bp, Artificial Sequence
  chemically synthesized
tgatggttgattctgcttaagg

SEQ ID NO: 1041958 - DNA, 22 bp, Artificial Sequence
  chemically synthesized
gatggttgattctgcttaaggc

SEQ ID NO: 1041959 - DNA, 22 bp, Artificial Sequence
  chemically synthesized
atggttgattctgcttaaggct

SEQ ID NO: 1041960 - DNA, 22 bp, Artificial Sequence
  chemically synthesized
attctgcttaaggctacatcaa

SEQ ID NO: 1041961 - DNA, 22 bp, Artificial Sequence
  chemically synthesized
tccccaaaacaccttgatgtag

SEQ ID NO: 1041962 - DNA, 22 bp, Artificial Sequence
  chemically synthesized
tgcttaaggctacatcaaggtg

SEQ ID NO: 1041963 - DNA, 22 bp, Artificial Sequence
  chemically synthesized
ttatccccaaaacaccttgatg

SEQ ID NO: 1041964 - DNA, 22 bp, Artificial Sequence
  chemically synthesized
cttaaggctacatcaaggtgtt

SEQ ID NO: 1041965 - DNA, 22 bp, Artificial Sequence
  chemically synthesized
tgttatccccaaaacaccttga

SEQ ID NO: 1041966 - DNA, 22 bp, Artificial Sequence
  chemically synthesized
ctgttatccccaaaacaccttg

SEQ ID NO: 1041967 - DNA, 22 bp, Artificial Sequence
  chemically synthesized
aaggctacatcaaggtgttttg

SEQ ID NO: 1041968 - DNA, 22 bp, Artificial Sequence
  chemically synthesized
aggctacatcaaggtgttttgg

SEQ ID NO: 1041969 - DNA, 22 bp, Artificial Sequence
  chemically synthesized
gatttctgttatccccaaaaca

SEQ ID NO: 1041970 - DNA, 22 bp, Artificial Sequence
  chemically synthesized
cgatttctgttatccccaaaac

SEQ ID NO: 1041971 - DNA, 22 bp, Artificial Sequence
  chemically synthesized
ttcgatttctgttatccccaaa

SEQ ID NO: 1041972 - DNA, 22 bp, Artificial Sequence
  chemically synthesized
catcaaggtgttttggggataa

SEQ ID NO: 1041973 - DNA, 22 bp, Artificial Sequence
  chemically synthesized
cttcgatttctgttatccccaa

SEQ ID NO: 1041974 - DNA, 22 bp, Artificial Sequence
  chemically synthesized
gcttcttcgatttctgttatcc

SEQ ID NO: 1041975 - DNA, 22 bp, Artificial Sequence
  chemically synthesized
tagcttcttcgatttctgttat

SEQ ID NO: 1041976 - DNA, 22 bp, Artificial Sequence
  chemically synthesized
ctagcttcttcgatttctgtta

SEQ ID NO: 1041977 - DNA, 22 bp, Artificial Sequence
  chemically synthesized
ttctagcttcttcgatttctgt

SEQ ID NO: 1041978 - DNA, 22 bp, Artificial Sequence
  chemically synthesized
cttctagcttcttcgatttctg

SEQ ID NO: 1041979 - DNA, 22 bp, Artificial Sequence
  chemically synthesized
tcttctagcttcttcgatttct

SEQ ID NO: 1041980 - DNA, 22 bp, Artificial Sequence
  chemically synthesized
tggggataacagaaatcgaaga

SEQ ID NO: 1041981 - DNA, 22 bp, Artificial Sequence
  chemically synthesized
ggggataacagaaatcgaagaa

SEQ ID NO: 1041982 - DNA, 22 bp, Artificial Sequence
  chemically synthesized
gggataacagaaatcgaagaag

SEQ ID NO: 1041983 - DNA, 22 bp, Artificial Sequence
  chemically synthesized
tactttcttctagcttcttcga

SEQ ID NO: 1041984 - DNA, 22 bp, Artificial Sequence
  chemically synthesized
cctgtactttcttctagcttct

SEQ ID NO: 1041985 - DNA, 22 bp, Artificial Sequence
  chemically synthesized
ccctgtactttcttctagcttc

SEQ ID NO: 1041986 - DNA, 22 bp, Artificial Sequence
  chemically synthesized
tccctgtactttcttctagctt

SEQ ID NO: 1041987 - DNA, 22 bp, Artificial Sequence
  chemically synthesized
ttccctgtactttcttctagct

SEQ ID NO: 1041988 - DNA, 22 bp, Artificial Sequence
  chemically synthesized
tttccctgtactttcttctagc

SEQ ID NO: 1041989 - DNA, 22 bp, Artificial Sequence
  chemically synthesized
aattttttccctgtactttctt

SEQ ID NO: 1041990 - DNA, 22 bp, Artificial Sequence
  chemically synthesized
gaattttttccctgtactttct

SEQ ID NO: 1041991 - DNA, 22 bp, Artificial Sequence
  chemically synthesized
tagacttgaattttttccctgt

SEQ ID NO: 1041992 - DNA, 22 bp, Artificial Sequence
  chemically synthesized
gaagaaagtacagggaaaaaat

SEQ ID NO: 1041993 - DNA, 22 bp, Artificial Sequence
  chemically synthesized
ccaacctgtagacttgaatttt

SEQ ID NO: 1041994 - DNA, 22 bp, Artificial Sequence
  chemically synthesized
tctaccaacctgtagacttgaa

SEQ ID NO: 1041995 - DNA, 22 bp, Artificial Sequence
  chemically synthesized
actgtctaccaacctgtagact

SEQ ID NO: 1041996 - DNA, 22 bp, Artificial Sequence
  chemically synthesized
tgactgtctaccaacctgtaga

SEQ ID NO: 1041997 - DNA, 22 bp, Artificial Sequence
  chemically synthesized
aagtctacaggttggtagacag

SEQ ID NO: 1041998 - DNA, 22 bp, Artificial Sequence
  chemically synthesized
caggttggtagacagtcagaga

SEQ ID NO: 1041999 - DNA, 22 bp, Artificial Sequence
  chemically synthesized
gtagacagtcagagactcttgg

SEQ ID NO: 1042000 - DNA, 22 bp, Artificial Sequence
  chemically synthesized
ttggttctgttgccatggtggg

SEQ ID NO: 1042001 - DNA, 22 bp, Artificial Sequence
  chemically synthesized
ggttctgttgccatggtgggat

SEQ ID NO: 1042002 - DNA, 22 bp, Artificial Sequence
  chemically synthesized
gttctgttgccatggtgggatt

SEQ ID NO: 1042003 - DNA, 22 bp, Artificial Sequence
  chemically synthesized
gaaggtgtatataatcccacca

SEQ ID NO: 1042004 - DNA, 22 bp, Artificial Sequence
  chemically synthesized
tggaaggtgtatataatcccac

SEQ ID NO: 1042005 - DNA, 22 bp, Artificial Sequence
  chemically synthesized
ctggaaggtgtatataatccca

SEQ ID NO: 1042006 - DNA, 22 bp, Artificial Sequence
  chemically synthesized
tgttgccatggtgggattatat

SEQ ID NO: 1042007 - DNA, 22 bp, Artificial Sequence
  chemically synthesized
tctggaaggtgtatataatccc

SEQ ID NO: 1042008 - DNA, 22 bp, Artificial Sequence
  chemically synthesized
ttgccatggtgggattatatac

SEQ ID NO: 1042009 - DNA, 22 bp, Artificial Sequence
  chemically synthesized
ccatggtgggattatatacacc

SEQ ID NO: 1042010 - DNA, 22 bp, Artificial Sequence
  chemically synthesized
aggaaaggttttctggaaggtg

SEQ ID NO: 1042011 - DNA, 22 bp, Artificial Sequence
  chemically synthesized
gttaaggaaaggttttctggaa

SEQ ID NO: 1042012 - DNA, 22 bp, Artificial Sequence
  chemically synthesized
tatacaccttccagaaaacctt

SEQ ID NO: 1042013 - DNA, 22 bp, Artificial Sequence
  chemically synthesized
attggttaaggaaaggttttct

SEQ ID NO: 1042014 - DNA, 22 bp, Artificial Sequence
  chemically synthesized
tgattggttaaggaaaggtttt

SEQ ID NO: 1042015 - DNA, 22 bp, Artificial Sequence
  chemically synthesized
ccagaaaacctttccttaacca

SEQ ID NO: 1042016 - DNA, 22 bp, Artificial Sequence
  chemically synthesized
cagaaaacctttccttaaccaa

SEQ ID NO: 1042017 - DNA, 22 bp, Artificial Sequence
  chemically synthesized
aataaatactctgattggttaa

SEQ ID NO: 1042018 - DNA, 22 bp, Artificial Sequence
  chemically synthesized
gttaaataaatactctgattgg

SEQ ID NO: 1042019 - DNA, 22 bp, Artificial Sequence
  chemically synthesized
tctagttaaataaatactctga

SEQ ID NO: 1042020 - DNA, 22 bp, Artificial Sequence
  chemically synthesized
tccttaaccaatcagagtattt

SEQ ID NO: 1042021 - DNA, 22 bp, Artificial Sequence
  chemically synthesized
ccttaaccaatcagagtattta

SEQ ID NO: 1042022 - DNA, 22 bp, Artificial Sequence
  chemically synthesized
tatctagttaaataaatactct

SEQ ID NO: 1042023 - DNA, 22 bp, Artificial Sequence
  chemically synthesized
cttaaccaatcagagtatttat

SEQ ID NO: 1042024 - DNA, 22 bp, Artificial Sequence
  chemically synthesized
ctatctagttaaataaatactc

SEQ ID NO: 1042025 - DNA, 22 bp, Artificial Sequence
  chemically synthesized
aaccaatcagagtatttattta

SEQ ID NO: 1042026 - DNA, 22 bp, Artificial Sequence
  chemically synthesized
accaatcagagtatttatttaa

SEQ ID NO: 1042027 - DNA, 22 bp, Artificial Sequence
  chemically synthesized
ccgatacatatttctatctagt

SEQ ID NO: 1042028 - DNA, 22 bp, Artificial Sequence
  chemically synthesized
cccgatacatatttctatctag

SEQ ID NO: 1042029 - DNA, 22 bp, Artificial Sequence
  chemically synthesized
gatttcccgatacatatttcta

SEQ ID NO: 1042030 - DNA, 22 bp, Artificial Sequence
  chemically synthesized
atttaactagatagaaatatgt

SEQ ID NO: 1042031 - DNA, 22 bp, Artificial Sequence
  chemically synthesized
tttaactagatagaaatatgta

SEQ ID NO: 1042032 - DNA, 22 bp, Artificial Sequence
  chemically synthesized
aactagatagaaatatgtatcg

SEQ ID NO: 1042033 - DNA, 22 bp, Artificial Sequence
  chemically synthesized
actagatagaaatatgtatcgg

SEQ ID NO: 1042034 - DNA, 22 bp, Artificial Sequence
  chemically synthesized
gatagaaatatgtatcgggaaa

SEQ ID NO: 1042035 - DNA, 22 bp, Artificial Sequence
  chemically synthesized
gtgcaaaatgtggactggattt

SEQ ID NO: 1042036 - DNA, 22 bp, Artificial Sequence
  chemically synthesized
tgttagtgcaaaatgtggactg

SEQ ID NO: 1042037 - DNA, 22 bp, Artificial Sequence
  chemically synthesized
ctgtgttagtgcaaaatgtgga

SEQ ID NO: 1042038 - DNA, 22 bp, Artificial Sequence
  chemically synthesized
cctgtgttagtgcaaaatgtgg

SEQ ID NO: 1042039 - DNA, 22 bp, Artificial Sequence
  chemically synthesized
tcctgtgttagtgcaaaatgtg

SEQ ID NO: 1042040 - DNA, 22 bp, Artificial Sequence
  chemically synthesized
gatcacccattttcctgtgtta

SEQ ID NO: 1042041 - DNA, 22 bp, Artificial Sequence
  chemically synthesized
tgcactaacacaggaaaatggg

SEQ ID NO: 1042042 - DNA, 22 bp, Artificial Sequence
  chemically synthesized
gcactaacacaggaaaatgggt

SEQ ID NO: 1042043 - DNA, 22 bp, Artificial Sequence
  chemically synthesized
cactaacacaggaaaatgggtg

SEQ ID NO: 1042044 - DNA, 22 bp, Artificial Sequence
  chemically synthesized
acacaggaaaatgggtgatcta

SEQ ID NO: 1042045 - DNA, 22 bp, Artificial Sequence
  chemically synthesized
aggagatgcccaacatcctaga

SEQ ID NO: 1042046 - DNA, 22 bp, Artificial Sequence
  chemically synthesized
actcaggagatgcccaacatcc

SEQ ID NO: 1042047 - DNA, 22 bp, Artificial Sequence
  chemically synthesized
aagttcactcaggagatgccca

SEQ ID NO: 1042048 - DNA, 22 bp, Artificial Sequence
  chemically synthesized
ttaaagttcactcaggagatgc

SEQ ID NO: 1042049 - DNA, 22 bp, Artificial Sequence
  chemically synthesized
ggatgttgggcatctcctgagt

SEQ ID NO: 1042050 - DNA, 22 bp, Artificial Sequence
  chemically synthesized
attattaaagttcactcaggag

SEQ ID NO: 1042051 - DNA, 22 bp, Artificial Sequence
  chemically synthesized
tcattattaaagttcactcagg

SEQ ID NO: 1042052 - DNA, 22 bp, Artificial Sequence
  chemically synthesized
ggcatctcctgagtgaacttta

SEQ ID NO: 1042053 - DNA, 22 bp, Artificial Sequence
  chemically synthesized
taccaggactctcattattaaa

SEQ ID NO: 1042054 - DNA, 22 bp, Artificial Sequence
  chemically synthesized
ctgagtgaactttaataatgag

SEQ ID NO: 1042055 - DNA, 22 bp, Artificial Sequence
  chemically synthesized
agtgaactttaataatgagagt

SEQ ID NO: 1042056 - DNA, 22 bp, Artificial Sequence
  chemically synthesized
agtagctgtaccaggactctca

SEQ ID NO: 1042057 - DNA, 22 bp, Artificial Sequence
  chemically synthesized
attcagtagctgtaccaggact

SEQ ID NO: 1042058 - DNA, 22 bp, Artificial Sequence
  chemically synthesized
gattcagtagctgtaccaggac

SEQ ID NO: 1042059 - DNA, 22 bp, Artificial Sequence
  chemically synthesized
taataatgagagtcctggtaca

SEQ ID NO: 1042060 - DNA, 22 bp, Artificial Sequence
  chemically synthesized
aataatgagagtcctggtacag

SEQ ID NO: 1042061 - DNA, 22 bp, Artificial Sequence
  chemically synthesized
ataatgagagtcctggtacagc

SEQ ID NO: 1042062 - DNA, 22 bp, Artificial Sequence
  chemically synthesized
taaaccatacccttgattcagt

SEQ ID NO: 1042063 - DNA, 22 bp, Artificial Sequence
  chemically synthesized
ataaaccatacccttgattcag

SEQ ID NO: 1042064 - DNA, 22 bp, Artificial Sequence
  chemically synthesized
gtacagctactgaatcaagggt

SEQ ID NO: 1042065 - DNA, 22 bp, Artificial Sequence
  chemically synthesized
gaccgatttataaaccataccc

SEQ ID NO: 1042066 - DNA, 22 bp, Artificial Sequence
  chemically synthesized
ctgaatcaagggtatggtttat

SEQ ID NO: 1042067 - DNA, 22 bp, Artificial Sequence
  chemically synthesized
aatcaagggtatggtttataaa

SEQ ID NO: 1042068 - DNA, 22 bp, Artificial Sequence
  chemically synthesized
agcatagctggaccgatttata

SEQ ID NO: 1042069 - DNA, 22 bp, Artificial Sequence
  chemically synthesized
tgttcagcatagctggaccgat

SEQ ID NO: 1042070 - DNA, 22 bp, Artificial Sequence
  chemically synthesized
gtgttcagcatagctggaccga

SEQ ID NO: 1042071 - DNA, 22 bp, Artificial Sequence
  chemically synthesized
ataaatcggtccagctatgctg

SEQ ID NO: 1042072 - DNA, 22 bp, Artificial Sequence
  chemically synthesized
taaatcggtccagctatgctga

SEQ ID NO: 1042073 - DNA, 22 bp, Artificial Sequence
  chemically synthesized
tgctgaacacaaatatctcctt

SEQ ID NO: 1042074 - DNA, 22 bp, Artificial Sequence
  chemically synthesized
aacacaaatatctccttactta

SEQ ID NO: 1042075 - DNA, 22 bp, Artificial Sequence
  chemically synthesized
cttacttattgttttatctctt

SEQ ID NO: 1042076 - DNA, 22 bp, Artificial Sequence
  chemically synthesized
acttattgttttatctctttat

SEQ ID NO: 1042077 - DNA, 22 bp, Artificial Sequence
  chemically synthesized
cttattgttttatctctttatt

SEQ ID NO: 1042078 - DNA, 22 bp, Artificial Sequence
  chemically synthesized
gacacaaggaaaaataaagaga

SEQ ID NO: 1042079 - DNA, 22 bp, Artificial Sequence
  chemically synthesized
attgttttatctctttattttt

SEQ ID NO: 1042080 - DNA, 22 bp, Artificial Sequence
  chemically synthesized
ttgttttatctctttatttttc

SEQ ID NO: 1042081 - DNA, 22 bp, Artificial Sequence
  chemically synthesized
ttttatctctttatttttcctt

SEQ ID NO: 1042082 - DNA, 22 bp, Artificial Sequence
  chemically synthesized
tatctctttatttttccttgtg

SEQ ID NO: 1042083 - DNA, 22 bp, Artificial Sequence
  chemically synthesized
atctctttatttttccttgtgt

SEQ ID NO: 1042084 - DNA, 22 bp, Artificial Sequence
  chemically synthesized
tctctttatttttccttgtgtc

SEQ ID NO: 1042085 - DNA, 22 bp, Artificial Sequence
  chemically synthesized
tttatttttccttgtgtccaat

SEQ ID NO: 1042086 - DNA, 22 bp, Artificial Sequence
  chemically synthesized
tatttttccttgtgtccaattt

SEQ ID NO: 1042087 - DNA, 22 bp, Artificial Sequence
  chemically synthesized
aaatggcaggataaattggaca

SEQ ID NO: 1042088 - DNA, 22 bp, Artificial Sequence
  chemically synthesized
atttttccttgtgtccaattta

SEQ ID NO: 1042089 - DNA, 22 bp, Artificial Sequence
  chemically synthesized
aaaatggcaggataaattggac

SEQ ID NO: 1042090 - DNA, 22 bp, Artificial Sequence
  chemically synthesized
tttttccttgtgtccaatttat

SEQ ID NO: 1042091 - DNA, 22 bp, Artificial Sequence
  chemically synthesized
ttccttgtgtccaatttatcct

SEQ ID NO: 1042092 - DNA, 22 bp, Artificial Sequence
  chemically synthesized
tccttgtgtccaatttatcctg

SEQ ID NO: 1042093 - DNA, 22 bp, Artificial Sequence
  chemically synthesized
ccttgtgtccaatttatcctgc

SEQ ID NO: 1042094 - DNA, 22 bp, Artificial Sequence
  chemically synthesized
cttgtgtccaatttatcctgcc

SEQ ID NO: 1042095 - DNA, 22 bp, Artificial Sequence
  chemically synthesized
gtgtccaatttatcctgccatt

SEQ ID NO: 1042096 - DNA, 22 bp, Artificial Sequence
  chemically synthesized
tgtccaatttatcctgccattt

SEQ ID NO: 1042097 - DNA, 22 bp, Artificial Sequence
  chemically synthesized
gtcagggataatccttaaaatg

SEQ ID NO: 1042098 - DNA, 22 bp, Artificial Sequence
  chemically synthesized
ggtcagggataatccttaaaat

SEQ ID NO: 1042099 - DNA, 22 bp, Artificial Sequence
  chemically synthesized
tggtcagggataatccttaaaa

SEQ ID NO: 1042100 - DNA, 22 bp, Artificial Sequence
  chemically synthesized
atcctgccattttaaggattat

SEQ ID NO: 1042101 - DNA, 22 bp, Artificial Sequence
  chemically synthesized
tcctgccattttaaggattatc

SEQ ID NO: 1042102 - DNA, 22 bp, Artificial Sequence
  chemically synthesized
ccattttaaggattatccctga

SEQ ID NO: 1042103 - DNA, 22 bp, Artificial Sequence
  chemically synthesized
taaggattatccctgaccaaaa

SEQ ID NO: 1042104 - DNA, 22 bp, Artificial Sequence
  chemically synthesized
aaggattatccctgaccaaaat

SEQ ID NO: 1042105 - DNA, 22 bp, Artificial Sequence
  chemically synthesized
aggattatccctgaccaaaatc

SEQ ID NO: 1042106 - DNA, 22 bp, Artificial Sequence
  chemically synthesized
tatgtcatcatggatggatttt

SEQ ID NO: 1042107 - DNA, 22 bp, Artificial Sequence
  chemically synthesized
tccctgaccaaaatccatccat

SEQ ID NO: 1042108 - DNA, 22 bp, Artificial Sequence
  chemically synthesized
accaaaatccatccatgatgac

SEQ ID NO: 1042109 - DNA, 22 bp, Artificial Sequence
  chemically synthesized
aaagtgtccaaaaagctatatg

SEQ ID NO: 1042110 - DNA, 22 bp, Artificial Sequence
  chemically synthesized
gaaagtgtccaaaaagctatat

SEQ ID NO: 1042111 - DNA, 22 bp, Artificial Sequence
  chemically synthesized
aaagatgggcttgaaagtgtcc

SEQ ID NO: 1042112 - DNA, 22 bp, Artificial Sequence
  chemically synthesized
tttggacactttcaagcccatc

SEQ ID NO: 1042113 - DNA, 22 bp, Artificial Sequence
  chemically synthesized
ttggacactttcaagcccatct

SEQ ID NO: 1042114 - DNA, 22 bp, Artificial Sequence
  chemically synthesized
tggacactttcaagcccatctt

SEQ ID NO: 1042115 - DNA, 22 bp, Artificial Sequence
  chemically synthesized
ggacactttcaagcccatcttt

SEQ ID NO: 1042116 - DNA, 22 bp, Artificial Sequence
  chemically synthesized
gacactttcaagcccatctttt

SEQ ID NO: 1042117 - DNA, 22 bp, Artificial Sequence
  chemically synthesized
gaaaaaaagatgggctaaaaga

SEQ ID NO: 1042118 - DNA, 22 bp, Artificial Sequence
  chemically synthesized
tcaagcccatcttttagcccat

SEQ ID NO: 1042119 - DNA, 22 bp, Artificial Sequence
  chemically synthesized
ctggaaaaaaagatgggctaaa

SEQ ID NO: 1042120 - DNA, 22 bp, Artificial Sequence
  chemically synthesized
caagcccatcttttagcccatc

SEQ ID NO: 1042121 - DNA, 22 bp, Artificial Sequence
  chemically synthesized
cctggaaaaaaagatgggctaa

SEQ ID NO: 1042122 - DNA, 22 bp, Artificial Sequence
  chemically synthesized
aagcccatcttttagcccatct

SEQ ID NO: 1042123 - DNA, 22 bp, Artificial Sequence
  chemically synthesized
tcctggaaaaaaagatgggcta

SEQ ID NO: 1042124 - DNA, 22 bp, Artificial Sequence
  chemically synthesized
ttcctggaaaaaaagatgggct

SEQ ID NO: 1042125 - DNA, 22 bp, Artificial Sequence
  chemically synthesized
tttcctggaaaaaaagatgggc

SEQ ID NO: 1042126 - DNA, 22 bp, Artificial Sequence
  chemically synthesized
ttttcctggaaaaaaagatggg

SEQ ID NO: 1042127 - DNA, 22 bp, Artificial Sequence
  chemically synthesized
tttttcctggaaaaaaagatgg

SEQ ID NO: 1042128 - DNA, 22 bp, Artificial Sequence
  chemically synthesized
ttttttcctggaaaaaaagatg

SEQ ID NO: 1042129 - DNA, 22 bp, Artificial Sequence
  chemically synthesized
ttttttttcctggaaaaaaaga

SEQ ID NO: 1042130 - DNA, 22 bp, Artificial Sequence
  chemically synthesized
cttttttttcctggaaaaaaag

SEQ ID NO: 1042131 - DNA, 22 bp, Artificial Sequence
  chemically synthesized
tcttttttttcctggaaaaaaa

SEQ ID NO: 1042132 - DNA, 22 bp, Artificial Sequence
  chemically synthesized
ttcttttttttcctggaaaaaa

SEQ ID NO: 1042133 - DNA, 22 bp, Artificial Sequence
  chemically synthesized
ttagcccatctttttttccagg

SEQ ID NO: 1042134 - DNA, 22 bp, Artificial Sequence
  chemically synthesized
tttcttttttttcctggaaaaa

SEQ ID NO: 1042135 - DNA, 22 bp, Artificial Sequence
  chemically synthesized
tagcccatctttttttccagga

SEQ ID NO: 1042136 - DNA, 22 bp, Artificial Sequence
  chemically synthesized
agcccatctttttttccaggaa

SEQ ID NO: 1042137 - DNA, 22 bp, Artificial Sequence
  chemically synthesized
gcccatctttttttccaggaaa

SEQ ID NO: 1042138 - DNA, 22 bp, Artificial Sequence
  chemically synthesized
tttttccaggaaaaaaaagaaa

SEQ ID NO: 1042139 - DNA, 22 bp, Artificial Sequence
  chemically synthesized
tgaatccagttttttctttttt

SEQ ID NO: 1042140 - DNA, 22 bp, Artificial Sequence
  chemically synthesized
ttttccaggaaaaaaaagaaaa

SEQ ID NO: 1042141 - DNA, 22 bp, Artificial Sequence
  chemically synthesized
tttccaggaaaaaaaagaaaaa

SEQ ID NO: 1042142 - DNA, 22 bp, Artificial Sequence
  chemically synthesized
ttccaggaaaaaaaagaaaaaa

SEQ ID NO: 1042143 - DNA, 22 bp, Artificial Sequence
  chemically synthesized
tccaggaaaaaaaagaaaaaac

SEQ ID NO: 1042144 - DNA, 22 bp, Artificial Sequence
  chemically synthesized
ccaggaaaaaaaagaaaaaact

SEQ ID NO: 1042145 - DNA, 22 bp, Artificial Sequence
  chemically synthesized
caggaaaaaaaagaaaaaactg

SEQ ID NO: 1042146 - DNA, 22 bp, Artificial Sequence
  chemically synthesized
gataaaaactgtgaatccagtt

SEQ ID NO: 1042147 - DNA, 22 bp, Artificial Sequence
  chemically synthesized
ggaaatcaagttggataaaaac

SEQ ID NO: 1042148 - DNA, 22 bp, Artificial Sequence
  chemically synthesized
gattcacagtttttatccaact

SEQ ID NO: 1042149 - DNA, 22 bp, Artificial Sequence
  chemically synthesized
acagtttttatccaacttgatt

SEQ ID NO: 1042150 - DNA, 22 bp, Artificial Sequence
  chemically synthesized
gcaaagcactaggaaatcaagt

SEQ ID NO: 1042151 - DNA, 22 bp, Artificial Sequence
  chemically synthesized
ctggcaaagcactaggaaatca

SEQ ID NO: 1042152 - DNA, 22 bp, Artificial Sequence
  chemically synthesized
ttatccaacttgatttcctagt

SEQ ID NO: 1042153 - DNA, 22 bp, Artificial Sequence
  chemically synthesized
tgctggcaaagcactaggaaat

SEQ ID NO: 1042154 - DNA, 22 bp, Artificial Sequence
  chemically synthesized
tatccaacttgatttcctagtg

SEQ ID NO: 1042155 - DNA, 22 bp, Artificial Sequence
  chemically synthesized
atccaacttgatttcctagtgc

SEQ ID NO: 1042156 - DNA, 22 bp, Artificial Sequence
  chemically synthesized
tccaacttgatttcctagtgct

SEQ ID NO: 1042157 - DNA, 22 bp, Artificial Sequence
  chemically synthesized
aagtgtctctgctggcaaagca

SEQ ID NO: 1042158 - DNA, 22 bp, Artificial Sequence
  chemically synthesized
caagtgtctctgctggcaaagc

SEQ ID NO: 1042159 - DNA, 22 bp, Artificial Sequence
  chemically synthesized
gatttcctagtgctttgccagc

SEQ ID NO: 1042160 - DNA, 22 bp, Artificial Sequence
  chemically synthesized
tcaagtgtctctgctggcaaag

SEQ ID NO: 1042161 - DNA, 22 bp, Artificial Sequence
  chemically synthesized
atttcctagtgctttgccagca

SEQ ID NO: 1042162 - DNA, 22 bp, Artificial Sequence
  chemically synthesized
cctagtgctttgccagcagaga

SEQ ID NO: 1042163 - DNA, 22 bp, Artificial Sequence
  chemically synthesized
tcctttcaagtgtctctgctgg

SEQ ID NO: 1042164 - DNA, 22 bp, Artificial Sequence
  chemically synthesized
ctagtgctttgccagcagagac

SEQ ID NO: 1042165 - DNA, 22 bp, Artificial Sequence
  chemically synthesized
gtgctttgccagcagagacact

SEQ ID NO: 1042166 - DNA, 22 bp, Artificial Sequence
  chemically synthesized
attatcctttcaagtgtctctg

SEQ ID NO: 1042167 - DNA, 22 bp, Artificial Sequence
  chemically synthesized
gattatcctttcaagtgtctct

SEQ ID NO: 1042168 - DNA, 22 bp, Artificial Sequence
  chemically synthesized
tgattatcctttcaagtgtctc

SEQ ID NO: 1042169 - DNA, 22 bp, Artificial Sequence
  chemically synthesized
tgccagcagagacacttgaaag

SEQ ID NO: 1042170 - DNA, 22 bp, Artificial Sequence
  chemically synthesized
actttgattatcctttcaagtg

SEQ ID NO: 1042171 - DNA, 22 bp, Artificial Sequence
  chemically synthesized
gccagcagagacacttgaaagg

SEQ ID NO: 1042172 - DNA, 22 bp, Artificial Sequence
  chemically synthesized
ccagcagagacacttgaaagga

SEQ ID NO: 1042173 - DNA, 22 bp, Artificial Sequence
  chemically synthesized
ttcactttgattatcctttcaa

SEQ ID NO: 1042174 - DNA, 22 bp, Artificial Sequence
  chemically synthesized
ttattcactttgattatccttt

SEQ ID NO: 1042175 - DNA, 22 bp, Artificial Sequence
  chemically synthesized
gttattcactttgattatcctt

SEQ ID NO: 1042176 - DNA, 22 bp, Artificial Sequence
  chemically synthesized
tgttattcactttgattatcct

SEQ ID NO: 1042177 - DNA, 22 bp, Artificial Sequence
  chemically synthesized
actttgttattcactttgatta

SEQ ID NO: 1042178 - DNA, 22 bp, Artificial Sequence
  chemically synthesized
cactttgttattcactttgatt

SEQ ID NO: 1042179 - DNA, 22 bp, Artificial Sequence
  chemically synthesized
gaaaggataatcaaagtgaata

SEQ ID NO: 1042180 - DNA, 22 bp, Artificial Sequence
  chemically synthesized
aaaggataatcaaagtgaataa

SEQ ID NO: 1042181 - DNA, 22 bp, Artificial Sequence
  chemically synthesized
atccttcactttgttattcact

SEQ ID NO: 1042182 - DNA, 22 bp, Artificial Sequence
  chemically synthesized
aagaataacaaagagattaatc

SEQ ID NO: 1042183 - DNA, 22 bp, Artificial Sequence
  chemically synthesized
atctctttgttattcttcagac

SEQ ID NO: 1042184 - DNA, 22 bp, Artificial Sequence
  chemically synthesized
tatcagaaggatgtgtctgaag

SEQ ID NO: 1042185 - DNA, 22 bp, Artificial Sequence
  chemically synthesized
tttgttattcttcagacacatc

SEQ ID NO: 1042186 - DNA, 22 bp, Artificial Sequence
  chemically synthesized
tgttattcttcagacacatcct

SEQ ID NO: 1042187 - DNA, 22 bp, Artificial Sequence
  chemically synthesized
gttattcttcagacacatcctt

SEQ ID NO: 1042188 - DNA, 22 bp, Artificial Sequence
  chemically synthesized
ttattcttcagacacatccttc

SEQ ID NO: 1042189 - DNA, 22 bp, Artificial Sequence
  chemically synthesized
ttcttcagacacatccttctga

SEQ ID NO: 1042190 - DNA, 22 bp, Artificial Sequence
  chemically synthesized
ttcagacacatccttctgatac

SEQ ID NO: 1042191 - DNA, 22 bp, Artificial Sequence
  chemically synthesized
cagacacatccttctgatacaa

SEQ ID NO: 1042192 - DNA, 22 bp, Artificial Sequence
  chemically synthesized
agacacatccttctgatacaat

SEQ ID NO: 1042193 - DNA, 22 bp, Artificial Sequence
  chemically synthesized
ctgatacaattttttttttttt

SEQ ID NO: 1042194 - DNA, 22 bp, Artificial Sequence
  chemically synthesized
tgatacaatttttttttttttt

SEQ ID NO: 1042195 - DNA, 22 bp, Artificial Sequence
  chemically synthesized
atacaattttttttttttttac

SEQ ID NO: 1042196 - DNA, 22 bp, Artificial Sequence
  chemically synthesized
aagatacaaagtcagtaagggt

SEQ ID NO: 1042197 - DNA, 22 bp, Artificial Sequence
  chemically synthesized
tttttttttttacccttactga

SEQ ID NO: 1042198 - DNA, 22 bp, Artificial Sequence
  chemically synthesized
ttttttttttacccttactgac

SEQ ID NO: 1042199 - DNA, 22 bp, Artificial Sequence
  chemically synthesized
tttttttttacccttactgact

SEQ ID NO: 1042200 - DNA, 22 bp, Artificial Sequence
  chemically synthesized
ttttttttacccttactgactt

SEQ ID NO: 1042201 - DNA, 22 bp, Artificial Sequence
  chemically synthesized
tttttttacccttactgacttt

SEQ ID NO: 1042202 - DNA, 22 bp, Artificial Sequence
  chemically synthesized
ttttttacccttactgactttg

SEQ ID NO: 1042203 - DNA, 22 bp, Artificial Sequence
  chemically synthesized
tttttacccttactgactttgt

SEQ ID NO: 1042204 - DNA, 22 bp, Artificial Sequence
  chemically synthesized
aaagttaaagatacaaagtcag

SEQ ID NO: 1042205 - DNA, 22 bp, Artificial Sequence
  chemically synthesized
ttttacccttactgactttgta

SEQ ID NO: 1042206 - DNA, 22 bp, Artificial Sequence
  chemically synthesized
caaagttaaagatacaaagtca

SEQ ID NO: 1042207 - DNA, 22 bp, Artificial Sequence
  chemically synthesized
tttacccttactgactttgtat

SEQ ID NO: 1042208 - DNA, 22 bp, Artificial Sequence
  chemically synthesized
tcaaagttaaagatacaaagtc

SEQ ID NO: 1042209 - DNA, 22 bp, Artificial Sequence
  chemically synthesized
ttacccttactgactttgtatc

SEQ ID NO: 1042210 - DNA, 22 bp, Artificial Sequence
  chemically synthesized
tacccttactgactttgtatct

SEQ ID NO: 1042211 - DNA, 22 bp, Artificial Sequence
  chemically synthesized
acccttactgactttgtatctt

SEQ ID NO: 1042212 - DNA, 22 bp, Artificial Sequence
  chemically synthesized
cccttactgactttgtatcttt

SEQ ID NO: 1042213 - DNA, 22 bp, Artificial Sequence
  chemically synthesized
actgactttgtatctttaactt

SEQ ID NO: 1042214 - DNA, 22 bp, Artificial Sequence
  chemically synthesized
ctgactttgtatctttaacttt

SEQ ID NO: 1042215 - DNA, 22 bp, Artificial Sequence
  chemically synthesized
actttgtatctttaactttgaa

SEQ ID NO: 1042216 - DNA, 22 bp, Artificial Sequence
  chemically synthesized
atgcagaaaatgttttcaaagt

SEQ ID NO: 1042217 - DNA, 22 bp, Artificial Sequence
  chemically synthesized
gatgcagaaaatgttttcaaag

SEQ ID NO: 1042218 - DNA, 22 bp, Artificial Sequence
  chemically synthesized
tgtatctttaactttgaaaaca

SEQ ID NO: 1042219 - DNA, 22 bp, Artificial Sequence
  chemically synthesized
gtatctttaactttgaaaacat

SEQ ID NO: 1042220 - DNA, 22 bp, Artificial Sequence
  chemically synthesized
ttgatgcagaaaatgttttcaa

SEQ ID NO: 1042221 - DNA, 22 bp, Artificial Sequence
  chemically synthesized
tatctttaactttgaaaacatt

SEQ ID NO: 1042222 - DNA, 22 bp, Artificial Sequence
  chemically synthesized
cttgatgcagaaaatgttttca

SEQ ID NO: 1042223 - DNA, 22 bp, Artificial Sequence
  chemically synthesized
taactttgaaaacattttctgc

SEQ ID NO: 1042224 - DNA, 22 bp, Artificial Sequence
  chemically synthesized
aactttgaaaacattttctgca

SEQ ID NO: 1042225 - DNA, 22 bp, Artificial Sequence
  chemically synthesized
actttgaaaacattttctgcat

SEQ ID NO: 1042226 - DNA, 22 bp, Artificial Sequence
  chemically synthesized
tacagtttcttgatgcagaaaa

SEQ ID NO: 1042227 - DNA, 22 bp, Artificial Sequence
  chemically synthesized
tgaaaacattttctgcatcaag

SEQ ID NO: 1042228 - DNA, 22 bp, Artificial Sequence
  chemically synthesized
gaaaacattttctgcatcaaga

SEQ ID NO: 1042229 - DNA, 22 bp, Artificial Sequence
  chemically synthesized
cgctatacagtttcttgatgca

SEQ ID NO: 1042230 - DNA, 22 bp, Artificial Sequence
  chemically synthesized
aaaacattttctgcatcaagaa

SEQ ID NO: 1042231 - DNA, 22 bp, Artificial Sequence
  chemically synthesized
agcactacgctatacagtttct

SEQ ID NO: 1042232 - DNA, 22 bp, Artificial Sequence
  chemically synthesized
aagcactacgctatacagtttc

SEQ ID NO: 1042233 - DNA, 22 bp, Artificial Sequence
  chemically synthesized
tctgcatcaagaaactgtatag

SEQ ID NO: 1042234 - DNA, 22 bp, Artificial Sequence
  chemically synthesized
ttaagcactacgctatacagtt

SEQ ID NO: 1042235 - DNA, 22 bp, Artificial Sequence
  chemically synthesized
ctgcatcaagaaactgtatagc

SEQ ID NO: 1042236 - DNA, 22 bp, Artificial Sequence
  chemically synthesized
tgcatcaagaaactgtatagcg

SEQ ID NO: 1042237 - DNA, 22 bp, Artificial Sequence
  chemically synthesized
ctcttaagcactacgctataca

SEQ ID NO: 1042238 - DNA, 22 bp, Artificial Sequence
  chemically synthesized
catcaagaaactgtatagcgta

SEQ ID NO: 1042239 - DNA, 22 bp, Artificial Sequence
  chemically synthesized
tgctcttaagcactacgctata

SEQ ID NO: 1042240 - DNA, 22 bp, Artificial Sequence
  chemically synthesized
ctgctcttaagcactacgctat

SEQ ID NO: 1042241 - DNA, 22 bp, Artificial Sequence
  chemically synthesized
cagagtttctgctcttaagcac

SEQ ID NO: 1042242 - DNA, 22 bp, Artificial Sequence
  chemically synthesized
tatagcgtagtgcttaagagca

SEQ ID NO: 1042243 - DNA, 22 bp, Artificial Sequence
  chemically synthesized
aagctccagagtttctgctctt

SEQ ID NO: 1042244 - DNA, 22 bp, Artificial Sequence
  chemically synthesized
gatgttcaagctccagagtttc

SEQ ID NO: 1042245 - DNA, 22 bp, Artificial Sequence
  chemically synthesized
tggatgttcaagctccagagtt

SEQ ID NO: 1042246 - DNA, 22 bp, Artificial Sequence
  chemically synthesized
aagagcagaaactctggagctt

SEQ ID NO: 1042247 - DNA, 22 bp, Artificial Sequence
  chemically synthesized
agagcagaaactctggagcttg

SEQ ID NO: 1042248 - DNA, 22 bp, Artificial Sequence
  chemically synthesized
aagtcccactctggatgttcaa

SEQ ID NO: 1042249 - DNA, 22 bp, Artificial Sequence
  chemically synthesized
tggagcttgaacatccagagtg

SEQ ID NO: 1042250 - DNA, 22 bp, Artificial Sequence
  chemically synthesized
gagcttgaacatccagagtggg

SEQ ID NO: 1042251 - DNA, 22 bp, Artificial Sequence
  chemically synthesized
aatatcatagttgaagtcccac

SEQ ID NO: 1042252 - DNA, 22 bp, Artificial Sequence
  chemically synthesized
gaacatccagagtgggacttca

SEQ ID NO: 1042253 - DNA, 22 bp, Artificial Sequence
  chemically synthesized
aaatatcatagttgaagtccca

SEQ ID NO: 1042254 - DNA, 22 bp, Artificial Sequence
  chemically synthesized
aacatccagagtgggacttcaa

SEQ ID NO: 1042255 - DNA, 22 bp, Artificial Sequence
  chemically synthesized
taaatatcatagttgaagtccc

SEQ ID NO: 1042256 - DNA, 22 bp, Artificial Sequence
  chemically synthesized
ttaaatatcatagttgaagtcc

SEQ ID NO: 1042257 - DNA, 22 bp, Artificial Sequence
  chemically synthesized
aggtgagatcatttttaaatat

SEQ ID NO: 1042258 - DNA, 22 bp, Artificial Sequence
  chemically synthesized
ctcaggtgagatcatttttaaa

SEQ ID NO: 1042259 - DNA, 22 bp, Artificial Sequence
  chemically synthesized
caactatgatatttaaaaatga

SEQ ID NO: 1042260 - DNA, 22 bp, Artificial Sequence
  chemically synthesized
gctcaggtgagatcatttttaa

SEQ ID NO: 1042261 - DNA, 22 bp, Artificial Sequence
  chemically synthesized
aactatgatatttaaaaatgat

SEQ ID NO: 1042262 - DNA, 22 bp, Artificial Sequence
  chemically synthesized
tgatatttaaaaatgatctcac

SEQ ID NO: 1042263 - DNA, 22 bp, Artificial Sequence
  chemically synthesized
agtgacttgctcaggtgagatc

SEQ ID NO: 1042264 - DNA, 22 bp, Artificial Sequence
  chemically synthesized
aaaaatgatctcacctgagcaa

SEQ ID NO: 1042265 - DNA, 22 bp, Artificial Sequence
  chemically synthesized
aaaatgatctcacctgagcaag

SEQ ID NO: 1042266 - DNA, 22 bp, Artificial Sequence
  chemically synthesized
agcagttaagtgacttgctcag

SEQ ID NO: 1042267 - DNA, 22 bp, Artificial Sequence
  chemically synthesized
acctgagcaagtcacttaactg

SEQ ID NO: 1042268 - DNA, 22 bp, Artificial Sequence
  chemically synthesized
agcaagtcacttaactgctcag

SEQ ID NO: 1042269 - DNA, 22 bp, Artificial Sequence
  chemically synthesized
agatggagaaacggaggtcctg

SEQ ID NO: 1042270 - DNA, 22 bp, Artificial Sequence
  chemically synthesized
aactgctcaggacctccgtttc

SEQ ID NO: 1042271 - DNA, 22 bp, Artificial Sequence
  chemically synthesized
actgctcaggacctccgtttct

SEQ ID NO: 1042272 - DNA, 22 bp, Artificial Sequence
  chemically synthesized
ctcaggacctccgtttctccat

SEQ ID NO: 1042273 - DNA, 22 bp, Artificial Sequence
  chemically synthesized
tacccatactcagatggagaaa

SEQ ID NO: 1042274 - DNA, 22 bp, Artificial Sequence
  chemically synthesized
aggacctccgtttctccatctg

SEQ ID NO: 1042275 - DNA, 22 bp, Artificial Sequence
  chemically synthesized
ttatacccatactcagatggag

SEQ ID NO: 1042276 - DNA, 22 bp, Artificial Sequence
  chemically synthesized
tattattatacccatactcaga

SEQ ID NO: 1042277 - DNA, 22 bp, Artificial Sequence
  chemically synthesized
cgtttctccatctgagtatggg

SEQ ID NO: 1042278 - DNA, 22 bp, Artificial Sequence
  chemically synthesized
ctccatctgagtatgggtataa

SEQ ID NO: 1042279 - DNA, 22 bp, Artificial Sequence
  chemically synthesized
tccatctgagtatgggtataat

SEQ ID NO: 1042280 - DNA, 22 bp, Artificial Sequence
  chemically synthesized
catctgagtatgggtataataa

SEQ ID NO: 1042281 - DNA, 22 bp, Artificial Sequence
  chemically synthesized
caaggaaggctgtattattata

SEQ ID NO: 1042282 - DNA, 22 bp, Artificial Sequence
  chemically synthesized
agtatgggtataataatacagc

SEQ ID NO: 1042283 - DNA, 22 bp, Artificial Sequence
  chemically synthesized
tatggtcatcataacagcccta

SEQ ID NO: 1042284 - DNA, 22 bp, Artificial Sequence
  chemically synthesized
gtatggtcatcataacagccct

SEQ ID NO: 1042285 - DNA, 22 bp, Artificial Sequence
  chemically synthesized
ccttgtagggctgttatgatga

SEQ ID NO: 1042286 - DNA, 22 bp, Artificial Sequence
  chemically synthesized
cttgtagggctgttatgatgac

SEQ ID NO: 1042287 - DNA, 22 bp, Artificial Sequence
  chemically synthesized
gagtaacttgtatggtcatcat

SEQ ID NO: 1042288 - DNA, 22 bp, Artificial Sequence
  chemically synthesized
gtagggctgttatgatgaccat

SEQ ID NO: 1042289 - DNA, 22 bp, Artificial Sequence
  chemically synthesized
agagtaacttgtatggtcatca

SEQ ID NO: 1042290 - DNA, 22 bp, Artificial Sequence
  chemically synthesized
tagggctgttatgatgaccata

SEQ ID NO: 1042291 - DNA, 22 bp, Artificial Sequence
  chemically synthesized
aacacttagagtaacttgtatg

SEQ ID NO: 1042292 - DNA, 22 bp, Artificial Sequence
  chemically synthesized
ttatgatgaccatacaagttac

SEQ ID NO: 1042293 - DNA, 22 bp, Artificial Sequence
  chemically synthesized
taaacacttagagtaacttgta

SEQ ID NO: 1042294 - DNA, 22 bp, Artificial Sequence
  chemically synthesized
tgatgaccatacaagttactct

SEQ ID NO: 1042295 - DNA, 22 bp, Artificial Sequence
  chemically synthesized
tgccaggacacattctaaacac

SEQ ID NO: 1042296 - DNA, 22 bp, Artificial Sequence
  chemically synthesized
gtgccaggacacattctaaaca

SEQ ID NO: 1042297 - DNA, 22 bp, Artificial Sequence
  chemically synthesized
tgtgccaggacacattctaaac

SEQ ID NO: 1042298 - DNA, 22 bp, Artificial Sequence
  chemically synthesized
ttgtgccaggacacattctaaa

SEQ ID NO: 1042299 - DNA, 22 bp, Artificial Sequence
  chemically synthesized
ctctaagtgtttagaatgtgtc

SEQ ID NO: 1042300 - DNA, 22 bp, Artificial Sequence
  chemically synthesized
tttttgtgccaggacacattct

SEQ ID NO: 1042301 - DNA, 22 bp, Artificial Sequence
  chemically synthesized
taagtgtttagaatgtgtcctg

SEQ ID NO: 1042302 - DNA, 22 bp, Artificial Sequence
  chemically synthesized
ttatttttgtgccaggacacat

SEQ ID NO: 1042303 - DNA, 22 bp, Artificial Sequence
  chemically synthesized
agtgtttagaatgtgtcctggc

SEQ ID NO: 1042304 - DNA, 22 bp, Artificial Sequence
  chemically synthesized
acagttattatttttgtgccag

SEQ ID NO: 1042305 - DNA, 22 bp, Artificial Sequence
  chemically synthesized
agaatgtgtcctggcacaaaaa

SEQ ID NO: 1042306 - DNA, 22 bp, Artificial Sequence
  chemically synthesized
gaatgtgtcctggcacaaaaat

SEQ ID NO: 1042307 - DNA, 22 bp, Artificial Sequence
  chemically synthesized
aatgtaatagctgacagttatt

SEQ ID NO: 1042308 - DNA, 22 bp, Artificial Sequence
  chemically synthesized
gaatgtaatagctgacagttat

SEQ ID NO: 1042309 - DNA, 22 bp, Artificial Sequence
  chemically synthesized
gcacaaaaataataactgtcag

SEQ ID NO: 1042310 - DNA, 22 bp, Artificial Sequence
  chemically synthesized
atcttgaatgtaatagctgaca

SEQ ID NO: 1042311 - DNA, 22 bp, Artificial Sequence
  chemically synthesized
gactaatcttgaatgtaatagc

SEQ ID NO: 1042312 - DNA, 22 bp, Artificial Sequence
  chemically synthesized
gaatctggactaatcttgaatg

SEQ ID NO: 1042313 - DNA, 22 bp, Artificial Sequence
  chemically synthesized
tcagctattacattcaagatta

SEQ ID NO: 1042314 - DNA, 22 bp, Artificial Sequence
  chemically synthesized
ttacattcaagattagtccaga

SEQ ID NO: 1042315 - DNA, 22 bp, Artificial Sequence
  chemically synthesized
cattcaagattagtccagattc

SEQ ID NO: 1042316 - DNA, 22 bp, Artificial Sequence
  chemically synthesized
aagattagtccagattccagtt

SEQ ID NO: 1042317 - DNA, 22 bp, Artificial Sequence
  chemically synthesized
aggtgtgaatataactggaatc

SEQ ID NO: 1042318 - DNA, 22 bp, Artificial Sequence
  chemically synthesized
gaggtgtgaatataactggaat

SEQ ID NO: 1042319 - DNA, 22 bp, Artificial Sequence
  chemically synthesized
gcttgaggtgtgaatataactg

SEQ ID NO: 1042320 - DNA, 22 bp, Artificial Sequence
  chemically synthesized
agcttgaggtgtgaatataact

SEQ ID NO: 1042321 - DNA, 22 bp, Artificial Sequence
  chemically synthesized
gtccagattccagttatattca

SEQ ID NO: 1042322 - DNA, 22 bp, Artificial Sequence
  chemically synthesized
cagttatattcacacctcaagc

SEQ ID NO: 1042323 - DNA, 22 bp, Artificial Sequence
  chemically synthesized
tagaggaggaatccttagcttg

SEQ ID NO: 1042324 - DNA, 22 bp, Artificial Sequence
  chemically synthesized
tattcacacctcaagctaagga

SEQ ID NO: 1042325 - DNA, 22 bp, Artificial Sequence
  chemically synthesized
atagaggaggaatccttagctt

SEQ ID NO: 1042326 - DNA, 22 bp, Artificial Sequence
  chemically synthesized
tatagaggaggaatccttagct

SEQ ID NO: 1042327 - DNA, 22 bp, Artificial Sequence
  chemically synthesized
acacctcaagctaaggattcct

SEQ ID NO: 1042328 - DNA, 22 bp, Artificial Sequence
  chemically synthesized
ggaggaattttatagaggagga

SEQ ID NO: 1042329 - DNA, 22 bp, Artificial Sequence
  chemically synthesized
aagctaaggattcctcctctat

SEQ ID NO: 1042330 - DNA, 22 bp, Artificial Sequence
  chemically synthesized
aggattcctcctctataaaatt

SEQ ID NO: 1042331 - DNA, 22 bp, Artificial Sequence
  chemically synthesized
ctcctctataaaattcctccta

SEQ ID NO: 1042332 - DNA, 22 bp, Artificial Sequence
  chemically synthesized
ctctataaaattcctcctagtt

SEQ ID NO: 1042333 - DNA, 22 bp, Artificial Sequence
  chemically synthesized
tataaaattcctcctagtttct

SEQ ID NO: 1042334 - DNA, 22 bp, Artificial Sequence
  chemically synthesized
taaaattcctcctagtttctgc

SEQ ID NO: 1042335 - DNA, 22 bp, Artificial Sequence
  chemically synthesized
ctcctagtttctgctttttgtg

SEQ ID NO: 1042336 - DNA, 22 bp, Artificial Sequence
  chemically synthesized
ctagtttctgctttttgtgctg

SEQ ID NO: 1042337 - DNA, 22 bp, Artificial Sequence
  chemically synthesized
gtttctgctttttgtgctgctt

SEQ ID NO: 1042338 - DNA, 22 bp, Artificial Sequence
  chemically synthesized
ctgctttttgtgctgctttctt

SEQ ID NO: 1042339 - DNA, 22 bp, Artificial Sequence
  chemically synthesized
tgctttttgtgctgctttcttc

SEQ ID NO: 1042340 - DNA, 22 bp, Artificial Sequence
  chemically synthesized
aaatcatgaaaagaagaaagca

SEQ ID NO: 1042341 - DNA, 22 bp, Artificial Sequence
  chemically synthesized
ctttttgtgctgctttcttctt

SEQ ID NO: 1042342 - DNA, 22 bp, Artificial Sequence
  chemically synthesized
tttgtgctgctttcttcttttc

SEQ ID NO: 1042343 - DNA, 22 bp, Artificial Sequence
  chemically synthesized
ttgtgctgctttcttcttttca

SEQ ID NO: 1042344 - DNA, 22 bp, Artificial Sequence
  chemically synthesized
tgtgctgctttcttcttttcat

SEQ ID NO: 1042345 - DNA, 22 bp, Artificial Sequence
  chemically synthesized
gtgctgctttcttcttttcatg

SEQ ID NO: 1042346 - DNA, 22 bp, Artificial Sequence
  chemically synthesized
tgctgctttcttcttttcatga

SEQ ID NO: 1042347 - DNA, 22 bp, Artificial Sequence
  chemically synthesized
ctttcttcttttcatgatttca

SEQ ID NO: 1042348 - DNA, 22 bp, Artificial Sequence
  chemically synthesized
tcttcttttcatgatttcagtt

SEQ ID NO: 1042349 - DNA, 22 bp, Artificial Sequence
  chemically synthesized
cttcttttcatgatttcagtta

SEQ ID NO: 1042350 - DNA, 22 bp, Artificial Sequence
  chemically synthesized
ttcttttcatgatttcagttac

SEQ ID NO: 1042351 - DNA, 22 bp, Artificial Sequence
  chemically synthesized
cttttcatgatttcagttacac

SEQ ID NO: 1042352 - DNA, 22 bp, Artificial Sequence
  chemically synthesized
ttttcatgatttcagttacact

SEQ ID NO: 1042353 - DNA, 22 bp, Artificial Sequence
  chemically synthesized
ttcatgatttcagttacactca

SEQ ID NO: 1042354 - DNA, 22 bp, Artificial Sequence
  chemically synthesized
tcatgatttcagttacactcat

SEQ ID NO: 1042355 - DNA, 22 bp, Artificial Sequence
  chemically synthesized
catgatttcagttacactcatg

SEQ ID NO: 1042356 - DNA, 22 bp, Artificial Sequence
  chemically synthesized
atgatttcagttacactcatgt

SEQ ID NO: 1042357 - DNA, 22 bp, Artificial Sequence
  chemically synthesized
cagttacactcatgtcttatat

SEQ ID NO: 1042358 - DNA, 22 bp, Artificial Sequence
  chemically synthesized
agttacactcatgtcttatata

SEQ ID NO: 1042359 - DNA, 22 bp, Artificial Sequence
  chemically synthesized
cactcatgtcttatatattttt

SEQ ID NO: 1042360 - DNA, 22 bp, Artificial Sequence
  chemically synthesized
aggacatcatccaagcaaaaat

SEQ ID NO: 1042361 - DNA, 22 bp, Artificial Sequence
  chemically synthesized
atgtcttatatatttttgcttg

SEQ ID NO: 1042362 - DNA, 22 bp, Artificial Sequence
  chemically synthesized
atatatttttgcttggatgatg

SEQ ID NO: 1042363 - DNA, 22 bp, Artificial Sequence
  chemically synthesized
tatatttttgcttggatgatgt

SEQ ID NO: 1042364 - DNA, 22 bp, Artificial Sequence
  chemically synthesized
ttgcttggatgatgtccttaat

SEQ ID NO: 1042365 - DNA, 22 bp, Artificial Sequence
  chemically synthesized
tgcttggatgatgtccttaatg

SEQ ID NO: 1042366 - DNA, 22 bp, Artificial Sequence
  chemically synthesized
gcttggatgatgtccttaatgt

SEQ ID NO: 1042367 - DNA, 22 bp, Artificial Sequence
  chemically synthesized
cttggatgatgtccttaatgtc

SEQ ID NO: 1042368 - DNA, 22 bp, Artificial Sequence
  chemically synthesized
gagagtaataaagacattaagg

SEQ ID NO: 1042369 - DNA, 22 bp, Artificial Sequence
  chemically synthesized
ggatgatgtccttaatgtcttt

SEQ ID NO: 1042370 - DNA, 22 bp, Artificial Sequence
  chemically synthesized
gatgatgtccttaatgtcttta

SEQ ID NO: 1042371 - DNA, 22 bp, Artificial Sequence
  chemically synthesized
tacaaacaagttagagagtaat

SEQ ID NO: 1042372 - DNA, 22 bp, Artificial Sequence
  chemically synthesized
aatgtctttattactctctaac

SEQ ID NO: 1042373 - DNA, 22 bp, Artificial Sequence
  chemically synthesized
atgtctttattactctctaact

SEQ ID NO: 1042374 - DNA, 22 bp, Artificial Sequence
  chemically synthesized
tagttatacaaacaagttagag

SEQ ID NO: 1042375 - DNA, 22 bp, Artificial Sequence
  chemically synthesized
tattactctctaacttgtttgt

SEQ ID NO: 1042376 - DNA, 22 bp, Artificial Sequence
  chemically synthesized
attactctctaacttgtttgta

SEQ ID NO: 1042377 - DNA, 22 bp, Artificial Sequence
  chemically synthesized
ttactctctaacttgtttgtat

SEQ ID NO: 1042378 - DNA, 22 bp, Artificial Sequence
  chemically synthesized
ctctctaacttgtttgtataac

SEQ ID NO: 1042379 - DNA, 22 bp, Artificial Sequence
  chemically synthesized
tctaacttgtttgtataactat

SEQ ID NO: 1042380 - DNA, 22 bp, Artificial Sequence
  chemically synthesized
aatatacatattatagttatac

SEQ ID NO: 1042381 - DNA, 22 bp, Artificial Sequence
  chemically synthesized
taacttgtttgtataactataa

SEQ ID NO: 1042382 - DNA, 22 bp, Artificial Sequence
  chemically synthesized
ttgaatatacatattatagtta

SEQ ID NO: 1042383 - DNA, 22 bp, Artificial Sequence
  chemically synthesized
acttgtttgtataactataata

SEQ ID NO: 1042384 - DNA, 22 bp, Artificial Sequence
  chemically synthesized
gtttgtataactataatatgta

SEQ ID NO: 1042385 - DNA, 22 bp, Artificial Sequence
  chemically synthesized
tttgtataactataatatgtat

SEQ ID NO: 1042386 - DNA, 22 bp, Artificial Sequence
  chemically synthesized
gtataactataatatgtatatt

SEQ ID NO: 1042387 - DNA, 22 bp, Artificial Sequence
  chemically synthesized
ataacattattgaatatacata

SEQ ID NO: 1042388 - DNA, 22 bp, Artificial Sequence
  chemically synthesized
tataactataatatgtatattc

SEQ ID NO: 1042389 - DNA, 22 bp, Artificial Sequence
  chemically synthesized
gtagttgataacattattgaat

SEQ ID NO: 1042390 - DNA, 22 bp, Artificial Sequence
  chemically synthesized
taatatgtatattcaataatgt

SEQ ID NO: 1042391 - DNA, 22 bp, Artificial Sequence
  chemically synthesized
tggtagttgataacattattga

SEQ ID NO: 1042392 - DNA, 22 bp, Artificial Sequence
  chemically synthesized
tactctggtagttgataacatt

SEQ ID NO: 1042393 - DNA, 22 bp, Artificial Sequence
  chemically synthesized
gtactctggtagttgataacat

SEQ ID NO: 1042394 - DNA, 22 bp, Artificial Sequence
  chemically synthesized
aataatgttatcaactaccaga

SEQ ID NO: 1042395 - DNA, 22 bp, Artificial Sequence
  chemically synthesized
aggaataatccttgtactctgg

SEQ ID NO: 1042396 - DNA, 22 bp, Artificial Sequence
  chemically synthesized
tcaactaccagagtacaaggat

SEQ ID NO: 1042397 - DNA, 22 bp, Artificial Sequence
  chemically synthesized
ccagagtacaaggattattcct

SEQ ID NO: 1042398 - DNA, 22 bp, Artificial Sequence
  chemically synthesized
aaagataagaaagaaatattaa

SEQ ID NO: 1042399 - DNA, 22 bp, Artificial Sequence
  chemically synthesized
taaaagataagaaagaaatatt

SEQ ID NO: 1042400 - DNA, 22 bp, Artificial Sequence
  chemically synthesized
ttccttaatatttctttcttat

SEQ ID NO: 1042401 - DNA, 22 bp, Artificial Sequence
  chemically synthesized
acattctaaaagataagaaaga

SEQ ID NO: 1042402 - DNA, 22 bp, Artificial Sequence
  chemically synthesized
aacattctaaaagataagaaag

SEQ ID NO: 1042403 - DNA, 22 bp, Artificial Sequence
  chemically synthesized
cttaatatttctttcttatctt

SEQ ID NO: 1042404 - DNA, 22 bp, Artificial Sequence
  chemically synthesized
aatatttctttcttatctttta

SEQ ID NO: 1042405 - DNA, 22 bp, Artificial Sequence
  chemically synthesized
tgcttaacattctaaaagataa

SEQ ID NO: 1042406 - DNA, 22 bp, Artificial Sequence
  chemically synthesized
atatttctttcttatcttttag

SEQ ID NO: 1042407 - DNA, 22 bp, Artificial Sequence
  chemically synthesized
ctttcttatcttttagaatgtt

SEQ ID NO: 1042408 - DNA, 22 bp, Artificial Sequence
  chemically synthesized
tttcttatcttttagaatgtta

SEQ ID NO: 1042409 - DNA, 22 bp, Artificial Sequence
  chemically synthesized
caagtgctatgcttaacattct

SEQ ID NO: 1042410 - DNA, 22 bp, Artificial Sequence
  chemically synthesized
tcttatcttttagaatgttaag

SEQ ID NO: 1042411 - DNA, 22 bp, Artificial Sequence
  chemically synthesized
cttatcttttagaatgttaagc

SEQ ID NO: 1042412 - DNA, 22 bp, Artificial Sequence
  chemically synthesized
ttatcttttagaatgttaagca

SEQ ID NO: 1042413 - DNA, 22 bp, Artificial Sequence
  chemically synthesized
atcttttagaatgttaagcata

SEQ ID NO: 1042414 - DNA, 22 bp, Artificial Sequence
  chemically synthesized
tcttttagaatgttaagcatag

SEQ ID NO: 1042415 - DNA, 22 bp, Artificial Sequence
  chemically synthesized
atgctacaagtgctatgcttaa

SEQ ID NO: 1042416 - DNA, 22 bp, Artificial Sequence
  chemically synthesized
ttaatgctacaagtgctatgct

SEQ ID NO: 1042417 - DNA, 22 bp, Artificial Sequence
  chemically synthesized
ttagaatgttaagcatagcact

SEQ ID NO: 1042418 - DNA, 22 bp, Artificial Sequence
  chemically synthesized
attaatgctacaagtgctatgc

SEQ ID NO: 1042419 - DNA, 22 bp, Artificial Sequence
  chemically synthesized
tagaatgttaagcatagcactt

SEQ ID NO: 1042420 - DNA, 22 bp, Artificial Sequence
  chemically synthesized
agaatgttaagcatagcacttg

SEQ ID NO: 1042421 - DNA, 22 bp, Artificial Sequence
  chemically synthesized
gaatgttaagcatagcacttgt

SEQ ID NO: 1042422 - DNA, 22 bp, Artificial Sequence
  chemically synthesized
agcatagcacttgtagcattaa

SEQ ID NO: 1042423 - DNA, 22 bp, Artificial Sequence
  chemically synthesized
aagtcaacagatatttattaat

SEQ ID NO: 1042424 - DNA, 22 bp, Artificial Sequence
  chemically synthesized
caagtcaacagatatttattaa

SEQ ID NO: 1042425 - DNA, 22 bp, Artificial Sequence
  chemically synthesized
cttcaagtcaacagatatttat

SEQ ID NO: 1042426 - DNA, 22 bp, Artificial Sequence
  chemically synthesized
acttcaagtcaacagatattta

SEQ ID NO: 1042427 - DNA, 22 bp, Artificial Sequence
  chemically synthesized
tacttcaagtcaacagatattt

SEQ ID NO: 1042428 - DNA, 22 bp, Artificial Sequence
  chemically synthesized
gtagcattaataaatatctgtt

SEQ ID NO: 1042429 - DNA, 22 bp, Artificial Sequence
  chemically synthesized
ttacttcaagtcaacagatatt

SEQ ID NO: 1042430 - DNA, 22 bp, Artificial Sequence
  chemically synthesized
tagcattaataaatatctgttg

SEQ ID NO: 1042431 - DNA, 22 bp, Artificial Sequence
  chemically synthesized
tttacttcaagtcaacagatat

SEQ ID NO: 1042432 - DNA, 22 bp, Artificial Sequence
  chemically synthesized
aactttttacttcaagtcaaca

SEQ ID NO: 1042433 - DNA, 22 bp, Artificial Sequence
  chemically synthesized
ataaatatctgttgacttgaag

SEQ ID NO: 1042434 - DNA, 22 bp, Artificial Sequence
  chemically synthesized
aactcaactttttacttcaagt

SEQ ID NO: 1042435 - DNA, 22 bp, Artificial Sequence
  chemically synthesized
ttgacttgaagtaaaaagttga

SEQ ID NO: 1042436 - DNA, 22 bp, Artificial Sequence
  chemically synthesized
acttgaagtaaaaagttgagtt

SEQ ID NO: 1042437 - DNA, 22 bp, Artificial Sequence
  chemically synthesized
ataagcaagttcaactcaactt

SEQ ID NO: 1042438 - DNA, 22 bp, Artificial Sequence
  chemically synthesized
cataagcaagttcaactcaact

SEQ ID NO: 1042439 - DNA, 22 bp, Artificial Sequence
  chemically synthesized
tcataagcaagttcaactcaac

SEQ ID NO: 1042440 - DNA, 22 bp, Artificial Sequence
  chemically synthesized
gaagtaaaaagttgagttgaac

SEQ ID NO: 1042441 - DNA, 22 bp, Artificial Sequence
  chemically synthesized
aagtaaaaagttgagttgaact

SEQ ID NO: 1042442 - DNA, 22 bp, Artificial Sequence
  chemically synthesized
gattttcataagcaagttcaac

SEQ ID NO: 1042443 - DNA, 22 bp, Artificial Sequence
  chemically synthesized
aaattggattttcataagcaag

SEQ ID NO: 1042444 - DNA, 22 bp, Artificial Sequence
  chemically synthesized
agttgaacttgcttatgaaaat

SEQ ID NO: 1042445 - DNA, 22 bp, Artificial Sequence
  chemically synthesized
aattcaaattggattttcataa

SEQ ID NO: 1042446 - DNA, 22 bp, Artificial Sequence
  chemically synthesized
aacttgcttatgaaaatccaat

SEQ ID NO: 1042447 - DNA, 22 bp, Artificial Sequence
  chemically synthesized
aatgattgaattcaaattggat

SEQ ID NO: 1042448 - DNA, 22 bp, Artificial Sequence
  chemically synthesized
gcttatgaaaatccaatttgaa

SEQ ID NO: 1042449 - DNA, 22 bp, Artificial Sequence
  chemically synthesized
cttatgaaaatccaatttgaat

SEQ ID NO: 1042450 - DNA, 22 bp, Artificial Sequence
  chemically synthesized
atgaaaatccaatttgaattca

SEQ ID NO: 1042451 - DNA, 22 bp, Artificial Sequence
  chemically synthesized
tgaaaatccaatttgaattcaa

SEQ ID NO: 1042452 - DNA, 22 bp, Artificial Sequence
  chemically synthesized
gaggttcaatgattgaattcaa

SEQ ID NO: 1042453 - DNA, 22 bp, Artificial Sequence
  chemically synthesized
agaggttcaatgattgaattca

SEQ ID NO: 1042454 - DNA, 22 bp, Artificial Sequence
  chemically synthesized
gaattcaatcattgaacctcta

SEQ ID NO: 1042455 - DNA, 22 bp, Artificial Sequence
  chemically synthesized
aattcaatcattgaacctctaa

SEQ ID NO: 1042456 - DNA, 22 bp, Artificial Sequence
  chemically synthesized
aacagagtaacaaatcttagag

SEQ ID NO: 1042457 - DNA, 22 bp, Artificial Sequence
  chemically synthesized
aatcattgaacctctaagattt

SEQ ID NO: 1042458 - DNA, 22 bp, Artificial Sequence
  chemically synthesized
aacctctaagatttgttactct

SEQ ID NO: 1042459 - DNA, 22 bp, Artificial Sequence
  chemically synthesized
caatggttgaacagagtaacaa

SEQ ID NO: 1042460 - DNA, 22 bp, Artificial Sequence
  chemically synthesized
tctacaatggttgaacagagta

SEQ ID NO: 1042461 - DNA, 22 bp, Artificial Sequence
  chemically synthesized
taagatttgttactctgttcaa

SEQ ID NO: 1042462 - DNA, 22 bp, Artificial Sequence
  chemically synthesized
agatttgttactctgttcaacc

SEQ ID NO: 1042463 - DNA, 22 bp, Artificial Sequence
  chemically synthesized
aatatctatctacaatggttga

SEQ ID NO: 1042464 - DNA, 22 bp, Artificial Sequence
  chemically synthesized
gttactctgttcaaccattgta

SEQ ID NO: 1042465 - DNA, 22 bp, Artificial Sequence
  chemically synthesized
ttactctgttcaaccattgtag

SEQ ID NO: 1042466 - DNA, 22 bp, Artificial Sequence
  chemically synthesized
ctctgttcaaccattgtagata

SEQ ID NO: 1042467 - DNA, 22 bp, Artificial Sequence
  chemically synthesized
tgttcaaccattgtagatagat

SEQ ID NO: 1042468 - DNA, 22 bp, Artificial Sequence
  chemically synthesized
accatacctgaatatctatcta

SEQ ID NO: 1042469 - DNA, 22 bp, Artificial Sequence
  chemically synthesized
ttcaaccattgtagatagatat

SEQ ID NO: 1042470 - DNA, 22 bp, Artificial Sequence
  chemically synthesized
aaccattgtagatagatattca

SEQ ID NO: 1042471 - DNA, 22 bp, Artificial Sequence
  chemically synthesized
acgtctgaccatacctgaatat

SEQ ID NO: 1042472 - DNA, 22 bp, Artificial Sequence
  chemically synthesized
tagatagatattcaggtatggt

SEQ ID NO: 1042473 - DNA, 22 bp, Artificial Sequence
  chemically synthesized
aatagctcacgtctgaccatac

SEQ ID NO: 1042474 - DNA, 22 bp, Artificial Sequence
  chemically synthesized
cctgaatagctcacgtctgacc

SEQ ID NO: 1042475 - DNA, 22 bp, Artificial Sequence
  chemically synthesized
aggtatggtcagacgtgagcta

SEQ ID NO: 1042476 - DNA, 22 bp, Artificial Sequence
  chemically synthesized
ttcaggtaattccttgtttatt

SEQ ID NO: 1042477 - DNA, 22 bp, Artificial Sequence
  chemically synthesized
taaaagtaaagtagaataaaca

SEQ ID NO: 1042478 - DNA, 22 bp, Artificial Sequence
  chemically synthesized
aggtaattccttgtttattcta

SEQ ID NO: 1042479 - DNA, 22 bp, Artificial Sequence
  chemically synthesized
gtaaaagtaaagtagaataaac

SEQ ID NO: 1042480 - DNA, 22 bp, Artificial Sequence
  chemically synthesized
atgtcttgtaaaagtaaagtag

SEQ ID NO: 1042481 - DNA, 22 bp, Artificial Sequence
  chemically synthesized
cttgtttattctactttacttt

SEQ ID NO: 1042482 - DNA, 22 bp, Artificial Sequence
  chemically synthesized
gtttattctactttacttttac

SEQ ID NO: 1042483 - DNA, 22 bp, Artificial Sequence
  chemically synthesized
tttattctactttacttttaca

SEQ ID NO: 1042484 - DNA, 22 bp, Artificial Sequence
  chemically synthesized
aacagctaatgtcttgtaaaag

SEQ ID NO: 1042485 - DNA, 22 bp, Artificial Sequence
  chemically synthesized
attctactttacttttacaaga

SEQ ID NO: 1042486 - DNA, 22 bp, Artificial Sequence
  chemically synthesized
ttctactttacttttacaagac

SEQ ID NO: 1042487 - DNA, 22 bp, Artificial Sequence
  chemically synthesized
ttcaacagctaatgtcttgtaa

SEQ ID NO: 1042488 - DNA, 22 bp, Artificial Sequence
  chemically synthesized
tactttacttttacaagacatt

SEQ ID NO: 1042489 - DNA, 22 bp, Artificial Sequence
  chemically synthesized
ctttacttttacaagacattag

SEQ ID NO: 1042490 - DNA, 22 bp, Artificial Sequence
  chemically synthesized
cactgttcaacagctaatgtct

SEQ ID NO: 1042491 - DNA, 22 bp, Artificial Sequence
  chemically synthesized
tacttttacaagacattagctg

SEQ ID NO: 1042492 - DNA, 22 bp, Artificial Sequence
  chemically synthesized
acttttacaagacattagctgt

SEQ ID NO: 1042493 - DNA, 22 bp, Artificial Sequence
  chemically synthesized
ttccactgttcaacagctaatg

SEQ ID NO: 1042494 - DNA, 22 bp, Artificial Sequence
  chemically synthesized
cttttacaagacattagctgtt

SEQ ID NO: 1042495 - DNA, 22 bp, Artificial Sequence
  chemically synthesized
tattccactgttcaacagctaa

SEQ ID NO: 1042496 - DNA, 22 bp, Artificial Sequence
  chemically synthesized
ctattccactgttcaacagcta

SEQ ID NO: 1042497 - DNA, 22 bp, Artificial Sequence
  chemically synthesized
ttacaagacattagctgttgaa

SEQ ID NO: 1042498 - DNA, 22 bp, Artificial Sequence
  chemically synthesized
tacaagacattagctgttgaac

SEQ ID NO: 1042499 - DNA, 22 bp, Artificial Sequence
  chemically synthesized
acaagacattagctgttgaaca

SEQ ID NO: 1042500 - DNA, 22 bp, Artificial Sequence
  chemically synthesized
caagacattagctgttgaacag

SEQ ID NO: 1042501 - DNA, 22 bp, Artificial Sequence
  chemically synthesized
gctgttgaacagtggaatagaa

SEQ ID NO: 1042502 - DNA, 22 bp, Artificial Sequence
  chemically synthesized
ttgaacagtggaatagaagtcc

SEQ ID NO: 1042503 - DNA, 22 bp, Artificial Sequence
  chemically synthesized
aacagtggaatagaagtccaca

SEQ ID NO: 1042504 - DNA, 22 bp, Artificial Sequence
  chemically synthesized
agccaggaaatgcatgtggact

SEQ ID NO: 1042505 - DNA, 22 bp, Artificial Sequence
  chemically synthesized
tgaggaaaccataaggaaactc

SEQ ID NO: 1042506 - DNA, 22 bp, Artificial Sequence
  chemically synthesized
cctggctgagtttccttatggt

SEQ ID NO: 1042507 - DNA, 22 bp, Artificial Sequence
  chemically synthesized
ctggctgagtttccttatggtt

SEQ ID NO: 1042508 - DNA, 22 bp, Artificial Sequence
  chemically synthesized
atgtgctgtgaggaaaccataa

SEQ ID NO: 1042509 - DNA, 22 bp, Artificial Sequence
  chemically synthesized
gctgagtttccttatggtttcc

SEQ ID NO: 1042510 - DNA, 22 bp, Artificial Sequence
  chemically synthesized
agtttccttatggtttcctcac

SEQ ID NO: 1042511 - DNA, 22 bp, Artificial Sequence
  chemically synthesized
gatatctaatgtgctgtgagga

SEQ ID NO: 1042512 - DNA, 22 bp, Artificial Sequence
  chemically synthesized
agatatctaatgtgctgtgagg

SEQ ID NO: 1042513 - DNA, 22 bp, Artificial Sequence
  chemically synthesized
ccttatggtttcctcacagcac

SEQ ID NO: 1042514 - DNA, 22 bp, Artificial Sequence
  chemically synthesized
cttatggtttcctcacagcaca

SEQ ID NO: 1042515 - DNA, 22 bp, Artificial Sequence
  chemically synthesized
ttagatatctaatgtgctgtga

SEQ ID NO: 1042516 - DNA, 22 bp, Artificial Sequence
  chemically synthesized
cttagatatctaatgtgctgtg

SEQ ID NO: 1042517 - DNA, 22 bp, Artificial Sequence
  chemically synthesized
tcttagatatctaatgtgctgt

SEQ ID NO: 1042518 - DNA, 22 bp, Artificial Sequence
  chemically synthesized
atggtttcctcacagcacatta

SEQ ID NO: 1042519 - DNA, 22 bp, Artificial Sequence
  chemically synthesized
ttcttagatatctaatgtgctg

SEQ ID NO: 1042520 - DNA, 22 bp, Artificial Sequence
  chemically synthesized
tggtttcctcacagcacattag

SEQ ID NO: 1042521 - DNA, 22 bp, Artificial Sequence
  chemically synthesized
tttcttagatatctaatgtgct

SEQ ID NO: 1042522 - DNA, 22 bp, Artificial Sequence
  chemically synthesized
ttttcttagatatctaatgtgc

SEQ ID NO: 1042523 - DNA, 22 bp, Artificial Sequence
  chemically synthesized
cctcacagcacattagatatct

SEQ ID NO: 1042524 - DNA, 22 bp, Artificial Sequence
  chemically synthesized
ctcacagcacattagatatcta

SEQ ID NO: 1042525 - DNA, 22 bp, Artificial Sequence
  chemically synthesized
acagcacattagatatctaaga

SEQ ID NO: 1042526 - DNA, 22 bp, Artificial Sequence
  chemically synthesized
aataaaggacttttttcttaga

SEQ ID NO: 1042527 - DNA, 22 bp, Artificial Sequence
  chemically synthesized
tgaataaaggacttttttctta

SEQ ID NO: 1042528 - DNA, 22 bp, Artificial Sequence
  chemically synthesized
gatatctaagaaaaaagtcctt

SEQ ID NO: 1042529 - DNA, 22 bp, Artificial Sequence
  chemically synthesized
agaaaaaagtcctttattcaga

SEQ ID NO: 1042530 - DNA, 22 bp, Artificial Sequence
  chemically synthesized
gagaaatgggcaggtgtaattc

SEQ ID NO: 1042531 - DNA, 22 bp, Artificial Sequence
  chemically synthesized
tattcagaattacacctgccca

SEQ ID NO: 1042532 - DNA, 22 bp, Artificial Sequence
  chemically synthesized
attcagaattacacctgcccat

SEQ ID NO: 1042533 - DNA, 22 bp, Artificial Sequence
  chemically synthesized
ttcagaattacacctgcccatt

SEQ ID NO: 1042534 - DNA, 22 bp, Artificial Sequence
  chemically synthesized
tggcatctggagaaatgggcag

SEQ ID NO: 1042535 - DNA, 22 bp, Artificial Sequence
  chemically synthesized
agaattacacctgcccatttct

SEQ ID NO: 1042536 - DNA, 22 bp, Artificial Sequence
  chemically synthesized
tgtggcatctggagaaatgggc

SEQ ID NO: 1042537 - DNA, 22 bp, Artificial Sequence
  chemically synthesized
atgctctgtggcatctggagaa

SEQ ID NO: 1042538 - DNA, 22 bp, Artificial Sequence
  chemically synthesized
cacctgcccatttctccagatg

SEQ ID NO: 1042539 - DNA, 22 bp, Artificial Sequence
  chemically synthesized
ttgatgctctgtggcatctgga

SEQ ID NO: 1042540 - DNA, 22 bp, Artificial Sequence
  chemically synthesized
gttgatgctctgtggcatctgg

SEQ ID NO: 1042541 - DNA, 22 bp, Artificial Sequence
  chemically synthesized
ttgttgatgctctgtggcatct

SEQ ID NO: 1042542 - DNA, 22 bp, Artificial Sequence
  chemically synthesized
cccatttctccagatgccacag

SEQ ID NO: 1042543 - DNA, 22 bp, Artificial Sequence
  chemically synthesized
ttcttgttgatgctctgtggca

SEQ ID NO: 1042544 - DNA, 22 bp, Artificial Sequence
  chemically synthesized
gttcttgttgatgctctgtggc

SEQ ID NO: 1042545 - DNA, 22 bp, Artificial Sequence
  chemically synthesized
tgttcttgttgatgctctgtgg

SEQ ID NO: 1042546 - DNA, 22 bp, Artificial Sequence
  chemically synthesized
ttgttcttgttgatgctctgtg

SEQ ID NO: 1042547 - DNA, 22 bp, Artificial Sequence
  chemically synthesized
tttgttcttgttgatgctctgt

SEQ ID NO: 1042548 - DNA, 22 bp, Artificial Sequence
  chemically synthesized
ctccagatgccacagagcatca

SEQ ID NO: 1042549 - DNA, 22 bp, Artificial Sequence
  chemically synthesized
tccagatgccacagagcatcaa

SEQ ID NO: 1042550 - DNA, 22 bp, Artificial Sequence
  chemically synthesized
tttttgttcttgttgatgctct

SEQ ID NO: 1042551 - DNA, 22 bp, Artificial Sequence
  chemically synthesized
cagatgccacagagcatcaaca

SEQ ID NO: 1042552 - DNA, 22 bp, Artificial Sequence
  chemically synthesized
ttctttttgttcttgttgatgc

SEQ ID NO: 1042553 - DNA, 22 bp, Artificial Sequence
  chemically synthesized
ttgttctttttgttcttgttga

SEQ ID NO: 1042554 - DNA, 22 bp, Artificial Sequence
  chemically synthesized
gttgttctttttgttcttgttg

SEQ ID NO: 1042555 - DNA, 22 bp, Artificial Sequence
  chemically synthesized
tgttgttctttttgttcttgtt

SEQ ID NO: 1042556 - DNA, 22 bp, Artificial Sequence
  chemically synthesized
ttgttgttctttttgttcttgt

SEQ ID NO: 1042557 - DNA, 22 bp, Artificial Sequence
  chemically synthesized
tttgttgttctttttgttcttg

SEQ ID NO: 1042558 - DNA, 22 bp, Artificial Sequence
  chemically synthesized
ttttgttgttctttttgttctt

SEQ ID NO: 1042559 - DNA, 22 bp, Artificial Sequence
  chemically synthesized
tttttgttgttctttttgttct

SEQ ID NO: 1042560 - DNA, 22 bp, Artificial Sequence
  chemically synthesized
gatcagtaaagtgcagggtttt

SEQ ID NO: 1042561 - DNA, 22 bp, Artificial Sequence
  chemically synthesized
ggatcagtaaagtgcagggttt

SEQ ID NO: 1042562 - DNA, 22 bp, Artificial Sequence
  chemically synthesized
agaaacacttggatcagtaaag

SEQ ID NO: 1042563 - DNA, 22 bp, Artificial Sequence
  chemically synthesized
tctgagaaacacttggatcagt

SEQ ID NO: 1042564 - DNA, 22 bp, Artificial Sequence
  chemically synthesized
atctgagaaacacttggatcag

SEQ ID NO: 1042565 - DNA, 22 bp, Artificial Sequence
  chemically synthesized
tatctgagaaacacttggatca

SEQ ID NO: 1042566 - DNA, 22 bp, Artificial Sequence
  chemically synthesized
cactttactgatccaagtgttt

SEQ ID NO: 1042567 - DNA, 22 bp, Artificial Sequence
  chemically synthesized
tactgatccaagtgtttctcag

SEQ ID NO: 1042568 - DNA, 22 bp, Artificial Sequence
  chemically synthesized
gaatcattttatctgagaaaca

SEQ ID NO: 1042569 - DNA, 22 bp, Artificial Sequence
  chemically synthesized
actgatccaagtgtttctcaga

SEQ ID NO: 1042570 - DNA, 22 bp, Artificial Sequence
  chemically synthesized
ctgatccaagtgtttctcagat

SEQ ID NO: 1042571 - DNA, 22 bp, Artificial Sequence
  chemically synthesized
atccaagtgtttctcagataaa

SEQ ID NO: 1042572 - DNA, 22 bp, Artificial Sequence
  chemically synthesized
atggactagaatcattttatct

SEQ ID NO: 1042573 - DNA, 22 bp, Artificial Sequence
  chemically synthesized
gtgctgatggactagaatcatt

SEQ ID NO: 1042574 - DNA, 22 bp, Artificial Sequence
  chemically synthesized
agtgctgatggactagaatcat

SEQ ID NO: 1042575 - DNA, 22 bp, Artificial Sequence
  chemically synthesized
ctcagataaaatgattctagtc

SEQ ID NO: 1042576 - DNA, 22 bp, Artificial Sequence
  chemically synthesized
tcagataaaatgattctagtcc

SEQ ID NO: 1042577 - DNA, 22 bp, Artificial Sequence
  chemically synthesized
cttagtgctgatggactagaat

SEQ ID NO: 1042578 - DNA, 22 bp, Artificial Sequence
  chemically synthesized
acttagtgctgatggactagaa

SEQ ID NO: 1042579 - DNA, 22 bp, Artificial Sequence
  chemically synthesized
agataaaatgattctagtccat

SEQ ID NO: 1042580 - DNA, 22 bp, Artificial Sequence
  chemically synthesized
aatttacttagtgctgatggac

SEQ ID NO: 1042581 - DNA, 22 bp, Artificial Sequence
  chemically synthesized
caatttacttagtgctgatgga

SEQ ID NO: 1042582 - DNA, 22 bp, Artificial Sequence
  chemically synthesized
tcaatttacttagtgctgatgg

SEQ ID NO: 1042583 - DNA, 22 bp, Artificial Sequence
  chemically synthesized
ttttcaatttacttagtgctga

SEQ ID NO: 1042584 - DNA, 22 bp, Artificial Sequence
  chemically synthesized
tagtccatcagcactaagtaaa

SEQ ID NO: 1042585 - DNA, 22 bp, Artificial Sequence
  chemically synthesized
gtccatcagcactaagtaaatt

SEQ ID NO: 1042586 - DNA, 22 bp, Artificial Sequence
  chemically synthesized
gtaaaattgttttcaatttact

SEQ ID NO: 1042587 - DNA, 22 bp, Artificial Sequence
  chemically synthesized
agtaaattgaaaacaattttac

SEQ ID NO: 1042588 - DNA, 22 bp, Artificial Sequence
  chemically synthesized
aaaacaattttaccagtccttt

SEQ ID NO: 1042589 - DNA, 22 bp, Artificial Sequence
  chemically synthesized
acacaaaatgtacgtatcataa

SEQ ID NO: 1042590 - DNA, 22 bp, Artificial Sequence
  chemically synthesized
taccagtccttttatgatacgt

SEQ ID NO: 1042591 - DNA, 22 bp, Artificial Sequence
  chemically synthesized
aacacaaaatgtacgtatcata

SEQ ID NO: 1042592 - DNA, 22 bp, Artificial Sequence
  chemically synthesized
accagtccttttatgatacgta

SEQ ID NO: 1042593 - DNA, 22 bp, Artificial Sequence
  chemically synthesized
ccagtccttttatgatacgtac

SEQ ID NO: 1042594 - DNA, 22 bp, Artificial Sequence
  chemically synthesized
ttatgatacgtacattttgtgt

SEQ ID NO: 1042595 - DNA, 22 bp, Artificial Sequence
  chemically synthesized
tatgatacgtacattttgtgtt

SEQ ID NO: 1042596 - DNA, 22 bp, Artificial Sequence
  chemically synthesized
atgatacgtacattttgtgtta

SEQ ID NO: 1042597 - DNA, 22 bp, Artificial Sequence
  chemically synthesized
tgatacgtacattttgtgttaa

SEQ ID NO: 1042598 - DNA, 22 bp, Artificial Sequence
  chemically synthesized
ggcgatgtgtacaacttaacac

SEQ ID NO: 1042599 - DNA, 22 bp, Artificial Sequence
  chemically synthesized
aggcgatgtgtacaacttaaca

SEQ ID NO: 1042600 - DNA, 22 bp, Artificial Sequence
  chemically synthesized
tgtgttaagttgtacacatcgc

SEQ ID NO: 1042601 - DNA, 22 bp, Artificial Sequence
  chemically synthesized
gtgttaagttgtacacatcgcc

SEQ ID NO: 1042602 - DNA, 22 bp, Artificial Sequence
  chemically synthesized
taaaatgatttaggcgatgtgt

SEQ ID NO: 1042603 - DNA, 22 bp, Artificial Sequence
  chemically synthesized
tgttaagttgtacacatcgcct

SEQ ID NO: 1042604 - DNA, 22 bp, Artificial Sequence
  chemically synthesized
tgtaaaatgatttaggcgatgt

SEQ ID NO: 1042605 - DNA, 22 bp, Artificial Sequence
  chemically synthesized
ctgtaaaatgatttaggcgatg

SEQ ID NO: 1042606 - DNA, 22 bp, Artificial Sequence
  chemically synthesized
tctgtaaaatgatttaggcgat

SEQ ID NO: 1042607 - DNA, 22 bp, Artificial Sequence
  chemically synthesized
agttgtacacatcgcctaaatc

SEQ ID NO: 1042608 - DNA, 22 bp, Artificial Sequence
  chemically synthesized
gattttctgtaaaatgatttag

SEQ ID NO: 1042609 - DNA, 22 bp, Artificial Sequence
  chemically synthesized
ggattttctgtaaaatgattta

SEQ ID NO: 1042610 - DNA, 22 bp, Artificial Sequence
  chemically synthesized
tacacatcgcctaaatcatttt

SEQ ID NO: 1042611 - DNA, 22 bp, Artificial Sequence
  chemically synthesized
tttggattttctgtaaaatgat

SEQ ID NO: 1042612 - DNA, 22 bp, Artificial Sequence
  chemically synthesized
tatttggattttctgtaaaatg

SEQ ID NO: 1042613 - DNA, 22 bp, Artificial Sequence
  chemically synthesized
ctatttggattttctgtaaaat

SEQ ID NO: 1042614 - DNA, 22 bp, Artificial Sequence
  chemically synthesized
tctatttggattttctgtaaaa

SEQ ID NO: 1042615 - DNA, 22 bp, Artificial Sequence
  chemically synthesized
ttctatttggattttctgtaaa

SEQ ID NO: 1042616 - DNA, 22 bp, Artificial Sequence
  chemically synthesized
aatcattttacagaaaatccaa

SEQ ID NO: 1042617 - DNA, 22 bp, Artificial Sequence
  chemically synthesized
tacagaaaatccaaatagaaaa

SEQ ID NO: 1042618 - DNA, 22 bp, Artificial Sequence
  chemically synthesized
acagaaaatccaaatagaaaaa

SEQ ID NO: 1042619 - DNA, 22 bp, Artificial Sequence
  chemically synthesized
cagaaaatccaaatagaaaaat

SEQ ID NO: 1042620 - DNA, 22 bp, Artificial Sequence
  chemically synthesized
ccatgcatgtgagtcaattttt

SEQ ID NO: 1042621 - DNA, 22 bp, Artificial Sequence
  chemically synthesized
gccatgcatgtgagtcaatttt

SEQ ID NO: 1042622 - DNA, 22 bp, Artificial Sequence
  chemically synthesized
tgccatgcatgtgagtcaattt

SEQ ID NO: 1042623 - DNA, 22 bp, Artificial Sequence
  chemically synthesized
taaaaccccctttgccatgcat

SEQ ID NO: 1042624 - DNA, 22 bp, Artificial Sequence
  chemically synthesized
tataaaaccccctttgccatgc

SEQ ID NO: 1042625 - DNA, 22 bp, Artificial Sequence
  chemically synthesized
ctataaaaccccctttgccatg

SEQ ID NO: 1042626 - DNA, 22 bp, Artificial Sequence
  chemically synthesized
actcacatgcatggcaaagggg

SEQ ID NO: 1042627 - DNA, 22 bp, Artificial Sequence
  chemically synthesized
cttctataaaaccccctttgcc

SEQ ID NO: 1042628 - DNA, 22 bp, Artificial Sequence
  chemically synthesized
acttctataaaaccccctttgc

SEQ ID NO: 1042629 - DNA, 22 bp, Artificial Sequence
  chemically synthesized
acatgcatggcaaagggggttt

SEQ ID NO: 1042630 - DNA, 22 bp, Artificial Sequence
  chemically synthesized
agagaaaagtacttacttctat

SEQ ID NO: 1042631 - DNA, 22 bp, Artificial Sequence
  chemically synthesized
aactaagagaaaagtacttact

SEQ ID NO: 1042632 - DNA, 22 bp, Artificial Sequence
  chemically synthesized
gaactaagagaaaagtacttac

SEQ ID NO: 1042633 - DNA, 22 bp, Artificial Sequence
  chemically synthesized
tgaactaagagaaaagtactta

SEQ ID NO: 1042634 - DNA, 22 bp, Artificial Sequence
  chemically synthesized
tatagaagtaagtacttttctc

SEQ ID NO: 1042635 - DNA, 22 bp, Artificial Sequence
  chemically synthesized
atagaagtaagtacttttctct

SEQ ID NO: 1042636 - DNA, 22 bp, Artificial Sequence
  chemically synthesized
tagaagtaagtacttttctctt

SEQ ID NO: 1042637 - DNA, 22 bp, Artificial Sequence
  chemically synthesized
ttctcttagttcaaaatatatg

SEQ ID NO: 1042638 - DNA, 22 bp, Artificial Sequence
  chemically synthesized
tctcttagttcaaaatatatgg

SEQ ID NO: 1042639 - DNA, 22 bp, Artificial Sequence
  chemically synthesized
ctcttagttcaaaatatatggc

SEQ ID NO: 1042640 - DNA, 22 bp, Artificial Sequence
  chemically synthesized
ggatcatagaatgccatatatt

SEQ ID NO: 1042641 - DNA, 22 bp, Artificial Sequence
  chemically synthesized
tcttagttcaaaatatatggca

SEQ ID NO: 1042642 - DNA, 22 bp, Artificial Sequence
  chemically synthesized
gggatcatagaatgccatatat

SEQ ID NO: 1042643 - DNA, 22 bp, Artificial Sequence
  chemically synthesized
ttagttcaaaatatatggcatt

SEQ ID NO: 1042644 - DNA, 22 bp, Artificial Sequence
  chemically synthesized
agttcaaaatatatggcattct

SEQ ID NO: 1042645 - DNA, 22 bp, Artificial Sequence
  chemically synthesized
gttcaaaatatatggcattcta

SEQ ID NO: 1042646 - DNA, 22 bp, Artificial Sequence
  chemically synthesized
agaaatttgggatcatagaatg

SEQ ID NO: 1042647 - DNA, 22 bp, Artificial Sequence
  chemically synthesized
aaaatatatggcattctatgat

SEQ ID NO: 1042648 - DNA, 22 bp, Artificial Sequence
  chemically synthesized
taagaaatttgggatcatagaa

SEQ ID NO: 1042649 - DNA, 22 bp, Artificial Sequence
  chemically synthesized
actctaagaaatttgggatcat

SEQ ID NO: 1042650 - DNA, 22 bp, Artificial Sequence
  chemically synthesized
tatgatcccaaatttcttagag

SEQ ID NO: 1042651 - DNA, 22 bp, Artificial Sequence
  chemically synthesized
aagcgtatcctgactctaagaa

SEQ ID NO: 1042652 - DNA, 22 bp, Artificial Sequence
  chemically synthesized
tgatcccaaatttcttagagtc

SEQ ID NO: 1042653 - DNA, 22 bp, Artificial Sequence
  chemically synthesized
cttagagtcaggatacgcttta

SEQ ID NO: 1042654 - DNA, 22 bp, Artificial Sequence
  chemically synthesized
ttagagtcaggatacgctttag

SEQ ID NO: 1042655 - DNA, 22 bp, Artificial Sequence
  chemically synthesized
agtcacacaacactaaagcgta

SEQ ID NO: 1042656 - DNA, 22 bp, Artificial Sequence
  chemically synthesized
agagtcaggatacgctttagtg

SEQ ID NO: 1042657 - DNA, 22 bp, Artificial Sequence
  chemically synthesized
gagtcaggatacgctttagtgt

SEQ ID NO: 1042658 - DNA, 22 bp, Artificial Sequence
  chemically synthesized
ctgagtcacacaacactaaagc

SEQ ID NO: 1042659 - DNA, 22 bp, Artificial Sequence
  chemically synthesized
tgctgagtcacacaacactaaa

SEQ ID NO: 1042660 - DNA, 22 bp, Artificial Sequence
  chemically synthesized
ctctgctgagtcacacaacact

SEQ ID NO: 1042661 - DNA, 22 bp, Artificial Sequence
  chemically synthesized
gccctcctctgctgagtcacac

SEQ ID NO: 1042662 - DNA, 22 bp, Artificial Sequence
  chemically synthesized
cctggccctcctctgctgagtc

SEQ ID NO: 1042663 - DNA, 22 bp, Artificial Sequence
  chemically synthesized
tagtgttgtgtgactcagcaga

SEQ ID NO: 1042664 - DNA, 22 bp, Artificial Sequence
  chemically synthesized
agtgttgtgtgactcagcagag

SEQ ID NO: 1042665 - DNA, 22 bp, Artificial Sequence
  chemically synthesized
gtgttgtgtgactcagcagagg

SEQ ID NO: 1042666 - DNA, 22 bp, Artificial Sequence
  chemically synthesized
tgtgactcagcagaggagggcc

SEQ ID NO: 1042667 - DNA, 22 bp, Artificial Sequence
  chemically synthesized
cataaaacctacctggccctcc

SEQ ID NO: 1042668 - DNA, 22 bp, Artificial Sequence
  chemically synthesized
ctccataaaacctacctggccc

SEQ ID NO: 1042669 - DNA, 22 bp, Artificial Sequence
  chemically synthesized
cctccataaaacctacctggcc

SEQ ID NO: 1042670 - DNA, 22 bp, Artificial Sequence
  chemically synthesized
tcctccataaaacctacctggc

SEQ ID NO: 1042671 - DNA, 22 bp, Artificial Sequence
  chemically synthesized
agcagaggagggccaggtaggt

SEQ ID NO: 1042672 - DNA, 22 bp, Artificial Sequence
  chemically synthesized
ttcctccataaaacctacctgg

SEQ ID NO: 1042673 - DNA, 22 bp, Artificial Sequence
  chemically synthesized
gaatttttcctccataaaacct

SEQ ID NO: 1042674 - DNA, 22 bp, Artificial Sequence
  chemically synthesized
ggaatttttcctccataaaacc

SEQ ID NO: 1042675 - DNA, 22 bp, Artificial Sequence
  chemically synthesized
tggaatttttcctccataaaac

SEQ ID NO: 1042676 - DNA, 22 bp, Artificial Sequence
  chemically synthesized
ctttggaatttttcctccataa

SEQ ID NO: 1042677 - DNA, 22 bp, Artificial Sequence
  chemically synthesized
tattgctttggaatttttcctc

SEQ ID NO: 1042678 - DNA, 22 bp, Artificial Sequence
  chemically synthesized
ttgtattgctttggaatttttc

SEQ ID NO: 1042679 - DNA, 22 bp, Artificial Sequence
  chemically synthesized
tatggaggaaaaattccaaagc

SEQ ID NO: 1042680 - DNA, 22 bp, Artificial Sequence
  chemically synthesized
gattgttgtattgctttggaat

SEQ ID NO: 1042681 - DNA, 22 bp, Artificial Sequence
  chemically synthesized
atggaggaaaaattccaaagca

SEQ ID NO: 1042682 - DNA, 22 bp, Artificial Sequence
  chemically synthesized
ggattgttgtattgctttggaa

SEQ ID NO: 1042683 - DNA, 22 bp, Artificial Sequence
  chemically synthesized
tggaggaaaaattccaaagcaa

SEQ ID NO: 1042684 - DNA, 22 bp, Artificial Sequence
  chemically synthesized
ttggattgttgtattgctttgg

SEQ ID NO: 1042685 - DNA, 22 bp, Artificial Sequence
  chemically synthesized
cttggattgttgtattgctttg

SEQ ID NO: 1042686 - DNA, 22 bp, Artificial Sequence
  chemically synthesized
tcttggattgttgtattgcttt

SEQ ID NO: 1042687 - DNA, 22 bp, Artificial Sequence
  chemically synthesized
aggttttcttggattgttgtat

SEQ ID NO: 1042688 - DNA, 22 bp, Artificial Sequence
  chemically synthesized
gaggttttcttggattgttgta

SEQ ID NO: 1042689 - DNA, 22 bp, Artificial Sequence
  chemically synthesized
tgaggttttcttggattgttgt

SEQ ID NO: 1042690 - DNA, 22 bp, Artificial Sequence
  chemically synthesized
ttgaggttttcttggattgttg

SEQ ID NO: 1042691 - DNA, 22 bp, Artificial Sequence
  chemically synthesized
caaagcaatacaacaatccaag

SEQ ID NO: 1042692 - DNA, 22 bp, Artificial Sequence
  chemically synthesized
gtgatcatcagtttttgaggtt

SEQ ID NO: 1042693 - DNA, 22 bp, Artificial Sequence
  chemically synthesized
attggtgatcatcagtttttga

SEQ ID NO: 1042694 - DNA, 22 bp, Artificial Sequence
  chemically synthesized
cattcattggtgatcatcagtt

SEQ ID NO: 1042695 - DNA, 22 bp, Artificial Sequence
  chemically synthesized
aaaaactgatgatcaccaatga

SEQ ID NO: 1042696 - DNA, 22 bp, Artificial Sequence
  chemically synthesized
aaaaagcatattccattcattg

SEQ ID NO: 1042697 - DNA, 22 bp, Artificial Sequence
  chemically synthesized
aaaaaagcatattccattcatt

SEQ ID NO: 1042698 - DNA, 22 bp, Artificial Sequence
  chemically synthesized
taaaaaagcatattccattcat

SEQ ID NO: 1042699 - DNA, 22 bp, Artificial Sequence
  chemically synthesized
atgatcaccaatgaatggaata

SEQ ID NO: 1042700 - DNA, 22 bp, Artificial Sequence
  chemically synthesized
aaaagtataacatgaattttaa

SEQ ID NO: 1042701 - DNA, 22 bp, Artificial Sequence
  chemically synthesized
ttttaaaattcatgttatactt

SEQ ID NO: 1042702 - DNA, 22 bp, Artificial Sequence
  chemically synthesized
tttaaaattcatgttatacttt

SEQ ID NO: 1042703 - DNA, 22 bp, Artificial Sequence
  chemically synthesized
ttaaaattcatgttatactttt

SEQ ID NO: 1042704 - DNA, 22 bp, Artificial Sequence
  chemically synthesized
taaaattcatgttatacttttt

SEQ ID NO: 1042705 - DNA, 22 bp, Artificial Sequence
  chemically synthesized
aaaattcatgttatacttttta

SEQ ID NO: 1042706 - DNA, 22 bp, Artificial Sequence
  chemically synthesized
aaattcatgttatactttttaa

SEQ ID NO: 1042707 - DNA, 22 bp, Artificial Sequence
  chemically synthesized
catatgtaaatagaattaaaaa

SEQ ID NO: 1042708 - DNA, 22 bp, Artificial Sequence
  chemically synthesized
atgttatactttttaattctat

SEQ ID NO: 1042709 - DNA, 22 bp, Artificial Sequence
  chemically synthesized
atgattgcatatgtaaatagaa

SEQ ID NO: 1042710 - DNA, 22 bp, Artificial Sequence
  chemically synthesized
tactttttaattctatttacat

SEQ ID NO: 1042711 - DNA, 22 bp, Artificial Sequence
  chemically synthesized
tttaattctatttacatatgca

SEQ ID NO: 1042712 - DNA, 22 bp, Artificial Sequence
  chemically synthesized
ttaattctatttacatatgcaa

SEQ ID NO: 1042713 - DNA, 22 bp, Artificial Sequence
  chemically synthesized
taattctatttacatatgcaat

SEQ ID NO: 1042714 - DNA, 22 bp, Artificial Sequence
  chemically synthesized
aattctatttacatatgcaatc

SEQ ID NO: 1042715 - DNA, 22 bp, Artificial Sequence
  chemically synthesized
attctatttacatatgcaatca

SEQ ID NO: 1042716 - DNA, 22 bp, Artificial Sequence
  chemically synthesized
tatttacatatgcaatcatgag

SEQ ID NO: 1042717 - DNA, 22 bp, Artificial Sequence
  chemically synthesized
tttacatatgcaatcatgagca

SEQ ID NO: 1042718 - DNA, 22 bp, Artificial Sequence
  chemically synthesized
tcaaaataataagatgctcatg

SEQ ID NO: 1042719 - DNA, 22 bp, Artificial Sequence
  chemically synthesized
acatatgcaatcatgagcatct

SEQ ID NO: 1042720 - DNA, 22 bp, Artificial Sequence
  chemically synthesized
atcaaaataataagatgctcat

SEQ ID NO: 1042721 - DNA, 22 bp, Artificial Sequence
  chemically synthesized
catatgcaatcatgagcatctt

SEQ ID NO: 1042722 - DNA, 22 bp, Artificial Sequence
  chemically synthesized
atttatcaaaataataagatgc

SEQ ID NO: 1042723 - DNA, 22 bp, Artificial Sequence
  chemically synthesized
catttatcaaaataataagatg

SEQ ID NO: 1042724 - DNA, 22 bp, Artificial Sequence
  chemically synthesized
tcatttatcaaaataataagat

SEQ ID NO: 1042725 - DNA, 22 bp, Artificial Sequence
  chemically synthesized
aattttcatttatcaaaataat

SEQ ID NO: 1042726 - DNA, 22 bp, Artificial Sequence
  chemically synthesized
tactaaattttcatttatcaaa

SEQ ID NO: 1042727 - DNA, 22 bp, Artificial Sequence
  chemically synthesized
atactaaattttcatttatcaa

SEQ ID NO: 1042728 - DNA, 22 bp, Artificial Sequence
  chemically synthesized
attattttgataaatgaaaatt

SEQ ID NO: 1042729 - DNA, 22 bp, Artificial Sequence
  chemically synthesized
ttattttgataaatgaaaattt

SEQ ID NO: 1042730 - DNA, 22 bp, Artificial Sequence
  chemically synthesized
atcatttatactaaattttcat

SEQ ID NO: 1042731 - DNA, 22 bp, Artificial Sequence
  chemically synthesized
aatcatttatactaaattttca

SEQ ID NO: 1042732 - DNA, 22 bp, Artificial Sequence
  chemically synthesized
ttttgataaatgaaaatttagt

SEQ ID NO: 1042733 - DNA, 22 bp, Artificial Sequence
  chemically synthesized
cttaatcatttatactaaattt

SEQ ID NO: 1042734 - DNA, 22 bp, Artificial Sequence
  chemically synthesized
tgataaatgaaaatttagtata

SEQ ID NO: 1042735 - DNA, 22 bp, Artificial Sequence
  chemically synthesized
gataaatgaaaatttagtataa

SEQ ID NO: 1042736 - DNA, 22 bp, Artificial Sequence
  chemically synthesized
ataaatgaaaatttagtataaa

SEQ ID NO: 1042737 - DNA, 22 bp, Artificial Sequence
  chemically synthesized
tgaagttgcttaatcatttata

SEQ ID NO: 1042738 - DNA, 22 bp, Artificial Sequence
  chemically synthesized
cctatgaagttgcttaatcatt

SEQ ID NO: 1042739 - DNA, 22 bp, Artificial Sequence
  chemically synthesized
agtataaatgattaagcaactt

SEQ ID NO: 1042740 - DNA, 22 bp, Artificial Sequence
  chemically synthesized
gtataaatgattaagcaacttc

SEQ ID NO: 1042741 - DNA, 22 bp, Artificial Sequence
  chemically synthesized
tcatgtatggtagctacctatg

SEQ ID NO: 1042742 - DNA, 22 bp, Artificial Sequence
  chemically synthesized
atcatgtatggtagctacctat

SEQ ID NO: 1042743 - DNA, 22 bp, Artificial Sequence
  chemically synthesized
tatcatgtatggtagctaccta

SEQ ID NO: 1042744 - DNA, 22 bp, Artificial Sequence
  chemically synthesized
agcaacttcataggtagctacc

SEQ ID NO: 1042745 - DNA, 22 bp, Artificial Sequence
  chemically synthesized
tattttatcatgtatggtagct

SEQ ID NO: 1042746 - DNA, 22 bp, Artificial Sequence
  chemically synthesized
attatattttatcatgtatggt

SEQ ID NO: 1042747 - DNA, 22 bp, Artificial Sequence
  chemically synthesized
cataggtagctaccatacatga

SEQ ID NO: 1042748 - DNA, 22 bp, Artificial Sequence
  chemically synthesized
gattatattttatcatgtatgg

SEQ ID NO: 1042749 - DNA, 22 bp, Artificial Sequence
  chemically synthesized
ataggtagctaccatacatgat

SEQ ID NO: 1042750 - DNA, 22 bp, Artificial Sequence
  chemically synthesized
caggtttgattatattttatca

SEQ ID NO: 1042751 - DNA, 22 bp, Artificial Sequence
  chemically synthesized
gcaggtttgattatattttatc

SEQ ID NO: 1042752 - DNA, 22 bp, Artificial Sequence
  chemically synthesized
tgcaggtttgattatattttat

SEQ ID NO: 1042753 - DNA, 22 bp, Artificial Sequence
  chemically synthesized
ttgcaggtttgattatatttta

SEQ ID NO: 1042754 - DNA, 22 bp, Artificial Sequence
  chemically synthesized
ccatacatgataaaatataatc

SEQ ID NO: 1042755 - DNA, 22 bp, Artificial Sequence
  chemically synthesized
atttttgcaggtttgattatat

SEQ ID NO: 1042756 - DNA, 22 bp, Artificial Sequence
  chemically synthesized
tcatcaatattaatttttgcag

SEQ ID NO: 1042757 - DNA, 22 bp, Artificial Sequence
  chemically synthesized
ctgtcatcaatattaatttttg

SEQ ID NO: 1042758 - DNA, 22 bp, Artificial Sequence
  chemically synthesized
actgtcatcaatattaattttt

SEQ ID NO: 1042759 - DNA, 22 bp, Artificial Sequence
  chemically synthesized
caaaaattaatattgatgacag

SEQ ID NO: 1042760 - DNA, 22 bp, Artificial Sequence
  chemically synthesized
ccaaaatagtttactgtcatca

SEQ ID NO: 1042761 - DNA, 22 bp, Artificial Sequence
  chemically synthesized
accaaaatagtttactgtcatc

SEQ ID NO: 1042762 - DNA, 22 bp, Artificial Sequence
  chemically synthesized
taccaaaatagtttactgtcat

SEQ ID NO: 1042763 - DNA, 22 bp, Artificial Sequence
  chemically synthesized
ttttaccaaaatagtttactgt

SEQ ID NO: 1042764 - DNA, 22 bp, Artificial Sequence
  chemically synthesized
tgttttaccaaaatagtttact

SEQ ID NO: 1042765 - DNA, 22 bp, Artificial Sequence
  chemically synthesized
atattgatgacagtaaactatt

SEQ ID NO: 1042766 - DNA, 22 bp, Artificial Sequence
  chemically synthesized
ctgttttaccaaaatagtttac

SEQ ID NO: 1042767 - DNA, 22 bp, Artificial Sequence
  chemically synthesized
tctgttttaccaaaatagttta

SEQ ID NO: 1042768 - DNA, 22 bp, Artificial Sequence
  chemically synthesized
atgacagtaaactattttggta

SEQ ID NO: 1042769 - DNA, 22 bp, Artificial Sequence
  chemically synthesized
ccaaatatgttttctgttttac

SEQ ID NO: 1042770 - DNA, 22 bp, Artificial Sequence
  chemically synthesized
ttttggtaaaacagaaaacata

SEQ ID NO: 1042771 - DNA, 22 bp, Artificial Sequence
  chemically synthesized
tggtaaaacagaaaacatattt

SEQ ID NO: 1042772 - DNA, 22 bp, Artificial Sequence
  chemically synthesized
ggtaaaacagaaaacatatttg

SEQ ID NO: 1042773 - DNA, 22 bp, Artificial Sequence
  chemically synthesized
gtaaaacagaaaacatatttgg

SEQ ID NO: 1042774 - DNA, 22 bp, Artificial Sequence
  chemically synthesized
tatataaaacgggcataatatt

SEQ ID NO: 1042775 - DNA, 22 bp, Artificial Sequence
  chemically synthesized
gttatatataaaacgggcataa

SEQ ID NO: 1042776 - DNA, 22 bp, Artificial Sequence
  chemically synthesized
ggtaatattatgcccgttttat

SEQ ID NO: 1042777 - DNA, 22 bp, Artificial Sequence
  chemically synthesized
gtaatattatgcccgttttata

SEQ ID NO: 1042778 - DNA, 22 bp, Artificial Sequence
  chemically synthesized
tgcccgttttatatataactaa

SEQ ID NO: 1042779 - DNA, 22 bp, Artificial Sequence
  chemically synthesized
cccaacatcagaagtattagtt

SEQ ID NO: 1042780 - DNA, 22 bp, Artificial Sequence
  chemically synthesized
ccccaacatcagaagtattagt

SEQ ID NO: 1042781 - DNA, 22 bp, Artificial Sequence
  chemically synthesized
tatatataactaatacttctga

SEQ ID NO: 1042782 - DNA, 22 bp, Artificial Sequence
  chemically synthesized
atatataactaatacttctgat

SEQ ID NO: 1042783 - DNA, 22 bp, Artificial Sequence
  chemically synthesized
tatataactaatacttctgatg

SEQ ID NO: 1042784 - DNA, 22 bp, Artificial Sequence
  chemically synthesized
atacttctgatgttggggaaat

SEQ ID NO: 1042785 - DNA, 22 bp, Artificial Sequence
  chemically synthesized
ctgatgttggggaaatgtgctt

SEQ ID NO: 1042786 - DNA, 22 bp, Artificial Sequence
  chemically synthesized
tgatgttggggaaatgtgcttt

SEQ ID NO: 1042787 - DNA, 22 bp, Artificial Sequence
  chemically synthesized
atgttggggaaatgtgctttcc

SEQ ID NO: 1042788 - DNA, 22 bp, Artificial Sequence
  chemically synthesized
tgtaaaacaatatgatggaaag

SEQ ID NO: 1042789 - DNA, 22 bp, Artificial Sequence
  chemically synthesized
gggaaatgtgctttccatcata

SEQ ID NO: 1042790 - DNA, 22 bp, Artificial Sequence
  chemically synthesized
tcccctgtgtaaaacaatatga

SEQ ID NO: 1042791 - DNA, 22 bp, Artificial Sequence
  chemically synthesized
tgtcccctgtgtaaaacaatat

SEQ ID NO: 1042792 - DNA, 22 bp, Artificial Sequence
  chemically synthesized
ctgtcccctgtgtaaaacaata

SEQ ID NO: 1042793 - DNA, 22 bp, Artificial Sequence
  chemically synthesized
tctgtcccctgtgtaaaacaat

SEQ ID NO: 1042794 - DNA, 22 bp, Artificial Sequence
  chemically synthesized
ttctgtcccctgtgtaaaacaa

SEQ ID NO: 1042795 - DNA, 22 bp, Artificial Sequence
  chemically synthesized
tccatcatattgttttacacag

SEQ ID NO: 1042796 - DNA, 22 bp, Artificial Sequence
  chemically synthesized
cttttctgtcccctgtgtaaaa

SEQ ID NO: 1042797 - DNA, 22 bp, Artificial Sequence
  chemically synthesized
ccatcatattgttttacacagg

SEQ ID NO: 1042798 - DNA, 22 bp, Artificial Sequence
  chemically synthesized
gcttttctgtcccctgtgtaaa

SEQ ID NO: 1042799 - DNA, 22 bp, Artificial Sequence
  chemically synthesized
catcatattgttttacacaggg

SEQ ID NO: 1042800 - DNA, 22 bp, Artificial Sequence
  chemically synthesized
tgcttttctgtcccctgtgtaa

SEQ ID NO: 1042801 - DNA, 22 bp, Artificial Sequence
  chemically synthesized
ttttacacaggggacagaaaag

SEQ ID NO: 1042802 - DNA, 22 bp, Artificial Sequence
  chemically synthesized
tacacaggggacagaaaagcaa

SEQ ID NO: 1042803 - DNA, 22 bp, Artificial Sequence
  chemically synthesized
acacaggggacagaaaagcaaa

SEQ ID NO: 1042804 - DNA, 22 bp, Artificial Sequence
  chemically synthesized
cacaggggacagaaaagcaaaa

SEQ ID NO: 1042805 - DNA, 22 bp, Artificial Sequence
  chemically synthesized
tatgaaagagcgattttgcttt

SEQ ID NO: 1042806 - DNA, 22 bp, Artificial Sequence
  chemically synthesized
ggtacagaacaattgtatgaaa

SEQ ID NO: 1042807 - DNA, 22 bp, Artificial Sequence
  chemically synthesized
gggtacagaacaattgtatgaa

SEQ ID NO: 1042808 - DNA, 22 bp, Artificial Sequence
  chemically synthesized
tttcatacaattgttctgtacc

SEQ ID NO: 1042809 - DNA, 22 bp, Artificial Sequence
  chemically synthesized
tcatacaattgttctgtaccca

SEQ ID NO: 1042810 - DNA, 22 bp, Artificial Sequence
  chemically synthesized
gatgtatgcatttgggtacaga

SEQ ID NO: 1042811 - DNA, 22 bp, Artificial Sequence
  chemically synthesized
catacaattgttctgtacccaa

SEQ ID NO: 1042812 - DNA, 22 bp, Artificial Sequence
  chemically synthesized
agatgtatgcatttgggtacag

SEQ ID NO: 1042813 - DNA, 22 bp, Artificial Sequence
  chemically synthesized
atacaattgttctgtacccaaa

SEQ ID NO: 1042814 - DNA, 22 bp, Artificial Sequence
  chemically synthesized
tagatgtatgcatttgggtaca

SEQ ID NO: 1042815 - DNA, 22 bp, Artificial Sequence
  chemically synthesized
ttagatgtatgcatttgggtac

SEQ ID NO: 1042816 - DNA, 22 bp, Artificial Sequence
  chemically synthesized
tttagatgtatgcatttgggta

SEQ ID NO: 1042817 - DNA, 22 bp, Artificial Sequence
  chemically synthesized
ttttagatgtatgcatttgggt

SEQ ID NO: 1042818 - DNA, 22 bp, Artificial Sequence
  chemically synthesized
tttttagatgtatgcatttggg

SEQ ID NO: 1042819 - DNA, 22 bp, Artificial Sequence
  chemically synthesized
ttttttagatgtatgcatttgg

SEQ ID NO: 1042820 - DNA, 22 bp, Artificial Sequence
  chemically synthesized
tttttttagatgtatgcatttg

SEQ ID NO: 1042821 - DNA, 22 bp, Artificial Sequence
  chemically synthesized
ttttttttagatgtatgcattt

SEQ ID NO: 1042822 - DNA, 22 bp, Artificial Sequence
  chemically synthesized
tttttttttagatgtatgcatt

SEQ ID NO: 1042823 - DNA, 22 bp, Artificial Sequence
  chemically synthesized
ttctgtacccaaatgcatacat

SEQ ID NO: 1042824 - DNA, 22 bp, Artificial Sequence
  chemically synthesized
ttttttttttagatgtatgcat

SEQ ID NO: 1042825 - DNA, 22 bp, Artificial Sequence
  chemically synthesized
tttttttttttagatgtatgca

SEQ ID NO: 1042826 - DNA, 22 bp, Artificial Sequence
  chemically synthesized
ttttttttttttagatgtatgc

SEQ ID NO: 1042827 - DNA, 22 bp, Artificial Sequence
  chemically synthesized
tgtacccaaatgcatacatcta

SEQ ID NO: 1042828 - DNA, 22 bp, Artificial Sequence
  chemically synthesized
tttttttttttttagatgtatg

SEQ ID NO: 1042829 - DNA, 22 bp, Artificial Sequence
  chemically synthesized
ttttttttttttttagatgtat

SEQ ID NO: 1042830 - DNA, 22 bp, Artificial Sequence
  chemically synthesized
tacccaaatgcatacatctaaa

SEQ ID NO: 1042831 - DNA, 22 bp, Artificial Sequence
  chemically synthesized
ttttttttttttttttagatgt

SEQ ID NO: 1042832 - DNA, 22 bp, Artificial Sequence
  chemically synthesized
cttttttttttttttttagatg

SEQ ID NO: 1042833 - DNA, 22 bp, Artificial Sequence
  chemically synthesized
tcttttttttttttttttagat

SEQ ID NO: 1042834 - DNA, 22 bp, Artificial Sequence
  chemically synthesized
tttcttttttttttttttttag

SEQ ID NO: 1042835 - DNA, 22 bp, Artificial Sequence
  chemically synthesized
ctttctttttttttttttttta

SEQ ID NO: 1042836 - DNA, 22 bp, Artificial Sequence
  chemically synthesized
tctttctttttttttttttttt

SEQ ID NO: 1042837 - DNA, 22 bp, Artificial Sequence
  chemically synthesized
ttctttcttttttttttttttt

SEQ ID NO: 1042838 - DNA, 22 bp, Artificial Sequence
  chemically synthesized
ttttctttcttttttttttttt

SEQ ID NO: 1042839 - DNA, 22 bp, Artificial Sequence
  chemically synthesized
cttttctttctttttttttttt

SEQ ID NO: 1042840 - DNA, 22 bp, Artificial Sequence
  chemically synthesized
tttcttttctttcttttttttt

SEQ ID NO: 1042841 - DNA, 22 bp, Artificial Sequence
  chemically synthesized
atttcttttctttctttttttt

SEQ ID NO: 1042842 - DNA, 22 bp, Artificial Sequence
  chemically synthesized
tttatttcttttctttcttttt

SEQ ID NO: 1042843 - DNA, 22 bp, Artificial Sequence
  chemically synthesized
gtttatttcttttctttctttt

SEQ ID NO: 1042844 - DNA, 22 bp, Artificial Sequence
  chemically synthesized
aaaaaaaaaaaaaaagaaagaa

SEQ ID NO: 1042845 - DNA, 22 bp, Artificial Sequence
  chemically synthesized
tgtttatttcttttctttcttt

SEQ ID NO: 1042846 - DNA, 22 bp, Artificial Sequence
  chemically synthesized
ttgtttatttcttttctttctt

SEQ ID NO: 1042847 - DNA, 22 bp, Artificial Sequence
  chemically synthesized
ccatatcatgccttttgtttat

SEQ ID NO: 1042848 - DNA, 22 bp, Artificial Sequence
  chemically synthesized
ctcccatatcatgccttttgtt

SEQ ID NO: 1042849 - DNA, 22 bp, Artificial Sequence
  chemically synthesized
ctgctcccatatcatgcctttt

SEQ ID NO: 1042850 - DNA, 22 bp, Artificial Sequence
  chemically synthesized
cctgctcccatatcatgccttt

SEQ ID NO: 1042851 - DNA, 22 bp, Artificial Sequence
  chemically synthesized
gcttcctgctcccatatcatgc

SEQ ID NO: 1042852 - DNA, 22 bp, Artificial Sequence
  chemically synthesized
agtagagtgttagcttcctgct

SEQ ID NO: 1042853 - DNA, 22 bp, Artificial Sequence
  chemically synthesized
caaaaaggtaaacattgagtag

SEQ ID NO: 1042854 - DNA, 22 bp, Artificial Sequence
  chemically synthesized
ccaaaaaggtaaacattgagta

SEQ ID NO: 1042855 - DNA, 22 bp, Artificial Sequence
  chemically synthesized
acactctactcaatgtttacct

SEQ ID NO: 1042856 - DNA, 22 bp, Artificial Sequence
  chemically synthesized
tggagcttccaaaaaggtaaac

SEQ ID NO: 1042857 - DNA, 22 bp, Artificial Sequence
  chemically synthesized
tactcaatgtttacctttttgg

SEQ ID NO: 1042858 - DNA, 22 bp, Artificial Sequence
  chemically synthesized
ctcaatgtttacctttttggaa

SEQ ID NO: 1042859 - DNA, 22 bp, Artificial Sequence
  chemically synthesized
aatgtttacctttttggaagct

SEQ ID NO: 1042860 - DNA, 22 bp, Artificial Sequence
  chemically synthesized
acctttttggaagctccataga

SEQ ID NO: 1042861 - DNA, 22 bp, Artificial Sequence
  chemically synthesized
tcagtaaggaaatctatggagc

SEQ ID NO: 1042862 - DNA, 22 bp, Artificial Sequence
  chemically synthesized
cctttttggaagctccatagat

SEQ ID NO: 1042863 - DNA, 22 bp, Artificial Sequence
  chemically synthesized
tttggaagctccatagatttcc

SEQ ID NO: 1042864 - DNA, 22 bp, Artificial Sequence
  chemically synthesized
ttggaagctccatagatttcct

SEQ ID NO: 1042865 - DNA, 22 bp, Artificial Sequence
  chemically synthesized
tggaagctccatagatttcctt

SEQ ID NO: 1042866 - DNA, 22 bp, Artificial Sequence
  chemically synthesized
ggaagctccatagatttcctta

SEQ ID NO: 1042867 - DNA, 22 bp, Artificial Sequence
  chemically synthesized
gaagctccatagatttccttac

SEQ ID NO: 1042868 - DNA, 22 bp, Artificial Sequence
  chemically synthesized
aatagtgttatcagtaaggaaa

SEQ ID NO: 1042869 - DNA, 22 bp, Artificial Sequence
  chemically synthesized
catagatttccttactgataac

SEQ ID NO: 1042870 - DNA, 22 bp, Artificial Sequence
  chemically synthesized
ccttactgataacactatttaa

SEQ ID NO: 1042871 - DNA, 22 bp, Artificial Sequence
  chemically synthesized
cttactgataacactatttaat

SEQ ID NO: 1042872 - DNA, 22 bp, Artificial Sequence
  chemically synthesized
actgataacactatttaatttt

SEQ ID NO: 1042873 - DNA, 22 bp, Artificial Sequence
  chemically synthesized
ctgataacactatttaattttt

SEQ ID NO: 1042874 - DNA, 22 bp, Artificial Sequence
  chemically synthesized
ccaaaccacaggcaaaaattaa

SEQ ID NO: 1042875 - DNA, 22 bp, Artificial Sequence
  chemically synthesized
gccaaaccacaggcaaaaatta

SEQ ID NO: 1042876 - DNA, 22 bp, Artificial Sequence
  chemically synthesized
ataacactatttaatttttgcc

SEQ ID NO: 1042877 - DNA, 22 bp, Artificial Sequence
  chemically synthesized
atttgccaaaccacaggcaaaa

SEQ ID NO: 1042878 - DNA, 22 bp, Artificial Sequence
  chemically synthesized
aatttgccaaaccacaggcaaa

SEQ ID NO: 1042879 - DNA, 22 bp, Artificial Sequence
  chemically synthesized
tttaatttttgcctgtggtttg

SEQ ID NO: 1042880 - DNA, 22 bp, Artificial Sequence
  chemically synthesized
aatttttgcctgtggtttggca

SEQ ID NO: 1042881 - DNA, 22 bp, Artificial Sequence
  chemically synthesized
ccaaatttaatttgccaaacca

SEQ ID NO: 1042882 - DNA, 22 bp, Artificial Sequence
  chemically synthesized
atttttgcctgtggtttggcaa

SEQ ID NO: 1042883 - DNA, 22 bp, Artificial Sequence
  chemically synthesized
ttgcctgtggtttggcaaatta

SEQ ID NO: 1042884 - DNA, 22 bp, Artificial Sequence
  chemically synthesized
tgcctgtggtttggcaaattaa

SEQ ID NO: 1042885 - DNA, 22 bp, Artificial Sequence
  chemically synthesized
gcctgtggtttggcaaattaaa

SEQ ID NO: 1042886 - DNA, 22 bp, Artificial Sequence
  chemically synthesized
cctgtggtttggcaaattaaat

SEQ ID NO: 1042887 - DNA, 22 bp, Artificial Sequence
  chemically synthesized
tggtttggcaaattaaatttgg

SEQ ID NO: 1042888 - DNA, 22 bp, Artificial Sequence
  chemically synthesized
acagacaccaattcccaaattt

SEQ ID NO: 1042889 - DNA, 22 bp, Artificial Sequence
  chemically synthesized
ggcaaattaaatttgggaattg

SEQ ID NO: 1042890 - DNA, 22 bp, Artificial Sequence
  chemically synthesized
gcaaattaaatttgggaattgg

SEQ ID NO: 1042891 - DNA, 22 bp, Artificial Sequence
  chemically synthesized
aatttgggaattggtgtctgtt

SEQ ID NO: 1042892 - DNA, 22 bp, Artificial Sequence
  chemically synthesized
taaatcacgtatgattaacaga

SEQ ID NO: 1042893 - DNA, 22 bp, Artificial Sequence
  chemically synthesized
gggaattggtgtctgttaatca

SEQ ID NO: 1042894 - DNA, 22 bp, Artificial Sequence
  chemically synthesized
ggaattggtgtctgttaatcat

SEQ ID NO: 1042895 - DNA, 22 bp, Artificial Sequence
  chemically synthesized
ttgtaaatcacgtatgattaac

SEQ ID NO: 1042896 - DNA, 22 bp, Artificial Sequence
  chemically synthesized
tgttgtaaatcacgtatgatta

SEQ ID NO: 1042897 - DNA, 22 bp, Artificial Sequence
  chemically synthesized
ctgttgtaaatcacgtatgatt

SEQ ID NO: 1042898 - DNA, 22 bp, Artificial Sequence
  chemically synthesized
tctgttgtaaatcacgtatgat

SEQ ID NO: 1042899 - DNA, 22 bp, Artificial Sequence
  chemically synthesized
gtgtctgttaatcatacgtgat

SEQ ID NO: 1042900 - DNA, 22 bp, Artificial Sequence
  chemically synthesized
ttaatcatacgtgatttacaac

SEQ ID NO: 1042901 - DNA, 22 bp, Artificial Sequence
  chemically synthesized
atcatacgtgatttacaacaga

SEQ ID NO: 1042902 - DNA, 22 bp, Artificial Sequence
  chemically synthesized
atggaaaaaaaacaagaacttt

SEQ ID NO: 1042903 - DNA, 22 bp, Artificial Sequence
  chemically synthesized
acaacagaaagttcttgttttt

SEQ ID NO: 1042904 - DNA, 22 bp, Artificial Sequence
  chemically synthesized
caacagaaagttcttgtttttt

SEQ ID NO: 1042905 - DNA, 22 bp, Artificial Sequence
  chemically synthesized
aacatcctgatggaaaaaaaac

SEQ ID NO: 1042906 - DNA, 22 bp, Artificial Sequence
  chemically synthesized
ttgttttttttccatcaggatg

SEQ ID NO: 1042907 - DNA, 22 bp, Artificial Sequence
  chemically synthesized
gttttttttccatcaggatgtt

SEQ ID NO: 1042908 - DNA, 22 bp, Artificial Sequence
  chemically synthesized
ttttttttccatcaggatgttt

SEQ ID NO: 1042909 - DNA, 22 bp, Artificial Sequence
  chemically synthesized
atatatatcattaaacatcctg

SEQ ID NO: 1042910 - DNA, 22 bp, Artificial Sequence
  chemically synthesized
tttttccatcaggatgtttaat

SEQ ID NO: 1042911 - DNA, 22 bp, Artificial Sequence
  chemically synthesized
ttttccatcaggatgtttaatg

SEQ ID NO: 1042912 - DNA, 22 bp, Artificial Sequence
  chemically synthesized
tttccatcaggatgtttaatga

SEQ ID NO: 1042913 - DNA, 22 bp, Artificial Sequence
  chemically synthesized
ttccatcaggatgtttaatgat

SEQ ID NO: 1042914 - DNA, 22 bp, Artificial Sequence
  chemically synthesized
tccatcaggatgtttaatgata

SEQ ID NO: 1042915 - DNA, 22 bp, Artificial Sequence
  chemically synthesized
aatattaatatatatcattaaa

SEQ ID NO: 1042916 - DNA, 22 bp, Artificial Sequence
  chemically synthesized
ccatcaggatgtttaatgatat

SEQ ID NO: 1042917 - DNA, 22 bp, Artificial Sequence
  chemically synthesized
catcaggatgtttaatgatata

SEQ ID NO: 1042918 - DNA, 22 bp, Artificial Sequence
  chemically synthesized
tgaatattaatatatatcatta

SEQ ID NO: 1042919 - DNA, 22 bp, Artificial Sequence
  chemically synthesized
ctgaatattaatatatatcatt

SEQ ID NO: 1042920 - DNA, 22 bp, Artificial Sequence
  chemically synthesized
tttctgaatattaatatatatc

SEQ ID NO: 1042921 - DNA, 22 bp, Artificial Sequence
  chemically synthesized
atttctgaatattaatatatat

SEQ ID NO: 1042922 - DNA, 22 bp, Artificial Sequence
  chemically synthesized
cttatttctgaatattaatata

SEQ ID NO: 1042923 - DNA, 22 bp, Artificial Sequence
  chemically synthesized
aatgatatatattaatattcag

SEQ ID NO: 1042924 - DNA, 22 bp, Artificial Sequence
  chemically synthesized
atgatatatattaatattcaga

SEQ ID NO: 1042925 - DNA, 22 bp, Artificial Sequence
  chemically synthesized
tacccaagtctgcttatttctg

SEQ ID NO: 1042926 - DNA, 22 bp, Artificial Sequence
  chemically synthesized
gtacccaagtctgcttatttct

SEQ ID NO: 1042927 - DNA, 22 bp, Artificial Sequence
  chemically synthesized
atattcagaaataagcagactt

SEQ ID NO: 1042928 - DNA, 22 bp, Artificial Sequence
  chemically synthesized
agaaataagcagacttgggtac

SEQ ID NO: 1042929 - DNA, 22 bp, Artificial Sequence
  chemically synthesized
atacaatgacttgtacccaagt

SEQ ID NO: 1042930 - DNA, 22 bp, Artificial Sequence
  chemically synthesized
aatacaatgacttgtacccaag

SEQ ID NO: 1042931 - DNA, 22 bp, Artificial Sequence
  chemically synthesized
tagtttaatacaatgacttgta

SEQ ID NO: 1042932 - DNA, 22 bp, Artificial Sequence
  chemically synthesized
atagtttaatacaatgacttgt

SEQ ID NO: 1042933 - DNA, 22 bp, Artificial Sequence
  chemically synthesized
gggtacaagtcattgtattaaa

SEQ ID NO: 1042934 - DNA, 22 bp, Artificial Sequence
  chemically synthesized
ggtacaagtcattgtattaaac

SEQ ID NO: 1042935 - DNA, 22 bp, Artificial Sequence
  chemically synthesized
gcaatatcttatagtttaatac

SEQ ID NO: 1042936 - DNA, 22 bp, Artificial Sequence
  chemically synthesized
aatattggcaatatcttatagt

SEQ ID NO: 1042937 - DNA, 22 bp, Artificial Sequence
  chemically synthesized
aaatattggcaatatcttatag

SEQ ID NO: 1042938 - DNA, 22 bp, Artificial Sequence
  chemically synthesized
tattaaactataagatattgcc

SEQ ID NO: 1042939 - DNA, 22 bp, Artificial Sequence
  chemically synthesized
aaaaggtttaaatattggcaat

SEQ ID NO: 1042940 - DNA, 22 bp, Artificial Sequence
  chemically synthesized
aactataagatattgccaatat

SEQ ID NO: 1042941 - DNA, 22 bp, Artificial Sequence
  chemically synthesized
caaaaggtttaaatattggcaa

SEQ ID NO: 1042942 - DNA, 22 bp, Artificial Sequence
  chemically synthesized
tcaaaaggtttaaatattggca

SEQ ID NO: 1042943 - DNA, 22 bp, Artificial Sequence
  chemically synthesized
taagatattgccaatatttaaa

SEQ ID NO: 1042944 - DNA, 22 bp, Artificial Sequence
  chemically synthesized
tcaagtctttcaaaaggtttaa

SEQ ID NO: 1042945 - DNA, 22 bp, Artificial Sequence
  chemically synthesized
ccaatatttaaaccttttgaaa

SEQ ID NO: 1042946 - DNA, 22 bp, Artificial Sequence
  chemically synthesized
tgaattgtcaagtctttcaaaa

SEQ ID NO: 1042947 - DNA, 22 bp, Artificial Sequence
  chemically synthesized
atgaattgtcaagtctttcaaa

SEQ ID NO: 1042948 - DNA, 22 bp, Artificial Sequence
  chemically synthesized
aaaccttttgaaagacttgaca

SEQ ID NO: 1042949 - DNA, 22 bp, Artificial Sequence
  chemically synthesized
aaccttatgaattgtcaagtct

SEQ ID NO: 1042950 - DNA, 22 bp, Artificial Sequence
  chemically synthesized
aaccttttgaaagacttgacaa

SEQ ID NO: 1042951 - DNA, 22 bp, Artificial Sequence
  chemically synthesized
cattgaaccttatgaattgtca

SEQ ID NO: 1042952 - DNA, 22 bp, Artificial Sequence
  chemically synthesized
ttgaaagacttgacaattcata

SEQ ID NO: 1042953 - DNA, 22 bp, Artificial Sequence
  chemically synthesized
tgaaagacttgacaattcataa

SEQ ID NO: 1042954 - DNA, 22 bp, Artificial Sequence
  chemically synthesized
ttccattgaaccttatgaattg

SEQ ID NO: 1042955 - DNA, 22 bp, Artificial Sequence
  chemically synthesized
gaaagacttgacaattcataag

SEQ ID NO: 1042956 - DNA, 22 bp, Artificial Sequence
  chemically synthesized
aaagacttgacaattcataagg

SEQ ID NO: 1042957 - DNA, 22 bp, Artificial Sequence
  chemically synthesized
taatgctattccattgaacctt

SEQ ID NO: 1042958 - DNA, 22 bp, Artificial Sequence
  chemically synthesized
gacaattcataaggttcaatgg

SEQ ID NO: 1042959 - DNA, 22 bp, Artificial Sequence
  chemically synthesized
acaattcataaggttcaatgga

SEQ ID NO: 1042960 - DNA, 22 bp, Artificial Sequence
  chemically synthesized
aaattataatgctattccattg

SEQ ID NO: 1042961 - DNA, 22 bp, Artificial Sequence
  chemically synthesized
ataaggttcaatggaatagcat

SEQ ID NO: 1042962 - DNA, 22 bp, Artificial Sequence
  chemically synthesized
aatggaatagcattataatttt

SEQ ID NO: 1042963 - DNA, 22 bp, Artificial Sequence
  chemically synthesized
taaccatgaacatattaaaatt

SEQ ID NO: 1042964 - DNA, 22 bp, Artificial Sequence
  chemically synthesized
gtaaccatgaacatattaaaat

SEQ ID NO: 1042965 - DNA, 22 bp, Artificial Sequence
  chemically synthesized
aatttgtaaccatgaacatatt

SEQ ID NO: 1042966 - DNA, 22 bp, Artificial Sequence
  chemically synthesized
gttaaatttgtaaccatgaaca

SEQ ID NO: 1042967 - DNA, 22 bp, Artificial Sequence
  chemically synthesized
taattttaatatgttcatggtt

SEQ ID NO: 1042968 - DNA, 22 bp, Artificial Sequence
  chemically synthesized
ctggttaaatttgtaaccatga

SEQ ID NO: 1042969 - DNA, 22 bp, Artificial Sequence
  chemically synthesized
tcctggttaaatttgtaaccat

SEQ ID NO: 1042970 - DNA, 22 bp, Artificial Sequence
  chemically synthesized
ctcctggttaaatttgtaacca

SEQ ID NO: 1042971 - DNA, 22 bp, Artificial Sequence
  chemically synthesized
taatatgttcatggttacaaat

SEQ ID NO: 1042972 - DNA, 22 bp, Artificial Sequence
  chemically synthesized
tctcctggttaaatttgtaacc

SEQ ID NO: 1042973 - DNA, 22 bp, Artificial Sequence
  chemically synthesized
aatatgttcatggttacaaatt

SEQ ID NO: 1042974 - DNA, 22 bp, Artificial Sequence
  chemically synthesized
atatgttcatggttacaaattt

SEQ ID NO: 1042975 - DNA, 22 bp, Artificial Sequence
  chemically synthesized
ttttctcctggttaaatttgta

SEQ ID NO: 1042976 - DNA, 22 bp, Artificial Sequence
  chemically synthesized
attttctcctggttaaatttgt

SEQ ID NO: 1042977 - DNA, 22 bp, Artificial Sequence
  chemically synthesized
tatttattttctcctggttaaa

SEQ ID NO: 1042978 - DNA, 22 bp, Artificial Sequence
  chemically synthesized
atggttacaaatttaaccagga

SEQ ID NO: 1042979 - DNA, 22 bp, Artificial Sequence
  chemically synthesized
gtatttattttctcctggttaa

SEQ ID NO: 1042980 - DNA, 22 bp, Artificial Sequence
  chemically synthesized
gtttgtatttattttctcctgg

SEQ ID NO: 1042981 - DNA, 22 bp, Artificial Sequence
  chemically synthesized
caaatttaaccaggagaaaata

SEQ ID NO: 1042982 - DNA, 22 bp, Artificial Sequence
  chemically synthesized
aaaaagttagtttgtatttatt

SEQ ID NO: 1042983 - DNA, 22 bp, Artificial Sequence
  chemically synthesized
aaccaggagaaaataaatacaa

SEQ ID NO: 1042984 - DNA, 22 bp, Artificial Sequence
  chemically synthesized
aaaaaagttagtttgtatttat

SEQ ID NO: 1042985 - DNA, 22 bp, Artificial Sequence
  chemically synthesized
accaggagaaaataaatacaaa

SEQ ID NO: 1042986 - DNA, 22 bp, Artificial Sequence
  chemically synthesized
ccatttaaaaaagttagtttgt

SEQ ID NO: 1042987 - DNA, 22 bp, Artificial Sequence
  chemically synthesized
gccatttaaaaaagttagtttg

SEQ ID NO: 1042988 - DNA, 22 bp, Artificial Sequence
  chemically synthesized
tgccatttaaaaaagttagttt

SEQ ID NO: 1042989 - DNA, 22 bp, Artificial Sequence
  chemically synthesized
ctttgccatttaaaaaagttag

SEQ ID NO: 1042990 - DNA, 22 bp, Artificial Sequence
  chemically synthesized
cctttgccatttaaaaaagtta

SEQ ID NO: 1042991 - DNA, 22 bp, Artificial Sequence
  chemically synthesized
tcctttgccatttaaaaaagtt

SEQ ID NO: 1042992 - DNA, 22 bp, Artificial Sequence
  chemically synthesized
tctttcctttgccatttaaaaa

SEQ ID NO: 1042993 - DNA, 22 bp, Artificial Sequence
  chemically synthesized
ttgtctttcctttgccatttaa

SEQ ID NO: 1042994 - DNA, 22 bp, Artificial Sequence
  chemically synthesized
gttgtctttcctttgccattta

SEQ ID NO: 1042995 - DNA, 22 bp, Artificial Sequence
  chemically synthesized
tgttgtctttcctttgccattt

SEQ ID NO: 1042996 - DNA, 22 bp, Artificial Sequence
  chemically synthesized
ttgttgtctttcctttgccatt

SEQ ID NO: 1042997 - DNA, 22 bp, Artificial Sequence
  chemically synthesized
tttgttgtctttcctttgccat

SEQ ID NO: 1042998 - DNA, 22 bp, Artificial Sequence
  chemically synthesized
acttttttaaatggcaaaggaa

SEQ ID NO: 1042999 - DNA, 22 bp, Artificial Sequence
  chemically synthesized
ttttttgttgtctttcctttgc

SEQ ID NO: 1043000 - DNA, 22 bp, Artificial Sequence
  chemically synthesized
attttttgttgtctttcctttg

SEQ ID NO: 1043001 - DNA, 22 bp, Artificial Sequence
  chemically synthesized
ttttaaatggcaaaggaaagac

SEQ ID NO: 1043002 - DNA, 22 bp, Artificial Sequence
  chemically synthesized
tttaaatggcaaaggaaagaca

SEQ ID NO: 1043003 - DNA, 22 bp, Artificial Sequence
  chemically synthesized
tttattttttgttgtctttcct

SEQ ID NO: 1043004 - DNA, 22 bp, Artificial Sequence
  chemically synthesized
ttaaatggcaaaggaaagacaa

SEQ ID NO: 1043005 - DNA, 22 bp, Artificial Sequence
  chemically synthesized
taaatggcaaaggaaagacaac

SEQ ID NO: 1043006 - DNA, 22 bp, Artificial Sequence
  chemically synthesized
aaatggcaaaggaaagacaaca

SEQ ID NO: 1043007 - DNA, 22 bp, Artificial Sequence
  chemically synthesized
ttgtttattttttgttgtcttt

SEQ ID NO: 1043008 - DNA, 22 bp, Artificial Sequence
  chemically synthesized
aatggcaaaggaaagacaacaa

SEQ ID NO: 1043009 - DNA, 22 bp, Artificial Sequence
  chemically synthesized
gttgtttattttttgttgtctt

SEQ ID NO: 1043010 - DNA, 22 bp, Artificial Sequence
  chemically synthesized
tgttgtttattttttgttgtct

SEQ ID NO: 1043011 - DNA, 22 bp, Artificial Sequence
  chemically synthesized
ttgttgtttattttttgttgtc

SEQ ID NO: 1043012 - DNA, 22 bp, Artificial Sequence
  chemically synthesized
cttttgttgtttattttttgtt

SEQ ID NO: 1043013 - DNA, 22 bp, Artificial Sequence
  chemically synthesized
gcttttgttgtttattttttgt

SEQ ID NO: 1043014 - DNA, 22 bp, Artificial Sequence
  chemically synthesized
aaatttgcttttgttgtttatt

SEQ ID NO: 1043015 - DNA, 22 bp, Artificial Sequence
  chemically synthesized
gaaatttgcttttgttgtttat

SEQ ID NO: 1043016 - DNA, 22 bp, Artificial Sequence
  chemically synthesized
gagtcttgaaatttgcttttgt

SEQ ID NO: 1043017 - DNA, 22 bp, Artificial Sequence
  chemically synthesized
ggagtcttgaaatttgcttttg

SEQ ID NO: 1043018 - DNA, 22 bp, Artificial Sequence
  chemically synthesized
tggagtcttgaaatttgctttt

SEQ ID NO: 1043019 - DNA, 22 bp, Artificial Sequence
  chemically synthesized
ctttggagtcttgaaatttgct

SEQ ID NO: 1043020 - DNA, 22 bp, Artificial Sequence
  chemically synthesized
gctttggagtcttgaaatttgc

SEQ ID NO: 1043021 - DNA, 22 bp, Artificial Sequence
  chemically synthesized
tgctttggagtcttgaaatttg

SEQ ID NO: 1043022 - DNA, 22 bp, Artificial Sequence
  chemically synthesized
ttgctttggagtcttgaaattt

SEQ ID NO: 1043023 - DNA, 22 bp, Artificial Sequence
  chemically synthesized
tttgctttggagtcttgaaatt

SEQ ID NO: 1043024 - DNA, 22 bp, Artificial Sequence
  chemically synthesized
ttttgctttggagtcttgaaat

SEQ ID NO: 1043025 - DNA, 22 bp, Artificial Sequence
  chemically synthesized
ttttttgctttggagtcttgaa

SEQ ID NO: 1043026 - DNA, 22 bp, Artificial Sequence
  chemically synthesized
tcttttttgctttggagtcttg

SEQ ID NO: 1043027 - DNA, 22 bp, Artificial Sequence
  chemically synthesized
ctcttttttgctttggagtctt

SEQ ID NO: 1043028 - DNA, 22 bp, Artificial Sequence
  chemically synthesized
tctcttttttgctttggagtct

SEQ ID NO: 1043029 - DNA, 22 bp, Artificial Sequence
  chemically synthesized
ttctcttttttgctttggagtc

SEQ ID NO: 1043030 - DNA, 22 bp, Artificial Sequence
  chemically synthesized
tttctcttttttgctttggagt

SEQ ID NO: 1043031 - DNA, 22 bp, Artificial Sequence
  chemically synthesized
ttttctcttttttgctttggag

SEQ ID NO: 1043032 - DNA, 22 bp, Artificial Sequence
  chemically synthesized
caagactccaaagcaaaaaaga

SEQ ID NO: 1043033 - DNA, 22 bp, Artificial Sequence
  chemically synthesized
aagactccaaagcaaaaaagag

SEQ ID NO: 1043034 - DNA, 22 bp, Artificial Sequence
  chemically synthesized
atcagtagtgtttttttctctt

SEQ ID NO: 1043035 - DNA, 22 bp, Artificial Sequence
  chemically synthesized
aatcagtagtgtttttttctct

SEQ ID NO: 1043036 - DNA, 22 bp, Artificial Sequence
  chemically synthesized
caaagcaaaaaagagaaaaaaa

SEQ ID NO: 1043037 - DNA, 22 bp, Artificial Sequence
  chemically synthesized
agcaaagaatgatttaatcagt

SEQ ID NO: 1043038 - DNA, 22 bp, Artificial Sequence
  chemically synthesized
taagcaaagaatgatttaatca

SEQ ID NO: 1043039 - DNA, 22 bp, Artificial Sequence
  chemically synthesized
aaactctaagcaaagaatgatt

SEQ ID NO: 1043040 - DNA, 22 bp, Artificial Sequence
  chemically synthesized
ctgattaaatcattctttgctt

SEQ ID NO: 1043041 - DNA, 22 bp, Artificial Sequence
  chemically synthesized
attaaatcattctttgcttaga

SEQ ID NO: 1043042 - DNA, 22 bp, Artificial Sequence
  chemically synthesized
aaaaatattgaaactctaagca

SEQ ID NO: 1043043 - DNA, 22 bp, Artificial Sequence
  chemically synthesized
aatcattctttgcttagagttt

SEQ ID NO: 1043044 - DNA, 22 bp, Artificial Sequence
  chemically synthesized
ttgaaaaatattgaaactctaa

SEQ ID NO: 1043045 - DNA, 22 bp, Artificial Sequence
  chemically synthesized
tttgcttagagtttcaatattt

SEQ ID NO: 1043046 - DNA, 22 bp, Artificial Sequence
  chemically synthesized
tgcttagagtttcaatattttt

SEQ ID NO: 1043047 - DNA, 22 bp, Artificial Sequence
  chemically synthesized
gcttagagtttcaatatttttc

SEQ ID NO: 1043048 - DNA, 22 bp, Artificial Sequence
  chemically synthesized
cttagagtttcaatatttttca

SEQ ID NO: 1043049 - DNA, 22 bp, Artificial Sequence
  chemically synthesized
agagtttcaatatttttcaata

SEQ ID NO: 1043050 - DNA, 22 bp, Artificial Sequence
  chemically synthesized
gagtttcaatatttttcaataa

SEQ ID NO: 1043051 - DNA, 22 bp, Artificial Sequence
  chemically synthesized
agaaccatgacaaaaattattg

SEQ ID NO: 1043052 - DNA, 22 bp, Artificial Sequence
  chemically synthesized
caatatttttcaataatttttg

SEQ ID NO: 1043053 - DNA, 22 bp, Artificial Sequence
  chemically synthesized
aatatttttcaataatttttgt

SEQ ID NO: 1043054 - DNA, 22 bp, Artificial Sequence
  chemically synthesized
tgagttcagaaccatgacaaaa

SEQ ID NO: 1043055 - DNA, 22 bp, Artificial Sequence
  chemically synthesized
ttcaataatttttgtcatggtt

SEQ ID NO: 1043056 - DNA, 22 bp, Artificial Sequence
  chemically synthesized
tcaataatttttgtcatggttc

SEQ ID NO: 1043057 - DNA, 22 bp, Artificial Sequence
  chemically synthesized
attgtgagttcagaaccatgac

SEQ ID NO: 1043058 - DNA, 22 bp, Artificial Sequence
  chemically synthesized
caataatttttgtcatggttct

SEQ ID NO: 1043059 - DNA, 22 bp, Artificial Sequence
  chemically synthesized
aataatttttgtcatggttctg

SEQ ID NO: 1043060 - DNA, 22 bp, Artificial Sequence
  chemically synthesized
taattgtgagttcagaaccatg

SEQ ID NO: 1043061 - DNA, 22 bp, Artificial Sequence
  chemically synthesized
ttctaattgtgagttcagaacc

SEQ ID NO: 1043062 - DNA, 22 bp, Artificial Sequence
  chemically synthesized
ttgtcatggttctgaactcaca

SEQ ID NO: 1043063 - DNA, 22 bp, Artificial Sequence
  chemically synthesized
tgtcatggttctgaactcacaa

SEQ ID NO: 1043064 - DNA, 22 bp, Artificial Sequence
  chemically synthesized
gtcatggttctgaactcacaat

SEQ ID NO: 1043065 - DNA, 22 bp, Artificial Sequence
  chemically synthesized
tcatggttctgaactcacaatt

SEQ ID NO: 1043066 - DNA, 22 bp, Artificial Sequence
  chemically synthesized
aaacccattgttctaattgtga

SEQ ID NO: 1043067 - DNA, 22 bp, Artificial Sequence
  chemically synthesized
aaaacccattgttctaattgtg

SEQ ID NO: 1043068 - DNA, 22 bp, Artificial Sequence
  chemically synthesized
tgaactcacaattagaacaatg

SEQ ID NO: 1043069 - DNA, 22 bp, Artificial Sequence
  chemically synthesized
aactcacaattagaacaatggg

SEQ ID NO: 1043070 - DNA, 22 bp, Artificial Sequence
  chemically synthesized
agtaacttaaaacccattgttc

SEQ ID NO: 1043071 - DNA, 22 bp, Artificial Sequence
  chemically synthesized
gttcagtaacttaaaacccatt

SEQ ID NO: 1043072 - DNA, 22 bp, Artificial Sequence
  chemically synthesized
acaattagaacaatgggtttta

SEQ ID NO: 1043073 - DNA, 22 bp, Artificial Sequence
  chemically synthesized
tagttcagtaacttaaaaccca

SEQ ID NO: 1043074 - DNA, 22 bp, Artificial Sequence
  chemically synthesized
ctagttcagtaacttaaaaccc

SEQ ID NO: 1043075 - DNA, 22 bp, Artificial Sequence
  chemically synthesized
gaacaatgggttttaagttact

SEQ ID NO: 1043076 - DNA, 22 bp, Artificial Sequence
  chemically synthesized
catttctagttcagtaacttaa

SEQ ID NO: 1043077 - DNA, 22 bp, Artificial Sequence
  chemically synthesized
ccatttctagttcagtaactta

SEQ ID NO: 1043078 - DNA, 22 bp, Artificial Sequence
  chemically synthesized
tccatttctagttcagtaactt

SEQ ID NO: 1043079 - DNA, 22 bp, Artificial Sequence
  chemically synthesized
ttccatttctagttcagtaact

SEQ ID NO: 1043080 - DNA, 22 bp, Artificial Sequence
  chemically synthesized
tttccatttctagttcagtaac

SEQ ID NO: 1043081 - DNA, 22 bp, Artificial Sequence
  chemically synthesized
ttttttccatttctagttcagt

SEQ ID NO: 1043082 - DNA, 22 bp, Artificial Sequence
  chemically synthesized
attttttccatttctagttcag

SEQ ID NO: 1043083 - DNA, 22 bp, Artificial Sequence
  chemically synthesized
atttattttttccatttctagt

SEQ ID NO: 1043084 - DNA, 22 bp, Artificial Sequence
  chemically synthesized
taagttactgaactagaaatgg

SEQ ID NO: 1043085 - DNA, 22 bp, Artificial Sequence
  chemically synthesized
aagttactgaactagaaatgga

SEQ ID NO: 1043086 - DNA, 22 bp, Artificial Sequence
  chemically synthesized
agttactgaactagaaatggaa

SEQ ID NO: 1043087 - DNA, 22 bp, Artificial Sequence
  chemically synthesized
ctgaactagaaatggaaaaaat

SEQ ID NO: 1043088 - DNA, 22 bp, Artificial Sequence
  chemically synthesized
aactagaaatggaaaaaataaa

SEQ ID NO: 1043089 - DNA, 22 bp, Artificial Sequence
  chemically synthesized
tgaaatgtgttgatttattttt

SEQ ID NO: 1043090 - DNA, 22 bp, Artificial Sequence
  chemically synthesized
atgaaatgtgttgatttatttt

SEQ ID NO: 1043091 - DNA, 22 bp, Artificial Sequence
  chemically synthesized
tatgaaatgtgttgatttattt

SEQ ID NO: 1043092 - DNA, 22 bp, Artificial Sequence
  chemically synthesized
gaaatggaaaaaataaatcaac

SEQ ID NO: 1043093 - DNA, 22 bp, Artificial Sequence
  chemically synthesized
tttatgaaatgtgttgatttat

SEQ ID NO: 1043094 - DNA, 22 bp, Artificial Sequence
  chemically synthesized
ctttatgaaatgtgttgattta

SEQ ID NO: 1043095 - DNA, 22 bp, Artificial Sequence
  chemically synthesized
gtttctttatgaaatgtgttga

SEQ ID NO: 1043096 - DNA, 22 bp, Artificial Sequence
  chemically synthesized
agtttctttatgaaatgtgttg

SEQ ID NO: 1043097 - DNA, 22 bp, Artificial Sequence
  chemically synthesized
tagtttctttatgaaatgtgtt

SEQ ID NO: 1043098 - DNA, 22 bp, Artificial Sequence
  chemically synthesized
ggctttagtttctttatgaaat

SEQ ID NO: 1043099 - DNA, 22 bp, Artificial Sequence
  chemically synthesized
gggctttagtttctttatgaaa

SEQ ID NO: 1043100 - DNA, 22 bp, Artificial Sequence
  chemically synthesized
tgggctttagtttctttatgaa

SEQ ID NO: 1043101 - DNA, 22 bp, Artificial Sequence
  chemically synthesized
ttttgggctttagtttctttat

SEQ ID NO: 1043102 - DNA, 22 bp, Artificial Sequence
  chemically synthesized
attttgggctttagtttcttta

SEQ ID NO: 1043103 - DNA, 22 bp, Artificial Sequence
  chemically synthesized
tattttgggctttagtttcttt

SEQ ID NO: 1043104 - DNA, 22 bp, Artificial Sequence
  chemically synthesized
ttttattttgggctttagtttc

SEQ ID NO: 1043105 - DNA, 22 bp, Artificial Sequence
  chemically synthesized
ttgttttattttgggctttagt

SEQ ID NO: 1043106 - DNA, 22 bp, Artificial Sequence
  chemically synthesized
cataaagaaactaaagcccaaa

SEQ ID NO: 1043107 - DNA, 22 bp, Artificial Sequence
  chemically synthesized
ataaagaaactaaagcccaaaa

SEQ ID NO: 1043108 - DNA, 22 bp, Artificial Sequence
  chemically synthesized
attgttgttttattttgggctt

SEQ ID NO: 1043109 - DNA, 22 bp, Artificial Sequence
  chemically synthesized
aattgttgttttattttgggct

SEQ ID NO: 1043110 - DNA, 22 bp, Artificial Sequence
  chemically synthesized
taattgttgttttattttgggc

SEQ ID NO: 1043111 - DNA, 22 bp, Artificial Sequence
  chemically synthesized
gttttaattgttgttttatttt

SEQ ID NO: 1043112 - DNA, 22 bp, Artificial Sequence
  chemically synthesized
ggttttaattgttgttttattt

SEQ ID NO: 1043113 - DNA, 22 bp, Artificial Sequence
  chemically synthesized
gcttggttttaattgttgtttt

SEQ ID NO: 1043114 - DNA, 22 bp, Artificial Sequence
  chemically synthesized
aagcccaaaataaaacaacaat

SEQ ID NO: 1043115 - DNA, 22 bp, Artificial Sequence
  chemically synthesized
tagcttggttttaattgttgtt

SEQ ID NO: 1043116 - DNA, 22 bp, Artificial Sequence
  chemically synthesized
ctagcttggttttaattgttgt

SEQ ID NO: 1043117 - DNA, 22 bp, Artificial Sequence
  chemically synthesized
tctagcttggttttaattgttg

SEQ ID NO: 1043118 - DNA, 22 bp, Artificial Sequence
  chemically synthesized
ttttctagcttggttttaattg

SEQ ID NO: 1043119 - DNA, 22 bp, Artificial Sequence
  chemically synthesized
ccaagaagaggatgctgttttc

SEQ ID NO: 1043120 - DNA, 22 bp, Artificial Sequence
  chemically synthesized
aaaccaagctagaaaacagcat

SEQ ID NO: 1043121 - DNA, 22 bp, Artificial Sequence
  chemically synthesized
accaagaagaggatgctgtttt

SEQ ID NO: 1043122 - DNA, 22 bp, Artificial Sequence
  chemically synthesized
taccaagaagaggatgctgttt

SEQ ID NO: 1043123 - DNA, 22 bp, Artificial Sequence
  chemically synthesized
ttaccaagaagaggatgctgtt

SEQ ID NO: 1043124 - DNA, 22 bp, Artificial Sequence
  chemically synthesized
gaaaacagcatcctcttcttgg

SEQ ID NO: 1043125 - DNA, 22 bp, Artificial Sequence
  chemically synthesized
tgtaccataacttttaccaaga

SEQ ID NO: 1043126 - DNA, 22 bp, Artificial Sequence
  chemically synthesized
tgtgtaccataacttttaccaa

SEQ ID NO: 1043127 - DNA, 22 bp, Artificial Sequence
  chemically synthesized
caagattctgtgtaccataact

SEQ ID NO: 1043128 - DNA, 22 bp, Artificial Sequence
  chemically synthesized
ttcttggtaaaagttatggtac

SEQ ID NO: 1043129 - DNA, 22 bp, Artificial Sequence
  chemically synthesized
cttggtaaaagttatggtacac

SEQ ID NO: 1043130 - DNA, 22 bp, Artificial Sequence
  chemically synthesized
ttccaagattctgtgtaccata

SEQ ID NO: 1043131 - DNA, 22 bp, Artificial Sequence
  chemically synthesized
ttggtaaaagttatggtacaca

SEQ ID NO: 1043132 - DNA, 22 bp, Artificial Sequence
  chemically synthesized
ggtaaaagttatggtacacaga

SEQ ID NO: 1043133 - DNA, 22 bp, Artificial Sequence
  chemically synthesized
gtaaaagttatggtacacagaa

SEQ ID NO: 1043134 - DNA, 22 bp, Artificial Sequence
  chemically synthesized
aattattccaagattctgtgta

SEQ ID NO: 1043135 - DNA, 22 bp, Artificial Sequence
  chemically synthesized
taaattattccaagattctgtg

SEQ ID NO: 1043136 - DNA, 22 bp, Artificial Sequence
  chemically synthesized
tggtacacagaatcttggaata

SEQ ID NO: 1043137 - DNA, 22 bp, Artificial Sequence
  chemically synthesized
aggtgcagaaatgcaactctaa

SEQ ID NO: 1043138 - DNA, 22 bp, Artificial Sequence
  chemically synthesized
gaggtgcagaaatgcaactcta

SEQ ID NO: 1043139 - DNA, 22 bp, Artificial Sequence
  chemically synthesized
ggaataatttagagttgcattt

SEQ ID NO: 1043140 - DNA, 22 bp, Artificial Sequence
  chemically synthesized
gaataatttagagttgcatttc

SEQ ID NO: 1043141 - DNA, 22 bp, Artificial Sequence
  chemically synthesized
tcttgaggtgcagaaatgcaac

SEQ ID NO: 1043142 - DNA, 22 bp, Artificial Sequence
  chemically synthesized
atcttgaggtgcagaaatgcaa

SEQ ID NO: 1043143 - DNA, 22 bp, Artificial Sequence
  chemically synthesized
tatatttatcttgaggtgcaga

SEQ ID NO: 1043144 - DNA, 22 bp, Artificial Sequence
  chemically synthesized
agagttgcatttctgcacctca

SEQ ID NO: 1043145 - DNA, 22 bp, Artificial Sequence
  chemically synthesized
gagttgcatttctgcacctcaa

SEQ ID NO: 1043146 - DNA, 22 bp, Artificial Sequence
  chemically synthesized
ttgtatatttatcttgaggtgc

SEQ ID NO: 1043147 - DNA, 22 bp, Artificial Sequence
  chemically synthesized
attgtatatttatcttgaggtg

SEQ ID NO: 1043148 - DNA, 22 bp, Artificial Sequence
  chemically synthesized
tattgtatatttatcttgaggt

SEQ ID NO: 1043149 - DNA, 22 bp, Artificial Sequence
  chemically synthesized
catttctgcacctcaagataaa

SEQ ID NO: 1043150 - DNA, 22 bp, Artificial Sequence
  chemically synthesized
actttattgtatatttatcttg

SEQ ID NO: 1043151 - DNA, 22 bp, Artificial Sequence
  chemically synthesized
ctgcacctcaagataaatatac

SEQ ID NO: 1043152 - DNA, 22 bp, Artificial Sequence
  chemically synthesized
tgcacctcaagataaatataca

SEQ ID NO: 1043153 - DNA, 22 bp, Artificial Sequence
  chemically synthesized
cacctcaagataaatatacaat

SEQ ID NO: 1043154 - DNA, 22 bp, Artificial Sequence
  chemically synthesized
aagataaatatacaataaagtg

SEQ ID NO: 1043155 - DNA, 22 bp, Artificial Sequence
  chemically synthesized
aggtataaaacaaataactcac

SEQ ID NO: 1043156 - DNA, 22 bp, Artificial Sequence
  chemically synthesized
aaggtataaaacaaataactca

SEQ ID NO: 1043157 - DNA, 22 bp, Artificial Sequence
  chemically synthesized
tttaaggtataaaacaaataac

SEQ ID NO: 1043158 - DNA, 22 bp, Artificial Sequence
  chemically synthesized
atttaaggtataaaacaaataa

SEQ ID NO: 1043159 - DNA, 22 bp, Artificial Sequence
  chemically synthesized
tttatttaaggtataaaacaaa

SEQ ID NO: 1043160 - DNA, 22 bp, Artificial Sequence
  chemically synthesized
tatttatttaaggtataaaaca

SEQ ID NO: 1043161 - DNA, 22 bp, Artificial Sequence
  chemically synthesized
ctatttatttaaggtataaaac

SEQ ID NO: 1043162 - DNA, 22 bp, Artificial Sequence
  chemically synthesized
ttctatttatttaaggtataaa

SEQ ID NO: 1043163 - DNA, 22 bp, Artificial Sequence
  chemically synthesized
ttcttctatttatttaaggtat

SEQ ID NO: 1043164 - DNA, 22 bp, Artificial Sequence
  chemically synthesized
attcttctatttatttaaggta

SEQ ID NO: 1043165 - DNA, 22 bp, Artificial Sequence
  chemically synthesized
tattcttctatttatttaaggt

SEQ ID NO: 1043166 - DNA, 22 bp, Artificial Sequence
  chemically synthesized
ttattcttctatttatttaagg

SEQ ID NO: 1043167 - DNA, 22 bp, Artificial Sequence
  chemically synthesized
tttgttttataccttaaataaa

SEQ ID NO: 1043168 - DNA, 22 bp, Artificial Sequence
  chemically synthesized
tttattcttctatttatttaag

SEQ ID NO: 1043169 - DNA, 22 bp, Artificial Sequence
  chemically synthesized
ttttattcttctatttatttaa

SEQ ID NO: 1043170 - DNA, 22 bp, Artificial Sequence
  chemically synthesized
gttttataccttaaataaatag

SEQ ID NO: 1043171 - DNA, 22 bp, Artificial Sequence
  chemically synthesized
ttttataccttaaataaataga

SEQ ID NO: 1043172 - DNA, 22 bp, Artificial Sequence
  chemically synthesized
tataccttaaataaatagaaga

SEQ ID NO: 1043173 - DNA, 22 bp, Artificial Sequence
  chemically synthesized
ataccttaaataaatagaagaa

SEQ ID NO: 1043174 - DNA, 22 bp, Artificial Sequence
  chemically synthesized
taccttaaataaatagaagaat

SEQ ID NO: 1043175 - DNA, 22 bp, Artificial Sequence
  chemically synthesized
aggagtaatttttttattcttc

SEQ ID NO: 1043176 - DNA, 22 bp, Artificial Sequence
  chemically synthesized
aaataaatagaagaataaaaaa

SEQ ID NO: 1043177 - DNA, 22 bp, Artificial Sequence
  chemically synthesized
ttcaggagtaatttttttattc

SEQ ID NO: 1043178 - DNA, 22 bp, Artificial Sequence
  chemically synthesized
aataaatagaagaataaaaaaa

SEQ ID NO: 1043179 - DNA, 22 bp, Artificial Sequence
  chemically synthesized
attcaggagtaatttttttatt

SEQ ID NO: 1043180 - DNA, 22 bp, Artificial Sequence
  chemically synthesized
cttattcaggagtaattttttt

SEQ ID NO: 1043181 - DNA, 22 bp, Artificial Sequence
  chemically synthesized
ttacttattcaggagtaatttt

SEQ ID NO: 1043182 - DNA, 22 bp, Artificial Sequence
  chemically synthesized
gttgttacttattcaggagtaa

SEQ ID NO: 1043183 - DNA, 22 bp, Artificial Sequence
  chemically synthesized
cgaggctagttgttacttattc

SEQ ID NO: 1043184 - DNA, 22 bp, Artificial Sequence
  chemically synthesized
ccgaggctagttgttacttatt

SEQ ID NO: 1043185 - DNA, 22 bp, Artificial Sequence
  chemically synthesized
ctcctgaataagtaacaactag

SEQ ID NO: 1043186 - DNA, 22 bp, Artificial Sequence
  chemically synthesized
ctgaataagtaacaactagcct

SEQ ID NO: 1043187 - DNA, 22 bp, Artificial Sequence
  chemically synthesized
aataagtaacaactagcctcgg

SEQ ID NO: 1043188 - DNA, 22 bp, Artificial Sequence
  chemically synthesized
taagacgggggccatgtgtatt

SEQ ID NO: 1043189 - DNA, 22 bp, Artificial Sequence
  chemically synthesized
gcctcggaaatacacatggccc

SEQ ID NO: 1043190 - DNA, 22 bp, Artificial Sequence
  chemically synthesized
ggaaatacacatggcccccgtc

SEQ ID NO: 1043191 - DNA, 22 bp, Artificial Sequence
  chemically synthesized
agtagaaacattataagacggg

SEQ ID NO: 1043192 - DNA, 22 bp, Artificial Sequence
  chemically synthesized
aaaaatcactaagtagaaacat

SEQ ID NO: 1043193 - DNA, 22 bp, Artificial Sequence
  chemically synthesized
aagttgaaaaatcactaagtag

SEQ ID NO: 1043194 - DNA, 22 bp, Artificial Sequence
  chemically synthesized
ataatgtttctacttagtgatt

SEQ ID NO: 1043195 - DNA, 22 bp, Artificial Sequence
  chemically synthesized
taatgtttctacttagtgattt

SEQ ID NO: 1043196 - DNA, 22 bp, Artificial Sequence
  chemically synthesized
accaccctaaagttgaaaaatc

SEQ ID NO: 1043197 - DNA, 22 bp, Artificial Sequence
  chemically synthesized
tcaccaccctaaagttgaaaaa

SEQ ID NO: 1043198 - DNA, 22 bp, Artificial Sequence
  chemically synthesized
ctacttagtgatttttcaactt

SEQ ID NO: 1043199 - DNA, 22 bp, Artificial Sequence
  chemically synthesized
ctcaccaccctaaagttgaaaa

SEQ ID NO: 1043200 - DNA, 22 bp, Artificial Sequence
  chemically synthesized
tacttagtgatttttcaacttt

SEQ ID NO: 1043201 - DNA, 22 bp, Artificial Sequence
  chemically synthesized
tctcaccaccctaaagttgaaa

SEQ ID NO: 1043202 - DNA, 22 bp, Artificial Sequence
  chemically synthesized
cttagtgatttttcaactttag

SEQ ID NO: 1043203 - DNA, 22 bp, Artificial Sequence
  chemically synthesized
agtgatttttcaactttagggt

SEQ ID NO: 1043204 - DNA, 22 bp, Artificial Sequence
  chemically synthesized
gtgatttttcaactttagggtg

SEQ ID NO: 1043205 - DNA, 22 bp, Artificial Sequence
  chemically synthesized
ttcaactttagggtggtgagaa

SEQ ID NO: 1043206 - DNA, 22 bp, Artificial Sequence
  chemically synthesized
tcaactttagggtggtgagaaa

SEQ ID NO: 1043207 - DNA, 22 bp, Artificial Sequence
  chemically synthesized
caactttagggtggtgagaaag

SEQ ID NO: 1043208 - DNA, 22 bp, Artificial Sequence
  chemically synthesized
aactttagggtggtgagaaagt

SEQ ID NO: 1043209 - DNA, 22 bp, Artificial Sequence
  chemically synthesized
gaatgaatgtatatcactttct

SEQ ID NO: 1043210 - DNA, 22 bp, Artificial Sequence
  chemically synthesized
cgaatgaatgtatatcactttc

SEQ ID NO: 1043211 - DNA, 22 bp, Artificial Sequence
  chemically synthesized
tagggtggtgagaaagtgatat

SEQ ID NO: 1043212 - DNA, 22 bp, Artificial Sequence
  chemically synthesized
agggtggtgagaaagtgatata

SEQ ID NO: 1043213 - DNA, 22 bp, Artificial Sequence
  chemically synthesized
gggtggtgagaaagtgatatac

SEQ ID NO: 1043214 - DNA, 22 bp, Artificial Sequence
  chemically synthesized
aagtatggtttcgaatgaatgt

SEQ ID NO: 1043215 - DNA, 22 bp, Artificial Sequence
  chemically synthesized
tactgaagtatggtttcgaatg

SEQ ID NO: 1043216 - DNA, 22 bp, Artificial Sequence
  chemically synthesized
gtgaatactatactgaagtatg

SEQ ID NO: 1043217 - DNA, 22 bp, Artificial Sequence
  chemically synthesized
agtgaatactatactgaagtat

SEQ ID NO: 1043218 - DNA, 22 bp, Artificial Sequence
  chemically synthesized
attcgaaaccatacttcagtat

SEQ ID NO: 1043219 - DNA, 22 bp, Artificial Sequence
  chemically synthesized
aatttagtgaatactatactga

SEQ ID NO: 1043220 - DNA, 22 bp, Artificial Sequence
  chemically synthesized
gaaaccatacttcagtatagta

SEQ ID NO: 1043221 - DNA, 22 bp, Artificial Sequence
  chemically synthesized
attcaatttagtgaatactata

SEQ ID NO: 1043222 - DNA, 22 bp, Artificial Sequence
  chemically synthesized
aatatctcattcaatttagtga

SEQ ID NO: 1043223 - DNA, 22 bp, Artificial Sequence
  chemically synthesized
cagtatagtattcactaaattg

SEQ ID NO: 1043224 - DNA, 22 bp, Artificial Sequence
  chemically synthesized
agtatagtattcactaaattga

SEQ ID NO: 1043225 - DNA, 22 bp, Artificial Sequence
  chemically synthesized
tagtaaagtgttgaatatctca

SEQ ID NO: 1043226 - DNA, 22 bp, Artificial Sequence
  chemically synthesized
actaaattgaatgagatattca

SEQ ID NO: 1043227 - DNA, 22 bp, Artificial Sequence
  chemically synthesized
atagtaaagtgttgaatatctc

SEQ ID NO: 1043228 - DNA, 22 bp, Artificial Sequence
  chemically synthesized
tatagtaaagtgttgaatatct

SEQ ID NO: 1043229 - DNA, 22 bp, Artificial Sequence
  chemically synthesized
aattgaatgagatattcaacac

SEQ ID NO: 1043230 - DNA, 22 bp, Artificial Sequence
  chemically synthesized
ttttatagtaaagtgttgaata

SEQ ID NO: 1043231 - DNA, 22 bp, Artificial Sequence
  chemically synthesized
aatgagatattcaacactttac

SEQ ID NO: 1043232 - DNA, 22 bp, Artificial Sequence
  chemically synthesized
aacactttactataaaataggt

SEQ ID NO: 1043233 - DNA, 22 bp, Artificial Sequence
  chemically synthesized
tactataaaataggtcttgtgt

SEQ ID NO: 1043234 - DNA, 22 bp, Artificial Sequence
  chemically synthesized
actataaaataggtcttgtgtt

SEQ ID NO: 1043235 - DNA, 22 bp, Artificial Sequence
  chemically synthesized
ctataaaataggtcttgtgttc

SEQ ID NO: 1043236 - DNA, 22 bp, Artificial Sequence
  chemically synthesized
cgcaaagtcatagaacacaaga

SEQ ID NO: 1043237 - DNA, 22 bp, Artificial Sequence
  chemically synthesized
taaaataggtcttgtgttctat

SEQ ID NO: 1043238 - DNA, 22 bp, Artificial Sequence
  chemically synthesized
cagttgcgcaaagtcatagaac

SEQ ID NO: 1043239 - DNA, 22 bp, Artificial Sequence
  chemically synthesized
acctacagttgcgcaaagtcat

SEQ ID NO: 1043240 - DNA, 22 bp, Artificial Sequence
  chemically synthesized
gtgttctatgactttgcgcaac

SEQ ID NO: 1043241 - DNA, 22 bp, Artificial Sequence
  chemically synthesized
tgttaacctacagttgcgcaaa

SEQ ID NO: 1043242 - DNA, 22 bp, Artificial Sequence
  chemically synthesized
tgttctatgactttgcgcaact

SEQ ID NO: 1043243 - DNA, 22 bp, Artificial Sequence
  chemically synthesized
tatgactttgcgcaactgtagg

SEQ ID NO: 1043244 - DNA, 22 bp, Artificial Sequence
  chemically synthesized
tgactttgcgcaactgtaggtt

SEQ ID NO: 1043245 - DNA, 22 bp, Artificial Sequence
  chemically synthesized
aacacctatgttaacctacagt

SEQ ID NO: 1043246 - DNA, 22 bp, Artificial Sequence
  chemically synthesized
tgaacacctatgttaacctaca

SEQ ID NO: 1043247 - DNA, 22 bp, Artificial Sequence
  chemically synthesized
tgcgcaactgtaggttaacata

SEQ ID NO: 1043248 - DNA, 22 bp, Artificial Sequence
  chemically synthesized
gcgcaactgtaggttaacatag

SEQ ID NO: 1043249 - DNA, 22 bp, Artificial Sequence
  chemically synthesized
cgcaactgtaggttaacatagg

SEQ ID NO: 1043250 - DNA, 22 bp, Artificial Sequence
  chemically synthesized
aacatgctctgaacacctatgt

SEQ ID NO: 1043251 - DNA, 22 bp, Artificial Sequence
  chemically synthesized
aaacatgctctgaacacctatg

SEQ ID NO: 1043252 - DNA, 22 bp, Artificial Sequence
  chemically synthesized
taggttaacataggtgttcaga

SEQ ID NO: 1043253 - DNA, 22 bp, Artificial Sequence
  chemically synthesized
ccttaaacatgctctgaacacc

SEQ ID NO: 1043254 - DNA, 22 bp, Artificial Sequence
  chemically synthesized
accttaaacatgctctgaacac

SEQ ID NO: 1043255 - DNA, 22 bp, Artificial Sequence
  chemically synthesized
gcttaccttaaacatgctctga

SEQ ID NO: 1043256 - DNA, 22 bp, Artificial Sequence
  chemically synthesized
acataggtgttcagagcatgtt

SEQ ID NO: 1043257 - DNA, 22 bp, Artificial Sequence
  chemically synthesized
gcctagcttaccttaaacatgc

SEQ ID NO: 1043258 - DNA, 22 bp, Artificial Sequence
  chemically synthesized
agcctagcttaccttaaacatg

SEQ ID NO: 1043259 - DNA, 22 bp, Artificial Sequence
  chemically synthesized
agagcatgtttaaggtaagcta

SEQ ID NO: 1043260 - DNA, 22 bp, Artificial Sequence
  chemically synthesized
aaggtaagctaggctaaaccat

SEQ ID NO: 1043261 - DNA, 22 bp, Artificial Sequence
  chemically synthesized
aggtaagctaggctaaaccatg

SEQ ID NO: 1043262 - DNA, 22 bp, Artificial Sequence
  chemically synthesized
acccaccaaatatcatggttta

SEQ ID NO: 1043263 - DNA, 22 bp, Artificial Sequence
  chemically synthesized
aacccaccaaatatcatggttt

SEQ ID NO: 1043264 - DNA, 22 bp, Artificial Sequence
  chemically synthesized
ggctaaaccatgatatttggtg

SEQ ID NO: 1043265 - DNA, 22 bp, Artificial Sequence
  chemically synthesized
aatacacttaacccaccaaata

SEQ ID NO: 1043266 - DNA, 22 bp, Artificial Sequence
  chemically synthesized
aaccatgatatttggtgggtta

SEQ ID NO: 1043267 - DNA, 22 bp, Artificial Sequence
  chemically synthesized
ggtgggttaagtgtattgaatg

SEQ ID NO: 1043268 - DNA, 22 bp, Artificial Sequence
  chemically synthesized
tatgcggaaatgcattcaatac

SEQ ID NO: 1043269 - DNA, 22 bp, Artificial Sequence
  chemically synthesized
gtgggttaagtgtattgaatgc

SEQ ID NO: 1043270 - DNA, 22 bp, Artificial Sequence
  chemically synthesized
gtatgcggaaatgcattcaata

SEQ ID NO: 1043271 - DNA, 22 bp, Artificial Sequence
  chemically synthesized
tgtatgcggaaatgcattcaat

SEQ ID NO: 1043272 - DNA, 22 bp, Artificial Sequence
  chemically synthesized
agtgtattgaatgcatttccgc

SEQ ID NO: 1043273 - DNA, 22 bp, Artificial Sequence
  chemically synthesized
agaattttgtatgcggaaatgc

SEQ ID NO: 1043274 - DNA, 22 bp, Artificial Sequence
  chemically synthesized
taagttgagaattttgtatgcg

SEQ ID NO: 1043275 - DNA, 22 bp, Artificial Sequence
  chemically synthesized
aatgcatttccgcatacaaaat

SEQ ID NO: 1043276 - DNA, 22 bp, Artificial Sequence
  chemically synthesized
ccgcatacaaaattctcaactt

SEQ ID NO: 1043277 - DNA, 22 bp, Artificial Sequence
  chemically synthesized
cgcatacaaaattctcaactta

SEQ ID NO: 1043278 - DNA, 22 bp, Artificial Sequence
  chemically synthesized
tatccagataaacccattgtaa

SEQ ID NO: 1043279 - DNA, 22 bp, Artificial Sequence
  chemically synthesized
tcaacttacaatgggtttatct

SEQ ID NO: 1043280 - DNA, 22 bp, Artificial Sequence
  chemically synthesized
aacttacaatgggtttatctgg

SEQ ID NO: 1043281 - DNA, 22 bp, Artificial Sequence
  chemically synthesized
tgatggggttatatccagataa

SEQ ID NO: 1043282 - DNA, 22 bp, Artificial Sequence
  chemically synthesized
gtgatggggttatatccagata

SEQ ID NO: 1043283 - DNA, 22 bp, Artificial Sequence
  chemically synthesized
acaatgggtttatctggatata

SEQ ID NO: 1043284 - DNA, 22 bp, Artificial Sequence
  chemically synthesized
caatgggtttatctggatataa

SEQ ID NO: 1043285 - DNA, 22 bp, Artificial Sequence
  chemically synthesized
acttgtgatggggttatatcca

SEQ ID NO: 1043286 - DNA, 22 bp, Artificial Sequence
  chemically synthesized
gacttgtgatggggttatatcc

SEQ ID NO: 1043287 - DNA, 22 bp, Artificial Sequence
  chemically synthesized
cttgacttgtgatggggttata

SEQ ID NO: 1043288 - DNA, 22 bp, Artificial Sequence
  chemically synthesized
atctggatataaccccatcaca

SEQ ID NO: 1043289 - DNA, 22 bp, Artificial Sequence
  chemically synthesized
tctggatataaccccatcacaa

SEQ ID NO: 1043290 - DNA, 22 bp, Artificial Sequence
  chemically synthesized
gatataaccccatcacaagtca

SEQ ID NO: 1043291 - DNA, 22 bp, Artificial Sequence
  chemically synthesized
tacagaatgttccttgacttgt

SEQ ID NO: 1043292 - DNA, 22 bp, Artificial Sequence
  chemically synthesized
ttgtacagaatgttccttgact

SEQ ID NO: 1043293 - DNA, 22 bp, Artificial Sequence
  chemically synthesized
tattgtacagaatgttccttga

SEQ ID NO: 1043294 - DNA, 22 bp, Artificial Sequence
  chemically synthesized
ctattgtacagaatgttccttg

SEQ ID NO: 1043295 - DNA, 22 bp, Artificial Sequence
  chemically synthesized
ttctattgtacagaatgttcct

SEQ ID NO: 1043296 - DNA, 22 bp, Artificial Sequence
  chemically synthesized
atcatattcttctattgtacag

SEQ ID NO: 1043297 - DNA, 22 bp, Artificial Sequence
  chemically synthesized
gatcatattcttctattgtaca

SEQ ID NO: 1043298 - DNA, 22 bp, Artificial Sequence
  chemically synthesized
tgatcatattcttctattgtac

SEQ ID NO: 1043299 - DNA, 22 bp, Artificial Sequence
  chemically synthesized
ttgatcatattcttctattgta

SEQ ID NO: 1043300 - DNA, 22 bp, Artificial Sequence
  chemically synthesized
caaacttttgatcatattcttc

SEQ ID NO: 1043301 - DNA, 22 bp, Artificial Sequence
  chemically synthesized
acaaacttttgatcatattctt

SEQ ID NO: 1043302 - DNA, 22 bp, Artificial Sequence
  chemically synthesized
tgtacaatagaagaatatgatc

SEQ ID NO: 1043303 - DNA, 22 bp, Artificial Sequence
  chemically synthesized
tacaatagaagaatatgatcaa

SEQ ID NO: 1043304 - DNA, 22 bp, Artificial Sequence
  chemically synthesized
gaggatcttacaaacttttgat

SEQ ID NO: 1043305 - DNA, 22 bp, Artificial Sequence
  chemically synthesized
agaggatcttacaaacttttga

SEQ ID NO: 1043306 - DNA, 22 bp, Artificial Sequence
  chemically synthesized
cttagaggatcttacaaacttt

SEQ ID NO: 1043307 - DNA, 22 bp, Artificial Sequence
  chemically synthesized
ccttagaggatcttacaaactt

SEQ ID NO: 1043308 - DNA, 22 bp, Artificial Sequence
  chemically synthesized
acaaaatcttccttagaggatc

SEQ ID NO: 1043309 - DNA, 22 bp, Artificial Sequence
  chemically synthesized
gacaaaatcttccttagaggat

SEQ ID NO: 1043310 - DNA, 22 bp, Artificial Sequence
  chemically synthesized
tgacaaaatcttccttagagga

SEQ ID NO: 1043311 - DNA, 22 bp, Artificial Sequence
  chemically synthesized
ttgacaaaatcttccttagagg

SEQ ID NO: 1043312 - DNA, 22 bp, Artificial Sequence
  chemically synthesized
cttttgacaaaatcttccttag

SEQ ID NO: 1043313 - DNA, 22 bp, Artificial Sequence
  chemically synthesized
gcttttgacaaaatcttcctta

SEQ ID NO: 1043314 - DNA, 22 bp, Artificial Sequence
  chemically synthesized
gtaagatcctctaaggaagatt

SEQ ID NO: 1043315 - DNA, 22 bp, Artificial Sequence
  chemically synthesized
taagatcctctaaggaagattt

SEQ ID NO: 1043316 - DNA, 22 bp, Artificial Sequence
  chemically synthesized
agccacgtttgcttttgacaaa

SEQ ID NO: 1043317 - DNA, 22 bp, Artificial Sequence
  chemically synthesized
taaggaagattttgtcaaaagc

SEQ ID NO: 1043318 - DNA, 22 bp, Artificial Sequence
  chemically synthesized
aggaagattttgtcaaaagcaa

SEQ ID NO: 1043319 - DNA, 22 bp, Artificial Sequence
  chemically synthesized
tgtcaaaagcaaacgtggctta

SEQ ID NO: 1043320 - DNA, 22 bp, Artificial Sequence
  chemically synthesized
gtcaaaagcaaacgtggcttag

SEQ ID NO: 1043321 - DNA, 22 bp, Artificial Sequence
  chemically synthesized
tcaaaagcaaacgtggcttagc

SEQ ID NO: 1043322 - DNA, 22 bp, Artificial Sequence
  chemically synthesized
aaataagagaatacatacaagc

SEQ ID NO: 1043323 - DNA, 22 bp, Artificial Sequence
  chemically synthesized
aaaataagagaatacatacaag

SEQ ID NO: 1043324 - DNA, 22 bp, Artificial Sequence
  chemically synthesized
taaaataagagaatacatacaa

SEQ ID NO: 1043325 - DNA, 22 bp, Artificial Sequence
  chemically synthesized
agcttgtatgtattctcttatt

SEQ ID NO: 1043326 - DNA, 22 bp, Artificial Sequence
  chemically synthesized
aaaaaactttaaaataagagaa

SEQ ID NO: 1043327 - DNA, 22 bp, Artificial Sequence
  chemically synthesized
gcttgtatgtattctcttattt

SEQ ID NO: 1043328 - DNA, 22 bp, Artificial Sequence
  chemically synthesized
gtatgtattctcttattttaaa

SEQ ID NO: 1043329 - DNA, 22 bp, Artificial Sequence
  chemically synthesized
tatgtattctcttattttaaag

SEQ ID NO: 1043330 - DNA, 22 bp, Artificial Sequence
  chemically synthesized
aagctaaaaaaactttaaaata

SEQ ID NO: 1043331 - DNA, 22 bp, Artificial Sequence
  chemically synthesized
taaagctaaaaaaactttaaaa

SEQ ID NO: 1043332 - DNA, 22 bp, Artificial Sequence
  chemically synthesized
tcttattttaaagtttttttag

SEQ ID NO: 1043333 - DNA, 22 bp, Artificial Sequence
  chemically synthesized
ttattttaaagtttttttagct

SEQ ID NO: 1043334 - DNA, 22 bp, Artificial Sequence
  chemically synthesized
attttaaagtttttttagcttt

SEQ ID NO: 1043335 - DNA, 22 bp, Artificial Sequence
  chemically synthesized
ttttaaagtttttttagcttta

SEQ ID NO: 1043336 - DNA, 22 bp, Artificial Sequence
  chemically synthesized
taaagtttttttagctttagaa

SEQ ID NO: 1043337 - DNA, 22 bp, Artificial Sequence
  chemically synthesized
aaagtttttttagctttagaat

SEQ ID NO: 1043338 - DNA, 22 bp, Artificial Sequence
  chemically synthesized
aagtttttttagctttagaata

SEQ ID NO: 1043339 - DNA, 22 bp, Artificial Sequence
  chemically synthesized
cagatgtggcaaatattctaaa

SEQ ID NO: 1043340 - DNA, 22 bp, Artificial Sequence
  chemically synthesized
ccagatgtggcaaatattctaa

SEQ ID NO: 1043341 - DNA, 22 bp, Artificial Sequence
  chemically synthesized
tttccagatgtggcaaatattc

SEQ ID NO: 1043342 - DNA, 22 bp, Artificial Sequence
  chemically synthesized
ttttagctttagaatatttgcc

SEQ ID NO: 1043343 - DNA, 22 bp, Artificial Sequence
  chemically synthesized
tttagctttagaatatttgcca

SEQ ID NO: 1043344 - DNA, 22 bp, Artificial Sequence
  chemically synthesized
ttagctttagaatatttgccac

SEQ ID NO: 1043345 - DNA, 22 bp, Artificial Sequence
  chemically synthesized
tagctttagaatatttgccaca

SEQ ID NO: 1043346 - DNA, 22 bp, Artificial Sequence
  chemically synthesized
agctttagaatatttgccacat

SEQ ID NO: 1043347 - DNA, 22 bp, Artificial Sequence
  chemically synthesized
gctttagaatatttgccacatc

SEQ ID NO: 1043348 - DNA, 22 bp, Artificial Sequence
  chemically synthesized
tagaatatttgccacatctgga

SEQ ID NO: 1043349 - DNA, 22 bp, Artificial Sequence
  chemically synthesized
agaatatttgccacatctggaa

SEQ ID NO: 1043350 - DNA, 22 bp, Artificial Sequence
  chemically synthesized
gaatatttgccacatctggaaa

SEQ ID NO: 1043351 - DNA, 22 bp, Artificial Sequence
  chemically synthesized
gccacatctggaaataacttta

SEQ ID NO: 1043352 - DNA, 22 bp, Artificial Sequence
  chemically synthesized
ccacatctggaaataactttac

SEQ ID NO: 1043353 - DNA, 22 bp, Artificial Sequence
  chemically synthesized
accacataaaatatacgtaaag

SEQ ID NO: 1043354 - DNA, 22 bp, Artificial Sequence
  chemically synthesized
gaaataactttacgtatatttt

SEQ ID NO: 1043355 - DNA, 22 bp, Artificial Sequence
  chemically synthesized
taaataaaatgttaaccacata

SEQ ID NO: 1043356 - DNA, 22 bp, Artificial Sequence
  chemically synthesized
tacgtatattttatgtggttaa

SEQ ID NO: 1043357 - DNA, 22 bp, Artificial Sequence
  chemically synthesized
acgtatattttatgtggttaac

SEQ ID NO: 1043358 - DNA, 22 bp, Artificial Sequence
  chemically synthesized
cgtatattttatgtggttaaca

SEQ ID NO: 1043359 - DNA, 22 bp, Artificial Sequence
  chemically synthesized
aaaaactgtaaataaaatgtta

SEQ ID NO: 1043360 - DNA, 22 bp, Artificial Sequence
  chemically synthesized
aaaaaactgtaaataaaatgtt

SEQ ID NO: 1043361 - DNA, 22 bp, Artificial Sequence
  chemically synthesized
tatgtggttaacattttattta

SEQ ID NO: 1043362 - DNA, 22 bp, Artificial Sequence
  chemically synthesized
atgtggttaacattttatttac

SEQ ID NO: 1043363 - DNA, 22 bp, Artificial Sequence
  chemically synthesized
tgtggttaacattttatttaca

SEQ ID NO: 1043364 - DNA, 22 bp, Artificial Sequence
  chemically synthesized
tatcttaaaaaactgtaaataa

SEQ ID NO: 1043365 - DNA, 22 bp, Artificial Sequence
  chemically synthesized
atatcttaaaaaactgtaaata

SEQ ID NO: 1043366 - DNA, 22 bp, Artificial Sequence
  chemically synthesized
acattttatttacagtttttta

SEQ ID NO: 1043367 - DNA, 22 bp, Artificial Sequence
  chemically synthesized
catatttatatcttaaaaaact

SEQ ID NO: 1043368 - DNA, 22 bp, Artificial Sequence
  chemically synthesized
tatttacagttttttaagatat

SEQ ID NO: 1043369 - DNA, 22 bp, Artificial Sequence
  chemically synthesized
atttacagttttttaagatata

SEQ ID NO: 1043370 - DNA, 22 bp, Artificial Sequence
  chemically synthesized
tttacagttttttaagatataa

SEQ ID NO: 1043371 - DNA, 22 bp, Artificial Sequence
  chemically synthesized
taaaattgcatatttatatctt

SEQ ID NO: 1043372 - DNA, 22 bp, Artificial Sequence
  chemically synthesized
acagttttttaagatataaata

SEQ ID NO: 1043373 - DNA, 22 bp, Artificial Sequence
  chemically synthesized
cagttttttaagatataaatat

SEQ ID NO: 1043374 - DNA, 22 bp, Artificial Sequence
  chemically synthesized
aacattataaaattgcatattt

SEQ ID NO: 1043375 - DNA, 22 bp, Artificial Sequence
  chemically synthesized
tttaagatataaatatgcaatt

SEQ ID NO: 1043376 - DNA, 22 bp, Artificial Sequence
  chemically synthesized
ttaagatataaatatgcaattt

SEQ ID NO: 1043377 - DNA, 22 bp, Artificial Sequence
  chemically synthesized
taagatataaatatgcaatttt

SEQ ID NO: 1043378 - DNA, 22 bp, Artificial Sequence
  chemically synthesized
aagatataaatatgcaatttta

SEQ ID NO: 1043379 - DNA, 22 bp, Artificial Sequence
  chemically synthesized
agatataaatatgcaattttat

SEQ ID NO: 1043380 - DNA, 22 bp, Artificial Sequence
  chemically synthesized
agaatgtgttaaacattataaa

SEQ ID NO: 1043381 - DNA, 22 bp, Artificial Sequence
  chemically synthesized
aagaatgtgttaaacattataa

SEQ ID NO: 1043382 - DNA, 22 bp, Artificial Sequence
  chemically synthesized
taagaatgtgttaaacattata

SEQ ID NO: 1043383 - DNA, 22 bp, Artificial Sequence
  chemically synthesized
cctttaagaatgtgttaaacat

SEQ ID NO: 1043384 - DNA, 22 bp, Artificial Sequence
  chemically synthesized
tataatgtttaacacattctta

SEQ ID NO: 1043385 - DNA, 22 bp, Artificial Sequence
  chemically synthesized
ataatgtttaacacattcttaa

SEQ ID NO: 1043386 - DNA, 22 bp, Artificial Sequence
  chemically synthesized
taatgtttaacacattcttaaa

SEQ ID NO: 1043387 - DNA, 22 bp, Artificial Sequence
  chemically synthesized
aaaacaaattacctttaagaat

SEQ ID NO: 1043388 - DNA, 22 bp, Artificial Sequence
  chemically synthesized
aacacattcttaaaggtaattt

SEQ ID NO: 1043389 - DNA, 22 bp, Artificial Sequence
  chemically synthesized
acacattcttaaaggtaatttg

SEQ ID NO: 1043390 - DNA, 22 bp, Artificial Sequence
  chemically synthesized
ttaaaggtaatttgtttttagg

SEQ ID NO: 1043391 - DNA, 22 bp, Artificial Sequence
  chemically synthesized
cacgtaaagtatcctaaaaaca

SEQ ID NO: 1043392 - DNA, 22 bp, Artificial Sequence
  chemically synthesized
ccacgtaaagtatcctaaaaac

SEQ ID NO: 1043393 - DNA, 22 bp, Artificial Sequence
  chemically synthesized
aaaggtaatttgtttttaggat

SEQ ID NO: 1043394 - DNA, 22 bp, Artificial Sequence
  chemically synthesized
aaggtaatttgtttttaggata

SEQ ID NO: 1043395 - DNA, 22 bp, Artificial Sequence
  chemically synthesized
taaatttccacgtaaagtatcc

SEQ ID NO: 1043396 - DNA, 22 bp, Artificial Sequence
  chemically synthesized
gtttttaggatactttacgtgg

SEQ ID NO: 1043397 - DNA, 22 bp, Artificial Sequence
  chemically synthesized
tttttaggatactttacgtgga

SEQ ID NO: 1043398 - DNA, 22 bp, Artificial Sequence
  chemically synthesized
ttaggatactttacgtggaaat

SEQ ID NO: 1043399 - DNA, 22 bp, Artificial Sequence
  chemically synthesized
agaaagttataaatttccacgt

SEQ ID NO: 1043400 - DNA, 22 bp, Artificial Sequence
  chemically synthesized
taggatactttacgtggaaatt

SEQ ID NO: 1043401 - DNA, 22 bp, Artificial Sequence
  chemically synthesized
aggatactttacgtggaaattt

SEQ ID NO: 1043402 - DNA, 22 bp, Artificial Sequence
  chemically synthesized
taagaaagttataaatttccac

SEQ ID NO: 1043403 - DNA, 22 bp, Artificial Sequence
  chemically synthesized
ggatactttacgtggaaattta

SEQ ID NO: 1043404 - DNA, 22 bp, Artificial Sequence
  chemically synthesized
tacgtggaaatttataactttc

SEQ ID NO: 1043405 - DNA, 22 bp, Artificial Sequence
  chemically synthesized
acgtggaaatttataactttct

SEQ ID NO: 1043406 - DNA, 22 bp, Artificial Sequence
  chemically synthesized
cgtggaaatttataactttctt

SEQ ID NO: 1043407 - DNA, 22 bp, Artificial Sequence
  chemically synthesized
atcaaacatcccaaattctaag

SEQ ID NO: 1043408 - DNA, 22 bp, Artificial Sequence
  chemically synthesized
catcaaacatcccaaattctaa

SEQ ID NO: 1043409 - DNA, 22 bp, Artificial Sequence
  chemically synthesized
ataactttcttagaatttggga

SEQ ID NO: 1043410 - DNA, 22 bp, Artificial Sequence
  chemically synthesized
cttcatcaaacatcccaaattc

SEQ ID NO: 1043411 - DNA, 22 bp, Artificial Sequence
  chemically synthesized
taactttcttagaatttgggat

SEQ ID NO: 1043412 - DNA, 22 bp, Artificial Sequence
  chemically synthesized
tcttagaatttgggatgtttga

SEQ ID NO: 1043413 - DNA, 22 bp, Artificial Sequence
  chemically synthesized
cttagaatttgggatgtttgat

SEQ ID NO: 1043414 - DNA, 22 bp, Artificial Sequence
  chemically synthesized
ttagaatttgggatgtttgatg

SEQ ID NO: 1043415 - DNA, 22 bp, Artificial Sequence
  chemically synthesized
agaatttgggatgtttgatgaa

SEQ ID NO: 1043416 - DNA, 22 bp, Artificial Sequence
  chemically synthesized
gaatttgggatgtttgatgaag

SEQ ID NO: 1043417 - DNA, 22 bp, Artificial Sequence
  chemically synthesized
taaaatgcatattgcttcatca

SEQ ID NO: 1043418 - DNA, 22 bp, Artificial Sequence
  chemically synthesized
gtaaaatgcatattgcttcatc

SEQ ID NO: 1043419 - DNA, 22 bp, Artificial Sequence
  chemically synthesized
gggatgtttgatgaagcaatat

SEQ ID NO: 1043420 - DNA, 22 bp, Artificial Sequence
  chemically synthesized
ggatgtttgatgaagcaatatg

SEQ ID NO: 1043421 - DNA, 22 bp, Artificial Sequence
  chemically synthesized
aagatttgtaaaatgcatattg

SEQ ID NO: 1043422 - DNA, 22 bp, Artificial Sequence
  chemically synthesized
caagatttgtaaaatgcatatt

SEQ ID NO: 1043423 - DNA, 22 bp, Artificial Sequence
  chemically synthesized
gatgaagcaatatgcattttac

SEQ ID NO: 1043424 - DNA, 22 bp, Artificial Sequence
  chemically synthesized
atgaagcaatatgcattttaca

SEQ ID NO: 1043425 - DNA, 22 bp, Artificial Sequence
  chemically synthesized
tataaatttcaagatttgtaaa

SEQ ID NO: 1043426 - DNA, 22 bp, Artificial Sequence
  chemically synthesized
aaatgtataattatataaattt

SEQ ID NO: 1043427 - DNA, 22 bp, Artificial Sequence
  chemically synthesized
tacaaatcttgaaatttatata

SEQ ID NO: 1043428 - DNA, 22 bp, Artificial Sequence
  chemically synthesized
acaaatcttgaaatttatataa

SEQ ID NO: 1043429 - DNA, 22 bp, Artificial Sequence
  chemically synthesized
caaatcttgaaatttatataat

SEQ ID NO: 1043430 - DNA, 22 bp, Artificial Sequence
  chemically synthesized
ttaaaatgtataattatataaa

SEQ ID NO: 1043431 - DNA, 22 bp, Artificial Sequence
  chemically synthesized
ctgttaaaatgtataattatat

SEQ ID NO: 1043432 - DNA, 22 bp, Artificial Sequence
  chemically synthesized
gaaatttatataattatacatt

SEQ ID NO: 1043433 - DNA, 22 bp, Artificial Sequence
  chemically synthesized
aaatttatataattatacattt

SEQ ID NO: 1043434 - DNA, 22 bp, Artificial Sequence
  chemically synthesized
atataattatacattttaacag

SEQ ID NO: 1043435 - DNA, 22 bp, Artificial Sequence
  chemically synthesized
tataattatacattttaacagg

SEQ ID NO: 1043436 - DNA, 22 bp, Artificial Sequence
  chemically synthesized
tgtaggaaaattcctgttaaaa

SEQ ID NO: 1043437 - DNA, 22 bp, Artificial Sequence
  chemically synthesized
tacattttaacaggaattttcc

SEQ ID NO: 1043438 - DNA, 22 bp, Artificial Sequence
  chemically synthesized
taacaggaattttcctacacag

SEQ ID NO: 1043439 - DNA, 22 bp, Artificial Sequence
  chemically synthesized
aacaggaattttcctacacagt

SEQ ID NO: 1043440 - DNA, 22 bp, Artificial Sequence
  chemically synthesized
acaggaattttcctacacagtc

SEQ ID NO: 1043441 - DNA, 22 bp, Artificial Sequence
  chemically synthesized
tcctacacagtcgtacatgatt

SEQ ID NO: 1043442 - DNA, 22 bp, Artificial Sequence
  chemically synthesized
cctacacagtcgtacatgattt

SEQ ID NO: 1043443 - DNA, 22 bp, Artificial Sequence
  chemically synthesized
ctacacagtcgtacatgatttc

SEQ ID NO: 1043444 - DNA, 22 bp, Artificial Sequence
  chemically synthesized
tgaagatacagtgaaatcatgt

SEQ ID NO: 1043445 - DNA, 22 bp, Artificial Sequence
  chemically synthesized
gtgaagatacagtgaaatcatg

SEQ ID NO: 1043446 - DNA, 22 bp, Artificial Sequence
  chemically synthesized
cacagtcgtacatgatttcact

SEQ ID NO: 1043447 - DNA, 22 bp, Artificial Sequence
  chemically synthesized
ttgtgaagatacagtgaaatca

SEQ ID NO: 1043448 - DNA, 22 bp, Artificial Sequence
  chemically synthesized
tactcttgtgaagatacagtga

SEQ ID NO: 1043449 - DNA, 22 bp, Artificial Sequence
  chemically synthesized
aactgtactcttgtgaagatac

SEQ ID NO: 1043450 - DNA, 22 bp, Artificial Sequence
  chemically synthesized
ctcaactgtactcttgtgaaga

SEQ ID NO: 1043451 - DNA, 22 bp, Artificial Sequence
  chemically synthesized
cctactcaactgtactcttgtg

SEQ ID NO: 1043452 - DNA, 22 bp, Artificial Sequence
  chemically synthesized
cactgtatcttcacaagagtac

SEQ ID NO: 1043453 - DNA, 22 bp, Artificial Sequence
  chemically synthesized
actgtatcttcacaagagtaca

SEQ ID NO: 1043454 - DNA, 22 bp, Artificial Sequence
  chemically synthesized
tatcttcacaagagtacagttg

SEQ ID NO: 1043455 - DNA, 22 bp, Artificial Sequence
  chemically synthesized
cccctgcctactcaactgtact

SEQ ID NO: 1043456 - DNA, 22 bp, Artificial Sequence
  chemically synthesized
cacaagagtacagttgagtagg

SEQ ID NO: 1043457 - DNA, 22 bp, Artificial Sequence
  chemically synthesized
acaagagtacagttgagtaggc

SEQ ID NO: 1043458 - DNA, 22 bp, Artificial Sequence
  chemically synthesized
aatcagtgataataactgcccc

SEQ ID NO: 1043459 - DNA, 22 bp, Artificial Sequence
  chemically synthesized
agtaggcaggggcagttattat

SEQ ID NO: 1043460 - DNA, 22 bp, Artificial Sequence
  chemically synthesized
aaattaaatcagtgataataac

SEQ ID NO: 1043461 - DNA, 22 bp, Artificial Sequence
  chemically synthesized
acgttgaaattaaatcagtgat

SEQ ID NO: 1043462 - DNA, 22 bp, Artificial Sequence
  chemically synthesized
aacgttgaaattaaatcagtga

SEQ ID NO: 1043463 - DNA, 22 bp, Artificial Sequence
  chemically synthesized
taacgttgaaattaaatcagtg

SEQ ID NO: 1043464 - DNA, 22 bp, Artificial Sequence
  chemically synthesized
ttaacgttgaaattaaatcagt

SEQ ID NO: 1043465 - DNA, 22 bp, Artificial Sequence
  chemically synthesized
tttaacgttgaaattaaatcag

SEQ ID NO: 1043466 - DNA, 22 bp, Artificial Sequence
  chemically synthesized
ttttttaacgttgaaattaaat

SEQ ID NO: 1043467 - DNA, 22 bp, Artificial Sequence
  chemically synthesized
ttatcactgatttaatttcaac

SEQ ID NO: 1043468 - DNA, 22 bp, Artificial Sequence
  chemically synthesized
tcactgatttaatttcaacgtt

SEQ ID NO: 1043469 - DNA, 22 bp, Artificial Sequence
  chemically synthesized
ggcctgttttttaacgttgaaa

SEQ ID NO: 1043470 - DNA, 22 bp, Artificial Sequence
  chemically synthesized
aggcctgttttttaacgttgaa

SEQ ID NO: 1043471 - DNA, 22 bp, Artificial Sequence
  chemically synthesized
atttaatttcaacgttaaaaaa

SEQ ID NO: 1043472 - DNA, 22 bp, Artificial Sequence
  chemically synthesized
aatttcaacgttaaaaaacagg

SEQ ID NO: 1043473 - DNA, 22 bp, Artificial Sequence
  chemically synthesized
atttcaacgttaaaaaacaggc

SEQ ID NO: 1043474 - DNA, 22 bp, Artificial Sequence
  chemically synthesized
caacgttaaaaaacaggcctaa

SEQ ID NO: 1043475 - DNA, 22 bp, Artificial Sequence
  chemically synthesized
aacgttaaaaaacaggcctaaa

SEQ ID NO: 1043476 - DNA, 22 bp, Artificial Sequence
  chemically synthesized
ggcaagtaacataagatattta

SEQ ID NO: 1043477 - DNA, 22 bp, Artificial Sequence
  chemically synthesized
aaaaacaggcctaaatatctta

SEQ ID NO: 1043478 - DNA, 22 bp, Artificial Sequence
  chemically synthesized
gggcaagtaacataagatattt

SEQ ID NO: 1043479 - DNA, 22 bp, Artificial Sequence
  chemically synthesized
tacccttgggcaagtaacataa

SEQ ID NO: 1043480 - DNA, 22 bp, Artificial Sequence
  chemically synthesized
aatatcttatgttacttgccca

SEQ ID NO: 1043481 - DNA, 22 bp, Artificial Sequence
  chemically synthesized
atagttgtacccttgggcaagt

SEQ ID NO: 1043482 - DNA, 22 bp, Artificial Sequence
  chemically synthesized
ttgatagttgtacccttgggca

SEQ ID NO: 1043483 - DNA, 22 bp, Artificial Sequence
  chemically synthesized
atgttacttgcccaagggtaca

SEQ ID NO: 1043484 - DNA, 22 bp, Artificial Sequence
  chemically synthesized
attgttgatagttgtacccttg

SEQ ID NO: 1043485 - DNA, 22 bp, Artificial Sequence
  chemically synthesized
tgttacttgcccaagggtacaa

SEQ ID NO: 1043486 - DNA, 22 bp, Artificial Sequence
  chemically synthesized
acctgattgttgatagttgtac

SEQ ID NO: 1043487 - DNA, 22 bp, Artificial Sequence
  chemically synthesized
cttgcccaagggtacaactatc

SEQ ID NO: 1043488 - DNA, 22 bp, Artificial Sequence
  chemically synthesized
aacctgattgttgatagttgta

SEQ ID NO: 1043489 - DNA, 22 bp, Artificial Sequence
  chemically synthesized
gcccaagggtacaactatcaac

SEQ ID NO: 1043490 - DNA, 22 bp, Artificial Sequence
  chemically synthesized
cccaagggtacaactatcaaca

SEQ ID NO: 1043491 - DNA, 22 bp, Artificial Sequence
  chemically synthesized
gaaagatttaacctgattgttg

SEQ ID NO: 1043492 - DNA, 22 bp, Artificial Sequence
  chemically synthesized
agaaagatttaacctgattgtt

SEQ ID NO: 1043493 - DNA, 22 bp, Artificial Sequence
  chemically synthesized
aaaagcttagaaagatttaacc

SEQ ID NO: 1043494 - DNA, 22 bp, Artificial Sequence
  chemically synthesized
tcaacaatcaggttaaatcttt

SEQ ID NO: 1043495 - DNA, 22 bp, Artificial Sequence
  chemically synthesized
gaacctgaaaagcttagaaaga

SEQ ID NO: 1043496 - DNA, 22 bp, Artificial Sequence
  chemically synthesized
tattggaacctgaaaagcttag

SEQ ID NO: 1043497 - DNA, 22 bp, Artificial Sequence
  chemically synthesized
aatctttctaagcttttcaggt

SEQ ID NO: 1043498 - DNA, 22 bp, Artificial Sequence
  chemically synthesized
tctaagcttttcaggttccaat

SEQ ID NO: 1043499 - DNA, 22 bp, Artificial Sequence
  chemically synthesized
gcaaagtactgtattggaacct

SEQ ID NO: 1043500 - DNA, 22 bp, Artificial Sequence
  chemically synthesized
ctaagcttttcaggttccaata

SEQ ID NO: 1043501 - DNA, 22 bp, Artificial Sequence
  chemically synthesized
agcaaagtactgtattggaacc

SEQ ID NO: 1043502 - DNA, 22 bp, Artificial Sequence
  chemically synthesized
taagcttttcaggttccaatac

SEQ ID NO: 1043503 - DNA, 22 bp, Artificial Sequence
  chemically synthesized
agcttttcaggttccaatacag

SEQ ID NO: 1043504 - DNA, 22 bp, Artificial Sequence
  chemically synthesized
ttcaggttccaatacagtactt

SEQ ID NO: 1043505 - DNA, 22 bp, Artificial Sequence
  chemically synthesized
tcaggttccaatacagtacttt

SEQ ID NO: 1043506 - DNA, 22 bp, Artificial Sequence
  chemically synthesized
caggttccaatacagtactttg

SEQ ID NO: 1043507 - DNA, 22 bp, Artificial Sequence
  chemically synthesized
aggttccaatacagtactttgc

SEQ ID NO: 1043508 - DNA, 22 bp, Artificial Sequence
  chemically synthesized
caatacagtactttgctaaact

SEQ ID NO: 1043509 - DNA, 22 bp, Artificial Sequence
  chemically synthesized
tgataagcagtagagtagagag

SEQ ID NO: 1043510 - DNA, 22 bp, Artificial Sequence
  chemically synthesized
tgctaaactctctactctactg

SEQ ID NO: 1043511 - DNA, 22 bp, Artificial Sequence
  chemically synthesized
gctaaactctctactctactgc

SEQ ID NO: 1043512 - DNA, 22 bp, Artificial Sequence
  chemically synthesized
ctaaactctctactctactgct

SEQ ID NO: 1043513 - DNA, 22 bp, Artificial Sequence
  chemically synthesized
tgtggttatgataagcagtaga

SEQ ID NO: 1043514 - DNA, 22 bp, Artificial Sequence
  chemically synthesized
aactctctactctactgcttat

SEQ ID NO: 1043515 - DNA, 22 bp, Artificial Sequence
  chemically synthesized
attatgtggttatgataagcag

SEQ ID NO: 1043516 - DNA, 22 bp, Artificial Sequence
  chemically synthesized
cattatgtggttatgataagca

SEQ ID NO: 1043517 - DNA, 22 bp, Artificial Sequence
  chemically synthesized
tcattatgtggttatgataagc

SEQ ID NO: 1043518 - DNA, 22 bp, Artificial Sequence
  chemically synthesized
tctactctactgcttatcataa

SEQ ID NO: 1043519 - DNA, 22 bp, Artificial Sequence
  chemically synthesized
tactctactgcttatcataacc

SEQ ID NO: 1043520 - DNA, 22 bp, Artificial Sequence
  chemically synthesized
ctctactgcttatcataaccac

SEQ ID NO: 1043521 - DNA, 22 bp, Artificial Sequence
  chemically synthesized
tactgcttatcataaccacata

SEQ ID NO: 1043522 - DNA, 22 bp, Artificial Sequence
  chemically synthesized
ctgcttatcataaccacataat

SEQ ID NO: 1043523 - DNA, 22 bp, Artificial Sequence
  chemically synthesized
cttatcataaccacataatgaa

SEQ ID NO: 1043524 - DNA, 22 bp, Artificial Sequence
  chemically synthesized
cacatcagtgagctttcattat

SEQ ID NO: 1043525 - DNA, 22 bp, Artificial Sequence
  chemically synthesized
atcataaccacataatgaaagc

SEQ ID NO: 1043526 - DNA, 22 bp, Artificial Sequence
  chemically synthesized
ccacatcagtgagctttcatta

SEQ ID NO: 1043527 - DNA, 22 bp, Artificial Sequence
  chemically synthesized
tcataaccacataatgaaagct

SEQ ID NO: 1043528 - DNA, 22 bp, Artificial Sequence
  chemically synthesized
tccacatcagtgagctttcatt

SEQ ID NO: 1043529 - DNA, 22 bp, Artificial Sequence
  chemically synthesized
ttccacatcagtgagctttcat

SEQ ID NO: 1043530 - DNA, 22 bp, Artificial Sequence
  chemically synthesized
acatttttccacatcagtgagc

SEQ ID NO: 1043531 - DNA, 22 bp, Artificial Sequence
  chemically synthesized
ctaacatttttccacatcagtg

SEQ ID NO: 1043532 - DNA, 22 bp, Artificial Sequence
  chemically synthesized
aaacattactaacatttttcca

SEQ ID NO: 1043533 - DNA, 22 bp, Artificial Sequence
  chemically synthesized
actgatgtggaaaaatgttagt

SEQ ID NO: 1043534 - DNA, 22 bp, Artificial Sequence
  chemically synthesized
atgtggaaaaatgttagtaatg

SEQ ID NO: 1043535 - DNA, 22 bp, Artificial Sequence
  chemically synthesized
gtaatgttttaattatatgtgg

SEQ ID NO: 1043536 - DNA, 22 bp, Artificial Sequence
  chemically synthesized
taattatatgtgggttccctgt

SEQ ID NO: 1043537 - DNA, 22 bp, Artificial Sequence
  chemically synthesized
tgaaaatgtgtgacagggaacc

SEQ ID NO: 1043538 - DNA, 22 bp, Artificial Sequence
  chemically synthesized
aattatatgtgggttccctgtc

SEQ ID NO: 1043539 - DNA, 22 bp, Artificial Sequence
  chemically synthesized
atgaaaatgtgtgacagggaac

SEQ ID NO: 1043540 - DNA, 22 bp, Artificial Sequence
  chemically synthesized
attatatgtgggttccctgtca

SEQ ID NO: 1043541 - DNA, 22 bp, Artificial Sequence
  chemically synthesized
tatgtgggttccctgtcacaca

SEQ ID NO: 1043542 - DNA, 22 bp, Artificial Sequence
  chemically synthesized
aaacaatcatttatgaaaatgt

SEQ ID NO: 1043543 - DNA, 22 bp, Artificial Sequence
  chemically synthesized
cctgtcacacattttcataaat

SEQ ID NO: 1043544 - DNA, 22 bp, Artificial Sequence
  chemically synthesized
aatctaaaacaatcatttatga

SEQ ID NO: 1043545 - DNA, 22 bp, Artificial Sequence
  chemically synthesized
tcacacattttcataaatgatt

SEQ ID NO: 1043546 - DNA, 22 bp, Artificial Sequence
  chemically synthesized
tatatactgaatctaaaacaat

SEQ ID NO: 1043547 - DNA, 22 bp, Artificial Sequence
  chemically synthesized
gtatatactgaatctaaaacaa

SEQ ID NO: 1043548 - DNA, 22 bp, Artificial Sequence
  chemically synthesized
tcataaatgattgttttagatt

SEQ ID NO: 1043549 - DNA, 22 bp, Artificial Sequence
  chemically synthesized
cataaatgattgttttagattc

SEQ ID NO: 1043550 - DNA, 22 bp, Artificial Sequence
  chemically synthesized
ataaatgattgttttagattca

SEQ ID NO: 1043551 - DNA, 22 bp, Artificial Sequence
  chemically synthesized
ggtttgtatatactgaatctaa

SEQ ID NO: 1043552 - DNA, 22 bp, Artificial Sequence
  chemically synthesized
taggtttgtatatactgaatct

SEQ ID NO: 1043553 - DNA, 22 bp, Artificial Sequence
  chemically synthesized
ttctaggtttgtatatactgaa

SEQ ID NO: 1043554 - DNA, 22 bp, Artificial Sequence
  chemically synthesized
ttttagattcagtatatacaaa

SEQ ID NO: 1043555 - DNA, 22 bp, Artificial Sequence
  chemically synthesized
tagattcagtatatacaaacct

SEQ ID NO: 1043556 - DNA, 22 bp, Artificial Sequence
  chemically synthesized
agattcagtatatacaaaccta

SEQ ID NO: 1043557 - DNA, 22 bp, Artificial Sequence
  chemically synthesized
gattcagtatatacaaacctag

SEQ ID NO: 1043558 - DNA, 22 bp, Artificial Sequence
  chemically synthesized
agtatatacaaacctagaacaa

SEQ ID NO: 1043559 - DNA, 22 bp, Artificial Sequence
  chemically synthesized
tatgcatataagcatgaagaaa

SEQ ID NO: 1043560 - DNA, 22 bp, Artificial Sequence
  chemically synthesized
gaacaatttcttcatgcttata

SEQ ID NO: 1043561 - DNA, 22 bp, Artificial Sequence
  chemically synthesized
caaatctatatgcatataagca

SEQ ID NO: 1043562 - DNA, 22 bp, Artificial Sequence
  chemically synthesized
tacaaatctatatgcatataag

SEQ ID NO: 1043563 - DNA, 22 bp, Artificial Sequence
  chemically synthesized
cttcatgcttatatgcatatag

SEQ ID NO: 1043564 - DNA, 22 bp, Artificial Sequence
  chemically synthesized
ttcatgcttatatgcatataga

SEQ ID NO: 1043565 - DNA, 22 bp, Artificial Sequence
  chemically synthesized
catgcttatatgcatatagatt

SEQ ID NO: 1043566 - DNA, 22 bp, Artificial Sequence
  chemically synthesized
atgcttatatgcatatagattt

SEQ ID NO: 1043567 - DNA, 22 bp, Artificial Sequence
  chemically synthesized
gacatgtgcattctacaaatct

SEQ ID NO: 1043568 - DNA, 22 bp, Artificial Sequence
  chemically synthesized
atatgcatatagatttgtagaa

SEQ ID NO: 1043569 - DNA, 22 bp, Artificial Sequence
  chemically synthesized
tatgcatatagatttgtagaat

SEQ ID NO: 1043570 - DNA, 22 bp, Artificial Sequence
  chemically synthesized
aatcatctagacatgtgcattc

SEQ ID NO: 1043571 - DNA, 22 bp, Artificial Sequence
  chemically synthesized
agttaaatcatctagacatgtg

SEQ ID NO: 1043572 - DNA, 22 bp, Artificial Sequence
  chemically synthesized
gtagaatgcacatgtctagatg

SEQ ID NO: 1043573 - DNA, 22 bp, Artificial Sequence
  chemically synthesized
actgagttaaatcatctagaca

SEQ ID NO: 1043574 - DNA, 22 bp, Artificial Sequence
  chemically synthesized
tagaatgcacatgtctagatga

SEQ ID NO: 1043575 - DNA, 22 bp, Artificial Sequence
  chemically synthesized
actcactgagttaaatcatcta

SEQ ID NO: 1043576 - DNA, 22 bp, Artificial Sequence
  chemically synthesized
tatcctaactcactgagttaaa

SEQ ID NO: 1043577 - DNA, 22 bp, Artificial Sequence
  chemically synthesized
tattgtatcctaactcactgag

SEQ ID NO: 1043578 - DNA, 22 bp, Artificial Sequence
  chemically synthesized
atattgtatcctaactcactga

SEQ ID NO: 1043579 - DNA, 22 bp, Artificial Sequence
  chemically synthesized
gatgatttaactcagtgagtta

SEQ ID NO: 1043580 - DNA, 22 bp, Artificial Sequence
  chemically synthesized
tatattgtatcctaactcactg

SEQ ID NO: 1043581 - DNA, 22 bp, Artificial Sequence
  chemically synthesized
ttatattgtatcctaactcact

SEQ ID NO: 1043582 - DNA, 22 bp, Artificial Sequence
  chemically synthesized
tttatattgtatcctaactcac

SEQ ID NO: 1043583 - DNA, 22 bp, Artificial Sequence
  chemically synthesized
tttttatattgtatcctaactc

SEQ ID NO: 1043584 - DNA, 22 bp, Artificial Sequence
  chemically synthesized
ctttttatattgtatcctaact

SEQ ID NO: 1043585 - DNA, 22 bp, Artificial Sequence
  chemically synthesized
aactcagtgagttaggatacaa

SEQ ID NO: 1043586 - DNA, 22 bp, Artificial Sequence
  chemically synthesized
cttctttttatattgtatccta

SEQ ID NO: 1043587 - DNA, 22 bp, Artificial Sequence
  chemically synthesized
actcagtgagttaggatacaat

SEQ ID NO: 1043588 - DNA, 22 bp, Artificial Sequence
  chemically synthesized
acttctttttatattgtatcct

SEQ ID NO: 1043589 - DNA, 22 bp, Artificial Sequence
  chemically synthesized
agtgagttaggatacaatataa

SEQ ID NO: 1043590 - DNA, 22 bp, Artificial Sequence
  chemically synthesized
ggatacaatataaaaagaagta

SEQ ID NO: 1043591 - DNA, 22 bp, Artificial Sequence
  chemically synthesized
aaagagaaaaccaaatttactt

SEQ ID NO: 1043592 - DNA, 22 bp, Artificial Sequence
  chemically synthesized
gtactaaaagagaaaaccaaat

SEQ ID NO: 1043593 - DNA, 22 bp, Artificial Sequence
  chemically synthesized
gtaagcgctggtactaaaagag

SEQ ID NO: 1043594 - DNA, 22 bp, Artificial Sequence
  chemically synthesized
ggttttctcttttagtaccagc

SEQ ID NO: 1043595 - DNA, 22 bp, Artificial Sequence
  chemically synthesized
gttttctcttttagtaccagcg

SEQ ID NO: 1043596 - DNA, 22 bp, Artificial Sequence
  chemically synthesized
tctcttttagtaccagcgctta

SEQ ID NO: 1043597 - DNA, 22 bp, Artificial Sequence
  chemically synthesized
ctcttttagtaccagcgcttac

SEQ ID NO: 1043598 - DNA, 22 bp, Artificial Sequence
  chemically synthesized
tcttttagtaccagcgcttact

SEQ ID NO: 1043599 - DNA, 22 bp, Artificial Sequence
  chemically synthesized
ttttagtaccagcgcttactaa

SEQ ID NO: 1043600 - DNA, 22 bp, Artificial Sequence
  chemically synthesized
ttagtaccagcgcttactaaca

SEQ ID NO: 1043601 - DNA, 22 bp, Artificial Sequence
  chemically synthesized
tagtaccagcgcttactaacac

SEQ ID NO: 1043602 - DNA, 22 bp, Artificial Sequence
  chemically synthesized
agtaccagcgcttactaacact

SEQ ID NO: 1043603 - DNA, 22 bp, Artificial Sequence
  chemically synthesized
gtaccagcgcttactaacactg

SEQ ID NO: 1043604 - DNA, 22 bp, Artificial Sequence
  chemically synthesized
agatagaagaagacagggcagt

SEQ ID NO: 1043605 - DNA, 22 bp, Artificial Sequence
  chemically synthesized
tgagatagaagaagacagggca

SEQ ID NO: 1043606 - DNA, 22 bp, Artificial Sequence
  chemically synthesized
actaacactgccctgtcttctt

SEQ ID NO: 1043607 - DNA, 22 bp, Artificial Sequence
  chemically synthesized
ctaacactgccctgtcttcttc

SEQ ID NO: 1043608 - DNA, 22 bp, Artificial Sequence
  chemically synthesized
acactgccctgtcttcttctat

SEQ ID NO: 1043609 - DNA, 22 bp, Artificial Sequence
  chemically synthesized
ccctgtcttcttctatctcaga

SEQ ID NO: 1043610 - DNA, 22 bp, Artificial Sequence
  chemically synthesized
tcttcttctatctcagagtcca

SEQ ID NO: 1043611 - DNA, 22 bp, Artificial Sequence
  chemically synthesized
atacatgtaggtgtggactctg

SEQ ID NO: 1043612 - DNA, 22 bp, Artificial Sequence
  chemically synthesized
cttctatctcagagtccacacc

SEQ ID NO: 1043613 - DNA, 22 bp, Artificial Sequence
  chemically synthesized
ttctatctcagagtccacacct

SEQ ID NO: 1043614 - DNA, 22 bp, Artificial Sequence
  chemically synthesized
ctatctcagagtccacacctac

SEQ ID NO: 1043615 - DNA, 22 bp, Artificial Sequence
  chemically synthesized
tatctcagagtccacacctaca

SEQ ID NO: 1043616 - DNA, 22 bp, Artificial Sequence
  chemically synthesized
tctcagagtccacacctacatg

SEQ ID NO: 1043617 - DNA, 22 bp, Artificial Sequence
  chemically synthesized
agagtccacacctacatgtatc

SEQ ID NO: 1043618 - DNA, 22 bp, Artificial Sequence
  chemically synthesized
gtgagtgatggtctgatacatg

SEQ ID NO: 1043619 - DNA, 22 bp, Artificial Sequence
  chemically synthesized
aattagtgagtgatggtctgat

SEQ ID NO: 1043620 - DNA, 22 bp, Artificial Sequence
  chemically synthesized
ttgaattagtgagtgatggtct

SEQ ID NO: 1043621 - DNA, 22 bp, Artificial Sequence
  chemically synthesized
catgtatcagaccatcactcac

SEQ ID NO: 1043622 - DNA, 22 bp, Artificial Sequence
  chemically synthesized
aatgtacatctgttgaattagt

SEQ ID NO: 1043623 - DNA, 22 bp, Artificial Sequence
  chemically synthesized
aaggtactgaatgtacatctgt

SEQ ID NO: 1043624 - DNA, 22 bp, Artificial Sequence
  chemically synthesized
aaaggtactgaatgtacatctg

SEQ ID NO: 1043625 - DNA, 22 bp, Artificial Sequence
  chemically synthesized
actaattcaacagatgtacatt

SEQ ID NO: 1043626 - DNA, 22 bp, Artificial Sequence
  chemically synthesized
attcaacagatgtacattcagt

SEQ ID NO: 1043627 - DNA, 22 bp, Artificial Sequence
  chemically synthesized
gcacttaaaggtactgaatgta

SEQ ID NO: 1043628 - DNA, 22 bp, Artificial Sequence
  chemically synthesized
aacagatgtacattcagtacct

SEQ ID NO: 1043629 - DNA, 22 bp, Artificial Sequence
  chemically synthesized
gaacagcacctagcacttaaag

SEQ ID NO: 1043630 - DNA, 22 bp, Artificial Sequence
  chemically synthesized
ctagaacagcacctagcactta

SEQ ID NO: 1043631 - DNA, 22 bp, Artificial Sequence
  chemically synthesized
agtacctttaagtgctaggtgc

SEQ ID NO: 1043632 - DNA, 22 bp, Artificial Sequence
  chemically synthesized
gaactcctagaacagcacctag

SEQ ID NO: 1043633 - DNA, 22 bp, Artificial Sequence
  chemically synthesized
taagtgctaggtgctgttctag

SEQ ID NO: 1043634 - DNA, 22 bp, Artificial Sequence
  chemically synthesized
tatctagaactcctagaacagc

SEQ ID NO: 1043635 - DNA, 22 bp, Artificial Sequence
  chemically synthesized
aagtgctaggtgctgttctagg

SEQ ID NO: 1043636 - DNA, 22 bp, Artificial Sequence
  chemically synthesized
agtgctaggtgctgttctagga

SEQ ID NO: 1043637 - DNA, 22 bp, Artificial Sequence
  chemically synthesized
caccactgtatctagaactcct

SEQ ID NO: 1043638 - DNA, 22 bp, Artificial Sequence
  chemically synthesized
ggtgctgttctaggagttctag

SEQ ID NO: 1043639 - DNA, 22 bp, Artificial Sequence
  chemically synthesized
ctccaccactgtatctagaact

SEQ ID NO: 1043640 - DNA, 22 bp, Artificial Sequence
  chemically synthesized
cctccaccactgtatctagaac

SEQ ID NO: 1043641 - DNA, 22 bp, Artificial Sequence
  chemically synthesized
tcctccaccactgtatctagaa

SEQ ID NO: 1043642 - DNA, 22 bp, Artificial Sequence
  chemically synthesized
ttcctccaccactgtatctaga

SEQ ID NO: 1043643 - DNA, 22 bp, Artificial Sequence
  chemically synthesized
tttcctccaccactgtatctag

SEQ ID NO: 1043644 - DNA, 22 bp, Artificial Sequence
  chemically synthesized
ttctaggagttctagatacagt

SEQ ID NO: 1043645 - DNA, 22 bp, Artificial Sequence
  chemically synthesized
ttttcctccaccactgtatcta

SEQ ID NO: 1043646 - DNA, 22 bp, Artificial Sequence
  chemically synthesized
taggagttctagatacagtggt

SEQ ID NO: 1043647 - DNA, 22 bp, Artificial Sequence
  chemically synthesized
tttttttcctccaccactgtat

SEQ ID NO: 1043648 - DNA, 22 bp, Artificial Sequence
  chemically synthesized
ggagttctagatacagtggtgg

SEQ ID NO: 1043649 - DNA, 22 bp, Artificial Sequence
  chemically synthesized
ttgtttttttcctccaccactg

SEQ ID NO: 1043650 - DNA, 22 bp, Artificial Sequence
  chemically synthesized
gttgtttttttcctccaccact

SEQ ID NO: 1043651 - DNA, 22 bp, Artificial Sequence
  chemically synthesized
tttgttgtttttttcctccacc

SEQ ID NO: 1043652 - DNA, 22 bp, Artificial Sequence
  chemically synthesized
gtttgttgtttttttcctccac

SEQ ID NO: 1043653 - DNA, 22 bp, Artificial Sequence
  chemically synthesized
tagatacagtggtggaggaaaa

SEQ ID NO: 1043654 - DNA, 22 bp, Artificial Sequence
  chemically synthesized
gatacagtggtggaggaaaaaa

SEQ ID NO: 1043655 - DNA, 22 bp, Artificial Sequence
  chemically synthesized
gtatcttgtttgttgttttttt

SEQ ID NO: 1043656 - DNA, 22 bp, Artificial Sequence
  chemically synthesized
atttttcttcctggtggctgtg

SEQ ID NO: 1043657 - DNA, 22 bp, Artificial Sequence
  chemically synthesized
ttcttcctggtggctgtgtgta

SEQ ID NO: 1043658 - DNA, 22 bp, Artificial Sequence
  chemically synthesized
tcttcctggtggctgtgtgtat

SEQ ID NO: 1043659 - DNA, 22 bp, Artificial Sequence
  chemically synthesized
cttcctggtggctgtgtgtatg

SEQ ID NO: 1043660 - DNA, 22 bp, Artificial Sequence
  chemically synthesized
aagaaggtgatacatacacaca

SEQ ID NO: 1043661 - DNA, 22 bp, Artificial Sequence
  chemically synthesized
ttcctggtggctgtgtgtatgt

SEQ ID NO: 1043662 - DNA, 22 bp, Artificial Sequence
  chemically synthesized
caagaaggtgatacatacacac

SEQ ID NO: 1043663 - DNA, 22 bp, Artificial Sequence
  chemically synthesized
tcaagaaggtgatacatacaca

SEQ ID NO: 1043664 - DNA, 22 bp, Artificial Sequence
  chemically synthesized
cctggtggctgtgtgtatgtat

SEQ ID NO: 1043665 - DNA, 22 bp, Artificial Sequence
  chemically synthesized
ttcaagaaggtgatacatacac

SEQ ID NO: 1043666 - DNA, 22 bp, Artificial Sequence
  chemically synthesized
ctggtggctgtgtgtatgtatc

SEQ ID NO: 1043667 - DNA, 22 bp, Artificial Sequence
  chemically synthesized
gtggctgtgtgtatgtatcacc

SEQ ID NO: 1043668 - DNA, 22 bp, Artificial Sequence
  chemically synthesized
catttttcaagaaggtgataca

SEQ ID NO: 1043669 - DNA, 22 bp, Artificial Sequence
  chemically synthesized
tgtgtatgtatcaccttcttga

SEQ ID NO: 1043670 - DNA, 22 bp, Artificial Sequence
  chemically synthesized
cagtgctacatttttcaagaag

SEQ ID NO: 1043671 - DNA, 22 bp, Artificial Sequence
  chemically synthesized
cttgaaaaatgtagcactgcag

SEQ ID NO: 1043672 - DNA, 22 bp, Artificial Sequence
  chemically synthesized
ttgaaaaatgtagcactgcagt

SEQ ID NO: 1043673 - DNA, 22 bp, Artificial Sequence
  chemically synthesized
gaaaaatgtagcactgcagtta

SEQ ID NO: 1043674 - DNA, 22 bp, Artificial Sequence
  chemically synthesized
aaaaatgtagcactgcagttac

SEQ ID NO: 1043675 - DNA, 22 bp, Artificial Sequence
  chemically synthesized
agtatatgtataacccatgtaa

SEQ ID NO: 1043676 - DNA, 22 bp, Artificial Sequence
  chemically synthesized
aagtatatgtataacccatgta

SEQ ID NO: 1043677 - DNA, 22 bp, Artificial Sequence
  chemically synthesized
cagttacatgggttatacatat

SEQ ID NO: 1043678 - DNA, 22 bp, Artificial Sequence
  chemically synthesized
tacatgcatttaagtatatgta

SEQ ID NO: 1043679 - DNA, 22 bp, Artificial Sequence
  chemically synthesized
catgggttatacatatacttaa

SEQ ID NO: 1043680 - DNA, 22 bp, Artificial Sequence
  chemically synthesized
taaacactatacatgcatttaa

SEQ ID NO: 1043681 - DNA, 22 bp, Artificial Sequence
  chemically synthesized
tacatatacttaaatgcatgta

SEQ ID NO: 1043682 - DNA, 22 bp, Artificial Sequence
  chemically synthesized
taagtctataaacactatacat

SEQ ID NO: 1043683 - DNA, 22 bp, Artificial Sequence
  chemically synthesized
ataagtctataaacactataca

SEQ ID NO: 1043684 - DNA, 22 bp, Artificial Sequence
  chemically synthesized
tataagtctataaacactatac

SEQ ID NO: 1043685 - DNA, 22 bp, Artificial Sequence
  chemically synthesized
aaatgcatgtatagtgtttata

SEQ ID NO: 1043686 - DNA, 22 bp, Artificial Sequence
  chemically synthesized
aatgcatgtatagtgtttatag

SEQ ID NO: 1043687 - DNA, 22 bp, Artificial Sequence
  chemically synthesized
gagttttataagtctataaaca

SEQ ID NO: 1043688 - DNA, 22 bp, Artificial Sequence
  chemically synthesized
atagacttataaaactctaggc

SEQ ID NO: 1043689 - DNA, 22 bp, Artificial Sequence
  chemically synthesized
tagacttataaaactctaggca

SEQ ID NO: 1043690 - DNA, 22 bp, Artificial Sequence
  chemically synthesized
ataaaactctaggcactattgt

SEQ ID NO: 1043691 - DNA, 22 bp, Artificial Sequence
  chemically synthesized
taaaactctaggcactattgtc

SEQ ID NO: 1043692 - DNA, 22 bp, Artificial Sequence
  chemically synthesized
ccaaaatatgacgacaatagtg

SEQ ID NO: 1043693 - DNA, 22 bp, Artificial Sequence
  chemically synthesized
cccaaaatatgacgacaatagt

SEQ ID NO: 1043694 - DNA, 22 bp, Artificial Sequence
  chemically synthesized
accttcccaaaatatgacgaca

SEQ ID NO: 1043695 - DNA, 22 bp, Artificial Sequence
  chemically synthesized
caccttcccaaaatatgacgac

SEQ ID NO: 1043696 - DNA, 22 bp, Artificial Sequence
  chemically synthesized
taggcactattgtcgtcatatt

SEQ ID NO: 1043697 - DNA, 22 bp, Artificial Sequence
  chemically synthesized
tcaccttcccaaaatatgacga

SEQ ID NO: 1043698 - DNA, 22 bp, Artificial Sequence
  chemically synthesized
ggcactattgtcgtcatatttt

SEQ ID NO: 1043699 - DNA, 22 bp, Artificial Sequence
  chemically synthesized
ttttcaccttcccaaaatatga

SEQ ID NO: 1043700 - DNA, 22 bp, Artificial Sequence
  chemically synthesized
ttattttcaccttcccaaaata

SEQ ID NO: 1043701 - DNA, 22 bp, Artificial Sequence
  chemically synthesized
ttgtcgtcatattttgggaagg

SEQ ID NO: 1043702 - DNA, 22 bp, Artificial Sequence
  chemically synthesized
tcgtcatattttgggaaggtga

SEQ ID NO: 1043703 - DNA, 22 bp, Artificial Sequence
  chemically synthesized
aagctattattttcaccttccc

SEQ ID NO: 1043704 - DNA, 22 bp, Artificial Sequence
  chemically synthesized
aaagctattattttcaccttcc

SEQ ID NO: 1043705 - DNA, 22 bp, Artificial Sequence
  chemically synthesized
cttaaagctattattttcacct

SEQ ID NO: 1043706 - DNA, 22 bp, Artificial Sequence
  chemically synthesized
aaactgcttaaagctattattt

SEQ ID NO: 1043707 - DNA, 22 bp, Artificial Sequence
  chemically synthesized
tgggaaggtgaaaataatagct

SEQ ID NO: 1043708 - DNA, 22 bp, Artificial Sequence
  chemically synthesized
gggaaggtgaaaataatagctt

SEQ ID NO: 1043709 - DNA, 22 bp, Artificial Sequence
  chemically synthesized
ggaaggtgaaaataatagcttt

SEQ ID NO: 1043710 - DNA, 22 bp, Artificial Sequence
  chemically synthesized
atacctaaaactgcttaaagct

SEQ ID NO: 1043711 - DNA, 22 bp, Artificial Sequence
  chemically synthesized
tgatacctaaaactgcttaaag

SEQ ID NO: 1043712 - DNA, 22 bp, Artificial Sequence
  chemically synthesized
ctgatacctaaaactgcttaaa

SEQ ID NO: 1043713 - DNA, 22 bp, Artificial Sequence
  chemically synthesized
aaggcatttctgatacctaaaa

SEQ ID NO: 1043714 - DNA, 22 bp, Artificial Sequence
  chemically synthesized
taagcagttttaggtatcagaa

SEQ ID NO: 1043715 - DNA, 22 bp, Artificial Sequence
  chemically synthesized
aagcagttttaggtatcagaaa

SEQ ID NO: 1043716 - DNA, 22 bp, Artificial Sequence
  chemically synthesized
agcagttttaggtatcagaaat

SEQ ID NO: 1043717 - DNA, 22 bp, Artificial Sequence
  chemically synthesized
caaagtgtctcaaggcatttct

SEQ ID NO: 1043718 - DNA, 22 bp, Artificial Sequence
  chemically synthesized
taggtatcagaaatgccttgag

SEQ ID NO: 1043719 - DNA, 22 bp, Artificial Sequence
  chemically synthesized
aggtatcagaaatgccttgaga

SEQ ID NO: 1043720 - DNA, 22 bp, Artificial Sequence
  chemically synthesized
ggtatcagaaatgccttgagac

SEQ ID NO: 1043721 - DNA, 22 bp, Artificial Sequence
  chemically synthesized
accaagttacaaagtgtctcaa

SEQ ID NO: 1043722 - DNA, 22 bp, Artificial Sequence
  chemically synthesized
ttaaccaagttacaaagtgtct

SEQ ID NO: 1043723 - DNA, 22 bp, Artificial Sequence
  chemically synthesized
tgttaaccaagttacaaagtgt

SEQ ID NO: 1043724 - DNA, 22 bp, Artificial Sequence
  chemically synthesized
ctctgttaaccaagttacaaag

SEQ ID NO: 1043725 - DNA, 22 bp, Artificial Sequence
  chemically synthesized
gagacactttgtaacttggtta

SEQ ID NO: 1043726 - DNA, 22 bp, Artificial Sequence
  chemically synthesized
agacactttgtaacttggttaa

SEQ ID NO: 1043727 - DNA, 22 bp, Artificial Sequence
  chemically synthesized
tgtgctcctctgttaaccaagt

SEQ ID NO: 1043728 - DNA, 22 bp, Artificial Sequence
  chemically synthesized
tgtaacttggttaacagaggag

SEQ ID NO: 1043729 - DNA, 22 bp, Artificial Sequence
  chemically synthesized
gtaacttggttaacagaggagc

SEQ ID NO: 1043730 - DNA, 22 bp, Artificial Sequence
  chemically synthesized
taacttggttaacagaggagca

SEQ ID NO: 1043731 - DNA, 22 bp, Artificial Sequence
  chemically synthesized
gaaatgaaagttatgtgctcct

SEQ ID NO: 1043732 - DNA, 22 bp, Artificial Sequence
  chemically synthesized
agaaatgaaagttatgtgctcc

SEQ ID NO: 1043733 - DNA, 22 bp, Artificial Sequence
  chemically synthesized
ggttaacagaggagcacataac

SEQ ID NO: 1043734 - DNA, 22 bp, Artificial Sequence
  chemically synthesized
ttagaaatgaaagttatgtgct

SEQ ID NO: 1043735 - DNA, 22 bp, Artificial Sequence
  chemically synthesized
gttaacagaggagcacataact

SEQ ID NO: 1043736 - DNA, 22 bp, Artificial Sequence
  chemically synthesized
cttagaaatgaaagttatgtgc

SEQ ID NO: 1043737 - DNA, 22 bp, Artificial Sequence
  chemically synthesized
tcttagaaatgaaagttatgtg

SEQ ID NO: 1043738 - DNA, 22 bp, Artificial Sequence
  chemically synthesized
ttcttagaaatgaaagttatgt

SEQ ID NO: 1043739 - DNA, 22 bp, Artificial Sequence
  chemically synthesized
tttcttagaaatgaaagttatg

SEQ ID NO: 1043740 - DNA, 22 bp, Artificial Sequence
  chemically synthesized
acagaggagcacataactttca

SEQ ID NO: 1043741 - DNA, 22 bp, Artificial Sequence
  chemically synthesized
ttttcttagaaatgaaagttat

SEQ ID NO: 1043742 - DNA, 22 bp, Artificial Sequence
  chemically synthesized
atccttttttcttagaaatgaa

SEQ ID NO: 1043743 - DNA, 22 bp, Artificial Sequence
  chemically synthesized
taatccttttttcttagaaatg

SEQ ID NO: 1043744 - DNA, 22 bp, Artificial Sequence
  chemically synthesized
ctaatccttttttcttagaaat

SEQ ID NO: 1043745 - DNA, 22 bp, Artificial Sequence
  chemically synthesized
tctaatccttttttcttagaaa

SEQ ID NO: 1043746 - DNA, 22 bp, Artificial Sequence
  chemically synthesized
ttctaatccttttttcttagaa

SEQ ID NO: 1043747 - DNA, 22 bp, Artificial Sequence
  chemically synthesized
tcatttctaagaaaaaaggatt

SEQ ID NO: 1043748 - DNA, 22 bp, Artificial Sequence
  chemically synthesized
atgggtttttctaatccttttt

SEQ ID NO: 1043749 - DNA, 22 bp, Artificial Sequence
  chemically synthesized
catttctaagaaaaaaggatta

SEQ ID NO: 1043750 - DNA, 22 bp, Artificial Sequence
  chemically synthesized
atttctaagaaaaaaggattag

SEQ ID NO: 1043751 - DNA, 22 bp, Artificial Sequence
  chemically synthesized
ctaatgggtttttctaatcctt

SEQ ID NO: 1043752 - DNA, 22 bp, Artificial Sequence
  chemically synthesized
ctaagaaaaaaggattagaaaa

SEQ ID NO: 1043753 - DNA, 22 bp, Artificial Sequence
  chemically synthesized
taagaaaaaaggattagaaaaa

SEQ ID NO: 1043754 - DNA, 22 bp, Artificial Sequence
  chemically synthesized
agaaaaaaggattagaaaaacc

SEQ ID NO: 1043755 - DNA, 22 bp, Artificial Sequence
  chemically synthesized
tcacaacagttactaatgggtt

SEQ ID NO: 1043756 - DNA, 22 bp, Artificial Sequence
  chemically synthesized
gaaaaacccattagtaactgtt

SEQ ID NO: 1043757 - DNA, 22 bp, Artificial Sequence
  chemically synthesized
cccaacggccgctgtcacaaca

SEQ ID NO: 1043758 - DNA, 22 bp, Artificial Sequence
  chemically synthesized
ctccccaacggccgctgtcaca

SEQ ID NO: 1043759 - DNA, 22 bp, Artificial Sequence
  chemically synthesized
gtaactgttgtgacagcggccg

SEQ ID NO: 1043760 - DNA, 22 bp, Artificial Sequence
  chemically synthesized
ttgtgacagcggccgttgggga

SEQ ID NO: 1043761 - DNA, 22 bp, Artificial Sequence
  chemically synthesized
agatagatctactccccaacgg

SEQ ID NO: 1043762 - DNA, 22 bp, Artificial Sequence
  chemically synthesized
aagatagatctactccccaacg

SEQ ID NO: 1043763 - DNA, 22 bp, Artificial Sequence
  chemically synthesized
taagatagatctactccccaac

SEQ ID NO: 1043764 - DNA, 22 bp, Artificial Sequence
  chemically synthesized
tgacagcggccgttggggagta

SEQ ID NO: 1043765 - DNA, 22 bp, Artificial Sequence
  chemically synthesized
cattttaagatagatctactcc

SEQ ID NO: 1043766 - DNA, 22 bp, Artificial Sequence
  chemically synthesized
ccattttaagatagatctactc

SEQ ID NO: 1043767 - DNA, 22 bp, Artificial Sequence
  chemically synthesized
tccattttaagatagatctact

SEQ ID NO: 1043768 - DNA, 22 bp, Artificial Sequence
  chemically synthesized
ttccattttaagatagatctac

SEQ ID NO: 1043769 - DNA, 22 bp, Artificial Sequence
  chemically synthesized
tttccattttaagatagatcta

SEQ ID NO: 1043770 - DNA, 22 bp, Artificial Sequence
  chemically synthesized
tttttccattttaagatagatc

SEQ ID NO: 1043771 - DNA, 22 bp, Artificial Sequence
  chemically synthesized
tctttttccattttaagataga

SEQ ID NO: 1043772 - DNA, 22 bp, Artificial Sequence
  chemically synthesized
ctctttttccattttaagatag

SEQ ID NO: 1043773 - DNA, 22 bp, Artificial Sequence
  chemically synthesized
gggagtagatctatcttaaaat

SEQ ID NO: 1043774 - DNA, 22 bp, Artificial Sequence
  chemically synthesized
tttctctttttccattttaaga

SEQ ID NO: 1043775 - DNA, 22 bp, Artificial Sequence
  chemically synthesized
atttctctttttccattttaag

SEQ ID NO: 1043776 - DNA, 22 bp, Artificial Sequence
  chemically synthesized
ttatttctctttttccatttta

SEQ ID NO: 1043777 - DNA, 22 bp, Artificial Sequence
  chemically synthesized
tcttatttctctttttccattt

SEQ ID NO: 1043778 - DNA, 22 bp, Artificial Sequence
  chemically synthesized
gttctcttatttctctttttcc

SEQ ID NO: 1043779 - DNA, 22 bp, Artificial Sequence
  chemically synthesized
ggttctcttatttctctttttc

SEQ ID NO: 1043780 - DNA, 22 bp, Artificial Sequence
  chemically synthesized
tggttctcttatttctcttttt

SEQ ID NO: 1043781 - DNA, 22 bp, Artificial Sequence
  chemically synthesized
tcttaaaatggaaaaagagaaa

SEQ ID NO: 1043782 - DNA, 22 bp, Artificial Sequence
  chemically synthesized
aaaatggaaaaagagaaataag

SEQ ID NO: 1043783 - DNA, 22 bp, Artificial Sequence
  chemically synthesized
aaatggaaaaagagaaataaga

SEQ ID NO: 1043784 - DNA, 22 bp, Artificial Sequence
  chemically synthesized
agtctttggttctcttatttct

SEQ ID NO: 1043785 - DNA, 22 bp, Artificial Sequence
  chemically synthesized
gagtctttggttctcttatttc

SEQ ID NO: 1043786 - DNA, 22 bp, Artificial Sequence
  chemically synthesized
gagtttgagtctttggttctct

SEQ ID NO: 1043787 - DNA, 22 bp, Artificial Sequence
  chemically synthesized
cagagagtgaaaatgaactgga

SEQ ID NO: 1043788 - DNA, 22 bp, Artificial Sequence
  chemically synthesized
aaactccagttcattttcactc

SEQ ID NO: 1043789 - DNA, 22 bp, Artificial Sequence
  chemically synthesized
cagttcattttcactctctgga

SEQ ID NO: 1043790 - DNA, 22 bp, Artificial Sequence
  chemically synthesized
tcagataaagacaaattccaga

SEQ ID NO: 1043791 - DNA, 22 bp, Artificial Sequence
  chemically synthesized
attttcactctctggaatttgt

SEQ ID NO: 1043792 - DNA, 22 bp, Artificial Sequence
  chemically synthesized
tctgtcagataaagacaaattc

SEQ ID NO: 1043793 - DNA, 22 bp, Artificial Sequence
  chemically synthesized
atctgtcagataaagacaaatt

SEQ ID NO: 1043794 - DNA, 22 bp, Artificial Sequence
  chemically synthesized
tcactctctggaatttgtcttt

SEQ ID NO: 1043795 - DNA, 22 bp, Artificial Sequence
  chemically synthesized
tatctgtcagataaagacaaat

SEQ ID NO: 1043796 - DNA, 22 bp, Artificial Sequence
  chemically synthesized
cactctctggaatttgtcttta

SEQ ID NO: 1043797 - DNA, 22 bp, Artificial Sequence
  chemically synthesized
actctctggaatttgtctttat

SEQ ID NO: 1043798 - DNA, 22 bp, Artificial Sequence
  chemically synthesized
cctttatctgtcagataaagac

SEQ ID NO: 1043799 - DNA, 22 bp, Artificial Sequence
  chemically synthesized
tctggaatttgtctttatctga

SEQ ID NO: 1043800 - DNA, 22 bp, Artificial Sequence
  chemically synthesized
tggaatttgtctttatctgaca

SEQ ID NO: 1043801 - DNA, 22 bp, Artificial Sequence
  chemically synthesized
gaatttgtctttatctgacaga

SEQ ID NO: 1043802 - DNA, 22 bp, Artificial Sequence
  chemically synthesized
gtctttatctgacagataaagg

SEQ ID NO: 1043803 - DNA, 22 bp, Artificial Sequence
  chemically synthesized
tatagggtgttgcctttatctg

SEQ ID NO: 1043804 - DNA, 22 bp, Artificial Sequence
  chemically synthesized
tctttatctgacagataaaggc

SEQ ID NO: 1043805 - DNA, 22 bp, Artificial Sequence
  chemically synthesized
atatagggtgttgcctttatct

SEQ ID NO: 1043806 - DNA, 22 bp, Artificial Sequence
  chemically synthesized
tatctgacagataaaggcaaca

SEQ ID NO: 1043807 - DNA, 22 bp, Artificial Sequence
  chemically synthesized
atctgacagataaaggcaacac

SEQ ID NO: 1043808 - DNA, 22 bp, Artificial Sequence
  chemically synthesized
gatttatatagggtgttgcctt

SEQ ID NO: 1043809 - DNA, 22 bp, Artificial Sequence
  chemically synthesized
tctgacagataaaggcaacacc

SEQ ID NO: 1043810 - DNA, 22 bp, Artificial Sequence
  chemically synthesized
acagataaaggcaacaccctat

SEQ ID NO: 1043811 - DNA, 22 bp, Artificial Sequence
  chemically synthesized
tataaatctaattcttacactc

SEQ ID NO: 1043812 - DNA, 22 bp, Artificial Sequence
  chemically synthesized
gatgggatgtgaagagtgtaag

SEQ ID NO: 1043813 - DNA, 22 bp, Artificial Sequence
  chemically synthesized
gtagctggatgggatgtgaaga

SEQ ID NO: 1043814 - DNA, 22 bp, Artificial Sequence
  chemically synthesized
attcttacactcttcacatccc

SEQ ID NO: 1043815 - DNA, 22 bp, Artificial Sequence
  chemically synthesized
ttacactcttcacatcccatcc

SEQ ID NO: 1043816 - DNA, 22 bp, Artificial Sequence
  chemically synthesized
acactcttcacatcccatccag

SEQ ID NO: 1043817 - DNA, 22 bp, Artificial Sequence
  chemically synthesized
cactcttcacatcccatccagc

SEQ ID NO: 1043818 - DNA, 22 bp, Artificial Sequence
  chemically synthesized
atgtagtgcctggtagctggat

SEQ ID NO: 1043819 - DNA, 22 bp, Artificial Sequence
  chemically synthesized
ttcacatcccatccagctacca

SEQ ID NO: 1043820 - DNA, 22 bp, Artificial Sequence
  chemically synthesized
cacatcccatccagctaccagg

SEQ ID NO: 1043821 - DNA, 22 bp, Artificial Sequence
  chemically synthesized
acatcccatccagctaccaggc

SEQ ID NO: 1043822 - DNA, 22 bp, Artificial Sequence
  chemically synthesized
gatatgtcattaatgtagtgcc

SEQ ID NO: 1043823 - DNA, 22 bp, Artificial Sequence
  chemically synthesized
ccaattcgatatgtcattaatg

SEQ ID NO: 1043824 - DNA, 22 bp, Artificial Sequence
  chemically synthesized
ccaggcactacattaatgacat

SEQ ID NO: 1043825 - DNA, 22 bp, Artificial Sequence
  chemically synthesized
aacacagttcccaattcgatat

SEQ ID NO: 1043826 - DNA, 22 bp, Artificial Sequence
  chemically synthesized
cattaatgacatatcgaattgg

SEQ ID NO: 1043827 - DNA, 22 bp, Artificial Sequence
  chemically synthesized
attgaacacagttcccaattcg

SEQ ID NO: 1043828 - DNA, 22 bp, Artificial Sequence
  chemically synthesized
gattgaacacagttcccaattc

SEQ ID NO: 1043829 - DNA, 22 bp, Artificial Sequence
  chemically synthesized
tgattgaacacagttcccaatt

SEQ ID NO: 1043830 - DNA, 22 bp, Artificial Sequence
  chemically synthesized
atgacatatcgaattgggaact

SEQ ID NO: 1043831 - DNA, 22 bp, Artificial Sequence
  chemically synthesized
ttgattgaacacagttcccaat

SEQ ID NO: 1043832 - DNA, 22 bp, Artificial Sequence
  chemically synthesized
atgccttttgattgaacacagt

SEQ ID NO: 1043833 - DNA, 22 bp, Artificial Sequence
  chemically synthesized
aatgccttttgattgaacacag

SEQ ID NO: 1043834 - DNA, 22 bp, Artificial Sequence
  chemically synthesized
taatgccttttgattgaacaca

SEQ ID NO: 1043835 - DNA, 22 bp, Artificial Sequence
  chemically synthesized
ggaactgtgttcaatcaaaagg

SEQ ID NO: 1043836 - DNA, 22 bp, Artificial Sequence
  chemically synthesized
ataagtactttaatgccttttg

SEQ ID NO: 1043837 - DNA, 22 bp, Artificial Sequence
  chemically synthesized
tgttcaatcaaaaggcattaaa

SEQ ID NO: 1043838 - DNA, 22 bp, Artificial Sequence
  chemically synthesized
gttaataagtactttaatgcct

SEQ ID NO: 1043839 - DNA, 22 bp, Artificial Sequence
  chemically synthesized
aatcaaaaggcattaaagtact

SEQ ID NO: 1043840 - DNA, 22 bp, Artificial Sequence
  chemically synthesized
cgtaaaacctagttaataagta

SEQ ID NO: 1043841 - DNA, 22 bp, Artificial Sequence
  chemically synthesized
gaagctccgtaaaacctagtta

SEQ ID NO: 1043842 - DNA, 22 bp, Artificial Sequence
  chemically synthesized
ggaagctccgtaaaacctagtt

SEQ ID NO: 1043843 - DNA, 22 bp, Artificial Sequence
  chemically synthesized
aagtacttattaactaggtttt

SEQ ID NO: 1043844 - DNA, 22 bp, Artificial Sequence
  chemically synthesized
tggaagctccgtaaaacctagt

SEQ ID NO: 1043845 - DNA, 22 bp, Artificial Sequence
  chemically synthesized
ttggaagctccgtaaaacctag

SEQ ID NO: 1043846 - DNA, 22 bp, Artificial Sequence
  chemically synthesized
tttggaagctccgtaaaaccta

SEQ ID NO: 1043847 - DNA, 22 bp, Artificial Sequence
  chemically synthesized
ttttggaagctccgtaaaacct

SEQ ID NO: 1043848 - DNA, 22 bp, Artificial Sequence
  chemically synthesized
tttttggaagctccgtaaaacc

SEQ ID NO: 1043849 - DNA, 22 bp, Artificial Sequence
  chemically synthesized
attaactaggttttacggagct

SEQ ID NO: 1043850 - DNA, 22 bp, Artificial Sequence
  chemically synthesized
actttttttggaagctccgtaa

SEQ ID NO: 1043851 - DNA, 22 bp, Artificial Sequence
  chemically synthesized
ttaactaggttttacggagctt

SEQ ID NO: 1043852 - DNA, 22 bp, Artificial Sequence
  chemically synthesized
aactttttttggaagctccgta

SEQ ID NO: 1043853 - DNA, 22 bp, Artificial Sequence
  chemically synthesized
taactttttttggaagctccgt

SEQ ID NO: 1043854 - DNA, 22 bp, Artificial Sequence
  chemically synthesized
ttaactttttttggaagctccg

SEQ ID NO: 1043855 - DNA, 22 bp, Artificial Sequence
  chemically synthesized
actaggttttacggagcttcca

SEQ ID NO: 1043856 - DNA, 22 bp, Artificial Sequence
  chemically synthesized
tttaactttttttggaagctcc

SEQ ID NO: 1043857 - DNA, 22 bp, Artificial Sequence
  chemically synthesized
ggttttacggagcttccaaaaa

SEQ ID NO: 1043858 - DNA, 22 bp, Artificial Sequence
  chemically synthesized
tacggagcttccaaaaaaagtt

SEQ ID NO: 1043859 - DNA, 22 bp, Artificial Sequence
  chemically synthesized
acggagcttccaaaaaaagtta

SEQ ID NO: 1043860 - DNA, 22 bp, Artificial Sequence
  chemically synthesized
cggagcttccaaaaaaagttaa

SEQ ID NO: 1043861 - DNA, 22 bp, Artificial Sequence
  chemically synthesized
ccaaaaaaagttaaaaagttat

SEQ ID NO: 1043862 - DNA, 22 bp, Artificial Sequence
  chemically synthesized
caaaaaaagttaaaaagttatt

SEQ ID NO: 1043863 - DNA, 22 bp, Artificial Sequence
  chemically synthesized
ccatagagccaccaaaaataac

SEQ ID NO: 1043864 - DNA, 22 bp, Artificial Sequence
  chemically synthesized
accatagagccaccaaaaataa

SEQ ID NO: 1043865 - DNA, 22 bp, Artificial Sequence
  chemically synthesized
aaaagttatttttggtggctct

SEQ ID NO: 1043866 - DNA, 22 bp, Artificial Sequence
  chemically synthesized
aaaggtcaccttaccatagagc

SEQ ID NO: 1043867 - DNA, 22 bp, Artificial Sequence
  chemically synthesized
tttttggtggctctatggtaag

SEQ ID NO: 1043868 - DNA, 22 bp, Artificial Sequence
  chemically synthesized
ttggtggctctatggtaaggtg

SEQ ID NO: 1043869 - DNA, 22 bp, Artificial Sequence
  chemically synthesized
tggtggctctatggtaaggtga

SEQ ID NO: 1043870 - DNA, 22 bp, Artificial Sequence
  chemically synthesized
ggtggctctatggtaaggtgac

SEQ ID NO: 1043871 - DNA, 22 bp, Artificial Sequence
  chemically synthesized
gtggctctatggtaaggtgacc

SEQ ID NO: 1043872 - DNA, 22 bp, Artificial Sequence
  chemically synthesized
tatggtaaggtgaccttttaat

SEQ ID NO: 1043873 - DNA, 22 bp, Artificial Sequence
  chemically synthesized
tggtaaggtgaccttttaattt

SEQ ID NO: 1043874 - DNA, 22 bp, Artificial Sequence
  chemically synthesized
ttaattttttcttcatggttta

SEQ ID NO: 1043875 - DNA, 22 bp, Artificial Sequence
  chemically synthesized
acatggggacaataaaccatga

SEQ ID NO: 1043876 - DNA, 22 bp, Artificial Sequence
  chemically synthesized
taattttttcttcatggtttat

SEQ ID NO: 1043877 - DNA, 22 bp, Artificial Sequence
  chemically synthesized
aattttttcttcatggtttatt

SEQ ID NO: 1043878 - DNA, 22 bp, Artificial Sequence
  chemically synthesized
tcacatggggacaataaaccat

SEQ ID NO: 1043879 - DNA, 22 bp, Artificial Sequence
  chemically synthesized
attttttcttcatggtttattg

SEQ ID NO: 1043880 - DNA, 22 bp, Artificial Sequence
  chemically synthesized
ctcacatggggacaataaacca

SEQ ID NO: 1043881 - DNA, 22 bp, Artificial Sequence
  chemically synthesized
tctcacatggggacaataaacc

SEQ ID NO: 1043882 - DNA, 22 bp, Artificial Sequence
  chemically synthesized
tttcttcatggtttattgtccc

SEQ ID NO: 1043883 - DNA, 22 bp, Artificial Sequence
  chemically synthesized
ttcttcatggtttattgtcccc

SEQ ID NO: 1043884 - DNA, 22 bp, Artificial Sequence
  chemically synthesized
tcttcatggtttattgtcccca

SEQ ID NO: 1043885 - DNA, 22 bp, Artificial Sequence
  chemically synthesized
cttcatggtttattgtccccat

SEQ ID NO: 1043886 - DNA, 22 bp, Artificial Sequence
  chemically synthesized
ttcatggtttattgtccccatg

SEQ ID NO: 1043887 - DNA, 22 bp, Artificial Sequence
  chemically synthesized
catggtttattgtccccatgtg

SEQ ID NO: 1043888 - DNA, 22 bp, Artificial Sequence
  chemically synthesized
atggtttattgtccccatgtga

SEQ ID NO: 1043889 - DNA, 22 bp, Artificial Sequence
  chemically synthesized
gaaagtgttttctcacatgggg

SEQ ID NO: 1043890 - DNA, 22 bp, Artificial Sequence
  chemically synthesized
agaaagtgttttctcacatggg

SEQ ID NO: 1043891 - DNA, 22 bp, Artificial Sequence
  chemically synthesized
tgtttagaaagtgttttctcac

SEQ ID NO: 1043892 - DNA, 22 bp, Artificial Sequence
  chemically synthesized
attgtccccatgtgagaaaaca

SEQ ID NO: 1043893 - DNA, 22 bp, Artificial Sequence
  chemically synthesized
ttgtccccatgtgagaaaacac

SEQ ID NO: 1043894 - DNA, 22 bp, Artificial Sequence
  chemically synthesized
tccccatgtgagaaaacacttt

SEQ ID NO: 1043895 - DNA, 22 bp, Artificial Sequence
  chemically synthesized
gtccaaatacgtagctgtgttt

SEQ ID NO: 1043896 - DNA, 22 bp, Artificial Sequence
  chemically synthesized
ggtccaaatacgtagctgtgtt

SEQ ID NO: 1043897 - DNA, 22 bp, Artificial Sequence
  chemically synthesized
tggtccaaatacgtagctgtgt

SEQ ID NO: 1043898 - DNA, 22 bp, Artificial Sequence
  chemically synthesized
tctaaacacagctacgtatttg

SEQ ID NO: 1043899 - DNA, 22 bp, Artificial Sequence
  chemically synthesized
ctaaacacagctacgtatttgg

SEQ ID NO: 1043900 - DNA, 22 bp, Artificial Sequence
  chemically synthesized
taaacacagctacgtatttgga

SEQ ID NO: 1043901 - DNA, 22 bp, Artificial Sequence
  chemically synthesized
aacacagctacgtatttggacc

SEQ ID NO: 1043902 - DNA, 22 bp, Artificial Sequence
  chemically synthesized
tgaagaatattttggtccaaat

SEQ ID NO: 1043903 - DNA, 22 bp, Artificial Sequence
  chemically synthesized
cgtatttggaccaaaatattct

SEQ ID NO: 1043904 - DNA, 22 bp, Artificial Sequence
  chemically synthesized
ggaccaaaatattcttcatagg

SEQ ID NO: 1043905 - DNA, 22 bp, Artificial Sequence
  chemically synthesized
gaccaaaatattcttcatagga

SEQ ID NO: 1043906 - DNA, 22 bp, Artificial Sequence
  chemically synthesized
tgcaaagacaatgcatcatcct

SEQ ID NO: 1043907 - DNA, 22 bp, Artificial Sequence
  chemically synthesized
atgcaaagacaatgcatcatcc

SEQ ID NO: 1043908 - DNA, 22 bp, Artificial Sequence
  chemically synthesized
tttatgcaaagacaatgcatca

SEQ ID NO: 1043909 - DNA, 22 bp, Artificial Sequence
  chemically synthesized
ttcataggatgatgcattgtct

SEQ ID NO: 1043910 - DNA, 22 bp, Artificial Sequence
  chemically synthesized
gttatttatgcaaagacaatgc

SEQ ID NO: 1043911 - DNA, 22 bp, Artificial Sequence
  chemically synthesized
cataggatgatgcattgtcttt

SEQ ID NO: 1043912 - DNA, 22 bp, Artificial Sequence
  chemically synthesized
ataggatgatgcattgtctttg

SEQ ID NO: 1043913 - DNA, 22 bp, Artificial Sequence
  chemically synthesized
attcgttatttatgcaaagaca

SEQ ID NO: 1043914 - DNA, 22 bp, Artificial Sequence
  chemically synthesized
ctgattcgttatttatgcaaag

SEQ ID NO: 1043915 - DNA, 22 bp, Artificial Sequence
  chemically synthesized
tctttgcataaataacgaatca

SEQ ID NO: 1043916 - DNA, 22 bp, Artificial Sequence
  chemically synthesized
tgcataaataacgaatcagtaa

SEQ ID NO: 1043917 - DNA, 22 bp, Artificial Sequence
  chemically synthesized
gcataaataacgaatcagtaat

SEQ ID NO: 1043918 - DNA, 22 bp, Artificial Sequence
  chemically synthesized
cataaataacgaatcagtaatt

SEQ ID NO: 1043919 - DNA, 22 bp, Artificial Sequence
  chemically synthesized
tgtgtgatatataattactgat

SEQ ID NO: 1043920 - DNA, 22 bp, Artificial Sequence
  chemically synthesized
atgtgtgatatataattactga

SEQ ID NO: 1043921 - DNA, 22 bp, Artificial Sequence
  chemically synthesized
tatgtgtgatatataattactg

SEQ ID NO: 1043922 - DNA, 22 bp, Artificial Sequence
  chemically synthesized
ttatgtgtgatatataattact

SEQ ID NO: 1043923 - DNA, 22 bp, Artificial Sequence
  chemically synthesized
tttatgtgtgatatataattac

SEQ ID NO: 1043924 - DNA, 22 bp, Artificial Sequence
  chemically synthesized
taatgtcgttttttatgtgtga

SEQ ID NO: 1043925 - DNA, 22 bp, Artificial Sequence
  chemically synthesized
tatatcacacataaaaaacgac

SEQ ID NO: 1043926 - DNA, 22 bp, Artificial Sequence
  chemically synthesized
gaccagttataatgtcgttttt

SEQ ID NO: 1043927 - DNA, 22 bp, Artificial Sequence
  chemically synthesized
cgaccagttataatgtcgtttt

SEQ ID NO: 1043928 - DNA, 22 bp, Artificial Sequence
  chemically synthesized
tgcttcgaccagttataatgtc

SEQ ID NO: 1043929 - DNA, 22 bp, Artificial Sequence
  chemically synthesized
aagctgtgcttcgaccagttat

SEQ ID NO: 1043930 - DNA, 22 bp, Artificial Sequence
  chemically synthesized
acaaacggttgaagctgtgctt

SEQ ID NO: 1043931 - DNA, 22 bp, Artificial Sequence
  chemically synthesized
taactggtcgaagcacagcttc

SEQ ID NO: 1043932 - DNA, 22 bp, Artificial Sequence
  chemically synthesized
ttcacaaacggttgaagctgtg

SEQ ID NO: 1043933 - DNA, 22 bp, Artificial Sequence
  chemically synthesized
attcacaaacggttgaagctgt

SEQ ID NO: 1043934 - DNA, 22 bp, Artificial Sequence
  chemically synthesized
tattcacaaacggttgaagctg

SEQ ID NO: 1043935 - DNA, 22 bp, Artificial Sequence
  chemically synthesized
ttattcacaaacggttgaagct

SEQ ID NO: 1043936 - DNA, 22 bp, Artificial Sequence
  chemically synthesized
gtcgaagcacagcttcaaccgt

SEQ ID NO: 1043937 - DNA, 22 bp, Artificial Sequence
  chemically synthesized
cttttattcacaaacggttgaa

SEQ ID NO: 1043938 - DNA, 22 bp, Artificial Sequence
  chemically synthesized
ccttttattcacaaacggttga

SEQ ID NO: 1043939 - DNA, 22 bp, Artificial Sequence
  chemically synthesized
tccttttattcacaaacggttg

SEQ ID NO: 1043940 - DNA, 22 bp, Artificial Sequence
  chemically synthesized
tggggaggttttccttttattc

SEQ ID NO: 1043941 - DNA, 22 bp, Artificial Sequence
  chemically synthesized
caaccgtttgtgaataaaagga

SEQ ID NO: 1043942 - DNA, 22 bp, Artificial Sequence
  chemically synthesized
aaccgtttgtgaataaaaggaa

SEQ ID NO: 1043943 - DNA, 22 bp, Artificial Sequence
  chemically synthesized
agttgtggggaggttttccttt

SEQ ID NO: 1043944 - DNA, 22 bp, Artificial Sequence
  chemically synthesized
gtgaataaaaggaaaacctccc

SEQ ID NO: 1043945 - DNA, 22 bp, Artificial Sequence
  chemically synthesized
tgaataaaaggaaaacctcccc

SEQ ID NO: 1043946 - DNA, 22 bp, Artificial Sequence
  chemically synthesized
cagttaagttgtggggaggttt

SEQ ID NO: 1043947 - DNA, 22 bp, Artificial Sequence
  chemically synthesized
aagttgcagttaagttgtgggg

SEQ ID NO: 1043948 - DNA, 22 bp, Artificial Sequence
  chemically synthesized
gaagttgcagttaagttgtggg

SEQ ID NO: 1043949 - DNA, 22 bp, Artificial Sequence
  chemically synthesized
tgaagttgcagttaagttgtgg

SEQ ID NO: 1043950 - DNA, 22 bp, Artificial Sequence
  chemically synthesized
gtagaaattttgaagttgcagt

SEQ ID NO: 1043951 - DNA, 22 bp, Artificial Sequence
  chemically synthesized
cccacaacttaactgcaacttc

SEQ ID NO: 1043952 - DNA, 22 bp, Artificial Sequence
  chemically synthesized
aactgcaacttcaaaatttcta

SEQ ID NO: 1043953 - DNA, 22 bp, Artificial Sequence
  chemically synthesized
actgcaacttcaaaatttctac

SEQ ID NO: 1043954 - DNA, 22 bp, Artificial Sequence
  chemically synthesized
caaatcatgaggctggtagaaa

SEQ ID NO: 1043955 - DNA, 22 bp, Artificial Sequence
  chemically synthesized
caacttcaaaatttctaccagc

SEQ ID NO: 1043956 - DNA, 22 bp, Artificial Sequence
  chemically synthesized
acaaatcatgaggctggtagaa

SEQ ID NO: 1043957 - DNA, 22 bp, Artificial Sequence
  chemically synthesized
caaaatttctaccagcctcatg

SEQ ID NO: 1043958 - DNA, 22 bp, Artificial Sequence
  chemically synthesized
aaacttacaaatcatgaggctg

SEQ ID NO: 1043959 - DNA, 22 bp, Artificial Sequence
  chemically synthesized
aaaatttctaccagcctcatga

SEQ ID NO: 1043960 - DNA, 22 bp, Artificial Sequence
  chemically synthesized
catattaaaacttacaaatcat

SEQ ID NO: 1043961 - DNA, 22 bp, Artificial Sequence
  chemically synthesized
ctaccagcctcatgatttgtaa

SEQ ID NO: 1043962 - DNA, 22 bp, Artificial Sequence
  chemically synthesized
ccatattaaaacttacaaatca

SEQ ID NO: 1043963 - DNA, 22 bp, Artificial Sequence
  chemically synthesized
taccagcctcatgatttgtaag

SEQ ID NO: 1043964 - DNA, 22 bp, Artificial Sequence
  chemically synthesized
ccagcctcatgatttgtaagtt

SEQ ID NO: 1043965 - DNA, 22 bp, Artificial Sequence
  chemically synthesized
atgatttgtaagttttaatatg

SEQ ID NO: 1043966 - DNA, 22 bp, Artificial Sequence
  chemically synthesized
gtaagttttaatatggaagttt

SEQ ID NO: 1043967 - DNA, 22 bp, Artificial Sequence
  chemically synthesized
taagttttaatatggaagtttc

SEQ ID NO: 1043968 - DNA, 22 bp, Artificial Sequence
  chemically synthesized
taatatggaagtttctgctttc

SEQ ID NO: 1043969 - DNA, 22 bp, Artificial Sequence
  chemically synthesized
aatatggaagtttctgctttct

SEQ ID NO: 1043970 - DNA, 22 bp, Artificial Sequence
  chemically synthesized
atatggaagtttctgctttcta

SEQ ID NO: 1043971 - DNA, 22 bp, Artificial Sequence
  chemically synthesized
ataatccccatcgtgtaaagtg

SEQ ID NO: 1043972 - DNA, 22 bp, Artificial Sequence
  chemically synthesized
cataatccccatcgtgtaaagt

SEQ ID NO: 1043973 - DNA, 22 bp, Artificial Sequence
  chemically synthesized
ctgctttctacactttacacga

SEQ ID NO: 1043974 - DNA, 22 bp, Artificial Sequence
  chemically synthesized
tcataatccccatcgtgtaaag

SEQ ID NO: 1043975 - DNA, 22 bp, Artificial Sequence
  chemically synthesized
tgctttctacactttacacgat

SEQ ID NO: 1043976 - DNA, 22 bp, Artificial Sequence
  chemically synthesized
ctttctacactttacacgatgg

SEQ ID NO: 1043977 - DNA, 22 bp, Artificial Sequence
  chemically synthesized
ttttcataatccccatcgtgta

SEQ ID NO: 1043978 - DNA, 22 bp, Artificial Sequence
  chemically synthesized
tctacactttacacgatgggga

SEQ ID NO: 1043979 - DNA, 22 bp, Artificial Sequence
  chemically synthesized
ctacactttacacgatggggat

SEQ ID NO: 1043980 - DNA, 22 bp, Artificial Sequence
  chemically synthesized
tacactttacacgatggggatt

SEQ ID NO: 1043981 - DNA, 22 bp, Artificial Sequence
  chemically synthesized
cactttacacgatggggattat

SEQ ID NO: 1043982 - DNA, 22 bp, Artificial Sequence
  chemically synthesized
tacacgatggggattatgaaaa

SEQ ID NO: 1043983 - DNA, 22 bp, Artificial Sequence
  chemically synthesized
ccagcagcactgttttcataat

SEQ ID NO: 1043984 - DNA, 22 bp, Artificial Sequence
  chemically synthesized
acacgatggggattatgaaaac

SEQ ID NO: 1043985 - DNA, 22 bp, Artificial Sequence
  chemically synthesized
cacgatggggattatgaaaaca

SEQ ID NO: 1043986 - DNA, 22 bp, Artificial Sequence
  chemically synthesized
tcccagcagcactgttttcata

SEQ ID NO: 1043987 - DNA, 22 bp, Artificial Sequence
  chemically synthesized
cattctcccagcagcactgttt

SEQ ID NO: 1043988 - DNA, 22 bp, Artificial Sequence
  chemically synthesized
ccattctcccagcagcactgtt

SEQ ID NO: 1043989 - DNA, 22 bp, Artificial Sequence
  chemically synthesized
cttccattctcccagcagcact

SEQ ID NO: 1043990 - DNA, 22 bp, Artificial Sequence
  chemically synthesized
ctccttccattctcccagcagc

SEQ ID NO: 1043991 - DNA, 22 bp, Artificial Sequence
  chemically synthesized
tgaaaacagtgctgctgggaga

SEQ ID NO: 1043992 - DNA, 22 bp, Artificial Sequence
  chemically synthesized
ctactccttccattctcccagc

SEQ ID NO: 1043993 - DNA, 22 bp, Artificial Sequence
  chemically synthesized
agaacgcactcctactccttcc

SEQ ID NO: 1043994 - DNA, 22 bp, Artificial Sequence
  chemically synthesized
aagaacgcactcctactccttc

SEQ ID NO: 1043995 - DNA, 22 bp, Artificial Sequence
  chemically synthesized
ctgggagaatggaaggagtagg

SEQ ID NO: 1043996 - DNA, 22 bp, Artificial Sequence
  chemically synthesized
taagaacgcactcctactcctt

SEQ ID NO: 1043997 - DNA, 22 bp, Artificial Sequence
  chemically synthesized
ggagaatggaaggagtaggagt

SEQ ID NO: 1043998 - DNA, 22 bp, Artificial Sequence
  chemically synthesized
aaatgtactttaagaacgcact

SEQ ID NO: 1043999 - DNA, 22 bp, Artificial Sequence
  chemically synthesized
ctaaaatgtactttaagaacgc

SEQ ID NO: 1044000 - DNA, 22 bp, Artificial Sequence
  chemically synthesized
tgctaaaatgtactttaagaac

SEQ ID NO: 1044001 - DNA, 22 bp, Artificial Sequence
  chemically synthesized
ccaactctgctaaaatgtactt

SEQ ID NO: 1044002 - DNA, 22 bp, Artificial Sequence
  chemically synthesized
ctcccaactctgctaaaatgta

SEQ ID NO: 1044003 - DNA, 22 bp, Artificial Sequence
  chemically synthesized
actcccaactctgctaaaatgt

SEQ ID NO: 1044004 - DNA, 22 bp, Artificial Sequence
  chemically synthesized
ttaaagtacattttagcagagt

SEQ ID NO: 1044005 - DNA, 22 bp, Artificial Sequence
  chemically synthesized
caatttactcccaactctgcta

SEQ ID NO: 1044006 - DNA, 22 bp, Artificial Sequence
  chemically synthesized
aaagtacattttagcagagttg

SEQ ID NO: 1044007 - DNA, 22 bp, Artificial Sequence
  chemically synthesized
aagtacattttagcagagttgg

SEQ ID NO: 1044008 - DNA, 22 bp, Artificial Sequence
  chemically synthesized
tgctgcaatttactcccaactc

SEQ ID NO: 1044009 - DNA, 22 bp, Artificial Sequence
  chemically synthesized
ttatgctgcaatttactcccaa

SEQ ID NO: 1044010 - DNA, 22 bp, Artificial Sequence
  chemically synthesized
tagcagagttgggagtaaattg

SEQ ID NO: 1044011 - DNA, 22 bp, Artificial Sequence
  chemically synthesized
actattatgctgcaatttactc

SEQ ID NO: 1044012 - DNA, 22 bp, Artificial Sequence
  chemically synthesized
agcagagttgggagtaaattgc

SEQ ID NO: 1044013 - DNA, 22 bp, Artificial Sequence
  chemically synthesized
gactattatgctgcaatttact

SEQ ID NO: 1044014 - DNA, 22 bp, Artificial Sequence
  chemically synthesized
gcagagttgggagtaaattgca

SEQ ID NO: 1044015 - DNA, 22 bp, Artificial Sequence
  chemically synthesized
ccttgactattatgctgcaatt

SEQ ID NO: 1044016 - DNA, 22 bp, Artificial Sequence
  chemically synthesized
tcctaccttgactattatgctg

SEQ ID NO: 1044017 - DNA, 22 bp, Artificial Sequence
  chemically synthesized
ggagtaaattgcagcataatag

SEQ ID NO: 1044018 - DNA, 22 bp, Artificial Sequence
  chemically synthesized
gcagttgtcctaccttgactat

SEQ ID NO: 1044019 - DNA, 22 bp, Artificial Sequence
  chemically synthesized
cagcataatagtcaaggtagga

SEQ ID NO: 1044020 - DNA, 22 bp, Artificial Sequence
  chemically synthesized
tcaagcctagcagttgtcctac

SEQ ID NO: 1044021 - DNA, 22 bp, Artificial Sequence
  chemically synthesized
atcaagcctagcagttgtccta

SEQ ID NO: 1044022 - DNA, 22 bp, Artificial Sequence
  chemically synthesized
tatcaagcctagcagttgtcct

SEQ ID NO: 1044023 - DNA, 22 bp, Artificial Sequence
  chemically synthesized
ttttatcaagcctagcagttgt

SEQ ID NO: 1044024 - DNA, 22 bp, Artificial Sequence
  chemically synthesized
tccccaaccattattttatcaa

SEQ ID NO: 1044025 - DNA, 22 bp, Artificial Sequence
  chemically synthesized
atccccaaccattattttatca

SEQ ID NO: 1044026 - DNA, 22 bp, Artificial Sequence
  chemically synthesized
tatccccaaccattattttatc

SEQ ID NO: 1044027 - DNA, 22 bp, Artificial Sequence
  chemically synthesized
tttatccccaaccattatttta

SEQ ID NO: 1044028 - DNA, 22 bp, Artificial Sequence
  chemically synthesized
ctaggcttgataaaataatggt

SEQ ID NO: 1044029 - DNA, 22 bp, Artificial Sequence
  chemically synthesized
ggcttgataaaataatggttgg

SEQ ID NO: 1044030 - DNA, 22 bp, Artificial Sequence
  chemically synthesized
tccattctttatccccaaccat

SEQ ID NO: 1044031 - DNA, 22 bp, Artificial Sequence
  chemically synthesized
gataaaataatggttggggata

SEQ ID NO: 1044032 - DNA, 22 bp, Artificial Sequence
  chemically synthesized
ataaaataatggttggggataa

SEQ ID NO: 1044033 - DNA, 22 bp, Artificial Sequence
  chemically synthesized
taggaaattatccattctttat

SEQ ID NO: 1044034 - DNA, 22 bp, Artificial Sequence
  chemically synthesized
gtaggaaattatccattcttta

SEQ ID NO: 1044035 - DNA, 22 bp, Artificial Sequence
  chemically synthesized
ttgtaggaaattatccattctt

SEQ ID NO: 1044036 - DNA, 22 bp, Artificial Sequence
  chemically synthesized
tcttgtaggaaattatccattc

SEQ ID NO: 1044037 - DNA, 22 bp, Artificial Sequence
  chemically synthesized
gggataaagaatggataatttc

SEQ ID NO: 1044038 - DNA, 22 bp, Artificial Sequence
  chemically synthesized
tacaaatctctcttgtaggaaa

SEQ ID NO: 1044039 - DNA, 22 bp, Artificial Sequence
  chemically synthesized
atacaaatctctcttgtaggaa

SEQ ID NO: 1044040 - DNA, 22 bp, Artificial Sequence
  chemically synthesized
tatacaaatctctcttgtagga

SEQ ID NO: 1044041 - DNA, 22 bp, Artificial Sequence
  chemically synthesized
tattttatacaaatctctcttg

SEQ ID NO: 1044042 - DNA, 22 bp, Artificial Sequence
  chemically synthesized
atattttatacaaatctctctt

SEQ ID NO: 1044043 - DNA, 22 bp, Artificial Sequence
  chemically synthesized
tatattttatacaaatctctct

SEQ ID NO: 1044044 - DNA, 22 bp, Artificial Sequence
  chemically synthesized
ttatattttatacaaatctctc

SEQ ID NO: 1044045 - DNA, 22 bp, Artificial Sequence
  chemically synthesized
ttttatattttatacaaatctc

SEQ ID NO: 1044046 - DNA, 22 bp, Artificial Sequence
  chemically synthesized
cttttatattttatacaaatct

SEQ ID NO: 1044047 - DNA, 22 bp, Artificial Sequence
  chemically synthesized
tcttttatattttatacaaatc

SEQ ID NO: 1044048 - DNA, 22 bp, Artificial Sequence
  chemically synthesized
cctacaagagagatttgtataa

SEQ ID NO: 1044049 - DNA, 22 bp, Artificial Sequence
  chemically synthesized
ctacaagagagatttgtataaa

SEQ ID NO: 1044050 - DNA, 22 bp, Artificial Sequence
  chemically synthesized
caagagagatttgtataaaata

SEQ ID NO: 1044051 - DNA, 22 bp, Artificial Sequence
  chemically synthesized
ggtacagttttcttttatattt

SEQ ID NO: 1044052 - DNA, 22 bp, Artificial Sequence
  chemically synthesized
cggtacagttttcttttatatt

SEQ ID NO: 1044053 - DNA, 22 bp, Artificial Sequence
  chemically synthesized
gtataaaatataaaagaaaact

SEQ ID NO: 1044054 - DNA, 22 bp, Artificial Sequence
  chemically synthesized
tataaaatataaaagaaaactg

SEQ ID NO: 1044055 - DNA, 22 bp, Artificial Sequence
  chemically synthesized
tatgtgcttcggtacagttttc

SEQ ID NO: 1044056 - DNA, 22 bp, Artificial Sequence
  chemically synthesized
atatgtgcttcggtacagtttt

SEQ ID NO: 1044057 - DNA, 22 bp, Artificial Sequence
  chemically synthesized
atatttatatgtgcttcggtac

SEQ ID NO: 1044058 - DNA, 22 bp, Artificial Sequence
  chemically synthesized
taccgaagcacatataaatatg

SEQ ID NO: 1044059 - DNA, 22 bp, Artificial Sequence
  chemically synthesized
agtcatgcccagctcatattta

SEQ ID NO: 1044060 - DNA, 22 bp, Artificial Sequence
  chemically synthesized
cagtcatgcccagctcatattt

SEQ ID NO: 1044061 - DNA, 22 bp, Artificial Sequence
  chemically synthesized
tcagtcatgcccagctcatatt

SEQ ID NO: 1044062 - DNA, 22 bp, Artificial Sequence
  chemically synthesized
cctttcagtcatgcccagctca

SEQ ID NO: 1044063 - DNA, 22 bp, Artificial Sequence
  chemically synthesized
ctgcctttcagtcatgcccagc

SEQ ID NO: 1044064 - DNA, 22 bp, Artificial Sequence
  chemically synthesized
actgcctttcagtcatgcccag

SEQ ID NO: 1044065 - DNA, 22 bp, Artificial Sequence
  chemically synthesized
tagatatttactgcctttcagt

SEQ ID NO: 1044066 - DNA, 22 bp, Artificial Sequence
  chemically synthesized
ggcatgactgaaaggcagtaaa

SEQ ID NO: 1044067 - DNA, 22 bp, Artificial Sequence
  chemically synthesized
tagagaagagattatagatatt

SEQ ID NO: 1044068 - DNA, 22 bp, Artificial Sequence
  chemically synthesized
aaaggcagtaaatatctataat

SEQ ID NO: 1044069 - DNA, 22 bp, Artificial Sequence
  chemically synthesized
tactatagagaagagattatag

SEQ ID NO: 1044070 - DNA, 22 bp, Artificial Sequence
  chemically synthesized
gtactatagagaagagattata

SEQ ID NO: 1044071 - DNA, 22 bp, Artificial Sequence
  chemically synthesized
tatgaaaagatttgtactatag

SEQ ID NO: 1044072 - DNA, 22 bp, Artificial Sequence
  chemically synthesized
taatctcttctctatagtacaa

SEQ ID NO: 1044073 - DNA, 22 bp, Artificial Sequence
  chemically synthesized
tattatatgaaaagatttgtac

SEQ ID NO: 1044074 - DNA, 22 bp, Artificial Sequence
  chemically synthesized
gtattatatgaaaagatttgta

SEQ ID NO: 1044075 - DNA, 22 bp, Artificial Sequence
  chemically synthesized
ttctctatagtacaaatctttt

SEQ ID NO: 1044076 - DNA, 22 bp, Artificial Sequence
  chemically synthesized
ctctatagtacaaatcttttca

SEQ ID NO: 1044077 - DNA, 22 bp, Artificial Sequence
  chemically synthesized
atttgtattatatgaaaagatt

SEQ ID NO: 1044078 - DNA, 22 bp, Artificial Sequence
  chemically synthesized
tctatagtacaaatcttttcat

SEQ ID NO: 1044079 - DNA, 22 bp, Artificial Sequence
  chemically synthesized
catttgtattatatgaaaagat

SEQ ID NO: 1044080 - DNA, 22 bp, Artificial Sequence
  chemically synthesized
tcatttgtattatatgaaaaga

SEQ ID NO: 1044081 - DNA, 22 bp, Artificial Sequence
  chemically synthesized
tatagtacaaatcttttcatat

SEQ ID NO: 1044082 - DNA, 22 bp, Artificial Sequence
  chemically synthesized
ttcatttgtattatatgaaaag

SEQ ID NO: 1044083 - DNA, 22 bp, Artificial Sequence
  chemically synthesized
tagtacaaatcttttcatataa

SEQ ID NO: 1044084 - DNA, 22 bp, Artificial Sequence
  chemically synthesized
tttttcatttgtattatatgaa

SEQ ID NO: 1044085 - DNA, 22 bp, Artificial Sequence
  chemically synthesized
ttcatataatacaaatgaaaaa

SEQ ID NO: 1044086 - DNA, 22 bp, Artificial Sequence
  chemically synthesized
catagtacattatttttcattt

SEQ ID NO: 1044087 - DNA, 22 bp, Artificial Sequence
  chemically synthesized
tcatataatacaaatgaaaaat

SEQ ID NO: 1044088 - DNA, 22 bp, Artificial Sequence
  chemically synthesized
ccatagtacattatttttcatt

SEQ ID NO: 1044089 - DNA, 22 bp, Artificial Sequence
  chemically synthesized
catataatacaaatgaaaaata

SEQ ID NO: 1044090 - DNA, 22 bp, Artificial Sequence
  chemically synthesized
atataatacaaatgaaaaataa

SEQ ID NO: 1044091 - DNA, 22 bp, Artificial Sequence
  chemically synthesized
tttccatagtacattatttttc

SEQ ID NO: 1044092 - DNA, 22 bp, Artificial Sequence
  chemically synthesized
aattatttccatagtacattat

SEQ ID NO: 1044093 - DNA, 22 bp, Artificial Sequence
  chemically synthesized
aaattatttccatagtacatta

SEQ ID NO: 1044094 - DNA, 22 bp, Artificial Sequence
  chemically synthesized
aatcatgcttaaattatttcca

SEQ ID NO: 1044095 - DNA, 22 bp, Artificial Sequence
  chemically synthesized
aaatcatgcttaaattatttcc

SEQ ID NO: 1044096 - DNA, 22 bp, Artificial Sequence
  chemically synthesized
tagtttaaatcatgcttaaatt

SEQ ID NO: 1044097 - DNA, 22 bp, Artificial Sequence
  chemically synthesized
actgtagtttaaatcatgctta

SEQ ID NO: 1044098 - DNA, 22 bp, Artificial Sequence
  chemically synthesized
tggaaataatttaagcatgatt

SEQ ID NO: 1044099 - DNA, 22 bp, Artificial Sequence
  chemically synthesized
atcattaactgtagtttaaatc

SEQ ID NO: 1044100 - DNA, 22 bp, Artificial Sequence
  chemically synthesized
aagcatgatttaaactacagtt

SEQ ID NO: 1044101 - DNA, 22 bp, Artificial Sequence
  chemically synthesized
agcatgatttaaactacagtta

SEQ ID NO: 1044102 - DNA, 22 bp, Artificial Sequence
  chemically synthesized
aaatattaatcattaactgtag

SEQ ID NO: 1044103 - DNA, 22 bp, Artificial Sequence
  chemically synthesized
caaatattaatcattaactgta

SEQ ID NO: 1044104 - DNA, 22 bp, Artificial Sequence
  chemically synthesized
tcaaatattaatcattaactgt

SEQ ID NO: 1044105 - DNA, 22 bp, Artificial Sequence
  chemically synthesized
aaactacagttaatgattaata

SEQ ID NO: 1044106 - DNA, 22 bp, Artificial Sequence
  chemically synthesized
aactacagttaatgattaatat

SEQ ID NO: 1044107 - DNA, 22 bp, Artificial Sequence
  chemically synthesized
cagttaatgattaatatttgaa

SEQ ID NO: 1044108 - DNA, 22 bp, Artificial Sequence
  chemically synthesized
atgattaatatttgaaaataca

SEQ ID NO: 1044109 - DNA, 22 bp, Artificial Sequence
  chemically synthesized
tatataaatgtgtgtattttca

SEQ ID NO: 1044110 - DNA, 22 bp, Artificial Sequence
  chemically synthesized
ctatatataaatgtgtgtattt

SEQ ID NO: 1044111 - DNA, 22 bp, Artificial Sequence
  chemically synthesized
gctatatataaatgtgtgtatt

SEQ ID NO: 1044112 - DNA, 22 bp, Artificial Sequence
  chemically synthesized
atatttgaaaatacacacattt

SEQ ID NO: 1044113 - DNA, 22 bp, Artificial Sequence
  chemically synthesized
atttgctatatataaatgtgtg

SEQ ID NO: 1044114 - DNA, 22 bp, Artificial Sequence
  chemically synthesized
attgatttgctatatataaatg

SEQ ID NO: 1044115 - DNA, 22 bp, Artificial Sequence
  chemically synthesized
gaaaatacacacatttatatat

SEQ ID NO: 1044116 - DNA, 22 bp, Artificial Sequence
  chemically synthesized
gattgatttgctatatataaat

SEQ ID NO: 1044117 - DNA, 22 bp, Artificial Sequence
  chemically synthesized
aaaatacacacatttatatata

SEQ ID NO: 1044118 - DNA, 22 bp, Artificial Sequence
  chemically synthesized
tttgattgatttgctatatata

SEQ ID NO: 1044119 - DNA, 22 bp, Artificial Sequence
  chemically synthesized
atttgattgatttgctatatat

SEQ ID NO: 1044120 - DNA, 22 bp, Artificial Sequence
  chemically synthesized
ggatttatttgattgatttgct

SEQ ID NO: 1044121 - DNA, 22 bp, Artificial Sequence
  chemically synthesized
gggatttatttgattgatttgc

SEQ ID NO: 1044122 - DNA, 22 bp, Artificial Sequence
  chemically synthesized
atatatagcaaatcaatcaaat

SEQ ID NO: 1044123 - DNA, 22 bp, Artificial Sequence
  chemically synthesized
tatatagcaaatcaatcaaata

SEQ ID NO: 1044124 - DNA, 22 bp, Artificial Sequence
  chemically synthesized
tatgacttgggatttatttgat

SEQ ID NO: 1044125 - DNA, 22 bp, Artificial Sequence
  chemically synthesized
atatgacttgggatttatttga

SEQ ID NO: 1044126 - DNA, 22 bp, Artificial Sequence
  chemically synthesized
aacagcttatatgacttgggat

SEQ ID NO: 1044127 - DNA, 22 bp, Artificial Sequence
  chemically synthesized
caacagcttatatgacttggga

SEQ ID NO: 1044128 - DNA, 22 bp, Artificial Sequence
  chemically synthesized
ttcaacagcttatatgacttgg

SEQ ID NO: 1044129 - DNA, 22 bp, Artificial Sequence
  chemically synthesized
cttcaacagcttatatgacttg

SEQ ID NO: 1044130 - DNA, 22 bp, Artificial Sequence
  chemically synthesized
tttcttcaacagcttatatgac

SEQ ID NO: 1044131 - DNA, 22 bp, Artificial Sequence
  chemically synthesized
gtttcttcaacagcttatatga

SEQ ID NO: 1044132 - DNA, 22 bp, Artificial Sequence
  chemically synthesized
taaatataatttgtttcttcaa

SEQ ID NO: 1044133 - DNA, 22 bp, Artificial Sequence
  chemically synthesized
gttataaatataatttgtttct

SEQ ID NO: 1044134 - DNA, 22 bp, Artificial Sequence
  chemically synthesized
ggttataaatataatttgtttc

SEQ ID NO: 1044135 - DNA, 22 bp, Artificial Sequence
  chemically synthesized
tttggttataaatataatttgt

SEQ ID NO: 1044136 - DNA, 22 bp, Artificial Sequence
  chemically synthesized
atttggttataaatataatttg

SEQ ID NO: 1044137 - DNA, 22 bp, Artificial Sequence
  chemically synthesized
ttgaagaaacaaattatattta

SEQ ID NO: 1044138 - DNA, 22 bp, Artificial Sequence
  chemically synthesized
aagaaacaaattatatttataa

SEQ ID NO: 1044139 - DNA, 22 bp, Artificial Sequence
  chemically synthesized
aacacatttatttggttataaa

SEQ ID NO: 1044140 - DNA, 22 bp, Artificial Sequence
  chemically synthesized
caacacatttatttggttataa

SEQ ID NO: 1044141 - DNA, 22 bp, Artificial Sequence
  chemically synthesized
tcaacacatttatttggttata

SEQ ID NO: 1044142 - DNA, 22 bp, Artificial Sequence
  chemically synthesized
ttcaacacatttatttggttat

SEQ ID NO: 1044143 - DNA, 22 bp, Artificial Sequence
  chemically synthesized
agtttttcaacacatttatttg

SEQ ID NO: 1044144 - DNA, 22 bp, Artificial Sequence
  chemically synthesized
tatttataaccaaataaatgtg

SEQ ID NO: 1044145 - DNA, 22 bp, Artificial Sequence
  chemically synthesized
ataaccaaataaatgtgttgaa

SEQ ID NO: 1044146 - DNA, 22 bp, Artificial Sequence
  chemically synthesized
taaccaaataaatgtgttgaaa

SEQ ID NO: 1044147 - DNA, 22 bp, Artificial Sequence
  chemically synthesized
gaaaaattgagtttttcaacac

SEQ ID NO: 1044148 - DNA, 22 bp, Artificial Sequence
  chemically synthesized
agaaaaattgagtttttcaaca

SEQ ID NO: 1044149 - DNA, 22 bp, Artificial Sequence
  chemically synthesized
ttagaaaaattgagtttttcaa

SEQ ID NO: 1044150 - DNA, 22 bp, Artificial Sequence
  chemically synthesized
tcttagaaaaattgagtttttc

SEQ ID NO: 1044151 - DNA, 22 bp, Artificial Sequence
  chemically synthesized
ctcttagaaaaattgagttttt

SEQ ID NO: 1044152 - DNA, 22 bp, Artificial Sequence
  chemically synthesized
aaaaactcaatttttctaagag

SEQ ID NO: 1044153 - DNA, 22 bp, Artificial Sequence
  chemically synthesized
aatttttctaagagaaaccact

SEQ ID NO: 1044154 - DNA, 22 bp, Artificial Sequence
  chemically synthesized
caataatgtgatcagtggtttc

SEQ ID NO: 1044155 - DNA, 22 bp, Artificial Sequence
  chemically synthesized
gcaataatgtgatcagtggttt

SEQ ID NO: 1044156 - DNA, 22 bp, Artificial Sequence
  chemically synthesized
ttctaagagaaaccactgatca

SEQ ID NO: 1044157 - DNA, 22 bp, Artificial Sequence
  chemically synthesized
tctaagagaaaccactgatcac

SEQ ID NO: 1044158 - DNA, 22 bp, Artificial Sequence
  chemically synthesized
ctaagagaaaccactgatcaca

SEQ ID NO: 1044159 - DNA, 22 bp, Artificial Sequence
  chemically synthesized
taagagaaaccactgatcacat

SEQ ID NO: 1044160 - DNA, 22 bp, Artificial Sequence
  chemically synthesized
agagaaaccactgatcacatta

SEQ ID NO: 1044161 - DNA, 22 bp, Artificial Sequence
  chemically synthesized
tacataaacatttgcaataatg

SEQ ID NO: 1044162 - DNA, 22 bp, Artificial Sequence
  chemically synthesized
aactatacataaacatttgcaa

SEQ ID NO: 1044163 - DNA, 22 bp, Artificial Sequence
  chemically synthesized
gaactatacataaacatttgca

SEQ ID NO: 1044164 - DNA, 22 bp, Artificial Sequence
  chemically synthesized
tgaactatacataaacatttgc

SEQ ID NO: 1044165 - DNA, 22 bp, Artificial Sequence
  chemically synthesized
atcacattattgcaaatgttta

SEQ ID NO: 1044166 - DNA, 22 bp, Artificial Sequence
  chemically synthesized
ttgaactatacataaacatttg

SEQ ID NO: 1044167 - DNA, 22 bp, Artificial Sequence
  chemically synthesized
atcttttgaactatacataaac

SEQ ID NO: 1044168 - DNA, 22 bp, Artificial Sequence
  chemically synthesized
ttgcaaatgtttatgtatagtt

SEQ ID NO: 1044169 - DNA, 22 bp, Artificial Sequence
  chemically synthesized
caaatgtttatgtatagttcaa

SEQ ID NO: 1044170 - DNA, 22 bp, Artificial Sequence
  chemically synthesized
tagaaactgatcttttgaacta

SEQ ID NO: 1044171 - DNA, 22 bp, Artificial Sequence
  chemically synthesized
gtagaaactgatcttttgaact

SEQ ID NO: 1044172 - DNA, 22 bp, Artificial Sequence
  chemically synthesized
tgtagaaactgatcttttgaac

SEQ ID NO: 1044173 - DNA, 22 bp, Artificial Sequence
  chemically synthesized
atgtatagttcaaaagatcagt

SEQ ID NO: 1044174 - DNA, 22 bp, Artificial Sequence
  chemically synthesized
tgtatagttcaaaagatcagtt

SEQ ID NO: 1044175 - DNA, 22 bp, Artificial Sequence
  chemically synthesized
tgactttgtagaaactgatctt

SEQ ID NO: 1044176 - DNA, 22 bp, Artificial Sequence
  chemically synthesized
atacattgtgactttgtagaaa

SEQ ID NO: 1044177 - DNA, 22 bp, Artificial Sequence
  chemically synthesized
aaaagatcagtttctacaaagt

SEQ ID NO: 1044178 - DNA, 22 bp, Artificial Sequence
  chemically synthesized
ttaatacattgtgactttgtag

SEQ ID NO: 1044179 - DNA, 22 bp, Artificial Sequence
  chemically synthesized
attaatacattgtgactttgta

SEQ ID NO: 1044180 - DNA, 22 bp, Artificial Sequence
  chemically synthesized
tattaatacattgtgactttgt

SEQ ID NO: 1044181 - DNA, 22 bp, Artificial Sequence
  chemically synthesized
ttattaatacattgtgactttg

SEQ ID NO: 1044182 - DNA, 22 bp, Artificial Sequence
  chemically synthesized
ctacaaagtcacaatgtattaa

SEQ ID NO: 1044183 - DNA, 22 bp, Artificial Sequence
  chemically synthesized
tacaaagtcacaatgtattaat

SEQ ID NO: 1044184 - DNA, 22 bp, Artificial Sequence
  chemically synthesized
caaagtcacaatgtattaataa

SEQ ID NO: 1044185 - DNA, 22 bp, Artificial Sequence
  chemically synthesized
atgcgtggaaaagatgattttt

SEQ ID NO: 1044186 - DNA, 22 bp, Artificial Sequence
  chemically synthesized
aatgcgtggaaaagatgatttt

SEQ ID NO: 1044187 - DNA, 22 bp, Artificial Sequence
  chemically synthesized
acagtttaatgcgtggaaaaga

SEQ ID NO: 1044188 - DNA, 22 bp, Artificial Sequence
  chemically synthesized
ataaaaatcatcttttccacgc

SEQ ID NO: 1044189 - DNA, 22 bp, Artificial Sequence
  chemically synthesized
taacagtttaatgcgtggaaaa

SEQ ID NO: 1044190 - DNA, 22 bp, Artificial Sequence
  chemically synthesized
atagttctaacagtttaatgcg

SEQ ID NO: 1044191 - DNA, 22 bp, Artificial Sequence
  chemically synthesized
aatagttctaacagtttaatgc

SEQ ID NO: 1044192 - DNA, 22 bp, Artificial Sequence
  chemically synthesized
ttccacgcattaaactgttaga

SEQ ID NO: 1044193 - DNA, 22 bp, Artificial Sequence
  chemically synthesized
tccacgcattaaactgttagaa

SEQ ID NO: 1044194 - DNA, 22 bp, Artificial Sequence
  chemically synthesized
atagtttaatagttctaacagt

SEQ ID NO: 1044195 - DNA, 22 bp, Artificial Sequence
  chemically synthesized
ccacgcattaaactgttagaac

SEQ ID NO: 1044196 - DNA, 22 bp, Artificial Sequence
  chemically synthesized
cacgcattaaactgttagaact

SEQ ID NO: 1044197 - DNA, 22 bp, Artificial Sequence
  chemically synthesized
taatagtttaatagttctaaca

SEQ ID NO: 1044198 - DNA, 22 bp, Artificial Sequence
  chemically synthesized
ctaatagtttaatagttctaac

SEQ ID NO: 1044199 - DNA, 22 bp, Artificial Sequence
  chemically synthesized
tctaatagtttaatagttctaa

SEQ ID NO: 1044200 - DNA, 22 bp, Artificial Sequence
  chemically synthesized
aattttctaatagtttaatagt

SEQ ID NO: 1044201 - DNA, 22 bp, Artificial Sequence
  chemically synthesized
aactgttagaactattaaacta

SEQ ID NO: 1044202 - DNA, 22 bp, Artificial Sequence
  chemically synthesized
gagttgaattttctaatagttt

SEQ ID NO: 1044203 - DNA, 22 bp, Artificial Sequence
  chemically synthesized
ttagaactattaaactattaga

SEQ ID NO: 1044204 - DNA, 22 bp, Artificial Sequence
  chemically synthesized
gaactattaaactattagaaaa

SEQ ID NO: 1044205 - DNA, 22 bp, Artificial Sequence
  chemically synthesized
aattcgagttgaattttctaat

SEQ ID NO: 1044206 - DNA, 22 bp, Artificial Sequence
  chemically synthesized
gaattcgagttgaattttctaa

SEQ ID NO: 1044207 - DNA, 22 bp, Artificial Sequence
  chemically synthesized
tgaattcgagttgaattttcta

SEQ ID NO: 1044208 - DNA, 22 bp, Artificial Sequence
  chemically synthesized
ttgaattcgagttgaattttct

SEQ ID NO: 1044209 - DNA, 22 bp, Artificial Sequence
  chemically synthesized
tttgaattcgagttgaattttc

SEQ ID NO: 1044210 - DNA, 22 bp, Artificial Sequence
  chemically synthesized
ttaaactattagaaaattcaac

SEQ ID NO: 1044211 - DNA, 22 bp, Artificial Sequence
  chemically synthesized
aactattagaaaattcaactcg

SEQ ID NO: 1044212 - DNA, 22 bp, Artificial Sequence
  chemically synthesized
ttagaaaattcaactcgaattc

SEQ ID NO: 1044213 - DNA, 22 bp, Artificial Sequence
  chemically synthesized
caaatgctttttgaattcgagt

SEQ ID NO: 1044214 - DNA, 22 bp, Artificial Sequence
  chemically synthesized
gcaaatgctttttgaattcgag

SEQ ID NO: 1044215 - DNA, 22 bp, Artificial Sequence
  chemically synthesized
gaaaattcaactcgaattcaaa

SEQ ID NO: 1044216 - DNA, 22 bp, Artificial Sequence
  chemically synthesized
tttgcaaatgctttttgaattc

SEQ ID NO: 1044217 - DNA, 22 bp, Artificial Sequence
  chemically synthesized
gtttgcaaatgctttttgaatt

SEQ ID NO: 1044218 - DNA, 22 bp, Artificial Sequence
  chemically synthesized
aactcgaattcaaaaagcattt

SEQ ID NO: 1044219 - DNA, 22 bp, Artificial Sequence
  chemically synthesized
gaattcaaaaagcatttgcaaa

SEQ ID NO: 1044220 - DNA, 22 bp, Artificial Sequence
  chemically synthesized
aaagcaaaatttgtttgcaaat

SEQ ID NO: 1044221 - DNA, 22 bp, Artificial Sequence
  chemically synthesized
caaagcaaaatttgtttgcaaa

SEQ ID NO: 1044222 - DNA, 22 bp, Artificial Sequence
  chemically synthesized
aaaaagcatttgcaaacaaatt

SEQ ID NO: 1044223 - DNA, 22 bp, Artificial Sequence
  chemically synthesized
gcaaacaaattttgctttgaaa

SEQ ID NO: 1044224 - DNA, 22 bp, Artificial Sequence
  chemically synthesized
caaacaaattttgctttgaaat

SEQ ID NO: 1044225 - DNA, 22 bp, Artificial Sequence
  chemically synthesized
aataatcatggatcatataaaa

SEQ ID NO: 1044226 - DNA, 22 bp, Artificial Sequence
  chemically synthesized
tgctttgaaattttatatgatc

SEQ ID NO: 1044227 - DNA, 22 bp, Artificial Sequence
  chemically synthesized
taaataatcatggatcatataa

SEQ ID NO: 1044228 - DNA, 22 bp, Artificial Sequence
  chemically synthesized
gctttgaaattttatatgatcc

SEQ ID NO: 1044229 - DNA, 22 bp, Artificial Sequence
  chemically synthesized
ctttgaaattttatatgatcca

SEQ ID NO: 1044230 - DNA, 22 bp, Artificial Sequence
  chemically synthesized
ctctaaataatcatggatcata

SEQ ID NO: 1044231 - DNA, 22 bp, Artificial Sequence
  chemically synthesized
tgaaattttatatgatccatga

SEQ ID NO: 1044232 - DNA, 22 bp, Artificial Sequence
  chemically synthesized
gaaattttatatgatccatgat

SEQ ID NO: 1044233 - DNA, 22 bp, Artificial Sequence
  chemically synthesized
aaattttatatgatccatgatt

SEQ ID NO: 1044234 - DNA, 22 bp, Artificial Sequence
  chemically synthesized
caattactctaaataatcatgg

SEQ ID NO: 1044235 - DNA, 22 bp, Artificial Sequence
  chemically synthesized
tatatgatccatgattatttag

SEQ ID NO: 1044236 - DNA, 22 bp, Artificial Sequence
  chemically synthesized
atatgatccatgattatttaga

SEQ ID NO: 1044237 - DNA, 22 bp, Artificial Sequence
  chemically synthesized
tatgatccatgattatttagag

SEQ ID NO: 1044238 - DNA, 22 bp, Artificial Sequence
  chemically synthesized
gaataagaggacattgcaatta

SEQ ID NO: 1044239 - DNA, 22 bp, Artificial Sequence
  chemically synthesized
tttagagtaattgcaatgtcct

SEQ ID NO: 1044240 - DNA, 22 bp, Artificial Sequence
  chemically synthesized
agagtaattgcaatgtcctctt

SEQ ID NO: 1044241 - DNA, 22 bp, Artificial Sequence
  chemically synthesized
gagtaattgcaatgtcctctta

SEQ ID NO: 1044242 - DNA, 22 bp, Artificial Sequence
  chemically synthesized
ataatattggaataagaggaca

SEQ ID NO: 1044243 - DNA, 22 bp, Artificial Sequence
  chemically synthesized
aataatattggaataagaggac

SEQ ID NO: 1044244 - DNA, 22 bp, Artificial Sequence
  chemically synthesized
caatgtcctcttattccaatat

SEQ ID NO: 1044245 - DNA, 22 bp, Artificial Sequence
  chemically synthesized
taatacaggggtatttaataat

SEQ ID NO: 1044246 - DNA, 22 bp, Artificial Sequence
  chemically synthesized
ttattccaatattattaaatac

SEQ ID NO: 1044247 - DNA, 22 bp, Artificial Sequence
  chemically synthesized
attccaatattattaaataccc

SEQ ID NO: 1044248 - DNA, 22 bp, Artificial Sequence
  chemically synthesized
ttccaatattattaaatacccc

SEQ ID NO: 1044249 - DNA, 22 bp, Artificial Sequence
  chemically synthesized
caatattattaaatacccctgt

SEQ ID NO: 1044250 - DNA, 22 bp, Artificial Sequence
  chemically synthesized
tatgcatattgtaatacagggg

SEQ ID NO: 1044251 - DNA, 22 bp, Artificial Sequence
  chemically synthesized
atatgcatattgtaatacaggg

SEQ ID NO: 1044252 - DNA, 22 bp, Artificial Sequence
  chemically synthesized
tttatatgcatattgtaataca

SEQ ID NO: 1044253 - DNA, 22 bp, Artificial Sequence
  chemically synthesized
ttaaatacccctgtattacaat

SEQ ID NO: 1044254 - DNA, 22 bp, Artificial Sequence
  chemically synthesized
aatacccctgtattacaatatg

SEQ ID NO: 1044255 - DNA, 22 bp, Artificial Sequence
  chemically synthesized
cattgtttatatgcatattgta

SEQ ID NO: 1044256 - DNA, 22 bp, Artificial Sequence
  chemically synthesized
tattacaatatgcatataaaca

SEQ ID NO: 1044257 - DNA, 22 bp, Artificial Sequence
  chemically synthesized
caatatgcatataaacaatgta

SEQ ID NO: 1044258 - DNA, 22 bp, Artificial Sequence
  chemically synthesized
taatacaggggcatattacatt

SEQ ID NO: 1044259 - DNA, 22 bp, Artificial Sequence
  chemically synthesized
tatgcgtattgtaatacagggg

SEQ ID NO: 1044260 - DNA, 22 bp, Artificial Sequence
  chemically synthesized
atatgcgtattgtaatacaggg

SEQ ID NO: 1044261 - DNA, 22 bp, Artificial Sequence
  chemically synthesized
tttatatgcgtattgtaataca

SEQ ID NO: 1044262 - DNA, 22 bp, Artificial Sequence
  chemically synthesized
tattacaatacgcatataaaca

SEQ ID NO: 1044263 - DNA, 22 bp, Artificial Sequence
  chemically synthesized
caatacgcatataaacaatcgt

SEQ ID NO: 1044264 - DNA, 22 bp, Artificial Sequence
  chemically synthesized
aaggaaaataaaagaacgattg

SEQ ID NO: 1044265 - DNA, 22 bp, Artificial Sequence
  chemically synthesized
ttttattttccttcagatattt

SEQ ID NO: 1044266 - DNA, 22 bp, Artificial Sequence
  chemically synthesized
ttattttccttcagatattttg

SEQ ID NO: 1044267 - DNA, 22 bp, Artificial Sequence
  chemically synthesized
tattttccttcagatattttgt

SEQ ID NO: 1044268 - DNA, 22 bp, Artificial Sequence
  chemically synthesized
attttccttcagatattttgtt

SEQ ID NO: 1044269 - DNA, 22 bp, Artificial Sequence
  chemically synthesized
ttttccttcagatattttgttt

SEQ ID NO: 1044270 - DNA, 22 bp, Artificial Sequence
  chemically synthesized
tccttcagatattttgtttgga

SEQ ID NO: 1044271 - DNA, 22 bp, Artificial Sequence
  chemically synthesized
ccttcagatattttgtttggat

SEQ ID NO: 1044272 - DNA, 22 bp, Artificial Sequence
  chemically synthesized
cttcagatattttgtttggatt

SEQ ID NO: 1044273 - DNA, 22 bp, Artificial Sequence
  chemically synthesized
cagatattttgtttggatttct

SEQ ID NO: 1044274 - DNA, 22 bp, Artificial Sequence
  chemically synthesized
agatattttgtttggatttcta

SEQ ID NO: 1044275 - DNA, 22 bp, Artificial Sequence
  chemically synthesized
tgtttggatttctacatatggt

SEQ ID NO: 1044276 - DNA, 22 bp, Artificial Sequence
  chemically synthesized
gtttggatttctacatatggtg

SEQ ID NO: 1044277 - DNA, 22 bp, Artificial Sequence
  chemically synthesized
tttggatttctacatatggtgc

SEQ ID NO: 1044278 - DNA, 22 bp, Artificial Sequence
  chemically synthesized
gataatagcaagaggcaccata

SEQ ID NO: 1044279 - DNA, 22 bp, Artificial Sequence
  chemically synthesized
ggatttctacatatggtgcctc

SEQ ID NO: 1044280 - DNA, 22 bp, Artificial Sequence
  chemically synthesized
gatttctacatatggtgcctct

SEQ ID NO: 1044281 - DNA, 22 bp, Artificial Sequence
  chemically synthesized
ctacatatggtgcctcttgcta

SEQ ID NO: 1044282 - DNA, 22 bp, Artificial Sequence
  chemically synthesized
tacatatggtgcctcttgctat

SEQ ID NO: 1044283 - DNA, 22 bp, Artificial Sequence
  chemically synthesized
ggagaattagataatagcaaga

SEQ ID NO: 1044284 - DNA, 22 bp, Artificial Sequence
  chemically synthesized
catatggtgcctcttgctatta

SEQ ID NO: 1044285 - DNA, 22 bp, Artificial Sequence
  chemically synthesized
gtattaggagaattagataata

SEQ ID NO: 1044286 - DNA, 22 bp, Artificial Sequence
  chemically synthesized
tggtattaggagaattagataa

SEQ ID NO: 1044287 - DNA, 22 bp, Artificial Sequence
  chemically synthesized
ttctggtattaggagaattaga

SEQ ID NO: 1044288 - DNA, 22 bp, Artificial Sequence
  chemically synthesized
tattctggtattaggagaatta

SEQ ID NO: 1044289 - DNA, 22 bp, Artificial Sequence
  chemically synthesized
ttgctattatctaattctccta

SEQ ID NO: 1044290 - DNA, 22 bp, Artificial Sequence
  chemically synthesized
ctattctggtattaggagaatt

SEQ ID NO: 1044291 - DNA, 22 bp, Artificial Sequence
  chemically synthesized
tctattctggtattaggagaat

SEQ ID NO: 1044292 - DNA, 22 bp, Artificial Sequence
  chemically synthesized
gctattatctaattctcctaat

SEQ ID NO: 1044293 - DNA, 22 bp, Artificial Sequence
  chemically synthesized
ttctattctggtattaggagaa

SEQ ID NO: 1044294 - DNA, 22 bp, Artificial Sequence
  chemically synthesized
ctattatctaattctcctaata

SEQ ID NO: 1044295 - DNA, 22 bp, Artificial Sequence
  chemically synthesized
cttttctattctggtattagga

SEQ ID NO: 1044296 - DNA, 22 bp, Artificial Sequence
  chemically synthesized
ttatctaattctcctaatacca

SEQ ID NO: 1044297 - DNA, 22 bp, Artificial Sequence
  chemically synthesized
tctaattctcctaataccagaa

SEQ ID NO: 1044298 - DNA, 22 bp, Artificial Sequence
  chemically synthesized
attctcctaataccagaataga

SEQ ID NO: 1044299 - DNA, 22 bp, Artificial Sequence
  chemically synthesized
tcctaataccagaatagaaaag

SEQ ID NO: 1044300 - DNA, 22 bp, Artificial Sequence
  chemically synthesized
ctaataccagaatagaaaagca

SEQ ID NO: 1044301 - DNA, 22 bp, Artificial Sequence
  chemically synthesized
ataccagaatagaaaagcagtc

SEQ ID NO: 1044302 - DNA, 22 bp, Artificial Sequence
  chemically synthesized
tgccatgagcaaagtgactgct

SEQ ID NO: 1044303 - DNA, 22 bp, Artificial Sequence
  chemically synthesized
aatgaaggcaaaattatgccat

SEQ ID NO: 1044304 - DNA, 22 bp, Artificial Sequence
  chemically synthesized
gttaaatgaaggcaaaattatg

SEQ ID NO: 1044305 - DNA, 22 bp, Artificial Sequence
  chemically synthesized
tgctcatggcataattttgcct

SEQ ID NO: 1044306 - DNA, 22 bp, Artificial Sequence
  chemically synthesized
gctcatggcataattttgcctt

SEQ ID NO: 1044307 - DNA, 22 bp, Artificial Sequence
  chemically synthesized
ctcatggcataattttgccttc

SEQ ID NO: 1044308 - DNA, 22 bp, Artificial Sequence
  chemically synthesized
atggcataattttgccttcatt

SEQ ID NO: 1044309 - DNA, 22 bp, Artificial Sequence
  chemically synthesized
ataatcccaattagttaaatga

SEQ ID NO: 1044310 - DNA, 22 bp, Artificial Sequence
  chemically synthesized
aataatcccaattagttaaatg

SEQ ID NO: 1044311 - DNA, 22 bp, Artificial Sequence
  chemically synthesized
tgccttcatttaactaattggg

SEQ ID NO: 1044312 - DNA, 22 bp, Artificial Sequence
  chemically synthesized
gccttcatttaactaattggga

SEQ ID NO: 1044313 - DNA, 22 bp, Artificial Sequence
  chemically synthesized
ccttcatttaactaattgggat

SEQ ID NO: 1044314 - DNA, 22 bp, Artificial Sequence
  chemically synthesized
agcacaaatttaataatcccaa

SEQ ID NO: 1044315 - DNA, 22 bp, Artificial Sequence
  chemically synthesized
catttaactaattgggattatt

SEQ ID NO: 1044316 - DNA, 22 bp, Artificial Sequence
  chemically synthesized
aagcacaaatttaataatccca

SEQ ID NO: 1044317 - DNA, 22 bp, Artificial Sequence
  chemically synthesized
atttaactaattgggattatta

SEQ ID NO: 1044318 - DNA, 22 bp, Artificial Sequence
  chemically synthesized
ttaagcacaaatttaataatcc

SEQ ID NO: 1044319 - DNA, 22 bp, Artificial Sequence
  chemically synthesized
aactaattgggattattaaatt

SEQ ID NO: 1044320 - DNA, 22 bp, Artificial Sequence
  chemically synthesized
actaattgggattattaaattt

SEQ ID NO: 1044321 - DNA, 22 bp, Artificial Sequence
  chemically synthesized
acagctcttaagcacaaattta

SEQ ID NO: 1044322 - DNA, 22 bp, Artificial Sequence
  chemically synthesized
attgggattattaaatttgtgc

SEQ ID NO: 1044323 - DNA, 22 bp, Artificial Sequence
  chemically synthesized
cacagctcttaagcacaaattt

SEQ ID NO: 1044324 - DNA, 22 bp, Artificial Sequence
  chemically synthesized
tttcacagctcttaagcacaaa

SEQ ID NO: 1044325 - DNA, 22 bp, Artificial Sequence
  chemically synthesized
ggattattaaatttgtgcttaa

SEQ ID NO: 1044326 - DNA, 22 bp, Artificial Sequence
  chemically synthesized
ttaaatttgtgcttaagagctg

SEQ ID NO: 1044327 - DNA, 22 bp, Artificial Sequence
  chemically synthesized
gaatctgtttcacagctcttaa

SEQ ID NO: 1044328 - DNA, 22 bp, Artificial Sequence
  chemically synthesized
tggaatctgtttcacagctctt

SEQ ID NO: 1044329 - DNA, 22 bp, Artificial Sequence
  chemically synthesized
aatttgtgcttaagagctgtga

SEQ ID NO: 1044330 - DNA, 22 bp, Artificial Sequence
  chemically synthesized
ctctggaatctgtttcacagct

SEQ ID NO: 1044331 - DNA, 22 bp, Artificial Sequence
  chemically synthesized
tcctctggaatctgtttcacag

SEQ ID NO: 1044332 - DNA, 22 bp, Artificial Sequence
  chemically synthesized
gtgcttaagagctgtgaaacag

SEQ ID NO: 1044333 - DNA, 22 bp, Artificial Sequence
  chemically synthesized
ctcctctggaatctgtttcaca

SEQ ID NO: 1044334 - DNA, 22 bp, Artificial Sequence
  chemically synthesized
tgcttaagagctgtgaaacaga

SEQ ID NO: 1044335 - DNA, 22 bp, Artificial Sequence
  chemically synthesized
tctcctctggaatctgtttcac

SEQ ID NO: 1044336 - DNA, 22 bp, Artificial Sequence
  chemically synthesized
aagagctgtgaaacagattcca

SEQ ID NO: 1044337 - DNA, 22 bp, Artificial Sequence
  chemically synthesized
agagctgtgaaacagattccag

SEQ ID NO: 1044338 - DNA, 22 bp, Artificial Sequence
  chemically synthesized
agatctttctcctctggaatct

SEQ ID NO: 1044339 - DNA, 22 bp, Artificial Sequence
  chemically synthesized
gttaagatctttctcctctgga

SEQ ID NO: 1044340 - DNA, 22 bp, Artificial Sequence
  chemically synthesized
tgaaacagattccagaggagaa

SEQ ID NO: 1044341 - DNA, 22 bp, Artificial Sequence
  chemically synthesized
atacactggttaagatctttct

SEQ ID NO: 1044342 - DNA, 22 bp, Artificial Sequence
  chemically synthesized
aatacactggttaagatctttc

SEQ ID NO: 1044343 - DNA, 22 bp, Artificial Sequence
  chemically synthesized
taatacactggttaagatcttt

SEQ ID NO: 1044344 - DNA, 22 bp, Artificial Sequence
  chemically synthesized
ttaatacactggttaagatctt

SEQ ID NO: 1044345 - DNA, 22 bp, Artificial Sequence
  chemically synthesized
cagaggagaaagatcttaacca

SEQ ID NO: 1044346 - DNA, 22 bp, Artificial Sequence
  chemically synthesized
gcaacagagatttttaatacac

SEQ ID NO: 1044347 - DNA, 22 bp, Artificial Sequence
  chemically synthesized
aaccagtgtattaaaaatctct

SEQ ID NO: 1044348 - DNA, 22 bp, Artificial Sequence
  chemically synthesized
accagtgtattaaaaatctctg

SEQ ID NO: 1044349 - DNA, 22 bp, Artificial Sequence
  chemically synthesized
aaaatctctgttgccagtactt

SEQ ID NO: 1044350 - DNA, 22 bp, Artificial Sequence
  chemically synthesized
aagtagggacaaaagtactggc

SEQ ID NO: 1044351 - DNA, 22 bp, Artificial Sequence
  chemically synthesized
gaagtagggacaaaagtactgg

SEQ ID NO: 1044352 - DNA, 22 bp, Artificial Sequence
  chemically synthesized
ccttgaagtagggacaaaagta

SEQ ID NO: 1044353 - DNA, 22 bp, Artificial Sequence
  chemically synthesized
gccttgaagtagggacaaaagt

SEQ ID NO: 1044354 - DNA, 22 bp, Artificial Sequence
  chemically synthesized
tgttgccagtacttttgtccct

SEQ ID NO: 1044355 - DNA, 22 bp, Artificial Sequence
  chemically synthesized
ttgccagtacttttgtccctac

SEQ ID NO: 1044356 - DNA, 22 bp, Artificial Sequence
  chemically synthesized
agtcttgccttgaagtagggac

SEQ ID NO: 1044357 - DNA, 22 bp, Artificial Sequence
  chemically synthesized
ccagtacttttgtccctacttc

SEQ ID NO: 1044358 - DNA, 22 bp, Artificial Sequence
  chemically synthesized
cagtcttgccttgaagtaggga

SEQ ID NO: 1044359 - DNA, 22 bp, Artificial Sequence
  chemically synthesized
ttcagtcttgccttgaagtagg

SEQ ID NO: 1044360 - DNA, 22 bp, Artificial Sequence
  chemically synthesized
gattcttcagtcttgccttgaa

SEQ ID NO: 1044361 - DNA, 22 bp, Artificial Sequence
  chemically synthesized
cgattcttcagtcttgccttga

SEQ ID NO: 1044362 - DNA, 22 bp, Artificial Sequence
  chemically synthesized
ttgtccctacttcaaggcaaga

SEQ ID NO: 1044363 - DNA, 22 bp, Artificial Sequence
  chemically synthesized
tgtccctacttcaaggcaagac

SEQ ID NO: 1044364 - DNA, 22 bp, Artificial Sequence
  chemically synthesized
gtccctacttcaaggcaagact

SEQ ID NO: 1044365 - DNA, 22 bp, Artificial Sequence
  chemically synthesized
tccctacttcaaggcaagactg

SEQ ID NO: 1044366 - DNA, 22 bp, Artificial Sequence
  chemically synthesized
gtcttcgattcttcagtcttgc

SEQ ID NO: 1044367 - DNA, 22 bp, Artificial Sequence
  chemically synthesized
agtcttcgattcttcagtcttg

SEQ ID NO: 1044368 - DNA, 22 bp, Artificial Sequence
  chemically synthesized
tagtcttcgattcttcagtctt

SEQ ID NO: 1044369 - DNA, 22 bp, Artificial Sequence
  chemically synthesized
cttcaaggcaagactgaagaat

SEQ ID NO: 1044370 - DNA, 22 bp, Artificial Sequence
  chemically synthesized
caaggcaagactgaagaatcga

SEQ ID NO: 1044371 - DNA, 22 bp, Artificial Sequence
  chemically synthesized
atattttagtcttcgattcttc

SEQ ID NO: 1044372 - DNA, 22 bp, Artificial Sequence
  chemically synthesized
aaggcaagactgaagaatcgaa

SEQ ID NO: 1044373 - DNA, 22 bp, Artificial Sequence
  chemically synthesized
tcatattttagtcttcgattct

SEQ ID NO: 1044374 - DNA, 22 bp, Artificial Sequence
  chemically synthesized
ctcatattttagtcttcgattc

SEQ ID NO: 1044375 - DNA, 22 bp, Artificial Sequence
  chemically synthesized
ttctcatattttagtcttcgat

SEQ ID NO: 1044376 - DNA, 22 bp, Artificial Sequence
  chemically synthesized
cttctcatattttagtcttcga

SEQ ID NO: 1044377 - DNA, 22 bp, Artificial Sequence
  chemically synthesized
aagaatcgaagactaaaatatg

SEQ ID NO: 1044378 - DNA, 22 bp, Artificial Sequence
  chemically synthesized
agagatgtatgatttcttctca

SEQ ID NO: 1044379 - DNA, 22 bp, Artificial Sequence
  chemically synthesized
gagagatgtatgatttcttctc

SEQ ID NO: 1044380 - DNA, 22 bp, Artificial Sequence
  chemically synthesized
aaatatgagaagaaatcataca

SEQ ID NO: 1044381 - DNA, 22 bp, Artificial Sequence
  chemically synthesized
gcagaagatcccttgagagatg

SEQ ID NO: 1044382 - DNA, 22 bp, Artificial Sequence
  chemically synthesized
gtaaaacctagcagaagatccc

SEQ ID NO: 1044383 - DNA, 22 bp, Artificial Sequence
  chemically synthesized
gtctcgtaaaacctagcagaag

SEQ ID NO: 1044384 - DNA, 22 bp, Artificial Sequence
  chemically synthesized
ggtctcgtaaaacctagcagaa

SEQ ID NO: 1044385 - DNA, 22 bp, Artificial Sequence
  chemically synthesized
tggtctcgtaaaacctagcaga

SEQ ID NO: 1044386 - DNA, 22 bp, Artificial Sequence
  chemically synthesized
tcaagggatcttctgctaggtt

SEQ ID NO: 1044387 - DNA, 22 bp, Artificial Sequence
  chemically synthesized
aagggatcttctgctaggtttt

SEQ ID NO: 1044388 - DNA, 22 bp, Artificial Sequence
  chemically synthesized
gaactttggtctcgtaaaacct

SEQ ID NO: 1044389 - DNA, 22 bp, Artificial Sequence
  chemically synthesized
agttagaactttggtctcgtaa

SEQ ID NO: 1044390 - DNA, 22 bp, Artificial Sequence
  chemically synthesized
ctgctaggttttacgagaccaa

SEQ ID NO: 1044391 - DNA, 22 bp, Artificial Sequence
  chemically synthesized
tgctaggttttacgagaccaaa

SEQ ID NO: 1044392 - DNA, 22 bp, Artificial Sequence
  chemically synthesized
ctaggttttacgagaccaaagt

SEQ ID NO: 1044393 - DNA, 22 bp, Artificial Sequence
  chemically synthesized
gggctgagttagaactttggtc

SEQ ID NO: 1044394 - DNA, 22 bp, Artificial Sequence
  chemically synthesized
ggggctgagttagaactttggt

SEQ ID NO: 1044395 - DNA, 22 bp, Artificial Sequence
  chemically synthesized
ggttttacgagaccaaagttct

SEQ ID NO: 1044396 - DNA, 22 bp, Artificial Sequence
  chemically synthesized
tacgagaccaaagttctaactc

SEQ ID NO: 1044397 - DNA, 22 bp, Artificial Sequence
  chemically synthesized
acgagaccaaagttctaactca

SEQ ID NO: 1044398 - DNA, 22 bp, Artificial Sequence
  chemically synthesized
cgagaccaaagttctaactcag

SEQ ID NO: 1044399 - DNA, 22 bp, Artificial Sequence
  chemically synthesized
ggccgacttggggctgagttag

SEQ ID NO: 1044400 - DNA, 22 bp, Artificial Sequence
  chemically synthesized
tcggccgacttggggctgagtt

SEQ ID NO: 1044401 - DNA, 22 bp, Artificial Sequence
  chemically synthesized
taactcagccccaagtcggccg

SEQ ID NO: 1044402 - DNA, 22 bp, Artificial Sequence
  chemically synthesized
actcagccccaagtcggccgag

SEQ ID NO: 1044403 - DNA, 22 bp, Artificial Sequence
  chemically synthesized
tgaaaacccattctcggccgac

SEQ ID NO: 1044404 - DNA, 22 bp, Artificial Sequence
  chemically synthesized
agccccaagtcggccgagaatg

SEQ ID NO: 1044405 - DNA, 22 bp, Artificial Sequence
  chemically synthesized
agcatgtgtctatgaaaaccca

SEQ ID NO: 1044406 - DNA, 22 bp, Artificial Sequence
  chemically synthesized
aagcatgtgtctatgaaaaccc

SEQ ID NO: 1044407 - DNA, 22 bp, Artificial Sequence
  chemically synthesized
gtcatacagaaacttaagcatg

SEQ ID NO: 1044408 - DNA, 22 bp, Artificial Sequence
  chemically synthesized
tggtcatacagaaacttaagca

SEQ ID NO: 1044409 - DNA, 22 bp, Artificial Sequence
  chemically synthesized
tcatagacacatgcttaagttt

SEQ ID NO: 1044410 - DNA, 22 bp, Artificial Sequence
  chemically synthesized
catagacacatgcttaagtttc

SEQ ID NO: 1044411 - DNA, 22 bp, Artificial Sequence
  chemically synthesized
tctggtcatacagaaacttaag

SEQ ID NO: 1044412 - DNA, 22 bp, Artificial Sequence
  chemically synthesized
atagacacatgcttaagtttct

SEQ ID NO: 1044413 - DNA, 22 bp, Artificial Sequence
  chemically synthesized
ctctggtcatacagaaacttaa

SEQ ID NO: 1044414 - DNA, 22 bp, Artificial Sequence
  chemically synthesized
aagtttctgtatgaccagagaa

SEQ ID NO: 1044415 - DNA, 22 bp, Artificial Sequence
  chemically synthesized
agtttctgtatgaccagagaaa

SEQ ID NO: 1044416 - DNA, 22 bp, Artificial Sequence
  chemically synthesized
gagatagcagatatatttctct

SEQ ID NO: 1044417 - DNA, 22 bp, Artificial Sequence
  chemically synthesized
ctgtatgaccagagaaatatat

SEQ ID NO: 1044418 - DNA, 22 bp, Artificial Sequence
  chemically synthesized
tgtatgaccagagaaatatatc

SEQ ID NO: 1044419 - DNA, 22 bp, Artificial Sequence
  chemically synthesized
tatgaccagagaaatatatctg

SEQ ID NO: 1044420 - DNA, 22 bp, Artificial Sequence
  chemically synthesized
aaattagagatagcagatatat

SEQ ID NO: 1044421 - DNA, 22 bp, Artificial Sequence
  chemically synthesized
gaaattagagatagcagatata

SEQ ID NO: 1044422 - DNA, 22 bp, Artificial Sequence
  chemically synthesized
tgaaattagagatagcagatat

SEQ ID NO: 1044423 - DNA, 22 bp, Artificial Sequence
  chemically synthesized
gaaatattttgaaattagagat

SEQ ID NO: 1044424 - DNA, 22 bp, Artificial Sequence
  chemically synthesized
tggaaatattttgaaattagag

SEQ ID NO: 1044425 - DNA, 22 bp, Artificial Sequence
  chemically synthesized
ctatctctaatttcaaaatatt

SEQ ID NO: 1044426 - DNA, 22 bp, Artificial Sequence
  chemically synthesized
tctctaatttcaaaatatttcc

SEQ ID NO: 1044427 - DNA, 22 bp, Artificial Sequence
  chemically synthesized
taatttcaaaatatttccagaa

SEQ ID NO: 1044428 - DNA, 22 bp, Artificial Sequence
  chemically synthesized
atttcaaaatatttccagaatc

SEQ ID NO: 1044429 - DNA, 22 bp, Artificial Sequence
  chemically synthesized
caaaatatttccagaatctgac

SEQ ID NO: 1044430 - DNA, 22 bp, Artificial Sequence
  chemically synthesized
aaaatatttccagaatctgaca

SEQ ID NO: 1044431 - DNA, 22 bp, Artificial Sequence
  chemically synthesized
gtcggtagtgagagaatgtcag

SEQ ID NO: 1044432 - DNA, 22 bp, Artificial Sequence
  chemically synthesized
ggtcggtagtgagagaatgtca

SEQ ID NO: 1044433 - DNA, 22 bp, Artificial Sequence
  chemically synthesized
ccagaatctgacattctctcac

SEQ ID NO: 1044434 - DNA, 22 bp, Artificial Sequence
  chemically synthesized
cagaatctgacattctctcact

SEQ ID NO: 1044435 - DNA, 22 bp, Artificial Sequence
  chemically synthesized
gacttggtcggtagtgagagaa

SEQ ID NO: 1044436 - DNA, 22 bp, Artificial Sequence
  chemically synthesized
ggacttggtcggtagtgagaga

SEQ ID NO: 1044437 - DNA, 22 bp, Artificial Sequence
  chemically synthesized
gtggcttggacttggtcggtag

SEQ ID NO: 1044438 - DNA, 22 bp, Artificial Sequence
  chemically synthesized
acattctctcactaccgaccaa

SEQ ID NO: 1044439 - DNA, 22 bp, Artificial Sequence
  chemically synthesized
tctcactaccgaccaagtccaa

SEQ ID NO: 1044440 - DNA, 22 bp, Artificial Sequence
  chemically synthesized
tcactaccgaccaagtccaagc

SEQ ID NO: 1044441 - DNA, 22 bp, Artificial Sequence
  chemically synthesized
actaccgaccaagtccaagcca

SEQ ID NO: 1044442 - DNA, 22 bp, Artificial Sequence
  chemically synthesized
aaaaagagatgctggtggcttg

SEQ ID NO: 1044443 - DNA, 22 bp, Artificial Sequence
  chemically synthesized
ccgaccaagtccaagccaccag

SEQ ID NO: 1044444 - DNA, 22 bp, Artificial Sequence
  chemically synthesized
tttttcaactcttgttgattct

SEQ ID NO: 1044445 - DNA, 22 bp, Artificial Sequence
  chemically synthesized
tttcaactcttgttgattctat

SEQ ID NO: 1044446 - DNA, 22 bp, Artificial Sequence
  chemically synthesized
ttcaactcttgttgattctatt

SEQ ID NO: 1044447 - DNA, 22 bp, Artificial Sequence
  chemically synthesized
taggggaccaataatagaatca

SEQ ID NO: 1044448 - DNA, 22 bp, Artificial Sequence
  chemically synthesized
tcaactcttgttgattctatta

SEQ ID NO: 1044449 - DNA, 22 bp, Artificial Sequence
  chemically synthesized
caactcttgttgattctattat

SEQ ID NO: 1044450 - DNA, 22 bp, Artificial Sequence
  chemically synthesized
aactcttgttgattctattatt

SEQ ID NO: 1044451 - DNA, 22 bp, Artificial Sequence
  chemically synthesized
ttgttgattctattattggtcc

SEQ ID NO: 1044452 - DNA, 22 bp, Artificial Sequence
  chemically synthesized
gttgattctattattggtcccc

SEQ ID NO: 1044453 - DNA, 22 bp, Artificial Sequence
  chemically synthesized
ttgattctattattggtcccct

SEQ ID NO: 1044454 - DNA, 22 bp, Artificial Sequence
  chemically synthesized
agagtagaactgtaggggacca

SEQ ID NO: 1044455 - DNA, 22 bp, Artificial Sequence
  chemically synthesized
attctattattggtcccctaca

SEQ ID NO: 1044456 - DNA, 22 bp, Artificial Sequence
  chemically synthesized
ggttgagagtagaactgtaggg

SEQ ID NO: 1044457 - DNA, 22 bp, Artificial Sequence
  chemically synthesized
tattattggtcccctacagttc

SEQ ID NO: 1044458 - DNA, 22 bp, Artificial Sequence
  chemically synthesized
tgggttgagagtagaactgtag

SEQ ID NO: 1044459 - DNA, 22 bp, Artificial Sequence
  chemically synthesized
ttattggtcccctacagttcta

SEQ ID NO: 1044460 - DNA, 22 bp, Artificial Sequence
  chemically synthesized
ctgggttgagagtagaactgta

SEQ ID NO: 1044461 - DNA, 22 bp, Artificial Sequence
  chemically synthesized
ttggtcccctacagttctactc

SEQ ID NO: 1044462 - DNA, 22 bp, Artificial Sequence
  chemically synthesized
gcttctgggttgagagtagaac

SEQ ID NO: 1044463 - DNA, 22 bp, Artificial Sequence
  chemically synthesized
gtcccctacagttctactctca

SEQ ID NO: 1044464 - DNA, 22 bp, Artificial Sequence
  chemically synthesized
cagttctactctcaacccagaa

SEQ ID NO: 1044465 - DNA, 22 bp, Artificial Sequence
  chemically synthesized
aaaggatcacactggcttctgg

SEQ ID NO: 1044466 - DNA, 22 bp, Artificial Sequence
  chemically synthesized
aaaaggatcacactggcttctg

SEQ ID NO: 1044467 - DNA, 22 bp, Artificial Sequence
  chemically synthesized
tactctcaacccagaagccagt

SEQ ID NO: 1044468 - DNA, 22 bp, Artificial Sequence
  chemically synthesized
taaaaggatcacactggcttct

SEQ ID NO: 1044469 - DNA, 22 bp, Artificial Sequence
  chemically synthesized
ctctcaacccagaagccagtgt

SEQ ID NO: 1044470 - DNA, 22 bp, Artificial Sequence
  chemically synthesized
tcaacccagaagccagtgtgat

SEQ ID NO: 1044471 - DNA, 22 bp, Artificial Sequence
  chemically synthesized
aacccagaagccagtgtgatcc

SEQ ID NO: 1044472 - DNA, 22 bp, Artificial Sequence
  chemically synthesized
aatcatgttttaaaaggatcac

SEQ ID NO: 1044473 - DNA, 22 bp, Artificial Sequence
  chemically synthesized
agtggcatgatctcaatcatgt

SEQ ID NO: 1044474 - DNA, 22 bp, Artificial Sequence
  chemically synthesized
ttaaaacatgattgagatcatg

SEQ ID NO: 1044475 - DNA, 22 bp, Artificial Sequence
  chemically synthesized
taaaacatgattgagatcatgc

SEQ ID NO: 1044476 - DNA, 22 bp, Artificial Sequence
  chemically synthesized
agcagttgagtggcatgatctc

SEQ ID NO: 1044477 - DNA, 22 bp, Artificial Sequence
  chemically synthesized
aaaacatgattgagatcatgcc

SEQ ID NO: 1044478 - DNA, 22 bp, Artificial Sequence
  chemically synthesized
aaacatgattgagatcatgcca

SEQ ID NO: 1044479 - DNA, 22 bp, Artificial Sequence
  chemically synthesized
tgagcagttgagtggcatgatc

SEQ ID NO: 1044480 - DNA, 22 bp, Artificial Sequence
  chemically synthesized
ctgagcagttgagtggcatgat

SEQ ID NO: 1044481 - DNA, 22 bp, Artificial Sequence
  chemically synthesized
taagtttctgagcagttgagtg

SEQ ID NO: 1044482 - DNA, 22 bp, Artificial Sequence
  chemically synthesized
agatcatgccactcaactgctc

SEQ ID NO: 1044483 - DNA, 22 bp, Artificial Sequence
  chemically synthesized
aactgctcagaaacttacaatt

SEQ ID NO: 1044484 - DNA, 22 bp, Artificial Sequence
  chemically synthesized
aatgagatgagagcaattgtaa

SEQ ID NO: 1044485 - DNA, 22 bp, Artificial Sequence
  chemically synthesized
taaatgagatgagagcaattgt

SEQ ID NO: 1044486 - DNA, 22 bp, Artificial Sequence
  chemically synthesized
ctcagaaacttacaattgctct

SEQ ID NO: 1044487 - DNA, 22 bp, Artificial Sequence
  chemically synthesized
agaaacttacaattgctctcat

SEQ ID NO: 1044488 - DNA, 22 bp, Artificial Sequence
  chemically synthesized
acaattgctctcatctcattta

SEQ ID NO: 1044489 - DNA, 22 bp, Artificial Sequence
  chemically synthesized
taaagaagattctaaatgagat

SEQ ID NO: 1044490 - DNA, 22 bp, Artificial Sequence
  chemically synthesized
caattgctctcatctcatttag

SEQ ID NO: 1044491 - DNA, 22 bp, Artificial Sequence
  chemically synthesized
ctctcatctcatttagaatctt

SEQ ID NO: 1044492 - DNA, 22 bp, Artificial Sequence
  chemically synthesized
gggccattgtaaagaagattct

SEQ ID NO: 1044493 - DNA, 22 bp, Artificial Sequence
  chemically synthesized
tcatctcatttagaatcttctt

SEQ ID NO: 1044494 - DNA, 22 bp, Artificial Sequence
  chemically synthesized
ggggccattgtaaagaagattc

SEQ ID NO: 1044495 - DNA, 22 bp, Artificial Sequence
  chemically synthesized
tggggccattgtaaagaagatt

SEQ ID NO: 1044496 - DNA, 22 bp, Artificial Sequence
  chemically synthesized
atctcatttagaatcttcttta

SEQ ID NO: 1044497 - DNA, 22 bp, Artificial Sequence
  chemically synthesized
atttagaatcttctttacaatg

SEQ ID NO: 1044498 - DNA, 22 bp, Artificial Sequence
  chemically synthesized
agaatcttctttacaatggccc

SEQ ID NO: 1044499 - DNA, 22 bp, Artificial Sequence
  chemically synthesized
gaatcttctttacaatggcccc

SEQ ID NO: 1044500 - DNA, 22 bp, Artificial Sequence
  chemically synthesized
tggagggcctttggggccattg

SEQ ID NO: 1044501 - DNA, 22 bp, Artificial Sequence
  chemically synthesized
ctttacaatggccccaaaggcc

SEQ ID NO: 1044502 - DNA, 22 bp, Artificial Sequence
  chemically synthesized
tttacaatggccccaaaggccc

SEQ ID NO: 1044503 - DNA, 22 bp, Artificial Sequence
  chemically synthesized
tacaatggccccaaaggccctc

SEQ ID NO: 1044504 - DNA, 22 bp, Artificial Sequence
  chemically synthesized
acaatggccccaaaggccctcc

SEQ ID NO: 1044505 - DNA, 22 bp, Artificial Sequence
  chemically synthesized
caatggccccaaaggccctcca

SEQ ID NO: 1044506 - DNA, 22 bp, Artificial Sequence
  chemically synthesized
tgagtgtccagattgtggaggg

SEQ ID NO: 1044507 - DNA, 22 bp, Artificial Sequence
  chemically synthesized
cacaatctggacactcacaact

SEQ ID NO: 1044508 - DNA, 22 bp, Artificial Sequence
  chemically synthesized
gacactcacaactcccatatcc

SEQ ID NO: 1044509 - DNA, 22 bp, Artificial Sequence
  chemically synthesized
acaactcccatatcctcatctc

SEQ ID NO: 1044510 - DNA, 22 bp, Artificial Sequence
  chemically synthesized
ccatatcctcatctctttctac

SEQ ID NO: 1044511 - DNA, 22 bp, Artificial Sequence
  chemically synthesized
atctctttctacccttccactg

SEQ ID NO: 1044512 - DNA, 22 bp, Artificial Sequence
  chemically synthesized
aagcaaaacaagccagtggaag

SEQ ID NO: 1044513 - DNA, 22 bp, Artificial Sequence
  chemically synthesized
tttctacccttccactggcttg

SEQ ID NO: 1044514 - DNA, 22 bp, Artificial Sequence
  chemically synthesized
tctacccttccactggcttgtt

SEQ ID NO: 1044515 - DNA, 22 bp, Artificial Sequence
  chemically synthesized
ctacccttccactggcttgttt

SEQ ID NO: 1044516 - DNA, 22 bp, Artificial Sequence
  chemically synthesized
tacccttccactggcttgtttt

SEQ ID NO: 1044517 - DNA, 22 bp, Artificial Sequence
  chemically synthesized
cccttccactggcttgttttgc

SEQ ID NO: 1044518 - DNA, 22 bp, Artificial Sequence
  chemically synthesized
ccactggcttgttttgcttcag

SEQ ID NO: 1044519 - DNA, 22 bp, Artificial Sequence
  chemically synthesized
cactggcttgttttgcttcagc

SEQ ID NO: 1044520 - DNA, 22 bp, Artificial Sequence
  chemically synthesized
gcttgttttgcttcagccactt

SEQ ID NO: 1044521 - DNA, 22 bp, Artificial Sequence
  chemically synthesized
gttttgcttcagccactttggc

SEQ ID NO: 1044522 - DNA, 22 bp, Artificial Sequence
  chemically synthesized
ttttgcttcagccactttggcc

SEQ ID NO: 1044523 - DNA, 22 bp, Artificial Sequence
  chemically synthesized
tgcttcagccactttggccttc

SEQ ID NO: 1044524 - DNA, 22 bp, Artificial Sequence
  chemically synthesized
gcttcagccactttggccttct

SEQ ID NO: 1044525 - DNA, 22 bp, Artificial Sequence
  chemically synthesized
cttcagccactttggccttctt

SEQ ID NO: 1044526 - DNA, 22 bp, Artificial Sequence
  chemically synthesized
atcaagcaccaacaagaaggcc

SEQ ID NO: 1044527 - DNA, 22 bp, Artificial Sequence
  chemically synthesized
aatcaagcaccaacaagaaggc

SEQ ID NO: 1044528 - DNA, 22 bp, Artificial Sequence
  chemically synthesized
cagccactttggccttcttgtt

SEQ ID NO: 1044529 - DNA, 22 bp, Artificial Sequence
  chemically synthesized
agccactttggccttcttgttg

SEQ ID NO: 1044530 - DNA, 22 bp, Artificial Sequence
  chemically synthesized
tcttaatcaagcaccaacaaga

SEQ ID NO: 1044531 - DNA, 22 bp, Artificial Sequence
  chemically synthesized
atcttaatcaagcaccaacaag

SEQ ID NO: 1044532 - DNA, 22 bp, Artificial Sequence
  chemically synthesized
tggccttcttgttggtgcttga

SEQ ID NO: 1044533 - DNA, 22 bp, Artificial Sequence
  chemically synthesized
agcttatcttaatcaagcacca

SEQ ID NO: 1044534 - DNA, 22 bp, Artificial Sequence
  chemically synthesized
ggccttcttgttggtgcttgat

SEQ ID NO: 1044535 - DNA, 22 bp, Artificial Sequence
  chemically synthesized
gccttcttgttggtgcttgatt

SEQ ID NO: 1044536 - DNA, 22 bp, Artificial Sequence
  chemically synthesized
cttgttggtgcttgattaagat

SEQ ID NO: 1044537 - DNA, 22 bp, Artificial Sequence
  chemically synthesized
ttgttggtgcttgattaagata

SEQ ID NO: 1044538 - DNA, 22 bp, Artificial Sequence
  chemically synthesized
gttggtgcttgattaagataag

SEQ ID NO: 1044539 - DNA, 22 bp, Artificial Sequence
  chemically synthesized
ttggtgcttgattaagataagc

SEQ ID NO: 1044540 - DNA, 22 bp, Artificial Sequence
  chemically synthesized
gtgcttgattaagataagctca

SEQ ID NO: 1044541 - DNA, 22 bp, Artificial Sequence
  chemically synthesized
gattaagataagctcagtccca

SEQ ID NO: 1044542 - DNA, 22 bp, Artificial Sequence
  chemically synthesized
attaagataagctcagtcccac

SEQ ID NO: 1044543 - DNA, 22 bp, Artificial Sequence
  chemically synthesized
agataagctcagtcccacattt

SEQ ID NO: 1044544 - DNA, 22 bp, Artificial Sequence
  chemically synthesized
agtcccacatttgggcctctac

SEQ ID NO: 1044545 - DNA, 22 bp, Artificial Sequence
  chemically synthesized
tgtagaggaaatagagtagagg

SEQ ID NO: 1044546 - DNA, 22 bp, Artificial Sequence
  chemically synthesized
gggcctctactctatttcctct

SEQ ID NO: 1044547 - DNA, 22 bp, Artificial Sequence
  chemically synthesized
ggcctctactctatttcctcta

SEQ ID NO: 1044548 - DNA, 22 bp, Artificial Sequence
  chemically synthesized
tactctatttcctctacacaga

SEQ ID NO: 1044549 - DNA, 22 bp, Artificial Sequence
  chemically synthesized
ctctatttcctctacacagact

SEQ ID NO: 1044550 - DNA, 22 bp, Artificial Sequence
  chemically synthesized
tatttcctctacacagactcca

SEQ ID NO: 1044551 - DNA, 22 bp, Artificial Sequence
  chemically synthesized
tttcctctacacagactccatg

SEQ ID NO: 1044552 - DNA, 22 bp, Artificial Sequence
  chemically synthesized
cctctacacagactccatggct

SEQ ID NO: 1044553 - DNA, 22 bp, Artificial Sequence
  chemically synthesized
ctctacacagactccatggctg

SEQ ID NO: 1044554 - DNA, 22 bp, Artificial Sequence
  chemically synthesized
tacacagactccatggctgact

SEQ ID NO: 1044555 - DNA, 22 bp, Artificial Sequence
  chemically synthesized
cacagactccatggctgactcc

SEQ ID NO: 1044556 - DNA, 22 bp, Artificial Sequence
  chemically synthesized
gaagaaggtaagggagtcagcc

SEQ ID NO: 1044557 - DNA, 22 bp, Artificial Sequence
  chemically synthesized
catggctgactcccttaccttc

SEQ ID NO: 1044558 - DNA, 22 bp, Artificial Sequence
  chemically synthesized
agcaaagattggaagaaggtaa

SEQ ID NO: 1044559 - DNA, 22 bp, Artificial Sequence
  chemically synthesized
gagcaaagattggaagaaggta

SEQ ID NO: 1044560 - DNA, 22 bp, Artificial Sequence
  chemically synthesized
tgagcaaagattggaagaaggt

SEQ ID NO: 1044561 - DNA, 22 bp, Artificial Sequence
  chemically synthesized
actcccttaccttcttccaatc

SEQ ID NO: 1044562 - DNA, 22 bp, Artificial Sequence
  chemically synthesized
ccttaccttcttccaatctttg

SEQ ID NO: 1044563 - DNA, 22 bp, Artificial Sequence
  chemically synthesized
accttcttccaatctttgctca

SEQ ID NO: 1044564 - DNA, 22 bp, Artificial Sequence
  chemically synthesized
ccttcttccaatctttgctcaa

SEQ ID NO: 1044565 - DNA, 22 bp, Artificial Sequence
  chemically synthesized
cttccaatctttgctcaaaggt

SEQ ID NO: 1044566 - DNA, 22 bp, Artificial Sequence
  chemically synthesized
ttccaatctttgctcaaaggtc

SEQ ID NO: 1044567 - DNA, 22 bp, Artificial Sequence
  chemically synthesized
ccaatctttgctcaaaggtcat

SEQ ID NO: 1044568 - DNA, 22 bp, Artificial Sequence
  chemically synthesized
caatctttgctcaaaggtcatt

SEQ ID NO: 1044569 - DNA, 22 bp, Artificial Sequence
  chemically synthesized
aaatagggtagaaatgaccttt

SEQ ID NO: 1044570 - DNA, 22 bp, Artificial Sequence
  chemically synthesized
caaatagggtagaaatgacctt

SEQ ID NO: 1044571 - DNA, 22 bp, Artificial Sequence
  chemically synthesized
tgctcaaaggtcatttctaccc

SEQ ID NO: 1044572 - DNA, 22 bp, Artificial Sequence
  chemically synthesized
ccatttcaaatagggtagaaat

SEQ ID NO: 1044573 - DNA, 22 bp, Artificial Sequence
  chemically synthesized
gctcaaaggtcatttctaccct

SEQ ID NO: 1044574 - DNA, 22 bp, Artificial Sequence
  chemically synthesized
ctcaaaggtcatttctacccta

SEQ ID NO: 1044575 - DNA, 22 bp, Artificial Sequence
  chemically synthesized
aaaggtcatttctaccctattt

SEQ ID NO: 1044576 - DNA, 22 bp, Artificial Sequence
  chemically synthesized
aaagtggcggaattgccatttc

SEQ ID NO: 1044577 - DNA, 22 bp, Artificial Sequence
  chemically synthesized
ctaccctatttgaaatggcaat

SEQ ID NO: 1044578 - DNA, 22 bp, Artificial Sequence
  chemically synthesized
taccctatttgaaatggcaatt

SEQ ID NO: 1044579 - DNA, 22 bp, Artificial Sequence
  chemically synthesized
ccctatttgaaatggcaattcc

SEQ ID NO: 1044580 - DNA, 22 bp, Artificial Sequence
  chemically synthesized
tttgaaatggcaattccgccac

SEQ ID NO: 1044581 - DNA, 22 bp, Artificial Sequence
  chemically synthesized
gaaatggcaattccgccacttt

SEQ ID NO: 1044582 - DNA, 22 bp, Artificial Sequence
  chemically synthesized
aaatggcaattccgccactttc

SEQ ID NO: 1044583 - DNA, 22 bp, Artificial Sequence
  chemically synthesized
caggggtagacgtaggtataat

SEQ ID NO: 1044584 - DNA, 22 bp, Artificial Sequence
  chemically synthesized
cgccactttcaattatacctac

SEQ ID NO: 1044585 - DNA, 22 bp, Artificial Sequence
  chemically synthesized
tcaattatacctacgtctaccc

SEQ ID NO: 1044586 - DNA, 22 bp, Artificial Sequence
  chemically synthesized
caattatacctacgtctacccc

SEQ ID NO: 1044587 - DNA, 22 bp, Artificial Sequence
  chemically synthesized
aattatacctacgtctacccct

SEQ ID NO: 1044588 - DNA, 22 bp, Artificial Sequence
  chemically synthesized
tacctacgtctacccctgtagt

SEQ ID NO: 1044589 - DNA, 22 bp, Artificial Sequence
  chemically synthesized
aggggatataggaccactacag

SEQ ID NO: 1044590 - DNA, 22 bp, Artificial Sequence
  chemically synthesized
cgtctacccctgtagtggtcct

SEQ ID NO: 1044591 - DNA, 22 bp, Artificial Sequence
  chemically synthesized
ttaaggggatataggaccacta

SEQ ID NO: 1044592 - DNA, 22 bp, Artificial Sequence
  chemically synthesized
cccctgtagtggtcctatatcc

SEQ ID NO: 1044593 - DNA, 22 bp, Artificial Sequence
  chemically synthesized
tagtggtcctatatccccttaa

SEQ ID NO: 1044594 - DNA, 22 bp, Artificial Sequence
  chemically synthesized
tatccccttaacagattctggt

SEQ ID NO: 1044595 - DNA, 22 bp, Artificial Sequence
  chemically synthesized
ggaaaaaaaaaaaaaccagaat

SEQ ID NO: 1044596 - DNA, 22 bp, Artificial Sequence
  chemically synthesized
gggaaaaaaaaaaaaaccagaa

SEQ ID NO: 1044597 - DNA, 22 bp, Artificial Sequence
  chemically synthesized
tgggaaaaaaaaaaaaaccaga

SEQ ID NO: 1044598 - DNA, 22 bp, Artificial Sequence
  chemically synthesized
aacagattctggtttttttttt

SEQ ID NO: 1044599 - DNA, 22 bp, Artificial Sequence
  chemically synthesized
acagattctggttttttttttt

SEQ ID NO: 1044600 - DNA, 22 bp, Artificial Sequence
  chemically synthesized
tggtttttttttttttcccaaa

SEQ ID NO: 1044601 - DNA, 22 bp, Artificial Sequence
  chemically synthesized
ggtgatacgtattttgggaaaa

SEQ ID NO: 1044602 - DNA, 22 bp, Artificial Sequence
  chemically synthesized
gtttttttttttttcccaaaat

SEQ ID NO: 1044603 - DNA, 22 bp, Artificial Sequence
  chemically synthesized
ctaggtgatacgtattttggga

SEQ ID NO: 1044604 - DNA, 22 bp, Artificial Sequence
  chemically synthesized
ttttttttttcccaaaatacgt

SEQ ID NO: 1044605 - DNA, 22 bp, Artificial Sequence
  chemically synthesized
tttttttttcccaaaatacgta

SEQ ID NO: 1044606 - DNA, 22 bp, Artificial Sequence
  chemically synthesized
ttttttttcccaaaatacgtat

SEQ ID NO: 1044607 - DNA, 22 bp, Artificial Sequence
  chemically synthesized
tttttttcccaaaatacgtatc

SEQ ID NO: 1044608 - DNA, 22 bp, Artificial Sequence
  chemically synthesized
ttttttcccaaaatacgtatca

SEQ ID NO: 1044609 - DNA, 22 bp, Artificial Sequence
  chemically synthesized
cgtattactaggtgatacgtat

SEQ ID NO: 1044610 - DNA, 22 bp, Artificial Sequence
  chemically synthesized
tttttcccaaaatacgtatcac

SEQ ID NO: 1044611 - DNA, 22 bp, Artificial Sequence
  chemically synthesized
ttttcccaaaatacgtatcacc

SEQ ID NO: 1044612 - DNA, 22 bp, Artificial Sequence
  chemically synthesized
tttcccaaaatacgtatcacct

SEQ ID NO: 1044613 - DNA, 22 bp, Artificial Sequence
  chemically synthesized
ttcccaaaatacgtatcaccta

SEQ ID NO: 1044614 - DNA, 22 bp, Artificial Sequence
  chemically synthesized
tcccaaaatacgtatcacctag

SEQ ID NO: 1044615 - DNA, 22 bp, Artificial Sequence
  chemically synthesized
cccaaaatacgtatcacctagt

SEQ ID NO: 1044616 - DNA, 22 bp, Artificial Sequence
  chemically synthesized
ccaaaatacgtatcacctagta

SEQ ID NO: 1044617 - DNA, 22 bp, Artificial Sequence
  chemically synthesized
gtaatacgcaatatttacttat

SEQ ID NO: 1044618 - DNA, 22 bp, Artificial Sequence
  chemically synthesized
acttatcatttttctttgtttg

SEQ ID NO: 1044619 - DNA, 22 bp, Artificial Sequence
  chemically synthesized
cttatcatttttctttgtttgc

SEQ ID NO: 1044620 - DNA, 22 bp, Artificial Sequence
  chemically synthesized
atcatttttctttgtttgcttg

SEQ ID NO: 1044621 - DNA, 22 bp, Artificial Sequence
  chemically synthesized
tcatttttctttgtttgcttgc

SEQ ID NO: 1044622 - DNA, 22 bp, Artificial Sequence
  chemically synthesized
ggagacagaatagaagcaagca

SEQ ID NO: 1044623 - DNA, 22 bp, Artificial Sequence
  chemically synthesized
ttctttgtttgcttgcttctat

SEQ ID NO: 1044624 - DNA, 22 bp, Artificial Sequence
  chemically synthesized
tctttgtttgcttgcttctatt

SEQ ID NO: 1044625 - DNA, 22 bp, Artificial Sequence
  chemically synthesized
ctttgtttgcttgcttctattc

SEQ ID NO: 1044626 - DNA, 22 bp, Artificial Sequence
  chemically synthesized
tttgtttgcttgcttctattct

SEQ ID NO: 1044627 - DNA, 22 bp, Artificial Sequence
  chemically synthesized
tgtttgcttgcttctattctgt

SEQ ID NO: 1044628 - DNA, 22 bp, Artificial Sequence
  chemically synthesized
taacattgggagacagaataga

SEQ ID NO: 1044629 - DNA, 22 bp, Artificial Sequence
  chemically synthesized
gtttgcttgcttctattctgtc

SEQ ID NO: 1044630 - DNA, 22 bp, Artificial Sequence
  chemically synthesized
tttgcttgcttctattctgtct

SEQ ID NO: 1044631 - DNA, 22 bp, Artificial Sequence
  chemically synthesized
ttataacattgggagacagaat

SEQ ID NO: 1044632 - DNA, 22 bp, Artificial Sequence
  chemically synthesized
attataacattgggagacagaa

SEQ ID NO: 1044633 - DNA, 22 bp, Artificial Sequence
  chemically synthesized
gcttgcttctattctgtctccc

SEQ ID NO: 1044634 - DNA, 22 bp, Artificial Sequence
  chemically synthesized
tattataacattgggagacaga

SEQ ID NO: 1044635 - DNA, 22 bp, Artificial Sequence
  chemically synthesized
cttgcttctattctgtctccca

SEQ ID NO: 1044636 - DNA, 22 bp, Artificial Sequence
  chemically synthesized
ttattataacattgggagacag

SEQ ID NO: 1044637 - DNA, 22 bp, Artificial Sequence
  chemically synthesized
gcttctattctgtctcccaatg

SEQ ID NO: 1044638 - DNA, 22 bp, Artificial Sequence
  chemically synthesized
cttctattctgtctcccaatgt

SEQ ID NO: 1044639 - DNA, 22 bp, Artificial Sequence
  chemically synthesized
agcttttattataacattggga

SEQ ID NO: 1044640 - DNA, 22 bp, Artificial Sequence
  chemically synthesized
ctattctgtctcccaatgttat

SEQ ID NO: 1044641 - DNA, 22 bp, Artificial Sequence
  chemically synthesized
tattctgtctcccaatgttata

SEQ ID NO: 1044642 - DNA, 22 bp, Artificial Sequence
  chemically synthesized
attcagcttttattataacatt

SEQ ID NO: 1044643 - DNA, 22 bp, Artificial Sequence
  chemically synthesized
ttctgtctcccaatgttataat

SEQ ID NO: 1044644 - DNA, 22 bp, Artificial Sequence
  chemically synthesized
tgtctcccaatgttataataaa

SEQ ID NO: 1044645 - DNA, 22 bp, Artificial Sequence
  chemically synthesized
ccctcattcagcttttattata

SEQ ID NO: 1044646 - DNA, 22 bp, Artificial Sequence
  chemically synthesized
tctcccaatgttataataaaag

SEQ ID NO: 1044647 - DNA, 22 bp, Artificial Sequence
  chemically synthesized
gccctcattcagcttttattat

SEQ ID NO: 1044648 - DNA, 22 bp, Artificial Sequence
  chemically synthesized
tgccctcattcagcttttatta

SEQ ID NO: 1044649 - DNA, 22 bp, Artificial Sequence
  chemically synthesized
ccaatgttataataaaagctga

SEQ ID NO: 1044650 - DNA, 22 bp, Artificial Sequence
  chemically synthesized
acgaatctttgccctcattcag

SEQ ID NO: 1044651 - DNA, 22 bp, Artificial Sequence
  chemically synthesized
taataaaagctgaatgagggca

SEQ ID NO: 1044652 - DNA, 22 bp, Artificial Sequence
  chemically synthesized
aatgagggcaaagattcgttag

SEQ ID NO: 1044653 - DNA, 22 bp, Artificial Sequence
  chemically synthesized
taaaacagtgaaaaagactaac

SEQ ID NO: 1044654 - DNA, 22 bp, Artificial Sequence
  chemically synthesized
ataaaacagtgaaaaagactaa

SEQ ID NO: 1044655 - DNA, 22 bp, Artificial Sequence
  chemically synthesized
agtgcttataaaacagtgaaaa

SEQ ID NO: 1044656 - DNA, 22 bp, Artificial Sequence
  chemically synthesized
taagtgcttataaaacagtgaa

SEQ ID NO: 1044657 - DNA, 22 bp, Artificial Sequence
  chemically synthesized
gttagtctttttcactgtttta

SEQ ID NO: 1044658 - DNA, 22 bp, Artificial Sequence
  chemically synthesized
ttctaagtgcttataaaacagt

SEQ ID NO: 1044659 - DNA, 22 bp, Artificial Sequence
  chemically synthesized
gtctttttcactgttttataag

SEQ ID NO: 1044660 - DNA, 22 bp, Artificial Sequence
  chemically synthesized
tttcactgttttataagcactt

SEQ ID NO: 1044661 - DNA, 22 bp, Artificial Sequence
  chemically synthesized
ttcactgttttataagcactta

SEQ ID NO: 1044662 - DNA, 22 bp, Artificial Sequence
  chemically synthesized
tcactgttttataagcacttag

SEQ ID NO: 1044663 - DNA, 22 bp, Artificial Sequence
  chemically synthesized
cactgttttataagcacttaga

SEQ ID NO: 1044664 - DNA, 22 bp, Artificial Sequence
  chemically synthesized
actgttttataagcacttagaa

SEQ ID NO: 1044665 - DNA, 22 bp, Artificial Sequence
  chemically synthesized
ttttataagcacttagaatagt

SEQ ID NO: 1044666 - DNA, 22 bp, Artificial Sequence
  chemically synthesized
gtatgtaccacacactattcta

SEQ ID NO: 1044667 - DNA, 22 bp, Artificial Sequence
  chemically synthesized
agtatgtaccacacactattct

SEQ ID NO: 1044668 - DNA, 22 bp, Artificial Sequence
  chemically synthesized
tataagcacttagaatagtgtg

SEQ ID NO: 1044669 - DNA, 22 bp, Artificial Sequence
  chemically synthesized
ataagcacttagaatagtgtgt

SEQ ID NO: 1044670 - DNA, 22 bp, Artificial Sequence
  chemically synthesized
ttagtatgtaccacacactatt

SEQ ID NO: 1044671 - DNA, 22 bp, Artificial Sequence
  chemically synthesized
taagcacttagaatagtgtgtg

SEQ ID NO: 1044672 - DNA, 22 bp, Artificial Sequence
  chemically synthesized
agctcttagtatgtaccacaca

SEQ ID NO: 1044673 - DNA, 22 bp, Artificial Sequence
  chemically synthesized
ttaagctcttagtatgtaccac

SEQ ID NO: 1044674 - DNA, 22 bp, Artificial Sequence
  chemically synthesized
agaatagtgtgtggtacatact

SEQ ID NO: 1044675 - DNA, 22 bp, Artificial Sequence
  chemically synthesized
gaatagtgtgtggtacatacta

SEQ ID NO: 1044676 - DNA, 22 bp, Artificial Sequence
  chemically synthesized
caaaaatagttattaagctctt

SEQ ID NO: 1044677 - DNA, 22 bp, Artificial Sequence
  chemically synthesized
gtatattccaaaaatagttatt

SEQ ID NO: 1044678 - DNA, 22 bp, Artificial Sequence
  chemically synthesized
agagcttaataactatttttgg

SEQ ID NO: 1044679 - DNA, 22 bp, Artificial Sequence
  chemically synthesized
aataactatttttggaatatac

SEQ ID NO: 1044680 - DNA, 22 bp, Artificial Sequence
  chemically synthesized
ataactatttttggaatatacg

SEQ ID NO: 1044681 - DNA, 22 bp, Artificial Sequence
  chemically synthesized
aggaatgtggattcgtatattc

SEQ ID NO: 1044682 - DNA, 22 bp, Artificial Sequence
  chemically synthesized
tttttggaatatacgaatccac

SEQ ID NO: 1044683 - DNA, 22 bp, Artificial Sequence
  chemically synthesized
ttggaatatacgaatccacatt

SEQ ID NO: 1044684 - DNA, 22 bp, Artificial Sequence
  chemically synthesized
tggaatatacgaatccacattc

SEQ ID NO: 1044685 - DNA, 22 bp, Artificial Sequence
  chemically synthesized
ggaatatacgaatccacattcc

SEQ ID NO: 1044686 - DNA, 22 bp, Artificial Sequence
  chemically synthesized
gaatatacgaatccacattcct

SEQ ID NO: 1044687 - DNA, 22 bp, Artificial Sequence
  chemically synthesized
ggacaagtaaacctaaggaatg

SEQ ID NO: 1044688 - DNA, 22 bp, Artificial Sequence
  chemically synthesized
ttaggacaagtaaacctaagga

SEQ ID NO: 1044689 - DNA, 22 bp, Artificial Sequence
  chemically synthesized
cttaggtttacttgtcctaaca

SEQ ID NO: 1044690 - DNA, 22 bp, Artificial Sequence
  chemically synthesized
agaaacaaaaaattgttaggac

SEQ ID NO: 1044691 - DNA, 22 bp, Artificial Sequence
  chemically synthesized
gagaaacaaaaaattgttagga

SEQ ID NO: 1044692 - DNA, 22 bp, Artificial Sequence
  chemically synthesized
aggtttacttgtcctaacaatt

SEQ ID NO: 1044693 - DNA, 22 bp, Artificial Sequence
  chemically synthesized
ggtttacttgtcctaacaattt

SEQ ID NO: 1044694 - DNA, 22 bp, Artificial Sequence
  chemically synthesized
ttgagaaacaaaaaattgttag

SEQ ID NO: 1044695 - DNA, 22 bp, Artificial Sequence
  chemically synthesized
ctcttgagaaacaaaaaattgt

SEQ ID NO: 1044696 - DNA, 22 bp, Artificial Sequence
  chemically synthesized
acttgtcctaacaattttttgt

SEQ ID NO: 1044697 - DNA, 22 bp, Artificial Sequence
  chemically synthesized
cttgtcctaacaattttttgtt

SEQ ID NO: 1044698 - DNA, 22 bp, Artificial Sequence
  chemically synthesized
cattgctcttgagaaacaaaaa

SEQ ID NO: 1044699 - DNA, 22 bp, Artificial Sequence
  chemically synthesized
gtcctaacaattttttgtttct

SEQ ID NO: 1044700 - DNA, 22 bp, Artificial Sequence
  chemically synthesized
gcattgctcttgagaaacaaaa

SEQ ID NO: 1044701 - DNA, 22 bp, Artificial Sequence
  chemically synthesized
tcctaacaattttttgtttctc

SEQ ID NO: 1044702 - DNA, 22 bp, Artificial Sequence
  chemically synthesized
tgcattgctcttgagaaacaaa

SEQ ID NO: 1044703 - DNA, 22 bp, Artificial Sequence
  chemically synthesized
ttgcattgctcttgagaaacaa

SEQ ID NO: 1044704 - DNA, 22 bp, Artificial Sequence
  chemically synthesized
tttgcattgctcttgagaaaca

SEQ ID NO: 1044705 - DNA, 22 bp, Artificial Sequence
  chemically synthesized
acaattttttgtttctcaagag

SEQ ID NO: 1044706 - DNA, 22 bp, Artificial Sequence
  chemically synthesized
aggttttttgcattgctcttga

SEQ ID NO: 1044707 - DNA, 22 bp, Artificial Sequence
  chemically synthesized
tttgtttctcaagagcaatgca

SEQ ID NO: 1044708 - DNA, 22 bp, Artificial Sequence
  chemically synthesized
ttgtttctcaagagcaatgcaa

SEQ ID NO: 1044709 - DNA, 22 bp, Artificial Sequence
  chemically synthesized
agttcaggttttttgcattgct

SEQ ID NO: 1044710 - DNA, 22 bp, Artificial Sequence
  chemically synthesized
tgtttctcaagagcaatgcaaa

SEQ ID NO: 1044711 - DNA, 22 bp, Artificial Sequence
  chemically synthesized
gagttcaggttttttgcattgc

SEQ ID NO: 1044712 - DNA, 22 bp, Artificial Sequence
  chemically synthesized
gtttctcaagagcaatgcaaaa

SEQ ID NO: 1044713 - DNA, 22 bp, Artificial Sequence
  chemically synthesized
tttctcaagagcaatgcaaaaa

SEQ ID NO: 1044714 - DNA, 22 bp, Artificial Sequence
  chemically synthesized
ttgagttcaggttttttgcatt

SEQ ID NO: 1044715 - DNA, 22 bp, Artificial Sequence
  chemically synthesized
ctcaagagcaatgcaaaaaacc

SEQ ID NO: 1044716 - DNA, 22 bp, Artificial Sequence
  chemically synthesized
tcaagagcaatgcaaaaaacct

SEQ ID NO: 1044717 - DNA, 22 bp, Artificial Sequence
  chemically synthesized
aagagcaatgcaaaaaacctga

SEQ ID NO: 1044718 - DNA, 22 bp, Artificial Sequence
  chemically synthesized
aagtcctcttgagttcaggttt

SEQ ID NO: 1044719 - DNA, 22 bp, Artificial Sequence
  chemically synthesized
aactcaagaggacttgaacgac

SEQ ID NO: 1044720 - DNA, 22 bp, Artificial Sequence
  chemically synthesized
aagaggacttgaacgacctggc

SEQ ID NO: 1044721 - DNA, 22 bp, Artificial Sequence
  chemically synthesized
taagccaaagatagtgtgaagc

SEQ ID NO: 1044722 - DNA, 22 bp, Artificial Sequence
  chemically synthesized
ataagccaaagatagtgtgaag

SEQ ID NO: 1044723 - DNA, 22 bp, Artificial Sequence
  chemically synthesized
gaacgacctggcttcacactat

SEQ ID NO: 1044724 - DNA, 22 bp, Artificial Sequence
  chemically synthesized
aacgacctggcttcacactatc

SEQ ID NO: 1044725 - DNA, 22 bp, Artificial Sequence
  chemically synthesized
gcttcacactatctttggctta

SEQ ID NO: 1044726 - DNA, 22 bp, Artificial Sequence
  chemically synthesized
gtagtgagcttataagccaaag

SEQ ID NO: 1044727 - DNA, 22 bp, Artificial Sequence
  chemically synthesized
cacactatctttggcttataag

SEQ ID NO: 1044728 - DNA, 22 bp, Artificial Sequence
  chemically synthesized
acactatctttggcttataagc

SEQ ID NO: 1044729 - DNA, 22 bp, Artificial Sequence
  chemically synthesized
tctttggcttataagctcacta

SEQ ID NO: 1044730 - DNA, 22 bp, Artificial Sequence
  chemically synthesized
tggcttataagctcactaccag

SEQ ID NO: 1044731 - DNA, 22 bp, Artificial Sequence
  chemically synthesized
ggcttataagctcactaccagc

SEQ ID NO: 1044732 - DNA, 22 bp, Artificial Sequence
  chemically synthesized
gcttataagctcactaccagct

SEQ ID NO: 1044733 - DNA, 22 bp, Artificial Sequence
  chemically synthesized
gagaccacaagggaaagctggt

SEQ ID NO: 1044734 - DNA, 22 bp, Artificial Sequence
  chemically synthesized
ataagctcactaccagctttcc

SEQ ID NO: 1044735 - DNA, 22 bp, Artificial Sequence
  chemically synthesized
taagctcactaccagctttccc

SEQ ID NO: 1044736 - DNA, 22 bp, Artificial Sequence
  chemically synthesized
aagttcgagaccacaagggaaa

SEQ ID NO: 1044737 - DNA, 22 bp, Artificial Sequence
  chemically synthesized
actaccagctttcccttgtggt

SEQ ID NO: 1044738 - DNA, 22 bp, Artificial Sequence
  chemically synthesized
ttcaagttcgagaccacaaggg

SEQ ID NO: 1044739 - DNA, 22 bp, Artificial Sequence
  chemically synthesized
gttcaagttcgagaccacaagg

SEQ ID NO: 1044740 - DNA, 22 bp, Artificial Sequence
  chemically synthesized
ccagctttcccttgtggtctcg

SEQ ID NO: 1044741 - DNA, 22 bp, Artificial Sequence
  chemically synthesized
tcccttgtggtctcgaacttga

SEQ ID NO: 1044742 - DNA, 22 bp, Artificial Sequence
  chemically synthesized
cccttgtggtctcgaacttgaa

SEQ ID NO: 1044743 - DNA, 22 bp, Artificial Sequence
  chemically synthesized
ccttgtggtctcgaacttgaac

SEQ ID NO: 1044744 - DNA, 22 bp, Artificial Sequence
  chemically synthesized
gtggtctcgaacttgaacaagg

SEQ ID NO: 1044745 - DNA, 22 bp, Artificial Sequence
  chemically synthesized
tggtctcgaacttgaacaaggg

SEQ ID NO: 1044746 - DNA, 22 bp, Artificial Sequence
  chemically synthesized
gaacttgaacaagggttgtctc

SEQ ID NO: 1044747 - DNA, 22 bp, Artificial Sequence
  chemically synthesized
aataggatcaagaaatagagac

SEQ ID NO: 1044748 - DNA, 22 bp, Artificial Sequence
  chemically synthesized
gaacaagggttgtctctatttc

SEQ ID NO: 1044749 - DNA, 22 bp, Artificial Sequence
  chemically synthesized
aaataggatcaagaaatagaga

SEQ ID NO: 1044750 - DNA, 22 bp, Artificial Sequence
  chemically synthesized
aacaagggttgtctctatttct

SEQ ID NO: 1044751 - DNA, 22 bp, Artificial Sequence
  chemically synthesized
taaataggatcaagaaatagag

SEQ ID NO: 1044752 - DNA, 22 bp, Artificial Sequence
  chemically synthesized
atgtagattttaaataggatca

SEQ ID NO: 1044753 - DNA, 22 bp, Artificial Sequence
  chemically synthesized
tctctatttcttgatcctattt

SEQ ID NO: 1044754 - DNA, 22 bp, Artificial Sequence
  chemically synthesized
tatttcttgatcctatttaaaa

SEQ ID NO: 1044755 - DNA, 22 bp, Artificial Sequence
  chemically synthesized
tttcttgatcctatttaaaatc

SEQ ID NO: 1044756 - DNA, 22 bp, Artificial Sequence
  chemically synthesized
cttgatcctatttaaaatctac

SEQ ID NO: 1044757 - DNA, 22 bp, Artificial Sequence
  chemically synthesized
ttgatcctatttaaaatctaca

SEQ ID NO: 1044758 - DNA, 22 bp, Artificial Sequence
  chemically synthesized
gatcctatttaaaatctacatt

SEQ ID NO: 1044759 - DNA, 22 bp, Artificial Sequence
  chemically synthesized
atcctatttaaaatctacatta

SEQ ID NO: 1044760 - DNA, 22 bp, Artificial Sequence
  chemically synthesized
tttaaaatctacattaggacca

SEQ ID NO: 1044761 - DNA, 22 bp, Artificial Sequence
  chemically synthesized
aaaatctacattaggaccacca

SEQ ID NO: 1044762 - DNA, 22 bp, Artificial Sequence
  chemically synthesized
aaatctacattaggaccaccat

SEQ ID NO: 1044763 - DNA, 22 bp, Artificial Sequence
  chemically synthesized
acgggtaggagacatggtggtc

SEQ ID NO: 1044764 - DNA, 22 bp, Artificial Sequence
  chemically synthesized
cattaggaccaccatgtctcct

SEQ ID NO: 1044765 - DNA, 22 bp, Artificial Sequence
  chemically synthesized
ggaccaccatgtctcctacccg

SEQ ID NO: 1044766 - DNA, 22 bp, Artificial Sequence
  chemically synthesized
ctacccgtgagctttcttcata

SEQ ID NO: 1044767 - DNA, 22 bp, Artificial Sequence
  chemically synthesized
cccgtgagctttcttcatatgg

SEQ ID NO: 1044768 - DNA, 22 bp, Artificial Sequence
  chemically synthesized
tcttcatatggccacgtttttc

SEQ ID NO: 1044769 - DNA, 22 bp, Artificial Sequence
  chemically synthesized
cttcatatggccacgtttttca

SEQ ID NO: 1044770 - DNA, 22 bp, Artificial Sequence
  chemically synthesized
ttcatatggccacgtttttcat

SEQ ID NO: 1044771 - DNA, 22 bp, Artificial Sequence
  chemically synthesized
catatggccacgtttttcatca

SEQ ID NO: 1044772 - DNA, 22 bp, Artificial Sequence
  chemically synthesized
atatggccacgtttttcatcac

SEQ ID NO: 1044773 - DNA, 22 bp, Artificial Sequence
  chemically synthesized
ggtaaccaagagggtgatgaaa

SEQ ID NO: 1044774 - DNA, 22 bp, Artificial Sequence
  chemically synthesized
gggtaaccaagagggtgatgaa

SEQ ID NO: 1044775 - DNA, 22 bp, Artificial Sequence
  chemically synthesized
tgggtaaccaagagggtgatga

SEQ ID NO: 1044776 - DNA, 22 bp, Artificial Sequence
  chemically synthesized
tactttgggtaaccaagagggt

SEQ ID NO: 1044777 - DNA, 22 bp, Artificial Sequence
  chemically synthesized
ttcatcaccctcttggttaccc

SEQ ID NO: 1044778 - DNA, 22 bp, Artificial Sequence
  chemically synthesized
tcatcaccctcttggttaccca

SEQ ID NO: 1044779 - DNA, 22 bp, Artificial Sequence
  chemically synthesized
catcaccctcttggttacccaa

SEQ ID NO: 1044780 - DNA, 22 bp, Artificial Sequence
  chemically synthesized
atcaccctcttggttacccaaa

SEQ ID NO: 1044781 - DNA, 22 bp, Artificial Sequence
  chemically synthesized
ttggttacccaaagtatagcac

SEQ ID NO: 1044782 - DNA, 22 bp, Artificial Sequence
  chemically synthesized
gaatgaataaaatgtgctatac

SEQ ID NO: 1044783 - DNA, 22 bp, Artificial Sequence
  chemically synthesized
ggttacccaaagtatagcacat

SEQ ID NO: 1044784 - DNA, 22 bp, Artificial Sequence
  chemically synthesized
ggaatgaataaaatgtgctata

SEQ ID NO: 1044785 - DNA, 22 bp, Artificial Sequence
  chemically synthesized
gttacccaaagtatagcacatt

SEQ ID NO: 1044786 - DNA, 22 bp, Artificial Sequence
  chemically synthesized
tttggaatgaataaaatgtgct

SEQ ID NO: 1044787 - DNA, 22 bp, Artificial Sequence
  chemically synthesized
gtttggaatgaataaaatgtgc

SEQ ID NO: 1044788 - DNA, 22 bp, Artificial Sequence
  chemically synthesized
cccaaagtatagcacattttat

SEQ ID NO: 1044789 - DNA, 22 bp, Artificial Sequence
  chemically synthesized
tagtacagatgccttgtttgga

SEQ ID NO: 1044790 - DNA, 22 bp, Artificial Sequence
  chemically synthesized
tattcattccaaacaaggcatc

SEQ ID NO: 1044791 - DNA, 22 bp, Artificial Sequence
  chemically synthesized
attcattccaaacaaggcatct

SEQ ID NO: 1044792 - DNA, 22 bp, Artificial Sequence
  chemically synthesized
ttcattccaaacaaggcatctg

SEQ ID NO: 1044793 - DNA, 22 bp, Artificial Sequence
  chemically synthesized
attccaaacaaggcatctgtac

SEQ ID NO: 1044794 - DNA, 22 bp, Artificial Sequence
  chemically synthesized
caaacaaggcatctgtactata

SEQ ID NO: 1044795 - DNA, 22 bp, Artificial Sequence
  chemically synthesized
atcaaaaccaattatagtacag

SEQ ID NO: 1044796 - DNA, 22 bp, Artificial Sequence
  chemically synthesized
tctcatcaaaaccaattatagt

SEQ ID NO: 1044797 - DNA, 22 bp, Artificial Sequence
  chemically synthesized
agttgtctcatcaaaaccaatt

SEQ ID NO: 1044798 - DNA, 22 bp, Artificial Sequence
  chemically synthesized
cagttgtctcatcaaaaccaat

SEQ ID NO: 1044799 - DNA, 22 bp, Artificial Sequence
  chemically synthesized
tactataattggttttgatgag

SEQ ID NO: 1044800 - DNA, 22 bp, Artificial Sequence
  chemically synthesized
taattggttttgatgagacaac

SEQ ID NO: 1044801 - DNA, 22 bp, Artificial Sequence
  chemically synthesized
gttttgatgagacaactgaaat

SEQ ID NO: 1044802 - DNA, 22 bp, Artificial Sequence
  chemically synthesized
tgatgagacaactgaaatgatg

SEQ ID NO: 1044803 - DNA, 22 bp, Artificial Sequence
  chemically synthesized
gatgagacaactgaaatgatgt

SEQ ID NO: 1044804 - DNA, 22 bp, Artificial Sequence
  chemically synthesized
atgagacaactgaaatgatgtg

SEQ ID NO: 1044805 - DNA, 22 bp, Artificial Sequence
  chemically synthesized
aaatgatgtgtgcctgatattt

SEQ ID NO: 1044806 - DNA, 22 bp, Artificial Sequence
  chemically synthesized
atattttttctttccttccatt

SEQ ID NO: 1044807 - DNA, 22 bp, Artificial Sequence
  chemically synthesized
tttctttccttccatttatttc

SEQ ID NO: 1044808 - DNA, 22 bp, Artificial Sequence
  chemically synthesized
ttctttccttccatttatttcc

SEQ ID NO: 1044809 - DNA, 22 bp, Artificial Sequence
  chemically synthesized
tctttccttccatttatttcct

SEQ ID NO: 1044810 - DNA, 22 bp, Artificial Sequence
  chemically synthesized
ctttccttccatttatttcctc

SEQ ID NO: 1044811 - DNA, 22 bp, Artificial Sequence
  chemically synthesized
tttccttccatttatttcctcc

SEQ ID NO: 1044812 - DNA, 22 bp, Artificial Sequence
  chemically synthesized
tccttccatttatttcctcctt

SEQ ID NO: 1044813 - DNA, 22 bp, Artificial Sequence
  chemically synthesized
ccttccatttatttcctccttg

SEQ ID NO: 1044814 - DNA, 22 bp, Artificial Sequence
  chemically synthesized
cttccatttatttcctccttgt

SEQ ID NO: 1044815 - DNA, 22 bp, Artificial Sequence
  chemically synthesized
ccatttatttcctccttgtttc

SEQ ID NO: 1044816 - DNA, 22 bp, Artificial Sequence
  chemically synthesized
catttatttcctccttgtttct

SEQ ID NO: 1044817 - DNA, 22 bp, Artificial Sequence
  chemically synthesized
atttcctccttgtttctctcct

SEQ ID NO: 1044818 - DNA, 22 bp, Artificial Sequence
  chemically synthesized
tttcctccttgtttctctcctt

SEQ ID NO: 1044819 - DNA, 22 bp, Artificial Sequence
  chemically synthesized
cctccttgtttctctccttatt

SEQ ID NO: 1044820 - DNA, 22 bp, Artificial Sequence
  chemically synthesized
ctccttgtttctctccttattt

SEQ ID NO: 1044821 - DNA, 22 bp, Artificial Sequence
  chemically synthesized
aagaaaagaaataaaataagga

SEQ ID NO: 1044822 - DNA, 22 bp, Artificial Sequence
  chemically synthesized
cttgtttctctccttattttat

SEQ ID NO: 1044823 - DNA, 22 bp, Artificial Sequence
  chemically synthesized
gtttctctccttattttatttc

SEQ ID NO: 1044824 - DNA, 22 bp, Artificial Sequence
  chemically synthesized
tttctctccttattttatttct

SEQ ID NO: 1044825 - DNA, 22 bp, Artificial Sequence
  chemically synthesized
ctctccttattttatttctttt

SEQ ID NO: 1044826 - DNA, 22 bp, Artificial Sequence
  chemically synthesized
tctccttattttatttcttttc

SEQ ID NO: 1044827 - DNA, 22 bp, Artificial Sequence
  chemically synthesized
tccttattttatttcttttctt

SEQ ID NO: 1044828 - DNA, 22 bp, Artificial Sequence
  chemically synthesized
cttattttatttcttttcttca

SEQ ID NO: 1044829 - DNA, 22 bp, Artificial Sequence
  chemically synthesized
attttatttcttttcttcaatt

SEQ ID NO: 1044830 - DNA, 22 bp, Artificial Sequence
  chemically synthesized
ttttatttcttttcttcaattc

SEQ ID NO: 1044831 - DNA, 22 bp, Artificial Sequence
  chemically synthesized
tatttcttttcttcaattctcc

SEQ ID NO: 1044832 - DNA, 22 bp, Artificial Sequence
  chemically synthesized
atttcttttcttcaattctccc

SEQ ID NO: 1044833 - DNA, 22 bp, Artificial Sequence
  chemically synthesized
tttcttttcttcaattctccct

SEQ ID NO: 1044834 - DNA, 22 bp, Artificial Sequence
  chemically synthesized
cttttcttcaattctccctccc

SEQ ID NO: 1044835 - DNA, 22 bp, Artificial Sequence
  chemically synthesized
ttttcttcaattctccctccct

SEQ ID NO: 1044836 - DNA, 22 bp, Artificial Sequence
  chemically synthesized
ttcttcaattctccctccctcc

SEQ ID NO: 1044837 - DNA, 22 bp, Artificial Sequence
  chemically synthesized
tcttcaattctccctccctcct

SEQ ID NO: 1044838 - DNA, 22 bp, Artificial Sequence
  chemically synthesized
cttcaattctccctccctcctt

SEQ ID NO: 1044839 - DNA, 22 bp, Artificial Sequence
  chemically synthesized
ttcaattctccctccctccttc

SEQ ID NO: 1044840 - DNA, 22 bp, Artificial Sequence
  chemically synthesized
caattctccctccctccttccc

SEQ ID NO: 1044841 - DNA, 22 bp, Artificial Sequence
  chemically synthesized
aattctccctccctccttccct

SEQ ID NO: 1044842 - DNA, 22 bp, Artificial Sequence
  chemically synthesized
tccctccctccttccctcactc

SEQ ID NO: 1044843 - DNA, 22 bp, Artificial Sequence
  chemically synthesized
cctccctccttccctcactctc

SEQ ID NO: 1044844 - DNA, 22 bp, Artificial Sequence
  chemically synthesized
cctccttccctcactctctttc

SEQ ID NO: 1044845 - DNA, 22 bp, Artificial Sequence
  chemically synthesized
cttccctcactctctttcttcc

SEQ ID NO: 1044846 - DNA, 22 bp, Artificial Sequence
  chemically synthesized
ccctcactctctttcttcctta

SEQ ID NO: 1044847 - DNA, 22 bp, Artificial Sequence
  chemically synthesized
cctcactctctttcttccttac

SEQ ID NO: 1044848 - DNA, 22 bp, Artificial Sequence
  chemically synthesized
actctctttcttccttacttcc

SEQ ID NO: 1044849 - DNA, 22 bp, Artificial Sequence
  chemically synthesized
tctttcttccttacttcctccc

SEQ ID NO: 1044850 - DNA, 22 bp, Artificial Sequence
  chemically synthesized
tttcttccttacttcctccctt

SEQ ID NO: 1044851 - DNA, 22 bp, Artificial Sequence
  chemically synthesized
tcttccttacttcctcccttcc

SEQ ID NO: 1044852 - DNA, 22 bp, Artificial Sequence
  chemically synthesized
cttccttacttcctcccttcct

SEQ ID NO: 1044853 - DNA, 22 bp, Artificial Sequence
  chemically synthesized
aaaggaggaggaaggaagggag

SEQ ID NO: 1044854 - DNA, 22 bp, Artificial Sequence
  chemically synthesized
ttccttacttcctcccttcctt

SEQ ID NO: 1044855 - DNA, 22 bp, Artificial Sequence
  chemically synthesized
ccttacttcctcccttccttcc

SEQ ID NO: 1044856 - DNA, 22 bp, Artificial Sequence
  chemically synthesized
cttacttcctcccttccttcct

SEQ ID NO: 1044857 - DNA, 22 bp, Artificial Sequence
  chemically synthesized
acttcctcccttccttcctcct

SEQ ID NO: 1044858 - DNA, 22 bp, Artificial Sequence
  chemically synthesized
cttcctcccttccttcctcctc

SEQ ID NO: 1044859 - DNA, 22 bp, Artificial Sequence
  chemically synthesized
aaatcactgaaaggaggaggaa

SEQ ID NO: 1044860 - DNA, 22 bp, Artificial Sequence
  chemically synthesized
caaatcactgaaaggaggagga

SEQ ID NO: 1044861 - DNA, 22 bp, Artificial Sequence
  chemically synthesized
cctcccttccttcctcctcctt

SEQ ID NO: 1044862 - DNA, 22 bp, Artificial Sequence
  chemically synthesized
ctcccttccttcctcctccttt

SEQ ID NO: 1044863 - DNA, 22 bp, Artificial Sequence
  chemically synthesized
ccttccttcctcctcctttcag

SEQ ID NO: 1044864 - DNA, 22 bp, Artificial Sequence
  chemically synthesized
gagtttcaaatcactgaaagga

SEQ ID NO: 1044865 - DNA, 22 bp, Artificial Sequence
  chemically synthesized
ccttcctcctcctttcagtgat

SEQ ID NO: 1044866 - DNA, 22 bp, Artificial Sequence
  chemically synthesized
cttcctcctcctttcagtgatt

SEQ ID NO: 1044867 - DNA, 22 bp, Artificial Sequence
  chemically synthesized
cactggagtttcaaatcactga

SEQ ID NO: 1044868 - DNA, 22 bp, Artificial Sequence
  chemically synthesized
cctcctcctttcagtgatttga

SEQ ID NO: 1044869 - DNA, 22 bp, Artificial Sequence
  chemically synthesized
ctcctcctttcagtgatttgaa

SEQ ID NO: 1044870 - DNA, 22 bp, Artificial Sequence
  chemically synthesized
ctcctttcagtgatttgaaact

SEQ ID NO: 1044871 - DNA, 22 bp, Artificial Sequence
  chemically synthesized
cacattgcactggagtttcaaa

SEQ ID NO: 1044872 - DNA, 22 bp, Artificial Sequence
  chemically synthesized
ctttcagtgatttgaaactcca

SEQ ID NO: 1044873 - DNA, 22 bp, Artificial Sequence
  chemically synthesized
tcagtgatttgaaactccagtg

SEQ ID NO: 1044874 - DNA, 22 bp, Artificial Sequence
  chemically synthesized
cagtgatttgaaactccagtgc

SEQ ID NO: 1044875 - DNA, 22 bp, Artificial Sequence
  chemically synthesized
agtgatttgaaactccagtgca

SEQ ID NO: 1044876 - DNA, 22 bp, Artificial Sequence
  chemically synthesized
aatattccacattgcactggag

SEQ ID NO: 1044877 - DNA, 22 bp, Artificial Sequence
  chemically synthesized
caatattccacattgcactgga

SEQ ID NO: 1044878 - DNA, 22 bp, Artificial Sequence
  chemically synthesized
gaaactccagtgcaatgtggaa

SEQ ID NO: 1044879 - DNA, 22 bp, Artificial Sequence
  chemically synthesized
aaactccagtgcaatgtggaat

SEQ ID NO: 1044880 - DNA, 22 bp, Artificial Sequence
  chemically synthesized
cccacatcccttcaatattcca

SEQ ID NO: 1044881 - DNA, 22 bp, Artificial Sequence
  chemically synthesized
cagtgcaatgtggaatattgaa

SEQ ID NO: 1044882 - DNA, 22 bp, Artificial Sequence
  chemically synthesized
aagggatgtgggcagatatcct

SEQ ID NO: 1044883 - DNA, 22 bp, Artificial Sequence
  chemically synthesized
aagaacatgaacaagacaagga

SEQ ID NO: 1044884 - DNA, 22 bp, Artificial Sequence
  chemically synthesized
acctgaagaacatgaacaagac

SEQ ID NO: 1044885 - DNA, 22 bp, Artificial Sequence
  chemically synthesized
cacctgaagaacatgaacaaga

SEQ ID NO: 1044886 - DNA, 22 bp, Artificial Sequence
  chemically synthesized
gtcttgttcatgttcttcaggt

SEQ ID NO: 1044887 - DNA, 22 bp, Artificial Sequence
  chemically synthesized
tcttgttcatgttcttcaggtg

SEQ ID NO: 1044888 - DNA, 22 bp, Artificial Sequence
  chemically synthesized
gttcatgttcttcaggtgaaga

SEQ ID NO: 1044889 - DNA, 22 bp, Artificial Sequence
  chemically synthesized
ttcatgttcttcaggtgaagac

SEQ ID NO: 1044890 - DNA, 22 bp, Artificial Sequence
  chemically synthesized
tggtagagcagaatgtcttcac

SEQ ID NO: 1044891 - DNA, 22 bp, Artificial Sequence
  chemically synthesized
atgttcttcaggtgaagacatt

SEQ ID NO: 1044892 - DNA, 22 bp, Artificial Sequence
  chemically synthesized
atggtagagcagaatgtcttca

SEQ ID NO: 1044893 - DNA, 22 bp, Artificial Sequence
  chemically synthesized
tatggtagagcagaatgtcttc

SEQ ID NO: 1044894 - DNA, 22 bp, Artificial Sequence
  chemically synthesized
tttatggtagagcagaatgtct

SEQ ID NO: 1044895 - DNA, 22 bp, Artificial Sequence
  chemically synthesized
ttcaggtgaagacattctgctc

SEQ ID NO: 1044896 - DNA, 22 bp, Artificial Sequence
  chemically synthesized
ttctttatggtagagcagaatg

SEQ ID NO: 1044897 - DNA, 22 bp, Artificial Sequence
  chemically synthesized
caggtgaagacattctgctcta

SEQ ID NO: 1044898 - DNA, 22 bp, Artificial Sequence
  chemically synthesized
aggtgaagacattctgctctac

SEQ ID NO: 1044899 - DNA, 22 bp, Artificial Sequence
  chemically synthesized
atattattctttatggtagagc

SEQ ID NO: 1044900 - DNA, 22 bp, Artificial Sequence
  chemically synthesized
cagctaatattattctttatgg

SEQ ID NO: 1044901 - DNA, 22 bp, Artificial Sequence
  chemically synthesized
acagctaatattattctttatg

SEQ ID NO: 1044902 - DNA, 22 bp, Artificial Sequence
  chemically synthesized
tgctctaccataaagaataata

SEQ ID NO: 1044903 - DNA, 22 bp, Artificial Sequence
  chemically synthesized
ctctaccataaagaataatatt

SEQ ID NO: 1044904 - DNA, 22 bp, Artificial Sequence
  chemically synthesized
taccataaagaataatattagc

SEQ ID NO: 1044905 - DNA, 22 bp, Artificial Sequence
  chemically synthesized
ccataaagaataatattagctg

SEQ ID NO: 1044906 - DNA, 22 bp, Artificial Sequence
  chemically synthesized
caataatgagaatcaatttaca

SEQ ID NO: 1044907 - DNA, 22 bp, Artificial Sequence
  chemically synthesized
gcaataatgagaatcaatttac

SEQ ID NO: 1044908 - DNA, 22 bp, Artificial Sequence
  chemically synthesized
tgcaataatgagaatcaattta

SEQ ID NO: 1044909 - DNA, 22 bp, Artificial Sequence
  chemically synthesized
ttgcaataatgagaatcaattt

SEQ ID NO: 1044910 - DNA, 22 bp, Artificial Sequence
  chemically synthesized
ccttttgcaataatgagaatca

SEQ ID NO: 1044911 - DNA, 22 bp, Artificial Sequence
  chemically synthesized
accttttgcaataatgagaatc

SEQ ID NO: 1044912 - DNA, 22 bp, Artificial Sequence
  chemically synthesized
taccttttgcaataatgagaat

SEQ ID NO: 1044913 - DNA, 22 bp, Artificial Sequence
  chemically synthesized
gctgtaaattgattctcattat

SEQ ID NO: 1044914 - DNA, 22 bp, Artificial Sequence
  chemically synthesized
taaattgattctcattattgca

SEQ ID NO: 1044915 - DNA, 22 bp, Artificial Sequence
  chemically synthesized
tgctttaccttttgcaataatg

SEQ ID NO: 1044916 - DNA, 22 bp, Artificial Sequence
  chemically synthesized
attctcattattgcaaaaggta

SEQ ID NO: 1044917 - DNA, 22 bp, Artificial Sequence
  chemically synthesized
tcattattgcaaaaggtaaagc

SEQ ID NO: 1044918 - DNA, 22 bp, Artificial Sequence
  chemically synthesized
attattgcaaaaggtaaagcat

SEQ ID NO: 1044919 - DNA, 22 bp, Artificial Sequence
  chemically synthesized
ttgcaaaaggtaaagcatagtt

SEQ ID NO: 1044920 - DNA, 22 bp, Artificial Sequence
  chemically synthesized
taataagaatgacaactatgct

SEQ ID NO: 1044921 - DNA, 22 bp, Artificial Sequence
  chemically synthesized
ataataagaatgacaactatgc

SEQ ID NO: 1044922 - DNA, 22 bp, Artificial Sequence
  chemically synthesized
caaaaggtaaagcatagttgtc

SEQ ID NO: 1044923 - DNA, 22 bp, Artificial Sequence
  chemically synthesized
tcattcttattataagctatgt

SEQ ID NO: 1044924 - DNA, 22 bp, Artificial Sequence
  chemically synthesized
ggacaaaaataagaacatagct

SEQ ID NO: 1044925 - DNA, 22 bp, Artificial Sequence
  chemically synthesized
aggacaaaaataagaacatagc

SEQ ID NO: 1044926 - DNA, 22 bp, Artificial Sequence
  chemically synthesized
taggacaaaaataagaacatag

SEQ ID NO: 1044927 - DNA, 22 bp, Artificial Sequence
  chemically synthesized
ttaggacaaaaataagaacata

SEQ ID NO: 1044928 - DNA, 22 bp, Artificial Sequence
  chemically synthesized
ttattataagctatgttcttat

SEQ ID NO: 1044929 - DNA, 22 bp, Artificial Sequence
  chemically synthesized
attataagctatgttcttattt

SEQ ID NO: 1044930 - DNA, 22 bp, Artificial Sequence
  chemically synthesized
ttataagctatgttcttatttt

SEQ ID NO: 1044931 - DNA, 22 bp, Artificial Sequence
  chemically synthesized
taagctatgttcttatttttgt

SEQ ID NO: 1044932 - DNA, 22 bp, Artificial Sequence
  chemically synthesized
tgttcttatttttgtcctaaaa

SEQ ID NO: 1044933 - DNA, 22 bp, Artificial Sequence
  chemically synthesized
ttatttttgtcctaaaaattca

SEQ ID NO: 1044934 - DNA, 22 bp, Artificial Sequence
  chemically synthesized
gtatcaataaatgtgaattttt

SEQ ID NO: 1044935 - DNA, 22 bp, Artificial Sequence
  chemically synthesized
atttttgtcctaaaaattcaca

SEQ ID NO: 1044936 - DNA, 22 bp, Artificial Sequence
  chemically synthesized
ggtatcaataaatgtgaatttt

SEQ ID NO: 1044937 - DNA, 22 bp, Artificial Sequence
  chemically synthesized
tttttgtcctaaaaattcacat

SEQ ID NO: 1044938 - DNA, 22 bp, Artificial Sequence
  chemically synthesized
ttgtcctaaaaattcacattta

SEQ ID NO: 1044939 - DNA, 22 bp, Artificial Sequence
  chemically synthesized
tgtcctaaaaattcacatttat

SEQ ID NO: 1044940 - DNA, 22 bp, Artificial Sequence
  chemically synthesized
gtcctaaaaattcacatttatt

SEQ ID NO: 1044941 - DNA, 22 bp, Artificial Sequence
  chemically synthesized
ggccttggtatcaataaatgtg

SEQ ID NO: 1044942 - DNA, 22 bp, Artificial Sequence
  chemically synthesized
tcctaaaaattcacatttattg

SEQ ID NO: 1044943 - DNA, 22 bp, Artificial Sequence
  chemically synthesized
aattaggccttggtatcaataa

SEQ ID NO: 1044944 - DNA, 22 bp, Artificial Sequence
  chemically synthesized
aaaattcacatttattgatacc

SEQ ID NO: 1044945 - DNA, 22 bp, Artificial Sequence
  chemically synthesized
ttcaattaggccttggtatcaa

SEQ ID NO: 1044946 - DNA, 22 bp, Artificial Sequence
  chemically synthesized
gctgttcaattaggccttggta

SEQ ID NO: 1044947 - DNA, 22 bp, Artificial Sequence
  chemically synthesized
acatttattgataccaaggcct

SEQ ID NO: 1044948 - DNA, 22 bp, Artificial Sequence
  chemically synthesized
agctgttcaattaggccttggt

SEQ ID NO: 1044949 - DNA, 22 bp, Artificial Sequence
  chemically synthesized
attgataccaaggcctaattga

SEQ ID NO: 1044950 - DNA, 22 bp, Artificial Sequence
  chemically synthesized
ttgataccaaggcctaattgaa

SEQ ID NO: 1044951 - DNA, 22 bp, Artificial Sequence
  chemically synthesized
ataccaaggcctaattgaacag

SEQ ID NO: 1044952 - DNA, 22 bp, Artificial Sequence
  chemically synthesized
agggaatccttagctgttcaat

SEQ ID NO: 1044953 - DNA, 22 bp, Artificial Sequence
  chemically synthesized
attcagggaatccttagctgtt

SEQ ID NO: 1044954 - DNA, 22 bp, Artificial Sequence
  chemically synthesized
cctcattcagggaatccttagc

SEQ ID NO: 1044955 - DNA, 22 bp, Artificial Sequence
  chemically synthesized
ctccctcattcagggaatcctt

SEQ ID NO: 1044956 - DNA, 22 bp, Artificial Sequence
  chemically synthesized
attgaacagctaaggattccct

SEQ ID NO: 1044957 - DNA, 22 bp, Artificial Sequence
  chemically synthesized
ctgctccctcattcagggaatc

SEQ ID NO: 1044958 - DNA, 22 bp, Artificial Sequence
  chemically synthesized
aacagctaaggattccctgaat

SEQ ID NO: 1044959 - DNA, 22 bp, Artificial Sequence
  chemically synthesized
tgctgctccctcattcagggaa

SEQ ID NO: 1044960 - DNA, 22 bp, Artificial Sequence
  chemically synthesized
aggattccctgaatgagggagc

SEQ ID NO: 1044961 - DNA, 22 bp, Artificial Sequence
  chemically synthesized
aagtgattctgctgctccctca

SEQ ID NO: 1044962 - DNA, 22 bp, Artificial Sequence
  chemically synthesized
caagtgattctgctgctccctc

SEQ ID NO: 1044963 - DNA, 22 bp, Artificial Sequence
  chemically synthesized
ttcaagtgattctgctgctccc

SEQ ID NO: 1044964 - DNA, 22 bp, Artificial Sequence
  chemically synthesized
cctgaatgagggagcagcagaa

SEQ ID NO: 1044965 - DNA, 22 bp, Artificial Sequence
  chemically synthesized
aatgagggagcagcagaatcac

SEQ ID NO: 1044966 - DNA, 22 bp, Artificial Sequence
  chemically synthesized
gagtggaattcttcaagtgatt

SEQ ID NO: 1044967 - DNA, 22 bp, Artificial Sequence
  chemically synthesized
ggagtggaattcttcaagtgat

SEQ ID NO: 1044968 - DNA, 22 bp, Artificial Sequence
  chemically synthesized
tggagtggaattcttcaagtga

SEQ ID NO: 1044969 - DNA, 22 bp, Artificial Sequence
  chemically synthesized
atgcctttggagtggaattctt

SEQ ID NO: 1044970 - DNA, 22 bp, Artificial Sequence
  chemically synthesized
gaaatagttcatgcctttggag

SEQ ID NO: 1044971 - DNA, 22 bp, Artificial Sequence
  chemically synthesized
gaagaattccactccaaaggca

SEQ ID NO: 1044972 - DNA, 22 bp, Artificial Sequence
  chemically synthesized
agaaatagttcatgcctttgga

SEQ ID NO: 1044973 - DNA, 22 bp, Artificial Sequence
  chemically synthesized
aagaattccactccaaaggcat

SEQ ID NO: 1044974 - DNA, 22 bp, Artificial Sequence
  chemically synthesized
ttagaaatagttcatgcctttg

SEQ ID NO: 1044975 - DNA, 22 bp, Artificial Sequence
  chemically synthesized
cactccaaaggcatgaactatt

SEQ ID NO: 1044976 - DNA, 22 bp, Artificial Sequence
  chemically synthesized
caaaggcatgaactatttctaa

SEQ ID NO: 1044977 - DNA, 22 bp, Artificial Sequence
  chemically synthesized
cgtagagaaattcttagaaata

SEQ ID NO: 1044978 - DNA, 22 bp, Artificial Sequence
  chemically synthesized
acgtagagaaattcttagaaat

SEQ ID NO: 1044979 - DNA, 22 bp, Artificial Sequence
  chemically synthesized
gcatttacgtagagaaattctt

SEQ ID NO: 1044980 - DNA, 22 bp, Artificial Sequence
  chemically synthesized
tttctaagaatttctctacgta

SEQ ID NO: 1044981 - DNA, 22 bp, Artificial Sequence
  chemically synthesized
tgtagttagcatttacgtagag

SEQ ID NO: 1044982 - DNA, 22 bp, Artificial Sequence
  chemically synthesized
ctaagaatttctctacgtaaat

SEQ ID NO: 1044983 - DNA, 22 bp, Artificial Sequence
  chemically synthesized
taagaatttctctacgtaaatg

SEQ ID NO: 1044984 - DNA, 22 bp, Artificial Sequence
  chemically synthesized
ctgtgtagttagcatttacgta

SEQ ID NO: 1044985 - DNA, 22 bp, Artificial Sequence
  chemically synthesized
actgtgtagttagcatttacgt

SEQ ID NO: 1044986 - DNA, 22 bp, Artificial Sequence
  chemically synthesized
agaatttctctacgtaaatgct

SEQ ID NO: 1044987 - DNA, 22 bp, Artificial Sequence
  chemically synthesized
ctctacgtaaatgctaactaca

SEQ ID NO: 1044988 - DNA, 22 bp, Artificial Sequence
  chemically synthesized
tctacgtaaatgctaactacac

SEQ ID NO: 1044989 - DNA, 22 bp, Artificial Sequence
  chemically synthesized
tacgtaaatgctaactacacag

SEQ ID NO: 1044990 - DNA, 22 bp, Artificial Sequence
  chemically synthesized
cgtaaatgctaactacacagta

SEQ ID NO: 1044991 - DNA, 22 bp, Artificial Sequence
  chemically synthesized
aaataaataatgacatatttac

SEQ ID NO: 1044992 - DNA, 22 bp, Artificial Sequence
  chemically synthesized
gaaataaataatgacatattta

SEQ ID NO: 1044993 - DNA, 22 bp, Artificial Sequence
  chemically synthesized
tgaaataaataatgacatattt

SEQ ID NO: 1044994 - DNA, 22 bp, Artificial Sequence
  chemically synthesized
ttgaaataaataatgacatatt

SEQ ID NO: 1044995 - DNA, 22 bp, Artificial Sequence
  chemically synthesized
actacacagtaaatatgtcatt

SEQ ID NO: 1044996 - DNA, 22 bp, Artificial Sequence
  chemically synthesized
cacagtaaatatgtcattattt

SEQ ID NO: 1044997 - DNA, 22 bp, Artificial Sequence
  chemically synthesized
ggacatttttgaaataaataat

SEQ ID NO: 1044998 - DNA, 22 bp, Artificial Sequence
  chemically synthesized
tctaggacatttttgaaataaa

SEQ ID NO: 1044999 - DNA, 22 bp, Artificial Sequence
  chemically synthesized
tatctaggacatttttgaaata

SEQ ID NO: 1045000 - DNA, 22 bp, Artificial Sequence
  chemically synthesized
tttatttcaaaaatgtcctaga

SEQ ID NO: 1045001 - DNA, 22 bp, Artificial Sequence
  chemically synthesized
taggggaactctatctaggaca

SEQ ID NO: 1045002 - DNA, 22 bp, Artificial Sequence
  chemically synthesized
ataggggaactctatctaggac

SEQ ID NO: 1045003 - DNA, 22 bp, Artificial Sequence
  chemically synthesized
atttcaaaaatgtcctagatag

SEQ ID NO: 1045004 - DNA, 22 bp, Artificial Sequence
  chemically synthesized
tttcaaaaatgtcctagataga

SEQ ID NO: 1045005 - DNA, 22 bp, Artificial Sequence
  chemically synthesized
cttataggggaactctatctag

SEQ ID NO: 1045006 - DNA, 22 bp, Artificial Sequence
  chemically synthesized
caaaaatgtcctagatagagtt

SEQ ID NO: 1045007 - DNA, 22 bp, Artificial Sequence
  chemically synthesized
aaaaatgtcctagatagagttc

SEQ ID NO: 1045008 - DNA, 22 bp, Artificial Sequence
  chemically synthesized
gaatctgcttataggggaactc

SEQ ID NO: 1045009 - DNA, 22 bp, Artificial Sequence
  chemically synthesized
cgaatctgcttataggggaact

SEQ ID NO: 1045010 - DNA, 22 bp, Artificial Sequence
  chemically synthesized
tcttcgaatctgcttatagggg

SEQ ID NO: 1045011 - DNA, 22 bp, Artificial Sequence
  chemically synthesized
gtcttcgaatctgcttataggg

SEQ ID NO: 1045012 - DNA, 22 bp, Artificial Sequence
  chemically synthesized
gatagagttcccctataagcag

SEQ ID NO: 1045013 - DNA, 22 bp, Artificial Sequence
  chemically synthesized
ccctataagcagattcgaagac

SEQ ID NO: 1045014 - DNA, 22 bp, Artificial Sequence
  chemically synthesized
ccaaagacatcccttgtcttcg

SEQ ID NO: 1045015 - DNA, 22 bp, Artificial Sequence
  chemically synthesized
taagcagattcgaagacaaggg

SEQ ID NO: 1045016 - DNA, 22 bp, Artificial Sequence
  chemically synthesized
gatcattcccaaagacatccct

SEQ ID NO: 1045017 - DNA, 22 bp, Artificial Sequence
  chemically synthesized
ggatcattcccaaagacatccc

SEQ ID NO: 1045018 - DNA, 22 bp, Artificial Sequence
  chemically synthesized
cttggatcattcccaaagacat

SEQ ID NO: 1045019 - DNA, 22 bp, Artificial Sequence
  chemically synthesized
gaagacaagggatgtctttggg

SEQ ID NO: 1045020 - DNA, 22 bp, Artificial Sequence
  chemically synthesized
gcacctccttggatcattccca

SEQ ID NO: 1045021 - DNA, 22 bp, Artificial Sequence
  chemically synthesized
ctagcacctccttggatcattc

SEQ ID NO: 1045022 - DNA, 22 bp, Artificial Sequence
  chemically synthesized
actagcacctccttggatcatt

SEQ ID NO: 1045023 - DNA, 22 bp, Artificial Sequence
  chemically synthesized
tactagcacctccttggatcat

SEQ ID NO: 1045024 - DNA, 22 bp, Artificial Sequence
  chemically synthesized
tgggaatgatccaaggaggtgc

SEQ ID NO: 1045025 - DNA, 22 bp, Artificial Sequence
  chemically synthesized
gggaatgatccaaggaggtgct

SEQ ID NO: 1045026 - DNA, 22 bp, Artificial Sequence
  chemically synthesized
ggaatgatccaaggaggtgcta

SEQ ID NO: 1045027 - DNA, 22 bp, Artificial Sequence
  chemically synthesized
cacacactttactagcacctcc

SEQ ID NO: 1045028 - DNA, 22 bp, Artificial Sequence
  chemically synthesized
acacacactttactagcacctc

SEQ ID NO: 1045029 - DNA, 22 bp, Artificial Sequence
  chemically synthesized
ccttacacacactttactagca

SEQ ID NO: 1045030 - DNA, 22 bp, Artificial Sequence
  chemically synthesized
tcctaccttacacacactttac

SEQ ID NO: 1045031 - DNA, 22 bp, Artificial Sequence
  chemically synthesized
cctgtcctaccttacacacact

SEQ ID NO: 1045032 - DNA, 22 bp, Artificial Sequence
  chemically synthesized
ctccctgtcctaccttacacac

SEQ ID NO: 1045033 - DNA, 22 bp, Artificial Sequence
  chemically synthesized
gctccctgtcctaccttacaca

SEQ ID NO: 1045034 - DNA, 22 bp, Artificial Sequence
  chemically synthesized
gtaaagtgtgtgtaaggtagga

SEQ ID NO: 1045035 - DNA, 22 bp, Artificial Sequence
  chemically synthesized
acttgctccctgtcctacctta

SEQ ID NO: 1045036 - DNA, 22 bp, Artificial Sequence
  chemically synthesized
cacttgctccctgtcctacctt

SEQ ID NO: 1045037 - DNA, 22 bp, Artificial Sequence
  chemically synthesized
ataggatacatttcacttgctc

SEQ ID NO: 1045038 - DNA, 22 bp, Artificial Sequence
  chemically synthesized
cctcataggatacatttcactt

SEQ ID NO: 1045039 - DNA, 22 bp, Artificial Sequence
  chemically synthesized
agaccccatcgcacacagtaaa

SEQ ID NO: 1045040 - DNA, 22 bp, Artificial Sequence
  chemically synthesized
tgaggcaggtttttactgtgtg

SEQ ID NO: 1045041 - DNA, 22 bp, Artificial Sequence
  chemically synthesized
caggattaagaccccatcgcac

SEQ ID NO: 1045042 - DNA, 22 bp, Artificial Sequence
  chemically synthesized
ttccaggattaagaccccatcg

SEQ ID NO: 1045043 - DNA, 22 bp, Artificial Sequence
  chemically synthesized
ttactgtgtgcgatggggtctt

SEQ ID NO: 1045044 - DNA, 22 bp, Artificial Sequence
  chemically synthesized
tgttccaggattaagaccccat

SEQ ID NO: 1045045 - DNA, 22 bp, Artificial Sequence
  chemically synthesized
tactgtgtgcgatggggtctta

SEQ ID NO: 1045046 - DNA, 22 bp, Artificial Sequence
  chemically synthesized
actgtgtgcgatggggtcttaa

SEQ ID NO: 1045047 - DNA, 22 bp, Artificial Sequence
  chemically synthesized
ctgtgtgcgatggggtcttaat

SEQ ID NO: 1045048 - DNA, 22 bp, Artificial Sequence
  chemically synthesized
tgtgcgatggggtcttaatcct

SEQ ID NO: 1045049 - DNA, 22 bp, Artificial Sequence
  chemically synthesized
acccaaaattctgttccaggat

SEQ ID NO: 1045050 - DNA, 22 bp, Artificial Sequence
  chemically synthesized
tgacccaaaattctgttccagg

SEQ ID NO: 1045051 - DNA, 22 bp, Artificial Sequence
  chemically synthesized
tgctctgacccaaaattctgtt

SEQ ID NO: 1045052 - DNA, 22 bp, Artificial Sequence
  chemically synthesized
atgctctgacccaaaattctgt

SEQ ID NO: 1045053 - DNA, 22 bp, Artificial Sequence
  chemically synthesized
aatcctggaacagaattttggg

SEQ ID NO: 1045054 - DNA, 22 bp, Artificial Sequence
  chemically synthesized
atcctggaacagaattttgggt

SEQ ID NO: 1045055 - DNA, 22 bp, Artificial Sequence
  chemically synthesized
gaacagaattttgggtcagagc

SEQ ID NO: 1045056 - DNA, 22 bp, Artificial Sequence
  chemically synthesized
aagcatgatttatgctctgacc

SEQ ID NO: 1045057 - DNA, 22 bp, Artificial Sequence
  chemically synthesized
tgaagcatgatttatgctctga

SEQ ID NO: 1045058 - DNA, 22 bp, Artificial Sequence
  chemically synthesized
tgggtcagagcataaatcatgc

SEQ ID NO: 1045059 - DNA, 22 bp, Artificial Sequence
  chemically synthesized
gggtcagagcataaatcatgct

SEQ ID NO: 1045060 - DNA, 22 bp, Artificial Sequence
  chemically synthesized
gggtaactctgaagcatgattt

SEQ ID NO: 1045061 - DNA, 22 bp, Artificial Sequence
  chemically synthesized
ggtcagagcataaatcatgctt

SEQ ID NO: 1045062 - DNA, 22 bp, Artificial Sequence
  chemically synthesized
agttagggtaactctgaagcat

SEQ ID NO: 1045063 - DNA, 22 bp, Artificial Sequence
  chemically synthesized
cagttagggtaactctgaagca

SEQ ID NO: 1045064 - DNA, 22 bp, Artificial Sequence
  chemically synthesized
ttcagttagggtaactctgaag

SEQ ID NO: 1045065 - DNA, 22 bp, Artificial Sequence
  chemically synthesized
attcttcagttagggtaactct

SEQ ID NO: 1045066 - DNA, 22 bp, Artificial Sequence
  chemically synthesized
actcattcttcagttagggtaa

SEQ ID NO: 1045067 - DNA, 22 bp, Artificial Sequence
  chemically synthesized
ctcactcattcttcagttaggg

SEQ ID NO: 1045068 - DNA, 22 bp, Artificial Sequence
  chemically synthesized
cagagttaccctaactgaagaa

SEQ ID NO: 1045069 - DNA, 22 bp, Artificial Sequence
  chemically synthesized
agagttaccctaactgaagaat

SEQ ID NO: 1045070 - DNA, 22 bp, Artificial Sequence
  chemically synthesized
ccctaactgaagaatgagtgag

SEQ ID NO: 1045071 - DNA, 22 bp, Artificial Sequence
  chemically synthesized
actgaagaatgagtgagtagtg

SEQ ID NO: 1045072 - DNA, 22 bp, Artificial Sequence
  chemically synthesized
gtggataaataccactactcac

SEQ ID NO: 1045073 - DNA, 22 bp, Artificial Sequence
  chemically synthesized
ggtggataaataccactactca

SEQ ID NO: 1045074 - DNA, 22 bp, Artificial Sequence
  chemically synthesized
tggtggataaataccactactc

SEQ ID NO: 1045075 - DNA, 22 bp, Artificial Sequence
  chemically synthesized
ttggtggataaataccactact

SEQ ID NO: 1045076 - DNA, 22 bp, Artificial Sequence
  chemically synthesized
aagaatgagtgagtagtggtat

SEQ ID NO: 1045077 - DNA, 22 bp, Artificial Sequence
  chemically synthesized
aaccaataacaaataacttttg

SEQ ID NO: 1045078 - DNA, 22 bp, Artificial Sequence
  chemically synthesized
atccaccaaaagttatttgtta

SEQ ID NO: 1045079 - DNA, 22 bp, Artificial Sequence
  chemically synthesized
tccaccaaaagttatttgttat

SEQ ID NO: 1045080 - DNA, 22 bp, Artificial Sequence
  chemically synthesized
cccagcaaacctcaaccaataa

SEQ ID NO: 1045081 - DNA, 22 bp, Artificial Sequence
  chemically synthesized
tttgttattggttgaggtttgc

SEQ ID NO: 1045082 - DNA, 22 bp, Artificial Sequence
  chemically synthesized
gttattggttgaggtttgctgg

SEQ ID NO: 1045083 - DNA, 22 bp, Artificial Sequence
  chemically synthesized
ttattggttgaggtttgctggg

SEQ ID NO: 1045084 - DNA, 22 bp, Artificial Sequence
  chemically synthesized
catcccccgtgttccccagcaa

SEQ ID NO: 1045085 - DNA, 22 bp, Artificial Sequence
  chemically synthesized
ttggttgaggtttgctggggaa

SEQ ID NO: 1045086 - DNA, 22 bp, Artificial Sequence
  chemically synthesized
tgcatcccccgtgttccccagc

SEQ ID NO: 1045087 - DNA, 22 bp, Artificial Sequence
  chemically synthesized
gttgaggtttgctggggaacac

SEQ ID NO: 1045088 - DNA, 22 bp, Artificial Sequence
  chemically synthesized
aggtttgctggggaacacgggg

SEQ ID NO: 1045089 - DNA, 22 bp, Artificial Sequence
  chemically synthesized
aagttctgcatcccccgtgttc

SEQ ID NO: 1045090 - DNA, 22 bp, Artificial Sequence
  chemically synthesized
gctggggaacacgggggatgca

SEQ ID NO: 1045091 - DNA, 22 bp, Artificial Sequence
  chemically synthesized
ctggggaacacgggggatgcag

SEQ ID NO: 1045092 - DNA, 22 bp, Artificial Sequence
  chemically synthesized
gggaacacgggggatgcagaac

SEQ ID NO: 1045093 - DNA, 22 bp, Artificial Sequence
  chemically synthesized
atgagtgtcaggtagttaaagt

SEQ ID NO: 1045094 - DNA, 22 bp, Artificial Sequence
  chemically synthesized
gtaatcaaagctcatgagtgtc

SEQ ID NO: 1045095 - DNA, 22 bp, Artificial Sequence
  chemically synthesized
tagtaatcaaagctcatgagtg

SEQ ID NO: 1045096 - DNA, 22 bp, Artificial Sequence
  chemically synthesized
taactacctgacactcatgagc

SEQ ID NO: 1045097 - DNA, 22 bp, Artificial Sequence
  chemically synthesized
aactacctgacactcatgagct

SEQ ID NO: 1045098 - DNA, 22 bp, Artificial Sequence
  chemically synthesized
tctagtaatcaaagctcatgag

SEQ ID NO: 1045099 - DNA, 22 bp, Artificial Sequence
  chemically synthesized
actacctgacactcatgagctt

SEQ ID NO: 1045100 - DNA, 22 bp, Artificial Sequence
  chemically synthesized
tctctagtaatcaaagctcatg

SEQ ID NO: 1045101 - DNA, 22 bp, Artificial Sequence
  chemically synthesized
cctgacactcatgagctttgat

SEQ ID NO: 1045102 - DNA, 22 bp, Artificial Sequence
  chemically synthesized
gggctctctctagtaatcaaag

SEQ ID NO: 1045103 - DNA, 22 bp, Artificial Sequence
  chemically synthesized
acactcatgagctttgattact

SEQ ID NO: 1045104 - DNA, 22 bp, Artificial Sequence
  chemically synthesized
agggctctctctagtaatcaaa

SEQ ID NO: 1045105 - DNA, 22 bp, Artificial Sequence
  chemically synthesized
ccttagggctctctctagtaat

SEQ ID NO: 1045106 - DNA, 22 bp, Artificial Sequence
  chemically synthesized
gccttagggctctctctagtaa

SEQ ID NO: 1045107 - DNA, 22 bp, Artificial Sequence
  chemically synthesized
atgagctttgattactagagag

SEQ ID NO: 1045108 - DNA, 22 bp, Artificial Sequence
  chemically synthesized
tttgccttagggctctctctag

SEQ ID NO: 1045109 - DNA, 22 bp, Artificial Sequence
  chemically synthesized
actgtttgccttagggctctct

SEQ ID NO: 1045110 - DNA, 22 bp, Artificial Sequence
  chemically synthesized
tgattactagagagagccctaa

SEQ ID NO: 1045111 - DNA, 22 bp, Artificial Sequence
  chemically synthesized
tgactgtttgccttagggctct

SEQ ID NO: 1045112 - DNA, 22 bp, Artificial Sequence
  chemically synthesized
gattactagagagagccctaag

SEQ ID NO: 1045113 - DNA, 22 bp, Artificial Sequence
  chemically synthesized
attactagagagagccctaagg

SEQ ID NO: 1045114 - DNA, 22 bp, Artificial Sequence
  chemically synthesized
ctagagagagccctaaggcaaa

SEQ ID NO: 1045115 - DNA, 22 bp, Artificial Sequence
  chemically synthesized
gagagagccctaaggcaaacag

SEQ ID NO: 1045116 - DNA, 22 bp, Artificial Sequence
  chemically synthesized
ccagatccaagtgtctctgact

SEQ ID NO: 1045117 - DNA, 22 bp, Artificial Sequence
  chemically synthesized
aggcaaacagtcagagacactt

SEQ ID NO: 1045118 - DNA, 22 bp, Artificial Sequence
  chemically synthesized
gtagctgccagatccaagtgtc

SEQ ID NO: 1045119 - DNA, 22 bp, Artificial Sequence
  chemically synthesized
actggtagctgccagatccaag

SEQ ID NO: 1045120 - DNA, 22 bp, Artificial Sequence
  chemically synthesized
tgactggtagctgccagatcca

SEQ ID NO: 1045121 - DNA, 22 bp, Artificial Sequence
  chemically synthesized
tactctgactggtagctgccag

SEQ ID NO: 1045122 - DNA, 22 bp, Artificial Sequence
  chemically synthesized
gtactctgactggtagctgcca

SEQ ID NO: 1045123 - DNA, 22 bp, Artificial Sequence
  chemically synthesized
ggatctggcagctaccagtcag

SEQ ID NO: 1045124 - DNA, 22 bp, Artificial Sequence
  chemically synthesized
gatctggcagctaccagtcaga

SEQ ID NO: 1045125 - DNA, 22 bp, Artificial Sequence
  chemically synthesized
agcatgccttgtactctgactg

SEQ ID NO: 1045126 - DNA, 22 bp, Artificial Sequence
  chemically synthesized
gcagctaccagtcagagtacaa

SEQ ID NO: 1045127 - DNA, 22 bp, Artificial Sequence
  chemically synthesized
actcagcatgccttgtactctg

SEQ ID NO: 1045128 - DNA, 22 bp, Artificial Sequence
  chemically synthesized
ctgactcagcatgccttgtact

SEQ ID NO: 1045129 - DNA, 22 bp, Artificial Sequence
  chemically synthesized
cctgactcagcatgccttgtac

SEQ ID NO: 1045130 - DNA, 22 bp, Artificial Sequence
  chemically synthesized
ccagtcagagtacaaggcatgc

SEQ ID NO: 1045131 - DNA, 22 bp, Artificial Sequence
  chemically synthesized
ggatgtcacccatatcatttcc

SEQ ID NO: 1045132 - DNA, 22 bp, Artificial Sequence
  chemically synthesized
gggatgtcacccatatcatttc

SEQ ID NO: 1045133 - DNA, 22 bp, Artificial Sequence
  chemically synthesized
ttgggatgtcacccatatcatt

SEQ ID NO: 1045134 - DNA, 22 bp, Artificial Sequence
  chemically synthesized
agtcaggaaatgatatgggtga

SEQ ID NO: 1045135 - DNA, 22 bp, Artificial Sequence
  chemically synthesized
gaggatgaaacactcttgggat

SEQ ID NO: 1045136 - DNA, 22 bp, Artificial Sequence
  chemically synthesized
ttggaggatgaaacactcttgg

SEQ ID NO: 1045137 - DNA, 22 bp, Artificial Sequence
  chemically synthesized
attggaggatgaaacactcttg

SEQ ID NO: 1045138 - DNA, 22 bp, Artificial Sequence
  chemically synthesized
tattggaggatgaaacactctt

SEQ ID NO: 1045139 - DNA, 22 bp, Artificial Sequence
  chemically synthesized
aaagcatcagttttattggagg

SEQ ID NO: 1045140 - DNA, 22 bp, Artificial Sequence
  chemically synthesized
ctgaaagcatcagttttattgg

SEQ ID NO: 1045141 - DNA, 22 bp, Artificial Sequence
  chemically synthesized
actgaaagcatcagttttattg

SEQ ID NO: 1045142 - DNA, 22 bp, Artificial Sequence
  chemically synthesized
tactgaaagcatcagttttatt

SEQ ID NO: 1045143 - DNA, 22 bp, Artificial Sequence
  chemically synthesized
catcctccaataaaactgatgc

SEQ ID NO: 1045144 - DNA, 22 bp, Artificial Sequence
  chemically synthesized
attttactgaaagcatcagttt

SEQ ID NO: 1045145 - DNA, 22 bp, Artificial Sequence
  chemically synthesized
atcctccaataaaactgatgct

SEQ ID NO: 1045146 - DNA, 22 bp, Artificial Sequence
  chemically synthesized
caataaaactgatgctttcagt

SEQ ID NO: 1045147 - DNA, 22 bp, Artificial Sequence
  chemically synthesized
atgctttcagtaaaattaggca

SEQ ID NO: 1045148 - DNA, 22 bp, Artificial Sequence
  chemically synthesized
tcatcatgtgtccatatgccta

SEQ ID NO: 1045149 - DNA, 22 bp, Artificial Sequence
  chemically synthesized
atcatcatgtgtccatatgcct

SEQ ID NO: 1045150 - DNA, 22 bp, Artificial Sequence
  chemically synthesized
tcagtaaaattaggcatatgga

SEQ ID NO: 1045151 - DNA, 22 bp, Artificial Sequence
  chemically synthesized
cagtaaaattaggcatatggac

SEQ ID NO: 1045152 - DNA, 22 bp, Artificial Sequence
  chemically synthesized
agtaaaattaggcatatggaca

SEQ ID NO: 1045153 - DNA, 22 bp, Artificial Sequence
  chemically synthesized
aaaggatttatcatcatgtgtc

SEQ ID NO: 1045154 - DNA, 22 bp, Artificial Sequence
  chemically synthesized
ggcatatggacacatgatgata

SEQ ID NO: 1045155 - DNA, 22 bp, Artificial Sequence
  chemically synthesized
actgaaaggatttatcatcatg

SEQ ID NO: 1045156 - DNA, 22 bp, Artificial Sequence
  chemically synthesized
aactgaaaggatttatcatcat

SEQ ID NO: 1045157 - DNA, 22 bp, Artificial Sequence
  chemically synthesized
aaagacttaactgaaaggattt

SEQ ID NO: 1045158 - DNA, 22 bp, Artificial Sequence
  chemically synthesized
aaaagacttaactgaaaggatt

SEQ ID NO: 1045159 - DNA, 22 bp, Artificial Sequence
  chemically synthesized
tcagttaagtcttttaagtgga

SEQ ID NO: 1045160 - DNA, 22 bp, Artificial Sequence
  chemically synthesized
cagttaagtcttttaagtggat

SEQ ID NO: 1045161 - DNA, 22 bp, Artificial Sequence
  chemically synthesized
aaagcagaaatgatccacttaa

SEQ ID NO: 1045162 - DNA, 22 bp, Artificial Sequence
  chemically synthesized
agttaagtcttttaagtggatc

SEQ ID NO: 1045163 - DNA, 22 bp, Artificial Sequence
  chemically synthesized
tcctaaaagcagaaatgatcca

SEQ ID NO: 1045164 - DNA, 22 bp, Artificial Sequence
  chemically synthesized
agtcttttaagtggatcatttc

SEQ ID NO: 1045165 - DNA, 22 bp, Artificial Sequence
  chemically synthesized
atcctaaaagcagaaatgatcc

SEQ ID NO: 1045166 - DNA, 22 bp, Artificial Sequence
  chemically synthesized
ttaagtggatcatttctgcttt

SEQ ID NO: 1045167 - DNA, 22 bp, Artificial Sequence
  chemically synthesized
taagtggatcatttctgctttt

SEQ ID NO: 1045168 - DNA, 22 bp, Artificial Sequence
  chemically synthesized
aaagcttatcctaaaagcagaa

SEQ ID NO: 1045169 - DNA, 22 bp, Artificial Sequence
  chemically synthesized
aagtggatcatttctgctttta

SEQ ID NO: 1045170 - DNA, 22 bp, Artificial Sequence
  chemically synthesized
gaaagcttatcctaaaagcaga

SEQ ID NO: 1045171 - DNA, 22 bp, Artificial Sequence
  chemically synthesized
agtggatcatttctgcttttag

SEQ ID NO: 1045172 - DNA, 22 bp, Artificial Sequence
  chemically synthesized
aatatttgaaagcttatcctaa

SEQ ID NO: 1045173 - DNA, 22 bp, Artificial Sequence
  chemically synthesized
ctgcttttaggataagctttca

SEQ ID NO: 1045174 - DNA, 22 bp, Artificial Sequence
  chemically synthesized
tgcttttaggataagctttcaa

SEQ ID NO: 1045175 - DNA, 22 bp, Artificial Sequence
  chemically synthesized
cttttaggataagctttcaaat

SEQ ID NO: 1045176 - DNA, 22 bp, Artificial Sequence
  chemically synthesized
gagagagttaaatatttgaaag

SEQ ID NO: 1045177 - DNA, 22 bp, Artificial Sequence
  chemically synthesized
ttaggataagctttcaaatatt

SEQ ID NO: 1045178 - DNA, 22 bp, Artificial Sequence
  chemically synthesized
tggagagagttaaatatttgaa

SEQ ID NO: 1045179 - DNA, 22 bp, Artificial Sequence
  chemically synthesized
taggataagctttcaaatattt

SEQ ID NO: 1045180 - DNA, 22 bp, Artificial Sequence
  chemically synthesized
aggataagctttcaaatattta

SEQ ID NO: 1045181 - DNA, 22 bp, Artificial Sequence
  chemically synthesized
tctggagagagttaaatatttg

SEQ ID NO: 1045182 - DNA, 22 bp, Artificial Sequence
  chemically synthesized
ggataagctttcaaatatttaa

SEQ ID NO: 1045183 - DNA, 22 bp, Artificial Sequence
  chemically synthesized
ctctggagagagttaaatattt

SEQ ID NO: 1045184 - DNA, 22 bp, Artificial Sequence
  chemically synthesized
tctctggagagagttaaatatt

SEQ ID NO: 1045185 - DNA, 22 bp, Artificial Sequence
  chemically synthesized
tcaaatatttaactctctccag

SEQ ID NO: 1045186 - DNA, 22 bp, Artificial Sequence
  chemically synthesized
caaatatttaactctctccaga

SEQ ID NO: 1045187 - DNA, 22 bp, Artificial Sequence
  chemically synthesized
aaatatttaactctctccagag

SEQ ID NO: 1045188 - DNA, 22 bp, Artificial Sequence
  chemically synthesized
ccaaaaggttttctctggagag

SEQ ID NO: 1045189 - DNA, 22 bp, Artificial Sequence
  chemically synthesized
aattaccaaaaggttttctctg

SEQ ID NO: 1045190 - DNA, 22 bp, Artificial Sequence
  chemically synthesized
aaattaccaaaaggttttctct

SEQ ID NO: 1045191 - DNA, 22 bp, Artificial Sequence
  chemically synthesized
taaattaccaaaaggttttctc

SEQ ID NO: 1045192 - DNA, 22 bp, Artificial Sequence
  chemically synthesized
aactctctccagagaaaacctt

SEQ ID NO: 1045193 - DNA, 22 bp, Artificial Sequence
  chemically synthesized
actctctccagagaaaaccttt

SEQ ID NO: 1045194 - DNA, 22 bp, Artificial Sequence
  chemically synthesized
tctccagagaaaaccttttggt

SEQ ID NO: 1045195 - DNA, 22 bp, Artificial Sequence
  chemically synthesized
tccagagaaaaccttttggtaa

SEQ ID NO: 1045196 - DNA, 22 bp, Artificial Sequence
  chemically synthesized
cagagaaaaccttttggtaatt

SEQ ID NO: 1045197 - DNA, 22 bp, Artificial Sequence
  chemically synthesized
gcatcgtaagttttaaattacc

SEQ ID NO: 1045198 - DNA, 22 bp, Artificial Sequence
  chemically synthesized
agcatcgtaagttttaaattac

SEQ ID NO: 1045199 - DNA, 22 bp, Artificial Sequence
  chemically synthesized
ttagcatcgtaagttttaaatt

SEQ ID NO: 1045200 - DNA, 22 bp, Artificial Sequence
  chemically synthesized
cttagcatcgtaagttttaaat

SEQ ID NO: 1045201 - DNA, 22 bp, Artificial Sequence
  chemically synthesized
ttggtaatttaaaacttacgat

SEQ ID NO: 1045202 - DNA, 22 bp, Artificial Sequence
  chemically synthesized
tggtaatttaaaacttacgatg

SEQ ID NO: 1045203 - DNA, 22 bp, Artificial Sequence
  chemically synthesized
ggtaatttaaaacttacgatgc

SEQ ID NO: 1045204 - DNA, 22 bp, Artificial Sequence
  chemically synthesized
gtaatttaaaacttacgatgct

SEQ ID NO: 1045205 - DNA, 22 bp, Artificial Sequence
  chemically synthesized
aaaacttacgatgctaagaaat

SEQ ID NO: 1045206 - DNA, 22 bp, Artificial Sequence
  chemically synthesized
aaacttacgatgctaagaaatt

SEQ ID NO: 1045207 - DNA, 22 bp, Artificial Sequence
  chemically synthesized
acgatgctaagaaattctgtgt

SEQ ID NO: 1045208 - DNA, 22 bp, Artificial Sequence
  chemically synthesized
cgatgctaagaaattctgtgtt

SEQ ID NO: 1045209 - DNA, 22 bp, Artificial Sequence
  chemically synthesized
atatgaaagcatgaacacagaa

SEQ ID NO: 1045210 - DNA, 22 bp, Artificial Sequence
  chemically synthesized
agaaattctgtgttcatgcttt

SEQ ID NO: 1045211 - DNA, 22 bp, Artificial Sequence
  chemically synthesized
aagtatctcatatgaaagcatg

SEQ ID NO: 1045212 - DNA, 22 bp, Artificial Sequence
  chemically synthesized
aaagtatctcatatgaaagcat

SEQ ID NO: 1045213 - DNA, 22 bp, Artificial Sequence
  chemically synthesized
ccttaaagtatctcatatgaaa

SEQ ID NO: 1045214 - DNA, 22 bp, Artificial Sequence
  chemically synthesized
tgtgttcatgctttcatatgag

SEQ ID NO: 1045215 - DNA, 22 bp, Artificial Sequence
  chemically synthesized
tgttcatgctttcatatgagat

SEQ ID NO: 1045216 - DNA, 22 bp, Artificial Sequence
  chemically synthesized
atgctttcatatgagatacttt

SEQ ID NO: 1045217 - DNA, 22 bp, Artificial Sequence
  chemically synthesized
tcatatgagatactttaaggca

SEQ ID NO: 1045218 - DNA, 22 bp, Artificial Sequence
  chemically synthesized
catatgagatactttaaggcag

SEQ ID NO: 1045219 - DNA, 22 bp, Artificial Sequence
  chemically synthesized
aaccgtcaaatcctgccttaaa

SEQ ID NO: 1045220 - DNA, 22 bp, Artificial Sequence
  chemically synthesized
atatgagatactttaaggcagg

SEQ ID NO: 1045221 - DNA, 22 bp, Artificial Sequence
  chemically synthesized
tgttaaaccgtcaaatcctgcc

SEQ ID NO: 1045222 - DNA, 22 bp, Artificial Sequence
  chemically synthesized
ctgtgttaaaccgtcaaatcct

SEQ ID NO: 1045223 - DNA, 22 bp, Artificial Sequence
  chemically synthesized
taaggcaggatttgacggttta

SEQ ID NO: 1045224 - DNA, 22 bp, Artificial Sequence
  chemically synthesized
aaggcaggatttgacggtttaa

SEQ ID NO: 1045225 - DNA, 22 bp, Artificial Sequence
  chemically synthesized
aggcaggatttgacggtttaac

SEQ ID NO: 1045226 - DNA, 22 bp, Artificial Sequence
  chemically synthesized
caaaatataattactgtgttaa

SEQ ID NO: 1045227 - DNA, 22 bp, Artificial Sequence
  chemically synthesized
ccaaaatataattactgtgtta

SEQ ID NO: 1045228 - DNA, 22 bp, Artificial Sequence
  chemically synthesized
tccaaaatataattactgtgtt

SEQ ID NO: 1045229 - DNA, 22 bp, Artificial Sequence
  chemically synthesized
gacggtttaacacagtaattat

SEQ ID NO: 1045230 - DNA, 22 bp, Artificial Sequence
  chemically synthesized
acggtttaacacagtaattata

SEQ ID NO: 1045231 - DNA, 22 bp, Artificial Sequence
  chemically synthesized
aacacagtaattatattttgga

SEQ ID NO: 1045232 - DNA, 22 bp, Artificial Sequence
  chemically synthesized
atgataaaattttccaaaatat

SEQ ID NO: 1045233 - DNA, 22 bp, Artificial Sequence
  chemically synthesized
acacagtaattatattttggaa

SEQ ID NO: 1045234 - DNA, 22 bp, Artificial Sequence
  chemically synthesized
catgataaaattttccaaaata

SEQ ID NO: 1045235 - DNA, 22 bp, Artificial Sequence
  chemically synthesized
tcatgataaaattttccaaaat

SEQ ID NO: 1045236 - DNA, 22 bp, Artificial Sequence
  chemically synthesized
tattttggaaaattttatcatg

SEQ ID NO: 1045237 - DNA, 22 bp, Artificial Sequence
  chemically synthesized
agaaaaaatcattttcatgata

SEQ ID NO: 1045238 - DNA, 22 bp, Artificial Sequence
  chemically synthesized
aagaaaaaatcattttcatgat

SEQ ID NO: 1045239 - DNA, 22 bp, Artificial Sequence
  chemically synthesized
tggaaaattttatcatgaaaat

SEQ ID NO: 1045240 - DNA, 22 bp, Artificial Sequence
  chemically synthesized
taagaaaaaatcattttcatga

SEQ ID NO: 1045241 - DNA, 22 bp, Artificial Sequence
  chemically synthesized
ggaaaattttatcatgaaaatg

SEQ ID NO: 1045242 - DNA, 22 bp, Artificial Sequence
  chemically synthesized
ttaagaaaaaatcattttcatg

SEQ ID NO: 1045243 - DNA, 22 bp, Artificial Sequence
  chemically synthesized
gaaaattttatcatgaaaatga

SEQ ID NO: 1045244 - DNA, 22 bp, Artificial Sequence
  chemically synthesized
atttttaagaaaaaatcatttt

SEQ ID NO: 1045245 - DNA, 22 bp, Artificial Sequence
  chemically synthesized
catttttaagaaaaaatcattt

SEQ ID NO: 1045246 - DNA, 22 bp, Artificial Sequence
  chemically synthesized
tatcatgaaaatgattttttct

SEQ ID NO: 1045247 - DNA, 22 bp, Artificial Sequence
  chemically synthesized
atcatgaaaatgattttttctt

SEQ ID NO: 1045248 - DNA, 22 bp, Artificial Sequence
  chemically synthesized
catttcatttttaagaaaaaat

SEQ ID NO: 1045249 - DNA, 22 bp, Artificial Sequence
  chemically synthesized
tcatgaaaatgattttttctta

SEQ ID NO: 1045250 - DNA, 22 bp, Artificial Sequence
  chemically synthesized
gcatttcatttttaagaaaaaa

SEQ ID NO: 1045251 - DNA, 22 bp, Artificial Sequence
  chemically synthesized
acttgcatttcatttttaagaa

SEQ ID NO: 1045252 - DNA, 22 bp, Artificial Sequence
  chemically synthesized
tttcttaaaaatgaaatgcaag

SEQ ID NO: 1045253 - DNA, 22 bp, Artificial Sequence
  chemically synthesized
gagcaatattaacttgcatttc

SEQ ID NO: 1045254 - DNA, 22 bp, Artificial Sequence
  chemically synthesized
ttcttaaaaatgaaatgcaagt

SEQ ID NO: 1045255 - DNA, 22 bp, Artificial Sequence
  chemically synthesized
agagcaatattaacttgcattt

SEQ ID NO: 1045256 - DNA, 22 bp, Artificial Sequence
  chemically synthesized
tcttaaaaatgaaatgcaagtt

SEQ ID NO: 1045257 - DNA, 22 bp, Artificial Sequence
  chemically synthesized
cttaaaaatgaaatgcaagtta

SEQ ID NO: 1045258 - DNA, 22 bp, Artificial Sequence
  chemically synthesized
ttaaaaatgaaatgcaagttaa

SEQ ID NO: 1045259 - DNA, 22 bp, Artificial Sequence
  chemically synthesized
aaaaatgaaatgcaagttaata

SEQ ID NO: 1045260 - DNA, 22 bp, Artificial Sequence
  chemically synthesized
aaaatgaaatgcaagttaatat

SEQ ID NO: 1045261 - DNA, 22 bp, Artificial Sequence
  chemically synthesized
gaagtttagagcaatattaact

SEQ ID NO: 1045262 - DNA, 22 bp, Artificial Sequence
  chemically synthesized
ggaagtttagagcaatattaac

SEQ ID NO: 1045263 - DNA, 22 bp, Artificial Sequence
  chemically synthesized
tggaagtttagagcaatattaa

SEQ ID NO: 1045264 - DNA, 22 bp, Artificial Sequence
  chemically synthesized
ttggaagtttagagcaatatta

SEQ ID NO: 1045265 - DNA, 22 bp, Artificial Sequence
  chemically synthesized
tttggaagtttagagcaatatt

SEQ ID NO: 1045266 - DNA, 22 bp, Artificial Sequence
  chemically synthesized
caattttttggaagtttagagc

SEQ ID NO: 1045267 - DNA, 22 bp, Artificial Sequence
  chemically synthesized
atattgctctaaacttccaaaa

SEQ ID NO: 1045268 - DNA, 22 bp, Artificial Sequence
  chemically synthesized
gaagaattgcaattttttggaa

SEQ ID NO: 1045269 - DNA, 22 bp, Artificial Sequence
  chemically synthesized
agaagaattgcaattttttgga

SEQ ID NO: 1045270 - DNA, 22 bp, Artificial Sequence
  chemically synthesized
tagaagaattgcaattttttgg

SEQ ID NO: 1045271 - DNA, 22 bp, Artificial Sequence
  chemically synthesized
ctctaaacttccaaaaaattgc

SEQ ID NO: 1045272 - DNA, 22 bp, Artificial Sequence
  chemically synthesized
taaacttccaaaaaattgcaat

SEQ ID NO: 1045273 - DNA, 22 bp, Artificial Sequence
  chemically synthesized
aacttccaaaaaattgcaattc

SEQ ID NO: 1045274 - DNA, 22 bp, Artificial Sequence
  chemically synthesized
ccaaaaaattgcaattcttcta

SEQ ID NO: 1045275 - DNA, 22 bp, Artificial Sequence
  chemically synthesized
caaaaaattgcaattcttctaa

SEQ ID NO: 1045276 - DNA, 22 bp, Artificial Sequence
  chemically synthesized
caattcttctaaaattatgtac

SEQ ID NO: 1045277 - DNA, 22 bp, Artificial Sequence
  chemically synthesized
ataacagacaagagtacataat

SEQ ID NO: 1045278 - DNA, 22 bp, Artificial Sequence
  chemically synthesized
ttctaaaattatgtactcttgt

SEQ ID NO: 1045279 - DNA, 22 bp, Artificial Sequence
  chemically synthesized
ctaaaattatgtactcttgtct

SEQ ID NO: 1045280 - DNA, 22 bp, Artificial Sequence
  chemically synthesized
taaaattatgtactcttgtctg

SEQ ID NO: 1045281 - DNA, 22 bp, Artificial Sequence
  chemically synthesized
ataatactcataacagacaaga

SEQ ID NO: 1045282 - DNA, 22 bp, Artificial Sequence
  chemically synthesized
aaattatgtactcttgtctgtt

SEQ ID NO: 1045283 - DNA, 22 bp, Artificial Sequence
  chemically synthesized
tgtactcttgtctgttatgagt

SEQ ID NO: 1045284 - DNA, 22 bp, Artificial Sequence
  chemically synthesized
ttgtctgttatgagtattatta

SEQ ID NO: 1045285 - DNA, 22 bp, Artificial Sequence
  chemically synthesized
tatgtacaaagttaataatact

SEQ ID NO: 1045286 - DNA, 22 bp, Artificial Sequence
  chemically synthesized
atatgtacaaagttaataatac

SEQ ID NO: 1045287 - DNA, 22 bp, Artificial Sequence
  chemically synthesized
gtctgttatgagtattattaac

SEQ ID NO: 1045288 - DNA, 22 bp, Artificial Sequence
  chemically synthesized
tctgttatgagtattattaact

SEQ ID NO: 1045289 - DNA, 22 bp, Artificial Sequence
  chemically synthesized
cttatatgtacaaagttaataa

SEQ ID NO: 1045290 - DNA, 22 bp, Artificial Sequence
  chemically synthesized
ttatgagtattattaactttgt

SEQ ID NO: 1045291 - DNA, 22 bp, Artificial Sequence
  chemically synthesized
tgagtattattaactttgtaca

SEQ ID NO: 1045292 - DNA, 22 bp, Artificial Sequence
  chemically synthesized
tgattgcttatatgtacaaagt

SEQ ID NO: 1045293 - DNA, 22 bp, Artificial Sequence
  chemically synthesized
attgtgattgcttatatgtaca

SEQ ID NO: 1045294 - DNA, 22 bp, Artificial Sequence
  chemically synthesized
attgattgtgattgcttatatg

SEQ ID NO: 1045295 - DNA, 22 bp, Artificial Sequence
  chemically synthesized
ttaactttgtacatataagcaa

SEQ ID NO: 1045296 - DNA, 22 bp, Artificial Sequence
  chemically synthesized
actttgtacatataagcaatca

SEQ ID NO: 1045297 - DNA, 22 bp, Artificial Sequence
  chemically synthesized
acagttaattgattgtgattgc

SEQ ID NO: 1045298 - DNA, 22 bp, Artificial Sequence
  chemically synthesized
tgtacatataagcaatcacaat

SEQ ID NO: 1045299 - DNA, 22 bp, Artificial Sequence
  chemically synthesized
gtacatataagcaatcacaatc

SEQ ID NO: 1045300 - DNA, 22 bp, Artificial Sequence
  chemically synthesized
tacatataagcaatcacaatca

SEQ ID NO: 1045301 - DNA, 22 bp, Artificial Sequence
  chemically synthesized
agagccaatattaacagttaat

SEQ ID NO: 1045302 - DNA, 22 bp, Artificial Sequence
  chemically synthesized
cagagccaatattaacagttaa

SEQ ID NO: 1045303 - DNA, 22 bp, Artificial Sequence
  chemically synthesized
cttcagagccaatattaacagt

SEQ ID NO: 1045304 - DNA, 22 bp, Artificial Sequence
  chemically synthesized
acttcagagccaatattaacag

SEQ ID NO: 1045305 - DNA, 22 bp, Artificial Sequence
  chemically synthesized
ttacttcagagccaatattaac

SEQ ID NO: 1045306 - DNA, 22 bp, Artificial Sequence
  chemically synthesized
cttacttcagagccaatattaa

SEQ ID NO: 1045307 - DNA, 22 bp, Artificial Sequence
  chemically synthesized
tcttacttcagagccaatatta

SEQ ID NO: 1045308 - DNA, 22 bp, Artificial Sequence
  chemically synthesized
tttcttacttcagagccaatat

SEQ ID NO: 1045309 - DNA, 22 bp, Artificial Sequence
  chemically synthesized
ctttcttacttcagagccaata

SEQ ID NO: 1045310 - DNA, 22 bp, Artificial Sequence
  chemically synthesized
tctttcttacttcagagccaat

SEQ ID NO: 1045311 - DNA, 22 bp, Artificial Sequence
  chemically synthesized
actgttaatattggctctgaag

SEQ ID NO: 1045312 - DNA, 22 bp, Artificial Sequence
  chemically synthesized
ttaatattggctctgaagtaag

SEQ ID NO: 1045313 - DNA, 22 bp, Artificial Sequence
  chemically synthesized
atattggctctgaagtaagaaa

SEQ ID NO: 1045314 - DNA, 22 bp, Artificial Sequence
  chemically synthesized
gctctgaagtaagaaagaaaat

SEQ ID NO: 1045315 - DNA, 22 bp, Artificial Sequence
  chemically synthesized
tgaagtaagaaagaaaatatta

SEQ ID NO: 1045316 - DNA, 22 bp, Artificial Sequence
  chemically synthesized
aagtaagaaagaaaatattact

SEQ ID NO: 1045317 - DNA, 22 bp, Artificial Sequence
  chemically synthesized
gagaagaatgagaaacatacac

SEQ ID NO: 1045318 - DNA, 22 bp, Artificial Sequence
  chemically synthesized
cttatgtgtatgtttctcattc

SEQ ID NO: 1045319 - DNA, 22 bp, Artificial Sequence
  chemically synthesized
atgtgtatgtttctcattcttc

SEQ ID NO: 1045320 - DNA, 22 bp, Artificial Sequence
  chemically synthesized
tgtgtatgtttctcattcttct

SEQ ID NO: 1045321 - DNA, 22 bp, Artificial Sequence
  chemically synthesized
aggcagagctagagaagaatga

SEQ ID NO: 1045322 - DNA, 22 bp, Artificial Sequence
  chemically synthesized
gctaaggcagagctagagaaga

SEQ ID NO: 1045323 - DNA, 22 bp, Artificial Sequence
  chemically synthesized
ctcattcttctctagctctgcc

SEQ ID NO: 1045324 - DNA, 22 bp, Artificial Sequence
  chemically synthesized
tcattcttctctagctctgcct

SEQ ID NO: 1045325 - DNA, 22 bp, Artificial Sequence
  chemically synthesized
attcttctctagctctgcctta

SEQ ID NO: 1045326 - DNA, 22 bp, Artificial Sequence
  chemically synthesized
ttctctagctctgccttagcta

SEQ ID NO: 1045327 - DNA, 22 bp, Artificial Sequence
  chemically synthesized
atagcaaaaacactagctaagg

SEQ ID NO: 1045328 - DNA, 22 bp, Artificial Sequence
  chemically synthesized
ctctagctctgccttagctagt

SEQ ID NO: 1045329 - DNA, 22 bp, Artificial Sequence
  chemically synthesized
aatagcaaaaacactagctaag

SEQ ID NO: 1045330 - DNA, 22 bp, Artificial Sequence
  chemically synthesized
tctagctctgccttagctagtg

SEQ ID NO: 1045331 - DNA, 22 bp, Artificial Sequence
  chemically synthesized
tagctctgccttagctagtgtt

SEQ ID NO: 1045332 - DNA, 22 bp, Artificial Sequence
  chemically synthesized
gctctgccttagctagtgtttt

SEQ ID NO: 1045333 - DNA, 22 bp, Artificial Sequence
  chemically synthesized
catttaatagcaaaaacactag

SEQ ID NO: 1045334 - DNA, 22 bp, Artificial Sequence
  chemically synthesized
tgccttagctagtgtttttgct

SEQ ID NO: 1045335 - DNA, 22 bp, Artificial Sequence
  chemically synthesized
ccttagctagtgtttttgctat

SEQ ID NO: 1045336 - DNA, 22 bp, Artificial Sequence
  chemically synthesized
agctagtgtttttgctattaaa

SEQ ID NO: 1045337 - DNA, 22 bp, Artificial Sequence
  chemically synthesized
gctagtgtttttgctattaaat

SEQ ID NO: 1045338 - DNA, 22 bp, Artificial Sequence
  chemically synthesized
gtgtttttgctattaaatgcag

SEQ ID NO: 1045339 - DNA, 22 bp, Artificial Sequence
  chemically synthesized
ttgctattaaatgcagatttcc

SEQ ID NO: 1045340 - DNA, 22 bp, Artificial Sequence
  chemically synthesized
tgctattaaatgcagatttcca

SEQ ID NO: 1045341 - DNA, 22 bp, Artificial Sequence
  chemically synthesized
gctattaaatgcagatttccac

SEQ ID NO: 1045342 - DNA, 22 bp, Artificial Sequence
  chemically synthesized
ctattaaatgcagatttccaca

SEQ ID NO: 1045343 - DNA, 22 bp, Artificial Sequence
  chemically synthesized
ttaaatgcagatttccacatat

SEQ ID NO: 1045344 - DNA, 22 bp, Artificial Sequence
  chemically synthesized
aatgcagatttccacatatgta

SEQ ID NO: 1045345 - DNA, 22 bp, Artificial Sequence
  chemically synthesized
ccacatatgtatatatatatac

SEQ ID NO: 1045346 - DNA, 22 bp, Artificial Sequence
  chemically synthesized
cacatatgtatatatatatacg

SEQ ID NO: 1045347 - DNA, 22 bp, Artificial Sequence
  chemically synthesized
tgcagataaacacaaacatata

SEQ ID NO: 1045348 - DNA, 22 bp, Artificial Sequence
  chemically synthesized
acagagactatgcagataaaca

SEQ ID NO: 1045349 - DNA, 22 bp, Artificial Sequence
  chemically synthesized
atcatgttgacagagactatgc

SEQ ID NO: 1045350 - DNA, 22 bp, Artificial Sequence
  chemically synthesized
gtgtttatctgcatagtctctg

SEQ ID NO: 1045351 - DNA, 22 bp, Artificial Sequence
  chemically synthesized
tgtttatctgcatagtctctgt

SEQ ID NO: 1045352 - DNA, 22 bp, Artificial Sequence
  chemically synthesized
cctaatcatgttgacagagact

SEQ ID NO: 1045353 - DNA, 22 bp, Artificial Sequence
  chemically synthesized
atctgcatagtctctgtcaaca

SEQ ID NO: 1045354 - DNA, 22 bp, Artificial Sequence
  chemically synthesized
tctgcatagtctctgtcaacat

SEQ ID NO: 1045355 - DNA, 22 bp, Artificial Sequence
  chemically synthesized
gaaagctacctaatcatgttga

SEQ ID NO: 1045356 - DNA, 22 bp, Artificial Sequence
  chemically synthesized
catagtctctgtcaacatgatt

SEQ ID NO: 1045357 - DNA, 22 bp, Artificial Sequence
  chemically synthesized
aattggaaagctacctaatcat

SEQ ID NO: 1045358 - DNA, 22 bp, Artificial Sequence
  chemically synthesized
tgtcaacatgattaggtagctt

SEQ ID NO: 1045359 - DNA, 22 bp, Artificial Sequence
  chemically synthesized
tcaacatgattaggtagctttc

SEQ ID NO: 1045360 - DNA, 22 bp, Artificial Sequence
  chemically synthesized
aatagatgtattgaattggaaa

SEQ ID NO: 1045361 - DNA, 22 bp, Artificial Sequence
  chemically synthesized
caatagatgtattgaattggaa

SEQ ID NO: 1045362 - DNA, 22 bp, Artificial Sequence
  chemically synthesized
ggtagctttccaattcaataca

SEQ ID NO: 1045363 - DNA, 22 bp, Artificial Sequence
  chemically synthesized
tccaattcaatacatctattga

SEQ ID NO: 1045364 - DNA, 22 bp, Artificial Sequence
  chemically synthesized
ccaattcaatacatctattgaa

SEQ ID NO: 1045365 - DNA, 22 bp, Artificial Sequence
  chemically synthesized
caattcaatacatctattgaaa

SEQ ID NO: 1045366 - DNA, 22 bp, Artificial Sequence
  chemically synthesized
aaatagcacgtatggtttcaat

SEQ ID NO: 1045367 - DNA, 22 bp, Artificial Sequence
  chemically synthesized
aatacatctattgaaaccatac

SEQ ID NO: 1045368 - DNA, 22 bp, Artificial Sequence
  chemically synthesized
ttgaaaccatacgtgctatttt

SEQ ID NO: 1045369 - DNA, 22 bp, Artificial Sequence
  chemically synthesized
aacaaaatacaactaaaatagc

SEQ ID NO: 1045370 - DNA, 22 bp, Artificial Sequence
  chemically synthesized
aaaccatacgtgctattttagt

SEQ ID NO: 1045371 - DNA, 22 bp, Artificial Sequence
  chemically synthesized
taaacaaaatacaactaaaata

SEQ ID NO: 1045372 - DNA, 22 bp, Artificial Sequence
  chemically synthesized
ctaaacaaaatacaactaaaat

SEQ ID NO: 1045373 - DNA, 22 bp, Artificial Sequence
  chemically synthesized
tctaaacaaaatacaactaaaa

SEQ ID NO: 1045374 - DNA, 22 bp, Artificial Sequence
  chemically synthesized
ctttctaaacaaaatacaacta

SEQ ID NO: 1045375 - DNA, 22 bp, Artificial Sequence
  chemically synthesized
ttttagttgtattttgtttaga

SEQ ID NO: 1045376 - DNA, 22 bp, Artificial Sequence
  chemically synthesized
aaagaattactttctaaacaaa

SEQ ID NO: 1045377 - DNA, 22 bp, Artificial Sequence
  chemically synthesized
tagttgtattttgtttagaaag

SEQ ID NO: 1045378 - DNA, 22 bp, Artificial Sequence
  chemically synthesized
agttgtattttgtttagaaagt

SEQ ID NO: 1045379 - DNA, 22 bp, Artificial Sequence
  chemically synthesized
gttgtattttgtttagaaagta

SEQ ID NO: 1045380 - DNA, 22 bp, Artificial Sequence
  chemically synthesized
tattttgtttagaaagtaattc

SEQ ID NO: 1045381 - DNA, 22 bp, Artificial Sequence
  chemically synthesized
tgtttagaaagtaattctttta

SEQ ID NO: 1045382 - DNA, 22 bp, Artificial Sequence
  chemically synthesized
gtttagaaagtaattcttttaa

SEQ ID NO: 1045383 - DNA, 22 bp, Artificial Sequence
  chemically synthesized
tttagaaagtaattcttttaac

SEQ ID NO: 1045384 - DNA, 22 bp, Artificial Sequence
  chemically synthesized
agaaagtaattcttttaacata

SEQ ID NO: 1045385 - DNA, 22 bp, Artificial Sequence
  chemically synthesized
gaaagtaattcttttaacatat

SEQ ID NO: 1045386 - DNA, 22 bp, Artificial Sequence
  chemically synthesized
ttttaacatattacatattatt

SEQ ID NO: 1045387 - DNA, 22 bp, Artificial Sequence
  chemically synthesized
ttaacatattacatattatttg

SEQ ID NO: 1045388 - DNA, 22 bp, Artificial Sequence
  chemically synthesized
taacatattacatattatttgt

SEQ ID NO: 1045389 - DNA, 22 bp, Artificial Sequence
  chemically synthesized
aacatattacatattatttgtg

SEQ ID NO: 1045390 - DNA, 22 bp, Artificial Sequence
  chemically synthesized
acatattacatattatttgtgt

SEQ ID NO: 1045391 - DNA, 22 bp, Artificial Sequence
  chemically synthesized
aaagtgcagtacaacacaaata

SEQ ID NO: 1045392 - DNA, 22 bp, Artificial Sequence
  chemically synthesized
gaaagtgcagtacaacacaaat

SEQ ID NO: 1045393 - DNA, 22 bp, Artificial Sequence
  chemically synthesized
tgaaagtgcagtacaacacaaa

SEQ ID NO: 1045394 - DNA, 22 bp, Artificial Sequence
  chemically synthesized
ttgaaagtgcagtacaacacaa

SEQ ID NO: 1045395 - DNA, 22 bp, Artificial Sequence
  chemically synthesized
tttgaaagtgcagtacaacaca

SEQ ID NO: 1045396 - DNA, 22 bp, Artificial Sequence
  chemically synthesized
ttttgaaagtgcagtacaacac

SEQ ID NO: 1045397 - DNA, 22 bp, Artificial Sequence
  chemically synthesized
catattatttgtgttgtactgc

SEQ ID NO: 1045398 - DNA, 22 bp, Artificial Sequence
  chemically synthesized
tttgtgttgtactgcactttca

SEQ ID NO: 1045399 - DNA, 22 bp, Artificial Sequence
  chemically synthesized
acatacatcttttttgaaagtg

SEQ ID NO: 1045400 - DNA, 22 bp, Artificial Sequence
  chemically synthesized
gtgttgtactgcactttcaaaa

SEQ ID NO: 1045401 - DNA, 22 bp, Artificial Sequence
  chemically synthesized
aacatacatcttttttgaaagt

SEQ ID NO: 1045402 - DNA, 22 bp, Artificial Sequence
  chemically synthesized
tgttgtactgcactttcaaaaa

SEQ ID NO: 1045403 - DNA, 22 bp, Artificial Sequence
  chemically synthesized
taacatacatcttttttgaaag

SEQ ID NO: 1045404 - DNA, 22 bp, Artificial Sequence
  chemically synthesized
tactgcactttcaaaaaagatg

SEQ ID NO: 1045405 - DNA, 22 bp, Artificial Sequence
  chemically synthesized
tgctttaacatacatctttttt

SEQ ID NO: 1045406 - DNA, 22 bp, Artificial Sequence
  chemically synthesized
ctgtgctttaacatacatcttt

SEQ ID NO: 1045407 - DNA, 22 bp, Artificial Sequence
  chemically synthesized
cactttcaaaaaagatgtatgt

SEQ ID NO: 1045408 - DNA, 22 bp, Artificial Sequence
  chemically synthesized
tcaaaaaagatgtatgttaaag

SEQ ID NO: 1045409 - DNA, 22 bp, Artificial Sequence
  chemically synthesized
caaaaaagatgtatgttaaagc

SEQ ID NO: 1045410 - DNA, 22 bp, Artificial Sequence
  chemically synthesized
aaaaaagatgtatgttaaagca

SEQ ID NO: 1045411 - DNA, 22 bp, Artificial Sequence
  chemically synthesized
tagtaagtattgctgtgcttta

SEQ ID NO: 1045412 - DNA, 22 bp, Artificial Sequence
  chemically synthesized
cagaactatagtaagtattgct

SEQ ID NO: 1045413 - DNA, 22 bp, Artificial Sequence
  chemically synthesized
aagcacagcaatacttactata

SEQ ID NO: 1045414 - DNA, 22 bp, Artificial Sequence
  chemically synthesized
actatagttctgtaatttgatt

SEQ ID NO: 1045415 - DNA, 22 bp, Artificial Sequence
  chemically synthesized
ctatagttctgtaatttgattc

SEQ ID NO: 1045416 - DNA, 22 bp, Artificial Sequence
  chemically synthesized
acagatatgcatgaatcaaatt

SEQ ID NO: 1045417 - DNA, 22 bp, Artificial Sequence
  chemically synthesized
tagttctgtaatttgattcatg

SEQ ID NO: 1045418 - DNA, 22 bp, Artificial Sequence
  chemically synthesized
ctgacagatatgcatgaatcaa

SEQ ID NO: 1045419 - DNA, 22 bp, Artificial Sequence
  chemically synthesized
ttcctgacagatatgcatgaat

SEQ ID NO: 1045420 - DNA, 22 bp, Artificial Sequence
  chemically synthesized
attcctgacagatatgcatgaa

SEQ ID NO: 1045421 - DNA, 22 bp, Artificial Sequence
  chemically synthesized
tattcctgacagatatgcatga

SEQ ID NO: 1045422 - DNA, 22 bp, Artificial Sequence
  chemically synthesized
tgtaatttgattcatgcatatc

SEQ ID NO: 1045423 - DNA, 22 bp, Artificial Sequence
  chemically synthesized
taatttgattcatgcatatctg

SEQ ID NO: 1045424 - DNA, 22 bp, Artificial Sequence
  chemically synthesized
attttattcctgacagatatgc

SEQ ID NO: 1045425 - DNA, 22 bp, Artificial Sequence
  chemically synthesized
gattcatgcatatctgtcagga

SEQ ID NO: 1045426 - DNA, 22 bp, Artificial Sequence
  chemically synthesized
attcatgcatatctgtcaggaa

SEQ ID NO: 1045427 - DNA, 22 bp, Artificial Sequence
  chemically synthesized
tggttgattttattcctgacag

SEQ ID NO: 1045428 - DNA, 22 bp, Artificial Sequence
  chemically synthesized
atgcatatctgtcaggaataaa

SEQ ID NO: 1045429 - DNA, 22 bp, Artificial Sequence
  chemically synthesized
aaattgtggttgattttattcc

SEQ ID NO: 1045430 - DNA, 22 bp, Artificial Sequence
  chemically synthesized
gaaattgtggttgattttattc

SEQ ID NO: 1045431 - DNA, 22 bp, Artificial Sequence
  chemically synthesized
tcaggaataaaatcaaccacaa

SEQ ID NO: 1045432 - DNA, 22 bp, Artificial Sequence
  chemically synthesized
ggaaggtttgaaattgtggttg

SEQ ID NO: 1045433 - DNA, 22 bp, Artificial Sequence
  chemically synthesized
gttgggaaggtttgaaattgtg

SEQ ID NO: 1045434 - DNA, 22 bp, Artificial Sequence
  chemically synthesized
ctggttgggaaggtttgaaatt

SEQ ID NO: 1045435 - DNA, 22 bp, Artificial Sequence
  chemically synthesized
tacagctgctggttgggaaggt

SEQ ID NO: 1045436 - DNA, 22 bp, Artificial Sequence
  chemically synthesized
caaaccttcccaaccagcagct

SEQ ID NO: 1045437 - DNA, 22 bp, Artificial Sequence
  chemically synthesized
aaaccttcccaaccagcagctg

SEQ ID NO: 1045438 - DNA, 22 bp, Artificial Sequence
  chemically synthesized
cccaaccagcagctgtacaatt

SEQ ID NO: 1045439 - DNA, 22 bp, Artificial Sequence
  chemically synthesized
ccaaccagcagctgtacaattt

SEQ ID NO: 1045440 - DNA, 22 bp, Artificial Sequence
  chemically synthesized
tacaatttatgcactgcttttc

SEQ ID NO: 1045441 - DNA, 22 bp, Artificial Sequence
  chemically synthesized
tccagtagtaaaaatggaaaag

SEQ ID NO: 1045442 - DNA, 22 bp, Artificial Sequence
  chemically synthesized
atgcactgcttttccattttta

SEQ ID NO: 1045443 - DNA, 22 bp, Artificial Sequence
  chemically synthesized
tgcactgcttttccatttttac

SEQ ID NO: 1045444 - DNA, 22 bp, Artificial Sequence
  chemically synthesized
tcattatccagtagtaaaaatg

SEQ ID NO: 1045445 - DNA, 22 bp, Artificial Sequence
  chemically synthesized
cttttccatttttactactgga

SEQ ID NO: 1045446 - DNA, 22 bp, Artificial Sequence
  chemically synthesized
atcattgtcattatccagtagt

SEQ ID NO: 1045447 - DNA, 22 bp, Artificial Sequence
  chemically synthesized
ttccatttttactactggataa

SEQ ID NO: 1045448 - DNA, 22 bp, Artificial Sequence
  chemically synthesized
tccatttttactactggataat

SEQ ID NO: 1045449 - DNA, 22 bp, Artificial Sequence
  chemically synthesized
ccatttttactactggataatg

SEQ ID NO: 1045450 - DNA, 22 bp, Artificial Sequence
  chemically synthesized
catttttactactggataatga

SEQ ID NO: 1045451 - DNA, 22 bp, Artificial Sequence
  chemically synthesized
aaggcattcatcattgtcatta

SEQ ID NO: 1045452 - DNA, 22 bp, Artificial Sequence
  chemically synthesized
ttactactggataatgacaatg

SEQ ID NO: 1045453 - DNA, 22 bp, Artificial Sequence
  chemically synthesized
tactactggataatgacaatga

SEQ ID NO: 1045454 - DNA, 22 bp, Artificial Sequence
  chemically synthesized
actactggataatgacaatgat

SEQ ID NO: 1045455 - DNA, 22 bp, Artificial Sequence
  chemically synthesized
ttaaaggcattcatcattgtca

SEQ ID NO: 1045456 - DNA, 22 bp, Artificial Sequence
  chemically synthesized
ctactggataatgacaatgatg

SEQ ID NO: 1045457 - DNA, 22 bp, Artificial Sequence
  chemically synthesized
ctgttaaaggcattcatcattg

SEQ ID NO: 1045458 - DNA, 22 bp, Artificial Sequence
  chemically synthesized
ctggataatgacaatgatgaat

SEQ ID NO: 1045459 - DNA, 22 bp, Artificial Sequence
  chemically synthesized
cctgttaaaggcattcatcatt

SEQ ID NO: 1045460 - DNA, 22 bp, Artificial Sequence
  chemically synthesized
gataatgacaatgatgaatgcc

SEQ ID NO: 1045461 - DNA, 22 bp, Artificial Sequence
  chemically synthesized
agtgaatatgtatttcctgtta

SEQ ID NO: 1045462 - DNA, 22 bp, Artificial Sequence
  chemically synthesized
cagtgaatatgtatttcctgtt

SEQ ID NO: 1045463 - DNA, 22 bp, Artificial Sequence
  chemically synthesized
tcagtgaatatgtatttcctgt

SEQ ID NO: 1045464 - DNA, 22 bp, Artificial Sequence
  chemically synthesized
ttcagtgaatatgtatttcctg

SEQ ID NO: 1045465 - DNA, 22 bp, Artificial Sequence
  chemically synthesized
agtcttttcagtgaatatgtat

SEQ ID NO: 1045466 - DNA, 22 bp, Artificial Sequence
  chemically synthesized
taacaggaaatacatattcact

SEQ ID NO: 1045467 - DNA, 22 bp, Artificial Sequence
  chemically synthesized
aacaggaaatacatattcactg

SEQ ID NO: 1045468 - DNA, 22 bp, Artificial Sequence
  chemically synthesized
acaggaaatacatattcactga

SEQ ID NO: 1045469 - DNA, 22 bp, Artificial Sequence
  chemically synthesized
agctcagtcttttcagtgaata

SEQ ID NO: 1045470 - DNA, 22 bp, Artificial Sequence
  chemically synthesized
gagctcagtcttttcagtgaat

SEQ ID NO: 1045471 - DNA, 22 bp, Artificial Sequence
  chemically synthesized
tgagctcagtcttttcagtgaa

SEQ ID NO: 1045472 - DNA, 22 bp, Artificial Sequence
  chemically synthesized
aagggggatagttttgagctca

SEQ ID NO: 1045473 - DNA, 22 bp, Artificial Sequence
  chemically synthesized
actgaaaagactgagctcaaaa

SEQ ID NO: 1045474 - DNA, 22 bp, Artificial Sequence
  chemically synthesized
gaagggggatagttttgagctc

SEQ ID NO: 1045475 - DNA, 22 bp, Artificial Sequence
  chemically synthesized
tgaagggggatagttttgagct

SEQ ID NO: 1045476 - DNA, 22 bp, Artificial Sequence
  chemically synthesized
ttgaagggggatagttttgagc

SEQ ID NO: 1045477 - DNA, 22 bp, Artificial Sequence
  chemically synthesized
tttgaagggggatagttttgag

SEQ ID NO: 1045478 - DNA, 22 bp, Artificial Sequence
  chemically synthesized
aaaagactgagctcaaaactat

SEQ ID NO: 1045479 - DNA, 22 bp, Artificial Sequence
  chemically synthesized
ttttgaagggggatagttttga

SEQ ID NO: 1045480 - DNA, 22 bp, Artificial Sequence
  chemically synthesized
acttttttgaagggggatagtt

SEQ ID NO: 1045481 - DNA, 22 bp, Artificial Sequence
  chemically synthesized
attgacttttttgaagggggat

SEQ ID NO: 1045482 - DNA, 22 bp, Artificial Sequence
  chemically synthesized
agctcaaaactatcccccttca

SEQ ID NO: 1045483 - DNA, 22 bp, Artificial Sequence
  chemically synthesized
cattgacttttttgaaggggga

SEQ ID NO: 1045484 - DNA, 22 bp, Artificial Sequence
  chemically synthesized
ccttcattgacttttttgaagg

SEQ ID NO: 1045485 - DNA, 22 bp, Artificial Sequence
  chemically synthesized
aaaactatcccccttcaaaaaa

SEQ ID NO: 1045486 - DNA, 22 bp, Artificial Sequence
  chemically synthesized
ctaccttcattgacttttttga

SEQ ID NO: 1045487 - DNA, 22 bp, Artificial Sequence
  chemically synthesized
cctaccttcattgacttttttg

SEQ ID NO: 1045488 - DNA, 22 bp, Artificial Sequence
  chemically synthesized
tcccccttcaaaaaagtcaatg

SEQ ID NO: 1045489 - DNA, 22 bp, Artificial Sequence
  chemically synthesized
caaaaaagtcaatgaaggtagg

SEQ ID NO: 1045490 - DNA, 22 bp, Artificial Sequence
  chemically synthesized
aaaaaagtcaatgaaggtagga

SEQ ID NO: 1045491 - DNA, 22 bp, Artificial Sequence
  chemically synthesized
cagcaggtgaatgggcttccta

SEQ ID NO: 1045492 - DNA, 22 bp, Artificial Sequence
  chemically synthesized
ccaacaaatctccagcaggtga

SEQ ID NO: 1045493 - DNA, 22 bp, Artificial Sequence
  chemically synthesized
tctcccaacaaatctccagcag

SEQ ID NO: 1045494 - DNA, 22 bp, Artificial Sequence
  chemically synthesized
tgtctcccaacaaatctccagc

SEQ ID NO: 1045495 - DNA, 22 bp, Artificial Sequence
  chemically synthesized
ctgtctcccaacaaatctccag

SEQ ID NO: 1045496 - DNA, 22 bp, Artificial Sequence
  chemically synthesized
cttctgtctcccaacaaatctc

SEQ ID NO: 1045497 - DNA, 22 bp, Artificial Sequence
  chemically synthesized
acctgctggagatttgttggga

SEQ ID NO: 1045498 - DNA, 22 bp, Artificial Sequence
  chemically synthesized
ctggagatttgttgggagacag

SEQ ID NO: 1045499 - DNA, 22 bp, Artificial Sequence
  chemically synthesized
gagatttgttgggagacagaag

SEQ ID NO: 1045500 - DNA, 22 bp, Artificial Sequence
  chemically synthesized
tgggcatgattccttctgtctc

SEQ ID NO: 1045501 - DNA, 22 bp, Artificial Sequence
  chemically synthesized
gttgggagacagaaggaatcat

SEQ ID NO: 1045502 - DNA, 22 bp, Artificial Sequence
  chemically synthesized
ttgggagacagaaggaatcatg

SEQ ID NO: 1045503 - DNA, 22 bp, Artificial Sequence
  chemically synthesized
ggagacagaaggaatcatgccc

SEQ ID NO: 1045504 - DNA, 22 bp, Artificial Sequence
  chemically synthesized
aatccccataagatacagttgt

SEQ ID NO: 1045505 - DNA, 22 bp, Artificial Sequence
  chemically synthesized
aatggttgaatccccataagat

SEQ ID NO: 1045506 - DNA, 22 bp, Artificial Sequence
  chemically synthesized
gctaaatggttgaatccccata

SEQ ID NO: 1045507 - DNA, 22 bp, Artificial Sequence
  chemically synthesized
agctaaatggttgaatccccat

SEQ ID NO: 1045508 - DNA, 22 bp, Artificial Sequence
  chemically synthesized
atttagctaaatggttgaatcc

SEQ ID NO: 1045509 - DNA, 22 bp, Artificial Sequence
  chemically synthesized
aatttagctaaatggttgaatc

SEQ ID NO: 1045510 - DNA, 22 bp, Artificial Sequence
  chemically synthesized
tatcttatggggattcaaccat

SEQ ID NO: 1045511 - DNA, 22 bp, Artificial Sequence
  chemically synthesized
atggggattcaaccatttagct

SEQ ID NO: 1045512 - DNA, 22 bp, Artificial Sequence
  chemically synthesized
tagatttaatttagctaaatgg

SEQ ID NO: 1045513 - DNA, 22 bp, Artificial Sequence
  chemically synthesized
tggggattcaaccatttagcta

SEQ ID NO: 1045514 - DNA, 22 bp, Artificial Sequence
  chemically synthesized
ttgtagatttaatttagctaaa

SEQ ID NO: 1045515 - DNA, 22 bp, Artificial Sequence
  chemically synthesized
aaccatttagctaaattaaatc

SEQ ID NO: 1045516 - DNA, 22 bp, Artificial Sequence
  chemically synthesized
taatatggtattattgtagatt

SEQ ID NO: 1045517 - DNA, 22 bp, Artificial Sequence
  chemically synthesized
ataatatggtattattgtagat

SEQ ID NO: 1045518 - DNA, 22 bp, Artificial Sequence
  chemically synthesized
agctaaattaaatctacaataa

SEQ ID NO: 1045519 - DNA, 22 bp, Artificial Sequence
  chemically synthesized
gctaaattaaatctacaataat

SEQ ID NO: 1045520 - DNA, 22 bp, Artificial Sequence
  chemically synthesized
aattaaatctacaataatacca

SEQ ID NO: 1045521 - DNA, 22 bp, Artificial Sequence
  chemically synthesized
cggtttataatatggtattatt

SEQ ID NO: 1045522 - DNA, 22 bp, Artificial Sequence
  chemically synthesized
ctgcggtttataatatggtatt

SEQ ID NO: 1045523 - DNA, 22 bp, Artificial Sequence
  chemically synthesized
aatctacaataataccatatta

SEQ ID NO: 1045524 - DNA, 22 bp, Artificial Sequence
  chemically synthesized
attactgcggtttataatatgg

SEQ ID NO: 1045525 - DNA, 22 bp, Artificial Sequence
  chemically synthesized
caataataccatattataaacc

SEQ ID NO: 1045526 - DNA, 22 bp, Artificial Sequence
  chemically synthesized
taaaccgcagtaatcaatacta

SEQ ID NO: 1045527 - DNA, 22 bp, Artificial Sequence
  chemically synthesized
atgtcaatcgtaatagtattga

SEQ ID NO: 1045528 - DNA, 22 bp, Artificial Sequence
  chemically synthesized
tagctgatgtcaatcgtaatag

SEQ ID NO: 1045529 - DNA, 22 bp, Artificial Sequence
  chemically synthesized
ttatagctgatgtcaatcgtaa

SEQ ID NO: 1045530 - DNA, 22 bp, Artificial Sequence
  chemically synthesized
atattattatagctgatgtcaa

SEQ ID NO: 1045531 - DNA, 22 bp, Artificial Sequence
  chemically synthesized
aatattattatagctgatgtca

SEQ ID NO: 1045532 - DNA, 22 bp, Artificial Sequence
  chemically synthesized
tttaatattattatagctgatg

SEQ ID NO: 1045533 - DNA, 22 bp, Artificial Sequence
  chemically synthesized
ttacgattgacatcagctataa

SEQ ID NO: 1045534 - DNA, 22 bp, Artificial Sequence
  chemically synthesized
cgattgacatcagctataataa

SEQ ID NO: 1045535 - DNA, 22 bp, Artificial Sequence
  chemically synthesized
atctatttaatattattatagc

SEQ ID NO: 1045536 - DNA, 22 bp, Artificial Sequence
  chemically synthesized
acatcagctataataatattaa

SEQ ID NO: 1045537 - DNA, 22 bp, Artificial Sequence
  chemically synthesized
atcctgatctatttaatattat

SEQ ID NO: 1045538 - DNA, 22 bp, Artificial Sequence
  chemically synthesized
ttcatcctgatctatttaatat

SEQ ID NO: 1045539 - DNA, 22 bp, Artificial Sequence
  chemically synthesized
gttcatcctgatctatttaata

SEQ ID NO: 1045540 - DNA, 22 bp, Artificial Sequence
  chemically synthesized
taataatattaaatagatcagg

SEQ ID NO: 1045541 - DNA, 22 bp, Artificial Sequence
  chemically synthesized
acagtgaatcatttgttcatcc

SEQ ID NO: 1045542 - DNA, 22 bp, Artificial Sequence
  chemically synthesized
aatagatcaggatgaacaaatg

SEQ ID NO: 1045543 - DNA, 22 bp, Artificial Sequence
  chemically synthesized
cactcacagtgaatcatttgtt

SEQ ID NO: 1045544 - DNA, 22 bp, Artificial Sequence
  chemically synthesized
gctacactcacagtgaatcatt

SEQ ID NO: 1045545 - DNA, 22 bp, Artificial Sequence
  chemically synthesized
ggctacactcacagtgaatcat

SEQ ID NO: 1045546 - DNA, 22 bp, Artificial Sequence
  chemically synthesized
gacccttggctacactcacagt

SEQ ID NO: 1045547 - DNA, 22 bp, Artificial Sequence
  chemically synthesized
agaatgttagacccttggctac

SEQ ID NO: 1045548 - DNA, 22 bp, Artificial Sequence
  chemically synthesized
actgtgagtgtagccaagggtc

SEQ ID NO: 1045549 - DNA, 22 bp, Artificial Sequence
  chemically synthesized
tgagtgtagccaagggtctaac

SEQ ID NO: 1045550 - DNA, 22 bp, Artificial Sequence
  chemically synthesized
gcatactcagaatgttagaccc

SEQ ID NO: 1045551 - DNA, 22 bp, Artificial Sequence
  chemically synthesized
gcctggcatactcagaatgtta

SEQ ID NO: 1045552 - DNA, 22 bp, Artificial Sequence
  chemically synthesized
agcctggcatactcagaatgtt

SEQ ID NO: 1045553 - DNA, 22 bp, Artificial Sequence
  chemically synthesized
ttagcctggcatactcagaatg

SEQ ID NO: 1045554 - DNA, 22 bp, Artificial Sequence
  chemically synthesized
catacctcttagcctggcatac

SEQ ID NO: 1045555 - DNA, 22 bp, Artificial Sequence
  chemically synthesized
acattctgagtatgccaggcta

SEQ ID NO: 1045556 - DNA, 22 bp, Artificial Sequence
  chemically synthesized
tctccatacctcttagcctggc

SEQ ID NO: 1045557 - DNA, 22 bp, Artificial Sequence
  chemically synthesized
tgtctccatacctcttagcctg

SEQ ID NO: 1045558 - DNA, 22 bp, Artificial Sequence
  chemically synthesized
tgagtatgccaggctaagaggt

SEQ ID NO: 1045559 - DNA, 22 bp, Artificial Sequence
  chemically synthesized
agtatgccaggctaagaggtat

SEQ ID NO: 1045560 - DNA, 22 bp, Artificial Sequence
  chemically synthesized
aataactctgtctccatacctc

SEQ ID NO: 1045561 - DNA, 22 bp, Artificial Sequence
  chemically synthesized
cccattgaataactctgtctcc

SEQ ID NO: 1045562 - DNA, 22 bp, Artificial Sequence
  chemically synthesized
agaggtatggagacagagttat

SEQ ID NO: 1045563 - DNA, 22 bp, Artificial Sequence
  chemically synthesized
agttgcccattgaataactctg

SEQ ID NO: 1045564 - DNA, 22 bp, Artificial Sequence
  chemically synthesized
ttaagttgcccattgaataact

SEQ ID NO: 1045565 - DNA, 22 bp, Artificial Sequence
  chemically synthesized
attaagttgcccattgaataac

SEQ ID NO: 1045566 - DNA, 22 bp, Artificial Sequence
  chemically synthesized
atcttattaagttgcccattga

SEQ ID NO: 1045567 - DNA, 22 bp, Artificial Sequence
  chemically synthesized
ttcaatgggcaacttaataaga

SEQ ID NO: 1045568 - DNA, 22 bp, Artificial Sequence
  chemically synthesized
aatgggcaacttaataagatca

SEQ ID NO: 1045569 - DNA, 22 bp, Artificial Sequence
  chemically synthesized
aggagagtagtgaccctgatct

SEQ ID NO: 1045570 - DNA, 22 bp, Artificial Sequence
  chemically synthesized
gttcaggagagtagtgaccctg

SEQ ID NO: 1045571 - DNA, 22 bp, Artificial Sequence
  chemically synthesized
ggttcaggagagtagtgaccct

SEQ ID NO: 1045572 - DNA, 22 bp, Artificial Sequence
  chemically synthesized
aataagatcagggtcactactc

SEQ ID NO: 1045573 - DNA, 22 bp, Artificial Sequence
  chemically synthesized
ataagatcagggtcactactct

SEQ ID NO: 1045574 - DNA, 22 bp, Artificial Sequence
  chemically synthesized
atggacatttggttcaggagag

SEQ ID NO: 1045575 - DNA, 22 bp, Artificial Sequence
  chemically synthesized
ccaggttcatggacatttggtt

SEQ ID NO: 1045576 - DNA, 22 bp, Artificial Sequence
  chemically synthesized
cccaggttcatggacatttggt

SEQ ID NO: 1045577 - DNA, 22 bp, Artificial Sequence
  chemically synthesized
ctctcctgaaccaaatgtccat

SEQ ID NO: 1045578 - DNA, 22 bp, Artificial Sequence
  chemically synthesized
cttcccaggttcatggacattt

SEQ ID NO: 1045579 - DNA, 22 bp, Artificial Sequence
  chemically synthesized
tcctgaaccaaatgtccatgaa

SEQ ID NO: 1045580 - DNA, 22 bp, Artificial Sequence
  chemically synthesized
ctgaaccaaatgtccatgaacc

SEQ ID NO: 1045581 - DNA, 22 bp, Artificial Sequence
  chemically synthesized
aaccaaatgtccatgaacctgg

SEQ ID NO: 1045582 - DNA, 22 bp, Artificial Sequence
  chemically synthesized
atatccattccttcccaggttc

SEQ ID NO: 1045583 - DNA, 22 bp, Artificial Sequence
  chemically synthesized
ccaatgagctaatatccattcc

SEQ ID NO: 1045584 - DNA, 22 bp, Artificial Sequence
  chemically synthesized
ttgccaatgagctaatatccat

SEQ ID NO: 1045585 - DNA, 22 bp, Artificial Sequence
  chemically synthesized
ggaaggaatggatattagctca

SEQ ID NO: 1045586 - DNA, 22 bp, Artificial Sequence
  chemically synthesized
aataagtaaattattgccaatg

SEQ ID NO: 1045587 - DNA, 22 bp, Artificial Sequence
  chemically synthesized
tcattcaataagtaaattattg

SEQ ID NO: 1045588 - DNA, 22 bp, Artificial Sequence
  chemically synthesized
gctcattggcaataatttactt

SEQ ID NO: 1045589 - DNA, 22 bp, Artificial Sequence
  chemically synthesized
attggcaataatttacttattg

SEQ ID NO: 1045590 - DNA, 22 bp, Artificial Sequence
  chemically synthesized
gcaataatttacttattgaatg

SEQ ID NO: 1045591 - DNA, 22 bp, Artificial Sequence
  chemically synthesized
taagtgcatcattgtcattcaa

SEQ ID NO: 1045592 - DNA, 22 bp, Artificial Sequence
  chemically synthesized
gtaagtgcatcattgtcattca

SEQ ID NO: 1045593 - DNA, 22 bp, Artificial Sequence
  chemically synthesized
acttattgaatgacaatgatgc

SEQ ID NO: 1045594 - DNA, 22 bp, Artificial Sequence
  chemically synthesized
cttattgaatgacaatgatgca

SEQ ID NO: 1045595 - DNA, 22 bp, Artificial Sequence
  chemically synthesized
attgaatgacaatgatgcactt

SEQ ID NO: 1045596 - DNA, 22 bp, Artificial Sequence
  chemically synthesized
ttgaatgacaatgatgcactta

SEQ ID NO: 1045597 - DNA, 22 bp, Artificial Sequence
  chemically synthesized
aatgacaatgatgcacttacaa

SEQ ID NO: 1045598 - DNA, 22 bp, Artificial Sequence
  chemically synthesized
atggcagcatagtttgtaagtg

SEQ ID NO: 1045599 - DNA, 22 bp, Artificial Sequence
  chemically synthesized
tcatggcagcatagtttgtaag

SEQ ID NO: 1045600 - DNA, 22 bp, Artificial Sequence
  chemically synthesized
agttctcatggcagcatagttt

SEQ ID NO: 1045601 - DNA, 22 bp, Artificial Sequence
  chemically synthesized
actaagttctcatggcagcata

SEQ ID NO: 1045602 - DNA, 22 bp, Artificial Sequence
  chemically synthesized
ttaactaagttctcatggcagc

SEQ ID NO: 1045603 - DNA, 22 bp, Artificial Sequence
  chemically synthesized
tattaactaagttctcatggca

SEQ ID NO: 1045604 - DNA, 22 bp, Artificial Sequence
  chemically synthesized
acaaactatgctgccatgagaa

SEQ ID NO: 1045605 - DNA, 22 bp, Artificial Sequence
  chemically synthesized
ctattaactaagttctcatggc

SEQ ID NO: 1045606 - DNA, 22 bp, Artificial Sequence
  chemically synthesized
caaactatgctgccatgagaac

SEQ ID NO: 1045607 - DNA, 22 bp, Artificial Sequence
  chemically synthesized
tttctattaactaagttctcat

SEQ ID NO: 1045608 - DNA, 22 bp, Artificial Sequence
  chemically synthesized
tgctgccatgagaacttagtta

SEQ ID NO: 1045609 - DNA, 22 bp, Artificial Sequence
  chemically synthesized
tcattatttctattaactaagt

SEQ ID NO: 1045610 - DNA, 22 bp, Artificial Sequence
  chemically synthesized
ctgtcattatttctattaacta

SEQ ID NO: 1045611 - DNA, 22 bp, Artificial Sequence
  chemically synthesized
ccatgagaacttagttaataga

SEQ ID NO: 1045612 - DNA, 22 bp, Artificial Sequence
  chemically synthesized
agttaatagaaataatgacagg

SEQ ID NO: 1045613 - DNA, 22 bp, Artificial Sequence
  chemically synthesized
gttaatagaaataatgacagga

SEQ ID NO: 1045614 - DNA, 22 bp, Artificial Sequence
  chemically synthesized
acatgccagaattcctgtcatt

SEQ ID NO: 1045615 - DNA, 22 bp, Artificial Sequence
  chemically synthesized
atagaaataatgacaggaattc

SEQ ID NO: 1045616 - DNA, 22 bp, Artificial Sequence
  chemically synthesized
ataaaataaagctgacatgcca

SEQ ID NO: 1045617 - DNA, 22 bp, Artificial Sequence
  chemically synthesized
atcagttaataaaataaagctg

SEQ ID NO: 1045618 - DNA, 22 bp, Artificial Sequence
  chemically synthesized
tggcatgtcagctttattttat

SEQ ID NO: 1045619 - DNA, 22 bp, Artificial Sequence
  chemically synthesized
gcatgtcagctttattttatta

SEQ ID NO: 1045620 - DNA, 22 bp, Artificial Sequence
  chemically synthesized
tattttattaactgattaggtt

SEQ ID NO: 1045621 - DNA, 22 bp, Artificial Sequence
  chemically synthesized
attttattaactgattaggttt

SEQ ID NO: 1045622 - DNA, 22 bp, Artificial Sequence
  chemically synthesized
ttttattaactgattaggtttc

SEQ ID NO: 1045623 - DNA, 22 bp, Artificial Sequence
  chemically synthesized
tattaactgattaggtttcttt

SEQ ID NO: 1045624 - DNA, 22 bp, Artificial Sequence
  chemically synthesized
gtacaatgaagaaaagaaacct

SEQ ID NO: 1045625 - DNA, 22 bp, Artificial Sequence
  chemically synthesized
attaactgattaggtttctttt

SEQ ID NO: 1045626 - DNA, 22 bp, Artificial Sequence
  chemically synthesized
ttaactgattaggtttcttttc

SEQ ID NO: 1045627 - DNA, 22 bp, Artificial Sequence
  chemically synthesized
ttggtacaatgaagaaaagaaa

SEQ ID NO: 1045628 - DNA, 22 bp, Artificial Sequence
  chemically synthesized
attggtacaatgaagaaaagaa

SEQ ID NO: 1045629 - DNA, 22 bp, Artificial Sequence
  chemically synthesized
actgattaggtttcttttcttc

SEQ ID NO: 1045630 - DNA, 22 bp, Artificial Sequence
  chemically synthesized
attaggtttcttttcttcattg

SEQ ID NO: 1045631 - DNA, 22 bp, Artificial Sequence
  chemically synthesized
ggtttcttttcttcattgtacc

SEQ ID NO: 1045632 - DNA, 22 bp, Artificial Sequence
  chemically synthesized
cttttcttcattgtaccaataa

SEQ ID NO: 1045633 - DNA, 22 bp, Artificial Sequence
  chemically synthesized
ttttcttcattgtaccaataag

SEQ ID NO: 1045634 - DNA, 22 bp, Artificial Sequence
  chemically synthesized
ttcttcattgtaccaataagtg

SEQ ID NO: 1045635 - DNA, 22 bp, Artificial Sequence
  chemically synthesized
tcttcattgtaccaataagtga

SEQ ID NO: 1045636 - DNA, 22 bp, Artificial Sequence
  chemically synthesized
cttcattgtaccaataagtgat

SEQ ID NO: 1045637 - DNA, 22 bp, Artificial Sequence
  chemically synthesized
ttcattgtaccaataagtgatt

SEQ ID NO: 1045638 - DNA, 22 bp, Artificial Sequence
  chemically synthesized
aagtaaaagtcaaatcacttat

SEQ ID NO: 1045639 - DNA, 22 bp, Artificial Sequence
  chemically synthesized
gaagtaaaagtcaaatcactta

SEQ ID NO: 1045640 - DNA, 22 bp, Artificial Sequence
  chemically synthesized
cattgtaccaataagtgatttg

SEQ ID NO: 1045641 - DNA, 22 bp, Artificial Sequence
  chemically synthesized
attgtaccaataagtgatttga

SEQ ID NO: 1045642 - DNA, 22 bp, Artificial Sequence
  chemically synthesized
tttgaagtaaaagtcaaatcac

SEQ ID NO: 1045643 - DNA, 22 bp, Artificial Sequence
  chemically synthesized
tgtttgaagtaaaagtcaaatc

SEQ ID NO: 1045644 - DNA, 22 bp, Artificial Sequence
  chemically synthesized
taccaataagtgatttgacttt

SEQ ID NO: 1045645 - DNA, 22 bp, Artificial Sequence
  chemically synthesized
ttctgtttgaagtaaaagtcaa

SEQ ID NO: 1045646 - DNA, 22 bp, Artificial Sequence
  chemically synthesized
attctgtttgaagtaaaagtca

SEQ ID NO: 1045647 - DNA, 22 bp, Artificial Sequence
  chemically synthesized
ttattctgtttgaagtaaaagt

SEQ ID NO: 1045648 - DNA, 22 bp, Artificial Sequence
  chemically synthesized
cttattctgtttgaagtaaaag

SEQ ID NO: 1045649 - DNA, 22 bp, Artificial Sequence
  chemically synthesized
tttcttattctgtttgaagtaa

SEQ ID NO: 1045650 - DNA, 22 bp, Artificial Sequence
  chemically synthesized
gacttttacttcaaacagaata

SEQ ID NO: 1045651 - DNA, 22 bp, Artificial Sequence
  chemically synthesized
acttttacttcaaacagaataa

SEQ ID NO: 1045652 - DNA, 22 bp, Artificial Sequence
  chemically synthesized
ttacttcaaacagaataagaaa

SEQ ID NO: 1045653 - DNA, 22 bp, Artificial Sequence
  chemically synthesized
tacttcaaacagaataagaaac

SEQ ID NO: 1045654 - DNA, 22 bp, Artificial Sequence
  chemically synthesized
acttcaaacagaataagaaaca

SEQ ID NO: 1045655 - DNA, 22 bp, Artificial Sequence
  chemically synthesized
cttcaaacagaataagaaacag

SEQ ID NO: 1045656 - DNA, 22 bp, Artificial Sequence
  chemically synthesized
caaacagaataagaaacagtgc

SEQ ID NO: 1045657 - DNA, 22 bp, Artificial Sequence
  chemically synthesized
aaacagaataagaaacagtgcc

SEQ ID NO: 1045658 - DNA, 22 bp, Artificial Sequence
  chemically synthesized
catccatgtcagtgtggcactg

SEQ ID NO: 1045659 - DNA, 22 bp, Artificial Sequence
  chemically synthesized
ttccatccatgtcagtgtggca

SEQ ID NO: 1045660 - DNA, 22 bp, Artificial Sequence
  chemically synthesized
gaactattccatccatgtcagt

SEQ ID NO: 1045661 - DNA, 22 bp, Artificial Sequence
  chemically synthesized
tggaactattccatccatgtca

SEQ ID NO: 1045662 - DNA, 22 bp, Artificial Sequence
  chemically synthesized
acagatctctggaactattcca

SEQ ID NO: 1045663 - DNA, 22 bp, Artificial Sequence
  chemically synthesized
cacagatctctggaactattcc

SEQ ID NO: 1045664 - DNA, 22 bp, Artificial Sequence
  chemically synthesized
acatggatggaatagttccaga

SEQ ID NO: 1045665 - DNA, 22 bp, Artificial Sequence
  chemically synthesized
cacagtaaaataagagcttcac

SEQ ID NO: 1045666 - DNA, 22 bp, Artificial Sequence
  chemically synthesized
cagagatctgtgaagctcttat

SEQ ID NO: 1045667 - DNA, 22 bp, Artificial Sequence
  chemically synthesized
taaaattacacagtaaaataag

SEQ ID NO: 1045668 - DNA, 22 bp, Artificial Sequence
  chemically synthesized
tgaagctcttattttactgtgt

SEQ ID NO: 1045669 - DNA, 22 bp, Artificial Sequence
  chemically synthesized
ttattttactgtgtaattttat

SEQ ID NO: 1045670 - DNA, 22 bp, Artificial Sequence
  chemically synthesized
tatcaaataagctataaaatta

SEQ ID NO: 1045671 - DNA, 22 bp, Artificial Sequence
  chemically synthesized
attttactgtgtaattttatag

SEQ ID NO: 1045672 - DNA, 22 bp, Artificial Sequence
  chemically synthesized
ttttactgtgtaattttatagc

SEQ ID NO: 1045673 - DNA, 22 bp, Artificial Sequence
  chemically synthesized
tactgtgtaattttatagctta

SEQ ID NO: 1045674 - DNA, 22 bp, Artificial Sequence
  chemically synthesized
actgtgtaattttatagcttat

SEQ ID NO: 1045675 - DNA, 22 bp, Artificial Sequence
  chemically synthesized
acattatatcaaataagctata

SEQ ID NO: 1045676 - DNA, 22 bp, Artificial Sequence
  chemically synthesized
ctgtgtaattttatagcttatt

SEQ ID NO: 1045677 - DNA, 22 bp, Artificial Sequence
  chemically synthesized
aacattatatcaaataagctat

SEQ ID NO: 1045678 - DNA, 22 bp, Artificial Sequence
  chemically synthesized
tgtaattttatagcttatttga

SEQ ID NO: 1045679 - DNA, 22 bp, Artificial Sequence
  chemically synthesized
atatcttaacattatatcaaat

SEQ ID NO: 1045680 - DNA, 22 bp, Artificial Sequence
  chemically synthesized
aatatcttaacattatatcaaa

SEQ ID NO: 1045681 - DNA, 22 bp, Artificial Sequence
  chemically synthesized
taatatcttaacattatatcaa

SEQ ID NO: 1045682 - DNA, 22 bp, Artificial Sequence
  chemically synthesized
tatagcttatttgatataatgt

SEQ ID NO: 1045683 - DNA, 22 bp, Artificial Sequence
  chemically synthesized
atagcttatttgatataatgtt

SEQ ID NO: 1045684 - DNA, 22 bp, Artificial Sequence
  chemically synthesized
tagcttatttgatataatgtta

SEQ ID NO: 1045685 - DNA, 22 bp, Artificial Sequence
  chemically synthesized
actttaatatcttaacattata

SEQ ID NO: 1045686 - DNA, 22 bp, Artificial Sequence
  chemically synthesized
gactttaatatcttaacattat

SEQ ID NO: 1045687 - DNA, 22 bp, Artificial Sequence
  chemically synthesized
atttgatataatgttaagatat

SEQ ID NO: 1045688 - DNA, 22 bp, Artificial Sequence
  chemically synthesized
tttgatataatgttaagatatt

SEQ ID NO: 1045689 - DNA, 22 bp, Artificial Sequence
  chemically synthesized
agtgacttgactttaatatctt

SEQ ID NO: 1045690 - DNA, 22 bp, Artificial Sequence
  chemically synthesized
gatataatgttaagatattaaa

SEQ ID NO: 1045691 - DNA, 22 bp, Artificial Sequence
  chemically synthesized
cagtgacttgactttaatatct

SEQ ID NO: 1045692 - DNA, 22 bp, Artificial Sequence
  chemically synthesized
atataatgttaagatattaaag

SEQ ID NO: 1045693 - DNA, 22 bp, Artificial Sequence
  chemically synthesized
cagtatcttcagtgacttgact

SEQ ID NO: 1045694 - DNA, 22 bp, Artificial Sequence
  chemically synthesized
agatattaaagtcaagtcactg

SEQ ID NO: 1045695 - DNA, 22 bp, Artificial Sequence
  chemically synthesized
aagtcaagtcactgaagatact

SEQ ID NO: 1045696 - DNA, 22 bp, Artificial Sequence
  chemically synthesized
gaaatcggtgttgcagtatctt

SEQ ID NO: 1045697 - DNA, 22 bp, Artificial Sequence
  chemically synthesized
ggaaatcggtgttgcagtatct

SEQ ID NO: 1045698 - DNA, 22 bp, Artificial Sequence
  chemically synthesized
tggaaatcggtgttgcagtatc

SEQ ID NO: 1045699 - DNA, 22 bp, Artificial Sequence
  chemically synthesized
ttttggaaatcggtgttgcagt

SEQ ID NO: 1045700 - DNA, 22 bp, Artificial Sequence
  chemically synthesized
gttttggaaatcggtgttgcag

SEQ ID NO: 1045701 - DNA, 22 bp, Artificial Sequence
  chemically synthesized
tttgttttggaaatcggtgttg

SEQ ID NO: 1045702 - DNA, 22 bp, Artificial Sequence
  chemically synthesized
gtttgttttggaaatcggtgtt

SEQ ID NO: 1045703 - DNA, 22 bp, Artificial Sequence
  chemically synthesized
aagatactgcaacaccgatttc

SEQ ID NO: 1045704 - DNA, 22 bp, Artificial Sequence
  chemically synthesized
tttgtttgttttggaaatcggt

SEQ ID NO: 1045705 - DNA, 22 bp, Artificial Sequence
  chemically synthesized
caacaccgatttccaaaacaaa

SEQ ID NO: 1045706 - DNA, 22 bp, Artificial Sequence
  chemically synthesized
ccaaaacaaacaaatagcttta

SEQ ID NO: 1045707 - DNA, 22 bp, Artificial Sequence
  chemically synthesized
caaaacaaacaaatagctttat

SEQ ID NO: 1045708 - DNA, 22 bp, Artificial Sequence
  chemically synthesized
tatgaatatacaaatggataaa

SEQ ID NO: 1045709 - DNA, 22 bp, Artificial Sequence
  chemically synthesized
cctgtatgaatatacaaatgga

SEQ ID NO: 1045710 - DNA, 22 bp, Artificial Sequence
  chemically synthesized
gcctgtatgaatatacaaatgg

SEQ ID NO: 1045711 - DNA, 22 bp, Artificial Sequence
  chemically synthesized
tatccatttgtatattcataca

SEQ ID NO: 1045712 - DNA, 22 bp, Artificial Sequence
  chemically synthesized
atccatttgtatattcatacag

SEQ ID NO: 1045713 - DNA, 22 bp, Artificial Sequence
  chemically synthesized
tccatttgtatattcatacagg

SEQ ID NO: 1045714 - DNA, 22 bp, Artificial Sequence
  chemically synthesized
tatcacacatttgcctgtatga

SEQ ID NO: 1045715 - DNA, 22 bp, Artificial Sequence
  chemically synthesized
tatatcacacatttgcctgtat

SEQ ID NO: 1045716 - DNA, 22 bp, Artificial Sequence
  chemically synthesized
gtatattcatacaggcaaatgt

SEQ ID NO: 1045717 - DNA, 22 bp, Artificial Sequence
  chemically synthesized
attctatatcacacatttgcct

SEQ ID NO: 1045718 - DNA, 22 bp, Artificial Sequence
  chemically synthesized
tatattcatacaggcaaatgtg

SEQ ID NO: 1045719 - DNA, 22 bp, Artificial Sequence
  chemically synthesized
gaagctcattctatatcacaca

SEQ ID NO: 1045720 - DNA, 22 bp, Artificial Sequence
  chemically synthesized
atacaggcaaatgtgtgatata

SEQ ID NO: 1045721 - DNA, 22 bp, Artificial Sequence
  chemically synthesized
ctggaagctcattctatatcac

SEQ ID NO: 1045722 - DNA, 22 bp, Artificial Sequence
  chemically synthesized
cctggaagctcattctatatca

SEQ ID NO: 1045723 - DNA, 22 bp, Artificial Sequence
  chemically synthesized
aaatggtttcctggaagctcat

SEQ ID NO: 1045724 - DNA, 22 bp, Artificial Sequence
  chemically synthesized
tactcaaatggtttcctggaag

SEQ ID NO: 1045725 - DNA, 22 bp, Artificial Sequence
  chemically synthesized
atactcaaatggtttcctggaa

SEQ ID NO: 1045726 - DNA, 22 bp, Artificial Sequence
  chemically synthesized
tatactcaaatggtttcctgga

SEQ ID NO: 1045727 - DNA, 22 bp, Artificial Sequence
  chemically synthesized
aagtattttatactcaaatggt

SEQ ID NO: 1045728 - DNA, 22 bp, Artificial Sequence
  chemically synthesized
gctaaagtattttatactcaaa

SEQ ID NO: 1045729 - DNA, 22 bp, Artificial Sequence
  chemically synthesized
ccaggaaaccatttgagtataa

SEQ ID NO: 1045730 - DNA, 22 bp, Artificial Sequence
  chemically synthesized
caggaaaccatttgagtataaa

SEQ ID NO: 1045731 - DNA, 22 bp, Artificial Sequence
  chemically synthesized
gagtataaaatactttagctaa

SEQ ID NO: 1045732 - DNA, 22 bp, Artificial Sequence
  chemically synthesized
agtataaaatactttagctaat

SEQ ID NO: 1045733 - DNA, 22 bp, Artificial Sequence
  chemically synthesized
tcagcagcacatattagctaaa

SEQ ID NO: 1045734 - DNA, 22 bp, Artificial Sequence
  chemically synthesized
ctatcagcagcacatattagct

SEQ ID NO: 1045735 - DNA, 22 bp, Artificial Sequence
  chemically synthesized
gctatcagcagcacatattagc

SEQ ID NO: 1045736 - DNA, 22 bp, Artificial Sequence
  chemically synthesized
tagctaatatgtgctgctgata

SEQ ID NO: 1045737 - DNA, 22 bp, Artificial Sequence
  chemically synthesized
agctaatatgtgctgctgatag

SEQ ID NO: 1045738 - DNA, 22 bp, Artificial Sequence
  chemically synthesized
gctaatatgtgctgctgatagc

SEQ ID NO: 1045739 - DNA, 22 bp, Artificial Sequence
  chemically synthesized
atatgtgctgctgatagcaaac

SEQ ID NO: 1045740 - DNA, 22 bp, Artificial Sequence
  chemically synthesized
taggcaaaagatgggtttgcta

SEQ ID NO: 1045741 - DNA, 22 bp, Artificial Sequence
  chemically synthesized
ctgatagcaaacccatcttttg

SEQ ID NO: 1045742 - DNA, 22 bp, Artificial Sequence
  chemically synthesized
atagcaaacccatcttttgcct

SEQ ID NO: 1045743 - DNA, 22 bp, Artificial Sequence
  chemically synthesized
aaatgcaaacagtatgtgatta

SEQ ID NO: 1045744 - DNA, 22 bp, Artificial Sequence
  chemically synthesized
caaatgcaaacagtatgtgatt

SEQ ID NO: 1045745 - DNA, 22 bp, Artificial Sequence
  chemically synthesized
tcaaatgcaaacagtatgtgat

SEQ ID NO: 1045746 - DNA, 22 bp, Artificial Sequence
  chemically synthesized
ttgcctataatcacatactgtt

SEQ ID NO: 1045747 - DNA, 22 bp, Artificial Sequence
  chemically synthesized
tgcctataatcacatactgttt

SEQ ID NO: 1045748 - DNA, 22 bp, Artificial Sequence
  chemically synthesized
gcctataatcacatactgtttg

SEQ ID NO: 1045749 - DNA, 22 bp, Artificial Sequence
  chemically synthesized
cctataatcacatactgtttgc

SEQ ID NO: 1045750 - DNA, 22 bp, Artificial Sequence
  chemically synthesized
gtattttcaaatgcaaacagta

SEQ ID NO: 1045751 - DNA, 22 bp, Artificial Sequence
  chemically synthesized
ggtattttcaaatgcaaacagt

SEQ ID NO: 1045752 - DNA, 22 bp, Artificial Sequence
  chemically synthesized
taatcacatactgtttgcattt

SEQ ID NO: 1045753 - DNA, 22 bp, Artificial Sequence
  chemically synthesized
tttgcatttgaaaataccaagc

SEQ ID NO: 1045754 - DNA, 22 bp, Artificial Sequence
  chemically synthesized
tagtatacccagagcttggtat

SEQ ID NO: 1045755 - DNA, 22 bp, Artificial Sequence
  chemically synthesized
gcatttgaaaataccaagctct

SEQ ID NO: 1045756 - DNA, 22 bp, Artificial Sequence
  chemically synthesized
catttgaaaataccaagctctg

SEQ ID NO: 1045757 - DNA, 22 bp, Artificial Sequence
  chemically synthesized
gaaaataccaagctctgggtat

SEQ ID NO: 1045758 - DNA, 22 bp, Artificial Sequence
  chemically synthesized
aaaataccaagctctgggtata

SEQ ID NO: 1045759 - DNA, 22 bp, Artificial Sequence
  chemically synthesized
aaaatgaaatattatagtatac

SEQ ID NO: 1045760 - DNA, 22 bp, Artificial Sequence
  chemically synthesized
cactcaaaatgaaatattatag

SEQ ID NO: 1045761 - DNA, 22 bp, Artificial Sequence
  chemically synthesized
acactcaaaatgaaatattata

SEQ ID NO: 1045762 - DNA, 22 bp, Artificial Sequence
  chemically synthesized
tacactcaaaatgaaatattat

SEQ ID NO: 1045763 - DNA, 22 bp, Artificial Sequence
  chemically synthesized
tgggtatactataatatttcat

SEQ ID NO: 1045764 - DNA, 22 bp, Artificial Sequence
  chemically synthesized
ggtatactataatatttcattt

SEQ ID NO: 1045765 - DNA, 22 bp, Artificial Sequence
  chemically synthesized
taatatttcattttgagtgtaa

SEQ ID NO: 1045766 - DNA, 22 bp, Artificial Sequence
  chemically synthesized
atgatcgtacattttacactca

SEQ ID NO: 1045767 - DNA, 22 bp, Artificial Sequence
  chemically synthesized
catgatcgtacattttacactc

SEQ ID NO: 1045768 - DNA, 22 bp, Artificial Sequence
  chemically synthesized
tcatgatcgtacattttacact

SEQ ID NO: 1045769 - DNA, 22 bp, Artificial Sequence
  chemically synthesized
cattttgagtgtaaaatgtacg

SEQ ID NO: 1045770 - DNA, 22 bp, Artificial Sequence
  chemically synthesized
attttgagtgtaaaatgtacga

SEQ ID NO: 1045771 - DNA, 22 bp, Artificial Sequence
  chemically synthesized
tgagtgtaaaatgtacgatcat

SEQ ID NO: 1045772 - DNA, 22 bp, Artificial Sequence
  chemically synthesized
cagataattttcatgatcgtac

SEQ ID NO: 1045773 - DNA, 22 bp, Artificial Sequence
  chemically synthesized
gagtgtaaaatgtacgatcatg

SEQ ID NO: 1045774 - DNA, 22 bp, Artificial Sequence
  chemically synthesized
agtgtaaaatgtacgatcatga

SEQ ID NO: 1045775 - DNA, 22 bp, Artificial Sequence
  chemically synthesized
tctggagacacattattatgtg

SEQ ID NO: 1045776 - DNA, 22 bp, Artificial Sequence
  chemically synthesized
gagacacattattatgtgcatt

SEQ ID NO: 1045777 - DNA, 22 bp, Artificial Sequence
  chemically synthesized
ttatgtgcattttcttgatcct

SEQ ID NO: 1045778 - DNA, 22 bp, Artificial Sequence
  chemically synthesized
tgtgcattttcttgatcctaca

SEQ ID NO: 1045779 - DNA, 22 bp, Artificial Sequence
  chemically synthesized
aagataaatgaatgtaggatca

SEQ ID NO: 1045780 - DNA, 22 bp, Artificial Sequence
  chemically synthesized
tcttgatcctacattcatttat

SEQ ID NO: 1045781 - DNA, 22 bp, Artificial Sequence
  chemically synthesized
cttgatcctacattcatttatc

SEQ ID NO: 1045782 - DNA, 22 bp, Artificial Sequence
  chemically synthesized
ttgatcctacattcatttatct

SEQ ID NO: 1045783 - DNA, 22 bp, Artificial Sequence
  chemically synthesized
gatcctacattcatttatcttc

SEQ ID NO: 1045784 - DNA, 22 bp, Artificial Sequence
  chemically synthesized
atcctacattcatttatcttca

SEQ ID NO: 1045785 - DNA, 22 bp, Artificial Sequence
  chemically synthesized
agaaggcagtgtctgaagataa

SEQ ID NO: 1045786 - DNA, 22 bp, Artificial Sequence
  chemically synthesized
cagaaggcagtgtctgaagata

SEQ ID NO: 1045787 - DNA, 22 bp, Artificial Sequence
  chemically synthesized
cattcatttatcttcagacact

SEQ ID NO: 1045788 - DNA, 22 bp, Artificial Sequence
  chemically synthesized
tgaatttcagaaggcagtgtct

SEQ ID NO: 1045789 - DNA, 22 bp, Artificial Sequence
  chemically synthesized
atttatcttcagacactgcctt

SEQ ID NO: 1045790 - DNA, 22 bp, Artificial Sequence
  chemically synthesized
atcttcagacactgccttctga

SEQ ID NO: 1045791 - DNA, 22 bp, Artificial Sequence
  chemically synthesized
tcttcagacactgccttctgaa

SEQ ID NO: 1045792 - DNA, 22 bp, Artificial Sequence
  chemically synthesized
cagacactgccttctgaaattc

SEQ ID NO: 1045793 - DNA, 22 bp, Artificial Sequence
  chemically synthesized
agacactgccttctgaaattca

SEQ ID NO: 1045794 - DNA, 22 bp, Artificial Sequence
  chemically synthesized
ccttctgaaattcatagcctat

SEQ ID NO: 1045795 - DNA, 22 bp, Artificial Sequence
  chemically synthesized
ctgaaattcatagcctatttca

SEQ ID NO: 1045796 - DNA, 22 bp, Artificial Sequence
  chemically synthesized
tgaaattcatagcctatttcat

SEQ ID NO: 1045797 - DNA, 22 bp, Artificial Sequence
  chemically synthesized
aaattcatagcctatttcatca

SEQ ID NO: 1045798 - DNA, 22 bp, Artificial Sequence
  chemically synthesized
atagcctatttcatcatcatta

SEQ ID NO: 1045799 - DNA, 22 bp, Artificial Sequence
  chemically synthesized
aagtaaggcaaataatgatgat

SEQ ID NO: 1045800 - DNA, 22 bp, Artificial Sequence
  chemically synthesized
tcaagtaaggcaaataatgatg

SEQ ID NO: 1045801 - DNA, 22 bp, Artificial Sequence
  chemically synthesized
aattctcaagtaaggcaaataa

SEQ ID NO: 1045802 - DNA, 22 bp, Artificial Sequence
  chemically synthesized
tttcatcatcattatttgcctt

SEQ ID NO: 1045803 - DNA, 22 bp, Artificial Sequence
  chemically synthesized
ctaaattctcaagtaaggcaaa

SEQ ID NO: 1045804 - DNA, 22 bp, Artificial Sequence
  chemically synthesized
catcatcattatttgccttact

SEQ ID NO: 1045805 - DNA, 22 bp, Artificial Sequence
  chemically synthesized
atcatcattatttgccttactt

SEQ ID NO: 1045806 - DNA, 22 bp, Artificial Sequence
  chemically synthesized
tttgccttacttgagaatttag

SEQ ID NO: 1045807 - DNA, 22 bp, Artificial Sequence
  chemically synthesized
gccttacttgagaatttagtaa

SEQ ID NO: 1045808 - DNA, 22 bp, Artificial Sequence
  chemically synthesized
ccttacttgagaatttagtaac

SEQ ID NO: 1045809 - DNA, 22 bp, Artificial Sequence
  chemically synthesized
acttgagaatttagtaacttgc

SEQ ID NO: 1045810 - DNA, 22 bp, Artificial Sequence
  chemically synthesized
aaaccaccaacagcaagttact

SEQ ID NO: 1045811 - DNA, 22 bp, Artificial Sequence
  chemically synthesized
cttgagaatttagtaacttgct

SEQ ID NO: 1045812 - DNA, 22 bp, Artificial Sequence
  chemically synthesized
caaaccaccaacagcaagttac

SEQ ID NO: 1045813 - DNA, 22 bp, Artificial Sequence
  chemically synthesized
tcaaaccaccaacagcaagtta

SEQ ID NO: 1045814 - DNA, 22 bp, Artificial Sequence
  chemically synthesized
gagaatttagtaacttgctgtt

SEQ ID NO: 1045815 - DNA, 22 bp, Artificial Sequence
  chemically synthesized
agaatttagtaacttgctgttg

SEQ ID NO: 1045816 - DNA, 22 bp, Artificial Sequence
  chemically synthesized
ttttcaaaccaccaacagcaag

SEQ ID NO: 1045817 - DNA, 22 bp, Artificial Sequence
  chemically synthesized
agtaacttgctgttggtggttt

SEQ ID NO: 1045818 - DNA, 22 bp, Artificial Sequence
  chemically synthesized
gtaacttgctgttggtggtttg

SEQ ID NO: 1045819 - DNA, 22 bp, Artificial Sequence
  chemically synthesized
gctgttggtggtttgaaaacag

SEQ ID NO: 1045820 - DNA, 22 bp, Artificial Sequence
  chemically synthesized
ctgttggtggtttgaaaacagc

SEQ ID NO: 1045821 - DNA, 22 bp, Artificial Sequence
  chemically synthesized
ccaacaaaatccagctgttttc

SEQ ID NO: 1045822 - DNA, 22 bp, Artificial Sequence
  chemically synthesized
ttggtggtttgaaaacagctgg

SEQ ID NO: 1045823 - DNA, 22 bp, Artificial Sequence
  chemically synthesized
gtggtttgaaaacagctggatt

SEQ ID NO: 1045824 - DNA, 22 bp, Artificial Sequence
  chemically synthesized
aaggctaccaacaaaatccagc

SEQ ID NO: 1045825 - DNA, 22 bp, Artificial Sequence
  chemically synthesized
gaaaacagctggattttgttgg

SEQ ID NO: 1045826 - DNA, 22 bp, Artificial Sequence
  chemically synthesized
aaaacagctggattttgttggt

SEQ ID NO: 1045827 - DNA, 22 bp, Artificial Sequence
  chemically synthesized
ccagttaaaggctaccaacaaa

SEQ ID NO: 1045828 - DNA, 22 bp, Artificial Sequence
  chemically synthesized
taactgccagttaaaggctacc

SEQ ID NO: 1045829 - DNA, 22 bp, Artificial Sequence
  chemically synthesized
ataactgccagttaaaggctac

SEQ ID NO: 1045830 - DNA, 22 bp, Artificial Sequence
  chemically synthesized
tataactgccagttaaaggcta

SEQ ID NO: 1045831 - DNA, 22 bp, Artificial Sequence
  chemically synthesized
gattttgttggtagcctttaac

SEQ ID NO: 1045832 - DNA, 22 bp, Artificial Sequence
  chemically synthesized
tttataactgccagttaaaggc

SEQ ID NO: 1045833 - DNA, 22 bp, Artificial Sequence
  chemically synthesized
ctttataactgccagttaaagg

SEQ ID NO: 1045834 - DNA, 22 bp, Artificial Sequence
  chemically synthesized
tctttataactgccagttaaag

SEQ ID NO: 1045835 - DNA, 22 bp, Artificial Sequence
  chemically synthesized
tgttggtagcctttaactggca

SEQ ID NO: 1045836 - DNA, 22 bp, Artificial Sequence
  chemically synthesized
gttggtagcctttaactggcag

SEQ ID NO: 1045837 - DNA, 22 bp, Artificial Sequence
  chemically synthesized
ttggtagcctttaactggcagt

SEQ ID NO: 1045838 - DNA, 22 bp, Artificial Sequence
  chemically synthesized
gtagcctttaactggcagttat

SEQ ID NO: 1045839 - DNA, 22 bp, Artificial Sequence
  chemically synthesized
taactggcagttataaagaaaa

SEQ ID NO: 1045840 - DNA, 22 bp, Artificial Sequence
  chemically synthesized
aactggcagttataaagaaaat

SEQ ID NO: 1045841 - DNA, 22 bp, Artificial Sequence
  chemically synthesized
actggcagttataaagaaaata

SEQ ID NO: 1045842 - DNA, 22 bp, Artificial Sequence
  chemically synthesized
gcagttataaagaaaatatttt

SEQ ID NO: 1045843 - DNA, 22 bp, Artificial Sequence
  chemically synthesized
aatagaaatcaataaaatattt

SEQ ID NO: 1045844 - DNA, 22 bp, Artificial Sequence
  chemically synthesized
taaagaaaatattttattgatt

SEQ ID NO: 1045845 - DNA, 22 bp, Artificial Sequence
  chemically synthesized
tattgatttctattcaatttta

SEQ ID NO: 1045846 - DNA, 22 bp, Artificial Sequence
  chemically synthesized
taacatatggaataaaattgaa

SEQ ID NO: 1045847 - DNA, 22 bp, Artificial Sequence
  chemically synthesized
attgatttctattcaattttat

SEQ ID NO: 1045848 - DNA, 22 bp, Artificial Sequence
  chemically synthesized
ttgatttctattcaattttatt

SEQ ID NO: 1045849 - DNA, 22 bp, Artificial Sequence
  chemically synthesized
atttctattcaattttattcca

SEQ ID NO: 1045850 - DNA, 22 bp, Artificial Sequence
  chemically synthesized
tgctataacatatggaataaaa

SEQ ID NO: 1045851 - DNA, 22 bp, Artificial Sequence
  chemically synthesized
ctattcaattttattccatatg

SEQ ID NO: 1045852 - DNA, 22 bp, Artificial Sequence
  chemically synthesized
tattcaattttattccatatgt

SEQ ID NO: 1045853 - DNA, 22 bp, Artificial Sequence
  chemically synthesized
ttcaattttattccatatgtta

SEQ ID NO: 1045854 - DNA, 22 bp, Artificial Sequence
  chemically synthesized
aattttattccatatgttatag

SEQ ID NO: 1045855 - DNA, 22 bp, Artificial Sequence
  chemically synthesized
atgtcaatacctgtgctataac

SEQ ID NO: 1045856 - DNA, 22 bp, Artificial Sequence
  chemically synthesized
tattccatatgttatagcacag

SEQ ID NO: 1045857 - DNA, 22 bp, Artificial Sequence
  chemically synthesized
attccatatgttatagcacagg

SEQ ID NO: 1045858 - DNA, 22 bp, Artificial Sequence
  chemically synthesized
ttccatatgttatagcacaggt

SEQ ID NO: 1045859 - DNA, 22 bp, Artificial Sequence
  chemically synthesized
aaattaatgtcaatacctgtgc

SEQ ID NO: 1045860 - DNA, 22 bp, Artificial Sequence
  chemically synthesized
catatgttatagcacaggtatt

SEQ ID NO: 1045861 - DNA, 22 bp, Artificial Sequence
  chemically synthesized
caaattaatgtcaatacctgtg

SEQ ID NO: 1045862 - DNA, 22 bp, Artificial Sequence
  chemically synthesized
aatttcaaattaatgtcaatac

SEQ ID NO: 1045863 - DNA, 22 bp, Artificial Sequence
  chemically synthesized
tagcacaggtattgacattaat

SEQ ID NO: 1045864 - DNA, 22 bp, Artificial Sequence
  chemically synthesized
tgtatacatattcaatttcaaa

SEQ ID NO: 1045865 - DNA, 22 bp, Artificial Sequence
  chemically synthesized
atgtatacatattcaatttcaa

SEQ ID NO: 1045866 - DNA, 22 bp, Artificial Sequence
  chemically synthesized
tatgtatacatattcaatttca

SEQ ID NO: 1045867 - DNA, 22 bp, Artificial Sequence
  chemically synthesized
ttatgtatacatattcaatttc

SEQ ID NO: 1045868 - DNA, 22 bp, Artificial Sequence
  chemically synthesized
tttatgtatacatattcaattt

SEQ ID NO: 1045869 - DNA, 22 bp, Artificial Sequence
  chemically synthesized
acattaatttgaaattgaatat

SEQ ID NO: 1045870 - DNA, 22 bp, Artificial Sequence
  chemically synthesized
tattttttatgtatacatattc

SEQ ID NO: 1045871 - DNA, 22 bp, Artificial Sequence
  chemically synthesized
atattttttatgtatacatatt

SEQ ID NO: 1045872 - DNA, 22 bp, Artificial Sequence
  chemically synthesized
atttgaaattgaatatgtatac

SEQ ID NO: 1045873 - DNA, 22 bp, Artificial Sequence
  chemically synthesized
tatattttttatgtatacatat

SEQ ID NO: 1045874 - DNA, 22 bp, Artificial Sequence
  chemically synthesized
ttttatattttttatgtataca

SEQ ID NO: 1045875 - DNA, 22 bp, Artificial Sequence
  chemically synthesized
gaaattgaatatgtatacataa

SEQ ID NO: 1045876 - DNA, 22 bp, Artificial Sequence
  chemically synthesized
gttttatattttttatgtatac

SEQ ID NO: 1045877 - DNA, 22 bp, Artificial Sequence
  chemically synthesized
aaattgaatatgtatacataaa

SEQ ID NO: 1045878 - DNA, 22 bp, Artificial Sequence
  chemically synthesized
tgttttatattttttatgtata

SEQ ID NO: 1045879 - DNA, 22 bp, Artificial Sequence
  chemically synthesized
ttgttttatattttttatgtat

SEQ ID NO: 1045880 - DNA, 22 bp, Artificial Sequence
  chemically synthesized
tttttgttttatattttttatg

SEQ ID NO: 1045881 - DNA, 22 bp, Artificial Sequence
  chemically synthesized
aatatgtatacataaaaaatat

SEQ ID NO: 1045882 - DNA, 22 bp, Artificial Sequence
  chemically synthesized
tatgtaatgtatattgtttttg

SEQ ID NO: 1045883 - DNA, 22 bp, Artificial Sequence
  chemically synthesized
atatgtaatgtatattgttttt

SEQ ID NO: 1045884 - DNA, 22 bp, Artificial Sequence
  chemically synthesized
atttatatgtaatgtatattgt

SEQ ID NO: 1045885 - DNA, 22 bp, Artificial Sequence
  chemically synthesized
catttatatgtaatgtatattg

SEQ ID NO: 1045886 - DNA, 22 bp, Artificial Sequence
  chemically synthesized
tcatttatatgtaatgtatatt

SEQ ID NO: 1045887 - DNA, 22 bp, Artificial Sequence
  chemically synthesized
ttcatttatatgtaatgtatat

SEQ ID NO: 1045888 - DNA, 22 bp, Artificial Sequence
  chemically synthesized
gatttttcatttatatgtaatg

SEQ ID NO: 1045889 - DNA, 22 bp, Artificial Sequence
  chemically synthesized
caaaaagggaaattagattttt

SEQ ID NO: 1045890 - DNA, 22 bp, Artificial Sequence
  chemically synthesized
ccaaaaagggaaattagatttt

SEQ ID NO: 1045891 - DNA, 22 bp, Artificial Sequence
  chemically synthesized
catataaatgaaaaatctaatt

SEQ ID NO: 1045892 - DNA, 22 bp, Artificial Sequence
  chemically synthesized
tccaaaaagggaaattagattt

SEQ ID NO: 1045893 - DNA, 22 bp, Artificial Sequence
  chemically synthesized
attttccaaaaagggaaattag

SEQ ID NO: 1045894 - DNA, 22 bp, Artificial Sequence
  chemically synthesized
cattttccaaaaagggaaatta

SEQ ID NO: 1045895 - DNA, 22 bp, Artificial Sequence
  chemically synthesized
tttcattttccaaaaagggaaa

SEQ ID NO: 1045896 - DNA, 22 bp, Artificial Sequence
  chemically synthesized
tgtttcattttccaaaaaggga

SEQ ID NO: 1045897 - DNA, 22 bp, Artificial Sequence
  chemically synthesized
ctgtttcattttccaaaaaggg

SEQ ID NO: 1045898 - DNA, 22 bp, Artificial Sequence
  chemically synthesized
atttccctttttggaaaatgaa

SEQ ID NO: 1045899 - DNA, 22 bp, Artificial Sequence
  chemically synthesized
atggatgacttctgtttcattt

SEQ ID NO: 1045900 - DNA, 22 bp, Artificial Sequence
  chemically synthesized
ccctttttggaaaatgaaacag

SEQ ID NO: 1045901 - DNA, 22 bp, Artificial Sequence
  chemically synthesized
cctttttggaaaatgaaacaga

SEQ ID NO: 1045902 - DNA, 22 bp, Artificial Sequence
  chemically synthesized
gttaatggatgacttctgtttc

SEQ ID NO: 1045903 - DNA, 22 bp, Artificial Sequence
  chemically synthesized
tttggaaaatgaaacagaagtc

SEQ ID NO: 1045904 - DNA, 22 bp, Artificial Sequence
  chemically synthesized
ttggaaaatgaaacagaagtca

SEQ ID NO: 1045905 - DNA, 22 bp, Artificial Sequence
  chemically synthesized
ctagttaatggatgacttctgt

SEQ ID NO: 1045906 - DNA, 22 bp, Artificial Sequence
  chemically synthesized
tggaaaatgaaacagaagtcat

SEQ ID NO: 1045907 - DNA, 22 bp, Artificial Sequence
  chemically synthesized
ggaaaatgaaacagaagtcatc

SEQ ID NO: 1045908 - DNA, 22 bp, Artificial Sequence
  chemically synthesized
gaaaatgaaacagaagtcatcc

SEQ ID NO: 1045909 - DNA, 22 bp, Artificial Sequence
  chemically synthesized
ttcctagttaatggatgacttc

SEQ ID NO: 1045910 - DNA, 22 bp, Artificial Sequence
  chemically synthesized
attcctagttaatggatgactt

SEQ ID NO: 1045911 - DNA, 22 bp, Artificial Sequence
  chemically synthesized
atggaagaacagtttattccta

SEQ ID NO: 1045912 - DNA, 22 bp, Artificial Sequence
  chemically synthesized
gatggaagaacagtttattcct

SEQ ID NO: 1045913 - DNA, 22 bp, Artificial Sequence
  chemically synthesized
tgatggaagaacagtttattcc

SEQ ID NO: 1045914 - DNA, 22 bp, Artificial Sequence
  chemically synthesized
actaggaataaactgttcttcc

SEQ ID NO: 1045915 - DNA, 22 bp, Artificial Sequence
  chemically synthesized
ggaataaactgttcttccatca

SEQ ID NO: 1045916 - DNA, 22 bp, Artificial Sequence
  chemically synthesized
ttcttccatcaaagtttattta

SEQ ID NO: 1045917 - DNA, 22 bp, Artificial Sequence
  chemically synthesized
ttccatcaaagtttatttactg

SEQ ID NO: 1045918 - DNA, 22 bp, Artificial Sequence
  chemically synthesized
ccatcaaagtttatttactggt

SEQ ID NO: 1045919 - DNA, 22 bp, Artificial Sequence
  chemically synthesized
catcaaagtttatttactggtg

SEQ ID NO: 1045920 - DNA, 22 bp, Artificial Sequence
  chemically synthesized
atttactggtggttcctttctg

SEQ ID NO: 1045921 - DNA, 22 bp, Artificial Sequence
  chemically synthesized
tttactggtggttcctttctgt

SEQ ID NO: 1045922 - DNA, 22 bp, Artificial Sequence
  chemically synthesized
catgcagtagggacagaaagga

SEQ ID NO: 1045923 - DNA, 22 bp, Artificial Sequence
  chemically synthesized
acatgcagtagggacagaaagg

SEQ ID NO: 1045924 - DNA, 22 bp, Artificial Sequence
  chemically synthesized
tacatgcagtagggacagaaag

SEQ ID NO: 1045925 - DNA, 22 bp, Artificial Sequence
  chemically synthesized
actggtggttcctttctgtccc

SEQ ID NO: 1045926 - DNA, 22 bp, Artificial Sequence
  chemically synthesized
ttacatgcagtagggacagaaa

SEQ ID NO: 1045927 - DNA, 22 bp, Artificial Sequence
  chemically synthesized
ctggtggttcctttctgtccct

SEQ ID NO: 1045928 - DNA, 22 bp, Artificial Sequence
  chemically synthesized
gtggttcctttctgtccctact

SEQ ID NO: 1045929 - DNA, 22 bp, Artificial Sequence
  chemically synthesized
ctttctgtccctactgcatgta

SEQ ID NO: 1045930 - DNA, 22 bp, Artificial Sequence
  chemically synthesized
tctgtccctactgcatgtaaaa

SEQ ID NO: 1045931 - DNA, 22 bp, Artificial Sequence
  chemically synthesized
ctgtccctactgcatgtaaaaa

SEQ ID NO: 1045932 - DNA, 22 bp, Artificial Sequence
  chemically synthesized
tgtccctactgcatgtaaaaat

SEQ ID NO: 1045933 - DNA, 22 bp, Artificial Sequence
  chemically synthesized
tccctactgcatgtaaaaatga

SEQ ID NO: 1045934 - DNA, 22 bp, Artificial Sequence
  chemically synthesized
ctgcatgtaaaaatgatcattt

SEQ ID NO: 1045935 - DNA, 22 bp, Artificial Sequence
  chemically synthesized
catgtaaaaatgatcatttttg

SEQ ID NO: 1045936 - DNA, 22 bp, Artificial Sequence
  chemically synthesized
aaatgaagaaatgcacaaaaat

SEQ ID NO: 1045937 - DNA, 22 bp, Artificial Sequence
  chemically synthesized
agagacatcctaaaatgaagaa

SEQ ID NO: 1045938 - DNA, 22 bp, Artificial Sequence
  chemically synthesized
gagagacatcctaaaatgaaga

SEQ ID NO: 1045939 - DNA, 22 bp, Artificial Sequence
  chemically synthesized
tgagagacatcctaaaatgaag

SEQ ID NO: 1045940 - DNA, 22 bp, Artificial Sequence
  chemically synthesized
ttgtgcatttcttcattttagg

SEQ ID NO: 1045941 - DNA, 22 bp, Artificial Sequence
  chemically synthesized
tgtgcatttcttcattttagga

SEQ ID NO: 1045942 - DNA, 22 bp, Artificial Sequence
  chemically synthesized
gtgcatttcttcattttaggat

SEQ ID NO: 1045943 - DNA, 22 bp, Artificial Sequence
  chemically synthesized
gctttgagagacatcctaaaat

SEQ ID NO: 1045944 - DNA, 22 bp, Artificial Sequence
  chemically synthesized
tgcatttcttcattttaggatg

SEQ ID NO: 1045945 - DNA, 22 bp, Artificial Sequence
  chemically synthesized
agctttgagagacatcctaaaa

SEQ ID NO: 1045946 - DNA, 22 bp, Artificial Sequence
  chemically synthesized
cttcattttaggatgtctctca

SEQ ID NO: 1045947 - DNA, 22 bp, Artificial Sequence
  chemically synthesized
ttcattttaggatgtctctcaa

SEQ ID NO: 1045948 - DNA, 22 bp, Artificial Sequence
  chemically synthesized
caatatttagctttgagagaca

SEQ ID NO: 1045949 - DNA, 22 bp, Artificial Sequence
  chemically synthesized
acaatatttagctttgagagac

SEQ ID NO: 1045950 - DNA, 22 bp, Artificial Sequence
  chemically synthesized
cattttaggatgtctctcaaag

SEQ ID NO: 1045951 - DNA, 22 bp, Artificial Sequence
  chemically synthesized
tacaatatttagctttgagaga

SEQ ID NO: 1045952 - DNA, 22 bp, Artificial Sequence
  chemically synthesized
attttaggatgtctctcaaagc

SEQ ID NO: 1045953 - DNA, 22 bp, Artificial Sequence
  chemically synthesized
taggatgtctctcaaagctaaa

SEQ ID NO: 1045954 - DNA, 22 bp, Artificial Sequence
  chemically synthesized
aggatgtctctcaaagctaaat

SEQ ID NO: 1045955 - DNA, 22 bp, Artificial Sequence
  chemically synthesized
ggatgtctctcaaagctaaata

SEQ ID NO: 1045956 - DNA, 22 bp, Artificial Sequence
  chemically synthesized
gaaaatgtattttacaatattt

SEQ ID NO: 1045957 - DNA, 22 bp, Artificial Sequence
  chemically synthesized
tcaaagctaaatattgtaaaat

SEQ ID NO: 1045958 - DNA, 22 bp, Artificial Sequence
  chemically synthesized
aaagctaaatattgtaaaatac

SEQ ID NO: 1045959 - DNA, 22 bp, Artificial Sequence
  chemically synthesized
aatattgtaaaatacattttct

SEQ ID NO: 1045960 - DNA, 22 bp, Artificial Sequence
  chemically synthesized
taaaatacattttctaacttat

SEQ ID NO: 1045961 - DNA, 22 bp, Artificial Sequence
  chemically synthesized
gggtagaaagacataagttaga

SEQ ID NO: 1045962 - DNA, 22 bp, Artificial Sequence
  chemically synthesized
agaaatctagggtagaaagaca

SEQ ID NO: 1045963 - DNA, 22 bp, Artificial Sequence
  chemically synthesized
cagaaatctagggtagaaagac

SEQ ID NO: 1045964 - DNA, 22 bp, Artificial Sequence
  chemically synthesized
tctaacttatgtctttctaccc

SEQ ID NO: 1045965 - DNA, 22 bp, Artificial Sequence
  chemically synthesized
ctaacttatgtctttctaccct

SEQ ID NO: 1045966 - DNA, 22 bp, Artificial Sequence
  chemically synthesized
taacttatgtctttctacccta

SEQ ID NO: 1045967 - DNA, 22 bp, Artificial Sequence
  chemically synthesized
gcttcagaaatctagggtagaa

SEQ ID NO: 1045968 - DNA, 22 bp, Artificial Sequence
  chemically synthesized
acttatgtctttctaccctaga

SEQ ID NO: 1045969 - DNA, 22 bp, Artificial Sequence
  chemically synthesized
atgtctttctaccctagatttc

SEQ ID NO: 1045970 - DNA, 22 bp, Artificial Sequence
  chemically synthesized
tgtctttctaccctagatttct

SEQ ID NO: 1045971 - DNA, 22 bp, Artificial Sequence
  chemically synthesized
atagtgtggttggcttcagaaa

SEQ ID NO: 1045972 - DNA, 22 bp, Artificial Sequence
  chemically synthesized
tctaccctagatttctgaagcc

SEQ ID NO: 1045973 - DNA, 22 bp, Artificial Sequence
  chemically synthesized
gatagtgtggttggcttcagaa

SEQ ID NO: 1045974 - DNA, 22 bp, Artificial Sequence
  chemically synthesized
ctaccctagatttctgaagcca

SEQ ID NO: 1045975 - DNA, 22 bp, Artificial Sequence
  chemically synthesized
taccctagatttctgaagccaa

SEQ ID NO: 1045976 - DNA, 22 bp, Artificial Sequence
  chemically synthesized
ccctagatttctgaagccaacc

SEQ ID NO: 1045977 - DNA, 22 bp, Artificial Sequence
  chemically synthesized
gatttctgaagccaaccacact

SEQ ID NO: 1045978 - DNA, 22 bp, Artificial Sequence
  chemically synthesized
aaaatacttgatagtgtggttg

SEQ ID NO: 1045979 - DNA, 22 bp, Artificial Sequence
  chemically synthesized
aaaaatacttgatagtgtggtt

SEQ ID NO: 1045980 - DNA, 22 bp, Artificial Sequence
  chemically synthesized
ttaaaaatacttgatagtgtgg

SEQ ID NO: 1045981 - DNA, 22 bp, Artificial Sequence
  chemically synthesized
ctgaagccaaccacactatcaa

SEQ ID NO: 1045982 - DNA, 22 bp, Artificial Sequence
  chemically synthesized
tgaagccaaccacactatcaag

SEQ ID NO: 1045983 - DNA, 22 bp, Artificial Sequence
  chemically synthesized
aagccaaccacactatcaagta

SEQ ID NO: 1045984 - DNA, 22 bp, Artificial Sequence
  chemically synthesized
acatggaattcttaaaaatact

SEQ ID NO: 1045985 - DNA, 22 bp, Artificial Sequence
  chemically synthesized
cacatggaattcttaaaaatac

SEQ ID NO: 1045986 - DNA, 22 bp, Artificial Sequence
  chemically synthesized
tcacatggaattcttaaaaata

SEQ ID NO: 1045987 - DNA, 22 bp, Artificial Sequence
  chemically synthesized
actttcacatggaattcttaaa

SEQ ID NO: 1045988 - DNA, 22 bp, Artificial Sequence
  chemically synthesized
gactttcacatggaattcttaa

SEQ ID NO: 1045989 - DNA, 22 bp, Artificial Sequence
  chemically synthesized
tgactttcacatggaattctta

SEQ ID NO: 1045990 - DNA, 22 bp, Artificial Sequence
  chemically synthesized
tcaagtatttttaagaattcca

SEQ ID NO: 1045991 - DNA, 22 bp, Artificial Sequence
  chemically synthesized
ttaagaattccatgtgaaagtc

SEQ ID NO: 1045992 - DNA, 22 bp, Artificial Sequence
  chemically synthesized
taagaattccatgtgaaagtca

SEQ ID NO: 1045993 - DNA, 22 bp, Artificial Sequence
  chemically synthesized
aagaattccatgtgaaagtcaa

SEQ ID NO: 1045994 - DNA, 22 bp, Artificial Sequence
  chemically synthesized
agaattccatgtgaaagtcaaa

SEQ ID NO: 1045995 - DNA, 22 bp, Artificial Sequence
  chemically synthesized
tatgcatcatgatggcattttg

SEQ ID NO: 1045996 - DNA, 22 bp, Artificial Sequence
  chemically synthesized
catgtgaaagtcaaaatgccat

SEQ ID NO: 1045997 - DNA, 22 bp, Artificial Sequence
  chemically synthesized
aattgtatgcatcatgatggca

SEQ ID NO: 1045998 - DNA, 22 bp, Artificial Sequence
  chemically synthesized
aaattgtatgcatcatgatggc

SEQ ID NO: 1045999 - DNA, 22 bp, Artificial Sequence
  chemically synthesized
acttaaattgtatgcatcatga

SEQ ID NO: 1046000 - DNA, 22 bp, Artificial Sequence
  chemically synthesized
atagtgccagaacaattgactt

SEQ ID NO: 1046001 - DNA, 22 bp, Artificial Sequence
  chemically synthesized
atcattcatagtgccagaacaa

SEQ ID NO: 1046002 - DNA, 22 bp, Artificial Sequence
  chemically synthesized
aagtcaattgttctggcactat

SEQ ID NO: 1046003 - DNA, 22 bp, Artificial Sequence
  chemically synthesized
agtcaattgttctggcactatg

SEQ ID NO: 1046004 - DNA, 22 bp, Artificial Sequence
  chemically synthesized
ttctggcactatgaatgatcag

SEQ ID NO: 1046005 - DNA, 22 bp, Artificial Sequence
  chemically synthesized
caaggtgatcatactgatcatt

SEQ ID NO: 1046006 - DNA, 22 bp, Artificial Sequence
  chemically synthesized
acaaggtgatcatactgatcat

SEQ ID NO: 1046007 - DNA, 22 bp, Artificial Sequence
  chemically synthesized
tggcactatgaatgatcagtat

SEQ ID NO: 1046008 - DNA, 22 bp, Artificial Sequence
  chemically synthesized
tacaaggtgatcatactgatca

SEQ ID NO: 1046009 - DNA, 22 bp, Artificial Sequence
  chemically synthesized
gcactatgaatgatcagtatga

SEQ ID NO: 1046010 - DNA, 22 bp, Artificial Sequence
  chemically synthesized
gtattttacaaggtgatcatac

SEQ ID NO: 1046011 - DNA, 22 bp, Artificial Sequence
  chemically synthesized
tgaatgatcagtatgatcacct

SEQ ID NO: 1046012 - DNA, 22 bp, Artificial Sequence
  chemically synthesized
attcgtattttacaaggtgatc

SEQ ID NO: 1046013 - DNA, 22 bp, Artificial Sequence
  chemically synthesized
cattcgtattttacaaggtgat

SEQ ID NO: 1046014 - DNA, 22 bp, Artificial Sequence
  chemically synthesized
tcattcgtattttacaaggtga

SEQ ID NO: 1046015 - DNA, 22 bp, Artificial Sequence
  chemically synthesized
gtaaaatacgaatgaaagtgct

SEQ ID NO: 1046016 - DNA, 22 bp, Artificial Sequence
  chemically synthesized
taaaatacgaatgaaagtgctt

SEQ ID NO: 1046017 - DNA, 22 bp, Artificial Sequence
  chemically synthesized
aaggtaaaaccaaagcactttc

SEQ ID NO: 1046018 - DNA, 22 bp, Artificial Sequence
  chemically synthesized
tgaaggtaaaaccaaagcactt

SEQ ID NO: 1046019 - DNA, 22 bp, Artificial Sequence
  chemically synthesized
agcaagaggagtctctgaaggt

SEQ ID NO: 1046020 - DNA, 22 bp, Artificial Sequence
  chemically synthesized
aagcaagaggagtctctgaagg

SEQ ID NO: 1046021 - DNA, 22 bp, Artificial Sequence
  chemically synthesized
taagcaagaggagtctctgaag

SEQ ID NO: 1046022 - DNA, 22 bp, Artificial Sequence
  chemically synthesized
tttaagcaagaggagtctctga

SEQ ID NO: 1046023 - DNA, 22 bp, Artificial Sequence
  chemically synthesized
tggttttaccttcagagactcc

SEQ ID NO: 1046024 - DNA, 22 bp, Artificial Sequence
  chemically synthesized
ggttttaccttcagagactcct

SEQ ID NO: 1046025 - DNA, 22 bp, Artificial Sequence
  chemically synthesized
gttttaccttcagagactcctc

SEQ ID NO: 1046026 - DNA, 22 bp, Artificial Sequence
  chemically synthesized
taccttcagagactcctcttgc

SEQ ID NO: 1046027 - DNA, 22 bp, Artificial Sequence
  chemically synthesized
accttcagagactcctcttgct

SEQ ID NO: 1046028 - DNA, 22 bp, Artificial Sequence
  chemically synthesized
aagatctctttaagcaagagga

SEQ ID NO: 1046029 - DNA, 22 bp, Artificial Sequence
  chemically synthesized
ccttcagagactcctcttgctt

SEQ ID NO: 1046030 - DNA, 22 bp, Artificial Sequence
  chemically synthesized
gaagatctctttaagcaagagg

SEQ ID NO: 1046031 - DNA, 22 bp, Artificial Sequence
  chemically synthesized
tgaagatctctttaagcaagag

SEQ ID NO: 1046032 - DNA, 22 bp, Artificial Sequence
  chemically synthesized
cagagactcctcttgcttaaag

SEQ ID NO: 1046033 - DNA, 22 bp, Artificial Sequence
  chemically synthesized
agagactcctcttgcttaaaga

SEQ ID NO: 1046034 - DNA, 22 bp, Artificial Sequence
  chemically synthesized
aggactttgaagatctctttaa

SEQ ID NO: 1046035 - DNA, 22 bp, Artificial Sequence
  chemically synthesized
ctcttgcttaaagagatcttca

SEQ ID NO: 1046036 - DNA, 22 bp, Artificial Sequence
  chemically synthesized
tgctaaggactttgaagatctc

SEQ ID NO: 1046037 - DNA, 22 bp, Artificial Sequence
  chemically synthesized
tgtgctaaggactttgaagatc

SEQ ID NO: 1046038 - DNA, 22 bp, Artificial Sequence
  chemically synthesized
ttgcttaaagagatcttcaaag

SEQ ID NO: 1046039 - DNA, 22 bp, Artificial Sequence
  chemically synthesized
gcttaaagagatcttcaaagtc

SEQ ID NO: 1046040 - DNA, 22 bp, Artificial Sequence
  chemically synthesized
cttaaagagatcttcaaagtcc

SEQ ID NO: 1046041 - DNA, 22 bp, Artificial Sequence
  chemically synthesized
acctctgtgctaaggactttga

SEQ ID NO: 1046042 - DNA, 22 bp, Artificial Sequence
  chemically synthesized
aaagagatcttcaaagtcctta

SEQ ID NO: 1046043 - DNA, 22 bp, Artificial Sequence
  chemically synthesized
aagagatcttcaaagtccttag

SEQ ID NO: 1046044 - DNA, 22 bp, Artificial Sequence
  chemically synthesized
ctgacctctgtgctaaggactt

SEQ ID NO: 1046045 - DNA, 22 bp, Artificial Sequence
  chemically synthesized
aatgctcctgacctctgtgcta

SEQ ID NO: 1046046 - DNA, 22 bp, Artificial Sequence
  chemically synthesized
tcaatgctcctgacctctgtgc

SEQ ID NO: 1046047 - DNA, 22 bp, Artificial Sequence
  chemically synthesized
caaagtccttagcacagaggtc

SEQ ID NO: 1046048 - DNA, 22 bp, Artificial Sequence
  chemically synthesized
ctcaatgctcctgacctctgtg

SEQ ID NO: 1046049 - DNA, 22 bp, Artificial Sequence
  chemically synthesized
aaagtccttagcacagaggtca

SEQ ID NO: 1046050 - DNA, 22 bp, Artificial Sequence
  chemically synthesized
agcacagaggtcaggagcattg

SEQ ID NO: 1046051 - DNA, 22 bp, Artificial Sequence
  chemically synthesized
gcacagaggtcaggagcattga

SEQ ID NO: 1046052 - DNA, 22 bp, Artificial Sequence
  chemically synthesized
gaagtggaacaacttctcaatg

SEQ ID NO: 1046053 - DNA, 22 bp, Artificial Sequence
  chemically synthesized
ttagaagtggaacaacttctca

SEQ ID NO: 1046054 - DNA, 22 bp, Artificial Sequence
  chemically synthesized
acaagccctattagaagtggaa

SEQ ID NO: 1046055 - DNA, 22 bp, Artificial Sequence
  chemically synthesized
agaagttgttccacttctaata

SEQ ID NO: 1046056 - DNA, 22 bp, Artificial Sequence
  chemically synthesized
atgtctcacaagccctattaga

SEQ ID NO: 1046057 - DNA, 22 bp, Artificial Sequence
  chemically synthesized
ttccacttctaatagggcttgt

SEQ ID NO: 1046058 - DNA, 22 bp, Artificial Sequence
  chemically synthesized
cacttctaatagggcttgtgag

SEQ ID NO: 1046059 - DNA, 22 bp, Artificial Sequence
  chemically synthesized
aaatcactcatgtctcacaagc

SEQ ID NO: 1046060 - DNA, 22 bp, Artificial Sequence
  chemically synthesized
ctaatagggcttgtgagacatg

SEQ ID NO: 1046061 - DNA, 22 bp, Artificial Sequence
  chemically synthesized
actgaaatcactcatgtctcac

SEQ ID NO: 1046062 - DNA, 22 bp, Artificial Sequence
  chemically synthesized
taatagggcttgtgagacatga

SEQ ID NO: 1046063 - DNA, 22 bp, Artificial Sequence
  chemically synthesized
gactgaaatcactcatgtctca

SEQ ID NO: 1046064 - DNA, 22 bp, Artificial Sequence
  chemically synthesized
atagggcttgtgagacatgagt

SEQ ID NO: 1046065 - DNA, 22 bp, Artificial Sequence
  chemically synthesized
tttgactgaaatcactcatgtc

SEQ ID NO: 1046066 - DNA, 22 bp, Artificial Sequence
  chemically synthesized
atttgactgaaatcactcatgt

SEQ ID NO: 1046067 - DNA, 22 bp, Artificial Sequence
  chemically synthesized
cttatttgactgaaatcactca

SEQ ID NO: 1046068 - DNA, 22 bp, Artificial Sequence
  chemically synthesized
tacttatttgactgaaatcact

SEQ ID NO: 1046069 - DNA, 22 bp, Artificial Sequence
  chemically synthesized
ctacttatttgactgaaatcac

SEQ ID NO: 1046070 - DNA, 22 bp, Artificial Sequence
  chemically synthesized
gtgagacatgagtgatttcagt

SEQ ID NO: 1046071 - DNA, 22 bp, Artificial Sequence
  chemically synthesized
tgagacatgagtgatttcagtc

SEQ ID NO: 1046072 - DNA, 22 bp, Artificial Sequence
  chemically synthesized
tgtgccttctacttatttgact

SEQ ID NO: 1046073 - DNA, 22 bp, Artificial Sequence
  chemically synthesized
atgtgccttctacttatttgac

SEQ ID NO: 1046074 - DNA, 22 bp, Artificial Sequence
  chemically synthesized
ttatgtgccttctacttatttg

SEQ ID NO: 1046075 - DNA, 22 bp, Artificial Sequence
  chemically synthesized
cttatgtgccttctacttattt

SEQ ID NO: 1046076 - DNA, 22 bp, Artificial Sequence
  chemically synthesized
cagtcaaataagtagaaggcac

SEQ ID NO: 1046077 - DNA, 22 bp, Artificial Sequence
  chemically synthesized
gaaatttcttatgtgccttcta

SEQ ID NO: 1046078 - DNA, 22 bp, Artificial Sequence
  chemically synthesized
agtcaaataagtagaaggcaca

SEQ ID NO: 1046079 - DNA, 22 bp, Artificial Sequence
  chemically synthesized
ggaaatttcttatgtgccttct

SEQ ID NO: 1046080 - DNA, 22 bp, Artificial Sequence
  chemically synthesized
tggaaatttcttatgtgccttc

SEQ ID NO: 1046081 - DNA, 22 bp, Artificial Sequence
  chemically synthesized
aagacatgcctttggaaatttc

SEQ ID NO: 1046082 - DNA, 22 bp, Artificial Sequence
  chemically synthesized
ccaaaggcatgtcttcagtcat

SEQ ID NO: 1046083 - DNA, 22 bp, Artificial Sequence
  chemically synthesized
caaaggcatgtcttcagtcatc

SEQ ID NO: 1046084 - DNA, 22 bp, Artificial Sequence
  chemically synthesized
tccgtgaagaaacgatgatggt

SEQ ID NO: 1046085 - DNA, 22 bp, Artificial Sequence
  chemically synthesized
cagtcatcaccatcatcgtttc

SEQ ID NO: 1046086 - DNA, 22 bp, Artificial Sequence
  chemically synthesized
agtcatcaccatcatcgtttct

SEQ ID NO: 1046087 - DNA, 22 bp, Artificial Sequence
  chemically synthesized
taccagcacactgtccgtgaag

SEQ ID NO: 1046088 - DNA, 22 bp, Artificial Sequence
  chemically synthesized
tatatctataccagcacactgt

SEQ ID NO: 1046089 - DNA, 22 bp, Artificial Sequence
  chemically synthesized
gtatatctataccagcacactg

SEQ ID NO: 1046090 - DNA, 22 bp, Artificial Sequence
  chemically synthesized
tgtatatctataccagcacact

SEQ ID NO: 1046091 - DNA, 22 bp, Artificial Sequence
  chemically synthesized
ttgtatatctataccagcacac

SEQ ID NO: 1046092 - DNA, 22 bp, Artificial Sequence
  chemically synthesized
cttcacggacagtgtgctggta

SEQ ID NO: 1046093 - DNA, 22 bp, Artificial Sequence
  chemically synthesized
ttcacggacagtgtgctggtat

SEQ ID NO: 1046094 - DNA, 22 bp, Artificial Sequence
  chemically synthesized
ttttgtatatctataccagcac

SEQ ID NO: 1046095 - DNA, 22 bp, Artificial Sequence
  chemically synthesized
cacggacagtgtgctggtatag

SEQ ID NO: 1046096 - DNA, 22 bp, Artificial Sequence
  chemically synthesized
acggacagtgtgctggtataga

SEQ ID NO: 1046097 - DNA, 22 bp, Artificial Sequence
  chemically synthesized
ttcttttgtatatctataccag

SEQ ID NO: 1046098 - DNA, 22 bp, Artificial Sequence
  chemically synthesized
aaaaaaattgttcttttgtata

SEQ ID NO: 1046099 - DNA, 22 bp, Artificial Sequence
  chemically synthesized
gtatagatatacaaaagaacaa

SEQ ID NO: 1046100 - DNA, 22 bp, Artificial Sequence
  chemically synthesized
ggaagctaaaaaaaattgttct

SEQ ID NO: 1046101 - DNA, 22 bp, Artificial Sequence
  chemically synthesized
ttaggaagctaaaaaaaattgt

SEQ ID NO: 1046102 - DNA, 22 bp, Artificial Sequence
  chemically synthesized
actgttaggaagctaaaaaaaa

SEQ ID NO: 1046103 - DNA, 22 bp, Artificial Sequence
  chemically synthesized
cactgttaggaagctaaaaaaa

SEQ ID NO: 1046104 - DNA, 22 bp, Artificial Sequence
  chemically synthesized
atggaggaggtttcactgttag

SEQ ID NO: 1046105 - DNA, 22 bp, Artificial Sequence
  chemically synthesized
tttttagcttcctaacagtgaa

SEQ ID NO: 1046106 - DNA, 22 bp, Artificial Sequence
  chemically synthesized
aatggaggaggtttcactgtta

SEQ ID NO: 1046107 - DNA, 22 bp, Artificial Sequence
  chemically synthesized
ttttagcttcctaacagtgaaa

SEQ ID NO: 1046108 - DNA, 22 bp, Artificial Sequence
  chemically synthesized
tttagcttcctaacagtgaaac

SEQ ID NO: 1046109 - DNA, 22 bp, Artificial Sequence
  chemically synthesized
ttagcttcctaacagtgaaacc

SEQ ID NO: 1046110 - DNA, 22 bp, Artificial Sequence
  chemically synthesized
tagcttcctaacagtgaaacct

SEQ ID NO: 1046111 - DNA, 22 bp, Artificial Sequence
  chemically synthesized
agcttcctaacagtgaaacctc

SEQ ID NO: 1046112 - DNA, 22 bp, Artificial Sequence
  chemically synthesized
gcttcctaacagtgaaacctcc

SEQ ID NO: 1046113 - DNA, 22 bp, Artificial Sequence
  chemically synthesized
tataaacttaatggaggaggtt

SEQ ID NO: 1046114 - DNA, 22 bp, Artificial Sequence
  chemically synthesized
cctaacagtgaaacctcctcca

SEQ ID NO: 1046115 - DNA, 22 bp, Artificial Sequence
  chemically synthesized
ctaacagtgaaacctcctccat

SEQ ID NO: 1046116 - DNA, 22 bp, Artificial Sequence
  chemically synthesized
acagtgaaacctcctccattaa

SEQ ID NO: 1046117 - DNA, 22 bp, Artificial Sequence
  chemically synthesized
tagaatgagacctatataaact

SEQ ID NO: 1046118 - DNA, 22 bp, Artificial Sequence
  chemically synthesized
ctccattaagtttatataggtc

SEQ ID NO: 1046119 - DNA, 22 bp, Artificial Sequence
  chemically synthesized
cattaagtttatataggtctca

SEQ ID NO: 1046120 - DNA, 22 bp, Artificial Sequence
  chemically synthesized
tcagctgtagaatgagacctat

SEQ ID NO: 1046121 - DNA, 22 bp, Artificial Sequence
  chemically synthesized
agtttatataggtctcattcta

SEQ ID NO: 1046122 - DNA, 22 bp, Artificial Sequence
  chemically synthesized
aattgtcagctgtagaatgaga

SEQ ID NO: 1046123 - DNA, 22 bp, Artificial Sequence
  chemically synthesized
atataggtctcattctacagct

SEQ ID NO: 1046124 - DNA, 22 bp, Artificial Sequence
  chemically synthesized
tataggtctcattctacagctg

SEQ ID NO: 1046125 - DNA, 22 bp, Artificial Sequence
  chemically synthesized
tagattcaattgtcagctgtag

SEQ ID NO: 1046126 - DNA, 22 bp, Artificial Sequence
  chemically synthesized
gtagattcaattgtcagctgta

SEQ ID NO: 1046127 - DNA, 22 bp, Artificial Sequence
  chemically synthesized
attctacagctgacaattgaat

SEQ ID NO: 1046128 - DNA, 22 bp, Artificial Sequence
  chemically synthesized
agcccagtttgtagattcaatt

SEQ ID NO: 1046129 - DNA, 22 bp, Artificial Sequence
  chemically synthesized
cagcccagtttgtagattcaat

SEQ ID NO: 1046130 - DNA, 22 bp, Artificial Sequence
  chemically synthesized
tacagctgacaattgaatctac

SEQ ID NO: 1046131 - DNA, 22 bp, Artificial Sequence
  chemically synthesized
tcagcccagtttgtagattcaa

SEQ ID NO: 1046132 - DNA, 22 bp, Artificial Sequence
  chemically synthesized
cagctgacaattgaatctacaa

SEQ ID NO: 1046133 - DNA, 22 bp, Artificial Sequence
  chemically synthesized
acaattgaatctacaaactggg

SEQ ID NO: 1046134 - DNA, 22 bp, Artificial Sequence
  chemically synthesized
aatccattttcagcccagtttg

SEQ ID NO: 1046135 - DNA, 22 bp, Artificial Sequence
  chemically synthesized
gaatccattttcagcccagttt

SEQ ID NO: 1046136 - DNA, 22 bp, Artificial Sequence
  chemically synthesized
tgaatccattttcagcccagtt

SEQ ID NO: 1046137 - DNA, 22 bp, Artificial Sequence
  chemically synthesized
aatctacaaactgggctgaaaa

SEQ ID NO: 1046138 - DNA, 22 bp, Artificial Sequence
  chemically synthesized
caaactgggctgaaaatggatt

SEQ ID NO: 1046139 - DNA, 22 bp, Artificial Sequence
  chemically synthesized
ccatcgtgaggttttgaatcca

SEQ ID NO: 1046140 - DNA, 22 bp, Artificial Sequence
  chemically synthesized
accatcgtgaggttttgaatcc

SEQ ID NO: 1046141 - DNA, 22 bp, Artificial Sequence
  chemically synthesized
ggctgaaaatggattcaaaacc

SEQ ID NO: 1046142 - DNA, 22 bp, Artificial Sequence
  chemically synthesized
gacttaccatcgtgaggttttg

SEQ ID NO: 1046143 - DNA, 22 bp, Artificial Sequence
  chemically synthesized
aaaatggattcaaaacctcacg

SEQ ID NO: 1046144 - DNA, 22 bp, Artificial Sequence
  chemically synthesized
ctagacttaccatcgtgaggtt

SEQ ID NO: 1046145 - DNA, 22 bp, Artificial Sequence
  chemically synthesized
actagacttaccatcgtgaggt

SEQ ID NO: 1046146 - DNA, 22 bp, Artificial Sequence
  chemically synthesized
tactagacttaccatcgtgagg

SEQ ID NO: 1046147 - DNA, 22 bp, Artificial Sequence
  chemically synthesized
aaaacctcacgatggtaagtct

SEQ ID NO: 1046148 - DNA, 22 bp, Artificial Sequence
  chemically synthesized
ataaatcaccgttttactagac

SEQ ID NO: 1046149 - DNA, 22 bp, Artificial Sequence
  chemically synthesized
acgatggtaagtctagtaaaac

SEQ ID NO: 1046150 - DNA, 22 bp, Artificial Sequence
  chemically synthesized
gtaaaacggtgatttattaatt

SEQ ID NO: 1046151 - DNA, 22 bp, Artificial Sequence
  chemically synthesized
gaaaaagtaggtatataattaa

SEQ ID NO: 1046152 - DNA, 22 bp, Artificial Sequence
  chemically synthesized
tggaaaaagtaggtatataatt

SEQ ID NO: 1046153 - DNA, 22 bp, Artificial Sequence
  chemically synthesized
ctggaaaaagtaggtatataat

SEQ ID NO: 1046154 - DNA, 22 bp, Artificial Sequence
  chemically synthesized
tctggaaaaagtaggtatataa

SEQ ID NO: 1046155 - DNA, 22 bp, Artificial Sequence
  chemically synthesized
acactttctggaaaaagtaggt

SEQ ID NO: 1046156 - DNA, 22 bp, Artificial Sequence
  chemically synthesized
attaattatatacctacttttt

SEQ ID NO: 1046157 - DNA, 22 bp, Artificial Sequence
  chemically synthesized
aacactttctggaaaaagtagg

SEQ ID NO: 1046158 - DNA, 22 bp, Artificial Sequence
  chemically synthesized
ttaattatatacctactttttc

SEQ ID NO: 1046159 - DNA, 22 bp, Artificial Sequence
  chemically synthesized
taacactttctggaaaaagtag

SEQ ID NO: 1046160 - DNA, 22 bp, Artificial Sequence
  chemically synthesized
ttaacactttctggaaaaagta

SEQ ID NO: 1046161 - DNA, 22 bp, Artificial Sequence
  chemically synthesized
attatatacctactttttccag

SEQ ID NO: 1046162 - DNA, 22 bp, Artificial Sequence
  chemically synthesized
tatacctactttttccagaaag

SEQ ID NO: 1046163 - DNA, 22 bp, Artificial Sequence
  chemically synthesized
tgaaatgcttttaacactttct

SEQ ID NO: 1046164 - DNA, 22 bp, Artificial Sequence
  chemically synthesized
ttatgaaatgcttttaacactt

SEQ ID NO: 1046165 - DNA, 22 bp, Artificial Sequence
  chemically synthesized
ctttttccagaaagtgttaaaa

SEQ ID NO: 1046166 - DNA, 22 bp, Artificial Sequence
  chemically synthesized
attatgaaatgcttttaacact

SEQ ID NO: 1046167 - DNA, 22 bp, Artificial Sequence
  chemically synthesized
tttccagaaagtgttaaaagca

SEQ ID NO: 1046168 - DNA, 22 bp, Artificial Sequence
  chemically synthesized
ttccagaaagtgttaaaagcat

SEQ ID NO: 1046169 - DNA, 22 bp, Artificial Sequence
  chemically synthesized
tccagaaagtgttaaaagcatt

SEQ ID NO: 1046170 - DNA, 22 bp, Artificial Sequence
  chemically synthesized
ccagaaagtgttaaaagcattt

SEQ ID NO: 1046171 - DNA, 22 bp, Artificial Sequence
  chemically synthesized
cagaaagtgttaaaagcatttc

SEQ ID NO: 1046172 - DNA, 22 bp, Artificial Sequence
  chemically synthesized
atatgtgtgtgtcacttattat

SEQ ID NO: 1046173 - DNA, 22 bp, Artificial Sequence
  chemically synthesized
aaagcatttcataataagtgac

SEQ ID NO: 1046174 - DNA, 22 bp, Artificial Sequence
  chemically synthesized
tggtgctaatatgtgtgtgtca

SEQ ID NO: 1046175 - DNA, 22 bp, Artificial Sequence
  chemically synthesized
atggtgctaatatgtgtgtgtc

SEQ ID NO: 1046176 - DNA, 22 bp, Artificial Sequence
  chemically synthesized
cataataagtgacacacacata

SEQ ID NO: 1046177 - DNA, 22 bp, Artificial Sequence
  chemically synthesized
ataataagtgacacacacatat

SEQ ID NO: 1046178 - DNA, 22 bp, Artificial Sequence
  chemically synthesized
tatttatggtgctaatatgtgt

SEQ ID NO: 1046179 - DNA, 22 bp, Artificial Sequence
  chemically synthesized
atatttatggtgctaatatgtg

SEQ ID NO: 1046180 - DNA, 22 bp, Artificial Sequence
  chemically synthesized
gtcttatatttatggtgctaat

SEQ ID NO: 1046181 - DNA, 22 bp, Artificial Sequence
  chemically synthesized
cgtcttatatttatggtgctaa

SEQ ID NO: 1046182 - DNA, 22 bp, Artificial Sequence
  chemically synthesized
tcgtcttatatttatggtgcta

SEQ ID NO: 1046183 - DNA, 22 bp, Artificial Sequence
  chemically synthesized
atggtctttcgtcttatattta

SEQ ID NO: 1046184 - DNA, 22 bp, Artificial Sequence
  chemically synthesized
gcaccataaatataagacgaaa

SEQ ID NO: 1046185 - DNA, 22 bp, Artificial Sequence
  chemically synthesized
tgacctcatggtctttcgtctt

SEQ ID NO: 1046186 - DNA, 22 bp, Artificial Sequence
  chemically synthesized
atgacctcatggtctttcgtct

SEQ ID NO: 1046187 - DNA, 22 bp, Artificial Sequence
  chemically synthesized
cttatgacctcatggtctttcg

SEQ ID NO: 1046188 - DNA, 22 bp, Artificial Sequence
  chemically synthesized
tccttatgacctcatggtcttt

SEQ ID NO: 1046189 - DNA, 22 bp, Artificial Sequence
  chemically synthesized
ctctccttatgacctcatggtc

SEQ ID NO: 1046190 - DNA, 22 bp, Artificial Sequence
  chemically synthesized
ggataaaactactctccttatg

SEQ ID NO: 1046191 - DNA, 22 bp, Artificial Sequence
  chemically synthesized
aggataaaactactctccttat

SEQ ID NO: 1046192 - DNA, 22 bp, Artificial Sequence
  chemically synthesized
ttaggataaaactactctcctt

SEQ ID NO: 1046193 - DNA, 22 bp, Artificial Sequence
  chemically synthesized
cttaggataaaactactctcct

SEQ ID NO: 1046194 - DNA, 22 bp, Artificial Sequence
  chemically synthesized
tcttaggataaaactactctcc

SEQ ID NO: 1046195 - DNA, 22 bp, Artificial Sequence
  chemically synthesized
ttcttaggataaaactactctc

SEQ ID NO: 1046196 - DNA, 22 bp, Artificial Sequence
  chemically synthesized
tttcttaggataaaactactct

SEQ ID NO: 1046197 - DNA, 22 bp, Artificial Sequence
  chemically synthesized
caaaaatcgtctttttcttagg

SEQ ID NO: 1046198 - DNA, 22 bp, Artificial Sequence
  chemically synthesized
tatcctaagaaaaagacgattt

SEQ ID NO: 1046199 - DNA, 22 bp, Artificial Sequence
  chemically synthesized
atcctaagaaaaagacgatttt

SEQ ID NO: 1046200 - DNA, 22 bp, Artificial Sequence
  chemically synthesized
tcctaagaaaaagacgattttt

SEQ ID NO: 1046201 - DNA, 22 bp, Artificial Sequence
  chemically synthesized
aatgccggttgcaaaaatcgtc

SEQ ID NO: 1046202 - DNA, 22 bp, Artificial Sequence
  chemically synthesized
aaatgccggttgcaaaaatcgt

SEQ ID NO: 1046203 - DNA, 22 bp, Artificial Sequence
  chemically synthesized
agaaaaagacgatttttgcaac

SEQ ID NO: 1046204 - DNA, 22 bp, Artificial Sequence
  chemically synthesized
gaaatttaaatgccggttgcaa

SEQ ID NO: 1046205 - DNA, 22 bp, Artificial Sequence
  chemically synthesized
gaattagaaatttaaatgccgg

SEQ ID NO: 1046206 - DNA, 22 bp, Artificial Sequence
  chemically synthesized
ttgcaaccggcatttaaatttc

SEQ ID NO: 1046207 - DNA, 22 bp, Artificial Sequence
  chemically synthesized
tgcaaccggcatttaaatttct

SEQ ID NO: 1046208 - DNA, 22 bp, Artificial Sequence
  chemically synthesized
caaattagaattagaaatttaa

SEQ ID NO: 1046209 - DNA, 22 bp, Artificial Sequence
  chemically synthesized
gcaaccggcatttaaatttcta

SEQ ID NO: 1046210 - DNA, 22 bp, Artificial Sequence
  chemically synthesized
caaccggcatttaaatttctaa

SEQ ID NO: 1046211 - DNA, 22 bp, Artificial Sequence
  chemically synthesized
aatgccagttgcaaattagaat

SEQ ID NO: 1046212 - DNA, 22 bp, Artificial Sequence
  chemically synthesized
aaatgccagttgcaaattagaa

SEQ ID NO: 1046213 - DNA, 22 bp, Artificial Sequence
  chemically synthesized
taaatgccagttgcaaattaga

SEQ ID NO: 1046214 - DNA, 22 bp, Artificial Sequence
  chemically synthesized
aaatttctaattctaatttgca

SEQ ID NO: 1046215 - DNA, 22 bp, Artificial Sequence
  chemically synthesized
aatttctaattctaatttgcaa

SEQ ID NO: 1046216 - DNA, 22 bp, Artificial Sequence
  chemically synthesized
gaattttaaatgccagttgcaa

SEQ ID NO: 1046217 - DNA, 22 bp, Artificial Sequence
  chemically synthesized
ctaattctaatttgcaactggc

SEQ ID NO: 1046218 - DNA, 22 bp, Artificial Sequence
  chemically synthesized
taattctaatttgcaactggca

SEQ ID NO: 1046219 - DNA, 22 bp, Artificial Sequence
  chemically synthesized
attctaatttgcaactggcatt

SEQ ID NO: 1046220 - DNA, 22 bp, Artificial Sequence
  chemically synthesized
taatttgcaactggcatttaaa

SEQ ID NO: 1046221 - DNA, 22 bp, Artificial Sequence
  chemically synthesized
atttgcaactggcatttaaaat

SEQ ID NO: 1046222 - DNA, 22 bp, Artificial Sequence
  chemically synthesized
caggaaaattagaattttaaat

SEQ ID NO: 1046223 - DNA, 22 bp, Artificial Sequence
  chemically synthesized
ccaggaaaattagaattttaaa

SEQ ID NO: 1046224 - DNA, 22 bp, Artificial Sequence
  chemically synthesized
gcaactggcatttaaaattcta

SEQ ID NO: 1046225 - DNA, 22 bp, Artificial Sequence
  chemically synthesized
caactggcatttaaaattctaa

SEQ ID NO: 1046226 - DNA, 22 bp, Artificial Sequence
  chemically synthesized
gatttccaggaaaattagaatt

SEQ ID NO: 1046227 - DNA, 22 bp, Artificial Sequence
  chemically synthesized
gcatttaaaattctaattttcc

SEQ ID NO: 1046228 - DNA, 22 bp, Artificial Sequence
  chemically synthesized
aaaattctaattttcctggaaa

SEQ ID NO: 1046229 - DNA, 22 bp, Artificial Sequence
  chemically synthesized
aaattctaattttcctggaaat

SEQ ID NO: 1046230 - DNA, 22 bp, Artificial Sequence
  chemically synthesized
taattttcctggaaatctagat

SEQ ID NO: 1046231 - DNA, 22 bp, Artificial Sequence
  chemically synthesized
acccaatcccatatctagattt

SEQ ID NO: 1046232 - DNA, 22 bp, Artificial Sequence
  chemically synthesized
attttcctggaaatctagatat

SEQ ID NO: 1046233 - DNA, 22 bp, Artificial Sequence
  chemically synthesized
tcctggaaatctagatatggga

SEQ ID NO: 1046234 - DNA, 22 bp, Artificial Sequence
  chemically synthesized
cctggaaatctagatatgggat

SEQ ID NO: 1046235 - DNA, 22 bp, Artificial Sequence
  chemically synthesized
ctggaaatctagatatgggatt

SEQ ID NO: 1046236 - DNA, 22 bp, Artificial Sequence
  chemically synthesized
gaaatctagatatgggattggg

SEQ ID NO: 1046237 - DNA, 22 bp, Artificial Sequence
  chemically synthesized
gatatgggattgggtgaggggg

SEQ ID NO: 1046238 - DNA, 22 bp, Artificial Sequence
  chemically synthesized
ggaataaaacagatatgagtcc

SEQ ID NO: 1046239 - DNA, 22 bp, Artificial Sequence
  chemically synthesized
ggtgagggggactcatatctgt

SEQ ID NO: 1046240 - DNA, 22 bp, Artificial Sequence
  chemically synthesized
tgttaggaataaaacagatatg

SEQ ID NO: 1046241 - DNA, 22 bp, Artificial Sequence
  chemically synthesized
cctgtgttaggaataaaacaga

SEQ ID NO: 1046242 - DNA, 22 bp, Artificial Sequence
  chemically synthesized
atatctgttttattcctaacac

SEQ ID NO: 1046243 - DNA, 22 bp, Artificial Sequence
  chemically synthesized
ttttattcctaacacaggcaac

SEQ ID NO: 1046244 - DNA, 22 bp, Artificial Sequence
  chemically synthesized
tagatacaggaaagttgcctgt

SEQ ID NO: 1046245 - DNA, 22 bp, Artificial Sequence
  chemically synthesized
tattcctaacacaggcaacttt

SEQ ID NO: 1046246 - DNA, 22 bp, Artificial Sequence
  chemically synthesized
attcctaacacaggcaactttc

SEQ ID NO: 1046247 - DNA, 22 bp, Artificial Sequence
  chemically synthesized
ctatagatacaggaaagttgcc

SEQ ID NO: 1046248 - DNA, 22 bp, Artificial Sequence
  chemically synthesized
ttcctaacacaggcaactttcc

SEQ ID NO: 1046249 - DNA, 22 bp, Artificial Sequence
  chemically synthesized
cctatagatacaggaaagttgc

SEQ ID NO: 1046250 - DNA, 22 bp, Artificial Sequence
  chemically synthesized
tcctatagatacaggaaagttg

SEQ ID NO: 1046251 - DNA, 22 bp, Artificial Sequence
  chemically synthesized
ctaacacaggcaactttcctgt

SEQ ID NO: 1046252 - DNA, 22 bp, Artificial Sequence
  chemically synthesized
acacaggcaactttcctgtatc

SEQ ID NO: 1046253 - DNA, 22 bp, Artificial Sequence
  chemically synthesized
agtgaactttcctatagataca

SEQ ID NO: 1046254 - DNA, 22 bp, Artificial Sequence
  chemically synthesized
tatctcagtgaactttcctata

SEQ ID NO: 1046255 - DNA, 22 bp, Artificial Sequence
  chemically synthesized
tcctgtatctataggaaagttc

SEQ ID NO: 1046256 - DNA, 22 bp, Artificial Sequence
  chemically synthesized
ttgtatctcagtgaactttcct

SEQ ID NO: 1046257 - DNA, 22 bp, Artificial Sequence
  chemically synthesized
cctgtatctataggaaagttca

SEQ ID NO: 1046258 - DNA, 22 bp, Artificial Sequence
  chemically synthesized
ctgtatctataggaaagttcac

SEQ ID NO: 1046259 - DNA, 22 bp, Artificial Sequence
  chemically synthesized
tatctataggaaagttcactga

SEQ ID NO: 1046260 - DNA, 22 bp, Artificial Sequence
  chemically synthesized
gtatctgttgtatctcagtgaa

SEQ ID NO: 1046261 - DNA, 22 bp, Artificial Sequence
  chemically synthesized
cgtatctgttgtatctcagtga

SEQ ID NO: 1046262 - DNA, 22 bp, Artificial Sequence
  chemically synthesized
taggaaagttcactgagataca

SEQ ID NO: 1046263 - DNA, 22 bp, Artificial Sequence
  chemically synthesized
cttcgtatctgttgtatctcag

SEQ ID NO: 1046264 - DNA, 22 bp, Artificial Sequence
  chemically synthesized
actacttcgtatctgttgtatc

SEQ ID NO: 1046265 - DNA, 22 bp, Artificial Sequence
  chemically synthesized
actgagatacaacagatacgaa

SEQ ID NO: 1046266 - DNA, 22 bp, Artificial Sequence
  chemically synthesized
agatacaacagatacgaagtag

SEQ ID NO: 1046267 - DNA, 22 bp, Artificial Sequence
  chemically synthesized
cataccagcctaactacttcgt

SEQ ID NO: 1046268 - DNA, 22 bp, Artificial Sequence
  chemically synthesized
atacaaagttacataccagcct

SEQ ID NO: 1046269 - DNA, 22 bp, Artificial Sequence
  chemically synthesized
aatacaaagttacataccagcc

SEQ ID NO: 1046270 - DNA, 22 bp, Artificial Sequence
  chemically synthesized
ggctggtatgtaactttgtatt

SEQ ID NO: 1046271 - DNA, 22 bp, Artificial Sequence
  chemically synthesized
gaggagaagagggcttaataca

SEQ ID NO: 1046272 - DNA, 22 bp, Artificial Sequence
  chemically synthesized
gtatgtaactttgtattaagcc

SEQ ID NO: 1046273 - DNA, 22 bp, Artificial Sequence
  chemically synthesized
ggaggagaagagggcttaatac

SEQ ID NO: 1046274 - DNA, 22 bp, Artificial Sequence
  chemically synthesized
gaatttggaggagaagagggct

SEQ ID NO: 1046275 - DNA, 22 bp, Artificial Sequence
  chemically synthesized
tgtattaagccctcttctcctc

SEQ ID NO: 1046276 - DNA, 22 bp, Artificial Sequence
  chemically synthesized
gtattaagccctcttctcctcc

SEQ ID NO: 1046277 - DNA, 22 bp, Artificial Sequence
  chemically synthesized
tattaagccctcttctcctcca

SEQ ID NO: 1046278 - DNA, 22 bp, Artificial Sequence
  chemically synthesized
atgtctagaatttggaggagaa

SEQ ID NO: 1046279 - DNA, 22 bp, Artificial Sequence
  chemically synthesized
agccctcttctcctccaaattc

SEQ ID NO: 1046280 - DNA, 22 bp, Artificial Sequence
  chemically synthesized
ttctcctccaaattctagacat

SEQ ID NO: 1046281 - DNA, 22 bp, Artificial Sequence
  chemically synthesized
ctcctccaaattctagacatta

SEQ ID NO: 1046282 - DNA, 22 bp, Artificial Sequence
  chemically synthesized
tcctccaaattctagacattag

SEQ ID NO: 1046283 - DNA, 22 bp, Artificial Sequence
  chemically synthesized
ctccaaattctagacattagct

SEQ ID NO: 1046284 - DNA, 22 bp, Artificial Sequence
  chemically synthesized
gcaacaaaaacaggagctaatg

SEQ ID NO: 1046285 - DNA, 22 bp, Artificial Sequence
  chemically synthesized
caaattctagacattagctcct

SEQ ID NO: 1046286 - DNA, 22 bp, Artificial Sequence
  chemically synthesized
tagacattagctcctgtttttg

SEQ ID NO: 1046287 - DNA, 22 bp, Artificial Sequence
  chemically synthesized
gacattagctcctgtttttgtt

SEQ ID NO: 1046288 - DNA, 22 bp, Artificial Sequence
  chemically synthesized
gcaagagactagcaacaaaaac

SEQ ID NO: 1046289 - DNA, 22 bp, Artificial Sequence
  chemically synthesized
agcaagagactagcaacaaaaa

SEQ ID NO: 1046290 - DNA, 22 bp, Artificial Sequence
  chemically synthesized
acttagcaagagactagcaaca

SEQ ID NO: 1046291 - DNA, 22 bp, Artificial Sequence
  chemically synthesized
gctcctgtttttgttgctagtc

SEQ ID NO: 1046292 - DNA, 22 bp, Artificial Sequence
  chemically synthesized
aacttagcaagagactagcaac

SEQ ID NO: 1046293 - DNA, 22 bp, Artificial Sequence
  chemically synthesized
ctgtttttgttgctagtctctt

SEQ ID NO: 1046294 - DNA, 22 bp, Artificial Sequence
  chemically synthesized
tttttgttgctagtctcttgct

SEQ ID NO: 1046295 - DNA, 22 bp, Artificial Sequence
  chemically synthesized
gcagcttaacttagcaagagac

SEQ ID NO: 1046296 - DNA, 22 bp, Artificial Sequence
  chemically synthesized
ttgttgctagtctcttgctaag

SEQ ID NO: 1046297 - DNA, 22 bp, Artificial Sequence
  chemically synthesized
tgttgctagtctcttgctaagt

SEQ ID NO: 1046298 - DNA, 22 bp, Artificial Sequence
  chemically synthesized
attagcagcttaacttagcaag

SEQ ID NO: 1046299 - DNA, 22 bp, Artificial Sequence
  chemically synthesized
gttgctagtctcttgctaagtt

SEQ ID NO: 1046300 - DNA, 22 bp, Artificial Sequence
  chemically synthesized
cattagcagcttaacttagcaa

SEQ ID NO: 1046301 - DNA, 22 bp, Artificial Sequence
  chemically synthesized
ttgctagtctcttgctaagtta

SEQ ID NO: 1046302 - DNA, 22 bp, Artificial Sequence
  chemically synthesized
ctagtctcttgctaagttaagc

SEQ ID NO: 1046303 - DNA, 22 bp, Artificial Sequence
  chemically synthesized
gtctcttgctaagttaagctgc

SEQ ID NO: 1046304 - DNA, 22 bp, Artificial Sequence
  chemically synthesized
ttgctaagttaagctgctaatg

SEQ ID NO: 1046305 - DNA, 22 bp, Artificial Sequence
  chemically synthesized
atatagcagcttcattagcagc

SEQ ID NO: 1046306 - DNA, 22 bp, Artificial Sequence
  chemically synthesized
gctaagttaagctgctaatgaa

SEQ ID NO: 1046307 - DNA, 22 bp, Artificial Sequence
  chemically synthesized
ctaagttaagctgctaatgaag

SEQ ID NO: 1046308 - DNA, 22 bp, Artificial Sequence
  chemically synthesized
ctcatatagcagcttcattagc

SEQ ID NO: 1046309 - DNA, 22 bp, Artificial Sequence
  chemically synthesized
tgctcatatagcagcttcatta

SEQ ID NO: 1046310 - DNA, 22 bp, Artificial Sequence
  chemically synthesized
agttaagctgctaatgaagctg

SEQ ID NO: 1046311 - DNA, 22 bp, Artificial Sequence
  chemically synthesized
agctgctaatgaagctgctata

SEQ ID NO: 1046312 - DNA, 22 bp, Artificial Sequence
  chemically synthesized
ctaatgaagctgctatatgagc

SEQ ID NO: 1046313 - DNA, 22 bp, Artificial Sequence
  chemically synthesized
cgcagtcagttctgctcatata

SEQ ID NO: 1046314 - DNA, 22 bp, Artificial Sequence
  chemically synthesized
atgaagctgctatatgagcaga

SEQ ID NO: 1046315 - DNA, 22 bp, Artificial Sequence
  chemically synthesized
ctatatgagcagaactgactgc

SEQ ID NO: 1046316 - DNA, 22 bp, Artificial Sequence
  chemically synthesized
aaatataaattccgcagtcagt

SEQ ID NO: 1046317 - DNA, 22 bp, Artificial Sequence
  chemically synthesized
aaaatataaattccgcagtcag

SEQ ID NO: 1046318 - DNA, 22 bp, Artificial Sequence
  chemically synthesized
tatgagcagaactgactgcgga

SEQ ID NO: 1046319 - DNA, 22 bp, Artificial Sequence
  chemically synthesized
taaaatataaattccgcagtca

SEQ ID NO: 1046320 - DNA, 22 bp, Artificial Sequence
  chemically synthesized
ttaaaatataaattccgcagtc

SEQ ID NO: 1046321 - DNA, 22 bp, Artificial Sequence
  chemically synthesized
tttaaaatataaattccgcagt

SEQ ID NO: 1046322 - DNA, 22 bp, Artificial Sequence
  chemically synthesized
tttttaaaatataaattccgca

SEQ ID NO: 1046323 - DNA, 22 bp, Artificial Sequence
  chemically synthesized
gagttctttttaaaatataaat

SEQ ID NO: 1046324 - DNA, 22 bp, Artificial Sequence
  chemically synthesized
tggagttctttttaaaatataa

SEQ ID NO: 1046325 - DNA, 22 bp, Artificial Sequence
  chemically synthesized
actgcggaatttatattttaaa

SEQ ID NO: 1046326 - DNA, 22 bp, Artificial Sequence
  chemically synthesized
cggaatttatattttaaaaaga

SEQ ID NO: 1046327 - DNA, 22 bp, Artificial Sequence
  chemically synthesized
atattttaaaaagaactccaga

SEQ ID NO: 1046328 - DNA, 22 bp, Artificial Sequence
  chemically synthesized
tattttaaaaagaactccagaa

SEQ ID NO: 1046329 - DNA, 22 bp, Artificial Sequence
  chemically synthesized
tatatcaggacattctggagtt

SEQ ID NO: 1046330 - DNA, 22 bp, Artificial Sequence
  chemically synthesized
atatatcaggacattctggagt

SEQ ID NO: 1046331 - DNA, 22 bp, Artificial Sequence
  chemically synthesized
taaaaagaactccagaatgtcc

SEQ ID NO: 1046332 - DNA, 22 bp, Artificial Sequence
  chemically synthesized
ccttatatatcaggacattctg

SEQ ID NO: 1046333 - DNA, 22 bp, Artificial Sequence
  chemically synthesized
aaaaagaactccagaatgtcct

SEQ ID NO: 1046334 - DNA, 22 bp, Artificial Sequence
  chemically synthesized
aaaagaactccagaatgtcctg

SEQ ID NO: 1046335 - DNA, 22 bp, Artificial Sequence
  chemically synthesized
gtgctcccttatatatcaggac

SEQ ID NO: 1046336 - DNA, 22 bp, Artificial Sequence
  chemically synthesized
cagaatgtcctgatatataagg

SEQ ID NO: 1046337 - DNA, 22 bp, Artificial Sequence
  chemically synthesized
atatataagggagcactagcct

SEQ ID NO: 1046338 - DNA, 22 bp, Artificial Sequence
  chemically synthesized
gcctcttctcttgcacctacac

SEQ ID NO: 1046339 - DNA, 22 bp, Artificial Sequence
  chemically synthesized
gatcccagtcagaaaagtgtag

SEQ ID NO: 1046340 - DNA, 22 bp, Artificial Sequence
  chemically synthesized
ttctcttgcacctacacttttc

SEQ ID NO: 1046341 - DNA, 22 bp, Artificial Sequence
  chemically synthesized
ggatcccagtcagaaaagtgta

SEQ ID NO: 1046342 - DNA, 22 bp, Artificial Sequence
  chemically synthesized
ctcttgcacctacacttttctg

SEQ ID NO: 1046343 - DNA, 22 bp, Artificial Sequence
  chemically synthesized
tcttgcacctacacttttctga

SEQ ID NO: 1046344 - DNA, 22 bp, Artificial Sequence
  chemically synthesized
ttgcacctacacttttctgact

SEQ ID NO: 1046345 - DNA, 22 bp, Artificial Sequence
  chemically synthesized
gcacttggatcccagtcagaaa

SEQ ID NO: 1046346 - DNA, 22 bp, Artificial Sequence
  chemically synthesized
gcacctacacttttctgactgg

SEQ ID NO: 1046347 - DNA, 22 bp, Artificial Sequence
  chemically synthesized
cacctacacttttctgactggg

SEQ ID NO: 1046348 - DNA, 22 bp, Artificial Sequence
  chemically synthesized
cacttttctgactgggatccaa

SEQ ID NO: 1046349 - DNA, 22 bp, Artificial Sequence
  chemically synthesized
atcatgtctagcacttggatcc

SEQ ID NO: 1046350 - DNA, 22 bp, Artificial Sequence
  chemically synthesized
tcatcatgtctagcacttggat

SEQ ID NO: 1046351 - DNA, 22 bp, Artificial Sequence
  chemically synthesized
ttctgactgggatccaagtgct

SEQ ID NO: 1046352 - DNA, 22 bp, Artificial Sequence
  chemically synthesized
tctgactgggatccaagtgcta

SEQ ID NO: 1046353 - DNA, 22 bp, Artificial Sequence
  chemically synthesized
ctgactgggatccaagtgctag

SEQ ID NO: 1046354 - DNA, 22 bp, Artificial Sequence
  chemically synthesized
tgactgggatccaagtgctaga

SEQ ID NO: 1046355 - DNA, 22 bp, Artificial Sequence
  chemically synthesized
actgggatccaagtgctagaca

SEQ ID NO: 1046356 - DNA, 22 bp, Artificial Sequence
  chemically synthesized
gaaattctcatcatgtctagca

SEQ ID NO: 1046357 - DNA, 22 bp, Artificial Sequence
  chemically synthesized
ggatccaagtgctagacatgat

SEQ ID NO: 1046358 - DNA, 22 bp, Artificial Sequence
  chemically synthesized
gagctggaaattctcatcatgt

SEQ ID NO: 1046359 - DNA, 22 bp, Artificial Sequence
  chemically synthesized
tggagctggaaattctcatcat

SEQ ID NO: 1046360 - DNA, 22 bp, Artificial Sequence
  chemically synthesized
gacatgatgagaatttccagct

SEQ ID NO: 1046361 - DNA, 22 bp, Artificial Sequence
  chemically synthesized
caaaaggactctggagctggaa

SEQ ID NO: 1046362 - DNA, 22 bp, Artificial Sequence
  chemically synthesized
ggaaactccaaaaggactctgg

SEQ ID NO: 1046363 - DNA, 22 bp, Artificial Sequence
  chemically synthesized
ctgggaaactccaaaaggactc

SEQ ID NO: 1046364 - DNA, 22 bp, Artificial Sequence
  chemically synthesized
ccagctccagagtccttttgga

SEQ ID NO: 1046365 - DNA, 22 bp, Artificial Sequence
  chemically synthesized
cagctccagagtccttttggag

SEQ ID NO: 1046366 - DNA, 22 bp, Artificial Sequence
  chemically synthesized
cagagtccttttggagtttccc

SEQ ID NO: 1046367 - DNA, 22 bp, Artificial Sequence
  chemically synthesized
ttggagtttcccagtaatacat

SEQ ID NO: 1046368 - DNA, 22 bp, Artificial Sequence
  chemically synthesized
tggagtttcccagtaatacatc

SEQ ID NO: 1046369 - DNA, 22 bp, Artificial Sequence
  chemically synthesized
ggagtttcccagtaatacatct

SEQ ID NO: 1046370 - DNA, 22 bp, Artificial Sequence
  chemically synthesized
gagtttcccagtaatacatctt

SEQ ID NO: 1046371 - DNA, 22 bp, Artificial Sequence
  chemically synthesized
taaagaatagggaaagatgtat

SEQ ID NO: 1046372 - DNA, 22 bp, Artificial Sequence
  chemically synthesized
ataaagaatagggaaagatgta

SEQ ID NO: 1046373 - DNA, 22 bp, Artificial Sequence
  chemically synthesized
ttataaagaatagggaaagatg

SEQ ID NO: 1046374 - DNA, 22 bp, Artificial Sequence
  chemically synthesized
cccagtaatacatctttcccta

SEQ ID NO: 1046375 - DNA, 22 bp, Artificial Sequence
  chemically synthesized
ccagtaatacatctttccctat

SEQ ID NO: 1046376 - DNA, 22 bp, Artificial Sequence
  chemically synthesized
ctcttataaagaatagggaaag

SEQ ID NO: 1046377 - DNA, 22 bp, Artificial Sequence
  chemically synthesized
gctcttataaagaatagggaaa

SEQ ID NO: 1046378 - DNA, 22 bp, Artificial Sequence
  chemically synthesized
tgctcttataaagaatagggaa

SEQ ID NO: 1046379 - DNA, 22 bp, Artificial Sequence
  chemically synthesized
ttgctcttataaagaataggga

SEQ ID NO: 1046380 - DNA, 22 bp, Artificial Sequence
  chemically synthesized
tttgctcttataaagaataggg

SEQ ID NO: 1046381 - DNA, 22 bp, Artificial Sequence
  chemically synthesized
ttttttgctcttataaagaata

SEQ ID NO: 1046382 - DNA, 22 bp, Artificial Sequence
  chemically synthesized
attttttgctcttataaagaat

SEQ ID NO: 1046383 - DNA, 22 bp, Artificial Sequence
  chemically synthesized
tccctattctttataagagcaa

SEQ ID NO: 1046384 - DNA, 22 bp, Artificial Sequence
  chemically synthesized
ccctattctttataagagcaaa

SEQ ID NO: 1046385 - DNA, 22 bp, Artificial Sequence
  chemically synthesized
cctattctttataagagcaaaa

SEQ ID NO: 1046386 - DNA, 22 bp, Artificial Sequence
  chemically synthesized
ttctttataagagcaaaaaata

SEQ ID NO: 1046387 - DNA, 22 bp, Artificial Sequence
  chemically synthesized
ccaagtagtatttattttttgc

SEQ ID NO: 1046388 - DNA, 22 bp, Artificial Sequence
  chemically synthesized
tttataagagcaaaaaataaat

SEQ ID NO: 1046389 - DNA, 22 bp, Artificial Sequence
  chemically synthesized
cctgccaagtagtatttatttt

SEQ ID NO: 1046390 - DNA, 22 bp, Artificial Sequence
  chemically synthesized
tataagagcaaaaaataaatac

SEQ ID NO: 1046391 - DNA, 22 bp, Artificial Sequence
  chemically synthesized
gcctgccaagtagtatttattt

SEQ ID NO: 1046392 - DNA, 22 bp, Artificial Sequence
  chemically synthesized
ataagagcaaaaaataaatact

SEQ ID NO: 1046393 - DNA, 22 bp, Artificial Sequence
  chemically synthesized
taagagcaaaaaataaatacta

SEQ ID NO: 1046394 - DNA, 22 bp, Artificial Sequence
  chemically synthesized
aatttgcctgccaagtagtatt

SEQ ID NO: 1046395 - DNA, 22 bp, Artificial Sequence
  chemically synthesized
tgaatttgcctgccaagtagta

SEQ ID NO: 1046396 - DNA, 22 bp, Artificial Sequence
  chemically synthesized
ctgaatttgcctgccaagtagt

SEQ ID NO: 1046397 - DNA, 22 bp, Artificial Sequence
  chemically synthesized
tctgaatttgcctgccaagtag

SEQ ID NO: 1046398 - DNA, 22 bp, Artificial Sequence
  chemically synthesized
cttggcaggcaaattcagaaag

SEQ ID NO: 1046399 - DNA, 22 bp, Artificial Sequence
  chemically synthesized
ggcaggcaaattcagaaagatg

SEQ ID NO: 1046400 - DNA, 22 bp, Artificial Sequence
  chemically synthesized
gcaggcaaattcagaaagatgg

SEQ ID NO: 1046401 - DNA, 22 bp, Artificial Sequence
  chemically synthesized
agaaagatggatgacctgtgct

SEQ ID NO: 1046402 - DNA, 22 bp, Artificial Sequence
  chemically synthesized
tagtgtagacagaagagagcac

SEQ ID NO: 1046403 - DNA, 22 bp, Artificial Sequence
  chemically synthesized
cctatagtgtagacagaagaga

SEQ ID NO: 1046404 - DNA, 22 bp, Artificial Sequence
  chemically synthesized
ctgcctatagtgtagacagaag

SEQ ID NO: 1046405 - DNA, 22 bp, Artificial Sequence
  chemically synthesized
gctgcctatagtgtagacagaa

SEQ ID NO: 1046406 - DNA, 22 bp, Artificial Sequence
  chemically synthesized
tgctgcctatagtgtagacaga

SEQ ID NO: 1046407 - DNA, 22 bp, Artificial Sequence
  chemically synthesized
tgctctcttctgtctacactat

SEQ ID NO: 1046408 - DNA, 22 bp, Artificial Sequence
  chemically synthesized
tcttctgtctacactataggca

SEQ ID NO: 1046409 - DNA, 22 bp, Artificial Sequence
  chemically synthesized
caagaattttgctgcctatagt

SEQ ID NO: 1046410 - DNA, 22 bp, Artificial Sequence
  chemically synthesized
ttctgtctacactataggcagc

SEQ ID NO: 1046411 - DNA, 22 bp, Artificial Sequence
  chemically synthesized
ctgtctacactataggcagcaa

SEQ ID NO: 1046412 - DNA, 22 bp, Artificial Sequence
  chemically synthesized
tgtctacactataggcagcaaa

SEQ ID NO: 1046413 - DNA, 22 bp, Artificial Sequence
  chemically synthesized
aattacaagaattttgctgcct

SEQ ID NO: 1046414 - DNA, 22 bp, Artificial Sequence
  chemically synthesized
caattacaagaattttgctgcc

SEQ ID NO: 1046415 - DNA, 22 bp, Artificial Sequence
  chemically synthesized
tctacactataggcagcaaaat

SEQ ID NO: 1046416 - DNA, 22 bp, Artificial Sequence
  chemically synthesized
cactataggcagcaaaattctt

SEQ ID NO: 1046417 - DNA, 22 bp, Artificial Sequence
  chemically synthesized
taggcagcaaaattcttgtaat

SEQ ID NO: 1046418 - DNA, 22 bp, Artificial Sequence
  chemically synthesized
ggagaataatttcaattacaag

SEQ ID NO: 1046419 - DNA, 22 bp, Artificial Sequence
  chemically synthesized
ttgggagaataatttcaattac

SEQ ID NO: 1046420 - DNA, 22 bp, Artificial Sequence
  chemically synthesized
ttgtaattgaaattattctccc

SEQ ID NO: 1046421 - DNA, 22 bp, Artificial Sequence
  chemically synthesized
gacaaagttattgggagaataa

SEQ ID NO: 1046422 - DNA, 22 bp, Artificial Sequence
  chemically synthesized
gtaattgaaattattctcccaa

SEQ ID NO: 1046423 - DNA, 22 bp, Artificial Sequence
  chemically synthesized
tagacaaagttattgggagaat

SEQ ID NO: 1046424 - DNA, 22 bp, Artificial Sequence
  chemically synthesized
taattgaaattattctcccaat

SEQ ID NO: 1046425 - DNA, 22 bp, Artificial Sequence
  chemically synthesized
aaattattctcccaataacttt

SEQ ID NO: 1046426 - DNA, 22 bp, Artificial Sequence
  chemically synthesized
atcaattctagacaaagttatt

SEQ ID NO: 1046427 - DNA, 22 bp, Artificial Sequence
  chemically synthesized
ttctcccaataactttgtctag

SEQ ID NO: 1046428 - DNA, 22 bp, Artificial Sequence
  chemically synthesized
tcccaataactttgtctagaat

SEQ ID NO: 1046429 - DNA, 22 bp, Artificial Sequence
  chemically synthesized
ccaataactttgtctagaattg

SEQ ID NO: 1046430 - DNA, 22 bp, Artificial Sequence
  chemically synthesized
tgtctagaattgatcaactgcc

SEQ ID NO: 1046431 - DNA, 22 bp, Artificial Sequence
  chemically synthesized
gtctagaattgatcaactgcca

SEQ ID NO: 1046432 - DNA, 22 bp, Artificial Sequence
  chemically synthesized
tctagaattgatcaactgccac

SEQ ID NO: 1046433 - DNA, 22 bp, Artificial Sequence
  chemically synthesized
atcaacaggcaggtggcagttg

SEQ ID NO: 1046434 - DNA, 22 bp, Artificial Sequence
  chemically synthesized
gaattgatcaactgccacctgc

SEQ ID NO: 1046435 - DNA, 22 bp, Artificial Sequence
  chemically synthesized
atcaactgccacctgcctgttg

SEQ ID NO: 1046436 - DNA, 22 bp, Artificial Sequence
  chemically synthesized
aggtgacctcatcaacaggcag

SEQ ID NO: 1046437 - DNA, 22 bp, Artificial Sequence
  chemically synthesized
ccacctgcctgttgatgaggtc

SEQ ID NO: 1046438 - DNA, 22 bp, Artificial Sequence
  chemically synthesized
aaaccctcaggtgacctcatca

SEQ ID NO: 1046439 - DNA, 22 bp, Artificial Sequence
  chemically synthesized
ccactgaaaccctcaggtgacc

SEQ ID NO: 1046440 - DNA, 22 bp, Artificial Sequence
  chemically synthesized
cctgttgatgaggtcacctgag

SEQ ID NO: 1046441 - DNA, 22 bp, Artificial Sequence
  chemically synthesized
ttgatgaggtcacctgagggtt

SEQ ID NO: 1046442 - DNA, 22 bp, Artificial Sequence
  chemically synthesized
atgaggtcacctgagggtttca

SEQ ID NO: 1046443 - DNA, 22 bp, Artificial Sequence
  chemically synthesized
cccagagaccctaccactgaaa

SEQ ID NO: 1046444 - DNA, 22 bp, Artificial Sequence
  chemically synthesized
ccccagagaccctaccactgaa

SEQ ID NO: 1046445 - DNA, 22 bp, Artificial Sequence
  chemically synthesized
tacttccccagagaccctacca

SEQ ID NO: 1046446 - DNA, 22 bp, Artificial Sequence
  chemically synthesized
gtacttccccagagaccctacc

SEQ ID NO: 1046447 - DNA, 22 bp, Artificial Sequence
  chemically synthesized
agggtttcagtggtagggtctc

SEQ ID NO: 1046448 - DNA, 22 bp, Artificial Sequence
  chemically synthesized
tcgtttgtacttccccagagac

SEQ ID NO: 1046449 - DNA, 22 bp, Artificial Sequence
  chemically synthesized
atcgtttgtacttccccagaga

SEQ ID NO: 1046450 - DNA, 22 bp, Artificial Sequence
  chemically synthesized
cagtggtagggtctctggggaa

SEQ ID NO: 1046451 - DNA, 22 bp, Artificial Sequence
  chemically synthesized
agtggtagggtctctggggaag

SEQ ID NO: 1046452 - DNA, 22 bp, Artificial Sequence
  chemically synthesized
gcatgcttatcgtttgtacttc

SEQ ID NO: 1046453 - DNA, 22 bp, Artificial Sequence
  chemically synthesized
cgttagcatgcttatcgtttgt

SEQ ID NO: 1046454 - DNA, 22 bp, Artificial Sequence
  chemically synthesized
tggggaagtacaaacgataagc

SEQ ID NO: 1046455 - DNA, 22 bp, Artificial Sequence
  chemically synthesized
gggaagtacaaacgataagcat

SEQ ID NO: 1046456 - DNA, 22 bp, Artificial Sequence
  chemically synthesized
tgcagtaataaatggctacgtt

SEQ ID NO: 1046457 - DNA, 22 bp, Artificial Sequence
  chemically synthesized
acgtagccatttattactgcac

SEQ ID NO: 1046458 - DNA, 22 bp, Artificial Sequence
  chemically synthesized
tcataaaaggctgtgcagtaat

SEQ ID NO: 1046459 - DNA, 22 bp, Artificial Sequence
  chemically synthesized
attactgcacagccttttatga

SEQ ID NO: 1046460 - DNA, 22 bp, Artificial Sequence
  chemically synthesized
ttactgcacagccttttatgac

SEQ ID NO: 1046461 - DNA, 22 bp, Artificial Sequence
  chemically synthesized
ctgcacagccttttatgacaac

SEQ ID NO: 1046462 - DNA, 22 bp, Artificial Sequence
  chemically synthesized
cacagccttttatgacaacacc

SEQ ID NO: 1046463 - DNA, 22 bp, Artificial Sequence
  chemically synthesized
caaaaataagtatggtgttgtc

SEQ ID NO: 1046464 - DNA, 22 bp, Artificial Sequence
  chemically synthesized
ctgcaaaaataagtatggtgtt

SEQ ID NO: 1046465 - DNA, 22 bp, Artificial Sequence
  chemically synthesized
ttatgacaacaccatacttatt

SEQ ID NO: 1046466 - DNA, 22 bp, Artificial Sequence
  chemically synthesized
cattactgcaaaaataagtatg

SEQ ID NO: 1046467 - DNA, 22 bp, Artificial Sequence
  chemically synthesized
tatgacaacaccatacttattt

SEQ ID NO: 1046468 - DNA, 22 bp, Artificial Sequence
  chemically synthesized
atgacaacaccatacttatttt

SEQ ID NO: 1046469 - DNA, 22 bp, Artificial Sequence
  chemically synthesized
tgacaacaccatacttattttt

SEQ ID NO: 1046470 - DNA, 22 bp, Artificial Sequence
  chemically synthesized
atttttgcagtaatgtaataca

SEQ ID NO: 1046471 - DNA, 22 bp, Artificial Sequence
  chemically synthesized
tttttgcagtaatgtaatacat

SEQ ID NO: 1046472 - DNA, 22 bp, Artificial Sequence
  chemically synthesized
ttgcagtaatgtaatacattgg

SEQ ID NO: 1046473 - DNA, 22 bp, Artificial Sequence
  chemically synthesized
tgcagtaatgtaatacattgga

SEQ ID NO: 1046474 - DNA, 22 bp, Artificial Sequence
  chemically synthesized
gtatccccaaagtccaatgtat

SEQ ID NO: 1046475 - DNA, 22 bp, Artificial Sequence
  chemically synthesized
gcagtaatgtaatacattggac

SEQ ID NO: 1046476 - DNA, 22 bp, Artificial Sequence
  chemically synthesized
cagtaatgtaatacattggact

SEQ ID NO: 1046477 - DNA, 22 bp, Artificial Sequence
  chemically synthesized
agtctagtatccccaaagtcca

SEQ ID NO: 1046478 - DNA, 22 bp, Artificial Sequence
  chemically synthesized
tgtggggttcagtctagtatcc

SEQ ID NO: 1046479 - DNA, 22 bp, Artificial Sequence
  chemically synthesized
gtgtggggttcagtctagtatc

SEQ ID NO: 1046480 - DNA, 22 bp, Artificial Sequence
  chemically synthesized
tgtgtggggttcagtctagtat

SEQ ID NO: 1046481 - DNA, 22 bp, Artificial Sequence
  chemically synthesized
gactttggggatactagactga

SEQ ID NO: 1046482 - DNA, 22 bp, Artificial Sequence
  chemically synthesized
tttgtgtggggttcagtctagt

SEQ ID NO: 1046483 - DNA, 22 bp, Artificial Sequence
  chemically synthesized
ctctttgtgtggggttcagtct

SEQ ID NO: 1046484 - DNA, 22 bp, Artificial Sequence
  chemically synthesized
tggggatactagactgaacccc

SEQ ID NO: 1046485 - DNA, 22 bp, Artificial Sequence
  chemically synthesized
ggggatactagactgaacccca

SEQ ID NO: 1046486 - DNA, 22 bp, Artificial Sequence
  chemically synthesized
ctcctctttgtgtggggttcag

SEQ ID NO: 1046487 - DNA, 22 bp, Artificial Sequence
  chemically synthesized
gggatactagactgaaccccac

SEQ ID NO: 1046488 - DNA, 22 bp, Artificial Sequence
  chemically synthesized
actcctctttgtgtggggttca

SEQ ID NO: 1046489 - DNA, 22 bp, Artificial Sequence
  chemically synthesized
tactcctctttgtgtggggttc

SEQ ID NO: 1046490 - DNA, 22 bp, Artificial Sequence
  chemically synthesized
taaattttactcctctttgtgt

SEQ ID NO: 1046491 - DNA, 22 bp, Artificial Sequence
  chemically synthesized
gactgaaccccacacaaagagg

SEQ ID NO: 1046492 - DNA, 22 bp, Artificial Sequence
  chemically synthesized
gtaaattttactcctctttgtg

SEQ ID NO: 1046493 - DNA, 22 bp, Artificial Sequence
  chemically synthesized
aaccccacacaaagaggagtaa

SEQ ID NO: 1046494 - DNA, 22 bp, Artificial Sequence
  chemically synthesized
aaaacaaaacataaagtgacca

SEQ ID NO: 1046495 - DNA, 22 bp, Artificial Sequence
  chemically synthesized
acaagctggtcactttatgttt

SEQ ID NO: 1046496 - DNA, 22 bp, Artificial Sequence
  chemically synthesized
caagctggtcactttatgtttt

SEQ ID NO: 1046497 - DNA, 22 bp, Artificial Sequence
  chemically synthesized
gtcactttatgttttgttttta

SEQ ID NO: 1046498 - DNA, 22 bp, Artificial Sequence
  chemically synthesized
ggtcagagaaattaaaaacaaa

SEQ ID NO: 1046499 - DNA, 22 bp, Artificial Sequence
  chemically synthesized
tatgttttgtttttaatttctc

SEQ ID NO: 1046500 - DNA, 22 bp, Artificial Sequence
  chemically synthesized
atgttttgtttttaatttctct

SEQ ID NO: 1046501 - DNA, 22 bp, Artificial Sequence
  chemically synthesized
tgttttgtttttaatttctctg

SEQ ID NO: 1046502 - DNA, 22 bp, Artificial Sequence
  chemically synthesized
tgtttttaatttctctgaccta

SEQ ID NO: 1046503 - DNA, 22 bp, Artificial Sequence
  chemically synthesized
gtttttaatttctctgacctag

SEQ ID NO: 1046504 - DNA, 22 bp, Artificial Sequence
  chemically synthesized
agtatgaaaatcctaggtcaga

SEQ ID NO: 1046505 - DNA, 22 bp, Artificial Sequence
  chemically synthesized
tttttaatttctctgacctagg

SEQ ID NO: 1046506 - DNA, 22 bp, Artificial Sequence
  chemically synthesized
ttaatttctctgacctaggatt

SEQ ID NO: 1046507 - DNA, 22 bp, Artificial Sequence
  chemically synthesized
taatttctctgacctaggattt

SEQ ID NO: 1046508 - DNA, 22 bp, Artificial Sequence
  chemically synthesized
aatttctctgacctaggatttt

SEQ ID NO: 1046509 - DNA, 22 bp, Artificial Sequence
  chemically synthesized
atttctctgacctaggattttc

SEQ ID NO: 1046510 - DNA, 22 bp, Artificial Sequence
  chemically synthesized
ctctgacctaggattttcatac

SEQ ID NO: 1046511 - DNA, 22 bp, Artificial Sequence
  chemically synthesized
tctgacctaggattttcatact

SEQ ID NO: 1046512 - DNA, 22 bp, Artificial Sequence
  chemically synthesized
tgacctaggattttcatactca

SEQ ID NO: 1046513 - DNA, 22 bp, Artificial Sequence
  chemically synthesized
acctaggattttcatactcaat

SEQ ID NO: 1046514 - DNA, 22 bp, Artificial Sequence
  chemically synthesized
tatcatgtaagaattgagtatg

SEQ ID NO: 1046515 - DNA, 22 bp, Artificial Sequence
  chemically synthesized
atatcatgtaagaattgagtat

SEQ ID NO: 1046516 - DNA, 22 bp, Artificial Sequence
  chemically synthesized
tatatcatgtaagaattgagta

SEQ ID NO: 1046517 - DNA, 22 bp, Artificial Sequence
  chemically synthesized
ttatatcatgtaagaattgagt

SEQ ID NO: 1046518 - DNA, 22 bp, Artificial Sequence
  chemically synthesized
tttatatcatgtaagaattgag

SEQ ID NO: 1046519 - DNA, 22 bp, Artificial Sequence
  chemically synthesized
ggattttcatactcaattctta

SEQ ID NO: 1046520 - DNA, 22 bp, Artificial Sequence
  chemically synthesized
attttttatatcatgtaagaat

SEQ ID NO: 1046521 - DNA, 22 bp, Artificial Sequence
  chemically synthesized
cattttttatatcatgtaagaa

SEQ ID NO: 1046522 - DNA, 22 bp, Artificial Sequence
  chemically synthesized
tcatactcaattcttacatgat

SEQ ID NO: 1046523 - DNA, 22 bp, Artificial Sequence
  chemically synthesized
catactcaattcttacatgata

SEQ ID NO: 1046524 - DNA, 22 bp, Artificial Sequence
  chemically synthesized
cttcattttttatatcatgtaa

SEQ ID NO: 1046525 - DNA, 22 bp, Artificial Sequence
  chemically synthesized
atactcaattcttacatgatat

SEQ ID NO: 1046526 - DNA, 22 bp, Artificial Sequence
  chemically synthesized
gaattacttcattttttatatc

SEQ ID NO: 1046527 - DNA, 22 bp, Artificial Sequence
  chemically synthesized
aattcttacatgatataaaaaa

SEQ ID NO: 1046528 - DNA, 22 bp, Artificial Sequence
  chemically synthesized
aattagaattacttcatttttt

SEQ ID NO: 1046529 - DNA, 22 bp, Artificial Sequence
  chemically synthesized
ttacatgatataaaaaatgaag

SEQ ID NO: 1046530 - DNA, 22 bp, Artificial Sequence
  chemically synthesized
acatgatataaaaaatgaagta

SEQ ID NO: 1046531 - DNA, 22 bp, Artificial Sequence
  chemically synthesized
catgatataaaaaatgaagtaa

SEQ ID NO: 1046532 - DNA, 22 bp, Artificial Sequence
  chemically synthesized
tatcacaagtagatgagatatc

SEQ ID NO: 1046533 - DNA, 22 bp, Artificial Sequence
  chemically synthesized
ctatatcacaagtagatgagat

SEQ ID NO: 1046534 - DNA, 22 bp, Artificial Sequence
  chemically synthesized
gctatatcacaagtagatgaga

SEQ ID NO: 1046535 - DNA, 22 bp, Artificial Sequence
  chemically synthesized
taatttagatatctcatctact

SEQ ID NO: 1046536 - DNA, 22 bp, Artificial Sequence
  chemically synthesized
atttagatatctcatctacttg

SEQ ID NO: 1046537 - DNA, 22 bp, Artificial Sequence
  chemically synthesized
agatatctcatctacttgtgat

SEQ ID NO: 1046538 - DNA, 22 bp, Artificial Sequence
  chemically synthesized
tgaatttgctatatcacaagta

SEQ ID NO: 1046539 - DNA, 22 bp, Artificial Sequence
  chemically synthesized
gatatctcatctacttgtgata

SEQ ID NO: 1046540 - DNA, 22 bp, Artificial Sequence
  chemically synthesized
tgtgaatttgctatatcacaag

SEQ ID NO: 1046541 - DNA, 22 bp, Artificial Sequence
  chemically synthesized
atctacttgtgatatagcaaat

SEQ ID NO: 1046542 - DNA, 22 bp, Artificial Sequence
  chemically synthesized
tgcaattctgtgaatttgctat

SEQ ID NO: 1046543 - DNA, 22 bp, Artificial Sequence
  chemically synthesized
gtgcaattctgtgaatttgcta

SEQ ID NO: 1046544 - DNA, 22 bp, Artificial Sequence
  chemically synthesized
cttgtgatatagcaaattcaca

SEQ ID NO: 1046545 - DNA, 22 bp, Artificial Sequence
  chemically synthesized
atttgtgcaattctgtgaattt

SEQ ID NO: 1046546 - DNA, 22 bp, Artificial Sequence
  chemically synthesized
gtgatatagcaaattcacagaa

SEQ ID NO: 1046547 - DNA, 22 bp, Artificial Sequence
  chemically synthesized
tgatatagcaaattcacagaat

SEQ ID NO: 1046548 - DNA, 22 bp, Artificial Sequence
  chemically synthesized
atagctaatttgtgcaattctg

SEQ ID NO: 1046549 - DNA, 22 bp, Artificial Sequence
  chemically synthesized
aatagctaatttgtgcaattct

SEQ ID NO: 1046550 - DNA, 22 bp, Artificial Sequence
  chemically synthesized
tttaatagctaatttgtgcaat

SEQ ID NO: 1046551 - DNA, 22 bp, Artificial Sequence
  chemically synthesized
acagaattgcacaaattagcta

SEQ ID NO: 1046552 - DNA, 22 bp, Artificial Sequence
  chemically synthesized
taaaaggtataattatttaata

SEQ ID NO: 1046553 - DNA, 22 bp, Artificial Sequence
  chemically synthesized
cacaaattagctattaaataat

SEQ ID NO: 1046554 - DNA, 22 bp, Artificial Sequence
  chemically synthesized
gctattaaataattataccttt

SEQ ID NO: 1046555 - DNA, 22 bp, Artificial Sequence
  chemically synthesized
ttaaataattataccttttaca

SEQ ID NO: 1046556 - DNA, 22 bp, Artificial Sequence
  chemically synthesized
aataattataccttttacaaca

SEQ ID NO: 1046557 - DNA, 22 bp, Artificial Sequence
  chemically synthesized
taccttttacaacatttgtttt

SEQ ID NO: 1046558 - DNA, 22 bp, Artificial Sequence
  chemically synthesized
gcccagatatacacaataaaac

SEQ ID NO: 1046559 - DNA, 22 bp, Artificial Sequence
  chemically synthesized
ttacaacatttgttttattgtg

SEQ ID NO: 1046560 - DNA, 22 bp, Artificial Sequence
  chemically synthesized
ggcccagatatacacaataaaa

SEQ ID NO: 1046561 - DNA, 22 bp, Artificial Sequence
  chemically synthesized
tacaacatttgttttattgtgt

SEQ ID NO: 1046562 - DNA, 22 bp, Artificial Sequence
  chemically synthesized
acaacatttgttttattgtgta

SEQ ID NO: 1046563 - DNA, 22 bp, Artificial Sequence
  chemically synthesized
caacatttgttttattgtgtat

SEQ ID NO: 1046564 - DNA, 22 bp, Artificial Sequence
  chemically synthesized
gttttattgtgtatatctgggc

SEQ ID NO: 1046565 - DNA, 22 bp, Artificial Sequence
  chemically synthesized
ttttattgtgtatatctgggcc

SEQ ID NO: 1046566 - DNA, 22 bp, Artificial Sequence
  chemically synthesized
tattgtgtatatctgggccaaa

SEQ ID NO: 1046567 - DNA, 22 bp, Artificial Sequence
  chemically synthesized
attgtgtatatctgggccaaat

SEQ ID NO: 1046568 - DNA, 22 bp, Artificial Sequence
  chemically synthesized
ttgtgtatatctgggccaaatc

SEQ ID NO: 1046569 - DNA, 22 bp, Artificial Sequence
  chemically synthesized
tgtatatctgggccaaatccat

SEQ ID NO: 1046570 - DNA, 22 bp, Artificial Sequence
  chemically synthesized
aacatgaaggaatgtgtgccat

SEQ ID NO: 1046571 - DNA, 22 bp, Artificial Sequence
  chemically synthesized
ggccaaatccatggcacacatt

SEQ ID NO: 1046572 - DNA, 22 bp, Artificial Sequence
  chemically synthesized
cattgaacatgaaggaatgtgt

SEQ ID NO: 1046573 - DNA, 22 bp, Artificial Sequence
  chemically synthesized
ttccattgaacatgaaggaatg

SEQ ID NO: 1046574 - DNA, 22 bp, Artificial Sequence
  chemically synthesized
cttcatgttcaatggaataatg

SEQ ID NO: 1046575 - DNA, 22 bp, Artificial Sequence
  chemically synthesized
catgttcaatggaataatgtat

SEQ ID NO: 1046576 - DNA, 22 bp, Artificial Sequence
  chemically synthesized
atgttcaatggaataatgtata

SEQ ID NO: 1046577 - DNA, 22 bp, Artificial Sequence
  chemically synthesized
aatggaataatgtatatatatt

SEQ ID NO: 1046578 - DNA, 22 bp, Artificial Sequence
  chemically synthesized
aatgtaaatgagaaatatatat

SEQ ID NO: 1046579 - DNA, 22 bp, Artificial Sequence
  chemically synthesized
aaatgtaaatgagaaatatata

SEQ ID NO: 1046580 - DNA, 22 bp, Artificial Sequence
  chemically synthesized
taaatgtaaatgagaaatatat

SEQ ID NO: 1046581 - DNA, 22 bp, Artificial Sequence
  chemically synthesized
ttaaatgtaaatgagaaatata

SEQ ID NO: 1046582 - DNA, 22 bp, Artificial Sequence
  chemically synthesized
atatccttttaaatgtaaatga

SEQ ID NO: 1046583 - DNA, 22 bp, Artificial Sequence
  chemically synthesized
taatatccttttaaatgtaaat

SEQ ID NO: 1046584 - DNA, 22 bp, Artificial Sequence
  chemically synthesized
ctaatatccttttaaatgtaaa

SEQ ID NO: 1046585 - DNA, 22 bp, Artificial Sequence
  chemically synthesized
aagtttctaatatccttttaaa

SEQ ID NO: 1046586 - DNA, 22 bp, Artificial Sequence
  chemically synthesized
ctcatttacatttaaaaggata

SEQ ID NO: 1046587 - DNA, 22 bp, Artificial Sequence
  chemically synthesized
tcatttacatttaaaaggatat

SEQ ID NO: 1046588 - DNA, 22 bp, Artificial Sequence
  chemically synthesized
gctcaagtttctaatatccttt

SEQ ID NO: 1046589 - DNA, 22 bp, Artificial Sequence
  chemically synthesized
atttacatttaaaaggatatta

SEQ ID NO: 1046590 - DNA, 22 bp, Artificial Sequence
  chemically synthesized
tggctcaagtttctaatatcct

SEQ ID NO: 1046591 - DNA, 22 bp, Artificial Sequence
  chemically synthesized
acatttaaaaggatattagaaa

SEQ ID NO: 1046592 - DNA, 22 bp, Artificial Sequence
  chemically synthesized
catttaaaaggatattagaaac

SEQ ID NO: 1046593 - DNA, 22 bp, Artificial Sequence
  chemically synthesized
tcaaactctggctcaagtttct

SEQ ID NO: 1046594 - DNA, 22 bp, Artificial Sequence
  chemically synthesized
aaaaggatattagaaacttgag

SEQ ID NO: 1046595 - DNA, 22 bp, Artificial Sequence
  chemically synthesized
atcaaactctggctcaagtttc

SEQ ID NO: 1046596 - DNA, 22 bp, Artificial Sequence
  chemically synthesized
aaaggatattagaaacttgagc

SEQ ID NO: 1046597 - DNA, 22 bp, Artificial Sequence
  chemically synthesized
tttatcaaactctggctcaagt

SEQ ID NO: 1046598 - DNA, 22 bp, Artificial Sequence
  chemically synthesized
atttatcaaactctggctcaag

SEQ ID NO: 1046599 - DNA, 22 bp, Artificial Sequence
  chemically synthesized
tatttatcaaactctggctcaa

SEQ ID NO: 1046600 - DNA, 22 bp, Artificial Sequence
  chemically synthesized
aattttatttatcaaactctgg

SEQ ID NO: 1046601 - DNA, 22 bp, Artificial Sequence
  chemically synthesized
gaaacttgagccagagtttgat

SEQ ID NO: 1046602 - DNA, 22 bp, Artificial Sequence
  chemically synthesized
tgaattttatttatcaaactct

SEQ ID NO: 1046603 - DNA, 22 bp, Artificial Sequence
  chemically synthesized
aattctgaattttatttatcaa

SEQ ID NO: 1046604 - DNA, 22 bp, Artificial Sequence
  chemically synthesized
gagccagagtttgataaataaa

SEQ ID NO: 1046605 - DNA, 22 bp, Artificial Sequence
  chemically synthesized
agccagagtttgataaataaaa

SEQ ID NO: 1046606 - DNA, 22 bp, Artificial Sequence
  chemically synthesized
ttaaattctgaattttatttat

SEQ ID NO: 1046607 - DNA, 22 bp, Artificial Sequence
  chemically synthesized
agaaatctgttaaattctgaat

SEQ ID NO: 1046608 - DNA, 22 bp, Artificial Sequence
  chemically synthesized
aagaaatctgttaaattctgaa

SEQ ID NO: 1046609 - DNA, 22 bp, Artificial Sequence
  chemically synthesized
gataaataaaattcagaattta

SEQ ID NO: 1046610 - DNA, 22 bp, Artificial Sequence
  chemically synthesized
ataaataaaattcagaatttaa

SEQ ID NO: 1046611 - DNA, 22 bp, Artificial Sequence
  chemically synthesized
ttaagaaatctgttaaattctg

SEQ ID NO: 1046612 - DNA, 22 bp, Artificial Sequence
  chemically synthesized
cttaagaaatctgttaaattct

SEQ ID NO: 1046613 - DNA, 22 bp, Artificial Sequence
  chemically synthesized
agaatttcttaagaaatctgtt

SEQ ID NO: 1046614 - DNA, 22 bp, Artificial Sequence
  chemically synthesized
agaatttaacagatttcttaag

SEQ ID NO: 1046615 - DNA, 22 bp, Artificial Sequence
  chemically synthesized
aacagatttcttaagaaattct

SEQ ID NO: 1046616 - DNA, 22 bp, Artificial Sequence
  chemically synthesized
acagatttcttaagaaattctt

SEQ ID NO: 1046617 - DNA, 22 bp, Artificial Sequence
  chemically synthesized
tgatgaaatagtgaaattaaga

SEQ ID NO: 1046618 - DNA, 22 bp, Artificial Sequence
  chemically synthesized
atgatgaaatagtgaaattaag

SEQ ID NO: 1046619 - DNA, 22 bp, Artificial Sequence
  chemically synthesized
cttaagaaattcttaatttcac

SEQ ID NO: 1046620 - DNA, 22 bp, Artificial Sequence
  chemically synthesized
ttaagaaattcttaatttcact

SEQ ID NO: 1046621 - DNA, 22 bp, Artificial Sequence
  chemically synthesized
aagaaattcttaatttcactat

SEQ ID NO: 1046622 - DNA, 22 bp, Artificial Sequence
  chemically synthesized
agaaattcttaatttcactatt

SEQ ID NO: 1046623 - DNA, 22 bp, Artificial Sequence
  chemically synthesized
ttaatttcactatttcatcata

SEQ ID NO: 1046624 - DNA, 22 bp, Artificial Sequence
  chemically synthesized
aatttcactatttcatcataag

SEQ ID NO: 1046625 - DNA, 22 bp, Artificial Sequence
  chemically synthesized
atttcactatttcatcataagc

SEQ ID NO: 1046626 - DNA, 22 bp, Artificial Sequence
  chemically synthesized
aatgtgtaaaatgcttatgatg

SEQ ID NO: 1046627 - DNA, 22 bp, Artificial Sequence
  chemically synthesized
aaatgtgtaaaatgcttatgat

SEQ ID NO: 1046628 - DNA, 22 bp, Artificial Sequence
  chemically synthesized
taaatgtgtaaaatgcttatga

SEQ ID NO: 1046629 - DNA, 22 bp, Artificial Sequence
  chemically synthesized
ttaaatgtgtaaaatgcttatg

SEQ ID NO: 1046630 - DNA, 22 bp, Artificial Sequence
  chemically synthesized
cactatttcatcataagcattt

SEQ ID NO: 1046631 - DNA, 22 bp, Artificial Sequence
  chemically synthesized
actatttcatcataagcatttt

SEQ ID NO: 1046632 - DNA, 22 bp, Artificial Sequence
  chemically synthesized
ttttaaatgtgtaaaatgctta

SEQ ID NO: 1046633 - DNA, 22 bp, Artificial Sequence
  chemically synthesized
cttttaaatgtgtaaaatgctt

SEQ ID NO: 1046634 - DNA, 22 bp, Artificial Sequence
  chemically synthesized
tcttttaaatgtgtaaaatgct

SEQ ID NO: 1046635 - DNA, 22 bp, Artificial Sequence
  chemically synthesized
ttcttttaaatgtgtaaaatgc

SEQ ID NO: 1046636 - DNA, 22 bp, Artificial Sequence
  chemically synthesized
tttcatcataagcattttacac

SEQ ID NO: 1046637 - DNA, 22 bp, Artificial Sequence
  chemically synthesized
tttttcttttaaatgtgtaaaa

SEQ ID NO: 1046638 - DNA, 22 bp, Artificial Sequence
  chemically synthesized
catcataagcattttacacatt

SEQ ID NO: 1046639 - DNA, 22 bp, Artificial Sequence
  chemically synthesized
atcataagcattttacacattt

SEQ ID NO: 1046640 - DNA, 22 bp, Artificial Sequence
  chemically synthesized
agttatttttcttttaaatgtg

SEQ ID NO: 1046641 - DNA, 22 bp, Artificial Sequence
  chemically synthesized
ctgagttatttttcttttaaat

SEQ ID NO: 1046642 - DNA, 22 bp, Artificial Sequence
  chemically synthesized
tacacatttaaaagaaaaataa

SEQ ID NO: 1046643 - DNA, 22 bp, Artificial Sequence
  chemically synthesized
acacatttaaaagaaaaataac

SEQ ID NO: 1046644 - DNA, 22 bp, Artificial Sequence
  chemically synthesized
cacatttaaaagaaaaataact

SEQ ID NO: 1046645 - DNA, 22 bp, Artificial Sequence
  chemically synthesized
aaatagcctgctgagttatttt

SEQ ID NO: 1046646 - DNA, 22 bp, Artificial Sequence
  chemically synthesized
aaaagaaaaataactcagcagg

SEQ ID NO: 1046647 - DNA, 22 bp, Artificial Sequence
  chemically synthesized
acattcaaatagcctgctgagt

SEQ ID NO: 1046648 - DNA, 22 bp, Artificial Sequence
  chemically synthesized
aaagaaaaataactcagcaggc

SEQ ID NO: 1046649 - DNA, 22 bp, Artificial Sequence
  chemically synthesized
cacattcaaatagcctgctgag

SEQ ID NO: 1046650 - DNA, 22 bp, Artificial Sequence
  chemically synthesized
agcaggctatttgaatgtgaaa

SEQ ID NO: 1046651 - DNA, 22 bp, Artificial Sequence
  chemically synthesized
atgtgtcagtgaaaatttcaca

SEQ ID NO: 1046652 - DNA, 22 bp, Artificial Sequence
  chemically synthesized
aatgtgtcagtgaaaatttcac

SEQ ID NO: 1046653 - DNA, 22 bp, Artificial Sequence
  chemically synthesized
tttaatgtgtcagtgaaaattt

SEQ ID NO: 1046654 - DNA, 22 bp, Artificial Sequence
  chemically synthesized
tttgaatgtgaaattttcactg

SEQ ID NO: 1046655 - DNA, 22 bp, Artificial Sequence
  chemically synthesized
ctgtttaatgtgtcagtgaaaa

SEQ ID NO: 1046656 - DNA, 22 bp, Artificial Sequence
  chemically synthesized
gaatgtgaaattttcactgaca

SEQ ID NO: 1046657 - DNA, 22 bp, Artificial Sequence
  chemically synthesized
tactgtttaatgtgtcagtgaa

SEQ ID NO: 1046658 - DNA, 22 bp, Artificial Sequence
  chemically synthesized
aatgtgaaattttcactgacac

SEQ ID NO: 1046659 - DNA, 22 bp, Artificial Sequence
  chemically synthesized
attctactgtttaatgtgtcag

SEQ ID NO: 1046660 - DNA, 22 bp, Artificial Sequence
  chemically synthesized
ttgattctactgtttaatgtgt

SEQ ID NO: 1046661 - DNA, 22 bp, Artificial Sequence
  chemically synthesized
tgctattgattctactgtttaa

SEQ ID NO: 1046662 - DNA, 22 bp, Artificial Sequence
  chemically synthesized
tcactgacacattaaacagtag

SEQ ID NO: 1046663 - DNA, 22 bp, Artificial Sequence
  chemically synthesized
gtgctattgattctactgttta

SEQ ID NO: 1046664 - DNA, 22 bp, Artificial Sequence
  chemically synthesized
cactgacacattaaacagtaga

SEQ ID NO: 1046665 - DNA, 22 bp, Artificial Sequence
  chemically synthesized
actgacacattaaacagtagaa

SEQ ID NO: 1046666 - DNA, 22 bp, Artificial Sequence
  chemically synthesized
cttgtgctattgattctactgt

SEQ ID NO: 1046667 - DNA, 22 bp, Artificial Sequence
  chemically synthesized
acacattaaacagtagaatcaa

SEQ ID NO: 1046668 - DNA, 22 bp, Artificial Sequence
  chemically synthesized
tgttacttgtgctattgattct

SEQ ID NO: 1046669 - DNA, 22 bp, Artificial Sequence
  chemically synthesized
gtgttacttgtgctattgattc

SEQ ID NO: 1046670 - DNA, 22 bp, Artificial Sequence
  chemically synthesized
aacagtagaatcaatagcacaa

SEQ ID NO: 1046671 - DNA, 22 bp, Artificial Sequence
  chemically synthesized
gtgttttgcacgcattacattg

SEQ ID NO: 1046672 - DNA, 22 bp, Artificial Sequence
  chemically synthesized
tgttttgcacgcattacattgg

SEQ ID NO: 1046673 - DNA, 22 bp, Artificial Sequence
  chemically synthesized
tgcacgcattacattggttggt

SEQ ID NO: 1046674 - DNA, 22 bp, Artificial Sequence
  chemically synthesized
gcacgcattacattggttggtg

SEQ ID NO: 1046675 - DNA, 22 bp, Artificial Sequence
  chemically synthesized
cacgcattacattggttggtga

SEQ ID NO: 1046676 - DNA, 22 bp, Artificial Sequence
  chemically synthesized
agaacaacataatggtcaccaa

SEQ ID NO: 1046677 - DNA, 22 bp, Artificial Sequence
  chemically synthesized
ttaagaacaacataatggtcac

SEQ ID NO: 1046678 - DNA, 22 bp, Artificial Sequence
  chemically synthesized
attaagaacaacataatggtca

SEQ ID NO: 1046679 - DNA, 22 bp, Artificial Sequence
  chemically synthesized
tattaagaacaacataatggtc

SEQ ID NO: 1046680 - DNA, 22 bp, Artificial Sequence
  chemically synthesized
cattggttggtgaccattatgt

SEQ ID NO: 1046681 - DNA, 22 bp, Artificial Sequence
  chemically synthesized
gttggtgaccattatgttgttc

SEQ ID NO: 1046682 - DNA, 22 bp, Artificial Sequence
  chemically synthesized
taaattttattaagaacaacat

SEQ ID NO: 1046683 - DNA, 22 bp, Artificial Sequence
  chemically synthesized
gtaaattttattaagaacaaca

SEQ ID NO: 1046684 - DNA, 22 bp, Artificial Sequence
  chemically synthesized
gtgaccattatgttgttcttaa

SEQ ID NO: 1046685 - DNA, 22 bp, Artificial Sequence
  chemically synthesized
acttgtaaattttattaagaac

SEQ ID NO: 1046686 - DNA, 22 bp, Artificial Sequence
  chemically synthesized
ttaacttgtaaattttattaag

SEQ ID NO: 1046687 - DNA, 22 bp, Artificial Sequence
  chemically synthesized
attaacttgtaaattttattaa

SEQ ID NO: 1046688 - DNA, 22 bp, Artificial Sequence
  chemically synthesized
tgttgttcttaataaaatttac

SEQ ID NO: 1046689 - DNA, 22 bp, Artificial Sequence
  chemically synthesized
ttcttaataaaatttacaagtt

SEQ ID NO: 1046690 - DNA, 22 bp, Artificial Sequence
  chemically synthesized
ttaataaaatttacaagttaat

SEQ ID NO: 1046691 - DNA, 22 bp, Artificial Sequence
  chemically synthesized
aataaaatttacaagttaataa

SEQ ID NO: 1046692 - DNA, 22 bp, Artificial Sequence
  chemically synthesized
ataaaatttacaagttaataag

SEQ ID NO: 1046693 - DNA, 22 bp, Artificial Sequence
  chemically synthesized
acgtgaataagaaagacgagct

SEQ ID NO: 1046694 - DNA, 22 bp, Artificial Sequence
  chemically synthesized
acaagttaataagctcgtcttt

SEQ ID NO: 1046695 - DNA, 22 bp, Artificial Sequence
  chemically synthesized
caagttaataagctcgtctttc

SEQ ID NO: 1046696 - DNA, 22 bp, Artificial Sequence
  chemically synthesized
ataagctcgtctttcttattca

SEQ ID NO: 1046697 - DNA, 22 bp, Artificial Sequence
  chemically synthesized
tagcaactaacgtgaataagaa

SEQ ID NO: 1046698 - DNA, 22 bp, Artificial Sequence
  chemically synthesized
gtctttcttattcacgttagtt

SEQ ID NO: 1046699 - DNA, 22 bp, Artificial Sequence
  chemically synthesized
caggggttatagcaactaacgt

SEQ ID NO: 1046700 - DNA, 22 bp, Artificial Sequence
  chemically synthesized
ctgcaggggttatagcaactaa

SEQ ID NO: 1046701 - DNA, 22 bp, Artificial Sequence
  chemically synthesized
tcttattcacgttagttgctat

SEQ ID NO: 1046702 - DNA, 22 bp, Artificial Sequence
  chemically synthesized
actgcaggggttatagcaacta

SEQ ID NO: 1046703 - DNA, 22 bp, Artificial Sequence
  chemically synthesized
cttattcacgttagttgctata

SEQ ID NO: 1046704 - DNA, 22 bp, Artificial Sequence
  chemically synthesized
tactgcaggggttatagcaact

SEQ ID NO: 1046705 - DNA, 22 bp, Artificial Sequence
  chemically synthesized
ttattcacgttagttgctataa

SEQ ID NO: 1046706 - DNA, 22 bp, Artificial Sequence
  chemically synthesized
attcacgttagttgctataacc

SEQ ID NO: 1046707 - DNA, 22 bp, Artificial Sequence
  chemically synthesized
ttcacgttagttgctataaccc

SEQ ID NO: 1046708 - DNA, 22 bp, Artificial Sequence
  chemically synthesized
tctttactgcaggggttatagc

SEQ ID NO: 1046709 - DNA, 22 bp, Artificial Sequence
  chemically synthesized
acgttagttgctataacccctg

SEQ ID NO: 1046710 - DNA, 22 bp, Artificial Sequence
  chemically synthesized
gttgctataacccctgcagtaa

SEQ ID NO: 1046711 - DNA, 22 bp, Artificial Sequence
  chemically synthesized
ctataacccctgcagtaaagat

SEQ ID NO: 1046712 - DNA, 22 bp, Artificial Sequence
  chemically synthesized
gatgatgtgaagctatctttac

SEQ ID NO: 1046713 - DNA, 22 bp, Artificial Sequence
  chemically synthesized
taacccctgcagtaaagatagc

SEQ ID NO: 1046714 - DNA, 22 bp, Artificial Sequence
  chemically synthesized
agatgatgtgaagctatcttta

SEQ ID NO: 1046715 - DNA, 22 bp, Artificial Sequence
  chemically synthesized
tagatgatgtgaagctatcttt

SEQ ID NO: 1046716 - DNA, 22 bp, Artificial Sequence
  chemically synthesized
ctttagatgatgtgaagctatc

SEQ ID NO: 1046717 - DNA, 22 bp, Artificial Sequence
  chemically synthesized
gctttagatgatgtgaagctat

SEQ ID NO: 1046718 - DNA, 22 bp, Artificial Sequence
  chemically synthesized
cagtaaagatagcttcacatca

SEQ ID NO: 1046719 - DNA, 22 bp, Artificial Sequence
  chemically synthesized
taagaaatacgcttgctttaga

SEQ ID NO: 1046720 - DNA, 22 bp, Artificial Sequence
  chemically synthesized
cacatcatctaaagcaagcgta

SEQ ID NO: 1046721 - DNA, 22 bp, Artificial Sequence
  chemically synthesized
acatcatctaaagcaagcgtat

SEQ ID NO: 1046722 - DNA, 22 bp, Artificial Sequence
  chemically synthesized
aataagtattataagaaatacg

SEQ ID NO: 1046723 - DNA, 22 bp, Artificial Sequence
  chemically synthesized
aagcaagcgtatttcttataat

SEQ ID NO: 1046724 - DNA, 22 bp, Artificial Sequence
  chemically synthesized
caccattaaataagtattataa

SEQ ID NO: 1046725 - DNA, 22 bp, Artificial Sequence
  chemically synthesized
attgcaccattaaataagtatt

SEQ ID NO: 1046726 - DNA, 22 bp, Artificial Sequence
  chemically synthesized
aattgcaccattaaataagtat

SEQ ID NO: 1046727 - DNA, 22 bp, Artificial Sequence
  chemically synthesized
cttataatacttatttaatggt

SEQ ID NO: 1046728 - DNA, 22 bp, Artificial Sequence
  chemically synthesized
ttataatacttatttaatggtg

SEQ ID NO: 1046729 - DNA, 22 bp, Artificial Sequence
  chemically synthesized
ataatacttatttaatggtgca

SEQ ID NO: 1046730 - DNA, 22 bp, Artificial Sequence
  chemically synthesized
taatacttatttaatggtgcaa

SEQ ID NO: 1046731 - DNA, 22 bp, Artificial Sequence
  chemically synthesized
aaggcagatttaattgcaccat

SEQ ID NO: 1046732 - DNA, 22 bp, Artificial Sequence
  chemically synthesized
atttaatggtgcaattaaatct

SEQ ID NO: 1046733 - DNA, 22 bp, Artificial Sequence
  chemically synthesized
tttaatggtgcaattaaatctg

SEQ ID NO: 1046734 - DNA, 22 bp, Artificial Sequence
  chemically synthesized
aatggtgcaattaaatctgcct

SEQ ID NO: 1046735 - DNA, 22 bp, Artificial Sequence
  chemically synthesized
atggtgcaattaaatctgcctt

SEQ ID NO: 1046736 - DNA, 22 bp, Artificial Sequence
  chemically synthesized
caggtgtaaaatgtatcattaa

SEQ ID NO: 1046737 - DNA, 22 bp, Artificial Sequence
  chemically synthesized
acaggtgtaaaatgtatcatta

SEQ ID NO: 1046738 - DNA, 22 bp, Artificial Sequence
  chemically synthesized
aatctgcctttaatgatacatt

SEQ ID NO: 1046739 - DNA, 22 bp, Artificial Sequence
  chemically synthesized
cctttaatgatacattttacac

SEQ ID NO: 1046740 - DNA, 22 bp, Artificial Sequence
  chemically synthesized
caaaaacttacaggtgtaaaat

SEQ ID NO: 1046741 - DNA, 22 bp, Artificial Sequence
  chemically synthesized
ccaaaaacttacaggtgtaaaa

SEQ ID NO: 1046742 - DNA, 22 bp, Artificial Sequence
  chemically synthesized
tccaaaaacttacaggtgtaaa

SEQ ID NO: 1046743 - DNA, 22 bp, Artificial Sequence
  chemically synthesized
taatgatacattttacacctgt

SEQ ID NO: 1046744 - DNA, 22 bp, Artificial Sequence
  chemically synthesized
aatgatacattttacacctgta

SEQ ID NO: 1046745 - DNA, 22 bp, Artificial Sequence
  chemically synthesized
atgatacattttacacctgtaa

SEQ ID NO: 1046746 - DNA, 22 bp, Artificial Sequence
  chemically synthesized
ttttccaaaaacttacaggtgt

SEQ ID NO: 1046747 - DNA, 22 bp, Artificial Sequence
  chemically synthesized
gttttccaaaaacttacaggtg

SEQ ID NO: 1046748 - DNA, 22 bp, Artificial Sequence
  chemically synthesized
tgttttccaaaaacttacaggt

SEQ ID NO: 1046749 - DNA, 22 bp, Artificial Sequence
  chemically synthesized
tacacctgtaagtttttggaaa

SEQ ID NO: 1046750 - DNA, 22 bp, Artificial Sequence
  chemically synthesized
acacctgtaagtttttggaaaa

SEQ ID NO: 1046751 - DNA, 22 bp, Artificial Sequence
  chemically synthesized
cacctgtaagtttttggaaaac

SEQ ID NO: 1046752 - DNA, 22 bp, Artificial Sequence
  chemically synthesized
ataacaaaaacctttgttttcc

SEQ ID NO: 1046753 - DNA, 22 bp, Artificial Sequence
  chemically synthesized
taagtttttggaaaacaaaggt

SEQ ID NO: 1046754 - DNA, 22 bp, Artificial Sequence
  chemically synthesized
ctgataacaaaaacctttgttt

SEQ ID NO: 1046755 - DNA, 22 bp, Artificial Sequence
  chemically synthesized
ttcctgataacaaaaacctttg

SEQ ID NO: 1046756 - DNA, 22 bp, Artificial Sequence
  chemically synthesized
tgttcctgataacaaaaacctt

SEQ ID NO: 1046757 - DNA, 22 bp, Artificial Sequence
  chemically synthesized
ttggaaaacaaaggtttttgtt

SEQ ID NO: 1046758 - DNA, 22 bp, Artificial Sequence
  chemically synthesized
tggaaaacaaaggtttttgtta

SEQ ID NO: 1046759 - DNA, 22 bp, Artificial Sequence
  chemically synthesized
ctctgttcctgataacaaaaac

SEQ ID NO: 1046760 - DNA, 22 bp, Artificial Sequence
  chemically synthesized
ggaaaacaaaggtttttgttat

SEQ ID NO: 1046761 - DNA, 22 bp, Artificial Sequence
  chemically synthesized
actctgttcctgataacaaaaa

SEQ ID NO: 1046762 - DNA, 22 bp, Artificial Sequence
  chemically synthesized
gaaaacaaaggtttttgttatc

SEQ ID NO: 1046763 - DNA, 22 bp, Artificial Sequence
  chemically synthesized
cttactctgttcctgataacaa

SEQ ID NO: 1046764 - DNA, 22 bp, Artificial Sequence
  chemically synthesized
tacttactctgttcctgataac

SEQ ID NO: 1046765 - DNA, 22 bp, Artificial Sequence
  chemically synthesized
ctacttactctgttcctgataa

SEQ ID NO: 1046766 - DNA, 22 bp, Artificial Sequence
  chemically synthesized
tcttctacttactctgttcctg

SEQ ID NO: 1046767 - DNA, 22 bp, Artificial Sequence
  chemically synthesized
gtcttctacttactctgttcct

SEQ ID NO: 1046768 - DNA, 22 bp, Artificial Sequence
  chemically synthesized
ttgttatcaggaacagagtaag

SEQ ID NO: 1046769 - DNA, 22 bp, Artificial Sequence
  chemically synthesized
tgttatcaggaacagagtaagt

SEQ ID NO: 1046770 - DNA, 22 bp, Artificial Sequence
  chemically synthesized
gttatcaggaacagagtaagta

SEQ ID NO: 1046771 - DNA, 22 bp, Artificial Sequence
  chemically synthesized
caacttgtcttctacttactct

SEQ ID NO: 1046772 - DNA, 22 bp, Artificial Sequence
  chemically synthesized
ttatcaggaacagagtaagtag

SEQ ID NO: 1046773 - DNA, 22 bp, Artificial Sequence
  chemically synthesized
tcaggaacagagtaagtagaag

SEQ ID NO: 1046774 - DNA, 22 bp, Artificial Sequence
  chemically synthesized
ataaataaatgaaaaactacaa

SEQ ID NO: 1046775 - DNA, 22 bp, Artificial Sequence
  chemically synthesized
tagtttttcatttatttattaa

SEQ ID NO: 1046776 - DNA, 22 bp, Artificial Sequence
  chemically synthesized
aacaacaaaacaaattaataaa

SEQ ID NO: 1046777 - DNA, 22 bp, Artificial Sequence
  chemically synthesized
ttcatttatttattaatttgtt

SEQ ID NO: 1046778 - DNA, 22 bp, Artificial Sequence
  chemically synthesized
attaaacaacaaaacaaattaa

SEQ ID NO: 1046779 - DNA, 22 bp, Artificial Sequence
  chemically synthesized
tcatttatttattaatttgttt

SEQ ID NO: 1046780 - DNA, 22 bp, Artificial Sequence
  chemically synthesized
gattaaacaacaaaacaaatta

SEQ ID NO: 1046781 - DNA, 22 bp, Artificial Sequence
  chemically synthesized
catttatttattaatttgtttt

SEQ ID NO: 1046782 - DNA, 22 bp, Artificial Sequence
  chemically synthesized
atttatttattaatttgttttg

SEQ ID NO: 1046783 - DNA, 22 bp, Artificial Sequence
  chemically synthesized
ccttgattaaacaacaaaacaa

SEQ ID NO: 1046784 - DNA, 22 bp, Artificial Sequence
  chemically synthesized
atttattaatttgttttgttgt

SEQ ID NO: 1046785 - DNA, 22 bp, Artificial Sequence
  chemically synthesized
tttattaatttgttttgttgtt

SEQ ID NO: 1046786 - DNA, 22 bp, Artificial Sequence
  chemically synthesized
attaatttgttttgttgtttaa

SEQ ID NO: 1046787 - DNA, 22 bp, Artificial Sequence
  chemically synthesized
ttaatttgttttgttgtttaat

SEQ ID NO: 1046788 - DNA, 22 bp, Artificial Sequence
  chemically synthesized
aaacaactcccttgattaaaca

SEQ ID NO: 1046789 - DNA, 22 bp, Artificial Sequence
  chemically synthesized
atttgttttgttgtttaatcaa

SEQ ID NO: 1046790 - DNA, 22 bp, Artificial Sequence
  chemically synthesized
tgaaacaactcccttgattaaa

SEQ ID NO: 1046791 - DNA, 22 bp, Artificial Sequence
  chemically synthesized
gttttgttgtttaatcaaggga

SEQ ID NO: 1046792 - DNA, 22 bp, Artificial Sequence
  chemically synthesized
ttttgttgtttaatcaagggag

SEQ ID NO: 1046793 - DNA, 22 bp, Artificial Sequence
  chemically synthesized
tgttgtttaatcaagggagttg

SEQ ID NO: 1046794 - DNA, 22 bp, Artificial Sequence
  chemically synthesized
gttgtttaatcaagggagttgt

SEQ ID NO: 1046795 - DNA, 22 bp, Artificial Sequence
  chemically synthesized
ttgtttaatcaagggagttgtt

SEQ ID NO: 1046796 - DNA, 22 bp, Artificial Sequence
  chemically synthesized
tttaatcaagggagttgtttca

SEQ ID NO: 1046797 - DNA, 22 bp, Artificial Sequence
  chemically synthesized
aatcaagggagttgtttcagaa

SEQ ID NO: 1046798 - DNA, 22 bp, Artificial Sequence
  chemically synthesized
atcaagggagttgtttcagaat

SEQ ID NO: 1046799 - DNA, 22 bp, Artificial Sequence
  chemically synthesized
aagatatgtccaattctgaaac

SEQ ID NO: 1046800 - DNA, 22 bp, Artificial Sequence
  chemically synthesized
caagatatgtccaattctgaaa

SEQ ID NO: 1046801 - DNA, 22 bp, Artificial Sequence
  chemically synthesized
tcaagatatgtccaattctgaa

SEQ ID NO: 1046802 - DNA, 22 bp, Artificial Sequence
  chemically synthesized
aatattttcaagatatgtccaa

SEQ ID NO: 1046803 - DNA, 22 bp, Artificial Sequence
  chemically synthesized
taaatattttcaagatatgtcc

SEQ ID NO: 1046804 - DNA, 22 bp, Artificial Sequence
  chemically synthesized
ctaaatattttcaagatatgtc

SEQ ID NO: 1046805 - DNA, 22 bp, Artificial Sequence
  chemically synthesized
tttcagaattggacatatcttg

SEQ ID NO: 1046806 - DNA, 22 bp, Artificial Sequence
  chemically synthesized
tctaaatattttcaagatatgt

SEQ ID NO: 1046807 - DNA, 22 bp, Artificial Sequence
  chemically synthesized
ttctaaatattttcaagatatg

SEQ ID NO: 1046808 - DNA, 22 bp, Artificial Sequence
  chemically synthesized
tttctaaatattttcaagatat

SEQ ID NO: 1046809 - DNA, 22 bp, Artificial Sequence
  chemically synthesized
cagaattggacatatcttgaaa

SEQ ID NO: 1046810 - DNA, 22 bp, Artificial Sequence
  chemically synthesized
ttttctaaatattttcaagata

SEQ ID NO: 1046811 - DNA, 22 bp, Artificial Sequence
  chemically synthesized
agaattggacatatcttgaaaa

SEQ ID NO: 1046812 - DNA, 22 bp, Artificial Sequence
  chemically synthesized
gacatatcttgaaaatatttag

SEQ ID NO: 1046813 - DNA, 22 bp, Artificial Sequence
  chemically synthesized
aggccacccagatttttttcta

SEQ ID NO: 1046814 - DNA, 22 bp, Artificial Sequence
  chemically synthesized
gaaaatatttagaaaaaaatct

SEQ ID NO: 1046815 - DNA, 22 bp, Artificial Sequence
  chemically synthesized
ttaaggccacccagattttttt

SEQ ID NO: 1046816 - DNA, 22 bp, Artificial Sequence
  chemically synthesized
aaaatatttagaaaaaaatctg

SEQ ID NO: 1046817 - DNA, 22 bp, Artificial Sequence
  chemically synthesized
gttaaggccacccagatttttt

SEQ ID NO: 1046818 - DNA, 22 bp, Artificial Sequence
  chemically synthesized
tgttaaggccacccagattttt

SEQ ID NO: 1046819 - DNA, 22 bp, Artificial Sequence
  chemically synthesized
ttgttaaggccacccagatttt

SEQ ID NO: 1046820 - DNA, 22 bp, Artificial Sequence
  chemically synthesized
cttttgttaaggccacccagat

SEQ ID NO: 1046821 - DNA, 22 bp, Artificial Sequence
  chemically synthesized
agaaaaaaatctgggtggcctt

SEQ ID NO: 1046822 - DNA, 22 bp, Artificial Sequence
  chemically synthesized
gaaaaaaatctgggtggcctta

SEQ ID NO: 1046823 - DNA, 22 bp, Artificial Sequence
  chemically synthesized
ccactgcttttgttaaggccac

SEQ ID NO: 1046824 - DNA, 22 bp, Artificial Sequence
  chemically synthesized
aattcccactgcttttgttaag

SEQ ID NO: 1046825 - DNA, 22 bp, Artificial Sequence
  chemically synthesized
tgaattcccactgcttttgtta

SEQ ID NO: 1046826 - DNA, 22 bp, Artificial Sequence
  chemically synthesized
ctgaattcccactgcttttgtt

SEQ ID NO: 1046827 - DNA, 22 bp, Artificial Sequence
  chemically synthesized
tctgaattcccactgcttttgt

SEQ ID NO: 1046828 - DNA, 22 bp, Artificial Sequence
  chemically synthesized
ttctgaattcccactgcttttg

SEQ ID NO: 1046829 - DNA, 22 bp, Artificial Sequence
  chemically synthesized
ggtggccttaacaaaagcagtg

SEQ ID NO: 1046830 - DNA, 22 bp, Artificial Sequence
  chemically synthesized
aacaaaagcagtgggaattcag

SEQ ID NO: 1046831 - DNA, 22 bp, Artificial Sequence
  chemically synthesized
acaaaagcagtgggaattcaga

SEQ ID NO: 1046832 - DNA, 22 bp, Artificial Sequence
  chemically synthesized
agaaaagttttgatgcatgtcc

SEQ ID NO: 1046833 - DNA, 22 bp, Artificial Sequence
  chemically synthesized
agaaaaagtgatgaggacatgc

SEQ ID NO: 1046834 - DNA, 22 bp, Artificial Sequence
  chemically synthesized
aagaaaaagtgatgaggacatg

SEQ ID NO: 1046835 - DNA, 22 bp, Artificial Sequence
  chemically synthesized
taagaaaaagtgatgaggacat

SEQ ID NO: 1046836 - DNA, 22 bp, Artificial Sequence
  chemically synthesized
ttaagaaaaagtgatgaggaca

SEQ ID NO: 1046837 - DNA, 22 bp, Artificial Sequence
  chemically synthesized
ttttaagaaaaagtgatgagga

SEQ ID NO: 1046838 - DNA, 22 bp, Artificial Sequence
  chemically synthesized
cttttaagaaaaagtgatgagg

SEQ ID NO: 1046839 - DNA, 22 bp, Artificial Sequence
  chemically synthesized
tcttttaagaaaaagtgatgag

SEQ ID NO: 1046840 - DNA, 22 bp, Artificial Sequence
  chemically synthesized
tgatgcatgtcctcatcacttt

SEQ ID NO: 1046841 - DNA, 22 bp, Artificial Sequence
  chemically synthesized
ttcttttaagaaaaagtgatga

SEQ ID NO: 1046842 - DNA, 22 bp, Artificial Sequence
  chemically synthesized
gatgcatgtcctcatcactttt

SEQ ID NO: 1046843 - DNA, 22 bp, Artificial Sequence
  chemically synthesized
atgcatgtcctcatcacttttt

SEQ ID NO: 1046844 - DNA, 22 bp, Artificial Sequence
  chemically synthesized
tttttcttttaagaaaaagtga

SEQ ID NO: 1046845 - DNA, 22 bp, Artificial Sequence
  chemically synthesized
gaattatttttcttttaagaaa

SEQ ID NO: 1046846 - DNA, 22 bp, Artificial Sequence
  chemically synthesized
agaattatttttcttttaagaa

SEQ ID NO: 1046847 - DNA, 22 bp, Artificial Sequence
  chemically synthesized
atcactttttcttaaaagaaaa

SEQ ID NO: 1046848 - DNA, 22 bp, Artificial Sequence
  chemically synthesized
tttcttaaaagaaaaataattc

SEQ ID NO: 1046849 - DNA, 22 bp, Artificial Sequence
  chemically synthesized
ttcttaaaagaaaaataattct

SEQ ID NO: 1046850 - DNA, 22 bp, Artificial Sequence
  chemically synthesized
tcttaaaagaaaaataattcta

SEQ ID NO: 1046851 - DNA, 22 bp, Artificial Sequence
  chemically synthesized
cttaaaagaaaaataattctaa

SEQ ID NO: 1046852 - DNA, 22 bp, Artificial Sequence
  chemically synthesized
ttaaaagaaaaataattctaag

SEQ ID NO: 1046853 - DNA, 22 bp, Artificial Sequence
  chemically synthesized
aaaagaaaaataattctaagat

SEQ ID NO: 1046854 - DNA, 22 bp, Artificial Sequence
  chemically synthesized
aaagaaaaataattctaagatg

SEQ ID NO: 1046855 - DNA, 22 bp, Artificial Sequence
  chemically synthesized
taagatgtttttatctattttc

SEQ ID NO: 1046856 - DNA, 22 bp, Artificial Sequence
  chemically synthesized
agatgtttttatctattttctg

SEQ ID NO: 1046857 - DNA, 22 bp, Artificial Sequence
  chemically synthesized
catatcaaagaagaatcagaaa

SEQ ID NO: 1046858 - DNA, 22 bp, Artificial Sequence
  chemically synthesized
ttatctattttctgattcttct

SEQ ID NO: 1046859 - DNA, 22 bp, Artificial Sequence
  chemically synthesized
tatctattttctgattcttctt

SEQ ID NO: 1046860 - DNA, 22 bp, Artificial Sequence
  chemically synthesized
atctattttctgattcttcttt

SEQ ID NO: 1046861 - DNA, 22 bp, Artificial Sequence
  chemically synthesized
tctattttctgattcttctttg

SEQ ID NO: 1046862 - DNA, 22 bp, Artificial Sequence
  chemically synthesized
agaaaactacatatcaaagaag

SEQ ID NO: 1046863 - DNA, 22 bp, Artificial Sequence
  chemically synthesized
ttttctgattcttctttgatat

SEQ ID NO: 1046864 - DNA, 22 bp, Artificial Sequence
  chemically synthesized
tctgattcttctttgatatgta

SEQ ID NO: 1046865 - DNA, 22 bp, Artificial Sequence
  chemically synthesized
ctgattcttctttgatatgtag

SEQ ID NO: 1046866 - DNA, 22 bp, Artificial Sequence
  chemically synthesized
tgattcttctttgatatgtagt

SEQ ID NO: 1046867 - DNA, 22 bp, Artificial Sequence
  chemically synthesized
attcttctttgatatgtagttt

SEQ ID NO: 1046868 - DNA, 22 bp, Artificial Sequence
  chemically synthesized
ttctttgatatgtagttttctc

SEQ ID NO: 1046869 - DNA, 22 bp, Artificial Sequence
  chemically synthesized
ctttgatatgtagttttctcag

SEQ ID NO: 1046870 - DNA, 22 bp, Artificial Sequence
  chemically synthesized
tttgatatgtagttttctcagt

SEQ ID NO: 1046871 - DNA, 22 bp, Artificial Sequence
  chemically synthesized
tgatatgtagttttctcagtct

SEQ ID NO: 1046872 - DNA, 22 bp, Artificial Sequence
  chemically synthesized
gatatgtagttttctcagtctt

SEQ ID NO: 1046873 - DNA, 22 bp, Artificial Sequence
  chemically synthesized
atatgtagttttctcagtcttc

SEQ ID NO: 1046874 - DNA, 22 bp, Artificial Sequence
  chemically synthesized
aaatgaaagtaatgaagactga

SEQ ID NO: 1046875 - DNA, 22 bp, Artificial Sequence
  chemically synthesized
tctcagtcttcattactttcat

SEQ ID NO: 1046876 - DNA, 22 bp, Artificial Sequence
  chemically synthesized
agagcatctcaaatgaaagtaa

SEQ ID NO: 1046877 - DNA, 22 bp, Artificial Sequence
  chemically synthesized
ctcagtcttcattactttcatt

SEQ ID NO: 1046878 - DNA, 22 bp, Artificial Sequence
  chemically synthesized
tcagtcttcattactttcattt

SEQ ID NO: 1046879 - DNA, 22 bp, Artificial Sequence
  chemically synthesized
agtcttcattactttcatttga

SEQ ID NO: 1046880 - DNA, 22 bp, Artificial Sequence
  chemically synthesized
agatagctgagagcatctcaaa

SEQ ID NO: 1046881 - DNA, 22 bp, Artificial Sequence
  chemically synthesized
cattactttcatttgagatgct

SEQ ID NO: 1046882 - DNA, 22 bp, Artificial Sequence
  chemically synthesized
aagatagctgagagcatctcaa

SEQ ID NO: 1046883 - DNA, 22 bp, Artificial Sequence
  chemically synthesized
attactttcatttgagatgctc

SEQ ID NO: 1046884 - DNA, 22 bp, Artificial Sequence
  chemically synthesized
ctttcatttgagatgctctcag

SEQ ID NO: 1046885 - DNA, 22 bp, Artificial Sequence
  chemically synthesized
tcatttgagatgctctcagcta

SEQ ID NO: 1046886 - DNA, 22 bp, Artificial Sequence
  chemically synthesized
catttgagatgctctcagctat

SEQ ID NO: 1046887 - DNA, 22 bp, Artificial Sequence
  chemically synthesized
atttgagatgctctcagctatc

SEQ ID NO: 1046888 - DNA, 22 bp, Artificial Sequence
  chemically synthesized
gagatgctctcagctatcttaa

SEQ ID NO: 1046889 - DNA, 22 bp, Artificial Sequence
  chemically synthesized
agatgctctcagctatcttaaa

SEQ ID NO: 1046890 - DNA, 22 bp, Artificial Sequence
  chemically synthesized
agcaccaatatgaatttaagat

SEQ ID NO: 1046891 - DNA, 22 bp, Artificial Sequence
  chemically synthesized
ttaagcaccaatatgaatttaa

SEQ ID NO: 1046892 - DNA, 22 bp, Artificial Sequence
  chemically synthesized
attaagcaccaatatgaattta

SEQ ID NO: 1046893 - DNA, 22 bp, Artificial Sequence
  chemically synthesized
tcagctatcttaaattcatatt

SEQ ID NO: 1046894 - DNA, 22 bp, Artificial Sequence
  chemically synthesized
agctatcttaaattcatattgg

SEQ ID NO: 1046895 - DNA, 22 bp, Artificial Sequence
  chemically synthesized
tatttattaagcaccaatatga

SEQ ID NO: 1046896 - DNA, 22 bp, Artificial Sequence
  chemically synthesized
ctatatttattaagcaccaata

SEQ ID NO: 1046897 - DNA, 22 bp, Artificial Sequence
  chemically synthesized
tcttaaattcatattggtgctt

SEQ ID NO: 1046898 - DNA, 22 bp, Artificial Sequence
  chemically synthesized
aaattcatattggtgcttaata

SEQ ID NO: 1046899 - DNA, 22 bp, Artificial Sequence
  chemically synthesized
aattcatattggtgcttaataa

SEQ ID NO: 1046900 - DNA, 22 bp, Artificial Sequence
  chemically synthesized
atattggtgcttaataaatata

SEQ ID NO: 1046901 - DNA, 22 bp, Artificial Sequence
  chemically synthesized
taatccacaattactatattta

SEQ ID NO: 1046902 - DNA, 22 bp, Artificial Sequence
  chemically synthesized
gtgcttaataaatatagtaatt

SEQ ID NO: 1046903 - DNA, 22 bp, Artificial Sequence
  chemically synthesized
gctataatccacaattactata

SEQ ID NO: 1046904 - DNA, 22 bp, Artificial Sequence
  chemically synthesized
ctggctataatccacaattact

SEQ ID NO: 1046905 - DNA, 22 bp, Artificial Sequence
  chemically synthesized
gctggctataatccacaattac

SEQ ID NO: 1046906 - DNA, 22 bp, Artificial Sequence
  chemically synthesized
aataaatatagtaattgtggat

SEQ ID NO: 1046907 - DNA, 22 bp, Artificial Sequence
  chemically synthesized
ttgctggctataatccacaatt

SEQ ID NO: 1046908 - DNA, 22 bp, Artificial Sequence
  chemically synthesized
ataaatatagtaattgtggatt

SEQ ID NO: 1046909 - DNA, 22 bp, Artificial Sequence
  chemically synthesized
cttgctggctataatccacaat

SEQ ID NO: 1046910 - DNA, 22 bp, Artificial Sequence
  chemically synthesized
agtttcttgctggctataatcc

SEQ ID NO: 1046911 - DNA, 22 bp, Artificial Sequence
  chemically synthesized
tggattatagccagcaagaaac

SEQ ID NO: 1046912 - DNA, 22 bp, Artificial Sequence
  chemically synthesized
accatacagctaagtttcttgc

SEQ ID NO: 1046913 - DNA, 22 bp, Artificial Sequence
  chemically synthesized
gaccatacagctaagtttcttg

SEQ ID NO: 1046914 - DNA, 22 bp, Artificial Sequence
  chemically synthesized
tagccagcaagaaacttagctg

SEQ ID NO: 1046915 - DNA, 22 bp, Artificial Sequence
  chemically synthesized
tatttgaccatacagctaagtt

SEQ ID NO: 1046916 - DNA, 22 bp, Artificial Sequence
  chemically synthesized
attatatttgaccatacagcta

SEQ ID NO: 1046917 - DNA, 22 bp, Artificial Sequence
  chemically synthesized
cattatatttgaccatacagct

SEQ ID NO: 1046918 - DNA, 22 bp, Artificial Sequence
  chemically synthesized
ttcattatatttgaccatacag

SEQ ID NO: 1046919 - DNA, 22 bp, Artificial Sequence
  chemically synthesized
cttcattatatttgaccataca

SEQ ID NO: 1046920 - DNA, 22 bp, Artificial Sequence
  chemically synthesized
tcttcattatatttgaccatac

SEQ ID NO: 1046921 - DNA, 22 bp, Artificial Sequence
  chemically synthesized
ttcttcattatatttgaccata

SEQ ID NO: 1046922 - DNA, 22 bp, Artificial Sequence
  chemically synthesized
tttcttcattatatttgaccat

SEQ ID NO: 1046923 - DNA, 22 bp, Artificial Sequence
  chemically synthesized
agctgtatggtcaaatataatg

SEQ ID NO: 1046924 - DNA, 22 bp, Artificial Sequence
  chemically synthesized
gctgtatggtcaaatataatga

SEQ ID NO: 1046925 - DNA, 22 bp, Artificial Sequence
  chemically synthesized
agtgtctttttcttcattatat

SEQ ID NO: 1046926 - DNA, 22 bp, Artificial Sequence
  chemically synthesized
gagtgtctttttcttcattata

SEQ ID NO: 1046927 - DNA, 22 bp, Artificial Sequence
  chemically synthesized
tgagtgtctttttcttcattat

SEQ ID NO: 1046928 - DNA, 22 bp, Artificial Sequence
  chemically synthesized
tatggtcaaatataatgaagaa

SEQ ID NO: 1046929 - DNA, 22 bp, Artificial Sequence
  chemically synthesized
gcagacaaaagtgagtatattt

SEQ ID NO: 1046930 - DNA, 22 bp, Artificial Sequence
  chemically synthesized
aaaatatactcacttttgtctg

SEQ ID NO: 1046931 - DNA, 22 bp, Artificial Sequence
  chemically synthesized
aatacaagttagcagacaaaag

SEQ ID NO: 1046932 - DNA, 22 bp, Artificial Sequence
  chemically synthesized
aggaagttaaatacaagttagc

SEQ ID NO: 1046933 - DNA, 22 bp, Artificial Sequence
  chemically synthesized
aaggaagttaaatacaagttag

SEQ ID NO: 1046934 - DNA, 22 bp, Artificial Sequence
  chemically synthesized
acttttgtctgctaacttgtat

SEQ ID NO: 1046935 - DNA, 22 bp, Artificial Sequence
  chemically synthesized
atttaaggaagttaaatacaag

SEQ ID NO: 1046936 - DNA, 22 bp, Artificial Sequence
  chemically synthesized
ttgtctgctaacttgtatttaa

SEQ ID NO: 1046937 - DNA, 22 bp, Artificial Sequence
  chemically synthesized
catttaaggaagttaaatacaa

SEQ ID NO: 1046938 - DNA, 22 bp, Artificial Sequence
  chemically synthesized
tgtctgctaacttgtatttaac

SEQ ID NO: 1046939 - DNA, 22 bp, Artificial Sequence
  chemically synthesized
gtctgctaacttgtatttaact

SEQ ID NO: 1046940 - DNA, 22 bp, Artificial Sequence
  chemically synthesized
tctgctaacttgtatttaactt

SEQ ID NO: 1046941 - DNA, 22 bp, Artificial Sequence
  chemically synthesized
aaatttcatttaaggaagttaa

SEQ ID NO: 1046942 - DNA, 22 bp, Artificial Sequence
  chemically synthesized
ctaacttgtatttaacttcctt

SEQ ID NO: 1046943 - DNA, 22 bp, Artificial Sequence
  chemically synthesized
gaaatttcatttaaggaagtta

SEQ ID NO: 1046944 - DNA, 22 bp, Artificial Sequence
  chemically synthesized
acttgtatttaacttccttaaa

SEQ ID NO: 1046945 - DNA, 22 bp, Artificial Sequence
  chemically synthesized
ggtttgaaatttcatttaagga

SEQ ID NO: 1046946 - DNA, 22 bp, Artificial Sequence
  chemically synthesized
gggtttgaaatttcatttaagg

SEQ ID NO: 1046947 - DNA, 22 bp, Artificial Sequence
  chemically synthesized
gtatttaacttccttaaatgaa

SEQ ID NO: 1046948 - DNA, 22 bp, Artificial Sequence
  chemically synthesized
tatttaacttccttaaatgaaa

SEQ ID NO: 1046949 - DNA, 22 bp, Artificial Sequence
  chemically synthesized
aacttccttaaatgaaatttca

SEQ ID NO: 1046950 - DNA, 22 bp, Artificial Sequence
  chemically synthesized
acttccttaaatgaaatttcaa

SEQ ID NO: 1046951 - DNA, 22 bp, Artificial Sequence
  chemically synthesized
ccttaaatgaaatttcaaaccc

SEQ ID NO: 1046952 - DNA, 22 bp, Artificial Sequence
  chemically synthesized
cttaaatgaaatttcaaaccca

SEQ ID NO: 1046953 - DNA, 22 bp, Artificial Sequence
  chemically synthesized
aaatgaaatttcaaacccaaat

SEQ ID NO: 1046954 - DNA, 22 bp, Artificial Sequence
  chemically synthesized
aatgaaatttcaaacccaaatt

SEQ ID NO: 1046955 - DNA, 22 bp, Artificial Sequence
  chemically synthesized
caaataccaaaatagtcaaaat

SEQ ID NO: 1046956 - DNA, 22 bp, Artificial Sequence
  chemically synthesized
tgcaaataccaaaatagtcaaa

SEQ ID NO: 1046957 - DNA, 22 bp, Artificial Sequence
  chemically synthesized
caaacccaaattttgactattt

SEQ ID NO: 1046958 - DNA, 22 bp, Artificial Sequence
  chemically synthesized
ctgcaaataccaaaatagtcaa

SEQ ID NO: 1046959 - DNA, 22 bp, Artificial Sequence
  chemically synthesized
aaacccaaattttgactatttt

SEQ ID NO: 1046960 - DNA, 22 bp, Artificial Sequence
  chemically synthesized
tctgcaaataccaaaatagtca

SEQ ID NO: 1046961 - DNA, 22 bp, Artificial Sequence
  chemically synthesized
ctttctgcaaataccaaaatag

SEQ ID NO: 1046962 - DNA, 22 bp, Artificial Sequence
  chemically synthesized
acgttcctttctgcaaatacca

SEQ ID NO: 1046963 - DNA, 22 bp, Artificial Sequence
  chemically synthesized
aacgttcctttctgcaaatacc

SEQ ID NO: 1046964 - DNA, 22 bp, Artificial Sequence
  chemically synthesized
tgactattttggtatttgcaga

SEQ ID NO: 1046965 - DNA, 22 bp, Artificial Sequence
  chemically synthesized
gactattttggtatttgcagaa

SEQ ID NO: 1046966 - DNA, 22 bp, Artificial Sequence
  chemically synthesized
tttaacgttcctttctgcaaat

SEQ ID NO: 1046967 - DNA, 22 bp, Artificial Sequence
  chemically synthesized
actattttggtatttgcagaaa

SEQ ID NO: 1046968 - DNA, 22 bp, Artificial Sequence
  chemically synthesized
atttaacgttcctttctgcaaa

SEQ ID NO: 1046969 - DNA, 22 bp, Artificial Sequence
  chemically synthesized
tatttaacgttcctttctgcaa

SEQ ID NO: 1046970 - DNA, 22 bp, Artificial Sequence
  chemically synthesized
ttatttaacgttcctttctgca

SEQ ID NO: 1046971 - DNA, 22 bp, Artificial Sequence
  chemically synthesized
ttttggtatttgcagaaaggaa

SEQ ID NO: 1046972 - DNA, 22 bp, Artificial Sequence
  chemically synthesized
atttttatttaacgttcctttc

SEQ ID NO: 1046973 - DNA, 22 bp, Artificial Sequence
  chemically synthesized
tggtatttgcagaaaggaacgt

SEQ ID NO: 1046974 - DNA, 22 bp, Artificial Sequence
  chemically synthesized
ggtatttgcagaaaggaacgtt

SEQ ID NO: 1046975 - DNA, 22 bp, Artificial Sequence
  chemically synthesized
gtatttgcagaaaggaacgtta

SEQ ID NO: 1046976 - DNA, 22 bp, Artificial Sequence
  chemically synthesized
gcagaaaggaacgttaaataaa

SEQ ID NO: 1046977 - DNA, 22 bp, Artificial Sequence
  chemically synthesized
gcaaatctcatttttatttaac

SEQ ID NO: 1046978 - DNA, 22 bp, Artificial Sequence
  chemically synthesized
cagaaaggaacgttaaataaaa

SEQ ID NO: 1046979 - DNA, 22 bp, Artificial Sequence
  chemically synthesized
attggcaaatctcatttttatt

SEQ ID NO: 1046980 - DNA, 22 bp, Artificial Sequence
  chemically synthesized
gattcattggcaaatctcattt

SEQ ID NO: 1046981 - DNA, 22 bp, Artificial Sequence
  chemically synthesized
ctggattcattggcaaatctca

SEQ ID NO: 1046982 - DNA, 22 bp, Artificial Sequence
  chemically synthesized
aataaaaatgagatttgccaat

SEQ ID NO: 1046983 - DNA, 22 bp, Artificial Sequence
  chemically synthesized
aaaagaccagctcctggattca

SEQ ID NO: 1046984 - DNA, 22 bp, Artificial Sequence
  chemically synthesized
caaaagaccagctcctggattc

SEQ ID NO: 1046985 - DNA, 22 bp, Artificial Sequence
  chemically synthesized
tcaaaagaccagctcctggatt

SEQ ID NO: 1046986 - DNA, 22 bp, Artificial Sequence
  chemically synthesized
ttcaaaagaccagctcctggat

SEQ ID NO: 1046987 - DNA, 22 bp, Artificial Sequence
  chemically synthesized
gccaatgaatccaggagctggt

SEQ ID NO: 1046988 - DNA, 22 bp, Artificial Sequence
  chemically synthesized
ccaatgaatccaggagctggtc

SEQ ID NO: 1046989 - DNA, 22 bp, Artificial Sequence
  chemically synthesized
atcttttcaaaagaccagctcc

SEQ ID NO: 1046990 - DNA, 22 bp, Artificial Sequence
  chemically synthesized
ttaatcttttcaaaagaccagc

SEQ ID NO: 1046991 - DNA, 22 bp, Artificial Sequence
  chemically synthesized
gttaatcttttcaaaagaccag

SEQ ID NO: 1046992 - DNA, 22 bp, Artificial Sequence
  chemically synthesized
tgttaatcttttcaaaagacca

SEQ ID NO: 1046993 - DNA, 22 bp, Artificial Sequence
  chemically synthesized
ttttgttaatcttttcaaaaga

SEQ ID NO: 1046994 - DNA, 22 bp, Artificial Sequence
  chemically synthesized
tctattttgttaatcttttcaa

SEQ ID NO: 1046995 - DNA, 22 bp, Artificial Sequence
  chemically synthesized
gtcttttgaaaagattaacaaa

SEQ ID NO: 1046996 - DNA, 22 bp, Artificial Sequence
  chemically synthesized
gtggtctatctattttgttaat

SEQ ID NO: 1046997 - DNA, 22 bp, Artificial Sequence
  chemically synthesized
ttgaaaagattaacaaaataga

SEQ ID NO: 1046998 - DNA, 22 bp, Artificial Sequence
  chemically synthesized
gctagtggtctatctattttgt

SEQ ID NO: 1046999 - DNA, 22 bp, Artificial Sequence
  chemically synthesized
tgaaaagattaacaaaatagat

SEQ ID NO: 1047000 - DNA, 22 bp, Artificial Sequence
  chemically synthesized
gaaaagattaacaaaatagata

SEQ ID NO: 1047001 - DNA, 22 bp, Artificial Sequence
  chemically synthesized
aaaagattaacaaaatagatag

SEQ ID NO: 1047002 - DNA, 22 bp, Artificial Sequence
  chemically synthesized
gtctggctagtggtctatctat

SEQ ID NO: 1047003 - DNA, 22 bp, Artificial Sequence
  chemically synthesized
ttagtctggctagtggtctatc

SEQ ID NO: 1047004 - DNA, 22 bp, Artificial Sequence
  chemically synthesized
attagtctggctagtggtctat

SEQ ID NO: 1047005 - DNA, 22 bp, Artificial Sequence
  chemically synthesized
tattagtctggctagtggtcta

SEQ ID NO: 1047006 - DNA, 22 bp, Artificial Sequence
  chemically synthesized
acaaaatagatagaccactagc

SEQ ID NO: 1047007 - DNA, 22 bp, Artificial Sequence
  chemically synthesized
tttattagtctggctagtggtc

SEQ ID NO: 1047008 - DNA, 22 bp, Artificial Sequence
  chemically synthesized
ctttattagtctggctagtggt

SEQ ID NO: 1047009 - DNA, 22 bp, Artificial Sequence
  chemically synthesized
ttctttattagtctggctagtg

SEQ ID NO: 1047010 - DNA, 22 bp, Artificial Sequence
  chemically synthesized
cttctttattagtctggctagt

SEQ ID NO: 1047011 - DNA, 22 bp, Artificial Sequence
  chemically synthesized
tcttctttattagtctggctag

SEQ ID NO: 1047012 - DNA, 22 bp, Artificial Sequence
  chemically synthesized
ttcttctttattagtctggcta

SEQ ID NO: 1047013 - DNA, 22 bp, Artificial Sequence
  chemically synthesized
ttttcttctttattagtctggc

SEQ ID NO: 1047014 - DNA, 22 bp, Artificial Sequence
  chemically synthesized
tcttttcttctttattagtctg

SEQ ID NO: 1047015 - DNA, 22 bp, Artificial Sequence
  chemically synthesized
ctcttttcttctttattagtct

SEQ ID NO: 1047016 - DNA, 22 bp, Artificial Sequence
  chemically synthesized
tctcttttcttctttattagtc

SEQ ID NO: 1047017 - DNA, 22 bp, Artificial Sequence
  chemically synthesized
ttctcttttcttctttattagt

SEQ ID NO: 1047018 - DNA, 22 bp, Artificial Sequence
  chemically synthesized
ttttctcttttcttctttatta

SEQ ID NO: 1047019 - DNA, 22 bp, Artificial Sequence
  chemically synthesized
attcttttctcttttcttcttt

SEQ ID NO: 1047020 - DNA, 22 bp, Artificial Sequence
  chemically synthesized
gccagactaataaagaagaaaa

SEQ ID NO: 1047021 - DNA, 22 bp, Artificial Sequence
  chemically synthesized
gattcttttctcttttcttctt

SEQ ID NO: 1047022 - DNA, 22 bp, Artificial Sequence
  chemically synthesized
tgattcttttctcttttcttct

SEQ ID NO: 1047023 - DNA, 22 bp, Artificial Sequence
  chemically synthesized
tttgattcttttctcttttctt

SEQ ID NO: 1047024 - DNA, 22 bp, Artificial Sequence
  chemically synthesized
ataaagaagaaaagagaaaaga

SEQ ID NO: 1047025 - DNA, 22 bp, Artificial Sequence
  chemically synthesized
tgcctctttgattcttttctct

SEQ ID NO: 1047026 - DNA, 22 bp, Artificial Sequence
  chemically synthesized
ttgtgcctctttgattcttttc

SEQ ID NO: 1047027 - DNA, 22 bp, Artificial Sequence
  chemically synthesized
attgtgcctctttgattctttt

SEQ ID NO: 1047028 - DNA, 22 bp, Artificial Sequence
  chemically synthesized
tattgtgcctctttgattcttt

SEQ ID NO: 1047029 - DNA, 22 bp, Artificial Sequence
  chemically synthesized
ttattgtgcctctttgattctt

SEQ ID NO: 1047030 - DNA, 22 bp, Artificial Sequence
  chemically synthesized
tttattgtgcctctttgattct

SEQ ID NO: 1047031 - DNA, 22 bp, Artificial Sequence
  chemically synthesized
tcattttttattgtgcctcttt

SEQ ID NO: 1047032 - DNA, 22 bp, Artificial Sequence
  chemically synthesized
atcattttttattgtgcctctt

SEQ ID NO: 1047033 - DNA, 22 bp, Artificial Sequence
  chemically synthesized
tatcattttttattgtgcctct

SEQ ID NO: 1047034 - DNA, 22 bp, Artificial Sequence
  chemically synthesized
tgggatcggtggtgatatcccc

SEQ ID NO: 1047035 - DNA, 22 bp, Artificial Sequence
  chemically synthesized
tgtgggatcggtggtgatatcc

SEQ ID NO: 1047036 - DNA, 22 bp, Artificial Sequence
  chemically synthesized
ctgtgggatcggtggtgatatc

SEQ ID NO: 1047037 - DNA, 22 bp, Artificial Sequence
  chemically synthesized
tatttctgtgggatcggtggtg

SEQ ID NO: 1047038 - DNA, 22 bp, Artificial Sequence
  chemically synthesized
gtatttctgtgggatcggtggt

SEQ ID NO: 1047039 - DNA, 22 bp, Artificial Sequence
  chemically synthesized
atggtagtttgtatttctgtgg

SEQ ID NO: 1047040 - DNA, 22 bp, Artificial Sequence
  chemically synthesized
tgatggtagtttgtatttctgt

SEQ ID NO: 1047041 - DNA, 22 bp, Artificial Sequence
  chemically synthesized
tctgatggtagtttgtatttct

SEQ ID NO: 1047042 - DNA, 22 bp, Artificial Sequence
  chemically synthesized
atagtattctctgatggtagtt

SEQ ID NO: 1047043 - DNA, 22 bp, Artificial Sequence
  chemically synthesized
cgtagaggtgttgatagtattc

SEQ ID NO: 1047044 - DNA, 22 bp, Artificial Sequence
  chemically synthesized
gcgtagaggtgttgatagtatt

SEQ ID NO: 1047045 - DNA, 22 bp, Artificial Sequence
  chemically synthesized
ccatcagagaatactatcaaca

SEQ ID NO: 1047046 - DNA, 22 bp, Artificial Sequence
  chemically synthesized
tttgcgtagaggtgttgatagt

SEQ ID NO: 1047047 - DNA, 22 bp, Artificial Sequence
  chemically synthesized
atttgcgtagaggtgttgatag

SEQ ID NO: 1047048 - DNA, 22 bp, Artificial Sequence
  chemically synthesized
gtttatttgcgtagaggtgttg

SEQ ID NO: 1047049 - DNA, 22 bp, Artificial Sequence
  chemically synthesized
tagtttatttgcgtagaggtgt

SEQ ID NO: 1047050 - DNA, 22 bp, Artificial Sequence
  chemically synthesized
ctagtttatttgcgtagaggtg

SEQ ID NO: 1047051 - DNA, 22 bp, Artificial Sequence
  chemically synthesized
tctagtttatttgcgtagaggt

SEQ ID NO: 1047052 - DNA, 22 bp, Artificial Sequence
  chemically synthesized
gattttctagtttatttgcgta

SEQ ID NO: 1047053 - DNA, 22 bp, Artificial Sequence
  chemically synthesized
tcaacacctctacgcaaataaa

SEQ ID NO: 1047054 - DNA, 22 bp, Artificial Sequence
  chemically synthesized
tagattttctagtttatttgcg

SEQ ID NO: 1047055 - DNA, 22 bp, Artificial Sequence
  chemically synthesized
ctagattttctagtttatttgc

SEQ ID NO: 1047056 - DNA, 22 bp, Artificial Sequence
  chemically synthesized
tctagattttctagtttatttg

SEQ ID NO: 1047057 - DNA, 22 bp, Artificial Sequence
  chemically synthesized
ttctagattttctagtttattt

SEQ ID NO: 1047058 - DNA, 22 bp, Artificial Sequence
  chemically synthesized
tttctagattttctagtttatt

SEQ ID NO: 1047059 - DNA, 22 bp, Artificial Sequence
  chemically synthesized
tacgcaaataaactagaaaatc

SEQ ID NO: 1047060 - DNA, 22 bp, Artificial Sequence
  chemically synthesized
tccattttttctagattttcta

SEQ ID NO: 1047061 - DNA, 22 bp, Artificial Sequence
  chemically synthesized
cgcaaataaactagaaaatcta

SEQ ID NO: 1047062 - DNA, 22 bp, Artificial Sequence
  chemically synthesized
atccattttttctagattttct

SEQ ID NO: 1047063 - DNA, 22 bp, Artificial Sequence
  chemically synthesized
gaaaatctagaaaaaatggata

SEQ ID NO: 1047064 - DNA, 22 bp, Artificial Sequence
  chemically synthesized
gaaaaaatggataaattcctgg

SEQ ID NO: 1047065 - DNA, 22 bp, Artificial Sequence
  chemically synthesized
ggagggtgtatgtgtccaggaa

SEQ ID NO: 1047066 - DNA, 22 bp, Artificial Sequence
  chemically synthesized
gggagggtgtatgtgtccagga

SEQ ID NO: 1047067 - DNA, 22 bp, Artificial Sequence
  chemically synthesized
gtcttgggagggtgtatgtgtc

SEQ ID NO: 1047068 - DNA, 22 bp, Artificial Sequence
  chemically synthesized
agtcttgggagggtgtatgtgt

SEQ ID NO: 1047069 - DNA, 22 bp, Artificial Sequence
  chemically synthesized
gtttagtcttgggagggtgtat

SEQ ID NO: 1047070 - DNA, 22 bp, Artificial Sequence
  chemically synthesized
ctggtttagtcttgggagggtg

SEQ ID NO: 1047071 - DNA, 22 bp, Artificial Sequence
  chemically synthesized
ctggacacatacaccctcccaa

SEQ ID NO: 1047072 - DNA, 22 bp, Artificial Sequence
  chemically synthesized
cctggtttagtcttgggagggt

SEQ ID NO: 1047073 - DNA, 22 bp, Artificial Sequence
  chemically synthesized
ttcctggtttagtcttgggagg

SEQ ID NO: 1047074 - DNA, 22 bp, Artificial Sequence
  chemically synthesized
gacacatacaccctcccaagac

SEQ ID NO: 1047075 - DNA, 22 bp, Artificial Sequence
  chemically synthesized
cttcctggtttagtcttgggag

SEQ ID NO: 1047076 - DNA, 22 bp, Artificial Sequence
  chemically synthesized
aacttcttcctggtttagtctt

SEQ ID NO: 1047077 - DNA, 22 bp, Artificial Sequence
  chemically synthesized
agggattcaacttcttcctggt

SEQ ID NO: 1047078 - DNA, 22 bp, Artificial Sequence
  chemically synthesized
ccaagactaaaccaggaagaag

SEQ ID NO: 1047079 - DNA, 22 bp, Artificial Sequence
  chemically synthesized
ttcagggattcaacttcttcct

SEQ ID NO: 1047080 - DNA, 22 bp, Artificial Sequence
  chemically synthesized
gtctattcagggattcaacttc

SEQ ID NO: 1047081 - DNA, 22 bp, Artificial Sequence
  chemically synthesized
aaccaggaagaagttgaatccc

SEQ ID NO: 1047082 - DNA, 22 bp, Artificial Sequence
  chemically synthesized
ttggtctattcagggattcaac

SEQ ID NO: 1047083 - DNA, 22 bp, Artificial Sequence
  chemically synthesized
ttattggtctattcagggattc

SEQ ID NO: 1047084 - DNA, 22 bp, Artificial Sequence
  chemically synthesized
gttattggtctattcagggatt

SEQ ID NO: 1047085 - DNA, 22 bp, Artificial Sequence
  chemically synthesized
agaacttgttattggtctattc

SEQ ID NO: 1047086 - DNA, 22 bp, Artificial Sequence
  chemically synthesized
cagaacttgttattggtctatt

SEQ ID NO: 1047087 - DNA, 22 bp, Artificial Sequence
  chemically synthesized
aatccctgaatagaccaataac

SEQ ID NO: 1047088 - DNA, 22 bp, Artificial Sequence
  chemically synthesized
aatttcagaacttgttattggt

SEQ ID NO: 1047089 - DNA, 22 bp, Artificial Sequence
  chemically synthesized
cctcaatttcagaacttgttat

SEQ ID NO: 1047090 - DNA, 22 bp, Artificial Sequence
  chemically synthesized
aatagaccaataacaagttctg

SEQ ID NO: 1047091 - DNA, 22 bp, Artificial Sequence
  chemically synthesized
ctgcctcaatttcagaacttgt

SEQ ID NO: 1047092 - DNA, 22 bp, Artificial Sequence
  chemically synthesized
ttactgcctcaatttcagaact

SEQ ID NO: 1047093 - DNA, 22 bp, Artificial Sequence
  chemically synthesized
gtaggctattactgcctcaatt

SEQ ID NO: 1047094 - DNA, 22 bp, Artificial Sequence
  chemically synthesized
gttcgtaggctattactgcctc

SEQ ID NO: 1047095 - DNA, 22 bp, Artificial Sequence
  chemically synthesized
ggttcgtaggctattactgcct

SEQ ID NO: 1047096 - DNA, 22 bp, Artificial Sequence
  chemically synthesized
tggttcgtaggctattactgcc

SEQ ID NO: 1047097 - DNA, 22 bp, Artificial Sequence
  chemically synthesized
ttggttcgtaggctattactgc

SEQ ID NO: 1047098 - DNA, 22 bp, Artificial Sequence
  chemically synthesized
tttggttcgtaggctattactg

SEQ ID NO: 1047099 - DNA, 22 bp, Artificial Sequence
  chemically synthesized
tgaaattgaggcagtaatagcc

SEQ ID NO: 1047100 - DNA, 22 bp, Artificial Sequence
  chemically synthesized
ttttggttcgtaggctattact

SEQ ID NO: 1047101 - DNA, 22 bp, Artificial Sequence
  chemically synthesized
tttttggttcgtaggctattac

SEQ ID NO: 1047102 - DNA, 22 bp, Artificial Sequence
  chemically synthesized
aaattgaggcagtaatagccta

SEQ ID NO: 1047103 - DNA, 22 bp, Artificial Sequence
  chemically synthesized
ttttttggttcgtaggctatta

SEQ ID NO: 1047104 - DNA, 22 bp, Artificial Sequence
  chemically synthesized
tttttttggttcgtaggctatt

SEQ ID NO: 1047105 - DNA, 22 bp, Artificial Sequence
  chemically synthesized
ttttttttggttcgtaggctat

SEQ ID NO: 1047106 - DNA, 22 bp, Artificial Sequence
  chemically synthesized
tttttttttggttcgtaggcta

SEQ ID NO: 1047107 - DNA, 22 bp, Artificial Sequence
  chemically synthesized
ttttttttttggttcgtaggct

SEQ ID NO: 1047108 - DNA, 22 bp, Artificial Sequence
  chemically synthesized
tttttttttttggttcgtaggc

SEQ ID NO: 1047109 - DNA, 22 bp, Artificial Sequence
  chemically synthesized
aggcagtaatagcctacgaacc

SEQ ID NO: 1047110 - DNA, 22 bp, Artificial Sequence
  chemically synthesized
ttttttttttttggttcgtagg

SEQ ID NO: 1047111 - DNA, 22 bp, Artificial Sequence
  chemically synthesized
tttttttttttttggttcgtag

SEQ ID NO: 1047112 - DNA, 22 bp, Artificial Sequence
  chemically synthesized
ttttttttttttttggttcgta

SEQ ID NO: 1047113 - DNA, 22 bp, Artificial Sequence
  chemically synthesized
tttttttttttttttggttcgt

SEQ ID NO: 1047114 - DNA, 22 bp, Artificial Sequence
  chemically synthesized
ttttttttttttttttggttcg

SEQ ID NO: 1047115 - DNA, 22 bp, Artificial Sequence
  chemically synthesized
tttttttttttttttttggttc

SEQ ID NO: 1047116 - DNA, 22 bp, Artificial Sequence
  chemically synthesized
ttttttttttttttttttggtt

SEQ ID NO: 1047117 - DNA, 22 bp, Artificial Sequence
  chemically synthesized
tttttttttttttttttttggt

SEQ ID NO: 1047118 - DNA, 22 bp, Artificial Sequence
  chemically synthesized
ttttttttttttttttttttgg

SEQ ID NO: 1047119 - DNA, 22 bp, Artificial Sequence
  chemically synthesized
ggcttttttttttttttttttt

SEQ ID NO: 1047120 - DNA, 22 bp, Artificial Sequence
  chemically synthesized
cgaaccaaaaaaaaaaaaaaaa

SEQ ID NO: 1047121 - DNA, 22 bp, Artificial Sequence
  chemically synthesized
gtcctgggcttttttttttttt

SEQ ID NO: 1047122 - DNA, 22 bp, Artificial Sequence
  chemically synthesized
tgaatccgtctggtcctgggct

SEQ ID NO: 1047123 - DNA, 22 bp, Artificial Sequence
  chemically synthesized
agctgtgaatccgtctggtcct

SEQ ID NO: 1047124 - DNA, 22 bp, Artificial Sequence
  chemically synthesized
gtagaattcagctgtgaatccg

SEQ ID NO: 1047125 - DNA, 22 bp, Artificial Sequence
  chemically synthesized
tggtagaattcagctgtgaatc

SEQ ID NO: 1047126 - DNA, 22 bp, Artificial Sequence
  chemically synthesized
tatctctggtagaattcagctg

SEQ ID NO: 1047127 - DNA, 22 bp, Artificial Sequence
  chemically synthesized
gtatctctggtagaattcagct

SEQ ID NO: 1047128 - DNA, 22 bp, Artificial Sequence
  chemically synthesized
tgtatctctggtagaattcagc

SEQ ID NO: 1047129 - DNA, 22 bp, Artificial Sequence
  chemically synthesized
tttgtatctctggtagaattca

SEQ ID NO: 1047130 - DNA, 22 bp, Artificial Sequence
  chemically synthesized
ctctttgtatctctggtagaat

SEQ ID NO: 1047131 - DNA, 22 bp, Artificial Sequence
  chemically synthesized
acagctgaattctaccagagat

SEQ ID NO: 1047132 - DNA, 22 bp, Artificial Sequence
  chemically synthesized
aattctaccagagatacaaaga

SEQ ID NO: 1047133 - DNA, 22 bp, Artificial Sequence
  chemically synthesized
taccagagatacaaagaggagc

SEQ ID NO: 1047134 - DNA, 22 bp, Artificial Sequence
  chemically synthesized
ccagagatacaaagaggagctg

SEQ ID NO: 1047135 - DNA, 22 bp, Artificial Sequence
  chemically synthesized
gagggaatggtaccagctcctc

SEQ ID NO: 1047136 - DNA, 22 bp, Artificial Sequence
  chemically synthesized
agagggaatggtaccagctcct

SEQ ID NO: 1047137 - DNA, 22 bp, Artificial Sequence
  chemically synthesized
tagagggaatggtaccagctcc

SEQ ID NO: 1047138 - DNA, 22 bp, Artificial Sequence
  chemically synthesized
gaatagttttagagggaatggt

SEQ ID NO: 1047139 - DNA, 22 bp, Artificial Sequence
  chemically synthesized
ggaatagttttagagggaatgg

SEQ ID NO: 1047140 - DNA, 22 bp, Artificial Sequence
  chemically synthesized
cttggaatagttttagagggaa

SEQ ID NO: 1047141 - DNA, 22 bp, Artificial Sequence
  chemically synthesized
tattgcttggaatagttttaga

SEQ ID NO: 1047142 - DNA, 22 bp, Artificial Sequence
  chemically synthesized
gtaccattccctctaaaactat

SEQ ID NO: 1047143 - DNA, 22 bp, Artificial Sequence
  chemically synthesized
gtattgcttggaatagttttag

SEQ ID NO: 1047144 - DNA, 22 bp, Artificial Sequence
  chemically synthesized
tgtattgcttggaatagtttta

SEQ ID NO: 1047145 - DNA, 22 bp, Artificial Sequence
  chemically synthesized
ttgtattgcttggaatagtttt

SEQ ID NO: 1047146 - DNA, 22 bp, Artificial Sequence
  chemically synthesized
ttttgtattgcttggaatagtt

SEQ ID NO: 1047147 - DNA, 22 bp, Artificial Sequence
  chemically synthesized
cttttgtattgcttggaatagt

SEQ ID NO: 1047148 - DNA, 22 bp, Artificial Sequence
  chemically synthesized
tcttttgtattgcttggaatag

SEQ ID NO: 1047149 - DNA, 22 bp, Artificial Sequence
  chemically synthesized
cctctaaaactattccaagcaa

SEQ ID NO: 1047150 - DNA, 22 bp, Artificial Sequence
  chemically synthesized
ttttcttttgtattgcttggaa

SEQ ID NO: 1047151 - DNA, 22 bp, Artificial Sequence
  chemically synthesized
attttcttttgtattgcttgga

SEQ ID NO: 1047152 - DNA, 22 bp, Artificial Sequence
  chemically synthesized
taaaactattccaagcaataca

SEQ ID NO: 1047153 - DNA, 22 bp, Artificial Sequence
  chemically synthesized
aaactattccaagcaatacaaa

SEQ ID NO: 1047154 - DNA, 22 bp, Artificial Sequence
  chemically synthesized
ttccaagcaatacaaaagaaaa

SEQ ID NO: 1047155 - DNA, 22 bp, Artificial Sequence
  chemically synthesized
gggaagaatttattttcttttg

SEQ ID NO: 1047156 - DNA, 22 bp, Artificial Sequence
  chemically synthesized
caagcaatacaaaagaaaataa

SEQ ID NO: 1047157 - DNA, 22 bp, Artificial Sequence
  chemically synthesized
ataaaaagagttagggaagaat

SEQ ID NO: 1047158 - DNA, 22 bp, Artificial Sequence
  chemically synthesized
gcctcataaaaagagttaggga

SEQ ID NO: 1047159 - DNA, 22 bp, Artificial Sequence
  chemically synthesized
ctggcctcataaaaagagttag

SEQ ID NO: 1047160 - DNA, 22 bp, Artificial Sequence
  chemically synthesized
ttccctaactctttttatgagg

SEQ ID NO: 1047161 - DNA, 22 bp, Artificial Sequence
  chemically synthesized
ccctaactctttttatgaggcc

SEQ ID NO: 1047162 - DNA, 22 bp, Artificial Sequence
  chemically synthesized
cctaactctttttatgaggcca

SEQ ID NO: 1047163 - DNA, 22 bp, Artificial Sequence
  chemically synthesized
gtatcaggatgctgctggcctc

SEQ ID NO: 1047164 - DNA, 22 bp, Artificial Sequence
  chemically synthesized
actctttttatgaggccagcag

SEQ ID NO: 1047165 - DNA, 22 bp, Artificial Sequence
  chemically synthesized
ggtatcaggatgctgctggcct

SEQ ID NO: 1047166 - DNA, 22 bp, Artificial Sequence
  chemically synthesized
tggtatcaggatgctgctggcc

SEQ ID NO: 1047167 - DNA, 22 bp, Artificial Sequence
  chemically synthesized
tttttatgaggccagcagcatc

SEQ ID NO: 1047168 - DNA, 22 bp, Artificial Sequence
  chemically synthesized
tttatgaggccagcagcatcct

SEQ ID NO: 1047169 - DNA, 22 bp, Artificial Sequence
  chemically synthesized
ttatgaggccagcagcatcctg

SEQ ID NO: 1047170 - DNA, 22 bp, Artificial Sequence
  chemically synthesized
tatgaggccagcagcatcctga

SEQ ID NO: 1047171 - DNA, 22 bp, Artificial Sequence
  chemically synthesized
atgaggccagcagcatcctgat

SEQ ID NO: 1047172 - DNA, 22 bp, Artificial Sequence
  chemically synthesized
ccaggttttggtatcaggatgc

SEQ ID NO: 1047173 - DNA, 22 bp, Artificial Sequence
  chemically synthesized
tgaggccagcagcatcctgata

SEQ ID NO: 1047174 - DNA, 22 bp, Artificial Sequence
  chemically synthesized
gccaggttttggtatcaggatg

SEQ ID NO: 1047175 - DNA, 22 bp, Artificial Sequence
  chemically synthesized
tgccaggttttggtatcaggat

SEQ ID NO: 1047176 - DNA, 22 bp, Artificial Sequence
  chemically synthesized
tgtctttgccaggttttggtat

SEQ ID NO: 1047177 - DNA, 22 bp, Artificial Sequence
  chemically synthesized
ttgtgtctttgccaggttttgg

SEQ ID NO: 1047178 - DNA, 22 bp, Artificial Sequence
  chemically synthesized
gttgtgtctttgccaggttttg

SEQ ID NO: 1047179 - DNA, 22 bp, Artificial Sequence
  chemically synthesized
tgttgtgtctttgccaggtttt

SEQ ID NO: 1047180 - DNA, 22 bp, Artificial Sequence
  chemically synthesized
ttgttgtgtctttgccaggttt

SEQ ID NO: 1047181 - DNA, 22 bp, Artificial Sequence
  chemically synthesized
tttgttgtgtctttgccaggtt

SEQ ID NO: 1047182 - DNA, 22 bp, Artificial Sequence
  chemically synthesized
ttttgttgtgtctttgccaggt

SEQ ID NO: 1047183 - DNA, 22 bp, Artificial Sequence
  chemically synthesized
ttttttgttgtgtctttgccag

SEQ ID NO: 1047184 - DNA, 22 bp, Artificial Sequence
  chemically synthesized
cttttttgttgtgtctttgcca

SEQ ID NO: 1047185 - DNA, 22 bp, Artificial Sequence
  chemically synthesized
ataccaaaacctggcaaagaca

SEQ ID NO: 1047186 - DNA, 22 bp, Artificial Sequence
  chemically synthesized
tcttttttgttgtgtctttgcc

SEQ ID NO: 1047187 - DNA, 22 bp, Artificial Sequence
  chemically synthesized
aggattttcttttttgttgtgt

SEQ ID NO: 1047188 - DNA, 22 bp, Artificial Sequence
  chemically synthesized
ttgaggattttcttttttgttg

SEQ ID NO: 1047189 - DNA, 22 bp, Artificial Sequence
  chemically synthesized
attgaggattttcttttttgtt

SEQ ID NO: 1047190 - DNA, 22 bp, Artificial Sequence
  chemically synthesized
tattgaggattttcttttttgt

SEQ ID NO: 1047191 - DNA, 22 bp, Artificial Sequence
  chemically synthesized
gcaaagacacaacaaaaaagaa

SEQ ID NO: 1047192 - DNA, 22 bp, Artificial Sequence
  chemically synthesized
ccagtattttattgaggatttt

SEQ ID NO: 1047193 - DNA, 22 bp, Artificial Sequence
  chemically synthesized
gccagtattttattgaggattt

SEQ ID NO: 1047194 - DNA, 22 bp, Artificial Sequence
  chemically synthesized
gtttgccagtattttattgagg

SEQ ID NO: 1047195 - DNA, 22 bp, Artificial Sequence
  chemically synthesized
ggtttgccagtattttattgag

SEQ ID NO: 1047196 - DNA, 22 bp, Artificial Sequence
  chemically synthesized
gatttggtttgccagtatttta

SEQ ID NO: 1047197 - DNA, 22 bp, Artificial Sequence
  chemically synthesized
ctggatttggtttgccagtatt

SEQ ID NO: 1047198 - DNA, 22 bp, Artificial Sequence
  chemically synthesized
aataaaatactggcaaaccaaa

SEQ ID NO: 1047199 - DNA, 22 bp, Artificial Sequence
  chemically synthesized
atgtgctactggatttggtttg

SEQ ID NO: 1047200 - DNA, 22 bp, Artificial Sequence
  chemically synthesized
aatgtgctactggatttggttt

SEQ ID NO: 1047201 - DNA, 22 bp, Artificial Sequence
  chemically synthesized
taatgtgctactggatttggtt

SEQ ID NO: 1047202 - DNA, 22 bp, Artificial Sequence
  chemically synthesized
ttaatgtgctactggatttggt

SEQ ID NO: 1047203 - DNA, 22 bp, Artificial Sequence
  chemically synthesized
tttaatgtgctactggatttgg

SEQ ID NO: 1047204 - DNA, 22 bp, Artificial Sequence
  chemically synthesized
gcaaaccaaatccagtagcaca

SEQ ID NO: 1047205 - DNA, 22 bp, Artificial Sequence
  chemically synthesized
tgatggatatgctttttaatgt

SEQ ID NO: 1047206 - DNA, 22 bp, Artificial Sequence
  chemically synthesized
attgtgatggatatgcttttta

SEQ ID NO: 1047207 - DNA, 22 bp, Artificial Sequence
  chemically synthesized
gattgtgatggatatgcttttt

SEQ ID NO: 1047208 - DNA, 22 bp, Artificial Sequence
  chemically synthesized
cttgattgtgatggatatgctt

SEQ ID NO: 1047209 - DNA, 22 bp, Artificial Sequence
  chemically synthesized
aaaagcatatccatcacaatca

SEQ ID NO: 1047210 - DNA, 22 bp, Artificial Sequence
  chemically synthesized
catcccagggatgaagcctact

SEQ ID NO: 1047211 - DNA, 22 bp, Artificial Sequence
  chemically synthesized
gcatcccagggatgaagcctac

SEQ ID NO: 1047212 - DNA, 22 bp, Artificial Sequence
  chemically synthesized
tgcatcccagggatgaagccta

SEQ ID NO: 1047213 - DNA, 22 bp, Artificial Sequence
  chemically synthesized
aaccagctttgcatcccaggga

SEQ ID NO: 1047214 - DNA, 22 bp, Artificial Sequence
  chemically synthesized
cgtatgttgaaccagctttgca

SEQ ID NO: 1047215 - DNA, 22 bp, Artificial Sequence
  chemically synthesized
catccctgggatgcaaagctgg

SEQ ID NO: 1047216 - DNA, 22 bp, Artificial Sequence
  chemically synthesized
gcgtatgttgaaccagctttgc

SEQ ID NO: 1047217 - DNA, 22 bp, Artificial Sequence
  chemically synthesized
atccctgggatgcaaagctggt

SEQ ID NO: 1047218 - DNA, 22 bp, Artificial Sequence
  chemically synthesized
atttgcgtatgttgaaccagct

SEQ ID NO: 1047219 - DNA, 22 bp, Artificial Sequence
  chemically synthesized
ttgatttgcgtatgttgaacca

SEQ ID NO: 1047220 - DNA, 22 bp, Artificial Sequence
  chemically synthesized
ggatgcaaagctggttcaacat

SEQ ID NO: 1047221 - DNA, 22 bp, Artificial Sequence
  chemically synthesized
attgatttgcgtatgttgaacc

SEQ ID NO: 1047222 - DNA, 22 bp, Artificial Sequence
  chemically synthesized
catttattgatttgcgtatgtt

SEQ ID NO: 1047223 - DNA, 22 bp, Artificial Sequence
  chemically synthesized
gttcaacatacgcaaatcaata

SEQ ID NO: 1047224 - DNA, 22 bp, Artificial Sequence
  chemically synthesized
aacatacgcaaatcaataaatg

SEQ ID NO: 1047225 - DNA, 22 bp, Artificial Sequence
  chemically synthesized
tgtgatgggttacatttattga

SEQ ID NO: 1047226 - DNA, 22 bp, Artificial Sequence
  chemically synthesized
atgtgatgggttacatttattg

SEQ ID NO: 1047227 - DNA, 22 bp, Artificial Sequence
  chemically synthesized
tttatgtgatgggttacattta

SEQ ID NO: 1047228 - DNA, 22 bp, Artificial Sequence
  chemically synthesized
tgtttatgtgatgggttacatt

SEQ ID NO: 1047229 - DNA, 22 bp, Artificial Sequence
  chemically synthesized
gttctgtttatgtgatgggtta

SEQ ID NO: 1047230 - DNA, 22 bp, Artificial Sequence
  chemically synthesized
gtcattggttctgtttatgtga

SEQ ID NO: 1047231 - DNA, 22 bp, Artificial Sequence
  chemically synthesized
ggtcattggttctgtttatgtg

SEQ ID NO: 1047232 - DNA, 22 bp, Artificial Sequence
  chemically synthesized
tggtcattggttctgtttatgt

SEQ ID NO: 1047233 - DNA, 22 bp, Artificial Sequence
  chemically synthesized
ttggtcattggttctgtttatg

SEQ ID NO: 1047234 - DNA, 22 bp, Artificial Sequence
  chemically synthesized
tttggtcattggttctgtttat

SEQ ID NO: 1047235 - DNA, 22 bp, Artificial Sequence
  chemically synthesized
ttttggtcattggttctgttta

SEQ ID NO: 1047236 - DNA, 22 bp, Artificial Sequence
  chemically synthesized
agataatcatgtggtttttttg

SEQ ID NO: 1047237 - DNA, 22 bp, Artificial Sequence
  chemically synthesized
ttgagataatcatgtggttttt

SEQ ID NO: 1047238 - DNA, 22 bp, Artificial Sequence
  chemically synthesized
catctattgagataatcatgtg

SEQ ID NO: 1047239 - DNA, 22 bp, Artificial Sequence
  chemically synthesized
tgcatctattgagataatcatg

SEQ ID NO: 1047240 - DNA, 22 bp, Artificial Sequence
  chemically synthesized
ctgcatctattgagataatcat

SEQ ID NO: 1047241 - DNA, 22 bp, Artificial Sequence
  chemically synthesized
tctgcatctattgagataatca

SEQ ID NO: 1047242 - DNA, 22 bp, Artificial Sequence
  chemically synthesized
ttctgcatctattgagataatc

SEQ ID NO: 1047243 - DNA, 22 bp, Artificial Sequence
  chemically synthesized
tccaagaccttttctgcatcta

SEQ ID NO: 1047244 - DNA, 22 bp, Artificial Sequence
  chemically synthesized
atccaagaccttttctgcatct

SEQ ID NO: 1047245 - DNA, 22 bp, Artificial Sequence
  chemically synthesized
tctcaatagatgcagaaaaggt

SEQ ID NO: 1047246 - DNA, 22 bp, Artificial Sequence
  chemically synthesized
aatttatccaagaccttttctg

SEQ ID NO: 1047247 - DNA, 22 bp, Artificial Sequence
  chemically synthesized
aatagatgcagaaaaggtcttg

SEQ ID NO: 1047248 - DNA, 22 bp, Artificial Sequence
  chemically synthesized
acatgaaagggtgttgaattta

SEQ ID NO: 1047249 - DNA, 22 bp, Artificial Sequence
  chemically synthesized
aacatgaaagggtgttgaattt

SEQ ID NO: 1047250 - DNA, 22 bp, Artificial Sequence
  chemically synthesized
taacatgaaagggtgttgaatt

SEQ ID NO: 1047251 - DNA, 22 bp, Artificial Sequence
  chemically synthesized
ttaacatgaaagggtgttgaat

SEQ ID NO: 1047252 - DNA, 22 bp, Artificial Sequence
  chemically synthesized
ggataaattcaacaccctttca

SEQ ID NO: 1047253 - DNA, 22 bp, Artificial Sequence
  chemically synthesized
gataaattcaacaccctttcat

SEQ ID NO: 1047254 - DNA, 22 bp, Artificial Sequence
  chemically synthesized
agtgtttttaacatgaaagggt

SEQ ID NO: 1047255 - DNA, 22 bp, Artificial Sequence
  chemically synthesized
ttgagtgtttttaacatgaaag

SEQ ID NO: 1047256 - DNA, 22 bp, Artificial Sequence
  chemically synthesized
attgagtgtttttaacatgaaa

SEQ ID NO: 1047257 - DNA, 22 bp, Artificial Sequence
  chemically synthesized
gtttattgagtgtttttaacat

SEQ ID NO: 1047258 - DNA, 22 bp, Artificial Sequence
  chemically synthesized
aacaccctttcatgttaaaaac

SEQ ID NO: 1047259 - DNA, 22 bp, Artificial Sequence
  chemically synthesized
tcatgttaaaaacactcaataa

SEQ ID NO: 1047260 - DNA, 22 bp, Artificial Sequence
  chemically synthesized
catgttaaaaacactcaataaa

SEQ ID NO: 1047261 - DNA, 22 bp, Artificial Sequence
  chemically synthesized
atgttaaaaacactcaataaac

SEQ ID NO: 1047262 - DNA, 22 bp, Artificial Sequence
  chemically synthesized
tcccatcaataactagtttatt

SEQ ID NO: 1047263 - DNA, 22 bp, Artificial Sequence
  chemically synthesized
gtcccatcaataactagtttat

SEQ ID NO: 1047264 - DNA, 22 bp, Artificial Sequence
  chemically synthesized
aaaacactcaataaactagtta

SEQ ID NO: 1047265 - DNA, 22 bp, Artificial Sequence
  chemically synthesized
agatttgtcccatcaataacta

SEQ ID NO: 1047266 - DNA, 22 bp, Artificial Sequence
  chemically synthesized
gagatttgtcccatcaataact

SEQ ID NO: 1047267 - DNA, 22 bp, Artificial Sequence
  chemically synthesized
tgagatttgtcccatcaataac

SEQ ID NO: 1047268 - DNA, 22 bp, Artificial Sequence
  chemically synthesized
aataaactagttattgatggga

SEQ ID NO: 1047269 - DNA, 22 bp, Artificial Sequence
  chemically synthesized
atattttgagatttgtcccatc

SEQ ID NO: 1047270 - DNA, 22 bp, Artificial Sequence
  chemically synthesized
aatattttgagatttgtcccat

SEQ ID NO: 1047271 - DNA, 22 bp, Artificial Sequence
  chemically synthesized
ttaatattttgagatttgtccc

SEQ ID NO: 1047272 - DNA, 22 bp, Artificial Sequence
  chemically synthesized
gttattgatgggacaaatctca

SEQ ID NO: 1047273 - DNA, 22 bp, Artificial Sequence
  chemically synthesized
ttgatgggacaaatctcaaaat

SEQ ID NO: 1047274 - DNA, 22 bp, Artificial Sequence
  chemically synthesized
atgggacaaatctcaaaatatt

SEQ ID NO: 1047275 - DNA, 22 bp, Artificial Sequence
  chemically synthesized
tcataaatagctcttaatattt

SEQ ID NO: 1047276 - DNA, 22 bp, Artificial Sequence
  chemically synthesized
gtcataaatagctcttaatatt

SEQ ID NO: 1047277 - DNA, 22 bp, Artificial Sequence
  chemically synthesized
tgggtttgtcataaatagctct

SEQ ID NO: 1047278 - DNA, 22 bp, Artificial Sequence
  chemically synthesized
aaaatattaagagctatttatg

SEQ ID NO: 1047279 - DNA, 22 bp, Artificial Sequence
  chemically synthesized
gctgtgggtttgtcataaatag

SEQ ID NO: 1047280 - DNA, 22 bp, Artificial Sequence
  chemically synthesized
agagctatttatgacaaaccca

SEQ ID NO: 1047281 - DNA, 22 bp, Artificial Sequence
  chemically synthesized
agtatgatactggctgtgggtt

SEQ ID NO: 1047282 - DNA, 22 bp, Artificial Sequence
  chemically synthesized
tttatgacaaacccacagccag

SEQ ID NO: 1047283 - DNA, 22 bp, Artificial Sequence
  chemically synthesized
atgacaaacccacagccagtat

SEQ ID NO: 1047284 - DNA, 22 bp, Artificial Sequence
  chemically synthesized
tgacaaacccacagccagtatc

SEQ ID NO: 1047285 - DNA, 22 bp, Artificial Sequence
  chemically synthesized
cccattcagtatgatactggct

SEQ ID NO: 1047286 - DNA, 22 bp, Artificial Sequence
  chemically synthesized
gcccattcagtatgatactggc

SEQ ID NO: 1047287 - DNA, 22 bp, Artificial Sequence
  chemically synthesized
tgcccattcagtatgatactgg

SEQ ID NO: 1047288 - DNA, 22 bp, Artificial Sequence
  chemically synthesized
ttgcccattcagtatgatactg

SEQ ID NO: 1047289 - DNA, 22 bp, Artificial Sequence
  chemically synthesized
gcttttgcccattcagtatgat

SEQ ID NO: 1047290 - DNA, 22 bp, Artificial Sequence
  chemically synthesized
tagcttttgcccattcagtatg

SEQ ID NO: 1047291 - DNA, 22 bp, Artificial Sequence
  chemically synthesized
ctagcttttgcccattcagtat

SEQ ID NO: 1047292 - DNA, 22 bp, Artificial Sequence
  chemically synthesized
aaagggaatgcttctagctttt

SEQ ID NO: 1047293 - DNA, 22 bp, Artificial Sequence
  chemically synthesized
caaagggaatgcttctagcttt

SEQ ID NO: 1047294 - DNA, 22 bp, Artificial Sequence
  chemically synthesized
tcaaagggaatgcttctagctt

SEQ ID NO: 1047295 - DNA, 22 bp, Artificial Sequence
  chemically synthesized
aatgggcaaaagctagaagcat

SEQ ID NO: 1047296 - DNA, 22 bp, Artificial Sequence
  chemically synthesized
tgccagttttcaaagggaatgc

SEQ ID NO: 1047297 - DNA, 22 bp, Artificial Sequence
  chemically synthesized
gtgccagttttcaaagggaatg

SEQ ID NO: 1047298 - DNA, 22 bp, Artificial Sequence
  chemically synthesized
tcttgtgccagttttcaaaggg

SEQ ID NO: 1047299 - DNA, 22 bp, Artificial Sequence
  chemically synthesized
gtcttgtgccagttttcaaagg

SEQ ID NO: 1047300 - DNA, 22 bp, Artificial Sequence
  chemically synthesized
gaagcattccctttgaaaactg

SEQ ID NO: 1047301 - DNA, 22 bp, Artificial Sequence
  chemically synthesized
cctttgaaaactggcacaagac

SEQ ID NO: 1047302 - DNA, 22 bp, Artificial Sequence
  chemically synthesized
tgaaaactggcacaagacaagg

SEQ ID NO: 1047303 - DNA, 22 bp, Artificial Sequence
  chemically synthesized
gaaaactggcacaagacaagga

SEQ ID NO: 1047304 - DNA, 22 bp, Artificial Sequence
  chemically synthesized
aaaactggcacaagacaaggat

SEQ ID NO: 1047305 - DNA, 22 bp, Artificial Sequence
  chemically synthesized
gcacaagacaaggatgccctct

SEQ ID NO: 1047306 - DNA, 22 bp, Artificial Sequence
  chemically synthesized
aataggagtggtgagagagggc

SEQ ID NO: 1047307 - DNA, 22 bp, Artificial Sequence
  chemically synthesized
tgttgaataggagtggtgagag

SEQ ID NO: 1047308 - DNA, 22 bp, Artificial Sequence
  chemically synthesized
caatactatgttgaataggagt

SEQ ID NO: 1047309 - DNA, 22 bp, Artificial Sequence
  chemically synthesized
ccaatactatgttgaataggag

SEQ ID NO: 1047310 - DNA, 22 bp, Artificial Sequence
  chemically synthesized
tctcaccactcctattcaacat

SEQ ID NO: 1047311 - DNA, 22 bp, Artificial Sequence
  chemically synthesized
tcaccactcctattcaacatag

SEQ ID NO: 1047312 - DNA, 22 bp, Artificial Sequence
  chemically synthesized
accactcctattcaacatagta

SEQ ID NO: 1047313 - DNA, 22 bp, Artificial Sequence
  chemically synthesized
gccaggacttccaatactatgt

SEQ ID NO: 1047314 - DNA, 22 bp, Artificial Sequence
  chemically synthesized
ctattcaacatagtattggaag

SEQ ID NO: 1047315 - DNA, 22 bp, Artificial Sequence
  chemically synthesized
ccctggccaggacttccaatac

SEQ ID NO: 1047316 - DNA, 22 bp, Artificial Sequence
  chemically synthesized
ttcaacatagtattggaagtcc

SEQ ID NO: 1047317 - DNA, 22 bp, Artificial Sequence
  chemically synthesized
attgccctggccaggacttcca

SEQ ID NO: 1047318 - DNA, 22 bp, Artificial Sequence
  chemically synthesized
aacatagtattggaagtcctgg

SEQ ID NO: 1047319 - DNA, 22 bp, Artificial Sequence
  chemically synthesized
cctgattgccctggccaggact

SEQ ID NO: 1047320 - DNA, 22 bp, Artificial Sequence
  chemically synthesized
gcctgattgccctggccaggac

SEQ ID NO: 1047321 - DNA, 22 bp, Artificial Sequence
  chemically synthesized
ttgcctgattgccctggccagg

SEQ ID NO: 1047322 - DNA, 22 bp, Artificial Sequence
  chemically synthesized
tcttgcctgattgccctggcca

SEQ ID NO: 1047323 - DNA, 22 bp, Artificial Sequence
  chemically synthesized
ctcttgcctgattgccctggcc

SEQ ID NO: 1047324 - DNA, 22 bp, Artificial Sequence
  chemically synthesized
tctcttgcctgattgccctggc

SEQ ID NO: 1047325 - DNA, 22 bp, Artificial Sequence
  chemically synthesized
tttctcttgcctgattgccctg

SEQ ID NO: 1047326 - DNA, 22 bp, Artificial Sequence
  chemically synthesized
gaagtcctggccagggcaatca

SEQ ID NO: 1047327 - DNA, 22 bp, Artificial Sequence
  chemically synthesized
ctttctcttgcctgattgccct

SEQ ID NO: 1047328 - DNA, 22 bp, Artificial Sequence
  chemically synthesized
tctttctcttgcctgattgccc

SEQ ID NO: 1047329 - DNA, 22 bp, Artificial Sequence
  chemically synthesized
tttctttctcttgcctgattgc

SEQ ID NO: 1047330 - DNA, 22 bp, Artificial Sequence
  chemically synthesized
ctttctttctcttgcctgattg

SEQ ID NO: 1047331 - DNA, 22 bp, Artificial Sequence
  chemically synthesized
tctttctttctcttgcctgatt

SEQ ID NO: 1047332 - DNA, 22 bp, Artificial Sequence
  chemically synthesized
gccagggcaatcaggcaagaga

SEQ ID NO: 1047333 - DNA, 22 bp, Artificial Sequence
  chemically synthesized
aatatctttctttctttctctt

SEQ ID NO: 1047334 - DNA, 22 bp, Artificial Sequence
  chemically synthesized
gaatatctttctttctttctct

SEQ ID NO: 1047335 - DNA, 22 bp, Artificial Sequence
  chemically synthesized
tttgaatatctttctttctttc

SEQ ID NO: 1047336 - DNA, 22 bp, Artificial Sequence
  chemically synthesized
ctatttgaatatctttctttct

SEQ ID NO: 1047337 - DNA, 22 bp, Artificial Sequence
  chemically synthesized
cctatttgaatatctttctttc

SEQ ID NO: 1047338 - DNA, 22 bp, Artificial Sequence
  chemically synthesized
ttcctatttgaatatctttctt

SEQ ID NO: 1047339 - DNA, 22 bp, Artificial Sequence
  chemically synthesized
tcttcctatttgaatatctttc

SEQ ID NO: 1047340 - DNA, 22 bp, Artificial Sequence
  chemically synthesized
ctctcttcctatttgaatatct

SEQ ID NO: 1047341 - DNA, 22 bp, Artificial Sequence
  chemically synthesized
cctctcttcctatttgaatatc

SEQ ID NO: 1047342 - DNA, 22 bp, Artificial Sequence
  chemically synthesized
acttcctctcttcctatttgaa

SEQ ID NO: 1047343 - DNA, 22 bp, Artificial Sequence
  chemically synthesized
gacttcctctcttcctatttga

SEQ ID NO: 1047344 - DNA, 22 bp, Artificial Sequence
  chemically synthesized
aaataggaagagaggaagtcaa

SEQ ID NO: 1047345 - DNA, 22 bp, Artificial Sequence
  chemically synthesized
caaacagagataatttgacttc

SEQ ID NO: 1047346 - DNA, 22 bp, Artificial Sequence
  chemically synthesized
aatatacaatcatgtcatctgc

SEQ ID NO: 1047347 - DNA, 22 bp, Artificial Sequence
  chemically synthesized
taaatatacaatcatgtcatct

SEQ ID NO: 1047348 - DNA, 22 bp, Artificial Sequence
  chemically synthesized
tctctgtttgcagatgacatga

SEQ ID NO: 1047349 - DNA, 22 bp, Artificial Sequence
  chemically synthesized
ctaaatatacaatcatgtcatc

SEQ ID NO: 1047350 - DNA, 22 bp, Artificial Sequence
  chemically synthesized
tctaaatatacaatcatgtcat

SEQ ID NO: 1047351 - DNA, 22 bp, Artificial Sequence
  chemically synthesized
tgtttgcagatgacatgattgt

SEQ ID NO: 1047352 - DNA, 22 bp, Artificial Sequence
  chemically synthesized
tttgcagatgacatgattgtat

SEQ ID NO: 1047353 - DNA, 22 bp, Artificial Sequence
  chemically synthesized
gcagatgacatgattgtatatt

SEQ ID NO: 1047354 - DNA, 22 bp, Artificial Sequence
  chemically synthesized
cagatgacatgattgtatattt

SEQ ID NO: 1047355 - DNA, 22 bp, Artificial Sequence
  chemically synthesized
agacgatggggttttctaaata

SEQ ID NO: 1047356 - DNA, 22 bp, Artificial Sequence
  chemically synthesized
ggctgagacgatggggttttct

SEQ ID NO: 1047357 - DNA, 22 bp, Artificial Sequence
  chemically synthesized
gggctgagacgatggggttttc

SEQ ID NO: 1047358 - DNA, 22 bp, Artificial Sequence
  chemically synthesized
tgggctgagacgatggggtttt

SEQ ID NO: 1047359 - DNA, 22 bp, Artificial Sequence
  chemically synthesized
ttgggctgagacgatggggttt

SEQ ID NO: 1047360 - DNA, 22 bp, Artificial Sequence
  chemically synthesized
tatatttagaaaaccccatcgt

SEQ ID NO: 1047361 - DNA, 22 bp, Artificial Sequence
  chemically synthesized
aagagtttttgggctgagacga

SEQ ID NO: 1047362 - DNA, 22 bp, Artificial Sequence
  chemically synthesized
agaaaaccccatcgtctcagcc

SEQ ID NO: 1047363 - DNA, 22 bp, Artificial Sequence
  chemically synthesized
aaagagtttttgggctgagacg

SEQ ID NO: 1047364 - DNA, 22 bp, Artificial Sequence
  chemically synthesized
gaaaaccccatcgtctcagccc

SEQ ID NO: 1047365 - DNA, 22 bp, Artificial Sequence
  chemically synthesized
tcagcttaaagagtttttgggc

SEQ ID NO: 1047366 - DNA, 22 bp, Artificial Sequence
  chemically synthesized
atcagcttaaagagtttttggg

SEQ ID NO: 1047367 - DNA, 22 bp, Artificial Sequence
  chemically synthesized
cttatcagcttaaagagttttt

SEQ ID NO: 1047368 - DNA, 22 bp, Artificial Sequence
  chemically synthesized
aagttgcttatcagcttaaaga

SEQ ID NO: 1047369 - DNA, 22 bp, Artificial Sequence
  chemically synthesized
agcccaaaaactctttaagctg

SEQ ID NO: 1047370 - DNA, 22 bp, Artificial Sequence
  chemically synthesized
ctgaagttgcttatcagcttaa

SEQ ID NO: 1047371 - DNA, 22 bp, Artificial Sequence
  chemically synthesized
gctgaagttgcttatcagctta

SEQ ID NO: 1047372 - DNA, 22 bp, Artificial Sequence
  chemically synthesized
tgctgaagttgcttatcagctt

SEQ ID NO: 1047373 - DNA, 22 bp, Artificial Sequence
  chemically synthesized
agactttgctgaagttgcttat

SEQ ID NO: 1047374 - DNA, 22 bp, Artificial Sequence
  chemically synthesized
tttaagctgataagcaacttca

SEQ ID NO: 1047375 - DNA, 22 bp, Artificial Sequence
  chemically synthesized
taagctgataagcaacttcagc

SEQ ID NO: 1047376 - DNA, 22 bp, Artificial Sequence
  chemically synthesized
aagctgataagcaacttcagca

SEQ ID NO: 1047377 - DNA, 22 bp, Artificial Sequence
  chemically synthesized
agctgataagcaacttcagcaa

SEQ ID NO: 1047378 - DNA, 22 bp, Artificial Sequence
  chemically synthesized
tatcctgagactttgctgaagt

SEQ ID NO: 1047379 - DNA, 22 bp, Artificial Sequence
  chemically synthesized
gtatcctgagactttgctgaag

SEQ ID NO: 1047380 - DNA, 22 bp, Artificial Sequence
  chemically synthesized
tgtatcctgagactttgctgaa

SEQ ID NO: 1047381 - DNA, 22 bp, Artificial Sequence
  chemically synthesized
ataagcaacttcagcaaagtct

SEQ ID NO: 1047382 - DNA, 22 bp, Artificial Sequence
  chemically synthesized
attttgtatcctgagactttgc

SEQ ID NO: 1047383 - DNA, 22 bp, Artificial Sequence
  chemically synthesized
cacgttgattttgtatcctgag

SEQ ID NO: 1047384 - DNA, 22 bp, Artificial Sequence
  chemically synthesized
gcacgttgattttgtatcctga

SEQ ID NO: 1047385 - DNA, 22 bp, Artificial Sequence
  chemically synthesized
tgcacgttgattttgtatcctg

SEQ ID NO: 1047386 - DNA, 22 bp, Artificial Sequence
  chemically synthesized
cagcaaagtctcaggatacaaa

SEQ ID NO: 1047387 - DNA, 22 bp, Artificial Sequence
  chemically synthesized
ttgcacgttgattttgtatcct

SEQ ID NO: 1047388 - DNA, 22 bp, Artificial Sequence
  chemically synthesized
agcaaagtctcaggatacaaaa

SEQ ID NO: 1047389 - DNA, 22 bp, Artificial Sequence
  chemically synthesized
tgatttttgcacgttgattttg

SEQ ID NO: 1047390 - DNA, 22 bp, Artificial Sequence
  chemically synthesized
gtgatttttgcacgttgatttt

SEQ ID NO: 1047391 - DNA, 22 bp, Artificial Sequence
  chemically synthesized
aggatacaaaatcaacgtgcaa

SEQ ID NO: 1047392 - DNA, 22 bp, Artificial Sequence
  chemically synthesized
taggaatgcttgtgatttttgc

SEQ ID NO: 1047393 - DNA, 22 bp, Artificial Sequence
  chemically synthesized
ataggaatgcttgtgatttttg

SEQ ID NO: 1047394 - DNA, 22 bp, Artificial Sequence
  chemically synthesized
gtttataggaatgcttgtgatt

SEQ ID NO: 1047395 - DNA, 22 bp, Artificial Sequence
  chemically synthesized
ttggtttataggaatgcttgtg

SEQ ID NO: 1047396 - DNA, 22 bp, Artificial Sequence
  chemically synthesized
ttattggtttataggaatgctt

SEQ ID NO: 1047397 - DNA, 22 bp, Artificial Sequence
  chemically synthesized
tctgttattggtttataggaat

SEQ ID NO: 1047398 - DNA, 22 bp, Artificial Sequence
  chemically synthesized
tgtctgttattggtttatagga

SEQ ID NO: 1047399 - DNA, 22 bp, Artificial Sequence
  chemically synthesized
tctgtctgttattggtttatag

SEQ ID NO: 1047400 - DNA, 22 bp, Artificial Sequence
  chemically synthesized
gctctctgtctgttattggttt

SEQ ID NO: 1047401 - DNA, 22 bp, Artificial Sequence
  chemically synthesized
ggctctctgtctgttattggtt

SEQ ID NO: 1047402 - DNA, 22 bp, Artificial Sequence
  chemically synthesized
tttggctctctgtctgttattg

SEQ ID NO: 1047403 - DNA, 22 bp, Artificial Sequence
  chemically synthesized
ctataaaccaataacagacaga

SEQ ID NO: 1047404 - DNA, 22 bp, Artificial Sequence
  chemically synthesized
attatttggctctctgtctgtt

SEQ ID NO: 1047405 - DNA, 22 bp, Artificial Sequence
  chemically synthesized
tcattatttggctctctgtctg

SEQ ID NO: 1047406 - DNA, 22 bp, Artificial Sequence
  chemically synthesized
taaaccaataacagacagagag

SEQ ID NO: 1047407 - DNA, 22 bp, Artificial Sequence
  chemically synthesized
tctcattatttggctctctgtc

SEQ ID NO: 1047408 - DNA, 22 bp, Artificial Sequence
  chemically synthesized
atgggagttctctcattatttg

SEQ ID NO: 1047409 - DNA, 22 bp, Artificial Sequence
  chemically synthesized
aatgggagttctctcattattt

SEQ ID NO: 1047410 - DNA, 22 bp, Artificial Sequence
  chemically synthesized
taatgggagttctctcattatt

SEQ ID NO: 1047411 - DNA, 22 bp, Artificial Sequence
  chemically synthesized
ttaatgggagttctctcattat

SEQ ID NO: 1047412 - DNA, 22 bp, Artificial Sequence
  chemically synthesized
tagcaatttttaatgggagttc

SEQ ID NO: 1047413 - DNA, 22 bp, Artificial Sequence
  chemically synthesized
gtagcaatttttaatgggagtt

SEQ ID NO: 1047414 - DNA, 22 bp, Artificial Sequence
  chemically synthesized
tgtagcaatttttaatgggagt

SEQ ID NO: 1047415 - DNA, 22 bp, Artificial Sequence
  chemically synthesized
tttgtagcaatttttaatggga

SEQ ID NO: 1047416 - DNA, 22 bp, Artificial Sequence
  chemically synthesized
tctttgtagcaatttttaatgg

SEQ ID NO: 1047417 - DNA, 22 bp, Artificial Sequence
  chemically synthesized
ttctctttgtagcaatttttaa

SEQ ID NO: 1047418 - DNA, 22 bp, Artificial Sequence
  chemically synthesized
attctctttgtagcaattttta

SEQ ID NO: 1047419 - DNA, 22 bp, Artificial Sequence
  chemically synthesized
tattctctttgtagcaattttt

SEQ ID NO: 1047420 - DNA, 22 bp, Artificial Sequence
  chemically synthesized
ccattaaaaattgctacaaaga

SEQ ID NO: 1047421 - DNA, 22 bp, Artificial Sequence
  chemically synthesized
ggtattttattctctttgtagc

SEQ ID NO: 1047422 - DNA, 22 bp, Artificial Sequence
  chemically synthesized
ctaggtattttattctctttgt

SEQ ID NO: 1047423 - DNA, 22 bp, Artificial Sequence
  chemically synthesized
aaaattgctacaaagagaataa

SEQ ID NO: 1047424 - DNA, 22 bp, Artificial Sequence
  chemically synthesized
tattcctaggtattttattctc

SEQ ID NO: 1047425 - DNA, 22 bp, Artificial Sequence
  chemically synthesized
ctacaaagagaataaaatacct

SEQ ID NO: 1047426 - DNA, 22 bp, Artificial Sequence
  chemically synthesized
caagttgtattcctaggtattt

SEQ ID NO: 1047427 - DNA, 22 bp, Artificial Sequence
  chemically synthesized
caaagagaataaaatacctagg

SEQ ID NO: 1047428 - DNA, 22 bp, Artificial Sequence
  chemically synthesized
gcaagttgtattcctaggtatt

SEQ ID NO: 1047429 - DNA, 22 bp, Artificial Sequence
  chemically synthesized
acatcccttgcaagttgtattc

SEQ ID NO: 1047430 - DNA, 22 bp, Artificial Sequence
  chemically synthesized
cacatcccttgcaagttgtatt

SEQ ID NO: 1047431 - DNA, 22 bp, Artificial Sequence
  chemically synthesized
ggaatacaacttgcaagggatg

SEQ ID NO: 1047432 - DNA, 22 bp, Artificial Sequence
  chemically synthesized
aagaggcccttcacatcccttg

SEQ ID NO: 1047433 - DNA, 22 bp, Artificial Sequence
  chemically synthesized
gaagaggcccttcacatccctt

SEQ ID NO: 1047434 - DNA, 22 bp, Artificial Sequence
  chemically synthesized
cttgaagaggcccttcacatcc

SEQ ID NO: 1047435 - DNA, 22 bp, Artificial Sequence
  chemically synthesized
tccttgaagaggcccttcacat

SEQ ID NO: 1047436 - DNA, 22 bp, Artificial Sequence
  chemically synthesized
gcaagggatgtgaagggcctct

SEQ ID NO: 1047437 - DNA, 22 bp, Artificial Sequence
  chemically synthesized
caagggatgtgaagggcctctt

SEQ ID NO: 1047438 - DNA, 22 bp, Artificial Sequence
  chemically synthesized
tagttctccttgaagaggccct

SEQ ID NO: 1047439 - DNA, 22 bp, Artificial Sequence
  chemically synthesized
gtagttctccttgaagaggccc

SEQ ID NO: 1047440 - DNA, 22 bp, Artificial Sequence
  chemically synthesized
agcagtggtttgtagttctcct

SEQ ID NO: 1047441 - DNA, 22 bp, Artificial Sequence
  chemically synthesized
gagcagtggtttgtagttctcc

SEQ ID NO: 1047442 - DNA, 22 bp, Artificial Sequence
  chemically synthesized
cttgagcagtggtttgtagttc

SEQ ID NO: 1047443 - DNA, 22 bp, Artificial Sequence
  chemically synthesized
ccttgagcagtggtttgtagtt

SEQ ID NO: 1047444 - DNA, 22 bp, Artificial Sequence
  chemically synthesized
ttcaaggagaactacaaaccac

SEQ ID NO: 1047445 - DNA, 22 bp, Artificial Sequence
  chemically synthesized
tttccttgagcagtggtttgta

SEQ ID NO: 1047446 - DNA, 22 bp, Artificial Sequence
  chemically synthesized
atttccttgagcagtggtttgt

SEQ ID NO: 1047447 - DNA, 22 bp, Artificial Sequence
  chemically synthesized
caaggagaactacaaaccactg

SEQ ID NO: 1047448 - DNA, 22 bp, Artificial Sequence
  chemically synthesized
aaggagaactacaaaccactgc

SEQ ID NO: 1047449 - DNA, 22 bp, Artificial Sequence
  chemically synthesized
ttatttccttgagcagtggttt

SEQ ID NO: 1047450 - DNA, 22 bp, Artificial Sequence
  chemically synthesized
tcttatttccttgagcagtggt

SEQ ID NO: 1047451 - DNA, 22 bp, Artificial Sequence
  chemically synthesized
ggtcctctcttatttccttgag

SEQ ID NO: 1047452 - DNA, 22 bp, Artificial Sequence
  chemically synthesized
gggtcctctcttatttccttga

SEQ ID NO: 1047453 - DNA, 22 bp, Artificial Sequence
  chemically synthesized
caaaccactgctcaaggaaata

SEQ ID NO: 1047454 - DNA, 22 bp, Artificial Sequence
  chemically synthesized
tttgggtcctctcttatttcct

SEQ ID NO: 1047455 - DNA, 22 bp, Artificial Sequence
  chemically synthesized
gtttgggtcctctcttatttcc

SEQ ID NO: 1047456 - DNA, 22 bp, Artificial Sequence
  chemically synthesized
catttgtttgggtcctctctta

SEQ ID NO: 1047457 - DNA, 22 bp, Artificial Sequence
  chemically synthesized
ccatttgtttgggtcctctctt

SEQ ID NO: 1047458 - DNA, 22 bp, Artificial Sequence
  chemically synthesized
ctcaaggaaataagagaggacc

SEQ ID NO: 1047459 - DNA, 22 bp, Artificial Sequence
  chemically synthesized
tccatttgtttgggtcctctct

SEQ ID NO: 1047460 - DNA, 22 bp, Artificial Sequence
  chemically synthesized
ttccatttgtttgggtcctctc

SEQ ID NO: 1047461 - DNA, 22 bp, Artificial Sequence
  chemically synthesized
aaggaaataagagaggacccaa

SEQ ID NO: 1047462 - DNA, 22 bp, Artificial Sequence
  chemically synthesized
cataagcatggaatgtttttcc

SEQ ID NO: 1047463 - DNA, 22 bp, Artificial Sequence
  chemically synthesized
ccataagcatggaatgtttttc

SEQ ID NO: 1047464 - DNA, 22 bp, Artificial Sequence
  chemically synthesized
tccataagcatggaatgttttt

SEQ ID NO: 1047465 - DNA, 22 bp, Artificial Sequence
  chemically synthesized
ctttccataagcatggaatgtt

SEQ ID NO: 1047466 - DNA, 22 bp, Artificial Sequence
  chemically synthesized
cctttccataagcatggaatgt

SEQ ID NO: 1047467 - DNA, 22 bp, Artificial Sequence
  chemically synthesized
ttcctttccataagcatggaat

SEQ ID NO: 1047468 - DNA, 22 bp, Artificial Sequence
  chemically synthesized
attcttcctttccataagcatg

SEQ ID NO: 1047469 - DNA, 22 bp, Artificial Sequence
  chemically synthesized
ttgattcttcctttccataagc

SEQ ID NO: 1047470 - DNA, 22 bp, Artificial Sequence
  chemically synthesized
atgttattgattcttcctttcc

SEQ ID NO: 1047471 - DNA, 22 bp, Artificial Sequence
  chemically synthesized
catgttattgattcttcctttc

SEQ ID NO: 1047472 - DNA, 22 bp, Artificial Sequence
  chemically synthesized
tcatgttattgattcttccttt

SEQ ID NO: 1047473 - DNA, 22 bp, Artificial Sequence
  chemically synthesized
catgcttatggaaaggaagaat

SEQ ID NO: 1047474 - DNA, 22 bp, Artificial Sequence
  chemically synthesized
atggaaaggaagaatcaataac

SEQ ID NO: 1047475 - DNA, 22 bp, Artificial Sequence
  chemically synthesized
tggaaaggaagaatcaataaca

SEQ ID NO: 1047476 - DNA, 22 bp, Artificial Sequence
  chemically synthesized
tggccattttcatgttattgat

SEQ ID NO: 1047477 - DNA, 22 bp, Artificial Sequence
  chemically synthesized
ggcgctatggccattttcatgt

SEQ ID NO: 1047478 - DNA, 22 bp, Artificial Sequence
  chemically synthesized
gggcgctatggccattttcatg

SEQ ID NO: 1047479 - DNA, 22 bp, Artificial Sequence
  chemically synthesized
tgggcgctatggccattttcat

SEQ ID NO: 1047480 - DNA, 22 bp, Artificial Sequence
  chemically synthesized
ctttgggcgctatggccatttt

SEQ ID NO: 1047481 - DNA, 22 bp, Artificial Sequence
  chemically synthesized
taaattactttgggcgctatgg

SEQ ID NO: 1047482 - DNA, 22 bp, Artificial Sequence
  chemically synthesized
aatctataaattactttgggcg

SEQ ID NO: 1047483 - DNA, 22 bp, Artificial Sequence
  chemically synthesized
atgggagtagcattgaatctat

SEQ ID NO: 1047484 - DNA, 22 bp, Artificial Sequence
  chemically synthesized
gatgggagtagcattgaatcta

SEQ ID NO: 1047485 - DNA, 22 bp, Artificial Sequence
  chemically synthesized
atagattcaatgctactcccat

SEQ ID NO: 1047486 - DNA, 22 bp, Artificial Sequence
  chemically synthesized
tagattcaatgctactcccatc

SEQ ID NO: 1047487 - DNA, 22 bp, Artificial Sequence
  chemically synthesized
aatgctactcccatcaagctac

SEQ ID NO: 1047488 - DNA, 22 bp, Artificial Sequence
  chemically synthesized
tgaagaaagtcaatggtagctt

SEQ ID NO: 1047489 - DNA, 22 bp, Artificial Sequence
  chemically synthesized
tgtgaagaaagtcaatggtagc

SEQ ID NO: 1047490 - DNA, 22 bp, Artificial Sequence
  chemically synthesized
ctcccatcaagctaccattgac

SEQ ID NO: 1047491 - DNA, 22 bp, Artificial Sequence
  chemically synthesized
attctgtgaagaaagtcaatgg

SEQ ID NO: 1047492 - DNA, 22 bp, Artificial Sequence
  chemically synthesized
ccatcaagctaccattgacttt

SEQ ID NO: 1047493 - DNA, 22 bp, Artificial Sequence
  chemically synthesized
taattctgtgaagaaagtcaat

SEQ ID NO: 1047494 - DNA, 22 bp, Artificial Sequence
  chemically synthesized
ttctaattctgtgaagaaagtc

SEQ ID NO: 1047495 - DNA, 22 bp, Artificial Sequence
  chemically synthesized
gttctaattctgtgaagaaagt

SEQ ID NO: 1047496 - DNA, 22 bp, Artificial Sequence
  chemically synthesized
ccattgactttcttcacagaat

SEQ ID NO: 1047497 - DNA, 22 bp, Artificial Sequence
  chemically synthesized
actttcttcacagaattagaac

SEQ ID NO: 1047498 - DNA, 22 bp, Artificial Sequence
  chemically synthesized
tcttcacagaattagaacaaac

SEQ ID NO: 1047499 - DNA, 22 bp, Artificial Sequence
  chemically synthesized
cttcacagaattagaacaaact

SEQ ID NO: 1047500 - DNA, 22 bp, Artificial Sequence
  chemically synthesized
ttcacagaattagaacaaacta

SEQ ID NO: 1047501 - DNA, 22 bp, Artificial Sequence
  chemically synthesized
cacagaattagaacaaactact

SEQ ID NO: 1047502 - DNA, 22 bp, Artificial Sequence
  chemically synthesized
acagaattagaacaaactactt

SEQ ID NO: 1047503 - DNA, 22 bp, Artificial Sequence
  chemically synthesized
catatgaaatgtaaagtagttt

SEQ ID NO: 1047504 - DNA, 22 bp, Artificial Sequence
  chemically synthesized
gttccatatgaaatgtaaagta

SEQ ID NO: 1047505 - DNA, 22 bp, Artificial Sequence
  chemically synthesized
ggttccatatgaaatgtaaagt

SEQ ID NO: 1047506 - DNA, 22 bp, Artificial Sequence
  chemically synthesized
tggttccatatgaaatgtaaag

SEQ ID NO: 1047507 - DNA, 22 bp, Artificial Sequence
  chemically synthesized
ttggttccatatgaaatgtaaa

SEQ ID NO: 1047508 - DNA, 22 bp, Artificial Sequence
  chemically synthesized
gaacaaactactttacatttca

SEQ ID NO: 1047509 - DNA, 22 bp, Artificial Sequence
  chemically synthesized
tttggttccatatgaaatgtaa

SEQ ID NO: 1047510 - DNA, 22 bp, Artificial Sequence
  chemically synthesized
ttttggttccatatgaaatgta

SEQ ID NO: 1047511 - DNA, 22 bp, Artificial Sequence
  chemically synthesized
ctttacatttcatatggaacca

SEQ ID NO: 1047512 - DNA, 22 bp, Artificial Sequence
  chemically synthesized
tatgggcccttttttggttcca

SEQ ID NO: 1047513 - DNA, 22 bp, Artificial Sequence
  chemically synthesized
tacatttcatatggaaccaaaa

SEQ ID NO: 1047514 - DNA, 22 bp, Artificial Sequence
  chemically synthesized
acatttcatatggaaccaaaaa

SEQ ID NO: 1047515 - DNA, 22 bp, Artificial Sequence
  chemically synthesized
catttcatatggaaccaaaaaa

SEQ ID NO: 1047516 - DNA, 22 bp, Artificial Sequence
  chemically synthesized
gctatatgggcccttttttggt

SEQ ID NO: 1047517 - DNA, 22 bp, Artificial Sequence
  chemically synthesized
ggctatatgggcccttttttgg

SEQ ID NO: 1047518 - DNA, 22 bp, Artificial Sequence
  chemically synthesized
ttggctatatgggccctttttt

SEQ ID NO: 1047519 - DNA, 22 bp, Artificial Sequence
  chemically synthesized
catatggaaccaaaaaagggcc

SEQ ID NO: 1047520 - DNA, 22 bp, Artificial Sequence
  chemically synthesized
cttggctatatgggcccttttt

SEQ ID NO: 1047521 - DNA, 22 bp, Artificial Sequence
  chemically synthesized
atatggaaccaaaaaagggccc

SEQ ID NO: 1047522 - DNA, 22 bp, Artificial Sequence
  chemically synthesized
tcttggctatatgggccctttt

SEQ ID NO: 1047523 - DNA, 22 bp, Artificial Sequence
  chemically synthesized
ggattttcttggctatatgggc

SEQ ID NO: 1047524 - DNA, 22 bp, Artificial Sequence
  chemically synthesized
aggattttcttggctatatggg

SEQ ID NO: 1047525 - DNA, 22 bp, Artificial Sequence
  chemically synthesized
cttaggattttcttggctatat

SEQ ID NO: 1047526 - DNA, 22 bp, Artificial Sequence
  chemically synthesized
gcttaggattttcttggctata

SEQ ID NO: 1047527 - DNA, 22 bp, Artificial Sequence
  chemically synthesized
ttgcttaggattttcttggcta

SEQ ID NO: 1047528 - DNA, 22 bp, Artificial Sequence
  chemically synthesized
ttcttgcttaggattttcttgg

SEQ ID NO: 1047529 - DNA, 22 bp, Artificial Sequence
  chemically synthesized
ttattcttgcttaggattttct

SEQ ID NO: 1047530 - DNA, 22 bp, Artificial Sequence
  chemically synthesized
gttattcttgcttaggattttc

SEQ ID NO: 1047531 - DNA, 22 bp, Artificial Sequence
  chemically synthesized
tgttattcttgcttaggatttt

SEQ ID NO: 1047532 - DNA, 22 bp, Artificial Sequence
  chemically synthesized
cagctttgttattcttgcttag

SEQ ID NO: 1047533 - DNA, 22 bp, Artificial Sequence
  chemically synthesized
agcaagaataacaaagctggag

SEQ ID NO: 1047534 - DNA, 22 bp, Artificial Sequence
  chemically synthesized
aagtcaggtagcgtgatgcctc

SEQ ID NO: 1047535 - DNA, 22 bp, Artificial Sequence
  chemically synthesized
gaagtcaggtagcgtgatgcct

SEQ ID NO: 1047536 - DNA, 22 bp, Artificial Sequence
  chemically synthesized
gaggcatcacgctacctgactt

SEQ ID NO: 1047537 - DNA, 22 bp, Artificial Sequence
  chemically synthesized
tagtatagtttgaagtcaggta

SEQ ID NO: 1047538 - DNA, 22 bp, Artificial Sequence
  chemically synthesized
tagcattatagtatagtttgaa

SEQ ID NO: 1047539 - DNA, 22 bp, Artificial Sequence
  chemically synthesized
ctgtagcattatagtatagttt

SEQ ID NO: 1047540 - DNA, 22 bp, Artificial Sequence
  chemically synthesized
cctgacttcaaactatactata

SEQ ID NO: 1047541 - DNA, 22 bp, Artificial Sequence
  chemically synthesized
gttactgtagcattatagtata

SEQ ID NO: 1047542 - DNA, 22 bp, Artificial Sequence
  chemically synthesized
ggttactgtagcattatagtat

SEQ ID NO: 1047543 - DNA, 22 bp, Artificial Sequence
  chemically synthesized
tggttactgtagcattatagta

SEQ ID NO: 1047544 - DNA, 22 bp, Artificial Sequence
  chemically synthesized
acttcaaactatactataatgc

SEQ ID NO: 1047545 - DNA, 22 bp, Artificial Sequence
  chemically synthesized
ttttggttactgtagcattata

SEQ ID NO: 1047546 - DNA, 22 bp, Artificial Sequence
  chemically synthesized
caaactatactataatgctaca

SEQ ID NO: 1047547 - DNA, 22 bp, Artificial Sequence
  chemically synthesized
aaactatactataatgctacag

SEQ ID NO: 1047548 - DNA, 22 bp, Artificial Sequence
  chemically synthesized
tactataatgctacagtaacca

SEQ ID NO: 1047549 - DNA, 22 bp, Artificial Sequence
  chemically synthesized
tcagtataatctgttttggtta

SEQ ID NO: 1047550 - DNA, 22 bp, Artificial Sequence
  chemically synthesized
taatgctacagtaaccaaaaca

SEQ ID NO: 1047551 - DNA, 22 bp, Artificial Sequence
  chemically synthesized
ctatcagtataatctgttttgg

SEQ ID NO: 1047552 - DNA, 22 bp, Artificial Sequence
  chemically synthesized
gctatcagtataatctgttttg

SEQ ID NO: 1047553 - DNA, 22 bp, Artificial Sequence
  chemically synthesized
tgctatcagtataatctgtttt

SEQ ID NO: 1047554 - DNA, 22 bp, Artificial Sequence
  chemically synthesized
ttttgctatcagtataatctgt

SEQ ID NO: 1047555 - DNA, 22 bp, Artificial Sequence
  chemically synthesized
cagtaaccaaaacagattatac

SEQ ID NO: 1047556 - DNA, 22 bp, Artificial Sequence
  chemically synthesized
tatatctgttttgctatcagta

SEQ ID NO: 1047557 - DNA, 22 bp, Artificial Sequence
  chemically synthesized
gtctatatatctgttttgctat

SEQ ID NO: 1047558 - DNA, 22 bp, Artificial Sequence
  chemically synthesized
cgttggtctatatatctgtttt

SEQ ID NO: 1047559 - DNA, 22 bp, Artificial Sequence
  chemically synthesized
tactgatagcaaaacagatata

SEQ ID NO: 1047560 - DNA, 22 bp, Artificial Sequence
  chemically synthesized
ttccgttggtctatatatctgt

SEQ ID NO: 1047561 - DNA, 22 bp, Artificial Sequence
  chemically synthesized
tgttccgttggtctatatatct

SEQ ID NO: 1047562 - DNA, 22 bp, Artificial Sequence
  chemically synthesized
atagcaaaacagatatatagac

SEQ ID NO: 1047563 - DNA, 22 bp, Artificial Sequence
  chemically synthesized
ttctgttccgttggtctatata

SEQ ID NO: 1047564 - DNA, 22 bp, Artificial Sequence
  chemically synthesized
tgttctgttccgttggtctata

SEQ ID NO: 1047565 - DNA, 22 bp, Artificial Sequence
  chemically synthesized
aggcctctgttctgttccgttg

SEQ ID NO: 1047566 - DNA, 22 bp, Artificial Sequence
  chemically synthesized
tgaggcctctgttctgttccgt

SEQ ID NO: 1047567 - DNA, 22 bp, Artificial Sequence
  chemically synthesized
ctgaggcctctgttctgttccg

SEQ ID NO: 1047568 - DNA, 22 bp, Artificial Sequence
  chemically synthesized
tagatgtgtggtgatatttctg

SEQ ID NO: 1047569 - DNA, 22 bp, Artificial Sequence
  chemically synthesized
agaaatatcaccacacatctac

SEQ ID NO: 1047570 - DNA, 22 bp, Artificial Sequence
  chemically synthesized
tcaaagatcagatggttgtaga

SEQ ID NO: 1047571 - DNA, 22 bp, Artificial Sequence
  chemically synthesized
gtcaaagatcagatggttgtag

SEQ ID NO: 1047572 - DNA, 22 bp, Artificial Sequence
  chemically synthesized
tcaggtttgtcaaagatcagat

SEQ ID NO: 1047573 - DNA, 22 bp, Artificial Sequence
  chemically synthesized
gtcaggtttgtcaaagatcaga

SEQ ID NO: 1047574 - DNA, 22 bp, Artificial Sequence
  chemically synthesized
tgtcaggtttgtcaaagatcag

SEQ ID NO: 1047575 - DNA, 22 bp, Artificial Sequence
  chemically synthesized
ttgtcaggtttgtcaaagatca

SEQ ID NO: 1047576 - DNA, 22 bp, Artificial Sequence
  chemically synthesized
tttttgtcaggtttgtcaaaga

SEQ ID NO: 1047577 - DNA, 22 bp, Artificial Sequence
  chemically synthesized
caaccatctgatctttgacaaa

SEQ ID NO: 1047578 - DNA, 22 bp, Artificial Sequence
  chemically synthesized
gtttttgtcaggtttgtcaaag

SEQ ID NO: 1047579 - DNA, 22 bp, Artificial Sequence
  chemically synthesized
cttgtttttgtcaggtttgtca

SEQ ID NO: 1047580 - DNA, 22 bp, Artificial Sequence
  chemically synthesized
atctttgacaaacctgacaaaa

SEQ ID NO: 1047581 - DNA, 22 bp, Artificial Sequence
  chemically synthesized
cacattgcttgtttttgtcagg

SEQ ID NO: 1047582 - DNA, 22 bp, Artificial Sequence
  chemically synthesized
ccacattgcttgtttttgtcag

SEQ ID NO: 1047583 - DNA, 22 bp, Artificial Sequence
  chemically synthesized
tccacattgcttgtttttgtca

SEQ ID NO: 1047584 - DNA, 22 bp, Artificial Sequence
  chemically synthesized
ttccacattgcttgtttttgtc

SEQ ID NO: 1047585 - DNA, 22 bp, Artificial Sequence
  chemically synthesized
tgacaaacctgacaaaaacaag

SEQ ID NO: 1047586 - DNA, 22 bp, Artificial Sequence
  chemically synthesized
gacaaacctgacaaaaacaagc

SEQ ID NO: 1047587 - DNA, 22 bp, Artificial Sequence
  chemically synthesized
acaaacctgacaaaaacaagca

SEQ ID NO: 1047588 - DNA, 22 bp, Artificial Sequence
  chemically synthesized
acaaaaacaagcaatgtggaaa

SEQ ID NO: 1047589 - DNA, 22 bp, Artificial Sequence
  chemically synthesized
aatagggaatcttttccacatt

SEQ ID NO: 1047590 - DNA, 22 bp, Artificial Sequence
  chemically synthesized
ttaaatagggaatcttttccac

SEQ ID NO: 1047591 - DNA, 22 bp, Artificial Sequence
  chemically synthesized
attaaatagggaatcttttcca

SEQ ID NO: 1047592 - DNA, 22 bp, Artificial Sequence
  chemically synthesized
ccgacaccatttattaaatagg

SEQ ID NO: 1047593 - DNA, 22 bp, Artificial Sequence
  chemically synthesized
cccgacaccatttattaaatag

SEQ ID NO: 1047594 - DNA, 22 bp, Artificial Sequence
  chemically synthesized
tcccgacaccatttattaaata

SEQ ID NO: 1047595 - DNA, 22 bp, Artificial Sequence
  chemically synthesized
cctatttaataaatggtgtcgg

SEQ ID NO: 1047596 - DNA, 22 bp, Artificial Sequence
  chemically synthesized
tttaataaatggtgtcgggaaa

SEQ ID NO: 1047597 - DNA, 22 bp, Artificial Sequence
  chemically synthesized
aataaatggtgtcgggaaaact

SEQ ID NO: 1047598 - DNA, 22 bp, Artificial Sequence
  chemically synthesized
ataaatggtgtcgggaaaactg

SEQ ID NO: 1047599 - DNA, 22 bp, Artificial Sequence
  chemically synthesized
catatggccagccagttttccc

SEQ ID NO: 1047600 - DNA, 22 bp, Artificial Sequence
  chemically synthesized
tgcatatggccagccagttttc

SEQ ID NO: 1047601 - DNA, 22 bp, Artificial Sequence
  chemically synthesized
ctgcatatggccagccagtttt

SEQ ID NO: 1047602 - DNA, 22 bp, Artificial Sequence
  chemically synthesized
tctgcatatggccagccagttt

SEQ ID NO: 1047603 - DNA, 22 bp, Artificial Sequence
  chemically synthesized
cgttttctgcatatggccagcc

SEQ ID NO: 1047604 - DNA, 22 bp, Artificial Sequence
  chemically synthesized
ccgttttctgcatatggccagc

SEQ ID NO: 1047605 - DNA, 22 bp, Artificial Sequence
  chemically synthesized
gtttccgttttctgcatatggc

SEQ ID NO: 1047606 - DNA, 22 bp, Artificial Sequence
  chemically synthesized
gctggccatatgcagaaaacgg

SEQ ID NO: 1047607 - DNA, 22 bp, Artificial Sequence
  chemically synthesized
gccatatgcagaaaacggaaac

SEQ ID NO: 1047608 - DNA, 22 bp, Artificial Sequence
  chemically synthesized
tataaggtgtaagaaaggggtc

SEQ ID NO: 1047609 - DNA, 22 bp, Artificial Sequence
  chemically synthesized
gtataaggtgtaagaaaggggt

SEQ ID NO: 1047610 - DNA, 22 bp, Artificial Sequence
  chemically synthesized
tgtataaggtgtaagaaagggg

SEQ ID NO: 1047611 - DNA, 22 bp, Artificial Sequence
  chemically synthesized
ttgtataaggtgtaagaaaggg

SEQ ID NO: 1047612 - DNA, 22 bp, Artificial Sequence
  chemically synthesized
atttttgtataaggtgtaagaa

SEQ ID NO: 1047613 - DNA, 22 bp, Artificial Sequence
  chemically synthesized
gacccctttcttacaccttata

SEQ ID NO: 1047614 - DNA, 22 bp, Artificial Sequence
  chemically synthesized
tcttacaccttatacaaaaatt

SEQ ID NO: 1047615 - DNA, 22 bp, Artificial Sequence
  chemically synthesized
cttacaccttatacaaaaatta

SEQ ID NO: 1047616 - DNA, 22 bp, Artificial Sequence
  chemically synthesized
ttacaccttatacaaaaattaa

SEQ ID NO: 1047617 - DNA, 22 bp, Artificial Sequence
  chemically synthesized
atccatcatgagttaatttttg

SEQ ID NO: 1047618 - DNA, 22 bp, Artificial Sequence
  chemically synthesized
aatccatcatgagttaattttt

SEQ ID NO: 1047619 - DNA, 22 bp, Artificial Sequence
  chemically synthesized
acaccttatacaaaaattaact

SEQ ID NO: 1047620 - DNA, 22 bp, Artificial Sequence
  chemically synthesized
taatccatcatgagttaatttt

SEQ ID NO: 1047621 - DNA, 22 bp, Artificial Sequence
  chemically synthesized
caccttatacaaaaattaactc

SEQ ID NO: 1047622 - DNA, 22 bp, Artificial Sequence
  chemically synthesized
agtctttaatccatcatgagtt

SEQ ID NO: 1047623 - DNA, 22 bp, Artificial Sequence
  chemically synthesized
atacaaaaattaactcatgatg

SEQ ID NO: 1047624 - DNA, 22 bp, Artificial Sequence
  chemically synthesized
aagtctttaatccatcatgagt

SEQ ID NO: 1047625 - DNA, 22 bp, Artificial Sequence
  chemically synthesized
tacaaaaattaactcatgatgg

SEQ ID NO: 1047626 - DNA, 22 bp, Artificial Sequence
  chemically synthesized
ggtttaagtctttaatccatca

SEQ ID NO: 1047627 - DNA, 22 bp, Artificial Sequence
  chemically synthesized
aggtttaagtctttaatccatc

SEQ ID NO: 1047628 - DNA, 22 bp, Artificial Sequence
  chemically synthesized
actcatgatggattaaagactt

SEQ ID NO: 1047629 - DNA, 22 bp, Artificial Sequence
  chemically synthesized
aggtcttaggtttaagtcttta

SEQ ID NO: 1047630 - DNA, 22 bp, Artificial Sequence
  chemically synthesized
caggtcttaggtttaagtcttt

SEQ ID NO: 1047631 - DNA, 22 bp, Artificial Sequence
  chemically synthesized
atgatggattaaagacttaaac

SEQ ID NO: 1047632 - DNA, 22 bp, Artificial Sequence
  chemically synthesized
tggtttcaggtcttaggtttaa

SEQ ID NO: 1047633 - DNA, 22 bp, Artificial Sequence
  chemically synthesized
atggtttcaggtcttaggttta

SEQ ID NO: 1047634 - DNA, 22 bp, Artificial Sequence
  chemically synthesized
tatggtttcaggtcttaggttt

SEQ ID NO: 1047635 - DNA, 22 bp, Artificial Sequence
  chemically synthesized
ttatggtttcaggtcttaggtt

SEQ ID NO: 1047636 - DNA, 22 bp, Artificial Sequence
  chemically synthesized
aagacttaaacctaagacctga

SEQ ID NO: 1047637 - DNA, 22 bp, Artificial Sequence
  chemically synthesized
gagtttttatggtttcaggtct

SEQ ID NO: 1047638 - DNA, 22 bp, Artificial Sequence
  chemically synthesized
tagagtttttatggtttcaggt

SEQ ID NO: 1047639 - DNA, 22 bp, Artificial Sequence
  chemically synthesized
ctagagtttttatggtttcagg

SEQ ID NO: 1047640 - DNA, 22 bp, Artificial Sequence
  chemically synthesized
aaacctaagacctgaaaccata

SEQ ID NO: 1047641 - DNA, 22 bp, Artificial Sequence
  chemically synthesized
ttctagagtttttatggtttca

SEQ ID NO: 1047642 - DNA, 22 bp, Artificial Sequence
  chemically synthesized
aacctaagacctgaaaccataa

SEQ ID NO: 1047643 - DNA, 22 bp, Artificial Sequence
  chemically synthesized
cttctagagtttttatggtttc

SEQ ID NO: 1047644 - DNA, 22 bp, Artificial Sequence
  chemically synthesized
tcttctagagtttttatggttt

SEQ ID NO: 1047645 - DNA, 22 bp, Artificial Sequence
  chemically synthesized
agacctgaaaccataaaaactc

SEQ ID NO: 1047646 - DNA, 22 bp, Artificial Sequence
  chemically synthesized
ggttttcttctagagtttttat

SEQ ID NO: 1047647 - DNA, 22 bp, Artificial Sequence
  chemically synthesized
cctaggttttcttctagagttt

SEQ ID NO: 1047648 - DNA, 22 bp, Artificial Sequence
  chemically synthesized
aaaccataaaaactctagaaga

SEQ ID NO: 1047649 - DNA, 22 bp, Artificial Sequence
  chemically synthesized
aatggtattgcctaggttttct

SEQ ID NO: 1047650 - DNA, 22 bp, Artificial Sequence
  chemically synthesized
tatcctgaatggtattgcctag

SEQ ID NO: 1047651 - DNA, 22 bp, Artificial Sequence
  chemically synthesized
tagaagaaaacctaggcaatac

SEQ ID NO: 1047652 - DNA, 22 bp, Artificial Sequence
  chemically synthesized
gaagaaaacctaggcaatacca

SEQ ID NO: 1047653 - DNA, 22 bp, Artificial Sequence
  chemically synthesized
cccatgcctgtatcctgaatgg

SEQ ID NO: 1047654 - DNA, 22 bp, Artificial Sequence
  chemically synthesized
gcccatgcctgtatcctgaatg

SEQ ID NO: 1047655 - DNA, 22 bp, Artificial Sequence
  chemically synthesized
tgcccatgcctgtatcctgaat

SEQ ID NO: 1047656 - DNA, 22 bp, Artificial Sequence
  chemically synthesized
ggcaataccattcaggatacag

SEQ ID NO: 1047657 - DNA, 22 bp, Artificial Sequence
  chemically synthesized
gtcatgaagtctttgcccatgc

SEQ ID NO: 1047658 - DNA, 22 bp, Artificial Sequence
  chemically synthesized
agtcatgaagtctttgcccatg

SEQ ID NO: 1047659 - DNA, 22 bp, Artificial Sequence
  chemically synthesized
tagtcatgaagtctttgcccat

SEQ ID NO: 1047660 - DNA, 22 bp, Artificial Sequence
  chemically synthesized
aggatacaggcatgggcaaaga

SEQ ID NO: 1047661 - DNA, 22 bp, Artificial Sequence
  chemically synthesized
gtgttttagtcatgaagtcttt

SEQ ID NO: 1047662 - DNA, 22 bp, Artificial Sequence
  chemically synthesized
ggtgttttagtcatgaagtctt

SEQ ID NO: 1047663 - DNA, 22 bp, Artificial Sequence
  chemically synthesized
tggtgttttagtcatgaagtct

SEQ ID NO: 1047664 - DNA, 22 bp, Artificial Sequence
  chemically synthesized
ttggtgttttagtcatgaagtc

SEQ ID NO: 1047665 - DNA, 22 bp, Artificial Sequence
  chemically synthesized
cttttggtgttttagtcatgaa

SEQ ID NO: 1047666 - DNA, 22 bp, Artificial Sequence
  chemically synthesized
ttgcttttggtgttttagtcat

SEQ ID NO: 1047667 - DNA, 22 bp, Artificial Sequence
  chemically synthesized
ctgttgcttttggtgttttagt

SEQ ID NO: 1047668 - DNA, 22 bp, Artificial Sequence
  chemically synthesized
ttgctgttgcttttggtgtttt

SEQ ID NO: 1047669 - DNA, 22 bp, Artificial Sequence
  chemically synthesized
gttgctgttgcttttggtgttt

SEQ ID NO: 1047670 - DNA, 22 bp, Artificial Sequence
  chemically synthesized
tgttgctgttgcttttggtgtt

SEQ ID NO: 1047671 - DNA, 22 bp, Artificial Sequence
  chemically synthesized
ttgttgctgttgcttttggtgt

SEQ ID NO: 1047672 - DNA, 22 bp, Artificial Sequence
  chemically synthesized
catgactaaaacaccaaaagca

SEQ ID NO: 1047673 - DNA, 22 bp, Artificial Sequence
  chemically synthesized
atgactaaaacaccaaaagcaa

SEQ ID NO: 1047674 - DNA, 22 bp, Artificial Sequence
  chemically synthesized
gcttttgttgctgttgcttttg

SEQ ID NO: 1047675 - DNA, 22 bp, Artificial Sequence
  chemically synthesized
ggcttttgttgctgttgctttt

SEQ ID NO: 1047676 - DNA, 22 bp, Artificial Sequence
  chemically synthesized
tggcttttgttgctgttgcttt

SEQ ID NO: 1047677 - DNA, 22 bp, Artificial Sequence
  chemically synthesized
aaacaccaaaagcaacagcaac

SEQ ID NO: 1047678 - DNA, 22 bp, Artificial Sequence
  chemically synthesized
tcaattttggcttttgttgctg

SEQ ID NO: 1047679 - DNA, 22 bp, Artificial Sequence
  chemically synthesized
gtcaattttggcttttgttgct

SEQ ID NO: 1047680 - DNA, 22 bp, Artificial Sequence
  chemically synthesized
gatcccatttgtcaattttggc

SEQ ID NO: 1047681 - DNA, 22 bp, Artificial Sequence
  chemically synthesized
attagatcccatttgtcaattt

SEQ ID NO: 1047682 - DNA, 22 bp, Artificial Sequence
  chemically synthesized
aattagatcccatttgtcaatt

SEQ ID NO: 1047683 - DNA, 22 bp, Artificial Sequence
  chemically synthesized
agtttaattagatcccatttgt

SEQ ID NO: 1047684 - DNA, 22 bp, Artificial Sequence
  chemically synthesized
cagtttaattagatcccatttg

SEQ ID NO: 1047685 - DNA, 22 bp, Artificial Sequence
  chemically synthesized
ttcagtttaattagatcccatt

SEQ ID NO: 1047686 - DNA, 22 bp, Artificial Sequence
  chemically synthesized
tgctcttcagtttaattagatc

SEQ ID NO: 1047687 - DNA, 22 bp, Artificial Sequence
  chemically synthesized
ctgtgctcttcagtttaattag

SEQ ID NO: 1047688 - DNA, 22 bp, Artificial Sequence
  chemically synthesized
acaaatgggatctaattaaact

SEQ ID NO: 1047689 - DNA, 22 bp, Artificial Sequence
  chemically synthesized
gctgtgctcttcagtttaatta

SEQ ID NO: 1047690 - DNA, 22 bp, Artificial Sequence
  chemically synthesized
tgctgtgctcttcagtttaatt

SEQ ID NO: 1047691 - DNA, 22 bp, Artificial Sequence
  chemically synthesized
ttgctgtgctcttcagtttaat

SEQ ID NO: 1047692 - DNA, 22 bp, Artificial Sequence
  chemically synthesized
attaaactgaagagcacagcaa

SEQ ID NO: 1047693 - DNA, 22 bp, Artificial Sequence
  chemically synthesized
atgatagggtcttttgctgtgc

SEQ ID NO: 1047694 - DNA, 22 bp, Artificial Sequence
  chemically synthesized
tcatgatagggtcttttgctgt

SEQ ID NO: 1047695 - DNA, 22 bp, Artificial Sequence
  chemically synthesized
aactgaagagcacagcaaaaga

SEQ ID NO: 1047696 - DNA, 22 bp, Artificial Sequence
  chemically synthesized
actctcatgatagggtcttttg

SEQ ID NO: 1047697 - DNA, 22 bp, Artificial Sequence
  chemically synthesized
aagagcacagcaaaagacccta

SEQ ID NO: 1047698 - DNA, 22 bp, Artificial Sequence
  chemically synthesized
ttgactctcatgatagggtctt

SEQ ID NO: 1047699 - DNA, 22 bp, Artificial Sequence
  chemically synthesized
cctgttgactctcatgataggg

SEQ ID NO: 1047700 - DNA, 22 bp, Artificial Sequence
  chemically synthesized
taggttgcctgttgactctcat

SEQ ID NO: 1047701 - DNA, 22 bp, Artificial Sequence
  chemically synthesized
tgtaggttgcctgttgactctc

SEQ ID NO: 1047702 - DNA, 22 bp, Artificial Sequence
  chemically synthesized
attctgtaggttgcctgttgac

SEQ ID NO: 1047703 - DNA, 22 bp, Artificial Sequence
  chemically synthesized
tcattctgtaggttgcctgttg

SEQ ID NO: 1047704 - DNA, 22 bp, Artificial Sequence
  chemically synthesized
tcatgagagtcaacaggcaacc

SEQ ID NO: 1047705 - DNA, 22 bp, Artificial Sequence
  chemically synthesized
tctcattctgtaggttgcctgt

SEQ ID NO: 1047706 - DNA, 22 bp, Artificial Sequence
  chemically synthesized
ctctcattctgtaggttgcctg

SEQ ID NO: 1047707 - DNA, 22 bp, Artificial Sequence
  chemically synthesized
tctctcattctgtaggttgcct

SEQ ID NO: 1047708 - DNA, 22 bp, Artificial Sequence
  chemically synthesized
caaaagttttctctcattctgt

SEQ ID NO: 1047709 - DNA, 22 bp, Artificial Sequence
  chemically synthesized
cagaatgagagaaaacttttgc

SEQ ID NO: 1047710 - DNA, 22 bp, Artificial Sequence
  chemically synthesized
tcagatggatagattgcaaaag

SEQ ID NO: 1047711 - DNA, 22 bp, Artificial Sequence
  chemically synthesized
gtcagatggatagattgcaaaa

SEQ ID NO: 1047712 - DNA, 22 bp, Artificial Sequence
  chemically synthesized
tgtcagatggatagattgcaaa

SEQ ID NO: 1047713 - DNA, 22 bp, Artificial Sequence
  chemically synthesized
ttgcaatctatccatctgacaa

SEQ ID NO: 1047714 - DNA, 22 bp, Artificial Sequence
  chemically synthesized
gataatagccctttgtcagatg

SEQ ID NO: 1047715 - DNA, 22 bp, Artificial Sequence
  chemically synthesized
tgcaatctatccatctgacaaa

SEQ ID NO: 1047716 - DNA, 22 bp, Artificial Sequence
  chemically synthesized
gcaatctatccatctgacaaag

SEQ ID NO: 1047717 - DNA, 22 bp, Artificial Sequence
  chemically synthesized
tggataatagccctttgtcaga

SEQ ID NO: 1047718 - DNA, 22 bp, Artificial Sequence
  chemically synthesized
caatctatccatctgacaaagg

SEQ ID NO: 1047719 - DNA, 22 bp, Artificial Sequence
  chemically synthesized
tagattctggataatagccctt

SEQ ID NO: 1047720 - DNA, 22 bp, Artificial Sequence
  chemically synthesized
tccatctgacaaagggctatta

SEQ ID NO: 1047721 - DNA, 22 bp, Artificial Sequence
  chemically synthesized
atagattctggataatagccct

SEQ ID NO: 1047722 - DNA, 22 bp, Artificial Sequence
  chemically synthesized
cttatagattctggataatagc

SEQ ID NO: 1047723 - DNA, 22 bp, Artificial Sequence
  chemically synthesized
acaaagggctattatccagaat

SEQ ID NO: 1047724 - DNA, 22 bp, Artificial Sequence
  chemically synthesized
agttccttatagattctggata

SEQ ID NO: 1047725 - DNA, 22 bp, Artificial Sequence
  chemically synthesized
aagttccttatagattctggat

SEQ ID NO: 1047726 - DNA, 22 bp, Artificial Sequence
  chemically synthesized
tttaagttccttatagattctg

SEQ ID NO: 1047727 - DNA, 22 bp, Artificial Sequence
  chemically synthesized
gtttaagttccttatagattct

SEQ ID NO: 1047728 - DNA, 22 bp, Artificial Sequence
  chemically synthesized
ttatccagaatctataaggaac

SEQ ID NO: 1047729 - DNA, 22 bp, Artificial Sequence
  chemically synthesized
taaatttgtttaagttccttat

SEQ ID NO: 1047730 - DNA, 22 bp, Artificial Sequence
  chemically synthesized
gtaaatttgtttaagttcctta

SEQ ID NO: 1047731 - DNA, 22 bp, Artificial Sequence
  chemically synthesized
tccagaatctataaggaactta

SEQ ID NO: 1047732 - DNA, 22 bp, Artificial Sequence
  chemically synthesized
ttgtaaatttgtttaagttcct

SEQ ID NO: 1047733 - DNA, 22 bp, Artificial Sequence
  chemically synthesized
cttgtaaatttgtttaagttcc

SEQ ID NO: 1047734 - DNA, 22 bp, Artificial Sequence
  chemically synthesized
tcttgtaaatttgtttaagttc

SEQ ID NO: 1047735 - DNA, 22 bp, Artificial Sequence
  chemically synthesized
ttcttgtaaatttgtttaagtt

SEQ ID NO: 1047736 - DNA, 22 bp, Artificial Sequence
  chemically synthesized
tttcttgtaaatttgtttaagt

SEQ ID NO: 1047737 - DNA, 22 bp, Artificial Sequence
  chemically synthesized
ttttcttgtaaatttgtttaag

SEQ ID NO: 1047738 - DNA, 22 bp, Artificial Sequence
  chemically synthesized
tttttcttgtaaatttgtttaa

SEQ ID NO: 1047739 - DNA, 22 bp, Artificial Sequence
  chemically synthesized
ttttttcttgtaaatttgttta

SEQ ID NO: 1047740 - DNA, 22 bp, Artificial Sequence
  chemically synthesized
taaggaacttaaacaaatttac

SEQ ID NO: 1047741 - DNA, 22 bp, Artificial Sequence
  chemically synthesized
atggggtcttttttttcttgta

SEQ ID NO: 1047742 - DNA, 22 bp, Artificial Sequence
  chemically synthesized
tgatggggtcttttttttcttg

SEQ ID NO: 1047743 - DNA, 22 bp, Artificial Sequence
  chemically synthesized
aaacaaatttacaagaaaaaaa

SEQ ID NO: 1047744 - DNA, 22 bp, Artificial Sequence
  chemically synthesized
ctgatggggtcttttttttctt

SEQ ID NO: 1047745 - DNA, 22 bp, Artificial Sequence
  chemically synthesized
aacaaatttacaagaaaaaaaa

SEQ ID NO: 1047746 - DNA, 22 bp, Artificial Sequence
  chemically synthesized
tctgatggggtcttttttttct

SEQ ID NO: 1047747 - DNA, 22 bp, Artificial Sequence
  chemically synthesized
cccactttctgatggggtcttt

SEQ ID NO: 1047748 - DNA, 22 bp, Artificial Sequence
  chemically synthesized
gcccactttctgatggggtctt

SEQ ID NO: 1047749 - DNA, 22 bp, Artificial Sequence
  chemically synthesized
acaagaaaaaaaagaccccatc

SEQ ID NO: 1047750 - DNA, 22 bp, Artificial Sequence
  chemically synthesized
tgcccactttctgatggggtct

SEQ ID NO: 1047751 - DNA, 22 bp, Artificial Sequence
  chemically synthesized
caagaaaaaaaagaccccatca

SEQ ID NO: 1047752 - DNA, 22 bp, Artificial Sequence
  chemically synthesized
atatcctttgcccactttctga

SEQ ID NO: 1047753 - DNA, 22 bp, Artificial Sequence
  chemically synthesized
ttcatatcctttgcccactttc

SEQ ID NO: 1047754 - DNA, 22 bp, Artificial Sequence
  chemically synthesized
cgaagtgtctgttcatatcctt

SEQ ID NO: 1047755 - DNA, 22 bp, Artificial Sequence
  chemically synthesized
gcgaagtgtctgttcatatcct

SEQ ID NO: 1047756 - DNA, 22 bp, Artificial Sequence
  chemically synthesized
tgcgaagtgtctgttcatatcc

SEQ ID NO: 1047757 - DNA, 22 bp, Artificial Sequence
  chemically synthesized
ttgcgaagtgtctgttcatatc

SEQ ID NO: 1047758 - DNA, 22 bp, Artificial Sequence
  chemically synthesized
ttttgcgaagtgtctgttcata

SEQ ID NO: 1047759 - DNA, 22 bp, Artificial Sequence
  chemically synthesized
cttttgcgaagtgtctgttcat

SEQ ID NO: 1047760 - DNA, 22 bp, Artificial Sequence
  chemically synthesized
gccgcgtaaatgtcttcttttg

SEQ ID NO: 1047761 - DNA, 22 bp, Artificial Sequence
  chemically synthesized
ttggccgcgtaaatgtcttctt

SEQ ID NO: 1047762 - DNA, 22 bp, Artificial Sequence
  chemically synthesized
gttggccgcgtaaatgtcttct

SEQ ID NO: 1047763 - DNA, 22 bp, Artificial Sequence
  chemically synthesized
tgtttgttggccgcgtaaatgt

SEQ ID NO: 1047764 - DNA, 22 bp, Artificial Sequence
  chemically synthesized
cgcaaaagaagacatttacgcg

SEQ ID NO: 1047765 - DNA, 22 bp, Artificial Sequence
  chemically synthesized
atgtttgttggccgcgtaaatg

SEQ ID NO: 1047766 - DNA, 22 bp, Artificial Sequence
  chemically synthesized
gcaaaagaagacatttacgcgg

SEQ ID NO: 1047767 - DNA, 22 bp, Artificial Sequence
  chemically synthesized
ttatgtttgttggccgcgtaaa

SEQ ID NO: 1047768 - DNA, 22 bp, Artificial Sequence
  chemically synthesized
cttatgtttgttggccgcgtaa

SEQ ID NO: 1047769 - DNA, 22 bp, Artificial Sequence
  chemically synthesized
tcttatgtttgttggccgcgta

SEQ ID NO: 1047770 - DNA, 22 bp, Artificial Sequence
  chemically synthesized
ttcttatgtttgttggccgcgt

SEQ ID NO: 1047771 - DNA, 22 bp, Artificial Sequence
  chemically synthesized
tttcttatgtttgttggccgcg

SEQ ID NO: 1047772 - DNA, 22 bp, Artificial Sequence
  chemically synthesized
ttttcttatgtttgttggccgc

SEQ ID NO: 1047773 - DNA, 22 bp, Artificial Sequence
  chemically synthesized
acgcggccaacaaacataagaa

SEQ ID NO: 1047774 - DNA, 22 bp, Artificial Sequence
  chemically synthesized
cgcggccaacaaacataagaaa

SEQ ID NO: 1047775 - DNA, 22 bp, Artificial Sequence
  chemically synthesized
atgaccagtgatgatgaggttt

SEQ ID NO: 1047776 - DNA, 22 bp, Artificial Sequence
  chemically synthesized
taatgaccagtgatgatgaggt

SEQ ID NO: 1047777 - DNA, 22 bp, Artificial Sequence
  chemically synthesized
tctaatgaccagtgatgatgag

SEQ ID NO: 1047778 - DNA, 22 bp, Artificial Sequence
  chemically synthesized
ctctaatgaccagtgatgatga

SEQ ID NO: 1047779 - DNA, 22 bp, Artificial Sequence
  chemically synthesized
catttctctaatgaccagtgat

SEQ ID NO: 1047780 - DNA, 22 bp, Artificial Sequence
  chemically synthesized
gcatttctctaatgaccagtga

SEQ ID NO: 1047781 - DNA, 22 bp, Artificial Sequence
  chemically synthesized
acttgcatttctctaatgacca

SEQ ID NO: 1047782 - DNA, 22 bp, Artificial Sequence
  chemically synthesized
gacttgcatttctctaatgacc

SEQ ID NO: 1047783 - DNA, 22 bp, Artificial Sequence
  chemically synthesized
tgacttgcatttctctaatgac

SEQ ID NO: 1047784 - DNA, 22 bp, Artificial Sequence
  chemically synthesized
atcatcactggtcattagagaa

SEQ ID NO: 1047785 - DNA, 22 bp, Artificial Sequence
  chemically synthesized
tggttttgacttgcatttctct

SEQ ID NO: 1047786 - DNA, 22 bp, Artificial Sequence
  chemically synthesized
gttgtggttttgacttgcattt

SEQ ID NO: 1047787 - DNA, 22 bp, Artificial Sequence
  chemically synthesized
gtcattagagaaatgcaagtca

SEQ ID NO: 1047788 - DNA, 22 bp, Artificial Sequence
  chemically synthesized
tctcgttgtggttttgacttgc

SEQ ID NO: 1047789 - DNA, 22 bp, Artificial Sequence
  chemically synthesized
gagaaatgcaagtcaaaaccac

SEQ ID NO: 1047790 - DNA, 22 bp, Artificial Sequence
  chemically synthesized
gtgtgagatgctatctcgttgt

SEQ ID NO: 1047791 - DNA, 22 bp, Artificial Sequence
  chemically synthesized
actggtgtgagatgctatctcg

SEQ ID NO: 1047792 - DNA, 22 bp, Artificial Sequence
  chemically synthesized
taactggtgtgagatgctatct

SEQ ID NO: 1047793 - DNA, 22 bp, Artificial Sequence
  chemically synthesized
atgatcgccattctaactggtg

SEQ ID NO: 1047794 - DNA, 22 bp, Artificial Sequence
  chemically synthesized
aatgatcgccattctaactggt

SEQ ID NO: 1047795 - DNA, 22 bp, Artificial Sequence
  chemically synthesized
taatgatcgccattctaactgg

SEQ ID NO: 1047796 - DNA, 22 bp, Artificial Sequence
  chemically synthesized
ttaatgatcgccattctaactg

SEQ ID NO: 1047797 - DNA, 22 bp, Artificial Sequence
  chemically synthesized
tttaatgatcgccattctaact

SEQ ID NO: 1047798 - DNA, 22 bp, Artificial Sequence
  chemically synthesized
actttttaatgatcgccattct

SEQ ID NO: 1047799 - DNA, 22 bp, Artificial Sequence
  chemically synthesized
acaccagttagaatggcgatca

SEQ ID NO: 1047800 - DNA, 22 bp, Artificial Sequence
  chemically synthesized
ctgactttttaatgatcgccat

SEQ ID NO: 1047801 - DNA, 22 bp, Artificial Sequence
  chemically synthesized
cctgactttttaatgatcgcca

SEQ ID NO: 1047802 - DNA, 22 bp, Artificial Sequence
  chemically synthesized
tttcctgactttttaatgatcg

SEQ ID NO: 1047803 - DNA, 22 bp, Artificial Sequence
  chemically synthesized
gaatggcgatcattaaaaagtc

SEQ ID NO: 1047804 - DNA, 22 bp, Artificial Sequence
  chemically synthesized
cagcatcagttgtttcctgact

SEQ ID NO: 1047805 - DNA, 22 bp, Artificial Sequence
  chemically synthesized
tccagcatcagttgtttcctga

SEQ ID NO: 1047806 - DNA, 22 bp, Artificial Sequence
  chemically synthesized
ctccagcatcagttgtttcctg

SEQ ID NO: 1047807 - DNA, 22 bp, Artificial Sequence
  chemically synthesized
aaaagtcaggaaacaactgatg

SEQ ID NO: 1047808 - DNA, 22 bp, Artificial Sequence
  chemically synthesized
cacatcttctccagcatcagtt

SEQ ID NO: 1047809 - DNA, 22 bp, Artificial Sequence
  chemically synthesized
tccacatcttctccagcatcag

SEQ ID NO: 1047810 - DNA, 22 bp, Artificial Sequence
  chemically synthesized
ctccacatcttctccagcatca

SEQ ID NO: 1047811 - DNA, 22 bp, Artificial Sequence
  chemically synthesized
tttctccacatcttctccagca

SEQ ID NO: 1047812 - DNA, 22 bp, Artificial Sequence
  chemically synthesized
ctatttctccacatcttctcca

SEQ ID NO: 1047813 - DNA, 22 bp, Artificial Sequence
  chemically synthesized
atgctggagaagatgtggagaa

SEQ ID NO: 1047814 - DNA, 22 bp, Artificial Sequence
  chemically synthesized
gagaagatgtggagaaatagga

SEQ ID NO: 1047815 - DNA, 22 bp, Artificial Sequence
  chemically synthesized
ccaccaacagtgtaaaagagtt

SEQ ID NO: 1047816 - DNA, 22 bp, Artificial Sequence
  chemically synthesized
cactcccaccaacagtgtaaaa

SEQ ID NO: 1047817 - DNA, 22 bp, Artificial Sequence
  chemically synthesized
acactcccaccaacagtgtaaa

SEQ ID NO: 1047818 - DNA, 22 bp, Artificial Sequence
  chemically synthesized
atttacactcccaccaacagtg

SEQ ID NO: 1047819 - DNA, 22 bp, Artificial Sequence
  chemically synthesized
ttttacactgttggtgggagtg

SEQ ID NO: 1047820 - DNA, 22 bp, Artificial Sequence
  chemically synthesized
ttacactgttggtgggagtgta

SEQ ID NO: 1047821 - DNA, 22 bp, Artificial Sequence
  chemically synthesized
tacactgttggtgggagtgtaa

SEQ ID NO: 1047822 - DNA, 22 bp, Artificial Sequence
  chemically synthesized
acactgttggtgggagtgtaaa

SEQ ID NO: 1047823 - DNA, 22 bp, Artificial Sequence
  chemically synthesized
cactgttggtgggagtgtaaat

SEQ ID NO: 1047824 - DNA, 22 bp, Artificial Sequence
  chemically synthesized
cacaatggtggaactaatttac

SEQ ID NO: 1047825 - DNA, 22 bp, Artificial Sequence
  chemically synthesized
ttggtgggagtgtaaattagtt

SEQ ID NO: 1047826 - DNA, 22 bp, Artificial Sequence
  chemically synthesized
ccacaatggtggaactaattta

SEQ ID NO: 1047827 - DNA, 22 bp, Artificial Sequence
  chemically synthesized
gtgggagtgtaaattagttcca

SEQ ID NO: 1047828 - DNA, 22 bp, Artificial Sequence
  chemically synthesized
tcttccacaatggtggaactaa

SEQ ID NO: 1047829 - DNA, 22 bp, Artificial Sequence
  chemically synthesized
cacactgtcttccacaatggtg

SEQ ID NO: 1047830 - DNA, 22 bp, Artificial Sequence
  chemically synthesized
gttccaccattgtggaagacag

SEQ ID NO: 1047831 - DNA, 22 bp, Artificial Sequence
  chemically synthesized
aggaatctgcacactgtcttcc

SEQ ID NO: 1047832 - DNA, 22 bp, Artificial Sequence
  chemically synthesized
gaggaatctgcacactgtcttc

SEQ ID NO: 1047833 - DNA, 22 bp, Artificial Sequence
  chemically synthesized
caccattgtggaagacagtgtg

SEQ ID NO: 1047834 - DNA, 22 bp, Artificial Sequence
  chemically synthesized
gatccttgaggaatctgcacac

SEQ ID NO: 1047835 - DNA, 22 bp, Artificial Sequence
  chemically synthesized
tagatccttgaggaatctgcac

SEQ ID NO: 1047836 - DNA, 22 bp, Artificial Sequence
  chemically synthesized
tggaagacagtgtgcagattcc

SEQ ID NO: 1047837 - DNA, 22 bp, Artificial Sequence
  chemically synthesized
gttctagatccttgaggaatct

SEQ ID NO: 1047838 - DNA, 22 bp, Artificial Sequence
  chemically synthesized
tggttctagatccttgaggaat

SEQ ID NO: 1047839 - DNA, 22 bp, Artificial Sequence
  chemically synthesized
ctggttctagatccttgaggaa

SEQ ID NO: 1047840 - DNA, 22 bp, Artificial Sequence
  chemically synthesized
ctcaaggatctagaaccagaaa

SEQ ID NO: 1047841 - DNA, 22 bp, Artificial Sequence
  chemically synthesized
ggtcaaatggtatttctggttc

SEQ ID NO: 1047842 - DNA, 22 bp, Artificial Sequence
  chemically synthesized
aaggatctagaaccagaaatac

SEQ ID NO: 1047843 - DNA, 22 bp, Artificial Sequence
  chemically synthesized
ctgggtcaaatggtatttctgg

SEQ ID NO: 1047844 - DNA, 22 bp, Artificial Sequence
  chemically synthesized
gaaccagaaataccatttgacc

SEQ ID NO: 1047845 - DNA, 22 bp, Artificial Sequence
  chemically synthesized
ggtatatatccagtaatgggat

SEQ ID NO: 1047846 - DNA, 22 bp, Artificial Sequence
  chemically synthesized
gggtatatatccagtaatggga

SEQ ID NO: 1047847 - DNA, 22 bp, Artificial Sequence
  chemically synthesized
tgggtatatatccagtaatggg

SEQ ID NO: 1047848 - DNA, 22 bp, Artificial Sequence
  chemically synthesized
gacccagcaatcccattactgg

SEQ ID NO: 1047849 - DNA, 22 bp, Artificial Sequence
  chemically synthesized
acccagcaatcccattactgga

SEQ ID NO: 1047850 - DNA, 22 bp, Artificial Sequence
  chemically synthesized
taatcctttgggtatatatcca

SEQ ID NO: 1047851 - DNA, 22 bp, Artificial Sequence
  chemically synthesized
ataatcctttgggtatatatcc

SEQ ID NO: 1047852 - DNA, 22 bp, Artificial Sequence
  chemically synthesized
ctggatatatacccaaaggatt

SEQ ID NO: 1047853 - DNA, 22 bp, Artificial Sequence
  chemically synthesized
gatatatacccaaaggattata

SEQ ID NO: 1047854 - DNA, 22 bp, Artificial Sequence
  chemically synthesized
tagtaggatgatttataatcct

SEQ ID NO: 1047855 - DNA, 22 bp, Artificial Sequence
  chemically synthesized
atagtaggatgatttataatcc

SEQ ID NO: 1047856 - DNA, 22 bp, Artificial Sequence
  chemically synthesized
tatagtaggatgatttataatc

SEQ ID NO: 1047857 - DNA, 22 bp, Artificial Sequence
  chemically synthesized
taaatcatcctactataaagac

SEQ ID NO: 1047858 - DNA, 22 bp, Artificial Sequence
  chemically synthesized
caataaacatacgtgtgcatgt

SEQ ID NO: 1047859 - DNA, 22 bp, Artificial Sequence
  chemically synthesized
ctataaagacacatgcacacgt

SEQ ID NO: 1047860 - DNA, 22 bp, Artificial Sequence
  chemically synthesized
taaagacacatgcacacgtatg

SEQ ID NO: 1047861 - DNA, 22 bp, Artificial Sequence
  chemically synthesized
tgaacagtgctgcaataaacat

SEQ ID NO: 1047862 - DNA, 22 bp, Artificial Sequence
  chemically synthesized
ttgtgaacagtgctgcaataaa

SEQ ID NO: 1047863 - DNA, 22 bp, Artificial Sequence
  chemically synthesized
ctattgtgaacagtgctgcaat

SEQ ID NO: 1047864 - DNA, 22 bp, Artificial Sequence
  chemically synthesized
gctattgtgaacagtgctgcaa

SEQ ID NO: 1047865 - DNA, 22 bp, Artificial Sequence
  chemically synthesized
tgctattgtgaacagtgctgca

SEQ ID NO: 1047866 - DNA, 22 bp, Artificial Sequence
  chemically synthesized
tttgctattgtgaacagtgctg

SEQ ID NO: 1047867 - DNA, 22 bp, Artificial Sequence
  chemically synthesized
caattctttgctattgtgaaca

SEQ ID NO: 1047868 - DNA, 22 bp, Artificial Sequence
  chemically synthesized
attgcagcactgttcacaatag

SEQ ID NO: 1047869 - DNA, 22 bp, Artificial Sequence
  chemically synthesized
ttgcagcactgttcacaatagc

SEQ ID NO: 1047870 - DNA, 22 bp, Artificial Sequence
  chemically synthesized
gttgcaattctttgctattgtg

SEQ ID NO: 1047871 - DNA, 22 bp, Artificial Sequence
  chemically synthesized
cagcactgttcacaatagcaaa

SEQ ID NO: 1047872 - DNA, 22 bp, Artificial Sequence
  chemically synthesized
ggttggttgcaattctttgcta

SEQ ID NO: 1047873 - DNA, 22 bp, Artificial Sequence
  chemically synthesized
gggttggttgcaattctttgct

SEQ ID NO: 1047874 - DNA, 22 bp, Artificial Sequence
  chemically synthesized
ttcacaatagcaaagaattgca

SEQ ID NO: 1047875 - DNA, 22 bp, Artificial Sequence
  chemically synthesized
acaatagcaaagaattgcaacc

SEQ ID NO: 1047876 - DNA, 22 bp, Artificial Sequence
  chemically synthesized
gtgggcatttgggttggttgca

SEQ ID NO: 1047877 - DNA, 22 bp, Artificial Sequence
  chemically synthesized
tcactggtgggcatttgggttg

SEQ ID NO: 1047878 - DNA, 22 bp, Artificial Sequence
  chemically synthesized
caaccaacccaaatgcccacca

SEQ ID NO: 1047879 - DNA, 22 bp, Artificial Sequence
  chemically synthesized
tccagtctatcactggtgggca

SEQ ID NO: 1047880 - DNA, 22 bp, Artificial Sequence
  chemically synthesized
atccagtctatcactggtgggc

SEQ ID NO: 1047881 - DNA, 22 bp, Artificial Sequence
  chemically synthesized
tatccagtctatcactggtggg

SEQ ID NO: 1047882 - DNA, 22 bp, Artificial Sequence
  chemically synthesized
tttatccagtctatcactggtg

SEQ ID NO: 1047883 - DNA, 22 bp, Artificial Sequence
  chemically synthesized
ctttatccagtctatcactggt

SEQ ID NO: 1047884 - DNA, 22 bp, Artificial Sequence
  chemically synthesized
tctttatccagtctatcactgg

SEQ ID NO: 1047885 - DNA, 22 bp, Artificial Sequence
  chemically synthesized
gataaagaaaattgacacatat

SEQ ID NO: 1047886 - DNA, 22 bp, Artificial Sequence
  chemically synthesized
catagtgtcccatggtgtatat

SEQ ID NO: 1047887 - DNA, 22 bp, Artificial Sequence
  chemically synthesized
tggctgcatagtgtcccatggt

SEQ ID NO: 1047888 - DNA, 22 bp, Artificial Sequence
  chemically synthesized
atggctgcatagtgtcccatgg

SEQ ID NO: 1047889 - DNA, 22 bp, Artificial Sequence
  chemically synthesized
acacatatacaccatgggacac

SEQ ID NO: 1047890 - DNA, 22 bp, Artificial Sequence
  chemically synthesized
tatggctgcatagtgtcccatg

SEQ ID NO: 1047891 - DNA, 22 bp, Artificial Sequence
  chemically synthesized
ttatggctgcatagtgtcccat

SEQ ID NO: 1047892 - DNA, 22 bp, Artificial Sequence
  chemically synthesized
tttatggctgcatagtgtccca

SEQ ID NO: 1047893 - DNA, 22 bp, Artificial Sequence
  chemically synthesized
ttttatggctgcatagtgtccc

SEQ ID NO: 1047894 - DNA, 22 bp, Artificial Sequence
  chemically synthesized
ttttttatggctgcatagtgtc

SEQ ID NO: 1047895 - DNA, 22 bp, Artificial Sequence
  chemically synthesized
attcttttttatggctgcatag

SEQ ID NO: 1047896 - DNA, 22 bp, Artificial Sequence
  chemically synthesized
tgcagccataaaaaagaatgag

SEQ ID NO: 1047897 - DNA, 22 bp, Artificial Sequence
  chemically synthesized
caaaggacacgaactcattctt

SEQ ID NO: 1047898 - DNA, 22 bp, Artificial Sequence
  chemically synthesized
ctgcaaaggacacgaactcatt

SEQ ID NO: 1047899 - DNA, 22 bp, Artificial Sequence
  chemically synthesized
atccatgttcctgcaaaggaca

SEQ ID NO: 1047900 - DNA, 22 bp, Artificial Sequence
  chemically synthesized
catccatgttcctgcaaaggac

SEQ ID NO: 1047901 - DNA, 22 bp, Artificial Sequence
  chemically synthesized
gtttcatccatgttcctgcaaa

SEQ ID NO: 1047902 - DNA, 22 bp, Artificial Sequence
  chemically synthesized
tagtttcatccatgttcctgca

SEQ ID NO: 1047903 - DNA, 22 bp, Artificial Sequence
  chemically synthesized
ctagtttcatccatgttcctgc

SEQ ID NO: 1047904 - DNA, 22 bp, Artificial Sequence
  chemically synthesized
gtgtcctttgcaggaacatgga

SEQ ID NO: 1047905 - DNA, 22 bp, Artificial Sequence
  chemically synthesized
tgcaggaacatggatgaaacta

SEQ ID NO: 1047906 - DNA, 22 bp, Artificial Sequence
  chemically synthesized
gcaggaacatggatgaaactag

SEQ ID NO: 1047907 - DNA, 22 bp, Artificial Sequence
  chemically synthesized
caggaacatggatgaaactaga

SEQ ID NO: 1047908 - DNA, 22 bp, Artificial Sequence
  chemically synthesized
agaatgacggtttctagtttca

SEQ ID NO: 1047909 - DNA, 22 bp, Artificial Sequence
  chemically synthesized
ctgagaatgacggtttctagtt

SEQ ID NO: 1047910 - DNA, 22 bp, Artificial Sequence
  chemically synthesized
gctgagaatgacggtttctagt

SEQ ID NO: 1047911 - DNA, 22 bp, Artificial Sequence
  chemically synthesized
gtttgctgagaatgacggtttc

SEQ ID NO: 1047912 - DNA, 22 bp, Artificial Sequence
  chemically synthesized
tgttagtttgctgagaatgacg

SEQ ID NO: 1047913 - DNA, 22 bp, Artificial Sequence
  chemically synthesized
ctgtgttagtttgctgagaatg

SEQ ID NO: 1047914 - DNA, 22 bp, Artificial Sequence
  chemically synthesized
ttcctgtgttagtttgctgaga

SEQ ID NO: 1047915 - DNA, 22 bp, Artificial Sequence
  chemically synthesized
gaaaccgtcattctcagcaaac

SEQ ID NO: 1047916 - DNA, 22 bp, Artificial Sequence
  chemically synthesized
tgttcctgtgttagtttgctga

SEQ ID NO: 1047917 - DNA, 22 bp, Artificial Sequence
  chemically synthesized
ctgttcctgtgttagtttgctg

SEQ ID NO: 1047918 - DNA, 22 bp, Artificial Sequence
  chemically synthesized
tctgttcctgtgttagtttgct

SEQ ID NO: 1047919 - DNA, 22 bp, Artificial Sequence
  chemically synthesized
gttttctgttcctgtgttagtt

SEQ ID NO: 1047920 - DNA, 22 bp, Artificial Sequence
  chemically synthesized
ggttttctgttcctgtgttagt

SEQ ID NO: 1047921 - DNA, 22 bp, Artificial Sequence
  chemically synthesized
tcagcaaactaacacaggaaca

SEQ ID NO: 1047922 - DNA, 22 bp, Artificial Sequence
  chemically synthesized
agcaaactaacacaggaacaga

SEQ ID NO: 1047923 - DNA, 22 bp, Artificial Sequence
  chemically synthesized
acacaggaacagaaaaccaaac

SEQ ID NO: 1047924 - DNA, 22 bp, Artificial Sequence
  chemically synthesized
tcagtgagaacatgcagtgttt

SEQ ID NO: 1047925 - DNA, 22 bp, Artificial Sequence
  chemically synthesized
ccattatcagtgagaacatgca

SEQ ID NO: 1047926 - DNA, 22 bp, Artificial Sequence
  chemically synthesized
aactcccattatcagtgagaac

SEQ ID NO: 1047927 - DNA, 22 bp, Artificial Sequence
  chemically synthesized
ttcaactcccattatcagtgag

SEQ ID NO: 1047928 - DNA, 22 bp, Artificial Sequence
  chemically synthesized
attgttcaactcccattatcag

SEQ ID NO: 1047929 - DNA, 22 bp, Artificial Sequence
  chemically synthesized
cattgttcaactcccattatca

SEQ ID NO: 1047930 - DNA, 22 bp, Artificial Sequence
  chemically synthesized
catgttctcactgataatggga

SEQ ID NO: 1047931 - DNA, 22 bp, Artificial Sequence
  chemically synthesized
tcattgttcaactcccattatc

SEQ ID NO: 1047932 - DNA, 22 bp, Artificial Sequence
  chemically synthesized
tcactgataatgggagttgaac

SEQ ID NO: 1047933 - DNA, 22 bp, Artificial Sequence
  chemically synthesized
actgataatgggagttgaacaa

SEQ ID NO: 1047934 - DNA, 22 bp, Artificial Sequence
  chemically synthesized
ataatgggagttgaacaatgaa

SEQ ID NO: 1047935 - DNA, 22 bp, Artificial Sequence
  chemically synthesized
cggccatatgttttcattgttc

SEQ ID NO: 1047936 - DNA, 22 bp, Artificial Sequence
  chemically synthesized
aacaatgaaaacatatggccgc

SEQ ID NO: 1047937 - DNA, 22 bp, Artificial Sequence
  chemically synthesized
ccccccacccgccaacaggccc

SEQ ID NO: 1047938 - DNA, 22 bp, Artificial Sequence
  chemically synthesized
gccccccacccgccaacaggcc

SEQ ID NO: 1047939 - DNA, 22 bp, Artificial Sequence
  chemically synthesized
cccttgccccccacccgccaac

SEQ ID NO: 1047940 - DNA, 22 bp, Artificial Sequence
  chemically synthesized
tccctccccttgccccccaccc

SEQ ID NO: 1047941 - DNA, 22 bp, Artificial Sequence
  chemically synthesized
atgctatccctccccttgcccc

SEQ ID NO: 1047942 - DNA, 22 bp, Artificial Sequence
  chemically synthesized
ttggcgggtggggggcaagggg

SEQ ID NO: 1047943 - DNA, 22 bp, Artificial Sequence
  chemically synthesized
ctaatgctatccctccccttgc

SEQ ID NO: 1047944 - DNA, 22 bp, Artificial Sequence
  chemically synthesized
gcgggtggggggcaaggggagg

SEQ ID NO: 1047945 - DNA, 22 bp, Artificial Sequence
  chemically synthesized
tcctaatgctatccctcccctt

SEQ ID NO: 1047946 - DNA, 22 bp, Artificial Sequence
  chemically synthesized
ctcctaatgctatccctcccct

SEQ ID NO: 1047947 - DNA, 22 bp, Artificial Sequence
  chemically synthesized
ggtatttctcctaatgctatcc

SEQ ID NO: 1047948 - DNA, 22 bp, Artificial Sequence
  chemically synthesized
cattaggtatttctcctaatgc

SEQ ID NO: 1047949 - DNA, 22 bp, Artificial Sequence
  chemically synthesized
tcatctacattaggtatttctc

SEQ ID NO: 1047950 - DNA, 22 bp, Artificial Sequence
  chemically synthesized
ggagaaatacctaatgtagatg

SEQ ID NO: 1047951 - DNA, 22 bp, Artificial Sequence
  chemically synthesized
cacccatcaacctgtcatctac

SEQ ID NO: 1047952 - DNA, 22 bp, Artificial Sequence
  chemically synthesized
ctgcacccatcaacctgtcatc

SEQ ID NO: 1047953 - DNA, 22 bp, Artificial Sequence
  chemically synthesized
gctgcacccatcaacctgtcat

SEQ ID NO: 1047954 - DNA, 22 bp, Artificial Sequence
  chemically synthesized
atgtagatgacaggttgatggg

SEQ ID NO: 1047955 - DNA, 22 bp, Artificial Sequence
  chemically synthesized
cgtggtggtttgctgcacccat

SEQ ID NO: 1047956 - DNA, 22 bp, Artificial Sequence
  chemically synthesized
atgggtgcagcaaaccaccacg

SEQ ID NO: 1047957 - DNA, 22 bp, Artificial Sequence
  chemically synthesized
cataggtatacatgttccgtgg

SEQ ID NO: 1047958 - DNA, 22 bp, Artificial Sequence
  chemically synthesized
ttgcataggtatacatgttccg

SEQ ID NO: 1047959 - DNA, 22 bp, Artificial Sequence
  chemically synthesized
gttgcataggtatacatgttcc

SEQ ID NO: 1047960 - DNA, 22 bp, Artificial Sequence
  chemically synthesized
ggatacatgtacagaacgtgca

SEQ ID NO: 1047961 - DNA, 22 bp, Artificial Sequence
  chemically synthesized
tgcaacaaacctgcacgttctg

SEQ ID NO: 1047962 - DNA, 22 bp, Artificial Sequence
  chemically synthesized
tgggatacatgtacagaacgtg

SEQ ID NO: 1047963 - DNA, 22 bp, Artificial Sequence
  chemically synthesized
agttctgggatacatgtacaga

SEQ ID NO: 1047964 - DNA, 22 bp, Artificial Sequence
  chemically synthesized
aagttctgggatacatgtacag

SEQ ID NO: 1047965 - DNA, 22 bp, Artificial Sequence
  chemically synthesized
tacttaagttctgggatacatg

SEQ ID NO: 1047966 - DNA, 22 bp, Artificial Sequence
  chemically synthesized
cacgttctgtacatgtatccca

SEQ ID NO: 1047967 - DNA, 22 bp, Artificial Sequence
  chemically synthesized
attatacttaagttctgggata

SEQ ID NO: 1047968 - DNA, 22 bp, Artificial Sequence
  chemically synthesized
aattatacttaagttctgggat

SEQ ID NO: 1047969 - DNA, 22 bp, Artificial Sequence
  chemically synthesized
taattatacttaagttctggga

SEQ ID NO: 1047970 - DNA, 22 bp, Artificial Sequence
  chemically synthesized
ttaattatacttaagttctggg

SEQ ID NO: 1047971 - DNA, 22 bp, Artificial Sequence
  chemically synthesized
tgtacatgtatcccagaactta

SEQ ID NO: 1047972 - DNA, 22 bp, Artificial Sequence
  chemically synthesized
tttaattatacttaagttctgg

SEQ ID NO: 1047973 - DNA, 22 bp, Artificial Sequence
  chemically synthesized
ttttaattatacttaagttctg

SEQ ID NO: 1047974 - DNA, 22 bp, Artificial Sequence
  chemically synthesized
tacatgtatcccagaacttaag

SEQ ID NO: 1047975 - DNA, 22 bp, Artificial Sequence
  chemically synthesized
tttttaattatacttaagttct

SEQ ID NO: 1047976 - DNA, 22 bp, Artificial Sequence
  chemically synthesized
ttttttaattatacttaagttc

SEQ ID NO: 1047977 - DNA, 22 bp, Artificial Sequence
  chemically synthesized
tttttttaattatacttaagtt

SEQ ID NO: 1047978 - DNA, 22 bp, Artificial Sequence
  chemically synthesized
ttttttttaattatacttaagt

SEQ ID NO: 1047979 - DNA, 22 bp, Artificial Sequence
  chemically synthesized
tttttttttaattatacttaag

SEQ ID NO: 1047980 - DNA, 22 bp, Artificial Sequence
  chemically synthesized
tttttttttttaattatactta

SEQ ID NO: 1047981 - DNA, 22 bp, Artificial Sequence
  chemically synthesized
ctttttttttttaattatactt

SEQ ID NO: 1047982 - DNA, 22 bp, Artificial Sequence
  chemically synthesized
tctttttttttttaattatact

SEQ ID NO: 1047983 - DNA, 22 bp, Artificial Sequence
  chemically synthesized
ttctttttttttttaattatac

SEQ ID NO: 1047984 - DNA, 22 bp, Artificial Sequence
  chemically synthesized
tttctttttttttttaattata

SEQ ID NO: 1047985 - DNA, 22 bp, Artificial Sequence
  chemically synthesized
aatgattttttctttttttttt

SEQ ID NO: 1047986 - DNA, 22 bp, Artificial Sequence
  chemically synthesized
aagtataattaaaaaaaaaaag

SEQ ID NO: 1047987 - DNA, 22 bp, Artificial Sequence
  chemically synthesized
agtataattaaaaaaaaaaaga

SEQ ID NO: 1047988 - DNA, 22 bp, Artificial Sequence
  chemically synthesized
aaaaaaaaaagaaaaaatcatt

SEQ ID NO: 1047989 - DNA, 22 bp, Artificial Sequence
  chemically synthesized
tccagtgtcactgaatgatttt

SEQ ID NO: 1047990 - DNA, 22 bp, Artificial Sequence
  chemically synthesized
atccagtgtcactgaatgattt

SEQ ID NO: 1047991 - DNA, 22 bp, Artificial Sequence
  chemically synthesized
tatccagtgtcactgaatgatt

SEQ ID NO: 1047992 - DNA, 22 bp, Artificial Sequence
  chemically synthesized
ttttatccagtgtcactgaatg

SEQ ID NO: 1047993 - DNA, 22 bp, Artificial Sequence
  chemically synthesized
attttatccagtgtcactgaat

SEQ ID NO: 1047994 - DNA, 22 bp, Artificial Sequence
  chemically synthesized
tattttatccagtgtcactgaa

SEQ ID NO: 1047995 - DNA, 22 bp, Artificial Sequence
  chemically synthesized
ttattttatccagtgtcactga

SEQ ID NO: 1047996 - DNA, 22 bp, Artificial Sequence
  chemically synthesized
atttttattttatccagtgtca

SEQ ID NO: 1047997 - DNA, 22 bp, Artificial Sequence
  chemically synthesized
agtgacactggataaaataaaa

SEQ ID NO: 1047998 - DNA, 22 bp, Artificial Sequence
  chemically synthesized
agtgaatctaatttttatttta

SEQ ID NO: 1047999 - DNA, 22 bp, Artificial Sequence
  chemically synthesized
taagtgaatctaatttttattt

SEQ ID NO: 1048000 - DNA, 22 bp, Artificial Sequence
  chemically synthesized
ctaagtgaatctaatttttatt

SEQ ID NO: 1048001 - DNA, 22 bp, Artificial Sequence
  chemically synthesized
tctaagtgaatctaatttttat

SEQ ID NO: 1048002 - DNA, 22 bp, Artificial Sequence
  chemically synthesized
ttttctaagtgaatctaatttt

SEQ ID NO: 1048003 - DNA, 22 bp, Artificial Sequence
  chemically synthesized
gataaaataaaaattagattca

SEQ ID NO: 1048004 - DNA, 22 bp, Artificial Sequence
  chemically synthesized
ttattttctaagtgaatctaat

SEQ ID NO: 1048005 - DNA, 22 bp, Artificial Sequence
  chemically synthesized
agagcacgaattattattttct

SEQ ID NO: 1048006 - DNA, 22 bp, Artificial Sequence
  chemically synthesized
gattcacttagaaaataataat

SEQ ID NO: 1048007 - DNA, 22 bp, Artificial Sequence
  chemically synthesized
gtctgagagcacgaattattat

SEQ ID NO: 1048008 - DNA, 22 bp, Artificial Sequence
  chemically synthesized
tggtctgagagcacgaattatt

SEQ ID NO: 1048009 - DNA, 22 bp, Artificial Sequence
  chemically synthesized
acttagaaaataataattcgtg

SEQ ID NO: 1048010 - DNA, 22 bp, Artificial Sequence
  chemically synthesized
agaaaataataattcgtgctct

SEQ ID NO: 1048011 - DNA, 22 bp, Artificial Sequence
  chemically synthesized
gaaaataataattcgtgctctc

SEQ ID NO: 1048012 - DNA, 22 bp, Artificial Sequence
  chemically synthesized
agacacagaattctggtctgag

SEQ ID NO: 1048013 - DNA, 22 bp, Artificial Sequence
  chemically synthesized
ctgagacacagaattctggtct

SEQ ID NO: 1048014 - DNA, 22 bp, Artificial Sequence
  chemically synthesized
gctgagacacagaattctggtc

SEQ ID NO: 1048015 - DNA, 22 bp, Artificial Sequence
  chemically synthesized
gtgctctcagaccagaattctg

SEQ ID NO: 1048016 - DNA, 22 bp, Artificial Sequence
  chemically synthesized
tttgctgagacacagaattctg

SEQ ID NO: 1048017 - DNA, 22 bp, Artificial Sequence
  chemically synthesized
atttgctgagacacagaattct

SEQ ID NO: 1048018 - DNA, 22 bp, Artificial Sequence
  chemically synthesized
tcagaccagaattctgtgtctc

SEQ ID NO: 1048019 - DNA, 22 bp, Artificial Sequence
  chemically synthesized
gatcttatttgctgagacacag

SEQ ID NO: 1048020 - DNA, 22 bp, Artificial Sequence
  chemically synthesized
agaccagaattctgtgtctcag

SEQ ID NO: 1048021 - DNA, 22 bp, Artificial Sequence
  chemically synthesized
acactggatcttatttgctgag

SEQ ID NO: 1048022 - DNA, 22 bp, Artificial Sequence
  chemically synthesized
tgattaacactggatcttattt

SEQ ID NO: 1048023 - DNA, 22 bp, Artificial Sequence
  chemically synthesized
tgtgtctcagcaaataagatcc

SEQ ID NO: 1048024 - DNA, 22 bp, Artificial Sequence
  chemically synthesized
tgtctcagcaaataagatccag

SEQ ID NO: 1048025 - DNA, 22 bp, Artificial Sequence
  chemically synthesized
ggactatgattaacactggatc

SEQ ID NO: 1048026 - DNA, 22 bp, Artificial Sequence
  chemically synthesized
aggactatgattaacactggat

SEQ ID NO: 1048027 - DNA, 22 bp, Artificial Sequence
  chemically synthesized
agcaaataagatccagtgttaa

SEQ ID NO: 1048028 - DNA, 22 bp, Artificial Sequence
  chemically synthesized
gtttaggactatgattaacact

SEQ ID NO: 1048029 - DNA, 22 bp, Artificial Sequence
  chemically synthesized
agccctggtttaggactatgat

SEQ ID NO: 1048030 - DNA, 22 bp, Artificial Sequence
  chemically synthesized
aagccctggtttaggactatga

SEQ ID NO: 1048031 - DNA, 22 bp, Artificial Sequence
  chemically synthesized
taagccctggtttaggactatg

SEQ ID NO: 1048032 - DNA, 22 bp, Artificial Sequence
  chemically synthesized
tttaagccctggtttaggacta

SEQ ID NO: 1048033 - DNA, 22 bp, Artificial Sequence
  chemically synthesized
cattctttaagccctggtttag

SEQ ID NO: 1048034 - DNA, 22 bp, Artificial Sequence
  chemically synthesized
atcatagtcctaaaccagggct

SEQ ID NO: 1048035 - DNA, 22 bp, Artificial Sequence
  chemically synthesized
cctacattctttaagccctggt

SEQ ID NO: 1048036 - DNA, 22 bp, Artificial Sequence
  chemically synthesized
aaccagggcttaaagaatgtag

SEQ ID NO: 1048037 - DNA, 22 bp, Artificial Sequence
  chemically synthesized
aaagaatgtaggcagcacacca

SEQ ID NO: 1048038 - DNA, 22 bp, Artificial Sequence
  chemically synthesized
aagaatgtaggcagcacaccat

SEQ ID NO: 1048039 - DNA, 22 bp, Artificial Sequence
  chemically synthesized
acagatgagaagccagggtatg

SEQ ID NO: 1048040 - DNA, 22 bp, Artificial Sequence
  chemically synthesized
aacagatgagaagccagggtat

SEQ ID NO: 1048041 - DNA, 22 bp, Artificial Sequence
  chemically synthesized
gcttctcatctgttaagcttct

SEQ ID NO: 1048042 - DNA, 22 bp, Artificial Sequence
  chemically synthesized
ctcatctgttaagcttctctcc

SEQ ID NO: 1048043 - DNA, 22 bp, Artificial Sequence
  chemically synthesized
tcatctgttaagcttctctcca

SEQ ID NO: 1048044 - DNA, 22 bp, Artificial Sequence
  chemically synthesized
atctgttaagcttctctccacc

SEQ ID NO: 1048045 - DNA, 22 bp, Artificial Sequence
  chemically synthesized
ttaagcttctctccacctgacc

SEQ ID NO: 1048046 - DNA, 22 bp, Artificial Sequence
  chemically synthesized
tggtagacacatggggtcaggt

SEQ ID NO: 1048047 - DNA, 22 bp, Artificial Sequence
  chemically synthesized
agcttctctccacctgacccca

SEQ ID NO: 1048048 - DNA, 22 bp, Artificial Sequence
  chemically synthesized
ctctccacctgaccccatgtgt

SEQ ID NO: 1048049 - DNA, 22 bp, Artificial Sequence
  chemically synthesized
tctccacctgaccccatgtgtc

SEQ ID NO: 1048050 - DNA, 22 bp, Artificial Sequence
  chemically synthesized
tccacctgaccccatgtgtcta

SEQ ID NO: 1048051 - DNA, 22 bp, Artificial Sequence
  chemically synthesized
cacctgaccccatgtgtctacc

SEQ ID NO: 1048052 - DNA, 22 bp, Artificial Sequence
  chemically synthesized
accccatgtgtctaccatagat

SEQ ID NO: 1048053 - DNA, 22 bp, Artificial Sequence
  chemically synthesized
aatcggtatataataatctatg

SEQ ID NO: 1048054 - DNA, 22 bp, Artificial Sequence
  chemically synthesized
ttaaatcggtatataataatct

SEQ ID NO: 1048055 - DNA, 22 bp, Artificial Sequence
  chemically synthesized
gttaaatcggtatataataatc

SEQ ID NO: 1048056 - DNA, 22 bp, Artificial Sequence
  chemically synthesized
ccatagattattatataccgat

SEQ ID NO: 1048057 - DNA, 22 bp, Artificial Sequence
  chemically synthesized
aagaatatttgttaaatcggta

SEQ ID NO: 1048058 - DNA, 22 bp, Artificial Sequence
  chemically synthesized
tgaagaatatttgttaaatcgg

SEQ ID NO: 1048059 - DNA, 22 bp, Artificial Sequence
  chemically synthesized
ttatataccgatttaacaaata

SEQ ID NO: 1048060 - DNA, 22 bp, Artificial Sequence
  chemically synthesized
atgttctgaagaatatttgtta

SEQ ID NO: 1048061 - DNA, 22 bp, Artificial Sequence
  chemically synthesized
aatgttctgaagaatatttgtt

SEQ ID NO: 1048062 - DNA, 22 bp, Artificial Sequence
  chemically synthesized
tataccgatttaacaaatattc

SEQ ID NO: 1048063 - DNA, 22 bp, Artificial Sequence
  chemically synthesized
gtttaatgttctgaagaatatt

SEQ ID NO: 1048064 - DNA, 22 bp, Artificial Sequence
  chemically synthesized
agtttaatgttctgaagaatat

SEQ ID NO: 1048065 - DNA, 22 bp, Artificial Sequence
  chemically synthesized
tagtttaatgttctgaagaata

SEQ ID NO: 1048066 - DNA, 22 bp, Artificial Sequence
  chemically synthesized
ttagtttaatgttctgaagaat

SEQ ID NO: 1048067 - DNA, 22 bp, Artificial Sequence
  chemically synthesized
aacaaatattcttcagaacatt

SEQ ID NO: 1048068 - DNA, 22 bp, Artificial Sequence
  chemically synthesized
acaaatattcttcagaacatta

SEQ ID NO: 1048069 - DNA, 22 bp, Artificial Sequence
  chemically synthesized
ttcagaacattaaactaaaaac

SEQ ID NO: 1048070 - DNA, 22 bp, Artificial Sequence
  chemically synthesized
cagaacattaaactaaaaacca

SEQ ID NO: 1048071 - DNA, 22 bp, Artificial Sequence
  chemically synthesized
agaacattaaactaaaaaccat

SEQ ID NO: 1048072 - DNA, 22 bp, Artificial Sequence
  chemically synthesized
aaagataggtgaaaatggtttt

SEQ ID NO: 1048073 - DNA, 22 bp, Artificial Sequence
  chemically synthesized
gaaagataggtgaaaatggttt

SEQ ID NO: 1048074 - DNA, 22 bp, Artificial Sequence
  chemically synthesized
tgaaagataggtgaaaatggtt

SEQ ID NO: 1048075 - DNA, 22 bp, Artificial Sequence
  chemically synthesized
tttgaaagataggtgaaaatgg

SEQ ID NO: 1048076 - DNA, 22 bp, Artificial Sequence
  chemically synthesized
ctttgaaagataggtgaaaatg

SEQ ID NO: 1048077 - DNA, 22 bp, Artificial Sequence
  chemically synthesized
tctttgaaagataggtgaaaat

SEQ ID NO: 1048078 - DNA, 22 bp, Artificial Sequence
  chemically synthesized
aactaaaaaccattttcaccta

SEQ ID NO: 1048079 - DNA, 22 bp, Artificial Sequence
  chemically synthesized
aaaaccattttcacctatcttt

SEQ ID NO: 1048080 - DNA, 22 bp, Artificial Sequence
  chemically synthesized
aaagagattttctttgaaagat

SEQ ID NO: 1048081 - DNA, 22 bp, Artificial Sequence
  chemically synthesized
taaaagagattttctttgaaag

SEQ ID NO: 1048082 - DNA, 22 bp, Artificial Sequence
  chemically synthesized
ctaaaagagattttctttgaaa

SEQ ID NO: 1048083 - DNA, 22 bp, Artificial Sequence
  chemically synthesized
ttctaaaagagattttctttga

SEQ ID NO: 1048084 - DNA, 22 bp, Artificial Sequence
  chemically synthesized
tcacctatctttcaaagaaaat

SEQ ID NO: 1048085 - DNA, 22 bp, Artificial Sequence
  chemically synthesized
cacctatctttcaaagaaaatc

SEQ ID NO: 1048086 - DNA, 22 bp, Artificial Sequence
  chemically synthesized
acctatctttcaaagaaaatct

SEQ ID NO: 1048087 - DNA, 22 bp, Artificial Sequence
  chemically synthesized
tctttcaaagaaaatctctttt

SEQ ID NO: 1048088 - DNA, 22 bp, Artificial Sequence
  chemically synthesized
tcaaagaaaatctcttttagaa

SEQ ID NO: 1048089 - DNA, 22 bp, Artificial Sequence
  chemically synthesized
caaagaaaatctcttttagaag

SEQ ID NO: 1048090 - DNA, 22 bp, Artificial Sequence
  chemically synthesized
aaagaaaatctcttttagaaga

SEQ ID NO: 1048091 - DNA, 22 bp, Artificial Sequence
  chemically synthesized
aatagatgccacataacactct

SEQ ID NO: 1048092 - DNA, 22 bp, Artificial Sequence
  chemically synthesized
aaatagatgccacataacactc

SEQ ID NO: 1048093 - DNA, 22 bp, Artificial Sequence
  chemically synthesized
ttttagaagagtgttatgtggc

SEQ ID NO: 1048094 - DNA, 22 bp, Artificial Sequence
  chemically synthesized
ttagaagagtgttatgtggcat

SEQ ID NO: 1048095 - DNA, 22 bp, Artificial Sequence
  chemically synthesized
tagaagagtgttatgtggcatc

SEQ ID NO: 1048096 - DNA, 22 bp, Artificial Sequence
  chemically synthesized
gcaatttaaatagatgccacat

SEQ ID NO: 1048097 - DNA, 22 bp, Artificial Sequence
  chemically synthesized
agaagagtgttatgtggcatct

SEQ ID NO: 1048098 - DNA, 22 bp, Artificial Sequence
  chemically synthesized
gaagagtgttatgtggcatcta

SEQ ID NO: 1048099 - DNA, 22 bp, Artificial Sequence
  chemically synthesized
ccagaaaaattggcaatttaaa

SEQ ID NO: 1048100 - DNA, 22 bp, Artificial Sequence
  chemically synthesized
tgtggcatctatttaaattgcc

SEQ ID NO: 1048101 - DNA, 22 bp, Artificial Sequence
  chemically synthesized
tttaaattgccaatttttctgg

SEQ ID NO: 1048102 - DNA, 22 bp, Artificial Sequence
  chemically synthesized
aaattgccaatttttctggtaa

SEQ ID NO: 1048103 - DNA, 22 bp, Artificial Sequence
  chemically synthesized
aattgccaatttttctggtaat

SEQ ID NO: 1048104 - DNA, 22 bp, Artificial Sequence
  chemically synthesized
ccaatttttctggtaatcatcc

SEQ ID NO: 1048105 - DNA, 22 bp, Artificial Sequence
  chemically synthesized
tacagagagtaaaaggatgatt

SEQ ID NO: 1048106 - DNA, 22 bp, Artificial Sequence
  chemically synthesized
gtacagagagtaaaaggatgat

SEQ ID NO: 1048107 - DNA, 22 bp, Artificial Sequence
  chemically synthesized
ttgtacagagagtaaaaggatg

SEQ ID NO: 1048108 - DNA, 22 bp, Artificial Sequence
  chemically synthesized
ttctggtaatcatccttttact

SEQ ID NO: 1048109 - DNA, 22 bp, Artificial Sequence
  chemically synthesized
tctggtaatcatccttttactc

SEQ ID NO: 1048110 - DNA, 22 bp, Artificial Sequence
  chemically synthesized
ctggtaatcatccttttactct

SEQ ID NO: 1048111 - DNA, 22 bp, Artificial Sequence
  chemically synthesized
tggtaatcatccttttactctc

SEQ ID NO: 1048112 - DNA, 22 bp, Artificial Sequence
  chemically synthesized
aactcttgtacagagagtaaaa

SEQ ID NO: 1048113 - DNA, 22 bp, Artificial Sequence
  chemically synthesized
gtaatcatccttttactctctg

SEQ ID NO: 1048114 - DNA, 22 bp, Artificial Sequence
  chemically synthesized
aaaattgaactcttgtacagag

SEQ ID NO: 1048115 - DNA, 22 bp, Artificial Sequence
  chemically synthesized
aaaaattgaactcttgtacaga

SEQ ID NO: 1048116 - DNA, 22 bp, Artificial Sequence
  chemically synthesized
ttaaaaattgaactcttgtaca

SEQ ID NO: 1048117 - DNA, 22 bp, Artificial Sequence
  chemically synthesized
cttaaaaattgaactcttgtac

SEQ ID NO: 1048118 - DNA, 22 bp, Artificial Sequence
  chemically synthesized
tcttaaaaattgaactcttgta

SEQ ID NO: 1048119 - DNA, 22 bp, Artificial Sequence
  chemically synthesized
ttactctctgtacaagagttca

SEQ ID NO: 1048120 - DNA, 22 bp, Artificial Sequence
  chemically synthesized
tactctctgtacaagagttcaa

SEQ ID NO: 1048121 - DNA, 22 bp, Artificial Sequence
  chemically synthesized
actctctgtacaagagttcaat

SEQ ID NO: 1048122 - DNA, 22 bp, Artificial Sequence
  chemically synthesized
ctctctgtacaagagttcaatt

SEQ ID NO: 1048123 - DNA, 22 bp, Artificial Sequence
  chemically synthesized
aaattttcttaaaaattgaact

SEQ ID NO: 1048124 - DNA, 22 bp, Artificial Sequence
  chemically synthesized
tctgtacaagagttcaattttt

SEQ ID NO: 1048125 - DNA, 22 bp, Artificial Sequence
  chemically synthesized
tgtacaagagttcaatttttaa

SEQ ID NO: 1048126 - DNA, 22 bp, Artificial Sequence
  chemically synthesized
tacaagagttcaatttttaaga

SEQ ID NO: 1048127 - DNA, 22 bp, Artificial Sequence
  chemically synthesized
ggtatctaaaattttcttaaaa

SEQ ID NO: 1048128 - DNA, 22 bp, Artificial Sequence
  chemically synthesized
aggtatctaaaattttcttaaa

SEQ ID NO: 1048129 - DNA, 22 bp, Artificial Sequence
  chemically synthesized
tcacttaggtatctaaaatttt

SEQ ID NO: 1048130 - DNA, 22 bp, Artificial Sequence
  chemically synthesized
gtcacttaggtatctaaaattt

SEQ ID NO: 1048131 - DNA, 22 bp, Artificial Sequence
  chemically synthesized
aatttttaagaaaattttagat

SEQ ID NO: 1048132 - DNA, 22 bp, Artificial Sequence
  chemically synthesized
tttgtcacttaggtatctaaaa

SEQ ID NO: 1048133 - DNA, 22 bp, Artificial Sequence
  chemically synthesized
ttaagaaaattttagataccta

SEQ ID NO: 1048134 - DNA, 22 bp, Artificial Sequence
  chemically synthesized
taagaaaattttagatacctaa

SEQ ID NO: 1048135 - DNA, 22 bp, Artificial Sequence
  chemically synthesized
aagaaaattttagatacctaag

SEQ ID NO: 1048136 - DNA, 22 bp, Artificial Sequence
  chemically synthesized
agaaaattttagatacctaagt

SEQ ID NO: 1048137 - DNA, 22 bp, Artificial Sequence
  chemically synthesized
caattatttgtcacttaggtat

SEQ ID NO: 1048138 - DNA, 22 bp, Artificial Sequence
  chemically synthesized
tagatacctaagtgacaaataa

SEQ ID NO: 1048139 - DNA, 22 bp, Artificial Sequence
  chemically synthesized
agatacctaagtgacaaataat

SEQ ID NO: 1048140 - DNA, 22 bp, Artificial Sequence
  chemically synthesized
gatacctaagtgacaaataatt

SEQ ID NO: 1048141 - DNA, 22 bp, Artificial Sequence
  chemically synthesized
gaaccagatacagaattacaat

SEQ ID NO: 1048142 - DNA, 22 bp, Artificial Sequence
  chemically synthesized
agtgacaaataattgtaattct

SEQ ID NO: 1048143 - DNA, 22 bp, Artificial Sequence
  chemically synthesized
tagaaccagatacagaattaca

SEQ ID NO: 1048144 - DNA, 22 bp, Artificial Sequence
  chemically synthesized
ctagaaccagatacagaattac

SEQ ID NO: 1048145 - DNA, 22 bp, Artificial Sequence
  chemically synthesized
taattctgtatctggttctaga

SEQ ID NO: 1048146 - DNA, 22 bp, Artificial Sequence
  chemically synthesized
taaaaaatgatttctagaacca

SEQ ID NO: 1048147 - DNA, 22 bp, Artificial Sequence
  chemically synthesized
gtaaaaaatgatttctagaacc

SEQ ID NO: 1048148 - DNA, 22 bp, Artificial Sequence
  chemically synthesized
tgtatctggttctagaaatcat

SEQ ID NO: 1048149 - DNA, 22 bp, Artificial Sequence
  chemically synthesized
tatctggttctagaaatcattt

SEQ ID NO: 1048150 - DNA, 22 bp, Artificial Sequence
  chemically synthesized
aaagtttgtaaaaaatgatttc

SEQ ID NO: 1048151 - DNA, 22 bp, Artificial Sequence
  chemically synthesized
aaaagtttgtaaaaaatgattt

SEQ ID NO: 1048152 - DNA, 22 bp, Artificial Sequence
  chemically synthesized
tttaaaagtttgtaaaaaatga

SEQ ID NO: 1048153 - DNA, 22 bp, Artificial Sequence
  chemically synthesized
gttctagaaatcattttttaca

SEQ ID NO: 1048154 - DNA, 22 bp, Artificial Sequence
  chemically synthesized
attatttaaaagtttgtaaaaa

SEQ ID NO: 1048155 - DNA, 22 bp, Artificial Sequence
  chemically synthesized
cattatttaaaagtttgtaaaa

SEQ ID NO: 1048156 - DNA, 22 bp, Artificial Sequence
  chemically synthesized
tagaaatcattttttacaaact

SEQ ID NO: 1048157 - DNA, 22 bp, Artificial Sequence
  chemically synthesized
ttcattatttaaaagtttgtaa

SEQ ID NO: 1048158 - DNA, 22 bp, Artificial Sequence
  chemically synthesized
gaaatcattttttacaaacttt

SEQ ID NO: 1048159 - DNA, 22 bp, Artificial Sequence
  chemically synthesized
cttcattatttaaaagtttgta

SEQ ID NO: 1048160 - DNA, 22 bp, Artificial Sequence
  chemically synthesized
tttacaaacttttaaataatga

SEQ ID NO: 1048161 - DNA, 22 bp, Artificial Sequence
  chemically synthesized
ataagagcttcttcattattta

SEQ ID NO: 1048162 - DNA, 22 bp, Artificial Sequence
  chemically synthesized
ttacaaacttttaaataatgaa

SEQ ID NO: 1048163 - DNA, 22 bp, Artificial Sequence
  chemically synthesized
tacaaacttttaaataatgaag

SEQ ID NO: 1048164 - DNA, 22 bp, Artificial Sequence
  chemically synthesized
acaaacttttaaataatgaaga

SEQ ID NO: 1048165 - DNA, 22 bp, Artificial Sequence
  chemically synthesized
caaacttttaaataatgaagaa

SEQ ID NO: 1048166 - DNA, 22 bp, Artificial Sequence
  chemically synthesized
gatcaggttaataagagcttct

SEQ ID NO: 1048167 - DNA, 22 bp, Artificial Sequence
  chemically synthesized
ttaaataatgaagaagctctta

SEQ ID NO: 1048168 - DNA, 22 bp, Artificial Sequence
  chemically synthesized
cgatcaggttaataagagcttc

SEQ ID NO: 1048169 - DNA, 22 bp, Artificial Sequence
  chemically synthesized
taaataatgaagaagctcttat

SEQ ID NO: 1048170 - DNA, 22 bp, Artificial Sequence
  chemically synthesized
aaataatgaagaagctcttatt

SEQ ID NO: 1048171 - DNA, 22 bp, Artificial Sequence
  chemically synthesized
aataatgaagaagctcttatta

SEQ ID NO: 1048172 - DNA, 22 bp, Artificial Sequence
  chemically synthesized
agagtatttcgatcaggttaat

SEQ ID NO: 1048173 - DNA, 22 bp, Artificial Sequence
  chemically synthesized
aagagtatttcgatcaggttaa

SEQ ID NO: 1048174 - DNA, 22 bp, Artificial Sequence
  chemically synthesized
taagagtatttcgatcaggtta

SEQ ID NO: 1048175 - DNA, 22 bp, Artificial Sequence
  chemically synthesized
ttaagagtatttcgatcaggtt

SEQ ID NO: 1048176 - DNA, 22 bp, Artificial Sequence
  chemically synthesized
ttttaagagtatttcgatcagg

SEQ ID NO: 1048177 - DNA, 22 bp, Artificial Sequence
  chemically synthesized
cttttaagagtatttcgatcag

SEQ ID NO: 1048178 - DNA, 22 bp, Artificial Sequence
  chemically synthesized
ttattaacctgatcgaaatact

SEQ ID NO: 1048179 - DNA, 22 bp, Artificial Sequence
  chemically synthesized
attaacctgatcgaaatactct

SEQ ID NO: 1048180 - DNA, 22 bp, Artificial Sequence
  chemically synthesized
atatttcttttaagagtatttc

SEQ ID NO: 1048181 - DNA, 22 bp, Artificial Sequence
  chemically synthesized
ttaacctgatcgaaatactctt

SEQ ID NO: 1048182 - DNA, 22 bp, Artificial Sequence
  chemically synthesized
acctgatcgaaatactcttaaa

SEQ ID NO: 1048183 - DNA, 22 bp, Artificial Sequence
  chemically synthesized
aatggctaatatttcttttaag

SEQ ID NO: 1048184 - DNA, 22 bp, Artificial Sequence
  chemically synthesized
atcgaaatactcttaaaagaaa

SEQ ID NO: 1048185 - DNA, 22 bp, Artificial Sequence
  chemically synthesized
cagttcaatggctaatatttct

SEQ ID NO: 1048186 - DNA, 22 bp, Artificial Sequence
  chemically synthesized
aacctgcagttcaatggctaat

SEQ ID NO: 1048187 - DNA, 22 bp, Artificial Sequence
  chemically synthesized
ttaaaagaaatattagccattg

SEQ ID NO: 1048188 - DNA, 22 bp, Artificial Sequence
  chemically synthesized
tcaacctgcagttcaatggcta

SEQ ID NO: 1048189 - DNA, 22 bp, Artificial Sequence
  chemically synthesized
aaaagaaatattagccattgaa

SEQ ID NO: 1048190 - DNA, 22 bp, Artificial Sequence
  chemically synthesized
aaagaaatattagccattgaac

SEQ ID NO: 1048191 - DNA, 22 bp, Artificial Sequence
  chemically synthesized
gagcattctcaacctgcagttc

SEQ ID NO: 1048192 - DNA, 22 bp, Artificial Sequence
  chemically synthesized
ttagagcattctcaacctgcag

SEQ ID NO: 1048193 - DNA, 22 bp, Artificial Sequence
  chemically synthesized
gccattgaactgcaggttgaga

SEQ ID NO: 1048194 - DNA, 22 bp, Artificial Sequence
  chemically synthesized
aactgcaggttgagaatgctct

SEQ ID NO: 1048195 - DNA, 22 bp, Artificial Sequence
  chemically synthesized
caggttgagaatgctctaataa

SEQ ID NO: 1048196 - DNA, 22 bp, Artificial Sequence
  chemically synthesized
agaatgctctaataatatgcat

SEQ ID NO: 1048197 - DNA, 22 bp, Artificial Sequence
  chemically synthesized
aaaataatcacaatatgcatat

SEQ ID NO: 1048198 - DNA, 22 bp, Artificial Sequence
  chemically synthesized
gaaaataatcacaatatgcata

SEQ ID NO: 1048199 - DNA, 22 bp, Artificial Sequence
  chemically synthesized
taataatatgcatattgtgatt

SEQ ID NO: 1048200 - DNA, 22 bp, Artificial Sequence
  chemically synthesized
ataatatgcatattgtgattat

SEQ ID NO: 1048201 - DNA, 22 bp, Artificial Sequence
  chemically synthesized
tgacaatcttgaaaataatcac

SEQ ID NO: 1048202 - DNA, 22 bp, Artificial Sequence
  chemically synthesized
gtgacaatcttgaaaataatca

SEQ ID NO: 1048203 - DNA, 22 bp, Artificial Sequence
  chemically synthesized
tttgtgacaatcttgaaaataa

SEQ ID NO: 1048204 - DNA, 22 bp, Artificial Sequence
  chemically synthesized
atttgtgacaatcttgaaaata

SEQ ID NO: 1048205 - DNA, 22 bp, Artificial Sequence
  chemically synthesized
tggcttatttgtgacaatcttg

SEQ ID NO: 1048206 - DNA, 22 bp, Artificial Sequence
  chemically synthesized
tgattattttcaagattgtcac

SEQ ID NO: 1048207 - DNA, 22 bp, Artificial Sequence
  chemically synthesized
tatggcttatttgtgacaatct

SEQ ID NO: 1048208 - DNA, 22 bp, Artificial Sequence
  chemically synthesized
ctctatggcttatttgtgacaa

SEQ ID NO: 1048209 - DNA, 22 bp, Artificial Sequence
  chemically synthesized
ttttcaagattgtcacaaataa

SEQ ID NO: 1048210 - DNA, 22 bp, Artificial Sequence
  chemically synthesized
gttgctctatggcttatttgtg

SEQ ID NO: 1048211 - DNA, 22 bp, Artificial Sequence
  chemically synthesized
tcaagattgtcacaaataagcc

SEQ ID NO: 1048212 - DNA, 22 bp, Artificial Sequence
  chemically synthesized
caagattgtcacaaataagcca

SEQ ID NO: 1048213 - DNA, 22 bp, Artificial Sequence
  chemically synthesized
aagattgtcacaaataagccat

SEQ ID NO: 1048214 - DNA, 22 bp, Artificial Sequence
  chemically synthesized
acactggttgctctatggctta

SEQ ID NO: 1048215 - DNA, 22 bp, Artificial Sequence
  chemically synthesized
tcacaaataagccatagagcaa

SEQ ID NO: 1048216 - DNA, 22 bp, Artificial Sequence
  chemically synthesized
catgtattgacactggttgctc

SEQ ID NO: 1048217 - DNA, 22 bp, Artificial Sequence
  chemically synthesized
ccatgtattgacactggttgct

SEQ ID NO: 1048218 - DNA, 22 bp, Artificial Sequence
  chemically synthesized
tttccatgtattgacactggtt

SEQ ID NO: 1048219 - DNA, 22 bp, Artificial Sequence
  chemically synthesized
agcatgtagggattatttccat

SEQ ID NO: 1048220 - DNA, 22 bp, Artificial Sequence
  chemically synthesized
atgccatggctgagcatgtagg

SEQ ID NO: 1048221 - DNA, 22 bp, Artificial Sequence
  chemically synthesized
gaaaatgtgttcatgccatggc

SEQ ID NO: 1048222 - DNA, 22 bp, Artificial Sequence
  chemically synthesized
tagaaaatgtgttcatgccatg

SEQ ID NO: 1048223 - DNA, 22 bp, Artificial Sequence
  chemically synthesized
catgctcagccatggcatgaac

SEQ ID NO: 1048224 - DNA, 22 bp, Artificial Sequence
  chemically synthesized
agtgttctagaaaatgtgttca

SEQ ID NO: 1048225 - DNA, 22 bp, Artificial Sequence
  chemically synthesized
agccatggcatgaacacatttt

SEQ ID NO: 1048226 - DNA, 22 bp, Artificial Sequence
  chemically synthesized
taagtgttctagaaaatgtgtt

SEQ ID NO: 1048227 - DNA, 22 bp, Artificial Sequence
  chemically synthesized
ctaagtgttctagaaaatgtgt

SEQ ID NO: 1048228 - DNA, 22 bp, Artificial Sequence
  chemically synthesized
atatttctaagtgttctagaaa

SEQ ID NO: 1048229 - DNA, 22 bp, Artificial Sequence
  chemically synthesized
aatatttctaagtgttctagaa

SEQ ID NO: 1048230 - DNA, 22 bp, Artificial Sequence
  chemically synthesized
taatatttctaagtgttctaga

SEQ ID NO: 1048231 - DNA, 22 bp, Artificial Sequence
  chemically synthesized
tctagaacacttagaaatatta

SEQ ID NO: 1048232 - DNA, 22 bp, Artificial Sequence
  chemically synthesized
ctagaacacttagaaatattaa

SEQ ID NO: 1048233 - DNA, 22 bp, Artificial Sequence
  chemically synthesized
tagaacacttagaaatattaaa

SEQ ID NO: 1048234 - DNA, 22 bp, Artificial Sequence
  chemically synthesized
aaccataagaattttaatattt

SEQ ID NO: 1048235 - DNA, 22 bp, Artificial Sequence
  chemically synthesized
gaacacttagaaatattaaaat

SEQ ID NO: 1048236 - DNA, 22 bp, Artificial Sequence
  chemically synthesized
tgttcaaccataagaattttaa

SEQ ID NO: 1048237 - DNA, 22 bp, Artificial Sequence
  chemically synthesized
attatgttcaaccataagaatt

SEQ ID NO: 1048238 - DNA, 22 bp, Artificial Sequence
  chemically synthesized
agaaatattaaaattcttatgg

SEQ ID NO: 1048239 - DNA, 22 bp, Artificial Sequence
  chemically synthesized
gaaatattaaaattcttatggt

SEQ ID NO: 1048240 - DNA, 22 bp, Artificial Sequence
  chemically synthesized
ttgattatgttcaaccataaga

SEQ ID NO: 1048241 - DNA, 22 bp, Artificial Sequence
  chemically synthesized
attgattatgttcaaccataag

SEQ ID NO: 1048242 - DNA, 22 bp, Artificial Sequence
  chemically synthesized
tattgattatgttcaaccataa

SEQ ID NO: 1048243 - DNA, 22 bp, Artificial Sequence
  chemically synthesized
ttattgattatgttcaaccata

SEQ ID NO: 1048244 - DNA, 22 bp, Artificial Sequence
  chemically synthesized
tttattgattatgttcaaccat

SEQ ID NO: 1048245 - DNA, 22 bp, Artificial Sequence
  chemically synthesized
aaattcttatggttgaacataa

SEQ ID NO: 1048246 - DNA, 22 bp, Artificial Sequence
  chemically synthesized
tacctttttattgattatgttc

SEQ ID NO: 1048247 - DNA, 22 bp, Artificial Sequence
  chemically synthesized
ttatggttgaacataatcaata

SEQ ID NO: 1048248 - DNA, 22 bp, Artificial Sequence
  chemically synthesized
atggttgaacataatcaataaa

SEQ ID NO: 1048249 - DNA, 22 bp, Artificial Sequence
  chemically synthesized
tggttgaacataatcaataaaa

SEQ ID NO: 1048250 - DNA, 22 bp, Artificial Sequence
  chemically synthesized
aacataatcaataaaaaggtat

SEQ ID NO: 1048251 - DNA, 22 bp, Artificial Sequence
  chemically synthesized
aagtaataaactataccttttt

SEQ ID NO: 1048252 - DNA, 22 bp, Artificial Sequence
  chemically synthesized
taaagtaataaactataccttt

SEQ ID NO: 1048253 - DNA, 22 bp, Artificial Sequence
  chemically synthesized
ctaaagtaataaactatacctt

SEQ ID NO: 1048254 - DNA, 22 bp, Artificial Sequence
  chemically synthesized
tctaaagtaataaactatacct

SEQ ID NO: 1048255 - DNA, 22 bp, Artificial Sequence
  chemically synthesized
ttctaaagtaataaactatacc

SEQ ID NO: 1048256 - DNA, 22 bp, Artificial Sequence
  chemically synthesized
agatttttctaaagtaataaac

SEQ ID NO: 1048257 - DNA, 22 bp, Artificial Sequence
  chemically synthesized
attcagatttttctaaagtaat

SEQ ID NO: 1048258 - DNA, 22 bp, Artificial Sequence
  chemically synthesized
tcattcagatttttctaaagta

SEQ ID NO: 1048259 - DNA, 22 bp, Artificial Sequence
  chemically synthesized
ctcattcagatttttctaaagt

SEQ ID NO: 1048260 - DNA, 22 bp, Artificial Sequence
  chemically synthesized
tctcattcagatttttctaaag

SEQ ID NO: 1048261 - DNA, 22 bp, Artificial Sequence
  chemically synthesized
ttctcattcagatttttctaaa

SEQ ID NO: 1048262 - DNA, 22 bp, Artificial Sequence
  chemically synthesized
attactttagaaaaatctgaat

SEQ ID NO: 1048263 - DNA, 22 bp, Artificial Sequence
  chemically synthesized
ttactttagaaaaatctgaatg

SEQ ID NO: 1048264 - DNA, 22 bp, Artificial Sequence
  chemically synthesized
ctttagaaaaatctgaatgaga

SEQ ID NO: 1048265 - DNA, 22 bp, Artificial Sequence
  chemically synthesized
tagaaaaatctgaatgagaaaa

SEQ ID NO: 1048266 - DNA, 22 bp, Artificial Sequence
  chemically synthesized
agaaaaatctgaatgagaaaaa

SEQ ID NO: 1048267 - DNA, 22 bp, Artificial Sequence
  chemically synthesized
gaaaaatctgaatgagaaaaat

SEQ ID NO: 1048268 - DNA, 22 bp, Artificial Sequence
  chemically synthesized
aggatagaaatgatttttctca

SEQ ID NO: 1048269 - DNA, 22 bp, Artificial Sequence
  chemically synthesized
aatgagaaaaatcatttctatc

SEQ ID NO: 1048270 - DNA, 22 bp, Artificial Sequence
  chemically synthesized
tcagtagttgaggatagaaatg

SEQ ID NO: 1048271 - DNA, 22 bp, Artificial Sequence
  chemically synthesized
attatcagtagttgaggataga

SEQ ID NO: 1048272 - DNA, 22 bp, Artificial Sequence
  chemically synthesized
aattatcagtagttgaggatag

SEQ ID NO: 1048273 - DNA, 22 bp, Artificial Sequence
  chemically synthesized
cttaattatcagtagttgagga

SEQ ID NO: 1048274 - DNA, 22 bp, Artificial Sequence
  chemically synthesized
aaagattacttaattatcagta

SEQ ID NO: 1048275 - DNA, 22 bp, Artificial Sequence
  chemically synthesized
ctatcctcaactactgataatt

SEQ ID NO: 1048276 - DNA, 22 bp, Artificial Sequence
  chemically synthesized
gaaagattacttaattatcagt

SEQ ID NO: 1048277 - DNA, 22 bp, Artificial Sequence
  chemically synthesized
tatcctcaactactgataatta

SEQ ID NO: 1048278 - DNA, 22 bp, Artificial Sequence
  chemically synthesized
tgaaagattacttaattatcag

SEQ ID NO: 1048279 - DNA, 22 bp, Artificial Sequence
  chemically synthesized
ttgaaagattacttaattatca

SEQ ID NO: 1048280 - DNA, 22 bp, Artificial Sequence
  chemically synthesized
tcctcaactactgataattaag

SEQ ID NO: 1048281 - DNA, 22 bp, Artificial Sequence
  chemically synthesized
aactactgataattaagtaatc

SEQ ID NO: 1048282 - DNA, 22 bp, Artificial Sequence
  chemically synthesized
ctgataattaagtaatctttca

SEQ ID NO: 1048283 - DNA, 22 bp, Artificial Sequence
  chemically synthesized
ataattaagtaatctttcaaaa

SEQ ID NO: 1048284 - DNA, 22 bp, Artificial Sequence
  chemically synthesized
taatggaaagaaaaatttttga

SEQ ID NO: 1048285 - DNA, 22 bp, Artificial Sequence
  chemically synthesized
ataatggaaagaaaaatttttg

SEQ ID NO: 1048286 - DNA, 22 bp, Artificial Sequence
  chemically synthesized
tataatggaaagaaaaattttt

SEQ ID NO: 1048287 - DNA, 22 bp, Artificial Sequence
  chemically synthesized
agtaatctttcaaaaatttttc

SEQ ID NO: 1048288 - DNA, 22 bp, Artificial Sequence
  chemically synthesized
tctttataatggaaagaaaaat

SEQ ID NO: 1048289 - DNA, 22 bp, Artificial Sequence
  chemically synthesized
atctttataatggaaagaaaaa

SEQ ID NO: 1048290 - DNA, 22 bp, Artificial Sequence
  chemically synthesized
atttatctttataatggaaaga

SEQ ID NO: 1048291 - DNA, 22 bp, Artificial Sequence
  chemically synthesized
tcaaaaatttttctttccatta

SEQ ID NO: 1048292 - DNA, 22 bp, Artificial Sequence
  chemically synthesized
caaaaatttttctttccattat

SEQ ID NO: 1048293 - DNA, 22 bp, Artificial Sequence
  chemically synthesized
taatttatctttataatggaaa

SEQ ID NO: 1048294 - DNA, 22 bp, Artificial Sequence
  chemically synthesized
aaaaatttttctttccattata

SEQ ID NO: 1048295 - DNA, 22 bp, Artificial Sequence
  chemically synthesized
ttctttccattataaagataaa

SEQ ID NO: 1048296 - DNA, 22 bp, Artificial Sequence
  chemically synthesized
caggtattctaatttatcttta

SEQ ID NO: 1048297 - DNA, 22 bp, Artificial Sequence
  chemically synthesized
tctttccattataaagataaat

SEQ ID NO: 1048298 - DNA, 22 bp, Artificial Sequence
  chemically synthesized
ctttccattataaagataaatt

SEQ ID NO: 1048299 - DNA, 22 bp, Artificial Sequence
  chemically synthesized
tttccattataaagataaatta

SEQ ID NO: 1048300 - DNA, 22 bp, Artificial Sequence
  chemically synthesized
tccattataaagataaattaga

SEQ ID NO: 1048301 - DNA, 22 bp, Artificial Sequence
  chemically synthesized
ccattataaagataaattagaa

SEQ ID NO: 1048302 - DNA, 22 bp, Artificial Sequence
  chemically synthesized
cattataaagataaattagaat

SEQ ID NO: 1048303 - DNA, 22 bp, Artificial Sequence
  chemically synthesized
gaaattacaggtattctaattt

SEQ ID NO: 1048304 - DNA, 22 bp, Artificial Sequence
  chemically synthesized
agaaattacaggtattctaatt

SEQ ID NO: 1048305 - DNA, 22 bp, Artificial Sequence
  chemically synthesized
taaagataaattagaatacctg

SEQ ID NO: 1048306 - DNA, 22 bp, Artificial Sequence
  chemically synthesized
taatgagaagcatcttagaaat

SEQ ID NO: 1048307 - DNA, 22 bp, Artificial Sequence
  chemically synthesized
gaatacctgtaatttctaagat

SEQ ID NO: 1048308 - DNA, 22 bp, Artificial Sequence
  chemically synthesized
taatttctaagatgcttctcat

SEQ ID NO: 1048309 - DNA, 22 bp, Artificial Sequence
  chemically synthesized
cccataggtaattgtaatgaga

SEQ ID NO: 1048310 - DNA, 22 bp, Artificial Sequence
  chemically synthesized
ctaagatgcttctcattacaat

SEQ ID NO: 1048311 - DNA, 22 bp, Artificial Sequence
  chemically synthesized
taagatgcttctcattacaatt

SEQ ID NO: 1048312 - DNA, 22 bp, Artificial Sequence
  chemically synthesized
ttgcccataggtaattgtaatg

SEQ ID NO: 1048313 - DNA, 22 bp, Artificial Sequence
  chemically synthesized
agatgcttctcattacaattac

SEQ ID NO: 1048314 - DNA, 22 bp, Artificial Sequence
  chemically synthesized
aactgttgcccataggtaattg

SEQ ID NO: 1048315 - DNA, 22 bp, Artificial Sequence
  chemically synthesized
ctcattacaattacctatgggc

SEQ ID NO: 1048316 - DNA, 22 bp, Artificial Sequence
  chemically synthesized
tcattacaattacctatgggca

SEQ ID NO: 1048317 - DNA, 22 bp, Artificial Sequence
  chemically synthesized
attacaattacctatgggcaac

SEQ ID NO: 1048318 - DNA, 22 bp, Artificial Sequence
  chemically synthesized
caattacctatgggcaacagtt

SEQ ID NO: 1048319 - DNA, 22 bp, Artificial Sequence
  chemically synthesized
taacgtatagctgaactgttgc

SEQ ID NO: 1048320 - DNA, 22 bp, Artificial Sequence
  chemically synthesized
ataacgtatagctgaactgttg

SEQ ID NO: 1048321 - DNA, 22 bp, Artificial Sequence
  chemically synthesized
tataacgtatagctgaactgtt

SEQ ID NO: 1048322 - DNA, 22 bp, Artificial Sequence
  chemically synthesized
cctatgggcaacagttcagcta

SEQ ID NO: 1048323 - DNA, 22 bp, Artificial Sequence
  chemically synthesized
gactttataacgtatagctgaa

SEQ ID NO: 1048324 - DNA, 22 bp, Artificial Sequence
  chemically synthesized
agactttataacgtatagctga

SEQ ID NO: 1048325 - DNA, 22 bp, Artificial Sequence
  chemically synthesized
tgggcaacagttcagctatacg

SEQ ID NO: 1048326 - DNA, 22 bp, Artificial Sequence
  chemically synthesized
tagactttataacgtatagctg

SEQ ID NO: 1048327 - DNA, 22 bp, Artificial Sequence
  chemically synthesized
ttagactttataacgtatagct

SEQ ID NO: 1048328 - DNA, 22 bp, Artificial Sequence
  chemically synthesized
accttttagactttataacgta

SEQ ID NO: 1048329 - DNA, 22 bp, Artificial Sequence
  chemically synthesized
agctatacgttataaagtctaa

SEQ ID NO: 1048330 - DNA, 22 bp, Artificial Sequence
  chemically synthesized
tacgttataaagtctaaaaggt

SEQ ID NO: 1048331 - DNA, 22 bp, Artificial Sequence
  chemically synthesized
aagtataacattaaccttttag

SEQ ID NO: 1048332 - DNA, 22 bp, Artificial Sequence
  chemically synthesized
aaagtataacattaacctttta

SEQ ID NO: 1048333 - DNA, 22 bp, Artificial Sequence
  chemically synthesized
taaagtctaaaaggttaatgtt

SEQ ID NO: 1048334 - DNA, 22 bp, Artificial Sequence
  chemically synthesized
aatatatttaaagtataacatt

SEQ ID NO: 1048335 - DNA, 22 bp, Artificial Sequence
  chemically synthesized
attaaatatatttaaagtataa

SEQ ID NO: 1048336 - DNA, 22 bp, Artificial Sequence
  chemically synthesized
aaaggttaatgttatactttaa

SEQ ID NO: 1048337 - DNA, 22 bp, Artificial Sequence
  chemically synthesized
cattaaatatatttaaagtata

SEQ ID NO: 1048338 - DNA, 22 bp, Artificial Sequence
  chemically synthesized
atgttatactttaaatatattt

SEQ ID NO: 1048339 - DNA, 22 bp, Artificial Sequence
  chemically synthesized
tactttaaatatatttaatgaa

SEQ ID NO: 1048340 - DNA, 22 bp, Artificial Sequence
  chemically synthesized
aatagatccgtcttcattaaat

SEQ ID NO: 1048341 - DNA, 22 bp, Artificial Sequence
  chemically synthesized
caatagatccgtcttcattaaa

SEQ ID NO: 1048342 - DNA, 22 bp, Artificial Sequence
  chemically synthesized
tcaatagatccgtcttcattaa

SEQ ID NO: 1048343 - DNA, 22 bp, Artificial Sequence
  chemically synthesized
taaatatatttaatgaagacgg

SEQ ID NO: 1048344 - DNA, 22 bp, Artificial Sequence
  chemically synthesized
aaatatatttaatgaagacgga

SEQ ID NO: 1048345 - DNA, 22 bp, Artificial Sequence
  chemically synthesized
aatatatttaatgaagacggat

SEQ ID NO: 1048346 - DNA, 22 bp, Artificial Sequence
  chemically synthesized
aatgaagacggatctattgaaa

SEQ ID NO: 1048347 - DNA, 22 bp, Artificial Sequence
  chemically synthesized
atgaagacggatctattgaaag

SEQ ID NO: 1048348 - DNA, 22 bp, Artificial Sequence
  chemically synthesized
cgtatcaagatagtaaatcttt

SEQ ID NO: 1048349 - DNA, 22 bp, Artificial Sequence
  chemically synthesized
gacactacgtatcaagatagta

SEQ ID NO: 1048350 - DNA, 22 bp, Artificial Sequence
  chemically synthesized
ttgaaagatttactatcttgat

SEQ ID NO: 1048351 - DNA, 22 bp, Artificial Sequence
  chemically synthesized
aaagatttactatcttgatacg

SEQ ID NO: 1048352 - DNA, 22 bp, Artificial Sequence
  chemically synthesized
tgatgactggacactacgtatc

SEQ ID NO: 1048353 - DNA, 22 bp, Artificial Sequence
  chemically synthesized
actatcttgatacgtagtgtcc

SEQ ID NO: 1048354 - DNA, 22 bp, Artificial Sequence
  chemically synthesized
tctgtgatgactggacactacg

SEQ ID NO: 1048355 - DNA, 22 bp, Artificial Sequence
  chemically synthesized
ctatcttgatacgtagtgtcca

SEQ ID NO: 1048356 - DNA, 22 bp, Artificial Sequence
  chemically synthesized
ttatctgtgatgactggacact

SEQ ID NO: 1048357 - DNA, 22 bp, Artificial Sequence
  chemically synthesized
tcttgatacgtagtgtccagtc

SEQ ID NO: 1048358 - DNA, 22 bp, Artificial Sequence
  chemically synthesized
gatacgtagtgtccagtcatca

SEQ ID NO: 1048359 - DNA, 22 bp, Artificial Sequence
  chemically synthesized
atacgtagtgtccagtcatcac

SEQ ID NO: 1048360 - DNA, 22 bp, Artificial Sequence
  chemically synthesized
gtgtctgttatctgtgatgact

SEQ ID NO: 1048361 - DNA, 22 bp, Artificial Sequence
  chemically synthesized
agtgtctgttatctgtgatgac

SEQ ID NO: 1048362 - DNA, 22 bp, Artificial Sequence
  chemically synthesized
taccacttagtgtctgttatct

SEQ ID NO: 1048363 - DNA, 22 bp, Artificial Sequence
  chemically synthesized
atctgtaccacttagtgtctgt

SEQ ID NO: 1048364 - DNA, 22 bp, Artificial Sequence
  chemically synthesized
gtcagctgatctgtaccactta

SEQ ID NO: 1048365 - DNA, 22 bp, Artificial Sequence
  chemically synthesized
tagtcagctgatctgtaccact

SEQ ID NO: 1048366 - DNA, 22 bp, Artificial Sequence
  chemically synthesized
tctagtcagctgatctgtacca

SEQ ID NO: 1048367 - DNA, 22 bp, Artificial Sequence
  chemically synthesized
ctctagtcagctgatctgtacc

SEQ ID NO: 1048368 - DNA, 22 bp, Artificial Sequence
  chemically synthesized
tctctagtcagctgatctgtac

SEQ ID NO: 1048369 - DNA, 22 bp, Artificial Sequence
  chemically synthesized
gttttctctagtcagctgatct

SEQ ID NO: 1048370 - DNA, 22 bp, Artificial Sequence
  chemically synthesized
agttttctctagtcagctgatc

SEQ ID NO: 1048371 - DNA, 22 bp, Artificial Sequence
  chemically synthesized
agtggtacagatcagctgacta

SEQ ID NO: 1048372 - DNA, 22 bp, Artificial Sequence
  chemically synthesized
acaggatcaacccttagttttc

SEQ ID NO: 1048373 - DNA, 22 bp, Artificial Sequence
  chemically synthesized
actagagaaaactaagggttga

SEQ ID NO: 1048374 - DNA, 22 bp, Artificial Sequence
  chemically synthesized
gagaaaactaagggttgatcct

SEQ ID NO: 1048375 - DNA, 22 bp, Artificial Sequence
  chemically synthesized
aagaaagttcacaggatcaacc

SEQ ID NO: 1048376 - DNA, 22 bp, Artificial Sequence
  chemically synthesized
tcaagaaagttcacaggatcaa

SEQ ID NO: 1048377 - DNA, 22 bp, Artificial Sequence
  chemically synthesized
ctcaagaaagttcacaggatca

SEQ ID NO: 1048378 - DNA, 22 bp, Artificial Sequence
  chemically synthesized
tttctcaagaaagttcacagga

SEQ ID NO: 1048379 - DNA, 22 bp, Artificial Sequence
  chemically synthesized
tatttctcaagaaagttcacag

SEQ ID NO: 1048380 - DNA, 22 bp, Artificial Sequence
  chemically synthesized
ctatttctcaagaaagttcaca

SEQ ID NO: 1048381 - DNA, 22 bp, Artificial Sequence
  chemically synthesized
agggttgatcctgtgaactttc

SEQ ID NO: 1048382 - DNA, 22 bp, Artificial Sequence
  chemically synthesized
atcctgtgaactttcttgagaa

SEQ ID NO: 1048383 - DNA, 22 bp, Artificial Sequence
  chemically synthesized
gaatatttctatttctcaagaa

SEQ ID NO: 1048384 - DNA, 22 bp, Artificial Sequence
  chemically synthesized
ggaatatttctatttctcaaga

SEQ ID NO: 1048385 - DNA, 22 bp, Artificial Sequence
  chemically synthesized
tggaatatttctatttctcaag

SEQ ID NO: 1048386 - DNA, 22 bp, Artificial Sequence
  chemically synthesized
ttttggaatatttctatttctc

SEQ ID NO: 1048387 - DNA, 22 bp, Artificial Sequence
  chemically synthesized
tgaactttcttgagaaatagaa

SEQ ID NO: 1048388 - DNA, 22 bp, Artificial Sequence
  chemically synthesized
tcttgagaaatagaaatattcc

SEQ ID NO: 1048389 - DNA, 22 bp, Artificial Sequence
  chemically synthesized
cttgagaaatagaaatattcca

SEQ ID NO: 1048390 - DNA, 22 bp, Artificial Sequence
  chemically synthesized
ttgagaaatagaaatattccaa

SEQ ID NO: 1048391 - DNA, 22 bp, Artificial Sequence
  chemically synthesized
gagaaatagaaatattccaaaa

SEQ ID NO: 1048392 - DNA, 22 bp, Artificial Sequence
  chemically synthesized
agaaatagaaatattccaaaat

SEQ ID NO: 1048393 - DNA, 22 bp, Artificial Sequence
  chemically synthesized
ccagtggtgtcaaaaagttatt

SEQ ID NO: 1048394 - DNA, 22 bp, Artificial Sequence
  chemically synthesized
cccagtggtgtcaaaaagttat

SEQ ID NO: 1048395 - DNA, 22 bp, Artificial Sequence
  chemically synthesized
acagtttcccagtggtgtcaaa

SEQ ID NO: 1048396 - DNA, 22 bp, Artificial Sequence
  chemically synthesized
caaaataactttttgacaccac

SEQ ID NO: 1048397 - DNA, 22 bp, Artificial Sequence
  chemically synthesized
tttgacaccactgggaaactgt

SEQ ID NO: 1048398 - DNA, 22 bp, Artificial Sequence
  chemically synthesized
gaaaatgagttcacagtttccc

SEQ ID NO: 1048399 - DNA, 22 bp, Artificial Sequence
  chemically synthesized
ttgacaccactgggaaactgtg

SEQ ID NO: 1048400 - DNA, 22 bp, Artificial Sequence
  chemically synthesized
tgacaccactgggaaactgtga

SEQ ID NO: 1048401 - DNA, 22 bp, Artificial Sequence
  chemically synthesized
tagaaaatgagttcacagtttc

SEQ ID NO: 1048402 - DNA, 22 bp, Artificial Sequence
  chemically synthesized
gacaccactgggaaactgtgaa

SEQ ID NO: 1048403 - DNA, 22 bp, Artificial Sequence
  chemically synthesized
ctagaaaatgagttcacagttt

SEQ ID NO: 1048404 - DNA, 22 bp, Artificial Sequence
  chemically synthesized
acaccactgggaaactgtgaac

SEQ ID NO: 1048405 - DNA, 22 bp, Artificial Sequence
  chemically synthesized
tctagaaaatgagttcacagtt

SEQ ID NO: 1048406 - DNA, 22 bp, Artificial Sequence
  chemically synthesized
ggaaactgtgaactcattttct

SEQ ID NO: 1048407 - DNA, 22 bp, Artificial Sequence
  chemically synthesized
ataacacggaattttctagaaa

SEQ ID NO: 1048408 - DNA, 22 bp, Artificial Sequence
  chemically synthesized
aataacacggaattttctagaa

SEQ ID NO: 1048409 - DNA, 22 bp, Artificial Sequence
  chemically synthesized
tgaactcattttctagaaaatt

SEQ ID NO: 1048410 - DNA, 22 bp, Artificial Sequence
  chemically synthesized
aaacttaataacacggaatttt

SEQ ID NO: 1048411 - DNA, 22 bp, Artificial Sequence
  chemically synthesized
attttctagaaaattccgtgtt

SEQ ID NO: 1048412 - DNA, 22 bp, Artificial Sequence
  chemically synthesized
tctagaaaattccgtgttatta

SEQ ID NO: 1048413 - DNA, 22 bp, Artificial Sequence
  chemically synthesized
ctagaaaattccgtgttattaa

SEQ ID NO: 1048414 - DNA, 22 bp, Artificial Sequence
  chemically synthesized
tagaaaattccgtgttattaag

SEQ ID NO: 1048415 - DNA, 22 bp, Artificial Sequence
  chemically synthesized
gaaaattccgtgttattaagtt

SEQ ID NO: 1048416 - DNA, 22 bp, Artificial Sequence
  chemically synthesized
taataaatgagaatattcaaac

SEQ ID NO: 1048417 - DNA, 22 bp, Artificial Sequence
  chemically synthesized
cgtgttattaagtttgaatatt

SEQ ID NO: 1048418 - DNA, 22 bp, Artificial Sequence
  chemically synthesized
ctataataaatgagaatattca

SEQ ID NO: 1048419 - DNA, 22 bp, Artificial Sequence
  chemically synthesized
ttaagtttgaatattctcattt

SEQ ID NO: 1048420 - DNA, 22 bp, Artificial Sequence
  chemically synthesized
agtttgaatattctcatttatt

SEQ ID NO: 1048421 - DNA, 22 bp, Artificial Sequence
  chemically synthesized
gaatattctcatttattatagc

SEQ ID NO: 1048422 - DNA, 22 bp, Artificial Sequence
  chemically synthesized
aatattctcatttattatagca

SEQ ID NO: 1048423 - DNA, 22 bp, Artificial Sequence
  chemically synthesized
tatatatcagattgctataata

SEQ ID NO: 1048424 - DNA, 22 bp, Artificial Sequence
  chemically synthesized
ttgtatatatcagattgctata

SEQ ID NO: 1048425 - DNA, 22 bp, Artificial Sequence
  chemically synthesized
tcatttattatagcaatctgat

SEQ ID NO: 1048426 - DNA, 22 bp, Artificial Sequence
  chemically synthesized
atttattatagcaatctgatat

SEQ ID NO: 1048427 - DNA, 22 bp, Artificial Sequence
  chemically synthesized
aacattattgtatatatcagat

SEQ ID NO: 1048428 - DNA, 22 bp, Artificial Sequence
  chemically synthesized
attatagcaatctgatatatac

SEQ ID NO: 1048429 - DNA, 22 bp, Artificial Sequence
  chemically synthesized
ttatagcaatctgatatataca

SEQ ID NO: 1048430 - DNA, 22 bp, Artificial Sequence
  chemically synthesized
tagcaatctgatatatacaata

SEQ ID NO: 1048431 - DNA, 22 bp, Artificial Sequence
  chemically synthesized
tatattaaacattattgtatat

SEQ ID NO: 1048432 - DNA, 22 bp, Artificial Sequence
  chemically synthesized
atatatacaataatgtttaata

SEQ ID NO: 1048433 - DNA, 22 bp, Artificial Sequence
  chemically synthesized
caaaaaagtctatatattaaac

SEQ ID NO: 1048434 - DNA, 22 bp, Artificial Sequence
  chemically synthesized
tatatgaaaattacaaaaaagt

SEQ ID NO: 1048435 - DNA, 22 bp, Artificial Sequence
  chemically synthesized
gtatatgaaaattacaaaaaag

SEQ ID NO: 1048436 - DNA, 22 bp, Artificial Sequence
  chemically synthesized
aatatatagacttttttgtaat

SEQ ID NO: 1048437 - DNA, 22 bp, Artificial Sequence
  chemically synthesized
ttgtatatgaaaattacaaaaa

SEQ ID NO: 1048438 - DNA, 22 bp, Artificial Sequence
  chemically synthesized
atatatagacttttttgtaatt

SEQ ID NO: 1048439 - DNA, 22 bp, Artificial Sequence
  chemically synthesized
cttgtatatgaaaattacaaaa

SEQ ID NO: 1048440 - DNA, 22 bp, Artificial Sequence
  chemically synthesized
gtagtttcttgtatatgaaaat

SEQ ID NO: 1048441 - DNA, 22 bp, Artificial Sequence
  chemically synthesized
tggtagtttcttgtatatgaaa

SEQ ID NO: 1048442 - DNA, 22 bp, Artificial Sequence
  chemically synthesized
ctggtagtttcttgtatatgaa

SEQ ID NO: 1048443 - DNA, 22 bp, Artificial Sequence
  chemically synthesized
ttttgtaattttcatatacaag

SEQ ID NO: 1048444 - DNA, 22 bp, Artificial Sequence
  chemically synthesized
tttgtaattttcatatacaaga

SEQ ID NO: 1048445 - DNA, 22 bp, Artificial Sequence
  chemically synthesized
ttgtaattttcatatacaagaa

SEQ ID NO: 1048446 - DNA, 22 bp, Artificial Sequence
  chemically synthesized
tgtaattttcatatacaagaaa

SEQ ID NO: 1048447 - DNA, 22 bp, Artificial Sequence
  chemically synthesized
aatttctggtagtttcttgtat

SEQ ID NO: 1048448 - DNA, 22 bp, Artificial Sequence
  chemically synthesized
gtaattttcatatacaagaaac

SEQ ID NO: 1048449 - DNA, 22 bp, Artificial Sequence
  chemically synthesized
taattttcatatacaagaaact

SEQ ID NO: 1048450 - DNA, 22 bp, Artificial Sequence
  chemically synthesized
attcaatttctggtagtttctt

SEQ ID NO: 1048451 - DNA, 22 bp, Artificial Sequence
  chemically synthesized
gattcaatttctggtagtttct

SEQ ID NO: 1048452 - DNA, 22 bp, Artificial Sequence
  chemically synthesized
tgattcaatttctggtagtttc

SEQ ID NO: 1048453 - DNA, 22 bp, Artificial Sequence
  chemically synthesized
ttgattcaatttctggtagttt

SEQ ID NO: 1048454 - DNA, 22 bp, Artificial Sequence
  chemically synthesized
tcatatacaagaaactaccaga

SEQ ID NO: 1048455 - DNA, 22 bp, Artificial Sequence
  chemically synthesized
catatacaagaaactaccagaa

SEQ ID NO: 1048456 - DNA, 22 bp, Artificial Sequence
  chemically synthesized
ttttgattcaatttctggtagt

SEQ ID NO: 1048457 - DNA, 22 bp, Artificial Sequence
  chemically synthesized
atatacaagaaactaccagaaa

SEQ ID NO: 1048458 - DNA, 22 bp, Artificial Sequence
  chemically synthesized
tcttttgattcaatttctggta

SEQ ID NO: 1048459 - DNA, 22 bp, Artificial Sequence
  chemically synthesized
gttctcttttgattcaatttct

SEQ ID NO: 1048460 - DNA, 22 bp, Artificial Sequence
  chemically synthesized
ccagaaattgaatcaaaagaga

SEQ ID NO: 1048461 - DNA, 22 bp, Artificial Sequence
  chemically synthesized
caaatgtctggttctcttttga

SEQ ID NO: 1048462 - DNA, 22 bp, Artificial Sequence
  chemically synthesized
gatctccaaatgtctggttctc

SEQ ID NO: 1048463 - DNA, 22 bp, Artificial Sequence
  chemically synthesized
aatcaaaagagaaccagacatt

SEQ ID NO: 1048464 - DNA, 22 bp, Artificial Sequence
  chemically synthesized
aggaatagatagcaaactagat

SEQ ID NO: 1048465 - DNA, 22 bp, Artificial Sequence
  chemically synthesized
aaggaatagatagcaaactaga

SEQ ID NO: 1048466 - DNA, 22 bp, Artificial Sequence
  chemically synthesized
taaggaatagatagcaaactag

SEQ ID NO: 1048467 - DNA, 22 bp, Artificial Sequence
  chemically synthesized
ttaaggaatagatagcaaacta

SEQ ID NO: 1048468 - DNA, 22 bp, Artificial Sequence
  chemically synthesized
ggagatctagtttgctatctat

SEQ ID NO: 1048469 - DNA, 22 bp, Artificial Sequence
  chemically synthesized
tacttttaaggaatagatagca

SEQ ID NO: 1048470 - DNA, 22 bp, Artificial Sequence
  chemically synthesized
gagatctagtttgctatctatt

SEQ ID NO: 1048471 - DNA, 22 bp, Artificial Sequence
  chemically synthesized
gtttgctatctattccttaaaa

SEQ ID NO: 1048472 - DNA, 22 bp, Artificial Sequence
  chemically synthesized
gctatctattccttaaaagtat

SEQ ID NO: 1048473 - DNA, 22 bp, Artificial Sequence
  chemically synthesized
ctatctattccttaaaagtata

SEQ ID NO: 1048474 - DNA, 22 bp, Artificial Sequence
  chemically synthesized
tctattccttaaaagtatagca

SEQ ID NO: 1048475 - DNA, 22 bp, Artificial Sequence
  chemically synthesized
tgtcaataggaatgctatactt

SEQ ID NO: 1048476 - DNA, 22 bp, Artificial Sequence
  chemically synthesized
ttccttaaaagtatagcattcc

SEQ ID NO: 1048477 - DNA, 22 bp, Artificial Sequence
  chemically synthesized
cttaaaagtatagcattcctat

SEQ ID NO: 1048478 - DNA, 22 bp, Artificial Sequence
  chemically synthesized
gcatgactgtgtcaataggaat

SEQ ID NO: 1048479 - DNA, 22 bp, Artificial Sequence
  chemically synthesized
aaaagtatagcattcctattga

SEQ ID NO: 1048480 - DNA, 22 bp, Artificial Sequence
  chemically synthesized
aaagtatagcattcctattgac

SEQ ID NO: 1048481 - DNA, 22 bp, Artificial Sequence
  chemically synthesized
tagattcgcatgactgtgtcaa

SEQ ID NO: 1048482 - DNA, 22 bp, Artificial Sequence
  chemically synthesized
attatagattcgcatgactgtg

SEQ ID NO: 1048483 - DNA, 22 bp, Artificial Sequence
  chemically synthesized
tcattatagattcgcatgactg

SEQ ID NO: 1048484 - DNA, 22 bp, Artificial Sequence
  chemically synthesized
ctcattatagattcgcatgact

SEQ ID NO: 1048485 - DNA, 22 bp, Artificial Sequence
  chemically synthesized
tctcattatagattcgcatgac

SEQ ID NO: 1048486 - DNA, 22 bp, Artificial Sequence
  chemically synthesized
ctattgacacagtcatgcgaat

SEQ ID NO: 1048487 - DNA, 22 bp, Artificial Sequence
  chemically synthesized
ttgacacagtcatgcgaatcta

SEQ ID NO: 1048488 - DNA, 22 bp, Artificial Sequence
  chemically synthesized
acacagtcatgcgaatctataa

SEQ ID NO: 1048489 - DNA, 22 bp, Artificial Sequence
  chemically synthesized
aatggatgtagttttctcatta

SEQ ID NO: 1048490 - DNA, 22 bp, Artificial Sequence
  chemically synthesized
aaagtcattcaatggatgtagt

SEQ ID NO: 1048491 - DNA, 22 bp, Artificial Sequence
  chemically synthesized
taatgagaaaactacatccatt

SEQ ID NO: 1048492 - DNA, 22 bp, Artificial Sequence
  chemically synthesized
aaccaaactgaaagtcattcaa

SEQ ID NO: 1048493 - DNA, 22 bp, Artificial Sequence
  chemically synthesized
ttaaaccaaactgaaagtcatt

SEQ ID NO: 1048494 - DNA, 22 bp, Artificial Sequence
  chemically synthesized
attaaaccaaactgaaagtcat

SEQ ID NO: 1048495 - DNA, 22 bp, Artificial Sequence
  chemically synthesized
tattaaaccaaactgaaagtca

SEQ ID NO: 1048496 - DNA, 22 bp, Artificial Sequence
  chemically synthesized
catccattgaatgactttcagt

SEQ ID NO: 1048497 - DNA, 22 bp, Artificial Sequence
  chemically synthesized
ttattaaaccaaactgaaagtc

SEQ ID NO: 1048498 - DNA, 22 bp, Artificial Sequence
  chemically synthesized
aaatttttattaaaccaaactg

SEQ ID NO: 1048499 - DNA, 22 bp, Artificial Sequence
  chemically synthesized
aatgactttcagtttggtttaa

SEQ ID NO: 1048500 - DNA, 22 bp, Artificial Sequence
  chemically synthesized
tctgaaatttttattaaaccaa

SEQ ID NO: 1048501 - DNA, 22 bp, Artificial Sequence
  chemically synthesized
tcagtttggtttaataaaaatt

SEQ ID NO: 1048502 - DNA, 22 bp, Artificial Sequence
  chemically synthesized
cagtttggtttaataaaaattt

SEQ ID NO: 1048503 - DNA, 22 bp, Artificial Sequence
  chemically synthesized
aataactgtctgaaatttttat

SEQ ID NO: 1048504 - DNA, 22 bp, Artificial Sequence
  chemically synthesized
agtttggtttaataaaaatttc

SEQ ID NO: 1048505 - DNA, 22 bp, Artificial Sequence
  chemically synthesized
aaataactgtctgaaattttta

SEQ ID NO: 1048506 - DNA, 22 bp, Artificial Sequence
  chemically synthesized
taaataactgtctgaaattttt

SEQ ID NO: 1048507 - DNA, 22 bp, Artificial Sequence
  chemically synthesized
ttaaataactgtctgaaatttt

SEQ ID NO: 1048508 - DNA, 22 bp, Artificial Sequence
  chemically synthesized
ggtttaataaaaatttcagaca

SEQ ID NO: 1048509 - DNA, 22 bp, Artificial Sequence
  chemically synthesized
gtttaataaaaatttcagacag

SEQ ID NO: 1048510 - DNA, 22 bp, Artificial Sequence
  chemically synthesized
atttttaaataactgtctgaaa

SEQ ID NO: 1048511 - DNA, 22 bp, Artificial Sequence
  chemically synthesized
aataaaaatttcagacagttat

SEQ ID NO: 1048512 - DNA, 22 bp, Artificial Sequence
  chemically synthesized
ataaaaatttcagacagttatt

SEQ ID NO: 1048513 - DNA, 22 bp, Artificial Sequence
  chemically synthesized
cactgatttttaaataactgtc

SEQ ID NO: 1048514 - DNA, 22 bp, Artificial Sequence
  chemically synthesized
attacactgatttttaaataac

SEQ ID NO: 1048515 - DNA, 22 bp, Artificial Sequence
  chemically synthesized
taattacactgatttttaaata

SEQ ID NO: 1048516 - DNA, 22 bp, Artificial Sequence
  chemically synthesized
ctaattacactgatttttaaat

SEQ ID NO: 1048517 - DNA, 22 bp, Artificial Sequence
  chemically synthesized
cagacagttatttaaaaatcag

SEQ ID NO: 1048518 - DNA, 22 bp, Artificial Sequence
  chemically synthesized
agacagttatttaaaaatcagt

SEQ ID NO: 1048519 - DNA, 22 bp, Artificial Sequence
  chemically synthesized
tttaaaaatcagtgtaattaga

SEQ ID NO: 1048520 - DNA, 22 bp, Artificial Sequence
  chemically synthesized
aaaaatcagtgtaattagaaat

SEQ ID NO: 1048521 - DNA, 22 bp, Artificial Sequence
  chemically synthesized
aaaatcagtgtaattagaaata

SEQ ID NO: 1048522 - DNA, 22 bp, Artificial Sequence
  chemically synthesized
cataaagaagagaaaatgaaca

SEQ ID NO: 1048523 - DNA, 22 bp, Artificial Sequence
  chemically synthesized
gcataaagaagagaaaatgaac

SEQ ID NO: 1048524 - DNA, 22 bp, Artificial Sequence
  chemically synthesized
tgcataaagaagagaaaatgaa

SEQ ID NO: 1048525 - DNA, 22 bp, Artificial Sequence
  chemically synthesized
gaaatatcatgttcattttctc

SEQ ID NO: 1048526 - DNA, 22 bp, Artificial Sequence
  chemically synthesized
gattttgcataaagaagagaaa

SEQ ID NO: 1048527 - DNA, 22 bp, Artificial Sequence
  chemically synthesized
attttctcttctttatgcaaaa

SEQ ID NO: 1048528 - DNA, 22 bp, Artificial Sequence
  chemically synthesized
aatgagtacctggattttgcat

SEQ ID NO: 1048529 - DNA, 22 bp, Artificial Sequence
  chemically synthesized
tctcttctttatgcaaaatcca

SEQ ID NO: 1048530 - DNA, 22 bp, Artificial Sequence
  chemically synthesized
ctcttctttatgcaaaatccag

SEQ ID NO: 1048531 - DNA, 22 bp, Artificial Sequence
  chemically synthesized
tcttctttatgcaaaatccagg

SEQ ID NO: 1048532 - DNA, 22 bp, Artificial Sequence
  chemically synthesized
atctgaatgagtacctggattt

SEQ ID NO: 1048533 - DNA, 22 bp, Artificial Sequence
  chemically synthesized
ttctttatgcaaaatccaggta

SEQ ID NO: 1048534 - DNA, 22 bp, Artificial Sequence
  chemically synthesized
ctttatgcaaaatccaggtact

SEQ ID NO: 1048535 - DNA, 22 bp, Artificial Sequence
  chemically synthesized
tttatgcaaaatccaggtactc

SEQ ID NO: 1048536 - DNA, 22 bp, Artificial Sequence
  chemically synthesized
tatgcaaaatccaggtactcat

SEQ ID NO: 1048537 - DNA, 22 bp, Artificial Sequence
  chemically synthesized
atgcaaaatccaggtactcatt

SEQ ID NO: 1048538 - DNA, 22 bp, Artificial Sequence
  chemically synthesized
tgcaaaatccaggtactcattc

SEQ ID NO: 1048539 - DNA, 22 bp, Artificial Sequence
  chemically synthesized
aaatgaaaaggattaatctgaa

SEQ ID NO: 1048540 - DNA, 22 bp, Artificial Sequence
  chemically synthesized
atgaaattcaaatgaaaaggat

SEQ ID NO: 1048541 - DNA, 22 bp, Artificial Sequence
  chemically synthesized
attcagattaatccttttcatt

SEQ ID NO: 1048542 - DNA, 22 bp, Artificial Sequence
  chemically synthesized
agattaatccttttcatttgaa

SEQ ID NO: 1048543 - DNA, 22 bp, Artificial Sequence
  chemically synthesized
atccttttcatttgaatttcat

SEQ ID NO: 1048544 - DNA, 22 bp, Artificial Sequence
  chemically synthesized
aaggcagagttaatgaaattca

SEQ ID NO: 1048545 - DNA, 22 bp, Artificial Sequence
  chemically synthesized
ttcaaggcagagttaatgaaat

SEQ ID NO: 1048546 - DNA, 22 bp, Artificial Sequence
  chemically synthesized
ttcatttgaatttcattaactc

SEQ ID NO: 1048547 - DNA, 22 bp, Artificial Sequence
  chemically synthesized
tcatttgaatttcattaactct

SEQ ID NO: 1048548 - DNA, 22 bp, Artificial Sequence
  chemically synthesized
catttgaatttcattaactctg

SEQ ID NO: 1048549 - DNA, 22 bp, Artificial Sequence
  chemically synthesized
atttgaatttcattaactctgc

SEQ ID NO: 1048550 - DNA, 22 bp, Artificial Sequence
  chemically synthesized
gaatttcattaactctgccttg

SEQ ID NO: 1048551 - DNA, 22 bp, Artificial Sequence
  chemically synthesized
aatttcattaactctgccttga

SEQ ID NO: 1048552 - DNA, 22 bp, Artificial Sequence
  chemically synthesized
agaaggataaaattattcaagg

SEQ ID NO: 1048553 - DNA, 22 bp, Artificial Sequence
  chemically synthesized
cattaactctgccttgaataat

SEQ ID NO: 1048554 - DNA, 22 bp, Artificial Sequence
  chemically synthesized
attaactctgccttgaataatt

SEQ ID NO: 1048555 - DNA, 22 bp, Artificial Sequence
  chemically synthesized
actctgccttgaataattttat

SEQ ID NO: 1048556 - DNA, 22 bp, Artificial Sequence
  chemically synthesized
tgccttgaataattttatcctt

SEQ ID NO: 1048557 - DNA, 22 bp, Artificial Sequence
  chemically synthesized
ccttgaataattttatccttct

SEQ ID NO: 1048558 - DNA, 22 bp, Artificial Sequence
  chemically synthesized
tacacatcagaactcagaagga

SEQ ID NO: 1048559 - DNA, 22 bp, Artificial Sequence
  chemically synthesized
gaataattttatccttctgagt

SEQ ID NO: 1048560 - DNA, 22 bp, Artificial Sequence
  chemically synthesized
gtacacatcagaactcagaagg

SEQ ID NO: 1048561 - DNA, 22 bp, Artificial Sequence
  chemically synthesized
aataattttatccttctgagtt

SEQ ID NO: 1048562 - DNA, 22 bp, Artificial Sequence
  chemically synthesized
tatccttctgagttctgatgtg

SEQ ID NO: 1048563 - DNA, 22 bp, Artificial Sequence
  chemically synthesized
atccttctgagttctgatgtgt

SEQ ID NO: 1048564 - DNA, 22 bp, Artificial Sequence
  chemically synthesized
gacgggatttgtacacatcaga

SEQ ID NO: 1048565 - DNA, 22 bp, Artificial Sequence
  chemically synthesized
tccttctgagttctgatgtgta

SEQ ID NO: 1048566 - DNA, 22 bp, Artificial Sequence
  chemically synthesized
ctgagttctgatgtgtacaaat

SEQ ID NO: 1048567 - DNA, 22 bp, Artificial Sequence
  chemically synthesized
tgagttctgatgtgtacaaatc

SEQ ID NO: 1048568 - DNA, 22 bp, Artificial Sequence
  chemically synthesized
agttctgatgtgtacaaatccc

SEQ ID NO: 1048569 - DNA, 22 bp, Artificial Sequence
  chemically synthesized
aaaaggttagacgggatttgta

SEQ ID NO: 1048570 - DNA, 22 bp, Artificial Sequence
  chemically synthesized
caaaaggttagacgggatttgt

SEQ ID NO: 1048571 - DNA, 22 bp, Artificial Sequence
  chemically synthesized
tcaaaaggttagacgggatttg

SEQ ID NO: 1048572 - DNA, 22 bp, Artificial Sequence
  chemically synthesized
tgatgtgtacaaatcccgtcta

SEQ ID NO: 1048573 - DNA, 22 bp, Artificial Sequence
  chemically synthesized
attttcaaaaggttagacggga

SEQ ID NO: 1048574 - DNA, 22 bp, Artificial Sequence
  chemically synthesized
atgtgtacaaatcccgtctaac

SEQ ID NO: 1048575 - DNA, 22 bp, Artificial Sequence
  chemically synthesized
acaaaagcaagttgattttcaa

SEQ ID NO: 1048576 - DNA, 22 bp, Artificial Sequence
  chemically synthesized
accttttgaaaatcaacttgct

SEQ ID NO: 1048577 - DNA, 22 bp, Artificial Sequence
  chemically synthesized
ttgaaaatcaacttgcttttgt

SEQ ID NO: 1048578 - DNA, 22 bp, Artificial Sequence
  chemically synthesized
tgaaaatcaacttgcttttgtt

SEQ ID NO: 1048579 - DNA, 22 bp, Artificial Sequence
  chemically synthesized
gaaaatcaacttgcttttgtta

SEQ ID NO: 1048580 - DNA, 22 bp, Artificial Sequence
  chemically synthesized
aaaatcaacttgcttttgttaa

SEQ ID NO: 1048581 - DNA, 22 bp, Artificial Sequence
  chemically synthesized
gcttttgttaatgttctttacc

SEQ ID NO: 1048582 - DNA, 22 bp, Artificial Sequence
  chemically synthesized
cttttgttaatgttctttacca

SEQ ID NO: 1048583 - DNA, 22 bp, Artificial Sequence
  chemically synthesized
taatgatataaggtggtaaaga

SEQ ID NO: 1048584 - DNA, 22 bp, Artificial Sequence
  chemically synthesized
ttgttaatgttctttaccacct

SEQ ID NO: 1048585 - DNA, 22 bp, Artificial Sequence
  chemically synthesized
tgttaatgttctttaccacctt

SEQ ID NO: 1048586 - DNA, 22 bp, Artificial Sequence
  chemically synthesized
gttaatgttctttaccacctta

SEQ ID NO: 1048587 - DNA, 22 bp, Artificial Sequence
  chemically synthesized
ttaatgttctttaccaccttat

SEQ ID NO: 1048588 - DNA, 22 bp, Artificial Sequence
  chemically synthesized
atgttctttaccaccttatatc

SEQ ID NO: 1048589 - DNA, 22 bp, Artificial Sequence
  chemically synthesized
tttaccaccttatatcattata

SEQ ID NO: 1048590 - DNA, 22 bp, Artificial Sequence
  chemically synthesized
taccaccttatatcattataga

SEQ ID NO: 1048591 - DNA, 22 bp, Artificial Sequence
  chemically synthesized
accaccttatatcattatagat

SEQ ID NO: 1048592 - DNA, 22 bp, Artificial Sequence
  chemically synthesized
ccaccttatatcattatagata

SEQ ID NO: 1048593 - DNA, 22 bp, Artificial Sequence
  chemically synthesized
atgatgcatgagtatctataat

SEQ ID NO: 1048594 - DNA, 22 bp, Artificial Sequence
  chemically synthesized
ctaatgatgcatgagtatctat

SEQ ID NO: 1048595 - DNA, 22 bp, Artificial Sequence
  chemically synthesized
gctaatgatgcatgagtatcta

SEQ ID NO: 1048596 - DNA, 22 bp, Artificial Sequence
  chemically synthesized
atatcattatagatactcatgc

SEQ ID NO: 1048597 - DNA, 22 bp, Artificial Sequence
  chemically synthesized
cttgctaatgatgcatgagtat

SEQ ID NO: 1048598 - DNA, 22 bp, Artificial Sequence
  chemically synthesized
tatcattatagatactcatgca

SEQ ID NO: 1048599 - DNA, 22 bp, Artificial Sequence
  chemically synthesized
ccttgctaatgatgcatgagta

SEQ ID NO: 1048600 - DNA, 22 bp, Artificial Sequence
  chemically synthesized
tagatactcatgcatcattagc

SEQ ID NO: 1048601 - DNA, 22 bp, Artificial Sequence
  chemically synthesized
tagcatttccttgctaatgatg

SEQ ID NO: 1048602 - DNA, 22 bp, Artificial Sequence
  chemically synthesized
atgcatcattagcaaggaaatg

SEQ ID NO: 1048603 - DNA, 22 bp, Artificial Sequence
  chemically synthesized
atcagattatagcatttccttg

SEQ ID NO: 1048604 - DNA, 22 bp, Artificial Sequence
  chemically synthesized
gcaaggaaatgctataatctga

SEQ ID NO: 1048605 - DNA, 22 bp, Artificial Sequence
  chemically synthesized
taatctgattaattcattttat

SEQ ID NO: 1048606 - DNA, 22 bp, Artificial Sequence
  chemically synthesized
attaattcattttatttctttg

SEQ ID NO: 1048607 - DNA, 22 bp, Artificial Sequence
  chemically synthesized
attcattttatttctttgtgtt

SEQ ID NO: 1048608 - DNA, 22 bp, Artificial Sequence
  chemically synthesized
aaaatgaaaataaacacaaaga

SEQ ID NO: 1048609 - DNA, 22 bp, Artificial Sequence
  chemically synthesized
attttatttctttgtgtttatt

SEQ ID NO: 1048610 - DNA, 22 bp, Artificial Sequence
  chemically synthesized
tatttctttgtgtttattttca

SEQ ID NO: 1048611 - DNA, 22 bp, Artificial Sequence
  chemically synthesized
atttctttgtgtttattttcat

SEQ ID NO: 1048612 - DNA, 22 bp, Artificial Sequence
  chemically synthesized
tttctttgtgtttattttcatt

SEQ ID NO: 1048613 - DNA, 22 bp, Artificial Sequence
  chemically synthesized
ctttgtgtttattttcattttt

SEQ ID NO: 1048614 - DNA, 22 bp, Artificial Sequence
  chemically synthesized
tttgtgtttattttcattttta

SEQ ID NO: 1048615 - DNA, 22 bp, Artificial Sequence
  chemically synthesized
gggtatatatggttaaaaatga

SEQ ID NO: 1048616 - DNA, 22 bp, Artificial Sequence
  chemically synthesized
tgtgtttattttcatttttaac

SEQ ID NO: 1048617 - DNA, 22 bp, Artificial Sequence
  chemically synthesized
ggggtatatatggttaaaaatg

SEQ ID NO: 1048618 - DNA, 22 bp, Artificial Sequence
  chemically synthesized
gtgtttattttcatttttaacc

SEQ ID NO: 1048619 - DNA, 22 bp, Artificial Sequence
  chemically synthesized
tggggtatatatggttaaaaat

SEQ ID NO: 1048620 - DNA, 22 bp, Artificial Sequence
  chemically synthesized
tgtttattttcatttttaacca

SEQ ID NO: 1048621 - DNA, 22 bp, Artificial Sequence
  chemically synthesized
tttggggtatatatggttaaaa

SEQ ID NO: 1048622 - DNA, 22 bp, Artificial Sequence
  chemically synthesized
attttcatttttaaccatatat

SEQ ID NO: 1048623 - DNA, 22 bp, Artificial Sequence
  chemically synthesized
ttttcatttttaaccatatata

SEQ ID NO: 1048624 - DNA, 22 bp, Artificial Sequence
  chemically synthesized
tcatttttaaccatatataccc

SEQ ID NO: 1048625 - DNA, 22 bp, Artificial Sequence
  chemically synthesized
gtatattctttggggtatatat

SEQ ID NO: 1048626 - DNA, 22 bp, Artificial Sequence
  chemically synthesized
catttttaaccatatatacccc

SEQ ID NO: 1048627 - DNA, 22 bp, Artificial Sequence
  chemically synthesized
atttttaaccatatatacccca

SEQ ID NO: 1048628 - DNA, 22 bp, Artificial Sequence
  chemically synthesized
ttaaccatatataccccaaaga

SEQ ID NO: 1048629 - DNA, 22 bp, Artificial Sequence
  chemically synthesized
taaccatatataccccaaagaa

SEQ ID NO: 1048630 - DNA, 22 bp, Artificial Sequence
  chemically synthesized
aaccatatataccccaaagaat

SEQ ID NO: 1048631 - DNA, 22 bp, Artificial Sequence
  chemically synthesized
accatatataccccaaagaata

SEQ ID NO: 1048632 - DNA, 22 bp, Artificial Sequence
  chemically synthesized
gaaaatgaggctagtatattct

SEQ ID NO: 1048633 - DNA, 22 bp, Artificial Sequence
  chemically synthesized
tagaaaatgaggctagtatatt

SEQ ID NO: 1048634 - DNA, 22 bp, Artificial Sequence
  chemically synthesized
ctagaaaatgaggctagtatat

SEQ ID NO: 1048635 - DNA, 22 bp, Artificial Sequence
  chemically synthesized
tttctagaaaatgaggctagta

SEQ ID NO: 1048636 - DNA, 22 bp, Artificial Sequence
  chemically synthesized
gtttctagaaaatgaggctagt

SEQ ID NO: 1048637 - DNA, 22 bp, Artificial Sequence
  chemically synthesized
tgtttctagaaaatgaggctag

SEQ ID NO: 1048638 - DNA, 22 bp, Artificial Sequence
  chemically synthesized
ttgtttctagaaaatgaggcta

SEQ ID NO: 1048639 - DNA, 22 bp, Artificial Sequence
  chemically synthesized
tttgtttctagaaaatgaggct

SEQ ID NO: 1048640 - DNA, 22 bp, Artificial Sequence
  chemically synthesized
acatatctttttgtttctagaa

SEQ ID NO: 1048641 - DNA, 22 bp, Artificial Sequence
  chemically synthesized
cacatatctttttgtttctaga

SEQ ID NO: 1048642 - DNA, 22 bp, Artificial Sequence
  chemically synthesized
tcacatatctttttgtttctag

SEQ ID NO: 1048643 - DNA, 22 bp, Artificial Sequence
  chemically synthesized
gcctcattttctagaaacaaaa

SEQ ID NO: 1048644 - DNA, 22 bp, Artificial Sequence
  chemically synthesized
tttcacatatctttttgtttct

SEQ ID NO: 1048645 - DNA, 22 bp, Artificial Sequence
  chemically synthesized
ctttcacatatctttttgtttc

SEQ ID NO: 1048646 - DNA, 22 bp, Artificial Sequence
  chemically synthesized
attttctagaaacaaaaagata

SEQ ID NO: 1048647 - DNA, 22 bp, Artificial Sequence
  chemically synthesized
tggtttctttcacatatctttt

SEQ ID NO: 1048648 - DNA, 22 bp, Artificial Sequence
  chemically synthesized
atggtttctttcacatatcttt

SEQ ID NO: 1048649 - DNA, 22 bp, Artificial Sequence
  chemically synthesized
tctagaaacaaaaagatatgtg

SEQ ID NO: 1048650 - DNA, 22 bp, Artificial Sequence
  chemically synthesized
tatggtttctttcacatatctt

SEQ ID NO: 1048651 - DNA, 22 bp, Artificial Sequence
  chemically synthesized
ctagaaacaaaaagatatgtga

SEQ ID NO: 1048652 - DNA, 22 bp, Artificial Sequence
  chemically synthesized
tagaaacaaaaagatatgtgaa

SEQ ID NO: 1048653 - DNA, 22 bp, Artificial Sequence
  chemically synthesized
gaaacaaaaagatatgtgaaag

SEQ ID NO: 1048654 - DNA, 22 bp, Artificial Sequence
  chemically synthesized
aataaaaataggcattttatgg

SEQ ID NO: 1048655 - DNA, 22 bp, Artificial Sequence
  chemically synthesized
aaataaaaataggcattttatg

SEQ ID NO: 1048656 - DNA, 22 bp, Artificial Sequence
  chemically synthesized
taaataaaaataggcattttat

SEQ ID NO: 1048657 - DNA, 22 bp, Artificial Sequence
  chemically synthesized
ttaaataaaaataggcatttta

SEQ ID NO: 1048658 - DNA, 22 bp, Artificial Sequence
  chemically synthesized
atttttaaataaaaataggcat

SEQ ID NO: 1048659 - DNA, 22 bp, Artificial Sequence
  chemically synthesized
catttttaaataaaaataggca

SEQ ID NO: 1048660 - DNA, 22 bp, Artificial Sequence
  chemically synthesized
tcatttttaaataaaaataggc

SEQ ID NO: 1048661 - DNA, 22 bp, Artificial Sequence
  chemically synthesized
ttcatttttaaataaaaatagg

SEQ ID NO: 1048662 - DNA, 22 bp, Artificial Sequence
  chemically synthesized
atcgaacttttcatttttaaat

SEQ ID NO: 1048663 - DNA, 22 bp, Artificial Sequence
  chemically synthesized
tttttatttaaaaatgaaaagt

SEQ ID NO: 1048664 - DNA, 22 bp, Artificial Sequence
  chemically synthesized
agcattgatcgaacttttcatt

SEQ ID NO: 1048665 - DNA, 22 bp, Artificial Sequence
  chemically synthesized
ttatttaaaaatgaaaagttcg

SEQ ID NO: 1048666 - DNA, 22 bp, Artificial Sequence
  chemically synthesized
tatttaaaaatgaaaagttcga

SEQ ID NO: 1048667 - DNA, 22 bp, Artificial Sequence
  chemically synthesized
atttaaaaatgaaaagttcgat

SEQ ID NO: 1048668 - DNA, 22 bp, Artificial Sequence
  chemically synthesized
tttaaaaatgaaaagttcgatc

SEQ ID NO: 1048669 - DNA, 22 bp, Artificial Sequence
  chemically synthesized
aaaaatgaaaagttcgatcaat

SEQ ID NO: 1048670 - DNA, 22 bp, Artificial Sequence
  chemically synthesized
aaaatgaaaagttcgatcaatg

SEQ ID NO: 1048671 - DNA, 22 bp, Artificial Sequence
  chemically synthesized
taatagtcattaagcattgatc

SEQ ID NO: 1048672 - DNA, 22 bp, Artificial Sequence
  chemically synthesized
tataatagtcattaagcattga

SEQ ID NO: 1048673 - DNA, 22 bp, Artificial Sequence
  chemically synthesized
tgttctataatagtcattaagc

SEQ ID NO: 1048674 - DNA, 22 bp, Artificial Sequence
  chemically synthesized
gatcaatgcttaatgactatta

SEQ ID NO: 1048675 - DNA, 22 bp, Artificial Sequence
  chemically synthesized
aatgactattatagaacacaat

SEQ ID NO: 1048676 - DNA, 22 bp, Artificial Sequence
  chemically synthesized
atgactattatagaacacaatt

SEQ ID NO: 1048677 - DNA, 22 bp, Artificial Sequence
  chemically synthesized
gatcatacaaatcataattgtg

SEQ ID NO: 1048678 - DNA, 22 bp, Artificial Sequence
  chemically synthesized
agatcatacaaatcataattgt

SEQ ID NO: 1048679 - DNA, 22 bp, Artificial Sequence
  chemically synthesized
ttatagaacacaattatgattt

SEQ ID NO: 1048680 - DNA, 22 bp, Artificial Sequence
  chemically synthesized
agtttagatcatacaaatcata

SEQ ID NO: 1048681 - DNA, 22 bp, Artificial Sequence
  chemically synthesized
tagaacacaattatgatttgta

SEQ ID NO: 1048682 - DNA, 22 bp, Artificial Sequence
  chemically synthesized
aagtttagatcatacaaatcat

SEQ ID NO: 1048683 - DNA, 22 bp, Artificial Sequence
  chemically synthesized
taagtttagatcatacaaatca

SEQ ID NO: 1048684 - DNA, 22 bp, Artificial Sequence
  chemically synthesized
actttaagtttagatcatacaa

SEQ ID NO: 1048685 - DNA, 22 bp, Artificial Sequence
  chemically synthesized
gactttaagtttagatcataca

SEQ ID NO: 1048686 - DNA, 22 bp, Artificial Sequence
  chemically synthesized
tgactttaagtttagatcatac

SEQ ID NO: 1048687 - DNA, 22 bp, Artificial Sequence
  chemically synthesized
ttttgactttaagtttagatca

SEQ ID NO: 1048688 - DNA, 22 bp, Artificial Sequence
  chemically synthesized
tgatttgtatgatctaaactta

SEQ ID NO: 1048689 - DNA, 22 bp, Artificial Sequence
  chemically synthesized
aaactgttttgactttaagttt

SEQ ID NO: 1048690 - DNA, 22 bp, Artificial Sequence
  chemically synthesized
aaaactgttttgactttaagtt

SEQ ID NO: 1048691 - DNA, 22 bp, Artificial Sequence
  chemically synthesized
gtatgatctaaacttaaagtca

SEQ ID NO: 1048692 - DNA, 22 bp, Artificial Sequence
  chemically synthesized
tatgatctaaacttaaagtcaa

SEQ ID NO: 1048693 - DNA, 22 bp, Artificial Sequence
  chemically synthesized
agaatcttaaaactgttttgac

SEQ ID NO: 1048694 - DNA, 22 bp, Artificial Sequence
  chemically synthesized
aacttaaagtcaaaacagtttt

SEQ ID NO: 1048695 - DNA, 22 bp, Artificial Sequence
  chemically synthesized
cacagctcagaatcttaaaact

SEQ ID NO: 1048696 - DNA, 22 bp, Artificial Sequence
  chemically synthesized
aaagtcaaaacagttttaagat

SEQ ID NO: 1048697 - DNA, 22 bp, Artificial Sequence
  chemically synthesized
acacagctcagaatcttaaaac

SEQ ID NO: 1048698 - DNA, 22 bp, Artificial Sequence
  chemically synthesized
aagtcaaaacagttttaagatt

SEQ ID NO: 1048699 - DNA, 22 bp, Artificial Sequence
  chemically synthesized
tttacacagctcagaatcttaa

SEQ ID NO: 1048700 - DNA, 22 bp, Artificial Sequence
  chemically synthesized
tgcctatttacacagctcagaa

SEQ ID NO: 1048701 - DNA, 22 bp, Artificial Sequence
  chemically synthesized
taagattctgagctgtgtaaat

SEQ ID NO: 1048702 - DNA, 22 bp, Artificial Sequence
  chemically synthesized
aagattctgagctgtgtaaata

SEQ ID NO: 1048703 - DNA, 22 bp, Artificial Sequence
  chemically synthesized
agattctgagctgtgtaaatag

SEQ ID NO: 1048704 - DNA, 22 bp, Artificial Sequence
  chemically synthesized
tgagtgatacctgtgcctattt

SEQ ID NO: 1048705 - DNA, 22 bp, Artificial Sequence
  chemically synthesized
gtgagtgatacctgtgcctatt

SEQ ID NO: 1048706 - DNA, 22 bp, Artificial Sequence
  chemically synthesized
tgagctgtgtaaataggcacag

SEQ ID NO: 1048707 - DNA, 22 bp, Artificial Sequence
  chemically synthesized
tgtgagtgatacctgtgcctat

SEQ ID NO: 1048708 - DNA, 22 bp, Artificial Sequence
  chemically synthesized
agctgtgtaaataggcacaggt

SEQ ID NO: 1048709 - DNA, 22 bp, Artificial Sequence
  chemically synthesized
tgtaaataggcacaggtatcac

SEQ ID NO: 1048710 - DNA, 22 bp, Artificial Sequence
  chemically synthesized
aaaactttgtgagtgatacctg

SEQ ID NO: 1048711 - DNA, 22 bp, Artificial Sequence
  chemically synthesized
agatgaatgaaaatgtattcaa

SEQ ID NO: 1048712 - DNA, 22 bp, Artificial Sequence
  chemically synthesized
cagatgaatgaaaatgtattca

SEQ ID NO: 1048713 - DNA, 22 bp, Artificial Sequence
  chemically synthesized
acaaagttttgaatacattttc

SEQ ID NO: 1048714 - DNA, 22 bp, Artificial Sequence
  chemically synthesized
agtttcagatgaatgaaaatgt

SEQ ID NO: 1048715 - DNA, 22 bp, Artificial Sequence
  chemically synthesized
aagtttcagatgaatgaaaatg

SEQ ID NO: 1048716 - DNA, 22 bp, Artificial Sequence
  chemically synthesized
tgaatacattttcattcatctg

SEQ ID NO: 1048717 - DNA, 22 bp, Artificial Sequence
  chemically synthesized
gaatacattttcattcatctga

SEQ ID NO: 1048718 - DNA, 22 bp, Artificial Sequence
  chemically synthesized
aatacattttcattcatctgaa

SEQ ID NO: 1048719 - DNA, 22 bp, Artificial Sequence
  chemically synthesized
tcattcatctgaaacttaagtt

SEQ ID NO: 1048720 - DNA, 22 bp, Artificial Sequence
  chemically synthesized
cattcatctgaaacttaagtta

SEQ ID NO: 1048721 - DNA, 22 bp, Artificial Sequence
  chemically synthesized
attcatctgaaacttaagttat

SEQ ID NO: 1048722 - DNA, 22 bp, Artificial Sequence
  chemically synthesized
atctgaaacttaagttatcaca

SEQ ID NO: 1048723 - DNA, 22 bp, Artificial Sequence
  chemically synthesized
tgtaatgaaaagaatgtgataa

SEQ ID NO: 1048724 - DNA, 22 bp, Artificial Sequence
  chemically synthesized
atgtaatgaaaagaatgtgata

SEQ ID NO: 1048725 - DNA, 22 bp, Artificial Sequence
  chemically synthesized
tatgtaatgaaaagaatgtgat

SEQ ID NO: 1048726 - DNA, 22 bp, Artificial Sequence
  chemically synthesized
aaacttaagttatcacattctt

SEQ ID NO: 1048727 - DNA, 22 bp, Artificial Sequence
  chemically synthesized
aagttatcacattcttttcatt

SEQ ID NO: 1048728 - DNA, 22 bp, Artificial Sequence
  chemically synthesized
agttatcacattcttttcatta

SEQ ID NO: 1048729 - DNA, 22 bp, Artificial Sequence
  chemically synthesized
tcacattcttttcattacataa

SEQ ID NO: 1048730 - DNA, 22 bp, Artificial Sequence
  chemically synthesized
aagaaacaaattttatgtaatg

SEQ ID NO: 1048731 - DNA, 22 bp, Artificial Sequence
  chemically synthesized
caagaaacaaattttatgtaat

SEQ ID NO: 1048732 - DNA, 22 bp, Artificial Sequence
  chemically synthesized
ttttcattacataaaatttgtt

SEQ ID NO: 1048733 - DNA, 22 bp, Artificial Sequence
  chemically synthesized
tggcccttcaagaaacaaattt

SEQ ID NO: 1048734 - DNA, 22 bp, Artificial Sequence
  chemically synthesized
ttcattacataaaatttgtttc

SEQ ID NO: 1048735 - DNA, 22 bp, Artificial Sequence
  chemically synthesized
tcattacataaaatttgtttct

SEQ ID NO: 1048736 - DNA, 22 bp, Artificial Sequence
  chemically synthesized
cattacataaaatttgtttctt

SEQ ID NO: 1048737 - DNA, 22 bp, Artificial Sequence
  chemically synthesized
attacataaaatttgtttcttg

SEQ ID NO: 1048738 - DNA, 22 bp, Artificial Sequence
  chemically synthesized
cagttatggcccttcaagaaac

SEQ ID NO: 1048739 - DNA, 22 bp, Artificial Sequence
  chemically synthesized
gcagttatggcccttcaagaaa

SEQ ID NO: 1048740 - DNA, 22 bp, Artificial Sequence
  chemically synthesized
cataaaatttgtttcttgaagg

SEQ ID NO: 1048741 - DNA, 22 bp, Artificial Sequence
  chemically synthesized
tgcagttatggcccttcaagaa

SEQ ID NO: 1048742 - DNA, 22 bp, Artificial Sequence
  chemically synthesized
tcctttgcagttatggcccttc

SEQ ID NO: 1048743 - DNA, 22 bp, Artificial Sequence
  chemically synthesized
atcctttgcagttatggccctt

SEQ ID NO: 1048744 - DNA, 22 bp, Artificial Sequence
  chemically synthesized
tatcctttgcagttatggccct

SEQ ID NO: 1048745 - DNA, 22 bp, Artificial Sequence
  chemically synthesized
ttatcctttgcagttatggccc

SEQ ID NO: 1048746 - DNA, 22 bp, Artificial Sequence
  chemically synthesized
gtttcttgaagggccataactg

SEQ ID NO: 1048747 - DNA, 22 bp, Artificial Sequence
  chemically synthesized
tttcttgaagggccataactgc

SEQ ID NO: 1048748 - DNA, 22 bp, Artificial Sequence
  chemically synthesized
cttttatcctttgcagttatgg

SEQ ID NO: 1048749 - DNA, 22 bp, Artificial Sequence
  chemically synthesized
cttgaagggccataactgcaaa

SEQ ID NO: 1048750 - DNA, 22 bp, Artificial Sequence
  chemically synthesized
ttgaagggccataactgcaaag

SEQ ID NO: 1048751 - DNA, 22 bp, Artificial Sequence
  chemically synthesized
gaagggccataactgcaaagga

SEQ ID NO: 1048752 - DNA, 22 bp, Artificial Sequence
  chemically synthesized
aagggccataactgcaaaggat

SEQ ID NO: 1048753 - DNA, 22 bp, Artificial Sequence
  chemically synthesized
aaaacaggattgcttttatcct

SEQ ID NO: 1048754 - DNA, 22 bp, Artificial Sequence
  chemically synthesized
caaaacaggattgcttttatcc

SEQ ID NO: 1048755 - DNA, 22 bp, Artificial Sequence
  chemically synthesized
tttcaaaacaggattgctttta

SEQ ID NO: 1048756 - DNA, 22 bp, Artificial Sequence
  chemically synthesized
gtttcaaaacaggattgctttt

SEQ ID NO: 1048757 - DNA, 22 bp, Artificial Sequence
  chemically synthesized
caaaggataaaagcaatcctgt

SEQ ID NO: 1048758 - DNA, 22 bp, Artificial Sequence
  chemically synthesized
gacataatgcaccatttgtttc

SEQ ID NO: 1048759 - DNA, 22 bp, Artificial Sequence
  chemically synthesized
ttttgaaacaaatggtgcatta

SEQ ID NO: 1048760 - DNA, 22 bp, Artificial Sequence
  chemically synthesized
aaaacctagacataatgcacca

SEQ ID NO: 1048761 - DNA, 22 bp, Artificial Sequence
  chemically synthesized
aaaaacctagacataatgcacc

SEQ ID NO: 1048762 - DNA, 22 bp, Artificial Sequence
  chemically synthesized
tgaaacaaatggtgcattatgt

SEQ ID NO: 1048763 - DNA, 22 bp, Artificial Sequence
  chemically synthesized
gaaacaaatggtgcattatgtc

SEQ ID NO: 1048764 - DNA, 22 bp, Artificial Sequence
  chemically synthesized
tttaaaaacctagacataatgc

SEQ ID NO: 1048765 - DNA, 22 bp, Artificial Sequence
  chemically synthesized
aaacaaatggtgcattatgtct

SEQ ID NO: 1048766 - DNA, 22 bp, Artificial Sequence
  chemically synthesized
gtttaaaaacctagacataatg

SEQ ID NO: 1048767 - DNA, 22 bp, Artificial Sequence
  chemically synthesized
tgtttaaaaacctagacataat

SEQ ID NO: 1048768 - DNA, 22 bp, Artificial Sequence
  chemically synthesized
tgtctaggtttttaaacaaaat

SEQ ID NO: 1048769 - DNA, 22 bp, Artificial Sequence
  chemically synthesized
aatcatggaggaaaacattttg

SEQ ID NO: 1048770 - DNA, 22 bp, Artificial Sequence
  chemically synthesized
aaatcatggaggaaaacatttt

SEQ ID NO: 1048771 - DNA, 22 bp, Artificial Sequence
  chemically synthesized
ggtttttaaacaaaatgttttc

SEQ ID NO: 1048772 - DNA, 22 bp, Artificial Sequence
  chemically synthesized
taaatcatggaggaaaacattt

SEQ ID NO: 1048773 - DNA, 22 bp, Artificial Sequence
  chemically synthesized
ttaaatcatggaggaaaacatt

SEQ ID NO: 1048774 - DNA, 22 bp, Artificial Sequence
  chemically synthesized
ttaaacaaaatgttttcctcca

SEQ ID NO: 1048775 - DNA, 22 bp, Artificial Sequence
  chemically synthesized
taaacaaaatgttttcctccat

SEQ ID NO: 1048776 - DNA, 22 bp, Artificial Sequence
  chemically synthesized
aaacaaaatgttttcctccatg

SEQ ID NO: 1048777 - DNA, 22 bp, Artificial Sequence
  chemically synthesized
aacaaaatgttttcctccatga

SEQ ID NO: 1048778 - DNA, 22 bp, Artificial Sequence
  chemically synthesized
aaggagaaagaagtcttttaaa

SEQ ID NO: 1048779 - DNA, 22 bp, Artificial Sequence
  chemically synthesized
aaaggagaaagaagtcttttaa

SEQ ID NO: 1048780 - DNA, 22 bp, Artificial Sequence
  chemically synthesized
tcctccatgatttaaaagactt

SEQ ID NO: 1048781 - DNA, 22 bp, Artificial Sequence
  chemically synthesized
cctccatgatttaaaagacttc

SEQ ID NO: 1048782 - DNA, 22 bp, Artificial Sequence
  chemically synthesized
ctccatgatttaaaagacttct

SEQ ID NO: 1048783 - DNA, 22 bp, Artificial Sequence
  chemically synthesized
catgatttaaaagacttctttc

SEQ ID NO: 1048784 - DNA, 22 bp, Artificial Sequence
  chemically synthesized
aatgcatttaaaggagaaagaa

SEQ ID NO: 1048785 - DNA, 22 bp, Artificial Sequence
  chemically synthesized
aaaagacttctttctcctttaa

SEQ ID NO: 1048786 - DNA, 22 bp, Artificial Sequence
  chemically synthesized
aaagacttctttctcctttaaa

SEQ ID NO: 1048787 - DNA, 22 bp, Artificial Sequence
  chemically synthesized
ctttctcctttaaatgcattga

SEQ ID NO: 1048788 - DNA, 22 bp, Artificial Sequence
  chemically synthesized
tttctcctttaaatgcattgag

SEQ ID NO: 1048789 - DNA, 22 bp, Artificial Sequence
  chemically synthesized
tctcctttaaatgcattgaggt

SEQ ID NO: 1048790 - DNA, 22 bp, Artificial Sequence
  chemically synthesized
ctcctttaaatgcattgaggtt

SEQ ID NO: 1048791 - DNA, 22 bp, Artificial Sequence
  chemically synthesized
tcctttaaatgcattgaggtta

SEQ ID NO: 1048792 - DNA, 22 bp, Artificial Sequence
  chemically synthesized
ataaatgggccagtaacctcaa

SEQ ID NO: 1048793 - DNA, 22 bp, Artificial Sequence
  chemically synthesized
ctttaaatgcattgaggttact

SEQ ID NO: 1048794 - DNA, 22 bp, Artificial Sequence
  chemically synthesized
taaatgcattgaggttactggc

SEQ ID NO: 1048795 - DNA, 22 bp, Artificial Sequence
  chemically synthesized
aaatgcattgaggttactggcc

SEQ ID NO: 1048796 - DNA, 22 bp, Artificial Sequence
  chemically synthesized
aatgcattgaggttactggccc

SEQ ID NO: 1048797 - DNA, 22 bp, Artificial Sequence
  chemically synthesized
ataactcataaatgggccagta

SEQ ID NO: 1048798 - DNA, 22 bp, Artificial Sequence
  chemically synthesized
acctcataactcataaatgggc

SEQ ID NO: 1048799 - DNA, 22 bp, Artificial Sequence
  chemically synthesized
gacctcataactcataaatggg

SEQ ID NO: 1048800 - DNA, 22 bp, Artificial Sequence
  chemically synthesized
tgacctcataactcataaatgg

SEQ ID NO: 1048801 - DNA, 22 bp, Artificial Sequence
  chemically synthesized
aggttactggcccatttatgag

SEQ ID NO: 1048802 - DNA, 22 bp, Artificial Sequence
  chemically synthesized
tttgacctcataactcataaat

SEQ ID NO: 1048803 - DNA, 22 bp, Artificial Sequence
  chemically synthesized
ctttgacctcataactcataaa

SEQ ID NO: 1048804 - DNA, 22 bp, Artificial Sequence
  chemically synthesized
ctggcccatttatgagttatga

SEQ ID NO: 1048805 - DNA, 22 bp, Artificial Sequence
  chemically synthesized
agtttctttgacctcataactc

SEQ ID NO: 1048806 - DNA, 22 bp, Artificial Sequence
  chemically synthesized
gagtttctttgacctcataact

SEQ ID NO: 1048807 - DNA, 22 bp, Artificial Sequence
  chemically synthesized
gcccatttatgagttatgaggt

SEQ ID NO: 1048808 - DNA, 22 bp, Artificial Sequence
  chemically synthesized
ttgagtttctttgacctcataa

SEQ ID NO: 1048809 - DNA, 22 bp, Artificial Sequence
  chemically synthesized
cttgagtttctttgacctcata

SEQ ID NO: 1048810 - DNA, 22 bp, Artificial Sequence
  chemically synthesized
ttcttgagtttctttgacctca

SEQ ID NO: 1048811 - DNA, 22 bp, Artificial Sequence
  chemically synthesized
cttcttgagtttctttgacctc

SEQ ID NO: 1048812 - DNA, 22 bp, Artificial Sequence
  chemically synthesized
tcttcttgagtttctttgacct

SEQ ID NO: 1048813 - DNA, 22 bp, Artificial Sequence
  chemically synthesized
ttcttcttgagtttctttgacc

SEQ ID NO: 1048814 - DNA, 22 bp, Artificial Sequence
  chemically synthesized
atgagttatgaggtcaaagaaa

SEQ ID NO: 1048815 - DNA, 22 bp, Artificial Sequence
  chemically synthesized
tgagttatgaggtcaaagaaac

SEQ ID NO: 1048816 - DNA, 22 bp, Artificial Sequence
  chemically synthesized
tgaggtcaaagaaactcaagaa

SEQ ID NO: 1048817 - DNA, 22 bp, Artificial Sequence
  chemically synthesized
aagaagaaaaatgtgctatatg

SEQ ID NO: 1048818 - DNA, 22 bp, Artificial Sequence
  chemically synthesized
tggcatatgtcataatcatatg

SEQ ID NO: 1048819 - DNA, 22 bp, Artificial Sequence
  chemically synthesized
gtggcatatgtcataatcatat

SEQ ID NO: 1048820 - DNA, 22 bp, Artificial Sequence
  chemically synthesized
tgtggcatatgtcataatcata

SEQ ID NO: 1048821 - DNA, 22 bp, Artificial Sequence
  chemically synthesized
ttttgtggcatatgtcataatc

SEQ ID NO: 1048822 - DNA, 22 bp, Artificial Sequence
  chemically synthesized
tatgacatatgattatgacata

SEQ ID NO: 1048823 - DNA, 22 bp, Artificial Sequence
  chemically synthesized
tgacatatgccacaaaataact

SEQ ID NO: 1048824 - DNA, 22 bp, Artificial Sequence
  chemically synthesized
tatgagatatatagttattttg

SEQ ID NO: 1048825 - DNA, 22 bp, Artificial Sequence
  chemically synthesized
atatgagatatatagttatttt

SEQ ID NO: 1048826 - DNA, 22 bp, Artificial Sequence
  chemically synthesized
atgtgccatatttatatgagat

SEQ ID NO: 1048827 - DNA, 22 bp, Artificial Sequence
  chemically synthesized
catgtgccatatttatatgaga

SEQ ID NO: 1048828 - DNA, 22 bp, Artificial Sequence
  chemically synthesized
tcatgtgccatatttatatgag

SEQ ID NO: 1048829 - DNA, 22 bp, Artificial Sequence
  chemically synthesized
ttcatgtgccatatttatatga

SEQ ID NO: 1048830 - DNA, 22 bp, Artificial Sequence
  chemically synthesized
tatatctcatataaatatggca

SEQ ID NO: 1048831 - DNA, 22 bp, Artificial Sequence
  chemically synthesized
atatatttttcatgtgccatat

SEQ ID NO: 1048832 - DNA, 22 bp, Artificial Sequence
  chemically synthesized
atataaatatggcacatgaaaa

SEQ ID NO: 1048833 - DNA, 22 bp, Artificial Sequence
  chemically synthesized
atgcattgatatatttttcatg

SEQ ID NO: 1048834 - DNA, 22 bp, Artificial Sequence
  chemically synthesized
gatgcattgatatatttttcat

SEQ ID NO: 1048835 - DNA, 22 bp, Artificial Sequence
  chemically synthesized
tgatgcattgatatatttttca

SEQ ID NO: 1048836 - DNA, 22 bp, Artificial Sequence
  chemically synthesized
ttgatgcattgatatatttttc

SEQ ID NO: 1048837 - DNA, 22 bp, Artificial Sequence
  chemically synthesized
cacttttgatgcattgatatat

SEQ ID NO: 1048838 - DNA, 22 bp, Artificial Sequence
  chemically synthesized
ttacacttttgatgcattgata

SEQ ID NO: 1048839 - DNA, 22 bp, Artificial Sequence
  chemically synthesized
gttacacttttgatgcattgat

SEQ ID NO: 1048840 - DNA, 22 bp, Artificial Sequence
  chemically synthesized
tgttacacttttgatgcattga

SEQ ID NO: 1048841 - DNA, 22 bp, Artificial Sequence
  chemically synthesized
ttgttacacttttgatgcattg

SEQ ID NO: 1048842 - DNA, 22 bp, Artificial Sequence
  chemically synthesized
tttttgttacacttttgatgca

SEQ ID NO: 1048843 - DNA, 22 bp, Artificial Sequence
  chemically synthesized
gtcaagataatagtctattttt

SEQ ID NO: 1048844 - DNA, 22 bp, Artificial Sequence
  chemically synthesized
ggtcaagataatagtctatttt

SEQ ID NO: 1048845 - DNA, 22 bp, Artificial Sequence
  chemically synthesized
tggtcaagataatagtctattt

SEQ ID NO: 1048846 - DNA, 22 bp, Artificial Sequence
  chemically synthesized
ttggtcaagataatagtctatt

SEQ ID NO: 1048847 - DNA, 22 bp, Artificial Sequence
  chemically synthesized
tttttggtcaagataatagtct

SEQ ID NO: 1048848 - DNA, 22 bp, Artificial Sequence
  chemically synthesized
ctgtttttggtcaagataatag

SEQ ID NO: 1048849 - DNA, 22 bp, Artificial Sequence
  chemically synthesized
actgtttttggtcaagataata

SEQ ID NO: 1048850 - DNA, 22 bp, Artificial Sequence
  chemically synthesized
tactgtttttggtcaagataat

SEQ ID NO: 1048851 - DNA, 22 bp, Artificial Sequence
  chemically synthesized
ttttactgtttttggtcaagat

SEQ ID NO: 1048852 - DNA, 22 bp, Artificial Sequence
  chemically synthesized
catcactattttactgtttttg

SEQ ID NO: 1048853 - DNA, 22 bp, Artificial Sequence
  chemically synthesized
ttatcttgaccaaaaacagtaa

SEQ ID NO: 1048854 - DNA, 22 bp, Artificial Sequence
  chemically synthesized
tcttgaccaaaaacagtaaaat

SEQ ID NO: 1048855 - DNA, 22 bp, Artificial Sequence
  chemically synthesized
gaccaaaaacagtaaaatagtg

SEQ ID NO: 1048856 - DNA, 22 bp, Artificial Sequence
  chemically synthesized
accaaaaacagtaaaatagtga

SEQ ID NO: 1048857 - DNA, 22 bp, Artificial Sequence
  chemically synthesized
aaaaaaaaaaggctccatcact

SEQ ID NO: 1048858 - DNA, 22 bp, Artificial Sequence
  chemically synthesized
acaccaacgcagttaaaaaaaa

SEQ ID NO: 1048859 - DNA, 22 bp, Artificial Sequence
  chemically synthesized
attaacaccaacgcagttaaaa

SEQ ID NO: 1048860 - DNA, 22 bp, Artificial Sequence
  chemically synthesized
cattaacaccaacgcagttaaa

SEQ ID NO: 1048861 - DNA, 22 bp, Artificial Sequence
  chemically synthesized
atcttcattaacaccaacgcag

SEQ ID NO: 1048862 - DNA, 22 bp, Artificial Sequence
  chemically synthesized
tttttttttaactgcgttggtg

SEQ ID NO: 1048863 - DNA, 22 bp, Artificial Sequence
  chemically synthesized
catcttcattaacaccaacgca

SEQ ID NO: 1048864 - DNA, 22 bp, Artificial Sequence
  chemically synthesized
ttttttttaactgcgttggtgt

SEQ ID NO: 1048865 - DNA, 22 bp, Artificial Sequence
  chemically synthesized
tcatcttcattaacaccaacgc

SEQ ID NO: 1048866 - DNA, 22 bp, Artificial Sequence
  chemically synthesized
tttttttaactgcgttggtgtt

SEQ ID NO: 1048867 - DNA, 22 bp, Artificial Sequence
  chemically synthesized
ttttttaactgcgttggtgtta

SEQ ID NO: 1048868 - DNA, 22 bp, Artificial Sequence
  chemically synthesized
tttttaactgcgttggtgttaa

SEQ ID NO: 1048869 - DNA, 22 bp, Artificial Sequence
  chemically synthesized
ttttcatcttcattaacaccaa

SEQ ID NO: 1048870 - DNA, 22 bp, Artificial Sequence
  chemically synthesized
ttttaactgcgttggtgttaat

SEQ ID NO: 1048871 - DNA, 22 bp, Artificial Sequence
  chemically synthesized
attttcatcttcattaacacca

SEQ ID NO: 1048872 - DNA, 22 bp, Artificial Sequence
  chemically synthesized
tttaactgcgttggtgttaatg

SEQ ID NO: 1048873 - DNA, 22 bp, Artificial Sequence
  chemically synthesized
ttaactgcgttggtgttaatga

SEQ ID NO: 1048874 - DNA, 22 bp, Artificial Sequence
  chemically synthesized
taactgcgttggtgttaatgaa

SEQ ID NO: 1048875 - DNA, 22 bp, Artificial Sequence
  chemically synthesized
cttattttcatcttcattaaca

SEQ ID NO: 1048876 - DNA, 22 bp, Artificial Sequence
  chemically synthesized
aactgcgttggtgttaatgaag

SEQ ID NO: 1048877 - DNA, 22 bp, Artificial Sequence
  chemically synthesized
gcttattttcatcttcattaac

SEQ ID NO: 1048878 - DNA, 22 bp, Artificial Sequence
  chemically synthesized
actgcgttggtgttaatgaaga

SEQ ID NO: 1048879 - DNA, 22 bp, Artificial Sequence
  chemically synthesized
cgttggtgttaatgaagatgaa

SEQ ID NO: 1048880 - DNA, 22 bp, Artificial Sequence
  chemically synthesized
aggatttgcttattttcatctt

SEQ ID NO: 1048881 - DNA, 22 bp, Artificial Sequence
  chemically synthesized
gaggatttgcttattttcatct

SEQ ID NO: 1048882 - DNA, 22 bp, Artificial Sequence
  chemically synthesized
tgaggatttgcttattttcatc

SEQ ID NO: 1048883 - DNA, 22 bp, Artificial Sequence
  chemically synthesized
gtgttaatgaagatgaaaataa

SEQ ID NO: 1048884 - DNA, 22 bp, Artificial Sequence
  chemically synthesized
ctttgaggatttgcttattttc

SEQ ID NO: 1048885 - DNA, 22 bp, Artificial Sequence
  chemically synthesized
actttgaggatttgcttatttt

SEQ ID NO: 1048886 - DNA, 22 bp, Artificial Sequence
  chemically synthesized
atgaagatgaaaataagcaaat

SEQ ID NO: 1048887 - DNA, 22 bp, Artificial Sequence
  chemically synthesized
ataaatcttactttgaggattt

SEQ ID NO: 1048888 - DNA, 22 bp, Artificial Sequence
  chemically synthesized
aatcattaataaatcttacttt

SEQ ID NO: 1048889 - DNA, 22 bp, Artificial Sequence
  chemically synthesized
acactaaatcattaataaatct

SEQ ID NO: 1048890 - DNA, 22 bp, Artificial Sequence
  chemically synthesized
aaagtaagatttattaatgatt

SEQ ID NO: 1048891 - DNA, 22 bp, Artificial Sequence
  chemically synthesized
tagctcacactaaatcattaat

SEQ ID NO: 1048892 - DNA, 22 bp, Artificial Sequence
  chemically synthesized
atattatagctcacactaaatc

SEQ ID NO: 1048893 - DNA, 22 bp, Artificial Sequence
  chemically synthesized
catattatagctcacactaaat

SEQ ID NO: 1048894 - DNA, 22 bp, Artificial Sequence
  chemically synthesized
tcatattatagctcacactaaa

SEQ ID NO: 1048895 - DNA, 22 bp, Artificial Sequence
  chemically synthesized
attaatgatttagtgtgagcta

SEQ ID NO: 1048896 - DNA, 22 bp, Artificial Sequence
  chemically synthesized
ttaatgatttagtgtgagctat

SEQ ID NO: 1048897 - DNA, 22 bp, Artificial Sequence
  chemically synthesized
atgatttagtgtgagctataat

SEQ ID NO: 1048898 - DNA, 22 bp, Artificial Sequence
  chemically synthesized
atagattttcatattatagctc

SEQ ID NO: 1048899 - DNA, 22 bp, Artificial Sequence
  chemically synthesized
tggctcatagattttcatatta

SEQ ID NO: 1048900 - DNA, 22 bp, Artificial Sequence
  chemically synthesized
agtgtgagctataatatgaaaa

SEQ ID NO: 1048901 - DNA, 22 bp, Artificial Sequence
  chemically synthesized
gtgtgagctataatatgaaaat

SEQ ID NO: 1048902 - DNA, 22 bp, Artificial Sequence
  chemically synthesized
atattatggctcatagattttc

SEQ ID NO: 1048903 - DNA, 22 bp, Artificial Sequence
  chemically synthesized
catattatggctcatagatttt

SEQ ID NO: 1048904 - DNA, 22 bp, Artificial Sequence
  chemically synthesized
tcatattatggctcatagattt

SEQ ID NO: 1048905 - DNA, 22 bp, Artificial Sequence
  chemically synthesized
taatatgaaaatctatgagcca

SEQ ID NO: 1048906 - DNA, 22 bp, Artificial Sequence
  chemically synthesized
acatactttcatattatggctc

SEQ ID NO: 1048907 - DNA, 22 bp, Artificial Sequence
  chemically synthesized
tgagccataatatgaaagtatg

SEQ ID NO: 1048908 - DNA, 22 bp, Artificial Sequence
  chemically synthesized
aggaaagataatcagatacaaa

SEQ ID NO: 1048909 - DNA, 22 bp, Artificial Sequence
  chemically synthesized
gaggaaagataatcagatacaa

SEQ ID NO: 1048910 - DNA, 22 bp, Artificial Sequence
  chemically synthesized
tgaggaaagataatcagataca

SEQ ID NO: 1048911 - DNA, 22 bp, Artificial Sequence
  chemically synthesized
agaatgtccctttgaggaaaga

SEQ ID NO: 1048912 - DNA, 22 bp, Artificial Sequence
  chemically synthesized
gtatctgattatctttcctcaa

SEQ ID NO: 1048913 - DNA, 22 bp, Artificial Sequence
  chemically synthesized
aagaatgtccctttgaggaaag

SEQ ID NO: 1048914 - DNA, 22 bp, Artificial Sequence
  chemically synthesized
tatctgattatctttcctcaaa

SEQ ID NO: 1048915 - DNA, 22 bp, Artificial Sequence
  chemically synthesized
attatctttcctcaaagggaca

SEQ ID NO: 1048916 - DNA, 22 bp, Artificial Sequence
  chemically synthesized
tctttcctcaaagggacattct

SEQ ID NO: 1048917 - DNA, 22 bp, Artificial Sequence
  chemically synthesized
tcctcaaagggacattcttaaa

SEQ ID NO: 1048918 - DNA, 22 bp, Artificial Sequence
  chemically synthesized
cctcaaagggacattcttaaat

SEQ ID NO: 1048919 - DNA, 22 bp, Artificial Sequence
  chemically synthesized
ctcaaagggacattcttaaata

SEQ ID NO: 1048920 - DNA, 22 bp, Artificial Sequence
  chemically synthesized
aataatccataatatttaagaa

SEQ ID NO: 1048921 - DNA, 22 bp, Artificial Sequence
  chemically synthesized
aaataatccataatatttaaga

SEQ ID NO: 1048922 - DNA, 22 bp, Artificial Sequence
  chemically synthesized
taaataatccataatatttaag

SEQ ID NO: 1048923 - DNA, 22 bp, Artificial Sequence
  chemically synthesized
aaagggacattcttaaatatta

SEQ ID NO: 1048924 - DNA, 22 bp, Artificial Sequence
  chemically synthesized
ttaaataatccataatatttaa

SEQ ID NO: 1048925 - DNA, 22 bp, Artificial Sequence
  chemically synthesized
cttttaaataatccataatatt

SEQ ID NO: 1048926 - DNA, 22 bp, Artificial Sequence
  chemically synthesized
ttacttttaaataatccataat

SEQ ID NO: 1048927 - DNA, 22 bp, Artificial Sequence
  chemically synthesized
tgttattacttttaaataatcc

SEQ ID NO: 1048928 - DNA, 22 bp, Artificial Sequence
  chemically synthesized
ttaaatattatggattatttaa

SEQ ID NO: 1048929 - DNA, 22 bp, Artificial Sequence
  chemically synthesized
aaatattatggattatttaaaa

SEQ ID NO: 1048930 - DNA, 22 bp, Artificial Sequence
  chemically synthesized
aatattatggattatttaaaag

SEQ ID NO: 1048931 - DNA, 22 bp, Artificial Sequence
  chemically synthesized
catatcattgtgttattacttt

SEQ ID NO: 1048932 - DNA, 22 bp, Artificial Sequence
  chemically synthesized
tggattatttaaaagtaataac

SEQ ID NO: 1048933 - DNA, 22 bp, Artificial Sequence
  chemically synthesized
acatatcattgtgttattactt

SEQ ID NO: 1048934 - DNA, 22 bp, Artificial Sequence
  chemically synthesized
gatttacatatcattgtgttat

SEQ ID NO: 1048935 - DNA, 22 bp, Artificial Sequence
  chemically synthesized
ggatttacatatcattgtgtta

SEQ ID NO: 1048936 - DNA, 22 bp, Artificial Sequence
  chemically synthesized
tttaaaagtaataacacaatga

SEQ ID NO: 1048937 - DNA, 22 bp, Artificial Sequence
  chemically synthesized
tggatttacatatcattgtgtt

SEQ ID NO: 1048938 - DNA, 22 bp, Artificial Sequence
  chemically synthesized
aaaagtaataacacaatgatat

SEQ ID NO: 1048939 - DNA, 22 bp, Artificial Sequence
  chemically synthesized
ttttggatttacatatcattgt

SEQ ID NO: 1048940 - DNA, 22 bp, Artificial Sequence
  chemically synthesized
aaagtaataacacaatgatatg

SEQ ID NO: 1048941 - DNA, 22 bp, Artificial Sequence
  chemically synthesized
cagtcctattttggatttacat

SEQ ID NO: 1048942 - DNA, 22 bp, Artificial Sequence
  chemically synthesized
aagcctgcagtcctattttgga

SEQ ID NO: 1048943 - DNA, 22 bp, Artificial Sequence
  chemically synthesized
aaagcctgcagtcctattttgg

SEQ ID NO: 1048944 - DNA, 22 bp, Artificial Sequence
  chemically synthesized
cttaaagcctgcagtcctattt

SEQ ID NO: 1048945 - DNA, 22 bp, Artificial Sequence
  chemically synthesized
tgacccatcagaacctacttaa

SEQ ID NO: 1048946 - DNA, 22 bp, Artificial Sequence
  chemically synthesized
atgacccatcagaacctactta

SEQ ID NO: 1048947 - DNA, 22 bp, Artificial Sequence
  chemically synthesized
atttatgacccatcagaaccta

SEQ ID NO: 1048948 - DNA, 22 bp, Artificial Sequence
  chemically synthesized
caggctttaagtaggttctgat

SEQ ID NO: 1048949 - DNA, 22 bp, Artificial Sequence
  chemically synthesized
catttatgacccatcagaacct

SEQ ID NO: 1048950 - DNA, 22 bp, Artificial Sequence
  chemically synthesized
tcatttatgacccatcagaacc

SEQ ID NO: 1048951 - DNA, 22 bp, Artificial Sequence
  chemically synthesized
ttcatttatgacccatcagaac

SEQ ID NO: 1048952 - DNA, 22 bp, Artificial Sequence
  chemically synthesized
ccttttcatttatgacccatca

SEQ ID NO: 1048953 - DNA, 22 bp, Artificial Sequence
  chemically synthesized
taagtaggttctgatgggtcat

SEQ ID NO: 1048954 - DNA, 22 bp, Artificial Sequence
  chemically synthesized
aagtaggttctgatgggtcata

SEQ ID NO: 1048955 - DNA, 22 bp, Artificial Sequence
  chemically synthesized
agtaggttctgatgggtcataa

SEQ ID NO: 1048956 - DNA, 22 bp, Artificial Sequence
  chemically synthesized
ccattgccttttcatttatgac

SEQ ID NO: 1048957 - DNA, 22 bp, Artificial Sequence
  chemically synthesized
cccattgccttttcatttatga

SEQ ID NO: 1048958 - DNA, 22 bp, Artificial Sequence
  chemically synthesized
tcccattgccttttcatttatg

SEQ ID NO: 1048959 - DNA, 22 bp, Artificial Sequence
  chemically synthesized
tgatgggtcataaatgaaaagg

SEQ ID NO: 1048960 - DNA, 22 bp, Artificial Sequence
  chemically synthesized
atgggtcataaatgaaaaggca

SEQ ID NO: 1048961 - DNA, 22 bp, Artificial Sequence
  chemically synthesized
agtctttcccattgccttttca

SEQ ID NO: 1048962 - DNA, 22 bp, Artificial Sequence
  chemically synthesized
aagtctttcccattgccttttc

SEQ ID NO: 1048963 - DNA, 22 bp, Artificial Sequence
  chemically synthesized
agacttaagtctttcccattgc

SEQ ID NO: 1048964 - DNA, 22 bp, Artificial Sequence
  chemically synthesized
tctaagacttaagtctttccca

SEQ ID NO: 1048965 - DNA, 22 bp, Artificial Sequence
  chemically synthesized
gtctaagacttaagtctttccc

SEQ ID NO: 1048966 - DNA, 22 bp, Artificial Sequence
  chemically synthesized
cttgtctaagacttaagtcttt

SEQ ID NO: 1048967 - DNA, 22 bp, Artificial Sequence
  chemically synthesized
agagacagagctacttgtctaa

SEQ ID NO: 1048968 - DNA, 22 bp, Artificial Sequence
  chemically synthesized
aagtcttagacaagtagctctg

SEQ ID NO: 1048969 - DNA, 22 bp, Artificial Sequence
  chemically synthesized
agtcttagacaagtagctctgt

SEQ ID NO: 1048970 - DNA, 22 bp, Artificial Sequence
  chemically synthesized
tggggctaagagacagagctac

SEQ ID NO: 1048971 - DNA, 22 bp, Artificial Sequence
  chemically synthesized
gtggggctaagagacagagcta

SEQ ID NO: 1048972 - DNA, 22 bp, Artificial Sequence
  chemically synthesized
agacaagtagctctgtctctta

SEQ ID NO: 1048973 - DNA, 22 bp, Artificial Sequence
  chemically synthesized
gacaagtagctctgtctcttag

SEQ ID NO: 1048974 - DNA, 22 bp, Artificial Sequence
  chemically synthesized
aagacttgtggggctaagagac

SEQ ID NO: 1048975 - DNA, 22 bp, Artificial Sequence
  chemically synthesized
tgaagacttgtggggctaagag

SEQ ID NO: 1048976 - DNA, 22 bp, Artificial Sequence
  chemically synthesized
tctgaagacttgtggggctaag

SEQ ID NO: 1048977 - DNA, 22 bp, Artificial Sequence
  chemically synthesized
ctctgaagacttgtggggctaa

SEQ ID NO: 1048978 - DNA, 22 bp, Artificial Sequence
  chemically synthesized
tctctgaagacttgtggggcta

SEQ ID NO: 1048979 - DNA, 22 bp, Artificial Sequence
  chemically synthesized
tctttctctgaagacttgtggg

SEQ ID NO: 1048980 - DNA, 22 bp, Artificial Sequence
  chemically synthesized
tgtctcttagccccacaagtct

SEQ ID NO: 1048981 - DNA, 22 bp, Artificial Sequence
  chemically synthesized
gtctttctctgaagacttgtgg

SEQ ID NO: 1048982 - DNA, 22 bp, Artificial Sequence
  chemically synthesized
tctcttagccccacaagtcttc

SEQ ID NO: 1048983 - DNA, 22 bp, Artificial Sequence
  chemically synthesized
ttagccccacaagtcttcagag

SEQ ID NO: 1048984 - DNA, 22 bp, Artificial Sequence
  chemically synthesized
agccccacaagtcttcagagaa

SEQ ID NO: 1048985 - DNA, 22 bp, Artificial Sequence
  chemically synthesized
gccccacaagtcttcagagaaa

SEQ ID NO: 1048986 - DNA, 22 bp, Artificial Sequence
  chemically synthesized
gaaggaaacttgtctttctctg

SEQ ID NO: 1048987 - DNA, 22 bp, Artificial Sequence
  chemically synthesized
ctagaaggaaacttgtctttct

SEQ ID NO: 1048988 - DNA, 22 bp, Artificial Sequence
  chemically synthesized
cagagaaagacaagtttccttc

SEQ ID NO: 1048989 - DNA, 22 bp, Artificial Sequence
  chemically synthesized
taatgattcctagaaggaaact

SEQ ID NO: 1048990 - DNA, 22 bp, Artificial Sequence
  chemically synthesized
agagaaagacaagtttccttct

SEQ ID NO: 1048991 - DNA, 22 bp, Artificial Sequence
  chemically synthesized
ctgtaatgattcctagaaggaa

SEQ ID NO: 1048992 - DNA, 22 bp, Artificial Sequence
  chemically synthesized
ttactgtaatgattcctagaag

SEQ ID NO: 1048993 - DNA, 22 bp, Artificial Sequence
  chemically synthesized
attactgtaatgattcctagaa

SEQ ID NO: 1048994 - DNA, 22 bp, Artificial Sequence
  chemically synthesized
tttattactgtaatgattccta

SEQ ID NO: 1048995 - DNA, 22 bp, Artificial Sequence
  chemically synthesized
gtttattactgtaatgattcct

SEQ ID NO: 1048996 - DNA, 22 bp, Artificial Sequence
  chemically synthesized
tgtttattactgtaatgattcc

SEQ ID NO: 1048997 - DNA, 22 bp, Artificial Sequence
  chemically synthesized
ccttctaggaatcattacagta

SEQ ID NO: 1048998 - DNA, 22 bp, Artificial Sequence
  chemically synthesized
aactttgtttattactgtaatg

SEQ ID NO: 1048999 - DNA, 22 bp, Artificial Sequence
  chemically synthesized
cttctaggaatcattacagtaa

SEQ ID NO: 1049000 - DNA, 22 bp, Artificial Sequence
  chemically synthesized
tcaactttgtttattactgtaa

SEQ ID NO: 1049001 - DNA, 22 bp, Artificial Sequence
  chemically synthesized
ctaggaatcattacagtaataa

SEQ ID NO: 1049002 - DNA, 22 bp, Artificial Sequence
  chemically synthesized
taggaatcattacagtaataaa

SEQ ID NO: 1049003 - DNA, 22 bp, Artificial Sequence
  chemically synthesized
ggaatcattacagtaataaaca

SEQ ID NO: 1049004 - DNA, 22 bp, Artificial Sequence
  chemically synthesized
cagtaataaacaaagttgagag

SEQ ID NO: 1049005 - DNA, 22 bp, Artificial Sequence
  chemically synthesized
tccaggagaaataaataaaaaa

SEQ ID NO: 1049006 - DNA, 22 bp, Artificial Sequence
  chemically synthesized
taattgtccaggagaaataaat

SEQ ID NO: 1049007 - DNA, 22 bp, Artificial Sequence
  chemically synthesized
agagattttttatttatttctc

SEQ ID NO: 1049008 - DNA, 22 bp, Artificial Sequence
  chemically synthesized
ttataattgtccaggagaaata

SEQ ID NO: 1049009 - DNA, 22 bp, Artificial Sequence
  chemically synthesized
tttatttatttctcctggacaa

SEQ ID NO: 1049010 - DNA, 22 bp, Artificial Sequence
  chemically synthesized
ttatttatttctcctggacaat

SEQ ID NO: 1049011 - DNA, 22 bp, Artificial Sequence
  chemically synthesized
tatttatttctcctggacaatt

SEQ ID NO: 1049012 - DNA, 22 bp, Artificial Sequence
  chemically synthesized
atttatttctcctggacaatta

SEQ ID NO: 1049013 - DNA, 22 bp, Artificial Sequence
  chemically synthesized
caatgcctattataattgtcca

SEQ ID NO: 1049014 - DNA, 22 bp, Artificial Sequence
  chemically synthesized
tttatttctcctggacaattat

SEQ ID NO: 1049015 - DNA, 22 bp, Artificial Sequence
  chemically synthesized
acaatgcctattataattgtcc

SEQ ID NO: 1049016 - DNA, 22 bp, Artificial Sequence
  chemically synthesized
atttctcctggacaattataat

SEQ ID NO: 1049017 - DNA, 22 bp, Artificial Sequence
  chemically synthesized
tttctcctggacaattataata

SEQ ID NO: 1049018 - DNA, 22 bp, Artificial Sequence
  chemically synthesized
tgcttacaatgcctattataat

SEQ ID NO: 1049019 - DNA, 22 bp, Artificial Sequence
  chemically synthesized
atgcttacaatgcctattataa

SEQ ID NO: 1049020 - DNA, 22 bp, Artificial Sequence
  chemically synthesized
ctcctggacaattataataggc

SEQ ID NO: 1049021 - DNA, 22 bp, Artificial Sequence
  chemically synthesized
tatgcttacaatgcctattata

SEQ ID NO: 1049022 - DNA, 22 bp, Artificial Sequence
  chemically synthesized
tcctggacaattataataggca

SEQ ID NO: 1049023 - DNA, 22 bp, Artificial Sequence
  chemically synthesized
ttatgcttacaatgcctattat

SEQ ID NO: 1049024 - DNA, 22 bp, Artificial Sequence
  chemically synthesized
ctggacaattataataggcatt

SEQ ID NO: 1049025 - DNA, 22 bp, Artificial Sequence
  chemically synthesized
gacaattataataggcattgta

SEQ ID NO: 1049026 - DNA, 22 bp, Artificial Sequence
  chemically synthesized
catttttatgcttacaatgcct

SEQ ID NO: 1049027 - DNA, 22 bp, Artificial Sequence
  chemically synthesized
gcatttttatgcttacaatgcc

SEQ ID NO: 1049028 - DNA, 22 bp, Artificial Sequence
  chemically synthesized
tgatttgcatttttatgcttac

SEQ ID NO: 1049029 - DNA, 22 bp, Artificial Sequence
  chemically synthesized
taataggcattgtaagcataaa

SEQ ID NO: 1049030 - DNA, 22 bp, Artificial Sequence
  chemically synthesized
gtgatttgcatttttatgctta

SEQ ID NO: 1049031 - DNA, 22 bp, Artificial Sequence
  chemically synthesized
tttgtgatttgcatttttatgc

SEQ ID NO: 1049032 - DNA, 22 bp, Artificial Sequence
  chemically synthesized
gtttgtgatttgcatttttatg

SEQ ID NO: 1049033 - DNA, 22 bp, Artificial Sequence
  chemically synthesized
atttgtttgtgatttgcatttt

SEQ ID NO: 1049034 - DNA, 22 bp, Artificial Sequence
  chemically synthesized
taagcataaaaatgcaaatcac

SEQ ID NO: 1049035 - DNA, 22 bp, Artificial Sequence
  chemically synthesized
cctaatttgtttgtgatttgca

SEQ ID NO: 1049036 - DNA, 22 bp, Artificial Sequence
  chemically synthesized
gcctaatttgtttgtgatttgc

SEQ ID NO: 1049037 - DNA, 22 bp, Artificial Sequence
  chemically synthesized
tgcctaatttgtttgtgatttg

SEQ ID NO: 1049038 - DNA, 22 bp, Artificial Sequence
  chemically synthesized
ttgcctaatttgtttgtgattt

SEQ ID NO: 1049039 - DNA, 22 bp, Artificial Sequence
  chemically synthesized
gaccaatacaatatttttgcct

SEQ ID NO: 1049040 - DNA, 22 bp, Artificial Sequence
  chemically synthesized
atcaccctggaccaatacaata

SEQ ID NO: 1049041 - DNA, 22 bp, Artificial Sequence
  chemically synthesized
aatcaccctggaccaatacaat

SEQ ID NO: 1049042 - DNA, 22 bp, Artificial Sequence
  chemically synthesized
taatcaccctggaccaatacaa

SEQ ID NO: 1049043 - DNA, 22 bp, Artificial Sequence
  chemically synthesized
ttaatcaccctggaccaataca

SEQ ID NO: 1049044 - DNA, 22 bp, Artificial Sequence
  chemically synthesized
ggcaaaaatattgtattggtcc

SEQ ID NO: 1049045 - DNA, 22 bp, Artificial Sequence
  chemically synthesized
tttaatcaccctggaccaatac

SEQ ID NO: 1049046 - DNA, 22 bp, Artificial Sequence
  chemically synthesized
gggttttttaatcaccctggac

SEQ ID NO: 1049047 - DNA, 22 bp, Artificial Sequence
  chemically synthesized
ggggttttttaatcaccctgga

SEQ ID NO: 1049048 - DNA, 22 bp, Artificial Sequence
  chemically synthesized
tttggggttttttaatcaccct

SEQ ID NO: 1049049 - DNA, 22 bp, Artificial Sequence
  chemically synthesized
tattggtccagggtgattaaaa

SEQ ID NO: 1049050 - DNA, 22 bp, Artificial Sequence
  chemically synthesized
ttgtttggggttttttaatcac

SEQ ID NO: 1049051 - DNA, 22 bp, Artificial Sequence
  chemically synthesized
attgtttggggttttttaatca

SEQ ID NO: 1049052 - DNA, 22 bp, Artificial Sequence
  chemically synthesized
tattgtttggggttttttaatc

SEQ ID NO: 1049053 - DNA, 22 bp, Artificial Sequence
  chemically synthesized
gtccagggtgattaaaaaaccc

SEQ ID NO: 1049054 - DNA, 22 bp, Artificial Sequence
  chemically synthesized
tgctttattgtttggggttttt

SEQ ID NO: 1049055 - DNA, 22 bp, Artificial Sequence
  chemically synthesized
atgctttattgtttggggtttt

SEQ ID NO: 1049056 - DNA, 22 bp, Artificial Sequence
  chemically synthesized
tatgctttattgtttggggttt

SEQ ID NO: 1049057 - DNA, 22 bp, Artificial Sequence
  chemically synthesized
ttatgctttattgtttggggtt

SEQ ID NO: 1049058 - DNA, 22 bp, Artificial Sequence
  chemically synthesized
tttttatgctttattgtttggg

SEQ ID NO: 1049059 - DNA, 22 bp, Artificial Sequence
  chemically synthesized
gtttttatgctttattgtttgg

SEQ ID NO: 1049060 - DNA, 22 bp, Artificial Sequence
  chemically synthesized
tgtttttatgctttattgtttg

SEQ ID NO: 1049061 - DNA, 22 bp, Artificial Sequence
  chemically synthesized
ttttgtttttatgctttattgt

SEQ ID NO: 1049062 - DNA, 22 bp, Artificial Sequence
  chemically synthesized
aaaaaccccaaacaataaagca

SEQ ID NO: 1049063 - DNA, 22 bp, Artificial Sequence
  chemically synthesized
catcatgttgttttgtttttat

SEQ ID NO: 1049064 - DNA, 22 bp, Artificial Sequence
  chemically synthesized
acctgcatcatgttgttttgtt

SEQ ID NO: 1049065 - DNA, 22 bp, Artificial Sequence
  chemically synthesized
aaaccatacccgtctcacctgc

SEQ ID NO: 1049066 - DNA, 22 bp, Artificial Sequence
  chemically synthesized
tatgtatccaaaacagtgacaa

SEQ ID NO: 1049067 - DNA, 22 bp, Artificial Sequence
  chemically synthesized
taatctgcgttgtcactgtttt

SEQ ID NO: 1049068 - DNA, 22 bp, Artificial Sequence
  chemically synthesized
aatctgcgttgtcactgttttg

SEQ ID NO: 1049069 - DNA, 22 bp, Artificial Sequence
  chemically synthesized
atctgcgttgtcactgttttgg

SEQ ID NO: 1049070 - DNA, 22 bp, Artificial Sequence
  chemically synthesized
cgttgtcactgttttggataca

SEQ ID NO: 1049071 - DNA, 22 bp, Artificial Sequence
  chemically synthesized
tcatgccattatatgtatccaa

SEQ ID NO: 1049072 - DNA, 22 bp, Artificial Sequence
  chemically synthesized
ttgtcatgccattatatgtatc

SEQ ID NO: 1049073 - DNA, 22 bp, Artificial Sequence
  chemically synthesized
tcactgttttggatacatataa

SEQ ID NO: 1049074 - DNA, 22 bp, Artificial Sequence
  chemically synthesized
ttattgtcatgccattatatgt

SEQ ID NO: 1049075 - DNA, 22 bp, Artificial Sequence
  chemically synthesized
ttttggatacatataatggcat

SEQ ID NO: 1049076 - DNA, 22 bp, Artificial Sequence
  chemically synthesized
tggatacatataatggcatgac

SEQ ID NO: 1049077 - DNA, 22 bp, Artificial Sequence
  chemically synthesized
ggatacatataatggcatgaca

SEQ ID NO: 1049078 - DNA, 22 bp, Artificial Sequence
  chemically synthesized
gatacatataatggcatgacaa

SEQ ID NO: 1049079 - DNA, 22 bp, Artificial Sequence
  chemically synthesized
tcagaatgctgttattgtcatg

SEQ ID NO: 1049080 - DNA, 22 bp, Artificial Sequence
  chemically synthesized
aaacagacaaaacgaagtactg

SEQ ID NO: 1049081 - DNA, 22 bp, Artificial Sequence
  chemically synthesized
actaaaacagacaaaacgaagt

SEQ ID NO: 1049082 - DNA, 22 bp, Artificial Sequence
  chemically synthesized
gactaaaacagacaaaacgaag

SEQ ID NO: 1049083 - DNA, 22 bp, Artificial Sequence
  chemically synthesized
tgacagtacttcgttttgtctg

SEQ ID NO: 1049084 - DNA, 22 bp, Artificial Sequence
  chemically synthesized
acagtacttcgttttgtctgtt

SEQ ID NO: 1049085 - DNA, 22 bp, Artificial Sequence
  chemically synthesized
cccagtgacttgactaaaacag

SEQ ID NO: 1049086 - DNA, 22 bp, Artificial Sequence
  chemically synthesized
tacccagtgacttgactaaaac

SEQ ID NO: 1049087 - DNA, 22 bp, Artificial Sequence
  chemically synthesized
ctacccagtgacttgactaaaa

SEQ ID NO: 1049088 - DNA, 22 bp, Artificial Sequence
  chemically synthesized
cgttttgtctgttttagtcaag

SEQ ID NO: 1049089 - DNA, 22 bp, Artificial Sequence
  chemically synthesized
tctacccagtgacttgactaaa

SEQ ID NO: 1049090 - DNA, 22 bp, Artificial Sequence
  chemically synthesized
gttttgtctgttttagtcaagt

SEQ ID NO: 1049091 - DNA, 22 bp, Artificial Sequence
  chemically synthesized
tgtctgttttagtcaagtcact

SEQ ID NO: 1049092 - DNA, 22 bp, Artificial Sequence
  chemically synthesized
gtctgttttagtcaagtcactg

SEQ ID NO: 1049093 - DNA, 22 bp, Artificial Sequence
  chemically synthesized
tctgttttagtcaagtcactgg

SEQ ID NO: 1049094 - DNA, 22 bp, Artificial Sequence
  chemically synthesized
aacatctttctacccagtgact

SEQ ID NO: 1049095 - DNA, 22 bp, Artificial Sequence
  chemically synthesized
ttttagtcaagtcactgggtag

SEQ ID NO: 1049096 - DNA, 22 bp, Artificial Sequence
  chemically synthesized
ttcaacatctttctacccagtg

SEQ ID NO: 1049097 - DNA, 22 bp, Artificial Sequence
  chemically synthesized
tagtcaagtcactgggtagaaa

SEQ ID NO: 1049098 - DNA, 22 bp, Artificial Sequence
  chemically synthesized
agtcaagtcactgggtagaaag

SEQ ID NO: 1049099 - DNA, 22 bp, Artificial Sequence
  chemically synthesized
attattcaacatctttctaccc

SEQ ID NO: 1049100 - DNA, 22 bp, Artificial Sequence
  chemically synthesized
gtcaagtcactgggtagaaaga

SEQ ID NO: 1049101 - DNA, 22 bp, Artificial Sequence
  chemically synthesized
gattgattattcaacatctttc

SEQ ID NO: 1049102 - DNA, 22 bp, Artificial Sequence
  chemically synthesized
attagattgattattcaacatc

SEQ ID NO: 1049103 - DNA, 22 bp, Artificial Sequence
  chemically synthesized
ggtagaaagatgttgaataatc

SEQ ID NO: 1049104 - DNA, 22 bp, Artificial Sequence
  chemically synthesized
gactcattagattgattattca

SEQ ID NO: 1049105 - DNA, 22 bp, Artificial Sequence
  chemically synthesized
agactcattagattgattattc

SEQ ID NO: 1049106 - DNA, 22 bp, Artificial Sequence
  chemically synthesized
aataatcaatctaatgagtcta

SEQ ID NO: 1049107 - DNA, 22 bp, Artificial Sequence
  chemically synthesized
tgcacggtcataaccaatatgc

SEQ ID NO: 1049108 - DNA, 22 bp, Artificial Sequence
  chemically synthesized
atgagtctaagcatattggtta

SEQ ID NO: 1049109 - DNA, 22 bp, Artificial Sequence
  chemically synthesized
tatgcacggtcataaccaatat

SEQ ID NO: 1049110 - DNA, 22 bp, Artificial Sequence
  chemically synthesized
ctatgcacggtcataaccaata

SEQ ID NO: 1049111 - DNA, 22 bp, Artificial Sequence
  chemically synthesized
tctatgcacggtcataaccaat

SEQ ID NO: 1049112 - DNA, 22 bp, Artificial Sequence
  chemically synthesized
ttctatgcacggtcataaccaa

SEQ ID NO: 1049113 - DNA, 22 bp, Artificial Sequence
  chemically synthesized
tttctatgcacggtcataacca

SEQ ID NO: 1049114 - DNA, 22 bp, Artificial Sequence
  chemically synthesized
ttttttctatgcacggtcataa

SEQ ID NO: 1049115 - DNA, 22 bp, Artificial Sequence
  chemically synthesized
agcatattggttatgaccgtgc

SEQ ID NO: 1049116 - DNA, 22 bp, Artificial Sequence
  chemically synthesized
ctattttttctatgcacggtca

SEQ ID NO: 1049117 - DNA, 22 bp, Artificial Sequence
  chemically synthesized
attgctattttttctatgcacg

SEQ ID NO: 1049118 - DNA, 22 bp, Artificial Sequence
  chemically synthesized
tcattgctattttttctatgca

SEQ ID NO: 1049119 - DNA, 22 bp, Artificial Sequence
  chemically synthesized
gttatgaccgtgcatagaaaaa

SEQ ID NO: 1049120 - DNA, 22 bp, Artificial Sequence
  chemically synthesized
tctcattgctattttttctatg

SEQ ID NO: 1049121 - DNA, 22 bp, Artificial Sequence
  chemically synthesized
tgaccgtgcatagaaaaaatag

SEQ ID NO: 1049122 - DNA, 22 bp, Artificial Sequence
  chemically synthesized
gctcttatgtgatttccccctt

SEQ ID NO: 1049123 - DNA, 22 bp, Artificial Sequence
  chemically synthesized
ctcttatgtgatttcccccttc

SEQ ID NO: 1049124 - DNA, 22 bp, Artificial Sequence
  chemically synthesized
gatgatgcaataggaaggggga

SEQ ID NO: 1049125 - DNA, 22 bp, Artificial Sequence
  chemically synthesized
agatgatgcaataggaaggggg

SEQ ID NO: 1049126 - DNA, 22 bp, Artificial Sequence
  chemically synthesized
ttatgtgatttcccccttccta

SEQ ID NO: 1049127 - DNA, 22 bp, Artificial Sequence
  chemically synthesized
tagatgatgcaataggaagggg

SEQ ID NO: 1049128 - DNA, 22 bp, Artificial Sequence
  chemically synthesized
ttagatgatgcaataggaaggg

SEQ ID NO: 1049129 - DNA, 22 bp, Artificial Sequence
  chemically synthesized
atgtgatttcccccttcctatt

SEQ ID NO: 1049130 - DNA, 22 bp, Artificial Sequence
  chemically synthesized
tttagatgatgcaataggaagg

SEQ ID NO: 1049131 - DNA, 22 bp, Artificial Sequence
  chemically synthesized
tgtgatttcccccttcctattg

SEQ ID NO: 1049132 - DNA, 22 bp, Artificial Sequence
  chemically synthesized
cccccttcctattgcatcatct

SEQ ID NO: 1049133 - DNA, 22 bp, Artificial Sequence
  chemically synthesized
ccccttcctattgcatcatcta

SEQ ID NO: 1049134 - DNA, 22 bp, Artificial Sequence
  chemically synthesized
acataagcaattttttagatga

SEQ ID NO: 1049135 - DNA, 22 bp, Artificial Sequence
  chemically synthesized
cacataagcaattttttagatg

SEQ ID NO: 1049136 - DNA, 22 bp, Artificial Sequence
  chemically synthesized
cctattgcatcatctaaaaaat

SEQ ID NO: 1049137 - DNA, 22 bp, Artificial Sequence
  chemically synthesized
ctattgcatcatctaaaaaatt

SEQ ID NO: 1049138 - DNA, 22 bp, Artificial Sequence
  chemically synthesized
ttgcatcatctaaaaaattgct

SEQ ID NO: 1049139 - DNA, 22 bp, Artificial Sequence
  chemically synthesized
catagcttcacataagcaattt

SEQ ID NO: 1049140 - DNA, 22 bp, Artificial Sequence
  chemically synthesized
catcatctaaaaaattgcttat

SEQ ID NO: 1049141 - DNA, 22 bp, Artificial Sequence
  chemically synthesized
gttacatagcttcacataagca

SEQ ID NO: 1049142 - DNA, 22 bp, Artificial Sequence
  chemically synthesized
ggttacatagcttcacataagc

SEQ ID NO: 1049143 - DNA, 22 bp, Artificial Sequence
  chemically synthesized
tggttacatagcttcacataag

SEQ ID NO: 1049144 - DNA, 22 bp, Artificial Sequence
  chemically synthesized
ttggttacatagcttcacataa

SEQ ID NO: 1049145 - DNA, 22 bp, Artificial Sequence
  chemically synthesized
tttggttacatagcttcacata

SEQ ID NO: 1049146 - DNA, 22 bp, Artificial Sequence
  chemically synthesized
ttttggttacatagcttcacat

SEQ ID NO: 1049147 - DNA, 22 bp, Artificial Sequence
  chemically synthesized
aaaaattgcttatgtgaagcta

SEQ ID NO: 1049148 - DNA, 22 bp, Artificial Sequence
  chemically synthesized
tttttggttacatagcttcaca

SEQ ID NO: 1049149 - DNA, 22 bp, Artificial Sequence
  chemically synthesized
cttatgtgaagctatgtaacca

SEQ ID NO: 1049150 - DNA, 22 bp, Artificial Sequence
  chemically synthesized
atgtgaagctatgtaaccaaaa

SEQ ID NO: 1049151 - DNA, 22 bp, Artificial Sequence
  chemically synthesized
tgtgaagctatgtaaccaaaaa

SEQ ID NO: 1049152 - DNA, 22 bp, Artificial Sequence
  chemically synthesized
agatggacaggccctttttttg

SEQ ID NO: 1049153 - DNA, 22 bp, Artificial Sequence
  chemically synthesized
tgagatggacaggccctttttt

SEQ ID NO: 1049154 - DNA, 22 bp, Artificial Sequence
  chemically synthesized
ttctgagatggacaggcccttt

SEQ ID NO: 1049155 - DNA, 22 bp, Artificial Sequence
  chemically synthesized
tgtaaccaaaaaaagggcctgt

SEQ ID NO: 1049156 - DNA, 22 bp, Artificial Sequence
  chemically synthesized
aataattattctgagatggaca

SEQ ID NO: 1049157 - DNA, 22 bp, Artificial Sequence
  chemically synthesized
tgaataattattctgagatgga

SEQ ID NO: 1049158 - DNA, 22 bp, Artificial Sequence
  chemically synthesized
attctgaataattattctgaga

SEQ ID NO: 1049159 - DNA, 22 bp, Artificial Sequence
  chemically synthesized
attgattctgaataattattct

SEQ ID NO: 1049160 - DNA, 22 bp, Artificial Sequence
  chemically synthesized
ttcattgattctgaataattat

SEQ ID NO: 1049161 - DNA, 22 bp, Artificial Sequence
  chemically synthesized
tccatctcagaataattattca

SEQ ID NO: 1049162 - DNA, 22 bp, Artificial Sequence
  chemically synthesized
agaataattattcagaatcaat

SEQ ID NO: 1049163 - DNA, 22 bp, Artificial Sequence
  chemically synthesized
aacaaagggggtaaattgttca

SEQ ID NO: 1049164 - DNA, 22 bp, Artificial Sequence
  chemically synthesized
ttcagaatcaatgaacaattta

SEQ ID NO: 1049165 - DNA, 22 bp, Artificial Sequence
  chemically synthesized
aaacaaagggggtaaattgttc

SEQ ID NO: 1049166 - DNA, 22 bp, Artificial Sequence
  chemically synthesized
taaacaaagggggtaaattgtt

SEQ ID NO: 1049167 - DNA, 22 bp, Artificial Sequence
  chemically synthesized
ttaaacaaagggggtaaattgt

SEQ ID NO: 1049168 - DNA, 22 bp, Artificial Sequence
  chemically synthesized
agaatcaatgaacaatttaccc

SEQ ID NO: 1049169 - DNA, 22 bp, Artificial Sequence
  chemically synthesized
tttaaacaaagggggtaaattg

SEQ ID NO: 1049170 - DNA, 22 bp, Artificial Sequence
  chemically synthesized
tttttaaacaaagggggtaaat

SEQ ID NO: 1049171 - DNA, 22 bp, Artificial Sequence
  chemically synthesized
ttctttttaaacaaagggggta

SEQ ID NO: 1049172 - DNA, 22 bp, Artificial Sequence
  chemically synthesized
attctttttaaacaaagggggt

SEQ ID NO: 1049173 - DNA, 22 bp, Artificial Sequence
  chemically synthesized
tattctttttaaacaaaggggg

SEQ ID NO: 1049174 - DNA, 22 bp, Artificial Sequence
  chemically synthesized
gtgagttttattctttttaaac

SEQ ID NO: 1049175 - DNA, 22 bp, Artificial Sequence
  chemically synthesized
accccctttgtttaaaaagaat

SEQ ID NO: 1049176 - DNA, 22 bp, Artificial Sequence
  chemically synthesized
ccccctttgtttaaaaagaata

SEQ ID NO: 1049177 - DNA, 22 bp, Artificial Sequence
  chemically synthesized
tgtatgttagtgagttttattc

SEQ ID NO: 1049178 - DNA, 22 bp, Artificial Sequence
  chemically synthesized
gtgtatgttagtgagttttatt

SEQ ID NO: 1049179 - DNA, 22 bp, Artificial Sequence
  chemically synthesized
tgtttaaaaagaataaaactca

SEQ ID NO: 1049180 - DNA, 22 bp, Artificial Sequence
  chemically synthesized
tgtgtatgttagtgagttttat

SEQ ID NO: 1049181 - DNA, 22 bp, Artificial Sequence
  chemically synthesized
gtttaaaaagaataaaactcac

SEQ ID NO: 1049182 - DNA, 22 bp, Artificial Sequence
  chemically synthesized
tttaaaaagaataaaactcact

SEQ ID NO: 1049183 - DNA, 22 bp, Artificial Sequence
  chemically synthesized
ttttgtgtatgttagtgagttt

SEQ ID NO: 1049184 - DNA, 22 bp, Artificial Sequence
  chemically synthesized
aaaaagaataaaactcactaac

SEQ ID NO: 1049185 - DNA, 22 bp, Artificial Sequence
  chemically synthesized
aaaagaataaaactcactaaca

SEQ ID NO: 1049186 - DNA, 22 bp, Artificial Sequence
  chemically synthesized
actattttgtgtatgttagtga

SEQ ID NO: 1049187 - DNA, 22 bp, Artificial Sequence
  chemically synthesized
gactattttgtgtatgttagtg

SEQ ID NO: 1049188 - DNA, 22 bp, Artificial Sequence
  chemically synthesized
ccttgactattttgtgtatgtt

SEQ ID NO: 1049189 - DNA, 22 bp, Artificial Sequence
  chemically synthesized
accttgactattttgtgtatgt

SEQ ID NO: 1049190 - DNA, 22 bp, Artificial Sequence
  chemically synthesized
taccttgactattttgtgtatg

SEQ ID NO: 1049191 - DNA, 22 bp, Artificial Sequence
  chemically synthesized
atattttaccttgactattttg

SEQ ID NO: 1049192 - DNA, 22 bp, Artificial Sequence
  chemically synthesized
actaacatacacaaaatagtca

SEQ ID NO: 1049193 - DNA, 22 bp, Artificial Sequence
  chemically synthesized
catattttaccttgactatttt

SEQ ID NO: 1049194 - DNA, 22 bp, Artificial Sequence
  chemically synthesized
tcatattttaccttgactattt

SEQ ID NO: 1049195 - DNA, 22 bp, Artificial Sequence
  chemically synthesized
tttcatattttaccttgactat

SEQ ID NO: 1049196 - DNA, 22 bp, Artificial Sequence
  chemically synthesized
acatacacaaaatagtcaaggt

SEQ ID NO: 1049197 - DNA, 22 bp, Artificial Sequence
  chemically synthesized
ctttcatattttaccttgacta

SEQ ID NO: 1049198 - DNA, 22 bp, Artificial Sequence
  chemically synthesized
tctttcatattttaccttgact

SEQ ID NO: 1049199 - DNA, 22 bp, Artificial Sequence
  chemically synthesized
gaaaataaataatatgggcata

SEQ ID NO: 1049200 - DNA, 22 bp, Artificial Sequence
  chemically synthesized
agaaaataaataatatgggcat

SEQ ID NO: 1049201 - DNA, 22 bp, Artificial Sequence
  chemically synthesized
tagaaaataaataatatgggca

SEQ ID NO: 1049202 - DNA, 22 bp, Artificial Sequence
  chemically synthesized
actttagaaaataaataatatg

SEQ ID NO: 1049203 - DNA, 22 bp, Artificial Sequence
  chemically synthesized
taactttagaaaataaataata

SEQ ID NO: 1049204 - DNA, 22 bp, Artificial Sequence
  chemically synthesized
tatgcccatattatttattttc

SEQ ID NO: 1049205 - DNA, 22 bp, Artificial Sequence
  chemically synthesized
attctaactttagaaaataaat

SEQ ID NO: 1049206 - DNA, 22 bp, Artificial Sequence
  chemically synthesized
atgcccatattatttattttct

SEQ ID NO: 1049207 - DNA, 22 bp, Artificial Sequence
  chemically synthesized
tgcccatattatttattttcta

SEQ ID NO: 1049208 - DNA, 22 bp, Artificial Sequence
  chemically synthesized
aaaattaattctaactttagaa

SEQ ID NO: 1049209 - DNA, 22 bp, Artificial Sequence
  chemically synthesized
aaaaattaattctaactttaga

SEQ ID NO: 1049210 - DNA, 22 bp, Artificial Sequence
  chemically synthesized
taaaaattaattctaactttag

SEQ ID NO: 1049211 - DNA, 22 bp, Artificial Sequence
  chemically synthesized
ctttaaaaattaattctaactt

SEQ ID NO: 1049212 - DNA, 22 bp, Artificial Sequence
  chemically synthesized
tttattttctaaagttagaatt

SEQ ID NO: 1049213 - DNA, 22 bp, Artificial Sequence
  chemically synthesized
attttctaaagttagaattaat

SEQ ID NO: 1049214 - DNA, 22 bp, Artificial Sequence
  chemically synthesized
ttttctaaagttagaattaatt

SEQ ID NO: 1049215 - DNA, 22 bp, Artificial Sequence
  chemically synthesized
ccctgctttaaaaattaattct

SEQ ID NO: 1049216 - DNA, 22 bp, Artificial Sequence
  chemically synthesized
tctaaagttagaattaattttt

SEQ ID NO: 1049217 - DNA, 22 bp, Artificial Sequence
  chemically synthesized
ctaaagttagaattaattttta

SEQ ID NO: 1049218 - DNA, 22 bp, Artificial Sequence
  chemically synthesized
taaagttagaattaatttttaa

SEQ ID NO: 1049219 - DNA, 22 bp, Artificial Sequence
  chemically synthesized
aagttagaattaatttttaaag

SEQ ID NO: 1049220 - DNA, 22 bp, Artificial Sequence
  chemically synthesized
acagcctgccctgctttaaaaa

SEQ ID NO: 1049221 - DNA, 22 bp, Artificial Sequence
  chemically synthesized
gctgacagcctgccctgcttta

SEQ ID NO: 1049222 - DNA, 22 bp, Artificial Sequence
  chemically synthesized
gaattaatttttaaagcagggc

SEQ ID NO: 1049223 - DNA, 22 bp, Artificial Sequence
  chemically synthesized
cgctgacagcctgccctgcttt

SEQ ID NO: 1049224 - DNA, 22 bp, Artificial Sequence
  chemically synthesized
tcgctgacagcctgccctgctt

SEQ ID NO: 1049225 - DNA, 22 bp, Artificial Sequence
  chemically synthesized
ttcgctgacagcctgccctgct

SEQ ID NO: 1049226 - DNA, 22 bp, Artificial Sequence
  chemically synthesized
tttcgctgacagcctgccctgc

SEQ ID NO: 1049227 - DNA, 22 bp, Artificial Sequence
  chemically synthesized
atttttaaagcagggcaggctg

SEQ ID NO: 1049228 - DNA, 22 bp, Artificial Sequence
  chemically synthesized
ttaaagcagggcaggctgtcag

SEQ ID NO: 1049229 - DNA, 22 bp, Artificial Sequence
  chemically synthesized
taaagcagggcaggctgtcagc

SEQ ID NO: 1049230 - DNA, 22 bp, Artificial Sequence
  chemically synthesized
catatctttttcgctgacagcc

SEQ ID NO: 1049231 - DNA, 22 bp, Artificial Sequence
  chemically synthesized
aaagcagggcaggctgtcagcg

SEQ ID NO: 1049232 - DNA, 22 bp, Artificial Sequence
  chemically synthesized
aagcagggcaggctgtcagcga

SEQ ID NO: 1049233 - DNA, 22 bp, Artificial Sequence
  chemically synthesized
tcagcgaaaaagatatgcagat

SEQ ID NO: 1049234 - DNA, 22 bp, Artificial Sequence
  chemically synthesized
gcaaatccagcatcatctgcat

SEQ ID NO: 1049235 - DNA, 22 bp, Artificial Sequence
  chemically synthesized
aagactggcaaatccagcatca

SEQ ID NO: 1049236 - DNA, 22 bp, Artificial Sequence
  chemically synthesized
aaagactggcaaatccagcatc

SEQ ID NO: 1049237 - DNA, 22 bp, Artificial Sequence
  chemically synthesized
gaagcagggtgtatttaaagac

SEQ ID NO: 1049238 - DNA, 22 bp, Artificial Sequence
  chemically synthesized
tagaagcagggtgtatttaaag

SEQ ID NO: 1049239 - DNA, 22 bp, Artificial Sequence
  chemically synthesized
gatttgccagtctttaaataca

SEQ ID NO: 1049240 - DNA, 22 bp, Artificial Sequence
  chemically synthesized
ctagaagcagggtgtatttaaa

SEQ ID NO: 1049241 - DNA, 22 bp, Artificial Sequence
  chemically synthesized
gccagtctttaaatacaccctg

SEQ ID NO: 1049242 - DNA, 22 bp, Artificial Sequence
  chemically synthesized
gccttctagaagcagggtgtat

SEQ ID NO: 1049243 - DNA, 22 bp, Artificial Sequence
  chemically synthesized
ccagtctttaaatacaccctgc

SEQ ID NO: 1049244 - DNA, 22 bp, Artificial Sequence
  chemically synthesized
tacctggccttctagaagcagg

SEQ ID NO: 1049245 - DNA, 22 bp, Artificial Sequence
  chemically synthesized
atacctggccttctagaagcag

SEQ ID NO: 1049246 - DNA, 22 bp, Artificial Sequence
  chemically synthesized
taaatacaccctgcttctagaa

SEQ ID NO: 1049247 - DNA, 22 bp, Artificial Sequence
  chemically synthesized
aaatacaccctgcttctagaag

SEQ ID NO: 1049248 - DNA, 22 bp, Artificial Sequence
  chemically synthesized
tttatacctggccttctagaag

SEQ ID NO: 1049249 - DNA, 22 bp, Artificial Sequence
  chemically synthesized
aatacaccctgcttctagaagg

SEQ ID NO: 1049250 - DNA, 22 bp, Artificial Sequence
  chemically synthesized
cttctagaaggccaggtataaa

SEQ ID NO: 1049251 - DNA, 22 bp, Artificial Sequence
  chemically synthesized
cataggacactatttatacctg

SEQ ID NO: 1049252 - DNA, 22 bp, Artificial Sequence
  chemically synthesized
acataggacactatttatacct

SEQ ID NO: 1049253 - DNA, 22 bp, Artificial Sequence
  chemically synthesized
tacataggacactatttatacc

SEQ ID NO: 1049254 - DNA, 22 bp, Artificial Sequence
  chemically synthesized
ctagaaggccaggtataaatag

SEQ ID NO: 1049255 - DNA, 22 bp, Artificial Sequence
  chemically synthesized
ttacataggacactatttatac

SEQ ID NO: 1049256 - DNA, 22 bp, Artificial Sequence
  chemically synthesized
tagaaggccaggtataaatagt

SEQ ID NO: 1049257 - DNA, 22 bp, Artificial Sequence
  chemically synthesized
gaaggccaggtataaatagtgt

SEQ ID NO: 1049258 - DNA, 22 bp, Artificial Sequence
  chemically synthesized
tccagaccttttacataggaca

SEQ ID NO: 1049259 - DNA, 22 bp, Artificial Sequence
  chemically synthesized
tgtaaaaggtctggacagacct

SEQ ID NO: 1049260 - DNA, 22 bp, Artificial Sequence
  chemically synthesized
gacagacctgctcattgacctg

SEQ ID NO: 1049261 - DNA, 22 bp, Artificial Sequence
  chemically synthesized
ctcattgacctgcctcatgtgg

SEQ ID NO: 1049262 - DNA, 22 bp, Artificial Sequence
  chemically synthesized
attgacctgcctcatgtggatt

SEQ ID NO: 1049263 - DNA, 22 bp, Artificial Sequence
  chemically synthesized
acctgcctcatgtggattctga

SEQ ID NO: 1049264 - DNA, 22 bp, Artificial Sequence
  chemically synthesized
atggtgtagaaagtcagaatcc

SEQ ID NO: 1049265 - DNA, 22 bp, Artificial Sequence
  chemically synthesized
catggtgtagaaagtcagaatc

SEQ ID NO: 1049266 - DNA, 22 bp, Artificial Sequence
  chemically synthesized
cctcatgtggattctgactttc

SEQ ID NO: 1049267 - DNA, 22 bp, Artificial Sequence
  chemically synthesized
atgtggattctgactttctaca

SEQ ID NO: 1049268 - DNA, 22 bp, Artificial Sequence
  chemically synthesized
ggtaaatttcatggtgtagaaa

SEQ ID NO: 1049269 - DNA, 22 bp, Artificial Sequence
  chemically synthesized
tgactttctacaccatgaaatt

SEQ ID NO: 1049270 - DNA, 22 bp, Artificial Sequence
  chemically synthesized
aggaattaggtaaatttcatgg

SEQ ID NO: 1049271 - DNA, 22 bp, Artificial Sequence
  chemically synthesized
actttctacaccatgaaattta

SEQ ID NO: 1049272 - DNA, 22 bp, Artificial Sequence
  chemically synthesized
tctacaccatgaaatttaccta

SEQ ID NO: 1049273 - DNA, 22 bp, Artificial Sequence
  chemically synthesized
gccctgaggaattaggtaaatt

SEQ ID NO: 1049274 - DNA, 22 bp, Artificial Sequence
  chemically synthesized
ctacaccatgaaatttacctaa

SEQ ID NO: 1049275 - DNA, 22 bp, Artificial Sequence
  chemically synthesized
ggccctgaggaattaggtaaat

SEQ ID NO: 1049276 - DNA, 22 bp, Artificial Sequence
  chemically synthesized
tacaccatgaaatttacctaat

SEQ ID NO: 1049277 - DNA, 22 bp, Artificial Sequence
  chemically synthesized
caccatgaaatttacctaattc

SEQ ID NO: 1049278 - DNA, 22 bp, Artificial Sequence
  chemically synthesized
agcttggccctgaggaattagg

SEQ ID NO: 1049279 - DNA, 22 bp, Artificial Sequence
  chemically synthesized
atagtaattgagcttggccctg

SEQ ID NO: 1049280 - DNA, 22 bp, Artificial Sequence
  chemically synthesized
acctaattcctcagggccaagc

SEQ ID NO: 1049281 - DNA, 22 bp, Artificial Sequence
  chemically synthesized
gatagtaattgagcttggccct

SEQ ID NO: 1049282 - DNA, 22 bp, Artificial Sequence
  chemically synthesized
cctaattcctcagggccaagct

SEQ ID NO: 1049283 - DNA, 22 bp, Artificial Sequence
  chemically synthesized
atttgatagtaattgagcttgg

SEQ ID NO: 1049284 - DNA, 22 bp, Artificial Sequence
  chemically synthesized
attcctcagggccaagctcaat

SEQ ID NO: 1049285 - DNA, 22 bp, Artificial Sequence
  chemically synthesized
aatttgatagtaattgagcttg

SEQ ID NO: 1049286 - DNA, 22 bp, Artificial Sequence
  chemically synthesized
ctcagggccaagctcaattact

SEQ ID NO: 1049287 - DNA, 22 bp, Artificial Sequence
  chemically synthesized
agggccaagctcaattactatc

SEQ ID NO: 1049288 - DNA, 22 bp, Artificial Sequence
  chemically synthesized
tcagcttaatttgatagtaatt

SEQ ID NO: 1049289 - DNA, 22 bp, Artificial Sequence
  chemically synthesized
atcagcttaatttgatagtaat

SEQ ID NO: 1049290 - DNA, 22 bp, Artificial Sequence
  chemically synthesized
agtttatcagcttaatttgata

SEQ ID NO: 1049291 - DNA, 22 bp, Artificial Sequence
  chemically synthesized
aattactatcaaattaagctga

SEQ ID NO: 1049292 - DNA, 22 bp, Artificial Sequence
  chemically synthesized
cagattcagtttatcagcttaa

SEQ ID NO: 1049293 - DNA, 22 bp, Artificial Sequence
  chemically synthesized
ccagattcagtttatcagctta

SEQ ID NO: 1049294 - DNA, 22 bp, Artificial Sequence
  chemically synthesized
tccagattcagtttatcagctt

SEQ ID NO: 1049295 - DNA, 22 bp, Artificial Sequence
  chemically synthesized
ctatcaaattaagctgataaac

SEQ ID NO: 1049296 - DNA, 22 bp, Artificial Sequence
  chemically synthesized
tcaaattaagctgataaactga

SEQ ID NO: 1049297 - DNA, 22 bp, Artificial Sequence
  chemically synthesized
acacattttccagattcagttt

SEQ ID NO: 1049298 - DNA, 22 bp, Artificial Sequence
  chemically synthesized
agctgataaactgaatctggaa

SEQ ID NO: 1049299 - DNA, 22 bp, Artificial Sequence
  chemically synthesized
ataaactgaatctggaaaatgt

SEQ ID NO: 1049300 - DNA, 22 bp, Artificial Sequence
  chemically synthesized
taagccattaacacattttcca

SEQ ID NO: 1049301 - DNA, 22 bp, Artificial Sequence
  chemically synthesized
aatctggaaaatgtgttaatgg

SEQ ID NO: 1049302 - DNA, 22 bp, Artificial Sequence
  chemically synthesized
aaccactataagccattaacac

SEQ ID NO: 1049303 - DNA, 22 bp, Artificial Sequence
  chemically synthesized
aaaccactataagccattaaca

SEQ ID NO: 1049304 - DNA, 22 bp, Artificial Sequence
  chemically synthesized
taaaccactataagccattaac

SEQ ID NO: 1049305 - DNA, 22 bp, Artificial Sequence
  chemically synthesized
gaaaatgtgttaatggcttata

SEQ ID NO: 1049306 - DNA, 22 bp, Artificial Sequence
  chemically synthesized
aaacgaaagactttaaaccact

SEQ ID NO: 1049307 - DNA, 22 bp, Artificial Sequence
  chemically synthesized
gaaacgaaagactttaaaccac

SEQ ID NO: 1049308 - DNA, 22 bp, Artificial Sequence
  chemically synthesized
tgaaacgaaagactttaaacca

SEQ ID NO: 1049309 - DNA, 22 bp, Artificial Sequence
  chemically synthesized
atggcttatagtggtttaaagt

SEQ ID NO: 1049310 - DNA, 22 bp, Artificial Sequence
  chemically synthesized
tcctttgaaacgaaagacttta

SEQ ID NO: 1049311 - DNA, 22 bp, Artificial Sequence
  chemically synthesized
atagtggtttaaagtctttcgt

SEQ ID NO: 1049312 - DNA, 22 bp, Artificial Sequence
  chemically synthesized
tagtggtttaaagtctttcgtt

SEQ ID NO: 1049313 - DNA, 22 bp, Artificial Sequence
  chemically synthesized
aaagtctttcgtttcaaaggac

SEQ ID NO: 1049314 - DNA, 22 bp, Artificial Sequence
  chemically synthesized
aagtctttcgtttcaaaggaca

SEQ ID NO: 1049315 - DNA, 22 bp, Artificial Sequence
  chemically synthesized
tataaaaatgcaaatgttgtcc

SEQ ID NO: 1049316 - DNA, 22 bp, Artificial Sequence
  chemically synthesized
tcgtttcaaaggacaacatttg

SEQ ID NO: 1049317 - DNA, 22 bp, Artificial Sequence
  chemically synthesized
cgtttcaaaggacaacatttgc

SEQ ID NO: 1049318 - DNA, 22 bp, Artificial Sequence
  chemically synthesized
gtttcaaaggacaacatttgca

SEQ ID NO: 1049319 - DNA, 22 bp, Artificial Sequence
  chemically synthesized
caaaggacaacatttgcatttt

SEQ ID NO: 1049320 - DNA, 22 bp, Artificial Sequence
  chemically synthesized
aaaatctgtataaaaatgcaaa

SEQ ID NO: 1049321 - DNA, 22 bp, Artificial Sequence
  chemically synthesized
aaaggacaacatttgcattttt

SEQ ID NO: 1049322 - DNA, 22 bp, Artificial Sequence
  chemically synthesized
gaaaatctgtataaaaatgcaa

SEQ ID NO: 1049323 - DNA, 22 bp, Artificial Sequence
  chemically synthesized
tgaaaatctgtataaaaatgca

SEQ ID NO: 1049324 - DNA, 22 bp, Artificial Sequence
  chemically synthesized
tttgaaaatctgtataaaaatg

SEQ ID NO: 1049325 - DNA, 22 bp, Artificial Sequence
  chemically synthesized
attctttgaaaatctgtataaa

SEQ ID NO: 1049326 - DNA, 22 bp, Artificial Sequence
  chemically synthesized
tgttaattctttgaaaatctgt

SEQ ID NO: 1049327 - DNA, 22 bp, Artificial Sequence
  chemically synthesized
atgttaattctttgaaaatctg

SEQ ID NO: 1049328 - DNA, 22 bp, Artificial Sequence
  chemically synthesized
gcatttttatacagattttcaa

SEQ ID NO: 1049329 - DNA, 22 bp, Artificial Sequence
  chemically synthesized
catttttatacagattttcaaa

SEQ ID NO: 1049330 - DNA, 22 bp, Artificial Sequence
  chemically synthesized
atttatgttaattctttgaaaa

SEQ ID NO: 1049331 - DNA, 22 bp, Artificial Sequence
  chemically synthesized
ttatacagattttcaaagaatt

SEQ ID NO: 1049332 - DNA, 22 bp, Artificial Sequence
  chemically synthesized
ctaatttatgttaattctttga

SEQ ID NO: 1049333 - DNA, 22 bp, Artificial Sequence
  chemically synthesized
tatacagattttcaaagaatta

SEQ ID NO: 1049334 - DNA, 22 bp, Artificial Sequence
  chemically synthesized
atacagattttcaaagaattaa

SEQ ID NO: 1049335 - DNA, 22 bp, Artificial Sequence
  chemically synthesized
tacagattttcaaagaattaac

SEQ ID NO: 1049336 - DNA, 22 bp, Artificial Sequence
  chemically synthesized
tcaagttactaatttatgttaa

SEQ ID NO: 1049337 - DNA, 22 bp, Artificial Sequence
  chemically synthesized
atcaagttactaatttatgtta

SEQ ID NO: 1049338 - DNA, 22 bp, Artificial Sequence
  chemically synthesized
tatcaagttactaatttatgtt

SEQ ID NO: 1049339 - DNA, 22 bp, Artificial Sequence
  chemically synthesized
tcaaagaattaacataaattag

SEQ ID NO: 1049340 - DNA, 22 bp, Artificial Sequence
  chemically synthesized
caaagaattaacataaattagt

SEQ ID NO: 1049341 - DNA, 22 bp, Artificial Sequence
  chemically synthesized
aaagaattaacataaattagta

SEQ ID NO: 1049342 - DNA, 22 bp, Artificial Sequence
  chemically synthesized
aaattttatcaagttactaatt

SEQ ID NO: 1049343 - DNA, 22 bp, Artificial Sequence
  chemically synthesized
acataaattagtaacttgataa

SEQ ID NO: 1049344 - DNA, 22 bp, Artificial Sequence
  chemically synthesized
gtgactaaaattttatcaagtt

SEQ ID NO: 1049345 - DNA, 22 bp, Artificial Sequence
  chemically synthesized
agtgactaaaattttatcaagt

SEQ ID NO: 1049346 - DNA, 22 bp, Artificial Sequence
  chemically synthesized
gtaacttgataaaattttagtc

SEQ ID NO: 1049347 - DNA, 22 bp, Artificial Sequence
  chemically synthesized
acaggccatacttagtgactaa

SEQ ID NO: 1049348 - DNA, 22 bp, Artificial Sequence
  chemically synthesized
tcacaggccatacttagtgact

SEQ ID NO: 1049349 - DNA, 22 bp, Artificial Sequence
  chemically synthesized
gataaaattttagtcactaagt

SEQ ID NO: 1049350 - DNA, 22 bp, Artificial Sequence
  chemically synthesized
ataaaattttagtcactaagta

SEQ ID NO: 1049351 - DNA, 22 bp, Artificial Sequence
  chemically synthesized
tctcacaggccatacttagtga

SEQ ID NO: 1049352 - DNA, 22 bp, Artificial Sequence
  chemically synthesized
ctctcacaggccatacttagtg

SEQ ID NO: 1049353 - DNA, 22 bp, Artificial Sequence
  chemically synthesized
ttctctcacaggccatacttag

SEQ ID NO: 1049354 - DNA, 22 bp, Artificial Sequence
  chemically synthesized
tcttctctcacaggccatactt

SEQ ID NO: 1049355 - DNA, 22 bp, Artificial Sequence
  chemically synthesized
ctcttctctcacaggccatact

SEQ ID NO: 1049356 - DNA, 22 bp, Artificial Sequence
  chemically synthesized
tctcttctctcacaggccatac

SEQ ID NO: 1049357 - DNA, 22 bp, Artificial Sequence
  chemically synthesized
tagtcactaagtatggcctgtg

SEQ ID NO: 1049358 - DNA, 22 bp, Artificial Sequence
  chemically synthesized
tttctcttctctcacaggccat

SEQ ID NO: 1049359 - DNA, 22 bp, Artificial Sequence
  chemically synthesized
agtcactaagtatggcctgtga

SEQ ID NO: 1049360 - DNA, 22 bp, Artificial Sequence
  chemically synthesized
ctttctcttctctcacaggcca

SEQ ID NO: 1049361 - DNA, 22 bp, Artificial Sequence
  chemically synthesized
gtcactaagtatggcctgtgag

SEQ ID NO: 1049362 - DNA, 22 bp, Artificial Sequence
  chemically synthesized
tctttctcttctctcacaggcc

SEQ ID NO: 1049363 - DNA, 22 bp, Artificial Sequence
  chemically synthesized
ttctttctcttctctcacaggc

SEQ ID NO: 1049364 - DNA, 22 bp, Artificial Sequence
  chemically synthesized
agtatggcctgtgagagaagag

SEQ ID NO: 1049365 - DNA, 22 bp, Artificial Sequence
  chemically synthesized
tgagagaagagaaagaaaaggg

SEQ ID NO: 1049366 - DNA, 22 bp, Artificial Sequence
  chemically synthesized
gtggcaaccaaagcccttttct

SEQ ID NO: 1049367 - DNA, 22 bp, Artificial Sequence
  chemically synthesized
ggtggcaaccaaagcccttttc

SEQ ID NO: 1049368 - DNA, 22 bp, Artificial Sequence
  chemically synthesized
tcttggtggcaaccaaagccct

SEQ ID NO: 1049369 - DNA, 22 bp, Artificial Sequence
  chemically synthesized
atcttggtggcaaccaaagccc

SEQ ID NO: 1049370 - DNA, 22 bp, Artificial Sequence
  chemically synthesized
atacttatcttggtggcaacca

SEQ ID NO: 1049371 - DNA, 22 bp, Artificial Sequence
  chemically synthesized
tgtgttgatacttatcttggtg

SEQ ID NO: 1049372 - DNA, 22 bp, Artificial Sequence
  chemically synthesized
atgtgttgatacttatcttggt

SEQ ID NO: 1049373 - DNA, 22 bp, Artificial Sequence
  chemically synthesized
cttatgtgttgatacttatctt

SEQ ID NO: 1049374 - DNA, 22 bp, Artificial Sequence
  chemically synthesized
tggttgccaccaagataagtat

SEQ ID NO: 1049375 - DNA, 22 bp, Artificial Sequence
  chemically synthesized
ggttgccaccaagataagtatc

SEQ ID NO: 1049376 - DNA, 22 bp, Artificial Sequence
  chemically synthesized
gttgccaccaagataagtatca

SEQ ID NO: 1049377 - DNA, 22 bp, Artificial Sequence
  chemically synthesized
ctgcttatgtgttgatacttat

SEQ ID NO: 1049378 - DNA, 22 bp, Artificial Sequence
  chemically synthesized
ccaccaagataagtatcaacac

SEQ ID NO: 1049379 - DNA, 22 bp, Artificial Sequence
  chemically synthesized
tatattgctgcttatgtgttga

SEQ ID NO: 1049380 - DNA, 22 bp, Artificial Sequence
  chemically synthesized
atatattgctgcttatgtgttg

SEQ ID NO: 1049381 - DNA, 22 bp, Artificial Sequence
  chemically synthesized
gtgcttatatattgctgcttat

SEQ ID NO: 1049382 - DNA, 22 bp, Artificial Sequence
  chemically synthesized
ttggtgcttatatattgctgct

SEQ ID NO: 1049383 - DNA, 22 bp, Artificial Sequence
  chemically synthesized
caaagcaggccatgattgttgg

SEQ ID NO: 1049384 - DNA, 22 bp, Artificial Sequence
  chemically synthesized
acaaagcaggccatgattgttg

SEQ ID NO: 1049385 - DNA, 22 bp, Artificial Sequence
  chemically synthesized
tacaaagcaggccatgattgtt

SEQ ID NO: 1049386 - DNA, 22 bp, Artificial Sequence
  chemically synthesized
gagatggttttacaaagcaggc

SEQ ID NO: 1049387 - DNA, 22 bp, Artificial Sequence
  chemically synthesized
ggagatggttttacaaagcagg

SEQ ID NO: 1049388 - DNA, 22 bp, Artificial Sequence
  chemically synthesized
tggagatggttttacaaagcag

SEQ ID NO: 1049389 - DNA, 22 bp, Artificial Sequence
  chemically synthesized
ttggagatggttttacaaagca

SEQ ID NO: 1049390 - DNA, 22 bp, Artificial Sequence
  chemically synthesized
tttggagatggttttacaaagc

SEQ ID NO: 1049391 - DNA, 22 bp, Artificial Sequence
  chemically synthesized
ttttttggagatggttttacaa

SEQ ID NO: 1049392 - DNA, 22 bp, Artificial Sequence
  chemically synthesized
taggttattttttggagatggt

SEQ ID NO: 1049393 - DNA, 22 bp, Artificial Sequence
  chemically synthesized
ataggttattttttggagatgg

SEQ ID NO: 1049394 - DNA, 22 bp, Artificial Sequence
  chemically synthesized
ctttgtaaaaccatctccaaaa

SEQ ID NO: 1049395 - DNA, 22 bp, Artificial Sequence
  chemically synthesized
atttataggttattttttggag

SEQ ID NO: 1049396 - DNA, 22 bp, Artificial Sequence
  chemically synthesized
tgtaaaaccatctccaaaaaat

SEQ ID NO: 1049397 - DNA, 22 bp, Artificial Sequence
  chemically synthesized
gtaaaaccatctccaaaaaata

SEQ ID NO: 1049398 - DNA, 22 bp, Artificial Sequence
  chemically synthesized
taaaaccatctccaaaaaataa

SEQ ID NO: 1049399 - DNA, 22 bp, Artificial Sequence
  chemically synthesized
ttaatttataggttattttttg

SEQ ID NO: 1049400 - DNA, 22 bp, Artificial Sequence
  chemically synthesized
tctattaatttataggttattt

SEQ ID NO: 1049401 - DNA, 22 bp, Artificial Sequence
  chemically synthesized
atctattaatttataggttatt

SEQ ID NO: 1049402 - DNA, 22 bp, Artificial Sequence
  chemically synthesized
caaaaaataacctataaattaa

SEQ ID NO: 1049403 - DNA, 22 bp, Artificial Sequence
  chemically synthesized
gggtgtataaccttatctatta

SEQ ID NO: 1049404 - DNA, 22 bp, Artificial Sequence
  chemically synthesized
gctagggtgtataaccttatct

SEQ ID NO: 1049405 - DNA, 22 bp, Artificial Sequence
  chemically synthesized
taaattaatagataaggttata

SEQ ID NO: 1049406 - DNA, 22 bp, Artificial Sequence
  chemically synthesized
taagttggctagggtgtataac

SEQ ID NO: 1049407 - DNA, 22 bp, Artificial Sequence
  chemically synthesized
ataagttggctagggtgtataa

SEQ ID NO: 1049408 - DNA, 22 bp, Artificial Sequence
  chemically synthesized
atagataaggttatacacccta

SEQ ID NO: 1049409 - DNA, 22 bp, Artificial Sequence
  chemically synthesized
ccttataagttggctagggtgt

SEQ ID NO: 1049410 - DNA, 22 bp, Artificial Sequence
  chemically synthesized
ctgccttataagttggctaggg

SEQ ID NO: 1049411 - DNA, 22 bp, Artificial Sequence
  chemically synthesized
gctgccttataagttggctagg

SEQ ID NO: 1049412 - DNA, 22 bp, Artificial Sequence
  chemically synthesized
tgctgccttataagttggctag

SEQ ID NO: 1049413 - DNA, 22 bp, Artificial Sequence
  chemically synthesized
ttgctgccttataagttggcta

SEQ ID NO: 1049414 - DNA, 22 bp, Artificial Sequence
  chemically synthesized
tttgctgccttataagttggct

SEQ ID NO: 1049415 - DNA, 22 bp, Artificial Sequence
  chemically synthesized
ttttttgctgccttataagttg

SEQ ID NO: 1049416 - DNA, 22 bp, Artificial Sequence
  chemically synthesized
tacaccctagccaacttataag

SEQ ID NO: 1049417 - DNA, 22 bp, Artificial Sequence
  chemically synthesized
attttttgctgccttataagtt

SEQ ID NO: 1049418 - DNA, 22 bp, Artificial Sequence
  chemically synthesized
catttattttttgctgccttat

SEQ ID NO: 1049419 - DNA, 22 bp, Artificial Sequence
  chemically synthesized
ctgcatttattttttgctgcct

SEQ ID NO: 1049420 - DNA, 22 bp, Artificial Sequence
  chemically synthesized
gccaacttataaggcagcaaaa

SEQ ID NO: 1049421 - DNA, 22 bp, Artificial Sequence
  chemically synthesized
gctgcatttattttttgctgcc

SEQ ID NO: 1049422 - DNA, 22 bp, Artificial Sequence
  chemically synthesized
tgctgcatttattttttgctgc

SEQ ID NO: 1049423 - DNA, 22 bp, Artificial Sequence
  chemically synthesized
ataaggcagcaaaaaataaatg

SEQ ID NO: 1049424 - DNA, 22 bp, Artificial Sequence
  chemically synthesized
taaggcagcaaaaaataaatgc

SEQ ID NO: 1049425 - DNA, 22 bp, Artificial Sequence
  chemically synthesized
ggcatgagtctttgctgcattt

SEQ ID NO: 1049426 - DNA, 22 bp, Artificial Sequence
  chemically synthesized
ggtactaggcatgagtctttgc

SEQ ID NO: 1049427 - DNA, 22 bp, Artificial Sequence
  chemically synthesized
tatgctaggtactaggcatgag

SEQ ID NO: 1049428 - DNA, 22 bp, Artificial Sequence
  chemically synthesized
ataacatactgtatgctaggta

SEQ ID NO: 1049429 - DNA, 22 bp, Artificial Sequence
  chemically synthesized
gataacatactgtatgctaggt

SEQ ID NO: 1049430 - DNA, 22 bp, Artificial Sequence
  chemically synthesized
tgataacatactgtatgctagg

SEQ ID NO: 1049431 - DNA, 22 bp, Artificial Sequence
  chemically synthesized
ttgataacatactgtatgctag

SEQ ID NO: 1049432 - DNA, 22 bp, Artificial Sequence
  chemically synthesized
atgcctagtacctagcatacag

SEQ ID NO: 1049433 - DNA, 22 bp, Artificial Sequence
  chemically synthesized
gtacctagcatacagtatgtta

SEQ ID NO: 1049434 - DNA, 22 bp, Artificial Sequence
  chemically synthesized
tccaacaaatatttttgataac

SEQ ID NO: 1049435 - DNA, 22 bp, Artificial Sequence
  chemically synthesized
gcatacagtatgttatcaaaaa

SEQ ID NO: 1049436 - DNA, 22 bp, Artificial Sequence
  chemically synthesized
atccaacaaatatttttgataa

SEQ ID NO: 1049437 - DNA, 22 bp, Artificial Sequence
  chemically synthesized
atttatccaacaaatatttttg

SEQ ID NO: 1049438 - DNA, 22 bp, Artificial Sequence
  chemically synthesized
attaatttatccaacaaatatt

SEQ ID NO: 1049439 - DNA, 22 bp, Artificial Sequence
  chemically synthesized
cattaatttatccaacaaatat

SEQ ID NO: 1049440 - DNA, 22 bp, Artificial Sequence
  chemically synthesized
tcattaatttatccaacaaata

SEQ ID NO: 1049441 - DNA, 22 bp, Artificial Sequence
  chemically synthesized
ttcattaatttatccaacaaat

SEQ ID NO: 1049442 - DNA, 22 bp, Artificial Sequence
  chemically synthesized
tttcattaatttatccaacaaa

SEQ ID NO: 1049443 - DNA, 22 bp, Artificial Sequence
  chemically synthesized
tcaaaaatatttgttggataaa

SEQ ID NO: 1049444 - DNA, 22 bp, Artificial Sequence
  chemically synthesized
ttttttcattaatttatccaac

SEQ ID NO: 1049445 - DNA, 22 bp, Artificial Sequence
  chemically synthesized
gttttttcattaatttatccaa

SEQ ID NO: 1049446 - DNA, 22 bp, Artificial Sequence
  chemically synthesized
atacttgttttttcattaattt

SEQ ID NO: 1049447 - DNA, 22 bp, Artificial Sequence
  chemically synthesized
gttggataaattaatgaaaaaa

SEQ ID NO: 1049448 - DNA, 22 bp, Artificial Sequence
  chemically synthesized
agttgatacttgttttttcatt

SEQ ID NO: 1049449 - DNA, 22 bp, Artificial Sequence
  chemically synthesized
ttggataaattaatgaaaaaac

SEQ ID NO: 1049450 - DNA, 22 bp, Artificial Sequence
  chemically synthesized
ttaagttgatacttgttttttc

SEQ ID NO: 1049451 - DNA, 22 bp, Artificial Sequence
  chemically synthesized
gataaattaatgaaaaaacaag

SEQ ID NO: 1049452 - DNA, 22 bp, Artificial Sequence
  chemically synthesized
tcctgttaagttgatacttgtt

SEQ ID NO: 1049453 - DNA, 22 bp, Artificial Sequence
  chemically synthesized
atgaaaaaacaagtatcaactt

SEQ ID NO: 1049454 - DNA, 22 bp, Artificial Sequence
  chemically synthesized
taattatcctgttaagttgata

SEQ ID NO: 1049455 - DNA, 22 bp, Artificial Sequence
  chemically synthesized
ataattatcctgttaagttgat

SEQ ID NO: 1049456 - DNA, 22 bp, Artificial Sequence
  chemically synthesized
tcttataattatcctgttaagt

SEQ ID NO: 1049457 - DNA, 22 bp, Artificial Sequence
  chemically synthesized
taaccacatatctatcttataa

SEQ ID NO: 1049458 - DNA, 22 bp, Artificial Sequence
  chemically synthesized
aacaggataattataagataga

SEQ ID NO: 1049459 - DNA, 22 bp, Artificial Sequence
  chemically synthesized
acaggataattataagatagat

SEQ ID NO: 1049460 - DNA, 22 bp, Artificial Sequence
  chemically synthesized
taagatagatatgtggttacaa

SEQ ID NO: 1049461 - DNA, 22 bp, Artificial Sequence
  chemically synthesized
taaatgtaaatcccagcaattg

SEQ ID NO: 1049462 - DNA, 22 bp, Artificial Sequence
  chemically synthesized
aatataaattataaatgtaaat

SEQ ID NO: 1049463 - DNA, 22 bp, Artificial Sequence
  chemically synthesized
caattgctgggatttacattta

SEQ ID NO: 1049464 - DNA, 22 bp, Artificial Sequence
  chemically synthesized
ctaaatataaattataaatgta

SEQ ID NO: 1049465 - DNA, 22 bp, Artificial Sequence
  chemically synthesized
ctgggatttacatttataattt

SEQ ID NO: 1049466 - DNA, 22 bp, Artificial Sequence
  chemically synthesized
ggatttacatttataatttata

SEQ ID NO: 1049467 - DNA, 22 bp, Artificial Sequence
  chemically synthesized
aatattcctaaatataaattat

SEQ ID NO: 1049468 - DNA, 22 bp, Artificial Sequence
  chemically synthesized
tgaatattcctaaatataaatt

SEQ ID NO: 1049469 - DNA, 22 bp, Artificial Sequence
  chemically synthesized
acatttataatttatatttagg

SEQ ID NO: 1049470 - DNA, 22 bp, Artificial Sequence
  chemically synthesized
catttataatttatatttagga

SEQ ID NO: 1049471 - DNA, 22 bp, Artificial Sequence
  chemically synthesized
aattctgaatattcctaaatat

SEQ ID NO: 1049472 - DNA, 22 bp, Artificial Sequence
  chemically synthesized
gaattctgaatattcctaaata

SEQ ID NO: 1049473 - DNA, 22 bp, Artificial Sequence
  chemically synthesized
tttgaattctgaatattcctaa

SEQ ID NO: 1049474 - DNA, 22 bp, Artificial Sequence
  chemically synthesized
ataatttatatttaggaatatt

SEQ ID NO: 1049475 - DNA, 22 bp, Artificial Sequence
  chemically synthesized
taatttatatttaggaatattc

SEQ ID NO: 1049476 - DNA, 22 bp, Artificial Sequence
  chemically synthesized
ctgtttgaattctgaatattcc

SEQ ID NO: 1049477 - DNA, 22 bp, Artificial Sequence
  chemically synthesized
atatttaggaatattcagaatt

SEQ ID NO: 1049478 - DNA, 22 bp, Artificial Sequence
  chemically synthesized
tatttaggaatattcagaattc

SEQ ID NO: 1049479 - DNA, 22 bp, Artificial Sequence
  chemically synthesized
aggaatattcagaattcaaaca

SEQ ID NO: 1049480 - DNA, 22 bp, Artificial Sequence
  chemically synthesized
ggaatattcagaattcaaacag

SEQ ID NO: 1049481 - DNA, 22 bp, Artificial Sequence
  chemically synthesized
taaaatgaagaaaatattcctg

SEQ ID NO: 1049482 - DNA, 22 bp, Artificial Sequence
  chemically synthesized
agaattcaaacaggaatatttt

SEQ ID NO: 1049483 - DNA, 22 bp, Artificial Sequence
  chemically synthesized
cattataaaatgaagaaaatat

SEQ ID NO: 1049484 - DNA, 22 bp, Artificial Sequence
  chemically synthesized
aaacaggaatattttcttcatt

SEQ ID NO: 1049485 - DNA, 22 bp, Artificial Sequence
  chemically synthesized
tgacaataaagattgcattata

SEQ ID NO: 1049486 - DNA, 22 bp, Artificial Sequence
  chemically synthesized
tcttcattttataatgcaatct

SEQ ID NO: 1049487 - DNA, 22 bp, Artificial Sequence
  chemically synthesized
cttcattttataatgcaatctt

SEQ ID NO: 1049488 - DNA, 22 bp, Artificial Sequence
  chemically synthesized
ttcattttataatgcaatcttt

SEQ ID NO: 1049489 - DNA, 22 bp, Artificial Sequence
  chemically synthesized
aatctatgacaataaagattgc

SEQ ID NO: 1049490 - DNA, 22 bp, Artificial Sequence
  chemically synthesized
cattttataatgcaatctttat

SEQ ID NO: 1049491 - DNA, 22 bp, Artificial Sequence
  chemically synthesized
aaatctatgacaataaagattg

SEQ ID NO: 1049492 - DNA, 22 bp, Artificial Sequence
  chemically synthesized
attttataatgcaatctttatt

SEQ ID NO: 1049493 - DNA, 22 bp, Artificial Sequence
  chemically synthesized
taaatctatgacaataaagatt

SEQ ID NO: 1049494 - DNA, 22 bp, Artificial Sequence
  chemically synthesized
ttaaatctatgacaataaagat

SEQ ID NO: 1049495 - DNA, 22 bp, Artificial Sequence
  chemically synthesized
tataatgcaatctttattgtca

SEQ ID NO: 1049496 - DNA, 22 bp, Artificial Sequence
  chemically synthesized
ataatgcaatctttattgtcat

SEQ ID NO: 1049497 - DNA, 22 bp, Artificial Sequence
  chemically synthesized
taatgcaatctttattgtcata

SEQ ID NO: 1049498 - DNA, 22 bp, Artificial Sequence
  chemically synthesized
tattgtcatagatttaaaaggt

SEQ ID NO: 1049499 - DNA, 22 bp, Artificial Sequence
  chemically synthesized
attgtcatagatttaaaaggta

SEQ ID NO: 1049500 - DNA, 22 bp, Artificial Sequence
  chemically synthesized
ttgtcatagatttaaaaggtat

SEQ ID NO: 1049501 - DNA, 22 bp, Artificial Sequence
  chemically synthesized
tcatagatttaaaaggtatatc

SEQ ID NO: 1049502 - DNA, 22 bp, Artificial Sequence
  chemically synthesized
aaaaggtatatctgatttcact

SEQ ID NO: 1049503 - DNA, 22 bp, Artificial Sequence
  chemically synthesized
aaaggtatatctgatttcacta

SEQ ID NO: 1049504 - DNA, 22 bp, Artificial Sequence
  chemically synthesized
aagaaatgcgacatagtgaaat

SEQ ID NO: 1049505 - DNA, 22 bp, Artificial Sequence
  chemically synthesized
tgaattgaagaaatgcgacata

SEQ ID NO: 1049506 - DNA, 22 bp, Artificial Sequence
  chemically synthesized
atttcactatgtcgcatttctt

SEQ ID NO: 1049507 - DNA, 22 bp, Artificial Sequence
  chemically synthesized
atgtgctatgaattgaagaaat

SEQ ID NO: 1049508 - DNA, 22 bp, Artificial Sequence
  chemically synthesized
cactatgtcgcatttcttcaat

SEQ ID NO: 1049509 - DNA, 22 bp, Artificial Sequence
  chemically synthesized
actatgtcgcatttcttcaatt

SEQ ID NO: 1049510 - DNA, 22 bp, Artificial Sequence
  chemically synthesized
tgtcgcatttcttcaattcata

SEQ ID NO: 1049511 - DNA, 22 bp, Artificial Sequence
  chemically synthesized
cttcaattcatagcacattagc

SEQ ID NO: 1049512 - DNA, 22 bp, Artificial Sequence
  chemically synthesized
ttcaattcatagcacattagct

SEQ ID NO: 1049513 - DNA, 22 bp, Artificial Sequence
  chemically synthesized
caattcatagcacattagctac

SEQ ID NO: 1049514 - DNA, 22 bp, Artificial Sequence
  chemically synthesized
aattcatagcacattagctaca

SEQ ID NO: 1049515 - DNA, 22 bp, Artificial Sequence
  chemically synthesized
atagcacattagctacatgcta

SEQ ID NO: 1049516 - DNA, 22 bp, Artificial Sequence
  chemically synthesized
agcacgcatgtacaatagcatg

SEQ ID NO: 1049517 - DNA, 22 bp, Artificial Sequence
  chemically synthesized
gctacatgctattgtacatgcg

SEQ ID NO: 1049518 - DNA, 22 bp, Artificial Sequence
  chemically synthesized
aggacctaagcacgcatgtaca

SEQ ID NO: 1049519 - DNA, 22 bp, Artificial Sequence
  chemically synthesized
aaggacctaagcacgcatgtac

SEQ ID NO: 1049520 - DNA, 22 bp, Artificial Sequence
  chemically synthesized
catgctattgtacatgcgtgct

SEQ ID NO: 1049521 - DNA, 22 bp, Artificial Sequence
  chemically synthesized
ttgtacatgcgtgcttaggtcc

SEQ ID NO: 1049522 - DNA, 22 bp, Artificial Sequence
  chemically synthesized
aaagacaatttaaggacctaag

SEQ ID NO: 1049523 - DNA, 22 bp, Artificial Sequence
  chemically synthesized
tacatgcgtgcttaggtcctta

SEQ ID NO: 1049524 - DNA, 22 bp, Artificial Sequence
  chemically synthesized
gtaactaaaagacaatttaagg

SEQ ID NO: 1049525 - DNA, 22 bp, Artificial Sequence
  chemically synthesized
aggtccttaaattgtcttttag

SEQ ID NO: 1049526 - DNA, 22 bp, Artificial Sequence
  chemically synthesized
ggtccttaaattgtcttttagt

SEQ ID NO: 1049527 - DNA, 22 bp, Artificial Sequence
  chemically synthesized
aaattgtcttttagttactaat

SEQ ID NO: 1049528 - DNA, 22 bp, Artificial Sequence
  chemically synthesized
aattgtcttttagttactaatc

SEQ ID NO: 1049529 - DNA, 22 bp, Artificial Sequence
  chemically synthesized
aagtataatgagtcagattagt

SEQ ID NO: 1049530 - DNA, 22 bp, Artificial Sequence
  chemically synthesized
tcttttagttactaatctgact

SEQ ID NO: 1049531 - DNA, 22 bp, Artificial Sequence
  chemically synthesized
tattcaagtataatgagtcaga

SEQ ID NO: 1049532 - DNA, 22 bp, Artificial Sequence
  chemically synthesized
ttagttactaatctgactcatt

SEQ ID NO: 1049533 - DNA, 22 bp, Artificial Sequence
  chemically synthesized
gtattcaagtataatgagtcag

SEQ ID NO: 1049534 - DNA, 22 bp, Artificial Sequence
  chemically synthesized
tagttactaatctgactcatta

SEQ ID NO: 1049535 - DNA, 22 bp, Artificial Sequence
  chemically synthesized
agttactaatctgactcattat

SEQ ID NO: 1049536 - DNA, 22 bp, Artificial Sequence
  chemically synthesized
gttactaatctgactcattata

SEQ ID NO: 1049537 - DNA, 22 bp, Artificial Sequence
  chemically synthesized
tgtttgtattcaagtataatga

SEQ ID NO: 1049538 - DNA, 22 bp, Artificial Sequence
  chemically synthesized
atgtttgtattcaagtataatg

SEQ ID NO: 1049539 - DNA, 22 bp, Artificial Sequence
  chemically synthesized
ctaatctgactcattatacttg

SEQ ID NO: 1049540 - DNA, 22 bp, Artificial Sequence
  chemically synthesized
cttatgtttgtattcaagtata

SEQ ID NO: 1049541 - DNA, 22 bp, Artificial Sequence
  chemically synthesized
atctgactcattatacttgaat

SEQ ID NO: 1049542 - DNA, 22 bp, Artificial Sequence
  chemically synthesized
actcattatacttgaatacaaa

SEQ ID NO: 1049543 - DNA, 22 bp, Artificial Sequence
  chemically synthesized
aaataattgcttatgtttgtat

SEQ ID NO: 1049544 - DNA, 22 bp, Artificial Sequence
  chemically synthesized
attatacttgaatacaaacata

SEQ ID NO: 1049545 - DNA, 22 bp, Artificial Sequence
  chemically synthesized
cctcaaataattgcttatgttt

SEQ ID NO: 1049546 - DNA, 22 bp, Artificial Sequence
  chemically synthesized
tacttgaatacaaacataagca

SEQ ID NO: 1049547 - DNA, 22 bp, Artificial Sequence
  chemically synthesized
gaatacaaacataagcaattat

SEQ ID NO: 1049548 - DNA, 22 bp, Artificial Sequence
  chemically synthesized
aatacaaacataagcaattatt

SEQ ID NO: 1049549 - DNA, 22 bp, Artificial Sequence
  chemically synthesized
tatgtcattacctcaaataatt

SEQ ID NO: 1049550 - DNA, 22 bp, Artificial Sequence
  chemically synthesized
atatcgtctatatgtcattacc

SEQ ID NO: 1049551 - DNA, 22 bp, Artificial Sequence
  chemically synthesized
aatatcgtctatatgtcattac

SEQ ID NO: 1049552 - DNA, 22 bp, Artificial Sequence
  chemically synthesized
tttgaggtaatgacatatagac

SEQ ID NO: 1049553 - DNA, 22 bp, Artificial Sequence
  chemically synthesized
gaggtaatgacatatagacgat

SEQ ID NO: 1049554 - DNA, 22 bp, Artificial Sequence
  chemically synthesized
aggtaatgacatatagacgata

SEQ ID NO: 1049555 - DNA, 22 bp, Artificial Sequence
  chemically synthesized
aaatcagtatatcttaatatcg

SEQ ID NO: 1049556 - DNA, 22 bp, Artificial Sequence
  chemically synthesized
agatatactgattttagcttct

SEQ ID NO: 1049557 - DNA, 22 bp, Artificial Sequence
  chemically synthesized
tgatacccatgaagaagctaaa

SEQ ID NO: 1049558 - DNA, 22 bp, Artificial Sequence
  chemically synthesized
attttagcttcttcatgggtat

SEQ ID NO: 1049559 - DNA, 22 bp, Artificial Sequence
  chemically synthesized
atagacattatgatacccatga

SEQ ID NO: 1049560 - DNA, 22 bp, Artificial Sequence
  chemically synthesized
ctaatagacattatgataccca

SEQ ID NO: 1049561 - DNA, 22 bp, Artificial Sequence
  chemically synthesized
tagcttcttcatgggtatcata

SEQ ID NO: 1049562 - DNA, 22 bp, Artificial Sequence
  chemically synthesized
gctaatagacattatgataccc

SEQ ID NO: 1049563 - DNA, 22 bp, Artificial Sequence
  chemically synthesized
agcttcttcatgggtatcataa

SEQ ID NO: 1049564 - DNA, 22 bp, Artificial Sequence
  chemically synthesized
gcttcttcatgggtatcataat

SEQ ID NO: 1049565 - DNA, 22 bp, Artificial Sequence
  chemically synthesized
aatttgctaatagacattatga

SEQ ID NO: 1049566 - DNA, 22 bp, Artificial Sequence
  chemically synthesized
cttcatgggtatcataatgtct

SEQ ID NO: 1049567 - DNA, 22 bp, Artificial Sequence
  chemically synthesized
caatttgctaatagacattatg

SEQ ID NO: 1049568 - DNA, 22 bp, Artificial Sequence
  chemically synthesized
ttcatgggtatcataatgtcta

SEQ ID NO: 1049569 - DNA, 22 bp, Artificial Sequence
  chemically synthesized
catgggtatcataatgtctatt

SEQ ID NO: 1049570 - DNA, 22 bp, Artificial Sequence
  chemically synthesized
atgggtatcataatgtctatta

SEQ ID NO: 1049571 - DNA, 22 bp, Artificial Sequence
  chemically synthesized
atacccttcaatttgctaatag

SEQ ID NO: 1049572 - DNA, 22 bp, Artificial Sequence
  chemically synthesized
tcatacccttcaatttgctaat

SEQ ID NO: 1049573 - DNA, 22 bp, Artificial Sequence
  chemically synthesized
ctcatacccttcaatttgctaa

SEQ ID NO: 1049574 - DNA, 22 bp, Artificial Sequence
  chemically synthesized
ttagcaaattgaagggtatgag

SEQ ID NO: 1049575 - DNA, 22 bp, Artificial Sequence
  chemically synthesized
aatacaagtcttctcataccct

SEQ ID NO: 1049576 - DNA, 22 bp, Artificial Sequence
  chemically synthesized
gaatacaagtcttctcataccc

SEQ ID NO: 1049577 - DNA, 22 bp, Artificial Sequence
  chemically synthesized
tgaatacaagtcttctcatacc

SEQ ID NO: 1049578 - DNA, 22 bp, Artificial Sequence
  chemically synthesized
gcaaattgaagggtatgagaag

SEQ ID NO: 1049579 - DNA, 22 bp, Artificial Sequence
  chemically synthesized
ttgaatacaagtcttctcatac

SEQ ID NO: 1049580 - DNA, 22 bp, Artificial Sequence
  chemically synthesized
tttgaatacaagtcttctcata

SEQ ID NO: 1049581 - DNA, 22 bp, Artificial Sequence
  chemically synthesized
aagggtatgagaagacttgtat

SEQ ID NO: 1049582 - DNA, 22 bp, Artificial Sequence
  chemically synthesized
aaatgattttttgaatacaagt

SEQ ID NO: 1049583 - DNA, 22 bp, Artificial Sequence
  chemically synthesized
tcaaaggttaaaatgatttttt

SEQ ID NO: 1049584 - DNA, 22 bp, Artificial Sequence
  chemically synthesized
gtattcaaaaaatcattttaac

SEQ ID NO: 1049585 - DNA, 22 bp, Artificial Sequence
  chemically synthesized
tattcaaaaaatcattttaacc

SEQ ID NO: 1049586 - DNA, 22 bp, Artificial Sequence
  chemically synthesized
ggaagagttatcaaaggttaaa

SEQ ID NO: 1049587 - DNA, 22 bp, Artificial Sequence
  chemically synthesized
gggaagagttatcaaaggttaa

SEQ ID NO: 1049588 - DNA, 22 bp, Artificial Sequence
  chemically synthesized
aaaaaatcattttaacctttga

SEQ ID NO: 1049589 - DNA, 22 bp, Artificial Sequence
  chemically synthesized
tgagaagagtttgggaagagtt

SEQ ID NO: 1049590 - DNA, 22 bp, Artificial Sequence
  chemically synthesized
taacctttgataactcttccca

SEQ ID NO: 1049591 - DNA, 22 bp, Artificial Sequence
  chemically synthesized
atgagaagagtttgggaagagt

SEQ ID NO: 1049592 - DNA, 22 bp, Artificial Sequence
  chemically synthesized
aacctttgataactcttcccaa

SEQ ID NO: 1049593 - DNA, 22 bp, Artificial Sequence
  chemically synthesized
tatgagaagagtttgggaagag

SEQ ID NO: 1049594 - DNA, 22 bp, Artificial Sequence
  chemically synthesized
acctttgataactcttcccaaa

SEQ ID NO: 1049595 - DNA, 22 bp, Artificial Sequence
  chemically synthesized
ttatgagaagagtttgggaaga

SEQ ID NO: 1049596 - DNA, 22 bp, Artificial Sequence
  chemically synthesized
tgataactcttcccaaactctt

SEQ ID NO: 1049597 - DNA, 22 bp, Artificial Sequence
  chemically synthesized
gataactcttcccaaactcttc

SEQ ID NO: 1049598 - DNA, 22 bp, Artificial Sequence
  chemically synthesized
ataactcttcccaaactcttct

SEQ ID NO: 1049599 - DNA, 22 bp, Artificial Sequence
  chemically synthesized
ttcccaaactcttctcataaaa

SEQ ID NO: 1049600 - DNA, 22 bp, Artificial Sequence
  chemically synthesized
cccaaactcttctcataaaagt

SEQ ID NO: 1049601 - DNA, 22 bp, Artificial Sequence
  chemically synthesized
ccaaactcttctcataaaagtt

SEQ ID NO: 1049602 - DNA, 22 bp, Artificial Sequence
  chemically synthesized
gatatgtaaacgaaaactttta

SEQ ID NO: 1049603 - DNA, 22 bp, Artificial Sequence
  chemically synthesized
ttctcataaaagttttcgttta

SEQ ID NO: 1049604 - DNA, 22 bp, Artificial Sequence
  chemically synthesized
ctcataaaagttttcgtttaca

SEQ ID NO: 1049605 - DNA, 22 bp, Artificial Sequence
  chemically synthesized
tcataaaagttttcgtttacat

SEQ ID NO: 1049606 - DNA, 22 bp, Artificial Sequence
  chemically synthesized
ataaaagttttcgtttacatat

SEQ ID NO: 1049607 - DNA, 22 bp, Artificial Sequence
  chemically synthesized
aaataaaaaatatatactagat

SEQ ID NO: 1049608 - DNA, 22 bp, Artificial Sequence
  chemically synthesized
aaaataaaaaatatatactaga

SEQ ID NO: 1049609 - DNA, 22 bp, Artificial Sequence
  chemically synthesized
tcgtttacatatctagtatata

SEQ ID NO: 1049610 - DNA, 22 bp, Artificial Sequence
  chemically synthesized
cgtttacatatctagtatatat

SEQ ID NO: 1049611 - DNA, 22 bp, Artificial Sequence
  chemically synthesized
gtttacatatctagtatatatt

SEQ ID NO: 1049612 - DNA, 22 bp, Artificial Sequence
  chemically synthesized
acatatctagtatatatttttt

SEQ ID NO: 1049613 - DNA, 22 bp, Artificial Sequence
  chemically synthesized
catatctagtatatatttttta

SEQ ID NO: 1049614 - DNA, 22 bp, Artificial Sequence
  chemically synthesized
gaatagcttaaaataaaaaata

SEQ ID NO: 1049615 - DNA, 22 bp, Artificial Sequence
  chemically synthesized
ggaatagcttaaaataaaaaat

SEQ ID NO: 1049616 - DNA, 22 bp, Artificial Sequence
  chemically synthesized
tggaatagcttaaaataaaaaa

SEQ ID NO: 1049617 - DNA, 22 bp, Artificial Sequence
  chemically synthesized
gtatatattttttattttaagc

SEQ ID NO: 1049618 - DNA, 22 bp, Artificial Sequence
  chemically synthesized
aaattttggaatagcttaaaat

SEQ ID NO: 1049619 - DNA, 22 bp, Artificial Sequence
  chemically synthesized
ccaagctgaaattttggaatag

SEQ ID NO: 1049620 - DNA, 22 bp, Artificial Sequence
  chemically synthesized
tttattttaagctattccaaaa

SEQ ID NO: 1049621 - DNA, 22 bp, Artificial Sequence
  chemically synthesized
ttattttaagctattccaaaat

SEQ ID NO: 1049622 - DNA, 22 bp, Artificial Sequence
  chemically synthesized
tattttaagctattccaaaatt

SEQ ID NO: 1049623 - DNA, 22 bp, Artificial Sequence
  chemically synthesized
attttaagctattccaaaattt

SEQ ID NO: 1049624 - DNA, 22 bp, Artificial Sequence
  chemically synthesized
ttttaagctattccaaaatttc

SEQ ID NO: 1049625 - DNA, 22 bp, Artificial Sequence
  chemically synthesized
taagctattccaaaatttcagc

SEQ ID NO: 1049626 - DNA, 22 bp, Artificial Sequence
  chemically synthesized
aagctattccaaaatttcagct

SEQ ID NO: 1049627 - DNA, 22 bp, Artificial Sequence
  chemically synthesized
agctattccaaaatttcagctt

SEQ ID NO: 1049628 - DNA, 22 bp, Artificial Sequence
  chemically synthesized
tagcaagtattcccaagctgaa

SEQ ID NO: 1049629 - DNA, 22 bp, Artificial Sequence
  chemically synthesized
ttccaaaatttcagcttgggaa

SEQ ID NO: 1049630 - DNA, 22 bp, Artificial Sequence
  chemically synthesized
ctatagcaagtattcccaagct

SEQ ID NO: 1049631 - DNA, 22 bp, Artificial Sequence
  chemically synthesized
caaaatttcagcttgggaatac

SEQ ID NO: 1049632 - DNA, 22 bp, Artificial Sequence
  chemically synthesized
cagcttgggaatacttgctata

SEQ ID NO: 1049633 - DNA, 22 bp, Artificial Sequence
  chemically synthesized
agcttgggaatacttgctatag

SEQ ID NO: 1049634 - DNA, 22 bp, Artificial Sequence
  chemically synthesized
gggaatacttgctatagcaatc

SEQ ID NO: 1049635 - DNA, 22 bp, Artificial Sequence
  chemically synthesized
ggaatacttgctatagcaatct

SEQ ID NO: 1049636 - DNA, 22 bp, Artificial Sequence
  chemically synthesized
tcaacatacaaaaagattgcta

SEQ ID NO: 1049637 - DNA, 22 bp, Artificial Sequence
  chemically synthesized
gtcaacatacaaaaagattgct

SEQ ID NO: 1049638 - DNA, 22 bp, Artificial Sequence
  chemically synthesized
cttgtcaacatacaaaaagatt

SEQ ID NO: 1049639 - DNA, 22 bp, Artificial Sequence
  chemically synthesized
gcttgtcaacatacaaaaagat

SEQ ID NO: 1049640 - DNA, 22 bp, Artificial Sequence
  chemically synthesized
gctatagcaatctttttgtatg

SEQ ID NO: 1049641 - DNA, 22 bp, Artificial Sequence
  chemically synthesized
ctatagcaatctttttgtatgt

SEQ ID NO: 1049642 - DNA, 22 bp, Artificial Sequence
  chemically synthesized
gatttgcttgtcaacatacaaa

SEQ ID NO: 1049643 - DNA, 22 bp, Artificial Sequence
  chemically synthesized
tagcaatctttttgtatgttga

SEQ ID NO: 1049644 - DNA, 22 bp, Artificial Sequence
  chemically synthesized
tttgtatgttgacaagcaaatc

SEQ ID NO: 1049645 - DNA, 22 bp, Artificial Sequence
  chemically synthesized
ttgtatgttgacaagcaaatcg

SEQ ID NO: 1049646 - DNA, 22 bp, Artificial Sequence
  chemically synthesized
tgtatgttgacaagcaaatcga

SEQ ID NO: 1049647 - DNA, 22 bp, Artificial Sequence
  chemically synthesized
gtatgttgacaagcaaatcgaa

SEQ ID NO: 1049648 - DNA, 22 bp, Artificial Sequence
  chemically synthesized
tatgttgacaagcaaatcgaac

SEQ ID NO: 1049649 - DNA, 22 bp, Artificial Sequence
  chemically synthesized
acaagcaaatcgaaccctccct

SEQ ID NO: 1049650 - DNA, 22 bp, Artificial Sequence
  chemically synthesized
agtataagtatgtgtgtgaggt

SEQ ID NO: 1049651 - DNA, 22 bp, Artificial Sequence
  chemically synthesized
aattaagtataagtatgtgtgt

SEQ ID NO: 1049652 - DNA, 22 bp, Artificial Sequence
  chemically synthesized
cctccacctcacacacatactt

SEQ ID NO: 1049653 - DNA, 22 bp, Artificial Sequence
  chemically synthesized
cacctcacacacatacttatac

SEQ ID NO: 1049654 - DNA, 22 bp, Artificial Sequence
  chemically synthesized
acactgaattaagtataagtat

SEQ ID NO: 1049655 - DNA, 22 bp, Artificial Sequence
  chemically synthesized
cacactgaattaagtataagta

SEQ ID NO: 1049656 - DNA, 22 bp, Artificial Sequence
  chemically synthesized
tcacactgaattaagtataagt

SEQ ID NO: 1049657 - DNA, 22 bp, Artificial Sequence
  chemically synthesized
ttttcacactgaattaagtata

SEQ ID NO: 1049658 - DNA, 22 bp, Artificial Sequence
  chemically synthesized
acacacatacttatacttaatt

SEQ ID NO: 1049659 - DNA, 22 bp, Artificial Sequence
  chemically synthesized
attttcacactgaattaagtat

SEQ ID NO: 1049660 - DNA, 22 bp, Artificial Sequence
  chemically synthesized
tattttcacactgaattaagta

SEQ ID NO: 1049661 - DNA, 22 bp, Artificial Sequence
  chemically synthesized
ttattttcacactgaattaagt

SEQ ID NO: 1049662 - DNA, 22 bp, Artificial Sequence
  chemically synthesized
cttttattttcacactgaatta

SEQ ID NO: 1049663 - DNA, 22 bp, Artificial Sequence
  chemically synthesized
tgttacttttattttcacactg

SEQ ID NO: 1049664 - DNA, 22 bp, Artificial Sequence
  chemically synthesized
gtgttacttttattttcacact

SEQ ID NO: 1049665 - DNA, 22 bp, Artificial Sequence
  chemically synthesized
atacttaattcagtgtgaaaat

SEQ ID NO: 1049666 - DNA, 22 bp, Artificial Sequence
  chemically synthesized
tacttaattcagtgtgaaaata

SEQ ID NO: 1049667 - DNA, 22 bp, Artificial Sequence
  chemically synthesized
ttgtgttacttttattttcaca

SEQ ID NO: 1049668 - DNA, 22 bp, Artificial Sequence
  chemically synthesized
cttgtgttacttttattttcac

SEQ ID NO: 1049669 - DNA, 22 bp, Artificial Sequence
  chemically synthesized
tcttgtgttacttttattttca

SEQ ID NO: 1049670 - DNA, 22 bp, Artificial Sequence
  chemically synthesized
ttcttgtgttacttttattttc

SEQ ID NO: 1049671 - DNA, 22 bp, Artificial Sequence
  chemically synthesized
tttcttgtgttacttttatttt

SEQ ID NO: 1049672 - DNA, 22 bp, Artificial Sequence
  chemically synthesized
aattcagtgtgaaaataaaagt

SEQ ID NO: 1049673 - DNA, 22 bp, Artificial Sequence
  chemically synthesized
attcagtgtgaaaataaaagta

SEQ ID NO: 1049674 - DNA, 22 bp, Artificial Sequence
  chemically synthesized
ttttttcttgtgttacttttat

SEQ ID NO: 1049675 - DNA, 22 bp, Artificial Sequence
  chemically synthesized
attttttcttgtgttactttta

SEQ ID NO: 1049676 - DNA, 22 bp, Artificial Sequence
  chemically synthesized
agtgtgaaaataaaagtaacac

SEQ ID NO: 1049677 - DNA, 22 bp, Artificial Sequence
  chemically synthesized
catacttattttttcttgtgtt

SEQ ID NO: 1049678 - DNA, 22 bp, Artificial Sequence
  chemically synthesized
ccatacttattttttcttgtgt

SEQ ID NO: 1049679 - DNA, 22 bp, Artificial Sequence
  chemically synthesized
tccatacttattttttcttgtg

SEQ ID NO: 1049680 - DNA, 22 bp, Artificial Sequence
  chemically synthesized
aggtctttccatacttattttt

SEQ ID NO: 1049681 - DNA, 22 bp, Artificial Sequence
  chemically synthesized
aaggtctttccatacttatttt

SEQ ID NO: 1049682 - DNA, 22 bp, Artificial Sequence
  chemically synthesized
cagtatttaaggtctttccata

SEQ ID NO: 1049683 - DNA, 22 bp, Artificial Sequence
  chemically synthesized
aaatactgcagttatatttcac

SEQ ID NO: 1049684 - DNA, 22 bp, Artificial Sequence
  chemically synthesized
aatactgcagttatatttcacc

SEQ ID NO: 1049685 - DNA, 22 bp, Artificial Sequence
  chemically synthesized
aaagcgatataggagggtgaaa

SEQ ID NO: 1049686 - DNA, 22 bp, Artificial Sequence
  chemically synthesized
cagttatatttcaccctcctat

SEQ ID NO: 1049687 - DNA, 22 bp, Artificial Sequence
  chemically synthesized
tatttcaccctcctatatcgct

SEQ ID NO: 1049688 - DNA, 22 bp, Artificial Sequence
  chemically synthesized
caccctcctatatcgcttttaa

SEQ ID NO: 1049689 - DNA, 22 bp, Artificial Sequence
  chemically synthesized
accctcctatatcgcttttaac

SEQ ID NO: 1049690 - DNA, 22 bp, Artificial Sequence
  chemically synthesized
ctatatcgcttttaacttctgt

SEQ ID NO: 1049691 - DNA, 22 bp, Artificial Sequence
  chemically synthesized
tatcgcttttaacttctgttgc

SEQ ID NO: 1049692 - DNA, 22 bp, Artificial Sequence
  chemically synthesized
acagatccacaaggcaacagaa

SEQ ID NO: 1049693 - DNA, 22 bp, Artificial Sequence
  chemically synthesized
aagttgacagatccacaaggca

SEQ ID NO: 1049694 - DNA, 22 bp, Artificial Sequence
  chemically synthesized
ttaacttctgttgccttgtgga

SEQ ID NO: 1049695 - DNA, 22 bp, Artificial Sequence
  chemically synthesized
taacttctgttgccttgtggat

SEQ ID NO: 1049696 - DNA, 22 bp, Artificial Sequence
  chemically synthesized
aacttctgttgccttgtggatc

SEQ ID NO: 1049697 - DNA, 22 bp, Artificial Sequence
  chemically synthesized
ctcaagttgacagatccacaag

SEQ ID NO: 1049698 - DNA, 22 bp, Artificial Sequence
  chemically synthesized
acttctgttgccttgtggatct

SEQ ID NO: 1049699 - DNA, 22 bp, Artificial Sequence
  chemically synthesized
ctgttgccttgtggatctgtca

SEQ ID NO: 1049700 - DNA, 22 bp, Artificial Sequence
  chemically synthesized
tgttgccttgtggatctgtcaa

SEQ ID NO: 1049701 - DNA, 22 bp, Artificial Sequence
  chemically synthesized
ttgccttgtggatctgtcaact

SEQ ID NO: 1049702 - DNA, 22 bp, Artificial Sequence
  chemically synthesized
aaaaatctactcaagttgacag

SEQ ID NO: 1049703 - DNA, 22 bp, Artificial Sequence
  chemically synthesized
ccttgtggatctgtcaacttga

SEQ ID NO: 1049704 - DNA, 22 bp, Artificial Sequence
  chemically synthesized
tgaaaaatctactcaagttgac

SEQ ID NO: 1049705 - DNA, 22 bp, Artificial Sequence
  chemically synthesized
ttctgaaaaatctactcaagtt

SEQ ID NO: 1049706 - DNA, 22 bp, Artificial Sequence
  chemically synthesized
gtggatctgtcaacttgagtag

SEQ ID NO: 1049707 - DNA, 22 bp, Artificial Sequence
  chemically synthesized
attctgaaaaatctactcaagt

SEQ ID NO: 1049708 - DNA, 22 bp, Artificial Sequence
  chemically synthesized
tggatctgtcaacttgagtaga

SEQ ID NO: 1049709 - DNA, 22 bp, Artificial Sequence
  chemically synthesized
tcaacttgagtagatttttcag

SEQ ID NO: 1049710 - DNA, 22 bp, Artificial Sequence
  chemically synthesized
gagtagatttttcagaataaac

SEQ ID NO: 1049711 - DNA, 22 bp, Artificial Sequence
  chemically synthesized
agtagatttttcagaataaact

SEQ ID NO: 1049712 - DNA, 22 bp, Artificial Sequence
  chemically synthesized
ttcagaataaactcacactttt

SEQ ID NO: 1049713 - DNA, 22 bp, Artificial Sequence
  chemically synthesized
tcagaataaactcacactttta

SEQ ID NO: 1049714 - DNA, 22 bp, Artificial Sequence
  chemically synthesized
cagaataaactcacacttttat

SEQ ID NO: 1049715 - DNA, 22 bp, Artificial Sequence
  chemically synthesized
agaataaactcacacttttatt

SEQ ID NO: 1049716 - DNA, 22 bp, Artificial Sequence
  chemically synthesized
acacttttatttctatattaca

SEQ ID NO: 1049717 - DNA, 22 bp, Artificial Sequence
  chemically synthesized
aggggtgtgacaaatgtaatat

SEQ ID NO: 1049718 - DNA, 22 bp, Artificial Sequence
  chemically synthesized
tgaggggtgtgacaaatgtaat

SEQ ID NO: 1049719 - DNA, 22 bp, Artificial Sequence
  chemically synthesized
ctgaggggtgtgacaaatgtaa

SEQ ID NO: 1049720 - DNA, 22 bp, Artificial Sequence
  chemically synthesized
ttatttctatattacatttgtc

SEQ ID NO: 1049721 - DNA, 22 bp, Artificial Sequence
  chemically synthesized
tctgaggggtgtgacaaatgta

SEQ ID NO: 1049722 - DNA, 22 bp, Artificial Sequence
  chemically synthesized
tatttctatattacatttgtca

SEQ ID NO: 1049723 - DNA, 22 bp, Artificial Sequence
  chemically synthesized
atttctatattacatttgtcac

SEQ ID NO: 1049724 - DNA, 22 bp, Artificial Sequence
  chemically synthesized
tttctatattacatttgtcaca

SEQ ID NO: 1049725 - DNA, 22 bp, Artificial Sequence
  chemically synthesized
ctatattacatttgtcacaccc

SEQ ID NO: 1049726 - DNA, 22 bp, Artificial Sequence
  chemically synthesized
tatattacatttgtcacacccc

SEQ ID NO: 1049727 - DNA, 22 bp, Artificial Sequence
  chemically synthesized
tattacatttgtcacacccctc

SEQ ID NO: 1049728 - DNA, 22 bp, Artificial Sequence
  chemically synthesized
catttgtcacacccctcagaaa

SEQ ID NO: 1049729 - DNA, 22 bp, Artificial Sequence
  chemically synthesized
gagatagtgtccacattttctg

SEQ ID NO: 1049730 - DNA, 22 bp, Artificial Sequence
  chemically synthesized
gtcacacccctcagaaaatgtg

SEQ ID NO: 1049731 - DNA, 22 bp, Artificial Sequence
  chemically synthesized
tcacacccctcagaaaatgtgg

SEQ ID NO: 1049732 - DNA, 22 bp, Artificial Sequence
  chemically synthesized
atctagagatagtgtccacatt

SEQ ID NO: 1049733 - DNA, 22 bp, Artificial Sequence
  chemically synthesized
agaaaatgtggacactatctct

SEQ ID NO: 1049734 - DNA, 22 bp, Artificial Sequence
  chemically synthesized
ccgcattaatctagagatagtg

SEQ ID NO: 1049735 - DNA, 22 bp, Artificial Sequence
  chemically synthesized
agttgccgcattaatctagaga

SEQ ID NO: 1049736 - DNA, 22 bp, Artificial Sequence
  chemically synthesized
tctctagattaatgcggcaact

SEQ ID NO: 1049737 - DNA, 22 bp, Artificial Sequence
  chemically synthesized
gacatagatactgagttgccgc

SEQ ID NO: 1049738 - DNA, 22 bp, Artificial Sequence
  chemically synthesized
agacatagatactgagttgccg

SEQ ID NO: 1049739 - DNA, 22 bp, Artificial Sequence
  chemically synthesized
tagattaatgcggcaactcagt

SEQ ID NO: 1049740 - DNA, 22 bp, Artificial Sequence
  chemically synthesized
gattaatgcggcaactcagtat

SEQ ID NO: 1049741 - DNA, 22 bp, Artificial Sequence
  chemically synthesized
atgcggcaactcagtatctatg

SEQ ID NO: 1049742 - DNA, 22 bp, Artificial Sequence
  chemically synthesized
tgacacatgcatatttagacat

SEQ ID NO: 1049743 - DNA, 22 bp, Artificial Sequence
  chemically synthesized
agtatctatgtctaaatatgca

SEQ ID NO: 1049744 - DNA, 22 bp, Artificial Sequence
  chemically synthesized
tgtctaaatatgcatgtgtcat

SEQ ID NO: 1049745 - DNA, 22 bp, Artificial Sequence
  chemically synthesized
aaaaacataattatgacacatg

SEQ ID NO: 1049746 - DNA, 22 bp, Artificial Sequence
  chemically synthesized
gaaaaacataattatgacacat

SEQ ID NO: 1049747 - DNA, 22 bp, Artificial Sequence
  chemically synthesized
cttgaaaaacataattatgaca

SEQ ID NO: 1049748 - DNA, 22 bp, Artificial Sequence
  chemically synthesized
ccttgaaaaacataattatgac

SEQ ID NO: 1049749 - DNA, 22 bp, Artificial Sequence
  chemically synthesized
aatatgcatgtgtcataattat

SEQ ID NO: 1049750 - DNA, 22 bp, Artificial Sequence
  chemically synthesized
atgaagagaatacttccttgaa

SEQ ID NO: 1049751 - DNA, 22 bp, Artificial Sequence
  chemically synthesized
taatgaagagaatacttccttg

SEQ ID NO: 1049752 - DNA, 22 bp, Artificial Sequence
  chemically synthesized
ctaatgaagagaatacttcctt

SEQ ID NO: 1049753 - DNA, 22 bp, Artificial Sequence
  chemically synthesized
tgtttttcaaggaagtattctc

SEQ ID NO: 1049754 - DNA, 22 bp, Artificial Sequence
  chemically synthesized
gcatttctaatgaagagaatac

SEQ ID NO: 1049755 - DNA, 22 bp, Artificial Sequence
  chemically synthesized
ttcaaggaagtattctcttcat

SEQ ID NO: 1049756 - DNA, 22 bp, Artificial Sequence
  chemically synthesized
tcaaggaagtattctcttcatt

SEQ ID NO: 1049757 - DNA, 22 bp, Artificial Sequence
  chemically synthesized
caaggaagtattctcttcatta

SEQ ID NO: 1049758 - DNA, 22 bp, Artificial Sequence
  chemically synthesized
aaggaagtattctcttcattag

SEQ ID NO: 1049759 - DNA, 22 bp, Artificial Sequence
  chemically synthesized
tcactcgcatttctaatgaaga

SEQ ID NO: 1049760 - DNA, 22 bp, Artificial Sequence
  chemically synthesized
ctatcactcgcatttctaatga

SEQ ID NO: 1049761 - DNA, 22 bp, Artificial Sequence
  chemically synthesized
actatcactcgcatttctaatg

SEQ ID NO: 1049762 - DNA, 22 bp, Artificial Sequence
  chemically synthesized
tactatcactcgcatttctaat

SEQ ID NO: 1049763 - DNA, 22 bp, Artificial Sequence
  chemically synthesized
tcttcattagaaatgcgagtga

SEQ ID NO: 1049764 - DNA, 22 bp, Artificial Sequence
  chemically synthesized
ttcattagaaatgcgagtgata

SEQ ID NO: 1049765 - DNA, 22 bp, Artificial Sequence
  chemically synthesized
tatgcatctttactatcactcg

SEQ ID NO: 1049766 - DNA, 22 bp, Artificial Sequence
  chemically synthesized
cattagaaatgcgagtgatagt

SEQ ID NO: 1049767 - DNA, 22 bp, Artificial Sequence
  chemically synthesized
attagaaatgcgagtgatagta

SEQ ID NO: 1049768 - DNA, 22 bp, Artificial Sequence
  chemically synthesized
gaaatgcgagtgatagtaaaga

SEQ ID NO: 1049769 - DNA, 22 bp, Artificial Sequence
  chemically synthesized
ccatacgggatagtgtaattat

SEQ ID NO: 1049770 - DNA, 22 bp, Artificial Sequence
  chemically synthesized
atgactaccatacgggatagtg

SEQ ID NO: 1049771 - DNA, 22 bp, Artificial Sequence
  chemically synthesized
cactatcccgtatggtagtcat

SEQ ID NO: 1049772 - DNA, 22 bp, Artificial Sequence
  chemically synthesized
gtcaagtgtagctaatgactac

SEQ ID NO: 1049773 - DNA, 22 bp, Artificial Sequence
  chemically synthesized
cgtcaagtgtagctaatgacta

SEQ ID NO: 1049774 - DNA, 22 bp, Artificial Sequence
  chemically synthesized
tcgtcaagtgtagctaatgact

SEQ ID NO: 1049775 - DNA, 22 bp, Artificial Sequence
  chemically synthesized
tcccgtatggtagtcattagct

SEQ ID NO: 1049776 - DNA, 22 bp, Artificial Sequence
  chemically synthesized
tttcgtcaagtgtagctaatga

SEQ ID NO: 1049777 - DNA, 22 bp, Artificial Sequence
  chemically synthesized
ctttcgtcaagtgtagctaatg

SEQ ID NO: 1049778 - DNA, 22 bp, Artificial Sequence
  chemically synthesized
catttctttcgtcaagtgtagc

SEQ ID NO: 1049779 - DNA, 22 bp, Artificial Sequence
  chemically synthesized
acatttctttcgtcaagtgtag

SEQ ID NO: 1049780 - DNA, 22 bp, Artificial Sequence
  chemically synthesized
gatttacatttctttcgtcaag

SEQ ID NO: 1049781 - DNA, 22 bp, Artificial Sequence
  chemically synthesized
agatttacatttctttcgtcaa

SEQ ID NO: 1049782 - DNA, 22 bp, Artificial Sequence
  chemically synthesized
gctacacttgacgaaagaaatg

SEQ ID NO: 1049783 - DNA, 22 bp, Artificial Sequence
  chemically synthesized
aataatttagatttacatttct

SEQ ID NO: 1049784 - DNA, 22 bp, Artificial Sequence
  chemically synthesized
cacttgacgaaagaaatgtaaa

SEQ ID NO: 1049785 - DNA, 22 bp, Artificial Sequence
  chemically synthesized
aaataatttagatttacatttc

SEQ ID NO: 1049786 - DNA, 22 bp, Artificial Sequence
  chemically synthesized
taaataatttagatttacattt

SEQ ID NO: 1049787 - DNA, 22 bp, Artificial Sequence
  chemically synthesized
ttaaataatttagatttacatt

SEQ ID NO: 1049788 - DNA, 22 bp, Artificial Sequence
  chemically synthesized
gacgaaagaaatgtaaatctaa

SEQ ID NO: 1049789 - DNA, 22 bp, Artificial Sequence
  chemically synthesized
cttttaaataatttagatttac

SEQ ID NO: 1049790 - DNA, 22 bp, Artificial Sequence
  chemically synthesized
acgaaagaaatgtaaatctaaa

SEQ ID NO: 1049791 - DNA, 22 bp, Artificial Sequence
  chemically synthesized
gcttttaaataatttagattta

SEQ ID NO: 1049792 - DNA, 22 bp, Artificial Sequence
  chemically synthesized
tatttgcttttaaataatttag

SEQ ID NO: 1049793 - DNA, 22 bp, Artificial Sequence
  chemically synthesized
attgtatttgcttttaaataat

SEQ ID NO: 1049794 - DNA, 22 bp, Artificial Sequence
  chemically synthesized
aattgtatttgcttttaaataa

SEQ ID NO: 1049795 - DNA, 22 bp, Artificial Sequence
  chemically synthesized
taattgtatttgcttttaaata

SEQ ID NO: 1049796 - DNA, 22 bp, Artificial Sequence
  chemically synthesized
ttaattgtatttgcttttaaat

SEQ ID NO: 1049797 - DNA, 22 bp, Artificial Sequence
  chemically synthesized
agtttttaattgtatttgcttt

SEQ ID NO: 1049798 - DNA, 22 bp, Artificial Sequence
  chemically synthesized
aattatttaaaagcaaatacaa

SEQ ID NO: 1049799 - DNA, 22 bp, Artificial Sequence
  chemically synthesized
tttaaaagcaaatacaattaaa

SEQ ID NO: 1049800 - DNA, 22 bp, Artificial Sequence
  chemically synthesized
aaaagcaaatacaattaaaaac

SEQ ID NO: 1049801 - DNA, 22 bp, Artificial Sequence
  chemically synthesized
aaagcaaatacaattaaaaact

SEQ ID NO: 1049802 - DNA, 22 bp, Artificial Sequence
  chemically synthesized
gtaaaaacagatgtactaagtt

SEQ ID NO: 1049803 - DNA, 22 bp, Artificial Sequence
  chemically synthesized
aaaacttagtacatctgttttt

SEQ ID NO: 1049804 - DNA, 22 bp, Artificial Sequence
  chemically synthesized
aaacatggctagtaaaaacaga

SEQ ID NO: 1049805 - DNA, 22 bp, Artificial Sequence
  chemically synthesized
aaaacatggctagtaaaaacag

SEQ ID NO: 1049806 - DNA, 22 bp, Artificial Sequence
  chemically synthesized
agtacatctgtttttactagcc

SEQ ID NO: 1049807 - DNA, 22 bp, Artificial Sequence
  chemically synthesized
gtacatctgtttttactagcca

SEQ ID NO: 1049808 - DNA, 22 bp, Artificial Sequence
  chemically synthesized
agaacttaaaacatggctagta

SEQ ID NO: 1049809 - DNA, 22 bp, Artificial Sequence
  chemically synthesized
ctgagaacttaaaacatggcta

SEQ ID NO: 1049810 - DNA, 22 bp, Artificial Sequence
  chemically synthesized
tttttactagccatgttttaag

SEQ ID NO: 1049811 - DNA, 22 bp, Artificial Sequence
  chemically synthesized
aggctactgagaacttaaaaca

SEQ ID NO: 1049812 - DNA, 22 bp, Artificial Sequence
  chemically synthesized
ttactagccatgttttaagttc

SEQ ID NO: 1049813 - DNA, 22 bp, Artificial Sequence
  chemically synthesized
tactagccatgttttaagttct

SEQ ID NO: 1049814 - DNA, 22 bp, Artificial Sequence
  chemically synthesized
ttgaggctactgagaacttaaa

SEQ ID NO: 1049815 - DNA, 22 bp, Artificial Sequence
  chemically synthesized
actagccatgttttaagttctc

SEQ ID NO: 1049816 - DNA, 22 bp, Artificial Sequence
  chemically synthesized
ctagccatgttttaagttctca

SEQ ID NO: 1049817 - DNA, 22 bp, Artificial Sequence
  chemically synthesized
gccatgttttaagttctcagta

SEQ ID NO: 1049818 - DNA, 22 bp, Artificial Sequence
  chemically synthesized
taagttctcagtagcctcaata

SEQ ID NO: 1049819 - DNA, 22 bp, Artificial Sequence
  chemically synthesized
aagttctcagtagcctcaatag

SEQ ID NO: 1049820 - DNA, 22 bp, Artificial Sequence
  chemically synthesized
agttctcagtagcctcaatagc

SEQ ID NO: 1049821 - DNA, 22 bp, Artificial Sequence
  chemically synthesized
tccaataaagtagctattgagg

SEQ ID NO: 1049822 - DNA, 22 bp, Artificial Sequence
  chemically synthesized
tcagtagcctcaatagctactt

SEQ ID NO: 1049823 - DNA, 22 bp, Artificial Sequence
  chemically synthesized
cactgtccaataaagtagctat

SEQ ID NO: 1049824 - DNA, 22 bp, Artificial Sequence
  chemically synthesized
agtagcctcaatagctacttta

SEQ ID NO: 1049825 - DNA, 22 bp, Artificial Sequence
  chemically synthesized
tatctacactgtccaataaagt

SEQ ID NO: 1049826 - DNA, 22 bp, Artificial Sequence
  chemically synthesized
tatatctacactgtccaataaa

SEQ ID NO: 1049827 - DNA, 22 bp, Artificial Sequence
  chemically synthesized
aatagctactttattggacagt

SEQ ID NO: 1049828 - DNA, 22 bp, Artificial Sequence
  chemically synthesized
ctttattggacagtgtagatat

SEQ ID NO: 1049829 - DNA, 22 bp, Artificial Sequence
  chemically synthesized
tattggacagtgtagatataga

SEQ ID NO: 1049830 - DNA, 22 bp, Artificial Sequence
  chemically synthesized
attggacagtgtagatatagaa

SEQ ID NO: 1049831 - DNA, 22 bp, Artificial Sequence
  chemically synthesized
ttggacagtgtagatatagaac

SEQ ID NO: 1049832 - DNA, 22 bp, Artificial Sequence
  chemically synthesized
agatgatggcaatgttctatat

SEQ ID NO: 1049833 - DNA, 22 bp, Artificial Sequence
  chemically synthesized
gacagtgtagatatagaacatt

SEQ ID NO: 1049834 - DNA, 22 bp, Artificial Sequence
  chemically synthesized
tgagatgatggcaatgttctat

SEQ ID NO: 1049835 - DNA, 22 bp, Artificial Sequence
  chemically synthesized
ctgagatgatggcaatgttcta

SEQ ID NO: 1049836 - DNA, 22 bp, Artificial Sequence
  chemically synthesized
tctgagatgatggcaatgttct

SEQ ID NO: 1049837 - DNA, 22 bp, Artificial Sequence
  chemically synthesized
tagaactttctgagatgatggc

SEQ ID NO: 1049838 - DNA, 22 bp, Artificial Sequence
  chemically synthesized
tcctatagaactttctgagatg

SEQ ID NO: 1049839 - DNA, 22 bp, Artificial Sequence
  chemically synthesized
gcactgtcctatagaactttct

SEQ ID NO: 1049840 - DNA, 22 bp, Artificial Sequence
  chemically synthesized
ccatcatctcagaaagttctat

SEQ ID NO: 1049841 - DNA, 22 bp, Artificial Sequence
  chemically synthesized
gattagcactgtcctatagaac

SEQ ID NO: 1049842 - DNA, 22 bp, Artificial Sequence
  chemically synthesized
tagattagcactgtcctataga

SEQ ID NO: 1049843 - DNA, 22 bp, Artificial Sequence
  chemically synthesized
tctagattagcactgtcctata

SEQ ID NO: 1049844 - DNA, 22 bp, Artificial Sequence
  chemically synthesized
agaaagttctataggacagtgc

SEQ ID NO: 1049845 - DNA, 22 bp, Artificial Sequence
  chemically synthesized
tcattctctagattagcactgt

SEQ ID NO: 1049846 - DNA, 22 bp, Artificial Sequence
  chemically synthesized
tataggacagtgctaatctaga

SEQ ID NO: 1049847 - DNA, 22 bp, Artificial Sequence
  chemically synthesized
taggacagtgctaatctagaga

SEQ ID NO: 1049848 - DNA, 22 bp, Artificial Sequence
  chemically synthesized
taaataaaatgtattgtcattc

SEQ ID NO: 1049849 - DNA, 22 bp, Artificial Sequence
  chemically synthesized
tataaataaaatgtattgtcat

SEQ ID NO: 1049850 - DNA, 22 bp, Artificial Sequence
  chemically synthesized
ctataaataaaatgtattgtca

SEQ ID NO: 1049851 - DNA, 22 bp, Artificial Sequence
  chemically synthesized
tctataaataaaatgtattgtc

SEQ ID NO: 1049852 - DNA, 22 bp, Artificial Sequence
  chemically synthesized
atctagagaatgacaatacatt

SEQ ID NO: 1049853 - DNA, 22 bp, Artificial Sequence
  chemically synthesized
ttctataaataaaatgtattgt

SEQ ID NO: 1049854 - DNA, 22 bp, Artificial Sequence
  chemically synthesized
gagaatgacaatacattttatt

SEQ ID NO: 1049855 - DNA, 22 bp, Artificial Sequence
  chemically synthesized
accttttctataaataaaatgt

SEQ ID NO: 1049856 - DNA, 22 bp, Artificial Sequence
  chemically synthesized
gtattaaccttttctataaata

SEQ ID NO: 1049857 - DNA, 22 bp, Artificial Sequence
  chemically synthesized
ggtattaaccttttctataaat

SEQ ID NO: 1049858 - DNA, 22 bp, Artificial Sequence
  chemically synthesized
tggtattaaccttttctataaa

SEQ ID NO: 1049859 - DNA, 22 bp, Artificial Sequence
  chemically synthesized
tatttatagaaaaggttaatac

SEQ ID NO: 1049860 - DNA, 22 bp, Artificial Sequence
  chemically synthesized
atttatagaaaaggttaatacc

SEQ ID NO: 1049861 - DNA, 22 bp, Artificial Sequence
  chemically synthesized
tttatagaaaaggttaatacca

SEQ ID NO: 1049862 - DNA, 22 bp, Artificial Sequence
  chemically synthesized
cagaacatactttggtattaac

SEQ ID NO: 1049863 - DNA, 22 bp, Artificial Sequence
  chemically synthesized
atagaaaaggttaataccaaag

SEQ ID NO: 1049864 - DNA, 22 bp, Artificial Sequence
  chemically synthesized
tagaaaaggttaataccaaagt

SEQ ID NO: 1049865 - DNA, 22 bp, Artificial Sequence
  chemically synthesized
ataccaaagtatgttctgtaat

SEQ ID NO: 1049866 - DNA, 22 bp, Artificial Sequence
  chemically synthesized
agtagaataaaaaacgattaca

SEQ ID NO: 1049867 - DNA, 22 bp, Artificial Sequence
  chemically synthesized
gacagagactgagtagaataaa

SEQ ID NO: 1049868 - DNA, 22 bp, Artificial Sequence
  chemically synthesized
tgtaatcgttttttattctact

SEQ ID NO: 1049869 - DNA, 22 bp, Artificial Sequence
  chemically synthesized
ggacagagactgagtagaataa

SEQ ID NO: 1049870 - DNA, 22 bp, Artificial Sequence
  chemically synthesized
tggacagagactgagtagaata

SEQ ID NO: 1049871 - DNA, 22 bp, Artificial Sequence
  chemically synthesized
taatcgttttttattctactca

SEQ ID NO: 1049872 - DNA, 22 bp, Artificial Sequence
  chemically synthesized
tttattctactcagtctctgtc

SEQ ID NO: 1049873 - DNA, 22 bp, Artificial Sequence
  chemically synthesized
gacagccctttggacagagact

SEQ ID NO: 1049874 - DNA, 22 bp, Artificial Sequence
  chemically synthesized
ttattctactcagtctctgtcc

SEQ ID NO: 1049875 - DNA, 22 bp, Artificial Sequence
  chemically synthesized
tattctactcagtctctgtcca

SEQ ID NO: 1049876 - DNA, 22 bp, Artificial Sequence
  chemically synthesized
attctactcagtctctgtccaa

SEQ ID NO: 1049877 - DNA, 22 bp, Artificial Sequence
  chemically synthesized
ttctactcagtctctgtccaaa

SEQ ID NO: 1049878 - DNA, 22 bp, Artificial Sequence
  chemically synthesized
tactcagtctctgtccaaaggg

SEQ ID NO: 1049879 - DNA, 22 bp, Artificial Sequence
  chemically synthesized
agtactagacagccctttggac

SEQ ID NO: 1049880 - DNA, 22 bp, Artificial Sequence
  chemically synthesized
ctcagtctctgtccaaagggct

SEQ ID NO: 1049881 - DNA, 22 bp, Artificial Sequence
  chemically synthesized
agtctctgtccaaagggctgtc

SEQ ID NO: 1049882 - DNA, 22 bp, Artificial Sequence
  chemically synthesized
accacattaagtactagacagc

SEQ ID NO: 1049883 - DNA, 22 bp, Artificial Sequence
  chemically synthesized
aaccacattaagtactagacag

SEQ ID NO: 1049884 - DNA, 22 bp, Artificial Sequence
  chemically synthesized
tgtccaaagggctgtctagtac

SEQ ID NO: 1049885 - DNA, 22 bp, Artificial Sequence
  chemically synthesized
taaccacattaagtactagaca

SEQ ID NO: 1049886 - DNA, 22 bp, Artificial Sequence
  chemically synthesized
tccaaagggctgtctagtactt

SEQ ID NO: 1049887 - DNA, 22 bp, Artificial Sequence
  chemically synthesized
ggtaactttaaccacattaagt

SEQ ID NO: 1049888 - DNA, 22 bp, Artificial Sequence
  chemically synthesized
attaggtaactttaaccacatt

SEQ ID NO: 1049889 - DNA, 22 bp, Artificial Sequence
  chemically synthesized
tctagtacttaatgtggttaaa

SEQ ID NO: 1049890 - DNA, 22 bp, Artificial Sequence
  chemically synthesized
gtacttaatgtggttaaagtta

SEQ ID NO: 1049891 - DNA, 22 bp, Artificial Sequence
  chemically synthesized
agtgctcattaggtaactttaa

SEQ ID NO: 1049892 - DNA, 22 bp, Artificial Sequence
  chemically synthesized
attgagtgctcattaggtaact

SEQ ID NO: 1049893 - DNA, 22 bp, Artificial Sequence
  chemically synthesized
aatgtggttaaagttacctaat

SEQ ID NO: 1049894 - DNA, 22 bp, Artificial Sequence
  chemically synthesized
atgtggttaaagttacctaatg

SEQ ID NO: 1049895 - DNA, 22 bp, Artificial Sequence
  chemically synthesized
aagttacctaatgagcactcaa

SEQ ID NO: 1049896 - DNA, 22 bp, Artificial Sequence
  chemically synthesized
taaaagaatattaattgagtgc

SEQ ID NO: 1049897 - DNA, 22 bp, Artificial Sequence
  chemically synthesized
cctaatgagcactcaattaata

SEQ ID NO: 1049898 - DNA, 22 bp, Artificial Sequence
  chemically synthesized
ccattataaaagaatattaatt

SEQ ID NO: 1049899 - DNA, 22 bp, Artificial Sequence
  chemically synthesized
atgagcactcaattaatattct

SEQ ID NO: 1049900 - DNA, 22 bp, Artificial Sequence
  chemically synthesized
tatgattgccattataaaagaa

SEQ ID NO: 1049901 - DNA, 22 bp, Artificial Sequence
  chemically synthesized
gtatgattgccattataaaaga

SEQ ID NO: 1049902 - DNA, 22 bp, Artificial Sequence
  chemically synthesized
ttgtatgattgccattataaaa

SEQ ID NO: 1049903 - DNA, 22 bp, Artificial Sequence
  chemically synthesized
aattaatattcttttataatgg

SEQ ID NO: 1049904 - DNA, 22 bp, Artificial Sequence
  chemically synthesized
cttgtatgattgccattataaa

SEQ ID NO: 1049905 - DNA, 22 bp, Artificial Sequence
  chemically synthesized
tcttgtatgattgccattataa

SEQ ID NO: 1049906 - DNA, 22 bp, Artificial Sequence
  chemically synthesized
tttcttgtatgattgccattat

SEQ ID NO: 1049907 - DNA, 22 bp, Artificial Sequence
  chemically synthesized
ctttcttgtatgattgccatta

SEQ ID NO: 1049908 - DNA, 22 bp, Artificial Sequence
  chemically synthesized
atattcttttataatggcaatc

SEQ ID NO: 1049909 - DNA, 22 bp, Artificial Sequence
  chemically synthesized
tctttcttgtatgattgccatt

SEQ ID NO: 1049910 - DNA, 22 bp, Artificial Sequence
  chemically synthesized
ttttataatggcaatcatacaa

SEQ ID NO: 1049911 - DNA, 22 bp, Artificial Sequence
  chemically synthesized
ttataatggcaatcatacaaga

SEQ ID NO: 1049912 - DNA, 22 bp, Artificial Sequence
  chemically synthesized
tataatggcaatcatacaagaa

SEQ ID NO: 1049913 - DNA, 22 bp, Artificial Sequence
  chemically synthesized
ataatggcaatcatacaagaaa

SEQ ID NO: 1049914 - DNA, 22 bp, Artificial Sequence
  chemically synthesized
taatggcaatcatacaagaaag

SEQ ID NO: 1049915 - DNA, 22 bp, Artificial Sequence
  chemically synthesized
aaaaagaaacaaatctttcttt

SEQ ID NO: 1049916 - DNA, 22 bp, Artificial Sequence
  chemically synthesized
gaaaaagaaacaaatctttctt

SEQ ID NO: 1049917 - DNA, 22 bp, Artificial Sequence
  chemically synthesized
ataagcaatttgaaaaagaaac

SEQ ID NO: 1049918 - DNA, 22 bp, Artificial Sequence
  chemically synthesized
aataagcaatttgaaaaagaaa

SEQ ID NO: 1049919 - DNA, 22 bp, Artificial Sequence
  chemically synthesized
taataagcaatttgaaaaagaa

SEQ ID NO: 1049920 - DNA, 22 bp, Artificial Sequence
  chemically synthesized
tattttaataagcaatttgaaa

SEQ ID NO: 1049921 - DNA, 22 bp, Artificial Sequence
  chemically synthesized
ttatattttaataagcaatttg

SEQ ID NO: 1049922 - DNA, 22 bp, Artificial Sequence
  chemically synthesized
gtttctttttcaaattgcttat

SEQ ID NO: 1049923 - DNA, 22 bp, Artificial Sequence
  chemically synthesized
tttctttttcaaattgcttatt

SEQ ID NO: 1049924 - DNA, 22 bp, Artificial Sequence
  chemically synthesized
ctttttcaaattgcttattaaa

SEQ ID NO: 1049925 - DNA, 22 bp, Artificial Sequence
  chemically synthesized
tttttcaaattgcttattaaaa

SEQ ID NO: 1049926 - DNA, 22 bp, Artificial Sequence
  chemically synthesized
tttcaaattgcttattaaaata

SEQ ID NO: 1049927 - DNA, 22 bp, Artificial Sequence
  chemically synthesized
ttcaaattgcttattaaaatat

SEQ ID NO: 1049928 - DNA, 22 bp, Artificial Sequence
  chemically synthesized
tcaaattgcttattaaaatata

SEQ ID NO: 1049929 - DNA, 22 bp, Artificial Sequence
  chemically synthesized
caaattgcttattaaaatataa

SEQ ID NO: 1049930 - DNA, 22 bp, Artificial Sequence
  chemically synthesized
aaattgcttattaaaatataac

SEQ ID NO: 1049931 - DNA, 22 bp, Artificial Sequence
  chemically synthesized
aaatagaacacattgttatatt

SEQ ID NO: 1049932 - DNA, 22 bp, Artificial Sequence
  chemically synthesized
aaaatagaacacattgttatat

SEQ ID NO: 1049933 - DNA, 22 bp, Artificial Sequence
  chemically synthesized
cttattaaaatataacaatgtg

SEQ ID NO: 1049934 - DNA, 22 bp, Artificial Sequence
  chemically synthesized
tttaaaatagaacacattgtta

SEQ ID NO: 1049935 - DNA, 22 bp, Artificial Sequence
  chemically synthesized
attaaaatataacaatgtgttc

SEQ ID NO: 1049936 - DNA, 22 bp, Artificial Sequence
  chemically synthesized
ttaaaatataacaatgtgttct

SEQ ID NO: 1049937 - DNA, 22 bp, Artificial Sequence
  chemically synthesized
acattatttaaaatagaacaca

SEQ ID NO: 1049938 - DNA, 22 bp, Artificial Sequence
  chemically synthesized
aaatataacaatgtgttctatt

SEQ ID NO: 1049939 - DNA, 22 bp, Artificial Sequence
  chemically synthesized
cacattatttaaaatagaacac

SEQ ID NO: 1049940 - DNA, 22 bp, Artificial Sequence
  chemically synthesized
tcacattatttaaaatagaaca

SEQ ID NO: 1049941 - DNA, 22 bp, Artificial Sequence
  chemically synthesized
gttttcacattatttaaaatag

SEQ ID NO: 1049942 - DNA, 22 bp, Artificial Sequence
  chemically synthesized
agttttcacattatttaaaata

SEQ ID NO: 1049943 - DNA, 22 bp, Artificial Sequence
  chemically synthesized
atataatcttagttttcacatt

SEQ ID NO: 1049944 - DNA, 22 bp, Artificial Sequence
  chemically synthesized
tattttaaataatgtgaaaact

SEQ ID NO: 1049945 - DNA, 22 bp, Artificial Sequence
  chemically synthesized
ttcatataatcttagttttcac

SEQ ID NO: 1049946 - DNA, 22 bp, Artificial Sequence
  chemically synthesized
ttttaaataatgtgaaaactaa

SEQ ID NO: 1049947 - DNA, 22 bp, Artificial Sequence
  chemically synthesized
taaataatgtgaaaactaagat

SEQ ID NO: 1049948 - DNA, 22 bp, Artificial Sequence
  chemically synthesized
aaataatgtgaaaactaagatt

SEQ ID NO: 1049949 - DNA, 22 bp, Artificial Sequence
  chemically synthesized
aataatgtgaaaactaagatta

SEQ ID NO: 1049950 - DNA, 22 bp, Artificial Sequence
  chemically synthesized
gaattattcatataatcttagt

SEQ ID NO: 1049951 - DNA, 22 bp, Artificial Sequence
  chemically synthesized
agattatatgaataattctaat

SEQ ID NO: 1049952 - DNA, 22 bp, Artificial Sequence
  chemically synthesized
atagatataataccagcattag

SEQ ID NO: 1049953 - DNA, 22 bp, Artificial Sequence
  chemically synthesized
tatgaataattctaatgctggt

SEQ ID NO: 1049954 - DNA, 22 bp, Artificial Sequence
  chemically synthesized
tgatagatataataccagcatt

SEQ ID NO: 1049955 - DNA, 22 bp, Artificial Sequence
  chemically synthesized
ctgatagatataataccagcat

SEQ ID NO: 1049956 - DNA, 22 bp, Artificial Sequence
  chemically synthesized
tctgatagatataataccagca

SEQ ID NO: 1049957 - DNA, 22 bp, Artificial Sequence
  chemically synthesized
taatgctggtattatatctatc

SEQ ID NO: 1049958 - DNA, 22 bp, Artificial Sequence
  chemically synthesized
caagtattttctgatagatata

SEQ ID NO: 1049959 - DNA, 22 bp, Artificial Sequence
  chemically synthesized
atgctggtattatatctatcag

SEQ ID NO: 1049960 - DNA, 22 bp, Artificial Sequence
  chemically synthesized
ggctacaagtattttctgatag

SEQ ID NO: 1049961 - DNA, 22 bp, Artificial Sequence
  chemically synthesized
gtattatatctatcagaaaata

SEQ ID NO: 1049962 - DNA, 22 bp, Artificial Sequence
  chemically synthesized
tatctatcagaaaatacttgta

SEQ ID NO: 1049963 - DNA, 22 bp, Artificial Sequence
  chemically synthesized
tgaaaaaactaggctacaagta

SEQ ID NO: 1049964 - DNA, 22 bp, Artificial Sequence
  chemically synthesized
gtgaaaaaactaggctacaagt

SEQ ID NO: 1049965 - DNA, 22 bp, Artificial Sequence
  chemically synthesized
tgtgaaaaaactaggctacaag

SEQ ID NO: 1049966 - DNA, 22 bp, Artificial Sequence
  chemically synthesized
tcagaaaatacttgtagcctag

SEQ ID NO: 1049967 - DNA, 22 bp, Artificial Sequence
  chemically synthesized
cctttgtgaaaaaactaggcta

SEQ ID NO: 1049968 - DNA, 22 bp, Artificial Sequence
  chemically synthesized
aattacctttgtgaaaaaacta

SEQ ID NO: 1049969 - DNA, 22 bp, Artificial Sequence
  chemically synthesized
tctaaattacctttgtgaaaaa

SEQ ID NO: 1049970 - DNA, 22 bp, Artificial Sequence
  chemically synthesized
gtagcctagttttttcacaaag

SEQ ID NO: 1049971 - DNA, 22 bp, Artificial Sequence
  chemically synthesized
tagcctagttttttcacaaagg

SEQ ID NO: 1049972 - DNA, 22 bp, Artificial Sequence
  chemically synthesized
gtagcctgtctaaattaccttt

SEQ ID NO: 1049973 - DNA, 22 bp, Artificial Sequence
  chemically synthesized
agtagcctgtctaaattacctt

SEQ ID NO: 1049974 - DNA, 22 bp, Artificial Sequence
  chemically synthesized
gttttttcacaaaggtaattta

SEQ ID NO: 1049975 - DNA, 22 bp, Artificial Sequence
  chemically synthesized
tttcacaaaggtaatttagaca

SEQ ID NO: 1049976 - DNA, 22 bp, Artificial Sequence
  chemically synthesized
gatttagtagcctgtctaaatt

SEQ ID NO: 1049977 - DNA, 22 bp, Artificial Sequence
  chemically synthesized
ttcacaaaggtaatttagacag

SEQ ID NO: 1049978 - DNA, 22 bp, Artificial Sequence
  chemically synthesized
ggatttagtagcctgtctaaat

SEQ ID NO: 1049979 - DNA, 22 bp, Artificial Sequence
  chemically synthesized
tcacaaaggtaatttagacagg

SEQ ID NO: 1049980 - DNA, 22 bp, Artificial Sequence
  chemically synthesized
cacaaaggtaatttagacaggc

SEQ ID NO: 1049981 - DNA, 22 bp, Artificial Sequence
  chemically synthesized
acaaaggtaatttagacaggct

SEQ ID NO: 1049982 - DNA, 22 bp, Artificial Sequence
  chemically synthesized
gtttggatttagtagcctgtct

SEQ ID NO: 1049983 - DNA, 22 bp, Artificial Sequence
  chemically synthesized
agtttggatttagtagcctgtc

SEQ ID NO: 1049984 - DNA, 22 bp, Artificial Sequence
  chemically synthesized
tagtttggatttagtagcctgt

SEQ ID NO: 1049985 - DNA, 22 bp, Artificial Sequence
  chemically synthesized
tgacattttagtttggatttag

SEQ ID NO: 1049986 - DNA, 22 bp, Artificial Sequence
  chemically synthesized
gtgacattttagtttggattta

SEQ ID NO: 1049987 - DNA, 22 bp, Artificial Sequence
  chemically synthesized
agacaggctactaaatccaaac

SEQ ID NO: 1049988 - DNA, 22 bp, Artificial Sequence
  chemically synthesized
gacaggctactaaatccaaact

SEQ ID NO: 1049989 - DNA, 22 bp, Artificial Sequence
  chemically synthesized
accttgtgacattttagtttgg

SEQ ID NO: 1049990 - DNA, 22 bp, Artificial Sequence
  chemically synthesized
caccttgtgacattttagtttg

SEQ ID NO: 1049991 - DNA, 22 bp, Artificial Sequence
  chemically synthesized
tcaccttgtgacattttagttt

SEQ ID NO: 1049992 - DNA, 22 bp, Artificial Sequence
  chemically synthesized
ctaaatccaaactaaaatgtca

SEQ ID NO: 1049993 - DNA, 22 bp, Artificial Sequence
  chemically synthesized
agttttcaccttgtgacatttt

SEQ ID NO: 1049994 - DNA, 22 bp, Artificial Sequence
  chemically synthesized
aatccaaactaaaatgtcacaa

SEQ ID NO: 1049995 - DNA, 22 bp, Artificial Sequence
  chemically synthesized
gttgagttttcaccttgtgaca

SEQ ID NO: 1049996 - DNA, 22 bp, Artificial Sequence
  chemically synthesized
aaatgtcacaaggtgaaaactc

SEQ ID NO: 1049997 - DNA, 22 bp, Artificial Sequence
  chemically synthesized
gatatagaataataacaaatta

SEQ ID NO: 1049998 - DNA, 22 bp, Artificial Sequence
  chemically synthesized
aactaatttgttattattctat

SEQ ID NO: 1049999 - DNA, 22 bp, Artificial Sequence
  chemically synthesized
atttgttattattctatatcca

SEQ ID NO: 1050000 - DNA, 22 bp, Artificial Sequence
  chemically synthesized
agtaaaatcaattggatataga

SEQ ID NO: 1050001 - DNA, 22 bp, Artificial Sequence
  chemically synthesized
gttattattctatatccaattg

SEQ ID NO: 1050002 - DNA, 22 bp, Artificial Sequence
  chemically synthesized
ttattattctatatccaattga

SEQ ID NO: 1050003 - DNA, 22 bp, Artificial Sequence
  chemically synthesized
gcaattcagtaaaatcaattgg

SEQ ID NO: 1050004 - DNA, 22 bp, Artificial Sequence
  chemically synthesized
ttattctatatccaattgattt

SEQ ID NO: 1050005 - DNA, 22 bp, Artificial Sequence
  chemically synthesized
ttctatatccaattgattttac

SEQ ID NO: 1050006 - DNA, 22 bp, Artificial Sequence
  chemically synthesized
tatatccaattgattttactga

SEQ ID NO: 1050007 - DNA, 22 bp, Artificial Sequence
  chemically synthesized
tatccaattgattttactgaat

SEQ ID NO: 1050008 - DNA, 22 bp, Artificial Sequence
  chemically synthesized
attttactgaattgctaataca

SEQ ID NO: 1050009 - DNA, 22 bp, Artificial Sequence
  chemically synthesized
aaaacaaaatacagtgtattag

SEQ ID NO: 1050010 - DNA, 22 bp, Artificial Sequence
  chemically synthesized
tactgaattgctaatacactgt

SEQ ID NO: 1050011 - DNA, 22 bp, Artificial Sequence
  chemically synthesized
actgaattgctaatacactgta

SEQ ID NO: 1050012 - DNA, 22 bp, Artificial Sequence
  chemically synthesized
ctgaattgctaatacactgtat

SEQ ID NO: 1050013 - DNA, 22 bp, Artificial Sequence
  chemically synthesized
cctgaaaacaaaatacagtgta

SEQ ID NO: 1050014 - DNA, 22 bp, Artificial Sequence
  chemically synthesized
aattgctaatacactgtatttt

SEQ ID NO: 1050015 - DNA, 22 bp, Artificial Sequence
  chemically synthesized
tgtctacctgaaaacaaaatac

SEQ ID NO: 1050016 - DNA, 22 bp, Artificial Sequence
  chemically synthesized
ctaatacactgtattttgtttt

SEQ ID NO: 1050017 - DNA, 22 bp, Artificial Sequence
  chemically synthesized
atacactgtattttgttttcag

SEQ ID NO: 1050018 - DNA, 22 bp, Artificial Sequence
  chemically synthesized
ggctgtgtctacctgaaaacaa

SEQ ID NO: 1050019 - DNA, 22 bp, Artificial Sequence
  chemically synthesized
aggctgtgtctacctgaaaaca

SEQ ID NO: 1050020 - DNA, 22 bp, Artificial Sequence
  chemically synthesized
tattttgttttcaggtagacac

SEQ ID NO: 1050021 - DNA, 22 bp, Artificial Sequence
  chemically synthesized
cagatttaggctgtgtctacct

SEQ ID NO: 1050022 - DNA, 22 bp, Artificial Sequence
  chemically synthesized
acagatttaggctgtgtctacc

SEQ ID NO: 1050023 - DNA, 22 bp, Artificial Sequence
  chemically synthesized
cttacagatttaggctgtgtct

SEQ ID NO: 1050024 - DNA, 22 bp, Artificial Sequence
  chemically synthesized
tgttttcaggtagacacagcct

SEQ ID NO: 1050025 - DNA, 22 bp, Artificial Sequence
  chemically synthesized
gttttcaggtagacacagccta

SEQ ID NO: 1050026 - DNA, 22 bp, Artificial Sequence
  chemically synthesized
ttttcaggtagacacagcctaa

SEQ ID NO: 1050027 - DNA, 22 bp, Artificial Sequence
  chemically synthesized
tcaggtagacacagcctaaatc

SEQ ID NO: 1050028 - DNA, 22 bp, Artificial Sequence
  chemically synthesized
caggtagacacagcctaaatct

SEQ ID NO: 1050029 - DNA, 22 bp, Artificial Sequence
  chemically synthesized
aggtagacacagcctaaatctg

SEQ ID NO: 1050030 - DNA, 22 bp, Artificial Sequence
  chemically synthesized
agtgagattacttacagattta

SEQ ID NO: 1050031 - DNA, 22 bp, Artificial Sequence
  chemically synthesized
agagttgagtgagattacttac

SEQ ID NO: 1050032 - DNA, 22 bp, Artificial Sequence
  chemically synthesized
cagagttgagtgagattactta

SEQ ID NO: 1050033 - DNA, 22 bp, Artificial Sequence
  chemically synthesized
tcttcagagttgagtgagatta

SEQ ID NO: 1050034 - DNA, 22 bp, Artificial Sequence
  chemically synthesized
aatctgtaagtaatctcactca

SEQ ID NO: 1050035 - DNA, 22 bp, Artificial Sequence
  chemically synthesized
attatcttcagagttgagtgag

SEQ ID NO: 1050036 - DNA, 22 bp, Artificial Sequence
  chemically synthesized
taagtaatctcactcaactctg

SEQ ID NO: 1050037 - DNA, 22 bp, Artificial Sequence
  chemically synthesized
aattaattatcttcagagttga

SEQ ID NO: 1050038 - DNA, 22 bp, Artificial Sequence
  chemically synthesized
aaattaattatcttcagagttg

SEQ ID NO: 1050039 - DNA, 22 bp, Artificial Sequence
  chemically synthesized
taaattaattatcttcagagtt

SEQ ID NO: 1050040 - DNA, 22 bp, Artificial Sequence
  chemically synthesized
ttaaattaattatcttcagagt

SEQ ID NO: 1050041 - DNA, 22 bp, Artificial Sequence
  chemically synthesized
actcaactctgaagataattaa

SEQ ID NO: 1050042 - DNA, 22 bp, Artificial Sequence
  chemically synthesized
aactctgaagataattaattta

SEQ ID NO: 1050043 - DNA, 22 bp, Artificial Sequence
  chemically synthesized
acaataataggtttttaaatta

SEQ ID NO: 1050044 - DNA, 22 bp, Artificial Sequence
  chemically synthesized
tgaagataattaatttaaaaac

SEQ ID NO: 1050045 - DNA, 22 bp, Artificial Sequence
  chemically synthesized
aagataattaatttaaaaacct

SEQ ID NO: 1050046 - DNA, 22 bp, Artificial Sequence
  chemically synthesized
tgtataattcacaataataggt

SEQ ID NO: 1050047 - DNA, 22 bp, Artificial Sequence
  chemically synthesized
atttaaaaacctattattgtga

SEQ ID NO: 1050048 - DNA, 22 bp, Artificial Sequence
  chemically synthesized
aaaaacctattattgtgaatta

SEQ ID NO: 1050049 - DNA, 22 bp, Artificial Sequence
  chemically synthesized
aaaacctattattgtgaattat

SEQ ID NO: 1050050 - DNA, 22 bp, Artificial Sequence
  chemically synthesized
ttattgtgaattatacataatt

SEQ ID NO: 1050051 - DNA, 22 bp, Artificial Sequence
  chemically synthesized
ttgtgaattatacataatttgc

SEQ ID NO: 1050052 - DNA, 22 bp, Artificial Sequence
  chemically synthesized
accatataaataatgcaaatta

SEQ ID NO: 1050053 - DNA, 22 bp, Artificial Sequence
  chemically synthesized
tgaattatacataatttgcatt

SEQ ID NO: 1050054 - DNA, 22 bp, Artificial Sequence
  chemically synthesized
gaccatataaataatgcaaatt

SEQ ID NO: 1050055 - DNA, 22 bp, Artificial Sequence
  chemically synthesized
tgaccatataaataatgcaaat

SEQ ID NO: 1050056 - DNA, 22 bp, Artificial Sequence
  chemically synthesized
tacataatttgcattatttata

SEQ ID NO: 1050057 - DNA, 22 bp, Artificial Sequence
  chemically synthesized
ataagctttgaccatataaata

SEQ ID NO: 1050058 - DNA, 22 bp, Artificial Sequence
  chemically synthesized
gcattatttatatggtcaaagc

SEQ ID NO: 1050059 - DNA, 22 bp, Artificial Sequence
  chemically synthesized
cattatttatatggtcaaagct

SEQ ID NO: 1050060 - DNA, 22 bp, Artificial Sequence
  chemically synthesized
tttatatggtcaaagcttatta

SEQ ID NO: 1050061 - DNA, 22 bp, Artificial Sequence
  chemically synthesized
atatggtcaaagcttattaatt

SEQ ID NO: 1050062 - DNA, 22 bp, Artificial Sequence
  chemically synthesized
tatggtcaaagcttattaatta

SEQ ID NO: 1050063 - DNA, 22 bp, Artificial Sequence
  chemically synthesized
attaattatatatatgcacatg

SEQ ID NO: 1050064 - DNA, 22 bp, Artificial Sequence
  chemically synthesized
ttaattatatatatgcacatgt

SEQ ID NO: 1050065 - DNA, 22 bp, Artificial Sequence
  chemically synthesized
attatatatatgcacatgtatg

SEQ ID NO: 1050066 - DNA, 22 bp, Artificial Sequence
  chemically synthesized
tatatatgcacatgtatgtatg

SEQ ID NO: 1050067 - DNA, 22 bp, Artificial Sequence
  chemically synthesized
cacagacacgtacatacataca

SEQ ID NO: 1050068 - DNA, 22 bp, Artificial Sequence
  chemically synthesized
gcacagacacgtacatacatac

SEQ ID NO: 1050069 - DNA, 22 bp, Artificial Sequence
  chemically synthesized
tatttgcacagacacgtacata

SEQ ID NO: 1050070 - DNA, 22 bp, Artificial Sequence
  chemically synthesized
tgtgtctgtatttgcacagaca

SEQ ID NO: 1050071 - DNA, 22 bp, Artificial Sequence
  chemically synthesized
gtgtgtctgtatttgcacagac

SEQ ID NO: 1050072 - DNA, 22 bp, Artificial Sequence
  chemically synthesized
tgtgtgtctgtatttgcacaga

SEQ ID NO: 1050073 - DNA, 22 bp, Artificial Sequence
  chemically synthesized
ttttgtgtgtctgtatttgcac

SEQ ID NO: 1050074 - DNA, 22 bp, Artificial Sequence
  chemically synthesized
tattttgtgtgtctgtatttgc

SEQ ID NO: 1050075 - DNA, 22 bp, Artificial Sequence
  chemically synthesized
ctattttgtgtgtctgtatttg

SEQ ID NO: 1050076 - DNA, 22 bp, Artificial Sequence
  chemically synthesized
aacatttctattttgtgtgtct

SEQ ID NO: 1050077 - DNA, 22 bp, Artificial Sequence
  chemically synthesized
tcaacatttctattttgtgtgt

SEQ ID NO: 1050078 - DNA, 22 bp, Artificial Sequence
  chemically synthesized
tgcaaatacagacacacaaaat

SEQ ID NO: 1050079 - DNA, 22 bp, Artificial Sequence
  chemically synthesized
cccattctcaacatttctattt

SEQ ID NO: 1050080 - DNA, 22 bp, Artificial Sequence
  chemically synthesized
acccattctcaacatttctatt

SEQ ID NO: 1050081 - DNA, 22 bp, Artificial Sequence
  chemically synthesized
cgatgtgatttacccattctca

SEQ ID NO: 1050082 - DNA, 22 bp, Artificial Sequence
  chemically synthesized
agaatgggtaaatcacatcgta

SEQ ID NO: 1050083 - DNA, 22 bp, Artificial Sequence
  chemically synthesized
aaagtgaaacagaaaacatatc

SEQ ID NO: 1050084 - DNA, 22 bp, Artificial Sequence
  chemically synthesized
agttcaaagtgaaacagaaaac

SEQ ID NO: 1050085 - DNA, 22 bp, Artificial Sequence
  chemically synthesized
catggactcagttcaaagtgaa

SEQ ID NO: 1050086 - DNA, 22 bp, Artificial Sequence
  chemically synthesized
acgttgcatggactcagttcaa

SEQ ID NO: 1050087 - DNA, 22 bp, Artificial Sequence
  chemically synthesized
tctgtttcactttgaactgagt

SEQ ID NO: 1050088 - DNA, 22 bp, Artificial Sequence
  chemically synthesized
gacgttgcatggactcagttca

SEQ ID NO: 1050089 - DNA, 22 bp, Artificial Sequence
  chemically synthesized
ctgtttcactttgaactgagtc

SEQ ID NO: 1050090 - DNA, 22 bp, Artificial Sequence
  chemically synthesized
tgtttcactttgaactgagtcc

SEQ ID NO: 1050091 - DNA, 22 bp, Artificial Sequence
  chemically synthesized
tttcactttgaactgagtccat

SEQ ID NO: 1050092 - DNA, 22 bp, Artificial Sequence
  chemically synthesized
tcttgacgttgcatggactcag

SEQ ID NO: 1050093 - DNA, 22 bp, Artificial Sequence
  chemically synthesized
cactttgaactgagtccatgca

SEQ ID NO: 1050094 - DNA, 22 bp, Artificial Sequence
  chemically synthesized
actttgaactgagtccatgcaa

SEQ ID NO: 1050095 - DNA, 22 bp, Artificial Sequence
  chemically synthesized
tgattatcttgacgttgcatgg

SEQ ID NO: 1050096 - DNA, 22 bp, Artificial Sequence
  chemically synthesized
tgaactgagtccatgcaacgtc

SEQ ID NO: 1050097 - DNA, 22 bp, Artificial Sequence
  chemically synthesized
gaactgagtccatgcaacgtca

SEQ ID NO: 1050098 - DNA, 22 bp, Artificial Sequence
  chemically synthesized
aactgagtccatgcaacgtcaa

SEQ ID NO: 1050099 - DNA, 22 bp, Artificial Sequence
  chemically synthesized
gttgtgattatcttgacgttgc

SEQ ID NO: 1050100 - DNA, 22 bp, Artificial Sequence
  chemically synthesized
agtccatgcaacgtcaagataa

SEQ ID NO: 1050101 - DNA, 22 bp, Artificial Sequence
  chemically synthesized
tagcagttagttgtgattatct

SEQ ID NO: 1050102 - DNA, 22 bp, Artificial Sequence
  chemically synthesized
aattgtagcagttagttgtgat

SEQ ID NO: 1050103 - DNA, 22 bp, Artificial Sequence
  chemically synthesized
taaattgtagcagttagttgtg

SEQ ID NO: 1050104 - DNA, 22 bp, Artificial Sequence
  chemically synthesized
ctaaattgtagcagttagttgt

SEQ ID NO: 1050105 - DNA, 22 bp, Artificial Sequence
  chemically synthesized
ttctaaattgtagcagttagtt

SEQ ID NO: 1050106 - DNA, 22 bp, Artificial Sequence
  chemically synthesized
atacatatattcttctaaattg

SEQ ID NO: 1050107 - DNA, 22 bp, Artificial Sequence
  chemically synthesized
actgctacaatttagaagaata

SEQ ID NO: 1050108 - DNA, 22 bp, Artificial Sequence
  chemically synthesized
aggtcctgatacatatattctt

SEQ ID NO: 1050109 - DNA, 22 bp, Artificial Sequence
  chemically synthesized
ctacaatttagaagaatatatg

SEQ ID NO: 1050110 - DNA, 22 bp, Artificial Sequence
  chemically synthesized
gaggtcctgatacatatattct

SEQ ID NO: 1050111 - DNA, 22 bp, Artificial Sequence
  chemically synthesized
caatttagaagaatatatgtat

SEQ ID NO: 1050112 - DNA, 22 bp, Artificial Sequence
  chemically synthesized
cataatttgaggtcctgataca

SEQ ID NO: 1050113 - DNA, 22 bp, Artificial Sequence
  chemically synthesized
agaagaatatatgtatcaggac

SEQ ID NO: 1050114 - DNA, 22 bp, Artificial Sequence
  chemically synthesized
ccataatttgaggtcctgatac

SEQ ID NO: 1050115 - DNA, 22 bp, Artificial Sequence
  chemically synthesized
gaagaatatatgtatcaggacc

SEQ ID NO: 1050116 - DNA, 22 bp, Artificial Sequence
  chemically synthesized
tccataatttgaggtcctgata

SEQ ID NO: 1050117 - DNA, 22 bp, Artificial Sequence
  chemically synthesized
ttccataatttgaggtcctgat

SEQ ID NO: 1050118 - DNA, 22 bp, Artificial Sequence
  chemically synthesized
tttccataatttgaggtcctga

SEQ ID NO: 1050119 - DNA, 22 bp, Artificial Sequence
  chemically synthesized
ttttccataatttgaggtcctg

SEQ ID NO: 1050120 - DNA, 22 bp, Artificial Sequence
  chemically synthesized
tttttccataatttgaggtcct

SEQ ID NO: 1050121 - DNA, 22 bp, Artificial Sequence
  chemically synthesized
ttttttccataatttgaggtcc

SEQ ID NO: 1050122 - DNA, 22 bp, Artificial Sequence
  chemically synthesized
caatttttttttccataatttg

SEQ ID NO: 1050123 - DNA, 22 bp, Artificial Sequence
  chemically synthesized
acctgcaatttttttttccata

SEQ ID NO: 1050124 - DNA, 22 bp, Artificial Sequence
  chemically synthesized
cacctgcaatttttttttccat

SEQ ID NO: 1050125 - DNA, 22 bp, Artificial Sequence
  chemically synthesized
ttcacctgcaatttttttttcc

SEQ ID NO: 1050126 - DNA, 22 bp, Artificial Sequence
  chemically synthesized
tcttcacctgcaattttttttt

SEQ ID NO: 1050127 - DNA, 22 bp, Artificial Sequence
  chemically synthesized
tctcttcacctgcaattttttt

SEQ ID NO: 1050128 - DNA, 22 bp, Artificial Sequence
  chemically synthesized
aaattatggaaaaaaaaattgc

SEQ ID NO: 1050129 - DNA, 22 bp, Artificial Sequence
  chemically synthesized
tggaaaaaaaaattgcaggtga

SEQ ID NO: 1050130 - DNA, 22 bp, Artificial Sequence
  chemically synthesized
atcatcattctctcttcacctg

SEQ ID NO: 1050131 - DNA, 22 bp, Artificial Sequence
  chemically synthesized
caggtgaagagagaatgatgat

SEQ ID NO: 1050132 - DNA, 22 bp, Artificial Sequence
  chemically synthesized
aaatatcaccagttcatcatca

SEQ ID NO: 1050133 - DNA, 22 bp, Artificial Sequence
  chemically synthesized
gaaatatcaccagttcatcatc

SEQ ID NO: 1050134 - DNA, 22 bp, Artificial Sequence
  chemically synthesized
tgaaatatcaccagttcatcat

SEQ ID NO: 1050135 - DNA, 22 bp, Artificial Sequence
  chemically synthesized
gtgatatttcaaagttatgtgt

SEQ ID NO: 1050136 - DNA, 22 bp, Artificial Sequence
  chemically synthesized
agatcgtgccaagatacacata

SEQ ID NO: 1050137 - DNA, 22 bp, Artificial Sequence
  chemically synthesized
tctcagatcgtgccaagataca

SEQ ID NO: 1050138 - DNA, 22 bp, Artificial Sequence
  chemically synthesized
caaagttatgtgtatcttggca

SEQ ID NO: 1050139 - DNA, 22 bp, Artificial Sequence
  chemically synthesized
tgtctcagatcgtgccaagata

SEQ ID NO: 1050140 - DNA, 22 bp, Artificial Sequence
  chemically synthesized
aaagttatgtgtatcttggcac

SEQ ID NO: 1050141 - DNA, 22 bp, Artificial Sequence
  chemically synthesized
ctgtctcagatcgtgccaagat

SEQ ID NO: 1050142 - DNA, 22 bp, Artificial Sequence
  chemically synthesized
tgtgtatcttggcacgatctga

SEQ ID NO: 1050143 - DNA, 22 bp, Artificial Sequence
  chemically synthesized
ggcacgatctgagacagaaatg

SEQ ID NO: 1050144 - DNA, 22 bp, Artificial Sequence
  chemically synthesized
gcacgatctgagacagaaatga

SEQ ID NO: 1050145 - DNA, 22 bp, Artificial Sequence
  chemically synthesized
aaaaccatcagatccatcattt

SEQ ID NO: 1050146 - DNA, 22 bp, Artificial Sequence
  chemically synthesized
gaaaaccatcagatccatcatt

SEQ ID NO: 1050147 - DNA, 22 bp, Artificial Sequence
  chemically synthesized
agacagaaatgatggatctgat

SEQ ID NO: 1050148 - DNA, 22 bp, Artificial Sequence
  chemically synthesized
cacatatatacttgaaaaccat

SEQ ID NO: 1050149 - DNA, 22 bp, Artificial Sequence
  chemically synthesized
atggttttcaagtatatatgtg

SEQ ID NO: 1050150 - DNA, 22 bp, Artificial Sequence
  chemically synthesized
caacagatcattccacatatat

SEQ ID NO: 1050151 - DNA, 22 bp, Artificial Sequence
  chemically synthesized
tcaagtatatatgtggaatgat

SEQ ID NO: 1050152 - DNA, 22 bp, Artificial Sequence
  chemically synthesized
caagtatatatgtggaatgatc

SEQ ID NO: 1050153 - DNA, 22 bp, Artificial Sequence
  chemically synthesized
aagtatatatgtggaatgatct

SEQ ID NO: 1050154 - DNA, 22 bp, Artificial Sequence
  chemically synthesized
aatcaatggtctccaacagatc

SEQ ID NO: 1050155 - DNA, 22 bp, Artificial Sequence
  chemically synthesized
aaatcaatggtctccaacagat

SEQ ID NO: 1050156 - DNA, 22 bp, Artificial Sequence
  chemically synthesized
cttaaatcaatggtctccaaca

SEQ ID NO: 1050157 - DNA, 22 bp, Artificial Sequence
  chemically synthesized
ttggagaccattgatttaagga

SEQ ID NO: 1050158 - DNA, 22 bp, Artificial Sequence
  chemically synthesized
agtcaaacagatctccttaaat

SEQ ID NO: 1050159 - DNA, 22 bp, Artificial Sequence
  chemically synthesized
aagtcaaacagatctccttaaa

SEQ ID NO: 1050160 - DNA, 22 bp, Artificial Sequence
  chemically synthesized
gagaccattgatttaaggagat

SEQ ID NO: 1050161 - DNA, 22 bp, Artificial Sequence
  chemically synthesized
ttaagtcaaacagatctcctta

SEQ ID NO: 1050162 - DNA, 22 bp, Artificial Sequence
  chemically synthesized
cttaagtcaaacagatctcctt

SEQ ID NO: 1050163 - DNA, 22 bp, Artificial Sequence
  chemically synthesized
atttaaggagatctgtttgact

SEQ ID NO: 1050164 - DNA, 22 bp, Artificial Sequence
  chemically synthesized
acccccttcttaagtcaaacag

SEQ ID NO: 1050165 - DNA, 22 bp, Artificial Sequence
  chemically synthesized
aaggagatctgtttgacttaag

SEQ ID NO: 1050166 - DNA, 22 bp, Artificial Sequence
  chemically synthesized
aggagatctgtttgacttaaga

SEQ ID NO: 1050167 - DNA, 22 bp, Artificial Sequence
  chemically synthesized
gcaggtactgacccccttctta

SEQ ID NO: 1050168 - DNA, 22 bp, Artificial Sequence
  chemically synthesized
tttgacttaagaagggggtcag

SEQ ID NO: 1050169 - DNA, 22 bp, Artificial Sequence
  chemically synthesized
gacttaagaagggggtcagtac

SEQ ID NO: 1050170 - DNA, 22 bp, Artificial Sequence
  chemically synthesized
acttaagaagggggtcagtacc

SEQ ID NO: 1050171 - DNA, 22 bp, Artificial Sequence
  chemically synthesized
aagaagggggtcagtacctgct

SEQ ID NO: 1050172 - DNA, 22 bp, Artificial Sequence
  chemically synthesized
agaagggggtcagtacctgcta

SEQ ID NO: 1050173 - DNA, 22 bp, Artificial Sequence
  chemically synthesized
catgaaacaaactagcaggtac

SEQ ID NO: 1050174 - DNA, 22 bp, Artificial Sequence
  chemically synthesized
cagtaatgcctgcatgaaacaa

SEQ ID NO: 1050175 - DNA, 22 bp, Artificial Sequence
  chemically synthesized
tccagtaatgcctgcatgaaac

SEQ ID NO: 1050176 - DNA, 22 bp, Artificial Sequence
  chemically synthesized
ctagtttgtttcatgcaggcat

SEQ ID NO: 1050177 - DNA, 22 bp, Artificial Sequence
  chemically synthesized
gtttgtttcatgcaggcattac

SEQ ID NO: 1050178 - DNA, 22 bp, Artificial Sequence
  chemically synthesized
gtttcatgcaggcattactgga

SEQ ID NO: 1050179 - DNA, 22 bp, Artificial Sequence
  chemically synthesized
tttcatgcaggcattactggag

SEQ ID NO: 1050180 - DNA, 22 bp, Artificial Sequence
  chemically synthesized
catgcaggcattactggagagt

SEQ ID NO: 1050181 - DNA, 22 bp, Artificial Sequence
  chemically synthesized
atgcaggcattactggagagtg

SEQ ID NO: 1050182 - DNA, 22 bp, Artificial Sequence
  chemically synthesized
aaccatgtagtacagccactct

SEQ ID NO: 1050183 - DNA, 22 bp, Artificial Sequence
  chemically synthesized
tcctcaaccatgtagtacagcc

SEQ ID NO: 1050184 - DNA, 22 bp, Artificial Sequence
  chemically synthesized
ctggagagtggctgtactacat

SEQ ID NO: 1050185 - DNA, 22 bp, Artificial Sequence
  chemically synthesized
gagagtggctgtactacatggt

SEQ ID NO: 1050186 - DNA, 22 bp, Artificial Sequence
  chemically synthesized
tactacatggttgaggacagcc

SEQ ID NO: 1050187 - DNA, 22 bp, Artificial Sequence
  chemically synthesized
catggttgaggacagccttact

SEQ ID NO: 1050188 - DNA, 22 bp, Artificial Sequence
  chemically synthesized
atggacaaggggtggaagtaag

SEQ ID NO: 1050189 - DNA, 22 bp, Artificial Sequence
  chemically synthesized
aggacagccttacttccacccc

SEQ ID NO: 1050190 - DNA, 22 bp, Artificial Sequence
  chemically synthesized
atctcatggacaaggggtggaa

SEQ ID NO: 1050191 - DNA, 22 bp, Artificial Sequence
  chemically synthesized
tgatctcatggacaaggggtgg

SEQ ID NO: 1050192 - DNA, 22 bp, Artificial Sequence
  chemically synthesized
acttccaccccttgtccatgag

SEQ ID NO: 1050193 - DNA, 22 bp, Artificial Sequence
  chemically synthesized
cttccaccccttgtccatgaga

SEQ ID NO: 1050194 - DNA, 22 bp, Artificial Sequence
  chemically synthesized
ccaccccttgtccatgagatca

SEQ ID NO: 1050195 - DNA, 22 bp, Artificial Sequence
  chemically synthesized
caccccttgtccatgagatcag

SEQ ID NO: 1050196 - DNA, 22 bp, Artificial Sequence
  chemically synthesized
catatgggaaaacatctctgat

SEQ ID NO: 1050197 - DNA, 22 bp, Artificial Sequence
  chemically synthesized
acatatgggaaaacatctctga

SEQ ID NO: 1050198 - DNA, 22 bp, Artificial Sequence
  chemically synthesized
gtccatgagatcagagatgttt

SEQ ID NO: 1050199 - DNA, 22 bp, Artificial Sequence
  chemically synthesized
tccatgagatcagagatgtttt

SEQ ID NO: 1050200 - DNA, 22 bp, Artificial Sequence
  chemically synthesized
acaaaatttacatatgggaaaa

SEQ ID NO: 1050201 - DNA, 22 bp, Artificial Sequence
  chemically synthesized
ttcacaaaatttacatatggga

SEQ ID NO: 1050202 - DNA, 22 bp, Artificial Sequence
  chemically synthesized
aaacctattcacaaaatttaca

SEQ ID NO: 1050203 - DNA, 22 bp, Artificial Sequence
  chemically synthesized
tcccatatgtaaattttgtgaa

SEQ ID NO: 1050204 - DNA, 22 bp, Artificial Sequence
  chemically synthesized
cccatatgtaaattttgtgaat

SEQ ID NO: 1050205 - DNA, 22 bp, Artificial Sequence
  chemically synthesized
ccatatgtaaattttgtgaata

SEQ ID NO: 1050206 - DNA, 22 bp, Artificial Sequence
  chemically synthesized
acaagctgaaacctattcacaa

SEQ ID NO: 1050207 - DNA, 22 bp, Artificial Sequence
  chemically synthesized
aacaagctgaaacctattcaca

SEQ ID NO: 1050208 - DNA, 22 bp, Artificial Sequence
  chemically synthesized
tttaacaagctgaaacctattc

SEQ ID NO: 1050209 - DNA, 22 bp, Artificial Sequence
  chemically synthesized
tgtgaataggtttcagcttgtt

SEQ ID NO: 1050210 - DNA, 22 bp, Artificial Sequence
  chemically synthesized
gtgaataggtttcagcttgtta

SEQ ID NO: 1050211 - DNA, 22 bp, Artificial Sequence
  chemically synthesized
tgaataggtttcagcttgttaa

SEQ ID NO: 1050212 - DNA, 22 bp, Artificial Sequence
  chemically synthesized
atgaataattatttaacaagct

SEQ ID NO: 1050213 - DNA, 22 bp, Artificial Sequence
  chemically synthesized
atctgatgaataattatttaac

SEQ ID NO: 1050214 - DNA, 22 bp, Artificial Sequence
  chemically synthesized
gatctgatgaataattatttaa

SEQ ID NO: 1050215 - DNA, 22 bp, Artificial Sequence
  chemically synthesized
tgatctgatgaataattattta

SEQ ID NO: 1050216 - DNA, 22 bp, Artificial Sequence
  chemically synthesized
ttttgatctgatgaataattat

SEQ ID NO: 1050217 - DNA, 22 bp, Artificial Sequence
  chemically synthesized
cagcttgttaaataattattca

SEQ ID NO: 1050218 - DNA, 22 bp, Artificial Sequence
  chemically synthesized
agcttgttaaataattattcat

SEQ ID NO: 1050219 - DNA, 22 bp, Artificial Sequence
  chemically synthesized
ttgttttgatctgatgaataat

SEQ ID NO: 1050220 - DNA, 22 bp, Artificial Sequence
  chemically synthesized
ttgttgttttgatctgatgaat

SEQ ID NO: 1050221 - DNA, 22 bp, Artificial Sequence
  chemically synthesized
gttaaataattattcatcagat

SEQ ID NO: 1050222 - DNA, 22 bp, Artificial Sequence
  chemically synthesized
ttaaataattattcatcagatc

SEQ ID NO: 1050223 - DNA, 22 bp, Artificial Sequence
  chemically synthesized
ttgttgttgttttgatctgatg

SEQ ID NO: 1050224 - DNA, 22 bp, Artificial Sequence
  chemically synthesized
aataattattcatcagatcaaa

SEQ ID NO: 1050225 - DNA, 22 bp, Artificial Sequence
  chemically synthesized
ttgttgttgttgttttgatctg

SEQ ID NO: 1050226 - DNA, 22 bp, Artificial Sequence
  chemically synthesized
ttgttgttgttgttgttttgat

SEQ ID NO: 1050227 - DNA, 22 bp, Artificial Sequence
  chemically synthesized
gttgttgttgttgttgttttga

SEQ ID NO: 1050228 - DNA, 22 bp, Artificial Sequence
  chemically synthesized
tgttgttgttgttgttgttttg

SEQ ID NO: 1050229 - DNA, 22 bp, Artificial Sequence
  chemically synthesized
ttcatcagatcaaaacaacaac

SEQ ID NO: 1050230 - DNA, 22 bp, Artificial Sequence
  chemically synthesized
atcagatcaaaacaacaacaac

SEQ ID NO: 1050231 - DNA, 22 bp, Artificial Sequence
  chemically synthesized
gaagttttgttgttgttgttgt

SEQ ID NO: 1050232 - DNA, 22 bp, Artificial Sequence
  chemically synthesized
agaagcaacatggatactggaa

SEQ ID NO: 1050233 - DNA, 22 bp, Artificial Sequence
  chemically synthesized
attgagaagcaacatggatact

SEQ ID NO: 1050234 - DNA, 22 bp, Artificial Sequence
  chemically synthesized
ccagtatccatgttgcttctca

SEQ ID NO: 1050235 - DNA, 22 bp, Artificial Sequence
  chemically synthesized
cagtatccatgttgcttctcaa

SEQ ID NO: 1050236 - DNA, 22 bp, Artificial Sequence
  chemically synthesized
atgcatagtgattgattgagaa

SEQ ID NO: 1050237 - DNA, 22 bp, Artificial Sequence
  chemically synthesized
gatgcatagtgattgattgaga

SEQ ID NO: 1050238 - DNA, 22 bp, Artificial Sequence
  chemically synthesized
tgatgcatagtgattgattgag

SEQ ID NO: 1050239 - DNA, 22 bp, Artificial Sequence
  chemically synthesized
atattttgatgcatagtgattg

SEQ ID NO: 1050240 - DNA, 22 bp, Artificial Sequence
  chemically synthesized
gatattttgatgcatagtgatt

SEQ ID NO: 1050241 - DNA, 22 bp, Artificial Sequence
  chemically synthesized
tgatattttgatgcatagtgat

SEQ ID NO: 1050242 - DNA, 22 bp, Artificial Sequence
  chemically synthesized
cttctcaatcaatcactatgca

SEQ ID NO: 1050243 - DNA, 22 bp, Artificial Sequence
  chemically synthesized
ctcaatcaatcactatgcatca

SEQ ID NO: 1050244 - DNA, 22 bp, Artificial Sequence
  chemically synthesized
tcaatcaatcactatgcatcaa

SEQ ID NO: 1050245 - DNA, 22 bp, Artificial Sequence
  chemically synthesized
aggttttgatattttgatgcat

SEQ ID NO: 1050246 - DNA, 22 bp, Artificial Sequence
  chemically synthesized
aatcaatcactatgcatcaaaa

SEQ ID NO: 1050247 - DNA, 22 bp, Artificial Sequence
  chemically synthesized
tgcatcaaaatatcaaaacctt

SEQ ID NO: 1050248 - DNA, 22 bp, Artificial Sequence
  chemically synthesized
gcgcaaatgcagttaaggtttt

SEQ ID NO: 1050249 - DNA, 22 bp, Artificial Sequence
  chemically synthesized
ggcgcaaatgcagttaaggttt

SEQ ID NO: 1050250 - DNA, 22 bp, Artificial Sequence
  chemically synthesized
aactgcatttgcgccaagacat

SEQ ID NO: 1050251 - DNA, 22 bp, Artificial Sequence
  chemically synthesized
actgcatttgcgccaagacatt

SEQ ID NO: 1050252 - DNA, 22 bp, Artificial Sequence
  chemically synthesized
agtcaaagaatgtaaaatgtct

SEQ ID NO: 1050253 - DNA, 22 bp, Artificial Sequence
  chemically synthesized
catttgcgccaagacattttac

SEQ ID NO: 1050254 - DNA, 22 bp, Artificial Sequence
  chemically synthesized
gcgccaagacattttacattct

SEQ ID NO: 1050255 - DNA, 22 bp, Artificial Sequence
  chemically synthesized
cgccaagacattttacattctt

SEQ ID NO: 1050256 - DNA, 22 bp, Artificial Sequence
  chemically synthesized
atgcctaagtcaaagaatgtaa

SEQ ID NO: 1050257 - DNA, 22 bp, Artificial Sequence
  chemically synthesized
tcatgcctaagtcaaagaatgt

SEQ ID NO: 1050258 - DNA, 22 bp, Artificial Sequence
  chemically synthesized
tctcatgcctaagtcaaagaat

SEQ ID NO: 1050259 - DNA, 22 bp, Artificial Sequence
  chemically synthesized
ctctcatgcctaagtcaaagaa

SEQ ID NO: 1050260 - DNA, 22 bp, Artificial Sequence
  chemically synthesized
tctctcatgcctaagtcaaaga

SEQ ID NO: 1050261 - DNA, 22 bp, Artificial Sequence
  chemically synthesized
ttttctctcatgcctaagtcaa

SEQ ID NO: 1050262 - DNA, 22 bp, Artificial Sequence
  chemically synthesized
attttctctcatgcctaagtca

SEQ ID NO: 1050263 - DNA, 22 bp, Artificial Sequence
  chemically synthesized
tattttctctcatgcctaagtc

SEQ ID NO: 1050264 - DNA, 22 bp, Artificial Sequence
  chemically synthesized
tacattctttgacttaggcatg

SEQ ID NO: 1050265 - DNA, 22 bp, Artificial Sequence
  chemically synthesized
acattctttgacttaggcatga

SEQ ID NO: 1050266 - DNA, 22 bp, Artificial Sequence
  chemically synthesized
ctttattttctctcatgcctaa

SEQ ID NO: 1050267 - DNA, 22 bp, Artificial Sequence
  chemically synthesized
cattctttgacttaggcatgag

SEQ ID NO: 1050268 - DNA, 22 bp, Artificial Sequence
  chemically synthesized
gctttattttctctcatgccta

SEQ ID NO: 1050269 - DNA, 22 bp, Artificial Sequence
  chemically synthesized
tgctttattttctctcatgcct

SEQ ID NO: 1050270 - DNA, 22 bp, Artificial Sequence
  chemically synthesized
tttgacttaggcatgagagaaa

SEQ ID NO: 1050271 - DNA, 22 bp, Artificial Sequence
  chemically synthesized
tgacttaggcatgagagaaaat

SEQ ID NO: 1050272 - DNA, 22 bp, Artificial Sequence
  chemically synthesized
gacttaggcatgagagaaaata

SEQ ID NO: 1050273 - DNA, 22 bp, Artificial Sequence
  chemically synthesized
acttaggcatgagagaaaataa

SEQ ID NO: 1050274 - DNA, 22 bp, Artificial Sequence
  chemically synthesized
aaaaagcctttgctttattttc

SEQ ID NO: 1050275 - DNA, 22 bp, Artificial Sequence
  chemically synthesized
aggcatgagagaaaataaagca

SEQ ID NO: 1050276 - DNA, 22 bp, Artificial Sequence
  chemically synthesized
tgaaaaagcctttgctttattt

SEQ ID NO: 1050277 - DNA, 22 bp, Artificial Sequence
  chemically synthesized
ggcatgagagaaaataaagcaa

SEQ ID NO: 1050278 - DNA, 22 bp, Artificial Sequence
  chemically synthesized
ctgaaaaagcctttgctttatt

SEQ ID NO: 1050279 - DNA, 22 bp, Artificial Sequence
  chemically synthesized
tgtcttctgaaaaagcctttgc

SEQ ID NO: 1050280 - DNA, 22 bp, Artificial Sequence
  chemically synthesized
gtgtcttctgaaaaagcctttg

SEQ ID NO: 1050281 - DNA, 22 bp, Artificial Sequence
  chemically synthesized
cagccccttgtgtcttctgaaa

SEQ ID NO: 1050282 - DNA, 22 bp, Artificial Sequence
  chemically synthesized
tccagccccttgtgtcttctga

SEQ ID NO: 1050283 - DNA, 22 bp, Artificial Sequence
  chemically synthesized
tctccagccccttgtgtcttct

SEQ ID NO: 1050284 - DNA, 22 bp, Artificial Sequence
  chemically synthesized
ctctccagccccttgtgtcttc

SEQ ID NO: 1050285 - DNA, 22 bp, Artificial Sequence
  chemically synthesized
tctctccagccccttgtgtctt

SEQ ID NO: 1050286 - DNA, 22 bp, Artificial Sequence
  chemically synthesized
tctttctctccagccccttgtg

SEQ ID NO: 1050287 - DNA, 22 bp, Artificial Sequence
  chemically synthesized
gtctttctctccagccccttgt

SEQ ID NO: 1050288 - DNA, 22 bp, Artificial Sequence
  chemically synthesized
tttcagaagacacaaggggctg

SEQ ID NO: 1050289 - DNA, 22 bp, Artificial Sequence
  chemically synthesized
tgtctttctctccagccccttg

SEQ ID NO: 1050290 - DNA, 22 bp, Artificial Sequence
  chemically synthesized
ttcagaagacacaaggggctgg

SEQ ID NO: 1050291 - DNA, 22 bp, Artificial Sequence
  chemically synthesized
tcagaagacacaaggggctgga

SEQ ID NO: 1050292 - DNA, 22 bp, Artificial Sequence
  chemically synthesized
cagaagacacaaggggctggag

SEQ ID NO: 1050293 - DNA, 22 bp, Artificial Sequence
  chemically synthesized
agaagacacaaggggctggaga

SEQ ID NO: 1050294 - DNA, 22 bp, Artificial Sequence
  chemically synthesized
agctttgtctttctctccagcc

SEQ ID NO: 1050295 - DNA, 22 bp, Artificial Sequence
  chemically synthesized
tcagctttgtctttctctccag

SEQ ID NO: 1050296 - DNA, 22 bp, Artificial Sequence
  chemically synthesized
tatggactctcagctttgtctt

SEQ ID NO: 1050297 - DNA, 22 bp, Artificial Sequence
  chemically synthesized
gtatggactctcagctttgtct

SEQ ID NO: 1050298 - DNA, 22 bp, Artificial Sequence
  chemically synthesized
cttgtatggactctcagctttg

SEQ ID NO: 1050299 - DNA, 22 bp, Artificial Sequence
  chemically synthesized
gagagaaagacaaagctgagag

SEQ ID NO: 1050300 - DNA, 22 bp, Artificial Sequence
  chemically synthesized
gtatactacttgtatggactct

SEQ ID NO: 1050301 - DNA, 22 bp, Artificial Sequence
  chemically synthesized
tagtatactacttgtatggact

SEQ ID NO: 1050302 - DNA, 22 bp, Artificial Sequence
  chemically synthesized
ctagtatactacttgtatggac

SEQ ID NO: 1050303 - DNA, 22 bp, Artificial Sequence
  chemically synthesized
cgtatcttctagtatactactt

SEQ ID NO: 1050304 - DNA, 22 bp, Artificial Sequence
  chemically synthesized
agagtccatacaagtagtatac

SEQ ID NO: 1050305 - DNA, 22 bp, Artificial Sequence
  chemically synthesized
ccgtatcttctagtatactact

SEQ ID NO: 1050306 - DNA, 22 bp, Artificial Sequence
  chemically synthesized
aatgtaccttccgtatcttcta

SEQ ID NO: 1050307 - DNA, 22 bp, Artificial Sequence
  chemically synthesized
ttaaatgtaccttccgtatctt

SEQ ID NO: 1050308 - DNA, 22 bp, Artificial Sequence
  chemically synthesized
attaaatgtaccttccgtatct

SEQ ID NO: 1050309 - DNA, 22 bp, Artificial Sequence
  chemically synthesized
tattaaatgtaccttccgtatc

SEQ ID NO: 1050310 - DNA, 22 bp, Artificial Sequence
  chemically synthesized
ttattaaatgtaccttccgtat

SEQ ID NO: 1050311 - DNA, 22 bp, Artificial Sequence
  chemically synthesized
tttttattaaatgtaccttccg

SEQ ID NO: 1050312 - DNA, 22 bp, Artificial Sequence
  chemically synthesized
atttttattaaatgtaccttcc

SEQ ID NO: 1050313 - DNA, 22 bp, Artificial Sequence
  chemically synthesized
tatttttattaaatgtaccttc

SEQ ID NO: 1050314 - DNA, 22 bp, Artificial Sequence
  chemically synthesized
gaagatacggaaggtacattta

SEQ ID NO: 1050315 - DNA, 22 bp, Artificial Sequence
  chemically synthesized
attttatttttattaaatgtac

SEQ ID NO: 1050316 - DNA, 22 bp, Artificial Sequence
  chemically synthesized
taattttatttttattaaatgt

SEQ ID NO: 1050317 - DNA, 22 bp, Artificial Sequence
  chemically synthesized
ctaattttatttttattaaatg

SEQ ID NO: 1050318 - DNA, 22 bp, Artificial Sequence
  chemically synthesized
atgtttctaattttatttttat

SEQ ID NO: 1050319 - DNA, 22 bp, Artificial Sequence
  chemically synthesized
aatgtttctaattttattttta

SEQ ID NO: 1050320 - DNA, 22 bp, Artificial Sequence
  chemically synthesized
taatgtttctaattttattttt

SEQ ID NO: 1050321 - DNA, 22 bp, Artificial Sequence
  chemically synthesized
ttaatgtttctaattttatttt

SEQ ID NO: 1050322 - DNA, 22 bp, Artificial Sequence
  chemically synthesized
accttttaatgtttctaatttt

SEQ ID NO: 1050323 - DNA, 22 bp, Artificial Sequence
  chemically synthesized
aataaaaataaaattagaaaca

SEQ ID NO: 1050324 - DNA, 22 bp, Artificial Sequence
  chemically synthesized
ataaaaataaaattagaaacat

SEQ ID NO: 1050325 - DNA, 22 bp, Artificial Sequence
  chemically synthesized
atgttaaccttttaatgtttct

SEQ ID NO: 1050326 - DNA, 22 bp, Artificial Sequence
  chemically synthesized
taatgttaaccttttaatgttt

SEQ ID NO: 1050327 - DNA, 22 bp, Artificial Sequence
  chemically synthesized
tgctctaatgttaaccttttaa

SEQ ID NO: 1050328 - DNA, 22 bp, Artificial Sequence
  chemically synthesized
tgtgctctaatgttaacctttt

SEQ ID NO: 1050329 - DNA, 22 bp, Artificial Sequence
  chemically synthesized
ctgtgctctaatgttaaccttt

SEQ ID NO: 1050330 - DNA, 22 bp, Artificial Sequence
  chemically synthesized
tctgtgctctaatgttaacctt

SEQ ID NO: 1050331 - DNA, 22 bp, Artificial Sequence
  chemically synthesized
gaaacattaaaaggttaacatt

SEQ ID NO: 1050332 - DNA, 22 bp, Artificial Sequence
  chemically synthesized
aaaggttaacattagagcacag

SEQ ID NO: 1050333 - DNA, 22 bp, Artificial Sequence
  chemically synthesized
ggtaacaggctttctgtgctct

SEQ ID NO: 1050334 - DNA, 22 bp, Artificial Sequence
  chemically synthesized
acattagagcacagaaagcctg

SEQ ID NO: 1050335 - DNA, 22 bp, Artificial Sequence
  chemically synthesized
aaaactaggtaacaggctttct

SEQ ID NO: 1050336 - DNA, 22 bp, Artificial Sequence
  chemically synthesized
aaaaactaggtaacaggctttc

SEQ ID NO: 1050337 - DNA, 22 bp, Artificial Sequence
  chemically synthesized
tttaaaaactaggtaacaggct

SEQ ID NO: 1050338 - DNA, 22 bp, Artificial Sequence
  chemically synthesized
gagcacagaaagcctgttacct

SEQ ID NO: 1050339 - DNA, 22 bp, Artificial Sequence
  chemically synthesized
ttatttaaaaactaggtaacag

SEQ ID NO: 1050340 - DNA, 22 bp, Artificial Sequence
  chemically synthesized
ttgttatttaaaaactaggtaa

SEQ ID NO: 1050341 - DNA, 22 bp, Artificial Sequence
  chemically synthesized
tctattgttatttaaaaactag

SEQ ID NO: 1050342 - DNA, 22 bp, Artificial Sequence
  chemically synthesized
agttgtctattgttatttaaaa

SEQ ID NO: 1050343 - DNA, 22 bp, Artificial Sequence
  chemically synthesized
taagttgtctattgttatttaa

SEQ ID NO: 1050344 - DNA, 22 bp, Artificial Sequence
  chemically synthesized
ttacctagtttttaaataacaa

SEQ ID NO: 1050345 - DNA, 22 bp, Artificial Sequence
  chemically synthesized
ctaagttgtctattgttattta

SEQ ID NO: 1050346 - DNA, 22 bp, Artificial Sequence
  chemically synthesized
tctaagttgtctattgttattt

SEQ ID NO: 1050347 - DNA, 22 bp, Artificial Sequence
  chemically synthesized
ttctaagttgtctattgttatt

SEQ ID NO: 1050348 - DNA, 22 bp, Artificial Sequence
  chemically synthesized
cctagtttttaaataacaatag

SEQ ID NO: 1050349 - DNA, 22 bp, Artificial Sequence
  chemically synthesized
ttttctaagttgtctattgtta

SEQ ID NO: 1050350 - DNA, 22 bp, Artificial Sequence
  chemically synthesized
tcttttctaagttgtctattgt

SEQ ID NO: 1050351 - DNA, 22 bp, Artificial Sequence
  chemically synthesized
gtttttaaataacaatagacaa

SEQ ID NO: 1050352 - DNA, 22 bp, Artificial Sequence
  chemically synthesized
ttaaataacaatagacaactta

SEQ ID NO: 1050353 - DNA, 22 bp, Artificial Sequence
  chemically synthesized
taaataacaatagacaacttag

SEQ ID NO: 1050354 - DNA, 22 bp, Artificial Sequence
  chemically synthesized
aaataacaatagacaacttaga

SEQ ID NO: 1050355 - DNA, 22 bp, Artificial Sequence
  chemically synthesized
aataacaatagacaacttagaa

SEQ ID NO: 1050356 - DNA, 22 bp, Artificial Sequence
  chemically synthesized
gccatgatcattctcttttcta

SEQ ID NO: 1050357 - DNA, 22 bp, Artificial Sequence
  chemically synthesized
agccatgatcattctcttttct

SEQ ID NO: 1050358 - DNA, 22 bp, Artificial Sequence
  chemically synthesized
tagccatgatcattctcttttc

SEQ ID NO: 1050359 - DNA, 22 bp, Artificial Sequence
  chemically synthesized
ttagccatgatcattctctttt

SEQ ID NO: 1050360 - DNA, 22 bp, Artificial Sequence
  chemically synthesized
tttttagccatgatcattctct

SEQ ID NO: 1050361 - DNA, 22 bp, Artificial Sequence
  chemically synthesized
atttttagccatgatcattctc

SEQ ID NO: 1050362 - DNA, 22 bp, Artificial Sequence
  chemically synthesized
tatttttagccatgatcattct

SEQ ID NO: 1050363 - DNA, 22 bp, Artificial Sequence
  chemically synthesized
agaaaagagaatgatcatggct

SEQ ID NO: 1050364 - DNA, 22 bp, Artificial Sequence
  chemically synthesized
gaaaagagaatgatcatggcta

SEQ ID NO: 1050365 - DNA, 22 bp, Artificial Sequence
  chemically synthesized
taaagaacccatattttatttt

SEQ ID NO: 1050366 - DNA, 22 bp, Artificial Sequence
  chemically synthesized
actgtaaagaacccatatttta

SEQ ID NO: 1050367 - DNA, 22 bp, Artificial Sequence
  chemically synthesized
gttgactgtaaagaacccatat

SEQ ID NO: 1050368 - DNA, 22 bp, Artificial Sequence
  chemically synthesized
tggttgactgtaaagaacccat

SEQ ID NO: 1050369 - DNA, 22 bp, Artificial Sequence
  chemically synthesized
ctggttgactgtaaagaaccca

SEQ ID NO: 1050370 - DNA, 22 bp, Artificial Sequence
  chemically synthesized
aaaataaaatatgggttcttta

SEQ ID NO: 1050371 - DNA, 22 bp, Artificial Sequence
  chemically synthesized
ttctggttgactgtaaagaacc

SEQ ID NO: 1050372 - DNA, 22 bp, Artificial Sequence
  chemically synthesized
cttctggttgactgtaaagaac

SEQ ID NO: 1050373 - DNA, 22 bp, Artificial Sequence
  chemically synthesized
tgatatacttcttctggttgac

SEQ ID NO: 1050374 - DNA, 22 bp, Artificial Sequence
  chemically synthesized
aattgtgatatacttcttctgg

SEQ ID NO: 1050375 - DNA, 22 bp, Artificial Sequence
  chemically synthesized
tttacagtcaaccagaagaagt

SEQ ID NO: 1050376 - DNA, 22 bp, Artificial Sequence
  chemically synthesized
aaattgtgatatacttcttctg

SEQ ID NO: 1050377 - DNA, 22 bp, Artificial Sequence
  chemically synthesized
taaattgtgatatacttcttct

SEQ ID NO: 1050378 - DNA, 22 bp, Artificial Sequence
  chemically synthesized
tacagtcaaccagaagaagtat

SEQ ID NO: 1050379 - DNA, 22 bp, Artificial Sequence
  chemically synthesized
acagtcaaccagaagaagtata

SEQ ID NO: 1050380 - DNA, 22 bp, Artificial Sequence
  chemically synthesized
cagtcaaccagaagaagtatat

SEQ ID NO: 1050381 - DNA, 22 bp, Artificial Sequence
  chemically synthesized
tctttaaattgtgatatacttc

SEQ ID NO: 1050382 - DNA, 22 bp, Artificial Sequence
  chemically synthesized
gtctttaaattgtgatatactt

SEQ ID NO: 1050383 - DNA, 22 bp, Artificial Sequence
  chemically synthesized
tttgtctttaaattgtgatata

SEQ ID NO: 1050384 - DNA, 22 bp, Artificial Sequence
  chemically synthesized
tatttgtctttaaattgtgata

SEQ ID NO: 1050385 - DNA, 22 bp, Artificial Sequence
  chemically synthesized
ctatttgtctttaaattgtgat

SEQ ID NO: 1050386 - DNA, 22 bp, Artificial Sequence
  chemically synthesized
tttctatttgtctttaaattgt

SEQ ID NO: 1050387 - DNA, 22 bp, Artificial Sequence
  chemically synthesized
atttctatttgtctttaaattg

SEQ ID NO: 1050388 - DNA, 22 bp, Artificial Sequence
  chemically synthesized
atgtcagtttatttctatttgt

SEQ ID NO: 1050389 - DNA, 22 bp, Artificial Sequence
  chemically synthesized
ttaatgtcagtttatttctatt

SEQ ID NO: 1050390 - DNA, 22 bp, Artificial Sequence
  chemically synthesized
actattaatgtcagtttatttc

SEQ ID NO: 1050391 - DNA, 22 bp, Artificial Sequence
  chemically synthesized
aaagacaaatagaaataaactg

SEQ ID NO: 1050392 - DNA, 22 bp, Artificial Sequence
  chemically synthesized
cactattaatgtcagtttattt

SEQ ID NO: 1050393 - DNA, 22 bp, Artificial Sequence
  chemically synthesized
aagacaaatagaaataaactga

SEQ ID NO: 1050394 - DNA, 22 bp, Artificial Sequence
  chemically synthesized
tcactattaatgtcagtttatt

SEQ ID NO: 1050395 - DNA, 22 bp, Artificial Sequence
  chemically synthesized
ttcactattaatgtcagtttat

SEQ ID NO: 1050396 - DNA, 22 bp, Artificial Sequence
  chemically synthesized
tttcactattaatgtcagttta

SEQ ID NO: 1050397 - DNA, 22 bp, Artificial Sequence
  chemically synthesized
ttttttcactattaatgtcagt

SEQ ID NO: 1050398 - DNA, 22 bp, Artificial Sequence
  chemically synthesized
attttttcactattaatgtcag

SEQ ID NO: 1050399 - DNA, 22 bp, Artificial Sequence
  chemically synthesized
ttattttttcactattaatgtc

SEQ ID NO: 1050400 - DNA, 22 bp, Artificial Sequence
  chemically synthesized
agtctcttattttttcactatt

SEQ ID NO: 1050401 - DNA, 22 bp, Artificial Sequence
  chemically synthesized
taagtctcttattttttcacta

SEQ ID NO: 1050402 - DNA, 22 bp, Artificial Sequence
  chemically synthesized
tctaagtctcttattttttcac

SEQ ID NO: 1050403 - DNA, 22 bp, Artificial Sequence
  chemically synthesized
acattaatagtgaaaaaataag

SEQ ID NO: 1050404 - DNA, 22 bp, Artificial Sequence
  chemically synthesized
ttctctaagtctcttatttttt

SEQ ID NO: 1050405 - DNA, 22 bp, Artificial Sequence
  chemically synthesized
atagtgaaaaaataagagactt

SEQ ID NO: 1050406 - DNA, 22 bp, Artificial Sequence
  chemically synthesized
gatctgttctctaagtctctta

SEQ ID NO: 1050407 - DNA, 22 bp, Artificial Sequence
  chemically synthesized
agatctgttctctaagtctctt

SEQ ID NO: 1050408 - DNA, 22 bp, Artificial Sequence
  chemically synthesized
ataggtatcttagatctgttct

SEQ ID NO: 1050409 - DNA, 22 bp, Artificial Sequence
  chemically synthesized
aataggtatcttagatctgttc

SEQ ID NO: 1050410 - DNA, 22 bp, Artificial Sequence
  chemically synthesized
cttaataggtatcttagatctg

SEQ ID NO: 1050411 - DNA, 22 bp, Artificial Sequence
  chemically synthesized
agagaacagatctaagatacct

SEQ ID NO: 1050412 - DNA, 22 bp, Artificial Sequence
  chemically synthesized
tcattgcttaataggtatctta

SEQ ID NO: 1050413 - DNA, 22 bp, Artificial Sequence
  chemically synthesized
gagaacagatctaagataccta

SEQ ID NO: 1050414 - DNA, 22 bp, Artificial Sequence
  chemically synthesized
atcattgcttaataggtatctt

SEQ ID NO: 1050415 - DNA, 22 bp, Artificial Sequence
  chemically synthesized
gtacttatcattgcttaatagg

SEQ ID NO: 1050416 - DNA, 22 bp, Artificial Sequence
  chemically synthesized
tggtacttatcattgcttaata

SEQ ID NO: 1050417 - DNA, 22 bp, Artificial Sequence
  chemically synthesized
attctggtacttatcattgctt

SEQ ID NO: 1050418 - DNA, 22 bp, Artificial Sequence
  chemically synthesized
agatacctattaagcaatgata

SEQ ID NO: 1050419 - DNA, 22 bp, Artificial Sequence
  chemically synthesized
tcattctggtacttatcattgc

SEQ ID NO: 1050420 - DNA, 22 bp, Artificial Sequence
  chemically synthesized
ctcattctggtacttatcattg

SEQ ID NO: 1050421 - DNA, 22 bp, Artificial Sequence
  chemically synthesized
tctcattctggtacttatcatt

SEQ ID NO: 1050422 - DNA, 22 bp, Artificial Sequence
  chemically synthesized
ttctcattctggtacttatcat

SEQ ID NO: 1050423 - DNA, 22 bp, Artificial Sequence
  chemically synthesized
tttctcattctggtacttatca

SEQ ID NO: 1050424 - DNA, 22 bp, Artificial Sequence
  chemically synthesized
ttttctcattctggtacttatc

SEQ ID NO: 1050425 - DNA, 22 bp, Artificial Sequence
  chemically synthesized
ttttttctcattctggtactta

SEQ ID NO: 1050426 - DNA, 22 bp, Artificial Sequence
  chemically synthesized
ttaagcaatgataagtaccaga

SEQ ID NO: 1050427 - DNA, 22 bp, Artificial Sequence
  chemically synthesized
cttttttctcattctggtactt

SEQ ID NO: 1050428 - DNA, 22 bp, Artificial Sequence
  chemically synthesized
ttcttttttctcattctggtac

SEQ ID NO: 1050429 - DNA, 22 bp, Artificial Sequence
  chemically synthesized
agcaatgataagtaccagaatg

SEQ ID NO: 1050430 - DNA, 22 bp, Artificial Sequence
  chemically synthesized
catctcttcttttttctcattc

SEQ ID NO: 1050431 - DNA, 22 bp, Artificial Sequence
  chemically synthesized
ccatctcttcttttttctcatt

SEQ ID NO: 1050432 - DNA, 22 bp, Artificial Sequence
  chemically synthesized
caaatcttccatctcttctttt

SEQ ID NO: 1050433 - DNA, 22 bp, Artificial Sequence
  chemically synthesized
ttacaaatcttccatctcttct

SEQ ID NO: 1050434 - DNA, 22 bp, Artificial Sequence
  chemically synthesized
attattacaaatcttccatctc

SEQ ID NO: 1050435 - DNA, 22 bp, Artificial Sequence
  chemically synthesized
aattattacaaatcttccatct

SEQ ID NO: 1050436 - DNA, 22 bp, Artificial Sequence
  chemically synthesized
taattattacaaatcttccatc

SEQ ID NO: 1050437 - DNA, 22 bp, Artificial Sequence
  chemically synthesized
ttttaattattacaaatcttcc

SEQ ID NO: 1050438 - DNA, 22 bp, Artificial Sequence
  chemically synthesized
tgattgttttaattattacaaa

SEQ ID NO: 1050439 - DNA, 22 bp, Artificial Sequence
  chemically synthesized
ttatgattgttttaattattac

SEQ ID NO: 1050440 - DNA, 22 bp, Artificial Sequence
  chemically synthesized
tattatgattgttttaattatt

SEQ ID NO: 1050441 - DNA, 22 bp, Artificial Sequence
  chemically synthesized
ctattatgattgttttaattat

SEQ ID NO: 1050442 - DNA, 22 bp, Artificial Sequence
  chemically synthesized
tctattatgattgttttaatta

SEQ ID NO: 1050443 - DNA, 22 bp, Artificial Sequence
  chemically synthesized
gtaataattaaaacaatcataa

SEQ ID NO: 1050444 - DNA, 22 bp, Artificial Sequence
  chemically synthesized
gaaaattttctattatgattgt

SEQ ID NO: 1050445 - DNA, 22 bp, Artificial Sequence
  chemically synthesized
taataattaaaacaatcataat

SEQ ID NO: 1050446 - DNA, 22 bp, Artificial Sequence
  chemically synthesized
tggaaaattttctattatgatt

SEQ ID NO: 1050447 - DNA, 22 bp, Artificial Sequence
  chemically synthesized
gctctggaaaattttctattat

SEQ ID NO: 1050448 - DNA, 22 bp, Artificial Sequence
  chemically synthesized
agctctggaaaattttctatta

SEQ ID NO: 1050449 - DNA, 22 bp, Artificial Sequence
  chemically synthesized
tagctctggaaaattttctatt

SEQ ID NO: 1050450 - DNA, 22 bp, Artificial Sequence
  chemically synthesized
aaacaatcataatagaaaattt

SEQ ID NO: 1050451 - DNA, 22 bp, Artificial Sequence
  chemically synthesized
tttagctctggaaaattttcta

SEQ ID NO: 1050452 - DNA, 22 bp, Artificial Sequence
  chemically synthesized
ctttagctctggaaaattttct

SEQ ID NO: 1050453 - DNA, 22 bp, Artificial Sequence
  chemically synthesized
ataacttctttagctctggaaa

SEQ ID NO: 1050454 - DNA, 22 bp, Artificial Sequence
  chemically synthesized
atattaataacttctttagctc

SEQ ID NO: 1050455 - DNA, 22 bp, Artificial Sequence
  chemically synthesized
tccagagctaaagaagttatta

SEQ ID NO: 1050456 - DNA, 22 bp, Artificial Sequence
  chemically synthesized
ccagagctaaagaagttattaa

SEQ ID NO: 1050457 - DNA, 22 bp, Artificial Sequence
  chemically synthesized
cagagctaaagaagttattaat

SEQ ID NO: 1050458 - DNA, 22 bp, Artificial Sequence
  chemically synthesized
aataaccaattaatattaataa

SEQ ID NO: 1050459 - DNA, 22 bp, Artificial Sequence
  chemically synthesized
aaataaccaattaatattaata

SEQ ID NO: 1050460 - DNA, 22 bp, Artificial Sequence
  chemically synthesized
taaataaccaattaatattaat

SEQ ID NO: 1050461 - DNA, 22 bp, Artificial Sequence
  chemically synthesized
aagaagttattaatattaattg

SEQ ID NO: 1050462 - DNA, 22 bp, Artificial Sequence
  chemically synthesized
ggtaacgttttaaataaccaat

SEQ ID NO: 1050463 - DNA, 22 bp, Artificial Sequence
  chemically synthesized
gggtaacgttttaaataaccaa

SEQ ID NO: 1050464 - DNA, 22 bp, Artificial Sequence
  chemically synthesized
ttaatattaattggttatttaa

SEQ ID NO: 1050465 - DNA, 22 bp, Artificial Sequence
  chemically synthesized
atattaattggttatttaaaac

SEQ ID NO: 1050466 - DNA, 22 bp, Artificial Sequence
  chemically synthesized
cacttgggtaacgttttaaata

SEQ ID NO: 1050467 - DNA, 22 bp, Artificial Sequence
  chemically synthesized
gcacttgggtaacgttttaaat

SEQ ID NO: 1050468 - DNA, 22 bp, Artificial Sequence
  chemically synthesized
tgcacttgggtaacgttttaaa

SEQ ID NO: 1050469 - DNA, 22 bp, Artificial Sequence
  chemically synthesized
ttgcacttgggtaacgttttaa

SEQ ID NO: 1050470 - DNA, 22 bp, Artificial Sequence
  chemically synthesized
tttgcacttgggtaacgtttta

SEQ ID NO: 1050471 - DNA, 22 bp, Artificial Sequence
  chemically synthesized
ttttgcacttgggtaacgtttt

SEQ ID NO: 1050472 - DNA, 22 bp, Artificial Sequence
  chemically synthesized
attggttatttaaaacgttacc

SEQ ID NO: 1050473 - DNA, 22 bp, Artificial Sequence
  chemically synthesized
ttttttgcacttgggtaacgtt

SEQ ID NO: 1050474 - DNA, 22 bp, Artificial Sequence
  chemically synthesized
gttatttaaaacgttacccaag

SEQ ID NO: 1050475 - DNA, 22 bp, Artificial Sequence
  chemically synthesized
attcttttttgcacttgggtaa

SEQ ID NO: 1050476 - DNA, 22 bp, Artificial Sequence
  chemically synthesized
aattcttttttgcacttgggta

SEQ ID NO: 1050477 - DNA, 22 bp, Artificial Sequence
  chemically synthesized
tttaaaacgttacccaagtgca

SEQ ID NO: 1050478 - DNA, 22 bp, Artificial Sequence
  chemically synthesized
tttaattcttttttgcacttgg

SEQ ID NO: 1050479 - DNA, 22 bp, Artificial Sequence
  chemically synthesized
atttaattcttttttgcacttg

SEQ ID NO: 1050480 - DNA, 22 bp, Artificial Sequence
  chemically synthesized
aaaacgttacccaagtgcaaaa

SEQ ID NO: 1050481 - DNA, 22 bp, Artificial Sequence
  chemically synthesized
aaacgttacccaagtgcaaaaa

SEQ ID NO: 1050482 - DNA, 22 bp, Artificial Sequence
  chemically synthesized
cccaagtgcaaaaaagaattaa

SEQ ID NO: 1050483 - DNA, 22 bp, Artificial Sequence
  chemically synthesized
tgacccaccacttatttaattc

SEQ ID NO: 1050484 - DNA, 22 bp, Artificial Sequence
  chemically synthesized
agttgtgacccaccacttattt

SEQ ID NO: 1050485 - DNA, 22 bp, Artificial Sequence
  chemically synthesized
cagttgtgacccaccacttatt

SEQ ID NO: 1050486 - DNA, 22 bp, Artificial Sequence
  chemically synthesized
ggatttcagttgtgacccacca

SEQ ID NO: 1050487 - DNA, 22 bp, Artificial Sequence
  chemically synthesized
aataagtggtgggtcacaactg

SEQ ID NO: 1050488 - DNA, 22 bp, Artificial Sequence
  chemically synthesized
aagtgctgggatttcagttgtg

SEQ ID NO: 1050489 - DNA, 22 bp, Artificial Sequence
  chemically synthesized
ctaaagtgctgggatttcagtt

SEQ ID NO: 1050490 - DNA, 22 bp, Artificial Sequence
  chemically synthesized
agcctcctaaagtgctgggatt

SEQ ID NO: 1050491 - DNA, 22 bp, Artificial Sequence
  chemically synthesized
acctcagcctcctaaagtgctg

SEQ ID NO: 1050492 - DNA, 22 bp, Artificial Sequence
  chemically synthesized
tcacctcagcctcctaaagtgc

SEQ ID NO: 1050493 - DNA, 22 bp, Artificial Sequence
  chemically synthesized
ctcacctcagcctcctaaagtg

SEQ ID NO: 1050494 - DNA, 22 bp, Artificial Sequence
  chemically synthesized
aaatcccagcactttaggaggc

SEQ ID NO: 1050495 - DNA, 22 bp, Artificial Sequence
  chemically synthesized
gaatcaagtaatcttctcacct

SEQ ID NO: 1050496 - DNA, 22 bp, Artificial Sequence
  chemically synthesized
taggaggctgaggtgagaagat

SEQ ID NO: 1050497 - DNA, 22 bp, Artificial Sequence
  chemically synthesized
aggaggctgaggtgagaagatt

SEQ ID NO: 1050498 - DNA, 22 bp, Artificial Sequence
  chemically synthesized
ctggaatcaagtaatcttctca

SEQ ID NO: 1050499 - DNA, 22 bp, Artificial Sequence
  chemically synthesized
ggaggctgaggtgagaagatta

SEQ ID NO: 1050500 - DNA, 22 bp, Artificial Sequence
  chemically synthesized
aactcctggaatcaagtaatct

SEQ ID NO: 1050501 - DNA, 22 bp, Artificial Sequence
  chemically synthesized
gaactcctggaatcaagtaatc

SEQ ID NO: 1050502 - DNA, 22 bp, Artificial Sequence
  chemically synthesized
aggtgagaagattacttgattc

SEQ ID NO: 1050503 - DNA, 22 bp, Artificial Sequence
  chemically synthesized
gtcttgaactcctggaatcaag

SEQ ID NO: 1050504 - DNA, 22 bp, Artificial Sequence
  chemically synthesized
cccaggctggtcttgaactcct

SEQ ID NO: 1050505 - DNA, 22 bp, Artificial Sequence
  chemically synthesized
cttgattccaggagttcaagac

SEQ ID NO: 1050506 - DNA, 22 bp, Artificial Sequence
  chemically synthesized
tgttgcccaggctggtcttgaa

SEQ ID NO: 1050507 - DNA, 22 bp, Artificial Sequence
  chemically synthesized
gattccaggagttcaagaccag

SEQ ID NO: 1050508 - DNA, 22 bp, Artificial Sequence
  chemically synthesized
attccaggagttcaagaccagc

SEQ ID NO: 1050509 - DNA, 22 bp, Artificial Sequence
  chemically synthesized
caggagttcaagaccagcctgg

SEQ ID NO: 1050510 - DNA, 22 bp, Artificial Sequence
  chemically synthesized
aagaccagcctgggcaacataa

SEQ ID NO: 1050511 - DNA, 22 bp, Artificial Sequence
  chemically synthesized
tagagatgatgtgtcattatgt

SEQ ID NO: 1050512 - DNA, 22 bp, Artificial Sequence
  chemically synthesized
gtagagatgatgtgtcattatg

SEQ ID NO: 1050513 - DNA, 22 bp, Artificial Sequence
  chemically synthesized
tttgtagagatgatgtgtcatt

SEQ ID NO: 1050514 - DNA, 22 bp, Artificial Sequence
  chemically synthesized
gtttgtagagatgatgtgtcat

SEQ ID NO: 1050515 - DNA, 22 bp, Artificial Sequence
  chemically synthesized
ggcaacataatgacacatcatc

SEQ ID NO: 1050516 - DNA, 22 bp, Artificial Sequence
  chemically synthesized
aaacatttgtttgtagagatga

SEQ ID NO: 1050517 - DNA, 22 bp, Artificial Sequence
  chemically synthesized
aaaacatttgtttgtagagatg

SEQ ID NO: 1050518 - DNA, 22 bp, Artificial Sequence
  chemically synthesized
taaaacatttgtttgtagagat

SEQ ID NO: 1050519 - DNA, 22 bp, Artificial Sequence
  chemically synthesized
ttaaaacatttgtttgtagaga

SEQ ID NO: 1050520 - DNA, 22 bp, Artificial Sequence
  chemically synthesized
atttttaaaacatttgtttgta

SEQ ID NO: 1050521 - DNA, 22 bp, Artificial Sequence
  chemically synthesized
gctaatttttaaaacatttgtt

SEQ ID NO: 1050522 - DNA, 22 bp, Artificial Sequence
  chemically synthesized
tacaaacaaatgttttaaaaat

SEQ ID NO: 1050523 - DNA, 22 bp, Artificial Sequence
  chemically synthesized
caaacaaatgttttaaaaatta

SEQ ID NO: 1050524 - DNA, 22 bp, Artificial Sequence
  chemically synthesized
caggccatcagtaccatgactg

SEQ ID NO: 1050525 - DNA, 22 bp, Artificial Sequence
  chemically synthesized
taaaaattagccagtcatggta

SEQ ID NO: 1050526 - DNA, 22 bp, Artificial Sequence
  chemically synthesized
aaaaattagccagtcatggtac

SEQ ID NO: 1050527 - DNA, 22 bp, Artificial Sequence
  chemically synthesized
aaaattagccagtcatggtact

SEQ ID NO: 1050528 - DNA, 22 bp, Artificial Sequence
  chemically synthesized
ggactacaggccatcagtacca

SEQ ID NO: 1050529 - DNA, 22 bp, Artificial Sequence
  chemically synthesized
gccagtcatggtactgatggcc

SEQ ID NO: 1050530 - DNA, 22 bp, Artificial Sequence
  chemically synthesized
gtggctgggactacaggccatc

SEQ ID NO: 1050531 - DNA, 22 bp, Artificial Sequence
  chemically synthesized
agtggctgggactacaggccat

SEQ ID NO: 1050532 - DNA, 22 bp, Artificial Sequence
  chemically synthesized
tagtggctgggactacaggcca

SEQ ID NO: 1050533 - DNA, 22 bp, Artificial Sequence
  chemically synthesized
tttagtggctgggactacaggc

SEQ ID NO: 1050534 - DNA, 22 bp, Artificial Sequence
  chemically synthesized
agcctctttagtggctgggact

SEQ ID NO: 1050535 - DNA, 22 bp, Artificial Sequence
  chemically synthesized
atggcctgtagtcccagccact

SEQ ID NO: 1050536 - DNA, 22 bp, Artificial Sequence
  chemically synthesized
cctcagcctctttagtggctgg

SEQ ID NO: 1050537 - DNA, 22 bp, Artificial Sequence
  chemically synthesized
ttgcctcagcctctttagtggc

SEQ ID NO: 1050538 - DNA, 22 bp, Artificial Sequence
  chemically synthesized
tagtcccagccactaaagaggc

SEQ ID NO: 1050539 - DNA, 22 bp, Artificial Sequence
  chemically synthesized
aggagatcctattgcctcagcc

SEQ ID NO: 1050540 - DNA, 22 bp, Artificial Sequence
  chemically synthesized
ggctcaggagatcctattgcct

SEQ ID NO: 1050541 - DNA, 22 bp, Artificial Sequence
  chemically synthesized
aagaggctgaggcaataggatc

SEQ ID NO: 1050542 - DNA, 22 bp, Artificial Sequence
  chemically synthesized
ctaggctcaggagatcctattg

SEQ ID NO: 1050543 - DNA, 22 bp, Artificial Sequence
  chemically synthesized
aggcaataggatctcctgagcc

SEQ ID NO: 1050544 - DNA, 22 bp, Artificial Sequence
  chemically synthesized
cagccaccaactcctaggctca

SEQ ID NO: 1050545 - DNA, 22 bp, Artificial Sequence
  chemically synthesized
actgcagccaccaactcctagg

SEQ ID NO: 1050546 - DNA, 22 bp, Artificial Sequence
  chemically synthesized
ctgagcctaggagttggtggct

SEQ ID NO: 1050547 - DNA, 22 bp, Artificial Sequence
  chemically synthesized
agcctaggagttggtggctgca

SEQ ID NO: 1050548 - DNA, 22 bp, Artificial Sequence
  chemically synthesized
ggagttggtggctgcagtgagc

SEQ ID NO: 1050549 - DNA, 22 bp, Artificial Sequence
  chemically synthesized
gtggctgcagtgagctatgatt

SEQ ID NO: 1050550 - DNA, 22 bp, Artificial Sequence
  chemically synthesized
gagtgccgcgatgcaatcatag

SEQ ID NO: 1050551 - DNA, 22 bp, Artificial Sequence
  chemically synthesized
cagtgagctatgattgcatcgc

SEQ ID NO: 1050552 - DNA, 22 bp, Artificial Sequence
  chemically synthesized
cccaagctggagtgccgcgatg

SEQ ID NO: 1050553 - DNA, 22 bp, Artificial Sequence
  chemically synthesized
ttgcccaagctggagtgccgcg

SEQ ID NO: 1050554 - DNA, 22 bp, Artificial Sequence
  chemically synthesized
tgattgcatcgcggcactccag

SEQ ID NO: 1050555 - DNA, 22 bp, Artificial Sequence
  chemically synthesized
ctattgcccaagctggagtgcc

SEQ ID NO: 1050556 - DNA, 22 bp, Artificial Sequence
  chemically synthesized
gctattgcccaagctggagtgc

SEQ ID NO: 1050557 - DNA, 22 bp, Artificial Sequence
  chemically synthesized
catcgcggcactccagcttggg

SEQ ID NO: 1050558 - DNA, 22 bp, Artificial Sequence
  chemically synthesized
agacagggtcttgctattgccc

SEQ ID NO: 1050559 - DNA, 22 bp, Artificial Sequence
  chemically synthesized
gagacagggtcttgctattgcc

SEQ ID NO: 1050560 - DNA, 22 bp, Artificial Sequence
  chemically synthesized
tgagacagggtcttgctattgc

SEQ ID NO: 1050561 - DNA, 22 bp, Artificial Sequence
  chemically synthesized
ttgagacagggtcttgctattg

SEQ ID NO: 1050562 - DNA, 22 bp, Artificial Sequence
  chemically synthesized
cagcttgggcaatagcaagacc

SEQ ID NO: 1050563 - DNA, 22 bp, Artificial Sequence
  chemically synthesized
tttttgagacagggtcttgcta

SEQ ID NO: 1050564 - DNA, 22 bp, Artificial Sequence
  chemically synthesized
atttttgagacagggtcttgct

SEQ ID NO: 1050565 - DNA, 22 bp, Artificial Sequence
  chemically synthesized
tatttttgagacagggtcttgc

SEQ ID NO: 1050566 - DNA, 22 bp, Artificial Sequence
  chemically synthesized
ttatttttgagacagggtcttg

SEQ ID NO: 1050567 - DNA, 22 bp, Artificial Sequence
  chemically synthesized
gggcaatagcaagaccctgtct

SEQ ID NO: 1050568 - DNA, 22 bp, Artificial Sequence
  chemically synthesized
tttttatttttgagacagggtc

SEQ ID NO: 1050569 - DNA, 22 bp, Artificial Sequence
  chemically synthesized
ggcaatagcaagaccctgtctc

SEQ ID NO: 1050570 - DNA, 22 bp, Artificial Sequence
  chemically synthesized
gtttttatttttgagacagggt

SEQ ID NO: 1050571 - DNA, 22 bp, Artificial Sequence
  chemically synthesized
tgtttttatttttgagacaggg

SEQ ID NO: 1050572 - DNA, 22 bp, Artificial Sequence
  chemically synthesized
ttttgtttttatttttgagaca

SEQ ID NO: 1050573 - DNA, 22 bp, Artificial Sequence
  chemically synthesized
attttgtttttatttttgagac

SEQ ID NO: 1050574 - DNA, 22 bp, Artificial Sequence
  chemically synthesized
tattttgtttttatttttgaga

SEQ ID NO: 1050575 - DNA, 22 bp, Artificial Sequence
  chemically synthesized
ttttattttgtttttatttttg

SEQ ID NO: 1050576 - DNA, 22 bp, Artificial Sequence
  chemically synthesized
attttattttgtttttattttt

SEQ ID NO: 1050577 - DNA, 22 bp, Artificial Sequence
  chemically synthesized
tattttattttgtttttatttt

SEQ ID NO: 1050578 - DNA, 22 bp, Artificial Sequence
  chemically synthesized
ttttattttattttgtttttat

SEQ ID NO: 1050579 - DNA, 22 bp, Artificial Sequence
  chemically synthesized
attttattttattttgttttta

SEQ ID NO: 1050580 - DNA, 22 bp, Artificial Sequence
  chemically synthesized
tattttattttattttgttttt

SEQ ID NO: 1050581 - DNA, 22 bp, Artificial Sequence
  chemically synthesized
tctcaaaaataaaaacaaaata

SEQ ID NO: 1050582 - DNA, 22 bp, Artificial Sequence
  chemically synthesized
ttttattttattttattttgtt

SEQ ID NO: 1050583 - DNA, 22 bp, Artificial Sequence
  chemically synthesized
aaaaataaaaacaaaataaaat

SEQ ID NO: 1050584 - DNA, 22 bp, Artificial Sequence
  chemically synthesized
ttattttattttattttatttt

SEQ ID NO: 1050585 - DNA, 22 bp, Artificial Sequence
  chemically synthesized
attattttattttattttattt

SEQ ID NO: 1050586 - DNA, 22 bp, Artificial Sequence
  chemically synthesized
tttattattttattttatttta

SEQ ID NO: 1050587 - DNA, 22 bp, Artificial Sequence
  chemically synthesized
aatgtgtccctgtttattattt

SEQ ID NO: 1050588 - DNA, 22 bp, Artificial Sequence
  chemically synthesized
taaatgtgtccctgtttattat

SEQ ID NO: 1050589 - DNA, 22 bp, Artificial Sequence
  chemically synthesized
ctaaatgtgtccctgtttatta

SEQ ID NO: 1050590 - DNA, 22 bp, Artificial Sequence
  chemically synthesized
aatgtttctaaatgtgtccctg

SEQ ID NO: 1050591 - DNA, 22 bp, Artificial Sequence
  chemically synthesized
aaatgtttctaaatgtgtccct

SEQ ID NO: 1050592 - DNA, 22 bp, Artificial Sequence
  chemically synthesized
taaatgtttctaaatgtgtccc

SEQ ID NO: 1050593 - DNA, 22 bp, Artificial Sequence
  chemically synthesized
agatataattttaaatgtttct

SEQ ID NO: 1050594 - DNA, 22 bp, Artificial Sequence
  chemically synthesized
attaagatataattttaaatgt

SEQ ID NO: 1050595 - DNA, 22 bp, Artificial Sequence
  chemically synthesized
cattaagatataattttaaatg

SEQ ID NO: 1050596 - DNA, 22 bp, Artificial Sequence
  chemically synthesized
agaaacatttaaaattatatct

SEQ ID NO: 1050597 - DNA, 22 bp, Artificial Sequence
  chemically synthesized
gaaacatttaaaattatatctt

SEQ ID NO: 1050598 - DNA, 22 bp, Artificial Sequence
  chemically synthesized
aagtacagaaatttcattaaga

SEQ ID NO: 1050599 - DNA, 22 bp, Artificial Sequence
  chemically synthesized
aaaattatatcttaatgaaatt

SEQ ID NO: 1050600 - DNA, 22 bp, Artificial Sequence
  chemically synthesized
ttgaagtacagaaatttcatta

SEQ ID NO: 1050601 - DNA, 22 bp, Artificial Sequence
  chemically synthesized
aaattatatcttaatgaaattt

SEQ ID NO: 1050602 - DNA, 22 bp, Artificial Sequence
  chemically synthesized
tatcttaatgaaatttctgtac

SEQ ID NO: 1050603 - DNA, 22 bp, Artificial Sequence
  chemically synthesized
tcccatctattgaagtacagaa

SEQ ID NO: 1050604 - DNA, 22 bp, Artificial Sequence
  chemically synthesized
aatgaaatttctgtacttcaat

SEQ ID NO: 1050605 - DNA, 22 bp, Artificial Sequence
  chemically synthesized
tctgtcccatctattgaagtac

SEQ ID NO: 1050606 - DNA, 22 bp, Artificial Sequence
  chemically synthesized
atgaaatttctgtacttcaata

SEQ ID NO: 1050607 - DNA, 22 bp, Artificial Sequence
  chemically synthesized
ctgtctgtcccatctattgaag

SEQ ID NO: 1050608 - DNA, 22 bp, Artificial Sequence
  chemically synthesized
aagttgctgtctgtcccatcta

SEQ ID NO: 1050609 - DNA, 22 bp, Artificial Sequence
  chemically synthesized
ctgtacttcaatagatgggaca

SEQ ID NO: 1050610 - DNA, 22 bp, Artificial Sequence
  chemically synthesized
tgtacttcaatagatgggacag

SEQ ID NO: 1050611 - DNA, 22 bp, Artificial Sequence
  chemically synthesized
taaagttgctgtctgtcccatc

SEQ ID NO: 1050612 - DNA, 22 bp, Artificial Sequence
  chemically synthesized
tacttcaatagatgggacagac

SEQ ID NO: 1050613 - DNA, 22 bp, Artificial Sequence
  chemically synthesized
aaactctaaagttgctgtctgt

SEQ ID NO: 1050614 - DNA, 22 bp, Artificial Sequence
  chemically synthesized
caatagatgggacagacagcaa

SEQ ID NO: 1050615 - DNA, 22 bp, Artificial Sequence
  chemically synthesized
aatagatgggacagacagcaac

SEQ ID NO: 1050616 - DNA, 22 bp, Artificial Sequence
  chemically synthesized
tcaaactctaaagttgctgtct

SEQ ID NO: 1050617 - DNA, 22 bp, Artificial Sequence
  chemically synthesized
tctcaaactctaaagttgctgt

SEQ ID NO: 1050618 - DNA, 22 bp, Artificial Sequence
  chemically synthesized
ctctcaaactctaaagttgctg

SEQ ID NO: 1050619 - DNA, 22 bp, Artificial Sequence
  chemically synthesized
tctctcaaactctaaagttgct

SEQ ID NO: 1050620 - DNA, 22 bp, Artificial Sequence
  chemically synthesized
tttctctcaaactctaaagttg

SEQ ID NO: 1050621 - DNA, 22 bp, Artificial Sequence
  chemically synthesized
ctttctctcaaactctaaagtt

SEQ ID NO: 1050622 - DNA, 22 bp, Artificial Sequence
  chemically synthesized
tctttctctcaaactctaaagt

SEQ ID NO: 1050623 - DNA, 22 bp, Artificial Sequence
  chemically synthesized
ttctttctctcaaactctaaag

SEQ ID NO: 1050624 - DNA, 22 bp, Artificial Sequence
  chemically synthesized
tttctttctctcaaactctaaa

SEQ ID NO: 1050625 - DNA, 22 bp, Artificial Sequence
  chemically synthesized
ttttctttctctcaaactctaa

SEQ ID NO: 1050626 - DNA, 22 bp, Artificial Sequence
  chemically synthesized
accttttttctttctctcaaac

SEQ ID NO: 1050627 - DNA, 22 bp, Artificial Sequence
  chemically synthesized
aaccttttttctttctctcaaa

SEQ ID NO: 1050628 - DNA, 22 bp, Artificial Sequence
  chemically synthesized
tatttaaccttttttctttctc

SEQ ID NO: 1050629 - DNA, 22 bp, Artificial Sequence
  chemically synthesized
gtatttaaccttttttctttct

SEQ ID NO: 1050630 - DNA, 22 bp, Artificial Sequence
  chemically synthesized
tagagtttgagagaaagaaaaa

SEQ ID NO: 1050631 - DNA, 22 bp, Artificial Sequence
  chemically synthesized
agagtttgagagaaagaaaaaa

SEQ ID NO: 1050632 - DNA, 22 bp, Artificial Sequence
  chemically synthesized
gagtttgagagaaagaaaaaag

SEQ ID NO: 1050633 - DNA, 22 bp, Artificial Sequence
  chemically synthesized
tttgtatttaaccttttttctt

SEQ ID NO: 1050634 - DNA, 22 bp, Artificial Sequence
  chemically synthesized
atttgtatttaaccttttttct

SEQ ID NO: 1050635 - DNA, 22 bp, Artificial Sequence
  chemically synthesized
gagagaaagaaaaaaggttaaa

SEQ ID NO: 1050636 - DNA, 22 bp, Artificial Sequence
  chemically synthesized
agagaaagaaaaaaggttaaat

SEQ ID NO: 1050637 - DNA, 22 bp, Artificial Sequence
  chemically synthesized
gtccaagtatcatttatttgta

SEQ ID NO: 1050638 - DNA, 22 bp, Artificial Sequence
  chemically synthesized
tagtccaagtatcatttatttg

SEQ ID NO: 1050639 - DNA, 22 bp, Artificial Sequence
  chemically synthesized
attctagtccaagtatcattta

SEQ ID NO: 1050640 - DNA, 22 bp, Artificial Sequence
  chemically synthesized
aatacaaataaatgatacttgg

SEQ ID NO: 1050641 - DNA, 22 bp, Artificial Sequence
  chemically synthesized
cagtgtaaagtctgattctagt

SEQ ID NO: 1050642 - DNA, 22 bp, Artificial Sequence
  chemically synthesized
ccagtgtaaagtctgattctag

SEQ ID NO: 1050643 - DNA, 22 bp, Artificial Sequence
  chemically synthesized
tttccagtgtaaagtctgattc

SEQ ID NO: 1050644 - DNA, 22 bp, Artificial Sequence
  chemically synthesized
ttgtttccagtgtaaagtctga

SEQ ID NO: 1050645 - DNA, 22 bp, Artificial Sequence
  chemically synthesized
ggactagaatcagactttacac

SEQ ID NO: 1050646 - DNA, 22 bp, Artificial Sequence
  chemically synthesized
ctattgtttccagtgtaaagtc

SEQ ID NO: 1050647 - DNA, 22 bp, Artificial Sequence
  chemically synthesized
gactagaatcagactttacact

SEQ ID NO: 1050648 - DNA, 22 bp, Artificial Sequence
  chemically synthesized
gaatcagactttacactggaaa

SEQ ID NO: 1050649 - DNA, 22 bp, Artificial Sequence
  chemically synthesized
aagctactattgtttccagtgt

SEQ ID NO: 1050650 - DNA, 22 bp, Artificial Sequence
  chemically synthesized
caagctactattgtttccagtg

SEQ ID NO: 1050651 - DNA, 22 bp, Artificial Sequence
  chemically synthesized
tcttcaagctactattgtttcc

SEQ ID NO: 1050652 - DNA, 22 bp, Artificial Sequence
  chemically synthesized
aactatcttcaagctactattg

SEQ ID NO: 1050653 - DNA, 22 bp, Artificial Sequence
  chemically synthesized
tacactggaaacaatagtagct

SEQ ID NO: 1050654 - DNA, 22 bp, Artificial Sequence
  chemically synthesized
caactatcttcaagctactatt

SEQ ID NO: 1050655 - DNA, 22 bp, Artificial Sequence
  chemically synthesized
acactggaaacaatagtagctt

SEQ ID NO: 1050656 - DNA, 22 bp, Artificial Sequence
  chemically synthesized
cactggaaacaatagtagcttg

SEQ ID NO: 1050657 - DNA, 22 bp, Artificial Sequence
  chemically synthesized
tttcaactatcttcaagctact

SEQ ID NO: 1050658 - DNA, 22 bp, Artificial Sequence
  chemically synthesized
gtttcaactatcttcaagctac

SEQ ID NO: 1050659 - DNA, 22 bp, Artificial Sequence
  chemically synthesized
ttgtttcaactatcttcaagct

SEQ ID NO: 1050660 - DNA, 22 bp, Artificial Sequence
  chemically synthesized
gaaacaatagtagcttgaagat

SEQ ID NO: 1050661 - DNA, 22 bp, Artificial Sequence
  chemically synthesized
cttgtttcaactatcttcaagc

SEQ ID NO: 1050662 - DNA, 22 bp, Artificial Sequence
  chemically synthesized
tcttgtttcaactatcttcaag

SEQ ID NO: 1050663 - DNA, 22 bp, Artificial Sequence
  chemically synthesized
ttttcttgtttcaactatcttc

SEQ ID NO: 1050664 - DNA, 22 bp, Artificial Sequence
  chemically synthesized
cattgttttcttgtttcaacta

SEQ ID NO: 1050665 - DNA, 22 bp, Artificial Sequence
  chemically synthesized
ccattgttttcttgtttcaact

SEQ ID NO: 1050666 - DNA, 22 bp, Artificial Sequence
  chemically synthesized
gaagatagttgaaacaagaaaa

SEQ ID NO: 1050667 - DNA, 22 bp, Artificial Sequence
  chemically synthesized
cagtttccattgttttcttgtt

SEQ ID NO: 1050668 - DNA, 22 bp, Artificial Sequence
  chemically synthesized
aagatagttgaaacaagaaaac

SEQ ID NO: 1050669 - DNA, 22 bp, Artificial Sequence
  chemically synthesized
ccagtttccattgttttcttgt

SEQ ID NO: 1050670 - DNA, 22 bp, Artificial Sequence
  chemically synthesized
tcttccagtttccattgttttc

SEQ ID NO: 1050671 - DNA, 22 bp, Artificial Sequence
  chemically synthesized
aaacaagaaaacaatggaaact

SEQ ID NO: 1050672 - DNA, 22 bp, Artificial Sequence
  chemically synthesized
tgaacaattgtcttccagtttc

SEQ ID NO: 1050673 - DNA, 22 bp, Artificial Sequence
  chemically synthesized
taggttatgaacaattgtcttc

SEQ ID NO: 1050674 - DNA, 22 bp, Artificial Sequence
  chemically synthesized
tgtaggttatgaacaattgtct

SEQ ID NO: 1050675 - DNA, 22 bp, Artificial Sequence
  chemically synthesized
gtagtctctgtaggttatgaac

SEQ ID NO: 1050676 - DNA, 22 bp, Artificial Sequence
  chemically synthesized
agtagtctctgtaggttatgaa

SEQ ID NO: 1050677 - DNA, 22 bp, Artificial Sequence
  chemically synthesized
gaagacaattgttcataaccta

SEQ ID NO: 1050678 - DNA, 22 bp, Artificial Sequence
  chemically synthesized
tagtagtctctgtaggttatga

SEQ ID NO: 1050679 - DNA, 22 bp, Artificial Sequence
  chemically synthesized
ttagtagtctctgtaggttatg

SEQ ID NO: 1050680 - DNA, 22 bp, Artificial Sequence
  chemically synthesized
tttagtagtctctgtaggttat

SEQ ID NO: 1050681 - DNA, 22 bp, Artificial Sequence
  chemically synthesized
ttttagtagtctctgtaggtta

SEQ ID NO: 1050682 - DNA, 22 bp, Artificial Sequence
  chemically synthesized
tttttagtagtctctgtaggtt

SEQ ID NO: 1050683 - DNA, 22 bp, Artificial Sequence
  chemically synthesized
tttttttagtagtctctgtagg

SEQ ID NO: 1050684 - DNA, 22 bp, Artificial Sequence
  chemically synthesized
ctctttttttagtagtctctgt

SEQ ID NO: 1050685 - DNA, 22 bp, Artificial Sequence
  chemically synthesized
ttcataacctacagagactact

SEQ ID NO: 1050686 - DNA, 22 bp, Artificial Sequence
  chemically synthesized
tcctctttttttagtagtctct

SEQ ID NO: 1050687 - DNA, 22 bp, Artificial Sequence
  chemically synthesized
ataacctacagagactactaaa

SEQ ID NO: 1050688 - DNA, 22 bp, Artificial Sequence
  chemically synthesized
atatctctcctctttttttagt

SEQ ID NO: 1050689 - DNA, 22 bp, Artificial Sequence
  chemically synthesized
aatatctctcctctttttttag

SEQ ID NO: 1050690 - DNA, 22 bp, Artificial Sequence
  chemically synthesized
taatatctctcctcttttttta

SEQ ID NO: 1050691 - DNA, 22 bp, Artificial Sequence
  chemically synthesized
cagagactactaaaaaaagagg

SEQ ID NO: 1050692 - DNA, 22 bp, Artificial Sequence
  chemically synthesized
tttaatatctctcctctttttt

SEQ ID NO: 1050693 - DNA, 22 bp, Artificial Sequence
  chemically synthesized
ctaaaaaaagaggagagatatt

SEQ ID NO: 1050694 - DNA, 22 bp, Artificial Sequence
  chemically synthesized
aaaaaagaggagagatattaaa

SEQ ID NO: 1050695 - DNA, 22 bp, Artificial Sequence
  chemically synthesized
gatagtaacattctttaatatc

SEQ ID NO: 1050696 - DNA, 22 bp, Artificial Sequence
  chemically synthesized
ttggatagtaacattctttaat

SEQ ID NO: 1050697 - DNA, 22 bp, Artificial Sequence
  chemically synthesized
attggatagtaacattctttaa

SEQ ID NO: 1050698 - DNA, 22 bp, Artificial Sequence
  chemically synthesized
aagaatgttactatccaataaa

SEQ ID NO: 1050699 - DNA, 22 bp, Artificial Sequence
  chemically synthesized
cagtcatcatgatggatttatt

SEQ ID NO: 1050700 - DNA, 22 bp, Artificial Sequence
  chemically synthesized
gcagtcatcatgatggatttat

SEQ ID NO: 1050701 - DNA, 22 bp, Artificial Sequence
  chemically synthesized
tgcagtcatcatgatggattta

SEQ ID NO: 1050702 - DNA, 22 bp, Artificial Sequence
  chemically synthesized
ctttgcagtcatcatgatggat

SEQ ID NO: 1050703 - DNA, 22 bp, Artificial Sequence
  chemically synthesized
ctatccaataaatccatcatga

SEQ ID NO: 1050704 - DNA, 22 bp, Artificial Sequence
  chemically synthesized
gctttgcagtcatcatgatgga

SEQ ID NO: 1050705 - DNA, 22 bp, Artificial Sequence
  chemically synthesized
tgctttgcagtcatcatgatgg

SEQ ID NO: 1050706 - DNA, 22 bp, Artificial Sequence
  chemically synthesized
tccaataaatccatcatgatga

SEQ ID NO: 1050707 - DNA, 22 bp, Artificial Sequence
  chemically synthesized
gaaatgatctttgctttgcagt

SEQ ID NO: 1050708 - DNA, 22 bp, Artificial Sequence
  chemically synthesized
cgaaatgatctttgctttgcag

SEQ ID NO: 1050709 - DNA, 22 bp, Artificial Sequence
  chemically synthesized
tcgaaatgatctttgctttgca

SEQ ID NO: 1050710 - DNA, 22 bp, Artificial Sequence
  chemically synthesized
cattttcgaaatgatctttgct

SEQ ID NO: 1050711 - DNA, 22 bp, Artificial Sequence
  chemically synthesized
gcattttcgaaatgatctttgc

SEQ ID NO: 1050712 - DNA, 22 bp, Artificial Sequence
  chemically synthesized
caaagcaaagatcatttcgaaa

SEQ ID NO: 1050713 - DNA, 22 bp, Artificial Sequence
  chemically synthesized
taaaccttgcattttcgaaatg

SEQ ID NO: 1050714 - DNA, 22 bp, Artificial Sequence
  chemically synthesized
gtaaaccttgcattttcgaaat

SEQ ID NO: 1050715 - DNA, 22 bp, Artificial Sequence
  chemically synthesized
tgtaaaccttgcattttcgaaa

SEQ ID NO: 1050716 - DNA, 22 bp, Artificial Sequence
  chemically synthesized
cgaaaatgcaaggtttacaaag

SEQ ID NO: 1050717 - DNA, 22 bp, Artificial Sequence
  chemically synthesized
gaaaatgcaaggtttacaaagt

SEQ ID NO: 1050718 - DNA, 22 bp, Artificial Sequence
  chemically synthesized
gtaaaaacataaaggatgtaaa

SEQ ID NO: 1050719 - DNA, 22 bp, Artificial Sequence
  chemically synthesized
acaaagtttacatcctttatgt

SEQ ID NO: 1050720 - DNA, 22 bp, Artificial Sequence
  chemically synthesized
caaagtttacatcctttatgtt

SEQ ID NO: 1050721 - DNA, 22 bp, Artificial Sequence
  chemically synthesized
acatcctttatgtttttacgag

SEQ ID NO: 1050722 - DNA, 22 bp, Artificial Sequence
  chemically synthesized
catcctttatgtttttacgagg

SEQ ID NO: 1050723 - DNA, 22 bp, Artificial Sequence
  chemically synthesized
gaacacatgagaaatgtcctcg

SEQ ID NO: 1050724 - DNA, 22 bp, Artificial Sequence
  chemically synthesized
tatgtttttacgaggacatttc

SEQ ID NO: 1050725 - DNA, 22 bp, Artificial Sequence
  chemically synthesized
atgtttttacgaggacatttct

SEQ ID NO: 1050726 - DNA, 22 bp, Artificial Sequence
  chemically synthesized
tgtttttacgaggacatttctc

SEQ ID NO: 1050727 - DNA, 22 bp, Artificial Sequence
  chemically synthesized
gttggaacacatgagaaatgtc

SEQ ID NO: 1050728 - DNA, 22 bp, Artificial Sequence
  chemically synthesized
ggttggaacacatgagaaatgt

SEQ ID NO: 1050729 - DNA, 22 bp, Artificial Sequence
  chemically synthesized
ttacgaggacatttctcatgtg

SEQ ID NO: 1050730 - DNA, 22 bp, Artificial Sequence
  chemically synthesized
atttggttggaacacatgagaa

SEQ ID NO: 1050731 - DNA, 22 bp, Artificial Sequence
  chemically synthesized
tacgaggacatttctcatgtgt

SEQ ID NO: 1050732 - DNA, 22 bp, Artificial Sequence
  chemically synthesized
aatttggttggaacacatgaga

SEQ ID NO: 1050733 - DNA, 22 bp, Artificial Sequence
  chemically synthesized
acgaggacatttctcatgtgtt

SEQ ID NO: 1050734 - DNA, 22 bp, Artificial Sequence
  chemically synthesized
taatttggttggaacacatgag

SEQ ID NO: 1050735 - DNA, 22 bp, Artificial Sequence
  chemically synthesized
cgaggacatttctcatgtgttc

SEQ ID NO: 1050736 - DNA, 22 bp, Artificial Sequence
  chemically synthesized
agttttaatttggttggaacac

SEQ ID NO: 1050737 - DNA, 22 bp, Artificial Sequence
  chemically synthesized
cagttttaatttggttggaaca

SEQ ID NO: 1050738 - DNA, 22 bp, Artificial Sequence
  chemically synthesized
tacttcagttttaatttggttg

SEQ ID NO: 1050739 - DNA, 22 bp, Artificial Sequence
  chemically synthesized
ctcatgtgttccaaccaaatta

SEQ ID NO: 1050740 - DNA, 22 bp, Artificial Sequence
  chemically synthesized
tcatgtgttccaaccaaattaa

SEQ ID NO: 1050741 - DNA, 22 bp, Artificial Sequence
  chemically synthesized
atgtgttccaaccaaattaaaa

SEQ ID NO: 1050742 - DNA, 22 bp, Artificial Sequence
  chemically synthesized
caaccaaattaaaactgaagta

SEQ ID NO: 1050743 - DNA, 22 bp, Artificial Sequence
  chemically synthesized
aaactgaagtacagttggccct

SEQ ID NO: 1050744 - DNA, 22 bp, Artificial Sequence
  chemically synthesized
aagtacagttggccctctgtat

SEQ ID NO: 1050745 - DNA, 22 bp, Artificial Sequence
  chemically synthesized
gccctctgtatccatgggttcc

SEQ ID NO: 1050746 - DNA, 22 bp, Artificial Sequence
  chemically synthesized
aatccacaaatgtggaacccat

SEQ ID NO: 1050747 - DNA, 22 bp, Artificial Sequence
  chemically synthesized
gttaaatccacaaatgtggaac

SEQ ID NO: 1050748 - DNA, 22 bp, Artificial Sequence
  chemically synthesized
tgtatccatgggttccacattt

SEQ ID NO: 1050749 - DNA, 22 bp, Artificial Sequence
  chemically synthesized
tatccatgggttccacatttgt

SEQ ID NO: 1050750 - DNA, 22 bp, Artificial Sequence
  chemically synthesized
gatcgatgactggttaaatcca

SEQ ID NO: 1050751 - DNA, 22 bp, Artificial Sequence
  chemically synthesized
cacatttgtggatttaaccagt

SEQ ID NO: 1050752 - DNA, 22 bp, Artificial Sequence
  chemically synthesized
gtggatttaaccagtcatcgat

SEQ ID NO: 1050753 - DNA, 22 bp, Artificial Sequence
  chemically synthesized
caaatgtgttcgatcgatgact

SEQ ID NO: 1050754 - DNA, 22 bp, Artificial Sequence
  chemically synthesized
tggatttaaccagtcatcgatc

SEQ ID NO: 1050755 - DNA, 22 bp, Artificial Sequence
  chemically synthesized
gcaaatgtgttcgatcgatgac

SEQ ID NO: 1050756 - DNA, 22 bp, Artificial Sequence
  chemically synthesized
tgcaaatgtgttcgatcgatga

SEQ ID NO: 1050757 - DNA, 22 bp, Artificial Sequence
  chemically synthesized
ttgcaaatgtgttcgatcgatg

SEQ ID NO: 1050758 - DNA, 22 bp, Artificial Sequence
  chemically synthesized
aaccagtcatcgatcgaacaca

SEQ ID NO: 1050759 - DNA, 22 bp, Artificial Sequence
  chemically synthesized
accagtcatcgatcgaacacat

SEQ ID NO: 1050760 - DNA, 22 bp, Artificial Sequence
  chemically synthesized
agtgcagacacagccatccatg

SEQ ID NO: 1050761 - DNA, 22 bp, Artificial Sequence
  chemically synthesized
gcaaaaatacatggatggctgt

SEQ ID NO: 1050762 - DNA, 22 bp, Artificial Sequence
  chemically synthesized
caaaaatacatggatggctgtg

SEQ ID NO: 1050763 - DNA, 22 bp, Artificial Sequence
  chemically synthesized
tacatgttcagtgcagacacag

SEQ ID NO: 1050764 - DNA, 22 bp, Artificial Sequence
  chemically synthesized
tgtctgcactgaacatgtacag

SEQ ID NO: 1050765 - DNA, 22 bp, Artificial Sequence
  chemically synthesized
cactgaacatgtacagacattt

SEQ ID NO: 1050766 - DNA, 22 bp, Artificial Sequence
  chemically synthesized
aacatgtacagacatttttatt

SEQ ID NO: 1050767 - DNA, 22 bp, Artificial Sequence
  chemically synthesized
gggaataatggcaataaaaatg

SEQ ID NO: 1050768 - DNA, 22 bp, Artificial Sequence
  chemically synthesized
agggaataatggcaataaaaat

SEQ ID NO: 1050769 - DNA, 22 bp, Artificial Sequence
  chemically synthesized
tttagggaataatggcaataaa

SEQ ID NO: 1050770 - DNA, 22 bp, Artificial Sequence
  chemically synthesized
tgcagtattgtttagggaataa

SEQ ID NO: 1050771 - DNA, 22 bp, Artificial Sequence
  chemically synthesized
ttattgccattattccctaaac

SEQ ID NO: 1050772 - DNA, 22 bp, Artificial Sequence
  chemically synthesized
ttatgcagtattgtttagggaa

SEQ ID NO: 1050773 - DNA, 22 bp, Artificial Sequence
  chemically synthesized
tattgccattattccctaaaca

SEQ ID NO: 1050774 - DNA, 22 bp, Artificial Sequence
  chemically synthesized
attgccattattccctaaacaa

SEQ ID NO: 1050775 - DNA, 22 bp, Artificial Sequence
  chemically synthesized
ttgccattattccctaaacaat

SEQ ID NO: 1050776 - DNA, 22 bp, Artificial Sequence
  chemically synthesized
ccattattccctaaacaatact

SEQ ID NO: 1050777 - DNA, 22 bp, Artificial Sequence
  chemically synthesized
ttccctaaacaatactgcataa

SEQ ID NO: 1050778 - DNA, 22 bp, Artificial Sequence
  chemically synthesized
tgtaaatagttgttatgcagta

SEQ ID NO: 1050779 - DNA, 22 bp, Artificial Sequence
  chemically synthesized
cctaaacaatactgcataacaa

SEQ ID NO: 1050780 - DNA, 22 bp, Artificial Sequence
  chemically synthesized
aacaatactgcataacaactat

SEQ ID NO: 1050781 - DNA, 22 bp, Artificial Sequence
  chemically synthesized
cataacaactatttacatagca

SEQ ID NO: 1050782 - DNA, 22 bp, Artificial Sequence
  chemically synthesized
tagtacccaatacaatgtaaat

SEQ ID NO: 1050783 - DNA, 22 bp, Artificial Sequence
  chemically synthesized
atagtacccaatacaatgtaaa

SEQ ID NO: 1050784 - DNA, 22 bp, Artificial Sequence
  chemically synthesized
tttacatagcatttacattgta

SEQ ID NO: 1050785 - DNA, 22 bp, Artificial Sequence
  chemically synthesized
tttatagtacccaatacaatgt

SEQ ID NO: 1050786 - DNA, 22 bp, Artificial Sequence
  chemically synthesized
acatagcatttacattgtattg

SEQ ID NO: 1050787 - DNA, 22 bp, Artificial Sequence
  chemically synthesized
catagcatttacattgtattgg

SEQ ID NO: 1050788 - DNA, 22 bp, Artificial Sequence
  chemically synthesized
gattatttatagtacccaatac

SEQ ID NO: 1050789 - DNA, 22 bp, Artificial Sequence
  chemically synthesized
tagattatttatagtacccaat

SEQ ID NO: 1050790 - DNA, 22 bp, Artificial Sequence
  chemically synthesized
acattgtattgggtactataaa

SEQ ID NO: 1050791 - DNA, 22 bp, Artificial Sequence
  chemically synthesized
cattgtattgggtactataaat

SEQ ID NO: 1050792 - DNA, 22 bp, Artificial Sequence
  chemically synthesized
atatcatctctagattatttat

SEQ ID NO: 1050793 - DNA, 22 bp, Artificial Sequence
  chemically synthesized
tattgggtactataaataatct

SEQ ID NO: 1050794 - DNA, 22 bp, Artificial Sequence
  chemically synthesized
catatcatctctagattattta

SEQ ID NO: 1050795 - DNA, 22 bp, Artificial Sequence
  chemically synthesized
ggtactataaataatctagaga

SEQ ID NO: 1050796 - DNA, 22 bp, Artificial Sequence
  chemically synthesized
aacacttcatatcatctctaga

SEQ ID NO: 1050797 - DNA, 22 bp, Artificial Sequence
  chemically synthesized
ctgaacacttcatatcatctct

SEQ ID NO: 1050798 - DNA, 22 bp, Artificial Sequence
  chemically synthesized
taaataatctagagatgatatg

SEQ ID NO: 1050799 - DNA, 22 bp, Artificial Sequence
  chemically synthesized
tggacaccctcctgaacacttc

SEQ ID NO: 1050800 - DNA, 22 bp, Artificial Sequence
  chemically synthesized
gagatgatatgaagtgttcagg

SEQ ID NO: 1050801 - DNA, 22 bp, Artificial Sequence
  chemically synthesized
catgtaactatggacaccctcc

SEQ ID NO: 1050802 - DNA, 22 bp, Artificial Sequence
  chemically synthesized
gcatgtaactatggacaccctc

SEQ ID NO: 1050803 - DNA, 22 bp, Artificial Sequence
  chemically synthesized
aggagggtgtccatagttacat

SEQ ID NO: 1050804 - DNA, 22 bp, Artificial Sequence
  chemically synthesized
tataaaatggcatagtgtttgc

SEQ ID NO: 1050805 - DNA, 22 bp, Artificial Sequence
  chemically synthesized
atataaaatggcatagtgtttg

SEQ ID NO: 1050806 - DNA, 22 bp, Artificial Sequence
  chemically synthesized
tttatataaaatggcatagtgt

SEQ ID NO: 1050807 - DNA, 22 bp, Artificial Sequence
  chemically synthesized
catgcaaacactatgccatttt

SEQ ID NO: 1050808 - DNA, 22 bp, Artificial Sequence
  chemically synthesized
aaattatttatataaaatggca

SEQ ID NO: 1050809 - DNA, 22 bp, Artificial Sequence
  chemically synthesized
aagaatactcaaattatttata

SEQ ID NO: 1050810 - DNA, 22 bp, Artificial Sequence
  chemically synthesized
tgccattttatataaataattt

SEQ ID NO: 1050811 - DNA, 22 bp, Artificial Sequence
  chemically synthesized
tatataaataatttgagtattc

SEQ ID NO: 1050812 - DNA, 22 bp, Artificial Sequence
  chemically synthesized
atataaataatttgagtattct

SEQ ID NO: 1050813 - DNA, 22 bp, Artificial Sequence
  chemically synthesized
tataaataatttgagtattctt

SEQ ID NO: 1050814 - DNA, 22 bp, Artificial Sequence
  chemically synthesized
atatcaaaattcaagaatactc

SEQ ID NO: 1050815 - DNA, 22 bp, Artificial Sequence
  chemically synthesized
gatatcaaaattcaagaatact

SEQ ID NO: 1050816 - DNA, 22 bp, Artificial Sequence
  chemically synthesized
tgatatcaaaattcaagaatac

SEQ ID NO: 1050817 - DNA, 22 bp, Artificial Sequence
  chemically synthesized
agcattttgatatcaaaattca

SEQ ID NO: 1050818 - DNA, 22 bp, Artificial Sequence
  chemically synthesized
cagcattttgatatcaaaattc

SEQ ID NO: 1050819 - DNA, 22 bp, Artificial Sequence
  chemically synthesized
gagtattcttgaattttgatat

SEQ ID NO: 1050820 - DNA, 22 bp, Artificial Sequence
  chemically synthesized
agtattcttgaattttgatatc

SEQ ID NO: 1050821 - DNA, 22 bp, Artificial Sequence
  chemically synthesized
gtttcagcattttgatatcaaa

SEQ ID NO: 1050822 - DNA, 22 bp, Artificial Sequence
  chemically synthesized
ttgaattttgatatcaaaatgc

SEQ ID NO: 1050823 - DNA, 22 bp, Artificial Sequence
  chemically synthesized
gaattttgatatcaaaatgctg

SEQ ID NO: 1050824 - DNA, 22 bp, Artificial Sequence
  chemically synthesized
aattttgatatcaaaatgctga

SEQ ID NO: 1050825 - DNA, 22 bp, Artificial Sequence
  chemically synthesized
tggggcactggtttcagcattt

SEQ ID NO: 1050826 - DNA, 22 bp, Artificial Sequence
  chemically synthesized
tgatatcaaaatgctgaaacca

SEQ ID NO: 1050827 - DNA, 22 bp, Artificial Sequence
  chemically synthesized
gatatcaaaatgctgaaaccag

SEQ ID NO: 1050828 - DNA, 22 bp, Artificial Sequence
  chemically synthesized
atatcaaaatgctgaaaccagt

SEQ ID NO: 1050829 - DNA, 22 bp, Artificial Sequence
  chemically synthesized
agtgtctgtggggcactggttt

SEQ ID NO: 1050830 - DNA, 22 bp, Artificial Sequence
  chemically synthesized
cagtgtctgtggggcactggtt

SEQ ID NO: 1050831 - DNA, 22 bp, Artificial Sequence
  chemically synthesized
aaaccagtgccccacagacact

SEQ ID NO: 1050832 - DNA, 22 bp, Artificial Sequence
  chemically synthesized
cacagtcatccttcagtgtctg

SEQ ID NO: 1050833 - DNA, 22 bp, Artificial Sequence
  chemically synthesized
ttacacagtcatccttcagtgt

SEQ ID NO: 1050834 - DNA, 22 bp, Artificial Sequence
  chemically synthesized
attacacagtcatccttcagtg

SEQ ID NO: 1050835 - DNA, 22 bp, Artificial Sequence
  chemically synthesized
tattacacagtcatccttcagt

SEQ ID NO: 1050836 - DNA, 22 bp, Artificial Sequence
  chemically synthesized
aaatctttattacacagtcatc

SEQ ID NO: 1050837 - DNA, 22 bp, Artificial Sequence
  chemically synthesized
gaaatctttattacacagtcat

SEQ ID NO: 1050838 - DNA, 22 bp, Artificial Sequence
  chemically synthesized
tgaaatctttattacacagtca

SEQ ID NO: 1050839 - DNA, 22 bp, Artificial Sequence
  chemically synthesized
ttttgaaatctttattacacag

SEQ ID NO: 1050840 - DNA, 22 bp, Artificial Sequence
  chemically synthesized
aaggatgactgtgtaataaaga

SEQ ID NO: 1050841 - DNA, 22 bp, Artificial Sequence
  chemically synthesized
attgttttgaaatctttattac

SEQ ID NO: 1050842 - DNA, 22 bp, Artificial Sequence
  chemically synthesized
tcattgttttgaaatctttatt

SEQ ID NO: 1050843 - DNA, 22 bp, Artificial Sequence
  chemically synthesized
ctcattgttttgaaatctttat

SEQ ID NO: 1050844 - DNA, 22 bp, Artificial Sequence
  chemically synthesized
tttctcattgttttgaaatctt

SEQ ID NO: 1050845 - DNA, 22 bp, Artificial Sequence
  chemically synthesized
atttctcattgttttgaaatct

SEQ ID NO: 1050846 - DNA, 22 bp, Artificial Sequence
  chemically synthesized
tgtaataaagatttcaaaacaa

SEQ ID NO: 1050847 - DNA, 22 bp, Artificial Sequence
  chemically synthesized
taccgtttatttctcattgttt

SEQ ID NO: 1050848 - DNA, 22 bp, Artificial Sequence
  chemically synthesized
gtaccgtttatttctcattgtt

SEQ ID NO: 1050849 - DNA, 22 bp, Artificial Sequence
  chemically synthesized
tgtaccgtttatttctcattgt

SEQ ID NO: 1050850 - DNA, 22 bp, Artificial Sequence
  chemically synthesized
ttgtaccgtttatttctcattg

SEQ ID NO: 1050851 - DNA, 22 bp, Artificial Sequence
  chemically synthesized
tttgtaccgtttatttctcatt

SEQ ID NO: 1050852 - DNA, 22 bp, Artificial Sequence
  chemically synthesized
ttttgtaccgtttatttctcat

SEQ ID NO: 1050853 - DNA, 22 bp, Artificial Sequence
  chemically synthesized
tttttttgtaccgtttatttct

SEQ ID NO: 1050854 - DNA, 22 bp, Artificial Sequence
  chemically synthesized
caaaacaatgagaaataaacgg

SEQ ID NO: 1050855 - DNA, 22 bp, Artificial Sequence
  chemically synthesized
aaaacaatgagaaataaacggt

SEQ ID NO: 1050856 - DNA, 22 bp, Artificial Sequence
  chemically synthesized
tcactgtttttttgtaccgttt

SEQ ID NO: 1050857 - DNA, 22 bp, Artificial Sequence
  chemically synthesized
ctgtcactgtttttttgtaccg

SEQ ID NO: 1050858 - DNA, 22 bp, Artificial Sequence
  chemically synthesized
cctgtcactgtttttttgtacc

SEQ ID NO: 1050859 - DNA, 22 bp, Artificial Sequence
  chemically synthesized
accacaaacgacacaaggtgta

SEQ ID NO: 1050860 - DNA, 22 bp, Artificial Sequence
  chemically synthesized
gaccacaaacgacacaaggtgt

SEQ ID NO: 1050861 - DNA, 22 bp, Artificial Sequence
  chemically synthesized
ataaaatttgaccacaaacgac

SEQ ID NO: 1050862 - DNA, 22 bp, Artificial Sequence
  chemically synthesized
cataaaatttgaccacaaacga

SEQ ID NO: 1050863 - DNA, 22 bp, Artificial Sequence
  chemically synthesized
tcacttcataaaatttgaccac

SEQ ID NO: 1050864 - DNA, 22 bp, Artificial Sequence
  chemically synthesized
gtgtcgtttgtggtcaaatttt

SEQ ID NO: 1050865 - DNA, 22 bp, Artificial Sequence
  chemically synthesized
tgtcgtttgtggtcaaatttta

SEQ ID NO: 1050866 - DNA, 22 bp, Artificial Sequence
  chemically synthesized
cactatcacttcataaaatttg

SEQ ID NO: 1050867 - DNA, 22 bp, Artificial Sequence
  chemically synthesized
aattacactatcacttcataaa

SEQ ID NO: 1050868 - DNA, 22 bp, Artificial Sequence
  chemically synthesized
aaattacactatcacttcataa

SEQ ID NO: 1050869 - DNA, 22 bp, Artificial Sequence
  chemically synthesized
gtggtcaaattttatgaagtga

SEQ ID NO: 1050870 - DNA, 22 bp, Artificial Sequence
  chemically synthesized
tggtcaaattttatgaagtgat

SEQ ID NO: 1050871 - DNA, 22 bp, Artificial Sequence
  chemically synthesized
cttaaattacactatcacttca

SEQ ID NO: 1050872 - DNA, 22 bp, Artificial Sequence
  chemically synthesized
ttacttaaattacactatcact

SEQ ID NO: 1050873 - DNA, 22 bp, Artificial Sequence
  chemically synthesized
tatgaagtgatagtgtaattta

SEQ ID NO: 1050874 - DNA, 22 bp, Artificial Sequence
  chemically synthesized
atgaagtgatagtgtaatttaa

SEQ ID NO: 1050875 - DNA, 22 bp, Artificial Sequence
  chemically synthesized
tgaagtgatagtgtaatttaag

SEQ ID NO: 1050876 - DNA, 22 bp, Artificial Sequence
  chemically synthesized
aagatgtcatgttattacttaa

SEQ ID NO: 1050877 - DNA, 22 bp, Artificial Sequence
  chemically synthesized
gttcaagatgtcatgttattac

SEQ ID NO: 1050878 - DNA, 22 bp, Artificial Sequence
  chemically synthesized
aagtaataacatgacatcttga

SEQ ID NO: 1050879 - DNA, 22 bp, Artificial Sequence
  chemically synthesized
agtaataacatgacatcttgaa

SEQ ID NO: 1050880 - DNA, 22 bp, Artificial Sequence
  chemically synthesized
tagtatcacatactagttcaag

SEQ ID NO: 1050881 - DNA, 22 bp, Artificial Sequence
  chemically synthesized
gtagtatcacatactagttcaa

SEQ ID NO: 1050882 - DNA, 22 bp, Artificial Sequence
  chemically synthesized
acttgtagtatcacatactagt

SEQ ID NO: 1050883 - DNA, 22 bp, Artificial Sequence
  chemically synthesized
cacttgtagtatcacatactag

SEQ ID NO: 1050884 - DNA, 22 bp, Artificial Sequence
  chemically synthesized
tcacttgtagtatcacatacta

SEQ ID NO: 1050885 - DNA, 22 bp, Artificial Sequence
  chemically synthesized
ttttcacttgtagtatcacata

SEQ ID NO: 1050886 - DNA, 22 bp, Artificial Sequence
  chemically synthesized
ttgttttcacttgtagtatcac

SEQ ID NO: 1050887 - DNA, 22 bp, Artificial Sequence
  chemically synthesized
gaactagtatgtgatactacaa

SEQ ID NO: 1050888 - DNA, 22 bp, Artificial Sequence
  chemically synthesized
aactagtatgtgatactacaag

SEQ ID NO: 1050889 - DNA, 22 bp, Artificial Sequence
  chemically synthesized
ctattgttttcacttgtagtat

SEQ ID NO: 1050890 - DNA, 22 bp, Artificial Sequence
  chemically synthesized
gctactattgttttcacttgta

SEQ ID NO: 1050891 - DNA, 22 bp, Artificial Sequence
  chemically synthesized
gtatgtgatactacaagtgaaa

SEQ ID NO: 1050892 - DNA, 22 bp, Artificial Sequence
  chemically synthesized
ctggctactattgttttcactt

SEQ ID NO: 1050893 - DNA, 22 bp, Artificial Sequence
  chemically synthesized
cctggctactattgttttcact

SEQ ID NO: 1050894 - DNA, 22 bp, Artificial Sequence
  chemically synthesized
tttcctggctactattgttttc

SEQ ID NO: 1050895 - DNA, 22 bp, Artificial Sequence
  chemically synthesized
atttcctggctactattgtttt

SEQ ID NO: 1050896 - DNA, 22 bp, Artificial Sequence
  chemically synthesized
tatttcctggctactattgttt

SEQ ID NO: 1050897 - DNA, 22 bp, Artificial Sequence
  chemically synthesized
caagtgaaaacaatagtagcca

SEQ ID NO: 1050898 - DNA, 22 bp, Artificial Sequence
  chemically synthesized
taattttatttcctggctacta

SEQ ID NO: 1050899 - DNA, 22 bp, Artificial Sequence
  chemically synthesized
ataattttatttcctggctact

SEQ ID NO: 1050900 - DNA, 22 bp, Artificial Sequence
  chemically synthesized
aaaagaaataatttataatttt

SEQ ID NO: 1050901 - DNA, 22 bp, Artificial Sequence
  chemically synthesized
aaaaagaaataatttataattt

SEQ ID NO: 1050902 - DNA, 22 bp, Artificial Sequence
  chemically synthesized
taaaaagaaataatttataatt

SEQ ID NO: 1050903 - DNA, 22 bp, Artificial Sequence
  chemically synthesized
taaattatttctttttaaagga

SEQ ID NO: 1050904 - DNA, 22 bp, Artificial Sequence
  chemically synthesized
aatcaaaggcaaaatcctttaa

SEQ ID NO: 1050905 - DNA, 22 bp, Artificial Sequence
  chemically synthesized
caatcaaaggcaaaatccttta

SEQ ID NO: 1050906 - DNA, 22 bp, Artificial Sequence
  chemically synthesized
tcaatcaaaggcaaaatccttt

SEQ ID NO: 1050907 - DNA, 22 bp, Artificial Sequence
  chemically synthesized
tttctttttaaaggattttgcc

SEQ ID NO: 1050908 - DNA, 22 bp, Artificial Sequence
  chemically synthesized
ttttcaatcaaaggcaaaatcc

SEQ ID NO: 1050909 - DNA, 22 bp, Artificial Sequence
  chemically synthesized
ctttttaaaggattttgccttt

SEQ ID NO: 1050910 - DNA, 22 bp, Artificial Sequence
  chemically synthesized
tttttaaaggattttgcctttg

SEQ ID NO: 1050911 - DNA, 22 bp, Artificial Sequence
  chemically synthesized
attattttcaatcaaaggcaaa

SEQ ID NO: 1050912 - DNA, 22 bp, Artificial Sequence
  chemically synthesized
tttaaaggattttgcctttgat

SEQ ID NO: 1050913 - DNA, 22 bp, Artificial Sequence
  chemically synthesized
ttaaaggattttgcctttgatt

SEQ ID NO: 1050914 - DNA, 22 bp, Artificial Sequence
  chemically synthesized
ctcattattttcaatcaaaggc

SEQ ID NO: 1050915 - DNA, 22 bp, Artificial Sequence
  chemically synthesized
taaaggattttgcctttgattg

SEQ ID NO: 1050916 - DNA, 22 bp, Artificial Sequence
  chemically synthesized
aaaggattttgcctttgattga

SEQ ID NO: 1050917 - DNA, 22 bp, Artificial Sequence
  chemically synthesized
aaggattttgcctttgattgaa

SEQ ID NO: 1050918 - DNA, 22 bp, Artificial Sequence
  chemically synthesized
gtcaactcctcattattttcaa

SEQ ID NO: 1050919 - DNA, 22 bp, Artificial Sequence
  chemically synthesized
agtcaactcctcattattttca

SEQ ID NO: 1050920 - DNA, 22 bp, Artificial Sequence
  chemically synthesized
tgcctttgattgaaaataatga

SEQ ID NO: 1050921 - DNA, 22 bp, Artificial Sequence
  chemically synthesized
gcctttgattgaaaataatgag

SEQ ID NO: 1050922 - DNA, 22 bp, Artificial Sequence
  chemically synthesized
cttagtcaactcctcattattt

SEQ ID NO: 1050923 - DNA, 22 bp, Artificial Sequence
  chemically synthesized
cctttgattgaaaataatgagg

SEQ ID NO: 1050924 - DNA, 22 bp, Artificial Sequence
  chemically synthesized
acttagtcaactcctcattatt

SEQ ID NO: 1050925 - DNA, 22 bp, Artificial Sequence
  chemically synthesized
tgattgaaaataatgaggagtt

SEQ ID NO: 1050926 - DNA, 22 bp, Artificial Sequence
  chemically synthesized
gattgaaaataatgaggagttg

SEQ ID NO: 1050927 - DNA, 22 bp, Artificial Sequence
  chemically synthesized
attgaaaataatgaggagttga

SEQ ID NO: 1050928 - DNA, 22 bp, Artificial Sequence
  chemically synthesized
aaaataatgaggagttgactaa

SEQ ID NO: 1050929 - DNA, 22 bp, Artificial Sequence
  chemically synthesized
atcaccaagatgatttacttag

SEQ ID NO: 1050930 - DNA, 22 bp, Artificial Sequence
  chemically synthesized
actaagtaaatcatcttggtga

SEQ ID NO: 1050931 - DNA, 22 bp, Artificial Sequence
  chemically synthesized
agtaaatcatcttggtgatgag

SEQ ID NO: 1050932 - DNA, 22 bp, Artificial Sequence
  chemically synthesized
aataagaacaatgccctcatca

SEQ ID NO: 1050933 - DNA, 22 bp, Artificial Sequence
  chemically synthesized
ggtgatgagggcattgttctta

SEQ ID NO: 1050934 - DNA, 22 bp, Artificial Sequence
  chemically synthesized
gtgatgagggcattgttcttat

SEQ ID NO: 1050935 - DNA, 22 bp, Artificial Sequence
  chemically synthesized
cgccaaaattaaataagaacaa

SEQ ID NO: 1050936 - DNA, 22 bp, Artificial Sequence
  chemically synthesized
tagtgttgcgccaaaattaaat

SEQ ID NO: 1050937 - DNA, 22 bp, Artificial Sequence
  chemically synthesized
tgtagtgttgcgccaaaattaa

SEQ ID NO: 1050938 - DNA, 22 bp, Artificial Sequence
  chemically synthesized
ctgtagtgttgcgccaaaatta

SEQ ID NO: 1050939 - DNA, 22 bp, Artificial Sequence
  chemically synthesized
ttcttatttaattttggcgcaa

SEQ ID NO: 1050940 - DNA, 22 bp, Artificial Sequence
  chemically synthesized
tatttctgtagtgttgcgccaa

SEQ ID NO: 1050941 - DNA, 22 bp, Artificial Sequence
  chemically synthesized
ttatttaattttggcgcaacac

SEQ ID NO: 1050942 - DNA, 22 bp, Artificial Sequence
  chemically synthesized
atttaattttggcgcaacacta

SEQ ID NO: 1050943 - DNA, 22 bp, Artificial Sequence
  chemically synthesized
tttaattttggcgcaacactac

SEQ ID NO: 1050944 - DNA, 22 bp, Artificial Sequence
  chemically synthesized
tgcctatatttctgtagtgttg

SEQ ID NO: 1050945 - DNA, 22 bp, Artificial Sequence
  chemically synthesized
atgcctatatttctgtagtgtt

SEQ ID NO: 1050946 - DNA, 22 bp, Artificial Sequence
  chemically synthesized
aattttggcgcaacactacaga

SEQ ID NO: 1050947 - DNA, 22 bp, Artificial Sequence
  chemically synthesized
tatgcctatatttctgtagtgt

SEQ ID NO: 1050948 - DNA, 22 bp, Artificial Sequence
  chemically synthesized
attttggcgcaacactacagaa

SEQ ID NO: 1050949 - DNA, 22 bp, Artificial Sequence
  chemically synthesized
tggcgcaacactacagaaatat

SEQ ID NO: 1050950 - DNA, 22 bp, Artificial Sequence
  chemically synthesized
ggcgcaacactacagaaatata

SEQ ID NO: 1050951 - DNA, 22 bp, Artificial Sequence
  chemically synthesized
gcgcaacactacagaaatatag

SEQ ID NO: 1050952 - DNA, 22 bp, Artificial Sequence
  chemically synthesized
aacaacaattttatgcctatat

SEQ ID NO: 1050953 - DNA, 22 bp, Artificial Sequence
  chemically synthesized
aaacaacaattttatgcctata

SEQ ID NO: 1050954 - DNA, 22 bp, Artificial Sequence
  chemically synthesized
taaacaacaattttatgcctat

SEQ ID NO: 1050955 - DNA, 22 bp, Artificial Sequence
  chemically synthesized
cagaaatataggcataaaattg

SEQ ID NO: 1050956 - DNA, 22 bp, Artificial Sequence
  chemically synthesized
ccattttaaacaacaattttat

SEQ ID NO: 1050957 - DNA, 22 bp, Artificial Sequence
  chemically synthesized
cccattttaaacaacaatttta

SEQ ID NO: 1050958 - DNA, 22 bp, Artificial Sequence
  chemically synthesized
tttcccattttaaacaacaatt

SEQ ID NO: 1050959 - DNA, 22 bp, Artificial Sequence
  chemically synthesized
gtgctgtttcccattttaaaca

SEQ ID NO: 1050960 - DNA, 22 bp, Artificial Sequence
  chemically synthesized
ctagtgctgtttcccattttaa

SEQ ID NO: 1050961 - DNA, 22 bp, Artificial Sequence
  chemically synthesized
actagtgctgtttcccatttta

SEQ ID NO: 1050962 - DNA, 22 bp, Artificial Sequence
  chemically synthesized
tactagtgctgtttcccatttt

SEQ ID NO: 1050963 - DNA, 22 bp, Artificial Sequence
  chemically synthesized
ttgtttaaaatgggaaacagca

SEQ ID NO: 1050964 - DNA, 22 bp, Artificial Sequence
  chemically synthesized
tcattttactagtgctgtttcc

SEQ ID NO: 1050965 - DNA, 22 bp, Artificial Sequence
  chemically synthesized
tttaaaatgggaaacagcacta

SEQ ID NO: 1050966 - DNA, 22 bp, Artificial Sequence
  chemically synthesized
tactatcattttactagtgctg

SEQ ID NO: 1050967 - DNA, 22 bp, Artificial Sequence
  chemically synthesized
aaaatgggaaacagcactagta

SEQ ID NO: 1050968 - DNA, 22 bp, Artificial Sequence
  chemically synthesized
gtactatcattttactagtgct

SEQ ID NO: 1050969 - DNA, 22 bp, Artificial Sequence
  chemically synthesized
aaatgggaaacagcactagtaa

SEQ ID NO: 1050970 - DNA, 22 bp, Artificial Sequence
  chemically synthesized
tgtactatcattttactagtgc

SEQ ID NO: 1050971 - DNA, 22 bp, Artificial Sequence
  chemically synthesized
tactttgtactatcattttact

SEQ ID NO: 1050972 - DNA, 22 bp, Artificial Sequence
  chemically synthesized
taagttatactttgtactatca

SEQ ID NO: 1050973 - DNA, 22 bp, Artificial Sequence
  chemically synthesized
ataagttatactttgtactatc

SEQ ID NO: 1050974 - DNA, 22 bp, Artificial Sequence
  chemically synthesized
tttataagttatactttgtact

SEQ ID NO: 1050975 - DNA, 22 bp, Artificial Sequence
  chemically synthesized
gtaaaatgatagtacaaagtat

SEQ ID NO: 1050976 - DNA, 22 bp, Artificial Sequence
  chemically synthesized
taggttatttataagttatact

SEQ ID NO: 1050977 - DNA, 22 bp, Artificial Sequence
  chemically synthesized
ataggttatttataagttatac

SEQ ID NO: 1050978 - DNA, 22 bp, Artificial Sequence
  chemically synthesized
ccgcacttataggttatttata

SEQ ID NO: 1050979 - DNA, 22 bp, Artificial Sequence
  chemically synthesized
cccgcacttataggttatttat

SEQ ID NO: 1050980 - DNA, 22 bp, Artificial Sequence
  chemically synthesized
ttcccgcacttataggttattt

SEQ ID NO: 1050981 - DNA, 22 bp, Artificial Sequence
  chemically synthesized
catctcttcccgcacttatagg

SEQ ID NO: 1050982 - DNA, 22 bp, Artificial Sequence
  chemically synthesized
ctgcatctcttcccgcacttat

SEQ ID NO: 1050983 - DNA, 22 bp, Artificial Sequence
  chemically synthesized
ataaataacctataagtgcggg

SEQ ID NO: 1050984 - DNA, 22 bp, Artificial Sequence
  chemically synthesized
taaataacctataagtgcggga

SEQ ID NO: 1050985 - DNA, 22 bp, Artificial Sequence
  chemically synthesized
tactgcatctcttcccgcactt

SEQ ID NO: 1050986 - DNA, 22 bp, Artificial Sequence
  chemically synthesized
cactctactgcatctcttcccg

SEQ ID NO: 1050987 - DNA, 22 bp, Artificial Sequence
  chemically synthesized
actgcactctactgcatctctt

SEQ ID NO: 1050988 - DNA, 22 bp, Artificial Sequence
  chemically synthesized
cactgcactctactgcatctct

SEQ ID NO: 1050989 - DNA, 22 bp, Artificial Sequence
  chemically synthesized
taagtgcgggaagagatgcagt

SEQ ID NO: 1050990 - DNA, 22 bp, Artificial Sequence
  chemically synthesized
ttcactgcactctactgcatct

SEQ ID NO: 1050991 - DNA, 22 bp, Artificial Sequence
  chemically synthesized
cttcactgcactctactgcatc

SEQ ID NO: 1050992 - DNA, 22 bp, Artificial Sequence
  chemically synthesized
atcatcttcttcactgcactct

SEQ ID NO: 1050993 - DNA, 22 bp, Artificial Sequence
  chemically synthesized
taattcatcatcttcttcactg

SEQ ID NO: 1050994 - DNA, 22 bp, Artificial Sequence
  chemically synthesized
ataattcatcatcttcttcact

SEQ ID NO: 1050995 - DNA, 22 bp, Artificial Sequence
  chemically synthesized
tataattcatcatcttcttcac

SEQ ID NO: 1050996 - DNA, 22 bp, Artificial Sequence
  chemically synthesized
taattttataattcatcatctt

SEQ ID NO: 1050997 - DNA, 22 bp, Artificial Sequence
  chemically synthesized
tctataattttataattcatca

SEQ ID NO: 1050998 - DNA, 22 bp, Artificial Sequence
  chemically synthesized
gtctataattttataattcatc

SEQ ID NO: 1050999 - DNA, 22 bp, Artificial Sequence
  chemically synthesized
tcccttgtctataattttataa

SEQ ID NO: 1051000 - DNA, 22 bp, Artificial Sequence
  chemically synthesized
atcccttgtctataattttata

SEQ ID NO: 1051001 - DNA, 22 bp, Artificial Sequence
  chemically synthesized
ttatcccttgtctataatttta

SEQ ID NO: 1051002 - DNA, 22 bp, Artificial Sequence
  chemically synthesized
ctcttatcccttgtctataatt

SEQ ID NO: 1051003 - DNA, 22 bp, Artificial Sequence
  chemically synthesized
actcttatcccttgtctataat

SEQ ID NO: 1051004 - DNA, 22 bp, Artificial Sequence
  chemically synthesized
tttactcttatcccttgtctat

SEQ ID NO: 1051005 - DNA, 22 bp, Artificial Sequence
  chemically synthesized
atttactcttatcccttgtcta

SEQ ID NO: 1051006 - DNA, 22 bp, Artificial Sequence
  chemically synthesized
tatttactcttatcccttgtct

SEQ ID NO: 1051007 - DNA, 22 bp, Artificial Sequence
  chemically synthesized
taaaattatagacaagggataa

SEQ ID NO: 1051008 - DNA, 22 bp, Artificial Sequence
  chemically synthesized
tcattttatttactcttatccc

SEQ ID NO: 1051009 - DNA, 22 bp, Artificial Sequence
  chemically synthesized
atcattttatttactcttatcc

SEQ ID NO: 1051010 - DNA, 22 bp, Artificial Sequence
  chemically synthesized
tatcattttatttactcttatc

SEQ ID NO: 1051011 - DNA, 22 bp, Artificial Sequence
  chemically synthesized
tagacaagggataagagtaaat

SEQ ID NO: 1051012 - DNA, 22 bp, Artificial Sequence
  chemically synthesized
ttttatcattttatttactctt

SEQ ID NO: 1051013 - DNA, 22 bp, Artificial Sequence
  chemically synthesized
atggtcattattttatcatttt

SEQ ID NO: 1051014 - DNA, 22 bp, Artificial Sequence
  chemically synthesized
tcatattgatggtcattatttt

SEQ ID NO: 1051015 - DNA, 22 bp, Artificial Sequence
  chemically synthesized
gtcatattgatggtcattattt

SEQ ID NO: 1051016 - DNA, 22 bp, Artificial Sequence
  chemically synthesized
cttgtcatattgatggtcatta

SEQ ID NO: 1051017 - DNA, 22 bp, Artificial Sequence
  chemically synthesized
attccttgtcatattgatggtc

SEQ ID NO: 1051018 - DNA, 22 bp, Artificial Sequence
  chemically synthesized
aattccttgtcatattgatggt

SEQ ID NO: 1051019 - DNA, 22 bp, Artificial Sequence
  chemically synthesized
taattccttgtcatattgatgg

SEQ ID NO: 1051020 - DNA, 22 bp, Artificial Sequence
  chemically synthesized
ttttaattccttgtcatattga

SEQ ID NO: 1051021 - DNA, 22 bp, Artificial Sequence
  chemically synthesized
tgtctgttttaattccttgtca

SEQ ID NO: 1051022 - DNA, 22 bp, Artificial Sequence
  chemically synthesized
taactgtgtctgttttaattcc

SEQ ID NO: 1051023 - DNA, 22 bp, Artificial Sequence
  chemically synthesized
ataactgtgtctgttttaattc

SEQ ID NO: 1051024 - DNA, 22 bp, Artificial Sequence
  chemically synthesized
ttataactgtgtctgttttaat

SEQ ID NO: 1051025 - DNA, 22 bp, Artificial Sequence
  chemically synthesized
caataactcttataactgtgtc

SEQ ID NO: 1051026 - DNA, 22 bp, Artificial Sequence
  chemically synthesized
acaataactcttataactgtgt

SEQ ID NO: 1051027 - DNA, 22 bp, Artificial Sequence
  chemically synthesized
tacaataactcttataactgtg

SEQ ID NO: 1051028 - DNA, 22 bp, Artificial Sequence
  chemically synthesized
ttacaataactcttataactgt

SEQ ID NO: 1051029 - DNA, 22 bp, Artificial Sequence
  chemically synthesized
aaacagacacagttataagagt

SEQ ID NO: 1051030 - DNA, 22 bp, Artificial Sequence
  chemically synthesized
atttttacaataactcttataa

SEQ ID NO: 1051031 - DNA, 22 bp, Artificial Sequence
  chemically synthesized
catttttacaataactcttata

SEQ ID NO: 1051032 - DNA, 22 bp, Artificial Sequence
  chemically synthesized
accaacttcatttttacaataa

SEQ ID NO: 1051033 - DNA, 22 bp, Artificial Sequence
  chemically synthesized
aaccaacttcatttttacaata

SEQ ID NO: 1051034 - DNA, 22 bp, Artificial Sequence
  chemically synthesized
taaccaacttcatttttacaat

SEQ ID NO: 1051035 - DNA, 22 bp, Artificial Sequence
  chemically synthesized
taagagttattgtaaaaatgaa

SEQ ID NO: 1051036 - DNA, 22 bp, Artificial Sequence
  chemically synthesized
gatgagacattttaaccaactt

SEQ ID NO: 1051037 - DNA, 22 bp, Artificial Sequence
  chemically synthesized
ttgtaaaaatgaagttggttaa

SEQ ID NO: 1051038 - DNA, 22 bp, Artificial Sequence
  chemically synthesized
agatgagacattttaaccaact

SEQ ID NO: 1051039 - DNA, 22 bp, Artificial Sequence
  chemically synthesized
tagatgagacattttaaccaac

SEQ ID NO: 1051040 - DNA, 22 bp, Artificial Sequence
  chemically synthesized
taaaaatgaagttggttaaaat

SEQ ID NO: 1051041 - DNA, 22 bp, Artificial Sequence
  chemically synthesized
atctttagatgagacattttaa

SEQ ID NO: 1051042 - DNA, 22 bp, Artificial Sequence
  chemically synthesized
gttaaaatgtctcatctaaaga

SEQ ID NO: 1051043 - DNA, 22 bp, Artificial Sequence
  chemically synthesized
aaatgtctcatctaaagatgaa

SEQ ID NO: 1051044 - DNA, 22 bp, Artificial Sequence
  chemically synthesized
atctaaagatgaactatctatc

SEQ ID NO: 1051045 - DNA, 22 bp, Artificial Sequence
  chemically synthesized
tgaagatataaaaatgatagat

SEQ ID NO: 1051046 - DNA, 22 bp, Artificial Sequence
  chemically synthesized
atgaagatataaaaatgataga

SEQ ID NO: 1051047 - DNA, 22 bp, Artificial Sequence
  chemically synthesized
aagatgaactatctatcatttt

SEQ ID NO: 1051048 - DNA, 22 bp, Artificial Sequence
  chemically synthesized
atcttatgaagatataaaaatg

SEQ ID NO: 1051049 - DNA, 22 bp, Artificial Sequence
  chemically synthesized
gatcttatgaagatataaaaat

SEQ ID NO: 1051050 - DNA, 22 bp, Artificial Sequence
  chemically synthesized
tctatcatttttatatcttcat

SEQ ID NO: 1051051 - DNA, 22 bp, Artificial Sequence
  chemically synthesized
tcatttttatatcttcataaga

SEQ ID NO: 1051052 - DNA, 22 bp, Artificial Sequence
  chemically synthesized
ccaatacgtgcttgatcttatg

SEQ ID NO: 1051053 - DNA, 22 bp, Artificial Sequence
  chemically synthesized
accaatacgtgcttgatcttat

SEQ ID NO: 1051054 - DNA, 22 bp, Artificial Sequence
  chemically synthesized
ttatatcttcataagatcaagc

SEQ ID NO: 1051055 - DNA, 22 bp, Artificial Sequence
  chemically synthesized
ttaccaatacgtgcttgatctt

SEQ ID NO: 1051056 - DNA, 22 bp, Artificial Sequence
  chemically synthesized
tatatcttcataagatcaagca

SEQ ID NO: 1051057 - DNA, 22 bp, Artificial Sequence
  chemically synthesized
atatcttcataagatcaagcac

SEQ ID NO: 1051058 - DNA, 22 bp, Artificial Sequence
  chemically synthesized
tatcttcataagatcaagcacg

SEQ ID NO: 1051059 - DNA, 22 bp, Artificial Sequence
  chemically synthesized
cataagatcaagcacgtattgg

SEQ ID NO: 1051060 - DNA, 22 bp, Artificial Sequence
  chemically synthesized
ataagatcaagcacgtattggt

SEQ ID NO: 1051061 - DNA, 22 bp, Artificial Sequence
  chemically synthesized
taaaaaaaaatcacatattctt

SEQ ID NO: 1051062 - DNA, 22 bp, Artificial Sequence
  chemically synthesized
gtatctataaaaaaaaatcaca

SEQ ID NO: 1051063 - DNA, 22 bp, Artificial Sequence
  chemically synthesized
tggtatctataaaaaaaaatca

SEQ ID NO: 1051064 - DNA, 22 bp, Artificial Sequence
  chemically synthesized
gtaagaatatgtgatttttttt

SEQ ID NO: 1051065 - DNA, 22 bp, Artificial Sequence
  chemically synthesized
ccagcctctggtatctataaaa

SEQ ID NO: 1051066 - DNA, 22 bp, Artificial Sequence
  chemically synthesized
cccagcctctggtatctataaa

SEQ ID NO: 1051067 - DNA, 22 bp, Artificial Sequence
  chemically synthesized
ttcccagcctctggtatctata

SEQ ID NO: 1051068 - DNA, 22 bp, Artificial Sequence
  chemically synthesized
cactcttcccagcctctggtat

SEQ ID NO: 1051069 - DNA, 22 bp, Artificial Sequence
  chemically synthesized
ttttttatagataccagaggct

SEQ ID NO: 1051070 - DNA, 22 bp, Artificial Sequence
  chemically synthesized
tttttatagataccagaggctg

SEQ ID NO: 1051071 - DNA, 22 bp, Artificial Sequence
  chemically synthesized
ttttatagataccagaggctgg

SEQ ID NO: 1051072 - DNA, 22 bp, Artificial Sequence
  chemically synthesized
tttatagataccagaggctggg

SEQ ID NO: 1051073 - DNA, 22 bp, Artificial Sequence
  chemically synthesized
ttatagataccagaggctggga

SEQ ID NO: 1051074 - DNA, 22 bp, Artificial Sequence
  chemically synthesized
tatagataccagaggctgggaa

SEQ ID NO: 1051075 - DNA, 22 bp, Artificial Sequence
  chemically synthesized
atagataccagaggctgggaag

SEQ ID NO: 1051076 - DNA, 22 bp, Artificial Sequence
  chemically synthesized
tagataccagaggctgggaaga

SEQ ID NO: 1051077 - DNA, 22 bp, Artificial Sequence
  chemically synthesized
cgcccacctacactcttcccag

SEQ ID NO: 1051078 - DNA, 22 bp, Artificial Sequence
  chemically synthesized
acccattccgcccacctacact

SEQ ID NO: 1051079 - DNA, 22 bp, Artificial Sequence
  chemically synthesized
cacccattccgcccacctacac

SEQ ID NO: 1051080 - DNA, 22 bp, Artificial Sequence
  chemically synthesized
ttcacccattccgcccacctac

SEQ ID NO: 1051081 - DNA, 22 bp, Artificial Sequence
  chemically synthesized
tcttcacccattccgcccacct

SEQ ID NO: 1051082 - DNA, 22 bp, Artificial Sequence
  chemically synthesized
ggaagagtgtaggtgggcggaa

SEQ ID NO: 1051083 - DNA, 22 bp, Artificial Sequence
  chemically synthesized
tatgtccgtacccagtaaccaa

SEQ ID NO: 1051084 - DNA, 22 bp, Artificial Sequence
  chemically synthesized
tgcaactgtatgtccgtaccca

SEQ ID NO: 1051085 - DNA, 22 bp, Artificial Sequence
  chemically synthesized
tatgcaactgtatgtccgtacc

SEQ ID NO: 1051086 - DNA, 22 bp, Artificial Sequence
  chemically synthesized
ctatgcaactgtatgtccgtac

SEQ ID NO: 1051087 - DNA, 22 bp, Artificial Sequence
  chemically synthesized
tctatgcaactgtatgtccgta

SEQ ID NO: 1051088 - DNA, 22 bp, Artificial Sequence
  chemically synthesized
tttctatgcaactgtatgtccg

SEQ ID NO: 1051089 - DNA, 22 bp, Artificial Sequence
  chemically synthesized
gttactgggtacggacatacag

SEQ ID NO: 1051090 - DNA, 22 bp, Artificial Sequence
  chemically synthesized
ctctttctatgcaactgtatgt

SEQ ID NO: 1051091 - DNA, 22 bp, Artificial Sequence
  chemically synthesized
actctttctatgcaactgtatg

SEQ ID NO: 1051092 - DNA, 22 bp, Artificial Sequence
  chemically synthesized
ctgggtacggacatacagttgc

SEQ ID NO: 1051093 - DNA, 22 bp, Artificial Sequence
  chemically synthesized
ggtacggacatacagttgcata

SEQ ID NO: 1051094 - DNA, 22 bp, Artificial Sequence
  chemically synthesized
gcacttactctttctatgcaac

SEQ ID NO: 1051095 - DNA, 22 bp, Artificial Sequence
  chemically synthesized
aaacattagcacttactctttc

SEQ ID NO: 1051096 - DNA, 22 bp, Artificial Sequence
  chemically synthesized
caaacattagcacttactcttt

SEQ ID NO: 1051097 - DNA, 22 bp, Artificial Sequence
  chemically synthesized
tcaaacattagcacttactctt

SEQ ID NO: 1051098 - DNA, 22 bp, Artificial Sequence
  chemically synthesized
tttcaaacattagcacttactc

SEQ ID NO: 1051099 - DNA, 22 bp, Artificial Sequence
  chemically synthesized
ctttcaaacattagcacttact

SEQ ID NO: 1051100 - DNA, 22 bp, Artificial Sequence
  chemically synthesized
ttctttcaaacattagcactta

SEQ ID NO: 1051101 - DNA, 22 bp, Artificial Sequence
  chemically synthesized
catagaaagagtaagtgctaat

SEQ ID NO: 1051102 - DNA, 22 bp, Artificial Sequence
  chemically synthesized
ctcttctttcaaacattagcac

SEQ ID NO: 1051103 - DNA, 22 bp, Artificial Sequence
  chemically synthesized
tagtcaccctactcttctttca

SEQ ID NO: 1051104 - DNA, 22 bp, Artificial Sequence
  chemically synthesized
attatagtcaccctactcttct

SEQ ID NO: 1051105 - DNA, 22 bp, Artificial Sequence
  chemically synthesized
atgtttgaaagaagagtagggt

SEQ ID NO: 1051106 - DNA, 22 bp, Artificial Sequence
  chemically synthesized
ttgattatagtcaccctactct

SEQ ID NO: 1051107 - DNA, 22 bp, Artificial Sequence
  chemically synthesized
gaaagaagagtagggtgactat

SEQ ID NO: 1051108 - DNA, 22 bp, Artificial Sequence
  chemically synthesized
aaagaagagtagggtgactata

SEQ ID NO: 1051109 - DNA, 22 bp, Artificial Sequence
  chemically synthesized
agagatacaatatattgttgat

SEQ ID NO: 1051110 - DNA, 22 bp, Artificial Sequence
  chemically synthesized
gagagatacaatatattgttga

SEQ ID NO: 1051111 - DNA, 22 bp, Artificial Sequence
  chemically synthesized
tgagagatacaatatattgttg

SEQ ID NO: 1051112 - DNA, 22 bp, Artificial Sequence
  chemically synthesized
ggtattttgagagatacaatat

SEQ ID NO: 1051113 - DNA, 22 bp, Artificial Sequence
  chemically synthesized
taatcaacaatatattgtatct

SEQ ID NO: 1051114 - DNA, 22 bp, Artificial Sequence
  chemically synthesized
taggtattttgagagatacaat

SEQ ID NO: 1051115 - DNA, 22 bp, Artificial Sequence
  chemically synthesized
ctaggtattttgagagatacaa

SEQ ID NO: 1051116 - DNA, 22 bp, Artificial Sequence
  chemically synthesized
ttctaggtattttgagagatac

SEQ ID NO: 1051117 - DNA, 22 bp, Artificial Sequence
  chemically synthesized
tcttctaggtattttgagagat

SEQ ID NO: 1051118 - DNA, 22 bp, Artificial Sequence
  chemically synthesized
ctctcttctaggtattttgaga

SEQ ID NO: 1051119 - DNA, 22 bp, Artificial Sequence
  chemically synthesized
aactcctctcttctaggtattt

SEQ ID NO: 1051120 - DNA, 22 bp, Artificial Sequence
  chemically synthesized
tatctctcaaaatacctagaag

SEQ ID NO: 1051121 - DNA, 22 bp, Artificial Sequence
  chemically synthesized
tcaaaatacctagaagagagga

SEQ ID NO: 1051122 - DNA, 22 bp, Artificial Sequence
  chemically synthesized
gaaatagttcaactcctctctt

SEQ ID NO: 1051123 - DNA, 22 bp, Artificial Sequence
  chemically synthesized
aaaatacctagaagagaggagt

SEQ ID NO: 1051124 - DNA, 22 bp, Artificial Sequence
  chemically synthesized
tatgtgttggaaatagttcaac

SEQ ID NO: 1051125 - DNA, 22 bp, Artificial Sequence
  chemically synthesized
atatgtgttggaaatagttcaa

SEQ ID NO: 1051126 - DNA, 22 bp, Artificial Sequence
  chemically synthesized
gaagagaggagttgaactattt

SEQ ID NO: 1051127 - DNA, 22 bp, Artificial Sequence
  chemically synthesized
tcatttatatgtgttggaaata

SEQ ID NO: 1051128 - DNA, 22 bp, Artificial Sequence
  chemically synthesized
atcatttatatgtgttggaaat

SEQ ID NO: 1051129 - DNA, 22 bp, Artificial Sequence
  chemically synthesized
aactatttccaacacatataaa

SEQ ID NO: 1051130 - DNA, 22 bp, Artificial Sequence
  chemically synthesized
aagtatttatcatttatatgtg

SEQ ID NO: 1051131 - DNA, 22 bp, Artificial Sequence
  chemically synthesized
tttccaacacatataaatgata

SEQ ID NO: 1051132 - DNA, 22 bp, Artificial Sequence
  chemically synthesized
ccaacacatataaatgataaat

SEQ ID NO: 1051133 - DNA, 22 bp, Artificial Sequence
  chemically synthesized
caacacatataaatgataaata

SEQ ID NO: 1051134 - DNA, 22 bp, Artificial Sequence
  chemically synthesized
gggtatccatcatctcaagtat

SEQ ID NO: 1051135 - DNA, 22 bp, Artificial Sequence
  chemically synthesized
agtcaggatagttagggtatcc

SEQ ID NO: 1051136 - DNA, 22 bp, Artificial Sequence
  chemically synthesized
gagatgatggataccctaacta

SEQ ID NO: 1051137 - DNA, 22 bp, Artificial Sequence
  chemically synthesized
agatgatggataccctaactat

SEQ ID NO: 1051138 - DNA, 22 bp, Artificial Sequence
  chemically synthesized
actatcctgacttaatcattat

SEQ ID NO: 1051139 - DNA, 22 bp, Artificial Sequence
  chemically synthesized
catgcatagaatgtataatgat

SEQ ID NO: 1051140 - DNA, 22 bp, Artificial Sequence
  chemically synthesized
tcctgacttaatcattatacat

SEQ ID NO: 1051141 - DNA, 22 bp, Artificial Sequence
  chemically synthesized
ctacatgcatagaatgtataat

SEQ ID NO: 1051142 - DNA, 22 bp, Artificial Sequence
  chemically synthesized
gctacatgcatagaatgtataa

SEQ ID NO: 1051143 - DNA, 22 bp, Artificial Sequence
  chemically synthesized
tgctacatgcatagaatgtata

SEQ ID NO: 1051144 - DNA, 22 bp, Artificial Sequence
  chemically synthesized
acttaatcattatacattctat

SEQ ID NO: 1051145 - DNA, 22 bp, Artificial Sequence
  chemically synthesized
aatcattatacattctatgcat

SEQ ID NO: 1051146 - DNA, 22 bp, Artificial Sequence
  chemically synthesized
atcattatacattctatgcatg

SEQ ID NO: 1051147 - DNA, 22 bp, Artificial Sequence
  chemically synthesized
tacattctatgcatgtagcaaa

SEQ ID NO: 1051148 - DNA, 22 bp, Artificial Sequence
  chemically synthesized
tagggtacatgtaatattttgc

SEQ ID NO: 1051149 - DNA, 22 bp, Artificial Sequence
  chemically synthesized
atagggtacatgtaatattttg

SEQ ID NO: 1051150 - DNA, 22 bp, Artificial Sequence
  chemically synthesized
tatgcatgtagcaaaatattac

SEQ ID NO: 1051151 - DNA, 22 bp, Artificial Sequence
  chemically synthesized
tatagggtacatgtaatatttt

SEQ ID NO: 1051152 - DNA, 22 bp, Artificial Sequence
  chemically synthesized
tgcatgtagcaaaatattacat

SEQ ID NO: 1051153 - DNA, 22 bp, Artificial Sequence
  chemically synthesized
catctttatagggtacatgtaa

SEQ ID NO: 1051154 - DNA, 22 bp, Artificial Sequence
  chemically synthesized
acatctttatagggtacatgta

SEQ ID NO: 1051155 - DNA, 22 bp, Artificial Sequence
  chemically synthesized
tacatctttatagggtacatgt

SEQ ID NO: 1051156 - DNA, 22 bp, Artificial Sequence
  chemically synthesized
ttacatctttatagggtacatg

SEQ ID NO: 1051157 - DNA, 22 bp, Artificial Sequence
  chemically synthesized
tgcaaatatttttacatcttta

SEQ ID NO: 1051158 - DNA, 22 bp, Artificial Sequence
  chemically synthesized
catgtaccctataaagatgtaa

SEQ ID NO: 1051159 - DNA, 22 bp, Artificial Sequence
  chemically synthesized
atgcaaatatttttacatcttt

SEQ ID NO: 1051160 - DNA, 22 bp, Artificial Sequence
  chemically synthesized
acttatgcaaatatttttacat

SEQ ID NO: 1051161 - DNA, 22 bp, Artificial Sequence
  chemically synthesized
aacttatgcaaatatttttaca

SEQ ID NO: 1051162 - DNA, 22 bp, Artificial Sequence
  chemically synthesized
taacttatgcaaatatttttac

SEQ ID NO: 1051163 - DNA, 22 bp, Artificial Sequence
  chemically synthesized
ttaacttatgcaaatattttta

SEQ ID NO: 1051164 - DNA, 22 bp, Artificial Sequence
  chemically synthesized
tttaacttatgcaaatattttt

SEQ ID NO: 1051165 - DNA, 22 bp, Artificial Sequence
  chemically synthesized
taaagatgtaaaaatatttgca

SEQ ID NO: 1051166 - DNA, 22 bp, Artificial Sequence
  chemically synthesized
tctttttaacttatgcaaatat

SEQ ID NO: 1051167 - DNA, 22 bp, Artificial Sequence
  chemically synthesized
gtctttttaacttatgcaaata

SEQ ID NO: 1051168 - DNA, 22 bp, Artificial Sequence
  chemically synthesized
tgtctttttaacttatgcaaat

SEQ ID NO: 1051169 - DNA, 22 bp, Artificial Sequence
  chemically synthesized
gataattttgtctttttaactt

SEQ ID NO: 1051170 - DNA, 22 bp, Artificial Sequence
  chemically synthesized
aactagataattttgtcttttt

SEQ ID NO: 1051171 - DNA, 22 bp, Artificial Sequence
  chemically synthesized
aaactagataattttgtctttt

SEQ ID NO: 1051172 - DNA, 22 bp, Artificial Sequence
  chemically synthesized
taaactagataattttgtcttt

SEQ ID NO: 1051173 - DNA, 22 bp, Artificial Sequence
  chemically synthesized
gcataagttaaaaagacaaaat

SEQ ID NO: 1051174 - DNA, 22 bp, Artificial Sequence
  chemically synthesized
cataagttaaaaagacaaaatt

SEQ ID NO: 1051175 - DNA, 22 bp, Artificial Sequence
  chemically synthesized
aaaagacaaaattatctagttt

SEQ ID NO: 1051176 - DNA, 22 bp, Artificial Sequence
  chemically synthesized
tagatggagtgtgcattttaaa

SEQ ID NO: 1051177 - DNA, 22 bp, Artificial Sequence
  chemically synthesized
tctagtttaaaatgcacactcc

SEQ ID NO: 1051178 - DNA, 22 bp, Artificial Sequence
  chemically synthesized
gtttaaaatgcacactccatct

SEQ ID NO: 1051179 - DNA, 22 bp, Artificial Sequence
  chemically synthesized
taaacagcctatagatggagtg

SEQ ID NO: 1051180 - DNA, 22 bp, Artificial Sequence
  chemically synthesized
gtaaacagcctatagatggagt

SEQ ID NO: 1051181 - DNA, 22 bp, Artificial Sequence
  chemically synthesized
ttgtaaacagcctatagatgga

SEQ ID NO: 1051182 - DNA, 22 bp, Artificial Sequence
  chemically synthesized
aaaatgcacactccatctatag

SEQ ID NO: 1051183 - DNA, 22 bp, Artificial Sequence
  chemically synthesized
cttgtaaacagcctatagatgg

SEQ ID NO: 1051184 - DNA, 22 bp, Artificial Sequence
  chemically synthesized
aaatgcacactccatctatagg

SEQ ID NO: 1051185 - DNA, 22 bp, Artificial Sequence
  chemically synthesized
tgtttcttgtaaacagcctata

SEQ ID NO: 1051186 - DNA, 22 bp, Artificial Sequence
  chemically synthesized
atgtttcttgtaaacagcctat

SEQ ID NO: 1051187 - DNA, 22 bp, Artificial Sequence
  chemically synthesized
tatgtttcttgtaaacagccta

SEQ ID NO: 1051188 - DNA, 22 bp, Artificial Sequence
  chemically synthesized
ttatgtttcttgtaaacagcct

SEQ ID NO: 1051189 - DNA, 22 bp, Artificial Sequence
  chemically synthesized
catctataggctgtttacaaga

SEQ ID NO: 1051190 - DNA, 22 bp, Artificial Sequence
  chemically synthesized
tatttttatgtttcttgtaaac

SEQ ID NO: 1051191 - DNA, 22 bp, Artificial Sequence
  chemically synthesized
gtatttttatgtttcttgtaaa

SEQ ID NO: 1051192 - DNA, 22 bp, Artificial Sequence
  chemically synthesized
taggctgtttacaagaaacata

SEQ ID NO: 1051193 - DNA, 22 bp, Artificial Sequence
  chemically synthesized
tgaccttgtatttttatgtttc

SEQ ID NO: 1051194 - DNA, 22 bp, Artificial Sequence
  chemically synthesized
tttacaagaaacataaaaatac

SEQ ID NO: 1051195 - DNA, 22 bp, Artificial Sequence
  chemically synthesized
acaagaaacataaaaatacaag

SEQ ID NO: 1051196 - DNA, 22 bp, Artificial Sequence
  chemically synthesized
caagaaacataaaaatacaagg

SEQ ID NO: 1051197 - DNA, 22 bp, Artificial Sequence
  chemically synthesized
acgcagcattgtgaccttgtat

SEQ ID NO: 1051198 - DNA, 22 bp, Artificial Sequence
  chemically synthesized
aatcaccattaacgcagcattg

SEQ ID NO: 1051199 - DNA, 22 bp, Artificial Sequence
  chemically synthesized
taaatcaccattaacgcagcat

SEQ ID NO: 1051200 - DNA, 22 bp, Artificial Sequence
  chemically synthesized
ctaaatcaccattaacgcagca

SEQ ID NO: 1051201 - DNA, 22 bp, Artificial Sequence
  chemically synthesized
tctaaatcaccattaacgcagc

SEQ ID NO: 1051202 - DNA, 22 bp, Artificial Sequence
  chemically synthesized
aaaaatggttttctaaatcacc

SEQ ID NO: 1051203 - DNA, 22 bp, Artificial Sequence
  chemically synthesized
aaaaaatggttttctaaatcac

SEQ ID NO: 1051204 - DNA, 22 bp, Artificial Sequence
  chemically synthesized
taaaaaatggttttctaaatca

SEQ ID NO: 1051205 - DNA, 22 bp, Artificial Sequence
  chemically synthesized
ttaaaaaatggttttctaaatc

SEQ ID NO: 1051206 - DNA, 22 bp, Artificial Sequence
  chemically synthesized
tttaaaaaatggttttctaaat

SEQ ID NO: 1051207 - DNA, 22 bp, Artificial Sequence
  chemically synthesized
cgttaatggtgatttagaaaac

SEQ ID NO: 1051208 - DNA, 22 bp, Artificial Sequence
  chemically synthesized
actttttaaaaaatggttttct

SEQ ID NO: 1051209 - DNA, 22 bp, Artificial Sequence
  chemically synthesized
cactttttaaaaaatggttttc

SEQ ID NO: 1051210 - DNA, 22 bp, Artificial Sequence
  chemically synthesized
atggtgatttagaaaaccattt

SEQ ID NO: 1051211 - DNA, 22 bp, Artificial Sequence
  chemically synthesized
tcactttttaaaaaatggtttt

SEQ ID NO: 1051212 - DNA, 22 bp, Artificial Sequence
  chemically synthesized
tgactttcactttttaaaaaat

SEQ ID NO: 1051213 - DNA, 22 bp, Artificial Sequence
  chemically synthesized
gtgactttcactttttaaaaaa

SEQ ID NO: 1051214 - DNA, 22 bp, Artificial Sequence
  chemically synthesized
ttgtgactttcactttttaaaa

SEQ ID NO: 1051215 - DNA, 22 bp, Artificial Sequence
  chemically synthesized
agaaaaccattttttaaaaagt

SEQ ID NO: 1051216 - DNA, 22 bp, Artificial Sequence
  chemically synthesized
cttgtgactttcactttttaaa

SEQ ID NO: 1051217 - DNA, 22 bp, Artificial Sequence
  chemically synthesized
gaaaaccattttttaaaaagtg

SEQ ID NO: 1051218 - DNA, 22 bp, Artificial Sequence
  chemically synthesized
tgtttcttgtgactttcacttt

SEQ ID NO: 1051219 - DNA, 22 bp, Artificial Sequence
  chemically synthesized
atgtttcttgtgactttcactt

SEQ ID NO: 1051220 - DNA, 22 bp, Artificial Sequence
  chemically synthesized
tatgtttcttgtgactttcact

SEQ ID NO: 1051221 - DNA, 22 bp, Artificial Sequence
  chemically synthesized
ttatgtttcttgtgactttcac

SEQ ID NO: 1051222 - DNA, 22 bp, Artificial Sequence
  chemically synthesized
tttaaaaagtgaaagtcacaag

SEQ ID NO: 1051223 - DNA, 22 bp, Artificial Sequence
  chemically synthesized
ttaaaaagtgaaagtcacaaga

SEQ ID NO: 1051224 - DNA, 22 bp, Artificial Sequence
  chemically synthesized
tatttttatgtttcttgtgact

SEQ ID NO: 1051225 - DNA, 22 bp, Artificial Sequence
  chemically synthesized
taaaaagtgaaagtcacaagaa

SEQ ID NO: 1051226 - DNA, 22 bp, Artificial Sequence
  chemically synthesized
gtatttttatgtttcttgtgac

SEQ ID NO: 1051227 - DNA, 22 bp, Artificial Sequence
  chemically synthesized
aaaaagtgaaagtcacaagaaa

SEQ ID NO: 1051228 - DNA, 22 bp, Artificial Sequence
  chemically synthesized
aaaagtgaaagtcacaagaaac

SEQ ID NO: 1051229 - DNA, 22 bp, Artificial Sequence
  chemically synthesized
tgaccttgtatttttatgtttc

SEQ ID NO: 1051230 - DNA, 22 bp, Artificial Sequence
  chemically synthesized
acgcagcattgtgaccttgtat

SEQ ID NO: 1051231 - DNA, 22 bp, Artificial Sequence
  chemically synthesized
aatcaccattaacgcagcattg

SEQ ID NO: 1051232 - DNA, 22 bp, Artificial Sequence
  chemically synthesized
taaatcaccattaacgcagcat

SEQ ID NO: 1051233 - DNA, 22 bp, Artificial Sequence
  chemically synthesized
ctaaatcaccattaacgcagca

SEQ ID NO: 1051234 - DNA, 22 bp, Artificial Sequence
  chemically synthesized
tctaaatcaccattaacgcagc

SEQ ID NO: 1051235 - DNA, 22 bp, Artificial Sequence
  chemically synthesized
aaaaatggttttctaaatcacc

SEQ ID NO: 1051236 - DNA, 22 bp, Artificial Sequence
  chemically synthesized
aaaaaatggttttctaaatcac

SEQ ID NO: 1051237 - DNA, 22 bp, Artificial Sequence
  chemically synthesized
taaaaaatggttttctaaatca

SEQ ID NO: 1051238 - DNA, 22 bp, Artificial Sequence
  chemically synthesized
ttaaaaaatggttttctaaatc

SEQ ID NO: 1051239 - DNA, 22 bp, Artificial Sequence
  chemically synthesized
tttaaaaaatggttttctaaat

SEQ ID NO: 1051240 - DNA, 22 bp, Artificial Sequence
  chemically synthesized
cgttaatggtgatttagaaaac

SEQ ID NO: 1051241 - DNA, 22 bp, Artificial Sequence
  chemically synthesized
actttttaaaaaatggttttct

SEQ ID NO: 1051242 - DNA, 22 bp, Artificial Sequence
  chemically synthesized
cactttttaaaaaatggttttc

SEQ ID NO: 1051243 - DNA, 22 bp, Artificial Sequence
  chemically synthesized
atggtgatttagaaaaccattt

SEQ ID NO: 1051244 - DNA, 22 bp, Artificial Sequence
  chemically synthesized
tcactttttaaaaaatggtttt

SEQ ID NO: 1051245 - DNA, 22 bp, Artificial Sequence
  chemically synthesized
actttcactttttaaaaaatgg

SEQ ID NO: 1051246 - DNA, 22 bp, Artificial Sequence
  chemically synthesized
gactttcactttttaaaaaatg

SEQ ID NO: 1051247 - DNA, 22 bp, Artificial Sequence
  chemically synthesized
tgactttcactttttaaaaaat

SEQ ID NO: 1051248 - DNA, 22 bp, Artificial Sequence
  chemically synthesized
ttttgactttcactttttaaaa

SEQ ID NO: 1051249 - DNA, 22 bp, Artificial Sequence
  chemically synthesized
agaaaaccattttttaaaaagt

SEQ ID NO: 1051250 - DNA, 22 bp, Artificial Sequence
  chemically synthesized
gaaaaccattttttaaaaagtg

SEQ ID NO: 1051251 - DNA, 22 bp, Artificial Sequence
  chemically synthesized
ttattttgactttcacttttta

SEQ ID NO: 1051252 - DNA, 22 bp, Artificial Sequence
  chemically synthesized
atgctattattttgactttcac

SEQ ID NO: 1051253 - DNA, 22 bp, Artificial Sequence
  chemically synthesized
gatgctattattttgactttca

SEQ ID NO: 1051254 - DNA, 22 bp, Artificial Sequence
  chemically synthesized
tttaaaaagtgaaagtcaaaat

SEQ ID NO: 1051255 - DNA, 22 bp, Artificial Sequence
  chemically synthesized
ttaaaaagtgaaagtcaaaata

SEQ ID NO: 1051256 - DNA, 22 bp, Artificial Sequence
  chemically synthesized
atttgatgctattattttgact

SEQ ID NO: 1051257 - DNA, 22 bp, Artificial Sequence
  chemically synthesized
taaaaagtgaaagtcaaaataa

SEQ ID NO: 1051258 - DNA, 22 bp, Artificial Sequence
  chemically synthesized
catttgatgctattattttgac

SEQ ID NO: 1051259 - DNA, 22 bp, Artificial Sequence
  chemically synthesized
aaaaagtgaaagtcaaaataat

SEQ ID NO: 1051260 - DNA, 22 bp, Artificial Sequence
  chemically synthesized
aaaagtgaaagtcaaaataata

SEQ ID NO: 1051261 - DNA, 22 bp, Artificial Sequence
  chemically synthesized
tacttcatttgatgctattatt

SEQ ID NO: 1051262 - DNA, 22 bp, Artificial Sequence
  chemically synthesized
aactatacttcatttgatgcta

SEQ ID NO: 1051263 - DNA, 22 bp, Artificial Sequence
  chemically synthesized
gaactatacttcatttgatgct

SEQ ID NO: 1051264 - DNA, 22 bp, Artificial Sequence
  chemically synthesized
ggtcttgaactatacttcattt

SEQ ID NO: 1051265 - DNA, 22 bp, Artificial Sequence
  chemically synthesized
cggtcttgaactatacttcatt

SEQ ID NO: 1051266 - DNA, 22 bp, Artificial Sequence
  chemically synthesized
tcggtcttgaactatacttcat

SEQ ID NO: 1051267 - DNA, 22 bp, Artificial Sequence
  chemically synthesized
ttcggtcttgaactatacttca

SEQ ID NO: 1051268 - DNA, 22 bp, Artificial Sequence
  chemically synthesized
gtgcttttcggtcttgaactat

SEQ ID NO: 1051269 - DNA, 22 bp, Artificial Sequence
  chemically synthesized
agtgcttttcggtcttgaacta

SEQ ID NO: 1051270 - DNA, 22 bp, Artificial Sequence
  chemically synthesized
agacccatttagtgcttttcgg

SEQ ID NO: 1051271 - DNA, 22 bp, Artificial Sequence
  chemically synthesized
tgagacccatttagtgcttttc

SEQ ID NO: 1051272 - DNA, 22 bp, Artificial Sequence
  chemically synthesized
tctgagacccatttagtgcttt

SEQ ID NO: 1051273 - DNA, 22 bp, Artificial Sequence
  chemically synthesized
aagaccgaaaagcactaaatgg

SEQ ID NO: 1051274 - DNA, 22 bp, Artificial Sequence
  chemically synthesized
caatggttctctgagacccatt

SEQ ID NO: 1051275 - DNA, 22 bp, Artificial Sequence
  chemically synthesized
tcattacaatggttctctgaga

SEQ ID NO: 1051276 - DNA, 22 bp, Artificial Sequence
  chemically synthesized
gtcattacaatggttctctgag

SEQ ID NO: 1051277 - DNA, 22 bp, Artificial Sequence
  chemically synthesized
tgtcattacaatggttctctga

SEQ ID NO: 1051278 - DNA, 22 bp, Artificial Sequence
  chemically synthesized
ttgtcattacaatggttctctg

SEQ ID NO: 1051279 - DNA, 22 bp, Artificial Sequence
  chemically synthesized
aatgggtctcagagaaccattg

SEQ ID NO: 1051280 - DNA, 22 bp, Artificial Sequence
  chemically synthesized
agagaaccattgtaatgacaaa

SEQ ID NO: 1051281 - DNA, 22 bp, Artificial Sequence
  chemically synthesized
ggaagaagtgtgatttttgtca

SEQ ID NO: 1051282 - DNA, 22 bp, Artificial Sequence
  chemically synthesized
gggaagaagtgtgatttttgtc

SEQ ID NO: 1051283 - DNA, 22 bp, Artificial Sequence
  chemically synthesized
tgggaagaagtgtgatttttgt

SEQ ID NO: 1051284 - DNA, 22 bp, Artificial Sequence
  chemically synthesized
tgctttgggaagaagtgtgatt

SEQ ID NO: 1051285 - DNA, 22 bp, Artificial Sequence
  chemically synthesized
taatgacaaaaatcacacttct

SEQ ID NO: 1051286 - DNA, 22 bp, Artificial Sequence
  chemically synthesized
ctgtgctttgggaagaagtgtg

SEQ ID NO: 1051287 - DNA, 22 bp, Artificial Sequence
  chemically synthesized
atgactactgtgctttgggaag

SEQ ID NO: 1051288 - DNA, 22 bp, Artificial Sequence
  chemically synthesized
cttcccaaagcacagtagtcat

SEQ ID NO: 1051289 - DNA, 22 bp, Artificial Sequence
  chemically synthesized
ttcccaaagcacagtagtcatt

SEQ ID NO: 1051290 - DNA, 22 bp, Artificial Sequence
  chemically synthesized
gggcatagcaattaatgactac

SEQ ID NO: 1051291 - DNA, 22 bp, Artificial Sequence
  chemically synthesized
cccaaagcacagtagtcattaa

SEQ ID NO: 1051292 - DNA, 22 bp, Artificial Sequence
  chemically synthesized
ggggcatagcaattaatgacta

SEQ ID NO: 1051293 - DNA, 22 bp, Artificial Sequence
  chemically synthesized
ccaaagcacagtagtcattaat

SEQ ID NO: 1051294 - DNA, 22 bp, Artificial Sequence
  chemically synthesized
tttggggcatagcaattaatga

SEQ ID NO: 1051295 - DNA, 22 bp, Artificial Sequence
  chemically synthesized
attgctatgccccaaacaattg

SEQ ID NO: 1051296 - DNA, 22 bp, Artificial Sequence
  chemically synthesized
tgtagaatgcacccaattgttt

SEQ ID NO: 1051297 - DNA, 22 bp, Artificial Sequence
  chemically synthesized
atgtagaatgcacccaattgtt

SEQ ID NO: 1051298 - DNA, 22 bp, Artificial Sequence
  chemically synthesized
ctatgccccaaacaattgggtg

SEQ ID NO: 1051299 - DNA, 22 bp, Artificial Sequence
  chemically synthesized
ccttatgtagaatgcacccaat

SEQ ID NO: 1051300 - DNA, 22 bp, Artificial Sequence
  chemically synthesized
tgccccaaacaattgggtgcat

SEQ ID NO: 1051301 - DNA, 22 bp, Artificial Sequence
  chemically synthesized
accttatgtagaatgcacccaa

SEQ ID NO: 1051302 - DNA, 22 bp, Artificial Sequence
  chemically synthesized
taccttatgtagaatgcaccca

SEQ ID NO: 1051303 - DNA, 22 bp, Artificial Sequence
  chemically synthesized
ttaccttatgtagaatgcaccc

SEQ ID NO: 1051304 - DNA, 22 bp, Artificial Sequence
  chemically synthesized
gtaatttttaccttatgtagaa

SEQ ID NO: 1051305 - DNA, 22 bp, Artificial Sequence
  chemically synthesized
tagtaatttttaccttatgtag

SEQ ID NO: 1051306 - DNA, 22 bp, Artificial Sequence
  chemically synthesized
ctagtaatttttaccttatgta

SEQ ID NO: 1051307 - DNA, 22 bp, Artificial Sequence
  chemically synthesized
ggtgcattctacataaggtaaa

SEQ ID NO: 1051308 - DNA, 22 bp, Artificial Sequence
  chemically synthesized
tttctagtaatttttaccttat

SEQ ID NO: 1051309 - DNA, 22 bp, Artificial Sequence
  chemically synthesized
atttctagtaatttttacctta

SEQ ID NO: 1051310 - DNA, 22 bp, Artificial Sequence
  chemically synthesized
tatttctagtaatttttacctt

SEQ ID NO: 1051311 - DNA, 22 bp, Artificial Sequence
  chemically synthesized
ttatttctagtaatttttacct

SEQ ID NO: 1051312 - DNA, 22 bp, Artificial Sequence
  chemically synthesized
cttttatttctagtaattttta

SEQ ID NO: 1051313 - DNA, 22 bp, Artificial Sequence
  chemically synthesized
tccttttatttctagtaatttt

SEQ ID NO: 1051314 - DNA, 22 bp, Artificial Sequence
  chemically synthesized
tacataaggtaaaaattactag

SEQ ID NO: 1051315 - DNA, 22 bp, Artificial Sequence
  chemically synthesized
cataaggtaaaaattactagaa

SEQ ID NO: 1051316 - DNA, 22 bp, Artificial Sequence
  chemically synthesized
tcatgttctccttttatttcta

SEQ ID NO: 1051317 - DNA, 22 bp, Artificial Sequence
  chemically synthesized
atcatgttctccttttatttct

SEQ ID NO: 1051318 - DNA, 22 bp, Artificial Sequence
  chemically synthesized
tatcatgttctccttttatttc

SEQ ID NO: 1051319 - DNA, 22 bp, Artificial Sequence
  chemically synthesized
tgattttatcatgttctccttt

SEQ ID NO: 1051320 - DNA, 22 bp, Artificial Sequence
  chemically synthesized
ctagaaataaaaggagaacatg

SEQ ID NO: 1051321 - DNA, 22 bp, Artificial Sequence
  chemically synthesized
gaaataaaaggagaacatgata

SEQ ID NO: 1051322 - DNA, 22 bp, Artificial Sequence
  chemically synthesized
cagctatgattttatcatgttc

SEQ ID NO: 1051323 - DNA, 22 bp, Artificial Sequence
  chemically synthesized
tatgtaaggtaccaactacagc

SEQ ID NO: 1051324 - DNA, 22 bp, Artificial Sequence
  chemically synthesized
cagaagagttgtatgtaaggta

SEQ ID NO: 1051325 - DNA, 22 bp, Artificial Sequence
  chemically synthesized
tagttggtaccttacatacaac

SEQ ID NO: 1051326 - DNA, 22 bp, Artificial Sequence
  chemically synthesized
acaaattacagaagagttgtat

SEQ ID NO: 1051327 - DNA, 22 bp, Artificial Sequence
  chemically synthesized
gtaccttacatacaactcttct

SEQ ID NO: 1051328 - DNA, 22 bp, Artificial Sequence
  chemically synthesized
atctaacaaattacagaagagt

SEQ ID NO: 1051329 - DNA, 22 bp, Artificial Sequence
  chemically synthesized
aatctaacaaattacagaagag

SEQ ID NO: 1051330 - DNA, 22 bp, Artificial Sequence
  chemically synthesized
taatctaacaaattacagaaga

SEQ ID NO: 1051331 - DNA, 22 bp, Artificial Sequence
  chemically synthesized
acatacaactcttctgtaattt

SEQ ID NO: 1051332 - DNA, 22 bp, Artificial Sequence
  chemically synthesized
ttttaatctaacaaattacaga

SEQ ID NO: 1051333 - DNA, 22 bp, Artificial Sequence
  chemically synthesized
catacaactcttctgtaatttg

SEQ ID NO: 1051334 - DNA, 22 bp, Artificial Sequence
  chemically synthesized
tctattttaatctaacaaatta

SEQ ID NO: 1051335 - DNA, 22 bp, Artificial Sequence
  chemically synthesized
gtctattttaatctaacaaatt

SEQ ID NO: 1051336 - DNA, 22 bp, Artificial Sequence
  chemically synthesized
tgtctattttaatctaacaaat

SEQ ID NO: 1051337 - DNA, 22 bp, Artificial Sequence
  chemically synthesized
ttgtctattttaatctaacaaa

SEQ ID NO: 1051338 - DNA, 22 bp, Artificial Sequence
  chemically synthesized
tttgtctattttaatctaacaa

SEQ ID NO: 1051339 - DNA, 22 bp, Artificial Sequence
  chemically synthesized
ttctgtaatttgttagattaaa

SEQ ID NO: 1051340 - DNA, 22 bp, Artificial Sequence
  chemically synthesized
ctgtaatttgttagattaaaat

SEQ ID NO: 1051341 - DNA, 22 bp, Artificial Sequence
  chemically synthesized
tattttttgtctattttaatct

SEQ ID NO: 1051342 - DNA, 22 bp, Artificial Sequence
  chemically synthesized
tgtaatttgttagattaaaata

SEQ ID NO: 1051343 - DNA, 22 bp, Artificial Sequence
  chemically synthesized
gtattttttgtctattttaatc

SEQ ID NO: 1051344 - DNA, 22 bp, Artificial Sequence
  chemically synthesized
taatttgttagattaaaataga

SEQ ID NO: 1051345 - DNA, 22 bp, Artificial Sequence
  chemically synthesized
tttgtattttttgtctatttta

SEQ ID NO: 1051346 - DNA, 22 bp, Artificial Sequence
  chemically synthesized
atttgtattttttgtctatttt

SEQ ID NO: 1051347 - DNA, 22 bp, Artificial Sequence
  chemically synthesized
tatttgtattttttgtctattt

SEQ ID NO: 1051348 - DNA, 22 bp, Artificial Sequence
  chemically synthesized
ttatttgtattttttgtctatt

SEQ ID NO: 1051349 - DNA, 22 bp, Artificial Sequence
  chemically synthesized
tttatttgtattttttgtctat

SEQ ID NO: 1051350 - DNA, 22 bp, Artificial Sequence
  chemically synthesized
gttagattaaaatagacaaaaa

SEQ ID NO: 1051351 - DNA, 22 bp, Artificial Sequence
  chemically synthesized
ttagattaaaatagacaaaaaa

SEQ ID NO: 1051352 - DNA, 22 bp, Artificial Sequence
  chemically synthesized
ttttttatttgtattttttgtc

SEQ ID NO: 1051353 - DNA, 22 bp, Artificial Sequence
  chemically synthesized
gttttttatttgtattttttgt

SEQ ID NO: 1051354 - DNA, 22 bp, Artificial Sequence
  chemically synthesized
gattaaaatagacaaaaaatac

SEQ ID NO: 1051355 - DNA, 22 bp, Artificial Sequence
  chemically synthesized
ttgttttttatttgtatttttt

SEQ ID NO: 1051356 - DNA, 22 bp, Artificial Sequence
  chemically synthesized
ttcttgttttttatttgtattt

SEQ ID NO: 1051357 - DNA, 22 bp, Artificial Sequence
  chemically synthesized
aaatagacaaaaaatacaaata

SEQ ID NO: 1051358 - DNA, 22 bp, Artificial Sequence
  chemically synthesized
tattcttgttttttatttgtat

SEQ ID NO: 1051359 - DNA, 22 bp, Artificial Sequence
  chemically synthesized
aaccacctctattcttgttttt

SEQ ID NO: 1051360 - DNA, 22 bp, Artificial Sequence
  chemically synthesized
aaaccacctctattcttgtttt

SEQ ID NO: 1051361 - DNA, 22 bp, Artificial Sequence
  chemically synthesized
taaaccacctctattcttgttt

SEQ ID NO: 1051362 - DNA, 22 bp, Artificial Sequence
  chemically synthesized
tcggttttaaaccacctctatt

SEQ ID NO: 1051363 - DNA, 22 bp, Artificial Sequence
  chemically synthesized
gtcggttttaaaccacctctat

SEQ ID NO: 1051364 - DNA, 22 bp, Artificial Sequence
  chemically synthesized
gcttgtcggttttaaaccacct

SEQ ID NO: 1051365 - DNA, 22 bp, Artificial Sequence
  chemically synthesized
agcttgtcggttttaaaccacc

SEQ ID NO: 1051366 - DNA, 22 bp, Artificial Sequence
  chemically synthesized
aatttagcttgtcggttttaaa

SEQ ID NO: 1051367 - DNA, 22 bp, Artificial Sequence
  chemically synthesized
aaaaccgacaagctaaatttaa

SEQ ID NO: 1051368 - DNA, 22 bp, Artificial Sequence
  chemically synthesized
aaaccgacaagctaaatttaat

SEQ ID NO: 1051369 - DNA, 22 bp, Artificial Sequence
  chemically synthesized
cagtgtgcacaaaatacggatt

SEQ ID NO: 1051370 - DNA, 22 bp, Artificial Sequence
  chemically synthesized
ccagtgtgcacaaaatacggat

SEQ ID NO: 1051371 - DNA, 22 bp, Artificial Sequence
  chemically synthesized
tccagtgtgcacaaaatacgga

SEQ ID NO: 1051372 - DNA, 22 bp, Artificial Sequence
  chemically synthesized
ttccagtgtgcacaaaatacgg

SEQ ID NO: 1051373 - DNA, 22 bp, Artificial Sequence
  chemically synthesized
tttccagtgtgcacaaaatacg

SEQ ID NO: 1051374 - DNA, 22 bp, Artificial Sequence
  chemically synthesized
aatttaatccgtattttgtgca

SEQ ID NO: 1051375 - DNA, 22 bp, Artificial Sequence
  chemically synthesized
aatccgtattttgtgcacactg

SEQ ID NO: 1051376 - DNA, 22 bp, Artificial Sequence
  chemically synthesized
atccgtattttgtgcacactgg

SEQ ID NO: 1051377 - DNA, 22 bp, Artificial Sequence
  chemically synthesized
tgtgcacactggaaaaagcata

SEQ ID NO: 1051378 - DNA, 22 bp, Artificial Sequence
  chemically synthesized
gtgcacactggaaaaagcatat

SEQ ID NO: 1051379 - DNA, 22 bp, Artificial Sequence
  chemically synthesized
tgcacactggaaaaagcatatt

SEQ ID NO: 1051380 - DNA, 22 bp, Artificial Sequence
  chemically synthesized
atgtcccaagtaaataggagaa

SEQ ID NO: 1051381 - DNA, 22 bp, Artificial Sequence
  chemically synthesized
gaaaaagcatattctcctattt

SEQ ID NO: 1051382 - DNA, 22 bp, Artificial Sequence
  chemically synthesized
gatgtcccaagtaaataggaga

SEQ ID NO: 1051383 - DNA, 22 bp, Artificial Sequence
  chemically synthesized
tgatgtcccaagtaaataggag

SEQ ID NO: 1051384 - DNA, 22 bp, Artificial Sequence
  chemically synthesized
ttgatgtcccaagtaaatagga

SEQ ID NO: 1051385 - DNA, 22 bp, Artificial Sequence
  chemically synthesized
tgtaatttttgatgtcccaagt

SEQ ID NO: 1051386 - DNA, 22 bp, Artificial Sequence
  chemically synthesized
tatgtaatttttgatgtcccaa

SEQ ID NO: 1051387 - DNA, 22 bp, Artificial Sequence
  chemically synthesized
tcctatttacttgggacatcaa

SEQ ID NO: 1051388 - DNA, 22 bp, Artificial Sequence
  chemically synthesized
tctatgtaatttttgatgtccc

SEQ ID NO: 1051389 - DNA, 22 bp, Artificial Sequence
  chemically synthesized
ctatttacttgggacatcaaaa

SEQ ID NO: 1051390 - DNA, 22 bp, Artificial Sequence
  chemically synthesized
ctctctatgtaatttttgatgt

SEQ ID NO: 1051391 - DNA, 22 bp, Artificial Sequence
  chemically synthesized
cctctctatgtaatttttgatg

SEQ ID NO: 1051392 - DNA, 22 bp, Artificial Sequence
  chemically synthesized
tttacttgggacatcaaaaatt

SEQ ID NO: 1051393 - DNA, 22 bp, Artificial Sequence
  chemically synthesized
acttgggacatcaaaaattaca

SEQ ID NO: 1051394 - DNA, 22 bp, Artificial Sequence
  chemically synthesized
cttgggacatcaaaaattacat

SEQ ID NO: 1051395 - DNA, 22 bp, Artificial Sequence
  chemically synthesized
aaagtttcctctctatgtaatt

SEQ ID NO: 1051396 - DNA, 22 bp, Artificial Sequence
  chemically synthesized
gggacatcaaaaattacataga

SEQ ID NO: 1051397 - DNA, 22 bp, Artificial Sequence
  chemically synthesized
aaaagtttcctctctatgtaat

SEQ ID NO: 1051398 - DNA, 22 bp, Artificial Sequence
  chemically synthesized
ggacatcaaaaattacatagag

SEQ ID NO: 1051399 - DNA, 22 bp, Artificial Sequence
  chemically synthesized
taaaagtttcctctctatgtaa

SEQ ID NO: 1051400 - DNA, 22 bp, Artificial Sequence
  chemically synthesized
ttaaaagtttcctctctatgta

SEQ ID NO: 1051401 - DNA, 22 bp, Artificial Sequence
  chemically synthesized
atgcttttaaaagtttcctctc

SEQ ID NO: 1051402 - DNA, 22 bp, Artificial Sequence
  chemically synthesized
gatgcttttaaaagtttcctct

SEQ ID NO: 1051403 - DNA, 22 bp, Artificial Sequence
  chemically synthesized
tgatgcttttaaaagtttcctc

SEQ ID NO: 1051404 - DNA, 22 bp, Artificial Sequence
  chemically synthesized
ttgatgcttttaaaagtttcct

SEQ ID NO: 1051405 - DNA, 22 bp, Artificial Sequence
  chemically synthesized
tttgatgcttttaaaagtttcc

SEQ ID NO: 1051406 - DNA, 22 bp, Artificial Sequence
  chemically synthesized
tttttgatgcttttaaaagttt

SEQ ID NO: 1051407 - DNA, 22 bp, Artificial Sequence
  chemically synthesized
ctttttgatgcttttaaaagtt

SEQ ID NO: 1051408 - DNA, 22 bp, Artificial Sequence
  chemically synthesized
catagagaggaaacttttaaaa

SEQ ID NO: 1051409 - DNA, 22 bp, Artificial Sequence
  chemically synthesized
tctttttgatgcttttaaaagt

SEQ ID NO: 1051410 - DNA, 22 bp, Artificial Sequence
  chemically synthesized
tcaaatctttctttttgatgct

SEQ ID NO: 1051411 - DNA, 22 bp, Artificial Sequence
  chemically synthesized
ttaaaagcatcaaaaagaaaga

SEQ ID NO: 1051412 - DNA, 22 bp, Artificial Sequence
  chemically synthesized
taaaagcatcaaaaagaaagat

SEQ ID NO: 1051413 - DNA, 22 bp, Artificial Sequence
  chemically synthesized
aaaagcatcaaaaagaaagatt

SEQ ID NO: 1051414 - DNA, 22 bp, Artificial Sequence
  chemically synthesized
aaagcatcaaaaagaaagattt

SEQ ID NO: 1051415 - DNA, 22 bp, Artificial Sequence
  chemically synthesized
gaaaaggtggcctatcaaatct

SEQ ID NO: 1051416 - DNA, 22 bp, Artificial Sequence
  chemically synthesized
attagaaaaggtggcctatcaa

SEQ ID NO: 1051417 - DNA, 22 bp, Artificial Sequence
  chemically synthesized
gattagaaaaggtggcctatca

SEQ ID NO: 1051418 - DNA, 22 bp, Artificial Sequence
  chemically synthesized
tgattagaaaaggtggcctatc

SEQ ID NO: 1051419 - DNA, 22 bp, Artificial Sequence
  chemically synthesized
tattttgattagaaaaggtggc

SEQ ID NO: 1051420 - DNA, 22 bp, Artificial Sequence
  chemically synthesized
ttatattttgattagaaaaggt

SEQ ID NO: 1051421 - DNA, 22 bp, Artificial Sequence
  chemically synthesized
gataggccaccttttctaatca

SEQ ID NO: 1051422 - DNA, 22 bp, Artificial Sequence
  chemically synthesized
ataggccaccttttctaatcaa

SEQ ID NO: 1051423 - DNA, 22 bp, Artificial Sequence
  chemically synthesized
gattattatattttgattagaa

SEQ ID NO: 1051424 - DNA, 22 bp, Artificial Sequence
  chemically synthesized
tggattattatattttgattag

SEQ ID NO: 1051425 - DNA, 22 bp, Artificial Sequence
  chemically synthesized
ctggattattatattttgatta

SEQ ID NO: 1051426 - DNA, 22 bp, Artificial Sequence
  chemically synthesized
catttctggattattatatttt

SEQ ID NO: 1051427 - DNA, 22 bp, Artificial Sequence
  chemically synthesized
tacatttctggattattatatt

SEQ ID NO: 1051428 - DNA, 22 bp, Artificial Sequence
  chemically synthesized
ctacatttctggattattatat

SEQ ID NO: 1051429 - DNA, 22 bp, Artificial Sequence
  chemically synthesized
ttctaatcaaaatataataatc

SEQ ID NO: 1051430 - DNA, 22 bp, Artificial Sequence
  chemically synthesized
tctaatcaaaatataataatcc

SEQ ID NO: 1051431 - DNA, 22 bp, Artificial Sequence
  chemically synthesized
ttctacatttctggattattat

SEQ ID NO: 1051432 - DNA, 22 bp, Artificial Sequence
  chemically synthesized
ctaatcaaaatataataatcca

SEQ ID NO: 1051433 - DNA, 22 bp, Artificial Sequence
  chemically synthesized
taatcaaaatataataatccag

SEQ ID NO: 1051434 - DNA, 22 bp, Artificial Sequence
  chemically synthesized
ttcttctacatttctggattat

SEQ ID NO: 1051435 - DNA, 22 bp, Artificial Sequence
  chemically synthesized
atcaaaatataataatccagaa

SEQ ID NO: 1051436 - DNA, 22 bp, Artificial Sequence
  chemically synthesized
ttattcttctacatttctggat

SEQ ID NO: 1051437 - DNA, 22 bp, Artificial Sequence
  chemically synthesized
tattattcttctacatttctgg

SEQ ID NO: 1051438 - DNA, 22 bp, Artificial Sequence
  chemically synthesized
gatgatgaatcaaaatgtattc

SEQ ID NO: 1051439 - DNA, 22 bp, Artificial Sequence
  chemically synthesized
agatgatgaatcaaaatgtatt

SEQ ID NO: 1051440 - DNA, 22 bp, Artificial Sequence
  chemically synthesized
tgaaagtcttagatgatgaatc

SEQ ID NO: 1051441 - DNA, 22 bp, Artificial Sequence
  chemically synthesized
gtgaaagtcttagatgatgaat

SEQ ID NO: 1051442 - DNA, 22 bp, Artificial Sequence
  chemically synthesized
tgtgaaagtcttagatgatgaa

SEQ ID NO: 1051443 - DNA, 22 bp, Artificial Sequence
  chemically synthesized
tttgtgaaagtcttagatgatg

SEQ ID NO: 1051444 - DNA, 22 bp, Artificial Sequence
  chemically synthesized
tgattcatcatctaagactttc

SEQ ID NO: 1051445 - DNA, 22 bp, Artificial Sequence
  chemically synthesized
tacattctttgtgaaagtctta

SEQ ID NO: 1051446 - DNA, 22 bp, Artificial Sequence
  chemically synthesized
gattcatcatctaagactttca

SEQ ID NO: 1051447 - DNA, 22 bp, Artificial Sequence
  chemically synthesized
atacattctttgtgaaagtctt

SEQ ID NO: 1051448 - DNA, 22 bp, Artificial Sequence
  chemically synthesized
attcatcatctaagactttcac

SEQ ID NO: 1051449 - DNA, 22 bp, Artificial Sequence
  chemically synthesized
atcatctaagactttcacaaag

SEQ ID NO: 1051450 - DNA, 22 bp, Artificial Sequence
  chemically synthesized
agactttcacaaagaatgtata

SEQ ID NO: 1051451 - DNA, 22 bp, Artificial Sequence
  chemically synthesized
tcacaaagaatgtataagatct

SEQ ID NO: 1051452 - DNA, 22 bp, Artificial Sequence
  chemically synthesized
cacaaagaatgtataagatcta

SEQ ID NO: 1051453 - DNA, 22 bp, Artificial Sequence
  chemically synthesized
acaaagaatgtataagatctat

SEQ ID NO: 1051454 - DNA, 22 bp, Artificial Sequence
  chemically synthesized
ccaggtaatgtatatagatctt

SEQ ID NO: 1051455 - DNA, 22 bp, Artificial Sequence
  chemically synthesized
gaaacatgttcccaggtaatgt

SEQ ID NO: 1051456 - DNA, 22 bp, Artificial Sequence
  chemically synthesized
tatacattacctgggaacatgt

SEQ ID NO: 1051457 - DNA, 22 bp, Artificial Sequence
  chemically synthesized
aatataacagtcaattagaaac

SEQ ID NO: 1051458 - DNA, 22 bp, Artificial Sequence
  chemically synthesized
cctgggaacatgtttctaattg

SEQ ID NO: 1051459 - DNA, 22 bp, Artificial Sequence
  chemically synthesized
aaatataacagtcaattagaaa

SEQ ID NO: 1051460 - DNA, 22 bp, Artificial Sequence
  chemically synthesized
taaatataacagtcaattagaa

SEQ ID NO: 1051461 - DNA, 22 bp, Artificial Sequence
  chemically synthesized
ggaacatgtttctaattgactg

SEQ ID NO: 1051462 - DNA, 22 bp, Artificial Sequence
  chemically synthesized
ttttaaatataacagtcaatta

SEQ ID NO: 1051463 - DNA, 22 bp, Artificial Sequence
  chemically synthesized
tgtattattttaaatataacag

SEQ ID NO: 1051464 - DNA, 22 bp, Artificial Sequence
  chemically synthesized
tgtgtattattttaaatataac

SEQ ID NO: 1051465 - DNA, 22 bp, Artificial Sequence
  chemically synthesized
ctaattgactgttatatttaaa

SEQ ID NO: 1051466 - DNA, 22 bp, Artificial Sequence
  chemically synthesized
taattgactgttatatttaaaa

SEQ ID NO: 1051467 - DNA, 22 bp, Artificial Sequence
  chemically synthesized
ttctgtgtattattttaaatat

SEQ ID NO: 1051468 - DNA, 22 bp, Artificial Sequence
  chemically synthesized
attctgtgtattattttaaata

SEQ ID NO: 1051469 - DNA, 22 bp, Artificial Sequence
  chemically synthesized
attgactgttatatttaaaata

SEQ ID NO: 1051470 - DNA, 22 bp, Artificial Sequence
  chemically synthesized
tattctgtgtattattttaaat

SEQ ID NO: 1051471 - DNA, 22 bp, Artificial Sequence
  chemically synthesized
ctttattctgtgtattatttta

SEQ ID NO: 1051472 - DNA, 22 bp, Artificial Sequence
  chemically synthesized
actgttatatttaaaataatac

SEQ ID NO: 1051473 - DNA, 22 bp, Artificial Sequence
  chemically synthesized
ttatatttaaaataatacacag

SEQ ID NO: 1051474 - DNA, 22 bp, Artificial Sequence
  chemically synthesized
tatttaaaataatacacagaat

SEQ ID NO: 1051475 - DNA, 22 bp, Artificial Sequence
  chemically synthesized
aaaaatactgctttattctgtg

SEQ ID NO: 1051476 - DNA, 22 bp, Artificial Sequence
  chemically synthesized
aaaaaatactgctttattctgt

SEQ ID NO: 1051477 - DNA, 22 bp, Artificial Sequence
  chemically synthesized
taaaaaatactgctttattctg

SEQ ID NO: 1051478 - DNA, 22 bp, Artificial Sequence
  chemically synthesized
aaaataatacacagaataaagc

SEQ ID NO: 1051479 - DNA, 22 bp, Artificial Sequence
  chemically synthesized
ttaaaaaatactgctttattct

SEQ ID NO: 1051480 - DNA, 22 bp, Artificial Sequence
  chemically synthesized
aaataatacacagaataaagca

SEQ ID NO: 1051481 - DNA, 22 bp, Artificial Sequence
  chemically synthesized
tttaaaaaatactgctttattc

SEQ ID NO: 1051482 - DNA, 22 bp, Artificial Sequence
  chemically synthesized
ttttaaaaaatactgctttatt

SEQ ID NO: 1051483 - DNA, 22 bp, Artificial Sequence
  chemically synthesized
cttttttaaaaaatactgcttt

SEQ ID NO: 1051484 - DNA, 22 bp, Artificial Sequence
  chemically synthesized
acttttttaaaaaatactgctt

SEQ ID NO: 1051485 - DNA, 22 bp, Artificial Sequence
  chemically synthesized
tacttttttaaaaaatactgct

SEQ ID NO: 1051486 - DNA, 22 bp, Artificial Sequence
  chemically synthesized
tttaaaaaagtaaaatatatct

SEQ ID NO: 1051487 - DNA, 22 bp, Artificial Sequence
  chemically synthesized
ttaaaaaagtaaaatatatcta

SEQ ID NO: 1051488 - DNA, 22 bp, Artificial Sequence
  chemically synthesized
taaaaaagtaaaatatatctat

SEQ ID NO: 1051489 - DNA, 22 bp, Artificial Sequence
  chemically synthesized
aaaaaagtaaaatatatctata

SEQ ID NO: 1051490 - DNA, 22 bp, Artificial Sequence
  chemically synthesized
aaaaagtaaaatatatctatat

SEQ ID NO: 1051491 - DNA, 22 bp, Artificial Sequence
  chemically synthesized
ccaatgaatagtatatatagat

SEQ ID NO: 1051492 - DNA, 22 bp, Artificial Sequence
  chemically synthesized
accaatgaatagtatatataga

SEQ ID NO: 1051493 - DNA, 22 bp, Artificial Sequence
  chemically synthesized
ttaccaatgaatagtatatata

SEQ ID NO: 1051494 - DNA, 22 bp, Artificial Sequence
  chemically synthesized
attcttaccaatgaatagtata

SEQ ID NO: 1051495 - DNA, 22 bp, Artificial Sequence
  chemically synthesized
ttcattcttaccaatgaatagt

SEQ ID NO: 1051496 - DNA, 22 bp, Artificial Sequence
  chemically synthesized
tatatactattcattggtaaga

SEQ ID NO: 1051497 - DNA, 22 bp, Artificial Sequence
  chemically synthesized
catatactgttcattcttacca

SEQ ID NO: 1051498 - DNA, 22 bp, Artificial Sequence
  chemically synthesized
tattccatatactgttcattct

SEQ ID NO: 1051499 - DNA, 22 bp, Artificial Sequence
  chemically synthesized
ttcattggtaagaatgaacagt

SEQ ID NO: 1051500 - DNA, 22 bp, Artificial Sequence
  chemically synthesized
attggtaagaatgaacagtata

SEQ ID NO: 1051501 - DNA, 22 bp, Artificial Sequence
  chemically synthesized
tactatattccatatactgttc

SEQ ID NO: 1051502 - DNA, 22 bp, Artificial Sequence
  chemically synthesized
gtactatattccatatactgtt

SEQ ID NO: 1051503 - DNA, 22 bp, Artificial Sequence
  chemically synthesized
tgtactatattccatatactgt

SEQ ID NO: 1051504 - DNA, 22 bp, Artificial Sequence
  chemically synthesized
gtaagaatgaacagtatatgga

SEQ ID NO: 1051505 - DNA, 22 bp, Artificial Sequence
  chemically synthesized
tttgtactatattccatatact

SEQ ID NO: 1051506 - DNA, 22 bp, Artificial Sequence
  chemically synthesized
gatatctctttgtactatattc

SEQ ID NO: 1051507 - DNA, 22 bp, Artificial Sequence
  chemically synthesized
agatatctctttgtactatatt

SEQ ID NO: 1051508 - DNA, 22 bp, Artificial Sequence
  chemically synthesized
gtcttagatatctctttgtact

SEQ ID NO: 1051509 - DNA, 22 bp, Artificial Sequence
  chemically synthesized
agtcttagatatctctttgtac

SEQ ID NO: 1051510 - DNA, 22 bp, Artificial Sequence
  chemically synthesized
tagtttagtcttagatatctct

SEQ ID NO: 1051511 - DNA, 22 bp, Artificial Sequence
  chemically synthesized
aaaagtctatagtttagtctta

SEQ ID NO: 1051512 - DNA, 22 bp, Artificial Sequence
  chemically synthesized
aaaaagtctatagtttagtctt

SEQ ID NO: 1051513 - DNA, 22 bp, Artificial Sequence
  chemically synthesized
taaaaagtctatagtttagtct

SEQ ID NO: 1051514 - DNA, 22 bp, Artificial Sequence
  chemically synthesized
gtctttaaaaagtctatagttt

SEQ ID NO: 1051515 - DNA, 22 bp, Artificial Sequence
  chemically synthesized
agtctttaaaaagtctatagtt

SEQ ID NO: 1051516 - DNA, 22 bp, Artificial Sequence
  chemically synthesized
agactaaactatagacttttta

SEQ ID NO: 1051517 - DNA, 22 bp, Artificial Sequence
  chemically synthesized
caatttagtctttaaaaagtct

SEQ ID NO: 1051518 - DNA, 22 bp, Artificial Sequence
  chemically synthesized
aactatagactttttaaagact

SEQ ID NO: 1051519 - DNA, 22 bp, Artificial Sequence
  chemically synthesized
tagactttttaaagactaaatt

SEQ ID NO: 1051520 - DNA, 22 bp, Artificial Sequence
  chemically synthesized
tttaaagactaaattgtagact

SEQ ID NO: 1051521 - DNA, 22 bp, Artificial Sequence
  chemically synthesized
aagcaaaaaaaaagtctacaat

SEQ ID NO: 1051522 - DNA, 22 bp, Artificial Sequence
  chemically synthesized
ttaaagactaaattgtagactt

SEQ ID NO: 1051523 - DNA, 22 bp, Artificial Sequence
  chemically synthesized
taaagactaaattgtagacttt

SEQ ID NO: 1051524 - DNA, 22 bp, Artificial Sequence
  chemically synthesized
aaagactaaattgtagactttt

SEQ ID NO: 1051525 - DNA, 22 bp, Artificial Sequence
  chemically synthesized
aagactaaattgtagacttttt

SEQ ID NO: 1051526 - DNA, 22 bp, Artificial Sequence
  chemically synthesized
actgaagcaaaaaaaaagtcta

SEQ ID NO: 1051527 - DNA, 22 bp, Artificial Sequence
  chemically synthesized
cctcactgaagcaaaaaaaaag

SEQ ID NO: 1051528 - DNA, 22 bp, Artificial Sequence
  chemically synthesized
aattgtagactttttttttgct

SEQ ID NO: 1051529 - DNA, 22 bp, Artificial Sequence
  chemically synthesized
ctccctcactgaagcaaaaaaa

SEQ ID NO: 1051530 - DNA, 22 bp, Artificial Sequence
  chemically synthesized
attcctccctcactgaagcaaa

SEQ ID NO: 1051531 - DNA, 22 bp, Artificial Sequence
  chemically synthesized
tagactttttttttgcttcagt

SEQ ID NO: 1051532 - DNA, 22 bp, Artificial Sequence
  chemically synthesized
ctgattcctccctcactgaagc

SEQ ID NO: 1051533 - DNA, 22 bp, Artificial Sequence
  chemically synthesized
tgctgattcctccctcactgaa

SEQ ID NO: 1051534 - DNA, 22 bp, Artificial Sequence
  chemically synthesized
tttttttgcttcagtgagggag

SEQ ID NO: 1051535 - DNA, 22 bp, Artificial Sequence
  chemically synthesized
ttttttgcttcagtgagggagg

SEQ ID NO: 1051536 - DNA, 22 bp, Artificial Sequence
  chemically synthesized
attctgctgattcctccctcac

SEQ ID NO: 1051537 - DNA, 22 bp, Artificial Sequence
  chemically synthesized
tttttgcttcagtgagggagga

SEQ ID NO: 1051538 - DNA, 22 bp, Artificial Sequence
  chemically synthesized
cattctgctgattcctccctca

SEQ ID NO: 1051539 - DNA, 22 bp, Artificial Sequence
  chemically synthesized
ttttgcttcagtgagggaggaa

SEQ ID NO: 1051540 - DNA, 22 bp, Artificial Sequence
  chemically synthesized
tttgcttcagtgagggaggaat

SEQ ID NO: 1051541 - DNA, 22 bp, Artificial Sequence
  chemically synthesized
ttcattctgctgattcctccct

SEQ ID NO: 1051542 - DNA, 22 bp, Artificial Sequence
  chemically synthesized
ttgcttcagtgagggaggaatc

SEQ ID NO: 1051543 - DNA, 22 bp, Artificial Sequence
  chemically synthesized
cttcattctgctgattcctccc

SEQ ID NO: 1051544 - DNA, 22 bp, Artificial Sequence
  chemically synthesized
tgcttcagtgagggaggaatca

SEQ ID NO: 1051545 - DNA, 22 bp, Artificial Sequence
  chemically synthesized
gcttcagtgagggaggaatcag

SEQ ID NO: 1051546 - DNA, 22 bp, Artificial Sequence
  chemically synthesized
cttcagtgagggaggaatcagc

SEQ ID NO: 1051547 - DNA, 22 bp, Artificial Sequence
  chemically synthesized
atttcttcattctgctgattcc

SEQ ID NO: 1051548 - DNA, 22 bp, Artificial Sequence
  chemically synthesized
catttcttcattctgctgattc

SEQ ID NO: 1051549 - DNA, 22 bp, Artificial Sequence
  chemically synthesized
cagtgagggaggaatcagcaga

SEQ ID NO: 1051550 - DNA, 22 bp, Artificial Sequence
  chemically synthesized
agtgagggaggaatcagcagaa

SEQ ID NO: 1051551 - DNA, 22 bp, Artificial Sequence
  chemically synthesized
ttcatttcttcattctgctgat

SEQ ID NO: 1051552 - DNA, 22 bp, Artificial Sequence
  chemically synthesized
ctcttcatttcttcattctgct

SEQ ID NO: 1051553 - DNA, 22 bp, Artificial Sequence
  chemically synthesized
ctactcttcatttcttcattct

SEQ ID NO: 1051554 - DNA, 22 bp, Artificial Sequence
  chemically synthesized
actactcttcatttcttcattc

SEQ ID NO: 1051555 - DNA, 22 bp, Artificial Sequence
  chemically synthesized
tactactcttcatttcttcatt

SEQ ID NO: 1051556 - DNA, 22 bp, Artificial Sequence
  chemically synthesized
aggaaactttactactcttcat

SEQ ID NO: 1051557 - DNA, 22 bp, Artificial Sequence
  chemically synthesized
atacaaaggtagattaaggaaa

SEQ ID NO: 1051558 - DNA, 22 bp, Artificial Sequence
  chemically synthesized
atcaattaatacaaaggtagat

SEQ ID NO: 1051559 - DNA, 22 bp, Artificial Sequence
  chemically synthesized
aatcaattaatacaaaggtaga

SEQ ID NO: 1051560 - DNA, 22 bp, Artificial Sequence
  chemically synthesized
taatcaattaatacaaaggtag

SEQ ID NO: 1051561 - DNA, 22 bp, Artificial Sequence
  chemically synthesized
ctttaatcaattaatacaaagg

SEQ ID NO: 1051562 - DNA, 22 bp, Artificial Sequence
  chemically synthesized
ccttaatctacctttgtattaa

SEQ ID NO: 1051563 - DNA, 22 bp, Artificial Sequence
  chemically synthesized
cttaatctacctttgtattaat

SEQ ID NO: 1051564 - DNA, 22 bp, Artificial Sequence
  chemically synthesized
aatctacctttgtattaattga

SEQ ID NO: 1051565 - DNA, 22 bp, Artificial Sequence
  chemically synthesized
atctacctttgtattaattgat

SEQ ID NO: 1051566 - DNA, 22 bp, Artificial Sequence
  chemically synthesized
cagtattactttaatcaattaa

SEQ ID NO: 1051567 - DNA, 22 bp, Artificial Sequence
  chemically synthesized
cctttgtattaattgattaaag

SEQ ID NO: 1051568 - DNA, 22 bp, Artificial Sequence
  chemically synthesized
tgtattaattgattaaagtaat

SEQ ID NO: 1051569 - DNA, 22 bp, Artificial Sequence
  chemically synthesized
gtattaattgattaaagtaata

SEQ ID NO: 1051570 - DNA, 22 bp, Artificial Sequence
  chemically synthesized
aatgtattgcagtattacttta

SEQ ID NO: 1051571 - DNA, 22 bp, Artificial Sequence
  chemically synthesized
tattaattgattaaagtaatac

SEQ ID NO: 1051572 - DNA, 22 bp, Artificial Sequence
  chemically synthesized
aaatgtattgcagtattacttt

SEQ ID NO: 1051573 - DNA, 22 bp, Artificial Sequence
  chemically synthesized
taaatgtattgcagtattactt

SEQ ID NO: 1051574 - DNA, 22 bp, Artificial Sequence
  chemically synthesized
ttttaaatgtattgcagtatta

SEQ ID NO: 1051575 - DNA, 22 bp, Artificial Sequence
  chemically synthesized
attgattaaagtaatactgcaa

SEQ ID NO: 1051576 - DNA, 22 bp, Artificial Sequence
  chemically synthesized
attaaagtaatactgcaataca

SEQ ID NO: 1051577 - DNA, 22 bp, Artificial Sequence
  chemically synthesized
tgcgattattttaaatgtattg

SEQ ID NO: 1051578 - DNA, 22 bp, Artificial Sequence
  chemically synthesized
aagtaatactgcaatacattta

SEQ ID NO: 1051579 - DNA, 22 bp, Artificial Sequence
  chemically synthesized
tgtgcgattattttaaatgtat

SEQ ID NO: 1051580 - DNA, 22 bp, Artificial Sequence
  chemically synthesized
agagctctgtgcgattatttta

SEQ ID NO: 1051581 - DNA, 22 bp, Artificial Sequence
  chemically synthesized
caatacatttaaaataatcgca

SEQ ID NO: 1051582 - DNA, 22 bp, Artificial Sequence
  chemically synthesized
gttcagagctctgtgcgattat

SEQ ID NO: 1051583 - DNA, 22 bp, Artificial Sequence
  chemically synthesized
gtgctagttcagagctctgtgc

SEQ ID NO: 1051584 - DNA, 22 bp, Artificial Sequence
  chemically synthesized
agtgctagttcagagctctgtg

SEQ ID NO: 1051585 - DNA, 22 bp, Artificial Sequence
  chemically synthesized
tagtgctagttcagagctctgt

SEQ ID NO: 1051586 - DNA, 22 bp, Artificial Sequence
  chemically synthesized
aaaataatcgcacagagctctg

SEQ ID NO: 1051587 - DNA, 22 bp, Artificial Sequence
  chemically synthesized
aaataatcgcacagagctctga

SEQ ID NO: 1051588 - DNA, 22 bp, Artificial Sequence
  chemically synthesized
tttagtgctagttcagagctct

SEQ ID NO: 1051589 - DNA, 22 bp, Artificial Sequence
  chemically synthesized
ctctttagtgctagttcagagc

SEQ ID NO: 1051590 - DNA, 22 bp, Artificial Sequence
  chemically synthesized
catctactctttagtgctagtt

SEQ ID NO: 1051591 - DNA, 22 bp, Artificial Sequence
  chemically synthesized
gcatctactctttagtgctagt

SEQ ID NO: 1051592 - DNA, 22 bp, Artificial Sequence
  chemically synthesized
tttgcatctactctttagtgct

SEQ ID NO: 1051593 - DNA, 22 bp, Artificial Sequence
  chemically synthesized
tgaactagcactaaagagtaga

SEQ ID NO: 1051594 - DNA, 22 bp, Artificial Sequence
  chemically synthesized
tatctatttgcatctactcttt

SEQ ID NO: 1051595 - DNA, 22 bp, Artificial Sequence
  chemically synthesized
aactagcactaaagagtagatg

SEQ ID NO: 1051596 - DNA, 22 bp, Artificial Sequence
  chemically synthesized
gcactaaagagtagatgcaaat

SEQ ID NO: 1051597 - DNA, 22 bp, Artificial Sequence
  chemically synthesized
aaatctgtatctatttgcatct

SEQ ID NO: 1051598 - DNA, 22 bp, Artificial Sequence
  chemically synthesized
gaaatctgtatctatttgcatc

SEQ ID NO: 1051599 - DNA, 22 bp, Artificial Sequence
  chemically synthesized
ccttgaaatctgtatctatttg

SEQ ID NO: 1051600 - DNA, 22 bp, Artificial Sequence
  chemically synthesized
aagagtagatgcaaatagatac

SEQ ID NO: 1051601 - DNA, 22 bp, Artificial Sequence
  chemically synthesized
accttgaaatctgtatctattt

SEQ ID NO: 1051602 - DNA, 22 bp, Artificial Sequence
  chemically synthesized
aatttaccttgaaatctgtatc

SEQ ID NO: 1051603 - DNA, 22 bp, Artificial Sequence
  chemically synthesized
tgtaaagactcaatttaccttg

SEQ ID NO: 1051604 - DNA, 22 bp, Artificial Sequence
  chemically synthesized
caaggtaaattgagtctttaca

SEQ ID NO: 1051605 - DNA, 22 bp, Artificial Sequence
  chemically synthesized
ataaatatgttatgtaaagact

SEQ ID NO: 1051606 - DNA, 22 bp, Artificial Sequence
  chemically synthesized
aaggtaaattgagtctttacat

SEQ ID NO: 1051607 - DNA, 22 bp, Artificial Sequence
  chemically synthesized
ctgataaatatgttatgtaaag

SEQ ID NO: 1051608 - DNA, 22 bp, Artificial Sequence
  chemically synthesized
agtctttacataacatatttat

SEQ ID NO: 1051609 - DNA, 22 bp, Artificial Sequence
  chemically synthesized
tacataacatatttatcagtag

SEQ ID NO: 1051610 - DNA, 22 bp, Artificial Sequence
  chemically synthesized
acataacatatttatcagtagg

SEQ ID NO: 1051611 - DNA, 22 bp, Artificial Sequence
  chemically synthesized
gagggggccatgcctactgata

SEQ ID NO: 1051612 - DNA, 22 bp, Artificial Sequence
  chemically synthesized
cataacatatttatcagtaggc

SEQ ID NO: 1051613 - DNA, 22 bp, Artificial Sequence
  chemically synthesized
atcagtaggcatggccccctct

SEQ ID NO: 1051614 - DNA, 22 bp, Artificial Sequence
  chemically synthesized
tcagtaggcatggccccctcta

SEQ ID NO: 1051615 - DNA, 22 bp, Artificial Sequence
  chemically synthesized
tgaacaataaagtcaattagag

SEQ ID NO: 1051616 - DNA, 22 bp, Artificial Sequence
  chemically synthesized
ttatgaacaataaagtcaatta

SEQ ID NO: 1051617 - DNA, 22 bp, Artificial Sequence
  chemically synthesized
taattgactttattgttcataa

SEQ ID NO: 1051618 - DNA, 22 bp, Artificial Sequence
  chemically synthesized
attgactttattgttcataata

SEQ ID NO: 1051619 - DNA, 22 bp, Artificial Sequence
  chemically synthesized
aatagaagtgaagtctattatg

SEQ ID NO: 1051620 - DNA, 22 bp, Artificial Sequence
  chemically synthesized
actttattgttcataatagact

SEQ ID NO: 1051621 - DNA, 22 bp, Artificial Sequence
  chemically synthesized
gaatagaagtgaagtctattat

SEQ ID NO: 1051622 - DNA, 22 bp, Artificial Sequence
  chemically synthesized
tattgttcataatagacttcac

SEQ ID NO: 1051623 - DNA, 22 bp, Artificial Sequence
  chemically synthesized
attgttcataatagacttcact

SEQ ID NO: 1051624 - DNA, 22 bp, Artificial Sequence
  chemically synthesized
ttgttcataatagacttcactt

SEQ ID NO: 1051625 - DNA, 22 bp, Artificial Sequence
  chemically synthesized
cagcttgaatagaagtgaagtc

SEQ ID NO: 1051626 - DNA, 22 bp, Artificial Sequence
  chemically synthesized
ttcataatagacttcacttcta

SEQ ID NO: 1051627 - DNA, 22 bp, Artificial Sequence
  chemically synthesized
ctgcagcttgaatagaagtgaa

SEQ ID NO: 1051628 - DNA, 22 bp, Artificial Sequence
  chemically synthesized
cctgcagcttgaatagaagtga

SEQ ID NO: 1051629 - DNA, 22 bp, Artificial Sequence
  chemically synthesized
ataatagacttcacttctattc

SEQ ID NO: 1051630 - DNA, 22 bp, Artificial Sequence
  chemically synthesized
cacttctattcaagctgcagga

SEQ ID NO: 1051631 - DNA, 22 bp, Artificial Sequence
  chemically synthesized
acttctattcaagctgcaggaa

SEQ ID NO: 1051632 - DNA, 22 bp, Artificial Sequence
  chemically synthesized
gtagtacatgccttcctgcagc

SEQ ID NO: 1051633 - DNA, 22 bp, Artificial Sequence
  chemically synthesized
ctattcaagctgcaggaaggca

SEQ ID NO: 1051634 - DNA, 22 bp, Artificial Sequence
  chemically synthesized
tattcaagctgcaggaaggcat

SEQ ID NO: 1051635 - DNA, 22 bp, Artificial Sequence
  chemically synthesized
ttcaagctgcaggaaggcatgt

SEQ ID NO: 1051636 - DNA, 22 bp, Artificial Sequence
  chemically synthesized
aagctgcaggaaggcatgtact

SEQ ID NO: 1051637 - DNA, 22 bp, Artificial Sequence
  chemically synthesized
ggagccaattagtagtacatgc

SEQ ID NO: 1051638 - DNA, 22 bp, Artificial Sequence
  chemically synthesized
caggaaggcatgtactactaat

SEQ ID NO: 1051639 - DNA, 22 bp, Artificial Sequence
  chemically synthesized
cataatattgggagccaattag

SEQ ID NO: 1051640 - DNA, 22 bp, Artificial Sequence
  chemically synthesized
ccataatattgggagccaatta

SEQ ID NO: 1051641 - DNA, 22 bp, Artificial Sequence
  chemically synthesized
tgcttccataatattgggagcc

SEQ ID NO: 1051642 - DNA, 22 bp, Artificial Sequence
  chemically synthesized
gtctatgcttccataatattgg

SEQ ID NO: 1051643 - DNA, 22 bp, Artificial Sequence
  chemically synthesized
ctaattggctcccaatattatg

SEQ ID NO: 1051644 - DNA, 22 bp, Artificial Sequence
  chemically synthesized
agtctatgcttccataatattg

SEQ ID NO: 1051645 - DNA, 22 bp, Artificial Sequence
  chemically synthesized
attggctcccaatattatggaa

SEQ ID NO: 1051646 - DNA, 22 bp, Artificial Sequence
  chemically synthesized
tcttagtctatgcttccataat

SEQ ID NO: 1051647 - DNA, 22 bp, Artificial Sequence
  chemically synthesized
gtcttagtctatgcttccataa

SEQ ID NO: 1051648 - DNA, 22 bp, Artificial Sequence
  chemically synthesized
tgtcttagtctatgcttccata

SEQ ID NO: 1051649 - DNA, 22 bp, Artificial Sequence
  chemically synthesized
gctcccaatattatggaagcat

SEQ ID NO: 1051650 - DNA, 22 bp, Artificial Sequence
  chemically synthesized
ccaatattatggaagcatagac

SEQ ID NO: 1051651 - DNA, 22 bp, Artificial Sequence
  chemically synthesized
aattttgtcttagtctatgctt

SEQ ID NO: 1051652 - DNA, 22 bp, Artificial Sequence
  chemically synthesized
tgaattttgtcttagtctatgc

SEQ ID NO: 1051653 - DNA, 22 bp, Artificial Sequence
  chemically synthesized
ctgaattttgtcttagtctatg

SEQ ID NO: 1051654 - DNA, 22 bp, Artificial Sequence
  chemically synthesized
ccttctgaattttgtcttagtc

SEQ ID NO: 1051655 - DNA, 22 bp, Artificial Sequence
  chemically synthesized
tggaagcatagactaagacaaa

SEQ ID NO: 1051656 - DNA, 22 bp, Artificial Sequence
  chemically synthesized
tcccttctgaattttgtcttag

SEQ ID NO: 1051657 - DNA, 22 bp, Artificial Sequence
  chemically synthesized
attctcccttctgaattttgtc

SEQ ID NO: 1051658 - DNA, 22 bp, Artificial Sequence
  chemically synthesized
cattctcccttctgaattttgt

SEQ ID NO: 1051659 - DNA, 22 bp, Artificial Sequence
  chemically synthesized
tcattctcccttctgaattttg

SEQ ID NO: 1051660 - DNA, 22 bp, Artificial Sequence
  chemically synthesized
agacaaaattcagaagggagaa

SEQ ID NO: 1051661 - DNA, 22 bp, Artificial Sequence
  chemically synthesized
aaaatgctttcattctcccttc

SEQ ID NO: 1051662 - DNA, 22 bp, Artificial Sequence
  chemically synthesized
caaaatgctttcattctccctt

SEQ ID NO: 1051663 - DNA, 22 bp, Artificial Sequence
  chemically synthesized
tttcaaaatgctttcattctcc

SEQ ID NO: 1051664 - DNA, 22 bp, Artificial Sequence
  chemically synthesized
agaagggagaatgaaagcattt

SEQ ID NO: 1051665 - DNA, 22 bp, Artificial Sequence
  chemically synthesized
ggtgatgatgtgaaattgtttc

SEQ ID NO: 1051666 - DNA, 22 bp, Artificial Sequence
  chemically synthesized
aggtgatgatgtgaaattgttt

SEQ ID NO: 1051667 - DNA, 22 bp, Artificial Sequence
  chemically synthesized
taggtgatgatgtgaaattgtt

SEQ ID NO: 1051668 - DNA, 22 bp, Artificial Sequence
  chemically synthesized
tgaaacaatttcacatcatcac

SEQ ID NO: 1051669 - DNA, 22 bp, Artificial Sequence
  chemically synthesized
gaaacaatttcacatcatcacc

SEQ ID NO: 1051670 - DNA, 22 bp, Artificial Sequence
  chemically synthesized
aaacaatttcacatcatcacct

SEQ ID NO: 1051671 - DNA, 22 bp, Artificial Sequence
  chemically synthesized
cacatcatcacctaaaaccata

SEQ ID NO: 1051672 - DNA, 22 bp, Artificial Sequence
  chemically synthesized
acatcatcacctaaaaccatat

SEQ ID NO: 1051673 - DNA, 22 bp, Artificial Sequence
  chemically synthesized
ggtatgcagtgaggggcaccaa

SEQ ID NO: 1051674 - DNA, 22 bp, Artificial Sequence
  chemically synthesized
aaaccatattggtgcccctcac

SEQ ID NO: 1051675 - DNA, 22 bp, Artificial Sequence
  chemically synthesized
tcaattgggtatgcagtgaggg

SEQ ID NO: 1051676 - DNA, 22 bp, Artificial Sequence
  chemically synthesized
tgtcaattgggtatgcagtgag

SEQ ID NO: 1051677 - DNA, 22 bp, Artificial Sequence
  chemically synthesized
ctgtcaattgggtatgcagtga

SEQ ID NO: 1051678 - DNA, 22 bp, Artificial Sequence
  chemically synthesized
ttctgtcaattgggtatgcagt

SEQ ID NO: 1051679 - DNA, 22 bp, Artificial Sequence
  chemically synthesized
gtgcccctcactgcatacccaa

SEQ ID NO: 1051680 - DNA, 22 bp, Artificial Sequence
  chemically synthesized
ccacgactcttctgtcaattgg

SEQ ID NO: 1051681 - DNA, 22 bp, Artificial Sequence
  chemically synthesized
gccacgactcttctgtcaattg

SEQ ID NO: 1051682 - DNA, 22 bp, Artificial Sequence
  chemically synthesized
tgccacgactcttctgtcaatt

SEQ ID NO: 1051683 - DNA, 22 bp, Artificial Sequence
  chemically synthesized
actgcatacccaattgacagaa

SEQ ID NO: 1051684 - DNA, 22 bp, Artificial Sequence
  chemically synthesized
catacccaattgacagaagagt

SEQ ID NO: 1051685 - DNA, 22 bp, Artificial Sequence
  chemically synthesized
gtctttgccacgactcttctgt

SEQ ID NO: 1051686 - DNA, 22 bp, Artificial Sequence
  chemically synthesized
acagaagagtcgtggcaaagac

SEQ ID NO: 1051687 - DNA, 22 bp, Artificial Sequence
  chemically synthesized
atgggcaacagcagccactagt

SEQ ID NO: 1051688 - DNA, 22 bp, Artificial Sequence
  chemically synthesized
catgggcaacagcagccactag

SEQ ID NO: 1051689 - DNA, 22 bp, Artificial Sequence
  chemically synthesized
cttcatgggcaacagcagccac

SEQ ID NO: 1051690 - DNA, 22 bp, Artificial Sequence
  chemically synthesized
acttcatgggcaacagcagcca

SEQ ID NO: 1051691 - DNA, 22 bp, Artificial Sequence
  chemically synthesized
tacttcatgggcaacagcagcc

SEQ ID NO: 1051692 - DNA, 22 bp, Artificial Sequence
  chemically synthesized
tttacttcatgggcaacagcag

SEQ ID NO: 1051693 - DNA, 22 bp, Artificial Sequence
  chemically synthesized
tctttacttcatgggcaacagc

SEQ ID NO: 1051694 - DNA, 22 bp, Artificial Sequence
  chemically synthesized
gtggctgctgttgcccatgaag

SEQ ID NO: 1051695 - DNA, 22 bp, Artificial Sequence
  chemically synthesized
aaaataattctctttacttcat

SEQ ID NO: 1051696 - DNA, 22 bp, Artificial Sequence
  chemically synthesized
ctgttgcccatgaagtaaagag

SEQ ID NO: 1051697 - DNA, 22 bp, Artificial Sequence
  chemically synthesized
ttgcccatgaagtaaagagaat

SEQ ID NO: 1051698 - DNA, 22 bp, Artificial Sequence
  chemically synthesized
cccatgaagtaaagagaattat

SEQ ID NO: 1051699 - DNA, 22 bp, Artificial Sequence
  chemically synthesized
aggcacctaaaaataattctct

SEQ ID NO: 1051700 - DNA, 22 bp, Artificial Sequence
  chemically synthesized
caggaatctcaggcacctaaaa

SEQ ID NO: 1051701 - DNA, 22 bp, Artificial Sequence
  chemically synthesized
atctccaggaatctcaggcacc

SEQ ID NO: 1051702 - DNA, 22 bp, Artificial Sequence
  chemically synthesized
ctcatctccaggaatctcaggc

SEQ ID NO: 1051703 - DNA, 22 bp, Artificial Sequence
  chemically synthesized
cctcatctccaggaatctcagg

SEQ ID NO: 1051704 - DNA, 22 bp, Artificial Sequence
  chemically synthesized
tttttaggtgcctgagattcct

SEQ ID NO: 1051705 - DNA, 22 bp, Artificial Sequence
  chemically synthesized
ttaggtgcctgagattcctgga

SEQ ID NO: 1051706 - DNA, 22 bp, Artificial Sequence
  chemically synthesized
aatttcctcatctccaggaatc

SEQ ID NO: 1051707 - DNA, 22 bp, Artificial Sequence
  chemically synthesized
taggtgcctgagattcctggag

SEQ ID NO: 1051708 - DNA, 22 bp, Artificial Sequence
  chemically synthesized
aggtgcctgagattcctggaga

SEQ ID NO: 1051709 - DNA, 22 bp, Artificial Sequence
  chemically synthesized
ggtgcctgagattcctggagat

SEQ ID NO: 1051710 - DNA, 22 bp, Artificial Sequence
  chemically synthesized
ttaaatttcctcatctccagga

SEQ ID NO: 1051711 - DNA, 22 bp, Artificial Sequence
  chemically synthesized
gctgttaaatttcctcatctcc

SEQ ID NO: 1051712 - DNA, 22 bp, Artificial Sequence
  chemically synthesized
agattcctggagatgaggaaat

SEQ ID NO: 1051713 - DNA, 22 bp, Artificial Sequence
  chemically synthesized
gccattggctgttaaatttcct

SEQ ID NO: 1051714 - DNA, 22 bp, Artificial Sequence
  chemically synthesized
ctggagatgaggaaatttaaca

SEQ ID NO: 1051715 - DNA, 22 bp, Artificial Sequence
  chemically synthesized
ttagccattggctgttaaattt

SEQ ID NO: 1051716 - DNA, 22 bp, Artificial Sequence
  chemically synthesized
gagatgaggaaatttaacagcc

SEQ ID NO: 1051717 - DNA, 22 bp, Artificial Sequence
  chemically synthesized
tcacataagagtgctattagcc

SEQ ID NO: 1051718 - DNA, 22 bp, Artificial Sequence
  chemically synthesized
aacagccaatggctaatagcac

SEQ ID NO: 1051719 - DNA, 22 bp, Artificial Sequence
  chemically synthesized
acagccaatggctaatagcact

SEQ ID NO: 1051720 - DNA, 22 bp, Artificial Sequence
  chemically synthesized
gatgctgtcacataagagtgct

SEQ ID NO: 1051721 - DNA, 22 bp, Artificial Sequence
  chemically synthesized
atagcactcttatgtgacagca

SEQ ID NO: 1051722 - DNA, 22 bp, Artificial Sequence
  chemically synthesized
aaatatatcgagtattggatgc

SEQ ID NO: 1051723 - DNA, 22 bp, Artificial Sequence
  chemically synthesized
ttatgtgacagcatccaatact

SEQ ID NO: 1051724 - DNA, 22 bp, Artificial Sequence
  chemically synthesized
atgtgacagcatccaatactcg

SEQ ID NO: 1051725 - DNA, 22 bp, Artificial Sequence
  chemically synthesized
tgtgacagcatccaatactcga

SEQ ID NO: 1051726 - DNA, 22 bp, Artificial Sequence
  chemically synthesized
agatcaattaaaatatatcgag

SEQ ID NO: 1051727 - DNA, 22 bp, Artificial Sequence
  chemically synthesized
aagatcaattaaaatatatcga

SEQ ID NO: 1051728 - DNA, 22 bp, Artificial Sequence
  chemically synthesized
agtacttaagatcaattaaaat

SEQ ID NO: 1051729 - DNA, 22 bp, Artificial Sequence
  chemically synthesized
gatatattttaattgatcttaa

SEQ ID NO: 1051730 - DNA, 22 bp, Artificial Sequence
  chemically synthesized
taattgatcttaagtactcaat

SEQ ID NO: 1051731 - DNA, 22 bp, Artificial Sequence
  chemically synthesized
aattgatcttaagtactcaatt

SEQ ID NO: 1051732 - DNA, 22 bp, Artificial Sequence
  chemically synthesized
attgatcttaagtactcaattt

SEQ ID NO: 1051733 - DNA, 22 bp, Artificial Sequence
  chemically synthesized
atcttaagtactcaattttttt

SEQ ID NO: 1051734 - DNA, 22 bp, Artificial Sequence
  chemically synthesized
aaaaaaaaaaaaaaaaaaaatt

SEQ ID NO: 1051735 - DNA, 22 bp, Artificial Sequence
  chemically synthesized
aagtactcaatttttttttttt

SEQ ID NO: 1051736 - DNA, 22 bp, Artificial Sequence
  chemically synthesized
agtactcaattttttttttttt

SEQ ID NO: 1051737 - DNA, 22 bp, Artificial Sequence
  chemically synthesized
cgtctcaaaaaaaaaaaaaaaa

SEQ ID NO: 1051738 - DNA, 22 bp, Artificial Sequence
  chemically synthesized
aatttttttttttttttttttt

SEQ ID NO: 1051739 - DNA, 22 bp, Artificial Sequence
  chemically synthesized
tttttttttttttttttgagac

SEQ ID NO: 1051740 - DNA, 22 bp, Artificial Sequence
  chemically synthesized
ttttttttttttttttgagacg

SEQ ID NO: 1051741 - DNA, 22 bp, Artificial Sequence
  chemically synthesized
tttttttttttttttgagacgg

SEQ ID NO: 1051742 - DNA, 22 bp, Artificial Sequence
  chemically synthesized
ttttttttttttttgagacgga

SEQ ID NO: 1051743 - DNA, 22 bp, Artificial Sequence
  chemically synthesized
tttttttttttttgagacggag

SEQ ID NO: 1051744 - DNA, 22 bp, Artificial Sequence
  chemically synthesized
ttttttttttttgagacggagt

SEQ ID NO: 1051745 - DNA, 22 bp, Artificial Sequence
  chemically synthesized
tttttttttttgagacggagtc

SEQ ID NO: 1051746 - DNA, 22 bp, Artificial Sequence
  chemically synthesized
ttttttttttgagacggagtct

SEQ ID NO: 1051747 - DNA, 22 bp, Artificial Sequence
  chemically synthesized
ggcaacagagcgagactccgtc

SEQ ID NO: 1051748 - DNA, 22 bp, Artificial Sequence
  chemically synthesized
tttttttttgagacggagtctc

SEQ ID NO: 1051749 - DNA, 22 bp, Artificial Sequence
  chemically synthesized
ttttttttgagacggagtctcg

SEQ ID NO: 1051750 - DNA, 22 bp, Artificial Sequence
  chemically synthesized
tttttttgagacggagtctcgc

SEQ ID NO: 1051751 - DNA, 22 bp, Artificial Sequence
  chemically synthesized
ttttttgagacggagtctcgct

SEQ ID NO: 1051752 - DNA, 22 bp, Artificial Sequence
  chemically synthesized
tttttgagacggagtctcgctc

SEQ ID NO: 1051753 - DNA, 22 bp, Artificial Sequence
  chemically synthesized
ttttgagacggagtctcgctct

SEQ ID NO: 1051754 - DNA, 22 bp, Artificial Sequence
  chemically synthesized
tttgagacggagtctcgctctg

SEQ ID NO: 1051755 - DNA, 22 bp, Artificial Sequence
  chemically synthesized
cagcctgggcaacagagcgaga

SEQ ID NO: 1051756 - DNA, 22 bp, Artificial Sequence
  chemically synthesized
ttgagacggagtctcgctctgt

SEQ ID NO: 1051757 - DNA, 22 bp, Artificial Sequence
  chemically synthesized
tgagacggagtctcgctctgtt

SEQ ID NO: 1051758 - DNA, 22 bp, Artificial Sequence
  chemically synthesized
gagacggagtctcgctctgttg

SEQ ID NO: 1051759 - DNA, 22 bp, Artificial Sequence
  chemically synthesized
agacggagtctcgctctgttgc

SEQ ID NO: 1051760 - DNA, 22 bp, Artificial Sequence
  chemically synthesized
cactccagcctgggcaacagag

SEQ ID NO: 1051761 - DNA, 22 bp, Artificial Sequence
  chemically synthesized
gctctgttgcccaggctggagt

SEQ ID NO: 1051762 - DNA, 22 bp, Artificial Sequence
  chemically synthesized
tgttgcccaggctggagtgcag

SEQ ID NO: 1051763 - DNA, 22 bp, Artificial Sequence
  chemically synthesized
ttgcccaggctggagtgcagtg

SEQ ID NO: 1051764 - DNA, 22 bp, Artificial Sequence
  chemically synthesized
cccaggctggagtgcagtggct

SEQ ID NO: 1051765 - DNA, 22 bp, Artificial Sequence
  chemically synthesized
cagtgagccgagatcaagccac

SEQ ID NO: 1051766 - DNA, 22 bp, Artificial Sequence
  chemically synthesized
gcagtgagccgagatcaagcca

SEQ ID NO: 1051767 - DNA, 22 bp, Artificial Sequence
  chemically synthesized
gagtgcagtggcttgatctcgg

SEQ ID NO: 1051768 - DNA, 22 bp, Artificial Sequence
  chemically synthesized
ggaagtgtagtttgcagtgagc

SEQ ID NO: 1051769 - DNA, 22 bp, Artificial Sequence
  chemically synthesized
gatctcggctcactgcaaacta

SEQ ID NO: 1051770 - DNA, 22 bp, Artificial Sequence
  chemically synthesized
atctcggctcactgcaaactac

SEQ ID NO: 1051771 - DNA, 22 bp, Artificial Sequence
  chemically synthesized
aacctgggaagtgtagtttgca

SEQ ID NO: 1051772 - DNA, 22 bp, Artificial Sequence
  chemically synthesized
ggctcactgcaaactacacttc

SEQ ID NO: 1051773 - DNA, 22 bp, Artificial Sequence
  chemically synthesized
taaattgaacctgggaagtgta

SEQ ID NO: 1051774 - DNA, 22 bp, Artificial Sequence
  chemically synthesized
ataaattgaacctgggaagtgt

SEQ ID NO: 1051775 - DNA, 22 bp, Artificial Sequence
  chemically synthesized
actgcaaactacacttcccagg

SEQ ID NO: 1051776 - DNA, 22 bp, Artificial Sequence
  chemically synthesized
cttataaattgaacctgggaag

SEQ ID NO: 1051777 - DNA, 22 bp, Artificial Sequence
  chemically synthesized
caaactacacttcccaggttca

SEQ ID NO: 1051778 - DNA, 22 bp, Artificial Sequence
  chemically synthesized
gttgcttataaattgaacctgg

SEQ ID NO: 1051779 - DNA, 22 bp, Artificial Sequence
  chemically synthesized
attagttgcttataaattgaac

SEQ ID NO: 1051780 - DNA, 22 bp, Artificial Sequence
  chemically synthesized
aattagttgcttataaattgaa

SEQ ID NO: 1051781 - DNA, 22 bp, Artificial Sequence
  chemically synthesized
cacttcccaggttcaatttata

SEQ ID NO: 1051782 - DNA, 22 bp, Artificial Sequence
  chemically synthesized
tttaattagttgcttataaatt

SEQ ID NO: 1051783 - DNA, 22 bp, Artificial Sequence
  chemically synthesized
atttaattagttgcttataaat

SEQ ID NO: 1051784 - DNA, 22 bp, Artificial Sequence
  chemically synthesized
cccaggttcaatttataagcaa

SEQ ID NO: 1051785 - DNA, 22 bp, Artificial Sequence
  chemically synthesized
ccaggttcaatttataagcaac

SEQ ID NO: 1051786 - DNA, 22 bp, Artificial Sequence
  chemically synthesized
gtgatacttatttaattagttg

SEQ ID NO: 1051787 - DNA, 22 bp, Artificial Sequence
  chemically synthesized
aatttataagcaactaattaaa

SEQ ID NO: 1051788 - DNA, 22 bp, Artificial Sequence
  chemically synthesized
attagtgatacttatttaatta

SEQ ID NO: 1051789 - DNA, 22 bp, Artificial Sequence
  chemically synthesized
tcattagtgatacttatttaat

SEQ ID NO: 1051790 - DNA, 22 bp, Artificial Sequence
  chemically synthesized
ataagcaactaattaaataagt

SEQ ID NO: 1051791 - DNA, 22 bp, Artificial Sequence
  chemically synthesized
ctcattagtgatacttatttaa

SEQ ID NO: 1051792 - DNA, 22 bp, Artificial Sequence
  chemically synthesized
taagcaactaattaaataagta

SEQ ID NO: 1051793 - DNA, 22 bp, Artificial Sequence
  chemically synthesized
tctcattagtgatacttattta

SEQ ID NO: 1051794 - DNA, 22 bp, Artificial Sequence
  chemically synthesized
ttctcattagtgatacttattt

SEQ ID NO: 1051795 - DNA, 22 bp, Artificial Sequence
  chemically synthesized
ggtatttttctcattagtgata

SEQ ID NO: 1051796 - DNA, 22 bp, Artificial Sequence
  chemically synthesized
gggtatttttctcattagtgat

SEQ ID NO: 1051797 - DNA, 22 bp, Artificial Sequence
  chemically synthesized
attaaataagtatcactaatga

SEQ ID NO: 1051798 - DNA, 22 bp, Artificial Sequence
  chemically synthesized
gcttgggtatttttctcattag

SEQ ID NO: 1051799 - DNA, 22 bp, Artificial Sequence
  chemically synthesized
aataagtatcactaatgagaaa

SEQ ID NO: 1051800 - DNA, 22 bp, Artificial Sequence
  chemically synthesized
ggcttgggtatttttctcatta

SEQ ID NO: 1051801 - DNA, 22 bp, Artificial Sequence
  chemically synthesized
tggcttgggtatttttctcatt

SEQ ID NO: 1051802 - DNA, 22 bp, Artificial Sequence
  chemically synthesized
ctttggcttgggtatttttctc

SEQ ID NO: 1051803 - DNA, 22 bp, Artificial Sequence
  chemically synthesized
actttggcttgggtatttttct

SEQ ID NO: 1051804 - DNA, 22 bp, Artificial Sequence
  chemically synthesized
aatgtttactttggcttgggta

SEQ ID NO: 1051805 - DNA, 22 bp, Artificial Sequence
  chemically synthesized
atgagaaaaatacccaagccaa

SEQ ID NO: 1051806 - DNA, 22 bp, Artificial Sequence
  chemically synthesized
gctaaatgtttactttggcttg

SEQ ID NO: 1051807 - DNA, 22 bp, Artificial Sequence
  chemically synthesized
agctaaatgtttactttggctt

SEQ ID NO: 1051808 - DNA, 22 bp, Artificial Sequence
  chemically synthesized
caatatccttagctaaatgttt

SEQ ID NO: 1051809 - DNA, 22 bp, Artificial Sequence
  chemically synthesized
tggattacaatatccttagcta

SEQ ID NO: 1051810 - DNA, 22 bp, Artificial Sequence
  chemically synthesized
atggattacaatatccttagct

SEQ ID NO: 1051811 - DNA, 22 bp, Artificial Sequence
  chemically synthesized
tatggattacaatatccttagc

SEQ ID NO: 1051812 - DNA, 22 bp, Artificial Sequence
  chemically synthesized
ttatggattacaatatccttag

SEQ ID NO: 1051813 - DNA, 22 bp, Artificial Sequence
  chemically synthesized
tatttttatggattacaatatc

SEQ ID NO: 1051814 - DNA, 22 bp, Artificial Sequence
  chemically synthesized
agctaaggatattgtaatccat

SEQ ID NO: 1051815 - DNA, 22 bp, Artificial Sequence
  chemically synthesized
gctaaggatattgtaatccata

SEQ ID NO: 1051816 - DNA, 22 bp, Artificial Sequence
  chemically synthesized
aggatattgtaatccataaaaa

SEQ ID NO: 1051817 - DNA, 22 bp, Artificial Sequence
  chemically synthesized
taatccataaaaatacaacttt

SEQ ID NO: 1051818 - DNA, 22 bp, Artificial Sequence
  chemically synthesized
aaatgcaaacaaaaagttgtat

SEQ ID NO: 1051819 - DNA, 22 bp, Artificial Sequence
  chemically synthesized
caaatgcaaacaaaaagttgta

SEQ ID NO: 1051820 - DNA, 22 bp, Artificial Sequence
  chemically synthesized
aagcagtcatttcaaatgcaaa

SEQ ID NO: 1051821 - DNA, 22 bp, Artificial Sequence
  chemically synthesized
tttgtttgcatttgaaatgact

SEQ ID NO: 1051822 - DNA, 22 bp, Artificial Sequence
  chemically synthesized
ttgtttgcatttgaaatgactg

SEQ ID NO: 1051823 - DNA, 22 bp, Artificial Sequence
  chemically synthesized
tgtttgcatttgaaatgactgc

SEQ ID NO: 1051824 - DNA, 22 bp, Artificial Sequence
  chemically synthesized
gtttgcatttgaaatgactgct

SEQ ID NO: 1051825 - DNA, 22 bp, Artificial Sequence
  chemically synthesized
tttgcatttgaaatgactgctt

SEQ ID NO: 1051826 - DNA, 22 bp, Artificial Sequence
  chemically synthesized
gcatttgaaatgactgcttcaa

SEQ ID NO: 1051827 - DNA, 22 bp, Artificial Sequence
  chemically synthesized
catttgaaatgactgcttcaat

SEQ ID NO: 1051828 - DNA, 22 bp, Artificial Sequence
  chemically synthesized
aaatacatggggagaattgaag

SEQ ID NO: 1051829 - DNA, 22 bp, Artificial Sequence
  chemically synthesized
caaatacatggggagaattgaa

SEQ ID NO: 1051830 - DNA, 22 bp, Artificial Sequence
  chemically synthesized
gaaatgactgcttcaattctcc

SEQ ID NO: 1051831 - DNA, 22 bp, Artificial Sequence
  chemically synthesized
aaatgactgcttcaattctccc

SEQ ID NO: 1051832 - DNA, 22 bp, Artificial Sequence
  chemically synthesized
cttcaattctccccatgtattt

SEQ ID NO: 1051833 - DNA, 22 bp, Artificial Sequence
  chemically synthesized
gcaaagtgacttcaaatacatg

SEQ ID NO: 1051834 - DNA, 22 bp, Artificial Sequence
  chemically synthesized
agcaaagtgacttcaaatacat

SEQ ID NO: 1051835 - DNA, 22 bp, Artificial Sequence
  chemically synthesized
caattctccccatgtatttgaa

SEQ ID NO: 1051836 - DNA, 22 bp, Artificial Sequence
  chemically synthesized
aattctccccatgtatttgaag

SEQ ID NO: 1051837 - DNA, 22 bp, Artificial Sequence
  chemically synthesized
agcttagcaaagtgacttcaaa

SEQ ID NO: 1051838 - DNA, 22 bp, Artificial Sequence
  chemically synthesized
cagcttagcaaagtgacttcaa

SEQ ID NO: 1051839 - DNA, 22 bp, Artificial Sequence
  chemically synthesized
tccccatgtatttgaagtcact

SEQ ID NO: 1051840 - DNA, 22 bp, Artificial Sequence
  chemically synthesized
tcagcttagcaaagtgacttca

SEQ ID NO: 1051841 - DNA, 22 bp, Artificial Sequence
  chemically synthesized
ttcagcttagcaaagtgacttc

SEQ ID NO: 1051842 - DNA, 22 bp, Artificial Sequence
  chemically synthesized
cccatgtatttgaagtcacttt

SEQ ID NO: 1051843 - DNA, 22 bp, Artificial Sequence
  chemically synthesized
gaagtcactttgctaagctgaa

SEQ ID NO: 1051844 - DNA, 22 bp, Artificial Sequence
  chemically synthesized
aagtcactttgctaagctgaaa

SEQ ID NO: 1051845 - DNA, 22 bp, Artificial Sequence
  chemically synthesized
tgctaagctgaaaagttttcct

SEQ ID NO: 1051846 - DNA, 22 bp, Artificial Sequence
  chemically synthesized
gctaagctgaaaagttttcctc

SEQ ID NO: 1051847 - DNA, 22 bp, Artificial Sequence
  chemically synthesized
ctaagctgaaaagttttcctct

SEQ ID NO: 1051848 - DNA, 22 bp, Artificial Sequence
  chemically synthesized
atgtgccaggccaaagaggaaa

SEQ ID NO: 1051849 - DNA, 22 bp, Artificial Sequence
  chemically synthesized
agctgaaaagttttcctctttg

SEQ ID NO: 1051850 - DNA, 22 bp, Artificial Sequence
  chemically synthesized
aaaagttttcctctttggcctg

SEQ ID NO: 1051851 - DNA, 22 bp, Artificial Sequence
  chemically synthesized
tcctctttggcctggcacatta

SEQ ID NO: 1051852 - DNA, 22 bp, Artificial Sequence
  chemically synthesized
cctctttggcctggcacattag

SEQ ID NO: 1051853 - DNA, 22 bp, Artificial Sequence
  chemically synthesized
ctctttggcctggcacattaga

SEQ ID NO: 1051854 - DNA, 22 bp, Artificial Sequence
  chemically synthesized
tttggcctggcacattagacca

SEQ ID NO: 1051855 - DNA, 22 bp, Artificial Sequence
  chemically synthesized
tggcctggcacattagaccatc

SEQ ID NO: 1051856 - DNA, 22 bp, Artificial Sequence
  chemically synthesized
ggcctggcacattagaccatct

SEQ ID NO: 1051857 - DNA, 22 bp, Artificial Sequence
  chemically synthesized
gcctggcacattagaccatctt

SEQ ID NO: 1051858 - DNA, 22 bp, Artificial Sequence
  chemically synthesized
agggcatggaaataaagatggt

SEQ ID NO: 1051859 - DNA, 22 bp, Artificial Sequence
  chemically synthesized
gcacattagaccatctttattt

SEQ ID NO: 1051860 - DNA, 22 bp, Artificial Sequence
  chemically synthesized
aagttaagggcatggaaataaa

SEQ ID NO: 1051861 - DNA, 22 bp, Artificial Sequence
  chemically synthesized
caagttaagggcatggaaataa

SEQ ID NO: 1051862 - DNA, 22 bp, Artificial Sequence
  chemically synthesized
gaccatctttatttccatgccc

SEQ ID NO: 1051863 - DNA, 22 bp, Artificial Sequence
  chemically synthesized
gtgtcccttcaagttaagggca

SEQ ID NO: 1051864 - DNA, 22 bp, Artificial Sequence
  chemically synthesized
tatttccatgcccttaacttga

SEQ ID NO: 1051865 - DNA, 22 bp, Artificial Sequence
  chemically synthesized
atttccatgcccttaacttgaa

SEQ ID NO: 1051866 - DNA, 22 bp, Artificial Sequence
  chemically synthesized
tttccatgcccttaacttgaag

SEQ ID NO: 1051867 - DNA, 22 bp, Artificial Sequence
  chemically synthesized
ccatgcccttaacttgaaggga

SEQ ID NO: 1051868 - DNA, 22 bp, Artificial Sequence
  chemically synthesized
catgcccttaacttgaagggac

SEQ ID NO: 1051869 - DNA, 22 bp, Artificial Sequence
  chemically synthesized
aacttgaagggacactaatgac

SEQ ID NO: 1051870 - DNA, 22 bp, Artificial Sequence
  chemically synthesized
acttgaagggacactaatgaca

SEQ ID NO: 1051871 - DNA, 22 bp, Artificial Sequence
  chemically synthesized
tcagtatatcacaatgtcatta

SEQ ID NO: 1051872 - DNA, 22 bp, Artificial Sequence
  chemically synthesized
gaagggacactaatgacattgt

SEQ ID NO: 1051873 - DNA, 22 bp, Artificial Sequence
  chemically synthesized
aagggacactaatgacattgtg

SEQ ID NO: 1051874 - DNA, 22 bp, Artificial Sequence
  chemically synthesized
ttatcagtatatcacaatgtca

SEQ ID NO: 1051875 - DNA, 22 bp, Artificial Sequence
  chemically synthesized
taaatactgttatcagtatatc

SEQ ID NO: 1051876 - DNA, 22 bp, Artificial Sequence
  chemically synthesized
gtaaatactgttatcagtatat

SEQ ID NO: 1051877 - DNA, 22 bp, Artificial Sequence
  chemically synthesized
atgacattgtgatatactgata

SEQ ID NO: 1051878 - DNA, 22 bp, Artificial Sequence
  chemically synthesized
tgtaaatactgttatcagtata

SEQ ID NO: 1051879 - DNA, 22 bp, Artificial Sequence
  chemically synthesized
tgatatactgataacagtattt

SEQ ID NO: 1051880 - DNA, 22 bp, Artificial Sequence
  chemically synthesized
ggtcagataattttgtaaatac

SEQ ID NO: 1051881 - DNA, 22 bp, Artificial Sequence
  chemically synthesized
ataacagtatttacaaaattat

SEQ ID NO: 1051882 - DNA, 22 bp, Artificial Sequence
  chemically synthesized
gaattaggtcagataattttgt

SEQ ID NO: 1051883 - DNA, 22 bp, Artificial Sequence
  chemically synthesized
ggaattaggtcagataattttg

SEQ ID NO: 1051884 - DNA, 22 bp, Artificial Sequence
  chemically synthesized
tttggaattaggtcagataatt

SEQ ID NO: 1051885 - DNA, 22 bp, Artificial Sequence
  chemically synthesized
ttatttggaattaggtcagata

SEQ ID NO: 1051886 - DNA, 22 bp, Artificial Sequence
  chemically synthesized
gttatttggaattaggtcagat

SEQ ID NO: 1051887 - DNA, 22 bp, Artificial Sequence
  chemically synthesized
acaaaattatctgacctaattc

SEQ ID NO: 1051888 - DNA, 22 bp, Artificial Sequence
  chemically synthesized
caaaattatctgacctaattcc

SEQ ID NO: 1051889 - DNA, 22 bp, Artificial Sequence
  chemically synthesized
aaacttgttatttggaattagg

SEQ ID NO: 1051890 - DNA, 22 bp, Artificial Sequence
  chemically synthesized
tcaaacttgttatttggaatta

SEQ ID NO: 1051891 - DNA, 22 bp, Artificial Sequence
  chemically synthesized
tctgacctaattccaaataaca

SEQ ID NO: 1051892 - DNA, 22 bp, Artificial Sequence
  chemically synthesized
acctaattccaaataacaagtt

SEQ ID NO: 1051893 - DNA, 22 bp, Artificial Sequence
  chemically synthesized
attccaaataacaagtttgaga

SEQ ID NO: 1051894 - DNA, 22 bp, Artificial Sequence
  chemically synthesized
caaataacaagtttgagagtta

SEQ ID NO: 1051895 - DNA, 22 bp, Artificial Sequence
  chemically synthesized
aaagaagaatagaatgcagggt

SEQ ID NO: 1051896 - DNA, 22 bp, Artificial Sequence
  chemically synthesized
caaagaagaatagaatgcaggg

SEQ ID NO: 1051897 - DNA, 22 bp, Artificial Sequence
  chemically synthesized
gagagttaccctgcattctatt

SEQ ID NO: 1051898 - DNA, 22 bp, Artificial Sequence
  chemically synthesized
agagttaccctgcattctattc

SEQ ID NO: 1051899 - DNA, 22 bp, Artificial Sequence
  chemically synthesized
tgcatatttcaaagaagaatag

SEQ ID NO: 1051900 - DNA, 22 bp, Artificial Sequence
  chemically synthesized
ccctgcattctattcttctttg

SEQ ID NO: 1051901 - DNA, 22 bp, Artificial Sequence
  chemically synthesized
ttgtgcatatttcaaagaagaa

SEQ ID NO: 1051902 - DNA, 22 bp, Artificial Sequence
  chemically synthesized
cattctattcttctttgaaata

SEQ ID NO: 1051903 - DNA, 22 bp, Artificial Sequence
  chemically synthesized
tattcttctttgaaatatgcac

SEQ ID NO: 1051904 - DNA, 22 bp, Artificial Sequence
  chemically synthesized
ttcttctttgaaatatgcacaa

SEQ ID NO: 1051905 - DNA, 22 bp, Artificial Sequence
  chemically synthesized
ttctttgaaatatgcacaacaa

SEQ ID NO: 1051906 - DNA, 22 bp, Artificial Sequence
  chemically synthesized
caggtatatgaaattgttgtgc

SEQ ID NO: 1051907 - DNA, 22 bp, Artificial Sequence
  chemically synthesized
ctttgaaatatgcacaacaatt

SEQ ID NO: 1051908 - DNA, 22 bp, Artificial Sequence
  chemically synthesized
tttgaaatatgcacaacaattt

SEQ ID NO: 1051909 - DNA, 22 bp, Artificial Sequence
  chemically synthesized
ttgcaggtatatgaaattgttg

SEQ ID NO: 1051910 - DNA, 22 bp, Artificial Sequence
  chemically synthesized
tgaaatatgcacaacaatttca

SEQ ID NO: 1051911 - DNA, 22 bp, Artificial Sequence
  chemically synthesized
attgcaggtatatgaaattgtt

SEQ ID NO: 1051912 - DNA, 22 bp, Artificial Sequence
  chemically synthesized
gaaatatgcacaacaatttcat

SEQ ID NO: 1051913 - DNA, 22 bp, Artificial Sequence
  chemically synthesized
tattgcaggtatatgaaattgt

SEQ ID NO: 1051914 - DNA, 22 bp, Artificial Sequence
  chemically synthesized
aaatatgcacaacaatttcata

SEQ ID NO: 1051915 - DNA, 22 bp, Artificial Sequence
  chemically synthesized
ttattgcaggtatatgaaattg

SEQ ID NO: 1051916 - DNA, 22 bp, Artificial Sequence
  chemically synthesized
tttattgcaggtatatgaaatt

SEQ ID NO: 1051917 - DNA, 22 bp, Artificial Sequence
  chemically synthesized
ctttttattgcaggtatatgaa

SEQ ID NO: 1051918 - DNA, 22 bp, Artificial Sequence
  chemically synthesized
cctgctttttattgcaggtata

SEQ ID NO: 1051919 - DNA, 22 bp, Artificial Sequence
  chemically synthesized
actgcctgctttttattgcagg

SEQ ID NO: 1051920 - DNA, 22 bp, Artificial Sequence
  chemically synthesized
aactgcctgctttttattgcag

SEQ ID NO: 1051921 - DNA, 22 bp, Artificial Sequence
  chemically synthesized
taactgcctgctttttattgca

SEQ ID NO: 1051922 - DNA, 22 bp, Artificial Sequence
  chemically synthesized
ttaactgcctgctttttattgc

SEQ ID NO: 1051923 - DNA, 22 bp, Artificial Sequence
  chemically synthesized
tttaactgcctgctttttattg

SEQ ID NO: 1051924 - DNA, 22 bp, Artificial Sequence
  chemically synthesized
ttttaactgcctgctttttatt

SEQ ID NO: 1051925 - DNA, 22 bp, Artificial Sequence
  chemically synthesized
catatacctgcaataaaaagca

SEQ ID NO: 1051926 - DNA, 22 bp, Artificial Sequence
  chemically synthesized
atatacctgcaataaaaagcag

SEQ ID NO: 1051927 - DNA, 22 bp, Artificial Sequence
  chemically synthesized
tgtttttttaactgcctgcttt

SEQ ID NO: 1051928 - DNA, 22 bp, Artificial Sequence
  chemically synthesized
caataaaaagcaggcagttaaa

SEQ ID NO: 1051929 - DNA, 22 bp, Artificial Sequence
  chemically synthesized
aagttgtgtttttttaactgcc

SEQ ID NO: 1051930 - DNA, 22 bp, Artificial Sequence
  chemically synthesized
ctaaagttgtgtttttttaact

SEQ ID NO: 1051931 - DNA, 22 bp, Artificial Sequence
  chemically synthesized
gtcgagttcctaaagttgtgtt

SEQ ID NO: 1051932 - DNA, 22 bp, Artificial Sequence
  chemically synthesized
agtcgagttcctaaagttgtgt

SEQ ID NO: 1051933 - DNA, 22 bp, Artificial Sequence
  chemically synthesized
tagtcgagttcctaaagttgtg

SEQ ID NO: 1051934 - DNA, 22 bp, Artificial Sequence
  chemically synthesized
ttagtcgagttcctaaagttgt

SEQ ID NO: 1051935 - DNA, 22 bp, Artificial Sequence
  chemically synthesized
aaaaaacacaactttaggaact

SEQ ID NO: 1051936 - DNA, 22 bp, Artificial Sequence
  chemically synthesized
catcttttagtcgagttcctaa

SEQ ID NO: 1051937 - DNA, 22 bp, Artificial Sequence
  chemically synthesized
tccatcttttagtcgagttcct

SEQ ID NO: 1051938 - DNA, 22 bp, Artificial Sequence
  chemically synthesized
ttctccatcttttagtcgagtt

SEQ ID NO: 1051939 - DNA, 22 bp, Artificial Sequence
  chemically synthesized
taggttattctccatcttttag

SEQ ID NO: 1051940 - DNA, 22 bp, Artificial Sequence
  chemically synthesized
taggaactcgactaaaagatgg

SEQ ID NO: 1051941 - DNA, 22 bp, Artificial Sequence
  chemically synthesized
gtaggttattctccatctttta

SEQ ID NO: 1051942 - DNA, 22 bp, Artificial Sequence
  chemically synthesized
aggaactcgactaaaagatgga

SEQ ID NO: 1051943 - DNA, 22 bp, Artificial Sequence
  chemically synthesized
tgtaggttattctccatctttt

SEQ ID NO: 1051944 - DNA, 22 bp, Artificial Sequence
  chemically synthesized
ggaactcgactaaaagatggag

SEQ ID NO: 1051945 - DNA, 22 bp, Artificial Sequence
  chemically synthesized
ttgtaggttattctccatcttt

SEQ ID NO: 1051946 - DNA, 22 bp, Artificial Sequence
  chemically synthesized
tgatttttgtaggttattctcc

SEQ ID NO: 1051947 - DNA, 22 bp, Artificial Sequence
  chemically synthesized
gactaaaagatggagaataacc

SEQ ID NO: 1051948 - DNA, 22 bp, Artificial Sequence
  chemically synthesized
aaagatggagaataacctacaa

SEQ ID NO: 1051949 - DNA, 22 bp, Artificial Sequence
  chemically synthesized
atcaagattatgatttttgtag

SEQ ID NO: 1051950 - DNA, 22 bp, Artificial Sequence
  chemically synthesized
aactcatcaagattatgatttt

SEQ ID NO: 1051951 - DNA, 22 bp, Artificial Sequence
  chemically synthesized
ctgaactcatcaagattatgat

SEQ ID NO: 1051952 - DNA, 22 bp, Artificial Sequence
  chemically synthesized
caaaaatcataatcttgatgag

SEQ ID NO: 1051953 - DNA, 22 bp, Artificial Sequence
  chemically synthesized
aaaaaaatgcctgctgaactca

SEQ ID NO: 1051954 - DNA, 22 bp, Artificial Sequence
  chemically synthesized
gaaaaaaatgcctgctgaactc

SEQ ID NO: 1051955 - DNA, 22 bp, Artificial Sequence
  chemically synthesized
tgaaaaaaatgcctgctgaact

SEQ ID NO: 1051956 - DNA, 22 bp, Artificial Sequence
  chemically synthesized
gctttgaaaaaaatgcctgctg

SEQ ID NO: 1051957 - DNA, 22 bp, Artificial Sequence
  chemically synthesized
ggctttgaaaaaaatgcctgct

SEQ ID NO: 1051958 - DNA, 22 bp, Artificial Sequence
  chemically synthesized
tggctttgaaaaaaatgcctgc

SEQ ID NO: 1051959 - DNA, 22 bp, Artificial Sequence
  chemically synthesized
gatgagttcagcaggcattttt

SEQ ID NO: 1051960 - DNA, 22 bp, Artificial Sequence
  chemically synthesized
atgagttcagcaggcatttttt

SEQ ID NO: 1051961 - DNA, 22 bp, Artificial Sequence
  chemically synthesized
agcaggcatttttttcaaagcc

SEQ ID NO: 1051962 - DNA, 22 bp, Artificial Sequence
  chemically synthesized
gcaaaatatgtcctttggcttt

SEQ ID NO: 1051963 - DNA, 22 bp, Artificial Sequence
  chemically synthesized
agcaaaatatgtcctttggctt

SEQ ID NO: 1051964 - DNA, 22 bp, Artificial Sequence
  chemically synthesized
cttagcaaaatatgtcctttgg

SEQ ID NO: 1051965 - DNA, 22 bp, Artificial Sequence
  chemically synthesized
ttttcaaagccaaaggacatat

SEQ ID NO: 1051966 - DNA, 22 bp, Artificial Sequence
  chemically synthesized
tttcaaagccaaaggacatatt

SEQ ID NO: 1051967 - DNA, 22 bp, Artificial Sequence
  chemically synthesized
ttcaaagccaaaggacatattt

SEQ ID NO: 1051968 - DNA, 22 bp, Artificial Sequence
  chemically synthesized
agttacttagcaaaatatgtcc

SEQ ID NO: 1051969 - DNA, 22 bp, Artificial Sequence
  chemically synthesized
tcaaagccaaaggacatatttt

SEQ ID NO: 1051970 - DNA, 22 bp, Artificial Sequence
  chemically synthesized
caaagccaaaggacatattttg

SEQ ID NO: 1051971 - DNA, 22 bp, Artificial Sequence
  chemically synthesized
aaagccaaaggacatattttgc

SEQ ID NO: 1051972 - DNA, 22 bp, Artificial Sequence
  chemically synthesized
ttaagttacttagcaaaatatg

SEQ ID NO: 1051973 - DNA, 22 bp, Artificial Sequence
  chemically synthesized
catctattaagttacttagcaa

SEQ ID NO: 1051974 - DNA, 22 bp, Artificial Sequence
  chemically synthesized
acatctattaagttacttagca

SEQ ID NO: 1051975 - DNA, 22 bp, Artificial Sequence
  chemically synthesized
tttacatctattaagttactta

SEQ ID NO: 1051976 - DNA, 22 bp, Artificial Sequence
  chemically synthesized
ctatttacatctattaagttac

SEQ ID NO: 1051977 - DNA, 22 bp, Artificial Sequence
  chemically synthesized
gctatttacatctattaagtta

SEQ ID NO: 1051978 - DNA, 22 bp, Artificial Sequence
  chemically synthesized
tttgctatttacatctattaag

SEQ ID NO: 1051979 - DNA, 22 bp, Artificial Sequence
  chemically synthesized
tgctaagtaacttaatagatgt

SEQ ID NO: 1051980 - DNA, 22 bp, Artificial Sequence
  chemically synthesized
gctaagtaacttaatagatgta

SEQ ID NO: 1051981 - DNA, 22 bp, Artificial Sequence
  chemically synthesized
ctaagtaacttaatagatgtaa

SEQ ID NO: 1051982 - DNA, 22 bp, Artificial Sequence
  chemically synthesized
agtaacttaatagatgtaaata

SEQ ID NO: 1051983 - DNA, 22 bp, Artificial Sequence
  chemically synthesized
tatgttatttgctatttacatc

SEQ ID NO: 1051984 - DNA, 22 bp, Artificial Sequence
  chemically synthesized
tgctatatgttatttgctattt

SEQ ID NO: 1051985 - DNA, 22 bp, Artificial Sequence
  chemically synthesized
aatagatgtaaatagcaaataa

SEQ ID NO: 1051986 - DNA, 22 bp, Artificial Sequence
  chemically synthesized
atagatgtaaatagcaaataac

SEQ ID NO: 1051987 - DNA, 22 bp, Artificial Sequence
  chemically synthesized
tgtagctatgctatatgttatt

SEQ ID NO: 1051988 - DNA, 22 bp, Artificial Sequence
  chemically synthesized
atgtagctatgctatatgttat

SEQ ID NO: 1051989 - DNA, 22 bp, Artificial Sequence
  chemically synthesized
tttatgtagctatgctatatgt

SEQ ID NO: 1051990 - DNA, 22 bp, Artificial Sequence
  chemically synthesized
atttatgtagctatgctatatg

SEQ ID NO: 1051991 - DNA, 22 bp, Artificial Sequence
  chemically synthesized
cacatatgcttatttatgtagc

SEQ ID NO: 1051992 - DNA, 22 bp, Artificial Sequence
  chemically synthesized
atatatgttacacatatgctta

SEQ ID NO: 1051993 - DNA, 22 bp, Artificial Sequence
  chemically synthesized
cataaataagcatatgtgtaac

SEQ ID NO: 1051994 - DNA, 22 bp, Artificial Sequence
  chemically synthesized
cataggcacacataaatgtatt

SEQ ID NO: 1051995 - DNA, 22 bp, Artificial Sequence
  chemically synthesized
aggctgcataggcacacataaa

SEQ ID NO: 1051996 - DNA, 22 bp, Artificial Sequence
  chemically synthesized
catctgaggctgcataggcaca

SEQ ID NO: 1051997 - DNA, 22 bp, Artificial Sequence
  chemically synthesized
acatctgaggctgcataggcac

SEQ ID NO: 1051998 - DNA, 22 bp, Artificial Sequence
  chemically synthesized
tatttacatctgaggctgcata

SEQ ID NO: 1051999 - DNA, 22 bp, Artificial Sequence
  chemically synthesized
tatatttacatctgaggctgca

SEQ ID NO: 1052000 - DNA, 22 bp, Artificial Sequence
  chemically synthesized
atgtgtgcctatgcagcctcag

SEQ ID NO: 1052001 - DNA, 22 bp, Artificial Sequence
  chemically synthesized
tgtgtgcctatgcagcctcaga

SEQ ID NO: 1052002 - DNA, 22 bp, Artificial Sequence
  chemically synthesized
tatctctatatttacatctgag

SEQ ID NO: 1052003 - DNA, 22 bp, Artificial Sequence
  chemically synthesized
atatctctatatttacatctga

SEQ ID NO: 1052004 - DNA, 22 bp, Artificial Sequence
  chemically synthesized
acttatatctctatatttacat

SEQ ID NO: 1052005 - DNA, 22 bp, Artificial Sequence
  chemically synthesized
tgcagcctcagatgtaaatata

SEQ ID NO: 1052006 - DNA, 22 bp, Artificial Sequence
  chemically synthesized
agatgtaaatatagagatataa

SEQ ID NO: 1052007 - DNA, 22 bp, Artificial Sequence
  chemically synthesized
ccaccagctaacttatatctct

SEQ ID NO: 1052008 - DNA, 22 bp, Artificial Sequence
  chemically synthesized
aatcacataccactgccaccag

SEQ ID NO: 1052009 - DNA, 22 bp, Artificial Sequence
  chemically synthesized
ctaaatcacataccactgccac

SEQ ID NO: 1052010 - DNA, 22 bp, Artificial Sequence
  chemically synthesized
cctaaatcacataccactgcca

SEQ ID NO: 1052011 - DNA, 22 bp, Artificial Sequence
  chemically synthesized
gcttcctaaatcacataccact

SEQ ID NO: 1052012 - DNA, 22 bp, Artificial Sequence
  chemically synthesized
gctggtggcagtggtatgtgat

SEQ ID NO: 1052013 - DNA, 22 bp, Artificial Sequence
  chemically synthesized
gtggcagtggtatgtgatttag

SEQ ID NO: 1052014 - DNA, 22 bp, Artificial Sequence
  chemically synthesized
atacataatgccatatggcata

SEQ ID NO: 1052015 - DNA, 22 bp, Artificial Sequence
  chemically synthesized
aatacataatgccatatggcat

SEQ ID NO: 1052016 - DNA, 22 bp, Artificial Sequence
  chemically synthesized
aggaagctaatatgccatatgg

SEQ ID NO: 1052017 - DNA, 22 bp, Artificial Sequence
  chemically synthesized
ggaagctaatatgccatatggc

SEQ ID NO: 1052018 - DNA, 22 bp, Artificial Sequence
  chemically synthesized
atatgccatatggcattatgta

SEQ ID NO: 1052019 - DNA, 22 bp, Artificial Sequence
  chemically synthesized
tgtgcaaaagtgtttaatacat

SEQ ID NO: 1052020 - DNA, 22 bp, Artificial Sequence
  chemically synthesized
cctatgtgcaaaagtgtttaat

SEQ ID NO: 1052021 - DNA, 22 bp, Artificial Sequence
  chemically synthesized
acctatgtgcaaaagtgtttaa

SEQ ID NO: 1052022 - DNA, 22 bp, Artificial Sequence
  chemically synthesized
atatcttacctatgtgcaaaag

SEQ ID NO: 1052023 - DNA, 22 bp, Artificial Sequence
  chemically synthesized
tgtattaaacacttttgcacat

SEQ ID NO: 1052024 - DNA, 22 bp, Artificial Sequence
  chemically synthesized
aatatcttacctatgtgcaaaa

SEQ ID NO: 1052025 - DNA, 22 bp, Artificial Sequence
  chemically synthesized
taatatcttacctatgtgcaaa

SEQ ID NO: 1052026 - DNA, 22 bp, Artificial Sequence
  chemically synthesized
aacacttttgcacataggtaag

SEQ ID NO: 1052027 - DNA, 22 bp, Artificial Sequence
  chemically synthesized
ttgcacataggtaagatattaa

SEQ ID NO: 1052028 - DNA, 22 bp, Artificial Sequence
  chemically synthesized
tgcacataggtaagatattaaa

SEQ ID NO: 1052029 - DNA, 22 bp, Artificial Sequence
  chemically synthesized
gcacataggtaagatattaaag

SEQ ID NO: 1052030 - DNA, 22 bp, Artificial Sequence
  chemically synthesized
cacataggtaagatattaaaga

SEQ ID NO: 1052031 - DNA, 22 bp, Artificial Sequence
  chemically synthesized
gtgtgagccatggcgcccagcc

SEQ ID NO: 1052032 - DNA, 22 bp, Artificial Sequence
  chemically synthesized
aagatccttgggctgggcgcca

SEQ ID NO: 1052033 - DNA, 22 bp, Artificial Sequence
  chemically synthesized
ctggtgtgagccatggcgccca

SEQ ID NO: 1052034 - DNA, 22 bp, Artificial Sequence
  chemically synthesized
ggattactggtgtgagccatgg

SEQ ID NO: 1052035 - DNA, 22 bp, Artificial Sequence
  chemically synthesized
gggctgggcgccatggctcaca

SEQ ID NO: 1052036 - DNA, 22 bp, Artificial Sequence
  chemically synthesized
ggctgggcgccatggctcacac

SEQ ID NO: 1052037 - DNA, 22 bp, Artificial Sequence
  chemically synthesized
ggcgccatggctcacaccagta

SEQ ID NO: 1052038 - DNA, 22 bp, Artificial Sequence
  chemically synthesized
ccaaagtgctgggattactggt

SEQ ID NO: 1052039 - DNA, 22 bp, Artificial Sequence
  chemically synthesized
ggcctcccaaagtgctgggatt

SEQ ID NO: 1052040 - DNA, 22 bp, Artificial Sequence
  chemically synthesized
acaccagtaatcccagcacttt

SEQ ID NO: 1052041 - DNA, 22 bp, Artificial Sequence
  chemically synthesized
cctcggcctcccaaagtgctgg

SEQ ID NO: 1052042 - DNA, 22 bp, Artificial Sequence
  chemically synthesized
cctgcctcggcctcccaaagtg

SEQ ID NO: 1052043 - DNA, 22 bp, Artificial Sequence
  chemically synthesized
aaatgatctgcctgcctcggcc

SEQ ID NO: 1052044 - DNA, 22 bp, Artificial Sequence
  chemically synthesized
acctcaaatgatctgcctgcct

SEQ ID NO: 1052045 - DNA, 22 bp, Artificial Sequence
  chemically synthesized
tgggaggccgaggcaggcagat

SEQ ID NO: 1052046 - DNA, 22 bp, Artificial Sequence
  chemically synthesized
gggaggccgaggcaggcagatc

SEQ ID NO: 1052047 - DNA, 22 bp, Artificial Sequence
  chemically synthesized
ctgacctcaaatgatctgcctg

SEQ ID NO: 1052048 - DNA, 22 bp, Artificial Sequence
  chemically synthesized
ggaggccgaggcaggcagatca

SEQ ID NO: 1052049 - DNA, 22 bp, Artificial Sequence
  chemically synthesized
aactcctgacctcaaatgatct

SEQ ID NO: 1052050 - DNA, 22 bp, Artificial Sequence
  chemically synthesized
gaactcctgacctcaaatgatc

SEQ ID NO: 1052051 - DNA, 22 bp, Artificial Sequence
  chemically synthesized
tcttgaactcctgacctcaaat

SEQ ID NO: 1052052 - DNA, 22 bp, Artificial Sequence
  chemically synthesized
gtcttgaactcctgacctcaaa

SEQ ID NO: 1052053 - DNA, 22 bp, Artificial Sequence
  chemically synthesized
tccaggcttgtcttgaactcct

SEQ ID NO: 1052054 - DNA, 22 bp, Artificial Sequence
  chemically synthesized
gaggtcaggagttcaagacaag

SEQ ID NO: 1052055 - DNA, 22 bp, Artificial Sequence
  chemically synthesized
aggtcaggagttcaagacaagc

SEQ ID NO: 1052056 - DNA, 22 bp, Artificial Sequence
  chemically synthesized
accatgttgtccaggcttgtct

SEQ ID NO: 1052057 - DNA, 22 bp, Artificial Sequence
  chemically synthesized
caccatgttgtccaggcttgtc

SEQ ID NO: 1052058 - DNA, 22 bp, Artificial Sequence
  chemically synthesized
aagacaagcctggacaacatgg

SEQ ID NO: 1052059 - DNA, 22 bp, Artificial Sequence
  chemically synthesized
gtacagacagggtttcaccatg

SEQ ID NO: 1052060 - DNA, 22 bp, Artificial Sequence
  chemically synthesized
agtacagacagggtttcaccat

SEQ ID NO: 1052061 - DNA, 22 bp, Artificial Sequence
  chemically synthesized
tagtacagacagggtttcacca

SEQ ID NO: 1052062 - DNA, 22 bp, Artificial Sequence
  chemically synthesized
ttagtacagacagggtttcacc

SEQ ID NO: 1052063 - DNA, 22 bp, Artificial Sequence
  chemically synthesized
tttagtacagacagggtttcac

SEQ ID NO: 1052064 - DNA, 22 bp, Artificial Sequence
  chemically synthesized
ttttagtacagacagggtttca

SEQ ID NO: 1052065 - DNA, 22 bp, Artificial Sequence
  chemically synthesized
gacaacatggtgaaaccctgtc

SEQ ID NO: 1052066 - DNA, 22 bp, Artificial Sequence
  chemically synthesized
tttttttagtacagacagggtt

SEQ ID NO: 1052067 - DNA, 22 bp, Artificial Sequence
  chemically synthesized
atttttttagtacagacagggt

SEQ ID NO: 1052068 - DNA, 22 bp, Artificial Sequence
  chemically synthesized
tatttttttagtacagacaggg

SEQ ID NO: 1052069 - DNA, 22 bp, Artificial Sequence
  chemically synthesized
ttatttttttagtacagacagg

SEQ ID NO: 1052070 - DNA, 22 bp, Artificial Sequence
  chemically synthesized
tttatttttttagtacagacag

SEQ ID NO: 1052071 - DNA, 22 bp, Artificial Sequence
  chemically synthesized
ttttatttttttagtacagaca

SEQ ID NO: 1052072 - DNA, 22 bp, Artificial Sequence
  chemically synthesized
atttttttatttttttagtaca

SEQ ID NO: 1052073 - DNA, 22 bp, Artificial Sequence
  chemically synthesized
gctaatttttttatttttttag

SEQ ID NO: 1052074 - DNA, 22 bp, Artificial Sequence
  chemically synthesized
tctgtactaaaaaaataaaaaa

SEQ ID NO: 1052075 - DNA, 22 bp, Artificial Sequence
  chemically synthesized
tactaaaaaaataaaaaaatta

SEQ ID NO: 1052076 - DNA, 22 bp, Artificial Sequence
  chemically synthesized
aaaaaataaaaaaattagccag

SEQ ID NO: 1052077 - DNA, 22 bp, Artificial Sequence
  chemically synthesized
caggcaaccgccatcacgcctg

SEQ ID NO: 1052078 - DNA, 22 bp, Artificial Sequence
  chemically synthesized
ggattacaggcaaccgccatca

SEQ ID NO: 1052079 - DNA, 22 bp, Artificial Sequence
  chemically synthesized
ctgggattacaggcaaccgcca

SEQ ID NO: 1052080 - DNA, 22 bp, Artificial Sequence
  chemically synthesized
gccaggcgtgatggcggttgcc

SEQ ID NO: 1052081 - DNA, 22 bp, Artificial Sequence
  chemically synthesized
cagagttgctgggattacaggc

SEQ ID NO: 1052082 - DNA, 22 bp, Artificial Sequence
  chemically synthesized
aacctccagagttgctgggatt

SEQ ID NO: 1052083 - DNA, 22 bp, Artificial Sequence
  chemically synthesized
cctcaacctccagagttgctgg

SEQ ID NO: 1052084 - DNA, 22 bp, Artificial Sequence
  chemically synthesized
cctgtaatcccagcaactctgg

SEQ ID NO: 1052085 - DNA, 22 bp, Artificial Sequence
  chemically synthesized
ctgcctcaacctccagagttgc

SEQ ID NO: 1052086 - DNA, 22 bp, Artificial Sequence
  chemically synthesized
tcctgcctcaacctccagagtt

SEQ ID NO: 1052087 - DNA, 22 bp, Artificial Sequence
  chemically synthesized
taatcccagcaactctggaggt

SEQ ID NO: 1052088 - DNA, 22 bp, Artificial Sequence
  chemically synthesized
aagtgattctcctgcctcaacc

SEQ ID NO: 1052089 - DNA, 22 bp, Artificial Sequence
  chemically synthesized
tggaggttgaggcaggagaatc

SEQ ID NO: 1052090 - DNA, 22 bp, Artificial Sequence
  chemically synthesized
ccaggttcaagtgattctcctg

SEQ ID NO: 1052091 - DNA, 22 bp, Artificial Sequence
  chemically synthesized
gaggttgaggcaggagaatcac

SEQ ID NO: 1052092 - DNA, 22 bp, Artificial Sequence
  chemically synthesized
tctcccaggttcaagtgattct

SEQ ID NO: 1052093 - DNA, 22 bp, Artificial Sequence
  chemically synthesized
tgtctcccaggttcaagtgatt

SEQ ID NO: 1052094 - DNA, 22 bp, Artificial Sequence
  chemically synthesized
aggcaggagaatcacttgaacc

SEQ ID NO: 1052095 - DNA, 22 bp, Artificial Sequence
  chemically synthesized
caccctctgtctcccaggttca

SEQ ID NO: 1052096 - DNA, 22 bp, Artificial Sequence
  chemically synthesized
actgcaccctctgtctcccagg

SEQ ID NO: 1052097 - DNA, 22 bp, Artificial Sequence
  chemically synthesized
ggctcactgcaccctctgtctc

SEQ ID NO: 1052098 - DNA, 22 bp, Artificial Sequence
  chemically synthesized
gaacctgggagacagagggtgc

SEQ ID NO: 1052099 - DNA, 22 bp, Artificial Sequence
  chemically synthesized
aacctgggagacagagggtgca

SEQ ID NO: 1052100 - DNA, 22 bp, Artificial Sequence
  chemically synthesized
ggagacagagggtgcagtgagc

SEQ ID NO: 1052101 - DNA, 22 bp, Artificial Sequence
  chemically synthesized
gagtgcagtggcatgatctcgg

SEQ ID NO: 1052102 - DNA, 22 bp, Artificial Sequence
  chemically synthesized
tcacccaggctggagtgcagtg

SEQ ID NO: 1052103 - DNA, 22 bp, Artificial Sequence
  chemically synthesized
accctgtcacccaggctggagt

SEQ ID NO: 1052104 - DNA, 22 bp, Artificial Sequence
  chemically synthesized
tcaccctgtcacccaggctgga

SEQ ID NO: 1052105 - DNA, 22 bp, Artificial Sequence
  chemically synthesized
cactccagcctgggtgacaggg

SEQ ID NO: 1052106 - DNA, 22 bp, Artificial Sequence
  chemically synthesized
agacagattctcaccctgtcac

SEQ ID NO: 1052107 - DNA, 22 bp, Artificial Sequence
  chemically synthesized
gagacagattctcaccctgtca

SEQ ID NO: 1052108 - DNA, 22 bp, Artificial Sequence
  chemically synthesized
tgagacagattctcaccctgtc

SEQ ID NO: 1052109 - DNA, 22 bp, Artificial Sequence
  chemically synthesized
ttgagacagattctcaccctgt

SEQ ID NO: 1052110 - DNA, 22 bp, Artificial Sequence
  chemically synthesized
cagcctgggtgacagggtgaga

SEQ ID NO: 1052111 - DNA, 22 bp, Artificial Sequence
  chemically synthesized
tttgagacagattctcaccctg

SEQ ID NO: 1052112 - DNA, 22 bp, Artificial Sequence
  chemically synthesized
ttttgagacagattctcaccct

SEQ ID NO: 1052113 - DNA, 22 bp, Artificial Sequence
  chemically synthesized
tttttgagacagattctcaccc

SEQ ID NO: 1052114 - DNA, 22 bp, Artificial Sequence
  chemically synthesized
ttttttgagacagattctcacc

SEQ ID NO: 1052115 - DNA, 22 bp, Artificial Sequence
  chemically synthesized
tttttttgagacagattctcac

SEQ ID NO: 1052116 - DNA, 22 bp, Artificial Sequence
  chemically synthesized
ttttttttgagacagattctca

SEQ ID NO: 1052117 - DNA, 22 bp, Artificial Sequence
  chemically synthesized
tttttttttgagacagattctc

SEQ ID NO: 1052118 - DNA, 22 bp, Artificial Sequence
  chemically synthesized
ggtgacagggtgagaatctgtc

SEQ ID NO: 1052119 - DNA, 22 bp, Artificial Sequence
  chemically synthesized
ttttttttttgagacagattct

SEQ ID NO: 1052120 - DNA, 22 bp, Artificial Sequence
  chemically synthesized
tttttttttttgagacagattc

SEQ ID NO: 1052121 - DNA, 22 bp, Artificial Sequence
  chemically synthesized
ttttttttttttgagacagatt

SEQ ID NO: 1052122 - DNA, 22 bp, Artificial Sequence
  chemically synthesized
tttttttttttttgagacagat

SEQ ID NO: 1052123 - DNA, 22 bp, Artificial Sequence
  chemically synthesized
ggtaaatacttttttttttttt

SEQ ID NO: 1052124 - DNA, 22 bp, Artificial Sequence
  chemically synthesized
tctcaaaaaaaaaaaaaaagta

SEQ ID NO: 1052125 - DNA, 22 bp, Artificial Sequence
  chemically synthesized
atatagttaggtaaatactttt

SEQ ID NO: 1052126 - DNA, 22 bp, Artificial Sequence
  chemically synthesized
aaaaaaaaaaaaaaagtattta

SEQ ID NO: 1052127 - DNA, 22 bp, Artificial Sequence
  chemically synthesized
ttcatatagttaggtaaatact

SEQ ID NO: 1052128 - DNA, 22 bp, Artificial Sequence
  chemically synthesized
attcatatagttaggtaaatac

SEQ ID NO: 1052129 - DNA, 22 bp, Artificial Sequence
  chemically synthesized
aatagtttattcatatagttag

SEQ ID NO: 1052130 - DNA, 22 bp, Artificial Sequence
  chemically synthesized
caatagtttattcatatagtta

SEQ ID NO: 1052131 - DNA, 22 bp, Artificial Sequence
  chemically synthesized
tttcaatagtttattcatatag

SEQ ID NO: 1052132 - DNA, 22 bp, Artificial Sequence
  chemically synthesized
attatttcaatagtttattcat

SEQ ID NO: 1052133 - DNA, 22 bp, Artificial Sequence
  chemically synthesized
aattatttcaatagtttattca

SEQ ID NO: 1052134 - DNA, 22 bp, Artificial Sequence
  chemically synthesized
acctaactatatgaataaacta

SEQ ID NO: 1052135 - DNA, 22 bp, Artificial Sequence
  chemically synthesized
cctaactatatgaataaactat

SEQ ID NO: 1052136 - DNA, 22 bp, Artificial Sequence
  chemically synthesized
actatatgaataaactattgaa

SEQ ID NO: 1052137 - DNA, 22 bp, Artificial Sequence
  chemically synthesized
tatgaataaactattgaaataa

SEQ ID NO: 1052138 - DNA, 22 bp, Artificial Sequence
  chemically synthesized
tggataatttaattatttcaat

SEQ ID NO: 1052139 - DNA, 22 bp, Artificial Sequence
  chemically synthesized
atggataatttaattatttcaa

SEQ ID NO: 1052140 - DNA, 22 bp, Artificial Sequence
  chemically synthesized
tacttatggataatttaattat

SEQ ID NO: 1052141 - DNA, 22 bp, Artificial Sequence
  chemically synthesized
atacttatggataatttaatta

SEQ ID NO: 1052142 - DNA, 22 bp, Artificial Sequence
  chemically synthesized
tatacttatggataatttaatt

SEQ ID NO: 1052143 - DNA, 22 bp, Artificial Sequence
  chemically synthesized
attttatacttatggataattt

SEQ ID NO: 1052144 - DNA, 22 bp, Artificial Sequence
  chemically synthesized
ttgaaataattaaattatccat

SEQ ID NO: 1052145 - DNA, 22 bp, Artificial Sequence
  chemically synthesized
cattttatacttatggataatt

SEQ ID NO: 1052146 - DNA, 22 bp, Artificial Sequence
  chemically synthesized
aaataattaaattatccataag

SEQ ID NO: 1052147 - DNA, 22 bp, Artificial Sequence
  chemically synthesized
tttcattttatacttatggata

SEQ ID NO: 1052148 - DNA, 22 bp, Artificial Sequence
  chemically synthesized
atttcattttatacttatggat

SEQ ID NO: 1052149 - DNA, 22 bp, Artificial Sequence
  chemically synthesized
gtgtttatttcattttatactt

SEQ ID NO: 1052150 - DNA, 22 bp, Artificial Sequence
  chemically synthesized
aattatccataagtataaaatg

SEQ ID NO: 1052151 - DNA, 22 bp, Artificial Sequence
  chemically synthesized
tccataagtataaaatgaaata

SEQ ID NO: 1052152 - DNA, 22 bp, Artificial Sequence
  chemically synthesized
attatctgttctctctctctgt

SEQ ID NO: 1052153 - DNA, 22 bp, Artificial Sequence
  chemically synthesized
tctgttctctctctctgtctcc

SEQ ID NO: 1052154 - DNA, 22 bp, Artificial Sequence
  chemically synthesized
ttctctctctctgtctcccttc

SEQ ID NO: 1052155 - DNA, 22 bp, Artificial Sequence
  chemically synthesized
tctctctctgtctcccttcctc

SEQ ID NO: 1052156 - DNA, 22 bp, Artificial Sequence
  chemically synthesized
tctctctgtctcccttcctcca

SEQ ID NO: 1052157 - DNA, 22 bp, Artificial Sequence
  chemically synthesized
tctctgtctcccttcctccatc

SEQ ID NO: 1052158 - DNA, 22 bp, Artificial Sequence
  chemically synthesized
tctgtctcccttcctccatccc

SEQ ID NO: 1052159 - DNA, 22 bp, Artificial Sequence
  chemically synthesized
tgtctcccttcctccatccctc

SEQ ID NO: 1052160 - DNA, 22 bp, Artificial Sequence
  chemically synthesized
tctcccttcctccatccctccc

SEQ ID NO: 1052161 - DNA, 22 bp, Artificial Sequence
  chemically synthesized
ccttcctccatccctccctctc

SEQ ID NO: 1052162 - DNA, 22 bp, Artificial Sequence
  chemically synthesized
cctccatccctccctctctcat

SEQ ID NO: 1052163 - DNA, 22 bp, Artificial Sequence
  chemically synthesized
ctccatccctccctctctcatc

SEQ ID NO: 1052164 - DNA, 22 bp, Artificial Sequence
  chemically synthesized
catccctccctctctcatctgt

SEQ ID NO: 1052165 - DNA, 22 bp, Artificial Sequence
  chemically synthesized
gcacagggcaacacagatgaga

SEQ ID NO: 1052166 - DNA, 22 bp, Artificial Sequence
  chemically synthesized
agcacagggcaacacagatgag

SEQ ID NO: 1052167 - DNA, 22 bp, Artificial Sequence
  chemically synthesized
cctctctcatctgtgttgccct

SEQ ID NO: 1052168 - DNA, 22 bp, Artificial Sequence
  chemically synthesized
tctcatctgtgttgccctgtgc

SEQ ID NO: 1052169 - DNA, 22 bp, Artificial Sequence
  chemically synthesized
gggaaataatttagcacagggc

SEQ ID NO: 1052170 - DNA, 22 bp, Artificial Sequence
  chemically synthesized
tcatctgtgttgccctgtgcta

SEQ ID NO: 1052171 - DNA, 22 bp, Artificial Sequence
  chemically synthesized
ggggaaataatttagcacaggg

SEQ ID NO: 1052172 - DNA, 22 bp, Artificial Sequence
  chemically synthesized
atctgtgttgccctgtgctaaa

SEQ ID NO: 1052173 - DNA, 22 bp, Artificial Sequence
  chemically synthesized
tgttgccctgtgctaaattatt

SEQ ID NO: 1052174 - DNA, 22 bp, Artificial Sequence
  chemically synthesized
atagtttggggaaataatttag

SEQ ID NO: 1052175 - DNA, 22 bp, Artificial Sequence
  chemically synthesized
ccctgtgctaaattatttcccc

SEQ ID NO: 1052176 - DNA, 22 bp, Artificial Sequence
  chemically synthesized
tgctaaattatttccccaaact

SEQ ID NO: 1052177 - DNA, 22 bp, Artificial Sequence
  chemically synthesized
tatatatggactcatagtttgg

SEQ ID NO: 1052178 - DNA, 22 bp, Artificial Sequence
  chemically synthesized
aattatttccccaaactatgag

SEQ ID NO: 1052179 - DNA, 22 bp, Artificial Sequence
  chemically synthesized
tttccccaaactatgagtccat

SEQ ID NO: 1052180 - DNA, 22 bp, Artificial Sequence
  chemically synthesized
ccccaaactatgagtccatata

SEQ ID NO: 1052181 - DNA, 22 bp, Artificial Sequence
  chemically synthesized
cccaaactatgagtccatatat

SEQ ID NO: 1052182 - DNA, 22 bp, Artificial Sequence
  chemically synthesized
tgagtccatatatataggttct

SEQ ID NO: 1052183 - DNA, 22 bp, Artificial Sequence
  chemically synthesized
gagtaaggtgaaaaagaaccta

SEQ ID NO: 1052184 - DNA, 22 bp, Artificial Sequence
  chemically synthesized
cagcctcgagtaaggtgaaaaa

SEQ ID NO: 1052185 - DNA, 22 bp, Artificial Sequence
  chemically synthesized
tttttcaccttactcgaggctg

SEQ ID NO: 1052186 - DNA, 22 bp, Artificial Sequence
  chemically synthesized
tttcaccttactcgaggctgca

SEQ ID NO: 1052187 - DNA, 22 bp, Artificial Sequence
  chemically synthesized
ttcaccttactcgaggctgcag

SEQ ID NO: 1052188 - DNA, 22 bp, Artificial Sequence
  chemically synthesized
tcaccttactcgaggctgcagc

SEQ ID NO: 1052189 - DNA, 22 bp, Artificial Sequence
  chemically synthesized
caccttactcgaggctgcagct

SEQ ID NO: 1052190 - DNA, 22 bp, Artificial Sequence
  chemically synthesized
accttactcgaggctgcagcta

SEQ ID NO: 1052191 - DNA, 22 bp, Artificial Sequence
  chemically synthesized
aaacaggagataatagctgcag

SEQ ID NO: 1052192 - DNA, 22 bp, Artificial Sequence
  chemically synthesized
actcgaggctgcagctattatc

SEQ ID NO: 1052193 - DNA, 22 bp, Artificial Sequence
  chemically synthesized
ctcgaggctgcagctattatct

SEQ ID NO: 1052194 - DNA, 22 bp, Artificial Sequence
  chemically synthesized
gaggctgcagctattatctcct

SEQ ID NO: 1052195 - DNA, 22 bp, Artificial Sequence
  chemically synthesized
cagctattatctcctgtttcag

SEQ ID NO: 1052196 - DNA, 22 bp, Artificial Sequence
  chemically synthesized
ttatctcctgtttcagtcattt

SEQ ID NO: 1052197 - DNA, 22 bp, Artificial Sequence
  chemically synthesized
tctcctgtttcagtcatttatt

SEQ ID NO: 1052198 - DNA, 22 bp, Artificial Sequence
  chemically synthesized
ctgtttcagtcatttattcctt

SEQ ID NO: 1052199 - DNA, 22 bp, Artificial Sequence
  chemically synthesized
tttcagtcatttattccttctg

SEQ ID NO: 1052200 - DNA, 22 bp, Artificial Sequence
  chemically synthesized
aagtcaaaatgggacagaagga

SEQ ID NO: 1052201 - DNA, 22 bp, Artificial Sequence
  chemically synthesized
cagtcatttattccttctgtcc

SEQ ID NO: 1052202 - DNA, 22 bp, Artificial Sequence
  chemically synthesized
gaagtcaaaatgggacagaagg

SEQ ID NO: 1052203 - DNA, 22 bp, Artificial Sequence
  chemically synthesized
agtcatttattccttctgtccc

SEQ ID NO: 1052204 - DNA, 22 bp, Artificial Sequence
  chemically synthesized
tgaagtcaaaatgggacagaag

SEQ ID NO: 1052205 - DNA, 22 bp, Artificial Sequence
  chemically synthesized
gtagctttgaagtcaaaatggg

SEQ ID NO: 1052206 - DNA, 22 bp, Artificial Sequence
  chemically synthesized
attccttctgtcccattttgac

SEQ ID NO: 1052207 - DNA, 22 bp, Artificial Sequence
  chemically synthesized
ttccttctgtcccattttgact

SEQ ID NO: 1052208 - DNA, 22 bp, Artificial Sequence
  chemically synthesized
cttctgtcccattttgacttca

SEQ ID NO: 1052209 - DNA, 22 bp, Artificial Sequence
  chemically synthesized
ctgtcccattttgacttcaaag

SEQ ID NO: 1052210 - DNA, 22 bp, Artificial Sequence
  chemically synthesized
tgcccctagtagctttgaagtc

SEQ ID NO: 1052211 - DNA, 22 bp, Artificial Sequence
  chemically synthesized
tgtcccattttgacttcaaagc

SEQ ID NO: 1052212 - DNA, 22 bp, Artificial Sequence
  chemically synthesized
gtgcccctagtagctttgaagt

SEQ ID NO: 1052213 - DNA, 22 bp, Artificial Sequence
  chemically synthesized
tgtgcccctagtagctttgaag

SEQ ID NO: 1052214 - DNA, 22 bp, Artificial Sequence
  chemically synthesized
tcccattttgacttcaaagcta

SEQ ID NO: 1052215 - DNA, 22 bp, Artificial Sequence
  chemically synthesized
ttgtgcccctagtagctttgaa

SEQ ID NO: 1052216 - DNA, 22 bp, Artificial Sequence
  chemically synthesized
tttgtgcccctagtagctttga

SEQ ID NO: 1052217 - DNA, 22 bp, Artificial Sequence
  chemically synthesized
ttttgtgcccctagtagctttg

SEQ ID NO: 1052218 - DNA, 22 bp, Artificial Sequence
  chemically synthesized
tttttgtgcccctagtagcttt

SEQ ID NO: 1052219 - DNA, 22 bp, Artificial Sequence
  chemically synthesized
ttttttgtgcccctagtagctt

SEQ ID NO: 1052220 - DNA, 22 bp, Artificial Sequence
  chemically synthesized
tttttttgtgcccctagtagct

SEQ ID NO: 1052221 - DNA, 22 bp, Artificial Sequence
  chemically synthesized
ttttttttgtgcccctagtagc

SEQ ID NO: 1052222 - DNA, 22 bp, Artificial Sequence
  chemically synthesized
tttttttttgtgcccctagtag

SEQ ID NO: 1052223 - DNA, 22 bp, Artificial Sequence
  chemically synthesized
tgacttcaaagctactaggggc

SEQ ID NO: 1052224 - DNA, 22 bp, Artificial Sequence
  chemically synthesized
gacttcaaagctactaggggca

SEQ ID NO: 1052225 - DNA, 22 bp, Artificial Sequence
  chemically synthesized
tttttttttttgtgcccctagt

SEQ ID NO: 1052226 - DNA, 22 bp, Artificial Sequence
  chemically synthesized
acttcaaagctactaggggcac

SEQ ID NO: 1052227 - DNA, 22 bp, Artificial Sequence
  chemically synthesized
tctctttttttttttgtgcccc

SEQ ID NO: 1052228 - DNA, 22 bp, Artificial Sequence
  chemically synthesized
caaagctactaggggcacaaaa

SEQ ID NO: 1052229 - DNA, 22 bp, Artificial Sequence
  chemically synthesized
aaagctactaggggcacaaaaa

SEQ ID NO: 1052230 - DNA, 22 bp, Artificial Sequence
  chemically synthesized
attatctctttttttttttgtg

SEQ ID NO: 1052231 - DNA, 22 bp, Artificial Sequence
  chemically synthesized
aattatctctttttttttttgt

SEQ ID NO: 1052232 - DNA, 22 bp, Artificial Sequence
  chemically synthesized
ctaggggcacaaaaaaaaaaag

SEQ ID NO: 1052233 - DNA, 22 bp, Artificial Sequence
  chemically synthesized
ggggcacaaaaaaaaaaagaga

SEQ ID NO: 1052234 - DNA, 22 bp, Artificial Sequence
  chemically synthesized
ataaacttaattatctcttttt

SEQ ID NO: 1052235 - DNA, 22 bp, Artificial Sequence
  chemically synthesized
taataaacttaattatctcttt

SEQ ID NO: 1052236 - DNA, 22 bp, Artificial Sequence
  chemically synthesized
aagaggtaattctaataaactt

SEQ ID NO: 1052237 - DNA, 22 bp, Artificial Sequence
  chemically synthesized
attaaagaggtaattctaataa

SEQ ID NO: 1052238 - DNA, 22 bp, Artificial Sequence
  chemically synthesized
gattaaagaggtaattctaata

SEQ ID NO: 1052239 - DNA, 22 bp, Artificial Sequence
  chemically synthesized
tgattaaagaggtaattctaat

SEQ ID NO: 1052240 - DNA, 22 bp, Artificial Sequence
  chemically synthesized
ctttgattaaagaggtaattct

SEQ ID NO: 1052241 - DNA, 22 bp, Artificial Sequence
  chemically synthesized
gctttgattaaagaggtaattc

SEQ ID NO: 1052242 - DNA, 22 bp, Artificial Sequence
  chemically synthesized
tgctttgattaaagaggtaatt

SEQ ID NO: 1052243 - DNA, 22 bp, Artificial Sequence
  chemically synthesized
agtttattagaattacctcttt

SEQ ID NO: 1052244 - DNA, 22 bp, Artificial Sequence
  chemically synthesized
attagaattacctctttaatca

SEQ ID NO: 1052245 - DNA, 22 bp, Artificial Sequence
  chemically synthesized
aaaattttgctttgattaaaga

SEQ ID NO: 1052246 - DNA, 22 bp, Artificial Sequence
  chemically synthesized
ttagaattacctctttaatcaa

SEQ ID NO: 1052247 - DNA, 22 bp, Artificial Sequence
  chemically synthesized
aaaaattttgctttgattaaag

SEQ ID NO: 1052248 - DNA, 22 bp, Artificial Sequence
  chemically synthesized
taaaaattttgctttgattaaa

SEQ ID NO: 1052249 - DNA, 22 bp, Artificial Sequence
  chemically synthesized
ttaaaaattttgctttgattaa

SEQ ID NO: 1052250 - DNA, 22 bp, Artificial Sequence
  chemically synthesized
gaattacctctttaatcaaagc

SEQ ID NO: 1052251 - DNA, 22 bp, Artificial Sequence
  chemically synthesized
tttaaaaattttgctttgatta

SEQ ID NO: 1052252 - DNA, 22 bp, Artificial Sequence
  chemically synthesized
cctctttaatcaaagcaaaatt

SEQ ID NO: 1052253 - DNA, 22 bp, Artificial Sequence
  chemically synthesized
gagattttttaaaaattttgct

SEQ ID NO: 1052254 - DNA, 22 bp, Artificial Sequence
  chemically synthesized
ggagattttttaaaaattttgc

SEQ ID NO: 1052255 - DNA, 22 bp, Artificial Sequence
  chemically synthesized
tggagattttttaaaaattttg

SEQ ID NO: 1052256 - DNA, 22 bp, Artificial Sequence
  chemically synthesized
tttaatcaaagcaaaattttta

SEQ ID NO: 1052257 - DNA, 22 bp, Artificial Sequence
  chemically synthesized
ttggagattttttaaaaatttt

SEQ ID NO: 1052258 - DNA, 22 bp, Artificial Sequence
  chemically synthesized
tttggagattttttaaaaattt

SEQ ID NO: 1052259 - DNA, 22 bp, Artificial Sequence
  chemically synthesized
taatcaaagcaaaatttttaaa

SEQ ID NO: 1052260 - DNA, 22 bp, Artificial Sequence
  chemically synthesized
ttttggagattttttaaaaatt

SEQ ID NO: 1052261 - DNA, 22 bp, Artificial Sequence
  chemically synthesized
aatcaaagcaaaatttttaaaa

SEQ ID NO: 1052262 - DNA, 22 bp, Artificial Sequence
  chemically synthesized
atcaaagcaaaatttttaaaaa

SEQ ID NO: 1052263 - DNA, 22 bp, Artificial Sequence
  chemically synthesized
caaatccttttttggagatttt

SEQ ID NO: 1052264 - DNA, 22 bp, Artificial Sequence
  chemically synthesized
ccaaatccttttttggagattt

SEQ ID NO: 1052265 - DNA, 22 bp, Artificial Sequence
  chemically synthesized
ttaaaaaatctccaaaaaagga

SEQ ID NO: 1052266 - DNA, 22 bp, Artificial Sequence
  chemically synthesized
taaaaaatctccaaaaaaggat

SEQ ID NO: 1052267 - DNA, 22 bp, Artificial Sequence
  chemically synthesized
aaaaaatctccaaaaaaggatt

SEQ ID NO: 1052268 - DNA, 22 bp, Artificial Sequence
  chemically synthesized
aaaaatctccaaaaaaggattt

SEQ ID NO: 1052269 - DNA, 22 bp, Artificial Sequence
  chemically synthesized
tgaaatgaatttccaaatcctt

SEQ ID NO: 1052270 - DNA, 22 bp, Artificial Sequence
  chemically synthesized
attatgaaatgaatttccaaat

SEQ ID NO: 1052271 - DNA, 22 bp, Artificial Sequence
  chemically synthesized
cattatgaaatgaatttccaaa

SEQ ID NO: 1052272 - DNA, 22 bp, Artificial Sequence
  chemically synthesized
caaaaaaggatttggaaattca

SEQ ID NO: 1052273 - DNA, 22 bp, Artificial Sequence
  chemically synthesized
tatttcattatgaaatgaattt

SEQ ID NO: 1052274 - DNA, 22 bp, Artificial Sequence
  chemically synthesized
atatttcattatgaaatgaatt

SEQ ID NO: 1052275 - DNA, 22 bp, Artificial Sequence
  chemically synthesized
cttatatttcattatgaaatga

SEQ ID NO: 1052276 - DNA, 22 bp, Artificial Sequence
  chemically synthesized
acttatatttcattatgaaatg

SEQ ID NO: 1052277 - DNA, 22 bp, Artificial Sequence
  chemically synthesized
ggaaattcatttcataatgaaa

SEQ ID NO: 1052278 - DNA, 22 bp, Artificial Sequence
  chemically synthesized
gaaattcatttcataatgaaat

SEQ ID NO: 1052279 - DNA, 22 bp, Artificial Sequence
  chemically synthesized
atttcataatgaaatataagta

SEQ ID NO: 1052280 - DNA, 22 bp, Artificial Sequence
  chemically synthesized
atgaaatccaaagcttacttat

SEQ ID NO: 1052281 - DNA, 22 bp, Artificial Sequence
  chemically synthesized
cataatgaaatataagtaagct

SEQ ID NO: 1052282 - DNA, 22 bp, Artificial Sequence
  chemically synthesized
ataatgaaatataagtaagctt

SEQ ID NO: 1052283 - DNA, 22 bp, Artificial Sequence
  chemically synthesized
aggttcatgaaatccaaagctt

SEQ ID NO: 1052284 - DNA, 22 bp, Artificial Sequence
  chemically synthesized
aaggttcatgaaatccaaagct

SEQ ID NO: 1052285 - DNA, 22 bp, Artificial Sequence
  chemically synthesized
taaggttcatgaaatccaaagc

SEQ ID NO: 1052286 - DNA, 22 bp, Artificial Sequence
  chemically synthesized
ttaaggttcatgaaatccaaag

SEQ ID NO: 1052287 - DNA, 22 bp, Artificial Sequence
  chemically synthesized
tttaaggttcatgaaatccaaa

SEQ ID NO: 1052288 - DNA, 22 bp, Artificial Sequence
  chemically synthesized
attttttaaggttcatgaaatc

SEQ ID NO: 1052289 - DNA, 22 bp, Artificial Sequence
  chemically synthesized
ccaaaattgattttttaaggtt

SEQ ID NO: 1052290 - DNA, 22 bp, Artificial Sequence
  chemically synthesized
tggatttcatgaaccttaaaaa

SEQ ID NO: 1052291 - DNA, 22 bp, Artificial Sequence
  chemically synthesized
ggatttcatgaaccttaaaaaa

SEQ ID NO: 1052292 - DNA, 22 bp, Artificial Sequence
  chemically synthesized
gatttcatgaaccttaaaaaat

SEQ ID NO: 1052293 - DNA, 22 bp, Artificial Sequence
  chemically synthesized
gattcccaaaattgatttttta

SEQ ID NO: 1052294 - DNA, 22 bp, Artificial Sequence
  chemically synthesized
tcgattcccaaaattgattttt

SEQ ID NO: 1052295 - DNA, 22 bp, Artificial Sequence
  chemically synthesized
catgaaccttaaaaaatcaatt

SEQ ID NO: 1052296 - DNA, 22 bp, Artificial Sequence
  chemically synthesized
atgaaccttaaaaaatcaattt

SEQ ID NO: 1052297 - DNA, 22 bp, Artificial Sequence
  chemically synthesized
aaaaaatcaattttgggaatcg

SEQ ID NO: 1052298 - DNA, 22 bp, Artificial Sequence
  chemically synthesized
aaaaatcaattttgggaatcga

SEQ ID NO: 1052299 - DNA, 22 bp, Artificial Sequence
  chemically synthesized
tgggaatcgagaggccttttgt

SEQ ID NO: 1052300 - DNA, 22 bp, Artificial Sequence
  chemically synthesized
gggaatcgagaggccttttgtt

SEQ ID NO: 1052301 - DNA, 22 bp, Artificial Sequence
  chemically synthesized
ggaatcgagaggccttttgttc

SEQ ID NO: 1052302 - DNA, 22 bp, Artificial Sequence
  chemically synthesized
ttgttctactccattcctgact

SEQ ID NO: 1052303 - DNA, 22 bp, Artificial Sequence
  chemically synthesized
tgttctactccattcctgactc

SEQ ID NO: 1052304 - DNA, 22 bp, Artificial Sequence
  chemically synthesized
caacacagccaagagtcaggaa

SEQ ID NO: 1052305 - DNA, 22 bp, Artificial Sequence
  chemically synthesized
gttctactccattcctgactct

SEQ ID NO: 1052306 - DNA, 22 bp, Artificial Sequence
  chemically synthesized
ttctactccattcctgactctt

SEQ ID NO: 1052307 - DNA, 22 bp, Artificial Sequence
  chemically synthesized
cctgcaacacagccaagagtca

SEQ ID NO: 1052308 - DNA, 22 bp, Artificial Sequence
  chemically synthesized
tactccattcctgactcttggc

SEQ ID NO: 1052309 - DNA, 22 bp, Artificial Sequence
  chemically synthesized
acctgcaacacagccaagagtc

SEQ ID NO: 1052310 - DNA, 22 bp, Artificial Sequence
  chemically synthesized
ctccattcctgactcttggctg

SEQ ID NO: 1052311 - DNA, 22 bp, Artificial Sequence
  chemically synthesized
atttacctgcaacacagccaag

SEQ ID NO: 1052312 - DNA, 22 bp, Artificial Sequence
  chemically synthesized
cattcctgactcttggctgtgt

SEQ ID NO: 1052313 - DNA, 22 bp, Artificial Sequence
  chemically synthesized
aatttacctgcaacacagccaa

SEQ ID NO: 1052314 - DNA, 22 bp, Artificial Sequence
  chemically synthesized
taatttacctgcaacacagcca

SEQ ID NO: 1052315 - DNA, 22 bp, Artificial Sequence
  chemically synthesized
ctgactcttggctgtgttgcag

SEQ ID NO: 1052316 - DNA, 22 bp, Artificial Sequence
  chemically synthesized
actcttggctgtgttgcaggta

SEQ ID NO: 1052317 - DNA, 22 bp, Artificial Sequence
  chemically synthesized
ttggctgtgttgcaggtaaatt

SEQ ID NO: 1052318 - DNA, 22 bp, Artificial Sequence
  chemically synthesized
ggctgtgttgcaggtaaattaa

SEQ ID NO: 1052319 - DNA, 22 bp, Artificial Sequence
  chemically synthesized
gctgtgttgcaggtaaattaaa

SEQ ID NO: 1052320 - DNA, 22 bp, Artificial Sequence
  chemically synthesized
tgttgcaggtaaattaaaatga

SEQ ID NO: 1052321 - DNA, 22 bp, Artificial Sequence
  chemically synthesized
agaggtcagatggatatcattt

SEQ ID NO: 1052322 - DNA, 22 bp, Artificial Sequence
  chemically synthesized
caggtaaattaaaatgatatcc

SEQ ID NO: 1052323 - DNA, 22 bp, Artificial Sequence
  chemically synthesized
ttcagaggtcagatggatatca

SEQ ID NO: 1052324 - DNA, 22 bp, Artificial Sequence
  chemically synthesized
attcagaggtcagatggatatc

SEQ ID NO: 1052325 - DNA, 22 bp, Artificial Sequence
  chemically synthesized
tttattcagaggtcagatggat

SEQ ID NO: 1052326 - DNA, 22 bp, Artificial Sequence
  chemically synthesized
atttattcagaggtcagatgga

SEQ ID NO: 1052327 - DNA, 22 bp, Artificial Sequence
  chemically synthesized
tatttattcagaggtcagatgg

SEQ ID NO: 1052328 - DNA, 22 bp, Artificial Sequence
  chemically synthesized
aaatgatatccatctgacctct

SEQ ID NO: 1052329 - DNA, 22 bp, Artificial Sequence
  chemically synthesized
tacacacagtggcactttattt

SEQ ID NO: 1052330 - DNA, 22 bp, Artificial Sequence
  chemically synthesized
acctctgaataaataaagtgcc

SEQ ID NO: 1052331 - DNA, 22 bp, Artificial Sequence
  chemically synthesized
tatacacacagtggcactttat

SEQ ID NO: 1052332 - DNA, 22 bp, Artificial Sequence
  chemically synthesized
ctatacacacagtggcacttta

SEQ ID NO: 1052333 - DNA, 22 bp, Artificial Sequence
  chemically synthesized
tgaataaataaagtgccactgt

SEQ ID NO: 1052334 - DNA, 22 bp, Artificial Sequence
  chemically synthesized
aataaataaagtgccactgtgt

SEQ ID NO: 1052335 - DNA, 22 bp, Artificial Sequence
  chemically synthesized
aatataaccatttctatacaca

SEQ ID NO: 1052336 - DNA, 22 bp, Artificial Sequence
  chemically synthesized
tgtgtatagaaatggttatatt

SEQ ID NO: 1052337 - DNA, 22 bp, Artificial Sequence
  chemically synthesized
ggaaaataatattaaatataac

SEQ ID NO: 1052338 - DNA, 22 bp, Artificial Sequence
  chemically synthesized
gggaaaataatattaaatataa

SEQ ID NO: 1052339 - DNA, 22 bp, Artificial Sequence
  chemically synthesized
tgggaaaataatattaaatata

SEQ ID NO: 1052340 - DNA, 22 bp, Artificial Sequence
  chemically synthesized
ttttgggaaaataatattaaat

SEQ ID NO: 1052341 - DNA, 22 bp, Artificial Sequence
  chemically synthesized
tatttaatattattttcccaaa

SEQ ID NO: 1052342 - DNA, 22 bp, Artificial Sequence
  chemically synthesized
gcaaaatatattattttgggaa

SEQ ID NO: 1052343 - DNA, 22 bp, Artificial Sequence
  chemically synthesized
aatattattttcccaaaataat

SEQ ID NO: 1052344 - DNA, 22 bp, Artificial Sequence
  chemically synthesized
atattattttcccaaaataata

SEQ ID NO: 1052345 - DNA, 22 bp, Artificial Sequence
  chemically synthesized
taacctggcaaaatatattatt

SEQ ID NO: 1052346 - DNA, 22 bp, Artificial Sequence
  chemically synthesized
ttttcccaaaataatatatttt

SEQ ID NO: 1052347 - DNA, 22 bp, Artificial Sequence
  chemically synthesized
tcccaaaataatatattttgcc

SEQ ID NO: 1052348 - DNA, 22 bp, Artificial Sequence
  chemically synthesized
cccaaaataatatattttgcca

SEQ ID NO: 1052349 - DNA, 22 bp, Artificial Sequence
  chemically synthesized
ccaaaataatatattttgccag

SEQ ID NO: 1052350 - DNA, 22 bp, Artificial Sequence
  chemically synthesized
caaagttataacctggcaaaat

SEQ ID NO: 1052351 - DNA, 22 bp, Artificial Sequence
  chemically synthesized
gcaaagttataacctggcaaaa

SEQ ID NO: 1052352 - DNA, 22 bp, Artificial Sequence
  chemically synthesized
tgcaaagttataacctggcaaa

SEQ ID NO: 1052353 - DNA, 22 bp, Artificial Sequence
  chemically synthesized
ccatattttgcaaagttataac

SEQ ID NO: 1052354 - DNA, 22 bp, Artificial Sequence
  chemically synthesized
ttaccatattttgcaaagttat

SEQ ID NO: 1052355 - DNA, 22 bp, Artificial Sequence
  chemically synthesized
tgccaggttataactttgcaaa

SEQ ID NO: 1052356 - DNA, 22 bp, Artificial Sequence
  chemically synthesized
gccaggttataactttgcaaaa

SEQ ID NO: 1052357 - DNA, 22 bp, Artificial Sequence
  chemically synthesized
ccaggttataactttgcaaaat

SEQ ID NO: 1052358 - DNA, 22 bp, Artificial Sequence
  chemically synthesized
agtgactattaccatattttgc

SEQ ID NO: 1052359 - DNA, 22 bp, Artificial Sequence
  chemically synthesized
cagtgactattaccatattttg

SEQ ID NO: 1052360 - DNA, 22 bp, Artificial Sequence
  chemically synthesized
ttcagtgactattaccatattt

SEQ ID NO: 1052361 - DNA, 22 bp, Artificial Sequence
  chemically synthesized
cttcagtgactattaccatatt

SEQ ID NO: 1052362 - DNA, 22 bp, Artificial Sequence
  chemically synthesized
taactttgcaaaatatggtaat

SEQ ID NO: 1052363 - DNA, 22 bp, Artificial Sequence
  chemically synthesized
tcttcagtgactattaccatat

SEQ ID NO: 1052364 - DNA, 22 bp, Artificial Sequence
  chemically synthesized
tgcaaaatatggtaatagtcac

SEQ ID NO: 1052365 - DNA, 22 bp, Artificial Sequence
  chemically synthesized
gcaaaatatggtaatagtcact

SEQ ID NO: 1052366 - DNA, 22 bp, Artificial Sequence
  chemically synthesized
caaaatatggtaatagtcactg

SEQ ID NO: 1052367 - DNA, 22 bp, Artificial Sequence
  chemically synthesized
gtaagagaaaaatggttttctt

SEQ ID NO: 1052368 - DNA, 22 bp, Artificial Sequence
  chemically synthesized
ggtaagagaaaaatggttttct

SEQ ID NO: 1052369 - DNA, 22 bp, Artificial Sequence
  chemically synthesized
tggtaagagaaaaatggttttc

SEQ ID NO: 1052370 - DNA, 22 bp, Artificial Sequence
  chemically synthesized
aagaaaaccatttttctcttac

SEQ ID NO: 1052371 - DNA, 22 bp, Artificial Sequence
  chemically synthesized
agcgtaatctttggtaagagaa

SEQ ID NO: 1052372 - DNA, 22 bp, Artificial Sequence
  chemically synthesized
aaaaagaattgagcgtaatctt

SEQ ID NO: 1052373 - DNA, 22 bp, Artificial Sequence
  chemically synthesized
ttctcttaccaaagattacgct

SEQ ID NO: 1052374 - DNA, 22 bp, Artificial Sequence
  chemically synthesized
aaaaaagaattgagcgtaatct

SEQ ID NO: 1052375 - DNA, 22 bp, Artificial Sequence
  chemically synthesized
tctcttaccaaagattacgctc

SEQ ID NO: 1052376 - DNA, 22 bp, Artificial Sequence
  chemically synthesized
taaaaaagaattgagcgtaatc

SEQ ID NO: 1052377 - DNA, 22 bp, Artificial Sequence
  chemically synthesized
ctcttaccaaagattacgctca

SEQ ID NO: 1052378 - DNA, 22 bp, Artificial Sequence
  chemically synthesized
ttaaaaaagaattgagcgtaat

SEQ ID NO: 1052379 - DNA, 22 bp, Artificial Sequence
  chemically synthesized
tcttaccaaagattacgctcaa

SEQ ID NO: 1052380 - DNA, 22 bp, Artificial Sequence
  chemically synthesized
ttaccaaagattacgctcaatt

SEQ ID NO: 1052381 - DNA, 22 bp, Artificial Sequence
  chemically synthesized
accaaagattacgctcaattct

SEQ ID NO: 1052382 - DNA, 22 bp, Artificial Sequence
  chemically synthesized
ccaaagattacgctcaattctt

SEQ ID NO: 1052383 - DNA, 22 bp, Artificial Sequence
  chemically synthesized
acaaaacttttaaaaaagaatt

SEQ ID NO: 1052384 - DNA, 22 bp, Artificial Sequence
  chemically synthesized
aattcacaaaacttttaaaaaa

SEQ ID NO: 1052385 - DNA, 22 bp, Artificial Sequence
  chemically synthesized
cgctcaattcttttttaaaagt

SEQ ID NO: 1052386 - DNA, 22 bp, Artificial Sequence
  chemically synthesized
aattcttttttaaaagttttgt

SEQ ID NO: 1052387 - DNA, 22 bp, Artificial Sequence
  chemically synthesized
aggtgtcattaaattcacaaaa

SEQ ID NO: 1052388 - DNA, 22 bp, Artificial Sequence
  chemically synthesized
ttttttaaaagttttgtgaatt

SEQ ID NO: 1052389 - DNA, 22 bp, Artificial Sequence
  chemically synthesized
ttttaaaagttttgtgaattta

SEQ ID NO: 1052390 - DNA, 22 bp, Artificial Sequence
  chemically synthesized
tttaaaagttttgtgaatttaa

SEQ ID NO: 1052391 - DNA, 22 bp, Artificial Sequence
  chemically synthesized
ttaaaagttttgtgaatttaat

SEQ ID NO: 1052392 - DNA, 22 bp, Artificial Sequence
  chemically synthesized
taaaagttttgtgaatttaatg

SEQ ID NO: 1052393 - DNA, 22 bp, Artificial Sequence
  chemically synthesized
agcctaaggtgtcattaaattc

SEQ ID NO: 1052394 - DNA, 22 bp, Artificial Sequence
  chemically synthesized
aaaagttttgtgaatttaatga

SEQ ID NO: 1052395 - DNA, 22 bp, Artificial Sequence
  chemically synthesized
aaagttttgtgaatttaatgac

SEQ ID NO: 1052396 - DNA, 22 bp, Artificial Sequence
  chemically synthesized
tgtgaatttaatgacaccttag

SEQ ID NO: 1052397 - DNA, 22 bp, Artificial Sequence
  chemically synthesized
gtgaatttaatgacaccttagg

SEQ ID NO: 1052398 - DNA, 22 bp, Artificial Sequence
  chemically synthesized
tgaatttaatgacaccttaggc

SEQ ID NO: 1052399 - DNA, 22 bp, Artificial Sequence
  chemically synthesized
taaagtagagcacattaagcct

SEQ ID NO: 1052400 - DNA, 22 bp, Artificial Sequence
  chemically synthesized
aatgacaccttaggcttaatgt

SEQ ID NO: 1052401 - DNA, 22 bp, Artificial Sequence
  chemically synthesized
atgacaccttaggcttaatgtg

SEQ ID NO: 1052402 - DNA, 22 bp, Artificial Sequence
  chemically synthesized
gattgtaaagtagagcacatta

SEQ ID NO: 1052403 - DNA, 22 bp, Artificial Sequence
  chemically synthesized
tctggattgtaaagtagagcac

SEQ ID NO: 1052404 - DNA, 22 bp, Artificial Sequence
  chemically synthesized
aggcttaatgtgctctacttta

SEQ ID NO: 1052405 - DNA, 22 bp, Artificial Sequence
  chemically synthesized
ggcttaatgtgctctactttac

SEQ ID NO: 1052406 - DNA, 22 bp, Artificial Sequence
  chemically synthesized
aatgtgctctactttacaatcc

SEQ ID NO: 1052407 - DNA, 22 bp, Artificial Sequence
  chemically synthesized
atgtgctctactttacaatcca

SEQ ID NO: 1052408 - DNA, 22 bp, Artificial Sequence
  chemically synthesized
ggagaaactatctggattgtaa

SEQ ID NO: 1052409 - DNA, 22 bp, Artificial Sequence
  chemically synthesized
aggagaaactatctggattgta

SEQ ID NO: 1052410 - DNA, 22 bp, Artificial Sequence
  chemically synthesized
taggagaaactatctggattgt

SEQ ID NO: 1052411 - DNA, 22 bp, Artificial Sequence
  chemically synthesized
ttttaggagaaactatctggat

SEQ ID NO: 1052412 - DNA, 22 bp, Artificial Sequence
  chemically synthesized
tactttacaatccagatagttt

SEQ ID NO: 1052413 - DNA, 22 bp, Artificial Sequence
  chemically synthesized
ctttacaatccagatagtttct

SEQ ID NO: 1052414 - DNA, 22 bp, Artificial Sequence
  chemically synthesized
tacaatccagatagtttctcct

SEQ ID NO: 1052415 - DNA, 22 bp, Artificial Sequence
  chemically synthesized
acaatccagatagtttctccta

SEQ ID NO: 1052416 - DNA, 22 bp, Artificial Sequence
  chemically synthesized
caatccagatagtttctcctaa

SEQ ID NO: 1052417 - DNA, 22 bp, Artificial Sequence
  chemically synthesized
acagagaacaagctattttagg

SEQ ID NO: 1052418 - DNA, 22 bp, Artificial Sequence
  chemically synthesized
gaacattgacagagaacaagct

SEQ ID NO: 1052419 - DNA, 22 bp, Artificial Sequence
  chemically synthesized
ctcctaaaatagcttgttctct

SEQ ID NO: 1052420 - DNA, 22 bp, Artificial Sequence
  chemically synthesized
tcctaaaatagcttgttctctg

SEQ ID NO: 1052421 - DNA, 22 bp, Artificial Sequence
  chemically synthesized
ctggaacattgacagagaacaa

SEQ ID NO: 1052422 - DNA, 22 bp, Artificial Sequence
  chemically synthesized
cctggaacattgacagagaaca

SEQ ID NO: 1052423 - DNA, 22 bp, Artificial Sequence
  chemically synthesized
ctaaaatagcttgttctctgtc

SEQ ID NO: 1052424 - DNA, 22 bp, Artificial Sequence
  chemically synthesized
tttcctggaacattgacagaga

SEQ ID NO: 1052425 - DNA, 22 bp, Artificial Sequence
  chemically synthesized
aaatagcttgttctctgtcaat

SEQ ID NO: 1052426 - DNA, 22 bp, Artificial Sequence
  chemically synthesized
ttatttcctggaacattgacag

SEQ ID NO: 1052427 - DNA, 22 bp, Artificial Sequence
  chemically synthesized
gttctctgtcaatgttccagga

SEQ ID NO: 1052428 - DNA, 22 bp, Artificial Sequence
  chemically synthesized
ttctctgtcaatgttccaggaa

SEQ ID NO: 1052429 - DNA, 22 bp, Artificial Sequence
  chemically synthesized
tctgtcaatgttccaggaaata

SEQ ID NO: 1052430 - DNA, 22 bp, Artificial Sequence
  chemically synthesized
tgtcaatgttccaggaaataat

SEQ ID NO: 1052431 - DNA, 22 bp, Artificial Sequence
  chemically synthesized
tcaatgttccaggaaataatag

SEQ ID NO: 1052432 - DNA, 22 bp, Artificial Sequence
  chemically synthesized
ccataggataatacaatgacta

SEQ ID NO: 1052433 - DNA, 22 bp, Artificial Sequence
  chemically synthesized
gccataggataatacaatgact

SEQ ID NO: 1052434 - DNA, 22 bp, Artificial Sequence
  chemically synthesized
caggaaataatagtcattgtat

SEQ ID NO: 1052435 - DNA, 22 bp, Artificial Sequence
  chemically synthesized
gaatccttgccataggataata

SEQ ID NO: 1052436 - DNA, 22 bp, Artificial Sequence
  chemically synthesized
tattggaatccttgccatagga

SEQ ID NO: 1052437 - DNA, 22 bp, Artificial Sequence
  chemically synthesized
atattggaatccttgccatagg

SEQ ID NO: 1052438 - DNA, 22 bp, Artificial Sequence
  chemically synthesized
tatattggaatccttgccatag

SEQ ID NO: 1052439 - DNA, 22 bp, Artificial Sequence
  chemically synthesized
tattatcctatggcaaggattc

SEQ ID NO: 1052440 - DNA, 22 bp, Artificial Sequence
  chemically synthesized
tcctatggcaaggattccaata

SEQ ID NO: 1052441 - DNA, 22 bp, Artificial Sequence
  chemically synthesized
tggcaaggattccaatataaaa

SEQ ID NO: 1052442 - DNA, 22 bp, Artificial Sequence
  chemically synthesized
gacagaatagaacaattttata

SEQ ID NO: 1052443 - DNA, 22 bp, Artificial Sequence
  chemically synthesized
tggacagaatagaacaatttta

SEQ ID NO: 1052444 - DNA, 22 bp, Artificial Sequence
  chemically synthesized
ctggacagaatagaacaatttt

SEQ ID NO: 1052445 - DNA, 22 bp, Artificial Sequence
  chemically synthesized
tctggacagaatagaacaattt

SEQ ID NO: 1052446 - DNA, 22 bp, Artificial Sequence
  chemically synthesized
caatataaaattgttctattct

SEQ ID NO: 1052447 - DNA, 22 bp, Artificial Sequence
  chemically synthesized
taaattttctggacagaataga

SEQ ID NO: 1052448 - DNA, 22 bp, Artificial Sequence
  chemically synthesized
gtaaattttctggacagaatag

SEQ ID NO: 1052449 - DNA, 22 bp, Artificial Sequence
  chemically synthesized
aaacttgtaaattttctggaca

SEQ ID NO: 1052450 - DNA, 22 bp, Artificial Sequence
  chemically synthesized
ttctattctgtccagaaaattt

SEQ ID NO: 1052451 - DNA, 22 bp, Artificial Sequence
  chemically synthesized
gagttaaaacttgtaaattttc

SEQ ID NO: 1052452 - DNA, 22 bp, Artificial Sequence
  chemically synthesized
tattctgtccagaaaatttaca

SEQ ID NO: 1052453 - DNA, 22 bp, Artificial Sequence
  chemically synthesized
agagttaaaacttgtaaatttt

SEQ ID NO: 1052454 - DNA, 22 bp, Artificial Sequence
  chemically synthesized
tagagttaaaacttgtaaattt

SEQ ID NO: 1052455 - DNA, 22 bp, Artificial Sequence
  chemically synthesized
ttctgtccagaaaatttacaag

SEQ ID NO: 1052456 - DNA, 22 bp, Artificial Sequence
  chemically synthesized
ttagagttaaaacttgtaaatt

SEQ ID NO: 1052457 - DNA, 22 bp, Artificial Sequence
  chemically synthesized
tgtccagaaaatttacaagttt

SEQ ID NO: 1052458 - DNA, 22 bp, Artificial Sequence
  chemically synthesized
tccagaaaatttacaagtttta

SEQ ID NO: 1052459 - DNA, 22 bp, Artificial Sequence
  chemically synthesized
tgtcaatatgagtttttagagt

SEQ ID NO: 1052460 - DNA, 22 bp, Artificial Sequence
  chemically synthesized
acaagttttaactctaaaaact

SEQ ID NO: 1052461 - DNA, 22 bp, Artificial Sequence
  chemically synthesized
caagttttaactctaaaaactc

SEQ ID NO: 1052462 - DNA, 22 bp, Artificial Sequence
  chemically synthesized
attgtgtcaatatgagttttta

SEQ ID NO: 1052463 - DNA, 22 bp, Artificial Sequence
  chemically synthesized
taactctaaaaactcatattga

SEQ ID NO: 1052464 - DNA, 22 bp, Artificial Sequence
  chemically synthesized
aactctaaaaactcatattgac

SEQ ID NO: 1052465 - DNA, 22 bp, Artificial Sequence
  chemically synthesized
actctaaaaactcatattgaca

SEQ ID NO: 1052466 - DNA, 22 bp, Artificial Sequence
  chemically synthesized
taaaaactcatattgacacaat

SEQ ID NO: 1052467 - DNA, 22 bp, Artificial Sequence
  chemically synthesized
aaaactcatattgacacaatca

SEQ ID NO: 1052468 - DNA, 22 bp, Artificial Sequence
  chemically synthesized
aaatggagtgaaaattgattgt

SEQ ID NO: 1052469 - DNA, 22 bp, Artificial Sequence
  chemically synthesized
atattgacacaatcaattttca

SEQ ID NO: 1052470 - DNA, 22 bp, Artificial Sequence
  chemically synthesized
acacaatcaattttcactccat

SEQ ID NO: 1052471 - DNA, 22 bp, Artificial Sequence
  chemically synthesized
aaaatatatgatctaaaatgga

SEQ ID NO: 1052472 - DNA, 22 bp, Artificial Sequence
  chemically synthesized
caaaatatatgatctaaaatgg

SEQ ID NO: 1052473 - DNA, 22 bp, Artificial Sequence
  chemically synthesized
tcaaaatatatgatctaaaatg

SEQ ID NO: 1052474 - DNA, 22 bp, Artificial Sequence
  chemically synthesized
ttcaaaatatatgatctaaaat

SEQ ID NO: 1052475 - DNA, 22 bp, Artificial Sequence
  chemically synthesized
ccttttcaaaatatatgatcta

SEQ ID NO: 1052476 - DNA, 22 bp, Artificial Sequence
  chemically synthesized
tcactccattttagatcatata

SEQ ID NO: 1052477 - DNA, 22 bp, Artificial Sequence
  chemically synthesized
cactccattttagatcatatat

SEQ ID NO: 1052478 - DNA, 22 bp, Artificial Sequence
  chemically synthesized
actccattttagatcatatatt

SEQ ID NO: 1052479 - DNA, 22 bp, Artificial Sequence
  chemically synthesized
attaccttttcaaaatatatga

SEQ ID NO: 1052480 - DNA, 22 bp, Artificial Sequence
  chemically synthesized
cattttagatcatatattttga

SEQ ID NO: 1052481 - DNA, 22 bp, Artificial Sequence
  chemically synthesized
agttaattaccttttcaaaata

SEQ ID NO: 1052482 - DNA, 22 bp, Artificial Sequence
  chemically synthesized
tcagttaattaccttttcaaaa

SEQ ID NO: 1052483 - DNA, 22 bp, Artificial Sequence
  chemically synthesized
tagatcatatattttgaaaagg

SEQ ID NO: 1052484 - DNA, 22 bp, Artificial Sequence
  chemically synthesized
agatcatatattttgaaaaggt

SEQ ID NO: 1052485 - DNA, 22 bp, Artificial Sequence
  chemically synthesized
gatcatatattttgaaaaggta

SEQ ID NO: 1052486 - DNA, 22 bp, Artificial Sequence
  chemically synthesized
tgaaaaggtaattaactgagaa

SEQ ID NO: 1052487 - DNA, 22 bp, Artificial Sequence
  chemically synthesized
gaaaaggtaattaactgagaac

SEQ ID NO: 1052488 - DNA, 22 bp, Artificial Sequence
  chemically synthesized
aaaaggtaattaactgagaact

SEQ ID NO: 1052489 - DNA, 22 bp, Artificial Sequence
  chemically synthesized
tggggaggaacagtcatatcca

SEQ ID NO: 1052490 - DNA, 22 bp, Artificial Sequence
  chemically synthesized
actgagaacttggatatgactg

SEQ ID NO: 1052491 - DNA, 22 bp, Artificial Sequence
  chemically synthesized
agaacttggatatgactgttcc

SEQ ID NO: 1052492 - DNA, 22 bp, Artificial Sequence
  chemically synthesized
caaggagattgtggggaggaac

SEQ ID NO: 1052493 - DNA, 22 bp, Artificial Sequence
  chemically synthesized
acaaggagattgtggggaggaa

SEQ ID NO: 1052494 - DNA, 22 bp, Artificial Sequence
  chemically synthesized
ggatatgactgttcctccccac

SEQ ID NO: 1052495 - DNA, 22 bp, Artificial Sequence
  chemically synthesized
tacaaggagattgtggggagga

SEQ ID NO: 1052496 - DNA, 22 bp, Artificial Sequence
  chemically synthesized
gatatgactgttcctccccaca

SEQ ID NO: 1052497 - DNA, 22 bp, Artificial Sequence
  chemically synthesized
ttacaaggagattgtggggagg

SEQ ID NO: 1052498 - DNA, 22 bp, Artificial Sequence
  chemically synthesized
cttttacaaggagattgtgggg

SEQ ID NO: 1052499 - DNA, 22 bp, Artificial Sequence
  chemically synthesized
tagctgcttttacaaggagatt

SEQ ID NO: 1052500 - DNA, 22 bp, Artificial Sequence
  chemically synthesized
ttcctccccacaatctccttgt

SEQ ID NO: 1052501 - DNA, 22 bp, Artificial Sequence
  chemically synthesized
ttgtagctgcttttacaaggag

SEQ ID NO: 1052502 - DNA, 22 bp, Artificial Sequence
  chemically synthesized
ctccccacaatctccttgtaaa

SEQ ID NO: 1052503 - DNA, 22 bp, Artificial Sequence
  chemically synthesized
tgttgtagctgcttttacaagg

SEQ ID NO: 1052504 - DNA, 22 bp, Artificial Sequence
  chemically synthesized
ctgttgtagctgcttttacaag

SEQ ID NO: 1052505 - DNA, 22 bp, Artificial Sequence
  chemically synthesized
cccacaatctccttgtaaaagc

SEQ ID NO: 1052506 - DNA, 22 bp, Artificial Sequence
  chemically synthesized
tttctgttgtagctgcttttac

SEQ ID NO: 1052507 - DNA, 22 bp, Artificial Sequence
  chemically synthesized
atttctgttgtagctgctttta

SEQ ID NO: 1052508 - DNA, 22 bp, Artificial Sequence
  chemically synthesized
tatttctgttgtagctgctttt

SEQ ID NO: 1052509 - DNA, 22 bp, Artificial Sequence
  chemically synthesized
cttgtaaaagcagctacaacag

SEQ ID NO: 1052510 - DNA, 22 bp, Artificial Sequence
  chemically synthesized
gtaaaagcagctacaacagaaa

SEQ ID NO: 1052511 - DNA, 22 bp, Artificial Sequence
  chemically synthesized
taaaagcagctacaacagaaat

SEQ ID NO: 1052512 - DNA, 22 bp, Artificial Sequence
  chemically synthesized
gtaaaatactttatttctgttg

SEQ ID NO: 1052513 - DNA, 22 bp, Artificial Sequence
  chemically synthesized
ggtaaaatactttatttctgtt

SEQ ID NO: 1052514 - DNA, 22 bp, Artificial Sequence
  chemically synthesized
tttggtaaaatactttatttct

SEQ ID NO: 1052515 - DNA, 22 bp, Artificial Sequence
  chemically synthesized
atttggtaaaatactttatttc

SEQ ID NO: 1052516 - DNA, 22 bp, Artificial Sequence
  chemically synthesized
tatttggtaaaatactttattt

SEQ ID NO: 1052517 - DNA, 22 bp, Artificial Sequence
  chemically synthesized
ttatttggtaaaatactttatt

SEQ ID NO: 1052518 - DNA, 22 bp, Artificial Sequence
  chemically synthesized
tttatttggtaaaatactttat

SEQ ID NO: 1052519 - DNA, 22 bp, Artificial Sequence
  chemically synthesized
ttttttatttggtaaaatactt

SEQ ID NO: 1052520 - DNA, 22 bp, Artificial Sequence
  chemically synthesized
caacagaaataaagtattttac

SEQ ID NO: 1052521 - DNA, 22 bp, Artificial Sequence
  chemically synthesized
attttttatttggtaaaatact

SEQ ID NO: 1052522 - DNA, 22 bp, Artificial Sequence
  chemically synthesized
agaagtgaaaaaaaatttattt

SEQ ID NO: 1052523 - DNA, 22 bp, Artificial Sequence
  chemically synthesized
taccaaataaaaaataaatttt

SEQ ID NO: 1052524 - DNA, 22 bp, Artificial Sequence
  chemically synthesized
gagaagtgaaaaaaaatttatt

SEQ ID NO: 1052525 - DNA, 22 bp, Artificial Sequence
  chemically synthesized
accaaataaaaaataaattttt

SEQ ID NO: 1052526 - DNA, 22 bp, Artificial Sequence
  chemically synthesized
tgagaagtgaaaaaaaatttat

SEQ ID NO: 1052527 - DNA, 22 bp, Artificial Sequence
  chemically synthesized
ccaaataaaaaataaatttttt

SEQ ID NO: 1052528 - DNA, 22 bp, Artificial Sequence
  chemically synthesized
aaaagttttgagaagtgaaaaa

SEQ ID NO: 1052529 - DNA, 22 bp, Artificial Sequence
  chemically synthesized
tgaaaagttttgagaagtgaaa

SEQ ID NO: 1052530 - DNA, 22 bp, Artificial Sequence
  chemically synthesized
tattctgaaaagttttgagaag

SEQ ID NO: 1052531 - DNA, 22 bp, Artificial Sequence
  chemically synthesized
gtattctgaaaagttttgagaa

SEQ ID NO: 1052532 - DNA, 22 bp, Artificial Sequence
  chemically synthesized
tttttcacttctcaaaactttt

SEQ ID NO: 1052533 - DNA, 22 bp, Artificial Sequence
  chemically synthesized
ttttcacttctcaaaacttttc

SEQ ID NO: 1052534 - DNA, 22 bp, Artificial Sequence
  chemically synthesized
aatttgtattctgaaaagtttt

SEQ ID NO: 1052535 - DNA, 22 bp, Artificial Sequence
  chemically synthesized
tttcacttctcaaaacttttca

SEQ ID NO: 1052536 - DNA, 22 bp, Artificial Sequence
  chemically synthesized
ttcacttctcaaaacttttcag

SEQ ID NO: 1052537 - DNA, 22 bp, Artificial Sequence
  chemically synthesized
tcacttctcaaaacttttcaga

SEQ ID NO: 1052538 - DNA, 22 bp, Artificial Sequence
  chemically synthesized
cacttctcaaaacttttcagaa

SEQ ID NO: 1052539 - DNA, 22 bp, Artificial Sequence
  chemically synthesized
acttctcaaaacttttcagaat

SEQ ID NO: 1052540 - DNA, 22 bp, Artificial Sequence
  chemically synthesized
ctcaaaacttttcagaatacaa

SEQ ID NO: 1052541 - DNA, 22 bp, Artificial Sequence
  chemically synthesized
tcaaaacttttcagaatacaaa

SEQ ID NO: 1052542 - DNA, 22 bp, Artificial Sequence
  chemically synthesized
aaaacttttcagaatacaaatt

SEQ ID NO: 1052543 - DNA, 22 bp, Artificial Sequence
  chemically synthesized
ttcagaatacaaatttaattgg

SEQ ID NO: 1052544 - DNA, 22 bp, Artificial Sequence
  chemically synthesized
tcagaatacaaatttaattggc

SEQ ID NO: 1052545 - DNA, 22 bp, Artificial Sequence
  chemically synthesized
gatataatataagccaattaaa

SEQ ID NO: 1052546 - DNA, 22 bp, Artificial Sequence
  chemically synthesized
cagaatacaaatttaattggct

SEQ ID NO: 1052547 - DNA, 22 bp, Artificial Sequence
  chemically synthesized
agaatacaaatttaattggctt

SEQ ID NO: 1052548 - DNA, 22 bp, Artificial Sequence
  chemically synthesized
gtctggatataatataagccaa

SEQ ID NO: 1052549 - DNA, 22 bp, Artificial Sequence
  chemically synthesized
aattggcttatattatatccag

SEQ ID NO: 1052550 - DNA, 22 bp, Artificial Sequence
  chemically synthesized
attggcttatattatatccaga

SEQ ID NO: 1052551 - DNA, 22 bp, Artificial Sequence
  chemically synthesized
agaaataattggtctggatata

SEQ ID NO: 1052552 - DNA, 22 bp, Artificial Sequence
  chemically synthesized
aagaaataattggtctggatat

SEQ ID NO: 1052553 - DNA, 22 bp, Artificial Sequence
  chemically synthesized
gcttatattatatccagaccaa

SEQ ID NO: 1052554 - DNA, 22 bp, Artificial Sequence
  chemically synthesized
tttaagaaataattggtctgga

SEQ ID NO: 1052555 - DNA, 22 bp, Artificial Sequence
  chemically synthesized
ttatttaagaaataattggtct

SEQ ID NO: 1052556 - DNA, 22 bp, Artificial Sequence
  chemically synthesized
atattatatccagaccaattat

SEQ ID NO: 1052557 - DNA, 22 bp, Artificial Sequence
  chemically synthesized
tattatatccagaccaattatt

SEQ ID NO: 1052558 - DNA, 22 bp, Artificial Sequence
  chemically synthesized
attattatttaagaaataattg

SEQ ID NO: 1052559 - DNA, 22 bp, Artificial Sequence
  chemically synthesized
tatccagaccaattatttctta

SEQ ID NO: 1052560 - DNA, 22 bp, Artificial Sequence
  chemically synthesized
gttaattattatttaagaaata

SEQ ID NO: 1052561 - DNA, 22 bp, Artificial Sequence
  chemically synthesized
agttaattattatttaagaaat

SEQ ID NO: 1052562 - DNA, 22 bp, Artificial Sequence
  chemically synthesized
tagttaattattatttaagaaa

SEQ ID NO: 1052563 - DNA, 22 bp, Artificial Sequence
  chemically synthesized
atcattttagttaattattatt

SEQ ID NO: 1052564 - DNA, 22 bp, Artificial Sequence
  chemically synthesized
tttcttaaataataattaacta

SEQ ID NO: 1052565 - DNA, 22 bp, Artificial Sequence
  chemically synthesized
acgttcatcattttagttaatt

SEQ ID NO: 1052566 - DNA, 22 bp, Artificial Sequence
  chemically synthesized
cttaaataataattaactaaaa

SEQ ID NO: 1052567 - DNA, 22 bp, Artificial Sequence
  chemically synthesized
taacgttcatcattttagttaa

SEQ ID NO: 1052568 - DNA, 22 bp, Artificial Sequence
  chemically synthesized
ttaaataataattaactaaaat

SEQ ID NO: 1052569 - DNA, 22 bp, Artificial Sequence
  chemically synthesized
aaataataattaactaaaatga

SEQ ID NO: 1052570 - DNA, 22 bp, Artificial Sequence
  chemically synthesized
aataataattaactaaaatgat

SEQ ID NO: 1052571 - DNA, 22 bp, Artificial Sequence
  chemically synthesized
acaaaagactctaacgttcatc

SEQ ID NO: 1052572 - DNA, 22 bp, Artificial Sequence
  chemically synthesized
actaaaatgatgaacgttagag

SEQ ID NO: 1052573 - DNA, 22 bp, Artificial Sequence
  chemically synthesized
tgattgacaaaagactctaacg

SEQ ID NO: 1052574 - DNA, 22 bp, Artificial Sequence
  chemically synthesized
gtgattgacaaaagactctaac

SEQ ID NO: 1052575 - DNA, 22 bp, Artificial Sequence
  chemically synthesized
aaatgatgaacgttagagtctt

SEQ ID NO: 1052576 - DNA, 22 bp, Artificial Sequence
  chemically synthesized
tttgtgattgacaaaagactct

SEQ ID NO: 1052577 - DNA, 22 bp, Artificial Sequence
  chemically synthesized
acataattatttgtgattgaca

SEQ ID NO: 1052578 - DNA, 22 bp, Artificial Sequence
  chemically synthesized
gagtcttttgtcaatcacaaat

SEQ ID NO: 1052579 - DNA, 22 bp, Artificial Sequence
  chemically synthesized
ataattaacataattatttgtg

SEQ ID NO: 1052580 - DNA, 22 bp, Artificial Sequence
  chemically synthesized
ttgtcaatcacaaataattatg

SEQ ID NO: 1052581 - DNA, 22 bp, Artificial Sequence
  chemically synthesized
tgtcaatcacaaataattatgt

SEQ ID NO: 1052582 - DNA, 22 bp, Artificial Sequence
  chemically synthesized
gtcaatcacaaataattatgtt

SEQ ID NO: 1052583 - DNA, 22 bp, Artificial Sequence
  chemically synthesized
tcaatcacaaataattatgtta

SEQ ID NO: 1052584 - DNA, 22 bp, Artificial Sequence
  chemically synthesized
ccagtgatcataatgactaata

SEQ ID NO: 1052585 - DNA, 22 bp, Artificial Sequence
  chemically synthesized
cccagtgatcataatgactaat

SEQ ID NO: 1052586 - DNA, 22 bp, Artificial Sequence
  chemically synthesized
tttcccagtgatcataatgact

SEQ ID NO: 1052587 - DNA, 22 bp, Artificial Sequence
  chemically synthesized
tgttaattattagtcattatga

SEQ ID NO: 1052588 - DNA, 22 bp, Artificial Sequence
  chemically synthesized
atttcccagtgatcataatgac

SEQ ID NO: 1052589 - DNA, 22 bp, Artificial Sequence
  chemically synthesized
tatttcccagtgatcataatga

SEQ ID NO: 1052590 - DNA, 22 bp, Artificial Sequence
  chemically synthesized
tttatttcccagtgatcataat

SEQ ID NO: 1052591 - DNA, 22 bp, Artificial Sequence
  chemically synthesized
attattagtcattatgatcact

SEQ ID NO: 1052592 - DNA, 22 bp, Artificial Sequence
  chemically synthesized
ttagtcattatgatcactggga

SEQ ID NO: 1052593 - DNA, 22 bp, Artificial Sequence
  chemically synthesized
acattctttatttcccagtgat

SEQ ID NO: 1052594 - DNA, 22 bp, Artificial Sequence
  chemically synthesized
cacattctttatttcccagtga

SEQ ID NO: 1052595 - DNA, 22 bp, Artificial Sequence
  chemically synthesized
tcacattctttatttcccagtg

SEQ ID NO: 1052596 - DNA, 22 bp, Artificial Sequence
  chemically synthesized
gtcattatgatcactgggaaat

SEQ ID NO: 1052597 - DNA, 22 bp, Artificial Sequence
  chemically synthesized
ttcacattctttatttcccagt

SEQ ID NO: 1052598 - DNA, 22 bp, Artificial Sequence
  chemically synthesized
tttcacattctttatttcccag

SEQ ID NO: 1052599 - DNA, 22 bp, Artificial Sequence
  chemically synthesized
ttttcacattctttatttccca

SEQ ID NO: 1052600 - DNA, 22 bp, Artificial Sequence
  chemically synthesized
tgatcactgggaaataaagaat

SEQ ID NO: 1052601 - DNA, 22 bp, Artificial Sequence
  chemically synthesized
tgcatgcttttttcacattctt

SEQ ID NO: 1052602 - DNA, 22 bp, Artificial Sequence
  chemically synthesized
ttatgcatgcttttttcacatt

SEQ ID NO: 1052603 - DNA, 22 bp, Artificial Sequence
  chemically synthesized
ggaaataaagaatgtgaaaaaa

SEQ ID NO: 1052604 - DNA, 22 bp, Artificial Sequence
  chemically synthesized
atgttattatgcatgctttttt

SEQ ID NO: 1052605 - DNA, 22 bp, Artificial Sequence
  chemically synthesized
acaaaatgcgttaatgttatta

SEQ ID NO: 1052606 - DNA, 22 bp, Artificial Sequence
  chemically synthesized
aacaaaatgcgttaatgttatt

SEQ ID NO: 1052607 - DNA, 22 bp, Artificial Sequence
  chemically synthesized
acgcattttgttaagtttttga

SEQ ID NO: 1052608 - DNA, 22 bp, Artificial Sequence
  chemically synthesized
taaacaatgcatcaagatcaaa

SEQ ID NO: 1052609 - DNA, 22 bp, Artificial Sequence
  chemically synthesized
tgttaagtttttgatcttgatg

SEQ ID NO: 1052610 - DNA, 22 bp, Artificial Sequence
  chemically synthesized
gttaagtttttgatcttgatgc

SEQ ID NO: 1052611 - DNA, 22 bp, Artificial Sequence
  chemically synthesized
ttaagtttttgatcttgatgca

SEQ ID NO: 1052612 - DNA, 22 bp, Artificial Sequence
  chemically synthesized
ataattgtaaacaatgcatcaa

SEQ ID NO: 1052613 - DNA, 22 bp, Artificial Sequence
  chemically synthesized
agtttttgatcttgatgcattg

SEQ ID NO: 1052614 - DNA, 22 bp, Artificial Sequence
  chemically synthesized
cataattgtaaacaatgcatca

SEQ ID NO: 1052615 - DNA, 22 bp, Artificial Sequence
  chemically synthesized
tcataattgtaaacaatgcatc

SEQ ID NO: 1052616 - DNA, 22 bp, Artificial Sequence
  chemically synthesized
ttcataattgtaaacaatgcat

SEQ ID NO: 1052617 - DNA, 22 bp, Artificial Sequence
  chemically synthesized
ttgatcttgatgcattgtttac

SEQ ID NO: 1052618 - DNA, 22 bp, Artificial Sequence
  chemically synthesized
tgatcttgatgcattgtttaca

SEQ ID NO: 1052619 - DNA, 22 bp, Artificial Sequence
  chemically synthesized
gatcttgatgcattgtttacaa

SEQ ID NO: 1052620 - DNA, 22 bp, Artificial Sequence
  chemically synthesized
tccttttcataattgtaaacaa

SEQ ID NO: 1052621 - DNA, 22 bp, Artificial Sequence
  chemically synthesized
atcttgatgcattgtttacaat

SEQ ID NO: 1052622 - DNA, 22 bp, Artificial Sequence
  chemically synthesized
tgtccttttcataattgtaaac

SEQ ID NO: 1052623 - DNA, 22 bp, Artificial Sequence
  chemically synthesized
ctgtccttttcataattgtaaa

SEQ ID NO: 1052624 - DNA, 22 bp, Artificial Sequence
  chemically synthesized
tctgtccttttcataattgtaa

SEQ ID NO: 1052625 - DNA, 22 bp, Artificial Sequence
  chemically synthesized
gatgcattgtttacaattatga

SEQ ID NO: 1052626 - DNA, 22 bp, Artificial Sequence
  chemically synthesized
atgcattgtttacaattatgaa

SEQ ID NO: 1052627 - DNA, 22 bp, Artificial Sequence
  chemically synthesized
cattttctgtccttttcataat

SEQ ID NO: 1052628 - DNA, 22 bp, Artificial Sequence
  chemically synthesized
tttacaattatgaaaaggacag

SEQ ID NO: 1052629 - DNA, 22 bp, Artificial Sequence
  chemically synthesized
acaattatgaaaaggacagaaa

SEQ ID NO: 1052630 - DNA, 22 bp, Artificial Sequence
  chemically synthesized
caattatgaaaaggacagaaaa

SEQ ID NO: 1052631 - DNA, 22 bp, Artificial Sequence
  chemically synthesized
aaaacagaagtattacattttc

SEQ ID NO: 1052632 - DNA, 22 bp, Artificial Sequence
  chemically synthesized
tgaaaaggacagaaaatgtaat

SEQ ID NO: 1052633 - DNA, 22 bp, Artificial Sequence
  chemically synthesized
attcaaaacagaagtattacat

SEQ ID NO: 1052634 - DNA, 22 bp, Artificial Sequence
  chemically synthesized
gaatccaaaaattaattcaaaa

SEQ ID NO: 1052635 - DNA, 22 bp, Artificial Sequence
  chemically synthesized
ggaatccaaaaattaattcaaa

SEQ ID NO: 1052636 - DNA, 22 bp, Artificial Sequence
  chemically synthesized
ctgttttgaattaatttttgga

SEQ ID NO: 1052637 - DNA, 22 bp, Artificial Sequence
  chemically synthesized
tgttttgaattaatttttggat

SEQ ID NO: 1052638 - DNA, 22 bp, Artificial Sequence
  chemically synthesized
atgatatttggaatccaaaaat

SEQ ID NO: 1052639 - DNA, 22 bp, Artificial Sequence
  chemically synthesized
ttttgaattaatttttggattc

SEQ ID NO: 1052640 - DNA, 22 bp, Artificial Sequence
  chemically synthesized
ctgatgatatttggaatccaaa

SEQ ID NO: 1052641 - DNA, 22 bp, Artificial Sequence
  chemically synthesized
cctgatgatatttggaatccaa

SEQ ID NO: 1052642 - DNA, 22 bp, Artificial Sequence
  chemically synthesized
tgaattaatttttggattccaa

SEQ ID NO: 1052643 - DNA, 22 bp, Artificial Sequence
  chemically synthesized
gaattaatttttggattccaaa

SEQ ID NO: 1052644 - DNA, 22 bp, Artificial Sequence
  chemically synthesized
aattaatttttggattccaaat

SEQ ID NO: 1052645 - DNA, 22 bp, Artificial Sequence
  chemically synthesized
atttttggattccaaatatcat

SEQ ID NO: 1052646 - DNA, 22 bp, Artificial Sequence
  chemically synthesized
ttggattccaaatatcatcagg

SEQ ID NO: 1052647 - DNA, 22 bp, Artificial Sequence
  chemically synthesized
tggattccaaatatcatcagga

SEQ ID NO: 1052648 - DNA, 22 bp, Artificial Sequence
  chemically synthesized
ggattccaaatatcatcaggaa

SEQ ID NO: 1052649 - DNA, 22 bp, Artificial Sequence
  chemically synthesized
gattccaaatatcatcaggaaa

SEQ ID NO: 1052650 - DNA, 22 bp, Artificial Sequence
  chemically synthesized
ataatagtatcatttcctgatg

SEQ ID NO: 1052651 - DNA, 22 bp, Artificial Sequence
  chemically synthesized
caaatatcatcaggaaatgata

SEQ ID NO: 1052652 - DNA, 22 bp, Artificial Sequence
  chemically synthesized
gtgatataaagaactcataata

SEQ ID NO: 1052653 - DNA, 22 bp, Artificial Sequence
  chemically synthesized
ggtgatataaagaactcataat

SEQ ID NO: 1052654 - DNA, 22 bp, Artificial Sequence
  chemically synthesized
tggtgatataaagaactcataa

SEQ ID NO: 1052655 - DNA, 22 bp, Artificial Sequence
  chemically synthesized
ttttggtgatataaagaactca

SEQ ID NO: 1052656 - DNA, 22 bp, Artificial Sequence
  chemically synthesized
gttttggtgatataaagaactc

SEQ ID NO: 1052657 - DNA, 22 bp, Artificial Sequence
  chemically synthesized
tttgttttggtgatataaagaa

SEQ ID NO: 1052658 - DNA, 22 bp, Artificial Sequence
  chemically synthesized
gtttgttttggtgatataaaga

SEQ ID NO: 1052659 - DNA, 22 bp, Artificial Sequence
  chemically synthesized
tgtttgttttggtgatataaag

SEQ ID NO: 1052660 - DNA, 22 bp, Artificial Sequence
  chemically synthesized
ttgtttgttttggtgatataaa

SEQ ID NO: 1052661 - DNA, 22 bp, Artificial Sequence
  chemically synthesized
ttatgagttctttatatcacca

SEQ ID NO: 1052662 - DNA, 22 bp, Artificial Sequence
  chemically synthesized
tttttgtttgttttggtgatat

SEQ ID NO: 1052663 - DNA, 22 bp, Artificial Sequence
  chemically synthesized
tgagttctttatatcaccaaaa

SEQ ID NO: 1052664 - DNA, 22 bp, Artificial Sequence
  chemically synthesized
aatctgtttttgtttgttttgg

SEQ ID NO: 1052665 - DNA, 22 bp, Artificial Sequence
  chemically synthesized
gaatctgtttttgtttgttttg

SEQ ID NO: 1052666 - DNA, 22 bp, Artificial Sequence
  chemically synthesized
tttatatcaccaaaacaaacaa

SEQ ID NO: 1052667 - DNA, 22 bp, Artificial Sequence
  chemically synthesized
tatatcaccaaaacaaacaaaa

SEQ ID NO: 1052668 - DNA, 22 bp, Artificial Sequence
  chemically synthesized
atatcaccaaaacaaacaaaaa

SEQ ID NO: 1052669 - DNA, 22 bp, Artificial Sequence
  chemically synthesized
gatttgaatctgtttttgtttg

SEQ ID NO: 1052670 - DNA, 22 bp, Artificial Sequence
  chemically synthesized
tatcaccaaaacaaacaaaaac

SEQ ID NO: 1052671 - DNA, 22 bp, Artificial Sequence
  chemically synthesized
tggatttgaatctgtttttgtt

SEQ ID NO: 1052672 - DNA, 22 bp, Artificial Sequence
  chemically synthesized
atcctctggatttgaatctgtt

SEQ ID NO: 1052673 - DNA, 22 bp, Artificial Sequence
  chemically synthesized
catcctctggatttgaatctgt

SEQ ID NO: 1052674 - DNA, 22 bp, Artificial Sequence
  chemically synthesized
tcatcctctggatttgaatctg

SEQ ID NO: 1052675 - DNA, 22 bp, Artificial Sequence
  chemically synthesized
tgtataaatattttcatcctct

SEQ ID NO: 1052676 - DNA, 22 bp, Artificial Sequence
  chemically synthesized
gtgtataaatattttcatcctc

SEQ ID NO: 1052677 - DNA, 22 bp, Artificial Sequence
  chemically synthesized
ttgtgtataaatattttcatcc

SEQ ID NO: 1052678 - DNA, 22 bp, Artificial Sequence
  chemically synthesized
cttgtgtataaatattttcatc

SEQ ID NO: 1052679 - DNA, 22 bp, Artificial Sequence
  chemically synthesized
tcttgtgtataaatattttcat

SEQ ID NO: 1052680 - DNA, 22 bp, Artificial Sequence
  chemically synthesized
aaatccagaggatgaaaatatt

SEQ ID NO: 1052681 - DNA, 22 bp, Artificial Sequence
  chemically synthesized
atacacaagaaaataccatttt

SEQ ID NO: 1052682 - DNA, 22 bp, Artificial Sequence
  chemically synthesized
tacacaagaaaataccattttg

SEQ ID NO: 1052683 - DNA, 22 bp, Artificial Sequence
  chemically synthesized
caaataataaaggtaccaaaat

SEQ ID NO: 1052684 - DNA, 22 bp, Artificial Sequence
  chemically synthesized
acaaataataaaggtaccaaaa

SEQ ID NO: 1052685 - DNA, 22 bp, Artificial Sequence
  chemically synthesized
acacttacaaataataaaggta

SEQ ID NO: 1052686 - DNA, 22 bp, Artificial Sequence
  chemically synthesized
aacgttaacacttacaaataat

SEQ ID NO: 1052687 - DNA, 22 bp, Artificial Sequence
  chemically synthesized
tggtacctttattatttgtaag

SEQ ID NO: 1052688 - DNA, 22 bp, Artificial Sequence
  chemically synthesized
ggtacctttattatttgtaagt

SEQ ID NO: 1052689 - DNA, 22 bp, Artificial Sequence
  chemically synthesized
ttcaacgttaacacttacaaat

SEQ ID NO: 1052690 - DNA, 22 bp, Artificial Sequence
  chemically synthesized
gtacctttattatttgtaagtg

SEQ ID NO: 1052691 - DNA, 22 bp, Artificial Sequence
  chemically synthesized
acattgttcaacgttaacactt

SEQ ID NO: 1052692 - DNA, 22 bp, Artificial Sequence
  chemically synthesized
tattatttgtaagtgttaacgt

SEQ ID NO: 1052693 - DNA, 22 bp, Artificial Sequence
  chemically synthesized
attatttgtaagtgttaacgtt

SEQ ID NO: 1052694 - DNA, 22 bp, Artificial Sequence
  chemically synthesized
ttatttgtaagtgttaacgttg

SEQ ID NO: 1052695 - DNA, 22 bp, Artificial Sequence
  chemically synthesized
tctaacattgttcaacgttaac

SEQ ID NO: 1052696 - DNA, 22 bp, Artificial Sequence
  chemically synthesized
gtctaacattgttcaacgttaa

SEQ ID NO: 1052697 - DNA, 22 bp, Artificial Sequence
  chemically synthesized
tttgtaagtgttaacgttgaac

SEQ ID NO: 1052698 - DNA, 22 bp, Artificial Sequence
  chemically synthesized
gtaagtgttaacgttgaacaat

SEQ ID NO: 1052699 - DNA, 22 bp, Artificial Sequence
  chemically synthesized
taagtgttaacgttgaacaatg

SEQ ID NO: 1052700 - DNA, 22 bp, Artificial Sequence
  chemically synthesized
acgttgaacaatgttagacaaa

SEQ ID NO: 1052701 - DNA, 22 bp, Artificial Sequence
  chemically synthesized
gggtatcacgacatttgtctaa

SEQ ID NO: 1052702 - DNA, 22 bp, Artificial Sequence
  chemically synthesized
aacaatgttagacaaatgtcgt

SEQ ID NO: 1052703 - DNA, 22 bp, Artificial Sequence
  chemically synthesized
gacaaatgtcgtgataccctaa

SEQ ID NO: 1052704 - DNA, 22 bp, Artificial Sequence
  chemically synthesized
attctactcttttttgtgtatt

SEQ ID NO: 1052705 - DNA, 22 bp, Artificial Sequence
  chemically synthesized
tactcttttttgtgtattttgt

SEQ ID NO: 1052706 - DNA, 22 bp, Artificial Sequence
  chemically synthesized
ctcttttttgtgtattttgtct

SEQ ID NO: 1052707 - DNA, 22 bp, Artificial Sequence
  chemically synthesized
ttttttgtgtattttgtcttgt

SEQ ID NO: 1052708 - DNA, 22 bp, Artificial Sequence
  chemically synthesized
ttttgtgtattttgtcttgttt

SEQ ID NO: 1052709 - DNA, 22 bp, Artificial Sequence
  chemically synthesized
tttgtgtattttgtcttgtttt

SEQ ID NO: 1052710 - DNA, 22 bp, Artificial Sequence
  chemically synthesized
ttgtgtattttgtcttgttttt

SEQ ID NO: 1052711 - DNA, 22 bp, Artificial Sequence
  chemically synthesized
tgtgtattttgtcttgtttttg

SEQ ID NO: 1052712 - DNA, 22 bp, Artificial Sequence
  chemically synthesized
gtgtattttgtcttgtttttgc

SEQ ID NO: 1052713 - DNA, 22 bp, Artificial Sequence
  chemically synthesized
tgtattttgtcttgtttttgct

SEQ ID NO: 1052714 - DNA, 22 bp, Artificial Sequence
  chemically synthesized
tcacatgtgaggagcaaaaaca

SEQ ID NO: 1052715 - DNA, 22 bp, Artificial Sequence
  chemically synthesized
gtcacatgtgaggagcaaaaac

SEQ ID NO: 1052716 - DNA, 22 bp, Artificial Sequence
  chemically synthesized
tgtcacatgtgaggagcaaaaa

SEQ ID NO: 1052717 - DNA, 22 bp, Artificial Sequence
  chemically synthesized
ttttgtcacatgtgaggagcaa

SEQ ID NO: 1052718 - DNA, 22 bp, Artificial Sequence
  chemically synthesized
attttgtcacatgtgaggagca

SEQ ID NO: 1052719 - DNA, 22 bp, Artificial Sequence
  chemically synthesized
tgtcttgtttttgctcctcaca

SEQ ID NO: 1052720 - DNA, 22 bp, Artificial Sequence
  chemically synthesized
gtcttgtttttgctcctcacat

SEQ ID NO: 1052721 - DNA, 22 bp, Artificial Sequence
  chemically synthesized
tcttgtttttgctcctcacatg

SEQ ID NO: 1052722 - DNA, 22 bp, Artificial Sequence
  chemically synthesized
aatttattttgtcacatgtgag

SEQ ID NO: 1052723 - DNA, 22 bp, Artificial Sequence
  chemically synthesized
gaatttattttgtcacatgtga

SEQ ID NO: 1052724 - DNA, 22 bp, Artificial Sequence
  chemically synthesized
gtttttgctcctcacatgtgac

SEQ ID NO: 1052725 - DNA, 22 bp, Artificial Sequence
  chemically synthesized
tttttgctcctcacatgtgaca

SEQ ID NO: 1052726 - DNA, 22 bp, Artificial Sequence
  chemically synthesized
ttgaatttattttgtcacatgt

SEQ ID NO: 1052727 - DNA, 22 bp, Artificial Sequence
  chemically synthesized
ttgctcctcacatgtgacaaaa

SEQ ID NO: 1052728 - DNA, 22 bp, Artificial Sequence
  chemically synthesized
tgctcctcacatgtgacaaaat

SEQ ID NO: 1052729 - DNA, 22 bp, Artificial Sequence
  chemically synthesized
gctcctcacatgtgacaaaata

SEQ ID NO: 1052730 - DNA, 22 bp, Artificial Sequence
  chemically synthesized
ctcctcacatgtgacaaaataa

SEQ ID NO: 1052731 - DNA, 22 bp, Artificial Sequence
  chemically synthesized
ctcacatgtgacaaaataaatt

SEQ ID NO: 1052732 - DNA, 22 bp, Artificial Sequence
  chemically synthesized
gaataacattcttgaatttatt

SEQ ID NO: 1052733 - DNA, 22 bp, Artificial Sequence
  chemically synthesized
acatgtgacaaaataaattcaa

SEQ ID NO: 1052734 - DNA, 22 bp, Artificial Sequence
  chemically synthesized
tccactggaataacattcttga

SEQ ID NO: 1052735 - DNA, 22 bp, Artificial Sequence
  chemically synthesized
aagaatgttattccagtggata

SEQ ID NO: 1052736 - DNA, 22 bp, Artificial Sequence
  chemically synthesized
gccccataacagttatccactg

SEQ ID NO: 1052737 - DNA, 22 bp, Artificial Sequence
  chemically synthesized
ttccagtggataactgttatgg

SEQ ID NO: 1052738 - DNA, 22 bp, Artificial Sequence
  chemically synthesized
cagtggataactgttatggggc

SEQ ID NO: 1052739 - DNA, 22 bp, Artificial Sequence
  chemically synthesized
ggcaagcagtactggccccata

SEQ ID NO: 1052740 - DNA, 22 bp, Artificial Sequence
  chemically synthesized
ttcggcaagcagtactggcccc

SEQ ID NO: 1052741 - DNA, 22 bp, Artificial Sequence
  chemically synthesized
ttatggggccagtactgcttgc

SEQ ID NO: 1052742 - DNA, 22 bp, Artificial Sequence
  chemically synthesized
tggggccagtactgcttgccga

SEQ ID NO: 1052743 - DNA, 22 bp, Artificial Sequence
  chemically synthesized
tatgtatggcctgttcggcaag

SEQ ID NO: 1052744 - DNA, 22 bp, Artificial Sequence
  chemically synthesized
ctatatgtatggcctgttcggc

SEQ ID NO: 1052745 - DNA, 22 bp, Artificial Sequence
  chemically synthesized
cttgccgaacaggccatacata

SEQ ID NO: 1052746 - DNA, 22 bp, Artificial Sequence
  chemically synthesized
gccgaacaggccatacatatag

SEQ ID NO: 1052747 - DNA, 22 bp, Artificial Sequence
  chemically synthesized
ccgaacaggccatacatatagg

SEQ ID NO: 1052748 - DNA, 22 bp, Artificial Sequence
  chemically synthesized
agaatgaggaagagaaagcatg

SEQ ID NO: 1052749 - DNA, 22 bp, Artificial Sequence
  chemically synthesized
cagaatgaggaagagaaagcat

SEQ ID NO: 1052750 - DNA, 22 bp, Artificial Sequence
  chemically synthesized
aagtttcagaatgaggaagaga

SEQ ID NO: 1052751 - DNA, 22 bp, Artificial Sequence
  chemically synthesized
gaagtttcagaatgaggaagag

SEQ ID NO: 1052752 - DNA, 22 bp, Artificial Sequence
  chemically synthesized
tcatgctttctcttcctcattc

SEQ ID NO: 1052753 - DNA, 22 bp, Artificial Sequence
  chemically synthesized
cttgaagtttcagaatgaggaa

SEQ ID NO: 1052754 - DNA, 22 bp, Artificial Sequence
  chemically synthesized
catgctttctcttcctcattct

SEQ ID NO: 1052755 - DNA, 22 bp, Artificial Sequence
  chemically synthesized
atgctttctcttcctcattctg

SEQ ID NO: 1052756 - DNA, 22 bp, Artificial Sequence
  chemically synthesized
gttgcttgaagtttcagaatga

SEQ ID NO: 1052757 - DNA, 22 bp, Artificial Sequence
  chemically synthesized
tctcttcctcattctgaaactt

SEQ ID NO: 1052758 - DNA, 22 bp, Artificial Sequence
  chemically synthesized
ctcttcctcattctgaaacttc

SEQ ID NO: 1052759 - DNA, 22 bp, Artificial Sequence
  chemically synthesized
tattggttgcttgaagtttcag

SEQ ID NO: 1052760 - DNA, 22 bp, Artificial Sequence
  chemically synthesized
tcttcctcattctgaaacttca

SEQ ID NO: 1052761 - DNA, 22 bp, Artificial Sequence
  chemically synthesized
tatattggttgcttgaagtttc

SEQ ID NO: 1052762 - DNA, 22 bp, Artificial Sequence
  chemically synthesized
ttcctcattctgaaacttcaag

SEQ ID NO: 1052763 - DNA, 22 bp, Artificial Sequence
  chemically synthesized
ctatattggttgcttgaagttt

SEQ ID NO: 1052764 - DNA, 22 bp, Artificial Sequence
  chemically synthesized
cctcattctgaaacttcaagca

SEQ ID NO: 1052765 - DNA, 22 bp, Artificial Sequence
  chemically synthesized
ctcattctgaaacttcaagcaa

SEQ ID NO: 1052766 - DNA, 22 bp, Artificial Sequence
  chemically synthesized
agtttctatattggttgcttga

SEQ ID NO: 1052767 - DNA, 22 bp, Artificial Sequence
  chemically synthesized
attctgaaacttcaagcaacca

SEQ ID NO: 1052768 - DNA, 22 bp, Artificial Sequence
  chemically synthesized
ctaagtttctatattggttgct

SEQ ID NO: 1052769 - DNA, 22 bp, Artificial Sequence
  chemically synthesized
tgaaacttcaagcaaccaatat

SEQ ID NO: 1052770 - DNA, 22 bp, Artificial Sequence
  chemically synthesized
ctgctaagtttctatattggtt

SEQ ID NO: 1052771 - DNA, 22 bp, Artificial Sequence
  chemically synthesized
aaacttcaagcaaccaatatag

SEQ ID NO: 1052772 - DNA, 22 bp, Artificial Sequence
  chemically synthesized
caagcaaccaatatagaaactt

SEQ ID NO: 1052773 - DNA, 22 bp, Artificial Sequence
  chemically synthesized
aagcaaccaatatagaaactta

SEQ ID NO: 1052774 - DNA, 22 bp, Artificial Sequence
  chemically synthesized
catgaaggaataccattcctgc

SEQ ID NO: 1052775 - DNA, 22 bp, Artificial Sequence
  chemically synthesized
acatgaaggaataccattcctg

SEQ ID NO: 1052776 - DNA, 22 bp, Artificial Sequence
  chemically synthesized
tttacatgaaggaataccattc

SEQ ID NO: 1052777 - DNA, 22 bp, Artificial Sequence
  chemically synthesized
atttacatgaaggaataccatt

SEQ ID NO: 1052778 - DNA, 22 bp, Artificial Sequence
  chemically synthesized
agcaggaatggtattccttcat

SEQ ID NO: 1052779 - DNA, 22 bp, Artificial Sequence
  chemically synthesized
gcaggaatggtattccttcatg

SEQ ID NO: 1052780 - DNA, 22 bp, Artificial Sequence
  chemically synthesized
gataaatttatttacatgaagg

SEQ ID NO: 1052781 - DNA, 22 bp, Artificial Sequence
  chemically synthesized
agataaatttatttacatgaag

SEQ ID NO: 1052782 - DNA, 22 bp, Artificial Sequence
  chemically synthesized
cttcatgtaaataaatttatct

SEQ ID NO: 1052783 - DNA, 22 bp, Artificial Sequence
  chemically synthesized
catgtaaataaatttatctaag

SEQ ID NO: 1052784 - DNA, 22 bp, Artificial Sequence
  chemically synthesized
atgtaaataaatttatctaagt

SEQ ID NO: 1052785 - DNA, 22 bp, Artificial Sequence
  chemically synthesized
atctaagttggtggtttacgga

SEQ ID NO: 1052786 - DNA, 22 bp, Artificial Sequence
  chemically synthesized
tgaaatacaatgtccgtaaacc

SEQ ID NO: 1052787 - DNA, 22 bp, Artificial Sequence
  chemically synthesized
tctaagttggtggtttacggac

SEQ ID NO: 1052788 - DNA, 22 bp, Artificial Sequence
  chemically synthesized
agttggtggtttacggacattg

SEQ ID NO: 1052789 - DNA, 22 bp, Artificial Sequence
  chemically synthesized
acctatgaaatacaatgtccgt

SEQ ID NO: 1052790 - DNA, 22 bp, Artificial Sequence
  chemically synthesized
ttgacctatgaaatacaatgtc

SEQ ID NO: 1052791 - DNA, 22 bp, Artificial Sequence
  chemically synthesized
gtggtttacggacattgtattt

SEQ ID NO: 1052792 - DNA, 22 bp, Artificial Sequence
  chemically synthesized
ttattgacctatgaaatacaat

SEQ ID NO: 1052793 - DNA, 22 bp, Artificial Sequence
  chemically synthesized
acggacattgtatttcataggt

SEQ ID NO: 1052794 - DNA, 22 bp, Artificial Sequence
  chemically synthesized
cggacattgtatttcataggtc

SEQ ID NO: 1052795 - DNA, 22 bp, Artificial Sequence
  chemically synthesized
taatgttgttattgacctatga

SEQ ID NO: 1052796 - DNA, 22 bp, Artificial Sequence
  chemically synthesized
gtaatgttgttattgacctatg

SEQ ID NO: 1052797 - DNA, 22 bp, Artificial Sequence
  chemically synthesized
tgtaatgttgttattgacctat

SEQ ID NO: 1052798 - DNA, 22 bp, Artificial Sequence
  chemically synthesized
ttgtaatgttgttattgaccta

SEQ ID NO: 1052799 - DNA, 22 bp, Artificial Sequence
  chemically synthesized
tttgtaatgttgttattgacct

SEQ ID NO: 1052800 - DNA, 22 bp, Artificial Sequence
  chemically synthesized
ttttgtaatgttgttattgacc

SEQ ID NO: 1052801 - DNA, 22 bp, Artificial Sequence
  chemically synthesized
tttttgtaatgttgttattgac

SEQ ID NO: 1052802 - DNA, 22 bp, Artificial Sequence
  chemically synthesized
ttttttgtaatgttgttattga

SEQ ID NO: 1052803 - DNA, 22 bp, Artificial Sequence
  chemically synthesized
tatttcataggtcaataacaac

SEQ ID NO: 1052804 - DNA, 22 bp, Artificial Sequence
  chemically synthesized
tttttttgtaatgttgttattg

SEQ ID NO: 1052805 - DNA, 22 bp, Artificial Sequence
  chemically synthesized
ttttttttgtaatgttgttatt

SEQ ID NO: 1052806 - DNA, 22 bp, Artificial Sequence
  chemically synthesized
tttttttttgtaatgttgttat

SEQ ID NO: 1052807 - DNA, 22 bp, Artificial Sequence
  chemically synthesized
cataggtcaataacaacattac

SEQ ID NO: 1052808 - DNA, 22 bp, Artificial Sequence
  chemically synthesized
ataggtcaataacaacattaca

SEQ ID NO: 1052809 - DNA, 22 bp, Artificial Sequence
  chemically synthesized
atagttttttttttttgtaatg

SEQ ID NO: 1052810 - DNA, 22 bp, Artificial Sequence
  chemically synthesized
cctaatagttttttttttttgt

SEQ ID NO: 1052811 - DNA, 22 bp, Artificial Sequence
  chemically synthesized
tgatgttccctaatagtttttt

SEQ ID NO: 1052812 - DNA, 22 bp, Artificial Sequence
  chemically synthesized
gtgatgttccctaatagttttt

SEQ ID NO: 1052813 - DNA, 22 bp, Artificial Sequence
  chemically synthesized
tgtgatgttccctaatagtttt

SEQ ID NO: 1052814 - DNA, 22 bp, Artificial Sequence
  chemically synthesized
ttgtgatgttccctaatagttt

SEQ ID NO: 1052815 - DNA, 22 bp, Artificial Sequence
  chemically synthesized
caaaaaaaaaaaactattaggg

SEQ ID NO: 1052816 - DNA, 22 bp, Artificial Sequence
  chemically synthesized
ttagggaacatcacaaaagttc

SEQ ID NO: 1052817 - DNA, 22 bp, Artificial Sequence
  chemically synthesized
gggaacatcacaaaagttctgc

SEQ ID NO: 1052818 - DNA, 22 bp, Artificial Sequence
  chemically synthesized
gaaaaagtaaagggcagaactt

SEQ ID NO: 1052819 - DNA, 22 bp, Artificial Sequence
  chemically synthesized
ctagaaaaagtaaagggcagaa

SEQ ID NO: 1052820 - DNA, 22 bp, Artificial Sequence
  chemically synthesized
actagaaaaagtaaagggcaga

SEQ ID NO: 1052821 - DNA, 22 bp, Artificial Sequence
  chemically synthesized
tactagaaaaagtaaagggcag

SEQ ID NO: 1052822 - DNA, 22 bp, Artificial Sequence
  chemically synthesized
caatgtcctttactagaaaaag

SEQ ID NO: 1052823 - DNA, 22 bp, Artificial Sequence
  chemically synthesized
tgccctttactttttctagtaa

SEQ ID NO: 1052824 - DNA, 22 bp, Artificial Sequence
  chemically synthesized
ttacaatgtcctttactagaaa

SEQ ID NO: 1052825 - DNA, 22 bp, Artificial Sequence
  chemically synthesized
gttacaatgtcctttactagaa

SEQ ID NO: 1052826 - DNA, 22 bp, Artificial Sequence
  chemically synthesized
ccctttactttttctagtaaag

SEQ ID NO: 1052827 - DNA, 22 bp, Artificial Sequence
  chemically synthesized
tgttacaatgtcctttactaga

SEQ ID NO: 1052828 - DNA, 22 bp, Artificial Sequence
  chemically synthesized
attttgttacaatgtcctttac

SEQ ID NO: 1052829 - DNA, 22 bp, Artificial Sequence
  chemically synthesized
tactttttctagtaaaggacat

SEQ ID NO: 1052830 - DNA, 22 bp, Artificial Sequence
  chemically synthesized
actttttctagtaaaggacatt

SEQ ID NO: 1052831 - DNA, 22 bp, Artificial Sequence
  chemically synthesized
tcattttgttacaatgtccttt

SEQ ID NO: 1052832 - DNA, 22 bp, Artificial Sequence
  chemically synthesized
ctttttctagtaaaggacattg

SEQ ID NO: 1052833 - DNA, 22 bp, Artificial Sequence
  chemically synthesized
ctcattttgttacaatgtcctt

SEQ ID NO: 1052834 - DNA, 22 bp, Artificial Sequence
  chemically synthesized
ttctcattttgttacaatgtcc

SEQ ID NO: 1052835 - DNA, 22 bp, Artificial Sequence
  chemically synthesized
tttctagtaaaggacattgtaa

SEQ ID NO: 1052836 - DNA, 22 bp, Artificial Sequence
  chemically synthesized
cttctcattttgttacaatgtc

SEQ ID NO: 1052837 - DNA, 22 bp, Artificial Sequence
  chemically synthesized
ttctagtaaaggacattgtaac

SEQ ID NO: 1052838 - DNA, 22 bp, Artificial Sequence
  chemically synthesized
tcttctcattttgttacaatgt

SEQ ID NO: 1052839 - DNA, 22 bp, Artificial Sequence
  chemically synthesized
tctagtaaaggacattgtaaca

SEQ ID NO: 1052840 - DNA, 22 bp, Artificial Sequence
  chemically synthesized
ctagtaaaggacattgtaacaa

SEQ ID NO: 1052841 - DNA, 22 bp, Artificial Sequence
  chemically synthesized
tttcttctcattttgttacaat

SEQ ID NO: 1052842 - DNA, 22 bp, Artificial Sequence
  chemically synthesized
tagtaaaggacattgtaacaaa

SEQ ID NO: 1052843 - DNA, 22 bp, Artificial Sequence
  chemically synthesized
ctttcttctcattttgttacaa

SEQ ID NO: 1052844 - DNA, 22 bp, Artificial Sequence
  chemically synthesized
tctttcttctcattttgttaca

SEQ ID NO: 1052845 - DNA, 22 bp, Artificial Sequence
  chemically synthesized
gtaaaggacattgtaacaaaat

SEQ ID NO: 1052846 - DNA, 22 bp, Artificial Sequence
  chemically synthesized
ttctttcttctcattttgttac

SEQ ID NO: 1052847 - DNA, 22 bp, Artificial Sequence
  chemically synthesized
tttctttcttctcattttgtta

SEQ ID NO: 1052848 - DNA, 22 bp, Artificial Sequence
  chemically synthesized
tttttctttcttctcattttgt

SEQ ID NO: 1052849 - DNA, 22 bp, Artificial Sequence
  chemically synthesized
ctttttctttcttctcattttg

SEQ ID NO: 1052850 - DNA, 22 bp, Artificial Sequence
  chemically synthesized
tctttttctttcttctcatttt

SEQ ID NO: 1052851 - DNA, 22 bp, Artificial Sequence
  chemically synthesized
taacaaaatgagaagaaagaaa

SEQ ID NO: 1052852 - DNA, 22 bp, Artificial Sequence
  chemically synthesized
aaatggcctttctttttctttc

SEQ ID NO: 1052853 - DNA, 22 bp, Artificial Sequence
  chemically synthesized
gaggtattaaaatggcctttct

SEQ ID NO: 1052854 - DNA, 22 bp, Artificial Sequence
  chemically synthesized
ggaggtattaaaatggcctttc

SEQ ID NO: 1052855 - DNA, 22 bp, Artificial Sequence
  chemically synthesized
tggaggtattaaaatggccttt

SEQ ID NO: 1052856 - DNA, 22 bp, Artificial Sequence
  chemically synthesized
aacagttttggaggtattaaaa

SEQ ID NO: 1052857 - DNA, 22 bp, Artificial Sequence
  chemically synthesized
caacagttttggaggtattaaa

SEQ ID NO: 1052858 - DNA, 22 bp, Artificial Sequence
  chemically synthesized
tgggtttcaacagttttggagg

SEQ ID NO: 1052859 - DNA, 22 bp, Artificial Sequence
  chemically synthesized
taatacctccaaaactgttgaa

SEQ ID NO: 1052860 - DNA, 22 bp, Artificial Sequence
  chemically synthesized
aaaattatgggtttcaacagtt

SEQ ID NO: 1052861 - DNA, 22 bp, Artificial Sequence
  chemically synthesized
aatacctccaaaactgttgaaa

SEQ ID NO: 1052862 - DNA, 22 bp, Artificial Sequence
  chemically synthesized
caaaattatgggtttcaacagt

SEQ ID NO: 1052863 - DNA, 22 bp, Artificial Sequence
  chemically synthesized
atacctccaaaactgttgaaac

SEQ ID NO: 1052864 - DNA, 22 bp, Artificial Sequence
  chemically synthesized
tcaaaattatgggtttcaacag

SEQ ID NO: 1052865 - DNA, 22 bp, Artificial Sequence
  chemically synthesized
tttcaaaattatgggtttcaac

SEQ ID NO: 1052866 - DNA, 22 bp, Artificial Sequence
  chemically synthesized
ctttcaaaattatgggtttcaa

SEQ ID NO: 1052867 - DNA, 22 bp, Artificial Sequence
  chemically synthesized
tctttcaaaattatgggtttca

SEQ ID NO: 1052868 - DNA, 22 bp, Artificial Sequence
  chemically synthesized
caaaactgttgaaacccataat

SEQ ID NO: 1052869 - DNA, 22 bp, Artificial Sequence
  chemically synthesized
tcctttctttcaaaattatggg

SEQ ID NO: 1052870 - DNA, 22 bp, Artificial Sequence
  chemically synthesized
ttgaaacccataattttgaaag

SEQ ID NO: 1052871 - DNA, 22 bp, Artificial Sequence
  chemically synthesized
aaacccataattttgaaagaaa

SEQ ID NO: 1052872 - DNA, 22 bp, Artificial Sequence
  chemically synthesized
atgcaagaattgtcctttcttt

SEQ ID NO: 1052873 - DNA, 22 bp, Artificial Sequence
  chemically synthesized
aatgcaagaattgtcctttctt

SEQ ID NO: 1052874 - DNA, 22 bp, Artificial Sequence
  chemically synthesized
taatgcaagaattgtcctttct

SEQ ID NO: 1052875 - DNA, 22 bp, Artificial Sequence
  chemically synthesized
ttaatgcaagaattgtcctttc

SEQ ID NO: 1052876 - DNA, 22 bp, Artificial Sequence
  chemically synthesized
tttaatgcaagaattgtccttt

SEQ ID NO: 1052877 - DNA, 22 bp, Artificial Sequence
  chemically synthesized
tgaaagaaaggacaattcttgc

SEQ ID NO: 1052878 - DNA, 22 bp, Artificial Sequence
  chemically synthesized
gaaagaaaggacaattcttgca

SEQ ID NO: 1052879 - DNA, 22 bp, Artificial Sequence
  chemically synthesized
aaagaaaggacaattcttgcat

SEQ ID NO: 1052880 - DNA, 22 bp, Artificial Sequence
  chemically synthesized
ataaagcaaagttttttaatgc

SEQ ID NO: 1052881 - DNA, 22 bp, Artificial Sequence
  chemically synthesized
cataaagcaaagttttttaatg

SEQ ID NO: 1052882 - DNA, 22 bp, Artificial Sequence
  chemically synthesized
tcataaagcaaagttttttaat

SEQ ID NO: 1052883 - DNA, 22 bp, Artificial Sequence
  chemically synthesized
ttcataaagcaaagttttttaa

SEQ ID NO: 1052884 - DNA, 22 bp, Artificial Sequence
  chemically synthesized
gcttttcataaagcaaagtttt

SEQ ID NO: 1052885 - DNA, 22 bp, Artificial Sequence
  chemically synthesized
agcttttcataaagcaaagttt

SEQ ID NO: 1052886 - DNA, 22 bp, Artificial Sequence
  chemically synthesized
ttgcattaaaaaactttgcttt

SEQ ID NO: 1052887 - DNA, 22 bp, Artificial Sequence
  chemically synthesized
tttagcttttcataaagcaaag

SEQ ID NO: 1052888 - DNA, 22 bp, Artificial Sequence
  chemically synthesized
gcattaaaaaactttgctttat

SEQ ID NO: 1052889 - DNA, 22 bp, Artificial Sequence
  chemically synthesized
atttagcttttcataaagcaaa

SEQ ID NO: 1052890 - DNA, 22 bp, Artificial Sequence
  chemically synthesized
cattaaaaaactttgctttatg

SEQ ID NO: 1052891 - DNA, 22 bp, Artificial Sequence
  chemically synthesized
tatttagcttttcataaagcaa

SEQ ID NO: 1052892 - DNA, 22 bp, Artificial Sequence
  chemically synthesized
ttatttagcttttcataaagca

SEQ ID NO: 1052893 - DNA, 22 bp, Artificial Sequence
  chemically synthesized
tttatttagcttttcataaagc

SEQ ID NO: 1052894 - DNA, 22 bp, Artificial Sequence
  chemically synthesized
aaaaactttgctttatgaaaag

SEQ ID NO: 1052895 - DNA, 22 bp, Artificial Sequence
  chemically synthesized
tgctttatgaaaagctaaataa

SEQ ID NO: 1052896 - DNA, 22 bp, Artificial Sequence
  chemically synthesized
gctttatgaaaagctaaataaa

SEQ ID NO: 1052897 - DNA, 22 bp, Artificial Sequence
  chemically synthesized
ctttatgaaaagctaaataaaa

SEQ ID NO: 1052898 - DNA, 22 bp, Artificial Sequence
  chemically synthesized
tatgaaaagctaaataaaaaat

SEQ ID NO: 1052899 - DNA, 22 bp, Artificial Sequence
  chemically synthesized
atgaaaagctaaataaaaaatt

SEQ ID NO: 1052900 - DNA, 22 bp, Artificial Sequence
  chemically synthesized
tgaaaagctaaataaaaaattg

SEQ ID NO: 1052901 - DNA, 22 bp, Artificial Sequence
  chemically synthesized
aataaaaaattgctcttttttt

SEQ ID NO: 1052902 - DNA, 22 bp, Artificial Sequence
  chemically synthesized
aatggtccataaggaaaagaaa

SEQ ID NO: 1052903 - DNA, 22 bp, Artificial Sequence
  chemically synthesized
caatggtccataaggaaaagaa

SEQ ID NO: 1052904 - DNA, 22 bp, Artificial Sequence
  chemically synthesized
tcaatggtccataaggaaaaga

SEQ ID NO: 1052905 - DNA, 22 bp, Artificial Sequence
  chemically synthesized
ctcttttttttcttttccttat

SEQ ID NO: 1052906 - DNA, 22 bp, Artificial Sequence
  chemically synthesized
ttttttttcttttccttatgga

SEQ ID NO: 1052907 - DNA, 22 bp, Artificial Sequence
  chemically synthesized
ttttttcttttccttatggacc

SEQ ID NO: 1052908 - DNA, 22 bp, Artificial Sequence
  chemically synthesized
tttttcttttccttatggacca

SEQ ID NO: 1052909 - DNA, 22 bp, Artificial Sequence
  chemically synthesized
ttttcttttccttatggaccat

SEQ ID NO: 1052910 - DNA, 22 bp, Artificial Sequence
  chemically synthesized
tttcttttccttatggaccatt

SEQ ID NO: 1052911 - DNA, 22 bp, Artificial Sequence
  chemically synthesized
ttcttttccttatggaccattg

SEQ ID NO: 1052912 - DNA, 22 bp, Artificial Sequence
  chemically synthesized
tcttttccttatggaccattga

SEQ ID NO: 1052913 - DNA, 22 bp, Artificial Sequence
  chemically synthesized
cttttccttatggaccattgaa

SEQ ID NO: 1052914 - DNA, 22 bp, Artificial Sequence
  chemically synthesized
ttttccttatggaccattgaaa

SEQ ID NO: 1052915 - DNA, 22 bp, Artificial Sequence
  chemically synthesized
ttccttatggaccattgaaaac

SEQ ID NO: 1052916 - DNA, 22 bp, Artificial Sequence
  chemically synthesized
tccttatggaccattgaaaact

SEQ ID NO: 1052917 - DNA, 22 bp, Artificial Sequence
  chemically synthesized
ccatggtccagaagttttcaat

SEQ ID NO: 1052918 - DNA, 22 bp, Artificial Sequence
  chemically synthesized
ccttatggaccattgaaaactt

SEQ ID NO: 1052919 - DNA, 22 bp, Artificial Sequence
  chemically synthesized
cttatggaccattgaaaacttc

SEQ ID NO: 1052920 - DNA, 22 bp, Artificial Sequence
  chemically synthesized
atggaccattgaaaacttctgg

SEQ ID NO: 1052921 - DNA, 22 bp, Artificial Sequence
  chemically synthesized
tggaccattgaaaacttctgga

SEQ ID NO: 1052922 - DNA, 22 bp, Artificial Sequence
  chemically synthesized
atgccagtctgccatggtccag

SEQ ID NO: 1052923 - DNA, 22 bp, Artificial Sequence
  chemically synthesized
aaaacttctggaccatggcaga

SEQ ID NO: 1052924 - DNA, 22 bp, Artificial Sequence
  chemically synthesized
ctggaccatggcagactggcat

SEQ ID NO: 1052925 - DNA, 22 bp, Artificial Sequence
  chemically synthesized
tggaccatggcagactggcatt

SEQ ID NO: 1052926 - DNA, 22 bp, Artificial Sequence
  chemically synthesized
gaccatggcagactggcattag

SEQ ID NO: 1052927 - DNA, 22 bp, Artificial Sequence
  chemically synthesized
tgtcagtggtatcctaatgcca

SEQ ID NO: 1052928 - DNA, 22 bp, Artificial Sequence
  chemically synthesized
atgtcagtggtatcctaatgcc

SEQ ID NO: 1052929 - DNA, 22 bp, Artificial Sequence
  chemically synthesized
tatgtcagtggtatcctaatgc

SEQ ID NO: 1052930 - DNA, 22 bp, Artificial Sequence
  chemically synthesized
ttatgtcagtggtatcctaatg

SEQ ID NO: 1052931 - DNA, 22 bp, Artificial Sequence
  chemically synthesized
tatttttatgtcagtggtatcc

SEQ ID NO: 1052932 - DNA, 22 bp, Artificial Sequence
  chemically synthesized
tgtatttttatgtcagtggtat

SEQ ID NO: 1052933 - DNA, 22 bp, Artificial Sequence
  chemically synthesized
ttctgtatttttatgtcagtgg

SEQ ID NO: 1052934 - DNA, 22 bp, Artificial Sequence
  chemically synthesized
gcattaggataccactgacata

SEQ ID NO: 1052935 - DNA, 22 bp, Artificial Sequence
  chemically synthesized
gttgttctgtatttttatgtca

SEQ ID NO: 1052936 - DNA, 22 bp, Artificial Sequence
  chemically synthesized
ggataccactgacataaaaata

SEQ ID NO: 1052937 - DNA, 22 bp, Artificial Sequence
  chemically synthesized
agagttggttgttctgtatttt

SEQ ID NO: 1052938 - DNA, 22 bp, Artificial Sequence
  chemically synthesized
cagagttggttgttctgtattt

SEQ ID NO: 1052939 - DNA, 22 bp, Artificial Sequence
  chemically synthesized
acataaaaatacagaacaacca

SEQ ID NO: 1052940 - DNA, 22 bp, Artificial Sequence
  chemically synthesized
cagtttcagagttggttgttct

SEQ ID NO: 1052941 - DNA, 22 bp, Artificial Sequence
  chemically synthesized
tggaaatccctgcagtttcaga

SEQ ID NO: 1052942 - DNA, 22 bp, Artificial Sequence
  chemically synthesized
ctgtggaaatccctgcagtttc

SEQ ID NO: 1052943 - DNA, 22 bp, Artificial Sequence
  chemically synthesized
cctgtggaaatccctgcagttt

SEQ ID NO: 1052944 - DNA, 22 bp, Artificial Sequence
  chemically synthesized
tgaaactgcagggatttccaca

SEQ ID NO: 1052945 - DNA, 22 bp, Artificial Sequence
  chemically synthesized
aaactgcagggatttccacagg

SEQ ID NO: 1052946 - DNA, 22 bp, Artificial Sequence
  chemically synthesized
cagggatttccacaggaagatg

SEQ ID NO: 1052947 - DNA, 22 bp, Artificial Sequence
  chemically synthesized
aatgaatgaatgtataacatct

SEQ ID NO: 1052948 - DNA, 22 bp, Artificial Sequence
  chemically synthesized
ccacaggaagatgttatacatt

SEQ ID NO: 1052949 - DNA, 22 bp, Artificial Sequence
  chemically synthesized
cacaggaagatgttatacattc

SEQ ID NO: 1052950 - DNA, 22 bp, Artificial Sequence
  chemically synthesized
tacattcattcattcaatcatt

SEQ ID NO: 1052951 - DNA, 22 bp, Artificial Sequence
  chemically synthesized
atgaaagtatgtggaatgaatg

SEQ ID NO: 1052952 - DNA, 22 bp, Artificial Sequence
  chemically synthesized
attcattcaatcattcattcca

SEQ ID NO: 1052953 - DNA, 22 bp, Artificial Sequence
  chemically synthesized
aatgaaagtatgtggaatgaat

SEQ ID NO: 1052954 - DNA, 22 bp, Artificial Sequence
  chemically synthesized
attcaatcattcattccacata

SEQ ID NO: 1052955 - DNA, 22 bp, Artificial Sequence
  chemically synthesized
aatcattcattccacatacttt

SEQ ID NO: 1052956 - DNA, 22 bp, Artificial Sequence
  chemically synthesized
attccacatactttcattaaat

SEQ ID NO: 1052957 - DNA, 22 bp, Artificial Sequence
  chemically synthesized
tcacagagcaggtatttaatga

SEQ ID NO: 1052958 - DNA, 22 bp, Artificial Sequence
  chemically synthesized
cacatactttcattaaatacct

SEQ ID NO: 1052959 - DNA, 22 bp, Artificial Sequence
  chemically synthesized
tcattaaatacctgctctgtga

SEQ ID NO: 1052960 - DNA, 22 bp, Artificial Sequence
  chemically synthesized
cattaaatacctgctctgtgat

SEQ ID NO: 1052961 - DNA, 22 bp, Artificial Sequence
  chemically synthesized
attaaatacctgctctgtgata

SEQ ID NO: 1052962 - DNA, 22 bp, Artificial Sequence
  chemically synthesized
aatacctgctctgtgatagact

SEQ ID NO: 1052963 - DNA, 22 bp, Artificial Sequence
  chemically synthesized
cccaagacatagagtctatcac

SEQ ID NO: 1052964 - DNA, 22 bp, Artificial Sequence
  chemically synthesized
ccccaagacatagagtctatca

SEQ ID NO: 1052965 - DNA, 22 bp, Artificial Sequence
  chemically synthesized
tttccccaagacatagagtcta

SEQ ID NO: 1052966 - DNA, 22 bp, Artificial Sequence
  chemically synthesized
ctctgtgatagactctatgtct

SEQ ID NO: 1052967 - DNA, 22 bp, Artificial Sequence
  chemically synthesized
tgtgatagactctatgtcttgg

SEQ ID NO: 1052968 - DNA, 22 bp, Artificial Sequence
  chemically synthesized
gtcactgtttccccaagacata

SEQ ID NO: 1052969 - DNA, 22 bp, Artificial Sequence
  chemically synthesized
tgatagactctatgtcttgggg

SEQ ID NO: 1052970 - DNA, 22 bp, Artificial Sequence
  chemically synthesized
ttagtcactgtttccccaagac

SEQ ID NO: 1052971 - DNA, 22 bp, Artificial Sequence
  chemically synthesized
gttagtcactgtttccccaaga

SEQ ID NO: 1052972 - DNA, 22 bp, Artificial Sequence
  chemically synthesized
tcttgttagtcactgtttcccc

SEQ ID NO: 1052973 - DNA, 22 bp, Artificial Sequence
  chemically synthesized
tatcttgttagtcactgtttcc

SEQ ID NO: 1052974 - DNA, 22 bp, Artificial Sequence
  chemically synthesized
tatgtcttggggaaacagtgac

SEQ ID NO: 1052975 - DNA, 22 bp, Artificial Sequence
  chemically synthesized
ttctatcttgttagtcactgtt

SEQ ID NO: 1052976 - DNA, 22 bp, Artificial Sequence
  chemically synthesized
tgtcttggggaaacagtgacta

SEQ ID NO: 1052977 - DNA, 22 bp, Artificial Sequence
  chemically synthesized
ggggaaacagtgactaacaaga

SEQ ID NO: 1052978 - DNA, 22 bp, Artificial Sequence
  chemically synthesized
gggaaacagtgactaacaagat

SEQ ID NO: 1052979 - DNA, 22 bp, Artificial Sequence
  chemically synthesized
atgaagtcaggagcctattcta

SEQ ID NO: 1052980 - DNA, 22 bp, Artificial Sequence
  chemically synthesized
gatgaagtcaggagcctattct

SEQ ID NO: 1052981 - DNA, 22 bp, Artificial Sequence
  chemically synthesized
acaagatagaataggctcctga

SEQ ID NO: 1052982 - DNA, 22 bp, Artificial Sequence
  chemically synthesized
gaatgtaggcttgatgaagtca

SEQ ID NO: 1052983 - DNA, 22 bp, Artificial Sequence
  chemically synthesized
tcattagaatgtaggcttgatg

SEQ ID NO: 1052984 - DNA, 22 bp, Artificial Sequence
  chemically synthesized
ctatcattagaatgtaggcttg

SEQ ID NO: 1052985 - DNA, 22 bp, Artificial Sequence
  chemically synthesized
ctgacttcatcaagcctacatt

SEQ ID NO: 1052986 - DNA, 22 bp, Artificial Sequence
  chemically synthesized
tctgctatcattagaatgtagg

SEQ ID NO: 1052987 - DNA, 22 bp, Artificial Sequence
  chemically synthesized
acttcatcaagcctacattcta

SEQ ID NO: 1052988 - DNA, 22 bp, Artificial Sequence
  chemically synthesized
gtctgctatcattagaatgtag

SEQ ID NO: 1052989 - DNA, 22 bp, Artificial Sequence
  chemically synthesized
catcaagcctacattctaatga

SEQ ID NO: 1052990 - DNA, 22 bp, Artificial Sequence
  chemically synthesized
atcaagcctacattctaatgat

SEQ ID NO: 1052991 - DNA, 22 bp, Artificial Sequence
  chemically synthesized
taatttgtctgctatcattaga

SEQ ID NO: 1052992 - DNA, 22 bp, Artificial Sequence
  chemically synthesized
ataatttgtctgctatcattag

SEQ ID NO: 1052993 - DNA, 22 bp, Artificial Sequence
  chemically synthesized
tttataatttgtctgctatcat

SEQ ID NO: 1052994 - DNA, 22 bp, Artificial Sequence
  chemically synthesized
gtttataatttgtctgctatca

SEQ ID NO: 1052995 - DNA, 22 bp, Artificial Sequence
  chemically synthesized
cttgtttataatttgtctgcta

SEQ ID NO: 1052996 - DNA, 22 bp, Artificial Sequence
  chemically synthesized
cattctaatgatagcagacaaa

SEQ ID NO: 1052997 - DNA, 22 bp, Artificial Sequence
  chemically synthesized
acttgtttataatttgtctgct

SEQ ID NO: 1052998 - DNA, 22 bp, Artificial Sequence
  chemically synthesized
taatgatagcagacaaattata

SEQ ID NO: 1052999 - DNA, 22 bp, Artificial Sequence
  chemically synthesized
atgatagcagacaaattataaa

SEQ ID NO: 1053000 - DNA, 22 bp, Artificial Sequence
  chemically synthesized
catgtttacttgtttataattt

SEQ ID NO: 1053001 - DNA, 22 bp, Artificial Sequence
  chemically synthesized
gcatgtttacttgtttataatt

SEQ ID NO: 1053002 - DNA, 22 bp, Artificial Sequence
  chemically synthesized
tgcatgtttacttgtttataat

SEQ ID NO: 1053003 - DNA, 22 bp, Artificial Sequence
  chemically synthesized
cctttgcatgtttacttgttta

SEQ ID NO: 1053004 - DNA, 22 bp, Artificial Sequence
  chemically synthesized
caaatgttacctttgcatgttt

SEQ ID NO: 1053005 - DNA, 22 bp, Artificial Sequence
  chemically synthesized
taaacaagtaaacatgcaaagg

SEQ ID NO: 1053006 - DNA, 22 bp, Artificial Sequence
  chemically synthesized
caatctgcaaatgttacctttg

SEQ ID NO: 1053007 - DNA, 22 bp, Artificial Sequence
  chemically synthesized
ctgcaatctgcaaatgttacct

SEQ ID NO: 1053008 - DNA, 22 bp, Artificial Sequence
  chemically synthesized
actgcaatctgcaaatgttacc

SEQ ID NO: 1053009 - DNA, 22 bp, Artificial Sequence
  chemically synthesized
atatttactgcaatctgcaaat

SEQ ID NO: 1053010 - DNA, 22 bp, Artificial Sequence
  chemically synthesized
taatatttactgcaatctgcaa

SEQ ID NO: 1053011 - DNA, 22 bp, Artificial Sequence
  chemically synthesized
ctaatatttactgcaatctgca

SEQ ID NO: 1053012 - DNA, 22 bp, Artificial Sequence
  chemically synthesized
ccttctaatatttactgcaatc

SEQ ID NO: 1053013 - DNA, 22 bp, Artificial Sequence
  chemically synthesized
cccttctaatatttactgcaat

SEQ ID NO: 1053014 - DNA, 22 bp, Artificial Sequence
  chemically synthesized
gacgtttcccttctaatattta

SEQ ID NO: 1053015 - DNA, 22 bp, Artificial Sequence
  chemically synthesized
gcagattgcagtaaatattaga

SEQ ID NO: 1053016 - DNA, 22 bp, Artificial Sequence
  chemically synthesized
cagattgcagtaaatattagaa

SEQ ID NO: 1053017 - DNA, 22 bp, Artificial Sequence
  chemically synthesized
cagtaaatattagaagggaaac

SEQ ID NO: 1053018 - DNA, 22 bp, Artificial Sequence
  chemically synthesized
gaacatcagctagacgtttccc

SEQ ID NO: 1053019 - DNA, 22 bp, Artificial Sequence
  chemically synthesized
tagaacatcagctagacgtttc

SEQ ID NO: 1053020 - DNA, 22 bp, Artificial Sequence
  chemically synthesized
gaagggaaacgtctagctgatg

SEQ ID NO: 1053021 - DNA, 22 bp, Artificial Sequence
  chemically synthesized
ccatcatgctctagaacatcag

SEQ ID NO: 1053022 - DNA, 22 bp, Artificial Sequence
  chemically synthesized
accatcatgctctagaacatca

SEQ ID NO: 1053023 - DNA, 22 bp, Artificial Sequence
  chemically synthesized
tccttaccatcatgctctagaa

SEQ ID NO: 1053024 - DNA, 22 bp, Artificial Sequence
  chemically synthesized
tatccttaccatcatgctctag

SEQ ID NO: 1053025 - DNA, 22 bp, Artificial Sequence
  chemically synthesized
gctgatgttctagagcatgatg

SEQ ID NO: 1053026 - DNA, 22 bp, Artificial Sequence
  chemically synthesized
atgttctagagcatgatggtaa

SEQ ID NO: 1053027 - DNA, 22 bp, Artificial Sequence
  chemically synthesized
tagagcatgatggtaaggatag

SEQ ID NO: 1053028 - DNA, 22 bp, Artificial Sequence
  chemically synthesized
gccacatccattctatccttac

SEQ ID NO: 1053029 - DNA, 22 bp, Artificial Sequence
  chemically synthesized
gagcatgatggtaaggatagaa

SEQ ID NO: 1053030 - DNA, 22 bp, Artificial Sequence
  chemically synthesized
tgtcgttcgccacatccattct

SEQ ID NO: 1053031 - DNA, 22 bp, Artificial Sequence
  chemically synthesized
atgtcgttcgccacatccattc

SEQ ID NO: 1053032 - DNA, 22 bp, Artificial Sequence
  chemically synthesized
tatgtcgttcgccacatccatt

SEQ ID NO: 1053033 - DNA, 22 bp, Artificial Sequence
  chemically synthesized
ttttatgtcgttcgccacatcc

SEQ ID NO: 1053034 - DNA, 22 bp, Artificial Sequence
  chemically synthesized
gacaacctattttatgtcgttc

SEQ ID NO: 1053035 - DNA, 22 bp, Artificial Sequence
  chemically synthesized
cgacaacctattttatgtcgtt

SEQ ID NO: 1053036 - DNA, 22 bp, Artificial Sequence
  chemically synthesized
ccttcgacaacctattttatgt

SEQ ID NO: 1053037 - DNA, 22 bp, Artificial Sequence
  chemically synthesized
cacaggtggcctgccttcgaca

SEQ ID NO: 1053038 - DNA, 22 bp, Artificial Sequence
  chemically synthesized
tctccacaggtggcctgccttc

SEQ ID NO: 1053039 - DNA, 22 bp, Artificial Sequence
  chemically synthesized
tcgaaggcaggccacctgtgga

SEQ ID NO: 1053040 - DNA, 22 bp, Artificial Sequence
  chemically synthesized
caggatgcagagtgaacattat

SEQ ID NO: 1053041 - DNA, 22 bp, Artificial Sequence
  chemically synthesized
tggagataatgttcactctgca

SEQ ID NO: 1053042 - DNA, 22 bp, Artificial Sequence
  chemically synthesized
ccgtcacattgcaggatgcaga

SEQ ID NO: 1053043 - DNA, 22 bp, Artificial Sequence
  chemically synthesized
gtctcccgtcacattgcaggat

SEQ ID NO: 1053044 - DNA, 22 bp, Artificial Sequence
  chemically synthesized
ctggtctcccgtcacattgcag

SEQ ID NO: 1053045 - DNA, 22 bp, Artificial Sequence
  chemically synthesized
gctggtctcccgtcacattgca

SEQ ID NO: 1053046 - DNA, 22 bp, Artificial Sequence
  chemically synthesized
actctgcatcctgcaatgtgac

SEQ ID NO: 1053047 - DNA, 22 bp, Artificial Sequence
  chemically synthesized
cttgctggtctcccgtcacatt

SEQ ID NO: 1053048 - DNA, 22 bp, Artificial Sequence
  chemically synthesized
ccttgctggtctcccgtcacat

SEQ ID NO: 1053049 - DNA, 22 bp, Artificial Sequence
  chemically synthesized
tgcatcctgcaatgtgacggga

SEQ ID NO: 1053050 - DNA, 22 bp, Artificial Sequence
  chemically synthesized
catcctgcaatgtgacgggaga

SEQ ID NO: 1053051 - DNA, 22 bp, Artificial Sequence
  chemically synthesized
gatatttccttgctggtctccc

SEQ ID NO: 1053052 - DNA, 22 bp, Artificial Sequence
  chemically synthesized
tggatatttccttgctggtctc

SEQ ID NO: 1053053 - DNA, 22 bp, Artificial Sequence
  chemically synthesized
caatgtgacgggagaccagcaa

SEQ ID NO: 1053054 - DNA, 22 bp, Artificial Sequence
  chemically synthesized
ctggatatttccttgctggtct

SEQ ID NO: 1053055 - DNA, 22 bp, Artificial Sequence
  chemically synthesized
tttctggatatttccttgctgg

SEQ ID NO: 1053056 - DNA, 22 bp, Artificial Sequence
  chemically synthesized
tatttctggatatttccttgct

SEQ ID NO: 1053057 - DNA, 22 bp, Artificial Sequence
  chemically synthesized
ggcctctatttctggatatttc

SEQ ID NO: 1053058 - DNA, 22 bp, Artificial Sequence
  chemically synthesized
gggcctctatttctggatattt

SEQ ID NO: 1053059 - DNA, 22 bp, Artificial Sequence
  chemically synthesized
acttgggcctctatttctggat

SEQ ID NO: 1053060 - DNA, 22 bp, Artificial Sequence
  chemically synthesized
gacttgggcctctatttctgga

SEQ ID NO: 1053061 - DNA, 22 bp, Artificial Sequence
  chemically synthesized
tgacttgggcctctatttctgg

SEQ ID NO: 1053062 - DNA, 22 bp, Artificial Sequence
  chemically synthesized
ctttgacttgggcctctatttc

SEQ ID NO: 1053063 - DNA, 22 bp, Artificial Sequence
  chemically synthesized
cctttgacttgggcctctattt

SEQ ID NO: 1053064 - DNA, 22 bp, Artificial Sequence
  chemically synthesized
tgtttcctttgacttgggcctc

SEQ ID NO: 1053065 - DNA, 22 bp, Artificial Sequence
  chemically synthesized
caattatgtttcctttgacttg

SEQ ID NO: 1053066 - DNA, 22 bp, Artificial Sequence
  chemically synthesized
aggtcattgcaattatgtttcc

SEQ ID NO: 1053067 - DNA, 22 bp, Artificial Sequence
  chemically synthesized
cctcaggtcattgcaattatgt

SEQ ID NO: 1053068 - DNA, 22 bp, Artificial Sequence
  chemically synthesized
tacctcaggtcattgcaattat

SEQ ID NO: 1053069 - DNA, 22 bp, Artificial Sequence
  chemically synthesized
ctacctcaggtcattgcaatta

SEQ ID NO: 1053070 - DNA, 22 bp, Artificial Sequence
  chemically synthesized
ccaagatgtcttctacctcagg

SEQ ID NO: 1053071 - DNA, 22 bp, Artificial Sequence
  chemically synthesized
gccaagatgtcttctacctcag

SEQ ID NO: 1053072 - DNA, 22 bp, Artificial Sequence
  chemically synthesized
caatgacctgaggtagaagaca

SEQ ID NO: 1053073 - DNA, 22 bp, Artificial Sequence
  chemically synthesized
aacttgccaagatgtcttctac

SEQ ID NO: 1053074 - DNA, 22 bp, Artificial Sequence
  chemically synthesized
aaacttgccaagatgtcttcta

SEQ ID NO: 1053075 - DNA, 22 bp, Artificial Sequence
  chemically synthesized
taaacttgccaagatgtcttct

SEQ ID NO: 1053076 - DNA, 22 bp, Artificial Sequence
  chemically synthesized
tttaaacttgccaagatgtctt

SEQ ID NO: 1053077 - DNA, 22 bp, Artificial Sequence
  chemically synthesized
ctttaaacttgccaagatgtct

SEQ ID NO: 1053078 - DNA, 22 bp, Artificial Sequence
  chemically synthesized
ttctttaaacttgccaagatgt

SEQ ID NO: 1053079 - DNA, 22 bp, Artificial Sequence
  chemically synthesized
aggtagaagacatcttggcaag

SEQ ID NO: 1053080 - DNA, 22 bp, Artificial Sequence
  chemically synthesized
ctcttctttaaacttgccaaga

SEQ ID NO: 1053081 - DNA, 22 bp, Artificial Sequence
  chemically synthesized
caaagccctcctcttctttaaa

SEQ ID NO: 1053082 - DNA, 22 bp, Artificial Sequence
  chemically synthesized
ctacaaagccctcctcttcttt

SEQ ID NO: 1053083 - DNA, 22 bp, Artificial Sequence
  chemically synthesized
ggcaagtttaaagaagaggagg

SEQ ID NO: 1053084 - DNA, 22 bp, Artificial Sequence
  chemically synthesized
gcaagtttaaagaagaggaggg

SEQ ID NO: 1053085 - DNA, 22 bp, Artificial Sequence
  chemically synthesized
atctgctacaaagccctcctct

SEQ ID NO: 1053086 - DNA, 22 bp, Artificial Sequence
  chemically synthesized
aatctgctacaaagccctcctc

SEQ ID NO: 1053087 - DNA, 22 bp, Artificial Sequence
  chemically synthesized
taatctgctacaaagccctcct

SEQ ID NO: 1053088 - DNA, 22 bp, Artificial Sequence
  chemically synthesized
tttaatctgctacaaagccctc

SEQ ID NO: 1053089 - DNA, 22 bp, Artificial Sequence
  chemically synthesized
aaagaagaggagggctttgtag

SEQ ID NO: 1053090 - DNA, 22 bp, Artificial Sequence
  chemically synthesized
aagaagaggagggctttgtagc

SEQ ID NO: 1053091 - DNA, 22 bp, Artificial Sequence
  chemically synthesized
atgggaaagggtctctttaatc

SEQ ID NO: 1053092 - DNA, 22 bp, Artificial Sequence
  chemically synthesized
cctaatgggaaagggtctcttt

SEQ ID NO: 1053093 - DNA, 22 bp, Artificial Sequence
  chemically synthesized
tgtagcagattaaagagaccct

SEQ ID NO: 1053094 - DNA, 22 bp, Artificial Sequence
  chemically synthesized
gtagcagattaaagagaccctt

SEQ ID NO: 1053095 - DNA, 22 bp, Artificial Sequence
  chemically synthesized
tagcagattaaagagacccttt

SEQ ID NO: 1053096 - DNA, 22 bp, Artificial Sequence
  chemically synthesized
gcctccctaatgggaaagggtc

SEQ ID NO: 1053097 - DNA, 22 bp, Artificial Sequence
  chemically synthesized
aagagaccctttcccattaggg

SEQ ID NO: 1053098 - DNA, 22 bp, Artificial Sequence
  chemically synthesized
atatattggcctccctaatggg

SEQ ID NO: 1053099 - DNA, 22 bp, Artificial Sequence
  chemically synthesized
catatattggcctccctaatgg

SEQ ID NO: 1053100 - DNA, 22 bp, Artificial Sequence
  chemically synthesized
ttcatatattggcctccctaat

SEQ ID NO: 1053101 - DNA, 22 bp, Artificial Sequence
  chemically synthesized
gtcctcttcatatattggcctc

SEQ ID NO: 1053102 - DNA, 22 bp, Artificial Sequence
  chemically synthesized
tcccattagggaggccaatata

SEQ ID NO: 1053103 - DNA, 22 bp, Artificial Sequence
  chemically synthesized
cccattagggaggccaatatat

SEQ ID NO: 1053104 - DNA, 22 bp, Artificial Sequence
  chemically synthesized
ccattagggaggccaatatatg

SEQ ID NO: 1053105 - DNA, 22 bp, Artificial Sequence
  chemically synthesized
agagatctagtcctcttcatat

SEQ ID NO: 1053106 - DNA, 22 bp, Artificial Sequence
  chemically synthesized
gggaggccaatatatgaagagg

SEQ ID NO: 1053107 - DNA, 22 bp, Artificial Sequence
  chemically synthesized
atatgtggaaaattaagagatc

SEQ ID NO: 1053108 - DNA, 22 bp, Artificial Sequence
  chemically synthesized
catatgtggaaaattaagagat

SEQ ID NO: 1053109 - DNA, 22 bp, Artificial Sequence
  chemically synthesized
gagtatttcatatgtggaaaat

SEQ ID NO: 1053110 - DNA, 22 bp, Artificial Sequence
  chemically synthesized
gatctcttaattttccacatat

SEQ ID NO: 1053111 - DNA, 22 bp, Artificial Sequence
  chemically synthesized
ttaattttccacatatgaaata

SEQ ID NO: 1053112 - DNA, 22 bp, Artificial Sequence
  chemically synthesized
aattttccacatatgaaatact

SEQ ID NO: 1053113 - DNA, 22 bp, Artificial Sequence
  chemically synthesized
attttccacatatgaaatactc

SEQ ID NO: 1053114 - DNA, 22 bp, Artificial Sequence
  chemically synthesized
gtagatacactcgagtatttca

SEQ ID NO: 1053115 - DNA, 22 bp, Artificial Sequence
  chemically synthesized
cgtagatacactcgagtatttc

SEQ ID NO: 1053116 - DNA, 22 bp, Artificial Sequence
  chemically synthesized
tccacatatgaaatactcgagt

SEQ ID NO: 1053117 - DNA, 22 bp, Artificial Sequence
  chemically synthesized
cttcgtagatacactcgagtat

SEQ ID NO: 1053118 - DNA, 22 bp, Artificial Sequence
  chemically synthesized
ccacatatgaaatactcgagtg

SEQ ID NO: 1053119 - DNA, 22 bp, Artificial Sequence
  chemically synthesized
gcttcgtagatacactcgagta

SEQ ID NO: 1053120 - DNA, 22 bp, Artificial Sequence
  chemically synthesized
cacatatgaaatactcgagtgt

SEQ ID NO: 1053121 - DNA, 22 bp, Artificial Sequence
  chemically synthesized
ttgcttcgtagatacactcgag

SEQ ID NO: 1053122 - DNA, 22 bp, Artificial Sequence
  chemically synthesized
cttgcttcgtagatacactcga

SEQ ID NO: 1053123 - DNA, 22 bp, Artificial Sequence
  chemically synthesized
atttcttgcttcgtagatacac

SEQ ID NO: 1053124 - DNA, 22 bp, Artificial Sequence
  chemically synthesized
catttcttgcttcgtagataca

SEQ ID NO: 1053125 - DNA, 22 bp, Artificial Sequence
  chemically synthesized
tcatttcttgcttcgtagatac

SEQ ID NO: 1053126 - DNA, 22 bp, Artificial Sequence
  chemically synthesized
tattttcatttcttgcttcgta

SEQ ID NO: 1053127 - DNA, 22 bp, Artificial Sequence
  chemically synthesized
gagtgtatctacgaagcaagaa

SEQ ID NO: 1053128 - DNA, 22 bp, Artificial Sequence
  chemically synthesized
cgaagcaagaaatgaaaatata

SEQ ID NO: 1053129 - DNA, 22 bp, Artificial Sequence
  chemically synthesized
gacaatcataaacacacatgaa

SEQ ID NO: 1053130 - DNA, 22 bp, Artificial Sequence
  chemically synthesized
ttcatgtttcatgtgtgtttat

SEQ ID NO: 1053131 - DNA, 22 bp, Artificial Sequence
  chemically synthesized
gtatctagacaatcataaacac

SEQ ID NO: 1053132 - DNA, 22 bp, Artificial Sequence
  chemically synthesized
atgtttcatgtgtgtttatgat

SEQ ID NO: 1053133 - DNA, 22 bp, Artificial Sequence
  chemically synthesized
gttagtatctagacaatcataa

SEQ ID NO: 1053134 - DNA, 22 bp, Artificial Sequence
  chemically synthesized
catgtgtgtttatgattgtcta

SEQ ID NO: 1053135 - DNA, 22 bp, Artificial Sequence
  chemically synthesized
atgtgtgtttatgattgtctag

SEQ ID NO: 1053136 - DNA, 22 bp, Artificial Sequence
  chemically synthesized
actggttagtatctagacaatc

SEQ ID NO: 1053137 - DNA, 22 bp, Artificial Sequence
  chemically synthesized
atgattgtctagatactaacca

SEQ ID NO: 1053138 - DNA, 22 bp, Artificial Sequence
  chemically synthesized
tgattgtctagatactaaccag

SEQ ID NO: 1053139 - DNA, 22 bp, Artificial Sequence
  chemically synthesized
aaaatgtgttaactggttagta

SEQ ID NO: 1053140 - DNA, 22 bp, Artificial Sequence
  chemically synthesized
tctagatactaaccagttaaca

SEQ ID NO: 1053141 - DNA, 22 bp, Artificial Sequence
  chemically synthesized
gatactaaccagttaacacatt

SEQ ID NO: 1053142 - DNA, 22 bp, Artificial Sequence
  chemically synthesized
accagttaacacattttgagct

SEQ ID NO: 1053143 - DNA, 22 bp, Artificial Sequence
  chemically synthesized
tgacccgtataaagctcaaaat

SEQ ID NO: 1053144 - DNA, 22 bp, Artificial Sequence
  chemically synthesized
catctgtgacccgtataaagct

SEQ ID NO: 1053145 - DNA, 22 bp, Artificial Sequence
  chemically synthesized
acacattttgagctttatacgg

SEQ ID NO: 1053146 - DNA, 22 bp, Artificial Sequence
  chemically synthesized
tgagctttatacgggtcacaga

SEQ ID NO: 1053147 - DNA, 22 bp, Artificial Sequence
  chemically synthesized
gagctttatacgggtcacagat

SEQ ID NO: 1053148 - DNA, 22 bp, Artificial Sequence
  chemically synthesized
agctttatacgggtcacagatg

SEQ ID NO: 1053149 - DNA, 22 bp, Artificial Sequence
  chemically synthesized
taacatataactccatctgtga

SEQ ID NO: 1053150 - DNA, 22 bp, Artificial Sequence
  chemically synthesized
tatacgggtcacagatggagtt

SEQ ID NO: 1053151 - DNA, 22 bp, Artificial Sequence
  chemically synthesized
tctataacatataactccatct

SEQ ID NO: 1053152 - DNA, 22 bp, Artificial Sequence
  chemically synthesized
atacgggtcacagatggagtta

SEQ ID NO: 1053153 - DNA, 22 bp, Artificial Sequence
  chemically synthesized
tacgggtcacagatggagttat

SEQ ID NO: 1053154 - DNA, 22 bp, Artificial Sequence
  chemically synthesized
acaaatacagttatctataaca

SEQ ID NO: 1053155 - DNA, 22 bp, Artificial Sequence
  chemically synthesized
cctaacaaatacagttatctat

SEQ ID NO: 1053156 - DNA, 22 bp, Artificial Sequence
  chemically synthesized
tatgttatagataactgtattt

SEQ ID NO: 1053157 - DNA, 22 bp, Artificial Sequence
  chemically synthesized
tagataactgtatttgttaggt

SEQ ID NO: 1053158 - DNA, 22 bp, Artificial Sequence
  chemically synthesized
tatttgttaggtaattcattta

SEQ ID NO: 1053159 - DNA, 22 bp, Artificial Sequence
  chemically synthesized
ggtgatgaaaaataaatgaatt

SEQ ID NO: 1053160 - DNA, 22 bp, Artificial Sequence
  chemically synthesized
tctgggtgatgaaaaataaatg

SEQ ID NO: 1053161 - DNA, 22 bp, Artificial Sequence
  chemically synthesized
gttaggtaattcatttattttt

SEQ ID NO: 1053162 - DNA, 22 bp, Artificial Sequence
  chemically synthesized
ttaggtaattcatttatttttc

SEQ ID NO: 1053163 - DNA, 22 bp, Artificial Sequence
  chemically synthesized
ggtaattcatttatttttcatc

SEQ ID NO: 1053164 - DNA, 22 bp, Artificial Sequence
  chemically synthesized
atagactatctgggtgatgaaa

SEQ ID NO: 1053165 - DNA, 22 bp, Artificial Sequence
  chemically synthesized
gttaatagactatctgggtgat

SEQ ID NO: 1053166 - DNA, 22 bp, Artificial Sequence
  chemically synthesized
atttatttttcatcacccagat

SEQ ID NO: 1053167 - DNA, 22 bp, Artificial Sequence
  chemically synthesized
agttaatagactatctgggtga

SEQ ID NO: 1053168 - DNA, 22 bp, Artificial Sequence
  chemically synthesized
ttagttaatagactatctgggt

SEQ ID NO: 1053169 - DNA, 22 bp, Artificial Sequence
  chemically synthesized
cttagttaatagactatctggg

SEQ ID NO: 1053170 - DNA, 22 bp, Artificial Sequence
  chemically synthesized
atttttcatcacccagatagtc

SEQ ID NO: 1053171 - DNA, 22 bp, Artificial Sequence
  chemically synthesized
tcttagttaatagactatctgg

SEQ ID NO: 1053172 - DNA, 22 bp, Artificial Sequence
  chemically synthesized
tttttcatcacccagatagtct

SEQ ID NO: 1053173 - DNA, 22 bp, Artificial Sequence
  chemically synthesized
ttcatcacccagatagtctatt

SEQ ID NO: 1053174 - DNA, 22 bp, Artificial Sequence
  chemically synthesized
tcatcacccagatagtctatta

SEQ ID NO: 1053175 - DNA, 22 bp, Artificial Sequence
  chemically synthesized
catcacccagatagtctattaa

SEQ ID NO: 1053176 - DNA, 22 bp, Artificial Sequence
  chemically synthesized
gtgctttcttagttaatagact

SEQ ID NO: 1053177 - DNA, 22 bp, Artificial Sequence
  chemically synthesized
atcacccagatagtctattaac

SEQ ID NO: 1053178 - DNA, 22 bp, Artificial Sequence
  chemically synthesized
cataataattagtgctttctta

SEQ ID NO: 1053179 - DNA, 22 bp, Artificial Sequence
  chemically synthesized
ccataataattagtgctttctt

SEQ ID NO: 1053180 - DNA, 22 bp, Artificial Sequence
  chemically synthesized
tccataataattagtgctttct

SEQ ID NO: 1053181 - DNA, 22 bp, Artificial Sequence
  chemically synthesized
ttaactaagaaagcactaatta

SEQ ID NO: 1053182 - DNA, 22 bp, Artificial Sequence
  chemically synthesized
actaagaaagcactaattatta

SEQ ID NO: 1053183 - DNA, 22 bp, Artificial Sequence
  chemically synthesized
agaaagcactaattattatgga

SEQ ID NO: 1053184 - DNA, 22 bp, Artificial Sequence
  chemically synthesized
cagaaggtccataattttccat

SEQ ID NO: 1053185 - DNA, 22 bp, Artificial Sequence
  chemically synthesized
attattatggaaaattatggac

SEQ ID NO: 1053186 - DNA, 22 bp, Artificial Sequence
  chemically synthesized
ttatggaaaattatggaccttc

SEQ ID NO: 1053187 - DNA, 22 bp, Artificial Sequence
  chemically synthesized
gggaaagttccagaaggtccat

SEQ ID NO: 1053188 - DNA, 22 bp, Artificial Sequence
  chemically synthesized
tggaaaattatggaccttctgg

SEQ ID NO: 1053189 - DNA, 22 bp, Artificial Sequence
  chemically synthesized
actggggaaagttccagaaggt

SEQ ID NO: 1053190 - DNA, 22 bp, Artificial Sequence
  chemically synthesized
tggaccttctggaactttcccc

SEQ ID NO: 1053191 - DNA, 22 bp, Artificial Sequence
  chemically synthesized
gccagaataaattaactgggga

SEQ ID NO: 1053192 - DNA, 22 bp, Artificial Sequence
  chemically synthesized
tcgccagaataaattaactggg

SEQ ID NO: 1053193 - DNA, 22 bp, Artificial Sequence
  chemically synthesized
ctggaactttccccagttaatt

SEQ ID NO: 1053194 - DNA, 22 bp, Artificial Sequence
  chemically synthesized
ctcgccagaataaattaactgg

SEQ ID NO: 1053195 - DNA, 22 bp, Artificial Sequence
  chemically synthesized
tggaactttccccagttaattt

SEQ ID NO: 1053196 - DNA, 22 bp, Artificial Sequence
  chemically synthesized
gaactttccccagttaatttat

SEQ ID NO: 1053197 - DNA, 22 bp, Artificial Sequence
  chemically synthesized
tccccagttaatttattctggc

SEQ ID NO: 1053198 - DNA, 22 bp, Artificial Sequence
  chemically synthesized
ccccagttaatttattctggcg

SEQ ID NO: 1053199 - DNA, 22 bp, Artificial Sequence
  chemically synthesized
cccagttaatttattctggcga

SEQ ID NO: 1053200 - DNA, 22 bp, Artificial Sequence
  chemically synthesized
atttattctggcgagaagtgcc

SEQ ID NO: 1053201 - DNA, 22 bp, Artificial Sequence
  chemically synthesized
gatatcagtgcatgggcacttc

SEQ ID NO: 1053202 - DNA, 22 bp, Artificial Sequence
  chemically synthesized
attctggcgagaagtgcccatg

SEQ ID NO: 1053203 - DNA, 22 bp, Artificial Sequence
  chemically synthesized
tggatatcagtgcatgggcact

SEQ ID NO: 1053204 - DNA, 22 bp, Artificial Sequence
  chemically synthesized
ttctggcgagaagtgcccatgc

SEQ ID NO: 1053205 - DNA, 22 bp, Artificial Sequence
  chemically synthesized
ctggatatcagtgcatgggcac

SEQ ID NO: 1053206 - DNA, 22 bp, Artificial Sequence
  chemically synthesized
tctggatatcagtgcatgggca

SEQ ID NO: 1053207 - DNA, 22 bp, Artificial Sequence
  chemically synthesized
ttctggatatcagtgcatgggc

SEQ ID NO: 1053208 - DNA, 22 bp, Artificial Sequence
  chemically synthesized
tggcgagaagtgcccatgcact

SEQ ID NO: 1053209 - DNA, 22 bp, Artificial Sequence
  chemically synthesized
gcgagaagtgcccatgcactga

SEQ ID NO: 1053210 - DNA, 22 bp, Artificial Sequence
  chemically synthesized
tttttctggatatcagtgcatg

SEQ ID NO: 1053211 - DNA, 22 bp, Artificial Sequence
  chemically synthesized
actgtttttctggatatcagtg

SEQ ID NO: 1053212 - DNA, 22 bp, Artificial Sequence
  chemically synthesized
ttaactgtttttctggatatca

SEQ ID NO: 1053213 - DNA, 22 bp, Artificial Sequence
  chemically synthesized
gaggcattgttaactgtttttc

SEQ ID NO: 1053214 - DNA, 22 bp, Artificial Sequence
  chemically synthesized
ggaggcattgttaactgttttt

SEQ ID NO: 1053215 - DNA, 22 bp, Artificial Sequence
  chemically synthesized
atatccagaaaaacagttaaca

SEQ ID NO: 1053216 - DNA, 22 bp, Artificial Sequence
  chemically synthesized
agataatttggaggcattgtta

SEQ ID NO: 1053217 - DNA, 22 bp, Artificial Sequence
  chemically synthesized
agatgttcagataatttggagg

SEQ ID NO: 1053218 - DNA, 22 bp, Artificial Sequence
  chemically synthesized
aagatgttcagataatttggag

SEQ ID NO: 1053219 - DNA, 22 bp, Artificial Sequence
  chemically synthesized
acaatgcctccaaattatctga

SEQ ID NO: 1053220 - DNA, 22 bp, Artificial Sequence
  chemically synthesized
tacaaacttaagatgttcagat

SEQ ID NO: 1053221 - DNA, 22 bp, Artificial Sequence
  chemically synthesized
caaattatctgaacatcttaag

SEQ ID NO: 1053222 - DNA, 22 bp, Artificial Sequence
  chemically synthesized
tctgaacatcttaagtttgtac

SEQ ID NO: 1053223 - DNA, 22 bp, Artificial Sequence
  chemically synthesized
aacatcttaagtttgtacagat

SEQ ID NO: 1053224 - DNA, 22 bp, Artificial Sequence
  chemically synthesized
aagtttgtacagatatgggcac

SEQ ID NO: 1053225 - DNA, 22 bp, Artificial Sequence
  chemically synthesized
aatataatccaagtgcccatat

SEQ ID NO: 1053226 - DNA, 22 bp, Artificial Sequence
  chemically synthesized
agtttgtacagatatgggcact

SEQ ID NO: 1053227 - DNA, 22 bp, Artificial Sequence
  chemically synthesized
gtacagatatgggcacttggat

SEQ ID NO: 1053228 - DNA, 22 bp, Artificial Sequence
  chemically synthesized
tacagatatgggcacttggatt

SEQ ID NO: 1053229 - DNA, 22 bp, Artificial Sequence
  chemically synthesized
ggattatatttaatccatgcat

SEQ ID NO: 1053230 - DNA, 22 bp, Artificial Sequence
  chemically synthesized
gattatatttaatccatgcatc

SEQ ID NO: 1053231 - DNA, 22 bp, Artificial Sequence
  chemically synthesized
atccatggatgaaagatgcatg

SEQ ID NO: 1053232 - DNA, 22 bp, Artificial Sequence
  chemically synthesized
tatttaatccatgcatctttca

SEQ ID NO: 1053233 - DNA, 22 bp, Artificial Sequence
  chemically synthesized
aatccatgcatctttcatccat

SEQ ID NO: 1053234 - DNA, 22 bp, Artificial Sequence
  chemically synthesized
atccatgcatctttcatccatg

SEQ ID NO: 1053235 - DNA, 22 bp, Artificial Sequence
  chemically synthesized
gtggtgactaatccatggatga

SEQ ID NO: 1053236 - DNA, 22 bp, Artificial Sequence
  chemically synthesized
agtggtgactaatccatggatg

SEQ ID NO: 1053237 - DNA, 22 bp, Artificial Sequence
  chemically synthesized
tatttagtggtgactaatccat

SEQ ID NO: 1053238 - DNA, 22 bp, Artificial Sequence
  chemically synthesized
tcatccatggattagtcaccac

SEQ ID NO: 1053239 - DNA, 22 bp, Artificial Sequence
  chemically synthesized
catccatggattagtcaccact

SEQ ID NO: 1053240 - DNA, 22 bp, Artificial Sequence
  chemically synthesized
atccatggattagtcaccacta

SEQ ID NO: 1053241 - DNA, 22 bp, Artificial Sequence
  chemically synthesized
gtcaccactaaatatagctttc

SEQ ID NO: 1053242 - DNA, 22 bp, Artificial Sequence
  chemically synthesized
acgcatgtaaaacagaggaaag

SEQ ID NO: 1053243 - DNA, 22 bp, Artificial Sequence
  chemically synthesized
aacgcatgtaaaacagaggaaa

SEQ ID NO: 1053244 - DNA, 22 bp, Artificial Sequence
  chemically synthesized
taacgcatgtaaaacagaggaa

SEQ ID NO: 1053245 - DNA, 22 bp, Artificial Sequence
  chemically synthesized
aatatagctttcctctgtttta

SEQ ID NO: 1053246 - DNA, 22 bp, Artificial Sequence
  chemically synthesized
ttttaacgcatgtaaaacagag

SEQ ID NO: 1053247 - DNA, 22 bp, Artificial Sequence
  chemically synthesized
aatagctattttaacgcatgta

SEQ ID NO: 1053248 - DNA, 22 bp, Artificial Sequence
  chemically synthesized
tcctctgttttacatgcgttaa

SEQ ID NO: 1053249 - DNA, 22 bp, Artificial Sequence
  chemically synthesized
cctctgttttacatgcgttaaa

SEQ ID NO: 1053250 - DNA, 22 bp, Artificial Sequence
  chemically synthesized
ctaaatagctattttaacgcat

SEQ ID NO: 1053251 - DNA, 22 bp, Artificial Sequence
  chemically synthesized
ctctgttttacatgcgttaaaa

SEQ ID NO: 1053252 - DNA, 22 bp, Artificial Sequence
  chemically synthesized
tgttttacatgcgttaaaatag

SEQ ID NO: 1053253 - DNA, 22 bp, Artificial Sequence
  chemically synthesized
ttttacatgcgttaaaatagct

SEQ ID NO: 1053254 - DNA, 22 bp, Artificial Sequence
  chemically synthesized
aaattcctaaatagctatttta

SEQ ID NO: 1053255 - DNA, 22 bp, Artificial Sequence
  chemically synthesized
aaaattcctaaatagctatttt

SEQ ID NO: 1053256 - DNA, 22 bp, Artificial Sequence
  chemically synthesized
taaaattcctaaatagctattt

SEQ ID NO: 1053257 - DNA, 22 bp, Artificial Sequence
  chemically synthesized
tacatgcgttaaaatagctatt

SEQ ID NO: 1053258 - DNA, 22 bp, Artificial Sequence
  chemically synthesized
ttaaaattcctaaatagctatt

SEQ ID NO: 1053259 - DNA, 22 bp, Artificial Sequence
  chemically synthesized
acatgcgttaaaatagctattt

SEQ ID NO: 1053260 - DNA, 22 bp, Artificial Sequence
  chemically synthesized
catgcgttaaaatagctattta

SEQ ID NO: 1053261 - DNA, 22 bp, Artificial Sequence
  chemically synthesized
aaatagctatttaggaatttta

SEQ ID NO: 1053262 - DNA, 22 bp, Artificial Sequence
  chemically synthesized
taatcatgagcagtttttaaaa

SEQ ID NO: 1053263 - DNA, 22 bp, Artificial Sequence
  chemically synthesized
tttaggaattttaaaaactgct

SEQ ID NO: 1053264 - DNA, 22 bp, Artificial Sequence
  chemically synthesized
aggaattttaaaaactgctcat

SEQ ID NO: 1053265 - DNA, 22 bp, Artificial Sequence
  chemically synthesized
ggaattttaaaaactgctcatg

SEQ ID NO: 1053266 - DNA, 22 bp, Artificial Sequence
  chemically synthesized
gcaccatatgctataatcatga

SEQ ID NO: 1053267 - DNA, 22 bp, Artificial Sequence
  chemically synthesized
agcaccatatgctataatcatg

SEQ ID NO: 1053268 - DNA, 22 bp, Artificial Sequence
  chemically synthesized
taaaaactgctcatgattatag

SEQ ID NO: 1053269 - DNA, 22 bp, Artificial Sequence
  chemically synthesized
aaaaactgctcatgattatagc

SEQ ID NO: 1053270 - DNA, 22 bp, Artificial Sequence
  chemically synthesized
aaaactgctcatgattatagca

SEQ ID NO: 1053271 - DNA, 22 bp, Artificial Sequence
  chemically synthesized
aaatttagcaccatatgctata

SEQ ID NO: 1053272 - DNA, 22 bp, Artificial Sequence
  chemically synthesized
tcaaatttagcaccatatgcta

SEQ ID NO: 1053273 - DNA, 22 bp, Artificial Sequence
  chemically synthesized
ctcatgattatagcatatggtg

SEQ ID NO: 1053274 - DNA, 22 bp, Artificial Sequence
  chemically synthesized
atgattatagcatatggtgcta

SEQ ID NO: 1053275 - DNA, 22 bp, Artificial Sequence
  chemically synthesized
cattctcaaatttagcaccata

SEQ ID NO: 1053276 - DNA, 22 bp, Artificial Sequence
  chemically synthesized
attgcattctcaaatttagcac

SEQ ID NO: 1053277 - DNA, 22 bp, Artificial Sequence
  chemically synthesized
tagcatatggtgctaaatttga

SEQ ID NO: 1053278 - DNA, 22 bp, Artificial Sequence
  chemically synthesized
aatggaagtccgaattgattgc

SEQ ID NO: 1053279 - DNA, 22 bp, Artificial Sequence
  chemically synthesized
aatttgagaatgcaatcaattc

SEQ ID NO: 1053280 - DNA, 22 bp, Artificial Sequence
  chemically synthesized
gagaatgcaatcaattcggact

SEQ ID NO: 1053281 - DNA, 22 bp, Artificial Sequence
  chemically synthesized
agaatgcaatcaattcggactt

SEQ ID NO: 1053282 - DNA, 22 bp, Artificial Sequence
  chemically synthesized
gtaacagccaagagaactaaat

SEQ ID NO: 1053283 - DNA, 22 bp, Artificial Sequence
  chemically synthesized
agtaacagccaagagaactaaa

SEQ ID NO: 1053284 - DNA, 22 bp, Artificial Sequence
  chemically synthesized
ggacttccatttagttctcttg

SEQ ID NO: 1053285 - DNA, 22 bp, Artificial Sequence
  chemically synthesized
ccatttagttctcttggctgtt

SEQ ID NO: 1053286 - DNA, 22 bp, Artificial Sequence
  chemically synthesized
catttagttctcttggctgtta

SEQ ID NO: 1053287 - DNA, 22 bp, Artificial Sequence
  chemically synthesized
gcacccatttagtaacagccaa

SEQ ID NO: 1053288 - DNA, 22 bp, Artificial Sequence
  chemically synthesized
agcacccatttagtaacagcca

SEQ ID NO: 1053289 - DNA, 22 bp, Artificial Sequence
  chemically synthesized
agttctcttggctgttactaaa

SEQ ID NO: 1053290 - DNA, 22 bp, Artificial Sequence
  chemically synthesized
gttctcttggctgttactaaat

SEQ ID NO: 1053291 - DNA, 22 bp, Artificial Sequence
  chemically synthesized
tcttggctgttactaaatgggt

SEQ ID NO: 1053292 - DNA, 22 bp, Artificial Sequence
  chemically synthesized
agtatagtttagcacccattta

SEQ ID NO: 1053293 - DNA, 22 bp, Artificial Sequence
  chemically synthesized
ttggctgttactaaatgggtgc

SEQ ID NO: 1053294 - DNA, 22 bp, Artificial Sequence
  chemically synthesized
gagtatagtttagcacccattt

SEQ ID NO: 1053295 - DNA, 22 bp, Artificial Sequence
  chemically synthesized
tgagtatagtttagcacccatt

SEQ ID NO: 1053296 - DNA, 22 bp, Artificial Sequence
  chemically synthesized
ggctgttactaaatgggtgcta

SEQ ID NO: 1053297 - DNA, 22 bp, Artificial Sequence
  chemically synthesized
ttgagtatagtttagcacccat

SEQ ID NO: 1053298 - DNA, 22 bp, Artificial Sequence
  chemically synthesized
gctgttactaaatgggtgctaa

SEQ ID NO: 1053299 - DNA, 22 bp, Artificial Sequence
  chemically synthesized
ttactaaatgggtgctaaacta

SEQ ID NO: 1053300 - DNA, 22 bp, Artificial Sequence
  chemically synthesized
atcttttgagtatagtttagca

SEQ ID NO: 1053301 - DNA, 22 bp, Artificial Sequence
  chemically synthesized
aatcttttgagtatagtttagc

SEQ ID NO: 1053302 - DNA, 22 bp, Artificial Sequence
  chemically synthesized
ctaaatgggtgctaaactatac

SEQ ID NO: 1053303 - DNA, 22 bp, Artificial Sequence
  chemically synthesized
tttaatcttttgagtatagttt

SEQ ID NO: 1053304 - DNA, 22 bp, Artificial Sequence
  chemically synthesized
atttaatcttttgagtatagtt

SEQ ID NO: 1053305 - DNA, 22 bp, Artificial Sequence
  chemically synthesized
aatgggtgctaaactatactca

SEQ ID NO: 1053306 - DNA, 22 bp, Artificial Sequence
  chemically synthesized
tatttaatcttttgagtatagt

SEQ ID NO: 1053307 - DNA, 22 bp, Artificial Sequence
  chemically synthesized
ccctttatttaatcttttgagt

SEQ ID NO: 1053308 - DNA, 22 bp, Artificial Sequence
  chemically synthesized
accctttatttaatcttttgag

SEQ ID NO: 1053309 - DNA, 22 bp, Artificial Sequence
  chemically synthesized
taccctttatttaatcttttga

SEQ ID NO: 1053310 - DNA, 22 bp, Artificial Sequence
  chemically synthesized
ttaccctttatttaatcttttg

SEQ ID NO: 1053311 - DNA, 22 bp, Artificial Sequence
  chemically synthesized
aactatactcaaaagattaaat

SEQ ID NO: 1053312 - DNA, 22 bp, Artificial Sequence
  chemically synthesized
tcatttttaccctttatttaat

SEQ ID NO: 1053313 - DNA, 22 bp, Artificial Sequence
  chemically synthesized
tactcaaaagattaaataaagg

SEQ ID NO: 1053314 - DNA, 22 bp, Artificial Sequence
  chemically synthesized
tatcatttttaccctttattta

SEQ ID NO: 1053315 - DNA, 22 bp, Artificial Sequence
  chemically synthesized
aaaagattaaataaagggtaaa

SEQ ID NO: 1053316 - DNA, 22 bp, Artificial Sequence
  chemically synthesized
aaaacattctatcatttttacc

SEQ ID NO: 1053317 - DNA, 22 bp, Artificial Sequence
  chemically synthesized
aaaaacattctatcatttttac

SEQ ID NO: 1053318 - DNA, 22 bp, Artificial Sequence
  chemically synthesized
cttaaaaacattctatcatttt

SEQ ID NO: 1053319 - DNA, 22 bp, Artificial Sequence
  chemically synthesized
aataaagggtaaaaatgataga

SEQ ID NO: 1053320 - DNA, 22 bp, Artificial Sequence
  chemically synthesized
gcttaaaaacattctatcattt

SEQ ID NO: 1053321 - DNA, 22 bp, Artificial Sequence
  chemically synthesized
tgcttaaaaacattctatcatt

SEQ ID NO: 1053322 - DNA, 22 bp, Artificial Sequence
  chemically synthesized
taacataattttgcttaaaaac

SEQ ID NO: 1053323 - DNA, 22 bp, Artificial Sequence
  chemically synthesized
atgttataacataattttgctt

SEQ ID NO: 1053324 - DNA, 22 bp, Artificial Sequence
  chemically synthesized
gatgttataacataattttgct

SEQ ID NO: 1053325 - DNA, 22 bp, Artificial Sequence
  chemically synthesized
ttaagcaaaattatgttataac

SEQ ID NO: 1053326 - DNA, 22 bp, Artificial Sequence
  chemically synthesized
taagcaaaattatgttataaca

SEQ ID NO: 1053327 - DNA, 22 bp, Artificial Sequence
  chemically synthesized
acatagccttgatgttataaca

SEQ ID NO: 1053328 - DNA, 22 bp, Artificial Sequence
  chemically synthesized
aagcaaaattatgttataacat

SEQ ID NO: 1053329 - DNA, 22 bp, Artificial Sequence
  chemically synthesized
agcaaaattatgttataacatc

SEQ ID NO: 1053330 - DNA, 22 bp, Artificial Sequence
  chemically synthesized
tgttataacatcaaggctatgt

SEQ ID NO: 1053331 - DNA, 22 bp, Artificial Sequence
  chemically synthesized
tgaataatacaaattcacatag

SEQ ID NO: 1053332 - DNA, 22 bp, Artificial Sequence
  chemically synthesized
taacatcaaggctatgtgaatt

SEQ ID NO: 1053333 - DNA, 22 bp, Artificial Sequence
  chemically synthesized
atgaataatacaaattcacata

SEQ ID NO: 1053334 - DNA, 22 bp, Artificial Sequence
  chemically synthesized
tatgaataatacaaattcacat

SEQ ID NO: 1053335 - DNA, 22 bp, Artificial Sequence
  chemically synthesized
gttttatgaataatacaaattc

SEQ ID NO: 1053336 - DNA, 22 bp, Artificial Sequence
  chemically synthesized
agttttatgaataatacaaatt

SEQ ID NO: 1053337 - DNA, 22 bp, Artificial Sequence
  chemically synthesized
aaatttagttttatgaataata

SEQ ID NO: 1053338 - DNA, 22 bp, Artificial Sequence
  chemically synthesized
aaaatttagttttatgaataat

SEQ ID NO: 1053339 - DNA, 22 bp, Artificial Sequence
  chemically synthesized
tgtgaatttgtattattcataa

SEQ ID NO: 1053340 - DNA, 22 bp, Artificial Sequence
  chemically synthesized
tttaaaatttagttttatgaat

SEQ ID NO: 1053341 - DNA, 22 bp, Artificial Sequence
  chemically synthesized
gtttaaaatttagttttatgaa

SEQ ID NO: 1053342 - DNA, 22 bp, Artificial Sequence
  chemically synthesized
gtattattcataaaactaaatt

SEQ ID NO: 1053343 - DNA, 22 bp, Artificial Sequence
  chemically synthesized
aggtttgtttaaaatttagttt

SEQ ID NO: 1053344 - DNA, 22 bp, Artificial Sequence
  chemically synthesized
tattattcataaaactaaattt

SEQ ID NO: 1053345 - DNA, 22 bp, Artificial Sequence
  chemically synthesized
ttcataaaactaaattttaaac

SEQ ID NO: 1053346 - DNA, 22 bp, Artificial Sequence
  chemically synthesized
ataaaactaaattttaaacaaa

SEQ ID NO: 1053347 - DNA, 22 bp, Artificial Sequence
  chemically synthesized
aaataattaaggtttgtttaaa

SEQ ID NO: 1053348 - DNA, 22 bp, Artificial Sequence
  chemically synthesized
gaaataattaaggtttgtttaa

SEQ ID NO: 1053349 - DNA, 22 bp, Artificial Sequence
  chemically synthesized
tgaaataattaaggtttgttta

SEQ ID NO: 1053350 - DNA, 22 bp, Artificial Sequence
  chemically synthesized
ttgaaataattaaggtttgttt

SEQ ID NO: 1053351 - DNA, 22 bp, Artificial Sequence
  chemically synthesized
cttttgaaataattaaggtttg

SEQ ID NO: 1053352 - DNA, 22 bp, Artificial Sequence
  chemically synthesized
aattttaaacaaaccttaatta

SEQ ID NO: 1053353 - DNA, 22 bp, Artificial Sequence
  chemically synthesized
taaacaaaccttaattatttca

SEQ ID NO: 1053354 - DNA, 22 bp, Artificial Sequence
  chemically synthesized
aaacaaaccttaattatttcaa

SEQ ID NO: 1053355 - DNA, 22 bp, Artificial Sequence
  chemically synthesized
aacaaaccttaattatttcaaa

SEQ ID NO: 1053356 - DNA, 22 bp, Artificial Sequence
  chemically synthesized
tgatccagttgcttttgaaata

SEQ ID NO: 1053357 - DNA, 22 bp, Artificial Sequence
  chemically synthesized
atgatccagttgcttttgaaat

SEQ ID NO: 1053358 - DNA, 22 bp, Artificial Sequence
  chemically synthesized
tatgatccagttgcttttgaaa

SEQ ID NO: 1053359 - DNA, 22 bp, Artificial Sequence
  chemically synthesized
ctttatgatccagttgcttttg

SEQ ID NO: 1053360 - DNA, 22 bp, Artificial Sequence
  chemically synthesized
aattatttcaaaagcaactgga

SEQ ID NO: 1053361 - DNA, 22 bp, Artificial Sequence
  chemically synthesized
attatttcaaaagcaactggat

SEQ ID NO: 1053362 - DNA, 22 bp, Artificial Sequence
  chemically synthesized
ccctcctttatgatccagttgc

SEQ ID NO: 1053363 - DNA, 22 bp, Artificial Sequence
  chemically synthesized
ctgccctcctttatgatccagt

SEQ ID NO: 1053364 - DNA, 22 bp, Artificial Sequence
  chemically synthesized
tttcaaaagcaactggatcata

SEQ ID NO: 1053365 - DNA, 22 bp, Artificial Sequence
  chemically synthesized
tcctgccctcctttatgatcca

SEQ ID NO: 1053366 - DNA, 22 bp, Artificial Sequence
  chemically synthesized
caaaagcaactggatcataaag

SEQ ID NO: 1053367 - DNA, 22 bp, Artificial Sequence
  chemically synthesized
aaaagcaactggatcataaagg

SEQ ID NO: 1053368 - DNA, 22 bp, Artificial Sequence
  chemically synthesized
ataattctcctgccctccttta

SEQ ID NO: 1053369 - DNA, 22 bp, Artificial Sequence
  chemically synthesized
tctgataattctcctgccctcc

SEQ ID NO: 1053370 - DNA, 22 bp, Artificial Sequence
  chemically synthesized
gatcataaaggagggcaggaga

SEQ ID NO: 1053371 - DNA, 22 bp, Artificial Sequence
  chemically synthesized
gtaagttatctgataattctcc

SEQ ID NO: 1053372 - DNA, 22 bp, Artificial Sequence
  chemically synthesized
aagttggtaagttatctgataa

SEQ ID NO: 1053373 - DNA, 22 bp, Artificial Sequence
  chemically synthesized
caagttggtaagttatctgata

SEQ ID NO: 1053374 - DNA, 22 bp, Artificial Sequence
  chemically synthesized
tcaagttggtaagttatctgat

SEQ ID NO: 1053375 - DNA, 22 bp, Artificial Sequence
  chemically synthesized
taatattttcaagttggtaagt

SEQ ID NO: 1053376 - DNA, 22 bp, Artificial Sequence
  chemically synthesized
tcagataacttaccaacttgaa

SEQ ID NO: 1053377 - DNA, 22 bp, Artificial Sequence
  chemically synthesized
accaacttgaaaatattataat

SEQ ID NO: 1053378 - DNA, 22 bp, Artificial Sequence
  chemically synthesized
ccaacttgaaaatattataatc

SEQ ID NO: 1053379 - DNA, 22 bp, Artificial Sequence
  chemically synthesized
acaaaataaaaggattataata

SEQ ID NO: 1053380 - DNA, 22 bp, Artificial Sequence
  chemically synthesized
cacaaaataaaaggattataat

SEQ ID NO: 1053381 - DNA, 22 bp, Artificial Sequence
  chemically synthesized
tcacaaaataaaaggattataa

SEQ ID NO: 1053382 - DNA, 22 bp, Artificial Sequence
  chemically synthesized
attttcacaaaataaaaggatt

SEQ ID NO: 1053383 - DNA, 22 bp, Artificial Sequence
  chemically synthesized
gaaaatattataatccttttat

SEQ ID NO: 1053384 - DNA, 22 bp, Artificial Sequence
  chemically synthesized
gattttcacaaaataaaaggat

SEQ ID NO: 1053385 - DNA, 22 bp, Artificial Sequence
  chemically synthesized
aaaatattataatccttttatt

SEQ ID NO: 1053386 - DNA, 22 bp, Artificial Sequence
  chemically synthesized
tgattttcacaaaataaaagga

SEQ ID NO: 1053387 - DNA, 22 bp, Artificial Sequence
  chemically synthesized
cactttgattttcacaaaataa

SEQ ID NO: 1053388 - DNA, 22 bp, Artificial Sequence
  chemically synthesized
ccactttgattttcacaaaata

SEQ ID NO: 1053389 - DNA, 22 bp, Artificial Sequence
  chemically synthesized
tccactttgattttcacaaaat

SEQ ID NO: 1053390 - DNA, 22 bp, Artificial Sequence
  chemically synthesized
taatccttttattttgtgaaaa

SEQ ID NO: 1053391 - DNA, 22 bp, Artificial Sequence
  chemically synthesized
ttttccactttgattttcacaa

SEQ ID NO: 1053392 - DNA, 22 bp, Artificial Sequence
  chemically synthesized
ttattttgtgaaaatcaaagtg

SEQ ID NO: 1053393 - DNA, 22 bp, Artificial Sequence
  chemically synthesized
tattttgtgaaaatcaaagtgg

SEQ ID NO: 1053394 - DNA, 22 bp, Artificial Sequence
  chemically synthesized
attttgtgaaaatcaaagtgga

SEQ ID NO: 1053395 - DNA, 22 bp, Artificial Sequence
  chemically synthesized
ttttgtgaaaatcaaagtggaa

SEQ ID NO: 1053396 - DNA, 22 bp, Artificial Sequence
  chemically synthesized
aagtgtatattgttttccactt

SEQ ID NO: 1053397 - DNA, 22 bp, Artificial Sequence
  chemically synthesized
tgtgaaaatcaaagtggaaaac

SEQ ID NO: 1053398 - DNA, 22 bp, Artificial Sequence
  chemically synthesized
gtgaaaatcaaagtggaaaaca

SEQ ID NO: 1053399 - DNA, 22 bp, Artificial Sequence
  chemically synthesized
tgaaaatcaaagtggaaaacaa

SEQ ID NO: 1053400 - DNA, 22 bp, Artificial Sequence
  chemically synthesized
ttcaagtgtatattgttttcca

SEQ ID NO: 1053401 - DNA, 22 bp, Artificial Sequence
  chemically synthesized
agaacagatgaataaaatctat

SEQ ID NO: 1053402 - DNA, 22 bp, Artificial Sequence
  chemically synthesized
tgagaacagatgaataaaatct

SEQ ID NO: 1053403 - DNA, 22 bp, Artificial Sequence
  chemically synthesized
gaatagattttattcatctgtt

SEQ ID NO: 1053404 - DNA, 22 bp, Artificial Sequence
  chemically synthesized
aatagattttattcatctgttc

SEQ ID NO: 1053405 - DNA, 22 bp, Artificial Sequence
  chemically synthesized
tatggaacatattctgagaaca

SEQ ID NO: 1053406 - DNA, 22 bp, Artificial Sequence
  chemically synthesized
tattcatctgttctcagaatat

SEQ ID NO: 1053407 - DNA, 22 bp, Artificial Sequence
  chemically synthesized
attgtatggaacatattctgag

SEQ ID NO: 1053408 - DNA, 22 bp, Artificial Sequence
  chemically synthesized
attcatctgttctcagaatatg

SEQ ID NO: 1053409 - DNA, 22 bp, Artificial Sequence
  chemically synthesized
ttcatctgttctcagaatatgt

SEQ ID NO: 1053410 - DNA, 22 bp, Artificial Sequence
  chemically synthesized
tcattgtatggaacatattctg

SEQ ID NO: 1053411 - DNA, 22 bp, Artificial Sequence
  chemically synthesized
atctgttctcagaatatgttcc

SEQ ID NO: 1053412 - DNA, 22 bp, Artificial Sequence
  chemically synthesized
agactctcattgtatggaacat

SEQ ID NO: 1053413 - DNA, 22 bp, Artificial Sequence
  chemically synthesized
aagactctcattgtatggaaca

SEQ ID NO: 1053414 - DNA, 22 bp, Artificial Sequence
  chemically synthesized
ttctcagaatatgttccataca

SEQ ID NO: 1053415 - DNA, 22 bp, Artificial Sequence
  chemically synthesized
cttaagactctcattgtatgga

SEQ ID NO: 1053416 - DNA, 22 bp, Artificial Sequence
  chemically synthesized
tcagaatatgttccatacaatg

SEQ ID NO: 1053417 - DNA, 22 bp, Artificial Sequence
  chemically synthesized
agaatatgttccatacaatgag

SEQ ID NO: 1053418 - DNA, 22 bp, Artificial Sequence
  chemically synthesized
aatgattacttaagactctcat

SEQ ID NO: 1053419 - DNA, 22 bp, Artificial Sequence
  chemically synthesized
caatgattacttaagactctca

SEQ ID NO: 1053420 - DNA, 22 bp, Artificial Sequence
  chemically synthesized
ttcaatgattacttaagactct

SEQ ID NO: 1053421 - DNA, 22 bp, Artificial Sequence
  chemically synthesized
catacaatgagagtcttaagta

SEQ ID NO: 1053422 - DNA, 22 bp, Artificial Sequence
  chemically synthesized
attcttcaatgattacttaaga

SEQ ID NO: 1053423 - DNA, 22 bp, Artificial Sequence
  chemically synthesized
tgattcttcaatgattacttaa

SEQ ID NO: 1053424 - DNA, 22 bp, Artificial Sequence
  chemically synthesized
tgaatcattctgattcttcaat

SEQ ID NO: 1053425 - DNA, 22 bp, Artificial Sequence
  chemically synthesized
aagtaatcattgaagaatcaga

SEQ ID NO: 1053426 - DNA, 22 bp, Artificial Sequence
  chemically synthesized
agtaatcattgaagaatcagaa

SEQ ID NO: 1053427 - DNA, 22 bp, Artificial Sequence
  chemically synthesized
caccatctgtgaatcattctga

SEQ ID NO: 1053428 - DNA, 22 bp, Artificial Sequence
  chemically synthesized
gcaccatctgtgaatcattctg

SEQ ID NO: 1053429 - DNA, 22 bp, Artificial Sequence
  chemically synthesized
aagaatcagaatgattcacaga

SEQ ID NO: 1053430 - DNA, 22 bp, Artificial Sequence
  chemically synthesized
aatcacttgcaccatctgtgaa

SEQ ID NO: 1053431 - DNA, 22 bp, Artificial Sequence
  chemically synthesized
aaaataattaaatcacttgcac

SEQ ID NO: 1053432 - DNA, 22 bp, Artificial Sequence
  chemically synthesized
gttaaaaataattaaatcactt

SEQ ID NO: 1053433 - DNA, 22 bp, Artificial Sequence
  chemically synthesized
acagatggtgcaagtgatttaa

SEQ ID NO: 1053434 - DNA, 22 bp, Artificial Sequence
  chemically synthesized
agcatgtccagaacaactggtt

SEQ ID NO: 1053435 - DNA, 22 bp, Artificial Sequence
  chemically synthesized
aattatttttaaccagttgttc

SEQ ID NO: 1053436 - DNA, 22 bp, Artificial Sequence
  chemically synthesized
tgagcatgtccagaacaactgg

SEQ ID NO: 1053437 - DNA, 22 bp, Artificial Sequence
  chemically synthesized
attatttttaaccagttgttct

SEQ ID NO: 1053438 - DNA, 22 bp, Artificial Sequence
  chemically synthesized
ctgagcatgtccagaacaactg

SEQ ID NO: 1053439 - DNA, 22 bp, Artificial Sequence
  chemically synthesized
tttttaaccagttgttctggac

SEQ ID NO: 1053440 - DNA, 22 bp, Artificial Sequence
  chemically synthesized
ttaaccagttgttctggacatg

SEQ ID NO: 1053441 - DNA, 22 bp, Artificial Sequence
  chemically synthesized
taaccagttgttctggacatgc

SEQ ID NO: 1053442 - DNA, 22 bp, Artificial Sequence
  chemically synthesized
aaccagttgttctggacatgct

SEQ ID NO: 1053443 - DNA, 22 bp, Artificial Sequence
  chemically synthesized
accagttgttctggacatgctc

SEQ ID NO: 1053444 - DNA, 22 bp, Artificial Sequence
  chemically synthesized
gaaatatccttctgagcatgtc

SEQ ID NO: 1053445 - DNA, 22 bp, Artificial Sequence
  chemically synthesized
ttctggacatgctcagaaggat

SEQ ID NO: 1053446 - DNA, 22 bp, Artificial Sequence
  chemically synthesized
tggacatgctcagaaggatatt

SEQ ID NO: 1053447 - DNA, 22 bp, Artificial Sequence
  chemically synthesized
cagtggggttggaaatatcctt

SEQ ID NO: 1053448 - DNA, 22 bp, Artificial Sequence
  chemically synthesized
gacatgctcagaaggatatttc

SEQ ID NO: 1053449 - DNA, 22 bp, Artificial Sequence
  chemically synthesized
tgcagtggggttggaaatatcc

SEQ ID NO: 1053450 - DNA, 22 bp, Artificial Sequence
  chemically synthesized
ctgcagtggggttggaaatatc

SEQ ID NO: 1053451 - DNA, 22 bp, Artificial Sequence
  chemically synthesized
agaaggatatttccaaccccac

SEQ ID NO: 1053452 - DNA, 22 bp, Artificial Sequence
  chemically synthesized
agatggcttctgcagtggggtt

SEQ ID NO: 1053453 - DNA, 22 bp, Artificial Sequence
  chemically synthesized
ccaaccccactgcagaagccat

SEQ ID NO: 1053454 - DNA, 22 bp, Artificial Sequence
  chemically synthesized
caaccccactgcagaagccatc

SEQ ID NO: 1053455 - DNA, 22 bp, Artificial Sequence
  chemically synthesized
gaagggagctcagatggcttct

SEQ ID NO: 1053456 - DNA, 22 bp, Artificial Sequence
  chemically synthesized
cagaagccatctgagctccctt

SEQ ID NO: 1053457 - DNA, 22 bp, Artificial Sequence
  chemically synthesized
aaaatatggaacaccagctgga

SEQ ID NO: 1053458 - DNA, 22 bp, Artificial Sequence
  chemically synthesized
gaaaatatggaacaccagctgg

SEQ ID NO: 1053459 - DNA, 22 bp, Artificial Sequence
  chemically synthesized
tgaaaatatggaacaccagctg

SEQ ID NO: 1053460 - DNA, 22 bp, Artificial Sequence
  chemically synthesized
agctcccttccagctggtgttc

SEQ ID NO: 1053461 - DNA, 22 bp, Artificial Sequence
  chemically synthesized
ctttgaaaatatggaacaccag

SEQ ID NO: 1053462 - DNA, 22 bp, Artificial Sequence
  chemically synthesized
gctttgaaaatatggaacacca

SEQ ID NO: 1053463 - DNA, 22 bp, Artificial Sequence
  chemically synthesized
ccttccagctggtgttccatat

SEQ ID NO: 1053464 - DNA, 22 bp, Artificial Sequence
  chemically synthesized
aatttgctttgaaaatatggaa

SEQ ID NO: 1053465 - DNA, 22 bp, Artificial Sequence
  chemically synthesized
ccagctggtgttccatattttc

SEQ ID NO: 1053466 - DNA, 22 bp, Artificial Sequence
  chemically synthesized
cagctggtgttccatattttca

SEQ ID NO: 1053467 - DNA, 22 bp, Artificial Sequence
  chemically synthesized
caatctaaatttgctttgaaaa

SEQ ID NO: 1053468 - DNA, 22 bp, Artificial Sequence
  chemically synthesized
gtgttccatattttcaaagcaa

SEQ ID NO: 1053469 - DNA, 22 bp, Artificial Sequence
  chemically synthesized
tccaatctaaatttgctttgaa

SEQ ID NO: 1053470 - DNA, 22 bp, Artificial Sequence
  chemically synthesized
ctccaatctaaatttgctttga

SEQ ID NO: 1053471 - DNA, 22 bp, Artificial Sequence
  chemically synthesized
tctccaatctaaatttgctttg

SEQ ID NO: 1053472 - DNA, 22 bp, Artificial Sequence
  chemically synthesized
catattttcaaagcaaatttag

SEQ ID NO: 1053473 - DNA, 22 bp, Artificial Sequence
  chemically synthesized
tcaaagcaaatttagattggag

SEQ ID NO: 1053474 - DNA, 22 bp, Artificial Sequence
  chemically synthesized
caaagcaaatttagattggaga

SEQ ID NO: 1053475 - DNA, 22 bp, Artificial Sequence
  chemically synthesized
aaagcaaatttagattggagaa

SEQ ID NO: 1053476 - DNA, 22 bp, Artificial Sequence
  chemically synthesized
agattggagaaaattacacttt

SEQ ID NO: 1053477 - DNA, 22 bp, Artificial Sequence
  chemically synthesized
gattggagaaaattacacttta

SEQ ID NO: 1053478 - DNA, 22 bp, Artificial Sequence
  chemically synthesized
caacacaacaatataaagtgta

SEQ ID NO: 1053479 - DNA, 22 bp, Artificial Sequence
  chemically synthesized
gcaacacaacaatataaagtgt

SEQ ID NO: 1053480 - DNA, 22 bp, Artificial Sequence
  chemically synthesized
gagaaaattacactttatattg

SEQ ID NO: 1053481 - DNA, 22 bp, Artificial Sequence
  chemically synthesized
cgtttgcaacacaacaatataa

SEQ ID NO: 1053482 - DNA, 22 bp, Artificial Sequence
  chemically synthesized
acctccgtttgcaacacaacaa

SEQ ID NO: 1053483 - DNA, 22 bp, Artificial Sequence
  chemically synthesized
gacctccgtttgcaacacaaca

SEQ ID NO: 1053484 - DNA, 22 bp, Artificial Sequence
  chemically synthesized
cactttatattgttgtgttgca

SEQ ID NO: 1053485 - DNA, 22 bp, Artificial Sequence
  chemically synthesized
tatattgttgtgttgcaaacgg

SEQ ID NO: 1053486 - DNA, 22 bp, Artificial Sequence
  chemically synthesized
atattgttgtgttgcaaacgga

SEQ ID NO: 1053487 - DNA, 22 bp, Artificial Sequence
  chemically synthesized
tattgttgtgttgcaaacggag

SEQ ID NO: 1053488 - DNA, 22 bp, Artificial Sequence
  chemically synthesized
tacacagcaatttgacctccgt

SEQ ID NO: 1053489 - DNA, 22 bp, Artificial Sequence
  chemically synthesized
ttgtgttgcaaacggaggtcaa

SEQ ID NO: 1053490 - DNA, 22 bp, Artificial Sequence
  chemically synthesized
atacacagcaatttgacctccg

SEQ ID NO: 1053491 - DNA, 22 bp, Artificial Sequence
  chemically synthesized
tgttgcaaacggaggtcaaatt

SEQ ID NO: 1053492 - DNA, 22 bp, Artificial Sequence
  chemically synthesized
caaacggaggtcaaattgctgt

SEQ ID NO: 1053493 - DNA, 22 bp, Artificial Sequence
  chemically synthesized
ctgtgtataaattcttgttctt

SEQ ID NO: 1053494 - DNA, 22 bp, Artificial Sequence
  chemically synthesized
tgtataaattcttgttcttttt

SEQ ID NO: 1053495 - DNA, 22 bp, Artificial Sequence
  chemically synthesized
atacaatgaagaaaaaaaagaa

SEQ ID NO: 1053496 - DNA, 22 bp, Artificial Sequence
  chemically synthesized
ttgttcttttttttcttcattg

SEQ ID NO: 1053497 - DNA, 22 bp, Artificial Sequence
  chemically synthesized
gttcttttttttcttcattgta

SEQ ID NO: 1053498 - DNA, 22 bp, Artificial Sequence
  chemically synthesized
ttcttttttttcttcattgtat

SEQ ID NO: 1053499 - DNA, 22 bp, Artificial Sequence
  chemically synthesized
ataaatataactcatacaatga

SEQ ID NO: 1053500 - DNA, 22 bp, Artificial Sequence
  chemically synthesized
gataaatataactcatacaatg

SEQ ID NO: 1053501 - DNA, 22 bp, Artificial Sequence
  chemically synthesized
ttttttttcttcattgtatgag

SEQ ID NO: 1053502 - DNA, 22 bp, Artificial Sequence
  chemically synthesized
ttttttcttcattgtatgagtt

SEQ ID NO: 1053503 - DNA, 22 bp, Artificial Sequence
  chemically synthesized
tttttcttcattgtatgagtta

SEQ ID NO: 1053504 - DNA, 22 bp, Artificial Sequence
  chemically synthesized
ttttcttcattgtatgagttat

SEQ ID NO: 1053505 - DNA, 22 bp, Artificial Sequence
  chemically synthesized
tttcttcattgtatgagttata

SEQ ID NO: 1053506 - DNA, 22 bp, Artificial Sequence
  chemically synthesized
ttcttcattgtatgagttatat

SEQ ID NO: 1053507 - DNA, 22 bp, Artificial Sequence
  chemically synthesized
tcttcattgtatgagttatatt

SEQ ID NO: 1053508 - DNA, 22 bp, Artificial Sequence
  chemically synthesized
cttcattgtatgagttatattt

SEQ ID NO: 1053509 - DNA, 22 bp, Artificial Sequence
  chemically synthesized
ttcattgtatgagttatattta

SEQ ID NO: 1053510 - DNA, 22 bp, Artificial Sequence
  chemically synthesized
cattgtatgagttatatttatc

SEQ ID NO: 1053511 - DNA, 22 bp, Artificial Sequence
  chemically synthesized
attgtatgagttatatttatca

SEQ ID NO: 1053512 - DNA, 22 bp, Artificial Sequence
  chemically synthesized
tatgagttatatttatcaaata

SEQ ID NO: 1053513 - DNA, 22 bp, Artificial Sequence
  chemically synthesized
tatttatcaaatatcacgtctt

SEQ ID NO: 1053514 - DNA, 22 bp, Artificial Sequence
  chemically synthesized
atcaaatatcacgtcttttgta

SEQ ID NO: 1053515 - DNA, 22 bp, Artificial Sequence
  chemically synthesized
tcaaatatcacgtcttttgtat

SEQ ID NO: 1053516 - DNA, 22 bp, Artificial Sequence
  chemically synthesized
gcaaatccatagcaatcataca

SEQ ID NO: 1053517 - DNA, 22 bp, Artificial Sequence
  chemically synthesized
ttgtatgattgctatggatttg

SEQ ID NO: 1053518 - DNA, 22 bp, Artificial Sequence
  chemically synthesized
tgtatgattgctatggatttgc

SEQ ID NO: 1053519 - DNA, 22 bp, Artificial Sequence
  chemically synthesized
gtatgattgctatggatttgcc

SEQ ID NO: 1053520 - DNA, 22 bp, Artificial Sequence
  chemically synthesized
tatgattgctatggatttgcca

SEQ ID NO: 1053521 - DNA, 22 bp, Artificial Sequence
  chemically synthesized
ctatggatttgccaatggtatt

SEQ ID NO: 1053522 - DNA, 22 bp, Artificial Sequence
  chemically synthesized
tggatttgccaatggtatttta

SEQ ID NO: 1053523 - DNA, 22 bp, Artificial Sequence
  chemically synthesized
gccaatggtattttacgttttg

SEQ ID NO: 1053524 - DNA, 22 bp, Artificial Sequence
  chemically synthesized
ccaatggtattttacgttttgt

SEQ ID NO: 1053525 - DNA, 22 bp, Artificial Sequence
  chemically synthesized
agtgccagacaacacaaaacgt

SEQ ID NO: 1053526 - DNA, 22 bp, Artificial Sequence
  chemically synthesized
ctaagtgccagacaacacaaaa

SEQ ID NO: 1053527 - DNA, 22 bp, Artificial Sequence
  chemically synthesized
gtgcctcctaagtgccagacaa

SEQ ID NO: 1053528 - DNA, 22 bp, Artificial Sequence
  chemically synthesized
tacgttttgtgttgtctggcac

SEQ ID NO: 1053529 - DNA, 22 bp, Artificial Sequence
  chemically synthesized
acgttttgtgttgtctggcact

SEQ ID NO: 1053530 - DNA, 22 bp, Artificial Sequence
  chemically synthesized
cgttttgtgttgtctggcactt

SEQ ID NO: 1053531 - DNA, 22 bp, Artificial Sequence
  chemically synthesized
tctagtgcctcctaagtgccag

SEQ ID NO: 1053532 - DNA, 22 bp, Artificial Sequence
  chemically synthesized
atctagtgcctcctaagtgcca

SEQ ID NO: 1053533 - DNA, 22 bp, Artificial Sequence
  chemically synthesized
tgtgttgtctggcacttaggag

SEQ ID NO: 1053534 - DNA, 22 bp, Artificial Sequence
  chemically synthesized
gtgttgtctggcacttaggagg

SEQ ID NO: 1053535 - DNA, 22 bp, Artificial Sequence
  chemically synthesized
tgttgtctggcacttaggaggc

SEQ ID NO: 1053536 - DNA, 22 bp, Artificial Sequence
  chemically synthesized
tctggcacttaggaggcactag

SEQ ID NO: 1053537 - DNA, 22 bp, Artificial Sequence
  chemically synthesized
aataaacatttatctagtgcct

SEQ ID NO: 1053538 - DNA, 22 bp, Artificial Sequence
  chemically synthesized
gcacttaggaggcactagataa

SEQ ID NO: 1053539 - DNA, 22 bp, Artificial Sequence
  chemically synthesized
attgaataaacatttatctagt

SEQ ID NO: 1053540 - DNA, 22 bp, Artificial Sequence
  chemically synthesized
cattgaataaacatttatctag

SEQ ID NO: 1053541 - DNA, 22 bp, Artificial Sequence
  chemically synthesized
tcattgaataaacatttatcta

SEQ ID NO: 1053542 - DNA, 22 bp, Artificial Sequence
  chemically synthesized
tttcattgaataaacatttatc

SEQ ID NO: 1053543 - DNA, 22 bp, Artificial Sequence
  chemically synthesized
aggaggcactagataaatgttt

SEQ ID NO: 1053544 - DNA, 22 bp, Artificial Sequence
  chemically synthesized
ctttcattgaataaacatttat

SEQ ID NO: 1053545 - DNA, 22 bp, Artificial Sequence
  chemically synthesized
ggaggcactagataaatgttta

SEQ ID NO: 1053546 - DNA, 22 bp, Artificial Sequence
  chemically synthesized
gtatttctttcattgaataaac

SEQ ID NO: 1053547 - DNA, 22 bp, Artificial Sequence
  chemically synthesized
gataaatgtttattcaatgaaa

SEQ ID NO: 1053548 - DNA, 22 bp, Artificial Sequence
  chemically synthesized
aattggtatttctttcattgaa

SEQ ID NO: 1053549 - DNA, 22 bp, Artificial Sequence
  chemically synthesized
aatacactgaattggtatttct

SEQ ID NO: 1053550 - DNA, 22 bp, Artificial Sequence
  chemically synthesized
gaatacactgaattggtatttc

SEQ ID NO: 1053551 - DNA, 22 bp, Artificial Sequence
  chemically synthesized
attcaatgaaagaaataccaat

SEQ ID NO: 1053552 - DNA, 22 bp, Artificial Sequence
  chemically synthesized
tgaatacactgaattggtattt

SEQ ID NO: 1053553 - DNA, 22 bp, Artificial Sequence
  chemically synthesized
ttcaatgaaagaaataccaatt

SEQ ID NO: 1053554 - DNA, 22 bp, Artificial Sequence
  chemically synthesized
ttttgaatacactgaattggta

SEQ ID NO: 1053555 - DNA, 22 bp, Artificial Sequence
  chemically synthesized
aatgaaagaaataccaattcag

SEQ ID NO: 1053556 - DNA, 22 bp, Artificial Sequence
  chemically synthesized
attttgaatacactgaattggt

SEQ ID NO: 1053557 - DNA, 22 bp, Artificial Sequence
  chemically synthesized
tattttgaatacactgaattgg

SEQ ID NO: 1053558 - DNA, 22 bp, Artificial Sequence
  chemically synthesized
aagttttattttgaatacactg

SEQ ID NO: 1053559 - DNA, 22 bp, Artificial Sequence
  chemically synthesized
gaaataaattcaagttttattt

SEQ ID NO: 1053560 - DNA, 22 bp, Artificial Sequence
  chemically synthesized
agtgtattcaaaataaaacttg

SEQ ID NO: 1053561 - DNA, 22 bp, Artificial Sequence
  chemically synthesized
aaaataaaacttgaatttattt

SEQ ID NO: 1053562 - DNA, 22 bp, Artificial Sequence
  chemically synthesized
gtgtgagtctagaaataaattc

SEQ ID NO: 1053563 - DNA, 22 bp, Artificial Sequence
  chemically synthesized
agtgtgagtctagaaataaatt

SEQ ID NO: 1053564 - DNA, 22 bp, Artificial Sequence
  chemically synthesized
catacacttagtgtgagtctag

SEQ ID NO: 1053565 - DNA, 22 bp, Artificial Sequence
  chemically synthesized
gaatttatttctagactcacac

SEQ ID NO: 1053566 - DNA, 22 bp, Artificial Sequence
  chemically synthesized
aatttatttctagactcacact

SEQ ID NO: 1053567 - DNA, 22 bp, Artificial Sequence
  chemically synthesized
atttctagactcacactaagtg

SEQ ID NO: 1053568 - DNA, 22 bp, Artificial Sequence
  chemically synthesized
tttctagactcacactaagtgt

SEQ ID NO: 1053569 - DNA, 22 bp, Artificial Sequence
  chemically synthesized
aatggtaactccatacacttag

SEQ ID NO: 1053570 - DNA, 22 bp, Artificial Sequence
  chemically synthesized
ctagactcacactaagtgtatg

SEQ ID NO: 1053571 - DNA, 22 bp, Artificial Sequence
  chemically synthesized
tagactcacactaagtgtatgg

SEQ ID NO: 1053572 - DNA, 22 bp, Artificial Sequence
  chemically synthesized
gactcacactaagtgtatggag

SEQ ID NO: 1053573 - DNA, 22 bp, Artificial Sequence
  chemically synthesized
acactaagtgtatggagttacc

SEQ ID NO: 1053574 - DNA, 22 bp, Artificial Sequence
  chemically synthesized
agtgtatggagttaccatttaa

SEQ ID NO: 1053575 - DNA, 22 bp, Artificial Sequence
  chemically synthesized
ccaataatggtgaggatgcagt

SEQ ID NO: 1053576 - DNA, 22 bp, Artificial Sequence
  chemically synthesized
ccatttaactgcatcctcacca

SEQ ID NO: 1053577 - DNA, 22 bp, Artificial Sequence
  chemically synthesized
aactgcatcctcaccattattg

SEQ ID NO: 1053578 - DNA, 22 bp, Artificial Sequence
  chemically synthesized
atgggaacctcccaataatggt

SEQ ID NO: 1053579 - DNA, 22 bp, Artificial Sequence
  chemically synthesized
actgcatcctcaccattattgg

SEQ ID NO: 1053580 - DNA, 22 bp, Artificial Sequence
  chemically synthesized
aatgggaacctcccaataatgg

SEQ ID NO: 1053581 - DNA, 22 bp, Artificial Sequence
  chemically synthesized
taatgggaacctcccaataatg

SEQ ID NO: 1053582 - DNA, 22 bp, Artificial Sequence
  chemically synthesized
ttaatgggaacctcccaataat

SEQ ID NO: 1053583 - DNA, 22 bp, Artificial Sequence
  chemically synthesized
catcctcaccattattgggagg

SEQ ID NO: 1053584 - DNA, 22 bp, Artificial Sequence
  chemically synthesized
atttttaatgggaacctcccaa

SEQ ID NO: 1053585 - DNA, 22 bp, Artificial Sequence
  chemically synthesized
ttcatttttaatgggaacctcc

SEQ ID NO: 1053586 - DNA, 22 bp, Artificial Sequence
  chemically synthesized
gttcatttttaatgggaacctc

SEQ ID NO: 1053587 - DNA, 22 bp, Artificial Sequence
  chemically synthesized
accattattgggaggttcccat

SEQ ID NO: 1053588 - DNA, 22 bp, Artificial Sequence
  chemically synthesized
tgttcatttttaatgggaacct

SEQ ID NO: 1053589 - DNA, 22 bp, Artificial Sequence
  chemically synthesized
ttgttcatttttaatgggaacc

SEQ ID NO: 1053590 - DNA, 22 bp, Artificial Sequence
  chemically synthesized
tttgttcatttttaatgggaac

SEQ ID NO: 1053591 - DNA, 22 bp, Artificial Sequence
  chemically synthesized
ttttgttcatttttaatgggaa

SEQ ID NO: 1053592 - DNA, 22 bp, Artificial Sequence
  chemically synthesized
tttttgttcatttttaatggga

SEQ ID NO: 1053593 - DNA, 22 bp, Artificial Sequence
  chemically synthesized
ttgggaggttcccattaaaaat

SEQ ID NO: 1053594 - DNA, 22 bp, Artificial Sequence
  chemically synthesized
ctttttttgttcatttttaatg

SEQ ID NO: 1053595 - DNA, 22 bp, Artificial Sequence
  chemically synthesized
cctttttttgttcatttttaat

SEQ ID NO: 1053596 - DNA, 22 bp, Artificial Sequence
  chemically synthesized
ggaggttcccattaaaaatgaa

SEQ ID NO: 1053597 - DNA, 22 bp, Artificial Sequence
  chemically synthesized
ttcctttttttgttcattttta

SEQ ID NO: 1053598 - DNA, 22 bp, Artificial Sequence
  chemically synthesized
cttcctttttttgttcattttt

SEQ ID NO: 1053599 - DNA, 22 bp, Artificial Sequence
  chemically synthesized
gtttcttcctttttttgttcat

SEQ ID NO: 1053600 - DNA, 22 bp, Artificial Sequence
  chemically synthesized
ccattaaaaatgaacaaaaaaa

SEQ ID NO: 1053601 - DNA, 22 bp, Artificial Sequence
  chemically synthesized
cattggtttcttcctttttttg

SEQ ID NO: 1053602 - DNA, 22 bp, Artificial Sequence
  chemically synthesized
ttacattggtttcttccttttt

SEQ ID NO: 1053603 - DNA, 22 bp, Artificial Sequence
  chemically synthesized
aaaatgaacaaaaaaaggaaga

SEQ ID NO: 1053604 - DNA, 22 bp, Artificial Sequence
  chemically synthesized
attacattggtttcttcctttt

SEQ ID NO: 1053605 - DNA, 22 bp, Artificial Sequence
  chemically synthesized
tattacattggtttcttccttt

SEQ ID NO: 1053606 - DNA, 22 bp, Artificial Sequence
  chemically synthesized
ttttattacattggtttcttcc

SEQ ID NO: 1053607 - DNA, 22 bp, Artificial Sequence
  chemically synthesized
atgatgggggtagtgatcgtgg

SEQ ID NO: 1053608 - DNA, 22 bp, Artificial Sequence
  chemically synthesized
gatgatgggggtagtgatcgtg

SEQ ID NO: 1053609 - DNA, 22 bp, Artificial Sequence
  chemically synthesized
tgatgatgggggtagtgatcgt

SEQ ID NO: 1053610 - DNA, 22 bp, Artificial Sequence
  chemically synthesized
tttgatgatgggggtagtgatc

SEQ ID NO: 1053611 - DNA, 22 bp, Artificial Sequence
  chemically synthesized
ctttgatgatgggggtagtgat

SEQ ID NO: 1053612 - DNA, 22 bp, Artificial Sequence
  chemically synthesized
tctttgatgatgggggtagtga

SEQ ID NO: 1053613 - DNA, 22 bp, Artificial Sequence
  chemically synthesized
atgattttctttgatgatgggg

SEQ ID NO: 1053614 - DNA, 22 bp, Artificial Sequence
  chemically synthesized
ttgatgattttctttgatgatg

SEQ ID NO: 1053615 - DNA, 22 bp, Artificial Sequence
  chemically synthesized
gttgatgattttctttgatgat

SEQ ID NO: 1053616 - DNA, 22 bp, Artificial Sequence
  chemically synthesized
tgttgatgattttctttgatga

SEQ ID NO: 1053617 - DNA, 22 bp, Artificial Sequence
  chemically synthesized
cccccatcatcaaagaaaatca

SEQ ID NO: 1053618 - DNA, 22 bp, Artificial Sequence
  chemically synthesized
acacagagttttgttgatgatt

SEQ ID NO: 1053619 - DNA, 22 bp, Artificial Sequence
  chemically synthesized
aattaacacagagttttgttga

SEQ ID NO: 1053620 - DNA, 22 bp, Artificial Sequence
  chemically synthesized
ttgaattaacacagagttttgt

SEQ ID NO: 1053621 - DNA, 22 bp, Artificial Sequence
  chemically synthesized
attgaattaacacagagttttg

SEQ ID NO: 1053622 - DNA, 22 bp, Artificial Sequence
  chemically synthesized
cttattgaattaacacagagtt

SEQ ID NO: 1053623 - DNA, 22 bp, Artificial Sequence
  chemically synthesized
acttattgaattaacacagagt

SEQ ID NO: 1053624 - DNA, 22 bp, Artificial Sequence
  chemically synthesized
tacttattgaattaacacagag

SEQ ID NO: 1053625 - DNA, 22 bp, Artificial Sequence
  chemically synthesized
tgtgttaattcaataagtaaaa

SEQ ID NO: 1053626 - DNA, 22 bp, Artificial Sequence
  chemically synthesized
tgttaattcaataagtaaaact

SEQ ID NO: 1053627 - DNA, 22 bp, Artificial Sequence
  chemically synthesized
cagcatcaagatgtagttttac

SEQ ID NO: 1053628 - DNA, 22 bp, Artificial Sequence
  chemically synthesized
attcaataagtaaaactacatc

SEQ ID NO: 1053629 - DNA, 22 bp, Artificial Sequence
  chemically synthesized
aataagtaaaactacatcttga

SEQ ID NO: 1053630 - DNA, 22 bp, Artificial Sequence
  chemically synthesized
ggggacagggttccagcatcaa

SEQ ID NO: 1053631 - DNA, 22 bp, Artificial Sequence
  chemically synthesized
catcttgatgctggaaccctgt

SEQ ID NO: 1053632 - DNA, 22 bp, Artificial Sequence
  chemically synthesized
taaaattaggggacagggttcc

SEQ ID NO: 1053633 - DNA, 22 bp, Artificial Sequence
  chemically synthesized
gatgctggaaccctgtccccta

SEQ ID NO: 1053634 - DNA, 22 bp, Artificial Sequence
  chemically synthesized
atgctggaaccctgtcccctaa

SEQ ID NO: 1053635 - DNA, 22 bp, Artificial Sequence
  chemically synthesized
agatcctataaaattaggggac

SEQ ID NO: 1053636 - DNA, 22 bp, Artificial Sequence
  chemically synthesized
ctaagatcctataaaattaggg

SEQ ID NO: 1053637 - DNA, 22 bp, Artificial Sequence
  chemically synthesized
cctaagatcctataaaattagg

SEQ ID NO: 1053638 - DNA, 22 bp, Artificial Sequence
  chemically synthesized
gaaccctgtcccctaattttat

SEQ ID NO: 1053639 - DNA, 22 bp, Artificial Sequence
  chemically synthesized
tcccctaattttataggatctt

SEQ ID NO: 1053640 - DNA, 22 bp, Artificial Sequence
  chemically synthesized
tcaagcaggtttcctaagatcc

SEQ ID NO: 1053641 - DNA, 22 bp, Artificial Sequence
  chemically synthesized
gtcaagcaggtttcctaagatc

SEQ ID NO: 1053642 - DNA, 22 bp, Artificial Sequence
  chemically synthesized
attttataggatcttaggaaac

SEQ ID NO: 1053643 - DNA, 22 bp, Artificial Sequence
  chemically synthesized
tataggatcttaggaaacctgc

SEQ ID NO: 1053644 - DNA, 22 bp, Artificial Sequence
  chemically synthesized
ataggatcttaggaaacctgct

SEQ ID NO: 1053645 - DNA, 22 bp, Artificial Sequence
  chemically synthesized
taggatcttaggaaacctgctt

SEQ ID NO: 1053646 - DNA, 22 bp, Artificial Sequence
  chemically synthesized
aaaaggtgaaaatttgtcaagc

SEQ ID NO: 1053647 - DNA, 22 bp, Artificial Sequence
  chemically synthesized
aggaaacctgcttgacaaattt

SEQ ID NO: 1053648 - DNA, 22 bp, Artificial Sequence
  chemically synthesized
ggaaacctgcttgacaaatttt

SEQ ID NO: 1053649 - DNA, 22 bp, Artificial Sequence
  chemically synthesized
tgatagcctaaaaaggtgaaaa

SEQ ID NO: 1053650 - DNA, 22 bp, Artificial Sequence
  chemically synthesized
atgatagcctaaaaaggtgaaa

SEQ ID NO: 1053651 - DNA, 22 bp, Artificial Sequence
  chemically synthesized
cttgacaaattttcaccttttt

SEQ ID NO: 1053652 - DNA, 22 bp, Artificial Sequence
  chemically synthesized
gacaaattttcacctttttagg

SEQ ID NO: 1053653 - DNA, 22 bp, Artificial Sequence
  chemically synthesized
tccttatgatagcctaaaaagg

SEQ ID NO: 1053654 - DNA, 22 bp, Artificial Sequence
  chemically synthesized
acaaattttcacctttttaggc

SEQ ID NO: 1053655 - DNA, 22 bp, Artificial Sequence
  chemically synthesized
atccttatgatagcctaaaaag

SEQ ID NO: 1053656 - DNA, 22 bp, Artificial Sequence
  chemically synthesized
ttatccttatgatagcctaaaa

SEQ ID NO: 1053657 - DNA, 22 bp, Artificial Sequence
  chemically synthesized
tcacctttttaggctatcataa

SEQ ID NO: 1053658 - DNA, 22 bp, Artificial Sequence
  chemically synthesized
cacctttttaggctatcataag

SEQ ID NO: 1053659 - DNA, 22 bp, Artificial Sequence
  chemically synthesized
acctttttaggctatcataagg

SEQ ID NO: 1053660 - DNA, 22 bp, Artificial Sequence
  chemically synthesized
tttaggctatcataaggataag

SEQ ID NO: 1053661 - DNA, 22 bp, Artificial Sequence
  chemically synthesized
caaagggtatctcttatcctta

SEQ ID NO: 1053662 - DNA, 22 bp, Artificial Sequence
  chemically synthesized
ttaggctatcataaggataaga

SEQ ID NO: 1053663 - DNA, 22 bp, Artificial Sequence
  chemically synthesized
acaaagggtatctcttatcctt

SEQ ID NO: 1053664 - DNA, 22 bp, Artificial Sequence
  chemically synthesized
taggctatcataaggataagag

SEQ ID NO: 1053665 - DNA, 22 bp, Artificial Sequence
  chemically synthesized
tacaaagggtatctcttatcct

SEQ ID NO: 1053666 - DNA, 22 bp, Artificial Sequence
  chemically synthesized
aggctatcataaggataagaga

SEQ ID NO: 1053667 - DNA, 22 bp, Artificial Sequence
  chemically synthesized
ttacaaagggtatctcttatcc

SEQ ID NO: 1053668 - DNA, 22 bp, Artificial Sequence
  chemically synthesized
ggctatcataaggataagagat

SEQ ID NO: 1053669 - DNA, 22 bp, Artificial Sequence
  chemically synthesized
aatttttacaaagggtatctct

SEQ ID NO: 1053670 - DNA, 22 bp, Artificial Sequence
  chemically synthesized
tcataaggataagagataccct

SEQ ID NO: 1053671 - DNA, 22 bp, Artificial Sequence
  chemically synthesized
tgaagtatgcaagactaaattt

SEQ ID NO: 1053672 - DNA, 22 bp, Artificial Sequence
  chemically synthesized
tgtaaaaatttagtcttgcata

SEQ ID NO: 1053673 - DNA, 22 bp, Artificial Sequence
  chemically synthesized
cgcattatgaagtatgcaagac

SEQ ID NO: 1053674 - DNA, 22 bp, Artificial Sequence
  chemically synthesized
gtaaaaatttagtcttgcatac

SEQ ID NO: 1053675 - DNA, 22 bp, Artificial Sequence
  chemically synthesized
taaaaatttagtcttgcatact

SEQ ID NO: 1053676 - DNA, 22 bp, Artificial Sequence
  chemically synthesized
cagtcattccgcattatgaagt

SEQ ID NO: 1053677 - DNA, 22 bp, Artificial Sequence
  chemically synthesized
agtcttgcatacttcataatgc

SEQ ID NO: 1053678 - DNA, 22 bp, Artificial Sequence
  chemically synthesized
gtcttgcatacttcataatgcg

SEQ ID NO: 1053679 - DNA, 22 bp, Artificial Sequence
  chemically synthesized
atgttacagtcattccgcatta

SEQ ID NO: 1053680 - DNA, 22 bp, Artificial Sequence
  chemically synthesized
gcatacttcataatgcggaatg

SEQ ID NO: 1053681 - DNA, 22 bp, Artificial Sequence
  chemically synthesized
catacttcataatgcggaatga

SEQ ID NO: 1053682 - DNA, 22 bp, Artificial Sequence
  chemically synthesized
actgatgttacagtcattccgc

SEQ ID NO: 1053683 - DNA, 22 bp, Artificial Sequence
  chemically synthesized
gactgatgttacagtcattccg

SEQ ID NO: 1053684 - DNA, 22 bp, Artificial Sequence
  chemically synthesized
ttgactgatgttacagtcattc

SEQ ID NO: 1053685 - DNA, 22 bp, Artificial Sequence
  chemically synthesized
cttgactgatgttacagtcatt

SEQ ID NO: 1053686 - DNA, 22 bp, Artificial Sequence
  chemically synthesized
cataatgcggaatgactgtaac

SEQ ID NO: 1053687 - DNA, 22 bp, Artificial Sequence
  chemically synthesized
ataatgcggaatgactgtaaca

SEQ ID NO: 1053688 - DNA, 22 bp, Artificial Sequence
  chemically synthesized
tgtttcttgactgatgttacag

SEQ ID NO: 1053689 - DNA, 22 bp, Artificial Sequence
  chemically synthesized
cagatatcagttatgtttcttg

SEQ ID NO: 1053690 - DNA, 22 bp, Artificial Sequence
  chemically synthesized
taacatcagtcaagaaacataa

SEQ ID NO: 1053691 - DNA, 22 bp, Artificial Sequence
  chemically synthesized
gcatagtggaaatgattacaga

SEQ ID NO: 1053692 - DNA, 22 bp, Artificial Sequence
  chemically synthesized
agcatagtggaaatgattacag

SEQ ID NO: 1053693 - DNA, 22 bp, Artificial Sequence
  chemically synthesized
ttagcatagtggaaatgattac

SEQ ID NO: 1053694 - DNA, 22 bp, Artificial Sequence
  chemically synthesized
cttagcatagtggaaatgatta

SEQ ID NO: 1053695 - DNA, 22 bp, Artificial Sequence
  chemically synthesized
tcttagcatagtggaaatgatt

SEQ ID NO: 1053696 - DNA, 22 bp, Artificial Sequence
  chemically synthesized
ttcttagcatagtggaaatgat

SEQ ID NO: 1053697 - DNA, 22 bp, Artificial Sequence
  chemically synthesized
atatctgtaatcatttccacta

SEQ ID NO: 1053698 - DNA, 22 bp, Artificial Sequence
  chemically synthesized
ccttttcttagcatagtggaaa

SEQ ID NO: 1053699 - DNA, 22 bp, Artificial Sequence
  chemically synthesized
cattcccttttcttagcatagt

SEQ ID NO: 1053700 - DNA, 22 bp, Artificial Sequence
  chemically synthesized
taatcatttccactatgctaag

SEQ ID NO: 1053701 - DNA, 22 bp, Artificial Sequence
  chemically synthesized
ccattcccttttcttagcatag

SEQ ID NO: 1053702 - DNA, 22 bp, Artificial Sequence
  chemically synthesized
cttccattcccttttcttagca

SEQ ID NO: 1053703 - DNA, 22 bp, Artificial Sequence
  chemically synthesized
ccactatgctaagaaaagggaa

SEQ ID NO: 1053704 - DNA, 22 bp, Artificial Sequence
  chemically synthesized
cactatgctaagaaaagggaat

SEQ ID NO: 1053705 - DNA, 22 bp, Artificial Sequence
  chemically synthesized
tgctaagaaaagggaatggaag

SEQ ID NO: 1053706 - DNA, 22 bp, Artificial Sequence
  chemically synthesized
agaaaagggaatggaaggaata

SEQ ID NO: 1053707 - DNA, 22 bp, Artificial Sequence
  chemically synthesized
atgggatgcccatattccttcc

SEQ ID NO: 1053708 - DNA, 22 bp, Artificial Sequence
  chemically synthesized
tggacattaatgggatgcccat

SEQ ID NO: 1053709 - DNA, 22 bp, Artificial Sequence
  chemically synthesized
tgactatggacattaatgggat

SEQ ID NO: 1053710 - DNA, 22 bp, Artificial Sequence
  chemically synthesized
attgtgactatggacattaatg

SEQ ID NO: 1053711 - DNA, 22 bp, Artificial Sequence
  chemically synthesized
tcattgtgactatggacattaa

SEQ ID NO: 1053712 - DNA, 22 bp, Artificial Sequence
  chemically synthesized
ctcattgtgactatggacatta

SEQ ID NO: 1053713 - DNA, 22 bp, Artificial Sequence
  chemically synthesized
cttctcattgtgactatggaca

SEQ ID NO: 1053714 - DNA, 22 bp, Artificial Sequence
  chemically synthesized
ttacttctcattgtgactatgg

SEQ ID NO: 1053715 - DNA, 22 bp, Artificial Sequence
  chemically synthesized
gttacttctcattgtgactatg

SEQ ID NO: 1053716 - DNA, 22 bp, Artificial Sequence
  chemically synthesized
atgtccatagtcacaatgagaa

SEQ ID NO: 1053717 - DNA, 22 bp, Artificial Sequence
  chemically synthesized
ggaacagtttgttacttctcat

SEQ ID NO: 1053718 - DNA, 22 bp, Artificial Sequence
  chemically synthesized
gggaacagtttgttacttctca

SEQ ID NO: 1053719 - DNA, 22 bp, Artificial Sequence
  chemically synthesized
tttgggaacagtttgttacttc

SEQ ID NO: 1053720 - DNA, 22 bp, Artificial Sequence
  chemically synthesized
atagaactatttgggaacagtt

SEQ ID NO: 1053721 - DNA, 22 bp, Artificial Sequence
  chemically synthesized
gatagaactatttgggaacagt

SEQ ID NO: 1053722 - DNA, 22 bp, Artificial Sequence
  chemically synthesized
catttgatagaactatttggga

SEQ ID NO: 1053723 - DNA, 22 bp, Artificial Sequence
  chemically synthesized
ttacatttgatagaactatttg

SEQ ID NO: 1053724 - DNA, 22 bp, Artificial Sequence
  chemically synthesized
ttcccaaatagttctatcaaat

SEQ ID NO: 1053725 - DNA, 22 bp, Artificial Sequence
  chemically synthesized
aaaaattattacatttgataga

SEQ ID NO: 1053726 - DNA, 22 bp, Artificial Sequence
  chemically synthesized
gaaaaattattacatttgatag

SEQ ID NO: 1053727 - DNA, 22 bp, Artificial Sequence
  chemically synthesized
ccaaatagttctatcaaatgta

SEQ ID NO: 1053728 - DNA, 22 bp, Artificial Sequence
  chemically synthesized
caaccttgaaaaattattacat

SEQ ID NO: 1053729 - DNA, 22 bp, Artificial Sequence
  chemically synthesized
tatcaaatgtaataatttttca

SEQ ID NO: 1053730 - DNA, 22 bp, Artificial Sequence
  chemically synthesized
aatgctacaaccttgaaaaatt

SEQ ID NO: 1053731 - DNA, 22 bp, Artificial Sequence
  chemically synthesized
tcaaatgtaataatttttcaag

SEQ ID NO: 1053732 - DNA, 22 bp, Artificial Sequence
  chemically synthesized
gaatgctacaaccttgaaaaat

SEQ ID NO: 1053733 - DNA, 22 bp, Artificial Sequence
  chemically synthesized
tttgaatgctacaaccttgaaa

SEQ ID NO: 1053734 - DNA, 22 bp, Artificial Sequence
  chemically synthesized
atttgaatgctacaaccttgaa

SEQ ID NO: 1053735 - DNA, 22 bp, Artificial Sequence
  chemically synthesized
tatttgaatgctacaaccttga

SEQ ID NO: 1053736 - DNA, 22 bp, Artificial Sequence
  chemically synthesized
tctttatttgaatgctacaacc

SEQ ID NO: 1053737 - DNA, 22 bp, Artificial Sequence
  chemically synthesized
gtattatctttatttgaatgct

SEQ ID NO: 1053738 - DNA, 22 bp, Artificial Sequence
  chemically synthesized
ttcaaggttgtagcattcaaat

SEQ ID NO: 1053739 - DNA, 22 bp, Artificial Sequence
  chemically synthesized
tcaaggttgtagcattcaaata

SEQ ID NO: 1053740 - DNA, 22 bp, Artificial Sequence
  chemically synthesized
caaggttgtagcattcaaataa

SEQ ID NO: 1053741 - DNA, 22 bp, Artificial Sequence
  chemically synthesized
aaggttgtagcattcaaataaa

SEQ ID NO: 1053742 - DNA, 22 bp, Artificial Sequence
  chemically synthesized
aagttagtattatctttatttg

SEQ ID NO: 1053743 - DNA, 22 bp, Artificial Sequence
  chemically synthesized
actaaagttagtattatcttta

SEQ ID NO: 1053744 - DNA, 22 bp, Artificial Sequence
  chemically synthesized
tagcattcaaataaagataata

SEQ ID NO: 1053745 - DNA, 22 bp, Artificial Sequence
  chemically synthesized
gttcactaaagttagtattatc

SEQ ID NO: 1053746 - DNA, 22 bp, Artificial Sequence
  chemically synthesized
ggttcactaaagttagtattat

SEQ ID NO: 1053747 - DNA, 22 bp, Artificial Sequence
  chemically synthesized
aaataaagataatactaacttt

SEQ ID NO: 1053748 - DNA, 22 bp, Artificial Sequence
  chemically synthesized
gcatcagatgaggaaacttggt

SEQ ID NO: 1053749 - DNA, 22 bp, Artificial Sequence
  chemically synthesized
agcatcagatgaggaaacttgg

SEQ ID NO: 1053750 - DNA, 22 bp, Artificial Sequence
  chemically synthesized
actttagtgaaccaagtttcct

SEQ ID NO: 1053751 - DNA, 22 bp, Artificial Sequence
  chemically synthesized
tagcatcagatgaggaaacttg

SEQ ID NO: 1053752 - DNA, 22 bp, Artificial Sequence
  chemically synthesized
ttagcatcagatgaggaaactt

SEQ ID NO: 1053753 - DNA, 22 bp, Artificial Sequence
  chemically synthesized
tagtgaaccaagtttcctcatc

SEQ ID NO: 1053754 - DNA, 22 bp, Artificial Sequence
  chemically synthesized
agtgaaccaagtttcctcatct

SEQ ID NO: 1053755 - DNA, 22 bp, Artificial Sequence
  chemically synthesized
atttttagcatcagatgaggaa

SEQ ID NO: 1053756 - DNA, 22 bp, Artificial Sequence
  chemically synthesized
gtgaaccaagtttcctcatctg

SEQ ID NO: 1053757 - DNA, 22 bp, Artificial Sequence
  chemically synthesized
cctcatctgatgctaaaaatga

SEQ ID NO: 1053758 - DNA, 22 bp, Artificial Sequence
  chemically synthesized
aaaaaatataactcatttttag

SEQ ID NO: 1053759 - DNA, 22 bp, Artificial Sequence
  chemically synthesized
ctcatctgatgctaaaaatgag

SEQ ID NO: 1053760 - DNA, 22 bp, Artificial Sequence
  chemically synthesized
atctgatgctaaaaatgagtta

SEQ ID NO: 1053761 - DNA, 22 bp, Artificial Sequence
  chemically synthesized
atgctaaaaatgagttatattt

SEQ ID NO: 1053762 - DNA, 22 bp, Artificial Sequence
  chemically synthesized
ataaaattaaaaaaatataact

SEQ ID NO: 1053763 - DNA, 22 bp, Artificial Sequence
  chemically synthesized
ctgataaaattaaaaaaatata

SEQ ID NO: 1053764 - DNA, 22 bp, Artificial Sequence
  chemically synthesized
aaaatgagttatatttttttaa

SEQ ID NO: 1053765 - DNA, 22 bp, Artificial Sequence
  chemically synthesized
tcatataatgttactgataaaa

SEQ ID NO: 1053766 - DNA, 22 bp, Artificial Sequence
  chemically synthesized
tatttttttaattttatcagta

SEQ ID NO: 1053767 - DNA, 22 bp, Artificial Sequence
  chemically synthesized
ctatcatataatgttactgata

SEQ ID NO: 1053768 - DNA, 22 bp, Artificial Sequence
  chemically synthesized
actatcatataatgttactgat

SEQ ID NO: 1053769 - DNA, 22 bp, Artificial Sequence
  chemically synthesized
tactatcatataatgttactga

SEQ ID NO: 1053770 - DNA, 22 bp, Artificial Sequence
  chemically synthesized
ttttaattttatcagtaacatt

SEQ ID NO: 1053771 - DNA, 22 bp, Artificial Sequence
  chemically synthesized
tttaattttatcagtaacatta

SEQ ID NO: 1053772 - DNA, 22 bp, Artificial Sequence
  chemically synthesized
ttaattttatcagtaacattat

SEQ ID NO: 1053773 - DNA, 22 bp, Artificial Sequence
  chemically synthesized
taattttatcagtaacattata

SEQ ID NO: 1053774 - DNA, 22 bp, Artificial Sequence
  chemically synthesized
aattttatcagtaacattatat

SEQ ID NO: 1053775 - DNA, 22 bp, Artificial Sequence
  chemically synthesized
attttatcagtaacattatatg

SEQ ID NO: 1053776 - DNA, 22 bp, Artificial Sequence
  chemically synthesized
tatcagtaacattatatgatag

SEQ ID NO: 1053777 - DNA, 22 bp, Artificial Sequence
  chemically synthesized
atcagtaacattatatgatagt

SEQ ID NO: 1053778 - DNA, 22 bp, Artificial Sequence
  chemically synthesized
tcagtaacattatatgatagta

SEQ ID NO: 1053779 - DNA, 22 bp, Artificial Sequence
  chemically synthesized
atatgtgcagttttactatcat

SEQ ID NO: 1053780 - DNA, 22 bp, Artificial Sequence
  chemically synthesized
ttgatatgtgcagttttactat

SEQ ID NO: 1053781 - DNA, 22 bp, Artificial Sequence
  chemically synthesized
tatgatagtaaaactgcacata

SEQ ID NO: 1053782 - DNA, 22 bp, Artificial Sequence
  chemically synthesized
cacatatcaataattcatcact

SEQ ID NO: 1053783 - DNA, 22 bp, Artificial Sequence
  chemically synthesized
gatataaatacaaaatgaagtg

SEQ ID NO: 1053784 - DNA, 22 bp, Artificial Sequence
  chemically synthesized
atcacttcattttgtatttata

SEQ ID NO: 1053785 - DNA, 22 bp, Artificial Sequence
  chemically synthesized
agaaatattggatataaataca

SEQ ID NO: 1053786 - DNA, 22 bp, Artificial Sequence
  chemically synthesized
cagaaatattggatataaatac

SEQ ID NO: 1053787 - DNA, 22 bp, Artificial Sequence
  chemically synthesized
tcagaaatattggatataaata

SEQ ID NO: 1053788 - DNA, 22 bp, Artificial Sequence
  chemically synthesized
ttcagaaatattggatataaat

SEQ ID NO: 1053789 - DNA, 22 bp, Artificial Sequence
  chemically synthesized
cattttgtatttatatccaata

SEQ ID NO: 1053790 - DNA, 22 bp, Artificial Sequence
  chemically synthesized
attttgtatttatatccaatat

SEQ ID NO: 1053791 - DNA, 22 bp, Artificial Sequence
  chemically synthesized
atatatttttcagaaatattgg

SEQ ID NO: 1053792 - DNA, 22 bp, Artificial Sequence
  chemically synthesized
tgtatttatatccaatatttct

SEQ ID NO: 1053793 - DNA, 22 bp, Artificial Sequence
  chemically synthesized
gtatttatatccaatatttctg

SEQ ID NO: 1053794 - DNA, 22 bp, Artificial Sequence
  chemically synthesized
tatttatatccaatatttctga

SEQ ID NO: 1053795 - DNA, 22 bp, Artificial Sequence
  chemically synthesized
tgattaatatatttttcagaaa

SEQ ID NO: 1053796 - DNA, 22 bp, Artificial Sequence
  chemically synthesized
atatccaatatttctgaaaaat

SEQ ID NO: 1053797 - DNA, 22 bp, Artificial Sequence
  chemically synthesized
tatccaatatttctgaaaaata

SEQ ID NO: 1053798 - DNA, 22 bp, Artificial Sequence
  chemically synthesized
caaaatctatgattaatatatt

SEQ ID NO: 1053799 - DNA, 22 bp, Artificial Sequence
  chemically synthesized
actgcaaaatctatgattaata

SEQ ID NO: 1053800 - DNA, 22 bp, Artificial Sequence
  chemically synthesized
ctgaaaaatatattaatcatag

SEQ ID NO: 1053801 - DNA, 22 bp, Artificial Sequence
  chemically synthesized
tgaaaaatatattaatcataga

SEQ ID NO: 1053802 - DNA, 22 bp, Artificial Sequence
  chemically synthesized
aaaaatatattaatcatagatt

SEQ ID NO: 1053803 - DNA, 22 bp, Artificial Sequence
  chemically synthesized
aggaaatattgactgcaaaatc

SEQ ID NO: 1053804 - DNA, 22 bp, Artificial Sequence
  chemically synthesized
caggaaatattgactgcaaaat

SEQ ID NO: 1053805 - DNA, 22 bp, Artificial Sequence
  chemically synthesized
ttcaggaaatattgactgcaaa

SEQ ID NO: 1053806 - DNA, 22 bp, Artificial Sequence
  chemically synthesized
atcatagattttgcagtcaata

SEQ ID NO: 1053807 - DNA, 22 bp, Artificial Sequence
  chemically synthesized
gcacattcttcaggaaatattg

SEQ ID NO: 1053808 - DNA, 22 bp, Artificial Sequence
  chemically synthesized
agcacattcttcaggaaatatt

SEQ ID NO: 1053809 - DNA, 22 bp, Artificial Sequence
  chemically synthesized
tgcagtcaatatttcctgaaga

SEQ ID NO: 1053810 - DNA, 22 bp, Artificial Sequence
  chemically synthesized
gcagtcaatatttcctgaagaa

SEQ ID NO: 1053811 - DNA, 22 bp, Artificial Sequence
  chemically synthesized
cagtcaatatttcctgaagaat

SEQ ID NO: 1053812 - DNA, 22 bp, Artificial Sequence
  chemically synthesized
tcaagtggaaatttagcacatt

SEQ ID NO: 1053813 - DNA, 22 bp, Artificial Sequence
  chemically synthesized
tatcaagtggaaatttagcaca

SEQ ID NO: 1053814 - DNA, 22 bp, Artificial Sequence
  chemically synthesized
ctatcaagtggaaatttagcac

SEQ ID NO: 1053815 - DNA, 22 bp, Artificial Sequence
  chemically synthesized
tctatcaagtggaaatttagca

SEQ ID NO: 1053816 - DNA, 22 bp, Artificial Sequence
  chemically synthesized
cctgaagaatgtgctaaatttc

SEQ ID NO: 1053817 - DNA, 22 bp, Artificial Sequence
  chemically synthesized
ttctatcaagtggaaatttagc

SEQ ID NO: 1053818 - DNA, 22 bp, Artificial Sequence
  chemically synthesized
ctgaagaatgtgctaaatttcc

SEQ ID NO: 1053819 - DNA, 22 bp, Artificial Sequence
  chemically synthesized
aagaatgtgctaaatttccact

SEQ ID NO: 1053820 - DNA, 22 bp, Artificial Sequence
  chemically synthesized
tgtcaaatttttctatcaagtg

SEQ ID NO: 1053821 - DNA, 22 bp, Artificial Sequence
  chemically synthesized
aatttccacttgatagaaaaat

SEQ ID NO: 1053822 - DNA, 22 bp, Artificial Sequence
  chemically synthesized
ccacttgatagaaaaatttgac

SEQ ID NO: 1053823 - DNA, 22 bp, Artificial Sequence
  chemically synthesized
cacttgatagaaaaatttgaca

SEQ ID NO: 1053824 - DNA, 22 bp, Artificial Sequence
  chemically synthesized
gatagaaaaatttgacacagta

SEQ ID NO: 1053825 - DNA, 22 bp, Artificial Sequence
  chemically synthesized
atagaaaaatttgacacagtat

SEQ ID NO: 1053826 - DNA, 22 bp, Artificial Sequence
  chemically synthesized
gacacagtatattactatgttt

SEQ ID NO: 1053827 - DNA, 22 bp, Artificial Sequence
  chemically synthesized
acacagtatattactatgtttt

SEQ ID NO: 1053828 - DNA, 22 bp, Artificial Sequence
  chemically synthesized
ataaacataagaaaaaacatag

SEQ ID NO: 1053829 - DNA, 22 bp, Artificial Sequence
  chemically synthesized
ctatgttttttcttatgtttat

SEQ ID NO: 1053830 - DNA, 22 bp, Artificial Sequence
  chemically synthesized
tcaaatatattaataaacataa

SEQ ID NO: 1053831 - DNA, 22 bp, Artificial Sequence
  chemically synthesized
tgttttttcttatgtttattaa

SEQ ID NO: 1053832 - DNA, 22 bp, Artificial Sequence
  chemically synthesized
tttcttatgtttattaatatat

SEQ ID NO: 1053833 - DNA, 22 bp, Artificial Sequence
  chemically synthesized
ttcttatgtttattaatatatt

SEQ ID NO: 1053834 - DNA, 22 bp, Artificial Sequence
  chemically synthesized
tcttatgtttattaatatattt

SEQ ID NO: 1053835 - DNA, 22 bp, Artificial Sequence
  chemically synthesized
cttatgtttattaatatatttg

SEQ ID NO: 1053836 - DNA, 22 bp, Artificial Sequence
  chemically synthesized
ttatgtttattaatatatttga

SEQ ID NO: 1053837 - DNA, 22 bp, Artificial Sequence
  chemically synthesized
atgtttattaatatatttgaca

SEQ ID NO: 1053838 - DNA, 22 bp, Artificial Sequence
  chemically synthesized
tgtttattaatatatttgacaa

SEQ ID NO: 1053839 - DNA, 22 bp, Artificial Sequence
  chemically synthesized
attaatatatttgacaacacat

SEQ ID NO: 1053840 - DNA, 22 bp, Artificial Sequence
  chemically synthesized
ttaatatatttgacaacacatt

SEQ ID NO: 1053841 - DNA, 22 bp, Artificial Sequence
  chemically synthesized
cagtcatcatgcaatgtgttgt

SEQ ID NO: 1053842 - DNA, 22 bp, Artificial Sequence
  chemically synthesized
atatatttgacaacacattgca

SEQ ID NO: 1053843 - DNA, 22 bp, Artificial Sequence
  chemically synthesized
gacaacacattgcatgatgact

SEQ ID NO: 1053844 - DNA, 22 bp, Artificial Sequence
  chemically synthesized
acaacacattgcatgatgactg

SEQ ID NO: 1053845 - DNA, 22 bp, Artificial Sequence
  chemically synthesized
cagtaatagactacagtcatca

SEQ ID NO: 1053846 - DNA, 22 bp, Artificial Sequence
  chemically synthesized
atgttacagtaatagactacag

SEQ ID NO: 1053847 - DNA, 22 bp, Artificial Sequence
  chemically synthesized
catgatgactgtagtctattac

SEQ ID NO: 1053848 - DNA, 22 bp, Artificial Sequence
  chemically synthesized
aattaatgttacagtaatagac

SEQ ID NO: 1053849 - DNA, 22 bp, Artificial Sequence
  chemically synthesized
tgaattaatgttacagtaatag

SEQ ID NO: 1053850 - DNA, 22 bp, Artificial Sequence
  chemically synthesized
ctgaattaatgttacagtaata

SEQ ID NO: 1053851 - DNA, 22 bp, Artificial Sequence
  chemically synthesized
tcttctgaattaatgttacagt

SEQ ID NO: 1053852 - DNA, 22 bp, Artificial Sequence
  chemically synthesized
atcttctgaattaatgttacag

SEQ ID NO: 1053853 - DNA, 22 bp, Artificial Sequence
  chemically synthesized
tagtctattactgtaacattaa

SEQ ID NO: 1053854 - DNA, 22 bp, Artificial Sequence
  chemically synthesized
cttatcttctgaattaatgtta

SEQ ID NO: 1053855 - DNA, 22 bp, Artificial Sequence
  chemically synthesized
gcttatcttctgaattaatgtt

SEQ ID NO: 1053856 - DNA, 22 bp, Artificial Sequence
  chemically synthesized
ttactgtaacattaattcagaa

SEQ ID NO: 1053857 - DNA, 22 bp, Artificial Sequence
  chemically synthesized
tatttgcttatcttctgaatta

SEQ ID NO: 1053858 - DNA, 22 bp, Artificial Sequence
  chemically synthesized
atatttgcttatcttctgaatt

SEQ ID NO: 1053859 - DNA, 22 bp, Artificial Sequence
  chemically synthesized
tatatttgcttatcttctgaat

SEQ ID NO: 1053860 - DNA, 22 bp, Artificial Sequence
  chemically synthesized
ctgtaacattaattcagaagat

SEQ ID NO: 1053861 - DNA, 22 bp, Artificial Sequence
  chemically synthesized
taacattaattcagaagataag

SEQ ID NO: 1053862 - DNA, 22 bp, Artificial Sequence
  chemically synthesized
attcagaagataagcaaatata

SEQ ID NO: 1053863 - DNA, 22 bp, Artificial Sequence
  chemically synthesized
gatatacaattttatatttgct

SEQ ID NO: 1053864 - DNA, 22 bp, Artificial Sequence
  chemically synthesized
ttagatatacaattttatattt

SEQ ID NO: 1053865 - DNA, 22 bp, Artificial Sequence
  chemically synthesized
agaagataagcaaatataaaat

SEQ ID NO: 1053866 - DNA, 22 bp, Artificial Sequence
  chemically synthesized
tgttagatatacaattttatat

SEQ ID NO: 1053867 - DNA, 22 bp, Artificial Sequence
  chemically synthesized
tggctctgttagatatacaatt

SEQ ID NO: 1053868 - DNA, 22 bp, Artificial Sequence
  chemically synthesized
gattatggctctgttagatata

SEQ ID NO: 1053869 - DNA, 22 bp, Artificial Sequence
  chemically synthesized
tagttagattatggctctgtta

SEQ ID NO: 1053870 - DNA, 22 bp, Artificial Sequence
  chemically synthesized
atagttagattatggctctgtt

SEQ ID NO: 1053871 - DNA, 22 bp, Artificial Sequence
  chemically synthesized
tatagttagattatggctctgt

SEQ ID NO: 1053872 - DNA, 22 bp, Artificial Sequence
  chemically synthesized
ttttatagttagattatggctc

SEQ ID NO: 1053873 - DNA, 22 bp, Artificial Sequence
  chemically synthesized
tatatctaacagagccataatc

SEQ ID NO: 1053874 - DNA, 22 bp, Artificial Sequence
  chemically synthesized
acaattattttatagttagatt

SEQ ID NO: 1053875 - DNA, 22 bp, Artificial Sequence
  chemically synthesized
acagagccataatctaactata

SEQ ID NO: 1053876 - DNA, 22 bp, Artificial Sequence
  chemically synthesized
ttcacaattattttatagttag

SEQ ID NO: 1053877 - DNA, 22 bp, Artificial Sequence
  chemically synthesized
ctattcacaattattttatagt

SEQ ID NO: 1053878 - DNA, 22 bp, Artificial Sequence
  chemically synthesized
actattcacaattattttatag

SEQ ID NO: 1053879 - DNA, 22 bp, Artificial Sequence
  chemically synthesized
cacttactattcacaattattt

SEQ ID NO: 1053880 - DNA, 22 bp, Artificial Sequence
  chemically synthesized
actataaaataattgtgaatag

SEQ ID NO: 1053881 - DNA, 22 bp, Artificial Sequence
  chemically synthesized
taaaataattgtgaatagtaag

SEQ ID NO: 1053882 - DNA, 22 bp, Artificial Sequence
  chemically synthesized
tgaatagtaagtgtagcttgac

SEQ ID NO: 1053883 - DNA, 22 bp, Artificial Sequence
  chemically synthesized
aataaaaatagtagaataaatg

SEQ ID NO: 1053884 - DNA, 22 bp, Artificial Sequence
  chemically synthesized
gacacatttattctactatttt

SEQ ID NO: 1053885 - DNA, 22 bp, Artificial Sequence
  chemically synthesized
acacatttattctactattttt

SEQ ID NO: 1053886 - DNA, 22 bp, Artificial Sequence
  chemically synthesized
aagtagcacgttaaataaaaat

SEQ ID NO: 1053887 - DNA, 22 bp, Artificial Sequence
  chemically synthesized
caagtagcacgttaaataaaaa

SEQ ID NO: 1053888 - DNA, 22 bp, Artificial Sequence
  chemically synthesized
attctactatttttatttaacg

SEQ ID NO: 1053889 - DNA, 22 bp, Artificial Sequence
  chemically synthesized
ttctactatttttatttaacgt

SEQ ID NO: 1053890 - DNA, 22 bp, Artificial Sequence
  chemically synthesized
gcttcaagtagcacgttaaata

SEQ ID NO: 1053891 - DNA, 22 bp, Artificial Sequence
  chemically synthesized
tactatttttatttaacgtgct

SEQ ID NO: 1053892 - DNA, 22 bp, Artificial Sequence
  chemically synthesized
ctatttttatttaacgtgctac

SEQ ID NO: 1053893 - DNA, 22 bp, Artificial Sequence
  chemically synthesized
tttttatttaacgtgctacttg

SEQ ID NO: 1053894 - DNA, 22 bp, Artificial Sequence
  chemically synthesized
aaatgactggcttcaagtagca

SEQ ID NO: 1053895 - DNA, 22 bp, Artificial Sequence
  chemically synthesized
ttatttaacgtgctacttgaag

SEQ ID NO: 1053896 - DNA, 22 bp, Artificial Sequence
  chemically synthesized
tatttaacgtgctacttgaagc

SEQ ID NO: 1053897 - DNA, 22 bp, Artificial Sequence
  chemically synthesized
atttaacgtgctacttgaagcc

SEQ ID NO: 1053898 - DNA, 22 bp, Artificial Sequence
  chemically synthesized
tctcaaatgactggcttcaagt

SEQ ID NO: 1053899 - DNA, 22 bp, Artificial Sequence
  chemically synthesized
tttaacgtgctacttgaagcca

SEQ ID NO: 1053900 - DNA, 22 bp, Artificial Sequence
  chemically synthesized
aacgtgctacttgaagccagtc

SEQ ID NO: 1053901 - DNA, 22 bp, Artificial Sequence
  chemically synthesized
acgtgctacttgaagccagtca

SEQ ID NO: 1053902 - DNA, 22 bp, Artificial Sequence
  chemically synthesized
aatattgtctcaaatgactggc

SEQ ID NO: 1053903 - DNA, 22 bp, Artificial Sequence
  chemically synthesized
gaatattgtctcaaatgactgg

SEQ ID NO: 1053904 - DNA, 22 bp, Artificial Sequence
  chemically synthesized
ttgaatattgtctcaaatgact

SEQ ID NO: 1053905 - DNA, 22 bp, Artificial Sequence
  chemically synthesized
cttgaagccagtcatttgagac

SEQ ID NO: 1053906 - DNA, 22 bp, Artificial Sequence
  chemically synthesized
cctcttgaatattgtctcaaat

SEQ ID NO: 1053907 - DNA, 22 bp, Artificial Sequence
  chemically synthesized
gaagccagtcatttgagacaat

SEQ ID NO: 1053908 - DNA, 22 bp, Artificial Sequence
  chemically synthesized
aagccagtcatttgagacaata

SEQ ID NO: 1053909 - DNA, 22 bp, Artificial Sequence
  chemically synthesized
tacaacatattacctcttgaat

SEQ ID NO: 1053910 - DNA, 22 bp, Artificial Sequence
  chemically synthesized
atacaacatattacctcttgaa

SEQ ID NO: 1053911 - DNA, 22 bp, Artificial Sequence
  chemically synthesized
gagacaatattcaagaggtaat

SEQ ID NO: 1053912 - DNA, 22 bp, Artificial Sequence
  chemically synthesized
agacaatattcaagaggtaata

SEQ ID NO: 1053913 - DNA, 22 bp, Artificial Sequence
  chemically synthesized
tacgtgatttatacaacatatt

SEQ ID NO: 1053914 - DNA, 22 bp, Artificial Sequence
  chemically synthesized
atacgtgatttatacaacatat

SEQ ID NO: 1053915 - DNA, 22 bp, Artificial Sequence
  chemically synthesized
aagaggtaatatgttgtataaa

SEQ ID NO: 1053916 - DNA, 22 bp, Artificial Sequence
  chemically synthesized
ccatttatacgtgatttataca

SEQ ID NO: 1053917 - DNA, 22 bp, Artificial Sequence
  chemically synthesized
accatttatacgtgatttatac

SEQ ID NO: 1053918 - DNA, 22 bp, Artificial Sequence
  chemically synthesized
agcaaatttaccatttatacgt

SEQ ID NO: 1053919 - DNA, 22 bp, Artificial Sequence
  chemically synthesized
aagcaaatttaccatttatacg

SEQ ID NO: 1053920 - DNA, 22 bp, Artificial Sequence
  chemically synthesized
tataaatcacgtataaatggta

SEQ ID NO: 1053921 - DNA, 22 bp, Artificial Sequence
  chemically synthesized
taagtttaagcaaatttaccat

SEQ ID NO: 1053922 - DNA, 22 bp, Artificial Sequence
  chemically synthesized
gtaagtttaagcaaatttacca

SEQ ID NO: 1053923 - DNA, 22 bp, Artificial Sequence
  chemically synthesized
ttgtaagtttaagcaaatttac

SEQ ID NO: 1053924 - DNA, 22 bp, Artificial Sequence
  chemically synthesized
atattcttgtaagtttaagcaa

SEQ ID NO: 1053925 - DNA, 22 bp, Artificial Sequence
  chemically synthesized
aatattcttgtaagtttaagca

SEQ ID NO: 1053926 - DNA, 22 bp, Artificial Sequence
  chemically synthesized
cagtttaatattcttgtaagtt

SEQ ID NO: 1053927 - DNA, 22 bp, Artificial Sequence
  chemically synthesized
attacagtttaatattcttgta

SEQ ID NO: 1053928 - DNA, 22 bp, Artificial Sequence
  chemically synthesized
gcttaaacttacaagaatatta

SEQ ID NO: 1053929 - DNA, 22 bp, Artificial Sequence
  chemically synthesized
cttaaacttacaagaatattaa

SEQ ID NO: 1053930 - DNA, 22 bp, Artificial Sequence
  chemically synthesized
aaacttacaagaatattaaact

SEQ ID NO: 1053931 - DNA, 22 bp, Artificial Sequence
  chemically synthesized
aacttacaagaatattaaactg

SEQ ID NO: 1053932 - DNA, 22 bp, Artificial Sequence
  chemically synthesized
acaagaatattaaactgtaatt

SEQ ID NO: 1053933 - DNA, 22 bp, Artificial Sequence
  chemically synthesized
caagaatattaaactgtaatta

SEQ ID NO: 1053934 - DNA, 22 bp, Artificial Sequence
  chemically synthesized
tgtataaaataagatgttaatt

SEQ ID NO: 1053935 - DNA, 22 bp, Artificial Sequence
  chemically synthesized
aactgtaattaacatcttattt

SEQ ID NO: 1053936 - DNA, 22 bp, Artificial Sequence
  chemically synthesized
taattaacatcttattttatac

SEQ ID NO: 1053937 - DNA, 22 bp, Artificial Sequence
  chemically synthesized
acatcttattttatacatagtg

SEQ ID NO: 1053938 - DNA, 22 bp, Artificial Sequence
  chemically synthesized
gtccaaagccatcactatgtat

SEQ ID NO: 1053939 - DNA, 22 bp, Artificial Sequence
  chemically synthesized
tagtccaaagccatcactatgt

SEQ ID NO: 1053940 - DNA, 22 bp, Artificial Sequence
  chemically synthesized
attttatacatagtgatggctt

SEQ ID NO: 1053941 - DNA, 22 bp, Artificial Sequence
  chemically synthesized
ttttatacatagtgatggcttt

SEQ ID NO: 1053942 - DNA, 22 bp, Artificial Sequence
  chemically synthesized
tatacatagtgatggctttgga

SEQ ID NO: 1053943 - DNA, 22 bp, Artificial Sequence
  chemically synthesized
atacatagtgatggctttggac

SEQ ID NO: 1053944 - DNA, 22 bp, Artificial Sequence
  chemically synthesized
cgaatatctctagtccaaagcc

SEQ ID NO: 1053945 - DNA, 22 bp, Artificial Sequence
  chemically synthesized
tacatagtgatggctttggact

SEQ ID NO: 1053946 - DNA, 22 bp, Artificial Sequence
  chemically synthesized
ccgaatatctctagtccaaagc

SEQ ID NO: 1053947 - DNA, 22 bp, Artificial Sequence
  chemically synthesized
tccgaatatctctagtccaaag

SEQ ID NO: 1053948 - DNA, 22 bp, Artificial Sequence
  chemically synthesized
tgttttccgaatatctctagtc

SEQ ID NO: 1053949 - DNA, 22 bp, Artificial Sequence
  chemically synthesized
gtgttttccgaatatctctagt

SEQ ID NO: 1053950 - DNA, 22 bp, Artificial Sequence
  chemically synthesized
tgtgttttccgaatatctctag

SEQ ID NO: 1053951 - DNA, 22 bp, Artificial Sequence
  chemically synthesized
tggactagagatattcggaaaa

SEQ ID NO: 1053952 - DNA, 22 bp, Artificial Sequence
  chemically synthesized
ggactagagatattcggaaaac

SEQ ID NO: 1053953 - DNA, 22 bp, Artificial Sequence
  chemically synthesized
gactagagatattcggaaaaca

SEQ ID NO: 1053954 - DNA, 22 bp, Artificial Sequence
  chemically synthesized
gagatattcggaaaacacaaaa

SEQ ID NO: 1053955 - DNA, 22 bp, Artificial Sequence
  chemically synthesized
tatgaacataggattttgtgtt

SEQ ID NO: 1053956 - DNA, 22 bp, Artificial Sequence
  chemically synthesized
ggaaaacacaaaatcctatgtt

SEQ ID NO: 1053957 - DNA, 22 bp, Artificial Sequence
  chemically synthesized
atcaagggtagtaagaaactat

SEQ ID NO: 1053958 - DNA, 22 bp, Artificial Sequence
  chemically synthesized
tgttcatatagtttcttactac

SEQ ID NO: 1053959 - DNA, 22 bp, Artificial Sequence
  chemically synthesized
aattcatcaagggtagtaagaa

SEQ ID NO: 1053960 - DNA, 22 bp, Artificial Sequence
  chemically synthesized
attgaattcatcaagggtagta

SEQ ID NO: 1053961 - DNA, 22 bp, Artificial Sequence
  chemically synthesized
atatagtttcttactacccttg

SEQ ID NO: 1053962 - DNA, 22 bp, Artificial Sequence
  chemically synthesized
agaacattaattgaattcatca

SEQ ID NO: 1053963 - DNA, 22 bp, Artificial Sequence
  chemically synthesized
cttactacccttgatgaattca

SEQ ID NO: 1053964 - DNA, 22 bp, Artificial Sequence
  chemically synthesized
aagaacattaattgaattcatc

SEQ ID NO: 1053965 - DNA, 22 bp, Artificial Sequence
  chemically synthesized
ttactacccttgatgaattcaa

SEQ ID NO: 1053966 - DNA, 22 bp, Artificial Sequence
  chemically synthesized
actacccttgatgaattcaatt

SEQ ID NO: 1053967 - DNA, 22 bp, Artificial Sequence
  chemically synthesized
ctacccttgatgaattcaatta

SEQ ID NO: 1053968 - DNA, 22 bp, Artificial Sequence
  chemically synthesized
aggtttaagaacattaattgaa

SEQ ID NO: 1053969 - DNA, 22 bp, Artificial Sequence
  chemically synthesized
cccttgatgaattcaattaatg

SEQ ID NO: 1053970 - DNA, 22 bp, Artificial Sequence
  chemically synthesized
gatgaattcaattaatgttctt

SEQ ID NO: 1053971 - DNA, 22 bp, Artificial Sequence
  chemically synthesized
atgaattcaattaatgttctta

SEQ ID NO: 1053972 - DNA, 22 bp, Artificial Sequence
  chemically synthesized
aattaatgttcttaaacctcag

SEQ ID NO: 1053973 - DNA, 22 bp, Artificial Sequence
  chemically synthesized
atgttcttaaacctcagttttc

SEQ ID NO: 1053974 - DNA, 22 bp, Artificial Sequence
  chemically synthesized
ttaaacctcagttttctatttg

SEQ ID NO: 1053975 - DNA, 22 bp, Artificial Sequence
  chemically synthesized
aagcaaataatccaaatagaaa

SEQ ID NO: 1053976 - DNA, 22 bp, Artificial Sequence
  chemically synthesized
aaacctcagttttctatttgga

SEQ ID NO: 1053977 - DNA, 22 bp, Artificial Sequence
  chemically synthesized
aacctcagttttctatttggat

SEQ ID NO: 1053978 - DNA, 22 bp, Artificial Sequence
  chemically synthesized
agttaaagcaaataatccaaat

SEQ ID NO: 1053979 - DNA, 22 bp, Artificial Sequence
  chemically synthesized
ttaagttaaagcaaataatcca

SEQ ID NO: 1053980 - DNA, 22 bp, Artificial Sequence
  chemically synthesized
agttttctatttggattatttg

SEQ ID NO: 1053981 - DNA, 22 bp, Artificial Sequence
  chemically synthesized
tctatttggattatttgcttta

SEQ ID NO: 1053982 - DNA, 22 bp, Artificial Sequence
  chemically synthesized
ctatttggattatttgctttaa

SEQ ID NO: 1053983 - DNA, 22 bp, Artificial Sequence
  chemically synthesized
tatttggattatttgctttaac

SEQ ID NO: 1053984 - DNA, 22 bp, Artificial Sequence
  chemically synthesized
tttggattatttgctttaactt

SEQ ID NO: 1053985 - DNA, 22 bp, Artificial Sequence
  chemically synthesized
ggattatttgctttaacttaat

SEQ ID NO: 1053986 - DNA, 22 bp, Artificial Sequence
  chemically synthesized
gattatttgctttaacttaata

SEQ ID NO: 1053987 - DNA, 22 bp, Artificial Sequence
  chemically synthesized
tttgctttaacttaatagcttg

SEQ ID NO: 1053988 - DNA, 22 bp, Artificial Sequence
  chemically synthesized
gctttaacttaatagcttgtct

SEQ ID NO: 1053989 - DNA, 22 bp, Artificial Sequence
  chemically synthesized
ctttaacttaatagcttgtctt

SEQ ID NO: 1053990 - DNA, 22 bp, Artificial Sequence
  chemically synthesized
taacttaatagcttgtctttat

SEQ ID NO: 1053991 - DNA, 22 bp, Artificial Sequence
  chemically synthesized
aacttaatagcttgtctttatt

SEQ ID NO: 1053992 - DNA, 22 bp, Artificial Sequence
  chemically synthesized
acttaatagcttgtctttattt

SEQ ID NO: 1053993 - DNA, 22 bp, Artificial Sequence
  chemically synthesized
aatagtagagggaaaaataaag

SEQ ID NO: 1053994 - DNA, 22 bp, Artificial Sequence
  chemically synthesized
gaatagtagagggaaaaataaa

SEQ ID NO: 1053995 - DNA, 22 bp, Artificial Sequence
  chemically synthesized
aatagcttgtctttatttttcc

SEQ ID NO: 1053996 - DNA, 22 bp, Artificial Sequence
  chemically synthesized
tgaatagtagagggaaaaataa

SEQ ID NO: 1053997 - DNA, 22 bp, Artificial Sequence
  chemically synthesized
atagcttgtctttatttttccc

SEQ ID NO: 1053998 - DNA, 22 bp, Artificial Sequence
  chemically synthesized
ttgaatagtagagggaaaaata

SEQ ID NO: 1053999 - DNA, 22 bp, Artificial Sequence
  chemically synthesized
gtctttatttttccctctacta

SEQ ID NO: 1054000 - DNA, 22 bp, Artificial Sequence
  chemically synthesized
tctttatttttccctctactat

SEQ ID NO: 1054001 - DNA, 22 bp, Artificial Sequence
  chemically synthesized
tatttttccctctactattcaa

SEQ ID NO: 1054002 - DNA, 22 bp, Artificial Sequence
  chemically synthesized
atttttccctctactattcaaa

SEQ ID NO: 1054003 - DNA, 22 bp, Artificial Sequence
  chemically synthesized
tttttccctctactattcaaaa

SEQ ID NO: 1054004 - DNA, 22 bp, Artificial Sequence
  chemically synthesized
ttccctctactattcaaaaatt

SEQ ID NO: 1054005 - DNA, 22 bp, Artificial Sequence
  chemically synthesized
tccctctactattcaaaaattg

SEQ ID NO: 1054006 - DNA, 22 bp, Artificial Sequence
  chemically synthesized
ccctctactattcaaaaattgt

SEQ ID NO: 1054007 - DNA, 22 bp, Artificial Sequence
  chemically synthesized
cctctactattcaaaaattgta

SEQ ID NO: 1054008 - DNA, 22 bp, Artificial Sequence
  chemically synthesized
aatcgatagaagtatacaattt

SEQ ID NO: 1054009 - DNA, 22 bp, Artificial Sequence
  chemically synthesized
tactattcaaaaattgtatact

SEQ ID NO: 1054010 - DNA, 22 bp, Artificial Sequence
  chemically synthesized
ctattcaaaaattgtatacttc

SEQ ID NO: 1054011 - DNA, 22 bp, Artificial Sequence
  chemically synthesized
ttcaaaaattgtatacttctat

SEQ ID NO: 1054012 - DNA, 22 bp, Artificial Sequence
  chemically synthesized
atcattaaatcgatagaagtat

SEQ ID NO: 1054013 - DNA, 22 bp, Artificial Sequence
  chemically synthesized
aaaaattgtatacttctatcga

SEQ ID NO: 1054014 - DNA, 22 bp, Artificial Sequence
  chemically synthesized
tactaatcattaaatcgataga

SEQ ID NO: 1054015 - DNA, 22 bp, Artificial Sequence
  chemically synthesized
atactaatcattaaatcgatag

SEQ ID NO: 1054016 - DNA, 22 bp, Artificial Sequence
  chemically synthesized
tatactaatcattaaatcgata

SEQ ID NO: 1054017 - DNA, 22 bp, Artificial Sequence
  chemically synthesized
tatacttctatcgatttaatga

SEQ ID NO: 1054018 - DNA, 22 bp, Artificial Sequence
  chemically synthesized
agaattttatactaatcattaa

SEQ ID NO: 1054019 - DNA, 22 bp, Artificial Sequence
  chemically synthesized
ctatcgatttaatgattagtat

SEQ ID NO: 1054020 - DNA, 22 bp, Artificial Sequence
  chemically synthesized
tatcgatttaatgattagtata

SEQ ID NO: 1054021 - DNA, 22 bp, Artificial Sequence
  chemically synthesized
tcgatttaatgattagtataaa

SEQ ID NO: 1054022 - DNA, 22 bp, Artificial Sequence
  chemically synthesized
tgcgtgttaagaattttatact

SEQ ID NO: 1054023 - DNA, 22 bp, Artificial Sequence
  chemically synthesized
gtgcgtgttaagaattttatac

SEQ ID NO: 1054024 - DNA, 22 bp, Artificial Sequence
  chemically synthesized
ttgtgcgtgttaagaattttat

SEQ ID NO: 1054025 - DNA, 22 bp, Artificial Sequence
  chemically synthesized
cttgtgcgtgttaagaatttta

SEQ ID NO: 1054026 - DNA, 22 bp, Artificial Sequence
  chemically synthesized
aatgattagtataaaattctta

SEQ ID NO: 1054027 - DNA, 22 bp, Artificial Sequence
  chemically synthesized
atgattagtataaaattcttaa

SEQ ID NO: 1054028 - DNA, 22 bp, Artificial Sequence
  chemically synthesized
caaaatttcttgtgcgtgttaa

SEQ ID NO: 1054029 - DNA, 22 bp, Artificial Sequence
  chemically synthesized
gtataaaattcttaacacgcac

SEQ ID NO: 1054030 - DNA, 22 bp, Artificial Sequence
  chemically synthesized
gcaaaatttcttgtgcgtgtta

SEQ ID NO: 1054031 - DNA, 22 bp, Artificial Sequence
  chemically synthesized
ttaacacgcacaagaaattttg

SEQ ID NO: 1054032 - DNA, 22 bp, Artificial Sequence
  chemically synthesized
gaatgaaaacttgcaaaatttc

SEQ ID NO: 1054033 - DNA, 22 bp, Artificial Sequence
  chemically synthesized
aacacgcacaagaaattttgca

SEQ ID NO: 1054034 - DNA, 22 bp, Artificial Sequence
  chemically synthesized
agaatgaaaacttgcaaaattt

SEQ ID NO: 1054035 - DNA, 22 bp, Artificial Sequence
  chemically synthesized
acacgcacaagaaattttgcaa

SEQ ID NO: 1054036 - DNA, 22 bp, Artificial Sequence
  chemically synthesized
gtgcttagaatgaaaacttgca

SEQ ID NO: 1054037 - DNA, 22 bp, Artificial Sequence
  chemically synthesized
agtgcttagaatgaaaacttgc

SEQ ID NO: 1054038 - DNA, 22 bp, Artificial Sequence
  chemically synthesized
ttagtgcttagaatgaaaactt

SEQ ID NO: 1054039 - DNA, 22 bp, Artificial Sequence
  chemically synthesized
tcttagtgcttagaatgaaaac

SEQ ID NO: 1054040 - DNA, 22 bp, Artificial Sequence
  chemically synthesized
agattctcttagtgcttagaat

SEQ ID NO: 1054041 - DNA, 22 bp, Artificial Sequence
  chemically synthesized
tgcaagttttcattctaagcac

SEQ ID NO: 1054042 - DNA, 22 bp, Artificial Sequence
  chemically synthesized
aagattctcttagtgcttagaa

SEQ ID NO: 1054043 - DNA, 22 bp, Artificial Sequence
  chemically synthesized
gcaagttttcattctaagcact

SEQ ID NO: 1054044 - DNA, 22 bp, Artificial Sequence
  chemically synthesized
taagattctcttagtgcttaga

SEQ ID NO: 1054045 - DNA, 22 bp, Artificial Sequence
  chemically synthesized
caagttttcattctaagcacta

SEQ ID NO: 1054046 - DNA, 22 bp, Artificial Sequence
  chemically synthesized
tcattctaagcactaagagaat

SEQ ID NO: 1054047 - DNA, 22 bp, Artificial Sequence
  chemically synthesized
cattctaagcactaagagaatc

SEQ ID NO: 1054048 - DNA, 22 bp, Artificial Sequence
  chemically synthesized
attctaagcactaagagaatct

SEQ ID NO: 1054049 - DNA, 22 bp, Artificial Sequence
  chemically synthesized
taagcactaagagaatcttaaa

SEQ ID NO: 1054050 - DNA, 22 bp, Artificial Sequence
  chemically synthesized
agcactaagagaatcttaaaat

SEQ ID NO: 1054051 - DNA, 22 bp, Artificial Sequence
  chemically synthesized
agagaatcttaaaattgcttta

SEQ ID NO: 1054052 - DNA, 22 bp, Artificial Sequence
  chemically synthesized
atcaataatgaataaagcaatt

SEQ ID NO: 1054053 - DNA, 22 bp, Artificial Sequence
  chemically synthesized
aaaattgctttattcattattg

SEQ ID NO: 1054054 - DNA, 22 bp, Artificial Sequence
  chemically synthesized
aaattgctttattcattattga

SEQ ID NO: 1054055 - DNA, 22 bp, Artificial Sequence
  chemically synthesized
ataaaataagtaattaatcaat

SEQ ID NO: 1054056 - DNA, 22 bp, Artificial Sequence
  chemically synthesized
ctttattcattattgattaatt

SEQ ID NO: 1054057 - DNA, 22 bp, Artificial Sequence
  chemically synthesized
tattcattattgattaattact

SEQ ID NO: 1054058 - DNA, 22 bp, Artificial Sequence
  chemically synthesized
attcataaaataagtaattaat

SEQ ID NO: 1054059 - DNA, 22 bp, Artificial Sequence
  chemically synthesized
attcattattgattaattactt

SEQ ID NO: 1054060 - DNA, 22 bp, Artificial Sequence
  chemically synthesized
aattcataaaataagtaattaa

SEQ ID NO: 1054061 - DNA, 22 bp, Artificial Sequence
  chemically synthesized
ttcattattgattaattactta

SEQ ID NO: 1054062 - DNA, 22 bp, Artificial Sequence
  chemically synthesized
tttaattcataaaataagtaat

SEQ ID NO: 1054063 - DNA, 22 bp, Artificial Sequence
  chemically synthesized
attattgattaattacttattt

SEQ ID NO: 1054064 - DNA, 22 bp, Artificial Sequence
  chemically synthesized
gtttaattcataaaataagtaa

SEQ ID NO: 1054065 - DNA, 22 bp, Artificial Sequence
  chemically synthesized
ttgattaattacttattttatg

SEQ ID NO: 1054066 - DNA, 22 bp, Artificial Sequence
  chemically synthesized
attaattacttattttatgaat

SEQ ID NO: 1054067 - DNA, 22 bp, Artificial Sequence
  chemically synthesized
attacttattttatgaattaaa

SEQ ID NO: 1054068 - DNA, 22 bp, Artificial Sequence
  chemically synthesized
cttattttatgaattaaacaaa

SEQ ID NO: 1054069 - DNA, 22 bp, Artificial Sequence
  chemically synthesized
attttatgaattaaacaaatat

SEQ ID NO: 1054070 - DNA, 22 bp, Artificial Sequence
  chemically synthesized
ggtacacagtatatatttgttt

SEQ ID NO: 1054071 - DNA, 22 bp, Artificial Sequence
  chemically synthesized
ttttatgaattaaacaaatata

SEQ ID NO: 1054072 - DNA, 22 bp, Artificial Sequence
  chemically synthesized
tatgaattaaacaaatatatac

SEQ ID NO: 1054073 - DNA, 22 bp, Artificial Sequence
  chemically synthesized
atgaattaaacaaatatatact

SEQ ID NO: 1054074 - DNA, 22 bp, Artificial Sequence
  chemically synthesized
tgaattaaacaaatatatactg

SEQ ID NO: 1054075 - DNA, 22 bp, Artificial Sequence
  chemically synthesized
aacaaatatatactgtgtacct

SEQ ID NO: 1054076 - DNA, 22 bp, Artificial Sequence
  chemically synthesized
aacacccaaaacagtgactagg

SEQ ID NO: 1054077 - DNA, 22 bp, Artificial Sequence
  chemically synthesized
tgtcctcaacacccaaaacagt

SEQ ID NO: 1054078 - DNA, 22 bp, Artificial Sequence
  chemically synthesized
tgtacctagtcactgttttggg

SEQ ID NO: 1054079 - DNA, 22 bp, Artificial Sequence
  chemically synthesized
ctgtgtcctcaacacccaaaac

SEQ ID NO: 1054080 - DNA, 22 bp, Artificial Sequence
  chemically synthesized
gtcactgttttgggtgttgagg

SEQ ID NO: 1054081 - DNA, 22 bp, Artificial Sequence
  chemically synthesized
ccactgctgtgtcctcaacacc

SEQ ID NO: 1054082 - DNA, 22 bp, Artificial Sequence
  chemically synthesized
cccactgctgtgtcctcaacac

SEQ ID NO: 1054083 - DNA, 22 bp, Artificial Sequence
  chemically synthesized
tcccactgctgtgtcctcaaca

SEQ ID NO: 1054084 - DNA, 22 bp, Artificial Sequence
  chemically synthesized
ttcccactgctgtgtcctcaac

SEQ ID NO: 1054085 - DNA, 22 bp, Artificial Sequence
  chemically synthesized
tttcccactgctgtgtcctcaa

SEQ ID NO: 1054086 - DNA, 22 bp, Artificial Sequence
  chemically synthesized
ttttcccactgctgtgtcctca

SEQ ID NO: 1054087 - DNA, 22 bp, Artificial Sequence
  chemically synthesized
tttttcccactgctgtgtcctc

SEQ ID NO: 1054088 - DNA, 22 bp, Artificial Sequence
  chemically synthesized
ttttgggtgttgaggacacagc

SEQ ID NO: 1054089 - DNA, 22 bp, Artificial Sequence
  chemically synthesized
tgggtgttgaggacacagcagt

SEQ ID NO: 1054090 - DNA, 22 bp, Artificial Sequence
  chemically synthesized
tctttttttcccactgctgtgt

SEQ ID NO: 1054091 - DNA, 22 bp, Artificial Sequence
  chemically synthesized
gggtgttgaggacacagcagtg

SEQ ID NO: 1054092 - DNA, 22 bp, Artificial Sequence
  chemically synthesized
ggtgttgaggacacagcagtgg

SEQ ID NO: 1054093 - DNA, 22 bp, Artificial Sequence
  chemically synthesized
aggacacagcagtgggaaaaaa

SEQ ID NO: 1054094 - DNA, 22 bp, Artificial Sequence
  chemically synthesized
caacccaacaatgcaaaaaaaa

SEQ ID NO: 1054095 - DNA, 22 bp, Artificial Sequence
  chemically synthesized
gaagtagagctccaacccaaca

SEQ ID NO: 1054096 - DNA, 22 bp, Artificial Sequence
  chemically synthesized
ttttttgcattgttgggttgga

SEQ ID NO: 1054097 - DNA, 22 bp, Artificial Sequence
  chemically synthesized
tttttgcattgttgggttggag

SEQ ID NO: 1054098 - DNA, 22 bp, Artificial Sequence
  chemically synthesized
ttttgcattgttgggttggagc

SEQ ID NO: 1054099 - DNA, 22 bp, Artificial Sequence
  chemically synthesized
cctagaagtagagctccaaccc

SEQ ID NO: 1054100 - DNA, 22 bp, Artificial Sequence
  chemically synthesized
tttgcattgttgggttggagct

SEQ ID NO: 1054101 - DNA, 22 bp, Artificial Sequence
  chemically synthesized
ttgcattgttgggttggagctc

SEQ ID NO: 1054102 - DNA, 22 bp, Artificial Sequence
  chemically synthesized
tgcattgttgggttggagctct

SEQ ID NO: 1054103 - DNA, 22 bp, Artificial Sequence
  chemically synthesized
gcattgttgggttggagctcta

SEQ ID NO: 1054104 - DNA, 22 bp, Artificial Sequence
  chemically synthesized
cctacctagaagtagagctcca

SEQ ID NO: 1054105 - DNA, 22 bp, Artificial Sequence
  chemically synthesized
cattgttgggttggagctctac

SEQ ID NO: 1054106 - DNA, 22 bp, Artificial Sequence
  chemically synthesized
ccctacctagaagtagagctcc

SEQ ID NO: 1054107 - DNA, 22 bp, Artificial Sequence
  chemically synthesized
tttccctacctagaagtagagc

SEQ ID NO: 1054108 - DNA, 22 bp, Artificial Sequence
  chemically synthesized
atttccctacctagaagtagag

SEQ ID NO: 1054109 - DNA, 22 bp, Artificial Sequence
  chemically synthesized
ttgggttggagctctacttcta

SEQ ID NO: 1054110 - DNA, 22 bp, Artificial Sequence
  chemically synthesized
ggttggagctctacttctaggt

SEQ ID NO: 1054111 - DNA, 22 bp, Artificial Sequence
  chemically synthesized
agtatttatttccctacctaga

SEQ ID NO: 1054112 - DNA, 22 bp, Artificial Sequence
  chemically synthesized
gagtatttatttccctacctag

SEQ ID NO: 1054113 - DNA, 22 bp, Artificial Sequence
  chemically synthesized
gagctctacttctaggtaggga

SEQ ID NO: 1054114 - DNA, 22 bp, Artificial Sequence
  chemically synthesized
ttgagtatttatttccctacct

SEQ ID NO: 1054115 - DNA, 22 bp, Artificial Sequence
  chemically synthesized
cttgagtatttatttccctacc

SEQ ID NO: 1054116 - DNA, 22 bp, Artificial Sequence
  chemically synthesized
tacttctaggtagggaaataaa

SEQ ID NO: 1054117 - DNA, 22 bp, Artificial Sequence
  chemically synthesized
tcttcttgagtatttatttccc

SEQ ID NO: 1054118 - DNA, 22 bp, Artificial Sequence
  chemically synthesized
atcttcttgagtatttatttcc

SEQ ID NO: 1054119 - DNA, 22 bp, Artificial Sequence
  chemically synthesized
cttctaggtagggaaataaata

SEQ ID NO: 1054120 - DNA, 22 bp, Artificial Sequence
  chemically synthesized
tatcttcttgagtatttatttc

SEQ ID NO: 1054121 - DNA, 22 bp, Artificial Sequence
  chemically synthesized
tttatcttcttgagtatttatt

SEQ ID NO: 1054122 - DNA, 22 bp, Artificial Sequence
  chemically synthesized
ctaggtagggaaataaatactc

SEQ ID NO: 1054123 - DNA, 22 bp, Artificial Sequence
  chemically synthesized
ctttatcttcttgagtatttat

SEQ ID NO: 1054124 - DNA, 22 bp, Artificial Sequence
  chemically synthesized
taggtagggaaataaatactca

SEQ ID NO: 1054125 - DNA, 22 bp, Artificial Sequence
  chemically synthesized
ggtagggaaataaatactcaag

SEQ ID NO: 1054126 - DNA, 22 bp, Artificial Sequence
  chemically synthesized
cttctttatcttcttgagtatt

SEQ ID NO: 1054127 - DNA, 22 bp, Artificial Sequence
  chemically synthesized
ccttctttatcttcttgagtat

SEQ ID NO: 1054128 - DNA, 22 bp, Artificial Sequence
  chemically synthesized
tccttctttatcttcttgagta

SEQ ID NO: 1054129 - DNA, 22 bp, Artificial Sequence
  chemically synthesized
aatattttccttctttatcttc

SEQ ID NO: 1054130 - DNA, 22 bp, Artificial Sequence
  chemically synthesized
tcaatattttccttctttatct

SEQ ID NO: 1054131 - DNA, 22 bp, Artificial Sequence
  chemically synthesized
aagaagataaagaaggaaaata

SEQ ID NO: 1054132 - DNA, 22 bp, Artificial Sequence
  chemically synthesized
aataaagtgcatgaccaggaaa

SEQ ID NO: 1054133 - DNA, 22 bp, Artificial Sequence
  chemically synthesized
tcaataaagtgcatgaccagga

SEQ ID NO: 1054134 - DNA, 22 bp, Artificial Sequence
  chemically synthesized
ctcaataaagtgcatgaccagg

SEQ ID NO: 1054135 - DNA, 22 bp, Artificial Sequence
  chemically synthesized
tctcaataaagtgcatgaccag

SEQ ID NO: 1054136 - DNA, 22 bp, Artificial Sequence
  chemically synthesized
ttctcaataaagtgcatgacca

SEQ ID NO: 1054137 - DNA, 22 bp, Artificial Sequence
  chemically synthesized
agaactttcctggtcatgcact

SEQ ID NO: 1054138 - DNA, 22 bp, Artificial Sequence
  chemically synthesized
tttttctcaataaagtgcatga

SEQ ID NO: 1054139 - DNA, 22 bp, Artificial Sequence
  chemically synthesized
atttttctcaataaagtgcatg

SEQ ID NO: 1054140 - DNA, 22 bp, Artificial Sequence
  chemically synthesized
atttatttttctcaataaagtg

SEQ ID NO: 1054141 - DNA, 22 bp, Artificial Sequence
  chemically synthesized
tcctggtcatgcactttattga

SEQ ID NO: 1054142 - DNA, 22 bp, Artificial Sequence
  chemically synthesized
cctggtcatgcactttattgag

SEQ ID NO: 1054143 - DNA, 22 bp, Artificial Sequence
  chemically synthesized
ctggtcatgcactttattgaga

SEQ ID NO: 1054144 - DNA, 22 bp, Artificial Sequence
  chemically synthesized
ctcatttatttttctcaataaa

SEQ ID NO: 1054145 - DNA, 22 bp, Artificial Sequence
  chemically synthesized
cctcatttatttttctcaataa

SEQ ID NO: 1054146 - DNA, 22 bp, Artificial Sequence
  chemically synthesized
tcctcatttatttttctcaata

SEQ ID NO: 1054147 - DNA, 22 bp, Artificial Sequence
  chemically synthesized
gtcatgcactttattgagaaaa

SEQ ID NO: 1054148 - DNA, 22 bp, Artificial Sequence
  chemically synthesized
tccatgctttcctcatttattt

SEQ ID NO: 1054149 - DNA, 22 bp, Artificial Sequence
  chemically synthesized
atccatgctttcctcatttatt

SEQ ID NO: 1054150 - DNA, 22 bp, Artificial Sequence
  chemically synthesized
tatccatgctttcctcatttat

SEQ ID NO: 1054151 - DNA, 22 bp, Artificial Sequence
  chemically synthesized
tattgagaaaaataaatgagga

SEQ ID NO: 1054152 - DNA, 22 bp, Artificial Sequence
  chemically synthesized
ttatccatgctttcctcattta

SEQ ID NO: 1054153 - DNA, 22 bp, Artificial Sequence
  chemically synthesized
attgagaaaaataaatgaggaa

SEQ ID NO: 1054154 - DNA, 22 bp, Artificial Sequence
  chemically synthesized
tttatccatgctttcctcattt

SEQ ID NO: 1054155 - DNA, 22 bp, Artificial Sequence
  chemically synthesized
ttgagaaaaataaatgaggaaa

SEQ ID NO: 1054156 - DNA, 22 bp, Artificial Sequence
  chemically synthesized
agaaaaataaatgaggaaagca

SEQ ID NO: 1054157 - DNA, 22 bp, Artificial Sequence
  chemically synthesized
atgtgtgcacatacaccacaca

SEQ ID NO: 1054158 - DNA, 22 bp, Artificial Sequence
  chemically synthesized
tcatgtgtgcacatacaccaca

SEQ ID NO: 1054159 - DNA, 22 bp, Artificial Sequence
  chemically synthesized
ctcatgtgtgcacatacaccac

SEQ ID NO: 1054160 - DNA, 22 bp, Artificial Sequence
  chemically synthesized
tctcatgtgtgcacatacacca

SEQ ID NO: 1054161 - DNA, 22 bp, Artificial Sequence
  chemically synthesized
aatgaatctttctcatgtgtgc

SEQ ID NO: 1054162 - DNA, 22 bp, Artificial Sequence
  chemically synthesized
caatgaatctttctcatgtgtg

SEQ ID NO: 1054163 - DNA, 22 bp, Artificial Sequence
  chemically synthesized
tcaatgaatctttctcatgtgt

SEQ ID NO: 1054164 - DNA, 22 bp, Artificial Sequence
  chemically synthesized
ttcaatgaatctttctcatgtg

SEQ ID NO: 1054165 - DNA, 22 bp, Artificial Sequence
  chemically synthesized
tttcaatgaatctttctcatgt

SEQ ID NO: 1054166 - DNA, 22 bp, Artificial Sequence
  chemically synthesized
ttttcaatgaatctttctcatg

SEQ ID NO: 1054167 - DNA, 22 bp, Artificial Sequence
  chemically synthesized
aaaagtgtttttttcaatgaat

SEQ ID NO: 1054168 - DNA, 22 bp, Artificial Sequence
  chemically synthesized
ctcaaaagtgtttttttcaatg

SEQ ID NO: 1054169 - DNA, 22 bp, Artificial Sequence
  chemically synthesized
actcaaaagtgtttttttcaat

SEQ ID NO: 1054170 - DNA, 22 bp, Artificial Sequence
  chemically synthesized
tactcaaaagtgtttttttcaa

SEQ ID NO: 1054171 - DNA, 22 bp, Artificial Sequence
  chemically synthesized
tttactcaaaagtgtttttttc

SEQ ID NO: 1054172 - DNA, 22 bp, Artificial Sequence
  chemically synthesized
ctttactcaaaagtgttttttt

SEQ ID NO: 1054173 - DNA, 22 bp, Artificial Sequence
  chemically synthesized
acttctttactcaaaagtgttt

SEQ ID NO: 1054174 - DNA, 22 bp, Artificial Sequence
  chemically synthesized
aacttctttactcaaaagtgtt

SEQ ID NO: 1054175 - DNA, 22 bp, Artificial Sequence
  chemically synthesized
attgaaaaaaacacttttgagt

SEQ ID NO: 1054176 - DNA, 22 bp, Artificial Sequence
  chemically synthesized
ccttaacttctttactcaaaag

SEQ ID NO: 1054177 - DNA, 22 bp, Artificial Sequence
  chemically synthesized
tgccttaacttctttactcaaa

SEQ ID NO: 1054178 - DNA, 22 bp, Artificial Sequence
  chemically synthesized
aaaaaaacacttttgagtaaag

SEQ ID NO: 1054179 - DNA, 22 bp, Artificial Sequence
  chemically synthesized
ctgccttaacttctttactcaa

SEQ ID NO: 1054180 - DNA, 22 bp, Artificial Sequence
  chemically synthesized
gtttctgccttaacttctttac

SEQ ID NO: 1054181 - DNA, 22 bp, Artificial Sequence
  chemically synthesized
cgtttctgccttaacttcttta

SEQ ID NO: 1054182 - DNA, 22 bp, Artificial Sequence
  chemically synthesized
tcgtttctgccttaacttcttt

SEQ ID NO: 1054183 - DNA, 22 bp, Artificial Sequence
  chemically synthesized
ttcgtttctgccttaacttctt

SEQ ID NO: 1054184 - DNA, 22 bp, Artificial Sequence
  chemically synthesized
ttttcgtttctgccttaacttc

SEQ ID NO: 1054185 - DNA, 22 bp, Artificial Sequence
  chemically synthesized
ttgagtaaagaagttaaggcag

SEQ ID NO: 1054186 - DNA, 22 bp, Artificial Sequence
  chemically synthesized
tgagtaaagaagttaaggcaga

SEQ ID NO: 1054187 - DNA, 22 bp, Artificial Sequence
  chemically synthesized
gagtaaagaagttaaggcagaa

SEQ ID NO: 1054188 - DNA, 22 bp, Artificial Sequence
  chemically synthesized
agtaaagaagttaaggcagaaa

SEQ ID NO: 1054189 - DNA, 22 bp, Artificial Sequence
  chemically synthesized
catgtggctcttttcgtttctg

SEQ ID NO: 1054190 - DNA, 22 bp, Artificial Sequence
  chemically synthesized
tccatgtggctcttttcgtttc

SEQ ID NO: 1054191 - DNA, 22 bp, Artificial Sequence
  chemically synthesized
ctccatgtggctcttttcgttt

SEQ ID NO: 1054192 - DNA, 22 bp, Artificial Sequence
  chemically synthesized
aggcagaaacgaaaagagccac

SEQ ID NO: 1054193 - DNA, 22 bp, Artificial Sequence
  chemically synthesized
ccccgtttctccatgtggctct

SEQ ID NO: 1054194 - DNA, 22 bp, Artificial Sequence
  chemically synthesized
aaataatcctcccccgtttctc

SEQ ID NO: 1054195 - DNA, 22 bp, Artificial Sequence
  chemically synthesized
cctaaaataatcctcccccgtt

SEQ ID NO: 1054196 - DNA, 22 bp, Artificial Sequence
  chemically synthesized
tgcctaaaataatcctcccccg

SEQ ID NO: 1054197 - DNA, 22 bp, Artificial Sequence
  chemically synthesized
cctctgcctaaaataatcctcc

SEQ ID NO: 1054198 - DNA, 22 bp, Artificial Sequence
  chemically synthesized
tgtgctacctctgcctaaaata

SEQ ID NO: 1054199 - DNA, 22 bp, Artificial Sequence
  chemically synthesized
cattgtgtgctacctctgccta

SEQ ID NO: 1054200 - DNA, 22 bp, Artificial Sequence
  chemically synthesized
ttttaggcagaggtagcacaca

SEQ ID NO: 1054201 - DNA, 22 bp, Artificial Sequence
  chemically synthesized
taggcagaggtagcacacaatg

SEQ ID NO: 1054202 - DNA, 22 bp, Artificial Sequence
  chemically synthesized
aggcagaggtagcacacaatgc

SEQ ID NO: 1054203 - DNA, 22 bp, Artificial Sequence
  chemically synthesized
ggcagaggtagcacacaatgca

SEQ ID NO: 1054204 - DNA, 22 bp, Artificial Sequence
  chemically synthesized
acatgcacccattgcattgtgt

SEQ ID NO: 1054205 - DNA, 22 bp, Artificial Sequence
  chemically synthesized
acagatctgacatgcacccatt

SEQ ID NO: 1054206 - DNA, 22 bp, Artificial Sequence
  chemically synthesized
cacagatctgacatgcacccat

SEQ ID NO: 1054207 - DNA, 22 bp, Artificial Sequence
  chemically synthesized
tcacagatctgacatgcaccca

SEQ ID NO: 1054208 - DNA, 22 bp, Artificial Sequence
  chemically synthesized
ctttcacagatctgacatgcac

SEQ ID NO: 1054209 - DNA, 22 bp, Artificial Sequence
  chemically synthesized
ctgctttcacagatctgacatg

SEQ ID NO: 1054210 - DNA, 22 bp, Artificial Sequence
  chemically synthesized
ctgctgctttcacagatctgac

SEQ ID NO: 1054211 - DNA, 22 bp, Artificial Sequence
  chemically synthesized
gctgctgctttcacagatctga

SEQ ID NO: 1054212 - DNA, 22 bp, Artificial Sequence
  chemically synthesized
tgctgctgctttcacagatctg

SEQ ID NO: 1054213 - DNA, 22 bp, Artificial Sequence
  chemically synthesized
acccctttgctgctgctttcac

SEQ ID NO: 1054214 - DNA, 22 bp, Artificial Sequence
  chemically synthesized
tgttgacccctttgctgctgct

SEQ ID NO: 1054215 - DNA, 22 bp, Artificial Sequence
  chemically synthesized
cacctatgttgacccctttgct

SEQ ID NO: 1054216 - DNA, 22 bp, Artificial Sequence
  chemically synthesized
tgaaagcagcagcaaaggggtc

SEQ ID NO: 1054217 - DNA, 22 bp, Artificial Sequence
  chemically synthesized
ctccacctatgttgaccccttt

SEQ ID NO: 1054218 - DNA, 22 bp, Artificial Sequence
  chemically synthesized
tgctccacctatgttgacccct

SEQ ID NO: 1054219 - DNA, 22 bp, Artificial Sequence
  chemically synthesized
ctctgctccacctatgttgacc

SEQ ID NO: 1054220 - DNA, 22 bp, Artificial Sequence
  chemically synthesized
cctctgctccacctatgttgac

SEQ ID NO: 1054221 - DNA, 22 bp, Artificial Sequence
  chemically synthesized
tcctctgctccacctatgttga

SEQ ID NO: 1054222 - DNA, 22 bp, Artificial Sequence
  chemically synthesized
atactttcctctgctccaccta

SEQ ID NO: 1054223 - DNA, 22 bp, Artificial Sequence
  chemically synthesized
aatactttcctctgctccacct

SEQ ID NO: 1054224 - DNA, 22 bp, Artificial Sequence
  chemically synthesized
ttaatactttcctctgctccac

SEQ ID NO: 1054225 - DNA, 22 bp, Artificial Sequence
  chemically synthesized
tctcttaatactttcctctgct

SEQ ID NO: 1054226 - DNA, 22 bp, Artificial Sequence
  chemically synthesized
atctcttaatactttcctctgc

SEQ ID NO: 1054227 - DNA, 22 bp, Artificial Sequence
  chemically synthesized
aggccttatctcttaatacttt

SEQ ID NO: 1054228 - DNA, 22 bp, Artificial Sequence
  chemically synthesized
actcaggccttatctcttaata

SEQ ID NO: 1054229 - DNA, 22 bp, Artificial Sequence
  chemically synthesized
aactcaggccttatctcttaat

SEQ ID NO: 1054230 - DNA, 22 bp, Artificial Sequence
  chemically synthesized
ttaactcaggccttatctctta

SEQ ID NO: 1054231 - DNA, 22 bp, Artificial Sequence
  chemically synthesized
cttaactcaggccttatctctt

SEQ ID NO: 1054232 - DNA, 22 bp, Artificial Sequence
  chemically synthesized
gcccacttcttaactcaggcct

SEQ ID NO: 1054233 - DNA, 22 bp, Artificial Sequence
  chemically synthesized
gctggcccacttcttaactcag

SEQ ID NO: 1054234 - DNA, 22 bp, Artificial Sequence
  chemically synthesized
agagataaggcctgagttaaga

SEQ ID NO: 1054235 - DNA, 22 bp, Artificial Sequence
  chemically synthesized
acctggctggcccacttcttaa

SEQ ID NO: 1054236 - DNA, 22 bp, Artificial Sequence
  chemically synthesized
agttaagaagtgggccagccag

SEQ ID NO: 1054237 - DNA, 22 bp, Artificial Sequence
  chemically synthesized
aagggatatctgacctggctgg

SEQ ID NO: 1054238 - DNA, 22 bp, Artificial Sequence
  chemically synthesized
caagggatatctgacctggctg

SEQ ID NO: 1054239 - DNA, 22 bp, Artificial Sequence
  chemically synthesized
agaagtgggccagccaggtcag

SEQ ID NO: 1054240 - DNA, 22 bp, Artificial Sequence
  chemically synthesized
atgaatttcaagggatatctga

SEQ ID NO: 1054241 - DNA, 22 bp, Artificial Sequence
  chemically synthesized
catgaatttcaagggatatctg

SEQ ID NO: 1054242 - DNA, 22 bp, Artificial Sequence
  chemically synthesized
ttcatgaatttcaagggatatc

SEQ ID NO: 1054243 - DNA, 22 bp, Artificial Sequence
  chemically synthesized
agtgaaatccaaaactcttcat

SEQ ID NO: 1054244 - DNA, 22 bp, Artificial Sequence
  chemically synthesized
aagtgaaatccaaaactcttca

SEQ ID NO: 1054245 - DNA, 22 bp, Artificial Sequence
  chemically synthesized
taagtgaaatccaaaactcttc

SEQ ID NO: 1054246 - DNA, 22 bp, Artificial Sequence
  chemically synthesized
ttaagtgaaatccaaaactctt

SEQ ID NO: 1054247 - DNA, 22 bp, Artificial Sequence
  chemically synthesized
gaaattcatgaagagttttgga

SEQ ID NO: 1054248 - DNA, 22 bp, Artificial Sequence
  chemically synthesized
aaattcatgaagagttttggat

SEQ ID NO: 1054249 - DNA, 22 bp, Artificial Sequence
  chemically synthesized
tttttaagtgaaatccaaaact

SEQ ID NO: 1054250 - DNA, 22 bp, Artificial Sequence
  chemically synthesized
atgaagagttttggatttcact

SEQ ID NO: 1054251 - DNA, 22 bp, Artificial Sequence
  chemically synthesized
ccatctatttttaagtgaaatc

SEQ ID NO: 1054252 - DNA, 22 bp, Artificial Sequence
  chemically synthesized
aatgaattcccatctattttta

SEQ ID NO: 1054253 - DNA, 22 bp, Artificial Sequence
  chemically synthesized
tggatttcacttaaaaatagat

SEQ ID NO: 1054254 - DNA, 22 bp, Artificial Sequence
  chemically synthesized
caatgaattcccatctattttt

SEQ ID NO: 1054255 - DNA, 22 bp, Artificial Sequence
  chemically synthesized
ggatttcacttaaaaatagatg

SEQ ID NO: 1054256 - DNA, 22 bp, Artificial Sequence
  chemically synthesized
gatttcacttaaaaatagatgg

SEQ ID NO: 1054257 - DNA, 22 bp, Artificial Sequence
  chemically synthesized
cacttaaaaatagatgggaatt

SEQ ID NO: 1054258 - DNA, 22 bp, Artificial Sequence
  chemically synthesized
acttaaaaatagatgggaattc

SEQ ID NO: 1054259 - DNA, 22 bp, Artificial Sequence
  chemically synthesized
aaaaatagatgggaattcattg

SEQ ID NO: 1054260 - DNA, 22 bp, Artificial Sequence
  chemically synthesized
atcataatccttcaatgaattc

SEQ ID NO: 1054261 - DNA, 22 bp, Artificial Sequence
  chemically synthesized
aaaatagatgggaattcattga

SEQ ID NO: 1054262 - DNA, 22 bp, Artificial Sequence
  chemically synthesized
aatctgatcataatccttcaat

SEQ ID NO: 1054263 - DNA, 22 bp, Artificial Sequence
  chemically synthesized
aaatctgatcataatccttcaa

SEQ ID NO: 1054264 - DNA, 22 bp, Artificial Sequence
  chemically synthesized
attgaaggattatgatcagatt

SEQ ID NO: 1054265 - DNA, 22 bp, Artificial Sequence
  chemically synthesized
aaggattatgatcagatttaaa

SEQ ID NO: 1054266 - DNA, 22 bp, Artificial Sequence
  chemically synthesized
aaaaatataaaccatatttaaa

SEQ ID NO: 1054267 - DNA, 22 bp, Artificial Sequence
  chemically synthesized
gaaaaatataaaccatatttaa

SEQ ID NO: 1054268 - DNA, 22 bp, Artificial Sequence
  chemically synthesized
tgatcagatttaaatatggttt

SEQ ID NO: 1054269 - DNA, 22 bp, Artificial Sequence
  chemically synthesized
aaatatggtttatatttttcaa

SEQ ID NO: 1054270 - DNA, 22 bp, Artificial Sequence
  chemically synthesized
aatatggtttatatttttcaaa

SEQ ID NO: 1054271 - DNA, 22 bp, Artificial Sequence
  chemically synthesized
cacaatacacagggacaacatt

SEQ ID NO: 1054272 - DNA, 22 bp, Artificial Sequence
  chemically synthesized
atatttttcaaatgttgtccct

SEQ ID NO: 1054273 - DNA, 22 bp, Artificial Sequence
  chemically synthesized
tacacaatacacagggacaaca

SEQ ID NO: 1054274 - DNA, 22 bp, Artificial Sequence
  chemically synthesized
tatttttcaaatgttgtccctg

SEQ ID NO: 1054275 - DNA, 22 bp, Artificial Sequence
  chemically synthesized
tctctacacaatacacagggac

SEQ ID NO: 1054276 - DNA, 22 bp, Artificial Sequence
  chemically synthesized
ttcaaatgttgtccctgtgtat

SEQ ID NO: 1054277 - DNA, 22 bp, Artificial Sequence
  chemically synthesized
tcaaatgttgtccctgtgtatt

SEQ ID NO: 1054278 - DNA, 22 bp, Artificial Sequence
  chemically synthesized
caaatgttgtccctgtgtattg

SEQ ID NO: 1054279 - DNA, 22 bp, Artificial Sequence
  chemically synthesized
aaatgttgtccctgtgtattgt

SEQ ID NO: 1054280 - DNA, 22 bp, Artificial Sequence
  chemically synthesized
gcctatctctacacaatacaca

SEQ ID NO: 1054281 - DNA, 22 bp, Artificial Sequence
  chemically synthesized
agcctatctctacacaatacac

SEQ ID NO: 1054282 - DNA, 22 bp, Artificial Sequence
  chemically synthesized
tagcctatctctacacaataca

SEQ ID NO: 1054283 - DNA, 22 bp, Artificial Sequence
  chemically synthesized
tttagcctatctctacacaata

SEQ ID NO: 1054284 - DNA, 22 bp, Artificial Sequence
  chemically synthesized
ctttagcctatctctacacaat

SEQ ID NO: 1054285 - DNA, 22 bp, Artificial Sequence
  chemically synthesized
tctttagcctatctctacacaa

SEQ ID NO: 1054286 - DNA, 22 bp, Artificial Sequence
  chemically synthesized
tccctgtgtattgtgtagagat

SEQ ID NO: 1054287 - DNA, 22 bp, Artificial Sequence
  chemically synthesized
tgtattgtgtagagataggcta

SEQ ID NO: 1054288 - DNA, 22 bp, Artificial Sequence
  chemically synthesized
cgcatgctttctttagcctatc

SEQ ID NO: 1054289 - DNA, 22 bp, Artificial Sequence
  chemically synthesized
tgtagagataggctaaagaaag

SEQ ID NO: 1054290 - DNA, 22 bp, Artificial Sequence
  chemically synthesized
agagaaaaaaaaaaatctacgc

SEQ ID NO: 1054291 - DNA, 22 bp, Artificial Sequence
  chemically synthesized
cagagaaaaaaaaaaatctacg

SEQ ID NO: 1054292 - DNA, 22 bp, Artificial Sequence
  chemically synthesized
aagaaagcatgcgtagattttt

SEQ ID NO: 1054293 - DNA, 22 bp, Artificial Sequence
  chemically synthesized
tcagagaaaaaaaaaaatctac

SEQ ID NO: 1054294 - DNA, 22 bp, Artificial Sequence
  chemically synthesized
aaattttcagagaaaaaaaaaa

SEQ ID NO: 1054295 - DNA, 22 bp, Artificial Sequence
  chemically synthesized
caaattttcagagaaaaaaaaa

SEQ ID NO: 1054296 - DNA, 22 bp, Artificial Sequence
  chemically synthesized
tcaaattttcagagaaaaaaaa

SEQ ID NO: 1054297 - DNA, 22 bp, Artificial Sequence
  chemically synthesized
tttcaaattttcagagaaaaaa

SEQ ID NO: 1054298 - DNA, 22 bp, Artificial Sequence
  chemically synthesized
ttttttttctctgaaaatttga

SEQ ID NO: 1054299 - DNA, 22 bp, Artificial Sequence
  chemically synthesized
tttttttctctgaaaatttgaa

SEQ ID NO: 1054300 - DNA, 22 bp, Artificial Sequence
  chemically synthesized
ttttttctctgaaaatttgaaa

SEQ ID NO: 1054301 - DNA, 22 bp, Artificial Sequence
  chemically synthesized
tttttctctgaaaatttgaaag

SEQ ID NO: 1054302 - DNA, 22 bp, Artificial Sequence
  chemically synthesized
ttttctctgaaaatttgaaaga

SEQ ID NO: 1054303 - DNA, 22 bp, Artificial Sequence
  chemically synthesized
tttctctgaaaatttgaaagaa

SEQ ID NO: 1054304 - DNA, 22 bp, Artificial Sequence
  chemically synthesized
ttctctgaaaatttgaaagaac

SEQ ID NO: 1054305 - DNA, 22 bp, Artificial Sequence
  chemically synthesized
tctctgaaaatttgaaagaacg

SEQ ID NO: 1054306 - DNA, 22 bp, Artificial Sequence
  chemically synthesized
ctctgaaaatttgaaagaacgg

SEQ ID NO: 1054307 - DNA, 22 bp, Artificial Sequence
  chemically synthesized
tctgaaaatttgaaagaacggt

SEQ ID NO: 1054308 - DNA, 22 bp, Artificial Sequence
  chemically synthesized
tgaaaatttgaaagaacggtgc

SEQ ID NO: 1054309 - DNA, 22 bp, Artificial Sequence
  chemically synthesized
aaatgcagtggaagcaccgttc

SEQ ID NO: 1054310 - DNA, 22 bp, Artificial Sequence
  chemically synthesized
aaaatttgaaagaacggtgctt

SEQ ID NO: 1054311 - DNA, 22 bp, Artificial Sequence
  chemically synthesized
ccctcaaatgcagtggaagcac

SEQ ID NO: 1054312 - DNA, 22 bp, Artificial Sequence
  chemically synthesized
cccctcaaatgcagtggaagca

SEQ ID NO: 1054313 - DNA, 22 bp, Artificial Sequence
  chemically synthesized
tcccctcaaatgcagtggaagc

SEQ ID NO: 1054314 - DNA, 22 bp, Artificial Sequence
  chemically synthesized
gaaagaacggtgcttccactgc

SEQ ID NO: 1054315 - DNA, 22 bp, Artificial Sequence
  chemically synthesized
ttcccctcaaatgcagtggaag

SEQ ID NO: 1054316 - DNA, 22 bp, Artificial Sequence
  chemically synthesized
aaagaacggtgcttccactgca

SEQ ID NO: 1054317 - DNA, 22 bp, Artificial Sequence
  chemically synthesized
ttttcccctcaaatgcagtgga

SEQ ID NO: 1054318 - DNA, 22 bp, Artificial Sequence
  chemically synthesized
ttcttttcccctcaaatgcagt

SEQ ID NO: 1054319 - DNA, 22 bp, Artificial Sequence
  chemically synthesized
ccactgcatttgaggggaaaag

SEQ ID NO: 1054320 - DNA, 22 bp, Artificial Sequence
  chemically synthesized
cactgcatttgaggggaaaaga

SEQ ID NO: 1054321 - DNA, 22 bp, Artificial Sequence
  chemically synthesized
aaacaaaattattcttttcccc

SEQ ID NO: 1054322 - DNA, 22 bp, Artificial Sequence
  chemically synthesized
attaaaacaaaattattctttt

SEQ ID NO: 1054323 - DNA, 22 bp, Artificial Sequence
  chemically synthesized
catttgaggggaaaagaataat

SEQ ID NO: 1054324 - DNA, 22 bp, Artificial Sequence
  chemically synthesized
gattaaaacaaaattattcttt

SEQ ID NO: 1054325 - DNA, 22 bp, Artificial Sequence
  chemically synthesized
gaggggaaaagaataattttgt

SEQ ID NO: 1054326 - DNA, 22 bp, Artificial Sequence
  chemically synthesized
aggggaaaagaataattttgtt

SEQ ID NO: 1054327 - DNA, 22 bp, Artificial Sequence
  chemically synthesized
gtgacttgattaaaacaaaatt

SEQ ID NO: 1054328 - DNA, 22 bp, Artificial Sequence
  chemically synthesized
atccagcctcgtgacttgatta

SEQ ID NO: 1054329 - DNA, 22 bp, Artificial Sequence
  chemically synthesized
catccagcctcgtgacttgatt

SEQ ID NO: 1054330 - DNA, 22 bp, Artificial Sequence
  chemically synthesized
tcatccagcctcgtgacttgat

SEQ ID NO: 1054331 - DNA, 22 bp, Artificial Sequence
  chemically synthesized
ttttcatccagcctcgtgactt

SEQ ID NO: 1054332 - DNA, 22 bp, Artificial Sequence
  chemically synthesized
tgttttaatcaagtcacgaggc

SEQ ID NO: 1054333 - DNA, 22 bp, Artificial Sequence
  chemically synthesized
gttttaatcaagtcacgaggct

SEQ ID NO: 1054334 - DNA, 22 bp, Artificial Sequence
  chemically synthesized
ctgttttcatccagcctcgtga

SEQ ID NO: 1054335 - DNA, 22 bp, Artificial Sequence
  chemically synthesized
ttttaatcaagtcacgaggctg

SEQ ID NO: 1054336 - DNA, 22 bp, Artificial Sequence
  chemically synthesized
gctgttttcatccagcctcgtg

SEQ ID NO: 1054337 - DNA, 22 bp, Artificial Sequence
  chemically synthesized
taatcaagtcacgaggctggat

SEQ ID NO: 1054338 - DNA, 22 bp, Artificial Sequence
  chemically synthesized
aatcaagtcacgaggctggatg

SEQ ID NO: 1054339 - DNA, 22 bp, Artificial Sequence
  chemically synthesized
atcaagtcacgaggctggatga

SEQ ID NO: 1054340 - DNA, 22 bp, Artificial Sequence
  chemically synthesized
tatatgtcttgctgttttcatc

SEQ ID NO: 1054341 - DNA, 22 bp, Artificial Sequence
  chemically synthesized
tatatatgtcttgctgttttca

SEQ ID NO: 1054342 - DNA, 22 bp, Artificial Sequence
  chemically synthesized
ttctatatatgtcttgctgttt

SEQ ID NO: 1054343 - DNA, 22 bp, Artificial Sequence
  chemically synthesized
attctatatatgtcttgctgtt

SEQ ID NO: 1054344 - DNA, 22 bp, Artificial Sequence
  chemically synthesized
tttattctatatatgtcttgct

SEQ ID NO: 1054345 - DNA, 22 bp, Artificial Sequence
  chemically synthesized
atttattctatatatgtcttgc

SEQ ID NO: 1054346 - DNA, 22 bp, Artificial Sequence
  chemically synthesized
tatttattctatatatgtcttg

SEQ ID NO: 1054347 - DNA, 22 bp, Artificial Sequence
  chemically synthesized
gatgaaaacagcaagacatata

SEQ ID NO: 1054348 - DNA, 22 bp, Artificial Sequence
  chemically synthesized
ttatttattctatatatgtctt

SEQ ID NO: 1054349 - DNA, 22 bp, Artificial Sequence
  chemically synthesized
ccatttttatttattctatata

SEQ ID NO: 1054350 - DNA, 22 bp, Artificial Sequence
  chemically synthesized
gccatttttatttattctatat

SEQ ID NO: 1054351 - DNA, 22 bp, Artificial Sequence
  chemically synthesized
ggcacttgccatttttatttat

SEQ ID NO: 1054352 - DNA, 22 bp, Artificial Sequence
  chemically synthesized
gggcacttgccatttttattta

SEQ ID NO: 1054353 - DNA, 22 bp, Artificial Sequence
  chemically synthesized
agtccttgggcacttgccattt

SEQ ID NO: 1054354 - DNA, 22 bp, Artificial Sequence
  chemically synthesized
agtgctcagtccttgggcactt

SEQ ID NO: 1054355 - DNA, 22 bp, Artificial Sequence
  chemically synthesized
aaatgcctcagtgctcagtcct

SEQ ID NO: 1054356 - DNA, 22 bp, Artificial Sequence
  chemically synthesized
atgctgaaatgcctcagtgctc

SEQ ID NO: 1054357 - DNA, 22 bp, Artificial Sequence
  chemically synthesized
taatgctgaaatgcctcagtgc

SEQ ID NO: 1054358 - DNA, 22 bp, Artificial Sequence
  chemically synthesized
tctaatgctgaaatgcctcagt

SEQ ID NO: 1054359 - DNA, 22 bp, Artificial Sequence
  chemically synthesized
ctctaatgctgaaatgcctcag

SEQ ID NO: 1054360 - DNA, 22 bp, Artificial Sequence
  chemically synthesized
cttctctaatgctgaaatgcct

SEQ ID NO: 1054361 - DNA, 22 bp, Artificial Sequence
  chemically synthesized
agcactgaggcatttcagcatt

SEQ ID NO: 1054362 - DNA, 22 bp, Artificial Sequence
  chemically synthesized
aggcatttcagcattagagaag

SEQ ID NO: 1054363 - DNA, 22 bp, Artificial Sequence
  chemically synthesized
cataggtagtacctacttctct

SEQ ID NO: 1054364 - DNA, 22 bp, Artificial Sequence
  chemically synthesized
ccataggtagtacctacttctc

SEQ ID NO: 1054365 - DNA, 22 bp, Artificial Sequence
  chemically synthesized
cagcattagagaagtaggtact

SEQ ID NO: 1054366 - DNA, 22 bp, Artificial Sequence
  chemically synthesized
agcattagagaagtaggtacta

SEQ ID NO: 1054367 - DNA, 22 bp, Artificial Sequence
  chemically synthesized
agtttccataggtagtacctac

SEQ ID NO: 1054368 - DNA, 22 bp, Artificial Sequence
  chemically synthesized
tcagtttccataggtagtacct

SEQ ID NO: 1054369 - DNA, 22 bp, Artificial Sequence
  chemically synthesized
ctcagtttccataggtagtacc

SEQ ID NO: 1054370 - DNA, 22 bp, Artificial Sequence
  chemically synthesized
tttctcagtttccataggtagt

SEQ ID NO: 1054371 - DNA, 22 bp, Artificial Sequence
  chemically synthesized
gagaagtaggtactacctatgg

SEQ ID NO: 1054372 - DNA, 22 bp, Artificial Sequence
  chemically synthesized
tgtattgtttctcagtttccat

SEQ ID NO: 1054373 - DNA, 22 bp, Artificial Sequence
  chemically synthesized
tatgtattgtttctcagtttcc

SEQ ID NO: 1054374 - DNA, 22 bp, Artificial Sequence
  chemically synthesized
ctatgtattgtttctcagtttc

SEQ ID NO: 1054375 - DNA, 22 bp, Artificial Sequence
  chemically synthesized
tctatgtattgtttctcagttt

SEQ ID NO: 1054376 - DNA, 22 bp, Artificial Sequence
  chemically synthesized
cctttctatgtattgtttctca

SEQ ID NO: 1054377 - DNA, 22 bp, Artificial Sequence
  chemically synthesized
cctatggaaactgagaaacaat

SEQ ID NO: 1054378 - DNA, 22 bp, Artificial Sequence
  chemically synthesized
ctacctttctatgtattgtttc

SEQ ID NO: 1054379 - DNA, 22 bp, Artificial Sequence
  chemically synthesized
tggaaactgagaaacaatacat

SEQ ID NO: 1054380 - DNA, 22 bp, Artificial Sequence
  chemically synthesized
cctgctacctttctatgtattg

SEQ ID NO: 1054381 - DNA, 22 bp, Artificial Sequence
  chemically synthesized
acctgctacctttctatgtatt

SEQ ID NO: 1054382 - DNA, 22 bp, Artificial Sequence
  chemically synthesized
agaaacaatacatagaaaggta

SEQ ID NO: 1054383 - DNA, 22 bp, Artificial Sequence
  chemically synthesized
atccagtttacctgctaccttt

SEQ ID NO: 1054384 - DNA, 22 bp, Artificial Sequence
  chemically synthesized
catccagtttacctgctacctt

SEQ ID NO: 1054385 - DNA, 22 bp, Artificial Sequence
  chemically synthesized
tcatccagtttacctgctacct

SEQ ID NO: 1054386 - DNA, 22 bp, Artificial Sequence
  chemically synthesized
ttcatccagtttacctgctacc

SEQ ID NO: 1054387 - DNA, 22 bp, Artificial Sequence
  chemically synthesized
agtttttcatccagtttacctg

SEQ ID NO: 1054388 - DNA, 22 bp, Artificial Sequence
  chemically synthesized
gatgaaaaacttaaccaccttc

SEQ ID NO: 1054389 - DNA, 22 bp, Artificial Sequence
  chemically synthesized
gacatcaatgaaacatgagaag

SEQ ID NO: 1054390 - DNA, 22 bp, Artificial Sequence
  chemically synthesized
aaccaccttctcatgtttcatt

SEQ ID NO: 1054391 - DNA, 22 bp, Artificial Sequence
  chemically synthesized
accaccttctcatgtttcattg

SEQ ID NO: 1054392 - DNA, 22 bp, Artificial Sequence
  chemically synthesized
ctcatgtttcattgatgtccag

SEQ ID NO: 1054393 - DNA, 22 bp, Artificial Sequence
  chemically synthesized
tcatgtttcattgatgtccagc

SEQ ID NO: 1054394 - DNA, 22 bp, Artificial Sequence
  chemically synthesized
atgtttcattgatgtccagcat

SEQ ID NO: 1054395 - DNA, 22 bp, Artificial Sequence
  chemically synthesized
aaaaacagaaaaatgctggaca

SEQ ID NO: 1054396 - DNA, 22 bp, Artificial Sequence
  chemically synthesized
ttaaaaaacagaaaaatgctgg

SEQ ID NO: 1054397 - DNA, 22 bp, Artificial Sequence
  chemically synthesized
cattgatgtccagcatttttct

SEQ ID NO: 1054398 - DNA, 22 bp, Artificial Sequence
  chemically synthesized
attgatgtccagcatttttctg

SEQ ID NO: 1054399 - DNA, 22 bp, Artificial Sequence
  chemically synthesized
atgtccagcatttttctgtttt

SEQ ID NO: 1054400 - DNA, 22 bp, Artificial Sequence
  chemically synthesized
ccgtgtatgaaagtgtctatta

SEQ ID NO: 1054401 - DNA, 22 bp, Artificial Sequence
  chemically synthesized
accgtgtatgaaagtgtctatt

SEQ ID NO: 1054402 - DNA, 22 bp, Artificial Sequence
  chemically synthesized
ttctgttttttaatagacactt

SEQ ID NO: 1054403 - DNA, 22 bp, Artificial Sequence
  chemically synthesized
tctgttttttaatagacacttt

SEQ ID NO: 1054404 - DNA, 22 bp, Artificial Sequence
  chemically synthesized
ctgttttttaatagacactttc

SEQ ID NO: 1054405 - DNA, 22 bp, Artificial Sequence
  chemically synthesized
tgttttttaatagacactttca

SEQ ID NO: 1054406 - DNA, 22 bp, Artificial Sequence
  chemically synthesized
ttttttaatagacactttcata

SEQ ID NO: 1054407 - DNA, 22 bp, Artificial Sequence
  chemically synthesized
tttaatagacactttcatacac

SEQ ID NO: 1054408 - DNA, 22 bp, Artificial Sequence
  chemically synthesized
ttaatagacactttcatacacg

SEQ ID NO: 1054409 - DNA, 22 bp, Artificial Sequence
  chemically synthesized
taatagacactttcatacacgg

SEQ ID NO: 1054410 - DNA, 22 bp, Artificial Sequence
  chemically synthesized
aataaacatttaccgtgtatga

SEQ ID NO: 1054411 - DNA, 22 bp, Artificial Sequence
  chemically synthesized
aatagacactttcatacacggt

SEQ ID NO: 1054412 - DNA, 22 bp, Artificial Sequence
  chemically synthesized
aaataaacatttaccgtgtatg

SEQ ID NO: 1054413 - DNA, 22 bp, Artificial Sequence
  chemically synthesized
atagacactttcatacacggta

SEQ ID NO: 1054414 - DNA, 22 bp, Artificial Sequence
  chemically synthesized
tcatacacggtaaatgtttatt

SEQ ID NO: 1054415 - DNA, 22 bp, Artificial Sequence
  chemically synthesized
catacacggtaaatgtttattt

SEQ ID NO: 1054416 - DNA, 22 bp, Artificial Sequence
  chemically synthesized
atacacggtaaatgtttattta

SEQ ID NO: 1054417 - DNA, 22 bp, Artificial Sequence
  chemically synthesized
atttaagacttttccatttttt

SEQ ID NO: 1054418 - DNA, 22 bp, Artificial Sequence
  chemically synthesized
tttaagacttttccattttttt

SEQ ID NO: 1054419 - DNA, 22 bp, Artificial Sequence
  chemically synthesized
aagacttttccatttttttacc

SEQ ID NO: 1054420 - DNA, 22 bp, Artificial Sequence
  chemically synthesized
agacttttccatttttttacca

SEQ ID NO: 1054421 - DNA, 22 bp, Artificial Sequence
  chemically synthesized
ttccatttttttaccattttct

SEQ ID NO: 1054422 - DNA, 22 bp, Artificial Sequence
  chemically synthesized
tccatttttttaccattttctt

SEQ ID NO: 1054423 - DNA, 22 bp, Artificial Sequence
  chemically synthesized
ccatttttttaccattttcttt

SEQ ID NO: 1054424 - DNA, 22 bp, Artificial Sequence
  chemically synthesized
catttttttaccattttctttg

SEQ ID NO: 1054425 - DNA, 22 bp, Artificial Sequence
  chemically synthesized
ttttaccattttctttgcacat

SEQ ID NO: 1054426 - DNA, 22 bp, Artificial Sequence
  chemically synthesized
caaaagaaaatgatgtgcaaag

SEQ ID NO: 1054427 - DNA, 22 bp, Artificial Sequence
  chemically synthesized
tttaccattttctttgcacatc

SEQ ID NO: 1054428 - DNA, 22 bp, Artificial Sequence
  chemically synthesized
ttaccattttctttgcacatca

SEQ ID NO: 1054429 - DNA, 22 bp, Artificial Sequence
  chemically synthesized
taccattttctttgcacatcat

SEQ ID NO: 1054430 - DNA, 22 bp, Artificial Sequence
  chemically synthesized
accattttctttgcacatcatt

SEQ ID NO: 1054431 - DNA, 22 bp, Artificial Sequence
  chemically synthesized
ccattttctttgcacatcattt

SEQ ID NO: 1054432 - DNA, 22 bp, Artificial Sequence
  chemically synthesized
agctgcaaaagaaaatgatgtg

SEQ ID NO: 1054433 - DNA, 22 bp, Artificial Sequence
  chemically synthesized
aagctgcaaaagaaaatgatgt

SEQ ID NO: 1054434 - DNA, 22 bp, Artificial Sequence
  chemically synthesized
tctttgcacatcattttctttt

SEQ ID NO: 1054435 - DNA, 22 bp, Artificial Sequence
  chemically synthesized
ctttgcacatcattttcttttg

SEQ ID NO: 1054436 - DNA, 22 bp, Artificial Sequence
  chemically synthesized
tttgcacatcattttcttttgc

SEQ ID NO: 1054437 - DNA, 22 bp, Artificial Sequence
  chemically synthesized
tgcacatcattttcttttgcag

SEQ ID NO: 1054438 - DNA, 22 bp, Artificial Sequence
  chemically synthesized
gcacatcattttcttttgcagc

SEQ ID NO: 1054439 - DNA, 22 bp, Artificial Sequence
  chemically synthesized
cacatcattttcttttgcagct

SEQ ID NO: 1054440 - DNA, 22 bp, Artificial Sequence
  chemically synthesized
tcttttgcagcttaaatcttcc

SEQ ID NO: 1054441 - DNA, 22 bp, Artificial Sequence
  chemically synthesized
cttttgcagcttaaatcttcca

SEQ ID NO: 1054442 - DNA, 22 bp, Artificial Sequence
  chemically synthesized
ttttgcagcttaaatcttccat

SEQ ID NO: 1054443 - DNA, 22 bp, Artificial Sequence
  chemically synthesized
ttgcagcttaaatcttccatct

SEQ ID NO: 1054444 - DNA, 22 bp, Artificial Sequence
  chemically synthesized
tgcagcttaaatcttccatctt

SEQ ID NO: 1054445 - DNA, 22 bp, Artificial Sequence
  chemically synthesized
gcagcttaaatcttccatcttg

SEQ ID NO: 1054446 - DNA, 22 bp, Artificial Sequence
  chemically synthesized
cagcttaaatcttccatcttgt

SEQ ID NO: 1054447 - DNA, 22 bp, Artificial Sequence
  chemically synthesized
agcaggagaaagatacaagatg

SEQ ID NO: 1054448 - DNA, 22 bp, Artificial Sequence
  chemically synthesized
aagcaggagaaagatacaagat

SEQ ID NO: 1054449 - DNA, 22 bp, Artificial Sequence
  chemically synthesized
taagcaggagaaagatacaaga

SEQ ID NO: 1054450 - DNA, 22 bp, Artificial Sequence
  chemically synthesized
aaatcttccatcttgtatcttt

SEQ ID NO: 1054451 - DNA, 22 bp, Artificial Sequence
  chemically synthesized
aatcttccatcttgtatctttc

SEQ ID NO: 1054452 - DNA, 22 bp, Artificial Sequence
  chemically synthesized
gtctttaagcaggagaaagata

SEQ ID NO: 1054453 - DNA, 22 bp, Artificial Sequence
  chemically synthesized
ccatcttgtatctttctcctgc

SEQ ID NO: 1054454 - DNA, 22 bp, Artificial Sequence
  chemically synthesized
catcttgtatctttctcctgct

SEQ ID NO: 1054455 - DNA, 22 bp, Artificial Sequence
  chemically synthesized
gtatctttctcctgcttaaaga

SEQ ID NO: 1054456 - DNA, 22 bp, Artificial Sequence
  chemically synthesized
tatctttctcctgcttaaagac

SEQ ID NO: 1054457 - DNA, 22 bp, Artificial Sequence
  chemically synthesized
gaggacgtcaagattggtcttt

SEQ ID NO: 1054458 - DNA, 22 bp, Artificial Sequence
  chemically synthesized
agaggacgtcaagattggtctt

SEQ ID NO: 1054459 - DNA, 22 bp, Artificial Sequence
  chemically synthesized
tctcctgcttaaagaccaatct

SEQ ID NO: 1054460 - DNA, 22 bp, Artificial Sequence
  chemically synthesized
tagaggacgtcaagattggtct

SEQ ID NO: 1054461 - DNA, 22 bp, Artificial Sequence
  chemically synthesized
ctcctgcttaaagaccaatctt

SEQ ID NO: 1054462 - DNA, 22 bp, Artificial Sequence
  chemically synthesized
tcctgcttaaagaccaatcttg

SEQ ID NO: 1054463 - DNA, 22 bp, Artificial Sequence
  chemically synthesized
ctgcttaaagaccaatcttgac

SEQ ID NO: 1054464 - DNA, 22 bp, Artificial Sequence
  chemically synthesized
cctttagaggacgtcaagattg

SEQ ID NO: 1054465 - DNA, 22 bp, Artificial Sequence
  chemically synthesized
cttaaagaccaatcttgacgtc

SEQ ID NO: 1054466 - DNA, 22 bp, Artificial Sequence
  chemically synthesized
aaagaccaatcttgacgtcctc

SEQ ID NO: 1054467 - DNA, 22 bp, Artificial Sequence
  chemically synthesized
aagaccaatcttgacgtcctct

SEQ ID NO: 1054468 - DNA, 22 bp, Artificial Sequence
  chemically synthesized
gcataaaattccctttagagga

SEQ ID NO: 1054469 - DNA, 22 bp, Artificial Sequence
  chemically synthesized
ctagcataaaattccctttaga

SEQ ID NO: 1054470 - DNA, 22 bp, Artificial Sequence
  chemically synthesized
actagcataaaattccctttag

SEQ ID NO: 1054471 - DNA, 22 bp, Artificial Sequence
  chemically synthesized
gacgtcctctaaagggaatttt

SEQ ID NO: 1054472 - DNA, 22 bp, Artificial Sequence
  chemically synthesized
acgtcctctaaagggaatttta

SEQ ID NO: 1054473 - DNA, 22 bp, Artificial Sequence
  chemically synthesized
taaagggaattttatgctagta

SEQ ID NO: 1054474 - DNA, 22 bp, Artificial Sequence
  chemically synthesized
aagggaattttatgctagtaaa

SEQ ID NO: 1054475 - DNA, 22 bp, Artificial Sequence
  chemically synthesized
agacacacagaaaccgtttact

SEQ ID NO: 1054476 - DNA, 22 bp, Artificial Sequence
  chemically synthesized
cagacacacagaaaccgtttac

SEQ ID NO: 1054477 - DNA, 22 bp, Artificial Sequence
  chemically synthesized
tcagacacacagaaaccgttta

SEQ ID NO: 1054478 - DNA, 22 bp, Artificial Sequence
  chemically synthesized
ttcagacacacagaaaccgttt

SEQ ID NO: 1054479 - DNA, 22 bp, Artificial Sequence
  chemically synthesized
tatgctagtaaacggtttctgt

SEQ ID NO: 1054480 - DNA, 22 bp, Artificial Sequence
  chemically synthesized
atgctagtaaacggtttctgtg

SEQ ID NO: 1054481 - DNA, 22 bp, Artificial Sequence
  chemically synthesized
tgctagtaaacggtttctgtgt

SEQ ID NO: 1054482 - DNA, 22 bp, Artificial Sequence
  chemically synthesized
gtaaacggtttctgtgtgtctg

SEQ ID NO: 1054483 - DNA, 22 bp, Artificial Sequence
  chemically synthesized
aaataaagatcttttcagacac

SEQ ID NO: 1054484 - DNA, 22 bp, Artificial Sequence
  chemically synthesized
ctgtgtgtctgaaaagatcttt

SEQ ID NO: 1054485 - DNA, 22 bp, Artificial Sequence
  chemically synthesized
tgtgtgtctgaaaagatcttta

SEQ ID NO: 1054486 - DNA, 22 bp, Artificial Sequence
  chemically synthesized
tgtgtctgaaaagatctttatt

SEQ ID NO: 1054487 - DNA, 22 bp, Artificial Sequence
  chemically synthesized
aggaataacattgaaataaaga

SEQ ID NO: 1054488 - DNA, 22 bp, Artificial Sequence
  chemically synthesized
caggaataacattgaaataaag

SEQ ID NO: 1054489 - DNA, 22 bp, Artificial Sequence
  chemically synthesized
tcaggaataacattgaaataaa

SEQ ID NO: 1054490 - DNA, 22 bp, Artificial Sequence
  chemically synthesized
tttcaggaataacattgaaata

SEQ ID NO: 1054491 - DNA, 22 bp, Artificial Sequence
  chemically synthesized
aaaagatctttatttcaatgtt

SEQ ID NO: 1054492 - DNA, 22 bp, Artificial Sequence
  chemically synthesized
tctttcaggaataacattgaaa

SEQ ID NO: 1054493 - DNA, 22 bp, Artificial Sequence
  chemically synthesized
tatttcaatgttattcctgaaa

SEQ ID NO: 1054494 - DNA, 22 bp, Artificial Sequence
  chemically synthesized
atagaaactctctttcaggaat

SEQ ID NO: 1054495 - DNA, 22 bp, Artificial Sequence
  chemically synthesized
atttcaatgttattcctgaaag

SEQ ID NO: 1054496 - DNA, 22 bp, Artificial Sequence
  chemically synthesized
tttcaatgttattcctgaaaga

SEQ ID NO: 1054497 - DNA, 22 bp, Artificial Sequence
  chemically synthesized
caatgttattcctgaaagagag

SEQ ID NO: 1054498 - DNA, 22 bp, Artificial Sequence
  chemically synthesized
aatgttattcctgaaagagagt

SEQ ID NO: 1054499 - DNA, 22 bp, Artificial Sequence
  chemically synthesized
tgtactgatagaaactctcttt

SEQ ID NO: 1054500 - DNA, 22 bp, Artificial Sequence
  chemically synthesized
ttcctgaaagagagtttctatc

SEQ ID NO: 1054501 - DNA, 22 bp, Artificial Sequence
  chemically synthesized
gaattgtgtactgatagaaact

SEQ ID NO: 1054502 - DNA, 22 bp, Artificial Sequence
  chemically synthesized
ctgaaagagagtttctatcagt

SEQ ID NO: 1054503 - DNA, 22 bp, Artificial Sequence
  chemically synthesized
aaagagagtttctatcagtaca

SEQ ID NO: 1054504 - DNA, 22 bp, Artificial Sequence
  chemically synthesized
ctatcagtacacaattctaggt

SEQ ID NO: 1054505 - DNA, 22 bp, Artificial Sequence
  chemically synthesized
tatcagtacacaattctaggtt

SEQ ID NO: 1054506 - DNA, 22 bp, Artificial Sequence
  chemically synthesized
tcagtacacaattctaggttcc

SEQ ID NO: 1054507 - DNA, 22 bp, Artificial Sequence
  chemically synthesized
taggttcctacgtggatgttct

SEQ ID NO: 1054508 - DNA, 22 bp, Artificial Sequence
  chemically synthesized
aaaaacaatgaaagaacatcca

SEQ ID NO: 1054509 - DNA, 22 bp, Artificial Sequence
  chemically synthesized
caaaaacaatgaaagaacatcc

SEQ ID NO: 1054510 - DNA, 22 bp, Artificial Sequence
  chemically synthesized
ggttcctacgtggatgttcttt

SEQ ID NO: 1054511 - DNA, 22 bp, Artificial Sequence
  chemically synthesized
tcaaaaacaatgaaagaacatc

SEQ ID NO: 1054512 - DNA, 22 bp, Artificial Sequence
  chemically synthesized
ctacgtggatgttctttcattg

SEQ ID NO: 1054513 - DNA, 22 bp, Artificial Sequence
  chemically synthesized
cgtggatgttctttcattgttt

SEQ ID NO: 1054514 - DNA, 22 bp, Artificial Sequence
  chemically synthesized
tttcattgtttttgaaaatatt

SEQ ID NO: 1054515 - DNA, 22 bp, Artificial Sequence
  chemically synthesized
tcattgtttttgaaaatattat

SEQ ID NO: 1054516 - DNA, 22 bp, Artificial Sequence
  chemically synthesized
cattgtttttgaaaatattatt

SEQ ID NO: 1054517 - DNA, 22 bp, Artificial Sequence
  chemically synthesized
attgtttttgaaaatattattc

SEQ ID NO: 1054518 - DNA, 22 bp, Artificial Sequence
  chemically synthesized
tttttgaaaatattattctacc

SEQ ID NO: 1054519 - DNA, 22 bp, Artificial Sequence
  chemically synthesized
ttgaaaatattattctaccgtc

SEQ ID NO: 1054520 - DNA, 22 bp, Artificial Sequence
  chemically synthesized
tgaaaatattattctaccgtct

SEQ ID NO: 1054521 - DNA, 22 bp, Artificial Sequence
  chemically synthesized
gaaaatattattctaccgtctt

SEQ ID NO: 1054522 - DNA, 22 bp, Artificial Sequence
  chemically synthesized
aaaatattattctaccgtcttc

SEQ ID NO: 1054523 - DNA, 22 bp, Artificial Sequence
  chemically synthesized
gagcaatgatagaagccagaag

SEQ ID NO: 1054524 - DNA, 22 bp, Artificial Sequence
  chemically synthesized
agagcaatgatagaagccagaa

SEQ ID NO: 1054525 - DNA, 22 bp, Artificial Sequence
  chemically synthesized
tagagcaatgatagaagccaga

SEQ ID NO: 1054526 - DNA, 22 bp, Artificial Sequence
  chemically synthesized
ttctaccgtcttctggcttcta

SEQ ID NO: 1054527 - DNA, 22 bp, Artificial Sequence
  chemically synthesized
taccgtcttctggcttctatca

SEQ ID NO: 1054528 - DNA, 22 bp, Artificial Sequence
  chemically synthesized
gttttagagcaatgatagaagc

SEQ ID NO: 1054529 - DNA, 22 bp, Artificial Sequence
  chemically synthesized
ccgtcttctggcttctatcatt

SEQ ID NO: 1054530 - DNA, 22 bp, Artificial Sequence
  chemically synthesized
ctggcttctatcattgctctaa

SEQ ID NO: 1054531 - DNA, 22 bp, Artificial Sequence
  chemically synthesized
tggcttctatcattgctctaaa

SEQ ID NO: 1054532 - DNA, 22 bp, Artificial Sequence
  chemically synthesized
gcttctatcattgctctaaaac

SEQ ID NO: 1054533 - DNA, 22 bp, Artificial Sequence
  chemically synthesized
aaatggtacctggttttagagc

SEQ ID NO: 1054534 - DNA, 22 bp, Artificial Sequence
  chemically synthesized
aaaatggtacctggttttagag

SEQ ID NO: 1054535 - DNA, 22 bp, Artificial Sequence
  chemically synthesized
ctatcattgctctaaaaccagg

SEQ ID NO: 1054536 - DNA, 22 bp, Artificial Sequence
  chemically synthesized
tatcattgctctaaaaccaggt

SEQ ID NO: 1054537 - DNA, 22 bp, Artificial Sequence
  chemically synthesized
tcattgctctaaaaccaggtac

SEQ ID NO: 1054538 - DNA, 22 bp, Artificial Sequence
  chemically synthesized
ctctaaaaccaggtaccatttt

SEQ ID NO: 1054539 - DNA, 22 bp, Artificial Sequence
  chemically synthesized
taaaaccaggtaccattttaag

SEQ ID NO: 1054540 - DNA, 22 bp, Artificial Sequence
  chemically synthesized
gaaagtagtgacacttaaaatg

SEQ ID NO: 1054541 - DNA, 22 bp, Artificial Sequence
  chemically synthesized
aaaccaggtaccattttaagtg

SEQ ID NO: 1054542 - DNA, 22 bp, Artificial Sequence
  chemically synthesized
agaaagtagtgacacttaaaat

SEQ ID NO: 1054543 - DNA, 22 bp, Artificial Sequence
  chemically synthesized
cttagaaagtagtgacacttaa

SEQ ID NO: 1054544 - DNA, 22 bp, Artificial Sequence
  chemically synthesized
ccttagaaagtagtgacactta

SEQ ID NO: 1054545 - DNA, 22 bp, Artificial Sequence
  chemically synthesized
tatttccttagaaagtagtgac

SEQ ID NO: 1054546 - DNA, 22 bp, Artificial Sequence
  chemically synthesized
ctgtatttccttagaaagtagt

SEQ ID NO: 1054547 - DNA, 22 bp, Artificial Sequence
  chemically synthesized
taagtgtcactactttctaagg

SEQ ID NO: 1054548 - DNA, 22 bp, Artificial Sequence
  chemically synthesized
aagtgtcactactttctaagga

SEQ ID NO: 1054549 - DNA, 22 bp, Artificial Sequence
  chemically synthesized
agtgtcactactttctaaggaa

SEQ ID NO: 1054550 - DNA, 22 bp, Artificial Sequence
  chemically synthesized
aatactgctgtatttccttaga

SEQ ID NO: 1054551 - DNA, 22 bp, Artificial Sequence
  chemically synthesized
aaatactgctgtatttccttag

SEQ ID NO: 1054552 - DNA, 22 bp, Artificial Sequence
  chemically synthesized
taaatactgctgtatttcctta

SEQ ID NO: 1054553 - DNA, 22 bp, Artificial Sequence
  chemically synthesized
ctttctaaggaaatacagcagt

SEQ ID NO: 1054554 - DNA, 22 bp, Artificial Sequence
  chemically synthesized
tctaaggaaatacagcagtatt

SEQ ID NO: 1054555 - DNA, 22 bp, Artificial Sequence
  chemically synthesized
ctaaggaaatacagcagtattt

SEQ ID NO: 1054556 - DNA, 22 bp, Artificial Sequence
  chemically synthesized
taaggaaatacagcagtattta

SEQ ID NO: 1054557 - DNA, 22 bp, Artificial Sequence
  chemically synthesized
aggaaatacagcagtatttaaa

SEQ ID NO: 1054558 - DNA, 22 bp, Artificial Sequence
  chemically synthesized
atgaatccaaaaaaagcaaaga

SEQ ID NO: 1054559 - DNA, 22 bp, Artificial Sequence
  chemically synthesized
aaaattatttctttgctttttt

SEQ ID NO: 1054560 - DNA, 22 bp, Artificial Sequence
  chemically synthesized
aaattatttctttgcttttttt

SEQ ID NO: 1054561 - DNA, 22 bp, Artificial Sequence
  chemically synthesized
tttctttgctttttttggattc

SEQ ID NO: 1054562 - DNA, 22 bp, Artificial Sequence
  chemically synthesized
ctttgctttttttggattcatc

SEQ ID NO: 1054563 - DNA, 22 bp, Artificial Sequence
  chemically synthesized
tttgctttttttggattcatca

SEQ ID NO: 1054564 - DNA, 22 bp, Artificial Sequence
  chemically synthesized
tgctttttttggattcatcaga

SEQ ID NO: 1054565 - DNA, 22 bp, Artificial Sequence
  chemically synthesized
tgagacgatgaatctgatgaat

SEQ ID NO: 1054566 - DNA, 22 bp, Artificial Sequence
  chemically synthesized
gctttttttggattcatcagat

SEQ ID NO: 1054567 - DNA, 22 bp, Artificial Sequence
  chemically synthesized
ctttttttggattcatcagatt

SEQ ID NO: 1054568 - DNA, 22 bp, Artificial Sequence
  chemically synthesized
tttttggattcatcagattcat

SEQ ID NO: 1054569 - DNA, 22 bp, Artificial Sequence
  chemically synthesized
ttttggattcatcagattcatc

SEQ ID NO: 1054570 - DNA, 22 bp, Artificial Sequence
  chemically synthesized
tttggattcatcagattcatcg

SEQ ID NO: 1054571 - DNA, 22 bp, Artificial Sequence
  chemically synthesized
ttggattcatcagattcatcgt

SEQ ID NO: 1054572 - DNA, 22 bp, Artificial Sequence
  chemically synthesized
tggattcatcagattcatcgtc

SEQ ID NO: 1054573 - DNA, 22 bp, Artificial Sequence
  chemically synthesized
ggattcatcagattcatcgtct

SEQ ID NO: 1054574 - DNA, 22 bp, Artificial Sequence
  chemically synthesized
gattcatcagattcatcgtctc

SEQ ID NO: 1054575 - DNA, 22 bp, Artificial Sequence
  chemically synthesized
atcagattcatcgtctcatagt

SEQ ID NO: 1054576 - DNA, 22 bp, Artificial Sequence
  chemically synthesized
atcgtctcatagtgatgatcta

SEQ ID NO: 1054577 - DNA, 22 bp, Artificial Sequence
  chemically synthesized
aaaaaaagaaatataagtatag

SEQ ID NO: 1054578 - DNA, 22 bp, Artificial Sequence
  chemically synthesized
atagtgatgatctatacttata

SEQ ID NO: 1054579 - DNA, 22 bp, Artificial Sequence
  chemically synthesized
ttaaaaaaaagaaatataagta

SEQ ID NO: 1054580 - DNA, 22 bp, Artificial Sequence
  chemically synthesized
tacttatatttcttttttttaa

SEQ ID NO: 1054581 - DNA, 22 bp, Artificial Sequence
  chemically synthesized
aagcagaaaagattattaaaaa

SEQ ID NO: 1054582 - DNA, 22 bp, Artificial Sequence
  chemically synthesized
atatttcttttttttaataatc

SEQ ID NO: 1054583 - DNA, 22 bp, Artificial Sequence
  chemically synthesized
tatttcttttttttaataatct

SEQ ID NO: 1054584 - DNA, 22 bp, Artificial Sequence
  chemically synthesized
cttttttttaataatcttttct

SEQ ID NO: 1054585 - DNA, 22 bp, Artificial Sequence
  chemically synthesized
ttttttttaataatcttttctg

SEQ ID NO: 1054586 - DNA, 22 bp, Artificial Sequence
  chemically synthesized
agcaaatctgaagcagaaaaga

SEQ ID NO: 1054587 - DNA, 22 bp, Artificial Sequence
  chemically synthesized
ttttttaataatcttttctgct

SEQ ID NO: 1054588 - DNA, 22 bp, Artificial Sequence
  chemically synthesized
tttttaataatcttttctgctt

SEQ ID NO: 1054589 - DNA, 22 bp, Artificial Sequence
  chemically synthesized
ttttaataatcttttctgcttc

SEQ ID NO: 1054590 - DNA, 22 bp, Artificial Sequence
  chemically synthesized
tttaataatcttttctgcttca

SEQ ID NO: 1054591 - DNA, 22 bp, Artificial Sequence
  chemically synthesized
ttaataatcttttctgcttcag

SEQ ID NO: 1054592 - DNA, 22 bp, Artificial Sequence
  chemically synthesized
taataatcttttctgcttcaga

SEQ ID NO: 1054593 - DNA, 22 bp, Artificial Sequence
  chemically synthesized
aataatcttttctgcttcagat

SEQ ID NO: 1054594 - DNA, 22 bp, Artificial Sequence
  chemically synthesized
ataatcttttctgcttcagatt

SEQ ID NO: 1054595 - DNA, 22 bp, Artificial Sequence
  chemically synthesized
ggaaactgagcaaatctgaagc

SEQ ID NO: 1054596 - DNA, 22 bp, Artificial Sequence
  chemically synthesized
cgattgggaaactgagcaaatc

SEQ ID NO: 1054597 - DNA, 22 bp, Artificial Sequence
  chemically synthesized
ttctgcttcagatttgctcagt

SEQ ID NO: 1054598 - DNA, 22 bp, Artificial Sequence
  chemically synthesized
tctgcttcagatttgctcagtt

SEQ ID NO: 1054599 - DNA, 22 bp, Artificial Sequence
  chemically synthesized
ctgcttcagatttgctcagttt

SEQ ID NO: 1054600 - DNA, 22 bp, Artificial Sequence
  chemically synthesized
tgcttcagatttgctcagtttc

SEQ ID NO: 1054601 - DNA, 22 bp, Artificial Sequence
  chemically synthesized
cttcagatttgctcagtttccc

SEQ ID NO: 1054602 - DNA, 22 bp, Artificial Sequence
  chemically synthesized
caatactccgattgggaaactg

SEQ ID NO: 1054603 - DNA, 22 bp, Artificial Sequence
  chemically synthesized
cagatttgctcagtttcccaat

SEQ ID NO: 1054604 - DNA, 22 bp, Artificial Sequence
  chemically synthesized
agatttgctcagtttcccaatc

SEQ ID NO: 1054605 - DNA, 22 bp, Artificial Sequence
  chemically synthesized
gctcagtttcccaatcggagta

SEQ ID NO: 1054606 - DNA, 22 bp, Artificial Sequence
  chemically synthesized
ctcagtttcccaatcggagtat

SEQ ID NO: 1054607 - DNA, 22 bp, Artificial Sequence
  chemically synthesized
atagaaattccaatactccgat

SEQ ID NO: 1054608 - DNA, 22 bp, Artificial Sequence
  chemically synthesized
aatagaaattccaatactccga

SEQ ID NO: 1054609 - DNA, 22 bp, Artificial Sequence
  chemically synthesized
agtttcccaatcggagtattgg

SEQ ID NO: 1054610 - DNA, 22 bp, Artificial Sequence
  chemically synthesized
cccaatcggagtattggaattt

SEQ ID NO: 1054611 - DNA, 22 bp, Artificial Sequence
  chemically synthesized
aaaacttaatagaaattccaat

SEQ ID NO: 1054612 - DNA, 22 bp, Artificial Sequence
  chemically synthesized
ccaatcggagtattggaatttc

SEQ ID NO: 1054613 - DNA, 22 bp, Artificial Sequence
  chemically synthesized
caaaacttaatagaaattccaa

SEQ ID NO: 1054614 - DNA, 22 bp, Artificial Sequence
  chemically synthesized
tcaaaacttaatagaaattcca

SEQ ID NO: 1054615 - DNA, 22 bp, Artificial Sequence
  chemically synthesized
ggattttcaaaacttaatagaa

SEQ ID NO: 1054616 - DNA, 22 bp, Artificial Sequence
  chemically synthesized
aggattttcaaaacttaataga

SEQ ID NO: 1054617 - DNA, 22 bp, Artificial Sequence
  chemically synthesized
gaatttctattaagttttgaaa

SEQ ID NO: 1054618 - DNA, 22 bp, Artificial Sequence
  chemically synthesized
ctattaagttttgaaaatccta

SEQ ID NO: 1054619 - DNA, 22 bp, Artificial Sequence
  chemically synthesized
tattaagttttgaaaatcctaa

SEQ ID NO: 1054620 - DNA, 22 bp, Artificial Sequence
  chemically synthesized
tagtgataatagcttaggattt

SEQ ID NO: 1054621 - DNA, 22 bp, Artificial Sequence
  chemically synthesized
ttaagttttgaaaatcctaagc

SEQ ID NO: 1054622 - DNA, 22 bp, Artificial Sequence
  chemically synthesized
agttttgaaaatcctaagctat

SEQ ID NO: 1054623 - DNA, 22 bp, Artificial Sequence
  chemically synthesized
tctgtagtgataatagcttagg

SEQ ID NO: 1054624 - DNA, 22 bp, Artificial Sequence
  chemically synthesized
tgaaaatcctaagctattatca

SEQ ID NO: 1054625 - DNA, 22 bp, Artificial Sequence
  chemically synthesized
gaaaatcctaagctattatcac

SEQ ID NO: 1054626 - DNA, 22 bp, Artificial Sequence
  chemically synthesized
aaaatcctaagctattatcact

SEQ ID NO: 1054627 - DNA, 22 bp, Artificial Sequence
  chemically synthesized
agctattatcactacagataat

SEQ ID NO: 1054628 - DNA, 22 bp, Artificial Sequence
  chemically synthesized
ttatcactacagataatgcctc

SEQ ID NO: 1054629 - DNA, 22 bp, Artificial Sequence
  chemically synthesized
cccacaatggagaagaggcatt

SEQ ID NO: 1054630 - DNA, 22 bp, Artificial Sequence
  chemically synthesized
tcactacagataatgcctcttc

SEQ ID NO: 1054631 - DNA, 22 bp, Artificial Sequence
  chemically synthesized
cagataatgcctcttctccatt

SEQ ID NO: 1054632 - DNA, 22 bp, Artificial Sequence
  chemically synthesized
ttctccattgtgggtaggattt

SEQ ID NO: 1054633 - DNA, 22 bp, Artificial Sequence
  chemically synthesized
ctccattgtgggtaggatttat

SEQ ID NO: 1054634 - DNA, 22 bp, Artificial Sequence
  chemically synthesized
tccattgtgggtaggatttatt

SEQ ID NO: 1054635 - DNA, 22 bp, Artificial Sequence
  chemically synthesized
taaaggggaataaataaatcct

SEQ ID NO: 1054636 - DNA, 22 bp, Artificial Sequence
  chemically synthesized
cattgtgggtaggatttattta

SEQ ID NO: 1054637 - DNA, 22 bp, Artificial Sequence
  chemically synthesized
agctgtaaaggggaataaataa

SEQ ID NO: 1054638 - DNA, 22 bp, Artificial Sequence
  chemically synthesized
tgggtaggatttatttattccc

SEQ ID NO: 1054639 - DNA, 22 bp, Artificial Sequence
  chemically synthesized
cctcagctgtaaaggggaataa

SEQ ID NO: 1054640 - DNA, 22 bp, Artificial Sequence
  chemically synthesized
ccctcagctgtaaaggggaata

SEQ ID NO: 1054641 - DNA, 22 bp, Artificial Sequence
  chemically synthesized
aagggcttccctcagctgtaaa

SEQ ID NO: 1054642 - DNA, 22 bp, Artificial Sequence
  chemically synthesized
atttattcccctttacagctga

SEQ ID NO: 1054643 - DNA, 22 bp, Artificial Sequence
  chemically synthesized
caagggcttccctcagctgtaa

SEQ ID NO: 1054644 - DNA, 22 bp, Artificial Sequence
  chemically synthesized
tttattcccctttacagctgag

SEQ ID NO: 1054645 - DNA, 22 bp, Artificial Sequence
  chemically synthesized
tcaagggcttccctcagctgta

SEQ ID NO: 1054646 - DNA, 22 bp, Artificial Sequence
  chemically synthesized
attcccctttacagctgaggga

SEQ ID NO: 1054647 - DNA, 22 bp, Artificial Sequence
  chemically synthesized
ttcccctttacagctgagggaa

SEQ ID NO: 1054648 - DNA, 22 bp, Artificial Sequence
  chemically synthesized
aattttcaagggcttccctcag

SEQ ID NO: 1054649 - DNA, 22 bp, Artificial Sequence
  chemically synthesized
ccctttacagctgagggaagcc

SEQ ID NO: 1054650 - DNA, 22 bp, Artificial Sequence
  chemically synthesized
tacagctgagggaagcccttga

SEQ ID NO: 1054651 - DNA, 22 bp, Artificial Sequence
  chemically synthesized
aagtctgaattttcaagggctt

SEQ ID NO: 1054652 - DNA, 22 bp, Artificial Sequence
  chemically synthesized
acagctgagggaagcccttgaa

SEQ ID NO: 1054653 - DNA, 22 bp, Artificial Sequence
  chemically synthesized
aaagtctgaattttcaagggct

SEQ ID NO: 1054654 - DNA, 22 bp, Artificial Sequence
  chemically synthesized
cagctgagggaagcccttgaaa

SEQ ID NO: 1054655 - DNA, 22 bp, Artificial Sequence
  chemically synthesized
cttaaagtctgaattttcaagg

SEQ ID NO: 1054656 - DNA, 22 bp, Artificial Sequence
  chemically synthesized
agggaagcccttgaaaattcag

SEQ ID NO: 1054657 - DNA, 22 bp, Artificial Sequence
  chemically synthesized
gaaaattcagactttaaggagg

SEQ ID NO: 1054658 - DNA, 22 bp, Artificial Sequence
  chemically synthesized
aaaattcagactttaaggaggg

SEQ ID NO: 1054659 - DNA, 22 bp, Artificial Sequence
  chemically synthesized
agactttaaggaggggttttat

SEQ ID NO: 1054660 - DNA, 22 bp, Artificial Sequence
  chemically synthesized
taaggaggggttttattttcac

SEQ ID NO: 1054661 - DNA, 22 bp, Artificial Sequence
  chemically synthesized
aaggaggggttttattttcacc

SEQ ID NO: 1054662 - DNA, 22 bp, Artificial Sequence
  chemically synthesized
aggaggggttttattttcacct

SEQ ID NO: 1054663 - DNA, 22 bp, Artificial Sequence
  chemically synthesized
aacaacacataatatagaggtg

SEQ ID NO: 1054664 - DNA, 22 bp, Artificial Sequence
  chemically synthesized
caacaacacataatatagaggt

SEQ ID NO: 1054665 - DNA, 22 bp, Artificial Sequence
  chemically synthesized
tattttcacctctatattatgt

SEQ ID NO: 1054666 - DNA, 22 bp, Artificial Sequence
  chemically synthesized
attttcacctctatattatgtg

SEQ ID NO: 1054667 - DNA, 22 bp, Artificial Sequence
  chemically synthesized
ttttcacctctatattatgtgt

SEQ ID NO: 1054668 - DNA, 22 bp, Artificial Sequence
  chemically synthesized
tcacctctatattatgtgttgt

SEQ ID NO: 1054669 - DNA, 22 bp, Artificial Sequence
  chemically synthesized
cacctctatattatgtgttgtt

SEQ ID NO: 1054670 - DNA, 22 bp, Artificial Sequence
  chemically synthesized
acctctatattatgtgttgttg

SEQ ID NO: 1054671 - DNA, 22 bp, Artificial Sequence
  chemically synthesized
tatattatgtgttgttgaaggt

SEQ ID NO: 1054672 - DNA, 22 bp, Artificial Sequence
  chemically synthesized
tattatgtgttgttgaaggtca

SEQ ID NO: 1054673 - DNA, 22 bp, Artificial Sequence
  chemically synthesized
ggacaaaatatgtgaccttcaa

SEQ ID NO: 1054674 - DNA, 22 bp, Artificial Sequence
  chemically synthesized
aggacaaaatatgtgaccttca

SEQ ID NO: 1054675 - DNA, 22 bp, Artificial Sequence
  chemically synthesized
taggacaaaatatgtgaccttc

SEQ ID NO: 1054676 - DNA, 22 bp, Artificial Sequence
  chemically synthesized
ttaggacaaaatatgtgacctt

SEQ ID NO: 1054677 - DNA, 22 bp, Artificial Sequence
  chemically synthesized
tgtgttgttgaaggtcacatat

SEQ ID NO: 1054678 - DNA, 22 bp, Artificial Sequence
  chemically synthesized
aagaccttttaggacaaaatat

SEQ ID NO: 1054679 - DNA, 22 bp, Artificial Sequence
  chemically synthesized
ttgaaggtcacatattttgtcc

SEQ ID NO: 1054680 - DNA, 22 bp, Artificial Sequence
  chemically synthesized
caagaccttttaggacaaaata

SEQ ID NO: 1054681 - DNA, 22 bp, Artificial Sequence
  chemically synthesized
tcaagaccttttaggacaaaat

SEQ ID NO: 1054682 - DNA, 22 bp, Artificial Sequence
  chemically synthesized
aaggtcacatattttgtcctaa

SEQ ID NO: 1054683 - DNA, 22 bp, Artificial Sequence
  chemically synthesized
ggaagaagttttcaagaccttt

SEQ ID NO: 1054684 - DNA, 22 bp, Artificial Sequence
  chemically synthesized
tgtcctaaaaggtcttgaaaac

SEQ ID NO: 1054685 - DNA, 22 bp, Artificial Sequence
  chemically synthesized
gtcctaaaaggtcttgaaaact

SEQ ID NO: 1054686 - DNA, 22 bp, Artificial Sequence
  chemically synthesized
tcctaaaaggtcttgaaaactt

SEQ ID NO: 1054687 - DNA, 22 bp, Artificial Sequence
  chemically synthesized
atggctaggaagaagttttcaa

SEQ ID NO: 1054688 - DNA, 22 bp, Artificial Sequence
  chemically synthesized
aaaggtcttgaaaacttcttcc

SEQ ID NO: 1054689 - DNA, 22 bp, Artificial Sequence
  chemically synthesized
agagcctaatggctaggaagaa

SEQ ID NO: 1054690 - DNA, 22 bp, Artificial Sequence
  chemically synthesized
gattgagagcctaatggctagg

SEQ ID NO: 1054691 - DNA, 22 bp, Artificial Sequence
  chemically synthesized
gaaaacttcttcctagccatta

SEQ ID NO: 1054692 - DNA, 22 bp, Artificial Sequence
  chemically synthesized
aaaacttcttcctagccattag

SEQ ID NO: 1054693 - DNA, 22 bp, Artificial Sequence
  chemically synthesized
aacctggattgagagcctaatg

SEQ ID NO: 1054694 - DNA, 22 bp, Artificial Sequence
  chemically synthesized
cttcctagccattaggctctca

SEQ ID NO: 1054695 - DNA, 22 bp, Artificial Sequence
  chemically synthesized
ttcctagccattaggctctcaa

SEQ ID NO: 1054696 - DNA, 22 bp, Artificial Sequence
  chemically synthesized
cctagccattaggctctcaatc

SEQ ID NO: 1054697 - DNA, 22 bp, Artificial Sequence
  chemically synthesized
ctagccattaggctctcaatcc

SEQ ID NO: 1054698 - DNA, 22 bp, Artificial Sequence
  chemically synthesized
gccattaggctctcaatccagg

SEQ ID NO: 1054699 - DNA, 22 bp, Artificial Sequence
  chemically synthesized
cgtgaaactgaacctggattga

SEQ ID NO: 1054700 - DNA, 22 bp, Artificial Sequence
  chemically synthesized
acgtgaaactgaacctggattg

SEQ ID NO: 1054701 - DNA, 22 bp, Artificial Sequence
  chemically synthesized
ggctctcaatccaggttcagtt

SEQ ID NO: 1054702 - DNA, 22 bp, Artificial Sequence
  chemically synthesized
tcaatccaggttcagtttcacg

SEQ ID NO: 1054703 - DNA, 22 bp, Artificial Sequence
  chemically synthesized
aatccaggttcagtttcacgta

SEQ ID NO: 1054704 - DNA, 22 bp, Artificial Sequence
  chemically synthesized
agtttcacgtaagatgatttga

SEQ ID NO: 1054705 - DNA, 22 bp, Artificial Sequence
  chemically synthesized
tgtgccatgaatgatcaaatca

SEQ ID NO: 1054706 - DNA, 22 bp, Artificial Sequence
  chemically synthesized
tgtgtgccatgaatgatcaaat

SEQ ID NO: 1054707 - DNA, 22 bp, Artificial Sequence
  chemically synthesized
cacgtaagatgatttgatcatt

SEQ ID NO: 1054708 - DNA, 22 bp, Artificial Sequence
  chemically synthesized
acgtaagatgatttgatcattc

SEQ ID NO: 1054709 - DNA, 22 bp, Artificial Sequence
  chemically synthesized
cctctgtgtgccatgaatgatc

SEQ ID NO: 1054710 - DNA, 22 bp, Artificial Sequence
  chemically synthesized
ccctctgtgtgccatgaatgat

SEQ ID NO: 1054711 - DNA, 22 bp, Artificial Sequence
  chemically synthesized
ttccctctgtgtgccatgaatg

SEQ ID NO: 1054712 - DNA, 22 bp, Artificial Sequence
  chemically synthesized
tcttccctctgtgtgccatgaa

SEQ ID NO: 1054713 - DNA, 22 bp, Artificial Sequence
  chemically synthesized
gatcattcatggcacacagagg

SEQ ID NO: 1054714 - DNA, 22 bp, Artificial Sequence
  chemically synthesized
atcattcatggcacacagaggg

SEQ ID NO: 1054715 - DNA, 22 bp, Artificial Sequence
  chemically synthesized
tggtggaacctctcttccctct

SEQ ID NO: 1054716 - DNA, 22 bp, Artificial Sequence
  chemically synthesized
atggcacacagagggaagagag

SEQ ID NO: 1054717 - DNA, 22 bp, Artificial Sequence
  chemically synthesized
ggctatggtggaacctctcttc

SEQ ID NO: 1054718 - DNA, 22 bp, Artificial Sequence
  chemically synthesized
aatacacagctgggctatggtg

SEQ ID NO: 1054719 - DNA, 22 bp, Artificial Sequence
  chemically synthesized
aaatacacagctgggctatggt

SEQ ID NO: 1054720 - DNA, 22 bp, Artificial Sequence
  chemically synthesized
taaatacacagctgggctatgg

SEQ ID NO: 1054721 - DNA, 22 bp, Artificial Sequence
  chemically synthesized
aaagttttaaatacacagctgg

SEQ ID NO: 1054722 - DNA, 22 bp, Artificial Sequence
  chemically synthesized
aaaagttttaaatacacagctg

SEQ ID NO: 1054723 - DNA, 22 bp, Artificial Sequence
  chemically synthesized
taaaagttttaaatacacagct

SEQ ID NO: 1054724 - DNA, 22 bp, Artificial Sequence
  chemically synthesized
caccatagcccagctgtgtatt

SEQ ID NO: 1054725 - DNA, 22 bp, Artificial Sequence
  chemically synthesized
ttaaaagttttaaatacacagc

SEQ ID NO: 1054726 - DNA, 22 bp, Artificial Sequence
  chemically synthesized
aataaaatataatttttaaaag

SEQ ID NO: 1054727 - DNA, 22 bp, Artificial Sequence
  chemically synthesized
tgtatttaaaacttttaaaaat

SEQ ID NO: 1054728 - DNA, 22 bp, Artificial Sequence
  chemically synthesized
tgaataaaatataatttttaaa

SEQ ID NO: 1054729 - DNA, 22 bp, Artificial Sequence
  chemically synthesized
aaaacttttaaaaattatattt

SEQ ID NO: 1054730 - DNA, 22 bp, Artificial Sequence
  chemically synthesized
aaacttttaaaaattatatttt

SEQ ID NO: 1054731 - DNA, 22 bp, Artificial Sequence
  chemically synthesized
ttaaaaattatattttattcag

SEQ ID NO: 1054732 - DNA, 22 bp, Artificial Sequence
  chemically synthesized
taaaaattatattttattcaga

SEQ ID NO: 1054733 - DNA, 22 bp, Artificial Sequence
  chemically synthesized
aaaaattatattttattcagaa

SEQ ID NO: 1054734 - DNA, 22 bp, Artificial Sequence
  chemically synthesized
aaaattatattttattcagaat

SEQ ID NO: 1054735 - DNA, 22 bp, Artificial Sequence
  chemically synthesized
aaatgcgtggaaattctgaata

SEQ ID NO: 1054736 - DNA, 22 bp, Artificial Sequence
  chemically synthesized
caaatgcgtggaaattctgaat

SEQ ID NO: 1054737 - DNA, 22 bp, Artificial Sequence
  chemically synthesized
acttcaaatgcgtggaaattct

SEQ ID NO: 1054738 - DNA, 22 bp, Artificial Sequence
  chemically synthesized
tattttattcagaatttccacg

SEQ ID NO: 1054739 - DNA, 22 bp, Artificial Sequence
  chemically synthesized
tattcagaatttccacgcattt

SEQ ID NO: 1054740 - DNA, 22 bp, Artificial Sequence
  chemically synthesized
attcagaatttccacgcatttg

SEQ ID NO: 1054741 - DNA, 22 bp, Artificial Sequence
  chemically synthesized
accccctcacttcaaatgcgtg

SEQ ID NO: 1054742 - DNA, 22 bp, Artificial Sequence
  chemically synthesized
ttcagaatttccacgcatttga

SEQ ID NO: 1054743 - DNA, 22 bp, Artificial Sequence
  chemically synthesized
ctcaccccctcacttcaaatgc

SEQ ID NO: 1054744 - DNA, 22 bp, Artificial Sequence
  chemically synthesized
agaatttccacgcatttgaagt

SEQ ID NO: 1054745 - DNA, 22 bp, Artificial Sequence
  chemically synthesized
attcctcaccccctcacttcaa

SEQ ID NO: 1054746 - DNA, 22 bp, Artificial Sequence
  chemically synthesized
aattcctcaccccctcacttca

SEQ ID NO: 1054747 - DNA, 22 bp, Artificial Sequence
  chemically synthesized
ccacgcatttgaagtgaggggg

SEQ ID NO: 1054748 - DNA, 22 bp, Artificial Sequence
  chemically synthesized
cacgcatttgaagtgagggggt

SEQ ID NO: 1054749 - DNA, 22 bp, Artificial Sequence
  chemically synthesized
acttaattcctcaccccctcac

SEQ ID NO: 1054750 - DNA, 22 bp, Artificial Sequence
  chemically synthesized
gaagtgagggggtgaggaatta

SEQ ID NO: 1054751 - DNA, 22 bp, Artificial Sequence
  chemically synthesized
aagtgagggggtgaggaattaa

SEQ ID NO: 1054752 - DNA, 22 bp, Artificial Sequence
  chemically synthesized
cagaaagatgacagactgactt

SEQ ID NO: 1054753 - DNA, 22 bp, Artificial Sequence
  chemically synthesized
ccagaaagatgacagactgact

SEQ ID NO: 1054754 - DNA, 22 bp, Artificial Sequence
  chemically synthesized
agtcagtctgtcatctttctgg

SEQ ID NO: 1054755 - DNA, 22 bp, Artificial Sequence
  chemically synthesized
agcgagtatcagcttccagaaa

SEQ ID NO: 1054756 - DNA, 22 bp, Artificial Sequence
  chemically synthesized
tcatctttctggaagctgatac

SEQ ID NO: 1054757 - DNA, 22 bp, Artificial Sequence
  chemically synthesized
tctggaagctgatactcgctga

SEQ ID NO: 1054758 - DNA, 22 bp, Artificial Sequence
  chemically synthesized
ctggaagctgatactcgctgaa

SEQ ID NO: 1054759 - DNA, 22 bp, Artificial Sequence
  chemically synthesized
agtagaggcatgttcagcgagt

SEQ ID NO: 1054760 - DNA, 22 bp, Artificial Sequence
  chemically synthesized
tggaagctgatactcgctgaac

SEQ ID NO: 1054761 - DNA, 22 bp, Artificial Sequence
  chemically synthesized
gaagctgatactcgctgaacat

SEQ ID NO: 1054762 - DNA, 22 bp, Artificial Sequence
  chemically synthesized
atggttaagtagaggcatgttc

SEQ ID NO: 1054763 - DNA, 22 bp, Artificial Sequence
  chemically synthesized
aatggttaagtagaggcatgtt

SEQ ID NO: 1054764 - DNA, 22 bp, Artificial Sequence
  chemically synthesized
atactcgctgaacatgcctcta

SEQ ID NO: 1054765 - DNA, 22 bp, Artificial Sequence
  chemically synthesized
gctgaacatgcctctacttaac

SEQ ID NO: 1054766 - DNA, 22 bp, Artificial Sequence
  chemically synthesized
aacatgcctctacttaaccatt

SEQ ID NO: 1054767 - DNA, 22 bp, Artificial Sequence
  chemically synthesized
tgtagcataatcagtttaatgg

SEQ ID NO: 1054768 - DNA, 22 bp, Artificial Sequence
  chemically synthesized
gttgtgtagcataatcagttta

SEQ ID NO: 1054769 - DNA, 22 bp, Artificial Sequence
  chemically synthesized
tacttaaccattaaactgatta

SEQ ID NO: 1054770 - DNA, 22 bp, Artificial Sequence
  chemically synthesized
cttaaccattaaactgattatg

SEQ ID NO: 1054771 - DNA, 22 bp, Artificial Sequence
  chemically synthesized
aaccattaaactgattatgcta

SEQ ID NO: 1054772 - DNA, 22 bp, Artificial Sequence
  chemically synthesized
accattaaactgattatgctac

SEQ ID NO: 1054773 - DNA, 22 bp, Artificial Sequence
  chemically synthesized
gtgtctagttgtgtagcataat

SEQ ID NO: 1054774 - DNA, 22 bp, Artificial Sequence
  chemically synthesized
tagtgtctagttgtgtagcata

SEQ ID NO: 1054775 - DNA, 22 bp, Artificial Sequence
  chemically synthesized
ttctagtgtctagttgtgtagc

SEQ ID NO: 1054776 - DNA, 22 bp, Artificial Sequence
  chemically synthesized
gttctagtgtctagttgtgtag

SEQ ID NO: 1054777 - DNA, 22 bp, Artificial Sequence
  chemically synthesized
aactgattatgctacacaacta

SEQ ID NO: 1054778 - DNA, 22 bp, Artificial Sequence
  chemically synthesized
tgttctagtgtctagttgtgta

SEQ ID NO: 1054779 - DNA, 22 bp, Artificial Sequence
  chemically synthesized
ttgttctagtgtctagttgtgt

SEQ ID NO: 1054780 - DNA, 22 bp, Artificial Sequence
  chemically synthesized
tttgttctagtgtctagttgtg

SEQ ID NO: 1054781 - DNA, 22 bp, Artificial Sequence
  chemically synthesized
ttttgttctagtgtctagttgt

SEQ ID NO: 1054782 - DNA, 22 bp, Artificial Sequence
  chemically synthesized
attatgctacacaactagacac

SEQ ID NO: 1054783 - DNA, 22 bp, Artificial Sequence
  chemically synthesized
tgctacacaactagacactaga

SEQ ID NO: 1054784 - DNA, 22 bp, Artificial Sequence
  chemically synthesized
tacggagtttttttgttctagt

SEQ ID NO: 1054785 - DNA, 22 bp, Artificial Sequence
  chemically synthesized
cacaactagacactagaacaaa

SEQ ID NO: 1054786 - DNA, 22 bp, Artificial Sequence
  chemically synthesized
gtacggagtttttttgttctag

SEQ ID NO: 1054787 - DNA, 22 bp, Artificial Sequence
  chemically synthesized
gacactagaacaaaaaaactcc

SEQ ID NO: 1054788 - DNA, 22 bp, Artificial Sequence
  chemically synthesized
taaatatttgtacggagttttt

SEQ ID NO: 1054789 - DNA, 22 bp, Artificial Sequence
  chemically synthesized
gaacaaaaaaactccgtacaaa

SEQ ID NO: 1054790 - DNA, 22 bp, Artificial Sequence
  chemically synthesized
atgatcatagtggttataaata

SEQ ID NO: 1054791 - DNA, 22 bp, Artificial Sequence
  chemically synthesized
ttgatgatcatagtggttataa

SEQ ID NO: 1054792 - DNA, 22 bp, Artificial Sequence
  chemically synthesized
cgtacaaatatttataaccact

SEQ ID NO: 1054793 - DNA, 22 bp, Artificial Sequence
  chemically synthesized
gattgttgatgatcatagtggt

SEQ ID NO: 1054794 - DNA, 22 bp, Artificial Sequence
  chemically synthesized
tagattgttgatgatcatagtg

SEQ ID NO: 1054795 - DNA, 22 bp, Artificial Sequence
  chemically synthesized
ctagattgttgatgatcatagt

SEQ ID NO: 1054796 - DNA, 22 bp, Artificial Sequence
  chemically synthesized
tctagattgttgatgatcatag

SEQ ID NO: 1054797 - DNA, 22 bp, Artificial Sequence
  chemically synthesized
ttctagattgttgatgatcata

SEQ ID NO: 1054798 - DNA, 22 bp, Artificial Sequence
  chemically synthesized
ataaccactatgatcatcaaca

SEQ ID NO: 1054799 - DNA, 22 bp, Artificial Sequence
  chemically synthesized
taaccactatgatcatcaacaa

SEQ ID NO: 1054800 - DNA, 22 bp, Artificial Sequence
  chemically synthesized
tgtttttctagattgttgatga

SEQ ID NO: 1054801 - DNA, 22 bp, Artificial Sequence
  chemically synthesized
atgtttttctagattgttgatg

SEQ ID NO: 1054802 - DNA, 22 bp, Artificial Sequence
  chemically synthesized
tatgtttttctagattgttgat

SEQ ID NO: 1054803 - DNA, 22 bp, Artificial Sequence
  chemically synthesized
acattttatgtttttctagatt

SEQ ID NO: 1054804 - DNA, 22 bp, Artificial Sequence
  chemically synthesized
tgatcatcaacaatctagaaaa

SEQ ID NO: 1054805 - DNA, 22 bp, Artificial Sequence
  chemically synthesized
gctaacattttatgtttttcta

SEQ ID NO: 1054806 - DNA, 22 bp, Artificial Sequence
  chemically synthesized
aaaaagaaattagctaacattt

SEQ ID NO: 1054807 - DNA, 22 bp, Artificial Sequence
  chemically synthesized
gaaaaacataaaatgttagcta

SEQ ID NO: 1054808 - DNA, 22 bp, Artificial Sequence
  chemically synthesized
caaggattaaaaaagaaattag

SEQ ID NO: 1054809 - DNA, 22 bp, Artificial Sequence
  chemically synthesized
acatattacaaggattaaaaaa

SEQ ID NO: 1054810 - DNA, 22 bp, Artificial Sequence
  chemically synthesized
gctaatttcttttttaatcctt

SEQ ID NO: 1054811 - DNA, 22 bp, Artificial Sequence
  chemically synthesized
taattaacatattacaaggatt

SEQ ID NO: 1054812 - DNA, 22 bp, Artificial Sequence
  chemically synthesized
atttcttttttaatccttgtaa

SEQ ID NO: 1054813 - DNA, 22 bp, Artificial Sequence
  chemically synthesized
gtaattaacatattacaaggat

SEQ ID NO: 1054814 - DNA, 22 bp, Artificial Sequence
  chemically synthesized
tgtaattaacatattacaagga

SEQ ID NO: 1054815 - DNA, 22 bp, Artificial Sequence
  chemically synthesized
cttttttaatccttgtaatatg

SEQ ID NO: 1054816 - DNA, 22 bp, Artificial Sequence
  chemically synthesized
ttttttaatccttgtaatatgt

SEQ ID NO: 1054817 - DNA, 22 bp, Artificial Sequence
  chemically synthesized
aattttgtaattaacatattac

SEQ ID NO: 1054818 - DNA, 22 bp, Artificial Sequence
  chemically synthesized
ttttaatccttgtaatatgtta

SEQ ID NO: 1054819 - DNA, 22 bp, Artificial Sequence
  chemically synthesized
tttaatccttgtaatatgttaa

SEQ ID NO: 1054820 - DNA, 22 bp, Artificial Sequence
  chemically synthesized
ttaatccttgtaatatgttaat

SEQ ID NO: 1054821 - DNA, 22 bp, Artificial Sequence
  chemically synthesized
taatccttgtaatatgttaatt

SEQ ID NO: 1054822 - DNA, 22 bp, Artificial Sequence
  chemically synthesized
aatccttgtaatatgttaatta

SEQ ID NO: 1054823 - DNA, 22 bp, Artificial Sequence
  chemically synthesized
agctcaattttgtaattaacat

SEQ ID NO: 1054824 - DNA, 22 bp, Artificial Sequence
  chemically synthesized
atccttgtaatatgttaattac

SEQ ID NO: 1054825 - DNA, 22 bp, Artificial Sequence
  chemically synthesized
tcagctcaattttgtaattaac

SEQ ID NO: 1054826 - DNA, 22 bp, Artificial Sequence
  chemically synthesized
ctctcagctcaattttgtaatt

SEQ ID NO: 1054827 - DNA, 22 bp, Artificial Sequence
  chemically synthesized
gtaatatgttaattacaaaatt

SEQ ID NO: 1054828 - DNA, 22 bp, Artificial Sequence
  chemically synthesized
tcctctcagctcaattttgtaa

SEQ ID NO: 1054829 - DNA, 22 bp, Artificial Sequence
  chemically synthesized
taatatgttaattacaaaattg

SEQ ID NO: 1054830 - DNA, 22 bp, Artificial Sequence
  chemically synthesized
ctcctctcagctcaattttgta

SEQ ID NO: 1054831 - DNA, 22 bp, Artificial Sequence
  chemically synthesized
tctcctctcagctcaattttgt

SEQ ID NO: 1054832 - DNA, 22 bp, Artificial Sequence
  chemically synthesized
ttctcctctcagctcaattttg

SEQ ID NO: 1054833 - DNA, 22 bp, Artificial Sequence
  chemically synthesized
attacaaaattgagctgagagg

SEQ ID NO: 1054834 - DNA, 22 bp, Artificial Sequence
  chemically synthesized
tagaatttttctcctctcagct

SEQ ID NO: 1054835 - DNA, 22 bp, Artificial Sequence
  chemically synthesized
gtagaatttttctcctctcagc

SEQ ID NO: 1054836 - DNA, 22 bp, Artificial Sequence
  chemically synthesized
caaaattgagctgagaggagaa

SEQ ID NO: 1054837 - DNA, 22 bp, Artificial Sequence
  chemically synthesized
tttgtagaatttttctcctctc

SEQ ID NO: 1054838 - DNA, 22 bp, Artificial Sequence
  chemically synthesized
agctgagaggagaaaaattcta

SEQ ID NO: 1054839 - DNA, 22 bp, Artificial Sequence
  chemically synthesized
agaggagaaaaattctacaaac

SEQ ID NO: 1054840 - DNA, 22 bp, Artificial Sequence
  chemically synthesized
caccaggatgtagctgtttgta

SEQ ID NO: 1054841 - DNA, 22 bp, Artificial Sequence
  chemically synthesized
tacaaacagctacatcctggtg

SEQ ID NO: 1054842 - DNA, 22 bp, Artificial Sequence
  chemically synthesized
agggaaatgttgcaccaggatg

SEQ ID NO: 1054843 - DNA, 22 bp, Artificial Sequence
  chemically synthesized
caaacagctacatcctggtgca

SEQ ID NO: 1054844 - DNA, 22 bp, Artificial Sequence
  chemically synthesized
ttaagggaaatgttgcaccagg

SEQ ID NO: 1054845 - DNA, 22 bp, Artificial Sequence
  chemically synthesized
catcctggtgcaacatttccct

SEQ ID NO: 1054846 - DNA, 22 bp, Artificial Sequence
  chemically synthesized
ataatggttgttaagggaaatg

SEQ ID NO: 1054847 - DNA, 22 bp, Artificial Sequence
  chemically synthesized
gtgcaacatttcccttaacaac

SEQ ID NO: 1054848 - DNA, 22 bp, Artificial Sequence
  chemically synthesized
taaatacaaaagactaataatg

SEQ ID NO: 1054849 - DNA, 22 bp, Artificial Sequence
  chemically synthesized
cccttaacaaccattattagtc

SEQ ID NO: 1054850 - DNA, 22 bp, Artificial Sequence
  chemically synthesized
ccttaacaaccattattagtct

SEQ ID NO: 1054851 - DNA, 22 bp, Artificial Sequence
  chemically synthesized
aacaaccattattagtcttttg

SEQ ID NO: 1054852 - DNA, 22 bp, Artificial Sequence
  chemically synthesized
acaaccattattagtcttttgt

SEQ ID NO: 1054853 - DNA, 22 bp, Artificial Sequence
  chemically synthesized
gcaaatggaattgtaaatacaa

SEQ ID NO: 1054854 - DNA, 22 bp, Artificial Sequence
  chemically synthesized
agcaaatggaattgtaaataca

SEQ ID NO: 1054855 - DNA, 22 bp, Artificial Sequence
  chemically synthesized
tagcaaatggaattgtaaatac

SEQ ID NO: 1054856 - DNA, 22 bp, Artificial Sequence
  chemically synthesized
ttagtcttttgtatttacaatt

SEQ ID NO: 1054857 - DNA, 22 bp, Artificial Sequence
  chemically synthesized
tttagcaaatggaattgtaaat

SEQ ID NO: 1054858 - DNA, 22 bp, Artificial Sequence
  chemically synthesized
gtcttttgtatttacaattcca

SEQ ID NO: 1054859 - DNA, 22 bp, Artificial Sequence
  chemically synthesized
ttgtatttacaattccatttgc

SEQ ID NO: 1054860 - DNA, 22 bp, Artificial Sequence
  chemically synthesized
tgtatttacaattccatttgct

SEQ ID NO: 1054861 - DNA, 22 bp, Artificial Sequence
  chemically synthesized
gtatttacaattccatttgcta

SEQ ID NO: 1054862 - DNA, 22 bp, Artificial Sequence
  chemically synthesized
tatttacaattccatttgctaa

SEQ ID NO: 1054863 - DNA, 22 bp, Artificial Sequence
  chemically synthesized
gagacagaatgttctttagcaa

SEQ ID NO: 1054864 - DNA, 22 bp, Artificial Sequence
  chemically synthesized
agagacagaatgttctttagca

SEQ ID NO: 1054865 - DNA, 22 bp, Artificial Sequence
  chemically synthesized
acaattccatttgctaaagaac

SEQ ID NO: 1054866 - DNA, 22 bp, Artificial Sequence
  chemically synthesized
caattccatttgctaaagaaca

SEQ ID NO: 1054867 - DNA, 22 bp, Artificial Sequence
  chemically synthesized
tttagagacagaatgttcttta

SEQ ID NO: 1054868 - DNA, 22 bp, Artificial Sequence
  chemically synthesized
atttagagacagaatgttcttt

SEQ ID NO: 1054869 - DNA, 22 bp, Artificial Sequence
  chemically synthesized
ttatttagagacagaatgttct

SEQ ID NO: 1054870 - DNA, 22 bp, Artificial Sequence
  chemically synthesized
cttatttagagacagaatgttc

SEQ ID NO: 1054871 - DNA, 22 bp, Artificial Sequence
  chemically synthesized
catttgctaaagaacattctgt

SEQ ID NO: 1054872 - DNA, 22 bp, Artificial Sequence
  chemically synthesized
tcttatttagagacagaatgtt

SEQ ID NO: 1054873 - DNA, 22 bp, Artificial Sequence
  chemically synthesized
gctaaagaacattctgtctcta

SEQ ID NO: 1054874 - DNA, 22 bp, Artificial Sequence
  chemically synthesized
ctaaagaacattctgtctctaa

SEQ ID NO: 1054875 - DNA, 22 bp, Artificial Sequence
  chemically synthesized
aagaacattctgtctctaaata

SEQ ID NO: 1054876 - DNA, 22 bp, Artificial Sequence
  chemically synthesized
ggaagataaatgattttcttat

SEQ ID NO: 1054877 - DNA, 22 bp, Artificial Sequence
  chemically synthesized
gggaagataaatgattttctta

SEQ ID NO: 1054878 - DNA, 22 bp, Artificial Sequence
  chemically synthesized
tgtctctaaataagaaaatcat

SEQ ID NO: 1054879 - DNA, 22 bp, Artificial Sequence
  chemically synthesized
tctctaaataagaaaatcattt

SEQ ID NO: 1054880 - DNA, 22 bp, Artificial Sequence
  chemically synthesized
taaataagaaaatcatttatct

SEQ ID NO: 1054881 - DNA, 22 bp, Artificial Sequence
  chemically synthesized
gagaatttgggaagataaatga

SEQ ID NO: 1054882 - DNA, 22 bp, Artificial Sequence
  chemically synthesized
ggagaatttgggaagataaatg

SEQ ID NO: 1054883 - DNA, 22 bp, Artificial Sequence
  chemically synthesized
aataagaaaatcatttatcttc

SEQ ID NO: 1054884 - DNA, 22 bp, Artificial Sequence
  chemically synthesized
ccagtgcaacatccttggagaa

SEQ ID NO: 1054885 - DNA, 22 bp, Artificial Sequence
  chemically synthesized
atcttcccaaattctccaagga

SEQ ID NO: 1054886 - DNA, 22 bp, Artificial Sequence
  chemically synthesized
tcttcccaaattctccaaggat

SEQ ID NO: 1054887 - DNA, 22 bp, Artificial Sequence
  chemically synthesized
cccaaattctccaaggatgttg

SEQ ID NO: 1054888 - DNA, 22 bp, Artificial Sequence
  chemically synthesized
ccaaattctccaaggatgttgc

SEQ ID NO: 1054889 - DNA, 22 bp, Artificial Sequence
  chemically synthesized
tcagctgccagtgcaacatcct

SEQ ID NO: 1054890 - DNA, 22 bp, Artificial Sequence
  chemically synthesized
tccaaggatgttgcactggcag

SEQ ID NO: 1054891 - DNA, 22 bp, Artificial Sequence
  chemically synthesized
caaggatgttgcactggcagct

SEQ ID NO: 1054892 - DNA, 22 bp, Artificial Sequence
  chemically synthesized
aaataacaacaaagattgtcag

SEQ ID NO: 1054893 - DNA, 22 bp, Artificial Sequence
  chemically synthesized
gaaataacaacaaagattgtca

SEQ ID NO: 1054894 - DNA, 22 bp, Artificial Sequence
  chemically synthesized
cactggcagctgacaatctttg

SEQ ID NO: 1054895 - DNA, 22 bp, Artificial Sequence
  chemically synthesized
ccttgaaataacaacaaagatt

SEQ ID NO: 1054896 - DNA, 22 bp, Artificial Sequence
  chemically synthesized
gccttgaaataacaacaaagat

SEQ ID NO: 1054897 - DNA, 22 bp, Artificial Sequence
  chemically synthesized
tgccttgaaataacaacaaaga

SEQ ID NO: 1054898 - DNA, 22 bp, Artificial Sequence
  chemically synthesized
gcagctgacaatctttgttgtt

SEQ ID NO: 1054899 - DNA, 22 bp, Artificial Sequence
  chemically synthesized
tttgccttgaaataacaacaaa

SEQ ID NO: 1054900 - DNA, 22 bp, Artificial Sequence
  chemically synthesized
ctttgccttgaaataacaacaa

SEQ ID NO: 1054901 - DNA, 22 bp, Artificial Sequence
  chemically synthesized
ttctttgccttgaaataacaac

SEQ ID NO: 1054902 - DNA, 22 bp, Artificial Sequence
  chemically synthesized
cttctttgccttgaaataacaa

SEQ ID NO: 1054903 - DNA, 22 bp, Artificial Sequence
  chemically synthesized
tcttctttgccttgaaataaca

SEQ ID NO: 1054904 - DNA, 22 bp, Artificial Sequence
  chemically synthesized
acaatctttgttgttatttcaa

SEQ ID NO: 1054905 - DNA, 22 bp, Artificial Sequence
  chemically synthesized
tgttgttatttcaaggcaaaga

SEQ ID NO: 1054906 - DNA, 22 bp, Artificial Sequence
  chemically synthesized
gttgttatttcaaggcaaagaa

SEQ ID NO: 1054907 - DNA, 22 bp, Artificial Sequence
  chemically synthesized
ttgttatttcaaggcaaagaag

SEQ ID NO: 1054908 - DNA, 22 bp, Artificial Sequence
  chemically synthesized
ccacatagattttcttctttgc

SEQ ID NO: 1054909 - DNA, 22 bp, Artificial Sequence
  chemically synthesized
ttatttcaaggcaaagaagaaa

SEQ ID NO: 1054910 - DNA, 22 bp, Artificial Sequence
  chemically synthesized
tttcaaggcaaagaagaaaatc

SEQ ID NO: 1054911 - DNA, 22 bp, Artificial Sequence
  chemically synthesized
caaggcaaagaagaaaatctat

SEQ ID NO: 1054912 - DNA, 22 bp, Artificial Sequence
  chemically synthesized
cataattgccacatagattttc

SEQ ID NO: 1054913 - DNA, 22 bp, Artificial Sequence
  chemically synthesized
aaggcaaagaagaaaatctatg

SEQ ID NO: 1054914 - DNA, 22 bp, Artificial Sequence
  chemically synthesized
gcataattgccacatagatttt

SEQ ID NO: 1054915 - DNA, 22 bp, Artificial Sequence
  chemically synthesized
tgcataattgccacatagattt

SEQ ID NO: 1054916 - DNA, 22 bp, Artificial Sequence
  chemically synthesized
tctttgcataattgccacatag

SEQ ID NO: 1054917 - DNA, 22 bp, Artificial Sequence
  chemically synthesized
ggggaaatatattgtctttgca

SEQ ID NO: 1054918 - DNA, 22 bp, Artificial Sequence
  chemically synthesized
tgtggcaattatgcaaagacaa

SEQ ID NO: 1054919 - DNA, 22 bp, Artificial Sequence
  chemically synthesized
tgcaaagacaatatatttcccc

SEQ ID NO: 1054920 - DNA, 22 bp, Artificial Sequence
  chemically synthesized
agaataaaattaggggaaatat

SEQ ID NO: 1054921 - DNA, 22 bp, Artificial Sequence
  chemically synthesized
gagaataaaattaggggaaata

SEQ ID NO: 1054922 - DNA, 22 bp, Artificial Sequence
  chemically synthesized
tgagaataaaattaggggaaat

SEQ ID NO: 1054923 - DNA, 22 bp, Artificial Sequence
  chemically synthesized
attttgagaataaaattagggg

SEQ ID NO: 1054924 - DNA, 22 bp, Artificial Sequence
  chemically synthesized
cccctaattttattctcaaaat

SEQ ID NO: 1054925 - DNA, 22 bp, Artificial Sequence
  chemically synthesized
ccctaattttattctcaaaatg

SEQ ID NO: 1054926 - DNA, 22 bp, Artificial Sequence
  chemically synthesized
taataaaagcaactcattttga

SEQ ID NO: 1054927 - DNA, 22 bp, Artificial Sequence
  chemically synthesized
gtaataaaagcaactcattttg

SEQ ID NO: 1054928 - DNA, 22 bp, Artificial Sequence
  chemically synthesized
attttattctcaaaatgagttg

SEQ ID NO: 1054929 - DNA, 22 bp, Artificial Sequence
  chemically synthesized
tcttgtaataaaagcaactcat

SEQ ID NO: 1054930 - DNA, 22 bp, Artificial Sequence
  chemically synthesized
tattctcaaaatgagttgcttt

SEQ ID NO: 1054931 - DNA, 22 bp, Artificial Sequence
  chemically synthesized
attctcaaaatgagttgctttt

SEQ ID NO: 1054932 - DNA, 22 bp, Artificial Sequence
  chemically synthesized
ctatcttgtaataaaagcaact

SEQ ID NO: 1054933 - DNA, 22 bp, Artificial Sequence
  chemically synthesized
ttctcaaaatgagttgctttta

SEQ ID NO: 1054934 - DNA, 22 bp, Artificial Sequence
  chemically synthesized
tcaaaatgagttgcttttatta

SEQ ID NO: 1054935 - DNA, 22 bp, Artificial Sequence
  chemically synthesized
tctcctatcttgtaataaaagc

SEQ ID NO: 1054936 - DNA, 22 bp, Artificial Sequence
  chemically synthesized
aaaatgagttgcttttattaca

SEQ ID NO: 1054937 - DNA, 22 bp, Artificial Sequence
  chemically synthesized
tattgtctcctatcttgtaata

SEQ ID NO: 1054938 - DNA, 22 bp, Artificial Sequence
  chemically synthesized
atattgtctcctatcttgtaat

SEQ ID NO: 1054939 - DNA, 22 bp, Artificial Sequence
  chemically synthesized
tatattgtctcctatcttgtaa

SEQ ID NO: 1054940 - DNA, 22 bp, Artificial Sequence
  chemically synthesized
ttatattgtctcctatcttgta

SEQ ID NO: 1054941 - DNA, 22 bp, Artificial Sequence
  chemically synthesized
tttatattgtctcctatcttgt

SEQ ID NO: 1054942 - DNA, 22 bp, Artificial Sequence
  chemically synthesized
cttttattacaagataggagac

SEQ ID NO: 1054943 - DNA, 22 bp, Artificial Sequence
  chemically synthesized
ttattacaagataggagacaat

SEQ ID NO: 1054944 - DNA, 22 bp, Artificial Sequence
  chemically synthesized
cacattttttatattgtctcct

SEQ ID NO: 1054945 - DNA, 22 bp, Artificial Sequence
  chemically synthesized
tattacaagataggagacaata

SEQ ID NO: 1054946 - DNA, 22 bp, Artificial Sequence
  chemically synthesized
attacaagataggagacaatat

SEQ ID NO: 1054947 - DNA, 22 bp, Artificial Sequence
  chemically synthesized
ttacaagataggagacaatata

SEQ ID NO: 1054948 - DNA, 22 bp, Artificial Sequence
  chemically synthesized
ctacacattttttatattgtct

SEQ ID NO: 1054949 - DNA, 22 bp, Artificial Sequence
  chemically synthesized
caagataggagacaatataaaa

SEQ ID NO: 1054950 - DNA, 22 bp, Artificial Sequence
  chemically synthesized
atggtctgctacacatttttta

SEQ ID NO: 1054951 - DNA, 22 bp, Artificial Sequence
  chemically synthesized
aatggtctgctacacatttttt

SEQ ID NO: 1054952 - DNA, 22 bp, Artificial Sequence
  chemically synthesized
gatttaatggtctgctacacat

SEQ ID NO: 1054953 - DNA, 22 bp, Artificial Sequence
  chemically synthesized
agcctagatttaatggtctgct

SEQ ID NO: 1054954 - DNA, 22 bp, Artificial Sequence
  chemically synthesized
tgtaaaataatgtctgagccta

SEQ ID NO: 1054955 - DNA, 22 bp, Artificial Sequence
  chemically synthesized
atgtaaaataatgtctgagcct

SEQ ID NO: 1054956 - DNA, 22 bp, Artificial Sequence
  chemically synthesized
aatctaggctcagacattattt

SEQ ID NO: 1054957 - DNA, 22 bp, Artificial Sequence
  chemically synthesized
ccaccaccttatgtaaaataat

SEQ ID NO: 1054958 - DNA, 22 bp, Artificial Sequence
  chemically synthesized
gccaccaccttatgtaaaataa

SEQ ID NO: 1054959 - DNA, 22 bp, Artificial Sequence
  chemically synthesized
ggctcagacattattttacata

SEQ ID NO: 1054960 - DNA, 22 bp, Artificial Sequence
  chemically synthesized
tttgccaccaccttatgtaaaa

SEQ ID NO: 1054961 - DNA, 22 bp, Artificial Sequence
  chemically synthesized
agacattattttacataaggtg

SEQ ID NO: 1054962 - DNA, 22 bp, Artificial Sequence
  chemically synthesized
ttttacataaggtggtggcaaa

SEQ ID NO: 1054963 - DNA, 22 bp, Artificial Sequence
  chemically synthesized
tacataaggtggtggcaaacag

SEQ ID NO: 1054964 - DNA, 22 bp, Artificial Sequence
  chemically synthesized
acataaggtggtggcaaacagt

SEQ ID NO: 1054965 - DNA, 22 bp, Artificial Sequence
  chemically synthesized
cataaggtggtggcaaacagtt

SEQ ID NO: 1054966 - DNA, 22 bp, Artificial Sequence
  chemically synthesized
agcagagatgtacaagaaaagt

SEQ ID NO: 1054967 - DNA, 22 bp, Artificial Sequence
  chemically synthesized
aagcagagatgtacaagaaaag

SEQ ID NO: 1054968 - DNA, 22 bp, Artificial Sequence
  chemically synthesized
tgttattacttttcttgtacat

SEQ ID NO: 1054969 - DNA, 22 bp, Artificial Sequence
  chemically synthesized
aatttaagcagagatgtacaag

SEQ ID NO: 1054970 - DNA, 22 bp, Artificial Sequence
  chemically synthesized
ttattacttttcttgtacatct

SEQ ID NO: 1054971 - DNA, 22 bp, Artificial Sequence
  chemically synthesized
aaatttaagcagagatgtacaa

SEQ ID NO: 1054972 - DNA, 22 bp, Artificial Sequence
  chemically synthesized
ttacttttcttgtacatctctg

SEQ ID NO: 1054973 - DNA, 22 bp, Artificial Sequence
  chemically synthesized
cttaaatttaagcagagatgta

SEQ ID NO: 1054974 - DNA, 22 bp, Artificial Sequence
  chemically synthesized
ccttaaatttaagcagagatgt

SEQ ID NO: 1054975 - DNA, 22 bp, Artificial Sequence
  chemically synthesized
cttttcttgtacatctctgctt

SEQ ID NO: 1054976 - DNA, 22 bp, Artificial Sequence
  chemically synthesized
ttcttgtacatctctgcttaaa

SEQ ID NO: 1054977 - DNA, 22 bp, Artificial Sequence
  chemically synthesized
tcttgtacatctctgcttaaat

SEQ ID NO: 1054978 - DNA, 22 bp, Artificial Sequence
  chemically synthesized
ggatttccttaaatttaagcag

SEQ ID NO: 1054979 - DNA, 22 bp, Artificial Sequence
  chemically synthesized
cttgtacatctctgcttaaatt

SEQ ID NO: 1054980 - DNA, 22 bp, Artificial Sequence
  chemically synthesized
gggatttccttaaatttaagca

SEQ ID NO: 1054981 - DNA, 22 bp, Artificial Sequence
  chemically synthesized
ttgtacatctctgcttaaattt

SEQ ID NO: 1054982 - DNA, 22 bp, Artificial Sequence
  chemically synthesized
gtacatctctgcttaaatttaa

SEQ ID NO: 1054983 - DNA, 22 bp, Artificial Sequence
  chemically synthesized
tttgggatttccttaaatttaa

SEQ ID NO: 1054984 - DNA, 22 bp, Artificial Sequence
  chemically synthesized
tacatctctgcttaaatttaag

SEQ ID NO: 1054985 - DNA, 22 bp, Artificial Sequence
  chemically synthesized
ttgtttgggatttccttaaatt

SEQ ID NO: 1054986 - DNA, 22 bp, Artificial Sequence
  chemically synthesized
tgttgtttgggatttccttaaa

SEQ ID NO: 1054987 - DNA, 22 bp, Artificial Sequence
  chemically synthesized
ctgttgtttgggatttccttaa

SEQ ID NO: 1054988 - DNA, 22 bp, Artificial Sequence
  chemically synthesized
ttctgttgtttgggatttcctt

SEQ ID NO: 1054989 - DNA, 22 bp, Artificial Sequence
  chemically synthesized
tgcttaaatttaaggaaatccc

SEQ ID NO: 1054990 - DNA, 22 bp, Artificial Sequence
  chemically synthesized
cttaaatttaaggaaatcccaa

SEQ ID NO: 1054991 - DNA, 22 bp, Artificial Sequence
  chemically synthesized
ttcttctgttgtttgggatttc

SEQ ID NO: 1054992 - DNA, 22 bp, Artificial Sequence
  chemically synthesized
aaatttaaggaaatcccaaaca

SEQ ID NO: 1054993 - DNA, 22 bp, Artificial Sequence
  chemically synthesized
aatttaaggaaatcccaaacaa

SEQ ID NO: 1054994 - DNA, 22 bp, Artificial Sequence
  chemically synthesized
aaggaaatcccaaacaacagaa

SEQ ID NO: 1054995 - DNA, 22 bp, Artificial Sequence
  chemically synthesized
aggaaatcccaaacaacagaag

SEQ ID NO: 1054996 - DNA, 22 bp, Artificial Sequence
  chemically synthesized
gaaaaaaatgggaagaacatca

SEQ ID NO: 1054997 - DNA, 22 bp, Artificial Sequence
  chemically synthesized
agaaaaaaatgggaagaacatc

SEQ ID NO: 1054998 - DNA, 22 bp, Artificial Sequence
  chemically synthesized
tagaaaaaaatgggaagaacat

SEQ ID NO: 1054999 - DNA, 22 bp, Artificial Sequence
  chemically synthesized
tttagaaaaaaatgggaagaac

SEQ ID NO: 1055000 - DNA, 22 bp, Artificial Sequence
  chemically synthesized
ttcccatttttttctaaagaat

SEQ ID NO: 1055001 - DNA, 22 bp, Artificial Sequence
  chemically synthesized
cccatttttttctaaagaatat

SEQ ID NO: 1055002 - DNA, 22 bp, Artificial Sequence
  chemically synthesized
ccatttttttctaaagaatatt

SEQ ID NO: 1055003 - DNA, 22 bp, Artificial Sequence
  chemically synthesized
agtgatggtgaaataagaatat

SEQ ID NO: 1055004 - DNA, 22 bp, Artificial Sequence
  chemically synthesized
ttttctaaagaatattcttatt

SEQ ID NO: 1055005 - DNA, 22 bp, Artificial Sequence
  chemically synthesized
gagtgatggtgaaataagaata

SEQ ID NO: 1055006 - DNA, 22 bp, Artificial Sequence
  chemically synthesized
tttctaaagaatattcttattt

SEQ ID NO: 1055007 - DNA, 22 bp, Artificial Sequence
  chemically synthesized
ttctaaagaatattcttatttc

SEQ ID NO: 1055008 - DNA, 22 bp, Artificial Sequence
  chemically synthesized
tctaaagaatattcttatttca

SEQ ID NO: 1055009 - DNA, 22 bp, Artificial Sequence
  chemically synthesized
tttgagtgatggtgaaataaga

SEQ ID NO: 1055010 - DNA, 22 bp, Artificial Sequence
  chemically synthesized
ctaaagaatattcttatttcac

SEQ ID NO: 1055011 - DNA, 22 bp, Artificial Sequence
  chemically synthesized
atttgagtgatggtgaaataag

SEQ ID NO: 1055012 - DNA, 22 bp, Artificial Sequence
  chemically synthesized
taaagaatattcttatttcacc

SEQ ID NO: 1055013 - DNA, 22 bp, Artificial Sequence
  chemically synthesized
ttatttgagtgatggtgaaata

SEQ ID NO: 1055014 - DNA, 22 bp, Artificial Sequence
  chemically synthesized
aagaatattcttatttcaccat

SEQ ID NO: 1055015 - DNA, 22 bp, Artificial Sequence
  chemically synthesized
cttatttgagtgatggtgaaat

SEQ ID NO: 1055016 - DNA, 22 bp, Artificial Sequence
  chemically synthesized
ttatttcaccatcactcaaata

SEQ ID NO: 1055017 - DNA, 22 bp, Artificial Sequence
  chemically synthesized
atgaaaggtttcttatttgagt

SEQ ID NO: 1055018 - DNA, 22 bp, Artificial Sequence
  chemically synthesized
atttcaccatcactcaaataag

SEQ ID NO: 1055019 - DNA, 22 bp, Artificial Sequence
  chemically synthesized
tttcaccatcactcaaataaga

SEQ ID NO: 1055020 - DNA, 22 bp, Artificial Sequence
  chemically synthesized
caccatcactcaaataagaaac

SEQ ID NO: 1055021 - DNA, 22 bp, Artificial Sequence
  chemically synthesized
accatcactcaaataagaaacc

SEQ ID NO: 1055022 - DNA, 22 bp, Artificial Sequence
  chemically synthesized
agattgatgaaaggtttcttat

SEQ ID NO: 1055023 - DNA, 22 bp, Artificial Sequence
  chemically synthesized
cagattgatgaaaggtttctta

SEQ ID NO: 1055024 - DNA, 22 bp, Artificial Sequence
  chemically synthesized
atttcagattgatgaaaggttt

SEQ ID NO: 1055025 - DNA, 22 bp, Artificial Sequence
  chemically synthesized
gatttcagattgatgaaaggtt

SEQ ID NO: 1055026 - DNA, 22 bp, Artificial Sequence
  chemically synthesized
aaataagaaacctttcatcaat

SEQ ID NO: 1055027 - DNA, 22 bp, Artificial Sequence
  chemically synthesized
tcatcaatctgaaatcaaattt

SEQ ID NO: 1055028 - DNA, 22 bp, Artificial Sequence
  chemically synthesized
catcaatctgaaatcaaatttc

SEQ ID NO: 1055029 - DNA, 22 bp, Artificial Sequence
  chemically synthesized
cagtagaaaagggaaatttgat

SEQ ID NO: 1055030 - DNA, 22 bp, Artificial Sequence
  chemically synthesized
atcaatctgaaatcaaatttcc

SEQ ID NO: 1055031 - DNA, 22 bp, Artificial Sequence
  chemically synthesized
gacagttgcagtagaaaaggga

SEQ ID NO: 1055032 - DNA, 22 bp, Artificial Sequence
  chemically synthesized
aaatcaaatttcccttttctac

SEQ ID NO: 1055033 - DNA, 22 bp, Artificial Sequence
  chemically synthesized
acatctagacagttgcagtaga

SEQ ID NO: 1055034 - DNA, 22 bp, Artificial Sequence
  chemically synthesized
cacatctagacagttgcagtag

SEQ ID NO: 1055035 - DNA, 22 bp, Artificial Sequence
  chemically synthesized
tcacatctagacagttgcagta

SEQ ID NO: 1055036 - DNA, 22 bp, Artificial Sequence
  chemically synthesized
cccttttctactgcaactgtct

SEQ ID NO: 1055037 - DNA, 22 bp, Artificial Sequence
  chemically synthesized
ccttttctactgcaactgtcta

SEQ ID NO: 1055038 - DNA, 22 bp, Artificial Sequence
  chemically synthesized
tagactttcacatctagacagt

SEQ ID NO: 1055039 - DNA, 22 bp, Artificial Sequence
  chemically synthesized
ttctactgcaactgtctagatg

SEQ ID NO: 1055040 - DNA, 22 bp, Artificial Sequence
  chemically synthesized
tatagactttcacatctagaca

SEQ ID NO: 1055041 - DNA, 22 bp, Artificial Sequence
  chemically synthesized
tctactgcaactgtctagatgt

SEQ ID NO: 1055042 - DNA, 22 bp, Artificial Sequence
  chemically synthesized
ctactgcaactgtctagatgtg

SEQ ID NO: 1055043 - DNA, 22 bp, Artificial Sequence
  chemically synthesized
tactgcaactgtctagatgtga

SEQ ID NO: 1055044 - DNA, 22 bp, Artificial Sequence
  chemically synthesized
ctgcaactgtctagatgtgaaa

SEQ ID NO: 1055045 - DNA, 22 bp, Artificial Sequence
  chemically synthesized
gattctatagactttcacatct

SEQ ID NO: 1055046 - DNA, 22 bp, Artificial Sequence
  chemically synthesized
caactgtctagatgtgaaagtc

SEQ ID NO: 1055047 - DNA, 22 bp, Artificial Sequence
  chemically synthesized
tctagatgtgaaagtctataga

SEQ ID NO: 1055048 - DNA, 22 bp, Artificial Sequence
  chemically synthesized
tgaaggggttagattctataga

SEQ ID NO: 1055049 - DNA, 22 bp, Artificial Sequence
  chemically synthesized
gatgtgaaagtctatagaatct

SEQ ID NO: 1055050 - DNA, 22 bp, Artificial Sequence
  chemically synthesized
tatgaaggggttagattctata

SEQ ID NO: 1055051 - DNA, 22 bp, Artificial Sequence
  chemically synthesized
ctatgaaggggttagattctat

SEQ ID NO: 1055052 - DNA, 22 bp, Artificial Sequence
  chemically synthesized
tctatgaaggggttagattcta

SEQ ID NO: 1055053 - DNA, 22 bp, Artificial Sequence
  chemically synthesized
tgactttctatgaaggggttag

SEQ ID NO: 1055054 - DNA, 22 bp, Artificial Sequence
  chemically synthesized
tagaatctaaccccttcataga

SEQ ID NO: 1055055 - DNA, 22 bp, Artificial Sequence
  chemically synthesized
atgggattatgactttctatga

SEQ ID NO: 1055056 - DNA, 22 bp, Artificial Sequence
  chemically synthesized
accccttcatagaaagtcataa

SEQ ID NO: 1055057 - DNA, 22 bp, Artificial Sequence
  chemically synthesized
atatgctaatgggattatgact

SEQ ID NO: 1055058 - DNA, 22 bp, Artificial Sequence
  chemically synthesized
gatatgctaatgggattatgac

SEQ ID NO: 1055059 - DNA, 22 bp, Artificial Sequence
  chemically synthesized
catagaaagtcataatcccatt

SEQ ID NO: 1055060 - DNA, 22 bp, Artificial Sequence
  chemically synthesized
atagaaagtcataatcccatta

SEQ ID NO: 1055061 - DNA, 22 bp, Artificial Sequence
  chemically synthesized
gtgcgtttgatatgctaatggg

SEQ ID NO: 1055062 - DNA, 22 bp, Artificial Sequence
  chemically synthesized
tagtgcgtttgatatgctaatg

SEQ ID NO: 1055063 - DNA, 22 bp, Artificial Sequence
  chemically synthesized
ctagtgcgtttgatatgctaat

SEQ ID NO: 1055064 - DNA, 22 bp, Artificial Sequence
  chemically synthesized
tctagtgcgtttgatatgctaa

SEQ ID NO: 1055065 - DNA, 22 bp, Artificial Sequence
  chemically synthesized
taactttctagtgcgtttgata

SEQ ID NO: 1055066 - DNA, 22 bp, Artificial Sequence
  chemically synthesized
tataactttctagtgcgtttga

SEQ ID NO: 1055067 - DNA, 22 bp, Artificial Sequence
  chemically synthesized
ctctataactttctagtgcgtt

SEQ ID NO: 1055068 - DNA, 22 bp, Artificial Sequence
  chemically synthesized
actctataactttctagtgcgt

SEQ ID NO: 1055069 - DNA, 22 bp, Artificial Sequence
  chemically synthesized
gcatatcaaacgcactagaaag

SEQ ID NO: 1055070 - DNA, 22 bp, Artificial Sequence
  chemically synthesized
cttactctataactttctagtg

SEQ ID NO: 1055071 - DNA, 22 bp, Artificial Sequence
  chemically synthesized
ccttactctataactttctagt

SEQ ID NO: 1055072 - DNA, 22 bp, Artificial Sequence
  chemically synthesized
tccttactctataactttctag

SEQ ID NO: 1055073 - DNA, 22 bp, Artificial Sequence
  chemically synthesized
agcaaactttccttactctata

SEQ ID NO: 1055074 - DNA, 22 bp, Artificial Sequence
  chemically synthesized
gaaagttatagagtaaggaaag

SEQ ID NO: 1055075 - DNA, 22 bp, Artificial Sequence
  chemically synthesized
tagagtaaggaaagtttgctta

SEQ ID NO: 1055076 - DNA, 22 bp, Artificial Sequence
  chemically synthesized
gtaaacagtagattaagcaaac

SEQ ID NO: 1055077 - DNA, 22 bp, Artificial Sequence
  chemically synthesized
ggtaaacagtagattaagcaaa

SEQ ID NO: 1055078 - DNA, 22 bp, Artificial Sequence
  chemically synthesized
tggtaaacagtagattaagcaa

SEQ ID NO: 1055079 - DNA, 22 bp, Artificial Sequence
  chemically synthesized
aacaattttggtaaacagtaga

SEQ ID NO: 1055080 - DNA, 22 bp, Artificial Sequence
  chemically synthesized
aaacaattttggtaaacagtag

SEQ ID NO: 1055081 - DNA, 22 bp, Artificial Sequence
  chemically synthesized
gcttaatctactgtttaccaaa

SEQ ID NO: 1055082 - DNA, 22 bp, Artificial Sequence
  chemically synthesized
cttaatctactgtttaccaaaa

SEQ ID NO: 1055083 - DNA, 22 bp, Artificial Sequence
  chemically synthesized
agtgtttaaacaattttggtaa

SEQ ID NO: 1055084 - DNA, 22 bp, Artificial Sequence
  chemically synthesized
cagtgtttaaacaattttggta

SEQ ID NO: 1055085 - DNA, 22 bp, Artificial Sequence
  chemically synthesized
aatctactgtttaccaaaattg

SEQ ID NO: 1055086 - DNA, 22 bp, Artificial Sequence
  chemically synthesized
atctactgtttaccaaaattgt

SEQ ID NO: 1055087 - DNA, 22 bp, Artificial Sequence
  chemically synthesized
ctgtttaccaaaattgtttaaa

SEQ ID NO: 1055088 - DNA, 22 bp, Artificial Sequence
  chemically synthesized
tttaccaaaattgtttaaacac

SEQ ID NO: 1055089 - DNA, 22 bp, Artificial Sequence
  chemically synthesized
accaaaattgtttaaacactga

SEQ ID NO: 1055090 - DNA, 22 bp, Artificial Sequence
  chemically synthesized
ccaaaattgtttaaacactgaa

SEQ ID NO: 1055091 - DNA, 22 bp, Artificial Sequence
  chemically synthesized
ataaaaaaggaaaaaagtttca

SEQ ID NO: 1055092 - DNA, 22 bp, Artificial Sequence
  chemically synthesized
tttaaacactgaaacttttttc

SEQ ID NO: 1055093 - DNA, 22 bp, Artificial Sequence
  chemically synthesized
ttaataaaaaaggaaaaaagtt

SEQ ID NO: 1055094 - DNA, 22 bp, Artificial Sequence
  chemically synthesized
aaacactgaaacttttttcctt

SEQ ID NO: 1055095 - DNA, 22 bp, Artificial Sequence
  chemically synthesized
aacactgaaacttttttccttt

SEQ ID NO: 1055096 - DNA, 22 bp, Artificial Sequence
  chemically synthesized
aaacttttttccttttttatta

SEQ ID NO: 1055097 - DNA, 22 bp, Artificial Sequence
  chemically synthesized
ttttccttttttattaataact

SEQ ID NO: 1055098 - DNA, 22 bp, Artificial Sequence
  chemically synthesized
tttccttttttattaataactc

SEQ ID NO: 1055099 - DNA, 22 bp, Artificial Sequence
  chemically synthesized
ttccttttttattaataactcc

SEQ ID NO: 1055100 - DNA, 22 bp, Artificial Sequence
  chemically synthesized
caaaacatggtgggagttatta

SEQ ID NO: 1055101 - DNA, 22 bp, Artificial Sequence
  chemically synthesized
tccttttttattaataactccc

SEQ ID NO: 1055102 - DNA, 22 bp, Artificial Sequence
  chemically synthesized
ccaaaacatggtgggagttatt

SEQ ID NO: 1055103 - DNA, 22 bp, Artificial Sequence
  chemically synthesized
ccttttttattaataactccca

SEQ ID NO: 1055104 - DNA, 22 bp, Artificial Sequence
  chemically synthesized
tccaaaacatggtgggagttat

SEQ ID NO: 1055105 - DNA, 22 bp, Artificial Sequence
  chemically synthesized
cttttttattaataactcccac

SEQ ID NO: 1055106 - DNA, 22 bp, Artificial Sequence
  chemically synthesized
ctttccaaaacatggtgggagt

SEQ ID NO: 1055107 - DNA, 22 bp, Artificial Sequence
  chemically synthesized
ttttattaataactcccaccat

SEQ ID NO: 1055108 - DNA, 22 bp, Artificial Sequence
  chemically synthesized
tttattaataactcccaccatg

SEQ ID NO: 1055109 - DNA, 22 bp, Artificial Sequence
  chemically synthesized
ttattaataactcccaccatgt

SEQ ID NO: 1055110 - DNA, 22 bp, Artificial Sequence
  chemically synthesized
tattaataactcccaccatgtt

SEQ ID NO: 1055111 - DNA, 22 bp, Artificial Sequence
  chemically synthesized
actgctttccaaaacatggtgg

SEQ ID NO: 1055112 - DNA, 22 bp, Artificial Sequence
  chemically synthesized
attaataactcccaccatgttt

SEQ ID NO: 1055113 - DNA, 22 bp, Artificial Sequence
  chemically synthesized
ttaataactcccaccatgtttt

SEQ ID NO: 1055114 - DNA, 22 bp, Artificial Sequence
  chemically synthesized
ataactcccaccatgttttgga

SEQ ID NO: 1055115 - DNA, 22 bp, Artificial Sequence
  chemically synthesized
aactcactgctttccaaaacat

SEQ ID NO: 1055116 - DNA, 22 bp, Artificial Sequence
  chemically synthesized
gaactcactgctttccaaaaca

SEQ ID NO: 1055117 - DNA, 22 bp, Artificial Sequence
  chemically synthesized
ccaccatgttttggaaagcagt

SEQ ID NO: 1055118 - DNA, 22 bp, Artificial Sequence
  chemically synthesized
tggaaagcagtgagttcaagtt

SEQ ID NO: 1055119 - DNA, 22 bp, Artificial Sequence
  chemically synthesized
ggaaagcagtgagttcaagttt

SEQ ID NO: 1055120 - DNA, 22 bp, Artificial Sequence
  chemically synthesized
gaaagcagtgagttcaagtttg

SEQ ID NO: 1055121 - DNA, 22 bp, Artificial Sequence
  chemically synthesized
agaaatggaagacgccaaactt

SEQ ID NO: 1055122 - DNA, 22 bp, Artificial Sequence
  chemically synthesized
aagtttggcgtcttccatttct

SEQ ID NO: 1055123 - DNA, 22 bp, Artificial Sequence
  chemically synthesized
tccaaggatacatctgagaaat

SEQ ID NO: 1055124 - DNA, 22 bp, Artificial Sequence
  chemically synthesized
gtccaaggatacatctgagaaa

SEQ ID NO: 1055125 - DNA, 22 bp, Artificial Sequence
  chemically synthesized
ggcgtcttccatttctcagatg

SEQ ID NO: 1055126 - DNA, 22 bp, Artificial Sequence
  chemically synthesized
gcgtcttccatttctcagatgt

SEQ ID NO: 1055127 - DNA, 22 bp, Artificial Sequence
  chemically synthesized
agagatttgtccaaggatacat

SEQ ID NO: 1055128 - DNA, 22 bp, Artificial Sequence
  chemically synthesized
ccatttctcagatgtatccttg

SEQ ID NO: 1055129 - DNA, 22 bp, Artificial Sequence
  chemically synthesized
catttctcagatgtatccttgg

SEQ ID NO: 1055130 - DNA, 22 bp, Artificial Sequence
  chemically synthesized
ctcagatgtatccttggacaaa

SEQ ID NO: 1055131 - DNA, 22 bp, Artificial Sequence
  chemically synthesized
tcagatgtatccttggacaaat

SEQ ID NO: 1055132 - DNA, 22 bp, Artificial Sequence
  chemically synthesized
agatgtatccttggacaaatct

SEQ ID NO: 1055133 - DNA, 22 bp, Artificial Sequence
  chemically synthesized
gcataaatgaggttaagagatt

SEQ ID NO: 1055134 - DNA, 22 bp, Artificial Sequence
  chemically synthesized
ggacaaatctcttaacctcatt

SEQ ID NO: 1055135 - DNA, 22 bp, Artificial Sequence
  chemically synthesized
gacaaatctcttaacctcattt

SEQ ID NO: 1055136 - DNA, 22 bp, Artificial Sequence
  chemically synthesized
taagaaaaattagcataaatga

SEQ ID NO: 1055137 - DNA, 22 bp, Artificial Sequence
  chemically synthesized
ctgtaagaaaaattagcataaa

SEQ ID NO: 1055138 - DNA, 22 bp, Artificial Sequence
  chemically synthesized
actgtaagaaaaattagcataa

SEQ ID NO: 1055139 - DNA, 22 bp, Artificial Sequence
  chemically synthesized
tactgtaagaaaaattagcata

SEQ ID NO: 1055140 - DNA, 22 bp, Artificial Sequence
  chemically synthesized
ttaacctcatttatgctaattt

SEQ ID NO: 1055141 - DNA, 22 bp, Artificial Sequence
  chemically synthesized
aacctcatttatgctaattttt

SEQ ID NO: 1055142 - DNA, 22 bp, Artificial Sequence
  chemically synthesized
acctcatttatgctaatttttc

SEQ ID NO: 1055143 - DNA, 22 bp, Artificial Sequence
  chemically synthesized
tcattttactgtaagaaaaatt

SEQ ID NO: 1055144 - DNA, 22 bp, Artificial Sequence
  chemically synthesized
gtcattttactgtaagaaaaat

SEQ ID NO: 1055145 - DNA, 22 bp, Artificial Sequence
  chemically synthesized
tgtcattttactgtaagaaaaa

SEQ ID NO: 1055146 - DNA, 22 bp, Artificial Sequence
  chemically synthesized
atttatgctaatttttcttaca

SEQ ID NO: 1055147 - DNA, 22 bp, Artificial Sequence
  chemically synthesized
tttgtcattttactgtaagaaa

SEQ ID NO: 1055148 - DNA, 22 bp, Artificial Sequence
  chemically synthesized
ctttgtcattttactgtaagaa

SEQ ID NO: 1055149 - DNA, 22 bp, Artificial Sequence
  chemically synthesized
tctttgtcattttactgtaaga

SEQ ID NO: 1055150 - DNA, 22 bp, Artificial Sequence
  chemically synthesized
atgctaatttttcttacagtaa

SEQ ID NO: 1055151 - DNA, 22 bp, Artificial Sequence
  chemically synthesized
tgctaatttttcttacagtaaa

SEQ ID NO: 1055152 - DNA, 22 bp, Artificial Sequence
  chemically synthesized
atttttcttacagtaaaatgac

SEQ ID NO: 1055153 - DNA, 22 bp, Artificial Sequence
  chemically synthesized
ttcttacagtaaaatgacaaag

SEQ ID NO: 1055154 - DNA, 22 bp, Artificial Sequence
  chemically synthesized
aagtatcattttctttgtcatt

SEQ ID NO: 1055155 - DNA, 22 bp, Artificial Sequence
  chemically synthesized
tcttacagtaaaatgacaaaga

SEQ ID NO: 1055156 - DNA, 22 bp, Artificial Sequence
  chemically synthesized
cttacagtaaaatgacaaagaa

SEQ ID NO: 1055157 - DNA, 22 bp, Artificial Sequence
  chemically synthesized
tcaagtatcattttctttgtca

SEQ ID NO: 1055158 - DNA, 22 bp, Artificial Sequence
  chemically synthesized
ttacagtaaaatgacaaagaaa

SEQ ID NO: 1055159 - DNA, 22 bp, Artificial Sequence
  chemically synthesized
acagtaaaatgacaaagaaaat

SEQ ID NO: 1055160 - DNA, 22 bp, Artificial Sequence
  chemically synthesized
cagtaaaatgacaaagaaaatg

SEQ ID NO: 1055161 - DNA, 22 bp, Artificial Sequence
  chemically synthesized
atcacagtaatgaccctctcaa

SEQ ID NO: 1055162 - DNA, 22 bp, Artificial Sequence
  chemically synthesized
gatcacagtaatgaccctctca

SEQ ID NO: 1055163 - DNA, 22 bp, Artificial Sequence
  chemically synthesized
gtttgatcacagtaatgaccct

SEQ ID NO: 1055164 - DNA, 22 bp, Artificial Sequence
  chemically synthesized
gagagggtcattactgtgatca

SEQ ID NO: 1055165 - DNA, 22 bp, Artificial Sequence
  chemically synthesized
agagggtcattactgtgatcaa

SEQ ID NO: 1055166 - DNA, 22 bp, Artificial Sequence
  chemically synthesized
acatgcatctagtttgatcaca

SEQ ID NO: 1055167 - DNA, 22 bp, Artificial Sequence
  chemically synthesized
cacatgcatctagtttgatcac

SEQ ID NO: 1055168 - DNA, 22 bp, Artificial Sequence
  chemically synthesized
tcacatgcatctagtttgatca

SEQ ID NO: 1055169 - DNA, 22 bp, Artificial Sequence
  chemically synthesized
ctgtgatcaaactagatgcatg

SEQ ID NO: 1055170 - DNA, 22 bp, Artificial Sequence
  chemically synthesized
acaaagagttttcacatgcatc

SEQ ID NO: 1055171 - DNA, 22 bp, Artificial Sequence
  chemically synthesized
tgatcaaactagatgcatgtga

SEQ ID NO: 1055172 - DNA, 22 bp, Artificial Sequence
  chemically synthesized
tacattcacaaagagttttcac

SEQ ID NO: 1055173 - DNA, 22 bp, Artificial Sequence
  chemically synthesized
gatgcatgtgaaaactctttgt

SEQ ID NO: 1055174 - DNA, 22 bp, Artificial Sequence
  chemically synthesized
aatagtattatacattcacaaa

SEQ ID NO: 1055175 - DNA, 22 bp, Artificial Sequence
  chemically synthesized
aatctgaatagtattatacatt

SEQ ID NO: 1055176 - DNA, 22 bp, Artificial Sequence
  chemically synthesized
gaatctgaatagtattatacat

SEQ ID NO: 1055177 - DNA, 22 bp, Artificial Sequence
  chemically synthesized
tttgaatctgaatagtattata

SEQ ID NO: 1055178 - DNA, 22 bp, Artificial Sequence
  chemically synthesized
tttgtgaatgtataatactatt

SEQ ID NO: 1055179 - DNA, 22 bp, Artificial Sequence
  chemically synthesized
tgtgaatgtataatactattca

SEQ ID NO: 1055180 - DNA, 22 bp, Artificial Sequence
  chemically synthesized
gtgaatgtataatactattcag

SEQ ID NO: 1055181 - DNA, 22 bp, Artificial Sequence
  chemically synthesized
agttgtttgaatctgaatagta

SEQ ID NO: 1055182 - DNA, 22 bp, Artificial Sequence
  chemically synthesized
tgaatgtataatactattcaga

SEQ ID NO: 1055183 - DNA, 22 bp, Artificial Sequence
  chemically synthesized
aagttgtttgaatctgaatagt

SEQ ID NO: 1055184 - DNA, 22 bp, Artificial Sequence
  chemically synthesized
taagttgtttgaatctgaatag

SEQ ID NO: 1055185 - DNA, 22 bp, Artificial Sequence
  chemically synthesized
ttaagttgtttgaatctgaata

SEQ ID NO: 1055186 - DNA, 22 bp, Artificial Sequence
  chemically synthesized
tttaagttgtttgaatctgaat

SEQ ID NO: 1055187 - DNA, 22 bp, Artificial Sequence
  chemically synthesized
ttttaagttgtttgaatctgaa

SEQ ID NO: 1055188 - DNA, 22 bp, Artificial Sequence
  chemically synthesized
acttttttaagttgtttgaatc

SEQ ID NO: 1055189 - DNA, 22 bp, Artificial Sequence
  chemically synthesized
cactaacttttttaagttgttt

SEQ ID NO: 1055190 - DNA, 22 bp, Artificial Sequence
  chemically synthesized
ccactaacttttttaagttgtt

SEQ ID NO: 1055191 - DNA, 22 bp, Artificial Sequence
  chemically synthesized
tccactaacttttttaagttgt

SEQ ID NO: 1055192 - DNA, 22 bp, Artificial Sequence
  chemically synthesized
ttcagattcaaacaacttaaaa

SEQ ID NO: 1055193 - DNA, 22 bp, Artificial Sequence
  chemically synthesized
ttccactaacttttttaagttg

SEQ ID NO: 1055194 - DNA, 22 bp, Artificial Sequence
  chemically synthesized
agattcaaacaacttaaaaaag

SEQ ID NO: 1055195 - DNA, 22 bp, Artificial Sequence
  chemically synthesized
aaacaacttaaaaaagttagtg

SEQ ID NO: 1055196 - DNA, 22 bp, Artificial Sequence
  chemically synthesized
tgaatatttttccactaacttt

SEQ ID NO: 1055197 - DNA, 22 bp, Artificial Sequence
  chemically synthesized
tatattgtgaatatttttccac

SEQ ID NO: 1055198 - DNA, 22 bp, Artificial Sequence
  chemically synthesized
aaaaaagttagtggaaaaatat

SEQ ID NO: 1055199 - DNA, 22 bp, Artificial Sequence
  chemically synthesized
aaaaagttagtggaaaaatatt

SEQ ID NO: 1055200 - DNA, 22 bp, Artificial Sequence
  chemically synthesized
gtggaaaaatattcacaatata

SEQ ID NO: 1055201 - DNA, 22 bp, Artificial Sequence
  chemically synthesized
taaaataaacacctatatattg

SEQ ID NO: 1055202 - DNA, 22 bp, Artificial Sequence
  chemically synthesized
gtaaaataaacacctatatatt

SEQ ID NO: 1055203 - DNA, 22 bp, Artificial Sequence
  chemically synthesized
aataaatttgtaaaataaacac

SEQ ID NO: 1055204 - DNA, 22 bp, Artificial Sequence
  chemically synthesized
acaatatataggtgtttatttt

SEQ ID NO: 1055205 - DNA, 22 bp, Artificial Sequence
  chemically synthesized
attgaataaatttgtaaaataa

SEQ ID NO: 1055206 - DNA, 22 bp, Artificial Sequence
  chemically synthesized
aattgaataaatttgtaaaata

SEQ ID NO: 1055207 - DNA, 22 bp, Artificial Sequence
  chemically synthesized
attttacaaatttattcaatta

SEQ ID NO: 1055208 - DNA, 22 bp, Artificial Sequence
  chemically synthesized
ttttacaaatttattcaattaa

SEQ ID NO: 1055209 - DNA, 22 bp, Artificial Sequence
  chemically synthesized
tacaaatttattcaattaagga

SEQ ID NO: 1055210 - DNA, 22 bp, Artificial Sequence
  chemically synthesized
acaaatttattcaattaaggac

SEQ ID NO: 1055211 - DNA, 22 bp, Artificial Sequence
  chemically synthesized
caaatttattcaattaaggact

SEQ ID NO: 1055212 - DNA, 22 bp, Artificial Sequence
  chemically synthesized
aagaaaaaaaagtagtccttaa

SEQ ID NO: 1055213 - DNA, 22 bp, Artificial Sequence
  chemically synthesized
attcaattaaggactacttttt

SEQ ID NO: 1055214 - DNA, 22 bp, Artificial Sequence
  chemically synthesized
ttcaattaaggactactttttt

SEQ ID NO: 1055215 - DNA, 22 bp, Artificial Sequence
  chemically synthesized
aattaaggactacttttttttc

SEQ ID NO: 1055216 - DNA, 22 bp, Artificial Sequence
  chemically synthesized
agaccccgcctcaagaaaaaaa

SEQ ID NO: 1055217 - DNA, 22 bp, Artificial Sequence
  chemically synthesized
aggactacttttttttcttgag

SEQ ID NO: 1055218 - DNA, 22 bp, Artificial Sequence
  chemically synthesized
cttttttttcttgaggcggggt

SEQ ID NO: 1055219 - DNA, 22 bp, Artificial Sequence
  chemically synthesized
ggcaacagattgagaccccgcc

SEQ ID NO: 1055220 - DNA, 22 bp, Artificial Sequence
  chemically synthesized
ttttttcttgaggcggggtctc

SEQ ID NO: 1055221 - DNA, 22 bp, Artificial Sequence
  chemically synthesized
tttttcttgaggcggggtctca

SEQ ID NO: 1055222 - DNA, 22 bp, Artificial Sequence
  chemically synthesized
ttttcttgaggcggggtctcaa

SEQ ID NO: 1055223 - DNA, 22 bp, Artificial Sequence
  chemically synthesized
tttcttgaggcggggtctcaat

SEQ ID NO: 1055224 - DNA, 22 bp, Artificial Sequence
  chemically synthesized
ttcttgaggcggggtctcaatc

SEQ ID NO: 1055225 - DNA, 22 bp, Artificial Sequence
  chemically synthesized
tcttgaggcggggtctcaatct

SEQ ID NO: 1055226 - DNA, 22 bp, Artificial Sequence
  chemically synthesized
cttgaggcggggtctcaatctg

SEQ ID NO: 1055227 - DNA, 22 bp, Artificial Sequence
  chemically synthesized
cagcctgggcaacagattgaga

SEQ ID NO: 1055228 - DNA, 22 bp, Artificial Sequence
  chemically synthesized
ttgaggcggggtctcaatctgt

SEQ ID NO: 1055229 - DNA, 22 bp, Artificial Sequence
  chemically synthesized
gaggcggggtctcaatctgttg

SEQ ID NO: 1055230 - DNA, 22 bp, Artificial Sequence
  chemically synthesized
aggcggggtctcaatctgttgc

SEQ ID NO: 1055231 - DNA, 22 bp, Artificial Sequence
  chemically synthesized
cactacagcctgggcaacagat

SEQ ID NO: 1055232 - DNA, 22 bp, Artificial Sequence
  chemically synthesized
aatctgttgcccaggctgtagt

SEQ ID NO: 1055233 - DNA, 22 bp, Artificial Sequence
  chemically synthesized
ttgcccaggctgtagtgcagtg

SEQ ID NO: 1055234 - DNA, 22 bp, Artificial Sequence
  chemically synthesized
cccaggctgtagtgcagtggtg

SEQ ID NO: 1055235 - DNA, 22 bp, Artificial Sequence
  chemically synthesized
cagtcagcagggatcacaccac

SEQ ID NO: 1055236 - DNA, 22 bp, Artificial Sequence
  chemically synthesized
tagtgcagtggtgtgatccctg

SEQ ID NO: 1055237 - DNA, 22 bp, Artificial Sequence
  chemically synthesized
ggagacagaggttacagtcagc

SEQ ID NO: 1055238 - DNA, 22 bp, Artificial Sequence
  chemically synthesized
aaactgggagacagaggttaca

SEQ ID NO: 1055239 - DNA, 22 bp, Artificial Sequence
  chemically synthesized
gaaactgggagacagaggttac

SEQ ID NO: 1055240 - DNA, 22 bp, Artificial Sequence
  chemically synthesized
cttgaaactgggagacagaggt

SEQ ID NO: 1055241 - DNA, 22 bp, Artificial Sequence
  chemically synthesized
ctgactgtaacctctgtctccc

SEQ ID NO: 1055242 - DNA, 22 bp, Artificial Sequence
  chemically synthesized
actgtaacctctgtctcccagt

SEQ ID NO: 1055243 - DNA, 22 bp, Artificial Sequence
  chemically synthesized
taacctctgtctcccagtttca

SEQ ID NO: 1055244 - DNA, 22 bp, Artificial Sequence
  chemically synthesized
aggcatgagaattgcttgaaac

SEQ ID NO: 1055245 - DNA, 22 bp, Artificial Sequence
  chemically synthesized
tgtctcccagtttcaagcaatt

SEQ ID NO: 1055246 - DNA, 22 bp, Artificial Sequence
  chemically synthesized
tctcccagtttcaagcaattct

SEQ ID NO: 1055247 - DNA, 22 bp, Artificial Sequence
  chemically synthesized
agaggctgaggcatgagaattg

SEQ ID NO: 1055248 - DNA, 22 bp, Artificial Sequence
  chemically synthesized
ccagtttcaagcaattctcatg

SEQ ID NO: 1055249 - DNA, 22 bp, Artificial Sequence
  chemically synthesized
tcagaggctgaggcatgagaat

SEQ ID NO: 1055250 - DNA, 22 bp, Artificial Sequence
  chemically synthesized
ctcagaggctgaggcatgagaa

SEQ ID NO: 1055251 - DNA, 22 bp, Artificial Sequence
  chemically synthesized
caagcaattctcatgcctcagc

SEQ ID NO: 1055252 - DNA, 22 bp, Artificial Sequence
  chemically synthesized
aagcaattctcatgcctcagcc

SEQ ID NO: 1055253 - DNA, 22 bp, Artificial Sequence
  chemically synthesized
taatccaagcttctcagaggct

SEQ ID NO: 1055254 - DNA, 22 bp, Artificial Sequence
  chemically synthesized
gtaatccaagcttctcagaggc

SEQ ID NO: 1055255 - DNA, 22 bp, Artificial Sequence
  chemically synthesized
tcatgcctcagcctctgagaag

SEQ ID NO: 1055256 - DNA, 22 bp, Artificial Sequence
  chemically synthesized
cttgtaatccaagcttctcaga

SEQ ID NO: 1055257 - DNA, 22 bp, Artificial Sequence
  chemically synthesized
atgcctcagcctctgagaagct

SEQ ID NO: 1055258 - DNA, 22 bp, Artificial Sequence
  chemically synthesized
gcagttgcttgtaatccaagct

SEQ ID NO: 1055259 - DNA, 22 bp, Artificial Sequence
  chemically synthesized
agcctctgagaagcttggatta

SEQ ID NO: 1055260 - DNA, 22 bp, Artificial Sequence
  chemically synthesized
ctggcagttgcttgtaatccaa

SEQ ID NO: 1055261 - DNA, 22 bp, Artificial Sequence
  chemically synthesized
gctggcagttgcttgtaatcca

SEQ ID NO: 1055262 - DNA, 22 bp, Artificial Sequence
  chemically synthesized
tgagaagcttggattacaagca

SEQ ID NO: 1055263 - DNA, 22 bp, Artificial Sequence
  chemically synthesized
agaagcttggattacaagcaac

SEQ ID NO: 1055264 - DNA, 22 bp, Artificial Sequence
  chemically synthesized
gccaggcttgctggcagttgct

SEQ ID NO: 1055265 - DNA, 22 bp, Artificial Sequence
  chemically synthesized
ggattacaagcaactgccagca

SEQ ID NO: 1055266 - DNA, 22 bp, Artificial Sequence
  chemically synthesized
gattacaagcaactgccagcaa

SEQ ID NO: 1055267 - DNA, 22 bp, Artificial Sequence
  chemically synthesized
caagcaactgccagcaagcctg

SEQ ID NO: 1055268 - DNA, 22 bp, Artificial Sequence
  chemically synthesized
tatataaaattagccaggcttg

SEQ ID NO: 1055269 - DNA, 22 bp, Artificial Sequence
  chemically synthesized
atatataaaattagccaggctt

SEQ ID NO: 1055270 - DNA, 22 bp, Artificial Sequence
  chemically synthesized
tatatataaaattagccaggct

SEQ ID NO: 1055271 - DNA, 22 bp, Artificial Sequence
  chemically synthesized
ccagcaagcctggctaatttta

SEQ ID NO: 1055272 - DNA, 22 bp, Artificial Sequence
  chemically synthesized
tatatgttttatatataaaatt

SEQ ID NO: 1055273 - DNA, 22 bp, Artificial Sequence
  chemically synthesized
gctaattttatatataaaacat

SEQ ID NO: 1055274 - DNA, 22 bp, Artificial Sequence
  chemically synthesized
attttatatataaaacatatat

SEQ ID NO: 1055275 - DNA, 22 bp, Artificial Sequence
  chemically synthesized
tatatatgtattatatatgttt

SEQ ID NO: 1055276 - DNA, 22 bp, Artificial Sequence
  chemically synthesized
tatatataaaacatatataata

SEQ ID NO: 1055277 - DNA, 22 bp, Artificial Sequence
  chemically synthesized
atatataaaacatatataatac

SEQ ID NO: 1055278 - DNA, 22 bp, Artificial Sequence
  chemically synthesized
tatataaaacatatataataca

SEQ ID NO: 1055279 - DNA, 22 bp, Artificial Sequence
  chemically synthesized
tatatatatgttatatatatgt

SEQ ID NO: 1055280 - DNA, 22 bp, Artificial Sequence
  chemically synthesized
gtatatatatgttatatatgga

SEQ ID NO: 1055281 - DNA, 22 bp, Artificial Sequence
  chemically synthesized
tatatatatgttatatatggat

SEQ ID NO: 1055282 - DNA, 22 bp, Artificial Sequence
  chemically synthesized
tatatggatgtatatatgtata

SEQ ID NO: 1055283 - DNA, 22 bp, Artificial Sequence
  chemically synthesized
tatatacatgtatatacatata

SEQ ID NO: 1055284 - DNA, 22 bp, Artificial Sequence
  chemically synthesized
taaatacatgttatatatacat

SEQ ID NO: 1055285 - DNA, 22 bp, Artificial Sequence
  chemically synthesized
tatatataacatgtatatataa

SEQ ID NO: 1055286 - DNA, 22 bp, Artificial Sequence
  chemically synthesized
ataacatttatatatacatgtt

SEQ ID NO: 1055287 - DNA, 22 bp, Artificial Sequence
  chemically synthesized
taacatttatatatacatgtta

SEQ ID NO: 1055288 - DNA, 22 bp, Artificial Sequence
  chemically synthesized
atatatacatgttatatatata

SEQ ID NO: 1055289 - DNA, 22 bp, Artificial Sequence
  chemically synthesized
tatatacatgttatatatataa

SEQ ID NO: 1055290 - DNA, 22 bp, Artificial Sequence
  chemically synthesized
tatataacatacacatgttata

SEQ ID NO: 1055291 - DNA, 22 bp, Artificial Sequence
  chemically synthesized
atatataacatacacatgttat

SEQ ID NO: 1055292 - DNA, 22 bp, Artificial Sequence
  chemically synthesized
tatatataacatacacatgtta

SEQ ID NO: 1055293 - DNA, 22 bp, Artificial Sequence
  chemically synthesized
tatatataacatgtgtatgtta

SEQ ID NO: 1055294 - DNA, 22 bp, Artificial Sequence
  chemically synthesized
tatataacatgttttatatata

SEQ ID NO: 1055295 - DNA, 22 bp, Artificial Sequence
  chemically synthesized
tatataaaacatgttatatata

SEQ ID NO: 1055296 - DNA, 22 bp, Artificial Sequence
  chemically synthesized
tataacatatacacgttatata

SEQ ID NO: 1055297 - DNA, 22 bp, Artificial Sequence
  chemically synthesized
tatataacgtgtatatgttata

SEQ ID NO: 1055298 - DNA, 22 bp, Artificial Sequence
  chemically synthesized
tgtatataacatgttatataac

SEQ ID NO: 1055299 - DNA, 22 bp, Artificial Sequence
  chemically synthesized
tataacatgttatatacataac

SEQ ID NO: 1055300 - DNA, 22 bp, Artificial Sequence
  chemically synthesized
tatataacatacacatgttatg

SEQ ID NO: 1055301 - DNA, 22 bp, Artificial Sequence
  chemically synthesized
atatataacatacacatgttat

SEQ ID NO: 1055302 - DNA, 22 bp, Artificial Sequence
  chemically synthesized
tatatataacatacacatgtta

SEQ ID NO: 1055303 - DNA, 22 bp, Artificial Sequence
  chemically synthesized
tatacataacatgtgtatgtta

SEQ ID NO: 1055304 - DNA, 22 bp, Artificial Sequence
  chemically synthesized
taatgttttatatataacatac

SEQ ID NO: 1055305 - DNA, 22 bp, Artificial Sequence
  chemically synthesized
ataatgttttatatataacata

SEQ ID NO: 1055306 - DNA, 22 bp, Artificial Sequence
  chemically synthesized
tataatgttttatatataacat

SEQ ID NO: 1055307 - DNA, 22 bp, Artificial Sequence
  chemically synthesized
ttttataatgttttatatataa

SEQ ID NO: 1055308 - DNA, 22 bp, Artificial Sequence
  chemically synthesized
gttttataatgttttatatata

SEQ ID NO: 1055309 - DNA, 22 bp, Artificial Sequence
  chemically synthesized
tatataaaacattataaaacaa

SEQ ID NO: 1055310 - DNA, 22 bp, Artificial Sequence
  chemically synthesized
tgtatataacatgtttgtttta

SEQ ID NO: 1055311 - DNA, 22 bp, Artificial Sequence
  chemically synthesized
tgtatatgttatgtatataaca

SEQ ID NO: 1055312 - DNA, 22 bp, Artificial Sequence
  chemically synthesized
taaaacaaacatgttatataca

SEQ ID NO: 1055313 - DNA, 22 bp, Artificial Sequence
  chemically synthesized
tgtatataacatgttatgtata

SEQ ID NO: 1055314 - DNA, 22 bp, Artificial Sequence
  chemically synthesized
tatacataacatatacataaca

SEQ ID NO: 1055315 - DNA, 22 bp, Artificial Sequence
  chemically synthesized
tgtatatgttatgtatataaca

SEQ ID NO: 1055316 - DNA, 22 bp, Artificial Sequence
  chemically synthesized
tatatacatattatgtatatgt

SEQ ID NO: 1055317 - DNA, 22 bp, Artificial Sequence
  chemically synthesized
tatacataacatatacataata

SEQ ID NO: 1055318 - DNA, 22 bp, Artificial Sequence
  chemically synthesized
tatgttatatatacatattatg

SEQ ID NO: 1055319 - DNA, 22 bp, Artificial Sequence
  chemically synthesized
tgtatataacatgttatatgtt

SEQ ID NO: 1055320 - DNA, 22 bp, Artificial Sequence
  chemically synthesized
tatatacatgttatgtatataa

SEQ ID NO: 1055321 - DNA, 22 bp, Artificial Sequence
  chemically synthesized
tatacataacatgtatatataa

SEQ ID NO: 1055322 - DNA, 22 bp, Artificial Sequence
  chemically synthesized
cgtatatacatgttatatatac

SEQ ID NO: 1055323 - DNA, 22 bp, Artificial Sequence
  chemically synthesized
tacgtatatacatgttatatat

SEQ ID NO: 1055324 - DNA, 22 bp, Artificial Sequence
  chemically synthesized
tatacacatgttctacgtatat

SEQ ID NO: 1055325 - DNA, 22 bp, Artificial Sequence
  chemically synthesized
tgcctatatacacatgttctac

SEQ ID NO: 1055326 - DNA, 22 bp, Artificial Sequence
  chemically synthesized
tatatacatgttatgcctatat

SEQ ID NO: 1055327 - DNA, 22 bp, Artificial Sequence
  chemically synthesized
atatatacatgttatgcctata

SEQ ID NO: 1055328 - DNA, 22 bp, Artificial Sequence
  chemically synthesized
tatatatacatgttatgcctat

SEQ ID NO: 1055329 - DNA, 22 bp, Artificial Sequence
  chemically synthesized
tacatatataacgttttatata

SEQ ID NO: 1055330 - DNA, 22 bp, Artificial Sequence
  chemically synthesized
tatataacatgttatacatata

SEQ ID NO: 1055331 - DNA, 22 bp, Artificial Sequence
  chemically synthesized
tatatgtataacatgttatata

SEQ ID NO: 1055332 - DNA, 22 bp, Artificial Sequence
  chemically synthesized
tacatatatacacgtgttatat

SEQ ID NO: 1055333 - DNA, 22 bp, Artificial Sequence
  chemically synthesized
tatataacacgtgtatatatgt

SEQ ID NO: 1055334 - DNA, 22 bp, Artificial Sequence
  chemically synthesized
tatataacatgttatacatata

SEQ ID NO: 1055335 - DNA, 22 bp, Artificial Sequence
  chemically synthesized
tatatgcacgttatatataaca

SEQ ID NO: 1055336 - DNA, 22 bp, Artificial Sequence
  chemically synthesized
aatataacatgttatatatgca

SEQ ID NO: 1055337 - DNA, 22 bp, Artificial Sequence
  chemically synthesized
tatataacgtgcatatataaca

SEQ ID NO: 1055338 - DNA, 22 bp, Artificial Sequence
  chemically synthesized
tacacatataacgttgaatata

SEQ ID NO: 1055339 - DNA, 22 bp, Artificial Sequence
  chemically synthesized
tattcaacgttatatgtgtata

SEQ ID NO: 1055340 - DNA, 22 bp, Artificial Sequence
  chemically synthesized
tatataacatgttatacacata

SEQ ID NO: 1055341 - DNA, 22 bp, Artificial Sequence
  chemically synthesized
aacgttatatgtgtataacatg

SEQ ID NO: 1055342 - DNA, 22 bp, Artificial Sequence
  chemically synthesized
tatgtgtataacatgttatata

SEQ ID NO: 1055343 - DNA, 22 bp, Artificial Sequence
  chemically synthesized
tatgtataacatgttatatata

SEQ ID NO: 1055344 - DNA, 22 bp, Artificial Sequence
  chemically synthesized
tatataacatgttatacatata

SEQ ID NO: 1055345 - DNA, 22 bp, Artificial Sequence
  chemically synthesized
tatataacatacatatatacac

SEQ ID NO: 1055346 - DNA, 22 bp, Artificial Sequence
  chemically synthesized
tacatataacgtgtatatatgt

SEQ ID NO: 1055347 - DNA, 22 bp, Artificial Sequence
  chemically synthesized
tatataacatacacgtatacac

SEQ ID NO: 1055348 - DNA, 22 bp, Artificial Sequence
  chemically synthesized
tatataacgtgtatacgtgtat

SEQ ID NO: 1055349 - DNA, 22 bp, Artificial Sequence
  chemically synthesized
tacacatatacacgttatatat

SEQ ID NO: 1055350 - DNA, 22 bp, Artificial Sequence
  chemically synthesized
tatataacgtgtatatgtgtat

SEQ ID NO: 1055351 - DNA, 22 bp, Artificial Sequence
  chemically synthesized
tatataacatgttatacacata

SEQ ID NO: 1055352 - DNA, 22 bp, Artificial Sequence
  chemically synthesized
tatatacacgttatatataaca

SEQ ID NO: 1055353 - DNA, 22 bp, Artificial Sequence
  chemically synthesized
tatataacgttatatatacacg

SEQ ID NO: 1055354 - DNA, 22 bp, Artificial Sequence
  chemically synthesized
tatataacgtgtatatataacg

SEQ ID NO: 1055355 - DNA, 22 bp, Artificial Sequence
  chemically synthesized
tatatacacgttatatataacg

SEQ ID NO: 1055356 - DNA, 22 bp, Artificial Sequence
  chemically synthesized
tatataacgttatatatacacg

SEQ ID NO: 1055357 - DNA, 22 bp, Artificial Sequence
  chemically synthesized
tatataacgtgtatatataacg

SEQ ID NO: 1055358 - DNA, 22 bp, Artificial Sequence
  chemically synthesized
tatatacacgttatatataacg

SEQ ID NO: 1055359 - DNA, 22 bp, Artificial Sequence
  chemically synthesized
tatataacgttatatatacacg

SEQ ID NO: 1055360 - DNA, 22 bp, Artificial Sequence
  chemically synthesized
tatataacgtgtatatataacg

SEQ ID NO: 1055361 - DNA, 22 bp, Artificial Sequence
  chemically synthesized
tacacacgttatatataacgtt

SEQ ID NO: 1055362 - DNA, 22 bp, Artificial Sequence
  chemically synthesized
tatataacatgttatacacacg

SEQ ID NO: 1055363 - DNA, 22 bp, Artificial Sequence
  chemically synthesized
tatataacgtgtgtataacatg

SEQ ID NO: 1055364 - DNA, 22 bp, Artificial Sequence
  chemically synthesized
tatataacgtgtgtatacgtac

SEQ ID NO: 1055365 - DNA, 22 bp, Artificial Sequence
  chemically synthesized
catataacatatataacatgta

SEQ ID NO: 1055366 - DNA, 22 bp, Artificial Sequence
  chemically synthesized
tacacgtatgcacatgttacat

SEQ ID NO: 1055367 - DNA, 22 bp, Artificial Sequence
  chemically synthesized
tatatgttatatgtaacatgtg

SEQ ID NO: 1055368 - DNA, 22 bp, Artificial Sequence
  chemically synthesized
tatgtaacatgtgcatacgtgt

SEQ ID NO: 1055369 - DNA, 22 bp, Artificial Sequence
  chemically synthesized
tacacacacagataacatgtta

SEQ ID NO: 1055370 - DNA, 22 bp, Artificial Sequence
  chemically synthesized
tacatatatacacatgttatac

SEQ ID NO: 1055371 - DNA, 22 bp, Artificial Sequence
  chemically synthesized
tctgtgtgtgtataacatgtgt

SEQ ID NO: 1055372 - DNA, 22 bp, Artificial Sequence
  chemically synthesized
tgtgtgtataacatgtgtatat

SEQ ID NO: 1055373 - DNA, 22 bp, Artificial Sequence
  chemically synthesized
acatatataacatgtcatgtat

SEQ ID NO: 1055374 - DNA, 22 bp, Artificial Sequence
  chemically synthesized
gctaacatatataacatgtcat

SEQ ID NO: 1055375 - DNA, 22 bp, Artificial Sequence
  chemically synthesized
cagatcagcctggctaacatat

SEQ ID NO: 1055376 - DNA, 22 bp, Artificial Sequence
  chemically synthesized
tatatgttagccaggctgatct

SEQ ID NO: 1055377 - DNA, 22 bp, Artificial Sequence
  chemically synthesized
aggaggagttccagatcagcct

SEQ ID NO: 1055378 - DNA, 22 bp, Artificial Sequence
  chemically synthesized
gaggaggagttccagatcagcc

SEQ ID NO: 1055379 - DNA, 22 bp, Artificial Sequence
  chemically synthesized
gccaggctgatctggaactcct

SEQ ID NO: 1055380 - DNA, 22 bp, Artificial Sequence
  chemically synthesized
atctggaactcctcctcaagtg

SEQ ID NO: 1055381 - DNA, 22 bp, Artificial Sequence
  chemically synthesized
gaactcctcctcaagtgatccg

SEQ ID NO: 1055382 - DNA, 22 bp, Artificial Sequence
  chemically synthesized
tgaggccgaggtgggcggatca

SEQ ID NO: 1055383 - DNA, 22 bp, Artificial Sequence
  chemically synthesized
gtgaggccgaggtgggcggatc

SEQ ID NO: 1055384 - DNA, 22 bp, Artificial Sequence
  chemically synthesized
tgtgaggccgaggtgggcggat

SEQ ID NO: 1055385 - DNA, 22 bp, Artificial Sequence
  chemically synthesized
ctcctcaagtgatccgcccacc

SEQ ID NO: 1055386 - DNA, 22 bp, Artificial Sequence
  chemically synthesized
tttgtgaggccgaggtgggcgg

SEQ ID NO: 1055387 - DNA, 22 bp, Artificial Sequence
  chemically synthesized
ctcaagtgatccgcccacctcg

SEQ ID NO: 1055388 - DNA, 22 bp, Artificial Sequence
  chemically synthesized
aagtgatccgcccacctcggcc

SEQ ID NO: 1055389 - DNA, 22 bp, Artificial Sequence
  chemically synthesized
taatcccagctctttgtgaggc

SEQ ID NO: 1055390 - DNA, 22 bp, Artificial Sequence
  chemically synthesized
acaactgtaatcccagctcttt

SEQ ID NO: 1055391 - DNA, 22 bp, Artificial Sequence
  chemically synthesized
ggcctcacaaagagctgggatt

SEQ ID NO: 1055392 - DNA, 22 bp, Artificial Sequence
  chemically synthesized
acaaagagctgggattacagtt

SEQ ID NO: 1055393 - DNA, 22 bp, Artificial Sequence
  chemically synthesized
ggcgtggtggctcacaactgta

SEQ ID NO: 1055394 - DNA, 22 bp, Artificial Sequence
  chemically synthesized
gctgggcgtggtggctcacaac

SEQ ID NO: 1055395 - DNA, 22 bp, Artificial Sequence
  chemically synthesized
ggctgggcgtggtggctcacaa

SEQ ID NO: 1055396 - DNA, 22 bp, Artificial Sequence
  chemically synthesized
ggattacagttgtgagccacca

SEQ ID NO: 1055397 - DNA, 22 bp, Artificial Sequence
  chemically synthesized
cagttgtgagccaccacgccca

SEQ ID NO: 1055398 - DNA, 22 bp, Artificial Sequence
  chemically synthesized
aaatagtccttggctgggcgtg

SEQ ID NO: 1055399 - DNA, 22 bp, Artificial Sequence
  chemically synthesized
aaaatagtccttggctgggcgt

SEQ ID NO: 1055400 - DNA, 22 bp, Artificial Sequence
  chemically synthesized
tgagccaccacgcccagccaag

SEQ ID NO: 1055401 - DNA, 22 bp, Artificial Sequence
  chemically synthesized
tttaaaatagtccttggctggg

SEQ ID NO: 1055402 - DNA, 22 bp, Artificial Sequence
  chemically synthesized
caataaatgtgttatttaaaat

SEQ ID NO: 1055403 - DNA, 22 bp, Artificial Sequence
  chemically synthesized
aatgctgcaataaatgtgttat

SEQ ID NO: 1055404 - DNA, 22 bp, Artificial Sequence
  chemically synthesized
ttttaaataacacatttattgc

SEQ ID NO: 1055405 - DNA, 22 bp, Artificial Sequence
  chemically synthesized
tagattaaatgctgcaataaat

SEQ ID NO: 1055406 - DNA, 22 bp, Artificial Sequence
  chemically synthesized
gtagattaaatgctgcaataaa

SEQ ID NO: 1055407 - DNA, 22 bp, Artificial Sequence
  chemically synthesized
taaataacacatttattgcagc

SEQ ID NO: 1055408 - DNA, 22 bp, Artificial Sequence
  chemically synthesized
aaataacacatttattgcagca

SEQ ID NO: 1055409 - DNA, 22 bp, Artificial Sequence
  chemically synthesized
aataacacatttattgcagcat

SEQ ID NO: 1055410 - DNA, 22 bp, Artificial Sequence
  chemically synthesized
tttgtagattaaatgctgcaat

SEQ ID NO: 1055411 - DNA, 22 bp, Artificial Sequence
  chemically synthesized
gtttgtagattaaatgctgcaa

SEQ ID NO: 1055412 - DNA, 22 bp, Artificial Sequence
  chemically synthesized
accttgtttgtagattaaatgc

SEQ ID NO: 1055413 - DNA, 22 bp, Artificial Sequence
  chemically synthesized
attgcagcatttaatctacaaa

SEQ ID NO: 1055414 - DNA, 22 bp, Artificial Sequence
  chemically synthesized
ttgcagcatttaatctacaaac

SEQ ID NO: 1055415 - DNA, 22 bp, Artificial Sequence
  chemically synthesized
cagcatttaatctacaaacaag

SEQ ID NO: 1055416 - DNA, 22 bp, Artificial Sequence
  chemically synthesized
atagaaaattaaccttgtttgt

SEQ ID NO: 1055417 - DNA, 22 bp, Artificial Sequence
  chemically synthesized
aatctacaaacaaggttaattt

SEQ ID NO: 1055418 - DNA, 22 bp, Artificial Sequence
  chemically synthesized
atctacaaacaaggttaatttt

SEQ ID NO: 1055419 - DNA, 22 bp, Artificial Sequence
  chemically synthesized
gaaggctgatagaaaattaacc

SEQ ID NO: 1055420 - DNA, 22 bp, Artificial Sequence
  chemically synthesized
ggaaggctgatagaaaattaac

SEQ ID NO: 1055421 - DNA, 22 bp, Artificial Sequence
  chemically synthesized
ttggaaggctgatagaaaatta

SEQ ID NO: 1055422 - DNA, 22 bp, Artificial Sequence
  chemically synthesized
caaacaaggttaattttctatc

SEQ ID NO: 1055423 - DNA, 22 bp, Artificial Sequence
  chemically synthesized
attttctatcagccttccaaga

SEQ ID NO: 1055424 - DNA, 22 bp, Artificial Sequence
  chemically synthesized
caaaatatacatgctcttggaa

SEQ ID NO: 1055425 - DNA, 22 bp, Artificial Sequence
  chemically synthesized
ccaaaatatacatgctcttgga

SEQ ID NO: 1055426 - DNA, 22 bp, Artificial Sequence
  chemically synthesized
tctatcagccttccaagagcat

SEQ ID NO: 1055427 - DNA, 22 bp, Artificial Sequence
  chemically synthesized
ctatcagccttccaagagcatg

SEQ ID NO: 1055428 - DNA, 22 bp, Artificial Sequence
  chemically synthesized
tatcagccttccaagagcatgt

SEQ ID NO: 1055429 - DNA, 22 bp, Artificial Sequence
  chemically synthesized
tcagccttccaagagcatgtat

SEQ ID NO: 1055430 - DNA, 22 bp, Artificial Sequence
  chemically synthesized
aagtacacatttccaaaatata

SEQ ID NO: 1055431 - DNA, 22 bp, Artificial Sequence
  chemically synthesized
ccaagagcatgtatattttgga

SEQ ID NO: 1055432 - DNA, 22 bp, Artificial Sequence
  chemically synthesized
caagagcatgtatattttggaa

SEQ ID NO: 1055433 - DNA, 22 bp, Artificial Sequence
  chemically synthesized
acaaaattaaagtacacatttc

SEQ ID NO: 1055434 - DNA, 22 bp, Artificial Sequence
  chemically synthesized
gacaaaattaaagtacacattt

SEQ ID NO: 1055435 - DNA, 22 bp, Artificial Sequence
  chemically synthesized
tgacaaaattaaagtacacatt

SEQ ID NO: 1055436 - DNA, 22 bp, Artificial Sequence
  chemically synthesized
tggaaatgtgtactttaatttt

SEQ ID NO: 1055437 - DNA, 22 bp, Artificial Sequence
  chemically synthesized
ggaaatgtgtactttaattttg

SEQ ID NO: 1055438 - DNA, 22 bp, Artificial Sequence
  chemically synthesized
gaaatgtgtactttaattttgt

SEQ ID NO: 1055439 - DNA, 22 bp, Artificial Sequence
  chemically synthesized
taatgggatattttgacaaaat

SEQ ID NO: 1055440 - DNA, 22 bp, Artificial Sequence
  chemically synthesized
taattttgtcaaaatatcccat

SEQ ID NO: 1055441 - DNA, 22 bp, Artificial Sequence
  chemically synthesized
aattttgtcaaaatatcccatt

SEQ ID NO: 1055442 - DNA, 22 bp, Artificial Sequence
  chemically synthesized
attttgtcaaaatatcccatta

SEQ ID NO: 1055443 - DNA, 22 bp, Artificial Sequence
  chemically synthesized
cagcagagtaattgtaatggga

SEQ ID NO: 1055444 - DNA, 22 bp, Artificial Sequence
  chemically synthesized
tgtcaaaatatcccattacaat

SEQ ID NO: 1055445 - DNA, 22 bp, Artificial Sequence
  chemically synthesized
gtcaaaatatcccattacaatt

SEQ ID NO: 1055446 - DNA, 22 bp, Artificial Sequence
  chemically synthesized
tcaaaatatcccattacaatta

SEQ ID NO: 1055447 - DNA, 22 bp, Artificial Sequence
  chemically synthesized
tcctacagcagagtaattgtaa

SEQ ID NO: 1055448 - DNA, 22 bp, Artificial Sequence
  chemically synthesized
gtcctacagcagagtaattgta

SEQ ID NO: 1055449 - DNA, 22 bp, Artificial Sequence
  chemically synthesized
caatggatagcttgtcctacag

SEQ ID NO: 1055450 - DNA, 22 bp, Artificial Sequence
  chemically synthesized
caattactctgctgtaggacaa

SEQ ID NO: 1055451 - DNA, 22 bp, Artificial Sequence
  chemically synthesized
tattgcaatggatagcttgtcc

SEQ ID NO: 1055452 - DNA, 22 bp, Artificial Sequence
  chemically synthesized
ctctgctgtaggacaagctatc

SEQ ID NO: 1055453 - DNA, 22 bp, Artificial Sequence
  chemically synthesized
tgctgtaggacaagctatccat

SEQ ID NO: 1055454 - DNA, 22 bp, Artificial Sequence
  chemically synthesized
ctgtaggacaagctatccattg

SEQ ID NO: 1055455 - DNA, 22 bp, Artificial Sequence
  chemically synthesized
caatattgtattgcaatggata

SEQ ID NO: 1055456 - DNA, 22 bp, Artificial Sequence
  chemically synthesized
taggacaagctatccattgcaa

SEQ ID NO: 1055457 - DNA, 22 bp, Artificial Sequence
  chemically synthesized
tccattgcaatacaatattgta

SEQ ID NO: 1055458 - DNA, 22 bp, Artificial Sequence
  chemically synthesized
caatacaatattgtaaccctct

SEQ ID NO: 1055459 - DNA, 22 bp, Artificial Sequence
  chemically synthesized
taaccctcttcatattcatctt

SEQ ID NO: 1055460 - DNA, 22 bp, Artificial Sequence
  chemically synthesized
ttcatattcatcttttaccacc

SEQ ID NO: 1055461 - DNA, 22 bp, Artificial Sequence
  chemically synthesized
catattcatcttttaccacctc

SEQ ID NO: 1055462 - DNA, 22 bp, Artificial Sequence
  chemically synthesized
gaacataaaagtgaggtggtaa

SEQ ID NO: 1055463 - DNA, 22 bp, Artificial Sequence
  chemically synthesized
atattcatcttttaccacctca

SEQ ID NO: 1055464 - DNA, 22 bp, Artificial Sequence
  chemically synthesized
tggaacataaaagtgaggtggt

SEQ ID NO: 1055465 - DNA, 22 bp, Artificial Sequence
  chemically synthesized
ctggaacataaaagtgaggtgg

SEQ ID NO: 1055466 - DNA, 22 bp, Artificial Sequence
  chemically synthesized
atcttttaccacctcactttta

SEQ ID NO: 1055467 - DNA, 22 bp, Artificial Sequence
  chemically synthesized
ttaccacctcacttttatgttc

SEQ ID NO: 1055468 - DNA, 22 bp, Artificial Sequence
  chemically synthesized
taccacctcacttttatgttcc

SEQ ID NO: 1055469 - DNA, 22 bp, Artificial Sequence
  chemically synthesized
accacctcacttttatgttcca

SEQ ID NO: 1055470 - DNA, 22 bp, Artificial Sequence
  chemically synthesized
ccacctcacttttatgttccag

SEQ ID NO: 1055471 - DNA, 22 bp, Artificial Sequence
  chemically synthesized
aggaaagacacagcttctggaa

SEQ ID NO: 1055472 - DNA, 22 bp, Artificial Sequence
  chemically synthesized
acttttatgttccagaagctgt

SEQ ID NO: 1055473 - DNA, 22 bp, Artificial Sequence
  chemically synthesized
ttatgttccagaagctgtgtct

SEQ ID NO: 1055474 - DNA, 22 bp, Artificial Sequence
  chemically synthesized
tatgttccagaagctgtgtctt

SEQ ID NO: 1055475 - DNA, 22 bp, Artificial Sequence
  chemically synthesized
atgttccagaagctgtgtcttt

SEQ ID NO: 1055476 - DNA, 22 bp, Artificial Sequence
  chemically synthesized
tgttccagaagctgtgtctttc

SEQ ID NO: 1055477 - DNA, 22 bp, Artificial Sequence
  chemically synthesized
cagaagctgtgtctttccttag

SEQ ID NO: 1055478 - DNA, 22 bp, Artificial Sequence
  chemically synthesized
gaagtaggcatactaaggaaag

SEQ ID NO: 1055479 - DNA, 22 bp, Artificial Sequence
  chemically synthesized
tagaagtaggcatactaaggaa

SEQ ID NO: 1055480 - DNA, 22 bp, Artificial Sequence
  chemically synthesized
ctagaagtaggcatactaagga

SEQ ID NO: 1055481 - DNA, 22 bp, Artificial Sequence
  chemically synthesized
cttctagaagtaggcatactaa

SEQ ID NO: 1055482 - DNA, 22 bp, Artificial Sequence
  chemically synthesized
tgtctttccttagtatgcctac

SEQ ID NO: 1055483 - DNA, 22 bp, Artificial Sequence
  chemically synthesized
cggttacttctagaagtaggca

SEQ ID NO: 1055484 - DNA, 22 bp, Artificial Sequence
  chemically synthesized
acggttacttctagaagtaggc

SEQ ID NO: 1055485 - DNA, 22 bp, Artificial Sequence
  chemically synthesized
tccttagtatgcctacttctag

SEQ ID NO: 1055486 - DNA, 22 bp, Artificial Sequence
  chemically synthesized
ttacggttacttctagaagtag

SEQ ID NO: 1055487 - DNA, 22 bp, Artificial Sequence
  chemically synthesized
ccttagtatgcctacttctaga

SEQ ID NO: 1055488 - DNA, 22 bp, Artificial Sequence
  chemically synthesized
cttagtatgcctacttctagaa

SEQ ID NO: 1055489 - DNA, 22 bp, Artificial Sequence
  chemically synthesized
tcttacggttacttctagaagt

SEQ ID NO: 1055490 - DNA, 22 bp, Artificial Sequence
  chemically synthesized
ctcttacggttacttctagaag

SEQ ID NO: 1055491 - DNA, 22 bp, Artificial Sequence
  chemically synthesized
agtatgcctacttctagaagta

SEQ ID NO: 1055492 - DNA, 22 bp, Artificial Sequence
  chemically synthesized
gtatgcctacttctagaagtaa

SEQ ID NO: 1055493 - DNA, 22 bp, Artificial Sequence
  chemically synthesized
cttctagaagtaaccgtaagag

SEQ ID NO: 1055494 - DNA, 22 bp, Artificial Sequence
  chemically synthesized
agaacatcagtttctcttacgg

SEQ ID NO: 1055495 - DNA, 22 bp, Artificial Sequence
  chemically synthesized
ctagaagtaaccgtaagagaaa

SEQ ID NO: 1055496 - DNA, 22 bp, Artificial Sequence
  chemically synthesized
tagaagtaaccgtaagagaaac

SEQ ID NO: 1055497 - DNA, 22 bp, Artificial Sequence
  chemically synthesized
gttcagaacatcagtttctctt

SEQ ID NO: 1055498 - DNA, 22 bp, Artificial Sequence
  chemically synthesized
gaagtaaccgtaagagaaactg

SEQ ID NO: 1055499 - DNA, 22 bp, Artificial Sequence
  chemically synthesized
ctcgttcagaacatcagtttct

SEQ ID NO: 1055500 - DNA, 22 bp, Artificial Sequence
  chemically synthesized
agactgctcgttcagaacatca

SEQ ID NO: 1055501 - DNA, 22 bp, Artificial Sequence
  chemically synthesized
aagactgctcgttcagaacatc

SEQ ID NO: 1055502 - DNA, 22 bp, Artificial Sequence
  chemically synthesized
ggagtttaagactgctcgttca

SEQ ID NO: 1055503 - DNA, 22 bp, Artificial Sequence
  chemically synthesized
atgttctgaacgagcagtctta

SEQ ID NO: 1055504 - DNA, 22 bp, Artificial Sequence
  chemically synthesized
tgaacgagcagtcttaaactcc

SEQ ID NO: 1055505 - DNA, 22 bp, Artificial Sequence
  chemically synthesized
tgtatgcaaattcggagtttaa

SEQ ID NO: 1055506 - DNA, 22 bp, Artificial Sequence
  chemically synthesized
aacgagcagtcttaaactccga

SEQ ID NO: 1055507 - DNA, 22 bp, Artificial Sequence
  chemically synthesized
atgtatgcaaattcggagttta

SEQ ID NO: 1055508 - DNA, 22 bp, Artificial Sequence
  chemically synthesized
tacttatgtatgcaaattcgga

SEQ ID NO: 1055509 - DNA, 22 bp, Artificial Sequence
  chemically synthesized
cctatacttatgtatgcaaatt

SEQ ID NO: 1055510 - DNA, 22 bp, Artificial Sequence
  chemically synthesized
aaactccgaatttgcatacata

SEQ ID NO: 1055511 - DNA, 22 bp, Artificial Sequence
  chemically synthesized
aactccgaatttgcatacataa

SEQ ID NO: 1055512 - DNA, 22 bp, Artificial Sequence
  chemically synthesized
tattccctatacttatgtatgc

SEQ ID NO: 1055513 - DNA, 22 bp, Artificial Sequence
  chemically synthesized
atattccctatacttatgtatg

SEQ ID NO: 1055514 - DNA, 22 bp, Artificial Sequence
  chemically synthesized
tatattccctatacttatgtat

SEQ ID NO: 1055515 - DNA, 22 bp, Artificial Sequence
  chemically synthesized
cgaatttgcatacataagtata

SEQ ID NO: 1055516 - DNA, 22 bp, Artificial Sequence
  chemically synthesized
taaatgttttatattccctata

SEQ ID NO: 1055517 - DNA, 22 bp, Artificial Sequence
  chemically synthesized
gcatacataagtatagggaata

SEQ ID NO: 1055518 - DNA, 22 bp, Artificial Sequence
  chemically synthesized
catacataagtatagggaatat

SEQ ID NO: 1055519 - DNA, 22 bp, Artificial Sequence
  chemically synthesized
ttataaatgttttatattccct

SEQ ID NO: 1055520 - DNA, 22 bp, Artificial Sequence
  chemically synthesized
tgttataaatgttttatattcc

SEQ ID NO: 1055521 - DNA, 22 bp, Artificial Sequence
  chemically synthesized
ctgttataaatgttttatattc

SEQ ID NO: 1055522 - DNA, 22 bp, Artificial Sequence
  chemically synthesized
tgtaatgtagtagtttctgtta

SEQ ID NO: 1055523 - DNA, 22 bp, Artificial Sequence
  chemically synthesized
gttatgtaatgtagtagtttct

SEQ ID NO: 1055524 - DNA, 22 bp, Artificial Sequence
  chemically synthesized
ataacagaaactactacattac

SEQ ID NO: 1055525 - DNA, 22 bp, Artificial Sequence
  chemically synthesized
taacagaaactactacattaca

SEQ ID NO: 1055526 - DNA, 22 bp, Artificial Sequence
  chemically synthesized
atgtataatctggttatgtaat

SEQ ID NO: 1055527 - DNA, 22 bp, Artificial Sequence
  chemically synthesized
gatgtataatctggttatgtaa

SEQ ID NO: 1055528 - DNA, 22 bp, Artificial Sequence
  chemically synthesized
tgatgtataatctggttatgta

SEQ ID NO: 1055529 - DNA, 22 bp, Artificial Sequence
  chemically synthesized
ctacattacataaccagattat

SEQ ID NO: 1055530 - DNA, 22 bp, Artificial Sequence
  chemically synthesized
cattacataaccagattataca

SEQ ID NO: 1055531 - DNA, 22 bp, Artificial Sequence
  chemically synthesized
gtagaactttgatgtataatct

SEQ ID NO: 1055532 - DNA, 22 bp, Artificial Sequence
  chemically synthesized
agtagaactttgatgtataatc

SEQ ID NO: 1055533 - DNA, 22 bp, Artificial Sequence
  chemically synthesized
cataaccagattatacatcaaa

SEQ ID NO: 1055534 - DNA, 22 bp, Artificial Sequence
  chemically synthesized
ggaacaatgaatatttagtaga

SEQ ID NO: 1055535 - DNA, 22 bp, Artificial Sequence
  chemically synthesized
tacatcaaagttctactaaata

SEQ ID NO: 1055536 - DNA, 22 bp, Artificial Sequence
  chemically synthesized
aggaacaatgaatatttagtag

SEQ ID NO: 1055537 - DNA, 22 bp, Artificial Sequence
  chemically synthesized
atttaggaacaatgaatattta

SEQ ID NO: 1055538 - DNA, 22 bp, Artificial Sequence
  chemically synthesized
catttaggaacaatgaatattt

SEQ ID NO: 1055539 - DNA, 22 bp, Artificial Sequence
  chemically synthesized
tcatttaggaacaatgaatatt

SEQ ID NO: 1055540 - DNA, 22 bp, Artificial Sequence
  chemically synthesized
tactaaatattcattgttccta

SEQ ID NO: 1055541 - DNA, 22 bp, Artificial Sequence
  chemically synthesized
ctaaatattcattgttcctaaa

SEQ ID NO: 1055542 - DNA, 22 bp, Artificial Sequence
  chemically synthesized
gatatcctttcatttaggaaca

SEQ ID NO: 1055543 - DNA, 22 bp, Artificial Sequence
  chemically synthesized
agatatcctttcatttaggaac

SEQ ID NO: 1055544 - DNA, 22 bp, Artificial Sequence
  chemically synthesized
aatattcattgttcctaaatga

SEQ ID NO: 1055545 - DNA, 22 bp, Artificial Sequence
  chemically synthesized
tttagatatcctttcatttagg

SEQ ID NO: 1055546 - DNA, 22 bp, Artificial Sequence
  chemically synthesized
atttagatatcctttcatttag

SEQ ID NO: 1055547 - DNA, 22 bp, Artificial Sequence
  chemically synthesized
attgttcctaaatgaaaggata

SEQ ID NO: 1055548 - DNA, 22 bp, Artificial Sequence
  chemically synthesized
taacttatttagatatcctttc

SEQ ID NO: 1055549 - DNA, 22 bp, Artificial Sequence
  chemically synthesized
ttcctaaatgaaaggatatcta

SEQ ID NO: 1055550 - DNA, 22 bp, Artificial Sequence
  chemically synthesized
ctaaatgaaaggatatctaaat

SEQ ID NO: 1055551 - DNA, 22 bp, Artificial Sequence
  chemically synthesized
aatgaaaggatatctaaataag

SEQ ID NO: 1055552 - DNA, 22 bp, Artificial Sequence
  chemically synthesized
cataggtgctataacttattta

SEQ ID NO: 1055553 - DNA, 22 bp, Artificial Sequence
  chemically synthesized
gcataggtgctataacttattt

SEQ ID NO: 1055554 - DNA, 22 bp, Artificial Sequence
  chemically synthesized
tgcataggtgctataacttatt

SEQ ID NO: 1055555 - DNA, 22 bp, Artificial Sequence
  chemically synthesized
gaattttgcataggtgctataa

SEQ ID NO: 1055556 - DNA, 22 bp, Artificial Sequence
  chemically synthesized
acctagaattttgcataggtgc

SEQ ID NO: 1055557 - DNA, 22 bp, Artificial Sequence
  chemically synthesized
aataagttatagcacctatgca

SEQ ID NO: 1055558 - DNA, 22 bp, Artificial Sequence
  chemically synthesized
cacctagaattttgcataggtg

SEQ ID NO: 1055559 - DNA, 22 bp, Artificial Sequence
  chemically synthesized
tcacctagaattttgcataggt

SEQ ID NO: 1055560 - DNA, 22 bp, Artificial Sequence
  chemically synthesized
ttcacctagaattttgcatagg

SEQ ID NO: 1055561 - DNA, 22 bp, Artificial Sequence
  chemically synthesized
tagcacctatgcaaaattctag

SEQ ID NO: 1055562 - DNA, 22 bp, Artificial Sequence
  chemically synthesized
atggaatatttttcacctagaa

SEQ ID NO: 1055563 - DNA, 22 bp, Artificial Sequence
  chemically synthesized
taatggaatatttttcacctag

SEQ ID NO: 1055564 - DNA, 22 bp, Artificial Sequence
  chemically synthesized
ctaatggaatatttttcaccta

SEQ ID NO: 1055565 - DNA, 22 bp, Artificial Sequence
  chemically synthesized
tctaatggaatatttttcacct

SEQ ID NO: 1055566 - DNA, 22 bp, Artificial Sequence
  chemically synthesized
tgcaaaattctaggtgaaaaat

SEQ ID NO: 1055567 - DNA, 22 bp, Artificial Sequence
  chemically synthesized
ttctaatggaatatttttcacc

SEQ ID NO: 1055568 - DNA, 22 bp, Artificial Sequence
  chemically synthesized
aacatatttttctaatggaata

SEQ ID NO: 1055569 - DNA, 22 bp, Artificial Sequence
  chemically synthesized
taggtgaaaaatattccattag

SEQ ID NO: 1055570 - DNA, 22 bp, Artificial Sequence
  chemically synthesized
gaacatatttttctaatggaat

SEQ ID NO: 1055571 - DNA, 22 bp, Artificial Sequence
  chemically synthesized
tgaacatatttttctaatggaa

SEQ ID NO: 1055572 - DNA, 22 bp, Artificial Sequence
  chemically synthesized
ggtgaaaaatattccattagaa

SEQ ID NO: 1055573 - DNA, 22 bp, Artificial Sequence
  chemically synthesized
catatcagtatctttgaacata

SEQ ID NO: 1055574 - DNA, 22 bp, Artificial Sequence
  chemically synthesized
cattagaaaaatatgttcaaag

SEQ ID NO: 1055575 - DNA, 22 bp, Artificial Sequence
  chemically synthesized
ccatatcagtatctttgaacat

SEQ ID NO: 1055576 - DNA, 22 bp, Artificial Sequence
  chemically synthesized
atttccatatcagtatctttga

SEQ ID NO: 1055577 - DNA, 22 bp, Artificial Sequence
  chemically synthesized
gaaaaatatgttcaaagatact

SEQ ID NO: 1055578 - DNA, 22 bp, Artificial Sequence
  chemically synthesized
catttccatatcagtatctttg

SEQ ID NO: 1055579 - DNA, 22 bp, Artificial Sequence
  chemically synthesized
aaagatactgatatggaaatga

SEQ ID NO: 1055580 - DNA, 22 bp, Artificial Sequence
  chemically synthesized
aacacaaccaatttcatttcca

SEQ ID NO: 1055581 - DNA, 22 bp, Artificial Sequence
  chemically synthesized
aaacacaaccaatttcatttcc

SEQ ID NO: 1055582 - DNA, 22 bp, Artificial Sequence
  chemically synthesized
tacttaaacacaaccaatttca

SEQ ID NO: 1055583 - DNA, 22 bp, Artificial Sequence
  chemically synthesized
tatacttaaacacaaccaattt

SEQ ID NO: 1055584 - DNA, 22 bp, Artificial Sequence
  chemically synthesized
atatggaaatgaaattggttgt

SEQ ID NO: 1055585 - DNA, 22 bp, Artificial Sequence
  chemically synthesized
ctatacttaaacacaaccaatt

SEQ ID NO: 1055586 - DNA, 22 bp, Artificial Sequence
  chemically synthesized
tctatacttaaacacaaccaat

SEQ ID NO: 1055587 - DNA, 22 bp, Artificial Sequence
  chemically synthesized
ttctatacttaaacacaaccaa

SEQ ID NO: 1055588 - DNA, 22 bp, Artificial Sequence
  chemically synthesized
ttttctatacttaaacacaacc

SEQ ID NO: 1055589 - DNA, 22 bp, Artificial Sequence
  chemically synthesized
cttttctatacttaaacacaac

SEQ ID NO: 1055590 - DNA, 22 bp, Artificial Sequence
  chemically synthesized
aaggtttcttttctatacttaa

SEQ ID NO: 1055591 - DNA, 22 bp, Artificial Sequence
  chemically synthesized
gttgtgtttaagtatagaaaag

SEQ ID NO: 1055592 - DNA, 22 bp, Artificial Sequence
  chemically synthesized
tgtttaagtatagaaaagaaac

SEQ ID NO: 1055593 - DNA, 22 bp, Artificial Sequence
  chemically synthesized
acatagaggcctaaaggtttct

SEQ ID NO: 1055594 - DNA, 22 bp, Artificial Sequence
  chemically synthesized
aagtatagaaaagaaaccttta

SEQ ID NO: 1055595 - DNA, 22 bp, Artificial Sequence
  chemically synthesized
agtatagaaaagaaacctttag

SEQ ID NO: 1055596 - DNA, 22 bp, Artificial Sequence
  chemically synthesized
ctaacatagaggcctaaaggtt

SEQ ID NO: 1055597 - DNA, 22 bp, Artificial Sequence
  chemically synthesized
tgctaacatagaggcctaaagg

SEQ ID NO: 1055598 - DNA, 22 bp, Artificial Sequence
  chemically synthesized
ctgctaacatagaggcctaaag

SEQ ID NO: 1055599 - DNA, 22 bp, Artificial Sequence
  chemically synthesized
ttctgctaacatagaggcctaa

SEQ ID NO: 1055600 - DNA, 22 bp, Artificial Sequence
  chemically synthesized
ctcttctgctaacatagaggcc

SEQ ID NO: 1055601 - DNA, 22 bp, Artificial Sequence
  chemically synthesized
gctcttctgctaacatagaggc

SEQ ID NO: 1055602 - DNA, 22 bp, Artificial Sequence
  chemically synthesized
tgctcttctgctaacatagagg

SEQ ID NO: 1055603 - DNA, 22 bp, Artificial Sequence
  chemically synthesized
ttgctcttctgctaacatagag

SEQ ID NO: 1055604 - DNA, 22 bp, Artificial Sequence
  chemically synthesized
tttgctcttctgctaacataga

SEQ ID NO: 1055605 - DNA, 22 bp, Artificial Sequence
  chemically synthesized
cctttttgctcttctgctaaca

SEQ ID NO: 1055606 - DNA, 22 bp, Artificial Sequence
  chemically synthesized
taggcctctatgttagcagaag

SEQ ID NO: 1055607 - DNA, 22 bp, Artificial Sequence
  chemically synthesized
aggcctctatgttagcagaaga

SEQ ID NO: 1055608 - DNA, 22 bp, Artificial Sequence
  chemically synthesized
ggcctctatgttagcagaagag

SEQ ID NO: 1055609 - DNA, 22 bp, Artificial Sequence
  chemically synthesized
tctccctttttgctcttctgct

SEQ ID NO: 1055610 - DNA, 22 bp, Artificial Sequence
  chemically synthesized
gtctccctttttgctcttctgc

SEQ ID NO: 1055611 - DNA, 22 bp, Artificial Sequence
  chemically synthesized
tgtctccctttttgctcttctg

SEQ ID NO: 1055612 - DNA, 22 bp, Artificial Sequence
  chemically synthesized
tatgttagcagaagagcaaaaa

SEQ ID NO: 1055613 - DNA, 22 bp, Artificial Sequence
  chemically synthesized
tgttagcagaagagcaaaaagg

SEQ ID NO: 1055614 - DNA, 22 bp, Artificial Sequence
  chemically synthesized
acactttgtctccctttttgct

SEQ ID NO: 1055615 - DNA, 22 bp, Artificial Sequence
  chemically synthesized
ctcacactttgtctcccttttt

SEQ ID NO: 1055616 - DNA, 22 bp, Artificial Sequence
  chemically synthesized
gcagaagagcaaaaagggagac

SEQ ID NO: 1055617 - DNA, 22 bp, Artificial Sequence
  chemically synthesized
ttactcacactttgtctccctt

SEQ ID NO: 1055618 - DNA, 22 bp, Artificial Sequence
  chemically synthesized
tgttactcacactttgtctccc

SEQ ID NO: 1055619 - DNA, 22 bp, Artificial Sequence
  chemically synthesized
ctgttactcacactttgtctcc

SEQ ID NO: 1055620 - DNA, 22 bp, Artificial Sequence
  chemically synthesized
tcacttctgttactcacacttt

SEQ ID NO: 1055621 - DNA, 22 bp, Artificial Sequence
  chemically synthesized
ctatcacttctgttactcacac

SEQ ID NO: 1055622 - DNA, 22 bp, Artificial Sequence
  chemically synthesized
cctatcacttctgttactcaca

SEQ ID NO: 1055623 - DNA, 22 bp, Artificial Sequence
  chemically synthesized
tatgatgtagccccttcctatc

SEQ ID NO: 1055624 - DNA, 22 bp, Artificial Sequence
  chemically synthesized
tgatccgctatatgatgtagcc

SEQ ID NO: 1055625 - DNA, 22 bp, Artificial Sequence
  chemically synthesized
aatgaaatcctgtgatccgcta

SEQ ID NO: 1055626 - DNA, 22 bp, Artificial Sequence
  chemically synthesized
aaatgaaatcctgtgatccgct

SEQ ID NO: 1055627 - DNA, 22 bp, Artificial Sequence
  chemically synthesized
taaatgaaatcctgtgatccgc

SEQ ID NO: 1055628 - DNA, 22 bp, Artificial Sequence
  chemically synthesized
tttaaatgaaatcctgtgatcc

SEQ ID NO: 1055629 - DNA, 22 bp, Artificial Sequence
  chemically synthesized
catcatatagcggatcacagga

SEQ ID NO: 1055630 - DNA, 22 bp, Artificial Sequence
  chemically synthesized
ctctttaaatgaaatcctgtga

SEQ ID NO: 1055631 - DNA, 22 bp, Artificial Sequence
  chemically synthesized
cccattactctttaaatgaaat

SEQ ID NO: 1055632 - DNA, 22 bp, Artificial Sequence
  chemically synthesized
ctgcccattactctttaaatga

SEQ ID NO: 1055633 - DNA, 22 bp, Artificial Sequence
  chemically synthesized
catttaaagagtaatgggcagg

SEQ ID NO: 1055634 - DNA, 22 bp, Artificial Sequence
  chemically synthesized
atttaaagagtaatgggcagga

SEQ ID NO: 1055635 - DNA, 22 bp, Artificial Sequence
  chemically synthesized
aaagagtaatgggcaggagggg

SEQ ID NO: 1055636 - DNA, 22 bp, Artificial Sequence
  chemically synthesized
aagagtaatgggcaggaggggc

SEQ ID NO: 1055637 - DNA, 22 bp, Artificial Sequence
  chemically synthesized
atgagatcatatcaggcccctc

SEQ ID NO: 1055638 - DNA, 22 bp, Artificial Sequence
  chemically synthesized
aggagttaatgagatcatatca

SEQ ID NO: 1055639 - DNA, 22 bp, Artificial Sequence
  chemically synthesized
taaggagttaatgagatcatat

SEQ ID NO: 1055640 - DNA, 22 bp, Artificial Sequence
  chemically synthesized
ctaaggagttaatgagatcata

SEQ ID NO: 1055641 - DNA, 22 bp, Artificial Sequence
  chemically synthesized
cttctaaggagttaatgagatc

SEQ ID NO: 1055642 - DNA, 22 bp, Artificial Sequence
  chemically synthesized
atatgatctcattaactcctta

SEQ ID NO: 1055643 - DNA, 22 bp, Artificial Sequence
  chemically synthesized
gtgaaggcagagagctccttct

SEQ ID NO: 1055644 - DNA, 22 bp, Artificial Sequence
  chemically synthesized
attaactccttagaaggagctc

SEQ ID NO: 1055645 - DNA, 22 bp, Artificial Sequence
  chemically synthesized
ctggtgaaggcagagagctcct

SEQ ID NO: 1055646 - DNA, 22 bp, Artificial Sequence
  chemically synthesized
actccttagaaggagctctctg

SEQ ID NO: 1055647 - DNA, 22 bp, Artificial Sequence
  chemically synthesized
tcctggtgaaggcagagagctc

SEQ ID NO: 1055648 - DNA, 22 bp, Artificial Sequence
  chemically synthesized
ctcctggtgaaggcagagagct

SEQ ID NO: 1055649 - DNA, 22 bp, Artificial Sequence
  chemically synthesized
cttagaaggagctctctgcctt

SEQ ID NO: 1055650 - DNA, 22 bp, Artificial Sequence
  chemically synthesized
agaaggagctctctgccttcac

SEQ ID NO: 1055651 - DNA, 22 bp, Artificial Sequence
  chemically synthesized
gaaggagctctctgccttcacc

SEQ ID NO: 1055652 - DNA, 22 bp, Artificial Sequence
  chemically synthesized
caccatatttctcctggtgaag

SEQ ID NO: 1055653 - DNA, 22 bp, Artificial Sequence
  chemically synthesized
acaccatatttctcctggtgaa

SEQ ID NO: 1055654 - DNA, 22 bp, Artificial Sequence
  chemically synthesized
tctgccttcaccaggagaaata

SEQ ID NO: 1055655 - DNA, 22 bp, Artificial Sequence
  chemically synthesized
cccacttacaccatatttctcc

SEQ ID NO: 1055656 - DNA, 22 bp, Artificial Sequence
  chemically synthesized
tgccttcaccaggagaaatatg

SEQ ID NO: 1055657 - DNA, 22 bp, Artificial Sequence
  chemically synthesized
ccccacttacaccatatttctc

SEQ ID NO: 1055658 - DNA, 22 bp, Artificial Sequence
  chemically synthesized
tccccacttacaccatatttct

SEQ ID NO: 1055659 - DNA, 22 bp, Artificial Sequence
  chemically synthesized
ccttcaccaggagaaatatggt

SEQ ID NO: 1055660 - DNA, 22 bp, Artificial Sequence
  chemically synthesized
caccaggagaaatatggtgtaa

SEQ ID NO: 1055661 - DNA, 22 bp, Artificial Sequence
  chemically synthesized
accaggagaaatatggtgtaag

SEQ ID NO: 1055662 - DNA, 22 bp, Artificial Sequence
  chemically synthesized
cagtctttccccacttacacca

SEQ ID NO: 1055663 - DNA, 22 bp, Artificial Sequence
  chemically synthesized
ccagtctttccccacttacacc

SEQ ID NO: 1055664 - DNA, 22 bp, Artificial Sequence
  chemically synthesized
ttccagtctttccccacttaca

SEQ ID NO: 1055665 - DNA, 22 bp, Artificial Sequence
  chemically synthesized
cttccagtctttccccacttac

SEQ ID NO: 1055666 - DNA, 22 bp, Artificial Sequence
  chemically synthesized
ttcttccagtctttccccactt

SEQ ID NO: 1055667 - DNA, 22 bp, Artificial Sequence
  chemically synthesized
acctcttcttccagtctttccc

SEQ ID NO: 1055668 - DNA, 22 bp, Artificial Sequence
  chemically synthesized
taacctcttcttccagtctttc

SEQ ID NO: 1055669 - DNA, 22 bp, Artificial Sequence
  chemically synthesized
aacaacctctaacctcttcttc

SEQ ID NO: 1055670 - DNA, 22 bp, Artificial Sequence
  chemically synthesized
caacaacctctaacctcttctt

SEQ ID NO: 1055671 - DNA, 22 bp, Artificial Sequence
  chemically synthesized
cttcaacaacctctaacctctt

SEQ ID NO: 1055672 - DNA, 22 bp, Artificial Sequence
  chemically synthesized
gattacttcaacaacctctaac

SEQ ID NO: 1055673 - DNA, 22 bp, Artificial Sequence
  chemically synthesized
gaagaagaggttagaggttgtt

SEQ ID NO: 1055674 - DNA, 22 bp, Artificial Sequence
  chemically synthesized
atctggattacttcaacaacct

SEQ ID NO: 1055675 - DNA, 22 bp, Artificial Sequence
  chemically synthesized
tcatctggattacttcaacaac

SEQ ID NO: 1055676 - DNA, 22 bp, Artificial Sequence
  chemically synthesized
tctctcatctggattacttcaa

SEQ ID NO: 1055677 - DNA, 22 bp, Artificial Sequence
  chemically synthesized
ttatctctcatctggattactt

SEQ ID NO: 1055678 - DNA, 22 bp, Artificial Sequence
  chemically synthesized
gaggttgttgaagtaatccaga

SEQ ID NO: 1055679 - DNA, 22 bp, Artificial Sequence
  chemically synthesized
caagattattatctctcatctg

SEQ ID NO: 1055680 - DNA, 22 bp, Artificial Sequence
  chemically synthesized
ttgaagtaatccagatgagaga

SEQ ID NO: 1055681 - DNA, 22 bp, Artificial Sequence
  chemically synthesized
aagtaatccagatgagagataa

SEQ ID NO: 1055682 - DNA, 22 bp, Artificial Sequence
  chemically synthesized
atctacaagattattatctctc

SEQ ID NO: 1055683 - DNA, 22 bp, Artificial Sequence
  chemically synthesized
tggaagtgctaatctacaagat

SEQ ID NO: 1055684 - DNA, 22 bp, Artificial Sequence
  chemically synthesized
ttatggaagtgctaatctacaa

SEQ ID NO: 1055685 - DNA, 22 bp, Artificial Sequence
  chemically synthesized
cgtatctgttatggaagtgcta

SEQ ID NO: 1055686 - DNA, 22 bp, Artificial Sequence
  chemically synthesized
ctccgtatctgttatggaagtg

SEQ ID NO: 1055687 - DNA, 22 bp, Artificial Sequence
  chemically synthesized
gtagattagcacttccataaca

SEQ ID NO: 1055688 - DNA, 22 bp, Artificial Sequence
  chemically synthesized
tagattagcacttccataacag

SEQ ID NO: 1055689 - DNA, 22 bp, Artificial Sequence
  chemically synthesized
gcacttccataacagatacgga

SEQ ID NO: 1055690 - DNA, 22 bp, Artificial Sequence
  chemically synthesized
ccataacagatacggaggagtg

SEQ ID NO: 1055691 - DNA, 22 bp, Artificial Sequence
  chemically synthesized
cataacagatacggaggagtga

SEQ ID NO: 1055692 - DNA, 22 bp, Artificial Sequence
  chemically synthesized
caaaatgcatcaaatcactcct

SEQ ID NO: 1055693 - DNA, 22 bp, Artificial Sequence
  chemically synthesized
gatatacctgcaaaatgcatca

SEQ ID NO: 1055694 - DNA, 22 bp, Artificial Sequence
  chemically synthesized
ttggatatacctgcaaaatgca

SEQ ID NO: 1055695 - DNA, 22 bp, Artificial Sequence
  chemically synthesized
gttggatatacctgcaaaatgc

SEQ ID NO: 1055696 - DNA, 22 bp, Artificial Sequence
  chemically synthesized
ttgttggatatacctgcaaaat

SEQ ID NO: 1055697 - DNA, 22 bp, Artificial Sequence
  chemically synthesized
cactcttgttggatatacctgc

SEQ ID NO: 1055698 - DNA, 22 bp, Artificial Sequence
  chemically synthesized
ccactcttgttggatatacctg

SEQ ID NO: 1055699 - DNA, 22 bp, Artificial Sequence
  chemically synthesized
gatgcattttgcaggtatatcc

SEQ ID NO: 1055700 - DNA, 22 bp, Artificial Sequence
  chemically synthesized
atgcattttgcaggtatatcca

SEQ ID NO: 1055701 - DNA, 22 bp, Artificial Sequence
  chemically synthesized
tttccactcttgttggatatac

SEQ ID NO: 1055702 - DNA, 22 bp, Artificial Sequence
  chemically synthesized
tgcaggtatatccaacaagagt

SEQ ID NO: 1055703 - DNA, 22 bp, Artificial Sequence
  chemically synthesized
gcaggtatatccaacaagagtg

SEQ ID NO: 1055704 - DNA, 22 bp, Artificial Sequence
  chemically synthesized
caggtatatccaacaagagtgg

SEQ ID NO: 1055705 - DNA, 22 bp, Artificial Sequence
  chemically synthesized
ccatgtaaattatttccactct

SEQ ID NO: 1055706 - DNA, 22 bp, Artificial Sequence
  chemically synthesized
cattaccatgtaaattatttcc

SEQ ID NO: 1055707 - DNA, 22 bp, Artificial Sequence
  chemically synthesized
acattaccatgtaaattatttc

SEQ ID NO: 1055708 - DNA, 22 bp, Artificial Sequence
  chemically synthesized
ttacattaccatgtaaattatt

SEQ ID NO: 1055709 - DNA, 22 bp, Artificial Sequence
  chemically synthesized
tcttacattaccatgtaaatta

SEQ ID NO: 1055710 - DNA, 22 bp, Artificial Sequence
  chemically synthesized
ctcttacattaccatgtaaatt

SEQ ID NO: 1055711 - DNA, 22 bp, Artificial Sequence
  chemically synthesized
tctcttacattaccatgtaaat

SEQ ID NO: 1055712 - DNA, 22 bp, Artificial Sequence
  chemically synthesized
ttctcttacattaccatgtaaa

SEQ ID NO: 1055713 - DNA, 22 bp, Artificial Sequence
  chemically synthesized
ttttctcttacattaccatgta

SEQ ID NO: 1055714 - DNA, 22 bp, Artificial Sequence
  chemically synthesized
atgattcttttctcttacatta

SEQ ID NO: 1055715 - DNA, 22 bp, Artificial Sequence
  chemically synthesized
catgattcttttctcttacatt

SEQ ID NO: 1055716 - DNA, 22 bp, Artificial Sequence
  chemically synthesized
acatggtaatgtaagagaaaag

SEQ ID NO: 1055717 - DNA, 22 bp, Artificial Sequence
  chemically synthesized
catggtaatgtaagagaaaaga

SEQ ID NO: 1055718 - DNA, 22 bp, Artificial Sequence
  chemically synthesized
gacatccttcatgattcttttc

SEQ ID NO: 1055719 - DNA, 22 bp, Artificial Sequence
  chemically synthesized
agtcagaaacctagacatcctt

SEQ ID NO: 1055720 - DNA, 22 bp, Artificial Sequence
  chemically synthesized
aagtcagaaacctagacatcct

SEQ ID NO: 1055721 - DNA, 22 bp, Artificial Sequence
  chemically synthesized
cttaagtcagaaacctagacat

SEQ ID NO: 1055722 - DNA, 22 bp, Artificial Sequence
  chemically synthesized
acttaagtcagaaacctagaca

SEQ ID NO: 1055723 - DNA, 22 bp, Artificial Sequence
  chemically synthesized
tttacttaagtcagaaacctag

SEQ ID NO: 1055724 - DNA, 22 bp, Artificial Sequence
  chemically synthesized
ttatttacttaagtcagaaacc

SEQ ID NO: 1055725 - DNA, 22 bp, Artificial Sequence
  chemically synthesized
cactattatttacttaagtcag

SEQ ID NO: 1055726 - DNA, 22 bp, Artificial Sequence
  chemically synthesized
aattgcactattatttacttaa

SEQ ID NO: 1055727 - DNA, 22 bp, Artificial Sequence
  chemically synthesized
ggtttctgacttaagtaaataa

SEQ ID NO: 1055728 - DNA, 22 bp, Artificial Sequence
  chemically synthesized
ttaaattgcactattatttact

SEQ ID NO: 1055729 - DNA, 22 bp, Artificial Sequence
  chemically synthesized
ctgacttaagtaaataatagtg

SEQ ID NO: 1055730 - DNA, 22 bp, Artificial Sequence
  chemically synthesized
tgacttaagtaaataatagtgc

SEQ ID NO: 1055731 - DNA, 22 bp, Artificial Sequence
  chemically synthesized
acttaagtaaataatagtgcaa

SEQ ID NO: 1055732 - DNA, 22 bp, Artificial Sequence
  chemically synthesized
cagatgttattaaattgcacta

SEQ ID NO: 1055733 - DNA, 22 bp, Artificial Sequence
  chemically synthesized
aagtaaataatagtgcaattta

SEQ ID NO: 1055734 - DNA, 22 bp, Artificial Sequence
  chemically synthesized
agtaaataatagtgcaatttaa

SEQ ID NO: 1055735 - DNA, 22 bp, Artificial Sequence
  chemically synthesized
ccaacatctccagatgttatta

SEQ ID NO: 1055736 - DNA, 22 bp, Artificial Sequence
  chemically synthesized
gcatctaccaacatctccagat

SEQ ID NO: 1055737 - DNA, 22 bp, Artificial Sequence
  chemically synthesized
attggcatctaccaacatctcc

SEQ ID NO: 1055738 - DNA, 22 bp, Artificial Sequence
  chemically synthesized
aataacatctggagatgttggt

SEQ ID NO: 1055739 - DNA, 22 bp, Artificial Sequence
  chemically synthesized
ataacatctggagatgttggta

SEQ ID NO: 1055740 - DNA, 22 bp, Artificial Sequence
  chemically synthesized
cgttaattggcatctaccaaca

SEQ ID NO: 1055741 - DNA, 22 bp, Artificial Sequence
  chemically synthesized
gagatgttggtagatgccaatt

SEQ ID NO: 1055742 - DNA, 22 bp, Artificial Sequence
  chemically synthesized
gtagatgccaattaacgtagat

SEQ ID NO: 1055743 - DNA, 22 bp, Artificial Sequence
  chemically synthesized
acgtagatggggggtggatcat

SEQ ID NO: 1055744 - DNA, 22 bp, Artificial Sequence
  chemically synthesized
aaacatacaatagccaagtgaa

SEQ ID NO: 1055745 - DNA, 22 bp, Artificial Sequence
  chemically synthesized
atttttcacttggctattgtat

SEQ ID NO: 1055746 - DNA, 22 bp, Artificial Sequence
  chemically synthesized
tttttcacttggctattgtatg

SEQ ID NO: 1055747 - DNA, 22 bp, Artificial Sequence
  chemically synthesized
atgagcatctcaaacatacaat

SEQ ID NO: 1055748 - DNA, 22 bp, Artificial Sequence
  chemically synthesized
ttcacttggctattgtatgttt

SEQ ID NO: 1055749 - DNA, 22 bp, Artificial Sequence
  chemically synthesized
tcacttggctattgtatgtttg

SEQ ID NO: 1055750 - DNA, 22 bp, Artificial Sequence
  chemically synthesized
cacttggctattgtatgtttga

SEQ ID NO: 1055751 - DNA, 22 bp, Artificial Sequence
  chemically synthesized
acttggctattgtatgtttgag

SEQ ID NO: 1055752 - DNA, 22 bp, Artificial Sequence
  chemically synthesized
ggctattgtatgtttgagatgc

SEQ ID NO: 1055753 - DNA, 22 bp, Artificial Sequence
  chemically synthesized
gatgcctaatgagcatctcaaa

SEQ ID NO: 1055754 - DNA, 22 bp, Artificial Sequence
  chemically synthesized
gctattgtatgtttgagatgct

SEQ ID NO: 1055755 - DNA, 22 bp, Artificial Sequence
  chemically synthesized
ggatgcctaatgagcatctcaa

SEQ ID NO: 1055756 - DNA, 22 bp, Artificial Sequence
  chemically synthesized
ttgtatgtttgagatgctcatt

SEQ ID NO: 1055757 - DNA, 22 bp, Artificial Sequence
  chemically synthesized
tcttggatgcctaatgagcatc

SEQ ID NO: 1055758 - DNA, 22 bp, Artificial Sequence
  chemically synthesized
atcttggatgcctaatgagcat

SEQ ID NO: 1055759 - DNA, 22 bp, Artificial Sequence
  chemically synthesized
tatgtttgagatgctcattagg

SEQ ID NO: 1055760 - DNA, 22 bp, Artificial Sequence
  chemically synthesized
ttatcttggatgcctaatgagc

SEQ ID NO: 1055761 - DNA, 22 bp, Artificial Sequence
  chemically synthesized
gagatgctcattaggcatccaa

SEQ ID NO: 1055762 - DNA, 22 bp, Artificial Sequence
  chemically synthesized
agatgctcattaggcatccaag

SEQ ID NO: 1055763 - DNA, 22 bp, Artificial Sequence
  chemically synthesized
tatccaacagtctcttatcttg

SEQ ID NO: 1055764 - DNA, 22 bp, Artificial Sequence
  chemically synthesized
atatccaacagtctcttatctt

SEQ ID NO: 1055765 - DNA, 22 bp, Artificial Sequence
  chemically synthesized
attaggcatccaagataagaga

SEQ ID NO: 1055766 - DNA, 22 bp, Artificial Sequence
  chemically synthesized
tatatccaacagtctcttatct

SEQ ID NO: 1055767 - DNA, 22 bp, Artificial Sequence
  chemically synthesized
ggcatccaagataagagactgt

SEQ ID NO: 1055768 - DNA, 22 bp, Artificial Sequence
  chemically synthesized
acattttatatccaacagtctc

SEQ ID NO: 1055769 - DNA, 22 bp, Artificial Sequence
  chemically synthesized
aacattttatatccaacagtct

SEQ ID NO: 1055770 - DNA, 22 bp, Artificial Sequence
  chemically synthesized
atgtttaacattttatatccaa

SEQ ID NO: 1055771 - DNA, 22 bp, Artificial Sequence
  chemically synthesized
gatgtttaacattttatatcca

SEQ ID NO: 1055772 - DNA, 22 bp, Artificial Sequence
  chemically synthesized
ttggatataaaatgttaaacat

SEQ ID NO: 1055773 - DNA, 22 bp, Artificial Sequence
  chemically synthesized
gatataaaatgttaaacatcaa

SEQ ID NO: 1055774 - DNA, 22 bp, Artificial Sequence
  chemically synthesized
aacatcaagatcatatacttgg

SEQ ID NO: 1055775 - DNA, 22 bp, Artificial Sequence
  chemically synthesized
tgacatcaaataccaagtatat

SEQ ID NO: 1055776 - DNA, 22 bp, Artificial Sequence
  chemically synthesized
agcatgttatgacatcaaatac

SEQ ID NO: 1055777 - DNA, 22 bp, Artificial Sequence
  chemically synthesized
agctgagcatgttatgacatca

SEQ ID NO: 1055778 - DNA, 22 bp, Artificial Sequence
  chemically synthesized
gagctgagcatgttatgacatc

SEQ ID NO: 1055779 - DNA, 22 bp, Artificial Sequence
  chemically synthesized
ggtatttgatgtcataacatgc

SEQ ID NO: 1055780 - DNA, 22 bp, Artificial Sequence
  chemically synthesized
cacttgagctgagcatgttatg

SEQ ID NO: 1055781 - DNA, 22 bp, Artificial Sequence
  chemically synthesized
gtatttgatgtcataacatgct

SEQ ID NO: 1055782 - DNA, 22 bp, Artificial Sequence
  chemically synthesized
ccacttgagctgagcatgttat

SEQ ID NO: 1055783 - DNA, 22 bp, Artificial Sequence
  chemically synthesized
gatgtcataacatgctcagctc

SEQ ID NO: 1055784 - DNA, 22 bp, Artificial Sequence
  chemically synthesized
atgtcataacatgctcagctca

SEQ ID NO: 1055785 - DNA, 22 bp, Artificial Sequence
  chemically synthesized
aatacatttccacttgagctga

SEQ ID NO: 1055786 - DNA, 22 bp, Artificial Sequence
  chemically synthesized
taaatacatttccacttgagct

SEQ ID NO: 1055787 - DNA, 22 bp, Artificial Sequence
  chemically synthesized
ctaaatacatttccacttgagc

SEQ ID NO: 1055788 - DNA, 22 bp, Artificial Sequence
  chemically synthesized
tctaaatacatttccacttgag

SEQ ID NO: 1055789 - DNA, 22 bp, Artificial Sequence
  chemically synthesized
agctcaagtggaaatgtattta

SEQ ID NO: 1055790 - DNA, 22 bp, Artificial Sequence
  chemically synthesized
aagtggaaatgtatttagaaaa

SEQ ID NO: 1055791 - DNA, 22 bp, Artificial Sequence
  chemically synthesized
agtgaagaaaaagaaatgtcca

SEQ ID NO: 1055792 - DNA, 22 bp, Artificial Sequence
  chemically synthesized
cagtgaagaaaaagaaatgtcc

SEQ ID NO: 1055793 - DNA, 22 bp, Artificial Sequence
  chemically synthesized
agaaaatggacatttctttttc

SEQ ID NO: 1055794 - DNA, 22 bp, Artificial Sequence
  chemically synthesized
gaaaatggacatttctttttct

SEQ ID NO: 1055795 - DNA, 22 bp, Artificial Sequence
  chemically synthesized
ctttttcttcactgaagtgggc

SEQ ID NO: 1055796 - DNA, 22 bp, Artificial Sequence
  chemically synthesized
tttttcttcactgaagtgggct

SEQ ID NO: 1055797 - DNA, 22 bp, Artificial Sequence
  chemically synthesized
tttcttcactgaagtgggcttt

SEQ ID NO: 1055798 - DNA, 22 bp, Artificial Sequence
  chemically synthesized
ttcttcactgaagtgggctttt

SEQ ID NO: 1055799 - DNA, 22 bp, Artificial Sequence
  chemically synthesized
tcttcactgaagtgggcttttt

SEQ ID NO: 1055800 - DNA, 22 bp, Artificial Sequence
  chemically synthesized
cttcactgaagtgggctttttt

SEQ ID NO: 1055801 - DNA, 22 bp, Artificial Sequence
  chemically synthesized
ttcactgaagtgggcttttttt

SEQ ID NO: 1055802 - DNA, 22 bp, Artificial Sequence
  chemically synthesized
cactgaagtgggcttttttttg

SEQ ID NO: 1055803 - DNA, 22 bp, Artificial Sequence
  chemically synthesized
actgaagtgggcttttttttgt

SEQ ID NO: 1055804 - DNA, 22 bp, Artificial Sequence
  chemically synthesized
aagtgggcttttttttgtattt

SEQ ID NO: 1055805 - DNA, 22 bp, Artificial Sequence
  chemically synthesized
caagaacagcagcaaaaaaata

SEQ ID NO: 1055806 - DNA, 22 bp, Artificial Sequence
  chemically synthesized
ccaagaacagcagcaaaaaaat

SEQ ID NO: 1055807 - DNA, 22 bp, Artificial Sequence
  chemically synthesized
tccaagaacagcagcaaaaaaa

SEQ ID NO: 1055808 - DNA, 22 bp, Artificial Sequence
  chemically synthesized
ttttttgtatttttttgctgct

SEQ ID NO: 1055809 - DNA, 22 bp, Artificial Sequence
  chemically synthesized
tttttgtatttttttgctgctg

SEQ ID NO: 1055810 - DNA, 22 bp, Artificial Sequence
  chemically synthesized
ttttgtatttttttgctgctgt

SEQ ID NO: 1055811 - DNA, 22 bp, Artificial Sequence
  chemically synthesized
tttgtatttttttgctgctgtt

SEQ ID NO: 1055812 - DNA, 22 bp, Artificial Sequence
  chemically synthesized
ttgtatttttttgctgctgttc

SEQ ID NO: 1055813 - DNA, 22 bp, Artificial Sequence
  chemically synthesized
tgtatttttttgctgctgttct

SEQ ID NO: 1055814 - DNA, 22 bp, Artificial Sequence
  chemically synthesized
gtatttttttgctgctgttctt

SEQ ID NO: 1055815 - DNA, 22 bp, Artificial Sequence
  chemically synthesized
tatttttttgctgctgttcttg

SEQ ID NO: 1055816 - DNA, 22 bp, Artificial Sequence
  chemically synthesized
ttttgctgctgttcttggaaag

SEQ ID NO: 1055817 - DNA, 22 bp, Artificial Sequence
  chemically synthesized
tttgctgctgttcttggaaagg

SEQ ID NO: 1055818 - DNA, 22 bp, Artificial Sequence
  chemically synthesized
ttgctgctgttcttggaaaggt

SEQ ID NO: 1055819 - DNA, 22 bp, Artificial Sequence
  chemically synthesized
tgctgctgttcttggaaaggtc

SEQ ID NO: 1055820 - DNA, 22 bp, Artificial Sequence
  chemically synthesized
gctgctgttcttggaaaggtca

SEQ ID NO: 1055821 - DNA, 22 bp, Artificial Sequence
  chemically synthesized
ctgctgttcttggaaaggtcat

SEQ ID NO: 1055822 - DNA, 22 bp, Artificial Sequence
  chemically synthesized
ctgttcttggaaaggtcatgta

SEQ ID NO: 1055823 - DNA, 22 bp, Artificial Sequence
  chemically synthesized
aaatatgtatacatacatgacc

SEQ ID NO: 1055824 - DNA, 22 bp, Artificial Sequence
  chemically synthesized
ttcttggaaaggtcatgtatgt

SEQ ID NO: 1055825 - DNA, 22 bp, Artificial Sequence
  chemically synthesized
tgaaatatgtatacatacatga

SEQ ID NO: 1055826 - DNA, 22 bp, Artificial Sequence
  chemically synthesized
ttggaaaggtcatgtatgtata

SEQ ID NO: 1055827 - DNA, 22 bp, Artificial Sequence
  chemically synthesized
ggaaaggtcatgtatgtataca

SEQ ID NO: 1055828 - DNA, 22 bp, Artificial Sequence
  chemically synthesized
gaaaggtcatgtatgtatacat

SEQ ID NO: 1055829 - DNA, 22 bp, Artificial Sequence
  chemically synthesized
aacctctgaaatatgtatacat

SEQ ID NO: 1055830 - DNA, 22 bp, Artificial Sequence
  chemically synthesized
gatagcaaaaaagtgctaaacc

SEQ ID NO: 1055831 - DNA, 22 bp, Artificial Sequence
  chemically synthesized
tagatagcaaaaaagtgctaaa

SEQ ID NO: 1055832 - DNA, 22 bp, Artificial Sequence
  chemically synthesized
ctagatagcaaaaaagtgctaa

SEQ ID NO: 1055833 - DNA, 22 bp, Artificial Sequence
  chemically synthesized
cagaggtttagcacttttttgc

SEQ ID NO: 1055834 - DNA, 22 bp, Artificial Sequence
  chemically synthesized
agaggtttagcacttttttgct

SEQ ID NO: 1055835 - DNA, 22 bp, Artificial Sequence
  chemically synthesized
taatgtttctagatagcaaaaa

SEQ ID NO: 1055836 - DNA, 22 bp, Artificial Sequence
  chemically synthesized
agcacttttttgctatctagaa

SEQ ID NO: 1055837 - DNA, 22 bp, Artificial Sequence
  chemically synthesized
gcacttttttgctatctagaaa

SEQ ID NO: 1055838 - DNA, 22 bp, Artificial Sequence
  chemically synthesized
ccaattataatgtttctagata

SEQ ID NO: 1055839 - DNA, 22 bp, Artificial Sequence
  chemically synthesized
ttaccaattataatgtttctag

SEQ ID NO: 1055840 - DNA, 22 bp, Artificial Sequence
  chemically synthesized
ttttgctatctagaaacattat

SEQ ID NO: 1055841 - DNA, 22 bp, Artificial Sequence
  chemically synthesized
tttgctatctagaaacattata

SEQ ID NO: 1055842 - DNA, 22 bp, Artificial Sequence
  chemically synthesized
ttgctatctagaaacattataa

SEQ ID NO: 1055843 - DNA, 22 bp, Artificial Sequence
  chemically synthesized
tgctatctagaaacattataat

SEQ ID NO: 1055844 - DNA, 22 bp, Artificial Sequence
  chemically synthesized
gctatctagaaacattataatt

SEQ ID NO: 1055845 - DNA, 22 bp, Artificial Sequence
  chemically synthesized
ctatctagaaacattataattg

SEQ ID NO: 1055846 - DNA, 22 bp, Artificial Sequence
  chemically synthesized
tgtaaattattaccaattataa

SEQ ID NO: 1055847 - DNA, 22 bp, Artificial Sequence
  chemically synthesized
tctagaaacattataattggta

SEQ ID NO: 1055848 - DNA, 22 bp, Artificial Sequence
  chemically synthesized
tatgtaaattattaccaattat

SEQ ID NO: 1055849 - DNA, 22 bp, Artificial Sequence
  chemically synthesized
gaaacattataattggtaataa

SEQ ID NO: 1055850 - DNA, 22 bp, Artificial Sequence
  chemically synthesized
taattggtaataatttacatag

SEQ ID NO: 1055851 - DNA, 22 bp, Artificial Sequence
  chemically synthesized
tgcataatgtgttctatgtaaa

SEQ ID NO: 1055852 - DNA, 22 bp, Artificial Sequence
  chemically synthesized
gtgcataatgtgttctatgtaa

SEQ ID NO: 1055853 - DNA, 22 bp, Artificial Sequence
  chemically synthesized
gtaataatttacatagaacaca

SEQ ID NO: 1055854 - DNA, 22 bp, Artificial Sequence
  chemically synthesized
acatagaacacattatgcacaa

SEQ ID NO: 1055855 - DNA, 22 bp, Artificial Sequence
  chemically synthesized
catagaacacattatgcacaag

SEQ ID NO: 1055856 - DNA, 22 bp, Artificial Sequence
  chemically synthesized
gagataatggcaacaaatataa

SEQ ID NO: 1055857 - DNA, 22 bp, Artificial Sequence
  chemically synthesized
tgcacaagccttatatttgttg

SEQ ID NO: 1055858 - DNA, 22 bp, Artificial Sequence
  chemically synthesized
ttcgagataatggcaacaaata

SEQ ID NO: 1055859 - DNA, 22 bp, Artificial Sequence
  chemically synthesized
attcgagataatggcaacaaat

SEQ ID NO: 1055860 - DNA, 22 bp, Artificial Sequence
  chemically synthesized
atatttgttgccattatctcga

SEQ ID NO: 1055861 - DNA, 22 bp, Artificial Sequence
  chemically synthesized
tatttgttgccattatctcgaa

SEQ ID NO: 1055862 - DNA, 22 bp, Artificial Sequence
  chemically synthesized
gttgccattatctcgaataagt

SEQ ID NO: 1055863 - DNA, 22 bp, Artificial Sequence
  chemically synthesized
ttgccattatctcgaataagtc

SEQ ID NO: 1055864 - DNA, 22 bp, Artificial Sequence
  chemically synthesized
ccattatctcgaataagtcttg

SEQ ID NO: 1055865 - DNA, 22 bp, Artificial Sequence
  chemically synthesized
tctcgaataagtcttgttttta

SEQ ID NO: 1055866 - DNA, 22 bp, Artificial Sequence
  chemically synthesized
tgtaaagggagataaaaacaag

SEQ ID NO: 1055867 - DNA, 22 bp, Artificial Sequence
  chemically synthesized
gaataagtcttgtttttatctc

SEQ ID NO: 1055868 - DNA, 22 bp, Artificial Sequence
  chemically synthesized
catatgctatgtaaagggagat

SEQ ID NO: 1055869 - DNA, 22 bp, Artificial Sequence
  chemically synthesized
gtttttatctccctttacatag

SEQ ID NO: 1055870 - DNA, 22 bp, Artificial Sequence
  chemically synthesized
tttttatctccctttacatagc

SEQ ID NO: 1055871 - DNA, 22 bp, Artificial Sequence
  chemically synthesized
catattacatatgctatgtaaa

SEQ ID NO: 1055872 - DNA, 22 bp, Artificial Sequence
  chemically synthesized
ttatctccctttacatagcata

SEQ ID NO: 1055873 - DNA, 22 bp, Artificial Sequence
  chemically synthesized
tatctccctttacatagcatat

SEQ ID NO: 1055874 - DNA, 22 bp, Artificial Sequence
  chemically synthesized
atctccctttacatagcatatg

SEQ ID NO: 1055875 - DNA, 22 bp, Artificial Sequence
  chemically synthesized
tctccctttacatagcatatgt

SEQ ID NO: 1055876 - DNA, 22 bp, Artificial Sequence
  chemically synthesized
atatcctgcatattacatatgc

SEQ ID NO: 1055877 - DNA, 22 bp, Artificial Sequence
  chemically synthesized
cctttacatagcatatgtaata

SEQ ID NO: 1055878 - DNA, 22 bp, Artificial Sequence
  chemically synthesized
attcatatcctgcatattacat

SEQ ID NO: 1055879 - DNA, 22 bp, Artificial Sequence
  chemically synthesized
aattcatatcctgcatattaca

SEQ ID NO: 1055880 - DNA, 22 bp, Artificial Sequence
  chemically synthesized
tacatagcatatgtaatatgca

SEQ ID NO: 1055881 - DNA, 22 bp, Artificial Sequence
  chemically synthesized
acatagcatatgtaatatgcag

SEQ ID NO: 1055882 - DNA, 22 bp, Artificial Sequence
  chemically synthesized
catagcatatgtaatatgcagg

SEQ ID NO: 1055883 - DNA, 22 bp, Artificial Sequence
  chemically synthesized
catatccttaattcatatcctg

SEQ ID NO: 1055884 - DNA, 22 bp, Artificial Sequence
  chemically synthesized
tgaattacatatccttaattca

SEQ ID NO: 1055885 - DNA, 22 bp, Artificial Sequence
  chemically synthesized
catatcctatgaattacatatc

SEQ ID NO: 1055886 - DNA, 22 bp, Artificial Sequence
  chemically synthesized
ttgcatatcctatgaattacat

SEQ ID NO: 1055887 - DNA, 22 bp, Artificial Sequence
  chemically synthesized
attgcatatcctatgaattaca

SEQ ID NO: 1055888 - DNA, 22 bp, Artificial Sequence
  chemically synthesized
aggatatgtaattcataggata

SEQ ID NO: 1055889 - DNA, 22 bp, Artificial Sequence
  chemically synthesized
ataggatatgcaataagtcttc

SEQ ID NO: 1055890 - DNA, 22 bp, Artificial Sequence
  chemically synthesized
tgtaaagagagagaaatcaaat

SEQ ID NO: 1055891 - DNA, 22 bp, Artificial Sequence
  chemically synthesized
atcctgtgtaaagagagagaaa

SEQ ID NO: 1055892 - DNA, 22 bp, Artificial Sequence
  chemically synthesized
ctatttgatttctctctcttta

SEQ ID NO: 1055893 - DNA, 22 bp, Artificial Sequence
  chemically synthesized
actgatcctgtgtaaagagaga

SEQ ID NO: 1055894 - DNA, 22 bp, Artificial Sequence
  chemically synthesized
tatttgatttctctctctttac

SEQ ID NO: 1055895 - DNA, 22 bp, Artificial Sequence
  chemically synthesized
gactgatcctgtgtaaagagag

SEQ ID NO: 1055896 - DNA, 22 bp, Artificial Sequence
  chemically synthesized
tttgatttctctctctttacac

SEQ ID NO: 1055897 - DNA, 22 bp, Artificial Sequence
  chemically synthesized
gatttctctctctttacacagg

SEQ ID NO: 1055898 - DNA, 22 bp, Artificial Sequence
  chemically synthesized
atttctctctctttacacagga

SEQ ID NO: 1055899 - DNA, 22 bp, Artificial Sequence
  chemically synthesized
ctctctctttacacaggatcag

SEQ ID NO: 1055900 - DNA, 22 bp, Artificial Sequence
  chemically synthesized
tctctctttacacaggatcagt

SEQ ID NO: 1055901 - DNA, 22 bp, Artificial Sequence
  chemically synthesized
tctctttacacaggatcagtca

SEQ ID NO: 1055902 - DNA, 22 bp, Artificial Sequence
  chemically synthesized
tctttacacaggatcagtcaaa

SEQ ID NO: 1055903 - DNA, 22 bp, Artificial Sequence
  chemically synthesized
ggagaatgcagtgtttgactga

SEQ ID NO: 1055904 - DNA, 22 bp, Artificial Sequence
  chemically synthesized
tttacacaggatcagtcaaaca

SEQ ID NO: 1055905 - DNA, 22 bp, Artificial Sequence
  chemically synthesized
tacacaggatcagtcaaacact

SEQ ID NO: 1055906 - DNA, 22 bp, Artificial Sequence
  chemically synthesized
acacaggatcagtcaaacactg

SEQ ID NO: 1055907 - DNA, 22 bp, Artificial Sequence
  chemically synthesized
cacaggatcagtcaaacactgc

SEQ ID NO: 1055908 - DNA, 22 bp, Artificial Sequence
  chemically synthesized
cattctcctagtattctgtgtt

SEQ ID NO: 1055909 - DNA, 22 bp, Artificial Sequence
  chemically synthesized
tcctagtattctgtgttttcct

SEQ ID NO: 1055910 - DNA, 22 bp, Artificial Sequence
  chemically synthesized
gtcagtgccaccaaggaaaaca

SEQ ID NO: 1055911 - DNA, 22 bp, Artificial Sequence
  chemically synthesized
ctagtattctgtgttttccttg

SEQ ID NO: 1055912 - DNA, 22 bp, Artificial Sequence
  chemically synthesized
ggtcagtgccaccaaggaaaac

SEQ ID NO: 1055913 - DNA, 22 bp, Artificial Sequence
  chemically synthesized
gtattctgtgttttccttggtg

SEQ ID NO: 1055914 - DNA, 22 bp, Artificial Sequence
  chemically synthesized
aaatttggtcagtgccaccaag

SEQ ID NO: 1055915 - DNA, 22 bp, Artificial Sequence
  chemically synthesized
tgtgttttccttggtggcactg

SEQ ID NO: 1055916 - DNA, 22 bp, Artificial Sequence
  chemically synthesized
tgttttccttggtggcactgac

SEQ ID NO: 1055917 - DNA, 22 bp, Artificial Sequence
  chemically synthesized
taatcctaaaatttggtcagtg

SEQ ID NO: 1055918 - DNA, 22 bp, Artificial Sequence
  chemically synthesized
ataatcctaaaatttggtcagt

SEQ ID NO: 1055919 - DNA, 22 bp, Artificial Sequence
  chemically synthesized
tccttggtggcactgaccaaat

SEQ ID NO: 1055920 - DNA, 22 bp, Artificial Sequence
  chemically synthesized
ccttggtggcactgaccaaatt

SEQ ID NO: 1055921 - DNA, 22 bp, Artificial Sequence
  chemically synthesized
cttggtggcactgaccaaattt

SEQ ID NO: 1055922 - DNA, 22 bp, Artificial Sequence
  chemically synthesized
ggtggcactgaccaaattttag

SEQ ID NO: 1055923 - DNA, 22 bp, Artificial Sequence
  chemically synthesized
gtggcactgaccaaattttagg

SEQ ID NO: 1055924 - DNA, 22 bp, Artificial Sequence
  chemically synthesized
aaaaagcttataatcctaaaat

SEQ ID NO: 1055925 - DNA, 22 bp, Artificial Sequence
  chemically synthesized
ttaaaaaagcttataatcctaa

SEQ ID NO: 1055926 - DNA, 22 bp, Artificial Sequence
  chemically synthesized
attaaaaaagcttataatccta

SEQ ID NO: 1055927 - DNA, 22 bp, Artificial Sequence
  chemically synthesized
accaaattttaggattataagc

SEQ ID NO: 1055928 - DNA, 22 bp, Artificial Sequence
  chemically synthesized
taggattataagcttttttaat

SEQ ID NO: 1055929 - DNA, 22 bp, Artificial Sequence
  chemically synthesized
aggattataagcttttttaata

SEQ ID NO: 1055930 - DNA, 22 bp, Artificial Sequence
  chemically synthesized
ggattataagcttttttaataa

SEQ ID NO: 1055931 - DNA, 22 bp, Artificial Sequence
  chemically synthesized
taaataagaacatttattaaaa

SEQ ID NO: 1055932 - DNA, 22 bp, Artificial Sequence
  chemically synthesized
tgtaaataagaacatttattaa

SEQ ID NO: 1055933 - DNA, 22 bp, Artificial Sequence
  chemically synthesized
tctgtaaataagaacatttatt

SEQ ID NO: 1055934 - DNA, 22 bp, Artificial Sequence
  chemically synthesized
taagcttttttaataaatgttc

SEQ ID NO: 1055935 - DNA, 22 bp, Artificial Sequence
  chemically synthesized
ctctgtaaataagaacatttat

SEQ ID NO: 1055936 - DNA, 22 bp, Artificial Sequence
  chemically synthesized
tctctgtaaataagaacattta

SEQ ID NO: 1055937 - DNA, 22 bp, Artificial Sequence
  chemically synthesized
ttttctctgtaaataagaacat

SEQ ID NO: 1055938 - DNA, 22 bp, Artificial Sequence
  chemically synthesized
ttttaataaatgttcttattta

SEQ ID NO: 1055939 - DNA, 22 bp, Artificial Sequence
  chemically synthesized
tttaataaatgttcttatttac

SEQ ID NO: 1055940 - DNA, 22 bp, Artificial Sequence
  chemically synthesized
ttaataaatgttcttatttaca

SEQ ID NO: 1055941 - DNA, 22 bp, Artificial Sequence
  chemically synthesized
taataaatgttcttatttacag

SEQ ID NO: 1055942 - DNA, 22 bp, Artificial Sequence
  chemically synthesized
aataaatgttcttatttacaga

SEQ ID NO: 1055943 - DNA, 22 bp, Artificial Sequence
  chemically synthesized
ataaatgttcttatttacagag

SEQ ID NO: 1055944 - DNA, 22 bp, Artificial Sequence
  chemically synthesized
tataaaattgttttctctgtaa

SEQ ID NO: 1055945 - DNA, 22 bp, Artificial Sequence
  chemically synthesized
ttatttacagagaaaacaattt

SEQ ID NO: 1055946 - DNA, 22 bp, Artificial Sequence
  chemically synthesized
atttacagagaaaacaatttta

SEQ ID NO: 1055947 - DNA, 22 bp, Artificial Sequence
  chemically synthesized
tttacagagaaaacaattttat

SEQ ID NO: 1055948 - DNA, 22 bp, Artificial Sequence
  chemically synthesized
acagagaaaacaattttataca

SEQ ID NO: 1055949 - DNA, 22 bp, Artificial Sequence
  chemically synthesized
cagagaaaacaattttatacag

SEQ ID NO: 1055950 - DNA, 22 bp, Artificial Sequence
  chemically synthesized
gaaggaaggagacagcgatgta

SEQ ID NO: 1055951 - DNA, 22 bp, Artificial Sequence
  chemically synthesized
tatacagctttacatcgctgtc

SEQ ID NO: 1055952 - DNA, 22 bp, Artificial Sequence
  chemically synthesized
atacagctttacatcgctgtct

SEQ ID NO: 1055953 - DNA, 22 bp, Artificial Sequence
  chemically synthesized
tacagctttacatcgctgtctc

SEQ ID NO: 1055954 - DNA, 22 bp, Artificial Sequence
  chemically synthesized
tacatcgctgtctccttccttc

SEQ ID NO: 1055955 - DNA, 22 bp, Artificial Sequence
  chemically synthesized
acatcgctgtctccttccttct

SEQ ID NO: 1055956 - DNA, 22 bp, Artificial Sequence
  chemically synthesized
catcgctgtctccttccttcta

SEQ ID NO: 1055957 - DNA, 22 bp, Artificial Sequence
  chemically synthesized
tgtaaaataaaatgaaactaga

SEQ ID NO: 1055958 - DNA, 22 bp, Artificial Sequence
  chemically synthesized
gtgtaaaataaaatgaaactag

SEQ ID NO: 1055959 - DNA, 22 bp, Artificial Sequence
  chemically synthesized
tctccttccttctagtttcatt

SEQ ID NO: 1055960 - DNA, 22 bp, Artificial Sequence
  chemically synthesized
cttccttctagtttcattttat

SEQ ID NO: 1055961 - DNA, 22 bp, Artificial Sequence
  chemically synthesized
ccttctagtttcattttatttt

SEQ ID NO: 1055962 - DNA, 22 bp, Artificial Sequence
  chemically synthesized
cttctagtttcattttatttta

SEQ ID NO: 1055963 - DNA, 22 bp, Artificial Sequence
  chemically synthesized
ctagtttcattttattttacac

SEQ ID NO: 1055964 - DNA, 22 bp, Artificial Sequence
  chemically synthesized
agcaatatatttgtgtaaaata

SEQ ID NO: 1055965 - DNA, 22 bp, Artificial Sequence
  chemically synthesized
tagtttcattttattttacaca

SEQ ID NO: 1055966 - DNA, 22 bp, Artificial Sequence
  chemically synthesized
gtttcattttattttacacaaa

SEQ ID NO: 1055967 - DNA, 22 bp, Artificial Sequence
  chemically synthesized
ctaagcaatatatttgtgtaaa

SEQ ID NO: 1055968 - DNA, 22 bp, Artificial Sequence
  chemically synthesized
cattttattttacacaaatata

SEQ ID NO: 1055969 - DNA, 22 bp, Artificial Sequence
  chemically synthesized
attttattttacacaaatatat

SEQ ID NO: 1055970 - DNA, 22 bp, Artificial Sequence
  chemically synthesized
tattttacacaaatatattgct

SEQ ID NO: 1055971 - DNA, 22 bp, Artificial Sequence
  chemically synthesized
aaataattactaagcaatatat

SEQ ID NO: 1055972 - DNA, 22 bp, Artificial Sequence
  chemically synthesized
attttacacaaatatattgctt

SEQ ID NO: 1055973 - DNA, 22 bp, Artificial Sequence
  chemically synthesized
ttttacacaaatatattgctta

SEQ ID NO: 1055974 - DNA, 22 bp, Artificial Sequence
  chemically synthesized
ctaaaataattactaagcaata

SEQ ID NO: 1055975 - DNA, 22 bp, Artificial Sequence
  chemically synthesized
gctaaaataattactaagcaat

SEQ ID NO: 1055976 - DNA, 22 bp, Artificial Sequence
  chemically synthesized
tacacaaatatattgcttagta

SEQ ID NO: 1055977 - DNA, 22 bp, Artificial Sequence
  chemically synthesized
tgctaaaataattactaagcaa

SEQ ID NO: 1055978 - DNA, 22 bp, Artificial Sequence
  chemically synthesized
acacaaatatattgcttagtaa

SEQ ID NO: 1055979 - DNA, 22 bp, Artificial Sequence
  chemically synthesized
ttgctaaaataattactaagca

SEQ ID NO: 1055980 - DNA, 22 bp, Artificial Sequence
  chemically synthesized
cacaaatatattgcttagtaat

SEQ ID NO: 1055981 - DNA, 22 bp, Artificial Sequence
  chemically synthesized
tagatttttgctaaaataatta

SEQ ID NO: 1055982 - DNA, 22 bp, Artificial Sequence
  chemically synthesized
tctatagatttttgctaaaata

SEQ ID NO: 1055983 - DNA, 22 bp, Artificial Sequence
  chemically synthesized
gtctatagatttttgctaaaat

SEQ ID NO: 1055984 - DNA, 22 bp, Artificial Sequence
  chemically synthesized
cttagtaattattttagcaaaa

SEQ ID NO: 1055985 - DNA, 22 bp, Artificial Sequence
  chemically synthesized
ttgtctatagatttttgctaaa

SEQ ID NO: 1055986 - DNA, 22 bp, Artificial Sequence
  chemically synthesized
cttgtctatagatttttgctaa

SEQ ID NO: 1055987 - DNA, 22 bp, Artificial Sequence
  chemically synthesized
agtaattattttagcaaaaatc

SEQ ID NO: 1055988 - DNA, 22 bp, Artificial Sequence
  chemically synthesized
gtaattattttagcaaaaatct

SEQ ID NO: 1055989 - DNA, 22 bp, Artificial Sequence
  chemically synthesized
agaatttcttgtctatagattt

SEQ ID NO: 1055990 - DNA, 22 bp, Artificial Sequence
  chemically synthesized
ttttagcaaaaatctatagaca

SEQ ID NO: 1055991 - DNA, 22 bp, Artificial Sequence
  chemically synthesized
tagcaaaaatctatagacaaga

SEQ ID NO: 1055992 - DNA, 22 bp, Artificial Sequence
  chemically synthesized
agcaaaaatctatagacaagaa

SEQ ID NO: 1055993 - DNA, 22 bp, Artificial Sequence
  chemically synthesized
gcaaaaatctatagacaagaaa

SEQ ID NO: 1055994 - DNA, 22 bp, Artificial Sequence
  chemically synthesized
aacaaaaactaagaatttcttg

SEQ ID NO: 1055995 - DNA, 22 bp, Artificial Sequence
  chemically synthesized
acctgaacaaaaactaagaatt

SEQ ID NO: 1055996 - DNA, 22 bp, Artificial Sequence
  chemically synthesized
cacctgaacaaaaactaagaat

SEQ ID NO: 1055997 - DNA, 22 bp, Artificial Sequence
  chemically synthesized
tagacaagaaattcttagtttt

SEQ ID NO: 1055998 - DNA, 22 bp, Artificial Sequence
  chemically synthesized
gtttcacctgaacaaaaactaa

SEQ ID NO: 1055999 - DNA, 22 bp, Artificial Sequence
  chemically synthesized
ttagtttttgttcaggtgaaac

SEQ ID NO: 1056000 - DNA, 22 bp, Artificial Sequence
  chemically synthesized
agacatacagctagtttcacct

SEQ ID NO: 1056001 - DNA, 22 bp, Artificial Sequence
  chemically synthesized
agtttttgttcaggtgaaacta

SEQ ID NO: 1056002 - DNA, 22 bp, Artificial Sequence
  chemically synthesized
gtttttgttcaggtgaaactag

SEQ ID NO: 1056003 - DNA, 22 bp, Artificial Sequence
  chemically synthesized
tcagacatacagctagtttcac

SEQ ID NO: 1056004 - DNA, 22 bp, Artificial Sequence
  chemically synthesized
ttgttcaggtgaaactagctgt

SEQ ID NO: 1056005 - DNA, 22 bp, Artificial Sequence
  chemically synthesized
tgttcaggtgaaactagctgta

SEQ ID NO: 1056006 - DNA, 22 bp, Artificial Sequence
  chemically synthesized
gttcaggtgaaactagctgtat

SEQ ID NO: 1056007 - DNA, 22 bp, Artificial Sequence
  chemically synthesized
ttcaggtgaaactagctgtatg

SEQ ID NO: 1056008 - DNA, 22 bp, Artificial Sequence
  chemically synthesized
aggtgaaactagctgtatgtct

SEQ ID NO: 1056009 - DNA, 22 bp, Artificial Sequence
  chemically synthesized
aggcaaaatattctcagacata

SEQ ID NO: 1056010 - DNA, 22 bp, Artificial Sequence
  chemically synthesized
gctgtatgtctgagaatatttt

SEQ ID NO: 1056011 - DNA, 22 bp, Artificial Sequence
  chemically synthesized
aagaattaaggcaaaatattct

SEQ ID NO: 1056012 - DNA, 22 bp, Artificial Sequence
  chemically synthesized
tatgtctgagaatattttgcct

SEQ ID NO: 1056013 - DNA, 22 bp, Artificial Sequence
  chemically synthesized
agaatattttgccttaattctt

SEQ ID NO: 1056014 - DNA, 22 bp, Artificial Sequence
  chemically synthesized
tgccttaattcttgaatcatgt

SEQ ID NO: 1056015 - DNA, 22 bp, Artificial Sequence
  chemically synthesized
gccttaattcttgaatcatgtt

SEQ ID NO: 1056016 - DNA, 22 bp, Artificial Sequence
  chemically synthesized
ccttaattcttgaatcatgttt

SEQ ID NO: 1056017 - DNA, 22 bp, Artificial Sequence
  chemically synthesized
aaataccaggtaaaacatgatt

SEQ ID NO: 1056018 - DNA, 22 bp, Artificial Sequence
  chemically synthesized
caaataccaggtaaaacatgat

SEQ ID NO: 1056019 - DNA, 22 bp, Artificial Sequence
  chemically synthesized
tcaaataccaggtaaaacatga

SEQ ID NO: 1056020 - DNA, 22 bp, Artificial Sequence
  chemically synthesized
aattcttgaatcatgttttacc

SEQ ID NO: 1056021 - DNA, 22 bp, Artificial Sequence
  chemically synthesized
attcttgaatcatgttttacct

SEQ ID NO: 1056022 - DNA, 22 bp, Artificial Sequence
  chemically synthesized
ttgaatcatgttttacctggta

SEQ ID NO: 1056023 - DNA, 22 bp, Artificial Sequence
  chemically synthesized
gaatcatgttttacctggtatt

SEQ ID NO: 1056024 - DNA, 22 bp, Artificial Sequence
  chemically synthesized
ggcacattttcaaataccaggt

SEQ ID NO: 1056025 - DNA, 22 bp, Artificial Sequence
  chemically synthesized
aatcatgttttacctggtattt

SEQ ID NO: 1056026 - DNA, 22 bp, Artificial Sequence
  chemically synthesized
aaaatgctaggcacattttcaa

SEQ ID NO: 1056027 - DNA, 22 bp, Artificial Sequence
  chemically synthesized
caaaatgctaggcacattttca

SEQ ID NO: 1056028 - DNA, 22 bp, Artificial Sequence
  chemically synthesized
tacctggtatttgaaaatgtgc

SEQ ID NO: 1056029 - DNA, 22 bp, Artificial Sequence
  chemically synthesized
acctggtatttgaaaatgtgcc

SEQ ID NO: 1056030 - DNA, 22 bp, Artificial Sequence
  chemically synthesized
cctggtatttgaaaatgtgcct

SEQ ID NO: 1056031 - DNA, 22 bp, Artificial Sequence
  chemically synthesized
gtatttgaaaatgtgcctagca

SEQ ID NO: 1056032 - DNA, 22 bp, Artificial Sequence
  chemically synthesized
aataatatcttcaaaatgctag

SEQ ID NO: 1056033 - DNA, 22 bp, Artificial Sequence
  chemically synthesized
gaaaatgtgcctagcattttga

SEQ ID NO: 1056034 - DNA, 22 bp, Artificial Sequence
  chemically synthesized
aaaatgtgcctagcattttgaa

SEQ ID NO: 1056035 - DNA, 22 bp, Artificial Sequence
  chemically synthesized
gaagacagttgaataatatctt

SEQ ID NO: 1056036 - DNA, 22 bp, Artificial Sequence
  chemically synthesized
gcattttgaagatattattcaa

SEQ ID NO: 1056037 - DNA, 22 bp, Artificial Sequence
  chemically synthesized
tgaagatattattcaactgtct

SEQ ID NO: 1056038 - DNA, 22 bp, Artificial Sequence
  chemically synthesized
gaagatattattcaactgtctt

SEQ ID NO: 1056039 - DNA, 22 bp, Artificial Sequence
  chemically synthesized
aagatattattcaactgtcttc

SEQ ID NO: 1056040 - DNA, 22 bp, Artificial Sequence
  chemically synthesized
atcaacaatagatattagaaga

SEQ ID NO: 1056041 - DNA, 22 bp, Artificial Sequence
  chemically synthesized
catcaacaatagatattagaag

SEQ ID NO: 1056042 - DNA, 22 bp, Artificial Sequence
  chemically synthesized
tcatcaacaatagatattagaa

SEQ ID NO: 1056043 - DNA, 22 bp, Artificial Sequence
  chemically synthesized
ttcatcaacaatagatattaga

SEQ ID NO: 1056044 - DNA, 22 bp, Artificial Sequence
  chemically synthesized
ttcaactgtcttctaatatcta

SEQ ID NO: 1056045 - DNA, 22 bp, Artificial Sequence
  chemically synthesized
aactgtcttctaatatctattg

SEQ ID NO: 1056046 - DNA, 22 bp, Artificial Sequence
  chemically synthesized
aagacttttcatcaacaataga

SEQ ID NO: 1056047 - DNA, 22 bp, Artificial Sequence
  chemically synthesized
tcttctaatatctattgttgat

SEQ ID NO: 1056048 - DNA, 22 bp, Artificial Sequence
  chemically synthesized
actgaagacttttcatcaacaa

SEQ ID NO: 1056049 - DNA, 22 bp, Artificial Sequence
  chemically synthesized
ctaatatctattgttgatgaaa

SEQ ID NO: 1056050 - DNA, 22 bp, Artificial Sequence
  chemically synthesized
taatatctattgttgatgaaaa

SEQ ID NO: 1056051 - DNA, 22 bp, Artificial Sequence
  chemically synthesized
atatctattgttgatgaaaagt

SEQ ID NO: 1056052 - DNA, 22 bp, Artificial Sequence
  chemically synthesized
ttgttgatgaaaagtcttcagt

SEQ ID NO: 1056053 - DNA, 22 bp, Artificial Sequence
  chemically synthesized
ttgatgaaaagtcttcagtcaa

SEQ ID NO: 1056054 - DNA, 22 bp, Artificial Sequence
  chemically synthesized
caggatgacaatattgactgaa

SEQ ID NO: 1056055 - DNA, 22 bp, Artificial Sequence
  chemically synthesized
acaggatgacaatattgactga

SEQ ID NO: 1056056 - DNA, 22 bp, Artificial Sequence
  chemically synthesized
atgaaaagtcttcagtcaatat

SEQ ID NO: 1056057 - DNA, 22 bp, Artificial Sequence
  chemically synthesized
cagtcaatattgtcatcctgta

SEQ ID NO: 1056058 - DNA, 22 bp, Artificial Sequence
  chemically synthesized
agtcaatattgtcatcctgtaa

SEQ ID NO: 1056059 - DNA, 22 bp, Artificial Sequence
  chemically synthesized
agacaaaagaacatttacagga

SEQ ID NO: 1056060 - DNA, 22 bp, Artificial Sequence
  chemically synthesized
aagacaaaagaacatttacagg

SEQ ID NO: 1056061 - DNA, 22 bp, Artificial Sequence
  chemically synthesized
cttaagacaaaagaacatttac

SEQ ID NO: 1056062 - DNA, 22 bp, Artificial Sequence
  chemically synthesized
tcatcctgtaaatgttcttttg

SEQ ID NO: 1056063 - DNA, 22 bp, Artificial Sequence
  chemically synthesized
agggttacttaagacaaaagaa

SEQ ID NO: 1056064 - DNA, 22 bp, Artificial Sequence
  chemically synthesized
taaatgttcttttgtcttaagt

SEQ ID NO: 1056065 - DNA, 22 bp, Artificial Sequence
  chemically synthesized
ttttgtcttaagtaacccttaa

SEQ ID NO: 1056066 - DNA, 22 bp, Artificial Sequence
  chemically synthesized
ttgtcttaagtaacccttaatg

SEQ ID NO: 1056067 - DNA, 22 bp, Artificial Sequence
  chemically synthesized
tgtcttaagtaacccttaatga

SEQ ID NO: 1056068 - DNA, 22 bp, Artificial Sequence
  chemically synthesized
gtcttaagtaacccttaatgat

SEQ ID NO: 1056069 - DNA, 22 bp, Artificial Sequence
  chemically synthesized
tcttaagtaacccttaatgata

SEQ ID NO: 1056070 - DNA, 22 bp, Artificial Sequence
  chemically synthesized
aagtaacccttaatgatacctt

SEQ ID NO: 1056071 - DNA, 22 bp, Artificial Sequence
  chemically synthesized
agtaacccttaatgataccttt

SEQ ID NO: 1056072 - DNA, 22 bp, Artificial Sequence
  chemically synthesized
agagcatcagtaatcaaaaagg

SEQ ID NO: 1056073 - DNA, 22 bp, Artificial Sequence
  chemically synthesized
aatgatacctttttgattactg

SEQ ID NO: 1056074 - DNA, 22 bp, Artificial Sequence
  chemically synthesized
atgatacctttttgattactga

SEQ ID NO: 1056075 - DNA, 22 bp, Artificial Sequence
  chemically synthesized
aatgaaactcagagcatcagta

SEQ ID NO: 1056076 - DNA, 22 bp, Artificial Sequence
  chemically synthesized
tgaatgaaactcagagcatcag

SEQ ID NO: 1056077 - DNA, 22 bp, Artificial Sequence
  chemically synthesized
tttgattactgatgctctgagt

SEQ ID NO: 1056078 - DNA, 22 bp, Artificial Sequence
  chemically synthesized
gctctgaatgaaactcagagca

SEQ ID NO: 1056079 - DNA, 22 bp, Artificial Sequence
  chemically synthesized
ttgattactgatgctctgagtt

SEQ ID NO: 1056080 - DNA, 22 bp, Artificial Sequence
  chemically synthesized
tgattactgatgctctgagttt

SEQ ID NO: 1056081 - DNA, 22 bp, Artificial Sequence
  chemically synthesized
gattactgatgctctgagtttc

SEQ ID NO: 1056082 - DNA, 22 bp, Artificial Sequence
  chemically synthesized
attactgatgctctgagtttca

SEQ ID NO: 1056083 - DNA, 22 bp, Artificial Sequence
  chemically synthesized
ccagctagctctgaatgaaact

SEQ ID NO: 1056084 - DNA, 22 bp, Artificial Sequence
  chemically synthesized
ctgatgctctgagtttcattca

SEQ ID NO: 1056085 - DNA, 22 bp, Artificial Sequence
  chemically synthesized
atgctctgagtttcattcagag

SEQ ID NO: 1056086 - DNA, 22 bp, Artificial Sequence
  chemically synthesized
tgagtttcattcagagctagct

SEQ ID NO: 1056087 - DNA, 22 bp, Artificial Sequence
  chemically synthesized
agtttcattcagagctagctgg

SEQ ID NO: 1056088 - DNA, 22 bp, Artificial Sequence
  chemically synthesized
cattcagagctagctggtagac

SEQ ID NO: 1056089 - DNA, 22 bp, Artificial Sequence
  chemically synthesized
attcagagctagctggtagact

SEQ ID NO: 1056090 - DNA, 22 bp, Artificial Sequence
  chemically synthesized
agagctagctggtagacttgtt

SEQ ID NO: 1056091 - DNA, 22 bp, Artificial Sequence
  chemically synthesized
gctggtagacttgtttttattt

SEQ ID NO: 1056092 - DNA, 22 bp, Artificial Sequence
  chemically synthesized
gtagacttgtttttattttttc

SEQ ID NO: 1056093 - DNA, 22 bp, Artificial Sequence
  chemically synthesized
gtttttattttttccacgttgg

SEQ ID NO: 1056094 - DNA, 22 bp, Artificial Sequence
  chemically synthesized
aataaaggtcaaccaacgtgga

SEQ ID NO: 1056095 - DNA, 22 bp, Artificial Sequence
  chemically synthesized
tttttattttttccacgttggt

SEQ ID NO: 1056096 - DNA, 22 bp, Artificial Sequence
  chemically synthesized
ttattttttccacgttggttga

SEQ ID NO: 1056097 - DNA, 22 bp, Artificial Sequence
  chemically synthesized
tattttttccacgttggttgac

SEQ ID NO: 1056098 - DNA, 22 bp, Artificial Sequence
  chemically synthesized
attttttccacgttggttgacc

SEQ ID NO: 1056099 - DNA, 22 bp, Artificial Sequence
  chemically synthesized
aaattcaataaaggtcaaccaa

SEQ ID NO: 1056100 - DNA, 22 bp, Artificial Sequence
  chemically synthesized
ttttttccacgttggttgacct

SEQ ID NO: 1056101 - DNA, 22 bp, Artificial Sequence
  chemically synthesized
tttccacgttggttgaccttta

SEQ ID NO: 1056102 - DNA, 22 bp, Artificial Sequence
  chemically synthesized
ttccacgttggttgacctttat

SEQ ID NO: 1056103 - DNA, 22 bp, Artificial Sequence
  chemically synthesized
tccacgttggttgacctttatt

SEQ ID NO: 1056104 - DNA, 22 bp, Artificial Sequence
  chemically synthesized
ccacgttggttgacctttattg

SEQ ID NO: 1056105 - DNA, 22 bp, Artificial Sequence
  chemically synthesized
cacgttggttgacctttattga

SEQ ID NO: 1056106 - DNA, 22 bp, Artificial Sequence
  chemically synthesized
atgaatcctcaaattcaataaa

SEQ ID NO: 1056107 - DNA, 22 bp, Artificial Sequence
  chemically synthesized
aatgaatcctcaaattcaataa

SEQ ID NO: 1056108 - DNA, 22 bp, Artificial Sequence
  chemically synthesized
taatgaatcctcaaattcaata

SEQ ID NO: 1056109 - DNA, 22 bp, Artificial Sequence
  chemically synthesized
gttgacctttattgaatttgag

SEQ ID NO: 1056110 - DNA, 22 bp, Artificial Sequence
  chemically synthesized
acctttattgaatttgaggatt

SEQ ID NO: 1056111 - DNA, 22 bp, Artificial Sequence
  chemically synthesized
tattgaatttgaggattcatta

SEQ ID NO: 1056112 - DNA, 22 bp, Artificial Sequence
  chemically synthesized
attgaatttgaggattcattaa

SEQ ID NO: 1056113 - DNA, 22 bp, Artificial Sequence
  chemically synthesized
ttgaatttgaggattcattaaa

SEQ ID NO: 1056114 - DNA, 22 bp, Artificial Sequence
  chemically synthesized
aatttgaggattcattaaaatt

SEQ ID NO: 1056115 - DNA, 22 bp, Artificial Sequence
  chemically synthesized
gaggattcattaaaatttacat

SEQ ID NO: 1056116 - DNA, 22 bp, Artificial Sequence
  chemically synthesized
aggattcattaaaatttacatt

SEQ ID NO: 1056117 - DNA, 22 bp, Artificial Sequence
  chemically synthesized
ataaaatggaataaatgtaaat

SEQ ID NO: 1056118 - DNA, 22 bp, Artificial Sequence
  chemically synthesized
aataaaatggaataaatgtaaa

SEQ ID NO: 1056119 - DNA, 22 bp, Artificial Sequence
  chemically synthesized
attaaaatttacatttattcca

SEQ ID NO: 1056120 - DNA, 22 bp, Artificial Sequence
  chemically synthesized
aaatttacatttattccatttt

SEQ ID NO: 1056121 - DNA, 22 bp, Artificial Sequence
  chemically synthesized
atgaaatttaataaaatggaat

SEQ ID NO: 1056122 - DNA, 22 bp, Artificial Sequence
  chemically synthesized
acatttattccattttattaaa

SEQ ID NO: 1056123 - DNA, 22 bp, Artificial Sequence
  chemically synthesized
atattaatgaaatttaataaaa

SEQ ID NO: 1056124 - DNA, 22 bp, Artificial Sequence
  chemically synthesized
catttattccattttattaaat

SEQ ID NO: 1056125 - DNA, 22 bp, Artificial Sequence
  chemically synthesized
catattaatgaaatttaataaa

SEQ ID NO: 1056126 - DNA, 22 bp, Artificial Sequence
  chemically synthesized
attccattttattaaatttcat

SEQ ID NO: 1056127 - DNA, 22 bp, Artificial Sequence
  chemically synthesized
ttccattttattaaatttcatt

SEQ ID NO: 1056128 - DNA, 22 bp, Artificial Sequence
  chemically synthesized
cattttattaaatttcattaat

SEQ ID NO: 1056129 - DNA, 22 bp, Artificial Sequence
  chemically synthesized
tattaaatttcattaatatgaa

SEQ ID NO: 1056130 - DNA, 22 bp, Artificial Sequence
  chemically synthesized
attaaatttcattaatatgaaa

SEQ ID NO: 1056131 - DNA, 22 bp, Artificial Sequence
  chemically synthesized
ttaaatttcattaatatgaaat

SEQ ID NO: 1056132 - DNA, 22 bp, Artificial Sequence
  chemically synthesized
aatttcattaatatgaaatatt

SEQ ID NO: 1056133 - DNA, 22 bp, Artificial Sequence
  chemically synthesized
tggggaagagacaatatttcat

SEQ ID NO: 1056134 - DNA, 22 bp, Artificial Sequence
  chemically synthesized
cattaatatgaaatattgtctc

SEQ ID NO: 1056135 - DNA, 22 bp, Artificial Sequence
  chemically synthesized
attaatatgaaatattgtctct

SEQ ID NO: 1056136 - DNA, 22 bp, Artificial Sequence
  chemically synthesized
atatgaaatattgtctcttccc

SEQ ID NO: 1056137 - DNA, 22 bp, Artificial Sequence
  chemically synthesized
aaaaaaatagggattatgggga

SEQ ID NO: 1056138 - DNA, 22 bp, Artificial Sequence
  chemically synthesized
aagttgaaaaaaatagggatta

SEQ ID NO: 1056139 - DNA, 22 bp, Artificial Sequence
  chemically synthesized
tctcttccccataatccctatt

SEQ ID NO: 1056140 - DNA, 22 bp, Artificial Sequence
  chemically synthesized
caagttgaaaaaaatagggatt

SEQ ID NO: 1056141 - DNA, 22 bp, Artificial Sequence
  chemically synthesized
ttccccataatccctatttttt

SEQ ID NO: 1056142 - DNA, 22 bp, Artificial Sequence
  chemically synthesized
ccccataatccctatttttttc

SEQ ID NO: 1056143 - DNA, 22 bp, Artificial Sequence
  chemically synthesized
cccataatccctatttttttca

SEQ ID NO: 1056144 - DNA, 22 bp, Artificial Sequence
  chemically synthesized
cgtgaaataagtttcaagttga

SEQ ID NO: 1056145 - DNA, 22 bp, Artificial Sequence
  chemically synthesized
tttttttcaacttgaaacttat

SEQ ID NO: 1056146 - DNA, 22 bp, Artificial Sequence
  chemically synthesized
ttttcaacttgaaacttatttc

SEQ ID NO: 1056147 - DNA, 22 bp, Artificial Sequence
  chemically synthesized
aaacatctgcgtgaaataagtt

SEQ ID NO: 1056148 - DNA, 22 bp, Artificial Sequence
  chemically synthesized
tttcaacttgaaacttatttca

SEQ ID NO: 1056149 - DNA, 22 bp, Artificial Sequence
  chemically synthesized
ttcaacttgaaacttatttcac

SEQ ID NO: 1056150 - DNA, 22 bp, Artificial Sequence
  chemically synthesized
tcaacttgaaacttatttcacg

SEQ ID NO: 1056151 - DNA, 22 bp, Artificial Sequence
  chemically synthesized
caacttgaaacttatttcacgc

SEQ ID NO: 1056152 - DNA, 22 bp, Artificial Sequence
  chemically synthesized
aacttgaaacttatttcacgca

SEQ ID NO: 1056153 - DNA, 22 bp, Artificial Sequence
  chemically synthesized
atccctcaaacatctgcgtgaa

SEQ ID NO: 1056154 - DNA, 22 bp, Artificial Sequence
  chemically synthesized
gaaacttatttcacgcagatgt

SEQ ID NO: 1056155 - DNA, 22 bp, Artificial Sequence
  chemically synthesized
aaacttatttcacgcagatgtt

SEQ ID NO: 1056156 - DNA, 22 bp, Artificial Sequence
  chemically synthesized
atttcacgcagatgtttgaggg

SEQ ID NO: 1056157 - DNA, 22 bp, Artificial Sequence
  chemically synthesized
tttcacgcagatgtttgaggga

SEQ ID NO: 1056158 - DNA, 22 bp, Artificial Sequence
  chemically synthesized
cacgcagatgtttgagggatta

SEQ ID NO: 1056159 - DNA, 22 bp, Artificial Sequence
  chemically synthesized
acgcagatgtttgagggattaa

SEQ ID NO: 1056160 - DNA, 22 bp, Artificial Sequence
  chemically synthesized
gaaatgaaaatataattaatcc

SEQ ID NO: 1056161 - DNA, 22 bp, Artificial Sequence
  chemically synthesized
gagggattaattatattttcat

SEQ ID NO: 1056162 - DNA, 22 bp, Artificial Sequence
  chemically synthesized
agggattaattatattttcatt

SEQ ID NO: 1056163 - DNA, 22 bp, Artificial Sequence
  chemically synthesized
aaaaaacaaagtctggaaatga

SEQ ID NO: 1056164 - DNA, 22 bp, Artificial Sequence
  chemically synthesized
gaaaaaacaaagtctggaaatg

SEQ ID NO: 1056165 - DNA, 22 bp, Artificial Sequence
  chemically synthesized
attatattttcatttccagact

SEQ ID NO: 1056166 - DNA, 22 bp, Artificial Sequence
  chemically synthesized
tattttcatttccagactttgt

SEQ ID NO: 1056167 - DNA, 22 bp, Artificial Sequence
  chemically synthesized
tcatttccagactttgtttttt

SEQ ID NO: 1056168 - DNA, 22 bp, Artificial Sequence
  chemically synthesized
catttccagactttgttttttc

SEQ ID NO: 1056169 - DNA, 22 bp, Artificial Sequence
  chemically synthesized
atttccagactttgttttttca

SEQ ID NO: 1056170 - DNA, 22 bp, Artificial Sequence
  chemically synthesized
ccagactttgttttttcaaatc

SEQ ID NO: 1056171 - DNA, 22 bp, Artificial Sequence
  chemically synthesized
cagactttgttttttcaaatct

SEQ ID NO: 1056172 - DNA, 22 bp, Artificial Sequence
  chemically synthesized
tataaagtgaaaacgaagattt

SEQ ID NO: 1056173 - DNA, 22 bp, Artificial Sequence
  chemically synthesized
tgttttttcaaatcttcgtttt

SEQ ID NO: 1056174 - DNA, 22 bp, Artificial Sequence
  chemically synthesized
gttttttcaaatcttcgttttc

SEQ ID NO: 1056175 - DNA, 22 bp, Artificial Sequence
  chemically synthesized
ttttttcaaatcttcgttttca

SEQ ID NO: 1056176 - DNA, 22 bp, Artificial Sequence
  chemically synthesized
tttcaaatcttcgttttcactt

SEQ ID NO: 1056177 - DNA, 22 bp, Artificial Sequence
  chemically synthesized
ttcaaatcttcgttttcacttt

SEQ ID NO: 1056178 - DNA, 22 bp, Artificial Sequence
  chemically synthesized
tcaaatcttcgttttcacttta

SEQ ID NO: 1056179 - DNA, 22 bp, Artificial Sequence
  chemically synthesized
caaatcttcgttttcactttat

SEQ ID NO: 1056180 - DNA, 22 bp, Artificial Sequence
  chemically synthesized
aaatcttcgttttcactttata

SEQ ID NO: 1056181 - DNA, 22 bp, Artificial Sequence
  chemically synthesized
cgttttcactttatataatggc

SEQ ID NO: 1056182 - DNA, 22 bp, Artificial Sequence
  chemically synthesized
cagtaagaataggccattatat

SEQ ID NO: 1056183 - DNA, 22 bp, Artificial Sequence
  chemically synthesized
gttttcactttatataatggcc

SEQ ID NO: 1056184 - DNA, 22 bp, Artificial Sequence
  chemically synthesized
ccagtaagaataggccattata

SEQ ID NO: 1056185 - DNA, 22 bp, Artificial Sequence
  chemically synthesized
tccagtaagaataggccattat

SEQ ID NO: 1056186 - DNA, 22 bp, Artificial Sequence
  chemically synthesized
ttccagtaagaataggccatta

SEQ ID NO: 1056187 - DNA, 22 bp, Artificial Sequence
  chemically synthesized
tttccagtaagaataggccatt

SEQ ID NO: 1056188 - DNA, 22 bp, Artificial Sequence
  chemically synthesized
tcactttatataatggcctatt

SEQ ID NO: 1056189 - DNA, 22 bp, Artificial Sequence
  chemically synthesized
ttttccagtaagaataggccat

SEQ ID NO: 1056190 - DNA, 22 bp, Artificial Sequence
  chemically synthesized
cactttatataatggcctattc

SEQ ID NO: 1056191 - DNA, 22 bp, Artificial Sequence
  chemically synthesized
actttatataatggcctattct

SEQ ID NO: 1056192 - DNA, 22 bp, Artificial Sequence
  chemically synthesized
tatataatggcctattcttact

SEQ ID NO: 1056193 - DNA, 22 bp, Artificial Sequence
  chemically synthesized
atataatggcctattcttactg

SEQ ID NO: 1056194 - DNA, 22 bp, Artificial Sequence
  chemically synthesized
tataatggcctattcttactgg

SEQ ID NO: 1056195 - DNA, 22 bp, Artificial Sequence
  chemically synthesized
aatggatttttttccagtaaga

SEQ ID NO: 1056196 - DNA, 22 bp, Artificial Sequence
  chemically synthesized
ttcttactggaaaaaaatccat

SEQ ID NO: 1056197 - DNA, 22 bp, Artificial Sequence
  chemically synthesized
ttactggaaaaaaatccattta

SEQ ID NO: 1056198 - DNA, 22 bp, Artificial Sequence
  chemically synthesized
aaaaataaaaattaaatggatt

SEQ ID NO: 1056199 - DNA, 22 bp, Artificial Sequence
  chemically synthesized
actggaaaaaaatccatttaat

SEQ ID NO: 1056200 - DNA, 22 bp, Artificial Sequence
  chemically synthesized
ctggaaaaaaatccatttaatt

SEQ ID NO: 1056201 - DNA, 22 bp, Artificial Sequence
  chemically synthesized
gaaaaaaatccatttaattttt

SEQ ID NO: 1056202 - DNA, 22 bp, Artificial Sequence
  chemically synthesized
atgttcaaaaataaaaattaaa

SEQ ID NO: 1056203 - DNA, 22 bp, Artificial Sequence
  chemically synthesized
aatgttcaaaaataaaaattaa

SEQ ID NO: 1056204 - DNA, 22 bp, Artificial Sequence
  chemically synthesized
taatgttcaaaaataaaaatta

SEQ ID NO: 1056205 - DNA, 22 bp, Artificial Sequence
  chemically synthesized
ttaatgttcaaaaataaaaatt

SEQ ID NO: 1056206 - DNA, 22 bp, Artificial Sequence
  chemically synthesized
agtaatttttaatgttcaaaaa

SEQ ID NO: 1056207 - DNA, 22 bp, Artificial Sequence
  chemically synthesized
aatttttatttttgaacattaa

SEQ ID NO: 1056208 - DNA, 22 bp, Artificial Sequence
  chemically synthesized
atttttatttttgaacattaaa

SEQ ID NO: 1056209 - DNA, 22 bp, Artificial Sequence
  chemically synthesized
ttatttttgaacattaaaaatt

SEQ ID NO: 1056210 - DNA, 22 bp, Artificial Sequence
  chemically synthesized
tatttttgaacattaaaaatta

SEQ ID NO: 1056211 - DNA, 22 bp, Artificial Sequence
  chemically synthesized
atttttgaacattaaaaattac

SEQ ID NO: 1056212 - DNA, 22 bp, Artificial Sequence
  chemically synthesized
tttttgaacattaaaaattact

SEQ ID NO: 1056213 - DNA, 22 bp, Artificial Sequence
  chemically synthesized
ttgaacattaaaaattacttaa

SEQ ID NO: 1056214 - DNA, 22 bp, Artificial Sequence
  chemically synthesized
tgaacattaaaaattacttaat

SEQ ID NO: 1056215 - DNA, 22 bp, Artificial Sequence
  chemically synthesized
gaacattaaaaattacttaata

SEQ ID NO: 1056216 - DNA, 22 bp, Artificial Sequence
  chemically synthesized
aacattaaaaattacttaatat

SEQ ID NO: 1056217 - DNA, 22 bp, Artificial Sequence
  chemically synthesized
aaaattacttaatatcctttgg

SEQ ID NO: 1056218 - DNA, 22 bp, Artificial Sequence
  chemically synthesized
cttaatatcctttggtgattat

SEQ ID NO: 1056219 - DNA, 22 bp, Artificial Sequence
  chemically synthesized
aatatcctttggtgattatcct

SEQ ID NO: 1056220 - DNA, 22 bp, Artificial Sequence
  chemically synthesized
atatcctttggtgattatcctc

SEQ ID NO: 1056221 - DNA, 22 bp, Artificial Sequence
  chemically synthesized
aagaaaatagagataagaggat

SEQ ID NO: 1056222 - DNA, 22 bp, Artificial Sequence
  chemically synthesized
tggtgattatcctcttatctct

SEQ ID NO: 1056223 - DNA, 22 bp, Artificial Sequence
  chemically synthesized
ggtgattatcctcttatctcta

SEQ ID NO: 1056224 - DNA, 22 bp, Artificial Sequence
  chemically synthesized
gtgattatcctcttatctctat

SEQ ID NO: 1056225 - DNA, 22 bp, Artificial Sequence
  chemically synthesized
tcctcttatctctattttcttc

SEQ ID NO: 1056226 - DNA, 22 bp, Artificial Sequence
  chemically synthesized
ttatctctattttcttcaggta

SEQ ID NO: 1056227 - DNA, 22 bp, Artificial Sequence
  chemically synthesized
aaaggagaatgtatacctgaag

SEQ ID NO: 1056228 - DNA, 22 bp, Artificial Sequence
  chemically synthesized
atctctattttcttcaggtata

SEQ ID NO: 1056229 - DNA, 22 bp, Artificial Sequence
  chemically synthesized
tctctattttcttcaggtatac

SEQ ID NO: 1056230 - DNA, 22 bp, Artificial Sequence
  chemically synthesized
tattttcttcaggtatacattc

SEQ ID NO: 1056231 - DNA, 22 bp, Artificial Sequence
  chemically synthesized
ttttcttcaggtatacattctc

SEQ ID NO: 1056232 - DNA, 22 bp, Artificial Sequence
  chemically synthesized
tcttcaggtatacattctcctt

SEQ ID NO: 1056233 - DNA, 22 bp, Artificial Sequence
  chemically synthesized
cttcaggtatacattctccttt

SEQ ID NO: 1056234 - DNA, 22 bp, Artificial Sequence
  chemically synthesized
ttcaggtatacattctcctttt

SEQ ID NO: 1056235 - DNA, 22 bp, Artificial Sequence
  chemically synthesized
caggtatacattctccttttaa

SEQ ID NO: 1056236 - DNA, 22 bp, Artificial Sequence
  chemically synthesized
aggtatacattctccttttaac

SEQ ID NO: 1056237 - DNA, 22 bp, Artificial Sequence
  chemically synthesized
tcagatgccaaacgttaaaagg

SEQ ID NO: 1056238 - DNA, 22 bp, Artificial Sequence
  chemically synthesized
tccttttaacgtttggcatctg

SEQ ID NO: 1056239 - DNA, 22 bp, Artificial Sequence
  chemically synthesized
taagcaatgttatcagatgcca

SEQ ID NO: 1056240 - DNA, 22 bp, Artificial Sequence
  chemically synthesized
cttttaacgtttggcatctgat

SEQ ID NO: 1056241 - DNA, 22 bp, Artificial Sequence
  chemically synthesized
ttaacgtttggcatctgataac

SEQ ID NO: 1056242 - DNA, 22 bp, Artificial Sequence
  chemically synthesized
taacgtttggcatctgataaca

SEQ ID NO: 1056243 - DNA, 22 bp, Artificial Sequence
  chemically synthesized
aacgtttggcatctgataacat

SEQ ID NO: 1056244 - DNA, 22 bp, Artificial Sequence
  chemically synthesized
acgtttggcatctgataacatt

SEQ ID NO: 1056245 - DNA, 22 bp, Artificial Sequence
  chemically synthesized
ggcatctgataacattgcttat

SEQ ID NO: 1056246 - DNA, 22 bp, Artificial Sequence
  chemically synthesized
tggaaaaaaattataagcaatg

SEQ ID NO: 1056247 - DNA, 22 bp, Artificial Sequence
  chemically synthesized
gcatctgataacattgcttata

SEQ ID NO: 1056248 - DNA, 22 bp, Artificial Sequence
  chemically synthesized
ttgtggaaaaaaattataagca

SEQ ID NO: 1056249 - DNA, 22 bp, Artificial Sequence
  chemically synthesized
ataacattgcttataatttttt

SEQ ID NO: 1056250 - DNA, 22 bp, Artificial Sequence
  chemically synthesized
tgattattgtggaaaaaaatta

SEQ ID NO: 1056251 - DNA, 22 bp, Artificial Sequence
  chemically synthesized
aaattatgattattgtggaaaa

SEQ ID NO: 1056252 - DNA, 22 bp, Artificial Sequence
  chemically synthesized
cttataatttttttccacaata

SEQ ID NO: 1056253 - DNA, 22 bp, Artificial Sequence
  chemically synthesized
ataatttttttccacaataatc

SEQ ID NO: 1056254 - DNA, 22 bp, Artificial Sequence
  chemically synthesized
taatttttttccacaataatca

SEQ ID NO: 1056255 - DNA, 22 bp, Artificial Sequence
  chemically synthesized
caaactaaaattatgattattg

SEQ ID NO: 1056256 - DNA, 22 bp, Artificial Sequence
  chemically synthesized
acaaactaaaattatgattatt

SEQ ID NO: 1056257 - DNA, 22 bp, Artificial Sequence
  chemically synthesized
ttttccacaataatcataattt

SEQ ID NO: 1056258 - DNA, 22 bp, Artificial Sequence
  chemically synthesized
tttccacaataatcataatttt

SEQ ID NO: 1056259 - DNA, 22 bp, Artificial Sequence
  chemically synthesized
ttccacaataatcataatttta

SEQ ID NO: 1056260 - DNA, 22 bp, Artificial Sequence
  chemically synthesized
tccacaataatcataattttag

SEQ ID NO: 1056261 - DNA, 22 bp, Artificial Sequence
  chemically synthesized
ccacaataatcataattttagt

SEQ ID NO: 1056262 - DNA, 22 bp, Artificial Sequence
  chemically synthesized
cacaataatcataattttagtt

SEQ ID NO: 1056263 - DNA, 22 bp, Artificial Sequence
  chemically synthesized
aggaacataagcttacaaacta

SEQ ID NO: 1056264 - DNA, 22 bp, Artificial Sequence
  chemically synthesized
ctaaggaacataagcttacaaa

SEQ ID NO: 1056265 - DNA, 22 bp, Artificial Sequence
  chemically synthesized
tagtttgtaagcttatgttcct

SEQ ID NO: 1056266 - DNA, 22 bp, Artificial Sequence
  chemically synthesized
agtttgtaagcttatgttcctt

SEQ ID NO: 1056267 - DNA, 22 bp, Artificial Sequence
  chemically synthesized
gtttgtaagcttatgttcctta

SEQ ID NO: 1056268 - DNA, 22 bp, Artificial Sequence
  chemically synthesized
gtaagcttatgttccttagcag

SEQ ID NO: 1056269 - DNA, 22 bp, Artificial Sequence
  chemically synthesized
taagcttatgttccttagcagt

SEQ ID NO: 1056270 - DNA, 22 bp, Artificial Sequence
  chemically synthesized
atgttccttagcagtttcacat

SEQ ID NO: 1056271 - DNA, 22 bp, Artificial Sequence
  chemically synthesized
tgttccttagcagtttcacatg

SEQ ID NO: 1056272 - DNA, 22 bp, Artificial Sequence
  chemically synthesized
caacccccaagggtcatgtgaa

SEQ ID NO: 1056273 - DNA, 22 bp, Artificial Sequence
  chemically synthesized
cttagcagtttcacatgaccct

SEQ ID NO: 1056274 - DNA, 22 bp, Artificial Sequence
  chemically synthesized
agcagtttcacatgacccttgg

SEQ ID NO: 1056275 - DNA, 22 bp, Artificial Sequence
  chemically synthesized
gcagtttcacatgacccttggg

SEQ ID NO: 1056276 - DNA, 22 bp, Artificial Sequence
  chemically synthesized
cacatgacccttgggggttgta

SEQ ID NO: 1056277 - DNA, 22 bp, Artificial Sequence
  chemically synthesized
acatgacccttgggggttgtag

SEQ ID NO: 1056278 - DNA, 22 bp, Artificial Sequence
  chemically synthesized
tacaatgaagataccactacaa

SEQ ID NO: 1056279 - DNA, 22 bp, Artificial Sequence
  chemically synthesized
gggggttgtagtggtatcttca

SEQ ID NO: 1056280 - DNA, 22 bp, Artificial Sequence
  chemically synthesized
ggggttgtagtggtatcttcat

SEQ ID NO: 1056281 - DNA, 22 bp, Artificial Sequence
  chemically synthesized
caaacacaaaattatacaatga

SEQ ID NO: 1056282 - DNA, 22 bp, Artificial Sequence
  chemically synthesized
tagtggtatcttcattgtataa

SEQ ID NO: 1056283 - DNA, 22 bp, Artificial Sequence
  chemically synthesized
gcaaacacaaaattatacaatg

SEQ ID NO: 1056284 - DNA, 22 bp, Artificial Sequence
  chemically synthesized
cattgtataattttgtgtttgc

SEQ ID NO: 1056285 - DNA, 22 bp, Artificial Sequence
  chemically synthesized
attgtataattttgtgtttgca

SEQ ID NO: 1056286 - DNA, 22 bp, Artificial Sequence
  chemically synthesized
tataattttgtgtttgcaaatg

SEQ ID NO: 1056287 - DNA, 22 bp, Artificial Sequence
  chemically synthesized
agagagcccaggcatttgcaaa

SEQ ID NO: 1056288 - DNA, 22 bp, Artificial Sequence
  chemically synthesized
tgtgtttgcaaatgcctgggct

SEQ ID NO: 1056289 - DNA, 22 bp, Artificial Sequence
  chemically synthesized
gtgtttgcaaatgcctgggctc

SEQ ID NO: 1056290 - DNA, 22 bp, Artificial Sequence
  chemically synthesized
tgtttgcaaatgcctgggctct

SEQ ID NO: 1056291 - DNA, 22 bp, Artificial Sequence
  chemically synthesized
gaaaataacctcagagagccca

SEQ ID NO: 1056292 - DNA, 22 bp, Artificial Sequence
  chemically synthesized
ggaaaataacctcagagagccc

SEQ ID NO: 1056293 - DNA, 22 bp, Artificial Sequence
  chemically synthesized
gcaaatgcctgggctctctgag

SEQ ID NO: 1056294 - DNA, 22 bp, Artificial Sequence
  chemically synthesized
caaatgcctgggctctctgagg

SEQ ID NO: 1056295 - DNA, 22 bp, Artificial Sequence
  chemically synthesized
tagcatttggaaaataacctca

SEQ ID NO: 1056296 - DNA, 22 bp, Artificial Sequence
  chemically synthesized
ggctctctgaggttattttcca

SEQ ID NO: 1056297 - DNA, 22 bp, Artificial Sequence
  chemically synthesized
acatcattgtagcatttggaaa

SEQ ID NO: 1056298 - DNA, 22 bp, Artificial Sequence
  chemically synthesized
tctgaggttattttccaaatgc

SEQ ID NO: 1056299 - DNA, 22 bp, Artificial Sequence
  chemically synthesized
tgaggttattttccaaatgcta

SEQ ID NO: 1056300 - DNA, 22 bp, Artificial Sequence
  chemically synthesized
aggttattttccaaatgctaca

SEQ ID NO: 1056301 - DNA, 22 bp, Artificial Sequence
  chemically synthesized
cccctcacatcattgtagcatt

SEQ ID NO: 1056302 - DNA, 22 bp, Artificial Sequence
  chemically synthesized
ttttccaaatgctacaatgatg

SEQ ID NO: 1056303 - DNA, 22 bp, Artificial Sequence
  chemically synthesized
aactgcccctcacatcattgta

SEQ ID NO: 1056304 - DNA, 22 bp, Artificial Sequence
  chemically synthesized
tccaaatgctacaatgatgtga

SEQ ID NO: 1056305 - DNA, 22 bp, Artificial Sequence
  chemically synthesized
ccaaatgctacaatgatgtgag

SEQ ID NO: 1056306 - DNA, 22 bp, Artificial Sequence
  chemically synthesized
cctaaactgcccctcacatcat

SEQ ID NO: 1056307 - DNA, 22 bp, Artificial Sequence
  chemically synthesized
caaatgctacaatgatgtgagg

SEQ ID NO: 1056308 - DNA, 22 bp, Artificial Sequence
  chemically synthesized
ccctaaactgcccctcacatca

SEQ ID NO: 1056309 - DNA, 22 bp, Artificial Sequence
  chemically synthesized
tccctaaactgcccctcacatc

SEQ ID NO: 1056310 - DNA, 22 bp, Artificial Sequence
  chemically synthesized
caatgatgtgaggggcagttta

SEQ ID NO: 1056311 - DNA, 22 bp, Artificial Sequence
  chemically synthesized
ccaagaaagggcatgattttcc

SEQ ID NO: 1056312 - DNA, 22 bp, Artificial Sequence
  chemically synthesized
atgactgccaagaaagggcatg

SEQ ID NO: 1056313 - DNA, 22 bp, Artificial Sequence
  chemically synthesized
agggaaaatcatgccctttctt

SEQ ID NO: 1056314 - DNA, 22 bp, Artificial Sequence
  chemically synthesized
gggaaaatcatgccctttcttg

SEQ ID NO: 1056315 - DNA, 22 bp, Artificial Sequence
  chemically synthesized
tcttggcagtcatcagatttgt

SEQ ID NO: 1056316 - DNA, 22 bp, Artificial Sequence
  chemically synthesized
cttggcagtcatcagatttgtg

SEQ ID NO: 1056317 - DNA, 22 bp, Artificial Sequence
  chemically synthesized
ttggcagtcatcagatttgtgt

SEQ ID NO: 1056318 - DNA, 22 bp, Artificial Sequence
  chemically synthesized
ggcagtcatcagatttgtgtga

SEQ ID NO: 1056319 - DNA, 22 bp, Artificial Sequence
  chemically synthesized
gcagtcatcagatttgtgtgat

SEQ ID NO: 1056320 - DNA, 22 bp, Artificial Sequence
  chemically synthesized
acagaataaacacaggaaatat

SEQ ID NO: 1056321 - DNA, 22 bp, Artificial Sequence
  chemically synthesized
gattcacagaataaacacagga

SEQ ID NO: 1056322 - DNA, 22 bp, Artificial Sequence
  chemically synthesized
gtgtgatatttcctgtgtttat

SEQ ID NO: 1056323 - DNA, 22 bp, Artificial Sequence
  chemically synthesized
tagattcacagaataaacacag

SEQ ID NO: 1056324 - DNA, 22 bp, Artificial Sequence
  chemically synthesized
tgtgatatttcctgtgtttatt

SEQ ID NO: 1056325 - DNA, 22 bp, Artificial Sequence
  chemically synthesized
tctagattcacagaataaacac

SEQ ID NO: 1056326 - DNA, 22 bp, Artificial Sequence
  chemically synthesized
ctctagattcacagaataaaca

SEQ ID NO: 1056327 - DNA, 22 bp, Artificial Sequence
  chemically synthesized
tctctagattcacagaataaac

SEQ ID NO: 1056328 - DNA, 22 bp, Artificial Sequence
  chemically synthesized
ttctctagattcacagaataaa

SEQ ID NO: 1056329 - DNA, 22 bp, Artificial Sequence
  chemically synthesized
cctgtgtttattctgtgaatct

SEQ ID NO: 1056330 - DNA, 22 bp, Artificial Sequence
  chemically synthesized
ctgtgtttattctgtgaatcta

SEQ ID NO: 1056331 - DNA, 22 bp, Artificial Sequence
  chemically synthesized
tgtttattctgtgaatctagag

SEQ ID NO: 1056332 - DNA, 22 bp, Artificial Sequence
  chemically synthesized
attctgtgaatctagagaaaag

SEQ ID NO: 1056333 - DNA, 22 bp, Artificial Sequence
  chemically synthesized
ttctgtgaatctagagaaaagt

SEQ ID NO: 1056334 - DNA, 22 bp, Artificial Sequence
  chemically synthesized
tgtgaatctagagaaaagtatc

SEQ ID NO: 1056335 - DNA, 22 bp, Artificial Sequence
  chemically synthesized
taatatataagcagatactttt

SEQ ID NO: 1056336 - DNA, 22 bp, Artificial Sequence
  chemically synthesized
tgaatctagagaaaagtatctg

SEQ ID NO: 1056337 - DNA, 22 bp, Artificial Sequence
  chemically synthesized
tataatatataagcagatactt

SEQ ID NO: 1056338 - DNA, 22 bp, Artificial Sequence
  chemically synthesized
attctataatatataagcagat

SEQ ID NO: 1056339 - DNA, 22 bp, Artificial Sequence
  chemically synthesized
aattctataatatataagcaga

SEQ ID NO: 1056340 - DNA, 22 bp, Artificial Sequence
  chemically synthesized
gagaaaagtatctgcttatata

SEQ ID NO: 1056341 - DNA, 22 bp, Artificial Sequence
  chemically synthesized
aaatttaattctataatatata

SEQ ID NO: 1056342 - DNA, 22 bp, Artificial Sequence
  chemically synthesized
caaatttaattctataatatat

SEQ ID NO: 1056343 - DNA, 22 bp, Artificial Sequence
  chemically synthesized
cttatatattatagaattaaat

SEQ ID NO: 1056344 - DNA, 22 bp, Artificial Sequence
  chemically synthesized
agtgaaaatttcaaatttaatt

SEQ ID NO: 1056345 - DNA, 22 bp, Artificial Sequence
  chemically synthesized
atatattatagaattaaatttg

SEQ ID NO: 1056346 - DNA, 22 bp, Artificial Sequence
  chemically synthesized
tatattatagaattaaatttga

SEQ ID NO: 1056347 - DNA, 22 bp, Artificial Sequence
  chemically synthesized
gttcagtgaaaatttcaaattt

SEQ ID NO: 1056348 - DNA, 22 bp, Artificial Sequence
  chemically synthesized
tagaattaaatttgaaattttc

SEQ ID NO: 1056349 - DNA, 22 bp, Artificial Sequence
  chemically synthesized
aatttgaaattttcactgaacg

SEQ ID NO: 1056350 - DNA, 22 bp, Artificial Sequence
  chemically synthesized
acaacagatatctcgttcagtg

SEQ ID NO: 1056351 - DNA, 22 bp, Artificial Sequence
  chemically synthesized
gaaattttcactgaacgagata

SEQ ID NO: 1056352 - DNA, 22 bp, Artificial Sequence
  chemically synthesized
aaattttcactgaacgagatat

SEQ ID NO: 1056353 - DNA, 22 bp, Artificial Sequence
  chemically synthesized
aaatgttaacaacagatatctc

SEQ ID NO: 1056354 - DNA, 22 bp, Artificial Sequence
  chemically synthesized
aaaatgttaacaacagatatct

SEQ ID NO: 1056355 - DNA, 22 bp, Artificial Sequence
  chemically synthesized
tcactgaacgagatatctgttg

SEQ ID NO: 1056356 - DNA, 22 bp, Artificial Sequence
  chemically synthesized
cactgaacgagatatctgttgt

SEQ ID NO: 1056357 - DNA, 22 bp, Artificial Sequence
  chemically synthesized
tttaaaatgttaacaacagata

SEQ ID NO: 1056358 - DNA, 22 bp, Artificial Sequence
  chemically synthesized
actgaacgagatatctgttgtt

SEQ ID NO: 1056359 - DNA, 22 bp, Artificial Sequence
  chemically synthesized
gtttaaaatgttaacaacagat

SEQ ID NO: 1056360 - DNA, 22 bp, Artificial Sequence
  chemically synthesized
aacgagatatctgttgttaaca

SEQ ID NO: 1056361 - DNA, 22 bp, Artificial Sequence
  chemically synthesized
agtacgcagcatttgtttaaaa

SEQ ID NO: 1056362 - DNA, 22 bp, Artificial Sequence
  chemically synthesized
ttgttaacattttaaacaaatg

SEQ ID NO: 1056363 - DNA, 22 bp, Artificial Sequence
  chemically synthesized
ttaacattttaaacaaatgctg

SEQ ID NO: 1056364 - DNA, 22 bp, Artificial Sequence
  chemically synthesized
acattttaaacaaatgctgcgt

SEQ ID NO: 1056365 - DNA, 22 bp, Artificial Sequence
  chemically synthesized
agagaattaagtacgcagcatt

SEQ ID NO: 1056366 - DNA, 22 bp, Artificial Sequence
  chemically synthesized
taaacaaatgctgcgtacttaa

SEQ ID NO: 1056367 - DNA, 22 bp, Artificial Sequence
  chemically synthesized
aaacaaatgctgcgtacttaat

SEQ ID NO: 1056368 - DNA, 22 bp, Artificial Sequence
  chemically synthesized
aacaaatgctgcgtacttaatt

SEQ ID NO: 1056369 - DNA, 22 bp, Artificial Sequence
  chemically synthesized
ataagtcattaagagaattaag

SEQ ID NO: 1056370 - DNA, 22 bp, Artificial Sequence
  chemically synthesized
cataagtcattaagagaattaa

SEQ ID NO: 1056371 - DNA, 22 bp, Artificial Sequence
  chemically synthesized
tcataagtcattaagagaatta

SEQ ID NO: 1056372 - DNA, 22 bp, Artificial Sequence
  chemically synthesized
cgtacttaattctcttaatgac

SEQ ID NO: 1056373 - DNA, 22 bp, Artificial Sequence
  chemically synthesized
aaatattttcataagtcattaa

SEQ ID NO: 1056374 - DNA, 22 bp, Artificial Sequence
  chemically synthesized
aaaatattttcataagtcatta

SEQ ID NO: 1056375 - DNA, 22 bp, Artificial Sequence
  chemically synthesized
taaaatattttcataagtcatt

SEQ ID NO: 1056376 - DNA, 22 bp, Artificial Sequence
  chemically synthesized
ttaaaatattttcataagtcat

SEQ ID NO: 1056377 - DNA, 22 bp, Artificial Sequence
  chemically synthesized
aattctcttaatgacttatgaa

SEQ ID NO: 1056378 - DNA, 22 bp, Artificial Sequence
  chemically synthesized
attctcttaatgacttatgaaa

SEQ ID NO: 1056379 - DNA, 22 bp, Artificial Sequence
  chemically synthesized
atttttaaaatattttcataag

SEQ ID NO: 1056380 - DNA, 22 bp, Artificial Sequence
  chemically synthesized
aatttttaaaatattttcataa

SEQ ID NO: 1056381 - DNA, 22 bp, Artificial Sequence
  chemically synthesized
taatttttaaaatattttcata

SEQ ID NO: 1056382 - DNA, 22 bp, Artificial Sequence
  chemically synthesized
tcttaatgacttatgaaaatat

SEQ ID NO: 1056383 - DNA, 22 bp, Artificial Sequence
  chemically synthesized
ttaatgacttatgaaaatattt

SEQ ID NO: 1056384 - DNA, 22 bp, Artificial Sequence
  chemically synthesized
aatgacttatgaaaatatttta

SEQ ID NO: 1056385 - DNA, 22 bp, Artificial Sequence
  chemically synthesized
atgacttatgaaaatattttaa

SEQ ID NO: 1056386 - DNA, 22 bp, Artificial Sequence
  chemically synthesized
atgaaaatattttaaaaattaa

SEQ ID NO: 1056387 - DNA, 22 bp, Artificial Sequence
  chemically synthesized
tgaaaatattttaaaaattaaa

SEQ ID NO: 1056388 - DNA, 22 bp, Artificial Sequence
  chemically synthesized
gaaaatagacataatctttaat

SEQ ID NO: 1056389 - DNA, 22 bp, Artificial Sequence
  chemically synthesized
acattggaaaatagacataatc

SEQ ID NO: 1056390 - DNA, 22 bp, Artificial Sequence
  chemically synthesized
taaaaattaaagattatgtcta

SEQ ID NO: 1056391 - DNA, 22 bp, Artificial Sequence
  chemically synthesized
aaaaattaaagattatgtctat

SEQ ID NO: 1056392 - DNA, 22 bp, Artificial Sequence
  chemically synthesized
aaaattaaagattatgtctatt

SEQ ID NO: 1056393 - DNA, 22 bp, Artificial Sequence
  chemically synthesized
aagattatgtctattttccaat

SEQ ID NO: 1056394 - DNA, 22 bp, Artificial Sequence
  chemically synthesized
tatatatattaacattggaaaa

SEQ ID NO: 1056395 - DNA, 22 bp, Artificial Sequence
  chemically synthesized
tgtatatatattaacattggaa

SEQ ID NO: 1056396 - DNA, 22 bp, Artificial Sequence
  chemically synthesized
ctgtatatatattaacattgga

SEQ ID NO: 1056397 - DNA, 22 bp, Artificial Sequence
  chemically synthesized
tctgtatatatattaacattgg

SEQ ID NO: 1056398 - DNA, 22 bp, Artificial Sequence
  chemically synthesized
tgtctattttccaatgttaata

SEQ ID NO: 1056399 - DNA, 22 bp, Artificial Sequence
  chemically synthesized
ctttctgtatatatattaacat

SEQ ID NO: 1056400 - DNA, 22 bp, Artificial Sequence
  chemically synthesized
ttttccaatgttaatatatata

SEQ ID NO: 1056401 - DNA, 22 bp, Artificial Sequence
  chemically synthesized
gtctcctttctgtatatatatt

SEQ ID NO: 1056402 - DNA, 22 bp, Artificial Sequence
  chemically synthesized
cgtctcctttctgtatatatat

SEQ ID NO: 1056403 - DNA, 22 bp, Artificial Sequence
  chemically synthesized
tccaatgttaatatatatacag

SEQ ID NO: 1056404 - DNA, 22 bp, Artificial Sequence
  chemically synthesized
ttcgtctcctttctgtatatat

SEQ ID NO: 1056405 - DNA, 22 bp, Artificial Sequence
  chemically synthesized
ccaatgttaatatatatacaga

SEQ ID NO: 1056406 - DNA, 22 bp, Artificial Sequence
  chemically synthesized
cttcgtctcctttctgtatata

SEQ ID NO: 1056407 - DNA, 22 bp, Artificial Sequence
  chemically synthesized
caatgttaatatatatacagaa

SEQ ID NO: 1056408 - DNA, 22 bp, Artificial Sequence
  chemically synthesized
tcttcgtctcctttctgtatat

SEQ ID NO: 1056409 - DNA, 22 bp, Artificial Sequence
  chemically synthesized
atatatatacagaaaggagacg

SEQ ID NO: 1056410 - DNA, 22 bp, Artificial Sequence
  chemically synthesized
aatgcatgaaagttttcttcgt

SEQ ID NO: 1056411 - DNA, 22 bp, Artificial Sequence
  chemically synthesized
tgcaggctcaatgcatgaaagt

SEQ ID NO: 1056412 - DNA, 22 bp, Artificial Sequence
  chemically synthesized
cgttatgcaggctcaatgcatg

SEQ ID NO: 1056413 - DNA, 22 bp, Artificial Sequence
  chemically synthesized
ctgcgttatgcaggctcaatgc

SEQ ID NO: 1056414 - DNA, 22 bp, Artificial Sequence
  chemically synthesized
tcatgcattgagcctgcataac

SEQ ID NO: 1056415 - DNA, 22 bp, Artificial Sequence
  chemically synthesized
catgcattgagcctgcataacg

SEQ ID NO: 1056416 - DNA, 22 bp, Artificial Sequence
  chemically synthesized
atgcattgagcctgcataacgc

SEQ ID NO: 1056417 - DNA, 22 bp, Artificial Sequence
  chemically synthesized
tcaaacacctgctgcgttatgc

SEQ ID NO: 1056418 - DNA, 22 bp, Artificial Sequence
  chemically synthesized
gtcaaacacctgctgcgttatg

SEQ ID NO: 1056419 - DNA, 22 bp, Artificial Sequence
  chemically synthesized
agcctgcataacgcagcaggtg

SEQ ID NO: 1056420 - DNA, 22 bp, Artificial Sequence
  chemically synthesized
cataacgcagcaggtgtttgac

SEQ ID NO: 1056421 - DNA, 22 bp, Artificial Sequence
  chemically synthesized
aataaggtaatatttgtcaaac

SEQ ID NO: 1056422 - DNA, 22 bp, Artificial Sequence
  chemically synthesized
aggattaaataaggtaatattt

SEQ ID NO: 1056423 - DNA, 22 bp, Artificial Sequence
  chemically synthesized
tgaggattaaataaggtaatat

SEQ ID NO: 1056424 - DNA, 22 bp, Artificial Sequence
  chemically synthesized
ctgaggattaaataaggtaata

SEQ ID NO: 1056425 - DNA, 22 bp, Artificial Sequence
  chemically synthesized
gacaaatattaccttatttaat

SEQ ID NO: 1056426 - DNA, 22 bp, Artificial Sequence
  chemically synthesized
acaaatattaccttatttaatc

SEQ ID NO: 1056427 - DNA, 22 bp, Artificial Sequence
  chemically synthesized
ccttatttaatcctcagaaaca

SEQ ID NO: 1056428 - DNA, 22 bp, Artificial Sequence
  chemically synthesized
atttaatcctcagaaacatcct

SEQ ID NO: 1056429 - DNA, 22 bp, Artificial Sequence
  chemically synthesized
tttaatcctcagaaacatcctt

SEQ ID NO: 1056430 - DNA, 22 bp, Artificial Sequence
  chemically synthesized
tacaatagagataaggatgttt

SEQ ID NO: 1056431 - DNA, 22 bp, Artificial Sequence
  chemically synthesized
aatcctcagaaacatccttatc

SEQ ID NO: 1056432 - DNA, 22 bp, Artificial Sequence
  chemically synthesized
atcctcagaaacatccttatct

SEQ ID NO: 1056433 - DNA, 22 bp, Artificial Sequence
  chemically synthesized
atctgtacaatagagataagga

SEQ ID NO: 1056434 - DNA, 22 bp, Artificial Sequence
  chemically synthesized
catctgtacaatagagataagg

SEQ ID NO: 1056435 - DNA, 22 bp, Artificial Sequence
  chemically synthesized
cttcatctgtacaatagagata

SEQ ID NO: 1056436 - DNA, 22 bp, Artificial Sequence
  chemically synthesized
agaaacatccttatctctattg

SEQ ID NO: 1056437 - DNA, 22 bp, Artificial Sequence
  chemically synthesized
acttcatctgtacaatagagat

SEQ ID NO: 1056438 - DNA, 22 bp, Artificial Sequence
  chemically synthesized
atttacttcatctgtacaatag

SEQ ID NO: 1056439 - DNA, 22 bp, Artificial Sequence
  chemically synthesized
agtctcatttacttcatctgta

SEQ ID NO: 1056440 - DNA, 22 bp, Artificial Sequence
  chemically synthesized
atctctattgtacagatgaagt

SEQ ID NO: 1056441 - DNA, 22 bp, Artificial Sequence
  chemically synthesized
tctctattgtacagatgaagta

SEQ ID NO: 1056442 - DNA, 22 bp, Artificial Sequence
  chemically synthesized
tattgtacagatgaagtaaatg

SEQ ID NO: 1056443 - DNA, 22 bp, Artificial Sequence
  chemically synthesized
ttgtacagatgaagtaaatgag

SEQ ID NO: 1056444 - DNA, 22 bp, Artificial Sequence
  chemically synthesized
tacagatgaagtaaatgagact

SEQ ID NO: 1056445 - DNA, 22 bp, Artificial Sequence
  chemically synthesized
tatgatcagggataaactgagt

SEQ ID NO: 1056446 - DNA, 22 bp, Artificial Sequence
  chemically synthesized
agtgctgtatgatcagggataa

SEQ ID NO: 1056447 - DNA, 22 bp, Artificial Sequence
  chemically synthesized
gagtgctgtatgatcagggata

SEQ ID NO: 1056448 - DNA, 22 bp, Artificial Sequence
  chemically synthesized
tgagtgctgtatgatcagggat

SEQ ID NO: 1056449 - DNA, 22 bp, Artificial Sequence
  chemically synthesized
agtttatccctgatcatacagc

SEQ ID NO: 1056450 - DNA, 22 bp, Artificial Sequence
  chemically synthesized
atccctgatcatacagcactca

SEQ ID NO: 1056451 - DNA, 22 bp, Artificial Sequence
  chemically synthesized
tccctgatcatacagcactcaa

SEQ ID NO: 1056452 - DNA, 22 bp, Artificial Sequence
  chemically synthesized
atcatacagcactcaaagtcac

SEQ ID NO: 1056453 - DNA, 22 bp, Artificial Sequence
  chemically synthesized
aatatgaatcccagtgactttg

SEQ ID NO: 1056454 - DNA, 22 bp, Artificial Sequence
  chemically synthesized
gaatatgaatcccagtgacttt

SEQ ID NO: 1056455 - DNA, 22 bp, Artificial Sequence
  chemically synthesized
aaagtcactgggattcatattc

SEQ ID NO: 1056456 - DNA, 22 bp, Artificial Sequence
  chemically synthesized
gataaacagccttgaatatgaa

SEQ ID NO: 1056457 - DNA, 22 bp, Artificial Sequence
  chemically synthesized
ggataaacagccttgaatatga

SEQ ID NO: 1056458 - DNA, 22 bp, Artificial Sequence
  chemically synthesized
ttggataaacagccttgaatat

SEQ ID NO: 1056459 - DNA, 22 bp, Artificial Sequence
  chemically synthesized
actcttggataaacagccttga

SEQ ID NO: 1056460 - DNA, 22 bp, Artificial Sequence
  chemically synthesized
ggattcatattcaaggctgttt

SEQ ID NO: 1056461 - DNA, 22 bp, Artificial Sequence
  chemically synthesized
atattcaaggctgtttatccaa

SEQ ID NO: 1056462 - DNA, 22 bp, Artificial Sequence
  chemically synthesized
gtaaaattaactcttggataaa

SEQ ID NO: 1056463 - DNA, 22 bp, Artificial Sequence
  chemically synthesized
aaggctgtttatccaagagtta

SEQ ID NO: 1056464 - DNA, 22 bp, Artificial Sequence
  chemically synthesized
tttatccaagagttaattttac

SEQ ID NO: 1056465 - DNA, 22 bp, Artificial Sequence
  chemically synthesized
atccaagagttaattttactag

SEQ ID NO: 1056466 - DNA, 22 bp, Artificial Sequence
  chemically synthesized
tccaagagttaattttactaga

SEQ ID NO: 1056467 - DNA, 22 bp, Artificial Sequence
  chemically synthesized
tcacagcagtgtggtctagtaa

SEQ ID NO: 1056468 - DNA, 22 bp, Artificial Sequence
  chemically synthesized
attttactagaccacactgctg

SEQ ID NO: 1056469 - DNA, 22 bp, Artificial Sequence
  chemically synthesized
taggatgtactatcacagcagt

SEQ ID NO: 1056470 - DNA, 22 bp, Artificial Sequence
  chemically synthesized
tactagaccacactgctgtgat

SEQ ID NO: 1056471 - DNA, 22 bp, Artificial Sequence
  chemically synthesized
actagaccacactgctgtgata

SEQ ID NO: 1056472 - DNA, 22 bp, Artificial Sequence
  chemically synthesized
tataggatgtactatcacagca

SEQ ID NO: 1056473 - DNA, 22 bp, Artificial Sequence
  chemically synthesized
ctagaccacactgctgtgatag

SEQ ID NO: 1056474 - DNA, 22 bp, Artificial Sequence
  chemically synthesized
gaccacactgctgtgatagtac

SEQ ID NO: 1056475 - DNA, 22 bp, Artificial Sequence
  chemically synthesized
ctgtgatagtacatcctataga

SEQ ID NO: 1056476 - DNA, 22 bp, Artificial Sequence
  chemically synthesized
tgatagtacatcctatagaact

SEQ ID NO: 1056477 - DNA, 22 bp, Artificial Sequence
  chemically synthesized
aggaaaagggatagttctatag

SEQ ID NO: 1056478 - DNA, 22 bp, Artificial Sequence
  chemically synthesized
taaactgaggaaaagggatagt

SEQ ID NO: 1056479 - DNA, 22 bp, Artificial Sequence
  chemically synthesized
tagaactatcccttttcctcag

SEQ ID NO: 1056480 - DNA, 22 bp, Artificial Sequence
  chemically synthesized
tcccttttcctcagtttacagt

SEQ ID NO: 1056481 - DNA, 22 bp, Artificial Sequence
  chemically synthesized
agaccaagcacggactgtaaac

SEQ ID NO: 1056482 - DNA, 22 bp, Artificial Sequence
  chemically synthesized
ttcctcagtttacagtccgtgc

SEQ ID NO: 1056483 - DNA, 22 bp, Artificial Sequence
  chemically synthesized
agttaagaccaagcacggactg

SEQ ID NO: 1056484 - DNA, 22 bp, Artificial Sequence
  chemically synthesized
tcctcagtttacagtccgtgct

SEQ ID NO: 1056485 - DNA, 22 bp, Artificial Sequence
  chemically synthesized
cctcagtttacagtccgtgctt

SEQ ID NO: 1056486 - DNA, 22 bp, Artificial Sequence
  chemically synthesized
ctcagtttacagtccgtgcttg

SEQ ID NO: 1056487 - DNA, 22 bp, Artificial Sequence
  chemically synthesized
ctcagttaagaccaagcacgga

SEQ ID NO: 1056488 - DNA, 22 bp, Artificial Sequence
  chemically synthesized
agtttacagtccgtgcttggtc

SEQ ID NO: 1056489 - DNA, 22 bp, Artificial Sequence
  chemically synthesized
ggttcctcagttaagaccaagc

SEQ ID NO: 1056490 - DNA, 22 bp, Artificial Sequence
  chemically synthesized
acagtccgtgcttggtcttaac

SEQ ID NO: 1056491 - DNA, 22 bp, Artificial Sequence
  chemically synthesized
cagtccgtgcttggtcttaact

SEQ ID NO: 1056492 - DNA, 22 bp, Artificial Sequence
  chemically synthesized
gaaactaggttcctcagttaag

SEQ ID NO: 1056493 - DNA, 22 bp, Artificial Sequence
  chemically synthesized
agaaactaggttcctcagttaa

SEQ ID NO: 1056494 - DNA, 22 bp, Artificial Sequence
  chemically synthesized
gtttagaaactaggttcctcag

SEQ ID NO: 1056495 - DNA, 22 bp, Artificial Sequence
  chemically synthesized
ttggtttagaaactaggttcct

SEQ ID NO: 1056496 - DNA, 22 bp, Artificial Sequence
  chemically synthesized
ggtcttaactgaggaacctagt

SEQ ID NO: 1056497 - DNA, 22 bp, Artificial Sequence
  chemically synthesized
gtcttaactgaggaacctagtt

SEQ ID NO: 1056498 - DNA, 22 bp, Artificial Sequence
  chemically synthesized
ctgttggtttagaaactaggtt

SEQ ID NO: 1056499 - DNA, 22 bp, Artificial Sequence
  chemically synthesized
cctgttggtttagaaactaggt

SEQ ID NO: 1056500 - DNA, 22 bp, Artificial Sequence
  chemically synthesized
aactgaggaacctagtttctaa

SEQ ID NO: 1056501 - DNA, 22 bp, Artificial Sequence
  chemically synthesized
actgaggaacctagtttctaaa

SEQ ID NO: 1056502 - DNA, 22 bp, Artificial Sequence
  chemically synthesized
aggaacctagtttctaaaccaa

SEQ ID NO: 1056503 - DNA, 22 bp, Artificial Sequence
  chemically synthesized
atatatttcctgttggtttaga

SEQ ID NO: 1056504 - DNA, 22 bp, Artificial Sequence
  chemically synthesized
taatatatttcctgttggttta

SEQ ID NO: 1056505 - DNA, 22 bp, Artificial Sequence
  chemically synthesized
ctaatatatttcctgttggttt

SEQ ID NO: 1056506 - DNA, 22 bp, Artificial Sequence
  chemically synthesized
gtttctaaaccaacaggaaata

SEQ ID NO: 1056507 - DNA, 22 bp, Artificial Sequence
  chemically synthesized
caatcatttctaatatatttcc

SEQ ID NO: 1056508 - DNA, 22 bp, Artificial Sequence
  chemically synthesized
ctaaaccaacaggaaatatatt

SEQ ID NO: 1056509 - DNA, 22 bp, Artificial Sequence
  chemically synthesized
taaaccaacaggaaatatatta

SEQ ID NO: 1056510 - DNA, 22 bp, Artificial Sequence
  chemically synthesized
aaccaacaggaaatatattaga

SEQ ID NO: 1056511 - DNA, 22 bp, Artificial Sequence
  chemically synthesized
ggaattccaatcatttctaata

SEQ ID NO: 1056512 - DNA, 22 bp, Artificial Sequence
  chemically synthesized
attaggaattccaatcatttct

SEQ ID NO: 1056513 - DNA, 22 bp, Artificial Sequence
  chemically synthesized
aattaggaattccaatcatttc

SEQ ID NO: 1056514 - DNA, 22 bp, Artificial Sequence
  chemically synthesized
ccttaattaggaattccaatca

SEQ ID NO: 1056515 - DNA, 22 bp, Artificial Sequence
  chemically synthesized
ctgccttaattaggaattccaa

SEQ ID NO: 1056516 - DNA, 22 bp, Artificial Sequence
  chemically synthesized
gaaatgattggaattcctaatt

SEQ ID NO: 1056517 - DNA, 22 bp, Artificial Sequence
  chemically synthesized
gaattcctaattaaggcaggag

SEQ ID NO: 1056518 - DNA, 22 bp, Artificial Sequence
  chemically synthesized
aaaatgagagaactcctgcctt

SEQ ID NO: 1056519 - DNA, 22 bp, Artificial Sequence
  chemically synthesized
ctaattaaggcaggagttctct

SEQ ID NO: 1056520 - DNA, 22 bp, Artificial Sequence
  chemically synthesized
attaaggcaggagttctctcat

SEQ ID NO: 1056521 - DNA, 22 bp, Artificial Sequence
  chemically synthesized
ccagatattcaaaatgagagaa

SEQ ID NO: 1056522 - DNA, 22 bp, Artificial Sequence
  chemically synthesized
accagatattcaaaatgagaga

SEQ ID NO: 1056523 - DNA, 22 bp, Artificial Sequence
  chemically synthesized
taccagatattcaaaatgagag

SEQ ID NO: 1056524 - DNA, 22 bp, Artificial Sequence
  chemically synthesized
aggcaggagttctctcattttg

SEQ ID NO: 1056525 - DNA, 22 bp, Artificial Sequence
  chemically synthesized
tctcattttgaatatctggtaa

SEQ ID NO: 1056526 - DNA, 22 bp, Artificial Sequence
  chemically synthesized
tcattttgaatatctggtaaaa

SEQ ID NO: 1056527 - DNA, 22 bp, Artificial Sequence
  chemically synthesized
attttgaatatctggtaaaatt

SEQ ID NO: 1056528 - DNA, 22 bp, Artificial Sequence
  chemically synthesized
tgaatatctggtaaaattttta

SEQ ID NO: 1056529 - DNA, 22 bp, Artificial Sequence
  chemically synthesized
ggaggacgcaggtaaaaatttt

SEQ ID NO: 1056530 - DNA, 22 bp, Artificial Sequence
  chemically synthesized
gaatatctggtaaaatttttac

SEQ ID NO: 1056531 - DNA, 22 bp, Artificial Sequence
  chemically synthesized
aatatctggtaaaatttttacc

SEQ ID NO: 1056532 - DNA, 22 bp, Artificial Sequence
  chemically synthesized
gtaaaatttttacctgcgtcct

SEQ ID NO: 1056533 - DNA, 22 bp, Artificial Sequence
  chemically synthesized
ttacctgcgtcctcccagtctc

SEQ ID NO: 1056534 - DNA, 22 bp, Artificial Sequence
  chemically synthesized
tacctgcgtcctcccagtctca

SEQ ID NO: 1056535 - DNA, 22 bp, Artificial Sequence
  chemically synthesized
acctgcgtcctcccagtctcat

SEQ ID NO: 1056536 - DNA, 22 bp, Artificial Sequence
  chemically synthesized
cctgcgtcctcccagtctcatg

SEQ ID NO: 1056537 - DNA, 22 bp, Artificial Sequence
  chemically synthesized
cgtcctcccagtctcatgcctc

SEQ ID NO: 1056538 - DNA, 22 bp, Artificial Sequence
  chemically synthesized
gagatgataaagaaagaggcat

SEQ ID NO: 1056539 - DNA, 22 bp, Artificial Sequence
  chemically synthesized
ccagtctcatgcctctttcttt

SEQ ID NO: 1056540 - DNA, 22 bp, Artificial Sequence
  chemically synthesized
atgcctctttctttatcatctc

SEQ ID NO: 1056541 - DNA, 22 bp, Artificial Sequence
  chemically synthesized
agggcaaacctggagatgataa

SEQ ID NO: 1056542 - DNA, 22 bp, Artificial Sequence
  chemically synthesized
tttctttatcatctccaggttt

SEQ ID NO: 1056543 - DNA, 22 bp, Artificial Sequence
  chemically synthesized
tggtcctcagggcaaacctgga

SEQ ID NO: 1056544 - DNA, 22 bp, Artificial Sequence
  chemically synthesized
tctttatcatctccaggtttgc

SEQ ID NO: 1056545 - DNA, 22 bp, Artificial Sequence
  chemically synthesized
ctttatcatctccaggtttgcc

SEQ ID NO: 1056546 - DNA, 22 bp, Artificial Sequence
  chemically synthesized
tttatcatctccaggtttgccc

SEQ ID NO: 1056547 - DNA, 22 bp, Artificial Sequence
  chemically synthesized
tatcatctccaggtttgccctg

SEQ ID NO: 1056548 - DNA, 22 bp, Artificial Sequence
  chemically synthesized
atcatctccaggtttgccctga

SEQ ID NO: 1056549 - DNA, 22 bp, Artificial Sequence
  chemically synthesized
tcatctccaggtttgccctgag

SEQ ID NO: 1056550 - DNA, 22 bp, Artificial Sequence
  chemically synthesized
caaattgtggtcctcagggcaa

SEQ ID NO: 1056551 - DNA, 22 bp, Artificial Sequence
  chemically synthesized
caggtttgccctgaggaccaca

SEQ ID NO: 1056552 - DNA, 22 bp, Artificial Sequence
  chemically synthesized
gccctgaggaccacaatttgca

SEQ ID NO: 1056553 - DNA, 22 bp, Artificial Sequence
  chemically synthesized
ccctgaggaccacaatttgcag

SEQ ID NO: 1056554 - DNA, 22 bp, Artificial Sequence
  chemically synthesized
aggaccacaatttgcagatacc

SEQ ID NO: 1056555 - DNA, 22 bp, Artificial Sequence
  chemically synthesized
gcagataccctctactatgctt

SEQ ID NO: 1056556 - DNA, 22 bp, Artificial Sequence
  chemically synthesized
cagataccctctactatgcttt

SEQ ID NO: 1056557 - DNA, 22 bp, Artificial Sequence
  chemically synthesized
tactatgctttggtctgcattc

SEQ ID NO: 1056558 - DNA, 22 bp, Artificial Sequence
  chemically synthesized
ctatgctttggtctgcattcct

SEQ ID NO: 1056559 - DNA, 22 bp, Artificial Sequence
  chemically synthesized
tgctttggtctgcattcctgtg

SEQ ID NO: 1056560 - DNA, 22 bp, Artificial Sequence
  chemically synthesized
tggtctgcattcctgtgtggct

SEQ ID NO: 1056561 - DNA, 22 bp, Artificial Sequence
  chemically synthesized
ggtctgcattcctgtgtggctg

SEQ ID NO: 1056562 - DNA, 22 bp, Artificial Sequence
  chemically synthesized
gtctgcattcctgtgtggctgg

SEQ ID NO: 1056563 - DNA, 22 bp, Artificial Sequence
  chemically synthesized
cattcctgtgtggctgggcgct

SEQ ID NO: 1056564 - DNA, 22 bp, Artificial Sequence
  chemically synthesized
ctgtgtggctgggcgctgcctc

SEQ ID NO: 1056565 - DNA, 22 bp, Artificial Sequence
  chemically synthesized
agggaacaatcatgaggcagcg

SEQ ID NO: 1056566 - DNA, 22 bp, Artificial Sequence
  chemically synthesized
gagggaacaatcatgaggcagc

SEQ ID NO: 1056567 - DNA, 22 bp, Artificial Sequence
  chemically synthesized
tgtggctgggcgctgcctcatg

SEQ ID NO: 1056568 - DNA, 22 bp, Artificial Sequence
  chemically synthesized
tgagggaacaatcatgaggcag

SEQ ID NO: 1056569 - DNA, 22 bp, Artificial Sequence
  chemically synthesized
agactttgagggaacaatcatg

SEQ ID NO: 1056570 - DNA, 22 bp, Artificial Sequence
  chemically synthesized
ggcgctgcctcatgattgttcc

SEQ ID NO: 1056571 - DNA, 22 bp, Artificial Sequence
  chemically synthesized
cctcatgattgttccctcaaag

SEQ ID NO: 1056572 - DNA, 22 bp, Artificial Sequence
  chemically synthesized
agaaaaggactgagactttgag

SEQ ID NO: 1056573 - DNA, 22 bp, Artificial Sequence
  chemically synthesized
atgattgttccctcaaagtctc

SEQ ID NO: 1056574 - DNA, 22 bp, Artificial Sequence
  chemically synthesized
ttccctcaaagtctcagtcctt

SEQ ID NO: 1056575 - DNA, 22 bp, Artificial Sequence
  chemically synthesized
cctcaaagtctcagtccttttc

SEQ ID NO: 1056576 - DNA, 22 bp, Artificial Sequence
  chemically synthesized
aaagtctcagtccttttctgag

SEQ ID NO: 1056577 - DNA, 22 bp, Artificial Sequence
  chemically synthesized
tatatggtagtaataaagctca

SEQ ID NO: 1056578 - DNA, 22 bp, Artificial Sequence
  chemically synthesized
agtccttttctgagctttatta

SEQ ID NO: 1056579 - DNA, 22 bp, Artificial Sequence
  chemically synthesized
ttctgagctttattactaccat

SEQ ID NO: 1056580 - DNA, 22 bp, Artificial Sequence
  chemically synthesized
tctgagctttattactaccata

SEQ ID NO: 1056581 - DNA, 22 bp, Artificial Sequence
  chemically synthesized
ctgagctttattactaccatat

SEQ ID NO: 1056582 - DNA, 22 bp, Artificial Sequence
  chemically synthesized
tgagctttattactaccatata

SEQ ID NO: 1056583 - DNA, 22 bp, Artificial Sequence
  chemically synthesized
agctttattactaccatatata

SEQ ID NO: 1056584 - DNA, 22 bp, Artificial Sequence
  chemically synthesized
tccatgtcagagctatatatgg

SEQ ID NO: 1056585 - DNA, 22 bp, Artificial Sequence
  chemically synthesized
tgtccatgtcagagctatatat

SEQ ID NO: 1056586 - DNA, 22 bp, Artificial Sequence
  chemically synthesized
tattactaccatatatagctct

SEQ ID NO: 1056587 - DNA, 22 bp, Artificial Sequence
  chemically synthesized
attactaccatatatagctctg

SEQ ID NO: 1056588 - DNA, 22 bp, Artificial Sequence
  chemically synthesized
ttactaccatatatagctctga

SEQ ID NO: 1056589 - DNA, 22 bp, Artificial Sequence
  chemically synthesized
ctaccatatatagctctgacat

SEQ ID NO: 1056590 - DNA, 22 bp, Artificial Sequence
  chemically synthesized
ggggactctgtccatgtcagag

SEQ ID NO: 1056591 - DNA, 22 bp, Artificial Sequence
  chemically synthesized
aggggactctgtccatgtcaga

SEQ ID NO: 1056592 - DNA, 22 bp, Artificial Sequence
  chemically synthesized
ccatatatagctctgacatgga

SEQ ID NO: 1056593 - DNA, 22 bp, Artificial Sequence
  chemically synthesized
aggcatttaggggactctgtcc

SEQ ID NO: 1056594 - DNA, 22 bp, Artificial Sequence
  chemically synthesized
tgacatggacagagtcccctaa

SEQ ID NO: 1056595 - DNA, 22 bp, Artificial Sequence
  chemically synthesized
acatggacagagtcccctaaat

SEQ ID NO: 1056596 - DNA, 22 bp, Artificial Sequence
  chemically synthesized
taaaattaaggcatttagggga

SEQ ID NO: 1056597 - DNA, 22 bp, Artificial Sequence
  chemically synthesized
accactgtaaaattaaggcatt

SEQ ID NO: 1056598 - DNA, 22 bp, Artificial Sequence
  chemically synthesized
aatgccttaattttacagtggt

SEQ ID NO: 1056599 - DNA, 22 bp, Artificial Sequence
  chemically synthesized
agagaagtgctaaccactgtaa

SEQ ID NO: 1056600 - DNA, 22 bp, Artificial Sequence
  chemically synthesized
aattttacagtggttagcactt

SEQ ID NO: 1056601 - DNA, 22 bp, Artificial Sequence
  chemically synthesized
attttacagtggttagcacttc

SEQ ID NO: 1056602 - DNA, 22 bp, Artificial Sequence
  chemically synthesized
tacagtggttagcacttctctg

SEQ ID NO: 1056603 - DNA, 22 bp, Artificial Sequence
  chemically synthesized
acagtggttagcacttctctga

SEQ ID NO: 1056604 - DNA, 22 bp, Artificial Sequence
  chemically synthesized
acagataaagactcagagaagt

SEQ ID NO: 1056605 - DNA, 22 bp, Artificial Sequence
  chemically synthesized
cagtggttagcacttctctgag

SEQ ID NO: 1056606 - DNA, 22 bp, Artificial Sequence
  chemically synthesized
tctcacagataaagactcagag

SEQ ID NO: 1056607 - DNA, 22 bp, Artificial Sequence
  chemically synthesized
atctcacagataaagactcaga

SEQ ID NO: 1056608 - DNA, 22 bp, Artificial Sequence
  chemically synthesized
cttatctcacagataaagactc

SEQ ID NO: 1056609 - DNA, 22 bp, Artificial Sequence
  chemically synthesized
ccttatctcacagataaagact

SEQ ID NO: 1056610 - DNA, 22 bp, Artificial Sequence
  chemically synthesized
gcacttctctgagtctttatct

SEQ ID NO: 1056611 - DNA, 22 bp, Artificial Sequence
  chemically synthesized
tccttatctcacagataaagac

SEQ ID NO: 1056612 - DNA, 22 bp, Artificial Sequence
  chemically synthesized
attttccttatctcacagataa

SEQ ID NO: 1056613 - DNA, 22 bp, Artificial Sequence
  chemically synthesized
ctctgagtctttatctgtgaga

SEQ ID NO: 1056614 - DNA, 22 bp, Artificial Sequence
  chemically synthesized
tctgagtctttatctgtgagat

SEQ ID NO: 1056615 - DNA, 22 bp, Artificial Sequence
  chemically synthesized
tgagtctttatctgtgagataa

SEQ ID NO: 1056616 - DNA, 22 bp, Artificial Sequence
  chemically synthesized
agtctttatctgtgagataagg

SEQ ID NO: 1056617 - DNA, 22 bp, Artificial Sequence
  chemically synthesized
tatctgtgagataaggaaaatt

SEQ ID NO: 1056618 - DNA, 22 bp, Artificial Sequence
  chemically synthesized
aaatgaaaaattaattttcctt

SEQ ID NO: 1056619 - DNA, 22 bp, Artificial Sequence
  chemically synthesized
atctgtgagataaggaaaatta

SEQ ID NO: 1056620 - DNA, 22 bp, Artificial Sequence
  chemically synthesized
aaaatgaaaaattaattttcct

SEQ ID NO: 1056621 - DNA, 22 bp, Artificial Sequence
  chemically synthesized
tctgtgagataaggaaaattaa

SEQ ID NO: 1056622 - DNA, 22 bp, Artificial Sequence
  chemically synthesized
tgagataaggaaaattaatttt

SEQ ID NO: 1056623 - DNA, 22 bp, Artificial Sequence
  chemically synthesized
agtgagtttaaaatgaaaaatt

SEQ ID NO: 1056624 - DNA, 22 bp, Artificial Sequence
  chemically synthesized
atttttcattttaaactcactc

SEQ ID NO: 1056625 - DNA, 22 bp, Artificial Sequence
  chemically synthesized
gtatgtgagagctgagtgagtt

SEQ ID NO: 1056626 - DNA, 22 bp, Artificial Sequence
  chemically synthesized
agtatgtgagagctgagtgagt

SEQ ID NO: 1056627 - DNA, 22 bp, Artificial Sequence
  chemically synthesized
ttcattttaaactcactcagct

SEQ ID NO: 1056628 - DNA, 22 bp, Artificial Sequence
  chemically synthesized
tcattttaaactcactcagctc

SEQ ID NO: 1056629 - DNA, 22 bp, Artificial Sequence
  chemically synthesized
cattttaaactcactcagctct

SEQ ID NO: 1056630 - DNA, 22 bp, Artificial Sequence
  chemically synthesized
attttaaactcactcagctctc

SEQ ID NO: 1056631 - DNA, 22 bp, Artificial Sequence
  chemically synthesized
aaatgcttagtatgtgagagct

SEQ ID NO: 1056632 - DNA, 22 bp, Artificial Sequence
  chemically synthesized
taaactcactcagctctcacat

SEQ ID NO: 1056633 - DNA, 22 bp, Artificial Sequence
  chemically synthesized
aaaatgcttagtatgtgagagc

SEQ ID NO: 1056634 - DNA, 22 bp, Artificial Sequence
  chemically synthesized
aaactcactcagctctcacata

SEQ ID NO: 1056635 - DNA, 22 bp, Artificial Sequence
  chemically synthesized
aactcactcagctctcacatac

SEQ ID NO: 1056636 - DNA, 22 bp, Artificial Sequence
  chemically synthesized
ttaaaatgcttagtatgtgaga

SEQ ID NO: 1056637 - DNA, 22 bp, Artificial Sequence
  chemically synthesized
actcagctctcacatactaagc

SEQ ID NO: 1056638 - DNA, 22 bp, Artificial Sequence
  chemically synthesized
agctctcacatactaagcattt

SEQ ID NO: 1056639 - DNA, 22 bp, Artificial Sequence
  chemically synthesized
tcacatactaagcattttaaga

SEQ ID NO: 1056640 - DNA, 22 bp, Artificial Sequence
  chemically synthesized
acatactaagcattttaagagt

SEQ ID NO: 1056641 - DNA, 22 bp, Artificial Sequence
  chemically synthesized
aaatagtaagcggtactcttaa

SEQ ID NO: 1056642 - DNA, 22 bp, Artificial Sequence
  chemically synthesized
agcattttaagagtaccgctta

SEQ ID NO: 1056643 - DNA, 22 bp, Artificial Sequence
  chemically synthesized
taagagtaccgcttactatttc

SEQ ID NO: 1056644 - DNA, 22 bp, Artificial Sequence
  chemically synthesized
cagcaacatgttgaaatagtaa

SEQ ID NO: 1056645 - DNA, 22 bp, Artificial Sequence
  chemically synthesized
aagagtaccgcttactatttca

SEQ ID NO: 1056646 - DNA, 22 bp, Artificial Sequence
  chemically synthesized
acagcaacatgttgaaatagta

SEQ ID NO: 1056647 - DNA, 22 bp, Artificial Sequence
  chemically synthesized
agagtaccgcttactatttcaa

SEQ ID NO: 1056648 - DNA, 22 bp, Artificial Sequence
  chemically synthesized
tacagcaacatgttgaaatagt

SEQ ID NO: 1056649 - DNA, 22 bp, Artificial Sequence
  chemically synthesized
atgtctttacagcaacatgttg

SEQ ID NO: 1056650 - DNA, 22 bp, Artificial Sequence
  chemically synthesized
catgtctttacagcaacatgtt

SEQ ID NO: 1056651 - DNA, 22 bp, Artificial Sequence
  chemically synthesized
tcatgtctttacagcaacatgt

SEQ ID NO: 1056652 - DNA, 22 bp, Artificial Sequence
  chemically synthesized
actatttcaacatgttgctgta

SEQ ID NO: 1056653 - DNA, 22 bp, Artificial Sequence
  chemically synthesized
ctatttcaacatgttgctgtaa

SEQ ID NO: 1056654 - DNA, 22 bp, Artificial Sequence
  chemically synthesized
atctttcatgtctttacagcaa

SEQ ID NO: 1056655 - DNA, 22 bp, Artificial Sequence
  chemically synthesized
tttcaacatgttgctgtaaaga

SEQ ID NO: 1056656 - DNA, 22 bp, Artificial Sequence
  chemically synthesized
caacatgttgctgtaaagacat

SEQ ID NO: 1056657 - DNA, 22 bp, Artificial Sequence
  chemically synthesized
aacatgttgctgtaaagacatg

SEQ ID NO: 1056658 - DNA, 22 bp, Artificial Sequence
  chemically synthesized
aagttcatctttcatgtcttta

SEQ ID NO: 1056659 - DNA, 22 bp, Artificial Sequence
  chemically synthesized
aaagttcatctttcatgtcttt

SEQ ID NO: 1056660 - DNA, 22 bp, Artificial Sequence
  chemically synthesized
taggcttaaagttcatctttca

SEQ ID NO: 1056661 - DNA, 22 bp, Artificial Sequence
  chemically synthesized
ctgtaaagacatgaaagatgaa

SEQ ID NO: 1056662 - DNA, 22 bp, Artificial Sequence
  chemically synthesized
taaagacatgaaagatgaactt

SEQ ID NO: 1056663 - DNA, 22 bp, Artificial Sequence
  chemically synthesized
gatataaactgtaggcttaaag

SEQ ID NO: 1056664 - DNA, 22 bp, Artificial Sequence
  chemically synthesized
tagatataaactgtaggcttaa

SEQ ID NO: 1056665 - DNA, 22 bp, Artificial Sequence
  chemically synthesized
ctagatataaactgtaggctta

SEQ ID NO: 1056666 - DNA, 22 bp, Artificial Sequence
  chemically synthesized
tctagatataaactgtaggctt

SEQ ID NO: 1056667 - DNA, 22 bp, Artificial Sequence
  chemically synthesized
ttctagatataaactgtaggct

SEQ ID NO: 1056668 - DNA, 22 bp, Artificial Sequence
  chemically synthesized
tttttctagatataaactgtag

SEQ ID NO: 1056669 - DNA, 22 bp, Artificial Sequence
  chemically synthesized
gtttttctagatataaactgta

SEQ ID NO: 1056670 - DNA, 22 bp, Artificial Sequence
  chemically synthesized
tgtttttctagatataaactgt

SEQ ID NO: 1056671 - DNA, 22 bp, Artificial Sequence
  chemically synthesized
ttgtttttctagatataaactg

SEQ ID NO: 1056672 - DNA, 22 bp, Artificial Sequence
  chemically synthesized
tttgtttttctagatataaact

SEQ ID NO: 1056673 - DNA, 22 bp, Artificial Sequence
  chemically synthesized
taagcctacagtttatatctag

SEQ ID NO: 1056674 - DNA, 22 bp, Artificial Sequence
  chemically synthesized
aagcctacagtttatatctaga

SEQ ID NO: 1056675 - DNA, 22 bp, Artificial Sequence
  chemically synthesized
agcctacagtttatatctagaa

SEQ ID NO: 1056676 - DNA, 22 bp, Artificial Sequence
  chemically synthesized
tccctttttgtttttctagata

SEQ ID NO: 1056677 - DNA, 22 bp, Artificial Sequence
  chemically synthesized
actgtccctttttgtttttcta

SEQ ID NO: 1056678 - DNA, 22 bp, Artificial Sequence
  chemically synthesized
cagtttatatctagaaaaacaa

SEQ ID NO: 1056679 - DNA, 22 bp, Artificial Sequence
  chemically synthesized
ctaactgtccctttttgttttt

SEQ ID NO: 1056680 - DNA, 22 bp, Artificial Sequence
  chemically synthesized
cctaactgtccctttttgtttt

SEQ ID NO: 1056681 - DNA, 22 bp, Artificial Sequence
  chemically synthesized
tcctaactgtccctttttgttt

SEQ ID NO: 1056682 - DNA, 22 bp, Artificial Sequence
  chemically synthesized
ttcctaactgtccctttttgtt

SEQ ID NO: 1056683 - DNA, 22 bp, Artificial Sequence
  chemically synthesized
atatctagaaaaacaaaaaggg

SEQ ID NO: 1056684 - DNA, 22 bp, Artificial Sequence
  chemically synthesized
tatctagaaaaacaaaaaggga

SEQ ID NO: 1056685 - DNA, 22 bp, Artificial Sequence
  chemically synthesized
cttttcctaactgtcccttttt

SEQ ID NO: 1056686 - DNA, 22 bp, Artificial Sequence
  chemically synthesized
acttttcctaactgtccctttt

SEQ ID NO: 1056687 - DNA, 22 bp, Artificial Sequence
  chemically synthesized
tacttttcctaactgtcccttt

SEQ ID NO: 1056688 - DNA, 22 bp, Artificial Sequence
  chemically synthesized
ttacttttcctaactgtccctt

SEQ ID NO: 1056689 - DNA, 22 bp, Artificial Sequence
  chemically synthesized
gaaaaacaaaaagggacagtta

SEQ ID NO: 1056690 - DNA, 22 bp, Artificial Sequence
  chemically synthesized
atttttacttttcctaactgtc

SEQ ID NO: 1056691 - DNA, 22 bp, Artificial Sequence
  chemically synthesized
gatttttacttttcctaactgt

SEQ ID NO: 1056692 - DNA, 22 bp, Artificial Sequence
  chemically synthesized
tttgatttttacttttcctaac

SEQ ID NO: 1056693 - DNA, 22 bp, Artificial Sequence
  chemically synthesized
attgtttgatttttacttttcc

SEQ ID NO: 1056694 - DNA, 22 bp, Artificial Sequence
  chemically synthesized
taattgtttgatttttactttt

SEQ ID NO: 1056695 - DNA, 22 bp, Artificial Sequence
  chemically synthesized
tctaattgtttgatttttactt

SEQ ID NO: 1056696 - DNA, 22 bp, Artificial Sequence
  chemically synthesized
ctctaattgtttgatttttact

SEQ ID NO: 1056697 - DNA, 22 bp, Artificial Sequence
  chemically synthesized
cttctctaattgtttgattttt

SEQ ID NO: 1056698 - DNA, 22 bp, Artificial Sequence
  chemically synthesized
tccttctctaattgtttgattt

SEQ ID NO: 1056699 - DNA, 22 bp, Artificial Sequence
  chemically synthesized
ggaaaagtaaaaatcaaacaat

SEQ ID NO: 1056700 - DNA, 22 bp, Artificial Sequence
  chemically synthesized
tattctccttctctaattgttt

SEQ ID NO: 1056701 - DNA, 22 bp, Artificial Sequence
  chemically synthesized
cccctatattctccttctctaa

SEQ ID NO: 1056702 - DNA, 22 bp, Artificial Sequence
  chemically synthesized
cctccccctatattctccttct

SEQ ID NO: 1056703 - DNA, 22 bp, Artificial Sequence
  chemically synthesized
acctccccctatattctccttc

SEQ ID NO: 1056704 - DNA, 22 bp, Artificial Sequence
  chemically synthesized
ttacctccccctatattctcct

SEQ ID NO: 1056705 - DNA, 22 bp, Artificial Sequence
  chemically synthesized
cttacctccccctatattctcc

SEQ ID NO: 1056706 - DNA, 22 bp, Artificial Sequence
  chemically synthesized
gagaaggagaatatagggggag

SEQ ID NO: 1056707 - DNA, 22 bp, Artificial Sequence
  chemically synthesized
agaatttcttacctccccctat

SEQ ID NO: 1056708 - DNA, 22 bp, Artificial Sequence
  chemically synthesized
cagaatttcttacctcccccta

SEQ ID NO: 1056709 - DNA, 22 bp, Artificial Sequence
  chemically synthesized
atgcagcatatgccatagcttc

SEQ ID NO: 1056710 - DNA, 22 bp, Artificial Sequence
  chemically synthesized
tgatgcagcatatgccatagct

SEQ ID NO: 1056711 - DNA, 22 bp, Artificial Sequence
  chemically synthesized
tgaagctatggcatatgctgca

SEQ ID NO: 1056712 - DNA, 22 bp, Artificial Sequence
  chemically synthesized
caatggctctgatgcagcatat

SEQ ID NO: 1056713 - DNA, 22 bp, Artificial Sequence
  chemically synthesized
acaatggctctgatgcagcata

SEQ ID NO: 1056714 - DNA, 22 bp, Artificial Sequence
  chemically synthesized
aagctatggcatatgctgcatc

SEQ ID NO: 1056715 - DNA, 22 bp, Artificial Sequence
  chemically synthesized
tggcatatgctgcatcagagcc

SEQ ID NO: 1056716 - DNA, 22 bp, Artificial Sequence
  chemically synthesized
atataaccttacaatggctctg

SEQ ID NO: 1056717 - DNA, 22 bp, Artificial Sequence
  chemically synthesized
gatataaccttacaatggctct

SEQ ID NO: 1056718 - DNA, 22 bp, Artificial Sequence
  chemically synthesized
catcagagccattgtaaggtta

SEQ ID NO: 1056719 - DNA, 22 bp, Artificial Sequence
  chemically synthesized
atgaaaagtagtatttgatata

SEQ ID NO: 1056720 - DNA, 22 bp, Artificial Sequence
  chemically synthesized
aatgaaaagtagtatttgatat

SEQ ID NO: 1056721 - DNA, 22 bp, Artificial Sequence
  chemically synthesized
taaggttatatcaaatactact

SEQ ID NO: 1056722 - DNA, 22 bp, Artificial Sequence
  chemically synthesized
tatcaaatactacttttcatta

SEQ ID NO: 1056723 - DNA, 22 bp, Artificial Sequence
  chemically synthesized
tgatagtcacagtaacagctta

SEQ ID NO: 1056724 - DNA, 22 bp, Artificial Sequence
  chemically synthesized
gtgatagtcacagtaacagctt

SEQ ID NO: 1056725 - DNA, 22 bp, Artificial Sequence
  chemically synthesized
cttttcattaagctgttactgt

SEQ ID NO: 1056726 - DNA, 22 bp, Artificial Sequence
  chemically synthesized
ttcattaagctgttactgtgac

SEQ ID NO: 1056727 - DNA, 22 bp, Artificial Sequence
  chemically synthesized
tcattaagctgttactgtgact

SEQ ID NO: 1056728 - DNA, 22 bp, Artificial Sequence
  chemically synthesized
cattaagctgttactgtgacta

SEQ ID NO: 1056729 - DNA, 22 bp, Artificial Sequence
  chemically synthesized
attaagctgttactgtgactat

SEQ ID NO: 1056730 - DNA, 22 bp, Artificial Sequence
  chemically synthesized
gagtcatttgtgatagtcacag

SEQ ID NO: 1056731 - DNA, 22 bp, Artificial Sequence
  chemically synthesized
agctgttactgtgactatcaca

SEQ ID NO: 1056732 - DNA, 22 bp, Artificial Sequence
  chemically synthesized
cgccctagagtcatttgtgata

SEQ ID NO: 1056733 - DNA, 22 bp, Artificial Sequence
  chemically synthesized
acgccctagagtcatttgtgat

SEQ ID NO: 1056734 - DNA, 22 bp, Artificial Sequence
  chemically synthesized
ttactgtgactatcacaaatga

SEQ ID NO: 1056735 - DNA, 22 bp, Artificial Sequence
  chemically synthesized
ttacgccctagagtcatttgtg

SEQ ID NO: 1056736 - DNA, 22 bp, Artificial Sequence
  chemically synthesized
ctgtgactatcacaaatgactc

SEQ ID NO: 1056737 - DNA, 22 bp, Artificial Sequence
  chemically synthesized
tgactatcacaaatgactctag

SEQ ID NO: 1056738 - DNA, 22 bp, Artificial Sequence
  chemically synthesized
ccaattcttacgccctagagtc

SEQ ID NO: 1056739 - DNA, 22 bp, Artificial Sequence
  chemically synthesized
cccaattcttacgccctagagt

SEQ ID NO: 1056740 - DNA, 22 bp, Artificial Sequence
  chemically synthesized
tcccaattcttacgccctagag

SEQ ID NO: 1056741 - DNA, 22 bp, Artificial Sequence
  chemically synthesized
tcacaaatgactctagggcgta

SEQ ID NO: 1056742 - DNA, 22 bp, Artificial Sequence
  chemically synthesized
tctttcccaattcttacgccct

SEQ ID NO: 1056743 - DNA, 22 bp, Artificial Sequence
  chemically synthesized
gagttatctttcccaattctta

SEQ ID NO: 1056744 - DNA, 22 bp, Artificial Sequence
  chemically synthesized
attagagttatctttcccaatt

SEQ ID NO: 1056745 - DNA, 22 bp, Artificial Sequence
  chemically synthesized
tagggcgtaagaattgggaaag

SEQ ID NO: 1056746 - DNA, 22 bp, Artificial Sequence
  chemically synthesized
gggcgtaagaattgggaaagat

SEQ ID NO: 1056747 - DNA, 22 bp, Artificial Sequence
  chemically synthesized
tggccactgattagagttatct

SEQ ID NO: 1056748 - DNA, 22 bp, Artificial Sequence
  chemically synthesized
actgtggccactgattagagtt

SEQ ID NO: 1056749 - DNA, 22 bp, Artificial Sequence
  chemically synthesized
cactgtggccactgattagagt

SEQ ID NO: 1056750 - DNA, 22 bp, Artificial Sequence
  chemically synthesized
ggaaagataactctaatcagtg

SEQ ID NO: 1056751 - DNA, 22 bp, Artificial Sequence
  chemically synthesized
atttcactgtggccactgatta

SEQ ID NO: 1056752 - DNA, 22 bp, Artificial Sequence
  chemically synthesized
aaactaatttcactgtggccac

SEQ ID NO: 1056753 - DNA, 22 bp, Artificial Sequence
  chemically synthesized
aaaactaatttcactgtggcca

SEQ ID NO: 1056754 - DNA, 22 bp, Artificial Sequence
  chemically synthesized
taaaactaatttcactgtggcc

SEQ ID NO: 1056755 - DNA, 22 bp, Artificial Sequence
  chemically synthesized
taatcagtggccacagtgaaat

SEQ ID NO: 1056756 - DNA, 22 bp, Artificial Sequence
  chemically synthesized
atcagtggccacagtgaaatta

SEQ ID NO: 1056757 - DNA, 22 bp, Artificial Sequence
  chemically synthesized
tcaatgcattttaaaactaatt

SEQ ID NO: 1056758 - DNA, 22 bp, Artificial Sequence
  chemically synthesized
accaattgtcaatgcattttaa

SEQ ID NO: 1056759 - DNA, 22 bp, Artificial Sequence
  chemically synthesized
gaccaattgtcaatgcatttta

SEQ ID NO: 1056760 - DNA, 22 bp, Artificial Sequence
  chemically synthesized
tacttgaccaattgtcaatgca

SEQ ID NO: 1056761 - DNA, 22 bp, Artificial Sequence
  chemically synthesized
atacttgaccaattgtcaatgc

SEQ ID NO: 1056762 - DNA, 22 bp, Artificial Sequence
  chemically synthesized
tatacttgaccaattgtcaatg

SEQ ID NO: 1056763 - DNA, 22 bp, Artificial Sequence
  chemically synthesized
gttttaaaatgcattgacaatt

SEQ ID NO: 1056764 - DNA, 22 bp, Artificial Sequence
  chemically synthesized
taaaatgcattgacaattggtc

SEQ ID NO: 1056765 - DNA, 22 bp, Artificial Sequence
  chemically synthesized
aaaatgcattgacaattggtca

SEQ ID NO: 1056766 - DNA, 22 bp, Artificial Sequence
  chemically synthesized
aaatgcattgacaattggtcaa

SEQ ID NO: 1056767 - DNA, 22 bp, Artificial Sequence
  chemically synthesized
aagatacatctttatacttgac

SEQ ID NO: 1056768 - DNA, 22 bp, Artificial Sequence
  chemically synthesized
acaattggtcaagtataaagat

SEQ ID NO: 1056769 - DNA, 22 bp, Artificial Sequence
  chemically synthesized
gtcaagtataaagatgtatctt

SEQ ID NO: 1056770 - DNA, 22 bp, Artificial Sequence
  chemically synthesized
gaatatttctacacccacctgt

SEQ ID NO: 1056771 - DNA, 22 bp, Artificial Sequence
  chemically synthesized
aatatttctacacccacctgtc

SEQ ID NO: 1056772 - DNA, 22 bp, Artificial Sequence
  chemically synthesized
gtaggtagatagatagacaggt

SEQ ID NO: 1056773 - DNA, 22 bp, Artificial Sequence
  chemically synthesized
ctacacccacctgtctatctat

SEQ ID NO: 1056774 - DNA, 22 bp, Artificial Sequence
  chemically synthesized
tacacccacctgtctatctatc

SEQ ID NO: 1056775 - DNA, 22 bp, Artificial Sequence
  chemically synthesized
cacccacctgtctatctatcta

SEQ ID NO: 1056776 - DNA, 22 bp, Artificial Sequence
  chemically synthesized
tctatctatctacctaccaacc

SEQ ID NO: 1056777 - DNA, 22 bp, Artificial Sequence
  chemically synthesized
tctatctacctaccaacctata

SEQ ID NO: 1056778 - DNA, 22 bp, Artificial Sequence
  chemically synthesized
tctacctaccaacctatatacc

SEQ ID NO: 1056779 - DNA, 22 bp, Artificial Sequence
  chemically synthesized
atagatgataagtaggtatata

SEQ ID NO: 1056780 - DNA, 22 bp, Artificial Sequence
  chemically synthesized
cctaccaacctatatacctact

SEQ ID NO: 1056781 - DNA, 22 bp, Artificial Sequence
  chemically synthesized
ccaacctatatacctacttatc

SEQ ID NO: 1056782 - DNA, 22 bp, Artificial Sequence
  chemically synthesized
agggataattgatagatgataa

SEQ ID NO: 1056783 - DNA, 22 bp, Artificial Sequence
  chemically synthesized
tatacctacttatcatctatca

SEQ ID NO: 1056784 - DNA, 22 bp, Artificial Sequence
  chemically synthesized
gaactgagggataattgataga

SEQ ID NO: 1056785 - DNA, 22 bp, Artificial Sequence
  chemically synthesized
attagaactgagggataattga

SEQ ID NO: 1056786 - DNA, 22 bp, Artificial Sequence
  chemically synthesized
cttatcatctatcaattatccc

SEQ ID NO: 1056787 - DNA, 22 bp, Artificial Sequence
  chemically synthesized
aattagaactgagggataattg

SEQ ID NO: 1056788 - DNA, 22 bp, Artificial Sequence
  chemically synthesized
taattagaactgagggataatt

SEQ ID NO: 1056789 - DNA, 22 bp, Artificial Sequence
  chemically synthesized
atcatctatcaattatccctca

SEQ ID NO: 1056790 - DNA, 22 bp, Artificial Sequence
  chemically synthesized
tcatctatcaattatccctcag

SEQ ID NO: 1056791 - DNA, 22 bp, Artificial Sequence
  chemically synthesized
tcaattatccctcagttctaat

SEQ ID NO: 1056792 - DNA, 22 bp, Artificial Sequence
  chemically synthesized
gcatcgtattttaattagaact

SEQ ID NO: 1056793 - DNA, 22 bp, Artificial Sequence
  chemically synthesized
ggcatcgtattttaattagaac

SEQ ID NO: 1056794 - DNA, 22 bp, Artificial Sequence
  chemically synthesized
tccctcagttctaattaaaata

SEQ ID NO: 1056795 - DNA, 22 bp, Artificial Sequence
  chemically synthesized
tatttggcatcgtattttaatt

SEQ ID NO: 1056796 - DNA, 22 bp, Artificial Sequence
  chemically synthesized
agttctaattaaaatacgatgc

SEQ ID NO: 1056797 - DNA, 22 bp, Artificial Sequence
  chemically synthesized
cagttatatttggcatcgtatt

SEQ ID NO: 1056798 - DNA, 22 bp, Artificial Sequence
  chemically synthesized
taattaaaatacgatgccaaat

SEQ ID NO: 1056799 - DNA, 22 bp, Artificial Sequence
  chemically synthesized
atattgcagttatatttggcat

SEQ ID NO: 1056800 - DNA, 22 bp, Artificial Sequence
  chemically synthesized
attaaaatacgatgccaaatat

SEQ ID NO: 1056801 - DNA, 22 bp, Artificial Sequence
  chemically synthesized
aatattgcagttatatttggca

SEQ ID NO: 1056802 - DNA, 22 bp, Artificial Sequence
  chemically synthesized
aaatacgatgccaaatataact

SEQ ID NO: 1056803 - DNA, 22 bp, Artificial Sequence
  chemically synthesized
tatgaagaataatcaatttaat

SEQ ID NO: 1056804 - DNA, 22 bp, Artificial Sequence
  chemically synthesized
caatattaaattgattattctt

SEQ ID NO: 1056805 - DNA, 22 bp, Artificial Sequence
  chemically synthesized
aattgattattcttcatacaga

SEQ ID NO: 1056806 - DNA, 22 bp, Artificial Sequence
  chemically synthesized
attattcttcatacagattgtg

SEQ ID NO: 1056807 - DNA, 22 bp, Artificial Sequence
  chemically synthesized
ttcttcatacagattgtgatta

SEQ ID NO: 1056808 - DNA, 22 bp, Artificial Sequence
  chemically synthesized
ttcatacagattgtgattactt

SEQ ID NO: 1056809 - DNA, 22 bp, Artificial Sequence
  chemically synthesized
tccatgataataaagtaatcac

SEQ ID NO: 1056810 - DNA, 22 bp, Artificial Sequence
  chemically synthesized
catacagattgtgattacttta

SEQ ID NO: 1056811 - DNA, 22 bp, Artificial Sequence
  chemically synthesized
atacagattgtgattactttat

SEQ ID NO: 1056812 - DNA, 22 bp, Artificial Sequence
  chemically synthesized
attatccatgataataaagtaa

SEQ ID NO: 1056813 - DNA, 22 bp, Artificial Sequence
  chemically synthesized
aattatccatgataataaagta

SEQ ID NO: 1056814 - DNA, 22 bp, Artificial Sequence
  chemically synthesized
ttaattatccatgataataaag

SEQ ID NO: 1056815 - DNA, 22 bp, Artificial Sequence
  chemically synthesized
actcttaattatccatgataat

SEQ ID NO: 1056816 - DNA, 22 bp, Artificial Sequence
  chemically synthesized
tgattactttattatcatggat

SEQ ID NO: 1056817 - DNA, 22 bp, Artificial Sequence
  chemically synthesized
tgttaactcttaattatccatg

SEQ ID NO: 1056818 - DNA, 22 bp, Artificial Sequence
  chemically synthesized
gtgttaactcttaattatccat

SEQ ID NO: 1056819 - DNA, 22 bp, Artificial Sequence
  chemically synthesized
tgtgttaactcttaattatcca

SEQ ID NO: 1056820 - DNA, 22 bp, Artificial Sequence
  chemically synthesized
ctttattatcatggataattaa

SEQ ID NO: 1056821 - DNA, 22 bp, Artificial Sequence
  chemically synthesized
ttgtgttaactcttaattatcc

SEQ ID NO: 1056822 - DNA, 22 bp, Artificial Sequence
  chemically synthesized
tattatcatggataattaagag

SEQ ID NO: 1056823 - DNA, 22 bp, Artificial Sequence
  chemically synthesized
tttttgtgttaactcttaatta

SEQ ID NO: 1056824 - DNA, 22 bp, Artificial Sequence
  chemically synthesized
attatcatggataattaagagt

SEQ ID NO: 1056825 - DNA, 22 bp, Artificial Sequence
  chemically synthesized
ttatcatggataattaagagtt

SEQ ID NO: 1056826 - DNA, 22 bp, Artificial Sequence
  chemically synthesized
tcatggataattaagagttaac

SEQ ID NO: 1056827 - DNA, 22 bp, Artificial Sequence
  chemically synthesized
agagttaacacaaaaatagccc

SEQ ID NO: 1056828 - DNA, 22 bp, Artificial Sequence
  chemically synthesized
agaatgtgaagggggctatttt

SEQ ID NO: 1056829 - DNA, 22 bp, Artificial Sequence
  chemically synthesized
acacaaaaatagcccccttcac

SEQ ID NO: 1056830 - DNA, 22 bp, Artificial Sequence
  chemically synthesized
aagatccaaaattcagaatgtg

SEQ ID NO: 1056831 - DNA, 22 bp, Artificial Sequence
  chemically synthesized
tatattaaagatccaaaattca

SEQ ID NO: 1056832 - DNA, 22 bp, Artificial Sequence
  chemically synthesized
atatattaaagatccaaaattc

SEQ ID NO: 1056833 - DNA, 22 bp, Artificial Sequence
  chemically synthesized
tatatattaaagatccaaaatt

SEQ ID NO: 1056834 - DNA, 22 bp, Artificial Sequence
  chemically synthesized
cacattctgaattttggatctt

SEQ ID NO: 1056835 - DNA, 22 bp, Artificial Sequence
  chemically synthesized
acattctgaattttggatcttt

SEQ ID NO: 1056836 - DNA, 22 bp, Artificial Sequence
  chemically synthesized
agttttatatattaaagatcca

SEQ ID NO: 1056837 - DNA, 22 bp, Artificial Sequence
  chemically synthesized
aagttttatatattaaagatcc

SEQ ID NO: 1056838 - DNA, 22 bp, Artificial Sequence
  chemically synthesized
ttaagttttatatattaaagat

SEQ ID NO: 1056839 - DNA, 22 bp, Artificial Sequence
  chemically synthesized
tgaattttggatctttaatata

SEQ ID NO: 1056840 - DNA, 22 bp, Artificial Sequence
  chemically synthesized
ttcttaagttttatatattaaa

SEQ ID NO: 1056841 - DNA, 22 bp, Artificial Sequence
  chemically synthesized
aattttggatctttaatatata

SEQ ID NO: 1056842 - DNA, 22 bp, Artificial Sequence
  chemically synthesized
attcttaagttttatatattaa

SEQ ID NO: 1056843 - DNA, 22 bp, Artificial Sequence
  chemically synthesized
tggatctttaatatataaaact

SEQ ID NO: 1056844 - DNA, 22 bp, Artificial Sequence
  chemically synthesized
ggatctttaatatataaaactt

SEQ ID NO: 1056845 - DNA, 22 bp, Artificial Sequence
  chemically synthesized
gatctttaatatataaaactta

SEQ ID NO: 1056846 - DNA, 22 bp, Artificial Sequence
  chemically synthesized
ataaacgatttattcttaagtt

SEQ ID NO: 1056847 - DNA, 22 bp, Artificial Sequence
  chemically synthesized
taatatataaaacttaagaata

SEQ ID NO: 1056848 - DNA, 22 bp, Artificial Sequence
  chemically synthesized
aatatataaaacttaagaataa

SEQ ID NO: 1056849 - DNA, 22 bp, Artificial Sequence
  chemically synthesized
ctcataaacgatttattcttaa

SEQ ID NO: 1056850 - DNA, 22 bp, Artificial Sequence
  chemically synthesized
atatataaaacttaagaataaa

SEQ ID NO: 1056851 - DNA, 22 bp, Artificial Sequence
  chemically synthesized
cctcataaacgatttattctta

SEQ ID NO: 1056852 - DNA, 22 bp, Artificial Sequence
  chemically synthesized
tcctcataaacgatttattctt

SEQ ID NO: 1056853 - DNA, 22 bp, Artificial Sequence
  chemically synthesized
ggatatattttcctcataaacg

SEQ ID NO: 1056854 - DNA, 22 bp, Artificial Sequence
  chemically synthesized
aagaataaatcgtttatgagga

SEQ ID NO: 1056855 - DNA, 22 bp, Artificial Sequence
  chemically synthesized
tgggatatattttcctcataaa

SEQ ID NO: 1056856 - DNA, 22 bp, Artificial Sequence
  chemically synthesized
agaataaatcgtttatgaggaa

SEQ ID NO: 1056857 - DNA, 22 bp, Artificial Sequence
  chemically synthesized
tagtaaaattctgggatatatt

SEQ ID NO: 1056858 - DNA, 22 bp, Artificial Sequence
  chemically synthesized
atgaggaaaatatatcccagaa

SEQ ID NO: 1056859 - DNA, 22 bp, Artificial Sequence
  chemically synthesized
tgaggaaaatatatcccagaat

SEQ ID NO: 1056860 - DNA, 22 bp, Artificial Sequence
  chemically synthesized
aaaaattgtagtaaaattctgg

SEQ ID NO: 1056861 - DNA, 22 bp, Artificial Sequence
  chemically synthesized
aaaaaattgtagtaaaattctg

SEQ ID NO: 1056862 - DNA, 22 bp, Artificial Sequence
  chemically synthesized
taaaaaattgtagtaaaattct

SEQ ID NO: 1056863 - DNA, 22 bp, Artificial Sequence
  chemically synthesized
ttaaaaaattgtagtaaaattc

SEQ ID NO: 1056864 - DNA, 22 bp, Artificial Sequence
  chemically synthesized
tactacaattttttaaaaatat

SEQ ID NO: 1056865 - DNA, 22 bp, Artificial Sequence
  chemically synthesized
actacaattttttaaaaatata

SEQ ID NO: 1056866 - DNA, 22 bp, Artificial Sequence
  chemically synthesized
ctacaattttttaaaaatatat

SEQ ID NO: 1056867 - DNA, 22 bp, Artificial Sequence
  chemically synthesized
caattttttaaaaatatatact

SEQ ID NO: 1056868 - DNA, 22 bp, Artificial Sequence
  chemically synthesized
tttaaaaatatatactggttca

SEQ ID NO: 1056869 - DNA, 22 bp, Artificial Sequence
  chemically synthesized
ttaaaaatatatactggttcac

SEQ ID NO: 1056870 - DNA, 22 bp, Artificial Sequence
  chemically synthesized
taaaaatatatactggttcaca

SEQ ID NO: 1056871 - DNA, 22 bp, Artificial Sequence
  chemically synthesized
aaaaatatatactggttcacac

SEQ ID NO: 1056872 - DNA, 22 bp, Artificial Sequence
  chemically synthesized
aaaatatatactggttcacaca

SEQ ID NO: 1056873 - DNA, 22 bp, Artificial Sequence
  chemically synthesized
gtgaaataaaggaagcatgtgt

SEQ ID NO: 1056874 - DNA, 22 bp, Artificial Sequence
  chemically synthesized
gttcacacatgcttcctttatt

SEQ ID NO: 1056875 - DNA, 22 bp, Artificial Sequence
  chemically synthesized
acacatgcttcctttatttcac

SEQ ID NO: 1056876 - DNA, 22 bp, Artificial Sequence
  chemically synthesized
tacaacgtaataatgactggtg

SEQ ID NO: 1056877 - DNA, 22 bp, Artificial Sequence
  chemically synthesized
gtacaacgtaataatgactggt

SEQ ID NO: 1056878 - DNA, 22 bp, Artificial Sequence
  chemically synthesized
cctttatttcaccagtcattat

SEQ ID NO: 1056879 - DNA, 22 bp, Artificial Sequence
  chemically synthesized
ctttatttcaccagtcattatt

SEQ ID NO: 1056880 - DNA, 22 bp, Artificial Sequence
  chemically synthesized
tatttcaccagtcattattacg

SEQ ID NO: 1056881 - DNA, 22 bp, Artificial Sequence
  chemically synthesized
atttcaccagtcattattacgt

SEQ ID NO: 1056882 - DNA, 22 bp, Artificial Sequence
  chemically synthesized
tttcaccagtcattattacgtt

SEQ ID NO: 1056883 - DNA, 22 bp, Artificial Sequence
  chemically synthesized
caccagtcattattacgttgta

SEQ ID NO: 1056884 - DNA, 22 bp, Artificial Sequence
  chemically synthesized
aacaaatatttgtacaacgtaa

SEQ ID NO: 1056885 - DNA, 22 bp, Artificial Sequence
  chemically synthesized
accagtcattattacgttgtac

SEQ ID NO: 1056886 - DNA, 22 bp, Artificial Sequence
  chemically synthesized
tcaacaaatatttgtacaacgt

SEQ ID NO: 1056887 - DNA, 22 bp, Artificial Sequence
  chemically synthesized
ttacgttgtacaaatatttgtt

SEQ ID NO: 1056888 - DNA, 22 bp, Artificial Sequence
  chemically synthesized
atagtaggctctcaacaaatat

SEQ ID NO: 1056889 - DNA, 22 bp, Artificial Sequence
  chemically synthesized
cgttgtacaaatatttgttgag

SEQ ID NO: 1056890 - DNA, 22 bp, Artificial Sequence
  chemically synthesized
ttcatagtaggctctcaacaaa

SEQ ID NO: 1056891 - DNA, 22 bp, Artificial Sequence
  chemically synthesized
tacaaatatttgttgagagcct

SEQ ID NO: 1056892 - DNA, 22 bp, Artificial Sequence
  chemically synthesized
tgtccctattcatagtaggctc

SEQ ID NO: 1056893 - DNA, 22 bp, Artificial Sequence
  chemically synthesized
gttgagagcctactatgaatag

SEQ ID NO: 1056894 - DNA, 22 bp, Artificial Sequence
  chemically synthesized
ttgagagcctactatgaatagg

SEQ ID NO: 1056895 - DNA, 22 bp, Artificial Sequence
  chemically synthesized
agagcctactatgaatagggac

SEQ ID NO: 1056896 - DNA, 22 bp, Artificial Sequence
  chemically synthesized
aaatgccattatgtccctattc

SEQ ID NO: 1056897 - DNA, 22 bp, Artificial Sequence
  chemically synthesized
aaaatgccattatgtccctatt

SEQ ID NO: 1056898 - DNA, 22 bp, Artificial Sequence
  chemically synthesized
cttaaaatgccattatgtccct

SEQ ID NO: 1056899 - DNA, 22 bp, Artificial Sequence
  chemically synthesized
acttaaaatgccattatgtccc

SEQ ID NO: 1056900 - DNA, 22 bp, Artificial Sequence
  chemically synthesized
ctatgaatagggacataatggc

SEQ ID NO: 1056901 - DNA, 22 bp, Artificial Sequence
  chemically synthesized
tgaatagggacataatggcatt

SEQ ID NO: 1056902 - DNA, 22 bp, Artificial Sequence
  chemically synthesized
cataaaccacttacttaaaatg

SEQ ID NO: 1056903 - DNA, 22 bp, Artificial Sequence
  chemically synthesized
taagtaagtggtttatggagat

SEQ ID NO: 1056904 - DNA, 22 bp, Artificial Sequence
  chemically synthesized
aagtaagtggtttatggagatt

SEQ ID NO: 1056905 - DNA, 22 bp, Artificial Sequence
  chemically synthesized
agtaagtggtttatggagattt

SEQ ID NO: 1056906 - DNA, 22 bp, Artificial Sequence
  chemically synthesized
aataggcacaggatcaaaaatc

SEQ ID NO: 1056907 - DNA, 22 bp, Artificial Sequence
  chemically synthesized
tggctaaataggcacaggatca

SEQ ID NO: 1056908 - DNA, 22 bp, Artificial Sequence
  chemically synthesized
atggagatttttgatcctgtgc

SEQ ID NO: 1056909 - DNA, 22 bp, Artificial Sequence
  chemically synthesized
atggctaaataggcacaggatc

SEQ ID NO: 1056910 - DNA, 22 bp, Artificial Sequence
  chemically synthesized
tggagatttttgatcctgtgcc

SEQ ID NO: 1056911 - DNA, 22 bp, Artificial Sequence
  chemically synthesized
tatggctaaataggcacaggat

SEQ ID NO: 1056912 - DNA, 22 bp, Artificial Sequence
  chemically synthesized
atgctttatggctaaataggca

SEQ ID NO: 1056913 - DNA, 22 bp, Artificial Sequence
  chemically synthesized
ttgatcctgtgcctatttagcc

SEQ ID NO: 1056914 - DNA, 22 bp, Artificial Sequence
  chemically synthesized
ctaatgctttatggctaaatag

SEQ ID NO: 1056915 - DNA, 22 bp, Artificial Sequence
  chemically synthesized
tgatcctgtgcctatttagcca

SEQ ID NO: 1056916 - DNA, 22 bp, Artificial Sequence
  chemically synthesized
gatcctgtgcctatttagccat

SEQ ID NO: 1056917 - DNA, 22 bp, Artificial Sequence
  chemically synthesized
atcctgtgcctatttagccata

SEQ ID NO: 1056918 - DNA, 22 bp, Artificial Sequence
  chemically synthesized
tgcctatttagccataaagcat

SEQ ID NO: 1056919 - DNA, 22 bp, Artificial Sequence
  chemically synthesized
atcaagttgctaatgctttatg

SEQ ID NO: 1056920 - DNA, 22 bp, Artificial Sequence
  chemically synthesized
tttagccataaagcattagcaa

SEQ ID NO: 1056921 - DNA, 22 bp, Artificial Sequence
  chemically synthesized
caaactaatcaagttgctaatg

SEQ ID NO: 1056922 - DNA, 22 bp, Artificial Sequence
  chemically synthesized
agccataaagcattagcaactt

SEQ ID NO: 1056923 - DNA, 22 bp, Artificial Sequence
  chemically synthesized
gccataaagcattagcaacttg

SEQ ID NO: 1056924 - DNA, 22 bp, Artificial Sequence
  chemically synthesized
gttacaaactaatcaagttgct

SEQ ID NO: 1056925 - DNA, 22 bp, Artificial Sequence
  chemically synthesized
aaattcgttacaaactaatcaa

SEQ ID NO: 1056926 - DNA, 22 bp, Artificial Sequence
  chemically synthesized
aaaattcgttacaaactaatca

SEQ ID NO: 1056927 - DNA, 22 bp, Artificial Sequence
  chemically synthesized
gcaacttgattagtttgtaacg

SEQ ID NO: 1056928 - DNA, 22 bp, Artificial Sequence
  chemically synthesized
gattagtttgtaacgaatttta

SEQ ID NO: 1056929 - DNA, 22 bp, Artificial Sequence
  chemically synthesized
attagtttgtaacgaattttaa

SEQ ID NO: 1056930 - DNA, 22 bp, Artificial Sequence
  chemically synthesized
gtttgtaacgaattttaaacct

SEQ ID NO: 1056931 - DNA, 22 bp, Artificial Sequence
  chemically synthesized
acacacccaatatgcaggttta

SEQ ID NO: 1056932 - DNA, 22 bp, Artificial Sequence
  chemically synthesized
gtaacgaattttaaacctgcat

SEQ ID NO: 1056933 - DNA, 22 bp, Artificial Sequence
  chemically synthesized
gacacacccaatatgcaggttt

SEQ ID NO: 1056934 - DNA, 22 bp, Artificial Sequence
  chemically synthesized
taacgaattttaaacctgcata

SEQ ID NO: 1056935 - DNA, 22 bp, Artificial Sequence
  chemically synthesized
cccaggtcttgacacacccaat

SEQ ID NO: 1056936 - DNA, 22 bp, Artificial Sequence
  chemically synthesized
taaacctgcatattgggtgtgt

SEQ ID NO: 1056937 - DNA, 22 bp, Artificial Sequence
  chemically synthesized
ccccaggtcttgacacacccaa

SEQ ID NO: 1056938 - DNA, 22 bp, Artificial Sequence
  chemically synthesized
aaacctgcatattgggtgtgtc

SEQ ID NO: 1056939 - DNA, 22 bp, Artificial Sequence
  chemically synthesized
tccccaggtcttgacacaccca

SEQ ID NO: 1056940 - DNA, 22 bp, Artificial Sequence
  chemically synthesized
aacctgcatattgggtgtgtca

SEQ ID NO: 1056941 - DNA, 22 bp, Artificial Sequence
  chemically synthesized
caattttccccaggtcttgaca

SEQ ID NO: 1056942 - DNA, 22 bp, Artificial Sequence
  chemically synthesized
catattgggtgtgtcaagacct

SEQ ID NO: 1056943 - DNA, 22 bp, Artificial Sequence
  chemically synthesized
cattccaattttccccaggtct

SEQ ID NO: 1056944 - DNA, 22 bp, Artificial Sequence
  chemically synthesized
tccattccaattttccccaggt

SEQ ID NO: 1056945 - DNA, 22 bp, Artificial Sequence
  chemically synthesized
ggtgtgtcaagacctggggaaa

SEQ ID NO: 1056946 - DNA, 22 bp, Artificial Sequence
  chemically synthesized
ctccattccaattttccccagg

SEQ ID NO: 1056947 - DNA, 22 bp, Artificial Sequence
  chemically synthesized
atttctccattccaattttccc

SEQ ID NO: 1056948 - DNA, 22 bp, Artificial Sequence
  chemically synthesized
actcatttctccattccaattt

SEQ ID NO: 1056949 - DNA, 22 bp, Artificial Sequence
  chemically synthesized
ctaactcatttctccattccaa

SEQ ID NO: 1056950 - DNA, 22 bp, Artificial Sequence
  chemically synthesized
actactaactcatttctccatt

SEQ ID NO: 1056951 - DNA, 22 bp, Artificial Sequence
  chemically synthesized
gggaaaattggaatggagaaat

SEQ ID NO: 1056952 - DNA, 22 bp, Artificial Sequence
  chemically synthesized
tctgactactaactcatttctc

SEQ ID NO: 1056953 - DNA, 22 bp, Artificial Sequence
  chemically synthesized
aattatctgactactaactcat

SEQ ID NO: 1056954 - DNA, 22 bp, Artificial Sequence
  chemically synthesized
gaattatctgactactaactca

SEQ ID NO: 1056955 - DNA, 22 bp, Artificial Sequence
  chemically synthesized
gaatggagaaatgagttagtag

SEQ ID NO: 1056956 - DNA, 22 bp, Artificial Sequence
  chemically synthesized
tgaattatctgactactaactc

SEQ ID NO: 1056957 - DNA, 22 bp, Artificial Sequence
  chemically synthesized
ctttgaattatctgactactaa

SEQ ID NO: 1056958 - DNA, 22 bp, Artificial Sequence
  chemically synthesized
gctttgaattatctgactacta

SEQ ID NO: 1056959 - DNA, 22 bp, Artificial Sequence
  chemically synthesized
tgctttgaattatctgactact

SEQ ID NO: 1056960 - DNA, 22 bp, Artificial Sequence
  chemically synthesized
gtagtcagataattcaaagcaa

SEQ ID NO: 1056961 - DNA, 22 bp, Artificial Sequence
  chemically synthesized
aagggggagtcctttgctttga

SEQ ID NO: 1056962 - DNA, 22 bp, Artificial Sequence
  chemically synthesized
atagatcattcaagggggagtc

SEQ ID NO: 1056963 - DNA, 22 bp, Artificial Sequence
  chemically synthesized
aatagatcattcaagggggagt

SEQ ID NO: 1056964 - DNA, 22 bp, Artificial Sequence
  chemically synthesized
aaagcaaaggactcccccttga

SEQ ID NO: 1056965 - DNA, 22 bp, Artificial Sequence
  chemically synthesized
aatttaatagatcattcaaggg

SEQ ID NO: 1056966 - DNA, 22 bp, Artificial Sequence
  chemically synthesized
acctcaatttaatagatcattc

SEQ ID NO: 1056967 - DNA, 22 bp, Artificial Sequence
  chemically synthesized
cacctcaatttaatagatcatt

SEQ ID NO: 1056968 - DNA, 22 bp, Artificial Sequence
  chemically synthesized
ccccttgaatgatctattaaat

SEQ ID NO: 1056969 - DNA, 22 bp, Artificial Sequence
  chemically synthesized
gaatgatctattaaattgaggt

SEQ ID NO: 1056970 - DNA, 22 bp, Artificial Sequence
  chemically synthesized
aatgatctattaaattgaggtg

SEQ ID NO: 1056971 - DNA, 22 bp, Artificial Sequence
  chemically synthesized
ataaaatagtttcacctcaatt

SEQ ID NO: 1056972 - DNA, 22 bp, Artificial Sequence
  chemically synthesized
taataaaatagtttcacctcaa

SEQ ID NO: 1056973 - DNA, 22 bp, Artificial Sequence
  chemically synthesized
ttaaattgaggtgaaactattt

SEQ ID NO: 1056974 - DNA, 22 bp, Artificial Sequence
  chemically synthesized
aattgaggtgaaactattttat

SEQ ID NO: 1056975 - DNA, 22 bp, Artificial Sequence
  chemically synthesized
aggtgaaactattttattagaa

SEQ ID NO: 1056976 - DNA, 22 bp, Artificial Sequence
  chemically synthesized
aggcaatcaaaaagaaaattct

SEQ ID NO: 1056977 - DNA, 22 bp, Artificial Sequence
  chemically synthesized
ttttattagaattttctttttg

SEQ ID NO: 1056978 - DNA, 22 bp, Artificial Sequence
  chemically synthesized
tattagaattttctttttgatt

SEQ ID NO: 1056979 - DNA, 22 bp, Artificial Sequence
  chemically synthesized
attagaattttctttttgattg

SEQ ID NO: 1056980 - DNA, 22 bp, Artificial Sequence
  chemically synthesized
ttagaattttctttttgattgc

SEQ ID NO: 1056981 - DNA, 22 bp, Artificial Sequence
  chemically synthesized
gaattttctttttgattgcctt

SEQ ID NO: 1056982 - DNA, 22 bp, Artificial Sequence
  chemically synthesized
tctttttgattgccttaatctt

SEQ ID NO: 1056983 - DNA, 22 bp, Artificial Sequence
  chemically synthesized
ctttttgattgccttaatcttt

SEQ ID NO: 1056984 - DNA, 22 bp, Artificial Sequence
  chemically synthesized
tttttgattgccttaatctttc

SEQ ID NO: 1056985 - DNA, 22 bp, Artificial Sequence
  chemically synthesized
tttgattgccttaatctttcgc

SEQ ID NO: 1056986 - DNA, 22 bp, Artificial Sequence
  chemically synthesized
ttgattgccttaatctttcgct

SEQ ID NO: 1056987 - DNA, 22 bp, Artificial Sequence
  chemically synthesized
tgattgccttaatctttcgctt

SEQ ID NO: 1056988 - DNA, 22 bp, Artificial Sequence
  chemically synthesized
gattgccttaatctttcgcttc

SEQ ID NO: 1056989 - DNA, 22 bp, Artificial Sequence
  chemically synthesized
cagatgcaaaatgaagcgaaag

SEQ ID NO: 1056990 - DNA, 22 bp, Artificial Sequence
  chemically synthesized
attgccttaatctttcgcttca

SEQ ID NO: 1056991 - DNA, 22 bp, Artificial Sequence
  chemically synthesized
ccttaatctttcgcttcatttt

SEQ ID NO: 1056992 - DNA, 22 bp, Artificial Sequence
  chemically synthesized
tgtctgcagatgcaaaatgaag

SEQ ID NO: 1056993 - DNA, 22 bp, Artificial Sequence
  chemically synthesized
aatctttcgcttcattttgcat

SEQ ID NO: 1056994 - DNA, 22 bp, Artificial Sequence
  chemically synthesized
atctttcgcttcattttgcatc

SEQ ID NO: 1056995 - DNA, 22 bp, Artificial Sequence
  chemically synthesized
tcgcttcattttgcatctgcag

SEQ ID NO: 1056996 - DNA, 22 bp, Artificial Sequence
  chemically synthesized
cgcttcattttgcatctgcaga

SEQ ID NO: 1056997 - DNA, 22 bp, Artificial Sequence
  chemically synthesized
gcttcattttgcatctgcagac

SEQ ID NO: 1056998 - DNA, 22 bp, Artificial Sequence
  chemically synthesized
accagcaagcctgtgtctgcag

SEQ ID NO: 1056999 - DNA, 22 bp, Artificial Sequence
  chemically synthesized
cattttgcatctgcagacacag

SEQ ID NO: 1057000 - DNA, 22 bp, Artificial Sequence
  chemically synthesized
attttgcatctgcagacacagg

SEQ ID NO: 1057001 - DNA, 22 bp, Artificial Sequence
  chemically synthesized
cactaaccagcaagcctgtgtc

SEQ ID NO: 1057002 - DNA, 22 bp, Artificial Sequence
  chemically synthesized
acactaaccagcaagcctgtgt

SEQ ID NO: 1057003 - DNA, 22 bp, Artificial Sequence
  chemically synthesized
tgcatctgcagacacaggcttg

SEQ ID NO: 1057004 - DNA, 22 bp, Artificial Sequence
  chemically synthesized
gcatctgcagacacaggcttgc

SEQ ID NO: 1057005 - DNA, 22 bp, Artificial Sequence
  chemically synthesized
catctgcagacacaggcttgct

SEQ ID NO: 1057006 - DNA, 22 bp, Artificial Sequence
  chemically synthesized
cagacacaggcttgctggttag

SEQ ID NO: 1057007 - DNA, 22 bp, Artificial Sequence
  chemically synthesized
gctggttagtgtaaggttattt

SEQ ID NO: 1057008 - DNA, 22 bp, Artificial Sequence
  chemically synthesized
ctggttagtgtaaggttattta

SEQ ID NO: 1057009 - DNA, 22 bp, Artificial Sequence
  chemically synthesized
gttagtgtaaggttatttatga

SEQ ID NO: 1057010 - DNA, 22 bp, Artificial Sequence
  chemically synthesized
tgaatgtaatgtgtcataaata

SEQ ID NO: 1057011 - DNA, 22 bp, Artificial Sequence
  chemically synthesized
gtgtaaggttatttatgacaca

SEQ ID NO: 1057012 - DNA, 22 bp, Artificial Sequence
  chemically synthesized
gatgttatgaatgtaatgtgtc

SEQ ID NO: 1057013 - DNA, 22 bp, Artificial Sequence
  chemically synthesized
atattagatgttatgaatgtaa

SEQ ID NO: 1057014 - DNA, 22 bp, Artificial Sequence
  chemically synthesized
tttatgacacattacattcata

SEQ ID NO: 1057015 - DNA, 22 bp, Artificial Sequence
  chemically synthesized
catattagatgttatgaatgta

SEQ ID NO: 1057016 - DNA, 22 bp, Artificial Sequence
  chemically synthesized
atgacacattacattcataaca

SEQ ID NO: 1057017 - DNA, 22 bp, Artificial Sequence
  chemically synthesized
tgacacattacattcataacat

SEQ ID NO: 1057018 - DNA, 22 bp, Artificial Sequence
  chemically synthesized
tccttcatattagatgttatga

SEQ ID NO: 1057019 - DNA, 22 bp, Artificial Sequence
  chemically synthesized
ttatccttcatattagatgtta

SEQ ID NO: 1057020 - DNA, 22 bp, Artificial Sequence
  chemically synthesized
cattcataacatctaatatgaa

SEQ ID NO: 1057021 - DNA, 22 bp, Artificial Sequence
  chemically synthesized
agcctattatccttcatattag

SEQ ID NO: 1057022 - DNA, 22 bp, Artificial Sequence
  chemically synthesized
cagcctattatccttcatatta

SEQ ID NO: 1057023 - DNA, 22 bp, Artificial Sequence
  chemically synthesized
ataacatctaatatgaaggata

SEQ ID NO: 1057024 - DNA, 22 bp, Artificial Sequence
  chemically synthesized
aatgtttcagcctattatcctt

SEQ ID NO: 1057025 - DNA, 22 bp, Artificial Sequence
  chemically synthesized
gctgaatgtttcagcctattat

SEQ ID NO: 1057026 - DNA, 22 bp, Artificial Sequence
  chemically synthesized
atatgaaggataataggctgaa

SEQ ID NO: 1057027 - DNA, 22 bp, Artificial Sequence
  chemically synthesized
cacctggctgaatgtttcagcc

SEQ ID NO: 1057028 - DNA, 22 bp, Artificial Sequence
  chemically synthesized
attccacctggctgaatgtttc

SEQ ID NO: 1057029 - DNA, 22 bp, Artificial Sequence
  chemically synthesized
aaacattcagccaggtggaatt

SEQ ID NO: 1057030 - DNA, 22 bp, Artificial Sequence
  chemically synthesized
catgtgaagtctaattccacct

SEQ ID NO: 1057031 - DNA, 22 bp, Artificial Sequence
  chemically synthesized
tattgcatgtgaagtctaattc

SEQ ID NO: 1057032 - DNA, 22 bp, Artificial Sequence
  chemically synthesized
agccaggtggaattagacttca

SEQ ID NO: 1057033 - DNA, 22 bp, Artificial Sequence
  chemically synthesized
gacttcacatgcaatacagttt

SEQ ID NO: 1057034 - DNA, 22 bp, Artificial Sequence
  chemically synthesized
cacatgcaatacagtttcgcta

SEQ ID NO: 1057035 - DNA, 22 bp, Artificial Sequence
  chemically synthesized
acatgcaatacagtttcgctat

SEQ ID NO: 1057036 - DNA, 22 bp, Artificial Sequence
  chemically synthesized
gaagaatacgagaaatagcgaa

SEQ ID NO: 1057037 - DNA, 22 bp, Artificial Sequence
  chemically synthesized
agcaattggaagaatacgagaa

SEQ ID NO: 1057038 - DNA, 22 bp, Artificial Sequence
  chemically synthesized
tgagcaattggaagaatacgag

SEQ ID NO: 1057039 - DNA, 22 bp, Artificial Sequence
  chemically synthesized
ttctgagcaattggaagaatac

SEQ ID NO: 1057040 - DNA, 22 bp, Artificial Sequence
  chemically synthesized
cgctatttctcgtattcttcca

SEQ ID NO: 1057041 - DNA, 22 bp, Artificial Sequence
  chemically synthesized
gctatttctcgtattcttccaa

SEQ ID NO: 1057042 - DNA, 22 bp, Artificial Sequence
  chemically synthesized
tttctcgtattcttccaattgc

SEQ ID NO: 1057043 - DNA, 22 bp, Artificial Sequence
  chemically synthesized
ctcgtattcttccaattgctca

SEQ ID NO: 1057044 - DNA, 22 bp, Artificial Sequence
  chemically synthesized
tcgtattcttccaattgctcag

SEQ ID NO: 1057045 - DNA, 22 bp, Artificial Sequence
  chemically synthesized
gtattcttccaattgctcagaa

SEQ ID NO: 1057046 - DNA, 22 bp, Artificial Sequence
  chemically synthesized
atagcaggtgaattattctgag

SEQ ID NO: 1057047 - DNA, 22 bp, Artificial Sequence
  chemically synthesized
aatagcaggtgaattattctga

SEQ ID NO: 1057048 - DNA, 22 bp, Artificial Sequence
  chemically synthesized
ttccaattgctcagaataattc

SEQ ID NO: 1057049 - DNA, 22 bp, Artificial Sequence
  chemically synthesized
ccaattgctcagaataattcac

SEQ ID NO: 1057050 - DNA, 22 bp, Artificial Sequence
  chemically synthesized
caattgctcagaataattcacc

SEQ ID NO: 1057051 - DNA, 22 bp, Artificial Sequence
  chemically synthesized
aagtttaatagcaggtgaatta

SEQ ID NO: 1057052 - DNA, 22 bp, Artificial Sequence
  chemically synthesized
ctcagaataattcacctgctat

SEQ ID NO: 1057053 - DNA, 22 bp, Artificial Sequence
  chemically synthesized
agaataattcacctgctattaa

SEQ ID NO: 1057054 - DNA, 22 bp, Artificial Sequence
  chemically synthesized
ataccctaaagtttaatagcag

SEQ ID NO: 1057055 - DNA, 22 bp, Artificial Sequence
  chemically synthesized
aatctaataccctaaagtttaa

SEQ ID NO: 1057056 - DNA, 22 bp, Artificial Sequence
  chemically synthesized
ttaaatctaataccctaaagtt

SEQ ID NO: 1057057 - DNA, 22 bp, Artificial Sequence
  chemically synthesized
acctgctattaaactttagggt

SEQ ID NO: 1057058 - DNA, 22 bp, Artificial Sequence
  chemically synthesized
tgttaaatctaataccctaaag

SEQ ID NO: 1057059 - DNA, 22 bp, Artificial Sequence
  chemically synthesized
ctgttaaatctaataccctaaa

SEQ ID NO: 1057060 - DNA, 22 bp, Artificial Sequence
  chemically synthesized
tctgttaaatctaataccctaa

SEQ ID NO: 1057061 - DNA, 22 bp, Artificial Sequence
  chemically synthesized
ctattaaactttagggtattag

SEQ ID NO: 1057062 - DNA, 22 bp, Artificial Sequence
  chemically synthesized
ttttctgttaaatctaataccc

SEQ ID NO: 1057063 - DNA, 22 bp, Artificial Sequence
  chemically synthesized
ttaaactttagggtattagatt

SEQ ID NO: 1057064 - DNA, 22 bp, Artificial Sequence
  chemically synthesized
aactttagggtattagatttaa

SEQ ID NO: 1057065 - DNA, 22 bp, Artificial Sequence
  chemically synthesized
tagggtattagatttaacagaa

SEQ ID NO: 1057066 - DNA, 22 bp, Artificial Sequence
  chemically synthesized
agggtattagatttaacagaaa

SEQ ID NO: 1057067 - DNA, 22 bp, Artificial Sequence
  chemically synthesized
gggtattagatttaacagaaaa

SEQ ID NO: 1057068 - DNA, 22 bp, Artificial Sequence
  chemically synthesized
ataaatacactgttttctgtta

SEQ ID NO: 1057069 - DNA, 22 bp, Artificial Sequence
  chemically synthesized
gatttaacagaaaacagtgtat

SEQ ID NO: 1057070 - DNA, 22 bp, Artificial Sequence
  chemically synthesized
aagaaaattaataaatacactg

SEQ ID NO: 1057071 - DNA, 22 bp, Artificial Sequence
  chemically synthesized
caagaaaattaataaatacact

SEQ ID NO: 1057072 - DNA, 22 bp, Artificial Sequence
  chemically synthesized
aacagaaaacagtgtatttatt

SEQ ID NO: 1057073 - DNA, 22 bp, Artificial Sequence
  chemically synthesized
acagaaaacagtgtatttatta

SEQ ID NO: 1057074 - DNA, 22 bp, Artificial Sequence
  chemically synthesized
atacttcaagaaaattaataaa

SEQ ID NO: 1057075 - DNA, 22 bp, Artificial Sequence
  chemically synthesized
aatacttcaagaaaattaataa

SEQ ID NO: 1057076 - DNA, 22 bp, Artificial Sequence
  chemically synthesized
taatacttcaagaaaattaata

SEQ ID NO: 1057077 - DNA, 22 bp, Artificial Sequence
  chemically synthesized
ttaatacttcaagaaaattaat

SEQ ID NO: 1057078 - DNA, 22 bp, Artificial Sequence
  chemically synthesized
ttttaatacttcaagaaaatta

SEQ ID NO: 1057079 - DNA, 22 bp, Artificial Sequence
  chemically synthesized
cttttaatacttcaagaaaatt

SEQ ID NO: 1057080 - DNA, 22 bp, Artificial Sequence
  chemically synthesized
tgacttcttttaatacttcaag

SEQ ID NO: 1057081 - DNA, 22 bp, Artificial Sequence
  chemically synthesized
attaattttcttgaagtattaa

SEQ ID NO: 1057082 - DNA, 22 bp, Artificial Sequence
  chemically synthesized
ttgtgacttcttttaatacttc

SEQ ID NO: 1057083 - DNA, 22 bp, Artificial Sequence
  chemically synthesized
ttaattttcttgaagtattaaa

SEQ ID NO: 1057084 - DNA, 22 bp, Artificial Sequence
  chemically synthesized
attttcttgaagtattaaaaga

SEQ ID NO: 1057085 - DNA, 22 bp, Artificial Sequence
  chemically synthesized
catattattgtgacttctttta

SEQ ID NO: 1057086 - DNA, 22 bp, Artificial Sequence
  chemically synthesized
tcttgaagtattaaaagaagtc

SEQ ID NO: 1057087 - DNA, 22 bp, Artificial Sequence
  chemically synthesized
cttgaagtattaaaagaagtca

SEQ ID NO: 1057088 - DNA, 22 bp, Artificial Sequence
  chemically synthesized
ttgaagtattaaaagaagtcac

SEQ ID NO: 1057089 - DNA, 22 bp, Artificial Sequence
  chemically synthesized
gaagtattaaaagaagtcacaa

SEQ ID NO: 1057090 - DNA, 22 bp, Artificial Sequence
  chemically synthesized
aagtattaaaagaagtcacaat

SEQ ID NO: 1057091 - DNA, 22 bp, Artificial Sequence
  chemically synthesized
aaagaagtcacaataatatgca

SEQ ID NO: 1057092 - DNA, 22 bp, Artificial Sequence
  chemically synthesized
taagcatataagggaagtatgt

SEQ ID NO: 1057093 - DNA, 22 bp, Artificial Sequence
  chemically synthesized
ataagcatataagggaagtatg

SEQ ID NO: 1057094 - DNA, 22 bp, Artificial Sequence
  chemically synthesized
tataagcatataagggaagtat

SEQ ID NO: 1057095 - DNA, 22 bp, Artificial Sequence
  chemically synthesized
attttataagcatataagggaa

SEQ ID NO: 1057096 - DNA, 22 bp, Artificial Sequence
  chemically synthesized
aattttataagcatataaggga

SEQ ID NO: 1057097 - DNA, 22 bp, Artificial Sequence
  chemically synthesized
ccataacttaattttataagca

SEQ ID NO: 1057098 - DNA, 22 bp, Artificial Sequence
  chemically synthesized
cccttatatgcttataaaatta

SEQ ID NO: 1057099 - DNA, 22 bp, Artificial Sequence
  chemically synthesized
ccttatatgcttataaaattaa

SEQ ID NO: 1057100 - DNA, 22 bp, Artificial Sequence
  chemically synthesized
atatgcttataaaattaagtta

SEQ ID NO: 1057101 - DNA, 22 bp, Artificial Sequence
  chemically synthesized
tatgcttataaaattaagttat

SEQ ID NO: 1057102 - DNA, 22 bp, Artificial Sequence
  chemically synthesized
ataaaattaagttatggtaact

SEQ ID NO: 1057103 - DNA, 22 bp, Artificial Sequence
  chemically synthesized
taaaattaagttatggtaactg

SEQ ID NO: 1057104 - DNA, 22 bp, Artificial Sequence
  chemically synthesized
aaatgtcaaaagcagttaccat

SEQ ID NO: 1057105 - DNA, 22 bp, Artificial Sequence
  chemically synthesized
aaaatgtcaaaagcagttacca

SEQ ID NO: 1057106 - DNA, 22 bp, Artificial Sequence
  chemically synthesized
taaaatgtcaaaagcagttacc

SEQ ID NO: 1057107 - DNA, 22 bp, Artificial Sequence
  chemically synthesized
ttaaaatgtcaaaagcagttac

SEQ ID NO: 1057108 - DNA, 22 bp, Artificial Sequence
  chemically synthesized
agttatggtaactgcttttgac

SEQ ID NO: 1057109 - DNA, 22 bp, Artificial Sequence
  chemically synthesized
tggtaactgcttttgacatttt

SEQ ID NO: 1057110 - DNA, 22 bp, Artificial Sequence
  chemically synthesized
gtgtatatttttaaaatgtcaa

SEQ ID NO: 1057111 - DNA, 22 bp, Artificial Sequence
  chemically synthesized
ggtgtatatttttaaaatgtca

SEQ ID NO: 1057112 - DNA, 22 bp, Artificial Sequence
  chemically synthesized
atttggtgtatatttttaaaat

SEQ ID NO: 1057113 - DNA, 22 bp, Artificial Sequence
  chemically synthesized
aatttggtgtatatttttaaaa

SEQ ID NO: 1057114 - DNA, 22 bp, Artificial Sequence
  chemically synthesized
cttttgacattttaaaaatata

SEQ ID NO: 1057115 - DNA, 22 bp, Artificial Sequence
  chemically synthesized
catttaatttggtgtatatttt

SEQ ID NO: 1057116 - DNA, 22 bp, Artificial Sequence
  chemically synthesized
ttgacattttaaaaatatacac

SEQ ID NO: 1057117 - DNA, 22 bp, Artificial Sequence
  chemically synthesized
tgacattttaaaaatatacacc

SEQ ID NO: 1057118 - DNA, 22 bp, Artificial Sequence
  chemically synthesized
gacattttaaaaatatacacca

SEQ ID NO: 1057119 - DNA, 22 bp, Artificial Sequence
  chemically synthesized
acattttaaaaatatacaccaa

SEQ ID NO: 1057120 - DNA, 22 bp, Artificial Sequence
  chemically synthesized
taaaaatatacaccaaattaaa

SEQ ID NO: 1057121 - DNA, 22 bp, Artificial Sequence
  chemically synthesized
aaaaatatacaccaaattaaat

SEQ ID NO: 1057122 - DNA, 22 bp, Artificial Sequence
  chemically synthesized
aaaatatacaccaaattaaatg

SEQ ID NO: 1057123 - DNA, 22 bp, Artificial Sequence
  chemically synthesized
tgatagtgtcagttccatttaa

SEQ ID NO: 1057124 - DNA, 22 bp, Artificial Sequence
  chemically synthesized
tgtgatagtgtcagttccattt

SEQ ID NO: 1057125 - DNA, 22 bp, Artificial Sequence
  chemically synthesized
ctgtgatagtgtcagttccatt

SEQ ID NO: 1057126 - DNA, 22 bp, Artificial Sequence
  chemically synthesized
ttctgtgatagtgtcagttcca

SEQ ID NO: 1057127 - DNA, 22 bp, Artificial Sequence
  chemically synthesized
cttctgtgatagtgtcagttcc

SEQ ID NO: 1057128 - DNA, 22 bp, Artificial Sequence
  chemically synthesized
ggaacttcttctgtgatagtgt

SEQ ID NO: 1057129 - DNA, 22 bp, Artificial Sequence
  chemically synthesized
gggaacttcttctgtgatagtg

SEQ ID NO: 1057130 - DNA, 22 bp, Artificial Sequence
  chemically synthesized
aatggaactgacactatcacag

SEQ ID NO: 1057131 - DNA, 22 bp, Artificial Sequence
  chemically synthesized
ttgggaacttcttctgtgatag

SEQ ID NO: 1057132 - DNA, 22 bp, Artificial Sequence
  chemically synthesized
cttgggaacttcttctgtgata

SEQ ID NO: 1057133 - DNA, 22 bp, Artificial Sequence
  chemically synthesized
acactatcacagaagaagttcc

SEQ ID NO: 1057134 - DNA, 22 bp, Artificial Sequence
  chemically synthesized
tcacagaagaagttcccaagaa

SEQ ID NO: 1057135 - DNA, 22 bp, Artificial Sequence
  chemically synthesized
agcccatgtatgagacttcttg

SEQ ID NO: 1057136 - DNA, 22 bp, Artificial Sequence
  chemically synthesized
catagggttcagcccatgtatg

SEQ ID NO: 1057137 - DNA, 22 bp, Artificial Sequence
  chemically synthesized
ccaagaagtctcatacatgggc

SEQ ID NO: 1057138 - DNA, 22 bp, Artificial Sequence
  chemically synthesized
atacatgggctgaaccctatgc

SEQ ID NO: 1057139 - DNA, 22 bp, Artificial Sequence
  chemically synthesized
tgtaaataataactgcataggg

SEQ ID NO: 1057140 - DNA, 22 bp, Artificial Sequence
  chemically synthesized
ccctatgtaaataataactgca

SEQ ID NO: 1057141 - DNA, 22 bp, Artificial Sequence
  chemically synthesized
gccctatgtaaataataactgc

SEQ ID NO: 1057142 - DNA, 22 bp, Artificial Sequence
  chemically synthesized
tgccctatgtaaataataactg

SEQ ID NO: 1057143 - DNA, 22 bp, Artificial Sequence
  chemically synthesized
aaccctatgcagttattattta

SEQ ID NO: 1057144 - DNA, 22 bp, Artificial Sequence
  chemically synthesized
aaccattttgccctatgtaaat

SEQ ID NO: 1057145 - DNA, 22 bp, Artificial Sequence
  chemically synthesized
tgcagttattatttacataggg

SEQ ID NO: 1057146 - DNA, 22 bp, Artificial Sequence
  chemically synthesized
ttatttacatagggcaaaatgg

SEQ ID NO: 1057147 - DNA, 22 bp, Artificial Sequence
  chemically synthesized
tttacatagggcaaaatggttg

SEQ ID NO: 1057148 - DNA, 22 bp, Artificial Sequence
  chemically synthesized
acatagggcaaaatggttgagt

SEQ ID NO: 1057149 - DNA, 22 bp, Artificial Sequence
  chemically synthesized
catagggcaaaatggttgagta

SEQ ID NO: 1057150 - DNA, 22 bp, Artificial Sequence
  chemically synthesized
tatgaatcaaacagatactcaa

SEQ ID NO: 1057151 - DNA, 22 bp, Artificial Sequence
  chemically synthesized
aattatatgaatcaaacagata

SEQ ID NO: 1057152 - DNA, 22 bp, Artificial Sequence
  chemically synthesized
ggttgaattatatgaatcaaac

SEQ ID NO: 1057153 - DNA, 22 bp, Artificial Sequence
  chemically synthesized
agtatctgtttgattcatataa

SEQ ID NO: 1057154 - DNA, 22 bp, Artificial Sequence
  chemically synthesized
agttaggttgaattatatgaat

SEQ ID NO: 1057155 - DNA, 22 bp, Artificial Sequence
  chemically synthesized
tagttaagttaggttgaattat

SEQ ID NO: 1057156 - DNA, 22 bp, Artificial Sequence
  chemically synthesized
atagttaagttaggttgaatta

SEQ ID NO: 1057157 - DNA, 22 bp, Artificial Sequence
  chemically synthesized
tttgattcatataattcaacct

SEQ ID NO: 1057158 - DNA, 22 bp, Artificial Sequence
  chemically synthesized
tatagttaagttaggttgaatt

SEQ ID NO: 1057159 - DNA, 22 bp, Artificial Sequence
  chemically synthesized
gattcatataattcaacctaac

SEQ ID NO: 1057160 - DNA, 22 bp, Artificial Sequence
  chemically synthesized
attcatataattcaacctaact

SEQ ID NO: 1057161 - DNA, 22 bp, Artificial Sequence
  chemically synthesized
agtctttatagttaagttaggt

SEQ ID NO: 1057162 - DNA, 22 bp, Artificial Sequence
  chemically synthesized
atataattcaacctaacttaac

SEQ ID NO: 1057163 - DNA, 22 bp, Artificial Sequence
  chemically synthesized
gaaactaagtctttatagttaa

SEQ ID NO: 1057164 - DNA, 22 bp, Artificial Sequence
  chemically synthesized
aacctaacttaactataaagac

SEQ ID NO: 1057165 - DNA, 22 bp, Artificial Sequence
  chemically synthesized
acttaactataaagacttagtt

SEQ ID NO: 1057166 - DNA, 22 bp, Artificial Sequence
  chemically synthesized
aactataaagacttagtttcca

SEQ ID NO: 1057167 - DNA, 22 bp, Artificial Sequence
  chemically synthesized
actataaagacttagtttccag

SEQ ID NO: 1057168 - DNA, 22 bp, Artificial Sequence
  chemically synthesized
taaagacttagtttccagattt

SEQ ID NO: 1057169 - DNA, 22 bp, Artificial Sequence
  chemically synthesized
acaaaaccaggatgtcaaaatc

SEQ ID NO: 1057170 - DNA, 22 bp, Artificial Sequence
  chemically synthesized
ctcacaaaaccaggatgtcaaa

SEQ ID NO: 1057171 - DNA, 22 bp, Artificial Sequence
  chemically synthesized
agtttccagattttgacatcct

SEQ ID NO: 1057172 - DNA, 22 bp, Artificial Sequence
  chemically synthesized
gtttccagattttgacatcctg

SEQ ID NO: 1057173 - DNA, 22 bp, Artificial Sequence
  chemically synthesized
ccagattttgacatcctggttt

SEQ ID NO: 1057174 - DNA, 22 bp, Artificial Sequence
  chemically synthesized
cagattttgacatcctggtttt

SEQ ID NO: 1057175 - DNA, 22 bp, Artificial Sequence
  chemically synthesized
tgacatcctggttttgtgagga

SEQ ID NO: 1057176 - DNA, 22 bp, Artificial Sequence
  chemically synthesized
gacatcctggttttgtgaggag

SEQ ID NO: 1057177 - DNA, 22 bp, Artificial Sequence
  chemically synthesized
tagaagaaagtactcctcacaa

SEQ ID NO: 1057178 - DNA, 22 bp, Artificial Sequence
  chemically synthesized
acatcctggttttgtgaggagt

SEQ ID NO: 1057179 - DNA, 22 bp, Artificial Sequence
  chemically synthesized
taattatagaagaaagtactcc

SEQ ID NO: 1057180 - DNA, 22 bp, Artificial Sequence
  chemically synthesized
gttttgtgaggagtactttctt

SEQ ID NO: 1057181 - DNA, 22 bp, Artificial Sequence
  chemically synthesized
tgtgaggagtactttcttctat

SEQ ID NO: 1057182 - DNA, 22 bp, Artificial Sequence
  chemically synthesized
gtgaggagtactttcttctata

SEQ ID NO: 1057183 - DNA, 22 bp, Artificial Sequence
  chemically synthesized
tgaggagtactttcttctataa

SEQ ID NO: 1057184 - DNA, 22 bp, Artificial Sequence
  chemically synthesized
tcttctataattacagatgatg

SEQ ID NO: 1057185 - DNA, 22 bp, Artificial Sequence
  chemically synthesized
cttctataattacagatgatga

SEQ ID NO: 1057186 - DNA, 22 bp, Artificial Sequence
  chemically synthesized
ttctataattacagatgatgat

SEQ ID NO: 1057187 - DNA, 22 bp, Artificial Sequence
  chemically synthesized
ctataattacagatgatgatca

SEQ ID NO: 1057188 - DNA, 22 bp, Artificial Sequence
  chemically synthesized
tataattacagatgatgatcat

SEQ ID NO: 1057189 - DNA, 22 bp, Artificial Sequence
  chemically synthesized
taattacagatgatgatcattc

SEQ ID NO: 1057190 - DNA, 22 bp, Artificial Sequence
  chemically synthesized
taagatgaagaggaatgatcat

SEQ ID NO: 1057191 - DNA, 22 bp, Artificial Sequence
  chemically synthesized
gtaagatgaagaggaatgatca

SEQ ID NO: 1057192 - DNA, 22 bp, Artificial Sequence
  chemically synthesized
cagatgatgatcattcctcttc

SEQ ID NO: 1057193 - DNA, 22 bp, Artificial Sequence
  chemically synthesized
acacttgtaagatgaagaggaa

SEQ ID NO: 1057194 - DNA, 22 bp, Artificial Sequence
  chemically synthesized
ttaacacttgtaagatgaagag

SEQ ID NO: 1057195 - DNA, 22 bp, Artificial Sequence
  chemically synthesized
ttattaacacttgtaagatgaa

SEQ ID NO: 1057196 - DNA, 22 bp, Artificial Sequence
  chemically synthesized
ctattattaacacttgtaagat

SEQ ID NO: 1057197 - DNA, 22 bp, Artificial Sequence
  chemically synthesized
ttcctattattaacacttgtaa

SEQ ID NO: 1057198 - DNA, 22 bp, Artificial Sequence
  chemically synthesized
gttcctattattaacacttgta

SEQ ID NO: 1057199 - DNA, 22 bp, Artificial Sequence
  chemically synthesized
tgttcctattattaacacttgt

SEQ ID NO: 1057200 - DNA, 22 bp, Artificial Sequence
  chemically synthesized
ctcttcatcttacaagtgttaa

SEQ ID NO: 1057201 - DNA, 22 bp, Artificial Sequence
  chemically synthesized
ttgttcctattattaacacttg

SEQ ID NO: 1057202 - DNA, 22 bp, Artificial Sequence
  chemically synthesized
ttcatcttacaagtgttaataa

SEQ ID NO: 1057203 - DNA, 22 bp, Artificial Sequence
  chemically synthesized
catcttacaagtgttaataata

SEQ ID NO: 1057204 - DNA, 22 bp, Artificial Sequence
  chemically synthesized
atcttacaagtgttaataatag

SEQ ID NO: 1057205 - DNA, 22 bp, Artificial Sequence
  chemically synthesized
acaagtgttaataataggaaca

SEQ ID NO: 1057206 - DNA, 22 bp, Artificial Sequence
  chemically synthesized
caagtgttaataataggaacaa

SEQ ID NO: 1057207 - DNA, 22 bp, Artificial Sequence
  chemically synthesized
acaggtacatttttgttcctat

SEQ ID NO: 1057208 - DNA, 22 bp, Artificial Sequence
  chemically synthesized
tgacaggtacatttttgttcct

SEQ ID NO: 1057209 - DNA, 22 bp, Artificial Sequence
  chemically synthesized
ctgacaggtacatttttgttcc

SEQ ID NO: 1057210 - DNA, 22 bp, Artificial Sequence
  chemically synthesized
tctgacaggtacatttttgttc

SEQ ID NO: 1057211 - DNA, 22 bp, Artificial Sequence
  chemically synthesized
ataataggaacaaaaatgtacc

SEQ ID NO: 1057212 - DNA, 22 bp, Artificial Sequence
  chemically synthesized
tagtaggtataaaccatagagg

SEQ ID NO: 1057213 - DNA, 22 bp, Artificial Sequence
  chemically synthesized
gtagtaggtataaaccatagag

SEQ ID NO: 1057214 - DNA, 22 bp, Artificial Sequence
  chemically synthesized
tcagaaaacctctatggtttat

SEQ ID NO: 1057215 - DNA, 22 bp, Artificial Sequence
  chemically synthesized
tttgtagtaggtataaaccata

SEQ ID NO: 1057216 - DNA, 22 bp, Artificial Sequence
  chemically synthesized
atttgtagtaggtataaaccat

SEQ ID NO: 1057217 - DNA, 22 bp, Artificial Sequence
  chemically synthesized
tatttgtagtaggtataaacca

SEQ ID NO: 1057218 - DNA, 22 bp, Artificial Sequence
  chemically synthesized
tttatttgtagtaggtataaac

SEQ ID NO: 1057219 - DNA, 22 bp, Artificial Sequence
  chemically synthesized
ctttatttgtagtaggtataaa

SEQ ID NO: 1057220 - DNA, 22 bp, Artificial Sequence
  chemically synthesized
acttctttatttgtagtaggta

SEQ ID NO: 1057221 - DNA, 22 bp, Artificial Sequence
  chemically synthesized
tatggtttatacctactacaaa

SEQ ID NO: 1057222 - DNA, 22 bp, Artificial Sequence
  chemically synthesized
tggtttatacctactacaaata

SEQ ID NO: 1057223 - DNA, 22 bp, Artificial Sequence
  chemically synthesized
gtctcacttctttatttgtagt

SEQ ID NO: 1057224 - DNA, 22 bp, Artificial Sequence
  chemically synthesized
ggtctcacttctttatttgtag

SEQ ID NO: 1057225 - DNA, 22 bp, Artificial Sequence
  chemically synthesized
gcttggtctcacttctttattt

SEQ ID NO: 1057226 - DNA, 22 bp, Artificial Sequence
  chemically synthesized
atacctactacaaataaagaag

SEQ ID NO: 1057227 - DNA, 22 bp, Artificial Sequence
  chemically synthesized
tacctactacaaataaagaagt

SEQ ID NO: 1057228 - DNA, 22 bp, Artificial Sequence
  chemically synthesized
ttagcttggtctcacttcttta

SEQ ID NO: 1057229 - DNA, 22 bp, Artificial Sequence
  chemically synthesized
ctacaaataaagaagtgagacc

SEQ ID NO: 1057230 - DNA, 22 bp, Artificial Sequence
  chemically synthesized
agaattgttagcttggtctcac

SEQ ID NO: 1057231 - DNA, 22 bp, Artificial Sequence
  chemically synthesized
caaataaagaagtgagaccaag

SEQ ID NO: 1057232 - DNA, 22 bp, Artificial Sequence
  chemically synthesized
aaaaggcgattcagaattgtta

SEQ ID NO: 1057233 - DNA, 22 bp, Artificial Sequence
  chemically synthesized
aaaaaggcgattcagaattgtt

SEQ ID NO: 1057234 - DNA, 22 bp, Artificial Sequence
  chemically synthesized
taaaaaggcgattcagaattgt

SEQ ID NO: 1057235 - DNA, 22 bp, Artificial Sequence
  chemically synthesized
tttaaaaaggcgattcagaatt

SEQ ID NO: 1057236 - DNA, 22 bp, Artificial Sequence
  chemically synthesized
tctttaaaaaggcgattcagaa

SEQ ID NO: 1057237 - DNA, 22 bp, Artificial Sequence
  chemically synthesized
tctctttaaaaaggcgattcag

SEQ ID NO: 1057238 - DNA, 22 bp, Artificial Sequence
  chemically synthesized
acaattctgaatcgccttttta

SEQ ID NO: 1057239 - DNA, 22 bp, Artificial Sequence
  chemically synthesized
tgaatcgcctttttaaagagag

SEQ ID NO: 1057240 - DNA, 22 bp, Artificial Sequence
  chemically synthesized
aatcgcctttttaaagagagaa

SEQ ID NO: 1057241 - DNA, 22 bp, Artificial Sequence
  chemically synthesized
aatggaaagtgtatggttctct

SEQ ID NO: 1057242 - DNA, 22 bp, Artificial Sequence
  chemically synthesized
tttaaagagagaaccatacact

SEQ ID NO: 1057243 - DNA, 22 bp, Artificial Sequence
  chemically synthesized
ttaaagagagaaccatacactt

SEQ ID NO: 1057244 - DNA, 22 bp, Artificial Sequence
  chemically synthesized
taaagagagaaccatacacttt

SEQ ID NO: 1057245 - DNA, 22 bp, Artificial Sequence
  chemically synthesized
aaagagagaaccatacactttc

SEQ ID NO: 1057246 - DNA, 22 bp, Artificial Sequence
  chemically synthesized
aagagagaaccatacactttcc

SEQ ID NO: 1057247 - DNA, 22 bp, Artificial Sequence
  chemically synthesized
aaacaactgaatggaaagtgta

SEQ ID NO: 1057248 - DNA, 22 bp, Artificial Sequence
  chemically synthesized
caaacaactgaatggaaagtgt

SEQ ID NO: 1057249 - DNA, 22 bp, Artificial Sequence
  chemically synthesized
tcaaacaactgaatggaaagtg

SEQ ID NO: 1057250 - DNA, 22 bp, Artificial Sequence
  chemically synthesized
tttcaaacaactgaatggaaag

SEQ ID NO: 1057251 - DNA, 22 bp, Artificial Sequence
  chemically synthesized
ctttcaaacaactgaatggaaa

SEQ ID NO: 1057252 - DNA, 22 bp, Artificial Sequence
  chemically synthesized
ttctttcaaacaactgaatgga

SEQ ID NO: 1057253 - DNA, 22 bp, Artificial Sequence
  chemically synthesized
ctcttctttcaaacaactgaat

SEQ ID NO: 1057254 - DNA, 22 bp, Artificial Sequence
  chemically synthesized
tccattcagttgtttgaaagaa

SEQ ID NO: 1057255 - DNA, 22 bp, Artificial Sequence
  chemically synthesized
ccattcagttgtttgaaagaag

SEQ ID NO: 1057256 - DNA, 22 bp, Artificial Sequence
  chemically synthesized
cattcagttgtttgaaagaaga

SEQ ID NO: 1057257 - DNA, 22 bp, Artificial Sequence
  chemically synthesized
agttgtttgaaagaagagcagt

SEQ ID NO: 1057258 - DNA, 22 bp, Artificial Sequence
  chemically synthesized
tttgaaagaagagcagtcactc

SEQ ID NO: 1057259 - DNA, 22 bp, Artificial Sequence
  chemically synthesized
gaaagaagagcagtcactcctt

SEQ ID NO: 1057260 - DNA, 22 bp, Artificial Sequence
  chemically synthesized
aaagaagagcagtcactccttt

SEQ ID NO: 1057261 - DNA, 22 bp, Artificial Sequence
  chemically synthesized
ccagccaaaacaaaaaggagtg

SEQ ID NO: 1057262 - DNA, 22 bp, Artificial Sequence
  chemically synthesized
aaatgttaccagccaaaacaaa

SEQ ID NO: 1057263 - DNA, 22 bp, Artificial Sequence
  chemically synthesized
ctgaaatgttaccagccaaaac

SEQ ID NO: 1057264 - DNA, 22 bp, Artificial Sequence
  chemically synthesized
ttactgaaatgttaccagccaa

SEQ ID NO: 1057265 - DNA, 22 bp, Artificial Sequence
  chemically synthesized
ctttttgttttggctggtaaca

SEQ ID NO: 1057266 - DNA, 22 bp, Artificial Sequence
  chemically synthesized
tttgttttggctggtaacattt

SEQ ID NO: 1057267 - DNA, 22 bp, Artificial Sequence
  chemically synthesized
ttgttttggctggtaacatttc

SEQ ID NO: 1057268 - DNA, 22 bp, Artificial Sequence
  chemically synthesized
tgttttggctggtaacatttca

SEQ ID NO: 1057269 - DNA, 22 bp, Artificial Sequence
  chemically synthesized
gttttggctggtaacatttcag

SEQ ID NO: 1057270 - DNA, 22 bp, Artificial Sequence
  chemically synthesized
ttttggctggtaacatttcagt

SEQ ID NO: 1057271 - DNA, 22 bp, Artificial Sequence
  chemically synthesized
tggctggtaacatttcagtaat

SEQ ID NO: 1057272 - DNA, 22 bp, Artificial Sequence
  chemically synthesized
ggctggtaacatttcagtaata

SEQ ID NO: 1057273 - DNA, 22 bp, Artificial Sequence
  chemically synthesized
gctggtaacatttcagtaataa

SEQ ID NO: 1057274 - DNA, 22 bp, Artificial Sequence
  chemically synthesized
gtaacatttcagtaataacatt

SEQ ID NO: 1057275 - DNA, 22 bp, Artificial Sequence
  chemically synthesized
aacaatatcagataatgttatt

SEQ ID NO: 1057276 - DNA, 22 bp, Artificial Sequence
  chemically synthesized
cagattgaacaatatcagataa

SEQ ID NO: 1057277 - DNA, 22 bp, Artificial Sequence
  chemically synthesized
cagtaataacattatctgatat

SEQ ID NO: 1057278 - DNA, 22 bp, Artificial Sequence
  chemically synthesized
agtaataacattatctgatatt

SEQ ID NO: 1057279 - DNA, 22 bp, Artificial Sequence
  chemically synthesized
attgcagattgaacaatatcag

SEQ ID NO: 1057280 - DNA, 22 bp, Artificial Sequence
  chemically synthesized
attgattgcagattgaacaata

SEQ ID NO: 1057281 - DNA, 22 bp, Artificial Sequence
  chemically synthesized
ctaattgattgcagattgaaca

SEQ ID NO: 1057282 - DNA, 22 bp, Artificial Sequence
  chemically synthesized
tctgatattgttcaatctgcaa

SEQ ID NO: 1057283 - DNA, 22 bp, Artificial Sequence
  chemically synthesized
atattgttcaatctgcaatcaa

SEQ ID NO: 1057284 - DNA, 22 bp, Artificial Sequence
  chemically synthesized
gtaagatggttgctaattgatt

SEQ ID NO: 1057285 - DNA, 22 bp, Artificial Sequence
  chemically synthesized
ttcaatctgcaatcaattagca

SEQ ID NO: 1057286 - DNA, 22 bp, Artificial Sequence
  chemically synthesized
aatctgcaatcaattagcaacc

SEQ ID NO: 1057287 - DNA, 22 bp, Artificial Sequence
  chemically synthesized
gatgcctagtaagatggttgct

SEQ ID NO: 1057288 - DNA, 22 bp, Artificial Sequence
  chemically synthesized
caatcaattagcaaccatctta

SEQ ID NO: 1057289 - DNA, 22 bp, Artificial Sequence
  chemically synthesized
gcaaccatcttactaggcatcc

SEQ ID NO: 1057290 - DNA, 22 bp, Artificial Sequence
  chemically synthesized
cagtgcccataaaagaactgga

SEQ ID NO: 1057291 - DNA, 22 bp, Artificial Sequence
  chemically synthesized
actaggcatccagttcttttat

SEQ ID NO: 1057292 - DNA, 22 bp, Artificial Sequence
  chemically synthesized
ctaggcatccagttcttttatg

SEQ ID NO: 1057293 - DNA, 22 bp, Artificial Sequence
  chemically synthesized
ggcatccagttcttttatgggc

SEQ ID NO: 1057294 - DNA, 22 bp, Artificial Sequence
  chemically synthesized
atgggttacagtgcccataaaa

SEQ ID NO: 1057295 - DNA, 22 bp, Artificial Sequence
  chemically synthesized
aatgggttacagtgcccataaa

SEQ ID NO: 1057296 - DNA, 22 bp, Artificial Sequence
  chemically synthesized
cttaatgggttacagtgcccat

SEQ ID NO: 1057297 - DNA, 22 bp, Artificial Sequence
  chemically synthesized
actacttaatgggttacagtgc

SEQ ID NO: 1057298 - DNA, 22 bp, Artificial Sequence
  chemically synthesized
aactacttaatgggttacagtg

SEQ ID NO: 1057299 - DNA, 22 bp, Artificial Sequence
  chemically synthesized
ttttatgggcactgtaacccat

SEQ ID NO: 1057300 - DNA, 22 bp, Artificial Sequence
  chemically synthesized
gtttaactacttaatgggttac

SEQ ID NO: 1057301 - DNA, 22 bp, Artificial Sequence
  chemically synthesized
ttatgggcactgtaacccatta

SEQ ID NO: 1057302 - DNA, 22 bp, Artificial Sequence
  chemically synthesized
tatgggcactgtaacccattaa

SEQ ID NO: 1057303 - DNA, 22 bp, Artificial Sequence
  chemically synthesized
atgggcactgtaacccattaag

SEQ ID NO: 1057304 - DNA, 22 bp, Artificial Sequence
  chemically synthesized
tgggcactgtaacccattaagt

SEQ ID NO: 1057305 - DNA, 22 bp, Artificial Sequence
  chemically synthesized
acacctggtttaactacttaat

SEQ ID NO: 1057306 - DNA, 22 bp, Artificial Sequence
  chemically synthesized
taacccattaagtagttaaacc

SEQ ID NO: 1057307 - DNA, 22 bp, Artificial Sequence
  chemically synthesized
atcctcacacctggtttaacta

SEQ ID NO: 1057308 - DNA, 22 bp, Artificial Sequence
  chemically synthesized
aatcctcacacctggtttaact

SEQ ID NO: 1057309 - DNA, 22 bp, Artificial Sequence
  chemically synthesized
agtagttaaaccaggtgtgagg

SEQ ID NO: 1057310 - DNA, 22 bp, Artificial Sequence
  chemically synthesized
aagaataatagcttaatcctca

SEQ ID NO: 1057311 - DNA, 22 bp, Artificial Sequence
  chemically synthesized
gaagaataatagcttaatcctc

SEQ ID NO: 1057312 - DNA, 22 bp, Artificial Sequence
  chemically synthesized
aaccaggtgtgaggattaagct

SEQ ID NO: 1057313 - DNA, 22 bp, Artificial Sequence
  chemically synthesized
acttgaagaataatagcttaat

SEQ ID NO: 1057314 - DNA, 22 bp, Artificial Sequence
  chemically synthesized
attgacttgaagaataatagct

SEQ ID NO: 1057315 - DNA, 22 bp, Artificial Sequence
  chemically synthesized
tctcattgacttgaagaataat

SEQ ID NO: 1057316 - DNA, 22 bp, Artificial Sequence
  chemically synthesized
agctattattcttcaagtcaat

SEQ ID NO: 1057317 - DNA, 22 bp, Artificial Sequence
  chemically synthesized
cataagccattatctcattgac

SEQ ID NO: 1057318 - DNA, 22 bp, Artificial Sequence
  chemically synthesized
ttattcttcaagtcaatgagat

SEQ ID NO: 1057319 - DNA, 22 bp, Artificial Sequence
  chemically synthesized
ttcttcaagtcaatgagataat

SEQ ID NO: 1057320 - DNA, 22 bp, Artificial Sequence
  chemically synthesized
ttcaagtcaatgagataatggc

SEQ ID NO: 1057321 - DNA, 22 bp, Artificial Sequence
  chemically synthesized
caagtcaatgagataatggctt

SEQ ID NO: 1057322 - DNA, 22 bp, Artificial Sequence
  chemically synthesized
aagtcaatgagataatggctta

SEQ ID NO: 1057323 - DNA, 22 bp, Artificial Sequence
  chemically synthesized
tgtcaacctgcataagccatta

SEQ ID NO: 1057324 - DNA, 22 bp, Artificial Sequence
  chemically synthesized
atgtcaacctgcataagccatt

SEQ ID NO: 1057325 - DNA, 22 bp, Artificial Sequence
  chemically synthesized
atggtacatcttatgtcaacct

SEQ ID NO: 1057326 - DNA, 22 bp, Artificial Sequence
  chemically synthesized
catggtacatcttatgtcaacc

SEQ ID NO: 1057327 - DNA, 22 bp, Artificial Sequence
  chemically synthesized
atgcaggttgacataagatgta

SEQ ID NO: 1057328 - DNA, 22 bp, Artificial Sequence
  chemically synthesized
tgcaggttgacataagatgtac

SEQ ID NO: 1057329 - DNA, 22 bp, Artificial Sequence
  chemically synthesized
acataagatgtaccatgaaata

SEQ ID NO: 1057330 - DNA, 22 bp, Artificial Sequence
  chemically synthesized
atgtatacatgataaataataa

SEQ ID NO: 1057331 - DNA, 22 bp, Artificial Sequence
  chemically synthesized
aatgtatacatgataaataata

SEQ ID NO: 1057332 - DNA, 22 bp, Artificial Sequence
  chemically synthesized
ttaatgtatacatgataaataa

SEQ ID NO: 1057333 - DNA, 22 bp, Artificial Sequence
  chemically synthesized
cttaatgtatacatgataaata

SEQ ID NO: 1057334 - DNA, 22 bp, Artificial Sequence
  chemically synthesized
tcttaatgtatacatgataaat

SEQ ID NO: 1057335 - DNA, 22 bp, Artificial Sequence
  chemically synthesized
ctttcttaatgtatacatgata

SEQ ID NO: 1057336 - DNA, 22 bp, Artificial Sequence
  chemically synthesized
actttcttaatgtatacatgat

SEQ ID NO: 1057337 - DNA, 22 bp, Artificial Sequence
  chemically synthesized
tactttcttaatgtatacatga

SEQ ID NO: 1057338 - DNA, 22 bp, Artificial Sequence
  chemically synthesized
attatttatcatgtatacatta

SEQ ID NO: 1057339 - DNA, 22 bp, Artificial Sequence
  chemically synthesized
attttactttcttaatgtatac

SEQ ID NO: 1057340 - DNA, 22 bp, Artificial Sequence
  chemically synthesized
ttatttatcatgtatacattaa

SEQ ID NO: 1057341 - DNA, 22 bp, Artificial Sequence
  chemically synthesized
tttatcatgtatacattaagaa

SEQ ID NO: 1057342 - DNA, 22 bp, Artificial Sequence
  chemically synthesized
atcatgtatacattaagaaagt

SEQ ID NO: 1057343 - DNA, 22 bp, Artificial Sequence
  chemically synthesized
tcatgtatacattaagaaagta

SEQ ID NO: 1057344 - DNA, 22 bp, Artificial Sequence
  chemically synthesized
agatcatcccatgctgatttta

SEQ ID NO: 1057345 - DNA, 22 bp, Artificial Sequence
  chemically synthesized
ctgagatcatcccatgctgatt

SEQ ID NO: 1057346 - DNA, 22 bp, Artificial Sequence
  chemically synthesized
cctgagatcatcccatgctgat

SEQ ID NO: 1057347 - DNA, 22 bp, Artificial Sequence
  chemically synthesized
tcctgagatcatcccatgctga

SEQ ID NO: 1057348 - DNA, 22 bp, Artificial Sequence
  chemically synthesized
agaaagtaaaatcagcatggga

SEQ ID NO: 1057349 - DNA, 22 bp, Artificial Sequence
  chemically synthesized
ctttcctgagatcatcccatgc

SEQ ID NO: 1057350 - DNA, 22 bp, Artificial Sequence
  chemically synthesized
atccaaaaaatatgtattgctt

SEQ ID NO: 1057351 - DNA, 22 bp, Artificial Sequence
  chemically synthesized
aggaaagcaatacatatttttt

SEQ ID NO: 1057352 - DNA, 22 bp, Artificial Sequence
  chemically synthesized
aatgtctaatccaaaaaatatg

SEQ ID NO: 1057353 - DNA, 22 bp, Artificial Sequence
  chemically synthesized
caatgtctaatccaaaaaatat

SEQ ID NO: 1057354 - DNA, 22 bp, Artificial Sequence
  chemically synthesized
cttcaatgtctaatccaaaaaa

SEQ ID NO: 1057355 - DNA, 22 bp, Artificial Sequence
  chemically synthesized
acttcaatgtctaatccaaaaa

SEQ ID NO: 1057356 - DNA, 22 bp, Artificial Sequence
  chemically synthesized
tacttcaatgtctaatccaaaa

SEQ ID NO: 1057357 - DNA, 22 bp, Artificial Sequence
  chemically synthesized
actttacttcaatgtctaatcc

SEQ ID NO: 1057358 - DNA, 22 bp, Artificial Sequence
  chemically synthesized
tttggattagacattgaagtaa

SEQ ID NO: 1057359 - DNA, 22 bp, Artificial Sequence
  chemically synthesized
ttggattagacattgaagtaaa

SEQ ID NO: 1057360 - DNA, 22 bp, Artificial Sequence
  chemically synthesized
tcatacattcactttacttcaa

SEQ ID NO: 1057361 - DNA, 22 bp, Artificial Sequence
  chemically synthesized
tggattagacattgaagtaaag

SEQ ID NO: 1057362 - DNA, 22 bp, Artificial Sequence
  chemically synthesized
atcatacattcactttacttca

SEQ ID NO: 1057363 - DNA, 22 bp, Artificial Sequence
  chemically synthesized
ggattagacattgaagtaaagt

SEQ ID NO: 1057364 - DNA, 22 bp, Artificial Sequence
  chemically synthesized
gattagacattgaagtaaagtg

SEQ ID NO: 1057365 - DNA, 22 bp, Artificial Sequence
  chemically synthesized
gacattgaagtaaagtgaatgt

SEQ ID NO: 1057366 - DNA, 22 bp, Artificial Sequence
  chemically synthesized
tcaatttatcatacattcactt

SEQ ID NO: 1057367 - DNA, 22 bp, Artificial Sequence
  chemically synthesized
gtcaatttatcatacattcact

SEQ ID NO: 1057368 - DNA, 22 bp, Artificial Sequence
  chemically synthesized
atttgtcaatttatcatacatt

SEQ ID NO: 1057369 - DNA, 22 bp, Artificial Sequence
  chemically synthesized
aagtaaagtgaatgtatgataa

SEQ ID NO: 1057370 - DNA, 22 bp, Artificial Sequence
  chemically synthesized
gcaatgttaatttgtcaattta

SEQ ID NO: 1057371 - DNA, 22 bp, Artificial Sequence
  chemically synthesized
ataacattggcaatgttaattt

SEQ ID NO: 1057372 - DNA, 22 bp, Artificial Sequence
  chemically synthesized
cataacattggcaatgttaatt

SEQ ID NO: 1057373 - DNA, 22 bp, Artificial Sequence
  chemically synthesized
tcataacattggcaatgttaat

SEQ ID NO: 1057374 - DNA, 22 bp, Artificial Sequence
  chemically synthesized
ttcataacattggcaatgttaa

SEQ ID NO: 1057375 - DNA, 22 bp, Artificial Sequence
  chemically synthesized
acaaattaacattgccaatgtt

SEQ ID NO: 1057376 - DNA, 22 bp, Artificial Sequence
  chemically synthesized
catcatttttcataacattggc

SEQ ID NO: 1057377 - DNA, 22 bp, Artificial Sequence
  chemically synthesized
ctacatcatttttcataacatt

SEQ ID NO: 1057378 - DNA, 22 bp, Artificial Sequence
  chemically synthesized
gctacatcatttttcataacat

SEQ ID NO: 1057379 - DNA, 22 bp, Artificial Sequence
  chemically synthesized
tgctacatcatttttcataaca

SEQ ID NO: 1057380 - DNA, 22 bp, Artificial Sequence
  chemically synthesized
ttgctacatcatttttcataac

SEQ ID NO: 1057381 - DNA, 22 bp, Artificial Sequence
  chemically synthesized
acattgccaatgttatgaaaaa

SEQ ID NO: 1057382 - DNA, 22 bp, Artificial Sequence
  chemically synthesized
tttgctacatcatttttcataa

SEQ ID NO: 1057383 - DNA, 22 bp, Artificial Sequence
  chemically synthesized
ttttgctacatcatttttcata

SEQ ID NO: 1057384 - DNA, 22 bp, Artificial Sequence
  chemically synthesized
tttttgctacatcatttttcat

SEQ ID NO: 1057385 - DNA, 22 bp, Artificial Sequence
  chemically synthesized
ccaatgttatgaaaaatgatgt

SEQ ID NO: 1057386 - DNA, 22 bp, Artificial Sequence
  chemically synthesized
attttttttgctacatcatttt

SEQ ID NO: 1057387 - DNA, 22 bp, Artificial Sequence
  chemically synthesized
aattttttttgctacatcattt

SEQ ID NO: 1057388 - DNA, 22 bp, Artificial Sequence
  chemically synthesized
tgaaaaatgatgtagcaaaaaa

SEQ ID NO: 1057389 - DNA, 22 bp, Artificial Sequence
  chemically synthesized
tcaaaaatgaaaatacatctta

SEQ ID NO: 1057390 - DNA, 22 bp, Artificial Sequence
  chemically synthesized
atcaaaaatgaaaatacatctt

SEQ ID NO: 1057391 - DNA, 22 bp, Artificial Sequence
  chemically synthesized
agatgtattttcatttttgata

SEQ ID NO: 1057392 - DNA, 22 bp, Artificial Sequence
  chemically synthesized
tcatttttgataaggggttttc

SEQ ID NO: 1057393 - DNA, 22 bp, Artificial Sequence
  chemically synthesized
acagataacagggaaaacccct

SEQ ID NO: 1057394 - DNA, 22 bp, Artificial Sequence
  chemically synthesized
catttttgataaggggttttcc

SEQ ID NO: 1057395 - DNA, 22 bp, Artificial Sequence
  chemically synthesized
atttttgataaggggttttccc

SEQ ID NO: 1057396 - DNA, 22 bp, Artificial Sequence
  chemically synthesized
ttgataaggggttttccctgtt

SEQ ID NO: 1057397 - DNA, 22 bp, Artificial Sequence
  chemically synthesized
tgataaggggttttccctgtta

SEQ ID NO: 1057398 - DNA, 22 bp, Artificial Sequence
  chemically synthesized
gataaggggttttccctgttat

SEQ ID NO: 1057399 - DNA, 22 bp, Artificial Sequence
  chemically synthesized
ataaggggttttccctgttatc

SEQ ID NO: 1057400 - DNA, 22 bp, Artificial Sequence
  chemically synthesized
aagacacaagaaattaacagat

SEQ ID NO: 1057401 - DNA, 22 bp, Artificial Sequence
  chemically synthesized
tccctgttatctgttaatttct

SEQ ID NO: 1057402 - DNA, 22 bp, Artificial Sequence
  chemically synthesized
ccctgttatctgttaatttctt

SEQ ID NO: 1057403 - DNA, 22 bp, Artificial Sequence
  chemically synthesized
cctgttatctgttaatttcttg

SEQ ID NO: 1057404 - DNA, 22 bp, Artificial Sequence
  chemically synthesized
ccaattaaagacacaagaaatt

SEQ ID NO: 1057405 - DNA, 22 bp, Artificial Sequence
  chemically synthesized
gccaattaaagacacaagaaat

SEQ ID NO: 1057406 - DNA, 22 bp, Artificial Sequence
  chemically synthesized
tgccaattaaagacacaagaaa

SEQ ID NO: 1057407 - DNA, 22 bp, Artificial Sequence
  chemically synthesized
ttatctgttaatttcttgtgtc

SEQ ID NO: 1057408 - DNA, 22 bp, Artificial Sequence
  chemically synthesized
tctgttaatttcttgtgtcttt

SEQ ID NO: 1057409 - DNA, 22 bp, Artificial Sequence
  chemically synthesized
attttgccaattaaagacacaa

SEQ ID NO: 1057410 - DNA, 22 bp, Artificial Sequence
  chemically synthesized
aattttgccaattaaagacaca

SEQ ID NO: 1057411 - DNA, 22 bp, Artificial Sequence
  chemically synthesized
ttaatttcttgtgtctttaatt

SEQ ID NO: 1057412 - DNA, 22 bp, Artificial Sequence
  chemically synthesized
atttcttgtgtctttaattggc

SEQ ID NO: 1057413 - DNA, 22 bp, Artificial Sequence
  chemically synthesized
gtgcttaattttgccaattaaa

SEQ ID NO: 1057414 - DNA, 22 bp, Artificial Sequence
  chemically synthesized
cttgtgtctttaattggcaaaa

SEQ ID NO: 1057415 - DNA, 22 bp, Artificial Sequence
  chemically synthesized
ttgtgtctttaattggcaaaat

SEQ ID NO: 1057416 - DNA, 22 bp, Artificial Sequence
  chemically synthesized
gtgtctttaattggcaaaatta

SEQ ID NO: 1057417 - DNA, 22 bp, Artificial Sequence
  chemically synthesized
tgtctttaattggcaaaattaa

SEQ ID NO: 1057418 - DNA, 22 bp, Artificial Sequence
  chemically synthesized
taacactagtgcttaattttgc

SEQ ID NO: 1057419 - DNA, 22 bp, Artificial Sequence
  chemically synthesized
tgtaacactagtgcttaatttt

SEQ ID NO: 1057420 - DNA, 22 bp, Artificial Sequence
  chemically synthesized
ctgtaacactagtgcttaattt

SEQ ID NO: 1057421 - DNA, 22 bp, Artificial Sequence
  chemically synthesized
taattggcaaaattaagcacta

SEQ ID NO: 1057422 - DNA, 22 bp, Artificial Sequence
  chemically synthesized
aattggcaaaattaagcactag

SEQ ID NO: 1057423 - DNA, 22 bp, Artificial Sequence
  chemically synthesized
attggcaaaattaagcactagt

SEQ ID NO: 1057424 - DNA, 22 bp, Artificial Sequence
  chemically synthesized
ggcttctgtaacactagtgctt

SEQ ID NO: 1057425 - DNA, 22 bp, Artificial Sequence
  chemically synthesized
gggcttctgtaacactagtgct

SEQ ID NO: 1057426 - DNA, 22 bp, Artificial Sequence
  chemically synthesized
tgggcttctgtaacactagtgc

SEQ ID NO: 1057427 - DNA, 22 bp, Artificial Sequence
  chemically synthesized
gcaaaattaagcactagtgtta

SEQ ID NO: 1057428 - DNA, 22 bp, Artificial Sequence
  chemically synthesized
actttgggcttctgtaacacta

SEQ ID NO: 1057429 - DNA, 22 bp, Artificial Sequence
  chemically synthesized
cctcactttgggcttctgtaac

SEQ ID NO: 1057430 - DNA, 22 bp, Artificial Sequence
  chemically synthesized
ccctcactttgggcttctgtaa

SEQ ID NO: 1057431 - DNA, 22 bp, Artificial Sequence
  chemically synthesized
agcactagtgttacagaagccc

SEQ ID NO: 1057432 - DNA, 22 bp, Artificial Sequence
  chemically synthesized
gtgttacagaagcccaaagtga

SEQ ID NO: 1057433 - DNA, 22 bp, Artificial Sequence
  chemically synthesized
aaagtgagtggtttccctcact

SEQ ID NO: 1057434 - DNA, 22 bp, Artificial Sequence
  chemically synthesized
cagaagcccaaagtgagggaaa

SEQ ID NO: 1057435 - DNA, 22 bp, Artificial Sequence
  chemically synthesized
tgaaagtgagtggtttccctca

SEQ ID NO: 1057436 - DNA, 22 bp, Artificial Sequence
  chemically synthesized
atgtacattctgaaagtgagtg

SEQ ID NO: 1057437 - DNA, 22 bp, Artificial Sequence
  chemically synthesized
taatgtacattctgaaagtgag

SEQ ID NO: 1057438 - DNA, 22 bp, Artificial Sequence
  chemically synthesized
ctaatgtacattctgaaagtga

SEQ ID NO: 1057439 - DNA, 22 bp, Artificial Sequence
  chemically synthesized
aacttctaatgtacattctgaa

SEQ ID NO: 1057440 - DNA, 22 bp, Artificial Sequence
  chemically synthesized
aaacttctaatgtacattctga

SEQ ID NO: 1057441 - DNA, 22 bp, Artificial Sequence
  chemically synthesized
taaacttctaatgtacattctg

SEQ ID NO: 1057442 - DNA, 22 bp, Artificial Sequence
  chemically synthesized
actttcagaatgtacattagaa

SEQ ID NO: 1057443 - DNA, 22 bp, Artificial Sequence
  chemically synthesized
ggtacagttttaaacttctaat

SEQ ID NO: 1057444 - DNA, 22 bp, Artificial Sequence
  chemically synthesized
tcagaatgtacattagaagttt

SEQ ID NO: 1057445 - DNA, 22 bp, Artificial Sequence
  chemically synthesized
cagaatgtacattagaagttta

SEQ ID NO: 1057446 - DNA, 22 bp, Artificial Sequence
  chemically synthesized
agaatgtacattagaagtttaa

SEQ ID NO: 1057447 - DNA, 22 bp, Artificial Sequence
  chemically synthesized
gaagtttaaaactgtacccaga

SEQ ID NO: 1057448 - DNA, 22 bp, Artificial Sequence
  chemically synthesized
aaaactgtacccagattttttg

SEQ ID NO: 1057449 - DNA, 22 bp, Artificial Sequence
  chemically synthesized
aaactgtacccagattttttgt

SEQ ID NO: 1057450 - DNA, 22 bp, Artificial Sequence
  chemically synthesized
ataaaaaaaaaagagacaaaaa

SEQ ID NO: 1057451 - DNA, 22 bp, Artificial Sequence
  chemically synthesized
tacccagattttttgtctcttt

SEQ ID NO: 1057452 - DNA, 22 bp, Artificial Sequence
  chemically synthesized
ctaataaaaaaaaaagagacaa

SEQ ID NO: 1057453 - DNA, 22 bp, Artificial Sequence
  chemically synthesized
tttgtctcttttttttttatta

SEQ ID NO: 1057454 - DNA, 22 bp, Artificial Sequence
  chemically synthesized
acagaggcctactaataaaaaa

SEQ ID NO: 1057455 - DNA, 22 bp, Artificial Sequence
  chemically synthesized
ttgtctcttttttttttattag

SEQ ID NO: 1057456 - DNA, 22 bp, Artificial Sequence
  chemically synthesized
tgtctcttttttttttattagt

SEQ ID NO: 1057457 - DNA, 22 bp, Artificial Sequence
  chemically synthesized
gtctcttttttttttattagta

SEQ ID NO: 1057458 - DNA, 22 bp, Artificial Sequence
  chemically synthesized
ttaacagaggcctactaataaa

SEQ ID NO: 1057459 - DNA, 22 bp, Artificial Sequence
  chemically synthesized
tctcttttttttttattagtag

SEQ ID NO: 1057460 - DNA, 22 bp, Artificial Sequence
  chemically synthesized
tattaacagaggcctactaata

SEQ ID NO: 1057461 - DNA, 22 bp, Artificial Sequence
  chemically synthesized
ttttttttttattagtaggcct

SEQ ID NO: 1057462 - DNA, 22 bp, Artificial Sequence
  chemically synthesized
ctctattaacagaggcctacta

SEQ ID NO: 1057463 - DNA, 22 bp, Artificial Sequence
  chemically synthesized
ttttttttattagtaggcctct

SEQ ID NO: 1057464 - DNA, 22 bp, Artificial Sequence
  chemically synthesized
tttttttattagtaggcctctg

SEQ ID NO: 1057465 - DNA, 22 bp, Artificial Sequence
  chemically synthesized
ctactctattaacagaggccta

SEQ ID NO: 1057466 - DNA, 22 bp, Artificial Sequence
  chemically synthesized
ttttttattagtaggcctctgt

SEQ ID NO: 1057467 - DNA, 22 bp, Artificial Sequence
  chemically synthesized
tttttattagtaggcctctgtt

SEQ ID NO: 1057468 - DNA, 22 bp, Artificial Sequence
  chemically synthesized
ttttattagtaggcctctgtta

SEQ ID NO: 1057469 - DNA, 22 bp, Artificial Sequence
  chemically synthesized
tttattagtaggcctctgttaa

SEQ ID NO: 1057470 - DNA, 22 bp, Artificial Sequence
  chemically synthesized
ttattagtaggcctctgttaat

SEQ ID NO: 1057471 - DNA, 22 bp, Artificial Sequence
  chemically synthesized
tattagtaggcctctgttaata

SEQ ID NO: 1057472 - DNA, 22 bp, Artificial Sequence
  chemically synthesized
caactactactctattaacaga

SEQ ID NO: 1057473 - DNA, 22 bp, Artificial Sequence
  chemically synthesized
attagtaggcctctgttaatag

SEQ ID NO: 1057474 - DNA, 22 bp, Artificial Sequence
  chemically synthesized
gcaactactactctattaacag

SEQ ID NO: 1057475 - DNA, 22 bp, Artificial Sequence
  chemically synthesized
ttagtaggcctctgttaataga

SEQ ID NO: 1057476 - DNA, 22 bp, Artificial Sequence
  chemically synthesized
gtaggcctctgttaatagagta

SEQ ID NO: 1057477 - DNA, 22 bp, Artificial Sequence
  chemically synthesized
tgttaatagagtagtagttgca

SEQ ID NO: 1057478 - DNA, 22 bp, Artificial Sequence
  chemically synthesized
ttaatagagtagtagttgcaaa

SEQ ID NO: 1057479 - DNA, 22 bp, Artificial Sequence
  chemically synthesized
atagagtagtagttgcaaacac

SEQ ID NO: 1057480 - DNA, 22 bp, Artificial Sequence
  chemically synthesized
gcaaacccacgtatgtgtttgc

SEQ ID NO: 1057481 - DNA, 22 bp, Artificial Sequence
  chemically synthesized
ctggcaaacccacgtatgtgtt

SEQ ID NO: 1057482 - DNA, 22 bp, Artificial Sequence
  chemically synthesized
ttactggcaaacccacgtatgt

SEQ ID NO: 1057483 - DNA, 22 bp, Artificial Sequence
  chemically synthesized
caaacacatacgtgggtttgcc

SEQ ID NO: 1057484 - DNA, 22 bp, Artificial Sequence
  chemically synthesized
tgagttgttactggcaaaccca

SEQ ID NO: 1057485 - DNA, 22 bp, Artificial Sequence
  chemically synthesized
cacaaattgtgagttgttactg

SEQ ID NO: 1057486 - DNA, 22 bp, Artificial Sequence
  chemically synthesized
gcacaaattgtgagttgttact

SEQ ID NO: 1057487 - DNA, 22 bp, Artificial Sequence
  chemically synthesized
tgcacaaattgtgagttgttac

SEQ ID NO: 1057488 - DNA, 22 bp, Artificial Sequence
  chemically synthesized
aactttgcacaaattgtgagtt

SEQ ID NO: 1057489 - DNA, 22 bp, Artificial Sequence
  chemically synthesized
gccagtaacaactcacaatttg

SEQ ID NO: 1057490 - DNA, 22 bp, Artificial Sequence
  chemically synthesized
ccagtaacaactcacaatttgt

SEQ ID NO: 1057491 - DNA, 22 bp, Artificial Sequence
  chemically synthesized
gaagactcaactttgcacaaat

SEQ ID NO: 1057492 - DNA, 22 bp, Artificial Sequence
  chemically synthesized
cgaagactcaactttgcacaaa

SEQ ID NO: 1057493 - DNA, 22 bp, Artificial Sequence
  chemically synthesized
agtttcgaagactcaactttgc

SEQ ID NO: 1057494 - DNA, 22 bp, Artificial Sequence
  chemically synthesized
acaatttgtgcaaagttgagtc

SEQ ID NO: 1057495 - DNA, 22 bp, Artificial Sequence
  chemically synthesized
ctcagtttcgaagactcaactt

SEQ ID NO: 1057496 - DNA, 22 bp, Artificial Sequence
  chemically synthesized
gctcagtttcgaagactcaact

SEQ ID NO: 1057497 - DNA, 22 bp, Artificial Sequence
  chemically synthesized
gtgcaaagttgagtcttcgaaa

SEQ ID NO: 1057498 - DNA, 22 bp, Artificial Sequence
  chemically synthesized
tgcaaagttgagtcttcgaaac

SEQ ID NO: 1057499 - DNA, 22 bp, Artificial Sequence
  chemically synthesized
agagcaaatttgctcagtttcg

SEQ ID NO: 1057500 - DNA, 22 bp, Artificial Sequence
  chemically synthesized
agtcttcgaaactgagcaaatt

SEQ ID NO: 1057501 - DNA, 22 bp, Artificial Sequence
  chemically synthesized
gcgggaaattgagagcaaattt

SEQ ID NO: 1057502 - DNA, 22 bp, Artificial Sequence
  chemically synthesized
cgaaactgagcaaatttgctct

SEQ ID NO: 1057503 - DNA, 22 bp, Artificial Sequence
  chemically synthesized
gaaactgagcaaatttgctctc

SEQ ID NO: 1057504 - DNA, 22 bp, Artificial Sequence
  chemically synthesized
agcaaatttgctctcaatttcc

SEQ ID NO: 1057505 - DNA, 22 bp, Artificial Sequence
  chemically synthesized
agcaagcgctggcgggaaattg

SEQ ID NO: 1057506 - DNA, 22 bp, Artificial Sequence
  chemically synthesized
gctctcaatttcccgccagcgc

SEQ ID NO: 1057507 - DNA, 22 bp, Artificial Sequence
  chemically synthesized
ctctcaatttcccgccagcgct

SEQ ID NO: 1057508 - DNA, 22 bp, Artificial Sequence
  chemically synthesized
tcaatttcccgccagcgcttgc

SEQ ID NO: 1057509 - DNA, 22 bp, Artificial Sequence
  chemically synthesized
agatccagctcagcaagcgctg

SEQ ID NO: 1057510 - DNA, 22 bp, Artificial Sequence
  chemically synthesized
aatttcccgccagcgcttgctg

SEQ ID NO: 1057511 - DNA, 22 bp, Artificial Sequence
  chemically synthesized
cccgccagcgcttgctgagctg

SEQ ID NO: 1057512 - DNA, 22 bp, Artificial Sequence
  chemically synthesized
ccgccagcgcttgctgagctgg

SEQ ID NO: 1057513 - DNA, 22 bp, Artificial Sequence
  chemically synthesized
gctgagctggatctgagttggc

SEQ ID NO: 1057514 - DNA, 22 bp, Artificial Sequence
  chemically synthesized
ctgagctggatctgagttggct

SEQ ID NO: 1057515 - DNA, 22 bp, Artificial Sequence
  chemically synthesized
agctggatctgagttggctcca

SEQ ID NO: 1057516 - DNA, 22 bp, Artificial Sequence
  chemically synthesized
gatctgagttggctccactgcc

SEQ ID NO: 1057517 - DNA, 22 bp, Artificial Sequence
  chemically synthesized
aggatggggccgcaatggcagt

SEQ ID NO: 1057518 - DNA, 22 bp, Artificial Sequence
  chemically synthesized
agttggctccactgccattgcg

SEQ ID NO: 1057519 - DNA, 22 bp, Artificial Sequence
  chemically synthesized
tctgaggatggggccgcaatgg

SEQ ID NO: 1057520 - DNA, 22 bp, Artificial Sequence
  chemically synthesized
gtctgaggatggggccgcaatg

SEQ ID NO: 1057521 - DNA, 22 bp, Artificial Sequence
  chemically synthesized
gctccactgccattgcggcccc

SEQ ID NO: 1057522 - DNA, 22 bp, Artificial Sequence
  chemically synthesized
cactgccattgcggccccatcc

SEQ ID NO: 1057523 - DNA, 22 bp, Artificial Sequence
  chemically synthesized
agggcttgtctgaggatggggc

SEQ ID NO: 1057524 - DNA, 22 bp, Artificial Sequence
  chemically synthesized
ccattgcggccccatcctcaga

SEQ ID NO: 1057525 - DNA, 22 bp, Artificial Sequence
  chemically synthesized
cggccccatcctcagacaagcc

SEQ ID NO: 1057526 - DNA, 22 bp, Artificial Sequence
  chemically synthesized
aatgcagtgcgtaggcaagctg

SEQ ID NO: 1057527 - DNA, 22 bp, Artificial Sequence
  chemically synthesized
agacaagccctcagcttgccta

SEQ ID NO: 1057528 - DNA, 22 bp, Artificial Sequence
  chemically synthesized
agcttgcctacgcactgcattc

SEQ ID NO: 1057529 - DNA, 22 bp, Artificial Sequence
  chemically synthesized
gcctacgcactgcattcagctc

SEQ ID NO: 1057530 - DNA, 22 bp, Artificial Sequence
  chemically synthesized
cctacgcactgcattcagctcc

SEQ ID NO: 1057531 - DNA, 22 bp, Artificial Sequence
  chemically synthesized
cagaagaagaaagaggagctga

SEQ ID NO: 1057532 - DNA, 22 bp, Artificial Sequence
  chemically synthesized
cgcactgcattcagctcctctt

SEQ ID NO: 1057533 - DNA, 22 bp, Artificial Sequence
  chemically synthesized
cattcagctcctctttcttctt

SEQ ID NO: 1057534 - DNA, 22 bp, Artificial Sequence
  chemically synthesized
atcgggaattgcagaagaagaa

SEQ ID NO: 1057535 - DNA, 22 bp, Artificial Sequence
  chemically synthesized
agctcctctttcttcttctgca

SEQ ID NO: 1057536 - DNA, 22 bp, Artificial Sequence
  chemically synthesized
ctctttcttcttctgcaattcc

SEQ ID NO: 1057537 - DNA, 22 bp, Artificial Sequence
  chemically synthesized
tttcttcttctgcaattcccga

SEQ ID NO: 1057538 - DNA, 22 bp, Artificial Sequence
  chemically synthesized
aataggaaattgatcgggaatt

SEQ ID NO: 1057539 - DNA, 22 bp, Artificial Sequence
  chemically synthesized
tcttcttctgcaattcccgatc

SEQ ID NO: 1057540 - DNA, 22 bp, Artificial Sequence
  chemically synthesized
cttcttctgcaattcccgatca

SEQ ID NO: 1057541 - DNA, 22 bp, Artificial Sequence
  chemically synthesized
ttcttctgcaattcccgatcaa

SEQ ID NO: 1057542 - DNA, 22 bp, Artificial Sequence
  chemically synthesized
ctcaataggaaattgatcggga

SEQ ID NO: 1057543 - DNA, 22 bp, Artificial Sequence
  chemically synthesized
gctcaataggaaattgatcggg

SEQ ID NO: 1057544 - DNA, 22 bp, Artificial Sequence
  chemically synthesized
cttctgcaattcccgatcaatt

SEQ ID NO: 1057545 - DNA, 22 bp, Artificial Sequence
  chemically synthesized
tgctcaataggaaattgatcgg

SEQ ID NO: 1057546 - DNA, 22 bp, Artificial Sequence
  chemically synthesized
ttctgcaattcccgatcaattt

SEQ ID NO: 1057547 - DNA, 22 bp, Artificial Sequence
  chemically synthesized
ctgcaattcccgatcaatttcc

SEQ ID NO: 1057548 - DNA, 22 bp, Artificial Sequence
  chemically synthesized
tgcaattcccgatcaatttcct

SEQ ID NO: 1057549 - DNA, 22 bp, Artificial Sequence
  chemically synthesized
gttttgctcaataggaaattga

SEQ ID NO: 1057550 - DNA, 22 bp, Artificial Sequence
  chemically synthesized
caattcccgatcaatttcctat

SEQ ID NO: 1057551 - DNA, 22 bp, Artificial Sequence
  chemically synthesized
tattggttttgctcaataggaa

SEQ ID NO: 1057552 - DNA, 22 bp, Artificial Sequence
  chemically synthesized
ccgatcaatttcctattgagca

SEQ ID NO: 1057553 - DNA, 22 bp, Artificial Sequence
  chemically synthesized
ggccctgtattggttttgctca

SEQ ID NO: 1057554 - DNA, 22 bp, Artificial Sequence
  chemically synthesized
ccctgggccctgtattggtttt

SEQ ID NO: 1057555 - DNA, 22 bp, Artificial Sequence
  chemically synthesized
cctattgagcaaaaccaataca

SEQ ID NO: 1057556 - DNA, 22 bp, Artificial Sequence
  chemically synthesized
ctattgagcaaaaccaatacag

SEQ ID NO: 1057557 - DNA, 22 bp, Artificial Sequence
  chemically synthesized
actgccctgggccctgtattgg

SEQ ID NO: 1057558 - DNA, 22 bp, Artificial Sequence
  chemically synthesized
ttgagcaaaaccaatacagggc

SEQ ID NO: 1057559 - DNA, 22 bp, Artificial Sequence
  chemically synthesized
gctaactgccctgggccctgta

SEQ ID NO: 1057560 - DNA, 22 bp, Artificial Sequence
  chemically synthesized
agcaaaaccaatacagggccca

SEQ ID NO: 1057561 - DNA, 22 bp, Artificial Sequence
  chemically synthesized
atgtggttagctaactgccctg

SEQ ID NO: 1057562 - DNA, 22 bp, Artificial Sequence
  chemically synthesized
caagtcggttgatgtggttagc

SEQ ID NO: 1057563 - DNA, 22 bp, Artificial Sequence
  chemically synthesized
gcaagtcggttgatgtggttag

SEQ ID NO: 1057564 - DNA, 22 bp, Artificial Sequence
  chemically synthesized
cttgcaagtcggttgatgtggt

SEQ ID NO: 1057565 - DNA, 22 bp, Artificial Sequence
  chemically synthesized
ctgcttgcaagtcggttgatgt

SEQ ID NO: 1057566 - DNA, 22 bp, Artificial Sequence
  chemically synthesized
gctgcttgcaagtcggttgatg

SEQ ID NO: 1057567 - DNA, 22 bp, Artificial Sequence
  chemically synthesized
gctaaccacatcaaccgacttg

SEQ ID NO: 1057568 - DNA, 22 bp, Artificial Sequence
  chemically synthesized
accacatcaaccgacttgcaag

SEQ ID NO: 1057569 - DNA, 22 bp, Artificial Sequence
  chemically synthesized
agagaagtatttgctgcttgca

SEQ ID NO: 1057570 - DNA, 22 bp, Artificial Sequence
  chemically synthesized
gagagaagtatttgctgcttgc

SEQ ID NO: 1057571 - DNA, 22 bp, Artificial Sequence
  chemically synthesized
tgagagaagtatttgctgcttg

SEQ ID NO: 1057572 - DNA, 22 bp, Artificial Sequence
  chemically synthesized
aaattttgagagaagtatttgc

SEQ ID NO: 1057573 - DNA, 22 bp, Artificial Sequence
  chemically synthesized
gaaattttgagagaagtatttg

SEQ ID NO: 1057574 - DNA, 22 bp, Artificial Sequence
  chemically synthesized
tgaaattttgagagaagtattt

SEQ ID NO: 1057575 - DNA, 22 bp, Artificial Sequence
  chemically synthesized
gcaagcagcaaatacttctctc

SEQ ID NO: 1057576 - DNA, 22 bp, Artificial Sequence
  chemically synthesized
caagcagcaaatacttctctca

SEQ ID NO: 1057577 - DNA, 22 bp, Artificial Sequence
  chemically synthesized
ctctcaaaatttcaaaggctgt

SEQ ID NO: 1057578 - DNA, 22 bp, Artificial Sequence
  chemically synthesized
tctcaaaatttcaaaggctgtt

SEQ ID NO: 1057579 - DNA, 22 bp, Artificial Sequence
  chemically synthesized
tcaaaatttcaaaggctgttgt

SEQ ID NO: 1057580 - DNA, 22 bp, Artificial Sequence
  chemically synthesized
aaaatttcaaaggctgttgtcc

SEQ ID NO: 1057581 - DNA, 22 bp, Artificial Sequence
  chemically synthesized
aaaggatgacaataaagggaca

SEQ ID NO: 1057582 - DNA, 22 bp, Artificial Sequence
  chemically synthesized
caaaggatgacaataaagggac

SEQ ID NO: 1057583 - DNA, 22 bp, Artificial Sequence
  chemically synthesized
caaaggctgttgtccctttatt

SEQ ID NO: 1057584 - DNA, 22 bp, Artificial Sequence
  chemically synthesized
aaaggctgttgtccctttattg

SEQ ID NO: 1057585 - DNA, 22 bp, Artificial Sequence
  chemically synthesized
taaacttcaaaggatgacaata

SEQ ID NO: 1057586 - DNA, 22 bp, Artificial Sequence
  chemically synthesized
gtaaacttcaaaggatgacaat

SEQ ID NO: 1057587 - DNA, 22 bp, Artificial Sequence
  chemically synthesized
ttgtccctttattgtcatcctt

SEQ ID NO: 1057588 - DNA, 22 bp, Artificial Sequence
  chemically synthesized
tccctttattgtcatcctttga

SEQ ID NO: 1057589 - DNA, 22 bp, Artificial Sequence
  chemically synthesized
atatttgtaaacttcaaaggat

SEQ ID NO: 1057590 - DNA, 22 bp, Artificial Sequence
  chemically synthesized
catatttgtaaacttcaaagga

SEQ ID NO: 1057591 - DNA, 22 bp, Artificial Sequence
  chemically synthesized
tcatatttgtaaacttcaaagg

SEQ ID NO: 1057592 - DNA, 22 bp, Artificial Sequence
  chemically synthesized
tattgtcatcctttgaagttta

SEQ ID NO: 1057593 - DNA, 22 bp, Artificial Sequence
  chemically synthesized
attgtcatcctttgaagtttac

SEQ ID NO: 1057594 - DNA, 22 bp, Artificial Sequence
  chemically synthesized
ttgtcatcctttgaagtttaca

SEQ ID NO: 1057595 - DNA, 22 bp, Artificial Sequence
  chemically synthesized
tcatcctttgaagtttacaaat

SEQ ID NO: 1057596 - DNA, 22 bp, Artificial Sequence
  chemically synthesized
tgaagtttacaaatatgaaagg

SEQ ID NO: 1057597 - DNA, 22 bp, Artificial Sequence
  chemically synthesized
gaagtttacaaatatgaaaggc

SEQ ID NO: 1057598 - DNA, 22 bp, Artificial Sequence
  chemically synthesized
aagtttacaaatatgaaaggca

SEQ ID NO: 1057599 - DNA, 22 bp, Artificial Sequence
  chemically synthesized
agcgaggatgacagtcatgcct

SEQ ID NO: 1057600 - DNA, 22 bp, Artificial Sequence
  chemically synthesized
acaaatatgaaaggcatgactg

SEQ ID NO: 1057601 - DNA, 22 bp, Artificial Sequence
  chemically synthesized
caaatatgaaaggcatgactgt

SEQ ID NO: 1057602 - DNA, 22 bp, Artificial Sequence
  chemically synthesized
ttgagcgaggatgacagtcatg

SEQ ID NO: 1057603 - DNA, 22 bp, Artificial Sequence
  chemically synthesized
ggttattgagcgaggatgacag

SEQ ID NO: 1057604 - DNA, 22 bp, Artificial Sequence
  chemically synthesized
gggttattgagcgaggatgaca

SEQ ID NO: 1057605 - DNA, 22 bp, Artificial Sequence
  chemically synthesized
aaataatatttgggttattgag

SEQ ID NO: 1057606 - DNA, 22 bp, Artificial Sequence
  chemically synthesized
tcatcctcgctcaataacccaa

SEQ ID NO: 1057607 - DNA, 22 bp, Artificial Sequence
  chemically synthesized
gctcaataacccaaatattatt

SEQ ID NO: 1057608 - DNA, 22 bp, Artificial Sequence
  chemically synthesized
aaaggataactgaaataatatt

SEQ ID NO: 1057609 - DNA, 22 bp, Artificial Sequence
  chemically synthesized
aataacccaaatattatttcag

SEQ ID NO: 1057610 - DNA, 22 bp, Artificial Sequence
  chemically synthesized
aaaccaagcattcaaaggataa

SEQ ID NO: 1057611 - DNA, 22 bp, Artificial Sequence
  chemically synthesized
tttcagttatcctttgaatgct

SEQ ID NO: 1057612 - DNA, 22 bp, Artificial Sequence
  chemically synthesized
cagttatcctttgaatgcttgg

SEQ ID NO: 1057613 - DNA, 22 bp, Artificial Sequence
  chemically synthesized
gaatatctaaaaccaagcattc

SEQ ID NO: 1057614 - DNA, 22 bp, Artificial Sequence
  chemically synthesized
agttatcctttgaatgcttggt

SEQ ID NO: 1057615 - DNA, 22 bp, Artificial Sequence
  chemically synthesized
attagaatatctaaaaccaagc

SEQ ID NO: 1057616 - DNA, 22 bp, Artificial Sequence
  chemically synthesized
aattagaatatctaaaaccaag

SEQ ID NO: 1057617 - DNA, 22 bp, Artificial Sequence
  chemically synthesized
tcctttgaatgcttggttttag

SEQ ID NO: 1057618 - DNA, 22 bp, Artificial Sequence
  chemically synthesized
cttaattagaatatctaaaacc

SEQ ID NO: 1057619 - DNA, 22 bp, Artificial Sequence
  chemically synthesized
acttaattagaatatctaaaac

SEQ ID NO: 1057620 - DNA, 22 bp, Artificial Sequence
  chemically synthesized
tgaatgcttggttttagatatt

SEQ ID NO: 1057621 - DNA, 22 bp, Artificial Sequence
  chemically synthesized
gaatgcttggttttagatattc

SEQ ID NO: 1057622 - DNA, 22 bp, Artificial Sequence
  chemically synthesized
aatgcttggttttagatattct

SEQ ID NO: 1057623 - DNA, 22 bp, Artificial Sequence
  chemically synthesized
aatatttacttaattagaatat

SEQ ID NO: 1057624 - DNA, 22 bp, Artificial Sequence
  chemically synthesized
caatatttacttaattagaata

SEQ ID NO: 1057625 - DNA, 22 bp, Artificial Sequence
  chemically synthesized
ggttttagatattctaattaag

SEQ ID NO: 1057626 - DNA, 22 bp, Artificial Sequence
  chemically synthesized
gttttagatattctaattaagt

SEQ ID NO: 1057627 - DNA, 22 bp, Artificial Sequence
  chemically synthesized
tagatattctaattaagtaaat

SEQ ID NO: 1057628 - DNA, 22 bp, Artificial Sequence
  chemically synthesized
agatattctaattaagtaaata

SEQ ID NO: 1057629 - DNA, 22 bp, Artificial Sequence
  chemically synthesized
gaccaatttcaatatttactta

SEQ ID NO: 1057630 - DNA, 22 bp, Artificial Sequence
  chemically synthesized
gatattctaattaagtaaatat

SEQ ID NO: 1057631 - DNA, 22 bp, Artificial Sequence
  chemically synthesized
taattaagtaaatattgaaatt

SEQ ID NO: 1057632 - DNA, 22 bp, Artificial Sequence
  chemically synthesized
attaagtaaatattgaaattgg

SEQ ID NO: 1057633 - DNA, 22 bp, Artificial Sequence
  chemically synthesized
agtaaatattgaaattggtcta

SEQ ID NO: 1057634 - DNA, 22 bp, Artificial Sequence
  chemically synthesized
gaagaaagaaaatgttagacca

SEQ ID NO: 1057635 - DNA, 22 bp, Artificial Sequence
  chemically synthesized
agaagaaagaaaatgttagacc

SEQ ID NO: 1057636 - DNA, 22 bp, Artificial Sequence
  chemically synthesized
aaattggtctaacattttcttt

SEQ ID NO: 1057637 - DNA, 22 bp, Artificial Sequence
  chemically synthesized
gtctaacattttctttcttcta

SEQ ID NO: 1057638 - DNA, 22 bp, Artificial Sequence
  chemically synthesized
acattttctttcttctaaattc

SEQ ID NO: 1057639 - DNA, 22 bp, Artificial Sequence
  chemically synthesized
tctttcttctaaattcctctgg

SEQ ID NO: 1057640 - DNA, 22 bp, Artificial Sequence
  chemically synthesized
ctttcttctaaattcctctggt

SEQ ID NO: 1057641 - DNA, 22 bp, Artificial Sequence
  chemically synthesized
aaatcccaagacaccagaggaa

SEQ ID NO: 1057642 - DNA, 22 bp, Artificial Sequence
  chemically synthesized
tttcttctaaattcctctggtg

SEQ ID NO: 1057643 - DNA, 22 bp, Artificial Sequence
  chemically synthesized
caaatcccaagacaccagagga

SEQ ID NO: 1057644 - DNA, 22 bp, Artificial Sequence
  chemically synthesized
tcttctaaattcctctggtgtc

SEQ ID NO: 1057645 - DNA, 22 bp, Artificial Sequence
  chemically synthesized
cttctaaattcctctggtgtct

SEQ ID NO: 1057646 - DNA, 22 bp, Artificial Sequence
  chemically synthesized
tttcaaatcccaagacaccaga

SEQ ID NO: 1057647 - DNA, 22 bp, Artificial Sequence
  chemically synthesized
ttctaaattcctctggtgtctt

SEQ ID NO: 1057648 - DNA, 22 bp, Artificial Sequence
  chemically synthesized
ctaaattcctctggtgtcttgg

SEQ ID NO: 1057649 - DNA, 22 bp, Artificial Sequence
  chemically synthesized
taaattcctctggtgtcttggg

SEQ ID NO: 1057650 - DNA, 22 bp, Artificial Sequence
  chemically synthesized
aattcctctggtgtcttgggat

SEQ ID NO: 1057651 - DNA, 22 bp, Artificial Sequence
  chemically synthesized
caaattgtttcaaatcccaaga

SEQ ID NO: 1057652 - DNA, 22 bp, Artificial Sequence
  chemically synthesized
ctctggtgtcttgggatttgaa

SEQ ID NO: 1057653 - DNA, 22 bp, Artificial Sequence
  chemically synthesized
tcactccaaattgtttcaaatc

SEQ ID NO: 1057654 - DNA, 22 bp, Artificial Sequence
  chemically synthesized
tggtgtcttgggatttgaaaca

SEQ ID NO: 1057655 - DNA, 22 bp, Artificial Sequence
  chemically synthesized
gtgtcttgggatttgaaacaat

SEQ ID NO: 1057656 - DNA, 22 bp, Artificial Sequence
  chemically synthesized
gggatttgaaacaatttggagt

SEQ ID NO: 1057657 - DNA, 22 bp, Artificial Sequence
  chemically synthesized
ggatttgaaacaatttggagtg

SEQ ID NO: 1057658 - DNA, 22 bp, Artificial Sequence
  chemically synthesized
ataaataatgagttatcactcc

SEQ ID NO: 1057659 - DNA, 22 bp, Artificial Sequence
  chemically synthesized
gaaacaatttggagtgataact

SEQ ID NO: 1057660 - DNA, 22 bp, Artificial Sequence
  chemically synthesized
aaacaatttggagtgataactc

SEQ ID NO: 1057661 - DNA, 22 bp, Artificial Sequence
  chemically synthesized
ggagtgataactcattatttat

SEQ ID NO: 1057662 - DNA, 22 bp, Artificial Sequence
  chemically synthesized
gagtgataactcattatttatt

SEQ ID NO: 1057663 - DNA, 22 bp, Artificial Sequence
  chemically synthesized
tgtggacggtccctaataaata

SEQ ID NO: 1057664 - DNA, 22 bp, Artificial Sequence
  chemically synthesized
tatgtggacggtccctaataaa

SEQ ID NO: 1057665 - DNA, 22 bp, Artificial Sequence
  chemically synthesized
tattctatgtggacggtcccta

SEQ ID NO: 1057666 - DNA, 22 bp, Artificial Sequence
  chemically synthesized
attatttattagggaccgtcca

SEQ ID NO: 1057667 - DNA, 22 bp, Artificial Sequence
  chemically synthesized
aattatattctatgtggacggt

SEQ ID NO: 1057668 - DNA, 22 bp, Artificial Sequence
  chemically synthesized
tttattagggaccgtccacata

SEQ ID NO: 1057669 - DNA, 22 bp, Artificial Sequence
  chemically synthesized
taaattatattctatgtggacg

SEQ ID NO: 1057670 - DNA, 22 bp, Artificial Sequence
  chemically synthesized
attagggaccgtccacatagaa

SEQ ID NO: 1057671 - DNA, 22 bp, Artificial Sequence
  chemically synthesized
ttagggaccgtccacatagaat

SEQ ID NO: 1057672 - DNA, 22 bp, Artificial Sequence
  chemically synthesized
ccctctaaattatattctatgt

SEQ ID NO: 1057673 - DNA, 22 bp, Artificial Sequence
  chemically synthesized
accctctaaattatattctatg

SEQ ID NO: 1057674 - DNA, 22 bp, Artificial Sequence
  chemically synthesized
gggaccgtccacatagaatata

SEQ ID NO: 1057675 - DNA, 22 bp, Artificial Sequence
  chemically synthesized
acttaccctctaaattatattc

SEQ ID NO: 1057676 - DNA, 22 bp, Artificial Sequence
  chemically synthesized
ttcacttaccctctaaattata

SEQ ID NO: 1057677 - DNA, 22 bp, Artificial Sequence
  chemically synthesized
attcacttaccctctaaattat

SEQ ID NO: 1057678 - DNA, 22 bp, Artificial Sequence
  chemically synthesized
agagggtaagtgaataagttat

SEQ ID NO: 1057679 - DNA, 22 bp, Artificial Sequence
  chemically synthesized
aaaaggaaataaataacttatt

SEQ ID NO: 1057680 - DNA, 22 bp, Artificial Sequence
  chemically synthesized
gagggtaagtgaataagttatt

SEQ ID NO: 1057681 - DNA, 22 bp, Artificial Sequence
  chemically synthesized
aaaaaggaaataaataacttat

SEQ ID NO: 1057682 - DNA, 22 bp, Artificial Sequence
  chemically synthesized
taaaaaggaaataaataactta

SEQ ID NO: 1057683 - DNA, 22 bp, Artificial Sequence
  chemically synthesized
aaacctttaaaaaggaaataaa

SEQ ID NO: 1057684 - DNA, 22 bp, Artificial Sequence
  chemically synthesized
ctcaaacctttaaaaaggaaat

SEQ ID NO: 1057685 - DNA, 22 bp, Artificial Sequence
  chemically synthesized
agttcctcaaacctttaaaaag

SEQ ID NO: 1057686 - DNA, 22 bp, Artificial Sequence
  chemically synthesized
ttgagttcctcaaacctttaaa

SEQ ID NO: 1057687 - DNA, 22 bp, Artificial Sequence
  chemically synthesized
tttatttcctttttaaaggttt

SEQ ID NO: 1057688 - DNA, 22 bp, Artificial Sequence
  chemically synthesized
tgttgagttcctcaaaccttta

SEQ ID NO: 1057689 - DNA, 22 bp, Artificial Sequence
  chemically synthesized
atttcctttttaaaggtttgag

SEQ ID NO: 1057690 - DNA, 22 bp, Artificial Sequence
  chemically synthesized
tctgttgagttcctcaaacctt

SEQ ID NO: 1057691 - DNA, 22 bp, Artificial Sequence
  chemically synthesized
tttcctttttaaaggtttgagg

SEQ ID NO: 1057692 - DNA, 22 bp, Artificial Sequence
  chemically synthesized
cctttttaaaggtttgaggaac

SEQ ID NO: 1057693 - DNA, 22 bp, Artificial Sequence
  chemically synthesized
attctctgttgagttcctcaaa

SEQ ID NO: 1057694 - DNA, 22 bp, Artificial Sequence
  chemically synthesized
ctttttaaaggtttgaggaact

SEQ ID NO: 1057695 - DNA, 22 bp, Artificial Sequence
  chemically synthesized
cattctctgttgagttcctcaa

SEQ ID NO: 1057696 - DNA, 22 bp, Artificial Sequence
  chemically synthesized
tttaaaggtttgaggaactcaa

SEQ ID NO: 1057697 - DNA, 22 bp, Artificial Sequence
  chemically synthesized
cttcattctctgttgagttcct

SEQ ID NO: 1057698 - DNA, 22 bp, Artificial Sequence
  chemically synthesized
ttaaaggtttgaggaactcaac

SEQ ID NO: 1057699 - DNA, 22 bp, Artificial Sequence
  chemically synthesized
gcttcattctctgttgagttcc

SEQ ID NO: 1057700 - DNA, 22 bp, Artificial Sequence
  chemically synthesized
taaaggtttgaggaactcaaca

SEQ ID NO: 1057701 - DNA, 22 bp, Artificial Sequence
  chemically synthesized
tgcttcattctctgttgagttc

SEQ ID NO: 1057702 - DNA, 22 bp, Artificial Sequence
  chemically synthesized
aaaggtttgaggaactcaacag

SEQ ID NO: 1057703 - DNA, 22 bp, Artificial Sequence
  chemically synthesized
aaggtttgaggaactcaacaga

SEQ ID NO: 1057704 - DNA, 22 bp, Artificial Sequence
  chemically synthesized
ttttgcttcattctctgttgag

SEQ ID NO: 1057705 - DNA, 22 bp, Artificial Sequence
  chemically synthesized
attttgcttcattctctgttga

SEQ ID NO: 1057706 - DNA, 22 bp, Artificial Sequence
  chemically synthesized
tattttgcttcattctctgttg

SEQ ID NO: 1057707 - DNA, 22 bp, Artificial Sequence
  chemically synthesized
ttattttgcttcattctctgtt

SEQ ID NO: 1057708 - DNA, 22 bp, Artificial Sequence
  chemically synthesized
tttattttgcttcattctctgt

SEQ ID NO: 1057709 - DNA, 22 bp, Artificial Sequence
  chemically synthesized
gaggaactcaacagagaatgaa

SEQ ID NO: 1057710 - DNA, 22 bp, Artificial Sequence
  chemically synthesized
aggaactcaacagagaatgaag

SEQ ID NO: 1057711 - DNA, 22 bp, Artificial Sequence
  chemically synthesized
cactttttattttgcttcattc

SEQ ID NO: 1057712 - DNA, 22 bp, Artificial Sequence
  chemically synthesized
acactttttattttgcttcatt

SEQ ID NO: 1057713 - DNA, 22 bp, Artificial Sequence
  chemically synthesized
tacactttttattttgcttcat

SEQ ID NO: 1057714 - DNA, 22 bp, Artificial Sequence
  chemically synthesized
ttttacactttttattttgctt

SEQ ID NO: 1057715 - DNA, 22 bp, Artificial Sequence
  chemically synthesized
aacagagaatgaagcaaaataa

SEQ ID NO: 1057716 - DNA, 22 bp, Artificial Sequence
  chemically synthesized
ttattttacactttttattttg

SEQ ID NO: 1057717 - DNA, 22 bp, Artificial Sequence
  chemically synthesized
ttattattttacactttttatt

SEQ ID NO: 1057718 - DNA, 22 bp, Artificial Sequence
  chemically synthesized
tgttattattttacacttttta

SEQ ID NO: 1057719 - DNA, 22 bp, Artificial Sequence
  chemically synthesized
ctgttattattttacacttttt

SEQ ID NO: 1057720 - DNA, 22 bp, Artificial Sequence
  chemically synthesized
tctgttattattttacactttt

SEQ ID NO: 1057721 - DNA, 22 bp, Artificial Sequence
  chemically synthesized
ttctgttattattttacacttt

SEQ ID NO: 1057722 - DNA, 22 bp, Artificial Sequence
  chemically synthesized
tttctgttattattttacactt

SEQ ID NO: 1057723 - DNA, 22 bp, Artificial Sequence
  chemically synthesized
ttttctgttattattttacact

SEQ ID NO: 1057724 - DNA, 22 bp, Artificial Sequence
  chemically synthesized
aatatgtttttttctgttatta

SEQ ID NO: 1057725 - DNA, 22 bp, Artificial Sequence
  chemically synthesized
tctaaatatgtttttttctgtt

SEQ ID NO: 1057726 - DNA, 22 bp, Artificial Sequence
  chemically synthesized
catattgtctaaatatgttttt

SEQ ID NO: 1057727 - DNA, 22 bp, Artificial Sequence
  chemically synthesized
gcatattgtctaaatatgtttt

SEQ ID NO: 1057728 - DNA, 22 bp, Artificial Sequence
  chemically synthesized
tttgcatattgtctaaatatgt

SEQ ID NO: 1057729 - DNA, 22 bp, Artificial Sequence
  chemically synthesized
atttgcatattgtctaaatatg

SEQ ID NO: 1057730 - DNA, 22 bp, Artificial Sequence
  chemically synthesized
tagatttatttgcatattgtct

SEQ ID NO: 1057731 - DNA, 22 bp, Artificial Sequence
  chemically synthesized
tatagatttatttgcatattgt

SEQ ID NO: 1057732 - DNA, 22 bp, Artificial Sequence
  chemically synthesized
tctatagatttatttgcatatt

SEQ ID NO: 1057733 - DNA, 22 bp, Artificial Sequence
  chemically synthesized
actctctatagatttatttgca

SEQ ID NO: 1057734 - DNA, 22 bp, Artificial Sequence
  chemically synthesized
agacaatatgcaaataaatcta

SEQ ID NO: 1057735 - DNA, 22 bp, Artificial Sequence
  chemically synthesized
gacaatatgcaaataaatctat

SEQ ID NO: 1057736 - DNA, 22 bp, Artificial Sequence
  chemically synthesized
acacatcagtgttcactctcta

SEQ ID NO: 1057737 - DNA, 22 bp, Artificial Sequence
  chemically synthesized
cacacatcagtgttcactctct

SEQ ID NO: 1057738 - DNA, 22 bp, Artificial Sequence
  chemically synthesized
tagagagtgaacactgatgtgt

SEQ ID NO: 1057739 - DNA, 22 bp, Artificial Sequence
  chemically synthesized
atcagagcatcttcacacatca

SEQ ID NO: 1057740 - DNA, 22 bp, Artificial Sequence
  chemically synthesized
catcagagcatcttcacacatc

SEQ ID NO: 1057741 - DNA, 22 bp, Artificial Sequence
  chemically synthesized
atttcatcagagcatcttcaca

SEQ ID NO: 1057742 - DNA, 22 bp, Artificial Sequence
  chemically synthesized
gcccattcatttcatcagagca

SEQ ID NO: 1057743 - DNA, 22 bp, Artificial Sequence
  chemically synthesized
atgtgtgaagatgctctgatga

SEQ ID NO: 1057744 - DNA, 22 bp, Artificial Sequence
  chemically synthesized
atgttagcccattcatttcatc

SEQ ID NO: 1057745 - DNA, 22 bp, Artificial Sequence
  chemically synthesized
ctcatgttagcccattcatttc

SEQ ID NO: 1057746 - DNA, 22 bp, Artificial Sequence
  chemically synthesized
actcatgttagcccattcattt

SEQ ID NO: 1057747 - DNA, 22 bp, Artificial Sequence
  chemically synthesized
ttactcatgttagcccattcat

SEQ ID NO: 1057748 - DNA, 22 bp, Artificial Sequence
  chemically synthesized
cttactcatgttagcccattca

SEQ ID NO: 1057749 - DNA, 22 bp, Artificial Sequence
  chemically synthesized
tgatgaaatgaatgggctaaca

SEQ ID NO: 1057750 - DNA, 22 bp, Artificial Sequence
  chemically synthesized
atgaaatgaatgggctaacatg

SEQ ID NO: 1057751 - DNA, 22 bp, Artificial Sequence
  chemically synthesized
tcggtatatggacgacttctta

SEQ ID NO: 1057752 - DNA, 22 bp, Artificial Sequence
  chemically synthesized
atcggtatatggacgacttctt

SEQ ID NO: 1057753 - DNA, 22 bp, Artificial Sequence
  chemically synthesized
acatgagtaagaagtcgtccat

SEQ ID NO: 1057754 - DNA, 22 bp, Artificial Sequence
  chemically synthesized
atgacttatcggtatatggacg

SEQ ID NO: 1057755 - DNA, 22 bp, Artificial Sequence
  chemically synthesized
cagatgaactaatgacttatcg

SEQ ID NO: 1057756 - DNA, 22 bp, Artificial Sequence
  chemically synthesized
ttccagatgaactaatgactta

SEQ ID NO: 1057757 - DNA, 22 bp, Artificial Sequence
  chemically synthesized
gttccagatgaactaatgactt

SEQ ID NO: 1057758 - DNA, 22 bp, Artificial Sequence
  chemically synthesized
tgttccagatgaactaatgact

SEQ ID NO: 1057759 - DNA, 22 bp, Artificial Sequence
  chemically synthesized
tgtatctttgttccagatgaac

SEQ ID NO: 1057760 - DNA, 22 bp, Artificial Sequence
  chemically synthesized
gtgtatctttgttccagatgaa

SEQ ID NO: 1057761 - DNA, 22 bp, Artificial Sequence
  chemically synthesized
tgtgtatctttgttccagatga

SEQ ID NO: 1057762 - DNA, 22 bp, Artificial Sequence
  chemically synthesized
actttgtgtatctttgttccag

SEQ ID NO: 1057763 - DNA, 22 bp, Artificial Sequence
  chemically synthesized
gttcatctggaacaaagataca

SEQ ID NO: 1057764 - DNA, 22 bp, Artificial Sequence
  chemically synthesized
taattgactttgtgtatctttg

SEQ ID NO: 1057765 - DNA, 22 bp, Artificial Sequence
  chemically synthesized
atctggaacaaagatacacaaa

SEQ ID NO: 1057766 - DNA, 22 bp, Artificial Sequence
  chemically synthesized
gaacaaagatacacaaagtcaa

SEQ ID NO: 1057767 - DNA, 22 bp, Artificial Sequence
  chemically synthesized
gtaaaattgtaattgactttgt

SEQ ID NO: 1057768 - DNA, 22 bp, Artificial Sequence
  chemically synthesized
tggtaaaattgtaattgacttt

SEQ ID NO: 1057769 - DNA, 22 bp, Artificial Sequence
  chemically synthesized
ctggtaaaattgtaattgactt

SEQ ID NO: 1057770 - DNA, 22 bp, Artificial Sequence
  chemically synthesized
tctggtaaaattgtaattgact

SEQ ID NO: 1057771 - DNA, 22 bp, Artificial Sequence
  chemically synthesized
agaaatgtgatgtgttttctgg

SEQ ID NO: 1057772 - DNA, 22 bp, Artificial Sequence
  chemically synthesized
aagaaatgtgatgtgttttctg

SEQ ID NO: 1057773 - DNA, 22 bp, Artificial Sequence
  chemically synthesized
caattttaccagaaaacacatc

SEQ ID NO: 1057774 - DNA, 22 bp, Artificial Sequence
  chemically synthesized
taccagaaaacacatcacattt

SEQ ID NO: 1057775 - DNA, 22 bp, Artificial Sequence
  chemically synthesized
accagaaaacacatcacatttc

SEQ ID NO: 1057776 - DNA, 22 bp, Artificial Sequence
  chemically synthesized
ccagaaaacacatcacatttct

SEQ ID NO: 1057777 - DNA, 22 bp, Artificial Sequence
  chemically synthesized
tgtaaagtgatttaagaaatgt

SEQ ID NO: 1057778 - DNA, 22 bp, Artificial Sequence
  chemically synthesized
gactatgtaaagtgatttaaga

SEQ ID NO: 1057779 - DNA, 22 bp, Artificial Sequence
  chemically synthesized
agactatgtaaagtgatttaag

SEQ ID NO: 1057780 - DNA, 22 bp, Artificial Sequence
  chemically synthesized
tagactatgtaaagtgatttaa

SEQ ID NO: 1057781 - DNA, 22 bp, Artificial Sequence
  chemically synthesized
cttaaatcactttacatagtct

SEQ ID NO: 1057782 - DNA, 22 bp, Artificial Sequence
  chemically synthesized
ttaaatcactttacatagtcta

SEQ ID NO: 1057783 - DNA, 22 bp, Artificial Sequence
  chemically synthesized
aaatcactttacatagtctaaa

SEQ ID NO: 1057784 - DNA, 22 bp, Artificial Sequence
  chemically synthesized
aatcactttacatagtctaaaa

SEQ ID NO: 1057785 - DNA, 22 bp, Artificial Sequence
  chemically synthesized
aatgaataaaatgttttagact

SEQ ID NO: 1057786 - DNA, 22 bp, Artificial Sequence
  chemically synthesized
tacatagtctaaaacattttat

SEQ ID NO: 1057787 - DNA, 22 bp, Artificial Sequence
  chemically synthesized
acatagtctaaaacattttatt

SEQ ID NO: 1057788 - DNA, 22 bp, Artificial Sequence
  chemically synthesized
catagtctaaaacattttattc

SEQ ID NO: 1057789 - DNA, 22 bp, Artificial Sequence
  chemically synthesized
acgtaatgttgaatgaataaaa

SEQ ID NO: 1057790 - DNA, 22 bp, Artificial Sequence
  chemically synthesized
aattgacgtaatgttgaatgaa

SEQ ID NO: 1057791 - DNA, 22 bp, Artificial Sequence
  chemically synthesized
aaacattttattcattcaacat

SEQ ID NO: 1057792 - DNA, 22 bp, Artificial Sequence
  chemically synthesized
ttcaattgacgtaatgttgaat

SEQ ID NO: 1057793 - DNA, 22 bp, Artificial Sequence
  chemically synthesized
tattcattcaacattacgtcaa

SEQ ID NO: 1057794 - DNA, 22 bp, Artificial Sequence
  chemically synthesized
agtgttattcaattgacgtaat

SEQ ID NO: 1057795 - DNA, 22 bp, Artificial Sequence
  chemically synthesized
attcattcaacattacgtcaat

SEQ ID NO: 1057796 - DNA, 22 bp, Artificial Sequence
  chemically synthesized
ttcattcaacattacgtcaatt

SEQ ID NO: 1057797 - DNA, 22 bp, Artificial Sequence
  chemically synthesized
attcaacattacgtcaattgaa

SEQ ID NO: 1057798 - DNA, 22 bp, Artificial Sequence
  chemically synthesized
tattaagtgttattcaattgac

SEQ ID NO: 1057799 - DNA, 22 bp, Artificial Sequence
  chemically synthesized
aacattacgtcaattgaataac

SEQ ID NO: 1057800 - DNA, 22 bp, Artificial Sequence
  chemically synthesized
cgtcaattgaataacacttaat

SEQ ID NO: 1057801 - DNA, 22 bp, Artificial Sequence
  chemically synthesized
agtaaatgtattgtattaagtg

SEQ ID NO: 1057802 - DNA, 22 bp, Artificial Sequence
  chemically synthesized
cagtaaatgtattgtattaagt

SEQ ID NO: 1057803 - DNA, 22 bp, Artificial Sequence
  chemically synthesized
tcagtaaatgtattgtattaag

SEQ ID NO: 1057804 - DNA, 22 bp, Artificial Sequence
  chemically synthesized
ttttcagtaaatgtattgtatt

SEQ ID NO: 1057805 - DNA, 22 bp, Artificial Sequence
  chemically synthesized
aataacacttaatacaatacat

SEQ ID NO: 1057806 - DNA, 22 bp, Artificial Sequence
  chemically synthesized
tgtgttgttttcagtaaatgta

SEQ ID NO: 1057807 - DNA, 22 bp, Artificial Sequence
  chemically synthesized
aatacaatacatttactgaaaa

SEQ ID NO: 1057808 - DNA, 22 bp, Artificial Sequence
  chemically synthesized
tattgtgtgttgttttcagtaa

SEQ ID NO: 1057809 - DNA, 22 bp, Artificial Sequence
  chemically synthesized
atacaatacatttactgaaaac

SEQ ID NO: 1057810 - DNA, 22 bp, Artificial Sequence
  chemically synthesized
gtattgtgtgttgttttcagta

SEQ ID NO: 1057811 - DNA, 22 bp, Artificial Sequence
  chemically synthesized
cttgtattgtgtgttgttttca

SEQ ID NO: 1057812 - DNA, 22 bp, Artificial Sequence
  chemically synthesized
ccttgtattgtgtgttgttttc

SEQ ID NO: 1057813 - DNA, 22 bp, Artificial Sequence
  chemically synthesized
atgcatttccttgtattgtgtg

SEQ ID NO: 1057814 - DNA, 22 bp, Artificial Sequence
  chemically synthesized
actgaaaacaacacacaataca

SEQ ID NO: 1057815 - DNA, 22 bp, Artificial Sequence
  chemically synthesized
gatgcatttccttgtattgtgt

SEQ ID NO: 1057816 - DNA, 22 bp, Artificial Sequence
  chemically synthesized
ctgaaaacaacacacaatacaa

SEQ ID NO: 1057817 - DNA, 22 bp, Artificial Sequence
  chemically synthesized
aaaacaacacacaatacaagga

SEQ ID NO: 1057818 - DNA, 22 bp, Artificial Sequence
  chemically synthesized
atttgatgcatttccttgtatt

SEQ ID NO: 1057819 - DNA, 22 bp, Artificial Sequence
  chemically synthesized
gatttgatgcatttccttgtat

SEQ ID NO: 1057820 - DNA, 22 bp, Artificial Sequence
  chemically synthesized
tgatttgatgcatttccttgta

SEQ ID NO: 1057821 - DNA, 22 bp, Artificial Sequence
  chemically synthesized
tttgatttgatgcatttccttg

SEQ ID NO: 1057822 - DNA, 22 bp, Artificial Sequence
  chemically synthesized
tctttgatttgatgcatttcct

SEQ ID NO: 1057823 - DNA, 22 bp, Artificial Sequence
  chemically synthesized
acgttctctttgatttgatgca

SEQ ID NO: 1057824 - DNA, 22 bp, Artificial Sequence
  chemically synthesized
ttaacgttctctttgatttgat

SEQ ID NO: 1057825 - DNA, 22 bp, Artificial Sequence
  chemically synthesized
tattaacgttctctttgatttg

SEQ ID NO: 1057826 - DNA, 22 bp, Artificial Sequence
  chemically synthesized
ctattaacgttctctttgattt

SEQ ID NO: 1057827 - DNA, 22 bp, Artificial Sequence
  chemically synthesized
tttctattaacgttctctttga

SEQ ID NO: 1057828 - DNA, 22 bp, Artificial Sequence
  chemically synthesized
gtttctattaacgttctctttg

SEQ ID NO: 1057829 - DNA, 22 bp, Artificial Sequence
  chemically synthesized
ttgtttctattaacgttctctt

SEQ ID NO: 1057830 - DNA, 22 bp, Artificial Sequence
  chemically synthesized
atgttcttgtttctattaacgt

SEQ ID NO: 1057831 - DNA, 22 bp, Artificial Sequence
  chemically synthesized
aaatgttgatgttcttgtttct

SEQ ID NO: 1057832 - DNA, 22 bp, Artificial Sequence
  chemically synthesized
aaaatgttgatgttcttgtttc
